United States Patent 7,795,419 (VIRAL AND VIRAL ASSOCIATED MIRNAS AND USES THEREOF) - sequence listing, part 10

SEQ ID NO: 272450 - RNA, 64 nt, Human
uccccacgcccccauauuggcaacacccccagcgccaccccaugcuccccaagaacgcggcucu

SEQ ID NO: 272451 - RNA, 64 nt, Human
acuugcuggagaucugagccggguggaaggucucccaccccagggcugcccugacagucucucu

SEQ ID NO: 272452 - RNA, 64 nt, Human
uagagcuguggcuaagggcaagccccuuccugccccaccccauuccuuauauucagcaagcaac

SEQ ID NO: 272453 - RNA, 64 nt, Human
ccuugacuuuaguguagugguggggucuuucccaccaccccacuaagccuuggcaaccucauuu

SEQ ID NO: 272454 - RNA, 64 nt, Human
uuugaugacauauuacccgcugacccagccccagccaccccauggacucaggacucaggucucc

SEQ ID NO: 272455 - RNA, 64 nt, Human
cagccucccaaguagcugagauuacaggcgccugccaccccaccuggcugauuuuuguaauuuu

SEQ ID NO: 272456 - RNA, 64 nt, Human
uuggauaugucucaagacacucaugugaaucaugccaccccaaauccuggcuuaucaaguccca

SEQ ID NO: 272457 - RNA, 64 nt, Human
uuguguaaauuuauuuauauuuauuguggcccauccaccccacuucugcaaacccaucccgagg

SEQ ID NO: 272458 - RNA, 64 nt, Human
gagcuguguccucuaggcugccagcucacagcccccaccccagggcccuguaagcugugcagug

SEQ ID NO: 272459 - RNA, 64 nt, Human
acacagggagcuagaaccccugcucccccuguccccaccccaggagaguaaggggacgagggcc

SEQ ID NO: 272460 - RNA, 64 nt, Human
ugagguuugauuggcacagcagcaaaaguugaggccaccccacuuguguccacuguuuuuagaa

SEQ ID NO: 272461 - RNA, 64 nt, Human
ucuccauccuccccagggguagaggcugggggcuccaccccagcccauguacguccccacgaac

SEQ ID NO: 272462 - RNA, 64 nt, Human
acuuagcuucccucucccucauucccggacccuuccaccccacugggcccaaccaugggcucag

SEQ ID NO: 272463 - RNA, 64 nt, Human
cccugcuuuuauuuauuuuggauuagccgguugcccaccccagcccucugguccaucccucccu

SEQ ID NO: 272464 - RNA, 64 nt, Human
acaggcugcagccuggcacccaccccucccaucuccaccccacauggaagacuugucuucaacu

SEQ ID NO: 272465 - RNA, 57 nt, Human
ggguggugcccggcauguaagccccgcccaccccacggaggccacagccacacagcc

SEQ ID NO: 272466 - RNA, 62 nt, Human
aguccccuuuccucuaacucacugccuaggaggcuggccaagguguccaggguccucuagcc

SEQ ID NO: 272467 - RNA, 62 nt, Human
gccgccaugagcaaccuggugccccccguggagcuggccaaccccgagaaccaguucagagu

SEQ ID NO: 272468 - RNA, 62 nt, Human
cugaccucccucaccaguggaggcuggguagugcuggccaucccaaaagggcucuguccugg

SEQ ID NO: 272469 - RNA, 64 nt, Human
gugugccaucuccaauauuucuauaguauaccaaccaccccaggaaugcacuuuaacaauauca

SEQ ID NO: 272470 - RNA, 64 nt, Human
acaagcccaagucauucuugauccaccccuucucccaccccagaucccagggacucauccugug

SEQ ID NO: 272471 - RNA, 64 nt, Human
uuuuuguuuaaaagagugcuuuugaaauaagcauccaccccaaauguugguuguauuuaugcug

SEQ ID NO: 272472 - RNA, 64 nt, Human
ccagugagaugggugcuguucuugagcagcuugaccaccccaacagggaucugggcagagaguc

SEQ ID NO: 272473 - RNA, 64 nt, Human
gaacugcaauaucacugagccugcgaucuauacaccaccccacauuuuguugguuucacagucu

SEQ ID NO: 272474 - RNA, 64 nt, Human
ugacgggucggggccucucucccucucccuguccccaccccagcgcagcagcccuccccgcagc

SEQ ID NO: 272475 - RNA, 64 nt, Human
gaguaccacaaaacaguguguccccagcagcuccccaccccagagccaaaugacaguagugcac

SEQ ID NO: 272476 - RNA, 64 nt, Human
ggaccuccugaaccgagagaacccagaggaacccccaccccacccccaccuaccacuccaugcu

SEQ ID NO: 272477 - RNA, 64 nt, Human
cugucugcguguuuaauuuuucccucucucaccuccaccccauccauauccucuuuauuuccuc

SEQ ID NO: 272478 - RNA, 64 nt, Human
cgcugacuccaccgaagaggugcgccacugggagccaccccagcgccaggcgcccguccaggga

SEQ ID NO: 272479 - RNA, 64 nt, Human
acacguacacacacugucuuagaguacugugagcccaccccacauuggucaucuucccuaucac

SEQ ID NO: 272480 - RNA, 64 nt, Human
cuccugccugcuccuguccagccaggucuaccacccaccccaccccucuucuccggcucccugc

SEQ ID NO: 272481 - RNA, 64 nt, Human
ccuugggauucacuagcccccagcccgccaaaccccaccccagcccuacacagcagucuggccu

SEQ ID NO: 272482 - RNA, 64 nt, Human
uucagguuggaagaagaaaaauagccucaaucucccaccccauguaggcacuaccuccccaauu

SEQ ID NO: 272483 - RNA, 64 nt, Human
gcucuuuugcccagagcguucccuguagccacccccaccccacuugcccuugguucuuuagaag

SEQ ID NO: 272484 - RNA, 64 nt, Human
uguucaauuaucugagguugucugggaccugccuccaccccauccagggaugagaauggcagcc

SEQ ID NO: 272485 - RNA, 62 nt, Human
cauggcccgggccuuauccagucaaagcggaugcuggccacagaaaggccacucaggauguc

SEQ ID NO: 272486 - RNA, 62 nt, Human
gugugagcauacgaggcugaugacugcccugugcuggccaaaagauuuuuauuuuaaaugaa

SEQ ID NO: 272487 - RNA, 62 nt, Human
ugugcaucaaccaggaagaguucuauccccaagcuggccacuaucacauaugcuuacucuug

SEQ ID NO: 272488 - RNA, 64 nt, Human
ccaggccaggcucccgaccccauccaccuauccaccaccccacccaccuuugcagggaauaccu

SEQ ID NO: 272489 - RNA, 64 nt, Human
gcuccucaggccauuccccaugagucccccacacccaccccauccucggucuuugcaaagaagg

SEQ ID NO: 272490 - RNA, 64 nt, Human
gcggguugacgacgguguccucgcagugucgccgccaccccagcguaguccaagucagacuauu

SEQ ID NO: 272491 - RNA, 64 nt, Human
aggcccagacucuggaggccuucacugaucccagccaccccagaaaagcugcagccugcaggca

SEQ ID NO: 272492 - RNA, 64 nt, Human
ggauggugucucccagcuuccccgcccagcuugcccaccccauaguuggugagaugccaaguuu

SEQ ID NO: 272493 - RNA, 64 nt, Human
cccucuuuccugccccuccccaucauaccugcacccaccccagccagggcucccuguccagaau

SEQ ID NO: 272494 - RNA, 64 nt, Human
ugaauacaaacaagcaacagcaacaaauccaccuccaccccaucucccccucauaucccugacc

SEQ ID NO: 272495 - RNA, 64 nt, Human
cucucugcauagccagauuugaagugacugauacccaccccaaaccuugcuguucacagucucc

SEQ ID NO: 272496 - RNA, 64 nt, Human
uucauucagaagacugguggcccacgugccaggaccaccccaccucucuugcugccuuuucucc

SEQ ID NO: 272497 - RNA, 64 nt, Human
cuaaagaccuccagcucagucccccaccuucaucccaccccacagaugauaaaauucagaccuc

SEQ ID NO: 272498 - RNA, 64 nt, Human
aggcugagcccggcgcagcaccugggcaguguccccaccccaggcccuccacauccuccucccu

SEQ ID NO: 272499 - RNA, 64 nt, Human
ucggcacugaguggcccagcaccgccuagcccugccaccccacugcccuccugggccuucugcu

SEQ ID NO: 272500 - RNA, 51 nt, Human
agaccccgcuguacaucuaggccaccccagccuggccacgcagccaggaca

SEQ ID NO: 272501 - RNA, 64 nt, Human
cauaguguguguguuuuguauacacuguaugaccccaccccaaaucuuuguauuguccacauuc

SEQ ID NO: 272502 - RNA, 52 nt, Human
agcagaccuccaccugcugagcccaccccaaguaugccugccaccuacgccc

SEQ ID NO: 272503 - RNA, 64 nt, Human
gccagggacccuguggcucugaucccccauuuauccaccccaugugccucaggacuagagugag

SEQ ID NO: 272504 - RNA, 62 nt, Human
ccuuaacuccuugcccuuugagaguguccauugcuggccauggucacuaaauuugaaguucc

SEQ ID NO: 272505 - RNA, 54 nt, Human; identical to SEQ ID NO: 50930

SEQ ID NO: 272506 - RNA, 62 nt, Human
cugccaguuccuuuauugaaagaggugugcuggcuggccacgguggcuuacaccuguaaucc

SEQ ID NO: 272507 - RNA, 64 nt, Human
uccuacagagugaaaugaaaacgggcugaaaauaccaccccaggagaggaccucgccccaagca

SEQ ID NO: 272508 - RNA, 64 nt, Human
accaggaggguuugguuagcucacaggacuucccccaccccagaagauuagcaucccauacuag

SEQ ID NO: 272509 - RNA, 64 nt, Human
caugggaggggacaaauaagggaauaaaaucuggccaccccagccagcagcagcaaccuguuca

SEQ ID NO: 272510 - RNA, 64 nt, Human
uguguauucaguuaaugacaccaaaaggcucagcccaccccaacccuaucucauguucagucug

SEQ ID NO: 272511 - RNA, 64 nt, Human
cagguggccuugccuggggagccccauguguggcccaccccaccaggccauccccauaccuucu

SEQ ID NO: 272512 - RNA, 64 nt, Human
uuggacugauucccaggcccugcugcucccauccccaccccagaucgaaugaacuuggcagaaa

SEQ ID NO: 272513 - RNA, 64 nt, Human
ucuggagacccccugccggcagccccuuucccugccaccccaggagccaggcuuccccucagcu

SEQ ID NO: 272514 - RNA, 64 nt, Human
uggcugaucuugggugucugaacagcuauuggguccaccccagucccuuucagcugcugcuuaa

SEQ ID NO: 272515 - RNA, 64 nt, Human
cuugucacuuuccuacccugauggucacacuagcccaccccaagcuccgacauugagguuuuca

SEQ ID NO: 272516 - RNA, 64 nt, Human
agguuuucaucucugcagggagagguuccaauguccaccccacccccagguacccgccucuucc

SEQ ID NO: 272517 - RNA, 64 nt, Human
ugugagaacaagaacugagggaaagcaccuucccccaccccagacguuuuuaucugaaugcaua

SEQ ID NO: 272518 - RNA, 64 nt, Human
cucugcugggugccuccuugccuugggaccauggccaccccagagccauccgaucgauggaugg

SEQ ID NO: 272519 - RNA, 64 nt, Human
ccuuccucagcucagcugggccacuccucuucacccaccccauggagacaauaaacagcugaac

SEQ ID NO: 272520 - RNA, 64 nt, Human
gucaguggagagagccaggggcuggagguggggcccaccccagccucuggucccagcucugcug

SEQ ID NO: 272521 - RNA, 64 nt, Human
uuugagcugaagugauccucucgucucuguuuccccaccccauuuguauuaauccuucauacaa

SEQ ID NO: 272522 - RNA, 64 nt, Human
aaagaaccaggguguccccgggacaggccgucccccaccccauccuguagaaguccauuccccu

SEQ ID NO: 272523 - RNA, 62 nt, Human
uuugagcagagagggaaagauuaauuuacacugcuggccaccgaaggcagguguuuccuggg

SEQ ID NO: 272524 - RNA, 62 nt, Human
aacuugcagcucugcuccucacaccaggcccggcuggccacccacccucgcccccacuggcc

SEQ ID NO: 272525 - RNA, 64 nt, Human
agaggcuccuggauuauagccugcacaaggagaggaccggcagcaaucgauuugccaagguugg

SEQ ID NO: 272526 - RNA, 64 nt, Human
gcauccacccagccugaggcucaagcugcccuuaccaccccaucccccacgcaggaccaacuac

SEQ ID NO: 272527 - RNA, 64 nt, Human
ucccaaaccacuuacuucccuguucaccucugccccaccccagcccagaggaguuugagccacc

SEQ ID NO: 272528 - RNA, 64 nt, Human
gcucaccccgggguggcccuggaggccccugaccccaccccacccacagagcacgagggccccg

SEQ ID NO: 272529 - RNA, 64 nt, Human
caucaucagaggacgccccgugcgcugucaccuuccaccccacaaggccaaccuuuuucugugg

SEQ ID NO: 272530 - RNA, 64 nt, Human
gccuggccaggagcaggcacgggugguccccguuccaccccaagagaacucgcgcucaguaaac

SEQ ID NO: 272531 - RNA, 64 nt, Human
ugaguccaucagcugccagccccggcccuggcccccaccccaaguucccugaagcauccuccag

SEQ ID NO: 272532 - RNA, 64 nt, Human
ccuccccgucgucaagccucuauccugucuguccccaccccagcuguccccugcccagggagcu

SEQ ID NO: 272533 - RNA, 64 nt, Human
ggggcagucaccgagugaccaccaagaggaagacccaccccacggcggggacagaugcggggua

SEQ ID NO: 272534 - RNA, 64 nt, Human
uagcggcuggcaggcacagaccagggcuccaaggccaccccaccaacgcaggccccagggucuc

SEQ ID NO: 272535 - RNA, 64 nt, Human
guagugacacucaggauccaaaagcuagcccugcccaccccagccccuggaccugcuuaccugg

SEQ ID NO: 272536 - RNA, 64 nt, Human
uuucguggcauuucuguggcucugcaguguuccuccaccccaggaccaauauguucaggccaca

SEQ ID NO: 272537 - RNA, 64 nt, Human
uggugauccuugucaggauguacaguccuugcucccaccccauccgggauggccgccugucccu

SEQ ID NO: 272538 - RNA, 64 nt, Human
cacucggaccgagcaucucccacgcaccucuaccccaccccaagcaccucucuccccccaugca

SEQ ID NO: 272539 - RNA, 64 nt, Human
uacccacugcucugguuaucuaauauguaacaagccaccccaaaucauaguggcuuaaaacaac

SEQ ID NO: 272540 - RNA, 64 nt, Human
ggcaggccacuucccucccagugccagucuccauccaccccagagaggaacaggcgggugggcc

SEQ ID NO: 272541 - RNA, 51 nt, Human
gaaccgaccaccucccaugacccaccccagcccccugaacccccuucaugg

SEQ ID NO: 272542 - RNA, 62 nt, Human
augccacaguggauacgccagcaggccacauggcuggccaagcaauuauuauuauggauccc

SEQ ID NO: 272543 - RNA, 62 nt, Human
uugcaggcggcuuggagaaagggcagugggacgcuggccacggccaggguggugucgggagc

SEQ ID NO: 272544 - RNA, 62 nt, Human
aaguguugacuuuguaaaucugcccacacccagcuggccauauccaccccucgacgccggga

SEQ ID NO: 272545 - RNA, 64 nt, Human
agucaccacuagggggugauggagaggaagggggccaccccagggccauuaacaaccaguacuc

SEQ ID NO: 272546 - RNA, 64 nt, Human
ccuaccugcacaucugccacagcuggcccugggcccaccccacgaagggccugggccuaacccc

SEQ ID NO: 272547 - RNA, 64 nt, Human
gagaauccccugccggggucccuggaaacagugcccaccccacaucacuacauucccucggccc

SEQ ID NO: 272548 - RNA, 64 nt, Human
cauggacccugggggcugugcccccaucuccuccccaccccaggucuaguggccccacccucca

SEQ ID NO: 272549 - RNA, 64 nt, Human
ccagagccagggagcccuuagccucaacucugccccaccccagccucuuccaggagagcacccu

SEQ ID NO: 272550 - RNA, 64 nt, Human
uuugucccgccgaguacuauguauuaccagccccccaccccacagaucaguuuuccuagucuuu

SEQ ID NO: 272551 - RNA, 64 nt, Human
uacaaccucgaccuccuggguucaagcgauucucccaccccagccucccaaguagcugggauua

SEQ ID NO: 272552 - RNA, 64 nt, Human
cugcaggcagccaggccacaagacccuuguggucccaccccacacacgccagauucuuuccuga

SEQ ID NO: 272553 - RNA, 64 nt, Human
cugagcgagcugggccgguuaguguaugucacccccaccccaccccuaaguagucaucaaugca

SEQ ID NO: 272554 - RNA, 64 nt, Human
cucgcuccccucugccggucccccaugccaccacccaccccaaacuuccagguuccauccacca

SEQ ID NO: 272555 - RNA, 64 nt, Human
agaugugucgccuccgccaguccgacugcccuccccaccccacccccgccaccccccacaugug

SEQ ID NO: 272556 - RNA, 64 nt, Human
acaaguaugggcaggaggcauggggcaggguggcccaccccagugggcaguagccuggccuuuu

SEQ ID NO: 272557 - RNA, 64 nt, Human
ggacacuccgucugcuccaaugacugagcagcauccaccccaccccaucuuugcugccagcucu

SEQ ID NO: 272558 - RNA, 64 nt, Human
cuccgucugcuccaaugacugagcagcauccaccccaccccaucuuugcugccagcucucagga

SEQ ID NO: 272559 - RNA, 64 nt, Human
ggaugaggcugcagagauggggaccagaagccccccaccccagcuuuccugggucugcauccca

SEQ ID NO: 272560 - RNA, 64 nt, Human
cugcuggggugcgcaggugggcgcucgcgucuccccaccccagggcuccccccgugcugaggcu

SEQ ID NO: 272561 - RNA, 61 nt, Human
uuuuuuuuuuuuuuaaucuacugacaaguugcucuaguaacccaaagaagugaaggagaaa

SEQ ID NO: 272562 - RNA, 61 nt, Human
aaucucgugcccucguuuuauggugcagcuucucuaguauuucuggggcuggggggcgggg

SEQ ID NO: 272563 - RNA, 61 nt, Human
ucauaaucuguuaacauuccaaaguguuuaacucuaguauuucguucucuucuucacaauu

SEQ ID NO: 272564 - RNA, 64 nt, Human
cuccuccagggcccaggugggcgggcuucuggccccaccccacagcgcuuggagcaucccuuug

SEQ ID NO: 272565 - RNA, 64 nt, Human
ugccucccagggucacuaggcgggcagcccacacccaccccagacggccaccacacugaggcca

SEQ ID NO: 272566 - RNA, 64 nt, Human
ggcccccucuccaggggcugugcaggcagcccauccaccccaguggaguucccacggacgcuuc

SEQ ID NO: 272567 - RNA, 64 nt, Human
gccucgaggccaagaugccuaaaaaagcuaaaggccaccccaccccccacccaccaccuccugc

SEQ ID NO: 272568 - RNA, 64 nt, Human
guguuuuggccaccuggggccgcccccaaccuccccaccccaagaggggucugagugggaccuc

SEQ ID NO: 272569 - RNA, 64 nt, Human
cccagcccccaccucugccuccaggucucaucuuccaccccaaaaaugucugucucucucuuuu

SEQ ID NO: 272570 - RNA, 64 nt, Human
cuucacauccagaaauucuguuggacacucacuuccaccccaaacuccucaaaucaaaagccuu

SEQ ID NO: 272571 - RNA, 64 nt, Human
agaagaacuuacuucugaaaugaagggaaaaaaaccaccccaucguucccuacuccuccccacc

SEQ ID NO: 272572 - RNA, 64 nt, Human
ccugugggcagagggacaggucagacacccaggcccaccccagagacccuccaugaacugugcu

SEQ ID NO: 272573 - RNA, 64 nt, Human
aacccaauguuuacauucucuucugucucugcccccaccccaugcagcgcuuugaggaauugga

SEQ ID NO: 272574 - RNA, 64 nt, Human
auccccaaggguuccucauguguuuucaccaaaaccaccccagugccugagauugaaaauauug

SEQ ID NO: 272575 - RNA, 64 nt, Human
accagcacaaagaucugaaugaugcaccccacccccaccccaauaaagaaauaacagaaaaccc

SEQ ID NO: 272576 - RNA, 64 nt, Human
ucgcaagaagagacagcgugaugccucccacaguccaccccagacccuggggcagccccucugg

SEQ ID NO: 272577 - RNA, 64 nt, Human
ugauagacugggucgugugugagacgcaugugcuccaccccacuccuuuugggggaagccaggc

SEQ ID NO: 272578 - RNA, 64 nt, Human
cggaucaucugugucugugcggaagacuacugccccaccccagaggccacaccccaggccgggc

SEQ ID NO: 272579 - RNA, 64 nt, Human
gccucucccugugucccacagggaguagcaagacccaccccacacugccuucaccaucuacacc

SEQ ID NO: 272580 - RNA, 61 nt, Human
gcaguaguguaaggcauuucauacuagucuccucuaguagaccugugacuuacuguguugg

SEQ ID NO: 272581 - RNA, 61 nt, Human
aauuauuaacuauauuuuacuaacuaaaaaacucuaguauucuuuaccuaaagucaauugg

SEQ ID NO: 272582 - RNA, 61 nt, Human
auuguggaauguuggauaaggaauuauagaccucuaguagcugaaaugcaagaccccaaga

SEQ ID NO: 272583 - RNA, 64 nt, Human
uguaccucuguguaucuguacagccucgcuccugccaccccacccuugcguucugcauuaggua

SEQ ID NO: 272584 - RNA, 64 nt, Human
ccccgggcacugcacagccugucugggggccagaccaccccauuguccauccuuguuguccgug

SEQ ID NO: 272585 - RNA, 64 nt, Human
guccccuguugccuauagcccuuuacccugagcaccaccccaacagacuggggaccagcccccu

SEQ ID NO: 272586 - RNA, 62 nt, Human
uccgcaucaacaaaaccugaggccccuuccucccaccccaucucucuccuguggaugcuccu

SEQ ID NO: 272587 - RNA, 64 nt, Human
gaaugucccugacccugccugaucccucccucacccaccccaaagguauuuuugauaacagagc

SEQ ID NO: 272588 - RNA, 64 nt, Human
aaaaugggggccuuauggggaaggcucugacacuccaccccagcucaggccaugggcagcaggg

SEQ ID NO: 272589 - RNA, 64 nt, Human
gugacugagccagggccugcauuuuugguuuuccccaccccacacauucucaaccauaguccuu

SEQ ID NO: 272590 - RNA, 64 nt, Human
ccuggacuuaauaccagccggauaccucuggcccccaccccauuacuguaccucuggagucacu

SEQ ID NO: 272591 - RNA, 64 nt, Human
ccccugggaaaaaacccaaagaaccaaaaacaaaccaccccaaggauaauaauagcuacacugc

SEQ ID NO: 272592 - RNA, 54 nt, Human
uuuugcagaggcugccguaguaauccaccccaacggccggaggagccgccggag

SEQ ID NO: 272593 - RNA, 64 nt, Human
gcucccggaaccggacggcacagggcguucuugcccaccccaggggccaggcuugcggaggggg

SEQ ID NO: 272594 - RNA, 64 nt, Human
acgacguggcacacauuccacgugggugcugccgccaccccagucggucguggcgugcagcugg

SEQ ID NO: 272595 - RNA, 64 nt, Human
cccuuuggccucuguuuguccccuuuccaguccuccaccccaccccuggagcccagccugggag

SEQ ID NO: 272596 - RNA, 64 nt, Human
agcugcacuacaugcaggaaucuccagggaccagccaccccaugcucagguuugacuauguccc

SEQ ID NO: 272597 - RNA, 64 nt, Human
ccaugcucaguccccucccaucccccacgcagcuccaccccagucccaagccaccagcugucug

SEQ ID NO: 272598 - RNA, 64 nt, Human
ccuaucucccauccuguggaacccgccccauuggccaccccaugcugcugcugccugggucucu

SEQ ID NO: 272599 - RNA, 61 nt, Human
uuugaauaacucccuugacgaaaacagacuccucuaguacuuggagaucuuggacguacac

SEQ ID NO: 272600 - RNA, 61 nt, Human
uuguagcugauuccuuaacuuucuuguaugccucuaguaauuucagagauuaaauauugcu

SEQ ID NO: 272601 - RNA, 61 nt, Human
uauacuauuugguaacauaauggauuaacaucucuaguaaucucuuuugcuaguggcuuug

SEQ ID NO: 272602 - RNA, 64 nt, Human
ggcuggggcacagccuggccaugcccaggaagacccaccccauucccacuccucugagcccgga

SEQ ID NO: 272603 - RNA, 64 nt, Human
cgccucccaucugcuccccaauucuugaucucucccaccccaucccucuccccagucuuggaua

SEQ ID NO: 272604 - RNA, 64 nt, Human
ugucugagaagugaggagccccuccgcccggcagccaccccaucugggaagugaggagcgucua

SEQ ID NO: 272605 - RNA, 64 nt, Human
cuacugggaagugaggagccccucugccuggccaccaccccaucugggaggugugcccagcagc

SEQ ID NO: 272606 - RNA, 64 nt, Human
ggcuagcauuguuugcacaaaaaguuggugauucccaccccaaauaguaauaaaauuacuucug

SEQ ID NO: 272607 - RNA, 64 nt, Human
gucuuugccuggugucuuccuuucccguguccgcccaccccagcgucuguugguacuuaccugu

SEQ ID NO: 272608 - RNA, 64 nt, Human
cccaacaccagucagcccuauacccuaacucacuccaccccauuuucuccggcugccuggccgg

SEQ ID NO: 272609 - RNA, 64 nt, Human
ggguauuuuguuuuuguucucaccugcugcccccccaccccaccaccccagggauaaauuggau

SEQ ID NO: 272610 - RNA, 64 nt, Human
uguuuuuguucucaccugcugcccccccaccccaccaccccagggauaaauuggauauaaacac

SEQ ID NO: 272611 - RNA, 64 nt, Human
auccuagaaccaagcuucagagccuagccaccucccaccccacuccagcccuguccccugaaaa

SEQ ID NO: 272612 - RNA, 64 nt, Human
cugcccucggucuucggcauugguucccuuugcuccaccccacucacagagacacagggcaucc

SEQ ID NO: 272613 - RNA, 64 nt, Human
cugcuuuuuccagauucuuccacuggcuccacauccaccccacuggaucuucagaaggcuagag

SEQ ID NO: 272614 - RNA, 64 nt, Human
agcuucacagggacgcuuccuucccuccccgcaaccaccccaggcuccccugggaggcugcagu

SEQ ID NO: 272615 - RNA, 64 nt, Human
acccugcaggccaggccagcuuccccucacuuaaccaccccauaccagucaccuccugcuccuu

SEQ ID NO: 272616 - RNA, 64 nt, Human
gcugagguggggagccuucuacggcgaaagccugccaccccacaaugaauccacccugcuccac

SEQ ID NO: 272617 - RNA, 64 nt, Human
guggccucaacccucccucagccccucuugccccccaccccagccuaagaugaagaggaucgga

SEQ ID NO: 272618 - RNA, 61 nt, Human
cuaagcccuaaucuguugacaucccuuggggcucuaguagaaggcagguauuuggcaauuu

SEQ ID NO: 272619 - RNA, 62 nt, Human
gccguggggacaucagagagugucaucacgcagcuggccagcugaguucuguuguuguuuuc

SEQ ID NO: 272620 - RNA, 62 nt, Human
agcucucccucccuacucccugggagccacgugcuggccauguggccagggacggcaugagc

SEQ ID NO: 272621 - RNA, 64 nt, Human
gccacagcccauccgcgugcugugugucccucuuccaccccaaccccugcuggcuccucuggga

SEQ ID NO: 272622 - RNA, 64 nt, Human
acacuugaauguagaauaggcagggggcccugccccaccccauccagccagaccccacgcugac

SEQ ID NO: 272623 - RNA, 64 nt, Human
cucccugcccccucccuggccuucuuccaccuauccaccccaaugccucucagcaaacugggcg

SEQ ID NO: 272624 - RNA, 64 nt, Human
cucuguuacucucagccuggaauccccaccuugcccaccccaguggaaaguaagcagugcccug

SEQ ID NO: 272625 - RNA, 64 nt, Human
uaguaacaugagcacugugauuggcuggcuauaaccaccccaguuaaaccauuuucauaauuag

SEQ ID NO: 272626 - RNA, 64 nt, Human
aguccgcacucugccacccuccugccccuuccacccaccccagcucuaugucugugucugaauu

SEQ ID NO: 272627 - RNA, 64 nt, Human
gccacccagugacuggcagggccgagccagcauuccaccccaccuuuuuccuucuccccaauua

SEQ ID NO: 272628 - RNA, 64 nt, Human
gcaccagcccugguaacugcaucuucuccccuugccaccccauggccccggcugaaagcuucgg

SEQ ID NO: 272629 - RNA, 64 nt, Human
uuacaggcaagcccugcuccugggagggcuccugccaccccacccuuccucuguguguuaucuc

SEQ ID NO: 272630 - RNA, 64 nt, Human
ccuauguaaggccuucuaguuuguucugagacccccaccccacgaaccaaauccaaauaaagug

SEQ ID NO: 272631 - RNA, 64 nt, Human
ccaguugcccuguccacuuacccuagguagccccccaccccaucagugccgaguccuugucccu

SEQ ID NO: 272632 - RNA, 64 nt, Human
ccaagucauuuccguccccccccaggcccucccaccaccccauuuuauuuuauaugauuuucuc

SEQ ID NO: 272633 - RNA, 64 nt, Human
guacauccauguguggcucugcuccaccccugugccaccccagagcccugggggguggucucca

SEQ ID NO: 272634 - RNA, 64 nt, Human
cggugucuccacggugcucucgcccugcccauggccaccccagacucugaucuccaggaacccc

SEQ ID NO: 272635 - RNA, 64 nt, Human
ggccgcacacggacauuccaaagaccuccagagaccaccccacccccacauuccuuugaccagc

SEQ ID NO: 272636 - RNA, 64 nt, Human
ccugaagcugacccucaccuccgagcccccacucccaccccagccgcacaguucccaccuccug

SEQ ID NO: 272637 - RNA, 61 nt, Human
ccuuuaaaacucauguuuuaaagaauaauaacucuaguaauaacucuuccugcuauucaga

SEQ ID NO: 272638 - RNA, 61 nt, Human
uuggaauuuggaggcaguaguugagcauauucucuaguauauagcuacaccuuuaauaaaa

SEQ ID NO: 272639 - RNA, 61 nt, Human
auacauuucuuugaaaagcaauucauucucucucuaguaauuguaauuaauccccccaaaa

SEQ ID NO: 272640 - RNA, 64 nt, Human
uggagaggcagaugagguuccugccuacugugugccaccccaagaagguagccccccaacagcc

SEQ ID NO: 272641 - RNA, 64 nt, Human
aacagcagcccugggcccccaccucuucuaccauccaccccagacuuaccacacacccuuccug

SEQ ID NO: 272642 - RNA, 64 nt, Human
ccaggucaccauccucagaggcugagcccuguacccaccccagcacagccaccuccgccagacc

SEQ ID NO: 272643 - RNA, 64 nt, Human
gaguuguaguucugggcccucgauuccuuucccaccaccccacaggcuuuacccuuugagaaaa

SEQ ID NO: 272644 - RNA, 64 nt, Human
ugccaaaccuaccuugcuuugggagcugccugcaccaccccagagaaggccccaccuucuucau

SEQ ID NO: 272645 - RNA, 64 nt, Human
gucccagaagaacuaccugaagcaccaaagcuccccaccccagccugguggcagaggaagcagg

SEQ ID NO: 272646 - RNA, 64 nt, Human
ucuucuagguuuucuuggcccagcacugcccaucccaccccaugaggcucacucauugcagauc

SEQ ID NO: 272647 - RNA, 64 nt, Human
uggccccugagccugggcagguggggacccaacuccaccccaccugucuucaucgugaggcugc

SEQ ID NO: 272648 - RNA, 64 nt, Human
agcucuuaccuccuccugguugcuuuucuugcccccaccccaaguuuauuuuuguuuucccccg

SEQ ID NO: 272649 - RNA, 64 nt, Human
ugaccaucagauuauaucuucaacaccacaccccccaccccaucgugggugaggguauccccug

SEQ ID NO: 272650 - RNA, 64 nt, Human
auauuaucccaguguccccugccccccucuucccccaccccaugcccccaauucuguggcgcau

SEQ ID NO: 272651 - RNA, 64 nt, Human
acacacacgcgcgcgcacacacacacacacacauccaccccagggccaagagaaaggccugcac

SEQ ID NO: 272652 - RNA, 64 nt, Human
aaguguguguguggaccauccgcaccuccagcccccaccccacccucuuugucucagcguguua

SEQ ID NO: 272653 - RNA, 64 nt, Human
gccauaggagcugggccacuccagacauuaauccccaccccaacagagccacuggcacaagugc

SEQ ID NO: 272654 - RNA, 64 nt, Human
agcucagggaggcucugcucagaguucggcggacccaccccaacccaacucccagccgccagcc

SEQ ID NO: 272655 - RNA, 64 nt, Human
caguuucaccccuccuccuguacccaacccauccccaccccauaugggagaugcuugcccaugu

SEQ ID NO: 272656 - RNA, 62 nt, Human
agcccacacugccagucgaggccuggcuggaggcuggccacaguggaaauucugccgagccu

SEQ ID NO: 272657 - RNA, 62 nt, Human
ccugcucugcugcauggggccccauggcuuuggcuggccacugaggguaggguguggaggug

SEQ ID NO: 272658 - RNA, 62 nt, Human
cuaggcugucccugcagccaggguguccgggggcuggccagucagagaaagggggccaugga

SEQ ID NO: 272659 - RNA, 64 nt, Human
uguaaccuccaccucccaggcucaagugauccucccaccccagccuccugaguagcugggacua

SEQ ID NO: 272660 - RNA, 64 nt, Human
cuuugaugaagugaugggcugcuucucugacuccccaccccagagucccacauucccugaggca

SEQ ID NO: 272661 - RNA, 64 nt, Human
ugccauuucuccccucucuuccuucaucuccaccccaccccacccuacucuccagacgcccuga

SEQ ID NO: 272662 - RNA, 64 nt, Human
acuccugccauuucuccccucucuuccuucaucuccaccccaccccacccuacucuccagacgc

SEQ ID NO: 272663 - RNA, 64 nt, Human
cucucauguggcagccacauguggcguugugaggccaccccauguggggucuguggugagaguc

SEQ ID NO: 272664 - RNA, 64 nt, Human
cuuggaggagcugggcucuaucccacacccacccccaccccacccccacccagccuccagaagc

SEQ ID NO: 272665 - RNA, 64 nt, Human
gcuggcaaaccaccugcuacaggaccaccugcugccaccccagcuauugcauuuccagcugcug

SEQ ID NO: 272666 - RNA, 64 nt, Human
ucagacuugauacacuuucagguugggaguggacccaccccagggccugcugaggacagagcag

SEQ ID NO: 272667 - RNA, 64 nt, Human
agagcgacagcgacugagccgcccccgcugccacccaccccauuccucgcuccuuccgaacuuc

SEQ ID NO: 272668 - RNA, 64 nt, Human
gugugaagugcgauuucugcuuuuguguaccccaccaccccauuaccacagcugccuuugugug

SEQ ID NO: 272669 - RNA, 64 nt, Human
guaaucauucacauguaaaaauaaccccaccuccccaccccaaaaagggcaagagcuguggaaa

SEQ ID NO: 272670 - RNA, 64 nt, Human
augacuaaggacugagcccccuacccaacuacccccaccccaaucccaccuucacccucuuccu

SEQ ID NO: 272671 - RNA, 64 nt, Human
cccagucaccaguucuccucuggacuggccacacccaccccauuccuggacuccucccaccucu

SEQ ID NO: 272672 - RNA, 64 nt, Human
ccucagacagucccucccacagucuacucugucuccaccccaaggucugguucugaaucauuca

SEQ ID NO: 272673 - RNA, 64 nt, Human
cuaucagacuaagccagcaccggaccagccuggcccaccccacccacuucugcacuugcgguuc

SEQ ID NO: 272674 - RNA, 59 nt, Human
cagacucugacuccaacugaggcucagccccaccccagggcagccagggagagcccagg

SEQ ID NO: 272675 - RNA, 64 nt, Human
ucuuaaaagaucuaguguccuuuuuguacacuaaacaggugaaugcugacuuuuuucauucucc

SEQ ID NO: 272676 - RNA, 64 nt, Human
uucggauuaguuaagauaaaagcauacauuguccacaggugagaagauuaaaucagaauaguug

SEQ ID NO: 272677 - RNA, 64 nt, Human
caguucuaaguuaggacguucuuggcuccguuagacaggugaggaaacuggggcacagagaggu

SEQ ID NO: 272678 - RNA, 64 nt, Human
cagccuggaggccgggugcucagggcugacacguccaccccagugcacccacucugcuuugacu

SEQ ID NO: 272679 - RNA, 64 nt, Human
ccccaguaagccacugccacacgucugacccucuccaccccauagugaccggcugcuuuucccu

SEQ ID NO: 272680 - RNA, 64 nt, Human
cugcuggcacauuuccccagaccugagcuccccaccaccccagcugcuccccucccuccucugu

SEQ ID NO: 272681 - RNA, 64 nt, Human
uaggacuguuuacugcccaccuccgccugccagcccaccccagccuggggagaggucgcggcgg

SEQ ID NO: 272682 - RNA, 64 nt, Human
agcuuguggucugaugggugaggcugacccaagcccaccccauugccaacagggccagggcaag

SEQ ID NO: 272683 - RNA, 64 nt, Human
ggcgaccccgguuccucuguguccucuuuacuccccaccccagugcgucucgccugcugagccc

SEQ ID NO: 272684 - RNA, 64 nt, Human
acugaucaucaaaaguucccacucccuacuucugccaccccaccaacgccuuggacuccucucu

SEQ ID NO: 272685 - RNA, 64 nt, Human
cccgaugauucuuaacacagccuuccuucugcucccaccccagaaaucacugugaaauuucaug

SEQ ID NO: 272686 - RNA, 64 nt, Human
gacacugggguaccccuccagauguggggacauuccaccccaguggggacagccauuccccuac

SEQ ID NO: 272687 - RNA, 64 nt, Human
ccacaggaacaucauuccucucccgcaaccacucccaccccagggaggcccuggccuccagugc

SEQ ID NO: 272688 - RNA, 64 nt, Human
gggagacggucuugccucucagccccucccugccccaccccagcuccugcccuggaaaucugga

SEQ ID NO: 272689 - RNA, 64 nt, Human
accgggagcucuuggcugcaucuucucccugcccccaccccacuaugaccuuugacccuacggc

SEQ ID NO: 272690 - RNA, 64 nt, Human
agggaagaguuugggcugccuccccuccucccguccaccccagaggggaaguuccucagccaga

SEQ ID NO: 272691 - RNA, 64 nt, Human
aaguagaccucagguagaacgacacugggcggagccaccccagggccugcucccagggagugcu

SEQ ID NO: 272692 - RNA, 64 nt, Human
ucucacccucagcuccgagggccgagggcuuuccccaccccacccuccuccuggccggcagucg

SEQ ID NO: 272693 - RNA, 64 nt, Human
gcgggcuggcgaaggaaauggucacaccccccgcccaccccaggcgaggauccuggugacaugc

SEQ ID NO: 272694 - RNA, 62 nt, Human
ccucgccccauccacuccggugccuccauuuagcuggccaaucagcccaggaggggcagguu

SEQ ID NO: 272695 - RNA, 53 nt, Human; identical to SEQ ID NO: 50908

SEQ ID NO: 272696 - RNA, 64 nt, Human
uccccgcagcagcgccuccucccggcgcccgagagaccggcacgccacggccccucccccaagg

SEQ ID NO: 272697 - RNA, 64 nt, Human
ggccuuuuggcuggucccgucccugaugucacccccaccccaccagccccuuucaucccuccuu

SEQ ID NO: 272698 - RNA, 64 nt, Human
cgcccccccaagagcccucgauggacagccucacccaccccaccugggcccagccaggagcccc

SEQ ID NO: 272699 - RNA, 64 nt, Human
ccaccggaggucacuccaccauccccaccccaccccaccccacccccgccaugcaacgggauug

SEQ ID NO: 272700 - RNA, 64 nt, Human
gccugccaccggaggucacuccaccauccccaccccaccccaccccacccccgccaugcaacgg

SEQ ID NO: 272701 - RNA, 64 nt, Human
cccccgccugccaccggaggucacuccaccauccccaccccaccccaccccacccccgccaugc

SEQ ID NO: 272702 - RNA, 64 nt, Human
cucaucaaacccacagacccggacucccuuucugccaccccaggcugguccggccccaggugug

SEQ ID NO: 272703 - RNA, 64 nt, Human
agaaucaggaucucuuucucauucaaggggggaaccaccccaggucagcgcugcgccugcugug

SEQ ID NO: 272704 - RNA, 64 nt, Human
auuccuuuccuuugaaugauagcugugauucaccccaccccauuuucuuguuucugguccaucc

SEQ ID NO: 272705 - RNA, 64 nt, Human
cagggcugcucaguucacaggaggcucccagcagccaccccacauccagccuacacagaacuuc

SEQ ID NO: 272706 - RNA, 64 nt, Human
uaagcaauaaauauggagugucaguagucuccuuccaccccagaaauguguugguguaacauuc

SEQ ID NO: 272707 - RNA, 64 nt, Human
ucuuuucuucauuucuuuccagaacaacucuuucccaccccaacaccacugccaccaccccucu

SEQ ID NO: 272708 - RNA, 64 nt, Human
uagcaggugcaacaaaaacaagaaacaaaugugcccaccccacuuuccgcuuaacugaaaagcu

SEQ ID NO: 272709 - RNA, 64 nt, Human
augaaauuaauaucuagacuugaccacuaucugcccaccccauuggcacucccaucuuagggca

SEQ ID NO: 272710 - RNA, 64 nt, Human
ccuuccucacaccagauuguucccaggggccugcccaccccagugccauccaguggcacggccg

SEQ ID NO: 272711 - RNA, 64 nt, Human
accgucugcaaggagcaagcaacgguggcccuguccaccccagcaaauaagaagcauaucugua

SEQ ID NO: 272712 - RNA, 64 nt, Human
aguuguauuuacuuguuucuguacucaccuacucccaccccaagggaaaauuuuagacaugaac

SEQ ID NO: 272713 - RNA, 61 nt, Human
gcuuugaccugcucagcccuguguguuaauccucuaguagccaauuaacuacucuggggug

SEQ ID NO: 272714 - RNA, 64 nt, Human
cauuggccucuugucccuuggcacacuuguacccacaggugaggggcaggaccugaagguauug

SEQ ID NO: 272715 - RNA, 64 nt, Human
gaaacuguaucaaagggggaagaaaauguauuuaacaggugaaucaaaucaggaaucuugucug

SEQ ID NO: 272716 - RNA, 64 nt, Human
guuggugggucuacaggagccucagccaggcagcccaccccacccuggggcccugccucaccaa

SEQ ID NO: 272717 - RNA, 64 nt, Human
ccaucaugugagccggcccccgagaccccggcccccaccccacaccacagacacccaccagccc

SEQ ID NO: 272718 - RNA, 64 nt, Human
uacagaugaggggaggggccgcagugcgcagaacccaccccaccccccagugcagacuucgggg

SEQ ID NO: 272719 - RNA, 64 nt, Human
cccaccccaccccccagugcagacuucggggucuccaccccaggccagcagcgcccacugggcu

SEQ ID NO: 272720 - RNA, 64 nt, Human
ggcgcgcgccuggucugucugauuccccuagccgccaccccacguuucuguaccgggucucugc

SEQ ID NO: 272721 - RNA, 64 nt, Human
ugcagcuucaacuuccugggcucaaguaauccucccaccccagccucccagguagcuaguacua

SEQ ID NO: 272722 - RNA, 64 nt, Human
gggcuucccauggucacccuggacaaggaggcaaccaccccaccuccccguaggagcagagagc

SEQ ID NO: 272723 - RNA, 64 nt, Human
cccccaguuccucccuagccuuccaucccucuguccaccccagggggagguaaccccgcacuca

SEQ ID NO: 272724 - RNA, 64 nt, Human
accaaaggguucaccucacacuugaauguacaacccaccccacugucgggaaggccuccguccu

SEQ ID NO: 272725 - RNA, 64 nt, Human
agcaaagcccccagagcccaggcucggccugcccccaccccauucccgcagugggagcaaacug

SEQ ID NO: 272726 - RNA, 64 nt, Human
aagggcuaacaucagcucauugucaaggccacccccaccccagaacagaaccgugucucugaua

SEQ ID NO: 272727 - RNA, 64 nt, Human
ccgaccaggagggggagagcagccuccacuuaccccaccccacccuugggcuaaaagcccccag

SEQ ID NO: 272728 - RNA, 64 nt, Human
ccgaggggcaccccagccccgccucugcucccccccaccccacccacccucggggcgccccccu

SEQ ID NO: 272729 - RNA, 64 nt, Human
gggggcuguugccccucccuccaucuccccacacccaccccaccccacagcagggcuccuggcc

SEQ ID NO: 272730 - RNA, 64 nt, Human
cuguugccccucccuccaucuccccacacccaccccaccccacagcagggcuccuggcccccac

SEQ ID NO: 272731 - RNA, 64 nt, Human
agucaccccuccucuccccccgccuccuggccugccaccccaccccagcguuuaccccaaagca

SEQ ID NO: 272732 - RNA, 61 nt, Human
ucagugcagagguccucagaggcuccagcaucucuaguacuaccugaaggcucuccuaacc

SEQ ID NO: 272733 - RNA, 64 nt, Human
ugcaagugcccugccaggcucuaaggcccgaagaacaggugauaucgggggcgcugcagagcug

SEQ ID NO: 272734 - RNA, 64 nt, Human
cuggccagggccccuguggcuuccugcacacuggacaggugacuguaugguagagacugugauc

SEQ ID NO: 272735 - RNA, 64 nt, Human
ccccuccucuccccccgccuccuggccugccaccccaccccagcguuuaccccaaagcacaaug

SEQ ID NO: 272736 - RNA, 64 nt, Human
augaguuugacagaugcauacaugcauguaaccaccaccccauuccagauauagaauguuucua

SEQ ID NO: 272737 - RNA, 64 nt, Human
agggucucccucgaugacgacgacgacgacgccaccaccccagcccccgucugugacugaaggc

SEQ ID NO: 272738 - RNA, 64 nt, Human
cacccccugcccuccugccggacccuggggccucccaccccagccucccugaggcccauacucc

SEQ ID NO: 272739 - RNA, 64 nt, Human
ccugucucucuccauguuggggguccuaacucccccaccccauaucuacguguccuccgggcau

SEQ ID NO: 272740 - RNA, 64 nt, Human
uuaugcaucccaugaagcccagauacacaaaauuccaccccaugaucaagaauccugcuccacu

SEQ ID NO: 272741 - RNA, 64 nt, Human
ugguagugccccugcccugggucccacuccugccccaccccacccuugucccuggccauugccu

SEQ ID NO: 272742 - RNA, 64 nt, Human
accaagcggaccuaauagacaucuacagaacucuccaccccaaauuaacagaauauacauuuuu

SEQ ID NO: 272743 - RNA, 50 nt, Human
gcgggccggaaauggcgugaccaccccauccuucuccaccaaagacaguu

SEQ ID NO: 272744 - RNA, 64 nt, Human
gccugcccgcccagagcuguggggaugaguguccccaccccagggccacuuagcugacaccagc

SEQ ID NO: 272745 - RNA, 64 nt, Human
cgccgggagcgcuccccggaaugagccgccccacccaccccaaggcuggagccgcugcacccug

SEQ ID NO: 272746 - RNA, 64 nt, Human
cccggggccuggaccuaugcagggaggccacgucccaccccaccucuuguuucugggucccugc

SEQ ID NO: 272747 - RNA, 64 nt, Human
ggauggugaagggggaccugguacccagugauccccaccccaggauccuaaaucaugacuuacc

SEQ ID NO: 272748 - RNA, 64 nt, Human
guucacagcagccgcagccaaacccggcugccucccaccccagccucaaaaccucuuccugacg

SEQ ID NO: 272749 - RNA, 64 nt, Human
uagccauaucucggccccuucccacucaccacccccaccccaggugcugggggucccuuauuuu

SEQ ID NO: 272750 - RNA, 64 nt, Human
cugccacuggggaaaacuccaccuucccacuuucccaccccacgccuuauccccacuugcagcc

SEQ ID NO: 272751 - RNA, 64 nt, Human
ccugcuguucuauuuccuuugaguguaaagacucacaggugaccugcuaucgagauagccagag

SEQ ID NO: 272752 - RNA, 64 nt, Human
gcggauuggggugauaaggggccuugcucugagcacaggugacagaucauaggaaguggcuggu

SEQ ID NO: 272753 - RNA, 64 nt, Human
uucuucugcuucagucucccaaguagcuuggauuacaggugagcacuaccacgcccggcuaauu

SEQ ID NO: 272754 - RNA, 64 nt, Human
cuuacugagucccucugggcagcagcucccuucuccaccccaccccagcacccgucccaaaugu

SEQ ID NO: 272755 - RNA, 64 nt, Human
ugagucccucugggcagcagcucccuucuccaccccaccccagcacccgucccaaauguggccu

SEQ ID NO: 272756 - RNA, 64 nt, Human
agcucaacccauaaccucaaccacaucuuauccuccaccccacaucccaccacauccaccucca

SEQ ID NO: 272757 - RNA, 64 nt, Human
gggucgggggggacauuggaaaggagggaccccgccaccccagcagcugaggaggggauucugg

SEQ ID NO: 272758 - RNA, 64 nt, Human
ggaugucucaccgggcugggggugagauauccccccaccccagggacuccccuucccucuggcu

SEQ ID NO: 272759 - RNA, 64 nt, Human
ccugaugaccccuauggccaacaucaacccggcaccaccccaaggcuggcuggggaacccuuca

SEQ ID NO: 272760 - RNA, 64 nt, Human
cuguucauuucaucuggcuccccccaccaccuccccaccccaccccccacccccugcuuccccu

SEQ ID NO: 272761 - RNA, 64 nt, Human
uggcuccagugcccucccucuguucccuggaccaccaccccacguagcugcucacaccagccuc

SEQ ID NO: 272762 - RNA, 64 nt, Human
uuccuggccucuuuggcagcuccacccuguccccccaccccacaaaggggggcuacgcagucac

SEQ ID NO: 272763 - RNA, 64 nt, Human
ugcucgcugggauucccacgcccaccacugucccccaccccauggcugggaggggccucugaac

SEQ ID NO: 272764 - RNA, 64 nt, Human
agucuguguguaugugucuuccccggaauccacaccaccccacccuccuccugucccgugguuu

SEQ ID NO: 272765 - RNA, 64 nt, Human
gcgggggcacggccuggcauuucacgcauugcugccaccccagguccaccugucuccacuuuca

SEQ ID NO: 272766 - RNA, 64 nt, Human
agaggggccagggaaguggaugucuccuccccucccaccccacccuguuguagccccuccuacc

SEQ ID NO: 272767 - RNA, 64 nt, Human
cgccugccgugcauggcuccugucuggcucggacccaccccaacucuccccagugccugccacu

SEQ ID NO: 272768 - RNA, 64 nt, Human
ccuccccagggagcaaagccauaaggggcaggggccaccccacggcaucuccccagaaguacag

SEQ ID NO: 272769 - RNA, 64 nt, Human
cuggggcccacucacacuacacccucuuccuuucccaccccaccuccccggagagaaacuggac

SEQ ID NO: 272770 - RNA, 61 nt, Human
ucuggccucugcccccuucucuagccacagccucuaguacacuuuagcaauaccaccagac

SEQ ID NO: 272771 - RNA, 61 nt, Human
acagcauguguagcaccaguugauaauuggucucuaguagcuuacugucaaaauguucaau

SEQ ID NO: 272772 - RNA, 61 nt, Human
uuuaaggcauacuuuuaccucaggaaacuuacucuaguauguucucauauauugaauucuc

SEQ ID NO: 272773 - RNA, 64 nt, Human
cccgcugggagacccacagagugugcaucagucaccaccccaacaugcucagggaggcagaguu

SEQ ID NO: 272774 - RNA, 64 nt, Human
uccgaaagaagcuaaaccuugcacaucccaacacccaccccagggagaguucccgugugugccu

SEQ ID NO: 272775 - RNA, 64 nt, Human
aucacugaguuuauccaccgccauccaccucuauccaccccauaaggucccuacagcaaguggg

SEQ ID NO: 272776 - RNA, 64 nt, Human
uaaggcuaugugugacacccuccugaggaccuccccaccccaguguaauggcccuucauggcag

SEQ ID NO: 272777 - RNA, 64 nt, Human
gcugcucaggagccagcacaggacaccccccaccccaccccaccauguccccauuacaccagag

SEQ ID NO: 272778 - RNA, 64 nt, Human
aggaugcugcucaggagccagcacaggacaccccccaccccaccccaccauguccccauuacac

SEQ ID NO: 272779 - RNA, 64 nt, Human
ugucaggcaggcagguggcaggcagcucacccacccaccccaugggaucccccagcccuucacc

SEQ ID NO: 272780 - RNA, 64 nt, Human
gggaacgagccaacaugugaccggcgagcgcgggccaccccacccuguucauuuccauaaacgu

SEQ ID NO: 272781 - RNA, 64 nt, Human
gccacuucgccgcugccccggagacuuuucaaucccaccccacuccucaucucaccauuugguc

SEQ ID NO: 272782 - RNA, 64 nt, Human
aggcaggggcuucuggggccaucuuggagucuguccaccccaacuccugacagcaucauccucu

SEQ ID NO: 272783 - RNA, 64 nt, Human
uucaccaugguacugucuccacagcccucaguccccaccccaggagaggcgccugccaccuccu

SEQ ID NO: 272784 - RNA, 64 nt, Human
caccuccagggccuuagaaccaccgccccucuccccaccccaggcaccccucuuuuuacucaaa

SEQ ID NO: 272785 - RNA, 64 nt, Human
gccuccaacccugccugcggccuccccccgucgcccaccccacgucuccuggccacugagacac

SEQ ID NO: 272786 - RNA, 64 nt, Human
gggccccggcccucccuggcuccccuuccccccaccaccccaucgcuggguuucggggcuuggu

SEQ ID NO: 272787 - RNA, 64 nt, Human
ucuggcacaagcugccaccaccagccacccacacccaccccagcacaccucacacgggaccaca

SEQ ID NO: 272788 - RNA, 64 nt, Human
ggucugucucaugcucucccuguuccucuccccgccaccccagggccuccaagccaccucugga

SEQ ID NO: 272789 - RNA, 59 nt, Human
cagaccuccauacuuuauaaguuguuggacucuaguaccaagaaacaacaacaaacgag

SEQ ID NO: 272790 - RNA, 61 nt, Human
gaaaauuuccaauuucuacuacguucaccaucucuaguaagaucugacauaugcugaaguu

SEQ ID NO: 272791 - RNA, 61 nt, Human
caaucuaaaaguguguuucaauugaguaucucucuaguagaauaggaguucauccugaaaa

SEQ ID NO: 272792 - RNA, 64 nt, Human
uucuggccucugagguugggggacuacuuguuucccaccccagguuccuccaggccaagucaug

SEQ ID NO: 272793 - RNA, 64 nt, Human
ugcuuuguccgucuauccacccgcccacccgcccccaccccaccggcagcguccaggugcgggg

SEQ ID NO: 272794 - RNA, 64 nt, Human
cagucugaggccagggacacaugaagggauguccccaccccagcacuaucagggccuccccagg

SEQ ID NO: 272795 - RNA, 64 nt, Human
aauucagcugacaggaggccucuauccugucccuccaccccacccuccaccucaauccccuccc

SEQ ID NO: 272796 - RNA, 64 nt, Human
ugacacccuccccugaccugacuagggggaggauccaccccaaccucugcccugcccgccccag

SEQ ID NO: 272797 - RNA, 64 nt, Human
ccacauccacuccaaggggacuauucccccgaccccaccccagucuccccacacggaccuuugc

SEQ ID NO: 272798 - RNA, 64 nt, Human
ccccgucuccucccuguucccguuccucccuggcccaccccacucacacuccccaaggcccacg

SEQ ID NO: 272799 - RNA, 64 nt, Human
aggccggagccccugggagcccucgcaccgcuccccaccccacucagcggccccaucggaacug

SEQ ID NO: 272800 - RNA, 64 nt, Human
gcccauagcaucccacaggcccaggcaggaggucccaccccagacccugccccagacgcucccu

SEQ ID NO: 272801 - RNA, 64 nt, Human
gugcccggggaucccccgccccauccuccugcccccaccccaggcugggcuguucacucucucg

SEQ ID NO: 272802 - RNA, 64 nt, Human
acauuccauaaauuagcugggugucccugcacgcccaccccaugaaacucgagcaggucucugg

SEQ ID NO: 272803 - RNA, 64 nt, Human
ggagaccacgcuucuccuccgugccgugcgacccccaccccaugacuauugugcgauucgugag

SEQ ID NO: 272804 - RNA, 64 nt, Human
gccccagcgucuucuccccagccccguccucccaccaccccagggggcaggcaggcaggccccc

SEQ ID NO: 272805 - RNA, 64 nt, Human
ucucguaauagaaaaguggggagccgcuggggagccaccccauucauccccguauuucccccuc

SEQ ID NO: 272806 - RNA, 64 nt, Human
agggccccagaguuccuugcaucuaauuucacccccaccccacccuccaggguuagggggagca

SEQ ID NO: 272807 - RNA, 64 nt, Human
ccccaaccuaaccagaccuggugccuugacgcccccaccccagcugggacgguacagagaaggg

SEQ ID NO: 272808 - RNA, 61 nt, Human
uggaaggcagaccugaaucacaacgggccagcucuaguaauacgaaggugaggucugggau

SEQ ID NO: 272809 - RNA, 61 nt, Human
aguaaauucuguugaaccaccuguguagucucucuaguaguuaaaacagcuauuuuaguaa

SEQ ID NO: 272810 - RNA, 61 nt, Human
guucuggguaagugaguuauaagaguacaugcucuaguaacucugguagucacugugacuc

SEQ ID NO: 272811 - RNA, 64 nt, Human
gccaggggucgggggaguguugggagccuccuccccaccccaccucccucacuucacugcauuc

SEQ ID NO: 272812 - RNA, 64 nt, Human
uucaccucuguaaguugaguccuccgccuccgggccaccccacucccuuccgcuugcagcuucc

SEQ ID NO: 272813 - RNA, 64 nt, Human
gagaggagugggguuuguugaugaaccuccacccccaccccacccccgcacgccuguaauccca

SEQ ID NO: 272814 - RNA, 64 nt, Human
cauggauaccacacauuucucaucucauuggcccccaccccagagaccuccaccucaacuucug

SEQ ID NO: 272815 - RNA, 64 nt, Human
uuccacgccucucccaccucccuccgcacacaccccaccccagccugcuauaggcugggcuucc

SEQ ID NO: 272816 - RNA, 64 nt, Human
cuagaacacccaacaccaaacuguacagacucucccaccccaaccuccccagacucugcacgga

SEQ ID NO: 272817 - RNA, 64 nt, Human
acccucaagaaacccccagugccuuguaugaagcccaccccacauggcccacagcuccugugcu

SEQ ID NO: 272818 - RNA, 64 nt, Human
aguagcagugccucccucaagggccuggguucuaccaccccacuccuagggaucucuugaaccu

SEQ ID NO: 272819 - RNA, 64 nt, Human
ugccccaaacucuuccccgggaagggggacagacccaccccagcccagggcccucacccaccuc

SEQ ID NO: 272820 - RNA, 64 nt, Human
ugcuuaggggcucuccugggccccacaccagugcccaccccaaaucuggucgucuccucccccc

SEQ ID NO: 272821 - RNA, 64 nt, Human
ucucuacaagugccugcuaucccucucccacuccccaccccagcaccgguccaaccccuucauc

SEQ ID NO: 272822 - RNA, 58 nt, Human
aagaggaauucuucaucugacccuauccccaccccaggccuaggccugggccugggcu

SEQ ID NO: 272823 - RNA, 64 nt, Human
cucccuggcaggguccucuucuuuucccagagcuccaccccaaccaggagcucuaguuaaugga

SEQ ID NO: 272824 - RNA, 64 nt, Human
cuccaaucugcguccacuuaggaggcccaacugcccaccccaaguccccaggggauggcccucc

SEQ ID NO: 272825 - RNA, 64 nt, Human
cuguuggugaccgucuauaucccuggggaaauuuccaccccaguccccuccccagggaaccacc

SEQ ID NO: 272826 - RNA, 64 nt, Human
uagacccugggcccuggagcuuaggggauucuccccaccccagccccacaccugcuccuucccu

SEQ ID NO: 272827 - RNA, 61 nt, Human
ccuuuucaccuuuucaggaaaauaacuuagacucuaguauuuauggguggauuuauccuuu

SEQ ID NO: 272828 - RNA, 64 nt, Human
uagggaagguggaggcacacuccucuucuguuggacaggugagcucugagggcaagcccugggc

SEQ ID NO: 272829 - RNA, 64 nt, Human
ucugaggcuggugacuccucccugcuggggccccacaggugaggcagaacagcuagagggccuc

SEQ ID NO: 272830 - RNA, 64 nt, Human
cauuucuacuuggggcccccuuccuaggacucucccaccccaaacuccaaccuguaucagaugc

SEQ ID NO: 272831 - RNA, 64 nt, Human
ugacccugacaugugacaucuaccucccgaccuaccaccccacuggcugguuccagaacgucuc

SEQ ID NO: 272832 - RNA, 64 nt, Human
gaauuuauuugugucagaaaauacuccagaacaaccaccccauauuaugauuagcucuuuuccu

SEQ ID NO: 272833 - RNA, 64 nt, Human
ucaacuuugagacuguagagucaggucccuaaguccaccccaggggcuggaaaccuggaguuca

SEQ ID NO: 272834 - RNA, 64 nt, Human
agcacguuguauacauguacugcaauauugcuguccaccccauaaauauguacaauucuguaua

SEQ ID NO: 272835 - RNA, 64 nt, Human
aagcuuccucugacgguuacccuccccccaccuuccaccccaaccaucugaaccauuccugucu

SEQ ID NO: 272836 - RNA, 53 nt, Human
ggcugcugccugcgcccugacucccaccccaagcccccggccaagccuggacu

SEQ ID NO: 272837 - RNA, 64 nt, Human
aacccacugggguagggaucaaagccagccacccccaccccaacacacucggugucccuuucau

SEQ ID NO: 272838 - RNA, 64 nt, Human
cacccucgaagcgcgccacucgcuucccccauagccaccccagaaauggugaaaauaaaauaaa

SEQ ID NO: 272839 - RNA, 64 nt, Human
ccaaggucagcuuaugaaggaccccacuugcaccccaccccagccauggaagagcagcuggagg

SEQ ID NO: 272840 - RNA, 64 nt, Human
gucauacucacuucuuuagccagccccauccccuccaccccacaccugaguucuugccuccucc

SEQ ID NO: 272841 - RNA, 64 nt, Human
ccucuucccucaucuccccccuccuuccucugccccaccccagcggggagcagacugcuccucc

SEQ ID NO: 272842 - RNA, 64 nt, Human
ugccaacaccugcuggucagaugucccccuacccccaccccacuguccuccaaggcuacaggac

SEQ ID NO: 272843 - RNA, 64 nt, Human
ugucucggcucccuccucccccuucccccuucccccaccccacacccuucacccucuguguccu

SEQ ID NO: 272844 - RNA, 51 nt, Human
ccaaggauaaagacgacuaggccaccccagcccccugacaccccagccccc

SEQ ID NO: 272845 - RNA, 64 nt, Human
uggaaggggagagguucucagcaucaggccaccuccaccccaaugccaggauagauguauucua

SEQ ID NO: 272846 - RNA, 61 nt, Human
caaaugucaugauagcuugcauaaauggugacucuaguagauuugacucaagcacuucuag

SEQ ID NO: 272847 - RNA, 61 nt, Human
cuguaguuuauuggaaucuguuaaugccuuccucuaguaguuaaagguuuaucaguauuuc

SEQ ID NO: 272848 - RNA, 61 nt, Human
uuagacuuaauagcaaagcauauuuauugaacucuaguagggcuauuuguugguaagcucu

SEQ ID NO: 272849 - RNA, 64 nt, Human
ggggagagcggggaagucucugcauccaugccacccaccccagucgggucucacuuuccugugc

SEQ ID NO: 272850 - RNA, 56 nt, Human
gccaagaagccaaccaauaaggccccccaccccaagcaggaaccccaggagaucaa

SEQ ID NO: 272851 - RNA, 64 nt, Human
caggacaaaggcugacagacucacugggaagcucccaccccacucaggggaccccacuccccuc

SEQ ID NO: 272852 - RNA, 64 nt, Human
cccauggauuguguugagugugcagacagggaggccaccccaauaggaauucgucuccaggauu

SEQ ID NO: 272853 - RNA, 64 nt, Human
ggaaggagagggaagcagcggccucggccaaggcccaccccauacucuuggcucuguagcauuu

SEQ ID NO: 272854 - RNA, 64 nt, Human
ccacagagggccgagggucacccgucggccgccgccaccccaggcgaggccggaggaaggauca

SEQ ID NO: 272855 - RNA, 64 nt, Human
cuugccuguuccgacuccaccugugcagccggggccaccccaggagaaaguguccagguggggg

SEQ ID NO: 272856 - RNA, 64 nt, Human
gaccuagcugugcccccaaccuagauuggcagcaccaccccagggcagaggacucucugggcac

SEQ ID NO: 272857 - RNA, 53 nt, Human
uuccagacuuugaugacuagcacccaccccauagcugaggaggagucacagug

SEQ ID NO: 272858 - RNA, 64 nt, Human
uaugucuacguggauuuuugguuuucagcuucccccaccccacuggcucuucuuaauuagaagu

SEQ ID NO: 272859 - RNA, 64 nt, Human
cagagacgcaagggagaagaaauccauaacacccccaccccaacacccccaagacagcagucuu

SEQ ID NO: 272860 - RNA, 64 nt, Human
augggagcugguuagaaaugcagaauccuaggcuccaccccauccaguucaugagaaucuauau

SEQ ID NO: 272861 - RNA, 64 nt, Human
agguuggcgucuuccuacgucccagaagcagcccccaccccacacaugacccacaccgcccuca

SEQ ID NO: 272862 - RNA, 64 nt, Human
ggcuccugaggggcaucugccccucccccaacccccaccccacacuuguuccagcucuuugaaa

SEQ ID NO: 272863 - RNA, 64 nt, Human
uguggcugcuggcugaggguucugcuguccugugccaccccauuaaagugcaguucccuccggg

SEQ ID NO: 272864 - RNA, 64 nt, Human
aucccuggcagaacacccagagugcccguggcucccaccccagggucuggccggugugcuggau

SEQ ID NO: 272865 - RNA, 61 nt, Human
ccaucuuaaaauuucaccuuaaguaaauggccucuaguagaugauaagccuaaaaaaagca

SEQ ID NO: 272866 - RNA, 61 nt, Human
cuuucuuaaauucuucuauucucagacacugcucuaguaccauuccuuccucuuagcccca

SEQ ID NO: 272867 - RNA, 61 nt, Human
augaguaauuuuuuuggcuucuucuccuccacucuaguauuuccacccucaguaaggaaug

SEQ ID NO: 272868 - RNA, 64 nt, Human
gccaacaccaccacccccagggggucuccccaccccaccccauuuacagggugagcucagccug

SEQ ID NO: 272869 - RNA, 64 nt, Human
ccggagccaacaccaccacccccagggggucuccccaccccaccccauuuacagggugagcuca

SEQ ID NO: 272870 - RNA, 64 nt, Human
agaaugcuggagggagcacgccgcugagaugcccccaccccagguuucccccaucagaguuaag

SEQ ID NO: 272871 - RNA, 64 nt, Human
ucugggacuagcagugaaucgggacacaaaccacccaccccauugggagaaaaacccagacgcc

SEQ ID NO: 272872 - RNA, 64 nt, Human
uuuaacauugugagccagcuagacccccagugcaccaccccauauugaaaaacaguugucuggc

SEQ ID NO: 272873 - RNA, 64 nt, Human
agcaagaaggcuggugagggaagggcucagcuucccaccccacguacagcaagggacuccccag

SEQ ID NO: 272874 - RNA, 64 nt, Human
ccaaagccaggggcccaccccgccccaccccaccccaccccacccucugaaaugugaaaagccu

SEQ ID NO: 272875 - RNA, 64 nt, Human
gcagcccaaagccaggggcccaccccgccccaccccaccccaccccacccucugaaaugugaaa

SEQ ID NO: 272876 - RNA, 64 nt, Human
ggagggcagcccaaagccaggggcccaccccgccccaccccaccccaccccacccucugaaaug

SEQ ID NO: 272877 - RNA, 64 nt, Human
ggucugguagcagccugucacuccagacuguccuccaccccagacuuccgcaaacugaugggcu

SEQ ID NO: 272878 - RNA, 64 nt, Human
uguguguggaaauggccaccaccauucuccuuccccaccccaccacaaaaagagaagcuguguc

SEQ ID NO: 272879 - RNA, 54 nt, Human
ucagauuuaaggaacagugacaccccaccccagucccguggagggggucugggc

SEQ ID NO: 272880 - RNA, 64 nt, Human
ucuuuauaagaacccuggucauugaauuuaaggcccaccccaaguccagaaugaccucgcaaga

SEQ ID NO: 272881 - RNA, 64 nt, Human
aaggcucagcuaucuguucaaacgucaccuguucccaccccagacccaaagagguugauucagu

SEQ ID NO: 272882 - RNA, 64 nt, Human
aacacagcaauaacugggcuuccuguccccacccccaccccagcagugcucucuggcacuggga

SEQ ID NO: 272883 - RNA, 64 nt, Human
accgcuaugccagccaguggacccucaaccgaccccaccccaccaucucagcacacacccucac

SEQ ID NO: 272884 - RNA, 61 nt, Human
ugugaaacugaaggacaguguuaaagcugggcucuaguauauugaugauuucugcauaagu

SEQ ID NO: 272885 - RNA, 61 nt, Human
aaaugaagcagaagcugggagucggccuuuccucuaguaaccaccacauggcucagcaucu

SEQ ID NO: 272886 - RNA, 61 nt, Human
uaaauaguauuuugucuaggagaugcuuucucucuaguaguuagaaauuaaaucuguguca

SEQ ID NO: 272887 - RNA, 64 nt, Human
ccaaggguauuacugguggaauaauauccgccccccaccccaguuucuaauuugcuguaggcug

SEQ ID NO: 272888 - RNA, 64 nt, Human
gaguggggguucucgccaauucccuaaugagauuccaccccaauaucaucaggcaccuuucccc

SEQ ID NO: 272889 - RNA, 64 nt, Human
guggcucccccggcccccaccacccucagcagccccaccccacucaacccugaggguccccagg

SEQ ID NO: 272890 - RNA, 64 nt, Human
cugaggcccaggacccaccccccugccaccccucccaccccacucccugcucaguaccuggcgu

SEQ ID NO: 272891 - RNA, 64 nt, Human
ggggguggccauuuagggaucguggggacgggguccaccccaagaagaaagaaaggcccgucca

SEQ ID NO: 272892 - RNA, 64 nt, Human
guccccgccuccuccgcugcccaaucucucagacccaccccaccugcaggcccagaccacgugg

SEQ ID NO: 272893 - RNA, 64 nt, Human
uccccaccaacuucucugccccagggacccgaggccaccccagccugguguggacccaucggcg

SEQ ID NO: 272894 - RNA, 64 nt, Human
agcccucaggcccucccugccaaacuggagaaccccaccccaaggcaugccacguccgcagccc

SEQ ID NO: 272895 - RNA, 64 nt, Human
uuggucccagggcggggcagggaauucuaaguguccaccccagggaggcaaggggcugcuuucc

SEQ ID NO: 272896 - RNA, 64 nt, Human
uauuauggaucccuugggcugugggccuucccauccaccccaccacaacugcccagguagcugg

SEQ ID NO: 272897 - RNA, 64 nt, Human
ucugguggguccccacuccuggggcccccuaaccccaccccaggcagcggaaggggcugacugg

SEQ ID NO: 272898 - RNA, 64 nt, Human
acacauuccauuuguugagccccaguccugccccccaccccacccucccuaccccuccccaguc

SEQ ID NO: 272899 - RNA, 64 nt, Human
cgggaacccgccgcacgcuguguucuaggcccgcccaccccaaccuucugguggggagaaauaa

SEQ ID NO: 272900 - RNA, 64 nt, Human
ggccuucuuugaagagcucuagcaggugacccagccaccccaggaccugccacuucuccugcua

SEQ ID NO: 272901 - RNA, 64 nt, Human
accagaggcccagcuaccaaggccacauuguccaccaccccagccuagagccuagaacuguagu

SEQ ID NO: 272902 - RNA, 64 nt, Human
uggccagccuggcccugcaggucucccaugaaggccaccccauggucugaugggcaugaagcau

SEQ ID NO: 272903 - RNA, 61 nt, Human
gacgagggcaagaaagcaacauugcugaucucucuaguaugaaagauuuggagggaguguu

SEQ ID NO: 272904 - RNA, 61 nt, Human
augaagagaacgcuggaaggcugcgagaggacucuaguaugagucuccaacauuuggaacg

SEQ ID NO: 272905 - RNA, 64 nt, Human
aauuguauugguuaauugacuguuuaaggccuuaacaggugaaucuagagccuacuuuuauuuu

SEQ ID NO: 272906 - RNA, 64 nt, Human
gcugcagugggaucuggcugcucugccuccuuucccaccccagcugaccaugagacuuugcuga

SEQ ID NO: 272907 - RNA, 64 nt, Human
ccuccuugagccuuaguccagggggucacuccucccaccccaccuaccucacaggguuguugug

SEQ ID NO: 272908 - RNA, 64 nt, Human
gucccaucgccugcagcaccuggagacccaccucccaccccagugcacucuuuugggccacaga

SEQ ID NO: 272909 - RNA, 64 nt, Human
ccaagggucccaccacagccagcgggcuggccucccaccccagcauccauacacguaggccugu

SEQ ID NO: 272910 - RNA, 64 nt, Human
gcuuuugucugaugcucugggauucuggccagacccaccccagggcacauguccugcgggggcg

SEQ ID NO: 272911 - RNA, 64 nt, Human
ccagccuuucgcgucaccuggaggccacaucuucccaccccaccugccagccccugucucuccu

SEQ ID NO: 272912 - RNA, 64 nt, Human
uuaggcuguaggggggugagaaggagagaagggaccaccccauucuucucaagcaaggauugcc

SEQ ID NO: 272913 - RNA, 64 nt, Human
gucugugcuuguggcuaugagcgugugccuccacccaccccacgacccgugacuacugugcaag

SEQ ID NO: 272914 - RNA, 64 nt, Human
gggcuucugguccaagcuguguugacugucauccccaccccaccccuaccucacgccugcccca

SEQ ID NO: 272915 - RNA, 64 nt, Human
cuggccucugcccacccuuugagcugcaccugccccaccccagcucauccaugugcuuguaccc

SEQ ID NO: 272916 - RNA, 64 nt, Human
ggcggagcggagagggcggccgugguggaggccuccaccccaggagcaccccgcgcacccucgg

SEQ ID NO: 272917 - RNA, 64 nt, Human
uccugugggagccccggccggcacccggcuggucccaccccaaauaccucagccauggagacca

SEQ ID NO: 272918 - RNA, 64 nt, Human
ggaggccagggaggggaacucagcaguucaggagccaccccaaaccauucugggacagggacac

SEQ ID NO: 272919 - RNA, 64 nt, Human
ccacagggacaagaggggcccccucgccccagccccaccccacauggagcucagggggaagcag

SEQ ID NO: 272920 - RNA, 64 nt, Human
cgcugcuagcgcaccccugcaguccagcgugcauccaccccacgcacgccccgugcuguguucc

SEQ ID NO: 272921 - RNA, 64 nt, Human
ucugcagcccagcucuguggcaggaggccugaccccaccccaucagucccucucccagcauugc

SEQ ID NO: 272922 - RNA, 61 nt, Human
cugccuuauaagugguuuagugcucaguuggcucuaguaaccagaggacacagaaaguauc

SEQ ID NO: 272923 - RNA, 61 nt, Human
gaccagccuagccaagauggugaaaccccgucucuaguaaagauaacaaaaaauuagcugg

SEQ ID NO: 272924 - RNA, 61 nt, Human
gaaauaaguugcaguauggucguacuuuuaacucuaguauccuuugcuugcuucuuacgcc

SEQ ID NO: 272925 - RNA, 64 nt, Human
ccaagccugacuuuggggacacccuccugcccccccaccccacuccccccauccuaccuaacuc

SEQ ID NO: 272926 - RNA, 64 nt, Human
ccugauggacgccugccgcccgccacccccaucuccaccccaucauguuuacaggguucggcgg

SEQ ID NO: 272927 - RNA, 64 nt, Human
gcgcgcagcucccucagcuucgcagcgccgcccgccaccccacaccucccacgcuaccgggcac

SEQ ID NO: 272928 - RNA, 64 nt, Human
gagccuggugcgccuaggcccucggaccccauccccaccccagccgggcccgcucaggaugccc

SEQ ID NO: 272929 - RNA, 64 nt, Human
agagaucucacagcugaacgugacugaacauuuuccaccccaagcagggccacucuaagaauug

SEQ ID NO: 272930 - RNA, 64 nt, Human
aacgccacuggccauguggaauccauggccuggaccaccccagaucccacauccccugacgaag

SEQ ID NO: 272931 - RNA, 64 nt, Human
gaccauccucaagaacugagaccccggccagcgcccaccccagccuucugcccgccccaucgag

SEQ ID NO: 272932 - RNA, 64 nt, Human
acugcuaggacaagcucagcuguugaggacacccccaccccaaauuucaguucuuacgugauuu

SEQ ID NO: 272933 - RNA, 64 nt, Human
cucccagcagggugaagaguccaagaagccagcaccaccccauccgcaucucaaguaagugcuu

SEQ ID NO: 272934 - RNA, 64 nt, Human
ucccucugcccugccucuccuucagcuccgaaccccaccccacucaguacauggccccccaaca

SEQ ID NO: 272935 - RNA, 64 nt, Human
aggcagaucacguugcaauggcucaaacaacauuccaccccagcaggacagugaccccaguccc

SEQ ID NO: 272936 - RNA, 64 nt, Human
cgcauguggaagcaucuacccguucacuccagucccaccccacgccugacuccccucuggaaac

SEQ ID NO: 272937 - RNA, 64 nt, Human
cccugggggcugggacuaaagaaaugggugucccccaccccaucagcugggaaagcccaggccg

SEQ ID NO: 272938 - RNA, 64 nt, Human
acuacucucuucaccccuuuauuccagcugccugccaccccagacccccaccucccacccugac

SEQ ID NO: 272939 - RNA, 64 nt, Human
uuccuuuaugcaacacccaaacaucuuggcauccccaccccaggaagugcggggaggagguuau

SEQ ID NO: 272940 - RNA, 64 nt, Human
aaaaaaauaauaauaaucuuaaagaugagaaaagccaccccaucuggcaccacagcugcaucuu

SEQ ID NO: 272941 - RNA, 61 nt, Human
ugacugacauacauacucaaauauaggcugucucuaguaaaucuuaaaaucuugaagcuaa

SEQ ID NO: 272942 - RNA, 61 nt, Human
gcuuuuauaucuguauguauuagugauauuucucuaguaguuaaaaaaaaaaaaaggaaaa

SEQ ID NO: 272943 - RNA, 61 nt, Human
agaugguaugaaguccucuuuggggcagggacucuaguagaucuucuugucagagaagcug

SEQ ID NO: 272944 - RNA, 64 nt, Human
gggggcccuccugcccgaagucauacucuugcucccaccccacccuugcccccagcccucucuc

SEQ ID NO: 272945 - RNA, 64 nt, Human
gcauuggaaggcccaaacccucucccuugaguggccaccccagccugguuggcugguuuucccc

SEQ ID NO: 272946 - RNA, 64 nt, Human
cuagugaaacuccuuucaucucuguccuauggccccaccccaccauucccucuaggcccagacc

SEQ ID NO: 272947 - RNA, 64 nt, Human
ccagcaccucagccugcucuucucucugguggcuccaccccaaccccuacuucuuuuccuuuau

SEQ ID NO: 272948 - RNA, 64 nt, Human
uuugcucauuuguaaaaugggcaggucaaucuucccaccccaccgugugggcugccccaacccc

SEQ ID NO: 272949 - RNA, 64 nt, Human
accuuucccuuuuccuugaguugugcugaaugccccaccccagcucucuuucccuucugggugu

SEQ ID NO: 272950 - RNA, 64 nt, Human
cacaugggcagcccaaagcugcaggugccagggcccaccccagccucgccugucacccccacuc

SEQ ID NO: 272951 - RNA, 64 nt, Human
gccuggggagccguuugggggcagccccuucugcccaccccauccuucuuccucuccagagaug

SEQ ID NO: 272952 - RNA, 64 nt, Human
uucuguuacacuguauaguaguccuauggcacccccaccccaucccuuucgugccacucccguc

SEQ ID NO: 272953 - RNA, 64 nt, Human
ccccaucccuuucgugccacucccguccccacccccaccccaguguguauaagcuggcauuucg

SEQ ID NO: 272954 - RNA, 64 nt, Human
cacaaaaucacaccauuuucaugccugucaauccccaccccaccacaaggcaggaagggggugg

SEQ ID NO: 272955 - RNA, 64 nt, Human
gucccugccaccuguaccaccaaugggccugcccccaccccaggaguuuggccgggggaaccca

SEQ ID NO: 272956 - RNA, 64 nt, Human
cugcaaauaacuccuccauugaaauaacuccuccccaccccaacaacaacauucccagcagacc

SEQ ID NO: 272957 - RNA, 64 nt, Human
ccacacccagugaagcauuggaaacccuauuuccccaccccagcucaugcccccuuucagaugu

SEQ ID NO: 272958 - RNA, 64 nt, Human
aguauucccugacuuggguuucacacuuuaucgaccaccccaugggguccuguguagccuuugg

SEQ ID NO: 272959 - RNA, 64 nt, Human
ccauccaccuccacacugccuccuggccagcugcccaccccagugccaggugggagagggagca

SEQ ID NO: 272960 - RNA, 61 nt, Human
uuuagagcacuugacuuuuuuuucucucucucucuaguauucuaaacugaccccaugacca

SEQ ID NO: 272961 - RNA, 61 nt, Human
caaauuuuaugguuuaucuccagcaacauuucucuaguacuugcacuuauuaucuuuuguc

SEQ ID NO: 272962 - RNA, 61 nt, Human
ccagaaaugaagguucaguuaugaggcaacccucuaguaaggcauuguaaaaguuacugga

SEQ ID NO: 272963 - RNA, 64 nt, Human
aaugggggaaugacacaucccccccaaccuacccccaccccaaaagcagcuccaacagaauggc

SEQ ID NO: 272964 - RNA, 64 nt, Human
ucacuccaccucaaagucauuugacugcccccauccaccccaccacccuaaucuuccaccaccu

SEQ ID NO: 272965 - RNA, 64 nt, Human
gcaccugccagggaggccaucuggggcuccuucuccaccccagcccccaaagcagcccuucccc

SEQ ID NO: 272966 - RNA, 64 nt, Human
ucuuuucuuccucauuuccuucuuuuauuccuccccaccccaaccccuuaaaaaaaaggucaga

SEQ ID NO: 272967 - RNA, 64 nt, Human
agaagccauuuuggaaauucacgaaaguacugcuccaccccaguugaguuauuuagaauuuuau

SEQ ID NO: 272968 - RNA, 64 nt, Human
uagaguaacuucugaggcuuuuugagaauaaaauccaccccacccuuguuuccccuugguauuu

SEQ ID NO: 272969 - RNA, 64 nt, Human
uuuaaagaaguaugggaaaugagaggcauuucccccaccccauuucucuccucacacacagacu

SEQ ID NO: 272970 - RNA, 64 nt, Human
gcauuucaauuucaaugguguuggcuuccccuccccaccccacgcgugcauaaaaacugguucu

SEQ ID NO: 272971 - RNA, 64 nt, Human
ggcccugcagggggaggggugacagggcgagcccccaccccagcagcagcaauacccccacccu

SEQ ID NO: 272972 - RNA, 64 nt, Human
aggcuuauccccucucaucuuccuccccuaaaccccaccccaguuuaggagauuaucaagcugg

SEQ ID NO: 272973 - RNA, 64 nt, Human
ugcacccaucagccaacacuccccaacccaucggccaccccaagcccucugcaaccacgaaucg

SEQ ID NO: 272974 - RNA, 64 nt, Human
cugcguccauaaggguccugcacguugccucccaccaccccagcucugccagaauaaaauuguu

SEQ ID NO: 272975 - RNA, 64 nt, Human
guggggaaguagccaggaaaugagaaacuuccucccaccccagacauuuuuccuggugggagcu

SEQ ID NO: 272976 - RNA, 64 nt, Human
auuuuuuuauugcuccgcauacugagaaucuaggccaccccaaccucuguuccccacccaguuc

SEQ ID NO: 272977 - RNA, 64 nt, Human
gccccugggaucuguacccaggaccuggagaauaccaccccacccccagcccauaauugggacc

SEQ ID NO: 272978 - RNA, 64 nt, Human
cccccagucaccauugucaccacacucacccaucccaccccaccccuccuauccaccccucccc

SEQ ID NO: 272979 - RNA, 61 nt, Human
uauauaacuuagugcuagcuagcgccacagacucuaguagauaauauuaucaucauaaugg

SEQ ID NO: 272980 - RNA, 61 nt, Human
uucuaccucuggggauaaggauucacauucgcucuaguacgaugggcucuuucaccccacu

SEQ ID NO: 272981 - RNA, 61 nt, Human
aauucuuggggcugagcugggagcccggcaacucuaguauuuaggauaaccuugugccuug

SEQ ID NO: 272982 - RNA, 64 nt, Human
ccaaggaccgggcccugccccgccacccuaccucccaccccagcagcccucucuucccccaccu

SEQ ID NO: 272983 - RNA, 64 nt, Human
accuucucuccccuuuccaugccguccaugauccccaccccauguguuuuaaaaaggcaguagc

SEQ ID NO: 272984 - RNA, 64 nt, Human
aagaccuagaggguuugggacaaacugggagcccccaccccacacucuaguugcccaugucuga

SEQ ID NO: 272985 - RNA, 64 nt, Human
ccuaaauuucccuuuggcucaugucccccccgccccaccccaccuucuccuuuuuggcaugucu

SEQ ID NO: 272986 - RNA, 64 nt, Human
aaaugccaccuccuccaugaagccuucccuaauuccaccccaaacccccaccuucaacaauauu

SEQ ID NO: 272987 - RNA, 64 nt, Human
gucuccuguaucccagucacuaguccucccugguccaccccacccucauccucaggagccacag

SEQ ID NO: 272988 - RNA, 64 nt, Human
cacagucaccuugcagucaggcuggaaucuugggccaccccaaagugcuuugcugaaggauuua

SEQ ID NO: 272989 - RNA, 64 nt, Human
guaaaaugccagacaugucccagcccgaacucccccaccccauggccuggagguuucuagaugg

SEQ ID NO: 272990 - RNA, 64 nt, Human
ccuugagcagucaccucucauuuucucccagugcccaccccauccccgagccccuggcaaccac

SEQ ID NO: 272991 - RNA, 64 nt, Human
cuuaaacuuggccaauuuggaaagggggaaggagccaccccaaaacggugguucagcuuguaga

SEQ ID NO: 272992 - RNA, 64 nt, Human
acucuggcagcaccgccucuucccgccgcccagcccaccccauggccggcuuucaggagcucca

SEQ ID NO: 272993 - RNA, 64 nt, Human
gaggcugggggaucugcuuggaguuuucugccccccaccccaaacuucugucgaggagcaaggc

SEQ ID NO: 272994 - RNA, 64 nt, Human
uacagcaaugcggagugggauagggauaaaauacccaccccaaaaugaccuuggccaccugucu

SEQ ID NO: 272995 - RNA, 64 nt, Human
guuuggauuaaacucuuccccuccugcuuuagugccaccccaaacugcauuuauaauuuuguga

SEQ ID NO: 272996 - RNA, 61 nt, Human
aauuguagacuaaaaccacucuuagcaucuccucuaguauuuuccauguaucaggacagag

SEQ ID NO: 272997 - RNA, 61 nt, Human
agugacuacagguuuucuuuacaaccauggccucuaguauacuuaaaauaagcguccaguu

SEQ ID NO: 272998 - RNA, 61 nt, Human
uuugaaagaugaaaauuaguaucaaacagcucucuaguagaauuucauuauuuuucaccag

SEQ ID NO: 272999 - RNA, 64 nt, Human
ucagccacgcccuggggaggauccacuggaucaccgccgucacugccuguucccggcggccucu

SEQ ID NO: 273000 - RNA, 64 nt, Human
gacgaggccuccugcggacaccagcuccucucuccgccgucaccggggaggccggggauccuug

SEQ ID NO: 273001 - RNA, 64 nt, Human
cugcaggcagcuucccccccaugccagggcucugcgccgucaugugagacuuaaaaaaaaaguu

SEQ ID NO: 273002 - RNA, 64 nt, Human
auggaaugauugaggaggucuggucacccucaagcgccgucaucgccuuguuuccaugggcuuc

SEQ ID NO: 273003 - RNA, 64 nt, Human
ugggcucuuggccguggcauuuccguggacagcccgccgucaggguggcuggggcuggcacggg

SEQ ID NO: 273004 - RNA, 64 nt, Human
ggccucccguugucaugccuuacgguuuccaaugcgccgucaccaucuccaccugccaccaaac

SEQ ID NO: 273005 - RNA, 64 nt, Human
auuggcuguguauuguccauugauuccugauugacgccgucaaaaacaaaugcuuguuaagccc

SEQ ID NO: 273006 - RNA, 64 nt, Human
gugcuaggaggcugccgccuccgccagcgccugucgccgucacucuccacccagccaguaccuc

SEQ ID NO: 273007 - RNA, 64 nt, Human
gagcggauggagaagcagcagguucgagucuccacgccgucagcugagaagagugagggugagc

SEQ ID NO: 273008 - RNA, 64 nt, Human
cagacgccuccauuggcaacgugacgggcagcaacgccgucaaugucuuccugggcaucggccu

SEQ ID NO: 273009 - RNA, 64 nt, Human
ccuaacuugcucugcaugcugucagcggcugccccgccgucauagacuuaaaggacugcaauaa

SEQ ID NO: 273010 - RNA, 64 nt, Human
gggucugauggggagcuccgucucaccggccacccgccgucaccauggcagaugcccuuggccg

SEQ ID NO: 273011 - RNA, 64 nt, Human
gaaccuguguuucacgugacucagcagugcccgccgccgucaccagcuaugcauucacuccguu

SEQ ID NO: 273012 - RNA, 61 nt, Human
gcacucaacucugagcccauacuuuuggcuccucuaguaagaugcacugaaaacuuagcca

SEQ ID NO: 273013 - RNA, 61 nt, Human
cuugaacuucuuacuggaacaauguuugauacucuaguauguaagcuguauuuauguaaua

SEQ ID NO: 273014 - RNA, 61 nt, Human
aaaaugaccuaaacuuuugagauagauuuggcucuaguaaguauuuaguuauaucacuugc

SEQ ID NO: 273015 - RNA, 61 nt, Human
gcggcgguggggcugggugccguguuacuaacucuaguauguuucugugucaaucgcugug

SEQ ID NO: 273016 - RNA, 61 nt, Human
ucggagagccuggggagggugccaaccccaccucuaguauuuugggagauagggaaaguga

SEQ ID NO: 273017 - RNA, 61 nt, Human
caaaacaaucaaaacaaaaaagaccuguggacucuaguagauuuugaauccugccucugcc

SEQ ID NO: 273018 - RNA, 61 nt, Human
gagcaaaacuuuuuaguacgcguauauaucccucuaguaaucacaacauuuuaggauuuag

SEQ ID NO: 273019 - RNA, 61 nt, Human
cagcaaauacagaggugguuuaaucaaacagcucuaguaugaagcaagaguaaagacuaag

SEQ ID NO: 273020 - RNA, 61 nt, Human
gcauuuauaaauccaagucugaaacucugcgcucuaguacugcuguuaagauacacaacuu

SEQ ID NO: 273021 - RNA, 61 nt, Human
cuuuuauuugugauauuuucagagacauuugcucuaguaugguguauuuaaauaauaaaaa

SEQ ID NO: 273022 - RNA, 61 nt, Human
caauuuuuuuaauguagccauuugggguuaucucuaguaaggcagauacccacguugguaa

SEQ ID NO: 273023 - RNA, 61 nt, Human
uuuucccccaaggggggaaauuuuacuuaaccucuaguauuugaacaacucaauauuugaa

SEQ ID NO: 273024 - RNA, 61 nt, Human
uauuuuucaccugagagaggaagagaaauuucucuaguaacacaaagagugaguucuaaaa

SEQ ID NO: 273025 - RNA, 61 nt, Human
aagucucaaauaaugccuuuuuaauuguauccucuaguauuauagauauaggacaguacug

SEQ ID NO: 273026 - RNA, 61 nt, Human
aggagaugccaauguugaaugaagucugaaacucuaguaugugcauaguuugacgugcagc

SEQ ID NO: 273027 - RNA, 61 nt, Human
caagugguaguagagugguuuaacgucuuuccucuaguacuaccaguauucauaaauguau

SEQ ID NO: 273028 - RNA, 61 nt, Human
acucuacaauccuuuccucgaccaacgcaaccucuaguaccuuuccagccgaaaacaggag

SEQ ID NO: 273029 - RNA, 61 nt, Human
guuugaacccgaaauaaggguucuuugguaccucuaguagauaguguguucauuucccugc

SEQ ID NO: 273030 - RNA, 61 nt, Human
auaccuucaggcaacacagcccaguuuuaaccucuaguauccaugaccaaacuaucccuga

SEQ ID NO: 273031 - RNA, 61 nt, Human
cgugaguaaauaaugcagcucagaugcugagcucuaguaggaaaugcuggcaugcugauua

SEQ ID NO: 273032 - RNA, 61 nt, Human
ugguccuguuuuuggguaggugacacguggacucuaguauguaaauguuacuugaaucugu

SEQ ID NO: 273033 - RNA, 61 nt, Human
gaccauccuggcaaacauggugaaaccccaucucuaguaaaaauacaaaaauuagcugggc

SEQ ID NO: 273034 - RNA, 64 nt, Human; identical to SEQ ID NO: 76682

SEQ ID NO: 273035 - RNA, 64 nt, Human; identical to SEQ ID NO: 76683

SEQ ID NO: 273036 - RNA, 64 nt, Human; identical to SEQ ID NO: 76684

SEQ ID NO: 273037 - RNA, 64 nt, Human; identical to SEQ ID NO: 76685

SEQ ID NO: 273038 - RNA, 64 nt, Human; identical to SEQ ID NO: 76686

SEQ ID NO: 273039 - RNA, 64 nt, Human; identical to SEQ ID NO: 76687

SEQ ID NO: 273040 - RNA, 64 nt, Human; identical to SEQ ID NO: 76688

SEQ ID NO: 273041 - RNA, 64 nt, Human; identical to SEQ ID NO: 76689

SEQ ID NO: 273042 - RNA, 64 nt, Human; identical to SEQ ID NO: 76690

SEQ ID NO: 273043 - RNA, 64 nt, Human; identical to SEQ ID NO: 76691

SEQ ID NO: 273044 - RNA, 64 nt, Human; identical to SEQ ID NO: 76692

SEQ ID NO: 273045 - RNA, 64 nt, Human; identical to SEQ ID NO: 76693

SEQ ID NO: 273046 - RNA, 64 nt, Human; identical to SEQ ID NO: 76694

SEQ ID NO: 273047 - RNA, 62 nt, Human; identical to SEQ ID NO: 76695

SEQ ID NO: 273048 - RNA, 64 nt, Human; identical to SEQ ID NO: 76696

SEQ ID NO: 273049 - RNA, 64 nt, Human; identical to SEQ ID NO: 76697

SEQ ID NO: 273050 - RNA, 64 nt, Human
cugccccauauucuugccgugucuuggaaaagucacaggugacagcccuccugaggcccacacu

SEQ ID NO: 273051 - RNA, 64 nt, Human
auuuacgaugaauuucuugugagcagaggacgaaacaggugaauucucaccagacucaaaccag

SEQ ID NO: 273052 - RNA, 62 nt, Human
cggggagaaguggggccgugguucgagggagggcuggccaggggugggacccuuaugagacu

SEQ ID NO: 273053 - RNA, 64 nt, Human; identical to SEQ ID NO: 76698

SEQ ID NO: 273054 - RNA, 64 nt, Human; identical to SEQ ID NO: 76699

SEQ ID NO: 273055 - RNA, 64 nt, Human; identical to SEQ ID NO: 76700

SEQ ID NO: 273056 - RNA, 64 nt, Human; identical to SEQ ID NO: 76701

SEQ ID NO: 273057 - RNA, 64 nt, Human; identical to SEQ ID NO: 76702

SEQ ID NO: 273058 - RNA, 64 nt, Human; identical to SEQ ID NO: 76703

SEQ ID NO: 273059 - RNA, 64 nt, Human; identical to SEQ ID NO: 76704

SEQ ID NO: 273060 - RNA, 64 nt, Human; identical to SEQ ID NO: 76705

SEQ ID NO: 273061 - RNA, 64 nt, Human; identical to SEQ ID NO: 76706

SEQ ID NO: 273062 - RNA, 64 nt, Human; identical to SEQ ID NO: 76707

SEQ ID NO: 273063 - RNA, 64 nt, Human; identical to SEQ ID NO: 76708

SEQ ID NO: 273064 - RNA, 64 nt, Human; identical to SEQ ID NO: 76709

SEQ ID NO: 273065 - RNA, 64 nt, Human; identical to SEQ ID NO: 76710

SEQ ID NO: 273066 - RNA, 64 nt, Human; identical to SEQ ID NO: 76711

SEQ ID NO: 273067 - RNA, 64 nt, Human; identical to SEQ ID NO: 76712

SEQ ID NO: 273068 - RNA, 64 nt, Human; identical to SEQ ID NO: 76713

SEQ ID NO: 273069 - RNA, 64 nt, Human
accuuggacagaggucaauccuugaugcuccagcacaggugacgucacuaauugucacuuucca

SEQ ID NO: 273070 - RNA, 64 nt, Human
aagagcaucccuuucuauacauaagagaggucauacaggugagagacaccaaguauauuaaaug

SEQ ID NO: 273071 - RNA, 64 nt, Human
aaggcugacuauacauaaagugacuggaauuuuaacaggugaaccugcauauguauaugcaggu

SEQ ID NO: 273072 - RNA, 64 nt, Human; identical to SEQ ID NO: 76714

SEQ ID NO: 273073 - RNA, 64 nt, Human; identical to SEQ ID NO: 76715

SEQ ID NO: 273074 - RNA, 64 nt, Human; identical to SEQ ID NO: 76716

SEQ ID NO: 273075 - RNA, 64 nt, Human; identical to SEQ ID NO: 76717

SEQ ID NO: 273076 - RNA, 64 nt, Human; identical to SEQ ID NO: 76718

SEQ ID NO: 273077 - RNA, 64 nt, Human; identical to SEQ ID NO: 76719

SEQ ID NO: 273078 - RNA, 64 nt, Human; identical to SEQ ID NO: 76720

SEQ ID NO: 273079 - RNA, 64 nt, Human; identical to SEQ ID NO: 76721

SEQ ID NO: 273080 - RNA, 64 nt, Human; identical to SEQ ID NO: 76722

SEQ ID NO: 273081 - RNA, 64 nt, Human; identical to SEQ ID NO: 76723

SEQ ID NO: 273082 - RNA, 64 nt, Human; identical to SEQ ID NO: 76724

SEQ ID NO: 273083 - RNA, 64 nt, Human; identical to SEQ ID NO: 76725

SEQ ID NO: 273084 - RNA, 64 nt, Human; identical to SEQ ID NO: 76726

SEQ ID NO: 273085 - RNA, 64 nt, Human; identical to SEQ ID NO: 76727

SEQ ID NO: 273086 - RNA, 64 nt, Human; identical to SEQ ID NO: 76728

SEQ ID NO: 273087 - RNA, 64 nt, Human; identical to SEQ ID NO: 76729

SEQ ID NO: 273088 - RNA, 64 nt, Human
aaauuaaaauuaaaaacaaauaauccugccuuuuacaggugaaacucggggcuguccauagcgg

SEQ ID NO: 273089 - RNA, 64 nt, Human
uuaucugaauccuaucaauuauucugaugcugggacaggugagaagaaacugugaaguauauga

SEQ ID NO: 273090 - RNA, 64 nt, Human
acacuauaacuguauuuggacauaggguuuucaaacaggugaguaacuucaaaugagguuguug

SEQ ID NO: 273091 - RNA, 64 nt, Human; identical to SEQ ID NO: 76730

SEQ ID NO: 273092 - RNA, 64 nt, Human; identical to SEQ ID NO: 76731

SEQ ID NO: 273093 - RNA, 50 nt, Human; identical to SEQ ID NO: 76732

SEQ ID NO: 273094 - RNA, 64 nt, Human; identical to SEQ ID NO: 76733

SEQ ID NO: 273095 - RNA, 64 nt, Human; identical to SEQ ID NO: 76734

SEQ ID NO: 273096 - RNA, 64 nt, Human; identical to SEQ ID NO: 76735

SEQ ID NO: 273097 - RNA, 64 nt, Human; identical to SEQ ID NO: 76736

SEQ ID NO: 273098 - RNA, 64 nt, Human; identical to SEQ ID NO: 76737

SEQ ID NO: 273099 - RNA, 64 nt, Human; identical to SEQ ID NO: 76738

SEQ ID NO: 273100 - RNA, 64 nt, Human; identical to SEQ ID NO: 76739

SEQ ID NO: 273101 - RNA, 64 nt, Human; identical to SEQ ID NO: 76740

SEQ ID NO: 273102 - RNA, 64 nt, Human; identical to SEQ ID NO: 76741

SEQ ID NO: 273103 - RNA, 64 nt, Human; identical to SEQ ID NO: 76742

SEQ ID NO: 273104 - RNA, 64 nt, Human; identical to SEQ ID NO: 76743

SEQ ID NO: 273105 - RNA, 64 nt, Human; identical to SEQ ID NO: 76744

SEQ ID NO: 273106 - RNA, 64 nt, Human; identical to SEQ ID NO: 76745

SEQ ID NO: 273107 - RNA, 64 nt, Human
gcucgcuucagucagcacuucaucucaggcaaccacaggugacaguuaaacaugaugaaaccgc

SEQ ID NO: 273108 - RNA, 64 nt, Human
uagcugagccauccugcccauuccuggagguccuacaggugaaacugcaggagcucagcauaga

SEQ ID NO: 273109 - RNA, 64 nt, Human
ccagcugauucccugacaggagccgacuucacacacaggugacucucaggcauuggcucauguu

SEQ ID NO: 273110 - RNA, 64 nt, Human; identical to SEQ ID NO: 76746

SEQ ID NO: 273111 - RNA, 64 nt, Human; identical to SEQ ID NO: 76747

SEQ ID NO: 273112 - RNA, 64 nt, Human; identical to SEQ ID NO: 76748

SEQ ID NO: 273113 - RNA, 64 nt, Human; identical to SEQ ID NO: 76749

SEQ ID NO: 273114 - RNA, 64 nt, Human; identical to SEQ ID NO: 76750

SEQ ID NO: 273115 - RNA, 64 nt, Human; identical to SEQ ID NO: 76751

SEQ ID NO: 273116 - RNA, 64 nt, Human; identical to SEQ ID NO: 76752

SEQ ID NO: 273117 - RNA, 64 nt, Human; identical to SEQ ID NO: 76753

SEQ ID NO: 273118 - RNA, 64 nt, Human; identical to SEQ ID NO: 76754

SEQ ID NO: 273119 - RNA, 64 nt, Human; identical to SEQ ID NO: 76755

SEQ ID NO: 273120 - RNA, 64 nt, Human; identical to SEQ ID NO: 76756

SEQ ID NO: 273121 - RNA, 63 nt, Human; identical to SEQ ID NO: 76757

SEQ ID NO: 273122 - RNA, 64 nt, Human; identical to SEQ ID NO: 76758

SEQ ID NO: 273123 - RNA, 64 nt, Human; identical to SEQ ID NO: 76759

SEQ ID NO: 273124 - RNA, 64 nt, Human; identical to SEQ ID NO: 76760

SEQ ID NO: 273125 - RNA, 64 nt, Human; identical to SEQ ID NO: 76761

SEQ ID NO: 273126 - RNA, 64 nt, Human
cuccuuauagacacuugcucccaacccauucacuacaggugaaggcucucacccccaucccugg

SEQ ID NO: 273127 - RNA, 64 nt, Human
uuugagauguaaguacuguuaucauccccauuucacaggugaagaaacagaagcacagagaugu

SEQ ID NO: 273128 - RNA, 64 nt, Human
aucccuccccucagccuccugaguagcugagacuacaggugagugccaccacacucagcuaauu

SEQ ID NO: 273129 - RNA, 64 nt, Human; identical to SEQ ID NO: 76762

SEQ ID NO: 273130 - RNA, 64 nt, Human; identical to SEQ ID NO: 76763

SEQ ID NO: 273131 - RNA, 64 nt, Human; identical to SEQ ID NO: 76764

SEQ ID NO: 273132 - RNA, 64 nt, Human; identical to SEQ ID NO: 76765

SEQ ID NO: 273133 - RNA, 64 nt, Human; identical to SEQ ID NO: 76766

SEQ ID NO: 273134 - RNA, 64 nt, Human; identical to SEQ ID NO: 76767

SEQ ID NO: 273135 - RNA, 64 nt, Human; identical to SEQ ID NO: 76768

SEQ ID NO: 273136 - RNA, 64 nt, Human; identical to SEQ ID NO: 76769

SEQ ID NO: 273137 - RNA, 64 nt, Human; identical to SEQ ID NO: 76770

SEQ ID NO: 273138 - RNA, 64 nt, Human; identical to SEQ ID NO: 76771

SEQ ID NO: 273139 - RNA, 64 nt, Human; identical to SEQ ID NO: 76772

SEQ ID NO: 273140 - RNA, 64 nt, Human; identical to SEQ ID NO: 76773

SEQ ID NO: 273141 - RNA, 64 nt, Human; identical to SEQ ID NO: 76774

SEQ ID NO: 273142 - RNA, 64 nt, Human; identical to SEQ ID NO: 76775

SEQ ID NO: 273143 - RNA, 64 nt, Human; identical to SEQ ID NO: 76776

SEQ ID NO: 273144 - RNA, 64 nt, Human; identical to SEQ ID NO: 76777

SEQ ID NO: 273145 - RNA, 64 nt, Human
cucuccugccucagccucccgaguaguugggauuacaggugacugccaccgugcccggcuaaug

SEQ ID NO: 273146 - RNA, 64 nt, Human
uagggaggacagacugucacuugcuguuacaggcacaggugauuaaaaugcuaaauauugcaaa

SEQ ID NO: 273147 - RNA, 62 nt, Human
ccagggccccaggggcggggaaggcauggcuugcuggccaggauauucagagguaggcagcc

SEQ ID NO: 273148 - RNA, 64 nt, Human; identical to SEQ ID NO: 76778

SEQ ID NO: 273149 - RNA, 64 nt, Human; identical to SEQ ID NO: 76779

SEQ ID NO: 273150 - RNA, 64 nt, Human; identical to SEQ ID NO: 76780

SEQ ID NO: 273151 - RNA, 64 nt, Human; identical to SEQ ID NO: 76781

SEQ ID NO: 273152 - RNA, 64 nt, Human; identical to SEQ ID NO: 76782

SEQ ID NO: 273153 - RNA, 64 nt, Human; identical to SEQ ID NO: 76783

SEQ ID NO: 273154 - RNA, 64 nt, Human; identical to SEQ ID NO: 76784

SEQ ID NO: 273155 - RNA, 64 nt, Human; identical to SEQ ID NO: 76785

SEQ ID NO: 273156 - RNA, 64 nt, Human; identical to SEQ ID NO: 76786

SEQ ID NO: 273157 - RNA, 64 nt, Human; identical to SEQ ID NO: 76787

SEQ ID NO: 273158 - RNA, 64 nt, Human; identical to SEQ ID NO: 76788

SEQ ID NO: 273159 - RNA, 64 nt, Human; identical to SEQ ID NO: 76789

SEQ ID NO: 273160 - RNA, 64 nt, Human; identical to SEQ ID NO: 76790

SEQ ID NO: 273161 - RNA, 64 nt, Human; identical to SEQ ID NO: 76791

SEQ ID NO: 273162 - RNA, 64 nt, Human; identical to SEQ ID NO: 76792

SEQ ID NO: 273163 - RNA, 57 nt, Human; identical to SEQ ID NO: 76793

SEQ ID NO: 273164 - RNA, 64 nt, Human
cuguuucuuuaacaguagcagggaaauguaaacuacaggugacaaaaaauacccagguaaacac

SEQ ID NO: 273165 - RNA, 64 nt, Human
gcagcaagcagguuuuuccucccuguugagcaagacaggugagcaagauaggacuuggcuuucu

SEQ ID NO: 273166 - RNA, 64 nt, Human
agaugagagagcacgagcuaaaguaaaauaucuaacaggugaaaaaggugugaggauugaacuc

SEQ ID NO: 273167 - RNA, 64 nt, Human; identical to SEQ ID NO: 76794

SEQ ID NO: 273168 - RNA, 64 nt, Human; identical to SEQ ID NO: 76795

SEQ ID NO: 273169 - RNA, 64 nt, Human; identical to SEQ ID NO: 76796

SEQ ID NO: 273170 - RNA, 64 nt, Human; identical to SEQ ID NO: 76797

SEQ ID NO: 273171 - RNA, 64 nt, Human; identical to SEQ ID NO: 76798

SEQ ID NO: 273172 - RNA, 64 nt, Human; identical to SEQ ID NO: 76799

SEQ ID NO: 273173 - RNA, 64 nt, Human; identical to SEQ ID NO: 76800

SEQ ID NO: 273174 - RNA, 64 nt, Human; identical to SEQ ID NO: 76801

SEQ ID NO: 273175 - RNA, 64 nt, Human; identical to SEQ ID NO: 76802

SEQ ID NO: 273176 - RNA, 64 nt, Human; identical to SEQ ID NO: 76803

SEQ ID NO: 273177 - RNA, 64 nt, Human; identical to SEQ ID NO: 76804

SEQ ID NO: 273178 - RNA, 64 nt, Human; identical to SEQ ID NO: 76805

SEQ ID NO: 273179 - RNA, 64 nt, Human; identical to SEQ ID NO: 76806

SEQ ID NO: 273180 - RNA, 64 nt, Human; identical to SEQ ID NO: 76807

SEQ ID NO: 273181 - RNA, 64 nt, Human; identical to SEQ ID NO: 76808

SEQ ID NO: 273182 - RNA, 64 nt, Human; identical to SEQ ID NO: 76809

SEQ ID NO: 273183 - RNA, 64 nt, Human
uuuucuccauguaccugcugggccagcccauuucacaggugaggaacccgaggcucagggcccc

SEQ ID NO: 273184 - RNA, 64 nt, Human
gucuggggccagccuaguaauuguuacuaggcacacaggugaugcugacucgauggccugagac

SEQ ID NO: 273185 - RNA, 64 nt, Human
agcucacagguugccaggcagagcuuuugagcucacaggugacaggcucaggguucucauccug

SEQ ID NO: 273186 - RNA, 64 nt, Human; identical to SEQ ID NO: 76810

SEQ ID NO: 273187 - RNA, 64 nt, Human; identical to SEQ ID NO: 76811

SEQ ID NO: 273188 - RNA, 64 nt, Human; identical to SEQ ID NO: 76812

SEQ ID NO: 273189 - RNA, 64 nt, Human; identical to SEQ ID NO: 76813

SEQ ID NO: 273190 - RNA, 64 nt, Human; identical to SEQ ID NO: 76814

SEQ ID NO: 273191 - RNA, 64 nt, Human; identical to SEQ ID NO: 76815

SEQ ID NO: 273192 - RNA, 64 nt, Human; identical to SEQ ID NO: 76816

SEQ ID NO: 273193 - RNA, 64 nt, Human; identical to SEQ ID NO: 76817

SEQ ID NO: 273194 - RNA, 64 nt, Human; identical to SEQ ID NO: 76818

SEQ ID NO: 273195 - RNA, 64 nt, Human; identical to SEQ ID NO: 76819

SEQ ID NO: 273196 - RNA, 64 nt, Human; identical to SEQ ID NO: 76820

SEQ ID NO: 273197 - RNA, 62 nt, Human; identical to SEQ ID NO: 76821

SEQ ID NO: 273198 - RNA, 64 nt, Human; identical to SEQ ID NO: 76822

SEQ ID NO: 273199 - RNA, 64 nt, Human; identical to SEQ ID NO: 76823

SEQ ID NO: 273200 - RNA, 59 nt, Human; identical to SEQ ID NO: 76824

SEQ ID NO: 273201 - RNA, 64 nt, Human; identical to SEQ ID NO: 76825

SEQ ID NO: 273202 - RNA, 64 nt, Human
caggugggguaucaucugcucgguggggccacccacaggugacagcauggacccucaggcuggc

SEQ ID NO: 273203 - RNA, 64 nt, Human
aauugagcugaaccuggggaccccugguuggggaacaggugaguucuauuugagacuuccagcc

SEQ ID NO: 273204 - RNA, 64 nt, Human
cccucuuacuuggcgaccacugaugagaucaacaacaggugaacuauaaaccuauuauuuauug

SEQ ID NO: 273205 - RNA, 64 nt, Human; identical to SEQ ID NO: 76826

SEQ ID NO: 273206 - RNA, 64 nt, Human; identical to SEQ ID NO: 76827

SEQ ID NO: 273207 - RNA, 64 nt, Human; identical to SEQ ID NO: 76828

SEQ ID NO: 273208 - RNA, 64 nt, Human; identical to SEQ ID NO: 76829

SEQ ID NO: 273209 - RNA, 64 nt, Human; identical to SEQ ID NO: 76830

SEQ ID NO: 273210 - RNA, 64 nt, Human; identical to SEQ ID NO: 76831

SEQ ID NO: 273211 - RNA, 61 nt, Human; identical to SEQ ID NO: 76832

SEQ ID NO: 273212 - RNA, 64 nt, Human; identical to SEQ ID NO: 76833

SEQ ID NO: 273213 - RNA, 64 nt, Human; identical to SEQ ID NO: 76834

SEQ ID NO: 273214 - RNA, 64 nt, Human; identical to SEQ ID NO: 76835

SEQ ID NO: 273215 - RNA, 64 nt, Human; identical to SEQ ID NO: 76836

SEQ ID NO: 273216 - RNA, 64 nt, Human; identical to SEQ ID NO: 76837

SEQ ID NO: 273217 - RNA, 64 nt, Human; identical to SEQ ID NO: 76838

SEQ ID NO: 273218 - RNA, 64 nt, Human; identical to SEQ ID NO: 76839

SEQ ID NO: 273219 - RNA, 64 nt, Human; identical to SEQ ID NO: 76840

SEQ ID NO: 273220 - RNA, 64 nt, Human; identical to SEQ ID NO: 76841

SEQ ID NO: 273221 - RNA, 64 nt, Human
guaaaauccaggagucugcaguuucuaaaaucacacaggugagugggcaugguggcucaugccu

SEQ ID NO: 273222 - RNA, 64 nt, Human
guggcuugguuacugugacuguagcuggaguggcacaggugacccaggcguccuuucagcucca

SEQ ID NO: 273223 - RNA, 62 nt, Human
cguggaccaaggggcauggagcuucacuccuugcuggccagggaguuggggacucagaggga

SEQ ID NO: 273224 - RNA, 64 nt, Human; identical to SEQ ID NO: 76842

SEQ ID NO: 273225 - RNA, 64 nt, Human; identical to SEQ ID NO: 76843

SEQ ID NO: 273226 - RNA, 64 nt, Human; identical to SEQ ID NO: 76844

SEQ ID NO: 273227 - RNA, 64 nt, Human; identical to SEQ ID NO: 76845

SEQ ID NO: 273228 - RNA, 64 nt, Human; identical to SEQ ID NO: 76846

SEQ ID NO: 273229 - RNA, 64 nt, Human; identical to SEQ ID NO: 76847

SEQ ID NO: 273230 - RNA, 64 nt, Human; identical to SEQ ID NO: 76848

SEQ ID NO: 273231 - RNA, 64 nt, Human; identical to SEQ ID NO: 76849

SEQ ID NO: 273232 - RNA, 64 nt, Human; identical to SEQ ID NO: 76850

SEQ ID NO: 273233 - RNA, 64 nt, Human; identical to SEQ ID NO: 76851

SEQ ID NO: 273234 - RNA, 64 nt, Human; identical to SEQ ID NO: 76852

SEQ ID NO: 273235 - RNA, 64 nt, Human; identical to SEQ ID NO: 76853

SEQ ID NO: 273236 - RNA, 64 nt, Human; identical to SEQ ID NO: 76854

SEQ ID NO: 273237 - RNA, 64 nt, Human; identical to SEQ ID NO: 76855

SEQ ID NO: 273238 - RNA, 64 nt, Human; identical to SEQ ID NO: 76856

SEQ ID NO: 273239 - RNA, 64 nt, Human; identical to SEQ ID NO: 76857

SEQ ID NO: 273240 - RNA, 64 nt, Human
cuguugaccugcaagagaauauacuuuugcauauacaggugaaaguuuugcaauuuauguauac

SEQ ID NO: 273241 - RNA, 64 nt, Human
cauuuccaaucccagaacacauggagggaaucggacaggugaugccagcaguuccugcuccucu

SEQ ID NO: 273242 - RNA, 64 nt, Human
cagugguucauaacaguagaggauuuugagcuuuacaggugauagguaccuaaugucuccuaca

SEQ ID NO: 273243 - RNA, 64 nt, Human; identical to SEQ ID NO: 76858

SEQ ID NO: 273244 - RNA, 64 nt, Human; identical to SEQ ID NO: 76859

SEQ ID NO: 273245 - RNA, 64 nt, Human; identical to SEQ ID NO: 76860

SEQ ID NO: 273246 - RNA, 64 nt, Human; identical to SEQ ID NO: 76861

SEQ ID NO: 273247 - RNA, 64 nt, Human; identical to SEQ ID NO: 76862

SEQ ID NO: 273248 - RNA, 64 nt, Human; identical to SEQ ID NO: 76863

SEQ ID NO: 273249 - RNA, 64 nt, Human; identical to SEQ ID NO: 76864

SEQ ID NO: 273250 - RNA, 64 nt, Human; identical to SEQ ID NO: 76865

SEQ ID NO: 273251 - RNA, 64 nt, Human; identical to SEQ ID NO: 76866

SEQ ID NO: 273252 - RNA, 64 nt, Human; identical to SEQ ID NO: 76867

SEQ ID NO: 273253 - RNA, 64 nt, Human; identical to SEQ ID NO: 76868

SEQ ID NO: 273254 - RNA, 64 nt, Human; identical to SEQ ID NO: 76869

SEQ ID NO: 273255 - RNA, 64 nt, Human; identical to SEQ ID NO: 76870

SEQ ID NO: 273256 - RNA, 64 nt, Human; identical to SEQ ID NO: 76871

SEQ ID NO: 273257 - RNA, 64 nt, Human; identical to SEQ ID NO: 76872

SEQ ID NO: 273258 - RNA, 64 nt, Human; identical to SEQ ID NO: 76873

SEQ ID NO: 273259 - RNA, 64 nt, Human
aggagucaggcaaggauugugcuucccccauuauacaggugacaaaacugaguccuggggaaag

SEQ ID NO: 273260 - RNA, 64 nt, Human
agccagaagacaggcaguaguuuuaauuucaggaacaggugauccacucuguaaaacagcaggu

SEQ ID NO: 273261 - RNA, 64 nt, Human
gacuccuccuuuuuccaugcccuaaacagaccugacaggugaggucuguuccuuuuauauaagu

SEQ ID NO: 273262 - RNA, 64 nt, Human; identical to SEQ ID NO: 76874

SEQ ID NO: 273263 - RNA, 64 nt, Human; identical to SEQ ID NO: 76875

SEQ ID NO: 273264 - RNA, 64 nt, Human; identical to SEQ ID NO: 76876

SEQ ID NO: 273265 - RNA, 64 nt, Human; identical to SEQ ID NO: 76877

SEQ ID NO: 273266 - RNA, 64 nt, Human; identical to SEQ ID NO: 76878

SEQ ID NO: 273267 - RNA, 64 nt, Human; identical to SEQ ID NO: 76879

SEQ ID NO: 273268 - RNA, 64 nt, Human; identical to SEQ ID NO: 76880

SEQ ID NO: 273269 - RNA, 64 nt, Human; identical to SEQ ID NO: 76881

SEQ ID NO: 273270 - RNA, 64 nt, Human; identical to SEQ ID NO: 76882

SEQ ID NO: 273271 - RNA, 64 nt, Human; identical to SEQ ID NO: 76883

SEQ ID NO: 273272 - RNA, 64 nt, Human; identical to SEQ ID NO: 76884

SEQ ID NO: 273273 - RNA, 64 nt, Human; identical to SEQ ID NO: 76885

SEQ ID NO: 273274 - RNA, 64 nt, Human; identical to SEQ ID NO: 76886

SEQ ID NO: 273275 - RNA, 64 nt, Human; identical to SEQ ID NO: 76887

SEQ ID NO: 273276 - RNA, 64 nt, Human; identical to SEQ ID NO: 76888

SEQ ID NO: 273277 - RNA, 64 nt, Human; identical to SEQ ID NO: 76889

SEQ ID NO: 273278 - RNA, 64 nt, Human
uuggcuuuuaguaaucauguuggcuggucuggucacaggugacugugaaacagaugcccugguc

SEQ ID NO: 273279 - RNA, 64 nt, Human
acugggucuuagcauccuccuguguauggaagagacaggugaccgcuccagguugggugcucac

SEQ ID NO: 273280 - RNA, 64 nt, Human
uccucccaggguuuccagggaaacaacaugaaaaacaggugacaugaacuacagacuaaagauu

SEQ ID NO: 273281 - RNA, 64 nt, Human; identical to SEQ ID NO: 76890

SEQ ID NO: 273282 - RNA, 64 nt, Human; identical to SEQ ID NO: 76891

SEQ ID NO: 273283 - RNA, 64 nt, Human; identical to SEQ ID NO: 76892

SEQ ID NO: 273284 - RNA, 64 nt, Human; identical to SEQ ID NO: 76893

SEQ ID NO: 273285 - RNA, 64 nt, Human; identical to SEQ ID NO: 76894

SEQ ID NO: 273286 - RNA, 64 nt, Human; identical to SEQ ID NO: 76895

SEQ ID NO: 273287 - RNA, 64 nt, Human; identical to SEQ ID NO: 76896

SEQ ID NO: 273288 - RNA, 64 nt, Human; identical to SEQ ID NO: 76897

SEQ ID NO: 273289 - RNA, 64 nt, Human; identical to SEQ ID NO: 76898

SEQ ID NO: 273290 - RNA, 64 nt, Human; identical to SEQ ID NO: 76899

SEQ ID NO: 273291 - RNA, 64 nt, Human; identical to SEQ ID NO: 76900

SEQ ID NO: 273292 - RNA, 64 nt, Human; identical to SEQ ID NO: 76901

SEQ ID NO: 273293 - RNA, 64 nt, Human; identical to SEQ ID NO: 76902

SEQ ID NO: 273294 - RNA, 64 nt, Human; identical to SEQ ID NO: 76903

SEQ ID NO: 273295 - RNA, 64 nt, Human; identical to SEQ ID NO: 76904

SEQ ID NO: 273296 - RNA, 64 nt, Human; identical to SEQ ID NO: 76905

SEQ ID NO: 273297 - RNA, 64 nt, Human
ugaacuuaacaaaacuguucauccugaaacaggcacaggugaugcauucuccugcuguugcuuc

SEQ ID NO: 273298 - RNA, 64 nt, Human
acccucccaucaucugcuucccccaaggccucccacaggugacagaauguucugccuucccuuc

SEQ ID NO: 273299 - RNA, 64 nt, Human
gaucaccucuuggggacccugccuaucccacuucacaggugaggcauggcaauucuggaagcug

SEQ ID NO: 273300 - RNA, 64 nt, Human; identical to SEQ ID NO: 76906

SEQ ID NO: 273301 - RNA, 64 nt, Human; identical to SEQ ID NO: 76907

SEQ ID NO: 273302 - RNA, 64 nt, Human; identical to SEQ ID NO: 76908

SEQ ID NO: 273303 - RNA, 54 nt, Human; identical to SEQ ID NO: 76909

SEQ ID NO: 273304 - RNA, 64 nt, Human; identical to SEQ ID NO: 76910

SEQ ID NO: 273305 - RNA, 64 nt, Human; identical to SEQ ID NO: 76911

SEQ ID NO: 273306 - RNA, 64 nt, Human; identical to SEQ ID NO: 76912

SEQ ID NO: 273307 - RNA, 64 nt, Human; identical to SEQ ID NO: 76913

SEQ ID NO: 273308 - RNA, 64 nt, Human; identical to SEQ ID NO: 76914

SEQ ID NO: 273309 - RNA, 64 nt, Human; identical to SEQ ID NO: 76915

SEQ ID NO: 273310 - RNA, 64 nt, Human; identical to SEQ ID NO: 76916

SEQ ID NO: 273311 - RNA, 64 nt, Human; identical to SEQ ID NO: 76917

SEQ ID NO: 273312 - RNA, 64 nt, Human; identical to SEQ ID NO: 76918

SEQ ID NO: 273313 - RNA, 64 nt, Human; identical to SEQ ID NO: 76919

SEQ ID NO: 273314 - RNA, 64 nt, Human; identical to SEQ ID NO: 76920

SEQ ID NO: 273315 - RNA, 64 nt, Human; identical to SEQ ID NO: 76921

SEQ ID NO: 273316 - RNA, 64 nt, Human
acuuaacccaaggucaagcagaugaguagugaacacaggugaucgaguguuggcucugaacacu

SEQ ID NO: 273317 - RNA, 64 nt, Human
auugucaaagaacaaagcgguguuuuucuuuuaaacaggugaucacguuucguguucauacuca

SEQ ID NO: 273318 - RNA, 64 nt, Human
cuuuuuuacaaaaagugccguauauacauauguaacaggugaguguguguuuaacauaauuuau

SEQ ID NO: 273319 - RNA, 64 nt, Human; identical to SEQ ID NO: 76922

SEQ ID NO: 273320 - RNA, 64 nt, Human; identical to SEQ ID NO: 76923

SEQ ID NO: 273321 - RNA, 64 nt, Human; identical to SEQ ID NO: 76924

SEQ ID NO: 273322 - RNA, 64 nt, Human; identical to SEQ ID NO: 76925

SEQ ID NO: 273323 - RNA, 64 nt, Human; identical to SEQ ID NO: 76926

SEQ ID NO: 273324 - RNA, 64 nt, Human; identical to SEQ ID NO: 76927

SEQ ID NO: 273325 - RNA, 64 nt, Human; identical to SEQ ID NO: 76928

SEQ ID NO: 273326 - RNA, 64 nt, Human; identical to SEQ ID NO: 76929

SEQ ID NO: 273327 - RNA, 64 nt, Human; identical to SEQ ID NO: 76930

SEQ ID NO: 273328 - RNA, 64 nt, Human; identical to SEQ ID NO: 76931

SEQ ID NO: 273329 - RNA, 64 nt, Human; identical to SEQ ID NO: 76932

SEQ ID NO: 273330 - RNA, 64 nt, Human; identical to SEQ ID NO: 76933

SEQ ID NO: 273331 - RNA, 64 nt, Human; identical to SEQ ID NO: 76934

SEQ ID NO: 273332 - RNA, 64 nt, Human; identical to SEQ ID NO: 76935

SEQ ID NO: 273333 - RNA, 64 nt, Human; identical to SEQ ID NO: 76936

SEQ ID NO: 273334 - RNA, 64 nt, Human; identical to SEQ ID NO: 76937

SEQ ID NO: 273335 - RNA, 64 nt, Human
agcacaugaaaugcuugugaguuguugacauuggacaggugaacaguagggcauuacauuugug

SEQ ID NO: 273336 - RNA, 64 nt, Human
ccucuggcccagccaccacugccucucagcuucaacaggugacaggcugcuuucgugacuugau

SEQ ID NO: 273337 - RNA, 64 nt, Human
gccacccuuuguuucccucauccucggcucccacacaggugacagacccagcagauagcuucuc

SEQ ID NO: 273338 - RNA, 64 nt, Human; identical to SEQ ID NO: 76938

SEQ ID NO: 273339 - RNA, 64 nt, Human; identical to SEQ ID NO: 76939

SEQ ID NO: 273340 - RNA, 64 nt, Human; identical to SEQ ID NO: 76940

SEQ ID NO: 273341 - RNA, 64 nt, Human; identical to SEQ ID NO: 76941

SEQ ID NO: 273342 - RNA, 64 nt, Human; identical to SEQ ID NO: 76942

SEQ ID NO: 273343 - RNA, 64 nt, Human; identical to SEQ ID NO: 76943

SEQ ID NO: 273344 - RNA, 64 nt, Human; identical to SEQ ID NO: 76944

SEQ ID NO: 273345 - RNA, 64 nt, Human; identical to SEQ ID NO: 76945

SEQ ID NO: 273346 - RNA, 64 nt, Human; identical to SEQ ID NO: 76946

SEQ ID NO: 273347 - RNA, 64 nt, Human; identical to SEQ ID NO: 76947

SEQ ID NO: 273348 - RNA, 64 nt, Human; identical to SEQ ID NO: 76948

SEQ ID NO: 273349 - RNA, 64 nt, Human; identical to SEQ ID NO: 76949

SEQ ID NO: 273350 - RNA, 64 nt, Human; identical to SEQ ID NO: 76950

SEQ ID NO: 273351 - RNA, 64 nt, Human; identical to SEQ ID NO: 76951

SEQ ID NO: 273352 - RNA, 64 nt, Human; identical to SEQ ID NO: 76952

SEQ ID NO: 273353 - RNA, 64 nt, Human; identical to SEQ ID NO: 76953

SEQ ID NO: 273354 - RNA, 64 nt, Human
gauaaggaguaccugcuggucagccuugagaugcacaggugaagguuagggugagaugagaaca

SEQ ID NO: 273355 - RNA, 64 nt, Human
ugucaggugagacuguguaugcaaaaugaauggcacaggugaugccagggccucuugcuugggu

SEQ ID NO: 273356 - RNA, 64 nt, Human
ucacugaggcuaugucaacaugauauuuagaccaacaggugaucaauguuuggaaaauacaaca

SEQ ID NO: 273357 - RNA, 64 nt, Human; identical to SEQ ID NO: 76954

SEQ ID NO: 273358 - RNA, 64 nt, Human; identical to SEQ ID NO: 76955

SEQ ID NO: 273359 - RNA, 64 nt, Human; identical to SEQ ID NO: 76956

SEQ ID NO: 273360 - RNA, 64 nt, Human; identical to SEQ ID NO: 76957

SEQ ID NO: 273361 - RNA, 64 nt, Human; identical to SEQ ID NO: 76958

SEQ ID NO: 273362 - RNA, 64 nt, Human; identical to SEQ ID NO: 76959

SEQ ID NO: 273363 - RNA, 64 nt, Human; identical to SEQ ID NO: 76960

SEQ ID NO: 273364 - RNA, 64 nt, Human; identical to SEQ ID NO: 76961

SEQ ID NO: 273365 - RNA, 64 nt, Human; identical to SEQ ID NO: 76962

SEQ ID NO: 273366 - RNA, 64 nt, Human; identical to SEQ ID NO: 76963

SEQ ID NO: 273367 - RNA, 64 nt, Human; identical to SEQ ID NO: 76964

SEQ ID NO: 273368 - RNA, 64 nt, Human; identical to SEQ ID NO: 76965

SEQ ID NO: 273369 - RNA, 55 nt, Human; identical to SEQ ID NO: 76966

SEQ ID NO: 273370 - RNA, 64 nt, Human; identical to SEQ ID NO: 76967

SEQ ID NO: 273371 - RNA, 64 nt, Human; identical to SEQ ID NO: 76968

SEQ ID NO: 273372 - RNA, 64 nt, Human; identical to SEQ ID NO: 76969

SEQ ID NO: 273373 - RNA, 63 nt, Human
auggcccaccacccaccuaacccacuggggcacacaggugacuuucuccuccaaccuccauca

SEQ ID NO: 273374 - RNA, 64 nt, Human
uggugcuaccuggcucuccugucucugcagcucuacaggugaggcccagcagagggaguagggc

SEQ ID NO: 273375 - RNA, 64 nt, Human
agggaagggugguggagccaguaaacagaggaguacaggugaagcaccaagcucaaagcgugga

SEQ ID NO: 273376 - RNA, 64 nt, Human; identical to SEQ ID NO: 76970

SEQ ID NO: 273377 - RNA, 64 nt, Human; identical to SEQ ID NO: 76971

SEQ ID NO: 273378 - RNA, 64 nt, Human; identical to SEQ ID NO: 76972

SEQ ID NO: 273379 - RNA, 64 nt, Human; identical to SEQ ID NO: 76973

SEQ ID NO: 273380 - RNA, 64 nt, Human; identical to SEQ ID NO: 76974

SEQ ID NO: 273381 - RNA, 64 nt, Human; identical to SEQ ID NO: 76975

SEQ ID NO: 273382 - RNA, 64 nt, Human; identical to SEQ ID NO: 76976

SEQ ID NO: 273383 - RNA, 64 nt, Human; identical to SEQ ID NO: 76977

SEQ ID NO: 273384 - RNA, 64 nt, Human; identical to SEQ ID NO: 76978

SEQ ID NO: 273385 - RNA, 64 nt, Human; identical to SEQ ID NO: 76979

SEQ ID NO: 273386 - RNA, 64 nt, Human; identical to SEQ ID NO: 76980

SEQ ID NO: 273387 - RNA, 64 nt, Human; identical to SEQ ID NO: 76981

SEQ ID NO: 273388 - RNA, 64 nt, Human; identical to SEQ ID NO: 76982

SEQ ID NO: 273389 - RNA, 64 nt, Human; identical to SEQ ID NO: 76983

SEQ ID NO: 273390 - RNA, 64 nt, Human; identical to SEQ ID NO: 76984

SEQ ID NO: 273391 - RNA, 64 nt, Human; identical to SEQ ID NO: 76985

SEQ ID NO: 273392 - RNA, 64 nt, Human
aacuccacagaugaaacaguucaauaaugaggaaacaggugagcccugaaaacacaaaaggaca

SEQ ID NO: 273393 - RNA, 64 nt, Human
cacagccaggcccugcacgcccaccuccucggacacaggugacaggguuacccuccaguuugag

SEQ ID NO: 273394 - RNA, 64 nt, Human
augaccuccucacccaaggaguucugcuguacaaacaggugauggagggccgggucaccuuugg

SEQ ID NO: 273395 - RNA, 62 nt, Human; identical to SEQ ID NO: 76986

SEQ ID NO: 273396 - RNA, 61 nt, Human; identical to SEQ ID NO: 76987

SEQ ID NO: 273397 - RNA, 64 nt, Human; identical to SEQ ID NO: 76988

SEQ ID NO: 273398 - RNA, 64 nt, Human; identical to SEQ ID NO: 76989

SEQ ID NO: 273399 - RNA, 64 nt, Human; identical to SEQ ID NO: 76990

SEQ ID NO: 273400 - RNA, 64 nt, Human; identical to SEQ ID NO: 76991

SEQ ID NO: 273401 - RNA, 64 nt, Human; identical to SEQ ID NO: 76992

SEQ ID NO: 273402 - RNA, 64 nt, Human; identical to SEQ ID NO: 76993

SEQ ID NO: 273403 - RNA, 64 nt, Human; identical to SEQ ID NO: 76994

SEQ ID NO: 273404 - RNA, 64 nt, Human; identical to SEQ ID NO: 76995

SEQ ID NO: 273405 - RNA, 64 nt, Human; identical to SEQ ID NO: 76996

SEQ ID NO: 273406 - RNA, 64 nt, Human; identical to SEQ ID NO: 76997

SEQ ID NO: 273407 - RNA, 64 nt, Human; identical to SEQ ID NO: 76998

SEQ ID NO: 273408 - RNA, 64 nt, Human; identical to SEQ ID NO: 76999

SEQ ID NO: 273409 - RNA, 64 nt, Human; identical to SEQ ID NO: 77000

SEQ ID NO: 273410 - RNA, 64 nt, Human; identical to SEQ ID NO: 77001

SEQ ID NO: 273411 - RNA, 64 nt, Human
aguaggugggggugaucugcuugcuucuuuuaccacaggugauuuuuaaguaacuuggguuuaa

SEQ ID NO: 273412 - RNA, 64 nt, Human
uccuagugugugcagugucuucggcccuguggacacaggugaaugagggaccagcccugcccug

SEQ ID NO: 273413 - RNA, 64 nt, Human
ggcugggguggugcaggggccuugggcucccaggacaggugaacagggagggaccuccccacac

SEQ ID NO: 273414 - RNA, 64 nt, Human; identical to SEQ ID NO: 77002

SEQ ID NO: 273415 - RNA, 64 nt, Human; identical to SEQ ID NO: 77003

SEQ ID NO: 273416 - RNA, 64 nt, Human; identical to SEQ ID NO: 77004

SEQ ID NO: 273417 - RNA, 64 nt, Human; identical to SEQ ID NO: 77005

SEQ ID NO: 273418 - RNA, 64 nt, Human; identical to SEQ ID NO: 77006

SEQ ID NO: 273419 - RNA, 64 nt, Human; identical to SEQ ID NO: 77007

SEQ ID NO: 273420 - RNA, 64 nt, Human; identical to SEQ ID NO: 77008

SEQ ID NO: 273421 - RNA, 64 nt, Human; identical to SEQ ID NO: 77009

SEQ ID NO: 273422 - RNA, 64 nt, Human; identical to SEQ ID NO: 77010

SEQ ID NO: 273423 - RNA, 64 nt, Human; identical to SEQ ID NO: 77011

SEQ ID NO: 273424 - RNA, 64 nt, Human; identical to SEQ ID NO: 77012

SEQ ID NO: 273425 - RNA, 64 nt, Human; identical to SEQ ID NO: 77013

SEQ ID NO: 273426 - RNA, 64 nt, Human; identical to SEQ ID NO: 77014

SEQ ID NO: 273427 - RNA, 64 nt, Human; identical to SEQ ID NO: 77015

SEQ ID NO: 273428 - RNA, 64 nt, Human; identical to SEQ ID NO: 77016

SEQ ID NO: 273429 - RNA, 64 nt, Human; identical to SEQ ID NO: 77017

SEQ ID NO: 273430 - RNA, 64 nt, Human
cuccucugccucaguaaguaucuggaggaagaaaacaggugaaagaagaaguaaaaaccauuua

SEQ ID NO: 273431 - RNA, 64 nt, Human
cuuccaccaccgaagaaaaaagauggucauacuaacaggugaaauguacaaggugucugugugu

SEQ ID NO: 273432 - RNA, 64 nt, Human
auaagcacuauucuuuguauuaccaaagcaagguacaggugacuacccuaguucaaaacaacca

SEQ ID NO: 273433 - RNA, 64 nt, Human; identical to SEQ ID NO: 77018

SEQ ID NO: 273434 - RNA, 64 nt, Human; identical to SEQ ID NO: 77019

SEQ ID NO: 273435 - RNA, 64 nt, Human; identical to SEQ ID NO: 77020

SEQ ID NO: 273436 - RNA, 64 nt, Human; identical to SEQ ID NO: 77021

SEQ ID NO: 273437 - RNA, 64 nt, Human; identical to SEQ ID NO: 77022

SEQ ID NO: 273438 - RNA, 64 nt, Human; identical to SEQ ID NO: 77023

SEQ ID NO: 273439 - RNA, 64 nt, Human; identical to SEQ ID NO: 77024

SEQ ID NO: 273440 - RNA, 64 nt, Human; identical to SEQ ID NO: 77025

SEQ ID NO: 273441 - RNA, 64 nt, Human; identical to SEQ ID NO: 77026

SEQ ID NO: 273442 - RNA, 64 nt, Human; identical to SEQ ID NO: 77027

SEQ ID NO: 273443 - RNA, 64 nt, Human; identical to SEQ ID NO: 77028

SEQ ID NO: 273444 - RNA, 62 nt, Human; identical to SEQ ID NO: 77029

SEQ ID NO: 273445 - RNA, 64 nt, Human; identical to SEQ ID NO: 77030

SEQ ID NO: 273446 - RNA, 64 nt, Human; identical to SEQ ID NO: 77031

SEQ ID NO: 273447 - RNA, 64 nt, Human; identical to SEQ ID NO: 77032

SEQ ID NO: 273448 - RNA, 64 nt, Human; identical to SEQ ID NO: 77033

SEQ ID NO: 273449 - RNA, 64 nt, Human
gaggccagacuccuccaacagugaaggaaaaggcacaggugagaguauaggugggagauuuggg

SEQ ID NO: 273450 - RNA, 64 nt, Human
ugguagugucuuucagguauccguuccacuagcuacaggugagcauuuuacccauuguuggaua

SEQ ID NO: 273451 - RNA, 64 nt, Human
cccaaaaggaauccuggagaggaggacagugacaacaggugacuucauucuuuagagugaacuu

SEQ ID NO: 273452 - RNA, 64 nt, Human; identical to SEQ ID NO: 77034

SEQ ID NO: 273453 - RNA, 64 nt, Human; identical to SEQ ID NO: 77035

SEQ ID NO: 273454 - RNA, 64 nt, Human; identical to SEQ ID NO: 77036

SEQ ID NO: 273455 - RNA, 64 nt, Human; identical to SEQ ID NO: 77037

SEQ ID NO: 273456 - RNA, 64 nt, Human; identical to SEQ ID NO: 77038

SEQ ID NO: 273457 - RNA, 64 nt, Human; identical to SEQ ID NO: 77039

SEQ ID NO: 273458 - RNA, 64 nt, Human; identical to SEQ ID NO: 77040

SEQ ID NO: 273459 - RNA, 64 nt, Human; identical to SEQ ID NO: 77041

SEQ ID NO: 273460 - RNA, 64 nt, Human; identical to SEQ ID NO: 77042

SEQ ID NO: 273461 - RNA, 64 nt, Human; identical to SEQ ID NO: 77043

SEQ ID NO: 273462 - RNA, 64 nt, Human; identical to SEQ ID NO: 77044

SEQ ID NO: 273463 - RNA, 64 nt, Human; identical to SEQ ID NO: 77045

SEQ ID NO: 273464 - RNA, 64 nt, Human; identical to SEQ ID NO: 77046

SEQ ID NO: 273465 - RNA, 64 nt, Human; identical to SEQ ID NO: 77047

SEQ ID NO: 273466 - RNA, 64 nt, Human; identical to SEQ ID NO: 77048

SEQ ID NO: 273467 - RNA, 64 nt, Human; identical to SEQ ID NO: 77049

SEQ ID NO: 273468 - RNA, 64 nt, Human
gauauauaaauauacauuucacagauaaacuguaacaggugaacaggugaacacaaacaugagg

SEQ ID NO: 273469 - RNA, 64 nt, Human
gacgcccccagggagcuggggacacccccaugggacaggugaggggcucggacggagccguggg

SEQ ID NO: 273470 - RNA, 64 nt, Human
cuccccucaggaggccaccucaggaaggauuuugacaggugaccauaaaaaccagaggugugac

SEQ ID NO: 273471 - RNA, 64 nt, Human; identical to SEQ ID NO: 77050

SEQ ID NO: 273472 - RNA, 64 nt, Human; identical to SEQ ID NO: 77051

SEQ ID NO: 273473 - RNA, 64 nt, Human; identical to SEQ ID NO: 77052

SEQ ID NO: 273474 - RNA, 64 nt, Human; identical to SEQ ID NO: 77053

SEQ ID NO: 273475 - RNA, 64 nt, Human; identical to SEQ ID NO: 77054

SEQ ID NO: 273476 - RNA, 64 nt, Human; identical to SEQ ID NO: 77055

SEQ ID NO: 273477 - RNA, 64 nt, Human; identical to SEQ ID NO: 77056

SEQ ID NO: 273478 - RNA, 64 nt, Human; identical to SEQ ID NO: 77057

SEQ ID NO: 273479 - RNA, 64 nt, Human; identical to SEQ ID NO: 77058

SEQ ID NO: 273480 - RNA, 64 nt, Human; identical to SEQ ID NO: 77059

SEQ ID NO: 273481 - RNA, 64 nt, Human; identical to SEQ ID NO: 77060

SEQ ID NO: 273482 - RNA, 64 nt, Human; identical to SEQ ID NO: 77061

SEQ ID NO: 273483 - RNA, 64 nt, Human; identical to SEQ ID NO: 77062

SEQ ID NO: 273484 - RNA, 64 nt, Human; identical to SEQ ID NO: 77063

SEQ ID NO: 273485 - RNA, 64 nt, Human; identical to SEQ ID NO: 77064

SEQ ID NO: 273486 - RNA, 64 nt, Human; identical to SEQ ID NO: 77065

SEQ ID NO: 273487 - RNA, 64 nt, Human
aacuugaacucucuccauucucuuguucccauuuacaggugaaucucuuccuuuaagccauuuu

SEQ ID NO: 273488 - RNA, 64 nt, Human
gcccagagccagagggcugggucccggguccuccacaggugaccccgguggacacacgcguucc

SEQ ID NO: 273489 - RNA, 64 nt, Human
ucugggagaaugaacccgagguugguuuggggagacaggugaggcggucggaucuacagaacaa

SEQ ID NO: 273490 - RNA, 64 nt, Human; identical to SEQ ID NO: 77066

SEQ ID NO: 273491 - RNA, 64 nt, Human; identical to SEQ ID NO: 77067

SEQ ID NO: 273492 - RNA, 64 nt, Human; identical to SEQ ID NO: 77068

SEQ ID NO: 273493 - RNA, 64 nt, Human; identical to SEQ ID NO: 77069

SEQ ID NO: 273494 - RNA, 64 nt, Human; identical to SEQ ID NO: 77070

SEQ ID NO: 273495 - RNA, 64 nt, Human; identical to SEQ ID NO: 77071

SEQ ID NO: 273496 - RNA, 64 nt, Human; identical to SEQ ID NO: 77072

SEQ ID NO: 273497 - RNA, 64 nt, Human; identical to SEQ ID NO: 77073

SEQ ID NO: 273498 - RNA, 64 nt, Human; identical to SEQ ID NO: 77074

SEQ ID NO: 273499 - RNA, 64 nt, Human; identical to SEQ ID NO: 77075

SEQ ID NO: 273500 - RNA, 64 nt, Human; identical to SEQ ID NO: 77076

SEQ ID NO: 273501 - RNA, 64 nt, Human; identical to SEQ ID NO: 77077

SEQ ID NO: 273502 - RNA, 64 nt, Human; identical to SEQ ID NO: 77078

SEQ ID NO: 273503 - RNA, 64 nt, Human; identical to SEQ ID NO: 77079

SEQ ID NO: 273504 - RNA, 64 nt, Human; identical to SEQ ID NO: 77080

SEQ ID NO: 273505 - RNA, 64 nt, Human; identical to SEQ ID NO: 77081

SEQ ID NO: 273506 - RNA, 64 nt, Human
uguaagagaaaaauguguggguacuugcuaauaaacaggugaauuaaugcacauccuuaucuca

SEQ ID NO: 273507 - RNA, 64 nt, Human
acuuuaagcaccuuaaaacauuuaaaaucuuauuacaggugauagagauagauacauguaugug

SEQ ID NO: 273508 - RNA, 64 nt, Human
agggcuguggagaaacucccucauguuguuggcaacaggugaaugaaccuagagcggugacaug

SEQ ID NO: 273509 - RNA, 64 nt, Human; identical to SEQ ID NO: 77082

SEQ ID NO: 273510 - RNA, 64 nt, Human; identical to SEQ ID NO: 77083

SEQ ID NO: 273511 - RNA, 64 nt, Human; identical to SEQ ID NO: 77084

SEQ ID NO: 273512 - RNA, 64 nt, Human; identical to SEQ ID NO: 77085

SEQ ID NO: 273513 - RNA, 64 nt, Human; identical to SEQ ID NO: 77086

SEQ ID NO: 273514 - RNA, 64 nt, Human; identical to SEQ ID NO: 77087

SEQ ID NO: 273515 - RNA, 64 nt, Human; identical to SEQ ID NO: 77088

SEQ ID NO: 273516 - RNA, 64 nt, Human; identical to SEQ ID NO: 77089

SEQ ID NO: 273517 - RNA, 64 nt, Human; identical to SEQ ID NO: 77090

SEQ ID NO: 273518 - RNA, 64 nt, Human; identical to SEQ ID NO: 77091

SEQ ID NO: 273519 - RNA, 64 nt, Human; identical to SEQ ID NO: 77092

SEQ ID NO: 273520 - RNA, 64 nt, Human; identical to SEQ ID NO: 77093

SEQ ID NO: 273521 - RNA, 60 nt, Human; identical to SEQ ID NO: 77094

SEQ ID NO: 273522 - RNA, 64 nt, Human; identical to SEQ ID NO: 77095

SEQ ID NO: 273523 - RNA, 64 nt, Human; identical to SEQ ID NO: 77096

SEQ ID NO: 273524 - RNA, 64 nt, Human; identical to SEQ ID NO: 77097

SEQ ID NO: 273525 - RNA, 64 nt, Human
cuuauaaauuaaacacauggcccccuuagagaccacaggugaugucugucuccauccuucccuc

SEQ ID NO: 273526 - RNA, 64 nt, Human
ggcaagagcacaaaaugaguucagaugaucacaaacaggugaguuuuguuggagaagaaaguug

SEQ ID NO: 273527 - RNA, 64 nt, Human
gggcuggcacuggagccagcagcuuggccgagucacaggugacccguggcccucacgucucugg

SEQ ID NO: 273528 - RNA, 64 nt, Human; identical to SEQ ID NO: 77098

SEQ ID NO: 273529 - RNA, 64 nt, Human; identical to SEQ ID NO: 77099

SEQ ID NO: 273530 - RNA, 64 nt, Human; identical to SEQ ID NO: 77100

SEQ ID NO: 273531 - RNA, 64 nt, Human; identical to SEQ ID NO: 77101

SEQ ID NO: 273532 - RNA, 64 nt, Human; identical to SEQ ID NO: 77102

SEQ ID NO: 273533 - RNA, 64 nt, Human; identical to SEQ ID NO: 77103

SEQ ID NO: 273534 - RNA, 64 nt, Human; identical to SEQ ID NO: 77104

SEQ ID NO: 273535 - RNA, 64 nt, Human; identical to SEQ ID NO: 77105

SEQ ID NO: 273536 - RNA, 64 nt, Human; identical to SEQ ID NO: 77106

SEQ ID NO: 273537 - RNA, 64 nt, Human; identical to SEQ ID NO: 77107

SEQ ID NO: 273538 - RNA, 64 nt, Human; identical to SEQ ID NO: 77108

SEQ ID NO: 273539 - RNA, 64 nt, Human; identical to SEQ ID NO: 77109

SEQ ID NO: 273540 - RNA, 64 nt, Human; identical to SEQ ID NO: 77110

SEQ ID NO: 273541 - RNA, 64 nt, Human; identical to SEQ ID NO: 77111

SEQ ID NO: 273542 - RNA, 64 nt, Human; identical to SEQ ID NO: 77112

SEQ ID NO: 273543 - RNA, 64 nt, Human; identical to SEQ ID NO: 77113

SEQ ID NO: 273544 - RNA, 64 nt, Human
ucauugcucuccagucacaugcccccacuuccccacaggugaaaguuuuucugaaaguguuggg

SEQ ID NO: 273545 - RNA, 64 nt, Human
ccuaguccaggcaaucuuucucuguuuagcagucacaggugagggugguauuagcaucuuuuuu

SEQ ID NO: 273546 - RNA, 64 nt, Human
gugugguuuugggagagaagugcaaaaucccacgacaggugaguugaaggaaugggauauggag

SEQ ID NO: 273547 - RNA, 64 nt, Human; identical to SEQ ID NO: 77114

SEQ ID NO: 273548 - RNA, 64 nt, Human; identical to SEQ ID NO: 77115

SEQ ID NO: 273549 - RNA, 64 nt, Human; identical to SEQ ID NO: 77116

SEQ ID NO: 273550 - RNA, 64 nt, Human; identical to SEQ ID NO: 77117

SEQ ID NO: 273551 - RNA, 64 nt, Human; identical to SEQ ID NO: 77118

SEQ ID NO: 273552 - RNA, 64 nt, Human; identical to SEQ ID NO: 77119

SEQ ID NO: 273553 - RNA, 64 nt, Human; identical to SEQ ID NO: 77120

SEQ ID NO: 273554 - RNA, 64 nt, Human; identical to SEQ ID NO: 77121

SEQ ID NO: 273555 - RNA, 64 nt, Human; identical to SEQ ID NO: 77122

SEQ ID NO: 273556 - RNA, 64 nt, Human; identical to SEQ ID NO: 77123

SEQ ID NO: 273557 - RNA, 64 nt, Human; identical to SEQ ID NO: 77124

SEQ ID NO: 273558 - RNA, 64 nt, Human; identical to SEQ ID NO: 77125

SEQ ID NO: 273559 - RNA, 64 nt, Human; identical to SEQ ID NO: 77126

SEQ ID NO: 273560 - RNA, 64 nt, Human; identical to SEQ ID NO: 77127

SEQ ID NO: 273561 - RNA, 64 nt, Human; identical to SEQ ID NO: 77128

SEQ ID NO: 273562 - RNA, 64 nt, Human; identical to SEQ ID NO: 77129

SEQ ID NO: 273563 - RNA, 64 nt, Human
gaguucuagaggauucugcuucucuaguaacuagacaggugauacgcauuugcuugccacauua

SEQ ID NO: 273564 - RNA, 64 nt, Human
caccagaaacaacaacugccagcccggccuggccacaggugaggucugugauuuccgagcacgc

SEQ ID NO: 273565 - RNA, 64 nt, Human
cugaguggcagaaggaaacugcucaggaagagaaacaggugacugaugggaagguugauuauuu

SEQ ID NO: 273566 - RNA, 64 nt, Human; identical to SEQ ID NO: 77130

SEQ ID NO: 273567 - RNA, 64 nt, Human; identical to SEQ ID NO: 77131

SEQ ID NO: 273568 - RNA, 64 nt, Human; identical to SEQ ID NO: 77132

SEQ ID NO: 273569 - RNA, 64 nt, Human; identical to SEQ ID NO: 77133

SEQ ID NO: 273570 - RNA, 64 nt, Human; identical to SEQ ID NO: 77134

SEQ ID NO: 273571 - RNA, 64 nt, Human; identical to SEQ ID NO: 77135

SEQ ID NO: 273572 - RNA, 64 nt, Human; identical to SEQ ID NO: 77136

SEQ ID NO: 273573 - RNA, 64 nt, Human; identical to SEQ ID NO: 77137

SEQ ID NO: 273574 - RNA, 64 nt, Human; identical to SEQ ID NO: 77138

SEQ ID NO: 273575 - RNA, 64 nt, Human; identical to SEQ ID NO: 77139

SEQ ID NO: 273576 - RNA, 64 nt, Human; identical to SEQ ID NO: 77140

SEQ ID NO: 273577 - RNA, 64 nt, Human; identical to SEQ ID NO: 77141

SEQ ID NO: 273578 - RNA, 60 nt, Human; identical to SEQ ID NO: 77142

SEQ ID NO: 273579 - RNA, 64 nt, Human; identical to SEQ ID NO: 77143

SEQ ID NO: 273580 - RNA, 64 nt, Human; identical to SEQ ID NO: 77144

SEQ ID NO: 273581 - RNA, 64 nt, Human; identical to SEQ ID NO: 77145

SEQ ID NO: 273582 - RNA, 64 nt, Human
aaaaacaucugaagagcuagucuaucagcaucugacaggugaauuggaugguucucagaaccau

SEQ ID NO: 273583 - RNA, 64 nt, Human
uuuuugucugauaccuggccccgggauagucaggacaggugaauguuggccuggggugugacag

SEQ ID NO: 273584 - RNA, 64 nt, Human
caguggaugcuguuucucaguauuaugacaugugacaggugaacucugggaauuggaccaugca

SEQ ID NO: 273585 - RNA, 64 nt, Human; identical to SEQ ID NO: 77146

SEQ ID NO: 273586 - RNA, 64 nt, Human; identical to SEQ ID NO: 77147

SEQ ID NO: 273587 - RNA, 64 nt, Human; identical to SEQ ID NO: 77148

SEQ ID NO: 273588 - RNA, 64 nt, Human; identical to SEQ ID NO: 77149

SEQ ID NO: 273589 - RNA, 64 nt, Human; identical to SEQ ID NO: 77150

SEQ ID NO: 273590 - RNA, 64 nt, Human; identical to SEQ ID NO: 77151

SEQ ID NO: 273591 - RNA, 64 nt, Human; identical to SEQ ID NO: 77152

SEQ ID NO: 273592 - RNA, 64 nt, Human; identical to SEQ ID NO: 77153

SEQ ID NO: 273593 - RNA, 64 nt, Human; identical to SEQ ID NO: 77154

SEQ ID NO: 273594 - RNA, 64 nt, Human; identical to SEQ ID NO: 77155

SEQ ID NO: 273595 - RNA, 64 nt, Human; identical to SEQ ID NO: 77156

SEQ ID NO: 273596 - RNA, 64 nt, Human; identical to SEQ ID NO: 77157

SEQ ID NO: 273597 - RNA, 64 nt, Human; identical to SEQ ID NO: 77158

SEQ ID NO: 273598 - RNA, 64 nt, Human; identical to SEQ ID NO: 77159

SEQ ID NO: 273599 - RNA, 64 nt, Human; identical to SEQ ID NO: 77160

SEQ ID NO: 273600 - RNA, 64 nt, Human; identical to SEQ ID NO: 77161

SEQ ID NO: 273601 - RNA, 64 nt, Human
aauagauggguaaaaagucuaggcacccugaagaacaggugagacagcuggccucuggacagag

SEQ ID NO: 273602 - RNA, 64 nt, Human
gcagcacacaugggcaggcaguuuacucacacugacaggugaccugaaaguggcacaagugcug

SEQ ID NO: 273603 - RNA, 64 nt, Human
ugaguuaaguaugugcccucaggugugaaggagcacaggugagggggugccugcuguggcacag

SEQ ID NO: 273604 - RNA, 64 nt, Human; identical to SEQ ID NO: 77162

SEQ ID NO: 273605 - RNA, 64 nt, Human; identical to SEQ ID NO: 77163

SEQ ID NO: 273606 - RNA, 64 nt, Human; identical to SEQ ID NO: 77164

SEQ ID NO: 273607 - RNA, 64 nt, Human; identical to SEQ ID NO: 77165

SEQ ID NO: 273608 - RNA, 64 nt, Human; identical to SEQ ID NO: 77166

SEQ ID NO: 273609 - RNA, 64 nt, Human; identical to SEQ ID NO: 77167

SEQ ID NO: 273610 - RNA, 64 nt, Human; identical to SEQ ID NO: 77168

SEQ ID NO: 273611 - RNA, 64 nt, Human; identical to SEQ ID NO: 77169

SEQ ID NO: 273612 - RNA, 64 nt, Human; identical to SEQ ID NO: 77170

SEQ ID NO: 273613 - RNA, 64 nt, Human; identical to SEQ ID NO: 77171

SEQ ID NO: 273614 - RNA, 64 nt, Human; identical to SEQ ID NO: 77172

SEQ ID NO: 273615 - RNA, 64 nt, Human; identical to SEQ ID NO: 77173

SEQ ID NO: 273616 - RNA, 64 nt, Human; identical to SEQ ID NO: 77174

SEQ ID NO: 273617 - RNA, 64 nt, Human; identical to SEQ ID NO: 77175

SEQ ID NO: 273618 - RNA, 64 nt, Human; identical to SEQ ID NO: 77176

SEQ ID NO: 273619 - RNA, 64 nt, Human; identical to SEQ ID NO: 77177

SEQ ID NO: 273620 - RNA, 64 nt, Human
acaucuuaaaggaaugaaguguaaugcuugaugcacaggugauaucuacuacauuuaagcccau

SEQ ID NO: 273621 - RNA, 64 nt, Human
guguauugugauuuuuacauacuaaugaauauaaacaggugauuuuaaaauauuacugugcuuc

SEQ ID NO: 273622 - RNA, 64 nt, Human
gcuugacugugaguguacaggagaagaaguucauacaggugauucguuggaaaaauucauuguc

SEQ ID NO: 273623 - RNA, 64 nt, Human; identical to SEQ ID NO: 77178

SEQ ID NO: 273624 - RNA, 64 nt, Human; identical to SEQ ID NO: 77179

SEQ ID NO: 273625 - RNA, 64 nt, Human; identical to SEQ ID NO: 77180

SEQ ID NO: 273626 - RNA, 64 nt, Human; identical to SEQ ID NO: 77181

SEQ ID NO: 273627 - RNA, 64 nt, Human; identical to SEQ ID NO: 77182

SEQ ID NO: 273628 - RNA, 64 nt, Human; identical to SEQ ID NO: 77183

SEQ ID NO: 273629 - RNA, 64 nt, Human; identical to SEQ ID NO: 77184

SEQ ID NO: 273630 - RNA, 64 nt, Human; identical to SEQ ID NO: 77185

SEQ ID NO: 273631 - RNA, 64 nt, Human; identical to SEQ ID NO: 77186

SEQ ID NO: 273632 - RNA, 64 nt, Human; identical to SEQ ID NO: 77187

SEQ ID NO: 273633 - RNA, 64 nt, Human; identical to SEQ ID NO: 77188

SEQ ID NO: 273634 - RNA, 64 nt, Human; identical to SEQ ID NO: 77189

SEQ ID NO: 273635 - RNA, 64 nt, Human; identical to SEQ ID NO: 77190

SEQ ID NO: 273636 - RNA, 64 nt, Human; identical to SEQ ID NO: 77191

SEQ ID NO: 273637 - RNA, 64 nt, Human; identical to SEQ ID NO: 77192

SEQ ID NO: 273638 - RNA, 64 nt, Human; identical to SEQ ID NO: 77193

SEQ ID NO: 273639 - RNA, 58 nt, Human
uagcugauguucaggcauaagguuguuuacaggugaauucaugacaccuuugacucuu

SEQ ID NO: 273640 - RNA, 64 nt, Human
agaaaucagcucauggcuuaggauggaauuagagacaggugagggacacucaggagcucauuuu

SEQ ID NO: 273641 - RNA, 64 nt, Human
accacuggagaaggaaugagagauaaagaaagagacaggugacaucuaagggaaaugaagagug

SEQ ID NO: 273642 - RNA, 64 nt, Human; identical to SEQ ID NO: 77194

SEQ ID NO: 273643 - RNA, 64 nt, Human; identical to SEQ ID NO: 77195

SEQ ID NO: 273644 - RNA, 64 nt, Human; identical to SEQ ID NO: 77196

SEQ ID NO: 273645 - RNA, 64 nt, Human; identical to SEQ ID NO: 77197

SEQ ID NO: 273646 - RNA, 64 nt, Human; identical to SEQ ID NO: 77198

SEQ ID NO: 273647 - RNA, 64 nt, Human; identical to SEQ ID NO: 77199

SEQ ID NO: 273648 - RNA, 64 nt, Human; identical to SEQ ID NO: 77200

SEQ ID NO: 273649 - RNA, 64 nt, Human; identical to SEQ ID NO: 77201

SEQ ID NO: 273650 - RNA, 64 nt, Human; identical to SEQ ID NO: 77202

SEQ ID NO: 273651 - RNA, 64 nt, Human; identical to SEQ ID NO: 77203

SEQ ID NO: 273652 - RNA, 64 nt, Human; identical to SEQ ID NO: 77204

SEQ ID NO: 273653 - RNA, 64 nt, Human; identical to SEQ ID NO: 77205

SEQ ID NO: 273654 - RNA, 64 nt, Human; identical to SEQ ID NO: 77206

SEQ ID NO: 273655 - RNA, 64 nt, Human; identical to SEQ ID NO: 77207

SEQ ID NO: 273656 - RNA, 64 nt, Human; identical to SEQ ID NO: 77208

SEQ ID NO: 273657 - RNA, 64 nt, Human; identical to SEQ ID NO: 77209

SEQ ID NO: 273658 - RNA, 64 nt, Human
cuaguucuuaaaauuaaauuugcccagguuucugacaggugauaccuggaagagagacuauguc

SEQ ID NO: 273659 - RNA, 64 nt, Human
acugaccucccugaacauuucacgcagucagggaacaggugaggaaagaaauaaauaagugauu

SEQ ID NO: 273660 - RNA, 64 nt, Human
guggauggauagauggauaggugaauguagguggacaggugacuggguggauguuguggucucu

SEQ ID NO: 273661 - RNA, 64 nt, Human; identical to SEQ ID NO: 77210

SEQ ID NO: 273662 - RNA, 64 nt, Human; identical to SEQ ID NO: 77211

SEQ ID NO: 273663 - RNA, 64 nt, Human; identical to SEQ ID NO: 77212

SEQ ID NO: 273664 - RNA, 64 nt, Human; identical to SEQ ID NO: 77213

SEQ ID NO: 273665 - RNA, 64 nt, Human; identical to SEQ ID NO: 77214

SEQ ID NO: 273666 - RNA, 64 nt, Human; identical to SEQ ID NO: 77215

SEQ ID NO: 273667 - RNA, 64 nt, Human; identical to SEQ ID NO: 77216

SEQ ID NO: 273668 - RNA, 64 nt, Human; identical to SEQ ID NO: 77217

SEQ ID NO: 273669 - RNA, 64 nt, Human; identical to SEQ ID NO: 77218

SEQ ID NO: 273670 - RNA, 64 nt, Human; identical to SEQ ID NO: 77219

SEQ ID NO: 273671 - RNA, 64 nt, Human; identical to SEQ ID NO: 77220

SEQ ID NO: 273672 - RNA, 64 nt, Human; identical to SEQ ID NO: 77221

SEQ ID NO: 273673 - RNA, 64 nt, Human; identical to SEQ ID NO: 77222

SEQ ID NO: 273674 - RNA, 64 nt, Human; identical to SEQ ID NO: 77223

SEQ ID NO: 273675 - RNA, 64 nt, Human; identical to SEQ ID NO: 77224

SEQ ID NO: 273676 - RNA, 64 nt, Human; identical to SEQ ID NO: 77225

SEQ ID NO: 273677 - RNA, 64 nt, Human
gagcucugcugcccuugcuggcccugcccuucccacaggugagcagggcuccuguccaccagca

SEQ ID NO: 273678 - RNA, 64 nt, Human
agggaaguccuccagucuaagucacagugcccugacaggugagaagcaaacucccgcuggaagc

SEQ ID NO: 273679 - RNA, 64 nt, Human
ccauugccuguuugggagacaaaaaugaacgaaaacaggugacuuuggaaagcaaagucaaaac

SEQ ID NO: 273680 - RNA, 64 nt, Human; identical to SEQ ID NO: 77226

SEQ ID NO: 273681 - RNA, 64 nt, Human; identical to SEQ ID NO: 77227

SEQ ID NO: 273682 - RNA, 64 nt, Human; identical to SEQ ID NO: 77228

SEQ ID NO: 273683 - RNA, 64 nt, Human; identical to SEQ ID NO: 77229

SEQ ID NO: 273684 - RNA, 64 nt, Human; identical to SEQ ID NO: 77230

SEQ ID NO: 273685 - RNA, 64 nt, Human; identical to SEQ ID NO: 77231

SEQ ID NO: 273686 - RNA, 64 nt, Human; identical to SEQ ID NO: 77232

SEQ ID NO: 273687 - RNA, 64 nt, Human; identical to SEQ ID NO: 77233

SEQ ID NO: 273688 - RNA, 64 nt, Human; identical to SEQ ID NO: 77234

SEQ ID NO: 273689 - RNA, 64 nt, Human; identical to SEQ ID NO: 77235

SEQ ID NO: 273690 - RNA, 64 nt, Human; identical to SEQ ID NO: 77236

SEQ ID NO: 273691 - RNA, 64 nt, Human; identical to SEQ ID NO: 77237

SEQ ID NO: 273692 - RNA, 64 nt, Human; identical to SEQ ID NO: 77238

SEQ ID NO: 273693 - RNA, 64 nt, Human; identical to SEQ ID NO: 77239

SEQ ID NO: 273694 - RNA, 64 nt, Human; identical to SEQ ID NO: 77240

SEQ ID NO: 273695 - RNA, 64 nt, Human; identical to SEQ ID NO: 77241

SEQ ID NO: 273696 - RNA, 64 nt, Human
cccuggaggguagcugggccagacuucucauuucacaggugaggagacuggugccccacaggga

SEQ ID NO: 273697 - RNA, 64 nt, Human
ucugcagugagucugggggcccauggggacagggacaggugaggggcuuccugaggaccugggg

SEQ ID NO: 273698 - RNA, 64 nt, Human
cggcgugagggaucaggcucgccagggccacaggacaggugaugaccuguggccacgcauuugu

SEQ ID NO: 273699 - RNA, 64 nt, Human; identical to SEQ ID NO: 77242

SEQ ID NO: 273700 - RNA, 64 nt, Human; identical to SEQ ID NO: 77243

SEQ ID NO: 273701 - RNA, 64 nt, Human; identical to SEQ ID NO: 77244

SEQ ID NO: 273702 - RNA, 64 nt, Human; identical to SEQ ID NO: 77245

SEQ ID NO: 273703 - RNA, 64 nt, Human; identical to SEQ ID NO: 77246

SEQ ID NO: 273704 - RNA, 64 nt, Human; identical to SEQ ID NO: 77247

SEQ ID NO: 273705 - RNA, 64 nt, Human; identical to SEQ ID NO: 77248

SEQ ID NO: 273706 - RNA, 64 nt, Human; identical to SEQ ID NO: 77249

SEQ ID NO: 273707 - RNA, 64 nt, Human; identical to SEQ ID NO: 77250

SEQ ID NO: 273708 - RNA, 64 nt, Human; identical to SEQ ID NO: 77251

SEQ ID NO: 273709 - RNA, 64 nt, Human; identical to SEQ ID NO: 77252

SEQ ID NO: 273710 - RNA, 64 nt, Human; identical to SEQ ID NO: 77253

SEQ ID NO: 273711 - RNA, 64 nt, Human; identical to SEQ ID NO: 77254

SEQ ID NO: 273712 - RNA, 64 nt, Human; identical to SEQ ID NO: 77255

SEQ ID NO: 273713 - RNA, 64 nt, Human; identical to SEQ ID NO: 77256

SEQ ID NO: 273714 - RNA, 64 nt, Human; identical to SEQ ID NO: 77257

SEQ ID NO: 273715 - RNA, 64 nt, Human
ccagcagggagcagacuuaccuccgaagauggagacaggugacugagagcugcaggccuccucu

SEQ ID NO: 273716 - RNA, 64 nt, Human
uggggccggcagggggcgccaggcagccgugaucacaggugacgaccgcaccgcggccguggga

SEQ ID NO: 273717 - RNA, 64 nt, Human
aaggacaggcucugaguguccaguggcagccagaacaggugacacagagcaggggcuucagcca

SEQ ID NO: 273718 - RNA, 64 nt, Human; identical to SEQ ID NO: 77258

SEQ ID NO: 273719 - RNA, 64 nt, Human; identical to SEQ ID NO: 77259

SEQ ID NO: 273720 - RNA, 64 nt, Human; identical to SEQ ID NO: 77260

SEQ ID NO: 273721 - RNA, 64 nt, Human; identical to SEQ ID NO: 77261

SEQ ID NO: 273722 - RNA, 64 nt, Human; identical to SEQ ID NO: 77262

SEQ ID NO: 273723 - RNA, 64 nt, Human; identical to SEQ ID NO: 77263

SEQ ID NO: 273724 - RNA, 64 nt, Human; identical to SEQ ID NO: 77264

SEQ ID NO: 273725 - RNA, 64 nt, Human; identical to SEQ ID NO: 77265

SEQ ID NO: 273726 - RNA, 64 nt, Human; identical to SEQ ID NO: 77266

SEQ ID NO: 273727 - RNA, 64 nt, Human; identical to SEQ ID NO: 77267

SEQ ID NO: 273728 - RNA, 64 nt, Human; identical to SEQ ID NO: 77268

SEQ ID NO: 273729 - RNA, 64 nt, Human; identical to SEQ ID NO: 77269

SEQ ID NO: 273730 - RNA, 64 nt, Human; identical to SEQ ID NO: 77270

SEQ ID NO: 273731 - RNA, 64 nt, Human; identical to SEQ ID NO: 77271

SEQ ID NO: 273732 - RNA, 64 nt, Human; identical to SEQ ID NO: 77272

SEQ ID NO: 273733 - RNA, 64 nt, Human; identical to SEQ ID NO: 77273

SEQ ID NO: 273734 - RNA, 64 nt, Human
uucuccugccucagccucccgaguagcugggacuacaggugagccccagcaugcccagcuaauu

SEQ ID NO: 273735 - RNA, 64 nt, Human
ugcuuggagaagcagcugcuaguagacccauuuuacaggugagagaaccaagucucacagaggc

SEQ ID NO: 273736 - RNA, 64 nt, Human
agauuuuaaccuuuaaacaacagaucuuuaaaaaacaggugaauacaagugaguuuaacaaaga

SEQ ID NO: 273737 - RNA, 64 nt, Human; identical to SEQ ID NO: 77274

SEQ ID NO: 273738 - RNA, 64 nt, Human; identical to SEQ ID NO: 77275

SEQ ID NO: 273739 - RNA, 64 nt, Human; identical to SEQ ID NO: 77276

SEQ ID NO: 273740 - RNA, 64 nt, Human; identical to SEQ ID NO: 77277

SEQ ID NO: 273741 - RNA, 64 nt, Human; identical to SEQ ID NO: 77278

SEQ ID NO: 273742 - RNA, 64 nt, Human; identical to SEQ ID NO: 77279

SEQ ID NO: 273743 - RNA, 64 nt, Human; identical to SEQ ID NO: 77280

SEQ ID NO: 273744 - RNA, 64 nt, Human; identical to SEQ ID NO: 77281

SEQ ID NO: 273745 - RNA, 64 nt, Human; identical to SEQ ID NO: 77282

SEQ ID NO: 273746 - RNA, 64 nt, Human; identical to SEQ ID NO: 77283

SEQ ID NO: 273747 - RNA, 64 nt, Human; identical to SEQ ID NO: 77284

SEQ ID NO: 273748 - RNA, 64 nt, Human; identical to SEQ ID NO: 77285

SEQ ID NO: 273749 - RNA, 64 nt, Human; identical to SEQ ID NO: 77286

SEQ ID NO: 273750 - RNA, 64 nt, Human; identical to SEQ ID NO: 77287

SEQ ID NO: 273751 - RNA, 64 nt, Human; identical to SEQ ID NO: 77288

SEQ ID NO: 273752 - RNA, 64 nt, Human; identical to SEQ ID NO: 77289

SEQ ID NO: 273753 - RNA, 64 nt, Human
uugccuucaagcagcuaacagaaauaagaagaaaacaggugaaaaagacagugugauaaggcca

SEQ ID NO: 273754 - RNA, 64 nt, Human
auucauacuuuguauaauuuuugauaucaugaucacaggugauucacacguacacacauaaaca

SEQ ID NO: 273755 - RNA, 64 nt, Human
agcccacacuauuuguuggugaucaaacaaagaaacaggugaugaggaugugggaguugaaaga

SEQ ID NO: 273756 - RNA, 64 nt, Human; identical to SEQ ID NO: 77290

SEQ ID NO: 273757 - RNA, 64 nt, Human; identical to SEQ ID NO: 77291

SEQ ID NO: 273758 - RNA, 64 nt, Human; identical to SEQ ID NO: 77292

SEQ ID NO: 273759 - RNA, 64 nt, Human; identical to SEQ ID NO: 77293

SEQ ID NO: 273760 - RNA, 64 nt, Human; identical to SEQ ID NO: 77294

SEQ ID NO: 273761 - RNA, 64 nt, Human; identical to SEQ ID NO: 77295

SEQ ID NO: 273762 - RNA, 64 nt, Human; identical to SEQ ID NO: 77296

SEQ ID NO: 273763 - RNA, 64 nt, Human; identical to SEQ ID NO: 77297

SEQ ID NO: 273764 - RNA, 64 nt, Human; identical to SEQ ID NO: 77298

SEQ ID NO: 273765 - RNA, 64 nt, Human; identical to SEQ ID NO: 77299

SEQ ID NO: 273766 - RNA, 64 nt, Human; identical to SEQ ID NO: 77300

SEQ ID NO: 273767 - RNA, 64 nt, Human; identical to SEQ ID NO: 77301

SEQ ID NO: 273768 - RNA, 64 nt, Human; identical to SEQ ID NO: 77302

SEQ ID NO: 273769 - RNA, 64 nt, Human; identical to SEQ ID NO: 77303

SEQ ID NO: 273770 - RNA, 64 nt, Human; identical to SEQ ID NO: 77304

SEQ ID NO: 273771 - RNA, 64 nt, Human; identical to SEQ ID NO: 77305

SEQ ID NO: 273772 - RNA, 64 nt, Human
aaauaaguucugccugggcauuuuguagauauuaacaggugaauucccgacucuuuugguuuga

SEQ ID NO: 273773 - RNA, 64 nt, Human
uggcacaaaucugaucagagacacauauccauacacaggugaaacacauacagacucaacagca

SEQ ID NO: 273774 - RNA, 64 nt, Human
cucugugugugugugugugugugugaaguuuuuuacaggugaauaaacaaaguuugaaagaugu

SEQ ID NO: 273775 - RNA, 64 nt, Human; identical to SEQ ID NO: 77306

SEQ ID NO: 273776 - RNA, 64 nt, Human; identical to SEQ ID NO: 77307

SEQ ID NO: 273777 - RNA, 64 nt, Human; identical to SEQ ID NO: 77308

SEQ ID NO: 273778 - RNA, 64 nt, Human; identical to SEQ ID NO: 77309

SEQ ID NO: 273779 - RNA, 64 nt, Human; identical to SEQ ID NO: 77310

SEQ ID NO: 273780 - RNA, 64 nt, Human; identical to SEQ ID NO: 77311

SEQ ID NO: 273781 - RNA, 64 nt, Human; identical to SEQ ID NO: 77312

SEQ ID NO: 273782 - RNA, 64 nt, Human; identical to SEQ ID NO: 77313

SEQ ID NO: 273783 - RNA, 64 nt, Human; identical to SEQ ID NO: 77314

SEQ ID NO: 273784 - RNA, 64 nt, Human; identical to SEQ ID NO: 77315

SEQ ID NO: 273785 - RNA, 64 nt, Human; identical to SEQ ID NO: 77316

SEQ ID NO: 273786 - RNA, 64 nt, Human; identical to SEQ ID NO: 77317

SEQ ID NO: 273787 - RNA, 64 nt, Human; identical to SEQ ID NO: 77318

SEQ ID NO: 273788 - RNA, 64 nt, Human; identical to SEQ ID NO: 77319

SEQ ID NO: 273789 - RNA, 64 nt, Human; identical to SEQ ID NO: 77320

SEQ ID NO: 273790 - RNA, 64 nt, Human; identical to SEQ ID NO: 77321

SEQ ID NO: 273791 - RNA, 64 nt, Human
gauuuccuggggcacagugggugaggagauggggacaggugaauggaggaguuaggggagagga

SEQ ID NO: 273792 - RNA, 64 nt, Human
uguuuaaauccucaugucuuugagggaucccaccacaggugaaggaaguaaagaccacuucucc

SEQ ID NO: 273793 - RNA, 64 nt, Human
cccccuccccaggaggagggauggccugacugaaacaggugagaguuugcuucccccuuucagc

SEQ ID NO: 273794 - RNA, 64 nt, Human; identical to SEQ ID NO: 77322

SEQ ID NO: 273795 - RNA, 64 nt, Human; identical to SEQ ID NO: 77323

SEQ ID NO: 273796 - RNA, 64 nt, Human; identical to SEQ ID NO: 77324

SEQ ID NO: 273797 - RNA, 64 nt, Human; identical to SEQ ID NO: 77325

SEQ ID NO: 273798 - RNA, 64 nt, Human; identical to SEQ ID NO: 77326

SEQ ID NO: 273799 - RNA, 61 nt, Human; identical to SEQ ID NO: 77327

SEQ ID NO: 273800 - RNA, 64 nt, Human; identical to SEQ ID NO: 77328

SEQ ID NO: 273801 - RNA, 64 nt, Human; identical to SEQ ID NO: 77329

SEQ ID NO: 273802 - RNA, 64 nt, Human; identical to SEQ ID NO: 77330

SEQ ID NO: 273803 - RNA, 64 nt, Human; identical to SEQ ID NO: 77331

SEQ ID NO: 273804 - RNA, 64 nt, Human; identical to SEQ ID NO: 77332

SEQ ID NO: 273805 - RNA, 64 nt, Human; identical to SEQ ID NO: 77333

SEQ ID NO: 273806 - RNA, 64 nt, Human; identical to SEQ ID NO: 77334

SEQ ID NO: 273807 - RNA, 64 nt, Human; identical to SEQ ID NO: 77335

SEQ ID NO: 273808 - RNA, 64 nt, Human; identical to SEQ ID NO: 77336

SEQ ID NO: 273809 - RNA, 64 nt, Human; identical to SEQ ID NO: 77337

SEQ ID NO: 273810 - RNA, 64 nt, Human
ucuccuacuuuucuuuucuacuguugucuuaacuacaggugauuggaaugccaaacacucuuaa

SEQ ID NO: 273811 - RNA, 64 nt, Human
gccagaagccccucccuucaaggaucucaccuucacaggugagagugaccugcagucucacuca

SEQ ID NO: 273812 - RNA, 64 nt, Human
gggaugaaguagguauuguuacuguucccauuuuacaggugagagauuugaagccuggggaggc

SEQ ID NO: 273813 - RNA, 64 nt, Human; identical to SEQ ID NO: 77338

SEQ ID NO: 273814 - RNA, 64 nt, Human; identical to SEQ ID NO: 77339

SEQ ID NO: 273815 - RNA, 64 nt, Human; identical to SEQ ID NO: 77340

SEQ ID NO: 273816 - RNA, 64 nt, Human; identical to SEQ ID NO: 77341

SEQ ID NO: 273817 - RNA, 64 nt, Human; identical to SEQ ID NO: 77342

SEQ ID NO: 273818 - RNA, 64 nt, Human; identical to SEQ ID NO: 77343

SEQ ID NO: 273819 - RNA, 64 nt, Human; identical to SEQ ID NO: 77344

SEQ ID NO: 273820 - RNA, 64 nt, Human; identical to SEQ ID NO: 77345

SEQ ID NO: 273821 - RNA, 64 nt, Human; identical to SEQ ID NO: 77346

SEQ ID NO: 273822 - RNA, 64 nt, Human; identical to SEQ ID NO: 77347

SEQ ID NO: 273823 - RNA, 64 nt, Human; identical to SEQ ID NO: 77348

SEQ ID NO: 273824 - RNA, 64 nt, Human; identical to SEQ ID NO: 77349

SEQ ID NO: 273825 - RNA, 64 nt, Human; identical to SEQ ID NO: 77350

SEQ ID NO: 273826 - RNA, 64 nt, Human; identical to SEQ ID NO: 77351

SEQ ID NO: 273827 - RNA, 64 nt, Human; identical to SEQ ID NO: 77352

SEQ ID NO: 273828 - RNA, 64 nt, Human; identical to SEQ ID NO: 77353

SEQ ID NO: 273829 - RNA, 64 nt, Human
uccuggcgauuauuuuaaugcuggcuacacccccacaggugacuuggauucagaaauacaauuu

SEQ ID NO: 273830 - RNA, 64 nt, Human
aggcaaguggauuagggggucuggauagggccccacaggugacagggagccugcagggcggauc

SEQ ID NO: 273831 - RNA, 64 nt, Human
caggcaaccucuuuucaaguuggucaggcuuuggacaggugagugauuugcuguauguguuugu

SEQ ID NO: 273832 - RNA, 64 nt, Human; identical to SEQ ID NO: 77354

SEQ ID NO: 273833 - RNA, 64 nt, Human; identical to SEQ ID NO: 77355

SEQ ID NO: 273834 - RNA, 64 nt, Human; identical to SEQ ID NO: 77356

SEQ ID NO: 273835 - RNA, 64 nt, Human; identical to SEQ ID NO: 77357

SEQ ID NO: 273836 - RNA, 64 nt, Human; identical to SEQ ID NO: 77358

SEQ ID NO: 273837 - RNA, 64 nt, Human; identical to SEQ ID NO: 77359

SEQ ID NO: 273838 - RNA, 64 nt, Human; identical to SEQ ID NO: 77360

SEQ ID NO: 273839 - RNA, 64 nt, Human; identical to SEQ ID NO: 77361

SEQ ID NO: 273840 - RNA, 64 nt, Human; identical to SEQ ID NO: 77362

SEQ ID NO: 273841 - RNA, 64 nt, Human; identical to SEQ ID NO: 77363

SEQ ID NO: 273842 - RNA, 64 nt, Human; identical to SEQ ID NO: 77364

SEQ ID NO: 273843 - RNA, 64 nt, Human; identical to SEQ ID NO: 77365

SEQ ID NO: 273844 - RNA, 64 nt, Human; identical to SEQ ID NO: 77366

SEQ ID NO: 273845 - RNA, 64 nt, Human; identical to SEQ ID NO: 77367

SEQ ID NO: 273846 - RNA, 64 nt, Human; identical to SEQ ID NO: 77368

SEQ ID NO: 273847 - RNA, 64 nt, Human; identical to SEQ ID NO: 77369

SEQ ID NO: 273848 - RNA, 64 nt, Human
auuuuucuuuuguuaccaggccuuguucaucaaaacaggugacagugaguaaccaaaugcagac

SEQ ID NO: 273849 - RNA, 64 nt, Human
uauuaaaaagaaaaaaaaaaguugcccuuccuccacaggugauuuaguaaauuuagacaguagu

SEQ ID NO: 273850 - RNA, 64 nt, Human
ugcuucaguuguuucucuucccagccaguaugccacaggugaacuuucgggguugucauuaagu

SEQ ID NO: 273851 - RNA, 64 nt, Human; identical to SEQ ID NO: 77370

SEQ ID NO: 273852 - RNA, 64 nt, Human; identical to SEQ ID NO: 77371

SEQ ID NO: 273853 - RNA, 64 nt, Human; identical to SEQ ID NO: 77372

SEQ ID NO: 273854 - RNA, 64 nt, Human; identical to SEQ ID NO: 77373

SEQ ID NO: 273855 - RNA, 64 nt, Human; identical to SEQ ID NO: 77374

SEQ ID NO: 273856 - RNA, 64 nt, Human; identical to SEQ ID NO: 77375

SEQ ID NO: 273857 - RNA, 64 nt, Human; identical to SEQ ID NO: 77376

SEQ ID NO: 273858 - RNA, 64 nt, Human; identical to SEQ ID NO: 77377

SEQ ID NO: 273859 - RNA, 64 nt, Human; identical to SEQ ID NO: 77378

SEQ ID NO: 273860 - RNA, 64 nt, Human; identical to SEQ ID NO: 77379

SEQ ID NO: 273861 - RNA, 64 nt, Human; identical to SEQ ID NO: 77380

SEQ ID NO: 273862 - RNA, 64 nt, Human; identical to SEQ ID NO: 77381

SEQ ID NO: 273863 - RNA, 64 nt, Human; identical to SEQ ID NO: 77382

SEQ ID NO: 273864 - RNA, 64 nt, Human; identical to SEQ ID NO: 77383

SEQ ID NO: 273865 - RNA, 64 nt, Human; identical to SEQ ID NO: 77384

SEQ ID NO: 273866 - RNA, 64 nt, Human; identical to SEQ ID NO: 77385

SEQ ID NO: 273867 - RNA, 64 nt, Human
uaccaaaaacuagaaauaacccagauauccuucaacaggugauuggauaagcuguugauaucca

SEQ ID NO: 273868 - RNA, 64 nt, Human
ucaaggcaaugacucgaaguuugcaguauggagaacaggugaaugaaauccugugccguucuuc

SEQ ID NO: 273869 - RNA, 64 nt, Human
gucuuuauguucauuuggagagucagggcgaaagacaggugauguagcacuucuguuuuuaaua

SEQ ID NO: 273870 - RNA, 64 nt, Human; identical to SEQ ID NO: 77386

SEQ ID NO: 273871 - RNA, 57 nt, Human; identical to SEQ ID NO: 77387

SEQ ID NO: 273872 - RNA, 64 nt, Human; identical to SEQ ID NO: 77388

SEQ ID NO: 273873 - RNA, 64 nt, Human; identical to SEQ ID NO: 77389

SEQ ID NO: 273874 - RNA, 64 nt, Human; identical to SEQ ID NO: 77390

SEQ ID NO: 273875 - RNA, 64 nt, Human; identical to SEQ ID NO: 77391

SEQ ID NO: 273876 - RNA, 55 nt, Human; identical to SEQ ID NO: 77392

SEQ ID NO: 273877 - RNA, 64 nt, Human; identical to SEQ ID NO: 77393

SEQ ID NO: 273878 - RNA, 64 nt, Human; identical to SEQ ID NO: 77394

SEQ ID NO: 273879 - RNA, 64 nt, Human; identical to SEQ ID NO: 77395

SEQ ID NO: 273880 - RNA, 64 nt, Human; identical to SEQ ID NO: 77396

SEQ ID NO: 273881 - RNA, 64 nt, Human; identical to SEQ ID NO: 77397

SEQ ID NO: 273882 - RNA, 64 nt, Human; identical to SEQ ID NO: 77398

SEQ ID NO: 273883 - RNA, 64 nt, Human; identical to SEQ ID NO: 77399

SEQ ID NO: 273884 - RNA, 64 nt, Human; identical to SEQ ID NO: 77400

SEQ ID NO: 273885 - RNA, 64 nt, Human; identical to SEQ ID NO: 77401

SEQ ID NO: 273886 - RNA, 64 nt, Human
ggugaacugggagaggacuuacucagagaccccaacaggugauacugcacaaagccugguucuu

SEQ ID NO: 273887 - RNA, 64 nt, Human
caaacagaaagccauucugaaacccuacaguaucacaggugagaaaaggugguuauuuuuuccc

SEQ ID NO: 273888 - RNA, 64 nt, Human
aucaccuggugucuguagguggacccggucucccacaggugacaucaaccugaggguggcgucu

SEQ ID NO: 273889 - RNA, 64 nt, Human; identical to SEQ ID NO: 77402

SEQ ID NO: 273890 - RNA, 64 nt, Human; identical to SEQ ID NO: 77403

SEQ ID NO: 273891 - RNA, 64 nt, Human; identical to SEQ ID NO: 77404

SEQ ID NO: 273892 - RNA, 64 nt, Human; identical to SEQ ID NO: 77405

SEQ ID NO: 273893 - RNA, 64 nt, Human; identical to SEQ ID NO: 77406

SEQ ID NO: 273894 - RNA, 64 nt, Human; identical to SEQ ID NO: 77407

SEQ ID NO: 273895 - RNA, 64 nt, Human; identical to SEQ ID NO: 77408

SEQ ID NO: 273896 - RNA, 64 nt, Human; identical to SEQ ID NO: 77409

SEQ ID NO: 273897 - RNA, 64 nt, Human; identical to SEQ ID NO: 77410

SEQ ID NO: 273898 - RNA, 64 nt, Human; identical to SEQ ID NO: 77411

SEQ ID NO: 273899 - RNA, 64 nt, Human; identical to SEQ ID NO: 77412

SEQ ID NO: 273900 - RNA, 64 nt, Human; identical to SEQ ID NO: 77413

SEQ ID NO: 273901 - RNA, 64 nt, Human; identical to SEQ ID NO: 77414

SEQ ID NO: 273902 - RNA, 64 nt, Human; identical to SEQ ID NO: 77415

SEQ ID NO: 273903 - RNA, 64 nt, Human; identical to SEQ ID NO: 77416

SEQ ID NO: 273904 - RNA, 64 nt, Human; identical to SEQ ID NO: 77417

SEQ ID NO: 273905 - RNA, 64 nt, Human
uaccuuucuuauguccuuuaauagcauagacuggacaggugacuauuuauaguggcuucucuuu

SEQ ID NO: 273906 - RNA, 64 nt, Human
gguaaaacagggaaggcagugccugagcauggggacaggugagguggggcugggcagacccccu

SEQ ID NO: 273907 - RNA, 64 nt, Human
uauuuuaguaaauccagaaaagaagacuaaggggacaggugaauaccugcuccucgccuggaug

SEQ ID NO: 273908 - RNA, 64 nt, Human; identical to SEQ ID NO: 77418

SEQ ID NO: 273909 - RNA, 64 nt, Human; identical to SEQ ID NO: 77419

SEQ ID NO: 273910 - RNA, 64 nt, Human; identical to SEQ ID NO: 77420

SEQ ID NO: 273911 - RNA, 64 nt, Human; identical to SEQ ID NO: 77421

SEQ ID NO: 273912 - RNA, 64 nt, Human; identical to SEQ ID NO: 77422

SEQ ID NO: 273913 - RNA, 64 nt, Human; identical to SEQ ID NO: 77423

SEQ ID NO: 273914 - RNA, 64 nt, Human; identical to SEQ ID NO: 77424

SEQ ID NO: 273915 - RNA, 64 nt, Human; identical to SEQ ID NO: 77425

SEQ ID NO: 273916 - RNA, 64 nt, Human; identical to SEQ ID NO: 77426

SEQ ID NO: 273917 - RNA, 64 nt, Human; identical to SEQ ID NO: 77427

SEQ ID NO: 273918 - RNA, 64 nt, Human; identical to SEQ ID NO: 77428

SEQ ID NO: 273919 - RNA, 64 nt, Human; identical to SEQ ID NO: 77429

SEQ ID NO: 273920 - RNA, 64 nt, Human; identical to SEQ ID NO: 77430

SEQ ID NO: 273921 - RNA, 64 nt, Human; identical to SEQ ID NO: 77431

SEQ ID NO: 273922 - RNA, 64 nt, Human; identical to SEQ ID NO: 77432

SEQ ID NO: 273923 - RNA, 64 nt, Human; identical to SEQ ID NO: 77433

SEQ ID NO: 273924 - RNA, 64 nt, Human
auuugguuuuguuuccuuuuguaacaaagugaaaacaggugagacaaugugcccaaaacaaagg

SEQ ID NO: 273925 - RNA, 64 nt, Human
aggaaaaaaaaaaguuugcaaauucagacaggaaacaggugagugguuugaauuggaugcagug

SEQ ID NO: 273926 - RNA, 64 nt, Human
ucagggaaaagaagaacuggaaaugaaacagaggacaggugacaaccaccucgaagagcuccca

SEQ ID NO: 273927 - RNA, 64 nt, Human; identical to SEQ ID NO: 77434

SEQ ID NO: 273928 - RNA, 64 nt, Human; identical to SEQ ID NO: 77435

SEQ ID NO: 273929 - RNA, 64 nt, Human; identical to SEQ ID NO: 77436

SEQ ID NO: 273930 - RNA, 64 nt, Human; identical to SEQ ID NO: 77437

SEQ ID NO: 273931 - RNA, 64 nt, Human; identical to SEQ ID NO: 77438

SEQ ID NO: 273932 - RNA, 64 nt, Human; identical to SEQ ID NO: 77439

SEQ ID NO: 273933 - RNA, 64 nt, Human; identical to SEQ ID NO: 77440

SEQ ID NO: 273934 - RNA, 64 nt, Human; identical to SEQ ID NO: 77441

SEQ ID NO: 273935 - RNA, 64 nt, Human; identical to SEQ ID NO: 77442

SEQ ID NO: 273936 - RNA, 64 nt, Human; identical to SEQ ID NO: 77443

SEQ ID NO: 273937 - RNA, 64 nt, Human; identical to SEQ ID NO: 77444

SEQ ID NO: 273938 - RNA, 64 nt, Human; identical to SEQ ID NO: 77445

SEQ ID NO: 273939 - RNA, 64 nt, Human; identical to SEQ ID NO: 77446

SEQ ID NO: 273940 - RNA, 64 nt, Human; identical to SEQ ID NO: 77447

SEQ ID NO: 273941 - RNA, 64 nt, Human; identical to SEQ ID NO: 77448

SEQ ID NO: 273942 - RNA, 64 nt, Human; identical to SEQ ID NO: 77449

SEQ ID NO: 273943 - RNA, 64 nt, Human
ucuuuagcaauaucagcuaaaaggauaugaaaucacaggugauagcaguugucauucaguaauu

SEQ ID NO: 273944 - RNA, 64 nt, Human
auauuugaaacagauuuuaaaaacuugaaaaauuacaggugagauuucuguuuaugccagauua

SEQ ID NO: 273945 - RNA, 64 nt, Human
uaaccuggugacuggcucuuaucacuucuaguuuacaggugagggaaccaaguuucacagaggc

SEQ ID NO: 273946 - RNA, 64 nt, Human; identical to SEQ ID NO: 77450

SEQ ID NO: 273947 - RNA, 64 nt, Human; identical to SEQ ID NO: 77451

SEQ ID NO: 273948 - RNA, 64 nt, Human; identical to SEQ ID NO: 77452

SEQ ID NO: 273949 - RNA, 64 nt, Human; identical to SEQ ID NO: 77453

SEQ ID NO: 273950 - RNA, 64 nt, Human; identical to SEQ ID NO: 77454

SEQ ID NO: 273951 - RNA, 64 nt, Human; identical to SEQ ID NO: 77455

SEQ ID NO: 273952 - RNA, 64 nt, Human; identical to SEQ ID NO: 77456

SEQ ID NO: 273953 - RNA, 64 nt, Human; identical to SEQ ID NO: 77457

SEQ ID NO: 273954 - RNA, 64 nt, Human; identical to SEQ ID NO: 77458

SEQ ID NO: 273955 - RNA, 64 nt, Human; identical to SEQ ID NO: 77459

SEQ ID NO: 273956 - RNA, 64 nt, Human; identical to SEQ ID NO: 77460

SEQ ID NO: 273957 - RNA, 64 nt, Human; identical to SEQ ID NO: 77461

SEQ ID NO: 273958 - RNA, 64 nt, Human; identical to SEQ ID NO: 77462

SEQ ID NO: 273959 - RNA, 64 nt, Human; identical to SEQ ID NO: 77463

SEQ ID NO: 273960 - RNA, 64 nt, Human; identical to SEQ ID NO: 77464

SEQ ID NO: 273961 - RNA, 64 nt, Human; identical to SEQ ID NO: 77465

SEQ ID NO: 273962 - RNA, 64 nt, Human
aaaagcuggagaguuggauucugcggugcugcugacaggugaacucugguccucugcaccuguu

SEQ ID NO: 273963 - RNA, 64 nt, Human
gggacuccccuauccgccccucacuuacccuuaaacaggugaucccaccugucuugucaaccuc

SEQ ID NO: 273964 - RNA, 64 nt, Human
gaaguuaggguuaaggagaggugaugccaacaagacaggugaguuaaauauaccauuucacaca

SEQ ID NO: 273965 - RNA, 64 nt, Human; identical to SEQ ID NO: 77466

SEQ ID NO: 273966 - RNA, 64 nt, Human; identical to SEQ ID NO: 77467

SEQ ID NO: 273967 - RNA, 64 nt, Human; identical to SEQ ID NO: 77468

SEQ ID NO: 273968 - RNA, 64 nt, Human; identical to SEQ ID NO: 77469

SEQ ID NO: 273969 - RNA, 64 nt, Human; identical to SEQ ID NO: 77470

SEQ ID NO: 273970 - RNA, 64 nt, Human; identical to SEQ ID NO: 77471

SEQ ID NO: 273971 - RNA, 64 nt, Human; identical to SEQ ID NO: 77472

SEQ ID NO: 273972 - RNA, 64 nt, Human; identical to SEQ ID NO: 77473

SEQ ID NO: 273973 - RNA, 64 nt, Human; identical to SEQ ID NO: 77474

SEQ ID NO: 273974 - RNA, 64 nt, Human; identical to SEQ ID NO: 77475

SEQ ID NO: 273975 - RNA, 64 nt, Human; identical to SEQ ID NO: 77476

SEQ ID NO: 273976 - RNA, 64 nt, Human; identical to SEQ ID NO: 77477

SEQ ID NO: 273977 - RNA, 64 nt, Human; identical to SEQ ID NO: 77478

SEQ ID NO: 273978 - RNA, 64 nt, Human; identical to SEQ ID NO: 77479

SEQ ID NO: 273979 - RNA, 64 nt, Human; identical to SEQ ID NO: 77480

SEQ ID NO: 273980 - RNA, 64 nt, Human; identical to SEQ ID NO: 77481

SEQ ID NO: 273981 - RNA, 64 nt, Human
cugucauacguuauugugagcuuugguucuuugaacaggugaucuauucucuuacauuuugugc

SEQ ID NO: 273982 - RNA, 64 nt, Human
gagaguguagaaaucccagugguagcauguaccaacaggugaguagaaagguaguguuagccug

SEQ ID NO: 273983 - RNA, 64 nt, Human
cuuacaauuaggaacugaguauguguaacaggauacaggugacagugaagauagaagaaccacg

SEQ ID NO: 273984 - RNA, 64 nt, Human; identical to SEQ ID NO: 77482

SEQ ID NO: 273985 - RNA, 64 nt, Human; identical to SEQ ID NO: 77483

SEQ ID NO: 273986 - RNA, 64 nt, Human; identical to SEQ ID NO: 77484

SEQ ID NO: 273987 - RNA, 64 nt, Human; identical to SEQ ID NO: 77485

SEQ ID NO: 273988 - RNA, 64 nt, Human; identical to SEQ ID NO: 77486

SEQ ID NO: 273989 - RNA, 64 nt, Human; identical to SEQ ID NO: 77487

SEQ ID NO: 273990 - RNA, 64 nt, Human; identical to SEQ ID NO: 77488

SEQ ID NO: 273991 - RNA, 64 nt, Human; identical to SEQ ID NO: 77489

SEQ ID NO: 273992 - RNA, 64 nt, Human; identical to SEQ ID NO: 77490

SEQ ID NO: 273993 - RNA, 64 nt, Human; identical to SEQ ID NO: 77491

SEQ ID NO: 273994 - RNA, 64 nt, Human; identical to SEQ ID NO: 77073

SEQ ID NO: 273995 - RNA, 64 nt, Human; identical to SEQ ID NO: 77493

SEQ ID NO: 273996 - RNA, 64 nt, Human; identical to SEQ ID NO: 77494

SEQ ID NO: 273997 - RNA, 64 nt, Human; identical to SEQ ID NO: 77495

SEQ ID NO: 273998 - RNA, 64 nt, Human; identical to SEQ ID NO: 77496

SEQ ID NO: 273999 - RNA, 64 nt, Human; identical to SEQ ID NO: 77497

SEQ ID NO: 274000 - RNA, 64 nt, Human
aaaaaucacagcuuccuugucggaggggaaaaggacaggugaucuggggaaaacgcagcuacac

SEQ ID NO: 274001 - RNA, 64 nt, Human
acacaagagcugagaugucacauucgucagcauuacaggugaucuauuuugguggcauuuugua

SEQ ID NO: 274002 - RNA, 64 nt, Human
uuuccugcugauuuuuucuacugcugauuuuugcacaggugagauaauuuugaacagagaauuu

SEQ ID NO: 274003 - RNA, 64 nt, Human; identical to SEQ ID NO: 77498

SEQ ID NO: 274004 - RNA, 64 nt, Human; identical to SEQ ID NO: 77499

SEQ ID NO: 274005 - RNA, 64 nt, Human; identical to SEQ ID NO: 77500

SEQ ID NO: 274006 - RNA, 64 nt, Human; identical to SEQ ID NO: 77501

SEQ ID NO: 274007 - RNA, 64 nt, Human; identical to SEQ ID NO: 77502

SEQ ID NO: 274008 - RNA, 64 nt, Human; identical to SEQ ID NO: 77503

SEQ ID NO: 274009 - RNA, 64 nt, Human; identical to SEQ ID NO: 77504

SEQ ID NO: 274010 - RNA, 64 nt, Human; identical to SEQ ID NO: 77505

SEQ ID NO: 274011 - RNA, 64 nt, Human; identical to SEQ ID NO: 77506

SEQ ID NO: 274012 - RNA, 64 nt, Human; identical to SEQ ID NO: 77507

SEQ ID NO: 274013 - RNA, 64 nt, Human; identical to SEQ ID NO: 77508

SEQ ID NO: 274014 - RNA, 64 nt, Human; identical to SEQ ID NO: 77509

SEQ ID NO: 274015 - RNA, 64 nt, Human; identical to SEQ ID NO: 77510

SEQ ID NO: 274016 - RNA, 64 nt, Human; identical to SEQ ID NO: 77511

SEQ ID NO: 274017 - RNA, 64 nt, Human; identical to SEQ ID NO: 77512

SEQ ID NO: 274018 - RNA, 64 nt, Human; identical to SEQ ID NO: 77513

SEQ ID NO: 274019 - RNA, 64 nt, Human
ucauuugcuagucacggacagugauuccugccucacaggugaagauuaaagagacaacgaaugu

SEQ ID NO: 274020 - RNA, 64 nt, Human
uugggaugaaccaggggucuggccccaucgggucacaggugauggcaaauagaaaagaagcaaa

SEQ ID NO: 274021 - RNA, 64 nt, Human
uggauuugcaggccagggagaaaauguccaaguaacaggugaaguuuauuugccugacguuuac

SEQ ID NO: 274022 - RNA, 64 nt, Human; identical to SEQ ID NO: 77514

SEQ ID NO: 274023 - RNA, 64 nt, Human; identical to SEQ ID NO: 77515

SEQ ID NO: 274024 - RNA, 64 nt, Human; identical to SEQ ID NO: 77516

SEQ ID NO: 274025 - RNA, 64 nt, Human; identical to SEQ ID NO: 77517

SEQ ID NO: 274026 - RNA, 64 nt, Human; identical to SEQ ID NO: 77518

SEQ ID NO: 274027 - RNA, 64 nt, Human; identical to SEQ ID NO: 77519

SEQ ID NO: 274028 - RNA, 64 nt, Human; identical to SEQ ID NO: 77520

SEQ ID NO: 274029 - RNA, 64 nt, Human; identical to SEQ ID NO: 77521

SEQ ID NO: 274030 - RNA, 64 nt, Human; identical to SEQ ID NO: 77522

SEQ ID NO: 274031 - RNA, 64 nt, Human; identical to SEQ ID NO: 77523

SEQ ID NO: 274032 - RNA, 64 nt, Human; identical to SEQ ID NO: 77524

SEQ ID NO: 274033 - RNA, 64 nt, Human; identical to SEQ ID NO: 77525

SEQ ID NO: 274034 - RNA, 64 nt, Human; identical to SEQ ID NO: 77526

SEQ ID NO: 274035 - RNA, 64 nt, Human; identical to SEQ ID NO: 77527

SEQ ID NO: 274036 - RNA, 64 nt, Human; identical to SEQ ID NO: 77528

SEQ ID NO: 274037 - RNA, 64 nt, Human; identical to SEQ ID NO: 77529

SEQ ID NO: 274038 - RNA, 64 nt, Human
uauauuggcagguauguguguaaucucagaauacacaggugacauagauaugauaugacaacug

SEQ ID NO: 274039 - RNA, 64 nt, Human
cauaacccuguuccucaccaucaugauaccagauacaggugaauacauaggaacuaucugccug

SEQ ID NO: 274040 - RNA, 64 nt, Human
guggaagggagcacauaaccagcuguuuggcaugacaggugacuuaguauauuuguaauugguu

SEQ ID NO: 274041 - RNA, 64 nt, Human; identical to SEQ ID NO: 77530

SEQ ID NO: 274042 - RNA, 64 nt, Human; identical to SEQ ID NO: 77531

SEQ ID NO: 274043 - RNA, 64 nt, Human; identical to SEQ ID NO: 77532

SEQ ID NO: 274044 - RNA, 64 nt, Human; identical to SEQ ID NO: 77533

SEQ ID NO: 274045 - RNA, 64 nt, Human; identical to SEQ ID NO: 77534

SEQ ID NO: 274046 - RNA, 64 nt, Human; identical to SEQ ID NO: 77535

SEQ ID NO: 274047 - RNA, 64 nt, Human; identical to SEQ ID NO: 77536

SEQ ID NO: 274048 - RNA, 64 nt, Human; identical to SEQ ID NO: 77537

SEQ ID NO: 274049 - RNA, 64 nt, Human
ugcauauagacgcaucuauuggaaaugcaguuccacaggugagcauguucuuucuggugaccug

SEQ ID NO: 274050 - RNA, 64 nt, Human
agauggggcuaggacugugggcuuuuagcagcccacaggugauccuaacauaucaggccaugga

SEQ ID NO: 274051 - RNA, 64 nt, Human
ugguagccucugugcacuguuugguggccacaucacaggugauguccuguucacauaccugcuu

SEQ ID NO: 274052 - RNA, 64 nt, Human
cucucucucugccuccccccccauccugucaggcacaggugacgggggcagcccaugcgagccc

SEQ ID NO: 274053 - RNA, 64 nt, Human
gccccugccggugggugauggauaucauccccgaacaggugaagggacaacugacuagcagccc

SEQ ID NO: 274054 - RNA, 60 nt, Human
aaugacagaccugaauaaaauguauuaagcagcagugaucuuuccucuccuccuucccaa

SEQ ID NO: 274055 - RNA, 60 nt, Human
agaagagacaguccaaggggacuggaucccagcagugauguugguugaggcagcaaacag

SEQ ID NO: 274056 - RNA, 60 nt, Human
ggacucucgucugcacugcguguccucugaagcagugaagucugugccuaugccgagcgc

SEQ ID NO: 274057 - RNA, 60 nt, Human
cuggcaaguuaccaagguuguuccugaaacagcagugaucaugacuucuccuuuccagag

SEQ ID NO: 274058 - RNA, 60 nt, Human
ucauagcuuaaaguauaaaaaagauucaagagcagugagguuuguucuuuccagugaaug

SEQ ID NO: 274059 - RNA, 60 nt, Human
aaucagggccucagcaagcagaggagacacagcagugagggaggcgucaagguacuagua

SEQ ID NO: 274060 - RNA, 60 nt, Human
aucuuuaacugacuucuguccacucuggagagcagugaggaauuaaucuugcuuuugcuu

SEQ ID NO: 274061 - RNA, 60 nt, Human
uccugcacaaccucccucacagaacagggaagcagugacagcugcagauggcagcgggcc

SEQ ID NO: 274062 - RNA, 60 nt, Human
uacgagauuagaguuaaaucagugguccugagcagugauuccaaacucucacugugccuu

SEQ ID NO: 274063 - RNA, 60 nt, Human
uguacagaucagcagagcaggacaguuggcagcagugaccucaguagggaacauguccgu

SEQ ID NO: 274064 - RNA, 60 nt, Human
ccuggggcauggacuuuguuaagcagagucagcagugagguccucauucuccagccagcc

SEQ ID NO: 274065 - RNA, 60 nt, Human
ugggaacugugaagaggcacccuggcaagcagcagugauugggggaggggacaggaucua

SEQ ID NO: 274066 - RNA, 60 nt, Human
cacuacaauguaagcuauagguggagcaucagcagugagugaggccauucuucauccuua

SEQ ID NO: 274067 - RNA, 62 nt, Human
aggauccccacccaaagccugauggcaccccggcuggccaugcuguccccucccuguggcgu

SEQ ID NO: 274068 - RNA, 62 nt, Human
gguguuggucccagaauugggaccggggccccgcuggccagcccugggccacuucccggguc

SEQ ID NO: 274069 - RNA, 62 nt, Human
ucccuuucaggcugggccacagggaguugcuggcuggccacuugacacccucccccuggagc

SEQ ID NO: 274070 - RNA, 60 nt, Human
gucaauauaauagaguaagauacacuuuuuagcagugaacuuuuaaaaaauucuuuuacu

SEQ ID NO: 274071 - RNA, 60 nt, Human
aaacugcuuugggauggaaccucgagcccuagcagugaagaagauuccauuucuugucca

SEQ ID NO: 274072 - RNA, 60 nt, Human
gcccggagugauuguuuucuccuugcuuuaagcagugaaguuauccuaaugcaaaagagc

SEQ ID NO: 274073 - RNA, 60 nt, Human
acuacggcauucucugugacuuccuuaaacagcagugaugggaagggauccaauaguauc

SEQ ID NO: 274074 - RNA, 60 nt, Human
gagaacggcugaaauggugcccaguccaucagcagugauggaauuugcuggaggacuagg

SEQ ID NO: 274075 - RNA, 60 nt, Human
cauugacccagauacugcugugugcugcacagcagugaaccaacacuagagggagccaca

SEQ ID NO: 274076 - RNA, 60 nt, Human
uuaauccuacuaaugugcagccauugcccaagcagugacugcguugcauacauuuggcac

SEQ ID NO: 274077 - RNA, 60 nt, Human
gucccgcguugcaucuccuccugaaagaaaagcagugauaccugaauaaugcuggcucuc

SEQ ID NO: 274078 - RNA, 60 nt, Human
ccucagcaguagugaugugugugucucaugagcagugagcacagucugcauucaucauga

SEQ ID NO: 274079 - RNA, 60 nt, Human
cucauagaacccagccuacucuagaauuucagcagugacauuggagaauauuuuuaauuu

SEQ ID NO: 274080 - RNA, 60 nt, Human
aaggaccagcagggagaaaugucuucucccagcagugaauucuguuaugcaauuuauucu

SEQ ID NO: 274081 - RNA, 60 nt, Human
auaagcuggaucuaaagaaauuacccagugagcagugaggagaaacaaggagcuagaaaa

SEQ ID NO: 274082 - RNA, 60 nt, Human
cacugguuagauuaaaaagaggcugagaugagcagugaacuaagaggccacacaaaagca

SEQ ID NO: 274083 - RNA, 60 nt, Human
ggcgcuguuuuuuugggaccuugcgugaagagcagugagcaggguuccugugguuucccu

SEQ ID NO: 274084 - RNA, 62 nt, Human
gauuaugccaaggccguggggcucuguaccacgcuggccaucugucuccuguauguggguca

SEQ ID NO: 274085 - RNA, 62 nt, Human
gugacagaacaugcagcaaggggacaucuuaggcuggccagacuucagcuguuccuuugaag

SEQ ID NO: 274086 - RNA, 62 nt, Human
uuuuacuuuguuguucugauuuuaggacucuggcuggccaugugcuugugguugccucuccu

SEQ ID NO: 274087 - RNA, 60 nt, Human
gcaggccuuguagaaugagguuguaucaauagcagugacaaaacgcacacaucaacccac

SEQ ID NO: 274088 - RNA, 60 nt, Human
gggaauauccuaagugguagccuuccaaguagcagugaguugacauucagcugcuuuuaa

SEQ ID NO: 274089 - RNA, 60 nt, Human
cuaaaaaugagggcaaaacacuaaggcucuagcagugacuuguucacuaaaaagagagag

SEQ ID NO: 274090 - RNA, 60 nt, Human
agcgcccacacccuucuagcaccuccugacagcagugagaagaucugcaccguccaguug

SEQ ID NO: 274091 - RNA, 59 nt, Human
gugagaaacaauuaaaugugauuuaacguaagcagugaauggggcuagaggcagugugg

SEQ ID NO: 274092 - RNA, 60 nt, Human
aaaaaaaacaaaaaacaacaccaaaaaaacagcagugauauauauauauauauauauaua

SEQ ID NO: 274093 - RNA, 60 nt, Human
guggggcuugaaaugagcccaggaaaccagagcagugagggcgggcggggcauuucaccc

SEQ ID NO: 274094 - RNA, 60 nt, Human
ucugagcuggccagccccucggggcugcagagcagugagccuacaucugccacucagccg

SEQ ID NO: 274095 - RNA, 60 nt, Human
agugcccauuggcuguguaugacgggaggcagcagugagaggccuuccuaguuagggcca

SEQ ID NO: 274096 - RNA, 60 nt, Human
aagguugcggaaaucgggguggagauggggagcagugacuccuccaaauauucauugcua

SEQ ID NO: 274097 - RNA, 60 nt, Human
agaagauuaggggaaaagaggucaccuuccagcagugaaaugaacaaauagaagaugaga

SEQ ID NO: 274098 - RNA, 60 nt, Human
acugaaccccaggccuccugggacuggagcagcagugaggcaaaacccgaccugcuagcc

SEQ ID NO: 274099 - RNA, 60 nt, Human
uacucccugcaacaggaggaauagaaaugaagcagugaguguucagaaauuagaucuaca

SEQ ID NO: 274100 - RNA, 60 nt, Human
aguacucuuaagagcaucuuccaagacuccagcagugagcauuuagagaguguguugucu

SEQ ID NO: 274101 - RNA, 62 nt, Human
auaccgacgucuauccuuuccugcuaggcagugcuggccaggcucauguguagugugcgaga

SEQ ID NO: 274102 - RNA, 62 nt, Human
gggcagaggcagaagcccacauaugcugugacgcuggccaccuuuucucagcuucugaggcu

SEQ ID NO: 274103 - RNA, 62 nt, Human
ggagcccauggaacacaaguuaaagagguuuugcuggccagguaugguggcucacgccugua

SEQ ID NO: 274104 - RNA, 60 nt, Human
acuuugaaauagguucugccagucuacaauagcagugaagacugacaaaucagauauucc

SEQ ID NO: 274105 - RNA, 60 nt, Human
cuuucuuuguccagucuuuuguuuuuaauaagcagugacccucccuacucuucuuuuuaa

SEQ ID NO: 274106 - RNA, 60 nt, Human
ucuuccuccgugaagcuucucccucagcugagcagugaucacuuacucacucuuaacccc

SEQ ID NO: 274107 - RNA, 60 nt, Human
augguuaauauauauguagauauauauuuuagcagugacauucccagagagccccagagc

SEQ ID NO: 274108 - RNA, 60 nt, Human
gaauuagaguuccaccuuuauucauuguugagcagugauuuauauuuaguuauuauauuu

SEQ ID NO: 274109 - RNA, 60 nt, Human
acacggccucgcagcaaagugugucagacgagcagugacgggcgugcggccgggcgggga

SEQ ID NO: 274110 - RNA, 60 nt, Human
gucgcccuuucuuaccaucugagccgucagagcagugacccaucuguacucaugugagug

SEQ ID NO: 274111 - RNA, 60 nt, Human
caauuuuuaaaaaucucauuucuacaucuuagcagugacaaacugcaauuuaaaaagugu

SEQ ID NO: 274112 - RNA, 60 nt, Human
guauuugguugcuugucacaacauucuccaagcagugauauuucuaaagaggagauacau

SEQ ID NO: 274113 - RNA, 60 nt, Human
cagaaggccuggcuggcugugacuuaccauagcagugacaauggcagucuuggcuuuaaa

SEQ ID NO: 274114 - RNA, 60 nt, Human
guuuauacugggaaaugcuuuguaccaaguagcagugacuagacccacagacaugaaaag

SEQ ID NO: 274115 - RNA, 60 nt, Human
uccuggcucugggggacccaggugggacuuagcagugaguauuggaagacuuggguugau

SEQ ID NO: 274116 - RNA, 60 nt, Human
ugaaagauaauuaagaucccccguggagaaagcagugacacauucacacagcuguucccu

SEQ ID NO: 274117 - RNA, 60 nt, Human
uaguaauagcuaaaaaugccaaucuauggaagcagugauuuucaauauaaaguucuauuu

SEQ ID NO: 274118 - RNA, 62 nt, Human
ugcuugugacagaugccaggagguagaugugugcuggccaauaaaggccccuaccugauucc

SEQ ID NO: 274119 - RNA, 62 nt, Human
uccuggcugucugagugggcacuugucuggcugcuggccagcagugaagggccacuugguga

SEQ ID NO: 274120 - RNA, 62 nt, Human
cgcagcgccuggugcgcgugcugcagaucugugcuggccacgugcccggugucucagcucug

SEQ ID NO: 274121 - RNA, 60 nt, Human
acuuugaauugcuugugauuucaaaaauaaagcagugaagcaauacuuguguacacuggu

SEQ ID NO: 274122 - RNA, 60 nt, Human
ugauggggcugggcuuugggcuugccugccagcagugaugucccacccuguucacccagc

SEQ ID NO: 274123 - RNA, 60 nt, Human
ucuuuaagcugguaaagugaggggcccaccagcagugaucuccugaugccuuacuggaaa

SEQ ID NO: 274124 - RNA, 60 nt, Human
gcaggugcuguguggccgugaugugcagagagcagugagggaggguucaugaaccaggug

SEQ ID NO: 274125 - RNA, 60 nt, Human
agggagacccaagaaagagucagguuagggagcagugaaagugaggagggaagacaauuc

SEQ ID NO: 274126 - RNA, 60 nt, Human
ggcacccuuauauauguuuuccaaacuuucagcagugauauuauuuccauaacuuaaaaa

SEQ ID NO: 274127 - RNA, 60 nt, Human
acuuguuucauuucuguguuuaaacuucugagcagugagacaucccugugagcagauaca

SEQ ID NO: 274128 - RNA, 60 nt, Human
auuucuuuguuucuccagaguguuauggaaagcagugacagaugugcuuuaucaucucca

SEQ ID NO: 274129 - RNA, 60 nt, Human
aggagaaugacuuuuccagaauagaaguggagcagugaucauuauucuccgcuuucucuu

SEQ ID NO: 274130 - RNA, 60 nt, Human
uccuacaaacuauaauuuuuuccaugauuuagcagugagugauuuucuagcuuuggcucu

SEQ ID NO: 274131 - RNA, 60 nt, Human
ggagcacaauuucccuucauacuccuuuuaagcagugaguuauggugguggucucaugaa

SEQ ID NO: 274132 - RNA, 60 nt, Human
uaugagaauuuuucugaaucauauuggggaagcagugauuuuaaaaccucaaguuuuuaa

SEQ ID NO: 274133 - RNA, 60 nt, Human
gucgcugcuucuagaaucuaugcaggggauagcagugaggucagaagucuuucccgggag

SEQ ID NO: 274134 - RNA, 60 nt, Human
uucuuuucuugggagccaguggauuuuuccagcagugaagggacauucucuacacucaga

SEQ ID NO: 274135 - RNA, 62 nt, Human
guucacuugggaggauggcaguaggagccagggcuggccauggguccccuacccuuccccgu

SEQ ID NO: 274136 - RNA, 62 nt, Human
caccuggcacuggugacuacagacguucucaggcuggccagaagagacaucuuggguuccuu

SEQ ID NO: 274137 - RNA, 62 nt, Human
caaaggggcagcccuggcccucccuccccucugcuggccagagggucugcaucucagcccac

SEQ ID NO: 274138 - RNA, 60 nt, Human
uguuuuaaaggcuaauuaucagcucaguagagcagugagaaacugaucaaauugcacuug

SEQ ID NO: 274139 - RNA, 60 nt, Human
aagcaggcuuugugaaaauguaauacaaacagcagugaaugggacucaaauguugugcuu

SEQ ID NO: 274140 - RNA, 60 nt, Human
auaaagucauauuucaugucaaaggaaaucagcagugauagaugaaggguucgcagcgag

SEQ ID NO: 274141 - RNA, 60 nt, Human
ucaguucugacuugccuuaccuggguggacagcagugaaucuccaccugucuucuccagg

SEQ ID NO: 274142 - RNA, 60 nt, Human
cugaacugccuucucugcacgcuugaccaaagcagugaugagggcggccaguaccugcgg

SEQ ID NO: 274143 - RNA, 60 nt, Human
caaacaagcaaaaaaccucaaauuuuuuucagcagugagagagaauaguaaagagaggcc

SEQ ID NO: 274144 - RNA, 60 nt, Human
aauaaaugcacacuucugacuauaauuuugagcagugaaggaaggaugacugccuguuac

SEQ ID NO: 274145 - RNA, 60 nt, Human
guaaacccccaguugugaaaacugcaguuuagcagugaccucagcaaccccuccuuuuua

SEQ ID NO: 274146 - RNA, 60 nt, Human
ggaccaaaaaaauaagguguauugcgucuuagcagugauuuuuauccaaucuuguuucca

SEQ ID NO: 274147 - RNA, 60 nt, Human
gauuugaauaaucacuuuaagucuuugggaagcagugauuugaaauuuugaggugacagg

SEQ ID NO: 274148 - RNA, 60 nt, Human
uucacaccucccagcuucugcccaaccuucagcagugacaaguccccaagagacucgccu

SEQ ID NO: 274149 - RNA, 60 nt, Human
aaaaaacauuuucuugaauggcaugcuaguagcagugagcaaaggugugggugugaaagg

SEQ ID NO: 274150 - RNA, 60 nt, Human
gcacuguccagagucaacaugaugugguuuagcagugaucacaucuaaacaaaguuuagg

SEQ ID NO: 274151 - RNA, 60 nt, Human
uaacuaagacuuucuuguagcaaucucguaagcagugaacccccucagaucaguagaaua

SEQ ID NO: 274152 - RNA, 62 nt, Human
uuguauuuucaguagagacagcguuuugccaugcuggccaggcucgucucgaacuccugacc

SEQ ID NO: 274153 - RNA, 62 nt, Human
ccaccaccucccucuaggaugcccccucaggggcuggccaggcccugcucaacaucuggaga

SEQ ID NO: 274154 - RNA, 62 nt, Human
uaacucugugagguuacugagauuugagcugugcuggccagcgcauugccucacagucacgc

SEQ ID NO: 274155 - RNA, 60 nt, Human
agauccuguucugagucagaugaugaugacagcagugaaacuccuccucacuggaaagag

SEQ ID NO: 274156 - RNA, 60 nt, Human
uguaguagaucaucuucauauacuucuauuagcagugaugauggaaggcgagcuaagagg

SEQ ID NO: 274157 - RNA, 60 nt, Human
caucuggccgcuagcacgcuuccugcucagagcagugaagaccggcucacuucacuguuc

SEQ ID NO: 274158 - RNA, 60 nt, Human
ccaaacaaaagccagucauguaacucuagaagcagugacugguggggcuuucugacaguu

SEQ ID NO: 274159 - RNA, 60 nt, Human
gacuacugggcaaagaguguagaucagagcagcagugaaaacaagugcuggcaccaccag

SEQ ID NO: 274160 - RNA, 60 nt, Human
acuccuuuccuuaccacaucaacugauuaaagcagugaccagcaggaacugcccagagaa

SEQ ID NO: 274161 - RNA, 60 nt, Human
gggagacagaccccaccuccuuggguagugagcagugagcagaaagcugugaacaggcug

SEQ ID NO: 274162 - RNA, 60 nt, Human
gugauucccuugcacagucagggccaagagagcagugaccacugaggauucagacacugu

SEQ ID NO: 274163 - RNA, 60 nt, Human
ucugggacugugagacaaggaagcagggccagcagugagacuaugagccaagcaaagaga

SEQ ID NO: 274164 - RNA, 60 nt, Human
uaacgaggauuucccugaagcuaugucucuagcagugaguacucauaaaggacacuggau

SEQ ID NO: 274165 - RNA, 60 nt, Human
guccauuuucuaugcuuguaacugucuucuagcagugagccaaauguaaaauagugaaua

SEQ ID NO: 274166 - RNA, 60 nt, Human
uagguucccuccuugcuggcauaaaggccaagcagugaaaugaaccuuggguuagaguua

SEQ ID NO: 274167 - RNA, 60 nt, Human
auuaaauaacaaguuguguucaagagucagagcagugagcucagaggcccuucucacuga

SEQ ID NO: 274168 - RNA, 60 nt, Human
auucaugauaaaacauuuugagaagggguaagcagugaguuauuacccacaauuuaaagc

SEQ ID NO: 274169 - RNA, 62 nt, Human
cacuucggaguccaccaccgagaucaccugcagcuggccacaccacaggcccccgugccugc

SEQ ID NO: 274170 - RNA, 62 nt, Human
gugggcacugcugggcugaguucacccccagggcuggccagauggggccaggagggacagag

SEQ ID NO: 274171 - RNA, 62 nt, Human
acagaucugggagccagcagcuggaugcuguggcuggccagagacaccuccaggcuguggcc

SEQ ID NO: 274172 - RNA, 60 nt, Human
ugcccagaaauaaggaugccagugcccagaagcagugagauuagucuguguccacaagca

SEQ ID NO: 274173 - RNA, 60 nt, Human
ccugcccaucaggugcaagugguagggacaagcagugaggugguggccaugacacuggag

SEQ ID NO: 274174 - RNA, 60 nt, Human
ggagaugggggacagugcuguuguggggccagcagugaaucuguaugcggagaguugugu

SEQ ID NO: 274175 - RNA, 60 nt, Human
aauaaauauaguuguuacugguccuguuguagcagugaauauaguuaaaauacguacauu

SEQ ID NO: 274176 - RNA, 60 nt, Human
augaggagagcucugauucucccauccgggagcagugaugucaaacuucugcugcugggg

SEQ ID NO: 274177 - RNA, 60 nt, Human
gccuuuuuaccaauuauaaggaaaauuuacagcagugaacaugaacauucacuuagcuuc

SEQ ID NO: 274178 - RNA, 60 nt, Human
uccacaaggaguggugguacagccagccgcagcagugacuacaauaguugcaccagggca

SEQ ID NO: 274179 - RNA, 60 nt, Human
uggacccugucuucugggcacaguggacucagcagugaccacaccaacacugacccuuga

SEQ ID NO: 274180 - RNA, 60 nt, Human
aaaaucaacaugaguggcuacauccuguucagcagugagaugagggcugugauuaaggcc

SEQ ID NO: 274181 - RNA, 60 nt, Human
aaggaaaaaaaaaaaaacacgucaaaaguuagcagugaaauuguucuccauuuguuguac

SEQ ID NO: 274182 - RNA, 60 nt, Human
guuaaaaauacuuauauauuucuauuacaaagcagugacaaaugaugcccugugugacuu

SEQ ID NO: 274183 - RNA, 60 nt, Human
aucucuuagauuuacauuauaacuacauaaagcagugaagcaaaggcaaauuaagauaaa

SEQ ID NO: 274184 - RNA, 60 nt, Human
agggauaauccagguaacuuugaagagaugagcagugagugaccaggcaguuuuucugcc

SEQ ID NO: 274185 - RNA, 60 nt, Human
cugcaacauuggugagaugagugaugguccagcagugaacuugggccauggaugauguua

SEQ ID NO: 274186 - RNA, 64 nt, Human
cuugucuguccacggggguggcuuuugcaaagaugaccggcauagggcaugccagcuccuugag

SEQ ID NO: 274187 - RNA, 64 nt, Human
ucgggccgcugcccccaugcucgcgcugggcagggaccggcagcccuggaaggggcacuugaua

SEQ ID NO: 274188 - RNA, 64 nt, Human
gcacgguggucggccuggugugaggccccccggggaccggcaguguguccagggaggggauggc

SEQ ID NO: 274189 - RNA, 60 nt, Human
gagaaucaaccaaaggugauucuccuaaagagcagugaaggaaaugucagguuagcagga

SEQ ID NO: 274190 - RNA, 60 nt, Human
ggugaaacacccacauggcagccugcuagcagcagugacuuugacuucuggucuuaaaga

SEQ ID NO: 274191 - RNA, 60 nt, Human
cuggguggguuuuaaacagaaugccuauguagcagugauagacauauuccccuccuuuga

SEQ ID NO: 274192 - RNA, 60 nt, Human
caaaagacuugcuucaagguguuuuuaaauagcagugauucagaauuuuuuuuaaugaaa

SEQ ID NO: 274193 - RNA, 60 nt, Human
cacaauaugaauacagggcaugcauuuugcagcagugagucucuucagaaaacccuuuuc

SEQ ID NO: 274194 - RNA, 60 nt, Human
uccaguaggggcuguugccuccaauaaagcagcagugagcuuugccuugguggcuggggc

SEQ ID NO: 274195 - RNA, 60 nt, Human
ccguccugugcccugguccaggaugcugacagcagugagaggccugccgugagguuuggu

SEQ ID NO: 274196 - RNA, 60 nt, Human
uuuuuuuuugacauagaaggauauagugggagcagugauacgcuaacauucauuacauuc

SEQ ID NO: 274197 - RNA, 60 nt, Human
aacucauaacauacuuuaaaauguucagguagcagugagcauuguucauaugagaauggc

SEQ ID NO: 274198 - RNA, 60 nt, Human
uccaucauugaaaauuuugacccaaggcacagcagugaaauuuauaguucucaauuuagu

SEQ ID NO: 274199 - RNA, 60 nt, Human
acugugguacauuuuaaaauaaaauauuuuagcagugaauauggauuaagguguuuuggg

SEQ ID NO: 274200 - RNA, 60 nt, Human
cugcauacuuacuaccagcuaggucgcggcagcagugauggauuuauaguuccuccaaac

SEQ ID NO: 274201 - RNA, 60 nt, Human
uuaaaugaauuuguuuugccauuaaaguagagcagugauacaauuuaaugccauuacaau

SEQ ID NO: 274202 - RNA, 60 nt, Human
caucucccaacaacugcacuuuagaauaccagcagugaaaugguauuacuguuucccucu

SEQ ID NO: 274203 - RNA, 62 nt, Human
uuuucagcuuuuggugccagcuacagaguugagcuggccauguuucacaguauaucaagcau

SEQ ID NO: 274204 - RNA, 62 nt, Human
uauaggaggcccuuauuuuugucacagagcaagcuggccaugaacgaaggagagaagacgcc

SEQ ID NO: 274205 - RNA, 62 nt, Human
caggaaggacgguguuugugucugagggagcugcuggccacagugaacacccacguuuauuc

SEQ ID NO: 274206 - RNA, 60 nt, Human
aaggauugcagguugggagaggugggaaauagcagugaauuuuagucauuaacuucaaaa

SEQ ID NO: 274207 - RNA, 52 nt, Human
uagcacaggugcagcagugaacagcagugagagucucccuccauccucgucu

SEQ ID NO: 274208 - RNA, 60 nt, Human
uuuuuacaguguaucucgaagucuuccaucagcagugauugaaguaucuguaccugcccc

SEQ ID NO: 274209 - RNA, 60 nt, Human
ggaaaaggaauuuuaggaggagaauuugugagcagugaaucugacagcccaggagguggg

SEQ ID NO: 274210 - RNA, 60 nt, Human
guuagguaccgugcucugcuguggagacagagcagugaccccaaggagcucacggucccu

SEQ ID NO: 274211 - RNA, 60 nt, Human
aacuguucagucacagauauauucuugccuagcagugaagugccuuuauuuucagcauag

SEQ ID NO: 274212 - RNA, 60 nt, Human
uguucuguuuugaggguuauuggaaaacagagcagugaccacuuccuguaaguaaagaaa

SEQ ID NO: 274213 - RNA, 60 nt, Human
uaacauagcccugcaaagagaucuggccccagcagugaacacaaacucaguaauucucuu

SEQ ID NO: 274214 - RNA, 60 nt, Human
aauaacauuaaauuaaaugucuuuacaagaagcagugaaggcacuggucuuaagugagaa

SEQ ID NO: 274215 - RNA, 60 nt, Human
cugcuucuucucagauucuuccagaugaccagcagugacaauuuuagacacacuguguua

SEQ ID NO: 274216 - RNA, 60 nt, Human
auuuuaaagaauugugucagacuguuuaguagcagugauugucuuaauauuguggguguu

SEQ ID NO: 274217 - RNA, 60 nt, Human
uuauaaaaugggaagacugagcuggaguucagcagugaugcuuuuaguuuuaaaagucua

SEQ ID NO: 274218 - RNA, 60 nt, Human
uuggccagaaaccuuccugcugagccucacagcagugagacuggggccacuacauuugcu

SEQ ID NO: 274219 - RNA, 60 nt, Human
ugagcugccagaaucagguuuccaaucaacagcagugaguugggauuggacaguagaauu

SEQ ID NO: 274220 - RNA, 63 nt, Human
gggggacguugguuauauucuguuagagggggacggucguauuuuccucccuacccgccaagu

SEQ ID NO: 274221 - RNA, 63 nt, Human
gucaccucucacuuaucucuuccacguacugcacggucguauuucaugagcuuucuguccaua

SEQ ID NO: 274222 - RNA, 60 nt, Human
uuaucacccuguauguuagggcaagaucucagcagugaaguauaaucagcacuuugccau

SEQ ID NO: 274223 - RNA, 60 nt, Human
cucacucccauugcaaaucaaggagaucucagcagugaacugggaaaauacaaaagcucu

SEQ ID NO: 274224 - RNA, 60 nt, Human
guuucugccaacugugaaguauccuccuggagcagugacacaaucuuggcggagcauugc

SEQ ID NO: 274225 - RNA, 60 nt, Human
uuaugucuccuacacaaagcuaaauauucuagcagugauguaaugaaaaauuacaucuua

SEQ ID NO: 274226 - RNA, 60 nt, Human
cucuggaaucuggaauguuaaguccaggccagcagugacaaaaguuauuguaaugaccuc

SEQ ID NO: 274227 - RNA, 60 nt, Human
ugcaugucaucuucuaggccaagcauuucuagcagugaugaaaaugaaucuucacaaaac

SEQ ID NO: 274228 - RNA, 60 nt, Human
aauauauuaagacuugcacugcuauuuacuagcagugagaagaaaccucaggaaaggaua

SEQ ID NO: 274229 - RNA, 60 nt, Human
acugucagauaaaacuuuauuuuacuaaugagcagugauuuucuuaggaauugaugaagg

SEQ ID NO: 274230 - RNA, 60 nt, Human
ucuauaccaugagguaacugaaguaaggagagcagugaaugucaaacuguguuucuuaga

SEQ ID NO: 274231 - RNA, 60 nt, Human
aaaugcucucugaccuaucaauaaaggaaaagcagugauucauucuccuguuugcaccug

SEQ ID NO: 274232 - RNA, 60 nt, Human
ggggguaugguuuugucacugcccagaccuagcagugacaucucauuguccccagcccag

SEQ ID NO: 274233 - RNA, 60 nt, Human
ugcuuuucagcaguggacugcaggggaaagagcagugauuuggggugaguaggcuucaau

SEQ ID NO: 274234 - RNA, 60 nt, Human
acuagggucccaggagaggggcauuucuagagcagugacccuggaaaaccaggaacaauu

SEQ ID NO: 274235 - RNA, 60 nt, Human
aacugaagcuauauuuuucacagaagaagaagcagugacggggacacaaauucuguugcc

SEQ ID NO: 274236 - RNA, 63 nt, Human
uucuaugagggugcucuccucaaggguaucagacggucguagguucuuaagaauuugauucau

SEQ ID NO: 274237 - RNA, 63 nt, Human
ggccucaccugcaggugcuccucgauguccuugcggucguaggugaugccacugggcgugaug

SEQ ID NO: 274238 - RNA, 63 nt, Human
cggguuauguucaugaccgcugaaccccaggcacggucguauccaagggagggaucauggcau

SEQ ID NO: 274239 - RNA, 60 nt, Human
aaacaggcucacagauugugugucggcugcagcagugauuccaacaagcagcuauugggg

SEQ ID NO: 274240 - RNA, 60 nt, Human
cucgcccagcacuugcggcugggcccggggagcagugaguggaaaucccccacgaggguc

SEQ ID NO: 274241 - RNA, 60 nt, Human
uggggauggguuuaggagcuccagguugggagcagugacagagagucauggccgugguga

SEQ ID NO: 274242 - RNA, 60 nt, Human
ucaaauugaucucuuugcagguaaccaaggagcagugaacagcagcuacuacaguagugg

SEQ ID NO: 274243 - RNA, 60 nt, Human
uuaaaggugugccccuccugcucucccaggagcagugaguugugaguggaaagaaggcug

SEQ ID NO: 274244 - RNA, 60 nt, Human
ucagcaugagguggagcagugaccagguggagcagugaccaggacgccucuggcccagug

SEQ ID NO: 274245 - RNA, 60 nt, Human
gacacacaggcuccucucagcaugagguggagcagugaccagguggagcagugaccagga

SEQ ID NO: 274246 - RNA, 60 nt, Human
uacacaguucagccuuuaucaagcuuagugagcagugagcacugaaacauuauuuuuuaa

SEQ ID NO: 274247 - RNA, 60 nt, Human
gcacugcagagaugacuuuggagaaagcaaagcagugacccagugaccaggcacauuacu

SEQ ID NO: 274248 - RNA, 60 nt, Human
gcuucaugacugaguaagaguuuugaagucagcagugaaucaagugcccacagauuugca

SEQ ID NO: 274249 - RNA, 60 nt, Human
ucccuggcacugguuguuuucugugaaaacagcagugaacagguucaguuuugaacuggc

SEQ ID NO: 274250 - RNA, 60 nt, Human
agugcuccugaucugcaggugccacaggacagcagugacgagguuucugauugucccagc

SEQ ID NO: 274251 - RNA, 60 nt, Human
acuguacaaaugaugcuaguuuauuuuuuuagcagugaaaaugaauauaaaaaaggugac

SEQ ID NO: 274252 - RNA, 60 nt, Human
ccacuauagauacaacggacuuugacuaaaagcagugaaggggauuugcuuccuuguuau

SEQ ID NO: 274253 - RNA, 63 nt, Human
cgccugccugggccugugcugucagacccgcgucggucguaacccucuguggcuccccugcau

SEQ ID NO: 274254 - RNA, 62 nt, Human
uuugaguguaaagacucacaggugaccugcuaucgagauagccagagggucaggagagaaug

SEQ ID NO: 274255 - RNA, 60 nt, Human
uuaccuguguguucaaaggcauuucuuuucagcagugaucauuauaacuucacaaaaaaa

SEQ ID NO: 274256 - RNA, 60 nt, Human
auuuugcauuggaaaaaggaagcacuguguagcagugaauugucugcuuuccaccgagua

SEQ ID NO: 274257 - RNA, 60 nt, Human
uaucugggagccucguacagaggcucgcacagcagugaucaagugucaucccuuacguga

SEQ ID NO: 274258 - RNA, 51 nt, Human
aaauacaaacaaaaaugugagagcagugagguccgaggaggaugaacucag

SEQ ID NO: 274259 - RNA, 60 nt, Human
uaaagucuagcacaguuccuugcauguuguagcagugauucaguaaguagcaacccugug

SEQ ID NO: 274260 - RNA, 60 nt, Human
uuaacauggguaacccagcaaauauuucccagcagugacaaucuacacccuuuaucuaaa

SEQ ID NO: 274261 - RNA, 60 nt, Human
accacugggacccagcagcagcucagcagcagcagugagagggccuugggaaagacuugg

SEQ ID NO: 274262 - RNA, 60 nt, Human
aauguguagauaaagcccugaguaggcaagagcagugagauccacugcuauggucuugau

SEQ ID NO: 274263 - RNA, 60 nt, Human
gugcuaccccuugcccaggcaaggaaagacagcagugaugacacugucugucuguggcuc

SEQ ID NO: 274264 - RNA, 60 nt, Human
uuaggauccaccaucgguggccaggaaaauagcagugacaauaaacaaaguacuaccuga

SEQ ID NO: 274265 - RNA, 60 nt, Human
auuuuucuguggaaaaccacugcuggcacaagcagugacuguuuggcagcuucaaguuua

SEQ ID NO: 274266 - RNA, 60 nt, Human
aaugcgaucacacuguagugauauaguagaagcagugaugauauucagauuguuuuauuu

SEQ ID NO: 274267 - RNA, 60 nt, Human
ucacuguuugaguggaggaauguuuucuagagcagugacuggaaggacaaacgugguguu

SEQ ID NO: 274268 - RNA, 60 nt, Human
aacgcccaacguggacacaggugccaguucagcagugaccgucaagaccggggaagugcc

SEQ ID NO: 274269 - RNA, 62 nt, Human
guucuuacguauuugaaaaauaaaauugcaauucgagauaagugcuugagcacucuacuuaa

SEQ ID NO: 274270 - RNA, 62 nt, Human
uuccccuuaauuaggaugcauguugauuaaacucgagauacagcuuuuugcaguaugguggg

SEQ ID NO: 274271 - RNA, 62 nt, Human
uggaauuucaaacaccagcaaaaaauuggaaaucgagauagguugcugacuuuuauuuuguc

SEQ ID NO: 274272 - RNA, 60 nt, Human
cauggcugguguuaaauggagcuauucaauagcagugacgcgcucuccucagccaccaaa

SEQ ID NO: 274273 - RNA, 60 nt, Human
ugcggucugcaucagccucugggaaaccacagcagugaugccagcugggcacgucaggac

SEQ ID NO: 274274 - RNA, 60 nt, Human
cucuuaaauaaaacugcucaacaguuaaucagcagugaaucaucuugcagcuaugcaauu

SEQ ID NO: 274275 - RNA, 60 nt, Human
cgagggccaaccaccgagcaggcacagcacagcagugacucggugaggggaggacacccg

SEQ ID NO: 274276 - RNA, 60 nt, Human
caagaagccuuugauggccacacuguaggcagcagugacuaagcacuggcaguuccagaa

SEQ ID NO: 274277 - RNA, 60 nt, Human
uauccagugaacaggauguuuugcuuuagcagcagugacauaaaauuccauguuagauaa

SEQ ID NO: 274278 - RNA, 60 nt, Human
acuuccccuccugcagguagcagggcgccaagcagugacuucugaccaacagaguguggg

SEQ ID NO: 274279 - RNA, 60 nt, Human
accaucauaaugcaugcuagaauucuuugaagcagugaucucaguuuccuuauguugucu

SEQ ID NO: 274280 - RNA, 60 nt, Human
gguguguggagaugcagagguaaaagugugagcagugaguuacagcgagaggcagagaaa

SEQ ID NO: 274281 - RNA, 60 nt, Human
cucuagggccucagucuggagugggauaggagcagugagugacaaagccucugaaagaug

SEQ ID NO: 274282 - RNA, 60 nt, Human
uuucuacugaucaucauaacucuguaucugagcagugauaccaaccacaucugaagucaa

SEQ ID NO: 274283 - RNA, 60 nt, Human
cugauuacaaaacgugcaauucaggagcccagcagugacacacuuaucacgccuaggcuc

SEQ ID NO: 274284 - RNA, 60 nt, Human
aaagccgacguggugauggugacucagcagagcagugacgguaagcgggagcaugcguga

SEQ ID NO: 274285 - RNA, 60 nt, Human
uuuaaaaaaaaaaaacaaaacaagaaaagcagcagugauuauagagaggucacacucuaa

SEQ ID NO: 274286 - RNA, 62 nt, Human
agauaaucgaugagaauucauguugcaugaguucgagauaacugagggguuuagcuuugauu

SEQ ID NO: 274287 - RNA, 62 nt, Human
aauauuugcaagcaacuuuuguacaguauuuaucgagauaaacauggcaaucaaaaugucca

SEQ ID NO: 274288 - RNA, 62 nt, Human
cuuaagggaggcuaauuuuuaauuuaaacugcucgagauaugaguucugcaaaagguggucc

SEQ ID NO: 274289 - RNA, 60 nt, Human
ggggucaggcacacuggacaggguucucuaagcagugaggcugguguguaugauugucuu

SEQ ID NO: 274290 - RNA, 60 nt, Human
aagcugggaauuuuuuggcgcaauccauguagcagugacccaggcuugggagccagaaac

SEQ ID NO: 274291 - RNA, 60 nt, Human
cacaguaccacggaaggaagggcacugugaagcagugaggauuucuugugccauuuucau

SEQ ID NO: 274292 - RNA, 60 nt, Human
gacgccgagagaggaguauaugugggucacagcagugagcucccacccgccuugcaguga

SEQ ID NO: 274293 - RNA, 60 nt, Human
aaaaaauccuuagccagggcucagagaugaagcagugaaagagacaggaauugggaggga

SEQ ID NO: 274294 - RNA, 60 nt, Human
cuuuucuaguuauuaaaaguugcuuguuucagcagugauauuguauaaagaacaucuugu

SEQ ID NO: 274295 - RNA, 60 nt, Human
ugcaaagucaaguggagggcauuuggaaggagcagugaagccaagccaggaaacaccaag

SEQ ID NO: 274296 - RNA, 60 nt, Human
aaaucugaagaagaaaugaauauccaguauagcagugacuuugacugcuguuauuaccua

SEQ ID NO: 274297 - RNA, 60 nt, Human
caacacugccagccaccugagaugcugaccagcagugaaggcugcacuaguuuucuacac

SEQ ID NO: 274298 - RNA, 60 nt, Human
aacuuuuugcacagcugguaucugucugguagcagugagaccccuugucuuggugauccu

SEQ ID NO: 274299 - RNA, 60 nt, Human
cugccuacauggcuuggcccauggagaaggagcagugaaugggaucgucggggaagcccc

SEQ ID NO: 274300 - RNA, 60 nt, Human
cauauugccuauaauauauauuuaccgauaagcagugaguguaaaauuguuguagcuuga

SEQ ID NO: 274301 - RNA, 60 nt, Human
uaagaccauuagaaagcaccaggccgugggagcagugaccaucugcugacuguucuugug

SEQ ID NO: 274302 - RNA, 60 nt, Human
caggugcuacugagacugcugcccaacaugagcagugaucuccaaggccagcugcagggc

SEQ ID NO: 274303 - RNA, 62 nt, Human
ggaguuacacauacauuuuauccugucauaccucgagauaaaguggcauguuagugaggagu

SEQ ID NO: 274304 - RNA, 62 nt, Human
uguaaaggauaucaagguucuccauagguucuucgagauaagcuuaaagcugaauuuccugu

SEQ ID NO: 274305 - RNA, 62 nt, Human
uaugcccgugguuaaaaagagcaggccaguuuucgagauaaagaagauuuggcguugacugc

SEQ ID NO: 274306 - RNA, 60 nt, Human
acugauucauagccauaccucugauggacaagcagugauuccuuuggugccauauaccac

SEQ ID NO: 274307 - RNA, 60 nt, Human
ggagagagccaaaacugaccaaggcuauucagcagugaaccagugaccaaagaauuaauu

SEQ ID NO: 274308 - RNA, 60 nt, Human
uguauugaaggcugugcccuuggugugcuuagcagugagcagcgucuucauuagguagcu

SEQ ID NO: 274309 - RNA, 60 nt, Human
cugucauugauggaccacuaccugcagcuaagcagugagcagaaucuccgggaaaugacu

SEQ ID NO: 274310 - RNA, 60 nt, Human
ugcgcuuuagacauauuucuuuaaaaugcaagcagugagaaauaagaccucucugaauua

SEQ ID NO: 274311 - RNA, 60 nt, Human
cucuggccucuguuucccccaccaacggggagcagugacauuuaccucccucacagaguc

SEQ ID NO: 274312 - RNA, 60 nt, Human
aaagcuauguacaauuaacuaaaaugauaaagcagugauguggauuucuguauucugaug

SEQ ID NO: 274313 - RNA, 60 nt, Human
ugaaguauagcagcgacuguguuaagagagagcagugacucucucuucuagagaagaggu

SEQ ID NO: 274314 - RNA, 60 nt, Human
auaugcacuuucccuagaaagccauauuccagcagugaaacuugugcuauaguguauacc

SEQ ID NO: 274315 - RNA, 60 nt, Human
uagauaagaacuuugcacacuucaaaucagagcagugauucucucuucucuccccuuuuc

SEQ ID NO: 274316 - RNA, 60 nt, Human
acacccuaccuuucuaaucaggagcaguggagcagugagcugccuccucuccuagcaccu

SEQ ID NO: 274317 - RNA, 60 nt, Human
ugccaguuccuguaacagguguggggacacagcagugaguaaucaauacagacaagguuc

SEQ ID NO: 274318 - RNA, 60 nt, Human
cuauugcgcucucaagaccagagacccaacagcagugaucucagggcagacagcccucca

SEQ ID NO: 274319 - RNA, 60 nt, Human
ugggagcccugucugcaaggacgcagaauaagcagugagggcggcugcaggagaggaagg

SEQ ID NO: 274320 - RNA, 62 nt, Human
agagcuggcaucuaucuggugauuucuagcucucgagauacccaagcagccugauggggcag

SEQ ID NO: 274321 - RNA, 62 nt, Human
uccuugaacugucuguaucaagacguguuacuucgagauauccauucacuuuauaauuuuga

SEQ ID NO: 274322 - RNA, 62 nt, Human
uuuguuuuguuuuguuuuguuuuuuguuuaagucgagauauaaaaacugaacacgauaacac

SEQ ID NO: 274323 - RNA, 60 nt, Human
cagcaguaccucucauggcuuuuugguuccagcagugagggcauuggugagaucaauggu

SEQ ID NO: 274324 - RNA, 60 nt, Human
cuacucccaggaacagcagagguggaggcaagcagugacuccugagagacauuccccacu

SEQ ID NO: 274325 - RNA, 60 nt, Human
ccuucucucucugaauuuggaucagcuccaagcagugaaaauaguaaucagauucccauc

SEQ ID NO: 274326 - RNA, 60 nt, Human
gaggaaggccuccugagggaggggcaggagagcagugaggagcugcugugugaccuggga

SEQ ID NO: 274327 - RNA, 60 nt, Human
ucguaguuaagaccucaaaugaggggagucagcagugaucaugggggaaauguuuacauu

SEQ ID NO: 274328 - RNA, 60 nt, Human
gggccguagaccuuguauauacccugcaccagcagugaccgggcagagcccaacccccuc

SEQ ID NO: 274329 - RNA, 60 nt, Human
aaaaguucccagaaagccccuucccucccaagcagugaauuaauaaccagcaggugccua

SEQ ID NO: 274330 - RNA, 60 nt, Human
ugcggccuuugucaccuacugugauaauaaagcagugagugcugagcucucacccuuccc

SEQ ID NO: 274331 - RNA, 60 nt, Human
guucuaaggggccgaggacaucagugaagcagcagugaaaccaggggcucugcaggucac

SEQ ID NO: 274332 - RNA, 60 nt, Human
uugcugauggccuagcuguuacagugcagcagcagugacggaggaaacagacauggggag

SEQ ID NO: 274333 - RNA, 60 nt, Human
guaucugguaauuaaauaggccucagauucagcagugacauaacaaggacauaauguaag

SEQ ID NO: 274334 - RNA, 60 nt, Human
cuguugccuugaauuacagccuaguuucuaagcagugaaauguaaugauaaagagggaua

SEQ ID NO: 274335 - RNA, 60 nt, Human
uaugacauuauaucuugugccuuucuccucagcagugagcagugagcuacuccuggccca

SEQ ID NO: 274336 - RNA, 60 nt, Human
uuauaucuugugccuuucuccucagcagugagcagugagcuacuccuggcccaggcccua

SEQ ID NO: 274337 - RNA, 64 nt, Human
cgggaggcagagguugucaugagcugagcuaacaccacggcacuucagccugggugacagaaug

SEQ ID NO: 274338 - RNA, 64 nt, Human
gagucccagccccaccaguaucugcuucuguagcccacggcaccccaaacuuggagggaccugc

SEQ ID NO: 274339 - RNA, 62 nt, Human
cccuccccuucccagacuuuugccccggcucugcuggccaagucguggguccuccucugucc

SEQ ID NO: 274340 - RNA, 60 nt, Human
ugacagucuaguuucagcacauagaaaaccagcagugaauaaaccaaggugaggccuuga

SEQ ID NO: 274341 - RNA, 60 nt, Human
agguggcccuguccccuguggagcacuuggagcagugaucuguuguuccagguguaaguc

SEQ ID NO: 274342 - RNA, 60 nt, Human
uauacacaauguauuuuauuuuuuggaccaagcagugacucuuugauuuugcacuuuuuu

SEQ ID NO: 274343 - RNA, 60 nt, Human
uuugcaaccucgcuggacucucagucucugagcagugaaugauucaguguuaaaugugau

SEQ ID NO: 274344 - RNA, 60 nt, Human
cccccacauuccaaggugagauuucugacuagcagugacuuuucuagggccgcuuggaaa

SEQ ID NO: 274345 - RNA, 60 nt, Human
aaaaauaauccauagucagcagaaaacaacagcagugagccagaggagcacaggcgggca

SEQ ID NO: 274346 - RNA, 60 nt, Human
aucaugugggcugaugcagggaagcucugaagcagugaauaaagguguuucgggcccugu

SEQ ID NO: 274347 - RNA, 60 nt, Human
gaaaaggggagcaccucuaggcugccuggcagcagugagcccugggccuguggcuacagc

SEQ ID NO: 274348 - RNA, 60 nt, Human
uucagccaagcccagagaagugugggcagaagcagugaagguucuucucugugugggugc

SEQ ID NO: 274349 - RNA, 60 nt, Human
uaagauugggucaucgcugccaagguggagagcagugagcaaggggcuuggggcaauuuc

SEQ ID NO: 274350 - RNA, 60 nt, Human
gacuguuagaaaaggccuuugaaaauuaccagcagugaaaucaaauaaauuagccacuuu

SEQ ID NO: 274351 - RNA, 60 nt, Human
ucugguccaguuccuucacuuacagauggcagcagugaggccuugggguagaaggauccu

SEQ ID NO: 274352 - RNA, 60 nt, Human
uguuccccacugagcuggaggaauaucuacagcagugaugcuugaaauuuuuguaugaau

SEQ ID NO: 274353 - RNA, 60 nt, Human
augucaggacuaaaaaaaggcaucacagugagcagugagcacagagggaguuucgaguau

SEQ ID NO: 274354 - RNA, 62 nt, Human
uuugagcuacuaaaaagcagaauuccggagcuucgagauaucuuauucuaggaaaaugaaac

SEQ ID NO: 274355 - RNA, 62 nt, Human
cccaacacccaggaaugggaaucuggcuugguucgagauaggagcuuuucuguguccuaagc

SEQ ID NO: 274356 - RNA, 62 nt, Human
gaucucuguuaugugccauuuuucuucuagcaucgagauacaauaaaaaaaaaaaaaaagaa

SEQ ID NO: 274357 - RNA, 60 nt, Human
agcguaaacaggcuuucuccagcucaguggagcagugagcagccgacucugagauuagcu

SEQ ID NO: 274358 - RNA, 60 nt, Human
ucuguuaaaauauauuugaagacccuuuaaagcagugaaucugaaacaauuuucacaccc

SEQ ID NO: 274359 - RNA, 60 nt, Human
ccccugaggaaucugacccuccccaaaagaagcagugaaauggaccaaaggacuuaagaa

SEQ ID NO: 274360 - RNA, 60 nt, Human
acacugaccuuggagagacacagcgucccuagcagugaacuauuucuacacagugggaac

SEQ ID NO: 274361 - RNA, 60 nt, Human
ugucucuucucguacguggcugcaguucauagcagugaggaagaucucagaaccccgccc

SEQ ID NO: 274362 - RNA, 60 nt, Human
augaacauuuguccuaacucagauuuugugagcagugaaguuuaacagagcagugacauu

SEQ ID NO: 274363 - RNA, 60 nt, Human
ucagauuuugugagcagugaaguuuaacagagcagugacauuuaacaaagcagugaaguu

SEQ ID NO: 274364 - RNA, 60 nt, Human
gaaguuuaacagagcagugacauuuaacaaagcagugaaguuuaacagaguucugagaau

SEQ ID NO: 274365 - RNA, 60 nt, Human
gcacucugcaaguccaguguuuaauuucaaagcagugaugaauugcucuuuugaaauuac

SEQ ID NO: 274366 - RNA, 60 nt, Human
gaaggggaguagggaugucuuuucccccccagcagugaugaguggggcuagcugaagccc

SEQ ID NO: 274367 - RNA, 60 nt, Human
ugugggggcccuggacagucacaccccagcagcagugagugggcagguuuggaggagccc

SEQ ID NO: 274368 - RNA, 60 nt, Human
gucaaggcuucuuucaaggaggcucauaaaagcagugaccucauccggggcuuuggauag

SEQ ID NO: 274369 - RNA, 60 nt, Human
ugggcaggagggcuugugcaggguuuuguaagcagugaucuaguuucauuaaaaaaagaa

SEQ ID NO: 274370 - RNA, 60 nt, Human
uuuucuugcucuggaagcccagggagguugagcagugagagagggaagggacuaacgugc

SEQ ID NO: 274371 - RNA, 64 nt, Human
acccagggaagagaaggaagccaggccuggagguccacggcagugggaguggggcucacuggcu

SEQ ID NO: 274372 - RNA, 64 nt, Human
aggaaauugauuuugaaaaaguaggcugccgccaccacggcauuaugaucccuucccccugcug

SEQ ID NO: 274373 - RNA, 62 nt, Human
ugaucauuucuuuauguuauuauuuuauuuuuucgagauagggucuugcucaauuucuuagg

SEQ ID NO: 274374 - RNA, 60 nt, Human
auuuuuuauguguuaucuucagccaugagaagcagugaugacuaucccauaucacagaua

SEQ ID NO: 274375 - RNA, 60 nt, Human
uuugcugcugcccauguuucaaauacuuagagcagugaagacuagaaaauuagacuguga

SEQ ID NO: 274376 - RNA, 60 nt, Human
aaaaauaaucaacaaugugggucuuucaugagcagugacggauaguuuagcuuacuaugu

SEQ ID NO: 274377 - RNA, 60 nt, Human
ccuccuccucucgggcuggaucugggggcuagcagugaguacccgcaugguaucagccug

SEQ ID NO: 274378 - RNA, 60 nt, Human
ccacacaaccagaugagaggucaucuaaguagcagugagcauugcacggaacagauucag

SEQ ID NO: 274379 - RNA, 60 nt, Human
agaauccgggaucaggaacuguuuuuauccagcagugaagcucuugagcucuuaggaagg

SEQ ID NO: 274380 - RNA, 60 nt, Human
guauccaugaggguuucauuguguguuagcagcagugagcuucuauuaaauguauauguc

SEQ ID NO: 274381 - RNA, 60 nt, Human
uacaaaguaccagcagcaaauuagcaaagaagcagugaaaacaggcuucuacucaaguga

SEQ ID NO: 274382 - RNA, 60 nt, Human
uggguagacaccaaccaaaaugacuuugaaagcagugagcugauugagcuccaguucugu

SEQ ID NO: 274383 - RNA, 60 nt, Human
auaacaacucugguauucuucccucauaugagcagugauuuuauuuguuacccaccuuag

SEQ ID NO: 274384 - RNA, 60 nt, Human
cugcuuaccacguaacacagcugcaucuugagcagugaccugccaagggcaaaggacccc

SEQ ID NO: 274385 - RNA, 60 nt, Human
uuguccuugcaccugagccuguucccacucagcagugagaguuccucuuugcccugaggc

SEQ ID NO: 274386 - RNA, 60 nt, Human
gaagaacaauccagggcugagaaaucguagagcagugaggcaggcugggagcauggagga

SEQ ID NO: 274387 - RNA, 60 nt, Human
cagugauagagacagaggaacaaaaagagcagcagugagaaggcaaagagagaggcagaa

SEQ ID NO: 274388 - RNA, 62 nt, Human
aaggcauucuguugacagaugaacagccgaaagcuggccagacccuccuguaugccucugcc

SEQ ID NO: 274389 - RNA, 62 nt, Human
acuuaauccuauuuauccccuggaaugugcgugcuggccaguaggagggcuggcuuuggcag

SEQ ID NO: 274390 - RNA, 62 nt, Human
aacugagaggggaccccagacugggcccagaggcuggccagaguucaggaacgccgggcaca

SEQ ID NO: 274391 - RNA, 60 nt, Human
aggggguaagggagauauaugggaugugagagcagugauuguagacagacugucacugau

SEQ ID NO: 274392 - RNA, 60 nt, Human
uccagaagucuuaagguuccaaagggauuuagcagugaggcagcaaugcugaguagguag

SEQ ID NO: 274393 - RNA, 60 nt, Human
ccucuguguucauuagauaaaaugaaaaaaagcagugaagcuguuuccauuuucaauagu

SEQ ID NO: 274394 - RNA, 60 nt, Human
gguauacccgccccuugccuuaguaagaggagcagugaaauguauauaguugauguucag

SEQ ID NO: 274395 - RNA, 60 nt, Human
acgcuucagccuuagcugcuaccuuucggcagcagugaaauacaagcugcagccucggcu

SEQ ID NO: 274396 - RNA, 60 nt, Human
ucugagggccauucacaauucucagggcucagcagugaugggagaacagaggacaguucc

SEQ ID NO: 274397 - RNA, 60 nt, Human
aacauuuggaaaauaguccuuuuucuuggaagcagugacgucucccuacccaaucuuucc

SEQ ID NO: 274398 - RNA, 60 nt, Human
agaugcagacugauaccaccuccaccgcugagcagugaccuuccucacuuucucuugucc

SEQ ID NO: 274399 - RNA, 60 nt, Human
auuauucacauuuaaauauuuucaguuauaagcagugagguccuaaaguguuacaagagu

SEQ ID NO: 274400 - RNA, 60 nt, Human
gugaauaacauauucccaguaaauuuauauagcagugaagaauuacaugccuucuggugg

SEQ ID NO: 274401 - RNA, 60 nt, Human
acccccuccccaggggagagggucuggagaagcagugagccgcaucuucuccaucuggca

SEQ ID NO: 274402 - RNA, 60 nt, Human
agagauaacuuuacuuaaauucuucauuuuagcagugaugauaugcauaagugcuguaag

SEQ ID NO: 274403 - RNA, 60 nt, Human
cugcuuuguucuuucccugagaaacaguucagcagugaccaccacccacaugacauuuca

SEQ ID NO: 274404 - RNA, 60 nt, Human
uuauguuuacuuauucccuucacagaaaucagcagugagcagucaaguuaauggguagcc

SEQ ID NO: 274405 - RNA, 62 nt, Human
cccacugucuggggcagggggagaagguauuuucgagauaaagcacaggcaccacaaauaaa

SEQ ID NO: 274406 - RNA, 62 nt, Human
acuugaaccugggaggcggagguugcagugagucgagauaacacuacugcauuccagccugg

SEQ ID NO: 274407 - RNA, 62 nt, Human
cuuuauauacucuuugcaccuccuuuuuuuagucgagauauaaauauuugaggggagagaaa

SEQ ID NO: 274408 - RNA, 60 nt, Human
aucugaaaaaugaaguggcuuaggaacaucagcagugaagaacugccaagaguuggugaa

SEQ ID NO: 274409 - RNA, 60 nt, Human
cauuuuuuccaguguuuagcauuucuaguaagcagugagguuguuugacauacagugaug

SEQ ID NO: 274410 - RNA, 60 nt, Human
accuaaagugcacuaccaucuaagaagacgagcagugaaaaccuuugugaaaacugaauu

SEQ ID NO: 274411 - RNA, 60 nt, Human
ccucugauuuuuacacaguguagaguggccagcagugaacagguugaggaugugcgggua

SEQ ID NO: 274412 - RNA, 60 nt, Human
agcaggguggacaggagagaccugaaucacagcagugaggaauuccucaaagcugugacc

SEQ ID NO: 274413 - RNA, 60 nt, Human
aaacuacauaauuucuaccagggccauauuagcagugaaacauuuuaaacugcagaaauu

SEQ ID NO: 274414 - RNA, 60 nt, Human
gguguucuuuauacaucaauuauuacaaaaagcagugaauuguaagugugagguguguuu

SEQ ID NO: 274415 - RNA, 60 nt, Human
guggcgugcaucugaucugagaggcaguaaagcagugaugaagacagugcagcagaacau

SEQ ID NO: 274416 - RNA, 60 nt, Human
agugcagcagaacauugaaguccugauugcagcagugacucugcaaccuuggauaaauua

SEQ ID NO: 274417 - RNA, 60 nt, Human
acagagaacugcagcccuuauucagaauugagcagugauugucaguugauaucucugagu

SEQ ID NO: 274418 - RNA, 60 nt, Human
acuaaagcaaauaucacucagaugaaacaaagcagugaaaccccuacaguuuaaaugaug

SEQ ID NO: 274419 - RNA, 60 nt, Human
gccacguaucaacaaucuucugacagcaggagcagugauaguuggggaauugugagauga

SEQ ID NO: 274420 - RNA, 60 nt, Human
uguaagggacucugcuucucuauuuuuggaagcagugaucuguucacgucucuccccagu

SEQ ID NO: 274421 - RNA, 60 nt, Human
accccuucuuuuuuuccccucuccaaaugcagcagugaaucccuuuauuaauacuggaaa

SEQ ID NO: 274422 - RNA, 64 nt, Human; identical to SEQ ID NO: 143552

SEQ ID NO: 274423 - RNA, 62 nt, Human
cguguuuggggcugaggccugcuggacagauggcuggccaagugggagcagacccuagggag

SEQ ID NO: 274424 - RNA, 60 nt, Human
ccggccgugaacgcuauuuucuaagcagccagcagugaaucuaaaacucuggaagaaguc

SEQ ID NO: 274425 - RNA, 60 nt, Human
agugguugaccuuacacuuacuccuuaaauagcagugaguaaugcauuugagcuguccca

SEQ ID NO: 274426 - RNA, 60 nt, Human
agauggcacccggggccagccagggggaccagcagugacucuggggcuaccuggcuccua

SEQ ID NO: 274427 - RNA, 60 nt, Human
aaagauagaagauuaaauauucuugaauaaagcagugauauauauuggaacacuucaccc

SEQ ID NO: 274428 - RNA, 60 nt, Human
guuugacucaucuuauaugggaaaccauguagcagugagucauaucuuaauauauuucua

SEQ ID NO: 274429 - RNA, 60 nt, Human
ugagauguagcuacaaaaauggcaccucuuagcagugaugaggcucaggauaucggauau

SEQ ID NO: 274430 - RNA, 60 nt, Human
agggguagcauuuaagauucaggagucauuagcagugaugauuuuggguccugccguaua

SEQ ID NO: 274431 - RNA, 60 nt, Human
gguauaucugcugccuuggaagacauaagaagcagugauacucccuggcucgguuauuuu

SEQ ID NO: 274432 - RNA, 60 nt, Human
aucucuuaguguaacuucaaaacuuuuaagagcagugaaguuggucagggacauguggcc

SEQ ID NO: 274433 - RNA, 60 nt, Human
guuauuuuuccuagaugaaaauaaaagucaagcagugauuaguuucacucacuguccuag

SEQ ID NO: 274434 - RNA, 60 nt, Human
gccaauaaauccuaaggagacaagcagcccagcagugaucagcaguagccaccuuagcac

SEQ ID NO: 274435 - RNA, 60 nt, Human
ucaauggggcuauugucugaggaccccaagagcagugauucagagaacagugugaccaaa

SEQ ID NO: 274436 - RNA, 60 nt, Human
gacacucucgugguauguaugggagauggcagcagugaagcagcagccaccagggagugg

SEQ ID NO: 274437 - RNA, 60 nt, Human
caggaacacguggccugagagcugggcaacagcagugauggcgaugcccuccaccucuuu

SEQ ID NO: 274438 - RNA, 62 nt, Human
gguuugcagaggggguaggggcagagucaggggcuggccagagggucugcucccuggacaga

SEQ ID NO: 274439 - RNA, 62 nt, Human
guggacagagggugacaucauaggagcagcucgcuggccagaaggggaugggggcaucccug

SEQ ID NO: 274440 - RNA, 62 nt, Human
uggaucaccugaggucaagaguuccagaccaggcuggccagcauggugaaaccccgucugua

SEQ ID NO: 274441 - RNA, 60 nt, Human
ggcaauucccuuucucucugucacugcuucagcagugaagacccauggcaccuagaaaug

SEQ ID NO: 274442 - RNA, 60 nt, Human
uugacuuucagcuuucuggagugacaaagcagcagugaugggugcuauuccugguucugu

SEQ ID NO: 274443 - RNA, 60 nt, Human
auuugcauugagaccauuguauuuuccacuagcagugaaaaugauuuuucacaacuaacu

SEQ ID NO: 274444 - RNA, 60 nt, Human
ugacuuggccccgaggccaucacccccuccagcagugaacacuguccgccgcugugaggc

SEQ ID NO: 274445 - RNA, 60 nt, Human
acauuaaagcgguucacgugcagagaacaaagcagugacaaccauuggcccuuagcauuc

SEQ ID NO: 274446 - RNA, 60 nt, Human
gucaggcacaguccuuggcacacagaauacagcagugaauuaaacaggcaaaaauuccuc

SEQ ID NO: 274447 - RNA, 60 nt, Human
cugccuccucaggaggagcauuaguagaacagcagugaugaggacacagagggagcagac

SEQ ID NO: 274448 - RNA, 60 nt, Human
cuuauccacauuggcuuauucuggaggaaaagcagugaucuguaaaacaaaucaagaaua

SEQ ID NO: 274449 - RNA, 60 nt, Human
aguacagcccaugauugaccagucaaaucgagcagugagccaaggagcagcauauagucc

SEQ ID NO: 274450 - RNA, 60 nt, Human
ucugaaccccagagugucaucauuggagagagcagugacugcgagagaugguggaggccg

SEQ ID NO: 274451 - RNA, 60 nt, Human
ccugggagcagguuguuugagcuguuuuagagcagugagcccuaccauuacauccugaua

SEQ ID NO: 274452 - RNA, 60 nt, Human
cucacaugcagguaaugagaacguuauggaagcagugaacccacaauccacaauccccaa

SEQ ID NO: 274453 - RNA, 60 nt, Human
caugacccgguuuuaugccaaccuucagaaagcagugaagcaauuccaugaguaaugcua

SEQ ID NO: 274454 - RNA, 60 nt, Human
cuccccuccucagagcccacccugagaggcagcagugacccccauggcacacaccugcca

SEQ ID NO: 274455 - RNA, 64 nt, Human
uuccugagauggauucucuugacuuaccaguccaccacggcacuuccccuuuaagguuauuaaa

SEQ ID NO: 274456 - RNA, 64 nt, Human
guagaguuuuuagugaagugggcaccuuucuaguccacggcauuugaagagagcgaggagaacc

SEQ ID NO: 274457 - RNA, 64 nt, Human
cccacccaacacacuccugcacacuggccccggcccacggcacagcaauccccugcgcguggau

SEQ ID NO: 274458 - RNA, 60 nt, Human
uggucccuacccccaagucacaggugacucagcagugacccugugugccaggccagaucc

SEQ ID NO: 274459 - RNA, 60 nt, Human
acuauacugaaaucugugcucucaagaucuagcagugaccagggcugcccggcgggggcu

SEQ ID NO: 274460 - RNA, 60 nt, Human
acacaacuagaaagugucaccuaugacaagagcagugaaggugagguacuugcugccaca

SEQ ID NO: 274461 - RNA, 60 nt, Human
ucaauaaucacaaaccccaaaacgggagagagcagugaaaacaugcagggcuguggacgg

SEQ ID NO: 274462 - RNA, 60 nt, Human
aaacagccuagcuuuaaaaaacagugaaauagcagugauuucaugucccuguauguucug

SEQ ID NO: 274463 - RNA, 60 nt, Human
acaagagaauaaaagcaggcugccugagccagcagugacaaccccccucggguccccucc

SEQ ID NO: 274464 - RNA, 60 nt, Human
gugaggguggcggucccuugccaaguugguagcagugacccagugauucacugccauccc

SEQ ID NO: 274465 - RNA, 60 nt, Human
cagagagcaucaaaaggagcccacaccuucagcagugaaggauucuaacacagggaaucu

SEQ ID NO: 274466 - RNA, 60 nt, Human
caggguggacgcgugggguuccguguccccagcagugagggcccuagaggacgccuucuc

SEQ ID NO: 274467 - RNA, 60 nt, Human
cucagcagggaugacucagcacugucccuuagcagugaugacacagcaaggaugacucag

SEQ ID NO: 274468 - RNA, 60 nt, Human
gaugcagagaugaccucucgcugccucacaagcagugacaccucggguccuuuccguugc

SEQ ID NO: 274469 - RNA, 60 nt, Human
cugugguacagauagacaugaagagagcuuagcagugauugagguggugacuaaauauac

SEQ ID NO: 274470 - RNA, 60 nt, Human
ccugcauugaacaguccuguggaaaggccaagcagugaccaggaagagggagaaacuucu

SEQ ID NO: 274471 - RNA, 60 nt, Human
caaggcuguuuugauaacccuggggugauaagcagugagcccucacacacuuacuuugac

SEQ ID NO: 274472 - RNA, 64 nt, Human
caggaggcagagcuugcagugagccgagaucgcgccacggcacuccagccugggagacagagca

SEQ ID NO: 274473 - RNA, 64 nt, Human
agcuggcuuggccggaaacccgggggaggcccagccacggcacauccugcuuuguucaccacug

SEQ ID NO: 274474 - RNA, 64 nt, Human
cccaugagaguagagggcacugggucgccgugccccacggcaggccccugcaggaaaacugagg

SEQ ID NO: 274475 - RNA, 60 nt, Human
gaacgcaaggcuccaggcccgugugucugaagcagugagugguccacacaggugccagga

SEQ ID NO: 274476 - RNA, 60 nt, Human
gucgggcaaagggggaucuggggggagcucagcagugacuggggagcuggucugccucag

SEQ ID NO: 274477 - RNA, 60 nt, Human
cucucuccuaccuaggguggcggugguggcagcagugauccucugaaccugcagaggccc

SEQ ID NO: 274478 - RNA, 60 nt, Human
uuauuauaaaauaguuucagucaucuaaacagcagugaugcuuaauuauuuuuuuuuuug

SEQ ID NO: 274479 - RNA, 60 nt, Human
ugcauuucugaguuucauucuccugccuguagcagugagaaaaagcuccuguccucccau

SEQ ID NO: 274480 - RNA, 60 nt, Human
cguagggcaggaggcccuccuggccaggccagcagugaagcaguauggcuggcuggauca

SEQ ID NO: 274481 - RNA, 60 nt, Human
uaaaauggguuggggcccugccagaguuaaagcagugacuggaggguggacugggggguu

SEQ ID NO: 274482 - RNA, 60 nt, Human
gcucagcccuggcauccccaggggaauggcagcagugagguagaugggaggacauuucug

SEQ ID NO: 274483 - RNA, 60 nt, Human
uuuucuugggaagcuguuuugguccuuggaagcagugagagcugggaagcuucuuuuggc

SEQ ID NO: 274484 - RNA, 60 nt, Human
uggccccuuagaggugagcaucagagccagagcagugagggggagacucacccacccucu

SEQ ID NO: 274485 - RNA, 60 nt, Human
cgaccaacugauggcaguaaagagaccaccagcagugacaccugccaaugacagaugcaa

SEQ ID NO: 274486 - RNA, 60 nt, Human
gauuucaacccaggugccccuggccuggccagcagugaauguaggagaugaauugugcaa

SEQ ID NO: 274487 - RNA, 60 nt, Human
agcuucuuaacuggugacuaccaaagaacaagcagugauuugaaaaaggaaaaacaaucc

SEQ ID NO: 274488 - RNA, 60 nt, Human
agaggaaguucuuugccacgagaacuuucaagcagugaaaggaauucccaucaggacuca

SEQ ID NO: 274489 - RNA, 64 nt, Human
acagaagauuuggcccucauuuucccucagaaccccacggcaaggauauauguccccuuguucu

SEQ ID NO: 274490 - RNA, 64 nt, Human
ggccagugaauaagcaacuuucuacaguuuugcaccacggcaagaaaaccaaaaaccaaaacaa

SEQ ID NO: 274491 - RNA, 64 nt, Human
cagaaguucaaggcugcaaugagccaugauuacaccacggcacuacaaccuugguggcacagug

SEQ ID NO: 274492 - RNA, 60 nt, Human
ccagguucuuauugcuaacaauggcauugcagcagugaaaugcaugcggucuauccguag

SEQ ID NO: 274493 - RNA, 60 nt, Human
acuggcgcagccccaggcgccuccaagggaagcagugaggaaagaugaggcaucgugccu

SEQ ID NO: 274494 - RNA, 60 nt, Human
uguacugaauugcaaauugauaguuguucuagcagugaagagauaaagaaaaaaaaguac

SEQ ID NO: 274495 - RNA, 60 nt, Human
ggaggggauucaacagcuuuauugucuggaagcagugagauuuggugauugucugggggg

SEQ ID NO: 274496 - RNA, 60 nt, Human
aaaauuaaggauucucaggucccuguguagagcagugaaaauaagaugugcguaugugug

SEQ ID NO: 274497 - RNA, 60 nt, Human
aagccuccuagaggccagguaagggggugcagcagugagggguauaucugggcuggccag

SEQ ID NO: 274498 - RNA, 60 nt, Human
aacaagauaucuucuguccgccuuacauauagcagugacacuuguugccuaacuuuaugg

SEQ ID NO: 274499 - RNA, 60 nt, Human
cccucuaucacagaccuuucacaaauuagaagcagugaagcauaacuuuaaccuggaaga

SEQ ID NO: 274500 - RNA, 60 nt, Human
ggauguacaaugaaacugccuggaacuaaaagcagugaagcaagggaggcaaucacacug

SEQ ID NO: 274501 - RNA, 60 nt, Human
gauuauauugggcagcuugcaaucugccgaagcagugacuugcauuuccacacuuggcuu

SEQ ID NO: 274502 - RNA, 60 nt, Human
aauggauguggcaaaagaauugcaauaagaagcagugaacauuuggaaccccaaaagaaa

SEQ ID NO: 274503 - RNA, 60 nt, Human
ucaagcuccuguggccaccugugucccagcagcagugaguggagcugcucagggugcccu

SEQ ID NO: 274504 - RNA, 60 nt, Human
gcgggaggugcagagcagagggcuuuagggagcagugacugcggucaccccuuuaguucu

SEQ ID NO: 274505 - RNA, 60 nt, Human
agcaggcacgcugggccucgcguguccccgagcagugagggucccaguguucccuccacu

SEQ ID NO: 274506 - RNA, 64 nt, Human
ccgagagaagcgggcuccuaaugaggugggaaagccacggcaggcagcgagcagcccaggccag

SEQ ID NO: 274507 - RNA, 64 nt, Human
aguuuuugguuagcuuuuacguuuucuucuccacccacggcacaggugauaaaauaggauccuu

SEQ ID NO: 274508 - RNA, 64 nt, Human
gacacaugacggaaguguguauuuuugggccacuccacggcaggucccuagccugcaacauuua

SEQ ID NO: 274509 - RNA, 60 nt, Human
ucccugcggccacuccugaacaaggacaugagcagugaggagcagucccucuacuacagg

SEQ ID NO: 274510 - RNA, 60 nt, Human
cacuuccuucuuguccuagaucacaaugaaagcagugaagugagccagucagagggagag

SEQ ID NO: 274511 - RNA, 60 nt, Human
cacuaauacccacugcuucaguguuaacacagcagugauugucagcugccaauagcaaau

SEQ ID NO: 274512 - RNA, 60 nt, Human
gucagccacaaacugacccagaguuuaauuagcagugacuaauuucauguuuccaaugua

SEQ ID NO: 274513 - RNA, 60 nt, Human
acggucuguaguugacuccaagucucugugagcagugacuugaaccaaacacaccaggaa

SEQ ID NO: 274514 - RNA, 60 nt, Human
uuuccacccccuccaauuugugaaaaacagagcagugaccuagcuguugcaucaucauga

SEQ ID NO: 274515 - RNA, 60 nt, Human
uucucuacaugaacugcucauuuggaggacagcagugagguccugccauagagcaaaugu

SEQ ID NO: 274516 - RNA, 60 nt, Human
uuguuuguuggacuccauaagugaauuucaagcagugaggauuuuguggugccugagaug

SEQ ID NO: 274517 - RNA, 60 nt, Human
ugcaguagccacggccaggcccuuaggaggagcagugaccggggguguccagaaauaucc

SEQ ID NO: 274518 - RNA, 60 nt, Human
ggaguauuacacagccauaaaaaggaaugaagcagugauccccacuacacuguggaugaa

SEQ ID NO: 274519 - RNA, 60 nt, Human
uguccuuuguuccaaagggaaaaaauugacagcagugacuugaaaaugauucugcucccu

SEQ ID NO: 274520 - RNA, 60 nt, Human
caaaugauagaauaguauacagcacuuaaaagcagugaaccagauccauauuguguaaca

SEQ ID NO: 274521 - RNA, 60 nt, Human
guuuaaaaagcaaaauggggagggggaggaagcagugacuuuuuuuugguaauuaugcgc

SEQ ID NO: 274522 - RNA, 60 nt, Human
gagcucuaacccauggguccaugggaauaaagcagugaauaguaacaauaaauaaucgua

SEQ ID NO: 274523 - RNA, 62 nt, Human
cucuagguaaaaagaaaagaaaaaaagaaauuucgagauauuuucaacauuguuagaguuug

SEQ ID NO: 274524 - RNA, 62 nt, Human
ugcauggagacuuuuguuucuauuuaauguuuucgagauaugacaugugauaagauggaaag

SEQ ID NO: 274525 - RNA, 62 nt, Human
agagaaacuggacauggggccuggggaggggagcuggccagaggaggaccccuuucccgugg

SEQ ID NO: 274526 - RNA, 60 nt, Human
cuucucuccaagccccugugggaggcggacagcagugaccaccuccccuucuuuuggacu

SEQ ID NO: 274527 - RNA, 60 nt, Human
gugcaaggccuuuuuaggcacuagagauauagcagugaccaaaacagacacaaauccugc

SEQ ID NO: 274528 - RNA, 60 nt, Human
uuucuucggacuauuuuccagccuucugucagcagugaaacuuauaaaauuuuuugugau

SEQ ID NO: 274529 - RNA, 60 nt, Human
gggcaguugaccugcacagacaggaaccucagcagugacagaagagagauccagggaugg

SEQ ID NO: 274530 - RNA, 60 nt, Human
gacgggcuccaggaacccugggcugaugggagcagugagcgggcuccgcugcccccugcc

SEQ ID NO: 274531 - RNA, 60 nt, Human
cauugcccucugcggaggggaccaggguucagcagugacguagcaucugaaucccuagac

SEQ ID NO: 274532 - RNA, 60 nt, Human
ucagcccugggcguagccggacaggaggagagcagugaugcggauggguacccgggcaca

SEQ ID NO: 274533 - RNA, 60 nt, Human
ccagaaaugcugccggcugcacccagagggagcagugaggcaggacagauggacagguuc

SEQ ID NO: 274534 - RNA, 60 nt, Human
ggaguauuacacagccauaaaaaggaaugaagcagugaucccuacuacacuguggaugaa

SEQ ID NO: 274535 - RNA, 60 nt, Human
cucuggguguguguuuuugugggggcucgaagcagugacuauggccuccuuuguucccau

SEQ ID NO: 274536 - RNA, 60 nt, Human
cccagcuacagccaaucagccgauuuccugagcagugaugccaccuccaagcuuguccua

SEQ ID NO: 274537 - RNA, 60 nt, Human
gcaugguccucucugagccuugguuucuucagcagugagaugcucagaauaacugcuguc

SEQ ID NO: 274538 - RNA, 60 nt, Human
gccaagcccuguucucggugcugggaguacagcagugagcaaaggagacaauauucccug

SEQ ID NO: 274539 - RNA, 60 nt, Human
cccuggguauuucugucaguccccauggcaagcagugauuuaguaaaacaccccagaguc

SEQ ID NO: 274540 - RNA, 64 nt, Human
aagccccuccgggaggcagguuggaaggcaggcaccacggcagguuuuccgcgaugaugucacc

SEQ ID NO: 274541 - RNA, 64 nt, Human
cucacucccaaaacagacccaggcagccccacccccacggcagacccuggugucccuggaccuc

SEQ ID NO: 274542 - RNA, 64 nt, Human
ccuuugggugguggucggcuugccucugaggccaccacggcaccagcagaauacguauuucuuc

SEQ ID NO: 274543 - RNA, 60 nt, Human
aaagugagaaaagcggcaugcagugaaaugagcagugagcagcccuuuagcaaaaucgcc

SEQ ID NO: 274544 - RNA, 60 nt, Human
aaagggcacacacccuaggucagcgugcagagcagugaugcuggaggacacaccaugggg

SEQ ID NO: 274545 - RNA, 60 nt, Human
gggagccgcucaagucugggagggcaugggagcagugagcaggcccauggggagaaauug

SEQ ID NO: 274546 - RNA, 60 nt, Human
ccgggucucgcagccugaagccuggauuccagcagugaaugcuagacagaaaccaagcca

SEQ ID NO: 274547 - RNA, 60 nt, Human
cuuccuccagcuccagccaccaccaggcugagcagugaggagagaaaguuucugccuggc

SEQ ID NO: 274548 - RNA, 60 nt, Human
ugagcuuuucuccaucagccgucugagaagagcagugaggccagcugcuuccuguccuuc

SEQ ID NO: 274549 - RNA, 60 nt, Human
uaaaaagaauaaacacaguguuuccugaguagcagugauuguuaugccuugcuauuuuaa

SEQ ID NO: 274550 - RNA, 60 nt, Human
ugugacgcgucucuagugccuuacugaagaagcagugacacucccgucgcucggugagga

SEQ ID NO: 274551 - RNA, 60 nt, Human
ugcuauuuuaaaggagacauauugcugaacagcagugagaaaagucugcaggaacugcug

SEQ ID NO: 274552 - RNA, 60 nt, Human
agcucugacaaguccuaucauccucugcucagcagugaccucccuggccccacuuugccc

SEQ ID NO: 274553 - RNA, 60 nt, Human
cguggcccugucaugcacauggggucccgcagcagugacuguguguccugcagaggcgug

SEQ ID NO: 274554 - RNA, 60 nt, Human
ucuaugcacacuacgguuguguuguuuucuagcagugacaaguucacuuugaaucagguu

SEQ ID NO: 274555 - RNA, 60 nt, Human
caagugcauuaaagucuacaauggaaaaaaagcagugaagcauuagaugcugguaaaagc

SEQ ID NO: 274556 - RNA, 60 nt, Human
aggauaguuagugaggauuauuaaccucugagcagugauauagcauaauaaagccccggg

SEQ ID NO: 274557 - RNA, 64 nt, Human
gggaaggccuguggccugcaugcuucccgauggcccacggcaggagguguguggaaguguaagg

SEQ ID NO: 274558 - RNA, 64 nt, Human
agguguuaggcaugucccacccacccgccgccucccacggcaccucggggacaccagagcugcc

SEQ ID NO: 274559 - RNA, 64 nt, Human
caagaguuugagccugcggugagcugugaaugcaccacggcacucaagccugggcaauguagca

SEQ ID NO: 274560 - RNA, 60 nt, Human
gagaaucgcuugaacccgggaggcagagguagcagugagcugaagucccgccacugcacu

SEQ ID NO: 274561 - RNA, 60 nt, Human
ucugagugggcacuugucuggcugcuggccagcagugaagggccacuuggugacuucgua

SEQ ID NO: 274562 - RNA, 60 nt, Human
cacgaugccaugagcugacggugucccuggagcagugaggggacaccagcaaaaaccuuc

SEQ ID NO: 274563 - RNA, 60 nt, Human
cucagguguguccaaguccucccaaaggacagcagugauggagaggaccccagccagcug

SEQ ID NO: 274564 - RNA, 60 nt, Human
uggggacccagcuugucucggcagcuaagaagcagugaccaggauguggauuuuggcgac

SEQ ID NO: 274565 - RNA, 60 nt, Human
gucuggcuucugagguuggagggggcacuuagcagugaaccuuaagucuggguacaugua

SEQ ID NO: 274566 - RNA, 60 nt, Human
gucaugaagccagagaagccccgcuccaugagcagugacuccccagguaagacuuucagc

SEQ ID NO: 274567 - RNA, 60 nt, Human
ccccugcugcugcaggcaccaugcugcuucagcagugacgauugagccauuugugagaga

SEQ ID NO: 274568 - RNA, 60 nt, Human
acagggucugguaccagggguugugcccucagcagugacagcagcuuaggugucaggcag

SEQ ID NO: 274569 - RNA, 60 nt, Human
aacagccaggaccccaucugccacccccgcagcagugacccccacccagggccaggccua

SEQ ID NO: 274570 - RNA, 60 nt, Human
aagaagcucagaggguggggagaagcaugaagcagugagcagagcacugggugagaggga

SEQ ID NO: 274571 - RNA, 60 nt, Human
acuuugcuuauuugaagaaucagugguaggagcagugaaguaaauucuauggaguacauu

SEQ ID NO: 274572 - RNA, 60 nt, Human
guggguagggugcaaucugguguguguuccagcagugagacgguguuauugugaaggugg

SEQ ID NO: 274573 - RNA, 60 nt, Human
ccaguggaauggagauuucauuuugucagcagcagugaccacagccuuaccaaagcagac

SEQ ID NO: 274574 - RNA, 64 nt, Human
augccugcggaguugugcacguaguagggucaggccacggcagccuaccggcaauuuccggcca

SEQ ID NO: 274575 - RNA, 64 nt, Human
ugccugcuccugucccuccagcacguccccugcaccacggcauagcuuaggugcgccguccugg

SEQ ID NO: 274576 - RNA, 64 nt, Human
ccagggagcaaagccauaaggggcaggggccaccccacggcaucuccccagaaguacaggccuc

SEQ ID NO: 274577 - RNA, 60 nt, Human
agugcgcgccccgccuguguuugcccuuccagcagugacccucccuucuagucuuuauuu

SEQ ID NO: 274578 - RNA, 60 nt, Human
ggaagggaaguggguguccaugggccacugagcagugagaggaaggcagugcagagcugg

SEQ ID NO: 274579 - RNA, 60 nt, Human
auaaccccacgggaagauauugaugaggacagcagugauccaaguuucaacccaauguau

SEQ ID NO: 274580 - RNA, 60 nt, Human
uuuuguuuucacuaacaacagauaagguagagcagugagguuuacaacaagcccuacaau

SEQ ID NO: 274581 - RNA, 60 nt, Human
caaaaagaagauggauguaauucucaugaaagcagugaagcaauuucaguuuuaaaaaug

SEQ ID NO: 274582 - RNA, 60 nt, Human
agccauguauuguaugaguguauuagucuaagcagugagaaucuuuucuaugccucuauu

SEQ ID NO: 274583 - RNA, 60 nt, Human
ucagacaagcuccuggcuaucuucauaaccagcagugaguagaucuucuuaauauagcug

SEQ ID NO: 274584 - RNA, 60 nt, Human
gcauuccacgagauuuuauaaccagagucuagcagugauaaaauguacaauuuacgcucu

SEQ ID NO: 274585 - RNA, 60 nt, Human
cagauuuuaguuuuauuuucuaaaguacugagcagugauauucuuuguuaauuuggacca

SEQ ID NO: 274586 - RNA, 60 nt, Human
cucuauuauaacagucaauuucugacucacagcagugaacaaacccccacuccauuguau

SEQ ID NO: 274587 - RNA, 60 nt, Human
ccaugaagccacagcccaggccuccagcucagcagugacuguggccaugguccccaagac

SEQ ID NO: 274588 - RNA, 60 nt, Human
gaaaacuaccuggaguaccggcaggugcccagcagugaucccauaugcuaugaguuacug

SEQ ID NO: 274589 - RNA, 60 nt, Human
gccucuuugaagagagcagucagcauucuuagcagugaguuucuguucuguuggaugacu

SEQ ID NO: 274590 - RNA, 60 nt, Human
gggcaggcugugggagccggggagggacugagcagugaguggggcugaaggccaggcuga

SEQ ID NO: 274591 - RNA, 64 nt, Human
cuugucugaugccugaaugucuccuuacccaugcccacggcacaggauagaugugcuauagggc

SEQ ID NO: 274592 - RNA, 64 nt, Human
gaaaaggaaggcaacugcuucaaauaaaauuccuccacggcauuauggaugagccauucauuca

SEQ ID NO: 274593 - RNA, 64 nt, Human
caggaggcagagguugcaaugagccgagauugugccacggcacuccagccugggcagcagagug

SEQ ID NO: 274594 - RNA, 60 nt, Human
uauaugcugccaucaauucuccugcuugucagcagugaaacugcagcugucaaaugagga

SEQ ID NO: 274595 - RNA, 61 nt, Human
agccagagcugcugccagagcugcguucccugcaguggagguggacuggacacccacgugc

SEQ ID NO: 274596 - RNA, 61 nt, Human
cucuuuccucuuuuuggagaaaaggaacagggcaguggaaugaaaauuuuuuguuuguuug

SEQ ID NO: 274597 - RNA, 61 nt, Human
ggaguucaaggcucaguccccgucccagauggcaguggagagucucaucccgugguccauc

SEQ ID NO: 274598 - RNA, 61 nt, Human
uacucccuccagaggagccgcccagauuccugcaguggagaggaggucuuccagcagcagc

SEQ ID NO: 274599 - RNA, 61 nt, Human
caugauucagcugaucuuaacaaaauucguagcaguggaaccuugaaaugcauguggcuag

SEQ ID NO: 274600 - RNA, 61 nt, Human
ucucuuagacacaauuucuucaucuggacgagcaguggagagggaaagcaacuucuugcug

SEQ ID NO: 274601 - RNA, 61 nt, Human
aguuuacaaguagacaccccugggggggcgggcaguggacaaggauggcaaggggugggca

SEQ ID NO: 274602 - RNA, 61 nt, Human
auccccaccugcgcacuauagcucagggucagcaguggaaugaagggccuuagaaccugca

SEQ ID NO: 274603 - RNA, 61 nt, Human
uuguuucuguuucuuuggcuuuucucgcuccgcaguggaggguuuacuaggauuuaagcuu

SEQ ID NO: 274604 - RNA, 61 nt, Human
uuaccccucacaauccuugccacaguguggggcaguggaugggugcuuaguaaguacuuaa

SEQ ID NO: 274605 - RNA, 61 nt, Human
cuagauacugaggcugcgaacuaguucuguggcaguggacuagcauaaguggaugucuaag

SEQ ID NO: 274606 - RNA, 61 nt, Human
caucauauccaaguucacucugucuuccugagcaguggaagaucauauugcuguaacuucu

SEQ ID NO: 274607 - RNA, 61 nt, Human
caccuccuagaugucaguaucagcuggcugggcaguggaauuuugagcgaccuuuacuuua

SEQ ID NO: 274608 - RNA, 64 nt, Human
gccaaagagcugucacaugggccagaaacaugagccacggcaggaagaccguggagcccguggg

SEQ ID NO: 274609 - RNA, 64 nt, Human
aacccgcagcgcccccaucugucuucagcacauuccacggcaucgcauccguccugggcgugac

SEQ ID NO: 274610 - RNA, 64 nt, Human
uuuguaucuaaaacucagauuggucacauaaaugccacggcauuccgaaguuuugauuuugauu

SEQ ID NO: 274611 - RNA, 61 nt, Human
aguuagaguaggagaggacuaauucucagcagcaguggaggugaguucuuucuuuugcgga

SEQ ID NO: 274612 - RNA, 61 nt, Human
augguuggggacaauccugcccaaaggcagggcaguggauggaauaacuccuuguggcauu

SEQ ID NO: 274613 - RNA, 61 nt, Human
uuuaccaauuugagugccuccuacaugggcagcaguggacuaagugcugggugugauaaag

SEQ ID NO: 274614 - RNA, 61 nt, Human
ugccuguuggcuacugggcucaucccagcuggcaguggagacuguagugugugcgugugug

SEQ ID NO: 274615 - RNA, 61 nt, Human
cucuuguugcuucccguucagcgucacaucugcaguggagccugaaaaggcuccacauuag

SEQ ID NO: 274616 - RNA, 61 nt, Human
gauguuucaggaggcuggaggaagggggguugcaguggagagggacagcccacugagaagu

SEQ ID NO: 274617 - RNA, 61 nt, Human
ccuuaaaucaacaaaaagaccucaugcucaugcaguggacauuucuuggccuguuuuccug

SEQ ID NO: 274618 - RNA, 61 nt, Human
cucccuccaaggcagcaaagcagaaucgggagcaguggagcagaaaugugcaagcacccug

SEQ ID NO: 274619 - RNA, 61 nt, Human
gugccagccccuccucaccacucuuccccuugcaguggaggagagagccagaguggauacu

SEQ ID NO: 274620 - RNA, 61 nt, Human
caagcaucuguggcauggacauguccucugugcaguggaaggaggaggggcgaaaguacgc

SEQ ID NO: 274621 - RNA, 61 nt, Human
cuugcuuuucuuuuuuaaaggggucuguucugcaguggagaagacauucuggugaccagac

SEQ ID NO: 274622 - RNA, 61 nt, Human
gcuuuugccucugcccaaccagguugcaguagcaguggauguuagccugcaaacaacauua

SEQ ID NO: 274623 - RNA, 61 nt, Human
cuccuaauuuuuaacacuaaaauucaaggaagcaguggaggaaagaaugcauuacuaccac

SEQ ID NO: 274624 - RNA, 61 nt, Human
ugcaucccagcucagaaggcugagaggguuugcaguggagcccugagcagggcuggauaug

SEQ ID NO: 274625 - RNA, 64 nt, Human
caccugaggauggggaggaccuggcaggcagcuuccacggcagggcugggaaguucagugccug

SEQ ID NO: 274626 - RNA, 64 nt, Human
cugcuccccagaccccaucucuccugaagaccugccacggcaagguauggggaggggagaccug

SEQ ID NO: 274627 - RNA, 64 nt, Human
gcaggcaucaagcagauccugccacaccagaugaccacggcagggcccgugcugggugagggcc

SEQ ID NO: 274628 - RNA, 61 nt, Human
aagaggaaggaugaagggcuucaggcugggggcaguggacagggaauugggauaccuggau

SEQ ID NO: 274629 - RNA, 61 nt, Human
uaaucauuaucaaucucgguuuuuuuguggugcaguggaaggagaaauaggucuaguuucu

SEQ ID NO: 274630 - RNA, 61 nt, Human
cuugccuuuuuuuuuuuuugaaauuugccgagcaguggagcccucugacaauuugcaaggc

SEQ ID NO: 274631 - RNA, 61 nt, Human
ucugugauaugccauaggugugacaauccgagcaguggagucauucagcgggagcacugcg

SEQ ID NO: 274632 - RNA, 61 nt, Human
guuucuucacggacuaggcaugcagaaauaagcaguggauuuuauugaaaccuaaaggcau

SEQ ID NO: 274633 - RNA, 61 nt, Human
uugugugccuccuacgcacaaagccagcucugcaguggaaucuggggauuauagccgggug

SEQ ID NO: 274634 - RNA, 61 nt, Human
ugguaaccaucucuggagugcagcgcuugcugcaguggaaaugaucaggaauacugaccgu

SEQ ID NO: 274635 - RNA, 61 nt, Human
auuauuaaugauuacuuagaucaauuauuuagcaguggacuaauggaagcuacagagcagg

SEQ ID NO: 274636 - RNA, 61 nt, Human
cggccuauucucagaggauuauguaaccccugcaguggaaacugagccagcuaacuuaaaa

SEQ ID NO: 274637 - RNA, 61 nt, Human
ugcucuuucucugugccugcuccuuaugagugcaguggaaggaagccacacacuggucagu

SEQ ID NO: 274638 - RNA, 61 nt, Human
ccgcaaacugaaaaagcugaguagaacaaaggcaguggagcauacaauacaauucuauuua

SEQ ID NO: 274639 - RNA, 61 nt, Human
auguccucagggcuggcagaugcaguagacugcaguggacaguccccaccuuguuacugcu

SEQ ID NO: 274640 - RNA, 61 nt, Human
ccuggugaagcccaggguggggggugucagggcaguggaggggcccgaggagccagguugc

SEQ ID NO: 274641 - RNA, 61 nt, Human
uuuuccaauagugugaguauauccauugcuggcaguggagggcuugccaugaaaaugcaac

SEQ ID NO: 274642 - RNA, 62 nt, Human
gggccccagugaggcacuuugucccgcccagcgcuggccagccccgaggagccgcugccuuc

SEQ ID NO: 274643 - RNA, 62 nt, Human
ucugaugccuuaaaagcugggccccaggcccugcuggccagagccacagaugccaagcucug

SEQ ID NO: 274644 - RNA, 62 nt, Human
cucgcagggugagaaccacuggaguggcuggggcuggccagaggucaccguuucuccuuccu

SEQ ID NO: 274645 - RNA, 61 nt, Human
cugaaagcagaagagugggauuugaugccaggcaguggaguggccucagccccagauugua

SEQ ID NO: 274646 - RNA, 61 nt, Human
caacucauuaaaaaaugcuuuauaguuuagggcaguggaaggaaggcuggcaucaaaauau

SEQ ID NO: 274647 - RNA, 61 nt, Human
gaaagguugguuucagaaaccaagagggucggcaguggacgcguacauuuugucacggagu

SEQ ID NO: 274648 - RNA, 53 nt, Human
uccugaaauguggacucugagcagcaguggaccucauaccugucuccagcucc

SEQ ID NO: 274649 - RNA, 61 nt, Human
auaggcacugguacgaauucucaauaagaaugcaguggaacaguuaaguagaacuguaacu

SEQ ID NO: 274650 - RNA, 61 nt, Human
uuucaaauccuuuugaacacguucgacaaaagcaguggagaagaggaagaccuggagcaau

SEQ ID NO: 274651 - RNA, 61 nt, Human
ggccugugcuccccaugggugaccucuggaggcaguggaccaagaugcagcaaggagagga

SEQ ID NO: 274652 - RNA, 61 nt, Human
guggugugcuugcuagcugggcaagaaagcagcaguggaccugccccaaggccacacgugc

SEQ ID NO: 274653 - RNA, 61 nt, Human
ccauaggucacgaggaauuucucccugucaagcaguggaaaacugcaugggaggcaaaaug

SEQ ID NO: 274654 - RNA, 61 nt, Human
ugggauugcacccugacacuggcauuuagcagcaguggaaccgcgagcaagucccuuccuu

SEQ ID NO: 274655 - RNA, 61 nt, Human
gcuuccuuccaggaacagucccucaggagaggcaguggaccagaagagauggcgaaacgug

SEQ ID NO: 274656 - RNA, 61 nt, Human
cguucucccugccugagaugguguggccacagcaguggaaggcugcacacaggcacauucc

SEQ ID NO: 274657 - RNA, 61 nt, Human
cgcugcugccaggugagucaccgccuguccugcaguggagcaugcacagcucgcagccucu

SEQ ID NO: 274658 - RNA, 61 nt, Human
gaucucuaucacuuugccaccuguuugaugugcaguggaaacugguuaagccaguuguuca

SEQ ID NO: 274659 - RNA, 64 nt, Human
uggccucccaaagugcugggauuacaggugugagccacggcacccagccuagcucucagaucuc

SEQ ID NO: 274660 - RNA, 64 nt, Human
cagccucccaaagugcugggauuacaagcaugcaccacggcacccagcagaauuccagucuuga

SEQ ID NO: 274661 - RNA, 64 nt, Human
caggagguggagguugcagugaacugagacugcgccacggcacuccagccugggcgacagagca

SEQ ID NO: 274662 - RNA, 61 nt, Human
aucagucccagggaagcauuuggugguggcggcaguggaggauugcccggugaaccuauaa

SEQ ID NO: 274663 - RNA, 61 nt, Human
ggguggaaccaaauagccuuugaugaaaagggcaguggauucuggaggcucuacuucaggu

SEQ ID NO: 274664 - RNA, 61 nt, Human
caccaaaucagaaaccuaacaccauguaccagcaguggagcugaucccuacguccgugucu

SEQ ID NO: 274665 - RNA, 61 nt, Human
ccuuuauaauuuacccauuucuauacaacaggcaguggaagcaguuucagagaacuuuuug

SEQ ID NO: 274666 - RNA, 61 nt, Human
ccuccuuggaacacccaagaaaccaugcaaagcaguggacaacacagaacacgcccuccuc

SEQ ID NO: 274667 - RNA, 61 nt, Human
agaaggggauuaccuuguaagaccaucuggcgcaguggaccuauuagaacuuggguuaaaa

SEQ ID NO: 274668 - RNA, 61 nt, Human
uugaaaccucccaauggcauuucagaagugagcaguggaauuuuccugccauccuaauaag

SEQ ID NO: 274669 - RNA, 61 nt, Human
gccuguccucagaggauggcgaggcagccgggcaguggaggccuucaugguaacaaaugaa

SEQ ID NO: 274670 - RNA, 61 nt, Human
cacaugggaaaacucagcacugguggugguggcaguggacagaucaaggcacuucaacuca

SEQ ID NO: 274671 - RNA, 61 nt, Human
aacgagaaauagaaauggggaacuacugcuggcaguggaacuaagaaagcccuuaggaaga

SEQ ID NO: 274672 - RNA, 61 nt, Human
cgguccagccucugccggagccccagucuccgcaguggagagcagagcgggcgguaaagcu

SEQ ID NO: 274673 - RNA, 61 nt, Human
gaucagauccucaaaaggaaauauucaguuagcaguggauauuguacaagauguaacaugg

SEQ ID NO: 274674 - RNA, 61 nt, Human
ucaaaaugaagauaguaaaacaagggaggaagcaguggauggaccaggauuaauuccuuuc

SEQ ID NO: 274675 - RNA, 61 nt, Human
auaacagagguggugccagaaugccuggacugcaguggaugugccccaccucuuugcuuaa

SEQ ID NO: 274676 - RNA, 64 nt, Human
ggcuguuggccacccuaugacuaacuggaagaggacacgccagagcuucagugagguuuccgag

SEQ ID NO: 274677 - RNA, 64 nt, Human
gaagucaguguaacaugacaacgccagggugaacacacgccacuucccagcuaggagugcacuu

SEQ ID NO: 274678 - RNA, 64 nt, Human
ccuccacuuacgaagaacuggccagggccuacgaacacgccaagauggaagagcaacugaggca

SEQ ID NO: 274679 - RNA, 61 nt, Human
aaucugaugaacaagcuggugaauaaccuuggcaguggaagggaagaugaugccauugucc

SEQ ID NO: 274680 - RNA, 61 nt, Human
aggucucagcuauaauucuguuauaugaggggcaguggacaguucccuaugccaacucacg

SEQ ID NO: 274681 - RNA, 61 nt, Human
gugaauguguugcacucugcuggaugaaauggcaguggauuuuuaaacuuuaauuucccaa

SEQ ID NO: 274682 - RNA, 61 nt, Human
gaagcucuuggaugucauuugaucggaauaugcaguggaauaggugacucacugaaaugcc

SEQ ID NO: 274683 - RNA, 61 nt, Human
accucuugguggaggaaguugggccaacacugcaguggagauaaccaccuuugcgauaaug

SEQ ID NO: 274684 - RNA, 61 nt, Human
ugcuuccauguauucagggcgcgcauugugagcaguggaguaugagccuugagggccucau

SEQ ID NO: 274685 - RNA, 61 nt, Human
gucaauuggcacagaguuucccacgggggcugcaguggauucacugugucagggaugagcc

SEQ ID NO: 274686 - RNA, 61 nt, Human
cccgccaggacccacauggggccacguguuggcaguggaaucagccugugcaggcugggga

SEQ ID NO: 274687 - RNA, 61 nt, Human
auaauuuuuuuugcuguaaguuacaucaugcgcaguggaaggucuuuuucuuauuguaaau

SEQ ID NO: 274688 - RNA, 61 nt, Human
cucuccucuacaguuuggaggugauggugcagcaguggaacaucucuugaugcaccacacu

SEQ ID NO: 274689 - RNA, 61 nt, Human
gcuacucacucaaguucaaggaccaacaagggcaguggaggugcugcauugccugcgguca

SEQ ID NO: 274690 - RNA, 61 nt, Human
caagaacguuaaaggaaacaaguagaaaucagcaguggagugucugugguaagaaaacaug

SEQ ID NO: 274691 - RNA, 61 nt, Human
uggguggaaauaugucuccaguuacaacuccgcaguggaugugaagaagcaaaaaaaaaaa

SEQ ID NO: 274692 - RNA, 61 nt, Human
aacuugcagaacucccucggagacgcagguugcaguggacauugggauuguugcuugaaaa

SEQ ID NO: 274693 - RNA, 64 nt, Human
agaggaggugggagaugagaucuuccgcacaggaacacgccagucccccuuucuccagggcugc

SEQ ID NO: 274694 - RNA, 64 nt, Human
uacauggugaagaacugcagccgggcuugugugcacacgccacacacugggcguucccggcacg

SEQ ID NO: 274695 - RNA, 64 nt, Human
caaggugcucauuccuacuaugaauccagaauaaacacgccaagauaacagcuaaaucagcaag

SEQ ID NO: 274696 - RNA, 61 nt, Human
ggguucagagacucagggccccagcacuaaagcaguggacaccaggagucccugguaauaa

SEQ ID NO: 274697 - RNA, 61 nt, Human
uaaggcuacugauuugauacuaaaugaaucagcaguggauguagggauagcugauuuuaaa

SEQ ID NO: 274698 - RNA, 61 nt, Human
ucccaccaucaucacaacuguagucucauuugcaguggagaaaagaacccgacgucccaca

SEQ ID NO: 274699 - RNA, 61 nt, Human
gggcuggagaggguggcaggcagugguuguggcaguggagcuggggagauguggucggauu

SEQ ID NO: 274700 - RNA, 61 nt, Human
augacucaaauuuucaaaugaaacaaaauaagcaguggaucuugcauuggagauggaguua

SEQ ID NO: 274701 - RNA, 61 nt, Human
cuugcucuuuccuggggguuccauuguucuagcaguggagguguuauagugucgccacucg

SEQ ID NO: 274702 - RNA, 61 nt, Human
auauuuucaggauggugcgucaggauaucuggcaguggauuucuaaugcuuuuggcuguau

SEQ ID NO: 274703 - RNA, 61 nt, Human
ccccucgucggugccugucaacugcuuuucagcaguggacugcaggggaaagagcagugau

SEQ ID NO: 274704 - RNA, 61 nt, Human
uuguuucuggagacagaagucaaaaggaagagcaguggagccuugcccacagggcugcugc

SEQ ID NO: 274705 - RNA, 61 nt, Human
acaggcacuaugcuauucucugaaagaugcagcaguggacaagacagaguaucuguccuca

SEQ ID NO: 274706 - RNA, 61 nt, Human
ggugaggggauagcgaaugcacucagggucagcaguggaguuuaaaaauugucucuuuuca

SEQ ID NO: 274707 - RNA, 61 nt, Human
cuuuuuaacuuuuuuuauauuaguaauaaaugcaguggaaaccagcauuuuauuuaauccc

SEQ ID NO: 274708 - RNA, 61 nt, Human
guugagccacagacagcucuucagcccaguagcaguggagcaggcccuguccugcccuccc

SEQ ID NO: 274709 - RNA, 61 nt, Human
acaucucagggaaacuugcguacucagcacagcaguggagaguguuccuguugaaucuugc

SEQ ID NO: 274710 - RNA, 64 nt, Human
ugugcuccuagcugcacgguggcugcuggccacaccacggcaaguggcagcaggggccggcccu

SEQ ID NO: 274711 - RNA, 64 nt, Human
aguuuuuuccccgaacugacagcaacgauuccaaccacggcaagcuggcuuccaacuauaacau

SEQ ID NO: 274712 - RNA, 64 nt, Human
ugagccccgccgugucuguggcccucucuuaaugccacggcagccacccugccauggaggcgcc

SEQ ID NO: 274713 - RNA, 61 nt, Human
ggaaggagaauuuccauuaggcaagcuguaugcaguggaauuuuccuuuuaggagacacac

SEQ ID NO: 274714 - RNA, 61 nt, Human
gccagcuuggaaguuuuacagcaauaauguugcaguggaauauuauuuguaguuaagguca

SEQ ID NO: 274715 - RNA, 61 nt, Human
gggguggggggcuucccgggacgauaaccuggcaguggaaggaaagaagcauggucuacuu

SEQ ID NO: 274716 - RNA, 61 nt, Human
auauuuuuuauuuuguuucucuaguguuauggcaguggaggugggaauuuaguccccaggu

SEQ ID NO: 274717 - RNA, 61 nt, Human
auuuacuacagugucucagccuugauaaggggcaguggauugccuguuguucgguguugug

SEQ ID NO: 274718 - RNA, 61 nt, Human
aaagguagacuuuuaugagaacaauggacaagcaguggauacgugucaaugugugcacuuu

SEQ ID NO: 274719 - RNA, 61 nt, Human
cagcaaugacucaggcaucagagaugaugcugcaguggaaaaccugacucugugugucugc

SEQ ID NO: 274720 - RNA, 61 nt, Human
uucgaggauccacuguguaagaagacuguuggcaguggaaggcucgaguugauuaagugac

SEQ ID NO: 274721 - RNA, 61 nt, Human
gaaaugcagccucaguaacuuccuuuucaaagcaguggaggagcacacggcaccuuucccc

SEQ ID NO: 274722 - RNA, 61 nt, Human
gugcuuggagggggaagagaucccaggaggugcaguggagggggcaagcuuugcuccuuca

SEQ ID NO: 274723 - RNA, 61 nt, Human
uauucuguguuuugaauuuuuauuuucuaaugcaguggaaaagaaacagaucauccuaaau

SEQ ID NO: 274724 - RNA, 61 nt, Human
cacagaaagucaucgaggcaaaaagaggcaggcaguggagucucccugucgacaguaaagu

SEQ ID NO: 274725 - RNA, 61 nt, Human
ggugugagaaagugguggugagaaccuuagagcaguggagauuugcuaccuggucuguguu

SEQ ID NO: 274726 - RNA, 61 nt, Human
aauagaauggugguuaucaagggcugguggggcaguggaggauugaggagauauuggucaa

SEQ ID NO: 274727 - RNA, 64 nt, Human
uucaucauaaaucuguccaguugaggccucaggaccacggcaugauuucaugacuccgaaguau

SEQ ID NO: 274728 - RNA, 54 nt, Human
acgagcccucacacaccugagucuccacggcagugaggaagccagccgggaaga

SEQ ID NO: 274729 - RNA, 64 nt, Human
uaggauaaggcagagaaacagauguugcagacuuccacggcacccgggggaguggugggugugg

SEQ ID NO: 274730 - RNA, 61 nt, Human
ccuuucugugguaucugaugcaggaaggacugcaguggaucagaacuuacaaaccaaacuu

SEQ ID NO: 274731 - RNA, 61 nt, Human
ucaaugugucauuuccggcugcugugugugagcaguggacacgugagggggggguggguga

SEQ ID NO: 274732 - RNA, 61 nt, Human
ucccugugcagcgcuaguaaaguugacucuugcaguggaaucccuagaaccuuggaccuga

SEQ ID NO: 274733 - RNA, 61 nt, Human
uauguucacccuaucuggcuguaucccauuggcaguggacagauugaggaaauuccuagau

SEQ ID NO: 274734 - RNA, 61 nt, Human
gugcuuugccugccucagccucauggucagagcaguggagacuggagcccuguuugcacgu

SEQ ID NO: 274735 - RNA, 61 nt, Human
gcuuuuggacagcucuccagaagcaugaacugcaguggagaugaagauccuggcucugugc

SEQ ID NO: 274736 - RNA, 61 nt, Human
caccgcaggccccuggccacugaaagagugugcaguggacugugggucucccauaugcggu

SEQ ID NO: 274737 - RNA, 61 nt, Human
cacagcauaaaagggcauuguccuuacuuuugcaguggaaaacugaauggcugacaagaug

SEQ ID NO: 274738 - RNA, 61 nt, Human
uuaguuggaguccgcguagucagcacagacagcaguggaaaggacgcucuggguccuguua

SEQ ID NO: 274739 - RNA, 61 nt, Human
cagagcuauucucugauggauuugagcaacagcaguggagauaaauguccuagagucacca

SEQ ID NO: 274740 - RNA, 61 nt, Human
agugguagagcagcaccgugccugcccugaggcaguggagucaguagcgcuguccccaggg

SEQ ID NO: 274741 - RNA, 61 nt, Human
caggugugcaaguacgacuucguggaggugcgcaguggacucacagcugacuccaagcugc

SEQ ID NO: 274742 - RNA, 61 nt, Human
cuucaugcagagauauucaggguuuggauuagcaguggaauaaagagaugggcauuguuuc

SEQ ID NO: 274743 - RNA, 61 nt, Human
aagaugaaagcguguggagaagugucagauggcaguggaagcauguguguuucuaaaaagu

SEQ ID NO: 274744 - RNA, 64 nt, Human
gaaccuauuugguuuacccugcaagcuaaauacuccacggcagagcuuaauuauccuuuuaauu

SEQ ID NO: 274745 - RNA, 64 nt, Human
cuucaaaugcccauguuggccuuuuacagcagugccacggcaccaagcgagcugccacaucuca

SEQ ID NO: 274746 - RNA, 64 nt, Human
gaggcucugaaagaaaggaggggagcagcagaagccacggcagggaggaaaggagccggagaag

SEQ ID NO: 274747 - RNA, 61 nt, Human
cuccagggacaggcugcagcuccagcgaguggcaguggagcugauucugagccagcucgcc

SEQ ID NO: 274748 - RNA, 61 nt, Human
ucugcucuagcagaggcuaaagcaggcuagagcaguggagggguggaguugaugaaaggag

SEQ ID NO: 274749 - RNA, 61 nt, Human
cccagggcaugcagucuggaagggggucccagcaguggagugccgggacccucagagugga

SEQ ID NO: 274750 - RNA, 61 nt, Human
ugccacagacaagccuagcucugcucacugugcaguggagauggaaggccagggaggagca

SEQ ID NO: 274751 - RNA, 61 nt, Human
acugcucaacacagagggugugauugacacagcaguggaaaaagcgucgucagcaggaaaa

SEQ ID NO: 274752 - RNA, 61 nt, Human
ucccuaaaggacucuggaaagccagaagacugcaguggauuucugaaacuugaacucagag

SEQ ID NO: 274753 - RNA, 61 nt, Human
agugauucacucauccugagacuuucuuuuugcaguggagagagagaauaaucuaguuggg

SEQ ID NO: 274754 - RNA, 56 nt, Human
uggacacccuaccuuucuaaucaggagcaguggagcagugagcugccuccucuccu

SEQ ID NO: 274755 - RNA, 61 nt, Human
gcagucgcggugacggggggagggccgcccggcaguggacucgcugauccugggccgcagc

SEQ ID NO: 274756 - RNA, 61 nt, Human
ccaaacucacuguccccacuguggcaugagggcaguggagcaccauguuugagggcgaagg

SEQ ID NO: 274757 - RNA, 61 nt, Human
uugacaacaaaaagccgagaacccagggccagcaguggagccucagcagaccagggccugg

SEQ ID NO: 274758 - RNA, 61 nt, Human
gaugcuguuacuaggagaguuuugagauacugcaguggaugugggauguauaugaacuucu

SEQ ID NO: 274759 - RNA, 61 nt, Human
uggcccuucugagucacaucaccgacacugagcaguggaaaggggcuauauguguaugaau

SEQ ID NO: 274760 - RNA, 61 nt, Human
gacagcuuugcuuuuucagaucccagcuucugcaguggaaaugccugguucagcagauguc

SEQ ID NO: 274761 - RNA, 64 nt, Human
aaggcugguagcucucucccucggcuuccagaguccacggcaguugcaagguaaccagugugga

SEQ ID NO: 274762 - RNA, 64 nt, Human
aagcauuagcuugaagcacuacaggaggaaugcaccacggcagcucuccgccaauuucucucag

SEQ ID NO: 274763 - RNA, 64 nt, Human
cugccaccaagggcugccauccaucgccuaguaaccacggcaacccaaccuacucuaaaaccaa

SEQ ID NO: 274764 - RNA, 61 nt, Human
uccuacggaggagaggcaguagagucaggcugcaguggaaucucccuaggaugccaaagug

SEQ ID NO: 274765 - RNA, 61 nt, Human
ggcugacagcguggcagcggagacuguggaggcaguggagacugacuucuuccugcugaca

SEQ ID NO: 274766 - RNA, 61 nt, Human
cggggcagugaaugcccaggcagcuccuggggcaguggauggauaaauagaagaacugcua

SEQ ID NO: 274767 - RNA, 61 nt, Human
gucuucgaguggaaccuggaagccccggguggcaguggauugauguccaguucuugucaga

SEQ ID NO: 274768 - RNA, 61 nt, Human
cuucugcuuuuucaaauucuugcuggucuuagcaguggagccaugccuggguuucagagca

SEQ ID NO: 274769 - RNA, 61 nt, Human
uguaaccauuguuuggauuuggaaguacucugcaguggacauaagcauugggccauaguuu

SEQ ID NO: 274770 - RNA, 61 nt, Human
gcuuuuguuucuguaggagcgccucuuccaagcaguggaggccugagggcuugagggaggc

SEQ ID NO: 274771 - RNA, 61 nt, Human
gauaagaucagccauauuucauuuugaaucugcaguggaaaaaaagcccacauuugaggug

SEQ ID NO: 274772 - RNA, 61 nt, Human
aaccucugugagcaggaggcccuaagccgcagcaguggauagaggugcagcucucugccuc

SEQ ID NO: 274773 - RNA, 61 nt, Human
ggccuccuugggccuggucccccuuugcccugcaguggaaugagggccccucagccccgca

SEQ ID NO: 274774 - RNA, 61 nt, Human
guuaguggaguccuccagcaauugaaugagagcaguggacacaucucagcaggucggucua

SEQ ID NO: 274775 - RNA, 61 nt, Human
ugaauggaugcaggaauuguguuccgugcaugcaguggaauaguaccagccuuccgcagga

SEQ ID NO: 274776 - RNA, 61 nt, Human
uaaaguggcgacuaaaacagccuuaagaauugcaguggagcaaauuggucauuuuuuaaaa

SEQ ID NO: 274777 - RNA, 61 nt, Human
uuagcacaaauaaaucauuugguuucacuuugcaguggaacacugagucacucuuuucuua

SEQ ID NO: 274778 - RNA, 64 nt, Human
agcaggauagggagccucgacucuuucucgguaaccacggcagagagcagcgccgaugugaaga

SEQ ID NO: 274779 - RNA, 64 nt, Human
uaacugauuuugcaccacuuuuuuguuacugugaccacggcagaacaaugucuucuagacuaua

SEQ ID NO: 274780 - RNA, 64 nt, Human
cuuucucuucccaugcaacacccucuucuaguuaccacggcaaccccugcagcuccucugccuu

SEQ ID NO: 274781 - RNA, 61 nt, Human
uaucuagauuacagaugggcauuuauuacuggcaguggaaacaccagauagaagaucuuag

SEQ ID NO: 274782 - RNA, 56 nt, Human
aaaugacugaugacaaguagagacgagcaguggaggaaacagccucccaaaaggac

SEQ ID NO: 274783 - RNA, 61 nt, Human
agauuuuucuguucauuuauuuuucuucauugcaguggauugauuugauaaauagaugugu

SEQ ID NO: 274784 - RNA, 61 nt, Human
agggaagcaccuggcucaaucaugucacacagcaguggaaagaauacggacucuuaaguca

SEQ ID NO: 274785 - RNA, 61 nt, Human
ucuuccccaggaggagaagaagguuucuggagcaguggacugccacaagccaccauguaac

SEQ ID NO: 274786 - RNA, 61 nt, Human
cucagucugaguuugugaggaagugugcccugcaguggaauggcuccuaaucaggguuugu

SEQ ID NO: 274787 - RNA, 61 nt, Human
ucugaguucuggugagacggagaccccgguggcaguggaaaaaucagaagcacaaaggaaa

SEQ ID NO: 274788 - RNA, 61 nt, Human
uuggcugcugccugccacagccucugugacugcaguggagcggcgaauucccuguggccug

SEQ ID NO: 274789 - RNA, 61 nt, Human
cuuuuugggcuuccccuccaaaggaccuucugcaguggaagugccacauccaguucuuuuc

SEQ ID NO: 274790 - RNA, 61 nt, Human
uccccaucgcaaaugcaguucucagcccacugcaguggauacaaggaagggccuuucucgg

SEQ ID NO: 274791 - RNA, 61 nt, Human
gacuuugaggcaagugugggccacugugguggcaguggaggugggguguuugggaggcugc

SEQ ID NO: 274792 - RNA, 61 nt, Human
agagcaaaaugaaaauuuugccuuagcuacugcaguggaaagagcacugaacuaggaguug

SEQ ID NO: 274793 - RNA, 61 nt, Human
uggaucauggccggugaaacaguuuugucuugcaguggaaagagacuuccugugaauguuu

SEQ ID NO: 274794 - RNA, 61 nt, Human
gccccucgcucccacacucggguccucuugagcaguggagcaagggagaccugggagcgug

SEQ ID NO: 274795 - RNA, 50 nt, Human
uggccucuuccucccaguaaccacggcaccugggcccuggggccuguacu

SEQ ID NO: 274796 - RNA, 64 nt, Human
ucaggagcaggaagggccaggaccagaaccuugcccacggcaacugccuuccugccucuccccu

SEQ ID NO: 274797 - RNA, 64 nt, Human
acacccgcuggagggacacucaccccaucugcucccacggcagcaccaucaacucaacaaguca

SEQ ID NO: 274798 - RNA, 61 nt, Human
ggucuauguugcaagcccuauauccuagcaugcaguggaaagugcuuagcucucucccucc

SEQ ID NO: 274799 - RNA, 61 nt, Human
gagaauggugugaacccgggaggcggagcuugcaguggagccaagauugcgccacugcacu

SEQ ID NO: 274800 - RNA, 61 nt, Human
ggacagccaccaguaggcuuggcagugggcugcaguggaaaucaacucaagauguacacga

SEQ ID NO: 274801 - RNA, 61 nt, Human
cugaggcccugaccccugcucccggccacaggcaguggagaaagccagguggccacguuuu

SEQ ID NO: 274802 - RNA, 61 nt, Human
uaguuggaucugggugucugguccauugcuggcaguggacauuauucuugcccuaagagac

SEQ ID NO: 274803 - RNA, 61 nt, Human
agacuuaccaauggaggcauugugaaugguugcaguggagcuuagguauaacaucaucaag

SEQ ID NO: 274804 - RNA, 61 nt, Human
caaacuuuccucagcugcauaaaauccauuugcaguggaguuccauguuuauuguccuuau

SEQ ID NO: 274805 - RNA, 61 nt, Human
gugaaacucauaauagacuucccacucuagggcaguggagucggaagggcacacggggugc

SEQ ID NO: 274806 - RNA, 61 nt, Human
cuugcuucuaggacucuuggccaugcugcuggcaguggagaccuucucugagcugccgcag

SEQ ID NO: 274807 - RNA, 61 nt, Human
ucgggaagugaguuucuuugcagugagcagugcaguggaagucgggcacagagguagcaga

SEQ ID NO: 274808 - RNA, 61 nt, Human
aucucucugaagaacugccaccuggucaucagcaguggagaacugugggagcugguggcuc

SEQ ID NO: 274809 - RNA, 61 nt, Human
auuugugaaaggagauucaggcagacugguggcaguggaguagggaaugggaggcuugcug

SEQ ID NO: 274810 - RNA, 61 nt, Human
gucaauuguaaguaauugugauauauucuaugcaguggaugaauguucuuuaaauuugugu

SEQ ID NO: 274811 - RNA, 61 nt, Human
cuccccaaccugcaauaaauccgcuucuccugcaguggaugagugugggugccaguccucc

SEQ ID NO: 274812 - RNA, 64 nt, Human
caggagguggagguuguagugagccaagauugcaccacggcacgcuagccugggugacacagca

SEQ ID NO: 274813 - RNA, 64 nt, Human
aggcgccccccuccauccucccccaucccgggggccacggcaggggggccgcacagcgcggcug

SEQ ID NO: 274814 - RNA, 64 nt, Human
ugucagcucaugcucacggguccuucccugucuuccacggcaggaaaagccccacguuuuuggc

SEQ ID NO: 274815 - RNA, 61 nt, Human
gcugggccuuuccagcccaacccacugucuugcaguggacggagagccuuggcgagggcag

SEQ ID NO: 274816 - RNA, 61 nt, Human
ccggaacagugucucaacuggccaggcgguggcaguggagcugcuucugacccugcagcug

SEQ ID NO: 274817 - RNA, 61 nt, Human
uucugccugcagggggcuggggggguggggggcaguggauggugcccuaucuggguagagg

SEQ ID NO: 274818 - RNA, 61 nt, Human
auuuuaagucaaguccuuuauaaagaccauagcaguggaaaacaguguacuuuuuaaaaaa

SEQ ID NO: 274819 - RNA, 61 nt, Human
ugguuccccuggauuuagugaaaugccguaugcaguggacccccaaaaguacaagggcaua

SEQ ID NO: 274820 - RNA, 61 nt, Human
cccaggagaauuuuuagucuucuuucaugaagcaguggagggguuggccucccuucuacug

SEQ ID NO: 274821 - RNA, 61 nt, Human
ucuuguuauuccuuggguguugguggaauaagcaguggaauuugaacaaggaagaggagaa

SEQ ID NO: 274822 - RNA, 61 nt, Human
gagaaaggaguuggggugagggccagagcuggcaguggaaacuuguucucuuuuucacuga

SEQ ID NO: 274823 - RNA, 61 nt, Human
cuggaugaggaggacucagugcuggcagauggcaguggaagcugcccugugcaacugugcu

SEQ ID NO: 274824 - RNA, 61 nt, Human
caucagaagacaggagugagggccccgggcagcaguggacgacccagccuccccauaccgg

SEQ ID NO: 274825 - RNA, 61 nt, Human
uagccuugguccuggggaccaccugccuggggcaguggacauccuaacuaaacaggcuucu

SEQ ID NO: 274826 - RNA, 61 nt, Human
agcaaaugcaguuacaauccauagauagccagcaguggauguuacuccaggaaaaugcagg

SEQ ID NO: 274827 - RNA, 61 nt, Human
auaauucauagaguagagugaaccuaugacugcaguggaucucaaaaacuuuuaaaaccau

SEQ ID NO: 274828 - RNA, 61 nt, Human
ucuuuuuuccuugugcacuauuuguuuaauugcaguggauuaauacagcaagagugccaca

SEQ ID NO: 274829 - RNA, 64 nt, Human
ccucacugcucccccaacccagcgucaggcugggacacgccaacgcuguuccggguuggaacag

SEQ ID NO: 274830 - RNA, 64 nt, Human
augggccauggagguccgugagcuggaacugggcacacgccaucccagagggcucaggaugccc

SEQ ID NO: 274831 - RNA, 64 nt, Human
gccacccugcacaccuccaagucagggcaccacaacacgccaccgggagagaugcugagaaaaa

SEQ ID NO: 274832 - RNA, 61 nt, Human
uugggccagcccuuuuuugacauugcuuccagcaguggaaaaugggcauuugauggcaaua

SEQ ID NO: 274833 - RNA, 61 nt, Human
augaauccuuacccaaaggaagccuguuuuagcaguggaugcaggaguugaugaacagaca

SEQ ID NO: 274834 - RNA, 61 nt, Human
gccuagagcuuguugauaauugcagcuuguggcaguggaaauauggcugaaugagcgucua

SEQ ID NO: 274835 - RNA, 61 nt, Human
aacauccaauaggaaugcuaacaguucacuugcaguggaagauacuuggaccgaguagagg

SEQ ID NO: 274836 - RNA, 61 nt, Human
auguacuccucauuuuagacauauucucuaugcaguggagauaaaucuauuaaaaggugcu

SEQ ID NO: 274837 - RNA, 61 nt, Human
agugguccaagccugcuguuuugaacccacagcaguggagauuuguauucuuauuuacagu

SEQ ID NO: 274838 - RNA, 61 nt, Human
uaguucucccucuucccacaaagcugucagcgcaguggaagagguugcacuucuccgagag

SEQ ID NO: 274839 - RNA, 61 nt, Human
ugugaagaaugcaaugggcagagaccuaccugcaguggacugucauuuuccuuucuuucuc

SEQ ID NO: 274840 - RNA, 61 nt, Human
uugaaaugcauugcucuggaucuguuccuuggcaguggacucagaaagccaacauguggcu

SEQ ID NO: 274841 - RNA, 61 nt, Human
uggaauuauuuagaaaagcauuuuuaaacuggcaguggaugacugaauaggcaucauauuu

SEQ ID NO: 274842 - RNA, 61 nt, Human
ucacagggcggcaggaugaaaaugacugccagcaguggaaaugccagacgcuuauaaaacc

SEQ ID NO: 274843 - RNA, 61 nt, Human
ggagagggacuuccucaagguuuuccugugugcaguggauccacauagcuaauaugacagc

SEQ ID NO: 274844 - RNA, 61 nt, Human
cuaagggggaaccaagacuaguuucuucagggcaguggacguaguaguuuguaaaaacguu

SEQ ID NO: 274845 - RNA, 61 nt, Human
cuauagaaaacgauuuugaacauacuucaucgcaguggacugugucccucggugcagaaac

SEQ ID NO: 274846 - RNA, 64 nt, Human
acuuggcaacuggcuuuucuccuguggagucgucacacgccauccagcagcgcuaagguggaca

SEQ ID NO: 274847 - RNA, 64 nt, Human
aagcaauuagaagccauccuaaggugcuuaccucacacgccacccaugaggcuuguggccacag

SEQ ID NO: 274848 - RNA, 64 nt, Human
ucccccgccccccaacgcgcaguguguauuugcaccacggcaggugccucuguguggagcuagg

SEQ ID NO: 274849 - RNA, 61 nt, Human
accaccagaaccaacuccucuuucaaacacagcaguggauucuuucucucagaagaucaug

SEQ ID NO: 274850 - RNA, 61 nt, Human
guuagauuuucugccagaggggugggucagagcaguggaggggagacaucgcccaugugcu

SEQ ID NO: 274851 - RNA, 61 nt, Human
agccgauaaacauugauuaauuuuaggccaugcaguggaaccugucaccuaaugggacugc

SEQ ID NO: 274852 - RNA, 61 nt, Human
uuugggcaguaggaacucaggcuucuggucugcaguggagccuguucgccucuaauagcca

SEQ ID NO: 274853 - RNA, 61 nt, Human
cuguuacugcauuuagcauggcucugacgaggcaguggagaguuccugacagcauagcaua

SEQ ID NO: 274854 - RNA, 61 nt, Human
uuucagaacauccccacugucaugugucucagcaguggagacugcaaguaaggcuuuuaau

SEQ ID NO: 274855 - RNA, 61 nt, Human
gugagacccugucucaaaaaaaaaaaaaaaggcaguggaaauagagaaguaacuuaaaggu

SEQ ID NO: 274856 - RNA, 61 nt, Human
cuaaacagaucgcaucccuuggaauuagaaagcaguggagaccgggcgcagugacucacac

SEQ ID NO: 274857 - RNA, 61 nt, Human
cuccgcagaugcuucauuuugacccuuggcugcaguggaagucagcacagagcagugcccu

SEQ ID NO: 274858 - RNA, 61 nt, Human
gagcagggugcuauugugaggccaucucugagcaguggacucaaaagcauuuucaggcaug

SEQ ID NO: 274859 - RNA, 61 nt, Human
aggauuucuuccucugaggacaccaaagcccgcaguggacugaugccuucgaugggcagga

SEQ ID NO: 274860 - RNA, 61 nt, Human
cauuuuuaggaauggaaagcaggccucugaggcaguggacaggaagacuucucauccuuga

SEQ ID NO: 274861 - RNA, 61 nt, Human
gcugugucuguguccccucgugaaauagugugcaguggaggucucuuguggugcuagaugu

SEQ ID NO: 274862 - RNA, 61 nt, Human
gguccacaggaagugaagaaucuguuucccagcaguggacucaaaacccaucugggcuccu

SEQ ID NO: 274863 - RNA, 64 nt, Human
cagcugggucaauaagggcaggugguucagcgagccacggcagcccccuguaucuggauuguaa

SEQ ID NO: 274864 - RNA, 64 nt, Human
agcgccucuucccaccaguccucagccaccuucuccacggcagcgaccuccgucucaaguuccg

SEQ ID NO: 274865 - RNA, 56 nt, Human
gcgugcagccggcccaguagcccagaccacggcagggcaugaccuggggagggcag

SEQ ID NO: 274866 - RNA, 61 nt, Human
gccauauacgugaaacugaagagugcauugggcaguggaagcuauuuuuugccuucccugu

SEQ ID NO: 274867 - RNA, 57 nt, Human
uucgagcugacagacugugaacagaaggcaguggaacagaagaauguuuuucugcaa

SEQ ID NO: 274868 - RNA, 61 nt, Human
guucaauaugagggauguguuuuauuaauuggcaguggaaauuggaaugugauuuaaggaa

SEQ ID NO: 274869 - RNA, 61 nt, Human
acaaguuggauccccuggcccauccucuccugcaguggaucaucucuagcaacaggucaca

SEQ ID NO: 274870 - RNA, 61 nt, Human
gaggugggacccugacuaucaccccuaaucugcaguggauuuggcucucggcacucccagg

SEQ ID NO: 274871 - RNA, 61 nt, Human
uaaugcucuaacgugauaaaccugcuccaaggcaguggaaauaaaaagaaggaaaaaaaag

SEQ ID NO: 274872 - RNA, 61 nt, Human
caggcaguagggggaggcgccacccauggcugcaguggaggggccagggcugagccggcgg

SEQ ID NO: 274873 - RNA, 61 nt, Human
gugaggcuguaagugugucagcacauuugccgcaguggauguguacugagggggcuggagg

SEQ ID NO: 274874 - RNA, 61 nt, Human
agcaugagguccgccuccugggcgagacccagcaguggacagcaugguccucacacccagc

SEQ ID NO: 274875 - RNA, 61 nt, Human
uauugcugagcucaaagccaagcagaggccggcaguggaggcugagcagggacucuccagg

SEQ ID NO: 274876 - RNA, 61 nt, Human
guuaaaaaaaauguauaaaauuuacaucugugcaguggaguuguuaaguucuagaaacagu

SEQ ID NO: 274877 - RNA, 61 nt, Human
agccaggcccaagacacagcagaggucaaaggcaguggagagccuuggccaguucagugac

SEQ ID NO: 274878 - RNA, 61 nt, Human
gaccaucucaugaccuguggcauugcacggugcaguggacagaagggauuauccucagcca

SEQ ID NO: 274879 - RNA, 61 nt, Human
ggagagggggcuggugggugccuaggccugggcaguggauggccgugaaugggugcccaca

SEQ ID NO: 274880 - RNA, 64 nt, Human
cucccgccacgcaccgguuagugagacagggcugccacggcaaccgccaagccccccucaaggu

SEQ ID NO: 274881 - RNA, 64 nt, Human
ucuggaccccuccucugccccgcaggaggaaguuccacggcagguggugcguucccacgcaggc

SEQ ID NO: 274882 - RNA, 61 nt, Human
uuugaagcaacugugaauucauucuggaggggcaguggagaucaggagugacagaucacag

SEQ ID NO: 274883 - RNA, 61 nt, Human
ccuaccguccccaaugcccccugggcaggaggcaguggagaaccaagccccauggccucag

SEQ ID NO: 274884 - RNA, 58 nt, Human
ucaauuuuauuuacaacugaauuccugcgcaguggagaaguaaaagaagccgcuuguc

SEQ ID NO: 274885 - RNA, 61 nt, Human
aggggcuccccagaggucacacagccugugugcaguggagcuggcaccauucagacuuuca

SEQ ID NO: 274886 - RNA, 61 nt, Human
ccugggccuccuccgggagccucccaucugggcaguggagccauaaacggggauccgagaa

SEQ ID NO: 274887 - RNA, 61 nt, Human
caagucccucuuccucggaguuucucuagcugcaguggaagauucuguuuuccugugggga

SEQ ID NO: 274888 - RNA, 61 nt, Human
ugccuggugcauugcugugugaauccaggaggcaguggacaucguaggcagccacggcccc

SEQ ID NO: 274889 - RNA, 61 nt, Human
ucccagucccucgccgucccucccaggucgggcaguggaggcugcugugaaaacucuggua

SEQ ID NO: 274890 - RNA, 61 nt, Human
caucagggaagagggggccaugagccggccagcaguggagacggcaguccaguuucucucc

SEQ ID NO: 274891 - RNA, 61 nt, Human
ucaaggcuaaaaaaaagucuugcaaaauggggcaguggacugacaggcugacauagaaaau

SEQ ID NO: 274892 - RNA, 61 nt, Human
uagggucugggcccugcucccugucccaucugcaguggaccccaggcaccccccuuugagg

SEQ ID NO: 274893 - RNA, 61 nt, Human
aggaggaacuuucaaaagucuggcccacugugcaguggagcagaaggcaggaccaugaggc

SEQ ID NO: 274894 - RNA, 61 nt, Human
gcucuuggaaccugggaggcagcaucugggggcaguggauagaacacccggccuguuucug

SEQ ID NO: 274895 - RNA, 61 nt, Human
agaccuaggccuccuggcacccaguccacuggcaguggaauugcuuuccugagaaucauuc

SEQ ID NO: 274896 - RNA, 64 nt, Human
caggcagugugguaguugucugauuuuguuuaccacacgccaggucccagggaagucuugcaca

SEQ ID NO: 274897 - RNA, 64 nt, Human
ugcugcaugcacugcauaugaaauaaaaucugcuacacgccagggagaacagguguccuguguc

SEQ ID NO: 274898 - RNA, 64 nt, Human
cucaggaggaaaagcucagccuggacuguggcagccacggcagaagguggaucuugggaucaau

SEQ ID NO: 274899 - RNA, 61 nt, Human
ccuugggcucccccaaggguucugcgaagaggcaguggaagaaggcaugaggagagggucu

SEQ ID NO: 274900 - RNA, 61 nt, Human
uccucagcuugagaucuucuuagcccagagagcaguggaguugagugaggaggcagauguc

SEQ ID NO: 274901 - RNA, 53 nt, Human
aacugauucuuggagacuaaaaagcaguggacuuaaucgguugacccuacugu

SEQ ID NO: 274902 - RNA, 61 nt, Human
aaucccaaacucaaaccaaaccaaacagaaagcaguggagguggggguugcuguugauuga

SEQ ID NO: 274903 - RNA, 61 nt, Human
ggggggucugaggcuguggaaguccgacugggcaguggaaugcugauggaggcagacgcug

SEQ ID NO: 274904 - RNA, 61 nt, Human
caaagugcuaggauuacaggugugagccacugcaguggaccaauuuuuguauuuuuuuaaa

SEQ ID NO: 274905 - RNA, 61 nt, Human
agggaggaccucaggguuccuggagauuccugcaguggaacuccaugccccgccucccaac

SEQ ID NO: 274906 - RNA, 61 nt, Human
ggagguggcaccugcaucaccuccuccucuugcaguggaaacuuugugcaaagaauagaua

SEQ ID NO: 274907 - RNA, 61 nt, Human
ccaaaaagguauuuggucauuaucuucuacagcaguggaaugaguggucccggagaugugc

SEQ ID NO: 274908 - RNA, 61 nt, Human
cuucccccaagaaaaaguguacagacagcuggcaguggagccugcuuuauuuagcaggggc

SEQ ID NO: 274909 - RNA, 61 nt, Human
gcuguuaggacccgauggggaggcagcccccgcaguggacaacccccgcuuggacacaguc

SEQ ID NO: 274910 - RNA, 61 nt, Human
gaucaugcaaacuguggagaucacuaagcaugcaguggacauagaagagaagggugugagg

SEQ ID NO: 274911 - RNA, 61 nt, Human
cuggccuuucuucuacccaccucuaaagcuggcaguggagucucugccucacccaaagacu

SEQ ID NO: 274912 - RNA, 61 nt, Human
cacccagaggaaagucagcuccugaaacgcugcaguggaacgcgcagccaccgcaccugag

SEQ ID NO: 274913 - RNA, 64 nt, Human
cacguguuuuuauugcugacuuuaaauauuuaucccacggcagacagagacauuuggugucuuu

SEQ ID NO: 274914 - RNA, 64 nt, Human
cagccucccaaaguacugugauuacaagcgugagccacggcaccugggcagaaaaguaucuuaa

SEQ ID NO: 274915 - RNA, 64 nt, Human
caccugaccguggcccgcccagccacucccgggaccacggcaaaaggaaccacccagacccacc

SEQ ID NO: 274916 - RNA, 61 nt, Human
cuuggauuugcauuacauugaccccagcccugcaguggaaccuaauaaaagcgccugaagc

SEQ ID NO: 274917 - RNA, 61 nt, Human
acgucaggcucagguuccaugggaggacgaagcaguggacgcauugugggcuuuagggaca

SEQ ID NO: 274918 - RNA, 61 nt, Human
uguucccaucgggcccugcuggcagggacuugcaguggauucuuggucaggugugcccaca

SEQ ID NO: 274919 - RNA, 61 nt, Human
ugagcagugaggagcagucccucuacuacaggcaguggaccuuggcccggcagcaccacgc

SEQ ID NO: 274920 - RNA, 61 nt, Human
gagaagacugugcuggguugauuuaugcugggcaguggaacgauuuccaaugugaagacgu

SEQ ID NO: 274921 - RNA, 61 nt, Human
gccagcucuacugggcuuggagcacguccgggcaguggagggagggacacagccugggaca

SEQ ID NO: 274922 - RNA, 61 nt, Human
uaauuagaaaagaauuguuguugggcugggcgcaguggaucgcaccuguaaucccagucac

SEQ ID NO: 274923 - RNA, 61 nt, Human
gggaaagggagggagaguuuugcggggguuggcaguggagagcaggcuggagaggagaugg

SEQ ID NO: 274924 - RNA, 61 nt, Human
gugcagcccuagaggaccccagggcugaggggcaguggauccugcgggagucucccggggc

SEQ ID NO: 274925 - RNA, 61 nt, Human
cagaccccaggguccuuggccuaggagaggagcaguggaggggcccaggcucugagcucca

SEQ ID NO: 274926 - RNA, 61 nt, Human
ccagcuauaaccaguaucagcaguaugcccagcaguggaaccaguacuaucagaaccaggg

SEQ ID NO: 274927 - RNA, 61 nt, Human
ucagcgcaggccacggcccgagggggcgcccgcaguggacaggacccgcguggguugggaa

SEQ ID NO: 274928 - RNA, 61 nt, Human
uggacaggacccgcguggguugggaaggaaagcaguggaacuggccggaccccgccuggag

SEQ ID NO: 274929 - RNA, 61 nt, Human
agguguuuaugauaagaggauugggccaggugcaguggaucacgccuguaaucccagcaca

SEQ ID NO: 274930 - RNA, 64 nt, Human
cagccacgccuggaccgcgccgcgccgcagccccacacgccagcucggcuguuuuucugcauua

SEQ ID NO: 274931 - RNA, 64 nt, Human
aaguggacacauuuuacaaaaacguuuuuuaaauacacgccagcucuucgagaagcacuuuuuu

SEQ ID NO: 274932 - RNA, 64 nt, Human
ggggccauggacccaugcgggggguuccagggucacacgccacauaacagacaaaaauacacac

SEQ ID NO: 274933 - RNA, 61 nt, Human
cagagucuggcucugucacccaggcuggagugcaguggagcaaucucggcucauugaaccu

SEQ ID NO: 274934 - RNA, 61 nt, Human
acggaaagcgcuagcagacccccgagagggugcaguggagcccugagcauuguaauaugcg

SEQ ID NO: 274935 - RNA, 61 nt, Human
aaaguccacacuggauaaggcccuuaugaaugcaguggauaugggaaagccuucagucacc

SEQ ID NO: 274936 - RNA, 61 nt, Human
cugagcgcuguggggagcgcgcccggaccuggcaguggagccaccgagcgagcagcucggu

SEQ ID NO: 274937 - RNA, 61 nt, Human
cgguuuguuggguuuuucgucuuuccagauugcaguggacacagcccccgaucucgagccc

SEQ ID NO: 274938 - RNA, 61 nt, Human
ccucaguggaagugacggcuacuguggagaugcaguggaggaccugguggcugagccagga

SEQ ID NO: 274939 - RNA, 61 nt, Human
agggacucggcccagggccgucaaggaaagggcaguggacgugcugcgcauguucgggagc

SEQ ID NO: 274940 - RNA, 54 nt, Human
auaauggaaacaaacccugacaaugcaguggacauguucaugccuuugggaaga

SEQ ID NO: 274941 - RNA, 61 nt, Human
augaguguaaaacuguaccacugggccaagugcaguggaucaugucuguaauccuagcacu

SEQ ID NO: 274942 - RNA, 61 nt, Human
ccgcaguagguucuagggggcggugcuggccgcaguggacuggccugcaggugagcacugc

SEQ ID NO: 274943 - RNA, 61 nt, Human
acuguuguggucauacuuagaagagugggaugcaguggauggcugggcuauggguccugcc

SEQ ID NO: 274944 - RNA, 61 nt, Human
cgcaggacacuguggccaugccacggagggggcaguggacaaaaccaauccaaagccaagc

SEQ ID NO: 274945 - RNA, 61 nt, Human
ccugcuacagaacacagcacccauggcgccugcaguggacuggccccuuaauucccacagg

SEQ ID NO: 274946 - RNA, 61 nt, Human
caagguggcuguuauaaauuugacuucauuggcaguggaugaagccuaagccagcugaguc

SEQ ID NO: 274947 - RNA, 64 nt, Human
cgcgccauugcacuccaaccuaggugacaaagcuacacgccaucucaaaaaaaaaaaagaaaaa

SEQ ID NO: 274948 - RNA, 64 nt, Human; identical to SEQ ID NO: 270434

SEQ ID NO: 274949 - RNA, 64 nt, Human
ugccucagccuccugaguagcugggauuacaggcacacgccaccacacgcagcuaauuuuugua

SEQ ID NO: 274950 - RNA, 61 nt, Human
uuagaccuccaccauccaaagcucaugcccggcaguggacucgcccucgcuccaucuaccu

SEQ ID NO: 274951 - RNA, 61 nt, Human
aucuuuuuauagggaaaaauggccuuuguaggcaguggaaaacuugcaaggaaagcugccg

SEQ ID NO: 274952 - RNA, 61 nt, Human
uuaacggaagcaaauucauuauuuuuuaaaugcaguggacuuuucaaaaaguuuaaauuag

SEQ ID NO: 274953 - RNA, 61 nt, Human
aaagaaggaagggaggacccaaucuauaggagcaguggacugcuugcuggucgcuuacauc

SEQ ID NO: 274954 - RNA, 61 nt, Human
guguaccagggaagagaccuugugccucuaagcaguggaccauggucaccuugcuggguag

SEQ ID NO: 274955 - RNA, 61 nt, Human
ggacuccaggacccuggagaagggagaccuggcaguggagggaggcugugcuguguguccc

SEQ ID NO: 274956 - RNA, 61 nt, Human
caggcaggaagggaggaggagagccaggugagcaguggagagaaggggggcccugcacaag

SEQ ID NO: 274957 - RNA, 61 nt, Human
caacccaaguuucauccgaggaaauguccccgcaguggaugcagcucacaugcugaggaac

SEQ ID NO: 274958 - RNA, 61 nt, Human
ucuuucccccacuagaaaucacauucacuaagcaguggauugaauuuaagagugcugcccc

SEQ ID NO: 274959 - RNA, 61 nt, Human
auggaaaaacaacagccauaauggcagcauggcaguggaaggguuugucuugugcccaggc

SEQ ID NO: 274960 - RNA, 61 nt, Human
ccucucccccuggcugaucacucucccucaggcaguggagaucugcgucuggacacccuca

SEQ ID NO: 274961 - RNA, 61 nt, Human
aaucccacaccuguacagaacugggauaggcgcaguggagcggguugcuuggggggcguug

SEQ ID NO: 274962 - RNA, 61 nt, Human
ugaauucaugacaacgauauguuggugacuggcaguggaagcccuugacacucuuguuuuc

SEQ ID NO: 274963 - RNA, 61 nt, Human
cuguuacucgaauccacccaggaacucccuggcaguggauugugggaggcucuugcuuaca

SEQ ID NO: 274964 - RNA, 64 nt, Human
gccaggccacaagacccuuguggucccaccccacacacgccagauucuuuccugaggcugggcu

SEQ ID NO: 274965 - RNA, 64 nt, Human
aaggacgucgcuguugaaaugugaaucccggcggacacgccaaauugcgaggcgacggaaacgg

SEQ ID NO: 274966 - RNA, 64 nt, Human
cacaagcuuugcccaaggacuaagcuguucguccacacgccaccaucuaccaguggggacgccc

SEQ ID NO: 274967 - RNA, 61 nt, Human
cacaugccgccauuuuccugaaucaaauucugcaguggaauggagaggaaaauacuucuag

SEQ ID NO: 274968 - RNA, 61 nt, Human
uagcugcgggagggggagggggagugggcgggcaguggauaguaagacuuacugcagucga

SEQ ID NO: 274969 - RNA, 61 nt, Human
aaacugaggcucggcaagcauaggcgaguuggcaguggaacacggaucuaaacucaggugu

SEQ ID NO: 274970 - RNA, 61 nt, Human
uggggcuauagagauucuccaaggacagauggcaguggagcuagaccugaguagggggcag

SEQ ID NO: 274971 - RNA, 61 nt, Human
gcccugcgaccucccugcccugccgccacaugcaguggaggagaggccuguggcccaaaga

SEQ ID NO: 274972 - RNA, 61 nt, Human
gcccugcgaccuacccgcccugccgccacaugcaguggaggagaggccuguggcccgaaga

SEQ ID NO: 274973 - RNA, 61 nt, Human
cucagaagccucaggacccaacagguggcaggcaguggacagggugcccgccccacagugc

SEQ ID NO: 274974 - RNA, 61 nt, Human
cggccagcagcuaccugagccugacgcccgagcaguggaggucccgcagaagcuacagcug

SEQ ID NO: 274975 - RNA, 61 nt, Human
ggaggaaguuucagcugagaagauggagcaugcaguggaagaggugaagaacagccugcag

SEQ ID NO: 274976 - RNA, 61 nt, Human
cuguuccuugcccaccucaggccuggugguggcaguggaggaggcugaggaggcugaagag

SEQ ID NO: 274977 - RNA, 61 nt, Human
ugggcuucgcagggguagaucccaggacucggcaguggaugggaugcagccagucaugggu

SEQ ID NO: 274978 - RNA, 61 nt, Human
gccguccuggggcgccgccgccccgccgccggcaguggaccgcugugcgcgaacccugaac

SEQ ID NO: 274979 - RNA, 61 nt, Human
gccgcgcaguucucugcaggugcagaugcaggcaguggagguggccugagcaggcagaagg

SEQ ID NO: 274980 - RNA, 61 nt, Human
cagaaauuugcugucaauauauaacccgccugcaguggaaaguguauaguguuuuguaaua

SEQ ID NO: 274981 - RNA, 64 nt, Human
guagaggcaugaacacacauggaugcacacacacacacgccaaugcacacacacagagauaugc

SEQ ID NO: 274982 - RNA, 64 nt, Human
ccgcagcucugugcccggcaagaagcagcuagacacacgccagggcgccaagcacggccagcuc

SEQ ID NO: 274983 - RNA, 61 nt, Human
agcgguggaccaagcacugguguuggcuucugcaguggaccaagcaccaguggcuucagcg

SEQ ID NO: 274984 - RNA, 61 nt, Human
ggugguggaccgagcaccagugcuggcuuuggcaguggagccgccagucuuggugccugug

SEQ ID NO: 274985 - RNA, 61 nt, Human
gccugcuguucccugaaaaucugauaauggagcaguggagguuuuuuucuuucugugcucu

SEQ ID NO: 274986 - RNA, 61 nt, Human
uauauugcugaaugcaagaaguggggcagcagcaguggagagaugggacaauuagauaaau

SEQ ID NO: 274987 - RNA, 61 nt, Human
guauagauaaauccaauagucugccacaagggcaguggaagagcugcuguauuugaggaaa

SEQ ID NO: 274988 - RNA, 61 nt, Human
gaccuuucaaagccauuuuaggcuguuaggggcaguggagguagaaugacuccuuggguau

SEQ ID NO: 274989 - RNA, 61 nt, Human
auggagucuugcuugucacccaggcuggagugcaguggagugaucucugcucacugcaacc

SEQ ID NO: 274990 - RNA, 61 nt, Human
uucuauuuugugaauuugggacauaauaacagcaguggaguaaguauuuagaagugugaau

SEQ ID NO: 274991 - RNA, 61 nt, Human
auuccauuuugugaauugugacauaauaauagcaguggaaaaaguauuugcuuaaaauugu

SEQ ID NO: 274992 - RNA, 61 nt, Human
uguugcaugacagauuuaacuauucuuuccagcaguggaggugcugucagaguccaguguu

SEQ ID NO: 274993 - RNA, 61 nt, Human
gaagaaaauguuuuacaauggcuggguuugggcaguggagaggggacuuggauaggagcuu

SEQ ID NO: 274994 - RNA, 61 nt, Human
auucagguugcaguuuuaauauucauugggggcaguggaauugcauguguaaauuauguua

SEQ ID NO: 274995 - RNA, 61 nt, Human
auuccauuuugugaauugggacauaguuacagcaguggaauaaguauucauuuagaaaugu

SEQ ID NO: 274996 - RNA, 61 nt, Human
cauuccauuuugugaauugugacaaauaacagcaguggaaaaaguaugugcuuagaauugu

SEQ ID NO: 274997 - RNA, 64 nt, Human
gacggcgagggcaucgucauugcccugagcguggacacgccaccggcagccguaagggaaaagg

SEQ ID NO: 274998 - RNA, 64 nt, Human
uucccugggcacucaugcuccacaccaaagcaggacacgccauuuuccacugaccacccuauac

SEQ ID NO: 274999 - RNA, 64 nt, Human
ggagcaggcucgccgcaagucauacuagugagccacacgccacagucagcgucugcugcuugug

SEQ ID NO: 275000 - RNA, 61 nt, Human
auuccauuuugugaguugucacauaauaacagcaguggaauauguauuugccuauauugug

SEQ ID NO: 275001 - RNA, 61 nt, Human
ccauucuauuuugugaauugggauaauaacagcaguggaauaaguacuuagaaaugugaaa

SEQ ID NO: 275002 - RNA, 61 nt, Human
ugagggcucuagaaaccaagccccaugagcagcaguggaagaccucgggccaugcggccug

SEQ ID NO: 275003 - RNA, 64 nt, Human
ccuggcagggcucacacuccugggcucugaacacacacgccagcuccucucugaagcgacucuc

SEQ ID NO: 275004 - RNA, 64 nt, Human
cgcccuccagaguuaccuggggaggaccgaggccacacgccacugcccccgaggccagagugua

SEQ ID NO: 275005 - RNA, 64 nt, Human
cauggaucacaaaacaauauacccuguauuucuuacacgccacuuauaugcagcaaggaguaaa

SEQ ID NO: 275006 - RNA, 64 nt, Human
ugccucagccucccaaguagcugggacuacaggcacacgccaccacacccagcuaauuuuuugu

SEQ ID NO: 275007 - RNA, 64 nt, Human
caggcugggagaaggggcuccugggugucuguauacacgccaaaggcagauacaaauaaaauac

SEQ ID NO: 275008 - RNA, 64 nt, Human
cagguaccuaagcaagucaguuggguacagcaggacacgccaccauuccaggguagcugguacc

SEQ ID NO: 275009 - RNA, 64 nt, Human
gagucggccuuacuccguuuccuuagcgcccaugacacgccaagucccguuucgcacucggcuu

SEQ ID NO: 275010 - RNA, 64 nt, Human
ccucccaagcagcugggauuauagacacccgccaacacgccaggcuaauguuuuuguauuuuua

SEQ ID NO: 275011 - RNA, 64 nt, Human
gagccacauccaggugcagcuggagcuggacagcacacgccaugccgugaagauccaggcaucu

SEQ ID NO: 275012 - RNA, 64 nt, Human
gauuagucuaaauuuucagagagaaauagauaaaacacgccacagccugggaaggagcgugcuc

SEQ ID NO: 275013 - RNA, 64 nt, Human
acuguuuuguaaagcgaggugggaccgauguggcacacgccagcugcgguuucccggagcgugg

SEQ ID NO: 275014 - RNA, 64 nt, Human
uccuucuacuagcccgcggcgccgcccgggugggacacgccaagcucuucagugaagacacgau

SEQ ID NO: 275015 - RNA, 64 nt, Human
uuuuaccaccuggugaaucagccauaacgcacacacacgccacccagccucuuguuucuaguau

SEQ ID NO: 275016 - RNA, 64 nt, Human
gcacaugccuccacaugcgaacacccacuuacacacacgccacucacacuggcacacaugcugu

SEQ ID NO: 275017 - RNA, 64 nt, Human
gcggaggccaugcgggugcucaccacccccaugcacacgccaucuguguaacuucaggaucugu

SEQ ID NO: 275018 - RNA, 64 nt, Human
gccugacaacagucuucugcccaugucugggaacacacgccaggaggaaugucugauacccucu

SEQ ID NO: 275019 - RNA, 64 nt, Human
ggcacuggcuagggaggggcaggccuccuuccugccccucgagacacucuugggagaugcauuu

SEQ ID NO: 275020 - RNA, 64 nt, Human; identical to SEQ ID NO: 275019

SEQ ID NO: 275021 - RNA, 64 nt, Human
ugcgacccaacuucauuuguuuacuugaaaauucccccucgagguugagagaaccucugaggug

SEQ ID NO: 275022 - RNA, 64 nt, Human
cacuguugcugacuacuacucugccaaucggcuaccccucgacucagcaccacauugccucauu

SEQ ID NO: 275023 - RNA, 64 nt, Human
ggcauccugcccgccgccugcucucugcccccauccccucgacgacccccgccccugccccccc

SEQ ID NO: 275024 - RNA, 64 nt, Human
uugaauugcuucauucaacacccccacccucccuccccucgaggugguaccuaagcuguggauu

SEQ ID NO: 275025 - RNA, 64 nt, Human
ugccacaggcuggcaggggccucugggggccccuccccucgacccccagccuggguagagccac

SEQ ID NO: 275026 - RNA, 64 nt, Human
cucgcucgauuccuuuucccgcgcuccaugccucccccucgacucccggugcugcggaagaacu

SEQ ID NO: 275027 - RNA, 64 nt, Human
gugcuucuaaagucagaacagguucuccaaggauccccucgagacuacucuguuaccagucaug

SEQ ID NO: 275028 - RNA, 64 nt, Human
gcuggauucaguccauggaccauagauugcugucccccucgacggacuuauaauguuucaggug

SEQ ID NO: 275029 - RNA, 64 nt, Human
ugcacaucagcaaaugucuuuagaucuccaucucccccucgagcuggaccauuugguuacccuc

SEQ ID NO: 275030 - RNA, 64 nt, Human
cuccccccagcucccugcaccgccgcagaagcagccccucgaggccuacagaggaggccucaaa

SEQ ID NO: 275031 - RNA, 64 nt, Human
uagaccuugaggugaucagcauaagaggccagauccccucgagucaucuacaccuagcuucacc

SEQ ID NO: 275032 - RNA, 64 nt, Human
gagacacugcuggugggagcaggaaggagcagugccccucgagcagccaggaagccugcggauc

SEQ ID NO: 275033 - RNA, 64 nt, Human
uauaaaucagcagucucuugggcagaggagcaagccccucgaacaugauuucaaacaagcaggu

SEQ ID NO: 275034 - RNA, 64 nt, Human
gcagugagauuagucuguguccacaagcagaggcccccucgaugggagggaguggcaggcagga

SEQ ID NO: 275035 - RNA, 62 nt, Human
gcuccuauguaucagguuaagagcaagggagagcuggccagggacagcaguuugcacagcag

SEQ ID NO: 275036 - RNA, 62 nt, Human
auccaacauucaacaacgggucugaaugucuagcuggccauuggcuugugcuguguuaagaa

SEQ ID NO: 275037 - RNA, 62 nt, Human
cugacuauuccgcugcugcaggaacccagcuagcuggccagguggggaggggcuggggaccg

SEQ ID NO: 275038 - RNA, 62 nt, Human
cgcaguggugugagucugcaggcccuggacccgcuggccagagggacaccuugguggcacug

SEQ ID NO: 275039 - RNA, 64 nt, Human
cgggguggcucacagcuuugaaccugccaaaggaccccucgacuggccacagcccagcccagcc

SEQ ID NO: 275040 - RNA, 64 nt, Human
caaagguaacucgagguggaggguagcccuggggccccucgacaucaccgucauugauggagcc

SEQ ID NO: 275041 - RNA, 64 nt, Human
aaucuugccaagcuguccgugagagacacgggcuccccucgagggagacuugcaaaugcuccau

SEQ ID NO: 275042 - RNA, 64 nt, Human
cugcucaaaggagggguuggcggugcaggggcaaccccucgaaagcggggugucuucucuuuuc

SEQ ID NO: 275043 - RNA, 64 nt, Human
gacugggcuccuucccuugacuuccagggagcacccccucgauuugggcagaugguggagucaa

SEQ ID NO: 275044 - RNA, 64 nt, Human
gcacaggacugaggauccucuccuccagaaaagcccccucgaggaaauaaauuagugcgguucu

SEQ ID NO: 275045 - RNA, 64 nt, Human
ccuaaaaacgccccugguccggccccacucugcgccccucgaucucccaggcucuuucugcagu

SEQ ID NO: 275046 - RNA, 64 nt, Human
cuguccuguguguugugggaggggaugggaggcgccccucgagugugcguguaucagggggucu

SEQ ID NO: 275047 - RNA, 64 nt, Human
auccccguuccccccagguggccugggagguggcccccucgaggaugacuccacuagcgcccug

SEQ ID NO: 275048 - RNA, 64 nt, Human
aaaacaagagcuggguaguuuagccaaacggcacccccucgaguucacugcagacccuucguuc

SEQ ID NO: 275049 - RNA, 64 nt, Human
cugcagacgacccccgcagccuuucccucggaccccccucgaagcccccuggacugauucccac

SEQ ID NO: 275050 - RNA, 64 nt, Human
caccucauuguuucccccacgucucccucuauacccccucgaagacucgagagggggagggggu

SEQ ID NO: 275051 - RNA, 64 nt, Human
cccaacccacauaccuccauuccacuugugacacccccucgacucccuggugacgcuccuccca

SEQ ID NO: 275052 - RNA, 64 nt, Human
cuccugcaggggaagcccugguccagcugggugcccccucgagcuccgggcggacucgcacaca

SEQ ID NO: 275053 - RNA, 64 nt, Human
ggagagaaggggagugcggagccccgucucccuaccccucgagcaccugggccagcggcugagc

SEQ ID NO: 275054 - RNA, 64 nt, Human
cggcccuuugugacucuuggcauccggagacuuuccccucgacccaguggagccgucaggccgg

SEQ ID NO: 275055 - RNA, 62 nt, Human
ugguggcaccagaugcaaccucacuaugguaugcuggccagcacccucuccuggggguggca

SEQ ID NO: 275056 - RNA, 62 nt, Human
uggcccaaggcuggcaggucaaccucgcgcuugcuggccaguccacccugccugccgucugu

SEQ ID NO: 275057 - RNA, 62 nt, Human
gggugauucagagguggggaugggcagagagggcuggccacucugccucaggacuugaccuc

SEQ ID NO: 275058 - RNA, 62 nt, Human
uugaaaugcuuaucaggauaaugguagcuauagcuggccauuuagaggaauucuaggacagu

SEQ ID NO: 275059 - RNA, 64 nt, Human
guuuagccuccccacccccucugaaugcuugaauccccucgacaauuuaugaugccaccagcaa

SEQ ID NO: 275060 - RNA, 64 nt, Human
ggggaagccccaauagcuggacagaccucggccuccccucgaagacaccucaauucacagacuc

SEQ ID NO: 275061 - RNA, 64 nt, Human
uuaagaaaauaaaugucaccagguacuugagaaaccccucgauugucuaccucgaucguacuuc

SEQ ID NO: 275062 - RNA, 64 nt, Human
ccaucccacgacccccgcaacccuucacaucaccccccucgaaggucggacaggacggguggag

SEQ ID NO: 275063 - RNA, 64 nt, Human
ggagcaggcugccaccccuucuaccucaccacugccccucgaagaauuuugcaaauggccccuu

SEQ ID NO: 275064 - RNA, 64 nt, Human
ucggcgggcgcuggaaguagagaggccagaaaggccccucgaggcagagacccuccgcccucuu

SEQ ID NO: 275065 - RNA, 64 nt, Human
gagccccgucuugcuucucuuccaggugcucuauccccucgagacccucuggugccaggcuugc

SEQ ID NO: 275066 - RNA, 64 nt, Human
cccccuuugccacaaugguaugauggcuugguagccccucgaggcagaugcaccugacuugcug

SEQ ID NO: 275067 - RNA, 64 nt, Human
ggaacagguagagacaaacguugcacuggugccuccccucgaaccgccaagcagaaaccggacc

SEQ ID NO: 275068 - RNA, 64 nt, Human
ugcucucuggguuacugaggggcucaggaaggggccccucgagccuuccuggaguacccgagug

SEQ ID NO: 275069 - RNA, 64 nt, Human
cccugcuucucugguauuuauuuuagaggggagcccccucgaaaugcagaaaaggacuuguggu

SEQ ID NO: 275070 - RNA, 64 nt, Human
aagcaggagcuagcagccgccuacuuggugcuaaccccucgauguacauagcuuuucucagcug

SEQ ID NO: 275071 - RNA, 64 nt, Human
cuggaagaaagcagucaguacccucccaacggccccccucgaaggucuccacucuccucugggc

SEQ ID NO: 275072 - RNA, 64 nt, Human
uaacacugugcaucuuauugugaggccagcuuguccccucgaacccucuuuggccagguaaaca

SEQ ID NO: 275073 - RNA, 64 nt, Human
uuugagaucuuuggaaaggacucuaucucauccuccccucgacaagccaagaaugagaauuggg

SEQ ID NO: 275074 - RNA, 64 nt, Human
ggcuucaugguuucugcucagucugucccccuucccccucgacccccgcaaugagugggcacca

SEQ ID NO: 275075 - RNA, 62 nt, Human
ccgcccccaccaccacccccagcuccugaggugcuggccagugcacccccacucccacccuc

SEQ ID NO: 275076 - RNA, 62 nt, Human
agcugcauggcacauaccaaagcugcugcacagcuggccaccauggcacccugcaccaggcc

SEQ ID NO: 275077 - RNA, 62 nt, Human
cccugaaguuaugcuuuccuucugugcucugugcuggccagaggugccucuugaaucagauu

SEQ ID NO: 275078 - RNA, 62 nt, Human
aguaaacaagcggaacauagauaauggacaaugcuggccacugccauucuguguucagaaag

SEQ ID NO: 275079 - RNA, 64 nt, Human
gaaaaaaauuagcaaaccgaaguuucuucaaugaccccucgagaacuuugggaccaguuuccua

SEQ ID NO: 275080 - RNA, 64 nt, Human
ucauacacaugaguuucccaaauguguaccuggaccccucgaaacagaggacucuacgaaauga

SEQ ID NO: 275081 - RNA, 64 nt, Human
gggaccagugaauaagaagaccccacuucaacuuccccucgaagacguugugccucacagcgag

SEQ ID NO: 275082 - RNA, 64 nt, Human
gaauguggggaucgagcagccuucuucuuugggaccccucgauaucccauggaaugcucgcacg

SEQ ID NO: 275083 - RNA, 64 nt, Human
acuccugagguagcuucuggaaauggggacaaguccccucgaaggaaaggaaaugacuagagua

SEQ ID NO: 275084 - RNA, 64 nt, Human
uggaagagaacucgaggggcugugcugcaggccuccccucgaaagacacugggaggucagcaug

SEQ ID NO: 275085 - RNA, 64 nt, Human
ugcagaauguuguugguuacuguugcuccccgagccccucgacucgucccguggccgccuguuu

SEQ ID NO: 275086 - RNA, 64 nt, Human
cuggucuccccgcagucgucccaggcugccggcuccccucgacagcucucugggcacccggucc

SEQ ID NO: 275087 - RNA, 64 nt, Human
gcccagagcccuggaggagccaccaccccgccggccccucgaccccucggccccucggccccuc

SEQ ID NO: 275088 - RNA, 64 nt, Human
cauccucucccacacacauuccagaagucagggcccccucgaggagcacccgcugcagggaugc

SEQ ID NO: 275089 - RNA, 64 nt, Human
ggguuaccauguccaucccccaaggggggcccugccccucgagucgauggugucccgcaucuac

SEQ ID NO: 275090 - RNA, 52 nt, Human
uggaggagauugccugcugacaccccucgagucacccagcacucccuccaaa

SEQ ID NO: 275091 - RNA, 64 nt, Human
agcauccccuguuccuguuucacucucagcuucuccccucgaagggacucucuggccaccuccu

SEQ ID NO: 275092 - RNA, 64 nt, Human
agaagcccggccuggacaccccucggccuggacaccccucgaaggagagggcgcuuccuugagu

SEQ ID NO: 275093 - RNA, 64 nt, Human
cucccuccugccccuugcuagggucugagccaagccccucgacucccucacuguguugacacuu

SEQ ID NO: 275094 - RNA, 64 nt, Human
ugauaagugauaguacucaaaaaccugaaucccaccccucgaccaauccuccacaaacuucagu

SEQ ID NO: 275095 - RNA, 62 nt, Human
cucaagugucuaccuggagccccuggggcggugcuggccaaugcuggaaacauucacuuucc

SEQ ID NO: 275096 - RNA, 62 nt, Human
cuaguuaaccagagccuuggaaucuacugccugcuggccaggcuuuaaaaugaaaaguguuu

SEQ ID NO: 275097 - RNA, 62 nt, Human
cgggggcccagagcuucccagcccugagucaagcuggccaugaacgcguacacuucaguuca

SEQ ID NO: 275098 - RNA, 62 nt, Human
uuggcccucgccauggagcagaggcggggacagcuggccaccgugucccaggaccguaccgu

SEQ ID NO: 275099 - RNA, 64 nt, Human
gccaggggaggaagugaggcccaggcaccugcugccccucgagggggcccugccugccgcgggg

SEQ ID NO: 275100 - RNA, 64 nt, Human
acucgccccaaagaucccgagggcauaggccaccccccucgaaguucagguucagcuccuggau

SEQ ID NO: 275101 - RNA, 62 nt, Human
cgcgcugcaugacuugcugaacggcacagggaccccucgaggaacaagguugcacaccagcu

SEQ ID NO: 275102 - RNA, 64 nt, Human
uuggcagagggucauuuuaggagagcugccccagccccucgaacgccuggcuuggggugucauu

SEQ ID NO: 275103 - RNA, 64 nt, Human
ccccugccagcucaccgugcccagccuccugcauccccucgaagagccuggccagagagggaag

SEQ ID NO: 275104 - RNA, 64 nt, Human
ugugcacaagugagugagagauuucgaacgcccaccccucgacuuugaaaucugagcaaaacaa

SEQ ID NO: 275105 - RNA, 64 nt, Human
cagccccugcuccgcacgccccaugcucuucccuccccucgaguguggguagggcugggacugc

SEQ ID NO: 275106 - RNA, 64 nt, Human
ccgcaguggggcccugacgcccaccucccaggugccccucgagcaaaaaccucuggcgccucca

SEQ ID NO: 275107 - RNA, 64 nt, Human
cuguguuucugcaccauuuccgaggacgacgcagccccucgagcccccccaccggccccggccg

SEQ ID NO: 275108 - RNA, 64 nt, Human
guggccuaggcugcucccaucgcuucccaccuguccccucgaggcuucugaccuuugauccgcu

SEQ ID NO: 275109 - RNA, 64 nt, Human
gagggggagggaguugggagaagcccagccccucccccucgagaccccucccaugucccuuccu

SEQ ID NO: 275110 - RNA, 64 nt, Human
gcuguggggagacgggggucuuccuucaccagcuccccucgacucaagcccuuguccucauuau

SEQ ID NO: 275111 - RNA, 64 nt, Human
cuccacugugucugucuuuucuucccuggggcucccccucgaggcgaggggccaugcaugucug

SEQ ID NO: 275112 - RNA, 64 nt, Human
ggagcaagaauaccaagacaaauucaaaagacugccccucgagauuuuggaauucgugcaggaa

SEQ ID NO: 275113 - RNA, 64 nt, Human
gagcauccuaugccuuugacaaagauugcaguggccccucgagugcagaggucaucccaggugu

SEQ ID NO: 275114 - RNA, 64 nt, Human
uguaaaucugcccacacccagcuggccauauccaccccucgacgccgggaugagccggcucugc

SEQ ID NO: 275115 - RNA, 62 nt, Human
cucuccuuuuuuucugaauguugauugccuuagcuggccaccugguguucugcauguagccu

SEQ ID NO: 275116 - RNA, 62 nt, Human
ccaaggugcgcccucgacucccgauuucauuugcuggccaggaaaaucgaaagggaaacacc

SEQ ID NO: 275117 - RNA, 62 nt, Human
uuuugaacuguacaucucacauguugggaaacgcuggccacugggaaaucauuagaaaggag

SEQ ID NO: 275118 - RNA, 62 nt, Human
gaagcccaccccacauggcccacagcuccugugcuggccagacucccagaaaauucucuauu

SEQ ID NO: 275119 - RNA, 64 nt, Human
uacaggaguccuccuuucugagcuccagccccagccccucgaaccaccuguaaucuaggcaccu

SEQ ID NO: 275120 - RNA, 61 nt, Human
ugaaguugaugcguuggugaggaggaaugggccccucgaagugggccgggccggccccacc

SEQ ID NO: 275121 - RNA, 62 nt, Human
gcugauguggacaguuugccaauguucucuucuauugcaaguucagccagacuccaugacuc

SEQ ID NO: 275122 - RNA, 62 nt, Human
aaaauuuaaaguuauguuuuucggaguuugauuauugcaaaauaaagcaaauuucagaacug

SEQ ID NO: 275123 - RNA, 62 nt, Human
ccuucuaaaauagagaaugguacgacauucuauauugcaauucaagccauccaugaagccaa

SEQ ID NO: 275124 - RNA, 62 nt, Human
auuccuuuaauucuaauuuuaaaggaagagcauauugcaauaauaaaaauauuuuuaaaauu

SEQ ID NO: 275125 - RNA, 62 nt, Human
guaauguuaguauuucugcuuugaauccuugauauugcaauggaauuccuacuuuauuaaau

SEQ ID NO: 275126 - RNA, 62 nt, Human
cugaggaacaggacuuucuccacauuguuuuguauugcaacauuuugcauuaaaaggaaaau

SEQ ID NO: 275127 - RNA, 62 nt, Human
ggguuuuauuuugcuuguugaacucuuagagcuauugcaaacuucccaagauccagaugacu

SEQ ID NO: 275128 - RNA, 62 nt, Human
uauuuauauauauauuucauauauauauauaauauugcaagcuuaaguuugcaauuucccaa

SEQ ID NO: 275129 - RNA, 62 nt, Human
aauucuuggcugucccaaggauucuucauguauauugcaaaauuuaauauauuuguucacuu

SEQ ID NO: 275130 - RNA, 62 nt, Human
acuuacaaacuuuguuugucacaagugguguuuauugcaauaaccgcuugguuugcaaccuc

SEQ ID NO: 275131 - RNA, 62 nt, Human
cgugggagggaggcagaccccugggcuuuccugcuggccacggagacucugcuccugcaugg

SEQ ID NO: 275132 - RNA, 62 nt, Human
ggaccaagggggcguggacccgucuuguaccagcuggccacaggcacaagggcugcagcugc

SEQ ID NO: 275133 - RNA, 62 nt, Human
uucugcugagccacagcccauugcagcacugugcuggccagacuucagcugccuugggaacu

SEQ ID NO: 275134 - RNA, 62 nt, Human
aauagcaaauaaaugauguaucaggguauuuguauugcaaacugugaaucaaaggcuucaca

SEQ ID NO: 275135 - RNA, 62 nt, Human
cacucucaugagugcaacuguggcuuagcuaauauugcaauguggcuugaauguagguagca

SEQ ID NO: 275136 - RNA, 62 nt, Human
uuguuaacgaugcauccacuugauugaugacuuauugcaaauggcgguuggcugaggaaaac

SEQ ID NO: 275137 - RNA, 62 nt, Human
guaaauggugucuuucuucugggguuuucaguuauugcaaagaaaugaagagauucuggaaa

SEQ ID NO: 275138 - RNA, 62 nt, Human
cugauggcuaaguuugcaugaaaacugcacuuuauugcaaguuaguguuucuagcauuaucc

SEQ ID NO: 275139 - RNA, 62 nt, Human
caguuuucuuuaaaaaccuacaaaugggauaguauugcaagguucuucugcaauuuacuuuu

SEQ ID NO: 275140 - RNA, 62 nt, Human
auauauucaaacucuccuuuaaauuccaaucuuauugcaacaacucugugaauugcaagguc

SEQ ID NO: 275141 - RNA, 62 nt, Human
aucauaauagauuuuaaaaaucuaauguucuuuauugcaagacauucuuuuguuaacagguu

SEQ ID NO: 275142 - RNA, 62 nt, Human
uuucugauugauauggucugaaguacuccugguauugcaagucauuugcucuaauucucaau

SEQ ID NO: 275143 - RNA, 62 nt, Human
uguuguuuaaaaauauauauuauuuuguauaauauugcaaauguaaaaugacaauuuggguc

SEQ ID NO: 275144 - RNA, 62 nt, Human
auaguucuuuguaucucuuaacagguugaaguuauugcaaaacacucuggaaaguaauaauu

SEQ ID NO: 275145 - RNA, 62 nt, Human
auuuucguaagaaaugauucuuuccugcagaauauugcaacuuuguguuguuuuaugaugag

SEQ ID NO: 275146 - RNA, 62 nt, Human
uuacuucaagaugaguuuauuguuuucauuuguauugcaaaaguuagaagucauuuuacaaa

SEQ ID NO: 275147 - RNA, 62 nt, Human
cauuguguuguacuggaugcaaagcuagaaaauauugcaauaaaugagaccgaugaaagacu

SEQ ID NO: 275148 - RNA, 62 nt, Human
ugugcaaaaaggacuggaaaaaugaacuguauuauugcaauuuuuuuuuguaaaaguagcag

SEQ ID NO: 275149 - RNA, 62 nt, Human
ucgccuuuucuaggauugcauuucccaagugcuauugcaauaacaguugauacucauuuuag

SEQ ID NO: 275150 - RNA, 62 nt, Human
aggauacuuuugcacagccuccaugaugucuuuauugcaaauauggaugacaagggucucug

SEQ ID NO: 275151 - RNA, 62 nt, Human
uaauacaguugugaggaauguguuguaacuuggcuggccaaguuacauguuacaguaucuuu

SEQ ID NO: 275152 - RNA, 62 nt, Human
ucucccacuuguccuccuuggaaggagcucuugcuggccaguguuuggaggggaggaugagu

SEQ ID NO: 275153 - RNA, 62 nt, Human
ccugugccccugacugagcagaagcccccacagcuggccagcagccccgccugacauggaac

SEQ ID NO: 275154 - RNA, 62 nt, Human
ugccaauauggcaaaauuacacaagaaaacaguauugcaaugacaccauuacauaaggaaca

SEQ ID NO: 275155 - RNA, 62 nt, Human
gaaacagccagaucucaugagaagucacucacuauugcaaggacagcaucaaagagauggug

SEQ ID NO: 275156 - RNA, 62 nt, Human
uaauaaaauaaaaauaacguuuuaugacuauuuauugcaaggucagaguuacagauuguuau

SEQ ID NO: 275157 - RNA, 62 nt, Human
auauugagaagaccuacuuacaaaguggcauauauugcaauuuauuuuaauuaaaagauacc

SEQ ID NO: 275158 - RNA, 62 nt, Human
ugccagucaaaugcuauuugguuuaaaaaaauuauugcaaucucaaguuaauggaauauuuu

SEQ ID NO: 275159 - RNA, 62 nt, Human
uuugcaaaguuuauuucaguucacauguaagguauugcaaauaaauucuuggacaauuuugu

SEQ ID NO: 275160 - RNA, 62 nt, Human
aaaaucaaagcagucauaagcuccaguuuucguauugcaaauaagacucuuaccuacaaaau

SEQ ID NO: 275161 - RNA, 62 nt, Human
ccuagaguuucgugccccucugaacugucuguuauugcaauguaguuuaucaacagaauuug

SEQ ID NO: 275162 - RNA, 62 nt, Human
uaguucuuauauaucccuauauauuauaucuauauugcaaaauuuugacugucagcuacaug

SEQ ID NO: 275163 - RNA, 62 nt, Human
caaccauuaaagucagaaguuuuacuccagguuauugcaauaaaguauaauguuuauuaaau

SEQ ID NO: 275164 - RNA, 62 nt, Human
auuuuaugcauuucagcaaagucauuggauacuauugcaacuugggaauacuggucugcauc

SEQ ID NO: 275165 - RNA, 62 nt, Human
auaaaaccauagaacuaugaaaauaucaagauuauugcaaaaaucuuauuccaaacacaccu

SEQ ID NO: 275166 - RNA, 62 nt, Human
gacagucaacaauauguacuuaaaaguugcacuauugcaaaacggguguauuauccagguac

SEQ ID NO: 275167 - RNA, 62 nt, Human
ugugcauauuugucuauuuuuucuauaaguuuuauugcaagagguaaagaagaaaacuauau

SEQ ID NO: 275168 - RNA, 62 nt, Human
augggugauguuucuuacuuaucaucccuaacuauugcaacuugaccuuaaaaagacaaaac

SEQ ID NO: 275169 - RNA, 62 nt, Human
aauaguaauaaaaauaacguuuuaugacuauuuauugcaaggucagauuuacagauuguuau

SEQ ID NO: 275170 - RNA, 62 nt, Human
aaguguggauuauauuuuuggguuuuguagaauauugcaaauuaaccacacaaaaaauguuu

SEQ ID NO: 275171 - RNA, 62 nt, Human
ggccagcuaaugaggcugacuggauguccagagcuggccaggccacugggcccugagccaga

SEQ ID NO: 275172 - RNA, 62 nt, Human
cucagaccuccucaucucaugagcuucuuggggcuggccaguggcccagggccagcuuggcg

SEQ ID NO: 275173 - RNA, 62 nt, Human
cccgccgcugcacuguaggagccccuuucugggcuggccaaggccggagccagcucccucag

SEQ ID NO: 275174 - RNA, 62 nt, Human
uaugaugauaugacaucuggcuaaaaagaaauuauugcaaaacuaaccacuauguacuuuuu

SEQ ID NO: 275175 - RNA, 62 nt, Human
guugguuguuuacuugcuagaaaccauuguuuuauugcaaacgaaggaaaaaugaagagauu

SEQ ID NO: 275176 - RNA, 62 nt, Human
cuaaaauucuggaccacugaagcuaaaagcccuauugcaaguaugaaauuaaguacuugagc

SEQ ID NO: 275177 - RNA, 62 nt, Human
aaagcagcugccuggagccuauucacuauguuuauugcaaaauccuuucgaaauaaacaguu

SEQ ID NO: 275178 - RNA, 62 nt, Human
uaauuuuccuuuuagacuugcaaauaugcuuuuauugcaauuuugucuccaucuguacugua

SEQ ID NO: 275179 - RNA, 62 nt, Human
uaaacaauguacccguaauuuguaacauaaaguauugcaauauguuaguaacaaucuugcag

SEQ ID NO: 275180 - RNA, 62 nt, Human
ucugagcagugcuugaaugaaguuguagguaauauugcaaggcaaagacuauucccuucuaa

SEQ ID NO: 275181 - RNA, 62 nt, Human
uuacuuuauaccucucuauuccuugcucaaauuauugcaaaagccucuauagaaaguccucu

SEQ ID NO: 275182 - RNA, 62 nt, Human
uguuguggcauucuaucuuguaggacacuguauauugcaaauugcugauuauggaaggggcc

SEQ ID NO: 275183 - RNA, 62 nt, Human
ccagugguacccaguaccucuuguauauagguuauugcaaauauuguucugaaaugcuuaac

SEQ ID NO: 275184 - RNA, 62 nt, Human
ggcauacucgggcuguuuccaaauauaaacucuauugcaauaucuuauuucaucuuucuaau

SEQ ID NO: 275185 - RNA, 62 nt, Human
ccacauagaaagaggccaauugcaugaguaauuauugcaauuggauuucagguucccuuuuu

SEQ ID NO: 275186 - RNA, 62 nt, Human
ucuuccauuuaacuauuacagaaagcaguaacuauugcaacuaucuaauaguucacacaaaa

SEQ ID NO: 275187 - RNA, 62 nt, Human
ugacgccaauguucaguuuggguacguugguguauugcaaggggagaggcuuuuauaacaau

SEQ ID NO: 275188 - RNA, 62 nt, Human
ucacguuuuugagaagauagucauauaaguuauauugcaaaagggauuuguauuaauuuaag

SEQ ID NO: 275189 - RNA, 62 nt, Human
cucagcugaauaaagaaaaauuuaguucaauuuauugcaauuuaauuacaauacuaccuuca

SEQ ID NO: 275190 - RNA, 62 nt, Human
uuuuuuaaaaccuucacauuacguguagauauuauugcaacuuauauuuugccugagcuuga

SEQ ID NO: 275191 - RNA, 57 nt, Human; identical to SEQ ID NO: 50856

SEQ ID NO: 275192 - RNA, 62 nt, Human
uugcuaaggcagcugauccaggcaaucguucugcuggccaagaaguuaaacuauuuugagca

SEQ ID NO: 275193 - RNA, 62 nt, Human
uuauauuuuugguagagaugggguuucaccaugcuggccaggcuggucucgaacuccugacc

SEQ ID NO: 275194 - RNA, 62 nt, Human
ccagccucacaaaaggauucuuucaacuucuuuauugcaagaaacaguugaguuaaauguuu

SEQ ID NO: 275195 - RNA, 62 nt, Human
uuuuccucaguuguauauugaccaguguucuuuauugcaaaaacauauacccgauuuagcag

SEQ ID NO: 275196 - RNA, 62 nt, Human
aagaauuuagaggcaaaugacaagcgauaggcuauugcaaccugagaaagagaacugcuccu

SEQ ID NO: 275197 - RNA, 62 nt, Human
ugaaaauuaaauauuuuuauggauuuuauaaauauugcaacauuuuagauauuguuuuggac

SEQ ID NO: 275198 - RNA, 62 nt, Human
guguugaauacucuuuccacaaguugcaagcauauugcaacacauguucuuuggguuuuuug

SEQ ID NO: 275199 - RNA, 62 nt, Human
augcacuagaauuauuaacuaacgaggugagguauugcaaauguucaaaaaagcucucuuga

SEQ ID NO: 275200 - RNA, 62 nt, Human
auggaagagaaaaccacuaaccuugauuuuuguauugcaaaaucagauagaccuggaaacau

SEQ ID NO: 275201 - RNA, 62 nt, Human
cuuaaaacuuacuggaauggaaaucuaugaauuauugcaaauuguaaugcuggaaacaaaaa

SEQ ID NO: 275202 - RNA, 62 nt, Human
caguguauucugaaaaagccuucaaauaaagguauugcaacacgauuuauacauugcauaaa

SEQ ID NO: 275203 - RNA, 62 nt, Human
gccaccucuggaucccguucagaaaaccacuuuauugcaaugcagagguugagaggaggacu

SEQ ID NO: 275204 - RNA, 62 nt, Human
uggccgaugauuuuugucaucagccaccauccuauugcaaagguuccaacuguauauauucc

SEQ ID NO: 275205 - RNA, 62 nt, Human
gaaagaauuguuccucuuuguagguaucuguguauugcaaucauucucaaccaggaggugau

SEQ ID NO: 275206 - RNA, 62 nt, Human
caaaacaaagguacauuuuuuaaaaugucauauauugcaacauauugaugcauuugucauac

SEQ ID NO: 275207 - RNA, 62 nt, Human
uaaaaaugagaagcauauuucaagaauuauuuuauugcaagucuuguauuuaaauguuaaau

SEQ ID NO: 275208 - RNA, 62 nt, Human
auuuaucuuuaauucgcuauccaaaauuaaauuauugcaagcugauucacauauaaagaugc

SEQ ID NO: 275209 - RNA, 62 nt, Human
uauuaugcgaaucucuauuauuuuaugguauuuauugcaaaagacuguugaaauguacucau

SEQ ID NO: 275210 - RNA, 62 nt, Human
ucgcuauuaauaacaaugcauuauugaaaguauauugcaaauacauguuuccucaugaaauc

SEQ ID NO: 275211 - RNA, 62 nt, Human
uguuuuuuaaguugcacugauauuuuaccucuuauugcaaaauagcauuuguuuaaggguga

SEQ ID NO: 275212 - RNA, 62 nt, Human
uuuuauuucuauuagcaaugggguuucaccaugcuggccaggcuuguuaugaacugaccuca

SEQ ID NO: 275213 - RNA, 62 nt, Human
cugagcaacuuguuagaagagaugaaggcgacgcuggccaaguguugagagcugccugcgag

SEQ ID NO: 275214 - RNA, 62 nt, Human
uuacuaagacaguaccuauuaggaaaaccaaauauugcaaauggucaauucgauuuuaauuu

SEQ ID NO: 275215 - RNA, 62 nt, Human
uuauuguuucuaggaaggaauuucuaaaucaauauugcaaccccaaaagcgguuauaauuug

SEQ ID NO: 275216 - RNA, 62 nt, Human
gacuguuacguuucuauugcuuuuguaugggauauugcaaaaauaaaaaggaaagaacccuc

SEQ ID NO: 275217 - RNA, 62 nt, Human
ccucaugggacagcgcguccuucccuaaagacuauugcaagucauacuuaggaauuucuccu

SEQ ID NO: 275218 - RNA, 62 nt, Human
uuuuggaacgaaaaaggguaaguauaagaaaauauugcaaacacauuaaaacaguuguaugg

SEQ ID NO: 275219 - RNA, 62 nt, Human
guacauauacauguacacauacacauaaauauuauugcaauuaagugaucaaguacagacac

SEQ ID NO: 275220 - RNA, 62 nt, Human
auagcuuauaaggcuuauggcaaugucccaacuauugcaaucauaaaacccuaguuuuagaa

SEQ ID NO: 275221 - RNA, 62 nt, Human
agcaaauuugcagcuguuguguaaauacuguauauugcaaaaaucaguauuauuuuaagaga

SEQ ID NO: 275222 - RNA, 62 nt, Human
uuuuugaugguaauauucuauccuuaugacacuauugcaaccaaauuggcuuuaccaucuug

SEQ ID NO: 275223 - RNA, 62 nt, Human
uuuucuacuuuuaggaaaauuuaaugagagcuuauugcaaaaauuguuauaauuuggucauu

SEQ ID NO: 275224 - RNA, 62 nt, Human
ucuuuuuuagugaaagaaugugccauauuacauauugcaaccuaauuuguuaaaacuaacuc

SEQ ID NO: 275225 - RNA, 62 nt, Human
aaucuccuauuuuuuuaaaaucacuaacauuauauugcaaugaaggaaauaaaaaagucucu

SEQ ID NO: 275226 - RNA, 62 nt, Human
gaucucauucuguugcccagacuagaguacaauauugcaaucacagcucacugcagccucaa

SEQ ID NO: 275227 - RNA, 62 nt, Human
gcugucaauuauugagauuuuuaaaugguaaauauugcaaaaguuaaacaaggguaccacaa

SEQ ID NO: 275228 - RNA, 62 nt, Human
auaaaaaaauuauaaacugguguuuuaacuaguauugcaauaagcaaaugcaaaaauauuca

SEQ ID NO: 275229 - RNA, 62 nt, Human
cuugagaacguauucuuuuuuuccuacuuuguuauugcaaauugaggaaucacuuuuaacug

SEQ ID NO: 275230 - RNA, 62 nt, Human
cacagaucuuggggagcugccccacaagccccgcuggccaccgagggcugcagccgcugcgc

SEQ ID NO: 275231 - RNA, 62 nt, Human
ccccucagcaggagagaggcccagaggcuccagcuggccaccgugccccacaagauggcccc

SEQ ID NO: 275232 - RNA, 62 nt, Human
cccccaaggaugaggcuggacugaggcaaagggcuggccacaccaccugagcaugugugagg

SEQ ID NO: 275233 - RNA, 62 nt, Human
ggcuuucucggccccucuccucagcuugcagagcuggccagcccccuccuuagggggugggc

SEQ ID NO: 275234 - RNA, 62 nt, Human
gauaucucuuuaugcaauaccucaauuuuucauauugcaaagaguagcuuuuuguacuuuua

SEQ ID NO: 275235 - RNA, 62 nt, Human
aaauaaugauuaaugcauucuccacauuuuaauauugcaaaggcccauuggaguuucugaag

SEQ ID NO: 275236 - RNA, 62 nt, Human
aagauuguccuuuucucccauuucuugcuagcuauugcaaaugagggaagaacauuauucau

SEQ ID NO: 275237 - RNA, 62 nt, Human
cagucuuguuugucuguuuacaaccauguauuuauugcaauguacauacuguaauguuaauu

SEQ ID NO: 275238 - RNA, 62 nt, Human
cauuauuugcaaauuaaugcgcauaguacuuuuauugcaaaauggcaugugcugccaucuau

SEQ ID NO: 275239 - RNA, 62 nt, Human
auaacuuaugaaaaguacagugaauuuugcuuuauugcaaagcuuuaaauauaaauuucaga

SEQ ID NO: 275240 - RNA, 62 nt, Human
accuacugugugccaaacaagauuuuguagaauauugcaaaaaugaccauaaauuccucgug

SEQ ID NO: 275241 - RNA, 62 nt, Human
uccaaagcacgauugcagaaggggaaagggaauauugcaaaagggagaggaaggggccuuau

SEQ ID NO: 275242 - RNA, 62 nt, Human
agaagacuguaauguaccugaaguuucugaaauauugcaaacccacagaguuuaggcuggug

SEQ ID NO: 275243 - RNA, 62 nt, Human
cuaaucuuguagcaguacaguacaguccugauuauugcaacuuuaggaaaaggucugauaaa

SEQ ID NO: 275244 - RNA, 62 nt, Human
cuaagagacgugguugcaaacuuagcucugguuauugcaaugagggccuugaacaagucauu

SEQ ID NO: 275245 - RNA, 62 nt, Human
cccuagcaccauauaugagucucaaguuuuauuauugcaauaaaagugcuuuaugcuggcuu

SEQ ID NO: 275246 - RNA, 62 nt, Human
auacugccacuaaccuuccaaaaauuacuuaguauugcaaagucaggaaucaucaggaacgu

SEQ ID NO: 275247 - RNA, 62 nt, Human
cuuuguauugauuuugaauacagugaaaaucuuauugcaauaaacuauuuuaguaaaauauu

SEQ ID NO: 275248 - RNA, 62 nt, Human
uaccuuuuaaaaguucugaaauuugggguugguauugcaaaaugaauugaacggauggugcu

SEQ ID NO: 275249 - RNA, 62 nt, Human
ccuuccauuuuuaagugcuuaaaugaguacuauauugcaauaaaauguagugauauaauuaa

SEQ ID NO: 275250 - RNA, 62 nt, Human
agauuuugaaaaauguaauaauauuaaugcaguauugcaacaggggugcaauuuaaggcuau

SEQ ID NO: 275251 - RNA, 62 nt, Human
auguaaaauaugguguagaaauucuugugaaauauugcaagaggcgaguuuaaaauucugca

SEQ ID NO: 275252 - RNA, 62 nt, Human
gccacucuuaggaaagacuauugggaguauuugcuggccagagaaugggacucuaucagcuu

SEQ ID NO: 275253 - RNA, 62 nt, Human
augaacugcuuugugacuuggaaagguacgcugcuggccagcauuggagaagaagcugcuga

SEQ ID NO: 275254 - RNA, 62 nt, Human
cacaaauacguauuuugccacaguguauucuauauugcaaugauuuuuuuagcauuuuaaua

SEQ ID NO: 275255 - RNA, 62 nt, Human
gagaagaguuuaagccuguuuuuuuaaaauauuauugcaaagagcucuauuuguagaagcaa

SEQ ID NO: 275256 - RNA, 62 nt, Human
uggcaguugccaauguuaaugauuauucuuuuuauugcaaguauuuccuaugauccuuccac

SEQ ID NO: 275257 - RNA, 62 nt, Human
ggagccugaugugaugccuucacugguugauauauugcaaauagacacucugagcccugcau

SEQ ID NO: 275258 - RNA, 62 nt, Human
uuccaucuguacuuugguccucugauuucacauauugcaaccuaguacuuuauuaguuuaaa

SEQ ID NO: 275259 - RNA, 62 nt, Human
uuugaggcuuuuccuucuugcccuuuucggaguauugcaaaggagcuaaaacuggugugcaa

SEQ ID NO: 275260 - RNA, 62 nt, Human
cauuaucaaaauauuugaugauguuucagauauauugcaaagucuguauuccagcucuuaag

SEQ ID NO: 275261 - RNA, 62 nt, Human
cagcacaaauuuaucucagaaagguuccuguguauugcaagguacaauuuucuccaauaaau

SEQ ID NO: 275262 - RNA, 62 nt, Human
gaagguaauucaguagaguguaacuuagagaauauugcaagugacacauugaauccugcccg

SEQ ID NO: 275263 - RNA, 62 nt, Human
guuggaaaagcaggagguaguugugccucaauuauugcaaaaauguaacaauaaaguuccuc

SEQ ID NO: 275264 - RNA, 62 nt, Human
aguaauuucuuauugugaggaacuguccaauguauugcaagauguucugcauacuuggcucu

SEQ ID NO: 275265 - RNA, 62 nt, Human
uccaagcacuuaauuuggaaauuuuauuguccuauugcaaaaugaaacaaaauuaaaagugg

SEQ ID NO: 275266 - RNA, 62 nt, Human
caggguucucuuuggauuaaaaguucuggauuuauugcaacuauuuuccuugagaaacauuc

SEQ ID NO: 275267 - RNA, 62 nt, Human
cccaccuucucuuccuucuuggucugucauuauauugcaaaauauuuuuccucugaaugaaa

SEQ ID NO: 275268 - RNA, 62 nt, Human
gauucauguuuuuauaagaauuuucauguaauuauugcaauuguggucaaauaaggaacguu

SEQ ID NO: 275269 - RNA, 62 nt, Human
guuaaauucauguauuuaauauuucugcaugcuauugcaagugguaagguuuucaaaaagcu

SEQ ID NO: 275270 - RNA, 62 nt, Human
aucaugagacaagucuuuuuuucugcuucuuauauugcaagcuccaucucuacuggugugug

SEQ ID NO: 275271 - RNA, 62 nt, Human
gcccccuuccuccccccgugucaacuuucagugcuggccaaaaccuggccgucucuucuauu

SEQ ID NO: 275272 - RNA, 62 nt, Human
accacacgaaaccucaacugggggagugaggggcuggccaggucuggaggggccucaggggu

SEQ ID NO: 275273 - RNA, 62 nt, Human
caucuaggcuccccagcccccacugugaaggggcuggccaggggcccgagcugcccccaccc

SEQ ID NO: 275274 - RNA, 62 nt, Human
cacuuucaugcaucucugggaaaugauaggaguauugcaaauaaguugaguuuguagagggu

SEQ ID NO: 275275 - RNA, 62 nt, Human
auaucaauucuugagaguuaaugugaucaugauauugcaaacaacuauaaauggucucuagg

SEQ ID NO: 275276 - RNA, 62 nt, Human
aauaaucauuuucagugguuuauggugggcaauauugcaauauuugaaaugguaaaaaugga

SEQ ID NO: 275277 - RNA, 62 nt, Human
aaagaagggaaacccauccaguccugugauucuauugcaagcuucaaggggcuuuuguuuga

SEQ ID NO: 275278 - RNA, 62 nt, Human
acauguuugaauugucaaauauaaaauaauguuauugcaauacauacaaaaaaguuaaagau

SEQ ID NO: 275279 - RNA, 62 nt, Human
uuuaccacaaacuuagugacuuaacacaaauuuauugcaauucuguaggcuggaagucugac

SEQ ID NO: 275280 - RNA, 62 nt, Human
uaaaaaaaaguuuuguugaaagcgcuauugaauauugcaaucuauauaguguauuggauggc

SEQ ID NO: 275281 - RNA, 62 nt, Human
guugggcucaaacuaaauucaaagaaguacuuuauugcaacucuuuuaagugccuuggauga

SEQ ID NO: 275282 - RNA, 62 nt, Human
gcacguuauauuguaauagcuuugccuguauuuauugcaagaccaccagcuccuggaagcug

SEQ ID NO: 275283 - RNA, 62 nt, Human
ucgacuacauaauggaguccauuggcgaacccuauugcaauuugguccaacuauaucuucug

SEQ ID NO: 275284 - RNA, 62 nt, Human
aauauuuauauuaauaauuagcucauaauuuuuauugcaaggcucaaugacugucauuggaa

SEQ ID NO: 275285 - RNA, 62 nt, Human
gaagaaaauaagggaacagaaaugccuuuuuguauugcaaucgaaaugaaagaagaguugau

SEQ ID NO: 275286 - RNA, 62 nt, Human
uuaaguauguacacgaggcacuacuucugauuuauugcaauguucaguccuaguuuuuacuu

SEQ ID NO: 275287 - RNA, 62 nt, Human
agugaguacauuugaauugaauauauaauaaauauugcaaaauaaaauccaucuaaauagaa

SEQ ID NO: 275288 - RNA, 62 nt, Human
uuggagauguguaugucaaacgcauuuuucuuuauugcaaagagagucuauuauagaaggaa

SEQ ID NO: 275289 - RNA, 62 nt, Human
ucaaacuuauugaugggcaauuuauuuuuuuuuauugcaaaaguuuuuucagaaaacuuuuu

SEQ ID NO: 275290 - RNA, 62 nt, Human
uuguuuugauuuuguuauacuugacuuaacuuuauugcaaugugaauuaauugcacugcuaa

SEQ ID NO: 275291 - RNA, 62 nt, Human
gcagcccccgccgggccccgccaggccuccccgcuggccauagcauuaagcccucgcccggc

SEQ ID NO: 275292 - RNA, 62 nt, Human
ccuccaccaaccacgggcuccaggaccccuuugcuggccauccccaggcaucucugguguca

SEQ ID NO: 275293 - RNA, 62 nt, Human
cagcuguuggggcagaagagacgggaccagcugcuggccacauuuccugcuuuauuuuaaaa

SEQ ID NO: 275294 - RNA, 62 nt, Human
cauuuucuuccuauuacuuuauugacucauuuuauugcaaaacaaaaaggauuacccaaaca

SEQ ID NO: 275295 - RNA, 62 nt, Human
aguagguucauugucugucuuagagucacuucuauugcaacucauuuucuuuuuccagggca

SEQ ID NO: 275296 - RNA, 62 nt, Human
cauggcuuggugcuguuuucuugauggugaauuauugcaagauacggucauuuaaaauugug

SEQ ID NO: 275297 - RNA, 62 nt, Human
auagggaaagaaauguguauaaguaauuaugauauugcaaaagugauacuuagauuuuacag

SEQ ID NO: 275298 - RNA, 62 nt, Human
ggacagucccuuccuucccugaaacccugcucuauugcaauucccuauuauauucugcauca

SEQ ID NO: 275299 - RNA, 62 nt, Human
cugcaaugccuauuccaaacuuuaaaucuaucuauugcaaaaccugaaggacuguaguuagc

SEQ ID NO: 275300 - RNA, 62 nt, Human
ggcauuccaaauucaaggcuacgauauuuucuuauugcaaagcuucagucagagccauuacc

SEQ ID NO: 275301 - RNA, 62 nt, Human
uauccaguuuggguuauucucauuaugacaccuauugcaaauuagcaucccauggcaaauau

SEQ ID NO: 275302 - RNA, 62 nt, Human
auaacucucuugauauggaugcuugcugguuuuauugcaagaauacaaguagcauugcagua

SEQ ID NO: 275303 - RNA, 62 nt, Human
auaaggcacugccucuuagaacacaaacagaauauugcaaaugcauuuaacaaauagggguc

SEQ ID NO: 275304 - RNA, 62 nt, Human
uuuauuauuauuaaaauaaacaggguugguuauauugcaauagaauaaugagaauugaauuu

SEQ ID NO: 275305 - RNA, 62 nt, Human
caauguaaagccauaucacaaugauacaguaauauugcaauguuuguaaaccuucauucuua

SEQ ID NO: 275306 - RNA, 62 nt, Human
cuugugaaugucgguaacuuacuuuuccauaauauugcaaauaacauaaaaucuuaaaauaa

SEQ ID NO: 275307 - RNA, 62 nt, Human
guuuuccuuuccguuucaagaccuuuuucuuuuauugcaaggggaaaaaaaugucaucuccc

SEQ ID NO: 275308 - RNA, 62 nt, Human
aacagaaaaucuucuuauccucuuugauauuuuauugcaaacacucagucuuuuaugauuuu

SEQ ID NO: 275309 - RNA, 62 nt, Human
gaaaugcugauugauuuuuaugcuuguuaguguauugcaagaaacacagaaaauguaguuuu

SEQ ID NO: 275310 - RNA, 62 nt, Human
uaaaauaucucacuaauaacuuuuccuuuguguauugcaaugauaauauguuggcucuauug

SEQ ID NO: 275311 - RNA, 62 nt, Human
cucagggcaagggaacauggggguagaguggugcuggccagaaccaucugcuugagcuacuu

SEQ ID NO: 275312 - RNA, 62 nt, Human
ggcccugcaauguaucccuucucacagcacaugcuggccagccuggggccuggcagggaggu

SEQ ID NO: 275313 - RNA, 62 nt, Human
ggcuauuucugcagcaaguggaaccuucuggagcuggccaucauccuggccagcuggagcgc

SEQ ID NO: 275314 - RNA, 62 nt, Human
uuauauguuaagcagcauacucuucugauuuuuauugcaaucuuuuaccaaguggugcacaa

SEQ ID NO: 275315 - RNA, 62 nt, Human
augcaaaaugcacuuauauauuuguuacacuguauugcaagauagcacacagaaguuggcug

SEQ ID NO: 275316 - RNA, 62 nt, Human
uuuuauacuagaguuuuauuuuuagcaaugccuauugcaagugcaauuauauacuccaggga

SEQ ID NO: 275317 - RNA, 62 nt, Human
agcagauauuuuaauuauuuguuaucuuuuuguauugcaagaaauuucuugcuagugaauca

SEQ ID NO: 275318 - RNA, 62 nt, Human
cauucauaaggaaauguguguuguaacaaauauauugcaaaaacauaguuuguaaaggcauu

SEQ ID NO: 275319 - RNA, 62 nt, Human
auuacaucauaaguucucaagcagaggcagucuauugcaaggaccuucuuugcugccaguua

SEQ ID NO: 275320 - RNA, 62 nt, Human
agucugugugaggaucugccccuucagucuguuauugcaaaguaauaaaaugucaccuacag

SEQ ID NO: 275321 - RNA, 62 nt, Human
uuggcuugaaccuuuucccuucaguaauaacguauugcaauucaucauugcugccugucucg

SEQ ID NO: 275322 - RNA, 62 nt, Human
aaaaaucgucuuaagcucuaagguggucucaguauugcaauaucauguaaguuuguuuuuau

SEQ ID NO: 275323 - RNA, 62 nt, Human
cguuuuuuuuuuuuuauuguuguuguuaauuuuauugcaaaguuguauucagcguacuugaa

SEQ ID NO: 275324 - RNA, 62 nt, Human
aacugguaguggugcaucauuuuuaacccaaauauugcaagcacuuuaaagauuugaaacca

SEQ ID NO: 275325 - RNA, 62 nt, Human
ccugaguagaaucuuauuuaugaacuccuguguauugcaaugguaugaaucugcucaugugg

SEQ ID NO: 275326 - RNA, 62 nt, Human
ugaagaaugccaucucugacuauauggccuuguauugcaaagcggaucaguggcuggggugc

SEQ ID NO: 275327 - RNA, 62 nt, Human
auuuuuuaagaaaaaaagcugcaaaaauuauauauugcaaggugugauggucuggcuugggu

SEQ ID NO: 275328 - RNA, 62 nt, Human
auuuucuugcugaugaacuggaauuggauaaauauugcaaguggaugaguuggaaauuaugc

SEQ ID NO: 275329 - RNA, 62 nt, Human
gcaaaagcacaaagauuauauaugacaaucaguauugcaaugaaagaaaaacuaaaaacaga

SEQ ID NO: 275330 - RNA, 62 nt, Human
aucagacagcauuucaauuccaguauuauguauauugcaaauuaaacauuuuaaaauauuuu

SEQ ID NO: 275331 - RNA, 62 nt, Human
cugcucagaguuuuuaagcccucucaaccagggcuggccacccuggucuugaggguuccugg

SEQ ID NO: 275332 - RNA, 62 nt, Human
gcugaccccucucccaccccucccugcaggcggcuggccaggugggcaggugccagccggag

SEQ ID NO: 275333 - RNA, 62 nt, Human
aaccucuuacugagaugcuuccugauagccaggcuggccagagaggggugcagggguuagau

SEQ ID NO: 275334 - RNA, 62 nt, Human
cucaaccugauaauuuccuuagcagaauuaccuauugcaacuucuguucagaaauacacagc

SEQ ID NO: 275335 - RNA, 62 nt, Human
aaaauagaaauuuguuagaauuuguuagauuuuauugcaaugaugccuaccaaacauuucca

SEQ ID NO: 275336 - RNA, 62 nt, Human
aggggcuuuucuaaagcaagaaggccuauaccuauugcaaggccacagaaaagagcagauag

SEQ ID NO: 275337 - RNA, 62 nt, Human
aguaauuauauacuugaaaguacauaauauaguauugcaaaaaugacuuugguauauuacaa

SEQ ID NO: 275338 - RNA, 62 nt, Human
aaacucagagaucacuccuuaggggugaguccuauugcaauaugaccgacaaagaagacaaa

SEQ ID NO: 275339 - RNA, 62 nt, Human
aaaaaauaggugguagauauugaggccaagaauauugcaaaauacaugaagcuucaugcacu

SEQ ID NO: 275340 - RNA, 62 nt, Human
aaccuuguuugagaaagguguuaauaaaauucuauugcaaaaauuucuuuuucuagaaaaaa

SEQ ID NO: 275341 - RNA, 62 nt, Human
uguugcucuguaugacuccuguaugcauuguauauugcaauuuauuacugucagagauuugu

SEQ ID NO: 275342 - RNA, 62 nt, Human
ccgauucugugugaacaucaguuuuguccucuuauugcaagacucccucauacacaugaguu

SEQ ID NO: 275343 - RNA, 62 nt, Human
ucgggggcuuugaaaaugccaccccccuuucuuauugcaagacggcuucucgcacaugaacu

SEQ ID NO: 275344 - RNA, 62 nt, Human
uggaaaaugacauuuuacuauuugccaauguauauugcaauugaugugauuauuuuucuuuu

SEQ ID NO: 275345 - RNA, 62 nt, Human
uauaaauuccuuaagcuauuguaaccauguuuuauugcaaagauguaaaauaugccagaugu

SEQ ID NO: 275346 - RNA, 62 nt, Human
ugcauaucucaucagagauaaugguugaauuuuauugcaaccauauuggcaaucugaaacug

SEQ ID NO: 275347 - RNA, 62 nt, Human
agaacauuuuagacuuuguuggcuauggucuguauugcaacuauaguacacaacucugccgu

SEQ ID NO: 275348 - RNA, 62 nt, Human
uuauagugaaacaaagccagagcaucuuuguauauugcaauauacuugaaaaaaaugaaugu

SEQ ID NO: 275349 - RNA, 62 nt, Human
gcucugcuaacgugaugagacaaacugaaaauuauugcaagcauugacuauaauuaugcagu

SEQ ID NO: 275350 - RNA, 62 nt, Human
gcuuccgugcugaacuuuagaacagaggauuguauugcaagacaaaguugaauguaaaguga

SEQ ID NO: 275351 - RNA, 62 nt, Human
aaaccaagaauuuuggacuugcaaagagguauuauugcaauaaugcacuuuucauacuugaa

SEQ ID NO: 275352 - RNA, 62 nt, Human
ggauuauucugggggcugcaguucgacucugugcuggccagcgagcgcccagcuccugacac

SEQ ID NO: 275353 - RNA, 62 nt, Human
gggaaccugaggcuuguucuugaagugggcaagcuggccaaaauauuggaacacacagaacc

SEQ ID NO: 275354 - RNA, 62 nt, Human
uauagagagguuuuuuauuuuuuuaauauuucuauugcaaaagucuauccgauuugaugcac

SEQ ID NO: 275355 - RNA, 62 nt, Human
gcacuaugauuugcuuuaacuauuauggguuauauugcaaaugaucuguacuuuaggguaga

SEQ ID NO: 275356 - RNA, 62 nt, Human
uuuacuacuguauuuuuaaaaaugaagguuguuauugcaaguuuaaaaagguaacagaauuu

SEQ ID NO: 275357 - RNA, 62 nt, Human
uuuaaauuuuccucuuaaaugguaaacugacuuauugcaaucccaagacccaucaauaucag

SEQ ID NO: 275358 - RNA, 62 nt, Human
auaauauauuuuuuuaauuuggcaggauaaaauauugcaaaaaaaacacauuuguauguuaa

SEQ ID NO: 275359 - RNA, 62 nt, Human
ugauggacuuccugccagugacagagcaugucuauugcaaacaauucucucaguuacguuca

SEQ ID NO: 275360 - RNA, 62 nt, Human
ugcauuuggccaaaugaaaugguagucaagccuauugcaacaaaguuaggaaguuuguuguu

SEQ ID NO: 275361 - RNA, 62 nt, Human
ccaggcuggaguguaguggcaugaucucggcuuauugcaaccuccgcuuccuggguucaaac

SEQ ID NO: 275362 - RNA, 62 nt, Human
uauucuuuuuugacuugaaaaauuauauuucauauugcaaagauguuuacaaguauuuuaau

SEQ ID NO: 275363 - RNA, 62 nt, Human
gaaaaugcauucauacaauuacagaauucaaauauugcaaaaggaugugugucuuucucccc

SEQ ID NO: 275364 - RNA, 62 nt, Human
aaugauucuguauuaauguaaauaagauuaucuauugcaaaaagauauuucaaaccuaaauu

SEQ ID NO: 275365 - RNA, 62 nt, Human
guggggagaaaggaagcuuuccgaggccugaguauugcaauacaugcaguaguacaucauuu

SEQ ID NO: 275366 - RNA, 62 nt, Human
ucauauucggauuuauagaagcauuuuacaaguauugcaaucauugaguagagauaaucaug

SEQ ID NO: 275367 - RNA, 62 nt, Human
cugacuccuugaacgucacugaaaacggcagcuauugcaaggagugggggccgcgggcagcc

SEQ ID NO: 275368 - RNA, 62 nt, Human
auuuuauagacaaaaaauuuaaagacuaucuguauugcaaaauuaaacuauuucuuuaauga

SEQ ID NO: 275369 - RNA, 62 nt, Human
uaaguuucucaucucaccagucuugguguuuauauugcaaaucuaucaaaguaagaaauaau

SEQ ID NO: 275370 - RNA, 62 nt, Human
ucccuugagaagcugagucuucugcaucagauuauugcaacauuuaaccugaauuuaaaagc

SEQ ID NO: 275371 - RNA, 62 nt, Human
ucagaucugucauguaucccuaaaaggagggagcuggccacuggcuguugggaaagccauga

SEQ ID NO: 275372 - RNA, 62 nt, Human
uguggcagccacauccaagacuggagcagcaggcuggccacgcucgggccagagagagcuca

SEQ ID NO: 275373 - RNA, 62 nt, Human
agccagggugugccgggccaagauacucacaggcuggccacagcugggcaaggcucuccgug

SEQ ID NO: 275374 - RNA, 62 nt, Human
uuauagagcaaagacagagcaguuacucuucauauugcaauaucuguguuugacuaggaaua

SEQ ID NO: 275375 - RNA, 62 nt, Human
acuuacugcauugacuguuguugauuaguuauuauugcaaagcacugucaccggccucaggg

SEQ ID NO: 275376 - RNA, 62 nt, Human
cuguuccucucugacucagcccuuuuuggcauuauugcaagagcuugacuccugguugccuu

SEQ ID NO: 275377 - RNA, 62 nt, Human
aacaauaggaaccaaaagccucugccugcugcuauugcaauucccaggaucucuccuucccu

SEQ ID NO: 275378 - RNA, 62 nt, Human
ugggguugauucccagauguguguugcuucucuauugcaagcagauucccuguuggauuuac

SEQ ID NO: 275379 - RNA, 62 nt, Human
agaugaagaauacagucagcuuugugaaauaguauugcaagcaagccccgugggcaaauuug

SEQ ID NO: 275380 - RNA, 62 nt, Human
ucgucucccgucuuugguucuccaguucaaauuauugcaaaguaaaggaucuuugaguaggu

SEQ ID NO: 275381 - RNA, 62 nt, Human
ucugugggagccguguucuaaccuguggaaaguauugcaauucugugagagugacucugcag

SEQ ID NO: 275382 - RNA, 52 nt, Human
aagauauauuuuucauuugacauauugcaaaauuuucuuaggaaauuugugg

SEQ ID NO: 275383 - RNA, 62 nt, Human
agaaaggaauuuugucaaucaaaauuauucuguauugcaacuuuucucagagauugcaaagg

SEQ ID NO: 275384 - RNA, 62 nt, Human
caaccaccgacuuaucaaugcagccgccuguguauugcaauuggccguuaccuuaagcacug

SEQ ID NO: 275385 - RNA, 62 nt, Human
aguguuacguuguguuuaaaauguguaugguuuauugcaaucugaacagagcuauggguuuc

SEQ ID NO: 275386 - RNA, 62 nt, Human
cuaguuggcaauagauaacucagcguagauaguauugcaaaaaggggaggaaauacacaaca

SEQ ID NO: 275387 - RNA, 62 nt, Human
gccacuaagguacaaaagacacuggacaaccauauugcaaucagaucuacagcuccuggaua

SEQ ID NO: 275388 - RNA, 62 nt, Human
gaauuacugauucauugaaaaauuauuuuauuuauugcaagucuaaauuuauccuuuuuuuc

SEQ ID NO: 275389 - RNA, 62 nt, Human
auagauugaguugguuuaagaggucuacuuuguauugcaagcauuguuguuucuacggauua

SEQ ID NO: 275390 - RNA, 62 nt, Human
ggcuccacuccagaucaccacaauaaugugaauauugcaauaaagcaagucauacacauuuu

SEQ ID NO: 275391 - RNA, 62 nt, Human
acuuccuggucucugggaugacuucagauucugcuggccaaggcaaauugaacucaguucaa

SEQ ID NO: 275392 - RNA, 62 nt, Human
agagcccugugaaaugcaucaagguccucuccgcuggccagcagcauccccaggcuucucuc

SEQ ID NO: 275393 - RNA, 62 nt, Human
aguaauaacaugaaaugaaacccagcauaggagcuggccaagagcuuuuaauuuuauugaua

SEQ ID NO: 275394 - RNA, 62 nt, Human
aggucuucuggcacaauucucacauuguacaauauugcaaaaauucaugcuugagagaaaca

SEQ ID NO: 275395 - RNA, 62 nt, Human
ugugcgugcguuugugccgagcuucuauuucauauugcaaauauaaauaaaggaaggcaguu

SEQ ID NO: 275396 - RNA, 62 nt, Human
uagauagauagauagauagauagauagagauuuauugcaaauaauugguuuacauaauuuug

SEQ ID NO: 275397 - RNA, 62 nt, Human
cagguuaaugcugaaaaaucauccaagacaguuauugcaagaguuuaauuuuugaaaacugg

SEQ ID NO: 275398 - RNA, 62 nt, Human
cccuagucuggaaucuuugugaagcauaggguuauugcaaggcaaaugggaacuaacacauc

SEQ ID NO: 275399 - RNA, 62 nt, Human
ccccagcaccauuuaugagucucaaguuuuauuauugcaauaaaagugcuuuaugccggcuu

SEQ ID NO: 275400 - RNA, 62 nt, Human
ugguuguuuuaucuuucuuguuuuauaauuccuauugcaaccucgugcacugcucgagacac

SEQ ID NO: 275401 - RNA, 62 nt, Human
uuuguugugucaauuagagggucacuuguuuguauugcaauaaacacugggaccaguuccgg

SEQ ID NO: 275402 - RNA, 62 nt, Human
accuuaucuguggacucaggaaugaugguguuuauugcaaaugcacaaucuuuuucccauug

SEQ ID NO: 275403 - RNA, 62 nt, Human
ucguacauucuuauuaaauauuucauacacuuuauugcaacuacuuuguuauuucuacaucu

SEQ ID NO: 275404 - RNA, 62 nt, Human
gcuugauauuucuaucaaacaaaugacuuucauauugcaacaaucuuuguaagaaccacuca

SEQ ID NO: 275405 - RNA, 62 nt, Human
ccaaaagcugccacugugugguauucgaggauuauugcaacaaagccaguaguuaaaccaaa

SEQ ID NO: 275406 - RNA, 62 nt, Human
cccuugucaugacucugagucacgugcugcuguauugcaacgugcaggaccauuuuaaaccu

SEQ ID NO: 275407 - RNA, 62 nt, Human
aaguucuaauacaaaagaguagagaagguucuuauugcaaauauuauuaggauguggacaug

SEQ ID NO: 275408 - RNA, 62 nt, Human
uucauucacaauggauuauacaaaaaaaaguguauugcaagugaaauaauauugauuucugc

SEQ ID NO: 275409 - RNA, 62 nt, Human
aaauagacuuuugugacccacuaauuguaagguauugcaaggucacuuugcgugugucauaa

SEQ ID NO: 275410 - RNA, 62 nt, Human
cucaucuggaagaaucccauacugauggcagggcuggccagggggaagaggguaguaucugu

SEQ ID NO: 275411 - RNA, 62 nt, Human
aagcuggcgcccccagccccacucuuggcugugcuggccaggugacuccuaguucuuggcca

SEQ ID NO: 275412 - RNA, 62 nt, Human
guuggggaguggguggcaggugggggugggcugcuggccaugaaucucugccucucccaggc

SEQ ID NO: 275413 - RNA, 62 nt, Human
gcccuuccuggcuaggacuguggaggggagcugcuggccauggcugcuuuguaguuugccca

SEQ ID NO: 275414 - RNA, 62 nt, Human
cagucucccuuugugguucgaaggauauggacuauugcaauacauuucuuccuucaaauccu

SEQ ID NO: 275415 - RNA, 62 nt, Human
cuguuacaggcacaggugauuaaaaugcuaaauauugcaaauuuaagcuuugucaguauaug

SEQ ID NO: 275416 - RNA, 62 nt, Human
uccuuguuugccgcugcugagauugcaguauuuauugcaauguaaauguauccugaaggugg

SEQ ID NO: 275417 - RNA, 62 nt, Human
augggacagccccccaguucaugaggccuggcuauugcaauauuuacuaguagaggaacucu

SEQ ID NO: 275418 - RNA, 62 nt, Human
aacuuuuaaaccuugccagucaggacuuuugcuauugcaaauagaaaacccaacucaaccug

SEQ ID NO: 275419 - RNA, 62 nt, Human
uauuugauuuauuuaaccuaauuauauucuaauauugcaaauauuaccauaaguggguaaaa

SEQ ID NO: 275420 - RNA, 62 nt, Human
guguaguuuagaaaauggcccguuaguggcucuauugcaauaauguuagggacauuauauga

SEQ ID NO: 275421 - RNA, 62 nt, Human
cauguacuuaguuuuaucccugcuacuggcuuuauugcaauauuuauuuucaucuacaauag

SEQ ID NO: 275422 - RNA, 62 nt, Human
aagcuggaugaaguagugugcauuuguaauacuauugcaagacuccucccacaauuauucua

SEQ ID NO: 275423 - RNA, 62 nt, Human
uuaucauuagucuagcuagcauuucagcaugauauugcaagcacuucucauugcuaaaaaua

SEQ ID NO: 275424 - RNA, 62 nt, Human
uugguacuaacauacucacugugaacccagccuauugcaaaaauaaaaucuuuuuauaauau

SEQ ID NO: 275425 - RNA, 62 nt, Human
cuauauuucgugucaucuuuuuuauuauaauuuauugcaaauuuuuuucugaauaaauauau

SEQ ID NO: 275426 - RNA, 62 nt, Human
guacuuacucuccgaaaggcaucuaucugugcuauugcaaacacuccuugagauuuuagggg

SEQ ID NO: 275427 - RNA, 62 nt, Human
uuagauuuaguugcaaauaauuguucucaaguuauugcaauaaaugucaaaugaaacaagcu

SEQ ID NO: 275428 - RNA, 62 nt, Human
aaaauuacuuuaaaaguagcuauauguuacuguauugcaaaaucuguuaagagcaggaccac

SEQ ID NO: 275429 - RNA, 62 nt, Human
cucccuaaaguguuguggccuuaacuguucaguauugcaauaaaaaauauauuuuuauaugu

SEQ ID NO: 275430 - RNA, 62 nt, Human
cacuucauuugauacuguuuuucauguucuuguauugcaaccuaaaauaaauaaauauuaaa

SEQ ID NO: 275431 - RNA, 62 nt, Human
uuuucuuuuuaguagagacgggguuuuaccaugcuggccaggcuggccucaaacuccugacc

SEQ ID NO: 275432 - RNA, 62 nt, Human
caggcgccccucacccccacaccugcugcauggcuggccacaccacucagugcauggcggcc

SEQ ID NO: 275433 - RNA, 62 nt, Human
acauuagguccuuuguuguuuuuaaagaggcugcuggccacaggcaaaaaaaaugaccuagc

SEQ ID NO: 275434 - RNA, 62 nt, Human
ccuuuugcuagcugugcuauuguuguauuugauauugcaaauugcuauguguguggugaugg

SEQ ID NO: 275435 - RNA, 62 nt, Human
gggaaaaaggccauuggcuaauugcacguguguauugcaaugggaaauaaauaaauaauaua

SEQ ID NO: 275436 - RNA, 62 nt, Human
ccuccccuuucugucaauugguugucuuuaaauauugcaaaaguccugaugcuaaacaguau

SEQ ID NO: 275437 - RNA, 62 nt, Human
aguauaucagaugacacugguggcucuaaggauauugcaauuaagcagcuaccuguagccag

SEQ ID NO: 275438 - RNA, 64 nt, Human
uccugacccucagcuggcccugcccagccacccuggacgugaccguaucccucugccacacccc

SEQ ID NO: 275439 - RNA, 64 nt, Human
caccaagcccaccccaggucaugccagcggcagaggacgugaggggcuggcagcaggcagggcg

SEQ ID NO: 275440 - RNA, 64 nt, Human
caccagagcaacagcccaguccugaggaugggagggacgugacuuagccuugggauuccacgcu

SEQ ID NO: 275441 - RNA, 64 nt, Human
agugagaagaugccuggcgagguuuuggccaggaggacgugaaguccuuggggaagaaaaacaa

SEQ ID NO: 275442 - RNA, 64 nt, Human
accuaccauacuaacaaucagcagauaaaauucuggacgugagauuccuuauaaucuaauuaua

SEQ ID NO: 275443 - RNA, 64 nt, Human
acaucugcagccagauguucgaaggccagauccuggacgugaaggguaaggugggauguauggg

SEQ ID NO: 275444 - RNA, 64 nt, Human
ccacuuuggugggagagaaggucgguugcuugggggacgugaagcuagaaaaauaaaugagccc

SEQ ID NO: 275445 - RNA, 64 nt, Human
cgcugccucugugguucccucccucauuuuuccuggacgugauagcucugccuauugcaggaca

SEQ ID NO: 275446 - RNA, 64 nt, Human
gacaucuucuugcugcuggauuuccaagcugagaggacgugaaccugggaccaccaguagccau

SEQ ID NO: 275447 - RNA, 64 nt, Human
ccccgcauucccaauauacccaggccacaagaguggacgugaaccacaggguguccugucagag

SEQ ID NO: 275448 - RNA, 64 nt, Human
cauacucaaucccauauucagcaagugugaagcuggacgugaugcaaaauaaccgaugcccuac

SEQ ID NO: 275449 - RNA, 64 nt, Human
ugaggagcgucucugccuggcugcccauugucugggacgugagcagccccucugccuggcugcc

SEQ ID NO: 275450 - RNA, 62 nt, Human
gccaacucaaacauagccuccuuccccacccagcuggccacccuggccucagcucccucagg

SEQ ID NO: 275451 - RNA, 62 nt, Human
ccaggcaaagcgccagcagcccugcacuccacgcuggccaagaaggccuuccacgcagaaug

SEQ ID NO: 275452 - RNA, 62 nt, Human
gacagcugccuggccggggccacuaggcugcggcuggccacugugucuccucacuucucuga

SEQ ID NO: 275453 - RNA, 64 nt, Human
caugagccgcccgccuuggccucccaaagugcugggacgugacaggagugagccaccacaccug

SEQ ID NO: 275454 - RNA, 64 nt, Human
ucccuuguuggcagcuccaguucaggccguggagggacgugaugcugggcuguguuuacuaaac

SEQ ID NO: 275455 - RNA, 64 nt, Human
gcuggaggccaccgccacccuaggaagggggcagggacgugaccuugacuuaccucuggaaagg

SEQ ID NO: 275456 - RNA, 64 nt, Human
aucucccgaaaugcaguuccuuagaugcccaucuggacgugaugccgcgccugccguguaagaa

SEQ ID NO: 275457 - RNA, 64 nt, Human
gugaauuuaagauaccgaagucuuaaagugaccuggacgugaaggaaaaaguaagaugagaaau

SEQ ID NO: 275458 - RNA, 64 nt, Human
cuuugcuccacacacauaauggcagcucacacagggacgugacagagcuaucauuaugcacuug

SEQ ID NO: 275459 - RNA, 64 nt, Human
cacagggcucaggguuaugcucccgcuugaaucuggacgugaaucugguaaaaauaucaaguac

SEQ ID NO: 275460 - RNA, 64 nt, Human
accaggugggacguggcaggcaggccucaguugaggacgugauguuuucucacagcagcugccu

SEQ ID NO: 275461 - RNA, 64 nt, Human
cucaucggaggccccuccgccuggagccuucuauggacgugauaugccuguaucuguuuuuaau

SEQ ID NO: 275462 - RNA, 64 nt, Human
ccugauuacuguacacaguagcuuuagauggcguggacgugaauaaaugcaacuuauguuuucu

SEQ ID NO: 275463 - RNA, 64 nt, Human
ggaugaaaagaaaaaauuccucuuuuuccuuacaggacgugauaggcugcaugcaagaggcaua

SEQ ID NO: 275464 - RNA, 64 nt, Human
ccggugcugggcacgugggggacagagguggccgggacgugagcugugaggcuuguugaugaug

SEQ ID NO: 275465 - RNA, 64 nt, Human
cagugcugaggcaggucgggcucaggaacugcagggacgugaacaugcgcuugcgguuugaggu

SEQ ID NO: 275466 - RNA, 64 nt, Human
aggaacggggcucguuuaucaccagugaggagcaggacgugagcccccgcccugcaccucugcu

SEQ ID NO: 275467 - RNA, 64 nt, Human
ggaacaugcauaagaaauguagcugaaguagaggggacgugagagaagggccaggccggcaggc

SEQ ID NO: 275468 - RNA, 64 nt, Human
cagaggugggggcaacucugcaagcucaccugcuggacgugagaauguuggaacguuccaguug

SEQ ID NO: 275469 - RNA, 64 nt, Human
cugcucguuguaaaugccaaggcauuuggcuuugggacgugacaacucaauccagaaggauggu

SEQ ID NO: 275470 - RNA, 64 nt, Human
uuuaaaaaacuauauuugaacauuggucuuucuuggacgugagcuaauuauaucaaauaaguau

SEQ ID NO: 275471 - RNA, 62 nt, Human
uuguauuuuuaguagagacgggguuucaccaugcuggccaggcuggucucaaacaccugacc

SEQ ID NO: 275472 - RNA, 62 nt, Human
ggcagguccucacucaggagugggggguguaggcuggccagcccccagggcuuguccaccag

SEQ ID NO: 275473 - RNA, 64 nt, Human
cacacuccuucaauaaacguggcugcuggccagaggacgugagcgugugacgggcgccuuggcg

SEQ ID NO: 275474 - RNA, 64 nt, Human
aguguggggagaagggauguguauuagccccggaggacgugaugugagacccgcuugugagucc

SEQ ID NO: 275475 - RNA, 64 nt, Human
cagcccuggacacugguccgagaagggacaugugggacgugagccgggcuccaacagccucugu

SEQ ID NO: 275476 - RNA, 64 nt, Human
gccucacuccucuaggcaggggagugaugcuucaggacgugacaggcuguucuaacaugugucu

SEQ ID NO: 275477 - RNA, 64 nt, Human
guggcagcaccgggcuggacugcccugaucccugggacgugagacuuagcuuccagccagugug

SEQ ID NO: 275478 - RNA, 64 nt, Human
ccuccaaugccagcgacucccaggagcccuugggggacgugaggggagccucucacauccgauu

SEQ ID NO: 275479 - RNA, 64 nt, Human
gugaucauuccgaguguugcugcaagauuacaguggacgugaucuuuuagcaugugcuuuuaua

SEQ ID NO: 275480 - RNA, 64 nt, Human
uggugccugcaggccacccagggaccacgggcgaggacgugaagccucccgaacacgcacagaa

SEQ ID NO: 275481 - RNA, 64 nt, Human
agcuccccgagcugccagccagcccgagccaggaggacgugagugcugauaugcaggagagaag

SEQ ID NO: 275482 - RNA, 64 nt, Human
cuagaugacucuaaggucucuuucaggucccaggggacgugaucuaaguuaggagugggaacau

SEQ ID NO: 275483 - RNA, 64 nt, Human
gagcugacugcuguucacccuuugaacaacucauggacgugagggaugggugcugagcagaacc

SEQ ID NO: 275484 - RNA, 64 nt, Human
ccuguugaucaugcagcuccaccaaaccuuagggggacgugaaaucacugccuguuguggucuc

SEQ ID NO: 275485 - RNA, 64 nt, Human
accccccuuucaggcccugucugcagucagaggaggacgugagccaguuugauacccgcuucac

SEQ ID NO: 275486 - RNA, 64 nt, Human
gaauacccagaguaguggaaauuuuaggacuugaggacgugaacaacuugaaagagaaaauuga

SEQ ID NO: 275487 - RNA, 64 nt, Human
uucuucauccucuccuacuucuuguccagggcaaggacgugagccagugggagcuggugucugu

SEQ ID NO: 275488 - RNA, 64 nt, Human
uuggucuccacacagagcccagcccaggggcgcuggacgugaccaucauguacaagggccgcac

SEQ ID NO: 275489 - RNA, 64 nt, Human
agagcuaggauguucugaggagagacuucaccugggacgugaaaggagcaugggcuugauguca

SEQ ID NO: 275490 - RNA, 64 nt, Human
acccaggaagggaaagcgggcagccccguuuuggggacgugaacguuuuaauaauuuuugcuga

SEQ ID NO: 275491 - RNA, 62 nt, Human
gcacuguacuacugacccaacaacugugacuagcuggccacgccauucagggcugguguggc

SEQ ID NO: 275492 - RNA, 62 nt, Human
uguacagguaauaaacauccccaagguuuguggcuggccauacacauaggcaucaguuuaac

SEQ ID NO: 275493 - RNA, 64 nt, Human
uucuccaauuuacccucuuuggauggugccagguggacgugacaucucgugccuguccggugcg

SEQ ID NO: 275494 - RNA, 64 nt, Human
guagguaggacagguuaugaugucuucacuguauggacgugaacccaggguucuaauagguugg

SEQ ID NO: 275495 - RNA, 64 nt, Human
ucuuggguucucaccugcauggaugcuuugaguuggacgugauacuguccauauucuccagagg

SEQ ID NO: 275496 - RNA, 64 nt, Human
aaagagaccacuugcucuuguuuaaaauaaauuuggacgugauuuuuccaugcagcaucuggug

SEQ ID NO: 275497 - RNA, 64 nt, Human
ccaccucuuggaccaggugugcccccuggguucuggacgugagugguggguccugcuccuaucu

SEQ ID NO: 275498 - RNA, 64 nt, Human
caaaaucugugcuuuuuugaaaauuuaagaguggggacgugaaacuguauucugugccuuccau

SEQ ID NO: 275499 - RNA, 64 nt, Human
cacgaauuccaaaucagauugccaggaagaaauaggacgugacgguacugggcccugugauucu

SEQ ID NO: 275500 - RNA, 64 nt, Human
ugcuaagggccuagcacacuuugaugagguuccuggacgugagacccucacaaagaccaaccau

SEQ ID NO: 275501 - RNA, 64 nt, Human
ucuucaccggcuccuuuugcuucuccuuccugcaggacgugaguuaugucuggucccaaaaccc

SEQ ID NO: 275502 - RNA, 64 nt, Human
gugcaggcggcuugcugggggaugugagcgcucaggacgugaugagguacucgugguucuggag

SEQ ID NO: 275503 - RNA, 64 nt, Human
gguggcugguggcaaggaggggcaggggauauggggacgugacugggacagguuccugccuuau

SEQ ID NO: 275504 - RNA, 64 nt, Human
ggggcgggguguugggaguagagacaggguaaggggacgugagaaaggaaaaggcaugaaguuc

SEQ ID NO: 275505 - RNA, 64 nt, Human
ggggcugagcuggagacugagcuggggcuggccgggacgugacaaggcaggacagaggcggccc

SEQ ID NO: 275506 - RNA, 64 nt, Human
uggagcgacagaaccaggaguaccaggugcuccuggacgugaaggcccggcuggagggugagau

SEQ ID NO: 275507 - RNA, 64 nt, Human
gaucccugcccccaugggaggcccccuacuagaaggacgugaaagcagcuuuugggggaaacug

SEQ ID NO: 275508 - RNA, 64 nt, Human
agucaccggcuucguccuuaguuuucccaacuugggacgugauaggagcaaagucucuccauuc

SEQ ID NO: 275509 - RNA, 64 nt, Human
cuauguguuguguuuguagucuugucuuagcucuggacgugaaauacuucgaugaugaugauga

SEQ ID NO: 275510 - RNA, 62 nt, Human
ccacagagugcccccacguggaacauucuggagcuggccaucccaaauucaaucaguccaua

SEQ ID NO: 275511 - RNA, 62 nt, Human
gaccccugcccccacuaucuggaguuuuccaugcuggccaagaucuggacacgagcaguccc

SEQ ID NO: 275512 - RNA, 62 nt, Human
agaacugcaaugaacaaucugacaaaugugaagcuggccaaaagucggaaaaugagaaugag

SEQ ID NO: 275513 - RNA, 64 nt, Human
uuuucacuagcugugaaccagccuuccuguccauggacgugaaacugcauaguaaugagacugu

SEQ ID NO: 275514 - RNA, 64 nt, Human
gaugcugcacugggcagcuacccaccuggggaugggacgugaggccaagaccccagcagagaug

SEQ ID NO: 275515 - RNA, 64 nt, Human
gccuccccuucgacgaccaggccucggucacaacggacgugacaugcugcuuuuuuuaauuuua

SEQ ID NO: 275516 - RNA, 64 nt, Human
gaccugcgcccacaggugcugucuuaguggacugggacgugaaccuuucgcucuccuucuggac

SEQ ID NO: 275517 - RNA, 64 nt, Human
uuucuauuaacgcugcccgucucccuuauaaccuggacgugagcugucagagcagaagccacua

SEQ ID NO: 275518 - RNA, 64 nt, Human
cuggcuccucauccugggagcaacagggcucugaggacgugaggagccaucgcugugggaggca

SEQ ID NO: 275519 - RNA, 64 nt, Human
aggccuuuugcaagaaggagaggaaugggggagaggacgugagggaccacccccacccacacag

SEQ ID NO: 275520 - RNA, 64 nt, Human
ucugucugccugguggagggagccgugggcguggggacgugacugaauaaagccaccaugggug

SEQ ID NO: 275521 - RNA, 64 nt, Human
uguggcccacgggccggccagcugggugccccagggacgugauaaugcagauaaauacauuuau

SEQ ID NO: 275522 - RNA, 64 nt, Human
uuuuaccccagcuccauccuugcaucacuggggaggacgugaugagugaggacuuggguccucg

SEQ ID NO: 275523 - RNA, 64 nt, Human
agugucugugugucugcauaaacccuccuguccuggacgugacuucauccugaggagccacagc

SEQ ID NO: 275524 - RNA, 64 nt, Human
aaggguccaacuuuuccuggauucgccucccagcggacgugagcuuccacugcggcugcagaga

SEQ ID NO: 275525 - RNA, 64 nt, Human
ucggggagguggagcugcuccuuccauuccgucaggacgugaucugaaaacauguagagaagau

SEQ ID NO: 275526 - RNA, 64 nt, Human
acucagccuuugcaauuuuuguagauguagcuuaggacgugaguuauuuuuccgcagacuggcc

SEQ ID NO: 275527 - RNA, 64 nt, Human
uaacggcuuccagcuucauccaugucccugcaaaggacgugaucucauuucuuuuuauggcugc

SEQ ID NO: 275528 - RNA, 64 nt, Human
uggcuggguggggugggggguaucaaggagccugggacgugaggccccacucucgccccauucc

SEQ ID NO: 275529 - RNA, 64 nt, Human
uguguccgaggucagugugcggaaucacagccaaggacgugaagagauguacgggggaaagaga

SEQ ID NO: 275530 - RNA, 64 nt, Human
cugagcccugaaccaaagucccagagcugggcugggacgugaccugugcugagggcugugagaa

SEQ ID NO: 275531 - RNA, 62 nt, Human
uaauggaagaauugagacaaaaauccaguguagcuggccacuuauccagggcuuuuucuacu

SEQ ID NO: 275532 - RNA, 62 nt, Human
augaggggcuucacgagaggccacagggccuggcuggccacgcugucccggccugcucacca

SEQ ID NO: 275533 - RNA, 64 nt, Human
uuccuaacggguguguuugcuauacgaacauaauggacgugaaguggggcagaaacccagaacu

SEQ ID NO: 275534 - RNA, 64 nt, Human
ucuucuccugcuggaagccgccccucucugcgauggacgugaggacguguccagcucugcucug

SEQ ID NO: 275535 - RNA, 64 nt, Human
ccaucaaagaggacccccagccagcccgguucucggacgugagugcaacuggggcuaggucauc

SEQ ID NO: 275536 - RNA, 64 nt, Human
ggccuggaaacacuaggauucaggaagguaggcaggacgugagagaagggagaugggagagaga

SEQ ID NO: 275537 - RNA, 64 nt, Human
agcaauaaggaaauaguucucuggcugaggcugaggacgugaaccgcgggcuuuggaaagggag

SEQ ID NO: 275538 - RNA, 64 nt, Human
ccaaaaauggugagcgaucauuuauuucaugauucaaccugauacauuuacauagugcaaaacu

SEQ ID NO: 275539 - RNA, 64 nt, Human
cuggauggggaggcucuagcaucucucauaggugcaaccugagagugggggagcuaagccauga

SEQ ID NO: 275540 - RNA, 64 nt, Human
aggagagcacuguucuuugauuguuuauccaguccaaccugauccauuagggaucgaggugcua

SEQ ID NO: 275541 - RNA, 64 nt, Human
cccuccuaacgucuuccuuucccugcacuaacgccaaccugacugcuuuuccugucagugcuuu

SEQ ID NO: 275542 - RNA, 62 nt, Human
ccauccuggcccaucaguguacccccgcccaggcuggccagccccacagcccacguccuguc

SEQ ID NO: 275543 - RNA, 62 nt, Human
uuauuucucauugagccucaggcuauacuccagcuggccaaggcuggaaaccugucucccuc

SEQ ID NO: 275544 - RNA, 58 nt, Human; identical to SEQ ID NO: 50816

SEQ ID NO: 275545 - RNA, 62 nt, Human
gagaggaagcucugcucaggccuccagcguuggcuggccauggccacagccagauggaggag

SEQ ID NO: 275546 - RNA, 64 nt, Human
aggcugcucaucugaccacugggcaccuuagugccaaccugaaccaaagagaccuccuuguuuc

SEQ ID NO: 275547 - RNA, 64 nt, Human
gugggcggaucgccugaggucaggaguucaagaccaaccugacuaacauggugaaaccccaucu

SEQ ID NO: 275548 - RNA, 64 nt, Human
cuuggaagcaaauccuaguucucuucccaccugucaaccugaauuaaagucuacacugccuuug

SEQ ID NO: 275549 - RNA, 64 nt, Human
guuaaaauaaacuaugcuguuuuauuuaucuucccaaccugauuggcagcuagacuuuuuuagg

SEQ ID NO: 275550 - RNA, 64 nt, Human
cugcacagggcaucaacauggccaacagcauugccaaccugagacugaaggccaaggaauauag

SEQ ID NO: 275551 - RNA, 64 nt, Human
uggaugacauaggggacaucaacaagacggcugccaaccugagaagucaccaaaccacaaaaau

SEQ ID NO: 275552 - RNA, 64 nt, Human
ugccauccuacagguggcuggagcagcugcuuugcaaccugaucaccuugaguucugagcaggg

SEQ ID NO: 275553 - RNA, 64 nt, Human
aggggcuuuguccuggugcccccgccccuggucccaaccugaucccacgagggaguugggacag

SEQ ID NO: 275554 - RNA, 64 nt, Human
acccaggugacgaugcccucucagccaacacugccaaccugacccugucaucccgauugacagc

SEQ ID NO: 275555 - RNA, 64 nt, Human
gaugucggucauaguuuccugaagcauuuaguuacaaccugaaggaauaaaaugauuuguggaa

SEQ ID NO: 275556 - RNA, 64 nt, Human
cuuuuucuugcccuuggagaaaaagaaucauucucaaccugauaaucuguuaagaaaaauccca

SEQ ID NO: 275557 - RNA, 64 nt, Human
agccacuucugcaguccacgcugaacaugggaaacaaccugaaaagcaggcaggccucccgguc

SEQ ID NO: 275558 - RNA, 64 nt, Human
gauguggcuuuacauuucaaaagugaacuugauucaaccugagaaaacugauuaaaaaauuagu

SEQ ID NO: 275559 - RNA, 64 nt, Human
cccauuuuccaggggguauauggucagggcuccccaaccugaguuggguuacuucaagggcagc

SEQ ID NO: 275560 - RNA, 62 nt, Human
uauuaauugucauuuuaacugaaagaauuaccgcuggccauuguagugcugagagcaagagc

SEQ ID NO: 275561 - RNA, 62 nt, Human
ccaccugagaggccccuggggccuccccagcugcuggccagacccuggcgcugccacagucc

SEQ ID NO: 275562 - RNA, 62 nt, Human
uucugugaaaugugcugcuccccuuugugcaggcuggccagccaagaguucccuuccagcuc

SEQ ID NO: 275563 - RNA, 62 nt, Human
uggugggauaagacaacaggcugacaaaccaagcuggccauuugguaccgugagaaaggaaa

SEQ ID NO: 275564 - RNA, 64 nt, Human
agggucccuggccagaaggggcauggccaccucccaaccugaugaccucucuggcuggccuccc

SEQ ID NO: 275565 - RNA, 64 nt, Human
cagugaaaucucauuauacaaagagaaccuuaugcaaccugacaaaccacugaggucaugguga

SEQ ID NO: 275566 - RNA, 64 nt, Human
ugaugaggguauuaaauuaaaauugauaauuaaacaaccugaugaucaauuucuuuuguugggu

SEQ ID NO: 275567 - RNA, 64 nt, Human
acagaguggccccucaccugggccuuuccugugccaaccugaugccccuuccccaagaagguga

SEQ ID NO: 275568 - RNA, 64 nt, Human
ggccucauaccuagguggggcaggcuggggcugccaaccugauccugccugggcaacccuuucc

SEQ ID NO: 275569 - RNA, 64 nt, Human
uuucccuggaauuuaauucaaaguuuguggcauacaaccugagccuuuucuuauauaagacaag

SEQ ID NO: 275570 - RNA, 64 nt, Human
ccaaaagaggaaauacuuuaaaaauuccuuuuagcaaccugagcaaucuuauucucguaacaau

SEQ ID NO: 275571 - RNA, 64 nt, Human
cacuaagcucuuaaucagcaaacgcagugaguaucaaccugauuguugccaggaaauccuuaug

SEQ ID NO: 275572 - RNA, 64 nt, Human
acuuuccagcacauaaauaaaggcuggaauuuuacaaccugauguauauauuagacaguucuag

SEQ ID NO: 275573 - RNA, 64 nt, Human
caucugcccuuuccccagccaccuccccagcaagcaaccugaaaucucagcagaugcccaccau

SEQ ID NO: 275574 - RNA, 64 nt, Human
guauaugugaagcaaacucuaaaauuauaaaugacaaccugaauuaucuauuucaucaaaccaa

SEQ ID NO: 275575 - RNA, 64 nt, Human
uuccccuuaucuggcucuaaaaccuucugcugcccaaccugacuuuguaguucugauuuuuacu

SEQ ID NO: 275576 - RNA, 64 nt, Human
uuuacacucagcugcucugcaagcagaaacuuuacaaccugaugucauauuccauuuuggacug

SEQ ID NO: 275577 - RNA, 64 nt, Human
ucuaguaugguguucuguuuucagcugacuuggacaaccugacuggcuuugcacagguguuccc

SEQ ID NO: 275578 - RNA, 62 nt, Human
uacucugcaaaccuugguaaaggaaccagucagcuggccagauuuccucacuaccugccaug

SEQ ID NO: 275579 - RNA, 62 nt, Human
agggccagugacuugcugggcuucguguucaugcuggccaugcaugucaucuaugcaagcgu

SEQ ID NO: 275580 - RNA, 62 nt, Human
gccagcugacgcccucccugccucccagggcagcuggccagccucgggcagcgcggcccccu

SEQ ID NO: 275581 - RNA, 62 nt, Human
uaaguaccuuuguguccuuguucauuuauaucgcuggccagcauuauaagcagguguauacu

SEQ ID NO: 275582 - RNA, 64 nt, Human
accuguuaagguggaaaauggacuggcuuggccacaaccugaaagacaaaauaaacauuuuauu

SEQ ID NO: 275583 - RNA, 64 nt, Human
uagagaugcagacaccccagccccauuauuaaaucaaccugagccacauguuaucuaaaggaac

SEQ ID NO: 275584 - RNA, 64 nt, Human
agggaccugccucacggaccuuagggaaaaaccucaaccugaaagaucucuuccuuucuggagc

SEQ ID NO: 275585 - RNA, 60 nt, Human
cucgcugccucauccucugaacaccgggcccaaccugaucugauccagaucuugacuggg

SEQ ID NO: 275586 - RNA, 64 nt, Human
acuucugagcaagcugaucuccccuggcaugcuccaaccugauuggacaaaggaagcucuaugg

SEQ ID NO: 275587 - RNA, 64 nt, Human
uuccuguacccucuguuuaaacuuuccguucucucaaccugaagauugagaccuugguggcugu

SEQ ID NO: 275588 - RNA, 53 nt, Human
ccuggauccucaguaacuaagagcaaccugagcacagacacccucaggguacu

SEQ ID NO: 275589 - RNA, 64 nt, Human
cucacccuggaagagaauauucgcuuaauucccccaaccugaccaccucauucuuaucuuucuu

SEQ ID NO: 275590 - RNA, 64 nt, Human
uguacugaugcguuagucuuauaauacuuugcaccaaccugaggaaucuucuaggcuucucuag

SEQ ID NO: 275591 - RNA, 64 nt, Human
uuguagugauuccaaauuaaaaguuuucuuucuccaaccugagggcacggccaaaaagaucugg

SEQ ID NO: 275592 - RNA, 64 nt, Human
uuccuuucacuccauucauuguccucucugugugcaaccugagcugggaaaggcauuuggaugc

SEQ ID NO: 275593 - RNA, 64 nt, Human
ucagucuaccuuaccaauggggcaucuggcuaaacaaccugacaaacuguggccaggggaaccg

SEQ ID NO: 275594 - RNA, 64 nt, Human
cacucugauacuuuuuuuuuuuuuuuuuuuuuugcaaccugauaccuugaaaagcuucuaugug

SEQ ID NO: 275595 - RNA, 64 nt, Human
ccuucauaaguguauuauucaguccuugugauaccaaccugaaaauauuaaaacuuuuuucccu

SEQ ID NO: 275596 - RNA, 62 nt, Human
ggaaggucucacaucugucucugggcacccaugcuggccagcaguuucccagggcucccugg

SEQ ID NO: 275597 - RNA, 62 nt, Human
ggcucagguuaauucucaaaacacaaauuguugcuggccaggcauggugacucaugccugua

SEQ ID NO: 275598 - RNA, 62 nt, Human
uggcagagggcaucggucagcggggcagcggggcuggccaugaggguccaccuucagcccuu

SEQ ID NO: 275599 - RNA, 62 nt, Human
gauguuaaauggaauucguguuaugaaucugugcuggccauggacgaauaugaaugucacau

SEQ ID NO: 275600 - RNA, 64 nt, Human
aauccaauguucaucaaugccuacacauucaguacaaccugauggcauuaauucugugguuggg

SEQ ID NO: 275601 - RNA, 64 nt, Human
gcuuugcuaauccaguugcucaaguucuuuaccucaaccugaaggaaugaagcauuauuacauu

SEQ ID NO: 275602 - RNA, 64 nt, Human
ccugcuugggaaugaaauuaacacaaaggaaguccaaccugagaaauggccaaauauauuuccu

SEQ ID NO: 275603 - RNA, 64 nt, Human
caucacugggauguucaagucuacuuuuuaguuucaaccugaagaggaaacucaguagguguug

SEQ ID NO: 275604 - RNA, 64 nt, Human
ccuuagcacauguuccuaagguguguugucaagccaaccugaauucugccucccuguuauaguc

SEQ ID NO: 275605 - RNA, 64 nt, Human
guauugcucugaggaccaggcaggaggaacucuacaaccugaguuugccuuugugaggcauuag

SEQ ID NO: 275606 - RNA, 64 nt, Human
guccccaggaaccaggcuuugcugaggugcugcccaaccugacaguccaggagauggacuggcu

SEQ ID NO: 275607 - RNA, 64 nt, Human
ucuguagguggacccggucucccacaggugacaucaaccugaggguggcgucuuuagagacagg

SEQ ID NO: 275608 - RNA, 64 nt, Human
uuaauccaagguacuggaaaaccuuccacaugcccaaccugagaccuguuccccaucgcuacca

SEQ ID NO: 275609 - RNA, 64 nt, Human
uuuagaauugaaguuugaauucuaagacuugaaacaaccugaucacugaagccaacuuuguccc

SEQ ID NO: 275610 - RNA, 64 nt, Human
aauuuagaggcaaaugacaagcgauaggcuauugcaaccugagaaagagaacugcuccuucauc

SEQ ID NO: 275611 - RNA, 64 nt, Human
uuuaucuuaucuuucaguuaguggaaaaacauuucaaccugacuaaaauuuggaauugugucuu

SEQ ID NO: 275612 - RNA, 64 nt, Human
acccaagcucaggaccuucguggagcugcuucuccaaccugagaaacucaagacccauccuccc

SEQ ID NO: 275613 - RNA, 64 nt, Human
uccaaguuauuuuguauuuuguuuuuaauaaauacaaccugauuuaagaagcuucuguauuucu

SEQ ID NO: 275614 - RNA, 62 nt, Human
acuaagccaagcuguguucauccagcuacuuagcuggccaaggagaggaguucuuuggcucu

SEQ ID NO: 275615 - RNA, 62 nt, Human
caagaauaggagugaugggugaagggaccuaagcuggccaauagcccucugccccagacaug

SEQ ID NO: 275616 - RNA, 62 nt, Human
cuguucuacccuugauggauuuucaaggucaugcuggccaauuaaggcaucaucaguccuac

SEQ ID NO: 275617 - RNA, 62 nt, Human
gugagccaaugcucaccagccccagagucagagcuggccacaggcuggcagccuccaggggc

SEQ ID NO: 275618 - RNA, 56 nt, Human
ggaaaauaguuucccauugaaaaugucaaccugaauuguuuaaaugggcuuauucu

SEQ ID NO: 275619 - RNA, 64 nt, Human
gccuuguugccugcuuugugcuuucugcaccagacaaccugauggaacauuugcaccugaguug

SEQ ID NO: 275620 - RNA, 64 nt, Human
caaaacuguaucacauaggguuuuuggucacucacaaccugaauucaccacagcuggaauagcu

SEQ ID NO: 275621 - RNA, 64 nt, Human
ccugcucagacugaguaaacauuuguggugcugucaaccugauuucuugacucucaaaugauuu

SEQ ID NO: 275622 - RNA, 64 nt, Human
uugaagcagauguucaccaaugucagcaagaacucaaccugaauuuaaagguggcauuccauau

SEQ ID NO: 275623 - RNA, 64 nt, Human
uucggaccagggacuagacaucaaagcagcguuccaaccugaggccaacccaucucaccugaca

SEQ ID NO: 275624 - RNA, 64 nt, Human
caugagaagcaguccagagucuaggcaauuuuuacaaccugaguucaagucaaauucugagccu

SEQ ID NO: 275625 - RNA, 64 nt, Human
aggagucaguaaccaaucccaccaaccacuccagcaaccugacaagacuaugaguaguucuccu

SEQ ID NO: 275626 - RNA, 64 nt, Human
aucagauucaaguugguuaauuuuaguuauguaacaaccugacaugauggaggaaaacaaccuu

SEQ ID NO: 275627 - RNA, 64 nt, Human
ugugaacuuaucaaaaaugcaaauucucaggccccaaccugaaggaggacccugaauuugagau

SEQ ID NO: 275628 - RNA, 64 nt, Human
uuuccccccuucuuuuccuaauuguaaacuaggccaaccugaaagccauggcugaugcucuagc

SEQ ID NO: 275629 - RNA, 64 nt, Human
cucuagccucuugucacauguggugcacaaaccucaaccugacagcuuucagacagcauucuug

SEQ ID NO: 275630 - RNA, 63 nt, Human
ucaguagcaguguugaauagcuugcggccaggacaaccugaauucuauaaguucuuguuuucu

SEQ ID NO: 275631 - RNA, 64 nt, Human
gggggcauucucugucaaugaugcacuaaccucccaaccugauuuccccgaaucugagggaagg

SEQ ID NO: 275632 - RNA, 62 nt, Human
gaugcugaaggcagagcagcugagggaggggcgcuggccacaugucacugauggucagauuc

SEQ ID NO: 275633 - RNA, 62 nt, Human
gggaggaaagggaggcagcgccggacggcgcagcuggccaagaggcgggcggggccagaaau

SEQ ID NO: 275634 - RNA, 62 nt, Human
gggcuggagcagguguacccugagcaggggcagcuggccacucccaguucucaccaagucac

SEQ ID NO: 275635 - RNA, 62 nt, Human
aaacgagggcugcuccaggagaagggccuccugcuggccagagcaaggaaggcugagcagcu

SEQ ID NO: 275636 - RNA, 64 nt, Human
caaaugauccuuaaagaagguguggggucuuucccaaccugaggauuucugaaagguucacagg

SEQ ID NO: 275637 - RNA, 64 nt, Human
aggggccuugcccucccgcucccagcccaggguccaaccugacccagugaucuuccauggccgu

SEQ ID NO: 275638 - RNA, 64 nt, Human
ccuuauccgucaacucaucagcucuuccucaaggcaaccugaggccagacaccaagaaaccaag

SEQ ID NO: 275639 - RNA, 64 nt, Human
gaaguuaauccaugugcugguuaauuuuagaugucaaccugacuggauuaaggaauaccuagac

SEQ ID NO: 275640 - RNA, 64 nt, Human
ugugagcaggcccaccuggcuccagacccgcccccaaccugagacagaaccaggcugagccagg

SEQ ID NO: 275641 - RNA, 64 nt, Human
cuaaagaacuuguugaaugcuaaggcugaaaucccaaccugagauuuguaguccaggauuacaa

SEQ ID NO: 275642 - RNA, 64 nt, Human
gugguagugggagaaugacuguuucugccacuaucaaccugauccucaugcugauagaaugaca

SEQ ID NO: 275643 - RNA, 64 nt, Human
gcugagagcuugguuucauuugaauuuucuuccccaaccugagugcuuugacaacaauggaaau

SEQ ID NO: 275644 - RNA, 64 nt, Human
acccauuaggcuaaagagagacaagagaagcccccaaccugauucucaugacagcuccaucaag

SEQ ID NO: 275645 - RNA, 64 nt, Human
uaaaauugaaccaaucacaguuaagaugagagaucaaccugaguuuuaaaauaccuuuaauaaa

SEQ ID NO: 275646 - RNA, 51 nt, Human
gaacucacagcccaaccugaacaaccugacugcugugggcugcucacuggc

SEQ ID NO: 275647 - RNA, 64 nt, Human
gucacccuuuugcuucaaucagguuugguggaggcaaccugaccagaaacacuucgcugcugca

SEQ ID NO: 275648 - RNA, 64 nt, Human
cauaauauaacuaggcaguggcggugccuugguacaaccugaaaaauguuaaggcuuauugaaa

SEQ ID NO: 275649 - RNA, 64 nt, Human
auguaauugaaauauauagauuauuguaaccuuucaaccugaaaaucaagcaguaugagaguuu

SEQ ID NO: 275650 - RNA, 62 nt, Human
gguucacauuagguuugaacgaccaagugcaugcuggccacugggaguggaucgguggugaa

SEQ ID NO: 275651 - RNA, 62 nt, Human
accucacccagcacccugccccgcuucccagggcuggccaagagagaagacuggacggcagg

SEQ ID NO: 275652 - RNA, 62 nt, Human
ucgugggcugagaaaggggcaggcaaaaugaagcuggccacugaaaacuguaagauggucaa

SEQ ID NO: 275653 - RNA, 62 nt, Human
augagccguauacaaggaauaugacauacagugcuggccacaaccuucugaaggcccaugcc

SEQ ID NO: 275654 - RNA, 64 nt, Human
uuaccacagaccccagcgucaggugggaguacugcaaccugacgcgaugcucagacagaaggga

SEQ ID NO: 275655 - RNA, 64 nt, Human
acacaacugauccgugugugaggugggaguacugcaaccugacacaaugcucagaaacagaauc

SEQ ID NO: 275656 - RNA, 64 nt, Human
acacgauggaucccaaagucagaugggaguacugcaaccugacacgaugcucagacacagaagg

SEQ ID NO: 275657 - RNA, 64 nt, Human
auacaacggaucccaaagucaggugggaguacugcaaccugacaggaugcucagacaagaauag

SEQ ID NO: 275658 - RNA, 64 nt, Human
aagaauguucagggggcugcccaggaggggcccccaaccugacuaucauggacaagagauuuga

SEQ ID NO: 275659 - RNA, 64 nt, Human
acgaaauccuaagcucuugaggccauucaccugccaaccugaccauacugcuuucaaaagucuu

SEQ ID NO: 275660 - RNA, 64 nt, Human
acaacauuguaugugagagaaauauaaauauuuacaaccugauauucguuguuguuuuauuguu

SEQ ID NO: 275661 - RNA, 64 nt, Human
gaucacaggcuauauucaugaaguuacuuuugaccaaccugaaaacugauaggauuuuguuugu

SEQ ID NO: 275662 - RNA, 64 nt, Human
uuucccuccaauguauguauguuuaguuuuuauccaaccugaggaaugaaaacuuaacuggauc

SEQ ID NO: 275663 - RNA, 64 nt, Human
cgugacacugggacucucagcagcuuugugcugccaaccugagauugaaggcagugccucagag

SEQ ID NO: 275664 - RNA, 64 nt, Human
uuuucuuaaagaacacuccaauucagccugagugcaaccugacucucugcaucuguauccugcu

SEQ ID NO: 275665 - RNA, 64 nt, Human
acgaggccaguccccaggagcagccccaggagcacaaccugagauuucuaagcuugcagguuac

SEQ ID NO: 275666 - RNA, 64 nt, Human
uguuuucuaaacaauuuguugauuaagugaucaacaaccugaagaaaauaucaauuuuuaauug

SEQ ID NO: 275667 - RNA, 64 nt, Human
ucacccuuuagaucuugauuucuuggucauuucucaaccugaggugcauagcauauucccacau

SEQ ID NO: 275668 - RNA, 62 nt, Human
cccacaagcagagcccugagggguggggaccagcuggccacauggugcugcuuuucagguua

SEQ ID NO: 275669 - RNA, 62 nt, Human
ucccucgggcccagaugcagacggugccgaacgcuggccacuggauccacgcugaccgccca

SEQ ID NO: 275670 - RNA, 62 nt, Human
cagagaagagcagcccugagccccuguauucugcuggccagacacacauggcacagacacag

SEQ ID NO: 275671 - RNA, 62 nt, Human
cccaggaggcagcucccuccuggcacaugggggcuggccacaauagcccagagggucagaac

SEQ ID NO: 275672 - RNA, 64 nt, Human
cccaauccccccagggccuuaauuuuucccuuuucaaccugaacaaaucacauucuguccagau

SEQ ID NO: 275673 - RNA, 64 nt, Human
cuuugcccuucuuucuacccugcuggggaaaguacaaccugaauacccuuuucugaccaaagag

SEQ ID NO: 275674 - RNA, 64 nt, Human
cuggaggcauuagacacccaaguggaaggugcuacaaccugaagcgcaggaaagaaaggcccau

SEQ ID NO: 275675 - RNA, 64 nt, Human
aucacaggugucuugaaacauuagcuucuuuuaccaaccugagaaaauuaggaugaccuggcaa

SEQ ID NO: 275676 - RNA, 64 nt, Human
ucaaagggacucauacaauuugagaaaaaacagucaaccugauuugagaaauuaaccaguaugg

SEQ ID NO: 275677 - RNA, 64 nt, Human
acaggguaccagcacggaagacuuucuuaaaacgcaaccugaauugaaugaugaaauguuguau

SEQ ID NO: 275678 - RNA, 64 nt, Human
acuuaagauguguuuugauuugguguucagaaagcaaccugacaaugauaauacuguaacuaug

SEQ ID NO: 275679 - RNA, 64 nt, Human
uaauauacuguaagguaaugagcuucagaacaggcaaccugacccugcagaggucgcgugcugu

SEQ ID NO: 275680 - RNA, 64 nt, Human
aaacugagauguugucuauagcuaugucuauaaacaaccugaagacuugugaaaucaauguuuc

SEQ ID NO: 275681 - RNA, 64 nt, Human
uuguauaguugacuucauugucuggauaacuauacaaccugaaaacugucauuucagguucugu

SEQ ID NO: 275682 - RNA, 64 nt, Human
uaccauuauuuuugauuccuggcuuggucaagaacaaccugauuuuuuuuuuuuuaaucuugca

SEQ ID NO: 275683 - RNA, 64 nt, Human
cuuggcugagccccacuacacacagagaaaucaucaaccugacuuaagaguuuucaagauguca

SEQ ID NO: 275684 - RNA, 64 nt, Human
cauagagaaaauauuuuuuucuagcacacaagagcaaccugaaaggcugcuccuggccagagga

SEQ ID NO: 275685 - RNA, 64 nt, Human
gccucucugguccaaugggacugacacuguuguacaaccugaccuguggcugagggugucuggg

SEQ ID NO: 275686 - RNA, 62 nt, Human
gcagaugaggugaagaucacugucaucuaaaagcuggccacuaaauuaaaaaaaaauuaaaa

SEQ ID NO: 275687 - RNA, 62 nt, Human
cauggcaggagucccggccucggagccaugaggcuggccagcccucagcggggccgggcggg

SEQ ID NO: 275688 - RNA, 62 nt, Human
uggcagguggcaggaauggagaagcugacccugcuggccaggcaaggggccagacccccccc

SEQ ID NO: 275689 - RNA, 62 nt, Human
gacagccaccuccagggcaccgucaggguggugcuggccacagaggcugcaugaccuccccu

SEQ ID NO: 275690 - RNA, 64 nt, Human
cuggcagacccgauccuccuucaugaacacccagcaaccugagcaagucccggcccugcccuca

SEQ ID NO: 275691 - RNA, 64 nt, Human
uucuagaauaugucacauuucugacaguuacccccaaccugaccagugucuacauugccaacca

SEQ ID NO: 275692 - RNA, 64 nt, Human
uauucuuuaaaaugaaauuccaagccuaauugugcaaccugauuacagaauaacugguacacuu

SEQ ID NO: 275693 - RNA, 64 nt, Human
ugguuuaaauaacuuguggaaucuuuccuaaugacaaccugauauuaagggaaacuaaagaaaa

SEQ ID NO: 275694 - RNA, 64 nt, Human
guccucaguccucagucaucuugacuucaaaucucaaccugagccauccccaguucuuagccag

SEQ ID NO: 275695 - RNA, 64 nt, Human
ccuccuguuauacucaguaucauuauaugcuagucaaccugauucacuaacacacagaugaaca

SEQ ID NO: 275696 - RNA, 64 nt, Human
cucuugggcaaaauaaauaaugagauuguuacagcaaccugauuuuugaaaagaaaaaaggaac

SEQ ID NO: 275697 - RNA, 64 nt, Human
ucuuagugacuccagucguagaaaaacgucuuuacaaccugaauaagauugaagaauugugaac

SEQ ID NO: 275698 - RNA, 54 nt, Human
ugcucauugaggaguguugaacuucaaccugagggggccgacagugcccuccaa

SEQ ID NO: 275699 - RNA, 64 nt, Human
ccauuuucaauagauuggccauuuuaauguucagcaaccugaaugguuauuuuuguuaauuaaa

SEQ ID NO: 275700 - RNA, 64 nt, Human
guuccccuccuuccaaaaacagccuccaauaccacaaccugaaaagagccgaaaugguuauuuu

SEQ ID NO: 275701 - RNA, 64 nt, Human
gaaaccagggaaaauauuaauuuuaauauuauaacaaccugaaaauaauggaaaagagguuuuu

SEQ ID NO: 275702 - RNA, 64 nt, Human
uaucuuuacauuuuaaagaucaaagaagucuuuacaaccugaauccaggucuaaaacacacuag

SEQ ID NO: 275703 - RNA, 64 nt, Human
auuuuucagauugacuagaccaagcagaaucucucaaccugaucuuaguauuuccuagaaagca

SEQ ID NO: 275704 - RNA, 62 nt, Human
aucccagggauccucaggccuccccuuccuuagcuggccaggagugcccuaaggguaagagg

SEQ ID NO: 275705 - RNA, 62 nt, Human
cauggacagccccugcucaagaaaaagcaugagcuggccacacauguaauccauaaccacca

SEQ ID NO: 275706 - RNA, 62 nt, Human
cacugcuaauaauucuguaaggacacaucaaagcuggccaaaauaaugaauuuuuuuuaaaa

SEQ ID NO: 275707 - RNA, 62 nt, Human
caggaagcugaggccgggcuugagaggagagcgcuggccaugccaggagagaacccacgcac

SEQ ID NO: 275708 - RNA, 64 nt, Human
acuguugauucagcacauuagcaucugacacagccaaccugaauacuuccugccccaggcgguc

SEQ ID NO: 275709 - RNA, 64 nt, Human
gcaggaggacuguuugagcccaggaguuugagaccaaccugaguaagguggcaaaaccccaucu

SEQ ID NO: 275710 - RNA, 64 nt, Human
gguugcagugaucaggaauugugccacugcacuccaaccugagugacagagcaacacucugucu

SEQ ID NO: 275711 - RNA, 64 nt, Human
ccucugccugugaucgucugaugaggcucccucccaaccugauccaaaagccagucucaggagu

SEQ ID NO: 275712 - RNA, 64 nt, Human
uuuaccugggcaucuggcugagaggaagaaaggccaaccugauccugaggggacccagacauau

SEQ ID NO: 275713 - RNA, 64 nt, Human
aaguuaaugaaagucuuuuuccuuuuccaaaacccaaccugaaccaguucuuucuugagacaga

SEQ ID NO: 275714 - RNA, 64 nt, Human
cccgcuuugauacauaaacuuuugcaggaaugggcaaccugagagcuguuaacuuucaugcuac

SEQ ID NO: 275715 - RNA, 64 nt, Human
cucuacgccuugaggggauguuucauccaaaguacaaccugaauugaggcuucuccuucacugg

SEQ ID NO: 275716 - RNA, 64 nt, Human
uucugauaguucuucauuauuucacaaagguggacaaccugaaagagaaaaggcugcuugaugu

SEQ ID NO: 275717 - RNA, 64 nt, Human
ugccuguuuuugccccaaagcuggaaauucaucacaaccugaggcccaggaucugcucugugcc

SEQ ID NO: 275718 - RNA, 64 nt, Human
acccuguggaagcauuucgcgauggacagacucacaaccugaaccuaggagugccccauucuuu

SEQ ID NO: 275719 - RNA, 64 nt, Human
ugcaggaccagguggugaucaucgacgaggcgcacaaccugaucgacaccaucacgggcaugca

SEQ ID NO: 275720 - RNA, 64 nt, Human
uauauuucuaacuauauaacccuaggaauuuagacaaccugaaauuuauucacauauaucaaag

SEQ ID NO: 275721 - RNA, 64 nt, Human
aguuugcacaugacagaaagcuggaagaaauagucaaccugaaacacaugauggaauuauaauu

SEQ ID NO: 275722 - RNA, 62 nt, Human
uuuguauuuuaguggagacgggguuucaccaugcuggccagacuggucucgaacuccugacc

SEQ ID NO: 275723 - RNA, 62 nt, Human
cugcgcuaccagcugcagcggggagugguggugcuggccaagagcuucucucaggagagaau

SEQ ID NO: 275724 - RNA, 62 nt, Human
gaaagggagcggcagcuagagguagccagggagcuggccaggcuccccggggccuuccuauu

SEQ ID NO: 275725 - RNA, 62 nt, Human
ccauacagaaaacggugccaucccugaacacggcuggccacuggguauacugcugacaaccg

SEQ ID NO: 275726 - RNA, 64 nt, Human
acaggcuugaaucaaagaacuucuccuacuguagcaaccugaaauuaacucagacacaaauaaa

SEQ ID NO: 275727 - RNA, 64 nt, Human
auuacagggauuuauaguaaaacaagugucuucccaaccugauaauucauuuuggauaggccuu

SEQ ID NO: 275728 - RNA, 64 nt, Human
gccaauacagaaaaggaguauccaaacaaugucucaaccugauaauuuccuuagcagaauuacc

SEQ ID NO: 275729 - RNA, 64 nt, Human
guagguggaucaccugaggucgggaguucgagaccaaccugaccaacauggagaaacccugucu

SEQ ID NO: 275730 - RNA, 64 nt, Human
aguuggugucucucuucaauuuccacaacuaugacaaccugaggcacugugcucggaaguuaga

SEQ ID NO: 275731 - RNA, 64 nt, Human
ucuaguucagcuauaauuccuuuuauagagaaaccaaccugauacacacuuucaugaugggaga

SEQ ID NO: 275732 - RNA, 64 nt, Human
guuaauuuauggcguacuuuguuuauccauuggccaaccugaaggaaaugaaacucaccuaucu

SEQ ID NO: 275733 - RNA, 64 nt, Human
cuaaucugcugaagaaagaagaauagaagaaaaucaaccugaguaaaagcagcacugguuuuga

SEQ ID NO: 275734 - RNA, 64 nt, Human
gcagugaaaucacaaaauucucuaucgggguggucaaccugagaacauuuauuugaaccucuua

SEQ ID NO: 275735 - RNA, 64 nt, Human
ugugguauugaauauuguguuccuuuuuaugaggcaaccugauuguaaacuucauguaacuaua

SEQ ID NO: 275736 - RNA, 64 nt, Human
uaaggagacuucugucuucuccagaaggcaauaccaaccugaaaguuccuucuguagccugaag

SEQ ID NO: 275737 - RNA, 64 nt, Human
ugaugcugauaggaccacaaaauauuuuuacacucaaccugagcgguuauucuugacacucuua

SEQ ID NO: 275738 - RNA, 64 nt, Human
aauucuuaugcagaauuuccuagcccauagaugacaaccugacuuucuguauguuaaaguagau

SEQ ID NO: 275739 - RNA, 64 nt, Human
gaaaucuuacaaggaguugaaaagauuaaugucccaaccugaugagauuacggccuugagacaa

SEQ ID NO: 275740 - RNA, 62 nt, Human
aacauucuccgccuccagggugcagauucagagcuggccagaguuucagugauagccguaug

SEQ ID NO: 275741 - RNA, 62 nt, Human
uaggaugccucucacucacaugccaguuccuggcuggccagcugcucagggcucaggcuggg

SEQ ID NO: 275742 - RNA, 62 nt, Human
agugagauguucuggaaaccaggcucgccggagcuggccaagccaccgacuugcuucucaaa

SEQ ID NO: 275743 - RNA, 62 nt, Human
aggcuggguugggggagccccacagcuuucuggcuggccaguggcaaucuacuggccuuguc

SEQ ID NO: 275744 - RNA, 64 nt, Human
ugcccuucauaugucaugguuuucagauccauuccaaccugacugaauguuaacagacagaauu

SEQ ID NO: 275745 - RNA, 64 nt, Human
ugcucaaaggauaccaaauaaugguuuaacuggacaaccugaaaauuagcauagaaaacaaucc

SEQ ID NO: 275746 - RNA, 64 nt, Human
agaauagaauuguaaaggaaaagugguacuguuccaaccugaaaugucuguuauaauuagguua

SEQ ID NO: 275747 - RNA, 64 nt, Human
ugaugucaauucucuuguuacauucucccuuuagcaaccugaguaagagacucucugccacugg

SEQ ID NO: 275748 - RNA, 64 nt, Human
ggaaucuauuggugcugcugcaugagucugcugacaaccugacugcacaaggacuggguagcag

SEQ ID NO: 275749 - RNA, 64 nt, Human
gauugacugauuguuuuaacugauuacuguagaucaaccugaugauuuguuuguuugaaauugg

SEQ ID NO: 275750 - RNA, 64 nt, Human
acgacccaugaccguucucugaggcaaaggagggcaaccugacagcaaacacagucacuguugg

SEQ ID NO: 275751 - RNA, 64 nt, Human
cuaaaugaaaaccguguuguuauaaagcuuaaugcaaccugauuaaugaguuucgauggugugu

SEQ ID NO: 275752 - RNA, 64 nt, Human
ugagcaucaggccaggcccucugcccacucccugcaaccugauugugucucuugguccugcugc

SEQ ID NO: 275753 - RNA, 64 nt, Human
cggacucugacugaaggccuggcgggugccuuggcaaccugagccacacaggccuccaccccug

SEQ ID NO: 275754 - RNA, 64 nt, Human
uggagaucagugaagacugggaggaaagcugcuucaaccugaguccggcucuucagcaggcugc

SEQ ID NO: 275755 - RNA, 64 nt, Human
ucggccaguacagccuccggaagcagcccuacaacaaccugaagcacaaguucccauggcuguc

SEQ ID NO: 275756 - RNA, 64 nt, Human
uggaacuucugggccuugcuggugaugguuaaaacaaccugagauggagaggccaggagagagu

SEQ ID NO: 275757 - RNA, 64 nt, Human
aaccuccucagccuguuugaggacacccuagacccaaccugagccccagacucugccucugcac

SEQ ID NO: 275758 - RNA, 62 nt, Human
gugugucgugagugcuggauguccaagucccugcuggccacggagggcuccugccucucuuc

SEQ ID NO: 275759 - RNA, 62 nt, Human
ugauccaagcaagacugaggggucgacuucgggcuggccaucugguuaggauggcaggacgu

SEQ ID NO: 275760 - RNA, 62 nt, Human
gcucaccuggggauuugggggugggguggucagcuggccaagggaguaaaaaugaagaaaua

SEQ ID NO: 275761 - RNA, 62 nt, Human
gcccuaugcgcacucaggggugaagggcguccgcuggccacucugcaggggccccugcagga

SEQ ID NO: 275762 - RNA, 64 nt, Human
cugggaacccuuucugggucugauggugcugccucaaccugagagcuuucauaaguaguucuga

SEQ ID NO: 275763 - RNA, 64 nt, Human
ccugugguauguugcaguuccggcauguucagaacaaccugaugagaaauucuacaacagaaaa

SEQ ID NO: 275764 - RNA, 64 nt, Human
gaaggugacagucugugugccuugguguggagaccaaccugaggauguccugggaaauguuuuc

SEQ ID NO: 275765 - RNA, 64 nt, Human
gucagaaguuacucucaucagucguucauggucacaaccugagguacucugcugagugggcaag

SEQ ID NO: 275766 - RNA, 64 nt, Human
agggagcuuuuggugguagauccccuggugucuccaaccugacuagguggacagagcucaaaga

SEQ ID NO: 275767 - RNA, 64 nt, Human
caaguggcagagaaagggucccaagugcuggucccaaccugaagcuguggagugacuagaucac

SEQ ID NO: 275768 - RNA, 64 nt, Human
gacuuccccucaacaugcugccccaguuaaucagcaaccugacucagguaacccuggguagggc

SEQ ID NO: 275769 - RNA, 64 nt, Human
aaagaaacuuaccaauugauguuuuacgugcaaacaaccugaaucuuuuuuuuauauaaauaua

SEQ ID NO: 275770 - RNA, 64 nt, Human
acgggcagauaaccugaggucaggauuucgagaccaaccugaccuacauggagaaacuccgccu

SEQ ID NO: 275771 - RNA, 64 nt, Human
gaauuccugggguggacuuugcaaacacauucuacaaccugaugguuuuuacugcucaaacugu

SEQ ID NO: 275772 - RNA, 64 nt, Human
aaaauugaaugcuaugcuuagauuagggguuuugcaaccugaggucuauaaacaaagucuuccu

SEQ ID NO: 275773 - RNA, 64 nt, Human
accagacuacuugggagcaccgccugugaaauaccaaccugaagacaccguucauucaggcaac

SEQ ID NO: 275774 - RNA, 64 nt, Human
aucgcgucucuugugucucacucacggaaagaaacaaccugaaggccaucccgucggucugcac

SEQ ID NO: 275775 - RNA, 64 nt, Human
gaagaaguagcacguaauggcuuuuaucuaccaucaaccugauaaggcacaugugaaauggaaa

SEQ ID NO: 275776 - RNA, 62 nt, Human
cauccacaccccagggugagcuggagcuccaggcuggccaggcugaaccucgcacacacgca

SEQ ID NO: 275777 - RNA, 62 nt, Human
agcuucuauuccuuggccauugucaacggagagcuggccaagucuucacaaacccuugcaac

SEQ ID NO: 275778 - RNA, 62 nt, Human
gcauucgcacugggggacaugggaggggucuagcuggccacugcuggaggcagcgcuggucg

SEQ ID NO: 275779 - RNA, 62 nt, Human
augccuuuggccuggagauggcagaagugaaagcuggccaucugcaaaaagcagauaaguga

SEQ ID NO: 275780 - RNA, 64 nt, Human
gggaguuccccccuccgagcccuccuucccggcccaaccugagggauguggauuugggacuguc

SEQ ID NO: 275781 - RNA, 64 nt, Human
uaucuugccagacauaagaagaugaaugguagagcaaccugaaggauuuagaaauuacauauaa

SEQ ID NO: 275782 - RNA, 64 nt, Human
gggaccugugugucugacccucccaccagucaugcaaccugagauuuuauuuauaaauuagcca

SEQ ID NO: 275783 - RNA, 64 nt, Human
gauaauucugagccuugagaggaauguggucaggcaaccugaguccaguggaaugcaggugcaa

SEQ ID NO: 275784 - RNA, 64 nt, Human
ccucacacaccuguugucagcaucgagccaacaccaaccugacaagguucggagugaugggggc

SEQ ID NO: 275785 - RNA, 64 nt, Human
ugggggcugcgcuagcugggcuggcauucccucccaaccugaacugcuccucagagccaucucc

SEQ ID NO: 275786 - RNA, 64 nt, Human
cacccagccucugagagcaguuacuggggucacccaaccugacuuccucugccacucccugcug

SEQ ID NO: 275787 - RNA, 64 nt, Human
gucucccagauguugcaucccugaaacaucucaacaaccugaaugucccaacccagacaauggc

SEQ ID NO: 275788 - RNA, 64 nt, Human
gagguuucucaaaaaggcuacuguuugugacuuucaaccugaacuauggaucuguggcuauuuu

SEQ ID NO: 275789 - RNA, 64 nt, Human
ccugagccccaggagcacugcagcccgagacuuccaaccugaguggcggagaagcugggacccu

SEQ ID NO: 275790 - RNA, 64 nt, Human
uuaauugcagcaaaaaccgcaauuacuuuugcuccaaccugacagcuagguaucuagcuagcua

SEQ ID NO: 275791 - RNA, 64 nt, Human
gaaaauuuguuccuggucuaauuuggcacccuuccaaccugaguauuguaggggaaggaaauuu

SEQ ID NO: 275792 - RNA, 64 nt, Human
gugagaaggcaaccaaagugcaggacaucaaaaacaaccugaaagaggcgauugaaguacgugc

SEQ ID NO: 275793 - RNA, 64 nt, Human
uucauggcagugcaagauugcaaaaaugacugugcaaccugaaacccaggaaagcagucuccau

SEQ ID NO: 275794 - RNA, 62 nt, Human
ucuggccagagguuaaagagcaggcugacauggcuggccauuaagcuuuauaaaaucaugug

SEQ ID NO: 275795 - RNA, 62 nt, Human
ggcagaucaugaggucaggaguuugagaccaggcuggccaacguggugaaaccccgucucua

SEQ ID NO: 275796 - RNA, 62 nt, Human
ucauacacagaaucaggaccagcaugugcagagcuggccaccagcacaggcuuagggcaguu

SEQ ID NO: 275797 - RNA, 62 nt, Human
uuguuuauuuuguaaaaaagaaaugaaaaucugcuggccagcuauguccucuaggaaaugac

SEQ ID NO: 275798 - RNA, 64 nt, Human
cagugcuugccaauuucucuaguguaauaacucccaaccugaccaauuucacacugccaacagu

SEQ ID NO: 275799 - RNA, 64 nt, Human
uccccagaccccaacucacugcaguucaucugaacaaccugagcuccugggccgggguggaagg

SEQ ID NO: 275800 - RNA, 62 nt, Human
uacccugaagcuuuugucaaauaaacugcuacaucaaccugagggcucugcauauuuuuuuu

SEQ ID NO: 275801 - RNA, 64 nt, Human
cuuuugcacacgcaccuggaaaagacacagaagccaaccugagaaccccuggugcuauuuuaaa

SEQ ID NO: 275802 - RNA, 64 nt, Human
uacuggguaaucagccaaguucauuuucuggcuccaaccugacauugaaugaugacuggaauaa

SEQ ID NO: 275803 - RNA, 64 nt, Human
caccacuggcuaaaacuggacacauccugccuggcaaccugauuuucuaaucacauuccucuca

SEQ ID NO: 275804 - RNA, 64 nt, Human
cacuuuuuaccuaugggaggcaguccccagauuucaaccugaauugugaaaugugucauaagaa

SEQ ID NO: 275805 - RNA, 64 nt, Human
uccgagccccaggcagcggugauucagcccugcccaaccugauucugaugacugcggaugcugu

SEQ ID NO: 275806 - RNA, 64 nt, Human
cgccagcuuccugcuccacucagcuccguccagucaaccugaacccacccaguccagcugucug

SEQ ID NO: 275807 - RNA, 64 nt, Human
caagugaagacgaggccaaggcugaaaccauccgcaaccugaggaagucuuuugccagccuguu

SEQ ID NO: 275808 - RNA, 64 nt, Human
cucacuauaguguggcuuuagaauauaucaaguacaaccugaauggacuuuuugauuuuacauu

SEQ ID NO: 275809 - RNA, 64 nt, Human
gugguacuuaagcuccccugccuuaaccugggaccaaccugaccuaaccuaggagggcucugag

SEQ ID NO: 275810 - RNA, 64 nt, Human
uccacuuuuugagugguacuuaaauguaaaguaacaaccugaauugagucauugcuuucugaag

SEQ ID NO: 275811 - RNA, 64 nt, Human
cuguucaaacauguuuuugaauauacauucuauaaaagauuauuugaaagacaaaauucauaga

SEQ ID NO: 275812 - RNA, 62 nt, Human
agucagggucccaagaucccaccuguauggucgcuggccagugauucuccuucugagccgug

SEQ ID NO: 275813 - RNA, 62 nt, Human
cugacugggggcaggggaagagacagggcacagcuggccacagggcucagccacugagcagg

SEQ ID NO: 275814 - RNA, 62 nt, Human
uugggcccggggccaugcccgggcugugcaaagcuggccagggccuccuguagggcuccucu

SEQ ID NO: 275815 - RNA, 62 nt, Human
cgagcuccgggcucagaccaacuccaaggucagcuggccacaggcccaggccuccucugaag

SEQ ID NO: 275816 - RNA, 64 nt, Human
ggcaucauacuaaaagcaauguuuaaaucaaacuaaagauuaaaaauuaaaauucguuuuugca

SEQ ID NO: 275817 - RNA, 64 nt, Human
guaugggacuaucuuuuuuuccuccucuaagcccaaagauuaacuagagucccuccaaccuuau

SEQ ID NO: 275818 - RNA, 64 nt, Human
agauuagucacauaguugccuaaauaggagagagaaagauuauauaugcacauauacaaagaca

SEQ ID NO: 275819 - RNA, 64 nt, Human
cucuuugucaaagauggucuguagaaauguuuuuaaagauuagggaugcuguacuuuuugaauu

SEQ ID NO: 275820 - RNA, 64 nt, Human
aucuuuaauuuuacuccuuccucuuauuuuuuuaaaagauuaucgaacaauaaaaucauuugcc

SEQ ID NO: 275821 - RNA, 64 nt, Human
uauugucuccauaauugagugauagcuuuaaaaaaaagauuaguuuugcuuaagaaguuauguu

SEQ ID NO: 275822 - RNA, 64 nt, Human
uugugugaguauauugugcuaaaaucauagaaauaaagauuagauuucuucaucaaaauuggaa

SEQ ID NO: 275823 - RNA, 64 nt, Human
cauuucacuuaucagagauuuuuauauuuauacaaaagauuacuaaaugaaggauugcuaaaug

SEQ ID NO: 275824 - RNA, 64 nt, Human
ucauacgaaccaucuuuccuagugcaugagaaauaaagauuauuuaaguaaugaggcagguggg

SEQ ID NO: 275825 - RNA, 64 nt, Human
gcaguuugccuuuauaaaaacuugcugccugacuaaagauuaacagguuauaguuuaaauuugu

SEQ ID NO: 275826 - RNA, 64 nt, Human
uauuaugagauacuggcauugaugagcuuugccuaaagauuaguaugaauuuucaguaauacac

SEQ ID NO: 275827 - RNA, 64 nt, Human
cuauaugccuauauuuauaaaccagcagcaggggaaagauuauauuuuauaagagggaacaaau

SEQ ID NO: 275828 - RNA, 64 nt, Human
cuugguuaaaaaauauauugcuuuguuaaguauuaaagauuauuuguaagucauuguauuaaua

SEQ ID NO: 275829 - RNA, 64 nt, Human
augaggugauuaggugaagucucugcccucaugaaaagauuaaucccauuaucucaggagugug

SEQ ID NO: 275830 - RNA, 62 nt, Human
cuuggaauuaaauauuguaagauauguauaaugcuggccauuuuaaagggguuuucucaaaa

SEQ ID NO: 275831 - RNA, 62 nt, Human
cagggccccugugggcacuagguguaaaaggugcuggccaaaugguucagggugaagagggc

SEQ ID NO: 275832 - RNA, 62 nt, Human
gcaugugcccagcaauguggcuccuuggccccgcuggccaguguccugggccccugacaggc

SEQ ID NO: 275833 - RNA, 62 nt, Human
ggguggucacaccccugagccuucagcacugugcuggccaccccggccucugaguaagacuc

SEQ ID NO: 275834 - RNA, 64 nt, Human
ggggcaguugugaggccacagagugccuugacacaaagauuacauuuuucagacccccacuccu

SEQ ID NO: 275835 - RNA, 64 nt, Human
uauuuuauuuauuacacuggagcaguuacuucccaaagauuauucugaacaucuaacaggacau

SEQ ID NO: 275836 - RNA, 64 nt, Human
agccucuuaauugcucuaacaagaugaguggggaaaagauuauacucuuaagaaauuccuacga

SEQ ID NO: 275837 - RNA, 64 nt, Human
aaguauccagagauacuacaauauuaacauaagaaaagauuauauauuauuucugaaucgagau

SEQ ID NO: 275838 - RNA, 64 nt, Human
uuguaaagaaaguggcuugaaaucuuuuuuguucaaagauuaaugccaacucuuaagauuauuc

SEQ ID NO: 275839 - RNA, 64 nt, Human
aguaaauaaaauuaacaaauuucuuuguuuaacaaaagauuaaucuuuaaaccacuaaaauaca

SEQ ID NO: 275840 - RNA, 64 nt, Human
uuuugagaaucuagauacuggguuuuauuuuuugaaagauuagcucuguuuguaagggcugauu

SEQ ID NO: 275841 - RNA, 64 nt, Human
ccaugaaaucaccaaucaaggccuccguucuucuaaagauuaguccaucaucauuagcaacuga

SEQ ID NO: 275842 - RNA, 64 nt, Human
uugggauucuaauguuuuauuuucaugcuuauccaaagauuacuauuguaucuucaaaugaauu

SEQ ID NO: 275843 - RNA, 64 nt, Human
gcgcaaacaacuccaggacaaggcaggacaugauaaagauuauaaagcagguccaaggaaagug

SEQ ID NO: 275844 - RNA, 64 nt, Human
uuacaguaauuauuuugcguauacguaacugcucaaagauuaugaaucuuaugaauguuaaccu

SEQ ID NO: 275845 - RNA, 64 nt, Human
cuaggaagguaaauccaguaucagaagguugcuaaaagauuaaagaucaagaagcuuggaaaca

SEQ ID NO: 275846 - RNA, 64 nt, Human
aauaaaugacaagugagacaaaaagcacuaguauaaagauuauauaaagaccuauaaaucauua

SEQ ID NO: 275847 - RNA, 64 nt, Human
guuuuguuuuaaucuuagcuuuuaauagugucauaaagauuauaauaugugccuuaaguuuuag

SEQ ID NO: 275848 - RNA, 62 nt, Human
uggcuccuccagagggccccucagagccaggugcuggccagaugccuugaucacagccucca

SEQ ID NO: 275849 - RNA, 62 nt, Human
aacaguuccccacccagcgauuagggagcugggcuggccaguacagccaguggggagugggu

SEQ ID NO: 275850 - RNA, 62 nt, Human
ggucuagcugaguucuagaacuucucucuuuagcuggccaucugaauacucccccaucacua

SEQ ID NO: 275851 - RNA, 62 nt, Human
cugggcuagaaggcaggggaccuuggcauguggcuggccacaccaagcaggaagcacaaacu

SEQ ID NO: 275852 - RNA, 64 nt, Human
ugcgacuggaaacuuuccuuucuguugugaaaauaaagauuauauuagaauccaaauaaacccu

SEQ ID NO: 275853 - RNA, 64 nt, Human
aaauguacuguuaauggguuuuuuuuaaaaauuaaaagauuaaauaaaaaauauuaaauaaaac

SEQ ID NO: 275854 - RNA, 64 nt, Human
uauuccccacaauccuguucucuaaaugucaaauaaagauuauuuucacuagauucaacuuuac

SEQ ID NO: 275855 - RNA, 64 nt, Human
cauuaauguugaaaauggaagagacuugcuuccaaaagauuaaaaggaguuguucuuuucuccu

SEQ ID NO: 275856 - RNA, 64 nt, Human
acagaaauaaaacuguaaagugcaaugugaaaucaaagauuauagucauuguauaauuuggcuu

SEQ ID NO: 275857 - RNA, 64 nt, Human
cauaauauuugaagugcacauuuuugugauuuuuaaagauuauuuagugcuaacuuuuaauggu

SEQ ID NO: 275858 - RNA, 64 nt, Human
uucuauaagauuauuuauauauguaaguguuuaaaaagauuauuuuccagaaaguuugugcagg

SEQ ID NO: 275859 - RNA, 64 nt, Human
uacaugaagugcacaucugggaacuuguaaguggaaagauuauugccacccugcacaucaagua

SEQ ID NO: 275860 - RNA, 64 nt, Human
ugcacuucucuuaauaauucucuccccucaaaagaaagauuaugauaaagaauaauuuggagua

SEQ ID NO: 275861 - RNA, 64 nt, Human
uaggggauuuuuuugaugugccuuaaauuauaccaaagauuacuaauuauuccucuuugcccaa

SEQ ID NO: 275862 - RNA, 64 nt, Human
uaugauaauaaaauacauuugucuauaaucguuuaaagauuagcuuugcaugauccuuuaugca

SEQ ID NO: 275863 - RNA, 64 nt, Human
uuuggucucucauuuuagguuaaaugauaacuagaaagauuaaacuagacagauaguuuaggug

SEQ ID NO: 275864 - RNA, 64 nt, Human
aguuaagcucauaaaauuucauuguuuucauuuaaaagauuaacguuauugauacuuggauaac

SEQ ID NO: 275865 - RNA, 64 nt, Human
auacuuaaauuacuugugaaaaacaacacauuuuaaagauuacgugcuucuugguacagguuug

SEQ ID NO: 275866 - RNA, 62 nt, Human
ugcccccucccucggguuggguggcccagccagcuggccagccuccacucccacucugccag

SEQ ID NO: 275867 - RNA, 62 nt, Human
uacugcccuccccuuccccuuuacucagcccagcuggccaccuagaagucucccugcacagc

SEQ ID NO: 275868 - RNA, 62 nt, Human
cuaaauuugggacucuuugcugcgggaguuuggcuggccaggaacuugagugacauugaccu

SEQ ID NO: 275869 - RNA, 62 nt, Human
cugcugcuggcuuuucagucagaggguugggggcuggccagccaagcugccuugcccuggcc

SEQ ID NO: 275870 - RNA, 64 nt, Human
uaaaguagaaauaaauauguauuccauguuuuuaaaagauuacuuucuacuuuguguuucacag

SEQ ID NO: 275871 - RNA, 64 nt, Human
uaacugucaagacacugguagaacagaacaagcaaaagauuaagaguucaaaaguaaaugcaac

SEQ ID NO: 275872 - RNA, 64 nt, Human
uuuuaggcuuuuuaaucugauuuucuuauaaaugaaagauuauuuagucaccuuucuccugucc

SEQ ID NO: 275873 - RNA, 64 nt, Human
guaauauucugagcacgggcaaagaaaacacacaaaagauuauguauuggcauuuauuuaugug

SEQ ID NO: 275874 - RNA, 64 nt, Human
gcugcagguucucucucacugccaucaaacuguaaaagauuaaacugcgaagucaagcucaaca

SEQ ID NO: 275875 - RNA, 64 nt, Human
aauucuuuuauauucuaacaauaaauaaaaaagaaaagauuacugacugugcauuguaccugua

SEQ ID NO: 275876 - RNA, 64 nt, Human
cuaccacauuucacuuuaguguaccuauuuacagaaagauuaaacugccaccugcgggcacauu

SEQ ID NO: 275877 - RNA, 64 nt, Human
uauuuggggacaaaaaaauauuucaagaguugauaaagauuaccugugcagugcagagcacuuu

SEQ ID NO: 275878 - RNA, 64 nt, Human
gagcaguacauauucaaauguauucagaaagucaaaagauuaccuaucguucuacaauaaaaua

SEQ ID NO: 275879 - RNA, 64 nt, Human
uaugguauuuucgugcauuugugagccaaagagaaaagauuaaaauuagugagauuuguauuua

SEQ ID NO: 275880 - RNA, 64 nt, Human
uccuaaaguuuauaaaacauuguuuagguuacauaaagauuaccaaguaagacucaaaauugca

SEQ ID NO: 275881 - RNA, 64 nt, Human
uuccuaagaaucagaguagaaauaaaagugaaugaaagauuaaacagaugaugagaauuucuaa

SEQ ID NO: 275882 - RNA, 64 nt, Human
aaugaaagauuaaacagaugaugagaauuucuaaaaagauuagcaaggucauuucuucagucag

SEQ ID NO: 275883 - RNA, 64 nt, Human
ggaaggauaaaucaaggcucaaggcuuccccagcaaagauuagggaaagagacuugaccccagg

SEQ ID NO: 275884 - RNA, 62 nt, Human
acauccccgccacagacacggaggccccgccugcuggccagcuguggccgccauaggggagc

SEQ ID NO: 275885 - RNA, 62 nt, Human
cacaccugcgcagcccuggcugaggucacuaggcuggccagaggcaggacaggcagucuuga

SEQ ID NO: 275886 - RNA, 62 nt, Human
agcugguuccucccugggagggcaacuucagggcuggccaccccccguguuccccauccuca

SEQ ID NO: 275887 - RNA, 62 nt, Human
gcaucucuccccugcuccagcgcaucucccgggcuggccaccuccuugaccagcauaucugu

SEQ ID NO: 275888 - RNA, 64 nt, Human
cuuuuuuuaaaggacugucaauauacaaaacuuuaaagauuaaaaacauuaaaaauaaaaccau

SEQ ID NO: 275889 - RNA, 64 nt, Human
gccaaccacaauuccuagaguuaagagaaccuuaaaagauuaccgcucaugcuaaaaguaugua

SEQ ID NO: 275890 - RNA, 64 nt, Human
agaaaaaaaaaaaagguacuuagaggucgcacuuaaagauuaugcacaucagcagaggaaaggc

SEQ ID NO: 275891 - RNA, 64 nt, Human
aacucugaaaaccuugaacacggccaaaauccauaaagauuauaaaagcaaacuaaguugugaa

SEQ ID NO: 275892 - RNA, 64 nt, Human
cccucuugguaauuuguccuucuauagaagcuucaaagauuaaaucaaauuaauuuucaaaaaa

SEQ ID NO: 275893 - RNA, 64 nt, Human
uuagccuagauacauggauucuuuucaaaucaggaaagauuagaaaaggaacccaaaaaacccu

SEQ ID NO: 275894 - RNA, 64 nt, Human
uaaugauguauauuuuucaaauuuaccuaaacagaaagauuauuggcuaaggcaggcggaucau

SEQ ID NO: 275895 - RNA, 64 nt, Human
auuugcuaguucuuccuuguagaguuauaaauggaaagauuacacuaucugauuaauaguuucu

SEQ ID NO: 275896 - RNA, 64 nt, Human
auguaaaaguucacaguuaaagacugaauuacagaaagauuaaaauauauacauauauaaauac

SEQ ID NO: 275897 - RNA, 64 nt, Human
uguuugaagcccuagaggugucucuaaucacuagaaagauuaaugacccuuuugcuuuuggguu

SEQ ID NO: 275898 - RNA, 64 nt, Human
uguuauagaagagccuucuguagaccauauagaaaaagauuauagaggaggagaaucuacugcu

SEQ ID NO: 275899 - RNA, 64 nt, Human
cucaugauuauuauuuuagugggggcggggugggaaagauuacuuuuucuuuauguguuugacg

SEQ ID NO: 275900 - RNA, 64 nt, Human
cuauugaaaauuaaaaagacauuuuguuuauguaaaagauuaacagaacuuaaagauaaucacu

SEQ ID NO: 275901 - RNA, 64 nt, Human
aagaggagacccccaggcagaggggcguucucccaaagauuaggucguuuuccaaagagccgcg

SEQ ID NO: 275902 - RNA, 62 nt, Human
gguggccuccccgcacucggcagcauggccaggcuggccagggcgugggcaggugguguccu

SEQ ID NO: 275903 - RNA, 62 nt, Human
uuggauccccggcugccccgggcaugaguguggcuggccaugggcacugggcucgccuugca

SEQ ID NO: 275904 - RNA, 62 nt, Human
agccaguccaggagugagaccggccagaugaggcuggccaagccggggagcugcucucucau

SEQ ID NO: 275905 - RNA, 62 nt, Human
uggggagggcacucucccaugcccuuggccucgcuggccacauuggccaaugagccagggcu

SEQ ID NO: 275906 - RNA, 64 nt, Human
aaguguucuauguuaagaguuguguuuaauuucuaaagauuaaaaaaagcaaaaaaauuggugc

SEQ ID NO: 275907 - RNA, 64 nt, Human
uguuaaugagcauuaauguuuucugaacacuuccaaagauuaaucaaacauaaauauucauugu

SEQ ID NO: 275908 - RNA, 64 nt, Human
uacuauaaauauauuguauauuuguaaauuuuggaaagauuauccuguuacugaauuugcuaau

SEQ ID NO: 275909 - RNA, 64 nt, Human
auguaaaccggaauccucucuauacaaguuuauuaaagauuauuuuuauuaccguacauauuuc

SEQ ID NO: 275910 - RNA, 64 nt, Human
cccauguguuuguagacacacaugcauacuguccaaagauuaggguuggugguggcagugcagc

SEQ ID NO: 275911 - RNA, 64 nt, Human
uaacgaaaaugcaaagcagaaagcagucuguaauaaagauuaaaauaaugccgugggagcaaag

SEQ ID NO: 275912 - RNA, 64 nt, Human
guacuuuuaaauuauacaaugauauccaauauuaaaagauuauaggaacugagguuuacauacg

SEQ ID NO: 275913 - RNA, 64 nt, Human
aauuucccuuauucagguuucugugggaaaaaugaaagauuaaccuuccccacuggugaugacc

SEQ ID NO: 275914 - RNA, 64 nt, Human
ucggaaacuccccuaugcacuugaagaugguuuaaaagauuaaagaaacgauuaagagaaaagg

SEQ ID NO: 275915 - RNA, 64 nt, Human
cucuaaaaacaugccaccaguguaugaauaagggaaagauuaauuuuggcuggaccaauauaaa

SEQ ID NO: 275916 - RNA, 64 nt, Human
uacaaagacauucuaacucaguuccaguaugaagaaagauuauucacucuagcuccacugagaa

SEQ ID NO: 275917 - RNA, 64 nt, Human
uugcacaauuugagaaccagcccauuucauaauaaaagauuaauguugggcuuguuguuaauau

SEQ ID NO: 275918 - RNA, 64 nt, Human
aaugacagaaggaugcacuauauucauggguaggaaagauuaguuucaucaagauuucaauuuu

SEQ ID NO: 275919 - RNA, 64 nt, Human
uacucuacuucuaagaaaauaauuagaaguagacaaagauuaaugaaagggauguucaugacag

SEQ ID NO: 275920 - RNA, 62 nt, Human
gggggccggcacugcugcuuagaguggaggaggcuggccaaagagacugugggcuguuuuca

SEQ ID NO: 275921 - RNA, 62 nt, Human
uugcagaacuguccugagaaguuauugcuggugcuggccagccauggcuuaggacuccaaca

SEQ ID NO: 275922 - RNA, 62 nt, Human
uaccaacgucgguaacuugagcagucccuguugcuggccagagacugccuggucgccagcgc

SEQ ID NO: 275923 - RNA, 62 nt, Human
uguuaauauuaauguucauguuaauguccuaagcuggccauuaacaugaacuacgucacuuu

SEQ ID NO: 275924 - RNA, 64 nt, Human
ucuuacgcuagagguccaaagcugccucuguuuuaaagauuaucccaauguggaagaugcccau

SEQ ID NO: 275925 - RNA, 64 nt, Human
cuagcugcaggauguaacauggaaaacaguaacuaaagauuaaauucaaaggacuuucagaagu

SEQ ID NO: 275926 - RNA, 64 nt, Human
ucugaucaagauaacguguauaaaaaaucagugaaaagauuaagauguggcaaaugccugacca

SEQ ID NO: 275927 - RNA, 64 nt, Human
agaagaacagaccgauuugaaagauucaagggagaaagauuaaggaucaggauugcaugaaaga

SEQ ID NO: 275928 - RNA, 64 nt, Human
ucucaguauugucaggggaacagagaaguugggaaaagauuacugaaauauaccuuuugcauuu

SEQ ID NO: 275929 - RNA, 64 nt, Human
ccuagauuuuaagcaguaaauaaaacauuucgcaaaagauuaaaguugaauuuuacaguucgua

SEQ ID NO: 275930 - RNA, 64 nt, Human
uuaauaucugagaaguguauauaguuugugguaaaaagauuauauaucauaaaguaugccuucc

SEQ ID NO: 275931 - RNA, 64 nt, Human
aaacagauggauagcuuugagguuuuagauaaggaaagauuauggagaauguaguuguuauuga

SEQ ID NO: 275932 - RNA, 64 nt, Human
guguuaaaucauuucaggguuuaauuuugaaauaaaagauuaauauaaaaugcaacaacuuuuu

SEQ ID NO: 275933 - RNA, 64 nt, Human
aaccuuucuuuucaguuacucuuuuucaagaaugaaagauuauuauacaaaaaauuguauacua

SEQ ID NO: 275934 - RNA, 64 nt, Human
acauuucuaagcuacagcguacuccaggagaagaaaagauuaauaccuuaaaagaagaaaacac

SEQ ID NO: 275935 - RNA, 64 nt, Human
aaaugaaaguuuuaguaaaaaaaauacaaaacaaaaagauuaaauugcuauugcuguaguaaga

SEQ ID NO: 275936 - RNA, 64 nt, Human
uugcuucugaaggcccauucauuagaccacuuguaaagauuacuccaacccaguuuuuauaucu

SEQ ID NO: 275937 - RNA, 64 nt, Human
uccagauuucuagguuuggguuuuucuaaaaauaaaagauuacauuuacuucuuuuacuuuuua

SEQ ID NO: 275938 - RNA, 62 nt, Human
auacacuucucccauuuuguaucagguguguugcuggccaggagcugauggcucacugggcu

SEQ ID NO: 275939 - RNA, 62 nt, Human
cugagccagaccuuaagcucuaugguuauuuagcuggccauucagguauaaggcaggguggu

SEQ ID NO: 275940 - RNA, 62 nt, Human
uccgaggcuuucccaggggcagucugugucacgcuggccauuugacauaaaggagacagccc

SEQ ID NO: 275941 - RNA, 62 nt, Human
ccccacucccuccaccaccacagcacaccggugcuggccacaccagcccccuuucaccucca

SEQ ID NO: 275942 - RNA, 64 nt, Human
uugcagucuugcagcuuuuauucccugugcaacaaaagauuagaacauguuaaagggauuuuua

SEQ ID NO: 275943 - RNA, 64 nt, Human
cucacuacccuguuucagaugcauuuggaauaccaaagauuaaauccuugacauaagaucucau

SEQ ID NO: 275944 - RNA, 64 nt, Human
augaaaagaaacaagauuguuugggauuggaaguaaagauuaaaaccaaaagaauuuguguuug

SEQ ID NO: 275945 - RNA, 64 nt, Human
aguuugagcacaggguuaauuauucauuugugguaaagauuauagcaucuauuuugaucagugg

SEQ ID NO: 275946 - RNA, 64 nt, Human
ugaacguaugguagauuuuuauuuucuuggcacuaaagauuagcuuuuuuaaaaaaacauccca

SEQ ID NO: 275947 - RNA, 64 nt, Human
ugguuuuauuucaaagggaaacuuuaauccaaagaaagauuaauuacucuaacaaacaagagaa

SEQ ID NO: 275948 - RNA, 64 nt, Human
ugcucucuuacauuuuauuauccucguguacagaaaagauuauauaaaauuuaaauccacauag

SEQ ID NO: 275949 - RNA, 64 nt, Human
uuacuuaagcauaauagccacaauaggacauauaaaagauuauaaauacagagcuuuauuaucc

SEQ ID NO: 275950 - RNA, 64 nt, Human
auaccuuaccuaccucguaaaagucugaugaggaaaagauuaacuaauagaugcauagcacuua

SEQ ID NO: 275951 - RNA, 64 nt, Human
gcuuguugcaaugugguagaaaauucacgugcacaaagauuagcacacuuaaaagcaaaggaaa

SEQ ID NO: 275952 - RNA, 64 nt, Human
uaaaaaucgaugaaucauuugugaugcuuuuaacaaagauuaaaugaauuugaucagcuuuugc

SEQ ID NO: 275953 - RNA, 64 nt, Human
cugaggucacauggguuuggacugucucaaucagaaagauuaaugacuguuaucaagaacauga

SEQ ID NO: 275954 - RNA, 64 nt, Human
auauuaccucaacauaaaauacuuguuuuguaauaaagauuauaauacccagaagaaauaugug

SEQ ID NO: 275955 - RNA, 64 nt, Human
agaagauaaaaaugcuugaagagccugagaguaaaaagauuaugcugcaaagcuaugauauaaa

SEQ ID NO: 275956 - RNA, 62 nt, Human
cacagagagucccacugccucagguuccuauggcuggccacugcacagagcucuccagcucc

SEQ ID NO: 275957 - RNA, 62 nt, Human
cccugagagacccugagaccuggggcacccuggcuggccaggucagaagcauccugacugca

SEQ ID NO: 275958 - RNA, 62 nt, Human
cucugcagcaagcagggcuucaggaggugcccgcuggccacagccagguuuucccuaagaag

SEQ ID NO: 275959 - RNA, 62 nt, Human
gacagugccacacuccuucaauaaacguggcugcuggccagaggacgugagcgugugacggg

SEQ ID NO: 275960 - RNA, 64 nt, Human
auaagguuaguacaagaucaguagagagaaagucaaagauuacagaagugcugaagcagaccau

SEQ ID NO: 275961 - RNA, 64 nt, Human
caggagauuccaugucuuucucauauuucagaggaaagauuauaaaauauaaaauuucuuagag

SEQ ID NO: 275962 - RNA, 64 nt, Human
acucauuuaccagaauucauuggaagaaaucaccaaagauuauuacaaaagaaaaauauguugc

SEQ ID NO: 275963 - RNA, 64 nt, Human
auaaauaaauaaauacacauuuuggccuauuagcaaagauuaagaaaugauaacauuaaauacu

SEQ ID NO: 275964 - RNA, 64 nt, Human
uccauuuuaugcagaagcauauuuugcugguuugaaagauuaugaugcauacaguuuucuagca

SEQ ID NO: 275965 - RNA, 64 nt, Human
ugcauuuugagcuuuaucucuaaaugugacaugcaaagauuauuccugguaaaggagguagcug

SEQ ID NO: 275966 - RNA, 64 nt, Human
augcauauuacuggauuagauuaagaaagacagaaaagauuaagggacgggcacauuuuucaac

SEQ ID NO: 275967 - RNA, 64 nt, Human
agugauugaaggguccuaaaaagggaaaauauauaaagauuauuucaugauuggguaguaaaac

SEQ ID NO: 275968 - RNA, 64 nt, Human
uggaugaauauucuuaauuccauuuccugagguaaaagauuagugugagaccaucauggugcca

SEQ ID NO: 275969 - RNA, 64 nt, Human
guuaaguagcuuaaugauuaggcaaacuagaugaaaagauuaggggcuuccacacugcauagau

SEQ ID NO: 275970 - RNA, 64 nt, Human
uauauaguuuauuuuuuccaugugcuagccagguaaagauuacacaguucuucuggacuguuaa

SEQ ID NO: 275971 - RNA, 64 nt, Human
aacuaaaccuguaaaauuaugaugauuguauucaaaagauuaaugaaaaauaaacauuucuguc

SEQ ID NO: 275972 - RNA, 64 nt, Human
uggcauguuguuugauuucuuuggcaauuuuuuuaaagauuauuuguaguuuacuuuccaucua

SEQ ID NO: 275973 - RNA, 64 nt, Human
ugugacuuguggcgucuuauaaauaaugcacuguaaagauuacugaauaguugugucauguuaa

SEQ ID NO: 275974 - RNA, 62 nt, Human
ggcacggcuggggccgcucugugcuggcgccugcuggccacugagggacagggacacgugcc

SEQ ID NO: 275975 - RNA, 62 nt, Human
auggauuuccuuaauucaaagaucauauuuuagcuggccacaaaaccaagaacauaucuagc

SEQ ID NO: 275976 - RNA, 62 nt, Human
uuaccugcugcugcccauuuucucuggguacugcuggccagaggacuuuagccuaccccuga

SEQ ID NO: 275977 - RNA, 62 nt, Human
ggguguggugguggaguggggagcuggcuucugcuggccaggauagcuuaacccugacuuug

SEQ ID NO: 275978 - RNA, 64 nt, Human
cuacuggggcaaugaaugcuuuuaggcaguaaucaaagauuaaauggacccaugauacucuucu

SEQ ID NO: 275979 - RNA, 64 nt, Human
uuggcaggaagaaaugaacacugguauuagacuuaaagauuaaauuuccucaaacauguccuau

SEQ ID NO: 275980 - RNA, 64 nt, Human
aguaccuguguugagaaaaggcuuucuuuauccuaaagauuauuaccuuuuuaaagugcucuua

SEQ ID NO: 275981 - RNA, 64 nt, Human
aaaguauuuagcaaaucguaaacauggauugaaaaaagauuaaaaacaguugccaaaauaugac

SEQ ID NO: 275982 - RNA, 64 nt, Human
uaguauucucuucuccacacuuaauccaguuccuaaagauuauuauuauuauuauuauuauuau

SEQ ID NO: 275983 - RNA, 64 nt, Human
agcuuccagcacugaaucagaggccacacagcccaaagauuagcuucauguccauuauagcauu

SEQ ID NO: 275984 - RNA, 64 nt, Human
cuguuacaccucaaaauguguuacaugggaagaaaaagauuaagaaaaagcaagauaauuuuga

SEQ ID NO: 275985 - RNA, 64 nt, Human
aggucaguaagugcaacaugaaaaaaaucuaugaaaagauuauuugaccuaauuauucacugau

SEQ ID NO: 275986 - RNA, 64 nt, Human
aauacauacuauggauauaaauguaggcaaaaugaaagauuaugacuaauauucagauuccauu

SEQ ID NO: 275987 - RNA, 64 nt, Human
agaaauaaacccaauggcauguguuuacaggaagaaagauuaccuucagauacuugacauuaac

SEQ ID NO: 275988 - RNA, 64 nt, Human
guuuuaugguauuuugugagggaugcauuuuuuaaaagauuaauuuuggaaacagaaggagaag

SEQ ID NO: 275989 - RNA, 64 nt, Human
uaagccgaagaagccugggaaucaaguuugaaacaaagauuaauaaaguucuuugccuaguaua

SEQ ID NO: 275990 - RNA, 64 nt, Human
uuauuauaauccucaagagaaaauguguaauucaaaagauuaauguguauuaaaacacauuaug

SEQ ID NO: 275991 - RNA, 64 nt, Human
aaacuacaaaucuccuccucagggugauauuuuuaaagauuaaggaguaugacaucaauuaaca

SEQ ID NO: 275992 - RNA, 62 nt, Human
agacaacaccugccuggcuucuauuaaugugugcuggccaugauauugccccaaauccgccc

SEQ ID NO: 275993 - RNA, 53 nt, Human; identical to SEQ ID NO: 50700

SEQ ID NO: 275994 - RNA, 62 nt, Human
cugcugccugucucuagagccuucaucgucuggcuggccaacggggacacccuccgugucuu

SEQ ID NO: 275995 - RNA, 62 nt, Human
uuguauuuuuaguagauacgggguuucaccaugcuggccagacugaggucucgaacugccga

SEQ ID NO: 275996 - RNA, 64 nt, Human
uaaguuucaaggagacuaucaggauuauuauuuuaaagauuagauuuagucaaauaagucuuag

SEQ ID NO: 275997 - RNA, 64 nt, Human
ugcugauuuaugaaggaaaaaagaagaauuuucuaaagauuacacauauuucagaaagacuuua

SEQ ID NO: 275998 - RNA, 64 nt, Human
acuuucuaauaaguaaaauuucuaauuuugaauaaaagauuaaauuuuacugaaauauuuuauu

SEQ ID NO: 275999 - RNA, 64 nt, Human
aaacauguuagucaaggacugguaaaauacauauaaagauuaacacucauuuccaaucauacaa

SEQ ID NO: 276000 - RNA, 64 nt, Human
uauucuaguguaacacugcaagaagucuugagaaaaagauuauuguaguguucaaaauauuuuu

SEQ ID NO: 276001 - RNA, 64 nt, Human
uucuucagaacauaugacuuucauuucccagaaaaaagauuaaugguccugaguaggaauauua

SEQ ID NO: 276002 - RNA, 64 nt, Human
aacacuguguauuuauuuuauuuagacuaccagcaaagauuaaagcaugaaauguaaaacaucu

SEQ ID NO: 276003 - RNA, 64 nt, Human
cugaucauguauuuuggaauuagacuugauaauaaaagauuaucauguaucacauaucucacac

SEQ ID NO: 276004 - RNA, 64 nt, Human
uaaaauaggccgggaaaaaaaaaucuuugguaccaaagauuacacuuguguuucuacacagcaa

SEQ ID NO: 276005 - RNA, 64 nt, Human
uucccaagugagcuggcuuuuuuucuuagaaauuaaagauuaugaaagccacaaacuuuuuagu

SEQ ID NO: 276006 - RNA, 64 nt, Human
gccaguaccacaaaaacuguguuguauauaauguaaagauuaaaauggggaaauaaugagcauc

SEQ ID NO: 276007 - RNA, 64 nt, Human
gcuccugguuguuccucucaaaccugugcugaccaaagauuaguaaccaguuauacccaguauu

SEQ ID NO: 276008 - RNA, 64 nt, Human
ucaugucaguuggcccuuuaauauuuccaaugugaaagauuauuuaaaugcuuuuaaaucugca

SEQ ID NO: 276009 - RNA, 64 nt, Human
ggcgugagccaccacauccagccagugauccuuaaaagauuaagagaugacuggaccaggucua

SEQ ID NO: 276010 - RNA, 62 nt, Human
cccucucugauuccuccguguugugaugugaugcuggccacguuuccaaacggcagcuccac

SEQ ID NO: 276011 - RNA, 62 nt, Human
gaggucucauacaaggauauuuggagugaaaugcuggccaguacuuguucucccuugcccca

SEQ ID NO: 276012 - RNA, 62 nt, Human
guucuuuucccgccucccuaguuagcauccaggcuggccagugcugcccaugagcaagccua

SEQ ID NO: 276013 - RNA, 62 nt, Human
caucggcaguguuucuugagcucccaguaggggcuggccacggccaggugugggagggacuu

SEQ ID NO: 276014 - RNA, 64 nt, Human
ugaaaauauguuuugagaauaaaaacacagcagaaaagauuaaguacuacugccuaguugcuau

SEQ ID NO: 276015 - RNA, 64 nt, Human
agucuaguagugcacuguaauaauucauuuuuuaaaagauuauuuaaugcccauuucaaaauac

SEQ ID NO: 276016 - RNA, 64 nt, Human
aguugucaccauuaugucuuaagcuguuagucuuaaagauuauuguuaaaaaauucagaagaaa

SEQ ID NO: 276017 - RNA, 64 nt, Human
cuuuguuuuuaaaaguuauaacauggcugaaaagaaagauuaaaccuacuuucauauguauuaa

SEQ ID NO: 276018 - RNA, 64 nt, Human
auuugucauaaagcuaaauauuuuauauguuuucaaagauuauuuuuucauauuaauagguugu

SEQ ID NO: 276019 - RNA, 64 nt, Human
uucaaaacacuuucagauagaagucuuucuaugcaaagauuaaaguaugacuucaauucauauu

SEQ ID NO: 276020 - RNA, 64 nt, Human
uuuguguuauucuaucuuuuauucugcuaagcccaaagauuacauguugguguucaaaguguag

SEQ ID NO: 276021 - RNA, 64 nt, Human
ggagaugauaagugcuuuccccucuuuauuuaaaaaagauuaaaaggaauaaaagaaauaaugu

SEQ ID NO: 276022 - RNA, 64 nt, Human
ccacaggcagaaaagacuguuuacuccuugacccaaagauuaaaaaggauuuuuuauuauuuua

SEQ ID NO: 276023 - RNA, 64 nt, Human
guuggauacugaaugacagacaaucuuauguagcaaagauuaugccugaaaaggaaaauuauuc

SEQ ID NO: 276024 - RNA, 64 nt, Human
caguaggguucaagguggucccaaaaguuauauaaaagauuaguuuuuacuauaaacccuuguc

SEQ ID NO: 276025 - RNA, 64 nt, Human
aaaguagcuccuuuggagaggagauuaugaugugaaagauuaugccuaugugucuugcagauug

SEQ ID NO: 276026 - RNA, 64 nt, Human
augauuuaugguuguguuuucagaauucaacauuaaagauuaauguuuauuuaaacgaacacau

SEQ ID NO: 276027 - RNA, 64 nt, Human
auaguacgauguuugggguuguauauuuuguuaaaaagauuaaagaauuuaugaguuggcuugg

SEQ ID NO: 276028 - RNA, 62 nt, Human
acaaggugauguaaucagcuuguuguagugaugcuggccaaauggugcucagcaggugagaa

SEQ ID NO: 276029 - RNA, 62 nt, Human
gucgagugauuuuuagccucugaaaacucuaugcuggccacugauuccuuugagucucacaa

SEQ ID NO: 276030 - RNA, 62 nt, Human
gcaauauugcagauugagcaggcccuccagcugcuggccacagaggcuccuguucuucugcc

SEQ ID NO: 276031 - RNA, 62 nt, Human
uggccggccagccagccacucuaccagugcaggcuggccagccgcucuccugccacauuaga

SEQ ID NO: 276032 - RNA, 64 nt, Human
uuuuuauuauuguuuguccuuuauaaauuuucuuaaagauuaagaaaauuuaagaccccauuga

SEQ ID NO: 276033 - RNA, 64 nt, Human
uggacaagagugggaaaaaagagauccuuuucaaaaagauuauaacuggauagauuaagucaac

SEQ ID NO: 276034 - RNA, 64 nt, Human
auucugaaggcaccccaagguauaucuguaauuuaaagauuacugcaaauaucuuuacuuuacu

SEQ ID NO: 276035 - RNA, 64 nt, Human
ucugcauuggguauaaucuaagaauuguuuacaaaaagauuauuuuguauuuacccuucauucc

SEQ ID NO: 276036 - RNA, 64 nt, Human
acuguggucccuggcagccagucuuuugaaguuuaaagauuaccugucucuugacugcaguacc

SEQ ID NO: 276037 - RNA, 64 nt, Human
ugucuguaauuguaugauuuuuaaaucaucaucaaaagauuaaauuauguuuggguuagguuuu

SEQ ID NO: 276038 - RNA, 64 nt, Human
aagugauaggauaaaguuggccauguauuaugaaaaagauuauuugugcauuuuauugacuggg

SEQ ID NO: 276039 - RNA, 64 nt, Human
uuagugguaauuccuaguuacauucaacaaguauaaagauuauagagcuuauuuuaugaacuau

SEQ ID NO: 276040 - RNA, 64 nt, Human
uuuuccuggacaguuuucugcuuuaauuucaugaaaagauuaugaucucagaaauuguaucuua

SEQ ID NO: 276041 - RNA, 64 nt, Human
cagcacacguagauccaaaucuguggcaccugcuaaagauuaggauuuggagaggacuccucuu

SEQ ID NO: 276042 - RNA, 64 nt, Human
ucagcuuuuuuuucagccauucacaacacaaucaaaagauuaacaacacugcaugcggcaaacc

SEQ ID NO: 276043 - RNA, 64 nt, Human
cugaaacccugcacuuagcuagaaccucauuuuuaaagauuaacaacaggaaauaaauuguaaa

SEQ ID NO: 276044 - RNA, 64 nt, Human
uaaauaugaacuuaggaaauaaggagggaaguacaaagauuauugacuauacaaccuaccagcu

SEQ ID NO: 276045 - RNA, 64 nt, Human
uaaugggaaacuggaauuguuaauaauugcuccuaaagauuauaauuuuaaaagucacaggagg

SEQ ID NO: 276046 - RNA, 62 nt, Human
ggcaaagaggagcugcuccugccuccaugguugcuggccacucccaccaacuacucuuaggg

SEQ ID NO: 276047 - RNA, 62 nt, Human
uuccaagccgggcauccuugcgagccccccaagcuggccacagaugccacuacuucuguagc

SEQ ID NO: 276048 - RNA, 62 nt, Human
uaacaagucuucuuagaguuaaaggagggggugcuggccaagagccaacacauucuuggccc

SEQ ID NO: 276049 - RNA, 62 nt, Human
agaguccagccuagugagagcugagugaaggggcuggccaugccugagacaaaaagucaaau

SEQ ID NO: 276050 - RNA, 64 nt, Human
uuucaagaggugaacagauacaaccuuaaucuuaaaagauuauugcuuuuuaaaguguguaguu

SEQ ID NO: 276051 - RNA, 64 nt, Human
gaugugcuggaguggcuauuaaccuuuuuuuccuaaagauuauuguuaaauagauauugugguu

SEQ ID NO: 276052 - RNA, 64 nt, Human
uuacuuauuacuuaaaucagaggaaggauuuuauaaagauuaauaaauuuaauuuuaccaauaa

SEQ ID NO: 276053 - RNA, 64 nt, Human
ugagggaacagguggugucuaucuuguauaucagaaagauuaucuagggucuauccuagugaua

SEQ ID NO: 276054 - RNA, 64 nt, Human
aaaaacacuauuagucuuucuaacacacugagggaaagauuaaaaucuguggaauaaaggagga

SEQ ID NO: 276055 - RNA, 64 nt, Human
acauuuggauauucuaguuguauuguaaauuuuaaaagauuaucaggauaacaugaccuugccu

SEQ ID NO: 276056 - RNA, 64 nt, Human
cuaccuuguuuaguaucaaauucacgccaugcaaaaagauuauaaauguaauaagcauguaugu

SEQ ID NO: 276057 - RNA, 64 nt, Human
agccugggcaacauagcgagaccccaucucuacaaaagauuaaaaauuagcugcguguaguagc

SEQ ID NO: 276058 - RNA, 64 nt, Human
aaaacaaaacaaacaaacaaacaaaaaaguaaaaaaagauuacuuucgagagagaaguuuaagc

SEQ ID NO: 276059 - RNA, 64 nt, Human
cauagguagagcaaagaaaggguggauggauugaaaagauuagccucugucucgguggcagguu

SEQ ID NO: 276060 - RNA, 64 nt, Human
cuaguuuugcuuagugugaauucuggcacuuuaaaaagauuaagcaagugaaauucugcugccc

SEQ ID NO: 276061 - RNA, 64 nt, Human
caauauugauagugagagguaugucuauuauaauaaagauuauggcacaguaaaaccuguauuu

SEQ ID NO: 276062 - RNA, 64 nt, Human
guuuaauauugguugaacaagaaaucugacuuuaaaagauuauuaaggagaauauuccuuaacu

SEQ ID NO: 276063 - RNA, 64 nt, Human
gauuuuggaagaaaaucugacuguggauuaugacaaagauuaucuuuuuucuuaaguaaucuau

SEQ ID NO: 276064 - RNA, 62 nt, Human
cacaaacccacgagggcagagugcugcuugcugcuggccaggccccugcgugggcccaagcu

SEQ ID NO: 276065 - RNA, 62 nt, Human
caguagccaaugaggugcggggagggggccgggcuggccaaugggagcugcuuuccugaggg

SEQ ID NO: 276066 - RNA, 62 nt, Human
guguuaacagaagggagggcagagcuggugcggcuggccauggagaaagcugacuuggcugg

SEQ ID NO: 276067 - RNA, 62 nt, Human
caacagcagauguugcaaacuuucauaccacugcuggccauggaagccucuuaacaacacac

SEQ ID NO: 276068 - RNA, 64 nt, Human
ugcaauaauuuaaaaucauaaagggccaguguauaaagauuauaccagcauuaauagugaaaau

SEQ ID NO: 276069 - RNA, 64 nt, Human
caauuuuagccuuucucaguuuauuuuucugcaaaaagauuaaaaauuguacaugaagcucaug

SEQ ID NO: 276070 - RNA, 64 nt, Human
gaaaggcauuuuagugugguuuauguguaauauuaaagauuauucaacaccucucacaucuuac

SEQ ID NO: 276071 - RNA, 64 nt, Human
uuuccauguuuauuguguuaucagagugcauuagaaagauuagugauucaucuucacagcacau

SEQ ID NO: 276072 - RNA, 64 nt, Human
uuucccauuuggacuguaacugacugccuugcuaaaagauuauagaaguagcaaaaaguauuga

SEQ ID NO: 276073 - RNA, 64 nt, Human
gacaaaacagguuugccuuggcaucagagagcacaaagauuaaaaguuacuuuaaauuugccaa

SEQ ID NO: 276074 - RNA, 64 nt, Human
uuuucugaagauguaaccagaucuuuccaaauacaaagauuagauaaauugucuuauuguacuu

SEQ ID NO: 276075 - RNA, 64 nt, Human
uuaccaccaauauuucuucacaaaggaacuuuuaaaagauuaucucagaaaguaaaucugagag

SEQ ID NO: 276076 - RNA, 64 nt, Human
auuuuagaaaauuagaaaaucagucccaccacccaaagauuauugugcaugcugaaaagaguau

SEQ ID NO: 276077 - RNA, 64 nt, Human
auccuguuguuaggaagauagaaacuagguuuugaaagauuacaugauucaagcgagggauuuu

SEQ ID NO: 276078 - RNA, 64 nt, Human
aaugaaagacuucuuuguugauuuuuuaagauagaaagauuaaaaagaaagaaagaugggaaga

SEQ ID NO: 276079 - RNA, 64 nt, Human
caguuucagaauugaauaggcaagugacuguuuuaaagauuaaguaauaaagaugucuuaucua

SEQ ID NO: 276080 - RNA, 64 nt, Human
uuaaaauauuaacuuuuuuuaaugcuauuuuaugaaagauuauuguaauaaacuuugauggggu

SEQ ID NO: 276081 - RNA, 64 nt, Human
cagcuugccuuuuugcggccuuauauuuugauguaaagauuaaaagaaugugcaaaacagucag

SEQ ID NO: 276082 - RNA, 62 nt, Human
cccucacacacacagcugggcaaagccacaaggcuggccagcaaggcagguuggaugggagu

SEQ ID NO: 276083 - RNA, 62 nt, Human
ccuugagucuccucucuggauggaauccgcgagcuggccaccuggccacccucuacacggcu

SEQ ID NO: 276084 - RNA, 62 nt, Human
aggauggcuaguaucaaaagaaagaaaaucaggcuggccaacggggugaaacccugucucua

SEQ ID NO: 276085 - RNA, 62 nt, Human
auuccuaagaacacugaagggcuggaaugcuggcuggccacucucugccucaguggccuccc

SEQ ID NO: 276086 - RNA, 64 nt, Human
uccacugugcuuucaaacauagauaaagcaugauaaagauuauuauuuaagauauacuuguauu

SEQ ID NO: 276087 - RNA, 64 nt, Human
guuucuuagacccuauguagauuauuaaugaacaaaagauuaaacuccaaauauuaaauaguaa

SEQ ID NO: 276088 - RNA, 64 nt, Human
uggguuaaaucaaagauaagguuauaguaacaucaaagauuaggugagguuuauagaaagauag

SEQ ID NO: 276089 - RNA, 64 nt, Human
gccaauuaacaguaugugccuugggggaggagggaaagauuagcuuugaacauuccuggcgcau

SEQ ID NO: 276090 - RNA, 64 nt, Human
uagaaaaccuguauaaauuacuggugcauaacuuaaagauuauucugccuuuggcuaauugagu

SEQ ID NO: 276091 - RNA, 64 nt, Human
auuagucauuaaaaaucuuguacguauauaauucaaagauuauaucuuguuauucagugcauga

SEQ ID NO: 276092 - RNA, 64 nt, Human
uugcuuuguuuucccuggcuaacagucuagugcaaaagauuaagauuuuaucugggggaaagaa

SEQ ID NO: 276093 - RNA, 64 nt, Human
cauuuauucaccaaaggaauuaauauacugagucaaagauuaacaaugcuauacuauagaguaa

SEQ ID NO: 276094 - RNA, 64 nt, Human
agaauauaaccacucaagcuacuggcacauagugaaagauuacuucugacauuccauugcucuu

SEQ ID NO: 276095 - RNA, 64 nt, Human
aucugaguucccuccccucucuuugacauuccugaaagauuaccagccagcaauagcccagggc

SEQ ID NO: 276096 - RNA, 64 nt, Human
acugagugguacaagccuuggggacugaaaaaaaaaagauuaaaaccauuaaaaagaaacucau

SEQ ID NO: 276097 - RNA, 64 nt, Human
auugauguaguaugaaacccugcaucuuuaaggaaaagauuaaaauaguaaaauaaaaguauuu

SEQ ID NO: 276098 - RNA, 64 nt, Human
uaugguauaaaugaugaaguugaagugauguuugaaagauuaaugagauacaauuuauauuauu

SEQ ID NO: 276099 - RNA, 64 nt, Human
cuuaguuuuguucuuggacaaauuuaaacuuuuaaaagauuauucaagaugaauuuaaaaguca

SEQ ID NO: 276100 - RNA, 62 nt, Human
aaaggccucuggauacugggcuccccagaacugcuggccacaggauggugggugagguuagu

SEQ ID NO: 276101 - RNA, 62 nt, Human
gcucuggcuguggaugucuucagccucugggugcuggccagugaggucccaaaugacccagg

SEQ ID NO: 276102 - RNA, 62 nt, Human
acgccuggagaagggugguuuccugccacccugcuggccaaggaggcuccugggguggggau

SEQ ID NO: 276103 - RNA, 62 nt, Human
agaaccagcucaccuggccagaguggguuccugcuggccagggugcagccuugaugacaccu

SEQ ID NO: 276104 - RNA, 64 nt, Human
auccccuuuuuccauuuuuauauaauuuauaaagaaagauuaaagccauguugacuauuuuaca

SEQ ID NO: 276105 - RNA, 64 nt, Human
uuguagauguuuugcuucaguuuaacuuaugagaaaagauuaucugacggauuuuguguugacu

SEQ ID NO: 276106 - RNA, 64 nt, Human
uucauuuucaaacgagagggaaacaugggaaguaaaagauuaggaugugaaagguuguccuaaa

SEQ ID NO: 276107 - RNA, 64 nt, Human
agugggaaagaacagcucaucucccccucaugugaaagauuaaauuguaaagcaaaaaaaaaaa

SEQ ID NO: 276108 - RNA, 64 nt, Human
ucuaugaaaugaguggaccauuaaccuuacauguaaagauuauguuaguaauuaagaaaccuaa

SEQ ID NO: 276109 - RNA, 64 nt, Human
cuaccuucuagggaacuaggaccuaggaagagguaaagauuaucagguaugcaaagcgccccaa

SEQ ID NO: 276110 - RNA, 64 nt, Human
ucaggucucaccccuguggccugugauuaugaauaaagauuaucuuuguaaagauccgugccag

SEQ ID NO: 276111 - RNA, 64 nt, Human
uuugggaaauuuuaaaguaaaaguuucaaaguugaaagauuauagugaguacccuuauguccuu

SEQ ID NO: 276112 - RNA, 64 nt, Human
acagaugaggcagucugacuguccuuucuacuugaaagauuagaauauguauccaaauggcauu

SEQ ID NO: 276113 - RNA, 64 nt, Human
caaacuuuucuaacuggagcucagaguaagaaauaaagauuacaucacaauccaauaucugugg

SEQ ID NO: 276114 - RNA, 64 nt, Human
ucccuucagcuuccccuccccguagcagccacuaaaagauuauuuaauuccagauuggaaauga

SEQ ID NO: 276115 - RNA, 64 nt, Human
uuauacuuggguauaaaucaaucccaguuugggaaaagauuauuuuuaagcuuaaaaggcugac

SEQ ID NO: 276116 - RNA, 64 nt, Human
cauguaauguauguaugcaguaugccuuacuuaaaaagauuaaaaggauacuaauguuaaaucu

SEQ ID NO: 276117 - RNA, 64 nt, Human
caccagcucuacagauaagaaaacauugaaauucaaagauuaaggccaaaaauaucucacuugc

SEQ ID NO: 276118 - RNA, 62 nt, Human
agauuuucagaagugucuggucaagauaacaugcuggccaaccacaauuccuagaguuaaga

SEQ ID NO: 276119 - RNA, 62 nt, Human
ugguggccccguuucugguggucuguuggcaggcuggccaguccaggcugccguggggccgc

SEQ ID NO: 276120 - RNA, 62 nt, Human
gacaucacuguuuguaccaaagccaaacucuggcuggccaagagguauguuaaaaucccaca

SEQ ID NO: 276121 - RNA, 62 nt, Human
gcuggacacacguggaaccaagccagggaugggcuggccauuguguccccgcaggagagaug

SEQ ID NO: 276122 - RNA, 64 nt, Human
agcuguauaauuaauugucauuauuuuuguuagcaaagauuaaaugugucauuggaagccaucc

SEQ ID NO: 276123 - RNA, 64 nt, Human
gucagaacuagaggaaauagccaagacuaaugaaaaagauuacucuaacccuuaaaagacuuuu

SEQ ID NO: 276124 - RNA, 64 nt, Human
cauauaacacaaaacuuuuauaaauuauuuuaacaaagauuaaaauauacugcagggcaaauaa

SEQ ID NO: 276125 - RNA, 64 nt, Human
ugaaaaaauaguuauaucaucuuauaguaaaccaaaagauuagcaauaauacuauggacacauu

SEQ ID NO: 276126 - RNA, 64 nt, Human
ucuaugccaaagaucacuuguuguuuuacuaaagaaagauuacuuagaggaaauaagaaaaauc

SEQ ID NO: 276127 - RNA, 64 nt, Human
cuaaguacccaaauaggaguguaugcagaggaugaaagauuaagauuaugcucuggcaucuaac

SEQ ID NO: 276128 - RNA, 64 nt, Human
acauuaagcgguuacucagacaguuaaucauagaaaagauuauuugcuucaucaguucauagaa

SEQ ID NO: 276129 - RNA, 64 nt, Human
auagaaaagauuauuugcuucaucaguucauagaaaagauuauuugcuucaucaguuaacuugu

SEQ ID NO: 276130 - RNA, 64 nt, Human
agagacugaaucacuuuucucauugauuaaauguaaagauuauugagaaaccuauaguaaauga

SEQ ID NO: 276131 - RNA, 64 nt, Human
uguaaaauggacucuaguuuaauaaugggggaaaaaagauuagguugcuccugaaacugacugu

SEQ ID NO: 276132 - RNA, 64 nt, Human
ugcaucggaggaccacaaucaguucuaugcugccaaagauuaaaaauaaauaaaaacauaaaaa

SEQ ID NO: 276133 - RNA, 64 nt, Human
uauguuuaaauuauuuguccuaaagcuuuauguuaaagauuauccuauuuuaccccuucgugug

SEQ ID NO: 276134 - RNA, 64 nt, Human
aaugaaaauaaacauaagccacaaggaaugggugaaagauuauuguaaugugcuuuaacuaaau

SEQ ID NO: 276135 - RNA, 64 nt, Human
auucagugcaauccauugcaugcauuagcaguucaaagauuaaauaugaucauaucaauaggua

SEQ ID NO: 276136 - RNA, 62 nt, Human
gucugugcuguuugucgugaaaagcuuaaugggcuggccaggcugugucaccuucuccaagc

SEQ ID NO: 276137 - RNA, 62 nt, Human
aaagagaagauacuuucuagauaccgcucuuugcuggccagagucuguccuggugugugagg

SEQ ID NO: 276138 - RNA, 62 nt, Human
gcaaccaggaccacccccacguucagaaaucagcuggccaagugacuccauuugacuugcaa

SEQ ID NO: 276139 - RNA, 62 nt, Human
cauugucuuuaaugaccacaagacaaccaacagcuggccacguacuuaaaauuuugucccca

SEQ ID NO: 276140 - RNA, 64 nt, Human
caaaguagucugugugugaccugucccccuccccaaagauuaaggaucacuguauagauuaaaa

SEQ ID NO: 276141 - RNA, 64 nt, Human
gaacaaagcagcaaaacaaaggcaguuuuauaugaaagauuagaagccuggaauaaucaggcuu

SEQ ID NO: 276142 - RNA, 64 nt, Human
auggggggccgcggggaaggcaagaguuuuuccaaaagauuauuagaaaugagggcuguaucua

SEQ ID NO: 276143 - RNA, 64 nt, Human
aggaggggaaauauuugccucaugucauaauugaaaagauuaaauaagaaauaaagggaagugu

SEQ ID NO: 276144 - RNA, 64 nt, Human
ugcaauguuaucauucaugaacuguuaaaguguuaaagauuaggauugaagucacugaccauuc

SEQ ID NO: 276145 - RNA, 64 nt, Human
aguguuucuauguuauugaaaaaugauguuccagaaagauuacuuuuuuccucuuauuuuuacu

SEQ ID NO: 276146 - RNA, 64 nt, Human
auagcgagacccccaucucuacaaagaaauuuuaaaagauuauccaggcaugguggugcaugcc

SEQ ID NO: 276147 - RNA, 64 nt, Human
uuuaauuuaaauggaugcagguugucuacuaaagaaagauuauauauaacuaugcuaauuguuc

SEQ ID NO: 276148 - RNA, 64 nt, Human
auacucgagauaaguccugaaaaaagaaaaaaugaaagauuaccuucagucagaaugcagaacu

SEQ ID NO: 276149 - RNA, 64 nt, Human
caauggucccaggggccaaguagaaagcauuuuuaaagauuaaucugaauuaagcuuuaucagu

SEQ ID NO: 276150 - RNA, 64 nt, Human
ugaaacuugugccacagagcuauauauaauaugaaaagauuaacuucauagagauauuguaagu

SEQ ID NO: 276151 - RNA, 64 nt, Human
ugaaacuguagagagcagguagcccaaaauagagaaagauuagauaaagagaaaauaaguaucc

SEQ ID NO: 276152 - RNA, 64 nt, Human
auccccugacuggauaacucagggcuggagaaacaaagauuauaaagcacgagaauggcaauuu

SEQ ID NO: 276153 - RNA, 64 nt, Human
uaagguggcaaaaccccaucucuaccaaaaauacaaagauuagccaggcgugguggugagcgcc

SEQ ID NO: 276154 - RNA, 62 nt, Human
uuacccccaugaccaacaucgcagacacaugugcuggccaccugcugagccccaaguggaac

SEQ ID NO: 276155 - RNA, 62 nt, Human
gcauaaacuucaucuucaaccuuaaggacuuagcuggccacagugagcugaugugcccacca

SEQ ID NO: 276156 - RNA, 62 nt, Human
ucgggaguccagugagcagagcauuggacuuggcuggccagagggucucugagggcaagaga

SEQ ID NO: 276157 - RNA, 62 nt, Human
gccgacgcccgcuacgaagcagccugcaacaggcuggccaacaaggcggugcagcggggcuc

SEQ ID NO: 276158 - RNA, 64 nt, Human
cuuuuucuuugguugcuccuguggaaaauacugaaaagauuacuuuguuuuauuuuguugucuu

SEQ ID NO: 276159 - RNA, 64 nt, Human
uuucccccuuccaucucugacuuaagcaaaagaaaaagauuacccaaaaacugucuuuaaaaga

SEQ ID NO: 276160 - RNA, 64 nt, Human
agaaaauucuagcacugguggagaauuauagaauaaagauuauaaaugguuggauaagacaaau

SEQ ID NO: 276161 - RNA, 64 nt, Human
uuacaaugcaugaaugccuaucccccuacaaaacaaagauuaaaugugaugauguaugccaagg

SEQ ID NO: 276162 - RNA, 64 nt, Human
auugacucuaaggcuuuuauuaagaaaacagcagaaagauuaaaucuugaauuaagucuggggg

SEQ ID NO: 276163 - RNA, 64 nt, Human
gaaacauauguagcaugauuuuguaggagaggaaaaagauuauuuaaauaggauuuaaaucaug

SEQ ID NO: 276164 - RNA, 64 nt, Human
gcuuaccccagagagcaagugaggcaaucuggcaaaagauuaauaaagauguaaaccccuggaa

SEQ ID NO: 276165 - RNA, 64 nt, Human
ucuccuagagaugagugcuugggauuucuuagagaaagauuacuuccugacagggguaggggag

SEQ ID NO: 276166 - RNA, 64 nt, Human
caaagagggagcacacagcauuauucugauggaaaaagauuauccagggaaugguacaacaaug

SEQ ID NO: 276167 - RNA, 64 nt, Human
cagacaaauuuaaaggaaacacuaaggcugcuucaaagauuaucugauuccuuuaaaauauaug

SEQ ID NO: 276168 - RNA, 64 nt, Human
uuagagcuuuauauacuuucucuuaaggacuugaaaagauuaggaaucuacgcauacacugaga

SEQ ID NO: 276169 - RNA, 64 nt, Human
cacaccaaaacuguauucuuaugaauauacgcuaaaagauuaaguaaaaugcccaaggguauaa

SEQ ID NO: 276170 - RNA, 64 nt, Human
auuauuugguauguguuuugcuuuguuuaacccaaaagauuauuuuuugguuccuaaagaaaaa

SEQ ID NO: 276171 - RNA, 64 nt, Human
ccuucucucucuacauguucaauaaaaguuguugaaagauuaacaacuauacaaaaagagcaug

SEQ ID NO: 276172 - RNA, 62 nt, Human
uuucuaugcaauguucaggauaaaugcauacugcuggccaaucagugucaucuccuggguaa

SEQ ID NO: 276173 - RNA, 62 nt, Human
gaguagcugggauuacaggcgccugccaccacgcuggccaauuuuuguacuuuuaguagaga

SEQ ID NO: 276174 - RNA, 62 nt, Human
aaccaggugucugugauuucuaauuaaucaccgcuggccauuacacagguuuuguuguuugg

SEQ ID NO: 276175 - RNA, 62 nt, Human
cugcgggagagcuggcuguugcuggacuacaugcuggccacugcugugaccacgacacugcu

SEQ ID NO: 276176 - RNA, 64 nt, Human
augauguuauagaauuauuuuugagcaggagcagaaagauuaaauaugaucacuucauacuucu

SEQ ID NO: 276177 - RNA, 64 nt, Human
cucagccccuuuuucugccuaggauaaggagcugaaagauuaacuuggaucuucuaauggucca

SEQ ID NO: 276178 - RNA, 64 nt, Human
uauauauauauauauauaaaccaaaaguaguuggaaagauuauuugaaaugacuaauuugugcu

SEQ ID NO: 276179 - RNA, 64 nt, Human
uaguaagagcuuuguuucaauaucacucuugaguaaagauuaaaauaaagcuaccauuuuacau

SEQ ID NO: 276180 - RNA, 64 nt, Human
cuucugauuggauauuguguuuuaaccaaauuuuaaagauuaauggaaucaugaaagggaaaaa

SEQ ID NO: 276181 - RNA, 64 nt, Human
uuugaggaauauuucaagcucugcaacagggggcaaagauuaaucuaccuugcaguguaggaau

SEQ ID NO: 276182 - RNA, 64 nt, Human
auucuucuagagaaaaagggaucuaggaaugcugaaagauuacccaacauaccauuauagucuc

SEQ ID NO: 276183 - RNA, 64 nt, Human
gacaguggacuguucuauuuuuuucaauaaccaaaaagauuaaacaaaaaauacuauaaaaccc

SEQ ID NO: 276184 - RNA, 64 nt, Human
ugcuuucuccuaaaagggcaaaaaacaaucucaaaaagauuagaaaaagagaaggggggaaggg

SEQ ID NO: 276185 - RNA, 64 nt, Human
ugggagaacagaaauaagaauuaaugaaaauuuaaaagauuaaaugaaugagaagaaaugauuc

SEQ ID NO: 276186 - RNA, 64 nt, Human
uccuaaucuggcuuuuacauuuauuuugugccuuaaagauuaacuacaaagauaaacauggcca

SEQ ID NO: 276187 - RNA, 64 nt, Human
cugaccguacaguaauuuauuugucguuaguguuaaagauuaagcauaguaacugacucuuaag

SEQ ID NO: 276188 - RNA, 64 nt, Human
uugaucccagaaaguauauacugaagugugggauaaagauuaugauuaggggaggguuggagac

SEQ ID NO: 276189 - RNA, 64 nt, Human
auuuuuuacauugaacuuuucuucacuuguauauaaagauuauauauaaguacuuauuuaugag

SEQ ID NO: 276190 - RNA, 62 nt, Human
gcucaggggccgggacagcacugggugcucaggcuggccaaggaccuucauugccuggcaag

SEQ ID NO: 276191 - RNA, 62 nt, Human
cauucuccauucuggagaaucugcuccaaaaagcuggccacaucucugaggugucagaauua

SEQ ID NO: 276192 - RNA, 62 nt, Human
uaaaggcaaaauagaggguaugaccugggguugcuggccagagccagggaggagccuuaaga

SEQ ID NO: 276193 - RNA, 62 nt, Human
ccaagccugggcauggguggggggccuugucugcuggccacgcaagugucacaugcgaucua

SEQ ID NO: 276194 - RNA, 64 nt, Human
uguuacaccuaggaugggcauuaugcaaaagcacaaagauuauauaugacaaucaguauugcaa

SEQ ID NO: 276195 - RNA, 64 nt, Human
aguagcuuauuugaccauaagucacacaucaaaaaaagauuacccuuaguguauguguuuuaau

SEQ ID NO: 276196 - RNA, 64 nt, Human
guacauaaagauuucuuuucaguuguaaauuuguaaagauuaccuugccacuuuauaagaaagu

SEQ ID NO: 276197 - RNA, 64 nt, Human
auuuguuuugaagguuuuuuuuccugacugucuuaaagauuaugcuagcuuuagaacacaugca

SEQ ID NO: 276198 - RNA, 64 nt, Human
guuuacuuuuuccauuaauauaaauuucauuuggaaagauuaaaaaaacaaguuugauugaacu

SEQ ID NO: 276199 - RNA, 64 nt, Human
cucuuucucaagguagucuuuuaucuuuauaaagaaagauuaguguuuaagagcguagacuuga

SEQ ID NO: 276200 - RNA, 64 nt, Human
auuacuucuguuuuuuacacccacauacaguacaaaagauuauuaaaaauauucccaaaaggca

SEQ ID NO: 276201 - RNA, 64 nt, Human
cuuuuuacuacaaacaaaauuacucaccuggauuaaagauuaaggccuuaaucuguuuagauua

SEQ ID NO: 276202 - RNA, 64 nt, Human
uuugaagauaguuuuaauucugcuugugacauuaaaagauuauuugggccaguuauagcuuauu

SEQ ID NO: 276203 - RNA, 64 nt, Human
uugguggcuaaguuuuacuaaggaaaauaacugaaaagauuaaaagugagagcugaaaagagaa

SEQ ID NO: 276204 - RNA, 64 nt, Human
ucaauugugggauuauaacuucuuuacacuucggaaagauuagccuagacuaacuucauucuug

SEQ ID NO: 276205 - RNA, 64 nt, Human
uauuuuuuaaaacaucaauugauauuaaaaaugaaaagauuauuggaaaguacauauugacuug

SEQ ID NO: 276206 - RNA, 64 nt, Human
auuuauuuuuuaaauaauugucuuuuuccauaaaaaagauuacuuuccauuccuuuaggggaaa

SEQ ID NO: 276207 - RNA, 64 nt, Human
uaguuuuccagaauggauuuuuuuuuuuagauaaaaagauuaucuaccuuuuggggguggaaua

SEQ ID NO: 276208 - RNA, 62 nt, Human
ucagugacugucgccuuguuacugauccucuugcuggccauuguugcuucuguugucaccuc

SEQ ID NO: 276209 - RNA, 62 nt, Human
agccacaccaacccugugcucucuggcccccagcuggccacacuucuccaggagggacccuu

SEQ ID NO: 276210 - RNA, 62 nt, Human
uggaggcuaagccuggacacagucagggcggggcuggccagcugugcgagaacacaagccac

SEQ ID NO: 276211 - RNA, 62 nt, Human
cuuuguucuuuguuagucucuugaaacuggcugcuggccaagcuuuauagcccucaccauuu

SEQ ID NO: 276212 - RNA, 64 nt, Human
agauuuuuuuccccuuaaaaugaauuaucuuuccaaagauuagacucaguaugagaguagguga

SEQ ID NO: 276213 - RNA, 64 nt, Human
uuugauuaucagauacugucucuaaaauuauuuuaaagauuaauauuuguucaaguagagaaug

SEQ ID NO: 276214 - RNA, 64 nt, Human
aguccuagauuacuuauugauuuaaaaacaaaaaaaagauuacuuaauuuugauuuaaaaacaa

SEQ ID NO: 276215 - RNA, 64 nt, Human
ucaccugcuaaaggagauuuacacauuagaaagcaaagauuauuuucauuuauccagaugacca

SEQ ID NO: 276216 - RNA, 64 nt, Human
aucaguguuuucuuuucuaaaacaucaaaaugccaaagauuaaucugugauuggugauaacugc

SEQ ID NO: 276217 - RNA, 64 nt, Human
gaguguaacagugauaaccugaucuguuuguuuuaaagauuauuaccaagugaaaaauucagaa

SEQ ID NO: 276218 - RNA, 64 nt, Human
auauacuguacauuccaaaaacucuaaacuuuuuaaagauuauagauacacuaccaaacauauc

SEQ ID NO: 276219 - RNA, 64 nt, Human
ucuacaguuucaaauaaaugacuuuuuaauuguaaaagauuaguugaaaaacuguaugaaugug

SEQ ID NO: 276220 - RNA, 64 nt, Human
cauucuugaauuuugaacacugaauaucuuuuugaaagauuauacuucuuuaccucuuugugcu

SEQ ID NO: 276221 - RNA, 64 nt, Human
gucuucagcuaacuuaguuauacauaaaugcugaaaagauuaucuugagcugggccuugggaga

SEQ ID NO: 276222 - RNA, 64 nt, Human
aggcauauuuuguauguauaaauucaccacaauuaaagauuauucuugucaguccuugcuaugu

SEQ ID NO: 276223 - RNA, 64 nt, Human
ccagcagugucgcuccaauucaaauuaguggagaaaagauuacaguaggcccugagccgacugu

SEQ ID NO: 276224 - RNA, 64 nt, Human
gucuugauguugugaagcagagguuauuuuguggaaagauuaaaaggauuuuguugguaccugg

SEQ ID NO: 276225 - RNA, 64 nt, Human
cuucaaaggcguaguuuugggaauuugaugcaguaaagauuacccuguuuuaugauuguuccuu

SEQ ID NO: 276226 - RNA, 62 nt, Human
ggaggggaguagagaaguuacacagaaaugcugcuggccaaauagcaaagacaaccugggaa

SEQ ID NO: 276227 - RNA, 62 nt, Human
uuuuccaggacaaagccaaaggccccuuguuagcuggccaucccugccccauuuuuuccccu

SEQ ID NO: 276228 - RNA, 62 nt, Human
gagccucgucccucccucacugaaggaccugagcuggccaggcccugagagucuggucugcg

SEQ ID NO: 276229 - RNA, 62 nt, Human
ggacauugaccaccugaccuccccuaacuagugcuggccaaggccugagaguucacagaacc

SEQ ID NO: 276230 - RNA, 64 nt, Human
ggauucuguuuaauuuauuguguauguguggggaaaagauuagauucuaaaauaaaaguuuacc

SEQ ID NO: 276231 - RNA, 64 nt, Human
uaaauuaauggacuuguuaaacuuuuggaaaaaaaaagauuaaaugccagcuuuguacaggucu

SEQ ID NO: 276232 - RNA, 64 nt, Human
gcaguuagacugagauuucuaaugacuucaccauaaagauuauacuucugccuggcgucguuuc

SEQ ID NO: 276233 - RNA, 64 nt, Human
uguuuguuguccugcuugguugaguaccacaauuaaagauuaugcuccccuuuucuuguuugaa

SEQ ID NO: 276234 - RNA, 64 nt, Human
cauauaguaaaugcaaacaugccaaguauuuuauaaagauuaauaacagaccuacucuuaccug

SEQ ID NO: 276235 - RNA, 64 nt, Human
uuugucauauucuuguauucaaagaaaaaggaaaaaagauuauuguaaauauuuuauuuaaugc

SEQ ID NO: 276236 - RNA, 64 nt, Human
cugucaccagauauugccauuuuucuuuuuguuaaaagauuauaugaucaagauaaauuggggu

SEQ ID NO: 276237 - RNA, 64 nt, Human
aaaauaagggaaauaaauguaauugccauuuuucaaagauuaaguaggaggagagggguuucuu

SEQ ID NO: 276238 - RNA, 64 nt, Human
agaaaccaaacugggaaaucuuacaaggaguugaaaagauuaaugucccaaccugaugagauua

SEQ ID NO: 276239 - RNA, 64 nt, Human
gguuccaaaauauguaaaaaugauaauaauaaaaaaagauuaacaucccuugucaucuuuuuua

SEQ ID NO: 276240 - RNA, 64 nt, Human
aacagauuuuaaaucaauguguauucuuuacuggaaagauuacauacauuugagaauaagaaau

SEQ ID NO: 276241 - RNA, 64 nt, Human
cccaagacuuaaaggaagaauucucugaagggauaaagauuacuaaaaaaaaaaaaaaaaaaaa

SEQ ID NO: 276242 - RNA, 64 nt, Human
ccuuugcaagcaaaugaguacuccucuccuaaagaaagauuacguugaugaaaaagaacauccu

SEQ ID NO: 276243 - RNA, 64 nt, Human
caggguaaaggcacccuuuggaauuacugauuucaaagauuaauaaaguaauucuauuuuuauu

SEQ ID NO: 276244 - RNA, 63 nt, Human
gcugcuaauaccuuggacuuuggacagaauggagcuauggacguuaauuugaccgucuacucc

SEQ ID NO: 276245 - RNA, 63 nt, Human
gcuucugaagguaaagggacacuggauccagaagcuauggaaccagcaguugauucuuguauu

SEQ ID NO: 276246 - RNA, 62 nt, Human
cuucugaacacucaggagaacguggcccucucgcuggccaacaucagcggccggcugucggg

SEQ ID NO: 276247 - RNA, 62 nt, Human
auauauacacaugcacauacacagauuuuucugcuggccaggugggccaacuggguuucccu

SEQ ID NO: 276248 - RNA, 64 nt, Human
uuauucuaaaaauuguacuacuuucacuuuucccaaagauuauauaauguucauaauccaccau

SEQ ID NO: 276249 - RNA, 64 nt, Human
agucagcucucuacuccuuuauuuuguuuuaucaaaagauuaagagcuccuuucuuugaauaaa

SEQ ID NO: 276250 - RNA, 64 nt, Human
uagagaagagaccuucaggugcuuuuguggcuaaaaagauuacagcgucaucugguugaacucu

SEQ ID NO: 276251 - RNA, 64 nt, Human
uuaucuaaagccaucucuauguuucuguucagauaaagauuaaugaguucuguguuuauaucag

SEQ ID NO: 276252 - RNA, 64 nt, Human
aagcaaaauucagagcaacugaguacugaucuaaaaagauuaccuuuggcuggaggugagcugc

SEQ ID NO: 276253 - RNA, 64 nt, Human
guucaucuauuuuaaacacagauguuuacaaaauaaagauuauuucaaaccaccgguguggcug

SEQ ID NO: 276254 - RNA, 64 nt, Human
uuuuuucuccaccagacaaauggaaaaaaagaggaaagauuaacuauuugcaccgaaaugucuu

SEQ ID NO: 276255 - RNA, 64 nt, Human
guaagaaguuauuacugcaucauuuguaauagcuaaagauuagaaacaauuaauugcuauggaa

SEQ ID NO: 276256 - RNA, 64 nt, Human
auagacacuauaguuuuacccauaaguaauauuuaaagauuauagcucccaaaagaauggacca

SEQ ID NO: 276257 - RNA, 64 nt, Human
gccucuguguuucaggugcccuucguuuuaaaagaaagauuauuggauuaaaagaugaguuuua

SEQ ID NO: 276258 - RNA, 64 nt, Human
ucuuuaauaaaaugccauuugugcaagauuucucaaagauuagguauauauuuaaauggaagag

SEQ ID NO: 276259 - RNA, 64 nt, Human
uggugucaccaaaacccuuuucuucaguaucgacaaagauuacauucugaguaccaaccaaacc

SEQ ID NO: 276260 - RNA, 64 nt, Human
ggcuuaucacaguuacaauguguuuucugaaaguaaagauuauuuuaccuugaaauuacaaaaa

SEQ ID NO: 276261 - RNA, 64 nt, Human
uguguucaacuuuuuaaaaagauguuuccuuucuaaagauuaauuucuugggagcaaaugagua

SEQ ID NO: 276262 - RNA, 62 nt, Human
ccccucuggcugugugucaccuuggcuggcuggcuggccaggguuuugccgauuucccuccu

SEQ ID NO: 276263 - RNA, 61 nt, Human; identical to SEQ ID NO: 50633

SEQ ID NO: 276264 - RNA, 52 nt, Human; identical to SEQ ID NO: 50642

SEQ ID NO: 276265 - RNA, 62 nt, Human
uaugaaggcagaaucagacuaucaggaaaggagcuggccagggccacagccagucaagaucu

SEQ ID NO: 276266 - RNA, 64 nt, Human
augcuaucaauacacuauguguccuuuuuagaauaaagauuacauaucaucauuccuuugggga

SEQ ID NO: 276267 - RNA, 64 nt, Human
gcugucugucccucagagggcaccuggaggcagcaaagauuaucuuauuuauuuuauuuuguuu

SEQ ID NO: 276268 - RNA, 64 nt, Human
uauuugcaaguaauuaccauuaaauucacacaugaaagauuaaucugaaagaucagagaccaug

SEQ ID NO: 276269 - RNA, 64 nt, Human
uauauuggaaugauuauauagaaaaugcucuuaaaaagauuaaaccuauuucucaguaugguau

SEQ ID NO: 276270 - RNA, 64 nt, Human
ccucccccuccuucagccagccuaugauaacacuaaagauuauuaauguugguuuuguaucucg

SEQ ID NO: 276271 - RNA, 64 nt, Human
ggaaguaaauccugcacagccaaccuggaauaccaaagauuagaugggagauagauaccaauga

SEQ ID NO: 276272 - RNA, 64 nt, Human
cugccggcuagucccaagcaaacgggcuaggaggaaagauuaaaaaaacaacaacaacaacuua

SEQ ID NO: 276273 - RNA, 64 nt, Human
auucaauuuuguggaugaauaaauugaggcacagaaagauuaaguuaccggcccaaggugacac

SEQ ID NO: 276274 - RNA, 64 nt, Human
auugcaugcuuuuguaaaaacaugcugggugaugaaagauuaguuuuagagagaaaauguucau

SEQ ID NO: 276275 - RNA, 64 nt, Human
agaaagauuuacaguaacgaauggauuccuauauaaagauuauuuuuauacuuuuugcagcaaa

SEQ ID NO: 276276 - RNA, 64 nt, Human
cgccauugccaccaguauggugguauguacucacaaagauuaagaaagaaauguauucugauua

SEQ ID NO: 276277 - RNA, 64 nt, Human
cuuagcuugucugugaucucugcuggggagauaaaaagauuaagccccaacauguucagaaaag

SEQ ID NO: 276278 - RNA, 64 nt, Human
acuggauugcuauauuuuuaaccagaaauaaacuaaagauuagagcauguuccaguuaaauuca

SEQ ID NO: 276279 - RNA, 64 nt, Human
uucuuggucuuuugcuguuuaaaugaugauuuugaaagauuaaaccuguacuguugguauugug

SEQ ID NO: 276280 - RNA, 63 nt, Human
gucuaucugcauuaggacccaugggccguggaggcuauggaggugguggcaguggugguggug

SEQ ID NO: 276281 - RNA, 63 nt, Human
uagaaaguccccaccagugaugcugaguguucugcuauggaaacaaugcugcuuuucucucag

SEQ ID NO: 276282 - RNA, 63 nt, Human
gaucuugacaugcccaucuuagaagccagucaagcuauggaacuaaugcggaggcugcuugcu

SEQ ID NO: 276283 - RNA, 63 nt, Human
gguggguuuagucaucucggaagucguagggcagcuauggaaaccacuggguucuggaacguu

SEQ ID NO: 276284 - RNA, 64 nt, Human
augaucuguaugauaccugcaauugaaaagccgaaaagauuauacugucaaguccaguaaauga

SEQ ID NO: 276285 - RNA, 64 nt, Human
cuaaagcugugcacauauguaaaaaaaaaaaaaaaaagauuauuuuaggggagauguaggugua

SEQ ID NO: 276286 - RNA, 64 nt, Human
gaaauugcuuaaaaaaaaagaaaaagaaaaaaaaaaagauuauucuaaauaaaaggaaaaaggc

SEQ ID NO: 276287 - RNA, 64 nt, Human
caguugaucugcucuguuuuauacuagugacaauaaagauuauuuuuugauacaccuaugaguu

SEQ ID NO: 276288 - RNA, 64 nt, Human
cuggugucaguccuuuuuuccuuuguuccaaauaaaagauuaaaccaauggccuuagggugucu

SEQ ID NO: 276289 - RNA, 64 nt, Human
ucuuuguagaauaaaugguuucucauuaaacucuaaagauuagggaaaauggauauagaaaauc

SEQ ID NO: 276290 - RNA, 64 nt, Human
cuugcguucaaccaaaauugauucuuggaacuguaaagauuacaacccaaagucucccaggaag

SEQ ID NO: 276291 - RNA, 64 nt, Human
cugcagauaaaaucacaaaaaccacuguuauauuaaagauuacacauuuccugggcacagccug

SEQ ID NO: 276292 - RNA, 64 nt, Human
ggaaaagaacuauguuaugauuuuguagaaauguaaagauuacuugagguguuuaaaauaaauu

SEQ ID NO: 276293 - RNA, 64 nt, Human
acgcuuugguuucucaacuucucuaccccaaagaaaagauuauucaauaaaguuuccugccuuu

SEQ ID NO: 276294 - RNA, 55 nt, Human
aggagcagggcaaagaguaaagauuaaagauuacccccaguccucccuagcucuu

SEQ ID NO: 276295 - RNA, 64 nt, Human
acugggaagcuggagagucacagucuaguagaagaaagauuagaaaaauuucaacuguaggugc

SEQ ID NO: 276296 - RNA, 64 nt, Human
uuuuagaauguaggacuuaugauccaauucaccaaaagauuaaaugaaaccacccuguguuuua

SEQ ID NO: 276297 - RNA, 64 nt, Human
agcuacaguuaugaaaaaggaagaauuuugcucuaaagauuauuaauaagcuuagaaaauccug

SEQ ID NO: 276298 - RNA, 63 nt, Human
gaugcugaaagagaaaagagggguugguaguuggcuauggauuuucuaaggaagaucacuuug

SEQ ID NO: 276299 - RNA, 63 nt, Human
aacauugagcagcauuggagaggccacagcugagcuauggagaugcuaaauuaacucauggcc

SEQ ID NO: 276300 - RNA, 63 nt, Human
gccugaguccagggauagcaaugguacugaccagcuauggacugggagaacauugaguccugu

SEQ ID NO: 276301 - RNA, 63 nt, Human
gagaaaucagugacaacaagucuuugaaauggugcuauggauuuaccauuccuuauuaucacu

SEQ ID NO: 276302 - RNA, 64 nt, Human
auauaccaacuucugcuuguauuucuuaaaugacaaagauuaccuagcuaagaaacuuccuagg

SEQ ID NO: 276303 - RNA, 64 nt, Human
ucaucccuccuuccucccccucaguuuuuguuggaaagauuaucucuagaguuauauuuucuau

SEQ ID NO: 276304 - RNA, 64 nt, Human
uaggaaauuacuuucacaguaaauaucaaagaaaaaagauuaagggucucuuugccaugcuuuu

SEQ ID NO: 276305 - RNA, 64 nt, Human
uuuuuugaaauguuccugaaacuaauuuggguuuaaagauuaaaaggguuguuaccauucuuau

SEQ ID NO: 276306 - RNA, 64 nt, Human
ugaauuuaggcacaugcauguacauuguauuuauaaagauuauauauguaguuuccaaggaaga

SEQ ID NO: 276307 - RNA, 64 nt, Human
ugcuuucaugggccauuuuaacaguuuuauuucaaaagauuagguuucccaacuuacuguuugu

SEQ ID NO: 276308 - RNA, 64 nt, Human
caaaauggcuuaagauaaaguauuuuuaaggaagaaagauuaaaaacaacuguuauacaugaga

SEQ ID NO: 276309 - RNA, 64 nt, Human
ugcccguuuaucuucauuguauuaauuauuacauaaagauuaacaaauacauugcaaaugcaaa

SEQ ID NO: 276310 - RNA, 64 nt, Human
agagucgucauuucuguguccucaauuuuaucugaaagauuaaaacaaaauauauuaugucacu

SEQ ID NO: 276311 - RNA, 64 nt, Human
aauguaaagaaaauguauuacauucuguauguacaaagauuaaaaaucaaccucuuuuuugugc

SEQ ID NO: 276312 - RNA, 64 nt, Human
accuaagucuucauuuaauuuauugucccccagaaaagauuaagaugcuacuugaaaagacugu

SEQ ID NO: 276313 - RNA, 64 nt, Human
aacagaucaggaauucuaaauaaauuucccaguuaaagauuauugugacuucacuguauauaaa

SEQ ID NO: 276314 - RNA, 64 nt, Human
cacgccauaaccauuuucuccagaagcguggaggaaagauuaugaaaggaacaggcucuuuaaa

SEQ ID NO: 276315 - RNA, 64 nt, Human
acugaagaccugaaucuacacuaguaaucucaagaaagauuauucauucuaucucagaguuacc

SEQ ID NO: 276316 - RNA, 63 nt, Human
agacccagcacaaggguccuuccagaaccaagugcuauggaugccagauuggagaggucagac

SEQ ID NO: 276317 - RNA, 63 nt, Human
uuuuuuuuuuaaucagaaaaaugcuaagucccagcuauggauuucaggccucuacacuucugc

SEQ ID NO: 276318 - RNA, 63 nt, Human
ccagaagccaggacuaggaccugggccuugccugcuauggaauauugagagagauuuuuuaaa

SEQ ID NO: 276319 - RNA, 63 nt, Human
gagucuuggguguguagccaagaggagccaugagcuauggacuccucaagcacgggaagagga

SEQ ID NO: 276320 - RNA, 64 nt, Human
uauuauuuuaaauguuauuuuauauaugauauuaaaagauuauaauuauauaaucuuuuucgau

SEQ ID NO: 276321 - RNA, 64 nt, Human
guuauugccucugaaaugccucuucuuuauguacaaagauuauuugcacgaacuggacugugug

SEQ ID NO: 276322 - RNA, 64 nt, Human
uaccaccaaccccacagaaauacgaaaaacccucaaagauuacuauaaacaccuguaugcacac

SEQ ID NO: 276323 - RNA, 64 nt, Human
aaaaugaaauaagacauguagcuaaaguaaguuaaaagauuaugauaaacucagaaaauaaaca

SEQ ID NO: 276324 - RNA, 64 nt, Human
uaucuauuaaccaaaaccuuugauuuguaguuuuaaagauuaacccucaaaguucucuucauaa

SEQ ID NO: 276325 - RNA, 64 nt, Human
ucgguugccaucuuuaauuauuggcaaugacaccaaagauuaucagauuuguccuaaaugccuu

SEQ ID NO: 276326 - RNA, 64 nt, Human
guuguuuuuuguuguuuuguuuuuuaagaaagugaaagauuauuuuucuacaacaaauuccaaa

SEQ ID NO: 276327 - RNA, 64 nt, Human
uucugaaguuuauggaauggaaguauuuaauuggaaagauuaaacauauugauuuuaauuaaua

SEQ ID NO: 276328 - RNA, 64 nt, Human
gauuuuauagcuuuugagcuaacguaacuuuuguaaagauuaagcucauuuaguguuguuuuuu

SEQ ID NO: 276329 - RNA, 64 nt, Human
gcuuaacuggcuguggggaguguuuuuguaucacaaagauuagagaggacuacacaucagggcu

SEQ ID NO: 276330 - RNA, 64 nt, Human
aaaguuguagucuauauuuauggggccauugcuuaaagauuauaaauuauguaaauacauuaau

SEQ ID NO: 276331 - RNA, 64 nt, Human
acaaaccugacuaguccuuacuagccugaggguaaaagauuaagcuccaaccucaagucauuua

SEQ ID NO: 276332 - RNA, 64 nt, Human
agauucuguauuuuuuaacaaucuucaauaauguaaagauuacuuuuaaaauauuuaaguuaaa

SEQ ID NO: 276333 - RNA, 64 nt, Human
caaaugcacucccaaagugguuuuaagaaaauaaaaagauuauccuuccucuuugucuaagggu

SEQ ID NO: 276334 - RNA, 63 nt, Human
gaccgugaacacaaaacaucaaguuccacacacgcuauggaaugguuaugaagggaagcgaga

SEQ ID NO: 276335 - RNA, 63 nt, Human
aauaauucaaacaucaaauaacuucaauuuaaggcuauggacuuugagauaauucugagccuu

SEQ ID NO: 276336 - RNA, 63 nt, Human
ucugauccuacacagaaaaugugugugaucccugcuauggagcagagguuaucaaacuaaagc

SEQ ID NO: 276337 - RNA, 63 nt, Human
cccacaggguuguguccaacauacacggaaguggcuauggaaugguguauuugugcaaccugg

SEQ ID NO: 276338 - RNA, 64 nt, Human
aaacaggacuuaaaugaacuuugaucucuguuuuaaagauuauuaaaaaacauuguguaucuau

SEQ ID NO: 276339 - RNA, 64 nt, Human
aaaacaauugcuuuugaggcucagugacaacggcaaagauuacaacuuaaaaaaaaaaaauaaa

SEQ ID NO: 276340 - RNA, 64 nt, Human
gaauucauaaaauuauuuaugucuguuauagaauaaagauuaauauauguuaguugaauuguuu

SEQ ID NO: 276341 - RNA, 64 nt, Human
aucuuuugcuuuaauugcuacuguacuugcuuugaaagauuaccuacuauuuuaugauaaaaug

SEQ ID NO: 276342 - RNA, 64 nt, Human
aaugaagugcuuuccagagaaccaucauauaaauaaagauuaauagaaaaauaucuugucccaa

SEQ ID NO: 276343 - RNA, 64 nt, Human
uuuuguaguauguauuuuucuaauugaagagaauaaagauuaaaacaaagugcuuuaagauuga

SEQ ID NO: 276344 - RNA, 64 nt, Human
ccuguuuuccuaauaacuuuguuacugugcugugaaagauuacagauuugaacauguaguguac

SEQ ID NO: 276345 - RNA, 64 nt, Human
acgagaguugcaaaguugcuuugagcagagagggaaagauuaauuuacacugcuggccaccgaa

SEQ ID NO: 276346 - RNA, 64 nt, Human
cucuaggcccccuucccucuacacaccucugggaaaagauuacacuguauuaacucucgaggag

SEQ ID NO: 276347 - RNA, 64 nt, Human
uaguuuucacccaagagcuguccuggugaccaaaaaagauuacuaggguuuugccaucagcaac

SEQ ID NO: 276348 - RNA, 64 nt, Human
uuugcuuugcuguacuaaaauguaaugaaaaauaaaagauuaauaaaugaaacauaaugcuaau

SEQ ID NO: 276349 - RNA, 64 nt, Human
aacauuaugagccuuuucugcucaaaaaauuuucaaagauuaaaacuauuauacauauacaggu

SEQ ID NO: 276350 - RNA, 64 nt, Human
aaacuuaaauauccaaagaugccuuuugaauuucaaagauuaaaacacagcuagaguaguagua

SEQ ID NO: 276351 - RNA, 64 nt, Human
acacacauuuaaaugauauaaaaagaagagguugaaagauuauuaaauaacuuaucaggcaucu

SEQ ID NO: 276352 - RNA, 62 nt, Human
uuguucccacaccccaacacuuccagcauuuagcuggccacauggcggagaguuuuaauuuu

SEQ ID NO: 276353 - RNA, 62 nt, Human
ucccucugcggggaggacccgggaccacagcugcuggccaggguagacuuggagcuguccuc

SEQ ID NO: 276354 - RNA, 62 nt, Human
ugcaaggacaccuuugcagggauucuuguccugcuggccaccccacccacaccugucccugg

SEQ ID NO: 276355 - RNA, 62 nt, Human
aaggugcuccccacuucccagauggugcggcggcuggccagaggcacucuucacuucccaga

SEQ ID NO: 276356 - RNA, 64 nt, Human
guauagaaaacaauucugaaagcuguguccacuaaaagauuaacagugguuaucucugggugau

SEQ ID NO: 276357 - RNA, 64 nt, Human
agagauuaaaugaguauucaguuuuauuuuuaguaaagauuaaauccaaaacuuuacuuuuaau

SEQ ID NO: 276358 - RNA, 64 nt, Human
agaaccaaagguuuagucaagaaacaaaaaucuuaaagauuauuauaacccagacuaagguuga

SEQ ID NO: 276359 - RNA, 64 nt, Human
gaaaugucuauuuaagcugcuuuaaguuaauagaaaagauuaaagcaaaauauucauuuuuacu

SEQ ID NO: 276360 - RNA, 64 nt, Human
gucaaucgauaaacccuacuuuccaaauuaucuaaaagauuaccauuuggggcccuuguuuuca

SEQ ID NO: 276361 - RNA, 64 nt, Human
aucauaaaaaugaaugagauuugaaaacuuucacaaagauuauaaauguaguuaguuugauacu

SEQ ID NO: 276362 - RNA, 64 nt, Human
auaacuaauaugguuuuguuuucaaugaauuaagaaagauuaaauauaucuuuguaaauuauuu

SEQ ID NO: 276363 - RNA, 64 nt, Human
gguaauuuuuuguaauguguauuaaacgaaguucaaagauuagaaauacaucuguguccugaaa

SEQ ID NO: 276364 - RNA, 64 nt, Human
aaaagaguuugaaaauagaauuuucaagcaacucaaagauuaucuauacacaaaacgguuauuu

SEQ ID NO: 276365 - RNA, 64 nt, Human
agauuaaagguuugccucaaaaugucccuguuugaaagauuagcacaaaagucuugauagcaca

SEQ ID NO: 276366 - RNA, 64 nt, Human
aauuuucugccccagccaaaauaaucuugugccaaaagauuaaagguuugccucaaaauguccc

SEQ ID NO: 276367 - RNA, 64 nt, Human
uacaaaauaccaacuguucuauauuucuuuagaaaaagauuauaguuauuaauauugauaccuc

SEQ ID NO: 276368 - RNA, 64 nt, Human
auaugcauguauguagaauauuuuugcagagcagaaagauuauguuagaagugugauuuuuauu

SEQ ID NO: 276369 - RNA, 64 nt, Human
cagaaaauuuccuuagagucuuuaauucccccacaaagauuauuaaucacauauauagggccuu

SEQ ID NO: 276370 - RNA, 63 nt, Human
gcauacccucaucaaaaacacucucacuaugcugcuauggacgaccuccagcucucaguuaca

SEQ ID NO: 276371 - RNA, 63 nt, Human
ggagggagacagaugcuuggaccugggugccuggcuauggagauugaccaagcaagaucagga

SEQ ID NO: 276372 - RNA, 63 nt, Human
cugggaagggaaggaagcaagccggcagaaauagcuauggaaggucuugcgcaggcugcaacc

SEQ ID NO: 276373 - RNA, 63 nt, Human
cugggguuagauguguuugagagucaaaugaaagcuauggaucuucucagcaauuaaaaaaaa

SEQ ID NO: 276374 - RNA, 64 nt, Human
uaaaacaguguauuuugaaguuugacugcuugaaaaagauuagcauacaucuaaugugaaaaga

SEQ ID NO: 276375 - RNA, 64 nt, Human
aaaaagaaagucuggguuccacacauacauagaaaaagauuauuauguucugagaaagcuuuac

SEQ ID NO: 276376 - RNA, 64 nt, Human
auuuuguguuauugcuguggugugcaugauuugcaaagauuaagugcauuuucucugucuauac

SEQ ID NO: 276377 - RNA, 64 nt, Human
ccuuuugauuuguggcauuguaacaacuccguguaaagauuaucugaaaaguaaaaaaaaaaaa

SEQ ID NO: 276378 - RNA, 64 nt, Human
aguuucacaauggggacaauuagcauaacuaaacaaagauuaugagcucuacuuauuccgugag

SEQ ID NO: 276379 - RNA, 64 nt, Human
acacacauuuaaaggauauaaaaagaagagguugaaagauuauuaaauaacuuaucaggcaucu

SEQ ID NO: 276380 - RNA, 64 nt, Human
acaguagcaaugguugcucuauauuuugucuuucaaagauuacugcauuaccaagaaacaguag

SEQ ID NO: 276381 - RNA, 64 nt, Human
gcucugaaaaauuccuuuucucuuuuuuuuuuguaaagauuaacuccaccucaccaccacaaug

SEQ ID NO: 276382 - RNA, 64 nt, Human
uuacuuugcugugccugugcugagagaccaugugcccgagcaucugguugaccggcaugaagua

SEQ ID NO: 276383 - RNA, 64 nt, Human
gccaguuugccagcaagcgcauccuagcaggguccccgagcagcagguuguguggaugaaggga

SEQ ID NO: 276384 - RNA, 64 nt, Human
agcuuuuuaaaagagagaaauuaucacuacaacucccgagcacuaaguagacgggguagaguca

SEQ ID NO: 276385 - RNA, 64 nt, Human
ccuccccuugugucaacuccggcagcucaagacccccgagcaacauuuguaggggccgcugcua

SEQ ID NO: 276386 - RNA, 64 nt, Human
agugcccaccuuccuuggcccacagcagauaggucccgagcagcaggacuggaggccuguggcg

SEQ ID NO: 276387 - RNA, 64 nt, Human
ggagggaagggcucuggcccugacuccgcugugucccgagcacacgugcugaccgcagcccgcc

SEQ ID NO: 276388 - RNA, 64 nt, Human
acggaguuugggggccacagcaccugggcacacacccgagcaccuguccauuggcaugcuucug

SEQ ID NO: 276389 - RNA, 63 nt, Human
cucuugaggaacuuuuaauuugcaggggugcccgcuauggacggggcauuccagcugagacac

SEQ ID NO: 276390 - RNA, 63 nt, Human
acaggguuaaaguccuuucuugcuuucaaauaugcuauggagccacaguugaggacaguaguu

SEQ ID NO: 276391 - RNA, 63 nt, Human
uccgccaggcccugccccaucgccagugaagcugcuauggagcaacaggaaacuggugauaaa

SEQ ID NO: 276392 - RNA, 64 nt, Human
aucuucugccaugcugaggagcaguccaucccugcccgagcauguaucggcaacaugggcagcc

SEQ ID NO: 276393 - RNA, 64 nt, Human
gacagaaccaaggcugcuugaaccagaaccuagucccgagcagcaccgcucuccugcaccuccc

SEQ ID NO: 276394 - RNA, 64 nt, Human
ugaccggccuguguccccgagcccucgcggcaggcccgagcaggcgaucgcggccgggcacgcg

SEQ ID NO: 276395 - RNA, 64 nt, Human
uaacacuuaagacucccacccugugacacugagucccgagcacagcaccuucccagucuccugu

SEQ ID NO: 276396 - RNA, 64 nt, Human
gccgcgaccucaguguggcuuuuacaggacuccccccgagcaucagcagggaccccggcggacg

SEQ ID NO: 276397 - RNA, 64 nt, Human
uuccuggguucaagugauucucuugccuuagccucccgagcagcugggauuauaggcguccacc

SEQ ID NO: 276398 - RNA, 64 nt, Human
cccaugucuccacgaaggcguccuggagucacuccccgagcagcgcggcggcggcagggaguug

SEQ ID NO: 276399 - RNA, 64 nt, Human
uauggaauuccagugccaggccagugaccucauucccgagcagcccugcucuggggugagugug

SEQ ID NO: 276400 - RNA, 64 nt, Human
gaccagaaaccuuccagagaacacagggcugcaucccgagcaacccucugaagaagggaauuag

SEQ ID NO: 276401 - RNA, 64 nt, Human
guuugcaaaauggccaaaaaaaaaaaccggcuuccccgagcagcugcccugaaaguaggggugg

SEQ ID NO: 276402 - RNA, 55 nt, Human
cagcuuccaacuccaccugaacagucccgagcagccagcugcacaggaaaaacca

SEQ ID NO: 276403 - RNA, 64 nt, Human
uuucagaagagcucagcagggcccugccuggucucccgagcaucaugaguaacgugucugcuca

SEQ ID NO: 276404 - RNA, 64 nt, Human
aggcagggauuugaggagcagcuucaguuguuuucccgagcaaagucuaaaguuuacaguaaau

SEQ ID NO: 276405 - RNA, 64 nt, Human
ucagugaagggcaaacagcccauggguaguauggcccgagcacugaauucccuugcgccuuuuc

SEQ ID NO: 276406 - RNA, 64 nt, Human
ucgugugugugccccaggcacguguaauaaagaacccgagcagaugccuccugcuugaaccagg

SEQ ID NO: 276407 - RNA, 64 nt, Human
cuccuggguucgaacgauucuccugccucagccucccgagcagcugggacuacaggcaugcgcc

SEQ ID NO: 276408 - RNA, 63 nt, Human
ucuuagcugaaauggccgaaaacugugagacaugcuauggaagcugaaugccggacgcuagca

SEQ ID NO: 276409 - RNA, 63 nt, Human
agagcagaaaagcauucaagauuugcaggccuugcuauggaugcgcuuaaucaccauggaggc

SEQ ID NO: 276410 - RNA, 63 nt, Human
caagcaguagcaggacgaugauagggcuggagggcuauggauucccagcccaucccugugaag

SEQ ID NO: 276411 - RNA, 64 nt, Human
uguguccagugcccagcaacuccugccucagccucccgagcagcugggacuacaggcgcccgcc

SEQ ID NO: 276412 - RNA, 64 nt, Human
cugcuccccuggagcggcgccccugcgcccucagcccgagcagcgacauccacucgccauuugc

SEQ ID NO: 276413 - RNA, 64 nt, Human
cuuucacugcugcacccgcgcccucggccggccccccgagcagccuuuguacucugcuugcgga

SEQ ID NO: 276414 - RNA, 64 nt, Human
cuccuggguucgaacgauucuccugccucagccucccgagcagcugggacuacaggcgugcgcc

SEQ ID NO: 276415 - RNA, 64 nt, Human
caguccagaugccggucauccacccacuguccagcccgagcaacagguucugugucaccagccu

SEQ ID NO: 276416 - RNA, 64 nt, Human
cggggcugagacgccggcuuccuccuuccagaugcccgagcaccgugucgggcaggucagcgcg

SEQ ID NO: 276417 - RNA, 64 nt, Human
gcugggcuggcggccauccccguguuggguggaccccgagcacgguugccugagguccgauggc

SEQ ID NO: 276418 - RNA, 64 nt, Human
agaguggaggcacaauggaaauccucugugggaccccgagcaagacccugcaccucuuugggcc

SEQ ID NO: 276419 - RNA, 64 nt, Human
gaccagccagcugguccucugggaacagccagcucccgagcacagccgcacuccuguugacccu

SEQ ID NO: 276420 - RNA, 64 nt, Human
cuguggcucuggagccccugccccugccugcauccccgagcaccccacccuccaggcuccacua

SEQ ID NO: 276421 - RNA, 64 nt, Human
aguccagguggacucuguggauguguggauguggcccgagcaggcucaggcggccccacucacc

SEQ ID NO: 276422 - RNA, 64 nt, Human
gugaggccagggcagagugagacccagcccucaucccgagcaccuccacauccuccacguucug

SEQ ID NO: 276423 - RNA, 64 nt, Human
gucggcauggcucacugugcugggugaaggccuccccgagcauuagguccuccacggggcugug

SEQ ID NO: 276424 - RNA, 64 nt, Human
gcaccugugccuuaaucuucccuccccugugcugcccgagcaccucccccgccccuuuacuccu

SEQ ID NO: 276425 - RNA, 64 nt, Human
cugguaccugcugggcccgccggcugccacucagcccgagcaggucggggagcugugcuucucu

SEQ ID NO: 276426 - RNA, 64 nt, Human
cucccagguucaagcgauucuccugccucagccucccgagcagcugagacuacaggcgccugcc

SEQ ID NO: 276427 - RNA, 63 nt, Human
ccccacccucuggcuggugcugggccggagguggcuauggaggauuuuggcaugcguggccug

SEQ ID NO: 276428 - RNA, 63 nt, Human
uuuugucaguaugaugauuuuugcagccacuuggcuauggagagcagccgacacccccucuua

SEQ ID NO: 276429 - RNA, 62 nt, Human
acacugccaagccaacccuggaaaaggaguucgcuggccauuggcuagaaucaggguggaga

SEQ ID NO: 276430 - RNA, 64 nt, Human
ugggcaucguuaguuggggcuauggcugcgggggcccgagcaccccaggaguauacaccaaggu

SEQ ID NO: 276431 - RNA, 64 nt, Human
ggccguuaaguggacaggaaguggccccacauagcccgagcagggucuggaagcauccugugcu

SEQ ID NO: 276432 - RNA, 64 nt, Human
cucccggguucacgccauucuccugccucagccucccgagcagcugggacuacaggcgcccgcc

SEQ ID NO: 276433 - RNA, 64 nt, Human
cuccuggguucaagugauucuucugccucagccucccgagcagcugggauuacaggcgcccacu

SEQ ID NO: 276434 - RNA, 64 nt, Human
gggcaggaguagcugagcucacaaggcagcaaggcccgagcagcugagcagggccggggaacug

SEQ ID NO: 276435 - RNA, 64 nt, Human
agaccuuucagcuucgagccagggggcgggggaucccgagcaaaagccuuccguggacaucagg

SEQ ID NO: 276436 - RNA, 64 nt, Human
acacauaugcagacacaugccagggccccccaagcccgagcaccggaccacguugcugcccagg

SEQ ID NO: 276437 - RNA, 64 nt, Human
aggugcucuugacugucgccugcgcacuguguaccccgagcaacauucuaagggugugcuuucg

SEQ ID NO: 276438 - RNA, 64 nt, Human
gcuucggaccccacgccucugcaagugggagagacccgagcauccuccccacccccauagcucc

SEQ ID NO: 276439 - RNA, 64 nt, Human
ggggaguggggaguggggggaaggaaagcggagacccgagcagggguuuuaaggagcaggaugg

SEQ ID NO: 276440 - RNA, 64 nt, Human
ccaggcugaugccaagcaccccuuuuaucccauccccgagcaggccuuacagaccacacugcag

SEQ ID NO: 276441 - RNA, 64 nt, Human
aggaagccagcuggcuuugcacuugaccucaucucccgagcaauggcgccugcucccuccagaa

SEQ ID NO: 276442 - RNA, 64 nt, Human
agcuccgccaccccccauugcccacccgcacuuucccgagcaccgcgccccgugggcugugggu

SEQ ID NO: 276443 - RNA, 51 nt, Human
ugcgcccgccguuuucgugagcccgagcagcggcgagcccagggcgccggg

SEQ ID NO: 276444 - RNA, 64 nt, Human
ucuguucugggaauguuucagcagccaauaagugcccgagcacacugcccccgguugccugccu

SEQ ID NO: 276445 - RNA, 64 nt, Human
cccggcugcccagagggcuggaugccugccgguccccgagcaagccugggaacucaggaaaauu

SEQ ID NO: 276446 - RNA, 62 nt, Human
uccccaaggugaaguggagggugcuguggugagcuggccacuccagagcugcagugccacug

SEQ ID NO: 276447 - RNA, 62 nt, Human
ccccaccccucaguugacgccagcccuguaaagcuggccacagugugcagggagaaugggga

SEQ ID NO: 276448 - RNA, 62 nt, Human
agagaaacagcuccuccccgacuagguggaaggcuggccaggcaccaagcaugugugugcac

SEQ ID NO: 276449 - RNA, 64 nt, Human
ugggcuucaacauggcaggucuguaggggucagacccgagcagccuggacuuuacaguuaugug

SEQ ID NO: 276450 - RNA, 64 nt, Human
ccucugcugccccugaugcaugcuucugcugauucccgagcaccaacuccuuacaagggggccu

SEQ ID NO: 276451 - RNA, 64 nt, Human
aagaaagcagggggaccugccacccccagccaaacccgagcaagggucgucggcauccaggccu

SEQ ID NO: 276452 - RNA, 64 nt, Human
ccaccugguggccucugccccgucucaugaggggcccgagcagaagcaggauaguugcuccgcc

SEQ ID NO: 276453 - RNA, 64 nt, Human
agagaaggagcaggcacgcugggccucgcguguccccgagcagugagggucccaguguucccuc

SEQ ID NO: 276454 - RNA, 64 nt, Human
aguaaaauuguuuuuucuguccgcaacacuggcucccgagcagcuuuuguuaaagcaguagguu

SEQ ID NO: 276455 - RNA, 64 nt, Human
ucagcuggccuccgaagagccguggacuguccuacccgagcacuugauucugguagcuccuucu

SEQ ID NO: 276456 - RNA, 64 nt, Human
caauaaacugggcgaccucaauggugcgugcauccccgagcacccuggcgaccucgugcagacc

SEQ ID NO: 276457 - RNA, 64 nt, Human
aggggucuuggagcuccuauggagcagacugccccccgagcaguguccccagccuagcccugug

SEQ ID NO: 276458 - RNA, 64 nt, Human
uccacuggcuuuugccuguaagaaaaaaaauguacccgagcacauagagcuuuuuaauagcacu

SEQ ID NO: 276459 - RNA, 64 nt, Human
ggccugaaggucagggucacccaagcaacaaagucccgagcaaugaagucauccacuccugcau

SEQ ID NO: 276460 - RNA, 64 nt, Human
gucuuagcaggaaaaaaaacuucgcauuucugugcccgagcaggcuccuugcaaagacagcagc

SEQ ID NO: 276461 - RNA, 64 nt, Human
caggaaauuccuccccuuauucuuccuugaagugcccgagcauguagggcaagaaggaaggcug

SEQ ID NO: 276462 - RNA, 64 nt, Human
guauaaguaugcugagaugcaggcugcucugggccccgagcaaccucuccaguuauccucauau

SEQ ID NO: 276463 - RNA, 64 nt, Human
agccuggccgggggcgcggggggugcagggcaggcccgagcagcucgguuucccgcggacuugg

SEQ ID NO: 276464 - RNA, 64 nt, Human
ggccccaucggccugcagaggggacggcuggggucccgagcaacucugccuccauccacguggg

SEQ ID NO: 276465 - RNA, 63 nt, Human
acugagagggcaaucuuugccuuuaucucugaggcuauggaggguccuccuccaucuuucuac

SEQ ID NO: 276466 - RNA, 63 nt, Human
agccaagagaauaugaaauuugcauagccaaaugcuauggaaccaaagaauaagaugacucac

SEQ ID NO: 276467 - RNA, 62 nt, Human
ucccaucacaucagccuaccucccuccuggcugcuggccaggaugucgccagcauuaccuuc

SEQ ID NO: 276468 - RNA, 64 nt, Human
acccagcaccugguaggcuccauuucuucccaagcccgagcagagggucaugcgggccccacag

SEQ ID NO: 276469 - RNA, 64 nt, Human
agagcuggguguagccagagcuacuggcaccuaccccgagcaucucucucuguaagcagcuuca

SEQ ID NO: 276470 - RNA, 64 nt, Human
gaaggugguauagauggcccucagauugcggggccccgagcagcuccccacucugcccguccac

SEQ ID NO: 276471 - RNA, 64 nt, Human
ccuccagaaccgacaguuccagcaaaagcagcggcccgagcagaagaucgaggacaucagcaau

SEQ ID NO: 276472 - RNA, 64 nt, Human
uggccagaguccacucccuuccuggcugugucaccccgagcagcucauccaccauggaggucau

SEQ ID NO: 276473 - RNA, 64 nt, Human
caaguacgcggccagcagcuaccugagccugacgcccgagcaguggaggucccgcagaagcuac

SEQ ID NO: 276474 - RNA, 64 nt, Human
acaggauaagcguccaggagccacgggcucccaccccgagcauaucacauggugccgaauugca

SEQ ID NO: 276475 - RNA, 64 nt, Human
ugccccaaaguguggggacagagccucagggagccccgagcaugguccagccccauuugagugc

SEQ ID NO: 276476 - RNA, 64 nt, Human; identical to SEQ ID NO: 276382

SEQ ID NO: 276477 - RNA, 64 nt, Human; identical to SEQ ID NO: 276383

SEQ ID NO: 276478 - RNA, 64 nt, Human; identical to SEQ ID NO: 276384

SEQ ID NO: 276479 - RNA, 64 nt, Human; identical to SEQ ID NO: 276385

SEQ ID NO: 276480 - RNA, 64 nt, Human; identical to SEQ ID NO: 276386

SEQ ID NO: 276481 - RNA, 64 nt, Human; identical to SEQ ID NO: 276387

SEQ ID NO: 276482 - RNA, 63 nt, Human
gacgguuugggggugggugggcgggaggacuuugcuauggauuugagguugaccuuaugcgcg

SEQ ID NO: 276483 - RNA, 63 nt, Human
gauggaguaaaauugucaaucauacauugaauugcuauggaagacuuguuuuuaugaugugca

SEQ ID NO: 276484 - RNA, 63 nt, Human
acccuucuuguugcccucagguagcagaugauggcuauggaguuuccuacaugauugcaggcg

SEQ ID NO: 276485 - RNA, 64 nt, Human; identical to SEQ ID NO: 276388

SEQ ID NO: 276486 - RNA, 64 nt, Human; identical to SEQ ID NO: 276392

SEQ ID NO: 276487 - RNA, 64 nt, Human; identical to SEQ ID NO: 276393

SEQ ID NO: 276488 - RNA, 64 nt, Human; identical to SEQ ID NO: 276394

SEQ ID NO: 276489 - RNA, 64 nt, Human; identical to SEQ ID NO: 276395

SEQ ID NO: 276490 - RNA, 64 nt, Human; identical to SEQ ID NO: 276396

SEQ ID NO: 276491 - RNA, 64 nt, Human; identical to SEQ ID NO: 276397

SEQ ID NO: 276492 - RNA, 64 nt, Human; identical to SEQ ID NO: 276398

SEQ ID NO: 276493 - RNA, 64 nt, Human; identical to SEQ ID NO: 276399

SEQ ID NO: 276494 - RNA, 64 nt, Human; identical to SEQ ID NO: 276400

SEQ ID NO: 276495 - RNA, 64 nt, Human; identical to SEQ ID NO: 276401

SEQ ID NO: 276496 - RNA, 55 nt, Human; identical to SEQ ID NO: 276402

SEQ ID NO: 276497 - RNA, 64 nt, Human; identical to SEQ ID NO: 276403

SEQ ID NO: 276498 - RNA, 64 nt, Human; identical to SEQ ID NO: 276404

SEQ ID NO: 276499 - RNA, 64 nt, Human; identical to SEQ ID NO: 276405

SEQ ID NO: 276500 - RNA, 64 nt, Human; identical to SEQ ID NO: 276406

SEQ ID NO: 276501 - RNA, 63 nt, Human
ucaaaaugugauucuaugugauuaguaugcuaugcuauggaauauacauguaaaaauguuucc

SEQ ID NO: 276502 - RNA, 63 nt, Human
caucacagaaaggagaaucuccacucacugacugcuauggaccuuucucaggacagcuaauug

SEQ ID NO: 276503 - RNA, 62 nt, Human
gucacuuagcagauugcacuuaagucccuugugcuggccagauggcguggcugguugccuua

SEQ ID NO: 276504 - RNA, 64 nt, Human; identical to SEQ ID NO: 276407

SEQ ID NO: 276505 - RNA, 64 nt, Human; identical to SEQ ID NO: 276411

SEQ ID NO: 276506 - RNA, 64 nt, Human; identical to SEQ ID NO: 276412

SEQ ID NO: 276507 - RNA, 64 nt, Human; identical to SEQ ID NO: 276413

SEQ ID NO: 276508 - RNA, 64 nt, Human; identical to SEQ ID NO: 276414

SEQ ID NO: 276509 - RNA, 64 nt, Human; identical to SEQ ID NO: 276415

SEQ ID NO: 276510 - RNA, 64 nt, Human; identical to SEQ ID NO: 276416

SEQ ID NO: 276511 - RNA, 64 nt, Human; identical to SEQ ID NO: 276417

SEQ ID NO: 276512 - RNA, 64 nt, Human; identical to SEQ ID NO: 276418

SEQ ID NO: 276513 - RNA, 64 nt, Human; identical to SEQ ID NO: 276419

SEQ ID NO: 276514 - RNA, 64 nt, Human; identical to SEQ ID NO: 276420

SEQ ID NO: 276515 - RNA, 64 nt, Human; identical to SEQ ID NO: 276421

SEQ ID NO: 276516 - RNA, 64 nt, Human; identical to SEQ ID NO: 276422

SEQ ID NO: 276517 - RNA, 64 nt, Human; identical to SEQ ID NO: 276423

SEQ ID NO: 276518 - RNA, 64 nt, Human; identical to SEQ ID NO: 276424

SEQ ID NO: 276519 - RNA, 64 nt, Human; identical to SEQ ID NO: 276425

SEQ ID NO: 276520 - RNA, 63 nt, Human
ucaguagguuuagauuugagcuuuugagaccuggcuauggaaaagaaagacacuugagaauuu

SEQ ID NO: 276521 - RNA, 63 nt, Human
uggggcacucaagaaaguucagaggaggcauaagcuauggagguuggaaaggaagaaagagaa

SEQ ID NO: 276522 - RNA, 63 nt, Human
uucccacuuggaggccuuucaucccucgggugugcuauggauggcuucuaacaaaaacuacac

SEQ ID NO: 276523 - RNA, 64 nt, Human; identical to SEQ ID NO: 276426

SEQ ID NO: 276524 - RNA, 64 nt, Human; identical to SEQ ID NO: 276430

SEQ ID NO: 276525 - RNA, 64 nt, Human; identical to SEQ ID NO: 276431

SEQ ID NO: 276526 - RNA, 64 nt, Human; identical to SEQ ID NO: 276432

SEQ ID NO: 276527 - RNA, 64 nt, Human; identical to SEQ ID NO: 276433

SEQ ID NO: 276528 - RNA, 64 nt, Human; identical to SEQ ID NO: 276434

SEQ ID NO: 276529 - RNA, 64 nt, Human; identical to SEQ ID NO: 276435

SEQ ID NO: 276530 - RNA, 64 nt, Human; identical to SEQ ID NO: 276436

SEQ ID NO: 276531 - RNA, 64 nt, Human; identical to SEQ ID NO: 276437

SEQ ID NO: 276532 - RNA, 64 nt, Human; identical to SEQ ID NO: 276438

SEQ ID NO: 276533 - RNA, 64 nt, Human; identical to SEQ ID NO: 276439

SEQ ID NO: 276534 - RNA, 64 nt, Human; identical to SEQ ID NO: 276440

SEQ ID NO: 276535 - RNA, 64 nt, Human; identical to SEQ ID NO: 276441

SEQ ID NO: 276536 - RNA, 64 nt, Human; identical to SEQ ID NO: 276442

SEQ ID NO: 276537 - RNA, 51 nt, Human; identical to SEQ ID NO: 276443

SEQ ID NO: 276538 - RNA, 64 nt, Human; identical to SEQ ID NO: 276444

SEQ ID NO: 276539 - RNA, 63 nt, Human
aaugauacaagugagcaaaaguuggucagcuuggcuauggagugguggcaauaaucucuaaac

SEQ ID NO: 276540 - RNA, 63 nt, Human
agagaaucaaauggacuggccuugggggucucugcuauggaaaugccauuuuuugugucuccu

SEQ ID NO: 276541 - RNA, 63 nt, Human
uaguuuuuacagcuguguuauucuuugcguguagcuauggaaguugcauaauuauuauuauua

SEQ ID NO: 276542 - RNA, 64 nt, Human; identical to SEQ ID NO: 276445

SEQ ID NO: 276543 - RNA, 64 nt, Human; identical to SEQ ID NO: 276449

SEQ ID NO: 276544 - RNA, 64 nt, Human; identical to SEQ ID NO: 276450

SEQ ID NO: 276545 - RNA, 64 nt, Human; identical to SEQ ID NO: 276451

SEQ ID NO: 276546 - RNA, 64 nt, Human; identical to SEQ ID NO: 276452

SEQ ID NO: 276547 - RNA, 64 nt, Human; identical to SEQ ID NO: 276453

SEQ ID NO: 276548 - RNA, 64 nt, Human; identical to SEQ ID NO: 276454

SEQ ID NO: 276549 - RNA, 64 nt, Human; identical to SEQ ID NO: 276455

SEQ ID NO: 276550 - RNA, 64 nt, Human; identical to SEQ ID NO: 276456

SEQ ID NO: 276551 - RNA, 64 nt, Human; identical to SEQ ID NO: 276457

SEQ ID NO: 276552 - RNA, 64 nt, Human; identical to SEQ ID NO: 276458

SEQ ID NO: 276553 - RNA, 64 nt, Human; identical to SEQ ID NO: 276459

SEQ ID NO: 276554 - RNA, 64 nt, Human; identical to SEQ ID NO: 276460

SEQ ID NO: 276555 - RNA, 64 nt, Human; identical to SEQ ID NO: 276461

SEQ ID NO: 276556 - RNA, 64 nt, Human; identical to SEQ ID NO: 276462

SEQ ID NO: 276557 - RNA, 64 nt, Human; identical to SEQ ID NO: 276463

SEQ ID NO: 276558 - RNA, 63 nt, Human
cuagcucccacggucuccagagcagcaaggccggcuauggagcugccgucgugugaccacagu

SEQ ID NO: 276559 - RNA, 63 nt, Human
gaaugacucacauguuucagacaggccuccacggcuauggagagaaggcuggaggagacacaa

SEQ ID NO: 276560 - RNA, 63 nt, Human
cuuccuacauuauauuuguguuuuuucaaaucugcuauggaaugaacuuauuccuagauuugg

SEQ ID NO: 276561 - RNA, 64 nt, Human; identical to SEQ ID NO: 276464

SEQ ID NO: 276562 - RNA, 64 nt, Human; identical to SEQ ID NO: 276468

SEQ ID NO: 276563 - RNA, 64 nt, Human; identical to SEQ ID NO: 276469

SEQ ID NO: 276564 - RNA, 64 nt, Human; identical to SEQ ID NO: 276470

SEQ ID NO: 276565 - RNA, 64 nt, Human; identical to SEQ ID NO: 276471

SEQ ID NO: 276566 - RNA, 64 nt, Human; identical to SEQ ID NO: 276472

SEQ ID NO: 276567 - RNA, 64 nt, Human; identical to SEQ ID NO: 276473

SEQ ID NO: 276568 - RNA, 64 nt, Human; identical to SEQ ID NO: 276474

SEQ ID NO: 276569 - RNA, 64 nt, Human; identical to SEQ ID NO: 276475

SEQ ID NO: 276570 - RNA, 64 nt, Human; identical to SEQ ID NO: 276382

SEQ ID NO: 276571 - RNA, 64 nt, Human; identical to SEQ ID NO: 276383

SEQ ID NO: 276572 - RNA, 64 nt, Human; identical to SEQ ID NO: 276384

SEQ ID NO: 276573 - RNA, 64 nt, Human; identical to SEQ ID NO: 276385

SEQ ID NO: 276574 - RNA, 64 nt, Human; identical to SEQ ID NO: 276386

SEQ ID NO: 276575 - RNA, 63 nt, Human
caggguaacuggaggcggggccagggccucagcgcuauggaagaguguccacugaggcugcac

SEQ ID NO: 276576 - RNA, 63 nt, Human
cuguucagaugggcuguaaguucucacuucaaagcuauggaauggauuuuagcaccuuuaaaa

SEQ ID NO: 276577 - RNA, 63 nt, Human
auauccucacauuucuagugcccuugagacugugcuauggaaccaaucuugaacauacaugca

SEQ ID NO: 276578 - RNA, 64 nt, Human; identical to SEQ ID NO: 276387

SEQ ID NO: 276579 - RNA, 64 nt, Human; identical to SEQ ID NO: 276388

SEQ ID NO: 276580 - RNA, 64 nt, Human; identical to SEQ ID NO: 276392

SEQ ID NO: 276581 - RNA, 64 nt, Human; identical to SEQ ID NO: 276393

SEQ ID NO: 276582 - RNA, 64 nt, Human; identical to SEQ ID NO: 276394

SEQ ID NO: 276583 - RNA, 64 nt, Human; identical to SEQ ID NO: 276395

SEQ ID NO: 276584 - RNA, 64 nt, Human; identical to SEQ ID NO: 276396

SEQ ID NO: 276585 - RNA, 64 nt, Human; identical to SEQ ID NO: 276397

SEQ ID NO: 276586 - RNA, 64 nt, Human; identical to SEQ ID NO: 276398

SEQ ID NO: 276587 - RNA, 64 nt, Human; identical to SEQ ID NO: 276399

SEQ ID NO: 276588 - RNA, 64 nt, Human; identical to SEQ ID NO: 276400

SEQ ID NO: 276589 - RNA, 64 nt, Human; identical to SEQ ID NO: 276401

SEQ ID NO: 276590 - RNA, 55 nt, Human; identical to SEQ ID NO: 276402

SEQ ID NO: 276591 - RNA, 64 nt, Human; identical to SEQ ID NO: 276403

SEQ ID NO: 276592 - RNA, 64 nt, Human; identical to SEQ ID NO: 276404

SEQ ID NO: 276593 - RNA, 64 nt, Human; identical to SEQ ID NO: 276405

SEQ ID NO: 276594 - RNA, 63 nt, Human
ccaaagcuuuguccuuuagccagcaccaagauagcuauggaucuuaagagcaccagauccaga

SEQ ID NO: 276595 - RNA, 63 nt, Human
auaggcaaagcgucuaggagcuuguuguuuuuugcuauggaaggccagcuuugggaucuauau

SEQ ID NO: 276596 - RNA, 63 nt, Human
aacuggaaggagcuccagcccugaugguuacuugcuauggaauuuuuuuaaauaaggggaggg

SEQ ID NO: 276597 - RNA, 64 nt, Human; identical to SEQ ID NO: 276406

SEQ ID NO: 276598 - RNA, 64 nt, Human; identical to SEQ ID NO: 276407

SEQ ID NO: 276599 - RNA, 64 nt, Human; identical to SEQ ID NO: 276411

SEQ ID NO: 276600 - RNA, 64 nt, Human; identical to SEQ ID NO: 276412

SEQ ID NO: 276601 - RNA, 64 nt, Human; identical to SEQ ID NO: 276413

SEQ ID NO: 276602 - RNA, 64 nt, Human; identical to SEQ ID NO: 276414

SEQ ID NO: 276603 - RNA, 64 nt, Human; identical to SEQ ID NO: 276415

SEQ ID NO: 276604 - RNA, 64 nt, Human; identical to SEQ ID NO: 276416

SEQ ID NO: 276605 - RNA, 64 nt, Human; identical to SEQ ID NO: 276417

SEQ ID NO: 276606 - RNA, 64 nt, Human; identical to SEQ ID NO: 276418

SEQ ID NO: 276607 - RNA, 64 nt, Human; identical to SEQ ID NO: 276419

SEQ ID NO: 276608 - RNA, 64 nt, Human; identical to SEQ ID NO: 276420

SEQ ID NO: 276609 - RNA, 64 nt, Human; identical to SEQ ID NO: 276421

SEQ ID NO: 276610 - RNA, 64 nt, Human; identical to SEQ ID NO: 276422

SEQ ID NO: 276611 - RNA, 64 nt, Human; identical to SEQ ID NO: 276423

SEQ ID NO: 276612 - RNA, 64 nt, Human; identical to SEQ ID NO: 276424

SEQ ID NO: 276613 - RNA, 63 nt, Human
auagcucuaucgcucugcggagucccagcagaggcuauggaauguuucugcaacccuaaggca

SEQ ID NO: 276614 - RNA, 63 nt, Human
uuguuucagaaacauagcaaugacauaaaaacugcuauggagagaaagcuaacauggucccau

SEQ ID NO: 276615 - RNA, 63 nt, Human
acccccgaucucagagggggccaccaauaucuagcuauggaucguguguuuuguuuagaaauc

SEQ ID NO: 276616 - RNA, 64 nt, Human; identical to SEQ ID NO: 276425

SEQ ID NO: 276617 - RNA, 64 nt, Human; identical to SEQ ID NO: 276426

SEQ ID NO: 276618 - RNA, 64 nt, Human; identical to SEQ ID NO: 276430

SEQ ID NO: 276619 - RNA, 64 nt, Human; identical to SEQ ID NO: 276431

SEQ ID NO: 276620 - RNA, 64 nt, Human; identical to SEQ ID NO: 276432

SEQ ID NO: 276621 - RNA, 64 nt, Human; identical to SEQ ID NO: 276433

SEQ ID NO: 276622 - RNA, 64 nt, Human; identical to SEQ ID NO: 276434

SEQ ID NO: 276623 - RNA, 64 nt, Human; identical to SEQ ID NO: 276435

SEQ ID NO: 276624 - RNA, 64 nt, Human; identical to SEQ ID NO: 276436

SEQ ID NO: 276625 - RNA, 64 nt, Human; identical to SEQ ID NO: 276437

SEQ ID NO: 276626 - RNA, 64 nt, Human; identical to SEQ ID NO: 276438

SEQ ID NO: 276627 - RNA, 64 nt, Human; identical to SEQ ID NO: 276439

SEQ ID NO: 276628 - RNA, 64 nt, Human; identical to SEQ ID NO: 276440

SEQ ID NO: 276629 - RNA, 64 nt, Human; identical to SEQ ID NO: 276441

SEQ ID NO: 276630 - RNA, 64 nt, Human; identical to SEQ ID NO: 276442

SEQ ID NO: 276631 - RNA, 51 nt, Human; identical to SEQ ID NO: 276443

SEQ ID NO: 276632 - RNA, 63 nt, Human
cugcccagggaagcgcaggcgccugcuagggacgcuauggacaccgugaguccaaggcgcugc

SEQ ID NO: 276633 - RNA, 63 nt, Human
aagcgccaugcaucccaagccuuugaccuucccgcuauggaagugcacuggaugacagaaacu

SEQ ID NO: 276634 - RNA, 63 nt, Human
uuaaggccagccacuugucccuguugaggccuggcuauggaacuaaauacaguguuggucuug

SEQ ID NO: 276635 - RNA, 64 nt, Human; identical to SEQ ID NO: 276444

SEQ ID NO: 276636 - RNA, 64 nt, Human; identical to SEQ ID NO: 276445

SEQ ID NO: 276637 - RNA, 64 nt, Human; identical to SEQ ID NO: 276449

SEQ ID NO: 276638 - RNA, 64 nt, Human; identical to SEQ ID NO: 276450

SEQ ID NO: 276639 - RNA, 64 nt, Human; identical to SEQ ID NO: 276451

SEQ ID NO: 276640 - RNA, 64 nt, Human; identical to SEQ ID NO: 276452

SEQ ID NO: 276641 - RNA, 64 nt, Human; identical to SEQ ID NO: 276453

SEQ ID NO: 276642 - RNA, 64 nt, Human; identical to SEQ ID NO: 276454

SEQ ID NO: 276643 - RNA, 64 nt, Human; identical to SEQ ID NO: 276455

SEQ ID NO: 276644 - RNA, 64 nt, Human; identical to SEQ ID NO: 276456

SEQ ID NO: 276645 - RNA, 64 nt, Human; identical to SEQ ID NO: 276457

SEQ ID NO: 276646 - RNA, 64 nt, Human; identical to SEQ ID NO: 276458

SEQ ID NO: 276647 - RNA, 64 nt, Human; identical to SEQ ID NO: 276459

SEQ ID NO: 276648 - RNA, 64 nt, Human; identical to SEQ ID NO: 276460

SEQ ID NO: 276649 - RNA, 64 nt, Human; identical to SEQ ID NO: 276461

SEQ ID NO: 276650 - RNA, 64 nt, Human; identical to SEQ ID NO: 276462

SEQ ID NO: 276651 - RNA, 63 nt, Human
uacagauuugaguucaugauuuuguuaaaaauugcuauggaguacuuuguuauauaacagaag

SEQ ID NO: 276652 - RNA, 63 nt, Human
auauuugaaauccuaaugaggaaaucagaaaaagcuauggaaaaauagacaaauuucauacau

SEQ ID NO: 276653 - RNA, 63 nt, Human
cguuugguuaaagcuuauugccaugcuggugcggcuauggagacugucuggaaggcuuggaau

SEQ ID NO: 276654 - RNA, 64 nt, Human; identical to SEQ ID NO: 276463

SEQ ID NO: 276655 - RNA, 64 nt, Human; identical to SEQ ID NO: 276464

SEQ ID NO: 276656 - RNA, 64 nt, Human; identical to SEQ ID NO: 276468

SEQ ID NO: 276657 - RNA, 64 nt, Human; identical to SEQ ID NO: 276469

SEQ ID NO: 276658 - RNA, 64 nt, Human; identical to SEQ ID NO: 276470

SEQ ID NO: 276659 - RNA, 64 nt, Human; identical to SEQ ID NO: 276471

SEQ ID NO: 276660 - RNA, 64 nt, Human; identical to SEQ ID NO: 276472

SEQ ID NO: 276661 - RNA, 64 nt, Human; identical to SEQ ID NO: 276473

SEQ ID NO: 276662 - RNA, 64 nt, Human; identical to SEQ ID NO: 276474

SEQ ID NO: 276663 - RNA, 64 nt, Human; identical to SEQ ID NO: 276475

SEQ ID NO: 276664 - RNA, 64 nt, Human; identical to SEQ ID NO: 276382

SEQ ID NO: 276665 - RNA, 64 nt, Human; identical to SEQ ID NO: 276383

SEQ ID NO: 276666 - RNA, 64 nt, Human; identical to SEQ ID NO: 276384

SEQ ID NO: 276667 - RNA, 64 nt, Human; identical to SEQ ID NO: 276385

SEQ ID NO: 276668 - RNA, 63 nt, Human
aaaaauauaaccgaaaguuggccgacugcacuugcuauggaauaagaccuuuuauucucccuc

SEQ ID NO: 276669 - RNA, 63 nt, Human
uccuuucuguccuggagacagguggccucucuggcuauggauguguggguacuugguggggac

SEQ ID NO: 276670 - RNA, 62 nt, Human
acuguuuucugagaaauguagcauccgcugcagcuggccacacugagggcccucugggaacc

SEQ ID NO: 276671 - RNA, 64 nt, Human; identical to SEQ ID NO: 276386

SEQ ID NO: 276672 - RNA, 64 nt, Human; identical to SEQ ID NO: 276387

SEQ ID NO: 276673 - RNA, 64 nt, Human; identical to SEQ ID NO: 276388

SEQ ID NO: 276674 - RNA, 64 nt, Human; identical to SEQ ID NO: 276392

SEQ ID NO: 276675 - RNA, 64 nt, Human; identical to SEQ ID NO: 276393

SEQ ID NO: 276676 - RNA, 64 nt, Human; identical to SEQ ID NO: 276394

SEQ ID NO: 276677 - RNA, 64 nt, Human; identical to SEQ ID NO: 276395

SEQ ID NO: 276678 - RNA, 64 nt, Human; identical to SEQ ID NO: 276396

SEQ ID NO: 276679 - RNA, 64 nt, Human; identical to SEQ ID NO: 276397

SEQ ID NO: 276680 - RNA, 64 nt, Human; identical to SEQ ID NO: 276398

SEQ ID NO: 276681 - RNA, 64 nt, Human; identical to SEQ ID NO: 276399

SEQ ID NO: 276682 - RNA, 64 nt, Human; identical to SEQ ID NO: 276400

SEQ ID NO: 276683 - RNA, 64 nt, Human; identical to SEQ ID NO: 276401

SEQ ID NO: 276684 - RNA, 55 nt, Human; identical to SEQ ID NO: 276402

SEQ ID NO: 276685 - RNA, 64 nt, Human; identical to SEQ ID NO: 276403

SEQ ID NO: 276686 - RNA, 64 nt, Human; identical to SEQ ID NO: 276404

SEQ ID NO: 276687 - RNA, 63 nt, Human
uaucacucuucagguuuagcuuacagagccauggcuauggauucuuagcucuguaaggaagug

SEQ ID NO: 276688 - RNA, 63 nt, Human
guugcuuuaagaaguaauuauaauuaggaauaggcuauggaugugauacuugguauuuuuuaa

SEQ ID NO: 276689 - RNA, 63 nt, Human
agccucugaccuuucccugggcuucaaaggaaggcuauggaguuugcugugggcccugcaacc

SEQ ID NO: 276690 - RNA, 64 nt, Human; identical to SEQ ID NO: 276405

SEQ ID NO: 276691 - RNA, 64 nt, Human; identical to SEQ ID NO: 276406

SEQ ID NO: 276692 - RNA, 64 nt, Human; identical to SEQ ID NO: 276407

SEQ ID NO: 276693 - RNA, 64 nt, Human; identical to SEQ ID NO: 276411

SEQ ID NO: 276694 - RNA, 64 nt, Human; identical to SEQ ID NO: 276412

SEQ ID NO: 276695 - RNA, 64 nt, Human; identical to SEQ ID NO: 276413

SEQ ID NO: 276696 - RNA, 64 nt, Human; identical to SEQ ID NO: 276414

SEQ ID NO: 276697 - RNA, 64 nt, Human; identical to SEQ ID NO: 276415

SEQ ID NO: 276698 - RNA, 64 nt, Human; identical to SEQ ID NO: 276416

SEQ ID NO: 276699 - RNA, 64 nt, Human; identical to SEQ ID NO: 276417

SEQ ID NO: 276700 - RNA, 64 nt, Human; identical to SEQ ID NO: 276418

SEQ ID NO: 276701 - RNA, 64 nt, Human; identical to SEQ ID NO: 276419

SEQ ID NO: 276702 - RNA, 64 nt, Human; identical to SEQ ID NO: 276420

SEQ ID NO: 276703 - RNA, 64 nt, Human; identical to SEQ ID NO: 276421

SEQ ID NO: 276704 - RNA, 64 nt, Human; identical to SEQ ID NO: 276422

SEQ ID NO: 276705 - RNA, 64 nt, Human; identical to SEQ ID NO: 276423

SEQ ID NO: 276706 - RNA, 63 nt, Human
aaugucucuucuguucauugcucuccagagaaugcuauggacaagaaucaaauuuuaccagga

SEQ ID NO: 276707 - RNA, 63 nt, Human
cucacacgagaaacagugaggcugaaagggggggcuauggaagagcgguagggaguccacgga

SEQ ID NO: 276708 - RNA, 63 nt, Human
uuaauagcaaaagauauuaaauaugcuaacauagcuauggaggaauugagggcaagcacccag

SEQ ID NO: 276709 - RNA, 64 nt, Human; identical to SEQ ID NO: 276424

SEQ ID NO: 276710 - RNA, 64 nt, Human; identical to SEQ ID NO: 276425

SEQ ID NO: 276711 - RNA, 64 nt, Human; identical to SEQ ID NO: 276426

SEQ ID NO: 276712 - RNA, 64 nt, Human; identical to SEQ ID NO: 276430

SEQ ID NO: 276713 - RNA, 64 nt, Human; identical to SEQ ID NO: 276431

SEQ ID NO: 276714 - RNA, 64 nt, Human; identical to SEQ ID NO: 276432

SEQ ID NO: 276715 - RNA, 64 nt, Human; identical to SEQ ID NO: 276433

SEQ ID NO: 276716 - RNA, 64 nt, Human; identical to SEQ ID NO: 276434

SEQ ID NO: 276717 - RNA, 64 nt, Human; identical to SEQ ID NO: 276435

SEQ ID NO: 276718 - RNA, 64 nt, Human; identical to SEQ ID NO: 276436

SEQ ID NO: 276719 - RNA, 64 nt, Human; identical to SEQ ID NO: 276437

SEQ ID NO: 276720 - RNA, 64 nt, Human; identical to SEQ ID NO: 276438

SEQ ID NO: 276721 - RNA, 64 nt, Human; identical to SEQ ID NO: 276439

SEQ ID NO: 276722 - RNA, 64 nt, Human; identical to SEQ ID NO: 276440

SEQ ID NO: 276723 - RNA, 64 nt, Human; identical to SEQ ID NO: 276441

SEQ ID NO: 276724 - RNA, 64 nt, Human; identical to SEQ ID NO: 276442

SEQ ID NO: 276725 - RNA, 63 nt, Human
gagguccaaaaaaggcugcccugggccauaugugcuauggagaggacucucccaaacccccaa

SEQ ID NO: 276726 - RNA, 63 nt, Human
gcagaucgcucacuguugugaaucaccaaaggagcuauggagagaauuaaaacucaacauuac

SEQ ID NO: 276727 - RNA, 63 nt, Human
cucuagaaauauaaagcaaagcacuauuccaaggcuauggaguagcucuacagccuggccuca

SEQ ID NO: 276728 - RNA, 51 nt, Human; identical to SEQ ID NO: 276443

SEQ ID NO: 276729 - RNA, 64 nt, Human; identical to SEQ ID NO: 276444

SEQ ID NO: 276730 - RNA, 64 nt, Human; identical to SEQ ID NO: 276445

SEQ ID NO: 276731 - RNA, 64 nt, Human; identical to SEQ ID NO: 276449

SEQ ID NO: 276732 - RNA, 64 nt, Human; identical to SEQ ID NO: 276450

SEQ ID NO: 276733 - RNA, 64 nt, Human; identical to SEQ ID NO: 276451

SEQ ID NO: 276734 - RNA, 64 nt, Human; identical to SEQ ID NO: 276452

SEQ ID NO: 276735 - RNA, 64 nt, Human; identical to SEQ ID NO: 276453

SEQ ID NO: 276736 - RNA, 64 nt, Human; identical to SEQ ID NO: 276454

SEQ ID NO: 276737 - RNA, 64 nt, Human; identical to SEQ ID NO: 276455

SEQ ID NO: 276738 - RNA, 64 nt, Human; identical to SEQ ID NO: 276456

SEQ ID NO: 276739 - RNA, 64 nt, Human; identical to SEQ ID NO: 276457

SEQ ID NO: 276740 - RNA, 64 nt, Human; identical to SEQ ID NO: 276458

SEQ ID NO: 276741 - RNA, 64 nt, Human; identical to SEQ ID NO: 276459

SEQ ID NO: 276742 - RNA, 64 nt, Human; identical to SEQ ID NO: 276460

SEQ ID NO: 276743 - RNA, 64 nt, Human; identical to SEQ ID NO: 276461

SEQ ID NO: 276744 - RNA, 64 nt, Human; identical to SEQ ID NO: 143554

SEQ ID NO: 276745 - RNA, 64 nt, Human; identical to SEQ ID NO: 3902

SEQ ID NO: 276746 - RNA, 64 nt, Human; identical to SEQ ID NO: 117960

SEQ ID NO: 276747 - RNA, 64 nt, Human; identical to SEQ ID NO: 276462

SEQ ID NO: 276748 - RNA, 64 nt, Human; identical to SEQ ID NO: 276463

SEQ ID NO: 276749 - RNA, 64 nt, Human; identical to SEQ ID NO: 276464

SEQ ID NO: 276750 - RNA, 64 nt, Human; identical to SEQ ID NO: 276468

SEQ ID NO: 276751 - RNA, 64 nt, Human; identical to SEQ ID NO: 276469

SEQ ID NO: 276752 - RNA, 64 nt, Human; identical to SEQ ID NO: 276470

SEQ ID NO: 276753 - RNA, 64 nt, Human; identical to SEQ ID NO: 276471

SEQ ID NO: 276754 - RNA, 64 nt, Human; identical to SEQ ID NO: 276472

SEQ ID NO: 276755 - RNA, 64 nt, Human; identical to SEQ ID NO: 276473

SEQ ID NO: 276756 - RNA, 64 nt, Human; identical to SEQ ID NO: 276474

SEQ ID NO: 276757 - RNA, 64 nt, Human; identical to SEQ ID NO: 276475

SEQ ID NO: 276758 - RNA, 64 nt, Human; identical to SEQ ID NO: 276382

SEQ ID NO: 276759 - RNA, 64 nt, Human; identical to SEQ ID NO: 276383

SEQ ID NO: 276760 - RNA, 64 nt, Human; identical to SEQ ID NO: 276384

SEQ ID NO: 276761 - RNA, 63 nt, Human
gggggccaaaaccucugcaguccccggcagugagcuauggacuuucuucccccucacaaggcu

SEQ ID NO: 276762 - RNA, 63 nt, Human
gcucaggcugcagcuggacagaggggacucugggcuauggacacagggugacggugacaaaga

SEQ ID NO: 276763 - RNA, 63 nt, Human
cccagacaucugacacccuaaaagccauccacagcuauggaaccugagcgacaccuugauuug

SEQ ID NO: 276764 - RNA, 64 nt, Human; identical to SEQ ID NO: 276385

SEQ ID NO: 276765 - RNA, 64 nt, Human; identical to SEQ ID NO: 276386

SEQ ID NO: 276766 - RNA, 64 nt, Human; identical to SEQ ID NO: 276387

SEQ ID NO: 276767 - RNA, 64 nt, Human; identical to SEQ ID NO: 276388

SEQ ID NO: 276768 - RNA, 64 nt, Human; identical to SEQ ID NO: 276392

SEQ ID NO: 276769 - RNA, 64 nt, Human; identical to SEQ ID NO: 276393

SEQ ID NO: 276770 - RNA, 64 nt, Human; identical to SEQ ID NO: 276394

SEQ ID NO: 276771 - RNA, 64 nt, Human; identical to SEQ ID NO: 276395

SEQ ID NO: 276772 - RNA, 64 nt, Human; identical to SEQ ID NO: 276396

SEQ ID NO: 276773 - RNA, 64 nt, Human; identical to SEQ ID NO: 276397

SEQ ID NO: 276774 - RNA, 64 nt, Human; identical to SEQ ID NO: 276398

SEQ ID NO: 276775 - RNA, 64 nt, Human; identical to SEQ ID NO: 276399

SEQ ID NO: 276776 - RNA, 64 nt, Human; identical to SEQ ID NO: 276400

SEQ ID NO: 276777 - RNA, 64 nt, Human; identical to SEQ ID NO: 276401

SEQ ID NO: 276778 - RNA, 55 nt, Human; identical to SEQ ID NO: 276402

SEQ ID NO: 276779 - RNA, 64 nt, Human; identical to SEQ ID NO: 276403

SEQ ID NO: 276780 - RNA, 63 nt, Human
cgugaaaggcaggaccuggucaccccagcaagugcuauggacaguucccggaaacgguugccc

SEQ ID NO: 276781 - RNA, 63 nt, Human
ugacauuuuauuuaaucacuuccaagagccaaagcuauggaaauacaguguuguccaucuuag

SEQ ID NO: 276782 - RNA, 63 nt, Human
acuuccuucucugccccauugccucccaaauaugcuauggagcuauuuuuguuaccacguuau

SEQ ID NO: 276783 - RNA, 64 nt, Human; identical to SEQ ID NO: 276404

SEQ ID NO: 276784 - RNA, 64 nt, Human; identical to SEQ ID NO: 276405

SEQ ID NO: 276785 - RNA, 64 nt, Human; identical to SEQ ID NO: 276406

SEQ ID NO: 276786 - RNA, 64 nt, Human; identical to SEQ ID NO: 276407

SEQ ID NO: 276787 - RNA, 64 nt, Human; identical to SEQ ID NO: 276411

SEQ ID NO: 276788 - RNA, 64 nt, Human; identical to SEQ ID NO: 276412

SEQ ID NO: 276789 - RNA, 64 nt, Human; identical to SEQ ID NO: 276413

SEQ ID NO: 276790 - RNA, 64 nt, Human; identical to SEQ ID NO: 276414

SEQ ID NO: 276791 - RNA, 64 nt, Human; identical to SEQ ID NO: 276415

SEQ ID NO: 276792 - RNA, 64 nt, Human; identical to SEQ ID NO: 276416

SEQ ID NO: 276793 - RNA, 64 nt, Human; identical to SEQ ID NO: 276417

SEQ ID NO: 276794 - RNA, 64 nt, Human; identical to SEQ ID NO: 276418

SEQ ID NO: 276795 - RNA, 64 nt, Human; identical to SEQ ID NO: 276419

SEQ ID NO: 276796 - RNA, 64 nt, Human; identical to SEQ ID NO: 276420

SEQ ID NO: 276797 - RNA, 64 nt, Human; identical to SEQ ID NO: 276421

SEQ ID NO: 276798 - RNA, 64 nt, Human; identical to SEQ ID NO: 276422

SEQ ID NO: 276799 - RNA, 63 nt, Human
acuacgcagggaucuuccacuuccaguucuggcgcuauggagaguggguggacgugguuauag

SEQ ID NO: 276800 - RNA, 63 nt, Human
ggauuuguuuaggugcccauugcaucuuuuugugcuauggaguuguuuacauuaagcaugacc

SEQ ID NO: 276801 - RNA, 63 nt, Human
aaugccuuuuuuuuuuuuucauagucaaaguuagcuauggaguuucuguaguauucacuacuc

SEQ ID NO: 276802 - RNA, 64 nt, Human; identical to SEQ ID NO: 276423

SEQ ID NO: 276803 - RNA, 64 nt, Human; identical to SEQ ID NO: 276424

SEQ ID NO: 276804 - RNA, 64 nt, Human; identical to SEQ ID NO: 276425

SEQ ID NO: 276805 - RNA, 64 nt, Human; identical to SEQ ID NO: 276426

SEQ ID NO: 276806 - RNA, 64 nt, Human; identical to SEQ ID NO: 276430

SEQ ID NO: 276807 - RNA, 64 nt, Human; identical to SEQ ID NO: 276431

SEQ ID NO: 276808 - RNA, 64 nt, Human; identical to SEQ ID NO: 276432

SEQ ID NO: 276809 - RNA, 64 nt, Human; identical to SEQ ID NO: 276433

SEQ ID NO: 276810 - RNA, 64 nt, Human; identical to SEQ ID NO: 276434

SEQ ID NO: 276811 - RNA, 64 nt, Human; identical to SEQ ID NO: 276435

SEQ ID NO: 276812 - RNA, 64 nt, Human; identical to SEQ ID NO: 276436

SEQ ID NO: 276813 - RNA, 64 nt, Human; identical to SEQ ID NO: 276437

SEQ ID NO: 276814 - RNA, 64 nt, Human; identical to SEQ ID NO: 276438

SEQ ID NO: 276815 - RNA, 64 nt, Human; identical to SEQ ID NO: 276439

SEQ ID NO: 276816 - RNA, 64 nt, Human; identical to SEQ ID NO: 276440

SEQ ID NO: 276817 - RNA, 64 nt, Human; identical to SEQ ID NO: 276441

SEQ ID NO: 276818 - RNA, 63 nt, Human
cagcaaauaggauccaacacaggcaauauuccagcuauggagcuagcuuuaaaaaggaacagu

SEQ ID NO: 276819 - RNA, 63 nt, Human
gaacucaccuccguuagcgcacugugucagcgggcuauggacaaggaagaauaguggcagaug

SEQ ID NO: 276820 - RNA, 63 nt, Human
uaaugucugcuguaauauauuugcacaguagaugcuauggaucauucugagcucaggguccag

SEQ ID NO: 276821 - RNA, 64 nt, Human; identical to SEQ ID NO: 276442

SEQ ID NO: 276822 - RNA, 51 nt, Human; identical to SEQ ID NO: 276443

SEQ ID NO: 276823 - RNA, 64 nt, Human; identical to SEQ ID NO: 276444

SEQ ID NO: 276824 - RNA, 64 nt, Human; identical to SEQ ID NO: 276445

SEQ ID NO: 276825 - RNA, 64 nt, Human; identical to SEQ ID NO: 276449

SEQ ID NO: 276826 - RNA, 64 nt, Human; identical to SEQ ID NO: 276450

SEQ ID NO: 276827 - RNA, 64 nt, Human; identical to SEQ ID NO: 276451

SEQ ID NO: 276828 - RNA, 64 nt, Human; identical to SEQ ID NO: 276452

SEQ ID NO: 276829 - RNA, 64 nt, Human; identical to SEQ ID NO: 276453

SEQ ID NO: 276830 - RNA, 64 nt, Human; identical to SEQ ID NO: 276454

SEQ ID NO: 276831 - RNA, 64 nt, Human; identical to SEQ ID NO: 276455

SEQ ID NO: 276832 - RNA, 64 nt, Human; identical to SEQ ID NO: 276456

SEQ ID NO: 276833 - RNA, 64 nt, Human; identical to SEQ ID NO: 276457

SEQ ID NO: 276834 - RNA, 64 nt, Human; identical to SEQ ID NO: 276458

SEQ ID NO: 276835 - RNA, 64 nt, Human; identical to SEQ ID NO: 276459

SEQ ID NO: 276836 - RNA, 64 nt, Human; identical to SEQ ID NO: 276460

SEQ ID NO: 276837 - RNA, 63 nt, Human
aagaccuauucagaguuucaucuggggaugaaagcuauggaagaugauguacaaauguuauug

SEQ ID NO: 276838 - RNA, 63 nt, Human
cccuggauaugcucuuguuuuuucccucuaauagcuauggaaagaugcauagaaagaguauaa

SEQ ID NO: 276839 - RNA, 63 nt, Human
gucaccugacugguuuuggagguucuguccacugcuauggagcagaguuuucccauuuucaga

SEQ ID NO: 276840 - RNA, 64 nt, Human; identical to SEQ ID NO: 276461

SEQ ID NO: 276841 - RNA, 64 nt, Human; identical to SEQ ID NO: 276462

SEQ ID NO: 276842 - RNA, 64 nt, Human; identical to SEQ ID NO: 276463

SEQ ID NO: 276843 - RNA, 64 nt, Human; identical to SEQ ID NO: 276464

SEQ ID NO: 276844 - RNA, 64 nt, Human; identical to SEQ ID NO: 276468

SEQ ID NO: 276845 - RNA, 64 nt, Human; identical to SEQ ID NO: 276469

SEQ ID NO: 276846 - RNA, 64 nt, Human; identical to SEQ ID NO: 276470

SEQ ID NO: 276847 - RNA, 64 nt, Human; identical to SEQ ID NO: 276471

SEQ ID NO: 276848 - RNA, 64 nt, Human; identical to SEQ ID NO: 276472

SEQ ID NO: 276849 - RNA, 64 nt, Human; identical to SEQ ID NO: 276473

SEQ ID NO: 276850 - RNA, 64 nt, Human; identical to SEQ ID NO: 276474

SEQ ID NO: 276851 - RNA, 64 nt, Human; identical to SEQ ID NO: 276475

SEQ ID NO: 276852 - RNA, 64 nt, Human; identical to SEQ ID NO: 143547

SEQ ID NO: 276853 - RNA, 64 nt, Human; identical to SEQ ID NO: 143548

SEQ ID NO: 276854 - RNA, 64 nt, Human; identical to SEQ ID NO: 143549

SEQ ID NO: 276855 - RNA, 64 nt, Human; identical to SEQ ID NO: 143550

SEQ ID NO: 276856 - RNA, 64 nt, Human; identical to SEQ ID NO: 122462

SEQ ID NO: 276857 - RNA, 64 nt, Human; identical to SEQ ID NO: 122479

SEQ ID NO: 276858 - RNA, 64 nt, Human; identical to SEQ ID NO: 143558

SEQ ID NO: 276859 - RNA, 50 nt, Human; identical to SEQ ID NO: 14033

SEQ ID NO: 276860 - RNA, 64 nt, Human; identical to SEQ ID NO: 143560

SEQ ID NO: 276861 - RNA, 64 nt, Human; identical to SEQ ID NO: 3867

SEQ ID NO: 276862 - RNA, 52 nt, Human; identical to SEQ ID NO: 14036

SEQ ID NO: 276863 - RNA, 64 nt, Human; identical to SEQ ID NO: 120464

SEQ ID NO: 276864 - RNA, 64 nt, Human; identical to SEQ ID NO: 143564

SEQ ID NO: 276865 - RNA, 64 nt, Human; identical to SEQ ID NO: 143565

SEQ ID NO: 276866 - RNA, 64 nt, Human; identical to SEQ ID NO: 143566

SEQ ID NO: 276867 - RNA, 64 nt, Human; identical to SEQ ID NO: 3868

SEQ ID NO: 276868 - RNA, 64 nt, Human; identical to SEQ ID NO: 116087

SEQ ID NO: 276869 - RNA, 64 nt, Human; identical to SEQ ID NO: 121900

SEQ ID NO: 276870 - RNA, 64 nt, Human; identical to SEQ ID NO: 143570

SEQ ID NO: 276871 - RNA, 64 nt, Human; identical to SEQ ID NO: 143571

SEQ ID NO: 276872 - RNA, 64 nt, Human; identical to SEQ ID NO: 143572

SEQ ID NO: 276873 - RNA, 64 nt, Human; identical to SEQ ID NO: 3869

SEQ ID NO: 276874 - RNA, 64 nt, Human; identical to SEQ ID NO: 116105

SEQ ID NO: 276875 - RNA, 63 nt, Human
ugcuuuuguuuuuuuuuuuuuuuuuuugccagggcuauggaguggggguuguuugucaaacug

SEQ ID NO: 276876 - RNA, 63 nt, Human
agagguggagagccaugccuguucuccuuccuugcuauggaauuugcugacacaauaucuucc

SEQ ID NO: 276877 - RNA, 64 nt, Human; identical to SEQ ID NO: 122007

SEQ ID NO: 276878 - RNA, 64 nt, Human; identical to SEQ ID NO: 143576

SEQ ID NO: 276879 - RNA, 64 nt, Human; identical to SEQ ID NO: 143577

SEQ ID NO: 276880 - RNA, 64 nt, Human; identical to SEQ ID NO: 143578

SEQ ID NO: 276881 - RNA, 64 nt, Human; identical to SEQ ID NO: 3883

SEQ ID NO: 276882 - RNA, 64 nt, Human; identical to SEQ ID NO: 116531

SEQ ID NO: 276883 - RNA, 64 nt, Human; identical to SEQ ID NO: 122428

SEQ ID NO: 276884 - RNA, 64 nt, Human; identical to SEQ ID NO: 143582

SEQ ID NO: 276885 - RNA, 64 nt, Human; identical to SEQ ID NO: 143583

SEQ ID NO: 276886 - RNA, 64 nt, Human; identical to SEQ ID NO: 143584

SEQ ID NO: 276887 - RNA, 64 nt, Human; identical to SEQ ID NO: 3884

SEQ ID NO: 276888 - RNA, 64 nt, Human; identical to SEQ ID NO: 117553

SEQ ID NO: 276889 - RNA, 64 nt, Human; identical to SEQ ID NO: 122445

SEQ ID NO: 276890 - RNA, 64 nt, Human; identical to SEQ ID NO: 143588

SEQ ID NO: 276891 - RNA, 64 nt, Human; identical to SEQ ID NO: 143589

SEQ ID NO: 276892 - RNA, 64 nt, Human; identical to SEQ ID NO: 143590

SEQ ID NO: 276893 - RNA, 64 nt, Human; identical to SEQ ID NO: 3885

SEQ ID NO: 276894 - RNA, 63 nt, Human
ccucuggaauaaaacauacaggagucugucucugcuauggaaugccccauggggcaucucuug

SEQ ID NO: 276895 - RNA, 63 nt, Human
ggagucagacauuuuaagaugguggcaguagaggcuauggacagggcaugccacgugggcuca

SEQ ID NO: 276896 - RNA, 63 nt, Human
agccccugggcagccgggcagaagggaauccaggcuauggaccucccaaguccccgcuccccg

SEQ ID NO: 276897 - RNA, 64 nt, Human
ucuccugcugcugggaccugcuccccugucucuucuccgugaccuuucucuagccagggagaag

SEQ ID NO: 276898 - RNA, 64 nt, Human
gaaucggcagaggccuccguggugaagacagaagcuccgugaaccaacucgaggcuggagccaa

SEQ ID NO: 276899 - RNA, 64 nt, Human
ccccugccccaguuuaccguuccucccucagggccuccgugacacuccaugaaaagaaguucuu

SEQ ID NO: 276900 - RNA, 64 nt, Human
uuugucuucauuuggugcuuuugguuuugcaccucuccgugauuguagcccuaccagcauguua

SEQ ID NO: 276901 - RNA, 64 nt, Human
accugcuuucagagcaaaacucaagucccucuuccuccgugaagcuucucccucagcugagcag

SEQ ID NO: 276902 - RNA, 63 nt, Human
augcagcugauuuaugaaagagagggcuacacugcuauggaaacuuagcuucaaagaaaaugc

SEQ ID NO: 276903 - RNA, 63 nt, Human
cagccagucuacuccauguccuguuaacagaaagcuauggauucccuggaugaaauccaagga

SEQ ID NO: 276904 - RNA, 63 nt, Human
cuaucaaggucaacuggcaguuuuauuaccuuugcuauggacuugaacuuacuguauaaaauu

SEQ ID NO: 276905 - RNA, 64 nt, Human
gccaauagauaugugaguuaauuuuuuuaaauaucuccgugaguuguaaauagauguguauuug

SEQ ID NO: 276906 - RNA, 64 nt, Human
cgucgcugcuugaacacagugccuggacucccugcuccgugaggcgaauuuacaccggguccag

SEQ ID NO: 276907 - RNA, 64 nt, Human
aacuguaaacgguaaagagauuuuuacuuuuggucuccgugagucgcaucucuacuaagguuua

SEQ ID NO: 276908 - RNA, 64 nt, Human
cauggugcuacuuccucugucagcuacagaaagccuccgugacaccguccaccagagcucuggg

SEQ ID NO: 276909 - RNA, 64 nt, Human
ucugaugcacucucuuccaucucuuuccccaaggcuccgugacugucaaacugggaguaggaga

SEQ ID NO: 276910 - RNA, 64 nt, Human
agcuugcucacuuugcuggccuuugaaauguguucuccgugauaagcuauccauguguuuguga

SEQ ID NO: 276911 - RNA, 64 nt, Human
ugggaccugagcagguuuggugaaagccaccguccuccgugacacacggcccccuuccuccugu

SEQ ID NO: 276912 - RNA, 64 nt, Human
gugaauggguuucccauaggggaaguuggccucccuccgugagcuuuggaaauguuuucuaaua

SEQ ID NO: 276913 - RNA, 64 nt, Human
cugcccacagagucugauucaggaugacguggaccuccgugacacacggaggcacugugacaag

SEQ ID NO: 276914 - RNA, 64 nt, Human
aaauaaauuaauaaauauauucuguauuuuugcucuccgugaaaaacaaaagagccucugacau

SEQ ID NO: 276915 - RNA, 64 nt, Human
acugagaaagcccccucccugcucuaagaaggggcuccgugaaguucuucccagagccgcgcug

SEQ ID NO: 276916 - RNA, 64 nt, Human
cacuguuccucguaugugaaggaggcagugcugacuccgugagugugagacacgugcuuugaac

SEQ ID NO: 276917 - RNA, 64 nt, Human
guugguuucuuggucguccuuugagugacaacuucuccgugaaccugcugaagaggcagaaagg

SEQ ID NO: 276918 - RNA, 64 nt, Human
gaucaauuaaauguagguaugaauaaguucgaagcuccgugagugaaccaucauuauaaacgug

SEQ ID NO: 276919 - RNA, 64 nt, Human
agugggcccccggcugccacuguuugcugguggucuccgugacccccuccucaccugcugguug

SEQ ID NO: 276920 - RNA, 64 nt, Human
cgagaccagccugggcaacauggugaaacccuaucuccgugaaaaaauaugaaaauuagccaag

SEQ ID NO: 276921 - RNA, 63 nt, Human
ucuuccuucccucaacucucugcccuccacagagcuauggagaaggcuggagaugaaagcuuu

SEQ ID NO: 276922 - RNA, 63 nt, Human
acaacugccagugcccaucaaacaggagugugcgcuauggaaaaccaggccagagggucacug

SEQ ID NO: 276923 - RNA, 63 nt, Human
accucacucagucacauuguaggagccaguguagcuauggaauuaucuuaggaacucaagcuu

SEQ ID NO: 276924 - RNA, 64 nt, Human
gugagccuggggacgacauggcaggcuggucccccuccgugaaaguguggauuccuacuuccug

SEQ ID NO: 276925 - RNA, 64 nt, Human
ugugaaguggcuauuucuuuauauuuauccacuacuccgugaaggcuucucuguucuacccguu

SEQ ID NO: 276926 - RNA, 64 nt, Human
ugguacuguuauucauaagucauauuaacauucucuccgugaaaucaugguacagucacugccc

SEQ ID NO: 276927 - RNA, 64 nt, Human
gauggacuggaucagcuugaaagaagcacaaagacuccgugaucacaauagucaaagacuggcu

SEQ ID NO: 276928 - RNA, 64 nt, Human
auuauaucuguaaaaucccuugguaaaggaaaagcuccgugaaaaugucaguuacuuuuacuaa

SEQ ID NO: 276929 - RNA, 64 nt, Human
caaguaauugaaaagacacuccuccacuuauccccuccgugauauggcucuucgcaugcugagu

SEQ ID NO: 276930 - RNA, 64 nt, Human
gcacccccccaccccacgaccuuggcccgagccccuccgugaggaacacaaucucaaucguugc

SEQ ID NO: 276931 - RNA, 64 nt, Human
auaguguacuguacacaaccagauguguuccacacuccgugacuccgcaguuuguccuggagug

SEQ ID NO: 276932 - RNA, 64 nt, Human
agacgucaguggucucuggggcacccacacgcgccuccgugauacccucgggcaccuccugguc

SEQ ID NO: 276933 - RNA, 64 nt, Human
gggaguaccugcugccccagcugacuguggcccccuccgugauccauccaucuccagggagcaa

SEQ ID NO: 276934 - RNA, 64 nt, Human
gucccuuuaacugguauaugauuauaaaauuuuucuccgugagcuguuucauuuccuugaugau

SEQ ID NO: 276935 - RNA, 64 nt, Human
ugaugccguccccugugcggucugaugcgccuuccuccgugacgccuucagcuucuuuugucgu

SEQ ID NO: 276936 - RNA, 64 nt, Human
gcccugcagcuucaggucccuaugggcgcagcugcuccgugagcugagucucccacugcccugc

SEQ ID NO: 276937 - RNA, 64 nt, Human
gacgaccccaccaguggggugcccgcugccuguccuccgugaaaccagccucagaucagggccc

SEQ ID NO: 276938 - RNA, 64 nt, Human
agcgccccuccaaccaggcuguuauuccccuggacuccgugacaucuguggaauuuuuuagcuc

SEQ ID NO: 276939 - RNA, 64 nt, Human
gggaguccaagggccggugagggaggguauugcccuccgugagcacagagacucuccaugggag

SEQ ID NO: 276940 - RNA, 63 nt, Human
cguccggaaccuagaagaggcuucauggccagggcuauggauucuuugcucuggaugaagcug

SEQ ID NO: 276941 - RNA, 63 nt, Human
uguuaagccucuuauucuaaaguccauagcaaugcuauggaauaucaaguauaaugauguagu

SEQ ID NO: 276942 - RNA, 63 nt, Human
ccacacggaagaguagcuacauacacuucaucagcuauggaucaucaacggcaauuuuuccuu

SEQ ID NO: 276943 - RNA, 64 nt, Human
cuagguuggggaagaugcuauugggaaaccucuucuccgugacacagaauguucugggugggag

SEQ ID NO: 276944 - RNA, 64 nt, Human
uggccuaccuggggaagcugcgggcacccauccgcuccgugaccuacacccuggcccagcuccc

SEQ ID NO: 276945 - RNA, 64 nt, Human
gccagugccaaacacacacuaacuguccuggccucuccgugacacaagucucuucccagccuuc

SEQ ID NO: 276946 - RNA, 64 nt, Human
gcagcaguacagccagacccaagaccuagguggccuccgugagcuggaccgcgcugcugagcca

SEQ ID NO: 276947 - RNA, 64 nt, Human
ccgaaacgggaaguacauauuggggcaugguggccuccgugagcaaauggugucuugggcaauc

SEQ ID NO: 276948 - RNA, 64 nt, Human
uccaucugugcuuauuacuugaggacugugucugcuccgugagagcugcgugggcagggcugca

SEQ ID NO: 276949 - RNA, 64 nt, Human
gagugaagcugccagagcccuccucaguggcacgcuccgugaagaaguaguacaccuugucauc

SEQ ID NO: 276950 - RNA, 64 nt, Human
cacuuguuuuucucuuccagcugcagagcccuugcuccgugagcaaagccugggugcccaagca

SEQ ID NO: 276951 - RNA, 64 nt, Human
uucucuuuucuauuuauauguguggcuuaggacccuccgugaacagaugauagagggcaucucu

SEQ ID NO: 276952 - RNA, 64 nt, Human
auuguuucccaucacuguauccauucuaccuguccuccgugaaaauauguuuggaauauuccac

SEQ ID NO: 276953 - RNA, 64 nt, Human
guacccugacugcacuacagugguuuaucuaugacuccgugaaggucuacuucagacuuccucg

SEQ ID NO: 276954 - RNA, 64 nt, Human
gucgcccauuacuccucaggccuggcccucgggccuccgugaugggagccccccaggagggguc

SEQ ID NO: 276955 - RNA, 64 nt, Human
aacagguucugggccuggaacuucugccuccuuccuccgugaucugccaggcucgugggcacuu

SEQ ID NO: 276956 - RNA, 64 nt, Human
gaacugaaguauuucugaucacucucagacuguccuccgugauuuaugcugacuuaacuguuua

SEQ ID NO: 276957 - RNA, 64 nt, Human
gggcagcagcugggccuucgaggcgcaccuuccccuccgugaaaccuggggugggacugucccc

SEQ ID NO: 276958 - RNA, 64 nt, Human
cagcacuaguauuucauguugcacacccacucagcuccgugaacuugugagaacacagccgauu

SEQ ID NO: 276959 - RNA, 63 nt, Human
gauauuggcacacugagaaauucauuuuguagagcuauggauaaggcuugcuaugauuugcac

SEQ ID NO: 276960 - RNA, 63 nt, Human
ucuuggcuuuuacugggugcaagguaaauaauggcuauggauuuuguuuugcuuucuguuuug

SEQ ID NO: 276961 - RNA, 63 nt, Human
auagaagaaccugucccuagaggcgacuucauugcuauggaucuggagucucugaacucuuaa

SEQ ID NO: 276962 - RNA, 64 nt, Human
caaacuaccaauuucucguuccugaagccacucccuccgugaccacuggccccaggcuuuccca

SEQ ID NO: 276963 - RNA, 64 nt, Human
cauuuagacauaaaacacuuaaguguuuucuucacuccgugaccuggagaguuuuccauuuuuu

SEQ ID NO: 276964 - RNA, 64 nt, Human
cuuuuuuuuuucuuuguuccugugaaauguuaaucuccgugaguucuuccugguucauguguuc

SEQ ID NO: 276965 - RNA, 64 nt, Human
ccagcacugggucagugguguccuggcagugaggcuccgugaggggcuggcccuuagaggaacu

SEQ ID NO: 276966 - RNA, 64 nt, Human
ugcaccuauggcccagccacugcagcacaggaggcuccgugagcccuugguuccuccccgaaaa

SEQ ID NO: 276967 - RNA, 64 nt, Human
caacagaccguuuuccauuucaucuguauuuuaucuccgugacuccaacuuguggguuuguucu

SEQ ID NO: 276968 - RNA, 64 nt, Human
uucggggguccuguugacccauuucgugaccuaccuccgugacugcucuuuuuccucugucucu

SEQ ID NO: 276969 - RNA, 64 nt, Human
cugcccccacccugcacuaccuauuuuugugagucuccgugacccgggucugucugcucaugag

SEQ ID NO: 276970 - RNA, 64 nt, Human
aaucacgccaccuccucucugagccugucucccacuccgugaaauggguaacaucaccucgaag

SEQ ID NO: 276971 - RNA, 64 nt, Human
cuuguuucccucccagccccaaaccuuuuguucucuccgugaaacuuaccuuucccuuuuucuu

SEQ ID NO: 276972 - RNA, 64 nt, Human
guguuuugauaugaaaacucucaugaauaaacaucuccgugaaacgccaaggcccucgucaaac

SEQ ID NO: 276973 - RNA, 64 nt, Human
auucucgccccuucccucucucccugccucacuccuccgugagcaccaccagggcuccaggagc

SEQ ID NO: 276974 - RNA, 64 nt, Human
guacugcacagggaccccccacccaggggaccugcuccgugagauaaugugaaauacgacugug

SEQ ID NO: 276975 - RNA, 64 nt, Human
cuccugcguggggugggacucgcaggggccgggucuccgugacuggggcaacgccucguccugc

SEQ ID NO: 276976 - RNA, 64 nt, Human
cccgcaggcacccgugugacauccgcacguccagcuccgugaccugugugugugugugugugca

SEQ ID NO: 276977 - RNA, 64 nt, Human
gccggcuuccaccacucgccgccccaccccugcacuccgugaccucugagaacccagcuggccc

SEQ ID NO: 276978 - RNA, 63 nt, Human
cacauugagugggaggcuucauccaauggcuuugcuauggaaaucuuggugguguagcuuuuc

SEQ ID NO: 276979 - RNA, 63 nt, Human
aggagccuaguugaagugcuauuaugagugugggcuauggaaagacagcuuuuccuacacuga

SEQ ID NO: 276980 - RNA, 63 nt, Human
uuggaagcaaaacuuuaauuuuauauaacguaugcuauggagagcuaagacaauuuaaggacu

SEQ ID NO: 276981 - RNA, 64 nt, Human
aucccuugauaccugcuggguauugguuccagcacuccgugagccauguccagucccuuuuaua

SEQ ID NO: 276982 - RNA, 64 nt, Human
cagcugcccuagugaggccccagccuaccugcaccuccgugaggcaacugggccacagccccga

SEQ ID NO: 276983 - RNA, 64 nt, Human
gccagcggugccugucggggaggguuccaaggugcuccgugaagagcaugggcaaguugucuga

SEQ ID NO: 276984 - RNA, 64 nt, Human
guaccagccacucaaaagugucugaacagaaccgcuccgugacugguagcugggucugaggauu

SEQ ID NO: 276985 - RNA, 64 nt, Human
aguucucguucauuggcaacagcagaaccugccucuccgugaagucgucagccuaaaauuuguu

SEQ ID NO: 276986 - RNA, 64 nt, Human
ugcuccugguacacggggguacacaccuguaucccuccgugaauaagcaucugguggaccccca

SEQ ID NO: 276987 - RNA, 64 nt, Human
ccugggcuuuagagcuggcuucugcccacacuuucuccgugaaaggaaaacaacuaugagucug

SEQ ID NO: 276988 - RNA, 64 nt, Human
gcccauacagcguguguguggagggggccuugaccuccgugaugucuacugugccucaggauaa

SEQ ID NO: 276989 - RNA, 64 nt, Human
caauccgagccagcucugggggcuccagcguggccuccgugacccaugcgauucaagucgcggc

SEQ ID NO: 276990 - RNA, 64 nt, Human
ccuggguguuggcgguuccgugccugcuccaacucuccgugaggccccucucccagagccugac

SEQ ID NO: 276991 - RNA, 64 nt, Human
aucucccugacaacacaaaacuagagccaggggccuccgugaacucccagagcaugccugauag

SEQ ID NO: 276992 - RNA, 64 nt, Human
ucaggcaagagggccagauaccuaacagguuuuucuccgugaaucuuaugcugaguaguuuuuc

SEQ ID NO: 276993 - RNA, 64 nt, Human
aaggaccacgggaggcccaggugcggaaaggaggcuccgugagaugggguccagcccaucccaa

SEQ ID NO: 276994 - RNA, 64 nt, Human
auugcuuggauucuacgugcagcggguucucugccuccgugaagacaagcugggcuggggagaa

SEQ ID NO: 276995 - RNA, 63 nt, Human
gacagagagagugaauggaggaguaccgagcuggcuauggacuugggugucuggcaaacacag

SEQ ID NO: 276996 - RNA, 57 nt, Human
ggaagauuuucagguuuuaauaaagcagcuauggaggccaagaacaugccagaccaa

SEQ ID NO: 276997 - RNA, 63 nt, Human
agcuuuuauguuauaccauggagccauagaaaggcuauggauuguuuaagaacuauuuuaaag

SEQ ID NO: 276998 - RNA, 56 nt, Human
ggguggagacggacguguagcccuggcgaggccagccggcggcagcacagccuguc

SEQ ID NO: 276999 - RNA, 64 nt, Human
gcuaccuggguaaggacuugccagagaacuacaacgaggccaaaugugucaccuucagccugcu

SEQ ID NO: 277000 - RNA, 64 nt, Human
gaccaucacucaguccaaacaagugaguggcccucgaggccacaguuaugcaacuuucagugug

SEQ ID NO: 277001 - RNA, 64 nt, Human
ccagcugucccaccgguggaugcagaggggaauccgaggccaucaaccuuggugacagcagcgc

SEQ ID NO: 277002 - RNA, 64 nt, Human
acaaugggcacgggguuuucagccacaguucccucgaggccaguguucagcaggaucaugccuu

SEQ ID NO: 277003 - RNA, 64 nt, Human
cuacagagaggcacgggcuccccugaaggauugucgaggccaggguucgggaaguacacugcca

SEQ ID NO: 277004 - RNA, 64 nt, Human
acauggaccccaugaacgaguacaacgcgcugaacgaggccaagcagaugaucgccgucgccga

SEQ ID NO: 277005 - RNA, 64 nt, Human
aggcagagccggagagcgugcugcuggugcauggcgaggccaagaagauggaguuccugaagca

SEQ ID NO: 277006 - RNA, 64 nt, Human
ccuggggaggaccgaggccacacgccacugcccccgaggccagaguguaaguaaaggauaacca

SEQ ID NO: 277007 - RNA, 64 nt, Human
uccacagcgcccuccagaguuaccuggggaggaccgaggccacacgccacugcccccgaggcca

SEQ ID NO: 277008 - RNA, 64 nt, Human
ugagcugcccgccccaccugcucaagucuaaguccgaggccagccuccuccagcugcuggcagg

SEQ ID NO: 277009 - RNA, 64 nt, Human
ccuccuccaggucggagugccuggagucaggugucgaggccacauugcuggcugcccccucuuu

SEQ ID NO: 277010 - RNA, 64 nt, Human
cggcaacaugggcagccugugaccgggucuggggcgaggccaggggccaucaaaaacaggcuga

SEQ ID NO: 277011 - RNA, 64 nt, Human
ggaggccccagaugcgcugugccaaagccagguccgaggccaaaguucucccugccauccuugg

SEQ ID NO: 277012 - RNA, 64 nt, Human
gcccugacgaguaugaagacccagcaguccucuacgaggccauccaguccuucgagaagaaggu

SEQ ID NO: 277013 - RNA, 64 nt, Human
gcugaggcgggcggaucaccugaggucgggaguucgaggccagccugaccaacauggagaaacc

SEQ ID NO: 277014 - RNA, 63 nt, Human
aaagcccccgguucccuugugggggcuuuggcagcuauggaagaaccaaaauaacgugaagaa

SEQ ID NO: 277015 - RNA, 63 nt, Human
ucuggauuuugaauuagauuauuucuguauuuggcuauggaucugauuuuuaauuuuuuuaaa

SEQ ID NO: 277016 - RNA, 63 nt, Human
uaagugauuuguuugucuugaacuguuugaaaagcuauggaagagguuacagugacaugcccu

SEQ ID NO: 277017 - RNA, 64 nt, Human
augccauuugagagugagguggucccugcugcuacgaggccauuguacuguuuuuuccuugagg

SEQ ID NO: 277018 - RNA, 64 nt, Human
gccaaggcagguggaucaccugaggucaagaguucgaggccagccuggccaacauggugaaacc

SEQ ID NO: 277019 - RNA, 64 nt, Human
cagggucaccucuuuuacaguuagaaacaccagccgaggccacagaaucccaucccuuuccuga

SEQ ID NO: 277020 - RNA, 64 nt, Human
gcuuuucccuacuguucccacgcuuccucucucucgaggccacugaaguuuggagucaaaaggc

SEQ ID NO: 277021 - RNA, 64 nt, Human
gaggcagcaugcacggaggcggggucaggggagacgaggccaagcugaggaggugcugcagguc

SEQ ID NO: 277022 - RNA, 64 nt, Human
gcacauuucacuuuggaaacacaguagacucuaucgaggccaggcuuggucacuuccuucccau

SEQ ID NO: 277023 - RNA, 64 nt, Human
aucugauguucagguagaccugggcgccugggaacgaggccaucagcugccaugcacauaacaa

SEQ ID NO: 277024 - RNA, 64 nt, Human
uucucuugcuguuuaccgcccacccagcagcgcccgaggccagggccgccgaagggcagccccg

SEQ ID NO: 277025 - RNA, 64 nt, Human
cugccagccugccccacuggugugugccgggcgccgaggccaggggccccuggcgagaaccgca

SEQ ID NO: 277026 - RNA, 64 nt, Human
ugugaugcaccgggugugcgucgagugagcgucccgaggccacgugcggaggccccucacugug

SEQ ID NO: 277027 - RNA, 64 nt, Human
uguccuggcacacaaggaggcgaggcuaugcguucgaggccaaccuaggcaaaauuggaaaaaa

SEQ ID NO: 277028 - RNA, 64 nt, Human
acaugguauccaugacaacugcugauuccagugucgaggccauuucucuuugccacugagaaau

SEQ ID NO: 277029 - RNA, 64 nt, Human
gggcauugcccucuggcucuguguggagccuuuacgaggccaccugccucucugagggaucuaa

SEQ ID NO: 277030 - RNA, 64 nt, Human
ucccgagaagagaagccacagaugagugggccagcgaggccagucuucaauguccacuaauuca

SEQ ID NO: 277031 - RNA, 64 nt, Human
cuggguauguucccccaggcauggaugugcugaacgaggccauugguacccucaccgccagggg

SEQ ID NO: 277032 - RNA, 64 nt, Human
gaagaaccccuucuaccaagcucccucguggccacgaggccacgaacccggccagcccugacgc

SEQ ID NO: 277033 - RNA, 63 nt, Human
ugcuguccagccaggccugccugaggccacgcugcuauggaggcugccuccuagucucccacc

SEQ ID NO: 277034 - RNA, 63 nt, Human
uuacuuagcucauguuuugguuuaguuauagucgcuauggauuuggccaaauaaaaaggcaaa

SEQ ID NO: 277035 - RNA, 63 nt, Human
guacuaguccugccaccuguguauuuuuagggugcuauggaaauaaugaaaagaaacggggau

SEQ ID NO: 277036 - RNA, 64 nt, Human
acauaccaccuggggaugggcugacucagggucccgaggccagagacaaagcugugggagccaa

SEQ ID NO: 277037 - RNA, 64 nt, Human
gccaggccugggugccgcugcgcuggaugucccccgaggccauccuggagggugacuucucuac

SEQ ID NO: 277038 - RNA, 64 nt, Human
auucaagagagcucguuccuaccuggcuggagaccgaggccagaaggcaaaaaccagaaaggga

SEQ ID NO: 277039 - RNA, 64 nt, Human
aaaaacuuuaaaaaaaaaaaaaccgacaaaguuacgaggccauccugcuauuuaucuucugagu

SEQ ID NO: 277040 - RNA, 64 nt, Human
uuucagugucgucuugccaagucgcuuuaucuuccgaggccaccguuuaacaggaguccccgca

SEQ ID NO: 277041 - RNA, 64 nt, Human
cagaccccucccuuccugggcugaccugcucccucgaggccagccugcucccuggcugaggcuc

SEQ ID NO: 277042 - RNA, 64 nt, Human
cagaggcugggacacaaggggcuggcgagggcugcgaggccagggaagcccugaguuucuggcg

SEQ ID NO: 277043 - RNA, 64 nt, Human
acgcgcuagguagcagcgucggucaggacugucucgaggccacacucgcucggcaggauuaugc

SEQ ID NO: 277044 - RNA, 64 nt, Human
cuggacaagcccucauaggcagggaggggguuuccgaggccaggcauccgccgccccgugucgc

SEQ ID NO: 277045 - RNA, 64 nt, Human
agacaggggagcaaagaacgccaagccggaggcccgaggccagccggccucucgagagccagag

SEQ ID NO: 277046 - RNA, 64 nt, Human
guagcuuuaagucacacuagacugcagagggguccgaggccagaaaccccuguccugcaucaga

SEQ ID NO: 277047 - RNA, 64 nt, Human
gcgcgccccgacacacaugcuuuucuccaugacacgaggccaguccccaggagcagccccagga

SEQ ID NO: 277048 - RNA, 64 nt, Human
gugccucccagauguggaggagugaagccaccaucgaggccacacucagcacuccaggauccca

SEQ ID NO: 277049 - RNA, 64 nt, Human
agcuccuuccccaucauuucuccuuggccaacgacgaggccagccagaauggcaauaaggacuc

SEQ ID NO: 277050 - RNA, 64 nt, Human
cugccaugggggauuuuaccccaacuccaggguucgaggccaaucugagaauggcuuaggauug

SEQ ID NO: 277051 - RNA, 64 nt, Human
guauuagaaguuaaaucccaucguaaauacaucacgaggccagcugugugauuucugagaccua

SEQ ID NO: 277052 - RNA, 63 nt, Human
auagcaguucuagagcacagguucucagucuaagcuauggaaaagcuccccuuauccaacaga

SEQ ID NO: 277053 - RNA, 63 nt, Human
uuuauucuugaccugguguucuucaucauucuugcuauggauuuaucaauuuuguuccucuuu

SEQ ID NO: 277054 - RNA, 63 nt, Human
guguugucaggccaacugaaugaugaugugguugcuauggaaacagaaaaggcugccagcugu

SEQ ID NO: 277055 - RNA, 64 nt, Human
ggcaggugcggccccaggaccaucaccaggaaugcgaggccacccuggaccagagguaggagcc

SEQ ID NO: 277056 - RNA, 64 nt, Human
aauuugccgcaauuccacuggaaggcauuucccacgaggccagagguugccaggcugccugagg

SEQ ID NO: 277057 - RNA, 64 nt, Human
cugagcaguguugggcaggccgggucucccaucccgaggccagcguuccugugcagagccccau

SEQ ID NO: 277058 - RNA, 64 nt, Human
gcccccgauggcccaggagcagaugggaggaccccgaggccagacgcacacuguccgagcccuc

SEQ ID NO: 277059 - RNA, 64 nt, Human
guuaagauccaaaagaaaacagaaaacaauuccacgaggccaaucuaaagggaaaaaauccuac

SEQ ID NO: 277060 - RNA, 64 nt, Human
uggccaggccucuuggcagucacaucucuuccuccgaggccaguaccuuuccauuuauucuuug

SEQ ID NO: 277061 - RNA, 64 nt, Human
cccuuucucucuuguccaauggggcuuggagcaccgaggccagcgaagccaucgcgcuccuugc

SEQ ID NO: 277062 - RNA, 64 nt, Human
auggaagcacugguggccgggccucuuuuuccagcgaggccagcccuggcuucuccucuguucc

SEQ ID NO: 277063 - RNA, 64 nt, Human
cucagcaauggaccccucacagagcuccucuauccgaggccauuggagaccccaguuucucaag

SEQ ID NO: 277064 - RNA, 63 nt, Human
gaauuaucccgaaaaguuaacaugucaccuccacgaggccauccucugugaccgaaggcagcu

SEQ ID NO: 277065 - RNA, 64 nt, Human
cagcaaaagccacuggacacacagcucugcuugacgaggccagugagggacggcguggcugugc

SEQ ID NO: 277066 - RNA, 64 nt, Human
cucuucucuccaggcuaaagaaucccgaaggcaucgaggccauuucugcugcaacaagguuucc

SEQ ID NO: 277067 - RNA, 64 nt, Human
guauuuaaacugaaacauacguuucuaagcaauacgaggccaccuucagucgcaagcugggugc

SEQ ID NO: 277068 - RNA, 64 nt, Human
accucccgggugugaggcagggggcggaggcugccgaggccagggccuguggaggugccagggc

SEQ ID NO: 277069 - RNA, 64 nt, Human
gugcugccacggcaggcccaggccagccagugcccgaggccaggaaggccgggccguggagguc

SEQ ID NO: 277070 - RNA, 64 nt, Human
cuucacggggccacgguggaaccaagacagcaggcgaggccaugccuaaacaaguggucuggca

SEQ ID NO: 277071 - RNA, 63 nt, Human
ccuucagagagggcuccucgcucaccucugguagcuauggaugggacaggaagcugccaaccu

SEQ ID NO: 277072 - RNA, 63 nt, Human
cauuuuagauuaggauugacaaguaaagauacugcuauggaaugauacauuguauuuucugca

SEQ ID NO: 277073 - RNA, 63 nt, Human
uggccuucaaggggcucagguuaauaauagagagcuauggagucaaggcauguuuaagauggg

SEQ ID NO: 277074 - RNA, 64 nt, Human
gcugaggcaggcggaucaccugagaucaggaguucgaggccagccuggccaagauggcaaaaac

SEQ ID NO: 277075 - RNA, 54 nt, Human
agacauguagccccauuugaggcacgaggccaggcagaucccacuugcagccuc

SEQ ID NO: 277076 - RNA, 64 nt, Human
ugucugaugcacggcgagugaacaccguuggcgccgaggccaagacuuugauuuaaaagaaaac

SEQ ID NO: 277077 - RNA, 64 nt, Human
cgugacggcucgggguguccgcuccccucugggucgaggccacagcugagucacguugcugcuc

SEQ ID NO: 277078 - RNA, 64 nt, Human
caugcagaagccugagcucauccgccguggagagcgaggccacgcaccagcggaagcuccggca

SEQ ID NO: 277079 - RNA, 64 nt, Human
ggagugucuggggcuccugguacgacagaggggccgaggccaaaagugucuuccaucacuguaa

SEQ ID NO: 277080 - RNA, 64 nt, Human
gggcggggggcaugcuggccucugagcgaucaggcgaggccagcgagggugugcuugcaaauuc

SEQ ID NO: 277081 - RNA, 64 nt, Human
aacaauguguguaucuuuugcacagcaaaaacugcgaggccagaacuaguuuaucugaacaccu

SEQ ID NO: 277082 - RNA, 64 nt, Human
ggggccccacuugaaggaggcaggacagaggcaccgaggccagggagacgcccaacgaggcagc

SEQ ID NO: 277083 - RNA, 64 nt, Human
cagggcagaaggaguuucuccggagaugagccggcgaggccaggugcggggcgcgcugcaccgg

SEQ ID NO: 277084 - RNA, 64 nt, Human
gauuagagagcagcgggaaaacgggcugugccugcgaggccaaguugcccacccugcggagcua

SEQ ID NO: 277085 - RNA, 64 nt, Human
ccagugaagacagaagcucuuacugacuuggccccgaggccaucacccccuccagcagugaaca

SEQ ID NO: 277086 - RNA, 64 nt, Human
ggugggagccaugccgucugccggacccggaggccgaggccaugugcauaguuucuuuauuuug

SEQ ID NO: 277087 - RNA, 64 nt, Human
cagcauuuggggaggcaaagguggaaguaucccucgaggccaagaguucaugaccagccugguc

SEQ ID NO: 277088 - RNA, 64 nt, Human
cagguuaggcuggggcucaucgagggucucaggccgaggccacugcggugccagugccccccug

SEQ ID NO: 277089 - RNA, 64 nt, Human
cgcucaccugccagccccaacacccgacgggggccgaggccaggcugccccucccugugggcuc

SEQ ID NO: 277090 - RNA, 63 nt, Human
aggacucagcaaccagccagggacagauaaagcgcuauggaaaggggcuuccaaguucuuuug

SEQ ID NO: 277091 - RNA, 63 nt, Human
agaagagggagccccccuagacauuucuuugcagcuauggacaugcgggauaucucccccugc

SEQ ID NO: 277092 - RNA, 63 nt, Human
cuggaaguuuucacuacaacuccucuaccaacggcuauggaaaccacaguuugcauuuaggau

SEQ ID NO: 277093 - RNA, 64 nt, Human
augaagugaaggucugagggagcgggcccuggggcgaggccaucucugccugccucccuagcag

SEQ ID NO: 277094 - RNA, 64 nt, Human
aggcaccugccuauaccccacaucccuucugccucgaggccaagaugccuaaaaaagcuaaagg

SEQ ID NO: 277095 - RNA, 64 nt, Human
aucagcccaucuaaagcagucuuuauaugcauuccgaggccagaguaacauuuugaacuuuggg

SEQ ID NO: 277096 - RNA, 64 nt, Human
caagucacccagcuguggaagcagagguagaagacgaggccagccaggagggcgacuucaguca

SEQ ID NO: 277097 - RNA, 64 nt, Human
guaaggaguguuugaguugaagagucaucugauucgaggccacucauguucuuuguaacuuaaa

SEQ ID NO: 277098 - RNA, 64 nt, Human
ccacuugagaagaguagcuauaaagacauaugagcgaggccagcugagcccagcacugcggcca

SEQ ID NO: 277099 - RNA, 64 nt, Human
uaggaggcugaagcaggaggauugauugagccugcgaggccaaggcugcagcaggcugugauug

SEQ ID NO: 277100 - RNA, 64 nt, Human
gccugcucccacagccugggcugacgucagaggccgaggccaggaacugagugaggccccuggu

SEQ ID NO: 277101 - RNA, 64 nt, Human
cccugcuccgcaagagccgcauccugguuuuagacgaggccacagcugccaucgaccuggagac

SEQ ID NO: 277102 - RNA, 53 nt, Human
gcacacucaagcuggcuugaggacgaggccacucagaggcccccaguggggac

SEQ ID NO: 277103 - RNA, 64 nt, Human
uaugucauuuggggucuugggggcagggcucccacgaggccauccuccucuucuuggaccuccu

SEQ ID NO: 277104 - RNA, 64 nt, Human
gacuuucuauuugccuagguaccgaaguggcauccgaggccacaugaaggcuguggugauggau

SEQ ID NO: 277105 - RNA, 64 nt, Human
cuggaaauagugugauuagaacacugaucgugugcgaggccaggagaucaagaccauccugacu

SEQ ID NO: 277106 - RNA, 64 nt, Human
cucggugcguuggcagaagaggcuucuggaguuucgaggccauaccuccuuucaagagcuuugg

SEQ ID NO: 277107 - RNA, 64 nt, Human
caauuugguuaccugcaauggcugcuuuugccagcgaggccaccauucauuggucaucuuggua

SEQ ID NO: 277108 - RNA, 64 nt, Human
ggagucaguaucggcccggcgcagccgcggcgggcgaggccaauggaaaggagacugaggggag

SEQ ID NO: 277109 - RNA, 63 nt, Human
agagguucgcagggauaaggggugcacuuuauagcuauggaaacaugagauucuccucuauug

SEQ ID NO: 277110 - RNA, 63 nt, Human
gagccauuuugguaaacgguuuuuauuaaagaugcuauggaacauaaaguuguauugcaugca

SEQ ID NO: 277111 - RNA, 63 nt, Human
gaacacaugauguuagaguauauuuuguugaaugcuauggaauauuaauauaauuaauucuaa

SEQ ID NO: 277112 - RNA, 64 nt, Human
gucgaaccgucggcccgagggcgcagaccugaggcgaggccaccccccuccauccugggggaag

SEQ ID NO: 277113 - RNA, 64 nt, Human
aggguuugcuggucccuccuuuccccccgucccacgaggccaccugggccagccccuuguccuc

SEQ ID NO: 277114 - RNA, 64 nt, Human
ugggcccugccuggcucccuacgaccuuugggcucgaggccagcuccuccccaugcccgcuguc

SEQ ID NO: 277115 - RNA, 64 nt, Human
uuuaucaggacacgggccccaccugucacgugcccgaggccacccaagcccagccugcggggcg

SEQ ID NO: 277116 - RNA, 64 nt, Human
cucauccuuccuccgacaccucggcuggggaaaccgaggccaccgccccccccuccgcugcccc

SEQ ID NO: 277117 - RNA, 64 nt, Human
gugcgcuccaaaccaaauacgcgcgcugcccuuucgaggccagugagcucagccuccaaggcuu

SEQ ID NO: 277118 - RNA, 64 nt, Human
ggaagcaggagggcagaggcuacagcuguggaaacgaggccaugcugccuccuccugguguucc

SEQ ID NO: 277119 - RNA, 64 nt, Human
gggagcagaguccccaggagccgagggggccacccgaggccaggauggaggugggaggccgagc

SEQ ID NO: 277120 - RNA, 64 nt, Human
caccugccccacuccaggugaugcugcagcagggcgaggccaugcgcugcccccagugccagau

SEQ ID NO: 277121 - RNA, 64 nt, Human
cuccaaguccaagcacagccaugcugaguggaagcgaggccaccaucugaguggauugguccca

SEQ ID NO: 277122 - RNA, 64 nt, Human
gcgcacaugcuuggagaguccucagcaggguagccgaggccaggccacuucugcugaggauggg

SEQ ID NO: 277123 - RNA, 64 nt, Human
ucacagccaccacuaccaccacuuuagacaggaccgaggccacauacuccccauucucucgugg

SEQ ID NO: 277124 - RNA, 64 nt, Human
aucucccugggugaggagugggugcacccagccccgaggccagugguugcucggggccuuccgu

SEQ ID NO: 277125 - RNA, 64 nt, Human
cccccuccccaccaacuucucugccccagggacccgaggccaccccagccugguguggacccau

SEQ ID NO: 277126 - RNA, 64 nt, Human
ccugucaucacccucuccugguguaguguggaugcgaggccacggcucagugaugggcucacca

SEQ ID NO: 277127 - RNA, 64 nt, Human
agggcagcagugcacauggaggagacgucucccacgaggccaaggccuccaaugcucaccgaug

SEQ ID NO: 277128 - RNA, 63 nt, Human
ggggcacucugaucguucacuuuggucccuuuggcuauggaacaggcugggucacagggaacu

SEQ ID NO: 277129 - RNA, 63 nt, Human
uuccuauaacuguauguguugaguggccgugaggcuauggaccuagccuggaauuuagauguc

SEQ ID NO: 277130 - RNA, 63 nt, Human
uacaggaugccagcuaauuuuccacagagcaaugcuauggaauacaaaauguacugacauuuu

SEQ ID NO: 277131 - RNA, 64 nt, Human
caacacauggaaucagggcuccacccagaccugccgaggccacacuccuggaguaucugcaucc

SEQ ID NO: 277132 - RNA, 64 nt, Human
gccauugcucuccuagagggggucucagaaacugcgaggccaguuccuuggagggacaugacua

SEQ ID NO: 277133 - RNA, 64 nt, Human
ccgacaccucccagcgugggaccccaagugaagacgaggccaaggcugaaaccauccgcaaccu

SEQ ID NO: 277134 - RNA, 64 nt, Human
gcgauggcacgccagugcuggagccgcagccaggcgaggccacucgacucccggggccggggcc

SEQ ID NO: 277135 - RNA, 64 nt, Human
uaugguguaugagguucugaacucccaucaccaccgaggccaguccuaguucuugguccaggga

SEQ ID NO: 277136 - RNA, 64 nt, Human
ccagccccccaaguggugaugcccaggcagaugccgaggccaaguggacugacccccagauuuc

SEQ ID NO: 277137 - RNA, 64 nt, Human
aaaaucgggucuuuccaaauguaauuaaguaaggcgaggccauacugcauuuacaaugggccca

SEQ ID NO: 277138 - RNA, 58 nt, Human
auaucucgggugugccauaauaauaccagcuauggagucccaagauguaaacauuuua

SEQ ID NO: 277139 - RNA, 63 nt, Human
auugaaacgggucaauuuacgaagucugcauuggcuauggagauaugguuuauaguacagccu

SEQ ID NO: 277140 - RNA, 63 nt, Human
accacuacagucuggcuagguuaaaggccagaggcuauggaacuuaacacuccccauuggagc

SEQ ID NO: 277141 - RNA, 63 nt, Human
ggcucauacccccaaaggacacuuucagcgacagcuauggacagcaugguaccaaggaguuaa

SEQ ID NO: 277142 - RNA, 63 nt, Human
cggaucccagccuaaaagacaccagagaccucagcuauggagcccuucggacccacuucucac

SEQ ID NO: 277143 - RNA, 63 nt, Human
uaccuucuccuggcccugcguucuuaauauugggcuauggagagauccuccuuuacccucuug

SEQ ID NO: 277144 - RNA, 63 nt, Human
caggcggaaucagcagacauugaugccagcucagcuauggacacaucugagccagccaaggug

SEQ ID NO: 277145 - RNA, 63 nt, Human
agauauugucuauuguuugugugcuuguuuugcgcuauggaacauuuuuuaauuuauuuuaag

SEQ ID NO: 277146 - RNA, 63 nt, Human
cuacauauuuuccaucuguaguuucucagaagggcuauggauuaguuugaacugucaaauccu

SEQ ID NO: 277147 - RNA, 63 nt, Human
cacuaugaacuuggauauucaagccuuuggauggcuauggagagggcuugaaauguguacagg

SEQ ID NO: 277148 - RNA, 63 nt, Human
uccaugcugcaaucacuguccugggcuuauggugcuauggacuagggguccuuugugaaagag

SEQ ID NO: 277149 - RNA, 63 nt, Human
gccaacuuagugccaagaggaggugugaugacagcuauggaggcccccagaucucucucuccu

SEQ ID NO: 277150 - RNA, 63 nt, Human
auauaaugaguauacaaguauaucuccucuuuugcuauggaggcuccauguucaaggcaaugg

SEQ ID NO: 277151 - RNA, 63 nt, Human
caguuucagcaacaaacaaacuuuguuugggaagcuauggaggaggacuuuuagauuuaguga

SEQ ID NO: 277152 - RNA, 63 nt, Human
agcugugcuccagacuagagccuccuuaccuaugcuauggauuuuuaauuuauuuucucuuau

SEQ ID NO: 277153 - RNA, 62 nt, Human
agugcgacauccagaaaugagcugaugucaaugcuauggacugcacaaaagucucaauguuc

SEQ ID NO: 277154 - RNA, 63 nt, Human
gcacgcacgccuugagcagucagcauugcaccugcuauggagaaggguauuccuuuauuaaaa

SEQ ID NO: 277155 - RNA, 63 nt, Human
uggggugcaggagccuuucuggauuuggauguggcuauggaaagaacacagaagccaagguca

SEQ ID NO: 277156 - RNA, 63 nt, Human
agcagugucuguaaaagagccuaguuuuuaauagcuauggaaucaauucaauuuggacuggug

SEQ ID NO: 277157 - RNA, 62 nt, Human
uucucucccucagccugcaaggguccgauuugccaucgaaaaagacaaccucuacuuuuuuc

SEQ ID NO: 277158 - RNA, 62 nt, Human
uguuuccccuacaucuuuugagccacagucgcccaucgaauaagcaaauuuguuuuugagaa

SEQ ID NO: 277159 - RNA, 62 nt, Human
cugccaaggugaagagauacagccuuccguauccaucgaagcagaugcucugaacccugagc

SEQ ID NO: 277160 - RNA, 62 nt, Human
augaagccucuuuggggugaagccuggacaucccaucgaaugaaaggacacuaguacagcgg

SEQ ID NO: 277161 - RNA, 62 nt, Human
auaauucagauuguuugucuccuugugaagaaccaucgaaaccuguuuguucccagcccacc

SEQ ID NO: 277162 - RNA, 62 nt, Human
uagugguuaacagagcuaagaaauaaggcuaaccaucgaaaagaacaugggccgcggguaaa

SEQ ID NO: 277163 - RNA, 62 nt, Human
ggauggaaacacaaauuucauggagcuguguaccaucgaagaaaccuggugucuggcaugaa

SEQ ID NO: 277164 - RNA, 62 nt, Human
aggauggacucagugcagagcaggacaugaugccaucgaaauuggaagguucccuggugcug

SEQ ID NO: 277165 - RNA, 62 nt, Human
aaaauuaugccucccucuguuuuuauaaguugccaucgaaaagugauuuaaauaagcagguu

SEQ ID NO: 277166 - RNA, 62 nt, Human
cacacuguuaggccuuuauuuuauuuuauuuuccaucgaaagcauuggaggcccagugcaau

SEQ ID NO: 277167 - RNA, 62 nt, Human
acaggcuucuggcaguagcuuugguuccuaucccaucgaaauuccccaaagcccugggccac

SEQ ID NO: 277168 - RNA, 62 nt, Human
ccacuguauggccgugccuagaccgauggcagccaucgaauauuccucugggcucacggggu

SEQ ID NO: 277169 - RNA, 62 nt, Human
caccguggguguaagaugccuuucuccuccacccaucgaaaccagccaccccuucccugugc

SEQ ID NO: 277170 - RNA, 62 nt, Human
acggaggacuuggggaaaaaggaccacauaguccaucgaagaagaguccuuggaacaagcaa

SEQ ID NO: 277171 - RNA, 62 nt, Human
acuccagaaggucauuccagauccagagauccccaucgaacugaaggaucacuggguugcag

SEQ ID NO: 277172 - RNA, 62 nt, Human
aggggggcccugcacaaggaaacagggaagagccaucgaaguuucagucggugagccuuggg

SEQ ID NO: 277173 - RNA, 62 nt, Human
gacccauggagaggaacucuucugcacucugagcuggccagccccucggggcugcagagcag

SEQ ID NO: 277174 - RNA, 62 nt, Human
gcugggauuacaggugugagccaccgcacccggcuggccaaucuuaucagaagugagcuacc

SEQ ID NO: 277175 - RNA, 62 nt, Human
guggucuuucauccuugacaggcugguaaugugcuggccaccuccagcuccugcaucgaguc

SEQ ID NO: 277176 - RNA, 62 nt, Human
ggaagaauucggauccuuaccauuggaaucuuccaucgaacauacucaaacacuuuuggacc

SEQ ID NO: 277177 - RNA, 62 nt, Human
uguucuuuuaauggucaguuuaaugaacuucaccaucgaaguuaaugaaugacaguagucac

SEQ ID NO: 277178 - RNA, 62 nt, Human
caccuggacgcugaugguggccaggaugcucagcuggccaggagggcagcaccugcugggga

SEQ ID NO: 277179 - RNA, 62 nt, Human
uguggucaugugcuccuagcugcacgguggcugcuggccacaccacggcaaguggcagcagg

SEQ ID NO: 277180 - RNA, 62 nt, Human
cgcuaaggaguaguggcccugacuuccggucggcuggccagcugacucccuagggccuucag

SEQ ID NO: 277181 - RNA, 62 nt, Human; identical to SEQ ID NO: 50553

SEQ ID NO: 277182 - RNA, 52 nt, Human; identical to SEQ ID NO: 50554

SEQ ID NO: 277183 - RNA, 55 nt, Human; identical to SEQ ID NO: 50555

SEQ ID NO: 277184 - RNA, 62 nt, Human
ugcuuggcuggggagccccccaggccagguuugcuggccauagauaccuuugggcugccugg

SEQ ID NO: 277185 - RNA, 62 nt, Human
aacccggugugccgggagauggcugugguacugcuggccaaccuggcucagggggacagccu

SEQ ID NO: 277186 - RNA, 62 nt, Human
agcuucaacguugaguaaagggauuucugagagcuggccaaugccuuuugccagcugcagug

SEQ ID NO: 277187 - RNA, 62 nt, Human
cugcccugaagaccaccccagucuaccucggugcuggccaggaaaccuuucggcuaccucuc

SEQ ID NO: 277188 - RNA, 62 nt, Human
cagagaugacugggcuggggaagcaggugcuugcuggccauggagccucauugcaaguuguu

SEQ ID NO: 277189 - RNA, 62 nt, Human
ucccuggcgcugucucccacuggacagaggaggcuggccauggggcccaggggucaggccca

SEQ ID NO: 277190 - RNA, 62 nt, Human
gggagaacuaaguaagaaacacaaugccaacagcuggccaguaauuaguguugugcacuuca

SEQ ID NO: 277191 - RNA, 62 nt, Human
ccaacuugaauuccuaguaacuuucuugguaugcuggccagaaagggaaaugaggaggagag

SEQ ID NO: 277192 - RNA, 62 nt, Human
guccacccaccggaagcgcucuuuacuuggucgcuggccaccccaguguuuggaaaaaaauc

SEQ ID NO: 277193 - RNA, 62 nt, Human
caauuugaauauguguuacuuaauaaggcuaggcuggccaucaguugcuuauuucagaugug

SEQ ID NO: 277194 - RNA, 62 nt, Human
aguaaugugguccacagccaugcccuugaggagcuggccacuggauacugaacacccuacuc

SEQ ID NO: 277195 - RNA, 62 nt, Human
uuucaacagagaagggaaaugacaaaggggcagcuggccagauaagcuaggaugagagcaga

SEQ ID NO: 277196 - RNA, 62 nt, Human
gaugcccugugccagugaccagagcacccagggcuggccagucacugagggaacagcgucuc

SEQ ID NO: 277197 - RNA, 64 nt, Human
uguucagcaggaucaugccuucugugucuggaagaggcggcagaggcaacaguguuuaggauuu

SEQ ID NO: 277198 - RNA, 64 nt, Human
aggccugggcuuccuggccugaguggguagacgcaggcggcagaggugcuggaccacaucuccg

SEQ ID NO: 277199 - RNA, 64 nt, Human
ggguuaucuccucucauacaucaagccccagaggaggcggcaagaggaacagccacaaacaagu

SEQ ID NO: 277200 - RNA, 64 nt, Human
guuagaugucacggaaaaagcuaguucuguggucaggcggcaccaaugagaaaggaaugcagac

SEQ ID NO: 277201 - RNA, 64 nt, Human
gggccagguccucacagcagucacaggcccaggaaggcggcaggcagagaaguggagugacuau

SEQ ID NO: 277202 - RNA, 64 nt, Human
cgggcugggucugcagcagccccugguccugagcaggcggcagugaacagcacuggcccaccuc

SEQ ID NO: 277203 - RNA, 58 nt, Human
aagacuguaccauguccuaagcugaggcaggcggcaggcgcggugcacaggaagucuc

SEQ ID NO: 277204 - RNA, 64 nt, Human
agcacaagcaggggacggaaagagagagacacucaggcggcagcauucccucccagccacugag

SEQ ID NO: 277205 - RNA, 64 nt, Human
caggcgcuucucgugguuggcgugcugcagcgacaggcggcagcacagcaccugcacgaacacc

SEQ ID NO: 277206 - RNA, 64 nt, Human
ucaggaggcugaggcagaagaauugcuugaacccaggcggcagagguugcagugagucgagauu

SEQ ID NO: 277207 - RNA, 64 nt, Human
ggugucagcauucccagcuuuccaagcugcccccaggcggcagagucugagggucccggggccc

SEQ ID NO: 277208 - RNA, 64 nt, Human
ccauggaaauacgcgcggggagcggccgcuucaaaggcggcacacuucacuacagacacucuau

SEQ ID NO: 277209 - RNA, 64 nt, Human
ccaccugcugagcgccauggugggagagacugugaggcggcagcuggggccggagccuuuggaa

SEQ ID NO: 277210 - RNA, 64 nt, Human
guggucaaggcccggccccaucagaggcugggggaggcggcacauuggcagugugucacacuga

SEQ ID NO: 277211 - RNA, 64 nt, Human
uuacaggcaggacagcauuugacuuuuauuuaaaaggcggcacuacuuauguaaaucugagcug

SEQ ID NO: 277212 - RNA, 64 nt, Human
acauguaucauuaaagguccuaaaaggaauuguuaggcggcaggcuuuguguuacguguuacau

SEQ ID NO: 277213 - RNA, 64 nt, Human
cuggcaaaaauuuauggugaaugaauauggcuuuaggcggcagaugauauacauaucugacuuc

SEQ ID NO: 277214 - RNA, 64 nt, Human
aguccaagaagaagagcagcagggccaaggcagcaggcggcaggaguagcagcagcaaacaaag

SEQ ID NO: 277215 - RNA, 64 nt, Human
cucagcaggagaagcacuugaacccaggagacggaggcggcagugagccaagauugugccacug

SEQ ID NO: 277216 - RNA, 64 nt, Human
ugaacaaaaccucagagcccgggucaucuucugcaggcggcagaacuacaucggggccaccaaa

SEQ ID NO: 277217 - RNA, 64 nt, Human
gaggcaggaaaugggaaaaaguguuagugcuuccaggcggcacugacagccucaguaacaauaa

SEQ ID NO: 277218 - RNA, 64 nt, Human
gcagcgccacuccaggguucagacagggcugcacaggcggcagagauacagggucugagggcug

SEQ ID NO: 277219 - RNA, 64 nt, Human
gcgugccuguaaucccagcuacccaggaaggcugaggcggcagaaucacuugaacccggaggcg

SEQ ID NO: 277220 - RNA, 64 nt, Human
caauucacuucauugaccaagaugaucacauggaaggcggcacagaggcagcugugugggcugc

SEQ ID NO: 277221 - RNA, 64 nt, Human
ucgggagguugaggcaggagaaucgcuuaaacccaggcggcagagguugcagugagccaagauc

SEQ ID NO: 277222 - RNA, 64 nt, Human
cucccgcuccugcggaggagguguggucaccaggaggcggcagugcaacaaccccagguaccgc

SEQ ID NO: 277223 - RNA, 64 nt, Human
gggaagcccugacaacaacuaucaccaaaagacgaggcggcaaagauccagcggggcuucuggg

SEQ ID NO: 277224 - RNA, 64 nt, Human
uuccaguaugaacgcacaggagagucccaucagcaggcggcauuggagucuaggagcucagcug

SEQ ID NO: 277225 - RNA, 64 nt, Human
ccucagagggagcagccuaucucccccaagcuggaggcggcagaggacugggccaagccccaac

SEQ ID NO: 277226 - RNA, 64 nt, Human
gcaccagggaguaguacccccagcucugagaaagaggcggcauccccuaggccaaguggaaaga

SEQ ID NO: 277227 - RNA, 64 nt, Human
guaugagcaugcgcagacggaggcgggugcgcggaggcggcaguguugauauggugaaaccggg

SEQ ID NO: 277228 - RNA, 64 nt, Human
accauucuuaagaaaaccugaauggauuucaucaaggcggcagcauaauuugaagggcaauugc

SEQ ID NO: 277229 - RNA, 64 nt, Human
acguugcaaugcacccagcagcuccuggcucugcaggcggcacagccuggggcccugugauccu

SEQ ID NO: 277230 - RNA, 64 nt, Human
ccaggguuggcaugacugucugugcaccgagaagaggcggcagauccugcccuggccaaucagg

SEQ ID NO: 277231 - RNA, 64 nt, Human
ccacccaccucgguccagcgcggcccugcccaggaggcggcagccgggcgcacccucgccagcc

SEQ ID NO: 277232 - RNA, 64 nt, Human
cccgaugcuucugucuccacucggcuuucccaaaaggcggcacccagcuccucaaucgaagcau

SEQ ID NO: 277233 - RNA, 64 nt, Human
accccgcaccccgcguguccccggggcccaggggaggcggcacuccaaccuaaccugugucugc

SEQ ID NO: 277234 - RNA, 64 nt, Human
ccaggcuuggguggagaagcuguugguacaggagaggcggcaggaggagcaggagaggcugcau

SEQ ID NO: 277235 - RNA, 64 nt, Human
ggcucuaaauuaaugguugaccggaagggauuggaggcggcagaaccauuaacccuacacaaga

SEQ ID NO: 277236 - RNA, 64 nt, Human
ucugggaaguaggacugauggucaucuucaugacaggcggcaucuccacuaagccuguguaacu

SEQ ID NO: 277237 - RNA, 64 nt, Human
ccgaugggggugggagccugucugcugggcugccaggcggcaccacugcaaggggugggagccu

SEQ ID NO: 277238 - RNA, 64 nt, Human
ugauggacugcgcaucucugagaaugccaaccagaggcggcagcccacccuuccugccuccugc

SEQ ID NO: 277239 - RNA, 64 nt, Human
augucagagugcgaauaugucucugagaagcuagaggcggcagagagagacaaucaaaaccugg

SEQ ID NO: 277240 - RNA, 64 nt, Human
aauagagggaagugucaugcaagugcuggacagaaggcggcaggugggacgagccccacagccc

SEQ ID NO: 277241 - RNA, 64 nt, Human
ucaugaagccagugcguuucccagaacgaacacuaggcggcaccguugguccacacucagaggc

SEQ ID NO: 277242 - RNA, 64 nt, Human
ggaugaaggagagauacuuaggaaauccuaaaagaggcggcaagaagguaccucccuguguaac

SEQ ID NO: 277243 - RNA, 64 nt, Human
guggcaauggcgagcacccugcagcugggcgggcaggcggcaggcgcggaacugacccucucgc

SEQ ID NO: 277244 - RNA, 64 nt, Human
guccugccauuuagccacagaaggcugcggagugaggcggcagcuagccuggccaguggcuguc

SEQ ID NO: 277245 - RNA, 64 nt, Human
aaucucaaguacccagggacacaaacacugcggaaggcggcaggguccucugccuaggaaaacc

SEQ ID NO: 277246 - RNA, 64 nt, Human
ucuuccaugacccuuugccuguuccgcauccuggaggcggcaaagggugaaauccgcauugaug

SEQ ID NO: 277247 - RNA, 64 nt, Human
gagcuuguuuucccuccaagaagagguuugagacaggcggcauccugcacugagucagacaagu

SEQ ID NO: 277248 - RNA, 64 nt, Human
cagcgggggagaugaaucaccuccugccuuggcgaggcggcagcucauuguuuacaggcaagcc

SEQ ID NO: 277249 - RNA, 64 nt, Human
gagucccggccucacucagcucacagggcgugccaggcggcaacaccagaaucuuccagaagcc

SEQ ID NO: 277250 - RNA, 64 nt, Human
agcugaccaaugaugggcggugacccgguaaccgaggcggcaaggaggccagguagucccggca

SEQ ID NO: 277251 - RNA, 51 nt, Human
gaggcucgggccgggcguaggaggcggcaccgggccgggagagcuucccug

SEQ ID NO: 277252 - RNA, 64 nt, Human
cagggcccaggccuggagcguuugcugugccaggaggcggcagcucuucugggcagagccuguc

SEQ ID NO: 277253 - RNA, 64 nt, Human
agaaccuucuggcucugagggagcaagagcuggcaggcggcagggcuggcacagacagacggaa

SEQ ID NO: 277254 - RNA, 64 nt, Human
gacacucacacucccuaacaucaacacaucuucaaggcggcagagcugugcgcccacccagcua

SEQ ID NO: 277255 - RNA, 64 nt, Human
aucaaccugcugugacccaggccccaccuggggcaggcggcaccggcgggcgggugggaggugg

SEQ ID NO: 277256 - RNA, 64 nt, Human
gaacgauuccggccugggaugcgggccaggcugcaggcggcauaguugggcccauucguccugg

SEQ ID NO: 277257 - RNA, 64 nt, Human
aucucucuccucggcagcagcgggaggcagaggaaggcggcagaagaugaagagcuuucccauc

SEQ ID NO: 277258 - RNA, 64 nt, Human
ccaacccgccggucucauuucuucucguuuucacaggcggcaugcguuccugcggacgaucgca

SEQ ID NO: 277259 - RNA, 64 nt, Human
ucagcagacuguccaaugugcucagccaggcuggaggcggcaggcggcaggcagcaggcugugg

SEQ ID NO: 277260 - RNA, 64 nt, Human
acuguccaaugugcucagccaggcuggaggcggcaggcggcaggcagcaggcuguggaggaggc

SEQ ID NO: 277261 - RNA, 64 nt, Human
acugauuggccucacggggacuuggguaagcaacaggcggcauucaggacucuucucaacccug

SEQ ID NO: 277262 - RNA, 64 nt, Human
ccuccguugacacagcuucucuggagacccuagaaggcggcauguccugcccucaaccugccug

SEQ ID NO: 277263 - RNA, 64 nt, Human
gcccagaguuugggguccccccagguauagcuauaggcggcagugccugucccuggccugccuu

SEQ ID NO: 277264 - RNA, 64 nt, Human
ccccagggccuucgcucccucagcacugggguggaggcggcaggaaggggcggcccuuaccugg

SEQ ID NO: 277265 - RNA, 64 nt, Human
caugugaagguggauuggucgccaucugcacgccaggcggcauccuuuucuaugaaguguugac

SEQ ID NO: 277266 - RNA, 64 nt, Human
gcuguggaugguggcaggagugucccagcaagaaaggcggcauccgucugugcccugugccuuu

SEQ ID NO: 277267 - RNA, 64 nt, Human
aauuccucuuuaaaugaacaaguaaccacaucucaggcggcagugaaguccagauaguuuugca

SEQ ID NO: 277268 - RNA, 64 nt, Human
ccugacaaaggcagcacuuauuuccugggcuggugcgccccaaaacacggccccgacacuuagu

SEQ ID NO: 277269 - RNA, 64 nt, Human
ccugagucuccucucccuuggaggccucauuccagcgccccaaggaggauucaaacuguugggg

SEQ ID NO: 277270 - RNA, 64 nt, Human
caaucgccccacccguuccuaccuggugccuugggcgccccaucccccaacagaacucccgggc

SEQ ID NO: 277271 - RNA, 64 nt, Human
gaccugugccccggaccugcggcgccgcccucgagcgccccaucucuaccccccacccuggcuu

SEQ ID NO: 277272 - RNA, 64 nt, Human
ccgucagguacuccugccagggaacuggccugcugcgccccaggccccgcccgucucugcucug

SEQ ID NO: 277273 - RNA, 64 nt, Human
cucaaggugcggggagaagaagcggccaggcggggcgccccaagagcccaaaagagggcacacc

SEQ ID NO: 277274 - RNA, 64 nt, Human
ucugccagaggugugguuaagggcagugauagcugcgccccagcaaggagggucaugggcccug

SEQ ID NO: 277275 - RNA, 64 nt, Human
cccgaccaacacuugcaggggucccugcuaguuagcgccccaccgccguggaguucguaccgcu

SEQ ID NO: 277276 - RNA, 64 nt, Human
uauucgcuacacgccucuucucuccuauaaggaugcgccccaccccgcuuuccccuuucuccgg

SEQ ID NO: 277277 - RNA, 64 nt, Human
ucccaaagugcugggauuacaggcgugagccaccgcgccccaccuaacccuuccuuauuuagcc

SEQ ID NO: 277278 - RNA, 64 nt, Human
uccccgggggcgagauuggcgcgggaguguggccgcgccccaucagauguucgcccuucaccag

SEQ ID NO: 277279 - RNA, 64 nt, Human
cacgucacagaagcaaaccgugccuucuggcucugcgccccauauucccagcaucauagacauc

SEQ ID NO: 277280 - RNA, 64 nt, Human
uggguuggcuggagccguccuacugggcaagauggcgccccacuuggagggcgguggucuguua

SEQ ID NO: 277281 - RNA, 64 nt, Human
acuaccuguugguauuguccacaagcucucccgagcgccccaucuugugccauguuuuaagucu

SEQ ID NO: 277282 - RNA, 64 nt, Human
ugccuggcacgcaccaccagucacaaccuaugcagcgccccacuucuuccaccucaacaccaag

SEQ ID NO: 277283 - RNA, 64 nt, Human
cuggcuucccugauggugucauguuucagcgcaugcgccccagccuuucccaugugccaaacca

SEQ ID NO: 277284 - RNA, 64 nt, Human
cucacccccagcacugcccaaacaggggccaagugcgccccaauuccaagaaugaaggcagagc

SEQ ID NO: 277285 - RNA, 64 nt, Human
uucugcaucgguucgcauuaucaaacccuuuccugcgccccagacuccaggccgccugcagccu

SEQ ID NO: 277286 - RNA, 64 nt, Human
acugacugugacccucugcuggccggucuugugugcgccccaugggacccccaguguucuugcc

SEQ ID NO: 277287 - RNA, 64 nt, Human
cuggugugcaagcacacaucacuuuagaggggcugcgccccaccagauaggaaggggaggauuu

SEQ ID NO: 277288 - RNA, 64 nt, Human
agguggcgcugccaggugcccgggucuauuggaggcgccccaucucagacuuccuaacacagcc

SEQ ID NO: 277289 - RNA, 64 nt, Human
acuucuccaggccuguguucccuccccaggaagugcgccccaaaccucuucauauugaagaugg

SEQ ID NO: 277290 - RNA, 64 nt, Human
acuucaccugagggccgugaggagaaggugggcugcgccccacagaacuggcagcagcuucucc

SEQ ID NO: 277291 - RNA, 64 nt, Human
ggcagccaguuuuaaccccagccugucaccgugagcgccccagaagagcgcggcgccccuagcc

SEQ ID NO: 277292 - RNA, 64 nt, Human
ggcugcaccaccccaagagccacgccccucgcuggcgccccagagccguggugcuugccaaggg

SEQ ID NO: 277293 - RNA, 64 nt, Human
acgccccuccgggcagagaccaccgcgccccucugcgccccagcgacgcggcccgcggggacgu

SEQ ID NO: 277294 - RNA, 64 nt, Human
gguccucagaaucccacugcaauggacccaggcagcgccccaggaagccaugcugggcccccgc

SEQ ID NO: 277295 - RNA, 64 nt, Human
cccagugcugcccagccuccccgcccgcucccaggcgccccauguccucacaggccaggacgcc

SEQ ID NO: 277296 - RNA, 64 nt, Human
ucuucucagcuuucucuuuaaauuccccuaaauagcgccccauuugggaacagagcaagagugu

SEQ ID NO: 277297 - RNA, 64 nt, Human
agcucgccugcgccgcugugccccccuccuccccgcgccccagucacuuccuguccgggagcag

SEQ ID NO: 277298 - RNA, 63 nt, Human
accacugguucgacguguagccagggcggccgggcgccccaucgccacauccugggggagcau

SEQ ID NO: 277299 - RNA, 64 nt, Human
aggccgucccggaucucagcggacacaggcaggagcgccccaucauuugacggugagcaggacu

SEQ ID NO: 277300 - RNA, 64 nt, Human
gggugaagugaaggcccagccuccccaccccaccgcgccccagggguuggaggaccuugucugu

SEQ ID NO: 277301 - RNA, 64 nt, Human
auggacccugacccccuugauccccaaagaagcugcgccccaccuuuccagauacccacaaagc

SEQ ID NO: 277302 - RNA, 64 nt, Human
agccaggggcaagccaggaugcccugugguuguggcgccccaggccaucccaaacccaguggca

SEQ ID NO: 277303 - RNA, 64 nt, Human
ucucugcaucaggucuccccacuccacgcuccgggcgccccaacuccaacaccacguccugccg

SEQ ID NO: 277304 - RNA, 64 nt, Human
ccuaggaagagguaaagauuaucagguaugcaaagcgccccaauucuucugcugccauggggga

SEQ ID NO: 277305 - RNA, 64 nt, Human
uuucccgggagggggcccugcccggcccucccuggcgccccagcccagugccccccgaagggcc

SEQ ID NO: 277306 - RNA, 57 nt, Human
ccugcaagaaagacucgugacugcccagcgccccaggcuggacugagccccucacgc

SEQ ID NO: 277307 - RNA, 64 nt, Human
cuaacgcugccggcacuuccgcaucugcccgugggcgccccacagcugccccucagccgcugag

SEQ ID NO: 277308 - RNA, 55 nt, Human
uuccggaggccuucaaguaaacggcgcgccccacgagaccccggcuuccuuuccc

SEQ ID NO: 277309 - RNA, 64 nt, Human
gaaaguauuaggagccucacaucuacucugccaagcgccccagcaggcacugugcugggcuuag

SEQ ID NO: 277310 - RNA, 64 nt, Human
cacaccuccagguucucuaaguucuggggagggagcgccccaccugcugaggucgguccucuca

SEQ ID NO: 277311 - RNA, 64 nt, Human
cuccaugcuggucacuagggugcugugcucucuggcgccccacagccuggccagcuccagggac

SEQ ID NO: 277312 - RNA, 64 nt, Human
ugaccuaggcacccuacgcuagugugagaagccugcgccccaggaaggaucuguguuagucccu

SEQ ID NO: 277313 - RNA, 64 nt, Human
uggacuaaaguaguggcuauuuuugugccacucugcgccccacccucacuguuggccgcuccuu

SEQ ID NO: 277314 - RNA, 64 nt, Human
ugguucgggcugugacgggguggccagcagggacgcgccccaggugggcagcuguggcagagca

SEQ ID NO: 277315 - RNA, 64 nt, Human
ugguucgggccgugacggggcggccagcagggacgcgccccaggugggcagcuguggcagagca

SEQ ID NO: 277316 - RNA, 64 nt, Human
gcccagcccucugcaccccccagcccggccaucugcgccccacagccccuuuggagcuuuucuc

SEQ ID NO: 277317 - RNA, 64 nt, Human
caggcacauuagcgaccaggcuugggcuuccccagcgccccaccaccaccacgugcagguggag

SEQ ID NO: 277318 - RNA, 62 nt, Human
acaaggaguauuaugucugagcccccggcacugcgccccacugccagcugccccuccuggga

SEQ ID NO: 277319 - RNA, 64 nt, Human
ggcuccccgugcgcgggcccugcccuuuccucccgcgccccaccggcuccgacgcgcaaccccg

SEQ ID NO: 277320 - RNA, 64 nt, Human
aaaauacagcugaaaccccgcgggcccuuagcacgcgccccagcgccggagcacggucaggguc

SEQ ID NO: 277321 - RNA, 64 nt, Human
agguggcagggcaguucccuggcugaggccuuuugcgccccaccuccaggaccaagggccauuc

SEQ ID NO: 277322 - RNA, 64 nt, Human
ucccauguucagcaaugucaauggcaucaggagggcgccccaagggccccaucgcuucccuuca

SEQ ID NO: 277323 - RNA, 64 nt, Human
cacgggcauagccagcccacuccuacugucacaggcgccccaccauucaaccuuccgggagguc

SEQ ID NO: 277324 - RNA, 64 nt, Human
cugcucugaugcaucagaaagggagggcucugaggcgccccaacccguggaggcugcucggggu

SEQ ID NO: 277325 - RNA, 64 nt, Human
cccauuuccuguuuuccauucccccguucuggccgcgccccacugcccaccugaaggggugguu

SEQ ID NO: 277326 - RNA, 64 nt, Human
auggguaccacugaagcaggggacgguggcaggagcgccccagccugcagcugacugaggacca

SEQ ID NO: 277327 - RNA, 64 nt, Human
uggguaaacguagaccuggcacuguuccacgcgggcgccccaagccugccacuccugugucccu

SEQ ID NO: 277328 - RNA, 64 nt, Human
ccugccucagccuccagaguagcugggacuacgggcgccccaccaccacgcccggcuaauuuuu

SEQ ID NO: 277329 - RNA, 64 nt, Human
gaagauagcuugagaggcauuggcgagguucgcagcgccccagggagagagaaaaagcugagac

SEQ ID NO: 277330 - RNA, 64 nt, Human
aggcuacagcggcucucaugaugugggcucaccugcgccccagacccugcaggggccccccugc

SEQ ID NO: 277331 - RNA, 64 nt, Human
cacccccaggaugucagugcucaccucgagcaaagcgccccagcucggccuugggagguggucg

SEQ ID NO: 277332 - RNA, 64 nt, Human
aagagcugccuccuggaagcuuuuccaagugugagcgccccaccgacugugugcugaucagaga

SEQ ID NO: 277333 - RNA, 64 nt, Human
gccagggaggaaggaggccacggagcgggaggcagcgccccaccacgucgggcuucccuggccu

SEQ ID NO: 277334 - RNA, 64 nt, Human
ccuggccgggcagggacagggcagaggacucugagcgccccacccaugccugccuggccuggua

SEQ ID NO: 277335 - RNA, 64 nt, Human
ccuggccugguagagaagauggcacaggauggaggcgccccaagacggacaguguacauaagag

SEQ ID NO: 277336 - RNA, 64 nt, Human
aucugggcccacucaucgccccuccaggcccccggcgccccacccccuagagugcucuguguau

SEQ ID NO: 277337 - RNA, 64 nt, Human
gcgcccugcuccaucggcacuaaugcuccacucggcgccccacuccaucggccccgcuccaucg

SEQ ID NO: 277338 - RNA, 64 nt, Human
cggccccgcuccaucggcacuaaugccccacucggcgccccacuccaucagcacuaaugcucca

SEQ ID NO: 277339 - RNA, 64 nt, Human
cucuucagcucgcggcccaggggaguggcgaggggcgccccaacccccugcccgccucuccgca

SEQ ID NO: 277340 - RNA, 63 nt, Human
accaacagaucaccgucuaagugcgucgcuugggcgccccaccccgucugcguccugcaucca

SEQ ID NO: 277341 - RNA, 64 nt, Human
gggggcuccuccgugcuucucuccuaaguucucugcgccccaagaacucgagguugugccuugc

SEQ ID NO: 277342 - RNA, 64 nt, Human
gcuccgccuucagucggccucuuguccaauccccgcgccccacacugcccagcgccccccggga

SEQ ID NO: 277343 - RNA, 64 nt, Human
guguccccagcgcccgcugcgccccugcgccccagcgccccaccuucccccacggcucaagaga

SEQ ID NO: 277344 - RNA, 64 nt, Human
cagcagguguguccccagcgcccgcugcgccccugcgccccagcgccccaccuucccccacggc

SEQ ID NO: 277345 - RNA, 64 nt, Human
gcugcuccauccgcccccccuccccuguguuuacgcgccccauccugugugucccagccuuuug

SEQ ID NO: 277346 - RNA, 64 nt, Human
ccccgucucuuuugguccuggcuccagaaaacccgcgccccacauaccugcaucuuccgcugug

SEQ ID NO: 277347 - RNA, 64 nt, Human
gaccuuuuuguuaagucaaauccaacggcccggugcgccccaggccgggagcgcgcgcggacug

SEQ ID NO: 277348 - RNA, 64 nt, Human
ggggacacuccaaguggggcagcucuccguacaugcgccccacccccaugagccaguucagccc

SEQ ID NO: 277349 - RNA, 64 nt, Human
ccuccccaccggcgggcgccccggcccugaacccgcgccccacauuucuguccucugcgcgugg

SEQ ID NO: 277350 - RNA, 64 nt, Human
agugcuaaggaaagcagcagagagagacgcuccggcgccccagccccacuaucaguguccagcg

SEQ ID NO: 277351 - RNA, 64 nt, Human
aaccuagccaccaauggggcuuccaggcacuggagcgccccaguccagcccuaucccaggcucu

SEQ ID NO: 277352 - RNA, 64 nt, Human
aguggcgggguaggugaaacuggggucccuuggggcgccccacgcugcuuccacacccaccacc

SEQ ID NO: 277353 - RNA, 64 nt, Human
ucgcacuuucuccacuguggagauggcuggggcggcgccccacaguguguauuccuguccucua

SEQ ID NO: 277354 - RNA, 64 nt, Human
ucuggauggcggagagugaaggagacggagaaacgcgccccaucccuuccgccgccuccuuucc

SEQ ID NO: 277355 - RNA, 64 nt, Human
cuggagccccagccccugcguccaucugugcugugcgccccacaguagacgugcagacgucccu

SEQ ID NO: 277356 - RNA, 64 nt, Human
gcgccgcgcggacuccugccccgaggguccggacgcgccccagcucgcgccccuucccauauuu

SEQ ID NO: 277357 - RNA, 64 nt, Human
cacuuagcugacaccagccccucagaggaccagugcgccccaucccagggaggguuccuugggg

SEQ ID NO: 277358 - RNA, 64 nt, Human
uggcugcccgggggaggaaggacacccggggcgggcgccccacgccgauggguccauggugaaa

SEQ ID NO: 277359 - RNA, 64 nt, Human
cugcuacggcggccuagcaaauuccgccccagaagcgccccaggaagggcgccgagugcccucu

SEQ ID NO: 277360 - RNA, 64 nt, Human
cccaccaccgcccgccugggcagccaugaauguagcgccccaggcccugccccagcccgccaug

SEQ ID NO: 277361 - RNA, 64 nt, Human
cuuccgcacgcuuccaccuccuucgaccuccacugcgccccaccucccugccuguguguguuau

SEQ ID NO: 277362 - RNA, 64 nt, Human
caucccgaguuucuguccacacauugcaugcacagcgccccacacauuggauacuguuguucac

SEQ ID NO: 277363 - RNA, 64 nt, Human
gggauugcccaacacuccuagggcagcccucccagcgccccauggggucgcccauggguagaga

SEQ ID NO: 277364 - RNA, 64 nt, Human
gggugcuccucaagaggaagaaaccgagaggcccgcgccccaccgaggaagccccgccccggug

SEQ ID NO: 277365 - RNA, 64 nt, Human
cucccaacucaggcaccagguccgcaccucucccgcgccccagagccggaaauuucucccuccc

SEQ ID NO: 277366 - RNA, 64 nt, Human
aaaauacauguuuguauaucuacauuuacauucugcgccccagagcuaagacagacugcgaauc

SEQ ID NO: 277367 - RNA, 64 nt, Human
guauucuagugauaagaauucuuaacauagccaagcgccccacguuuguuccccacguuuguuc

SEQ ID NO: 277368 - RNA, 64 nt, Human
ccgguuggaggcacccaggcuugccagccacagagcgccccaaagucaccgucaucccagcccc

SEQ ID NO: 277369 - RNA, 64 nt, Human
gucgguguuuggaggcugcugcccccuggcuuuggcgccccaugggcccucagcgucuccccau

SEQ ID NO: 277370 - RNA, 64 nt, Human
caugcuuggaaccucagaaaagccggacccugaagcgccccacgguccuggagcccaucccgau

SEQ ID NO: 277371 - RNA, 64 nt, Human
cucagacugugguuuuuuauguggccaccugagggcgccccaagccaguucaucucggagucca

SEQ ID NO: 277372 - RNA, 64 nt, Human
cccacccgcagcuggccucacugucccggguggcgcgccccaccugccuggcuggugguaggcc

SEQ ID NO: 277373 - RNA, 64 nt, Human
gccagacaaggguggggcuccacaggcagcacaggcgccccaccaccacccaguuuggggaccc

SEQ ID NO: 277374 - RNA, 64 nt, Human
gcgggaaagagauggggauggagucccaaggcaagcgccccaaaccucgggccacaagacacca

SEQ ID NO: 277375 - RNA, 64 nt, Human
uugauuccagggggcugguucacacuguucuugggcgccccagcauuguguugugaggcgcacu

SEQ ID NO: 277376 - RNA, 64 nt, Human
augcugguucuacaucccgaggagugucugaggugcgccccacucuguacagaggcuguuuggg

SEQ ID NO: 277377 - RNA, 64 nt, Human
aggguguccaccaagaagucacagagcccguucugcgccccacaccaucuggagcaggggcuuc

SEQ ID NO: 277378 - RNA, 56 nt, Human; identical to SEQ ID NO: 233996

SEQ ID NO: 277379 - RNA, 64 nt, Human; identical to SEQ ID NO: 234000

SEQ ID NO: 277380 - RNA, 64 nt, Human
gcugaugguggccaggaugcucagcuggccaggagggcagcaccugcuggggacgguggcccug

SEQ ID NO: 277381 - RNA, 64 nt, Human
gccacugugagggugggugcuggcugagcccccggggcagcaggagccaggcaggugaugucuu

SEQ ID NO: 277382 - RNA, 64 nt, Human
caacggaagucuuuuagugauggcuaaugggucugggcagcaucccuucaugaauuuuuuuuua

SEQ ID NO: 277383 - RNA, 64 nt, Human
ggaaagugaggccugggcugggcuggggcuaggagggcagcaggguggccucugggaggccagg

SEQ ID NO: 277384 - RNA, 64 nt, Human
aaucagaaauccacauaaaagugcucuccugccugggcagcaacaaccaagaacaaagccccgg

SEQ ID NO: 277385 - RNA, 64 nt, Human
aggcacccacagccucagcuccugugcaguuccugggcagcacaguggaagugggagccugguc

SEQ ID NO: 277386 - RNA, 64 nt, Human
caguuccagcuuccuaaaauagacaguggguaucgggcagcagucacuggggcucaagggcagu

SEQ ID NO: 277387 - RNA, 64 nt, Human
uaguuguuuacauuucuugaaaaaauaggaacucgggcagcagaaucagauuggcagaaucuuu

SEQ ID NO: 277388 - RNA, 64 nt, Human
gucacaucuggcccugaccccacuggaccaaaaggggcagcacuggugcccaccauacacacag

SEQ ID NO: 277389 - RNA, 64 nt, Human
gcaccaacauggacugagggacuucucagaggcagggcagcacacggccagccccgcggccugg

SEQ ID NO: 277390 - RNA, 64 nt, Human
auucagcaccagugaaaggcuuugagaaggacgugggcagcaaaacgacacugcgcaucaccua

SEQ ID NO: 277391 - RNA, 64 nt, Human
cagacccagagaaggacggugccaagggccccaggggcagcaaggccuugguggagcagccaga

SEQ ID NO: 277392 - RNA, 64 nt, Human
cccagcaggcccagcaugcagguggugggacacugggcagcaaggcugcugccggaaucacuuc

SEQ ID NO: 277393 - RNA, 64 nt, Human
auguuacucuguauuuaaggguaagccccacagcgggcagcacaaacagccugggagccacugu

SEQ ID NO: 277394 - RNA, 64 nt, Human
aauuaaagaagaaaaccagcaaacuaaaacuucugggcagcaaaaauauauaaaugcuucagau

SEQ ID NO: 277395 - RNA, 60 nt, Human
cuuguguucacuucaaagauggcccaacccccgcccuacacucagcucaugccuaaccua

SEQ ID NO: 277396 - RNA, 60 nt, Human
ccgcuucucuaucuccuacaggcggcuggaccgcccuaccaggauccgcuucucagacuc

SEQ ID NO: 277397 - RNA, 64 nt, Human; identical to SEQ ID NO: 234004

SEQ ID NO: 277398 - RNA, 64 nt, Human
uucucccuccaucaccaccugcccucacauccuggggcagcagcuggacagccauuagaccuca

SEQ ID NO: 277399 - RNA, 64 nt, Human
ucagaccacagacucaagauuggcucuucccagagggcagcagacagucaccccaaggcaggug

SEQ ID NO: 277400 - RNA, 64 nt, Human
cccugccaucugugcccugugggccuuuucccuggggcagcaccuugcccuccccaggggauca

SEQ ID NO: 277401 - RNA, 64 nt, Human
gggcagaacauggggaggggacuagaugggcaaggggcagcacugccugcugcuuccuuccccu

SEQ ID NO: 277402 - RNA, 64 nt, Human
uuuguagccagguacugcauucucucccauccuggggcagcacuccccagagcugugccagcag

SEQ ID NO: 277403 - RNA, 64 nt, Human
ugggucaaaugagaggccucaauaaagacaucuggggcagcaugaacaaguguauuuuggugaa

SEQ ID NO: 277404 - RNA, 64 nt, Human
caaacguucccuugcagauggagacugaaucugagggcagcagacuuuuaucagcuugaguuua

SEQ ID NO: 277405 - RNA, 64 nt, Human
aucucaugcauaacccuguggcuugcuucccccagggcagcacaggcuaagucaggaacaucgg

SEQ ID NO: 277406 - RNA, 64 nt, Human
ucuguucucggcaccccgggcccauacaggaccagggcagcagcauugagccacccccuuggca

SEQ ID NO: 277407 - RNA, 64 nt, Human
ccuuuucugcaggguggacacagggucugugugugggcagcagccccugucucucagcaagaau

SEQ ID NO: 277408 - RNA, 64 nt, Human
aguacaaccagcuccucagaauugaagaggagcugggcagcaaggcuaaguuugccggcaggaa

SEQ ID NO: 277409 - RNA, 64 nt, Human
uaugguggugucuagcacugaauggggaaacugggggcagcaacacuuauagccaguuaaagcc

SEQ ID NO: 277410 - RNA, 64 nt, Human
ugggcucugauaucccgugcggaguuggacaagugggcagcauaaagucacucauuucuuacca

SEQ ID NO: 277411 - RNA, 64 nt, Human
aacaaaacaaagaaaaagagcuuugagucuguaggggcagcaauuugggggaagcaaauauaug

SEQ ID NO: 277412 - RNA, 64 nt, Human
ccgaggaggugcucaaguacagcgaguucuucacgggcagcaagcugguggacuacgcgcgcag

SEQ ID NO: 277413 - RNA, 64 nt, Human; identical to SEQ ID NO: 234008

SEQ ID NO: 277414 - RNA, 64 nt, Human; identical to SEQ ID NO: 234013

SEQ ID NO: 277415 - RNA, 64 nt, Human; identical to SEQ ID NO: 234019

SEQ ID NO: 277416 - RNA, 64 nt, Human
agcguaugaucccagggagggugggcuggggggggggcagcacuugccucggagccacugcugc

SEQ ID NO: 277417 - RNA, 64 nt, Human
uccaggccugcuggggccuggcugggaguccugugggcagcauggaacaugcagcugggcuucc

SEQ ID NO: 277418 - RNA, 64 nt, Human
ccugcuucacggccuucaccagcccugauggagagggcagcagcugccacguggaggaagcuca

SEQ ID NO: 277419 - RNA, 64 nt, Human
agugagccaagauggcaccauugcacucuagccugggcagcagagcgagacccugucucaaaaa

SEQ ID NO: 277420 - RNA, 64 nt, Human
caagucuguggcccagacaggaugccaagucugggggcagcagcaggguccuugagagaacagg

SEQ ID NO: 277421 - RNA, 64 nt, Human
ggcugcccccgccagcucuggcuguuuagcuugagggcagcacagaggccccugggacaccuac

SEQ ID NO: 277422 - RNA, 64 nt, Human
cugccccaccccauccccgcgguugaggcugugggggcagcagaucaggagcccacugauaagg

SEQ ID NO: 277423 - RNA, 64 nt, Human
auuucucuuuuaccaauuugagugccuccuacaugggcagcaguggacuaagugcuggguguga

SEQ ID NO: 277424 - RNA, 64 nt, Human
uguugaauaucuuugaacuugcuguuuucaauaugggcagcacaaaggugagagauacauauua

SEQ ID NO: 277425 - RNA, 64 nt, Human
agggagggcugaagacaaggggccggcauucagugggcagcagaaaggagaggcuccuugaagc

SEQ ID NO: 277426 - RNA, 64 nt, Human
ggccugggaggggcaauccucaaaugcggggugggggcagcacaggagggcggccuccuucuga

SEQ ID NO: 277427 - RNA, 64 nt, Human
acuggagaaagaagcuccauugaccgaagccacagggcagcauggaaguuuaaauuuucucuaa

SEQ ID NO: 277428 - RNA, 64 nt, Human
gguuaacaaagaaugcguccgaggacuuugggccgggcagcagcaggagcuuauauuucuucgc

SEQ ID NO: 277429 - RNA, 64 nt, Human
gcugcugggcaaggaauuccagugccuccuacgggggcagcacacuuagauauuccuggacauc

SEQ ID NO: 277430 - RNA, 64 nt, Human
gucugaauauuaaagcucuucauuucuggagauggggcagcagguggcucuucugcuggggcug

SEQ ID NO: 277431 - RNA, 64 nt, Human; identical to SEQ ID NO: 234023

SEQ ID NO: 277432 - RNA, 64 nt, Human; identical to SEQ ID NO: 234029

SEQ ID NO: 277433 - RNA, 64 nt, Human
aaaaaacagucuguuggcuucucagucugcaucuuggaggcagggaggugagggcaggugcccc

SEQ ID NO: 277434 - RNA, 64 nt, Human
cuggaccaggccaccugagccaggccuucuaccugggcagcaccucugccgacgccgucccacc

SEQ ID NO: 277435 - RNA, 64 nt, Human
agaaaagcuccuaaagugaccuuccgggugggaagggcagcaguacacaugaccccauccuuuu

SEQ ID NO: 277436 - RNA, 64 nt, Human
ugucuguguuguuagaacucagaggaagaggcaggggcagcagccgacagggggcagcaugacc

SEQ ID NO: 277437 - RNA, 64 nt, Human
cucagaggaagaggcaggggcagcagccgacagggggcagcaugacccaagcaaggggccugag

SEQ ID NO: 277438 - RNA, 64 nt, Human
cgcucccgcccaccuuccccaguagcccaggccugggcagcaagcgcagccuggaggaagaggg

SEQ ID NO: 277439 - RNA, 64 nt, Human
acccaugaggguccauguggcaaguagggccacagggcagcaccugguuacaacuugcuggugg

SEQ ID NO: 277440 - RNA, 64 nt, Human
uguggugugcccuuggcuucugggggagagcuuggggcagcagaggccccugggcagcccagcc

SEQ ID NO: 277441 - RNA, 64 nt, Human
augugagcagcggcuggucucuucccuccaccuggggcagcagcaggaggccuggggaggagga

SEQ ID NO: 277442 - RNA, 64 nt, Human
gcgucucccccaccagccccaccaggcgguguaggggcagcaggcugcacugaggaccgugagc

SEQ ID NO: 277443 - RNA, 64 nt, Human
agauccaaggagcgcuugaggagcucuggguacagggcagcaacccagagcccaugggcccucc

SEQ ID NO: 277444 - RNA, 64 nt, Human
gugaagaguagcagccgaugcucucuccaaagcagggcagcagcccauaccagcuggcaucucc

SEQ ID NO: 277445 - RNA, 64 nt, Human
uacgggguucuuggagagucggccagacggcggggggcagcaggaacuuugccucauaccccac

SEQ ID NO: 277446 - RNA, 64 nt, Human
ugacuccauauggaggccucacacccagaggguagggcagcagaucuucuuuauaacuauuuau

SEQ ID NO: 277447 - RNA, 51 nt, Human
ggagaaggaaagaagacugaggggcagcagcugcuuggaguuugcguccuu

SEQ ID NO: 277448 - RNA, 64 nt, Human
uggugcuucccuggaccagaacagacuggaaacugggcagcaagcagccugcaaccaccucaga

SEQ ID NO: 277449 - RNA, 64 nt, Human
aaacagcaguguaaaauccaaaaacuuccaguccuggaggcagguugugcagcuuaggggagga

SEQ ID NO: 277450 - RNA, 62 nt, Human
gagaacugauugcccuuuaacagucaauauguuggaggcaugcuaagguacuuccuuauuac

SEQ ID NO: 277451 - RNA, 64 nt, Human
ucaggcccagaauugcaguucagaauggcaguccuggaggcagggggugaggggcaggucuagu

SEQ ID NO: 277452 - RNA, 64 nt, Human
ugcccuucucagcccagaugccaugccccugggcgggcagcagcuccccaucuucucuggcaga

SEQ ID NO: 277453 - RNA, 64 nt, Human
auccagcagaccccuuuccugucuuacuagaucugggcagcauuugacauggcugaucaccccu

SEQ ID NO: 277454 - RNA, 64 nt, Human
uccacuucagucuuaggcagauuugaccuuuuaggggcagcaaugcugaaggacacagcaauuu

SEQ ID NO: 277455 - RNA, 64 nt, Human
ugagguugacacugggaggggcuagaagauuggugggcagcagacuaaagaguuauguuggaua

SEQ ID NO: 277456 - RNA, 64 nt, Human
gugcagucacuaacucugauuuccuaagaaaggugggcagcauuagcagaugguuauuuuugca

SEQ ID NO: 277457 - RNA, 64 nt, Human
acucuaugcuuagaguuuuggcaccaaugcuguagggcagcagaaucuauucucaguaaaauaa

SEQ ID NO: 277458 - RNA, 64 nt, Human
ugcagcauuguuggcuguuccugcaguagaaugggggcagcaccuccuaagaaggcaccucucu

SEQ ID NO: 277459 - RNA, 64 nt, Human
cccacaucucuucuugccaguaagcagcuuuggugggcagcagcagcucaugaauggcaagcug

SEQ ID NO: 277460 - RNA, 64 nt, Human
ggcugcugugucuaugccagguggucccugcugggggcagcaguaccaucuacaucuccuucac

SEQ ID NO: 277461 - RNA, 64 nt, Human
uauaguaucugggggagaagacuuacuuccuucagggcagcagccacagccaggcuucugucau

SEQ ID NO: 277462 - RNA, 64 nt, Human
gugcugggggucugcagcagaaagaaaggggccugggcagcagguguggccagucccucugcca

SEQ ID NO: 277463 - RNA, 64 nt, Human
ccacuuuauucugaggaauacagugagcagauaugggcagcagccagguagggcaaagggguga

SEQ ID NO: 277464 - RNA, 64 nt, Human
agcacagggagaauguugacuuagaagcaauagggggcagcaggccaccaagagcacaacccca

SEQ ID NO: 277465 - RNA, 64 nt, Human
gggaauguggcacugucuauccauccgguggacugggcagcauuccuccccagggcucuucccu

SEQ ID NO: 277466 - RNA, 64 nt, Human
acacuucgcucuugaggagcucaacggucuggcagggcagcaggaggcuuucugggcucuggac

SEQ ID NO: 277467 - RNA, 64 nt, Human
uuuuaugagaauuuaaacuuagcaagaauggccauggaggcaaagccuucacccagacccaucc

SEQ ID NO: 277468 - RNA, 64 nt, Human
aacaaagcucacgcccuaugcaguucugagaagguggaggcaccaggcucaaaagaggaaauuu

SEQ ID NO: 277469 - RNA, 64 nt, Human
aacacucuucuggaccugguugaagcaggaaagauggaggcaaaguagugaaauaauccagaau

SEQ ID NO: 277470 - RNA, 64 nt, Human
gccugucguguccagccugacgccuacuggggcagggcagcaggcuuuuguguucucuaaaaau

SEQ ID NO: 277471 - RNA, 64 nt, Human
uggccugaaaguugggaaugguugggggagagaagggcagcagcuuauugguggucuuuucacc

SEQ ID NO: 277472 - RNA, 64 nt, Human
guccccucuuaggacaggcacugcccagcagcaagggcagcagaguugggugcuaagauccuga

SEQ ID NO: 277473 - RNA, 64 nt, Human
aaguuuuguuuuguuuuucagcguuaauguaaaggggcagcagugccaaaauauaaucagagau

SEQ ID NO: 277474 - RNA, 62 nt, Human
acuaucugcaguaccagugagccaagccugaugggcagcacagacacagacacacaccgcag

SEQ ID NO: 277475 - RNA, 64 nt, Human
gcggccccgagaccccaacacaugcuucuucgaggggcagcagcgcccccacggggcucgcugg

SEQ ID NO: 277476 - RNA, 64 nt, Human
ucucauaaugugaaauaugaugagauucacuuaggggcagcauguuaguuuugggaggcaaugu

SEQ ID NO: 277477 - RNA, 64 nt, Human
cugugcugagagguacccagaagguucccaugaagggcagcauguccaagccccugaccccaga

SEQ ID NO: 277478 - RNA, 64 nt, Human
gguucaggaagacugacugaggccacuuccaggugggcagcagaggcaggccccagugugacca

SEQ ID NO: 277479 - RNA, 64 nt, Human
uggcacuguccucgguguguccuggagcugugcugggcagcagggccucgcguaaggaacugcu

SEQ ID NO: 277480 - RNA, 64 nt, Human
cagacuggaaaggaccacagaccuggccaucccugggcagcagggccagugucaccugcugacc

SEQ ID NO: 277481 - RNA, 64 nt, Human
uugagcaaagaacuaaggauuuuuccauggacaugggcagcaauucacgcugucucuucuuaac

SEQ ID NO: 277482 - RNA, 64 nt, Human
augcuugggcuuaggaucuugaggccugucacaugggcagcaugugcacaggggacagaguauu

SEQ ID NO: 277483 - RNA, 64 nt, Human
ggcuguggagcagcaggaccuggcccuucugccugggcagcagaauauauauuuuaccuaucag

SEQ ID NO: 277484 - RNA, 64 nt, Human
ugugcucuuucaggugggaguuuuggggccuccagggcagcaggcaccaccuccauaucccggc

SEQ ID NO: 277485 - RNA, 64 nt, Human
uugaaaaacccaaacaauauucuucuuagauuuuuggaggcaaaauuuagaccaguauacuaau

SEQ ID NO: 277486 - RNA, 64 nt, Human
ccugcaaccaccucagacauccuggacugggagguggaggcagagccccccaggacaggagcaa

SEQ ID NO: 277487 - RNA, 64 nt, Human
acccgcagaguucucagaaucaugcugagagagcuggaggcacccaugccaucucaaccucuuc

SEQ ID NO: 277488 - RNA, 64 nt, Human
cuuugcagggcccaguugauggccuuguuagcaugggcagcaugcagccacuucacccuggggg

SEQ ID NO: 277489 - RNA, 64 nt, Human
acagaccgucauauucuaauagcucaugaaauuugggcagcagggaggaaaguccccagaaauu

SEQ ID NO: 277490 - RNA, 64 nt, Human
guagcgaagagagaggugugcuucaauccuggaggggcagcaggaggcggagcucuuuugcuug

SEQ ID NO: 277491 - RNA, 64 nt, Human
uaaaguuaaguuugaauccccuauuuuugcacaggggcagcagauacacacaacaaugagaacu

SEQ ID NO: 277492 - RNA, 64 nt, Human
ccuuucccuugugaacaaaagccuaguuuugugugggcagcaauauaggguaaauaaaaccacc

SEQ ID NO: 277493 - RNA, 64 nt, Human
cggcccugccuucccaccaccaccaccgugcauggggcagcaaacacguggggccgcagacaua

SEQ ID NO: 277494 - RNA, 64 nt, Human
uccacagguacgcgggagccucagguucucucaggggcagcaaaguggcccaagcugccccuga

SEQ ID NO: 277495 - RNA, 64 nt, Human
cucccccagccaggaccaccucguccucguggcggggcagcaggagcgguagaaagggguccga

SEQ ID NO: 277496 - RNA, 64 nt, Human
ggcccucucccaccugccuguucaguggaggccagggcagcagcccagaacagcacaugugggg

SEQ ID NO: 277497 - RNA, 64 nt, Human
cccugagugcccagggugucuccucugcccagaggggcagcagcucucccugguucuccccagg

SEQ ID NO: 277498 - RNA, 64 nt, Human
agugagccuagaucaugccacugcacuccaaccugggcagcagagcaagacucugucucaaaag

SEQ ID NO: 277499 - RNA, 64 nt, Human
aacaacuaaaaaaguggaccuucucagaaaaaaagggcagcaaaugaccaagggcgccccuucu

SEQ ID NO: 277500 - RNA, 64 nt, Human
acuugucaaauauaucaagaguauaucauugcaagggcagcacuuguccuguggaacaacuacu

SEQ ID NO: 277501 - RNA, 64 nt, Human
gcugccagucccuccagccucaccuccccgcccugggcagcaggugugggcagcgugugaggcu

SEQ ID NO: 277502 - RNA, 64 nt, Human
acuaguuagacucuuuagaauacuccaagaguuagggcagcagaguggagcgauuuagaaagaa

SEQ ID NO: 277503 - RNA, 64 nt, Human
agccagguggccugugcuccccaugggugaccucuggaggcaguggaccaagaugcagcaagga

SEQ ID NO: 277504 - RNA, 64 nt, Human
agcaaccuuuguuaggaaaaagcacagccucagauggaggcagccuaaacuguguucuuguuuu

SEQ ID NO: 277505 - RNA, 64 nt, Human
ggggcccgggaguccaaauacuggaauggaggguuggaggcagccuuccuuggauuuacucaug

SEQ ID NO: 277506 - RNA, 64 nt, Human
cuggugaaaugcguguguguacagacaguccacugggcagcacagguauccucauguucuuuau

SEQ ID NO: 277507 - RNA, 64 nt, Human
uccuugucugcuggguggccccugccauucugaauggaggcagaaccagcaacaacucugggcg

SEQ ID NO: 277508 - RNA, 64 nt, Human
uaugggggagaaaagggaaaaugcugucaguagauggaggcaagguuacagguugacucaauag

SEQ ID NO: 277509 - RNA, 64 nt, Human
cugcauggagcacucggugacccagagcagggacuggaggcacccccagcccugccccaggcca

SEQ ID NO: 277510 - RNA, 64 nt, Human
uccuggugucgccgguggcucauuuucuggcaaauggaggcacgaacgcaggggccaaauagca

SEQ ID NO: 277511 - RNA, 64 nt, Human
ccugauuuccuggaaaauuuuauuauucaaaagguggaggcauuguaaaaaggaaauagugaug

SEQ ID NO: 277512 - RNA, 64 nt, Human
agccugggaaagggcuggcucacugaugagaauguggaggcaucagcaaggaucucgguggguu

SEQ ID NO: 277513 - RNA, 64 nt, Human
uuccagccauaccuguucuggaagggagaggggcuggaggcacccacaggcacaagcugaaggc

SEQ ID NO: 277514 - RNA, 64 nt, Human
ccugaugcaguuucugugccauugcuggugcugguggaggcagcggagcagaggcucaggcaca

SEQ ID NO: 277515 - RNA, 64 nt, Human
agaugcauucucauaccugcccacagcuccauuuuggaggcaggcagguuggugccugacagac

SEQ ID NO: 277516 - RNA, 64 nt, Human
cuacggggcaugugccucaucacaccauccauccuggaggcacaaggccuggcuggcugcgagc

SEQ ID NO: 277517 - RNA, 64 nt, Human
ccuagcucccucccccaaaggcgcuuucccccgauggaggcacaggcuucugucucggauguuu

SEQ ID NO: 277518 - RNA, 64 nt, Human
gagcaugucacccuuuugcuucaaucagguuugguggaggcaaccugaccagaaacacuucgcu

SEQ ID NO: 277519 - RNA, 64 nt, Human
gggcauccucaggcuggcggccaaggccugccccuggaggcacuagaggagggcaucugucugu

SEQ ID NO: 277520 - RNA, 64 nt, Human
gggguaugcagagcuugugguggggcaggaacgguggaggcagaggugacaguucccagagugg

SEQ ID NO: 277521 - RNA, 61 nt, Human
ugcccugggaggccagcuaggaagcaaggguuggaggcaaugugggaucucagacccagua

SEQ ID NO: 277522 - RNA, 64 nt, Human
acugcagcuucugcuggugcuccccccguccuccuggaggcaguauaggagagagagcaaggau

SEQ ID NO: 277523 - RNA, 64 nt, Human
gcacccuuccccucccgcagaugauccuggaguguggaggcagcagcggcaccucgagagagaa

SEQ ID NO: 277524 - RNA, 64 nt, Human
ugugugugugcgugugugugugugugugugugucuggaggcacaggcacaaagcauugcuuggg

SEQ ID NO: 277525 - RNA, 64 nt, Human
cucaccuccagcugucagagggugagcagggcccuggaggcaggcacccccuccuccuccuccc

SEQ ID NO: 277526 - RNA, 64 nt, Human
gcaggguggggcaucaccaccucacuggccuugcuggaggcacagggcucugcggaccugcagc

SEQ ID NO: 277527 - RNA, 64 nt, Human
cagccugaagucacgguccuggcccagcacaggugggcagcagcgagcuggcaggugaagugug

SEQ ID NO: 277528 - RNA, 64 nt, Human
cucucaccuguagguuuaaucaccuugagugacugggcagcagcgguggagucuguguugcacc

SEQ ID NO: 277529 - RNA, 64 nt, Human
auuccuguuguguaauaacagaacucguggcguggggcagcagcugccucugagcccucgcucg

SEQ ID NO: 277530 - RNA, 64 nt, Human
agagggaacuugaaauccagggucaaagguuaaggggcagcagcuggucuggccccugaaagcc

SEQ ID NO: 277531 - RNA, 64 nt, Human
ccccucucugcacuauccgauccucaucaacagagggcagcauuguguuggucaauguucccuu

SEQ ID NO: 277532 - RNA, 64 nt, Human
caggaucagggguuagggugcaagaagccauuuagggcagcaaaacaagugacaugaagggagg

SEQ ID NO: 277533 - RNA, 64 nt, Human
guauuuguuauugucuacaauauauuugaauuuggggcagcauauuaagauguaauggccuguu

SEQ ID NO: 277534 - RNA, 64 nt, Human
aguagaaagcuaaagugauccuaaauaugacagugggcagcaccuuucuagcgugagcuguaga

SEQ ID NO: 277535 - RNA, 64 nt, Human
cucccguagaaagguuugguuugaaaugccccgggggcagcaaacugacaugguugaaugauag

SEQ ID NO: 277536 - RNA, 64 nt, Human
cccagcacugagaacaaaaugcaggcaucccccggggcagcaucagagugccuuucuagaggga

SEQ ID NO: 277537 - RNA, 64 nt, Human
cagguucaaugaaggauaauaaucuaaaucauuagggcagcaguuucucugguaacggaagaga

SEQ ID NO: 277538 - RNA, 64 nt, Human
ucacugaauaggagacuuuacaucucucauggcugggcagcagcugugucuggcuuccuuacuu

SEQ ID NO: 277539 - RNA, 64 nt, Human
ggugauaguugucaugcgacagccugagaacgcugggcagcaccacacccuccaauucacacug

SEQ ID NO: 277540 - RNA, 64 nt, Human
ccaccaacuaccagaccagaacacgagccccucugggcagcaggauuccuaagucaaagaccag

SEQ ID NO: 277541 - RNA, 64 nt, Human
uucugugcugucccaggaagugucuggcgggcgugggcagcacagcucuacacuguacgauuca

SEQ ID NO: 277542 - RNA, 64 nt, Human
gggaagagaaagggcaccccagcgggggcauguguggaggcagcacggaacauguagguuauag

SEQ ID NO: 277543 - RNA, 64 nt, Human
ugcaauuccauguggaugucaccaaaccccaguguggaggcagggacagucaugggaauguggg

SEQ ID NO: 277544 - RNA, 51 nt, Human
ggucacacgagccagugugaguggaggcagaggagugaggcccacgggcag

SEQ ID NO: 277545 - RNA, 64 nt, Human
uguaaagaacuuaauuucaguauaaacugacucugggcagcauuggugaugcuguauccugagu

SEQ ID NO: 277546 - RNA, 64 nt, Human
ccgcgagugggcacgucucugaaugugaggucucgggcagcacgugagguagaacgagugugag

SEQ ID NO: 277547 - RNA, 64 nt, Human
uugugcaggcagcugccggaggggugccaggagggggcagcaacaacggcaagacucccgugug

SEQ ID NO: 277548 - RNA, 64 nt, Human
acauuucauuagccaugcaacauggauauguauugggcagcagacuguguuucgugaacugcag

SEQ ID NO: 277549 - RNA, 64 nt, Human
ccauaccugccagcuucagacauuuagggaaaaggggcagcauguggggaaugccccccgccuu

SEQ ID NO: 277550 - RNA, 64 nt, Human
aauguguguagugcuuuuguuaaagccccuauaugggcagcauggaggaucauaagauagcaaa

SEQ ID NO: 277551 - RNA, 64 nt, Human
gcucccagccaagaagaaagugugagaaguugaugggcagcaaaccugcuguuuaacaucaggg

SEQ ID NO: 277552 - RNA, 64 nt, Human
gugcucggcagucauacuggggugcgagagaggugggcagcagcucagccuccccccgcugggg

SEQ ID NO: 277553 - RNA, 64 nt, Human
agccuggagccaccuaccucuggccucaggcugugggcagcaaaaggaaugugugugcacuugg

SEQ ID NO: 277554 - RNA, 64 nt, Human
guugccuuggaguccccuacagccccucagcagagggcagcacuugaaugcuuagcuccauccc

SEQ ID NO: 277555 - RNA, 64 nt, Human
accuauauccagaaggggagcuuuuucagaaacagggcagcaguggggugaaauuuucuuaacc

SEQ ID NO: 277556 - RNA, 64 nt, Human
acccuggauuacucuuuggaaaucacuccuuggugggcagcauccugaggcuuccccagaacca

SEQ ID NO: 277557 - RNA, 64 nt, Human
uagccuucagugggaggaguggcaaaggcacgcagggcagcaguacccccguuuggcacuugag

SEQ ID NO: 277558 - RNA, 64 nt, Human
gaagacaccuauuccacagagacugauuuauagggggcagcacuuuauuuuuuucuggaaaccc

SEQ ID NO: 277559 - RNA, 64 nt, Human
cugccucagcucuguacacaugauaugcaacaaagggcagcaagaaaugcuggguccaccuaau

SEQ ID NO: 277560 - RNA, 64 nt, Human
aucaggggauaugaugugaugauuuucaagguguuggaggcaacuucuguuccaagaacuccca

SEQ ID NO: 277561 - RNA, 64 nt, Human
uuuuuauuagcugcuugguaugcaguaacuuggguggaggcaaaacacuaauaaaagggcuaaa

SEQ ID NO: 277562 - RNA, 64 nt, Human
uucuuuauggaccacgaagggaagcccaccuuccuggaggcaggaccuucggccuaagaaacac

SEQ ID NO: 277563 - RNA, 64 nt, Human
ggguagcgcacucuucauggugacacucgaggucgggcagcacaaguguaaugaauaccuuagu

SEQ ID NO: 277564 - RNA, 64 nt, Human
gccccaggccgggggacaccagaggcuccuccaugggcagcaggagugagcggagggguguguc

SEQ ID NO: 277565 - RNA, 64 nt, Human
ggcgacucccauacccugaagccuggggcaugcugggcagcaccggugcccaaaucuggcuggu

SEQ ID NO: 277566 - RNA, 64 nt, Human
ggugaaggcaaguucaagcaccacuugagacugggggcagcauggaguagggcagggcuacggg

SEQ ID NO: 277567 - RNA, 64 nt, Human
ccacaagaaaagagcacaggcugcaccaaagcaggggcagcagagaauaaaauaucccuuugaa

SEQ ID NO: 277568 - RNA, 64 nt, Human
uggagaugguaggagaguuuccuaggucuuuccagggcagcaugugauucauuuggggauggaa

SEQ ID NO: 277569 - RNA, 64 nt, Human
ucucacaggccuccucuuucaaauaaggcauggugggcagcaaagaaaggguguauugauaaug

SEQ ID NO: 277570 - RNA, 64 nt, Human
cuguguuuuucucaacacuacuuuucugauaugagggcagcaccugccucugaaugggaaauca

SEQ ID NO: 277571 - RNA, 64 nt, Human
guggggacagcugcagagaagaggccuggaacucgggcagcacugcagugccaggaggcaggcg

SEQ ID NO: 277572 - RNA, 64 nt, Human
ccugggugacaugggaugugacuuucgggugucggggcagcaugcccuucucccccacuuccuu

SEQ ID NO: 277573 - RNA, 64 nt, Human
caaccuccgccuccuggguucaagcaauucucuggggcagcaguucuaagcucugguugcacau

SEQ ID NO: 277574 - RNA, 64 nt, Human
cuacuucauugaguaaaaucgagugagagguuccgggcagcaggaucgacgcccaguccagccg

SEQ ID NO: 277575 - RNA, 64 nt, Human
cuccuuuguucuggguccuuucgggagggcugaugggcagcacaggaggcccguccucgggggg

SEQ ID NO: 277576 - RNA, 64 nt, Human
uuucaguucacuguugguucucaucuuugaaagagggcagcauaagggaaaugauggagaaggg

SEQ ID NO: 277577 - RNA, 64 nt, Human
gggcugauccugccucagcuguguggccaugugggggcagcaggggccugggccauagcugggg

SEQ ID NO: 277578 - RNA, 64 nt, Human
ucauuuagccuguccugucaucaucauggccagcuggaggcaggggcuuccuggugcuggaggu

SEQ ID NO: 277579 - RNA, 64 nt, Human
uucucgaagagcuaccaacacccaaguucagcuuuggaggcagaucuggaaacaguguagcagc

SEQ ID NO: 277580 - RNA, 64 nt, Human
cauguuguccagagguccagucuggcugcuguuguggaggcaaggaaggcaacucaucccagaa

SEQ ID NO: 277581 - RNA, 64 nt, Human
gcaggugcucgaugggccccccagggcuucuccagggcagcacagggaccccggaugaagacuc

SEQ ID NO: 277582 - RNA, 64 nt, Human
caaggcuccucgccaaggaacucguggcagaagagggcagcaguuggcaguagcugccgauguc

SEQ ID NO: 277583 - RNA, 64 nt, Human
aguuuauaaauaauauguugaauuaugucagugugggcagcaguagaauacuaaaaggaaaaug

SEQ ID NO: 277584 - RNA, 64 nt, Human
cuugccuuuuuccuguucuguuuggaguggagaagggcagcaccucuguguuuaauggaaauag

SEQ ID NO: 277585 - RNA, 64 nt, Human
uucaccacccuguugagcaauuuucccaaaaaaagggcagcaauuauuaaauugaauucaagua

SEQ ID NO: 277586 - RNA, 64 nt, Human
ggcugggugcacguccugccucuccagccccacagggcagcagcaugacugacagacacgcugg

SEQ ID NO: 277587 - RNA, 64 nt, Human
cccugcccugucaggcugucagacaagccccggggggcagcaggugggcucgggacgggcuggg

SEQ ID NO: 277588 - RNA, 64 nt, Human
cagccauguuugaagggcacaugugaugaguggggggcagcaagaugccauuucugcaucuccc

SEQ ID NO: 277589 - RNA, 64 nt, Human
gacccguuuccuuucagggauguggacaggguaagggcagcaagcaugguucuguuaaaggagu

SEQ ID NO: 277590 - RNA, 64 nt, Human
ggggcgaggagagagccagaaaacauagauccgagggcagcagugcuggguggagagagccaga

SEQ ID NO: 277591 - RNA, 64 nt, Human
ugacauuuuacauuaaauuuuuuuuacauuuuuugggcagcaauuuaaauguuaugacuaugua

SEQ ID NO: 277592 - RNA, 63 nt, Human
ggccccagccccucacguagucugggaggcagggggcagcagccccugggccgccuccccacc

SEQ ID NO: 277593 - RNA, 64 nt, Human
ugugggggauugaaacuagcucccagcccccauggggcagcagcugggccacaauugccccuuu

SEQ ID NO: 277594 - RNA, 64 nt, Human
cugcugguggguggcccagagccucugcuggaaggggcagcaggaggaguggaaggaaaccgcu

SEQ ID NO: 277595 - RNA, 64 nt, Human
gcugccccucugucugccuggcugagaugcaugugggcagcaggaagcccaagugaaauuaaua

SEQ ID NO: 277596 - RNA, 64 nt, Human
gucacacguggaacugacaggagacccgccaccguggaggcagggggcaagaaacucaagaacg

SEQ ID NO: 277597 - RNA, 64 nt, Human
ucucuuaaguaauugguuaguuaacacugaauuuuggaggcaaaggaggguuggccugaguuag

SEQ ID NO: 277598 - RNA, 64 nt, Human
gauuaucugggggucuguccacccuggcuggaucuggaggcaagaugccaggccccccaggugu

SEQ ID NO: 277599 - RNA, 64 nt, Human
gugucugccuaagccuucaagugggcggagcugagggcagcagcuugacuuugcagacaucuga

SEQ ID NO: 277600 - RNA, 64 nt, Human
ugagcccugucugccagcccaccccagggacugggggcagcaccaggucccggggagagggauu

SEQ ID NO: 277601 - RNA, 64 nt, Human
ccauagccccaguaggacaaacgggcucgggucugggcagcaccucuggucaggagggucaccc

SEQ ID NO: 277602 - RNA, 64 nt, Human
agugaaccgagaucacaccacugcauucccgccugggcagcagagcgagacuccgucucaaaca

SEQ ID NO: 277603 - RNA, 64 nt, Human
ucuucuuuguaucucccuccuucccagcccacccgggcagcagacucugauggaaggaaggugc

SEQ ID NO: 277604 - RNA, 64 nt, Human
aagugagaaguguuaugacauuagugcccugauugggcagcacccacggcuacaguaucagguc

SEQ ID NO: 277605 - RNA, 64 nt, Human
auuugacuaucuuggggguaaaaugcugucauaggggcagcagucucaggggguguaaacucug

SEQ ID NO: 277606 - RNA, 64 nt, Human
agugagccgagaucgcaccacugcacuccagccugggcagcagagcaaguaguaauaaccaccg

SEQ ID NO: 277607 - RNA, 64 nt, Human
ccucuuuuccugcucccuaaccuuucgccgaauggggcagcaccacugacguuucugggcggcc

SEQ ID NO: 277608 - RNA, 64 nt, Human
gagaugcacgcagacccaucucccuugucaugcugggcagcacaccggcuaagcaggggagcag

SEQ ID NO: 277609 - RNA, 64 nt, Human
guggucugaguggagaccugugcuccccggagaggggcagcagugcgggaggggcuuugcacag

SEQ ID NO: 277610 - RNA, 64 nt, Human
aagcccaacagcaagggugacuccuggcaggugggggcagcaggagggcagagggcagagcucu

SEQ ID NO: 277611 - RNA, 64 nt, Human
uugucuccccuccugggcuuuccuccugcccugugggcagcagccuaggcugggucaggggcuu

SEQ ID NO: 277612 - RNA, 64 nt, Human
gagaggcagcgugcagcccuacugucccuuacuggggcagcagagggcuucggaggcagaagug

SEQ ID NO: 277613 - RNA, 64 nt, Human
ccaccucugcaggggagaaggcucccuccccauggggcagcaucaggacgggggcucaagcugc

SEQ ID NO: 277614 - RNA, 64 nt, Human
agaugaaguuucccaggcacagggcaucugugacuggaggcaucagauuccugauccacacccc

SEQ ID NO: 277615 - RNA, 64 nt, Human
ggcccaggaaggggugggcuggauuuuguaaagcuggaggcagccaggaaucugacuguccgga

SEQ ID NO: 277616 - RNA, 64 nt, Human
cuucuuauauuaacacguuuuacauauaaagaaauggaggcaagaaagcauuuccuuugggguu

SEQ ID NO: 277617 - RNA, 64 nt, Human
gagauggacccgugaccucguggaggccgugugggggcagcagccuggccugugccaugguggg

SEQ ID NO: 277618 - RNA, 64 nt, Human
caauacauccuuuugucucccaagggaagagaaugggcagcagguaugugugugugugcaugug

SEQ ID NO: 277619 - RNA, 64 nt, Human
ccaggaggugcagacuucuuaaaaggagcucgcggggcagcaaagcagcugauucagcagugcc

SEQ ID NO: 277620 - RNA, 64 nt, Human
ccuguggaggugcugaagcccacaguuccacacagggcagcagggagcgcaaggcucaggucag

SEQ ID NO: 277621 - RNA, 64 nt, Human
uucaucccaaguuagguacugaccccucccucuugggcagcaccucccuuuuuaaaaaaauuuu

SEQ ID NO: 277622 - RNA, 64 nt, Human
ggcgaaggugguaguacagcaagaggcacuggcggggcagcaggccugcaggagcuguuuuucc

SEQ ID NO: 277623 - RNA, 64 nt, Human
uaaccuaacgaaauuuccaugaagaaccaagucagggcagcaucuccuuagucccagcucaggc

SEQ ID NO: 277624 - RNA, 64 nt, Human
cuucuacugaaggacaguccgcugucuccagugggggcagcagcugucccccagccucgaugga

SEQ ID NO: 277625 - RNA, 64 nt, Human
aucucgccugcgcuuccuccugauggucgccagagggcagcauccccuaacuaauaccguaacc

SEQ ID NO: 277626 - RNA, 64 nt, Human
cacccaccaugccgcacauuacuggguaaaagcagggcagcagggaacaaaacuccagacucuu

SEQ ID NO: 277627 - RNA, 64 nt, Human
ccucagccggcgccggacccgguaggggcagucugggcagcaggaaggaagggcgcagcguccc

SEQ ID NO: 277628 - RNA, 64 nt, Human
cagucaccgccgucggaaggcgcuggagccugcggggcagcaggggccaagcaggcacucuggg

SEQ ID NO: 277629 - RNA, 64 nt, Human
agggugagguguggaagggacagggggaggagaugggcagcauuguugagagauugguaacacu

SEQ ID NO: 277630 - RNA, 64 nt, Human
ccugguauuggcacuaaaaucauguaguuauacugggcagcaauaauaauugggcaugaggcug

SEQ ID NO: 277631 - RNA, 50 nt, Human
ggauuaccgacagugacuaagggcagcauguuuaacccagguauaguaag

SEQ ID NO: 277632 - RNA, 64 nt, Human
cucuucauuuauuuugacugugauuuauuuggaguggaggcauuguuuuuaagaaaaacauguc

SEQ ID NO: 277633 - RNA, 64 nt, Human
ugcuccuuuggcuucauauaugagcgugagcagcuggaggcaacuuguccccagugucaccaga

SEQ ID NO: 277634 - RNA, 64 nt, Human
guucccccggcagucggcuucuucagucgcucccuggaggcaggugggcacugcagaggaucac

SEQ ID NO: 277635 - RNA, 64 nt, Human
uggacuuagggcugggcaggcaguagccaccagagggcagcagcgaacuaggccaggccugacu

SEQ ID NO: 277636 - RNA, 64 nt, Human
ucagcaaccagcucuguagggagcucugccagaggggcagcagcugcagauccacuuaggcccc

SEQ ID NO: 277637 - RNA, 64 nt, Human
gggucaaaucuuucuaauuuuuuguaucuuuagagggcagcacuagaagaaaucagcaggucua

SEQ ID NO: 277638 - RNA, 64 nt, Human
caaaucaacauuccagcggucaggacugaccccggggcagcacugggcucaggcuucagcgcga

SEQ ID NO: 277639 - RNA, 64 nt, Human
acaaugugacagaagccugggcgaggcccucggagggcagcagcuggacaggggcuacuggguu

SEQ ID NO: 277640 - RNA, 64 nt, Human
gcaucucuugaggccaggaguuugagaccagccugggcagcauagcaagacacaucccuacaaa

SEQ ID NO: 277641 - RNA, 64 nt, Human
cauaagcucaucacaggggagggaauuaggagcagggcagcagguaauuaaacaagauaaauua

SEQ ID NO: 277642 - RNA, 64 nt, Human
cagcauccuuacuggauaucuuaguugcuuguuugggcagcacacuaauauuacuuaaaacacu

SEQ ID NO: 277643 - RNA, 64 nt, Human
auccacaugggagccgggucugccucuucugggagggcagcagggcuacccugagcugaggcag

SEQ ID NO: 277644 - RNA, 64 nt, Human
agggucugguccuggcuccucuuacugagauacagggcagcacuggcagagagcagacuuaagg

SEQ ID NO: 277645 - RNA, 64 nt, Human
agcuucugcaagguuuuccaggaaaaucugcuuggggcagcauuuguuaaccuagcugccagua

SEQ ID NO: 277646 - RNA, 64 nt, Human
ggcggagaaugaaggugguggcggcagaggaggagggcagcagcugagaggccagggacagggu

SEQ ID NO: 277647 - RNA, 64 nt, Human
ggcaggccgcaagugggguuggugggggucgagcgggcagcacggugcagcggugcaguggcaa

SEQ ID NO: 277648 - RNA, 64 nt, Human
cugcagacaugcugggaacucgcauggaacaggagggcagcagggcacuaaccuccgaagccag

SEQ ID NO: 277649 - RNA, 64 nt, Human
gggcguccaugccaaggccccauaccugggccgggggcagcacggccuggcuuucccccgcuuc

SEQ ID NO: 277650 - RNA, 64 nt, Human
cagcaguaccaguauaagaugacauuccaaagacuggaggcaacucagccugaguuaauucaca

SEQ ID NO: 277651 - RNA, 64 nt, Human
cucuggagcagcugucugucccucagagggcaccuggaggcagcaaagauuaucuuauuuauuu

SEQ ID NO: 277652 - RNA, 64 nt, Human
ugagucuagagagauuugaguuuuguuuugccuguggaggcaauuggggguuucaggucaaaga

SEQ ID NO: 277653 - RNA, 64 nt, Human
aaggcccucccucacccugcuccccacccaggcagggcagcaugggacccagugucucagugcc

SEQ ID NO: 277654 - RNA, 64 nt, Human
ggagagagaggcugagaucauucaggaguuuguugggcagcaagcauggagcuucuugcacaaa

SEQ ID NO: 277655 - RNA, 64 nt, Human
gccuaggaggugccccccacauugguguccccaugggcagcaggcagacagcucacccccacca

SEQ ID NO: 277656 - RNA, 64 nt, Human
uaucaacuuccuaaauauuaugagaugcuggcuugggcagcauccccuugaacucuucacucuu

SEQ ID NO: 277657 - RNA, 64 nt, Human
ggcuaacuucaggcugaugagugugugggguauggggcagcagaggcagccagccagcaaagag

SEQ ID NO: 277658 - RNA, 64 nt, Human
gggugggccugggcagcugggugggccugagcuagggcagcagggccuggcucacgccgcugcc

SEQ ID NO: 277659 - RNA, 64 nt, Human
ugcagguggcaccgguggcccuggcugcaguucugggcagcauccucccaagcagagaccuugc

SEQ ID NO: 277660 - RNA, 64 nt, Human
acccacucagccaaaucucauggaagaccaaggagggcagcacuguuuuuguuuuuuguuuuuu

SEQ ID NO: 277661 - RNA, 62 nt, Human
accaggagacggcuguguagcgggccgcccacgggcagcaggagggacaaugcggccagggg

SEQ ID NO: 277662 - RNA, 64 nt, Human
uuauuuauguuuucccuuuggcugugacuggguggggcagcaugcagcuucugauuuuaaagag

SEQ ID NO: 277663 - RNA, 64 nt, Human
ugacaccaagaagggccccucgcucuugcuggcagggcagcagggggacugaaggcuggagcgg

SEQ ID NO: 277664 - RNA, 64 nt, Human
ucggggccggagaagagaccaagagaccaggcccgggcagcagccuaccggccacguggaacac

SEQ ID NO: 277665 - RNA, 64 nt, Human
gcauugaacggccuguccaaagauccucucucuagggcagcagagagcuuuuugcacuuuaaaa

SEQ ID NO: 277666 - RNA, 64 nt, Human
cccaucugcccaggacggggccggccaggugggcgggcagcacagcaaggaggcuggcuggggc

SEQ ID NO: 277667 - RNA, 64 nt, Human
agggaauauggcucaguagggccugccccuucaagggcagcaagaacgaagcaggauguuguca

SEQ ID NO: 277668 - RNA, 64 nt, Human
uugccuaagaggaaucccucuauuucaccuguucuggaggcaccagaccuugaaaagaacaugc

SEQ ID NO: 277669 - RNA, 64 nt, Human
ucgggugugcaaugucugagugaaccuguauaaguggaggcacuuuagggcuguaaaaugcaug

SEQ ID NO: 277670 - RNA, 64 nt, Human
ggacagaguagaagccccuccaucugcccugggguggaggcaccaucaccaucaccaggcaugu

SEQ ID NO: 277671 - RNA, 64 nt, Human
uucacucuaauggacuguuccagggaagggaugggggcagcagcugcuucggauccacacugua

SEQ ID NO: 277672 - RNA, 64 nt, Human
agggccaugugcaauauuuggaggguuuucuggagggcagcaggaaggcuggggaauuccccau

SEQ ID NO: 277673 - RNA, 64 nt, Human
cccguaaccacuauuuguugcacugugccuugaagggcagcaggcccaagugcugcucugacug

SEQ ID NO: 277674 - RNA, 64 nt, Human
gaauuacuugagcccaggaguuugaauccauccugggcagcauacugagacccugccuuuaaaa

SEQ ID NO: 277675 - RNA, 64 nt, Human
uccugcccuucggucgaguggagcaagcucucgagggcagcacugacaaauguguuccuaagaa

SEQ ID NO: 277676 - RNA, 64 nt, Human
ugguguccucggauaaugaucugccccggagcuagggcagcaacaugaggaccaaaccaugcac

SEQ ID NO: 277677 - RNA, 64 nt, Human
ccagucaucaaagcagagagacguggcggcaugugggcagcaugcccagguuccuugcugacuc

SEQ ID NO: 277678 - RNA, 64 nt, Human
agggaagaccccuccccagcccucccgucggcaggggcagcagggggcagggugcaggguccac

SEQ ID NO: 277679 - RNA, 64 nt, Human
ccagcaguguugcucagcuccuaccucugugccagggcagcauuuucauauccaagaucaauuc

SEQ ID NO: 277680 - RNA, 64 nt, Human
ccugacaccugucauauuuauggaccagacacuggggcagcaucaggcacagucugucugggug

SEQ ID NO: 277681 - RNA, 64 nt, Human
ucaaguucuagagagcugccugugggacagcccagggcagcagagcugggauguggugcaugcc

SEQ ID NO: 277682 - RNA, 64 nt, Human
aagucugaggccccguggacugcugggagggagggggcagcaggccccuggccccucccuggca

SEQ ID NO: 277683 - RNA, 64 nt, Human
uggggguaccccagggguguuaaggcucaggagugggcagcagucagggagagacagaacuggg

SEQ ID NO: 277684 - RNA, 64 nt, Human
ccacgagcagcagccuguggcacccgcugggcgcgggcagcagggaagagggagcaaggcauug

SEQ ID NO: 277685 - RNA, 64 nt, Human
ucacccucauccuggugcuuagguggcagagggugggcagcaggggacagggaugggauggcaa

SEQ ID NO: 277686 - RNA, 64 nt, Human
aagccaaagcaauccuaagcaaaaagaacaaagcuggaggcaucgcauuacccaacuucaaacu

SEQ ID NO: 277687 - RNA, 64 nt, Human
acccaucccuuuuccuuucuggccccagccuagguggaggcaaguggaauaucuuauauugggc

SEQ ID NO: 277688 - RNA, 64 nt, Human
auuguauuuuguguccauggaacguuuauagacauggaggcaggcaauaaauuccuccaauaau

SEQ ID NO: 277689 - RNA, 64 nt, Human
gcugcgcaugaggacugucugccuuugagggcuugggcagcagcggcagccaucuugguuuuag

SEQ ID NO: 277690 - RNA, 64 nt, Human
agggaaaggaaugccugggagugggggugcaggcgggcagcacugagggacccugccccgcccc

SEQ ID NO: 277691 - RNA, 64 nt, Human
auguuauuuuuuaaaaccuggaccuuuucuggaagggcagcauauaaaaacaucagucccgagg

SEQ ID NO: 277692 - RNA, 64 nt, Human
aggccuuugcuucucugccuacguccccuuagaugggcagcagaggcaacucccgcauccuuug

SEQ ID NO: 277693 - RNA, 64 nt, Human
uuccugcccccuccuugcccaccugccugcccccgggcagcacgggagggagagcagggugagc

SEQ ID NO: 277694 - RNA, 64 nt, Human
caguggggagcaaaccuagauaaggaccuguuuggggcagcagggagcaaaaucuccuuuaaca

SEQ ID NO: 277695 - RNA, 64 nt, Human
ccacugucuugcaguggacggagagccuuggcgagggcagcaggguagagaggacaaagaaugu

SEQ ID NO: 277696 - RNA, 64 nt, Human
acagagaucacacacaccaaaccagacagaggcagggcagcauggagacagguagacagaccuc

SEQ ID NO: 277697 - RNA, 64 nt, Human
gauggcuuugggccuaguaguucgaguccagccugggcagcauagugugagacccugucucuua

SEQ ID NO: 277698 - RNA, 64 nt, Human
cagugcauguugcagauaccggcggccgcaggaggggcagcauccaguagaggacuggcguugg

SEQ ID NO: 277699 - RNA, 64 nt, Human
aauguguucauagaugaugcugaaugggggaggggggcagcacgucagagaauuuacuauuaau

SEQ ID NO: 277700 - RNA, 64 nt, Human
uuuaugugggagcagaaucagcugaugaaggggugggcagcaguguggggcaggcaccccacug

SEQ ID NO: 277701 - RNA, 64 nt, Human
cacacauauccaagagcucagggccaguucuggugggcagcagagaccugcucugccaaguugu

SEQ ID NO: 277702 - RNA, 64 nt, Human
ccuuccuccaucagaagacaggagugagggccccgggcagcaguggacgacccagccuccccau

SEQ ID NO: 277703 - RNA, 64 nt, Human
cuggggccuguacugccugcuuggggggugaugagggcagcagccagcccugccuggaggaccu

SEQ ID NO: 277704 - RNA, 64 nt, Human
gugcuucuccagggaccucucuccgggggcucccuggaggcaccccucccccauucccaauauc

SEQ ID NO: 277705 - RNA, 64 nt, Human
guguggcucaguggcuggugguggaccuggagaguggaggcaccggccaggcaggggggcaggg

SEQ ID NO: 277706 - RNA, 64 nt, Human
ucugaugcucugaggcuucugggaggcugggcccuggaggcaacgugcugcaggcgcacucugu

SEQ ID NO: 277707 - RNA, 64 nt, Human
guccugucagcuuccucuuuaggaacccaccagagggcagcaagcuccuuucacuucgcuagua

SEQ ID NO: 277708 - RNA, 64 nt, Human
gcucacagugugugcccagaugugccaccccugugggcagcaagaagcugggaucgcugcagcc

SEQ ID NO: 277709 - RNA, 53 nt, Human
cuaagccuccgugccaguagucagggcagcagggcugccucucaucuaaagca

SEQ ID NO: 277710 - RNA, 64 nt, Human
ggcuggaaucugaugagguuguaugauggcugcugggcagcaccuccuaacuucagggaauaaa

SEQ ID NO: 277711 - RNA, 64 nt, Human
gcagcuugccaugccuacccuucccugucugucugggcagcagguucagggcugagcccuucuu

SEQ ID NO: 277712 - RNA, 64 nt, Human
aaacgagggccugcuggcugagauauggggcugugggcagcagacgaugccgacuggaagggag

SEQ ID NO: 277713 - RNA, 64 nt, Human
agaagaugggaggaaggggagccccguccuccaagggcagcacccccacuuucaacugaaucaa

SEQ ID NO: 277714 - RNA, 64 nt, Human
cccaaaguagggaaggcagcugggggaggguucagggcagcaaugcugaguucaagaaaaguac

SEQ ID NO: 277715 - RNA, 64 nt, Human
cccuagccccaggucuagccgggcccauugcagggggcagcacuugggggcaucuccggcacuu

SEQ ID NO: 277716 - RNA, 64 nt, Human
agggagcccgggcagccaccgucuccagagcccugggcagcauuuuccagcaagauguacacaa

SEQ ID NO: 277717 - RNA, 64 nt, Human
caucugugaaaaggagcacuguauggccacagaagggcagcagcugcgucagccuaagacagag

SEQ ID NO: 277718 - RNA, 64 nt, Human
gugggcucuggccuggccugguggcuggcccagggggcagcagugcuuagagcuucugcagggc

SEQ ID NO: 277719 - RNA, 64 nt, Human
aaguugaagucgacugccaaagaggcccagcagagggcagcacccccaucauuuuuuugaauuu

SEQ ID NO: 277720 - RNA, 64 nt, Human
gaccugucuuugggaaacauuaaaggauguuugagggcagcaggaaaauaauacaaaacuuaag

SEQ ID NO: 277721 - RNA, 64 nt, Human
uguacaagucucuauacaaugucuuuaucccugugggcagcaagcaaugaugauaaugacaaac

SEQ ID NO: 277722 - RNA, 64 nt, Human
auuguguuuuccauggugcuacaguuacacaauauggaggcaaacaucagaaaucaaaguccuu

SEQ ID NO: 277723 - RNA, 64 nt, Human
ccuuccuugggccccucucauucccuccccagaauggaggcaacgccagaauccagcaccggcc

SEQ ID NO: 277724 - RNA, 64 nt, Human
uacuuuacaagguaauagaauaucacaaggcaaguggaggcagggcgagaucacaggaccaagg

SEQ ID NO: 277725 - RNA, 64 nt, Human
cagcuuguaaauuuuguggaaccacagguauuuggggcagcauucauaauuuucauuuuguauu

SEQ ID NO: 277726 - RNA, 61 nt, Human
cuggcugugaaggcagcugacacagggcuaggggcagcagcugggccuucgaggcgcaccu

SEQ ID NO: 277727 - RNA, 64 nt, Human
acugucgauguuucuuagcagagauggucacagagggcagcagggacaggacuggaagggaccu

SEQ ID NO: 277728 - RNA, 64 nt, Human
ccauugcacaugucuccccugcccccuggcauuagggcagcaugacaaggagaggaaauaaaug

SEQ ID NO: 277729 - RNA, 64 nt, Human
gucaucagagcuaaaggggcucccagaaaccacugggcagcaucugccuucucucuuggcaugg

SEQ ID NO: 277730 - RNA, 64 nt, Human
gcgcuggggagagggaugaaggcucggcggcccagggcagcacccaaggucugggcaaacucag

SEQ ID NO: 277731 - RNA, 64 nt, Human
cugagccgauggggccccccaggcccaggcgaaagggcagcagcauguggcccauggcaccacc

SEQ ID NO: 277732 - RNA, 64 nt, Human
agaauccaaagcauuuugguuuauccaggacccagggcagcacagcugucaccaagcaggagag

SEQ ID NO: 277733 - RNA, 64 nt, Human
uucucuaagaccuggaaagucagcaacccucugggggcagcaggacugggcagaucccaggcug

SEQ ID NO: 277734 - RNA, 64 nt, Human
cccagcacugacccauagagggcuccucucagaugggcagcagcuuggagcaggccaggcaggg

SEQ ID NO: 277735 - RNA, 64 nt, Human
ggaauggcaaugguguucaccaucggcagugccagggcagcacucauucacuugauaaaugaau

SEQ ID NO: 277736 - RNA, 64 nt, Human
ccuccucagacaacagccucuacaccaacgccaagggcagcaccaucucugccuucgauggggg

SEQ ID NO: 277737 - RNA, 64 nt, Human
auguauaugcagacgccuccauuggcaacgugacgggcagcaacgccgucaaugucuuccuggg

SEQ ID NO: 277738 - RNA, 64 nt, Human
cucgagcccagauggaaagacguuuuugugcugugggcagcacccucccccgcagcgggguagg

SEQ ID NO: 277739 - RNA, 64 nt, Human
agggcgcggaacccugucauggaugacaaggcaagggcagcaauaggcuggagcccgaagguau

SEQ ID NO: 277740 - RNA, 64 nt, Human
acuccaucaucuccaggugccccacgccuggggguggaggcacaaccucuccccuaacccugcu

SEQ ID NO: 277741 - RNA, 64 nt, Human
gaucucuaauguggaggugggaacauuauugugguggaggcaauuaugaggguagcauuucuuu

SEQ ID NO: 277742 - RNA, 64 nt, Human
aguauuaggcugcugucagggagaggauggcagauggaggcaucaagcacaaggaaaaugcaca

SEQ ID NO: 277743 - RNA, 64 nt, Human
cuagagcagucaugguuccucuccuaaaagccaugggcagcaguuuccgagggccugcaugauc

SEQ ID NO: 277744 - RNA, 64 nt, Human
gcugcuaacagcauugccugugcucuccucucaggggcagcaugcuaacggggcgacguccuaa

SEQ ID NO: 277745 - RNA, 64 nt, Human
ucuccuuggcccaggccaagauugagaagaucaagggcagcaagaaggccaucaagguaguccc

SEQ ID NO: 277746 - RNA, 64 nt, Human
augagaugcagaacccccaggagcgcccaggcuugggcagcaaccccugcauccccauuuuuua

SEQ ID NO: 277747 - RNA, 64 nt, Human
gucuggguucaggggcauggccuggagggcuggugggcagcacugucaggcucagguuucccug

SEQ ID NO: 277748 - RNA, 64 nt, Human
gaaauauagguaagcagcuuaccucaguauuucagggcagcaaguguuugugaagcaaggauga

SEQ ID NO: 277749 - RNA, 64 nt, Human
cccuagacauggacgcaccggccuggcugcagcugggcagcagggguagggguagggagccucc

SEQ ID NO: 277750 - RNA, 64 nt, Human
gcucuguccugcaugccuggcgagcuggggcccagggcagcaugaaggagagcccugcguucug

SEQ ID NO: 277751 - RNA, 64 nt, Human
uuucccuaaagacccuaaaucugaggaaucaacagggcagcagaucuguauauuuuuuucuaag

SEQ ID NO: 277752 - RNA, 64 nt, Human
ucccccacuccugacccuggugauggucgccacugggcagcagcagccuuaccaguccuccaug

SEQ ID NO: 277753 - RNA, 64 nt, Human
gaccugggugugccucgcugcuggggcucugcaggggcagcacagcuggggugcaggccaggcu

SEQ ID NO: 277754 - RNA, 64 nt, Human
gcccgucaccccaggaggaaaagcccagggucuggggcagcagagccaucgcaucauguuuccc

SEQ ID NO: 277755 - RNA, 64 nt, Human
caggaccaagcaguuaccgagcgaggcacucacugggcagcacauccagccagacccgaccagc

SEQ ID NO: 277756 - RNA, 64 nt, Human
ccauggcauccccauggaggaaccaggcccaucugggcagcagcaucugguugaccagauggcc

SEQ ID NO: 277757 - RNA, 64 nt, Human
ggaucgcuugagaccaggaguucgagaccagccugggcagcauagcaagauccccaucuuuuaa

SEQ ID NO: 277758 - RNA, 64 nt, Human
ccgugucagaaacaguaccgagucccacccccucuggaggcacagcuguugcgucaggcaaggu

SEQ ID NO: 277759 - RNA, 64 nt, Human
cugcugugggcuggguccccggcgggacugucaauggaggcagggguuccagcacaaaguuuac

SEQ ID NO: 277760 - RNA, 64 nt, Human
gaggccaccccccaggugggggugcccgcagggauggaggcagcuccugaacugguggccagcc

SEQ ID NO: 277761 - RNA, 64 nt, Human
caaaccgacacagggcuuggaagggauuugccaagggcagcaggugaucagggcagagcuggga

SEQ ID NO: 277762 - RNA, 64 nt, Human
acauuuugcuccggggcagauccaaccuuaccuggggcagcaaacuuuguccugguaccugggc

SEQ ID NO: 277763 - RNA, 64 nt, Human
cacaaggagacaaagcagagccuugucuguaucugggcagcagguguuccaugcugcuaggugg

SEQ ID NO: 277764 - RNA, 64 nt, Human
ucccuuaccaccaggagcauucaagcucuggauugggcagcagaugugcccccagucccgcagg

SEQ ID NO: 277765 - RNA, 64 nt, Human
agaaugguguggccaccuccucccuuucaagcuagggcagcagguagcucuucccagccccuga

SEQ ID NO: 277766 - RNA, 64 nt, Human
uaguguccaagcaucuuagcuguucaagaggagagggcagcauaacuuccugaccaccgguguc

SEQ ID NO: 277767 - RNA, 64 nt, Human
uuccaaggguuugccuugugucucagcucauucugggcagcacguuugucuucugucccuagag

SEQ ID NO: 277768 - RNA, 64 nt, Human
agugagcccuuggcacggucucugcuccccaccagggcagcacgggacagaaacgucacggagg

SEQ ID NO: 277769 - RNA, 64 nt, Human
gggaggucccucacuccacgggacagaggccccugggcagcagaggaaaccuacagcucugggu

SEQ ID NO: 277770 - RNA, 64 nt, Human
uccaucgucagugccugagcggccagcagaaggggggcagcagccuccacugagccucugguuc

SEQ ID NO: 277771 - RNA, 61 nt, Human
aaguuccugacacaugguaaccaagaccugagggcagcaaaccgcuggugcugucgcugug

SEQ ID NO: 277772 - RNA, 64 nt, Human
uucccuuguagagccauagaaauauucuggcuuggggcagcagucccuucuucccuugaucauc

SEQ ID NO: 277773 - RNA, 64 nt, Human
gcgcauaggaagcuuuugucccugcuguuaaugcgggcagcaccuacagcaacuuggaaugagu

SEQ ID NO: 277774 - RNA, 64 nt, Human
aauggcuggcccuggguggggauaguuuacacccgggcagcagcaccacacaugaacccaaaga

SEQ ID NO: 277775 - RNA, 64 nt, Human
caacauagcuuccccacccaggcacccccucccggggcagcaggcgugggagucagggcugcau

SEQ ID NO: 277776 - RNA, 64 nt, Human
auguaggaggucagcaggggugggcaggcccagcuggaggcagcugggugaggguccugguucc

SEQ ID NO: 277777 - RNA, 64 nt, Human
gcauuguucuugauuaguuuggcacuccauuacguggaggcagcacagugcagacagaccuaau

SEQ ID NO: 277778 - RNA, 64 nt, Human
gaggcauccccuaagcagccagccauggccuggguggaggcaccugaagacgucugucccaaac

SEQ ID NO: 277779 - RNA, 64 nt, Human
gagagcagccuggcccucaccagugcgcaagcuggggcagcaaggcugacaguugcugcaugcc

SEQ ID NO: 277780 - RNA, 64 nt, Human
cucugcccucagaccuggccaggugaugcucugggggcagcaucuccccaccgagagaagcggg

SEQ ID NO: 277781 - RNA, 64 nt, Human
ggaaagguaggaggagagaaggcuggggagggcugggcagcaagccaggcacagugaguggcag

SEQ ID NO: 277782 - RNA, 64 nt, Human
uuucacccagcacugugggggccuucagacucuggggcagcagacaugcugcuucccaucagcc

SEQ ID NO: 277783 - RNA, 64 nt, Human
gccggacaccaagcccgccuccagcaccaagggcgggcagcacccuccgacccucccaugcggg

SEQ ID NO: 277784 - RNA, 64 nt, Human
uugggaggaagaagacaagccccacuagggccaagggcagcagagcccugccgagugagaggcu

SEQ ID NO: 277785 - RNA, 64 nt, Human
gaaggcucugacacuccaccccagcucaggccaugggcagcagggcuccauucucuggccuggc

SEQ ID NO: 277786 - RNA, 64 nt, Human
agcaaagcaaccuggaggcugcauauccaugggcgggcagcauaagagaaugugaagcccuuca

SEQ ID NO: 277787 - RNA, 64 nt, Human
cccgccuggcagaccaccgcacacagaucaagcggggcagcaccuacuaccugcauguccagag

SEQ ID NO: 277788 - RNA, 64 nt, Human
ugcacacgagcgaggggugaguggccguggcugugggcagcauccacacgguuagccgugcaug

SEQ ID NO: 277789 - RNA, 64 nt, Human
ugccuuaaaccugaagaugucuccucaagccugugggcagcaugcccagauucccagaccuuaa

SEQ ID NO: 277790 - RNA, 64 nt, Human
aauuucaggggagcaucaguggaggaggcagugggggcagcagcagccuccugaccaaugcccg

SEQ ID NO: 277791 - RNA, 64 nt, Human
aaacgggcuggugcauccuccucuuggccacagagggcagcaucgcccgccccuucccccaaau

SEQ ID NO: 277792 - RNA, 64 nt, Human
aaacuuuuguuccuacucccacccucagcgaacugggcagcacggggaggguuuggcuaccccu

SEQ ID NO: 277793 - RNA, 64 nt, Human
cucuguguguuaucucugccccacagcagccccugggcagcaccaguggccacugggcuccccc

SEQ ID NO: 277794 - RNA, 59 nt, Human
cgaacaucugccccuucagggaggacccccgcgcacaccagaaccucuggcaagccgcc

SEQ ID NO: 277795 - RNA, 59 nt, Human
cagauuuuuuagaagggauaggagacacacgcgcacacacacacacacacgaaacuuga

SEQ ID NO: 277796 - RNA, 59 nt, Human
ccgagcaggccacagaggcucggucuccccgcgcacagcguaggcacccgguguacucu

SEQ ID NO: 277797 - RNA, 64 nt, Human
ucaaugucacuugguggcgggguggggugggggugggcagcagcaucccagccuugagaugcuu

SEQ ID NO: 277798 - RNA, 64 nt, Human
aaggcugccuucauggccaucuagccccaguucagggcagcauccauagcccacaagccagcgu

SEQ ID NO: 277799 - RNA, 64 nt, Human
accaguaucaggauuucuguucugagagcagcgugggcagcaaggcagggcagcccagaggugg

SEQ ID NO: 277800 - RNA, 64 nt, Human
aggcugguuccccagggaagcagagccugugugcgggcagcagcugugugcgggccuggggguu

SEQ ID NO: 277801 - RNA, 64 nt, Human
ucggcuuggcugggagagauggauggcgggaaaggggcagcagucuugaggagcagggagagga

SEQ ID NO: 277802 - RNA, 64 nt, Human
aaacuaccaucuuggccagugacaaguguucggagggcagcagagaggaccaagccugugucac

SEQ ID NO: 277803 - RNA, 64 nt, Human
cccugggcagggagagggccaaggacaauugggagggcagcaggcagcccgcagaugguggcca

SEQ ID NO: 277804 - RNA, 53 nt, Human
agccugagaagacagacugagcagggcagcaccuccauaggaagccuuccuuu

SEQ ID NO: 277805 - RNA, 64 nt, Human
ggucaagacacgggaugacgggaagcaggaagcggggcagcagcacagcgugggguccuggcac

SEQ ID NO: 277806 - RNA, 64 nt, Human
ucuuagaagccucugagucccucugcagaagaccgggcagcaaagccuccaucuggaagucugu

SEQ ID NO: 277807 - RNA, 64 nt, Human
aggaagccaguccuguuccucuaaccagcaacgugggcagcacagugaaggguggacaaaacuc

SEQ ID NO: 277808 - RNA, 64 nt, Human
agccuggugccgauggccccacccucaccagccugggcagcagcaagaacuauuuauuaaaaac

SEQ ID NO: 277809 - RNA, 64 nt, Human
uucucaaaguccagaaaauuagggucccagaagggggcagcagcaggcugggaguuaggaggga

SEQ ID NO: 277810 - RNA, 64 nt, Human
ugcaugagaaaucuaucuuacugugguucuccaugggcagcaggaccauuuuucagaaucaaga

SEQ ID NO: 277811 - RNA, 64 nt, Human
aaggaaauuauggguaugugagccauaauaugaugggcagcagguggcgcugccuuccacccau

SEQ ID NO: 277812 - RNA, 59 nt, Human
gccgggagggucggcgucuggggucagggcgcgcacagcccagcagcccgaggccgccc

SEQ ID NO: 277813 - RNA, 59 nt, Human
cgcugcccgaaccucugugugaagcuuuacgcgcacacggacaaaaugcccaaacugga

SEQ ID NO: 277814 - RNA, 59 nt, Human
ucagccucccaaguagcugggacugcaggcgcgcacaccacgcccagcuaauuuuugua

SEQ ID NO: 277815 - RNA, 64 nt, Human
ugccucugccucccaaguagcugggaccacaggugggcagcaccacaccuggcuaauuuuuuaa

SEQ ID NO: 277816 - RNA, 64 nt, Human
guagugcccccaguauugggauuuuugagcuaaugggcagcagucagcugggggcuucugaggg

SEQ ID NO: 277817 - RNA, 64 nt, Human
uguauuuugaguuucagcuggaaacuucuguaaggggcagcaguugaggugggguagugccgca

SEQ ID NO: 277818 - RNA, 64 nt, Human
ugccuuauuuuguucugaauaaauuuacaguauugggcagcaauucuggauucuagacuugaga

SEQ ID NO: 277819 - RNA, 64 nt, Human
cuccuuucuucucuuucugcuucaguugcugucagggcagcaguuccaguucuguaagucucac

SEQ ID NO: 277820 - RNA, 64 nt, Human
cucuugccaaagggccuggaguagaaggacaacagggcagcaacuuggagggaguucucugggg

SEQ ID NO: 277821 - RNA, 64 nt, Human
ccuggaugaaccaucuacgggcauagaccccacagggcagcagcaaauguggugagcaucauua

SEQ ID NO: 277822 - RNA, 64 nt, Human
ugguucuauguagcauuucuccuuauaucaccaugggcagcaucagugauuacaagguaagaaa

SEQ ID NO: 277823 - RNA, 63 nt, Human
gagcugcgcagcgggaaugagcggggaugccgcgggcagcagcuggagcuaaaggaagggcag

SEQ ID NO: 277824 - RNA, 64 nt, Human
uccuguguccccugaccuguccaggugagugugagggcagcacugggaagcuggagugcugcuu

SEQ ID NO: 277825 - RNA, 64 nt, Human
ucaccuuguagccuaugcgcucaauggcccggaggggcagcaaccccccgcacacgucagccaa

SEQ ID NO: 277826 - RNA, 64 nt, Human
gccaccagggcagccccgggggauccgggcugcugggcagcaggucggcgggaccacaugccug

SEQ ID NO: 277827 - RNA, 64 nt, Human
uuggaguguccaguggggacacuggugugggaaggggcagcaccuggggagucccugccucucc

SEQ ID NO: 277828 - RNA, 64 nt, Human
ggagagccggucacgguggcuggucuuuacugcagggcagcacuguggccagcugucugucuuu

SEQ ID NO: 277829 - RNA, 64 nt, Human
agauugcuugaacccaggaguucaagaccagccugggcagcauggugaaacccuguaucuacaa

SEQ ID NO: 277830 - RNA, 64 nt, Human
cuguaaacuuucugguccgagaacgagccgaacacagcgcgacgcagggacuaggacggcccgg

SEQ ID NO: 277831 - RNA, 64 nt, Human; identical to SEQ ID NO: 93808

SEQ ID NO: 277832 - RNA, 64 nt, Human
cugggagcccgaagcucggagccagggcucgcgagggcagcaccgcagccucugccccagcccc

SEQ ID NO: 277833 - RNA, 64 nt, Human
acuguauguuauagaacuucauggaucagaucuggggcagcacccuauaaaucaacaccuuaau

SEQ ID NO: 277834 - RNA, 64 nt, Human
gcgaguccagcagggaguccagcaacgaggaugagggcagcagcuccgaggccgacgagauggc

SEQ ID NO: 277835 - RNA, 64 nt, Human
caugcgggcugggcagcuguuagaguccaacguggggcagcacagagagggggccaccucccca

SEQ ID NO: 277836 - RNA, 64 nt, Human
cucgccccuucuccaucgucccaggaaucccagggggcagcacagccggcccccggcccacguu

SEQ ID NO: 277837 - RNA, 64 nt, Human
uccguucccuggagggguggaggaaggagguguugggcagcaucaaaggugcugggacauccca

SEQ ID NO: 277838 - RNA, 64 nt, Human
auuucaucugcucuccuuccuggagcccagaggagggcagcagaaggggguggugucuccaacc

SEQ ID NO: 277839 - RNA, 64 nt, Human
gaggagcccauggggcgggcagcccccagaaagcgggcagcaggccccgauaccgggaagagcc

SEQ ID NO: 277840 - RNA, 64 nt, Human
ccauggagcugagggucggaggaaccuuccuugggggcagcagcccuucccgggggccuaccca

SEQ ID NO: 277841 - RNA, 64 nt, Human
agccucuuuuugccucccggaaucaaggcccugagggcagcaggaugguggccugggugggguc

SEQ ID NO: 277842 - RNA, 64 nt, Human
uuccuggagccccagaaccccaacucccagccuagggcagcagggagucuugaagugaucauuu

SEQ ID NO: 277843 - RNA, 64 nt, Human
uccuuuguuucccagcaucuggcugggaugugaagggcagcacucccuguccccaugucccggg

SEQ ID NO: 277844 - RNA, 64 nt, Human
uuccugccugagcaccgcagcgggagccagcagggggcagcagaggccaacagggagcucgcag

SEQ ID NO: 277845 - RNA, 64 nt, Human
gccaucacugucugguauuuugaugccaaggagcgggcagcagccaaagacaaguaucagcuag

SEQ ID NO: 277846 - RNA, 64 nt, Human
uccagauguggagcaacuugggcuuuuggggauggggcagcaaaguugggagcuggaccccaau

SEQ ID NO: 277847 - RNA, 64 nt, Human; identical to SEQ ID NO: 93814

SEQ ID NO: 277848 - RNA, 64 nt, Human; identical to SEQ ID NO: 93818

SEQ ID NO: 277849 - RNA, 64 nt, Human
uuggcccccacccugaaucuuacugagucccucugggcagcagcucccuucuccaccccacccc

SEQ ID NO: 277850 - RNA, 64 nt, Human
gaacugaauggcgcuucgggauucugaguagcaggggcagcaugcccagugggccugggguccc

SEQ ID NO: 277851 - RNA, 64 nt, Human
augaguuggccagauuguggggugcagcuggguggggcagcacaccucuggggggauaaugucc

SEQ ID NO: 277852 - RNA, 64 nt, Human
ccuccauuguugcccuggaauguacgggacccaggggcagcagcaguccaggugccacaggcag

SEQ ID NO: 277853 - RNA, 64 nt, Human
gcuuuggauauuggagcccacgugggcccaccccgggcagcagagaaggcccagcugacagggg

SEQ ID NO: 277854 - RNA, 64 nt, Human
caagauuuuguggcacuccugguuacagauacuggggcagcaaauaaaacugaaucuuguuuuc

SEQ ID NO: 277855 - RNA, 64 nt, Human
ucuuugcacuuccauuuccugcccucuaauuugggggcagcaguuugugcuuuguaagcuucag

SEQ ID NO: 277856 - RNA, 64 nt, Human
accgcgcccagucucuccccacguucuugaacucgggcagcacauccucacagaaaucuaggaa

SEQ ID NO: 277857 - RNA, 64 nt, Human
ccccugccauggaaggaagaacgggacaaaggaggggcagcagggugugugcauaugagacuug

SEQ ID NO: 277858 - RNA, 64 nt, Human
gagcccaccccgccugcccucccacccccuccccgggcagcagagagagagagagagaaagaga

SEQ ID NO: 277859 - RNA, 64 nt, Human
ggugagccaagaucgcgccacugcacuccagccugggcagcaagagcaaaacaaccucugucac

SEQ ID NO: 277860 - RNA, 64 nt, Human
gccagccuccccagcccccuucccucaacucuaggggcagcauagccccaggccacccuagccc

SEQ ID NO: 277861 - RNA, 64 nt, Human
gaaggcaucuuucaagcccucgcucugguucucagggcagcauuuuccaggcggguuuguuuug

SEQ ID NO: 277862 - RNA, 64 nt, Human
cuaccugcggcugcaggagcugguggcccuccaagggcagcauccacccugcagcgccaaugag

SEQ ID NO: 277863 - RNA, 64 nt, Human
ggagcugaccggcuuuggggaggcagguaccccagggcagcaggcucagaguacagucccuuca

SEQ ID NO: 277864 - RNA, 64 nt, Human; identical to SEQ ID NO: 93824

SEQ ID NO: 277865 - RNA, 64 nt, Human; identical to SEQ ID NO: 93829

SEQ ID NO: 277866 - RNA, 64 nt, Human
ccagcccaggugggccuuaaauggaggacuuggcgggcagcaggaggcaaggguuccuccaucu

SEQ ID NO: 277867 - RNA, 64 nt, Human
aaugagccgagauugugccacggcacuccagccugggcagcagagugagacucucucucaaaaa

SEQ ID NO: 277868 - RNA, 64 nt, Human
acagccgcuccugguaucagagcugcuuuccagagggcagcacagccagggccgggugucuuua

SEQ ID NO: 277869 - RNA, 64 nt, Human
cuugggaaaagggggugacagacaacuuuugagagggcagcagacucccucagccaugagaacc

SEQ ID NO: 277870 - RNA, 64 nt, Human
agugagccgagauugcgccacugcacuccagccugggcagcagagcaacacucugucucaaaaa

SEQ ID NO: 277871 - RNA, 64 nt, Human
agaucugaugaucugaggagguucuggaagacuggggcagcaguuggggaagugucugcugaga

SEQ ID NO: 277872 - RNA, 64 nt, Human
ugucugggccaguuuuguagguccaucugugcaugggcagcaguagucaaaaagccaaggaaaa

SEQ ID NO: 277873 - RNA, 64 nt, Human
ccucccucucagaccaaggugguggcugugaggagggcagcaaaugcugacaaggaugaaaagc

SEQ ID NO: 277874 - RNA, 64 nt, Human
gccaacucccugguuucuuccuggcaugguguuugggcagcaggcaucauuuuccuuuucuagc

SEQ ID NO: 277875 - RNA, 64 nt, Human
cauuugcuucucugggcaaaugggaaguucagcggggcagcagaaucaguggcauucccccugg

SEQ ID NO: 277876 - RNA, 64 nt, Human
gccgagacagacccucugccgcugcuuccaggcugggcagcacaaggccuugccuggccugaug

SEQ ID NO: 277877 - RNA, 64 nt, Human
cagugggccgagagacacgguggguaaaggaugugggcagcagcagggaagacaacagaaacac

SEQ ID NO: 277878 - RNA, 64 nt, Human
gacccaugagcaggcugcauggucuagagguugugggcagcauggacagucccccacucagaag

SEQ ID NO: 277879 - RNA, 64 nt, Human
ccugagagcguggccugacuugcagacucggcuugggcagcacuucggggggggaggggguguu

SEQ ID NO: 277880 - RNA, 64 nt, Human
uacuccaucucacaucugccucagugagggaucagggcagcaaacaagggccaagaccaucuga

SEQ ID NO: 277881 - RNA, 64 nt, Human; identical to SEQ ID NO: 93835

SEQ ID NO: 277882 - RNA, 64 nt, Human; identical to SEQ ID NO: 93841

SEQ ID NO: 277883 - RNA, 64 nt, Human
agauuuuagccuuauauguaauuccuucacauuugggcagcauggacgagaaggaagaauuugc

SEQ ID NO: 277884 - RNA, 64 nt, Human
caugaacucagcuauuaagaaaaucacauuuccagggcagcagccgggaucgaugguggcgcuu

SEQ ID NO: 277885 - RNA, 64 nt, Human
uccuuccugcccuccgauggggccaccugugucggggcagcaguguccauguuuauggagauca

SEQ ID NO: 277886 - RNA, 64 nt, Human
cagaacuaacccccagcaggccugguuccacccugggcagcacccccucuaguucuaauaaagc

SEQ ID NO: 277887 - RNA, 64 nt, Human
uggcugcccccaggacaugcaggauuucugcagggggcagcacagguucugggauugugaggcu

SEQ ID NO: 277888 - RNA, 64 nt, Human
cuguuuccacuggacauucucccuuugccucucugggcagcaacuccuaggccagccgaccugc

SEQ ID NO: 277889 - RNA, 64 nt, Human
acaauacacugccucguucucucaguuagcagcugggcagcagcgcaccauucaucauuuaggc

SEQ ID NO: 277890 - RNA, 64 nt, Human
cagguucccacaccucacuuuucacagccuccaagggcagcagugcacauggaggagacgucuc

SEQ ID NO: 277891 - RNA, 64 nt, Human
gcaggcugugcugcuugugcgcagggaucgagacgggcagcacucaugggugccaaggggcagg

SEQ ID NO: 277892 - RNA, 64 nt, Human
cucccaugccccagcugugccaucccaaauacuugggcagcagcucagcaugggcagacauggg

SEQ ID NO: 277893 - RNA, 64 nt, Human
ggggguacugaugguaacccccauguggauuugagggcagcagucccuggccucacccuagcca

SEQ ID NO: 277894 - RNA, 64 nt, Human
cucccauguuugcucucccaacucauuagcuccugggcagcauccuccugagccacaugugcag

SEQ ID NO: 277895 - RNA, 64 nt, Human
aaucccucccugugcuuuggaagggaagggaggugggcagcagugggucagagauagaccuuug

SEQ ID NO: 277896 - RNA, 64 nt, Human
uugugucaucuguuguaaacguucaggaggaccagggcagcaucuggggccugggauggccaca

SEQ ID NO: 277897 - RNA, 64 nt, Human
cuggccggggguuggggagccacacagggugaacgggcagcagccggcuccaugccccacugcc

SEQ ID NO: 277898 - RNA, 64 nt, Human; identical to SEQ ID NO: 93846

SEQ ID NO: 277899 - RNA, 59 nt, Human
acaccccuaaucuagccuugugagcuucgcuaguuaaugugugcucacuuucccuccau

SEQ ID NO: 277900 - RNA, 64 nt, Human
uggcaucagcccuggggccuccuggguggcaggggggcagcagcucuccuccccacucacaggc

SEQ ID NO: 277901 - RNA, 64 nt, Human
agccgacaccccuacaggagaagcucugggacuggggcagcagcaaggcgcccaugccacacac

SEQ ID NO: 277902 - RNA, 64 nt, Human
agcaagcuccaagacugagcccagcaccaccccugggcagcagcauccuccucucuggccuugc

SEQ ID NO: 277903 - RNA, 64 nt, Human
cagugcugucucgcucagucuuuccagaccagcggggcagcaccugggaggccugucugaagca

SEQ ID NO: 277904 - RNA, 64 nt, Human
cuggggccggggcugccgcaucugccuggagccugggcagcaccuccgggacugaccuucggca

SEQ ID NO: 277905 - RNA, 64 nt, Human
gccuguggcccaaagaaccugguagcgccuccuggggcagcacguggguggcgcagccuuggua

SEQ ID NO: 277906 - RNA, 64 nt, Human
gccuguggcccgaagagccugguagcgccuccuggggcagcacguggguggcgcaggcuuagua

SEQ ID NO: 277907 - RNA, 64 nt, Human
ugucucagggcagagggcaggcagggggaccgaggggcagcagauaggagagcacugagcccgg

SEQ ID NO: 277908 - RNA, 64 nt, Human
aacggcagccaaaccaaagacacuggugugcauggggcagcaugguugugcacgugggacccug

SEQ ID NO: 277909 - RNA, 64 nt, Human
gccuucugcccgccccaucgaggaggccccucgggggcagcacaucuuccuccucgcaggaggg

SEQ ID NO: 277910 - RNA, 64 nt, Human
gauagguugaggcagauggugcccagaagaaagagggcagcacccauugcacauggcaggccug

SEQ ID NO: 277911 - RNA, 64 nt, Human
cagagccacauuaccuacccugugcaugguccuggggcagcaaggaagaagcucagaggguggg

SEQ ID NO: 277912 - RNA, 64 nt, Human
gucacuccucucuagggcagaagacuagaggccagggcagcaagggaccugcucaucauauucc

SEQ ID NO: 277913 - RNA, 64 nt, Human
guaggaccuggguagggauuggaaguacuuggcagggcagcagcaaucuugcuguguuugauau

SEQ ID NO: 277914 - RNA, 64 nt, Human
cccccuacccacaaccaugcccuugaggguagcagggcagcagcauaccaaagagaugugcugc

SEQ ID NO: 277915 - RNA, 57 nt, Human
ggcaguggcacuacauguaaccuucaucuaguuaaccaaucgcaaagcaagggggaa

SEQ ID NO: 277916 - RNA, 59 nt, Human
ggcuaccuaaaaagaugacccauuauguccuaguuaaucaucauuuuuccuuuaguuua

SEQ ID NO: 277917 - RNA, 64 nt, Human
ucuaaaauuagccagcucuuccugucagggaucagggcagcacuaacaggcgcaaaaguagagc

SEQ ID NO: 277918 - RNA, 64 nt, Human
acacgugggaacuaaagagaaaaaugaccagccugggcagcauagcaagacccugucucuaaaa

SEQ ID NO: 277919 - RNA, 64 nt, Human
ucuuacuuucagaauuuccacggggggacuaggagggcagcauugcuggggagaggggcuccug

SEQ ID NO: 277920 - RNA, 64 nt, Human
ucugggcagaguggagcugcaacccuguuguggggggcagcauuuggcagguuuucuccuuggg

SEQ ID NO: 277921 - RNA, 64 nt, Human
cugcacgauuucauguuccuaaacccaugucuuagggcagcacagagccaggucaugucaugcc

SEQ ID NO: 277922 - RNA, 64 nt, Human
agcuguauaggacauuacccuugcggaagcuggagggcagcaauuggagaugccggggacccuu

SEQ ID NO: 277923 - RNA, 64 nt, Human
acaaaggaacuuuagggcaggguagggaaaaaaggggcagcaggggguguguuuguggacaaau

SEQ ID NO: 277924 - RNA, 64 nt, Human
gaggucuuugagcucaggaguucaagaccagccugggcagcaugacaaaacccugucucuacca

SEQ ID NO: 277925 - RNA, 64 nt, Human
uuaaaacguuaacuguuuuaagucacuaaguuuugggcagcaugauaacaacccagcaaaaagc

SEQ ID NO: 277926 - RNA, 64 nt, Human
gaucuauuguuuguugcacuaaaaugaggauccagggcagcaggccagagaaagcaaaggugca

SEQ ID NO: 277927 - RNA, 64 nt, Human
gaucagaugucuauauugcugaaugcaagaaguggggcagcagcaguggagagaugggacaauu

SEQ ID NO: 277928 - RNA, 64 nt, Human
acacaacagaaacuuauuugcuuacauuuuugaagggcagcaaagccaugcucccuccagaggc

SEQ ID NO: 277929 - RNA, 64 nt, Human
ccccacauuccucaacuaguauuauuugggcucugggcagcagcagggaucuggugguauguga

SEQ ID NO: 277930 - RNA, 64 nt, Human
aauuuauuuguaagccugaaucgcagcccaaacagggcagcaauguugaagugaccauaaagug

SEQ ID NO: 277931 - RNA, 64 nt, Human
agggaggagagagaggagaagggaggcaggggaggggcagcagaaccaaggcaaauauuucagc

SEQ ID NO: 277932 - RNA, 59 nt, Human
ugguacuuuuauucagacuuguuuccuuucuaguuaacagaaauagugacauuuagagg

SEQ ID NO: 277933 - RNA, 59 nt, Human
uugcuacugggacuugauuuacuguggcacuaguuaaguaaguuaaaaaaaaguuaaac

SEQ ID NO: 277934 - RNA, 64 nt, Human
aggaagauugagccuaggaguucgagaccgaccugggcagcauagcgagaccccaucucuauau

SEQ ID NO: 277935 - RNA, 64 nt, Human
uccugguugucccugcucccauuuacagauguuugggcagcauugauagaaguauggagggguu

SEQ ID NO: 277936 - RNA, 64 nt, Human
caauuaugagagauagauugauaaccauccuuuggggcagcauuccagggaugcaaaaugugcu

SEQ ID NO: 277937 - RNA, 64 nt, Human
uagacacuggcauuaucccuuuaggaagaggggggggcagcaagagagccuauuugggacagca

SEQ ID NO: 277938 - RNA, 64 nt, Human
ugcuugccuauaccuggcaccucauuaagaugcugggcagcaguauaacaggaggaagagaucc

SEQ ID NO: 277939 - RNA, 64 nt, Human
agauugcuugagccugggaguuugagacuggccugggcagcauagcgagaccccaucucuauau

SEQ ID NO: 277940 - RNA, 64 nt, Human
cgucccugacuaggccggcucccccagacucagagggcagcaggagcagcagcagcagcagcag

SEQ ID NO: 277941 - RNA, 59 nt, Human
aauguugugaauaacaucaauuaauguaacuaguuaauuacuaugauuaucaccuccug

SEQ ID NO: 277942 - RNA, 59 nt, Human
uagaguuaguuucaucaaccuaaugaaugcuaguuaaauuugaauuccuuggaauuuau

SEQ ID NO: 277943 - RNA, 59 nt, Human
uaacugccucuagauacauagccauacugcuaguuaacccagugucccucagacuugga

SEQ ID NO: 277944 - RNA, 64 nt, Human
gcugcuucucucguaagggucuuggggagaaguaagcccgcagccugccucugcaccucguucc

SEQ ID NO: 277945 - RNA, 64 nt, Human
ccacccuguccggaggcgggcgugagacaagcccagcccgcacgcgcucaucuuucuucguuuu

SEQ ID NO: 277946 - RNA, 64 nt, Human
caagccccccgagugaggacgcaccgccgccaccagcccgcaacucuccagccgaagcugcagg

SEQ ID NO: 277947 - RNA, 64 nt, Human
cucccagcucucuugcacugcaggcccuggggccagcccgcacacaccaugccuccugucucaa

SEQ ID NO: 277948 - RNA, 64 nt, Human
cauggcccucgcucugucuaugcaggggccccaaagcccgcacuuuguccgugugucuuagccc

SEQ ID NO: 277949 - RNA, 64 nt, Human
ccaagcgagguggaccccgaaacggacggcccggagcccgcaccagccccgcgccuacccgggc

SEQ ID NO: 277950 - RNA, 64 nt, Human
ggagcugcucuaaggcgccugcagaggcgagcagagcccgcagcccacgccuucucgaccgcgc

SEQ ID NO: 277951 - RNA, 64 nt, Human
uccagaacacgccggagauugcugcugcuuucugagcccgcaccugugcgccuaaacugcugau

SEQ ID NO: 277952 - RNA, 59 nt, Human
gagaaucaaacaaaacagauaugcuuacucuaguuaaaaagaaaauaaaucucauguca

SEQ ID NO: 277953 - RNA, 59 nt, Human
ggcacauaguacaugcaauauguuugaaacuaguuaaggaauuauaaaaacaaaugagu

SEQ ID NO: 277954 - RNA, 59 nt, Human
aaagaaugucagaucccuucuuugucuuacuaguuaaauccucaccuaaucucuugggu

SEQ ID NO: 277955 - RNA, 64 nt, Human
aaaaaaaaagcacauaacuuuuaacacuagaaucagcccgcaagaugcuugccccgcuaguggc

SEQ ID NO: 277956 - RNA, 64 nt, Human
gucuaaaauaaucgcuaguguuaugucaaaguuaagcccgcacgccaggcccaguuaaugcuag

SEQ ID NO: 277957 - RNA, 64 nt, Human
gaaagcgcugagcugagggacgaggaagagcuggagcccgcagaagccguccacagcccugccu

SEQ ID NO: 277958 - RNA, 64 nt, Human
guaugacaguauuauacgcuggcaacacagaggcagcccgcacaccugcgccuggguguugaga

SEQ ID NO: 277959 - RNA, 64 nt, Human
aggauccuggccugagaauugaggggagguggccagcccgcagagguggggugcuggggcugca

SEQ ID NO: 277960 - RNA, 64 nt, Human
uuuucucuuuuugccaaaauuaacuguuuggugaagcccgcaaaaccuccucgcuuugcaugca

SEQ ID NO: 277961 - RNA, 64 nt, Human
gccacccggaaugugaagggcgcuccgggcucugagcccgcagcuuuuacgacuucucccugcc

SEQ ID NO: 277962 - RNA, 64 nt, Human
aaaggacacggcucagcaagggggacauugcccaagcccgcaagcuuuacaagugcccagguca

SEQ ID NO: 277963 - RNA, 64 nt, Human
agacgaggagcuggacugggccuuggcuucccugagcccgcacuccaaccagcagcuggauucc

SEQ ID NO: 277964 - RNA, 64 nt, Human
caguauccgagucucgugcagugcugcguagguuagcccgcaucgugcagacaaccucaguccu

SEQ ID NO: 277965 - RNA, 64 nt, Human
uccccgccgggucccaccuugccuuuugaagaagagcccgcauaaugaguggacggcagacagc

SEQ ID NO: 277966 - RNA, 64 nt, Human
caggccuuggggacaaccuuggcuuggcccuggcagcccgcaucagcugcucagaucccacuuu

SEQ ID NO: 277967 - RNA, 64 nt, Human
ccaagguugggacccaaggaucggggggcccagcagcccgcaccgaucgagccggacucucggc

SEQ ID NO: 277968 - RNA, 64 nt, Human
cuuccugcccauauauuauaccaguugcuucugcagcccgcagaugccagcgaugccaggaaac

SEQ ID NO: 277969 - RNA, 64 nt, Human
uuuagucccucagcuugauaaagagugaguuuggagcccgcauugggcuggcccacuggguugc

SEQ ID NO: 277970 - RNA, 64 nt, Human
ucagaugggaaaucugccuaugucauaccgugacagcccgcaggaucaggugacuucuagcaga

SEQ ID NO: 277971 - RNA, 59 nt, Human
ugauucacuuuuacacuuauauuucauugcuaguuaaaaaauaaaaccuuugagaaucu

SEQ ID NO: 277972 - RNA, 59 nt, Human
aaugcccugugucauuucuggauuauauacuaguuaauuucuuccauuccccacuacac

SEQ ID NO: 277973 - RNA, 59 nt, Human
acuagaucgauuguacaucuucacaaauucuaguuaacaauuuuauuuuguauucuugc

SEQ ID NO: 277974 - RNA, 64 nt, Human
guaacuuauguucaaugugccaacaccaguggggagcccgcaggccuauguggcagcgucacca

SEQ ID NO: 277975 - RNA, 64 nt, Human
uugucuuuaaacaacccuaaauacacgucuguuuagcccgcaauuggaaaggauauauguggca

SEQ ID NO: 277976 - RNA, 64 nt, Human
agaaggugaaaccagguuaucugggaaucuuuccagcccgcaggucgccacggccaucccuuug

SEQ ID NO: 277977 - RNA, 64 nt, Human
gaccccaagcccgcggaggcaccgaugcccgcagagcccgcaccccccggcccugccuccccag

SEQ ID NO: 277978 - RNA, 54 nt, Human
uggagaacuacugcaacuagacgcagcccgcaggcagccccacacccgccgccu

SEQ ID NO: 277979 - RNA, 64 nt, Human
uuucaccccccuccccaacaaagaguuauuaaagagcccgcaugcauuuguggcuccacaauua

SEQ ID NO: 277980 - RNA, 64 nt, Human
ccuugacugcgcucuccugugacgaugccacugcagcccgcaccuugucacugcugggccaaga

SEQ ID NO: 277981 - RNA, 64 nt, Human
ugagugaaggauuuccacguagacaccuaggaagagcccgcaugcccuagacucacuccagagg

SEQ ID NO: 277982 - RNA, 64 nt, Human
auuguguuuuccuuguuuucagcccccccacuccagcccgcagcacauuuccgcuguccgucag

SEQ ID NO: 277983 - RNA, 64 nt, Human
agggaucuugucaggguuccuuacugaccagaggagcccgcagcaaucuccacagccuccuggg

SEQ ID NO: 277984 - RNA, 64 nt, Human
gccaucaggagacuugaguugguauuuggaccugagcccgcacauuccacucccauucucccuc

SEQ ID NO: 277985 - RNA, 64 nt, Human
gaguucaccuuggaagggcguucuagguaggaagagcccgcagggccaugcagaccucaugccc

SEQ ID NO: 277986 - RNA, 59 nt, Human
uaaaggauuucuuccucugaggacaccaaagcccgcaguggacugaugccuucgauggg

SEQ ID NO: 277987 - RNA, 64 nt, Human
gucgugcuuuguuuuuggaagaucugguaacagcagcccgcauuagcagagagcuguagcugag

SEQ ID NO: 277988 - RNA, 64 nt, Human
gggcugaggauggagccgcccccagccgacuccaagcccgcagagggcagacgccacccuggac

SEQ ID NO: 277989 - RNA, 64 nt, Human
ugccccugagaacuucguggugacugccuuugggagcccgcagguggccagaggcagggguagc

SEQ ID NO: 277990 - RNA, 59 nt, Human
uugggaaagggcaaaaugugucagaugcccuaguuaaucauguaauuuaauucugguau

SEQ ID NO: 277991 - RNA, 59 nt, Human
gugguucauguuauauaauacacccuuaacuaguuaaauggaauguugguaugguacag

SEQ ID NO: 277992 - RNA, 59 nt, Human
uuuugcuucagguuugaaguaaaaauuaucuaguuaaauuuuuuuuauuucacguuacc

SEQ ID NO: 277993 - RNA, 64 nt, Human
gugcugguuucucauauugucuguaggcucacucagcccgcaguuuaugugugugcuuuuuucu

SEQ ID NO: 277994 - RNA, 64 nt, Human
gagaacaggugguguggcaggcgagcgggugggcagcccgcaucauccagcacgagauggacca

SEQ ID NO: 277995 - RNA, 64 nt, Human
gagugccccaccugccacuaggcugggugcccacagcccgcaugcagcagcuugcugcacccca

SEQ ID NO: 277996 - RNA, 64 nt, Human
uuccgacaaccgaugcuccagccaaccccuguggagcccgcacccccacccuuuggggggggcc

SEQ ID NO: 277997 - RNA, 64 nt, Human
cccccgaccccucccagauccuggggaccaauaaagcccgcagcgggucucggcuggcguccug

SEQ ID NO: 277998 - RNA, 64 nt, Human
cgcuuuccaggagccccaggcccggaggaggcgaagcccgcagagcaaagguggaaacacgugc

SEQ ID NO: 277999 - RNA, 64 nt, Human
gagagggccaaggacaauugggagggcagcaggcagcccgcagaugguggccauguggcacgcu

SEQ ID NO: 278000 - RNA, 64 nt, Human
cuuucccccgaccuaaacauaaaagacaaggcaaagcccgcauaauuuuaagacgguucuuuag

SEQ ID NO: 278001 - RNA, 64 nt, Human
acacaugggaugggggaggcagagacugguccagagcccgcaaauggacucggagccgagggcc

SEQ ID NO: 278002 - RNA, 64 nt, Human
cgaugugacguugacaauuacuggaucugcaaaaagcccgcagccugcuucagagacgaauagu

SEQ ID NO: 278003 - RNA, 64 nt, Human
cgggcccggggccuuggcuggcaaauaaagcguuagcccgcagcgcgacugugucuguguccca

SEQ ID NO: 278004 - RNA, 64 nt, Human
cccagaccaagcugaaucacgcuuucuccaagacagcccgcaggcuaagugcauuccuuccccu

SEQ ID NO: 278005 - RNA, 64 nt, Human
aggggcacaggacccugcccucguguucccucccagcccgcaguauuucagggacaggcucuuc

SEQ ID NO: 278006 - RNA, 64 nt, Human
acacccugcgagaccuggagcguagggcccagcuagcccgcaccuggauuuccaccguucagag

SEQ ID NO: 278007 - RNA, 64 nt, Human
gcacuuugggaggccaaggcaggaagaucacuugagcccgcaaguuugagaccacccugggcaa

SEQ ID NO: 278008 - RNA, 64 nt, Human
augacuaggcguggaccugcccauggugccugucagcccgcagagcccaucuacgcccaacaca

SEQ ID NO: 278009 - RNA, 59 nt, Human
gugaacaaaaauuuugugauggaaggauucuaguuaaugaguauugcaucaagauuuac

SEQ ID NO: 278010 - RNA, 59 nt, Human
ugcacuacuugagaaaauuuaaaguguuucuaguuaaauuauuuccuucuugagcgauc

SEQ ID NO: 278011 - RNA, 59 nt, Human
ggcauugauuaaagauucacagcaaaucacuaguuaagcagauuuuuuuucuauuuccu

SEQ ID NO: 278012 - RNA, 64 nt, Human
agcugagcaccgugccgggagguggccaagguacagcccgcaaugggccuguaaauaguccggc

SEQ ID NO: 278013 - RNA, 64 nt, Human
acaaccccgaugcccugcccgagacgcuggucugagcccgcacccagccgagcccccccugccc

SEQ ID NO: 278014 - RNA, 62 nt, Human
uucaugucuuuauuuaguuguuuauuuauuuaguuauuuaucuuauuuauugaggggugagg

SEQ ID NO: 278015 - RNA, 62 nt, Human
agaaccgacauggcugccuuuuguuuacacugguuauuuauuuaugacuugaaauaguuuaa

SEQ ID NO: 278016 - RNA, 62 nt, Human
cuguuucgaaauggggaaagccgugcgugcgcguuauuuauuuaagugcgccugugugcgcg

SEQ ID NO: 278017 - RNA, 62 nt, Human
cuccuccuucccaagucauuugaaaaguguuuguuauuuaaauuccaauaaugcccaauacu

SEQ ID NO: 278018 - RNA, 62 nt, Human
aaaugcuccauuuuuaaaguuuuauaacuuguguuauuuaaugagucagucaaucggcugca

SEQ ID NO: 278019 - RNA, 62 nt, Human
uuuauuagugaguguccuguucccagugcccgguuauuuaugauuaaauuacugaagugucu

SEQ ID NO: 278020 - RNA, 62 nt, Human
gacagaauauuaaucuuguacgcuuggauugaguuauuuaauuuuuuuuucuuuugcacauu

SEQ ID NO: 278021 - RNA, 62 nt, Human
uucuguaggagacuguuauuucuguaaagaugguuauuuaacccuccuccaccccaucacgg

SEQ ID NO: 278022 - RNA, 62 nt, Human
gauuauugcaaaauaaagcaaauuucagaacuguuauuuaaauggaaugaaccauuaaauga

SEQ ID NO: 278023 - RNA, 62 nt, Human
uguugcagcagagugacgauggggguugggggguuauuuauuuugccuguccuuaucccugc

SEQ ID NO: 278024 - RNA, 62 nt, Human
cacaugauuaauuuccaacaagacacuugggaguuauuuacuguguuccucuggcagccaau

SEQ ID NO: 278025 - RNA, 59 nt, Human
cucagaaggcagcuauucccagcagcuuccuaguuaacaacccccaugcugccuccagu

SEQ ID NO: 278026 - RNA, 59 nt, Human
auuacuaauucuauuucucuauguuuauucuaguuaaggaaauguugagggcaagccac

SEQ ID NO: 278027 - RNA, 59 nt, Human
aacuugcaggacaguuagagccugcauuucuaguuaagauggaucuuguaaauuuaaaa

SEQ ID NO: 278028 - RNA, 62 nt, Human
aaauaagaaagguaauaguugguaaggccaauguuauuuaaaugaaaguaguuagaaaaaug

SEQ ID NO: 278029 - RNA, 62 nt, Human
agguucagggaaaagaguucgcuacuccagggguuauuuagaagacacuuucucugccucau

SEQ ID NO: 278030 - RNA, 62 nt, Human
uaagccugagccuuagcucccagcuagggggcguuauuuauggaccacuuuuauuuauuguc

SEQ ID NO: 278031 - RNA, 62 nt, Human
uauuuccauucagugauguuggauguauaucaguuauuuaguaaauaaucucaauaaauuuu

SEQ ID NO: 278032 - RNA, 62 nt, Human
uaccaaacuaagaauuauuucagauuuagucuguuauuuauuaaacaacuaaaugcuacuua

SEQ ID NO: 278033 - RNA, 62 nt, Human
aaacuguucaagguaaccauaacaaacuagguguuauuuauuaacguauuauaaaauaaugu

SEQ ID NO: 278034 - RNA, 62 nt, Human
aaauucuacuaaguuauuuuaugacaugaaaaguuauuuaugcuauaaauuuuuugaaacac

SEQ ID NO: 278035 - RNA, 62 nt, Human
aaaugguuauaaagcuccuguuacucauauuaguuauuuacaucaaaaagcuuuuagaaaau

SEQ ID NO: 278036 - RNA, 62 nt, Human
aauaauaaaaauauuuuuaaaauuauguucagguuauuuauugacagguacuacuuacacca

SEQ ID NO: 278037 - RNA, 62 nt, Human
ucuaauaagagcuuguuaaauuuaagaauaaaguuauuuaaaauauucugaguauaguauau

SEQ ID NO: 278038 - RNA, 62 nt, Human
uucauaugaagugcuuuacucccaaccauugaguuauuuauaauguauuuauuaggggaggg

SEQ ID NO: 278039 - RNA, 62 nt, Human
aacuuccaggcaguaucuuucuauuguaaccuguuauuuaaggaaauacuagugauuucuuc

SEQ ID NO: 278040 - RNA, 60 nt, Human
auauaugguuuuaauguaauaaacuuuaaugaguuauuuagaccucuuauuuuuucugau

SEQ ID NO: 278041 - RNA, 59 nt, Human
aacaacaagcaaugauggcgauggcgauucuaguuaauaaaaaggggggagaugugggc

SEQ ID NO: 278042 - RNA, 59 nt, Human
cccucacacccugccucgcccccacuuuucuaguuaacuuuuuccauaucccucuugac

SEQ ID NO: 278043 - RNA, 59 nt, Human
uuaaaauaaaaauaaucacucccuaugaucuaguuaauguaauuauccagucacuguaa

SEQ ID NO: 278044 - RNA, 62 nt, Human
acugugcuccucacuuccucuucuucauugcaguuauuuagauccccccuuuccuucuaauu

SEQ ID NO: 278045 - RNA, 62 nt, Human
caagauguacauaauaucaugcucacugcaguguuauuuaaaauaaaaggcaggaaauaacc

SEQ ID NO: 278046 - RNA, 62 nt, Human
uucucacagaauucagcaagaaguagaaaccuguuauuuacuacauugugauuuaacuuugg

SEQ ID NO: 278047 - RNA, 62 nt, Human
cacauugaaauacuugaaaacuucucauuuauguuauuuaugauguuauuuuguacguguua

SEQ ID NO: 278048 - RNA, 62 nt, Human
aucaccaacaggguuuacucuccccuggagagguuauuuaaauagcuguccauaagccaucc

SEQ ID NO: 278049 - RNA, 62 nt, Human
uuccuuuuuaacuuugugguaacuucuuugaaguuauuuagaaauauccuuuggaacaauua

SEQ ID NO: 278050 - RNA, 62 nt, Human
uauaggauaacuuugaaacuuucugaauuaacguuauuuaaaaggaaauguagauguuauuu

SEQ ID NO: 278051 - RNA, 62 nt, Human
uuuguuuuuugacuguugggcuuugggaagauguuauuuaugaccaauaucugccaguaacg

SEQ ID NO: 278052 - RNA, 62 nt, Human
uuugaugcuuugauuugaaaauguucuucccuguuauuuacauucugguggguuuuuaaaau

SEQ ID NO: 278053 - RNA, 62 nt, Human
acugaauuagccuuggagguugacugugcaauguuauuuacuguuguaauuacuguaauacc

SEQ ID NO: 278054 - RNA, 62 nt, Human
guucuuuuaaacaacuguuuccuugggcuucaguuauuuaaaguaaauuuagguguaauaua

SEQ ID NO: 278055 - RNA, 62 nt, Human
ucuggugccuggaggugugggagggaagaugaguuauuuaacugguaagcgauuugaaacac

SEQ ID NO: 278056 - RNA, 62 nt, Human
gaugcaagauagauacuauauuaaacuguacuguuauuuaagauguaauaaagcaguuugac

SEQ ID NO: 278057 - RNA, 59 nt, Human
aaagaauaaaguccaaagucagaucuggucuaguuaaccuagaaguauuuuugucucuu

SEQ ID NO: 278058 - RNA, 59 nt, Human
ucuccccacuccuuucuucccuccucaaucuaguuaaauuuccuaagcuuucacaaaaa

SEQ ID NO: 278059 - RNA, 62 nt, Human
ugggcuuucuucucuaauucuucuguuuuauuagacccaagacaaguucuaaaaauugaaug

SEQ ID NO: 278060 - RNA, 50 nt, Human
aaggugacaagcaguuauaaguuauuuauuuguuaacgcuggcuguggaa

SEQ ID NO: 278061 - RNA, 62 nt, Human
uuuuuguucugguuugguuuuuggguccucauguuauuuauugccgaaaccaggcaggcaac

SEQ ID NO: 278062 - RNA, 62 nt, Human
aggacaaacucaggcaaggagcauguuuuuuuguuauuuacaaaaucuagcagacugugggu

SEQ ID NO: 278063 - RNA, 62 nt, Human
cauccccacccaaagugcucagaccuugucuaguuauuuauaaaacuguauguaccucccuc

SEQ ID NO: 278064 - RNA, 62 nt, Human
auaauaaaacugacauucaauuuucaacuuuaguuauuuaacacagauuuuuuuauuuuuua

SEQ ID NO: 278065 - RNA, 62 nt, Human
cagaaguggaccaaaggauuccucugaauaaaguuauuuaaauugauguucacuggcucagg

SEQ ID NO: 278066 - RNA, 62 nt, Human
ccacuaugauuauaaacugugucucgaccuguguuauuuacauuagcugcuuaaaaaagcau

SEQ ID NO: 278067 - RNA, 62 nt, Human
uuguauuacccagcuuucuuuuuaauacaaauguuauuuauaguuuacaaugaaugcacugc

SEQ ID NO: 278068 - RNA, 62 nt, Human
guuccauuuucuccacaaccuugccagcaucuguuauuuauugacuuucuaguaacagccau

SEQ ID NO: 278069 - RNA, 62 nt, Human
aaaugaugcuucgguuugauggaccuuucaacguuauuuauugaauauguauuucgguugcc

SEQ ID NO: 278070 - RNA, 62 nt, Human
uuucugauccaaacugucuuuuuuuuguaucuguuauuuaaagcccaguggauauuucaauu

SEQ ID NO: 278071 - RNA, 62 nt, Human
agaauuucugcaucugguacaugggcaaguaaguuauuuaguucuaaccacaaauaacaagu

SEQ ID NO: 278072 - RNA, 62 nt, Human
gauguucaaauauuguaaaacuuuggugcauuguuauuuaauagcugugaucagugauuuuc

SEQ ID NO: 278073 - RNA, 62 nt, Human
aaggcccagcugcagcccucagcuagaguccaagacccaaccaggcgcugggcugacucuga

SEQ ID NO: 278074 - RNA, 62 nt, Human
ucgugucucuuugugcuuuuguuuguggaaggagacccaaaugccuuuacuuuauucucugg

SEQ ID NO: 278075 - RNA, 62 nt, Human
ugggagggauaucaacuuggaggagaacaccuagacccaaggacuuuuuucugcccaaggaa

SEQ ID NO: 278076 - RNA, 62 nt, Human
cuucccucugcugugccacggcuguugcuucgguuauuuaaauaaaaagaaaguggaacugg

SEQ ID NO: 278077 - RNA, 62 nt, Human
agcagccacuguaugauauuuuaagcaaauauguuauuuaaaauauugauccuucccuugga

SEQ ID NO: 278078 - RNA, 62 nt, Human
uuacaaagggcuucagauguuuagaguacuagguuauuuauguuuuacaaaguuugaaucuu

SEQ ID NO: 278079 - RNA, 62 nt, Human
auaacauuguuuuuguuauuguuggugcuguuguuauuuauuauuguaauuucaguuugccu

SEQ ID NO: 278080 - RNA, 62 nt, Human
uuuauacuaauaaguuugcuaguacagugucaguuauuuaaagugguaaugcccgauaaugu

SEQ ID NO: 278081 - RNA, 62 nt, Human
ugcuacaauaaugauaauuuauuagucuuucuguuauuuaaagaauaaaaacaugcuuauaa

SEQ ID NO: 278082 - RNA, 62 nt, Human
uuugaaucuaaauuauuugugcugaacauuucguuauuuauaaaugaaaaccaauaaauguc

SEQ ID NO: 278083 - RNA, 62 nt, Human
cagccaaaguccacauauggauauuuggggauguuauuuaaauacucagcaggcugagugca

SEQ ID NO: 278084 - RNA, 62 nt, Human
accacuucauucuugaaagcuguggccagcuuguuauuuauaacaaccuaaauuugguucua

SEQ ID NO: 278085 - RNA, 62 nt, Human
uucaguaauuaaaaugggaaacagaagccuaaguuauuuaccuuaucaaaaccacguuccuu

SEQ ID NO: 278086 - RNA, 62 nt, Human
cucuugcuucauagguguaccauuuaaagaguguuauuuaaugcuaaguuuaacugcuuuaa

SEQ ID NO: 278087 - RNA, 62 nt, Human
auuuguacagaacacagaacuuauuucugucaguuauuuaauacauugaaaauuuagugaaa

SEQ ID NO: 278088 - RNA, 62 nt, Human
caggguguucucuuacuuggacugugauauucguuauuuaugaaaaagacuuuuaaaugccc

SEQ ID NO: 278089 - RNA, 62 nt, Human
aaagagucucauagaucauaguccaauccccuagacccaaaggcccagacacgcaggguucu

SEQ ID NO: 278090 - RNA, 62 nt, Human
cucuguaagggcagugugagggacugcugugcagacccaagcaaucccaaccuggugcuagg

SEQ ID NO: 278091 - RNA, 64 nt, Human
aaauccuucuaaucugcuaugcuugaaugccacgcgguacaaaggaaaaaguaucauggaaaua

SEQ ID NO: 278092 - RNA, 62 nt, Human
gagucucugggaagcuuuaggacaucugcuacguuauuuaucaaaauauugggaucucugcc

SEQ ID NO: 278093 - RNA, 62 nt, Human
agauauaauuuuauuuucggagcuaagaugguguuauuuaaggguggugaugggugagcgcu

SEQ ID NO: 278094 - RNA, 62 nt, Human
cuuuuauuguauuaacagcugagguagcuaaaguuauuuaaaauaaaauuaaauuuaugauc

SEQ ID NO: 278095 - RNA, 62 nt, Human
gguuuaggauguuacaguacuaauaccaucauguuauuuauucuaauauagaggcauugaga

SEQ ID NO: 278096 - RNA, 62 nt, Human
gcaaauaaagauauaucaggaaggauguauuaguuauuuacuuaaauguuuauaauaucugg

SEQ ID NO: 278097 - RNA, 62 nt, Human
cuucaugcugagguagugguugccuuagagcuguuauuuaugcuguagaaaacgaaaauggu

SEQ ID NO: 278098 - RNA, 62 nt, Human
aauuucuauaggauauguauuuauuauugauuguuauuuaauuuuuuuccaauuuuaccugu

SEQ ID NO: 278099 - RNA, 62 nt, Human
auuauacacaucaucuuaauaacuauuuuuaaguuauuuaccauagccucuguauagaccuu

SEQ ID NO: 278100 - RNA, 62 nt, Human
uguucuuaaaccgacucagugugucauccccgguuauuuagaauuacaguuaagaaggagaa

SEQ ID NO: 278101 - RNA, 62 nt, Human
caucccgaagaaugauuuugucaggaauuauuguuauuuaauaaauauuucaggauauuuuu

SEQ ID NO: 278102 - RNA, 62 nt, Human
uuuuugcagcgugcaugaguuuuagugaccuuguuauuuaagaaguuaaauacaaggaguaa

SEQ ID NO: 278103 - RNA, 62 nt, Human
gggcaaccuccagaacugugaaaaauaaauuuguuauuuaaaaagaaaaaaaaaaaaacaaa

SEQ ID NO: 278104 - RNA, 62 nt, Human
auuuaugguuuauuuuaagugacuuuuuauggguuauuuagguuuucgucuuaguuguagca

SEQ ID NO: 278105 - RNA, 64 nt, Human
gagagaaaaucauugcaaaaucauuuuuuuuguucgguacaauaaaguuuacuaaaaaacagua

SEQ ID NO: 278106 - RNA, 64 nt, Human
ggauguguauuuccauaaaugcuuucugaggauccgguacaaaaugauuucccaaaguucugaa

SEQ ID NO: 278107 - RNA, 64 nt, Human
caagucucucaaacaucaagacaacuucagcagucgguacaagucacauuucauuuugauugaa

SEQ ID NO: 278108 - RNA, 62 nt, Human
guuuugcccgauagaagagccagcauguucacguuauuuaaauuagguggaaaaaucuaaac

SEQ ID NO: 278109 - RNA, 62 nt, Human
acaauguuuagguaaagacauacucauuaaguguuauuuauuuuacucaagaacuggaaacc

SEQ ID NO: 278110 - RNA, 62 nt, Human
aauaaguuuccauaagucuccuacauagcaguguuauuuauguacagauaagaaaaccauau

SEQ ID NO: 278111 - RNA, 62 nt, Human
uuuucgcuaggaccgguuugggcuuuguacagguuauuuaauagcuuuguuaaagauaauua

SEQ ID NO: 278112 - RNA, 62 nt, Human
uuguaaauaguucauucaaucaaugguauggaguuauuuauuugcuacauaauagauacugu

SEQ ID NO: 278113 - RNA, 62 nt, Human
gagaucccuuccuuccucuucggugaaugcagguuauuuaaacuuugggaaauguacuuuua

SEQ ID NO: 278114 - RNA, 62 nt, Human
gaaggauccugaacauauuuaguuacccuguaguuauuuaggaauuuaaaccagaagacuuu

SEQ ID NO: 278115 - RNA, 62 nt, Human
uuuuuguuagcaggaaagagugauuaagugagguuauuuaccccuaaaugguccauucugca

SEQ ID NO: 278116 - RNA, 62 nt, Human
gucaaccagugcaagugaccgacaaaauuccaguuauuuauuuccaaaauguuuggaaacag

SEQ ID NO: 278117 - RNA, 62 nt, Human
uguaaaaucuuuguuguuuaauuaaaugugccguuauuuaccccugauguuauuuaugacua

SEQ ID NO: 278118 - RNA, 62 nt, Human
uuuaauuaaaugugccguuauuuaccccugauguuauuuaugacuaugugccgauuccugcu

SEQ ID NO: 278119 - RNA, 62 nt, Human
uccuaaagaacaaaguaaugacagaacaugcuguuauuuagguauuuuucuuuaaccaaaca

SEQ ID NO: 278120 - RNA, 62 nt, Human
aagcaucacauuaaaguuaaacuguauuuuauguuauuuauagcuguagguuuucuguguuu

SEQ ID NO: 278121 - RNA, 64 nt, Human; identical to SEQ ID NO: 6094

SEQ ID NO: 278122 - RNA, 64 nt, Human; identical to SEQ ID NO: 6101

SEQ ID NO: 278123 - RNA, 64 nt, Human; identical to SEQ ID NO: 6107

SEQ ID NO: 278124 - RNA, 64 nt, Human; identical to SEQ ID NO: 6113

SEQ ID NO: 278125 - RNA, 62 nt, Human
acccacauucugugacucuuugcaucacucguguuauuuauuuauuuauuuauauucugccu

SEQ ID NO: 278126 - RNA, 62 nt, Human
acucaguggguuuuuauuaauaugcugauuaaguuauuuacugggccagucauugugcuaaa

SEQ ID NO: 278127 - RNA, 62 nt, Human
augugagaggguguccaguuugucuagugauuguuauuuagagaguuggaccacuauugugu

SEQ ID NO: 278128 - RNA, 62 nt, Human
cugcucuucuucgccuccuuuauuuaauucauguuauuuauucgcggagcucuguucguguu

SEQ ID NO: 278129 - RNA, 62 nt, Human
augcuacuucuuacauacccaaaagaaauucaguuauuuauuguauauuuauuguauucuaa

SEQ ID NO: 278130 - RNA, 62 nt, Human
ugaauuugaagugaguuuuuuuccccccauaaguuauuuauuccuuuuuucuguguaaauau

SEQ ID NO: 278131 - RNA, 62 nt, Human
auuuaguauaaaguuuuugcuguuaaauauuuguuauuuaguaaaauaugaauuuugcucua

SEQ ID NO: 278132 - RNA, 62 nt, Human
ccucccuugugacucccacaucaaccauuaaaguuauuuaacagcagccuucaccuggcucc

SEQ ID NO: 278133 - RNA, 62 nt, Human
guuuucuaaacucaauaagguaaugaccaguuguuauuuacagcucuguaaccucccguugc

SEQ ID NO: 278134 - RNA, 62 nt, Human
uaagaguggaaccaacacuaacauauaauguuguuauuuaaagaacacccuauauuuugcau

SEQ ID NO: 278135 - RNA, 62 nt, Human
uuaacuauuagaggcccugugagauguaggcaguuauuuacagaugagaaaacuaacacagc

SEQ ID NO: 278136 - RNA, 62 nt, Human
auggcaccuuacuuuuuggaaacaaaucuucuguuauuuacaaaauaauaauuuuuaaaaaa

SEQ ID NO: 278137 - RNA, 62 nt, Human
uuauugacaguuuugcacagguucuugaaaacguuauuuauaaugaaaucaacuaaaacuau

SEQ ID NO: 278138 - RNA, 64 nt, Human; identical to SEQ ID NO: 6120

SEQ ID NO: 278139 - RNA, 64 nt, Human; identical to SEQ ID NO: 6127

SEQ ID NO: 278140 - RNA, 64 nt, Human; identical to SEQ ID NO: 6131

SEQ ID NO: 278141 - RNA, 64 nt, Human; identical to SEQ ID NO: 6138

SEQ ID NO: 278142 - RNA, 62 nt, Human
aaaaagcaaauauauauuacuaaggaaaaaaaguuauuuauaauugccuugucauaauuguu

SEQ ID NO: 278143 - RNA, 62 nt, Human
guuuugauuauaugcuucuugcaguuaaucucguuauuuaaacaaaaaguuuugggucuguc

SEQ ID NO: 278144 - RNA, 62 nt, Human
gucuuuguuguugaaaugaaagguauuuugggguuauuuauuaugaaaacaacaugcucuua

SEQ ID NO: 278145 - RNA, 62 nt, Human
auugugaauaagauuuuaauguugauaauucuguuauuuacauaucucuaauuuacuuugaa

SEQ ID NO: 278146 - RNA, 62 nt, Human
aagaaaagaacauuuccagucauucagcugugguuauuuaaagcagacuuacauguaaaccg

SEQ ID NO: 278147 - RNA, 62 nt, Human
ccaacuguuauagguuguuggauaaaucagugguuauuuagggaacugcuugacguaggaac

SEQ ID NO: 278148 - RNA, 62 nt, Human
aagaacaguguugaaauuggaaaggacuuuguguuauuuagguuguuagaaugagccuuacc

SEQ ID NO: 278149 - RNA, 62 nt, Human
uguuguuguuuuaacauguuuaaccaacagaaguuauuuacagaaauucauauauccaggca

SEQ ID NO: 278150 - RNA, 62 nt, Human
aguaauugccuagaaauaucuuucucuuaccuguuauuuaucaauuuuucccaguauuuuua

SEQ ID NO: 278151 - RNA, 62 nt, Human
ugcugcauuucaggggccaccauggagcagccguuauuuauagaacugccuguuggaggugg

SEQ ID NO: 278152 - RNA, 62 nt, Human
auguugagaggaacaagaagguggaaggcaguguuauuuauuucuuucuauucuuggaacca

SEQ ID NO: 278153 - RNA, 62 nt, Human
gaguuuugugggauggggaagagauuuuaguuguuauuuaacuugagaaagacuaagcgccu

SEQ ID NO: 278154 - RNA, 62 nt, Human
ucacuacagguuaaaagaccauaagcaaacugguuauuuaaaauguaaaaaggaauaugaaa

SEQ ID NO: 278155 - RNA, 64 nt, Human; identical to SEQ ID NO: 6144

SEQ ID NO: 278156 - RNA, 64 nt, Human; identical to SEQ ID NO: 6149

SEQ ID NO: 278157 - RNA, 64 nt, Human; identical to SEQ ID NO: 6155

SEQ ID NO: 278158 - RNA, 64 nt, Human; identical to SEQ ID NO: 6159

SEQ ID NO: 278159 - RNA, 62 nt, Human
ugagccaccgcacccggccgagaauauguguuguuauuuaugacuggauuaugaagaaucag

SEQ ID NO: 278160 - RNA, 62 nt, Human
aaaacauucuuuguuuagaaggagauucuaaaguuauuuaugaugcuuagccauaguauuca

SEQ ID NO: 278161 - RNA, 55 nt, Human
aagucuuugagagguguuaaauaugguuauuuaugcacugugggauguguucuuc

SEQ ID NO: 278162 - RNA, 62 nt, Human
cagccgcgauacggcgcaguuccuauauucauguuauuuauuguguacugacuccaucugcc

SEQ ID NO: 278163 - RNA, 62 nt, Human
auccugaccugagccagaccuuaagcucuaugguuauuuagcuggccauucagguauaaggc

SEQ ID NO: 278164 - RNA, 62 nt, Human
gauuuaaguaucuguuuuaauaagcucuuuuuguuauuuaaaggcugcccauggguuucugc

SEQ ID NO: 278165 - RNA, 62 nt, Human
auuuauauauauauauagcaagauuuucauguguuauuuaauucuguauuguuucuuauauu

SEQ ID NO: 278166 - RNA, 62 nt, Human
caggggccccgggucgcagagagcacguucccguuauuuauuccccuccgcguccuacacag

SEQ ID NO: 278167 - RNA, 62 nt, Human
gauugagugaaacuuuauaaagcauauggucaguuauuuaauuaaaaaggcaaaaccugaac

SEQ ID NO: 278168 - RNA, 62 nt, Human
aauggaaaaugauacagcuauaaaagaaagcuguuauuuacuguaguuguagauguauucac

SEQ ID NO: 278169 - RNA, 62 nt, Human
ugucucuaaauauuccaccauaaaacagcugaguuauuuaugaauuagaggcuauagcucac

SEQ ID NO: 278170 - RNA, 62 nt, Human
accuugaaaguccuaacauuagaauuguaaauguuauuuauggaaauaccuuccaaugcuau

SEQ ID NO: 278171 - RNA, 62 nt, Human
uuaacuccaugacugaauagcauaaggaagagguuauuuaaaagcaagaacuacuuuuuuug

SEQ ID NO: 278172 - RNA, 64 nt, Human; identical to SEQ ID NO: 6165

SEQ ID NO: 278173 - RNA, 64 nt, Human; identical to SEQ ID NO: 6172

SEQ ID NO: 278174 - RNA, 64 nt, Human; identical to SEQ ID NO: 6179

SEQ ID NO: 278175 - RNA, 64 nt, Human; identical to SEQ ID NO: 6184

SEQ ID NO: 278176 - RNA, 62 nt, Human
uuagagauuguuauucaaguuccuuagaaauuguuauuuagguauaauaucaucuugucuuu

SEQ ID NO: 278177 - RNA, 62 nt, Human
aauauuuguagauuuauagcaaauagagacucguuauuuaaagguuaaauaacaauuuguuc

SEQ ID NO: 278178 - RNA, 62 nt, Human
aagacugcccuaaacaaccauuuugucacucaguuauuuaacuguguuuagcucauuuaaau

SEQ ID NO: 278179 - RNA, 62 nt, Human
uccagcucuacuauuuuugguugugugauagaguuauuuaaccucucugagccucaguuccc

SEQ ID NO: 278180 - RNA, 62 nt, Human
cauugauaaaauaguaagucaauccaggaacaguuauuuagaauucauauugaauuaaauua

SEQ ID NO: 278181 - RNA, 62 nt, Human
guuugaaaccugucuuugaaauuagcaccuuuguuauuuauguuguacuugugaaaacagua

SEQ ID NO: 278182 - RNA, 62 nt, Human
ccuuuuuauuauuauuuauuuggugguccuguguuauuuaagagaucaaauguauaaccacc

SEQ ID NO: 278183 - RNA, 62 nt, Human
gguuugucauuuuuguuguuguuguuguuguuguuauuuacucuauacccuuuagcaaaaua

SEQ ID NO: 278184 - RNA, 62 nt, Human
gaugcaaauagacugauacauaauuuggaaagguuauuuacauggcagaauacauguaugaa

SEQ ID NO: 278185 - RNA, 62 nt, Human
aagaaaacacaacccuuucccuuugguguacaguuauuuauuaaguugauuuugggguuucu

SEQ ID NO: 278186 - RNA, 62 nt, Human
ucagcacuuuggacaccuggagacccagcccuguuauuuaaugguagugggcaagugugugu

SEQ ID NO: 278187 - RNA, 62 nt, Human
uaauuuguuuauuagccaggacccaagacuaaguuauuuacauguccauuguaaaugcaaug

SEQ ID NO: 278188 - RNA, 62 nt, Human
gugaaagagggaguauuacuuuuauguacaaaguuauuuauuuauagaaauuuugguacagu

SEQ ID NO: 278189 - RNA, 62 nt, Human
cgaaugagcuggcaggucuaaugggggaggcggcgucccagucuguguugcagcagcauucu

SEQ ID NO: 278190 - RNA, 62 nt, Human
ccaggggcccacccucugcccagggaguccuugcgucccaugaggucuucccgcaaggccuc

SEQ ID NO: 278191 - RNA, 62 nt, Human
gcuguggaccguggacaggcccagcgcggccagcgucccaggguacccgccugagcuccugc

SEQ ID NO: 278192 - RNA, 62 nt, Human
aaaaagaaaccaacaauuuaaauuauauugauguuauuuacuuaaaauaauuauucucagaa

SEQ ID NO: 278193 - RNA, 62 nt, Human
aaaaccuaauagcugccucaugacaaguacauguuauuuaaggaggaaaaaauauuaaauuu

SEQ ID NO: 278194 - RNA, 62 nt, Human
aaucucugucauuuucaaagaugcaaaaugguguuauuuaauugucuccaccauugucacac

SEQ ID NO: 278195 - RNA, 62 nt, Human
cguaauugcucagaguagagagcccccacaaaguuauuuaaaagaugcccuagcagcaaucc

SEQ ID NO: 278196 - RNA, 62 nt, Human
acaaguuaauuauuucaaaauguuuuucagauguuauuuaaauaguaauauauacauugauu

SEQ ID NO: 278197 - RNA, 50 nt, Human
ugucauuuauagaucccuaaguuauuuacuuuucauugaauugaaauuua

SEQ ID NO: 278198 - RNA, 62 nt, Human
accaaauaguuauuuucuauguuggacacuuaguuauuuaccaaagccuccgauuugugaug

SEQ ID NO: 278199 - RNA, 62 nt, Human
guuauuucacuuuaucuuauuggaguuuuugaguuauuuauuuuuacaguaacuuauuugac

SEQ ID NO: 278200 - RNA, 62 nt, Human
uauuuuuaauuaucuuuacaauuauuaucugaguuauuuaccuucauaguuauuucacuuua

SEQ ID NO: 278201 - RNA, 62 nt, Human
uauuuucaaaguuauuuaguuguucauuuucaguuauuuauauguaguuguuuuguuuuagg

SEQ ID NO: 278202 - RNA, 62 nt, Human
aguuacugguuuauaguuacuuuauuuucaaaguuauuuaguuguucauuuucaguuauuua

SEQ ID NO: 278203 - RNA, 62 nt, Human
uuaguugauuuucauuucuuuguagcuuucugguuauuuaauuuuauaguuucaguuacugg

SEQ ID NO: 278204 - RNA, 62 nt, Human
uuauuaaaucuucaaaaaauauauuuuagucuguuauuuaagaaaaacauaacaucccaaaa

SEQ ID NO: 278205 - RNA, 62 nt, Human
cgagggacuguggcgaccgugccucugugccagcgucccaggaaggaagccaacccugagcg

SEQ ID NO: 278206 - RNA, 62 nt, Human
auuuuuguaggggauugaagccagagcuaguugcgucccagggaccaagagaaagaagcaga

SEQ ID NO: 278207 - RNA, 50 nt, Human
agagcugcacccuccugugagcgucccacccgccuccaacgggucacaca

SEQ ID NO: 278208 - RNA, 62 nt, Human
gugcagaagacgcccauucggacugcugugccgcgucccacgucuccuccucgaagccaugu

SEQ ID NO: 278209 - RNA, 62 nt, Human
acuucacuuuaauucucaugugauccuuuuauguuauuuauauauugguaacauccuuucua

SEQ ID NO: 278210 - RNA, 62 nt, Human
ugcaaauuggauuccauagaaguuuuagcuauguuauuuacaaugcaggauuuuacagauaa

SEQ ID NO: 278211 - RNA, 62 nt, Human
gucauauuauaaaagguuugcuuucuuuaaguguuauuuaucuuaaauuauaaucguuaaau

SEQ ID NO: 278212 - RNA, 62 nt, Human
cauguuuuuaugcuuccauagggaacauuuugguuauuuaaauuguucauaaugucccauau

SEQ ID NO: 278213 - RNA, 62 nt, Human
uauuugcaguucaccugcacuuaaggcacucuguuauuuagacucaucuuacuguaccuguu

SEQ ID NO: 278214 - RNA, 62 nt, Human
cuguuuuguaacuguuuagaugaaugucaguuguuauuuauugaaaugauuucacagugugu

SEQ ID NO: 278215 - RNA, 62 nt, Human
cacacuaagaaaacuguaaaaccuugaacauuguuauuuauauuuuuuaaaauggaaaagau

SEQ ID NO: 278216 - RNA, 62 nt, Human
ccagaaucaggcuuuauuucgauauugaagauguuauuuaacaucuuucuuuuuuccuuacu

SEQ ID NO: 278217 - RNA, 62 nt, Human
aaauauauugaauaaaauaagcaaaagcuauuguuauuuacugauccuggauugucuuaaag

SEQ ID NO: 278218 - RNA, 62 nt, Human
cuugaaagcauuacagguaagggcauguuaugguuauuuaucauuguuuaaugaauaguaga

SEQ ID NO: 278219 - RNA, 62 nt, Human
caucaaaguuuaaagcauuuacuucagaauaaguuauuuauguguauauguucaauaaauau

SEQ ID NO: 278220 - RNA, 62 nt, Human
agaugaaguauuuaacuaugaauaucaugaagguuauuuaaaaauguauuuauuuuaucuuu

SEQ ID NO: 278221 - RNA, 62 nt, Human
uuagggaaucuuccuuuaaagcaagaaaucauguuauuuagaaagaaaaacuaaucuuaaac

SEQ ID NO: 278222 - RNA, 62 nt, Human
accccuggaccgaccaaagcccgcgcgcugcugcgucccacacccggugcccacaucccgcc

SEQ ID NO: 278223 - RNA, 62 nt, Human
augccccucggcuuccccccagccuggcagcagcgucccagcgccuccacauugccccucuc

SEQ ID NO: 278224 - RNA, 62 nt, Human
auacagagcacggugcuggcugacucaacugugcgucccagguucagggucuuacagagcuc

SEQ ID NO: 278225 - RNA, 51 nt, Human
uccgcaccaucagcgucugaggcgucccacuggcucugaucuugcuuccug

SEQ ID NO: 278226 - RNA, 62 nt, Human
ggaaaugucuuuuguuaauauaaucuucccauguuauuuaacaaauuguuuuugcacauauc

SEQ ID NO: 278227 - RNA, 62 nt, Human
uuucuauuugguugugcaaaauguuuuucccaguuauuuaaucgaaguaauuccuuuuaaua

SEQ ID NO: 278228 - RNA, 62 nt, Human
cuggaucuaguaacaugaaacacacaacguaaguuauuuagaaucacuuuaaucaaccaaua

SEQ ID NO: 278229 - RNA, 62 nt, Human
gcaguacuuucugcuuuaauauuaaacagcuuguuauuuaaauauuggacaaaauggcuggc

SEQ ID NO: 278230 - RNA, 62 nt, Human
caaagacauucugcaaagauauguuuuauauuguuauuuauugugacaaaaggaaauaaaaa

SEQ ID NO: 278231 - RNA, 62 nt, Human
uauacuuuuuuuuuaaaaaaagaaugucaguuguuauuuauucaaauuaucucacauuaugu

SEQ ID NO: 278232 - RNA, 62 nt, Human
uugaaagcuuguauuuuaauauuuuacaugcuguuauuuaaagaugugaguguguuucauca

SEQ ID NO: 278233 - RNA, 62 nt, Human
cuauuuuguaacuguaaagaugaaugucaguuguuauuuauugaaaugauuucacagugugu

SEQ ID NO: 278234 - RNA, 62 nt, Human
cucauuauuuguguggcuaauuauaauucagcguuauuuaagcacauaaagaccaaaaaaaa

SEQ ID NO: 278235 - RNA, 62 nt, Human
gcugguuagcaaacuccuuuuuacccauauaaguuauuuaauauaauaaugaagcucaacac

SEQ ID NO: 278236 - RNA, 62 nt, Human
guguaguuggauuuugggaccuuggccucaguguuauuuacugggauuggcauacguguuca

SEQ ID NO: 278237 - RNA, 62 nt, Human
auagacagagcugcagucugugcuaacauuagguuauuuauugauucaaucaguugacacaa

SEQ ID NO: 278238 - RNA, 62 nt, Human
cuaugaauauaauuacaguauuuuaauauuuaguuauuuaauuuguucuacuaguuggauac

SEQ ID NO: 278239 - RNA, 62 nt, Human
ugucucaguuagugugugugugucuuuaacuugcgucccauucucagggcccccacaucagu

SEQ ID NO: 278240 - RNA, 64 nt, Human
acaaauggggacacucuguucaggagaauaauccgacuggcauuuguggcaguuuuugaaaugu

SEQ ID NO: 278241 - RNA, 64 nt, Human
uuuucuaucauucuuucuagacacacacacaucagacuggcaacuguuuuguagcaagagccau

SEQ ID NO: 278242 - RNA, 62 nt, Human
aguuuauuucaggacugagaaauaucuugaagguuauuuauuagaugacuaucucaaaugaa

SEQ ID NO: 278243 - RNA, 62 nt, Human
ggcuagugaaucgccacuguacuguaauaaugguuauuuaccucugugcuguuuuaauuacc

SEQ ID NO: 278244 - RNA, 62 nt, Human
uaggacuguauuuccaaauuacugauaucagaguuauuuaaaaauuguuuauuugaggagau

SEQ ID NO: 278245 - RNA, 62 nt, Human
cagaacaucauuuuaaaggagauacuugaauuguuauuuaaaucaaaccagauguaaaacac

SEQ ID NO: 278246 - RNA, 62 nt, Human
gccugauuccccgacuccauccuuuuucagggguuauuuaaaaaucugccuuagauucuaua

SEQ ID NO: 278247 - RNA, 62 nt, Human
uaaguaaauggaugucucgugaugcaucuacaguuauuuauuguuacauccuuuuccagaca

SEQ ID NO: 278248 - RNA, 62 nt, Human
guuucuucuugugauugcugccauaauucuaaguuauuuacuuuuaccacuauuuaaguuau

SEQ ID NO: 278249 - RNA, 62 nt, Human
auuuaauccucucaaccaccuuucagauaacuguuauuuauaaucacuuuuuuccacauaag

SEQ ID NO: 278250 - RNA, 62 nt, Human
acaacucuaauaaaugugaguuuuaaaggauuguuauuuacuacuuuggauuguaauuagaa

SEQ ID NO: 278251 - RNA, 62 nt, Human
uuguguggauggggaaaauguuuuaaaauccaguuauuuaauaugaguuugagagagaaaau

SEQ ID NO: 278252 - RNA, 62 nt, Human
auuucuuuuaagaaauuuauagcauuuacuguguuauuuaaaugcuaagccaaaguaucugc

SEQ ID NO: 278253 - RNA, 62 nt, Human
uaccgaaguuggcucaagaauuuguuuuuaguguuauuuaccaagauuaggacgucaguggc

SEQ ID NO: 278254 - RNA, 62 nt, Human
aucuuuucugaagugucuuugggcaguauguaguuauuuauuacaaaauuauauucaccuaa

SEQ ID NO: 278255 - RNA, 64 nt, Human
ucuaguacaaggcgaguggauaauuccaacacaagacuggcaguccaaauugaaagagauccag

SEQ ID NO: 278256 - RNA, 64 nt, Human
cagcuaauguugcaguucuuauuguauggcauaggacuggcauuauauagcagaaaucaacuac

SEQ ID NO: 278257 - RNA, 64 nt, Human
ucagcuccccucggagaagagcuguucacagccagacuggcacaguuuucugagaaagacuauu

SEQ ID NO: 278258 - RNA, 64 nt, Human
gggccucugcucuauaucuauucccuuccagccagacuggcagaugggggcuucccccuacccc

SEQ ID NO: 278259 - RNA, 62 nt, Human
acacuucuucuuggucuuauuuauuauuguguguuauuuaaaugaguguguuugucaccguu

SEQ ID NO: 278260 - RNA, 62 nt, Human
uuuaggcauuaauauaaaagagguaggagucuguuauuuaaaaaaagcauuaaauuuaaaaa

SEQ ID NO: 278261 - RNA, 62 nt, Human
ucucaguacaagauucugaguaucauaaaaugguuauuuaauugaaacguagugugguauac

SEQ ID NO: 278262 - RNA, 62 nt, Human
ugaccaggcugugaacauugacuguggcuaaaguuauuuaugugguguuauaugaagguacu

SEQ ID NO: 278263 - RNA, 62 nt, Human
ccaguguauugcucauauuaucagaaggaaaaguuauuuaaguaugucaguuaauuguacua

SEQ ID NO: 278264 - RNA, 62 nt, Human
uaaauugucagaucguucauugccuuuccaggguuauuuaguaaaguuuguugaaaacaaaa

SEQ ID NO: 278265 - RNA, 62 nt, Human
gaaacaagugcccuuuucaugaucgaaacuggguuauuuaauuggaagaaaguaaaaaaaaa

SEQ ID NO: 278266 - RNA, 62 nt, Human
cucucacuuggaagcuguguuacacuggggauguuauuuacuuguuuauuaguuagcacuua

SEQ ID NO: 278267 - RNA, 62 nt, Human
gaagcaagauaaauggguauguaggaugaaggguuauuuaaaauggaacuaaagauagaagg

SEQ ID NO: 278268 - RNA, 62 nt, Human
auugaauauacauucuuuuaaaaaguauauuuguuauuuaaguuuuucagauaauaugugac

SEQ ID NO: 278269 - RNA, 62 nt, Human
guguucaauacauuagccacuagccacaugugguuauuuaaauaagauaaaauaaaaauugg

SEQ ID NO: 278270 - RNA, 62 nt, Human
cacauccucccaauuuguucuguauuuagguaguuauuuauacaagagucuuuaagucauuc

SEQ ID NO: 278271 - RNA, 62 nt, Human
uacaauagauagugucauguugcagguucaacguuauuuacauguaaauagacaaaaggaaa

SEQ ID NO: 278272 - RNA, 64 nt, Human
agcauauuuuuggaaagcuaaauguuuccucgaugacuggcagcaaacucguggcccccaccuu

SEQ ID NO: 278273 - RNA, 64 nt, Human
cuuuucauugaauugaaauuuauuuuggaugaaugacuggcaugaacacgucuuugaaguugug

SEQ ID NO: 278274 - RNA, 64 nt, Human
ugacaauaaagucugucagccaagcacgaaccaagacuggcacuauuuuucuuaguguauauaa

SEQ ID NO: 278275 - RNA, 64 nt, Human
acaacagcaauauuuuuauucugggccaccucucgacuggcacucaucccaugguaaaauauuc

SEQ ID NO: 278276 - RNA, 62 nt, Human
agugcagaggcuguggucaugcggaacacucuguuauuuaagauggcuauccagauaauccu

SEQ ID NO: 278277 - RNA, 62 nt, Human
gaaauuuguaucgcaaagcuauaugugcauauguuauuuaauucaucuaaugcuacacaaaa

SEQ ID NO: 278278 - RNA, 62 nt, Human
aauauauguguuggccuauuauugauguaaaaguuauuuaaauaaguuaauguuagaaacau

SEQ ID NO: 278279 - RNA, 62 nt, Human
agccugacugugugcaugugugugugugauagguuauuuauaaagacuuuggauagaaggag

SEQ ID NO: 278280 - RNA, 62 nt, Human
uguugucucugcucuucccucuccuggcugugguuauuuauuauuagugguguggcacuggg

SEQ ID NO: 278281 - RNA, 62 nt, Human
uaaguaauuuauguauuuauuaguauauuacuguuauuuaacguuugucugccaggauguau

SEQ ID NO: 278282 - RNA, 62 nt, Human
aacgaaugcaaauuccacucagcagaggcaauguuauuuauguacauagggauaguggaaug

SEQ ID NO: 278283 - RNA, 62 nt, Human
uucauuaaaagucucagcaguggguuucuuggguuauuuaaaacaucaccuaaauaggccuu

SEQ ID NO: 278284 - RNA, 62 nt, Human
acagucuguacaccuuuauuauuaguuuuugaguuauuuauguaccagauauuauacuuuua

SEQ ID NO: 278285 - RNA, 62 nt, Human
uuaagagccuucaauuguagaugaacaucucuguuauuuaucccucauucauccauccguuc

SEQ ID NO: 278286 - RNA, 62 nt, Human
cuggaaauuuuacaggggaagaaaacacgcuaguuauuuaacugcaagcuacuaaaagcaua

SEQ ID NO: 278287 - RNA, 62 nt, Human
agaaaagcuauaaaaugaauacaauuaaagcuguuauuuaauuagccagugaaaaacuauua

SEQ ID NO: 278288 - RNA, 62 nt, Human
cuagcaagacuggcaguuuucuguaaaggaggguuauuuacuacgguagugcaaauaacuuu

SEQ ID NO: 278289 - RNA, 64 nt, Human
acuccuacaaaugagaauucuugcacaaacagcagacuggcaugcucaaaguuacugacaaaaa

SEQ ID NO: 278290 - RNA, 55 nt, Human
acuucgaugaugaugugugaucugggacuggcagguuauuaaucgagauacacuu

SEQ ID NO: 278291 - RNA, 64 nt, Human
cuguggagaagcacuccaggccgcuagcagaugggacuggcauuccagagggucaagaagugac

SEQ ID NO: 278292 - RNA, 64 nt, Human
cugcaguuugccacccugagaacaccuucuccaggacuggcauuucagaaucagauucuucauu

SEQ ID NO: 278293 - RNA, 62 nt, Human
auaaucauauccuuucuucccacccuucuccuguuauuuaggauuucugacaaagcuggcuu

SEQ ID NO: 278294 - RNA, 62 nt, Human
aguuaugcuguuacuagugauuuuagggcuuuguuauuuaacuuauuucaagggugcugugc

SEQ ID NO: 278295 - RNA, 62 nt, Human
gguguggcaauggacugaacuguaaugaaaauguuauuuaaucuuugucucuguauuuugau

SEQ ID NO: 278296 - RNA, 62 nt, Human
uucauguauaacauagggacaguucugcugcuguuauuuauaugcaauucuucugguaaaua

SEQ ID NO: 278297 - RNA, 62 nt, Human
uugcuucuuguuuacuuuuuuaagggcuuuaaguuauuuauguauuuaauaugcccugagau

SEQ ID NO: 278298 - RNA, 62 nt, Human
cuugucauauuaucuuuguguauaugcuucauguuauuuaaccagaaaugucuuaucucuaa

SEQ ID NO: 278299 - RNA, 62 nt, Human
aaaggaagaacaggggccucuggaggcccuugguuauuuaaaucuuggauuauuugugauag

SEQ ID NO: 278300 - RNA, 62 nt, Human
uggccccucaagcaccguuaauuuacauuccaguuauuuacaugauaauucaugacauucug

SEQ ID NO: 278301 - RNA, 62 nt, Human
aacuaucuuauguuuacauacugguuuacaauguuauuuaugugcaaauugucaaaauguaa

SEQ ID NO: 278302 - RNA, 62 nt, Human
ucauuugcaacuucauuuuguuuuuuauaaauguuauuuauacagaaaguggcuauugacuu

SEQ ID NO: 278303 - RNA, 62 nt, Human
auauuccuacaauaaaguaagcuagagaaaauguuauuuagaaaaucauaagaaagagaaaa

SEQ ID NO: 278304 - RNA, 62 nt, Human
ucaaucaagcuuacuuacacacauucuacagaguuauuuaaggcauacauuauaaucuccca

SEQ ID NO: 278305 - RNA, 62 nt, Human
uuagcuggguaaacuaucuuuguaacagauaaguuauuuauaaaaauuaaaaaacuuauauu

SEQ ID NO: 278306 - RNA, 64 nt, Human
cugugucaccguaucucaggaaguccagccacuugacuggcacacaccccuccggacauccagc

SEQ ID NO: 278307 - RNA, 56 nt, Human
ccauggccaucaaaagcuaaccuguugacuggcauccauaagugugccucugccuu

SEQ ID NO: 278308 - RNA, 64 nt, Human
agagcaugaggaaccaguugacaugcuggguugugacuggcagcuuuagcagccucgguacuga

SEQ ID NO: 278309 - RNA, 64 nt, Human
ugcacacacacucacgcaugagcaaacguguacagacuggcacaugccuccacaugcgaacacc

SEQ ID NO: 278310 - RNA, 62 nt, Human
uaguucguguuaucaaucugaucugcagccagguuauuuacuucugaagcauuggaguuauc

SEQ ID NO: 278311 - RNA, 62 nt, Human
cauuuauuuuauuagccacccuaaaugcgucaguuauuuagggauggucuuuuguucauuuc

SEQ ID NO: 278312 - RNA, 62 nt, Human
caaucugcuguacaaucugaggacuuggcucuguuauuuacaaaaugaugcugugguucuga

SEQ ID NO: 278313 - RNA, 62 nt, Human
guuagcaaauaauugucuguauuaaacauggcguuauuuaaguaguccugcugcaagaaagg

SEQ ID NO: 278314 - RNA, 62 nt, Human
acguguggggucugcguuucuaaauaaagacgguuauuuaauggacuuaccuccugcccaag

SEQ ID NO: 278315 - RNA, 62 nt, Human
agauuguuuuauauucauuccauuuugaugguguuauuuaaauugauucucuguuauaagag

SEQ ID NO: 278316 - RNA, 62 nt, Human
uuaccucagauaccuguugucacucuucacagguuauuuaaguuuuugaagcugggaggaaa

SEQ ID NO: 278317 - RNA, 62 nt, Human
gggcccauauuuaacacauuuugugauuuuggguuauuuauuuugugcaucuguggcaauaa

SEQ ID NO: 278318 - RNA, 62 nt, Human
uucccuaguuuaauuagucccuguuauaaccaguuauuuaucuuuuuuuguagauucucggu

SEQ ID NO: 278319 - RNA, 62 nt, Human
caggggugcaauuuaaggcuaugugauagaggguuauuuacucagugugugcagauauuuau

SEQ ID NO: 278320 - RNA, 62 nt, Human
caugagacaauuuugcuucacuuugccuucugguuauuuaugguuucugucugaauuauucu

SEQ ID NO: 278321 - RNA, 62 nt, Human
accauuuugaaaugcugggcaaacuacaugaaguuauuuauaauuaauucacagcuaaucag

SEQ ID NO: 278322 - RNA, 62 nt, Human
auggagaagacuucuuugcaacaauaauaaauguuauuuaagaaugacaggcuuuuacuucc

SEQ ID NO: 278323 - RNA, 64 nt, Human
caagagcuguuuuugcauccauuugcaucgugaagacuggcauuuugauacuucagcuguuugu

SEQ ID NO: 278324 - RNA, 64 nt, Human
uuugcugugaugaaaauccuggauggcugaccaagacuggcacuuguuccagccauuagugagu

SEQ ID NO: 278325 - RNA, 64 nt, Human
uuuauaaagauaaaugggccaaaguguacauugagacuggcagccaucuaugguaccacugaaa

SEQ ID NO: 278326 - RNA, 64 nt, Human
ugguccauacgggcucccaacugcuggaaguacagacuggcacagcaacaucaggguugugaca

SEQ ID NO: 278327 - RNA, 62 nt, Human
auuuuuccguaaaaaugauuucaguagcacaaguuauuuaaaucuguuuuucuaacuggggg

SEQ ID NO: 278328 - RNA, 62 nt, Human
auagauuauuaucuauuaucucaauuuaguuuguuauuuauccuagugggccauuaaaaacu

SEQ ID NO: 278329 - RNA, 58 nt, Human
uuauuucccaaaaaguuuaaguugauuuguuauuuauagacuuucguaucuuagaaaa

SEQ ID NO: 278330 - RNA, 62 nt, Human
gucacuugugugcuaugugaauagcuauguuuguuauuuaaauauauuuauagaaguucaaa

SEQ ID NO: 278331 - RNA, 53 nt, Human
ccaacauggaagaauucugaaaaguuauuuauaacagagaccucuagugcugc

SEQ ID NO: 278332 - RNA, 62 nt, Human
gggaaaugauggagaagggagaauuguggaugguuauuuauagcucaugauucauccaagga

SEQ ID NO: 278333 - RNA, 62 nt, Human
auaggagauccaaaacuaaaauuguuagguaaguuauuuauauauaacuuuaaaagaaguag

SEQ ID NO: 278334 - RNA, 62 nt, Human
aagcuuuauaacauuuugugaguaagacaaauguuauuuaaaauucuuguugucaguccagc

SEQ ID NO: 278335 - RNA, 62 nt, Human
cuuuaaaaauauuuucaucucugaaauaucucguuauuuauuggagguauuguuuaaccuua

SEQ ID NO: 278336 - RNA, 62 nt, Human
ugccaaaauugcacuauuauaggacuuguauuguuauuuaaauuacuggauucuaaggaauu

SEQ ID NO: 278337 - RNA, 62 nt, Human
cuauaucaauuguguuuaaaccuuucaagaagguuauuuagcuagcuuaguguugaacuaaa

SEQ ID NO: 278338 - RNA, 62 nt, Human
aagcugccugccgugcucacccuguguguuagguuauuuauuuauuaaaaucaagaauccug

SEQ ID NO: 278339 - RNA, 62 nt, Human
cuucuuuauauaaaggcuaauaaggaaggaguguuauuuauggcuuugccaagcuacaucaa

SEQ ID NO: 278340 - RNA, 64 nt, Human
aaaguggacacuggcuccgcccuggccaccuggggacuggcacuguggugcacaguggcccaau

SEQ ID NO: 278341 - RNA, 64 nt, Human
ggcuggggggcccacuccaggcaggguggcguuagacuggcaucaggcuggcacuaggcucagc

SEQ ID NO: 278342 - RNA, 64 nt, Human
acugggcacugagacgaagcucccugacagccgagacuggcagcccuccaucugguccguaccc

SEQ ID NO: 278343 - RNA, 64 nt, Human
guugaagucucguccuggucucugcccuggcauggacuggcacagagguguucuguaguugaau

SEQ ID NO: 278344 - RNA, 62 nt, Human
caccucuuaguuuaaucugaaaucuugacccaguuauuuaacaaauaaauaccucauugauu

SEQ ID NO: 278345 - RNA, 62 nt, Human
aguuggacaauauugcauuuucaaaauggagaguuauuuaaaguggauguguagccuucugg

SEQ ID NO: 278346 - RNA, 62 nt, Human
cuugaaauuuugggguccauagugaauauuuuguuauuuauuuguuuggcucauucuuuaua

SEQ ID NO: 278347 - RNA, 62 nt, Human
augguuuacauuuggacaaaguauugcuuaguguuauuuaaguagauuuaagaucucaaagc

SEQ ID NO: 278348 - RNA, 62 nt, Human
cuuccaaacaaaagcacuuacuuuuuuuggaaguuauuuauuuuagacucaaagaauauaau

SEQ ID NO: 278349 - RNA, 62 nt, Human
aaauguauuuucuacuugaaccacauaacacuguuauuuaaaacaguuuucugcagucuaua

SEQ ID NO: 278350 - RNA, 62 nt, Human
uucuguccugggcuuauauuacacauauaacuguuauuuaaauacuuaaccacuaauuuuga

SEQ ID NO: 278351 - RNA, 62 nt, Human
gcauuguauaaaaaaaccuaaaagcaguaucuguuauuuagcuguaaaccaaguuggaagcu

SEQ ID NO: 278352 - RNA, 62 nt, Human
auauuugugcuuugaaaaaaaguuucuauuuaguuauuuaagaagaaugagaaggccaauag

SEQ ID NO: 278353 - RNA, 62 nt, Human
caagaugguucacaguuucuuuuuuuaacuagguuauuuauaauguauuucugaaccacuug

SEQ ID NO: 278354 - RNA, 62 nt, Human
cugauaugggguguguuuaugaacuuguuaauguuauuuaaucaugcagauuuccaaucagu

SEQ ID NO: 278355 - RNA, 62 nt, Human
cagcgcggccucaaccagggcaggaaagagugguuauuuauguacuuaaaguuucauuaaag

SEQ ID NO: 278356 - RNA, 62 nt, Human
uguuuuuuguuuuuguuuuuguuuuuugccauguuauuuauaguguugcuuuccuugugguu

SEQ ID NO: 278357 - RNA, 64 nt, Human
agccucagaggggcaggcauccccgcacagacuugacuggcagggcggucacgggaccugcggg

SEQ ID NO: 278358 - RNA, 64 nt, Human
cugugaaagaaaguuggucacugagugccuuggggacuggcaaaacauuccagaaugaagagag

SEQ ID NO: 278359 - RNA, 64 nt, Human
caaggaugaauuggcugugaaggauccucccugagacuggcaagggaggaggcugagcagaagg

SEQ ID NO: 278360 - RNA, 64 nt, Human
uaaccagcuccugauggccugagccaggcaucuugacuggcaccuggagagcccuuaagucugu

SEQ ID NO: 278361 - RNA, 62 nt, Human
aaaacccacacacacuccuuggaauggguccuguuauuuaugcuugcugcacagacauauua

SEQ ID NO: 278362 - RNA, 62 nt, Human
cuaucuucuacacaaggcguguccuuggguaaguuauuuaacuucaauuuaccuuaccugua

SEQ ID NO: 278363 - RNA, 62 nt, Human
uuuagcauuacguaucuguguguuacugcuguguuauuuacacuguuuuguauuguacaaua

SEQ ID NO: 278364 - RNA, 62 nt, Human
ugagaggauaaacaauauuaguuaacauuucuguuauuuaugaugccaauuaguaguaagau

SEQ ID NO: 278365 - RNA, 62 nt, Human
cuagaucuuuagagaaguugccauugagcaaaguuauuuaaaugaguuaguugaguuggaug

SEQ ID NO: 278366 - RNA, 62 nt, Human
cuaguauggccuacaugccacuuacguuuuaaguuauuuaggaacacaaaggacagacaaaa

SEQ ID NO: 278367 - RNA, 62 nt, Human
uaugucauuuauucuuccuauacuuguaaaagguuauuuaucuuuaaaauuuagcaauuuga

SEQ ID NO: 278368 - RNA, 62 nt, Human
uguauaugauuauggccuacaauguuguauuuguuauuuauuaaauugugauuguuuuauua

SEQ ID NO: 278369 - RNA, 62 nt, Human
ggccuaaacugagaauuaaucuaaaagucaguguuauuuaaacauuuucaaugugcaugcau

SEQ ID NO: 278370 - RNA, 62 nt, Human
aaaagugccuuguuucauuuuuauaggaugaaguuauuuauuuucuauuuucacuguuuugc

SEQ ID NO: 278371 - RNA, 62 nt, Human
ucauuuuuucaaaugucuggccauuuagcaaaguuauuuacuauuuacuguguacauagaaa

SEQ ID NO: 278372 - RNA, 62 nt, Human
ggcaggaugcaguuuuaaauuuuaugccaucaguuauuuauucuuguuuauucaaaugacug

SEQ ID NO: 278373 - RNA, 62 nt, Human
gaauucauuuaaguucuaagcauuugauuuauguuauuuauacaguugggaucuaauuagga

SEQ ID NO: 278374 - RNA, 64 nt, Human
aaucacaacuugugccucccaucccuggaguacugacuggcaccgguaagacagaaucucuuug

SEQ ID NO: 278375 - RNA, 64 nt, Human
aggacuaaaaucucugaauuuuaaagacacagaugacuggcauauuuuggauaccaguauagcu

SEQ ID NO: 278376 - RNA, 64 nt, Human
aacauuagagagggcuaaacaagggcagugagaagacuggcaggcagcagaaaucauuuucuuu

SEQ ID NO: 278377 - RNA, 64 nt, Human
agacccagcggacacacgcgguuugguuugcagcgacuggcauacuauguggaugugacagugg

SEQ ID NO: 278378 - RNA, 62 nt, Human
cccauaaaauugcucugcccuugacagguucuguuauuuauugacuuuugccaaggcuuggu

SEQ ID NO: 278379 - RNA, 62 nt, Human
aacauuuuauccuuucuuuuuauauucauaauguuauuuaagugucauugauguacuguauu

SEQ ID NO: 278380 - RNA, 62 nt, Human
caaagaaugugaggaagaaaugggacucuuugguuauuuauugaugcgacuguaaauuggua

SEQ ID NO: 278381 - RNA, 62 nt, Human
cuuaugauaaaucuuuaaguauuggugugaauguuauuuaaauucuauauuuuucuuauuua

SEQ ID NO: 278382 - RNA, 62 nt, Human
auuaaaauuuuuaaaaauuacaaauauacaaaguuauuuaucuuagcacauuuauuaugugu

SEQ ID NO: 278383 - RNA, 62 nt, Human
ccuauuuuauaaugaaguguugaauagcucauguuauuuacugaauacuguugugaaaguga

SEQ ID NO: 278384 - RNA, 62 nt, Human
acuuguuaagaucagcuggcuuucuuguuaaaguuauuuaaguuuugaaugcucuacuacuu

SEQ ID NO: 278385 - RNA, 62 nt, Human
ugguaccugugugagugaguauguaaauuaaaguuauuuaaaugguuggaauauguggcucc

SEQ ID NO: 278386 - RNA, 62 nt, Human
guuuuuucuguggaaucuccuucauuggcauuguuauuuaaucauaaacggggcagaugucu

SEQ ID NO: 278387 - RNA, 62 nt, Human
aacugaauacuuauaaacuguuguuccuggaaguuauuuauuccauaaaaaauuuguucuuu

SEQ ID NO: 278388 - RNA, 62 nt, Human
uauuugucaguuugguugggcuauagcacacaguuauuuaaucaaacaguaaucuaggugug

SEQ ID NO: 278389 - RNA, 62 nt, Human
ggacuguuaggaugaauggacgccuucuccccguuauuuaagauuugugaccuuguacauaa

SEQ ID NO: 278390 - RNA, 62 nt, Human
uguuugucgaagauguugguuucccuuucucuguuauuuauauaaaaauaauuuaucaaaag

SEQ ID NO: 278391 - RNA, 64 nt, Human
aggcuuugguacccccaaacccccaauauuuuuggacuggcagacucaaggggcuggaaucuca

SEQ ID NO: 278392 - RNA, 64 nt, Human
ggccagcggugccggcugugggaccuuccuggcugacuggcagaggaagauugcagugacagcu

SEQ ID NO: 278393 - RNA, 64 nt, Human
uagcagcugugaugucauuucuguauuucaggaagacuggcaggagauuuauggaaaggucucu

SEQ ID NO: 278394 - RNA, 64 nt, Human
ucucuccccguaagugaugcuggaaaagucauaggacuggcaaagcaacuguuuaaacccuuug

SEQ ID NO: 278395 - RNA, 62 nt, Human
gcuguacauaccgugugcaaaguguauaugaaguuauuuauucgugacccaugagcccguga

SEQ ID NO: 278396 - RNA, 62 nt, Human
ucagcuuuccauuugguuaaauauuguauuuuguuauuuauuaaauuauuuucaaacaaaac

SEQ ID NO: 278397 - RNA, 62 nt, Human
gacuuagguucaggggcaucagucccuaagauguuauuuauuuuuacucauuuauuuauucu

SEQ ID NO: 278398 - RNA, 62 nt, Human
guguacuuuuacauuguguuauaucaaaauauguuauuuauauuuagucaauauauuauuuu

SEQ ID NO: 278399 - RNA, 62 nt, Human
uuuuaauuaugcugcaauguauaaucugguguguuauuuaaacagcacuaguacuguacacu

SEQ ID NO: 278400 - RNA, 62 nt, Human
aaaaacugcuuauaagugcuuaauaaauacuaguuauuuacaacuuuugcucaagccgaggg

SEQ ID NO: 278401 - RNA, 62 nt, Human
uuacuuuugcccucucccauuuucuguuuugaguuauuuaucuuguaaagucuguuuuccuu

SEQ ID NO: 278402 - RNA, 62 nt, Human
uuuucuaccauaagugacaccaauaaauguuuguuauuuacacuggucuaauguuugugaga

SEQ ID NO: 278403 - RNA, 62 nt, Human
uggcaaguggggcugguuuuucauuuccauugguuauuuaaaguuuccuuuaaaauaaacga

SEQ ID NO: 278404 - RNA, 62 nt, Human
cugacuccuuaaauuucuggaugaugaugauuguuauuuaauagccagaggcucauauaauu

SEQ ID NO: 278405 - RNA, 62 nt, Human
cuucacauuuuaagaaaacuuuaucuuauggaguuauuuaagccaucuacagagcugaggaa

SEQ ID NO: 278406 - RNA, 62 nt, Human
acagauacuauaauauuuccuuuuauuuuaguguuauuuagcuuuauuacagauuucuauuu

SEQ ID NO: 278407 - RNA, 62 nt, Human
uauuguauauuguagauuuuuuucauucauguguuauuuaauuuacacugaucucugcuauu

SEQ ID NO: 278408 - RNA, 64 nt, Human
uguuguuucuggacuuuuuaauaaucaccauucugacuggcaugagaugguaucucauuguggu

SEQ ID NO: 278409 - RNA, 64 nt, Human
uuguuuaagguauuaagcacgaauuauuacaugagacuggcagauagcuauuaauccucuuaca

SEQ ID NO: 278410 - RNA, 64 nt, Human
accagggugugcucaaaggcuggcccuggugguggacuggcaccugugcagagugccgugugcu

SEQ ID NO: 278411 - RNA, 64 nt, Human
gcccaccugugucccugacucaggguggucccaggacuggcaccuacucuuuagagagccccag

SEQ ID NO: 278412 - RNA, 62 nt, Human
uugucagcacuuccaacuucuuguuugacaguguuauuuauguuauuuauauuagcuaacag

SEQ ID NO: 278413 - RNA, 62 nt, Human
cuuccaacuucuuguuugacaguguuauuuauguuauuuauauuagcuaacaggaaacaacu

SEQ ID NO: 278414 - RNA, 62 nt, Human
uccauuucuaauguaugcauucauccaacagaguuauuuauuggcuggagauggaaaaucac

SEQ ID NO: 278415 - RNA, 62 nt, Human
auucuuuauucucaguaacuuuuaaaagggaaguuauuuauauuuuguguauaaugugcuuu

SEQ ID NO: 278416 - RNA, 62 nt, Human
uauuaguaaaagaugccauaggagaguuugggguuauuuaggucuuauugaaaugcagauug

SEQ ID NO: 278417 - RNA, 62 nt, Human
accugaaaacuguuggagaaauaauguuuaaaguuauuuaagaaaaacuguuacaucacuaa

SEQ ID NO: 278418 - RNA, 62 nt, Human
ucaacaaaggggauuuuguacacauaacauggguuauuuaguuuaacucuggcaaaaaaaaa

SEQ ID NO: 278419 - RNA, 62 nt, Human
cuuugaaaacugcaauguauguauguuucaagguuauuuaacaguguacuaugguuuuauau

SEQ ID NO: 278420 - RNA, 62 nt, Human
uaugucguuacuuugauaagcauuccacuuuuguuauuuauuagugcuaucuuuuuuuuuua

SEQ ID NO: 278421 - RNA, 62 nt, Human
acgcuccugaaguuaggucauuacuaaccauaguuauuuacuugaaagaugggucuccgcac

SEQ ID NO: 278422 - RNA, 62 nt, Human
ugagaagaucuguuauuacauuaguauauuacguuauuuauuaugauccuaguugauggccu

SEQ ID NO: 278423 - RNA, 62 nt, Human
aaucaagacaaaccauuugaauuuuaacauugguuauuuauuuguguaauggccuuacaugu

SEQ ID NO: 278424 - RNA, 62 nt, Human
gacggauuuuugcagauucaaaaucugcaaugguuauuuacaagucaaucuacugaauuccu

SEQ ID NO: 278425 - RNA, 64 nt, Human
ccccaagguucuccccuccccccgcugcccaggugacuggcaggagcugcgacugccacguagu

SEQ ID NO: 278426 - RNA, 64 nt, Human
gacucccugcuuagcucugugggagaccaacuacgacuggcaucuucucuucccccuggaaggc

SEQ ID NO: 278427 - RNA, 64 nt, Human
gaugccugccucagcucggcgccugccagggggugacuggcacagagcgggccguaggggaccc

SEQ ID NO: 278428 - RNA, 62 nt, Human
auggcacaugcacuacaagaggaaccuuuuggguuauuuaauauguacagaaaacauuagaa

SEQ ID NO: 278429 - RNA, 62 nt, Human
acaguucacuuuuuacagugcuauuuacugaaguuauuuauuaaauaugccuaaaauacuua

SEQ ID NO: 278430 - RNA, 62 nt, Human
cuucugcaaggcaguaauuccccuuaggccuuguuauuuauccugcaugguaucacuaaagg

SEQ ID NO: 278431 - RNA, 62 nt, Human
cuuuauauucuacaaaggagagagauguaaggguuauuuagauauguucccucacugaaaaa

SEQ ID NO: 278432 - RNA, 62 nt, Human
uuguuggugcuguugguauuauugccauaguuguuauuuaauugcuugauuaaacucaguca

SEQ ID NO: 278433 - RNA, 62 nt, Human
ucuuaagugcuuguucuucauguuuccuucuuguuauuuaugcuauucucuuuguggcucca

SEQ ID NO: 278434 - RNA, 62 nt, Human
guuacuuuaaaauugcuaugauuguauuguacguuauuuaaugucugauugaaacacaaauu

SEQ ID NO: 278435 - RNA, 62 nt, Human
agcacuguggggaagagaguguuuauaauuauguuauuuauugcuggaugcugagaaugguc

SEQ ID NO: 278436 - RNA, 62 nt, Human
agcugguggauccaauccuuucuucaucuguuguuauuuagaacucaccucucacacucugu

SEQ ID NO: 278437 - RNA, 62 nt, Human
uaauuucugaaugaaugagcacacuuuaaccaguuauuuacaguuaccuuuuuccuuuaacc

SEQ ID NO: 278438 - RNA, 62 nt, Human
cuugaaauuaaauuuuaucaggcuaccaacauguuauuuauuuauuuaauaaacacauuuau

SEQ ID NO: 278439 - RNA, 62 nt, Human
auugcuguggucaggccauuuuuaagggaagaguuauuuaauauaaauagucucugauuuua

SEQ ID NO: 278440 - RNA, 62 nt, Human
cgcuguccuuucuagagcacugccaccaguagguuauuuagcuugggaaaggugguguuucu

SEQ ID NO: 278441 - RNA, 64 nt, Human
ccuaggcacugagagcuggagaguuggugauaagcgagacgaacacauuuccugcccucauaca

SEQ ID NO: 278442 - RNA, 64 nt, Human
gaccacuaugcaacguaacuaccgcuccccucuccuccgccacccccgccguggggcuccggag

SEQ ID NO: 278443 - RNA, 64 nt, Human
ucagcagagauggcccucugggacccuauacggacuccgccacuugagagcaguccuaggcccg

SEQ ID NO: 278444 - RNA, 62 nt, Human
ccagcaggccaggccgcugggcugggaucaguguuauuuauuugccguuuuaauuuauggau

SEQ ID NO: 278445 - RNA, 55 nt, Human
acaggcuuguaaaggacugaacaugguuauuuauauauauagauaucuguauaua

SEQ ID NO: 278446 - RNA, 62 nt, Human
uauccuuuugaggcugaauccguuauuaacuuguuauuuagguuuuuacucccaguagcaag

SEQ ID NO: 278447 - RNA, 62 nt, Human
gauucuaaguuaguugcacuuacaugauuauuguuauuuaaaacuaagaauaaaggcugcau

SEQ ID NO: 278448 - RNA, 62 nt, Human
aucauguaaaggguacccagaccucacuuuuaguuauuuacaucaaugaguucuuucaggga

SEQ ID NO: 278449 - RNA, 62 nt, Human
agcuuuuguuuuguauuuguuuacuaugagucguuauuuaauuucucuugaaaauaauuucc

SEQ ID NO: 278450 - RNA, 62 nt, Human
agcccugacuuccacucuggcucagcaaccugguuauuuauguggggccgugcaggcauggg

SEQ ID NO: 278451 - RNA, 62 nt, Human
ugguccggagucugggaccuacuuuguuuuuuguuauuuaugaccuuguuuaaagaaaauaa

SEQ ID NO: 278452 - RNA, 62 nt, Human
uguaaauuuggaagugucaugggugucuguggguuauuuaaaagaaauuauaacaauuuugc

SEQ ID NO: 278453 - RNA, 62 nt, Human
auggcagucauucaguauguguacuuguacaaguuauuuaacccauuggagccuaaauuccc

SEQ ID NO: 278454 - RNA, 62 nt, Human
uuuuacuuuaggacuccagaauuccacuucuaguuauuuauucaagagaaggaaaaacaaug

SEQ ID NO: 278455 - RNA, 62 nt, Human
gaguuccagaauaaaagauaugacuuuucugaguuauuuauguacuuaaaauauguugucac

SEQ ID NO: 278456 - RNA, 62 nt, Human
aaacugggaaauaaaaaccuggggaacuuuagguuauuuauacaaagggaauaaauaggcug

SEQ ID NO: 278457 - RNA, 64 nt, Human
ucucggugaucgcgcucuccaacauccuccacgccuccgccagccucccgcccgaguaccagaa

SEQ ID NO: 278458 - RNA, 64 nt, Human
ucuuggguacucgcaccucuuggcuuuguugaugcuccgccaggaaggccacuugugugugcgu

SEQ ID NO: 278459 - RNA, 64 nt, Human
agaauccagagcccagaggaagugcaagcggguccuccgccaacggggagagccucuucgcggc

SEQ ID NO: 278460 - RNA, 64 nt, Human
cgucagccgacacucagggauguagcuaacaccacuccgccagugcuuucaguaggaagagcug

SEQ ID NO: 278461 - RNA, 62 nt, Human
aguuauuuuuauuauugagucuguccagauaaguuauuuauaaugggcauuacugaauuuuu

SEQ ID NO: 278462 - RNA, 62 nt, Human
acugacuuaugagaaagcaaagcacugguacaguuauuuaacaggcauacacaagcagggaa

SEQ ID NO: 278463 - RNA, 62 nt, Human
uguaaucagcuccugccuuuuuauuuucuuggguuauuuacaugucagagacauuuauaaaa

SEQ ID NO: 278464 - RNA, 62 nt, Human
uuuaucccccagaauccuucaccuuucaaggaguuauuuaacaaugagcccagugacucaau

SEQ ID NO: 278465 - RNA, 62 nt, Human
guguacuaauaaagacugcagcaagcacuuguguuauuuaaauuauguaaguagauugucau

SEQ ID NO: 278466 - RNA, 62 nt, Human
augauuuuucaaaauaaaagucaaucagcauuguuauuuaucauuaagguauugaacacugg

SEQ ID NO: 278467 - RNA, 62 nt, Human
ucauucugugaaaagacuucuugcaguugugaguuauuuagaaaugaucaaaauuuguaauu

SEQ ID NO: 278468 - RNA, 62 nt, Human
cguuacucacuggagagauuggacuuucuggaguuauuuaaccacuauguucaguauuuuag

SEQ ID NO: 278469 - RNA, 62 nt, Human
aucuuuggggauguuuucaagaagggauauaaguuauuuacuuugggcauuuaaaagaaaau

SEQ ID NO: 278470 - RNA, 62 nt, Human
gguucuuuaccaaaugugcuugcuucuccuaaguuauuuauaaagagaaaucacuaauggac

SEQ ID NO: 278471 - RNA, 62 nt, Human
uguguuguauuaauauuuauuuauuuggagauguuauuuauuagaugauauuuauugcagaa

SEQ ID NO: 278472 - RNA, 62 nt, Human
gaggagugaggcccacaccagccuggaccuggguuauuuauugacacacccaaggggcccga

SEQ ID NO: 278473 - RNA, 62 nt, Human
gugccaggcggugcgggacgugccucccguguguuauuuaaucccuucaggagcccacaaga

SEQ ID NO: 278474 - RNA, 64 nt, Human
ggcaggggcugcugcccccgccuccuccugccgccuccgccagcccucccucccacacugcccc

SEQ ID NO: 278475 - RNA, 64 nt, Human
aaucccgauucacccuguccaaacugccuaagcccuccgccauucucaagcccugcagucacag

SEQ ID NO: 278476 - RNA, 64 nt, Human
acucccucugccacuauccccagggaaggaaaggcuccgccauuugggaaagugguuucuacgu

SEQ ID NO: 278477 - RNA, 62 nt, Human
auuuugugguguuaagugucuuuuuaaaaauuguuauuuaaauccugaagagcauuuggggu

SEQ ID NO: 278478 - RNA, 62 nt, Human
auuuaauuaccuuauuggauauuugauauuugguuauuuaaucacagucaucuuuaacagcu

SEQ ID NO: 278479 - RNA, 62 nt, Human
agggccagccuccagcgcugcucuuucuguagguuauuuauuaguauuggaugaaggcgaag

SEQ ID NO: 278480 - RNA, 62 nt, Human
uacuuucuagcauaucuuuaagaaaauugauuguuauuuacucccagauccucuugcagacc

SEQ ID NO: 278481 - RNA, 62 nt, Human
gacccacugguugaaaauguugacccuauccuguuauuuaaaugugaacauuuauuguacau

SEQ ID NO: 278482 - RNA, 62 nt, Human
aagugaauuugaagacucauuuaaaauauuguguuauuuauaaagucauuugaagaauauuc

SEQ ID NO: 278483 - RNA, 62 nt, Human
ucucauauacuaaauagacaaguuuacaugcuguuauuuagaaaaugacuaaaauauuaaaa

SEQ ID NO: 278484 - RNA, 62 nt, Human
aaagcaaguauauuuuugcuuuuacuucaaauguuauuuaaaguagaaauuuaauuuguaga

SEQ ID NO: 278485 - RNA, 62 nt, Human
cccuacugaagggaacagccugagccgaacauguuauuuaaccugaguauaguauuuaacga

SEQ ID NO: 278486 - RNA, 62 nt, Human
caaauauuguccugucccugucugggaguuguguuauuuaaagauauucuguauguuguauc

SEQ ID NO: 278487 - RNA, 62 nt, Human
ggguguuuuuuuuuaaaaggccauuuugggggguuauuuauuuuuuaagaaaaaaagcugca

SEQ ID NO: 278488 - RNA, 62 nt, Human
ccuuuuuaucuucucucaucccagcauacugaguuauuuauuaauuaguugauuuauuuuug

SEQ ID NO: 278489 - RNA, 62 nt, Human
uccugaaaagauuuucuuccauuucuaagacuguuauuuacaauaggaaaauuccuguuugg

SEQ ID NO: 278490 - RNA, 64 nt, Human
ggcgugcaguggugugaucucggcucacuucagccuccgccaccucaaggcaguucaagcaauu

SEQ ID NO: 278491 - RNA, 64 nt, Human
guuugagaaagcagccgcagcucaacucuuccagcuccgccaggguugggaaguccuuaggugc

SEQ ID NO: 278492 - RNA, 64 nt, Human
ggcaucgccgacccuauuauuccauuaccaggcacuccgccacccacaugccaacugacuugau

SEQ ID NO: 278493 - RNA, 62 nt, Human
gggggaaauuuuagauaauuuuuaaauucaaaguuauuuauaaaaugcuagaauuuguuuua

SEQ ID NO: 278494 - RNA, 62 nt, Human
auauucagugagaccagcuuaaaugaauaguuguuauuuaacauuaaaaucuaagaaugaac

SEQ ID NO: 278495 - RNA, 62 nt, Human
ccucaguguagauugcucuuaaaauguauucaguuauuuaguggcccccacaggaguggagu

SEQ ID NO: 278496 - RNA, 62 nt, Human
ucaaauguuuauuuuggcuuguggaucuugguguuauuuaaaaaauugaggugauggucauu

SEQ ID NO: 278497 - RNA, 62 nt, Human
uuccuaggucaagcuguguaaaagucauuuauguuauuuaaaugauguacuguacugcuguu

SEQ ID NO: 278498 - RNA, 62 nt, Human
cuggguuuaugucccuucacauaguuuuuaagguuauuuauuuaaaugucuaauguauuuua

SEQ ID NO: 278499 - RNA, 62 nt, Human
uuauaaugugcugaagguaccauauuuuaaauguuauuuaaugcaggugauuuauucaaaca

SEQ ID NO: 278500 - RNA, 62 nt, Human
auuauuaauaauauugccgcacccuaauaucuguuauuuaauugaaaucugcuugugugcuu

SEQ ID NO: 278501 - RNA, 62 nt, Human
uguggaauaauuuucagcugcucauauauuuaguuauuuaaacaaacuggggggagaagaac

SEQ ID NO: 278502 - RNA, 62 nt, Human
ucuuccguggauguuucaguuacaacuguaauguuauuuauagaacaacauuaauccauuaa

SEQ ID NO: 278503 - RNA, 62 nt, Human
ggaaaagagucacuggccauguuauaaauauuguuauuuaaaaaacaaaaaacaaaacacac

SEQ ID NO: 278504 - RNA, 62 nt, Human
auguuuuauaaaauaaaaauaaaauaucguuuguuauuuaucucauuagagaacugcuagug

SEQ ID NO: 278505 - RNA, 62 nt, Human
cuccuccccuguacgugccccagcauucugggguuauuuaacaauagcaauaguucuaguga

SEQ ID NO: 278506 - RNA, 64 nt, Human
gugugugccugcagacggcccgggagcugugugucuccgccagagucacagcagugccgaggug

SEQ ID NO: 278507 - RNA, 64 nt, Human
ccacuaggacuuuagcaggaagcccacauggaggcuccgccaggcuguggcccagcuggugaug

SEQ ID NO: 278508 - RNA, 64 nt, Human
gcaagaggugagagcugccagccugaggugcccacuccgccagccacaggaccaccuccucugc

SEQ ID NO: 278509 - RNA, 62 nt, Human
caaacaauugaaacauuuccuucuaaauauauguuauuuaauaguuacauguauuauaauca

SEQ ID NO: 278510 - RNA, 62 nt, Human
cuuuguagccauauauguaauugacuuugaauguuauuuaccugaaauuaaucuuccuucac

SEQ ID NO: 278511 - RNA, 62 nt, Human
aggaagccaccuucaguugugaauccuaugguguuauuuauuuuguuccugaaaugggauuu

SEQ ID NO: 278512 - RNA, 62 nt, Human
uuacuuauaaugcaaggaaucaggaaacuuuaguuauuuauaguauaaucaccauuaucugu

SEQ ID NO: 278513 - RNA, 62 nt, Human
ugaaucaaauacuucaucacuaaagaauucuuguuauuuaauaucaaauaaugaaacagcag

SEQ ID NO: 278514 - RNA, 62 nt, Human
aauuuuuaaaagguguuuguuuuuucauuuauguuauuuauuaaaauuuugauguuuacuua

SEQ ID NO: 278515 - RNA, 62 nt, Human
uuucuguucaggaaaucuuguaguuuauuguuguuauuuaacaguauuaaguggauuuuugu

SEQ ID NO: 278516 - RNA, 62 nt, Human
uuaaauaauuuuaugcuuauuuucugauacguguuauuuagguaaucaugcccuguacauuu

SEQ ID NO: 278517 - RNA, 62 nt, Human
gaauugggaugucuaaaccuauuuuuauagauguuauuuaaauaaugcagcaauaucaccuc

SEQ ID NO: 278518 - RNA, 62 nt, Human
aauugguggggaguucaauacuuuucaauuaaguuauuuaaaaauauucuucauugauggaa

SEQ ID NO: 278519 - RNA, 62 nt, Human
ucuucucaguguuuuacccuguuacauguucuguuauuuaauguuguuaucucaagcuccua

SEQ ID NO: 278520 - RNA, 62 nt, Human
agguaccccagcucugcuugccgaaacuggaaguuauuuauuuuuuaauaacccuugaaagu

SEQ ID NO: 278521 - RNA, 62 nt, Human
gguuccucgggggacagucucaguuucgugccguuauuuaaagaauucucuccauguuuuug

SEQ ID NO: 278522 - RNA, 64 nt, Human
ggccacgcagccgggccuucuucucucugggacccuccgccagcgcauagccgcaggccggugu

SEQ ID NO: 278523 - RNA, 64 nt, Human
ccccccgcgacccacccgcggaguggggggcccccuccgccacaaggaagcacaaccagcucgc

SEQ ID NO: 278524 - RNA, 64 nt, Human
ccagggcgcgggcgcggaccccgggccggugcugcuccgccaguuggugcccgcccuggggccg

SEQ ID NO: 278525 - RNA, 62 nt, Human
ugcagaacuauuuuuguacaaauuguuuaaaaguuauuuaugcaagguuugaaugcauacca

SEQ ID NO: 278526 - RNA, 62 nt, Human
gugcgccgcugccccagaaggcucuuaucaauguuauuuauuugauuguguggucgauguuu

SEQ ID NO: 278527 - RNA, 62 nt, Human
cuggguuagccaaacaaccuucaaaaagcauuguuauuuagguuaaauaucuguggacaaga

SEQ ID NO: 278528 - RNA, 62 nt, Human
agugggagauaccagaggugggaggagaaaaaguuauuuauuaccguucccuuccuccugcc

SEQ ID NO: 278529 - RNA, 62 nt, Human
aauuaagucauaauuuaagaugcuauguaucuguuauuuaaaacauggagaaacagggccuu

SEQ ID NO: 278530 - RNA, 62 nt, Human
ugauuccuaagccacuugaaauguuagucauuguuauuuauacaagauugaaaaucuugugu

SEQ ID NO: 278531 - RNA, 62 nt, Human
auugaaggagaccuaauaauugugucuuuuugguuauuuagugacaaacguggcuuucaaac

SEQ ID NO: 278532 - RNA, 62 nt, Human
guaugaaaacuugaacagcgaaagcagagcauguuauuuauauaacugcauuuaagcaguac

SEQ ID NO: 278533 - RNA, 62 nt, Human
auuuaugguuggaaaugcugauaauuuauuuuguuauuuaagagcuguuguuaaguggagga

SEQ ID NO: 278534 - RNA, 62 nt, Human
uguuccauuauuggaacacuaagcaugugggaguuauuuauauccuacugcucaaggucauc

SEQ ID NO: 278535 - RNA, 62 nt, Human
uugaacuuuuaauuauaaguguuauggcuaaaguuauuuacugaaaauuucaguaaaaugug

SEQ ID NO: 278536 - RNA, 62 nt, Human
guauucagaaauggaaaauuuacaucauauagguuauuuaacuuguguucagccuuuuugua

SEQ ID NO: 278537 - RNA, 62 nt, Human
uauuucuaacauuccauaaauauacuugaaauguuauuuaaauauauucaaagaaauuugaa

SEQ ID NO: 278538 - RNA, 64 nt, Human
cuucgcgcccgccccugcagcacggacaauaaaccuccgccaaugcacggccucgcgucugucu

SEQ ID NO: 278539 - RNA, 64 nt, Human
ugcgcaggggcuggcgcugcggcuaccucgagugcuccgccaaguacaacuggcacgugcugcg

SEQ ID NO: 278540 - RNA, 64 nt, Human
caguguacuugguaccaucccugggcucugcuggcgagacgaaacagcuguagagaugaaaaca

SEQ ID NO: 278541 - RNA, 62 nt, Human
agacagggaucuguguagaggaguaauuugcaguuauuuaacauaaaccugauuugcaguga

SEQ ID NO: 278542 - RNA, 62 nt, Human
aucuugacucugugguagauuucaaguucaauguuauuuaauuacauuugguuuuccguaaa

SEQ ID NO: 278543 - RNA, 62 nt, Human
aauuauccuuguuacugcuuugccaguucuacguuauuuacaauuauucagcucuugcaaua

SEQ ID NO: 278544 - RNA, 62 nt, Human
aaagaggaauauucugguuuauuuccuagacuguuauuuaaaaaaaaaaaaaacauuguguu

SEQ ID NO: 278545 - RNA, 62 nt, Human
uuaauuuuaaaaaauuguaauuauuuaaaacaguuauuuaauguauugaaugaguuuaaguu

SEQ ID NO: 278546 - RNA, 62 nt, Human
acugaggaagauggugaagauuuuuucuacuuguuauuuacuguaagaagccuggcaucucc

SEQ ID NO: 278547 - RNA, 62 nt, Human
acaaauguuuaaccacuuugcugcugacuugaguuauuuauccaaauauauuaacuauagac

SEQ ID NO: 278548 - RNA, 62 nt, Human
uguuuuguucuuuuuuuguuuuuuguuguuuuguuauuuacuuauauacauauaaaauuuua

SEQ ID NO: 278549 - RNA, 62 nt, Human
cauucuuguacuuuuugcauaauuuuguaagaguuauuuaucaaaauuaugugagguuccaa

SEQ ID NO: 278550 - RNA, 62 nt, Human
uaguacaaaauucugaaaacacauaagggcugguuauuuaccuccuuuuuuuuuuuuuuuuu

SEQ ID NO: 278551 - RNA, 62 nt, Human
cauccuccaggaacugcaggucaaguugucagguuauuuauuuuauaauguccauaugcuaa

SEQ ID NO: 278552 - RNA, 62 nt, Human
cagauucuuagauuuggaguagaccugaccuuguuauuuauuagauaacauuuugaauguau

SEQ ID NO: 278553 - RNA, 62 nt, Human
aagacaaaaaugaaauauauaacaacaaugaaguuauuuaacaagauuucuaaagcugaaau

SEQ ID NO: 278554 - RNA, 64 nt, Human
uagagaaucagacaggcgagaaguacgaggggagcgagacgaaaggagaacggugauuauucau

SEQ ID NO: 278555 - RNA, 64 nt, Human
gccccguggucuggugcgugacaauccaaagcgccgagacgagggugcugugucccucaaaccc

SEQ ID NO: 278556 - RNA, 62 nt, Human
ugauuauuuuguuucuucugcaauaucaagauguuauuuauuuugagaaaugcuuauuuuua

SEQ ID NO: 278557 - RNA, 62 nt, Human
gccugagucagucuccccaaugucuacauuguguuauuuauacuagcaaaaaaauagacaca

SEQ ID NO: 278558 - RNA, 62 nt, Human
gguauucugcucggcaauuuguaaguuuacauguuauuuaaggauaaagguaaaucauucaa

SEQ ID NO: 278559 - RNA, 62 nt, Human
cuaguuucaaaaccacccuguugaaaguuccaguuauuuauaugcccaacaaauuucauagc

SEQ ID NO: 278560 - RNA, 62 nt, Human
cucccucuccugcugcccacccaccugccaguguuauuuaugcucccuucgugggugauggc

SEQ ID NO: 278561 - RNA, 62 nt, Human
aaauaauuuguagcuuaauauuaaagauuuaaguuauuuauuguuucauuuuuuuucccaca

SEQ ID NO: 278562 - RNA, 62 nt, Human
cuuuccccuccagacauucuaguuuguggaggguuauuuaaaaaaacaaaaaaggaagaugg

SEQ ID NO: 278563 - RNA, 62 nt, Human
uguggaugaauucaggcacuggggguggggggguuauuuauaaacacaaggugguugguuua

SEQ ID NO: 278564 - RNA, 62 nt, Human
gcacacuuuuuggguguguaaaugacacaaaaguuauuuacauauuauauaugugaauaugu

SEQ ID NO: 278565 - RNA, 62 nt, Human
auauaugccuguuacaagagaaggaaauaugaguuauuuaaguuuaacuuuuuuaugugaau

SEQ ID NO: 278566 - RNA, 62 nt, Human
aaaccuaugaugauuuuguccuguguguaaauguuauuuauuuagcauagacauuaaagaua

SEQ ID NO: 278567 - RNA, 62 nt, Human
guggaaugugaauaguuaaaugaaaaguuaugguuauuuaauguaauuauuacuucaaaucc

SEQ ID NO: 278568 - RNA, 62 nt, Human
uucuaaacagacucauuacaaaugguuaccuuguuauuuaacccauuugucucuacuuuucc

SEQ ID NO: 278569 - RNA, 64 nt, Human
ccagcugcaugggcuccugcuuguguguucccuccuccgccauccucuguuccccgcaccuccc

SEQ ID NO: 278570 - RNA, 56 nt, Human
ugcaguccguggucaucuaggcccuacuccgccaccggaucugcucugaccgcacu

SEQ ID NO: 278571 - RNA, 64 nt, Human
cccgcacccuuaagaagguauuuuguaauauucucuccgccauugagaaugugcuuuguaagau

SEQ ID NO: 278572 - RNA, 62 nt, Human
uuguggaaucucucgagugcaaagacugucuaguuauuuaucaggcuauuucuacugaugaa

SEQ ID NO: 278573 - RNA, 62 nt, Human
ccuuccucuuauuuauuuggggacauuauuuuguuauuuagauaccaaggccuaauuaauua

SEQ ID NO: 278574 - RNA, 62 nt, Human
uauuuuaaguuguuuuugaacuuuauuguuuuguuauuuaaguuuauguuauuuauaaaaaa

SEQ ID NO: 278575 - RNA, 62 nt, Human
uugaacuuuauuguuuuguuauuuaaguuuauguuauuuauaaaaaaaaaaccuuaauaagc

SEQ ID NO: 278576 - RNA, 62 nt, Human
accccccaaaaaaggcguacagccaacucuuaguuauuuaggguaagagaaaaaagaaaacu

SEQ ID NO: 278577 - RNA, 62 nt, Human
auuuuauuauauuagguaguaaaaaauguaggguuauuuaccauaaccuguucauuaauauc

SEQ ID NO: 278578 - RNA, 62 nt, Human
gaaagcucucucgccuucguaauuauucuauuguuauuuaugagagaguaccgagagacacg

SEQ ID NO: 278579 - RNA, 62 nt, Human
agccuuugccgaacaaacaaacguaaguuauuguuauuuauugugagaacagccaguucaua

SEQ ID NO: 278580 - RNA, 62 nt, Human
gccaggacccucacagcucugaauuugcuucuguuauuuauggcuuuucgcugcuucuuggu

SEQ ID NO: 278581 - RNA, 62 nt, Human
cauggcguugaaaccacacaguucucauuacuguuauuuauuagcuguagcauucucugucu

SEQ ID NO: 278582 - RNA, 62 nt, Human
aaaaauaauacaaauaaaaauacaguauaacaguuauuuaaauagcauuuacauugcauuag

SEQ ID NO: 278583 - RNA, 62 nt, Human
uucuuucuaugccucuuuaauggagugguucuguuauuuaagccuguucuaaguuugaucaa

SEQ ID NO: 278584 - RNA, 62 nt, Human
acuucugcuagguauuacucucuacuccuaaaguuauuuacuauuuggcuucaaguauaaaa

SEQ ID NO: 278585 - RNA, 64 nt, Human
cugaagauugacuagcuacacuaaagaaaaugaacuccgccauccgaccuuccauccaguugcu

SEQ ID NO: 278586 - RNA, 64 nt, Human
ggcggcuccugccaacccucccugcuaaccccuucuccgccaggugggcuccagggcgggaggc

SEQ ID NO: 278587 - RNA, 64 nt, Human; identical to SEQ ID NO: 278459

SEQ ID NO: 278588 - RNA, 62 nt, Human
uuauacuuagaaauauuugaagaaaaaaaagcguuauuuauaguccaaagaaaccaaagacu

SEQ ID NO: 278589 - RNA, 62 nt, Human
cuauccaugauguuuuaaagucuccacuugcuguuauuuacaaacgacagugcauucagcag

SEQ ID NO: 278590 - RNA, 62 nt, Human
ggacacugacagccgcgugguacagaauaaacguuauuuauuuuuuuauuuaugauacugcu

SEQ ID NO: 278591 - RNA, 62 nt, Human
agccaggacaucuacccuugacuauuuuuuauguuauuuauuuauuaguuuguccauuugua

SEQ ID NO: 278592 - RNA, 62 nt, Human
cuuuaccaauuuugggaauaaaagguguuuugguuauuuaauauaauaagagcuguuaaacu

SEQ ID NO: 278593 - RNA, 62 nt, Human
aucaauauauuguacagccuaaguuaauaaauguuauuuauauaugcauucaaguuguacuu

SEQ ID NO: 278594 - RNA, 62 nt, Human
uaccauaguaccauuuauacaaauuagaaaauguuauuuaacagcugaauuaucuauacaua

SEQ ID NO: 278595 - RNA, 62 nt, Human
uagaauaaggguuuuugcauaauaagcagguuguuauuuagguuaacaauauuaauucaggu

SEQ ID NO: 278596 - RNA, 62 nt, Human
ucaugccauggccuguggauggagaaugugcaguuauuuauuaugcguauucaguuuguaaa

SEQ ID NO: 278597 - RNA, 62 nt, Human
aaaacccgauuuuuauucucauaaauuuugugguuauuuauacaagggcugugcuaugcuac

SEQ ID NO: 278598 - RNA, 62 nt, Human
ugaucauguuaccuuuaugauuaaaguaucauguuauuuagccaaugcaaaucuguuuuaaa

SEQ ID NO: 278599 - RNA, 62 nt, Human
gaguguuaagaauaauguuacuugguuaauguguuauuuauugaguauuguuugugcuaagc

SEQ ID NO: 278600 - RNA, 62 nt, Human
gccaaugaguuucaggaaugaaguagaagguaguuauuuaaaaauaaaaaacacaguccguc

SEQ ID NO: 278601 - RNA, 64 nt, Human
acacccaggggaaggcccugaggcggaggcugugcuccgccauggugucccgguaccuuccaua

SEQ ID NO: 278602 - RNA, 64 nt, Human
agggacagccugcacagugguccaggguccagcccuccgccagcccuguuccgccucacugggu

SEQ ID NO: 278603 - RNA, 64 nt, Human; identical to SEQ ID NO: 278475

SEQ ID NO: 278604 - RNA, 62 nt, Human
cagagggcacccccuauuuauguguauuuauuguuauuuauaugccucccccaacacuaccc

SEQ ID NO: 278605 - RNA, 62 nt, Human
cucaacgggacaugcaacauaaaaaugggaagguuauuuaaacaacaaaaaacaguaugauu

SEQ ID NO: 278606 - RNA, 62 nt, Human
ggucugaugaucacacacaaaauguaauuccgguuauuuaagucauuucugugauucuauca

SEQ ID NO: 278607 - RNA, 62 nt, Human
guuuccaucuguccugagcaagucauuccuuuguuauuuagcauuucgaacaucucggccau

SEQ ID NO: 278608 - RNA, 62 nt, Human
aaaauauacauuguaccugacccuuuaaucauguuauuuaugccaccaagguuguggaucuu

SEQ ID NO: 278609 - RNA, 62 nt, Human
auauuuaucuuaguuugcucugcuguaguucuguuauuuauacuugguguugcuugucaugg

SEQ ID NO: 278610 - RNA, 62 nt, Human
ucaucagacugaaacuugcucacagacuuccaguuauuuauuuggggucugaaggauaucaa

SEQ ID NO: 278611 - RNA, 62 nt, Human
ggaggcguguagcuucuuaucauuguaacuauguuauuuagaaauaaaacgggaggcagguu

SEQ ID NO: 278612 - RNA, 62 nt, Human
uacuugagagcaucaaauuuugucauuaaaauguuauuuaaauauaugcuuuuaaaagcuca

SEQ ID NO: 278613 - RNA, 62 nt, Human
cugcacccgcccuaccauggucucucucugcaguuauuuaaugccugugucagaucuacugu

SEQ ID NO: 278614 - RNA, 62 nt, Human
uuacauccuuaucaucaggaagacacaauguuguuauuuauuacuccuugagaucuagauac

SEQ ID NO: 278615 - RNA, 62 nt, Human
gucaccugugagaccaggucuaccuugggacuguuauuuaacugaaucaguuauuuccuuga

SEQ ID NO: 278616 - RNA, 62 nt, Human
augucauccaagacguagagcuugaaugugacguuauuuaaaaacaacaacaaagaaggcag

SEQ ID NO: 278617 - RNA, 64 nt, Human
ggagggagauggaucaaucaaacccggcgguccccuccgccaggcgagauggggugggguggag

SEQ ID NO: 278618 - RNA, 64 nt, Human
aggguauugagggcgcccuuagucauagucucgacuccgccauugccuucuccucggcguccuc

SEQ ID NO: 278619 - RNA, 64 nt, Human
ggagugcaguggcacgaucucagcucauugcagccuccgccaccuggguucaagcaauucuccu

SEQ ID NO: 278620 - RNA, 62 nt, Human
uuuucccccuuuaccuagcugugcccccucugguuauuuauuuccuuagugccaggagggca

SEQ ID NO: 278621 - RNA, 62 nt, Human
gcauuuauaaaaucugaaguaucauaaauaaaguuauuuauuuaauuauacuaccagucuuu

SEQ ID NO: 278622 - RNA, 62 nt, Human
guguauauuaucuuuguauuagaaccaaaaaaguuauuuauuuuggucccuaugauuuuauu

SEQ ID NO: 278623 - RNA, 62 nt, Human
ucuucuacaucagguaguggaggcucagacaaguuauuuagccauucaccuagagaguaagu

SEQ ID NO: 278624 - RNA, 62 nt, Human
caugggcagaggaccaggcuguaggaaaucuaguuauuuacaggaacuucaucauaauuugg

SEQ ID NO: 278625 - RNA, 62 nt, Human
guaaauagcauccccaaaccagccagccuucaguuauuuacaaauguuuguucuuuuuucag

SEQ ID NO: 278626 - RNA, 62 nt, Human
auaaguauguggcacuguuuuuauuuguuuauguuauuuaaauacacacccagacacacaca

SEQ ID NO: 278627 - RNA, 62 nt, Human
gccuuauaagguucguauugcuauguucuucuguuauuuauuucagcauggacuguucauuu

SEQ ID NO: 278628 - RNA, 62 nt, Human
gcccaucuagcguggcuccggccuccugagacguuauuuaaaacucagccuucuccuccucc

SEQ ID NO: 278629 - RNA, 62 nt, Human
ccgugugugugucccccuguaaauagccagcuguuauuuauacauauauaauauuauauaua

SEQ ID NO: 278630 - RNA, 62 nt, Human
gcaccacuguguauuuaacugccuuguguacaguuauuuaugccucuguauuuaaaaaacua

SEQ ID NO: 278631 - RNA, 62 nt, Human
ggaaucaaauuuauuucaagagacuacacaugguuauuuaaucuccgguacugaauagguuu

SEQ ID NO: 278632 - RNA, 62 nt, Human
caaauauauauauauacauauauauauauauaguuauuuaaaaaaggcaacugaaaguaauu

SEQ ID NO: 278633 - RNA, 64 nt, Human
cagcaggaaggggcccugcacgccgggacgccaccuccgccagccgccuccacccgccccacac

SEQ ID NO: 278634 - RNA, 64 nt, Human
caagagggggugcgaagggggcaugucacgacagcuccgccaccccccauugcccacccgcacu

SEQ ID NO: 278635 - RNA, 63 nt, Human
gcuggaauagcccuaccugagugcccuguuugacuccgccacuaucugccaugugaguugggc

SEQ ID NO: 278636 - RNA, 62 nt, Human
cuuuucagacucccagaauuggguguuccuggguuauuuacauagcugagcaguguccaggg

SEQ ID NO: 278637 - RNA, 62 nt, Human
augugcauagaugaaacuuuuuuuuaaaaaaaguuauuuaacaguaaucuauuuacuaauua

SEQ ID NO: 278638 - RNA, 62 nt, Human
aaugggggaaaaaaagaaaaguauuuuuuaugguuauuuagcugaaaaaccauuugguuccu

SEQ ID NO: 278639 - RNA, 62 nt, Human
acccguuucgugaagcugaagauacccaggcuguuauuuaaaaaaguaugucgauaacuuau

SEQ ID NO: 278640 - RNA, 62 nt, Human
ucagauacauauuuuagugucaaggcagauuaguuauuuagccaccaaaaaaaaguauugug

SEQ ID NO: 278641 - RNA, 62 nt, Human
gaguuaaguuacauauuuauuuucucacuuaaguuauuuaugcaaaaguuuuucuuguagag

SEQ ID NO: 278642 - RNA, 62 nt, Human
auuuucaggauaggcuuuguauacuuuuauugguuauuuagaauccagugguauguuugugg

SEQ ID NO: 278643 - RNA, 62 nt, Human
gguuuugauuugauuuuuuguaagccagucagguuauuuaaugaugagguaauaaucaaauu

SEQ ID NO: 278644 - RNA, 62 nt, Human
gcucuuuauauuguguguuaucugacaagauaguuauuuaagaaacaugggaauugcagaaa

SEQ ID NO: 278645 - RNA, 62 nt, Human
uucagagaaaauagaaaaaacaauguuagaagguuauuuaaaaugauacuuaaauaaagaaa

SEQ ID NO: 278646 - RNA, 62 nt, Human
ugucccuggacuggccaugaagugaggagaugguuauuuaaagagaauucccuauuuauuug

SEQ ID NO: 278647 - RNA, 62 nt, Human
ccccguggggcaauuuaaccuuuuucaugaaaguuauuuacaaugaaaaguuuuuaaaaaua

SEQ ID NO: 278648 - RNA, 62 nt, Human
aaaccuacaaaaguugguguaaauuuguauauguuauuuaccuucagaucuaaaugguaauc

SEQ ID NO: 278649 - RNA, 64 nt, Human
caccugagcccugccccacccugcugagaaaacacuccgccacgugaagagacagaggaggaug

SEQ ID NO: 278650 - RNA, 64 nt, Human; identical to SEQ ID NO: 278523

SEQ ID NO: 278651 - RNA, 64 nt, Human
ggaguccaguggugcaaucuuggcucacugcaaccuccgccacccagguuaaaaauucuccugc

SEQ ID NO: 278652 - RNA, 62 nt, Human
cuagaguuauauuuucuauuagauguaaauauguuauuuaagaaaaauaucuaaauauauau

SEQ ID NO: 278653 - RNA, 62 nt, Human
uguaugaaauggauuugauaaaguuuuugcuaguuauuuacuacauuuugggauuaauaagu

SEQ ID NO: 278654 - RNA, 62 nt, Human
aucuguuuaaugacuaguugauauuugugcauguuauuuaauaaagaguuauauuuuuauag

SEQ ID NO: 278655 - RNA, 62 nt, Human
guuucuuauauacauuuguguauuuuuaugguguuauuuauuccauggcuuagcuuccuuca

SEQ ID NO: 278656 - RNA, 62 nt, Human
cauuuuccaucauuuauuauuuauauuuuauuguuauuuauugguaaauuccuauaaauuug

SEQ ID NO: 278657 - RNA, 62 nt, Human
caaccacccuagagaacugccuuuguuaaauaguuauuuaaagacucauacauaucaaacca

SEQ ID NO: 278658 - RNA, 62 nt, Human
cagaaggaugaaggacaguuuuuuccuucuuaguuauuuauaguuaaaguugguacuaaaca

SEQ ID NO: 278659 - RNA, 62 nt, Human
caguuuauuuuuauaacauuaacuuuuacuuuguuauuuauuauuuuauauaauggugaguu

SEQ ID NO: 278660 - RNA, 62 nt, Human
uuuacauaaauagaauccaaaucguaugaacaguuauuuaaauaaacaaaauucuuuggguc

SEQ ID NO: 278661 - RNA, 62 nt, Human
uucuuuuuuccuguaaaauauugcaguuuauaguuauuuacaaauguaagcuuugguacaag

SEQ ID NO: 278662 - RNA, 62 nt, Human
uuauuggaauuuuaaacuuuuguucuugcuggguuauuuauuuugauuuuagcauuaaaugu

SEQ ID NO: 278663 - RNA, 62 nt, Human
uuaauuuuguauuuauggagcuauucuaacuuguuauuuaaaaggaaaaagguauuaaacuu

SEQ ID NO: 278664 - RNA, 62 nt, Human
cagaaauuuaugauugauguauuuuaucuauaguuauuuagacauguuuacaugcagcagau

SEQ ID NO: 278665 - RNA, 64 nt, Human
gaaaguccagggcccccccacccuccccaccacccuccgccaucagccugccugggccagccug

SEQ ID NO: 278666 - RNA, 64 nt, Human
ggaguuggcccccaggggaaagggcugugagcugcuccgccauuaaacucaccuccaccugagg

SEQ ID NO: 278667 - RNA, 62 nt, Human
uugagcagguucucagcugggcucugauaucccgugcggaguuggacaagugggcagcauaa

SEQ ID NO: 278668 - RNA, 62 nt, Human
ggaaagcaugcauugaaaaauuucuaaccacgguuauuuaagcauaaucugaaaacaucuag

SEQ ID NO: 278669 - RNA, 62 nt, Human
gagaauagacugaacauaugguuauauucacaguuauuuauuaacuuaaauguuauuccaac

SEQ ID NO: 278670 - RNA, 62 nt, Human
cucaaggauuguuuaccuaaaacagaacuaugguuauuuaucucagauuguaaguuuuauuu

SEQ ID NO: 278671 - RNA, 62 nt, Human
uauuuugugauauauaaguagugaacacacauguuauuuacuucaaaagacaggauugacaa

SEQ ID NO: 278672 - RNA, 62 nt, Human
ucuuccuauuuucagcuccauuuaaaccaggaguuauuuauaaagaccucuuccucucaugu

SEQ ID NO: 278673 - RNA, 62 nt, Human
caaccuccagauaccuccgauguggagaggguguuauuuagagaucaaggaaggaagucauc

SEQ ID NO: 278674 - RNA, 62 nt, Human
ugccauuuauuuuguaaaaauccuauuuaacaguuauuuaauaaaacaauauuuuuagaaac

SEQ ID NO: 278675 - RNA, 62 nt, Human
ugaauauuagcaguagguggcaaauuauuguuguuauuuaguuguuuauuuuugacuggcuu

SEQ ID NO: 278676 - RNA, 62 nt, Human
ggccuggugcccgaggccccccaucauccccuguuauuuauugccacagcagagucuaauuu

SEQ ID NO: 278677 - RNA, 62 nt, Human
cccucccgcuccccgaugguggcguggacaugguuauuuaucucugcuccuucuugccugga

SEQ ID NO: 278678 - RNA, 62 nt, Human
uugccugugcccaggucaucccaaacccuucuguuauuuauuagggcugugggaaggguuuu

SEQ ID NO: 278679 - RNA, 62 nt, Human
uccugcccaaacagcuguauuuauauaagucuguuauuuauuauuaauuuauuggggugacc

SEQ ID NO: 278680 - RNA, 62 nt, Human
aauucaguaggaauuccuucauagaauaacauguuauuuauugguauugacuucuuauuaga

SEQ ID NO: 278681 - RNA, 62 nt, Human
ugcggagggugaugaggaugucuggugacagccgugcggacaccacuccucucugcagcacu

SEQ ID NO: 278682 - RNA, 62 nt, Human
auugauuaaaugcaagauaguuuaucuaacuucgugcggaaucagcuucuauccuugacuua

SEQ ID NO: 278683 - RNA, 62 nt, Human
gccaggcacggaaggcgggacucugggagaagcgugcggaggaccguggcgucggcgucccg

SEQ ID NO: 278684 - RNA, 62 nt, Human
aagccaauuuuuguguauuguuacaguuucagguuauuuauauucgauguuuuguaaaacuc

SEQ ID NO: 278685 - RNA, 62 nt, Human
caucugucuggaggggagcucugucuguccguguuauuuauugcuacuuccugccuggucuc

SEQ ID NO: 278686 - RNA, 62 nt, Human
gccccccgggcacuggguggggcagggcacgaguuauuuaaaacaguuacacugcaggguuu

SEQ ID NO: 278687 - RNA, 62 nt, Human
gggaacuuuacuguugcaaguuguaaauaaugguuauuuauauccuauuuuuucucacccca

SEQ ID NO: 278688 - RNA, 62 nt, Human
cuccccaucuggcccugcuguugcuaguaccuguuauuuauuaccuggaggccuguccagca

SEQ ID NO: 278689 - RNA, 62 nt, Human
cugguuuuaucucuagugaaauaaagucaaaaguuauuuaauucccgucaccugucucagug

SEQ ID NO: 278690 - RNA, 62 nt, Human
uuggaaacacuaagaaaaucaaauuuuuaaaaguuauuuauggccugggaaacaauuugcau

SEQ ID NO: 278691 - RNA, 62 nt, Human
aaccguaaaaccuuguuguaaaugugagaaacguuauuuauguagagcauguaggaaaaccu

SEQ ID NO: 278692 - RNA, 62 nt, Human
aacugggagggaagggugagacggagccggaaguuauuuauugggaaccccugcagggcccu

SEQ ID NO: 278693 - RNA, 62 nt, Human
gggcucagccccuccaccccucccuucauccuguuauuuauucggaagguuucaaaucacga

SEQ ID NO: 278694 - RNA, 62 nt, Human
ccucuugguaccucacacucucugucccucgcguuauuuauucuacacugccacuucuguaa

SEQ ID NO: 278695 - RNA, 62 nt, Human
cuuuuuugagguguguuacuauacugcuguaaguuauuuauuauauaaaguauuguaaauag

SEQ ID NO: 278696 - RNA, 62 nt, Human
cuaggaaccgugggcaaagggggcuccccuggguuauuuauuuucccaauaauuuuguguga

SEQ ID NO: 278697 - RNA, 64 nt, Human
cuucaguaccaccccucucuccccaccuucccucucccggcaacaucucugggaaucaacagca

SEQ ID NO: 278698 - RNA, 64 nt, Human
ccagccugccccuccacuucucucccaagccaggucccggcauggguggguuaugcucaugcug

SEQ ID NO: 278699 - RNA, 64 nt, Human
cagcccagaccaguacccuuaccgaacccaggauucccggcagaagaaccccaugacugcagcc

SEQ ID NO: 278700 - RNA, 62 nt, Human
uaaaaugguaauaauaguacuuauauguauuaguuauuuauugcugcguaauaaauuaccac

SEQ ID NO: 278701 - RNA, 62 nt, Human
aauaggguggaaaccaaacugcuccaugccggguuauuuaaaagaaaggcagaguuuguggu

SEQ ID NO: 278702 - RNA, 62 nt, Human
gugcauacuuucccucauccaugcugugcuguguuauuuaauuuuuccuggcuaagaucaug

SEQ ID NO: 278703 - RNA, 62 nt, Human
cuuaacccugacuucuaagccaucaauuucauguuauuuauuauugcccuaugugggguggg

SEQ ID NO: 278704 - RNA, 62 nt, Human
guccacucuggaugagaauuggccaccugaugguuauuuauacguccagaagaacaucauuu

SEQ ID NO: 278705 - RNA, 62 nt, Human
cuccuguccccucccuccaacucugucucuaaguuauuuaaauuauggcuggggucggggag

SEQ ID NO: 278706 - RNA, 62 nt, Human
uagaucuuucuaucgcuaacuuaauucucuucguuauuuaucugacccucuaacuccauguc

SEQ ID NO: 278707 - RNA, 62 nt, Human
ugaaggaaaagaauagggaaaagcuuucagcaguuauuuagcccuuacucaaaaucagauaa

SEQ ID NO: 278708 - RNA, 62 nt, Human
aauucuggcucuggaaauguuuuuguuuuauaguuauuuacgauuucguuuguuuggauuca

SEQ ID NO: 278709 - RNA, 62 nt, Human
cauuugggauagucgucuuuaaaagacuugguguuauuuacaguguuuguuuugauaacauu

SEQ ID NO: 278710 - RNA, 62 nt, Human
uuaugauaucccugauccuaacugaagagacaguuauuuauagucauuuauuuuaaaaaaug

SEQ ID NO: 278711 - RNA, 62 nt, Human
agaugccuucagccagcaucccagacuccacaguuauuuaugaaugaugucgugauucuccc

SEQ ID NO: 278712 - RNA, 62 nt, Human
aauggcuagaguauaaaaauguucuuuuuaaaguuauuuauuaaguucuucauuggaaguuu

SEQ ID NO: 278713 - RNA, 64 nt, Human
uggggcauuccaggcagagaaggagcagaggcucucccggcaggagcuggggucucagggcuca

SEQ ID NO: 278714 - RNA, 64 nt, Human
ccggcuuguuuccuccccuuggcaggcuaagcucucccggcagcccgggcucuggggcggaagg

SEQ ID NO: 278715 - RNA, 56 nt, Human
guacgagguguguguccuaaacacacucccggcagcucugucuuuggaaaagguug

SEQ ID NO: 278716 - RNA, 64 nt, Human
cugggugcugccggucaccuugagcugugguggcucccggcacacgaguguccgggguucggcc

SEQ ID NO: 278717 - RNA, 62 nt, Human
cucuaaauguauauguugauuuaugaguaauuguuauuuauucuuuauuuauuuauauuaau

SEQ ID NO: 278718 - RNA, 62 nt, Human
ugcccuuguuuccugaaugaaaugcuucugggguuauuuaugaaaggagugauccuggggca

SEQ ID NO: 278719 - RNA, 62 nt, Human
ccagccccccuccuuuuuuuguuuuucuuuuaguuauuuacuuuguuuguauaauuugcuuu

SEQ ID NO: 278720 - RNA, 62 nt, Human
gccagguccacagcagucauuuuuaaaauaaaguuauuuaauagucuccauuuaauugguuu

SEQ ID NO: 278721 - RNA, 62 nt, Human
uuuaucaugaauucccuuuuaaucaacuguagguuauuuaaaauaaauuccuacaacuuaau

SEQ ID NO: 278722 - RNA, 62 nt, Human
auuauuuuucgucucaaugguauuguaacuaaguuauuuacuccuccugcuccucaccccug

SEQ ID NO: 278723 - RNA, 62 nt, Human
gguacacuuucaagacacuguaaccacaagauguuauuuauugagcuggcgccgggacuugg

SEQ ID NO: 278724 - RNA, 62 nt, Human
ccgcacaugcagauggggcucccgcccgugguguuauuuaaagaagaaacgucuauguguac

SEQ ID NO: 278725 - RNA, 62 nt, Human
aguacugggaaggaggacgguuguaagcaguuguuauuuagugauauuguggguaacgugag

SEQ ID NO: 278726 - RNA, 62 nt, Human
gggaggacaauuauugucugaagcuaaaauggguuauuuauaggacugauggaaaugauuuc

SEQ ID NO: 278727 - RNA, 62 nt, Human
gauucacuguuuucucugcuaauugagagagcguuauuuacauuauuuauuuguuuugacac

SEQ ID NO: 278728 - RNA, 62 nt, Human
aggcagaaucuacuuacagugguguaauuaaaguuauuuaaccaaaaauagguaugugucca

SEQ ID NO: 278729 - RNA, 62 nt, Human
caguuaaaacugugcauaucgaaauauauuuuguuauuuaagccugcguccccguaccgcgu

SEQ ID NO: 278730 - RNA, 64 nt, Human
caucuaggccacgugcgguggcucaugccuguaaucccggcacuuugggaggccugaguggaug

SEQ ID NO: 278731 - RNA, 64 nt, Human
ccggcggccuuccccugccacgcucgugccggccucccggcagccuccaccagcccggcuccug

SEQ ID NO: 278732 - RNA, 64 nt, Human
ugagggagccucgacuuccggcgccgccgcccucucccggcauccgcagagccagcugacgccc

SEQ ID NO: 278733 - RNA, 64 nt, Human
aaauaaagccgggcgugguggcucacgccuguaaucccggcacuuugggaggcugaggcaggcg

SEQ ID NO: 278734 - RNA, 62 nt, Human
uugaugcaaccaaguuauuuuuuauauauuuuguuauuuauucuuuuaauaauggaauuuuu

SEQ ID NO: 278735 - RNA, 62 nt, Human
augcccuucccccauccggcuggguccuuccaguuauuuauuuguguauuuauuuauuuauc

SEQ ID NO: 278736 - RNA, 62 nt, Human
augcacaguccuuaauuuguguauaauggaaaguuauuuacaauauaacacuguaaauaaga

SEQ ID NO: 278737 - RNA, 62 nt, Human
ucuauuuuguaaacucaaaauauuuguacauaguuauuuauuuauuggagauaaucuagaac

SEQ ID NO: 278738 - RNA, 62 nt, Human
aagguuuuuucugauugaagcuuuaauggagcguuauuuauuuaucgaggccucuuugguga

SEQ ID NO: 278739 - RNA, 62 nt, Human
cacacguuguauaaacauaaacuguaugugcaguuauuuaaauuuguuucugucaaauuaau

SEQ ID NO: 278740 - RNA, 62 nt, Human
aauuugugcaaugguuucuuaauuuuuuuacuguuauuuaaagauguuuuacauaauucaau

SEQ ID NO: 278741 - RNA, 62 nt, Human
uaaagaaaaaaauuacaaagcagggguuuagaguuauuuauauaaauguugagauuuugcac

SEQ ID NO: 278742 - RNA, 62 nt, Human
gcuggguuguccccccaaacauauuuuaauauguuauuuaaaaugauuuuacccaagccuaa

SEQ ID NO: 278743 - RNA, 62 nt, Human
uguguccugaaugugucucuguaaacauagcuguuauuuauuauugugauguugggaccuuu

SEQ ID NO: 278744 - RNA, 62 nt, Human
auauuaauaaauuacuaaacuaagaguaucagguuauuuauauauuugcaagcaaaggacag

SEQ ID NO: 278745 - RNA, 62 nt, Human
gggacuguuuuuaauacauagcaacagacuggguuauuuauuuaagauguguauugugucau

SEQ ID NO: 278746 - RNA, 62 nt, Human
auaugaaguuuaagagacauaaauggcauuuuguuauuuauuaagacaaacuccaauuguuc

SEQ ID NO: 278747 - RNA, 64 nt, Human
gcucugcuaucgcuugcaugcucgguguacagucucccggcaacuguuuuguuccaaucaacuu

SEQ ID NO: 278748 - RNA, 64 nt, Human
gcaaggcaggcaggucugagaggcgaaacgaaucucccggcagugcuuggaagugucugugggg

SEQ ID NO: 278749 - RNA, 64 nt, Human
accaaugucuaagucaugccuccuuccaccucccucccggcaugggaaagccaccucucccuca

SEQ ID NO: 278750 - RNA, 64 nt, Human
aaaguaggccgggcacggugguucacaccuguaaucccggcauuuugggaggccgagauaggug

SEQ ID NO: 278751 - RNA, 62 nt, Human
cuaaaaauauaguuccugauuuuuaaaauucaguuauuuauucccacuucaaaugacaaguu

SEQ ID NO: 278752 - RNA, 62 nt, Human
cuuugagaauuuacuuuauggagcguauguaaguuauuuauauacaaggaaaucuauuuuau

SEQ ID NO: 278753 - RNA, 62 nt, Human
aauaguauaggaugugaaaguuuugaauuacgguuauuuaaaaacuaacauuugcuauggcc

SEQ ID NO: 278754 - RNA, 62 nt, Human
uuugacacaugugugcuccaaaugaucuggugguuauuuaacguaccucuuaaaauucguug

SEQ ID NO: 278755 - RNA, 62 nt, Human
cugccaucaucacuuuuugaauuucuuuggggguuauuuaaugaaaaacaugcuauguuuug

SEQ ID NO: 278756 - RNA, 62 nt, Human
gaagcaucagacugguaucaauauuagacaauguuauuuauuagcccuaauuguguuugguu

SEQ ID NO: 278757 - RNA, 62 nt, Human
guaagggauauguuacaguaccccaccuguaaguuauuuauuagcccuaauuguguuugauu

SEQ ID NO: 278758 - RNA, 62 nt, Human
auuucguagcacuguuuacaguuuuccuccauguuauuuaugaauuuuauauuccgugaaug

SEQ ID NO: 278759 - RNA, 62 nt, Human
cuuaaaaaagauaagauuuuaaagagucccaaguuauuuaaguugaguguaauugucauuua

SEQ ID NO: 278760 - RNA, 62 nt, Human
ccuaaacaauaucaucuaggacuucuauuuaaguuauuuaaaauaaaucuuccuugagagcc

SEQ ID NO: 278761 - RNA, 62 nt, Human
uuccucuugcaaaugaacccuuaaaguacaguguuauuuaagaaucuuccagaggcagucaa

SEQ ID NO: 278762 - RNA, 62 nt, Human
guggugguuguagugugauggauccccuuuagguuauuuagggguauauguccccugcuuga

SEQ ID NO: 278763 - RNA, 62 nt, Human
guggugguuguagugugacagguccccuuuagguuauuuaagggugcauguccccugcuuga

SEQ ID NO: 278764 - RNA, 64 nt, Human
aaacuagccaagggcaagcuauuauucagcagugucccggcacuacuaaccccugcaacaagcc

SEQ ID NO: 278765 - RNA, 64 nt, Human
auccugcggacaguuguggugcccccccggcagcucccggcacugcccccgacgaacggaaacu

SEQ ID NO: 278766 - RNA, 64 nt, Human
cuggaguggacguuaauugucagccaccagacugucccggcaccuacagagaauguuucacagu

SEQ ID NO: 278767 - RNA, 64 nt, Human
acccgguaaccgaggcggcaaggaggccagguagucccggcaccucucacucugcagagaccag

SEQ ID NO: 278768 - RNA, 62 nt, Human
ccaaauccacauguaacucauuacugucuccuguuauuuaucucaguaguccccucuccuag

SEQ ID NO: 278769 - RNA, 62 nt, Human
uaggggcaucggcaggagagugugugggcaggguuauuuaauaugguauuugcuguauugcc

SEQ ID NO: 278770 - RNA, 62 nt, Human
ugauuuuuagugggcagaugggagaaggaaagguuauuuauucuauagaagagacugcggac

SEQ ID NO: 278771 - RNA, 62 nt, Human
auuauaugaaugccuauuugugucuagaaccaguuauuuaaccuguaaaaugucaauagcaa

SEQ ID NO: 278772 - RNA, 62 nt, Human
gaccuaaaauuugcccucccaucccguuuagaguuauuuaggcuuuguaacgauugggggau

SEQ ID NO: 278773 - RNA, 62 nt, Human
uugguguugcagccgcagagaaaugccccaguguuauuuauuccccagugacuccaggguga

SEQ ID NO: 278774 - RNA, 62 nt, Human
gcuaguuuaaacaaauguguauaggaaaggauguuauuuauauauucuuacaagaguguaag

SEQ ID NO: 278775 - RNA, 62 nt, Human
aauucacgaaaguacugcuccaccccaguugaguuauuuagaauuuuaucucaagugaaagc

SEQ ID NO: 278776 - RNA, 62 nt, Human
ugugaaaguggcaagcucuucauugcacugcaguuauuuaccagaaguuuaaaucuuuguua

SEQ ID NO: 278777 - RNA, 62 nt, Human
uaacuugcuuugcaagccuacucugaaaauaaguuauuuagucaaguuauucucaaagaugu

SEQ ID NO: 278778 - RNA, 62 nt, Human
ggguauuagcuguauuauccauuuuuuuuacuguuauuuaauugaaaccauagacuaagaau

SEQ ID NO: 278779 - RNA, 62 nt, Human
uuuuuugugguuguuguaaauguuuugguuugguuauuuauuuauuuaucuaucuauugauc

SEQ ID NO: 278780 - RNA, 62 nt, Human
cauuguuuccagagugaacuuguaauuaucuuguuauuuauuuuuugaauaauaaagaccuc

SEQ ID NO: 278781 - RNA, 64 nt, Human
cauuacccgcccucggggggucgggcugugggggucccggcaccuggcgugaguuucauguaug

SEQ ID NO: 278782 - RNA, 64 nt, Human
caaaggacuugaggggcagcugacaaucgcugugucccggcagauccgcagcucgaaaaagaac

SEQ ID NO: 278783 - RNA, 64 nt, Human
gguguugaagacaagcugcuugucaagaagcauuucccggcaagagaggggcaagucuggggcu

SEQ ID NO: 278784 - RNA, 64 nt, Human
cugccuuagagucaucucuaguuccccaccucaaucccggcauccagccuucagucccgcccac

SEQ ID NO: 278785 - RNA, 62 nt, Human
aaaguauugccaaacauuaauguugauuucuaguuauuuauucugggaauguauaguauuug

SEQ ID NO: 278786 - RNA, 62 nt, Human
gaaugacaguagucacacauauugcuguuuauguuauuuaggaguaagauucuugcuuuuga

SEQ ID NO: 278787 - RNA, 62 nt, Human
aagcaacucaaagauuaucuauacacaaaacgguuauuuauauagaagucacaaguagagaa

SEQ ID NO: 278788 - RNA, 62 nt, Human
uauuuuuaggauucaugaauaguuuuguaggaguuauuuagaacaggaaaagguaaauugga

SEQ ID NO: 278789 - RNA, 62 nt, Human
aauagaucaauugguauuuccuugugaacaguguuauuuauaaagaguucauuaucaauaau

SEQ ID NO: 278790 - RNA, 62 nt, Human
aucauuguucaguaucaugucaagagcacauuguuauuuauccauucauccauugauggaua

SEQ ID NO: 278791 - RNA, 62 nt, Human
agucugugaaaccuaaauagaauucuuaaaauguuauuuaccaacuaaguauucauguucaa

SEQ ID NO: 278792 - RNA, 62 nt, Human
gguacauuuuaauuauuuuuucucauaaauggguuauuuauagaaauuuuguuaacucuuga

SEQ ID NO: 278793 - RNA, 62 nt, Human
auacuugcuguguaaauguuucuggacuuuauguuauuuaauuuacugacugaaauccaauu

SEQ ID NO: 278794 - RNA, 62 nt, Human
ccgaaaauaauuccuugaucauaucugaagugguuauuuacucaaaucaauuucuccccugc

SEQ ID NO: 278795 - RNA, 62 nt, Human
uuuuuagcaauuuagagcaauucuauauuugaguuauuuaauacacuucuaauucuaguuua

SEQ ID NO: 278796 - RNA, 62 nt, Human
auuauauguauucuguauacucaguucauaagguuauuuagcacaaaguauagcagcuucac

SEQ ID NO: 278797 - RNA, 62 nt, Human
caauuacaguucccaaagacacaguuguucauguuauuuaaaguuuuauccaguauucuagg

SEQ ID NO: 278798 - RNA, 64 nt, Human
gucucuccuucucuagcugucaaacagccccaucucccggcauugagccccaucuucuggcauu

SEQ ID NO: 278799 - RNA, 64 nt, Human; identical to SEQ ID NO: 214073

SEQ ID NO: 278800 - RNA, 64 nt, Human; identical to SEQ ID NO: 214079

SEQ ID NO: 278801 - RNA, 64 nt, Human; identical to SEQ ID NO: 214083

SEQ ID NO: 278802 - RNA, 62 nt, Human
aaacagaggcuuaauuuuauuagaaguagccaguuauuuauuaaagcaugauguuaauaaaa

SEQ ID NO: 278803 - RNA, 62 nt, Human
cccagaaugaaggugucaguugggcaugaaguguuauuuaguguccauucuugauccuucug

SEQ ID NO: 278804 - RNA, 62 nt, Human
guuucugcuuccuuacacauagauauaauuauguuauuuagucauuaugaggggcacauucu

SEQ ID NO: 278805 - RNA, 62 nt, Human
ccugcuucuuacuuugugauguaugugcauuuguuauuuauuuuuuuuuccuuggucggacg

SEQ ID NO: 278806 - RNA, 62 nt, Human
gcuuacuauaugcuaagcacuauuuuuagcauguuauuuauauuagcucauucauuccucac

SEQ ID NO: 278807 - RNA, 62 nt, Human
uuaauauaaguaucuggugaaggaccaaaaccgugugauaagguugugugucgugugggagu

SEQ ID NO: 278808 - RNA, 62 nt, Human
ucugaagcguuuguguguguguugaucagguugugugauauuuuugcuugauagagaaucaa

SEQ ID NO: 278809 - RNA, 62 nt, Human
auauaguaaagcugguagccuugaaaaugucagugugauaucuauuauguagauaaauauau

SEQ ID NO: 278810 - RNA, 62 nt, Human
agauggacaaugaaauaucaguugguggauaugugugauagcugauuucaauauugaaguau

SEQ ID NO: 278811 - RNA, 62 nt, Human
cccccgguggaggggcaaauggcugaauccuugugugauauuuuuuucuucgcuuguuuauu

SEQ ID NO: 278812 - RNA, 62 nt, Human
aguucuggggugggaguuuugcucucugucaggugugauaaaauguugaacccuccccacca

SEQ ID NO: 278813 - RNA, 62 nt, Human
ggaaccuugugccggccaggcccaguuuccuugugugauacacuaauguauuugcuuuuuuu

SEQ ID NO: 278814 - RNA, 62 nt, Human
ugauuugacugggauguuuuaugagaauguaagugugauauuauacugucugccuugcugga

SEQ ID NO: 278815 - RNA, 64 nt, Human; identical to SEQ ID NO: 214092

SEQ ID NO: 278816 - RNA, 64 nt, Human; identical to SEQ ID NO: 214098

SEQ ID NO: 278817 - RNA, 64 nt, Human; identical to SEQ ID NO: 214101

SEQ ID NO: 278818 - RNA, 64 nt, Human; identical to SEQ ID NO: 214107

SEQ ID NO: 278819 - RNA, 62 nt, Human
gcugcaugagcuagaauuuguucuagucuucugugugauacucauacuugcuguccagaggg

SEQ ID NO: 278820 - RNA, 62 nt, Human
uccuacaugggcagcaguggacuaagugcugggugugauaaagaggaaugacuuaauuauga

SEQ ID NO: 278821 - RNA, 62 nt, Human
ucaaaauguuuaccaauguuuuaagaagcuuugugugauauucuuccaaauguaguuaccaa

SEQ ID NO: 278822 - RNA, 62 nt, Human
gggauggagucaguuguucaggguccccgugugugugauaagcagugcuggcuggcugucuu

SEQ ID NO: 278823 - RNA, 62 nt, Human
ugaaaacacacuuccagucuagaugaugcuuugugugauacauuaaguucuuauuuuggauu

SEQ ID NO: 278824 - RNA, 62 nt, Human
cggaaaccguccuguguacacaugggaguuuagugugauaaaggcaguauuucagacuggug

SEQ ID NO: 278825 - RNA, 62 nt, Human
gcagaauuucaugcaaaugaggagugccagcagugugauaauuuaaacauauuuaaacaaaa

SEQ ID NO: 278826 - RNA, 62 nt, Human
uuuuucucaggccugagggggaaccauuuuuggugugauaaauacccuaaacugccuuuuuu

SEQ ID NO: 278827 - RNA, 62 nt, Human
caaaugguuacccugcuucuuccuacaaugcugugugauaugggugaacccagccccugacc

SEQ ID NO: 278828 - RNA, 62 nt, Human
acauaggaugguaaugccagucccaggggagggugugauaguaaggaaggccacuguuaggu

SEQ ID NO: 278829 - RNA, 62 nt, Human
aguggucacagucaucuaaccaaagugaucuagugugauagaucgaaauuaacauauuuuug

SEQ ID NO: 278830 - RNA, 62 nt, Human
uggcugugcaaauaaauggggcugaggccccugugugauauugaaaggguuguugugucugg

SEQ ID NO: 278831 - RNA, 62 nt, Human
uuagagauuacagaauuuuuaaacagggagacgugugauauacucccucccuucccuacuau

SEQ ID NO: 278832 - RNA, 64 nt, Human; identical to SEQ ID NO: 214113

SEQ ID NO: 278833 - RNA, 64 nt, Human; identical to SEQ ID NO: 214117

SEQ ID NO: 278834 - RNA, 64 nt, Human; identical to SEQ ID NO: 214121

SEQ ID NO: 278835 - RNA, 64 nt, Human; identical to SEQ ID NO: 214127

SEQ ID NO: 278836 - RNA, 62 nt, Human
gauguguguauauuauucaaaaaaauguacuggugugauaucuuguaugaaugaucauuuaa

SEQ ID NO: 278837 - RNA, 62 nt, Human
augaaaucuuauaagguuucaguuugacagaagugugauauauguaacuugugccauggacc

SEQ ID NO: 278838 - RNA, 62 nt, Human
uaauuuuuucaacuccuauuguguuucuuugugugugauauuuuaaucaaaagugguugagu

SEQ ID NO: 278839 - RNA, 62 nt, Human
gauagugaaucaugacccuaagggagagauuugugugauaaaaguauuguauauaauagauc

SEQ ID NO: 278840 - RNA, 62 nt, Human
cuucaggucucuaagccccuggaagcagcauugugugauauucucagaggcaggggaaaaua

SEQ ID NO: 278841 - RNA, 62 nt, Human
uugaaguuauuuguaauucagaaaccuugcuugugugauacauagucucuucauuuauuacu

SEQ ID NO: 278842 - RNA, 62 nt, Human
auauaauugguaauggauaacuuaauaaauuugugugauauaaaaguaguguaucauguucu

SEQ ID NO: 278843 - RNA, 62 nt, Human
ucuacugauaaaauuaucccaaagguagguuggugugauaguuuccgaguaagaccuuaagg

SEQ ID NO: 278844 - RNA, 62 nt, Human
ugauuaacagugaagaccuuguaaaugcagaugugugauaaagcauuuagucagucccccaa

SEQ ID NO: 278845 - RNA, 62 nt, Human
uuuaucuuuuaaaacuucacuaauauagcauugugugauaagcacuaagcagucaguccccu

SEQ ID NO: 278846 - RNA, 62 nt, Human
cuguacuccacaugcaacccaacagcagugcagugugauaacugagcggucgcauggcagag

SEQ ID NO: 278847 - RNA, 62 nt, Human
gagguuuuguucaugcccccuuugacugaucagugugauaaggacuuuaggaaaaaaagcau

SEQ ID NO: 278848 - RNA, 62 nt, Human
gguugcuagucaauguucuauauuuaaugaaugugugauaaaucauccuguaaucaguaugg

SEQ ID NO: 278849 - RNA, 64 nt, Human; identical to SEQ ID NO: 214134

SEQ ID NO: 278850 - RNA, 64 nt, Human; identical to SEQ ID NO: 214140

SEQ ID NO: 278851 - RNA, 64 nt, Human; identical to SEQ ID NO: 214144

SEQ ID NO: 278852 - RNA, 64 nt, Human; identical to SEQ ID NO: 214153

SEQ ID NO: 278853 - RNA, 62 nt, Human
cucuguauuccgauacaaaguguuguaucaaagugugauauacaaaguguaccaacauaagu

SEQ ID NO: 278854 - RNA, 62 nt, Human
uuaguuauaaucaccuuguaucucuaaauauggugugauaugaaccaguccauucacauugg

SEQ ID NO: 278855 - RNA, 62 nt, Human
uguaaaauugaaaauucauuugcuguuucaaagugugauaucuuucacaauagccuuuuuau

SEQ ID NO: 278856 - RNA, 62 nt, Human
ggguuugaauuccagcucuacuauuuuugguugugugauagaguuauuuaaccucucugagc

SEQ ID NO: 278857 - RNA, 62 nt, Human
aaacaggaucuaagcuuaggaauaauauuuaggugugauauaguguuagauuuuuuugaugu

SEQ ID NO: 278858 - RNA, 62 nt, Human
ugcagagggggucauuccaggcccuccagugugugugauagucaccaugccaugcagggaua

SEQ ID NO: 278859 - RNA, 62 nt, Human
gcaguuucagcguucaaacagcaauagcucaagugugauaacuacugaggauaauaaaaucc

SEQ ID NO: 278860 - RNA, 62 nt, Human
uuguauguaaaacccaaauaaagguagaguaagugugauauaugggaguauuaaaauagcuu

SEQ ID NO: 278861 - RNA, 62 nt, Human
ccccaucccccgaccccaccacaguccccagagugugauauuccccuuccuguguccacgug

SEQ ID NO: 278862 - RNA, 62 nt, Human
aaaaaaaaaacucaagauaguaaaagcaccuagugugauagauuaucgguuaggucauuugu

SEQ ID NO: 278863 - RNA, 62 nt, Human
ucauuaaaaacaaauacuucuacuguuugggugugugauaggguucucaaugcagaucuccc

SEQ ID NO: 278864 - RNA, 62 nt, Human
accugugugauucaguaggguuugagacuuacgugugauacugacagguaagcaacagugcu

SEQ ID NO: 278865 - RNA, 62 nt, Human
gacauuucuaucacaaucauuuuauggaagaugugugauaaucuguuuuuacugguauuaau

SEQ ID NO: 278866 - RNA, 64 nt, Human; identical to SEQ ID NO: 242559

SEQ ID NO: 278867 - RNA, 64 nt, Human; identical to SEQ ID NO: 242565

SEQ ID NO: 278868 - RNA, 59 nt, Human
cuaacagcagugagauuuaaaaagagcuagugugauaauccuaacucuacuacgcauua

SEQ ID NO: 278869 - RNA, 62 nt, Human
aagguauaaggagaaaggagauugguaaggaagugugauacauauugaaucaggugucaagg

SEQ ID NO: 278870 - RNA, 62 nt, Human
uuuuccucccacuuagacucaaacacauuuuagugugauauuucauuuauuauagguaguau

SEQ ID NO: 278871 - RNA, 62 nt, Human
uucuagacugucucuguggaauauauuugugugugugauauaugcaugugugugaugguaug

SEQ ID NO: 278872 - RNA, 62 nt, Human
uuuugcauugugaaaaaaacaaaauaaauuuugugugauaauuuugaugaugaaagguggaa

SEQ ID NO: 278873 - RNA, 62 nt, Human
acuaauaaaaaucuauaugacuuuuuauuauugugugauaaccaaguaaauguuuucuauuu

SEQ ID NO: 278874 - RNA, 62 nt, Human
uaauaucuuauguguauauagcauccugagcugugugauacaguagauuucuucuuagcaga

SEQ ID NO: 278875 - RNA, 62 nt, Human
caugaagaagaauaaaugaggguaaggggcuagugugauagggagaggggugggaugccauc

SEQ ID NO: 278876 - RNA, 62 nt, Human
ugaaggauuuccuaacagcuuuagaaaucuuagugugauacaucucucauacaguuuggggu

SEQ ID NO: 278877 - RNA, 62 nt, Human
uuuuuauguggcugcccaacguggagcgggcagugugauaggcugggugggcuaagcagccu

SEQ ID NO: 278878 - RNA, 62 nt, Human
aaaaaacaaaaauguacaugugauguuaguaggugugauaugcaaccugguauacagacauu

SEQ ID NO: 278879 - RNA, 62 nt, Human
uguuucugcagaucuuguggcauuugucucuagugugauauauaaagguguaauuaagacag

SEQ ID NO: 278880 - RNA, 62 nt, Human
agagcuuuuauauaaaguuuuaaaaauugaaugugugauauguguucuuugaagguuuuuua

SEQ ID NO: 278881 - RNA, 64 nt, Human; identical to SEQ ID NO: 240458

SEQ ID NO: 278882 - RNA, 64 nt, Human; identical to SEQ ID NO: 240477

SEQ ID NO: 278883 - RNA, 64 nt, Human; identical to SEQ ID NO: 242570

SEQ ID NO: 278884 - RNA, 62 nt, Human
cuucaaaguagccugacugugugcaugugugugugugauagguuauuuauaaagacuuugga

SEQ ID NO: 278885 - RNA, 62 nt, Human
ggauguuagcuuuguggcagaauucccugcaugugugauaacugaucuuguuuuauuuuuug

SEQ ID NO: 278886 - RNA, 62 nt, Human
auucuguuuaauuacaucuguaaauauuaugugugugauaguauucaauaaaguaaaaucaa

SEQ ID NO: 278887 - RNA, 62 nt, Human
guggagugucuccuggagagagugaggagagugugugauagcuagaaagagagagagacaga

SEQ ID NO: 278888 - RNA, 62 nt, Human
cuguauaaagaaucuaugacuuuuugagggaagugugauauauuaacaaauauaaccaauuc

SEQ ID NO: 278889 - RNA, 62 nt, Human
cuggaggaaauaauauuuucaaacugucguuggugugauacuuuggcucaaaggaucuuugc

SEQ ID NO: 278890 - RNA, 62 nt, Human
cuugcgauuugcacauauugaguuuauaacuugugugauauuccugcaguuuuuauccaaua

SEQ ID NO: 278891 - RNA, 62 nt, Human
auguuucuguuuguucccucccccucccccuugugugauaccacauguguauaguauuuaag

SEQ ID NO: 278892 - RNA, 62 nt, Human
uccauuaauuaccaagcccucacccagcccaugugugauaggauuuauguaggaagaaacuu

SEQ ID NO: 278893 - RNA, 62 nt, Human
aucuuuucuucuguaucucuguuacaagcguagugugauaauaccagauaauaaggaaaaca

SEQ ID NO: 278894 - RNA, 62 nt, Human
guuuagcaguauccccuucccacuuauauauugugugauaugauuuugcuugccuauaggag

SEQ ID NO: 278895 - RNA, 62 nt, Human
aaauaggaaugguuuucucaagaauagauuuggugugauaccuuguguuugcuuacauuggc

SEQ ID NO: 278896 - RNA, 62 nt, Human
cuucccucaucccaucacacaacuuuuuuugugugugauaaacugauuuugguuugcaauaa

SEQ ID NO: 278897 - RNA, 64 nt, Human; identical to SEQ ID NO: 242576

SEQ ID NO: 278898 - RNA, 64 nt, Human; identical to SEQ ID NO: 242580

SEQ ID NO: 278899 - RNA, 64 nt, Human; identical to SEQ ID NO: 242586

SEQ ID NO: 278900 - RNA, 62 nt, Human
uuuuuguucuuuucuugacuccuuucucaagugugugauaaggucugcugauaaaauauuua

SEQ ID NO: 278901 - RNA, 62 nt, Human
uaaagucugaguaagaaacuucaugcuggccugugugauacaagagucagcaucauuaaagg

SEQ ID NO: 278902 - RNA, 62 nt, Human
gagcaugcauuucucacaauaauuauuaagcugugugauaauuucugcuuucaggacacuca

SEQ ID NO: 278903 - RNA, 62 nt, Human
cauucagacugacuucuacaggacuucuacgugugugauaaaagccugugaaucgugagucc

SEQ ID NO: 278904 - RNA, 62 nt, Human
ugaaacugcuaaauauguauagagagguugacgugugauacgugggacaguucacauagaca

SEQ ID NO: 278905 - RNA, 62 nt, Human
cacgccaaguggaagccacuggaccacaggaggugugauagagccuuugaucuucaggaugc

SEQ ID NO: 278906 - RNA, 62 nt, Human
uaaccacugaagauugcuguaaauuauaaagggugugauagaauccacauggcugucaagaa

SEQ ID NO: 278907 - RNA, 62 nt, Human
ccugagaacacagacaaugaccacuacccugggugugauaucacaggaggccagagagaggc

SEQ ID NO: 278908 - RNA, 62 nt, Human
uaauuaagaauguugguuauuuucacgggagcgugugauauuuaacauuaauauuuuauuug

SEQ ID NO: 278909 - RNA, 62 nt, Human
uauaggaugauuggaauuauuaauuuuuaaaggugugauaagauacugcacuuggcugggca

SEQ ID NO: 278910 - RNA, 62 nt, Human
aaauacuuaaccacuaauuuugaaaauuaccagugugauacauaggaaucauuauucagaau

SEQ ID NO: 278911 - RNA, 62 nt, Human
uuucuucccaggcaauacaccucugaacaugugugugauaaauggguuugcuaaugugcugu

SEQ ID NO: 278912 - RNA, 62 nt, Human
cccaagggcugacauggugugagugugugggugugugauaagcuucucaucccugcauagau

SEQ ID NO: 278913 - RNA, 64 nt, Human; identical to SEQ ID NO: 242592

SEQ ID NO: 278914 - RNA, 64 nt, Human; identical to SEQ ID NO: 242598

SEQ ID NO: 278915 - RNA, 64 nt, Human
aaauccuugaugauugacaacacccauuuuuccuuuugccgaccccaagaguuuugggaguugu

SEQ ID NO: 278916 - RNA, 62 nt, Human
cuuacauuuuguuauuucuauuuuuauaaauugugugauaauuagagguaagaauaacaagu

SEQ ID NO: 278917 - RNA, 62 nt, Human
augauuccuguauuauuucagugagagcuacagugugauauuucagagucuauuaaauaaaa

SEQ ID NO: 278918 - RNA, 62 nt, Human
cagcucacuaggauuuugcugaacauuaaaaagugugauagcgauauuagugccaaucaaau

SEQ ID NO: 278919 - RNA, 62 nt, Human
acgcacuuggaguaauuuuuaugaaauacugcgugugauaagcaaacgggagaaauuuauau

SEQ ID NO: 278920 - RNA, 62 nt, Human
aagagcaucccuaugggcuuggaccacuuacagugugauaaggccuacuauacauuaggaag

SEQ ID NO: 278921 - RNA, 62 nt, Human
aauugcauacacaugccuccaugcauauaugugugugauaauacacaugcauuuaugugcgu

SEQ ID NO: 278922 - RNA, 62 nt, Human
uuauuauuguguauaucuaauauauuaaguaugugugauacuaagguuugacugcuauaauu

SEQ ID NO: 278923 - RNA, 62 nt, Human
caaagaaaucaauggaacccuugcacaaaaaagugugauaaauauuuuuaaauaaaaacuua

SEQ ID NO: 278924 - RNA, 62 nt, Human
auggauucuuccauccugccggaugagugugggugugauacagccuacauaaagacuguuau

SEQ ID NO: 278925 - RNA, 62 nt, Human
auaguggcuacugauguucaagugggauugaagugugauaaauggauauauuuuguuguuug

SEQ ID NO: 278926 - RNA, 62 nt, Human
uuucuaauuaguggaucuuuuuccacuggaaagugugauagcucauugcuaauuuuucauuc

SEQ ID NO: 278927 - RNA, 62 nt, Human
auuugcucugggucaggaagaagcuguucacggugugauaauacucuuuagauugugcuuuc

SEQ ID NO: 278928 - RNA, 62 nt, Human
ggaacagauuuuucauuguaauaguggaaguugugugauaguuaggagauaucaacaugcau

SEQ ID NO: 278929 - RNA, 64 nt, Human
ugugugucaccuuggcuggcuggcuggccaggguuuugccgauuucccuccucacaucccuccc

SEQ ID NO: 278930 - RNA, 64 nt, Human
gauuuuaugcacagccuaguuaucaaggggaugauuugccgacauguuugagaacccccuaacc

SEQ ID NO: 278931 - RNA, 64 nt, Human
aaauaucucccaccuaaaauagagaauguugucuuuugccgaccaggagcacuacagauugagc

SEQ ID NO: 278932 - RNA, 62 nt, Human
uguacguauguguguguucuacaagaacggaagugugauauguuuaaagaugaucagagaaa

SEQ ID NO: 278933 - RNA, 62 nt, Human
cagaaauaagaagaaaacaggugaaaaagacagugugauaaggccauggugguggauugugg

SEQ ID NO: 278934 - RNA, 62 nt, Human
cucaguugguggguguuaagcuagaaugggcugugugauaggaaacaaaugccuuacagaug

SEQ ID NO: 278935 - RNA, 62 nt, Human
gucucuauugucacccaggcuggagugugguggugugauaauagcucaccuugaccuccuag

SEQ ID NO: 278936 - RNA, 62 nt, Human
uuuuuuuuuuuuuuuuuacaaaaugaugauuagugugauaaugugcugcaaaaaauauccaa

SEQ ID NO: 278937 - RNA, 62 nt, Human
uuaacuuaugaaaaaauuauuuggggacaggagugugauaccuuccuugguuuuuuuuugca

SEQ ID NO: 278938 - RNA, 62 nt, Human
gaaaagcuuuucaacagccuuucuauaucaucgugugauaauuguucaccaaugaaugaguc

SEQ ID NO: 278939 - RNA, 62 nt, Human
ggacucaguuucuccacagccuucuccagccugugugauacaaguuugaucccaggaacuug

SEQ ID NO: 278940 - RNA, 62 nt, Human
gguccucagcaacugucuggauccugacaggugugugauaauuacuuagugaauucaugggu

SEQ ID NO: 278941 - RNA, 62 nt, Human
ucgcuuuauccaccauaacguaaagaacugcggugugauaacagccuucacggggccacggu

SEQ ID NO: 278942 - RNA, 62 nt, Human
cauaaaaauuuaaagugagaggcaugguuagugugugauacaauaaaaaguaauuguuuggu

SEQ ID NO: 278943 - RNA, 62 nt, Human
cuccccuuuuuuuaaaaaggacuguuuugcuagugugauaaugaauagguaagauaugagau

SEQ ID NO: 278944 - RNA, 62 nt, Human
ucaaucacucagccccuccaaagauaguugaugugugauaaucucauaauguugagaacccu

SEQ ID NO: 278945 - RNA, 64 nt, Human
cucaguauccagagcuuacaaggagcugcaaggguuugccgagggcugcccagcucugcuucug

SEQ ID NO: 278946 - RNA, 64 nt, Human
uccccucccgucuacucauuccccggggcguuucuuugccgauuuuugaaugugauuuuaaaga

SEQ ID NO: 278947 - RNA, 64 nt, Human
uaaguuauucgacggaggacagaguaugugagccuuugccgaacaaacaaacguaaguuauugu

SEQ ID NO: 278948 - RNA, 62 nt, Human
aaggguagaccuggaccugccaccuaugaguugugugauauagaaaaaaaucucuuagcucu

SEQ ID NO: 278949 - RNA, 62 nt, Human
ucuguaaauaaaaucuuugaucacaccacucagugugauaauugugucuacagcuaaaaugg

SEQ ID NO: 278950 - RNA, 62 nt, Human
caagaugaaacaggacaggagagaacuguucagugugauacagagcugccauuuccaaagua

SEQ ID NO: 278951 - RNA, 62 nt, Human
aacauaugugauuguuccauaauaaacuucuggugugauacuuucaucuuguaaaucugcuu

SEQ ID NO: 278952 - RNA, 62 nt, Human
gaggccggucaccagaagccagcaggcguggggugugauacucucuauagccacuacagggc

SEQ ID NO: 278953 - RNA, 62 nt, Human
guauccaucuauacuuggcagcaacaugagaagugugauacaugugaacccaacaaauucaa

SEQ ID NO: 278954 - RNA, 62 nt, Human
cauaaauucaagcacuaccacuggucaguuuugugugauagaauaaaaauauguuaccugca

SEQ ID NO: 278955 - RNA, 62 nt, Human
uccuugucaagcuuucuucuguggucugauuagugugauaccggggcaccuccucugguacu

SEQ ID NO: 278956 - RNA, 62 nt, Human
aguaugcagaggaguuuucaagaggcuaucuggugugauauuguaauaggcugaaugcaaaa

SEQ ID NO: 278957 - RNA, 62 nt, Human
cuaugguuaguuuugcagguuugcauccagcugugugauauucugcugugcaaauccaugca

SEQ ID NO: 278958 - RNA, 62 nt, Human
auacacuagcaauuuuuuuaaaaacuggaacagugugauaggaagccugcuggaugauuucu

SEQ ID NO: 278959 - RNA, 62 nt, Human
aucaugaacagcguaaguuccuacacacggacgugugauacacacaugcauguacagguaag

SEQ ID NO: 278960 - RNA, 62 nt, Human
cagucuaucagggaggcugaagcaagggcgcagugugauauuuuaggaauacagaagauuua

SEQ ID NO: 278961 - RNA, 64 nt, Human
ggguuaguuggcaguuaguucuauggucaucucuuuugccgagacuguauauuuaucagacucc

SEQ ID NO: 278962 - RNA, 64 nt, Human
gaagauaaaaagcacuguugaggcaguguuugcuuuugccgagcugguguccgacagcucccug

SEQ ID NO: 278963 - RNA, 64 nt, Human
acugggaaaucauuagaaaggaggcuguagaauauuugccgagccucuacuguauaccaggggc

SEQ ID NO: 278964 - RNA, 62 nt, Human
cuggccguccuugucucugggccacuuggagugugugauaaaucagucaagcuguugaaguc

SEQ ID NO: 278965 - RNA, 62 nt, Human
aaaaacuugaaagaacacuucuaagccuaagugugugauacaguuuguuacuuuuaaguaca

SEQ ID NO: 278966 - RNA, 62 nt, Human
ucauuugagaauuuuuuuuguacagcauucaugugugauauuuuccagauuuguuggaucua

SEQ ID NO: 278967 - RNA, 62 nt, Human
guacucacauggauuuuuaagauaaaucaccugugugauaauauuuugaaucugagacgaau

SEQ ID NO: 278968 - RNA, 62 nt, Human
ugugaauguaucauguuuuacuuuaaaugugugugugauacuucuucauuauguccugcgcu

SEQ ID NO: 278969 - RNA, 62 nt, Human
aagaaguuaauuuuugaaaaugacauauuuuugugugauagaaagaauggagcaaguugugc

SEQ ID NO: 278970 - RNA, 62 nt, Human
auaacaaaacccaguagucaccaaggcagguagugugauaaaugaacacaccacucugaggc

SEQ ID NO: 278971 - RNA, 62 nt, Human
uuuuacuuuuguauauaaaucuaagacugccugugugauaaaacacuuguuuaaaaaaaaaa

SEQ ID NO: 278972 - RNA, 62 nt, Human
ggacacgcuugguuugcucuauuuuuguuuaugugugauagugguucugucaucaucauuca

SEQ ID NO: 278973 - RNA, 62 nt, Human
augucaccuugaugggggcugugaguggggcagugugauacccagugacuagacgcacucug

SEQ ID NO: 278974 - RNA, 62 nt, Human
cuagguugaugcauuuuguacuuagcuguacugugugauauuuuucauuauuuuaggacgcc

SEQ ID NO: 278975 - RNA, 62 nt, Human
cauccacggugggugaguggccaagacaagcagugugauagaguccuugguggguuuaguca

SEQ ID NO: 278976 - RNA, 62 nt, Human
uuuaaugaacauuugucuuucagaauaggauugugugauaauguuuaaauggcaaaaacaaa

SEQ ID NO: 278977 - RNA, 64 nt, Human
ugcugcguggcagauuuccuguucuuguucgcaguuugccgacugaagagugugggauuuccga

SEQ ID NO: 278978 - RNA, 64 nt, Human
aagccaaugucaccucagagguuucaaacauugcacaagcaacuaacuuuauuccuccacagga

SEQ ID NO: 278979 - RNA, 64 nt, Human
auuuucuacagugguuuuauacugaaggaaaaacacaagcaaaaaaaaaaaaaagcaucuaucu

SEQ ID NO: 278980 - RNA, 62 nt, Human
uacuguauuuaguuugugauaaauuuuucacugugugauauuuaugcucuaaaucacuacac

SEQ ID NO: 278981 - RNA, 62 nt, Human
uaggaacccuggcaucuuuucuauauuauccagugugauaaucuuuucacguuuuauagagc

SEQ ID NO: 278982 - RNA, 62 nt, Human
ccaagaauaccacuuuugaaguuaauccuuuugugugauacaggaugaacuugggauguuug

SEQ ID NO: 278983 - RNA, 62 nt, Human
cuccauauauuuauuuguuuggaaucacucuugugugauauaaaggcguguauauuaucuuu

SEQ ID NO: 278984 - RNA, 62 nt, Human
agguuggagugacuggugggccuagaucacuggugugauaaaccccaauuuucaccccgggg

SEQ ID NO: 278985 - RNA, 62 nt, Human
ccuacguacuuauaucagcaccauguauguaggugugauaguacuuucaaacagcgccucca

SEQ ID NO: 278986 - RNA, 62 nt, Human
gcggcaauagacuggaacgauuaaggaccauggugugauagaucccauuucaaaugauucca

SEQ ID NO: 278987 - RNA, 62 nt, Human
aagugaaaggguagggggauaguccugaucaagugugauaaauuuuuauagacauauauaaa

SEQ ID NO: 278988 - RNA, 62 nt, Human
gagagaaggaaauuuuaucaauuaaaaaugcugugugauaaaaucccagcccagauugcuca

SEQ ID NO: 278989 - RNA, 62 nt, Human
uuuucaaaagacaguguugaauaaacauaccugugugauaaaacacagaauuuacauauaca

SEQ ID NO: 278990 - RNA, 62 nt, Human
uuuuuuuuuuuuaguguguguuuucccuccaagugugauauuuccugcugaauuaaauuaua

SEQ ID NO: 278991 - RNA, 62 nt, Human
uacagucugauuuagaagucaucuuuucagccgugugauaauuaacaugguaagccuuagca

SEQ ID NO: 278992 - RNA, 62 nt, Human
auuuaaauuggucagucagguagaagauacaugugugauauagaaaaauaaugccucuccug

SEQ ID NO: 278993 - RNA, 64 nt, Human
aucaaucuguaaaagguaaaaaugaaaaacaaaaacaagcaaacaaacaaaaaacaauggaaaa

SEQ ID NO: 278994 - RNA, 64 nt, Human
aaucgguaaaagcagugccuccucacuuaagugaacaagcaaucauuuaguggcauagaugcag

SEQ ID NO: 278995 - RNA, 64 nt, Human
gggcuugaagcccggggccgccauugacagagggacaagcaaugggcuggcugaggccugggac

SEQ ID NO: 278996 - RNA, 62 nt, Human
auuuaaagacucauccccagccuccaccuccugugugauacuugggggcuagcuuuuuucuu

SEQ ID NO: 278997 - RNA, 62 nt, Human
uguaugauauaaaguuauagucauuuaaaaaugugugauauuaguacauuaguagguaaaug

SEQ ID NO: 278998 - RNA, 62 nt, Human
aucaucauugccuuuccacuacucuacuaucugugugauauuagacaaaauauuugcuucuu

SEQ ID NO: 278999 - RNA, 62 nt, Human
cacguaaguguuguacauauuuaugggguacagugugauauuuaaauauauguauaugaugu

SEQ ID NO: 279000 - RNA, 62 nt, Human
cacauaacuguuguacucauuuaugggguacagugugauaguuaaugcaaguauacaaugug

SEQ ID NO: 279001 - RNA, 62 nt, Human
caugauggugaugaaucuauuaaucaugaugagugugauaggggugcucuucaagacuuaga

SEQ ID NO: 279002 - RNA, 62 nt, Human
uguagcuuuguaggauauuuggggauuccauagugugauauccccuucuucccuuugcucaa

SEQ ID NO: 279003 - RNA, 62 nt, Human
agguaagaacaguaauuggcccagacagguaggugugauaaacagaguagaaaagauugugg

SEQ ID NO: 279004 - RNA, 62 nt, Human
caauauuagauaauauuaagaaacuuuguuaugugugauaauagcauugugguuauguaaaa

SEQ ID NO: 279005 - RNA, 62 nt, Human
uucuagucugcauaggaagggaacaccuggacgugugauaaauagguuagcacuucaguuac

SEQ ID NO: 279006 - RNA, 62 nt, Human
gccugacccuuccugucccagggcccaggucugugugauaucuguauauauugcauuuuguu

SEQ ID NO: 279007 - RNA, 62 nt, Human
uuuaauugcauccuaucagauuguugaggugggugugauagucuucaggugcagugcguuca

SEQ ID NO: 279008 - RNA, 62 nt, Human
uuuccucuuccugugcaaauuccucuagucaagugugauauaucaagaaaucugaggaggau

SEQ ID NO: 279009 - RNA, 64 nt, Human
aaagcuuugugccaugaauacgucgcauuuaauaacaagcaacacacggcauauagaaauaacu

SEQ ID NO: 279010 - RNA, 64 nt, Human
cagagaaggggaaaaaaaacccaaaauuaugugaacaagcaaaauuaaaauuucauuuuaggcu

SEQ ID NO: 279011 - RNA, 64 nt, Human
ucccaaacaugcacuuccuugcuuaagguaugguacaagcaaugccugcccauuggagagaaaa

SEQ ID NO: 279012 - RNA, 62 nt, Human
gaucccauuuccgucugcccccucgucaccaggugugauagccccagccaggucacaccugg

SEQ ID NO: 279013 - RNA, 62 nt, Human
cgcacaccacuggcgugagacagcgcuugguggugugauacuuuuggugcuguguauaguau

SEQ ID NO: 279014 - RNA, 62 nt, Human
aacucuaaaguucugacuucaaucaacgguuagugugauacugccaaagaacuguauacugu

SEQ ID NO: 279015 - RNA, 62 nt, Human
aucucuucagaaauaagaagcuauuucauuaagugugauauaaaccuccucaaacauuuuac

SEQ ID NO: 279016 - RNA, 62 nt, Human
agacaaucgggagaagauagcaagaugcuagugugugauacgugugacaaaggguaucauac

SEQ ID NO: 279017 - RNA, 62 nt, Human
auauuuauugaucaucucuucuccauaagauagugugauaaacacagucaugaauaaaguua

SEQ ID NO: 279018 - RNA, 62 nt, Human
gauuuauaugcacugaugaggaaagacauacugugugauagggagaaaaagcagcuuauaaa

SEQ ID NO: 279019 - RNA, 62 nt, Human
uaguuugcuguuaauuuaugcauuugaagccagugugauacagccaucuguaccuacuggag

SEQ ID NO: 279020 - RNA, 62 nt, Human
cagguagcagggggagugcuggucacaccccugugugauaugugaugcccucggcaaagaau

SEQ ID NO: 279021 - RNA, 62 nt, Human
aacuugggcuaaaaucaaaccuuggcacacaggugugauacaacuuaacaggaaucaucgau

SEQ ID NO: 279022 - RNA, 62 nt, Human
uuuaagaucucuaccacuccaaucgauguuuagugugauaggacaucaccauuucaaggccc

SEQ ID NO: 279023 - RNA, 62 nt, Human
accuguagauaucaucuuuucucagauauuuugugugauacucugugguguucuguucaugu

SEQ ID NO: 279024 - RNA, 62 nt, Human
uagaagaaaucuuacggaguuugccaugggaugugugauaucagcagucuucagcuccuuac

SEQ ID NO: 279025 - RNA, 64 nt, Human
ucugcuuuauucucuagcaauccacaguacaagaacaagcaaaugccacagcugcacgacuguu

SEQ ID NO: 279026 - RNA, 64 nt, Human
gaauuuggugaagaggaggaggaggagauugaugacaagcaaguuacucaggaaucaaaagaga

SEQ ID NO: 279027 - RNA, 64 nt, Human
cucugagcauuuuuaaaaguuuguuuacaauuccacaagcaaaagcucuaauuuaaccagauuu

SEQ ID NO: 279028 - RNA, 62 nt, Human
cccccucccccgaccccaccacaguccccagagugugauauuccccuuccuguguccaugug

SEQ ID NO: 279029 - RNA, 62 nt, Human
aaauugauuccucugacuuugcuauugauguagugugauagaaaauucaccccucugaacug

SEQ ID NO: 279030 - RNA, 62 nt, Human
auucuuuuuuucucuagaguagagguauaauugugugauauuucagaaauacagauaaauga

SEQ ID NO: 279031 - RNA, 62 nt, Human
uugaguauuugugccuagggcuugggcuguuugugugauaccggccccccgccagacaauag

SEQ ID NO: 279032 - RNA, 62 nt, Human
ccaaggccccauccauuaguuuccacugccucgugugauaugaggcccauucuucacucuuu

SEQ ID NO: 279033 - RNA, 62 nt, Human
ccagggccccauccauuagcuuccacugccucgugugauaugaggcccauuccugccucuuu

SEQ ID NO: 279034 - RNA, 61 nt, Human
gaggccgcgugcgucucugucguggacacgcgugauugacccuuuaacuguauccuuaacc

SEQ ID NO: 279035 - RNA, 61 nt, Human
aagccaaaagaguuuggcuucaugaggcaaggugauugacucaauggcuuguugaaucuca

SEQ ID NO: 279036 - RNA, 61 nt, Human
gccagggcccucagccuucccugcugccccagugauugauugagagagcuguugggguuuc

SEQ ID NO: 279037 - RNA, 61 nt, Human
gugcacggccuuguucuaacccggaauaaaggugauugauuguauugcaacuaacugauuu

SEQ ID NO: 279038 - RNA, 61 nt, Human
uauuauggcagcuugcuauuuuuauaacauggugauugaguugaacacaaucaaaguacag

SEQ ID NO: 279039 - RNA, 61 nt, Human
ggcauuguggugucugucuaggaaggaaggggugauugacaagagacaagucuggcccagu

SEQ ID NO: 279040 - RNA, 61 nt, Human
agagcaggacuuuacuuucaaauuucuuucagugauugacucuucaaaauugcaguagugu

SEQ ID NO: 279041 - RNA, 64 nt, Human
uggggccuagcccugcuagaggcuacagcacuuuacaagcaagguaugcuuucuuccagccccu

SEQ ID NO: 279042 - RNA, 64 nt, Human
auaaaaaguagaugagacuucuccaagcugcuucacaagcaaacuaaccgaaaaaccgaaaaua

SEQ ID NO: 279043 - RNA, 64 nt, Human
auuuuagcucuguuagauauguuucuuucuaaggacaagcaacuauguauagacuuguuguuug

SEQ ID NO: 279044 - RNA, 61 nt, Human
aaugaacgcaguaaaccuucauggaccaacagugauugaggauuugugggcagccagaggg

SEQ ID NO: 279045 - RNA, 61 nt, Human
ggagguucuccacugugguggucuggauucagugauugauucuauuuuucuauagcaaagc

SEQ ID NO: 279046 - RNA, 61 nt, Human
agaaaauacuuauaaaaagacuucauuuuuagugauugacaagcaaacggguucauuuaaa

SEQ ID NO: 279047 - RNA, 61 nt, Human
agaugaacuccuuaaggacaggauuugguaagugauugacuucuuuuuaguuccaugaucu

SEQ ID NO: 279048 - RNA, 61 nt, Human
aguuuuacaaaauaaugaagcaauuagcuaugugauugagaguuauuguuuggggaugugu

SEQ ID NO: 279049 - RNA, 61 nt, Human
gaaaaacagcugcucuccuugucccagcuuugugauugagcccucugucuugcucucucug

SEQ ID NO: 279050 - RNA, 61 nt, Human
uauugaggcacacuccuuggccugcagaaaugugauugaaguaaggaguaauuugggaaau

SEQ ID NO: 279051 - RNA, 61 nt, Human
ugcucgcuacaagcuggccguggcagaugcugugauugagaaguuugccccaauuaagcgu

SEQ ID NO: 279052 - RNA, 61 nt, Human
gguaggacagaaaggaagacagccagauccagugauugacuuggcaugaaaaugagaaaau

SEQ ID NO: 279053 - RNA, 61 nt, Human
aagcuaaaagcaaauuuaugaaacuaaaagggugauugacauccauguuuacacuccgcuc

SEQ ID NO: 279054 - RNA, 61 nt, Human
gcuuccacaguaaaaucugaaaaacugauuugugauugaaagcugccuuucuauuuacuug

SEQ ID NO: 279055 - RNA, 61 nt, Human
aagacuucacgaagacugcugauaacuaucugugauugauaggaaauuuuuuuucuugauu

SEQ ID NO: 279056 - RNA, 61 nt, Human
auuggagguuauuuuauuuuugguugucauggugauugaaagagauaauguaaaugccuua

SEQ ID NO: 279057 - RNA, 64 nt, Human
accagauuguacuccuaaaacuuaacaggccaucacaagcaauugucuuuuguuuacaagauug

SEQ ID NO: 279058 - RNA, 64 nt, Human
uggcuagcccaggggaauguauuuuucaaaacauacaagcaacagcaaaagcccuaacuucuua

SEQ ID NO: 279059 - RNA, 64 nt, Human
ucagguggagagcacuagaagugguuuccugauaacaagcaaggauaucagagcugggaaauuc

SEQ ID NO: 279060 - RNA, 61 nt, Human
accuaaauaggaaccauguaauuucucaaaagugauugaacaguuugcccacacuuaguuu

SEQ ID NO: 279061 - RNA, 61 nt, Human
gaagaaagccuuagguaucaauuccaaaacagugauugaaauuucccaaaauaauuauggc

SEQ ID NO: 279062 - RNA, 61 nt, Human
aaucaaucacauugcauucaaucaaucagcugugauugauugauuaugcuuagaaauacua

SEQ ID NO: 279063 - RNA, 61 nt, Human
uuauugcuauugucauuugcauagaauuuaagugauugauuuaaaaaaacuggacauaaac

SEQ ID NO: 279064 - RNA, 61 nt, Human
uuuucugccacuucaccuuagggagcuuccagugauugauuuuaggaggcccacaccaaac

SEQ ID NO: 279065 - RNA, 61 nt, Human
gacagagacaaguaauuucaguguaaagugugugauugaaggugauaagggaaaagauaaa

SEQ ID NO: 279066 - RNA, 61 nt, Human
cugguuauauacaaaugugacccgugauaaugugauugaacacuuuaguaaugcaaaauaa

SEQ ID NO: 279067 - RNA, 61 nt, Human
agaccauaauguuacauuauuaucaacaauagugauugauagaguguuaucagucauaacu

SEQ ID NO: 279068 - RNA, 61 nt, Human
uuaguuuuuuccaaaguaaguuauugaagcugugauugacauuuuucucauaaugaauccu

SEQ ID NO: 279069 - RNA, 61 nt, Human
uaagagcuuuacauuucugagauuuuguauagugauugagaugucuauuuuauuauugaua

SEQ ID NO: 279070 - RNA, 61 nt, Human
uaugaaguuugucuuuucugaaacuggcuuagugauugaguaucauguaauaauuauaaua

SEQ ID NO: 279071 - RNA, 61 nt, Human
gggcaguggucccaauaggagacaaaggagagugauugauuuucuuccuccaauaguuggu

SEQ ID NO: 279072 - RNA, 61 nt, Human
uggguccccuguggccgucacagugucugcugugauugagaugcgcacagguugggggagg

SEQ ID NO: 279073 - RNA, 64 nt, Human
uugcuuguauauucuuccagagaucucugucuauacaagcaaaaacacauguggucuuuuuccu

SEQ ID NO: 279074 - RNA, 64 nt, Human
auauccagaaucuacaaggaacuuaaacaauucaacaagcaagaagaaaaaacccaauuaaaau

SEQ ID NO: 279075 - RNA, 64 nt, Human
ucugaguguuuacaggcggaccuguucucuuccgacaagcaauuugaaucuuaacuuuccauca

SEQ ID NO: 279076 - RNA, 61 nt, Human
gacucauuguaauucaagcuuuccgagucaagugauugacaacugaagagacacguggcua

SEQ ID NO: 279077 - RNA, 61 nt, Human
ucagaggcgcuuaguaagccuuaguaaaguugugauugaagaaacuuaauacaaaugaacu

SEQ ID NO: 279078 - RNA, 61 nt, Human
aaugaauucugugaauucugugaagaguaaugugauugaaaauaagucuaaacagcuguaa

SEQ ID NO: 279079 - RNA, 61 nt, Human
uuuuacguuggaauccuccuucuagcugaaggugauugaaaaggaaaagagugagugaaca

SEQ ID NO: 279080 - RNA, 61 nt, Human
uacuuuggaacacuacucuuacauguauaaagugauugacuugacuuucuagcuucccuug

SEQ ID NO: 279081 - RNA, 61 nt, Human
auaucauauuccuugauuuaaauuggcuuuugugauugagugaaacuuuauaaagcauaug

SEQ ID NO: 279082 - RNA, 61 nt, Human
cugucagaucacuguucuuuucuuucuuuuugugauugaaaagccuauacuacaauuugaa

SEQ ID NO: 279083 - RNA, 61 nt, Human
ccuuuaggcuguucuuugagguaucaaugaagugauugaauuucaauaccuuaauucagug

SEQ ID NO: 279084 - RNA, 61 nt, Human
cauuaaaugccaaaaaaaaaauacauuaucagugauugaaacguuuacauguacccaaaaa

SEQ ID NO: 279085 - RNA, 61 nt, Human
gacugaagucacacugccugcuccuuugggugugauugagugcccuccuggcuccugggcu

SEQ ID NO: 279086 - RNA, 61 nt, Human
aaauuggacuuaaucaagauuugaagcuuuugugauugaaaagacccuaucaagaagguga

SEQ ID NO: 279087 - RNA, 61 nt, Human
gugauucuugagcacuugaacaaugacugaugugauugaagaacccaucuuucaauucaau

SEQ ID NO: 279088 - RNA, 61 nt, Human
uccaacuacuuauguguguccuguaacacaggugauugaacguaugagagggaaaggcaaa

SEQ ID NO: 279089 - RNA, 64 nt, Human
uaaaguuuggucugguaugaaaugggacuguuuaacaagcaaggcucuuaggggacacuguuga

SEQ ID NO: 279090 - RNA, 64 nt, Human
auauuuccucugggcuucuucuaguuucugccuuacaagcaaugcuguucuguaaauuuauuga

SEQ ID NO: 279091 - RNA, 64 nt, Human
accauuaaugcugcugaauaucuuuaaacucugcacaagcaaguguguagcuuaaggccacuac

SEQ ID NO: 279092 - RNA, 61 nt, Human
uuuggggacauaugccucagucagucauucagugauugauccaaaauuauuuacugagugc

SEQ ID NO: 279093 - RNA, 61 nt, Human
ucaguacccgcccuccaucaaugguggucgugugauugaagccuacaaggggcagaccacg

SEQ ID NO: 279094 - RNA, 61 nt, Human
uuggaggacugauggugucaaccaaaggcaugugauugauuaaugauucccccuuagaaag

SEQ ID NO: 279095 - RNA, 61 nt, Human
ugggaaugaaugucagugugacugaucucucgugauugauaagaaccuuuugagugccuua

SEQ ID NO: 279096 - RNA, 61 nt, Human
uaccccgauguaacagucucccuuauggucagugauugaugaccucgauauggauuuagau

SEQ ID NO: 279097 - RNA, 61 nt, Human
uuguugaacguuauacuggucuuccucacuggugauugauaagcuccuuucuagccaguuu

SEQ ID NO: 279098 - RNA, 61 nt, Human
cuuuuuaaggagaggcacuuuccaacugaaggugauugauguagggaaauguuuguacuau

SEQ ID NO: 279099 - RNA, 61 nt, Human
uugauccacuuaucuauggauauuuuucucugugauugauagacuacacaagaagucauau

SEQ ID NO: 279100 - RNA, 61 nt, Human
uuacaguguaucucgaagucuuccaucagcagugauugaaguaucuguaccugcccccacu

SEQ ID NO: 279101 - RNA, 61 nt, Human
cuugcccugaacauacacaugcugggccauugugauugaagucuucuaacucugucucagu

SEQ ID NO: 279102 - RNA, 61 nt, Human
acuuuaugccugaauaacauuuagcaguauugugauugaaaaauugccauauuuugaugua

SEQ ID NO: 279103 - RNA, 61 nt, Human
uuaccugucuuuucuccauauuuuaagcuaugugauugaaguaccucuguucauaguuucc

SEQ ID NO: 279104 - RNA, 61 nt, Human
aaauugaaccucacagacguuccuguuuuuugugauugagaaacuggucaaugaacaggaa

SEQ ID NO: 279105 - RNA, 64 nt, Human
aggaggaagauggugacaugauuugguuagaagcacaagcaaacugaucagccucccagaccug

SEQ ID NO: 279106 - RNA, 64 nt, Human
ggaaaugucauuacaguaugaauuauaauuauuuacaagcaauggcuuuuguggccaucauuug

SEQ ID NO: 279107 - RNA, 64 nt, Human
uuuacagucuaguacuuauuacaugcugcuauacacaagcaaugcaagaaaaaaacuuacuggg

SEQ ID NO: 279108 - RNA, 61 nt, Human
guuuaauauauauuuuuaaaacauuucacuagugauugaauucuacuuuugccaucugaau

SEQ ID NO: 279109 - RNA, 61 nt, Human
uuuauauuaaaguaauuaaagaaaauguauugugauugaaauuauuuuguccuccacaaga

SEQ ID NO: 279110 - RNA, 61 nt, Human
agccucaggagcgaucgcuccccuggagagggugauugaguguggagaucaccggggccgc

SEQ ID NO: 279111 - RNA, 61 nt, Human
uuuagacuuuaccuuauuugugauuacuguagugauugauugauugauuacuauuaacuac

SEQ ID NO: 279112 - RNA, 61 nt, Human
agcucuuuuuuuuuuuuuuuccccuuuccuggugauugauuuuacaaaagaaaguaagcug

SEQ ID NO: 279113 - RNA, 61 nt, Human
auuugcuuuauuuuauuauuuuaaagcuacugugauugauagcauuguaagaaucgggaca

SEQ ID NO: 279114 - RNA, 61 nt, Human
gagcccaggauaccugcccuggacuuaaauugugauugaaguggagagguacucuaggaau

SEQ ID NO: 279115 - RNA, 61 nt, Human
aaauuugaaaguuguaagcacugauguuaaugugauugaucagcaugggcauauguaaaau

SEQ ID NO: 279116 - RNA, 61 nt, Human
uuugaaauauccuuuguguccagugauaaaugugauugaucuugccuuuuguacauggagg

SEQ ID NO: 279117 - RNA, 61 nt, Human
gaaacauuacugggagguggagguggaaaacgugauugaguggacugugggggucuguaga

SEQ ID NO: 279118 - RNA, 61 nt, Human
aaaacagcaaaaccaaauaaaguggagaugagugauugagugagguagauugcugucccgu

SEQ ID NO: 279119 - RNA, 61 nt, Human
uuugcuuugcuuucugcucagcuucuccugugugauugacagcuuugcugcugaaggcuca

SEQ ID NO: 279120 - RNA, 61 nt, Human
cuucugaauaaucuaacaaaggaaaauauaagugauugaaucauaagauauaaggggggua

SEQ ID NO: 279121 - RNA, 64 nt, Human
uguuuuagcaguggaugcaggaguugaugaacagacaagcaaguucugcuucuguccuguuucc

SEQ ID NO: 279122 - RNA, 64 nt, Human
gucauuucuggaagugugaaaauguuaauguucaacaagcaacauuaaaaauagauuugaaaca

SEQ ID NO: 279123 - RNA, 64 nt, Human
ucaccgacuuuacacaguauuuaauugaauacaaacaagcaacagcaacaaauccaccuccacc

SEQ ID NO: 279124 - RNA, 61 nt, Human
auaaagacuaacacaaacuuaaugauuaaaagugauugagucucauagucuuucauuugcu

SEQ ID NO: 279125 - RNA, 61 nt, Human
acaguaagcccuccugggaugucugugccaugugauugacuuacaagugaaacugucuuau

SEQ ID NO: 279126 - RNA, 61 nt, Human
aaauuguuauuaagagcaaaagaaaaauaaagugauugaugauaguucugcuuauuaauuc

SEQ ID NO: 279127 - RNA, 61 nt, Human
ggcaagugauugaaaauaguaaaugcuuugugugauugaaucugauuggacauuuucuuca

SEQ ID NO: 279128 - RNA, 61 nt, Human
auuucuuacuaaacauuuuguuauugggcaagugauugaaaauaguaaaugcuuuguguga

SEQ ID NO: 279129 - RNA, 61 nt, Human
acuuaauaaauacaauaugcuacucccuguugugauugaacaauacaaauaacaaacaaga

SEQ ID NO: 279130 - RNA, 61 nt, Human
ugcagcuccacugacugacaguaaagcugcagugauugaggacugcaccagaguucugaag

SEQ ID NO: 279131 - RNA, 61 nt, Human
auguucagaauuuuggaaaaaugucacugaagugauugaaagagugccuggcaugcaagga

SEQ ID NO: 279132 - RNA, 61 nt, Human
uacacauaggguguuccugaaaagccccauagugauugagucuucaaaaccaccgauucug

SEQ ID NO: 279133 - RNA, 61 nt, Human
ggcacugagauuuuuuuuucaagauuguaaugugauugaaguuuucaacacaucaacucac

SEQ ID NO: 279134 - RNA, 61 nt, Human
augggaauagcagaaaccaaccaugucuucagugauugaaacucauaccccauugcccuuu

SEQ ID NO: 279135 - RNA, 61 nt, Human
gaccuuggcugcccaacuguguggaggcugagugauugacaaacacagguuggcucauucu

SEQ ID NO: 279136 - RNA, 61 nt, Human
gugauuuuguagguuauuuuauauuugaguugugauugaaaguauguuguauaugguauug

SEQ ID NO: 279137 - RNA, 64 nt, Human
ggccuauuccauucuggauuuugucaagcaguagacaagcaauuagacaagaacuuggaggcac

SEQ ID NO: 279138 - RNA, 64 nt, Human
aaguaugagacuucucugaggaagcagacccuucacaagcaaaaucagccagcacuuugaucac

SEQ ID NO: 279139 - RNA, 64 nt, Human
ucuaaggaguccgaaaccaaguccgaagucaacaacaagcaaugauggcgauggcgauucuagu

SEQ ID NO: 279140 - RNA, 61 nt, Human
guaauuaagaaauacauaugcaaauucuuuugugauugaguaaaagcagcuuaaauuacuu

SEQ ID NO: 279141 - RNA, 61 nt, Human
ucuuuccugggagagacugcuggcuucauuggugauugauuuggaggggggaaaaagggca

SEQ ID NO: 279142 - RNA, 61 nt, Human
gcaacacaggggccuggccucuagagggcuggugauugaggggcccgggcuggcggcaaag

SEQ ID NO: 279143 - RNA, 61 nt, Human
acugaaauauauauaaccucaguccaaaguggugauugauuugaguauuugaaaauuguug

SEQ ID NO: 279144 - RNA, 61 nt, Human
gugccaaguccaucuuugcccagucaauucagugauugauagcaauuuacauuaauugcag

SEQ ID NO: 279145 - RNA, 61 nt, Human
cacgauucucccaaaguaccuugaacucuuagugauugagacucaaaaaaacaaaaaagac

SEQ ID NO: 279146 - RNA, 61 nt, Human
gugauuuacuguacugcucaacacagagggugugauugacacagcaguggaaaaagcgucg

SEQ ID NO: 279147 - RNA, 61 nt, Human
accacaaaugauucaugcaaaugaauuuuuggugauugaaaaauauuaaauucccaauuua

SEQ ID NO: 279148 - RNA, 61 nt, Human
caauaagaacuguuucccucuuguggauguagugauugauccuuaccuuguauaucaucuu

SEQ ID NO: 279149 - RNA, 61 nt, Human
gaacuacuaaaguuuuacagaaaguagugcugugauugauugcccuagccaauucacaagu

SEQ ID NO: 279150 - RNA, 61 nt, Human
gagaauaagaauugcagaaaauaacagugaagugauugaaacuuucuucugaugaguuucu

SEQ ID NO: 279151 - RNA, 61 nt, Human
agauaggaaucuguuggaaggauuugaacaggugauugaauauguuaggaacuuugaggcu

SEQ ID NO: 279152 - RNA, 61 nt, Human
aaaauauuuucuuuucagaaauaguuuacuagugauugaaguacuuuucuuauuuuugcuu

SEQ ID NO: 279153 - RNA, 64 nt, Human
gggcuucagguguuuucaagcacaacccaccacaacaagcaagugcauuuucagucguugugcu

SEQ ID NO: 279154 - RNA, 64 nt, Human
guagucugaagauuccuguguaaaagcaaagcuaacaagcaaugaagacaugaagcaaaauacu

SEQ ID NO: 279155 - RNA, 64 nt, Human
ucuuuuuuagauaccuuugucuggauauggaggaacaagcaaucuuauuuuggaaggcguuaaa

SEQ ID NO: 279156 - RNA, 61 nt, Human
gugaggaaggaggauuugggguggggguggggugauugaauauuuguauaaaaagcaaaaa

SEQ ID NO: 279157 - RNA, 61 nt, Human
ucauuccuguguacaguagcuuaaaauugcagugauugagcauaaccuacuuguuuguaua

SEQ ID NO: 279158 - RNA, 61 nt, Human
uuaaagaagugggacucagccauguuggcgcgugauugacauuacagcacagaaaacuguu

SEQ ID NO: 279159 - RNA, 61 nt, Human
cacauaggcaaggugaguccucuguggaauugugauugaaggauuuuaaagcaggggagga

SEQ ID NO: 279160 - RNA, 61 nt, Human
uccagugugacccugugcuuagugagcaauagugauugagcucauguucccugcaagugcc

SEQ ID NO: 279161 - RNA, 61 nt, Human
uagccguguaacuccugcaaugaauguuuaugugauugaagcaaaugugaaucguauuauu

SEQ ID NO: 279162 - RNA, 61 nt, Human
ccaugguauacaacaaaaauacauuucuuuggugauugaaauuaaggccguauuuacaaug

SEQ ID NO: 279163 - RNA, 61 nt, Human
aauugagauaauaucugugaggugcugaugagugauugacacacagcacucucuaaaucuu

SEQ ID NO: 279164 - RNA, 61 nt, Human
ucaagagcaagggccuccggagauccaaacugugauugaaccaagugcagacuccuaaugc

SEQ ID NO: 279165 - RNA, 61 nt, Human
uucacugccgcagcucuuuccacacggggccgugauugacccuaaaaauugcagaccagca

SEQ ID NO: 279166 - RNA, 61 nt, Human
uauuuuaaaaagagaaguucaacucauaaacgugauugauagguggcugauuuauuuaggu

SEQ ID NO: 279167 - RNA, 61 nt, Human
guuuuuucuuuuuguugucacuuacucccuugugauugaauuuuuucuccugcauccaugg

SEQ ID NO: 279168 - RNA, 61 nt, Human
uucagggugaagauuauauaaagaugagucagugauugaagccaauauucugauucccaug

SEQ ID NO: 279169 - RNA, 64 nt, Human
aaaggguggagaauggaggggaaccaggcguccuuggaggcagcuugggagggugacuguguag

SEQ ID NO: 279170 - RNA, 64 nt, Human
agggacguccuccaacggguggcgcuagaggccauggaggcaguaggacaaggugcaggcaggc

SEQ ID NO: 279171 - RNA, 64 nt, Human
caccacaggggcggguggacgugcuggccgaggaacaagcaaucauguuugcguccccguccgu

SEQ ID NO: 279172 - RNA, 64 nt, Human
uauaccuacaaccaugugauccucaacaaaacugacaagcaaugaaguaagaacuucauucaau

SEQ ID NO: 279173 - RNA, 61 nt, Human
auuuugagaaugcugacacuuuuucagggcugugauugagugagggcauggguaaaaauau

SEQ ID NO: 279174 - RNA, 61 nt, Human
aaaaugacgcuuguccagcaguuugcuucuugugauugaacugaaccuguaaggauucaug

SEQ ID NO: 279175 - RNA, 61 nt, Human
caucauccccccgccccccgacguccagcccgugauugacaagcuggccgaguaugucgcc

SEQ ID NO: 279176 - RNA, 61 nt, Human
ucuauauuaugaaaccucuuuauuagaauuugugauugauucugacaguguauagauuuac

SEQ ID NO: 279177 - RNA, 61 nt, Human
auguaccauuaacugaaaaucauacauaacugugauugaaauuugguuuugauaaaauuau

SEQ ID NO: 279178 - RNA, 61 nt, Human
uugagccuugcauucaugcaacuugauucuugugauugacuuuuuggcucauuagcugaau

SEQ ID NO: 279179 - RNA, 61 nt, Human
aguuaccagaaucuugcugcuaaaguugcaagugauugauaauggauuuuuaacagagaag

SEQ ID NO: 279180 - RNA, 61 nt, Human
aaaaaaaaaaaaaagaggaagaaaaucuuaagugauugaugcuguuuucuuuuaaaaaaaa

SEQ ID NO: 279181 - RNA, 61 nt, Human
uacugguugauguguuuuuuccuuuugccaagugauugagucuguuuaguaguuuccauca

SEQ ID NO: 279182 - RNA, 61 nt, Human
uaaguggcccacaucauggggaaggagugcugugauugacuaguaauggcuaccacgggaa

SEQ ID NO: 279183 - RNA, 61 nt, Human
uuaaggagccucuguuuuggaagggcugucugugauugaacgugaaauguguagugccauu

SEQ ID NO: 279184 - RNA, 61 nt, Human
ucaaacauccauuuucuuugugaacauauuagugauugaaguauuuugacuuuugagauug

SEQ ID NO: 279185 - RNA, 61 nt, Human
ccccagcccccuuuucuugaccauaucacaagugauugaagcccagugaauuagucgguua

SEQ ID NO: 279186 - RNA, 64 nt, Human
ggacuccaacuaagggaaccugaaaucaacucaauggaggcacuucagagcuaaaauaauuaug

SEQ ID NO: 279187 - RNA, 64 nt, Human
cagccacaacccugccaccuuggggaauccagccuggaggcauccccuaagcagccagccaugg

SEQ ID NO: 279188 - RNA, 64 nt, Human
guauccaucaccucuaguauuuauccuuuguauuacaagcaacccaguuuuauacuuuuaguua

SEQ ID NO: 279189 - RNA, 64 nt, Human
aaaaauaccugguccaaacaagaaaaacaaaaagacaagcaaaacuaaagaacugcagucuucu

SEQ ID NO: 279190 - RNA, 61 nt, Human
acggguucaguuuuagacucugaaguugguugugauugacagaacccuuugggagcaaacu

SEQ ID NO: 279191 - RNA, 61 nt, Human
auuuaguguuugugaccaaaggaccaacuaugugauugauaaguucgcaaagaaccuucuc

SEQ ID NO: 279192 - RNA, 61 nt, Human
uuuuaauacauaaaacuuacauucucauaacgugauugauaacuuaggaaguucacaaugu

SEQ ID NO: 279193 - RNA, 61 nt, Human
ggagaaaucugacagacaccagcucagccaggugauugagguuaacaucauccaugauaag

SEQ ID NO: 279194 - RNA, 61 nt, Human
uccccaccagggaggacaacaucuucaugcugugauugaagcauccauucagaacacgagg

SEQ ID NO: 279195 - RNA, 61 nt, Human
gaauggagaggaggaagaaaaugaagaaggagugauugaaugucgggcaaggcacuggcug

SEQ ID NO: 279196 - RNA, 61 nt, Human
uuucuuauguuuauucggagaauuuggagaagugauugaacuuuucaagacauuggaaaca

SEQ ID NO: 279197 - RNA, 61 nt, Human
ucucucagggaaaauaauuuuugaaaguagggugauugaguacuaacuaggaagguauuaa

SEQ ID NO: 279198 - RNA, 61 nt, Human
cagcuucccaaacaccaguguuggauauucugugauugauuuugguccuccuccgcugucc

SEQ ID NO: 279199 - RNA, 61 nt, Human
uuugucauaugcuccuagagaggagaaaggggugauugaaagaaaaaaaaauacuuaaaua

SEQ ID NO: 279200 - RNA, 61 nt, Human
gacacgacuuguaaugaaaguuuggggacaugugauugauugauugauuguaaauaaagga

SEQ ID NO: 279201 - RNA, 61 nt, Human
uuccaaaaaucuuguauauaagauagcaacagugauugaugauaauacuguacuucaucuu

SEQ ID NO: 279202 - RNA, 61 nt, Human
uccagccccaccaugugugcuguuuucagaugugauugagggguguucugcccugccucca

SEQ ID NO: 279203 - RNA, 64 nt, Human
ccuauuugcaaauuagaaugacaguguuggaauuuggaggcaguaguugagcauauucucuagu

SEQ ID NO: 279204 - RNA, 64 nt, Human
acuaagcuauuaauacggcuugucuuaagauaucuggaggcaugcucugaaauccuauauaaaa

SEQ ID NO: 279205 - RNA, 64 nt, Human
aaaaaggugugucaaagauuuuaccugggauaugacaagcaagguuucuggugccuauuuauuc

SEQ ID NO: 279206 - RNA, 64 nt, Human
auauugggggaggaagagagggaggcacguaggaacaagcaaugagaagaccaggaaaagaaag

SEQ ID NO: 279207 - RNA, 61 nt, Human
aaaaauaacacuguuggcacuuauagguaacgugauugauucaguaucuuagaguuuacag

SEQ ID NO: 279208 - RNA, 61 nt, Human
gcuauagcuaaugugcugagcuugugccuuggugauugauugauugauugacugauuguuu

SEQ ID NO: 279209 - RNA, 61 nt, Human
ggucggaaaacaugcuacacacugcauguuugugauugacgggacuguugguauuggcuag

SEQ ID NO: 279210 - RNA, 61 nt, Human
uaauacauaauaaugucuuuuuauauuauaagugauugaguuuaguucauuucaauacauu

SEQ ID NO: 279211 - RNA, 61 nt, Human
uaugauaguugucuugaggaaaagcacuugugugauugaauugugagguaaacuaccugau

SEQ ID NO: 279212 - RNA, 61 nt, Human
gagagacagaguccuccccauugggaacagggugauugaggaaagugaaccuuggguguga

SEQ ID NO: 279213 - RNA, 61 nt, Human
acguacuuaagccaggagaaugaauuauacagugauugaaaauccauuuaauuccuaugac

SEQ ID NO: 279214 - RNA, 61 nt, Human
uuaaaaaccuuucaggaagucaaugauuucugugauugauauaauucuaaggugucugaga

SEQ ID NO: 279215 - RNA, 61 nt, Human
ugguacagauagacaugaagagagcuuagcagugauugagguggugacuaaauauacaguc

SEQ ID NO: 279216 - RNA, 61 nt, Human
cgaucacguccugguuauggaaaaugggaaggugauugaguuugacaagccugaaguccuu

SEQ ID NO: 279217 - RNA, 61 nt, Human
ucuuccuucccagcuccuuaauaaaagcaaagugauugaguagguaauguucaaagugucu

SEQ ID NO: 279218 - RNA, 61 nt, Human
gaaaggaaacauauuguauauuuggcccagugugauugauugcuuuaucuuugguaacuuu

SEQ ID NO: 279219 - RNA, 61 nt, Human
ggaguucaguccccuccucuguggggcucaggugauugaaauguggaugaaacauuucucu

SEQ ID NO: 279220 - RNA, 64 nt, Human
aaaggacgcaagauacucuauagccaagucagcuuggaggcaggauggguugcugagugaaguc

SEQ ID NO: 279221 - RNA, 64 nt, Human
gaaacaccuggcgcagauugcagcgcagcuguguuggaggcaggacugggcuguuuccucagcc

SEQ ID NO: 279222 - RNA, 64 nt, Human
ucuuaaggacaguguucaaauucugauuauuacaacaagcaaacugaaauuaguguuuucauuc

SEQ ID NO: 279223 - RNA, 64 nt, Human; identical to SEQ ID NO: 72647

SEQ ID NO: 279224 - RNA, 61 nt, Human
uuugguuacaguuaacuauuuucggaguguggugauugaagacaauuucaucaucccacug

SEQ ID NO: 279225 - RNA, 61 nt, Human
auucaguacauugccagcucuuggucacugagugauugaguuagggcuccgcaagagacuu

SEQ ID NO: 279226 - RNA, 61 nt, Human
agaauuuguuacucgcuuugggggaaauaaagugauugagaagguaaguuguaacuugcug

SEQ ID NO: 279227 - RNA, 61 nt, Human
ggggccgcugcugucuggugcccugugagcugugauugauugccuuuggucaguaaugcgu

SEQ ID NO: 279228 - RNA, 61 nt, Human
uucuuguuucuacuugucaguuuuguuaaaggugauugaauauaaguaaccaugacuugua

SEQ ID NO: 279229 - RNA, 61 nt, Human
acuuccaguccuuagguuagaugaaaaguaggugauugaaggagaggauugaggguggaag

SEQ ID NO: 279230 - RNA, 61 nt, Human
auuuaacacacaguagcaaauuuugaacgaugugauugauauaaccuaacaaaucugagcc

SEQ ID NO: 279231 - RNA, 61 nt, Human
guucgaggaggacccuagaaagccaggagcugugauugacaguagcuguagguuaccagac

SEQ ID NO: 279232 - RNA, 61 nt, Human
uuugaacagauaaaucauggacagccuuauugugauugaaaugcuuguagguucugugcca

SEQ ID NO: 279233 - RNA, 61 nt, Human
gucugagcuguucuuaacugauccugguuuugugauugacaauauuucaugcucuguagug

SEQ ID NO: 279234 - RNA, 61 nt, Human
auaugccuagauaauggggaaaaaaagucuugugauugacuuucgcaaaauaaacaggauu

SEQ ID NO: 279235 - RNA, 61 nt, Human
cuaacacuucccaggaacugaagugccucaugugauugauucccaggcccaggcagcggag

SEQ ID NO: 279236 - RNA, 61 nt, Human
ucaguucauuuucaguuaucuuugauuauaugugauugacaauguguauuuuugagggagc

SEQ ID NO: 279237 - RNA, 64 nt, Human; identical to SEQ ID NO: 72653

SEQ ID NO: 279238 - RNA, 64 nt, Human; identical to SEQ ID NO: 72659

SEQ ID NO: 279239 - RNA, 64 nt, Human; identical to SEQ ID NO: 72665

SEQ ID NO: 279240 - RNA, 64 nt, Human; identical to SEQ ID NO: 72669

SEQ ID NO: 279241 - RNA, 61 nt, Human
guuaaauuguauaugguugcuuaauuguucugugauugaggaccacugaaaaauaagucuu

SEQ ID NO: 279242 - RNA, 61 nt, Human
auagcaccuugacaucuacaacuuaaaaauggugauugaagcaaaauauguaaacuuguac

SEQ ID NO: 279243 - RNA, 61 nt, Human
ucuaagaaaucagcuuuuuaagcuuccccaugugauugaggacaguuugaaguuaguguuu

SEQ ID NO: 279244 - RNA, 61 nt, Human
cacugucuucacagaaaaaguuugcugacuugugauugagaccuacugucccauugugagg

SEQ ID NO: 279245 - RNA, 61 nt, Human
cugaguuccugaagagccacagacagggugggugauugaugaguugucaaaaugauaggug

SEQ ID NO: 279246 - RNA, 61 nt, Human
aagcauuauaacuguaacguucuuugaguuugugauugauccacauuuuucccccugcauu

SEQ ID NO: 279247 - RNA, 61 nt, Human
caguaacccuugcaguuaagagugugcccaugugauugaguucuagccaauggagugugag

SEQ ID NO: 279248 - RNA, 61 nt, Human
cuccaguauuggagguggggcccauugggaggugauugaaucauggaaguggauuucucaa

SEQ ID NO: 279249 - RNA, 61 nt, Human
auuccuccugucuccucugucaguuugugaagugauugacauuuuguagcuaguuuaaaau

SEQ ID NO: 279250 - RNA, 61 nt, Human
gagaacaggucuuuguggagaucuaaaggcagugauugauuucacagggagcucuaaucuc

SEQ ID NO: 279251 - RNA, 61 nt, Human
agagccuaagaugcuggugaagaauagcugugugauugaauaggcucaaaggagaguucag

SEQ ID NO: 279252 - RNA, 61 nt, Human
gcugacauucuaaaauuauaauuaucugacugugauugauguauccugagguuccuagauc

SEQ ID NO: 279253 - RNA, 61 nt, Human
uaucugcagccaggagacuugcaagggauuggugauugacagagaggacucgugcgcuguu

SEQ ID NO: 279254 - RNA, 64 nt, Human; identical to SEQ ID NO: 72675

SEQ ID NO: 279255 - RNA, 64 nt, Human; identical to SEQ ID NO: 72681

SEQ ID NO: 279256 - RNA, 64 nt, Human; identical to SEQ ID NO: 72684

SEQ ID NO: 279257 - RNA, 64 nt, Human; identical to SEQ ID NO: 72690

SEQ ID NO: 279258 - RNA, 61 nt, Human
gucagaccaggcuuuuggucuuucaaaauuugugauugaaagcacuuuagugacuuggauu

SEQ ID NO: 279259 - RNA, 61 nt, Human
cugggccuuuguuuccuuguuggucagaggagugauugaaccagcucaucuccaaggaucc

SEQ ID NO: 279260 - RNA, 61 nt, Human
uacuugauguaguccugugccuugaggcugagugauugacaucuuuuuggcacauuacacu

SEQ ID NO: 279261 - RNA, 61 nt, Human
uuuguauuuuugugguuaccuucuaagacaagugauugaucuaaaguuccuuuuaaguuua

SEQ ID NO: 279262 - RNA, 61 nt, Human
acggacacagggagaagcuaguuucuuucaugugauugaaaugaugacucuacuccuaaaa

SEQ ID NO: 279263 - RNA, 61 nt, Human
ccaggugugcaucuuacuggaugagguugcugugauugagauaguuaaauacaugcuaauu

SEQ ID NO: 279264 - RNA, 61 nt, Human
agaaaaacaacacaguguguuuuuggaagaugugauugauuuguaaaccgcauuaaaugcu

SEQ ID NO: 279265 - RNA, 61 nt, Human
auugccugauuuccuguccuuuacagcccgagugauugauguaucuaaugggaaaguucau

SEQ ID NO: 279266 - RNA, 61 nt, Human
cgggccuggcuggcacccgguuuacagggaggugauugaggacgucguuaugauuugauuu

SEQ ID NO: 279267 - RNA, 61 nt, Human
accauguaccauguguuagaguuggcaaaaugugauugacuagagauggacaugaauugau

SEQ ID NO: 279268 - RNA, 61 nt, Human
uuguagcuaauuaggaagcuugauuugcuuugugauugaaaaauugaaaaccucuuuccaa

SEQ ID NO: 279269 - RNA, 61 nt, Human
agaaaaaggcagacuaagaaucagaagccaugugauugaugucugacgugagucugucuca

SEQ ID NO: 279270 - RNA, 61 nt, Human
gcaugcagcuacccaggcccacccaucacgugugauugacauguagguacccugccacggc

SEQ ID NO: 279271 - RNA, 64 nt, Human
gcacagaggcagcccgugggucucugucucagucuggaggcagcagggaugcugcugggagucc

SEQ ID NO: 279272 - RNA, 64 nt, Human
auuacagaugagaacagaggggacaugaacuccuuggaggcagggcugggaagggacccugggc

SEQ ID NO: 279273 - RNA, 64 nt, Human; identical to SEQ ID NO: 72694

SEQ ID NO: 279274 - RNA, 64 nt, Human; identical to SEQ ID NO: 72698

SEQ ID NO: 279275 - RNA, 61 nt, Human
cuguuuuaauauauugucugauuggguaaaugugauugaccacuugcugucucuguuguau

SEQ ID NO: 279276 - RNA, 61 nt, Human
uugaaaaagaaaaguguugggaaugaagcaagugauugauuggaaaacauacugaauggaa

SEQ ID NO: 279277 - RNA, 61 nt, Human
cuuacacauuuuaaaacguuuucucuuccuugugauugaagaugaaaggaguaagaaauua

SEQ ID NO: 279278 - RNA, 61 nt, Human
augguuguauuauuuuuuaaaaaaauuccaagugauugaaaccuacacgagauacagaauu

SEQ ID NO: 279279 - RNA, 61 nt, Human
uuucuucucacauuuauauuuuugugauuuugugauugauuauaugucacuuugcuacagg

SEQ ID NO: 279280 - RNA, 61 nt, Human
uuaauuuuuauauaugcaggaaagaauagaagugauugaauauuguuaauuauaccaccgu

SEQ ID NO: 279281 - RNA, 61 nt, Human
aggccguugggaagaucaaacaauauuggaugugauugaacuuuauaaacuggagagcuac

SEQ ID NO: 279282 - RNA, 61 nt, Human
acuuuuguacuuaauccauuucuugauuaaagugauugaaaugguuuuaauguucuuuuga

SEQ ID NO: 279283 - RNA, 61 nt, Human
aaugggaaauaaauaaauaauauagccuggugugauugaugugagcuuggacuugcauucc

SEQ ID NO: 279284 - RNA, 62 nt, Human
caaaggaaaggaacaaauuuucaaagacuugggggagugaaggcagagccuggugcagaugg

SEQ ID NO: 279285 - RNA, 62 nt, Human
uccuccccuccacugccugcauggggggcgcggggagugaccaggcgggggccucaccgccc

SEQ ID NO: 279286 - RNA, 62 nt, Human
gguccugcucagcccgaggagcagucuggcaugggagugaggccccguccuucucacugccu

SEQ ID NO: 279287 - RNA, 62 nt, Human
cacagcucgaucuucuacuugccuguggggaggggagugacagguccacacaccacacuggg

SEQ ID NO: 279288 - RNA, 64 nt, Human; identical to SEQ ID NO: 72704

SEQ ID NO: 279289 - RNA, 64 nt, Human; identical to SEQ ID NO: 72709

SEQ ID NO: 279290 - RNA, 64 nt, Human; identical to SEQ ID NO: 72715

SEQ ID NO: 279291 - RNA, 64 nt, Human; identical to SEQ ID NO: 72719

SEQ ID NO: 279292 - RNA, 62 nt, Human
gcuuacuacuucuagaagaaagcagagugccagggagugagauugcaucccugggcuuagaa

SEQ ID NO: 279293 - RNA, 62 nt, Human
agggaugcucuuuguaaauaucggaugggugugggagugagggguuaccucccucgccccaa

SEQ ID NO: 279294 - RNA, 62 nt, Human
ugacacguucacacgacuauguagcacaugccgggagugaucugccagacauucuaauuuga

SEQ ID NO: 279295 - RNA, 62 nt, Human
aucugacaccauguagaagcuaaaaguuuagagggagugaggguuuucucaagaccuuccuc

SEQ ID NO: 279296 - RNA, 62 nt, Human
gaacuaacaaauauaaaggaacuugaaauguggggagugauaauaguccagugauuaaacua

SEQ ID NO: 279297 - RNA, 62 nt, Human
gcacuuguauuuccguauauuuuguuucgcgggggagugagggggaagaacacggaugaaaa

SEQ ID NO: 279298 - RNA, 62 nt, Human
ggcaacaaguaaugccuugaaggccaggaggugggagugaggagcccauacucagccugcug

SEQ ID NO: 279299 - RNA, 62 nt, Human
ggcaacaaguagggccuugaaggccaggaggugggagugaggagcccauacucagccugcug

SEQ ID NO: 279300 - RNA, 62 nt, Human; identical to SEQ ID NO: 279299

SEQ ID NO: 279301 - RNA, 62 nt, Human
gucgauggagauggacuaggcuggcccgggaggggagugacagagggacguucuaggagcaa

SEQ ID NO: 279302 - RNA, 62 nt, Human
cuccauccgcucucacgccuccugcaggaucugggagugaggguggagagucuuuccucacg

SEQ ID NO: 279303 - RNA, 62 nt, Human
uagauggucugcagaacguguuuggggugagugggagugaggggcaauguuacuuuuucucc

SEQ ID NO: 279304 - RNA, 62 nt, Human
gaagggaucacguggcaaaagagcauguacaugggagugagagaaaaagagagagagagaca

SEQ ID NO: 279305 - RNA, 64 nt, Human
cgauaccucguuccaccuuggcgucacggugggcuggaggcagcccccccccccacaacacuug

SEQ ID NO: 279306 - RNA, 64 nt, Human
ccugggcagggcucuggugggagagggagacagauggaggcaguggcuggugggccacucucuc

SEQ ID NO: 279307 - RNA, 64 nt, Human
gacuggugggaucuaagaaagggaggugaguggguggaggcagggugacgucucugaacccaaa

SEQ ID NO: 279308 - RNA, 64 nt, Human
agcucuuaguuauagguggcucccagggucuaauuggaggcaccuggcugggguccacucugac

SEQ ID NO: 279309 - RNA, 62 nt, Human
gauggaggcugugcccagagccccaggaaaaugggagugagaagaugccuggcgagguuuug

SEQ ID NO: 279310 - RNA, 62 nt, Human
gauauuugcuggagugcuggcuccacgcccuggggagugagcuuggugcgguaggugcuggc

SEQ ID NO: 279311 - RNA, 62 nt, Human
auuuggcuucuguacuggcugaggacaggggagggagugaaguugguuugggguggccugug

SEQ ID NO: 279312 - RNA, 62 nt, Human
ugaggguggggagggagagagagggagggagagggagugaagagccugcccuccuauaugga

SEQ ID NO: 279313 - RNA, 62 nt, Human
aaacagucuccuaaccagccauccccuccugugggagugagcuggggguuuuguccauagcu

SEQ ID NO: 279314 - RNA, 62 nt, Human
uggaggcagcacaaggaggaugugauaugugggggagugagcacuggguugggagccggguc

SEQ ID NO: 279315 - RNA, 62 nt, Human
gggccugugagucaaagaaaagguccuuuucagggagugacaaguaguaauuaggcugaguu

SEQ ID NO: 279316 - RNA, 62 nt, Human
augcuuguggauugaggguaggagguuuggaugggagugagacagaaguaagugggguugca

SEQ ID NO: 279317 - RNA, 62 nt, Human
ccccuccccaagcagggagccugggaugggcagggagugauagccaaacuccuuggucaccu

SEQ ID NO: 279318 - RNA, 62 nt, Human
aagggaaaggcugcaugggggagccccaucuagggagugaugggcccggcauugccugaggc

SEQ ID NO: 279319 - RNA, 62 nt, Human
aaggcaucaguguugauuaacacucauaacuagggagugagugguaguuacuuaaguaauug

SEQ ID NO: 279320 - RNA, 62 nt, Human
ugacacguucacauaacugugcagcacaugccgggagugaucagucggacauuuuaauuuga

SEQ ID NO: 279321 - RNA, 62 nt, Human
cggaagcugaaccugagggagacaacggcagagggagugagcaggggagaaauagcagaggg

SEQ ID NO: 279322 - RNA, 64 nt, Human; identical to SEQ ID NO: 72725

SEQ ID NO: 279323 - RNA, 64 nt, Human; identical to SEQ ID NO: 72731

SEQ ID NO: 279324 - RNA, 64 nt, Human; identical to SEQ ID NO: 72734

SEQ ID NO: 279325 - RNA, 62 nt, Human
acagucuucccaaggauugaguuauggacuuugggagugagacaucuucuugcugcuggauu

SEQ ID NO: 279326 - RNA, 62 nt, Human
aaaagaaaagucaaggguagggugggccuucagggagugagggauuaucuuuuuuuuuuuuu

SEQ ID NO: 279327 - RNA, 62 nt, Human
agccugcuugugucaggugaaggugagggaucgggagugauggagaugcauacagaucagca

SEQ ID NO: 279328 - RNA, 62 nt, Human
uuuuccuccccugugaaaacguaacuacuguugggagugaauugaggauguagaaagguggu

SEQ ID NO: 279329 - RNA, 62 nt, Human
aacauuuuacuuaaaugauuugaggggugggagggagugaacuacugaguuugccagaguga

SEQ ID NO: 279330 - RNA, 62 nt, Human
acacuuccacacuauuuauuuggggaugggcugggagugacaguagccuaguaguucagcua

SEQ ID NO: 279331 - RNA, 62 nt, Human
uccaucucaccucggggggcugcccucaaugugggagugaccccagccagaucugaaggaca

SEQ ID NO: 279332 - RNA, 62 nt, Human
cccuguagagaccaugcaugcucuaagccuuagggagugagaccaacacccaucccugccca

SEQ ID NO: 279333 - RNA, 62 nt, Human
cugaauguaauuucgauacuguguacauagcagggagugaucggggugaaauaacuugggcc

SEQ ID NO: 279334 - RNA, 62 nt, Human
agucuccggguugaauuccaguguaucccacugggagugaauggaucaugaggugggauggc

SEQ ID NO: 279335 - RNA, 58 nt, Human
uuaccucccugaagcuguagggccuugugggagugaucugguggccagaacaggauuu

SEQ ID NO: 279336 - RNA, 62 nt, Human
uagugugucugugauauuccauuuucauggcagggagugaucaggaagaaggcuuccuaggg

SEQ ID NO: 279337 - RNA, 62 nt, Human
ccgauggguugguguuugggaaauucugagaugggagugagaucugaucggauccugggaag

SEQ ID NO: 279338 - RNA, 64 nt, Human
ugccucaagccucccguggaaggcgagaugguccuggaggcaguccucaccucugccucccucg

SEQ ID NO: 279339 - RNA, 64 nt, Human
cgaccuccagcucucaguuacaagugcaggcgacuggaggcaggacuccugggucccugggaaa

SEQ ID NO: 279340 - RNA, 64 nt, Human
aggcugagaccuacugggcugcauucucagacaguggaggcauucuaagucacaggaugagaca

SEQ ID NO: 279341 - RNA, 64 nt, Human
uaucccagagagcucauuuagggcugaaacacuguggaggcagugguuguggaggacauuucug

SEQ ID NO: 279342 - RNA, 62 nt, Human
auaucaaucaccagccucccacuguggugccugggagugaccugguaaagugcaacgugcca

SEQ ID NO: 279343 - RNA, 62 nt, Human
gggacugcucuuuaggaaggggagcagcggcugggagugagcagggcagggugggggcaggg

SEQ ID NO: 279344 - RNA, 62 nt, Human
guuggaccguuuauuuacacaaguauuguugagggagugauuuuuucuugauaugcgucugu

SEQ ID NO: 279345 - RNA, 62 nt, Human
ugggugauuugagcuacaucuuguugagcaaggggagugaaaccacagaaacuguuaaauug

SEQ ID NO: 279346 - RNA, 62 nt, Human
accuggcgggagcccugggguagugucagagcgggagugaggcuggugcaggagcaguucug

SEQ ID NO: 279347 - RNA, 62 nt, Human
cugugguauaugacugcuucgaggcugcccuagggagugagguacgaaucugguccuauacu

SEQ ID NO: 279348 - RNA, 62 nt, Human
cccgccuaaaucccuucuacuucacuccucaggggagugaagugccuuaagaaacaaagccc

SEQ ID NO: 279349 - RNA, 62 nt, Human
uuaaauguucgaaugaaaguaugauuguaaaagggagugaauugguuuaaaaauauauguau

SEQ ID NO: 279350 - RNA, 62 nt, Human
guguguguguguggcggggggugcugagggaggggagugagucacaggagccugucccccaa

SEQ ID NO: 279351 - RNA, 62 nt, Human
ucuguggguuggucuucagccagcauucuggugggagugacuggcauuaacaagacuggaaa

SEQ ID NO: 279352 - RNA, 62 nt, Human
cauucuuuguggagauggucuggugccuagcugggagugagcagcagcccauccccuguuca

SEQ ID NO: 279353 - RNA, 62 nt, Human
uuggucgaggaguaacaauacaaauggauuuugggagugacucaagaagugaagaaugcaca

SEQ ID NO: 279354 - RNA, 62 nt, Human
guguguguguuguguuaauucuuucucauguugggagugagaaugccgggccccucagggcu

SEQ ID NO: 279355 - RNA, 64 nt, Human
cgccgcuccaccgucugcccuccaaggacccgcauggaggcagugggcuggcagcuuccugcug

SEQ ID NO: 279356 - RNA, 64 nt, Human
aggggagauguggaggggacacaucugguugccuuggaggcagaagcugugaguuucagaacag

SEQ ID NO: 279357 - RNA, 64 nt, Human
aaaggugggcugugagcuugaaucgggagugggguggaggcacaggccaaccugcgcucucccc

SEQ ID NO: 279358 - RNA, 64 nt, Human
gcuccuggcuuccagacugggccuugguguuugcuggaggcaucggccaggugagguggcggau

SEQ ID NO: 279359 - RNA, 62 nt, Human
gaaaggaaggccaaauugggucgggggagggugggagugaggaaguuaaaaucacuauaggg

SEQ ID NO: 279360 - RNA, 62 nt, Human
aagcuuuaacugugagggcacagccuugaagugggagugaugagauucugagggacccauga

SEQ ID NO: 279361 - RNA, 62 nt, Human
augggugccccccacccccaguucagucuguagggagugaagccacagacucuuacguggag

SEQ ID NO: 279362 - RNA, 62 nt, Human
ccuguagauguuugagucaggaagguaaggcggggagugacugaauaaacucugccuuuuaa

SEQ ID NO: 279363 - RNA, 62 nt, Human
ggcaaggggcgggaucuccacugggggcuuacgggagugagcgguuuucccaaaacaagccc

SEQ ID NO: 279364 - RNA, 62 nt, Human
uuucucacguaauaaacaaauuaucgagacaugggagugaccagcaccuuuucuuuaaaugg

SEQ ID NO: 279365 - RNA, 62 nt, Human
ucuggguuuaucauguuuuaauuuuagagacagggagugaugaaucaucaccgguugucccc

SEQ ID NO: 279366 - RNA, 62 nt, Human
ggauccucuuggccuucuuuuuuggggauggugggagugaagggggugaaucuuaaaagcuu

SEQ ID NO: 279367 - RNA, 62 nt, Human
cuugcugugucugagguauaaauauagucugugggagugagaggcaaaccaguccuacccaa

SEQ ID NO: 279368 - RNA, 62 nt, Human
uuuugcuuuuaacuuugcccccaacguuuaaagggagugaucugcuuuacaugauacuaugc

SEQ ID NO: 279369 - RNA, 62 nt, Human
uuuuugguuuagauuauggaugcaugaaguaagggagugaaucaguuucuuguuuauauuuu

SEQ ID NO: 279370 - RNA, 62 nt, Human
aaggguaagggcgcauggaauggggcuaaggugggagugaacacuggggugaauaaauuuua

SEQ ID NO: 279371 - RNA, 62 nt, Human
gcuuucacucaaccaagggggccacagcacuggggagugaaacugccccgccucacccugcg

SEQ ID NO: 279372 - RNA, 64 nt, Human
cucacuaagccccggcacuucuaguggucucaccuggaggcaagagggaggggacagaggcccu

SEQ ID NO: 279373 - RNA, 64 nt, Human
cuccugccuccaccgccuugguuuugcuuccugcuggaggcagggcaccugcugcgacccagau

SEQ ID NO: 279374 - RNA, 64 nt, Human
acugggagaugggucggucacccagacagcucuguggaggcagggucugagccuugccuggggc

SEQ ID NO: 279375 - RNA, 64 nt, Human
gcccaggcuccugggccagugcucucuccucaaauggaggcagccauggccugaagugcagauc

SEQ ID NO: 279376 - RNA, 62 nt, Human
auccauuauuacuuuagggcuugauucucuuggggagugacuuggcuaagcuucagguguaa

SEQ ID NO: 279377 - RNA, 62 nt, Human
uguccacauugaggccuauacagaaaaucauggggagugauuucuauuuuuuuauugucuaa

SEQ ID NO: 279378 - RNA, 62 nt, Human
uucacucaauaugcagcuuccuguuucaguaggggagugaccuaacuggccuaauuaauggg

SEQ ID NO: 279379 - RNA, 62 nt, Human
cuaccgauuaaauucauuagugugaaagaggugggagugagguuuucuggccugaagcaguc

SEQ ID NO: 279380 - RNA, 62 nt, Human
auaagaaaacauguaaagggggaauauauggggggagugagcucucucagacccuugaagau

SEQ ID NO: 279381 - RNA, 62 nt, Human
cacugguucaggcucccuuugggcgaaauccugggagugaugcucuaaaaauccaccuuucc

SEQ ID NO: 279382 - RNA, 62 nt, Human
uccugugacuguggagcucuggaaggcuuggugggagugaauuugcccacaccuuacaauug

SEQ ID NO: 279383 - RNA, 62 nt, Human
aguugaauagcuuuucuucugcaaugggaguugggagugaugcguuugauucugcccacagg

SEQ ID NO: 279384 - RNA, 62 nt, Human
caauccuccauucuuccucuccagauauuuuugggagugacaaacauucucucauccuacuu

SEQ ID NO: 279385 - RNA, 62 nt, Human
gagcacgaggccuucagaaaagacacuucaaugggagugaacauuucuaacuaaggacagga

SEQ ID NO: 279386 - RNA, 62 nt, Human
uuaagccaaaacaauguuuaaaccuuuuuugggggagugacaggaugggguauggauucuaa

SEQ ID NO: 279387 - RNA, 62 nt, Human
ggacaugcucaccucuagccuuaaggggggcagggagugaugauuugggggaggcuuuggga

SEQ ID NO: 279388 - RNA, 62 nt, Human
ccaaaggccagcuggccucaucuaaucuggaagggagugacuuguuaguuccaggccuccuu

SEQ ID NO: 279389 - RNA, 64 nt, Human
ggacuugaaaucaaauguuugggaauggugcccuuggaggcaaccucccauuuuagauguuuaa

SEQ ID NO: 279390 - RNA, 64 nt, Human
cauguagcugccgggucaucagcaagaaaugaauuggaggcaggaagaguccaagccugaauaa

SEQ ID NO: 279391 - RNA, 64 nt, Human
cgcugcccgcucagcccagcuguugggaacagcauggaggcagauguggggcugagcuggggaa

SEQ ID NO: 279392 - RNA, 64 nt, Human
agccggcuaugaaagggagcgagccccucggcucuggaggcaaucaagcagacauagaagagcc

SEQ ID NO: 279393 - RNA, 62 nt, Human
ggcucccuuuguuguuugcauuuuaaggaacugggagugaggcucagagaaguugagggacc

SEQ ID NO: 279394 - RNA, 62 nt, Human
gcagcauaucuucucuuuuagugucauuacgagggagugauggcgggaaucucagucgcacu

SEQ ID NO: 279395 - RNA, 62 nt, Human
ugcuaagugcagugaugaggaauaaagccaaggggagugagaugaggugggcuugaaaguac

SEQ ID NO: 279396 - RNA, 62 nt, Human
uaagaauguguuuucaaaacaguguguguauugggagugauggguauguguuagguauguga

SEQ ID NO: 279397 - RNA, 62 nt, Human
ucacuuguaaacuugugaaaaucugaacauaggggagugagguauggccacugaggauuuuu

SEQ ID NO: 279398 - RNA, 62 nt, Human
ucuccuacagcauuuuguauaaaacacaaugagggagugaaauguuacccaauuaggcuugu

SEQ ID NO: 279399 - RNA, 62 nt, Human
uuguuuuaauuuguguuuuuuggggggagggagggagugaacuugcugauucuguagcaaaa

SEQ ID NO: 279400 - RNA, 62 nt, Human
agguggcauccacacuggacagcagggaggaggggagugaggguaacauuuccauuucccuu

SEQ ID NO: 279401 - RNA, 62 nt, Human
aaacaaacaaacaaaaaaaacaaggguggguggggagugaagcacgaggaauaccuaugaag

SEQ ID NO: 279402 - RNA, 62 nt, Human
uccacccagaaggcuuucauuuguacucugcugggagugacugggaaaaacuccuucccugc

SEQ ID NO: 279403 - RNA, 62 nt, Human
cugugagcaugggaagggccugcagugggcgcgggagugagcugaggaacuggggugcgccc

SEQ ID NO: 279404 - RNA, 62 nt, Human
uccacauuuaaaaauuauaaaagcaaggacuugggagugacugaugaaucaugaaauugcug

SEQ ID NO: 279405 - RNA, 62 nt, Human
gacaaaacaacauugaauucccagccccauuggggagugaucucuuggacacagagccccca

SEQ ID NO: 279406 - RNA, 64 nt, Human
gcacaguugacuugggaagcaguauuacuagaucuggaggcaaccacaggacacuaaacuucuc

SEQ ID NO: 279407 - RNA, 64 nt, Human
ucaccccuacugcacuaccaaauucauuugacuuuggaggcaaaauguguugaagugcccuaug

SEQ ID NO: 279408 - RNA, 64 nt, Human
ccuucugccaccagccccuccccagacucucagguggaggcaacagggccaugugcugcccugu

SEQ ID NO: 279409 - RNA, 64 nt, Human
acaacaucuaccagauauagcagacaagcacccauggaggcagguuucgggccugaagcagauc

SEQ ID NO: 279410 - RNA, 62 nt, Human
aaacaucaaacaucaaucguguguccugauuugggagugauuggggggauggggugggagag

SEQ ID NO: 279411 - RNA, 62 nt, Human
guggcucuucuaaccucagccaaacacagagcgggagugacgggagccuccucugcuugcau

SEQ ID NO: 279412 - RNA, 62 nt, Human
caaaggggagccagaaaugggcaguucucccagggagugagcagcuacuguaacuuuuuuaa

SEQ ID NO: 279413 - RNA, 62 nt, Human
acuuuccaauuaugagauggacuguggguacugggagugaucacuaacaccauaguaauguc

SEQ ID NO: 279414 - RNA, 62 nt, Human
augcuacaaucuucauaacuaauauuuuaauggggagugacugcuuaauuggcaugagguuu

SEQ ID NO: 279415 - RNA, 62 nt, Human
gguggaacaaacagaaaugacugugguguggagggagugagccagcagcuuaaguccagcuc

SEQ ID NO: 279416 - RNA, 62 nt, Human
caaaccguagugggguggaggcugcuggaggugggagugaggagaugagggcagggucucaa

SEQ ID NO: 279417 - RNA, 62 nt, Human
uacguuaaaacacacaacucacugugaucuaugggagugauaucaaauacaaacgauguugu

SEQ ID NO: 279418 - RNA, 62 nt, Human
agacuuuguguguaugggggacuuguauguaugggagugaggaguuucagggccauugcaaa

SEQ ID NO: 279419 - RNA, 62 nt, Human
gucagaaaguggauugagugcugucagaaagugggagugauuuugcaacuggguaucuuaau

SEQ ID NO: 279420 - RNA, 62 nt, Human
cuguuugcuuaaagucaguggguucuggugcagggagugagaagugggggaagugaaaggga

SEQ ID NO: 279421 - RNA, 62 nt, Human
ucuguguuguggggucaaccguacaauggugugggagugacgaugaugugaguauuuagaau

SEQ ID NO: 279422 - RNA, 62 nt, Human
uaaaaaauccacuaguaauaucagaauguccagggagugacugucacuacaaugaugguuua

SEQ ID NO: 279423 - RNA, 64 nt, Human
auuuggguaaaagaauggguaauguuuaaacauguggaggcauguggagcuuuauacaaacagg

SEQ ID NO: 279424 - RNA, 64 nt, Human
acgguuccugccugucuuggggguugguggaggguggaggcaguucugccagccguggcagggc

SEQ ID NO: 279425 - RNA, 64 nt, Human
uugaauuaauucugacagccccuaugaggaaaucuggaggcagguaacaguucccauuuuagag

SEQ ID NO: 279426 - RNA, 64 nt, Human
uccccuccucuuagccacaaaagaggggggagacuggaggcaccccugcagcaggggcacuucc

SEQ ID NO: 279427 - RNA, 62 nt, Human
ggaaagccucuccuggggccacuguugggggugggagugagcccaccacagaggccacaggc

SEQ ID NO: 279428 - RNA, 62 nt, Human
cguuaauaccuggcugcgugugcagcugaggagggagugaaccucaagccuaaauaccuguu

SEQ ID NO: 279429 - RNA, 62 nt, Human
aguucuucuuguaacccugaggugccagcgcggggagugaggaggggucagggggcuaagga

SEQ ID NO: 279430 - RNA, 62 nt, Human
ucuuugcauggggcugggggagauggggcgcugggagugagugcauggugcuuugucccagc

SEQ ID NO: 279431 - RNA, 62 nt, Human
acuuaccaaaacauaucauuaaacugagugcugggagugaguugguaauaugagaugggaag

SEQ ID NO: 279432 - RNA, 62 nt, Human
acaucauuuuaaggcauggagcugagaagucugggagugaggagaucccaguccggcuaagc

SEQ ID NO: 279433 - RNA, 62 nt, Human
aacgcacuuucuaaaucuagaucagcagagaugggagugauuuucuggaaagagaugugauc

SEQ ID NO: 279434 - RNA, 62 nt, Human
caagccuguggugaauguuaguauuuaccauagggagugaaguggaguuaugguuucauuca

SEQ ID NO: 279435 - RNA, 62 nt, Human
agcaguugaagagguugugugggugggcuguugggagugaggauggaguguucagugcccau

SEQ ID NO: 279436 - RNA, 62 nt, Human
caaugggaauccuagaggggauggaagacgcggggagugagcugggugggcccugcuagcga

SEQ ID NO: 279437 - RNA, 62 nt, Human
gggccgucucccuuggcccagagacggagugugggagugauucccaacuccuuucugcagac

SEQ ID NO: 279438 - RNA, 62 nt, Human
gacaucaugaagcaucaaagcacuguuuaacugggagugauaugauguguagggcuuuuuuu

SEQ ID NO: 279439 - RNA, 62 nt, Human
guuuuccaucuguuuuugauaagaauaagaaagggagugagugugaagauggugguuagcag

SEQ ID NO: 279440 - RNA, 64 nt, Human
caugcucccuuucucggcacccccuuguuggagauggaggcagcagacgugcagugccauaagg

SEQ ID NO: 279441 - RNA, 64 nt, Human
gggaaagagagaugggccaggcagagaacagaacuggaggcaguccaucuagggaaugggacug

SEQ ID NO: 279442 - RNA, 64 nt, Human; identical to SEQ ID NO: 72738

SEQ ID NO: 279443 - RNA, 64 nt, Human; identical to SEQ ID NO: 72742

SEQ ID NO: 279444 - RNA, 62 nt, Human
aauuagccaugagccaaaaguaucaauaaacggggagugaagaaacccguuuuauacaauaa

SEQ ID NO: 279445 - RNA, 62 nt, Human
guguuccuuuuguuguucacugcucagcugaugggagugauucccugagacccaguaugaaa

SEQ ID NO: 279446 - RNA, 62 nt, Human
uuuuccucuccagagggaucaggguccucuuagggagugacgggcuuuucauauauuuuugc

SEQ ID NO: 279447 - RNA, 62 nt, Human
caagccugugacucaacuccaggggcaagauggggagugagcugauggcuccgagacugguc

SEQ ID NO: 279448 - RNA, 62 nt, Human
ggcacacuuuuugcaggcaacaaaaugugccugggagugauggauuuuaaugugcuccagag

SEQ ID NO: 279449 - RNA, 62 nt, Human
gccuccacugaugcaggagcugccaccccaaggggagugaccccugccagcacacccugcag

SEQ ID NO: 279450 - RNA, 62 nt, Human
gcccaugucucuuguucucugcaaugccucaagggagugagcucucaaccacagauagcugu

SEQ ID NO: 279451 - RNA, 53 nt, Human
aggccaagugcugcaagugagcugggagugaccagaagaaaugacgcagaagu

SEQ ID NO: 279452 - RNA, 62 nt, Human
caggccacugucacucuuugugggaggggacggggagugagguugggcagugugguggaugg

SEQ ID NO: 279453 - RNA, 62 nt, Human
aaacaaaaaaugaaaagucugucuggacgaaggggagugagcuugagccuuugauaucuugc

SEQ ID NO: 279454 - RNA, 62 nt, Human
auuaaaaaugcuucuguaaaguuuucaagguagggagugauuuuauuauuguguauaucuaa

SEQ ID NO: 279455 - RNA, 62 nt, Human
caggaguggaggacagugaacuuccuugaagagggagugacuaaggugaccuccaaccugcc

SEQ ID NO: 279456 - RNA, 62 nt, Human
ugggagucucccugccucacuccucuaggcaggggagugaugcuucaggacgugacaggcug

SEQ ID NO: 279457 - RNA, 64 nt, Human
acgagaauugugcuacuuauacugguucauaaucuggaggcaagguucgacugcagccgccccg

SEQ ID NO: 279458 - RNA, 64 nt, Human
acaaagaugguuguucgggguuugggauugacacuggaggcagauaguugcaaaguuagucuaa

SEQ ID NO: 279459 - RNA, 64 nt, Human
agccaagggugaggaggcaggaagcaccuccgguuggaggcacccaggcuugccagccacagag

SEQ ID NO: 279460 - RNA, 64 nt, Human
ugggaagaccuggcuuccgcgagagccuuguuccuggaggcaggagcgccccgccauccugggu

SEQ ID NO: 279461 - RNA, 62 nt, Human
agggaacaaaaguggaaacauggcuacuuuuggggagugauauuuuaaaaaauaaguugucu

SEQ ID NO: 279462 - RNA, 62 nt, Human
ugaugaccgugugacaauagagcgaagccccggggagugaacgguccaaccucugcauucag

SEQ ID NO: 279463 - RNA, 62 nt, Human
guguguguguguguguguguguguguguguuagggagugagggucucucaggccuccagguc

SEQ ID NO: 279464 - RNA, 62 nt, Human
ggugggagcuggaauggggagcaaugagaggagggagugagacuguuggcuuaggaagggug

SEQ ID NO: 279465 - RNA, 62 nt, Human
caggagagcagugaggagcugcugugugaccugggagugauuuugacaugggggugccaggu

SEQ ID NO: 279466 - RNA, 62 nt, Human
cacggugccaccaugcggaccggggggaggcagggagugaggguguggcuccccugggcuac

SEQ ID NO: 279467 - RNA, 62 nt, Human
uugacuucuccaaagccucuguguaggugguagggagugagucaaagcacuaauagaccagg

SEQ ID NO: 279468 - RNA, 62 nt, Human
uuauagcugcuuggauucucugagaaaugauggggagugagugaucacugguauuaacuuua

SEQ ID NO: 279469 - RNA, 62 nt, Human
ugaaggaggggacccccauccugggggaugcugggagugagugagugagauggcugagugag

SEQ ID NO: 279470 - RNA, 62 nt, Human
aggguuuucaccuuagcaacaaugggagcugugggagugauuuuggccacacugucaacauu

SEQ ID NO: 279471 - RNA, 62 nt, Human
cgcgucugucgcccaauaaaggcaucuuugucgggagugaggguguccugacaucugaaggg

SEQ ID NO: 279472 - RNA, 62 nt, Human
cgccaacccaccgugauucaucuucugaagcugggagugaaacugggucagcuguaaccugu

SEQ ID NO: 279473 - RNA, 62 nt, Human
aguguaggcugcccuuggugaagcugugacaagggagugaccauccauccccuccacaggag

SEQ ID NO: 279474 - RNA, 64 nt, Human
agcgcugagugcaggaaggaccccaggucuucccuggaggcagccuccugaaggaaggaagauu

SEQ ID NO: 279475 - RNA, 64 nt, Human
gcccugugcugaacuugcuguucaucuguugaucuggaggcaggacagcuucugggacacacaa

SEQ ID NO: 279476 - RNA, 64 nt, Human
ugcaccuaaagaggaaauuggguuuauaagaaaauggaggcaaagaacuuaaguuuuaagaaaa

SEQ ID NO: 279477 - RNA, 64 nt, Human
uaaagguuggagauuguuacgcuugaaauuaaguuggaggcaaauugauaauuacuuaguaaug

SEQ ID NO: 279478 - RNA, 62 nt, Human
uaucuugaagguuugaaaaacaaccaaagaaagggagugaggacuauggcugcauguccucu

SEQ ID NO: 279479 - RNA, 62 nt, Human
ugaaacaacgguuugcaagccaccaaauaccagggagugaaggauagugauucuugagaggg

SEQ ID NO: 279480 - RNA, 62 nt, Human
aaaagacagucaaaggacggaaguggaaggacgggagugagcuggggagcuguugaucuuuc

SEQ ID NO: 279481 - RNA, 62 nt, Human
cuuguauccccugcaggcugagugcauuuggagggagugaguggcccuuucggauccaggga

SEQ ID NO: 279482 - RNA, 62 nt, Human
uaacuuggacagagcagcagagaaaagcugaugggagugagagaacucagcaagccaaccug

SEQ ID NO: 279483 - RNA, 62 nt, Human
cuaaucucacucaggccuccagggauccaugggggagugaaaccaauucucagagaacaacc

SEQ ID NO: 279484 - RNA, 62 nt, Human
gaaugagcagucccuaaugguauugggcaguugggagugaguuuaggcagcuucucuguaac

SEQ ID NO: 279485 - RNA, 62 nt, Human
uccucaugaauacuuuaggguaggggagggaagggagugagugaugcucaggggcugucaaa

SEQ ID NO: 279486 - RNA, 62 nt, Human
cccaagcagaggccuugcccugcugggaccccgggagugagagcagcccaaggauccagggu

SEQ ID NO: 279487 - RNA, 62 nt, Human
gggccucagugccccauucucacugcuaucuggggagugauuaccccgggagacugaacugc

SEQ ID NO: 279488 - RNA, 62 nt, Human
aacucugggugacccugggcacccacagaacugggagugagggcuccucaggcagccacaag

SEQ ID NO: 279489 - RNA, 62 nt, Human
gcacccaaaccucccuucccuuucgugucgaagggagugaggagugaauuaaggaagagagc

SEQ ID NO: 279490 - RNA, 62 nt, Human
accucaaugucauuuacuucccucauauuaaugggagugaaaugucuaauacuuuugccccu

SEQ ID NO: 279491 - RNA, 64 nt, Human
ggcagucacuggaucaggauccaggggagggagauggaggcacccaaacuggaacuucauuugu

SEQ ID NO: 279492 - RNA, 64 nt, Human
gaagacggagcugccccagcuguggcuggggguguggaggcagugggaugaacugggggacagg

SEQ ID NO: 279493 - RNA, 64 nt, Human
aguuucgugcacugugguuaacaggagggcugccuggaggcaguggcugagccagaaaguaaca

SEQ ID NO: 279494 - RNA, 64 nt, Human
acccccaggagggcggggguggguggagcaggaguggaggcagccugcagaggaagggugcggg

SEQ ID NO: 279495 - RNA, 62 nt, Human
aaauacaacccaaggcaacugggguacucacugggagugaaaaugacuucuucacaacagac

SEQ ID NO: 279496 - RNA, 62 nt, Human
ggcauuuuaaauacaaugguauguuauugccagggagugagguacaagacgauggcucaugu

SEQ ID NO: 279497 - RNA, 62 nt, Human
ugcagagcugggcaugggagagaaacgggcuggggagugaggccaggagugggauucagcug

SEQ ID NO: 279498 - RNA, 62 nt, Human
uaucccuggcauuacguuucuagguagaaucugggagugaauuugucccauucccucucugu

SEQ ID NO: 279499 - RNA, 62 nt, Human
uuuuuuuuuuuuaaccccccagggggguaguugggagugagacuauaggccauaaagaaugg

SEQ ID NO: 279500 - RNA, 62 nt, Human
aggggucagaugcuggaaggggccgcuuucuggggagugaggugagacauagcggcccgggc

SEQ ID NO: 279501 - RNA, 62 nt, Human
aaggaacagccccagugcacugggggaggggagggagugaggggcaguggugcccuuccugc

SEQ ID NO: 279502 - RNA, 62 nt, Human
aaugaaaguguugggaaaaaagugaugugacagggagugaagacacuugauaccagacucug

SEQ ID NO: 279503 - RNA, 62 nt, Human
gccugaucacugaauaaagaacugagauggaggggagugaacagugccuauuguugaaaagu

SEQ ID NO: 279504 - RNA, 62 nt, Human
aaccucauaggauaauguggugccucugaaaggggagugauggaagccuugcuuucacauca

SEQ ID NO: 279505 - RNA, 62 nt, Human
aggagacugcccaaggcuugcagaagagguaagggagugaggcacuccuaucccagucuccc

SEQ ID NO: 279506 - RNA, 62 nt, Human
ucuuugggcuccccagagaccugacaguauuagggagugaagggaggaggggcccuggcuau

SEQ ID NO: 279507 - RNA, 62 nt, Human
accugucucauaguguuuauaaguggccugcugggagugagugcucccucuguucccucccu

SEQ ID NO: 279508 - RNA, 64 nt, Human
cucuaucucauagaugugaaucugggggccaggcuggaggcagggauggggacagggugggugg

SEQ ID NO: 279509 - RNA, 64 nt, Human
cagaauuuuagcaucagaacuagcuuucugggauuggaggcaaaccaucaagguggucccucuc

SEQ ID NO: 279510 - RNA, 64 nt, Human; identical to SEQ ID NO: 72746

SEQ ID NO: 279511 - RNA, 64 nt, Human; identical to SEQ ID NO: 72750

SEQ ID NO: 279512 - RNA, 62 nt, Human
uggaugggggagugaaauugugagguggaugggggagugaaaucuccaugguuccugcuuug

SEQ ID NO: 279513 - RNA, 62 nt, Human
gugcuagauuaauuucauugugagguggaugggggagugaaauugugagguggaugggggag

SEQ ID NO: 279514 - RNA, 62 nt, Human
ugauacacacuuucaugaugggagaaaaaugugggagugaaaugguauuuagaaagcagcag

SEQ ID NO: 279515 - RNA, 62 nt, Human
acuaacuuuauuaggagaagccuaugccagcugggagugauugcuaagaggcuccagucuuu

SEQ ID NO: 279516 - RNA, 62 nt, Human
uuccgcagauagcuggguuagaagagagacaggggagugagcuagucaaaugugaaaaaugc

SEQ ID NO: 279517 - RNA, 62 nt, Human
ucucacugugaaccacacgaaaccucaacugggggagugaggggcuggccaggucuggaggg

SEQ ID NO: 279518 - RNA, 62 nt, Human
agaucgugccacugcucuccagccugcaugacgggagugagacaccaucucaaaaaauacau

SEQ ID NO: 279519 - RNA, 62 nt, Human
ccgagcugcugugucacgcccucagccugcuagggagugacaagcccaagucauucuugauc

SEQ ID NO: 279520 - RNA, 62 nt, Human
guuggcagccaagaacccacaccaugaagacagggagugaggggccuuugugcccaacucca

SEQ ID NO: 279521 - RNA, 62 nt, Human
cacuugccagggguuuucucucugugugagaggggagugauuuaagcaauggugucuggagu

SEQ ID NO: 279522 - RNA, 62 nt, Human
guuuuuaaauuugugucuauuggggugggaaggggagugaggcccuaaagauaggaauucac

SEQ ID NO: 279523 - RNA, 57 nt, Human
cuccagaauugcaaccauagccuuauggggagugagagagagggcacgagaacccaa

SEQ ID NO: 279524 - RNA, 62 nt, Human
gaguuuucaagaugccuuguugcuuugaagaagggagugaugucaauucucuuguuacauuc

SEQ ID NO: 279525 - RNA, 64 nt, Human
gguaaggcuggugagguccuggugccuaucugccuggaggcaaaggccuggacagcuugacuug

SEQ ID NO: 279526 - RNA, 64 nt, Human
ggcgagucuuccuccuuguccuaguuacugccuauggaggcaguguuuagaucaagaaggccuc

SEQ ID NO: 279527 - RNA, 64 nt, Human
agagcccccgggaagggcgcaagucaaagagcacuggaggcaccgccggcgauggacguccagg

SEQ ID NO: 279528 - RNA, 64 nt, Human
ggagaagcccugucaccugugcacaucuugcugguggaggcauggcccacugugcaggacccca

SEQ ID NO: 279529 - RNA, 62 nt, Human
ccaggccagccucuguaaguuggccacacuuggggagugaguguggguaugacuuuacccuc

SEQ ID NO: 279530 - RNA, 62 nt, Human
uuccaagcaggaggauguggcaggggagggcugggagugaguagcucuguguuuagaguugg

SEQ ID NO: 279531 - RNA, 62 nt, Human
ugcgcgcacagucucccgggacuuggacucgagggagugacgaggaggagcuccgagcugcg

SEQ ID NO: 279532 - RNA, 62 nt, Human
auacuuaaacagagcaaauguaguaggaacaagggagugagccuuauaagaggacguucagu

SEQ ID NO: 279533 - RNA, 62 nt, Human
uggcucuucccuccaugccugucagcugccuggggagugagccucccugguccuuccugccu

SEQ ID NO: 279534 - RNA, 62 nt, Human
ccagcgcccgcagacacccuggcaucucaagagggagugaggagaggauugcagggacuuuu

SEQ ID NO: 279535 - RNA, 62 nt, Human
gaucuguagugucaugggugcugccgcaggcagggagugagcugggggugccugcagccuuc

SEQ ID NO: 279536 - RNA, 62 nt, Human
gaauggccugcuccaggccauggcugggggcagggagugaggggacaauuucugagugaaag

SEQ ID NO: 279537 - RNA, 62 nt, Human
uccccccaguuuuauuuuuagcuuuggcuucagggagugacagccaucacaaauagccacau

SEQ ID NO: 279538 - RNA, 62 nt, Human
uggcaauucaauaaauaaauaaaauaagaagggggagugaaacagagaaagaaaaggcaaaa

SEQ ID NO: 279539 - RNA, 62 nt, Human
agcuauuguugguugcuaaaugugaaucacgcgggagugagugugcccuucacacugugaca

SEQ ID NO: 279540 - RNA, 62 nt, Human
augucugaacgaccgucuuuugaaaacucaucgggagugaauggcaucucguuguaaguacu

SEQ ID NO: 279541 - RNA, 62 nt, Human
agccuuuccuccauuuucuguguauuggugaugggagugauaaccuuuugggggagcuuucu

SEQ ID NO: 279542 - RNA, 64 nt, Human
gggggagcccuggugaagggcuggaccugacccauggaggcaggaggaagaccuggcuuucuug

SEQ ID NO: 279543 - RNA, 64 nt, Human
aauggaugcuuucuguugagaaaccaguaccuuguggaggcagguucuugggcugcuacuccag

SEQ ID NO: 279544 - RNA, 64 nt, Human
uuuaaaagcaugaacuguguauaaaauggggaaauggaggcaggagacuuugagguaacauggu

SEQ ID NO: 279545 - RNA, 64 nt, Human
cagccacggccccggguccaggagaagugcucccuggaggcacgcaccacugcuucccacuggg

SEQ ID NO: 279546 - RNA, 62 nt, Human
ccugauaucuggggcuucugaaggucuguacugggagugaagaguggcuuagcuauuuaccc

SEQ ID NO: 279547 - RNA, 62 nt, Human
cuguucugucuuguggcagggcucuaccaggagggagugagaucuggggacacaguggcuuc

SEQ ID NO: 279548 - RNA, 62 nt, Human
gguuuuagccauaauagggcccgguacgauuugggagugacauuucuguaaagaagaggaaa

SEQ ID NO: 279549 - RNA, 62 nt, Human
cucucuuccagaagaagcuaaaggaagagaaggggagugagaguucagggaggcccuuccca

SEQ ID NO: 279550 - RNA, 62 nt, Human
ccugcuaucacaccuugggcuuggaggucauugggagugagcagauguggggguggccagcc

SEQ ID NO: 279551 - RNA, 62 nt, Human
augugcagacgcauuuuugguaaucacagcuggggagugaaaagggugccacuggcaccacu

SEQ ID NO: 279552 - RNA, 62 nt, Human
gcuguacaacuucugggccucucuuggacccugggagugaggguggguguggguggaagccu

SEQ ID NO: 279553 - RNA, 62 nt, Human
aggacauugcggacagccacggccaggccagagggagugacagaggcagccccauucugccu

SEQ ID NO: 279554 - RNA, 62 nt, Human
uugccucugccucugacacacagcucuguccugggagugagcugguuuuuagcggagacgga

SEQ ID NO: 279555 - RNA, 62 nt, Human
gcuuguuuuccugcaauuagacggucccauaugggagugaugggagacagugacagaucauc

SEQ ID NO: 279556 - RNA, 62 nt, Human
cccagcagaggccuuagucccauuuggggcuugggagugacauuugcuugaggcuuauacac

SEQ ID NO: 279557 - RNA, 62 nt, Human
gggcucucaguuccgauuucccaggcugaauugggagugagaugccugcaugcuggguucug

SEQ ID NO: 279558 - RNA, 62 nt, Human
ccaugucuuauugugcaucagauaauuuauaugggagugaaacccuacaaauguuaagaaug

SEQ ID NO: 279559 - RNA, 64 nt, Human
guacguucuggacgcguuuuguuggcugggcuucuggaggcacuggcaaggucaaacugcauuu

SEQ ID NO: 279560 - RNA, 64 nt, Human
auccugggaaauccagcuaccagggcccucccaguggaggcaucuuacauuuaggcuacuucaa

SEQ ID NO: 279561 - RNA, 64 nt, Human
gggaaaguugcugcuauugauucagggucugucuuggaggcagaggacccuugguggauaguug

SEQ ID NO: 279562 - RNA, 64 nt, Human
cucaguugucuacaggacaguggucagggaugccuggaggcauauauccagcugccaccaaggg

SEQ ID NO: 279563 - RNA, 62 nt, Human
aggcuugcuguggggcucagguugaaaguguggggagugacacugccuaggcauccagcuca

SEQ ID NO: 279564 - RNA, 62 nt, Human
ucuuuggacccugaggcccagagggccugcaagggagugaguugauagcacagacccugccc

SEQ ID NO: 279565 - RNA, 62 nt, Human
ccaucuggugucugcauggguguuggcagccugggagugaucacugcacgcccaucgugcac

SEQ ID NO: 279566 - RNA, 62 nt, Human
gcagagagaggcagggaggccagugagggccagggagugaguguuagaagaagcuggggccc

SEQ ID NO: 279567 - RNA, 62 nt, Human
uguagacuuacacucaacccucaugugagcgugggagugaggguggcggucccuugccaagu

SEQ ID NO: 279568 - RNA, 62 nt, Human
uuuauuccagacaaggcaggaaagucugaguugggagugacaguggcuggagagaagcagau

SEQ ID NO: 279569 - RNA, 62 nt, Human
aaaaccuucgucaauugcacaccggugcuguugggagugaccaaaccacaugaaccagacuu

SEQ ID NO: 279570 - RNA, 62 nt, Human
aggcuccucuucugcagugccagcugacuuaagggagugaacuaccugugaaguagaaaauc

SEQ ID NO: 279571 - RNA, 62 nt, Human
agcgccuccaacccuagcaaaagugcaagauggggagugagaggcugggaauggaggggcag

SEQ ID NO: 279572 - RNA, 62 nt, Human
uucuuugcacgggguugauuaauuucugcacagggagugagauuauuaaaguaacacacaca

SEQ ID NO: 279573 - RNA, 62 nt, Human
aagggaggcagggagagggcgaaggcaggaaggggagugagaaagaggcugaaauuaagagg

SEQ ID NO: 279574 - RNA, 62 nt, Human
gggccccacccagcucgguguucugagaccucgggagugaggacgcagggguaugaggcagg

SEQ ID NO: 279575 - RNA, 62 nt, Human
cggcucacagagccaccgcaacucugcccagcgggagugacaccacugaugccacagaagcc

SEQ ID NO: 279576 - RNA, 64 nt, Human
agacgaagaguguguuggggcaaaggggcucgguuggaggcauuucccauaagacugagcccuc

SEQ ID NO: 279577 - RNA, 64 nt, Human
gcccuacaggcccagaacuuucucacaucugaaauggaggcauugcaaugaaaaggcacccaca

SEQ ID NO: 279578 - RNA, 64 nt, Human
ccaauuuaagaguccugaggcagaaccugguggcuggaggcauucccagagguggggaagagag

SEQ ID NO: 279579 - RNA, 64 nt, Human
ucuccuuuaccauacuacuggacuggacucaggcuggaggcagauagacacaguauagggggaa

SEQ ID NO: 279580 - RNA, 62 nt, Human
cuaucaggaguucuaggaacucagugcaauacgggagugacccagcuacugaaccagccacg

SEQ ID NO: 279581 - RNA, 62 nt, Human
ucgcuugaccggucuuguucacauaggccucugggagugauuugguucuuugcccuaauguu

SEQ ID NO: 279582 - RNA, 62 nt, Human
gacagccggaucuuggagacaauuacaagacggggagugagacuccugauugcucuggaagc

SEQ ID NO: 279583 - RNA, 62 nt, Human
agcagcagccuccugaccaaugcccgcucuuggggagugaggauucugcacguggaugguac

SEQ ID NO: 279584 - RNA, 62 nt, Human
aauguuugccugucugaacugugaagacacuugggagugauuguggucuaauuuccaaccug

SEQ ID NO: 279585 - RNA, 62 nt, Human
gaaguccuugcaagcuaauucuuugaccuguugggagugaggaugucugggccacucagggg

SEQ ID NO: 279586 - RNA, 62 nt, Human
accucccugcaccccuccccucuauagagcaggggagugaagggguaugucaggcggggaag

SEQ ID NO: 279587 - RNA, 62 nt, Human
cggcucuggaguaccgucugccccagacaagugggagugaaauggggguggggggaagcacu

SEQ ID NO: 279588 - RNA, 58 nt, Human
auauaaaggcgacugaauagauggaugagggagugaaaacuuugcauagaauccucac

SEQ ID NO: 279589 - RNA, 62 nt, Human
auuuauauauaagguaauguaggguuauauuugggagugacugcaagcauuuuuccaucugu

SEQ ID NO: 279590 - RNA, 62 nt, Human
aggacaggcauuuacacugaugaaacgccacugggagugaggaagccagacuccagagacac

SEQ ID NO: 279591 - RNA, 62 nt, Human
cuucauucuggcggugagaggcccacgaccacgggagugagagcugguguggcgaggcccgg

SEQ ID NO: 279592 - RNA, 62 nt, Human
gacaagcugugggaagcguucuuggaagcauggggagugauguacauccaaccgucacuguc

SEQ ID NO: 279593 - RNA, 64 nt, Human
caaucuuuuuuccuuuuuccugacccccuccuucuggaggcaguugggagcuauccuuguuuau

SEQ ID NO: 279594 - RNA, 64 nt, Human
gaccagcuucugcagaggauaaaaucauugucucuggaggcaauuuggaaauuauuucugcuuc

SEQ ID NO: 279595 - RNA, 64 nt, Human
uucaugugaaucccagggggcagagaggaggcucuggaggcacacaggaugcagccuucccccu

SEQ ID NO: 279596 - RNA, 64 nt, Human
uagcuggcuaucucuggccuuacuaacaccccccuggaggcaugccccuuuucuccagcacaca

SEQ ID NO: 279597 - RNA, 62 nt, Human
uacaccaggcuguuaauauugauuaccuugaggggagugagaaaaggagaaguagagauaag

SEQ ID NO: 279598 - RNA, 62 nt, Human
gugauugaguuagggcuccgcaagagacuuuggggagugaaguggaucucuuccucaucuuu

SEQ ID NO: 279599 - RNA, 62 nt, Human
agcucccagugggaaaacgugugcuagaguuggggagugagaugaguggugcuguccaugga

SEQ ID NO: 279600 - RNA, 62 nt, Human
uggugaauauucaguuuaggggaacaguucuagggagugagacauuuuugggagcagaggaa

SEQ ID NO: 279601 - RNA, 62 nt, Human
gggaaugaauuguccuuuucuaggaagcacgggggagugagacaggcuggguccugccagcu

SEQ ID NO: 279602 - RNA, 62 nt, Human
cuuuucagugaucuggauaaguguucugaccagggagugacagguuaugacauuuccauguc

SEQ ID NO: 279603 - RNA, 62 nt, Human
uauuuuuuuuuaagauaaaaacugcacaaaaggggagugagagagacuaguuuccacauccu

SEQ ID NO: 279604 - RNA, 62 nt, Human
agauuccgucguucuuacugagucugcagcgggggagugaacaagugugcagauguaaguuc

SEQ ID NO: 279605 - RNA, 62 nt, Human
caccaugccuuacugcauccagccaggcugcagggagugaggcacacggugaacauggccac

SEQ ID NO: 279606 - RNA, 62 nt, Human
uccuugggagcaagcagcacuaaaucacaucagggagugauuaguccuggggaaauucagug

SEQ ID NO: 279607 - RNA, 62 nt, Human
cuagaguuagaacacuauguacucugcacagggggagugaaguaauauuggcuuagaagacu

SEQ ID NO: 279608 - RNA, 62 nt, Human
gucuuagcacuuccucgaugugccugcccugagggagugaguucacauuugagacaacugca

SEQ ID NO: 279609 - RNA, 62 nt, Human
uucagaguccccuccuaggccugcagacaugagggagugaaugauugauuuaccugcuucuc

SEQ ID NO: 279610 - RNA, 64 nt, Human
auccugggaaauccagcuaccauggcccucccaguggaggcaucuuacauuuaggauacuucag

SEQ ID NO: 279611 - RNA, 64 nt, Human
aagacccugaaaaaggggcgggcaguagggaagguggaggcacacuccucuucuguuggacagg

SEQ ID NO: 279612 - RNA, 64 nt, Human
gcuguggaaguccgacugggcaguggaaugcugauggaggcagacgcugccgagggggugugga

SEQ ID NO: 279613 - RNA, 64 nt, Human
aaggacacucaucugugccccacguccagaucccuggaggcagcugaccaaugaugggcgguga

SEQ ID NO: 279614 - RNA, 62 nt, Human
cucuguaauuuacaagauuuuucaaauugguggggagugaauaaauacaauuuaaaagucag

SEQ ID NO: 279615 - RNA, 62 nt, Human
uggagacugaagaggaagaggaggaggagaaggggagugagcggccgcccccagggcggaga

SEQ ID NO: 279616 - RNA, 62 nt, Human
auuuuguggugccugagauggccgagggcacagggagugagcuguaugugugaggaauuugg

SEQ ID NO: 279617 - RNA, 62 nt, Human
aaggagugccuuccuuuugcucccuccuagcugggagugacgggugggagugugugugccca

SEQ ID NO: 279618 - RNA, 62 nt, Human
uggccccgagcuggcggagggagggaagaggagggagugacgggaggggaggaggucagcga

SEQ ID NO: 279619 - RNA, 62 nt, Human
gaagaaagccauguggcggcagaggcagagaugggagugaugcggacggacacaaacuaagg

SEQ ID NO: 279620 - RNA, 62 nt, Human
ccucccaaaaguaucgggggcuggggcaggaggggagugaggcaggugacagugagguccug

SEQ ID NO: 279621 - RNA, 62 nt, Human
ucuguauuuuuaaaauuucucaaaauaggaaugggagugaggaugggaaugcuguaucugug

SEQ ID NO: 279622 - RNA, 62 nt, Human
uccaaugcugccuugaucucugucugggaggggggagugaaggggcccuagcccccugcacu

SEQ ID NO: 279623 - RNA, 62 nt, Human
ugucauucacuuugagagcccgaggggugggagggagugaugcaggcagacgcugcgccucc

SEQ ID NO: 279624 - RNA, 62 nt, Human
aaguaggggccaguuuccaauucacccugucagggagugagccggaucugacguuccuugug

SEQ ID NO: 279625 - RNA, 62 nt, Human
gcaaugggaagcuguuggaugguuugaugaaggggagugacaggauccgauguaccuauuua

SEQ ID NO: 279626 - RNA, 62 nt, Human
caccccuuggccccucacauccucuccaggaagggagugaggggcugugacauuuuuccgga

SEQ ID NO: 279627 - RNA, 64 nt, Human
cuggggccaaggcuacauaggggccccauucaccuggaggcaucucaggccaggccaugccagg

SEQ ID NO: 279628 - RNA, 64 nt, Human
agcauugaaaugacugucauuaaccacacaguccuggaggcagagaugcaguuaccuacccuag

SEQ ID NO: 279629 - RNA, 64 nt, Human
ggaagcaacccaauccucugucuccuugcuccaauggaggcagaagagcccaggacccaagcgu

SEQ ID NO: 279630 - RNA, 64 nt, Human
guucuggacaguucugccuccugcccugucccaguggaggcaguaauucuaggagauccuaagg

SEQ ID NO: 279631 - RNA, 62 nt, Human
accuuucauauuuuaggugcugaaaauggugagggagugagugcucugcacccuugggcuuu

SEQ ID NO: 279632 - RNA, 62 nt, Human
uucccucguuauugaucuauagacauuaggaagggagugagacggcuccuccaccauccuca

SEQ ID NO: 279633 - RNA, 62 nt, Human
acucucucacagucugugucagucggggauuugggagugauguaucugggugguuguggccc

SEQ ID NO: 279634 - RNA, 62 nt, Human
uagagggcuccgggugugugugcaggugucgggggagugaccuccacuccucaaccucgggc

SEQ ID NO: 279635 - RNA, 62 nt, Human
ccuggggaacuggcuuacuuggggccccacccgggagugaugguucuggcugauuuguuugu

SEQ ID NO: 279636 - RNA, 62 nt, Human
ggggaacuaagggguaucucugcuacaggaaugggagugagaacauucacuuuuugaaggac

SEQ ID NO: 279637 - RNA, 62 nt, Human
aguguagugaggaggagcccagaggaccccaggggagugaggagggagaacuuggaagggug

SEQ ID NO: 279638 - RNA, 62 nt, Human
ggcgacuguccugcguggguagcccucggccggggagugaggccaccaaccaaagucaguuc

SEQ ID NO: 279639 - RNA, 62 nt, Human
gccaucuucaaugguuugacucuucucauucugggagugauuggucuauucaccaucccccu

SEQ ID NO: 279640 - RNA, 62 nt, Human
uugugaguggacacugaccaugagucccuggggggagugaucccccaggcaucgugugccau

SEQ ID NO: 279641 - RNA, 62 nt, Human
agcuuacaaauguaagguuucugacaagacuugggagugauucacaccuggaacaacauacu

SEQ ID NO: 279642 - RNA, 62 nt, Human
cauacaaauguaagguuuguaacaaggcuuuugggagugauucacaccuggcacaccauacu

SEQ ID NO: 279643 - RNA, 62 nt, Human
aaaggaccuugggugguaaagcuguacuuggugggagugagggcguggggaggaaccaugca

SEQ ID NO: 279644 - RNA, 64 nt, Human
ccgaggaagcggggucuggcccugguggggcuuguggaggcagcaggugaagaggcagggcccc

SEQ ID NO: 279645 - RNA, 64 nt, Human
ccccuggggcugagaaaggguccgcccgguggccuggaggcaggcgccgggagcgcaguagcac

SEQ ID NO: 279646 - RNA, 64 nt, Human
ggaaaccccaagacccagagaggaagggucaaccuggaggcaggaaaaaguuggcuuggaucca

SEQ ID NO: 279647 - RNA, 64 nt, Human
agguacuacaaacacgauuuccgcaaccuggaguuggaggcauugcaggcuguccagccucauc

SEQ ID NO: 279648 - RNA, 62 nt, Human
ugugcucuuguuguuuggcauuuggggugacagggagugacccagaggccaccacugcuuuu

SEQ ID NO: 279649 - RNA, 62 nt, Human
cagcuggcuggaccagaaaguagagggcccaugggagugacugcacccuugguggcugcugg

SEQ ID NO: 279650 - RNA, 62 nt, Human
uuuuucccaugugucccccaguacuuauaaaagggagugaaaagaccgagcuguaaggcaug

SEQ ID NO: 279651 - RNA, 62 nt, Human
guacccuggacagugccuaacuccuuacagaagggagugaaaaccucuuucggaaaugauug

SEQ ID NO: 279652 - RNA, 62 nt, Human
uguuugagagauuucccaggacauacaagauggggagugagaugaguaauucagggaagaga

SEQ ID NO: 279653 - RNA, 62 nt, Human
ggaucauugaggcuucuggugacaucauucaagggagugaagacaaucagaacuuugagagu

SEQ ID NO: 279654 - RNA, 62 nt, Human
gguucuguggacauaugauccccacaaacugugggagugauuggccaggccuuguuuuguuu

SEQ ID NO: 279655 - RNA, 62 nt, Human
aacgccuucacuggaucagccgcuggaacugagggagugagcuuggggacuuccuucgucag

SEQ ID NO: 279656 - RNA, 62 nt, Human
cagguuuauucuaaacccagugagaggugagggggagugaugaaaggggaucagcuguauuu

SEQ ID NO: 279657 - RNA, 62 nt, Human
acccaagcaaugggggcgcccacagagcaguggggagugaggggauguucucuccgggaccu

SEQ ID NO: 279658 - RNA, 62 nt, Human
ccugucaaaaccaugccugagaggucccggcugggagugacagggugcuucuuagauucuau

SEQ ID NO: 279659 - RNA, 62 nt, Human
ugcagccccucagcccccaggauugaccucuggggagugaugguagcguuggugccaggccg

SEQ ID NO: 279660 - RNA, 62 nt, Human
cuauaagucauucaguauucuuuucucucugugggagugauacagucuugguuuguauuuug

SEQ ID NO: 279661 - RNA, 64 nt, Human
acaagcagcccaagaaacucugaacggggcccaauggaggcaaacuugagcaaauaauugggau

SEQ ID NO: 279662 - RNA, 64 nt, Human
cugagcccagccaagacuucaguguugacugcuuuggaggcacaaacccaugcaagcguuaguu

SEQ ID NO: 279663 - RNA, 64 nt, Human
aagcagcagaacugacauugggacccagguccauuggaggcaucuuuuaguuaugcgcuugaga

SEQ ID NO: 279664 - RNA, 64 nt, Human
aucuacccugccuguacuacucuagggaguaugcuggaggcagagggcaagggaggggugguau

SEQ ID NO: 279665 - RNA, 62 nt, Human
uaagacagcuuggucuggucugugcagaaguggggagugaugggcagguucggcagccuaac

SEQ ID NO: 279666 - RNA, 62 nt, Human
gaggggcugugccgugcuagaguccucagggagggagugaccucgacccuggcugugcugca

SEQ ID NO: 279667 - RNA, 62 nt, Human
aggcaggggaggcucagcauggaaugaaacaggggagugagggacacaaggaggugggaagu

SEQ ID NO: 279668 - RNA, 62 nt, Human
uuaaaauucccaggcagggggagaguggcauggggagugacuucuuaauggguaaggggcug

SEQ ID NO: 279669 - RNA, 62 nt, Human
accuccaccgcccagccugggaagucauuguagggagugagacacugaagcccugagaagcc

SEQ ID NO: 279670 - RNA, 62 nt, Human
cgugcugaaccucugcuggucccaagggagaagggagugagcgugggucaccuggggaaaau

SEQ ID NO: 279671 - RNA, 62 nt, Human
cagcugcagggagggccagggagguugggggugggagugaaugcuaaaagcagaucguccag

SEQ ID NO: 279672 - RNA, 62 nt, Human
gagcgagugcugagacaguauuuaggguuucugggagugaggcugguagaagaguuggccuu

SEQ ID NO: 279673 - RNA, 62 nt, Human
auuuugcuuaggucaaggcuacuuuuuaaaaagggagugacuuucaugaagucaguuugaag

SEQ ID NO: 279674 - RNA, 62 nt, Human
gucacugagcccuaucccuuuggaauguggcagggagugagguuggugagagaacauguggg

SEQ ID NO: 279675 - RNA, 62 nt, Human
gcacacggcaugaggacagagggaggggcacggggagugaaggagggggcccuggggcaagg

SEQ ID NO: 279676 - RNA, 62 nt, Human
auggggcaguugaccugggucuugaaagagucgggagugacaagcucagagagcaugaacug

SEQ ID NO: 279677 - RNA, 62 nt, Human
cccauagagggccuugcagccugauaccaccugggagugagggucacaaaggagaccuuggc

SEQ ID NO: 279678 - RNA, 64 nt, Human
ugggcagaugagauccuacuuucuccccaggaccuggaggcaggcugucucucaagguggucuc

SEQ ID NO: 279679 - RNA, 64 nt, Human
aggucagccccacccgaucccucaaaugggcucuuggaggcacccccaggggcagcccauuucu

SEQ ID NO: 279680 - RNA, 64 nt, Human
gaggggccugccaccuggaccccugcauuggaacuggaggcagggaacauggggaggaggaggg

SEQ ID NO: 279681 - RNA, 64 nt, Human
caguacaaauauauugcuuuaaauuggaagacgcuggaggcacugggaugugauaugccccucu

SEQ ID NO: 279682 - RNA, 62 nt, Human
caguguugucacugagugguccccugcugguugggagugaagagaauccaggcuggcagagc

SEQ ID NO: 279683 - RNA, 54 nt, Human
aauucaaaaucaagcuuugagcaggggagugaggcagccagaagugggggcaga

SEQ ID NO: 279684 - RNA, 62 nt, Human
gugggcaccacccuggcaguuccagccuguaggggagugaagggacauggcugagcugggca

SEQ ID NO: 279685 - RNA, 62 nt, Human
uagaaguaaaccacaggucccaccagcuccaugggagugaccaccucaguccagggaaaaca

SEQ ID NO: 279686 - RNA, 62 nt, Human
uuuucaccugaaaugccuucagcucaggccuugggagugaggugugggaguagccaccagcc

SEQ ID NO: 279687 - RNA, 62 nt, Human
aaagcugccuccaugccgaguguugugugggugggagugagacuggguagaauguuacuuga

SEQ ID NO: 279688 - RNA, 62 nt, Human
caucuagagcuugaugccaguaggcucaacuagggagugagugcaaaaagcugaguauggug

SEQ ID NO: 279689 - RNA, 62 nt, Human
aagguccgaaaauguucccuuuacccuggagugggagugaggggucauacaccaaagguauu

SEQ ID NO: 279690 - RNA, 62 nt, Human
ugauggcauuugaucuugccccauucagguuggggagugaagugugaggacccuuuuccccc

SEQ ID NO: 279691 - RNA, 62 nt, Human
gauagacccggcuucugguccauuccagggcagggagugaggagcaaggcaacuggcauuug

SEQ ID NO: 279692 - RNA, 62 nt, Human
gccagagaaaaacggugguagccauggaaaucgggagugaaggagcacugcuucauuguggc

SEQ ID NO: 279693 - RNA, 62 nt, Human
agauaaauuuaaaauuaaaauauucugcaguugggagugaaaugugauagcacauacguuga

SEQ ID NO: 279694 - RNA, 62 nt, Human
guucucuaaacauguugcacacauaaacucaagggagugauuucgguuccuaaguccuaggg

SEQ ID NO: 279695 - RNA, 64 nt, Human
ucaaaaggaggauugaggaggaucagaucaauaauggaggcaaugguaugacuccaagugcuau

SEQ ID NO: 279696 - RNA, 64 nt, Human
auccugggaaauccagcuaccauggcccucccaguggaggcaucuuacauuuaggauacuucaa

SEQ ID NO: 279697 - RNA, 64 nt, Human
agucugucugcaccuugaagcugaggguguggccuggaggcaccagaggggcaagagaauguuc

SEQ ID NO: 279698 - RNA, 64 nt, Human
agccacuggugggauauuuugggaugucaagggguggaggcagagcacaagucacaccagaaac

SEQ ID NO: 279699 - RNA, 62 nt, Human
ggcaaacgccugcaaaacagaagccuggagaggggagugaccugcucagagucauugcagag

SEQ ID NO: 279700 - RNA, 62 nt, Human
uacacucaaacuauagugauauaucaguguuugggagugaccucuagaaaaaagaaaacugu

SEQ ID NO: 279701 - RNA, 61 nt, Human
uaucugccaugugaagagaauuaacaauaaaagugugaagagcgauugugaggaacaagcc

SEQ ID NO: 279702 - RNA, 61 nt, Human
agagacuucuucccuucaggcuuauuguuugagugugaaguuccagagcaaggagccaugu

SEQ ID NO: 279703 - RNA, 61 nt, Human
gggcugcagggacaaacaucguuggggggugagugugaaaggugcugauggcccucaucuc

SEQ ID NO: 279704 - RNA, 61 nt, Human
guugugaauuuaggaaaaucacuuguaaugaagugugaaucuuguuaucaaauuuauuucu

SEQ ID NO: 279705 - RNA, 61 nt, Human
uuaucccugaauucagagugauaauuuuauaagugugaaacuuaauuauguagggcucccc

SEQ ID NO: 279706 - RNA, 61 nt, Human
agggacguuuuauagucacuauccacaugccagugugaaaugggcaucuaugacgugguca

SEQ ID NO: 279707 - RNA, 61 nt, Human
auuagagaaaauuugagucaguguacuuuauagugugaauccugugagcuaauacagucua

SEQ ID NO: 279708 - RNA, 61 nt, Human
uaaucaguaucaguaaaaagacaaaaauuacagugugaacaagagaaaaacaggaauagaa

SEQ ID NO: 279709 - RNA, 61 nt, Human
ugccuuggacuugaauccaugcaauguuuagagugugaagucaguuacuuguugauguuuu

SEQ ID NO: 279710 - RNA, 61 nt, Human
cuuucagugauugacucuucaaaauugcaguagugugaaaauacauuuuuuacaaacugaa

SEQ ID NO: 279711 - RNA, 61 nt, Human
gcuugucccccaggagucggagaagcuggaaagugugaaugcugaacugaaggcucagauu

SEQ ID NO: 279712 - RNA, 64 nt, Human
ucacuccgagccuggagaacugcaggggccaagguggaggcaggcuuaaguucaguccuccugc

SEQ ID NO: 279713 - RNA, 64 nt, Human
aagaacacgcagcugaagaggaggaucgaggagcuggaggcagagcuccgagaaaaggagacag

SEQ ID NO: 279714 - RNA, 64 nt, Human
acaucagggagugauuaguccuggggaaauucaguggaggcacaagccugaagcacucuucuac

SEQ ID NO: 279715 - RNA, 64 nt, Human
uaguggugcagccagggagaggacucagauuuccuggaggcaaagucuaucucugaaacuccau

SEQ ID NO: 279716 - RNA, 61 nt, Human
aguggaaaggugguucauguucauucucaucagugugaaacugaggagucugcaauuugga

SEQ ID NO: 279717 - RNA, 61 nt, Human
cugccaugcaguguugcgguggcacugaagaagugugaaugugaaggcggcgucggcgcgg

SEQ ID NO: 279718 - RNA, 61 nt, Human
aagcuccgugggccuguuucccaaucugcaaagugugaagggauuagaugggauggucucu

SEQ ID NO: 279719 - RNA, 61 nt, Human
ugccugggacccucagggucuuagguuggggagugugaauaggaguuugcagauggagaau

SEQ ID NO: 279720 - RNA, 61 nt, Human
ccuuacaaucagagccccucucaccuuguaaagugugaaucgcccuucccuuuuguacaga

SEQ ID NO: 279721 - RNA, 61 nt, Human
ccucgccaggccagccccacuccuuguaccaagugugaacuggggucauucggucugugau

SEQ ID NO: 279722 - RNA, 61 nt, Human
ccucaggcccaauauucucagacagcccagcagugugaacacacaaugccaggccaggaac

SEQ ID NO: 279723 - RNA, 61 nt, Human
ucaucugcaaagagccauguauucaacaucgagugugaaaagaucuauuggaaaacaacau

SEQ ID NO: 279724 - RNA, 61 nt, Human
agauuccuugagacguacuuuuaaaaucuaaagugugaaagaaacagcagaguaaaagcca

SEQ ID NO: 279725 - RNA, 61 nt, Human
ucucuucccuagaguugauugucggguacacagugugaacccccgaagacggaaccucaca

SEQ ID NO: 279726 - RNA, 61 nt, Human
uguaaagauagaaaauuuuuuaauuuaaagaagugugaaacauagccauugauugaucaga

SEQ ID NO: 279727 - RNA, 61 nt, Human
cuuaguuucuuuucauaaaguaaguuauuuuagugugaaggucaugggaaauggcauacgu

SEQ ID NO: 279728 - RNA, 61 nt, Human
ucuccucugcuccuagaagcgagaugagcgcagugugaagagcacagcugugcggguggua

SEQ ID NO: 279729 - RNA, 64 nt, Human
cccagaccaucccugcgcaucugacugacuccgguggaggcacugcuguguguuuucugaaacc

SEQ ID NO: 279730 - RNA, 64 nt, Human
gugaggguacuucuuccuauuuuucuucuguuuuuggaggcauacacauuaugcauaaccaaaa

SEQ ID NO: 279731 - RNA, 64 nt, Human
gagagacgcaguccgcccagguccccgcuuucuuuggaggcagcagcucccgcagggcugaagu

SEQ ID NO: 279732 - RNA, 64 nt, Human
uacagcggaaccacaagagagacugaggaaggccuggaggcaggggcagaggugacgacagugc

SEQ ID NO: 279733 - RNA, 61 nt, Human
ugucuccuaccacuucggagccaugggggcaagugugaagcagccagucccugggucagcc

SEQ ID NO: 279734 - RNA, 61 nt, Human
ggacguauguuccauguuuauuuguuaaagcagugugaauagccuucaagcaugugaauaa

SEQ ID NO: 279735 - RNA, 61 nt, Human
acaaaguggcauaaaaaacaugugguuacacagugugaauaaagugcugcggagcaagagg

SEQ ID NO: 279736 - RNA, 61 nt, Human
ugggaccuccccugaggcucagggaaaggccagugugaaccgaggggcucaggaaaacggg

SEQ ID NO: 279737 - RNA, 61 nt, Human
uacccaucaauuuucuauccuuagacaauguagugugaaguucacaguugacaaacaacaa

SEQ ID NO: 279738 - RNA, 61 nt, Human
cccagcugcgugggguacaggcauugcacacagugugaaugggucuacaccugcaugggcu

SEQ ID NO: 279739 - RNA, 61 nt, Human
guguagcaaugaaagcaauaugauaugcugcagugugaagcuccuucugggguuaucguau

SEQ ID NO: 279740 - RNA, 53 nt, Human
ucaaguuuucuguggcuuaaggaagugugaagauaugauccaguccagggcua

SEQ ID NO: 279741 - RNA, 60 nt, Human
aucuuacagcuucccaaugagaggccaggaagugugaacauacugauagaaaaagacuau

SEQ ID NO: 279742 - RNA, 61 nt, Human
ucuaagauuaaaaugucauuacaaaauauuuagugugaacauuuaauuuaaacuugucuca

SEQ ID NO: 279743 - RNA, 61 nt, Human
uccauguguuagauggaagcauuuccuauccagugugaauaaaaagaacaguuguaguaaa

SEQ ID NO: 279744 - RNA, 61 nt, Human
cuggucauaggaaaacacacgguucuaauuaagugugaagguauagcuauugcacuuaugc

SEQ ID NO: 279745 - RNA, 61 nt, Human
uuggcgugcagcucaucauggacaugagaccagugugaagacucacccuggaagagaauau

SEQ ID NO: 279746 - RNA, 64 nt, Human
gguaguauaguaugauucucaccauuauuugucauggaggcagacauacaccagaaauggggga

SEQ ID NO: 279747 - RNA, 64 nt, Human
acuugggguugacaaggugcucacaccaugagaauggaggcaggaauugagcugacugagggaa

SEQ ID NO: 279748 - RNA, 64 nt, Human
aggaauccagcacuacgcccugcccucuacugacuggaggcaggccucugccuacuuuagaagu

SEQ ID NO: 279749 - RNA, 64 nt, Human
uugcuugccucaaauccaagcagucuugaacacuuggaggcaauuaaugaguauaucuuaguca

SEQ ID NO: 279750 - RNA, 61 nt, Human
cagcugcucauacucaaucccauauucagcaagugugaagcuggacgugaugcaaaauaac

SEQ ID NO: 279751 - RNA, 61 nt, Human
caaacuguaaugaaacuacauuguauuucuaagugugaaaacgacaggcugccccguuuuu

SEQ ID NO: 279752 - RNA, 61 nt, Human
ccagcuacucgggaggcugaggcaggagaauagugugaacccaggaggcggagcuugcagu

SEQ ID NO: 279753 - RNA, 61 nt, Human
aagagaaaagaaauauuuggaggauauugaaagugugaaaaaaaagaaugauaaucuuuua

SEQ ID NO: 279754 - RNA, 61 nt, Human
cuuguagggcccuuuccuuauucauuuagguagugugaacauuaaguauaaaauaaauuau

SEQ ID NO: 279755 - RNA, 61 nt, Human
auuagaaauuaccuguggauauuuguauaaaagugugaaauaaauuuuuuauaaaaguguu

SEQ ID NO: 279756 - RNA, 61 nt, Human
auacgcaacauaauucacauaauuuguaugcagugugaaggagcagaaggcaucuucucac

SEQ ID NO: 279757 - RNA, 61 nt, Human
uaugcuuagaaauacuauaguaacuagaugcagugugaauuuuuuccauuaacaaacaaac

SEQ ID NO: 279758 - RNA, 61 nt, Human
caggcggcaggcgcggugcacaggaagucucagugugaaggggucuuuucucuccacugcc

SEQ ID NO: 279759 - RNA, 61 nt, Human
ccugacaucccagaagaacaucucagauaucagugugaaaagucuggggauuucaaacuga

SEQ ID NO: 279760 - RNA, 61 nt, Human
ucucauagguuaaaaaaaaaagucaccaaauagugugaaauauauuacuuaacuguccgua

SEQ ID NO: 279761 - RNA, 61 nt, Human
auuagaaaaggaacccaaaaaacccuuuaacagugugaaucuuuauaguauuugaaaauga

SEQ ID NO: 279762 - RNA, 61 nt, Human
uuuuaggaauuacugcuuuguugauauucaaagugugaaacuaaaacuuuaugguuguacu

SEQ ID NO: 279763 - RNA, 64 nt, Human
cauuagcaaagugaucuuugucucuguucuaaaauggaggcaguagggagcaaaacuauucuuc

SEQ ID NO: 279764 - RNA, 64 nt, Human
acucgucugacuguguguggaggaguccaggccauggaggcagaauccuggcccucuguguugg

SEQ ID NO: 279765 - RNA, 64 nt, Human
auuuuccucgcugccuuuggcuggcaggaggcuuuggaggcacaagccauuauaaccuucuugg

SEQ ID NO: 279766 - RNA, 64 nt, Human
gugggggcaagggggaaaugcccccccaucuccuuggaggcaguggugugaaucuucuucaaca

SEQ ID NO: 279767 - RNA, 61 nt, Human
ugagaggaagagcacauguuggucuccucuuagugugaacgagauugccaggcccuuuucu

SEQ ID NO: 279768 - RNA, 61 nt, Human
uuaaugacccuuuugcuuuuggguuuugcucagugugaaagguuacuuaauuaaauuacaa

SEQ ID NO: 279769 - RNA, 61 nt, Human
uguuaaaauuaaaaacaacguauuccuuuguagugugaauaugagcaaucuauuuuauaug

SEQ ID NO: 279770 - RNA, 61 nt, Human
uuuucuuagcuuucugucuuucuuucaacguagugugaagugucuuauccuuuucuaugaa

SEQ ID NO: 279771 - RNA, 61 nt, Human
uucaauaauuauuuucaaugaugaaucacuuagugugaaagacuugccuuguguauucuuu

SEQ ID NO: 279772 - RNA, 61 nt, Human
guuacacuccugcacuaaaggcacguacugcagugugaagaaauguucugaaaaaggguua

SEQ ID NO: 279773 - RNA, 61 nt, Human
gaacauuucuagaaaaaacuacuuuuguaccagugugaauaaaguuaguguguugucugug

SEQ ID NO: 279774 - RNA, 61 nt, Human
gagcaucagccuucuagaaucggagcuccggagugugaagauucaguauugauaugauaug

SEQ ID NO: 279775 - RNA, 61 nt, Human
uugcuacuguuguucaacaccauuaauggucagugugaaccauuacaaagaauguggcaac

SEQ ID NO: 279776 - RNA, 61 nt, Human
cacacugugccuuguguuuggggcuugauagagugugaaagguguguugcuugaaaggugu

SEQ ID NO: 279777 - RNA, 61 nt, Human
guaaauucugaggccacagagaaaugcauugagugugaauguugucaucuguaaucccucc

SEQ ID NO: 279778 - RNA, 61 nt, Human
ucaucuccauuuauuucuuuuguucccgcucagugugaaguugggaacugagaggggaugg

SEQ ID NO: 279779 - RNA, 61 nt, Human
guugagauguuuuucuuaaacacugccugucagugugaaguggcacagcucugauguagug

SEQ ID NO: 279780 - RNA, 64 nt, Human
gggagggcgcuccuguucccaucucuguguucccuggaggcagguaucacaaagcauuugugaa

SEQ ID NO: 279781 - RNA, 64 nt, Human
uauacagaaggcagucaagcucaacucagagccauggaggcaaguaccuuaauuaguuuuauau

SEQ ID NO: 279782 - RNA, 64 nt, Human
cuugugugagugaccacggccccaagcccagggcuggaggcaggucccaggacgcgccgcuccc

SEQ ID NO: 279783 - RNA, 64 nt, Human
aauuuuggcaaggaauucaugcauaacugagacuuggaggcagccccugcucacuucacgcugu

SEQ ID NO: 279784 - RNA, 61 nt, Human
acacgucuggcuucacagaugugugauucacagugugaaucuuggugucuacguuaccagg

SEQ ID NO: 279785 - RNA, 61 nt, Human
acgguucagaaagaucugucaaucaagcaguagugugaaaaaagcacuauaagaaaaugca

SEQ ID NO: 279786 - RNA, 61 nt, Human
gcucacccagcaucucuuuuaccaaccagagagugugaaacuaguuucauauauuaccuag

SEQ ID NO: 279787 - RNA, 61 nt, Human
aaaucagaagacguucuaaagucaguaagaaagugugaaaugcuaguauaaagguuauuuu

SEQ ID NO: 279788 - RNA, 61 nt, Human
uucuuauucccuuuaagaauguuuauguaugagugugaagaugcuagcgaaccuaugcuca

SEQ ID NO: 279789 - RNA, 61 nt, Human
ucccagccccuaugguuucacauagacgugcagugugaaccaaagcaagacugaaugugac

SEQ ID NO: 279790 - RNA, 61 nt, Human
cuguugugcaacaaaaaugucacuuuaucucagugugaaugaguagucuaaauucccuuuc

SEQ ID NO: 279791 - RNA, 61 nt, Human
auuuauucaauaaaguauuuaauuagugcuaagugugaacuggacccuguugcuaagcccc

SEQ ID NO: 279792 - RNA, 61 nt, Human
uugaagaaaaucuguaaguaaguaaaccuuaagugugaaacuaaacauguucuuuguucaa

SEQ ID NO: 279793 - RNA, 61 nt, Human
cccaggaggcagcagggucuggucauaauccagugugaagaugaggugaggaaggaagggg

SEQ ID NO: 279794 - RNA, 61 nt, Human
ccucucuuccccagcaagaugucaauuaagcagugugaauucugacugcaauaggcaccag

SEQ ID NO: 279795 - RNA, 61 nt, Human
uucacucucgccagcucaguuggcuuugugaagugugaaacccuacaaugugaaaggaaag

SEQ ID NO: 279796 - RNA, 61 nt, Human
gcucuuggcccggcagggcccccaauaaaccagugugaacccccacuguguugucuggacu

SEQ ID NO: 279797 - RNA, 64 nt, Human
ggaggagucguaugcacuguuuuucuguugcugauggaggcaagcaggccuucuaauuagucua

SEQ ID NO: 279798 - RNA, 64 nt, Human
uucuaacuuccaaauacuauauuaucaauaggcauggaggcagguguuuccaagggugucucau

SEQ ID NO: 279799 - RNA, 64 nt, Human
guggggugccccuuaggcuuggagagccccagauuggaggcagacagacugcaccaccccuucc

SEQ ID NO: 279800 - RNA, 64 nt, Human
cugccugccccucagcccuggcccaggccccuuuuggaggcagcugaggaaggaugcuggggaa

SEQ ID NO: 279801 - RNA, 61 nt, Human
agugguauuucaguuccuaaguuacauaaaaagugugaaagaacacugugaggucccagca

SEQ ID NO: 279802 - RNA, 61 nt, Human
cuucugucauauaguugugggaucucuaccaagugugaaggugaaugagguaagggagauc

SEQ ID NO: 279803 - RNA, 61 nt, Human
uagaauuugagauuuuuguaauaauagaaguagugugaacccuagaaauuagaaaaucaag

SEQ ID NO: 279804 - RNA, 61 nt, Human
auuuccucaagaaauaacugaagaaggagcaagugugaacaguuucuuguguauccuuuca

SEQ ID NO: 279805 - RNA, 61 nt, Human
ccacaccaccaaaugucacaccuucuuauaaagugugaacaaggaaggucauguuuuugug

SEQ ID NO: 279806 - RNA, 61 nt, Human
cagguuuuauacauagccauuguauauuuuuagugugaaaaacauuaauauauuauaugca

SEQ ID NO: 279807 - RNA, 61 nt, Human
aggcugagaugauugagaugaaaguuaacauagugugaaugaaagucuggccaacagagca

SEQ ID NO: 279808 - RNA, 61 nt, Human
guaauguuauauuaaccucuuccuacuuuaaagugugaaauguuucaccucagcuguacaa

SEQ ID NO: 279809 - RNA, 61 nt, Human
augcaaugugacaguguuacauuuggagagaagugugaaaucuaaccaaucgcuagcacau

SEQ ID NO: 279810 - RNA, 61 nt, Human
agcaggcuuuaaaugucaccugcuaccuuagagugugaaggugaugguaacugccacagca

SEQ ID NO: 279811 - RNA, 61 nt, Human
agucaagugacuuuacuaaucaguuguucuaagugugaauauggcaugcuaauuagcuaau

SEQ ID NO: 279812 - RNA, 61 nt, Human
agauaaugauacuuaaccaguuagaagagguagugugaauauuaauuaguuuauauuacuc

SEQ ID NO: 279813 - RNA, 61 nt, Human
uaguccgugaaaguuggggcugaaguaccuaagugugaaugucucucccguuaaacugagu

SEQ ID NO: 279814 - RNA, 64 nt, Human
aguuacugugguauggcuaauaccugucaacauuuggaggcaauccuaccuugcuuuugcuucu

SEQ ID NO: 279815 - RNA, 64 nt, Human
cugccauuugacaguaaaggcucuuggcuucuguuggaggcaugggaaauugucucaauuugua

SEQ ID NO: 279816 - RNA, 64 nt, Human
gauguaaucagacuaacaguugaaucauugcuguuggaggcagcacaaauuuauguguuacaac

SEQ ID NO: 279817 - RNA, 64 nt, Human
gauggaagauucugagccuggaauuaggaccccauggaggcaguucaguaacuaaacuaauaaa

SEQ ID NO: 279818 - RNA, 61 nt, Human
uauacagaccaggugagagcccuuuugccuuagugugaaaauguaacauuuuaugcuuuua

SEQ ID NO: 279819 - RNA, 61 nt, Human
gcauuucucaaaggaagcaggggauucagugagugugaaggugaacaggauggccuggcag

SEQ ID NO: 279820 - RNA, 61 nt, Human
ggguggauggggggagcaagcauaauuuuuaagugugaagcuuugcaucaagaaauuauua

SEQ ID NO: 279821 - RNA, 61 nt, Human
gagacauaggccaugaaaaaaaugauccccaagugugaacaaaagaugcucuucuguggac

SEQ ID NO: 279822 - RNA, 61 nt, Human
acaaaaaucaguauuguuauuuuuuuccaagagugugaaggaaaauggggcauuccuuucc

SEQ ID NO: 279823 - RNA, 61 nt, Human
gugaauauacacacacacacacacacaggugagugugaauacuuccuuguuggcugaucca

SEQ ID NO: 279824 - RNA, 61 nt, Human
uguuuaucuuuaaaauaaauaaaaucuugcuagugugaauauaucuuagaacaaaagguau

SEQ ID NO: 279825 - RNA, 61 nt, Human
cccuggcugcuggcuaccgauuaaauucauuagugugaaagaggugggagugagguuuucu

SEQ ID NO: 279826 - RNA, 61 nt, Human
ucuuucaugcuuuuuucugugcacuuaccuaagugugaauauguaaaggguuuguuuugua

SEQ ID NO: 279827 - RNA, 61 nt, Human
aacacaagauauaggugcuguguagccugauagugugaaauguuuaaugagggaguuguac

SEQ ID NO: 279828 - RNA, 61 nt, Human
uguugauuuaacuuuuaaaauguuguuuaaaagugugaagcuaugaaaagccugauaaugu

SEQ ID NO: 279829 - RNA, 61 nt, Human
aaguucuugagacauuuaaacuguauuuaccagugugaaaaaugucauuuauggagauuaa

SEQ ID NO: 279830 - RNA, 61 nt, Human
ccuguccuucaguuuguauaaaccuaaggagagugugaaauccagcaacugaauugugguc

SEQ ID NO: 279831 - RNA, 64 nt, Human
ucugugacaggaugaaugagguggguauggacaguggaggcagcuggaauggcaagugcagaaa

SEQ ID NO: 279832 - RNA, 64 nt, Human
ugggggacaugggaggggucuagcuggccacugcuggaggcagcgcuggucgucaccugggcgg

SEQ ID NO: 279833 - RNA, 64 nt, Human
agcuaaggaaguugaaaaggaaagcucacuucuuuggaggcaccuguccagaagccuggccuag

SEQ ID NO: 279834 - RNA, 64 nt, Human
gaggaugcguguuccucaguagaagacaagcagguggaggcauccagugauuucuacccugugg

SEQ ID NO: 279835 - RNA, 61 nt, Human
aaaagaaaauguguuuuuuguuugguaccauagugugaaaugcugggaacaaugacuauaa

SEQ ID NO: 279836 - RNA, 61 nt, Human
cguuuguaugggaacauuggcaagaaagaauagugugaaagggaacuguuuuaguuuccua

SEQ ID NO: 279837 - RNA, 61 nt, Human
gugguuagcacaaggaaucuaauuuauagcaagugugaaauaguuaccauuuuuuccugau

SEQ ID NO: 279838 - RNA, 61 nt, Human
auuauucuacuauacuguacaugaaaguagcagugugaaguacaauaauucauauucuuca

SEQ ID NO: 279839 - RNA, 61 nt, Human
aucagugcaguucgguucucagggggaaagaagugugaaacugucaggaagacagaugaaa

SEQ ID NO: 279840 - RNA, 61 nt, Human
uucacaucaugaaaguguacaugcauaugcaagugugaauuacgugguauggauguuugcu

SEQ ID NO: 279841 - RNA, 61 nt, Human
guauguauguauuuauuuauuuauugccuggagugugaacuguauuuauuuuagcagagga

SEQ ID NO: 279842 - RNA, 61 nt, Human
auuuggguagguuaagcugccauacguguucagugugaauaguguuuaaguugaaaauauu

SEQ ID NO: 279843 - RNA, 61 nt, Human
gaugucccuggucuauucagggaaagauuucagugugaaaugguaaacauccaauugacag

SEQ ID NO: 279844 - RNA, 61 nt, Human
auguacccugugguauugccccucuguccguagugugaacuguccugugagcuuuauguca

SEQ ID NO: 279845 - RNA, 61 nt, Human
uggagaauugguugaguagccaaggaaggucagugugaaaagcuugcuauggcaaauauag

SEQ ID NO: 279846 - RNA, 61 nt, Human
cuaauucggagaugccuuucccagccaugggagugugaagugcuaggaugaaccuggccau

SEQ ID NO: 279847 - RNA, 61 nt, Human
augggguuuuguuauugguuuuuuuuuguaaagugugaauaaaagguauguuuacucauuu

SEQ ID NO: 279848 - RNA, 64 nt, Human
uggacagaggggcaggggagugccaagguuguccuggaggcagacagcccagcugagccuccuu

SEQ ID NO: 279849 - RNA, 64 nt, Human
auccacacauaggagagcuggggcacaaggggacuggaggcaguugcuuugcaagauggcugag

SEQ ID NO: 279850 - RNA, 64 nt, Human
gacccugcacccuccgggaagccauggagucugcuggaggcaccauaucagccugcgggacuag

SEQ ID NO: 279851 - RNA, 64 nt, Human
gcaugguggcacauaacugcaaucccagcuacuuuggaggcagggaugggaggaucacuugagg

SEQ ID NO: 279852 - RNA, 61 nt, Human
gauaggcaucuugugaggguguguuuuucccagugugaauuggcuugaagagccaugggcu

SEQ ID NO: 279853 - RNA, 61 nt, Human
uccgucaaaucucuuaaguaacaacacauuaagugugaauuacuuuucucucauuguuucc

SEQ ID NO: 279854 - RNA, 61 nt, Human
ccagcaggauugcagaucauuugaggaucagagugugaaaacgaguuucucuuuuacagau

SEQ ID NO: 279855 - RNA, 61 nt, Human
caguguugagauggguagggccaagaugaccagugugaaaacucucagauagaaaggagcc

SEQ ID NO: 279856 - RNA, 61 nt, Human
ucuacacugauugcacugaggauuucuccccagugugaaguuucuggcauagaguccuggc

SEQ ID NO: 279857 - RNA, 61 nt, Human
ccugcauuugcuguuuucucaugucucucccagugugaauucuuuggugugcagugcgcuc

SEQ ID NO: 279858 - RNA, 61 nt, Human
cucugaaaccccauucccugcucugaggaacagugugaaaaaaagucuuuuaggagauuua

SEQ ID NO: 279859 - RNA, 61 nt, Human
gauaugaauuuguucaugaauauuuuucuguagugugaaacagcugcccugugugggacug

SEQ ID NO: 279860 - RNA, 61 nt, Human
ggccuugugguuucaggacugcaaggacuccagugugaacucaggaggggcaggugucaga

SEQ ID NO: 279861 - RNA, 61 nt, Human
uugguuccuucucuguaacacuaaauauuuuagugugaaauugaauuuuuuuauuacuaua

SEQ ID NO: 279862 - RNA, 61 nt, Human
auacuuuaauaauguugcgauggauugccacagugugaaggaaaugcaguguggggauagg

SEQ ID NO: 279863 - RNA, 61 nt, Human
guaggagagauuaucagauggugcuaaagaaagugugaagaucuuaugaaauagguggaug

SEQ ID NO: 279864 - RNA, 61 nt, Human
aaagauuugaccuuaagagggaagggaaaaaagugugaaaggaugaugaagaaaauaauuu

SEQ ID NO: 279865 - RNA, 64 nt, Human
ugcggcacccuugcgcuuuugcuggucacugccauggaggcacacagcugcagagacagagagg

SEQ ID NO: 279866 - RNA, 64 nt, Human
ggucagcagagccgccccguguccccccaggugcuggaggcagacucgagggccgaauuguuuc

SEQ ID NO: 279867 - RNA, 64 nt, Human
uguccuuuugugaggggcugaggcgacugucccauggaggcauccaaggcuuucugugccaaga

SEQ ID NO: 279868 - RNA, 64 nt, Human
gucccaggugucauggcaacagaacgugggaugcuggaggcaugccugcagaaggacuguugau

SEQ ID NO: 279869 - RNA, 61 nt, Human
auguuuauuuuauggggacuaagggauuaggagugugaacuaaaagguaacauuuuccacu

SEQ ID NO: 279870 - RNA, 61 nt, Human
ucccugaggcccuguguguuaucugugauggagugugaauguguaacgggcacuguguuac

SEQ ID NO: 279871 - RNA, 61 nt, Human
gacuggggagagcugugugccucaguguugcagugugaauuccuaaauagaggguaaagug

SEQ ID NO: 279872 - RNA, 61 nt, Human
gggaauguggggaucagggagguggagggacagugugaauaaauggcaucuaggaagguaa

SEQ ID NO: 279873 - RNA, 61 nt, Human
auaugaaauauuuugaauacacaucucugucagugugaaaauucagcggcaguguguccau

SEQ ID NO: 279874 - RNA, 50 nt, Human
aacaacacacacgucucugaagugugaaacagagcacuugcagagccugg

SEQ ID NO: 279875 - RNA, 61 nt, Human
agaaaacccacccuggggagaagccccagcaagugugaaaaaagcuucuaacaaaacucug

SEQ ID NO: 279876 - RNA, 61 nt, Human
ugucuggaucaguaaaauuauacugugugugagugugaauauaaauguguguauguguguu

SEQ ID NO: 279877 - RNA, 61 nt, Human
augagaggacuggcuaaagugaagugugcacagugugaaguuuaaugcuguugucaagagg

SEQ ID NO: 279878 - RNA, 61 nt, Human
caaugagauucaaaaguugaccugaaagucaagugugaaaaaaaaaaagagauuaaacaag

SEQ ID NO: 279879 - RNA, 61 nt, Human
caugcacaagcuuugcguucugacuauaaaaagugugaacaaaucaaugccagauuccugu

SEQ ID NO: 279880 - RNA, 61 nt, Human
uuaaauguucagcaggagaacgccaccgccuagugugaaugcuaggucagaagcugcuuuu

SEQ ID NO: 279881 - RNA, 61 nt, Human
auuaauacuucccuaggauauccuguguuugagugugaaguuaauaucacacaaagcaugu

SEQ ID NO: 279882 - RNA, 64 nt, Human
gaaucacaguguauccaaaucuucagcuugaauuuggaggcagauucuuagagugaaaaagccu

SEQ ID NO: 279883 - RNA, 64 nt, Human
uuuuuuuuuuuaagaaaauugaagauuggggugguggaggcaguagggagaugggauugggcac

SEQ ID NO: 279884 - RNA, 64 nt, Human
cacagccugcugggcugggucgcguagcccaggguggaggcagaacgaugcugcugugguagcc

SEQ ID NO: 279885 - RNA, 64 nt, Human
ugucaagcaguagacaagcaauuagacaagaacuuggaggcaccauuuguauccacuuuuuaga

SEQ ID NO: 279886 - RNA, 61 nt, Human
ugagguguaaauuuugcccagauguauacccagugugaaauaucuucuaauaaaaauauau

SEQ ID NO: 279887 - RNA, 61 nt, Human
cuguugccauaguugguaaggcuuuccuuuaagugugaaauauuuagaugaaauuuucucu

SEQ ID NO: 279888 - RNA, 61 nt, Human
gcucuuguccuuggcugugaucccuauacauagugugaauuuauauccagguuucccagga

SEQ ID NO: 279889 - RNA, 61 nt, Human
auuucaaaggugcuaaaaucugaaaucugcuagugugaaacuugcucuacucucugaaaug

SEQ ID NO: 279890 - RNA, 61 nt, Human
aacugugggcuaggcaaacaaaauagaaaaaagugugaaaaacaguaaaguugggagagga

SEQ ID NO: 279891 - RNA, 61 nt, Human
ugcgagugugugugagaauggcuguguggugagugugaacuuuguucugugaucauagaaa

SEQ ID NO: 279892 - RNA, 61 nt, Human
uaugacauucuauuuuugacuuauuaguccuagugugaaagcauuaauauuauuagcauga

SEQ ID NO: 279893 - RNA, 61 nt, Human
gucugccccacaaucaagaauguauguguaaagugugaauaaaucucauaucaaaugucaa

SEQ ID NO: 279894 - RNA, 61 nt, Human
gacgcuuccucaagcccagccuucuacagagagugugaacgguacagccccggccugaccc

SEQ ID NO: 279895 - RNA, 61 nt, Human
gaccuuucuuaaaugugacagaugguccugcagugugaaacugaaggacaguguuaaagcu

SEQ ID NO: 279896 - RNA, 61 nt, Human
ugucgggagcagggagccaccuucaccugcgagugugaaguugguuacgggggaggccugu

SEQ ID NO: 279897 - RNA, 61 nt, Human
uugguagcuugguuucuuuuuuuuauuaaauagugugaaaauauaaugggcauuuugaaaa

SEQ ID NO: 279898 - RNA, 61 nt, Human
cacaaaaccuggcacaauggcuaauucccagagugugaaacuuccuaaguauaaaugguug

SEQ ID NO: 279899 - RNA, 64 nt, Human
gagccagaggcagaauggauggacagacaggccauggaggcagcacugagccagcaccacacgu

SEQ ID NO: 279900 - RNA, 64 nt, Human
agcucccguucccaaguguggacuccagaggggcuggaggcaagcuaugaacuugcucgcuggc

SEQ ID NO: 279901 - RNA, 64 nt, Human
guggaguggacucgagucccuggagcaggcaguguggaggcagccauccccugugaugacuggc

SEQ ID NO: 279902 - RNA, 64 nt, Human
caaagaaacccaagugggggcagagggcagaggcuggaggcagggccuugcccagagaugccuc

SEQ ID NO: 279903 - RNA, 61 nt, Human
aaugccaccaacucuggcuuaguuaagugagagugugaacuguguggcaagagagccucac

SEQ ID NO: 279904 - RNA, 61 nt, Human
guguguguauacuuauguguguguaugugugagugugaauauauguauauguguacauaug

SEQ ID NO: 279905 - RNA, 61 nt, Human
cuuccuaaauuuaaaagcucuaguuuugcuuagugugaauucuggcacuuuaaaaagauua

SEQ ID NO: 279906 - RNA, 61 nt, Human
uaguuuauaauuaaaugcauucuugaaguccagugugaauuuuauuaaugcuaucaucucg

SEQ ID NO: 279907 - RNA, 61 nt, Human
caugcucccuucuccuccauucggggggaaaagugugaaaugaagcuacauggaccucaca

SEQ ID NO: 279908 - RNA, 61 nt, Human
aagaaaauucauacuggagagaaaccuuacaagugugaagaauguggcaaaacuucuaacc

SEQ ID NO: 279909 - RNA, 61 nt, Human
guaggugcucaaguguuucuguucgggacugagugugaaucuguaaaaggggaaaauccuc

SEQ ID NO: 279910 - RNA, 61 nt, Human
uucuucuguuuugccuuuucacgcccuuuauagugugaaaugaaaaauuagucacuuccuc

SEQ ID NO: 279911 - RNA, 61 nt, Human
ccagcagaguaucugucuuauuuuaggaugcagugugaaacuuaccauucaacugaacaac

SEQ ID NO: 279912 - RNA, 61 nt, Human
ucuguuuuugauaagaauaagaaagggagugagugugaagauggugguuagcaguuucacu

SEQ ID NO: 279913 - RNA, 61 nt, Human
cugaaguaccguaacugcacuaaagggacguagugugaacaucccgcaguauaggcuuaag

SEQ ID NO: 279914 - RNA, 61 nt, Human
cucucucuuuuguaauuuauguucccaauugagugugaauguccaaguaaugguguaugua

SEQ ID NO: 279915 - RNA, 61 nt, Human
aucacaucacgaaaauucugugccugucgucagugugaaaaugccuuugcugauaauuuau

SEQ ID NO: 279916 - RNA, 64 nt, Human
gguauucuaaaccagcagagcacuuguuaacguuuggaggcacaguuucacccagggcgacccu

SEQ ID NO: 279917 - RNA, 57 nt, Human
gcagugucucugaggacuagcaaagucuggaggcagaugaaugguuucugacccuca

SEQ ID NO: 279918 - RNA, 64 nt, Human
aacuaaguauuguuauaaguuuuuuaaaaacaacuggaggcaucuuuguacauauuauggccag

SEQ ID NO: 279919 - RNA, 64 nt, Human
caugagguauggagacacccuggcccccaggagcuggaggcaccgcccacuccccuggcauucc

SEQ ID NO: 279920 - RNA, 61 nt, Human
gaacaauauaucccaugggagaagaccuuucagugugaacuguucuauuuuuguguuauaa

SEQ ID NO: 279921 - RNA, 61 nt, Human
uggccuuaaaauucuucugugaaauuucaaaagugugaacuuuuuauucuuccaaagaauu

SEQ ID NO: 279922 - RNA, 61 nt, Human
aaagcacuuuguauauauaaggugcuauauaagugugaaauaucauucauuuauaaaugaa

SEQ ID NO: 279923 - RNA, 61 nt, Human
aagggaaaagaaauaucuggaguacauuaaaagugugaaagaaaagaaugauaaucuucua

SEQ ID NO: 279924 - RNA, 61 nt, Human
cacauccauacacucugacaaucuccacgcuagugugaacgccucugucccgaggcgcagc

SEQ ID NO: 279925 - RNA, 61 nt, Human
caucaacuggcaaggccuagaggagcuacacagugugaaugaaaacaucuaugaguacaga

SEQ ID NO: 279926 - RNA, 61 nt, Human
aaguuucuuagcaauuaaaguuuuuuuauucagugugaacugucaguaucuauucuggugc

SEQ ID NO: 279927 - RNA, 61 nt, Human
uuuuaauguuuguaaacuuuuacuaauaauuagugugaauugcauucugauacaauaauga

SEQ ID NO: 279928 - RNA, 61 nt, Human
gacuucauaucguggaaguauugucuauuucagugugaaacuaucuugaauuugcaaauau

SEQ ID NO: 279929 - RNA, 61 nt, Human
gagauggaugaggagaauggcuucaugauccagugugaagagugcuuguguuggcaacaca

SEQ ID NO: 279930 - RNA, 61 nt, Human
caagaugagcaaagaaagguuugcacagaggagugugaauguguguuuguugcuggcugaa

SEQ ID NO: 279931 - RNA, 61 nt, Human
uagucaacccauccccagggccauaguguagagugugaaaagcuacccugaaacccaguaa

SEQ ID NO: 279932 - RNA, 61 nt, Human
aagcaggacgaaaaagaggcauacacacagcagugugaauagccuggccaccagccauccu

SEQ ID NO: 279933 - RNA, 64 nt, Human
ugcugcaaggaaagaagauucuaaaguccguuuauggaggcaauuccauauccuuucuugaacg

SEQ ID NO: 279934 - RNA, 64 nt, Human
ccucccaggcacccagcacuuuaagccugcuccauggaggcagagaggcccggcaagcacagcc

SEQ ID NO: 279935 - RNA, 64 nt, Human
cggcucuggccccuggacuucuccucggugcuccuggaggcaggugaugcugugggcacgcucu

SEQ ID NO: 279936 - RNA, 64 nt, Human
aggcccccucuguccuuuucagaacacauggacuuggaggcagauuugaaauaaacuuuuagua

SEQ ID NO: 279937 - RNA, 61 nt, Human
cauuuuuaauauauuugagugauugcugggaagugugaaaauauuguuauguaucauauca

SEQ ID NO: 279938 - RNA, 61 nt, Human
cucuuguguuugacacuaagaaaauagcaagagugugaaaucucagauacuuaugaaaucu

SEQ ID NO: 279939 - RNA, 61 nt, Human
aacaaaaaacccacaauugaacuuccaggaaagugugaagacccaaaacagcuuugucucc

SEQ ID NO: 279940 - RNA, 61 nt, Human
aaaucauucagaucauccccccuuuuuaaguagugugaauugcaaaacccaacauauuuuu

SEQ ID NO: 279941 - RNA, 61 nt, Human
aaugacacuaaacuccaugauauuuaaggauagugugaagaucuuuggcaugauuuaaagg

SEQ ID NO: 279942 - RNA, 61 nt, Human
ggucucacugccuuuccuucccacagaccugagugugaaagacugagaguugaggaguuac

SEQ ID NO: 279943 - RNA, 61 nt, Human
aagaggucuucugaccuuuccuuuccccgugagugugaagcuggcagaaaucacuaguaaa

SEQ ID NO: 279944 - RNA, 61 nt, Human
auuggugcuagauucugcaggaaaccccagcagugugaacgcaucccaacauagguuaaga

SEQ ID NO: 279945 - RNA, 61 nt, Human
ugauuccuccccuuggcgggagagcucucucagugugaacaugccuucugugggcggaaau

SEQ ID NO: 279946 - RNA, 61 nt, Human
gcuuuuaauucucauuuguucucacaccaacagugugaagugcgugguauaaucuccauuu

SEQ ID NO: 279947 - RNA, 61 nt, Human
uggaguuugauggacagggcugccuuuaaugagugugaaggucacuaagucacuuagacau

SEQ ID NO: 279948 - RNA, 61 nt, Human
cgugcuguacgugugugugugugugugagcgagugugaacucuucaagaaacaugcauuuu

SEQ ID NO: 279949 - RNA, 61 nt, Human
aucccugggacgugagacuuagcuuccagccagugugaaucauuguaucugucucauaauc

SEQ ID NO: 279950 - RNA, 64 nt, Human
gcgaccccccgacauagcaaaagguggcaacccauggaggcagaaagaaggacgccagccugac

SEQ ID NO: 279951 - RNA, 64 nt, Human
agcaggggcaacuccuggcacacaucaugggcuuuggaggcacacaagccuggauucgaaucug

SEQ ID NO: 279952 - RNA, 64 nt, Human
acuauggaaagaguacucuuguuuccuuauauuauggaggcaggaguuucguuuucaaaauugu

SEQ ID NO: 279953 - RNA, 64 nt, Human
cucugugcaggaaccaagauggggcugaagccucuggaggcaguugguugggggcgggcaggca

SEQ ID NO: 279954 - RNA, 61 nt, Human
aguugaaucaaaauuuucaaauguuuucagcagugugaagaagcuugguguauaccugugc

SEQ ID NO: 279955 - RNA, 61 nt, Human
uuuuccuguguaauuuggguagauuuucaagagugugaacacaaauuuaaaauaagcuaua

SEQ ID NO: 279956 - RNA, 61 nt, Human
uacauuugaacuauauccuuccuaguggguuagugugaaaaagaguuuggcugauuccuaa

SEQ ID NO: 279957 - RNA, 61 nt, Human
auucuaaugcaagauauuuuuucuuuuuuauagugugaagcaguauucuggaaaguuuuuc

SEQ ID NO: 279958 - RNA, 61 nt, Human; identical to SEQ ID NO: 279875

SEQ ID NO: 279959 - RNA, 61 nt, Human
gagauuaauguuucaugauuucuaccuccaaagugugaagacaaguaaaacaauguuucua

SEQ ID NO: 279960 - RNA, 61 nt, Human
gguagggagcgauauucaagauauauugugaagugugaaaaaguagguugcugaaccaugu

SEQ ID NO: 279961 - RNA, 61 nt, Human
uuauauauauauauuuuuuuuuugguuaggaagugugaaguuuuguguguaugauuucugu

SEQ ID NO: 279962 - RNA, 61 nt, Human
uaaaaugucugguugugccagacauuucacaagugugaaaggagauaggagaagcucaacu

SEQ ID NO: 279963 - RNA, 61 nt, Human
uucuuccugaagccuacagacauaaaauaacagugugaagaauuacuuguucacgguuagu

SEQ ID NO: 279964 - RNA, 61 nt, Human
agaaucaagcugguguggggcuuuuauugauagugugaagauuguacacuauauuacauga

SEQ ID NO: 279965 - RNA, 61 nt, Human
aguagaucacuuaaauacuggaucuuuugcuagugugaaaacauugggaauuuaaugacau

SEQ ID NO: 279966 - RNA, 61 nt, Human
ccuucccugucugccagggccagucuugacgagugugaagcuuccuuggcuuuuacugaag

SEQ ID NO: 279967 - RNA, 64 nt, Human
gcccgggugcugccagccacggcggaagcucccuuggaggcagcccugccccgugccaccugca

SEQ ID NO: 279968 - RNA, 52 nt, Human
caccgccugcacugccaugaccuggaggcagacagacgcccaccugcucccc

SEQ ID NO: 279969 - RNA, 64 nt, Human
cucaggccuggcaggcagaagcagcuguggucccuggaggcaaaaggcagcucacggggccuuc

SEQ ID NO: 279970 - RNA, 64 nt, Human
ucaguucacuguauaugauucgguauuggggguuuggaggcacccagacccuggcaauauuaug

SEQ ID NO: 279971 - RNA, 61 nt, Human
acuguaaugcaacaugccuugggaauguuauagugugaacuaccuuuauaacauagguuaa

SEQ ID NO: 279972 - RNA, 61 nt, Human
gauacacauuuuuuguguauguauucuaauuagugugaauaaagcaguaacauuaaugcau

SEQ ID NO: 279973 - RNA, 61 nt, Human
guuuugguaaugagccauucaaaccgacagcagugugaaggugugucaagguguauauucu

SEQ ID NO: 279974 - RNA, 61 nt, Human
gauugacaguguaucauaggauuacccucuaagugugaaaauguguaauuauguacgguau

SEQ ID NO: 279975 - RNA, 61 nt, Human
agaaucaagcuggcauggggcuuuuauugacagugugaagauuguacacuacauuacauga

SEQ ID NO: 279976 - RNA, 61 nt, Human
aagauaauucauuuuaaucguaauguauuuuagugugaauuuaaaaauuucauacaucaaa

SEQ ID NO: 279977 - RNA, 61 nt, Human
cuuuuaaagugauuuuugccuuuaaagauacagugugaaaauuugcucggguguguagcag

SEQ ID NO: 279978 - RNA, 61 nt, Human
gccugguuuugauggcagcaguaaucaugauagugugaacccgcgaaggccucaggauuau

SEQ ID NO: 279979 - RNA, 61 nt, Human
aaauuaagguuagcggaucauguacaagcugagugugaaaguagaaaucaccuacaccaga

SEQ ID NO: 279980 - RNA, 61 nt, Human
gaaguguccuuguucauuuucacccaaaugaagugugaacgugauguuuucggaugcaaac

SEQ ID NO: 279981 - RNA, 61 nt, Human
aaauguaaaauuuggucuuccagcuuaaugcagugugaacaauagaugguuaggaaaacaa

SEQ ID NO: 279982 - RNA, 61 nt, Human
ucccaaagaucaaguugucugaaggagccaaagugugaaugugggugucggcugcggcauu

SEQ ID NO: 279983 - RNA, 61 nt, Human
ugaacugaccuugaaucuuuuuaucccauuuagugugaauauuccuuuauuuugcugcuug

SEQ ID NO: 279984 - RNA, 64 nt, Human
gcugucugcgguggggggaagguuggggggugucuggaggcauguuccccucaccaccccccgu

SEQ ID NO: 279985 - RNA, 64 nt, Human
ccuucagccccccucccccagacuaacagacccuuggaggcaggggcuguggaaauaaaucucu

SEQ ID NO: 279986 - RNA, 64 nt, Human
ggcaauugaacaucauucaucuaaauaugcacacuggaggcaagaugagaauuccugacagauu

SEQ ID NO: 279987 - RNA, 64 nt, Human
gcucaacccuuaguaaacacgagaggacacacacuggaggcaaacccuaugaaugugaccauug

SEQ ID NO: 279988 - RNA, 61 nt, Human
ccagaaccuuacuaaaguagagggcacaaucagugugaauaaauucacuucagaaucucaa

SEQ ID NO: 279989 - RNA, 61 nt, Human
gcaguuguuguaaugacaagauuacugcgcaagugugaauccaaacaguauagcuuuuaaa

SEQ ID NO: 279990 - RNA, 61 nt, Human
agucucuggucugugucugugugugccuguaagugugaaauaaaccucucugauggcagca

SEQ ID NO: 279991 - RNA, 61 nt, Human
uuugucaagacauuaaaccaucuuagaucggagugugaaguaaauuaugguauauuuuaug

SEQ ID NO: 279992 - RNA, 61 nt, Human
gguauuaaucuuguguagucuucaacugguuagugugaaauaguucugccaccucugacgc

SEQ ID NO: 279993 - RNA, 61 nt, Human
augugguucuuacccauuuaucuaggaugaaagugugaauuagagggacuccuuccaauaa

SEQ ID NO: 279994 - RNA, 61 nt, Human
auacacagaagggaaaaugugcacucaugcuagugugaauuugguaaguugcgugacucug

SEQ ID NO: 279995 - RNA, 61 nt, Human
aucuaauucuccugacuguucuucccaggggagugugaaggucuuggcccuguucccuguc

SEQ ID NO: 279996 - RNA, 61 nt, Human
auuucaguaguuugaucaguugaaggcuagaagugugaagugcagaugaguguguguucuu

SEQ ID NO: 279997 - RNA, 61 nt, Human
auuuucauuucaauauaaaaucaguauaaaaagugugaaugagcuguuuuugcuuuugcuu

SEQ ID NO: 279998 - RNA, 61 nt, Human
augagggagacagaccacuuuucuauauugcagugugaaugcugggccccugcucaagucu

SEQ ID NO: 279999 - RNA, 61 nt, Human
ggaaaagcuuccuugaugugagcucugggggagugugaaggaugcaucucuagcccccgag

SEQ ID NO: 280000 - RNA, 61 nt, Human
uuuucguuuuagcaaguaguacuuaauuuaaagugugaacuuaauauauaagaugccagga

SEQ ID NO: 280001 - RNA, 64 nt, Human
auauauuuaugcgaguugcaacuaugcuggcaacuggaggcaacagaaagaaaugaagugacuc

SEQ ID NO: 280002 - RNA, 64 nt, Human
ggccacccgaccugcccccagaacuuuuggauacuggaggcaguugcauaggucucccucucug

SEQ ID NO: 280003 - RNA, 64 nt, Human
ccauuccuuaguaucucacaaagcagaguaauacuggaggcagaguagggggugguuggagagc

SEQ ID NO: 280004 - RNA, 64 nt, Human
guuggaaguugaguaccugugaucuaaaauguccuggaggcagaugacaucuaaaauaugugcu

SEQ ID NO: 280005 - RNA, 61 nt, Human
cuucuuuaaaaaaaagggggggaaauaccaaagugugaaauacugugcuaccuuccagagu

SEQ ID NO: 280006 - RNA, 61 nt, Human
uaucucccugaggcuguuuccucgucuguuaagugugaauaucaauaccugccuuucauaa

SEQ ID NO: 280007 - RNA, 61 nt, Human
cacaccugucaccuuguaaaacacggacauuagugugaacacaggacagcuucgcucuuuc

SEQ ID NO: 280008 - RNA, 61 nt, Human
uccuguuucuacaggaagucaugcucgagggagugugaagugguucagguuggugcagagg

SEQ ID NO: 280009 - RNA, 57 nt, Human
agggauugaaaauggaguagaguauaaagugugaaugcauguugauuuugucuuagu

SEQ ID NO: 280010 - RNA, 61 nt, Human
gcuuuggcccccuuacucuuucauugacugcagugugaauauuggcuugaaccuuuucccu

SEQ ID NO: 280011 - RNA, 61 nt, Human
guaaccuaucaagaaaagcccuuauuuggaaagugugaaauuuguauuuggaaaagcugcc

SEQ ID NO: 280012 - RNA, 61 nt, Human
ggaguggagggaagcagggagggagggagcaagugugaagggcacagcugcuggcaaaugc

SEQ ID NO: 280013 - RNA, 61 nt, Human
uuuuaacuuuauaguuagaaaaauuggccucagugugaaauuuuuccagucccauagcuca

SEQ ID NO: 280014 - RNA, 61 nt, Human
aaauauuaauacuaacugggaaaaaaaaacuagugugaaguuuacaguuagaagaaacaga

SEQ ID NO: 280015 - RNA, 61 nt, Human
ggagaccauuggaagggauggaauauaagucagugugaaacugaguauacacugccauguu

SEQ ID NO: 280016 - RNA, 61 nt, Human
uuuaaagcacauuacgugcaauggcauagaaagugugaacaaagaaaaugauauuaaggag

SEQ ID NO: 280017 - RNA, 61 nt, Human
acacauaacauccaauuaugacuggguaauaagugugaaaauuuuaauuugugguuuucau

SEQ ID NO: 280018 - RNA, 64 nt, Human
ggucaccagcugagcugcgauaggaaaaucugaauggaggcagcaaacagccaaaacaaacauu

SEQ ID NO: 280019 - RNA, 64 nt, Human
aauugucucaaucuuggauguuucauuuuaugaauggaggcacuuuacuaggucuagaauauuu

SEQ ID NO: 280020 - RNA, 64 nt, Human
cacacacguguaacacugcaucggaugcggggcguggaggcaccgcuguauuaaaggaaguggc

SEQ ID NO: 280021 - RNA, 64 nt, Human
ggugugggcagcuguucccugccucgcaguguccuggaggcagcugucucgcagacucagcuug

SEQ ID NO: 280022 - RNA, 61 nt, Human
uguauaauuuaacagugcccuuuucaucuccagugugaauauauggucugugugucugaug

SEQ ID NO: 280023 - RNA, 61 nt, Human
guccucacaugcagaguugugcaugccccugagugugaacagguuugccuacguuggugca

SEQ ID NO: 280024 - RNA, 61 nt, Human
cucuuaagccaucuugguaaauuuccccaacagugugaaguuagaauuccuucagggugau

SEQ ID NO: 280025 - RNA, 61 nt, Human
gaauuuuugagacuuggguuuucuuaaugccagugugaauuugcagauguuuucagaaaau

SEQ ID NO: 280026 - RNA, 61 nt, Human
guguaauuguaauguagaacaguugugugguagugugaaccguaugaaccuaaguaguuug

SEQ ID NO: 280027 - RNA, 61 nt, Human
gauggaacaaacuuuaacuuaccaagcaccaagugugaaagugacuuucacgguuccuuca

SEQ ID NO: 280028 - RNA, 61 nt, Human
ucaacagcugcccuugaggagcacaggcagaagugugaacuugugaauguaauugaucuuu

SEQ ID NO: 280029 - RNA, 61 nt, Human
agcagcuuucucuggaaaaugaaugcuaauuagugugaaccaaaagaguaaguaagagucu

SEQ ID NO: 280030 - RNA, 61 nt, Human
uugcacuuuuuuguuugaauguuagaugcuuagugugaaguugauacgcaaggaaaauggu

SEQ ID NO: 280031 - RNA, 61 nt, Human
auucuaagugguugacagauguucacuuugaagugugaaguuuuaaaaauacgugaauaaa

SEQ ID NO: 280032 - RNA, 61 nt, Human
ccuugaaucugacuauagacauuuguuauucagugugaaacaaauauaagauacaucacag

SEQ ID NO: 280033 - RNA, 61 nt, Human
cuuaauaaauguaugacacugaaaagauuugagugugaaucuacugaaaucacuauaaugc

SEQ ID NO: 280034 - RNA, 61 nt, Human
auaaaucacuuaucggaaaugcacauuucauagugugaagcacucauuucuaaaccuuauu

SEQ ID NO: 280035 - RNA, 64 nt, Human
acuaacccaaaaacuuucuguagagcuguuccuuuggaggcagcaucacuuauuggcaguaaag

SEQ ID NO: 280036 - RNA, 64 nt, Human
caggauuaugguuaaccuggagaggagcaggccauggaggcaggugccaggucaguauugaguc

SEQ ID NO: 280037 - RNA, 64 nt, Human
acuugggagagaacgcagagcucccagccugcuguggaggcagcugagaagugguggccucagg

SEQ ID NO: 280038 - RNA, 64 nt, Human
uugagucuuuggaugccaacucagcccccugaccuggaggcagccggccaaggccucuagggaa

SEQ ID NO: 280039 - RNA, 61 nt, Human
guacacuuuuucaaaaugcucaccuacuggaagugugaauuacuugacaauguauggcuua

SEQ ID NO: 280040 - RNA, 61 nt, Human
aaggucaucaucgauucuacuuuagaaugagagugugaaauagacauuuguaaauguaaaa

SEQ ID NO: 280041 - RNA, 61 nt, Human
ccccauaaaaugauccugccaaucuaaugugagugugaagcuuugcacacuaguuuaugcu

SEQ ID NO: 280042 - RNA, 61 nt, Human
uuuaaguguuugaaaauuguuaauuaugcccagugugaacuuaguacuuaacacauuuuga

SEQ ID NO: 280043 - RNA, 61 nt, Human
ccuuauuuggaaaguugccauuuuaauguucagugugaaucagguagggauuugcuaguca

SEQ ID NO: 280044 - RNA, 61 nt, Human
gcaucauuuuuuuaaaaaauguaauugaauaagugugaaugcagaagcaaauauugucugc

SEQ ID NO: 280045 - RNA, 61 nt, Human
ucuguaccuuacaacagcgauucaggacccaagugugaacaacacucagcccgcccucugg

SEQ ID NO: 280046 - RNA, 61 nt, Human
uuucucgguucucagaggaaaaguaugaaugagugugaaguguaugugagaacuuuuguuu

SEQ ID NO: 280047 - RNA, 61 nt, Human
gugugacuccuuccagagccacagguaggggagugugaaguugagggggaggaaagcugga

SEQ ID NO: 280048 - RNA, 61 nt, Human
uagaaguaaagugugaugacgauaacacuuaagugugaauuuuuaaauauaguugaguaga

SEQ ID NO: 280049 - RNA, 61 nt, Human
uacuguuaaauauauguguguaaucagccugagugugaaaguuaauggaggccugggaaca

SEQ ID NO: 280050 - RNA, 61 nt, Human
aaguguaagaggaaucuacuguugcuauguuagugugaauguugaaggugcaauuaucaca

SEQ ID NO: 280051 - RNA, 61 nt, Human
uucaucucaggguuucuuggaguacaagaccagugugaaguuauucugauuucuugggaau

SEQ ID NO: 280052 - RNA, 64 nt, Human
ccuuucaacagaauucacuuguggcuauuagagcuggaggcacccuuagccacuucauuccccu

SEQ ID NO: 280053 - RNA, 64 nt, Human
gcuucauuucgucauguaauuguauauuuuuauuuggaggcauauuuucuuuucuuacagucau

SEQ ID NO: 280054 - RNA, 64 nt, Human
agcaguucuggcuguuguccaaagcaugggauucuggaggcagccagagcccugcugaguuccu

SEQ ID NO: 280055 - RNA, 64 nt, Human
acagccaugcucuugaggagcuuacaauccuggcuggaggcaggggaggguauauucuuuaaau

SEQ ID NO: 280056 - RNA, 61 nt, Human
ucaacauacuucauuuaauagcucguuaccaagugugaaugaagcaauaugucauaauaga

SEQ ID NO: 280057 - RNA, 61 nt, Human
gcuguuugaagugaguauuaaauauuucagaagugugaauuucauguauuugagcuccucu

SEQ ID NO: 280058 - RNA, 61 nt, Human
uagucaccauguaccucugacaacaaguuuuagugugaaagucacuaaacuuuuacacacu

SEQ ID NO: 280059 - RNA, 61 nt, Human
uagaguauuuuaauccuauuacuugacuaagagugugaagguaguacuuuuuagagugcac

SEQ ID NO: 280060 - RNA, 61 nt, Human
aguagcucuacagccuggccucaacucuaaaagugugaagaaugcaaugggcagagaccua

SEQ ID NO: 280061 - RNA, 61 nt, Human
caacaauuugaaaauugugguugcauuuuaaagugugaacacuccccuauguaaauaugcu

SEQ ID NO: 280062 - RNA, 61 nt, Human
uguuuauauuuuuauuaaugucauuucuggaagugugaaaauguuaauguucaacaagcaa

SEQ ID NO: 280063 - RNA, 61 nt, Human
agaauguuuauuaccucauaagugcauauauagugugaaagagaaggcauuaaaaagaagu

SEQ ID NO: 280064 - RNA, 61 nt, Human
agaauggcugacuugaagagcaacaucauagagugugaauuucuauuugggaaggagaaaa

SEQ ID NO: 280065 - RNA, 61 nt, Human
gucaugcagacaugacuguucucuuuguacaagugugaaucaaaauauguaucucuuuuuc

SEQ ID NO: 280066 - RNA, 61 nt, Human
gguuuuccuguugaggggcaccacauacaauagugugaaguagguaugaggggcagucauu

SEQ ID NO: 280067 - RNA, 61 nt, Human
ugggauguuaacaggagccaaaaggagggaaagugugaagaauaaaguagaucugagaaau

SEQ ID NO: 280068 - RNA, 61 nt, Human
ccugcagaccuggcugggccugggcuuccacagugugaagacacugugcaggcccaggcag

SEQ ID NO: 280069 - RNA, 64 nt, Human
uuagagccagggggagcugggccuggucucacccuggaggcaccugguggccaugcuccucuuc

SEQ ID NO: 280070 - RNA, 64 nt, Human
gaaagacauucuuccccaggaggaauguuuaaaauggaggcaacauuuuggccaacauuggaaa

SEQ ID NO: 280071 - RNA, 64 nt, Human
caugggcuucaaagaacauuucuucuuuuagcuuuggaggcacuugccguggcacaccuggacu

SEQ ID NO: 280072 - RNA, 64 nt, Human
gccuucuaggaucuguccaagacacucucaggccuggaggcagggcauagaaucaguucuucac

SEQ ID NO: 280073 - RNA, 61 nt, Human
aacaaaaaagcaaaccuuaaaaugugaagaaagugugaauuuuaguuuugucacaguuaac

SEQ ID NO: 280074 - RNA, 61 nt, Human
caacaaacugcuuucugguuagcugaaggcaagugugaaaaucagaauuuagaauauuuag

SEQ ID NO: 280075 - RNA, 61 nt, Human
uuggaagguggcccaguaugagcccuagaagagugugaaaaggaauggcaaugguguucac

SEQ ID NO: 280076 - RNA, 61 nt, Human
caaauuccuguacauagagauauauuuuuuaagugugaauguaacaacauacugugaauuc

SEQ ID NO: 280077 - RNA, 61 nt, Human
uugaaucucagaaaaaaguagauuuuaauaaagugugaaaguugucaaucaaagcggaguc

SEQ ID NO: 280078 - RNA, 61 nt, Human
uaguuauauuacaaacauuaucggccuuucuagugugaaugaacauuagacacauuauugu

SEQ ID NO: 280079 - RNA, 61 nt, Human
cauaccaugcggauuuuauauguacaucaguagugugaauccacuggcacaguguguguaa

SEQ ID NO: 280080 - RNA, 61 nt, Human
aaguaggguccuauuauguuuuuuuuucaguagugugaauuaauccuuuugugcuguguuu

SEQ ID NO: 280081 - RNA, 61 nt, Human
guauuuuuuuaaaaaaaaaguuuaccgcuguagugugaaauauugucuggaaagggauggu

SEQ ID NO: 280082 - RNA, 61 nt, Human
ugaauuuugucaauuaaaaaagcgugggagcagugugaaggagaagaggcaagaacgaccc

SEQ ID NO: 280083 - RNA, 61 nt, Human
acuguauuuuaugcauucaugucuaggauacagugugaaaauuaaaaaguuuagagggcag

SEQ ID NO: 280084 - RNA, 61 nt, Human
ugcagugagcaucacuacagucucagucaacagugugaauguaucauguuuuacuuuaaau

SEQ ID NO: 280085 - RNA, 61 nt, Human
gcaugcuuuugugcacacucucuggggcuccagugugaagggugcccuggggcugagggcc

SEQ ID NO: 280086 - RNA, 64 nt, Human
auggacaguccagggcuuaugcccagcagcccacuggaggcauucuucaggcuccuuuaaggca

SEQ ID NO: 280087 - RNA, 64 nt, Human
cuuuccccaaugcuugaaagaagaucaccacugcuggaggcauaauguacaaggcaggaaaagg

SEQ ID NO: 280088 - RNA, 64 nt, Human
ucaggaggcugaggcaggagaaugcugugaacccuggaggcagagcuugcagugagccgaauau

SEQ ID NO: 280089 - RNA, 64 nt, Human
uuugguaaaccauuuaaaauacaaaauccuauuuuggaggcaauaggauaagcauugucuuagu

SEQ ID NO: 280090 - RNA, 61 nt, Human
cuagcagacuaucuguucauaaucaguuuucagugugaauucacugaauguuuauagacaa

SEQ ID NO: 280091 - RNA, 61 nt, Human
gagacagauuuguccuuuacagaaauuacugagugugaauaaaaacuucagauccaagaaa

SEQ ID NO: 280092 - RNA, 61 nt, Human
ccuuccugcucccccauuuccuaacucccccagugugaauucucagggucacuucugccuc

SEQ ID NO: 280093 - RNA, 61 nt, Human
uuuguuccuuguggaacaaaugggcaaaagaagugugaaaauguggguguuuaugucugug

SEQ ID NO: 280094 - RNA, 61 nt, Human
gucaggguaccuggggccaaacccaccugcuagugugaauuaaaguacuuuaauuuuguuu

SEQ ID NO: 280095 - RNA, 61 nt, Human
aaaguaaugguggauaagcugcuggugccuuagugugaaucaagguagugccaccaaagug

SEQ ID NO: 280096 - RNA, 61 nt, Human
gguagauuucacagcccuucuacuaauagugagugugaaggcaagcuugaugcaaaaccuc

SEQ ID NO: 280097 - RNA, 61 nt, Human
auaaugauagaugauauacuagauuuuucaaagugugaaaaccuuuagacuuuuuuuagca

SEQ ID NO: 280098 - RNA, 61 nt, Human
uaaacauggauuaccuguguuuaaaaaaaaaagugugaauggcguuaggguaagggcacag

SEQ ID NO: 280099 - RNA, 61 nt, Human
uuccccaaggauuuauugacauugcuacuugagugugaacaguuaccuggaaauacugaug

SEQ ID NO: 280100 - RNA, 61 nt, Human
uuauauaaaaccaucuuuaaaaaccaauagaagugugaauaguagaauauuaauuaaaaug

SEQ ID NO: 280101 - RNA, 61 nt, Human
uguccaaacuuggggcuucccaggcaccugcagugugaacacugcuuggcuggcucaagau

SEQ ID NO: 280102 - RNA, 61 nt, Human
gggagagcagcuccccucgccccgccccugcagugugaaugugugaaacauccccucaggc

SEQ ID NO: 280103 - RNA, 64 nt, Human
gguguggugcuggcuagaggucccugccccugucuggaggcacaacgcccauccuuaggccaaa

SEQ ID NO: 280104 - RNA, 64 nt, Human
cucccucucuccuccggcacccauuaccucucccuggaggcaacuguuuugauccauuucuuac

SEQ ID NO: 280105 - RNA, 64 nt, Human
agauagagacacaggggagaaugccacaugaagcuggaggcagagauuggagugauacauugug

SEQ ID NO: 280106 - RNA, 64 nt, Human
cuaauuuaaccuuaacugaauucuccguuucuccuggaggcauuuauauucagugauaauuccu

SEQ ID NO: 280107 - RNA, 61 nt, Human
aggccagggacgucacccaaggcugguggucagugugaagggcuccgugccaacuggucag

SEQ ID NO: 280108 - RNA, 61 nt, Human
cgagaguucgccccaacccuuccccaggcccagugugaaaaacagacucacaaggggcuuc

SEQ ID NO: 280109 - RNA, 61 nt, Human
acaucuucccucuccccauucgguguggugcagugugaaaaguccuugauuguucgggugu

SEQ ID NO: 280110 - RNA, 61 nt, Human
gggcacgggcgcgggccgggccucaagggugagugugaaauaaacaaauccugcaguguuu

SEQ ID NO: 280111 - RNA, 61 nt, Human
acuaggauacuuuuauaugaugggugcuuugagugugaaugcagcaggcucucuuguuucc

SEQ ID NO: 280112 - RNA, 61 nt, Human
auuuuguuuuccacuugaauuacaccacccuagugugaaaucggggacuucaaagugcuug

SEQ ID NO: 280113 - RNA, 61 nt, Human
ucuaucagggaagucaauggcuggccaguguagugugaagucccagcuuggcagagacuug

SEQ ID NO: 280114 - RNA, 61 nt, Human
aguauauguuaggagguuauaaaucuuguggagugugaauuaaguauguggagugucuaga

SEQ ID NO: 280115 - RNA, 61 nt, Human
ggucugaucagugcuaugagauggacagauaagugugaauguuuuauacagaaaauggaaa

SEQ ID NO: 280116 - RNA, 61 nt, Human
aaaaaaaaaaaaaacuucauuggcuuguccgagugugaaaugcacauuuaggaagguuaca

SEQ ID NO: 280117 - RNA, 59 nt, Human
cgucuuugauuuugugacauuucugcuuggaagugugaacuacccccccccccccgcuu

SEQ ID NO: 280118 - RNA, 61 nt, Human
gaaaauuacugaaacuauuuuacugugaaacagugugaacuauuauaaugcaaauacuuuu

SEQ ID NO: 280119 - RNA, 61 nt, Human
gggacuaagggaagaacucucuaguucccucagugugaagccugucguguucucuccccuu

SEQ ID NO: 280120 - RNA, 64 nt, Human
agccugagggggugucuaggugaucauuuggaucuggaggcagagucugccauucugccagacu

SEQ ID NO: 280121 - RNA, 64 nt, Human
gcaggcccugcccucugggaaggucccuucaugcuggaggcacacagcuuuaaggaaguagguu

SEQ ID NO: 280122 - RNA, 64 nt, Human
uuucuaccccugacucaugcagacaucuauuacauggaggcaguagaaggaccccuggagccag

SEQ ID NO: 280123 - RNA, 64 nt, Human
cuggcccuucccucaagcccagugaggagguggguggaggcaugcaggggagacgacucaggga

SEQ ID NO: 280124 - RNA, 61 nt, Human
gucacucacuggcugauacauuuaaagcagcagugugaauagcaaggacagacaccuucaa

SEQ ID NO: 280125 - RNA, 61 nt, Human
aaauaggaguaaagcaugcacuacuuguugaagugugaaauggagacucuggacuuugggu

SEQ ID NO: 280126 - RNA, 61 nt, Human
uaucuuugcacucuugugcuaguaugucuauagugugaauacauucauaaauuucuugauc

SEQ ID NO: 280127 - RNA, 61 nt, Human
gggcacggggcgucggcugcugcggccccgcagugugaacguuggcugcugccuuagcugc

SEQ ID NO: 280128 - RNA, 51 nt, Human
gcaugugugugugugugugagagugugaaugcacagguggguauuuaaucu

SEQ ID NO: 280129 - RNA, 61 nt, Human
ggccacccuagugugcuaagcugagcagugcagugugaacagggcccaugguguauucuag

SEQ ID NO: 280130 - RNA, 61 nt, Human
guuuuuuuucuucuguuaguuuuuguuuuuaagugugaaugcaagugauuaaugaauacag

SEQ ID NO: 280131 - RNA, 61 nt, Human
uguggugaacucuuaaggacuuuucccuucaagugugaaggaaggugugaugaaugcugug

SEQ ID NO: 280132 - RNA, 61 nt, Human
ggaacuuucaccuuaaaaucuuucuaagcaaagugugaauaggauuuuuacucccuuugua

SEQ ID NO: 280133 - RNA, 61 nt, Human
cucaacaggguccuggaugagaugcgcugucagugugaaacggugcuugccaacaaucgca

SEQ ID NO: 280134 - RNA, 61 nt, Human
accacaggagggagauguugucaaaugcuacagugugaacauguauuuugaauauucugua

SEQ ID NO: 280135 - RNA, 61 nt, Human
gaaaaagacaaaugcccucauaguagugggaagugugaaggugaccgugaacauccuuccu

SEQ ID NO: 280136 - RNA, 61 nt, Human
ucaccguauuucuacuacuacuuaaugaaaaagugugaacuuuauagaauccucucuguac

SEQ ID NO: 280137 - RNA, 64 nt, Human
cugcccagagauucccccuucuccucuccccuacuggaggcaaaggaaggggaggguggauggg

SEQ ID NO: 280138 - RNA, 64 nt, Human
ggggaggaggggcuagaacaagggcccaggggacuggaggcaggaugguggcuuucccuaccug

SEQ ID NO: 280139 - RNA, 64 nt, Human
auccccacauggguccucauaaaggauuauucaauggaggcauccugacaucuguucauuuagg

SEQ ID NO: 280140 - RNA, 64 nt, Human
agcagccuuuaagaagugucccuuuggcgcccccuggaggcagagcacugagcuggacccuggg

SEQ ID NO: 280141 - RNA, 61 nt, Human
gaaaaaugaccugacccuguagagagaacacagugugaauguuuccccucgugugagccca

SEQ ID NO: 280142 - RNA, 61 nt, Human
aucuuaaacuaggugauucuacuugauuuucagugugaagccauuaauaacgaacuuuaug

SEQ ID NO: 280143 - RNA, 61 nt, Human
uguauaggucugccugcagggugaaaaugccagugugaauauucuagcuaccaaacauugu

SEQ ID NO: 280144 - RNA, 61 nt, Human
cagggccuucuccagaucuguuccaacuuggagugugaagggcuugagcauacgggggaag

SEQ ID NO: 280145 - RNA, 61 nt, Human
aggaaauaagcccugcugcuuucuagaaauaagugugaaggauaaauuuucuuuguugacc

SEQ ID NO: 280146 - RNA, 61 nt, Human
uuuuuagcuuuuaaaauuuaaaguguuuuugagugugaaaaguugaguaaaacuauuugca

SEQ ID NO: 280147 - RNA, 61 nt, Human
ucauuuuacagaugaggaaauaaagccuacaagugugaaauuaauuuccuuacaguuuucc

SEQ ID NO: 280148 - RNA, 61 nt, Human
aggguacggagaguccccucugugggcuggcagugugaaugagaucuguuuagucucgugc

SEQ ID NO: 280149 - RNA, 61 nt, Human
uugugagugauaucugcauauguuucuguacagugugaaaugacugacccuguaguauagu

SEQ ID NO: 280150 - RNA, 61 nt, Human
agaccuuaauaggaaaaaaagaguaaagcucagugugaaugcaaacauccacaaaauauga

SEQ ID NO: 280151 - RNA, 61 nt, Human
uuauaccuuaauauucagcugugaucucacaagugugaaaaaucuuaugaauguaaaaugu

SEQ ID NO: 280152 - RNA, 61 nt, Human
ccucaccuucccugcugggucucuggggcacagugugaaacccgcacccuagccaggcccc

SEQ ID NO: 280153 - RNA, 61 nt, Human
cacauaauucauaccaaacagaagcccuacaagugugaagaauguggcaaaaccuauaaac

SEQ ID NO: 280154 - RNA, 64 nt, Human
ggugggaacauggaggccaguguuggggagccuguggaggcagguguguagaauuguguucggg

SEQ ID NO: 280155 - RNA, 64 nt, Human
uugacagcauuuguuaggcagaauauuuuggauuuggaggcauuugcaugguagucuuugaaca

SEQ ID NO: 280156 - RNA, 64 nt, Human
ucauucauuuaacagagcuuccuuagguugaugcuggaggcagaaucccggcugucaaggggug

SEQ ID NO: 280157 - RNA, 57 nt, Human
ggguucuggguggggagugaggggucuuggaggcagggcugucccacagggcgcccg

SEQ ID NO: 280158 - RNA, 61 nt, Human
aagaacauucauacugaagaggaacccuaugagugugaagaauauggcaaagccuucaaca

SEQ ID NO: 280159 - RNA, 61 nt, Human
aagauaguucauacugaagaaaacuucuacaagugugaacaguguggcaaaacuuuuaaug

SEQ ID NO: 280160 - RNA, 61 nt, Human
aaaaaaauuuauacuguacaaaaaccccacaagugugaaaaacauggcaaagccuuuaaga

SEQ ID NO: 280161 - RNA, 61 nt, Human
acacauaauuuauacuggacagaaauccuaaagugugaagaaugucacaaagcccuuaaua

SEQ ID NO: 280162 - RNA, 61 nt, Human
gguaagauaauucauacuggagaaaacuaccagugugaacaacguggccaagcuucgacaa

SEQ ID NO: 280163 - RNA, 61 nt, Human
aaacacgaccagguccgaaaugcaggucaugagugugaaauucucaaauuuacauaaaaag

SEQ ID NO: 280164 - RNA, 61 nt, Human
uaaaugacauauaaguuauacauauuuauggagugugaaauuugauacauguauauaaugu

SEQ ID NO: 280165 - RNA, 61 nt, Human
cuuauuccccaccugauaccuuauagagaaaagugugaauucagguggagaguaggcccag

SEQ ID NO: 280166 - RNA, 61 nt, Human
ggaggagccuggccucuguccacccgucagcagugugaagucuguuguguuugagcuucuc

SEQ ID NO: 280167 - RNA, 61 nt, Human
ucuuaccaugugcugauguaugugcucugccagugugaagggugaacagcuccaacuuuau

SEQ ID NO: 280168 - RNA, 61 nt, Human
auuuauaccuauuuauguauuuauuuauugaagugugaaauugagcaauaggcaggcacca

SEQ ID NO: 280169 - RNA, 61 nt, Human
aaagugggaaaaucuuccaacuguccucuagagugugaauauaugaaaggagucagagugg

SEQ ID NO: 280170 - RNA, 61 nt, Human
uaagauaauucuuacuagaaaaacucuuacaagugugaagaauguggcaaaauuuuuaaug

SEQ ID NO: 280171 - RNA, 64 nt, Human
augccaguuaucaugcugccacuacaucguuaucuggaggcaacuucuggugguuuuuuuuucu

SEQ ID NO: 280172 - RNA, 64 nt, Human
cucuuaggugccagucugguaacugaacucccucuggaggcaggcuugagggaggauuccucag

SEQ ID NO: 280173 - RNA, 64 nt, Human
caaggacuuucaugauuauccucagggacaggauuggaggcauugagcguguuuauuaacaaau

SEQ ID NO: 280174 - RNA, 64 nt, Human
ugcacugcucccucuagaaagauuccuucaggucuggaggcagaggaaugggcauagcugagcc

SEQ ID NO: 280175 - RNA, 61 nt, Human
aagauaauuuacauuggaguaaacuucuacaagugugaagaauguggcaaaacuuuuaauu

SEQ ID NO: 280176 - RNA, 61 nt, Human
guccacacucaagagaacgggaugauacaagagugugaauaaguccuggagacaggaccac

SEQ ID NO: 280177 - RNA, 61 nt, Human
aacucuuacucaacaucaaagaauucauaccagugugaaacccuaugaauguaaggaaugu

SEQ ID NO: 280178 - RNA, 61 nt, Human
aaccaugcuaaccaccaaggcaaagcagcacagugugaauagaacagagcgggaucaagaa

SEQ ID NO: 280179 - RNA, 61 nt, Human
cucuuaccgcucaugggccucaguuuccuaaagugugaaaugucaggcacuucccucuaac

SEQ ID NO: 280180 - RNA, 61 nt, Human
uccuccauaucucccucuucccuaggagaggagugugaagcaaggagcuuagauaagacac

SEQ ID NO: 280181 - RNA, 61 nt, Human
uuaucuuggggaccagcuaagucucugcaguagugugaaauuccaaaugguuguuuuauca

SEQ ID NO: 280182 - RNA, 61 nt, Human
aacuucugagucgcccaucuguugcugugggagugugaacggaucgcugaaggagagggag

SEQ ID NO: 280183 - RNA, 61 nt, Human
cccgcccuucguucugaguaauaauaccgucagugugaaaacauuccguaguuuagaagua

SEQ ID NO: 280184 - RNA, 61 nt, Human
uuuccaucacuguuaaugaucagaguaacaaagugugaaaaauaagaaaccaucauugaug

SEQ ID NO: 280185 - RNA, 61 nt, Human
acacacuuccuuccuucuuuggugucugaggagugugaacuguuggggucaguuaagaccc

SEQ ID NO: 280186 - RNA, 61 nt, Human
ggagccuugauucccuuguuauucaacagcaagugugaauacugcuugaauaaacaccacu

SEQ ID NO: 280187 - RNA, 61 nt, Human
ggagagcccagugaacugacccuucaggcugagugugaagcgucucagaggcauuucagaa

SEQ ID NO: 280188 - RNA, 64 nt, Human
uuauaaaccaaauuuacuaugaaguccuuugcuguggaggcaauguuguuccagagucaacgag

SEQ ID NO: 280189 - RNA, 64 nt, Human
agcccaacacaaaacgaguguggauuuaucuaaauggaggcagaccugaagauggcacuuaugc

SEQ ID NO: 280190 - RNA, 64 nt, Human
cgcuuucauaaacuucagggaucccguguugccauggaggcaugccaaauguuccauauguggg

SEQ ID NO: 280191 - RNA, 64 nt, Human
guucccuuaaaaagaaacacauaagacuuaccaauggaggcauugugaaugguugcaguggagc

SEQ ID NO: 280192 - RNA, 61 nt, Human
uucaagugauucucaucucagccucccaaguagugugaacuaaaggcaugugccaccacgc

SEQ ID NO: 280193 - RNA, 61 nt, Human
ucccaagguagaauuguaauaagcaugugccagugugaaagcuggaaggaaaaaagcuauu

SEQ ID NO: 280194 - RNA, 61 nt, Human
aaacguacagccaggcccgugugcuguuaauagugugaaauugucauguuaaaaaaaaaaa

SEQ ID NO: 280195 - RNA, 61 nt, Human
guccuccuuaaccacuuaucucccauaugagagugugaaaaauaggaacacgugcucuacc

SEQ ID NO: 280196 - RNA, 61 nt, Human
uuuuauauuccuguuucuaaaucagcucuucagugugaaagaaaacacguuucuguaacag

SEQ ID NO: 280197 - RNA, 61 nt, Human
uuacuaacucaugacuugggagcuaagcccaagugugaaaccucuggauccuauggauuug

SEQ ID NO: 280198 - RNA, 61 nt, Human
cccaaagcugcugccuggccccuugcuguaaagugugaagggggcggcugaguucucuuag

SEQ ID NO: 280199 - RNA, 61 nt, Human
guguauguuaaaggaucuccacaaugucugcagugugaaggcagguucauuguggaauagu

SEQ ID NO: 280200 - RNA, 61 nt, Human
uuucugaaacuggagcgguucaacguuauccagugugaaaaucagugaguccucccuggca

SEQ ID NO: 280201 - RNA, 61 nt, Human
ucaugugaugucaugaaacuguacauacugcagugugaauuuuuuuguuuuguuuuuuaau

SEQ ID NO: 280202 - RNA, 61 nt, Human
aggugccacaaugcaaaugcuuaaggcacggagugugaaugugaagacacaagcucuuucu

SEQ ID NO: 280203 - RNA, 61 nt, Human
uuagaaauacuuccaggaaaugcuuuuuugaagugugaauuaauaagaaaugggguaaaua

SEQ ID NO: 280204 - RNA, 61 nt, Human
cagaaaagaucaauagcuuuagccacauggaagugugaacauccugauggggaaaauacca

SEQ ID NO: 280205 - RNA, 64 nt, Human
caggaauggguuuuggugccugaaaaauuggccauggaggcacaccaaagcuucaagcacaagu

SEQ ID NO: 280206 - RNA, 64 nt, Human
agucacaucuguccagagaaauuccuuuugggacuggaggcagaaaagcggccagaaggcagca

SEQ ID NO: 280207 - RNA, 64 nt, Human
ggccuggccuaccucccccauccccugcuucccuuggaggcagagggcucccuugacuaccuuu

SEQ ID NO: 280208 - RNA, 64 nt, Human
aggagguuggauuucugccagugggggauguuucuggaggcagcuggucccccacaccgcgucc

SEQ ID NO: 280209 - RNA, 61 nt, Human
cauaaaugacuuuuaaagggguuguauguuuagugugaacaaagacaguacaaagcauaua

SEQ ID NO: 280210 - RNA, 61 nt, Human
uuaugauacggguuucuugggucugauguacagugugaauaaaugcuugcagcucuuagcu

SEQ ID NO: 280211 - RNA, 61 nt, Human
ugugcugagggcugugagaaugugaaacaacagugugaaaauuggcugugacacucugguc

SEQ ID NO: 280212 - RNA, 61 nt, Human
ggucaagauauaaaggugucagcuaguuuuaagugugaaacuuauuucacuuucacacugc

SEQ ID NO: 280213 - RNA, 61 nt, Human
agucuggaagggcaggugggagcugugacacagugugaaaaagcauuuguagagagacuuu

SEQ ID NO: 280214 - RNA, 61 nt, Human
agaagccggcguccugcucacaaacugggaaagugugaaaacuauuuaagauaauuauuac

SEQ ID NO: 280215 - RNA, 61 nt, Human
ugaaccaacaucaggggcaccugccaugaugagugugaagaaaucauuucucuaugcaaga

SEQ ID NO: 280216 - RNA, 61 nt, Human
guauggcuuuuguguaguuagggguuuuuuaagugugaagaaagguaugugggcuuuaaaa

SEQ ID NO: 280217 - RNA, 61 nt, Human
guguugcuguaaaguguuuuucuccauaggaagugugaacuguguauugucuauuguuagu

SEQ ID NO: 280218 - RNA, 61 nt, Human
uugaggaccucauccaaacaauuuaaaaaugagugugaagggggaacaagucaaaauauuu

SEQ ID NO: 280219 - RNA, 61 nt, Human
acagucaacaggggugugauggugaaggcagagugugaaaaacgugagagaggaagagaaa

SEQ ID NO: 280220 - RNA, 61 nt, Human
guuaaggagaaagaaauuaauauacaagcugagugugaaaguagaaaucaccuacaccaga

SEQ ID NO: 280221 - RNA, 61 nt, Human
cauaauaacagcaguggaguaaguauuuagaagugugaauucaccgugaaauaggugagau

SEQ ID NO: 280222 - RNA, 64 nt, Human
acuuaaaucuugcccugcaugaaauucaaauacauggaggcacaucuucagggcaccaguguua

SEQ ID NO: 280223 - RNA, 64 nt, Human
uggaaggccaaagcuacugaauuuagcgaauuuguggaggcauugccacaaaucagccagguga

SEQ ID NO: 280224 - RNA, 64 nt, Human
cgcucaucuggacccugcagugucagggacccuauggaggcaagccaguaauaaagaagacacu

SEQ ID NO: 280225 - RNA, 64 nt, Human
uuccuccgugcaguuuucugcaacucuggagaaguggaggcauacuugugugucuggguuguuu

SEQ ID NO: 280226 - RNA, 61 nt, Human
cccuaccuuaccccucugccccuagccaaggagugugaauuuauagaucuaacuuucauag

SEQ ID NO: 280227 - RNA, 61 nt, Human
uuucuucuaaaaucaaagcaugaugcuugacagugugaaauguccaauuuuaccuuuuaca

SEQ ID NO: 280228 - RNA, 61 nt, Human
agaacagcaacaagagaguucuaacaauucuagugugaagccaaauagugaucuuuuagug

SEQ ID NO: 280229 - RNA, 61 nt, Human
cguacagcauaucuauacaaaauucugcuauagugugaaaaucagggcuaaaaaccugaag

SEQ ID NO: 280230 - RNA, 61 nt, Human
guuuacugucacuuuugauauggucuuauccagugugaacagcaauuuauucuuauuuuug

SEQ ID NO: 280231 - RNA, 61 nt, Human
uuuuuuauucagcagacuuucucuguguaugagugugaaugaucaaguccuuugugaauau

SEQ ID NO: 280232 - RNA, 61 nt, Human
ugucacugcaauaaguggguuuuagaaaauaagugugaaaagaaucagguguuaauauaau

SEQ ID NO: 280233 - RNA, 59 nt, Human
gauggaguuucacuuuuguugcccaggcuggaguguaguggcgcgaucucggcucagcc

SEQ ID NO: 280234 - RNA, 59 nt, Human
guuugcagaaccagggguuuauauugcagggaguguauuuucugaauucuaagucagaa

SEQ ID NO: 280235 - RNA, 59 nt, Human
aagcaaggaggagggaggugggguagggaggaguguaggaugccuuguuuccuucuaua

SEQ ID NO: 280236 - RNA, 59 nt, Human
gauggaauuucacucuugucgcccaggcuggaguguaguggcgcagucucagcucacug

SEQ ID NO: 280237 - RNA, 59 nt, Human
gaauuuucuucuacuuggucaucaaaaaaggaguguaauagaagugaggggagcugcuc

SEQ ID NO: 280238 - RNA, 59 nt, Human
cuguuuaccuuuucaaggcuguauugguuggaguguagacugaacugccuggggucugu

SEQ ID NO: 280239 - RNA, 64 nt, Human
caagaagaggaguggaagcacaguugccuggauuuggaggcagaguugucaggcuuuucaagcu

SEQ ID NO: 280240 - RNA, 64 nt, Human
ucugcccagcugcccuccccucgccccuuggcauuggaggcaacagacggugguccucuuggua

SEQ ID NO: 280241 - RNA, 64 nt, Human
ggagcucuuugcagugcaccaggcacguugagaguggaggcacaauggaaauccucugugggac

SEQ ID NO: 280242 - RNA, 64 nt, Human
cacugucacugccgacaucccucccccagcagaauggaggcaggggacaagggaggcaguggcu

SEQ ID NO: 280243 - RNA, 59 nt, Human
cuaagccauuugucuuuuucucaguggagggaguguauggaccuggccccauggcuuug

SEQ ID NO: 280244 - RNA, 59 nt, Human
uugcccugagcuuuccggggaggagccuuggaguguaauuaccugucaucugggccacc

SEQ ID NO: 280245 - RNA, 59 nt, Human
gcaucagcuuuggaaagugugacucuguaggaguguagaaggcagugguguaugaucuu

SEQ ID NO: 280246 - RNA, 59 nt, Human
uauuuuuuuaauuuuguggguacauaguaggaguguauuuuuauggguuacaugagaua

SEQ ID NO: 280247 - RNA, 59 nt, Human
gagacggagucuugcccucucgccaggcuggaguguaguggcacaaucucagcucacug

SEQ ID NO: 280248 - RNA, 59 nt, Human
cagagucucccccucugcagcccauccugggaguguauuaacuggagggaagauggguc

SEQ ID NO: 280249 - RNA, 59 nt, Human
uguucucugcugugaaacucuuaaaacaaggaguguauuuuagagacaagggaaaaaaa

SEQ ID NO: 280250 - RNA, 59 nt, Human
cuacuccucuuggcaucaaacaagguuugggaguguaggaggugcgggaaagugcuugu

SEQ ID NO: 280251 - RNA, 59 nt, Human
uagccgucccagugaaaauccucauuguuggaguguaaaccaaauacgaagcccucuug

SEQ ID NO: 280252 - RNA, 59 nt, Human
cacagacuguugucccugcacucuuuaagggaguguacucccagggcuuacggcccugg

SEQ ID NO: 280253 - RNA, 59 nt, Human
augucuauguucuuguugcuaugagucaaggaguguaaccuucuccuuuacuauguuga

SEQ ID NO: 280254 - RNA, 59 nt, Human
gagacggagucucgcccugucgccaggcuggaguguaguggcaugaucucgacucacug

SEQ ID NO: 280255 - RNA, 59 nt, Human
acauggcacaggcauugcacacggugugaggaguguacaccugcaagggcugaggcccu

SEQ ID NO: 280256 - RNA, 59 nt, Human
cuaaaacuuggaacuaagauagagaagauggaguguauguagaagggcuguuaaaaaug

SEQ ID NO: 280257 - RNA, 64 nt, Human
gaaaugacacaccuacucccaggaacagcagagguggaggcaagcagugacuccugagagacau

SEQ ID NO: 280258 - RNA, 64 nt, Human
agcauagaaguaaucaaguagcaucugagacuguuggaggcacuagggccucucugggcccuac

SEQ ID NO: 280259 - RNA, 59 nt, Human
gccacaugaggcugucaagcaaaagaauaggaguguaguugaguagcugguuggcccua

SEQ ID NO: 280260 - RNA, 59 nt, Human
uuuaauauauaaauuauguauggugaaguggaguguauuguguaggucccguauuuaau

SEQ ID NO: 280261 - RNA, 59 nt, Human
uauucuaauauagaggcauugagaggaggggaguguaugucuagaguuaccccaauucu

SEQ ID NO: 280262 - RNA, 59 nt, Human
uucaaggugaucuuuuauuuaccuguacaggaguguaaacuuuuuugugcuuuuauuuu

SEQ ID NO: 280263 - RNA, 59 nt, Human
aaaguauaccgucaccuuuucacaucacuggaguguaaaauuuaaaacaagauggugau

SEQ ID NO: 280264 - RNA, 59 nt, Human
cugccaugucacagcugcuuucucuggcuggaguguaggcuguaccccauuuccuuggc

SEQ ID NO: 280265 - RNA, 59 nt, Human
agacagggucucgcucugucacccaggcuggaguguaguggugcagucuuggcucacug

SEQ ID NO: 280266 - RNA, 59 nt, Human
gauguuaaaaugcuaauuugagagaaguaggaguguaucuguuuuauauguugggaugu

SEQ ID NO: 280267 - RNA, 59 nt, Human
uuuuauuucacaaaacaggcauaugucuaggaguguaauuuguggaugguugaguuugu

SEQ ID NO: 280268 - RNA, 59 nt, Human
cccgaauaccugcuuaguuccugaaaaggggaguguaacuaguggauuugggaaagguu

SEQ ID NO: 280269 - RNA, 59 nt, Human
ccgguauucgauacugcgacuuucugccuggaguguaugacugcacaugacucgggggu

SEQ ID NO: 280270 - RNA, 59 nt, Human
aauuuuuuuugauguuguugucuuuuucaggaguguagaaaucuauguauuggugguug

SEQ ID NO: 280271 - RNA, 59 nt, Human
aaucuaaagccaguggcuugaggcuacagggaguguaguaaagccguuguuuacuuaaa

SEQ ID NO: 280272 - RNA, 59 nt, Human
ugcuggaagcuaaauuuacacuuaaaguuggaguguauaaacauuuuaauauauguuaa

SEQ ID NO: 280273 - RNA, 64 nt, Human
uuccccaggaggaaaacaaguacaaagguuacgguggaggcauaaguagaagagauuguuaaga

SEQ ID NO: 280274 - RNA, 64 nt, Human
uuucccacuaacuuuguuucugaccaaagugaauuggaggcacucugcuaaaagacauccccgu

SEQ ID NO: 280275 - RNA, 59 nt, Human
gcccacgucauccugaacgacaucaccgaggaguguaggcccccaucgucccucaugug

SEQ ID NO: 280276 - RNA, 59 nt, Human
ccaauaggauuugcugagaguuugaauguggaguguaagagaaggaagaguuaaugaug

SEQ ID NO: 280277 - RNA, 59 nt, Human
gugcucagcccugagauccugcacaagguggaguguacuggcuacgcccuggguuucau

SEQ ID NO: 280278 - RNA, 59 nt, Human
aagguggguggggugugcauuuccuguuaggaguguaucagugcuugucuuauuauaag

SEQ ID NO: 280279 - RNA, 59 nt, Human
uccuucagccagagcccagagcauagacaggaguguaggagucccuguuugauguacuc

SEQ ID NO: 280280 - RNA, 59 nt, Human
uggcaacaggacccucgcucacauccaccggaguguauguguggggaggggcuucaccu

SEQ ID NO: 280281 - RNA, 59 nt, Human
auauaagaaaauguuagaaaaaaauauggggaguguauauaaaacuugcuuuauugcau

SEQ ID NO: 280282 - RNA, 59 nt, Human
ucuauaaaguaguaagacuugguaugguuggaguguaggaaugaauauucaugaaaugu

SEQ ID NO: 280283 - RNA, 59 nt, Human
cucauacuuccccacauugagaagcauucggaguguauuuagccuguagauguugugau

SEQ ID NO: 280284 - RNA, 59 nt, Human
auaaauacaucuaaauaaaacaugccuugggaguguacagaccuuucugcacuaauacc

SEQ ID NO: 280285 - RNA, 59 nt, Human
ugcaaauuguuccucaaaugaagcaguguggaguguauuggggauuuuguuauauuuug

SEQ ID NO: 280286 - RNA, 59 nt, Human
cuacguuccuuucagcaguuguccaaguaggaguguauccagugaagacauaucaaauc

SEQ ID NO: 280287 - RNA, 59 nt, Human
aaagcccggaucccgagaaagauuuaguaggaguguaaagugacauucuuaugaaacaa

SEQ ID NO: 280288 - RNA, 64 nt, Human
cugacuuucagcaucaugcaggggcuuaucugucuggaggcaguuaccucauaauaaacuauaa

SEQ ID NO: 280289 - RNA, 64 nt, Human
gccccuacucguguacugugccugaagcugaaguuggaggcauccaaaauaaggcggggcacag

SEQ ID NO: 280290 - RNA, 64 nt, Human
ugcgaaugaugucucggugagccuguacagaagcuggaggcagcauaaaggacucaaggaccac

SEQ ID NO: 280291 - RNA, 64 nt, Human
uaguaauuggcaaaggcuccuuguaagauuucacuggaggcaguguggccuggaguauuuauau

SEQ ID NO: 280292 - RNA, 59 nt, Human
uuaugacaugggaauguucugucaucaauggaguguauucuuguaauagaauucuuuau

SEQ ID NO: 280293 - RNA, 59 nt, Human
uaccuaggaugcaugacaauugucagguuggaguguaagugcuucauuugggaaauuca

SEQ ID NO: 280294 - RNA, 59 nt, Human
cagucucgccuaauggagcugccauuaggggaguguaaaacugggaaaugcugcucacu

SEQ ID NO: 280295 - RNA, 59 nt, Human
gcgauuaggauuuuucgcuugcgagcaagggaguguauauacuaaaugccacacuguau

SEQ ID NO: 280296 - RNA, 59 nt, Human
uaggguggcacaucuguccugacagacgaggaguguaacugaaccaggaauauuuccuc

SEQ ID NO: 280297 - RNA, 59 nt, Human
guguacugcaguugguaugaccccucuaaggaguguagcaacuacagucuaaagcuggu

SEQ ID NO: 280298 - RNA, 59 nt, Human
gaaacugcgugagagugugugcgugcaugggaguguacuuguggaaagguguguuugcg

SEQ ID NO: 280299 - RNA, 59 nt, Human
auaauaagauuguauaguuuguauauuuaggaguguauuuuugggaaagaaaauuuaaa

SEQ ID NO: 280300 - RNA, 59 nt, Human
ccugcaaguggacgugggcuccagggacuggaguguaaugcucggugggagccgucagc

SEQ ID NO: 280301 - RNA, 59 nt, Human
cauuggaaggagucuuucuuuagaacuuuggaguguaaaucuucaugauguuguaauuc

SEQ ID NO: 280302 - RNA, 59 nt, Human
uucagauaauuuccuucagucuccagauaggaguguauccaaacaucuaauuuuaugug

SEQ ID NO: 280303 - RNA, 59 nt, Human
uacacacacaccggcauguuuauacacagggaguguaugguuccuguaagcacuaaguu

SEQ ID NO: 280304 - RNA, 59 nt, Human
gaugcuauggcaagaaucuuuuuguguuuggaguguaguccauuugcaauagaaauaaa

SEQ ID NO: 280305 - RNA, 64 nt, Human
ccagggccccccgcccccuccucugccugcugcguggaggcagccaugggaaggagcccagggg

SEQ ID NO: 280306 - RNA, 64 nt, Human
cucuuagggaaaccaauaguccccaucagcaccauggaggcaggcucccccugccuuugaaauu

SEQ ID NO: 280307 - RNA, 64 nt, Human
cuccuccauccacccugaggacccuggggcucaguggaggcagggcccugccccccucccuucc

SEQ ID NO: 280308 - RNA, 64 nt, Human
gcagagacagguggaccaacagacagcuggccccuggaggcagaaaggcccuucuaacuuccag

SEQ ID NO: 280309 - RNA, 59 nt, Human
cacacagggagcugccuagcaucuggccuggaguguacuagccacauucccaagguccc

SEQ ID NO: 280310 - RNA, 59 nt, Human
agagucccuaagccacccccuccaaagauggaguguagaaaugaugacagcacuuagua

SEQ ID NO: 280311 - RNA, 59 nt, Human
aauauuacacaguaaugguaauuuauaaaggaguguauaguaguauacugacugcuaag

SEQ ID NO: 280312 - RNA, 59 nt, Human
agacagugccucacucugucacccaggcuggaguguaguggcaugaucugggcucacug

SEQ ID NO: 280313 - RNA, 59 nt, Human
ugaaaacuccuuuuaaaaauaaaaucugaggaguguacaauaagcauaugcuuugacuu

SEQ ID NO: 280314 - RNA, 59 nt, Human
auguaacaucaacucaguuguaugaaucuggaguguaauauuuauauuagaauguauau

SEQ ID NO: 280315 - RNA, 59 nt, Human
agauggaguuucacucugucgcccaggcuggaguguaguggcacauucucagcucacug

SEQ ID NO: 280316 - RNA, 59 nt, Human
gccaucuuuaauacuuuaugaguaguucuggaguguaaacauaaacgaguauucuuuug

SEQ ID NO: 280317 - RNA, 59 nt, Human
uuauacacauucuagaaaugauucugagaggaguguauaguauggugccuaucuacacu

SEQ ID NO: 280318 - RNA, 59 nt, Human
agcagagagaagcccagacuuccuucccuggaguguagaccugugugugggaccugcuc

SEQ ID NO: 280319 - RNA, 59 nt, Human
ccccagaaacagugugcauggguuauuuuggaguguaggugacuuguuuacucauugaa

SEQ ID NO: 280320 - RNA, 59 nt, Human
uuaagggaagaauuccaggguauggccauggaguguacaaguaugugggcagauuuuca

SEQ ID NO: 280321 - RNA, 59 nt, Human
aagcuuuuuauuacuugcuauagguuuagggaguguaccucagauagauuuuaaaaaaa

SEQ ID NO: 280322 - RNA, 64 nt, Human
auaugguucaaauguaacagugcagaauugaauauggaggcaugcauaaccuuccucuuagaaa

SEQ ID NO: 280323 - RNA, 64 nt, Human
guaguugucuuuccuggcacuaacguugagccccuggaggcacugaagugcuuaguguacuugg

SEQ ID NO: 280324 - RNA, 64 nt, Human
augcccaugaagcagguccagaacuaagugggaguggaggcaggcccuccacagaagcucugca

SEQ ID NO: 280325 - RNA, 64 nt, Human
cauuucagacgaaaguaggcgguacgaacccuaauggaggcaguuuugaggagguccucagcuc

SEQ ID NO: 280326 - RNA, 59 nt, Human
cuuuuuuuucagugaaaacaccaugucauggaguguaggaaagagcagaccaaaaucag

SEQ ID NO: 280327 - RNA, 59 nt, Human
gacaucaaauuguuuccugaauuuauuaaggaguguaaauaaagccuuguugauugaag

SEQ ID NO: 280328 - RNA, 59 nt, Human
agcccugaauucacucuaauuauaaacagggaguguaaacugcccccagauguuccugg

SEQ ID NO: 280329 - RNA, 59 nt, Human
acuguccugucacaugugcagcaggccauggaguguagcgggcaucgcugccgccauuc

SEQ ID NO: 280330 - RNA, 59 nt, Human
auacagccaugaagcgguguuacaggugaggaguguaauccuaggaagcaucaggugaa

SEQ ID NO: 280331 - RNA, 59 nt, Human
uaauccugaaacaaagaaaacuacaagcuggaguguaggaauugacuauagcaauuuga

SEQ ID NO: 280332 - RNA, 59 nt, Human
auauauauauagcugauaaaauuaccugaggaguguaaugcuuauuuuuuuguguauau

SEQ ID NO: 280333 - RNA, 59 nt, Human
uguucuuggggagaaggagggaggucucgggaguguagcaccaugccaaccagcccugc

SEQ ID NO: 280334 - RNA, 59 nt, Human
cauuuggaagcuuugguuaugaaacauguggaguguauuaagugcagcuugacauuaug

SEQ ID NO: 280335 - RNA, 59 nt, Human
gggcaguagcucaacaaggaauagagggaggaguguaauuuugguagcugguguugaau

SEQ ID NO: 280336 - RNA, 59 nt, Human
uggggagguuagauguguguuucaggcuuggaguguaugagugguuuugcuuguauuuu

SEQ ID NO: 280337 - RNA, 59 nt, Human
gucuggcucagggucaaagacagaaugguggaguguagccuccaccugauauucaggcu

SEQ ID NO: 280338 - RNA, 59 nt, Human
aguugaaucaaaauuuucagaucuuuucaggaguguaaggaaacaucauguuuaccugu

SEQ ID NO: 280339 - RNA, 64 nt, Human
acuuuccaaagggacugauaaaaaccaaaggaucuggaggcauugcuaucccauuuguggacag

SEQ ID NO: 280340 - RNA, 64 nt, Human
uguucaugcaggcagguuucugccgcauuugauguggaggcagugaagggcuugcccugcuggc

SEQ ID NO: 280341 - RNA, 64 nt, Human
uucugcucggagcugcagaccccagggcucuugguggaggcaggggaacccugagagugcuguu

SEQ ID NO: 280342 - RNA, 64 nt, Human
uuugacucugccauuucugaaaugugggggaggauggaggcagcugaccucuccaguugcugug

SEQ ID NO: 280343 - RNA, 59 nt, Human
aguugaaucaaaauuuucaaauguuuucaggaguguaaagaagcaucguguuuaccugu

SEQ ID NO: 280344 - RNA, 59 nt, Human
gggagggagucagaagggucagaugaacuggaguguagacagcaucagaugcagcagug

SEQ ID NO: 280345 - RNA, 59 nt, Human
agcauuccaauaacaccuuccaaaaaccuggaguguaagagcuuuguuucuuuauggaa

SEQ ID NO: 280346 - RNA, 59 nt, Human
aguguccuucccugaaauaaauaccuaagggaguguaacagucucuggaggaccacuuu

SEQ ID NO: 280347 - RNA, 59 nt, Human
guggggguauuugacauauuuuacaggguggaguguacuauauacuauuaccuuugaau

SEQ ID NO: 280348 - RNA, 59 nt, Human
uggggucugaucgcaaauacacuaaauguggaguguaggaaccaaaaugaaaccugcug

SEQ ID NO: 280349 - RNA, 59 nt, Human
ggauggacugcaaccuuaauuuacuugccggaguguacauucuagugugguguauacug

SEQ ID NO: 280350 - RNA, 59 nt, Human
aaugcaguggcaugcuaaguacccaaauaggaguguaugcagaggaugaaagauuaaga

SEQ ID NO: 280351 - RNA, 59 nt, Human
uuuccccuuacugauaagcggccacuuuaggaguguagcaaauauagauugagcuaugu

SEQ ID NO: 280352 - RNA, 59 nt, Human
cccagcauguaaaagugauccacgcagccggaguguaugccgggagcuaaguggucuau

SEQ ID NO: 280353 - RNA, 59 nt, Human
uacagcgugcauagggacucuugccuuaaggaguguaaacuugaucugcauuugcugau

SEQ ID NO: 280354 - RNA, 59 nt, Human
ccugaaaugcuaauuuaccccuuaccuaaggaguguaguuauaauacagaguugguuuc

SEQ ID NO: 280355 - RNA, 59 nt, Human
caacuugggcaggccuaugaagugcauagggaguguaugucuucugaaugguuuuauug

SEQ ID NO: 280356 - RNA, 64 nt, Human
gugagucaauacaccauagcucuguugaaauuccuggaggcaaaauugaccuuggccccaaaga

SEQ ID NO: 280357 - RNA, 64 nt, Human
gauuugcaagaaguugguuuauagacguuuacucuggaggcacaagcuggcugccaugcugagu

SEQ ID NO: 280358 - RNA, 64 nt, Human
uucccgcuccuggaacacuuccugcagcugugccuggaggcagucggccugcagugccagacuc

SEQ ID NO: 280359 - RNA, 64 nt, Human
aaaacugucacuguuggacgucagcaaguucacauggaggcauugaugcaugcuauucacaauu

SEQ ID NO: 280360 - RNA, 59 nt, Human
cuguggaaaccaccuuccgggagaccugaggaguguaacguggaggcggcuaccuccgu

SEQ ID NO: 280361 - RNA, 59 nt, Human
auuccuacaagugaaacacuagacuauuuggaguguauauggcuuguguuuugggauuu

SEQ ID NO: 280362 - RNA, 59 nt, Human
gagcuguuuuugcuuuugcuuugaaaucuggaguguaucuuacacaucuugauuggaac

SEQ ID NO: 280363 - RNA, 59 nt, Human
uauaaauaaaaaauauuuuugcuauucauggaguguaauauuuaugcacaccaucaaau

SEQ ID NO: 280364 - RNA, 58 nt, Human
uggaaacaggcuuacucugacuucccugggaguguacuuuuccugccucacaguuaca

SEQ ID NO: 280365 - RNA, 59 nt, Human
agacggagucucacucugucgccgaguuuggaguguauuggcgcgaucucggcucacug

SEQ ID NO: 280366 - RNA, 59 nt, Human
uuugcucucagccaccuguuacuaagucaggaguguaguuggaucucuacauuaauguc

SEQ ID NO: 280367 - RNA, 59 nt, Human
ggcaugaggcaucaaucaaauacauuuaaggaguguaggggguggggguucuaggcuau

SEQ ID NO: 280368 - RNA, 59 nt, Human
gaggcugagggcgaacaguagguagcaagggaguguaaaggaauuuaucuagauaaguu

SEQ ID NO: 280369 - RNA, 59 nt, Human
uggagagccugcacccagguacugaguggggaguguacagaccccugccuuggggguuc

SEQ ID NO: 280370 - RNA, 59 nt, Human
cuuccuaguuugcagcaauuaaagauaacggaguguaaagucauuagacccagaauuag

SEQ ID NO: 280371 - RNA, 59 nt, Human
uggucagcaaauuggaagaggauccgaugggaguguaaaugugagacacaaugucuuga

SEQ ID NO: 280372 - RNA, 59 nt, Human
cacgugcucacgcuguccaccugccagguggaguguauguggcuguggcccucccucgu

SEQ ID NO: 280373 - RNA, 64 nt, Human
gcaggugagaaccccgcccauccgugcuaugacauggaggcacugaagcccgaggaaggugugu

SEQ ID NO: 280374 - RNA, 64 nt, Human
gccuggacacccggcagcuucuggaguuugucaguggaggcagaggggauccggccaggccccu

SEQ ID NO: 280375 - RNA, 64 nt, Human
ccaaguggguggauaucugccuuccugcugcaaguggaggcagguccagcagccccucuucaga

SEQ ID NO: 280376 - RNA, 64 nt, Human
auuacuccagaagaguauaucuaaguaacuaaaauggaggcagaaaauguuuuaaggauuuucu

SEQ ID NO: 280377 - RNA, 59 nt, Human
uuucaugaucugaagaaaugauggaauggggaguguagagaaaugagagucuguaugau

SEQ ID NO: 280378 - RNA, 59 nt, Human
aggcggagucuugcucuauuggccaggcuggaguguaguggcaccaucuccacuuacca

SEQ ID NO: 280379 - RNA, 59 nt, Human
aagaaauuguguuaaaggccuaaaguucaggaguguauuacuuuagguucuuuccaguu

SEQ ID NO: 280380 - RNA, 59 nt, Human
auuacauugcugccuuuguugaggugcaaggaguguaaaauguauauuuuuaaagaaug

SEQ ID NO: 280381 - RNA, 59 nt, Human
gacuugccuaaaauauuauuaaaauuacgggaguguacucagcuuugagccuaggagaa

SEQ ID NO: 280382 - RNA, 59 nt, Human
gagaggggacauggugaugaaacauggcaggaguguaacagauaccagugguguguugc

SEQ ID NO: 280383 - RNA, 59 nt, Human
cuauccuucuaaauuaauuuucugaaguuggaguguagucuuuucccccuuaggcuaug

SEQ ID NO: 280384 - RNA, 59 nt, Human
uuauguuuauugucuuguauccuuucucuggaguguaagcacaaugaagacaggaauuu

SEQ ID NO: 280385 - RNA, 59 nt, Human
agacagggucuugcucuguugcccaggcuggaguguagagacacaguuacaccucaaug

SEQ ID NO: 280386 - RNA, 59 nt, Human
aauauaccuaaguguuuuuuuaaacuaugggaguguauuauaaaaucaauaauaauaug

SEQ ID NO: 280387 - RNA, 59 nt, Human
ccgucucaagggugggccccagagaguuuggaguguaggauucccucugugaaggaauc

SEQ ID NO: 280388 - RNA, 58 nt, Human
ucucggacucaguagcuuaggcaugguaggaguguaucagugauccauugcaccuuua

SEQ ID NO: 280389 - RNA, 59 nt, Human
ucuuugugcugugacugcaucaccuuuauggaguguagacauuggcauuuauguacaau

SEQ ID NO: 280390 - RNA, 64 nt, Human
auguaugaaggcuuuuggucucccugggaguggguggaggcagccagggcuuaccuguacacug

SEQ ID NO: 280391 - RNA, 64 nt, Human
uuuggggauaaaggauuauuuggucuucuggauuuggaggcaaucagcggacagcauggaagau

SEQ ID NO: 280392 - RNA, 64 nt, Human
cauuuuaucaacaaauuucauaauuguggacaauuggaggcauuuauuuuaaaaaacaauuuua

SEQ ID NO: 280393 - RNA, 64 nt, Human
agcuuuuccuuucuuuuuuuuuuuuuuuuuuuuuuggaggcagagucuccguuugucgccaggc

SEQ ID NO: 280394 - RNA, 59 nt, Human
acuccggagucucgcucuaucgccaggcuggaguguaguggcaugaucucggcuuauug

SEQ ID NO: 280395 - RNA, 59 nt, Human
ucugcucugcagggccuaggguagcgcugggaguguagaaguggccugcccuuaacugu

SEQ ID NO: 280396 - RNA, 59 nt, Human
cucaacccccacaagaccaagcaucacauggaguguagggucacugggagagcagaggu

SEQ ID NO: 280397 - RNA, 59 nt, Human
acucuugccaaacguucccgaggcgccaaggaguguaguacacccuggcugccaucacu

SEQ ID NO: 280398 - RNA, 59 nt, Human
uauugguauuugucuguugggauuucaagggaguguagagaagacagaaggaaagcuga

SEQ ID NO: 280399 - RNA, 59 nt, Human
accaaaggagaaggguaggcgagggguucggaguguauuuucagguuggaaugugaagg

SEQ ID NO: 280400 - RNA, 59 nt, Human
agauaggaucuugcucuguugcccaggcuggaguguagugguaugaucauagcucacca

SEQ ID NO: 280401 - RNA, 59 nt, Human
agacagagucuugcucuguuacccaggcuggaguguaguggugccaucucagcucacug

SEQ ID NO: 280402 - RNA, 59 nt, Human
uuucuuggcuggaagaaguuggccuccugggaguguaguuuucuguuuuaaauccccca

SEQ ID NO: 280403 - RNA, 59 nt, Human
ucaguugguucucaguuagcuggucaaguggaguguaaugguggcguagagaaucacaa

SEQ ID NO: 280404 - RNA, 59 nt, Human
gaggcacagucugugagugggaagagacuggaguguagauguugcccauuuguaggugg

SEQ ID NO: 280405 - RNA, 59 nt, Human
gcuugcagccaggagaaggucagcgagaaggaguguaugagugugagugugugugcaug

SEQ ID NO: 280406 - RNA, 59 nt, Human
aagauuaaugugaguggucagugggaaggggaguguaauggcaaacgaggucacuuccc

SEQ ID NO: 280407 - RNA, 64 nt, Human
ugaggacagaaagacccugaugcaggucagcccauggaggcagaugcccuugcugggccugggg

SEQ ID NO: 280408 - RNA, 64 nt, Human
cuuuuccuuuccuuuuuuuuuuuuuuuuuuuuucuggaggcagagucucccuuugucgccaggc

SEQ ID NO: 280409 - RNA, 64 nt, Human
ugugggagcaggcuacucuccagggacauguuuuuggaggcauauggagaagggggcccaggcg

SEQ ID NO: 280410 - RNA, 64 nt, Human
ucuggaggcugaggcaggagaaucacuugaacccuggaggcagagguugcaaugagccgagauc

SEQ ID NO: 280411 - RNA, 59 nt, Human
aaccaccauagacucucacuuauuuuggaggaguguaugugcauguguacacauaugua

SEQ ID NO: 280412 - RNA, 59 nt, Human
accauaauggcccacacucccuggguccaggaguguagaauaugcggcugcuuccauuu

SEQ ID NO: 280413 - RNA, 59 nt, Human
acgagcguuggcugggccucggcuucgcuggaguguacuccagggugaaggcagagugg

SEQ ID NO: 280414 - RNA, 59 nt, Human
ucccgucuaaccaugaugccuuaacauguggaguguaccguggggccucacuagccucu

SEQ ID NO: 280415 - RNA, 59 nt, Human
uuuuauuggaccaaaguugugguuuguauggaguguaguaguaguguguacagguagaa

SEQ ID NO: 280416 - RNA, 59 nt, Human
aaaaguaauaacuauggcacaaauguucaggaguguauauaaaaauaugugggcucucg

SEQ ID NO: 280417 - RNA, 59 nt, Human
ucuccauggcuuaacucccugucagugucggaguguauaagaaugcuuguaaauacugu

SEQ ID NO: 280418 - RNA, 59 nt, Human
cagcugagaggagguggaggggccccaggggaguguacgucaggcuuugcggggcacgg

SEQ ID NO: 280419 - RNA, 59 nt, Human
guuugggaacacagagggaagacaggaugggaguguagccacagaacccaccugcaccc

SEQ ID NO: 280420 - RNA, 59 nt, Human
agauggcaucucacucugucacccaggcuggaguguagugacacgaucucgacucacug

SEQ ID NO: 280421 - RNA, 59 nt, Human
agucaaaccuauuaggcugaggaccuuguggaguguagcugauccagcugauagaggaa

SEQ ID NO: 280422 - RNA, 59 nt, Human
agauagagucucacucuguugcccaggcuggaguguagugguguguucuuggcucacug

SEQ ID NO: 280423 - RNA, 59 nt, Human
cuccauggacagaaaagcuacgaauguauggaguguaggaaagccuucacuucacguaa

SEQ ID NO: 280424 - RNA, 64 nt, Human
uacagcagggaaccaugaaacagaaacagcaagauggaggcagccagacaccaaacugggaacu

SEQ ID NO: 280425 - RNA, 64 nt, Human
uagaauucuuagaacuauuaaugaucaagagggguggaggcauuucuugguaucaaauaacugg

SEQ ID NO: 280426 - RNA, 64 nt, Human
gcagugcuggguggagagagccagaaaacagaucuggaggcagcagugcuggauggaauugucu

SEQ ID NO: 280427 - RNA, 64 nt, Human
acugggcugggaggagagcaagcaggaacagggauggaggcaggaggagcagcccuuuuauuca

SEQ ID NO: 280428 - RNA, 59 nt, Human
acaguaguguccagaauguucagacauucggaguguacauaaaacagaaaaaaucuuca

SEQ ID NO: 280429 - RNA, 59 nt, Human
agauggaaucucucucuguugcccaggcuggaguguaguggugcgaucucagcucacug

SEQ ID NO: 280430 - RNA, 59 nt, Human
auugauucuaagacauguuagguauauaaggaguguagauaaggcuucagccaugaguc

SEQ ID NO: 280431 - RNA, 57 nt, Human
aaagcugcagcagugacuagguguccuggaguguacaacugcggccacugcauguga

SEQ ID NO: 280432 - RNA, 59 nt, Human
gucauucauccaggccacguuuccucugcggaguguagcagcccugccuuucauagcag

SEQ ID NO: 280433 - RNA, 59 nt, Human
uuugugaaaaugugacagugacacuuccuggaguguagagcuugagguguacagaugcu

SEQ ID NO: 280434 - RNA, 59 nt, Human
ccaagcggcccgugggggguggggggcagggaguguaccacacagggccauugucucac

SEQ ID NO: 280435 - RNA, 59 nt, Human
uaugauggaaggaucuuaaccagucgaguggaguguacauugucugaauacaggaugca

SEQ ID NO: 280436 - RNA, 59 nt, Human
guccucugcucuugggaguguaaaaguugggaguguaguguagcaucuggggagacagc

SEQ ID NO: 280437 - RNA, 59 nt, Human
agaauccccaaucuuguccucugcucuugggaguguaaaaguugggaguguaguguagc

SEQ ID NO: 280438 - RNA, 59 nt, Human
agacggagucuuacucugucgcccaggcuggaguguaguggcaugaucucggcucacug

SEQ ID NO: 280439 - RNA, 59 nt, Human
cucugagccccacgcgcaugcuaaugcguggaguguaugcgcagaguagcugucuguuu

SEQ ID NO: 280440 - RNA, 59 nt, Human
uuagcuuuccucaaguuaguuauguuguaggaguguaccuaagcaguaagcguauuuag

SEQ ID NO: 280441 - RNA, 64 nt, Human
augaacuauaccuguuaaguuccaaaggucaaaauggaggcauuugcugucuaauauucaaaca

SEQ ID NO: 280442 - RNA, 64 nt, Human
aaggcacauuuucauuucugaugcagccaccuucuggaggcagcuuuuauccuuucucucuauu

SEQ ID NO: 280443 - RNA, 64 nt, Human
auaguaaggcaauccuaagcaaaaagaacaaagcuggaggcaucacgcuacccagcuucaaacu

SEQ ID NO: 280444 - RNA, 64 nt, Human
aaguaacuauaaacgggugcaucccaccacucccuggaggcauuagacacccaaguggaaggug

SEQ ID NO: 280445 - RNA, 59 nt, Human
auugcaguacagagauggguccccaaaguggaguguauuuacagcuuguuaaauuagag

SEQ ID NO: 280446 - RNA, 59 nt, Human
cccccaccuccauuuggcacuacccaaguggaguguacccuugcccuuuccaccuguac

SEQ ID NO: 280447 - RNA, 59 nt, Human
agcguuucuacccaaaguuguguguggaaggaguguauagcagagaggaaaucccuuuc

SEQ ID NO: 280448 - RNA, 59 nt, Human
uuccguucuguuuuaaacagaaaauaaaaggaguguaagcuccuuuucucauuucaaag

SEQ ID NO: 280449 - RNA, 59 nt, Human
gguccugucuggaugacuuaugcggugggggaguguaaaccagaacuuuucaucuauuu

SEQ ID NO: 280450 - RNA, 59 nt, Human
gacggaguuucgcucucguugccgaggcuggaguguaguagugugauccuggcucacug

SEQ ID NO: 280451 - RNA, 59 nt, Human
auucugaaaccaacuugucccaggccacaggaguguauauguuucauaaucuuuaucaa

SEQ ID NO: 280452 - RNA, 64 nt, Human
gcacaugauuaaguaccgguacaucccguucacacaugggaagagaagguacagaggcaaggag

SEQ ID NO: 280453 - RNA, 64 nt, Human
uucaagcaguaauauuucagcaagaggagguggucaugggaagccagcacagcagaggcucccu

SEQ ID NO: 280454 - RNA, 64 nt, Human
ugcagaggggcaggugugugguaaacggguaaugcaugggaaauaaugagaagcagcucacaga

SEQ ID NO: 280455 - RNA, 64 nt, Human
ccugccagcacgugccugaagguuucacaugaagcaugggaagcgcacccugucguucagugac

SEQ ID NO: 280456 - RNA, 64 nt, Human
caugguccagccaccaggcucccugugucccuuccaugggaaggucuuccgcugugccucucau

SEQ ID NO: 280457 - RNA, 64 nt, Human
auuuuagacauuccucgucaguauuaggaauuuccaugggaaaagagguuugcaugcugguaau

SEQ ID NO: 280458 - RNA, 64 nt, Human; identical to SEQ ID NO: 234009

SEQ ID NO: 280459 - RNA, 64 nt, Human; identical to SEQ ID NO: 234010

SEQ ID NO: 280460 - RNA, 64 nt, Human; identical to SEQ ID NO: 234011

SEQ ID NO: 280461 - RNA, 64 nt, Human
cuccacucaaaugaccugccuguguugucauuuccaugggaaagaacucuuuccacgagaucug

SEQ ID NO: 280462 - RNA, 64 nt, Human
uagacuucagagagcacuucucucuuaugggguucaugggaacaggggugggugugacuugcuu

SEQ ID NO: 280463 - RNA, 64 nt, Human
aaguccacuucugccucugccacuacugcugccacaugggaacugugaagaggcacccuggcaa

SEQ ID NO: 280464 - RNA, 64 nt, Human
aacccccuaaagucuuuugggaauccucaaaaagcaugggaaguuaaguauuuagcuacauaaa

SEQ ID NO: 280465 - RNA, 64 nt, Human
cuggacaaucggguacaagagacuuaagguugggcaugggaagggugggguuuccaugauccau

SEQ ID NO: 280466 - RNA, 64 nt, Human
aucuguuuaaucaaaauggaagguucaguaauuucaugggaaaccuugguuuuucauuaagugc

SEQ ID NO: 280467 - RNA, 64 nt, Human
agggaaaggguagcugagucugcuuaggggacugcaugggaagcacggaauauaggguuagaug

SEQ ID NO: 280468 - RNA, 64 nt, Human
ucccucaaccgacccuggcucaggagguugaugccaugggaaccugaaccugaaacacuucaug

SEQ ID NO: 280469 - RNA, 64 nt, Human
ggugccuggaaaucaccaugguccucauaucucccaugggaauccuguccugccucgaaggagc

SEQ ID NO: 280470 - RNA, 64 nt, Human
gagcucuggugaaaugcugauacaucugaucuaucaugggaauugcaguuagagagaguaagga

SEQ ID NO: 280471 - RNA, 64 nt, Human
guggcuugcuuggugggaccugacgaguugguggcaugggaaggaugugggucucuagugccuu

SEQ ID NO: 280472 - RNA, 64 nt, Human
cucucaccuucuccaucgugcauguccccagccacaugggaagugaaagcugagaagggaaggc

SEQ ID NO: 280473 - RNA, 64 nt, Human
guaucauaaaugagaugcguaguuuguuuucuuucaugggaaguagagauaaaaauauauacau

SEQ ID NO: 280474 - RNA, 64 nt, Human; identical to SEQ ID NO: 234014

SEQ ID NO: 280475 - RNA, 64 nt, Human; identical to SEQ ID NO: 234015

SEQ ID NO: 280476 - RNA, 64 nt, Human; identical to SEQ ID NO: 234016

SEQ ID NO: 280477 - RNA, 64 nt, Human
gaggcuggcagggaagacaaaucugcuacaaguccaugggaagacccuacaaugaaauguucau

SEQ ID NO: 280478 - RNA, 64 nt, Human
cgguucccacggagccauuuuuagcucugaucagcaugggaaugugccucggccuccaaggggc

SEQ ID NO: 280479 - RNA, 64 nt, Human
gagcucuaggcugccuggagggaaggaacaggcccaugggaagaaggggguuuuaaaaacaugu

SEQ ID NO: 280480 - RNA, 64 nt, Human
gaaaaauuaauuuacuagaaaggcaugaaaugaucaugggaagagugguuaagacuacugaaga

SEQ ID NO: 280481 - RNA, 64 nt, Human
gauggugcccauauaggugagcaucccuuuagaucaugggaaccagcagacugcauuccuaauc

SEQ ID NO: 280482 - RNA, 64 nt, Human
aaucaacaacuuguuucaauuuaauaaaaaugcucaugggaagugcuuuggcgcguguacccuc

SEQ ID NO: 280483 - RNA, 64 nt, Human
cacuugccacggaugggccacggauggagcuugccaugggaagcacugggaaguaauggggugu

SEQ ID NO: 280484 - RNA, 64 nt, Human
aggagcgugagccacuucugcaguccacgcugaacaugggaaacaaccugaaaagcaggcaggc

SEQ ID NO: 280485 - RNA, 64 nt, Human
cuuccaggcucuuccuggaccugagucggccccacaugggaaccuaguacucucugcucuagcc

SEQ ID NO: 280486 - RNA, 64 nt, Human
uccagaggaauuugucuucucugccuucacucagcaugggaaccaguguucauccugaccuugu

SEQ ID NO: 280487 - RNA, 64 nt, Human
cuaggacugacgaguuacggcugccagaugccugcaugggaagagguggacaucugcaucuucc

SEQ ID NO: 280488 - RNA, 64 nt, Human
acuauuuacaauguguaucaaaacuaccugugagcaugggaauacaaaagguuugagauuccug

SEQ ID NO: 280489 - RNA, 64 nt, Human
aaacuuaauuuugauugaacuaauaauuuauaaacaugggaaacaagucagaaguagugacauu

SEQ ID NO: 280490 - RNA, 64 nt, Human; identical to SEQ ID NO: 234017

SEQ ID NO: 280491 - RNA, 64 nt, Human; identical to SEQ ID NO: 234018

SEQ ID NO: 280492 - RNA, 64 nt, Human; identical to SEQ ID NO: 234020

SEQ ID NO: 280493 - RNA, 64 nt, Human
augccaccagggcuggucucccaggaguagagaccaugggaaaugggguggauuaggauugagc

SEQ ID NO: 280494 - RNA, 64 nt, Human
gcuucacccuugacaugauuacccuugaguaaaacaugggaauuuguaguugugugauccucug

SEQ ID NO: 280495 - RNA, 64 nt, Human
cagccacucaacuccugcuuguuuuuccuuuggccaugggaagguuuaccaguagaauccuugc

SEQ ID NO: 280496 - RNA, 64 nt, Human
cuuuucauaaaguaaguuauuuuagugugaaggucaugggaaauggcauacguagcuuuuuaac

SEQ ID NO: 280497 - RNA, 64 nt, Human
guggcaagaggauuauggcuaacaagaauaaauacaugggaagagugcuccccauugauugaag

SEQ ID NO: 280498 - RNA, 64 nt, Human
auggggggagaggggagauuuaaaggaccagggacaugggaaccaagccauagggaucagaggg

SEQ ID NO: 280499 - RNA, 64 nt, Human
uuccaucucuggggcccacucucuucugucuucccaugggaagugccacugggaucccucugcc

SEQ ID NO: 280500 - RNA, 64 nt, Human
aucuucccacagcagcuuugcucagugauacccacaugggaaaaaucccaggggauguugcuua

SEQ ID NO: 280501 - RNA, 64 nt, Human
gccuaggccaggugcaaccagggagcugcaggggcaugggaaggugggcgggcaggggaggguc

SEQ ID NO: 280502 - RNA, 64 nt, Human
aaaccucgaauugaaaugugugaggcaaacuaugcaugggaauagcuuaaugugaagauaauca

SEQ ID NO: 280503 - RNA, 64 nt, Human
cuaauugcuuuacucucaggaaaguguaauaacgcaugggaauucuguacguuaucacuguaau

SEQ ID NO: 280504 - RNA, 64 nt, Human
ggcuccccacccuggcccccugccccugcacucccaugggaaugccgcagggagccaggcuggg

SEQ ID NO: 280505 - RNA, 58 nt, Human
uuuuucuauaggcaaguuaaccgauauccaugggaauguucuucaguaccacaaggau

SEQ ID NO: 280506 - RNA, 64 nt, Human
aacuaaccagauacagaaacagaagagaggcugccgggaccagcauauuuccguugcagccaaa

SEQ ID NO: 280507 - RNA, 64 nt, Human
gccuccaccugaccguggcccgcccagccacucccgggaccacggcaaaaggaaccacccagac

SEQ ID NO: 280508 - RNA, 64 nt, Human
uucauagagaacuuaauguucaaaauuugcuuuguggaggcauguaauaagauaaacaucauac

SEQ ID NO: 280509 - RNA, 64 nt, Human
gaguaaccucauucucugccugaugauucaaaggcaugggaagaccaaaaccauguggcaguuc

SEQ ID NO: 280510 - RNA, 64 nt, Human
uauuucaccacaaaucaacaaugugccugaggugcaugggaaauauaguuagcuauacucugaa

SEQ ID NO: 280511 - RNA, 64 nt, Human
uuaaaacaacacauguaaaugccuuuugauauuucaugggaaugccucucauuuaaaaauagaa

SEQ ID NO: 280512 - RNA, 64 nt, Human
gcagaguccagcugcagcauccagcucacgcccucaugggaauuggcacaggccuggggcaggg

SEQ ID NO: 280513 - RNA, 64 nt, Human
gcucagcugcuccuguaccuuggagguccauucacaugggaaaguauuuuggaaugugucuuuu

SEQ ID NO: 280514 - RNA, 64 nt, Human
gaacagugauuaccagggacugaggggaggggagcaugggaagugacgguuuaaugggcacagg

SEQ ID NO: 280515 - RNA, 64 nt, Human
ugcugugccuuucuggcaggguuuuguggggucacaugggaagcaauguguuacgcaagcaguc

SEQ ID NO: 280516 - RNA, 64 nt, Human
ugacagugcgcgucuuacaacuaauuccacuaggcaugggaaugucaccuccuuugccacugua

SEQ ID NO: 280517 - RNA, 64 nt, Human
aucuugugaaacuuauucacuaucacaagaauagcaugggaaagacuggcccccaugauucaau

SEQ ID NO: 280518 - RNA, 64 nt, Human
uccuucugcauuuccuaucuuccugugucuugugcaugggaagcagccuucagugccuucauga

SEQ ID NO: 280519 - RNA, 64 nt, Human
cucccugaccccucugaccuuuccacgagugucacaugggaauguguggggcgcaggggcgggu

SEQ ID NO: 280520 - RNA, 64 nt, Human
cuucagaggccagcugucaguaucuguagccaagcaugggaaucuuugcucccaggcccagcac

SEQ ID NO: 280521 - RNA, 64 nt, Human
ggguuugcggggacagggacagaacuacaggagucaugggaaagaaaauucuggcuucacuacu

SEQ ID NO: 280522 - RNA, 64 nt, Human; identical to SEQ ID NO: 234024

SEQ ID NO: 280523 - RNA, 64 nt, Human; identical to SEQ ID NO: 234025

SEQ ID NO: 280524 - RNA, 64 nt, Human; identical to SEQ ID NO: 234026

SEQ ID NO: 280525 - RNA, 64 nt, Human
guugugccuaaccugggagacggaagaagcacgccaugggaaguguuuacacuuggggacaagu

SEQ ID NO: 280526 - RNA, 64 nt, Human
ggcagcugcaauuguaucuuaaaagugagucuuucaugggaaucagaagaauaguauaccaggg

SEQ ID NO: 280527 - RNA, 64 nt, Human
cuuacugugacuccgaaaacuguaguauuggugucaugggaauguacguuauuuccaaagucau

SEQ ID NO: 280528 - RNA, 64 nt, Human
uauacuauuuagauuguccuucuuauuuuaaaugcaugggaacagaaugacaggugggaugcug

SEQ ID NO: 280529 - RNA, 64 nt, Human
uuauuuuaagaaauucuugaaaaacccuauguuccaugggaacauaaaguuauuauagugccuc

SEQ ID NO: 280530 - RNA, 64 nt, Human
cucaggagugggggagcacgggccuucuacaccacaugggaaggcucuggcaugagguuuuccu

SEQ ID NO: 280531 - RNA, 64 nt, Human
uucuauaccuugaaaugauuauaaaauagauuuucaugggaauuuuaaaaacucuauccaaaac

SEQ ID NO: 280532 - RNA, 64 nt, Human
agcgggcaaagaggauggaaaucauaaaauauuucaugggaaucgaaccuagggauagugcucc

SEQ ID NO: 280533 - RNA, 64 nt, Human
acccacacugcagguagaggaggccaucugaucccaugggaagccaucagagacacugcuggug

SEQ ID NO: 280534 - RNA, 64 nt, Human
uugauaacuacccaaaccaaacaaccaauacauacaugggaagagaggcccugugugcucagug

SEQ ID NO: 280535 - RNA, 64 nt, Human
ucagaucucaugaggcuuacuaucacgagaacagcaugggaaagaccugcccccgugauuaaau

SEQ ID NO: 280536 - RNA, 64 nt, Human
acacaacaucucagaauuuuaauuuuuagaaauucaugggaaauuggauuuuuguaauaaucuu

SEQ ID NO: 280537 - RNA, 64 nt, Human
cacucuucacacugagccuguaccacuguuguaacaugggaagacgugaagaagaaauaaucug

SEQ ID NO: 280538 - RNA, 64 nt, Human; identical to SEQ ID NO: 234030

SEQ ID NO: 280539 - RNA, 64 nt, Human; identical to SEQ ID NO: 234031

SEQ ID NO: 280540 - RNA, 64 nt, Human; identical to SEQ ID NO: 234032

SEQ ID NO: 280541 - RNA, 64 nt, Human
cucagagauacuugcaggggcaagcuguaaagggcaugggaacagugagggacauauguggggu

SEQ ID NO: 280542 - RNA, 64 nt, Human
ugggggagggagggcaauaguggaacgaacuuuccaugggaaacuuucccuuuuguaaguugag

SEQ ID NO: 280543 - RNA, 64 nt, Human
auaguguguggaauuuuauuuugaaggauaagaccaugggaaaauugugguaaagacuguuugu

SEQ ID NO: 280544 - RNA, 64 nt, Human
uucuuucucaaaacuaguuuuugaugcuuucuuucaugggaauagucacuuuuuuauuuaguaa

SEQ ID NO: 280545 - RNA, 64 nt, Human
gaggcccgggcgcuggcugcagcucacguccagccaugggaaucccacggaccucucgcguguc

SEQ ID NO: 280546 - RNA, 64 nt, Human
uaaaucuguuugauccuccuggcuuaucuaguuacaugggaaguugcugguuuugaauauuaag

SEQ ID NO: 280547 - RNA, 64 nt, Human
uauuuucguaucuucuaucccucaaagcaucagacaugggaaaauugguuuauaccaagaaagc

SEQ ID NO: 280548 - RNA, 64 nt, Human
gcagcaaggcaguaacaccacaaaagcaaaaccacaugggaaaacucagcacuggugguggugg

SEQ ID NO: 280549 - RNA, 64 nt, Human
uggauggaauagucuggacaccuggugggggaugcaugggaaagccaggagggcccugaccucc

SEQ ID NO: 280550 - RNA, 64 nt, Human
ugguuuuuuaauuuauuuaaaauuggggggagggcaugggaaggauuuaacaccgauauauugu

SEQ ID NO: 280551 - RNA, 64 nt, Human
uucccccccacugagacagccugagauauggccucaugggaagggaaagaccugacuguccccc

SEQ ID NO: 280552 - RNA, 64 nt, Human
uagaucuaguugaggaagugugggccuggcuguucaugggaagucuucaguggccuucauggau

SEQ ID NO: 280553 - RNA, 64 nt, Human
acuuaaaaacaacacauuauuuggaaagacaagccaugggaaagaaauauggcguuucuauuuu

SEQ ID NO: 280554 - RNA, 60 nt, Human; identical to SEQ ID NO: 234021

SEQ ID NO: 280555 - RNA, 64 nt, Human; identical to SEQ ID NO: 234022

SEQ ID NO: 280556 - RNA, 64 nt, Human
uuaauuaucuuagucuauagaaaugaucauugcauggaggcauguauagguaugaucuguguaa

SEQ ID NO: 280557 - RNA, 64 nt, Human
gcuucaugaugugcaggcaguagccagacagggucaugggaagggggcccugugcuucuaaacu

SEQ ID NO: 280558 - RNA, 64 nt, Human
aauuuguuuaaaaaaaaaaaggcagaaaacccaccaugggaaaauaagcauuuuuuaaaaucug

SEQ ID NO: 280559 - RNA, 64 nt, Human
aaaggaaaucuauggaguauuauagggacauucccaugggaauguaucuuccuccauggcaugu

SEQ ID NO: 280560 - RNA, 64 nt, Human
augucuagcagcuucagacauuugguuaagaacccaugggaaaaaaaaaauccuugcuaaugug

SEQ ID NO: 280561 - RNA, 64 nt, Human
ccgccugcuuagucagccccggcagcagggcagccaugggaacucaggaaaagcaggaacccuu

SEQ ID NO: 280562 - RNA, 64 nt, Human
acaagacuaauaauauuuucuuauuuaaaaaaagcaugggaagauuuuuauuuaucaaaauaua

SEQ ID NO: 280563 - RNA, 64 nt, Human
uuguuuccuuguguacuccagcauugguuauagucaugggaaaggaagguguccacggaggcac

SEQ ID NO: 280564 - RNA, 64 nt, Human
ccuugcagcugaugacacaucugaggaacuuguucaugggaaacauggaaaaagcacugccuca

SEQ ID NO: 280565 - RNA, 64 nt, Human
ccaucccuuaaagaauagaauaguuugucccucucaugggaauugggcuguauguauauuguuc

SEQ ID NO: 280566 - RNA, 64 nt, Human
ugugguuuaccauaccaaagcuugcuuucucuggcaugggaaaaauaaauuuaagcaccaaacc

SEQ ID NO: 280567 - RNA, 64 nt, Human
uucggaaacacugacuuagguuucaggaaguugccaugggaaacaaauaauuugaacuuuggaa

SEQ ID NO: 280568 - RNA, 64 nt, Human
cacaccccuuccauuacugcugaauaggacauugcaugggaagaguacagagguggcagaauga

SEQ ID NO: 280569 - RNA, 64 nt, Human
gaaacugggcaagccaaugaaagucucuggggaucaugggaauugagugucuaugaaaaccaua

SEQ ID NO: 280570 - RNA, 64 nt, Human
ggggcccuccaaggugucuccguagucagcagguuggaggcagaggagccgauggcuggaggaa

SEQ ID NO: 280571 - RNA, 64 nt, Human
uggcuguguuguggcaugaguuugcaugacuuucuggaggcauggaguuagguaaggcuacaug

SEQ ID NO: 280572 - RNA, 64 nt, Human
agaagcagagcuacgcuuaggcuccaguaaggauuggaggcacuuuccagcccugugcaguguu

SEQ ID NO: 280573 - RNA, 64 nt, Human
auaggauaagacaaugccagaggaaggauagaaacaugggaaguuucuaucauuucauuuucug

SEQ ID NO: 280574 - RNA, 64 nt, Human
acacagccuuaaacucaaugcuuuugcuuuaugacaugggaauguucugucaucaauggagugu

SEQ ID NO: 280575 - RNA, 64 nt, Human
aagcagugcaugcugucccuuacgugaguccuggcaugggaaugaaugucagugugacugaucu

SEQ ID NO: 280576 - RNA, 64 nt, Human
gauuggagacuuugauuuuuuuuuuuuuuuuucacaugggaaagucuuagauuccaguagaugg

SEQ ID NO: 280577 - RNA, 64 nt, Human
aagauaagacuugagauuuuugaauugagaauuucaugggaauauucagucaaggagcagacuu

SEQ ID NO: 280578 - RNA, 64 nt, Human
caaaacaucuuaggcacuuuuuaacauucucaaucaugggaauuuuaacuuuugggauuuguug

SEQ ID NO: 280579 - RNA, 64 nt, Human
cguguucccuucuauuuauuauaaagaaauuuuucaugggaaaauauguauuuuuuguauauuc

SEQ ID NO: 280580 - RNA, 64 nt, Human
cugguaaugaauaagauccuuaccacaguuuucucaugggaaauacauaauaaacccuuucauc

SEQ ID NO: 280581 - RNA, 64 nt, Human
caguaggccuucuguuacaccucaaaauguguuacaugggaagaaaaagauuaagaaaaagcaa

SEQ ID NO: 280582 - RNA, 64 nt, Human
ucuaauacaaucagauuacucaguugccuuaccucaugggaagaguuacuuuuuuagaucuaaa

SEQ ID NO: 280583 - RNA, 64 nt, Human
cccacccagcagaaauacaauccgagcuacaaagcaugggaaaaagagacucuuuuaggaucag

SEQ ID NO: 280584 - RNA, 64 nt, Human
gggcucauaaaacaugaaucaagcaauccagccucaugggaaguccuggcacaguuuuuguaaa

SEQ ID NO: 280585 - RNA, 64 nt, Human
ugccagaagccaggaagccugcaagggaugaggccaugggaauggagagaaggggccacccacu

SEQ ID NO: 280586 - RNA, 64 nt, Human
agucgccauagagcugggccuggccuugcuggaauggaggcauccuuccaaaccugggggacgg

SEQ ID NO: 280587 - RNA, 64 nt, Human
guucccacggcugacagcguggcagcggagacuguggaggcaguggagacugacuucuuccugc

SEQ ID NO: 280588 - RNA, 64 nt, Human
uggagcgcaggggccuggggagcagcgcuaacccuggaggcagccuuugggugauggcuuuuuc

SEQ ID NO: 280589 - RNA, 64 nt, Human
cccacgacugaaguuguagauugagcugaauaaccaugggaagugaccaagcaaagacacucga

SEQ ID NO: 280590 - RNA, 64 nt, Human
uucaggacuguccuuuaguucugucuuuugaacucaugggaauaauugugagucagcguaacau

SEQ ID NO: 280591 - RNA, 64 nt, Human
uagagguauuuauucucaauaccugacaggggcccaugggaaugacuucagaagcaucccggau

SEQ ID NO: 280592 - RNA, 64 nt, Human
gcuuugauaagugcuauuaguaaugaauauauaacaugggaaccaauguuaucuuuaauguugc

SEQ ID NO: 280593 - RNA, 64 nt, Human
cggccauaagaggugaucucugggaguuauaggucaugggaagagcguagacagguguuacuua

SEQ ID NO: 280594 - RNA, 64 nt, Human
ucuagaaucucguuucuccucuuuccuccugcuucaugggaaaacagaccugugugugccucca

SEQ ID NO: 280595 - RNA, 64 nt, Human
gcuuuaaucagcacucacgcaccggaguucugcccaugggaaguaaacugcagcaggccacugg

SEQ ID NO: 280596 - RNA, 64 nt, Human
agcagaguacaagaccacugucuaauuuugacuucaugggaauuuugguuuuaucuucccuucu

SEQ ID NO: 280597 - RNA, 64 nt, Human
agaguccaccucagugccucgugugcucaguggucaugggaaaggagcgaaggaaccauccuug

SEQ ID NO: 280598 - RNA, 64 nt, Human
agaacuucccagggccccucccucaaauugucuccaugggaaacuugacccaguggcaaguugc

SEQ ID NO: 280599 - RNA, 64 nt, Human
uguccuggaaagcccccagcagcugccccagggacaugggaagaccacgggaccucuuucacua

SEQ ID NO: 280600 - RNA, 64 nt, Human
cagaguuuucccauuuucagaagauaaugacucacaugggaauugaacugggaccugcacugaa

SEQ ID NO: 280601 - RNA, 64 nt, Human
guguauaacagcucugcuggacacccaagaaagccaugggaacgccaacuggaaagguccccuu

SEQ ID NO: 280602 - RNA, 64 nt, Human; identical to SEQ ID NO: 234006

SEQ ID NO: 280603 - RNA, 62 nt, Human; identical to SEQ ID NO: 234007

SEQ ID NO: 280604 - RNA, 64 nt, Human
auguucguauguguguugcacuaauucuaaacuuuggaggcauuuugcugugugaggccgaucg

SEQ ID NO: 280605 - RNA, 64 nt, Human
uuggggggaggaggaccugugugucaggcucugccaugggaacgaguguaaaccguggcugucu

SEQ ID NO: 280606 - RNA, 64 nt, Human
cggagggagagacccugggugagaccccugugagcaugggaagggccugcagugggcgcgggag

SEQ ID NO: 280607 - RNA, 64 nt, Human
ugauuccagaccugucccaacagcagggaugcuacaugggaagagaaguggacaucccacaugu

SEQ ID NO: 280608 - RNA, 64 nt, Human
cauccgcaggugcuggucccggggccagcacuuccaugggaaugucucuuuggcgaccuccuuu

SEQ ID NO: 280609 - RNA, 64 nt, Human
aucuguaacucuuacaugaguguccagaggcacucaugggaaaauugguuuugcuuucuuugua

SEQ ID NO: 280610 - RNA, 64 nt, Human
gcauaguguuugggcuaguggguuucugacagcccaugggaaugcccugaaacuacuguaucug

SEQ ID NO: 280611 - RNA, 64 nt, Human
uaguaccuuucucuaugucaaguuuugugucagacaugggaaaucauguauuuguucaauugac

SEQ ID NO: 280612 - RNA, 64 nt, Human
aucuguuuucaaccaacuauuuuugaggaauuaucaugggaaaagaccagggcuuuucccagga

SEQ ID NO: 280613 - RNA, 64 nt, Human
ucaguugaacccacuguuaccauuguucuuaucccaugggaagcaguugguuacacgauucuua

SEQ ID NO: 280614 - RNA, 64 nt, Human
aaaaauugcuuccauuuuauaauuugagguguugcaugggaauucuaagcugauccaucaugau

SEQ ID NO: 280615 - RNA, 64 nt, Human
ccgcccccuccucugccugcugcguggaggcagccaugggaaggagcccaggggagcuggccug

SEQ ID NO: 280616 - RNA, 64 nt, Human
acccccguuugcugggggcuccuccagccgcccccaugggaagaggccugguaccgccucaccc

SEQ ID NO: 280617 - RNA, 64 nt, Human
acuuguuuaauuccucagugggugugacauauuucaugggaauauucaaauaucuaugguaaua

SEQ ID NO: 280618 - RNA, 64 nt, Human; identical to SEQ ID NO: 234002

SEQ ID NO: 280619 - RNA, 64 nt, Human; identical to SEQ ID NO: 234003

SEQ ID NO: 280620 - RNA, 64 nt, Human; identical to SEQ ID NO: 234012

SEQ ID NO: 280621 - RNA, 64 nt, Human
uuuuuuuuuuaacuuagaguuuuaaauugccaaacaugggaacagccuugaauaggauaaauuu

SEQ ID NO: 280622 - RNA, 64 nt, Human
gagauggucccugggcuuaauauucuuuaaagggcaugggaauuuagccucucuuuuauuguaa

SEQ ID NO: 280623 - RNA, 64 nt, Human
caagauacaaaugugcugccugcaguuaguccugcaugggaauaaggacuaguuauuuuuuuag

SEQ ID NO: 280624 - RNA, 64 nt, Human
ucuugucauaaaacagcuuucccccaccccauaucaugggaaaagggggagaaauauagccccu

SEQ ID NO: 280625 - RNA, 64 nt, Human
gcgcagcacugaacagccucaucauuccacuuuucaugggaaauauauuucacaccauugccuu

SEQ ID NO: 280626 - RNA, 64 nt, Human
aaauggcucauaccccgaaggcaguuccuagacacaugggaaauuucccucaccaaagagcaau

SEQ ID NO: 280627 - RNA, 64 nt, Human
auggagaauguuuucucucaaauuuccucugacccaugggaaugaaaauacuuaaauacuguaa

SEQ ID NO: 280628 - RNA, 64 nt, Human
guagauucugagcagguugagauguggauaucuccaugggaagcuugaaccaggcuagaacagc

SEQ ID NO: 280629 - RNA, 64 nt, Human
cauggcucucuauucccucagccuaagaaacacucaugggaaugcauuuggcaacccaaggaac

SEQ ID NO: 280630 - RNA, 64 nt, Human
cacuuuuuauaaucaagccucaucuugcugguaucaugggaacuccagccugcuaucuuucaug

SEQ ID NO: 280631 - RNA, 64 nt, Human
gcuuuucuuccucuucccccaaccuaacuucugccaugggaacugguuaaaaacacugcucuaa

SEQ ID NO: 280632 - RNA, 64 nt, Human
auuuucuucugcuccaaacagcuggaguaaaauucaugggaaauggcccuucauuuaaaaaaag

SEQ ID NO: 280633 - RNA, 64 nt, Human
accugcuccccagcucuuccugucagccgguuuacaugggaacaggguuaacaucuguguuagg

SEQ ID NO: 280634 - RNA, 64 nt, Human; identical to SEQ ID NO: 233966

SEQ ID NO: 280635 - RNA, 64 nt, Human; identical to SEQ ID NO: 233967

SEQ ID NO: 280636 - RNA, 64 nt, Human; identical to SEQ ID NO: 233969

SEQ ID NO: 280637 - RNA, 64 nt, Human
cucuucuccccaugaaauuaucucaaggaucuuccaugggaagaugugacagaaccaggacacu

SEQ ID NO: 280638 - RNA, 64 nt, Human
cauauaaugacugauaagaguacaauacaggugccaugggaacacgugacaucacugaagacug

SEQ ID NO: 280639 - RNA, 64 nt, Human
uuaaaugacaguuguagauugauacgcaguugugcaugggaaggggaaacgcacagcuuuauuu

SEQ ID NO: 280640 - RNA, 64 nt, Human
cugcagagcugauuaaacaguguugugacugucucaugggaagagcuggggcccagagggaccu

SEQ ID NO: 280641 - RNA, 64 nt, Human
gggaguuuuaagcauaaaucccuguuuaguguuacaugggaauaaggaauuucauucacuucag

SEQ ID NO: 280642 - RNA, 64 nt, Human
uauuuucauaccuuagucacauuuggagaauucacaugggaauaaaauuccauugcugcaauga

SEQ ID NO: 280643 - RNA, 64 nt, Human
agcuugguggagcauuuucccauugagagccuuccaugggaacucaauguucccauuguaagua

SEQ ID NO: 280644 - RNA, 64 nt, Human
cucuuaccuuagaugcauccugguuaucuggaagcaugggaaagaaggcuacuuaucucuuugu

SEQ ID NO: 280645 - RNA, 64 nt, Human
uaaaauuuuaucuaaguugguaucuaaaauuuuucaugggaaguuaaauaguugacaaaguaug

SEQ ID NO: 280646 - RNA, 64 nt, Human
uuaagagcuuucuagccagaaucuggaccuauaccaugggaaaauuuaggggugcugggaaucc

SEQ ID NO: 280647 - RNA, 64 nt, Human
gagaaaaacccgugaaacaugaaaaaggaaauaccaugggaaacgugauucucagugugauucc

SEQ ID NO: 280648 - RNA, 64 nt, Human
uaacauuucagaaaggugcuuuuuugguacucuucaugggaacaguuuagcagccaugagugau

SEQ ID NO: 280649 - RNA, 64 nt, Human
cacgugugaguuacuaaaaaguuagaauaaugugcaugggaacagugcagcaacaugcuagaaa

SEQ ID NO: 280650 - RNA, 64 nt, Human; identical to SEQ ID NO: 233970

SEQ ID NO: 280651 - RNA, 64 nt, Human; identical to SEQ ID NO: 233971

SEQ ID NO: 280652 - RNA, 64 nt, Human; identical to SEQ ID NO: 233973

SEQ ID NO: 280653 - RNA, 64 nt, Human
uguuaauuccagucagauaauggcauuguacagacaugggaaacaaccaauuuuuuuguuuuuc

SEQ ID NO: 280654 - RNA, 64 nt, Human
cugggcaugggugcaccccacccccuaggguccccaugggaaagggacaugcaaggaaacagca

SEQ ID NO: 280655 - RNA, 64 nt, Human
gcuaccuccuccuccucaccaccuuggggcuucucaugggaaaugugcccccgccccaggaccc

SEQ ID NO: 280656 - RNA, 64 nt, Human
guuucaaagaugauauuucugugaacagagaggccaugggaagauuugaaaauuauuaaagaaa

SEQ ID NO: 280657 - RNA, 64 nt, Human
ggccaauauaauuauuaagugacuuugguguguucaugggaaacugauguaauuaaauauucug

SEQ ID NO: 280658 - RNA, 64 nt, Human
gaauguuaucuuucuugcaagaguaauuuaagcacaugggaaagauucuagacuuuuuguuucu

SEQ ID NO: 280659 - RNA, 64 nt, Human
acaaauaaagguucuuguacccagagugauucuacaugggaaaaacaaaccagcuuuuuucaga

SEQ ID NO: 280660 - RNA, 64 nt, Human
ugugggugucuucacaccggggaggagggccucucaugggaaagcccuggccaccacaccggcc

SEQ ID NO: 280661 - RNA, 64 nt, Human
gcaggaaacccacuuccugaagccaggacuuccccaugggaagugcaggggccacugggcagcc

SEQ ID NO: 280662 - RNA, 64 nt, Human
gagcucauggcaguaaacuuugaacauugauauccaugggaauaggauuagaaaaggauugcuu

SEQ ID NO: 280663 - RNA, 64 nt, Human
uggucaggcacauacauaguaaauuauaaucaaucaugggaauuacauaaggauaaugaggccc

SEQ ID NO: 280664 - RNA, 64 nt, Human
gaaaaaaacuugaaaauaguaauaccugaguacccaugggaauaauagacacuggggagguagg

SEQ ID NO: 280665 - RNA, 64 nt, Human
ugcugugcaauauauacauaaagcuucugcuucucaugggaauuuaguuacagugcuuggaaug

SEQ ID NO: 280666 - RNA, 64 nt, Human; identical to SEQ ID NO: 233977

SEQ ID NO: 280667 - RNA, 64 nt, Human; identical to SEQ ID NO: 233978

SEQ ID NO: 280668 - RNA, 64 nt, Human; identical to SEQ ID NO: 233979

SEQ ID NO: 280669 - RNA, 64 nt, Human
cccgcccucacugcuguucuugccuuacagccaccaugggaaagcugcaaccuuucuguuuuau

SEQ ID NO: 280670 - RNA, 64 nt, Human
gcccccacacccaguccucacccuuaacuucugccaugggaauuccuccaucugcagcggucac

SEQ ID NO: 280671 - RNA, 64 nt, Human
aggcucuagcucugggcccuccuucagcccccaucaugggaauaaauuaauuuucucaauguac

SEQ ID NO: 280672 - RNA, 64 nt, Human
agacagaaaaaauaacugauuagacccaagauuucaugggaagaaguuaaaagaaacugccuug

SEQ ID NO: 280673 - RNA, 64 nt, Human
uuggucacucugugcccacuucaacgaaaaccaccaugggaaacagaauuucaugcacaaucca

SEQ ID NO: 280674 - RNA, 64 nt, Human
uggauccugcacucuaacacucgacucugcugcucaugggaagaacagaauugcuccugcaugc

SEQ ID NO: 280675 - RNA, 64 nt, Human
guccucauggggaggggagggcacguucuugacacaugggaacuucgcucaggagggccucccc

SEQ ID NO: 280676 - RNA, 64 nt, Human
gcaagaaauauuccauugaaauauugugcuguaacaugggaaaguguaaauguuuuucaugguu

SEQ ID NO: 280677 - RNA, 64 nt, Human
cacccauaccacaauuaauauuaggcuggauugccaugggaaacauuuuuuggcauuaaugcag

SEQ ID NO: 280678 - RNA, 64 nt, Human
uacgguacaggcugagguacacgguuagcaaaaccaugggaaggggaauggcggugcauaucau

SEQ ID NO: 280679 - RNA, 64 nt, Human
gagcuagcguauuagccuugugggcaacaugaugcaugggaaaugaaagauuuuuguaaaaagu

SEQ ID NO: 280680 - RNA, 64 nt, Human
caggcacucaagugacuucauauuucucucugcccaugggaaaagagauaggcuuuauauuucc

SEQ ID NO: 280681 - RNA, 64 nt, Human
uauuaaaauuacaucuuuaaagaauacaugacaacaugggaaauuacguaagucauacaaggug

SEQ ID NO: 280682 - RNA, 64 nt, Human; identical to SEQ ID NO: 233974

SEQ ID NO: 280683 - RNA, 64 nt, Human; identical to SEQ ID NO: 233975

SEQ ID NO: 280684 - RNA, 64 nt, Human; identical to SEQ ID NO: 233995

SEQ ID NO: 280685 - RNA, 64 nt, Human
agguugcuuucccacccugggcaaugcagugcagcaugggaaaggaauaagggggcaacaaggu

SEQ ID NO: 280686 - RNA, 64 nt, Human
cucucucccagucuacccagagaagccccuuccccaugggaagacgaggcccucgggcccagcc

SEQ ID NO: 280687 - RNA, 64 nt, Human
auuuugguuuccgcaaaggauggauggugagcaucaugggaaagcuguaguuuagugacuuagc

SEQ ID NO: 280688 - RNA, 64 nt, Human
cuaagguaaauuucauuuucaaacgagagggaaacaugggaaguaaaagauuaggaugugaaag

SEQ ID NO: 280689 - RNA, 64 nt, Human
aauaaugcaaguugcgauuaauuauuucuggagucaugggaacacacagcacagaggguagggg

SEQ ID NO: 280690 - RNA, 64 nt, Human
acacaggggccuuuuaaguugagcgugcgcacugcaugggaaauagcggcccuggaggauguua

SEQ ID NO: 280691 - RNA, 64 nt, Human
guucauuucaugaucaguguuaagcauuuuccuccaugggaaggaagcaugggauauagaaaag

SEQ ID NO: 280692 - RNA, 64 nt, Human
cuguaauuugccucgaaguucagcaguucaucuucaugggaaauuugcugagcccccaccaggg

SEQ ID NO: 280693 - RNA, 64 nt, Human
gauauccaugcuuauguauccaaacacagagacccaugggaacaaaugagacacauauagauac

SEQ ID NO: 280694 - RNA, 64 nt, Human
gaaucuaaaaccaaauauuaguuuuuauuaaacucaugggaaggcuaauauauuccaacguaaa

SEQ ID NO: 280695 - RNA, 64 nt, Human
ggccuucugagaaaagagcuucuaguaauugaaccaugggaaacccagcuucuggaggguuggc

SEQ ID NO: 280696 - RNA, 64 nt, Human
aaacccaccugccucugccaggaacagccaacuccaugggaacucuaugggaguggcuuuuaaa

SEQ ID NO: 280697 - RNA, 64 nt, Human
acacaguagcacacaggaucucacaguaacgcggcaugggaacagugagacagggggaggggag

SEQ ID NO: 280698 - RNA, 64 nt, Human; identical to SEQ ID NO: 233982

SEQ ID NO: 280699 - RNA, 64 nt, Human; identical to SEQ ID NO: 233983

SEQ ID NO: 280700 - RNA, 64 nt, Human; identical to SEQ ID NO: 233984

SEQ ID NO: 280701 - RNA, 64 nt, Human
gaaagaggcgagcguggauugucacagcugcgggcaugggaagggcuagcugagcucuucaccu

SEQ ID NO: 280702 - RNA, 64 nt, Human
ugucaccaaaccccaguguggaggcagggacagucaugggaaugugggggaugaagcccaggca

SEQ ID NO: 280703 - RNA, 64 nt, Human
acuguuuggugcaucuugaccugggaagacgccucaugggaacgaacuuggacagguguugggu

SEQ ID NO: 280704 - RNA, 64 nt, Human
cuucacguuguaaauauguuuuguagagugaagccaugggaagccauguguaacagagcuuaga

SEQ ID NO: 280705 - RNA, 64 nt, Human
uucauuuuguacagaaggaugaauaacuacagcucaugggaaauguuuugacuuuacaaaguau

SEQ ID NO: 280706 - RNA, 64 nt, Human
gcagauugcuacuagaaauaaauaacuuuggaaacaugggaaggugccacugguaauggguaag

SEQ ID NO: 280707 - RNA, 64 nt, Human
uccucauuuuggaaacuuuuccuccucuauuaaacaugggaaacugaagcccuugaagguuugg

SEQ ID NO: 280708 - RNA, 64 nt, Human
auucaauuaccucccccgggucccucccacaacacaugggaauucugagagauaccauuuaagu

SEQ ID NO: 280709 - RNA, 64 nt, Human
uugggucagcuccuauccucuggacggggagcaucaugggaaaaagagguccgagucauauuua

SEQ ID NO: 280710 - RNA, 64 nt, Human
uaaaauacguuugaaauaguugaucuacaaaggccaugggaaaaauucagagaguuaggaagga

SEQ ID NO: 280711 - RNA, 64 nt, Human
gcaggccagaggcuuuuuuuuuaaucacagaucucaugggaauuaguggaugcuaaauggcaau

SEQ ID NO: 280712 - RNA, 62 nt, Human
ucauggcugcaaaacucugaagauuccccaugcaugggaaagugcaaguggaugcauuccug

SEQ ID NO: 280713 - RNA, 64 nt, Human
aacuagaaugauacaaagaaaggucagagaaaugcaugggaauauuuuuuccuuaaaacagaaa

SEQ ID NO: 280714 - RNA, 64 nt, Human; identical to SEQ ID NO: 233985

SEQ ID NO: 280715 - RNA, 64 nt, Human; identical to SEQ ID NO: 233986

SEQ ID NO: 280716 - RNA, 64 nt, Human; identical to SEQ ID NO: 233988

SEQ ID NO: 280717 - RNA, 64 nt, Human
agggguuguuugggggccuggguggucggccucacaugggaaggggauggguaguggauggggu

SEQ ID NO: 280718 - RNA, 64 nt, Human
cggauaagagcuggcaagugcccuuaggaugccgcaugggaaaaaucgguuaucauaauuucaa

SEQ ID NO: 280719 - RNA, 64 nt, Human
cuggauaagccauuaaacuuagcauuaucuucaucaugggaaaacacuuauuuuacuuucgauu

SEQ ID NO: 280720 - RNA, 64 nt, Human
gucuggcuuugugaugguugacaaggucuagcuacaugggaaagccugagaagucacuuuggaa

SEQ ID NO: 280721 - RNA, 64 nt, Human
ccuuccuucaagauaacuggccccaagaguggggcaugggaagggcugguccaggggucugggc

SEQ ID NO: 280722 - RNA, 64 nt, Human
uaccugacacaagaggaauaagaauggagcaguacaugggaaaggaggcaugccucugauaugg

SEQ ID NO: 280723 - RNA, 64 nt, Human
ucauccaaaagacucauuuguguggaugcgugaccaugggaaaaagaaaaaaaaaaagauccau

SEQ ID NO: 280724 - RNA, 64 nt, Human
auagugaagagaaacucgggcaucuguguuugaucaugggaagauacucucacuaacugaaccc

SEQ ID NO: 280725 - RNA, 64 nt, Human
cucacugcggcggcucccuaagaaggugaagcaacaugggaacacauccuaagacagguccuuu

SEQ ID NO: 280726 - RNA, 64 nt, Human
agccgcucccaaccaugagagccgaggugggaggcaugggaaacagugcagugacucacccccu

SEQ ID NO: 280727 - RNA, 64 nt, Human
gaccauuccccccacucccuacccuuaauccccacaugggaagaagcuaucaucacagguacaa

SEQ ID NO: 280728 - RNA, 64 nt, Human
ucuuuugccuuuaaaaaaaacuaaacagauaaaacaugggaaucuccuuuuuguagguuuauag

SEQ ID NO: 280729 - RNA, 64 nt, Human
gaccccagggcugccuaaggacacagagauucuccaugggaaggggacugccaagcaugaggaa

SEQ ID NO: 280730 - RNA, 60 nt, Human
uauccauucauaaaaugaaugugggugaagccgcccuaaggauuuuccuuuaauuucucu

SEQ ID NO: 280731 - RNA, 60 nt, Human
ugggagcagcuugggagccccccauuggcgccgcccuacuggggaagccgguccguacgu

SEQ ID NO: 280732 - RNA, 60 nt, Human
ggcugcgcuucggaccgcggcgcgcgcuggccgcccuagugcgcaggggcuggcgcugcg

SEQ ID NO: 280733 - RNA, 64 nt, Human
gcccuccagagaggggcugcuaccucccagcaggcaugggaagagcacugguguggggguucca

SEQ ID NO: 280734 - RNA, 64 nt, Human
ucuucuuauacccuaaaaccuucuacacuagugccaugggaaccaggucugaaaaaguagagag

SEQ ID NO: 280735 - RNA, 64 nt, Human
uuagugcaauuuuguuuuucuuaaugccaguuuacaugggaaugcauccuauaauuccaaaugu

SEQ ID NO: 280736 - RNA, 64 nt, Human
ucauuccucccacccuccgagauggucagugugucaugggaagcccacccccagcucugccagu

SEQ ID NO: 280737 - RNA, 64 nt, Human
auuacacugugugauggucauauuagucucucuacaugggaagauguugugcuuacuauggcca

SEQ ID NO: 280738 - RNA, 64 nt, Human
cauggaccacccucauccaugcaacuccaggccccaugggaacggauguggaaggaagaacugu

SEQ ID NO: 280739 - RNA, 64 nt, Human
ugcuccaaggccugaugugagccagcggggggugcaugggaaacugcaccccacaacccacauc

SEQ ID NO: 280740 - RNA, 64 nt, Human
cuggcaucaaucagcccaagacccccaggggauucaugggaaaugucguauuuuagaguccuac

SEQ ID NO: 280741 - RNA, 64 nt, Human
cuauaagggucaccucuagcacagaggccugagucaugggaaagagucacacuccugacccuua

SEQ ID NO: 280742 - RNA, 64 nt, Human
gagccuuuuguuccuccugucccaguuugguuuccaugggaaccugaguggcagcgucaucacu

SEQ ID NO: 280743 - RNA, 64 nt, Human
uuuccaaauguggccuccaugugggugcuagggacaugggaaaaaccacugcuaugccauuucu

SEQ ID NO: 280744 - RNA, 64 nt, Human
auguguacuuuuggguucacagaagcacagcacccaugggaaggguccaucucagagaauuuac

SEQ ID NO: 280745 - RNA, 64 nt, Human
aauccugguggaagucuuggguguuagugucagccaugggaaaugagccagcccaagggcauca

SEQ ID NO: 280746 - RNA, 64 nt, Human; identical to SEQ ID NO: 233947

SEQ ID NO: 280747 - RNA, 64 nt, Human; identical to SEQ ID NO: 233948

SEQ ID NO: 280748 - RNA, 64 nt, Human; identical to SEQ ID NO: 233980

SEQ ID NO: 280749 - RNA, 64 nt, Human
ugggugguuccuaagggaaagggaagcacaugaucaugggaaugauagcccagaacaaaaagaa

SEQ ID NO: 280750 - RNA, 64 nt, Human
uugggagccacaggugccuaauugggaaccagggcaugggaaaggagugggucaaaauucuucu

SEQ ID NO: 280751 - RNA, 64 nt, Human
uuagucuaugugugguaugggcagcccaagguugcaugggaaaacacgccccuacagaagugca

SEQ ID NO: 280752 - RNA, 64 nt, Human
uugcauagaucuuugaucuauaguuauuucaagucaugggaaauucaaugcauauacuauauac

SEQ ID NO: 280753 - RNA, 64 nt, Human
cuuguuuuuauuacguuuccuuuuucaaacuguccaugggaaggcugaauugagugacucccca

SEQ ID NO: 280754 - RNA, 64 nt, Human
gaaaagguaccugaggaugcagaaguaccuaccacaugggaaccguuuguccacacucauucca

SEQ ID NO: 280755 - RNA, 64 nt, Human
agaugggcucagugcugccacccagaucagaucacaugggaaugaggcccuccgaccauuggca

SEQ ID NO: 280756 - RNA, 64 nt, Human
ccaccuuugacguguggcucuuucuccugaccaucaugggaagugucugcuggauuccauuuuc

SEQ ID NO: 280757 - RNA, 64 nt, Human
gucuaagucaugccuccuuccaccucccucccggcaugggaaagccaccucucccucaacaagg

SEQ ID NO: 280758 - RNA, 64 nt, Human
gucuaagucgugccuccuuccaccucccucccggcaugggaaagccaccucucccucaacaagg

SEQ ID NO: 280759 - RNA, 64 nt, Human
agaugguaacaugcaaugucagcucucuugaagacaugggaaaccuaaguuacaccuuggguua

SEQ ID NO: 280760 - RNA, 64 nt, Human
aagugugucuacaaugguacagcucuuccagggacaugggaaguuuaucgugggagauauccag

SEQ ID NO: 280761 - RNA, 64 nt, Human
caaugagaagcauuccuaaaucccaaagugcccacaugggaaagagauaaaauguacaaauuag

SEQ ID NO: 280762 - RNA, 60 nt, Human
uagagggaugcuacagaugucauuugucucccgcccuaaguccuccagucuccuuagagc

SEQ ID NO: 280763 - RNA, 60 nt, Human
aaccagggcugccccaccgcccgccgucugccgcccuaggcuuccugacuccauuaguuc

SEQ ID NO: 280764 - RNA, 60 nt, Human
ugcaucuucauugcaaaagcacuggcucauccgcccuacuucccaucccacacaaaccca

SEQ ID NO: 280765 - RNA, 64 nt, Human
ccugcucuuuacucaaugguacccagggagggagcaugggaagagggugagcugagggcuggag

SEQ ID NO: 280766 - RNA, 64 nt, Human
guggggagcacuggaggguuacugacucucuggccaugggaacucagagauucucauccccaaa

SEQ ID NO: 280767 - RNA, 64 nt, Human
ggacaaaaggggaacugcaccauggcacuuggcccaugggaaagaggguaugguggugugccga

SEQ ID NO: 280768 - RNA, 64 nt, Human
uaucaggagccauccuccuggugguacccaaugucaugggaaugaugugccugucacccccauu

SEQ ID NO: 280769 - RNA, 64 nt, Human
uaacaguggcccagacgcugcuuugugcuaaaagcaugggaaauguaaaggcagucuuucucug

SEQ ID NO: 280770 - RNA, 64 nt, Human
caugcugccuuauuucuuuccuucggcagguguucaugggaaguagguggaucagugaaggcau

SEQ ID NO: 280771 - RNA, 64 nt, Human
uucacugcagguuaagaauccacacaaccaaguucaugggaauuuuguguaaaauaaaagauaa

SEQ ID NO: 280772 - RNA, 64 nt, Human
aacacccuggggugaaagcccuugaauucauccucaugggaaauggcugaguggaucaaaccuc

SEQ ID NO: 280773 - RNA, 64 nt, Human
augcuuuugucgcauuuugcuucacugugaguagcaugggaaaaggguccacgucuccaaaaga

SEQ ID NO: 280774 - RNA, 64 nt, Human
auugcugaaaggaaguaaaaccccauagaagaaacaugggaauacagaauauauucugggguca

SEQ ID NO: 280775 - RNA, 64 nt, Human
uauuucuguaauauugcaguccccagauccagaacaugggaaguuagggaaaaugugugauuuu

SEQ ID NO: 280776 - RNA, 64 nt, Human
gcugaggggccccugugagaggccucuggaugggcaugggaagaugggcucccuggcccccagc

SEQ ID NO: 280777 - RNA, 64 nt, Human
ggauacauaaaaugcacgcaagccauuaucucuccaugggaagcuaaguuauaaaaauaggugc

SEQ ID NO: 280778 - RNA, 64 nt, Human; identical to SEQ ID NO: 233992

SEQ ID NO: 280779 - RNA, 64 nt, Human; identical to SEQ ID NO: 233993

SEQ ID NO: 280780 - RNA, 64 nt, Human; identical to SEQ ID NO: 233994

SEQ ID NO: 280781 - RNA, 64 nt, Human
uuugacaguaaaggcucuuggcuucuguuggaggcaugggaaauugucucaauuuguacaguuu

SEQ ID NO: 280782 - RNA, 64 nt, Human
ccugcccagccuguggugcuugaaacguuugccccaugggaaacguaugugugcaggagccucc

SEQ ID NO: 280783 - RNA, 64 nt, Human
guuauagaaaagaacuuugcagucagacauucgucaugggaaaguucagaaaaaaauaaagucc

SEQ ID NO: 280784 - RNA, 64 nt, Human
gauggaauuugcugcuauaagaauguccagcuaccaugggaacgcaaggcagcaacucucuaau

SEQ ID NO: 280785 - RNA, 64 nt, Human
gaugauuucgagguuggccuuagaggaaacagaucaugggaauuucuguggggcuuucuucaac

SEQ ID NO: 280786 - RNA, 64 nt, Human
caccagaacagcaaugcuaguaacaggaugggaacaugggaaugauaauauauauuuuuucuuu

SEQ ID NO: 280787 - RNA, 64 nt, Human
cauuaaaauuaugugucagaagaaggcuuaaucucaugggaaaguguucacaccauauuauuaa

SEQ ID NO: 280788 - RNA, 64 nt, Human
cccuggggauucugcuuugauuggcauuuuuagucaugggaauguauauuugcugauauaucug

SEQ ID NO: 280789 - RNA, 64 nt, Human
gucaagagucaagguugcgaguacaggccaagaccaugggaaaaaaagccaugcucacuggcca

SEQ ID NO: 280790 - RNA, 64 nt, Human
uagcaguuuugcucaugacuuaccauuccagcugcaugggaaagcaaagcagaaaacagugccc

SEQ ID NO: 280791 - RNA, 64 nt, Human
uggucagaggguaggugggaaagaacagacaagccaugggaaguuggcaguggggagauuucca

SEQ ID NO: 280792 - RNA, 64 nt, Human
acuuaucagcagcaacaacugucaguucauccugcaugggaaaaauguuggaaugggagucuga

SEQ ID NO: 280793 - RNA, 64 nt, Human
ggacccaaaguuuaugggagaagggcaaagacuucaugggaagagagaaggaaggcccugggua

SEQ ID NO: 280794 - RNA, 60 nt, Human
ugccccugcuggaggggcaccaugugugagccgcccuacucccuucaccuggcccucugu

SEQ ID NO: 280795 - RNA, 60 nt, Human
auugaaaugccucuugaccuuccccuccacccgcccuaacccccucucauuuaccucgca

SEQ ID NO: 280796 - RNA, 60 nt, Human
ccugaccugcucaggggcugagggucuggcccgcccuaagcagccccuggcuucacccug

SEQ ID NO: 280797 - RNA, 60 nt, Human
uaagggcacccagcagcagagcuaggacuuccgcccuaaggcugugccucacugccacca

SEQ ID NO: 280798 - RNA, 64 nt, Human
ggcccagaguacugugaggggugauuuugaaagacaugggaaaaagcauuccuagagaaaagcu

SEQ ID NO: 280799 - RNA, 64 nt, Human
aggcagaugcauucuccuggcugcugggagagcccaugggaaccuugcuuagcgcccaagguag

SEQ ID NO: 280800 - RNA, 64 nt, Human
ccgacauuccuuauacaugacagacacuuggcuacaugggaagaugauguuaauaauaaaauga

SEQ ID NO: 280801 - RNA, 64 nt, Human
aaaagcauauauauauauaaaauaaaauuuaggccaugggaacuggcauuuuacuugguauagg

SEQ ID NO: 280802 - RNA, 64 nt, Human
cuggccagagggacaccuugguggcacugguggacaugggaaagcagguggacaugagcuaacc

SEQ ID NO: 280803 - RNA, 64 nt, Human
auguuuuagccuugugcacucuuagagucagcaucaugggaaagaguaacagcaauugaaaaaa

SEQ ID NO: 280804 - RNA, 64 nt, Human
augcuguguaaguagacguuaaucuggcuggaaccaugggaagcacuuugcaguguucagaaga

SEQ ID NO: 280805 - RNA, 64 nt, Human
uugcaugaaucugcaggagacagagauccccuugcaugggaaacauaaagcagaauugggaggg

SEQ ID NO: 280806 - RNA, 64 nt, Human
ccaaccuggcaugggugucuguugcaaaggggugcaugggaaagggcuguugauauuaaaaaca

SEQ ID NO: 280807 - RNA, 64 nt, Human
uacaaucuugaacuguacacaacaaagguacagccaugggaauacagaaugauagaagagacua

SEQ ID NO: 280808 - RNA, 64 nt, Human
aacccucccgggucacuuuuguucccagguaccucaugggaagcauguggaugacacaaucccu

SEQ ID NO: 280809 - RNA, 64 nt, Human
ucucccagugauuacaucuaaggaccuccagaagcaugggaacaucugggugugcccugugucc

SEQ ID NO: 280810 - RNA, 64 nt, Human
ggcugcaguccaggcccgugcuggcgggauugggcaugggaaggagcagggccugcugcuuccc

SEQ ID NO: 280811 - RNA, 60 nt, Human
accucccagccccugccccucaugccaaccccgcccuaggccuggcauggcaccugucgc

SEQ ID NO: 280812 - RNA, 60 nt, Human
gacaagagaauacccauacaaaucgucccaccgcccuagaggccacagaauuagcccaaa

SEQ ID NO: 280813 - RNA, 60 nt, Human
uucccuucgggcccccauguuuuccugcacccgcccuaccauggucucucucugcaguua

SEQ ID NO: 280814 - RNA, 60 nt, Human
gauaggccugacgcagcccccagcccagggccgcccuagcaacuuccuguacauaugacu

SEQ ID NO: 280815 - RNA, 64 nt, Human
gauugaugugggguaaauauuaaggagauggccucaugggaauuugaccuugacuagaaauaga

SEQ ID NO: 280816 - RNA, 64 nt, Human
gugcuaaggcuggaaauggcccccucuuaguugccaugggaaccuaguaacagacucugcuggc

SEQ ID NO: 280817 - RNA, 64 nt, Human
ucagcccucccugccccucccuucaaccauuccccaugggaaaugucaacaaguaugaauaaag

SEQ ID NO: 280818 - RNA, 64 nt, Human
cugaaagggacgcuacccgggaagggggcugggacaugggaaaggggaaguuguaggcauaaag

SEQ ID NO: 280819 - RNA, 64 nt, Human
acccauggugcacaccuguaguccuccaugaggacaugggaagguaggaguugccgcccugggg

SEQ ID NO: 280820 - RNA, 64 nt, Human
ccuggagcuacagugucccccaccuuccuugccccaugggaaccuccaccuccuacuccccacc

SEQ ID NO: 280821 - RNA, 64 nt, Human
auuccucuaauagccauuuaacgguacugcaguucaugggaaaauguccucauucuuaggagau

SEQ ID NO: 280822 - RNA, 64 nt, Human
gcgggugaaaaaccucaugacaguauugagggaacaugggaauucauacugagaugcaaucucu

SEQ ID NO: 280823 - RNA, 64 nt, Human
gcccaacggaguucugggaugggaggggugggagcaugggaagggaggcaucccacccccaaga

SEQ ID NO: 280824 - RNA, 64 nt, Human
uccauuauauuuuuauaguugauuauugcuuuuacaugggaaaguuauuuuuaauuauauauuu

SEQ ID NO: 280825 - RNA, 64 nt, Human
gugucccacauucccaacaccgcccucugaucaccaugggaaucuuuggacucaggacagggcc

SEQ ID NO: 280826 - RNA, 64 nt, Human
gacuccaacgggauugugagaaucaagucacucucaugggaagaauuuuuauaugggaaagcgg

SEQ ID NO: 280827 - RNA, 64 nt, Human
augaccugugucuugaagaaguuggcuuucuuuacaugggaaggaaaucaugccaaaaaaaucc

SEQ ID NO: 280828 - RNA, 64 nt, Human
cacaugggugcugguggcagggaucuaucuaauguggaggcacgguaaggguuauaauucuuua

SEQ ID NO: 280829 - RNA, 64 nt, Human
aaaauuuccuugaaaacuccuacaauauuauauuuggaggcagcuucagacuguuuuauuggug

SEQ ID NO: 280830 - RNA, 64 nt, Human
uuaccaaacuuguaaaagcauuccauguauucaguggaggcagaauguauaauauuuuuuccuu

SEQ ID NO: 280831 - RNA, 64 nt, Human
uaacuuucaguuagaaaucagccacaauaaacaacaugggaaaaugccuuaggauggaguuugc

SEQ ID NO: 280832 - RNA, 64 nt, Human
guucaugggugagggauaaaaugaggcuccaauacaugggaagcuuugcugaaaaaguaaagug

SEQ ID NO: 280833 - RNA, 64 nt, Human
auguggaugugcuagaauuggauauguccaggaacaugggaagggcucacuauuggaaucccau

SEQ ID NO: 280834 - RNA, 64 nt, Human
cucccuucugugggucgcucccagagccauggcccaugggaaggacagaguguguguguccuug

SEQ ID NO: 280835 - RNA, 64 nt, Human
ugggcuuugcaagcuccugcuccauauugguggacaugggaaugguugguguggccugagauac

SEQ ID NO: 280836 - RNA, 64 nt, Human
guguguuuuguuuuuguuuuccauuugggggccccaugggaaagagcuucugaacucuuuccuu

SEQ ID NO: 280837 - RNA, 64 nt, Human
ggcagccccaccucacagccagagucaaugccuucaugggaagggcucccagccacacccagag

SEQ ID NO: 280838 - RNA, 64 nt, Human
cuugccugguggauguuucuggcccuuuuuccaccaugggaauuucucaccucuagcucuaagg

SEQ ID NO: 280839 - RNA, 64 nt, Human
gggcgugcuucaggcuccucccucuaaggggcgccaugggaacaggcuccggagggagccggcg

SEQ ID NO: 280840 - RNA, 64 nt, Human
cccacauaccaggaacuauuggacauuuauuuuacaugggaaaaauuauuuggaauaauaaagc

SEQ ID NO: 280841 - RNA, 64 nt, Human
uggccuuugucugcucucagugucuucccuuugacaugggaaaggaguuguggccaaaaucccc

SEQ ID NO: 280842 - RNA, 64 nt, Human
gaccuguaguaggacauggugauuuguuaauuuccaugggaagccaugauggccuagcauggag

SEQ ID NO: 280843 - RNA, 64 nt, Human
gaucuggguuagguggccgcuccucccugcuccucaugggaagaugucucagagccuuccauga

SEQ ID NO: 280844 - RNA, 60 nt, Human
guggcucggccucagcugccuggguuguggccgcccuagcauccuguaugcccacagcua

SEQ ID NO: 280845 - RNA, 60 nt, Human
ugccacaagauucccgaaccuccccaaaccccgcccuacugucucuuccuguuuguuccc

SEQ ID NO: 280846 - RNA, 60 nt, Human
cuccagugagaaucccccuacccucgaaggccgcccuaacaacuucccauccgcugaccc

SEQ ID NO: 280847 - RNA, 64 nt, Human
gucccuuccaggccaucagaggccuagucagccacaugggaaacuuccaagaccugacucaggc

SEQ ID NO: 280848 - RNA, 64 nt, Human
uggcuucccugcccaauccucccuggagaagggacaugggaaugaauugaaauggggcgcugga

SEQ ID NO: 280849 - RNA, 64 nt, Human
agaggucagucauuacagccccuuaugccucuuccaugggaacaaauacugugcagauguuugu

SEQ ID NO: 280850 - RNA, 64 nt, Human
aaaccuucaauuuauggucuucuguuuugaagcucaugggaaaauugugaucaaaagggcuaug

SEQ ID NO: 280851 - RNA, 64 nt, Human
ugccucuucuuccuccuuucuuuccccaucuguucaugggaagaguuugucuuucuuaucuuua

SEQ ID NO: 280852 - RNA, 64 nt, Human
ggcguguggcauguaggaguccugcuucuuuguacaugggaauuguggacucaugcgugugugu

SEQ ID NO: 280853 - RNA, 64 nt, Human
cagcugggaggggcccgccccggcacaaagcacccaugggaauaaaggccaagccgcgacaguc

SEQ ID NO: 280854 - RNA, 64 nt, Human
caguguuuuugccccugcacauuccagaagcccucaugggaagggaugcagccaggcagacucc

SEQ ID NO: 280855 - RNA, 64 nt, Human
ugauuuguaccuucugaauccugucacguguagacaugggaaacugaccuaucaguguuuugug

SEQ ID NO: 280856 - RNA, 64 nt, Human
uauccuuaacccauacuccucugaggcaaacaggcaugggaaaauggaaggguugaggauggac

SEQ ID NO: 280857 - RNA, 64 nt, Human
gggcaccggucucccccacccgacugcugaucugcaugggaaacacccugaccuucuucuguca

SEQ ID NO: 280858 - RNA, 64 nt, Human
acuccucugacuggagucuaggaagggcgugucccaugggaaguggauacucuggggugccccu

SEQ ID NO: 280859 - RNA, 64 nt, Human
ugaaguguguggcugggcggauucagcgaagucucaugggaagcaggaccuagagccgggcaca

SEQ ID NO: 280860 - RNA, 64 nt, Human
agccggagagcugcggaagcccacucaggaggaguggaggcagguuguagauauccuguggagu

SEQ ID NO: 280861 - RNA, 64 nt, Human
gcccuuaaugcuacaggacaagcaaaccucagccuggaggcacuuuuccagguaacuuguguca

SEQ ID NO: 280862 - RNA, 64 nt, Human
cagaaggcuacggggaggacugagaggacagggcuggaggcagccaaguaacguagucauauca

SEQ ID NO: 280863 - RNA, 64 nt, Human
ggcccucgacaaaggcuugggaaaugaggggagguggaggcagggcaggggaagcgaagaguca

SEQ ID NO: 280864 - RNA, 53 nt, Human
ugauguauggcaaugagugagcccaugggaaacagguggagauggggaagccg

SEQ ID NO: 280865 - RNA, 64 nt, Human
uaccuacacacacacacacucuuacaaccuccaucaugggaagucaaguuucagaaacaaaagu

SEQ ID NO: 280866 - RNA, 64 nt, Human
agguggcacaguuuagucuaagacagcaguaguacaugggaaaaacaguaugggaagaguucuu

SEQ ID NO: 280867 - RNA, 64 nt, Human
ugacacccaggcccgagcgccugcguucccagaccaugggaaaugggaauugcgcucaggggcu

SEQ ID NO: 280868 - RNA, 64 nt, Human
uguguguuaucugacaagauaguuauuuaagaaacaugggaauugcagaaaugacugcagugca

SEQ ID NO: 280869 - RNA, 64 nt, Human
ugaggagggggcuagggauaugcucuggggcuuucaugggaaugaugaagaugauaaugagaaa

SEQ ID NO: 280870 - RNA, 64 nt, Human
gcaagucccagacaaggagagcggaggaggaagucaugggaacgcagccuccaguuguagcagg

SEQ ID NO: 280871 - RNA, 64 nt, Human
uaauccagaggcccugucauggcccgcccccagccaugggaaagcaaacuucauccuaaggugu

SEQ ID NO: 280872 - RNA, 64 nt, Human
gcccugggggggaggcauagagggcccugggggucaugggaagcgagcacgcagcaggcgugcc

SEQ ID NO: 280873 - RNA, 64 nt, Human
caaauauaggcugaauucaaacaugcaauuaaagcaugggaagagcuucuaagggcaucuuaac

SEQ ID NO: 280874 - RNA, 64 nt, Human
cugagcacgggagacccaccgugcaggggccuuucaugggaacggcccacacgcaguuugaccc

SEQ ID NO: 280875 - RNA, 64 nt, Human
gccugaacugguugugcagaacaaacaaggcauucaugggaauuguuguauuccuucugcagcc

SEQ ID NO: 280876 - RNA, 64 nt, Human
ccacacaggagucuguucugagguggcaauagcacaugggaagaugaacuuucccuguuuguuu

SEQ ID NO: 280877 - RNA, 60 nt, Human
ggcaccauagugcggugcccuguggcuucaccgcccuacuuccaccuccgcccagccugu

SEQ ID NO: 280878 - RNA, 60 nt, Human
uccaagccagcgggaauggcagcugccacgccgcccuaaaagcacacucauccccucacu

SEQ ID NO: 280879 - RNA, 60 nt, Human
cccugcccaaacaaaacaggacaucugugaccgcccuacccccacgccagccccaaacua

SEQ ID NO: 280880 - RNA, 60 nt, Human
agaaagccucccuucuucuccagguccccuccgcccuagucccugccugucucaucuaac

SEQ ID NO: 280881 - RNA, 64 nt, Human
aguuacucagguuaugaaugaauuagguuuucaacaugggaagcaugaaauccacuucuggauu

SEQ ID NO: 280882 - RNA, 64 nt, Human
aauaaaccgagaaaucaugagaaaugucuaaucccaugggaaaaccuguaugccgauuuuccuc

SEQ ID NO: 280883 - RNA, 64 nt, Human
cgcaggcaucugagcucugugccggggccguggccaugggaagauguuccacgcugccuccucc

SEQ ID NO: 280884 - RNA, 64 nt, Human
gaauucuagagagaagccauauacauguaaguaacaugggaaagcuuucaaucauuuuaguucc

SEQ ID NO: 280885 - RNA, 64 nt, Human
agcucagccagauccuuacacguggagcccccagcaugggaaugaggggcucugcaacugagcg

SEQ ID NO: 280886 - RNA, 64 nt, Human
gccagugacgcuccgaguugaggauguugaacaacaugggaaggucgcagcguacuaagugaag

SEQ ID NO: 280887 - RNA, 64 nt, Human
gacauggcacaggcccgcccucugccuccucagccaugggaaccucauaugcaauuugggauuu

SEQ ID NO: 280888 - RNA, 64 nt, Human
cuguaacggaaaaugauucuguuaauguaaugaacaugggaaagaccagccuuggccuaucuuu

SEQ ID NO: 280889 - RNA, 64 nt, Human
ccuacuuuauguauggagcucuaacccauggguccaugggaauaaagcagugaauaguaacaau

SEQ ID NO: 280890 - RNA, 64 nt, Human
augaucauguaaauauuacacaucaaaccaaugacaugggaaaaugggagcuucuaaugaggac

SEQ ID NO: 280891 - RNA, 64 nt, Human
auccaaucaugguaaaaauguguuucccucaaaucaugggaaccaucgcaaaauuauucugaag

SEQ ID NO: 280892 - RNA, 64 nt, Human
gaaaggaugcaucagaccuguuccacaucaugcacaugggaaagggugguuaucauuuuccuuc

SEQ ID NO: 280893 - RNA, 64 nt, Human
uguccagaucuaaucuauuccuggggccauaacucaugggaaaacagaauuauccccuaggacu

SEQ ID NO: 280894 - RNA, 60 nt, Human
cagcgggggcuucagccauguccuagcuccccgcccuaaaaggaggcagugaggaccagg

SEQ ID NO: 280895 - RNA, 53 nt, Human
uccuggagcugcagacgugaggcccgcccuacgcuccccuugcugaguccccu

SEQ ID NO: 280896 - RNA, 64 nt, Human
uauaagucagaguuggacaacucaauguaaauuucaugggaaaauccuuguaccugaugucuga

SEQ ID NO: 280897 - RNA, 64 nt, Human
uauaagcuggagguggacaacucgauguaaauuucaugggaaaacccuuguaccugacauguga

SEQ ID NO: 280898 - RNA, 64 nt, Human
cacuccagauaggagccccaugcacuuaaaaaaacaugggaagauaugguugccuggaauuguc

SEQ ID NO: 280899 - RNA, 64 nt, Human
ggcugagggccugcuggaggccucaggugcuguccaugggaaagaugguguggguguccugccu

SEQ ID NO: 280900 - RNA, 64 nt, Human
caucucucaugguugaagaagugguggaggauggcaugggaaagagugccugaggauccuugcc

SEQ ID NO: 280901 - RNA, 64 nt, Human
cucaguucccagggcacauuucuggaucagaacccaugggaaacaggagguacuaagugcaaug

SEQ ID NO: 280902 - RNA, 61 nt, Human
ugugccuuguggugagauaauaaauuauggccaugggaaacauuguauauuuagugugugu

SEQ ID NO: 280903 - RNA, 64 nt, Human
gccagcagccagacuacggaauccacauguggaccaugggaagucagucucuugcguguccuag

SEQ ID NO: 280904 - RNA, 64 nt, Human
ucuauaaaucacccaacuaagaucagggguguuucaugggaaaaucuacacaaacuauucauua

SEQ ID NO: 280905 - RNA, 64 nt, Human
uggggcucacggggccuccaacccauuuaaucaccaugggaaacuguugugggcgcugcuucca

SEQ ID NO: 280906 - RNA, 64 nt, Human
uucaaucucugggccaagaucacaugcaggauaccaugggaaggagccaucuccacucuccuuc

SEQ ID NO: 280907 - RNA, 64 nt, Human
ucugcucugcuucuccuccugccgcugaccagagcaugggaaauagcccuggauuggguagugg

SEQ ID NO: 280908 - RNA, 64 nt, Human
cauuguauauaugugacuauuuacauguaaucaacaugggaacuuuuaggggaaccuaauaaga

SEQ ID NO: 280909 - RNA, 64 nt, Human; identical to SEQ ID NO: 233929

SEQ ID NO: 280910 - RNA, 64 nt, Human; identical to SEQ ID NO: 233930

SEQ ID NO: 280911 - RNA, 64 nt, Human; identical to SEQ ID NO: 233997

SEQ ID NO: 280912 - RNA, 64 nt, Human
cacauguuauggcagauugaaaaggaucucauuccaugggaaaaaaaaaaauccugucuuguuc

SEQ ID NO: 280913 - RNA, 64 nt, Human
gcguggggaagggcccuggagaagcccucauccucaugggaaccacacugcaguggguggggaa

SEQ ID NO: 280914 - RNA, 64 nt, Human
uuucugcuuuagcaaaaauaaccacugucucauucaugggaaaaggccgccaaacaaauuuguu

SEQ ID NO: 280915 - RNA, 64 nt, Human
cgccaacgaaccacaggugcugggcuuuagagaacaugggaaggcggccccagaccugcgggaa

SEQ ID NO: 280916 - RNA, 64 nt, Human
uccugacccauucauaaaugcugagaaugucucucaugggaacacuguuaaugacccacacagg

SEQ ID NO: 280917 - RNA, 64 nt, Human
aaauaaaacugcggaauacaauguccuuccauagcaugggaagaagaaaauaaacaucuccuuu

SEQ ID NO: 280918 - RNA, 64 nt, Human
ucucacgguguccuccaugccugcagggcccaugcaugggaaguugcguuggcggccugggugu

SEQ ID NO: 280919 - RNA, 64 nt, Human
agcauggccauuaugccuaguuuugaugaauaaacaugggaaagccauaacuguuacuaagugg

SEQ ID NO: 280920 - RNA, 64 nt, Human
caccggucacauuuucuauuggcagugacugauucaugggaaagggcuuugaaggaacuacuuc

SEQ ID NO: 280921 - RNA, 64 nt, Human
cauuaauuaagaaaaccagcaugguuugacaccacaugggaacaugaauaaaucugucucauga

SEQ ID NO: 280922 - RNA, 64 nt, Human
gcguuguuuaaugccugaaauccaagucuuccuccaugggaaaauacuguuauaccaaauaauu

SEQ ID NO: 280923 - RNA, 64 nt, Human
gggaugggacuagauucuaaaauuuauuugggaccaugggaaugauaguugggaagaaaacuau

SEQ ID NO: 280924 - RNA, 64 nt, Human
accuuaaaauugaggauguuacucaguguuaacacaugggaacaccaaaauauucaauaagccu

SEQ ID NO: 280925 - RNA, 64 nt, Human; identical to SEQ ID NO: 233925

SEQ ID NO: 280926 - RNA, 64 nt, Human; identical to SEQ ID NO: 233926

SEQ ID NO: 280927 - RNA, 64 nt, Human; identical to SEQ ID NO: 233928

SEQ ID NO: 280928 - RNA, 64 nt, Human
aucucuugagacucguucacuaucaugagaauagcaugggaaagaccugccuccaugauucagu

SEQ ID NO: 280929 - RNA, 64 nt, Human
ugucaugcagaguauuucuaaaguaauugguuaucaugggaaaguauucucuuuucaagaaguu

SEQ ID NO: 280930 - RNA, 64 nt, Human
gucuauuuuucaauuggaaacuuucacacauuugcaugggaauauguucauuccauguuguaaa

SEQ ID NO: 280931 - RNA, 64 nt, Human
uauugauuacaacucagcuauaauccugagggaacaugggaaggaaucaaagguaaagcccauu

SEQ ID NO: 280932 - RNA, 64 nt, Human
gaauguuuccaacuggcucaauuggcugggaaaacaugggaacaagagaagcugaaauauauuu

SEQ ID NO: 280933 - RNA, 64 nt, Human
uuaaaucuguuggauccucucagcuaucuaguuucaugggaaguugcugguuuugaauauuaag

SEQ ID NO: 280934 - RNA, 64 nt, Human; identical to SEQ ID NO: 280933

SEQ ID NO: 280935 - RNA, 64 nt, Human
aaaauucaguauguucuagcuacuucacacauguguacgcgacaguuauuuuuacaguaaggua

SEQ ID NO: 280936 - RNA, 64 nt, Human
acgcgcgcuccgcgcagcucaggcuggcaccgcuguacgcgagcgcgcgcgcccucuggcugcu

SEQ ID NO: 280937 - RNA, 64 nt, Human
ucguuuuaaguguaauuccauaaugagcagagguguacgcgaaauuguguuaugacugauagcc

SEQ ID NO: 280938 - RNA, 64 nt, Human
uauuacuugucuagugauguccucucaaagugcuguacgcgagcucggcgccaccuccgccucc

SEQ ID NO: 280939 - RNA, 64 nt, Human
ucaccuggcgucugaaagagaauuacgccgcggaguacgcgaacgcacuggagaaggggcugcc

SEQ ID NO: 280940 - RNA, 60 nt, Human
ugggauuccacgcucgccgcccucccuuggccgcccuacuccccaguuuccuggcgauga

SEQ ID NO: 280941 - RNA, 60 nt, Human
gagcccacagccaccccacuaugccgcaggccgcccuacccaccuucaggcagccuaugg

SEQ ID NO: 280942 - RNA, 60 nt, Human
ggcccccagccugcucucuaggaucaccccccgcccuaaggggccuggccuggggugacg

SEQ ID NO: 280943 - RNA, 60 nt, Human
cugaagccuggcuuggguugaaaaguguucccgcccuaaggccuuggugcccugaaccuc

SEQ ID NO: 280944 - RNA, 60 nt, Human
acguccucccaaggggccuucugcccgcccccgcccuagcugugccuuagucagugugua

SEQ ID NO: 280945 - RNA, 64 nt, Human
cugccgggacccuuucacugccccgguggagugaauagaggaugaggggcccugacccuguguc

SEQ ID NO: 280946 - RNA, 64 nt, Human
caccaauuuucucauuucaccccauuuaccuuguauagaggauuguucauuccuuugggacuaa

SEQ ID NO: 280947 - RNA, 64 nt, Human
acacagugucaugaagguuauucauaauugcauuauagaggaauguaguaugucauaaguacuu

SEQ ID NO: 280948 - RNA, 64 nt, Human
ggugcccucuucggcagccaagggugaaggccccauagaggagaggauccaaaggagcauugag

SEQ ID NO: 280949 - RNA, 64 nt, Human
aagcugauaccuuaggcacacagguuggacuuacauagaggaaagaaagcaagaaaugcccuau

SEQ ID NO: 280950 - RNA, 64 nt, Human
uguugagaggucuuggugagggcucaacucaagcauagaggauucuucugucuuggaguucaga

SEQ ID NO: 280951 - RNA, 64 nt, Human
ccuaggcucuaaaagauauuacauauuugaacuaauagaggaacucugagucacccaugccagc

SEQ ID NO: 280952 - RNA, 64 nt, Human
uuggagguaaagaacugaagauaacuggugcuggauagaggagccuuauuuuuuauuauggcag

SEQ ID NO: 280953 - RNA, 64 nt, Human
auuuguuccucuuagaagucagaucaucugauuuauagaggauuaugaaaaccagaguuuuuga

SEQ ID NO: 280954 - RNA, 64 nt, Human
cucagcccccugcguguguauauuggugggaggcauagaggauggauguucuagaaaugaguaa

SEQ ID NO: 280955 - RNA, 64 nt, Human
cauccacagcuucaugacccacccugaauucgccauagaggaggaguugccacgaacaccacuc

SEQ ID NO: 280956 - RNA, 64 nt, Human
uucaugaaacugaauaaaagaaauccuuuccgagauagaggagauuuguaggugaaugcagaag

SEQ ID NO: 280957 - RNA, 64 nt, Human
acagagaagucucagaaaaggcuaacaauuuuauauagaggacaaaacagcauuaaacucauca

SEQ ID NO: 280958 - RNA, 64 nt, Human
ggacgugaagcuagaaaaauaaaugagcccaggcauagaggacuagagcccaggugcacgguua

SEQ ID NO: 280959 - RNA, 64 nt, Human
ccccuucgcugaaauugcuuauuuuugguguuggauagaggauagggagaauauuuacuaacua

SEQ ID NO: 280960 - RNA, 64 nt, Human
guucauauaaucugucuguucccuggagaugggaauagaggaugaugacaguuuauuuucuaca

SEQ ID NO: 280961 - RNA, 64 nt, Human; identical to SEQ ID NO: 233932

SEQ ID NO: 280962 - RNA, 64 nt, Human; identical to SEQ ID NO: 233933

SEQ ID NO: 280963 - RNA, 64 nt, Human; identical to SEQ ID NO: 233934

SEQ ID NO: 280964 - RNA, 64 nt, Human
uguugucauggaugguggugacauggacuuguuuauagaggacaggucagcugucuggcucaau

SEQ ID NO: 280965 - RNA, 64 nt, Human
gugacuuuucaccuuaaugcauauuccccucuccauagaggagaggaaaagguguaggccugcc

SEQ ID NO: 280966 - RNA, 64 nt, Human
aggcaggagggcccucagcuccuagggcugucgaauagaggaggagagagaaauggucuagcca

SEQ ID NO: 280967 - RNA, 64 nt, Human
ugaugaaacuaucagauacuaaaacauucuuaaaauagaggaauauaguuagagacaucagguu

SEQ ID NO: 280968 - RNA, 64 nt, Human
ccuaguaagcacuuugucucuguucacuacugcgauagaggaaaucuaucucccuaucuugggu

SEQ ID NO: 280969 - RNA, 64 nt, Human
uaaaauuguagcacauguuucccugacauuuucaauagaggauacaacaucacagaaucuuucu

SEQ ID NO: 280970 - RNA, 64 nt, Human
agccuaacucuugaggucucuaacauaccuugucauagaggaaaagcacagauuauaccuggau

SEQ ID NO: 280971 - RNA, 64 nt, Human
cuuggggguuagggaugcuaagaagagcccacaaauagaggauuacucuuccccugaaucucua

SEQ ID NO: 280972 - RNA, 64 nt, Human
cacacaucauuugauaaguuggauguuccauuacauagaggaacacaaaauuccaggguuuuug

SEQ ID NO: 280973 - RNA, 64 nt, Human
gggaugguaucuaaaaacucaaguauuuucgaugauagaggagguauaaauauuucaggccaag

SEQ ID NO: 280974 - RNA, 64 nt, Human
aguaucucaaugaaaagggaguuucguaagcaaaauagaggacagaaaugcaguucaugaacuu

SEQ ID NO: 280975 - RNA, 64 nt, Human
ucaguagccuugugacacugaaccuggauggauuauagaggagcccucacggcugaucaauaau

SEQ ID NO: 280976 - RNA, 64 nt, Human
aaaauuuuuuuuuagaaauguuauuuucccugugauagaggaugacuucccaguuucaccaaag

SEQ ID NO: 280977 - RNA, 64 nt, Human
gggauagaggaagggugagcuccucauucaggaaauagaggaguguuuccucuuuauuuuugcu

SEQ ID NO: 280978 - RNA, 64 nt, Human
ccuauuuaucucugaggaucgaccggggacugggauagaggaagggugagcuccucauucagga

SEQ ID NO: 280979 - RNA, 64 nt, Human
gaagagccuucuguagaccauauagaaaaagauuauagaggaggagaaucuacugcuggcaauu

SEQ ID NO: 280980 - RNA, 64 nt, Human; identical to SEQ ID NO: 233938

SEQ ID NO: 280981 - RNA, 64 nt, Human; identical to SEQ ID NO: 233939

SEQ ID NO: 280982 - RNA, 64 nt, Human; identical to SEQ ID NO: 233940

SEQ ID NO: 280983 - RNA, 64 nt, Human
auuagacacaucugugcuucagucauagauguuaauagaggaagcaguuuuccugcugcagauu

SEQ ID NO: 280984 - RNA, 64 nt, Human
cacauacuagagagaggcccuaugaaagcaggaaauagaggaaggccuucagucagggcucauc

SEQ ID NO: 280985 - RNA, 64 nt, Human
gccuguuacacagaaacaggaauaccauguuaagauagaggaaaaaaauuuuguuuauuugggg

SEQ ID NO: 280986 - RNA, 64 nt, Human
agaaaugacagcagaagccauggcacagacuuguauagaggagaaaaaauguacagagagcacc

SEQ ID NO: 280987 - RNA, 64 nt, Human
cuuuuaaacauugcagaucaguguagaacuggucauagaggaagagcuagaaauccaguagcau

SEQ ID NO: 280988 - RNA, 64 nt, Human
caacaaaaugauccuuaugauguccaacaaggaaauagaggacgaaggccuguguguugccagg

SEQ ID NO: 280989 - RNA, 64 nt, Human
uaaacuggauuguacuuaaauaaugaagcucugcauagaggaacuagucagaaguggggaaaac

SEQ ID NO: 280990 - RNA, 64 nt, Human
ggagaaggcauaugacaguagagaggacuggaauauagaggagaauauaagcauguagaugagg

SEQ ID NO: 280991 - RNA, 64 nt, Human
aaaaacaucaacauggaguccaaguaaugaauuuauagaggaaaauguaugcuacucugaaaac

SEQ ID NO: 280992 - RNA, 64 nt, Human
cauuguguauucaauccagcgaacugcuguauguauagaggagcugaggugcugucuaauggga

SEQ ID NO: 280993 - RNA, 64 nt, Human
uauuuaccauuguuaacaggaauuaaauaagcacauagaggaugguaugggaagaaauuuggcu

SEQ ID NO: 280994 - RNA, 64 nt, Human
cuguguuuaaguuuguuauuugaauguaauuuacauagaggaauauaauaauggagagacuuca

SEQ ID NO: 280995 - RNA, 64 nt, Human
uggaggccuucaugguaacaaaugaaagcucaguauagaggaacagacacuguuuacgucccuc

SEQ ID NO: 280996 - RNA, 64 nt, Human
ccccaucacccaccucagugauaacacauuacugauagaggaagucauuagaaucauuuuuaag

SEQ ID NO: 280997 - RNA, 64 nt, Human
gugugggcugcucuaggagcagauacaggcugguauagaggaugcagaaagguagggcaguaug

SEQ ID NO: 280998 - RNA, 64 nt, Human
aaaaaagcaugggaagauuuuuauuuaucaaaauauagaggaaauguagacaaaauggauauaa

SEQ ID NO: 280999 - RNA, 64 nt, Human; identical to SEQ ID NO: 233935

SEQ ID NO: 281000 - RNA, 64 nt, Human; identical to SEQ ID NO: 233936

SEQ ID NO: 281001 - RNA, 64 nt, Human; identical to SEQ ID NO: 233961

SEQ ID NO: 281002 - RNA, 64 nt, Human
auuagggaccagaaaauuauaucuuggcuaaguaauagaggaccauuuugguuuuuguacuuga

SEQ ID NO: 281003 - RNA, 64 nt, Human
ucaauuuucagaaaugaauuaucuguacauaugaauagaggaaaauacugagugcuaauguuac

SEQ ID NO: 281004 - RNA, 64 nt, Human
aaugaacucuccaacuuauuaaacuuuuauauagauagaggaagacagcucuuucgggauaacc

SEQ ID NO: 281005 - RNA, 64 nt, Human
uuacgacaucacuuccauugugugcauguuuguuauagaggagguuuuaggcuacaauauuugu

SEQ ID NO: 281006 - RNA, 64 nt, Human
cgccacacaccucagggccguccgcugcauugccauagaggagcccucccuccaguggucacuu

SEQ ID NO: 281007 - RNA, 64 nt, Human
uagaucugccucccaauuuaaggaaaacauaagaauagaggaacauauuaugcuacacguugga

SEQ ID NO: 281008 - RNA, 64 nt, Human
ugucaggugcuguguguaaguggagaacuuggggauagaggaggaagcuccucguggcccuucc

SEQ ID NO: 281009 - RNA, 64 nt, Human
ccuuggauuuauagacaauguauguacaauccaaauagaggagcuuaauggaauccuuuuagga

SEQ ID NO: 281010 - RNA, 64 nt, Human
ucaguaagaaaaaugucuugagcuagaagaacccauagaggaagauuuuguaaugcgaaucucc

SEQ ID NO: 281011 - RNA, 64 nt, Human
aaagacuuguuacauagagggaaaauggacugggauagaggacagacugauaguuucuuucuuu

SEQ ID NO: 281012 - RNA, 64 nt, Human
ucaucuaaguuuaccaugcaguuguuuaccaaaaauagaggaggagagucuuaacuuuugcucu

SEQ ID NO: 281013 - RNA, 64 nt, Human
cauauaagaggcuugaacauccauggauuuugguauagaggagggguuuaagggguguccugca

SEQ ID NO: 281014 - RNA, 64 nt, Human
uagacaguucaacaagccacaucuaauggcacagauagaggauguagcuauuuuauaccuuuca

SEQ ID NO: 281015 - RNA, 64 nt, Human
ugugccagugcacagguagacuaaggaaaacauuauagaggagugaagagaacagaccauugaa

SEQ ID NO: 281016 - RNA, 64 nt, Human
guccuugaaauuauuauaacuggcucccaggggaauagaggaaaccaggaauucauuucaaaau

SEQ ID NO: 281017 - RNA, 64 nt, Human
cagucuuaccuuacaaauuucuuuucuaugaauaauagaggaacuuacggcacucugccauuug

SEQ ID NO: 281018 - RNA, 64 nt, Human; identical to SEQ ID NO: 233944

SEQ ID NO: 281019 - RNA, 64 nt, Human; identical to SEQ ID NO: 233945

SEQ ID NO: 281020 - RNA, 64 nt, Human; identical to SEQ ID NO: 233946

SEQ ID NO: 281021 - RNA, 64 nt, Human
ugggauagguugcaguaccagccacagccagcagauagaggaaaagacacacauaaacucgcuu

SEQ ID NO: 281022 - RNA, 64 nt, Human
guguauauaaugcagcauuagcaauaugguuccaauagaggaguuaaauauauauuguuaaagg

SEQ ID NO: 281023 - RNA, 64 nt, Human
agaagggagagggaaccagauaugcagaucagagauagaggaaguggaaccagagagcugggag

SEQ ID NO: 281024 - RNA, 64 nt, Human
agagaggagagggaaccagauaugcagaucagagauagaggaaguggaaccagagagcugggag

SEQ ID NO: 281025 - RNA, 64 nt, Human
augagcagggaugaagggucaggcagaaagcgugauagaggagagaauuuuugacaaaacucaa

SEQ ID NO: 281026 - RNA, 64 nt, Human
aaaaugucugccucacagauaggagggaaaauauauagaggauuauaauaugguucaacaaaug

SEQ ID NO: 281027 - RNA, 64 nt, Human
gaugggccaaaaaaagcaaucaaagucuuacgucauagaggaccaccuuuuggaucauaaauuc

SEQ ID NO: 281028 - RNA, 64 nt, Human
gcuuugggaacuguguucagagagauuccgaggaauagaggagaguguaagggaguagggggug

SEQ ID NO: 281029 - RNA, 64 nt, Human
aguggaaaguguuccagacggagacucugaguuaauagaggaguagaagcugguguuaaaguuc

SEQ ID NO: 281030 - RNA, 64 nt, Human
cuaguauuuaagaguaaccuugagauugggaggaauagaggaggcugguacaaauagauggaga

SEQ ID NO: 281031 - RNA, 64 nt, Human
ccacuggucccacuugggggucuagaccaggauuauagaggacacagcaagugaguccucccca

SEQ ID NO: 281032 - RNA, 64 nt, Human
auuggcuuuuuucuuuuauuuuuaaaaaacucacauagaggagacaaucagaaauuuaccauag

SEQ ID NO: 281033 - RNA, 64 nt, Human
cugaaucucugugaugcuggugggaauuguuugcauagaggaaggacaauaacccugccaucgu

SEQ ID NO: 281034 - RNA, 64 nt, Human
ucuuggcugcauguugaaaaugugauuaaaguuaauagaggagaugaaauaaguauuugagauu

SEQ ID NO: 281035 - RNA, 64 nt, Human
gugaguuggguguauugugcgcuaaacuuuucugauagaggaagccugauuaaagaaugguccg

SEQ ID NO: 281036 - RNA, 51 nt, Human
cauuacagcuaauuucuugagauagaggacagagaagaugacucguuccca

SEQ ID NO: 281037 - RNA, 64 nt, Human; identical to SEQ ID NO: 233998

SEQ ID NO: 281038 - RNA, 64 nt, Human; identical to SEQ ID NO: 233999

SEQ ID NO: 281039 - RNA, 64 nt, Human; identical to SEQ ID NO: 234001

SEQ ID NO: 281040 - RNA, 64 nt, Human
gaguuaaagacccuccuggggcucucagugugccauagaggacagcaacuggugauuguuucag

SEQ ID NO: 281041 - RNA, 64 nt, Human
cauuuuuuaaaggaauauuuucuucuuaagauauauagaggauuuuggagaagagagacaggag

SEQ ID NO: 281042 - RNA, 64 nt, Human
aaggguaacuucacaguaaaucauuucuccugaaauagaggaagauucuuuauguuguugugcu

SEQ ID NO: 281043 - RNA, 64 nt, Human
aacagucagaggucaguaucucagcgugugaauuauagaggaaauacagagagaaccucuucca

SEQ ID NO: 281044 - RNA, 64 nt, Human
gcauauaucucugccuaacacuuuaguaggugcuauagaggauacaugaaaaguaugagaucug

SEQ ID NO: 281045 - RNA, 64 nt, Human
uauucuguucacuaucacaaaaucaucuauauuuauagaggaauagaaguuuauauauauauaa

SEQ ID NO: 281046 - RNA, 64 nt, Human
ucaguugaagaggacgagaggacgaccuucucugauagaggaggaccacgcuucagucaaaggc

SEQ ID NO: 281047 - RNA, 64 nt, Human
aagcagauuucugcuuccuuuuauuuuuauaggaauagaggaagaaaugucagaugcgugccca

SEQ ID NO: 281048 - RNA, 64 nt, Human
acggugaaccgcauggaacagugcaggacggaauauagaggagcacuauuauggaugaaggacg

SEQ ID NO: 281049 - RNA, 64 nt, Human
gacuauuugacccccacaacaauggguauccuuaauagaggagcugcuuguuguuuguugacag

SEQ ID NO: 281050 - RNA, 64 nt, Human
uucaauguuauuuuagccauguaaauaaguguagauagaggaauuaaacuguauauucuggaua

SEQ ID NO: 281051 - RNA, 64 nt, Human
cucauggucuguauagaguguuauacuugguaauauagaggagaugaccaaaucagugcugggg

SEQ ID NO: 281052 - RNA, 64 nt, Human
gacauaaaugagguuaauguaauauuacauauugauagaggaauaggucaauagagaagauaca

SEQ ID NO: 281053 - RNA, 64 nt, Human
agauuggaaaaagcuggccgagaaccauuuauacauagaggaagggcuuauggacugagaaagg

SEQ ID NO: 281054 - RNA, 64 nt, Human
aggaguggcugaccaggcccugcucaucacccggauagaggacacggacccugugugguauuuu

SEQ ID NO: 281055 - RNA, 64 nt, Human
uggagauggaacauagauuagugguugccaggggauagaggaguaauuguuagugggcauggga

SEQ ID NO: 281056 - RNA, 50 nt, Human
gacccacugucaucaccugaauagaggaaagaucacucaccagggccaaa

SEQ ID NO: 281057 - RNA, 64 nt, Human; identical to SEQ ID NO: 233950

SEQ ID NO: 281058 - RNA, 64 nt, Human; identical to SEQ ID NO: 233951

SEQ ID NO: 281059 - RNA, 64 nt, Human
gaaaacauaccucaauacacucaaaacugaagacauagaggacucagaucaaagacaaaaucug

SEQ ID NO: 281060 - RNA, 64 nt, Human
cuggucugucaacuaguccaaccccuuaaaauucauagaggagcaaacuggggcccauugaagg

SEQ ID NO: 281061 - RNA, 64 nt, Human
aucucuuauaggaaucaaaguuuauuaaaguuacauagaggauugaaaaauguauaucacucaa

SEQ ID NO: 281062 - RNA, 64 nt, Human
uauucucauacuuuacauucaugcuuaguauacuauagaggaugccagcuuuaaucuuucuguc

SEQ ID NO: 281063 - RNA, 64 nt, Human
cuaaaaugucaguagaagacuugacagcuugagaauagaggaaaaaauaaaagcgaagcagaca

SEQ ID NO: 281064 - RNA, 64 nt, Human
uccuuagaauggccucuuuguagaacccugugguauagaggaguauggccacugccccacuauu

SEQ ID NO: 281065 - RNA, 64 nt, Human
aaauaauugagaugggaaagaauagugcagcuccauagaggagacggacuguagacaaugagau

SEQ ID NO: 281066 - RNA, 64 nt, Human
ccucggcgacccaucacuggguaugcuauuguacauagaggaaaccugggcuagccccacccag

SEQ ID NO: 281067 - RNA, 64 nt, Human
aguugcagugcuggaaguccagaacaagaagcuuauagaggaacuugaaaccuugaaagacauu

SEQ ID NO: 281068 - RNA, 64 nt, Human
gacuugauagcuugaagaauccuuuuccacugaaauagaggauaauuaauugacacaucugaaa

SEQ ID NO: 281069 - RNA, 64 nt, Human
aauugugcagaguaguuuauuccuucugaccaucauagaggagacauuaaauaaauuaugcauu

SEQ ID NO: 281070 - RNA, 64 nt, Human
agauuuauaaaaauugcauuauguguuucugcuaauagaggaaucauagccauuuagaauuuuu

SEQ ID NO: 281071 - RNA, 64 nt, Human
uuuuucaccuuaaaaauugacacagaguuuacuaauagaggaguagagauuguugaccauuuuu

SEQ ID NO: 281072 - RNA, 64 nt, Human
uugaugcccugaaucuugaggugacuuauuuugcauagaggauauggauagaccaacaguaagg

SEQ ID NO: 281073 - RNA, 64 nt, Human
aggcugccagcuguuuuaccagggauccagagacauagaggaaguagggggugguaugagauua

SEQ ID NO: 281074 - RNA, 64 nt, Human
acaggcagccaacaagcaauuaagagcaguuauaauagaggaagcugggggacccauuuugcac

SEQ ID NO: 281075 - RNA, 64 nt, Human; identical to SEQ ID NO: 233941

SEQ ID NO: 281076 - RNA, 64 nt, Human; identical to SEQ ID NO: 233942

SEQ ID NO: 281077 - RNA, 64 nt, Human; identical to SEQ ID NO: 233952

SEQ ID NO: 281078 - RNA, 64 nt, Human
cucaccugcucaugaccagagagcauuuaggauaauagaggaccuaacugaaggaauccuugua

SEQ ID NO: 281079 - RNA, 64 nt, Human
gccagggucccuggacuggggguugguguuuucuauagaggaggaaaggcccucccucacccug

SEQ ID NO: 281080 - RNA, 64 nt, Human
accguaaaucuuuuuaaauucuggaacuaauuauauagaggauaugucucaauuuguucugcau

SEQ ID NO: 281081 - RNA, 64 nt, Human
aauugucaccaaggaguuaaaagcuucuucuucaauagaggaauuguucuggggguccuggaga

SEQ ID NO: 281082 - RNA, 64 nt, Human
acuaggcuugggguggggaggucccguguuccauauagaggaaccccaaauaauaaaaggcccc

SEQ ID NO: 281083 - RNA, 64 nt, Human
ugagcggugggggaggaggguugugcuacagaugauagaggauuuuauaccccaauaaucaacu

SEQ ID NO: 281084 - RNA, 64 nt, Human
ugcaacuuccuuugacuuucuguguaccacugggauagaggaaucaagaggacaaucuagcucu

SEQ ID NO: 281085 - RNA, 64 nt, Human
aagcauaguaaauaaaggucaaguagcauuuauaauagaggaaguauuguuaucccuagcauga

SEQ ID NO: 281086 - RNA, 64 nt, Human
uccaaucauuuuuuacucccuuuugaugccauacauagaggaaagucuagcuuuuuuggcguga

SEQ ID NO: 281087 - RNA, 64 nt, Human
agcaaaacaaauauucccaugccuggagcauggcauagaggaagcugagaaauguggggucuga

SEQ ID NO: 281088 - RNA, 64 nt, Human
aaguagcuggcauguagugucacggauuuucuggauagaggaagugauuggaaguacuccacuu

SEQ ID NO: 281089 - RNA, 64 nt, Human
agcccgggagagccacacugugggcuuaaugugaauagaggaacaaguggguaucucugccagg

SEQ ID NO: 281090 - RNA, 64 nt, Human
gauggcccugccaagaccagcacccagcaagauuauagaggaagaaauccuaaaugcuggugug

SEQ ID NO: 281091 - RNA, 64 nt, Human
uucaagauagcagucaauucgauaaggcauuuucauagaggaaaguuuacagaaacaguuuaug

SEQ ID NO: 281092 - RNA, 64 nt, Human
agcaugucaggacagagcuguuggauuggcuuugauagaggaauggggaugauguaaguuuaca

SEQ ID NO: 281093 - RNA, 64 nt, Human
gaagaacauuuucucaggcucguagagaggugggauagaggaagggagguuugagccagacagg

SEQ ID NO: 281094 - RNA, 64 nt, Human; identical to SEQ ID NO: 234027

SEQ ID NO: 281095 - RNA, 64 nt, Human; identical to SEQ ID NO: 234028

SEQ ID NO: 281096 - RNA, 64 nt, Human
auuccucauuaaagagagaaucucagguucucacuggaggcacugugcauauuuucaaccagau

SEQ ID NO: 281097 - RNA, 58 nt, Human
aucgcuguggcugcucuuaaggugggggauagaggaugccucccccacagacccuacc

SEQ ID NO: 281098 - RNA, 64 nt, Human
cucucucccaggugucaguccggaggaaguccugauagaggaugacgucugaccucuaccaucg

SEQ ID NO: 281099 - RNA, 64 nt, Human
aucuggaugaccugccuagcaguuuccccaugagauagaggaaugucuacguauuucauucccu

SEQ ID NO: 281100 - RNA, 64 nt, Human
uauccugaauggaaaauagaggauacaauggaaaauagaggauaccaacuguaugcuacuggga

SEQ ID NO: 281101 - RNA, 57 nt, Human
ggacaauugugcuauccugaauggaaaauagaggauacaauggaaaauagaggauac

SEQ ID NO: 281102 - RNA, 64 nt, Human
gaacauacagacacauuuacacuagaggccagggauagaggauauugggucucagcccuagggg

SEQ ID NO: 281103 - RNA, 64 nt, Human
auugucuucaaugaagacuaauucaauuuugcauauagaggagccaaagagagauuucagcucu

SEQ ID NO: 281104 - RNA, 64 nt, Human
cuaguuuguguccagaaacugcaaguugacaugaauagaggacaaagguugugucuugcuuuug

SEQ ID NO: 281105 - RNA, 64 nt, Human
cgaaguaccaauuaaggugucuuaaauuuggcgcauagaggagagaaggaaaccugaggaguag

SEQ ID NO: 281106 - RNA, 64 nt, Human
uugaaaaaguaaaguguucugccagaucuuagguauagaggacccuaacacaguauaucccaag

SEQ ID NO: 281107 - RNA, 64 nt, Human
uauauuuguguauguaguguaacuauuuuguacaauagaggacuguaacuacuauuuagguugu

SEQ ID NO: 281108 - RNA, 64 nt, Human
acacuuggaaugaacgaaugaacuuguagggggcauagaggauucuugaaaaaaaaaaaugcaa

SEQ ID NO: 281109 - RNA, 64 nt, Human
gguaaaaauaccuguugggaggagaaaugagaacauagaggaaagccucuuggaggaaaggugc

SEQ ID NO: 281110 - RNA, 64 nt, Human
ggcaucaucauaacuuuuccucaccuuuauucgaauagaggaauaaaugucuucaguugucucu

SEQ ID NO: 281111 - RNA, 64 nt, Human
agcaaauuguacaaaguauguaggauguuuuguuauagaggacuauaguggaagugaaagcauu

SEQ ID NO: 281112 - RNA, 64 nt, Human
agcuaaaucagaacugcacacuccuucccugaugauagaggaaguggaagugccuuuaggaugg

SEQ ID NO: 281113 - RNA, 64 nt, Human; identical to SEQ ID NO: 233954

SEQ ID NO: 281114 - RNA, 64 nt, Human; identical to SEQ ID NO: 233955

SEQ ID NO: 281115 - RNA, 64 nt, Human; identical to SEQ ID NO: 233956

SEQ ID NO: 281116 - RNA, 64 nt, Human
aaggacuuaauucuuguuuuuuucccaguuuuauauagaggaaacacuaugauaggauuuccua

SEQ ID NO: 281117 - RNA, 64 nt, Human
aaaggacuuacuucuuguuuuuucccaguuuuauauagaggaaacacugucuaugauaggauuu

SEQ ID NO: 281118 - RNA, 64 nt, Human
caugucaaucaaucaagcauguugaauaagggacauagaggauuuaacuuuuguuaucauaaau

SEQ ID NO: 281119 - RNA, 64 nt, Human
cagacuuucugugacgcagacagaggggauggggauagaggaaagggaugguaaguugagaugu

SEQ ID NO: 281120 - RNA, 64 nt, Human
gcuugggcauucagaccaaccaucauuaauguuaauagaggaaaugcagcaacgucaaaagcaa

SEQ ID NO: 281121 - RNA, 64 nt, Human
cuuuaaguaaaaaaaaaaaaaauucugguugaagauagaggauaugaaaugccauaagacccaa

SEQ ID NO: 281122 - RNA, 55 nt, Human
acuuguccgaugaggacuaauagucauagaggaugcuuuacccaagagccacagu

SEQ ID NO: 281123 - RNA, 64 nt, Human
gcaaaacuuaaaaaaaaaaaaaaagaggagagagauagaggaaggugaauuagacuccaaaaga

SEQ ID NO: 281124 - RNA, 64 nt, Human
cuuuuauccuagaucaccacuggauugcugacagauagaggaggugggacccugacuaucaccc

SEQ ID NO: 281125 - RNA, 64 nt, Human
aaguugugcccaacacuguggaucagcaaacacgauagaggagaccagucaguacuucuuggag

SEQ ID NO: 281126 - RNA, 64 nt, Human
ugcacacaccugccugcagagcaggaaaugagagauagaggaugggcagcuggggggcuguccu

SEQ ID NO: 281127 - RNA, 64 nt, Human
ucaucuuggacaacuuucuuaacuuauauucuuuauagaggauuccccaaaaugugcuccucau

SEQ ID NO: 281128 - RNA, 64 nt, Human
auuuaaaaauaaaaaacacaguccgucccuaccaauagaggaaaaugguuuuaauguuugcugg

SEQ ID NO: 281129 - RNA, 64 nt, Human
agguccuuuacguguggauggaguucacaggcgaauagaggagaggaccaggggacguggcuug

SEQ ID NO: 281130 - RNA, 64 nt, Human
cagugccguggauggcggcaggaagucucacaucauagaggaccccuccuccucucccaguucu

SEQ ID NO: 281131 - RNA, 64 nt, Human
caagcagagucaugaccagggacacagcugagagauagaggaggcugugaaugcugagaccaga

SEQ ID NO: 281132 - RNA, 64 nt, Human; identical to SEQ ID NO: 233957

SEQ ID NO: 281133 - RNA, 64 nt, Human; identical to SEQ ID NO: 233958

SEQ ID NO: 281134 - RNA, 64 nt, Human; identical to SEQ ID NO: 233960

SEQ ID NO: 281135 - RNA, 64 nt, Human
cugugcauuugugucugccugccucaugcucucuauagaggaggauggucaucgugacagcagc

SEQ ID NO: 281136 - RNA, 64 nt, Human
uccugccucccaccccucacaccuggcuucuagaauagaggauugcucagcaugaguccaauuc

SEQ ID NO: 281137 - RNA, 64 nt, Human
uucgggguggugcucaguguggggugaugguaucauagaggaccacggcgcuuaucagcauugu

SEQ ID NO: 281138 - RNA, 64 nt, Human
caguuccucugggugugcacauauguuuggagaaauagaggagagaaaagagggccacguaacu

SEQ ID NO: 281139 - RNA, 64 nt, Human
acccucaagcuggacuguggguuccaaauuacucauagaggagaaaaccagagaaagaugaaga

SEQ ID NO: 281140 - RNA, 64 nt, Human
agggagcaugaccgcucucugacuucacauguuaauagaggaucagagcagaguugggaguaua

SEQ ID NO: 281141 - RNA, 64 nt, Human
guuauucccauuuuaaugaugaggaaacugagucauagaggauacagacuugcccaaaggagag

SEQ ID NO: 281142 - RNA, 64 nt, Human
ucauugaccuuagcuaaaccauggcaauucauaaauagaggaaacauuaaugaauuaaaagcau

SEQ ID NO: 281143 - RNA, 64 nt, Human
acaaagcacaccauauguccacuguucuguucucauagaggaaauucaaaucccuuuuaucuau

SEQ ID NO: 281144 - RNA, 64 nt, Human
aaguguaugaauugcugcgacaauuuugaaaagaauagaggaaacacccucacuguaugauaua

SEQ ID NO: 281145 - RNA, 64 nt, Human
cugaggaccuuguggaguguagcugauccagcugauagaggaacuagccaggugggggccuuuc

SEQ ID NO: 281146 - RNA, 64 nt, Human
cugagaaccuuguggaaugcagcugacccagcugauagaggaaguagccaggugggagccuuuc

SEQ ID NO: 281147 - RNA, 64 nt, Human
uacaucucaguccucacacaaccaucccuguuuuauagaggaggaaguggcuuagagaauguaa

SEQ ID NO: 281148 - RNA, 64 nt, Human
gacgagggcagggcugggaaggauggggagggacauagaggauucgguuccucccccaccuugu

SEQ ID NO: 281149 - RNA, 64 nt, Human
gaaggaguaguucccgaaggaccuugugggugauauagaggacuucgcuuuugcucugagugag

SEQ ID NO: 281150 - RNA, 64 nt, Human
ggaacagcugaauacuaggaauauaucuugcucuauagaggauuuuuuuuuguauguuucaagc

SEQ ID NO: 281151 - RNA, 64 nt, Human; identical to SEQ ID NO: 233989

SEQ ID NO: 281152 - RNA, 64 nt, Human; identical to SEQ ID NO: 233990

SEQ ID NO: 281153 - RNA, 64 nt, Human; identical to SEQ ID NO: 234005

SEQ ID NO: 281154 - RNA, 64 nt, Human
ucccuggagccuggccagcccucaccucuucuggauagaggauucccccaacuccccaacuuuc

SEQ ID NO: 281155 - RNA, 64 nt, Human
gcauuuaggcgagaacccuuauaaguagauguacauagaggauuccaucugggacucagagcuu

SEQ ID NO: 281156 - RNA, 64 nt, Human
uuuuguucaaggcuuaauaaccguuagcuagaccauagaggacagaaacuuuacuaauguacug

SEQ ID NO: 281157 - RNA, 64 nt, Human
aacgcuggccugauacgugucaaaggagagagggauagaggaggauugaauagaaggagacuaa

SEQ ID NO: 281158 - RNA, 64 nt, Human
acaggagagcugcaguugugaaagcaccaucaucauagaggaugauguaauuaaaaaaugguca

SEQ ID NO: 281159 - RNA, 64 nt, Human
cagcuaaaaagcaagaggcaucguugccuggauaauagaggauguguuucagcccugagauguu

SEQ ID NO: 281160 - RNA, 64 nt, Human
guggacaucugucccagagggggcagaaucuccaauagaggacugagcacugcuucuggucugu

SEQ ID NO: 281161 - RNA, 64 nt, Human
aaauaacuuacacaaugcuaaacugugaguauguauagaggaguaaaaucuuauaaauguaaug

SEQ ID NO: 281162 - RNA, 64 nt, Human
agagucgaugaucaccaagcaggaaagggagggaauagaggaauguguucggguuaagugauga

SEQ ID NO: 281163 - RNA, 64 nt, Human
uacagauuauauauauauauacauauuuuccuuaauagaggaaugcuucauauuauucaaaaau

SEQ ID NO: 281164 - RNA, 64 nt, Human
uuuugaauuuauauauguuauugaacaaauaguaauagaggauucgcuguugaaacaaguuguc

SEQ ID NO: 281165 - RNA, 64 nt, Human
aaaaucuugcucuuccauaaucuuacucugugaaauagaggaauucgugugccuuagauuuaga

SEQ ID NO: 281166 - RNA, 64 nt, Human
cugccaguagccaaaacaaagucuuuuuagggcaauagaggaaauuauuuugugucucaggugu

SEQ ID NO: 281167 - RNA, 64 nt, Human
guaaaaaaaaauuacuguuuauuaaaguacaaccauagaggauggucuuacagcaggcaguauc

SEQ ID NO: 281168 - RNA, 64 nt, Human
ggcugaggagccgcugcugggagacagcgcagccauagaggaaguggugaguguccucagaccu

SEQ ID NO: 281169 - RNA, 64 nt, Human
cuuuuuaggucaccugaagcaguuuagccuuuggauagaggaaccugccugaauuuauggcauu

SEQ ID NO: 281170 - RNA, 64 nt, Human; identical to SEQ ID NO: 233963

SEQ ID NO: 281171 - RNA, 64 nt, Human; identical to SEQ ID NO: 233964

SEQ ID NO: 281172 - RNA, 64 nt, Human; identical to SEQ ID NO: 233965

SEQ ID NO: 281173 - RNA, 64 nt, Human
agaacauguauauugagaaagaaaacauacuuauauagaggaauuuauguaaccaugacuuugu

SEQ ID NO: 281174 - RNA, 64 nt, Human
uaguuugauuuacgcaaucuccuuccuugugaaaauagaggauacaaaauugucuaauuuucau

SEQ ID NO: 281175 - RNA, 64 nt, Human
aaagaaccucacacaacauaauuggagucuuaaaauagaggaagaguaagcaaagcaugucaag

SEQ ID NO: 281176 - RNA, 64 nt, Human
uaucucauagauuggaaaauuuucuccaaauacaauagaggagaauauguaaaggguauacauu

SEQ ID NO: 281177 - RNA, 64 nt, Human
acugggucaagauguccaauuuuccagaguaaggauagaggagucaaauucaaauacagguuuu

SEQ ID NO: 281178 - RNA, 64 nt, Human
agugcauuuucucugucuauacugauuauuguauauagaggauguuauaaauauacauauacau

SEQ ID NO: 281179 - RNA, 64 nt, Human; identical to SEQ ID NO: 233915

SEQ ID NO: 281180 - RNA, 64 nt, Human; identical to SEQ ID NO: 233916

SEQ ID NO: 281181 - RNA, 64 nt, Human; identical to SEQ ID NO: 233917

SEQ ID NO: 281182 - RNA, 64 nt, Human; identical to SEQ ID NO: 233918

SEQ ID NO: 281183 - RNA, 64 nt, Human; identical to SEQ ID NO: 233919

SEQ ID NO: 281184 - RNA, 64 nt, Human; identical to SEQ ID NO: 233920

SEQ ID NO: 281185 - RNA, 64 nt, Human; identical to SEQ ID NO: 233921

SEQ ID NO: 281186 - RNA, 64 nt, Human; identical to SEQ ID NO: 233922

SEQ ID NO: 281187 - RNA, 64 nt, Human; identical to SEQ ID NO: 233923

SEQ ID NO: 281188 - RNA, 64 nt, Human; identical to SEQ ID NO: 233924

SEQ ID NO: 281189 - RNA, 64 nt, Human
uuuucaaagacuugggggagugaaggcagagccuggugcagauggacgaggucugcagacggag

SEQ ID NO: 281190 - RNA, 64 nt, Human
gggccagccagugucugaccaaggucaaggggcaggugcagagguggcagggauggcuccgaag

SEQ ID NO: 281191 - RNA, 64 nt, Human
ggggaacauucagagcaugauugguagacagaagggugcagaggcgcccaggggaguacauugc

SEQ ID NO: 281192 - RNA, 64 nt, Human
cuguccugcuagccuuccuccaggaagcacacugggugcagauaaucaggacauuccagagauc

SEQ ID NO: 281193 - RNA, 64 nt, Human
ggggauucacccagugguccccagaggugcuccauggaggcaacaagucauuccaugaagcccc

SEQ ID NO: 281194 - RNA, 64 nt, Human
aaaaacugacacauggccagugcccggaggggucuggaggcauaagucuagaugcccagagagc

SEQ ID NO: 281195 - RNA, 64 nt, Human
uucuuuaaagcaaguauauauaguaugagaaacuuggaggcauuucauacacacguuucuuagg

SEQ ID NO: 281196 - RNA, 64 nt, Human
uucacccucuggggcgccccugcugcggcuggcaggugcagacagccuuugcugguccccagca

SEQ ID NO: 281197 - RNA, 64 nt, Human
ccaagauggcaugaaucgggcuaaggucccugggggugcagaugguacugcugaggucccgggc

SEQ ID NO: 281198 - RNA, 64 nt, Human
cugaccuggcagccuggcucccucugggucauauggugcagacugugaccagcaccaggcaggc

SEQ ID NO: 281199 - RNA, 64 nt, Human
ggggauaacaugggugugugcccacaacacucuaggugcagagccccuguggcaaaguauuaca

SEQ ID NO: 281200 - RNA, 64 nt, Human
cauucauccagcucaguguuuuaagaugauccugggugcagaaguugagcccuccuuugcauug

SEQ ID NO: 281201 - RNA, 64 nt, Human
ccagcaccgggaugcgcagagcacuggaagggcuggugcagaucuacuucccaugcagaagaga

SEQ ID NO: 281202 - RNA, 64 nt, Human
ggucauacauauaugauacaaauccagaguuauuggugcagaaauggcuacccgagagcuuggu

SEQ ID NO: 281203 - RNA, 64 nt, Human
gugauaccaaguuuuauugucaagacagugucauggugcagagguaggcauucugagcagggga

SEQ ID NO: 281204 - RNA, 64 nt, Human
gauaaucugccuuguauuuagucagagggcuagaggugcagauuucauauuuucuuaaugaaaa

SEQ ID NO: 281205 - RNA, 64 nt, Human
uuguacugggaccuucccagggaaggugccuuggggugcagaauccugggaauguuaggaaagg

SEQ ID NO: 281206 - RNA, 53 nt, Human
uugaaaaaacaaaaaaaugacauggugcagaagcuuguaacauugaucacauu

SEQ ID NO: 281207 - RNA, 64 nt, Human
ugcaagccccagggccugggggcagugacuggcaggugcagaugggcuguuucguguaguggaa

SEQ ID NO: 281208 - RNA, 64 nt, Human
uaaucuuauggggccggaaggaaugucagggccaggugcagaccuugggggaagacuuuaaacc

SEQ ID NO: 281209 - RNA, 64 nt, Human
ggacacggaagcagcggguuuggacucuuuauucggugcagaacucggcaaggggcagcuuacc

SEQ ID NO: 281210 - RNA, 64 nt, Human
caggaaauagcauuccaggcaaaggaacaaaacuggugcagacccagcugcuagaaggagcaga

SEQ ID NO: 281211 - RNA, 64 nt, Human
aaacaaauguccccggaucuuucgaugcaaguccuggaggcagggagaucacugccugccuggc

SEQ ID NO: 281212 - RNA, 64 nt, Human
gaaauucuuuuacuucaaaugcaaaagaauaagcuggaggcaauuauuuccuuucauacagagu

SEQ ID NO: 281213 - RNA, 64 nt, Human
aaagccaagaagaauuuauuacaaaucagaacuuuggaggcaaaucuuucugcaugaccaaagu

SEQ ID NO: 281214 - RNA, 64 nt, Human
gagcagaagggcugcauuuugcuuaucagaagaaggugcagauuuaagggaauucauaugaggu

SEQ ID NO: 281215 - RNA, 64 nt, Human
cugugggcccuggccagacaggguuaccuggugaggugcagagagucccucuaguggccauuuu

SEQ ID NO: 281216 - RNA, 64 nt, Human
ucagcacuagacuaacauaacaggucacuacacgggugcagaaucacuuuacaaaagaagacuc

SEQ ID NO: 281217 - RNA, 64 nt, Human
uucccuucuugauuugguacuuuuucucccagagggugcagaaacagauuuacugcaaaacuca

SEQ ID NO: 281218 - RNA, 64 nt, Human
guugggggguaacuuuacuacaauuaguaaguauggugcagaauuucaugcaaaugaggagugc

SEQ ID NO: 281219 - RNA, 64 nt, Human
uggcaggagacagcaugucacccaggacucugccggugcagaauaugagcaaugccauguucuu

SEQ ID NO: 281220 - RNA, 64 nt, Human
gcaggacaauugcauuuuaguuuuauuuuguggaggugcagaauauuuacucuuucuguccaac

SEQ ID NO: 281221 - RNA, 64 nt, Human
aguaacccagcaagucaaggccaggaggaccaggggugcagacagaacacauacuggaacacag

SEQ ID NO: 281222 - RNA, 64 nt, Human
agagucauucuccagaaggaacuugggagaugauggugcagaugaugaaacuggguucauccca

SEQ ID NO: 281223 - RNA, 64 nt, Human
uuucuuaaagggccaauucaaagccaagucguggggugcagauuguuauggugacaggcacaca

SEQ ID NO: 281224 - RNA, 64 nt, Human
gccaguuuuguaaucacugacuuaugugcaaacuggugcagaaauucuauaaacucuuugcugu

SEQ ID NO: 281225 - RNA, 64 nt, Human
cugugagcuuggugguuauuuguacauaaucggaggugcagaaucuuggaauugucugaacaca

SEQ ID NO: 281226 - RNA, 64 nt, Human
accugcucugggccugacucaaagcaaacacgugggugcagaagacccaugggaggaggaggug

SEQ ID NO: 281227 - RNA, 64 nt, Human
uauuaacucgcucuguguuguugcaaaacuuuuuggugcagauucguuuccaaaacuauugcua

SEQ ID NO: 281228 - RNA, 64 nt, Human
cugaaagguuacaaggaguguuguagcuucugaaggugcagaaaacaauuucuaaaaaugcuuu

SEQ ID NO: 281229 - RNA, 64 nt, Human
agguucuuugccagugcagguggcaugaacugcauggaggcauaacagucagggggaguggaag

SEQ ID NO: 281230 - RNA, 64 nt, Human
aacacccugggugaggccuggggguuuccgaaaauggaggcauuccuuuccaaaucuggacagc

SEQ ID NO: 281231 - RNA, 64 nt, Human
gcuacuugguauacggagauguuaauuugggauauggaggcauuuuuaucuucugucacuacua

SEQ ID NO: 281232 - RNA, 64 nt, Human
gcucaggccaggugugaauccugagguccauggaggugcagagaugagauuacuccuauucacg

SEQ ID NO: 281233 - RNA, 64 nt, Human
uguggacugguucagggaaggaggggaaaagggaggugcagagagcucuaagccagugugcuua

SEQ ID NO: 281234 - RNA, 64 nt, Human
gaaaggcgcccgcugcucgcucuuucucucggagggugcagagcuggguuccuugggaggaagu

SEQ ID NO: 281235 - RNA, 64 nt, Human
agggcugaggucugaugggaaggacuugacuccaggugcagagaugcacaggcucaagagagua

SEQ ID NO: 281236 - RNA, 64 nt, Human
ccaaaacacacacacacauuuacaauggacugcuggugcagaagaauaaacaacuuuaaaaaua

SEQ ID NO: 281237 - RNA, 64 nt, Human
acugcaguuggacuuugccgaugcugcaagaaggggugcagagaagacuccuguguuggagaca

SEQ ID NO: 281238 - RNA, 64 nt, Human
aauaauaaaugcaauuauaaacuauauggaggagggugcagaggagggaaugugucuggugugu

SEQ ID NO: 281239 - RNA, 64 nt, Human
acaucuaaauuccauuucuucuucuuguuuaaauggugcagagagaaagguugcccagacaucc

SEQ ID NO: 281240 - RNA, 64 nt, Human
gaauacacaaguccaagucuacuguguugcuaggggugcagaacccguuucuuuguaugagaga

SEQ ID NO: 281241 - RNA, 64 nt, Human
aaaaggugaccuaguguacugggcagcugguggcggugcagaaaagagucucagguuauuuuuu

SEQ ID NO: 281242 - RNA, 64 nt, Human
ggaacuugacacaguguugcauuaauaacuuuagggugcagacaugcugugugaaucucacaau

SEQ ID NO: 281243 - RNA, 64 nt, Human
cuuugauuagacaagccugggaagagaauguugaggugcagagcucaccagccaaguucaugcc

SEQ ID NO: 281244 - RNA, 64 nt, Human
ucuugaugccaguacuggauuccagcauucagcaggugcagaucucggcuuuacacaauuuauc

SEQ ID NO: 281245 - RNA, 64 nt, Human
guccacucagaguucugaagggggccagauguugggugcagauguagaagcagccagucacaga

SEQ ID NO: 281246 - RNA, 64 nt, Human
augcuguuacugacggggcagggugucaugcaugggugcagaggauggaggcugagaaagguag

SEQ ID NO: 281247 - RNA, 64 nt, Human
ucucugcucccgccagccuuguuuucagguggucuggaggcagcuccacguccacacaguggcc

SEQ ID NO: 281248 - RNA, 64 nt, Human
auauuucaaaugaacacgugcaccccaucaucacuggaggcaaauuucagcauagaucuguagg

SEQ ID NO: 281249 - RNA, 64 nt, Human
aagucuugauguaagugggaauuagauaacuaauuggaggcauuuuauuuuaaguuaaagacag

SEQ ID NO: 281250 - RNA, 64 nt, Human
aaagaaaaaugcauccuaaccauuccauccuguuggugcagagaaauuuuggugauuuauuaga

SEQ ID NO: 281251 - RNA, 64 nt, Human
gcaauuuuaacuuaaaaugugcaucaugauggaaggugcagacuuuuuuggaaguuuccgagag

SEQ ID NO: 281252 - RNA, 64 nt, Human
ucuggugauuuuagcagcugugauguugguaccuggugcagaccaggccaaaguucuggaaagc

SEQ ID NO: 281253 - RNA, 64 nt, Human
gugaccacgcacaaaggcagucacugccucgaggggugcagaccgcagaauuuucacagcaggg

SEQ ID NO: 281254 - RNA, 64 nt, Human
acucuggaccuaagucuaguguauccauacaauuggugcagagaaauaagguguaaauggugcu

SEQ ID NO: 281255 - RNA, 64 nt, Human
aucagcaccaguguccgucaggaaggcaggugguggugcagaaacaugaugccuggcugauuuu

SEQ ID NO: 281256 - RNA, 64 nt, Human
uuuucaccauuggcagaaacagugagagcuguguggugcagaaauccagaaaugagguguaggg

SEQ ID NO: 281257 - RNA, 64 nt, Human
aagaaaaugauccacaccacucccccgauucccgggugcagaauuguaacucgggguugggccu

SEQ ID NO: 281258 - RNA, 64 nt, Human
uccuagaaauauaucuguaacaaugauuuaagguggugcagaugguguuuguucuauauuauaa

SEQ ID NO: 281259 - RNA, 64 nt, Human
cagccuauaacuguauguguguuccuugaagccaggugcagaguucccagcuacugcagcuugg

SEQ ID NO: 281260 - RNA, 64 nt, Human
gaaggccucucacuguacucuaguccugacuuggggugcagagggcugcuugcaauccuguuug

SEQ ID NO: 281261 - RNA, 59 nt, Human
cccucuggaaagcacacugaugggguggaggugcagagcuuuccaguauagcccuguuu

SEQ ID NO: 281262 - RNA, 64 nt, Human
cuuguaguccuacaccuugcccugccugggcuuuggugcagacuagguguggauuugagcucug

SEQ ID NO: 281263 - RNA, 64 nt, Human
aguuugucagcccacuccucaggacacuuccucaggugcagacccuuggacuuguaauaauaau

SEQ ID NO: 281264 - RNA, 64 nt, Human
aaauggaaugacuugucugccucacauauucuaaggugcagagucagaauaugaacuguuggua

SEQ ID NO: 281265 - RNA, 64 nt, Human
cuuaucuagaaacaugugaagaugcccaagagccuggaggcacugcuguccuuccugcagaaac

SEQ ID NO: 281266 - RNA, 64 nt, Human
aaagaaauguacuguuuuaagauacuguaaaauguggaggcagggcaaacguuuauaagggcug

SEQ ID NO: 281267 - RNA, 64 nt, Human
cgucccugggggcugggccccaggcgcacggggcuggaggcaggccuucgugccuucgugccuu

SEQ ID NO: 281268 - RNA, 64 nt, Human
ggcuccaugugcaucugugagcaugcgugugacaggugcagagacgggggacuggagggagacu

SEQ ID NO: 281269 - RNA, 64 nt, Human
cccugagaagcugcuccaggccugcagcaggaguggugcagacagaagucuccucaauuuuugu

SEQ ID NO: 281270 - RNA, 64 nt, Human
ucgcgccucgaucucugagagcccaccgcaugccggugcagacggaugcgaggaugcagggacg

SEQ ID NO: 281271 - RNA, 64 nt, Human
ugggcacacacuuccggacacacaugcacacacaggugcagauaugcugccuggacacacgcag

SEQ ID NO: 281272 - RNA, 64 nt, Human
gcgugugccugugugcgugcgcaucuugccuccaggugcagagguacccuggguguccccgcug

SEQ ID NO: 281273 - RNA, 64 nt, Human
uuuaugucaucauacaugacucagcauaccugcuggugcagagcugaagauuuuggaggguccu

SEQ ID NO: 281274 - RNA, 64 nt, Human
cugucuagaguagcuuaccagaagcuuccauaguggugcagaggaaguggaaggcaucaguccc

SEQ ID NO: 281275 - RNA, 64 nt, Human
auaauuauguuaauaugguccucauuuuucuuuuggugcagaaccguugugcaguggggucuac

SEQ ID NO: 281276 - RNA, 64 nt, Human
agcuccucucauuucagcaaauauccauuuucaaggugcagaacaaggagugaaagaaaauaua

SEQ ID NO: 281277 - RNA, 64 nt, Human
uagcacccagaagggaccaaaagcagggcauggcggugcagaggaguuugggagguguaaacag

SEQ ID NO: 281278 - RNA, 64 nt, Human
uuuccccaguagagaagggugcgagaaacaucagggugcagaauugauaccagacagaaggugu

SEQ ID NO: 281279 - RNA, 64 nt, Human
ccucagacaugccacucuguggcucccaauauagggugcagacaagagcaaucccugacaugac

SEQ ID NO: 281280 - RNA, 64 nt, Human
agcacaacgaguuuauaugagaaagcacugagggggugcagagggcccgcuaguuccaggggaa

SEQ ID NO: 281281 - RNA, 64 nt, Human
accaagcuccagucaguugaugggcagcuagaggggugcagaaagccugugggcccaggagaug

SEQ ID NO: 281282 - RNA, 64 nt, Human
ugacaaguaccuucugccuccuccauucuuccugggugcagaacuguagaagacccugaggacu

SEQ ID NO: 281283 - RNA, 64 nt, Human
acuauacagaaaccaaaaccagaaugccaugugguggaggcaaagggcagaauuucugaccccu

SEQ ID NO: 281284 - RNA, 64 nt, Human
ucucuggacuguugcauguacagugccuccauccuggaggcaagagaguugggaguggcucgaa

SEQ ID NO: 281285 - RNA, 64 nt, Human
uuuauuugacccaacaacacaguaucccaggauauggaggcaaggggaacaaagagcaugaguc

SEQ ID NO: 281286 - RNA, 64 nt, Human
acuccugggcuagugugagcagcuauucugcaugggugcagauggcuggaugugaaagagacau

SEQ ID NO: 281287 - RNA, 64 nt, Human
guuaguguggucuguucuuuaccucccuuuauuuggugcagagaaguuagauccugcuaaauuu

SEQ ID NO: 281288 - RNA, 64 nt, Human
cuugguacugugggucccucaaagaggagaguggggugcagaaaugccucagcauggcucaugc

SEQ ID NO: 281289 - RNA, 64 nt, Human
guuaaagcugucugagucuaaagcaccguaucuuggugcagaacagauaauuauacagagaugg

SEQ ID NO: 281290 - RNA, 64 nt, Human
cuaggcaagcaggaccuggcaucaugguggauauggugcagagaagcuggacuucugugggccc

SEQ ID NO: 281291 - RNA, 64 nt, Human
ugaguggguggugggagccuggagcaagguggagggugcagaggggcugggguagggcauguag

SEQ ID NO: 281292 - RNA, 64 nt, Human
ccaggagcagugaguugugaguggaaagaaggcuggugcagacccagcugccuuagacagauuc

SEQ ID NO: 281293 - RNA, 64 nt, Human
uaugcguggguguauguuugggaagaaaaacaaaggugcagacuaucuuccuuuuuuucuucuu

SEQ ID NO: 281294 - RNA, 64 nt, Human
ucuuauuuuccccuuauacagauaaggaaacuggggugcagaaaagugaauugacuacaaagua

SEQ ID NO: 281295 - RNA, 64 nt, Human
ccuuauuguccccuuauacagauaaggaaacuggggugcagaaaggugaauuaacuuuacaaag

SEQ ID NO: 281296 - RNA, 64 nt, Human
agguugucuaaccuggggucaaguuugggugacuggugcagaguuacuuccuaaaaggccacuc

SEQ ID NO: 281297 - RNA, 64 nt, Human
uuucaacauucuuuauggccagcagcccuugguuggugcagauggugauaggaccagugggucc

SEQ ID NO: 281298 - RNA, 64 nt, Human
gguguugccauuucucugcuuacccuucaccuuuggugcagagguuucuugaauaucugcccca

SEQ ID NO: 281299 - RNA, 64 nt, Human
aaacccaggcucugugcuccuuccagcccuugcuggugcagaugcuaccccacaagcuugucag

SEQ ID NO: 281300 - RNA, 64 nt, Human
ugugggcaggggaugugcuccccugcaccucuggggugcagaaaccucuugccuccagauuugg

SEQ ID NO: 281301 - RNA, 64 nt, Human
aggcagggugguguaccugcuggcacuauccagauggaggcaccaaacacccacauaccuggcc

SEQ ID NO: 281302 - RNA, 64 nt, Human
cccuaugucccaccuuaacccgcaagcgccuggguggaggcaggguagggcaggggccuggaga

SEQ ID NO: 281303 - RNA, 64 nt, Human
gcuccagcagccccaaccacagcauucccuaacauggaggcaaaauaccacauggcuucucccg

SEQ ID NO: 281304 - RNA, 64 nt, Human
aggagagccccgagccggccccggggcaaagaggggugcagagggaguucccccagaucaguac

SEQ ID NO: 281305 - RNA, 64 nt, Human
aagccacaggcugguggccauguucucugaauugggugcagaagacaagggcagaguggcugcg

SEQ ID NO: 281306 - RNA, 64 nt, Human
aucaggagauuuucguccauuuaaaaaauguauaggugcagauauugaaacuaggugggcacuu

SEQ ID NO: 281307 - RNA, 64 nt, Human
cuaaguccaucauuagguuaagcgauuuacugaaggugcagauaucaugcuuauuucauugggu

SEQ ID NO: 281308 - RNA, 64 nt, Human
cccgcccuccggcuacaauccccgcagagucuccggugcagacgcgcugcggggauggggagcg

SEQ ID NO: 281309 - RNA, 64 nt, Human
gggggauggggggaugcugcuggaggucucagugggugcagacagcccugccuugaggauggcu

SEQ ID NO: 281310 - RNA, 64 nt, Human
cagagaaagcagucaauaaauguuugccagacugggugcagaauuuauucagguggguguacuc

SEQ ID NO: 281311 - RNA, 64 nt, Human
uggcgccaccuguugggugcucacugccucugcaggugcagaggggucagcagcaggagaagcg

SEQ ID NO: 281312 - RNA, 64 nt, Human
gucuuugagaagacgguagcuucugcaguuaggaggugcagacacuugcucuccuauguaguuc

SEQ ID NO: 281313 - RNA, 64 nt, Human
gucagcccuuggugguggccagggagaggcgcccggugcagauggccccgggcggcccaggucc

SEQ ID NO: 281314 - RNA, 64 nt, Human
uggugcuguccuugacccacgagcuguugagaagggugcagagccccuggcacagccaacccug

SEQ ID NO: 281315 - RNA, 64 nt, Human
uccuauuaaauccauaugaagccagauaugauugggugcagaugugguguuccucauauuaugg

SEQ ID NO: 281316 - RNA, 64 nt, Human
uagcugcguucaaggcggggcccucgggagcccaggugcagagcgaggccguguccaggagccg

SEQ ID NO: 281317 - RNA, 64 nt, Human
ugacguucauugcacagaaguccuucuggcugcaggugcagacccaaacuuagauccccucaac

SEQ ID NO: 281318 - RNA, 64 nt, Human
gaacuguguggcaagagagccucacaccucacuaggugcagagagcccaggccuuauguuaaaa

SEQ ID NO: 281319 - RNA, 64 nt, Human
uuagugcuuuuuguuuucuaaccucauggggugguggaggcagccuucagugagcauggagggg

SEQ ID NO: 281320 - RNA, 64 nt, Human
aaaagucuccauuuucauuuuacauccucucuauuggaggcagcacuuuucccucaugcugucc

SEQ ID NO: 281321 - RNA, 64 nt, Human
cagcuccccggcacugcagucugcagaguucuccuggaggcaggggcugcugccuuguuucacc

SEQ ID NO: 281322 - RNA, 64 nt, Human
gccauugaguggaagcugccccaggcccuuaccaggugcagaugcccaaucuugaugcccagcc

SEQ ID NO: 281323 - RNA, 64 nt, Human
ugccuuauagugcuuaaacauucuccgccuccagggugcagauucagagcuggccagaguuuca

SEQ ID NO: 281324 - RNA, 64 nt, Human
gcccucccuacgaggagggaagaacaggcccuggggugcagaggcccggcacguagagaaccca

SEQ ID NO: 281325 - RNA, 64 nt, Human
gaugagcugcagguuuuuugaacucacuucuggaggugcagagccacaaacgcacuuucggggc

SEQ ID NO: 281326 - RNA, 64 nt, Human
aagggcgcccagggaucuugccuggggaaaguggggugcagaaggcaugacccacgccacagcg

SEQ ID NO: 281327 - RNA, 64 nt, Human
uuccuacugcgccucgugcuggcggacgcagcugggugcagaagcuguggggucggagaggcgu

SEQ ID NO: 281328 - RNA, 64 nt, Human
cugccacauccccagugaaaucagcauguuucucggugcagaucugaaaucacauccagcuccu

SEQ ID NO: 281329 - RNA, 64 nt, Human
aucauuuuuauuguggcuugagcucagucaaucuggugcagaugaggcuggacaacuacuaacc

SEQ ID NO: 281330 - RNA, 64 nt, Human
uuucaucauagaggucuguuuugugaggguuuggggugcagaaaacuuugauuaaaucuuaaug

SEQ ID NO: 281331 - RNA, 64 nt, Human
ccgggcagucuuggugugagaagcuguuuccaagggugcagaugagccuuagguuccagccgcc

SEQ ID NO: 281332 - RNA, 64 nt, Human
ugaaugucuagugagacauucaaaauucguauagggugcagaguaauuucuuauugugaggaac

SEQ ID NO: 281333 - RNA, 64 nt, Human
agccuguaauccucagcugacacauaauuugaauggugcagaaaaaaaaaaagaaaccguaauu

SEQ ID NO: 281334 - RNA, 64 nt, Human
ucuaugguccccugaaauuuugacuuaguauauaggugcagagacacccacuuagaaaguuaac

SEQ ID NO: 281335 - RNA, 64 nt, Human
uaaacucuggugauccaaacaaaauggcuucaguggugcagaugucaccuacauguuauucuag

SEQ ID NO: 281336 - RNA, 64 nt, Human
augcauaucuucuccaaccaugaaaucaaagcacggugcagaacuuguaccaaguacaaaaggu

SEQ ID NO: 281337 - RNA, 64 nt, Human
uugagagaauaaaaacuuccuucaaucuucauuuuggaggcagggcugggaagggagcgcucuc

SEQ ID NO: 281338 - RNA, 64 nt, Human
agucaaauguauuuucugcugaaaucugcauauuuggaggcauuucccaccaccgauucacagc

SEQ ID NO: 281339 - RNA, 64 nt, Human
acggacaaguggaggccucuugcugcggcugcaauggaggcaaggggcugcagagcccaggugc

SEQ ID NO: 281340 - RNA, 64 nt, Human
cagucacagaggagcugggugcccaguacccuugggugcagaucuuugaaaacaaaggugccau

SEQ ID NO: 281341 - RNA, 64 nt, Human
acaguggcucacacacuuugggaggccaagcgggggugcagaucaccugaggucaggaguuuga

SEQ ID NO: 281342 - RNA, 64 nt, Human
accugugugcacugggggagggaugguuugggcaggugcagauccaagggcugugguaaacggg

SEQ ID NO: 281343 - RNA, 64 nt, Human
acuugaaguauacucaguuaaaaucggggcuggaggugcagacggugucugaccggaggaugug

SEQ ID NO: 281344 - RNA, 64 nt, Human
uuuuucugauuguuuccuuuauagagugucucagggugcagaggucagacuaagaaauauucca

SEQ ID NO: 281345 - RNA, 64 nt, Human
ucacugcuugagggagaauccucccuucccaggaggugcagacuucuuaaaaggagcucgcggg

SEQ ID NO: 281346 - RNA, 64 nt, Human
cuuacaacagagaugggagcugagugcuagaguaggugcagaagugguaggucagcuacaaauu

SEQ ID NO: 281347 - RNA, 64 nt, Human
ugaaagugagaaagcccuuuucacacuguggagcggugcagaugugggaaaccucaaagauggu

SEQ ID NO: 281348 - RNA, 64 nt, Human
gcaagcauagaccccugucuaacggggguagacaggugcagaugaggugaagaucacugucauc

SEQ ID NO: 281349 - RNA, 64 nt, Human
acgccuuagagcagagcagccccuccucucauuuggugcagaaacagucaagaggaaccauugg

SEQ ID NO: 281350 - RNA, 64 nt, Human
uucuguauuuuuacucuucuagaugugaaaagagggugcagaguccaggccagauagucuuccc

SEQ ID NO: 281351 - RNA, 64 nt, Human
aggaaagaauaugcuuauuacaaagacaaaauguggugcagaaacuaucuugcaccugugugca

SEQ ID NO: 281352 - RNA, 64 nt, Human
agauggcaagggcagugcguggaaaggccggggaggugcagaaaccagagcccagggcaauggu

SEQ ID NO: 281353 - RNA, 64 nt, Human
gagugcucugggagccaggccagggugugagggaggugcagaggcauccggggcgggagcaagc

SEQ ID NO: 281354 - RNA, 64 nt, Human
cuucagcucacgcuucacagugaucgaugauucaggugcagaggaaguacaaacuaaggugcua

SEQ ID NO: 281355 - RNA, 64 nt, Human
guuugagacagcuccguguggagagcuuagccccuggaggcagcacaaggaggaugugauaugu

SEQ ID NO: 281356 - RNA, 64 nt, Human
caccaccaaggggcccucuggaacuugagaccacuggaggcacaccugcuauaccucaugccuu

SEQ ID NO: 281357 - RNA, 64 nt, Human
gggaagccacccaggucucauuccucccugcuguuggaggcaacaucuccucuuuuuacagagg

SEQ ID NO: 281358 - RNA, 64 nt, Human
cucuugggaaucagcuaguuuucaaucuuauuagggugcagaaggaaaacuaauaagaaaaccu

SEQ ID NO: 281359 - RNA, 64 nt, Human
ccggggaggacucccgcguugauggaccguucuuggugcagacuccugacugcgugcaugaaac

SEQ ID NO: 281360 - RNA, 64 nt, Human
ccagcuccaugcauggcuggacuggugauuccagggugcagaagggauucauauucccagaacg

SEQ ID NO: 281361 - RNA, 64 nt, Human
gaagagguuacagugacaugcccucgaaagauuuggugcagaccaacugucgcggcuguuaccu

SEQ ID NO: 281362 - RNA, 64 nt, Human
uuagcucucucagauucuuccccaaaugaggcagggugcagacagcacagucagcucugcagag

SEQ ID NO: 281363 - RNA, 64 nt, Human
agccuugcucaggugcaagugccccagggggcggggugcagaagaauccgaguguuugccaggc

SEQ ID NO: 281364 - RNA, 64 nt, Human
gaacuugguaacugcaagggccucagguggggcaggugcagagggcaagcauuccacacuccgc

SEQ ID NO: 281365 - RNA, 64 nt, Human
gcucaggacauggaggugccggaugcaggaaggaggugcagacggaaggaggaggaaggaagga

SEQ ID NO: 281366 - RNA, 64 nt, Human
gccaccaaccucguccacacccggggggcccccgggugcagaaaacagcaccucccaccaacca

SEQ ID NO: 281367 - RNA, 64 nt, Human
gcugcuccucuccacugcccagcaccaugaguugggugcagacaccuagaaggagagacuucuu

SEQ ID NO: 281368 - RNA, 53 nt, Human
ccugcagaaccagcgugugauggggugcagaccccccucauggaguauggggc

SEQ ID NO: 281369 - RNA, 64 nt, Human
gucaugcucgagggagugugaagugguucagguuggugcagaggcgcucauggccuccugcuuc

SEQ ID NO: 281370 - RNA, 64 nt, Human
uccacugggaguggaggaagagcucagaggcccaggugcagauaguucugcaauuuagucugua

SEQ ID NO: 281371 - RNA, 64 nt, Human
ugaggcugaggccauggcaggacagcugcuguggggugcagaggcagaagaugaaggacaaaag

SEQ ID NO: 281372 - RNA, 64 nt, Human
ugaggaccaauaucuguucguguugaggagaugaggugcagacuccacacuggggucuuagagg

SEQ ID NO: 281373 - RNA, 64 nt, Human
uuuaauauuauuacuguugauaauucuuauuuuguggaggcagugucauuugcucugccuaauu

SEQ ID NO: 281374 - RNA, 64 nt, Human
ugcagaagcaccugcuccggcauccagcgcugccuggaggcaggaaggagaggcagggcaggac

SEQ ID NO: 281375 - RNA, 64 nt, Human
uguccacugugucacucuccaagugccagagaaguggaggcagaucgcuaccccaggcugagau

SEQ ID NO: 281376 - RNA, 64 nt, Human
aacagggucaagggugcagaggccaggcagagugggugcagagugggggaugggcaaccagccu

SEQ ID NO: 281377 - RNA, 64 nt, Human
cagcagggaagaggggcaauacaacagggucaagggugcagaggccaggcagagugggugcaga

SEQ ID NO: 281378 - RNA, 64 nt, Human
ggccagucuugugcuccuggacaugcgguacugaggugcagacaagggucuccacuguggugac

SEQ ID NO: 281379 - RNA, 64 nt, Human
gaucugcucugugccgguccucugggcaguguggggugcagaauggggugccuaggccugagcg

SEQ ID NO: 281380 - RNA, 64 nt, Human
uauuaguggacagcacuuaguagcugugaaggaaggugcagagucagaagaugaagaagaggag

SEQ ID NO: 281381 - RNA, 64 nt, Human
gugcacagcaccgcagcuagugggccuggcugggggugcagaagggcaggguaguucuuuccau

SEQ ID NO: 281382 - RNA, 64 nt, Human
guccuccuaagucccuuccuauucuccugccaugggugcagacccugaacccacaccugggcau

SEQ ID NO: 281383 - RNA, 64 nt, Human
agugcaaccccguuggugcucugcaggagcugguggugcagaaaggcuggcgguugccggagua

SEQ ID NO: 281384 - RNA, 64 nt, Human
uaccauaaccgaacccacggaaagacgcugcgcgggugcagaagaguauuuaauguuaaggaaa

SEQ ID NO: 281385 - RNA, 64 nt, Human
gcagcaggcaacaacugccccuucuuuaugcagaggugcagaaccagggacuccugggcccauc

SEQ ID NO: 281386 - RNA, 64 nt, Human
cuccucuugucuugcagguggccugugcgggacuggugcagaaacuacucgucucccuuuucac

SEQ ID NO: 281387 - RNA, 64 nt, Human
gcccauuggaucugugaaagccucuagcuucacuggugcagaaaauuuuccucuagaucagaau

SEQ ID NO: 281388 - RNA, 64 nt, Human
gugucccaaagaugaagauacuauaaccucaaauggugcagauccagaacugggcuggaugaca

SEQ ID NO: 281389 - RNA, 64 nt, Human
gaggggggagacaacccccuacuuccucccuuggggugcagaggcacggggagagggaggauga

SEQ ID NO: 281390 - RNA, 64 nt, Human
auagaugcagguccauucugcaccucuuggcucgggugcagaguucacccugugcccuccguua

SEQ ID NO: 281391 - RNA, 64 nt, Human
agccuuggaagagaaaaguagaauucaguauguauggaggcacaguuuugcacaguauguugca

SEQ ID NO: 281392 - RNA, 64 nt, Human
ccacaaacugaguccccucaccugaacucugggcuggaggcagggagacacugcccugcuuccu

SEQ ID NO: 281393 - RNA, 64 nt, Human
uuguugcucacugugcugcuuuuccaugagcucuuggaggcaccaagaaauaaacucguaaccc

SEQ ID NO: 281394 - RNA, 64 nt, Human
aggauuugucaagaugguuagcucuuuguuuuggggugcagagaaagaaaagagcagcaacagc

SEQ ID NO: 281395 - RNA, 64 nt, Human
uucucccuucccuccucuugcuccucaaguaagaggugcagagaugagguccuucuggacuaaa

SEQ ID NO: 281396 - RNA, 64 nt, Human
gauggcccucuugagccuugggcagggugggugaggugcagaugaccaggagugugugaaugcc

SEQ ID NO: 281397 - RNA, 64 nt, Human
aaggagugaaaaaccuauuacuacuaagagaaggggugcagaguguuuaccuggugcucucaac

SEQ ID NO: 281398 - RNA, 64 nt, Human
ggagaacuguccuguaggauauucucuuccugauggugcagaacccagaauuagaaguuugugg

SEQ ID NO: 281399 - RNA, 64 nt, Human
gaagcuccagcaucugugccccuugaauugcuuaggugcagacaguucuaaagcaaggagcugc

SEQ ID NO: 281400 - RNA, 64 nt, Human
auugaaaaguguucugugcgucuguuuugugucuggugcagaauaugacaaucuaccaacuguc

SEQ ID NO: 281401 - RNA, 64 nt, Human
aauuuuuacuuuuuugauuuuuguaauaaaaauuggugcagauaaaaugucaaaugaacaaacc

SEQ ID NO: 281402 - RNA, 64 nt, Human
aagaaacucugaguuugagguacaggggcuucggggugcagacgucccuccagggcccaugguc

SEQ ID NO: 281403 - RNA, 64 nt, Human
auuccuggcugaggggucaguuuuauggcugggaggugcagaauuacacagaagucccagucug

SEQ ID NO: 281404 - RNA, 64 nt, Human
ugaacauacuucaucgcaguggacugugucccucggugcagaaacuaccagauuugagggacga

SEQ ID NO: 281405 - RNA, 64 nt, Human
ccuucuaggcagugcaucagucagcucuaaaucuggugcagaggguuaacagcauaacccuugu

SEQ ID NO: 281406 - RNA, 64 nt, Human
ccaggggcuuguugagagcugagccaugcacacaggugcagacaccccccaacucccaugcaca

SEQ ID NO: 281407 - RNA, 64 nt, Human
agauacauccagaaaguccuggccaugaauuggaggugcagaguccugcagagccucugggcug

SEQ ID NO: 281408 - RNA, 64 nt, Human
cugcuauuaugccuucuuuagaucuuucuucuguggugcagacauuucuaguaaguguuugacu

SEQ ID NO: 281409 - RNA, 64 nt, Human
uugggaggcugaggcaggagaauugcuugaacccuggaggcagaaguugcagugagccgagauc

SEQ ID NO: 281410 - RNA, 64 nt, Human
uucaucuucucuauaauaaugacaucccaguucauggaggcaaaaaacaaguuucuuguuaucc

SEQ ID NO: 281411 - RNA, 64 nt, Human
ggggccuccauucauaaccaaaguuguaggggcauggaggcaguggcgccuuauggauagguca

SEQ ID NO: 281412 - RNA, 64 nt, Human
gagccacagcaaggagcucagccagccgugguggggugcagaguuggcaggagugggagaagga

SEQ ID NO: 281413 - RNA, 64 nt, Human
ugcugcagcagcuggacugagggcagagccuguaggugcagaggcccuggcucccgagguccag

SEQ ID NO: 281414 - RNA, 64 nt, Human
aacugcagcagcuggacugagggcagagucugugggugcagagacccugcauguaggucacagg

SEQ ID NO: 281415 - RNA, 64 nt, Human
cuuaccccugauguaggaggggcacacagcugggggugcagagcccaccuggguaccugacccc

SEQ ID NO: 281416 - RNA, 64 nt, Human
acauggguaggucaguucuuugguccaagccucuggugcagauucaagcuccuccucuuagagg

SEQ ID NO: 281417 - RNA, 64 nt, Human
cacacguggucuuucuuacaaggaagguggugggggugcagaugagguugcuagagaauguuag

SEQ ID NO: 281418 - RNA, 64 nt, Human
agcaaaauaagaccccuaucuagugagggagacaggugcagaugaggugaagaucacugucauc

SEQ ID NO: 281419 - RNA, 64 nt, Human
gagaccagaaaggugaccaagacagauuuuuuaaggugcagaaacugcaggggggccucaguga

SEQ ID NO: 281420 - RNA, 64 nt, Human
ggcuuccccaugugugggcugggaccgcccacggggugcagaucuccuggcguguccaccaugg

SEQ ID NO: 281421 - RNA, 64 nt, Human
cuaucuguagacuuaggaauacuugaugggcagcggugcagaccccgggcaccugcgugcagcc

SEQ ID NO: 281422 - RNA, 64 nt, Human
cauucuucagguaaugggggcucauugugagggaggugcagaggcagcagaggauuggcauaaa

SEQ ID NO: 281423 - RNA, 64 nt, Human
cccauggagggagccgggcccuugcugcucaggaggugcagacugccccgugcucugggccuug

SEQ ID NO: 281424 - RNA, 64 nt, Human
guggugguggcaaggacugaguccaggccugugaggugcagagugcccagaacuggacucagga

SEQ ID NO: 281425 - RNA, 64 nt, Human
uacgcugcucuccugacagccacacgcgacccucggugcagagugcagaggcggcucugguucc

SEQ ID NO: 281426 - RNA, 64 nt, Human
aaggaaaucccguuuuuuucuagacagacacuuuggugcagaagcuucuuuucaauccauccuc

SEQ ID NO: 281427 - RNA, 64 nt, Human
uaauuucauuccaaacaucggggcuaacagagacuggaggcauuucuuuuuaggcucugagacu

SEQ ID NO: 281428 - RNA, 64 nt, Human
uauacauuuucuuuuacuuuccuuuuuuccuuucuggaggcaucacaugcuggugcugugucuu

SEQ ID NO: 281429 - RNA, 64 nt, Human
acuuugaccuuuuuuguuccuguuccugaagugcuggaggcaguuauggaaggagcugcuuagg

SEQ ID NO: 281430 - RNA, 64 nt, Human
aggaccugggcagagcaggcaugagcugggcuguggugcagagcaagcagacccagccacacug

SEQ ID NO: 281431 - RNA, 64 nt, Human
ugggggggucgaccucuugcaggaggguggguguggugcagagagaggcaguccccaugauagg

SEQ ID NO: 281432 - RNA, 64 nt, Human
gggaugcccaggccgcagaggaagcugggcacugggugcagaacaagggcaaggacaggcucug

SEQ ID NO: 281433 - RNA, 64 nt, Human
caaggggaccccggccuaggaggcaggaagccaaggugcagagagcagccuggcccucaccagu

SEQ ID NO: 281434 - RNA, 64 nt, Human
guuauugaaacagauuuauuagaaggagaggguaggugcagagcuggagagccaugggugaggc

SEQ ID NO: 281435 - RNA, 64 nt, Human
uguagcaggcgcuaggcccgggaggagagugcauggugcagagggggcuggggcgcacggagaa

SEQ ID NO: 281436 - RNA, 64 nt, Human
ucggucguguuuuuaacacagagucucuagaagaggugcagacaucccgucugacugucccugu

SEQ ID NO: 281437 - RNA, 64 nt, Human
guucugauuuuguuugugggugucgggauauuugggugcagaggguuugugcccaguuagaagc

SEQ ID NO: 281438 - RNA, 64 nt, Human
ccuucuguccaucguggguaacagccuuggggagggugcagagcucugcagagccaugggccag

SEQ ID NO: 281439 - RNA, 64 nt, Human
cauaugccuccagcucaguugacgcuuaaaaacaggugcagaaaagcucgcgauggaaggucuu

SEQ ID NO: 281440 - RNA, 64 nt, Human
uugaaggugacggaaauaccuaaaaacuccuaaaggugcagagcacaccuuccaaaucucucaa

SEQ ID NO: 281441 - RNA, 64 nt, Human
uuugcgcucccuuuucucaucauugggguuagcgggugcagacaaauucagcaauaguaugcag

SEQ ID NO: 281442 - RNA, 64 nt, Human
gggggaaaggcaguucuggugcuguagaggcccuggugcagaaagugggacgucuuuuuuccua

SEQ ID NO: 281443 - RNA, 64 nt, Human
cccuggagccccacuuauugaggccagcagaauaggugcagagaugaagugagcuuagagaugu

SEQ ID NO: 281444 - RNA, 64 nt, Human
gaauuuauuucuuuguauaguauacuauguucauggugcagauacuacaacauuguggcauuuu

SEQ ID NO: 281445 - RNA, 64 nt, Human
augcagcccagugcagccuugcagaggacaaggcuggaggcauuugucaucacuacagauaugc

SEQ ID NO: 281446 - RNA, 64 nt, Human
agacugggaggugaaauggggaaauggaaggguuuggaggcagagcugaaaacaggguuggaag

SEQ ID NO: 281447 - RNA, 64 nt, Human
uggaugugcccucucugaguucugugcugucucuuggaggcagggcccaggagaacaaagugug

SEQ ID NO: 281448 - RNA, 64 nt, Human
ugggcccugcccacaagcacacccucaggccgagggugcagacugaugcucuucccugauggag

SEQ ID NO: 281449 - RNA, 64 nt, Human
agucccagcugcuggcuuugaagaaagagcugauggugcagaagcagcaggaggcacuugagga

SEQ ID NO: 281450 - RNA, 64 nt, Human
agggcaccuggaggacagcuggaccgcguuggaaggugcagaggauaaggaggcacugcugauu

SEQ ID NO: 281451 - RNA, 64 nt, Human
ugccaccgucaacggcuucccaucggaggugguuggugcagauggaaguuucugucugcuggcc

SEQ ID NO: 281452 - RNA, 64 nt, Human
ggagcagcugggauucccgaccaaagccccagggggugcagaagacucaccacgcgggccagcc

SEQ ID NO: 281453 - RNA, 64 nt, Human
uucuugaaauaauaaauauuuuauugggaugugaggugcagaagaggaacugugcuggauucuc

SEQ ID NO: 281454 - RNA, 64 nt, Human
ugcugaugcgaccucggcugacagcugggccuguggugcagacaggagcuguguggacaguccc

SEQ ID NO: 281455 - RNA, 64 nt, Human
auuucccagaccccuccuguucccgccucagucaggugcagacaagugggcgguguccauuaaa

SEQ ID NO: 281456 - RNA, 64 nt, Human
ucagacuuagcccugagccugcacuuccuguucaggugcagacacugaacagggucucaaacac

SEQ ID NO: 281457 - RNA, 64 nt, Human
agcacagccugagccauuccugcaggggucccagggugcagagaccuccccacccccgguucug

SEQ ID NO: 281458 - RNA, 64 nt, Human
cuaccccgaacuccaaaaauuacaccuggagucaggugcagaagggaaccuuguauuucacagg

SEQ ID NO: 281459 - RNA, 64 nt, Human
aaaccccaaccucaguugaggccaggguggucagggugcagaauaaaugccaucgagccugugg

SEQ ID NO: 281460 - RNA, 64 nt, Human
ugaugagacuagccaaacaaucucgucaucuggaggugcagaucuuagcggaccaauauggcaa

SEQ ID NO: 281461 - RNA, 64 nt, Human
cgccguucugcaaugcaucacucccgcagaggggggugcagaucaggcgccgugcugcgcguug

SEQ ID NO: 281462 - RNA, 64 nt, Human
ggccacacugacugcccacccagcuguggcgggaggugcagagcagagggcuuuagggagcagu

SEQ ID NO: 281463 - RNA, 64 nt, Human
augugccugcccgccugagagccagcuuccgcguuggaggcacguguucagagagcugcugagc

SEQ ID NO: 281464 - RNA, 64 nt, Human
gacaauguggagcccccagaacuucagaacuguguggaggcacaugucugcucuccugaaaaga

SEQ ID NO: 281465 - RNA, 64 nt, Human
aagccugaggagucccagcuuagggagucacuauuggaggcagagaggcaugcaggcagggucc

SEQ ID NO: 281466 - RNA, 64 nt, Human
ccgucacucuugcuugugccuuccacaccuucucggugcagaucccuaugggggagcugccuca

SEQ ID NO: 281467 - RNA, 64 nt, Human
uccauccagcggcucuucuuuuuaggaaggcucuggugcagagcacuucaaauauguccucagg

SEQ ID NO: 281468 - RNA, 64 nt, Human
ggaagguugugguuguaaaugaguugucuaaaggggugcagaggccugagguuucuaaaagaag

SEQ ID NO: 281469 - RNA, 64 nt, Human
uauuuguucaauaaacuggcugagcuuagagagaggugcagaauuccugguucugagcaggugc

SEQ ID NO: 281470 - RNA, 64 nt, Human
uugggcucugcuggcggagauccccuuccuucugggugcagacugcaccuccggaugcaguuuu

SEQ ID NO: 281471 - RNA, 64 nt, Human
gaaaagaaaaacacgagaaacgccaucgcgggauggugcagacgcggcggggacucggagggug

SEQ ID NO: 281472 - RNA, 64 nt, Human
cgggaaggcagcgggcugcguacgaugggacccuggugcagacgccgggccggcugacauuugg

SEQ ID NO: 281473 - RNA, 64 nt, Human
aggauggccuucagggaagguggucuuggggcauggugcagagcaggugaccggagggaaucgg

SEQ ID NO: 281474 - RNA, 64 nt, Human
ugacacuaggcaccccccaggcgagagcuaguggggugcagagggccccaugccagacagcccu

SEQ ID NO: 281475 - RNA, 64 nt, Human
cacacaaagacgugggugaccauguuguuuguggggugcagagaugggagggguggggcccacc

SEQ ID NO: 281476 - RNA, 64 nt, Human
acuugcuuaguccugcaacguucuccacucucgaggugcagaagcauacaucuuuauaaaaaau

SEQ ID NO: 281477 - RNA, 64 nt, Human
agacgcagccccaggcagccggggcuccuaggcuggugcagauggugggguuaaacgggcugag

SEQ ID NO: 281478 - RNA, 64 nt, Human
gauuuguuugugauguuguuagccgccugugaggggugcagagagauaaucaccgcaccguuuc

SEQ ID NO: 281479 - RNA, 64 nt, Human
gauuuguuugugauguuguuagccgccugugaggggugcagagagaucaucacggcacgguuuc

SEQ ID NO: 281480 - RNA, 64 nt, Human
agccauaccugcgggacccuguggccuacccuaaggugcagaugcugauguacauguuuuaugu

SEQ ID NO: 281481 - RNA, 64 nt, Human
agggaucucucuacaagagccccugccccucuguuggaggcacaguuuuagaauaaggaggagg

SEQ ID NO: 281482 - RNA, 64 nt, Human
aagauacgcuuuccauuugaugauggaguugacauggaggcagugcuugcauugcuuuguucgc

SEQ ID NO: 281483 - RNA, 64 nt, Human
cacaugccaaauggaccaauguccauuugcuuauuggaggcaaagcuacaauagaagucagagc

SEQ ID NO: 281484 - RNA, 64 nt, Human
aagaggauaagguagagcucccaccugcugaacuggugcagagggacguggaugccucucccuc

SEQ ID NO: 281485 - RNA, 64 nt, Human
ccugagucugauucuuuagcagcagagacugaggggugcagagugugagcugggaaagguuugu

SEQ ID NO: 281486 - RNA, 64 nt, Human
agcaccgacuguggggguggaccuggccuugccgggugcagagguggaggcccggggagaggca

SEQ ID NO: 281487 - RNA, 64 nt, Human
cucuuucccgcaggggacucccagccucgcuggaggugcagaggccuggccucugucuguuugc

SEQ ID NO: 281488 - RNA, 64 nt, Human
cguugccuggaaaagccacagagcucccugcgggggugcagaacccugcaggcagccccaggcu

SEQ ID NO: 281489 - RNA, 64 nt, Human
ucugcuuuggagaaagacccagagaucaggcagaggugcagauucaaucauuacucauaaccuu

SEQ ID NO: 281490 - RNA, 64 nt, Human
gauggaagacauugucugcuugaacucugggcuuggugcagaguagguauuugguaaauguuga

SEQ ID NO: 281491 - RNA, 64 nt, Human
gcaggagagcuucccccaaggcugaugcauucccggugcagaacaggggcacccuccaaacacu

SEQ ID NO: 281492 - RNA, 64 nt, Human
guccuucauugcccacauggauagacggagcuguggugcagagaacuuuucccgcaacaggugc

SEQ ID NO: 281493 - RNA, 64 nt, Human
cuccuccaguugggaacaugcacccggagcuuggggugcagauccugaugggugccugccuccc

SEQ ID NO: 281494 - RNA, 64 nt, Human
ugcaggagccgccgggcgugagacgcggucccucggugcagacaccaggccgggcgcggcuggg

SEQ ID NO: 281495 - RNA, 64 nt, Human
gguguguucggcccagaggccccuggccugagcaggugcagaguuuuacagacacccggucagc

SEQ ID NO: 281496 - RNA, 64 nt, Human
cagagagcuggaaagguaagacugaggucagaaaggugcagagaugaaaagauuuugaaggacc

SEQ ID NO: 281497 - RNA, 64 nt, Human
cggaacucaagaggcagaaaaagaccaguuaggcggugcagacggucugggacguggcagacgg

SEQ ID NO: 281498 - RNA, 64 nt, Human
ugguggucguguagagguccuucuccuuucacauggugcagagagcgaggaccucuccuccucg

SEQ ID NO: 281499 - RNA, 64 nt, Human
uuauucacucuacuaaaaaauuauuuuaaaaggcuggaggcaagguggugacaggcagcagggu

SEQ ID NO: 281500 - RNA, 64 nt, Human
uccucagauagguucugcaguguuaccugucacuuggaggcagccaacacuucuggacauugca

SEQ ID NO: 281501 - RNA, 64 nt, Human
ccacccaguccauucacccucaccucucccugcauggaggcaacagcauuucaagauguaccuu

SEQ ID NO: 281502 - RNA, 64 nt, Human
ggaagugucugaccugggccugagagcuggagaaggugcagauucaaagugagcggcuccugag

SEQ ID NO: 281503 - RNA, 64 nt, Human
ugcagcccugguucugcagggaacaggugcugggggugcagaucccucccuccuugagccaggg

SEQ ID NO: 281504 - RNA, 64 nt, Human
ggccuugcuaccugggauuccagagaguugauggggugcagauagggguaggacuguuagaaua

SEQ ID NO: 281505 - RNA, 64 nt, Human
gggcagguggaggagagugaggggagagcugcccggugcagacccaggacgagggcugcacuug

SEQ ID NO: 281506 - RNA, 64 nt, Human
gaggggcuggggcacggucccagggccccaccuaggugcagagccggccccucaccuaacagcu

SEQ ID NO: 281507 - RNA, 64 nt, Human
ccauggccccacagccuccuucgaggcugugcugggugcagaaccgccagagccacccaaaagg

SEQ ID NO: 281508 - RNA, 64 nt, Human
ugaacauauguaauauuaauaguuauuauuuacuggugcagaugguugacauuuuucccuauuu

SEQ ID NO: 281509 - RNA, 64 nt, Human
aggaaauggguguguuuaguggggaaagggacggggugcagacggcagggccaguauggggccc

SEQ ID NO: 281510 - RNA, 64 nt, Human
uuucaucuggugaugccaaagccccauggauucaggugcagaagagggccaggacuaggucuuc

SEQ ID NO: 281511 - RNA, 64 nt, Human
gagguggguagggcaggggcagguugcuaagucaggugcagagguucugagggacccaggcucu

SEQ ID NO: 281512 - RNA, 64 nt, Human
ccugauucucugcucccaggagccagugacaugaggugcagaggcccacccagcccccuaccua

SEQ ID NO: 281513 - RNA, 64 nt, Human
ggacuugaaugauucggcuaccaccuguuccagaggugcagacaagagguggcgagagccccca

SEQ ID NO: 281514 - RNA, 64 nt, Human
ucccaccccccagggagcugccucccaggcagggggugcagaaaaugauugaugggcuggggaa

SEQ ID NO: 281515 - RNA, 64 nt, Human
ugcugggcugaccuggcugagcaggcaaaaggugggugcagacuggccuccccccagggaugga

SEQ ID NO: 281516 - RNA, 64 nt, Human
cccuguucucugcagugcuuucuaacagcuucugggugcagauuuucuucggcauccuuuugca

SEQ ID NO: 281517 - RNA, 64 nt, Human
aggggcugccggcuucuuucaggaggcugagguuuggaggcaaaaucaaccugggagaccaccc

SEQ ID NO: 281518 - RNA, 64 nt, Human
aaauucuggacucuuugauauaauaaaaugagacuggaggcauucugaaaugaaagaaacuccu

SEQ ID NO: 281519 - RNA, 64 nt, Human
agaaguaacacuuuuuaaacuuguuagaaaucccuggaggcauuucaaauucaucuucuaaccu

SEQ ID NO: 281520 - RNA, 64 nt, Human
augcugcuuuuuauucuccuaacccuuucaagugggugcagacuucucguuagcagcuggaaga

SEQ ID NO: 281521 - RNA, 64 nt, Human
gccacgaccacagacacgcaugcacacacgcagaggugcagagcgaggaggccggcaaaucccg

SEQ ID NO: 281522 - RNA, 64 nt, Human
ccugccuuggugcugccagcagcagacauagacgggugcagaagcggggagcuccaggugcagg

SEQ ID NO: 281523 - RNA, 64 nt, Human
cucccaggccugggggcccccugggggcccgcggggugcagagcaccccaacuuugcacucaug

SEQ ID NO: 281524 - RNA, 64 nt, Human
cacaaggcacaccagugcaagcagaugacaaaaaggugcagaaggcaaucuuaaaacagaaagg

SEQ ID NO: 281525 - RNA, 64 nt, Human
aaaggaaggccagagagccgcgcaguucucugcaggugcagaugcaggcaguggagguggccug

SEQ ID NO: 281526 - RNA, 64 nt, Human
ggguuaauaacuacuacauugaauugcauguuaaggugcagaaauaauacauuaaaagauuuuc

SEQ ID NO: 281527 - RNA, 64 nt, Human
ccuggguucacacagcuuuuuagcuuacauaacuggugcagauuuucuguguggagauguugcc

SEQ ID NO: 281528 - RNA, 64 nt, Human
gaaauguccgcauggaugaucacgaaacaaucacggugcagaauguccguauggaugaucauga

SEQ ID NO: 281529 - RNA, 64 nt, Human
uuaagugauaagggacuuaaauaugaauuagaauggugcagaaagagauaccuuuucuggauau

SEQ ID NO: 281530 - RNA, 64 nt, Human
cucucacucuccguacagcugaagaguugggcgaggugcagagacuucuagcuggacaaccuac

SEQ ID NO: 281531 - RNA, 64 nt, Human
cuauguaagcuggaaaaaagguagggaguuuuggggugcagaaggguacuggagcuaauuuuuu

SEQ ID NO: 281532 - RNA, 64 nt, Human
auggcggaagcugcuacucgugagcgccagugcgggugcagacaaucuucuguuggguggcauc

SEQ ID NO: 281533 - RNA, 64 nt, Human
uuguguuaggaucacugauuaucugacaaaggcuggugcagaaaaaaaauuguaggcccaagug

SEQ ID NO: 281534 - RNA, 64 nt, Human
uccacgcacgacccagccagacccucgcggagauggugcagaaggcggagcgggugagcggccg

SEQ ID NO: 281535 - RNA, 64 nt, Human
cauucccaggggcaucaucauguucaacaaggcauggaggcagggccaucuuugcagcucaguc

SEQ ID NO: 281536 - RNA, 64 nt, Human
guaaaugguuaccuuccuguaacugccccgcaccuggaggcauggaguugugugcauccugcuu

SEQ ID NO: 281537 - RNA, 64 nt, Human
uccgucugucuuggcuggaaauucucugacgucuuggaggcagcuggaauggaaaggagaauuc

SEQ ID NO: 281538 - RNA, 64 nt, Human
uuuauucucucucccuuuuuauuuugccugcagaaucguugagagacuaauaaggcuuaauauu

SEQ ID NO: 281539 - RNA, 64 nt, Human
ugugcgcuguuuagaaguugugugauuuuuugccaucguugauaaaaaugcaaagucaaauaaa

SEQ ID NO: 281540 - RNA, 64 nt, Human
auuugggaaugaaaaaccuuaaaaaaaucucuucaucguugaacugugcauuuucccugcauuu

SEQ ID NO: 281541 - RNA, 64 nt, Human
uggcauucaggccccuauauuuucuguaggaaaaaucguugagaacacuuuucuauauggguga

SEQ ID NO: 281542 - RNA, 64 nt, Human
cguuugcaaaauguauuggcgugacuguaaacacaucguugaaguaaagcgauuacauauugag

SEQ ID NO: 281543 - RNA, 64 nt, Human
ccuggacaagauucauagacugaaagcuguugacaucguugaaucauauguuuauauauuguuu

SEQ ID NO: 281544 - RNA, 64 nt, Human
ucagaacucuuuuuuaauaaaauaaauaacauaaaucguugaacauaauguuccaguugaaugc

SEQ ID NO: 281545 - RNA, 64 nt, Human
aaacaauaaaauguaugcuuccuugaacugucauaucguugaccugcaaaauucaccuuuggaa

SEQ ID NO: 281546 - RNA, 64 nt, Human
cuuuucauuuuagagaauggggcagauggggcaaaucguugaauuuucccagaaaucacaccag

SEQ ID NO: 281547 - RNA, 64 nt, Human
cccacagggucuagacuagaaauccaucaucucuaucguugauauccuuccauccaggaauaga

SEQ ID NO: 281548 - RNA, 64 nt, Human
uaauuauuacuuuuauauuucaaaguacacuaagaucguugaagagcaauagaaccuuuaagac

SEQ ID NO: 281549 - RNA, 64 nt, Human
cagauaguuguaguguuuagacaugacaggaccuaucguugagguuucuaagacuuacuauggg

SEQ ID NO: 281550 - RNA, 64 nt, Human
ucaaagguggagggaguuuauuaguuaaccaaauaucguugagaggaauuuaaaauacuguuac

SEQ ID NO: 281551 - RNA, 64 nt, Human
uaaccccauuuuccgaagcugugaccuguccuucaucguugagccccaaaccacugcucagggu

SEQ ID NO: 281552 - RNA, 64 nt, Human
aaaauauuuuguguuugaaguaucugugcaugggaucguugauguuuaucagaacuguucacuu

SEQ ID NO: 281553 - RNA, 64 nt, Human
accucuggccuucaucuuggugcugcgacaauuguggaggcaaagcauucuuucugugacuauu

SEQ ID NO: 281554 - RNA, 64 nt, Human
uguguuuuaucuacuguguguugugguggccuguuggaggcaaauagaucagauuuuuuuugua

SEQ ID NO: 281555 - RNA, 64 nt, Human
uacuuuuuuauaauuaaugacuaaaugaucacuuuggaggcagggugguggggguguauuagca

SEQ ID NO: 281556 - RNA, 64 nt, Human
gaggaguaaaacugggcaagacaaagagcccuggaucguugaauugauaguuuaauuucugcug

SEQ ID NO: 281557 - RNA, 64 nt, Human
ugugacagaauguuccauagucugagagaauggaaucguugagcauuuaguacaaguccagugu

SEQ ID NO: 281558 - RNA, 64 nt, Human
guggcaguggaaauauggcugaaugagcgucuaaaucguugagaccagugcaacuuugggugca

SEQ ID NO: 281559 - RNA, 64 nt, Human
auuaaaacucaagugacacaaguuacaaguugauaucguugaaugaaaagcaaaacaaaaacaa

SEQ ID NO: 281560 - RNA, 64 nt, Human
gcaauaguugcacuacgugaucaguuuauuaaaaaucguugauguguguguguaaaaugggugg

SEQ ID NO: 281561 - RNA, 64 nt, Human
uaaaaugcugaccagaacgcucuugagcccaggcaucguugagcauuaacacucugugacagag

SEQ ID NO: 281562 - RNA, 64 nt, Human
guuucucucucuuugaggcauuuguuuggaaaaaaucguugagaugcccaagaaccugggauaa

SEQ ID NO: 281563 - RNA, 64 nt, Human
caucuggucuuguuuccaggagcauagaagccacaucguugagacaucaggaagguaaaaaccc

SEQ ID NO: 281564 - RNA, 64 nt, Human
uggccuucacagccauggcuggugacaacagaggaucguugagauugagcagcgcuuggugauc

SEQ ID NO: 281565 - RNA, 64 nt, Human
cuaaaugucaugggucauaguaucugauaucaauaucguugauaacauauccacagguaacacc

SEQ ID NO: 281566 - RNA, 64 nt, Human
aaauagacucuugggauuccccucuucugugcacaucguugaaugaagagagucuuuuugcaca

SEQ ID NO: 281567 - RNA, 64 nt, Human
ggcauauauguaccacauuuucuuuauccagccuaucguugauggauauuugguuugauuccau

SEQ ID NO: 281568 - RNA, 64 nt, Human
guucuaaguccaccuucuaucccauucauguuagaucguugaaacccuguaucccucugaaaca

SEQ ID NO: 281569 - RNA, 64 nt, Human; identical to SEQ ID NO: 281538

SEQ ID NO: 281570 - RNA, 64 nt, Human; identical to SEQ ID NO: 281539

SEQ ID NO: 281571 - RNA, 64 nt, Human
gaaacauaagcgugcaugccauguuguuuugaauuggaggcacaauuucauuauucgagaguaa

SEQ ID NO: 281572 - RNA, 64 nt, Human
uggccuggugcucugggcucugccuucugguuccuggaggcaucaaaggcugcauccguucugc

SEQ ID NO: 281573 - RNA, 64 nt, Human
ucagcaagaggagaccuggggcugugcaucuggauggaggcacucaggccuggguaggauuccu

SEQ ID NO: 281574 - RNA, 64 nt, Human; identical to SEQ ID NO: 281540

SEQ ID NO: 281575 - RNA, 64 nt, Human; identical to SEQ ID NO: 281541

SEQ ID NO: 281576 - RNA, 64 nt, Human; identical to SEQ ID NO: 281542

SEQ ID NO: 281577 - RNA, 64 nt, Human; identical to SEQ ID NO: 281543

SEQ ID NO: 281578 - RNA, 64 nt, Human; identical to SEQ ID NO: 281544

SEQ ID NO: 281579 - RNA, 64 nt, Human; identical to SEQ ID NO: 281545

SEQ ID NO: 281580 - RNA, 64 nt, Human; identical to SEQ ID NO: 281546

SEQ ID NO: 281581 - RNA, 64 nt, Human; identical to SEQ ID NO: 281547

SEQ ID NO: 281582 - RNA, 64 nt, Human; identical to SEQ ID NO: 281548

SEQ ID NO: 281583 - RNA, 64 nt, Human; identical to SEQ ID NO: 281549

SEQ ID NO: 281584 - RNA, 64 nt, Human; identical to SEQ ID NO: 281550

SEQ ID NO: 281585 - RNA, 64 nt, Human; identical to SEQ ID NO: 281551

SEQ ID NO: 281586 - RNA, 64 nt, Human; identical to SEQ ID NO: 281552

SEQ ID NO: 281587 - RNA, 64 nt, Human; identical to SEQ ID NO: 281556

SEQ ID NO: 281588 - RNA, 64 nt, Human; identical to SEQ ID NO: 281557

SEQ ID NO: 281589 - RNA, 64 nt, Human
ggggcugcuggaagggggcccucuggauucccuuuggaggcaucagguucugugcacaacuugu

SEQ ID NO: 281590 - RNA, 64 nt, Human
ggagaaguucuccuuuguuugcaaguucaaauacuggaggcaauuguaaaauggacgucuagaa

SEQ ID NO: 281591 - RNA, 64 nt, Human
cagacccucagccugaggucuggugaguggagccuggaggcaaggugguaggcaccaucugggu

SEQ ID NO: 281592 - RNA, 64 nt, Human; identical to SEQ ID NO: 281558

SEQ ID NO: 281593 - RNA, 64 nt, Human; identical to SEQ ID NO: 281559

SEQ ID NO: 281594 - RNA, 64 nt, Human; identical to SEQ ID NO: 281560

SEQ ID NO: 281595 - RNA, 64 nt, Human; identical to SEQ ID NO: 281561

SEQ ID NO: 281596 - RNA, 64 nt, Human; identical to SEQ ID NO: 281562

SEQ ID NO: 281597 - RNA, 64 nt, Human; identical to SEQ ID NO: 281563

SEQ ID NO: 281598 - RNA, 64 nt, Human; identical to SEQ ID NO: 281564

SEQ ID NO: 281599 - RNA, 64 nt, Human; identical to SEQ ID NO: 281565

SEQ ID NO: 281600 - RNA, 64 nt, Human; identical to SEQ ID NO: 281566

SEQ ID NO: 281601 - RNA, 64 nt, Human; identical to SEQ ID NO: 281567

SEQ ID NO: 281602 - RNA, 64 nt, Human; identical to SEQ ID NO: 281568

SEQ ID NO: 281603 - RNA, 64 nt, Human
gggaggccgagccugaauccuugccugugucugacgggaccacuacuaaaaaccuaaaaauauc

SEQ ID NO: 281604 - RNA, 64 nt, Human
agaccgugaacugaaaaaaguguuggccuuuuugcgggaccagauuuuuaagauaaaauaaaua

SEQ ID NO: 281605 - RNA, 64 nt, Human
agcgguccacaaccucaaggcugucuucaaggggcgggaccagaagcugauggacagugcgguc

SEQ ID NO: 281606 - RNA, 64 nt, Human
aucaggaugacccuacauacccaggucagauugacgggaccagaagggaacaucgacuucuaau

SEQ ID NO: 281607 - RNA, 64 nt, Human
uuuugcugucucauggggcagcuacaagcaugaacgggaccagggaauggcagcagcaugcaga

SEQ ID NO: 281608 - RNA, 64 nt, Human
ccucccugcacuccccucuugcugcguguugauuuggaggcacugcaguccaggccgaguccuc

SEQ ID NO: 281609 - RNA, 64 nt, Human
aggacacaggcacuuuuccaaugggcaagcccaguggaggcaggaugggagagcccccugggug

SEQ ID NO: 281610 - RNA, 64 nt, Human
ugugcuccugcaucuugucugggagugcagugaccgggaccagaaccuuccccaccucaauuag

SEQ ID NO: 281611 - RNA, 64 nt, Human
ugagagcaagagccuucacuucuucuugcggugccgggaccauguguuggugaagcuggugcug

SEQ ID NO: 281612 - RNA, 64 nt, Human
gcaagucuacuuccugccauuucugaaagccccgcgggaccagcuucuaggcugagcugccuag

SEQ ID NO: 281613 - RNA, 64 nt, Human
cuccagagucggaacugaggguuggaacuauacccgggaccaaacucacggaccacucgaggcc

SEQ ID NO: 281614 - RNA, 64 nt, Human
gaggggcggggcguguagccagccaggugcaugccgggaccauggcccccauacuuggcugcuu

SEQ ID NO: 281615 - RNA, 64 nt, Human
cugcuuacguaugccaugcauaccuccugccccgcgggaccacaauaaaaaccuuggcagacgg

SEQ ID NO: 281616 - RNA, 64 nt, Human
ccccaucccacccccaggaggccggggcuacgaccgggaccacguggugcuaugggagccggau

SEQ ID NO: 281617 - RNA, 64 nt, Human
gcaggggcugucucauucaucuguggauauggagcgggaccacuaugugccaggcccugugcca

SEQ ID NO: 281618 - RNA, 64 nt, Human
accagaaaucaccacauauuuggaaucucuuccacgggaccagcccagagcuaugccauggaaa

SEQ ID NO: 281619 - RNA, 64 nt, Human
uuccucaacuugaagugcaagauucucuuauuuccgggaccacggagagucugacuuaacuaca

SEQ ID NO: 281620 - RNA, 64 nt, Human
cccgccccagccccugacacacacucggaccccccgggaccacaaagccaccgccgcuguuacc

SEQ ID NO: 281621 - RNA, 64 nt, Human
cagauggcagaggaucugccucggcgucugcaggcgggaccacgucagggaggguuccuucaug

SEQ ID NO: 281622 - RNA, 64 nt, Human
gcugcugguguuuuaugggccaccuuucccgcugcgggaccaagccgggaaugagcuugugugc

SEQ ID NO: 281623 - RNA, 64 nt, Human
ccaggcagggguuuuguggacagagccccacuuucgggaccagccugagguguaagggcagaca

SEQ ID NO: 281624 - RNA, 64 nt, Human
uuccugcuucgagaauguauaacguggaaauccacgggaccaaauuucugcagaggccuugccg

SEQ ID NO: 281625 - RNA, 64 nt, Human
cccucccccgcuuccucccucugcggggaggacccgggaccacagcugcuggccaggguagacu

SEQ ID NO: 281626 - RNA, 64 nt, Human
ucuugcacuauaaacuggaauggauuucucaaugcgggaccagauuaugacuagaguuuuuaug

SEQ ID NO: 281627 - RNA, 64 nt, Human
uuagcgucaagacauuugcugaacucagcacauucgggaccaauauauaguggguacaucaagu

SEQ ID NO: 281628 - RNA, 64 nt, Human
ccacagggacacagggcaagaccagccuugcuuauggaggcaggacaccacaaucuggcccaug

SEQ ID NO: 281629 - RNA, 64 nt, Human
agaugaagccaucuugaaagugagugguguccuuuggaggcaugguggaugaaaggcgcaaagg

SEQ ID NO: 281630 - RNA, 64 nt, Human
gaucacaauggaaaaggugaagaaauuugagaaucgggaccaguauucacaucugcuaagugau

SEQ ID NO: 281631 - RNA, 64 nt, Human
ugcugcugcccggaggguucacugagggguggcacgggaccacuccagguggaacaaacagaaa

SEQ ID NO: 281632 - RNA, 64 nt, Human
uggaguucaaguuccuuugcauucgauuguccaucgggaccacacuaggaagcugcagagagug

SEQ ID NO: 281633 - RNA, 64 nt, Human
caaggaauauggagacuacuucguaguggaguaccgggaccagaagccauacugcaucagcccc

SEQ ID NO: 281634 - RNA, 64 nt, Human
cccuuaaggucuccaaaccagacggugacgccugcgggaccaucuggggcaccugcuuccaccc

SEQ ID NO: 281635 - RNA, 64 nt, Human
uaaaauguuuucacuguaauauaaauuaugagugcgggaccacuauucaauuuuuuuuuguaaa

SEQ ID NO: 281636 - RNA, 64 nt, Human
ccagcugcugcuggagggccuggagggggugcugcgggaccagcuggcccugcgagccuuggag

SEQ ID NO: 281637 - RNA, 64 nt, Human
aguauuauuuauagguaguuguuuacauaugagucgggaccaaagagaacuggauccacgugaa

SEQ ID NO: 281638 - RNA, 64 nt, Human
gaaaggccagaguggguuuguggagucgccacugcgggaccagcacgaaagcugcuugucugcu

SEQ ID NO: 281639 - RNA, 64 nt, Human
acucggaagaucccgugugugcacgcuggcuucucgggaccagccagggccaaggcuugggaac

SEQ ID NO: 281640 - RNA, 64 nt, Human
uggggguuccuguccaaccccagcaggggcgcagcgggaccagccccacauuccacuuguguca

SEQ ID NO: 281641 - RNA, 59 nt, Human
cccaggccguccugcucuaggcagagucccgggaccauggccuccugccacacaacacg

SEQ ID NO: 281642 - RNA, 64 nt, Human
ucccagggggaggugucagaccucgggaggcagacgggaccagagccaggcuguucacuguggg

SEQ ID NO: 281643 - RNA, 64 nt, Human
aauuaauaauaauaaaaccuuccaaaaaaagugccgggaccaaauggauucacugaugugcauu

SEQ ID NO: 281644 - RNA, 64 nt, Human
uuauuauguacuauucaaucuuuacacaaugucacgggaccaguauuguuuacccaauuuuuua

SEQ ID NO: 281645 - RNA, 64 nt, Human
gaacagggagcuccuggagcgcagccuggagagucgggaccaccugcaccgcgaacagcgggag

SEQ ID NO: 281646 - RNA, 64 nt, Human
uaggccugccuuccggagacccuguccacauugccgggaccacccugguggggccacugguggg

SEQ ID NO: 281647 - RNA, 64 nt, Human
ucacuucccagggcccaggccucagcccaggccucgggaccaacucuuuguauaaccuaccuga

SEQ ID NO: 281648 - RNA, 64 nt, Human
gcuaaaguggauacagcuguuggggcagaagagacgggaccagcugcuggccacauuuccugcu

SEQ ID NO: 281649 - RNA, 64 nt, Human
gguaccagccacuggaggggucauccuugcccaucgggaccagaaaccugggagagacuuggau

SEQ ID NO: 281650 - RNA, 64 nt, Human
cucagccccacuagcuggcaccaacuuaauuccacgggaccaucugcugaacauuccccagugc

SEQ ID NO: 281651 - RNA, 64 nt, Human
acucuuaugcaaaaauccuaaucgugucgcaacacgggaccaguuacugugucuaucgggucau

SEQ ID NO: 281652 - RNA, 64 nt, Human
uccugauguuuugccguggcuuggggauuguacacgggaccagcucacguaaugcauugccugu

SEQ ID NO: 281653 - RNA, 64 nt, Human
ugcggugaaguuuaaacucugcucaggauaaggacgggaccauuuuuacauccaugaaaaugaa

SEQ ID NO: 281654 - RNA, 64 nt, Human
guauaaacuucagcugcagggauuccagagcccucgggaccacucugucaccuuaauagccaag

SEQ ID NO: 281655 - RNA, 57 nt, Human
aacgacgucguagccaguagggagcagcgggaccaucugaccccacuugccaguccc

SEQ ID NO: 281656 - RNA, 64 nt, Human
auauugcauaaugacaaauauuuaagauugcagacgggaccagguauucuuaauugggaaaaca

SEQ ID NO: 281657 - RNA, 64 nt, Human
cagggcgacagaggggcacugguuuacacuuugccgggaccaucagggccgccaagcaggucag

SEQ ID NO: 281658 - RNA, 64 nt, Human
ccuccccacacaugggcaaggacagguggaaugucgggaccacacugugcggcuucucggcaca

SEQ ID NO: 281659 - RNA, 64 nt, Human
cgggucuuuaccgaguugggaacugugauggcaucgggaccaguccugggcgcccugagaccac

SEQ ID NO: 281660 - RNA, 64 nt, Human
gcugaggcgggcggaucgguugagcucaggcguucgggaccagccuggccaacaugaugaaacc

SEQ ID NO: 281661 - RNA, 64 nt, Human
gggccuccugcccgcgcgggaggggagggcgccccgggaccagggauggggcagcgcacaggcc

SEQ ID NO: 281662 - RNA, 64 nt, Human
caugcgucucuggcccucguggguaaaugacaaacgggaccaauggguuugccaagcccuuugc

SEQ ID NO: 281663 - RNA, 64 nt, Human
ccaauccucucccccacgggacaccucucugguucgggaccaaucccucccuggggacgugccc

SEQ ID NO: 281664 - RNA, 64 nt, Human
caccaagaagcacugggugaccagcuggcagacucgggaccaauacuacugacguccucccuga

SEQ ID NO: 281665 - RNA, 64 nt, Human
agcccuuccuugggcgucucccccagagugcugucgggaccacaucuguccucacccuguggga

SEQ ID NO: 281666 - RNA, 64 nt, Human
gccgaggugggcggaucaccugaagucaggaguucgggaccagccuggcaaacaccccaucucu

SEQ ID NO: 281667 - RNA, 64 nt, Human
cccgggggauccgggcugcugggcagcaggucggcgggaccacaugccugggucucacccucag

SEQ ID NO: 281668 - RNA, 64 nt, Human
cacccugccacuaugagcuagugcucaugugacuuggaggcaggauccaggcacagcuccccuc

SEQ ID NO: 281669 - RNA, 64 nt, Human
uauauccgcccccagguggagcaacaugcgauucuggaggcacggggguaacugaaagugagua

SEQ ID NO: 281670 - RNA, 64 nt, Human
uuaggcuggacugaucgcgggucgcaggugaccccgggaccagaugucccuccccucaugagcg

SEQ ID NO: 281671 - RNA, 64 nt, Human
gggccucgugcagggacgcucaggcugcucccagcgggaccacaguuuuggccucugaaacaca

SEQ ID NO: 281672 - RNA, 64 nt, Human
gugaagaucucacucugccccccccccccaucuucgggaccaggauuugcacagaagcacaugc

SEQ ID NO: 281673 - RNA, 64 nt, Human
cacccucaaccggcuccaucacauccucaggucucgggaccauggggggcucagaggggagaca

SEQ ID NO: 281674 - RNA, 64 nt, Human
cuggugaccuugcaagcaucccauggggcgggggcgggaccagggagaauuaauaaaguucugg

SEQ ID NO: 281675 - RNA, 64 nt, Human
cucggccgccuccacgacccggaguaggggggcucgggaccaugaggaugaccagcaaaauuca

SEQ ID NO: 281676 - RNA, 64 nt, Human
cagcagugccccugccagccccgaaucccacccccgggaccagccacauccacagcacaacugc

SEQ ID NO: 281677 - RNA, 64 nt, Human
ccagccacccacacccaccccagcacaccucacacgggaccacagccgcgcugccgagggccaa

SEQ ID NO: 281678 - RNA, 64 nt, Human
uaagcgauccucccaccucagccucucgaguagccgggaccacaggugcgagccccuacaccug

SEQ ID NO: 281679 - RNA, 64 nt, Human
gggggacguugccagaggggaccagggccagagacgggaccaggaaggaacugaggaccaagaa

SEQ ID NO: 281680 - RNA, 64 nt, Human
cggccugggaaguucacugccccaacucuuuucccgggaccauacugagucccccagccacgcu

SEQ ID NO: 281681 - RNA, 64 nt, Human
aacaucccccgggacuaggcacacccugccuuggcgggaccagcgggcauuuguuuucuugcug

SEQ ID NO: 281682 - RNA, 64 nt, Human
ggugaacauuaacuuuccccagcucggccucugucgggaccagugccagguggacagccagugu

SEQ ID NO: 281683 - RNA, 64 nt, Human
agccuaagagaagacagucccaggagaagcuggccgggaccagccaggagcugggagccacagg

SEQ ID NO: 281684 - RNA, 56 nt, Human
agcccgacacggaggacugaggucgccgggaccacccugagccggccccaggcucg

SEQ ID NO: 281685 - RNA, 64 nt, Human
ggucuaaggagcgcuagugccuugcccacaggugcgggaccaucugaugugaugugaauacucu

SEQ ID NO: 281686 - RNA, 64 nt, Human
gagagacaguggccccuugauaaucugggucucacgggaccagcuagggguccagguuucaguc

SEQ ID NO: 281687 - RNA, 64 nt, Human
gcugaggugggcggauuacuugagcccaggaguucgggaccagccugggaaauauagugaaacu

SEQ ID NO: 281688 - RNA, 64 nt, Human
uaggauggggcucccagcuccuuucuccugugaauggaggcagagaccuccaauaaagugccuu

SEQ ID NO: 281689 - RNA, 64 nt, Human
guccgguggauguggcugggguuuccugguauuguggaggcacccagguuguccaugcuuggga

SEQ ID NO: 281690 - RNA, 64 nt, Human
gcugaguugggcagaucaccugagaucaggaguucgggaccagccugggcaacauggugaaacc

SEQ ID NO: 281691 - RNA, 64 nt, Human
gccgaacgaggaacucaaucaaaaugagccauagcgggaccacaagggcaaggagaccaccacc

SEQ ID NO: 281692 - RNA, 64 nt, Human
acgcgggcugccguccuaaucaacgugccuauggcgggaccacgcucggagccugccucuucug

SEQ ID NO: 281693 - RNA, 64 nt, Human
cuucccgccgcccgaccccgagucgggaggacuccgggaccauugaccucagcugcacauuccu

SEQ ID NO: 281694 - RNA, 64 nt, Human
caccccggaaccggcgucgcuggcgcauccuggguggaggcaggccccgagcucggggaagggg

SEQ ID NO: 281695 - RNA, 64 nt, Human
ccaagccuccugggcugcaacuggucuuuauuuuuggaggcaaugaauggagcaccucggccug

SEQ ID NO: 281696 - RNA, 64 nt, Human
ugcgggcagccuggagacucguggacuuaccgccuggaggcaggcccgggaaggcugcuguuua

SEQ ID NO: 281697 - RNA, 64 nt, Human
ccaggaggaaagaggcccagcucucagcugacgauggaggcagaaccggagucggguuugggga

SEQ ID NO: 281698 - RNA, 64 nt, Human
gcugcccccacagagugggacccaaggggcuaauuggaggcacgaggggaccccuccccagggc

SEQ ID NO: 281699 - RNA, 64 nt, Human
agcccuguugaaggagcuggugacauucugaugcuggaggcaggugacggggagcacagacuuu

SEQ ID NO: 281700 - RNA, 64 nt, Human
ugcauguuaugagcgugugcuuauccguuaaggcuggaggcacaugugggugaugguggaugau

SEQ ID NO: 281701 - RNA, 64 nt, Human
caggguucccggucaguccggcuggccgccuucauggaggcaucauggcagagcacaugagaug

SEQ ID NO: 281702 - RNA, 64 nt, Human
uacccaauuucugggcucuggauccucacagucauggaggcaccgugggccuggcacuugcaaa

SEQ ID NO: 281703 - RNA, 64 nt, Human
gcagagcccuacaauuaaggcgggaaugaggggcuggaggcagcaaacggaaucugcccuauga

SEQ ID NO: 281704 - RNA, 64 nt, Human
gcuuuacccaaauccuucuccagccaugacuuggugacucuaagcuugcucccaccugcccccu

SEQ ID NO: 281705 - RNA, 64 nt, Human
cugucuuuauugaagagcugcccacccagagucuugacucuagggcaggcuagugcuauugugg

SEQ ID NO: 281706 - RNA, 64 nt, Human
gcaauagcaguuauaacagaugugaaaauauacuugacucuaauaugauuauacaaaagagcau

SEQ ID NO: 281707 - RNA, 64 nt, Human
uuuuuuuuuuguuuuuuuguuuuuuuguuuuuuuugacucuaaucaacauuccuuuuguuggug

SEQ ID NO: 281708 - RNA, 64 nt, Human
uaacauagcugagguaaaaacugaacuauguaaaugacucuacuaaaaguuuagggaaaaaaaa

SEQ ID NO: 281709 - RNA, 64 nt, Human
guaguauaguagugcaaaauggaagacugauuuuugacucuauuauaaucagcuucagagauuc

SEQ ID NO: 281710 - RNA, 64 nt, Human
gcugggcuauggggaagggagguugugcggaucuugacucuagggcagaacagaucuaaccaug

SEQ ID NO: 281711 - RNA, 64 nt, Human
uagauuccacaaccugguuugccaguucaucuuuugacucuauuaaaaucuucaauaguuguua

SEQ ID NO: 281712 - RNA, 64 nt, Human
uugguccacuaaaacaagaugaaaaauacaagagugacucuauaacucuggucuuuaagaaagc

SEQ ID NO: 281713 - RNA, 64 nt, Human
uucucuagauauuuaauacagagaguguauagacugacucuaaguuaauaaugugcaaaauauc

SEQ ID NO: 281714 - RNA, 64 nt, Human
uacaccccuuccuaucagcuggauucuauccaagugacucuauugauguauguauguucauuca

SEQ ID NO: 281715 - RNA, 64 nt, Human
aggugcaucuggauuccaaauauuggauuugaguugacucuacucauuuauuauacacuaaaga

SEQ ID NO: 281716 - RNA, 64 nt, Human
auguauuaugaaaaaauaaaguuguaauuucugaugacucuaagucccuuucuuugguuaauaa

SEQ ID NO: 281717 - RNA, 64 nt, Human
uuuccaaaacuugcacgugucccugaauuccaucugacucuaauuuuaugagaauugcagaacu

SEQ ID NO: 281718 - RNA, 64 nt, Human
gccugggaaucuaagugggagacaauauuaauuuggauccgauuaauuggagauuacuaacugu

SEQ ID NO: 281719 - RNA, 64 nt, Human
cccacuggugccggagacggaguggagugggccuggauccgagggaugcuaccucucccuuucc

SEQ ID NO: 281720 - RNA, 64 nt, Human
ucugcucugugcuccucaaaauauaauuucaaauggauccgaucuaaaucuauaccuagugcag

SEQ ID NO: 281721 - RNA, 64 nt, Human
uuggcgagaaaugacuuccaaugauguuguagcuggauccgacuaaguauagcucccccuuccc

SEQ ID NO: 281722 - RNA, 64 nt, Human
gugcuacuuaaacaguuuucacaguuucauugauugacucuaccuccuugccccacaccacuuu

SEQ ID NO: 281723 - RNA, 64 nt, Human
caaccuuaaaaagugucaaagcaucuuuguagggugacucuaaacugcuaauuaaggguuaaua

SEQ ID NO: 281724 - RNA, 64 nt, Human
ucuuauauaguucccuuuccagacuguuuucuuuugacucuaacuauaaucauaagucugugcu

SEQ ID NO: 281725 - RNA, 64 nt, Human
gacugugccuguauaugaacuuugaaaaaauacuugacucuacuuuuguuaccuaaaauaaaau

SEQ ID NO: 281726 - RNA, 64 nt, Human
cauuuggaauguaccuugcuuccauaacagacuuugacucuaugaccuaugaagaauaaaaaga

SEQ ID NO: 281727 - RNA, 64 nt, Human
cuguguuauagaacuguaggggaggccauggaaaugacucuaaagauacaaaauuuugaagagg

SEQ ID NO: 281728 - RNA, 64 nt, Human
ccuccagucacaggccauccuugcugcucccuacugacucuagcuuacuuccccugugaagaaa

SEQ ID NO: 281729 - RNA, 64 nt, Human
ccaagucucggccuccacauuaaccauaggauguugacucuagaaccuggacccacccagcgcg

SEQ ID NO: 281730 - RNA, 64 nt, Human
ccgauaaggaauaucugggacaggguuuagaucaugacucuacacagauaccaugaugagagua

SEQ ID NO: 281731 - RNA, 64 nt, Human
aauguggcaugauuacuuauuuauuuguuccaggugacucuaaauaguugauuuuucugccuga

SEQ ID NO: 281732 - RNA, 64 nt, Human
auccgugccucuuuuuaaaguucaaacucacaggugacucuaagguuaucuacuuuuacucaua

SEQ ID NO: 281733 - RNA, 64 nt, Human
ugccauauaccgcagggcuugcuucugucaagugugacucuaucucaguaauuaaaauaagugc

SEQ ID NO: 281734 - RNA, 64 nt, Human
uuccagcagugaagggacauucucuacacucagaugacucuaccaguggccuuuuaaccaagaa

SEQ ID NO: 281735 - RNA, 64 nt, Human
guuuauuaaaugcuucauuuguaugucaaagcuuugacucuauaagcaaauugcuuuuuuccaa

SEQ ID NO: 281736 - RNA, 64 nt, Human
uccauggugcccccuggucaacauaaggagcgugggauccgauggaaagguggagcucagggaa

SEQ ID NO: 281737 - RNA, 64 nt, Human
guguggccaggaaaagacaagcucuucagcuuggggauccgaucuggaagagagauucugaucu

SEQ ID NO: 281738 - RNA, 64 nt, Human
aacuuuugauucucuuuuguagcuugagcagggaggauccgaaguucaaaaaugauuucacugc

SEQ ID NO: 281739 - RNA, 64 nt, Human
gggaaccagagagaaucaacagaucaaugacauaggauccgaagugcaaugauagucacuucua

SEQ ID NO: 281740 - RNA, 64 nt, Human
ugaagaaaaagaucuagaaacugaguuguggagcugacucuaaucaaaugugaugauuggaauu

SEQ ID NO: 281741 - RNA, 64 nt, Human
cuugcaaaaacauuacuaaguauaccaaaauaauugacucuauuaucugaaaugaagaauaaac

SEQ ID NO: 281742 - RNA, 64 nt, Human
gguucaagaccagccugggcaacacagugacaccugacucuacuaaaaaauuaaaaaauuagcu

SEQ ID NO: 281743 - RNA, 64 nt, Human
aauuugcauaguuaauuugggauggggaagcaaaugacucuaaaauaaaaauuaaaugaaaaag

SEQ ID NO: 281744 - RNA, 64 nt, Human
uuucaacaaauaguugcugcaagaauuuuuaauaugacucuauaaaagcucuuuaguacaauug

SEQ ID NO: 281745 - RNA, 64 nt, Human
aaggacaaacugugcauuuaauggacacaagaauugacucuaacuccaugucugugguuucuuu

SEQ ID NO: 281746 - RNA, 64 nt, Human
ugaaggaccaucagguccggacucauggaagugaugacucuaaacagugcaaugaacaauuuau

SEQ ID NO: 281747 - RNA, 64 nt, Human
ucgaucuuuuguuuggagaacagcuggcuaaggaugacucuaaguguacuguuugcauuuccaa

SEQ ID NO: 281748 - RNA, 64 nt, Human
gaguuucucuagaagcuccagugauaagagauguugacucuaaaguugauuuaaggccaggcau

SEQ ID NO: 281749 - RNA, 64 nt, Human
cuuaaaugcuucaucacagucacauucaaaauagugacucuaaacaaagaagaaagcagcacug

SEQ ID NO: 281750 - RNA, 64 nt, Human
agccaagaacuaacuuugcuuacugugaguugacugacucuaauugaaucugcgugguuuugau

SEQ ID NO: 281751 - RNA, 64 nt, Human
aucgucccuuccccagagaccuucagugccauccugacucuagaaggccccccacagcagggcg

SEQ ID NO: 281752 - RNA, 64 nt, Human
uucccccuugucaacacaagcuggcagauacauuugacucuacagaugaaggugaacaauguua

SEQ ID NO: 281753 - RNA, 64 nt, Human
uucagccguugaacacauaggaaugucuguggggugacucuacugugcuuuaucuuuuaacauu

SEQ ID NO: 281754 - RNA, 64 nt, Human; identical to SEQ ID NO: 281719

SEQ ID NO: 281755 - RNA, 64 nt, Human
uaaaaggauucuuuacugugccagcacggggauuggauccgaagaaacuggcuacugggguuug

SEQ ID NO: 281756 - RNA, 64 nt, Human; identical to SEQ ID NO: 281721

SEQ ID NO: 281757 - RNA, 64 nt, Human
agagaaugaaugaagcaacaaggaagagagaccaugacucuaucgaugacacuguuuauagaaa

SEQ ID NO: 281758 - RNA, 64 nt, Human
uaaauugggcuuggagaaucuauucugaaaacauugacucuagacuuguagaaaagagccauuu

SEQ ID NO: 281759 - RNA, 64 nt, Human
ccuggggaugggaggccucucucuccccacccccugacucuagagaacuggguuuucucccagu

SEQ ID NO: 281760 - RNA, 64 nt, Human
uuaacugacgaagaagcaacuaaguuaauaauaaugacucuaaagaaacagaagauuacaaaag

SEQ ID NO: 281761 - RNA, 64 nt, Human
uaaauguuuuuuaaaaaugcagaacuaagauuuuugacucuaaagagagaaaauuacaagggug

SEQ ID NO: 281762 - RNA, 64 nt, Human
agcgaaagggacucucuaacagggcagucacuguugacucuauucugaauuuccucccuugggg

SEQ ID NO: 281763 - RNA, 64 nt, Human
aguuuggauuacuuaaauuacaacucuuuaauguugacucuagucauugggcauugacguguaa

SEQ ID NO: 281764 - RNA, 64 nt, Human
caugagaaaucacuguugcaaauugccuauaaauugacucuacuaaaauaacaauguuucaguc

SEQ ID NO: 281765 - RNA, 64 nt, Human
ucugcagaauguggguuuuccugguguuucccucugacucuagugcacugaugaucucugauaa

SEQ ID NO: 281766 - RNA, 64 nt, Human
agaggauuuucucugauuuuauuuucuuuguuucugacucuaauaauuaguuggaaacucauau

SEQ ID NO: 281767 - RNA, 64 nt, Human
auuuuaaucguuguaaacuaacagcuuaaacuauugacucuauaccucuaaagaauugcugcua

SEQ ID NO: 281768 - RNA, 64 nt, Human
augauuugauagauuaaccuuucauuuuuuuaggugacucuaguuagaaagucuuauuucacaa

SEQ ID NO: 281769 - RNA, 64 nt, Human
ugagagaccuugagaaagaaugaugcagauuacaugacucuaaugugggcagucugaaaauauc

SEQ ID NO: 281770 - RNA, 64 nt, Human
uccuccuuuuacccguugaauguuuugaaugcccugacucuaccagcgcccauaaaugaucucu

SEQ ID NO: 281771 - RNA, 64 nt, Human
ggcaucuuuucuagagacacauuggaccagaugaggauccgaaacggcagccuuuacguucauc

SEQ ID NO: 281772 - RNA, 64 nt, Human
aagcuguuggaugguuugaugaaggggagugacaggauccgauguaccuauuuaagaauuuaag

SEQ ID NO: 281773 - RNA, 64 nt, Human
uggcgucaaguucagcuccacgugugccaucaguggauccgauccguccagccauggcuuccua

SEQ ID NO: 281774 - RNA, 64 nt, Human
uuuuccuuucugacuuuuucccuuugcuuucgugugaccacauguuuucuguaccagucacugg

SEQ ID NO: 281775 - RNA, 64 nt, Human
ucagucuuauagcaagacuguuagcccucaaacuugacucuacugaucugaccauuucccucuc

SEQ ID NO: 281776 - RNA, 64 nt, Human
ucuccucaucuuuuuugugugugagggcaggucuugacucuaggucucagcuggaaccccaccc

SEQ ID NO: 281777 - RNA, 64 nt, Human
agugacaaaacugagcauccauccuagaucugccugacucuaagucagugacuuugcucccauu

SEQ ID NO: 281778 - RNA, 64 nt, Human
ccguaucuuccacaugugaaugucauugcaagggugacucuagacaaacuacaaaccgauggac

SEQ ID NO: 281779 - RNA, 64 nt, Human
aacaauauuuauguccuauguuuguguauagacaugacucuacuagggcauaauuagaguuugu

SEQ ID NO: 281780 - RNA, 64 nt, Human
gacaagucaaauguaguaaaaugacaacacuuggugacucuaggugacuggucgacagauguuc

SEQ ID NO: 281781 - RNA, 64 nt, Human
cuucucacgcuuuguuuacucucuucauccguugugacucuaggcuucagguugcauugggguu

SEQ ID NO: 281782 - RNA, 64 nt, Human
ugaacucaaaugucaugauagcuugcauaaauggugacucuaguagauuugacucaagcacuuc

SEQ ID NO: 281783 - RNA, 64 nt, Human
guauuauuuguugaaaaugguuagaauaaaacuaugacucuauaagguuuucaaacaucugagg

SEQ ID NO: 281784 - RNA, 64 nt, Human
gaggguucuuuuuuaaaguguaugcuugaguaacugacucuauggagucuauaaaugcacugac

SEQ ID NO: 281785 - RNA, 64 nt, Human
ugcaauguuagcaauaaguuuuuuucuucuguaaugacucuacguuauccuguuucccugugcc

SEQ ID NO: 281786 - RNA, 64 nt, Human
gaaauguacauuuuugagagcucuguacuuauagugacucuacuguuugaaauacuauuuuuuu

SEQ ID NO: 281787 - RNA, 64 nt, Human
cuauaguacagcugagccccagugcugugcagucugacucuaauuaaaggcaccuucuuuacag

SEQ ID NO: 281788 - RNA, 64 nt, Human
acaccguccuacacuuuaagcugcuccuuugguaugacucuauacuuauggaaauguagaaaca

SEQ ID NO: 281789 - RNA, 64 nt, Human
uccagucggagagcgaggagaagguugucaccuaugaccacauugggcccaacgucugcauggg

SEQ ID NO: 281790 - RNA, 64 nt, Human
ugugcuggaaagcguugauggggagcgucggcgcugaccacacgcgggagcugcggaagcccag

SEQ ID NO: 281791 - RNA, 64 nt, Human
gggagucugcccuggugcccacugggcuguggggugaccacacuguacuuggggcugggcccuc

SEQ ID NO: 281792 - RNA, 64 nt, Human
uuguuaauguaauauuuuaauagcaaagauaucaugacucuagccacagccuaaccaaggauua

SEQ ID NO: 281793 - RNA, 64 nt, Human
uccaaauauauguuuauauaauauuuccacugugugacucuagugaucuuuaacauacacagaa

SEQ ID NO: 281794 - RNA, 64 nt, Human
cuaugaagguguaugagcccauccuuuuauucauugacucuaagagucaaauuuucuagugcau

SEQ ID NO: 281795 - RNA, 64 nt, Human
aaagcuuuugcuuuuuguuaggaaaagguguggaugacucuacugcguggaugguuacauuugc

SEQ ID NO: 281796 - RNA, 64 nt, Human
uguguguauguguguugaaacuguaaagcuuuuaugacucuaauauuaaucucuuaaaugaaau

SEQ ID NO: 281797 - RNA, 64 nt, Human
aaagcugaacuacauccuuaguuuucagucuacuugacucuaucaggagcuuuuuaaggaaagu

SEQ ID NO: 281798 - RNA, 64 nt, Human
uuuaaugaacaaauggccuuuauuaaaaacugagugacucuauauagcugaucaguuuuuucac

SEQ ID NO: 281799 - RNA, 64 nt, Human
gaagaaaggauccacuacuucuuguucuuaugaaugacucuagaaaaaucagaaucaaguugug

SEQ ID NO: 281800 - RNA, 64 nt, Human
aaugguuuuuacuucucuguguuaauuguaauauugacucuauuuuguaacuuaaguuucugac

SEQ ID NO: 281801 - RNA, 64 nt, Human
ggggacuaguguauuuauauauuuaauugauuucugacucuaucauuggccuccaaacacagau

SEQ ID NO: 281802 - RNA, 59 nt, Human
aaaacagcaaagagggauaaaauaguuuuugacucuaauacuguauaugcauuuaagug

SEQ ID NO: 281803 - RNA, 64 nt, Human
acagagugagacuccaucucaaaaaaaaaaaaguugacucuacccccuaauuugguaggagaug

SEQ ID NO: 281804 - RNA, 64 nt, Human
aaagagaugcuuggagcaaucagaacuucaggugugacucuagcaaggcucaucuuucugcccg

SEQ ID NO: 281805 - RNA, 64 nt, Human
gacagcuuuccugcacugcagccuccugcuccucugacucuagugggaacaggccccagcucag

SEQ ID NO: 281806 - RNA, 64 nt, Human
ggucagcgggucacagcugcccccacucuauaagcagggcuaauuguguacccuuugcagaaau

SEQ ID NO: 281807 - RNA, 64 nt, Human
gaaaauaauucaugugaacuagagucaacugugucagggcuaagaaacccugguuuugaguaga

SEQ ID NO: 281808 - RNA, 64 nt, Human
cugccaaugccaugacugcucaggccucaccucccagggcuacacagacccugcccaccccauc

SEQ ID NO: 281809 - RNA, 64 nt, Human
gugggccuugaaugcuaaaaagaagcaggguacgcagggcuacauguagauaccacaccaaggc

SEQ ID NO: 281810 - RNA, 64 nt, Human
aauaucaagaguugaauccauaguguggggcccaugacucuagcugggcaccuuggaccuccag

SEQ ID NO: 281811 - RNA, 64 nt, Human
uggaccaucaguuuugcacuuuagagaguguuucugacucuaaaccuguuuuaucagaaaauuu

SEQ ID NO: 281812 - RNA, 64 nt, Human
ucaaaugcagacucaaaccuucccaacaucuuuaugacucuagaauaaucauauugaugaaauc

SEQ ID NO: 281813 - RNA, 64 nt, Human
uggaggaccacgucuauuucaucagaacagcuguugacucuaguacugugaauccagugaaaau

SEQ ID NO: 281814 - RNA, 64 nt, Human
cccuucuccagcaagcagugcccucuggacagcuugacucuacucccagcgcuggcuccaggcu

SEQ ID NO: 281815 - RNA, 64 nt, Human
gaaaugaugugcauaugaaaauguaguuuggggaugacucuaccugaaaacuccaaacagggaa

SEQ ID NO: 281816 - RNA, 64 nt, Human
uaaaaguuguuacugauaugcuuuugauuuccuaugacucuauuauguuguacagaacaucuuu

SEQ ID NO: 281817 - RNA, 64 nt, Human
agggcagaggccuuuguacgcagcugccgaacucugacucuaguucugcggaagaaaaggaugc

SEQ ID NO: 281818 - RNA, 64 nt, Human
uuaauuuccucgcaaauaacaagacccacagaagugacucuagcuacuuaaugguucuguucuu

SEQ ID NO: 281819 - RNA, 64 nt, Human
uggaauccaaacucugguuugucucuugaaaauuugacucuauaaaacugaucugauuuucugu

SEQ ID NO: 281820 - RNA, 64 nt, Human
uuucucuaucuuuuauuuuuucaaagauauuauuugacucuaucaaaagucucuccuuuuuaaa

SEQ ID NO: 281821 - RNA, 64 nt, Human
acuguuuuguuacugcuuuugugcccagaaaccuugacucuaaaauucugugcugugcgaaaca

SEQ ID NO: 281822 - RNA, 64 nt, Human
ucagcagguggauccauucuucgacccccagaugugacucuaaagaaggcugaaaauuuuuguc

SEQ ID NO: 281823 - RNA, 64 nt, Human
cauccauuauggcuuggcaaucucuuuuauuuguugacucuagcucccuucaaagucgaggaaa

SEQ ID NO: 281824 - RNA, 64 nt, Human
aaaauuccuucaacugcauugcauccucuuggaccagggcuagaauggggauuucagguuucua

SEQ ID NO: 281825 - RNA, 64 nt, Human
uaucuguaaacaugaaucaccguguguguacuuacagggcuaggauuucaguguugucagagua

SEQ ID NO: 281826 - RNA, 64 nt, Human
caaagugcuuuggcaaggcaagggucucccucagcagggcuaggugcacuacagccucuuuccc

SEQ ID NO: 281827 - RNA, 64 nt, Human
caagaauucuguuuccuaggcaaacauugcaacucagggcuaaagucauccagugaaacuuuua

SEQ ID NO: 281828 - RNA, 64 nt, Human
gacuucauuuguaaaugagagugauucaucuagaugacucuaaggucucuuucaggucccaggg

SEQ ID NO: 281829 - RNA, 64 nt, Human
aaaagaauguauuuuuguggaugguguugacuucugacucuaaaagcaaucaaacauguuucug

SEQ ID NO: 281830 - RNA, 64 nt, Human
aaauuuuagaagaaaaguauuacaaacaauauuuugacucuauuaccuguuuugccuuauacau

SEQ ID NO: 281831 - RNA, 64 nt, Human
aaagcaaaaaacaaaaacaagucccauguccuacugacucuaguucuuccagucguuauccucu

SEQ ID NO: 281832 - RNA, 64 nt, Human
aguuuacuggcucugcucccgccuguuuucuuucugacucuaucuggcagcccgaugccaccca

SEQ ID NO: 281833 - RNA, 64 nt, Human
ggucuugagucacacugagauagucaguugugugugacucuaauaaacggagccuaccuuuugu

SEQ ID NO: 281834 - RNA, 64 nt, Human
aacuugaucauuaucagcuugauaagagacuuuuugacucuauauccuugcaguuaagaagaaa

SEQ ID NO: 281835 - RNA, 64 nt, Human
auggcaccaaucacaagaaccuuggacguuugacugacucuauccuuucucuccuaacuauaaa

SEQ ID NO: 281836 - RNA, 64 nt, Human
aauuuauuacaaauuuaguauuuuuaguacuugaugacucuaauuacaugaaugcaccuggaau

SEQ ID NO: 281837 - RNA, 64 nt, Human
uauaauaguucauagguugaucacucauaauaauugacucuaaggcuuuuauuaagaaaacagc

SEQ ID NO: 281838 - RNA, 64 nt, Human
ugucaccggauccuggguggucugcaggcagggcugacucuaggugcccuuggaggccagccag

SEQ ID NO: 281839 - RNA, 64 nt, Human
uauaaggccaguaaaauuuuaguaccuggagguuugacucuaauuuuugcacugauggugccaa

SEQ ID NO: 281840 - RNA, 64 nt, Human
agcuagugaagaccagagcaguuucaucugguugugacucuaagcucagugcucucuccacuac

SEQ ID NO: 281841 - RNA, 64 nt, Human
uugggacuugaaucauugagaaauaaagcacauuugacucuaagaaguauguagaaccuuguuu

SEQ ID NO: 281842 - RNA, 64 nt, Human
gcaugaaagcaguugcaauuacuuucuguuauuacagggcuaucuauaaaaagaaaacuuagaa

SEQ ID NO: 281843 - RNA, 64 nt, Human
ccuggucuaccuguucgcgcgccuccgcuacuuccagggcuacgcgcgcuccgcgcagcucagg

SEQ ID NO: 281844 - RNA, 64 nt, Human
uugggggccuaacccacgcagugaccccagagggcagggcuaggcgagagccugggguggggcg

SEQ ID NO: 281845 - RNA, 64 nt, Human
accaauguuauguaucaaagacuguugaaagagacagggcuacucuaggaauggaugggugggg

SEQ ID NO: 281846 - RNA, 64 nt, Human
ccccaaggcccugccccccagccccacccacucaugacucuaaguguguuguauuaauauuuau

SEQ ID NO: 281847 - RNA, 64 nt, Human
caagggauuuaaauauaacaaaauguguaauuugugacucuaauauuaaauaagauauuugaac

SEQ ID NO: 281848 - RNA, 64 nt, Human
ucaauuuugaaaacucuaauuguccauucuugcuugacucuacuauuaaguuugaaaauaguua

SEQ ID NO: 281849 - RNA, 64 nt, Human
auggagccaggcugcggggucuggguucaaauccugacucuaccacuuaggagcuguguguaca

SEQ ID NO: 281850 - RNA, 64 nt, Human
ccugaagugccaagagagcugagaggagcaguugugacucuacccaggaacaaacugugccuga

SEQ ID NO: 281851 - RNA, 64 nt, Human
ccuauacccagcagagggauaacccaaacaaaaaugacucuaaauagcccagaucccaagagau

SEQ ID NO: 281852 - RNA, 64 nt, Human
uuugaauaaucuucauauuuucauuuaaccuauaugacucuaauuuuuuuucugaggaaaucau

SEQ ID NO: 281853 - RNA, 64 nt, Human
uaaaauuaugauuuuguaucaaaaguauucaugaugacucuauuuggaaugauauucagggaaa

SEQ ID NO: 281854 - RNA, 64 nt, Human
ccagccugcguuugcagcuucucugucacuuccaugacucuauccucauaccaccacugcugcu

SEQ ID NO: 281855 - RNA, 64 nt, Human
agcgagagcagaaccaauccagucaggaugucacugacucuaaaucaggugauucaagaugccc

SEQ ID NO: 281856 - RNA, 64 nt, Human
aggccaagucugcccggcuuaaggaugcugguucugacucuaccccacugcuuccuucugcucc

SEQ ID NO: 281857 - RNA, 64 nt, Human
gcuauuagagaguuucugagucggcacccuggugugacucuagugaucuacguagcucggcuuu

SEQ ID NO: 281858 - RNA, 64 nt, Human
guuaaggguuagagaaaucccuuauuucaugucuugacucuaaaauuaucaaaguacuuuuccu

SEQ ID NO: 281859 - RNA, 64 nt, Human
uccaaaaccagggaaucagagcagucaggccuguugacucuaagcagcagacauccugaagaaa

SEQ ID NO: 281860 - RNA, 64 nt, Human
cugauguuaccacgauagaauguuacugaugauucagggcuauuucugaagucuguauguugcu

SEQ ID NO: 281861 - RNA, 64 nt, Human
acaucugaaugguuaaaaauacuggaagaguugucagggcuacaauagugaauguccuuuuuuu

SEQ ID NO: 281862 - RNA, 64 nt, Human
ugacguggucagccucauucauccuugcccuucucagggcuagcugcuccucucacaggcuggg

SEQ ID NO: 281863 - RNA, 64 nt, Human
uugauuucugaccauuaucaagaguuguaggaugcagggcuaaauugcaaaauaaaauaaaaua

SEQ ID NO: 281864 - RNA, 64 nt, Human
acacagccuaaggcagauuuuguuuugucuguacugacucuaucugccacacagaauguaugua

SEQ ID NO: 281865 - RNA, 64 nt, Human
cagugggcuagccuugguccucagggacagugugugacucuaguggucuuccuaaccagucucu

SEQ ID NO: 281866 - RNA, 64 nt, Human
uuuucuuuaauuucauuaugaacuuuuauuuacaugacucuaagacuauaagaaaaucugaugg

SEQ ID NO: 281867 - RNA, 64 nt, Human
uucucuauuauuuuuauuaccaagcgcuucuuucugacucuaaaauauggaaaauaaaauauuu

SEQ ID NO: 281868 - RNA, 64 nt, Human
ucucucaggcagccagccaccuggucccuugugcugacucuagcacaguggccaggauccaaua

SEQ ID NO: 281869 - RNA, 64 nt, Human
ccuucaauuaauaaaauauuuuugccauaguaugugacucuacauaacauacugaaacuauuua

SEQ ID NO: 281870 - RNA, 64 nt, Human
guccuaaagagaauuauauccucucauagaccaaugacucuauaauagagaaauauguaaugau

SEQ ID NO: 281871 - RNA, 64 nt, Human
caaggaaauugcagaccaauuaguugucuuggccugacucuaaugccuuuugcaaguagcuuuc

SEQ ID NO: 281872 - RNA, 64 nt, Human
ggaaucacuuuguuguaacaaaauugauucauggugacucuaauauuuguguaaaucugcugaa

SEQ ID NO: 281873 - RNA, 64 nt, Human
aaugaaauauagauuaguuuaaaugugaauucagugacucuagggccaaagaauauuagguaug

SEQ ID NO: 281874 - RNA, 64 nt, Human
uuucuuuauuucuuuacagugaauaacuacaagcugacucuaauuuuaaaaaauaaaaauuuua

SEQ ID NO: 281875 - RNA, 64 nt, Human
gugaaauguaucaagucaaagugaaucauuuaguugacucuauaauucuaaggucaaaauggaa

SEQ ID NO: 281876 - RNA, 64 nt, Human
cacuuuaaaaaggaaaugauucuggaugguucuuugacucuauuuuuauuuuuacuuagagaca

SEQ ID NO: 281877 - RNA, 64 nt, Human
ugcugccuuuccacagcuauaauggacaucagguugacucuaaaucaaggaucaugugugcaca

SEQ ID NO: 281878 - RNA, 64 nt, Human
auaugauugaauuuagggaacaggguugacacagcagggcuaguccugcauauuuuuucuuaaa

SEQ ID NO: 281879 - RNA, 64 nt, Human
gagaagccaaacagcaagaagcuguuaccacacccagggcuaugaggauaaugggaagagguuu

SEQ ID NO: 281880 - RNA, 64 nt, Human
ggggguccuucucccucgcagccaccacaugucucagggcuaccuucuccgauuggauuugcau

SEQ ID NO: 281881 - RNA, 64 nt, Human
cuggcucagggagguuaagugacuugcccaguuucagggcuaacgaccacagggucugcacucu

SEQ ID NO: 281882 - RNA, 64 nt, Human
ugguccucucccagccucucccccacauugucccugacucuaggggcacauccagucuccaucg

SEQ ID NO: 281883 - RNA, 64 nt, Human
aaggccauaacaugguccaggaucaucauucuucugacucuagaugggacacuugacagugacu

SEQ ID NO: 281884 - RNA, 64 nt, Human
auuucucugguggucucaagacaagaacaagagcugacucuagaaucuucugccuggcugaccu

SEQ ID NO: 281885 - RNA, 64 nt, Human
gauguuucccaaacacuguuuacagaaugagaugugacucuacagauaccucauagaagacaau

SEQ ID NO: 281886 - RNA, 64 nt, Human
ugggcaauauuugcccauucugguguaacuuaugugacucuagugcuuaacagcugccguugaa

SEQ ID NO: 281887 - RNA, 64 nt, Human
aaaacucuguaucuguuucuagcaugugcugcauugacucuauuaaucacauuucaaauucacc

SEQ ID NO: 281888 - RNA, 64 nt, Human
uuuuuaaauaucuuuuuccuucuacuccucccucugacucuaagaauucucucuucuggaaucg

SEQ ID NO: 281889 - RNA, 64 nt, Human
gccuguagacuuuggagccaagaaacacucugugugacucuacacacacuucaggugguuugug

SEQ ID NO: 281890 - RNA, 64 nt, Human
gcaaaagcagcuucuuaacagauggcauuuucugugacucuaggccucacaaaagagccagagu

SEQ ID NO: 281891 - RNA, 64 nt, Human
aaaauaguguuuuuuuuuuuuaauuucaguucauugacucuauaacugcagaaauuagauaaug

SEQ ID NO: 281892 - RNA, 64 nt, Human
augccuugggguucgugcacaacacagcuucuguugacucuaacuuccaaaucaaaaucauuug

SEQ ID NO: 281893 - RNA, 59 nt, Human
agaacagugucaccaucugagcccuagagugacucuaccugcaagauuucacaucagcu

SEQ ID NO: 281894 - RNA, 64 nt, Human
aucuguucucaaguuugagucauggucucagcuuugacucuaaagucaagagcuucauucccug

SEQ ID NO: 281895 - RNA, 64 nt, Human
cgcugcaggacuguggagacguaaauguaaacugugacucuaccucgacccuguuucuuauuuu

SEQ ID NO: 281896 - RNA, 64 nt, Human
gucauauuugcugcuacaguagcucaauauuuuacagggcuaacauaaagcuggcuccauuuaa

SEQ ID NO: 281897 - RNA, 64 nt, Human
uuaaauuacccaagcuuacuuuccaucuauaaaacagggcuaauaaugguaaucacaucuaauu

SEQ ID NO: 281898 - RNA, 64 nt, Human
guuggccagaauuaagcaaccaauacaugauagacagggcuaaaacugggcuacagaauuuuca

SEQ ID NO: 281899 - RNA, 64 nt, Human
aacccagccacugaagagagagucucugcagagacagggcuaccugggugguugaggggacuga

SEQ ID NO: 281900 - RNA, 64 nt, Human
gaaaguacgauguacaguaacuuaauggaagugcugacucuagcaucagccucuaccgauugau

SEQ ID NO: 281901 - RNA, 64 nt, Human
accuaaguuuaagaagugccguccucgaacuuucugacucuaagcuccugagcgggagucagac

SEQ ID NO: 281902 - RNA, 64 nt, Human
uggggggaggggcuauaacccugcuauuuuucauugacucuauugaacucuuuaggaugaugac

SEQ ID NO: 281903 - RNA, 64 nt, Human
ccccuccucucuugccugacucuccucucuugccugacucuagacacuaacuuaguuccagguu

SEQ ID NO: 281904 - RNA, 64 nt, Human
uauuauauuuuaaccgugcuaacuugucaagugcugacucuacucccguuuguacgugguguua

SEQ ID NO: 281905 - RNA, 64 nt, Human
uagaggcagagcuggaacuagauaucuggucuguugacucuagcucagugucuucugguaacug

SEQ ID NO: 281906 - RNA, 64 nt, Human
aaaaucauuuuucauagaacuguuucagaaaaccugacucuaacugguuuauauacaaaagaaa

SEQ ID NO: 281907 - RNA, 64 nt, Human
augggccaugugauuuucucuaaaccaaucacugugacucuagaguggccagacucagagcugc

SEQ ID NO: 281908 - RNA, 64 nt, Human
agggacacgaucuguguuccacucuauagcaacaugacucuagcaaugugacuuucgguuccaa

SEQ ID NO: 281909 - RNA, 64 nt, Human
guucgagaucaaccugggcaagagagugagacccugacucuacgaaaauuaaaaguuagcccgg

SEQ ID NO: 281910 - RNA, 64 nt, Human
uauagcguucccaacaacauccauguccuaugugugacucuaaauucuuuauuucugucauuca

SEQ ID NO: 281911 - RNA, 64 nt, Human
gaaauguauaaaucuaagauguauaauacauuauugacucuaugaauguuuucugaaguuuguu

SEQ ID NO: 281912 - RNA, 64 nt, Human
ggcccccaccccugcuucacagaauaaugggaagugacucuagucuuuguaagcaauuuucauu

SEQ ID NO: 281913 - RNA, 64 nt, Human
aaauacuugugauuuuuauaauacaaaagggucuugacucuaaaugcaguuuuaagaauuguuu

SEQ ID NO: 281914 - RNA, 64 nt, Human
uacuacuuaccuaccacaugccaagcacugugcucagggcuaaacgggcauugccuuuagugau

SEQ ID NO: 281915 - RNA, 64 nt, Human
uugaaaaccaccacggugccaucucuuguguaugcagggcuaugcaccugcaggcacgugugua

SEQ ID NO: 281916 - RNA, 64 nt, Human
agcuacccuauccuaaaauaguuuguguggauaucagggcuaaaaguucuccccaucuauuuua

SEQ ID NO: 281917 - RNA, 64 nt, Human
cacugugugaagcuuucaagagcuugguacuucccagggcuaccggcaguccucuguaguccag

SEQ ID NO: 281918 - RNA, 64 nt, Human
gcuauuguucauguaucgugcuggaagucugaacugacucuagaggaugaauuagcaagagggu

SEQ ID NO: 281919 - RNA, 64 nt, Human
agcuguguguuggcgugccacgguggggauuucgugacucuauaaugauuguuacucccccucc

SEQ ID NO: 281920 - RNA, 64 nt, Human
cgugggcucuccauaguguguaugaaaagcuuguugacucuagcggcucagagaggacuuugcu

SEQ ID NO: 281921 - RNA, 64 nt, Human
ggagaagcuaguuucuuucaugugauugaaaugaugacucuacuccuaaaagggaaaaaacaau

SEQ ID NO: 281922 - RNA, 64 nt, Human
acagacaucauugcuguuccccguuaccucgagcugacucuagaggggaaggcagagcucagga

SEQ ID NO: 281923 - RNA, 64 nt, Human
uccuccagaaagcccucggccugggccgccgccgugacucuagcacucucagucgcuguacagu

SEQ ID NO: 281924 - RNA, 64 nt, Human
ugugaguauauuaucuacauuuuagaaaauuuucugacucuagauccauagauucuguuguauu

SEQ ID NO: 281925 - RNA, 64 nt, Human
agccuaccaaagaguauucacaccuuuccaucccugacucuauggguuacugucccaauugcga

SEQ ID NO: 281926 - RNA, 64 nt, Human
gaggaugaauaccuuucacauuuugaucuuuaguugacucuacagucaugaaacauacaggucu

SEQ ID NO: 281927 - RNA, 64 nt, Human
uuaccaaaaagaauagggaaaaacaagaauuucaugacucuaccuguggucuaucuuuaauuuc

SEQ ID NO: 281928 - RNA, 64 nt, Human
gggcaggcggggucuuuguucucggcucccacagcagagccaggugagggggggccugccagga

SEQ ID NO: 281929 - RNA, 64 nt, Human
aggcaggugaugucuuuguucucggcucccacagcagagccaggugagggggcgccugccaggg

SEQ ID NO: 281930 - RNA, 64 nt, Human
gcuguugauuucucaaaggucuuccaaaacucaacagagccagaaguagccgcccgcucagcgg

SEQ ID NO: 281931 - RNA, 64 nt, Human
uaaugacuacugauaaggcaucagaauggauuuucagggcuaccagaaaaauguuuccagaugg

SEQ ID NO: 281932 - RNA, 64 nt, Human
auuacagggaugagggagucacuguggguggccacagggcuauggccaagcguucccuggccgu

SEQ ID NO: 281933 - RNA, 64 nt, Human
cccuggcccuuggcugugacacaagauccuccugcagggcuaggcggauuguucuggauuuccu

SEQ ID NO: 281934 - RNA, 64 nt, Human
cucccaggugacucugccaagcagcuguggcccccagggcuacccuacacaacgcccuccccag

SEQ ID NO: 281935 - RNA, 64 nt, Human
uccaguguuggcacaggcccaccccuggcuccaccagagccagaagcagagguagaaucaggcg

SEQ ID NO: 281936 - RNA, 64 nt, Human
ugguuuccauguauucuaggccagguaggcaacacagagccaaggcgggugcuggaagccagac

SEQ ID NO: 281937 - RNA, 64 nt, Human
uucucuccaacucccucugggaaggugaccuggccagagccaagaaacacuuucagaaaaacaa

SEQ ID NO: 281938 - RNA, 64 nt, Human
cuggacgggaucugaugcacaggcccccacgccucagagccagagugguccucagcccauuuca

SEQ ID NO: 281939 - RNA, 64 nt, Human
gagcagcaaguuuccauuuggcauuagcccagcacagagccaccggaacaucaagauccuagag

SEQ ID NO: 281940 - RNA, 64 nt, Human
ccuagaggacagccuugccgccacacaguuccagcagagccaggccagccuccuccacaugcag

SEQ ID NO: 281941 - RNA, 64 nt, Human
agguuuugaaaaaggaugggucccacccucccuccagagccaccaguguuagagcggagcccaa

SEQ ID NO: 281942 - RNA, 64 nt, Human
uccuuccugggccugcggcuggaggagaagaucacagagccauucuugguggugagccuagacu

SEQ ID NO: 281943 - RNA, 64 nt, Human
augauggcagaaacuucaugaaccagcccuuucucagagccagugaugugaguguaucagaaug

SEQ ID NO: 281944 - RNA, 64 nt, Human
cccucuggccuuuugcagcugauccagaggaacccagagccaacuuaccccaaccucacccuau

SEQ ID NO: 281945 - RNA, 64 nt, Human
cacauaggcucaggcuucuguaggcuuccugucccagagccaauuauggaaguaagggcuuccc

SEQ ID NO: 281946 - RNA, 64 nt, Human
uggcuguuuugucaacucucauccacugguggcucagagccauaagguggguugauuacacaau

SEQ ID NO: 281947 - RNA, 64 nt, Human
auagugaaaauuuuccaguuugauaauugauggucagagccagcacuggaauuuugaaaacaaa

SEQ ID NO: 281948 - RNA, 64 nt, Human
uucauacauuuccaguacgacuuuaguaucucuccagagccauauuuucucaguccgaauuaau

SEQ ID NO: 281949 - RNA, 64 nt, Human
augauuucagcagggaugacgucaucaucacauucagggcuauuuuuucccccacaaacccaag

SEQ ID NO: 281950 - RNA, 64 nt, Human
cuuggggggcuugagacaaauccuuucugccccccagggcuagugaaguggccucuuggauacc

SEQ ID NO: 281951 - RNA, 64 nt, Human
caagcacgagaugcagcauuucgugaaggucauccagggcuacaucgccaaccagauccugcac

SEQ ID NO: 281952 - RNA, 64 nt, Human
ugaggcucagggccugguacucuagcagcagccacagggcuaagcaugcauguuaacaggguau

SEQ ID NO: 281953 - RNA, 64 nt, Human
cacagcuuuugcuuaguguuuccugggucaggaacagagccaacaggaugaacgugugcaaaag

SEQ ID NO: 281954 - RNA, 64 nt, Human
agcaaagucauacacucccuguggccagcgugaacagagccaugccccacccucccagacugau

SEQ ID NO: 281955 - RNA, 64 nt, Human
cugguggaaaaucucccaugcgacccucggggcccagagccaucugggucugauguucuguucc

SEQ ID NO: 281956 - RNA, 64 nt, Human
gcaguaucccaguaucacugggauccauguggaacagagccagcugggggguugggcagcucuc

SEQ ID NO: 281957 - RNA, 64 nt, Human
ugaaacuuauaguuaauauuuuguucuuauuugccagagccaaauuuuaucuggaaguugagac

SEQ ID NO: 281958 - RNA, 64 nt, Human
cugaagcuuaagagaaggcagggaaguauacaagcagagccaguucugguacaaacaaagaauu

SEQ ID NO: 281959 - RNA, 64 nt, Human
cgaaggggcaccugugaacucaaaaggcucuuuucagagccacccacguuuucaaauaaaagag

SEQ ID NO: 281960 - RNA, 64 nt, Human
gccggagguuccaucguauccaaaaggcucuuuucagagccacccacaucagcacuuggaagaa

SEQ ID NO: 281961 - RNA, 64 nt, Human
caacucauuucugaaaaccuaccauguuucuuuacagagccauccaaaaauuuuuugucccuac

SEQ ID NO: 281962 - RNA, 64 nt, Human
gguggccuggcuguuucuuuggaucccucugucccagagccacccagaacccugacucuugaga

SEQ ID NO: 281963 - RNA, 64 nt, Human
cugagaucgcaccauuacacuccagccugggcaacagagccagacucugucucaaaaaaaaaaa

SEQ ID NO: 281964 - RNA, 64 nt, Human
gggagcaaggcugcuaaguggaagacagagauggcagagccauccacccugaggagugaugggc

SEQ ID NO: 281965 - RNA, 50 nt, Human
aacugcagcuucaguauuagcagagccacaggccgccucuguggcaucac

SEQ ID NO: 281966 - RNA, 64 nt, Human
cguuccucggcguccugaacccaaaggcucuuuucagagccacccacacgaucaagaaaggguu

SEQ ID NO: 281967 - RNA, 64 nt, Human
uuaauuucuucccuucuccccaccaguguugucacagggcuauguugcuuaaagguagucuggc

SEQ ID NO: 281968 - RNA, 64 nt, Human
ugaucagggucuauuuggaagagguaacccuuuucagggcuaagggccaggguguucuucugca

SEQ ID NO: 281969 - RNA, 64 nt, Human
aauugccagccaggacuuugacaugaaacagacccagggcuaaauuuuggcucugugguguugg

SEQ ID NO: 281970 - RNA, 64 nt, Human
cccuuucugacaugcuuuagcagagauaacuuaucagggcuaguuuaaacaaauguguauagga

SEQ ID NO: 281971 - RNA, 64 nt, Human
cucaguugcagggucgggcuugcggugggugacccagagccaccaaagucacauccacaacuaa

SEQ ID NO: 281972 - RNA, 64 nt, Human
cauggcagaggggcaccccggcccggaaagacgccagagccagcaggggcuguuucgggccgcg

SEQ ID NO: 281973 - RNA, 64 nt, Human
agccacuuuaagccagugcugaguagggcuucugcagagccauguuugagccaaggucuuggaa

SEQ ID NO: 281974 - RNA, 64 nt, Human
agagcaucgugacccuucagggccagaaggagggcagagccaugggccugggccugcuuuucca

SEQ ID NO: 281975 - RNA, 64 nt, Human
guugccaacuaagcccucgaaccaaggcagccuccagagccagccugggacucccagugaacuu

SEQ ID NO: 281976 - RNA, 64 nt, Human
accccgugcccccagccagcuggcugugccagggcagagccaugccacaucuguauauagaugg

SEQ ID NO: 281977 - RNA, 64 nt, Human
uuuggaggcuaccucaccugggcagggaugauggcagagccaggcuguuggaaaauccagaacu

SEQ ID NO: 281978 - RNA, 64 nt, Human
acugcacucauagggugcucugaggucaauaaagcagagccaaggccacccaguugccuuuuug

SEQ ID NO: 281979 - RNA, 64 nt, Human
uuaaagucaucuuguccugcuggaauuugcugugcagagccauaagccucccauuuuguuagcg

SEQ ID NO: 281980 - RNA, 64 nt, Human
ggauucuggcccagggcgccuccucccgacugagcagagccagacagacauuccugaggggccc

SEQ ID NO: 281981 - RNA, 64 nt, Human
guuacugccuggccgauccaaggcuguggagucccagagccagcaguucacuggugcucauucc

SEQ ID NO: 281982 - RNA, 64 nt, Human
ucccugcuuuccugugccccacugcugcccucugcagagccaucugcuccaggcacccaccugc

SEQ ID NO: 281983 - RNA, 64 nt, Human
ccugcugcccccucucuccucgggaucggguccccagagccaccaucuccugagccucccaccc

SEQ ID NO: 281984 - RNA, 64 nt, Human
aauaacuuaucugugguuacaagcuaguaaguagcagagccaagauuuuuuuuaauauagagac

SEQ ID NO: 281985 - RNA, 64 nt, Human; identical to SEQ ID NO: 198287

SEQ ID NO: 281986 - RNA, 64 nt, Human; identical to SEQ ID NO: 196336

SEQ ID NO: 281987 - RNA, 64 nt, Human; identical to SEQ ID NO: 198250

SEQ ID NO: 281988 - RNA, 64 nt, Human; identical to SEQ ID NO: 198270

SEQ ID NO: 281989 - RNA, 64 nt, Human
gagucgccggcugcuugacuccaaaggcucuuuucagagccacccaccuaaucacuagaaaaga

SEQ ID NO: 281990 - RNA, 64 nt, Human
uguaauggggaagaacugcccugccugcccaucucagagccauaaggucaucuuugcuagagcu

SEQ ID NO: 281991 - RNA, 64 nt, Human
ggccccagcuguuugccuuugacucccugaccuccagagccaggguugugccuuauugucccau

SEQ ID NO: 281992 - RNA, 64 nt, Human
cuacagagauccaggaaaccaaagcccugcugagcagagccauuuuguggcuauuucuggaggc

SEQ ID NO: 281993 - RNA, 64 nt, Human
caccucuagguccccauacuccuaugaucugagucagagccaugucuucucccuggaaugaguu

SEQ ID NO: 281994 - RNA, 64 nt, Human
aggccucucuacaagcagcaggaaacauagaacucagagccagaucccuuauccaacucucgac

SEQ ID NO: 281995 - RNA, 64 nt, Human
augaauaaucugauauuaaaguaguauuuggacccagagccagaacucggugguggaggcugcu

SEQ ID NO: 281996 - RNA, 64 nt, Human
accauuucccugaugcucugagcuuaugaucacacagagccaguccauccucauuuccuggugg

SEQ ID NO: 281997 - RNA, 64 nt, Human
ucugugacaugaaaccagaaauccaugugaacuacagagccaccaacuaaauguacaucacagu

SEQ ID NO: 281998 - RNA, 64 nt, Human
ggccaccagcacacccccgcacgcugggcaccaacagagccacggagcgcgagcacaugcccgc

SEQ ID NO: 281999 - RNA, 64 nt, Human
gggggcucucaagugccugauccugcccugggcucagagccagcccagagggaagcaacugcac

SEQ ID NO: 282000 - RNA, 64 nt, Human
aagcccuggcugaggccaaugcugugaagcuccacagagccacauucugaagccguccucugcc

SEQ ID NO: 282001 - RNA, 56 nt, Human
gaagucauggcaccuugugagcccagcagagccaccacccagcaucccaggcuggu

SEQ ID NO: 282002 - RNA, 64 nt, Human
uccacccuggcagcuaguagguucugcuguuaugcagagccauuuccucuagaauuuggauaau

SEQ ID NO: 282003 - RNA, 64 nt, Human; identical to SEQ ID NO: 196370

SEQ ID NO: 282004 - RNA, 64 nt, Human; identical to SEQ ID NO: 197984

SEQ ID NO: 282005 - RNA, 64 nt, Human; identical to SEQ ID NO: 198004

SEQ ID NO: 282006 - RNA, 64 nt, Human
cucuagucaccuggggagcuguagaaaacacuugcagagccagguuuugcugguuuggggcaug

SEQ ID NO: 282007 - RNA, 64 nt, Human
ccggggccccuuugauggacauaaaggcucuuuucagagccaccuacuaucucgagaaaagagc

SEQ ID NO: 282008 - RNA, 64 nt, Human
gggaggugaguggaggagagucucugaccagcugcagagccaaccccuaucauuuuauuaacau

SEQ ID NO: 282009 - RNA, 64 nt, Human
gcuguuauccagaguauagaaacuuuuuuucucccagagccacccaacgucauaaaacugguag

SEQ ID NO: 282010 - RNA, 64 nt, Human
uuccuuaauuucagggaugauaccggggacucuccagagccaugacuagauccaauggauucug

SEQ ID NO: 282011 - RNA, 64 nt, Human
gggaugcagagccucagagcaaauaaaucuuccucagagccagcuucuccucucaaugucugaa

SEQ ID NO: 282012 - RNA, 64 nt, Human
ccugcccaccucaccucacugcaccgcaccgcaccagagccagagcagcugcuugucugcagca

SEQ ID NO: 282013 - RNA, 64 nt, Human
gauggguuaauacaacaacugcacuguaaggacucagagccacacagaacuucugagaggggcu

SEQ ID NO: 282014 - RNA, 64 nt, Human
uuguugcugugagaauuuacugcccuauguuucccagagccauuuuggcucaauucaagucuau

SEQ ID NO: 282015 - RNA, 64 nt, Human
uuggcucacuucucuucagacuuggguagaagugcagagccacagaauugcuuuccuuccccgc

SEQ ID NO: 282016 - RNA, 64 nt, Human
gacuagggcaacgugccccccagaacucccugggcagagccagcucgggugaggggugagugga

SEQ ID NO: 282017 - RNA, 64 nt, Human
ggcucugaaggggagggaaggcaacggcucugcccagagccaucccuggagcaugugagcagcg

SEQ ID NO: 282018 - RNA, 64 nt, Human
ggauccuccugugagagugacgucaccuccuuuccagagccauuagugagccuggcuugggaac

SEQ ID NO: 282019 - RNA, 64 nt, Human
gauggcgcccuguccugccaaggggcgccaggagcagagccagggccuggcgagcuggcgugga

SEQ ID NO: 282020 - RNA, 64 nt, Human
cguaggggacccccucacacaccaccgagauggacagggcuauauuucgcaaagcaauuguaac

SEQ ID NO: 282021 - RNA, 64 nt, Human
auauacucacacacauauagcauaaaauacucagcagggcuaguuauuccgauuucuugcacaa

SEQ ID NO: 282022 - RNA, 64 nt, Human
uaacucuugagccauaugcauguguagauacuggcagggcuauguuuguuuaugaugcucugca

SEQ ID NO: 282023 - RNA, 64 nt, Human
auaucuauacaaaauucugcuauagugugaaaaucagggcuaaaaaccugaagccuuuguuuaa

SEQ ID NO: 282024 - RNA, 64 nt, Human
caugcuaagacuggagcuagacacaaugaaacaucagagccagcuaagagaaaagaaauauuug

SEQ ID NO: 282025 - RNA, 64 nt, Human
agcagaagaacaaaaugccacguaaccaaagcaucagagccaucauugcacgugucuuuuuuuc

SEQ ID NO: 282026 - RNA, 64 nt, Human
caaccuuuaaaaaauauuaaaacgauucuuagcucagagccauacaaaaguaggcuggauucag

SEQ ID NO: 282027 - RNA, 64 nt, Human
ugccccacccaucccugcaaagccauuuuucagacagagccauuccuaagaacacugaagggcu

SEQ ID NO: 282028 - RNA, 64 nt, Human
aggcagagcugugucgcacagcagugcugugcgucagagccagcugaggacaggcuugccugga

SEQ ID NO: 282029 - RNA, 64 nt, Human
agcccaguccauggccuucuugggccucugggcacagagccaauguucgucauugcagcucuca

SEQ ID NO: 282030 - RNA, 64 nt, Human
ccccuuucccccaccccagaguugggaugcggggcagagccaccagggcacugucugcgugacu

SEQ ID NO: 282031 - RNA, 64 nt, Human
gugaagucggucaagaacaaauggccccuaugcacagagccauaggaacugggggccuucccug

SEQ ID NO: 282032 - RNA, 64 nt, Human
ucaggccugguacccauccucuuuccacugugagcagagccagaagguaggucuguucagaguc

SEQ ID NO: 282033 - RNA, 64 nt, Human
caccaacacccgccaguacugugacuuccaaagccagagccacaugugcucaucaaacuugcau

SEQ ID NO: 282034 - RNA, 64 nt, Human
uuaaguuccucuaaaaaguuuuucuuccucucuucagagccaaaauaaaagugaacuacacugu

SEQ ID NO: 282035 - RNA, 64 nt, Human
ccagcaagggggugcagcccagggucaggcccuucagagccagggcagaggaugcacgguggcu

SEQ ID NO: 282036 - RNA, 64 nt, Human
ucgauuccuuucaucucagcaaaaugggcacugccagagccauuucugaucacaccaccauccu

SEQ ID NO: 282037 - RNA, 64 nt, Human
ggaagcugagccuggcugcuugucauagcugacacagagccaucugccacaaaccuguggcggc

SEQ ID NO: 282038 - RNA, 64 nt, Human
cauuguaguaggguacuucugcucaaguguccaacagggcuauuggugcuuucaaguuuuuauu

SEQ ID NO: 282039 - RNA, 64 nt, Human
agaaauucuuuucggggcaugaguaaauuuuguucagggcuacugucuguaugugcccagauaa

SEQ ID NO: 282040 - RNA, 64 nt, Human
auucuuuacaccuccccccccaagagaaaguacacagggcuauucuguaauauuguucagggaa

SEQ ID NO: 282041 - RNA, 64 nt, Human
acuacugccuuuguaacuuccacuuagccuacuacagggcuaugcacaucuuaguuuccaaaag

SEQ ID NO: 282042 - RNA, 64 nt, Human
gugacaucuagaaacuauaguucacaggacagagcagagccauggagacuaagcauugacuacc

SEQ ID NO: 282043 - RNA, 64 nt, Human
cccggagcaggguggggaggugcaguggcacccccagagccaacagagggagcaggcagagggu

SEQ ID NO: 282044 - RNA, 64 nt, Human
gguugcaaaauagaaaugagcuuaauccaggccgcagagccagggaaggugaguaacuuuagga

SEQ ID NO: 282045 - RNA, 64 nt, Human
ucuggccaccugugggguagguugucaaaccaaacagagccaccgugggacaucaaguggaaga

SEQ ID NO: 282046 - RNA, 64 nt, Human
cugggcucuggacaagcacugggggacgugcccccagagccacccacuucucaucccaaaccca

SEQ ID NO: 282047 - RNA, 64 nt, Human
auggccacaccccaccccacuucucccccaaaaccagagccaccugccagccucgcugggcagg

SEQ ID NO: 282048 - RNA, 64 nt, Human
accaguguuguccaagguugcuagcaggaaauggcagagccaggaguuggaccuagguuuaauc

SEQ ID NO: 282049 - RNA, 64 nt, Human
ucagccaggugccguguuggccuuggcuaggacccagagccacacugcagccuccgccgacucc

SEQ ID NO: 282050 - RNA, 64 nt, Human
cagucacuccuccuggucaccuagugagcagggacagagccaggagucaagugcagugccaagg

SEQ ID NO: 282051 - RNA, 64 nt, Human
ccuuuuagcccauuccccaugcugggccugcucacagagccacaggaagaucauucagaaacua

SEQ ID NO: 282052 - RNA, 64 nt, Human
cacagguggggacgaggcugagagagucagcaggcagagccagaugccaugcuuggcagcagca

SEQ ID NO: 282053 - RNA, 64 nt, Human
uagaacaggaccagcugagacuaagaaggaccagcagagccagcucagcucugagccauucaca

SEQ ID NO: 282054 - RNA, 64 nt, Human
guugaaaaguuuucacauaauccaguauuggcaucagagccagaaaugcccucccuagguccag

SEQ ID NO: 282055 - RNA, 64 nt, Human
uugugucaaucaguuuaucccauccccuuggccacagagccauugugauaugaggagauacugg

SEQ ID NO: 282056 - RNA, 64 nt, Human; identical to SEQ ID NO: 203629

SEQ ID NO: 282057 - RNA, 64 nt, Human; identical to SEQ ID NO: 203630

SEQ ID NO: 282058 - RNA, 64 nt, Human; identical to SEQ ID NO: 203631

SEQ ID NO: 282059 - RNA, 64 nt, Human
ccagauggcaaugccaccauuguugaugugacuccagagccaguuauuaggaagagcaagcuca

SEQ ID NO: 282060 - RNA, 51 nt, Human
uucaccagcaccacuucuagccagagccacuugcagacaucacggcagggg

SEQ ID NO: 282061 - RNA, 64 nt, Human
gcggcauccacagccagagaggcagaggcaagagcagagccaggcugugcccgagggaccccag

SEQ ID NO: 282062 - RNA, 64 nt, Human
gccugugccauccuggaaccuccaccuuugaacccagagccaggcugggcccuauuuaugagcu

SEQ ID NO: 282063 - RNA, 64 nt, Human
caccuccaugugacaaguuugacaccugucuacccagagccagugacugucccucccagcagcc

SEQ ID NO: 282064 - RNA, 64 nt, Human
guuuuuguuuuguuuuuuaacuugcaguauaucacagagccacucuucaaguagauuggcuggg

SEQ ID NO: 282065 - RNA, 64 nt, Human
auaaugggagauacaagauauuuggguggagacacagagccaaaccauaucacaccuuaagguc

SEQ ID NO: 282066 - RNA, 64 nt, Human
cccugacccugggauggcuggauugagcaaugagcagagccaagcagcacagaguccccugggg

SEQ ID NO: 282067 - RNA, 64 nt, Human
ggcaaaauagaggguaugaccugggguugcuggccagagccagggaggagccuuaagaagugaa

SEQ ID NO: 282068 - RNA, 64 nt, Human
ucaucucugcaagggacccugacgccugggagaucagagccacugacccuuuauggcacugcua

SEQ ID NO: 282069 - RNA, 64 nt, Human
aguuuccccacaugugaagacagguacaaaauagcagagccaagcagacagugggucuauucuu

SEQ ID NO: 282070 - RNA, 64 nt, Human
uuacuccccgagcccccagauucucaccuuugcccagagccacauucgggcuugucuuccucuu

SEQ ID NO: 282071 - RNA, 64 nt, Human
aauuagaguauuauuucuucaguguuauuguuuucagagccacauuuuguugcauauuugcuag

SEQ ID NO: 282072 - RNA, 64 nt, Human
aggaguugcccuuugccccccagagacugacucucagagccagagaugggaugugugagugugu

SEQ ID NO: 282073 - RNA, 64 nt, Human; identical to SEQ ID NO: 203632

SEQ ID NO: 282074 - RNA, 64 nt, Human; identical to SEQ ID NO: 203633

SEQ ID NO: 282075 - RNA, 64 nt, Human; identical to SEQ ID NO: 203634

SEQ ID NO: 282076 - RNA, 64 nt, Human; identical to SEQ ID NO: 203635

SEQ ID NO: 282077 - RNA, 64 nt, Human
gcaagugcagccucacgacagauaccaggcaauccagagccacaaaacgugauuccuccaggcu

SEQ ID NO: 282078 - RNA, 64 nt, Human
ggcuuucuguuaauagugguuuuucuccuguugacagagccaccggauuaugacacaggaugag

SEQ ID NO: 282079 - RNA, 64 nt, Human
ugcuuccagaguucuuaaugccucucuggcauuucagagccagcaucccccaacucccaccccu

SEQ ID NO: 282080 - RNA, 64 nt, Human
ucaugggacuguccccuuuagagaucccaccugucagagccacagcuucgggguccugucauca

SEQ ID NO: 282081 - RNA, 64 nt, Human
gaauggagcuuagugcuacugaauacccuggccacagagccaccucaggauauucuuuucucca

SEQ ID NO: 282082 - RNA, 64 nt, Human
cccagccaucugcuccuuaaucccuggagaggaacagagccaacuggacacagcguuggucucu

SEQ ID NO: 282083 - RNA, 64 nt, Human
auagugauuuccacagugacuccacucugagucccagagccaaucaguagccagcaucugccuc

SEQ ID NO: 282084 - RNA, 64 nt, Human
ccgagaucaugcgacugcacuccagccugggugacagagccagacucugucucaaaaaaaaaaa

SEQ ID NO: 282085 - RNA, 64 nt, Human
cauggcucguccccggaguuggggguacccguugcagagccagggacaugaugcaggcgaagcu

SEQ ID NO: 282086 - RNA, 64 nt, Human
cuacagcucacuucuaucagaggcccaggugccucagagccacauugaguugcuuuuucuggga

SEQ ID NO: 282087 - RNA, 57 nt, Human
ugccaaaagaacuggcguaagaggcaacagagccaucuagaagaacaagaaauggaa

SEQ ID NO: 282088 - RNA, 64 nt, Human
agacccugaacaagaauaacuugaucccugaugacagagccaacuucuacccauugcagcagac

SEQ ID NO: 282089 - RNA, 64 nt, Human
gaaggugccuggccaugucaccuggcugcuaggccagagccaugccaggcugcgucccuccgag

SEQ ID NO: 282090 - RNA, 64 nt, Human
agugcaugugcuugaguuaaaugugcagggcagacagagccagaagggccuguacccaggggcu

SEQ ID NO: 282091 - RNA, 52 nt, Human; identical to SEQ ID NO: 203636

SEQ ID NO: 282092 - RNA, 64 nt, Human; identical to SEQ ID NO: 203637

SEQ ID NO: 282093 - RNA, 64 nt, Human; identical to SEQ ID NO: 203638

SEQ ID NO: 282094 - RNA, 64 nt, Human; identical to SEQ ID NO: 203639

SEQ ID NO: 282095 - RNA, 64 nt, Human
aaaacauggaaaaguugccuuuauggaaacuuggcagagccagaguguacacauuccuaaacca

SEQ ID NO: 282096 - RNA, 64 nt, Human
ccuugcucuccccagccugccaagcccagcccuccagagccagcccuccuggguaccggcaacu

SEQ ID NO: 282097 - RNA, 64 nt, Human
ccagccuccuuuugcuuuggcaagcuggauuucucagagccagcauguuguuuccauaacuacu

SEQ ID NO: 282098 - RNA, 64 nt, Human
aaaggaagaaggaaguggcugaguuauuaauagccagagccacugggagacuggggagacuggc

SEQ ID NO: 282099 - RNA, 64 nt, Human
gcugaugagcagugcaggagcagggcgagaggaacagagccaaugauguguggguuacacugag

SEQ ID NO: 282100 - RNA, 64 nt, Human
cagcaauaugacugcuaaaagaaccaacccaggacagagccacaaucuuccucuauuucauugu

SEQ ID NO: 282101 - RNA, 64 nt, Human
uccaguuaaaugcuuugauauaguggcuccuuugcagagccaaaacaagauuuauuaaauuucc

SEQ ID NO: 282102 - RNA, 64 nt, Human
ugaaucacuuaaaugucaccuggcuaacugauggcagagccagagcuugaauucauguuggucu

SEQ ID NO: 282103 - RNA, 64 nt, Human
auacauucuguuucaacaguggguacaccccuaacagagccagugccaacaaaacauuuugaau

SEQ ID NO: 282104 - RNA, 64 nt, Human
uuguuaaucuuaugagaaccuuuuuauuuuuguacagagccaugguauaaauuaacagguuaau

SEQ ID NO: 282105 - RNA, 64 nt, Human
ugguggcaccuggaggacaugcaccaaggcuugccagagccaacaggaagugagcccagagcau

SEQ ID NO: 282106 - RNA, 64 nt, Human
gagccggcucaaguggcuaaagcauccuggggcccagagccaggugauaggucccucuggccaa

SEQ ID NO: 282107 - RNA, 64 nt, Human
uacauuuguaagaaauaacacugugaauguaaaacagagccauucccuuggaaugcauaucgcu

SEQ ID NO: 282108 - RNA, 64 nt, Human
aagacaaagaauacuggagaagagagagggugggcagagccacaaccucauccucccagugguu

SEQ ID NO: 282109 - RNA, 64 nt, Human; identical to SEQ ID NO: 203640

SEQ ID NO: 282110 - RNA, 64 nt, Human; identical to SEQ ID NO: 203641

SEQ ID NO: 282111 - RNA, 64 nt, Human; identical to SEQ ID NO: 203642

SEQ ID NO: 282112 - RNA, 64 nt, Human; identical to SEQ ID NO: 203643

SEQ ID NO: 282113 - RNA, 64 nt, Human
caaaugaugcccuggagaugucacagauuccuggcagagccauggucccaggcuucccaaaagu

SEQ ID NO: 282114 - RNA, 64 nt, Human
ccaccugugucgccuccacuggcagucacgccaccagagccacccuggcucccucuccucccug

SEQ ID NO: 282115 - RNA, 64 nt, Human
gccuucccagagucaaccuccugugacgcccucccagagccaaccucgggugacacccucccag

SEQ ID NO: 282116 - RNA, 64 nt, Human
cuacaguuaugucagcuacccagacuuaaugggccagagccaugacccucacaggucuuguguu

SEQ ID NO: 282117 - RNA, 64 nt, Human
ccccucugagucgucuuugcucauggacuugcagcagagccacguaguuuggcauuuugauuca

SEQ ID NO: 282118 - RNA, 64 nt, Human
acaacacauaaggaaucugaagcacaggagaacacagagccaacaaacagaaugaagaacaauc

SEQ ID NO: 282119 - RNA, 64 nt, Human
cugcuagaggcuaccccauuuuccuuuccacaaucagagccauuuuuguuaaaguggcaguuuu

SEQ ID NO: 282120 - RNA, 64 nt, Human
uuuccuaauuuuguuuaucacguuuugcacaaagcagagccacugucuaacacagcuguuaacg

SEQ ID NO: 282121 - RNA, 64 nt, Human
gagcagagacaugacucagccuguuccaugaaggcagagccauggaccacgcaggaagggccua

SEQ ID NO: 282122 - RNA, 64 nt, Human
ggucgcccugaagguuuuccaaagggcuuggcuccagagccaccuggcagacugcccguggccc

SEQ ID NO: 282123 - RNA, 64 nt, Human
uucuauuugaugaaguaagacuguggacucaauccagagccagauaguagggggaagccacagc

SEQ ID NO: 282124 - RNA, 64 nt, Human
ccgagaucaugccacugcacuccagccugggugacagagccagacuccgucucaaaaaaaaaag

SEQ ID NO: 282125 - RNA, 64 nt, Human
cuugccgagccuaaugaaagggaaagucagcuuucagagccagugaaggagccacgugaauggc

SEQ ID NO: 282126 - RNA, 64 nt, Human
cugagacugugccacugcaguccagccugggugacagagccagacacugucucggggaaaaaaa

SEQ ID NO: 282127 - RNA, 64 nt, Human; identical to SEQ ID NO: 196388

SEQ ID NO: 282128 - RNA, 64 nt, Human; identical to SEQ ID NO: 198081

SEQ ID NO: 282129 - RNA, 64 nt, Human; identical to SEQ ID NO: 198100

SEQ ID NO: 282130 - RNA, 64 nt, Human
aaugguauguagagcuuagauuucccuauugugacagagccaugguguguuuguaauaauaaaa

SEQ ID NO: 282131 - RNA, 64 nt, Human
gcagggcucuuugcuggagcagaggcccuucacccagagccaguguggucaguauuccaaacuc

SEQ ID NO: 282132 - RNA, 64 nt, Human
gaggaggguuccucuuaggucagauggagguucucagagccaaguccucccucucuacuggagu

SEQ ID NO: 282133 - RNA, 64 nt, Human
acccuucacuucccgagggcgggugaguggagagcagagccaggagcucuggcagcuguggaca

SEQ ID NO: 282134 - RNA, 64 nt, Human
caaguggcuuuccuugccuacuuuagucacccagcagagccacuggagcuggcuaguccagccc

SEQ ID NO: 282135 - RNA, 64 nt, Human
uucuuucaguuuuacugauguucugggugggggacagagccagauucagaguaaucuugacuga

SEQ ID NO: 282136 - RNA, 64 nt, Human
cuagagccccacccccgaccccaccccgggagggcagagccagaagaaggcucauuagaccugg

SEQ ID NO: 282137 - RNA, 64 nt, Human
uaccaauuaaauaacugagaccuaagucugggaacagagccacgaaucugccuuugagaugcug

SEQ ID NO: 282138 - RNA, 64 nt, Human
cuuuucugcaaguagcuggcuuguaaagggugaacagagccaugggaggaaggucuggcauugg

SEQ ID NO: 282139 - RNA, 64 nt, Human
agcgcucugggguucggagaguuugggaauuucucagagccaacuggcucaggcuugggaaggc

SEQ ID NO: 282140 - RNA, 64 nt, Human
aucucugggacaauggcuccuccagagggccccucagagccaggugcuggccagaugccuugau

SEQ ID NO: 282141 - RNA, 64 nt, Human
ccccccugugucucagcuaugcccggaccuccaucagagccagucucaccuucaaccgcggcuu

SEQ ID NO: 282142 - RNA, 64 nt, Human
uuauaauuuuaacuauaaagguccaauuguuucacagagccaguuugggaugggcugcauucca

SEQ ID NO: 282143 - RNA, 64 nt, Human
auagaaauguucaguaaugaaaaauauauccaaucagagccaucccuaaagaguguucucuugu

SEQ ID NO: 282144 - RNA, 64 nt, Human; identical to SEQ ID NO: 198137

SEQ ID NO: 282145 - RNA, 64 nt, Human; identical to SEQ ID NO: 198157

SEQ ID NO: 282146 - RNA, 64 nt, Human; identical to SEQ ID NO: 196424

SEQ ID NO: 282147 - RNA, 64 nt, Human; identical to SEQ ID NO: 282124

SEQ ID NO: 282148 - RNA, 64 nt, Human
cucuguauggucaggauguagggguuaacuuggucagagccacucuaugaguuggacuucaguc

SEQ ID NO: 282149 - RNA, 64 nt, Human
auagcagaagucccgggaagguaaaugccaaacccagagccaugugagauucugacuuugaucu

SEQ ID NO: 282150 - RNA, 64 nt, Human
ccagauugugucauuuggcuccaccuucaucuugcagagccagcugaucucagauugccaagaa

SEQ ID NO: 282151 - RNA, 64 nt, Human
agcacaauucugucccugucccugccccgccccccagagccagggcuguccuuagacuccuucu

SEQ ID NO: 282152 - RNA, 64 nt, Human
accaguguuccagucuuaaaguagacaaaauauucagagccauuuuuuuuaagggaaaugaaaa

SEQ ID NO: 282153 - RNA, 64 nt, Human
aaguaaacgucauuucuaacccaaaggcucuuuucagagccacuuaaacauacugaaacagcug

SEQ ID NO: 282154 - RNA, 64 nt, Human
uggucucucugacgguccaagcaaaggcucuuuucagagccaccaccuuuucaaguaaaguagc

SEQ ID NO: 282155 - RNA, 64 nt, Human
cugcccguuucuuccucauugaaaaggcucuuuucagagccacucacaauuucacuuaaaaaca

SEQ ID NO: 282156 - RNA, 64 nt, Human
gcuuagaagcccaacacaacccaaaggcucuuuucagagccacccaccgcucucaguaaaagag

SEQ ID NO: 282157 - RNA, 64 nt, Human
cugcaacugccuuaguaaacccaaaggcucuuuucagagccacucaccuuuucacaauuggagc

SEQ ID NO: 282158 - RNA, 64 nt, Human
gugaucccgagucccagaaaccaaaggcucuuuucagagccacccaccuuuucuguaaagugcu

SEQ ID NO: 282159 - RNA, 64 nt, Human
uuugaguacaaaccuuaaauccaaaggcucuucucagagccaaccacuuuguccgugaaaaggg

SEQ ID NO: 282160 - RNA, 64 nt, Human
aaauggacgcauguucaaacccaaaggcucuuuucagagccacuuaaugauuucaauuaagagu

SEQ ID NO: 282161 - RNA, 64 nt, Human
cugugggucccccuccccuguucaccuuccccaacagggcuauaguuuaagggugucccaggcc

SEQ ID NO: 282162 - RNA, 64 nt, Human
ggcaagaccucaauucuuggcugcaaaguuucaucagggcuagggggcuggugccgccucauag

SEQ ID NO: 282163 - RNA, 64 nt, Human
uuugucaaggggcuuugcauucaaacugcuuuuccagggcuauacucagaagaaagauaaaagu

SEQ ID NO: 282164 - RNA, 64 nt, Human
uuagauuuagaaguguguucuuuaauagaguguacagggcuaaaagaguauuuaaguuaauaug

SEQ ID NO: 282165 - RNA, 64 nt, Human
uccacccaacaaaugugauaagugaucaugcagccagagccagccuuccuucaaucaagguuuc

SEQ ID NO: 282166 - RNA, 64 nt, Human
cccacccaacaaaugugauaagugauugugcagccagagccagccuuccuucaaucaagguuuc

SEQ ID NO: 282167 - RNA, 64 nt, Human
gagguugugaaaacuggaaaacaaaggcucuuuucagagccauucuacacugucuuagagaaag

SEQ ID NO: 282168 - RNA, 64 nt, Human
gcaacucaaucccaaaggaaccaaaggcucuuuucagagccaccuacaauuuuguggaagaacu

SEQ ID NO: 282169 - RNA, 64 nt, Human
aggacucacugauuacauacccaaaggcucuuuucagagccacccacaugcgcgcugaaaagau

SEQ ID NO: 282170 - RNA, 64 nt, Human
ggucagucucggcccacaccccaaaggcucuuuucagagccacucagucuucccaaagagaacu

SEQ ID NO: 282171 - RNA, 64 nt, Human
ccauagaaucacuuuccaauacaacggcucuuuucagagccaccuacuauuucugcgggagagc

SEQ ID NO: 282172 - RNA, 64 nt, Human
cucucgcagcugccagcaauccaaaggcucuuuucagagccacucacgcuuccagagaaagagc

SEQ ID NO: 282173 - RNA, 64 nt, Human
ugcaccagugggaguggcuccacccuucccaccucagagccauggggagccagggcucuggcgg

SEQ ID NO: 282174 - RNA, 64 nt, Human
uacuacauuccagaugcccaccucauccaauuuccagagccacuaucucugcuguccacuuucc

SEQ ID NO: 282175 - RNA, 64 nt, Human
ccaugguggcagcagagaggcagaagugggaguccagagccaggaacagugaaggaugguuccu

SEQ ID NO: 282176 - RNA, 64 nt, Human
ucaggcuccccagaacuggcugggccccuggggacagagccaccccaugagcucgggguccacc

SEQ ID NO: 282177 - RNA, 64 nt, Human
cacagaaauaaucccucuguuuaacauguuuguucagagccaaggguuuauugugaagaacugu

SEQ ID NO: 282178 - RNA, 64 nt, Human
gacugugaacaaaucauucacaaacagaauaaaacagagccaacaacaguauuuuaagggucac

SEQ ID NO: 282179 - RNA, 64 nt, Human; identical to SEQ ID NO: 198062

SEQ ID NO: 282180 - RNA, 64 nt, Human; identical to SEQ ID NO: 197456

SEQ ID NO: 282181 - RNA, 64 nt, Human; identical to SEQ ID NO: 197513

SEQ ID NO: 282182 - RNA, 64 nt, Human
gaaaagacacacaagucgcguggguuggagaagccagagccauuccaccuccccucccccagca

SEQ ID NO: 282183 - RNA, 64 nt, Human
guuuuuuuaggguuucugauucuucaaagaggcacagagccaaauugguagaggaaggaugcaa

SEQ ID NO: 282184 - RNA, 64 nt, Human
aacacugcuuuaggcacuggggacacaaaggggacagagccauccuccuuugacaccuggucuu

SEQ ID NO: 282185 - RNA, 64 nt, Human
guggaccuggcuggauaugguuuuugccaauccacagagccauccugcccugacagcuagcaag

SEQ ID NO: 282186 - RNA, 64 nt, Human
agcuguuugagccacugcacgccagccugggugacagagccagacccugucuucaaaaaaauaa

SEQ ID NO: 282187 - RNA, 64 nt, Human
gacuucugugucagaaaaaacaaaaggcucuuuucagagccaccuaccgucucagaaaaaggcu

SEQ ID NO: 282188 - RNA, 64 nt, Human
uuuuucaucagucuuaaaacccaaaggcucuuuucagagccacccacuuauuccaacgaaagua

SEQ ID NO: 282189 - RNA, 64 nt, Human
cagacaaaaucagccuaacagcaaaggcucuuuucagagccaccuacgacuuccauuaaaugag

SEQ ID NO: 282190 - RNA, 64 nt, Human
uuauguaagcacuuccaaacccaaaggcucuuuucagagccaccuacuuugucacaaggagagc

SEQ ID NO: 282191 - RNA, 64 nt, Human
gaacgccuacuucuaaaacccaaaaggcucuuuucagagccaccacugaucucaauaaaagagc

SEQ ID NO: 282192 - RNA, 64 nt, Human
gaaugugugcuaaccaaaacccaaaggcucuuuucagagccaaccaccuuuucuauaaaaguug

SEQ ID NO: 282193 - RNA, 64 nt, Human
uuuuuaaggaagcagucuuaacaaaggcucuuuucagagccacccauguauuccuuaaaagggc

SEQ ID NO: 282194 - RNA, 64 nt, Human
gugcuuaggugcuuuaaaacucaaaggcucuuuucagagccacucaagucucacauaaagagcu

SEQ ID NO: 282195 - RNA, 64 nt, Human
acguuccccuuugaaaauuuuaaacggcucuuuucagagccacccacaggucucagucaaaaga

SEQ ID NO: 282196 - RNA, 64 nt, Human
gggucagacagacgggagaguccagaaacagacccagggcuacaggaauuuaguauaugguaag

SEQ ID NO: 282197 - RNA, 64 nt, Human
aaggaaagacggcuucccuggacaaagaagaccucagggcuacccaaggaaauaggaggagucu

SEQ ID NO: 282198 - RNA, 64 nt, Human
accaucugggcccuccgacuuccuucaaccaaaccagggcuagaguccugaccugccagugguc

SEQ ID NO: 282199 - RNA, 64 nt, Human
ggagacguguuacggcagagcaggugggcaaggccagggcuaccccaggcccauguggccuccu

SEQ ID NO: 282200 - RNA, 64 nt, Human
agggugugcgccaacuuaaaccaaaggcucuuuucagagccaccaacaauuucaguugaaagcg

SEQ ID NO: 282201 - RNA, 64 nt, Human
uucucaagcucuuguccaacccaaaggcucuuuucagagccacucacuauuaucuaaagaagag

SEQ ID NO: 282202 - RNA, 64 nt, Human
gaguugaaaagcgcauaaaaacaaaggcucuuuucagagccacuucaacaaucauaaaaagaug

SEQ ID NO: 282203 - RNA, 64 nt, Human
cucauaccucgguccaaaccaaaaagguucuuuucagagccaccuacuuuuucaccaaguagag

SEQ ID NO: 282204 - RNA, 64 nt, Human
gugaaaaccgcaacaaagccccaaaggcucuuuucagagccacccagagaccucuaaaaaaugg

SEQ ID NO: 282205 - RNA, 64 nt, Human
ucuuaauugcuuccaagcuuccaaaggcucuuuucagagccacuuacauucucacugaggauag

SEQ ID NO: 282206 - RNA, 64 nt, Human
aaaaauguaaacuuacaagacaaaaggcucuuuucagagccacccaccauuucuacggaagaac

SEQ ID NO: 282207 - RNA, 64 nt, Human
uacuuucuucccuuaaaucaugguauucuucugacagagccauauguacccuacccugcacauu

SEQ ID NO: 282208 - RNA, 64 nt, Human
uucaccugcugucccuucuuaacacccaggcccccagagccagcugggccuguccagcagccac

SEQ ID NO: 282209 - RNA, 64 nt, Human
uggaaauggugaaggaaccagcccaauagaaguacagagccagcugacaaguccuuguaaagcu

SEQ ID NO: 282210 - RNA, 64 nt, Human
cuguuuuuauauaccuggaaucuguuguuggcuucagagccagugguuaaagagcaggguccca

SEQ ID NO: 282211 - RNA, 64 nt, Human
auaagauaggaagagucuggaucucugaugaucacagagccauccuaacaaacggaauaucacc

SEQ ID NO: 282212 - RNA, 64 nt, Human
cccugccacccucccuggcacguuuauuucacagcagagccaagucuguggcagguugacacag

SEQ ID NO: 282213 - RNA, 64 nt, Human
auauaccugccugagauaggcugguccucaccuccagagccagccagccccgucaggggccaaa

SEQ ID NO: 282214 - RNA, 64 nt, Human
cugcccuccucugcaccugaccacacucccuacucagggcuagucuguucuucccggacaucuu

SEQ ID NO: 282215 - RNA, 64 nt, Human
ucucauggcuggguggcugguguuccugaagacccagggcuacccucuguccagcccuguccuc

SEQ ID NO: 282216 - RNA, 64 nt, Human
ccugcaggagggcaggcgagacaaggaggguguccagggcuagggagugccggaugaaaccagc

SEQ ID NO: 282217 - RNA, 64 nt, Human
cuggcucaggcagagggagaugguuagacucuugcagggcuaaaacucuaauuuggaauugaau

SEQ ID NO: 282218 - RNA, 64 nt, Human
gugcccagcguuuaucagaggcagcauccaagcccagagccagugucgacucuucggcuggugc

SEQ ID NO: 282219 - RNA, 64 nt, Human
cuccaaauggcugggguaggaaugguuguuggggcagagccaguggaggugagugacccugaga

SEQ ID NO: 282220 - RNA, 64 nt, Human
ccaagauuguaccacugcauuccaaccugggcgacagagccagaccuugucucaaaaaaaaaaa

SEQ ID NO: 282221 - RNA, 64 nt, Human
caagccacccucccaaaaugcugugauuauaggccagagccauuguucccaggcucaauucauu

SEQ ID NO: 282222 - RNA, 64 nt, Human
ccaagccuagaggauccuuccaaaccagcaccaacagagccaaggccuugggagcagcagugcu

SEQ ID NO: 282223 - RNA, 64 nt, Human
ccugaaucccuuucaguuuguccacacaagacagcagagccaucugcgacaccaccaacaggcg

SEQ ID NO: 282224 - RNA, 64 nt, Human
guacgauguuugcugugcuucccgccguggagggcagagccaccccacaucaggaucggacgug

SEQ ID NO: 282225 - RNA, 64 nt, Human
aggagaauagccugaaccugggaaucggagguugcagagccaagaucgccccacugcacuccag

SEQ ID NO: 282226 - RNA, 64 nt, Human
gaaaguggcuaugcaguuugaauauccuuuguuucagagccagaucauuucuuggaaaguguag

SEQ ID NO: 282227 - RNA, 64 nt, Human
cacuccaggcuuucauaugcccaugucuucugagcagagccaccauuuuuuauaauuucuaaua

SEQ ID NO: 282228 - RNA, 64 nt, Human
cucagagcuugguggcucaagacuguuagccuggcagagccaggggugaagggagaagcucuug

SEQ ID NO: 282229 - RNA, 64 nt, Human
cucagcugggacaguggggacccaggcuucuccucagagccaggcccugacuugccuucuccca

SEQ ID NO: 282230 - RNA, 64 nt, Human
augagauacugugcuucccaccuccccuucaguucagagccaaaaugggucuagaaucuggcac

SEQ ID NO: 282231 - RNA, 64 nt, Human
aaucauaaucuuaaaaucaggaauguguggagaacagagccaugucauaucacuuugcucuuac

SEQ ID NO: 282232 - RNA, 64 nt, Human
ggagcucaaauuguuggggccccucuaccucucucagggcuagaacugccugacucuuggugga

SEQ ID NO: 282233 - RNA, 64 nt, Human
uugaucugcucagugugagcgguuugcuguuagccagggcuauuuauggcaaacacaugcuuuu

SEQ ID NO: 282234 - RNA, 64 nt, Human
gaaugaccagggcgaaguuagucucacagaauaccagggcuagaagacaucguggagcccaugg

SEQ ID NO: 282235 - RNA, 64 nt, Human
ugguucgauaccuggagcagaggaggggaaaguccagggcuauagggugugaugaagucacccc

SEQ ID NO: 282236 - RNA, 64 nt, Human
gcucaggcauaauucagcauaagaaaauucacaccagagccaaaucuuacaaauguagcaguug

SEQ ID NO: 282237 - RNA, 64 nt, Human
uggcucuucgcaugcugaguacuggaccucggaccagagccauguaagaaaaggccuguucccu

SEQ ID NO: 282238 - RNA, 64 nt, Human
ggaagcauucagagagcagcuuuaaacucagggacagagccaugcugggaagacgccugagcuc

SEQ ID NO: 282239 - RNA, 64 nt, Human
ggaguauagugauguuguccugaauaaggagauccagagccagcagcggcuggagagccugucc

SEQ ID NO: 282240 - RNA, 64 nt, Human
uuagcugaugaaaauaggcacucacaaugacaaccagagccaguuucuugucuuuuuuauacau

SEQ ID NO: 282241 - RNA, 64 nt, Human
agcugcagguuuuuugaacucacuucuggaggugcagagccacaaacgcacuuucggggccuag

SEQ ID NO: 282242 - RNA, 64 nt, Human
gaggaaugccaguguuaccuuacgcuucuagaagcagagccacuccagccagaacccauuuugc

SEQ ID NO: 282243 - RNA, 64 nt, Human
uuucuguuuagugauucccugacccaguuucaaacagagccaucuuuuacagauuauuuuggag

SEQ ID NO: 282244 - RNA, 64 nt, Human
uuuugacuuaagaaugacaucuuuagaugcauuucagagccaaugaugauauuugcuuuagaua

SEQ ID NO: 282245 - RNA, 64 nt, Human
cccaucccuacucccagccccuucucccaggguccagagccaggaccccuuaaucuagguaaau

SEQ ID NO: 282246 - RNA, 64 nt, Human
cccacggagcgggcuugaacagggaccaccccugcagagccagccagggcggagagccauaccc

SEQ ID NO: 282247 - RNA, 64 nt, Human
uuggagcucuugggucagagaaaaugagaaaggacagagccagcggcuccaacuccuuucagcc

SEQ ID NO: 282248 - RNA, 64 nt, Human
auuucuagugccuugugcucacuccugcucucuacagagccagccuggccugggcauuguaaac

SEQ ID NO: 282249 - RNA, 64 nt, Human
ugcccugccucucgugccggguguugcuucagcccagagccagagggcugggucccggguccuc

SEQ ID NO: 282250 - RNA, 64 nt, Human
gcccugcuuggccguggucacuggccgccaagaucagggcuacagaugucugcucucuggaccc

SEQ ID NO: 282251 - RNA, 64 nt, Human
uagccugaguguccacagggacacacgugagccacagggcuagaagcacaggcccgucacccca

SEQ ID NO: 282252 - RNA, 64 nt, Human
uggcccagcuggcuuccccagccccucagccauccagggcuacccacugcuuacucagggacca

SEQ ID NO: 282253 - RNA, 64 nt, Human
cauggagacagcaguuuccagagaguggagagagcagggcuaaauaaagaggagauaagguggc

SEQ ID NO: 282254 - RNA, 64 nt, Human
aagugacuugcccaaggucagagccacuuggugacagagccaggaugagaacaaagauuccauu

SEQ ID NO: 282255 - RNA, 64 nt, Human
gagaccugaagaggguaagugacuugcccaaggucagagccacuuggugacagagccaggauga

SEQ ID NO: 282256 - RNA, 64 nt, Human
ccuuagacucacgaacaaauccaccugagaucagcagagccacccuagaucagcugaaacucua

SEQ ID NO: 282257 - RNA, 64 nt, Human
ucugcagaacgcaucaguuucuauucugcaguugcagagccagccccgcgugagaacgugcaua

SEQ ID NO: 282258 - RNA, 64 nt, Human
agcggcuugcacgcagacuugcuaggaagaaaugcagagccagccugugcugcccacuuucaga

SEQ ID NO: 282259 - RNA, 64 nt, Human
aacauuuaugugugaagccaaaaucacccugcagcagagccaauacugaucaacugaaaguaaa

SEQ ID NO: 282260 - RNA, 64 nt, Human
cuaacuguaugugucuuuaucagugauggucucacagagccaacucacucuuaugaaaugggcu

SEQ ID NO: 282261 - RNA, 64 nt, Human
auuccccagugggcaguuacugagcuuuccuccucagagccaugcuggcagcccugggacagag

SEQ ID NO: 282262 - RNA, 64 nt, Human
uagguguaaaagauggagucccacggaggaggggcagagccaggaggcaguggggcugugggcu

SEQ ID NO: 282263 - RNA, 62 nt, Human
gaagccagagcuucuacugaggagggcuguggcagagccacugucacacagaaugccggagg

SEQ ID NO: 282264 - RNA, 64 nt, Human
caucuguaugcauuccugucauuacccauuguaacagagccacaaacuaauacuaugcaauguu

SEQ ID NO: 282265 - RNA, 64 nt, Human
ccucuccagagcaucauuccuuucuaucugcugccagagccacggugccauuuacuccaaggac

SEQ ID NO: 282266 - RNA, 64 nt, Human
uaugugacgcaguccucucaggagucugaguuuacagagccaacuugcagcaccugguuaugcc

SEQ ID NO: 282267 - RNA, 64 nt, Human
cggcggccaggcacagggcccgcagugcugggaccagagccagaugcaggacaggaggcggccc

SEQ ID NO: 282268 - RNA, 64 nt, Human
cagugaggcuaugaaauugccagugaauuaagaccagggcuagagucaacaguccagaaccccu

SEQ ID NO: 282269 - RNA, 64 nt, Human
uucagcuccaccuggggcacccagcaccccaccacagggcuagaggcccuaagacccugaaaaa

SEQ ID NO: 282270 - RNA, 64 nt, Human; identical to SEQ ID NO: 196429

SEQ ID NO: 282271 - RNA, 64 nt, Human; identical to SEQ ID NO: 197534

SEQ ID NO: 282272 - RNA, 64 nt, Human
gacaaggauaaaggaauaugauuuuccagagccccagagccagcucaucuuccaggugcugaaa

SEQ ID NO: 282273 - RNA, 64 nt, Human
uauucucauuuuccuuuuaccuuucuccaccauccagagccacaaaagcaaaccuucuaccucc

SEQ ID NO: 282274 - RNA, 64 nt, Human
uuguacuuuuccagacucuucugcaccauggagccagagccaguccagcccggcaugcuuaucg

SEQ ID NO: 282275 - RNA, 64 nt, Human
cacccugggccccaagcaugacucauccagguuccagagccaaaguggacugaacauggaaaga

SEQ ID NO: 282276 - RNA, 64 nt, Human
ugcucucucuucccagugcagauccacucaucagcagagccagauugugccaacuauccaaaaa

SEQ ID NO: 282277 - RNA, 64 nt, Human
aagcccgccccgcuggccgccagcugcccguccccagagccacugcagcaggagucgggcccug

SEQ ID NO: 282278 - RNA, 64 nt, Human
ccucaaauccggcugaggcagcagcuggcaccaucagagccaggagagugacaacagguaacgg

SEQ ID NO: 282279 - RNA, 64 nt, Human
gacuuccggcgccgccgcccucucccggcauccgcagagccagcugacgcccucccugccuccc

SEQ ID NO: 282280 - RNA, 64 nt, Human
caagcucaugggacacccagagcagaagcuagggcagagccaaugcugagggagccucgacuuc

SEQ ID NO: 282281 - RNA, 64 nt, Human
ucagacacacccaggcuugauuuggauccacaggcagagccaagggaaggugugauucucugag

SEQ ID NO: 282282 - RNA, 64 nt, Human
gagguuguagugagccaagauccagccugggcgacagagccagacucuugucucgaggggaaaa

SEQ ID NO: 282283 - RNA, 64 nt, Human
agugucuuaaauuuucuuccuuugaagcuuuaggcagagccauaauggacuaaaacauuuugac

SEQ ID NO: 282284 - RNA, 64 nt, Human
ucuaaacuuuauuccaagucagaaacuguuucugcagagccacucucuccccugcuccauuucg

SEQ ID NO: 282285 - RNA, 64 nt, Human
accccacccuguuccuuuuuuaucaggaggacuucagagccaggccugcagcauuuuguuugaa

SEQ ID NO: 282286 - RNA, 64 nt, Human
acuucauuuccugaagggucaccaagggucagcucagggcuaggaaaaaccauuuccagccuua

SEQ ID NO: 282287 - RNA, 64 nt, Human
cugguggggaaccagaaacucccugucuuuggggcagggcuaaagcagcuccuaaggaccacug

SEQ ID NO: 282288 - RNA, 64 nt, Human
gcaagaagggacccuuccaggaugacacuaggaacagggcuagggcacucgcucagucccuagg

SEQ ID NO: 282289 - RNA, 64 nt, Human
agccagcgggucagcccagaggcagccucagcuccagggcuaaggacucucggcucccauuuuc

SEQ ID NO: 282290 - RNA, 64 nt, Human
uggguaagaagggugggaguggggccuuugccagcagagccagggcagggcgagcugcaggaau

SEQ ID NO: 282291 - RNA, 64 nt, Human
ccaccugaaggguggaugugcuggagggguggcccagagccauacugcguccacccugagcucg

SEQ ID NO: 282292 - RNA, 64 nt, Human
ggaggauacaggcacacgggcacccagccccucucagagccaggcgugucuugacgguaucugc

SEQ ID NO: 282293 - RNA, 64 nt, Human
gcaucugaagacaucuaacuuagagucugcagcccagagccacaugcaaaacaccuucaauaaa

SEQ ID NO: 282294 - RNA, 64 nt, Human
agauucucaagcagaugcccaagggagguccccacagagccagagugccugaggcuuccugcuu

SEQ ID NO: 282295 - RNA, 64 nt, Human
gcagagccuccggcacccaguggccucccccagacagagccaccccugccgugggaaccugucc

SEQ ID NO: 282296 - RNA, 64 nt, Human
aaggcuaggaggcggcgucagaggugcugggugacagagccaugagccagccauuuuauaagca

SEQ ID NO: 282297 - RNA, 64 nt, Human
uggguauuuucucauuuccaaagacccagagucucagagccagguuaaguggaagaaacuuuga

SEQ ID NO: 282298 - RNA, 64 nt, Human
cccugcacccgcuaccacaccagcucagccacagcagagccaaucacagacccaccacacagcc

SEQ ID NO: 282299 - RNA, 64 nt, Human
aguucuuagccaguugagccagcgacaacagcaccagagccaggcagucacuguuccuccuccu

SEQ ID NO: 282300 - RNA, 64 nt, Human
ccccccaaccccugugcccccaucaucuggaccccagagccagcccucccacuaccaccaccac

SEQ ID NO: 282301 - RNA, 64 nt, Human
cuaccuucacuggcauuuccauaguccuggaauccagagccaaguggccuaucuaaaauucaca

SEQ ID NO: 282302 - RNA, 64 nt, Human
uccuuguuuuauuugcaagugcuucugacaucaccagagccagccccaugccaggaacuaagga

SEQ ID NO: 282303 - RNA, 64 nt, Human
caaguggaaggaagauuugguuugguuuuauucucagagccauuaaacacuaguucaguaugug

SEQ ID NO: 282304 - RNA, 64 nt, Human
gaugguauaauuuacaauuuggagauuuaauaaccagggcuacccagaaaaagugacuugauaa

SEQ ID NO: 282305 - RNA, 64 nt, Human
ugugggauucuguguaguucuucacuaucuguuccagggcuagucggaggaucauaagcaagcu

SEQ ID NO: 282306 - RNA, 64 nt, Human
agaaaugaacuuuugauuaguauggugccagucacagggcuauuuuccugaauauugggugaug

SEQ ID NO: 282307 - RNA, 64 nt, Human
gaggcaucgcauuacccaacuucaaacuauacuacagggcuacaguaaccaaaacugcaugaua

SEQ ID NO: 282308 - RNA, 64 nt, Human
ugggacaaucugcuaguaucuauuuuacaaaaugcagagccaggucccucagcccagacucagu

SEQ ID NO: 282309 - RNA, 64 nt, Human
aggaagucuaaccaaggaacaagaaucucacuaucagagccacaaaucugggaccugucuuucc

SEQ ID NO: 282310 - RNA, 64 nt, Human
cggccacaccaccacaugcccaaguguacacacacagagccacaccgucccucugggccugcug

SEQ ID NO: 282311 - RNA, 64 nt, Human
caccuccccgcugggaagagaagagggcccagcccagagccaccuggaucuaucccugcggccu

SEQ ID NO: 282312 - RNA, 64 nt, Human
cgugcaccagaacuccgucuuccacugccccacgcagagccaggcugcaguagccgagagcuuu

SEQ ID NO: 282313 - RNA, 64 nt, Human
cccgggggggacugcaaaccgcucaggguugcggcagagccauggacuuccggucccugcaacg

SEQ ID NO: 282314 - RNA, 64 nt, Human
cagccuagguucccauuuggggacuucaggaccccagagccacuaggacuuccuugggaagccc

SEQ ID NO: 282315 - RNA, 64 nt, Human
cugcccauuggccaugcugggagccacagcuauccagagccagcaugaccuggggcuugguuuc

SEQ ID NO: 282316 - RNA, 64 nt, Human
ggggaggugucagaccucgggaggcagacgggaccagagccaggcuguucacugugggcccacu

SEQ ID NO: 282317 - RNA, 64 nt, Human
uauagcuggggcgagggggcaggccccccuugugcagagccaggggucugagggcaccuggcug

SEQ ID NO: 282318 - RNA, 64 nt, Human
gucagugcauuauguugaaugagguccaggaacccagagccacccagcagacaccacuguggcu

SEQ ID NO: 282319 - RNA, 64 nt, Human
cuagggagccuggucaucaacuugcaauaccucacagagccaguucacaucccacucugagcuc

SEQ ID NO: 282320 - RNA, 64 nt, Human
accugggagccugugcccucagaccgccccgcaccagagccacgggcuguggggcggggagccc

SEQ ID NO: 282321 - RNA, 64 nt, Human
gcccuacguccagagggagaggagccgacacccccagagccagugccccaucuuaagcaucagc

SEQ ID NO: 282322 - RNA, 64 nt, Human
agcugugaaaggauccacauuaauucuucagaggcagggcuaagacuuucaagacugaaaagag

SEQ ID NO: 282323 - RNA, 64 nt, Human
ccaacucaguagcuccaguguaugaaaaugucuccagggcuaaaggcuggagaucucaccagug

SEQ ID NO: 282324 - RNA, 64 nt, Human
ugaggaggguggggggaagugaaggaaagacaagcagggcuaauuccaaaaagcaaggcuagaa

SEQ ID NO: 282325 - RNA, 64 nt, Human
uggauccgcuguguccagcccggcugagcaucgccagggcuagcucaugcugcucuugucagcc

SEQ ID NO: 282326 - RNA, 64 nt, Human
gucucuuggacaaccccaggaacuuggaccaaggcagagccaaucuugcaaacuggccauggau

SEQ ID NO: 282327 - RNA, 64 nt, Human
ucgcaagcugggcccaguccucucaucccaagagcagagccaccguagccggaguccuagccuc

SEQ ID NO: 282328 - RNA, 64 nt, Human
aggugcucccucaggaucaggugcccugcagacccagagccaguuccuauccccuaaccuaaac

SEQ ID NO: 282329 - RNA, 64 nt, Human
acagguggugucacugucccuccuggugucaccccagagccacacaugggcaucuaugggagag

SEQ ID NO: 282330 - RNA, 64 nt, Human
guaaggcucagccuacagaaagauuugaaauggccagagccaaucgcuuggugcauucugcgua

SEQ ID NO: 282331 - RNA, 64 nt, Human
aagccuccuuagugcccuggggcugauggucacccagagccauagagcacccuuccuccugggc

SEQ ID NO: 282332 - RNA, 64 nt, Human
ccaagaucacgccacugcacuccagcuggagugacagagccaaacuccgucaaaaaaaaacaaa

SEQ ID NO: 282333 - RNA, 64 nt, Human
aggcuacgauauuuucuuauugcaaagcuucagucagagccauuacccuuucaagccccugguc

SEQ ID NO: 282334 - RNA, 64 nt, Human
agagaaguugggauuaaaagcagucucggaaacacagagccaggaauauagccuuuuggcaugg

SEQ ID NO: 282335 - RNA, 64 nt, Human
uccauacaaucugggccugguggagucuucgcuucagagccauucggccaggugcgggugaugu

SEQ ID NO: 282336 - RNA, 64 nt, Human
caccccuccccgcauguaacccaaaagagguguccagagccaaggcuucuaccuucauuguccc

SEQ ID NO: 282337 - RNA, 64 nt, Human
ggcaaaaugagcuuccaccucuguccacucccugcagagccaauauagucgugcuuccaccucg

SEQ ID NO: 282338 - RNA, 64 nt, Human
cuguaaggaagcagucgauccuagagugucagaacagagccauucucuccuccugaguaggaac

SEQ ID NO: 282339 - RNA, 64 nt, Human
agggaauggaccagggagucccaggccugggacccagagccaagaaagcugagauauccugugc

SEQ ID NO: 282340 - RNA, 64 nt, Human
agagcuugucuuucaaggcagguuccuggggcuucagggcuaggagggaggagccugcccuuuu

SEQ ID NO: 282341 - RNA, 64 nt, Human
augcggcucaagucacucagaggcuguugcauuucagggcuauguugguccuuuguuuaccucc

SEQ ID NO: 282342 - RNA, 64 nt, Human
cuuccuuagauuccuuacagccuccggcggcucacagggcuagaaguccagaacauguaugugg

SEQ ID NO: 282343 - RNA, 64 nt, Human
gaaggugaaggugaaggugagacccuguagggcacagggcuaauuaguggacaagggaaggggg

SEQ ID NO: 282344 - RNA, 64 nt, Human
agagcuucagcuaagaggaggcucugucccuuuucagagccaaaggaaauaauacaacaaaaag

SEQ ID NO: 282345 - RNA, 64 nt, Human
caaacccugccucugaggggagacugaggaagggcagagccagaagcaagccgugccaggccau

SEQ ID NO: 282346 - RNA, 64 nt, Human
ucucaguugauuuucuggauuccccaucucaggccagagccaaggggcuucagguccaggcugu

SEQ ID NO: 282347 - RNA, 64 nt, Human
acaaagcaagcaccaucugggauuggcacacuggcagagccaguguguugggguaugugcugca

SEQ ID NO: 282348 - RNA, 64 nt, Human
uagcuuuuauguacugacuucauaaaagccaucucagagccauugauacaagucaaucuuacua

SEQ ID NO: 282349 - RNA, 64 nt, Human
ugcauuggcuacuucaagucucuuuuaccccuggcagagccaguugcagugcaauuuuuuguac

SEQ ID NO: 282350 - RNA, 64 nt, Human
ccagcaccuggcccagguaacagccuucugaaagcagagccaaggagcugcuucucucuucucc

SEQ ID NO: 282351 - RNA, 64 nt, Human
gcuacuuauggccggucacaauccagcacucagacagagccaaggcaauauccucuugcccaug

SEQ ID NO: 282352 - RNA, 64 nt, Human
ggggguccgcaucccuaccucagcuuaggacccccagagccaagguggcugggaucuggcccca

SEQ ID NO: 282353 - RNA, 64 nt, Human
ccaugauuacuccacugcacuccagccugggcaacagagccaggcccuguaucaaaaaaaaaaa

SEQ ID NO: 282354 - RNA, 64 nt, Human
gcggcuggagcuggagcgggcacagcuggagaugcagagccagcagcugcgcgaguccaaccag

SEQ ID NO: 282355 - RNA, 64 nt, Human
gcccaaccccaguuuaggggaagguagcacagggcagagccacugggcacuuuguuuccuuggc

SEQ ID NO: 282356 - RNA, 64 nt, Human
ccggcccagccaggccaucucacguguacauaaucagagccacaauaaauucuauuucacaccc

SEQ ID NO: 282357 - RNA, 64 nt, Human
gucuugugggccaaagggaaaaacaggcaggggucagagccagccugccagaggcaaaugcaaa

SEQ ID NO: 282358 - RNA, 64 nt, Human
uuccuggugguaccaucccuauuuccuggagcaccagggcuaaauggggagcuaucuggaaacu

SEQ ID NO: 282359 - RNA, 64 nt, Human
gagaaaggaaugaaauccauucaggaaauaucgacagggcuacacgugauguccccaaacugcu

SEQ ID NO: 282360 - RNA, 64 nt, Human
uaaccucccucaucucuaacugcccccacggggccagggcuaccccagaacuuuuaacucuucc

SEQ ID NO: 282361 - RNA, 64 nt, Human
uuuuuuuuaaaaauggugggggugggugggugcccagggcuaggggcuauucccugucucugug

SEQ ID NO: 282362 - RNA, 64 nt, Human
accauagacucaguggccuggccuccccagaccccagagccaagaacacuaagcacucgccggc

SEQ ID NO: 282363 - RNA, 64 nt, Human
caagcccaggagaggaaggcagagugugacagagcagagccagggccaggcgcaccaggagagg

SEQ ID NO: 282364 - RNA, 64 nt, Human
aggcuucacccucccugccuaagcagggugggggcagagccaugacauuuuugguuuaaaggag

SEQ ID NO: 282365 - RNA, 64 nt, Human
aaaauuuauggagauagguaggucauuaugauugcagagccaaaauagcaaaacaaacauauua

SEQ ID NO: 282366 - RNA, 64 nt, Human
aguauguuucuuuguaacaucuuuagcaguaggacagagccauacaugugaaaucugauuuuua

SEQ ID NO: 282367 - RNA, 64 nt, Human
ucagaccccuuugccaggggcuuugggggcugagcagagccacauccagagugggguaauagcu

SEQ ID NO: 282368 - RNA, 56 nt, Human
cagagauccagaugguuugaaggccgcagagccagaccauuucuuccccagguccu

SEQ ID NO: 282369 - RNA, 64 nt, Human
uacuccuagaucuuuugguuuuauccccuggccucagagccauuuauauucccagaguaggcag

SEQ ID NO: 282370 - RNA, 64 nt, Human
guaggcguugggguuaguaucucucgggugcccucagagccaccucugccugugaucgucugau

SEQ ID NO: 282371 - RNA, 64 nt, Human
agacagggaacagcuucaggauacuuccaggagacagagccaccagcagcaaaacaaauauucc

SEQ ID NO: 282372 - RNA, 64 nt, Human
ccaaccacacccggugggggcacagcacagaccccagagccaggaaccucucagccgaugcccc

SEQ ID NO: 282373 - RNA, 64 nt, Human
ccagccacacccagugggggcacagcacagaccccagagccaggaaccucucagccgaugcccc

SEQ ID NO: 282374 - RNA, 64 nt, Human
gcacauaaaaccaguuauaggacacaguuggaagcagagccagucuuccuccucagucuucuca

SEQ ID NO: 282375 - RNA, 64 nt, Human
gaggcagcuuugcccuguccaccuguugggugggcagagccaccaggaacccagacaccaccuc

SEQ ID NO: 282376 - RNA, 64 nt, Human
guaacauccauguauucuucaacaauggauugaucagggcuacucagaaggcugaggcggaagg

SEQ ID NO: 282377 - RNA, 54 nt, Human
aggucacaugugcugcuuaaaauucagggcuaagcauuuugggugauuuuaaac

SEQ ID NO: 282378 - RNA, 64 nt, Human; identical to SEQ ID NO: 197629

SEQ ID NO: 282379 - RNA, 64 nt, Human; identical to SEQ ID NO: 197838

SEQ ID NO: 282380 - RNA, 64 nt, Human
acaggugcacccuucccacacccuuuacauuccccagagccaagggaguuuaaguuugcaguua

SEQ ID NO: 282381 - RNA, 64 nt, Human
gagcaaagggaacagugaggugcccagcuagcugcagagccacccuguguugacaccucgcccc

SEQ ID NO: 282382 - RNA, 64 nt, Human
gccaugggaggccuuucccuaagccagcugcccccagagccacaguuccccuauguggaagugg

SEQ ID NO: 282383 - RNA, 64 nt, Human
ggccuaugagguugcuugcugcugggaagccuggcagagccaauuaccacccucugcugcuuag

SEQ ID NO: 282384 - RNA, 64 nt, Human
aagggcucuccccacugcuucgugauuccagggccagagccaugcagucccagaaaccccaacc

SEQ ID NO: 282385 - RNA, 64 nt, Human
cccugcgucccgcgucuggguucucagcuauuuccagagccagcucaaaucaggguccaguggg

SEQ ID NO: 282386 - RNA, 64 nt, Human
agcccuccacuggucuggccagaugcacugggaacagagccacggguccuggguccuagaccag

SEQ ID NO: 282387 - RNA, 64 nt, Human
aaggcccagaggaaguuaagggagagucaaugggcagagccagggcuaggcccugguggugugu

SEQ ID NO: 282388 - RNA, 64 nt, Human
caagaaucucccagucugguaggagagagugcugcagagccacguggccgccacgcagugugcu

SEQ ID NO: 282389 - RNA, 64 nt, Human
aaaugguggaggauugcugccagagaagucuggucagagccacagggucugccuccagccaaac

SEQ ID NO: 282390 - RNA, 64 nt, Human
gcucagauuuuccuggcuuugggagcagacagaccagagccaccagccauucagaaaacuucuu

SEQ ID NO: 282391 - RNA, 64 nt, Human
cuucucuggcuccucagucuccaguuugaagcaacagagccaucauuuucccagugggaggggc

SEQ ID NO: 282392 - RNA, 64 nt, Human
cggcgcccaucuccacccgcacggcucgccgguccagagccaugagccaagagcccucuucacg

SEQ ID NO: 282393 - RNA, 64 nt, Human
ugagucccagcugcauuagguuaagagacucuuccagagccagcgccaggucuugaauggcacc

SEQ ID NO: 282394 - RNA, 64 nt, Human
aaguagcuuggggaagcugaauaaacucuaggcccagggcuacuaaagacuucaggauagaauu

SEQ ID NO: 282395 - RNA, 64 nt, Human
caacaagguuggcaccccagcuaccccuucuuugcagggcuaaggcccccaaacauagccccug

SEQ ID NO: 282396 - RNA, 64 nt, Human
guuuuucuuauagauguuagcccugcccaacagccagggcuacacuacaaaaggcaagaaugcc

SEQ ID NO: 282397 - RNA, 64 nt, Human
gccaguguuauugaggugaucaagaucuguuccacagggcuaaugccaccaucuccccucaaaa

SEQ ID NO: 282398 - RNA, 64 nt, Human
cuggggagggaaagcgccuuuuccugcagcucuucagagccacagaccucaggguggagugagc

SEQ ID NO: 282399 - RNA, 64 nt, Human
cccugacucuccagcuuccaggaagguuccuucucagagccaaauacucuuugugcaagugccu

SEQ ID NO: 282400 - RNA, 64 nt, Human
cuuccugagcagaagaacuggagaaagggaaccacagagccaggaggaaugucugagcagaguc

SEQ ID NO: 282401 - RNA, 64 nt, Human
gagucugaggccccaggcccuaggauuccucccccagagccacuaccuuuguccaggccugggu

SEQ ID NO: 282402 - RNA, 64 nt, Human
cacccuccccccaccgugcccuuggccugccacccagagccaagagggugcugcucaguugcag

SEQ ID NO: 282403 - RNA, 64 nt, Human
gacaugaugggaaucucauucccaccucucauagcagagccaaaccuuuaguguuggugguagg

SEQ ID NO: 282404 - RNA, 64 nt, Human
ucauugccuccuuuuccaggcagcucuauucuugcagagccauagcaggacauguuaaaauucc

SEQ ID NO: 282405 - RNA, 64 nt, Human
gacggagcugaagaccaucaacgacuuucucuuccagagccagaucgacaacaucaaccuguuc

SEQ ID NO: 282406 - RNA, 64 nt, Human
caguguguaaauaauuugcacugaaacguggauacagagccacgaguuuggauguuguaaauaa

SEQ ID NO: 282407 - RNA, 64 nt, Human
aucaagucggcacuggggaagcaggcagcggucccagagccacccugugguccugauagcuccu

SEQ ID NO: 282408 - RNA, 64 nt, Human
uccuuugcaucucuuaaauguugggggugggggucagagccaguuauccggcuucuguuuuguc

SEQ ID NO: 282409 - RNA, 64 nt, Human
guccucuuucuuggggaaguugaggagugcccuucagagccaguagcaggcagggguggguagg

SEQ ID NO: 282410 - RNA, 64 nt, Human
uugucaucuucacucuccacccccagagaggagucagagccauaacucaaucacucagccccuc

SEQ ID NO: 282411 - RNA, 64 nt, Human
augaaggaacuguguaucucaaaaaccauauuuccagagccacaaacaugaggaccaaaaagga

SEQ ID NO: 282412 - RNA, 64 nt, Human
aggcagcuccugcccccgccuucccucacugaggcagggcuagcaggggugggaggcagugggg

SEQ ID NO: 282413 - RNA, 64 nt, Human
cagccacuggggugggggccagguucacugggaccagggcuacaggcacagagucuccuggaaa

SEQ ID NO: 282414 - RNA, 64 nt, Human; identical to SEQ ID NO: 196434

SEQ ID NO: 282415 - RNA, 64 nt, Human; identical to SEQ ID NO: 198233

SEQ ID NO: 282416 - RNA, 64 nt, Human
gacaacacuucauuuucaggaaaucuacuuccuacagagccaaaaugccauuuagcaauaaaua

SEQ ID NO: 282417 - RNA, 64 nt, Human
cugaauagugaaaauaauuagacauuuuaagaaccagagccauagaauuauuuuaaauuaguag

SEQ ID NO: 282418 - RNA, 64 nt, Human
aggacagcucagaaaaucaaagaggccaacugcccagagccacagaaaauggaggauaauugag

SEQ ID NO: 282419 - RNA, 64 nt, Human
agugacaguggagucagcugcucuugggugccagcagagccauucaguacaacccccaggcuca

SEQ ID NO: 282420 - RNA, 64 nt, Human
acuucagucucccuccauggagacaaaggcuucccagagccaccaaaaaccuucuuagcaggac

SEQ ID NO: 282421 - RNA, 64 nt, Human
gagcggcaggaggggugggaccaggcugggaggacagagccagcagcugccaugcccuccugcu

SEQ ID NO: 282422 - RNA, 64 nt, Human
cagccugaccuguguuuuggcaaggugauccuuccagagccaucccaaaaagucagcacugaca

SEQ ID NO: 282423 - RNA, 64 nt, Human
ccagggcuccucuagccucauacccgugcccucacagagccaugccccggcaccucugcccugu

SEQ ID NO: 282424 - RNA, 64 nt, Human
accccaacccaagcucugcggaaaucaacagccccagagccacuuggagggaggaagaaaggga

SEQ ID NO: 282425 - RNA, 64 nt, Human
cagcccagccuugcccaccauuuaagaaauaucacagagccacuagaucucauaugaucuucuu

SEQ ID NO: 282426 - RNA, 64 nt, Human
cuucguaacugcaaucggaagugcaggagcuggucagagccaaugagaaggaaaccucaucuuu

SEQ ID NO: 282427 - RNA, 64 nt, Human
ccuggaaucugagaggguggguggcagaggggagcagagccaucugcacuauugcauaaucuga

SEQ ID NO: 282428 - RNA, 64 nt, Human
acacuggauuagucugucuucugcagguagccaucagagccaguguguuucuaugguuuacugu

SEQ ID NO: 282429 - RNA, 64 nt, Human
cugccagggugggagaggagcaucaccagcuccucagagccacuccgcuccauaucaguaucuc

SEQ ID NO: 282430 - RNA, 64 nt, Human
aaggaaacaacaucccauaauagaaaugagcaugcagggcuaaggcauauaggauuuuucugca

SEQ ID NO: 282431 - RNA, 62 nt, Human
ucaccugcacugaucugugaugccccugccuccagggcuagguagagagggcccaggcaggc

SEQ ID NO: 282432 - RNA, 64 nt, Human
ggggagcugacagccuuggaguucagugcuuccccagggcuacgaaggaagcugaacacgcguc

SEQ ID NO: 282433 - RNA, 64 nt, Human
ugcuccguccggaaccuagaagaggcuucauggccagggcuauggauucuuugcucuggaugaa

SEQ ID NO: 282434 - RNA, 64 nt, Human
ugaagccagucaucucagcacugucugaggagggcagagccauggguucugugcuggagggugc

SEQ ID NO: 282435 - RNA, 64 nt, Human
uccucuccccagcccagagacauacuugaagggccagagccaggggggugaggagcuggggauc

SEQ ID NO: 282436 - RNA, 64 nt, Human
ucuguccagccccucccucccacuggagcagcuccagagccauuccucacccccgugaccucuc

SEQ ID NO: 282437 - RNA, 64 nt, Human
auacccagaguucuucgcuccacucacucaaaaucagagccacgaugacccaaaggauaagaaa

SEQ ID NO: 282438 - RNA, 64 nt, Human
cggccaaaccuagccagggucuguucuuguggaccagagccagccuagucauuauuugcugucg

SEQ ID NO: 282439 - RNA, 64 nt, Human
cgaauuguucaauuguguaugucuuccacuaugucagagccacauucccgucacauuauaaaug

SEQ ID NO: 282440 - RNA, 64 nt, Human
aacauuuuuauacagaaggcagucaagcucaacucagagccauggaggcaaguaccuuaauuag

SEQ ID NO: 282441 - RNA, 64 nt, Human
ggaaguuugguugagguucaagugugacuccuuccagagccacagguaggggagugugaaguug

SEQ ID NO: 282442 - RNA, 64 nt, Human
ccacaggcuccccaggaggcucgugucuuuggcccagagccagccuuaguuugucccugccauc

SEQ ID NO: 282443 - RNA, 64 nt, Human
ccccaaaggcagcaacaacguacucauauguacacagagccaugaugugaggaauguacuccuc

SEQ ID NO: 282444 - RNA, 64 nt, Human
gcuguccaugaauccucuguggcaacuguaaucacagagccagaagccagagggccagggauau

SEQ ID NO: 282445 - RNA, 64 nt, Human
aucagauggcaagggucuuugcagaugugcauuccagagccagccgggauuccagugagauggg

SEQ ID NO: 282446 - RNA, 64 nt, Human
cugagcaguaaagguaaggagagcucaaucugcacagagccaguuuuuaguguuugauggaaau

SEQ ID NO: 282447 - RNA, 64 nt, Human
gcccgaccaugacagcaccacgcuaacagugacccagagccauacugccuugggucaguccagc

SEQ ID NO: 282448 - RNA, 64 nt, Human
aaacuccagcagguggcugggcuggaaaggagggcagggcuacauccuggcucggugggaucug

SEQ ID NO: 282449 - RNA, 64 nt, Human
cugcccccuucuuaccucgugcccugcagggcuccagggcuauuuggagggaccuugggcugca

SEQ ID NO: 282450 - RNA, 64 nt, Human
gccccucgcacucugguggcaggugccuuguccucagggcuacagcaguagggaggucagugcu

SEQ ID NO: 282451 - RNA, 64 nt, Human
cccuucuaacgggcgggaggaaggccgcugcucgcagggcuagguggagacacacuucccagau

SEQ ID NO: 282452 - RNA, 64 nt, Human
cucugggcugaauguaugucagugcuauaaaugccagagccaaccuggacuuccugucauuuuc

SEQ ID NO: 282453 - RNA, 64 nt, Human
cacaaaacaguguguccccagcagcuccccaccccagagccaaaugacaguagugcacuuaaaa

SEQ ID NO: 282454 - RNA, 64 nt, Human
aagugcucagugguuugcccuuggcuaaaugaagcagagccaggaaaaacagacuacauauuuu

SEQ ID NO: 282455 - RNA, 64 nt, Human
ucucucuucugaaccuggagccugaauacauuuucagagccaaauuacaagugggugaagacau

SEQ ID NO: 282456 - RNA, 64 nt, Human
ugcuacaauucaagguuagauuugggugaggacacagagccauaccauaucagcccagaucaag

SEQ ID NO: 282457 - RNA, 64 nt, Human
auaauacuagacaaaauugucuucucuuucaaaccagagccauauauaugucuguauauauggg

SEQ ID NO: 282458 - RNA, 64 nt, Human
agaugucacacagugguauuauagaaggauaauacagagccaagaucaaauuaaaagacaauaa

SEQ ID NO: 282459 - RNA, 64 nt, Human
caugcuaagacuggaacuagacguaaugaaacaucagagccagcuaagagaaaagaaauauuug

SEQ ID NO: 282460 - RNA, 64 nt, Human
gaugaguugcacaagauuauacacuguuaaguagcagagccagaauggacuucagaaucccaac

SEQ ID NO: 282461 - RNA, 64 nt, Human
uauuguacaaauaucacucuucagguuuagcuuacagagccauggcuauggauucuuagcucug

SEQ ID NO: 282462 - RNA, 64 nt, Human
uggucuuguugugaguaugcugacaccagaaacucagagccagcuuguggcaagcaguuggggu

SEQ ID NO: 282463 - RNA, 64 nt, Human
agcucagcuucuccacaaggcuagaaauggggcacagagccacuggaggccucugacugaccuc

SEQ ID NO: 282464 - RNA, 64 nt, Human
accuuugaggcuggucauaccuccaggaacaauacagagccagucaacuuccuggaauccaaga

SEQ ID NO: 282465 - RNA, 64 nt, Human
cuucucuggcccuuaggaucuccccauuuggagacagagccauuuggauauuuuccccuugaac

SEQ ID NO: 282466 - RNA, 64 nt, Human
gugcgccugagcagaucaauccaccagugcaaaacagggcuaacggcaccugcaggacagcagc

SEQ ID NO: 282467 - RNA, 64 nt, Human
cguauuuuuugauacgcacuuugcaggaugaccucagggcuauguggauugaguaaugggauuu

SEQ ID NO: 282468 - RNA, 64 nt, Human
aagcggcaguuucaguccauaucaauugugugaccagggcuagucacuuuuuacuucucagugc

SEQ ID NO: 282469 - RNA, 64 nt, Human
aguugauuaauuuggcuucauaguauaaugagagcagggcuauuguaguucccagauucaaucc

SEQ ID NO: 282470 - RNA, 64 nt, Human
gacaugagaagacuuuaaaaguuuuggaaauuuacagagccaugauuuuugaaccuaauugaaa

SEQ ID NO: 282471 - RNA, 64 nt, Human
acagagaugaauggcaucugaguauuacggcauccagagccacugcugacucccacuugcacgc

SEQ ID NO: 282472 - RNA, 64 nt, Human
guuacuccuacagcuaauucugcagggcacagcccagagccauguggauuugacuuacgggagu

SEQ ID NO: 282473 - RNA, 64 nt, Human
cccacuuccuggauaauucucuacccucaccccacagagccaucucucuccagaccaaaagcug

SEQ ID NO: 282474 - RNA, 64 nt, Human
gaccguaauucuugacuucaggcuccuccaucuucagagccagcuguggguaguugaaucuuuu

SEQ ID NO: 282475 - RNA, 64 nt, Human
gggcuccuggauccaaagcaaaugacaggaauuccagagccaggugcauccacucagggcagcc

SEQ ID NO: 282476 - RNA, 64 nt, Human; identical to SEQ ID NO: 282459

SEQ ID NO: 282477 - RNA, 64 nt, Human
uacgaaggauccccaagcccuucaggccugagaucagagccagaucagccuuaagucaccuccc

SEQ ID NO: 282478 - RNA, 64 nt, Human
guuauauagcaagacauaaacagauuauaaacaucagagccauuugcuucucaguuuacauuuc

SEQ ID NO: 282479 - RNA, 64 nt, Human
ucuggauuuucuucccuucuuuuugguuuugguucagagccaauucuuguuucauuggaacagu

SEQ ID NO: 282480 - RNA, 64 nt, Human
uaaugagaccagccucagcugacucacagagcugcagagccaggcuggguccuaacaacucucu

SEQ ID NO: 282481 - RNA, 64 nt, Human
gcauaguguccuggcgcugggaguuccccguggacagagccagagggcaguggcgcucccuguc

SEQ ID NO: 282482 - RNA, 64 nt, Human
acucagcccuggcaggggauggggacaugaugcccagagccaccccuauacuccagucucccug

SEQ ID NO: 282483 - RNA, 64 nt, Human
aaaugagguuggcagaguggcagugggggcucugcagagccagccuuggagccugcucauucug

SEQ ID NO: 282484 - RNA, 64 nt, Human
gccauggaggucugggagagagagcagagggcggcagggcuaaguuggugaucauuggguucuu

SEQ ID NO: 282485 - RNA, 64 nt, Human
agguuguguuuuguuuuuguauaggagccccaggcagggcuaguaacaguuuuuaaauaaaagg

SEQ ID NO: 282486 - RNA, 64 nt, Human
cucagagaugguaccagccaggggcaagcaugaccagagccagggacccuguggcucugauccc

SEQ ID NO: 282487 - RNA, 64 nt, Human
cuugaucagccccacccuggccuagaccagcagacagagccaggagaagcucagcugcauuccg

SEQ ID NO: 282488 - RNA, 64 nt, Human
ccagggguuuugcccacccgggccccagcguucccagagccaaaugacacuaacuuauagaagg

SEQ ID NO: 282489 - RNA, 64 nt, Human
ggugguuuuccccaauaccuggagcucagaaaggcagagccaucuggcccuccagggugucccc

SEQ ID NO: 282490 - RNA, 64 nt, Human
aggcuccauuuguggcuauuauguagaacugggccagagccaguccauugccuguuuuuuuaaa

SEQ ID NO: 282491 - RNA, 64 nt, Human
cucaccccagugacuuugacagugugcucacucucagagccauggauuaccuggaacaaagugc

SEQ ID NO: 282492 - RNA, 64 nt, Human
cccuuaacuucucccuuaccagugaccccagagacagagccaggacaggagugggggccagccu

SEQ ID NO: 282493 - RNA, 64 nt, Human
cuugggcccaagaauucaggaccagucugggcaacagagccagacacugucucuauaaaaaaaa

SEQ ID NO: 282494 - RNA, 64 nt, Human
ccuugacuccagccucgaccgccaggccccaggccagagccacccaaugaacagugcaauguga

SEQ ID NO: 282495 - RNA, 64 nt, Human
aagcucaauauuuucuaugaauucaaaaauacuucagagccaaagccaacuucaaauaccguga

SEQ ID NO: 282496 - RNA, 64 nt, Human
acagacacaccgacuuuguccuuuuucucagcaucagagccagacaggauucagaauaaggaga

SEQ ID NO: 282497 - RNA, 64 nt, Human
gugaggacaggagccgccgcuucaguugucacugcagagccaucguaugucaguugcaauuucc

SEQ ID NO: 282498 - RNA, 64 nt, Human
cguaggcuguccgcuggcuauguggacgcuggggcagagccaggccggagucgaaugaucagcc

SEQ ID NO: 282499 - RNA, 64 nt, Human
cccacuuggaggccccaggauugguccugagguacagagccacugccaccacuggcggccuggg

SEQ ID NO: 282500 - RNA, 59 nt, Human
uauguguauuauguaugcgugcaugcgugcgcgcacacacacacacacacacacacacu

SEQ ID NO: 282501 - RNA, 59 nt, Human
acccagacacacgcacgcacacacacgcgcgcgcacacacaugcuuuuuucuguucccc

SEQ ID NO: 282502 - RNA, 64 nt, Human
ugaguucucagagcaugaacuguccucagaagagcagggcuaggacuugucccagcaucugugc

SEQ ID NO: 282503 - RNA, 64 nt, Human
agcgcucgaggugugcuguuaggcuaagagggugcagggcuagacacgaagcuuaaacuauuca

SEQ ID NO: 282504 - RNA, 64 nt, Human
gucacucugcagcuuggcccgaccacaaacaggacagagccaggcuguugucuugacacugaag

SEQ ID NO: 282505 - RNA, 64 nt, Human
cgugaacaaaaauaaaauaggcacauuuagaauucagagccaauaugugcuugcuuauuaguuu

SEQ ID NO: 282506 - RNA, 64 nt, Human
uuaagauucagccugagaguuaggagaaauauuucagagccaaaagugccuuauacaaccuuag

SEQ ID NO: 282507 - RNA, 64 nt, Human
cuguccuccugcaggaaaguacgucacaucauaccagagccagaggucagugcugaagacgugg

SEQ ID NO: 282508 - RNA, 64 nt, Human
ugggugccuccuugccuugggaccauggccaccccagagccauccgaucgauggaugggaugca

SEQ ID NO: 282509 - RNA, 64 nt, Human
gaggcggaggguagagaugaacucacugagcagccagagccaaaugcaaucgguacgaaucuua

SEQ ID NO: 282510 - RNA, 59 nt, Human
ugcgacacugcugcacguaggugccucaccagagccagauuaucuggucuuccaagacu

SEQ ID NO: 282511 - RNA, 64 nt, Human
uuuuuuuuuuagcauccuuuuggggcuucacucucagagccaguuuuuaagggacaccagagcc

SEQ ID NO: 282512 - RNA, 64 nt, Human
caucuuaaccuccaaagccacagaacuaggggcucagagccagagcuggcagccgccagccaaa

SEQ ID NO: 282513 - RNA, 64 nt, Human
caggcugugugcucaaagcggacaaaacucaggccagagccacagcugggagaccugcacuguc

SEQ ID NO: 282514 - RNA, 64 nt, Human
gggagggaagggcugguguugauuuuccucccugcagagccaauggugcacauugguuuaagcc

SEQ ID NO: 282515 - RNA, 64 nt, Human
caccccaggaggaaaagcccagggucuggggcagcagagccaucgcaucauguuucccagggca

SEQ ID NO: 282516 - RNA, 64 nt, Human
uguuuuuucaauagcuacuuuuuuuagcagacaccagagccacacucaaauggcuaaguagguu

SEQ ID NO: 282517 - RNA, 64 nt, Human
cagcccugggggucuuccucaccugaggacccuucagagccacccuuucuaguuugcauuuccu

SEQ ID NO: 282518 - RNA, 64 nt, Human
uucuuuuuuuuuaaacaaaaacaaaaaaagcaaccagggcuauuuguacaguugaaggggugaa

SEQ ID NO: 282519 - RNA, 64 nt, Human
ugugagauccaugcugaggagaagcaaaauggcacagggcuaguugccaccaaccaauuuacug

SEQ ID NO: 282520 - RNA, 64 nt, Human
aguguaggaucucgcugggcuggguccuggauuccagggcuauucccuggaggacagucucagu

SEQ ID NO: 282521 - RNA, 64 nt, Human
ucuuauaccacucuguauuggacaaaggcuagcacagggcuaggcaccaauaaagauuucuaau

SEQ ID NO: 282522 - RNA, 64 nt, Human
guaggugcuugacauaauuucacugaauuaaugacagagccagugggaagauacagaaaaagag

SEQ ID NO: 282523 - RNA, 64 nt, Human
ugcagcaucuauguggaucagcccacacccuucccagagccagggagcccuuagccucaacucu

SEQ ID NO: 282524 - RNA, 64 nt, Human
aggcgccccuucccccuccaaucccaccaacccucagagccaccccuaaagagauacuuugaua

SEQ ID NO: 282525 - RNA, 64 nt, Human
caccuuaccccauagcaucuugcggcccagaaaccagagccauuugucucagacccuaaaucaa

SEQ ID NO: 282526 - RNA, 64 nt, Human
gcgggcucccggagcagcauuccagagccuccugcagagccagcgaaggaaagcucuagaggga

SEQ ID NO: 282527 - RNA, 64 nt, Human
cccacccgaugaccugcaugaagccagcagcacccagagccacuccugcugcccuagaacuagc

SEQ ID NO: 282528 - RNA, 64 nt, Human
gccccaugucaucacagggccuucaugacagggccagagccagccagcuuugaagacgcggccc

SEQ ID NO: 282529 - RNA, 64 nt, Human
uguugagugccagcucuaaacaagucccuuuaugcagagccacagcugugcaugcucagcccug

SEQ ID NO: 282530 - RNA, 64 nt, Human
cugcgggcuccagcggccgugugcuccagcaggccagagccagacacgaccucccugagccuca

SEQ ID NO: 282531 - RNA, 64 nt, Human
auccguuuccgguuucuaagagucaguucaguggcagagccaccagggaaaagugaggcucuug

SEQ ID NO: 282532 - RNA, 64 nt, Human
gaggaaagggaaggacugggagagacacaaagaccagagccagccucagggacaagagauucca

SEQ ID NO: 282533 - RNA, 64 nt, Human
ggcggugccugggauggccacccaucaggacagccagagccagggucccggcguccugagaguc

SEQ ID NO: 282534 - RNA, 64 nt, Human
auuaaacaaaaccccagguuauuucuucccugcccagagccagccugggauugucagccuucaa

SEQ ID NO: 282535 - RNA, 64 nt, Human
uaugagucccggggauggugaggaacgccacagacagagccacccuaggagugaguauagugcu

SEQ ID NO: 282536 - RNA, 59 nt, Human
aaaggacguaugccauggagaaacacacccgcgcacacagcugcucucuacagaggcug

SEQ ID NO: 282537 - RNA, 59 nt, Human
ugggacugugagaccuggccucgcacaggcgcgcacacaccgccaagcagcucagcauu

SEQ ID NO: 282538 - RNA, 64 nt, Human
ggguaauaaaccuucacauggcuucaaaaggaaaacaagcaaaucuucucuaaucuacucuuac

SEQ ID NO: 282539 - RNA, 64 nt, Human
aacuuuaacagauuugauauggaugcauuuauucacaagcaaccccaaaaguccaaaaauguaa

SEQ ID NO: 282540 - RNA, 64 nt, Human
acaacuggcauucaaaucuaggucagucugcccccagagccacuacccuuaccccucacugaau

SEQ ID NO: 282541 - RNA, 64 nt, Human
caagauggggagugagaggcugggaauggaggggcagagccaggaagaucccccagaaaagaaa

SEQ ID NO: 282542 - RNA, 64 nt, Human
gaaugucucaaaaaaaaaggacaaaaaacaaacccagagccacuccuuuaauacagaaacuuca

SEQ ID NO: 282543 - RNA, 64 nt, Human
uaggagguuugaagcagaaaugaaauguguuauucagagccaauguuguacauagagcauuuuc

SEQ ID NO: 282544 - RNA, 64 nt, Human
gcacagccccagucagcucaacccaguccugcuucagagccaagacuaggccaggguggggacc

SEQ ID NO: 282545 - RNA, 64 nt, Human
agggaagucgcuuuuggugccuggcugguuugcccagagccaagcuggggcaaggggcagccag

SEQ ID NO: 282546 - RNA, 64 nt, Human
guuugagccuccucucccuucugugggucgcucccagagccauggcccaugggaaggacagagu

SEQ ID NO: 282547 - RNA, 64 nt, Human
ucugcccgggcccaagcccugccccuccagaguccagagccaggaaggggcugcugagggcgag

SEQ ID NO: 282548 - RNA, 64 nt, Human
cuucaucacuguuggagaucauggagcuaagaagcagagccaaguccacccauguccuuggcag

SEQ ID NO: 282549 - RNA, 64 nt, Human
gcuggaaugccaccacccucaguaauggcaguaccagagccaggaccaacgucaaggguauccc

SEQ ID NO: 282550 - RNA, 64 nt, Human
aaaaagccuuagguaaauaagucauucucccuagcagagccacuugggucuccugcauggaagc

SEQ ID NO: 282551 - RNA, 64 nt, Human
ugugaacagcacugcuccacauggugucggcucacagagccaccgcaacucugcccagcgggag

SEQ ID NO: 282552 - RNA, 64 nt, Human
ccuguccugguccugaugcccguugucuaggagacagagccaagcacugcucacgucucugccg

SEQ ID NO: 282553 - RNA, 64 nt, Human
guuucucuuucugagaacguaacuugaaacacuacagagccaauaaucauauaaaaaguguauc

SEQ ID NO: 282554 - RNA, 64 nt, Human
agagcuaagauuaucuggggaaaucaaaacaaaaacaagcaaacaaaaaaaaaaagcaaaaaca

SEQ ID NO: 282555 - RNA, 64 nt, Human
guggcuucagaaacagcuuaaaauaauuuuauuuacaagcaaguuauguaagagaauguuuuau

SEQ ID NO: 282556 - RNA, 64 nt, Human
ggagccacuaggccuggccuccucuacacauccccagggcuaucugguuaauuccaucaagcuc

SEQ ID NO: 282557 - RNA, 64 nt, Human
uuucccaucuucgauguugcuaauauuaaggcuucagggcuacuuuuaucaacaugccugucuu

SEQ ID NO: 282558 - RNA, 64 nt, Human
cuucagaccuggugcggagccaggcggagggacacagagccaggacucccagccguauugaaau

SEQ ID NO: 282559 - RNA, 64 nt, Human
uggguaacagccuuggggagggugcagagcucugcagagccaugggccagguggggcugccuca

SEQ ID NO: 282560 - RNA, 64 nt, Human
aaauggagugggggaguccuggccccugaaucaccagagccaccaagccugccagaggggucuc

SEQ ID NO: 282561 - RNA, 64 nt, Human
uguaccgugagcggggcuccagccaguucaagcucagagccagagcuggacgggccagaacugc

SEQ ID NO: 282562 - RNA, 64 nt, Human
gacccucugcuuccuagccugaugauggggaacccagagccacccgcuaugagcacaggccggg

SEQ ID NO: 282563 - RNA, 64 nt, Human
ccaagaucgcgccacugcacuccagccugggcgacagagccagacugucucaaauaaauaaaua

SEQ ID NO: 282564 - RNA, 57 nt, Human
ccuugcuucuccagauuuagcauccugcagagccaccgagaaaauaaaaaagcuggg

SEQ ID NO: 282565 - RNA, 64 nt, Human
augugacguuauuuaaaaacaacaacaaagaaggcagagccaggauauaacuagaaaaaggaug

SEQ ID NO: 282566 - RNA, 64 nt, Human
ccuuuccucaugcagcacaagugcucaccggggccagagccagggcauggauaugacaagcagg

SEQ ID NO: 282567 - RNA, 64 nt, Human
ucacgagccuugcgcaaaacccagaagauguauucagagccacccaggccacugaccucccacu

SEQ ID NO: 282568 - RNA, 64 nt, Human
cuacuuucagcuucaaccccaggcccucagaaaccagagccaugagaccuaccauaccaccagc

SEQ ID NO: 282569 - RNA, 64 nt, Human
gaucucagacuauccugauuaaucuggggaagaacagagccagggaaagaaugguggggacccc

SEQ ID NO: 282570 - RNA, 64 nt, Human
acccugcgggccaggguccugucgccaccacuuccagagccagaaagggugccaguugggcucg

SEQ ID NO: 282571 - RNA, 64 nt, Human
cguggugcuguguccuuaccaccuaagggcauuucagagccaucagcugaagacaucugaaauc

SEQ ID NO: 282572 - RNA, 64 nt, Human; identical to SEQ ID NO: 281738

SEQ ID NO: 282573 - RNA, 64 nt, Human
aggagcagcugggacccagaacugagccugggagggauccgacagaaaagcucagggcgggucu

SEQ ID NO: 282574 - RNA, 64 nt, Human
gugguuuuugccaagucauacaacauacuuaaugcagggcuacacugaaccuccagaaucauuu

SEQ ID NO: 282575 - RNA, 64 nt, Human
augggagccgggucugccucuucugggagggcagcagggcuacccugagcugaggcagcagugu

SEQ ID NO: 282576 - RNA, 64 nt, Human
acgagauugcgccacugcacuccagccugggcgacagagccagacuccgucucaaaaaaaaaaa

SEQ ID NO: 282577 - RNA, 64 nt, Human
uuuagccauucaccuagagaguaaguguugaagccagagccaccuccaacucuggagccuacca

SEQ ID NO: 282578 - RNA, 64 nt, Human
ugguuggcuuugaugaacccucaugcugcaccuucagagccaguccucuaguuuggaauaaaaa

SEQ ID NO: 282579 - RNA, 64 nt, Human
ggccccagagacucagagggaggaaucgaggaaccagagccauggacucuacacugugaacuug

SEQ ID NO: 282580 - RNA, 64 nt, Human
uaagagaccucuuuuugaucuguauugggcuaaccagagccaaauacuuuugaagaguuuccca

SEQ ID NO: 282581 - RNA, 64 nt, Human
ccuagagguggaguucuuagcuauccuuggcuuucagagccagccuggcucugcccccuccccc

SEQ ID NO: 282582 - RNA, 64 nt, Human
uuguggggccuccuugucagcucugcugcugucucagagccaucuggaugagugucccgacacc

SEQ ID NO: 282583 - RNA, 64 nt, Human
acgugaguccuaaccuggccacaguugggggaggcagagccagcagguggacagguguuugcag

SEQ ID NO: 282584 - RNA, 64 nt, Human
cagcuaaggagccucauagccuggcgggggcuggcagagccacaccccaagugccugugcccag

SEQ ID NO: 282585 - RNA, 64 nt, Human
ccuggcagagacgcaguugucucugggcgcuugccagagccacgaaccccagaccuguuuguau

SEQ ID NO: 282586 - RNA, 64 nt, Human
gucaucugugauuguuuuaucacucuggacugugcagagccaccugccaccgagaucugcauuc

SEQ ID NO: 282587 - RNA, 64 nt, Human
agucaggccagggccuuccagcugcucuuggggccagagccaagagccucucaguagagggagg

SEQ ID NO: 282588 - RNA, 64 nt, Human
ccgaagcugcguguggccccuuagaggugagcaucagagccagagcagugagggggagacucac

SEQ ID NO: 282589 - RNA, 64 nt, Human
ccgagaucgcgccacugcacuccagccugggugacagagccagacuccaucucaaagaaaaaaa

SEQ ID NO: 282590 - RNA, 59 nt, Human
gugguccuuccuaccucuguggugugugucgcgcacacagcuuagaagugcuauaaaaa

SEQ ID NO: 282591 - RNA, 59 nt, Human
gcaucucgcgccugcuacaucaaagggcccgcgcacaaagcaguguuucuucgccacgg

SEQ ID NO: 282592 - RNA, 59 nt, Human
cugccuggaugcauguaugcacacacaugcgcgcacacgugcucccugaaggcacacgu

SEQ ID NO: 282593 - RNA, 59 nt, Human
auacauucaccgcccccccgcccccccaacgcgcacacacacguccucuccucccagga

SEQ ID NO: 282594 - RNA, 64 nt, Human
ugucugggccgaagcacgucccaccacacagugccagagccagagaaggggccccaccaccaag

SEQ ID NO: 282595 - RNA, 64 nt, Human
ucuugcccuggagugccgaugaugauucucccuccagagccacgcuugggaacaugaagcaagu

SEQ ID NO: 282596 - RNA, 64 nt, Human
augugaggccagggugggcaccaaagaccaggcccagagccaggggacagguuggggcuguggg

SEQ ID NO: 282597 - RNA, 64 nt, Human
agucccucucuguggagaacugaauggcccugugcagagccauagucccacuguggguccugca

SEQ ID NO: 282598 - RNA, 64 nt, Human
cuguguccuuucuggaaauuaagaaggugugcuccagagccaagaggagcaauaagaaaccucg

SEQ ID NO: 282599 - RNA, 64 nt, Human
gcugggccacuccagacauuaauccccaccccaacagagccacuggcacaagugcccuuagugc

SEQ ID NO: 282600 - RNA, 64 nt, Human
gguuuucccacagauccccgccuguggcacaccccagagccagaaaucgaaggucacaggaagu

SEQ ID NO: 282601 - RNA, 64 nt, Human
gaagagcauuggggcuggaguguuccggcaaagacagagccagcagcugcgcugggggagggaa

SEQ ID NO: 282602 - RNA, 64 nt, Human
caacauccugacguaguucucuucuaccuucagccagagccagagagcuggauauggggucggg

SEQ ID NO: 282603 - RNA, 64 nt, Human
guuacaaagugagggagggcaguguccagauccccagagccacacauacauacacauacacacc

SEQ ID NO: 282604 - RNA, 50 nt, Human
cggaacacaugagcauguaacagagccaggaacccuacugcaguaaacug

SEQ ID NO: 282605 - RNA, 64 nt, Human
guccucucauacagaugggaugggguuagaaagccagagccaguuuuuccaucuggcguuuccu

SEQ ID NO: 282606 - RNA, 64 nt, Human
guugguugaaggaaacaauccuuccuucugguggcagagccagucuucugggccucacaugccu

SEQ ID NO: 282607 - RNA, 64 nt, Human
aaguauuggccagucaggcgccucguggucagagcagagccaccaggucccacugccccgagcc

SEQ ID NO: 282608 - RNA, 59 nt, Human
aaccauguuguugcugguuguccuggcaucgcgcacacuguauguacauacuggcaacg

SEQ ID NO: 282609 - RNA, 59 nt, Human
cuuuucaaacacacacacacacgcgcgcgcgcgcacacacacucuucaaguuuuuuuca

SEQ ID NO: 282610 - RNA, 59 nt, Human
augccgagugcguaaggaaaccguggcgucgcgcacagugggucugcuugucaaggcca

SEQ ID NO: 282611 - RNA, 59 nt, Human
acaauuaacagucaaggauaaaacaagcacgcgcacaaucaaggagcuggaacacacuc

SEQ ID NO: 282612 - RNA, 64 nt, Human
caguuucucugcucaguguucugguagcagagcucagagccaacuguuuaccucuugguugucc

SEQ ID NO: 282613 - RNA, 64 nt, Human
guaagaugaccacugucucacuaucaagagccugcagagccauuuuccagaccugugauugccc

SEQ ID NO: 282614 - RNA, 64 nt, Human
cgcagcaggcgugcccaggagcgugugcaugugucagagccauuugguccaucaucuccugcaa

SEQ ID NO: 282615 - RNA, 64 nt, Human
gugucugagagauacugcaucagcccuagacccccagagccagucccgcccuuuacagagcagc

SEQ ID NO: 282616 - RNA, 64 nt, Human
cuggauagugugugaaagucuuugcugaaaguuccagagccauugagaauaacugaggccgcag

SEQ ID NO: 282617 - RNA, 64 nt, Human
gggcaggacccccgccccugcagggcccaugcaccagagccacugagcccagucccauaaaccu

SEQ ID NO: 282618 - RNA, 64 nt, Human
auuuucaaaucugguccauauuuacauucuaguucagagccaagccuuaaacuguacagaauuu

SEQ ID NO: 282619 - RNA, 64 nt, Human
gccugacgggccgcuuaccauccccucugcccugcagagccagccgccaagguugaccucagcu

SEQ ID NO: 282620 - RNA, 64 nt, Human
ggcaaagagggccacaggacccgggaaauacacacagagccaggagcagaagcaaagagcagac

SEQ ID NO: 282621 - RNA, 64 nt, Human
ccagggaccaucacauggguagggauuuuccauccagagccaauaaaaggacuggugggggccg

SEQ ID NO: 282622 - RNA, 64 nt, Human
aagauuccuguaccaggcccacggccgucucgggcagagccaccugggccccgggugcagccgg

SEQ ID NO: 282623 - RNA, 64 nt, Human
uggaauccccuaggagccuucagucugggagaaacagagccagacauagacaguuccagcauca

SEQ ID NO: 282624 - RNA, 64 nt, Human
uccaucaccaaauccuuacuccaaauccagaagucagagccaacucccaucuugguucugaccc

SEQ ID NO: 282625 - RNA, 64 nt, Human
gaggcucacagguggcacacaggcgcugucucuccagagccauccuucagaguggaccucagug

SEQ ID NO: 282626 - RNA, 59 nt, Human
guuuucaaaagugccuugccauguaccuucgcgcacacacugguucuccucuuuugggu

SEQ ID NO: 282627 - RNA, 59 nt, Human
cauggauauggaacagaaagacuaugacucgcgcacagcucugcauguugcugcagcug

SEQ ID NO: 282628 - RNA, 59 nt, Human
gacacaccccaacaugccugcaccugcagcgcgcacacgcacgcacacacacauacaga

SEQ ID NO: 282629 - RNA, 59 nt, Human
uuuuacuccuuuuuuuaaaaacacaugcgcgcgcacacacacaugcuuuacaaguuuua

SEQ ID NO: 282630 - RNA, 64 nt, Human
cacacacucacugcggagaaccuugugccuggcucagagccagucuuuuuggugaggguaaccc

SEQ ID NO: 282631 - RNA, 64 nt, Human
ugaaggggcccuagcccccugcacuccgccgccucagagccaugcgguuaauuccugacuuagu

SEQ ID NO: 282632 - RNA, 64 nt, Human
ggcaguuuaugugugaccuggacacagacagagacagagccaggcccggcccucccgcccccga

SEQ ID NO: 282633 - RNA, 64 nt, Human
aaggcgcucagccuuggcuggaguagaauuaagucagagccaacagguggggagagacagagaa

SEQ ID NO: 282634 - RNA, 64 nt, Human
ucaguauuguuaaaauacugcccaaagcaauuuacagagccaaugcuauuucuaucaaacuacc

SEQ ID NO: 282635 - RNA, 64 nt, Human
gugguggcugaacucuaguggggccgagacuauucagagccaguaggaggccgacagucacagc

SEQ ID NO: 282636 - RNA, 64 nt, Human
gcauggccccccugccccgugcugaaugaauguacagagccagacaaagcugugaauggccuag

SEQ ID NO: 282637 - RNA, 64 nt, Human
ugcccaauaaacggcuguggaguggaaauuccuccagagccaaaaaggcucccugcuugauccg

SEQ ID NO: 282638 - RNA, 64 nt, Human
acccacacuccucauccacacaccuuucuuuacccagagccacugaaaacuauuuuuauaucau

SEQ ID NO: 282639 - RNA, 64 nt, Human
augccuuaaaagcugggccccaggcccugcuggccagagccacagaugccaagcucugggagcu

SEQ ID NO: 282640 - RNA, 64 nt, Human
uagggaugacaggagccugguucccugaugauggcagagccagauaucagcacaaacuuauuua

SEQ ID NO: 282641 - RNA, 64 nt, Human
ggcucugggcuuucggccagaaguuaauuaaccucagagccaggagccuggggcuggggccucc

SEQ ID NO: 282642 - RNA, 64 nt, Human
ugagccaagaugcacugcaccccagccugggcgacagagccagacccugucucaaaaaaaaaaa

SEQ ID NO: 282643 - RNA, 64 nt, Human
cucuguccacuuguggguccuggggucgucuuagcagagccaccgccaagguuugcacucaggg

SEQ ID NO: 282644 - RNA, 64 nt, Human
gugggcaauugucugaaaagugaagacagaaccacagggcuauuuuguuugcuucauguguccc

SEQ ID NO: 282645 - RNA, 64 nt, Human
uggguagccuggggcugaggaggugcccuggacucagggcuauccuguccugucuuggaucuug

SEQ ID NO: 282646 - RNA, 64 nt, Human
gucucacccuacagaugagagguggcugaggcaccagggcuaagcaauuaaaccaguuaagucu

SEQ ID NO: 282647 - RNA, 64 nt, Human
uuuuuuuugucauuguuuuccccauugaaacaaacagggcuaaaaagucaucuguucauuagga

SEQ ID NO: 282648 - RNA, 64 nt, Human
ugagaacuccagcuggugcccccagacagcugcucagagccaagggggcagagggcuuucagcg

SEQ ID NO: 282649 - RNA, 64 nt, Human
cuuuguguguuuuacauauauauaucucuaaguccagagccaggagaguuggaccauugagggc

SEQ ID NO: 282650 - RNA, 64 nt, Human
gggcuggcauucccucccaaccugaacugcuccucagagccaucuccugaacccacaaauuauu

SEQ ID NO: 282651 - RNA, 64 nt, Human
uaaguaaucuuuuccaaguuuccuuaguaagggacagagccaggauuuuuuuauuuuuauuuuu

SEQ ID NO: 282652 - RNA, 64 nt, Human
ucugggagggauguucuagcccucccuggcaugucagagccaggcucugccuggaggaucccuc

SEQ ID NO: 282653 - RNA, 64 nt, Human
gaaaacuguacucuguccagacaugauagagggacagagccaaaaggauagagaaagagaccca

SEQ ID NO: 282654 - RNA, 64 nt, Human
ucuccccuacaguuuuaugcucagacauggaggucagagccacaagggaaaggggagaggggga

SEQ ID NO: 282655 - RNA, 64 nt, Human
cacaaagugaagaugaacccuuucugugcaggagcagagccaggugggcccuggacauuuuuuu

SEQ ID NO: 282656 - RNA, 64 nt, Human
augacugggugaaaaucacauagcugucuggugccagagccagccuauaguagaguccccugac

SEQ ID NO: 282657 - RNA, 64 nt, Human
gccugaggccucuuggaacucuugcuaaccuguucagagccaggaaggagacugcacaguuuug

SEQ ID NO: 282658 - RNA, 64 nt, Human
gcagaccggcugggauagccuccccaccccuuaucagagccaagacaccugcugcagcucucca

SEQ ID NO: 282659 - RNA, 64 nt, Human
gacucucccacgcacgagcuagugaguggcacaccagagccaucugcagggaagggcguggcgg

SEQ ID NO: 282660 - RNA, 64 nt, Human
aguacugcacccagcaucaccagcuagaaaguggcagagccaggauucaacccuggcuugucua

SEQ ID NO: 282661 - RNA, 64 nt, Human
ggucuuggaugagaacaugacuuuuggcaucauucagagccagguuugaauccuggcuauaaaa

SEQ ID NO: 282662 - RNA, 59 nt, Human
aaggcugagaacacugugaaaacauuuugcgcgcacaauaguaaccuggguaaaugcag

SEQ ID NO: 282663 - RNA, 59 nt, Human
cuuuaccuaccccucaguuuuccuuaaaacgcgcacacaacucuagagaguguuaagaa

SEQ ID NO: 282664 - RNA, 59 nt, Human
ccccggcgggaugaggagaccaugccgggcgcgcacacacggcagcuucuguuugaaaa

SEQ ID NO: 282665 - RNA, 59 nt, Human
ccaucucuuuucuuuaaggcuucaggcagcgcgcacaggcucuggcagccgucucaggc

SEQ ID NO: 282666 - RNA, 64 nt, Human
agaaauuugcuaggaucacaccacuaauaagcaacagagccaggauucaaacccagguguggcu

SEQ ID NO: 282667 - RNA, 64 nt, Human
auguggcccucaagagccauccccacugccuggccagagccauuguuguccccuacuuccuagg

SEQ ID NO: 282668 - RNA, 64 nt, Human
ccagcuggugguguuaagccagaauuugaccucccagagccaguuuccauuagcugccaugcuc

SEQ ID NO: 282669 - RNA, 64 nt, Human
aaagugguguaaucuccuucucuacaucuguugucagagccacugagugcugugcugcucgacg

SEQ ID NO: 282670 - RNA, 64 nt, Human
cuguugggucaccggcuggaccugcugcagccugcagagccacagucagccugcccacaugcca

SEQ ID NO: 282671 - RNA, 64 nt, Human
uccagccaggccccaagcccacugggguguguggcagagccaggacccaggaggugugauuccu

SEQ ID NO: 282672 - RNA, 64 nt, Human
ccguguaccucaguucccucuugcucagugggggcagagccaccugacucuugcagggguagcc

SEQ ID NO: 282673 - RNA, 64 nt, Human
acauuugcaugagacauggcugucucacaggucacagagccauuacaacagcuuacuaguuuuu

SEQ ID NO: 282674 - RNA, 64 nt, Human
aggguugggggcagggccauccacgguuucugggcagagccaugguggcaggagagagauggcu

SEQ ID NO: 282675 - RNA, 64 nt, Human
uccugaucagucaccuuuguugcugcuguguagacagagccaggccucaccuguuuguuuaggc

SEQ ID NO: 282676 - RNA, 64 nt, Human
ggcuucaaucggcuugugggugauguuugaccuucagagccagccggcuaugaaagggagcgag

SEQ ID NO: 282677 - RNA, 64 nt, Human
uggagauaaaauggguuuaaugaggucuaccuugcagagccauugugagcauuggaaaugauga

SEQ ID NO: 282678 - RNA, 64 nt, Human
caguucuguuggagaaacgcuugguuuccggauccagagccacagaaagaaauguaggugugaa

SEQ ID NO: 282679 - RNA, 64 nt, Human
cucaguacccagaacagccaguuuuacugugauucagagccacagucuaacugagcaccuuuua

SEQ ID NO: 282680 - RNA, 59 nt, Human
cagucaguauucccagccuugagcgcacgcgcgcacacacacacacacauacacacacg

SEQ ID NO: 282681 - RNA, 59 nt, Human
cucgcucacgcucagacgcuacacacgcgcgcgcacagacacggugcaccuaggucaca

SEQ ID NO: 282682 - RNA, 59 nt, Human
ggaacuguaguguagcgaccucacugcugcgcgcacagucucccgggacuuggacucga

SEQ ID NO: 282683 - RNA, 59 nt, Human
aagcaagagcgagagagaguacgugcacacgcgcacaaaagagagaaacggacaccaga

SEQ ID NO: 282684 - RNA, 64 nt, Human
agccacugccuucaugcugcccccgccggacuggcagagccaggggucagccaccugccuuuga

SEQ ID NO: 282685 - RNA, 64 nt, Human
aauuagcaagcuccuagagaagccaugugauucccagagccaggcgcuuuacaccuaaaguagu

SEQ ID NO: 282686 - RNA, 64 nt, Human
agagccaggugccugacuaguacauggggagcuacagagccaaggucaaugugagucaacaucc

SEQ ID NO: 282687 - RNA, 64 nt, Human
cccucaggcugggcucugaacgaggaccuggacucagagccagacagggcagccucagacccuu

SEQ ID NO: 282688 - RNA, 64 nt, Human
cacgugaacccacggccacagagaggcaggacggcagagccaugauuucccaccgagcgauuac

SEQ ID NO: 282689 - RNA, 64 nt, Human
ccacucgccuuugccccgucaucgaugauucaggcagagccagauucguuaggucccuggagga

SEQ ID NO: 282690 - RNA, 64 nt, Human
gagcuugcugcccaacgggaggauggcuucacagcagagccagcaugagggguggggccuggca

SEQ ID NO: 282691 - RNA, 64 nt, Human
cucagucuuguaaauguaucuugagagguaggagcagagccacuaucuccauugaagcugaaau

SEQ ID NO: 282692 - RNA, 64 nt, Human
cgaguggagcuucgacccacccacuccaggaacccagagccacauuagaaguuccugagggcug

SEQ ID NO: 282693 - RNA, 64 nt, Human
cugacagccacuccaggaacuugaacugcaggggcagagccagugaaucaccggaccuccagca

SEQ ID NO: 282694 - RNA, 64 nt, Human
ugacuagauuuguuugagacaagaguggugggaucagagccauguggagagcucauggccuguc

SEQ ID NO: 282695 - RNA, 64 nt, Human
ggauuggccucaggcucaggcuagaccugaaggccagagccacguggcacaauugcuggcccca

SEQ ID NO: 282696 - RNA, 64 nt, Human
aaacucaggugacuuguuagagcacuaacuuggucagagccaaauccuggcaaacgcugccuga

SEQ ID NO: 282697 - RNA, 64 nt, Human
agaggugaaaugcacaagcugcuggagaaggggucagagccauaucaaguuaaagguuaaccag

SEQ ID NO: 282698 - RNA, 59 nt, Human
ucagaaucacguuuuuaguugugcgugugcgcgcacacguguguaaaaagcacuuucga

SEQ ID NO: 282699 - RNA, 59 nt, Human
gcacacacacacacaugcacacacacgcgcgcgcacacacacacacacacauccacccc

SEQ ID NO: 282700 - RNA, 59 nt, Human
agcugagacccucgccacggggagggggacgcgcacacacaccggucaccgagacggcu

SEQ ID NO: 282701 - RNA, 59 nt, Human
cccccgccaagugcucacacacaaccucacgcgcacacacacacacgcagauggaggcg

SEQ ID NO: 282702 - RNA, 64 nt, Human
uggucccccuucccaacuucugaagcacgugcugcagagccaccuuggucugagcaccugagga

SEQ ID NO: 282703 - RNA, 61 nt, Human
uuguucaccuccugaccugaccgucgcuuaccagagccagaaguuccugcugaggacauga

SEQ ID NO: 282704 - RNA, 64 nt, Human
cucccccuuuuugccuccucggaagcucgcugcccagagccauguccagaacccagccggccau

SEQ ID NO: 282705 - RNA, 64 nt, Human
cccagaguugauccacaagauaagaaaucccuuucagagccagggaaggguccagacaggagau

SEQ ID NO: 282706 - RNA, 64 nt, Human
ugaugggacaauucuucucgacuucaggagcugacagagccagaggcaccuaaacuuggguaca

SEQ ID NO: 282707 - RNA, 64 nt, Human
uagcuacugaggcauagggagaggaaguuaauuucagagccauacaaaaauaagccacaaccag

SEQ ID NO: 282708 - RNA, 64 nt, Human
agggggagccugggugcagcagagacagaggaagcagagccaggugccgagcgcgacccugcag

SEQ ID NO: 282709 - RNA, 64 nt, Human
agugugaagggggcggcugaguucucuuaggacccagagccagggcccucaacuuccauccugc

SEQ ID NO: 282710 - RNA, 64 nt, Human
gauguaaccaagcuguacccuugagaccuggaaccagagccacaggccccuuuuguggguuucu

SEQ ID NO: 282711 - RNA, 64 nt, Human
cuccgaggacacggguggcaggcccguugcagcccagagccacuggucccuacagggcgccgcc

SEQ ID NO: 282712 - RNA, 64 nt, Human
cacacagcccugccaugcugacucgguuuccccucagagccauuguugucugggcucgaguuuc

SEQ ID NO: 282713 - RNA, 64 nt, Human
ucguuaugauuugauuugaccuuggcacacacugcagagccacagggauguugcugaauuucaa

SEQ ID NO: 282714 - RNA, 64 nt, Human
aaaaugccuggggucccugcugccucucaaucuccagagccauguccauggggaggugggcucu

SEQ ID NO: 282715 - RNA, 64 nt, Human
ccagucaacagaacucuagucccaaagggguggccagagccaaagccagcuacuguccuguccu

SEQ ID NO: 282716 - RNA, 59 nt, Human
gugugugugugugugcgcgcgcgcgcgcacgcgcacacacucacgcacacacaagcaga

SEQ ID NO: 282717 - RNA, 59 nt, Human
caugccacacagacacacaugcgcgcgcgcgcgcacacacacacacacacacacacaca

SEQ ID NO: 282718 - RNA, 59 nt, Human
acccauccacacacaccuacacucacacacgcgcacaugggcgcgcacgaacuaccauu

SEQ ID NO: 282719 - RNA, 64 nt, Human
gagacagagagacuggccaggccuccccgguggccagagccagccagcauggccacccucaaga

SEQ ID NO: 282720 - RNA, 64 nt, Human
auggcuuguuucuuccgggugggaggaugguggucagagccaggaguauggagaucugagaccg

SEQ ID NO: 282721 - RNA, 64 nt, Human
aggcggccccagaccugcgggaacgccuuucccucagagccaggccccggccccgucugggaag

SEQ ID NO: 282722 - RNA, 64 nt, Human
gccuccuucgaggcugugcugggugcagaaccgccagagccacccaaaagguguuucucuucug

SEQ ID NO: 282723 - RNA, 64 nt, Human
uggaacugccagaggauggcggccugggcuuccccagagccaggcgugcgggagaggugaggac

SEQ ID NO: 282724 - RNA, 64 nt, Human
acagcccaacucccccagcccagcucccccagcccagagccagggaagaggaagguggggccag

SEQ ID NO: 282725 - RNA, 64 nt, Human
cggccacaccagugucccaaagaggagagcgcagcagagccaggggucuguucuguagcagcca

SEQ ID NO: 282726 - RNA, 64 nt, Human
gggugcccgccccacagugcuuuccccagcaccccagagccagucgggacaccccccgcagccc

SEQ ID NO: 282727 - RNA, 64 nt, Human
cccagcuggcaguagccugaccaucuggacacagcagagccagggcggcccagggacggcagga

SEQ ID NO: 282728 - RNA, 64 nt, Human
augugggguuaagugagguggggaccaaaggaaacagagccagagcagccacagaagcugugcc

SEQ ID NO: 282729 - RNA, 64 nt, Human
cugagaucgugccacugcacuccagccugggcaacagagccagacuccgucucuaaacaaacaa

SEQ ID NO: 282730 - RNA, 64 nt, Human
aaucugcuacaauuccaccucauucuuucacacccagagccagagccuuaagcaucaugguacc

SEQ ID NO: 282731 - RNA, 64 nt, Human
uccuuggcacagacuguggaugccucucccccagcagagccacacagccuucgugacaacugcu

SEQ ID NO: 282732 - RNA, 64 nt, Human
cgggucggguccgugucggagaagugacaggucccagagccaaagccggcccucaagcaucauc

SEQ ID NO: 282733 - RNA, 64 nt, Human
acggugacauuacaguuaaauuucccaauugaaaacaagcaaacagacacucaaacugguccug

SEQ ID NO: 282734 - RNA, 64 nt, Human
gcuggcuacugauugcuccaggcagacaaggcugacaagcaauccagggacaagauacucacca

SEQ ID NO: 282735 - RNA, 64 nt, Human
acugccgcuggcccaccugcugcagacgcagaaucagggcuauacccacuucugccgggguggc

SEQ ID NO: 282736 - RNA, 64 nt, Human
cagaggaaguuaagggagagucaaugggcagagccagggcuaggcccuggugguguguggagca

SEQ ID NO: 282737 - RNA, 64 nt, Human
ugggaugccaggacacccccucccacacucaggacagagccaacccuggcuccguggaccuucu

SEQ ID NO: 282738 - RNA, 64 nt, Human
acacgugaccugcacaggaucacagagcauggggcagagccaggacuagagcucagggcaucug

SEQ ID NO: 282739 - RNA, 64 nt, Human
agaggccucauggcccaggagaccccaccucuggcagagccacauuaccuacccugugcauggu

SEQ ID NO: 282740 - RNA, 64 nt, Human
aaggguacuugcgaugccggauuuaaaacuugcucagagccacuuagccacuugagaaccagac

SEQ ID NO: 282741 - RNA, 64 nt, Human
uuucauguuccuaaacccaugucuuagggcagcacagagccaggucaugucaugccccaaagug

SEQ ID NO: 282742 - RNA, 64 nt, Human
cccuguuucuuuggugccugcaguuuagagaaggcagagccacugguuuugagaaccagauuug

SEQ ID NO: 282743 - RNA, 64 nt, Human
ucacugcugagacccacaggucuaagaggagaggcagagccagugugccaccaggcugggcagg

SEQ ID NO: 282744 - RNA, 64 nt, Human
caccccauucccccagggaacaucuugcugcucucagagccagaaaaugcugacagccucaugc

SEQ ID NO: 282745 - RNA, 64 nt, Human
agcagggcagcccccugggugccgcugucaggagcagagccaggcccagguggcuccagcugcc

SEQ ID NO: 282746 - RNA, 64 nt, Human
cuuucccaagcgcuagcacaggugcaaaauccaucagagccauuguuuucauaaaaaccaagca

SEQ ID NO: 282747 - RNA, 64 nt, Human
ggagaauuguuugaauauuaucccauugaauacccagagccacuaaaucuuuuuuuacuagaaa

SEQ ID NO: 282748 - RNA, 64 nt, Human
aggaagaauucaacagugugucuucagcaguguucagagccaagcaagaaguugaaguugccua

SEQ ID NO: 282749 - RNA, 64 nt, Human
cuggggaacacagccagacauccugauggggaggcagagccaggaagcuaagccagggcccagc

SEQ ID NO: 282750 - RNA, 64 nt, Human
uggguggauguuauuaacugucauuguuguugcccagagccauggguuuuuuaaccccaaauua

SEQ ID NO: 282751 - RNA, 64 nt, Human; identical to SEQ ID NO: 281718

SEQ ID NO: 282752 - RNA, 64 nt, Human
augaagcgagucggguccccaacccgugccccugggauccgagggccccucuccaagcgccugg

SEQ ID NO: 282753 - RNA, 64 nt, Human
ggacaucguuuaacaccuaaacucauuuaacaaaggauccgagaagaacagggacaguguggga

SEQ ID NO: 282754 - RNA, 64 nt, Human
aagaggaagaagaaguaggaggagcugugugcccggauccgaggagcaaguuaaucugucccuu

SEQ ID NO: 282755 - RNA, 64 nt, Human
ugagagacugaggcuugagugaacugaaggcaaacagagccaaguauccuucaguccacuggaa

SEQ ID NO: 282756 - RNA, 64 nt, Human
uuuuacagauuuaacauacuguauuauuugaugccagagccaacaggcuauaucauaggcaguu

SEQ ID NO: 282757 - RNA, 64 nt, Human
ucugcgguguaaguggcucuguccucagggugggcagagccacuaaacuuguuuuaccuaguuc

SEQ ID NO: 282758 - RNA, 64 nt, Human
cugcuccaggggcugccagggacugcucacucugcagagccaacgggcuugccaggccgacugc

SEQ ID NO: 282759 - RNA, 64 nt, Human
ccccgcucuuccagcacuuccaccggcagagucccagagccacuucacccugggggugggcugu

SEQ ID NO: 282760 - RNA, 64 nt, Human
aguaaggcauauggcucacagugaugaugccagucagagccaggccagauggaaauuguuuucu

SEQ ID NO: 282761 - RNA, 59 nt, Human
uucaacacacacagacaaacacagccacacgcgcacacaaguauaagacuuuuuguauu

SEQ ID NO: 282762 - RNA, 59 nt, Human
cccaggucugcagcuccagguacauaucacgcgcacagccuggcagccuggcccuccug

SEQ ID NO: 282763 - RNA, 59 nt, Human
uauagaaauauauacgaacaaaacacacgcgcgcacacacacacauacacgaaagagag

SEQ ID NO: 282764 - RNA, 59 nt, Human
ccguucccagguguacgcacgcgcgcgcgcgcgcacagacacacacacacacacacaca

SEQ ID NO: 282765 - RNA, 59 nt, Human
gagagaggaauggagagacagagggggcgcgcgcacaggagccugacuccgcugggaga

SEQ ID NO: 282766 - RNA, 59 nt, Human
uggcccguccuuggugagugcacacacugcgcgcacacaucgcggccuuccuggcuucu

SEQ ID NO: 282767 - RNA, 59 nt, Human
cccgccggaggagcgcguccccagccuuccgcgcacagagccgcaucccgccccgcccu

SEQ ID NO: 282768 - RNA, 64 nt, Human
uucugccucagccuccugaguagcugggauuacaggugugcaccaccguacccagcuaauuuuu

SEQ ID NO: 282769 - RNA, 64 nt, Human
cccccuuccggccugaaagcccucccugcaagaaggugugcaggagagaagaggccccggcaug

SEQ ID NO: 282770 - RNA, 64 nt, Human
aauccuacugcuuuuccuaaaaacagaauaauuuggugugcauucuuucagacuuuuuccuaua

SEQ ID NO: 282771 - RNA, 64 nt, Human
acagcgcgcugcucucggcguucucuguccacugggugugcauugauuuaaacuucuccacugu

SEQ ID NO: 282772 - RNA, 64 nt, Human
uaaacucucaaacucuauuuagcugugaaauaguggugugcaauuccuuguuaaagaaaugcua

SEQ ID NO: 282773 - RNA, 64 nt, Human
ggggcgggacagcgucggccugauuucccguaaaggugugcagccugagagacgggaagaggag

SEQ ID NO: 282774 - RNA, 64 nt, Human
gagcucggggugugugugugcgugcuguguguauggugugcacauacgugagugugggugugug

SEQ ID NO: 282775 - RNA, 64 nt, Human
uucuuuccuuugcaccagcuucccgauacuucuuggugugcaagaggaaggguaccuguagaga

SEQ ID NO: 282776 - RNA, 64 nt, Human
ugugcuuccugaugcuuccauggggaugugcccuggugugcaucugcuugucaggaagagucac

SEQ ID NO: 282777 - RNA, 64 nt, Human
gagaccaaggagccagcuggcgggaaggggugggggugugcagucugcccuguccuucugcuca

SEQ ID NO: 282778 - RNA, 64 nt, Human
uuccgccucacccuccugaguagcugggacuacaggugugcaccaccacaccuggcuaauucuu

SEQ ID NO: 282779 - RNA, 64 nt, Human
agcccaaauggcucugugaaaucagaagugcaaaggugugcaaacuuguaucugaagaccuacc

SEQ ID NO: 282780 - RNA, 64 nt, Human
ucuacuaaagauacaaaaauuugcugagcgugguggugugcaccuguaaucccagcuacucgag

SEQ ID NO: 282781 - RNA, 64 nt, Human
ucacaaagggaauaaaacaggauugagauuuugaggugugcacaaggugguaagauaaagggca

SEQ ID NO: 282782 - RNA, 64 nt, Human
ccuggaagccaaacaaaggcccagcagccuucugacaagcaagggcugugcugaggucaccacg

SEQ ID NO: 282783 - RNA, 64 nt, Human
cacccaaccaacuuuccccccaacccggaaacagacaagcaacccaaacugaacccccucaaaa

SEQ ID NO: 282784 - RNA, 64 nt, Human
ggaccacauaguccaucgaagaagaguccuuggaacaagcaacuggcuauugaaaagguuauuu

SEQ ID NO: 282785 - RNA, 64 nt, Human
cgccgaguagcuuguguggaugcaguccugugagggugugcauaaccguucccagguguacgca

SEQ ID NO: 282786 - RNA, 64 nt, Human
uggugaagucagcagauauuuauugaguuccuguggugugcaaagcauuaugauaggcaccgug

SEQ ID NO: 282787 - RNA, 64 nt, Human
uccugccucagccuccugaguagcugggauuacaggugugcaccaacacacccggcuaauuuuu

SEQ ID NO: 282788 - RNA, 64 nt, Human
ccccaccucagccuuccaaguaacugggacuacaggugugcaucacuggcagugggaauugugg

SEQ ID NO: 282789 - RNA, 64 nt, Human
ggguggggucuuaggacgggaggcuguguccgugggugugcagugcccagcacgggacccggcu

SEQ ID NO: 282790 - RNA, 64 nt, Human
ggguccacgauguacaaagucauuucggccaguaggugugcagaccccuccccgccacgaucgu

SEQ ID NO: 282791 - RNA, 64 nt, Human
guuugacauagagagaugucagauugauuugaaaggugugcagccugauuuaaaaccaaacccu

SEQ ID NO: 282792 - RNA, 64 nt, Human
uaaugugucugcuccuuguugggcagacaccagcggugugcagggagagaccaaguaccaucuu

SEQ ID NO: 282793 - RNA, 64 nt, Human
uguuacauagguaaacugcaugucauggggguuuggugugcagauaauuuuaucacacaauuau

SEQ ID NO: 282794 - RNA, 64 nt, Human
aaaaaaaaaaaaaaaccaaaaagccaagugugguggugugcaccuauagucccagcuacucagg

SEQ ID NO: 282795 - RNA, 64 nt, Human
uugccaaagucugcagaagagcucuucaguuguuggugugcacuccaagucaggauggacaaug

SEQ ID NO: 282796 - RNA, 64 nt, Human
gguguuuccggaggagcaaguccuuuuccaacugggugugcaugcuaaaaaccuguauuuucau

SEQ ID NO: 282797 - RNA, 64 nt, Human
caugacaugccgaugguuguuuauuuuguuuuuaggugugcauucuuuuucuucuuagcaauuc

SEQ ID NO: 282798 - RNA, 64 nt, Human
gaucauucuaagaccagauucucuaauguuucugggugugcaauagagugaucacaucuuuguu

SEQ ID NO: 282799 - RNA, 64 nt, Human
cagaguauuuauaaaacugucuuuuagaaaaaaaacaagcaagaagaccauuugaccauaugaa

SEQ ID NO: 282800 - RNA, 64 nt, Human
aaaauuacuaauugcucuagugcauauuugaacuacaagcaacuuuuuaggaauaccucuuuau

SEQ ID NO: 282801 - RNA, 64 nt, Human
uauauagaauuucuauuaaggauuuuuuaaauggacaagcaauaggggguugaaguguuuaucu

SEQ ID NO: 282802 - RNA, 64 nt, Human
uuagggaagaaucugacaggaagaagcgcacaggggugugcacaaagaaaaugacaugaaucuu

SEQ ID NO: 282803 - RNA, 64 nt, Human
aguccccuaugugcccccaagucaucugagcauuggugugcauuaagguacucaaucuuccaac

SEQ ID NO: 282804 - RNA, 64 nt, Human
cccgcccccuauuuguggacuaaagaugaacucuggugugcaugcuauuauugcugcaauuaga

SEQ ID NO: 282805 - RNA, 64 nt, Human
auguugccugcuguccaggagcccgggagggaggggugugcaggagccgcagggccguguggga

SEQ ID NO: 282806 - RNA, 64 nt, Human
auuugcaggggggucugaauguaacucaccauguggugugcaagguuccccugcauuguauugc

SEQ ID NO: 282807 - RNA, 64 nt, Human
ggcgccccacuuggagggcgguggucuguuacagggugugcaggggcagagaaggaagggacca

SEQ ID NO: 282808 - RNA, 64 nt, Human
uuuucuuuggcagaccaagugaagacucaggaauggugugcauuauaaaugacacacauugcca

SEQ ID NO: 282809 - RNA, 64 nt, Human
uaaccuaaaacacguggcucugaccugugcugauggugugcagucauucauauuccagcugaau

SEQ ID NO: 282810 - RNA, 64 nt, Human
ggcuugcugccaggcuugcacugccguuccugggggugugcaucuucgggaaaggugguggcgg

SEQ ID NO: 282811 - RNA, 64 nt, Human
cuggggaauuagaaaaaauaauaagucgcugucaggugugcaugaagaaaagacacugaagcua

SEQ ID NO: 282812 - RNA, 64 nt, Human
uuugcacuuaccuuguccuauauauccguacggaggugugcaauuccucgugucaguagccuug

SEQ ID NO: 282813 - RNA, 64 nt, Human
ucauuccuugauuuguguuugucuuggccuuccuggugugcaguacugcuguagaaaaguauua

SEQ ID NO: 282814 - RNA, 64 nt, Human
ugucuuuuuccuuuagccuuagcaguggguaugaggugugcagggggagcuggguggcuucacu

SEQ ID NO: 282815 - RNA, 64 nt, Human
ggaaugacaugaccugugacacccccuaucagugggugugcaagaagcccaugggccagggugu

SEQ ID NO: 282816 - RNA, 64 nt, Human
agccucuccccagguccagcucuggaggggagggggauccgacugcuuuggaccuaaauggccu

SEQ ID NO: 282817 - RNA, 64 nt, Human
aguuggaagcauacugaagugucuuggugaaccuggauccgaguccaugaguuugaggacuaca

SEQ ID NO: 282818 - RNA, 64 nt, Human
ugaacccuuggccauugauagucuaccuuugcugggauccgaaggaacuguacucccccugccc

SEQ ID NO: 282819 - RNA, 64 nt, Human
ugagccugcuagacugagugacugcaguuaggagggauccgacagagaagaccauuuccacuca

SEQ ID NO: 282820 - RNA, 64 nt, Human
acuagugcaggagggaagucagcagccuguguuuggugugcaacucaucaugggcaugagacca

SEQ ID NO: 282821 - RNA, 64 nt, Human
uguccuguuggcugguggcugcauuauguccuggggugugcaugugggucuauuuagagcuucu

SEQ ID NO: 282822 - RNA, 64 nt, Human
cacacuccgcagcuaggggcugccuaccccgcugggugugcacacacuccucucaagagcugcc

SEQ ID NO: 282823 - RNA, 64 nt, Human
gaagcaauggucgugccaaagagguccacaaccaggugugcacuguucacugcagcccauuugc

SEQ ID NO: 282824 - RNA, 64 nt, Human
cgcugccucagccucccaaauaacuggggccacaggugugcaccacaacucucagcuaauuuuu

SEQ ID NO: 282825 - RNA, 64 nt, Human
agauaugguccauuuguuuuucuuccugcaauguggugugcagagaugcugcauauccuuuuua

SEQ ID NO: 282826 - RNA, 64 nt, Human
agaauauucauuucuugcuuaugagugccugcauggugugcaccauagguuuccgcuuucaugg

SEQ ID NO: 282827 - RNA, 64 nt, Human
uuguuugggccccugaaguuccaucuccgagaguggugugcagggcaggccagggcccaugcug

SEQ ID NO: 282828 - RNA, 64 nt, Human
aaauggauuugugcagaccuggcuguggcuugcuggugugcaagcacacaucacuuuagagggg

SEQ ID NO: 282829 - RNA, 64 nt, Human
cauccacaccaagaggguguugugaugaggugccggugugcaaagggaacuuuaguuuuuccac

SEQ ID NO: 282830 - RNA, 64 nt, Human
ugggcugggucuuccaaaccuaccaugaaacccuggugugcaggcugcacucaaugaccucaac

SEQ ID NO: 282831 - RNA, 64 nt, Human
uuucuuucucuucaguccucugaguacaucugguggugugcauuagaugugagggcuauguuga

SEQ ID NO: 282832 - RNA, 64 nt, Human
agcacuuggcugaguuggguuggaguacacaccuggugugcagggugaagcagcucauuuuguc

SEQ ID NO: 282833 - RNA, 64 nt, Human
uuggaauccuuuggccagaugucacuucagccagggugugcaucaucauugguucuuuuucaca

SEQ ID NO: 282834 - RNA, 64 nt, Human
uauguagagacauauguggcuucauugguaauuuacaagcaaaagaugacaugacgugacaccu

SEQ ID NO: 282835 - RNA, 64 nt, Human
agaaauggaaaaaaaaaucaaaaaucuuaaaaaaacaagcaaacaguccagcuuccuguccucc

SEQ ID NO: 282836 - RNA, 64 nt, Human
uucauaagugaaggagaaauaaaauacuuuacagacaagcaaaugcugagagauuuugucacca

SEQ ID NO: 282837 - RNA, 64 nt, Human
uacaacuaucugaccuuugacaaaccugacaaaaacaagcaauggggaaaggauucccuauuua

SEQ ID NO: 282838 - RNA, 64 nt, Human
uuugccuguagggguagacucggaagguggguggggugugcauuuccuguuaggaguguaucag

SEQ ID NO: 282839 - RNA, 64 nt, Human
uccuaccugagccuucugaguaacuggaacuacaggugugcacuccucgccuggcuaauuuuuu

SEQ ID NO: 282840 - RNA, 64 nt, Human
cauaaauaauuccaauagucugcacuucucccaaggugugcacugcucauaaacuugccagugu

SEQ ID NO: 282841 - RNA, 64 nt, Human
acuaacaaagaaaaacaauacuuccugggguuuuggugugcagagggcuuuguuggaaguguga

SEQ ID NO: 282842 - RNA, 64 nt, Human
aucaacuuccugagugucuaaagaagaugaggaaggugugcaggaagaaaacucccuugggaga

SEQ ID NO: 282843 - RNA, 64 nt, Human
cugccacuugguuauguugugugugugcgugaguggugugcaggcgcgguuccuuacgccccau

SEQ ID NO: 282844 - RNA, 64 nt, Human
ucuccaccauuucucuauguacuuuauaugcacgggugugcaugccugugugggccaguguccc

SEQ ID NO: 282845 - RNA, 64 nt, Human
guugggggcgagcucaucaguacccagagcgccuggugugcagccaaaggcccccauuuuauua

SEQ ID NO: 282846 - RNA, 64 nt, Human
ugaggugcuuacggcacaguguccagggcagcugggugugcagggacugggggcucccggaaga

SEQ ID NO: 282847 - RNA, 64 nt, Human
gcuuugggaacacuggccugggucucccugguggggugugcaugccacgccccgugucuggaug

SEQ ID NO: 282848 - RNA, 64 nt, Human
ugucuggagacacagaccgugaccuuggcgcagcggugugcaucagaggcgugugcugagaagg

SEQ ID NO: 282849 - RNA, 64 nt, Human
auaaauauauuuucuuucuaguuuguuuaguuaaggugugcaguguuuuuccuguguauuaaac

SEQ ID NO: 282850 - RNA, 64 nt, Human
gacuuucaaaucacguuaggaccuggauugaggaggugugcaguucgcugcucccugcuuggcu

SEQ ID NO: 282851 - RNA, 64 nt, Human
gaaugauugaauaucuugaaauguugaaauguaaggugugcacagugaucuucaacuuaacaaa

SEQ ID NO: 282852 - RNA, 64 nt, Human
ccucaauuuuuccuuaucuuguuuuccacaauucacaagcaacagcaagcauuuucuauaauuu

SEQ ID NO: 282853 - RNA, 64 nt, Human
uaacgggggauucucugccuuuuuguaucaaagaacaagcaaauggacccccgcccgcugcagg

SEQ ID NO: 282854 - RNA, 64 nt, Human
aaacuauuccugcagaacugccugguuggcguccacaagcaauaccucucguuccagcaggacc

SEQ ID NO: 282855 - RNA, 64 nt, Human
cuucauauaaaugcuacagaaaaaccuuuguuuuggugugcacauccauuuuguuuuugcuuua

SEQ ID NO: 282856 - RNA, 64 nt, Human
caaccuguaacugcccuuuuaaauggcaugacaaggugugcaguggccccauccagcaugugug

SEQ ID NO: 282857 - RNA, 64 nt, Human
uucugcuguaaauccuugccgccugcugaaacauggugugcaggucaacggagaauacuagcug

SEQ ID NO: 282858 - RNA, 64 nt, Human
aaccacuacgggucuggcagugcgugucccguggggugugcauuuuaaaacucgauucauagac

SEQ ID NO: 282859 - RNA, 64 nt, Human
ucucgcugguuagugccucguuggcugaggacuaggugugcauuucuccuagcuuuucaucagg

SEQ ID NO: 282860 - RNA, 64 nt, Human
gacaauaaagcaugcacuguaagaacugaccucaggugugcagaucuacuuugauuugggguuu

SEQ ID NO: 282861 - RNA, 64 nt, Human
uuccugcccuuucccauugcuacugauuugccacggugugcagcuuuuacucgccaccuuccgg

SEQ ID NO: 282862 - RNA, 64 nt, Human
gcggauggacagcacccaccuggguuuacucaagggugugcauucauuuuaggugggaucgcca

SEQ ID NO: 282863 - RNA, 64 nt, Human
cuugauagacaucuauaacguuauuauuuucaguggugugcagcauuuuugcuucaugaguaug

SEQ ID NO: 282864 - RNA, 64 nt, Human
uuccaccuuagccucuggagcagcugggacuacaggugugcacuaccacaccaggccaauuuuu

SEQ ID NO: 282865 - RNA, 64 nt, Human
aauuuuggaaugaauacugacaauauuccaugagggugugcaagcacaaauuuuaccaaucuga

SEQ ID NO: 282866 - RNA, 64 nt, Human
uuucuuggcgacucuaggugaacagccuccagacggugugcaccaacaucuacaagauccuccu

SEQ ID NO: 282867 - RNA, 64 nt, Human
ugaugagucuaacuguuccaaacgccucccaccuggugugcacagcugccuggguccauuguca

SEQ ID NO: 282868 - RNA, 64 nt, Human
uuaugcuuuuaucuucucugcaguguuauauguuggugugcaaaaauguuaaauuuauuuuucc

SEQ ID NO: 282869 - RNA, 64 nt, Human
cacugggaaggacaaagaguuugccgccuuucggggauccgagggacuguggcgaccgugccuc

SEQ ID NO: 282870 - RNA, 64 nt, Human; identical to SEQ ID NO: 281720

SEQ ID NO: 282871 - RNA, 64 nt, Human
ccauccccccucaccaggggcaggcacagcacagggauccgacuugaauuuucccacugcaccc

SEQ ID NO: 282872 - RNA, 64 nt, Human
gcccggcccccuguccuggccaagcugccggccuggauccgagcccguguggaggucaaagcua

SEQ ID NO: 282873 - RNA, 64 nt, Human
uaaucuuagcauugaagccaccaauguaauuaauggugugcaguuauuuuaaaaacuacagauc

SEQ ID NO: 282874 - RNA, 64 nt, Human
uuguauuucacauauuacaauuugucacauuguuggugugcacuuuguggguucuuccugcaua

SEQ ID NO: 282875 - RNA, 64 nt, Human
gucuucuuuuucuugugcuuucccccuauuccagggugugcacccucuccccaacccccaagaa

SEQ ID NO: 282876 - RNA, 64 nt, Human
ucuacuaaaaauacaaaaauuaaccaggcuugauggugugcaccuguaaucucagcuacucggg

SEQ ID NO: 282877 - RNA, 64 nt, Human
uccuaccucagccucccaaguaguugggaccacaggugugcaccccauauccagcuauuuuuuu

SEQ ID NO: 282878 - RNA, 64 nt, Human
uccugccucagucuccugaguagcugggacuacaggugugcaccaacaugcccagcuaauuuuu

SEQ ID NO: 282879 - RNA, 64 nt, Human
ggcuauaguaccaaaguacuuuugguguuugguuggugugcauuucuuuagugucgauaguaac

SEQ ID NO: 282880 - RNA, 64 nt, Human
auugaaaguauuuggaggaaaaugguuaauucugggugugcaccaggguucaguagaguccacu

SEQ ID NO: 282881 - RNA, 64 nt, Human
gaagccccucguggcagggcguuuucuguccuguggugugcauucucuaccaaaucaagcagga

SEQ ID NO: 282882 - RNA, 64 nt, Human
ccgcuuuuccucuccgugaggacagggcagucuuggugugcagccccucuccucucuguccccu

SEQ ID NO: 282883 - RNA, 64 nt, Human
ccaaagacagaugucagugggcugcucuggcccuggugugcacggcuguggcagcuguugaugc

SEQ ID NO: 282884 - RNA, 64 nt, Human
gugcacacacggguguuggugcaacucaccagcaggugugcaguaggcaagcuugaagguggcc

SEQ ID NO: 282885 - RNA, 64 nt, Human
ucuacaaaaaauuuaaaaauuauccagguguaauggugugcaccugugauccuagcuacuuggg

SEQ ID NO: 282886 - RNA, 64 nt, Human
aacuugugcaauaucuguguaauguagaauguggggugugcaugcagaugucugguacuggagu

SEQ ID NO: 282887 - RNA, 64 nt, Human
gauugauuuuguguuuucuuaggcauuucaagugacaagcaaaguaaauguauauauuauguga

SEQ ID NO: 282888 - RNA, 64 nt, Human
aaacaauuguauucccagccugugucccaugggcacaagcaaaucccaaauucuccuccugaac

SEQ ID NO: 282889 - RNA, 64 nt, Human
cuccaacucagaaaaagcaaaacaaaacaaacaaacaagcaaaaaaccacaauuagacugacag

SEQ ID NO: 282890 - RNA, 64 nt, Human
uagcuacauaauuuuaagaauuaguauuuucaguggugugcauauuuugguucuuaaauuuuug

SEQ ID NO: 282891 - RNA, 64 nt, Human
ccccaucagcugcccggacccuuuggccuggcuuggugugcaggccugucuguuugcuuaaagu

SEQ ID NO: 282892 - RNA, 64 nt, Human
gaucuguuuuuucacacugauccguauuccccugggugugcacacagggcggguguggggcauu

SEQ ID NO: 282893 - RNA, 64 nt, Human
cauuccuacuuaaacccagcagggaacagggagcggugugcagaggagguggccugcccgggaa

SEQ ID NO: 282894 - RNA, 64 nt, Human
uccugucucagccuccugaguagcugggacuacaggugugcaccaccacgcccggcuaauuuuu

SEQ ID NO: 282895 - RNA, 64 nt, Human
uggagggggcaggguccagcccgccuggaucgguggugugcaccugaugggauuugggaaaugg

SEQ ID NO: 282896 - RNA, 64 nt, Human
gcccuuuucggaguauugcaaaggagcuaaaacuggugugcaaccgcacagcgcuccuggucgu

SEQ ID NO: 282897 - RNA, 64 nt, Human
uacaaguguuuucggggcauacauuuuuuuucugggugugcaucuguugaaaugcucaagacuu

SEQ ID NO: 282898 - RNA, 64 nt, Human
uucccacuggagccgcccaagcuuguagguggguggugugcauaggccacgugugccccacaua

SEQ ID NO: 282899 - RNA, 64 nt, Human
cucucccacucagcuaugcuagggcuuggcuguaggugugcacugucuauuuacauccguccuu

SEQ ID NO: 282900 - RNA, 64 nt, Human
acagcccagggggugugcccacggcugacccaggggugugcacacggcugagcugggagucccg

SEQ ID NO: 282901 - RNA, 64 nt, Human
acaaagucaagccacauggugacuuuugaaaagaggugugcaagagagggaugcauggagauag

SEQ ID NO: 282902 - RNA, 64 nt, Human
ucccaccucagcuuccugacuagcugggacuacuggugugcaccaccacacccagcuaauuuuc

SEQ ID NO: 282903 - RNA, 64 nt, Human
uccugucucagccuccugaguagcuaggacuacaggugugcaccaccacgccccgcuaauuuuu

SEQ ID NO: 282904 - RNA, 64 nt, Human
auauccauuaccucuagcauuuauucuuuuuauuacaagcaauucaauuguacacuuuuaguua

SEQ ID NO: 282905 - RNA, 64 nt, Human
aucuaugcuggacucacagccaaauuaauacugaacaagcaaaagcuggaagcauuccccuuga

SEQ ID NO: 282906 - RNA, 64 nt, Human
uggcugcgcaccaucucugugauccuguuccucaacaagcaagaucugcucgcugagaaagucc

SEQ ID NO: 282907 - RNA, 64 nt, Human
agauacugaaaguccuggggcaguaucuucugauggugugcaugugaggagaagaugagguuag

SEQ ID NO: 282908 - RNA, 64 nt, Human
guggaaagccaggucagccagaccuguuagaauuggugugcacucaccugagagaucuggcagg

SEQ ID NO: 282909 - RNA, 64 nt, Human
aaagcucuuggaggcuuuaaaguucuuucuguugggugugcauuacaguuuacuuaacugaugu

SEQ ID NO: 282910 - RNA, 64 nt, Human
uggucaaccagucacuaguugguuggcaugagguggugugcagaggaaagcugcauucacuauu

SEQ ID NO: 282911 - RNA, 64 nt, Human
acuaaaaauacaaaauaauuagccggguguugguggugugcaccuguaaucccagcuacucagg

SEQ ID NO: 282912 - RNA, 64 nt, Human
ugugcaguagaagcuagugagcaugugagcaagcggugugcacacggagacucaucguuauaau

SEQ ID NO: 282913 - RNA, 64 nt, Human
gaaaucuccaauucaguaagugcaaaagagaauuggugugcaucugagaggucugacauuucau

SEQ ID NO: 282914 - RNA, 64 nt, Human
ugucaguagggaugugugccuggcuguguacgugggugugcagugcacgugagagcacguggcg

SEQ ID NO: 282915 - RNA, 64 nt, Human
ucccaccucagccauccaaauagcugggaccacaggugugcaccaccacgcccggcuaauuuuu

SEQ ID NO: 282916 - RNA, 64 nt, Human
gaaaagcacaaggggccaaggucagggagcaagaggugugcacaccaaagcuauuggagauuug

SEQ ID NO: 282917 - RNA, 64 nt, Human
aaaagguauagacaaccagcuaaacugccuuuuuggugugcacacacauuucaugugcagacgu

SEQ ID NO: 282918 - RNA, 64 nt, Human
ugcuuuggcuagugacaguuuuuugcaugggacuggugugcaaugaacuuguauuuauccuucu

SEQ ID NO: 282919 - RNA, 64 nt, Human
ucaugccucagccucccaaguagcugggacuacaggugugcaccacuacuccuggauauuuuuu

SEQ ID NO: 282920 - RNA, 64 nt, Human
ggugaaaacgagauugauccgucugggguuuuacggugugcacugggugcugcacagacuuguc

SEQ ID NO: 282921 - RNA, 64 nt, Human
gcuggcuacugauugcuccaggcggacaaggcugacaagcaauccaggaacaaaauacucacca

SEQ ID NO: 282922 - RNA, 64 nt, Human
acagccaguggccuguccgcauugcccugugcccacaagcaacaguccacagcccuugguggcu

SEQ ID NO: 282923 - RNA, 64 nt, Human
agccacagccaagggcccaagcagaaguacacccacaagcaaggccuuggauuucuggcuccca

SEQ ID NO: 282924 - RNA, 64 nt, Human
gcaguggacucgcugauccugggccgcagccuggggugugcagccaucucauucugugaaugug

SEQ ID NO: 282925 - RNA, 64 nt, Human
cuacuaaaaauacaaaaaauuagccaggugugguggugugcaccuguagucccagcuauuuggg

SEQ ID NO: 282926 - RNA, 64 nt, Human
ccgggaacgcccccgcccccgccccgcugcucccggugugcagcgggugcgggugccgcuuaaa

SEQ ID NO: 282927 - RNA, 64 nt, Human
augguuccgcuuccggccgggagcccugaacacgggugugcagacucacccuaaagggcggccc

SEQ ID NO: 282928 - RNA, 64 nt, Human
uuacucaaguucagucugcagccaaaaccauuagggugugcauugcagacuguuuuguugucuu

SEQ ID NO: 282929 - RNA, 64 nt, Human
uugugucucagucuuccggguagcugggacuacaggugugcaccacuaugccuggcuaauuuug

SEQ ID NO: 282930 - RNA, 64 nt, Human
guacauuguuaacauuaaggaaagcuggcagaagggugugcauaaauucuauacucuuuuugaa

SEQ ID NO: 282931 - RNA, 64 nt, Human
cccucugugguucauauuacuacuucuguuccauggugugcaggucugcuucuuaauucagugu

SEQ ID NO: 282932 - RNA, 64 nt, Human
ccccaggagcucuuuccuuuccccucuaguuuugggugugcauguuuggaguuuguagugggug

SEQ ID NO: 282933 - RNA, 64 nt, Human
gggugguugcuggggugguccucauggacagugaggugugcaagggugcacugagggugguggg

SEQ ID NO: 282934 - RNA, 64 nt, Human
ucccgcuucagccucucaagcagcgggaacuacaggugugcacuaccacaccuggcuauuuuuu

SEQ ID NO: 282935 - RNA, 64 nt, Human
ugccccuugacuguaggagccagaaggggacccaggugugcauagcucucuguagacauuuuua

SEQ ID NO: 282936 - RNA, 64 nt, Human
uguguauuucacugcugagaacauccuuuaacuuggugugcaauuugaaaggaugugaaucaug

SEQ ID NO: 282937 - RNA, 64 nt, Human
gccggagaggaagagacacucagaccagagaaggggugugcaugcgccuacucgcuugcuagaa

SEQ ID NO: 282938 - RNA, 64 nt, Human
cuuuuccccccugacccagaacagccuuuaaaucacaagcaaaauaggaaaguuaaccacggag

SEQ ID NO: 282939 - RNA, 64 nt, Human
gaaagcagugugcauaucuugaggggugaugaacacaagcaaaccaaguugcaccuggcuucug

SEQ ID NO: 282940 - RNA, 64 nt, Human
gucagccaccugggaacacaguucugggcaaagaggauccgagguugagaggaaggaggguccc

SEQ ID NO: 282941 - RNA, 64 nt, Human
guugucucuagauacagaugcacgauuuggccauggauccgacuacucucgccaacagaacaga

SEQ ID NO: 282942 - RNA, 64 nt, Human
ccgcaucuucuguucccugggaugccuuagacggggugugcaguauuuuagguacaucgugagc

SEQ ID NO: 282943 - RNA, 64 nt, Human
ucaugccucauccucccaaguagcuggaacuacaggugugcaccaccaugccugguucauuuuu

SEQ ID NO: 282944 - RNA, 64 nt, Human
cuaccugcggggguaacgggccugggggcugccaggugugcagggccaauccugacgguaauug

SEQ ID NO: 282945 - RNA, 64 nt, Human
augguggguccaugggcagagcccaagggaauucggugugcaccaggguugaccccagaggauu

SEQ ID NO: 282946 - RNA, 64 nt, Human
aacaugacaggagcugggacugguuugaacacagggugugcagauggggaggggguacuggccu

SEQ ID NO: 282947 - RNA, 64 nt, Human
aaaagaacucauucauaggaagguguuucauuuuggugugcaacccugucauuacgucaacgca

SEQ ID NO: 282948 - RNA, 64 nt, Human
ugccaucagagaagggacacacagcccguucgaaggugugcagagggcucugagcgccaggaug

SEQ ID NO: 282949 - RNA, 64 nt, Human
aguaaaucauccucuuuucaagagcaguguccguggugugcaguuccucuccaauugcugcgug

SEQ ID NO: 282950 - RNA, 64 nt, Human
guacgcgcguguguacacaugcguggccgccuguggugugcacgugugcucugggcuccgaggc

SEQ ID NO: 282951 - RNA, 64 nt, Human
caucaucgugggaggggagcagggcacaggggauggugugcauucagagcauuggguugggggc

SEQ ID NO: 282952 - RNA, 64 nt, Human
gccagacaggagggaggugcguguggauguauguggugugcacauguggccagaggugugugcg

SEQ ID NO: 282953 - RNA, 64 nt, Human
gcgacccggaguuuccccagaagcggggugggagggugugcaugcuaguguuggcgcguaugca

SEQ ID NO: 282954 - RNA, 64 nt, Human
agucaccagcccucugccugcagccauggaagggggugugcacgugccucuguguguguggcug

SEQ ID NO: 282955 - RNA, 64 nt, Human
ggccucaccccaccccuacccgccacagccucagggugugcaggggagccugcugcacagauau

SEQ ID NO: 282956 - RNA, 64 nt, Human
auaauaaagcuuucagguguuacagaaaucguagacaagcaagugcacaugauaaacaucaaaa

SEQ ID NO: 282957 - RNA, 64 nt, Human
uuuuuaauauuuuuuacaaaaaaaaagauuuuauacaagcaauauauauauggauuucuauaau

SEQ ID NO: 282958 - RNA, 64 nt, Human
cuccacugccucccagcagaucuguggagacaaaacaagcaacaccuuaaaagaguuuuauuuc

SEQ ID NO: 282959 - RNA, 64 nt, Human
ucaaauuuaaccauuuucauaacugguuccuggaggugugcagugcccccuugccucuucaaac

SEQ ID NO: 282960 - RNA, 64 nt, Human
uacucuaauauagauuuugguggauaauuuugugggugugcauuuuguucuguuuuguuggguu

SEQ ID NO: 282961 - RNA, 64 nt, Human
ucugucuuuuuugaucaguguccuauacaucgaaggugugcauauauguugaaugacauuuuag

SEQ ID NO: 282962 - RNA, 64 nt, Human
uuuuuaaauagggaauaugauagcuucgcaugguggugugcaccuauagcccccacugccugga

SEQ ID NO: 282963 - RNA, 64 nt, Human
gggaggugagguguccguccacuucccccauaaaggugugcauuucaguuaggcugccccgcca

SEQ ID NO: 282964 - RNA, 64 nt, Human
uugauguuuagaaguucguggaaguagacgcugaggugugcagaggagcugguggauaacagag

SEQ ID NO: 282965 - RNA, 64 nt, Human
gagcagaaagugaaggagggacacgugcaagaguggugugcaugguggugugacaugaggaccg

SEQ ID NO: 282966 - RNA, 64 nt, Human
ucaugccucggccucuccaguagcugggauuacaggugugcaccaccacgccuggcuaaauuuu

SEQ ID NO: 282967 - RNA, 64 nt, Human
acuaagcuaaggagaagccagaugccgguuacugggugugcaggggcuguucugagcugggggg

SEQ ID NO: 282968 - RNA, 64 nt, Human
agccauggcaccaaaggagaaggggcauuuugugggugugcauuaggucugaacugcuuuaucu

SEQ ID NO: 282969 - RNA, 64 nt, Human
agggagggacagacagaaggccaaggcccgauguggugugcagagguggggagguggcgaggau

SEQ ID NO: 282970 - RNA, 64 nt, Human
cuuaguaguauuucaagguguuuacuuuucaauuggugugcacugaaugcauguauggaagaau

SEQ ID NO: 282971 - RNA, 64 nt, Human
ugcacaagaggaucugugacacugacauggcuguggugugcauacuguguaguuacauagcccu

SEQ ID NO: 282972 - RNA, 64 nt, Human
gcugugaaauuucuguaccuucaaccugguguuaggugugcaaaguccguguccuaccuccguc

SEQ ID NO: 282973 - RNA, 64 nt, Human
gccggcuacugagugcuccaggaggacaaggcugacaagcaauccagggacaagauacucacca

SEQ ID NO: 282974 - RNA, 64 nt, Human; identical to SEQ ID NO: 282973

SEQ ID NO: 282975 - RNA, 64 nt, Human
cggacaacauccuuucugucugaaacaaacagucacaagcaaaggaagaggcugggggacuaga

SEQ ID NO: 282976 - RNA, 64 nt, Human
uccugccucagucucccaaguagcugggauuacaggugugcaccaccacgccugacuaauuuug

SEQ ID NO: 282977 - RNA, 64 nt, Human
ccggccgcugcugccagccucagaaaggcacccaggugugcaggggagcacacagggcccggca

SEQ ID NO: 282978 - RNA, 64 nt, Human
uucucaaaaucuagcaaaggaaguagucugcauuggugugcauuacaguauuuugcuuaaugaa

SEQ ID NO: 282979 - RNA, 64 nt, Human
uuauuggauggaucagguggcccuguguaauagaggugugcauguauaacauggaagcuacuag

SEQ ID NO: 282980 - RNA, 64 nt, Human
aaagaccaucuuuccauaauuaaagaaccuggugggugugcacuaugagauuggagaaaugaau

SEQ ID NO: 282981 - RNA, 64 nt, Human
uauauacuuacguguauaucaguauaaaaacacuggugugcaauuaauuggauugauuauaaua

SEQ ID NO: 282982 - RNA, 64 nt, Human
ccuaugcucuccccagcggaaagugaccagaagaggugugcaguuuccaggccuggcccauaca

SEQ ID NO: 282983 - RNA, 64 nt, Human
ccuaagacagagacauuugaacagggccuugaagggugugcaggaguucgccagcaaagccagg

SEQ ID NO: 282984 - RNA, 64 nt, Human
cuauuacuggcuuuuuuuuuuuuuuuuuaacaauggugugcaugugcaggaaaugacaaauuug

SEQ ID NO: 282985 - RNA, 64 nt, Human
gggauuucucagcuucgguggaagauacgaaaagggugugcaauuuccuuuaaaauuuacacgu

SEQ ID NO: 282986 - RNA, 64 nt, Human
uuagaccuuuucuggguuuuguauugauuaucuuggugugcauuuaauuauuuuucugaauucu

SEQ ID NO: 282987 - RNA, 64 nt, Human
cugggguguuuucacugauaaacaacacauagcaggugugcauucauuacaaauauauguaucu

SEQ ID NO: 282988 - RNA, 64 nt, Human
cgcuaugaccccgcggggccgccucgcgaggaccggugugcacacguguacauauguauaggua

SEQ ID NO: 282989 - RNA, 64 nt, Human
accggacuugucacacggaccucgggcuaguuaaggugugcaaagaucucuagaguuuaguccu

SEQ ID NO: 282990 - RNA, 64 nt, Human
ccuuguuguuugaugaaugaugguuucaugagucacaagcaagcguucccccaacugcugaguc

SEQ ID NO: 282991 - RNA, 64 nt, Human
gucucugauauuuggaggggaacaaaaaucacucacaagcaauccaugaucuauacacauaagc

SEQ ID NO: 282992 - RNA, 64 nt, Human
cgcccugaagcguacgaccuuacacuuucucaguacaagcaacuguuauccauugaguccagac

SEQ ID NO: 282993 - RNA, 64 nt, Human
cuguggaauacuacaguaaauauuguuuucaaacacaagcaauaauucaaauaguuauuuuucu

SEQ ID NO: 282994 - RNA, 64 nt, Human
ugcuuggacacgcgugugcaugugcacgcaugcuggugugcaugcugggcugccuggcaaaucu

SEQ ID NO: 282995 - RNA, 64 nt, Human
ugguuucuugccauuuucacuuucagugauggugggugugcaguagaccaaaagugucuucugc

SEQ ID NO: 282996 - RNA, 64 nt, Human
cacagaaggcggagagagcuggggcucagacaugggugugcaccuuaauaaacccugcugucug

SEQ ID NO: 282997 - RNA, 64 nt, Human
uuuuaccaucuuauauuaaaaugaccuuuugacaggugugcacuguuuugucuccagugagcac

SEQ ID NO: 282998 - RNA, 64 nt, Human
cuaguugucugaauugagaaaagagugagaacuaggugugcaagaaccaaacguauuuuauuuu

SEQ ID NO: 282999 - RNA, 64 nt, Human
cuccaccaaggcuuuguuagcccccacccugccuggugugcagcuaaccccucccuccccacag

SEQ ID NO: 283000 - RNA, 64 nt, Human
ugcaaacacacagcggcccacagcuucacgugguggugugcagugugaggcagcuccuuggcuu

SEQ ID NO: 283001 - RNA, 64 nt, Human
uccccgcucagccuccugaguagcugggacuacaggugugcaccaccacacccagccaaaacag

SEQ ID NO: 283002 - RNA, 64 nt, Human
gaaauucuccaaauccagccauagauggcugcugggugugcagcaggagaaggaggauggucag

SEQ ID NO: 283003 - RNA, 64 nt, Human
uccugccucagccucccaaguagcugggauuacaggugugcaccaccaugcccggcuaauuuuu

SEQ ID NO: 283004 - RNA, 64 nt, Human
uugucaagaaaagcaguuugcagcaagggcauguggugugcaccuaguauuaaaauugcuuugu

SEQ ID NO: 283005 - RNA, 64 nt, Human
uuugagacagaguuuggcucuuguugcccaggcuggugugcaauggcgugaucucggcacacca

SEQ ID NO: 283006 - RNA, 64 nt, Human
gagaagguuccaaagcugagcacccaucacccuaggugugcaccagacuccuauuagccccucc

SEQ ID NO: 283007 - RNA, 64 nt, Human
auaggaagggaccaaggcaaggcaggugccuccaggugugcacguggcauguggccuguggccu

SEQ ID NO: 283008 - RNA, 64 nt, Human
uuuucaaaaauuugcugugaacaacgugaugacaacaagcaacauuuaucuaaugaacuacagc

SEQ ID NO: 283009 - RNA, 64 nt, Human
agggaguggcagaacugggccgccucucugguugacaagcaaaccacaugcuaaggcuuggagc

SEQ ID NO: 283010 - RNA, 64 nt, Human
uaauaaaaugguaaauuuuuuucucaguuauugaacaagcaagcauuauccaguugaucuggca

SEQ ID NO: 283011 - RNA, 64 nt, Human
ccaguucuagacuuuggagaugcagugucucccaggugugcacggacaccugguccguggaaac

SEQ ID NO: 283012 - RNA, 64 nt, Human
ugcuuugugcugaccgucagauugugucaagucaggugugcaaauugaccacacucccaaagaa

SEQ ID NO: 283013 - RNA, 64 nt, Human
agaaggugaacaccauccgggcccaugacaacccggugugcacgcuggucuccucacacaacgu

SEQ ID NO: 283014 - RNA, 64 nt, Human
ucgggacaagggggcuguguguggccuugagguuggugugcacaggcacuggcugcugugagug

SEQ ID NO: 283015 - RNA, 64 nt, Human
ccugcccaccccagccccuggaccugcuuaccugggugugcaccugcuccgggggguggaggug

SEQ ID NO: 283016 - RNA, 64 nt, Human
acccaccucagccuuccaaguagcugggacuacaggugugcaccaccacagcuggcuaauucua

SEQ ID NO: 283017 - RNA, 64 nt, Human
ggagcaucaucucuucgacccuaaagaugucaaaggugugcagcuuccaaacggcauccccagg

SEQ ID NO: 283018 - RNA, 64 nt, Human
gauucucauaaggagugcacaaucuagauccuuuggugugcaguucacaguaggauuugggcuc

SEQ ID NO: 283019 - RNA, 64 nt, Human
guguggugcagugugaaaaguccuugauuguucgggugugcaaugucugagugaaccuguauaa

SEQ ID NO: 283020 - RNA, 64 nt, Human
ugcuggcugagcugaacacauuugcccaauuccaggugugcacagaaaaccgagaauauucaaa

SEQ ID NO: 283021 - RNA, 64 nt, Human
gcuuguaauaaauuauuuacacgggagcugggcuggugugcaguggcaggucccgucagaagag

SEQ ID NO: 283022 - RNA, 64 nt, Human
uggccccagccugaggaggguguccuggccuccaggugugcagcaggggcugugugcuggggga

SEQ ID NO: 283023 - RNA, 64 nt, Human
ccuaaugguuucucuaauacagaauaagcaauauggugugcauguaaaccugacacagacaaaa

SEQ ID NO: 283024 - RNA, 64 nt, Human
ucuacuaaaaauagaaaaauuagccagguguaguggugugcaccuguagucccagcucuucagg

SEQ ID NO: 283025 - RNA, 64 nt, Human
ucuuaaagauacuccaagccacaugccacuaaccacaagcaagcuggcugcaagacuaaagagc

SEQ ID NO: 283026 - RNA, 64 nt, Human
ggaggaggaauacuagcccuuuuuauauauuuacacaagcaaaacuuuuaaauauuugaauuga

SEQ ID NO: 283027 - RNA, 64 nt, Human
uuuccaaccaguucugcagcauauuagauucuagacaagcaacaccccucuggagccagcacag

SEQ ID NO: 283028 - RNA, 64 nt, Human
uuguuaccccaggggcuguggcaugucccaggagggugugcaugugugugugugugugugugug

SEQ ID NO: 283029 - RNA, 64 nt, Human
cugcccgguuggaccuccucccuuuguugaauguggugugcagccucucaucucacacugugag

SEQ ID NO: 283030 - RNA, 64 nt, Human
ugaagggaagaaaucacugugcuuuguucggccuggugugcaaggaugguuggugguuuuccug

SEQ ID NO: 283031 - RNA, 64 nt, Human
uauauugacaagauggagaaagcaagaucaugaaggugugcaaaugauucuuacggcauggaca

SEQ ID NO: 283032 - RNA, 64 nt, Human
ucuguugcccacuucacaacacccagugaucaccggugugcaauugccuccuuggcucugaggg

SEQ ID NO: 283033 - RNA, 64 nt, Human
gagcagaggaccugaucccccacuagagagguccggugugcacagccggccucccagugugcca

SEQ ID NO: 283034 - RNA, 64 nt, Human
acucugcuuuauguugcggugagaacucugcccaggugugcaggguuuggcuugugggcugcuu

SEQ ID NO: 283035 - RNA, 64 nt, Human
ccaucaugcguggacugauaggacaucuuuucguggugugcaccagugcuuuccacacuugaca

SEQ ID NO: 283036 - RNA, 64 nt, Human
gucagggcccacugagacccaugcagaguuuccaggugugcacuggaagugaggucacaugagc

SEQ ID NO: 283037 - RNA, 64 nt, Human
uaccagaggcauaaacacaacugacucccauuuuggugugcaucugugugugugugcguguaua

SEQ ID NO: 283038 - RNA, 64 nt, Human
gccuggcuccccgagggcucagaagagcagcuucggugugcagaucauccgucugugugggguu

SEQ ID NO: 283039 - RNA, 64 nt, Human
ucuccuucucuuugagaccugacugaaaaaauuaggugugcacaccuguaaucccagcuaccug

SEQ ID NO: 283040 - RNA, 64 nt, Human
ggucggagggaucacgagacacagaaccuggaggggugugcacgcuggcagguggccucugcgg

SEQ ID NO: 283041 - RNA, 64 nt, Human
ucuguugacaagauggagaaagcaagaucaugaaggugugcaaaugauucuuacggcaugggcg

SEQ ID NO: 283042 - RNA, 64 nt, Human
acaggacuccacacagcguuugccaccagaaaccacaagcaaaaucuggaucuugggaccucca

SEQ ID NO: 283043 - RNA, 64 nt, Human
cucuuuaaaugaccaccuaaaggacaguauauuaacaagcaaagucgauucaacaacagcuucu

SEQ ID NO: 283044 - RNA, 64 nt, Human
aauaggaugauuccguguguguacugauucaagaacaagcaaugaugacccacuaaagagugaa

SEQ ID NO: 283045 - RNA, 64 nt, Human
aucugacaugauuccuuccuguucugaacuguggggugugcacaucucugcuugagucagguuu

SEQ ID NO: 283046 - RNA, 64 nt, Human
ucuacuaaaaauacaaaaauuagccaggcaugauggugugcaccuguagucccagcuacucagg

SEQ ID NO: 283047 - RNA, 64 nt, Human
ggggaggcguaggggucuacggcugccugagaugggugugcacagugugugaaguaccuaccuc

SEQ ID NO: 283048 - RNA, 64 nt, Human
gcccgcacccuggaauugccacucaguuccucugggugugcacauauguuuggagaaauagagg

SEQ ID NO: 283049 - RNA, 64 nt, Human
uauauugacaagauggagaaagcaagaucacgaaggugugcaaaugauucuuaaggcauggacg

SEQ ID NO: 283050 - RNA, 64 nt, Human
uccugccucagccuucugaguagcugggacuacaggugugcaccaccaugcccagcuaguuuuu

SEQ ID NO: 283051 - RNA, 64 nt, Human
uuuugagacaggaucuccaucugucacccaggcuggugugcaggggugcggucaugggcucaug

SEQ ID NO: 283052 - RNA, 64 nt, Human
acaccuggaccuccgugcccucaccccagcccuaggugugcaccuaggccucauuccuuacccc

SEQ ID NO: 283053 - RNA, 64 nt, Human
gcccccagccaugggaaagcaaacuucauccuaaggugugcagcccaggcccugccccuuuaca

SEQ ID NO: 283054 - RNA, 64 nt, Human
aggugcuccugcuucggcucuguuucggcucacaggugugcaucacugggcuuggauuugcauu

SEQ ID NO: 283055 - RNA, 64 nt, Human
cacucuaggggaccccuacuaaaggguaacuucaggugugcagcccugagcuccaaggcucugc

SEQ ID NO: 283056 - RNA, 64 nt, Human
ucccaccccagccucccagguagcuaguacuauaggugugcaccaccacgcccagcaaauuuuu

SEQ ID NO: 283057 - RNA, 64 nt, Human
ucccgccgugggggugcaggugauuguaaacacgggugugcauguggaugcacacgggugugcg

SEQ ID NO: 283058 - RNA, 64 nt, Human
acccugcguggcucuugucuguguuagcugucacggugugcacacuaaucucuguuaaaguugu

SEQ ID NO: 283059 - RNA, 64 nt, Human
gauucagaugagcauuuuccuuauacaauaccaaacaagcaaaaggauguaagcugauucaucu

SEQ ID NO: 283060 - RNA, 64 nt, Human
aaucauaugugcaguuaguauacaacugacuaaaacaagcaagcagagaaaagcaucagccuuc

SEQ ID NO: 283061 - RNA, 64 nt, Human
aagaacagccuguaaaaucgagcugcagacauagacaagcaagcuggaagcuuccacgggugaa

SEQ ID NO: 283062 - RNA, 64 nt, Human
ggacagggaguggggcaggcagugguugguggguggugugcaaagggaaugaagagcguccugg

SEQ ID NO: 283063 - RNA, 64 nt, Human
uggggauugggcccucuuucucccaguggaggaaggugugcaguguacuuccccuuuaaauuaa

SEQ ID NO: 283064 - RNA, 64 nt, Human
uucauguagguauguuucacuaugguaauaugguggugugcagugccugagucacgugauagau

SEQ ID NO: 283065 - RNA, 64 nt, Human
uucugccucagccucccgaguagcagggauuaccggugugcaccaccaugccuggauaacuuuu

SEQ ID NO: 283066 - RNA, 64 nt, Human
gagggcgaaggguaugugugugaccaucagcaguggugugcacauggcugggggacacucgguu

SEQ ID NO: 283067 - RNA, 64 nt, Human
cacagggcccaagggagcuggauguguugcccaaggugugcagggcaggucagggaagggcagg

SEQ ID NO: 283068 - RNA, 64 nt, Human
cacccaggggggccaguucagagacccacucccaggugugcauucucuuucucaaggauguucc

SEQ ID NO: 283069 - RNA, 64 nt, Human
cuaccuggccgccuucaccuggaugcugcuggagggugugcaccucuuccucacugcacggaac

SEQ ID NO: 283070 - RNA, 64 nt, Human
uccugccucagccucccgaguagcugggauuacaggugugcaccaccacacccggcuaauuuuu

SEQ ID NO: 283071 - RNA, 64 nt, Human
ccaucucugaaaaaaaaaauuagccaggcaugguggugugcaccugagaaucccagcuacucag

SEQ ID NO: 283072 - RNA, 64 nt, Human
cuacuaaaaauccaaaaaauuagccgggcuugguggugugcaccuguaauuccagcuacucggg

SEQ ID NO: 283073 - RNA, 64 nt, Human
ucgugcuucagccucccaaguaccugggacuacaggugugcaccaccacaccaggcuaauuuuu

SEQ ID NO: 283074 - RNA, 64 nt, Human
auaaguauaaccuuaaacaucagcuaauacaccuggugugcauuuucagucaggauaccuuaau

SEQ ID NO: 283075 - RNA, 64 nt, Human
cuacuaaaaauacaaaaguuagccggggggugguggugugcaccuuuaguuccagcuacuugag

SEQ ID NO: 283076 - RNA, 61 nt, Human
cucuuucugcacauaaauaaaaggaaaagaaacaagcaauuuuggaugaaaaugcaaaugg

SEQ ID NO: 283077 - RNA, 64 nt, Human
ggcucuuccaagucagaagaauggaggaagguggacaagcaacccagcaucccccgaccccuug

SEQ ID NO: 283078 - RNA, 64 nt, Human
aucugacacgggcaucccuggcuugcuuuuagcuacaagcaagcagcguggcuggaagcugaug

SEQ ID NO: 283079 - RNA, 64 nt, Human
agaaacucucuuggagcuuuugcauuuaaaacaaacaagcaagcagacacacacagugaacaca

SEQ ID NO: 283080 - RNA, 64 nt, Human
uccugccucagccucccgauuagcugggaucacaggugugcaccaccaugcccagcuaauuauu

SEQ ID NO: 283081 - RNA, 64 nt, Human
ucgaugcccauuucuguggcuaaggcuuagguuuggugugcagagccuggccugcucuuguggg

SEQ ID NO: 283082 - RNA, 64 nt, Human
caaugaagcaagugucuccuuuccuuguccccaaggugugcagacuuuggcagccgugcaccug

SEQ ID NO: 283083 - RNA, 64 nt, Human
auuugguggaagaagaauuaagagugauggugauggugugcacguuucauuaauccaaccaaaa

SEQ ID NO: 283084 - RNA, 64 nt, Human
uuaaaaaaaagaaugagagaaaagcccaguuaguggugugcaaacuuacuuccuuuaaaugucc

SEQ ID NO: 283085 - RNA, 64 nt, Human
uuccuuugaaaauacaauaaaauucccccauaccggugugcauuuaaauguucuuuucucuuca

SEQ ID NO: 283086 - RNA, 64 nt, Human
gacuggaauacgaaauacuacagcccugcucccaggugugcaucuuacuggaugagguugcugu

SEQ ID NO: 283087 - RNA, 64 nt, Human
cccaagauccucagcagggauuaagaaggaacccggugugcacagcagauccccgaaauuggug

SEQ ID NO: 283088 - RNA, 64 nt, Human
ucucuacaaauaaaauaaauuaguuggacaugauggugugcaccuauagucccagcuacucggg

SEQ ID NO: 283089 - RNA, 64 nt, Human
uugcagcagccucaaauugcucuuaagggguuuaggugugcagaagcuuuccuuucccuaccca

SEQ ID NO: 283090 - RNA, 64 nt, Human
gccacaccccugcagcccugcaucccagcucuggggugugcagagguuugugucuccagggaac

SEQ ID NO: 283091 - RNA, 64 nt, Human
ugaagaggaaaguuuuuccuggcuggaagagaugggugugcaagauaaaauuaaaaagccagac

SEQ ID NO: 283092 - RNA, 64 nt, Human
gcuccuguuguuaagaagcgucccugucagcacaggugugcauugaggaaggggccccagggcc

SEQ ID NO: 283093 - RNA, 64 nt, Human
aggaugcagcgcugacuucuuaggucagggcggaggugugcaggagcccaguuacgaacucacc

SEQ ID NO: 283094 - RNA, 64 nt, Human
ugaaccuuuuugcaacuaggaacauauacaguaaacaagcaauacaucaccaacgagcauucuu

SEQ ID NO: 283095 - RNA, 64 nt, Human
auacagaugguucguguucauacugcagcuuaaaacaagcaaaauacacagaugauaauaugcu

SEQ ID NO: 283096 - RNA, 64 nt, Human
acuggagucccuggugacuccauucugaggugucacaagcaaugaagcuaugcaaacaauagga

SEQ ID NO: 283097 - RNA, 64 nt, Human
ugcccagaguccuucaggggcaccccucugccuuggugugcaguccagggcucucacccaggug

SEQ ID NO: 283098 - RNA, 64 nt, Human
auaggugcccaacggcagccaaaccaaagacacuggugugcauggggcagcaugguugugcacg

SEQ ID NO: 283099 - RNA, 64 nt, Human
ccucucaugggauggacccugccaaccuggccugggugugcagggagggguuccccuugguacc

SEQ ID NO: 283100 - RNA, 64 nt, Human
cuaacgaauauauuggggggaggaauagaggggaggugugcaggaaccagcaaugagaaggcca

SEQ ID NO: 283101 - RNA, 64 nt, Human
augugguuucucggcugcaccgggccaggcugcgggugugcaggcgucugcuaaguugugugau

SEQ ID NO: 283102 - RNA, 64 nt, Human
ugugcagaaacgcucaugcacaccuggcugcacaggugugcacgcauuacccuucgcguguacg

SEQ ID NO: 283103 - RNA, 64 nt, Human
ucuacaaaaaauuuaaaaauuagccaagugugguggugugcaccuguagucccagcuacucggg

SEQ ID NO: 283104 - RNA, 64 nt, Human
aacuccgggccuguuuggggaggugaagcugccaggugugcacaggggccucccaggcuccugg

SEQ ID NO: 283105 - RNA, 64 nt, Human
aucucauugucacuggauagugcuguaucacuuaggugugcauucggcugcaaauaacagaaaa

SEQ ID NO: 283106 - RNA, 64 nt, Human
augacagaaaaauuucuacuuuacuguccauauaggugugcauuuuaauauuuuucuuuccaag

SEQ ID NO: 283107 - RNA, 64 nt, Human
aagcugcauauaacuagcaauaacuacauugaacggugugcauuguucaugauuguuguguuuu

SEQ ID NO: 283108 - RNA, 64 nt, Human
augcauucuaccacuacauuuuggugcuauuuaaggugugcaauuuucuauaggugacuuuugc

SEQ ID NO: 283109 - RNA, 64 nt, Human
guucaucacaguguaaauggugaugcgugucguaggugugcagcuauuugagggacuaagggau

SEQ ID NO: 283110 - RNA, 64 nt, Human
gaggcugaccagcagcguuuauuuagcaaggguaggugugcaucacauugggcuuguucucacc

SEQ ID NO: 283111 - RNA, 64 nt, Human
uuaucaccuuagcagaaaaaccacaguccaaaagacaagcaaauuaagaauggagcuuaaccau

SEQ ID NO: 283112 - RNA, 64 nt, Human
gccucaaaaggcuuggaaagaaaaaacaaauacaacaagcaaacaacaauaucaacaacaagag

SEQ ID NO: 283113 - RNA, 64 nt, Human
accacugccugacugcccgcuccucgggaaacacacaagcaacaaaccucacugagaggccugg

SEQ ID NO: 283114 - RNA, 64 nt, Human
ugcucuauugaaaauguuucauuuuuuucacuguacaagcaacuuagauuuuuauuuguacaaa

SEQ ID NO: 283115 - RNA, 64 nt, Human
aucucuacaaaaaauuuaaaaaauuagccaugguggugugcaccuguggucccagcuacuccag

SEQ ID NO: 283116 - RNA, 64 nt, Human
ucuacaaaaaguuaaaaaauuaucugagcaugguggugugcaccuguagucccaguuaggaggc

SEQ ID NO: 283117 - RNA, 64 nt, Human
uggccucccugcucuauccugaauaaagcagacaggugugcagauuuuggccaugaaagcaugg

SEQ ID NO: 283118 - RNA, 64 nt, Human
ccugucacagcuucccaaguagcugggauuuacaggugugcaccgccaugccaggcuaauuuuu

SEQ ID NO: 283119 - RNA, 64 nt, Human
uuguuacagaaaaaacauuuuguguuauugcuguggugugcaugauuugcaaagauuaagugca

SEQ ID NO: 283120 - RNA, 64 nt, Human
ugucuuugucucuuccuuucaccucauucugguagcagcauaaagguuaggcaaucacugggac

SEQ ID NO: 283121 - RNA, 64 nt, Human
ggccaaugccuuuugccagcugcagugagauucugcagcauaggccacgauaaaggaaggagag

SEQ ID NO: 283122 - RNA, 64 nt, Human
ucaaacaaaagucuaguugggauuuuuuaccaaagcagcauaauauguguuauauaaacauaau

SEQ ID NO: 283123 - RNA, 64 nt, Human
gaugaauagaauaagcaagcaguuaccaucaaaggcagcauauuuccaauuccaacauuacugu

SEQ ID NO: 283124 - RNA, 64 nt, Human
ggcucugauaucccgugcggaguuggacaagugggcagcauaaagucacucauuucuuaccauu

SEQ ID NO: 283125 - RNA, 64 nt, Human
gccgccuccacaccccucucccaggggcuugguggcagcauagcccccaccccugcggccuuug

SEQ ID NO: 283126 - RNA, 64 nt, Human
auuagcggauuccguuccauuaucaaacccgaguggauccgaauguucucaacuccugaacugc

SEQ ID NO: 283127 - RNA, 64 nt, Human
cgcuagccuggucaguggucagcaaauuggaagaggauccgaugggaguguaaaugugagacac

SEQ ID NO: 283128 - RNA, 64 nt, Human
ucuuaggcaacacaguuguuaccacaagacaagucagggcuaaauaugacagaucacaauguau

SEQ ID NO: 283129 - RNA, 64 nt, Human
gcucaggaaacuagggugucacuuuuuuugcacugcagcauauacacuaacuagcuuauuaaaa

SEQ ID NO: 283130 - RNA, 64 nt, Human
uauaugauugaugaugugaaaaccuaaauuacuugcagcauaguauuacuucuuugauguucuc

SEQ ID NO: 283131 - RNA, 64 nt, Human
cagagggauagaaugacucucucucuacauaccagcagcauaccaaaugcguucucuaaguucc

SEQ ID NO: 283132 - RNA, 64 nt, Human
caaaaagacugauuuuuaaaguauggcauuuuuugcagcauaaauaaaauauuguucaguacgu

SEQ ID NO: 283133 - RNA, 64 nt, Human
aucauuaccuguggaauggcuaggaauauuggaagcagcauaguguugauguacgcaaaacaag

SEQ ID NO: 283134 - RNA, 64 nt, Human
uuaaugauauaguguuuggaaaggaguagaacaugcagcauaagaaacugcugcagaguggugc

SEQ ID NO: 283135 - RNA, 64 nt, Human
gucucuuaacugauggaugcccacuugccuuaaagcagcauacuuauuuuuuguuuauuuauug

SEQ ID NO: 283136 - RNA, 64 nt, Human
acacuguaauaggguaguucuggagagaugguaugcagcauacaaaaauauauuaaaaauauaa

SEQ ID NO: 283137 - RNA, 64 nt, Human
auauauauacacacacgcacacauauauguugcugcagcauaaagaaauugaaauaaaaguuua

SEQ ID NO: 283138 - RNA, 64 nt, Human
uucagugucuuuuuuaguagucaaaugguaaaaugcagcauaagaauauaagucuuccaaguua

SEQ ID NO: 283139 - RNA, 64 nt, Human
ccaaaugagcuggucuauuaugccuuguaaaacagcagcauagggcuuuuaaaagguagucaau

SEQ ID NO: 283140 - RNA, 64 nt, Human
gcuuuuagagacugcuccuauaauugaggaaucagcagcauaggcuuuaucucccuacuuccuc

SEQ ID NO: 283141 - RNA, 64 nt, Human
uagaagcagaucauuucccaaaauucuaagagcagcagcauauguuguugcuuguauaaagccu

SEQ ID NO: 283142 - RNA, 64 nt, Human
ugguaagauaaaauuccacaaaaauagggauggugcagcauaugcaauuuccauuccuauuaua

SEQ ID NO: 283143 - RNA, 64 nt, Human
uaaggagguuuguauaaguaauucagugggaauugcagcauaucguuuaauuuuaagaaggcau

SEQ ID NO: 283144 - RNA, 64 nt, Human
ccccagaaauaguaaacuugcagcugccccuaaugcagcauauuuuucuuaccaaaggagucuu

SEQ ID NO: 283145 - RNA, 64 nt, Human
aucccuggugucguauuuugccuguuaaaucguaacaagcaauaaacaacuuucacuuugcaaa

SEQ ID NO: 283146 - RNA, 64 nt, Human
cuaacuucuaguguaguacugguucuaacaaguaacaagcaaguuuuaaaauuuuaauguuuug

SEQ ID NO: 283147 - RNA, 64 nt, Human
uuggccugaaauagaguccuuaagacaagcaaagacaagcaaggcaagcacgucuggaaacaga

SEQ ID NO: 283148 - RNA, 64 nt, Human
cagagcuuucaagaacacacaaugcaaagugagcgcagcauagcuguuaacaaacauacaacuu

SEQ ID NO: 283149 - RNA, 64 nt, Human
uauucguaaggaugggaaggagggagguauucgugcagcauaugaggaugcagagucagcagaa

SEQ ID NO: 283150 - RNA, 64 nt, Human
gcuuaagagguuucucagaauaucuauggccacagcagcauaccaguuuccauccuaauaggaa

SEQ ID NO: 283151 - RNA, 64 nt, Human
uuuuuuucuucuacuggauuagacaagagagauagcagcauaucagagcugaucuccuccaccu

SEQ ID NO: 283152 - RNA, 64 nt, Human
gagcuuccauuguaaugauuccuuuuuauuuguagcagcauaauuauuuccaaagaccccagua

SEQ ID NO: 283153 - RNA, 64 nt, Human
aagaucauuuaucagaggagguucagcauuuuuugcagcauaacuuuucaugagucuguauuac

SEQ ID NO: 283154 - RNA, 64 nt, Human
gguacugaaacacacaaucuuagugaguuaaguugcagcauaaauccaagggcccacugggaaa

SEQ ID NO: 283155 - RNA, 64 nt, Human
guggugaucaaacuaucacaauucagugugaugagcagcauagcaaacagauggauuugaagcu

SEQ ID NO: 283156 - RNA, 64 nt, Human
augaaugacaguacacauuaaaagguaugcauuagcagcauauuaguaugcuguuuuauuugcu

SEQ ID NO: 283157 - RNA, 64 nt, Human
acaugccuuguucauaaaaucacuggauuauauugcagcauauuuuacauuugaauacaaggau

SEQ ID NO: 283158 - RNA, 64 nt, Human
gagcugugcaugcgcagucugcuagugugugugugcagcauacgcaggagccuauccugaauuu

SEQ ID NO: 283159 - RNA, 64 nt, Human
agaaucucaagcugaagggcuuuggggagccaaagcagcauauuagagcauaggcuugaacuua

SEQ ID NO: 283160 - RNA, 64 nt, Human
gccucugaaagacuauccauaguggacauuguuggcagcauaaaggccuuuuuuggcuuuagac

SEQ ID NO: 283161 - RNA, 64 nt, Human
acacugacagaaucuucaucuagauauucgaguagcagcauaucuucucuuuuagugucauuac

SEQ ID NO: 283162 - RNA, 64 nt, Human
accacuaggucaucuuauuugaugcaucaguaaagcagcauauucaaauguggauuuuuaaaua

SEQ ID NO: 283163 - RNA, 64 nt, Human
auuuguuauugucuacaauauauuugaauuuggggcagcauauuaagauguaauggccuguuau

SEQ ID NO: 283164 - RNA, 64 nt, Human
uccaggacacuaaggucgugggagcgggacugcaacaagcaaugccagauaacugagaaaucau

SEQ ID NO: 283165 - RNA, 64 nt, Human
cgagacuccgccuuucuaaucacaaauguagccuacaagcaagcggcuuuggauugcuuauggg

SEQ ID NO: 283166 - RNA, 64 nt, Human
ccaucuuaagagaugccucauuuuagaaccaccaacaagcaagcucccaagggauggugcccug

SEQ ID NO: 283167 - RNA, 64 nt, Human
uaggggauucuaauuuuacuuagggucucuaagugcagcauaauguuccugauguuaacagaag

SEQ ID NO: 283168 - RNA, 64 nt, Human
uuugacuagugacacauuguacaugguacgaauggcagcauacacagaugaaggugggaaggau

SEQ ID NO: 283169 - RNA, 64 nt, Human
gaaauucaaggagaaggaaugaggaguuagggaagcagcauacuugaauauuagagaaggagag

SEQ ID NO: 283170 - RNA, 64 nt, Human
aauacuguacaauuguuuaauuuuaaacuauuuugcagcauagcuaccuucagaauuuagugua

SEQ ID NO: 283171 - RNA, 64 nt, Human
gucucccucacugaacccugcacguugaguaacagcagcauaauuccauccuaggaaaggggau

SEQ ID NO: 283172 - RNA, 64 nt, Human
cuuauucugugagauguuuuguauuauuucaccagcagcauagaacaggaccucugcuuuugca

SEQ ID NO: 283173 - RNA, 64 nt, Human
cacaucuaccauauagcaaguuuaguaagggaaggcagcauacgucccagggacaguggguuug

SEQ ID NO: 283174 - RNA, 64 nt, Human
uuauucuccaauucauguacaguauuuuguccuagcagcauaaagaccuagcucuuuucuuaca

SEQ ID NO: 283175 - RNA, 64 nt, Human
uuuugcccugauuguuuagggugauaggucuuaagcagcauauaucuauauaucuguauguggg

SEQ ID NO: 283176 - RNA, 64 nt, Human
gccaaagaagcaggaaaaucucaaagcucuaauggcagcauaaaucaaagaauuucacaggcua

SEQ ID NO: 283177 - RNA, 64 nt, Human
gcugccucuugggaagcguugcauauuuuacagugcagcauaaugccaugggcuuccguggaug

SEQ ID NO: 283178 - RNA, 64 nt, Human
augaaaaucuuaucacauuaaauucacugugaaggcagcauacuuaaauuuuuauuuugaaaag

SEQ ID NO: 283179 - RNA, 64 nt, Human
ucaguucacuguugguucucaucuuugaaagagggcagcauaagggaaaugauggagaagggag

SEQ ID NO: 283180 - RNA, 64 nt, Human
cuaugauaauuacaauacaaagguuccauucagugcagcauauacaauaauguaauuuagucua

SEQ ID NO: 283181 - RNA, 64 nt, Human
aagcacaaggacugccgccuucucgcucccgccagcagcauagacuggacuggaccagacaaug

SEQ ID NO: 283182 - RNA, 64 nt, Human
cuaguguuaaacuaccugauuaauuucuuauaaagcagcauaaccuuggcuugauuaaggaauu

SEQ ID NO: 283183 - RNA, 64 nt, Human
ggaucaaguauuggccugaaauagaguccuuaagacaagcaaagacaagcaaggcaagcacguc

SEQ ID NO: 283184 - RNA, 64 nt, Human
ggcagcaucccaagguucaauaaggccuuauuuaacaagcaagcaaaaugcaaaccaaaccauu

SEQ ID NO: 283185 - RNA, 64 nt, Human
aguuaugacaugcccauucacuacagccuggaugacaagcaagacccucccuccaaagaaaaua

SEQ ID NO: 283186 - RNA, 64 nt, Human
uaagcaaucuucuauucucauuccuuuucccacagcagcauauuuuagaggcacauacaaaacc

SEQ ID NO: 283187 - RNA, 64 nt, Human
gucagucuuuguucucugagaaauuauguuggaagcagcauacuuucaaauuauuaccaugagu

SEQ ID NO: 283188 - RNA, 53 nt, Human
ugcaagauacaaggcuuuagagagcagcauaaauguugacaugggacauuugc

SEQ ID NO: 283189 - RNA, 64 nt, Human
ucuauccauugcuuucugugauuagggcggcccugcagcauaucucacagcagacacaguguuc

SEQ ID NO: 283190 - RNA, 64 nt, Human
uuucuuguuuggguuuggaauggaaauauggauagcagcauaaaguacuuuuauuuugacaaaa

SEQ ID NO: 283191 - RNA, 64 nt, Human
uuaguuuauuaucgaaauuggaaggauucauugagcagcauagaaguuuguuuacauguuacuu

SEQ ID NO: 283192 - RNA, 64 nt, Human
uucucuguugggaugagugacuuuauugauuugagcagcauaugcugugauuggcugcccugca

SEQ ID NO: 283193 - RNA, 64 nt, Human
ucuucuacuuguuuaacauugcugauuuucucuggcagcauaauuuugugguuaagagaaugaa

SEQ ID NO: 283194 - RNA, 64 nt, Human
uaaagcuaaguauaguugauguaacauuguagaagcagcauaggaacaauaagaacaauaggua

SEQ ID NO: 283195 - RNA, 64 nt, Human
gucauuaauuacacuucaacuggucaauauaguggcagcauaaaguguuuauuucagaauauca

SEQ ID NO: 283196 - RNA, 64 nt, Human
aguacaggucuacaaaauguuuucaaggagaaaagcagcauauccuuaagugaaguauuauauu

SEQ ID NO: 283197 - RNA, 64 nt, Human
ccugugacaucuucaaugauaugugcccucaguugcagcauagcuucucugcugccuauugcca

SEQ ID NO: 283198 - RNA, 64 nt, Human
cuuuuaaaugugcugcaacguuuuuaaaaaugcagcagcauaggagugaacaacagcaacacaa

SEQ ID NO: 283199 - RNA, 64 nt, Human
ugccaaacaaaauaaaugaaaucucugcauguuugcagcauaucugccuuuugggaauguaauc

SEQ ID NO: 283200 - RNA, 64 nt, Human
agcacuagaaagcaguuuuaggagguuccagccugcagcauagguacgaccucagaggauggcu

SEQ ID NO: 283201 - RNA, 64 nt, Human
uacccccucuagauucccugauuuccccaggccugcagcauacaguaagaugggucccugugcc

SEQ ID NO: 283202 - RNA, 64 nt, Human
aauuaaguggaagaagaauuacuuuaaucaacuaacaagcaauaauaaaaugaaacuuaaaaua

SEQ ID NO: 283203 - RNA, 64 nt, Human
aucccucauuucuuucccugaaauaaaaauacacacaagcaaaaaaaaaaugauaguuucacau

SEQ ID NO: 283204 - RNA, 64 nt, Human
aaucuaugcgugucauuuaaagaaaaguugcagaacaagcaauuggcuuagauauacaaucugg

SEQ ID NO: 283205 - RNA, 64 nt, Human
gccaggccgccucccgcaccccuaccccguggcagcagcauaccucugcauuucuggaaugugu

SEQ ID NO: 283206 - RNA, 64 nt, Human
cugcccacuguuuugucgacucugcccuccucuggcagcauagauccuuaggugcucaauaaag

SEQ ID NO: 283207 - RNA, 64 nt, Human
ccuccuucccaccuaccuguccuggggcuguugagcagcauaauaaucccgggagaaugauucc

SEQ ID NO: 283208 - RNA, 64 nt, Human
aucacuaccuuucucguuucauuuguguaaccaugcagcauaggcacuguguuacaucaucuuu

SEQ ID NO: 283209 - RNA, 64 nt, Human
aucucuugaggccaggaguuugagaccagccugggcagcauagcaagacacaucccuacaaaaa

SEQ ID NO: 283210 - RNA, 64 nt, Human
ggcaauuagcuggacuccaugacccaccccuggugcagcauagauccgacgucugucugggcga

SEQ ID NO: 283211 - RNA, 64 nt, Human
gaaaagaacguugaaccaaauauuagcuuugauggcagcauacaguguucuggaaaagaugcca

SEQ ID NO: 283212 - RNA, 64 nt, Human
auuuguggggucagggaggggcagggggcaccuggcagcauauuuucugugacaauguguccag

SEQ ID NO: 283213 - RNA, 64 nt, Human
cccgcaaccaccauguuccuuuguauaugaugcagcagcauaaauguaagcuuuuauaucauaa

SEQ ID NO: 283214 - RNA, 64 nt, Human
ugugaucgacuuagaauccaaauuugaggaguaagcagcauaaccuucuaccuuguaauaugua

SEQ ID NO: 283215 - RNA, 64 nt, Human
cuguggcagaugucucaucuucuuuauauguuaagcagcauacucuucugauuuuuauugcaau

SEQ ID NO: 283216 - RNA, 64 nt, Human
aaggucuguggccaucugugagguagaugaagaagcagcauaguggucuccuuacaucuaggcc

SEQ ID NO: 283217 - RNA, 64 nt, Human
cauacaugcauugacuugacaaguuacugaguaagcagcauauucagcaggugccacuacaugc

SEQ ID NO: 283218 - RNA, 64 nt, Human
uuauauaaaaaugcacaccuuuaaucucuauauggcagcauauacauauauauauauaaaaugc

SEQ ID NO: 283219 - RNA, 64 nt, Human
auuacuugagcccaggaguuugaauccauccugggcagcauacugagacccugccuuuaaaaac

SEQ ID NO: 283220 - RNA, 64 nt, Human
caccagcuuaaaauugaagcugcuuaucuccaaagcagcauaagcugcacauggcauuaaagga

SEQ ID NO: 283221 - RNA, 64 nt, Human
aauauuaugauagauucuguacuacaugugggaaacaagcaagaacuaaauaaucaaauguugu

SEQ ID NO: 283222 - RNA, 64 nt, Human
uuucccucaacaagguuuuacuuuuucuuacuuuacaagcaagggaaguuuugugauaggagag

SEQ ID NO: 283223 - RNA, 64 nt, Human
aguauccuccaaacuguggauacaguuuagugagacaagcaauuucucccuucugaguuauucu

SEQ ID NO: 283224 - RNA, 64 nt, Human
augaugucucggugagccuguacagaagcuggaggcagcauaaaggacucaaggaccacagccu

SEQ ID NO: 283225 - RNA, 64 nt, Human
augacuaaacaauaauuuaaaacaaaucauaguagcagcauauuaaggguuucuaguaugcuaa

SEQ ID NO: 283226 - RNA, 64 nt, Human
ccccucagaggcccccgccagccccaccuugaaagcagcauacaggggaaggcuuggaccaagc

SEQ ID NO: 283227 - RNA, 64 nt, Human
augauuguuuuucuuauaacuuuacuauaugaaagcagcauaagaguagucacaaacauguuuu

SEQ ID NO: 283228 - RNA, 64 nt, Human
guuauuuuuuaaaaccuggaccuuuucuggaagggcagcauauaaaaacaucagucccgaggag

SEQ ID NO: 283229 - RNA, 64 nt, Human
uuuuccaguugugacccguuuuccaaccaguucugcagcauauuagauucuagacaagcaacac

SEQ ID NO: 283230 - RNA, 64 nt, Human
gguggugugcgugugcgugcaugugugaaugugagcagcauaguugauauuuacccacaaacac

SEQ ID NO: 283231 - RNA, 64 nt, Human
ucuuaagaaaaccugaauggauuucaucaaggcggcagcauaauuugaagggcaauugcgugug

SEQ ID NO: 283232 - RNA, 64 nt, Human
uuuuuaagugaaaaguaaccuuucaggcauuucagcagcauacauugacaaucuaggguauaua

SEQ ID NO: 283233 - RNA, 64 nt, Human
agcuggagcauuuccuucccuuuccagugaaggagcagcauagugaaauccuggcaccccucac

SEQ ID NO: 283234 - RNA, 64 nt, Human
cuuuuaguuacuaaauuauagcuaaguuuugucagcagcauacuccggaaagucucauacuucu

SEQ ID NO: 283235 - RNA, 64 nt, Human
aacgaacaguggcuuaaugcagaucacucaagaggcagcauagcaauguaaaaggaauauaagu

SEQ ID NO: 283236 - RNA, 64 nt, Human
uggcuuugggccuaguaguucgaguccagccugggcagcauagugugagacccugucucuuaaa

SEQ ID NO: 283237 - RNA, 64 nt, Human
ucauauuucauuucaaauucaaacuucugagguugcagcauauaugaauugcauuuucaaaaga

SEQ ID NO: 283238 - RNA, 64 nt, Human
guaaauuaauauuucuuuggggaugaugcugcgagcagcauagugagaauuauuuaaaauccuu

SEQ ID NO: 283239 - RNA, 64 nt, Human
ccccuugaucuuugaaggaguccucaggccccucgcagcauaaggauguuuugcaacuuuccag

SEQ ID NO: 283240 - RNA, 64 nt, Human
ccaaucagcuguuaaucugaauuuucaagagaaaacaagcaaacauaacugaucagcugccggu

SEQ ID NO: 283241 - RNA, 64 nt, Human
aaauaggaguaaaggcccuugcaauuuuuaauuaacaagcaaggcccaagggaacacauguccu

SEQ ID NO: 283242 - RNA, 64 nt, Human
cuuaauguugcuuagaugagggugacugucaaguacaagcaagacugggaccuuagaaaucauu

SEQ ID NO: 283243 - RNA, 64 nt, Human
caauggugccaaacccuucaucuccccaagaagcgcagcauaccccugggaccccucggccacu

SEQ ID NO: 283244 - RNA, 64 nt, Human
ccugguucuagccuagauucuuaccuccccaaaagcagcauauuaggcccaggacauaccugaa

SEQ ID NO: 283245 - RNA, 64 nt, Human
gacuuauacucaccacagaauggauugggacacagcagcauaagugugcuacuuggcagcuagu

SEQ ID NO: 283246 - RNA, 64 nt, Human
aaaaaagauaauacauacacaugaacaaagaauggcagcauauuucuggugagaacuaugcaag

SEQ ID NO: 283247 - RNA, 64 nt, Human
uuuagacagugaaacugacuuuguuuaccugcuugcagcauauuagaacagacgauccaugcua

SEQ ID NO: 283248 - RNA, 60 nt, Human
gagacagcaagagaucuugauccagacagagcagcauaucuuugcucauacaaacuagaa

SEQ ID NO: 283249 - RNA, 64 nt, Human
acaccauugcccggaggcuuccgaaucuagcaaagcagcauauuaaaugacuccaccugcgcag

SEQ ID NO: 283250 - RNA, 64 nt, Human
auauauauguuacuugaaauguuaaauuuaauaugcagcauaccauagguguauauauagguau

SEQ ID NO: 283251 - RNA, 64 nt, Human
aacaguccacacuggggccugcgggacacauauagcagcauauuuugcucuuaaccccacccac

SEQ ID NO: 283252 - RNA, 64 nt, Human
aguuuuaccuaaaaagccaacauuugaauugguugcagcauagagaagaaacacugguccuucu

SEQ ID NO: 283253 - RNA, 64 nt, Human
cauuuguuaaguuggagcuugcacauuuaaaccagcagcauacguuccagaagagcaucucaag

SEQ ID NO: 283254 - RNA, 64 nt, Human
ucuuuuuugaagaguuuuucuugugcuugcuucggcagcauauauacugaaauuagaaaaagaa

SEQ ID NO: 283255 - RNA, 64 nt, Human
agauuuuacuucaaauuacaccuucaaaacuggagcagcauauagccgaaaaggagcacaacug

SEQ ID NO: 283256 - RNA, 64 nt, Human
gcauuuaaauuaaauggcuucuaaacaagaaauugcagcauauucuucucuuuggcccagaggu

SEQ ID NO: 283257 - RNA, 64 nt, Human
gauugaccagucaaaucgagcagugagccaaggagcagcauauaguccagagggucagcccaug

SEQ ID NO: 283258 - RNA, 64 nt, Human
ggauuguuuuuaucaaguggguuguucugugccugcagcauagagcgcaggcuggcagagcaaa

SEQ ID NO: 283259 - RNA, 63 nt, Human
aucauaucugauugcagaaauuaaagcacaauuuacaagcaauacuguacuuggugugguugg

SEQ ID NO: 283260 - RNA, 64 nt, Human
ugcuccuggguucaaguaguauuaccacccuuucacaagcaacagacucucacagggcaaaaaa

SEQ ID NO: 283261 - RNA, 64 nt, Human
aaucaagggugaagguaaaauaauacauuuuuagacaagcaaagacucagggguuaccuccaug

SEQ ID NO: 283262 - RNA, 64 nt, Human
uugagaaaaaugaauaguaaaugucucuaaacaggcagcauacagauucagugaaaaguuugaa

SEQ ID NO: 283263 - RNA, 64 nt, Human
ccgaggcgggagaaguagggagcuguucguuuaagcagcauacaccuaaauuggggguuuaaac

SEQ ID NO: 283264 - RNA, 64 nt, Human
ggcuuccuggacccucaaccccagaucauuccaggcagcauagcuuucuucacaguccuuucag

SEQ ID NO: 283265 - RNA, 64 nt, Human
aucgcuugagaccaggaguucgagaccagccugggcagcauagcaagauccccaucuuuuaaaa

SEQ ID NO: 283266 - RNA, 64 nt, Human
caccuggccucugcacuccccugcuggguguggcgcagcauauucaggaagcucagggccuggc

SEQ ID NO: 283267 - RNA, 64 nt, Human
cauacacaacccauuuccccuggugagccacuuggcagcauauguagguaccagcucaacccca

SEQ ID NO: 283268 - RNA, 64 nt, Human
ucaggccuuggguagauuuggcaaaagaacaggagcagcauaggcuguuugagcuuuggggaaa

SEQ ID NO: 283269 - RNA, 64 nt, Human
ggguucaccaucucaagggaaaauggaggcuccagcagcauauuguaccgcuaccccuuugaaa

SEQ ID NO: 283270 - RNA, 64 nt, Human
guguccaagcaucuuagcuguucaagaggagagggcagcauaacuuccugaccaccggugucag

SEQ ID NO: 283271 - RNA, 64 nt, Human
uuuaaaaucuugaaugaauugaguauucuagacagcagcauaagaaauauacaaacaguauccu

SEQ ID NO: 283272 - RNA, 64 nt, Human
ugaaaggaaauuuaggaggcauaggccauuucaggcagcauaaguaaucuccuguccuuuggca

SEQ ID NO: 283273 - RNA, 64 nt, Human
uccuugguuugauuuuguguaauggauggaaaacgcagcauacuuggccucccccaccucccug

SEQ ID NO: 283274 - RNA, 64 nt, Human
caaagcaaccuggaggcugcauauccaugggcgggcagcauaagagaaugugaagcccuucagu

SEQ ID NO: 283275 - RNA, 64 nt, Human
cauaucccaaauucuuaugagccacucacagcaggcagcauauguugaaauaaguuauuacugg

SEQ ID NO: 283276 - RNA, 64 nt, Human
ggacaacuccgcuuuggccaaccuagccaaggcugcagcauauagaccaggaaaucagguagcc

SEQ ID NO: 283277 - RNA, 64 nt, Human
uguaagggugggcaggccucguaagaaagauguagcagcauauucacuauccguuaauccuucu

SEQ ID NO: 283278 - RNA, 64 nt, Human
ccuuuaguuuaaauccaacagaaaucuagaagucacaagcaaauaucuuaaagguaaaauccau

SEQ ID NO: 283279 - RNA, 64 nt, Human
ugaggaugugaaaaacuagggaccacaaaagggaacaagcaaaaaaguuuggauucgauaaagu

SEQ ID NO: 283280 - RNA, 64 nt, Human
ugaaaacauccccuuucaccccucugcaaaacaaacaagcaacauccucaaaacccaaccccau

SEQ ID NO: 283281 - RNA, 64 nt, Human
ggacugguagcagucaucugcauuugaggguucagcagcauauaccuucacacuagguuucaga

SEQ ID NO: 283282 - RNA, 64 nt, Human
aggcugggagggggcagccaagaagccggagcuggcagcauacccagagauccggggccccccc

SEQ ID NO: 283283 - RNA, 64 nt, Human
ugcaauucaggagcugguuagaacauuuuaaguggcagcauagaauuuuggaauuuuggggcuu

SEQ ID NO: 283284 - RNA, 64 nt, Human
ucugaauggaugaggugaauuuuccgggaacuuugcagcauaccaauuacccauaaacagcaca

SEQ ID NO: 283285 - RNA, 64 nt, Human
ccaacacaaguaggauugacuuaaacucuuaagcgcagcauauugcuguacacauuuacagaau

SEQ ID NO: 283286 - RNA, 64 nt, Human
acugcauguacccggaccccuaggccuggccuuugcagcauaguugggagcuucuggauuccau

SEQ ID NO: 283287 - RNA, 64 nt, Human
agagagcucacacuggauauauaaguuauuuguugcagcauaacaaaugauccccgcaaauuuu

SEQ ID NO: 283288 - RNA, 64 nt, Human
cagccuccccagcccccuucccucaacucuaggggcagcauagccccaggccacccuagcccag

SEQ ID NO: 283289 - RNA, 64 nt, Human
agcccaggaaccuuugcagggccaucucacccaugcagcauaaggcagaagccauagucacuuu

SEQ ID NO: 283290 - RNA, 64 nt, Human
cucacacaugaucguguuucguaaggagccagaggcagcauagugaaaaguuaggagcgugggc

SEQ ID NO: 283291 - RNA, 64 nt, Human
ucccgcccuccagggugcgcuucccucucuugccgcagcauacacgagggcaggcaguggccuu

SEQ ID NO: 283292 - RNA, 64 nt, Human
aacuuuaaaggugugagaguauuaggaaacaugagcagcauauggcuuuugaucaguuuuucag

SEQ ID NO: 283293 - RNA, 64 nt, Human
ccugcuauucagaauaaguaggagaaugaaaacugcagcauaucagacagcaauuuaacagcuu

SEQ ID NO: 283294 - RNA, 64 nt, Human
ggugagggucuccccaccagugcugcaccccgcagcagcauacaggccuguguggccugcuggc

SEQ ID NO: 283295 - RNA, 64 nt, Human
ugaaccuuuaagcaaauaagaaucucagagacucgcagcauagccauacaccucagccugugaa

SEQ ID NO: 283296 - RNA, 64 nt, Human
ucaguguccuuggcagugcugcuacuccucaggugcagcauacauaaccaguaagagacuaaau

SEQ ID NO: 283297 - RNA, 64 nt, Human
agaacugcugcccacucaaaagucucaacaagacacaagcaaaaauccagcaaugcucaaaucc

SEQ ID NO: 283298 - RNA, 64 nt, Human
ccugcagccccagacccgccguaguauaagccuaacaagcaacacguagcaccuuagucuuugu

SEQ ID NO: 283299 - RNA, 64 nt, Human
cccaaaacagggaacugacugucugguagugaagacaagcaaguggagaaguuauacgauauag

SEQ ID NO: 283300 - RNA, 64 nt, Human
cuuugggggacgggcuuccccugugagcagcagagcagcauaauaaaugaggccacugugccag

SEQ ID NO: 283301 - RNA, 64 nt, Human
uacccacaaccaugcccuugaggguagcagggcagcagcauaccaaagagaugugcugcaggac

SEQ ID NO: 283302 - RNA, 64 nt, Human
acgugggaacuaaagagaaaaaugaccagccugggcagcauagcaagacccugucucuaaaaaa

SEQ ID NO: 283303 - RNA, 64 nt, Human
aucuaacguuucaguguauccuuacagaaauaaagcagcauaugaauaaccugccuccugucuu

SEQ ID NO: 283304 - RNA, 64 nt, Human
gaagauugagccuaggaguucgagaccgaccugggcagcauagcgagaccccaucucuauauaa

SEQ ID NO: 283305 - RNA, 64 nt, Human
auuauuauucagaaaugacuuuuugaaaguaaaagcagcauaaagaauuugucacaggaaggcu

SEQ ID NO: 283306 - RNA, 64 nt, Human
uguuguaaaguaaaacauaacagguuauggcaaagcagcauauuuaauaucagcucacauaugu

SEQ ID NO: 283307 - RNA, 64 nt, Human
ccgcaugcucuaaucggucucuuuauauacucaggcagcauauauuaaaagcuuugcaucuuuu

SEQ ID NO: 283308 - RNA, 64 nt, Human
gugagggcauacgggagccuaucucagugaaagagcagcauaagcgggaagggcuuggucugga

SEQ ID NO: 283309 - RNA, 64 nt, Human
auggccuucaagagcacuagggcauaugcuuuuggcagcauaacgggcugacuuggugauggag

SEQ ID NO: 283310 - RNA, 59 nt, Human
ccaaacagagcaguggcuaaauugcaguagcagcauaucuuuuuuucuuugcacaaaua

SEQ ID NO: 283311 - RNA, 64 nt, Human
auugcuugagccugggaguuugagacuggccugggcagcauagcgagaccccaucucuauauaa

SEQ ID NO: 283312 - RNA, 64 nt, Human; identical to SEQ ID NO: 189246

SEQ ID NO: 283313 - RNA, 64 nt, Human
auaaaagaauaaaucacuauacugauauuuugauacaagcaagcacuuacaugguaaucacuau

SEQ ID NO: 283314 - RNA, 64 nt, Human
cuugguguuaauagcugaaguccuaucuguaccaacaagcaaggccacuuuucagaagauaaga

SEQ ID NO: 283315 - RNA, 64 nt, Human
cucucucucucucucucauugcuuguaugacuucacaagcaacucaggaucauucuagcaggcu

SEQ ID NO: 283316 - RNA, 64 nt, Human; identical to SEQ ID NO: 189247

SEQ ID NO: 283317 - RNA, 64 nt, Human; identical to SEQ ID NO: 189248

SEQ ID NO: 283318 - RNA, 64 nt, Human; identical to SEQ ID NO: 189249

SEQ ID NO: 283319 - RNA, 64 nt, Human; identical to SEQ ID NO: 189250

SEQ ID NO: 283320 - RNA, 64 nt, Human; identical to SEQ ID NO: 189251

SEQ ID NO: 283321 - RNA, 64 nt, Human; identical to SEQ ID NO: 189252

SEQ ID NO: 283322 - RNA, 64 nt, Human; identical to SEQ ID NO: 189253

SEQ ID NO: 283323 - RNA, 64 nt, Human; identical to SEQ ID NO: 189254

SEQ ID NO: 283324 - RNA, 64 nt, Human; identical to SEQ ID NO: 189255

SEQ ID NO: 283325 - RNA, 64 nt, Human; identical to SEQ ID NO: 189256

SEQ ID NO: 283326 - RNA, 64 nt, Human; identical to SEQ ID NO: 189257

SEQ ID NO: 283327 - RNA, 64 nt, Human; identical to SEQ ID NO: 189258

SEQ ID NO: 283328 - RNA, 64 nt, Human; identical to SEQ ID NO: 189262

SEQ ID NO: 283329 - RNA, 64 nt, Human; identical to SEQ ID NO: 189263

SEQ ID NO: 283330 - RNA, 64 nt, Human
uuacauucuagcaggagauacaauuuacaaauauacaagcaaauaauauaauauuaugccagga

SEQ ID NO: 283331 - RNA, 64 nt, Human
ccaaggacccgauucuugggcuaggaaagagagaacaagcaagccggggcuaccugcccccagg

SEQ ID NO: 283332 - RNA, 64 nt, Human
uuugguuuagcugccucugcugcccuuuacugugacaagcaaggagggguugcuucccucccua

SEQ ID NO: 283333 - RNA, 64 nt, Human; identical to SEQ ID NO: 189264

SEQ ID NO: 283334 - RNA, 64 nt, Human; identical to SEQ ID NO: 189265

SEQ ID NO: 283335 - RNA, 64 nt, Human; identical to SEQ ID NO: 189266

SEQ ID NO: 283336 - RNA, 64 nt, Human; identical to SEQ ID NO: 189267

SEQ ID NO: 283337 - RNA, 64 nt, Human; identical to SEQ ID NO: 189268

SEQ ID NO: 283338 - RNA, 64 nt, Human; identical to SEQ ID NO: 189269

SEQ ID NO: 283339 - RNA, 59 nt, Human; identical to SEQ ID NO: 189270

SEQ ID NO: 283340 - RNA, 64 nt, Human; identical to SEQ ID NO: 189271

SEQ ID NO: 283341 - RNA, 64 nt, Human; identical to SEQ ID NO: 189272

SEQ ID NO: 283342 - RNA, 64 nt, Human; identical to SEQ ID NO: 189273

SEQ ID NO: 283343 - RNA, 64 nt, Human; identical to SEQ ID NO: 189274

SEQ ID NO: 283344 - RNA, 64 nt, Human; identical to SEQ ID NO: 189275

SEQ ID NO: 283345 - RNA, 64 nt, Human; identical to SEQ ID NO: 189276

SEQ ID NO: 283346 - RNA, 64 nt, Human; identical to SEQ ID NO: 189280

SEQ ID NO: 283347 - RNA, 64 nt, Human
uuugaaauauuaaguaugaaaggaguaauuaaaaacaagcaaaacaaaacaagacuuaguuuuu

SEQ ID NO: 283348 - RNA, 64 nt, Human
ccagagcugguguaccgcugguggaucaggucuuacaagcaaagaaccucacacucccaacugg

SEQ ID NO: 283349 - RNA, 64 nt, Human
acaaagucaggguuuucuccucuuauauuuuaucacaagcaacucuucaagauguugcaaaagc

SEQ ID NO: 283350 - RNA, 64 nt, Human; identical to SEQ ID NO: 189281

SEQ ID NO: 283351 - RNA, 64 nt, Human; identical to SEQ ID NO: 189282

SEQ ID NO: 283352 - RNA, 64 nt, Human; identical to SEQ ID NO: 189283

SEQ ID NO: 283353 - RNA, 64 nt, Human; identical to SEQ ID NO: 189284

SEQ ID NO: 283354 - RNA, 64 nt, Human; identical to SEQ ID NO: 189285

SEQ ID NO: 283355 - RNA, 64 nt, Human; identical to SEQ ID NO: 189286

SEQ ID NO: 283356 - RNA, 64 nt, Human; identical to SEQ ID NO: 189287

SEQ ID NO: 283357 - RNA, 64 nt, Human; identical to SEQ ID NO: 189288

SEQ ID NO: 283358 - RNA, 64 nt, Human; identical to SEQ ID NO: 189289

SEQ ID NO: 283359 - RNA, 64 nt, Human; identical to SEQ ID NO: 189290

SEQ ID NO: 283360 - RNA, 64 nt, Human; identical to SEQ ID NO: 189291

SEQ ID NO: 283361 - RNA, 64 nt, Human; identical to SEQ ID NO: 189292

SEQ ID NO: 283362 - RNA, 64 nt, Human; identical to SEQ ID NO: 189293

SEQ ID NO: 283363 - RNA, 64 nt, Human; identical to SEQ ID NO: 189294

SEQ ID NO: 283364 - RNA, 64 nt, Human
ccucucucucccaacugcugcuuaaaaugcaaggacaagcaauuagaagccauccuaaggugcu

SEQ ID NO: 283365 - RNA, 64 nt, Human
acuccccgcgagaccccgcagcugggugggaugaacaagcaacgcagaccacaagcgagugccu

SEQ ID NO: 283366 - RNA, 64 nt, Human
ucugugcccuacuauuuucaacaaaacaaaacaaacaagcaaaaaacacaaaaaccucagagac

SEQ ID NO: 283367 - RNA, 64 nt, Human; identical to SEQ ID NO: 189298

SEQ ID NO: 283368 - RNA, 64 nt, Human; identical to SEQ ID NO: 189299

SEQ ID NO: 283369 - RNA, 64 nt, Human; identical to SEQ ID NO: 189300

SEQ ID NO: 283370 - RNA, 64 nt, Human; identical to SEQ ID NO: 189301

SEQ ID NO: 283371 - RNA, 64 nt, Human; identical to SEQ ID NO: 189302

SEQ ID NO: 283372 - RNA, 64 nt, Human; identical to SEQ ID NO: 189303

SEQ ID NO: 283373 - RNA, 64 nt, Human; identical to SEQ ID NO: 189304

SEQ ID NO: 283374 - RNA, 64 nt, Human; identical to SEQ ID NO: 189305

SEQ ID NO: 283375 - RNA, 64 nt, Human; identical to SEQ ID NO: 189306

SEQ ID NO: 283376 - RNA, 64 nt, Human; identical to SEQ ID NO: 189307

SEQ ID NO: 283377 - RNA, 64 nt, Human; identical to SEQ ID NO: 189308

SEQ ID NO: 283378 - RNA, 64 nt, Human; identical to SEQ ID NO: 189309

SEQ ID NO: 283379 - RNA, 64 nt, Human; identical to SEQ ID NO: 189310

SEQ ID NO: 283380 - RNA, 53 nt, Human; identical to SEQ ID NO: 189311

SEQ ID NO: 283381 - RNA, 64 nt, Human
aucguauuaauuaucugaucgggauaacaaaaucacaagcaauaauuaggaucuaugcaauuuu

SEQ ID NO: 283382 - RNA, 64 nt, Human
uagcaauuuucaaucaagccugucccauggagacacaagcaauagugacaugagcacuugacuc

SEQ ID NO: 283383 - RNA, 64 nt, Human
uuuuucacuguuuccuauuaaucuucagcugaacacaagcaaaccuucucaggaggugucuccu

SEQ ID NO: 283384 - RNA, 64 nt, Human; identical to SEQ ID NO: 189312

SEQ ID NO: 283385 - RNA, 64 nt, Human; identical to SEQ ID NO: 189317

SEQ ID NO: 283386 - RNA, 64 nt, Human; identical to SEQ ID NO: 189318

SEQ ID NO: 283387 - RNA, 64 nt, Human; identical to SEQ ID NO: 189319

SEQ ID NO: 283388 - RNA, 64 nt, Human; identical to SEQ ID NO: 189320

SEQ ID NO: 283389 - RNA, 64 nt, Human; identical to SEQ ID NO: 189321

SEQ ID NO: 283390 - RNA, 64 nt, Human; identical to SEQ ID NO: 189322

SEQ ID NO: 283391 - RNA, 64 nt, Human; identical to SEQ ID NO: 189323

SEQ ID NO: 283392 - RNA, 64 nt, Human; identical to SEQ ID NO: 189324

SEQ ID NO: 283393 - RNA, 64 nt, Human; identical to SEQ ID NO: 189325

SEQ ID NO: 283394 - RNA, 64 nt, Human; identical to SEQ ID NO: 189326

SEQ ID NO: 283395 - RNA, 64 nt, Human; identical to SEQ ID NO: 189327

SEQ ID NO: 283396 - RNA, 64 nt, Human; identical to SEQ ID NO: 189328

SEQ ID NO: 283397 - RNA, 64 nt, Human; identical to SEQ ID NO: 189329

SEQ ID NO: 283398 - RNA, 64 nt, Human
uggcccgucugggccaacccuuccaugggugaagacaagcaagucccccuggaggcggguggcc

SEQ ID NO: 283399 - RNA, 64 nt, Human
gagugggguauuuuguucuggcauuaaaagaaaaacaagcaagcaaacaaaaacacagccuccg

SEQ ID NO: 283400 - RNA, 64 nt, Human
ugauuuuaaauauacaauacaucauacauacuuuacaagcaaguuaaauggagauaaaguugaa

SEQ ID NO: 283401 - RNA, 64 nt, Human; identical to SEQ ID NO: 189330

SEQ ID NO: 283402 - RNA, 64 nt, Human; identical to SEQ ID NO: 189331

SEQ ID NO: 283403 - RNA, 64 nt, Human; identical to SEQ ID NO: 189336

SEQ ID NO: 283404 - RNA, 64 nt, Human; identical to SEQ ID NO: 189337

SEQ ID NO: 283405 - RNA, 64 nt, Human; identical to SEQ ID NO: 189338

SEQ ID NO: 283406 - RNA, 64 nt, Human; identical to SEQ ID NO: 189339

SEQ ID NO: 283407 - RNA, 64 nt, Human; identical to SEQ ID NO: 189340

SEQ ID NO: 283408 - RNA, 64 nt, Human; identical to SEQ ID NO: 189341

SEQ ID NO: 283409 - RNA, 64 nt, Human; identical to SEQ ID NO: 189342

SEQ ID NO: 283410 - RNA, 64 nt, Human; identical to SEQ ID NO: 189343

SEQ ID NO: 283411 - RNA, 64 nt, Human; identical to SEQ ID NO: 189344

SEQ ID NO: 283412 - RNA, 64 nt, Human; identical to SEQ ID NO: 189345

SEQ ID NO: 283413 - RNA, 64 nt, Human; identical to SEQ ID NO: 189346

SEQ ID NO: 283414 - RNA, 64 nt, Human; identical to SEQ ID NO: 189347

SEQ ID NO: 283415 - RNA, 64 nt, Human
agugcuccucaccuguguggcccagauggcuccaacaagcaaaaggaaggaugcagugacucuu

SEQ ID NO: 283416 - RNA, 64 nt, Human
auuuaggacaacugaagaaaagcuggaaaaaaaaacaagcaaacuugaacacugaagcaaccuc

SEQ ID NO: 283417 - RNA, 64 nt, Human
cccugcuguuuccugcccaucagagaggccugauacaagcaaguuuguuuacaucccuggggaa

SEQ ID NO: 283418 - RNA, 64 nt, Human; identical to SEQ ID NO: 189348

SEQ ID NO: 283419 - RNA, 64 nt, Human; identical to SEQ ID NO: 189349

SEQ ID NO: 283420 - RNA, 64 nt, Human; identical to SEQ ID NO: 189350

SEQ ID NO: 283421 - RNA, 64 nt, Human; identical to SEQ ID NO: 189355

SEQ ID NO: 283422 - RNA, 64 nt, Human; identical to SEQ ID NO: 189356

SEQ ID NO: 283423 - RNA, 64 nt, Human; identical to SEQ ID NO: 189357

SEQ ID NO: 283424 - RNA, 64 nt, Human; identical to SEQ ID NO: 189358

SEQ ID NO: 283425 - RNA, 64 nt, Human; identical to SEQ ID NO: 189359

SEQ ID NO: 283426 - RNA, 64 nt, Human; identical to SEQ ID NO: 189360

SEQ ID NO: 283427 - RNA, 64 nt, Human; identical to SEQ ID NO: 189361

SEQ ID NO: 283428 - RNA, 64 nt, Human; identical to SEQ ID NO: 189362

SEQ ID NO: 283429 - RNA, 64 nt, Human; identical to SEQ ID NO: 189363

SEQ ID NO: 283430 - RNA, 64 nt, Human; identical to SEQ ID NO: 189364

SEQ ID NO: 283431 - RNA, 64 nt, Human; identical to SEQ ID NO: 189365

SEQ ID NO: 283432 - RNA, 64 nt, Human
ccuucucgcuguauccucaaugguagaagcacaaacaagcaagcuccuuccugccucuuuuaua

SEQ ID NO: 283433 - RNA, 64 nt, Human
uagauuuuguuaacaaauuaaagaauaaaguuagacaagcaacugguugacuaauacauuaagc

SEQ ID NO: 283434 - RNA, 64 nt, Human
ccccucacuaggucccaguuucuccauuuguaaaacaagcaauugugcuacauugaugguuuac

SEQ ID NO: 283435 - RNA, 64 nt, Human; identical to SEQ ID NO: 189366

SEQ ID NO: 283436 - RNA, 64 nt, Human; identical to SEQ ID NO: 189367

SEQ ID NO: 283437 - RNA, 64 nt, Human; identical to SEQ ID NO: 189368

SEQ ID NO: 283438 - RNA, 64 nt, Human; identical to SEQ ID NO: 189369

SEQ ID NO: 283439 - RNA, 64 nt, Human; identical to SEQ ID NO: 189374

SEQ ID NO: 283440 - RNA, 64 nt, Human; identical to SEQ ID NO: 189375

SEQ ID NO: 283441 - RNA, 64 nt, Human; identical to SEQ ID NO: 189376

SEQ ID NO: 283442 - RNA, 64 nt, Human; identical to SEQ ID NO: 189377

SEQ ID NO: 283443 - RNA, 64 nt, Human; identical to SEQ ID NO: 189378

SEQ ID NO: 283444 - RNA, 64 nt, Human; identical to SEQ ID NO: 189379

SEQ ID NO: 283445 - RNA, 64 nt, Human; identical to SEQ ID NO: 189380

SEQ ID NO: 283446 - RNA, 64 nt, Human; identical to SEQ ID NO: 189381

SEQ ID NO: 283447 - RNA, 64 nt, Human; identical to SEQ ID NO: 189382

SEQ ID NO: 283448 - RNA, 64 nt, Human; identical to SEQ ID NO: 189383

SEQ ID NO: 283449 - RNA, 64 nt, Human
gcugucgcaucucagcggggcgcacauguuauccacaagcaauggaccuuuggggaagggggag

SEQ ID NO: 283450 - RNA, 64 nt, Human
gagugggguauuuuguucuggcauuagaagaaaaacaagcaagcaaacaaaaacacagccuccg

SEQ ID NO: 283451 - RNA, 64 nt, Human
uacugacuguauugccacuagagaauucuacaaaacaagcaaaaacacauccugagacaccuca

SEQ ID NO: 283452 - RNA, 64 nt, Human; identical to SEQ ID NO: 189384

SEQ ID NO: 283453 - RNA, 64 nt, Human; identical to SEQ ID NO: 189385

SEQ ID NO: 283454 - RNA, 64 nt, Human; identical to SEQ ID NO: 189386

SEQ ID NO: 283455 - RNA, 64 nt, Human; identical to SEQ ID NO: 189387

SEQ ID NO: 283456 - RNA, 64 nt, Human; identical to SEQ ID NO: 189388

SEQ ID NO: 283457 - RNA, 64 nt, Human; identical to SEQ ID NO: 188697

SEQ ID NO: 283458 - RNA, 64 nt, Human; identical to SEQ ID NO: 188698

SEQ ID NO: 283459 - RNA, 64 nt, Human; identical to SEQ ID NO: 188699

SEQ ID NO: 283460 - RNA, 64 nt, Human; identical to SEQ ID NO: 188700

SEQ ID NO: 283461 - RNA, 64 nt, Human; identical to SEQ ID NO: 188701

SEQ ID NO: 283462 - RNA, 64 nt, Human; identical to SEQ ID NO: 188702

SEQ ID NO: 283463 - RNA, 64 nt, Human; identical to SEQ ID NO: 188703

SEQ ID NO: 283464 - RNA, 64 nt, Human; identical to SEQ ID NO: 188704

SEQ ID NO: 283465 - RNA, 64 nt, Human; identical to SEQ ID NO: 188705

SEQ ID NO: 283466 - RNA, 64 nt, Human
acuugauauguguauauacaguaaaguguucaccacaagcaagccaauuaacauauccucacuu

SEQ ID NO: 283467 - RNA, 64 nt, Human
aaauuguacaucagacuuuuaaaaucuguaauauacaagcaagcaaaauuauuuuaaaugacuu

SEQ ID NO: 283468 - RNA, 64 nt, Human
cuuuaauaccucuuaggaaccaaagaaugccucuacaagcaaaaagauaguugaaaauaguuaa

SEQ ID NO: 283469 - RNA, 64 nt, Human; identical to SEQ ID NO: 188706

SEQ ID NO: 283470 - RNA, 64 nt, Human; identical to SEQ ID NO: 188707

SEQ ID NO: 283471 - RNA, 64 nt, Human; identical to SEQ ID NO: 188708

SEQ ID NO: 283472 - RNA, 64 nt, Human; identical to SEQ ID NO: 188709

SEQ ID NO: 283473 - RNA, 64 nt, Human; identical to SEQ ID NO: 188710

SEQ ID NO: 283474 - RNA, 64 nt, Human; identical to SEQ ID NO: 189392

SEQ ID NO: 283475 - RNA, 64 nt, Human; identical to SEQ ID NO: 189411

SEQ ID NO: 283476 - RNA, 64 nt, Human; identical to SEQ ID NO: 189412

SEQ ID NO: 283477 - RNA, 64 nt, Human; identical to SEQ ID NO: 189413

SEQ ID NO: 283478 - RNA, 64 nt, Human; identical to SEQ ID NO: 189414

SEQ ID NO: 283479 - RNA, 64 nt, Human; identical to SEQ ID NO: 189415

SEQ ID NO: 283480 - RNA, 64 nt, Human; identical to SEQ ID NO: 189416

SEQ ID NO: 283481 - RNA, 64 nt, Human; identical to SEQ ID NO: 189417

SEQ ID NO: 283482 - RNA, 64 nt, Human; identical to SEQ ID NO: 189418

SEQ ID NO: 283483 - RNA, 64 nt, Human
cauuccuaggcacaaaauuaccucauucuuccuaacaagcaaucugggaccugauuuuccaccu

SEQ ID NO: 283484 - RNA, 64 nt, Human
ucucgugcuuauugcagaugcugugguuggccucacaagcaacgccuuaugcugaugugcagag

SEQ ID NO: 283485 - RNA, 55 nt, Human
aaagagaaagcauucuuugagaaaaacaagcaaaggagaagaguguuacuguacc

SEQ ID NO: 283486 - RNA, 64 nt, Human; identical to SEQ ID NO: 189419

SEQ ID NO: 283487 - RNA, 64 nt, Human; identical to SEQ ID NO: 189420

SEQ ID NO: 283488 - RNA, 64 nt, Human; identical to SEQ ID NO: 189421

SEQ ID NO: 283489 - RNA, 64 nt, Human; identical to SEQ ID NO: 189422

SEQ ID NO: 283490 - RNA, 64 nt, Human; identical to SEQ ID NO: 189423

SEQ ID NO: 283491 - RNA, 64 nt, Human; identical to SEQ ID NO: 189424

SEQ ID NO: 283492 - RNA, 64 nt, Human; identical to SEQ ID NO: 189425

SEQ ID NO: 283493 - RNA, 64 nt, Human; identical to SEQ ID NO: 189429

SEQ ID NO: 283494 - RNA, 64 nt, Human; identical to SEQ ID NO: 189430

SEQ ID NO: 283495 - RNA, 64 nt, Human; identical to SEQ ID NO: 189431

SEQ ID NO: 283496 - RNA, 64 nt, Human; identical to SEQ ID NO: 189432

SEQ ID NO: 283497 - RNA, 64 nt, Human; identical to SEQ ID NO: 189433

SEQ ID NO: 283498 - RNA, 64 nt, Human; identical to SEQ ID NO: 189434

SEQ ID NO: 283499 - RNA, 64 nt, Human; identical to SEQ ID NO: 189435

SEQ ID NO: 283500 - RNA, 64 nt, Human
acccggaccugaauguaaugcaagaaugaacagaacaagcaaaaugaccagcugcuuagucacc

SEQ ID NO: 283501 - RNA, 64 nt, Human
acugauaaagcuguacaaauaagcagugugccuaacaagcaacacaguaauguugacaugcuua

SEQ ID NO: 283502 - RNA, 64 nt, Human
uggccaaaauuuaaacuguauaauggagcuagauacaagcaagaauaguauuugaaagacuuuu

SEQ ID NO: 283503 - RNA, 64 nt, Human; identical to SEQ ID NO: 189436

SEQ ID NO: 283504 - RNA, 64 nt, Human; identical to SEQ ID NO: 189437

SEQ ID NO: 283505 - RNA, 64 nt, Human; identical to SEQ ID NO: 189438

SEQ ID NO: 283506 - RNA, 64 nt, Human; identical to SEQ ID NO: 189439

SEQ ID NO: 283507 - RNA, 64 nt, Human; identical to SEQ ID NO: 189440

SEQ ID NO: 283508 - RNA, 64 nt, Human; identical to SEQ ID NO: 189441

SEQ ID NO: 283509 - RNA, 64 nt, Human; identical to SEQ ID NO: 189442

SEQ ID NO: 283510 - RNA, 64 nt, Human; identical to SEQ ID NO: 189443

SEQ ID NO: 283511 - RNA, 64 nt, Human; identical to SEQ ID NO: 189447

SEQ ID NO: 283512 - RNA, 64 nt, Human; identical to SEQ ID NO: 189448

SEQ ID NO: 283513 - RNA, 64 nt, Human; identical to SEQ ID NO: 189449

SEQ ID NO: 283514 - RNA, 64 nt, Human; identical to SEQ ID NO: 189450

SEQ ID NO: 283515 - RNA, 64 nt, Human; identical to SEQ ID NO: 189451

SEQ ID NO: 283516 - RNA, 64 nt, Human; identical to SEQ ID NO: 189452

SEQ ID NO: 283517 - RNA, 64 nt, Human
uuuagggggaaaaucagucauaucuuuaacaccaacaagcaauuucccaccaacgaauguagua

SEQ ID NO: 283518 - RNA, 64 nt, Human
aaacagaaguuccagagcacagaaggucaucaucacaagcaaacuuuauuaaaaaaaaacuaga

SEQ ID NO: 283519 - RNA, 64 nt, Human
uuuuucaguguuggacuugacagcuucuuuugccacaagcaagagagaauuuaacacuguuuca

SEQ ID NO: 283520 - RNA, 64 nt, Human; identical to SEQ ID NO: 189453

SEQ ID NO: 283521 - RNA, 64 nt, Human; identical to SEQ ID NO: 189454

SEQ ID NO: 283522 - RNA, 64 nt, Human; identical to SEQ ID NO: 189455

SEQ ID NO: 283523 - RNA, 64 nt, Human; identical to SEQ ID NO: 189456

SEQ ID NO: 283524 - RNA, 64 nt, Human; identical to SEQ ID NO: 189457

SEQ ID NO: 283525 - RNA, 64 nt, Human; identical to SEQ ID NO: 189458

SEQ ID NO: 283526 - RNA, 64 nt, Human; identical to SEQ ID NO: 189459

SEQ ID NO: 283527 - RNA, 64 nt, Human; identical to SEQ ID NO: 189460

SEQ ID NO: 283528 - RNA, 64 nt, Human; identical to SEQ ID NO: 189461

SEQ ID NO: 283529 - RNA, 64 nt, Human; identical to SEQ ID NO: 189465

SEQ ID NO: 283530 - RNA, 64 nt, Human; identical to SEQ ID NO: 189466

SEQ ID NO: 283531 - RNA, 64 nt, Human; identical to SEQ ID NO: 189467

SEQ ID NO: 283532 - RNA, 64 nt, Human; identical to SEQ ID NO: 189468

SEQ ID NO: 283533 - RNA, 64 nt, Human; identical to SEQ ID NO: 189469

SEQ ID NO: 283534 - RNA, 64 nt, Human
agccuaggugacagagcaagacucugucucaaaaacaagcaaacagacuuccuucaacaaauau

SEQ ID NO: 283535 - RNA, 64 nt, Human
agggaacucugcuaugugauggggacuuccugggacaagcaaggaaaguacugaggcagccacu

SEQ ID NO: 283536 - RNA, 64 nt, Human
aaucugcuguaagcuuucuuaacuguuuuuuguaacaagcaaagagaauauggcaaauauuugu

SEQ ID NO: 283537 - RNA, 64 nt, Human; identical to SEQ ID NO: 189470

SEQ ID NO: 283538 - RNA, 51 nt, Human; identical to SEQ ID NO: 189471

SEQ ID NO: 283539 - RNA, 64 nt, Human; identical to SEQ ID NO: 189472

SEQ ID NO: 283540 - RNA, 64 nt, Human; identical to SEQ ID NO: 189473

SEQ ID NO: 283541 - RNA, 64 nt, Human; identical to SEQ ID NO: 189474

SEQ ID NO: 283542 - RNA, 64 nt, Human; identical to SEQ ID NO: 189475

SEQ ID NO: 283543 - RNA, 64 nt, Human; identical to SEQ ID NO: 189476

SEQ ID NO: 283544 - RNA, 64 nt, Human; identical to SEQ ID NO: 189477

SEQ ID NO: 283545 - RNA, 64 nt, Human; identical to SEQ ID NO: 189478

SEQ ID NO: 283546 - RNA, 64 nt, Human; identical to SEQ ID NO: 189479

SEQ ID NO: 283547 - RNA, 64 nt, Human; identical to SEQ ID NO: 189483

SEQ ID NO: 283548 - RNA, 64 nt, Human; identical to SEQ ID NO: 189484

SEQ ID NO: 283549 - RNA, 64 nt, Human; identical to SEQ ID NO: 189485

SEQ ID NO: 283550 - RNA, 64 nt, Human; identical to SEQ ID NO: 189486

SEQ ID NO: 283551 - RNA, 64 nt, Human
agugagaaacugaucaaauugcacuuguucuccuacaagcaaccuccacgcagacaccucguac

SEQ ID NO: 283552 - RNA, 64 nt, Human
ugaucuuuuucuagaagguacuaagaagacagaaacaagcaaagccgccaccacagagcccgaa

SEQ ID NO: 283553 - RNA, 64 nt, Human
agccggagaagccggagcagaaguccugguaguuacaagcaaagggagacaaggaaacgggcac

SEQ ID NO: 283554 - RNA, 64 nt, Human; identical to SEQ ID NO: 189487

SEQ ID NO: 283555 - RNA, 64 nt, Human; identical to SEQ ID NO: 189488

SEQ ID NO: 283556 - RNA, 64 nt, Human; identical to SEQ ID NO: 189489

SEQ ID NO: 283557 - RNA, 64 nt, Human; identical to SEQ ID NO: 189246

SEQ ID NO: 283558 - RNA, 64 nt, Human; identical to SEQ ID NO: 189247

SEQ ID NO: 283559 - RNA, 64 nt, Human; identical to SEQ ID NO: 189248

SEQ ID NO: 283560 - RNA, 64 nt, Human; identical to SEQ ID NO: 189249

SEQ ID NO: 283561 - RNA, 64 nt, Human; identical to SEQ ID NO: 189250

SEQ ID NO: 283562 - RNA, 64 nt, Human; identical to SEQ ID NO: 189251

SEQ ID NO: 283563 - RNA, 64 nt, Human; identical to SEQ ID NO: 189252

SEQ ID NO: 283564 - RNA, 64 nt, Human; identical to SEQ ID NO: 189253

SEQ ID NO: 283565 - RNA, 64 nt, Human; identical to SEQ ID NO: 189254

SEQ ID NO: 283566 - RNA, 64 nt, Human
gcugugcccaaaagggucuaccucaggugggguuacaagcaaaccugggugacccucuuguccc

SEQ ID NO: 283567 - RNA, 64 nt, Human
caucugucuaaguaaucagacucagguuccacacacaagcaacaacucgugggccucuuuucua

SEQ ID NO: 283568 - RNA, 64 nt, Human
aaauaccaaaccuucugacuuugccaaaaagcauacaagcaaccuggucauacauaggaugaca

SEQ ID NO: 283569 - RNA, 64 nt, Human; identical to SEQ ID NO: 189255

SEQ ID NO: 283570 - RNA, 64 nt, Human; identical to SEQ ID NO: 189256

SEQ ID NO: 283571 - RNA, 64 nt, Human; identical to SEQ ID NO: 189257

SEQ ID NO: 283572 - RNA, 64 nt, Human; identical to SEQ ID NO: 189258

SEQ ID NO: 283573 - RNA, 64 nt, Human; identical to SEQ ID NO: 189262

SEQ ID NO: 283574 - RNA, 64 nt, Human; identical to SEQ ID NO: 189263

SEQ ID NO: 283575 - RNA, 64 nt, Human; identical to SEQ ID NO: 189264

SEQ ID NO: 283576 - RNA, 64 nt, Human; identical to SEQ ID NO: 189265

SEQ ID NO: 283577 - RNA, 64 nt, Human; identical to SEQ ID NO: 189266

SEQ ID NO: 283578 - RNA, 64 nt, Human; identical to SEQ ID NO: 189267

SEQ ID NO: 283579 - RNA, 64 nt, Human; identical to SEQ ID NO: 189268

SEQ ID NO: 283580 - RNA, 64 nt, Human; identical to SEQ ID NO: 189269

SEQ ID NO: 283581 - RNA, 59 nt, Human; identical to SEQ ID NO: 189270

SEQ ID NO: 283582 - RNA, 64 nt, Human; identical to SEQ ID NO: 189271

SEQ ID NO: 283583 - RNA, 64 nt, Human
uuagccaggauccuugguguccuaggagaaacagacaagcaaaacaaagugaaaaccgaaugga

SEQ ID NO: 283584 - RNA, 64 nt, Human
aauuaaauauguacauauugauuagaaaaauauaacaagcaauuuuuccugcuaacccaaaaug

SEQ ID NO: 283585 - RNA, 64 nt, Human
gucuggucuguccaccccaucaacaagucuugaaacaagcaacagauggauagucuguccaaau

SEQ ID NO: 283586 - RNA, 64 nt, Human; identical to SEQ ID NO: 189272

SEQ ID NO: 283587 - RNA, 64 nt, Human; identical to SEQ ID NO: 189273

SEQ ID NO: 283588 - RNA, 64 nt, Human; identical to SEQ ID NO: 189274

SEQ ID NO: 283589 - RNA, 64 nt, Human; identical to SEQ ID NO: 189275

SEQ ID NO: 283590 - RNA, 64 nt, Human; identical to SEQ ID NO: 189276

SEQ ID NO: 283591 - RNA, 64 nt, Human; identical to SEQ ID NO: 189280

SEQ ID NO: 283592 - RNA, 64 nt, Human; identical to SEQ ID NO: 189281

SEQ ID NO: 283593 - RNA, 64 nt, Human; identical to SEQ ID NO: 189282

SEQ ID NO: 283594 - RNA, 64 nt, Human; identical to SEQ ID NO: 189283

SEQ ID NO: 283595 - RNA, 64 nt, Human; identical to SEQ ID NO: 189284

SEQ ID NO: 283596 - RNA, 64 nt, Human; identical to SEQ ID NO: 189285

SEQ ID NO: 283597 - RNA, 64 nt, Human; identical to SEQ ID NO: 189286

SEQ ID NO: 283598 - RNA, 64 nt, Human; identical to SEQ ID NO: 189287

SEQ ID NO: 283599 - RNA, 64 nt, Human; identical to SEQ ID NO: 189288

SEQ ID NO: 283600 - RNA, 64 nt, Human
ugaguaaagaaaaggcuaaaaucaugaauuaguuacaagcaacaguaccaacuuaugugacccc

SEQ ID NO: 283601 - RNA, 64 nt, Human
uaggcagugguuucuuagauaugauaccaaagacacaagcaaccaauggaaaaauagguaaauu

SEQ ID NO: 283602 - RNA, 64 nt, Human
aaaugaggguggugaauauuguucauauuguggcacaagcaaaagggugucugagcccucaaag

SEQ ID NO: 283603 - RNA, 64 nt, Human; identical to SEQ ID NO: 189289

SEQ ID NO: 283604 - RNA, 64 nt, Human; identical to SEQ ID NO: 189290

SEQ ID NO: 283605 - RNA, 64 nt, Human; identical to SEQ ID NO: 189291

SEQ ID NO: 283606 - RNA, 64 nt, Human; identical to SEQ ID NO: 189292

SEQ ID NO: 283607 - RNA, 64 nt, Human; identical to SEQ ID NO: 189293

SEQ ID NO: 283608 - RNA, 64 nt, Human; identical to SEQ ID NO: 189294

SEQ ID NO: 283609 - RNA, 64 nt, Human; identical to SEQ ID NO: 189298

SEQ ID NO: 283610 - RNA, 64 nt, Human; identical to SEQ ID NO: 189299

SEQ ID NO: 283611 - RNA, 64 nt, Human; identical to SEQ ID NO: 189300

SEQ ID NO: 283612 - RNA, 64 nt, Human; identical to SEQ ID NO: 189301

SEQ ID NO: 283613 - RNA, 64 nt, Human; identical to SEQ ID NO: 189302

SEQ ID NO: 283614 - RNA, 64 nt, Human; identical to SEQ ID NO: 189303

SEQ ID NO: 283615 - RNA, 64 nt, Human; identical to SEQ ID NO: 189304

SEQ ID NO: 283616 - RNA, 64 nt, Human; identical to SEQ ID NO: 189305

SEQ ID NO: 283617 - RNA, 64 nt, Human
gcuuuuuuaggggaaauaggucauuugcuauauuacaagcaauccccaaauuuuauggucuucc

SEQ ID NO: 283618 - RNA, 64 nt, Human
uuagcucauuugaaguuggcaaaaacaaauacaaacaagcaaaaaaccucaaauuuuuuucagc

SEQ ID NO: 283619 - RNA, 64 nt, Human
aagacuccuaauaggucaagagagagagacccagacaagcaaacucaaaauaaagagaaaagga

SEQ ID NO: 283620 - RNA, 64 nt, Human; identical to SEQ ID NO: 189306

SEQ ID NO: 283621 - RNA, 64 nt, Human; identical to SEQ ID NO: 189307

SEQ ID NO: 283622 - RNA, 64 nt, Human; identical to SEQ ID NO: 189308

SEQ ID NO: 283623 - RNA, 64 nt, Human; identical to SEQ ID NO: 189309

SEQ ID NO: 283624 - RNA, 64 nt, Human; identical to SEQ ID NO: 189310

SEQ ID NO: 283625 - RNA, 53 nt, Human; identical to SEQ ID NO: 189311

SEQ ID NO: 283626 - RNA, 64 nt, Human; identical to SEQ ID NO: 189312

SEQ ID NO: 283627 - RNA, 64 nt, Human; identical to SEQ ID NO: 189317

SEQ ID NO: 283628 - RNA, 64 nt, Human; identical to SEQ ID NO: 189318

SEQ ID NO: 283629 - RNA, 64 nt, Human; identical to SEQ ID NO: 189319

SEQ ID NO: 283630 - RNA, 64 nt, Human; identical to SEQ ID NO: 189320

SEQ ID NO: 283631 - RNA, 64 nt, Human; identical to SEQ ID NO: 189321

SEQ ID NO: 283632 - RNA, 64 nt, Human; identical to SEQ ID NO: 189322

SEQ ID NO: 283633 - RNA, 64 nt, Human; identical to SEQ ID NO: 189323

SEQ ID NO: 283634 - RNA, 64 nt, Human
acugagaauaauuaaaacaaaauuaagcaaaugcacaagcaaaaagaugcuugauacacaaaag

SEQ ID NO: 283635 - RNA, 64 nt, Human
gaacaucugccaucaaggcccuuaaugcuacaggacaagcaaaccucagccuggaggcacuuuu

SEQ ID NO: 283636 - RNA, 64 nt, Human
cucugaggucauaauuuccucggagaccuguuuaacaagcaaaaaucaaaacccuccaagauug

SEQ ID NO: 283637 - RNA, 64 nt, Human; identical to SEQ ID NO: 189324

SEQ ID NO: 283638 - RNA, 64 nt, Human; identical to SEQ ID NO: 189325

SEQ ID NO: 283639 - RNA, 64 nt, Human; identical to SEQ ID NO: 189326

SEQ ID NO: 283640 - RNA, 64 nt, Human; identical to SEQ ID NO: 189327

SEQ ID NO: 283641 - RNA, 64 nt, Human; identical to SEQ ID NO: 189328

SEQ ID NO: 283642 - RNA, 64 nt, Human; identical to SEQ ID NO: 189329

SEQ ID NO: 283643 - RNA, 64 nt, Human; identical to SEQ ID NO: 189330

SEQ ID NO: 283644 - RNA, 64 nt, Human; identical to SEQ ID NO: 189331

SEQ ID NO: 283645 - RNA, 64 nt, Human; identical to SEQ ID NO: 189336

SEQ ID NO: 283646 - RNA, 64 nt, Human; identical to SEQ ID NO: 189337

SEQ ID NO: 283647 - RNA, 64 nt, Human; identical to SEQ ID NO: 189338

SEQ ID NO: 283648 - RNA, 64 nt, Human; identical to SEQ ID NO: 189339

SEQ ID NO: 283649 - RNA, 64 nt, Human; identical to SEQ ID NO: 189340

SEQ ID NO: 283650 - RNA, 64 nt, Human; identical to SEQ ID NO: 189341

SEQ ID NO: 283651 - RNA, 64 nt, Human
ccacugauuuccugauguccaugucuauauguuuacaagcaauauggagcaccauucuuuaaau

SEQ ID NO: 283652 - RNA, 64 nt, Human
cuguaaggcguagaaugaggguuguuaauccaucacaagcaaaaggucagaacaguuaaacacu

SEQ ID NO: 283653 - RNA, 64 nt, Human
cucauccguacauccagcauuucuuuauggauauacaagcaaaugggaauguagagucucacau

SEQ ID NO: 283654 - RNA, 64 nt, Human; identical to SEQ ID NO: 189342

SEQ ID NO: 283655 - RNA, 64 nt, Human; identical to SEQ ID NO: 189343

SEQ ID NO: 283656 - RNA, 64 nt, Human; identical to SEQ ID NO: 189344

SEQ ID NO: 283657 - RNA, 64 nt, Human; identical to SEQ ID NO: 189345

SEQ ID NO: 283658 - RNA, 64 nt, Human; identical to SEQ ID NO: 189346

SEQ ID NO: 283659 - RNA, 64 nt, Human; identical to SEQ ID NO: 189347

SEQ ID NO: 283660 - RNA, 64 nt, Human; identical to SEQ ID NO: 189348

SEQ ID NO: 283661 - RNA, 64 nt, Human; identical to SEQ ID NO: 189349

SEQ ID NO: 283662 - RNA, 64 nt, Human; identical to SEQ ID NO: 189350

SEQ ID NO: 283663 - RNA, 64 nt, Human; identical to SEQ ID NO: 189355

SEQ ID NO: 283664 - RNA, 64 nt, Human; identical to SEQ ID NO: 189356

SEQ ID NO: 283665 - RNA, 64 nt, Human; identical to SEQ ID NO: 189357

SEQ ID NO: 283666 - RNA, 64 nt, Human; identical to SEQ ID NO: 189358

SEQ ID NO: 283667 - RNA, 64 nt, Human; identical to SEQ ID NO: 189359

SEQ ID NO: 283668 - RNA, 64 nt, Human
gugggggccagccucgcuggagggagagcaacccuuugccgaugaccacgcuugccgccaucuc

SEQ ID NO: 283669 - RNA, 64 nt, Human
cucagcuggccacccugcacguugugcacugaccuuugccgaccuccagcggaaccccccaggg

SEQ ID NO: 283670 - RNA, 64 nt, Human
agaccugucuucucaucagccaccgcuguuuucuuuugccgaacgaugguugcaucucucggac

SEQ ID NO: 283671 - RNA, 64 nt, Human; identical to SEQ ID NO: 189360

SEQ ID NO: 283672 - RNA, 64 nt, Human; identical to SEQ ID NO: 189361

SEQ ID NO: 283673 - RNA, 64 nt, Human; identical to SEQ ID NO: 189362

SEQ ID NO: 283674 - RNA, 64 nt, Human; identical to SEQ ID NO: 189363

SEQ ID NO: 283675 - RNA, 64 nt, Human; identical to SEQ ID NO: 189364

SEQ ID NO: 283676 - RNA, 64 nt, Human; identical to SEQ ID NO: 189365

SEQ ID NO: 283677 - RNA, 64 nt, Human; identical to SEQ ID NO: 189366

SEQ ID NO: 283678 - RNA, 64 nt, Human; identical to SEQ ID NO: 189367

SEQ ID NO: 283679 - RNA, 64 nt, Human; identical to SEQ ID NO: 189368

SEQ ID NO: 283680 - RNA, 64 nt, Human; identical to SEQ ID NO: 189369

SEQ ID NO: 283681 - RNA, 64 nt, Human; identical to SEQ ID NO: 189374

SEQ ID NO: 283682 - RNA, 64 nt, Human; identical to SEQ ID NO: 189375

SEQ ID NO: 283683 - RNA, 64 nt, Human; identical to SEQ ID NO: 189376

SEQ ID NO: 283684 - RNA, 64 nt, Human; identical to SEQ ID NO: 189377

SEQ ID NO: 283685 - RNA, 64 nt, Human
ucuauacccaccaccucccuucauaaccuuuauauuugccgaauuuggccuccucaaaagcagc

SEQ ID NO: 283686 - RNA, 64 nt, Human
aaauacgacauuaacaggagagcagcaguacgauuuugccgauggaauaacagauuugccggca

SEQ ID NO: 283687 - RNA, 64 nt, Human
aacccaggggacuggcaacuauaacaucgaagacuuugccgaccugggcauguuuccaccguuu

SEQ ID NO: 283688 - RNA, 64 nt, Human; identical to SEQ ID NO: 189378

SEQ ID NO: 283689 - RNA, 64 nt, Human; identical to SEQ ID NO: 189379

SEQ ID NO: 283690 - RNA, 64 nt, Human; identical to SEQ ID NO: 189380

SEQ ID NO: 283691 - RNA, 64 nt, Human; identical to SEQ ID NO: 189381

SEQ ID NO: 283692 - RNA, 64 nt, Human; identical to SEQ ID NO: 189382

SEQ ID NO: 283693 - RNA, 64 nt, Human; identical to SEQ ID NO: 189383

SEQ ID NO: 283694 - RNA, 64 nt, Human; identical to SEQ ID NO: 189384

SEQ ID NO: 283695 - RNA, 64 nt, Human; identical to SEQ ID NO: 189385

SEQ ID NO: 283696 - RNA, 64 nt, Human; identical to SEQ ID NO: 189386

SEQ ID NO: 283697 - RNA, 64 nt, Human; identical to SEQ ID NO: 189387

SEQ ID NO: 283698 - RNA, 64 nt, Human; identical to SEQ ID NO: 189388

SEQ ID NO: 283699 - RNA, 64 nt, Human; identical to SEQ ID NO: 188697

SEQ ID NO: 283700 - RNA, 64 nt, Human; identical to SEQ ID NO: 188698

SEQ ID NO: 283701 - RNA, 64 nt, Human; identical to SEQ ID NO: 188699

SEQ ID NO: 283702 - RNA, 64 nt, Human
gguauuugaaguguccagcaguugcuugaaaugcuuugccgaaucugacuccaguaagaaugug

SEQ ID NO: 283703 - RNA, 64 nt, Human; identical to SEQ ID NO: 283686

SEQ ID NO: 283704 - RNA, 64 nt, Human
uccucucucaggaugacgaggaccugugccuucaacaagcaaaaugcugcucacgguuguccug

SEQ ID NO: 283705 - RNA, 64 nt, Human; identical to SEQ ID NO: 188700

SEQ ID NO: 283706 - RNA, 64 nt, Human; identical to SEQ ID NO: 188701

SEQ ID NO: 283707 - RNA, 64 nt, Human; identical to SEQ ID NO: 188702

SEQ ID NO: 283708 - RNA, 64 nt, Human; identical to SEQ ID NO: 188703

SEQ ID NO: 283709 - RNA, 64 nt, Human; identical to SEQ ID NO: 188704

SEQ ID NO: 283710 - RNA, 64 nt, Human; identical to SEQ ID NO: 188705

SEQ ID NO: 283711 - RNA, 64 nt, Human; identical to SEQ ID NO: 188706

SEQ ID NO: 283712 - RNA, 64 nt, Human; identical to SEQ ID NO: 188707

SEQ ID NO: 283713 - RNA, 64 nt, Human; identical to SEQ ID NO: 188708

SEQ ID NO: 283714 - RNA, 64 nt, Human; identical to SEQ ID NO: 188709

SEQ ID NO: 283715 - RNA, 64 nt, Human; identical to SEQ ID NO: 188710

SEQ ID NO: 283716 - RNA, 64 nt, Human; identical to SEQ ID NO: 189392

SEQ ID NO: 283717 - RNA, 64 nt, Human; identical to SEQ ID NO: 189411

SEQ ID NO: 283718 - RNA, 64 nt, Human; identical to SEQ ID NO: 189412

SEQ ID NO: 283719 - RNA, 64 nt, Human
gagcuggcagcauggagcccucggcuccccagacuuugccgaggggcugcuccggaccccguug

SEQ ID NO: 283720 - RNA, 64 nt, Human
guaucggggugggucagaaaaagucucaccucaauuugccgacagugucaccugcuugccuuag

SEQ ID NO: 283721 - RNA, 64 nt, Human
caaccaaauaaaacugaacuuggcaaaaaagaacuuugccgagaaaauuguguaccugccagaa

SEQ ID NO: 283722 - RNA, 64 nt, Human; identical to SEQ ID NO: 189413

SEQ ID NO: 283723 - RNA, 64 nt, Human; identical to SEQ ID NO: 189414

SEQ ID NO: 283724 - RNA, 64 nt, Human; identical to SEQ ID NO: 189415

SEQ ID NO: 283725 - RNA, 64 nt, Human; identical to SEQ ID NO: 189416

SEQ ID NO: 283726 - RNA, 64 nt, Human; identical to SEQ ID NO: 189417

SEQ ID NO: 283727 - RNA, 64 nt, Human; identical to SEQ ID NO: 189418

SEQ ID NO: 283728 - RNA, 64 nt, Human; identical to SEQ ID NO: 189419

SEQ ID NO: 283729 - RNA, 64 nt, Human; identical to SEQ ID NO: 189420

SEQ ID NO: 283730 - RNA, 64 nt, Human; identical to SEQ ID NO: 189421

SEQ ID NO: 283731 - RNA, 64 nt, Human; identical to SEQ ID NO: 189422

SEQ ID NO: 283732 - RNA, 64 nt, Human; identical to SEQ ID NO: 189423

SEQ ID NO: 283733 - RNA, 64 nt, Human; identical to SEQ ID NO: 189424

SEQ ID NO: 283734 - RNA, 64 nt, Human; identical to SEQ ID NO: 189425

SEQ ID NO: 283735 - RNA, 64 nt, Human; identical to SEQ ID NO: 189429

SEQ ID NO: 283736 - RNA, 64 nt, Human
uuacaguugagggagcugagcucagauucaguucuuugccgaagcccucauagcugguaagugg

SEQ ID NO: 283737 - RNA, 64 nt, Human
auuucuuuuuuacuuagagaaucguucuaguguuuuugccgaagauuaccgcuggccuacugug

SEQ ID NO: 283738 - RNA, 64 nt, Human
aggagcaaagcuguauccuggaguuggucugugauuugccgacagccuugcaggcugggcucag

SEQ ID NO: 283739 - RNA, 64 nt, Human; identical to SEQ ID NO: 189430

SEQ ID NO: 283740 - RNA, 64 nt, Human; identical to SEQ ID NO: 189431

SEQ ID NO: 283741 - RNA, 64 nt, Human; identical to SEQ ID NO: 189432

SEQ ID NO: 283742 - RNA, 64 nt, Human; identical to SEQ ID NO: 189433

SEQ ID NO: 283743 - RNA, 64 nt, Human; identical to SEQ ID NO: 189434

SEQ ID NO: 283744 - RNA, 64 nt, Human; identical to SEQ ID NO: 189435

SEQ ID NO: 283745 - RNA, 64 nt, Human; identical to SEQ ID NO: 189436

SEQ ID NO: 283746 - RNA, 64 nt, Human; identical to SEQ ID NO: 189437

SEQ ID NO: 283747 - RNA, 64 nt, Human; identical to SEQ ID NO: 189438

SEQ ID NO: 283748 - RNA, 64 nt, Human; identical to SEQ ID NO: 189439

SEQ ID NO: 283749 - RNA, 64 nt, Human; identical to SEQ ID NO: 189440

SEQ ID NO: 283750 - RNA, 64 nt, Human; identical to SEQ ID NO: 189441

SEQ ID NO: 283751 - RNA, 64 nt, Human; identical to SEQ ID NO: 189442

SEQ ID NO: 283752 - RNA, 64 nt, Human; identical to SEQ ID NO: 189443

SEQ ID NO: 283753 - RNA, 64 nt, Human
cuuugacauucacauccucagugucucagucuuuuuugccgagaaagcacaguagucugggacu

SEQ ID NO: 283754 - RNA, 64 nt, Human
ucaacuccuugguccccuguugucugggucaacauuugccgagacgccuuggcuggcacccucu

SEQ ID NO: 283755 - RNA, 64 nt, Human
ggagcugcguagucuccucagacauagucaaagcuuugccgagaaaagaaauguaugaacuaua

SEQ ID NO: 283756 - RNA, 64 nt, Human; identical to SEQ ID NO: 189447

SEQ ID NO: 283757 - RNA, 64 nt, Human; identical to SEQ ID NO: 189448

SEQ ID NO: 283758 - RNA, 64 nt, Human; identical to SEQ ID NO: 189449

SEQ ID NO: 283759 - RNA, 64 nt, Human; identical to SEQ ID NO: 189450

SEQ ID NO: 283760 - RNA, 64 nt, Human; identical to SEQ ID NO: 189451

SEQ ID NO: 283761 - RNA, 64 nt, Human; identical to SEQ ID NO: 189452

SEQ ID NO: 283762 - RNA, 64 nt, Human; identical to SEQ ID NO: 189453

SEQ ID NO: 283763 - RNA, 64 nt, Human; identical to SEQ ID NO: 189454

SEQ ID NO: 283764 - RNA, 64 nt, Human; identical to SEQ ID NO: 189455

SEQ ID NO: 283765 - RNA, 64 nt, Human; identical to SEQ ID NO: 189456

SEQ ID NO: 283766 - RNA, 64 nt, Human; identical to SEQ ID NO: 189457

SEQ ID NO: 283767 - RNA, 64 nt, Human; identical to SEQ ID NO: 189458

SEQ ID NO: 283768 - RNA, 64 nt, Human; identical to SEQ ID NO: 189459

SEQ ID NO: 283769 - RNA, 64 nt, Human; identical to SEQ ID NO: 189460

SEQ ID NO: 283770 - RNA, 64 nt, Human
gccagcuagccuuaacaucuaagaaauuuuuccaacaagcaaaaaccuuuagaaaugaaagaau

SEQ ID NO: 283771 - RNA, 64 nt, Human
auuuaguacaaaaauagauucccaguagauauccacaagcaauauuagcagggcuucuguuucu

SEQ ID NO: 283772 - RNA, 64 nt, Human
acuuucaaaggaacagaaguaguuaaccaaacuaacaagcaaaaccugagguuuaccuagugac

SEQ ID NO: 283773 - RNA, 64 nt, Human; identical to SEQ ID NO: 189461

SEQ ID NO: 283774 - RNA, 64 nt, Human; identical to SEQ ID NO: 189465

SEQ ID NO: 283775 - RNA, 64 nt, Human; identical to SEQ ID NO: 189466

SEQ ID NO: 283776 - RNA, 64 nt, Human; identical to SEQ ID NO: 189467

SEQ ID NO: 283777 - RNA, 64 nt, Human; identical to SEQ ID NO: 189468

SEQ ID NO: 283778 - RNA, 64 nt, Human; identical to SEQ ID NO: 189469

SEQ ID NO: 283779 - RNA, 64 nt, Human; identical to SEQ ID NO: 189470

SEQ ID NO: 283780 - RNA, 51 nt, Human; identical to SEQ ID NO: 189471

SEQ ID NO: 283781 - RNA, 64 nt, Human; identical to SEQ ID NO: 189472

SEQ ID NO: 283782 - RNA, 64 nt, Human; identical to SEQ ID NO: 189473

SEQ ID NO: 283783 - RNA, 64 nt, Human; identical to SEQ ID NO: 189474

SEQ ID NO: 283784 - RNA, 64 nt, Human; identical to SEQ ID NO: 189475

SEQ ID NO: 283785 - RNA, 64 nt, Human; identical to SEQ ID NO: 189476

SEQ ID NO: 283786 - RNA, 64 nt, Human; identical to SEQ ID NO: 189477

SEQ ID NO: 283787 - RNA, 64 nt, Human
agcugggagucuggcaggcccuuuuuuuuuuuucuuugccgaaaccugcaggcguucucucucu

SEQ ID NO: 283788 - RNA, 64 nt, Human
aaaggagaaaggacuauuucucaguuagaaaacuuuugccgauaccuuguacacuuagcggaua

SEQ ID NO: 283789 - RNA, 64 nt, Human
gaguauccuuugcuuaucuuuguaguacugaaaauuugccgaaguaacuggcugugcagaaugu

SEQ ID NO: 283790 - RNA, 64 nt, Human; identical to SEQ ID NO: 189478

SEQ ID NO: 283791 - RNA, 64 nt, Human; identical to SEQ ID NO: 189479

SEQ ID NO: 283792 - RNA, 64 nt, Human; identical to SEQ ID NO: 189483

SEQ ID NO: 283793 - RNA, 64 nt, Human; identical to SEQ ID NO: 189484

SEQ ID NO: 283794 - RNA, 64 nt, Human; identical to SEQ ID NO: 189485

SEQ ID NO: 283795 - RNA, 64 nt, Human; identical to SEQ ID NO: 189486

SEQ ID NO: 283796 - RNA, 64 nt, Human; identical to SEQ ID NO: 189487

SEQ ID NO: 283797 - RNA, 64 nt, Human; identical to SEQ ID NO: 189488

SEQ ID NO: 283798 - RNA, 64 nt, Human; identical to SEQ ID NO: 189489

SEQ ID NO: 283799 - RNA, 64 nt, Human
cgugaggucaagaguucaagaccagccuggccaauauggugaaaccccaucucuacuaagaaua

SEQ ID NO: 283800 - RNA, 64 nt, Human
gugaaaaguaguucccauaauacacaugguugacuauggugauccaccuugugaugguuaauau

SEQ ID NO: 283801 - RNA, 64 nt, Human
aggauuguucauuccuuugggacuaaguuauaguuauggugaguguguauuuacuguaguuuug

SEQ ID NO: 283802 - RNA, 64 nt, Human
cccaucucgggcagacccccagcagaugugucggacaagcaacuucuuuuccucugugaggaga

SEQ ID NO: 283803 - RNA, 64 nt, Human
uuaagauucugcugcuguuuagagaaauugugaaacaagcaaaacaaaacuuuccagccauuuu

SEQ ID NO: 283804 - RNA, 64 nt, Human
aggugggcugguuuuaguacucugaaggacaaaaacaagcaaacaaaaaccccugcugcagcau

SEQ ID NO: 283805 - RNA, 64 nt, Human
ccuauguguuuuaucuaauuauuuugguuguuaauauggugauaauggaaagucaaguuaaauu

SEQ ID NO: 283806 - RNA, 64 nt, Human
auauuuauucuggguuuuguagcauuuuuauuaauauggugacuuuuuaaaauaaaaacaaaca

SEQ ID NO: 283807 - RNA, 64 nt, Human
gaagcacuuguaggucuuuacuagugcuaaguauuauggugagcuaucauuaaagugugccauc

SEQ ID NO: 283808 - RNA, 64 nt, Human
ugugaucuuugacugcuaggggagggaaccuggguauggugagacggugacgagagaaaagggu

SEQ ID NO: 283809 - RNA, 64 nt, Human
ccugugucuacaaaaaauuuaaaaauuagccaaguauggugacaggcaccuaugguuccagcua

SEQ ID NO: 283810 - RNA, 64 nt, Human
agcccgaaguggaaagaccuuaugguuuuguagauauggugacuccagucuuuguuguauaaag

SEQ ID NO: 283811 - RNA, 64 nt, Human
gacagggcagguuuggggagccgcuguccagcccuauggugagacccuggcugacauuuccccu

SEQ ID NO: 283812 - RNA, 64 nt, Human
acggcucuaaggcuggaaugaccacauagguagguauggugaguucaaccauuuuugcucuuga

SEQ ID NO: 283813 - RNA, 64 nt, Human
ccugaggucaugaguucaagaccagccugaccaauauggugaaacccugucucuacuaaagaaa

SEQ ID NO: 283814 - RNA, 64 nt, Human
auccuuuugcuauccucuugcucaugaccagccauauggugaggcuggggaguucacauccuca

SEQ ID NO: 283815 - RNA, 64 nt, Human
uguuauauaagaugaucaugugauguguacaaacuauggugaaaagugccagugguaguaacug

SEQ ID NO: 283816 - RNA, 64 nt, Human
uguugauuuguuuucaauauuucuuuucgugcuguauggugaugcuuucuuaguauucuacaca

SEQ ID NO: 283817 - RNA, 64 nt, Human
uuuaaauguacaaauuauuuguaugcuaauguaauauggugaaauuaaaauaaaucacacuguu

SEQ ID NO: 283818 - RNA, 64 nt, Human
ccaauucaaagccaagucguggggugcagauuguuauggugacaggcacacacauuuuucuacc

SEQ ID NO: 283819 - RNA, 64 nt, Human
aauuucuucugcaauucaggucuccuuuugcauuuuugccgagaccagcugggucguggagacc

SEQ ID NO: 283820 - RNA, 64 nt, Human
aaggaacgacaauguucucuuuguuucuuuaaguuuugccgagacaugguuaugccuaauuuau

SEQ ID NO: 283821 - RNA, 64 nt, Human
uagaaauagcuuuaacuuugcuuaaacuacaaacacaagcaaaacuucacggggucauacuaca

SEQ ID NO: 283822 - RNA, 64 nt, Human
uuauacuguaagugagcaaucagaguauaauguuuauggugacaaaauuaaaggcuuucuuaua

SEQ ID NO: 283823 - RNA, 64 nt, Human
aaaauguaaauacauagcuuaguuuuuuguaauauauggugacuucagauuuuuuuguacagua

SEQ ID NO: 283824 - RNA, 64 nt, Human
cugugguccccuuucuuuuaauauauaaauuauguauggugaaguggaguguauuguguagguc

SEQ ID NO: 283825 - RNA, 64 nt, Human
cacaaggucaggaguucaagaccagccuggccaauauggugaaaguccgucucuacuaaaauua

SEQ ID NO: 283826 - RNA, 64 nt, Human
agcuccgugcucaacugauuaaacuuuacugcccuauggugaccaucuaggagaggggagggca

SEQ ID NO: 283827 - RNA, 64 nt, Human
uuggggcuaauuaaaaugggguuugcaggcuuuuuauggugaagaauaauauaucucugucuau

SEQ ID NO: 283828 - RNA, 64 nt, Human
ccaugauuuauuuguguuuugugaauuuucaauuuauggugaugaucugcugauaugcauuuau

SEQ ID NO: 283829 - RNA, 64 nt, Human
gcacacaggaguguccagaguugagguuugcauauauggugaccacaguacuucuuaguguauu

SEQ ID NO: 283830 - RNA, 64 nt, Human
aagauaggauuuucuguguuuccugaauuuuuuauauggugauuuguauuuaaauuuuaagacu

SEQ ID NO: 283831 - RNA, 64 nt, Human
ugucuauaugaaucucuuaaguagaaaugaguuguauggugaaucuguguagugauaauuauau

SEQ ID NO: 283832 - RNA, 64 nt, Human
aggugccgccccggggcaagggccccagcagcccuauggugaccgccacacugugccuuaaugu

SEQ ID NO: 283833 - RNA, 64 nt, Human
aaauucuacccaaugggccaauauugcagaacaguauggugacuguuaugacaaacauuaauuc

SEQ ID NO: 283834 - RNA, 64 nt, Human
aaauauuguacuuauuggaaguaauaucaaacuguauggugauaaguauuguuuugauucuuau

SEQ ID NO: 283835 - RNA, 64 nt, Human
ccacgaacaaguuccaguugagaaacacuaagguuauggugaauaaaaccauagggagcuucuu

SEQ ID NO: 283836 - RNA, 64 nt, Human
ggaaaaggcucuuuagagauccuauuagauuugcuuugccgauugucacucuucaucacaggca

SEQ ID NO: 283837 - RNA, 64 nt, Human
ggagggagaacucauuuuacagaacuugguuuccuuugccgaucuuauguacauacccauuuua

SEQ ID NO: 283838 - RNA, 64 nt, Human
agggcaggcuggcugcacggggagagggaaguauuuugccgaaauaugagaacuggggccuccu

SEQ ID NO: 283839 - RNA, 64 nt, Human
gggggaacacacuagagaaccaaaaaugugauuauauggugauauaaaaaucccuuuccucugu

SEQ ID NO: 283840 - RNA, 64 nt, Human
uauggagauuaaaauaugucaucagucaucucuuuauggugacuucccuuugcaaaccaggcug

SEQ ID NO: 283841 - RNA, 64 nt, Human
caauagcacuuugaagaaaauagagaauuuaauauauggugauugggauauguagcauucaaaa

SEQ ID NO: 283842 - RNA, 64 nt, Human
caugaggucaggaguucgagaccagcccgcccaauauggugaaaccccgucucuccugaaaaaa

SEQ ID NO: 283843 - RNA, 64 nt, Human
uuuaaccuagacaaggauuccgcuuauuccuugguauggugacagugucucuccauggccugag

SEQ ID NO: 283844 - RNA, 64 nt, Human
ugguagauauucccccuuggaauuugacaguuucuauggugaaauggcagaagguaacaacuau

SEQ ID NO: 283845 - RNA, 64 nt, Human
uuuuaaggaaaaauacguuuggaaaauaaacuguuauggugauaauuuggggaauaugugcacg

SEQ ID NO: 283846 - RNA, 64 nt, Human
acuuuucuguaaguuucuauacugucuaaaaccuuauggugaccagaauuguuuauuaauauca

SEQ ID NO: 283847 - RNA, 64 nt, Human
aauuguucccuaugaaagauuccacagagauguuuauggugagguuuaaaggauaugaaacucu

SEQ ID NO: 283848 - RNA, 64 nt, Human
cuugucuauacuccuucccuuaagggguaucauguauggugauagguaucuagagcuuaaugcu

SEQ ID NO: 283849 - RNA, 64 nt, Human
uuguuuuuuuggaaguuaaucugggguagaaauguauggugauuuuuauuuucucugucugaag

SEQ ID NO: 283850 - RNA, 64 nt, Human
uggguauaauuuaagaguccuuguguuguacagauauggugacugauguaguuauuaauacuac

SEQ ID NO: 283851 - RNA, 64 nt, Human
aagcauacuggaagccaccucuggaaaagccucauauggugauaugccaaaauauuuaugucaa

SEQ ID NO: 283852 - RNA, 64 nt, Human
ugauuauucucgcaugauaaggaugguacuugcauauggugaauuacuacuguugacaguuucc

SEQ ID NO: 283853 - RNA, 64 nt, Human
cuccaccuuacuucuucucauacuauuuaagagaacaagcaaauauaaacagcaacuuguguuc

SEQ ID NO: 283854 - RNA, 60 nt, Human
aacuggccaaugaaauuugaacaucacuaaacaagcaaauggaaugacuuuggaccauau

SEQ ID NO: 283855 - RNA, 64 nt, Human
cuugaucauuugaaagaaaugauaaggcuguaguacaagcaagcaguuuaaagauaagacuuga

SEQ ID NO: 283856 - RNA, 64 nt, Human
aguuaguuucacugucuucuuggcuggaccugucacaagcaaccuuuaaguccuacagcacuuu

SEQ ID NO: 283857 - RNA, 64 nt, Human
uccuaguuuauucucccauaagucuuagaagcuuuauggugauuauuuugagguuuucauucuc

SEQ ID NO: 283858 - RNA, 64 nt, Human
acgcucgcgaggagcaggcugcagguuuccugccuauggugagaucagauguggccaagggaag

SEQ ID NO: 283859 - RNA, 64 nt, Human
uuagaaacugaaaacuguaaauacaaaauaaaauuauggugaaauuaugaaaaaugugaauuug

SEQ ID NO: 283860 - RNA, 64 nt, Human
ugguaaccugaguuuauaucuggcaugaauucauuauggugauacacauaugugaauucaguac

SEQ ID NO: 283861 - RNA, 64 nt, Human
auguauaagagaaacaagaauuguuacaacccaguauggugagugccaagacagagagcuauga

SEQ ID NO: 283862 - RNA, 64 nt, Human
auccagugacgucugcuuggcaucuugagauuguuauggugagaguauuuacaccucagcaaau

SEQ ID NO: 283863 - RNA, 64 nt, Human
acucacaucuuaagcauucuuccuggcaaaaauuuauggugaaugaauauggcuuuaggcggca

SEQ ID NO: 283864 - RNA, 64 nt, Human
aagacucccuuuagucccuuuuucaauuaaaaccuauggugaaaaaggcguuugcacuccaauu

SEQ ID NO: 283865 - RNA, 64 nt, Human
aaucaaucucgaccuauauaaauaguagauuuuuuauggugaaacuuucccacauaaaguaaau

SEQ ID NO: 283866 - RNA, 64 nt, Human
uuuauugugaauaucuucaccauauggggucacuuauggugaauaucuuucuucagaguugcug

SEQ ID NO: 283867 - RNA, 64 nt, Human
aguuccaucuuaacagaggaaaccaugaggaccauauggugaacuuacgguacaagucaaaaca

SEQ ID NO: 283868 - RNA, 64 nt, Human
aguaccacagacucaucuuaaaaaaaacucucauuauggugaucauagaauugaccauccaaac

SEQ ID NO: 283869 - RNA, 64 nt, Human
caugaugucaggaguuugagaccagccuggccaauauggugaaacccugucucuacaaaaaaua

SEQ ID NO: 283870 - RNA, 64 nt, Human
cuauucgaguaucacagagguuuucaaaagcccuuauggugacaucuaccuagguaaaagccug

SEQ ID NO: 283871 - RNA, 64 nt, Human
cuaaugaaagccuccucaccucuucccaacccuuacaagcaagggugcuaggggcucagcuaua

SEQ ID NO: 283872 - RNA, 64 nt, Human
cacugagccaccgcgcccuccugcccacgggaggacaagcaauaacucucuacaggaauauauu

SEQ ID NO: 283873 - RNA, 64 nt, Human
guugaacgguccacuuucuuugaugaguggaaugacaagcaaugucugaugccuuuuugugccc

SEQ ID NO: 283874 - RNA, 64 nt, Human
ggacuucuccaacuuacuauuagacuaaaccagaacaagcaacaaacuguauuuaugcaagcaa

SEQ ID NO: 283875 - RNA, 64 nt, Human
auuguacaacuaacaacaguaacuagcccuuaauuauggugacaguuccuuauuggugugugug

SEQ ID NO: 283876 - RNA, 64 nt, Human
uacaauguagaaaaugaggaaaugccacaaauuguauggugauaaaagucacgugaaacagagu

SEQ ID NO: 283877 - RNA, 64 nt, Human
auuucagcauaucaguuuuauaaagcaguuuagguauggugauuuagcagaacacaagagagca

SEQ ID NO: 283878 - RNA, 64 nt, Human
cacauuauguuuacauaaguagcaaaaauauauuuauggugaucugcauuuucauaauaaagug

SEQ ID NO: 283879 - RNA, 64 nt, Human
uguuuauuuaaauaucauuaaggagaaaaaaaaauauggugagaagcucgcuccuuucaacuug

SEQ ID NO: 283880 - RNA, 64 nt, Human
cacaaggucaggaguucgagaccagccuggccaauauggugaaaccccgucucuacuaaaaaua

SEQ ID NO: 283881 - RNA, 64 nt, Human
gcaggaggaucucuugagcccaggaggucaaggcuauggugagccgugauugugccacugcaua

SEQ ID NO: 283882 - RNA, 64 nt, Human
acuucacccgaguuccucuggguuucuaagcaguuauggugaugacuuagcgucaagacauuug

SEQ ID NO: 283883 - RNA, 64 nt, Human
aaccuccuggacauuuuuucagucauauaaaagcuauggugagaugcagcuggaaaagggucuu

SEQ ID NO: 283884 - RNA, 64 nt, Human
cgggcagaucacgaggucaggaguuucagaccaauauggugaaaccccaucucuacuaaaauua

SEQ ID NO: 283885 - RNA, 64 nt, Human
cuuguauuauuuuuaaagagaucuauacuauaaauauggugauauauuuacaaguaaucuguua

SEQ ID NO: 283886 - RNA, 64 nt, Human
gucaguagcuuuguuugauauuuaacaauaaguauauggugauauacuugaaauuuauguccag

SEQ ID NO: 283887 - RNA, 64 nt, Human
uuuauuuagccugauguauuuuuaauucaauuuuuauggugaugggcaaaucauucuugguaaa

SEQ ID NO: 283888 - RNA, 64 nt, Human
guuuccuuuugagaugaggaaaauguucugaaaauauggugaugguugcacaccauugugaaug

SEQ ID NO: 283889 - RNA, 64 nt, Human; identical to SEQ ID NO: 242581

SEQ ID NO: 283890 - RNA, 64 nt, Human; identical to SEQ ID NO: 242582

SEQ ID NO: 283891 - RNA, 59 nt, Human; identical to SEQ ID NO: 242583

SEQ ID NO: 283892 - RNA, 64 nt, Human; identical to SEQ ID NO: 242584

SEQ ID NO: 283893 - RNA, 64 nt, Human
caucaaugcaguaaguguaguaaaagcuuuaguuuauggugagucauuacucagcaucauggag

SEQ ID NO: 283894 - RNA, 64 nt, Human
aaguagaaugaauugcagaggaaaguuuuaugaauauggugaugaguuaguaaaaguggccauu

SEQ ID NO: 283895 - RNA, 64 nt, Human
gggaaaaguucucagggaauugaaguguuguugcuauggugacguccuuuugcugugaauaaag

SEQ ID NO: 283896 - RNA, 64 nt, Human
uaucagggaaucauacaaaggcaaaaucugucaauauggugaauguggaaaauauauugucuug

SEQ ID NO: 283897 - RNA, 64 nt, Human
agaaaaacuuuguaugguaccacuguguugguuauauggugaaucugaacguacaucucacugg

SEQ ID NO: 283898 - RNA, 64 nt, Human
ugaaccucgauacugcauuuguaaucagguaucuuauggugagauggugggaugugauaaccaa

SEQ ID NO: 283899 - RNA, 64 nt, Human
gaucuugguuuuuccaaacuggaccauccugucuuauggugaaaaaguaaagaagaaagauaac

SEQ ID NO: 283900 - RNA, 64 nt, Human
aguguucccuuuguauaacugaaguauuuucagauauggugaaugcauugacuggaagcuccuu

SEQ ID NO: 283901 - RNA, 64 nt, Human
ugaaauaaaauguguaucugagugagaaaacaaguauggugaggucacuuuaauguuucacagc

SEQ ID NO: 283902 - RNA, 64 nt, Human
cacuccaagcagaugugaaucaagauguuagguuuauggugaguuagcuuugagguguguugcc

SEQ ID NO: 283903 - RNA, 64 nt, Human
uugauuauguaagagcuauuucauuauaacuuauuauggugauuauacaggcaagaagacaaaa

SEQ ID NO: 283904 - RNA, 64 nt, Human
gcuacuugugguugaauuguguucccccaaaauauauggugaagucuuaacccccauccccgug

SEQ ID NO: 283905 - RNA, 64 nt, Human
ugaaugacuagcccaauuauccuuauaaauugaauauggugaccaaaugcuuugauaucauacu

SEQ ID NO: 283906 - RNA, 64 nt, Human
aaaguuuaauguacagaaugguuggagaaaugccuauggugaauuaaagcuucauaucugcuuu

SEQ ID NO: 283907 - RNA, 64 nt, Human; identical to SEQ ID NO: 242587

SEQ ID NO: 283908 - RNA, 64 nt, Human; identical to SEQ ID NO: 242588

SEQ ID NO: 283909 - RNA, 64 nt, Human; identical to SEQ ID NO: 242589

SEQ ID NO: 283910 - RNA, 64 nt, Human
guggauuaccuggucucgagaccagccugaccaauauggugaaaccccgucucuacuaaaaaua

SEQ ID NO: 283911 - RNA, 64 nt, Human
cuccccucuuuaaauaccugucacaccguaugaauauggugagaucagacucccuaagacucuu

SEQ ID NO: 283912 - RNA, 64 nt, Human
guauucugggagaaguggcuggaagaagggguaauauggugaaagcaaauucccuuucccagga

SEQ ID NO: 283913 - RNA, 64 nt, Human
guaacauuggcagagagguacaguauguuaucccuauggugaaaauaaauuaauuuguuguaua

SEQ ID NO: 283914 - RNA, 64 nt, Human
caguucuaaaguuccaaagcacuaaaaacuuaucuauggugauuacaguuugaauaguagguau

SEQ ID NO: 283915 - RNA, 64 nt, Human
acaucuguauaucagcucuaaagcagagauguauuauggugauacuccaagguggcauagccau

SEQ ID NO: 283916 - RNA, 64 nt, Human
uacaaggucaggaguuccagaccagccuggcuaauauggugaaaccucgucucuacuaaaaaua

SEQ ID NO: 283917 - RNA, 64 nt, Human
caauuucagaauaacuaagaguggaauauaugcauauggugaaauuauaaccuugcccuuuuuu

SEQ ID NO: 283918 - RNA, 64 nt, Human
uucucugcauaauuucucaauaucuuuagcacaguauggugaugaugacuuuuaagcauuuaca

SEQ ID NO: 283919 - RNA, 64 nt, Human
gucgaugcguucacuccaaugucugcugaggaguuauggugaacccacaacuuaggcccuagcg

SEQ ID NO: 283920 - RNA, 64 nt, Human
gcaacaacuuuugacuuagaugggggguauguauuauggugagagguuagccuuccuggcacau

SEQ ID NO: 283921 - RNA, 64 nt, Human
caguauagacaacccagaaacaaauucauacaucuauggugaccacuuuugacaaaggaaugaa

SEQ ID NO: 283922 - RNA, 64 nt, Human
aaagacuaaugagcacaaugauauuaaucacuuuuauggugaauaauaaaugcaauaauugccu

SEQ ID NO: 283923 - RNA, 64 nt, Human
cccaauuggaaauaugcugucaguuugugcaccauauggugaccacgccugugcucaguuuggc

SEQ ID NO: 283924 - RNA, 64 nt, Human; identical to SEQ ID NO: 242590

SEQ ID NO: 283925 - RNA, 64 nt, Human; identical to SEQ ID NO: 242591

SEQ ID NO: 283926 - RNA, 64 nt, Human
aucaaaacacugcagcaguuccuaaaugauucucacaagcaacccugagagagacagucuugug

SEQ ID NO: 283927 - RNA, 64 nt, Human
acauuucugcugauauucagcaaauuucuaaguuuauggugaacuuuuaacucaauguguaaau

SEQ ID NO: 283928 - RNA, 64 nt, Human
uuuuaaauuggauucuaugaaaaugcauaaugcuuauggugaauucucaggcuauucugagcuc

SEQ ID NO: 283929 - RNA, 64 nt, Human
ucugccaccacuucauuagcuguauucuccauaguauggugaaauagcaggugcgucuucuagu

SEQ ID NO: 283930 - RNA, 64 nt, Human
uuuguacugaggggaauucuauucaucuaaguaauauggugaaaauauuuaucuggaauuuaug

SEQ ID NO: 283931 - RNA, 64 nt, Human
gcagggagcauaauuauugguuuauuaugguaauuauggugauuuuuuaaauaucauguaaugu

SEQ ID NO: 283932 - RNA, 64 nt, Human
guaaggauuuagagggccuucugcccucugaauauauggugaggagaaugggguaucuggaaaa

SEQ ID NO: 283933 - RNA, 64 nt, Human
aagaccaaggauucagcauuagaacaucuauacauauggugaucuaaauguacaaaauguaaaa

SEQ ID NO: 283934 - RNA, 64 nt, Human
uucugcaagaccuuuggcucacagaacugcaggguauggugagaaaccaacuacggauugcugc

SEQ ID NO: 283935 - RNA, 64 nt, Human
ggaggcagcuccccugccuccaggacccuguugcuauggugacacagcguuucuaggacagagg

SEQ ID NO: 283936 - RNA, 64 nt, Human
caugaggucaagaguucgagaccagccuggccaauauggugaaaccccgucucuauugggagua

SEQ ID NO: 283937 - RNA, 64 nt, Human
ugguggcagcaauagagcaaagguuaccuuuuuguauggugaagggaggccuuccuauggcugu

SEQ ID NO: 283938 - RNA, 64 nt, Human
ucaaaaggauagccaaggguggaguggaaaaagauauggugaaggcagaacugcucacaccagc

SEQ ID NO: 283939 - RNA, 64 nt, Human
cacaaugucaggaguuugagacuagccuggccaauauggugaaacccugucucuacuaaaaaua

SEQ ID NO: 283940 - RNA, 64 nt, Human
gacggaggcgggugcgcggaggcggcaguguugauauggugaaaccgggucgcauuugcuuccg

SEQ ID NO: 283941 - RNA, 64 nt, Human; identical to SEQ ID NO: 242593

SEQ ID NO: 283942 - RNA, 64 nt, Human; identical to SEQ ID NO: 242594

SEQ ID NO: 283943 - RNA, 64 nt, Human; identical to SEQ ID NO: 242595

SEQ ID NO: 283944 - RNA, 64 nt, Human
cguuggugggaggacagagcaagugggaaggggguauggugagugcggcaaucccucauccucu

SEQ ID NO: 283945 - RNA, 64 nt, Human
uuaacaagaggacauggcauuauuuuaauuugauuauggugaguugaauuuaagacaugaccau

SEQ ID NO: 283946 - RNA, 64 nt, Human
gauaaugcuuagaauucuuuauugguggcccuacuauggugaugaucuagaacugacuuacuuc

SEQ ID NO: 283947 - RNA, 64 nt, Human
auacucaguuggcucucuuuaucucccuugccuuuauggugaaacaggggagaugugcaccuuu

SEQ ID NO: 283948 - RNA, 64 nt, Human
gauccugaguccagaaugguacacaaugugauuuuauggugaugucacucaccuagacaaccag

SEQ ID NO: 283949 - RNA, 64 nt, Human
aaaaaaauaaagauagguauaggauaauuuuuaauauggugaccuuacagaaaauauuucccaa

SEQ ID NO: 283950 - RNA, 64 nt, Human
auuagcgauaauaauaguacuuaccugguaggauuauggugaguauuaaaugaguaaauggaaa

SEQ ID NO: 283951 - RNA, 64 nt, Human
ucacauagugaaaguuuauaagaggaugaagugauauggugagcagcggacuucaaaaacuguc

SEQ ID NO: 283952 - RNA, 64 nt, Human
ggcuuuaagagcacauuuaucguacgucacaguguauggugaauauauuauuaaauaauguggu

SEQ ID NO: 283953 - RNA, 64 nt, Human
cuuuuauuuaugaaccuuugaaaggaucgucuuguauggugaauuuucuaggagcgaugaugua

SEQ ID NO: 283954 - RNA, 64 nt, Human
auugaaaguguuugcucaugaaaucaguuauaaauauggugaauuuuuucuggaccauaggaau

SEQ ID NO: 283955 - RNA, 64 nt, Human
cacaaggucaggaguucgagaccagccuggccaauauggugaaaccccaucucuacuaaaaaua

SEQ ID NO: 283956 - RNA, 64 nt, Human
ugauaaaguuauguuuuuggauacaauauauuuguauggugagagugaugaauuguuggaucau

SEQ ID NO: 283957 - RNA, 64 nt, Human
ugugcaucuacugcagugaaggcacuuguagcauuauggugacagcugccucgggaagccaagu

SEQ ID NO: 283958 - RNA, 64 nt, Human; identical to SEQ ID NO: 242599

SEQ ID NO: 283959 - RNA, 64 nt, Human; identical to SEQ ID NO: 242600

SEQ ID NO: 283960 - RNA, 54 nt, Human; identical to SEQ ID NO: 242601

SEQ ID NO: 283961 - RNA, 64 nt, Human; identical to SEQ ID NO: 242602

SEQ ID NO: 283962 - RNA, 64 nt, Human
uuaaagccuucuggauccauggggggagaagugauauggugaagggaaguggggaguauuugaa

SEQ ID NO: 283963 - RNA, 64 nt, Human
uacucccuuggcuguaugucugacagucuuuagcuauggugacuauuguuuauuuuuaaugggu

SEQ ID NO: 283964 - RNA, 64 nt, Human
acaaccucaaaugugaaugccuugauuuuauuuuuauggugacuuuagcuacagcauuuccuau

SEQ ID NO: 283965 - RNA, 64 nt, Human
uguuuuccauuuuagggugguugaguuugccucuuauggugacuuaaagaaugcuauugaaaaa

SEQ ID NO: 283966 - RNA, 64 nt, Human
ggcuucuuucugcuggcugauggguggaccuguguauggugaccucuccggccuggccuuuucc

SEQ ID NO: 283967 - RNA, 64 nt, Human
uuuuaguugaguauguuuaugauuuuugaagccauauggugaguaaauguaaauaugaaaaaag

SEQ ID NO: 283968 - RNA, 64 nt, Human
guagggaagggaauaucggauucaugcaucaguuuauggugaauccaaaucaaugucuugaauc

SEQ ID NO: 283969 - RNA, 64 nt, Human
aaaacaagccaguuagcaaacaguccuggaaaaauauggugagaaugguuuaauuccggucuuc

SEQ ID NO: 283970 - RNA, 64 nt, Human
cuugaggucagaaguucaagaccagccugaccaauauggugaaaccccgucucuacuaaaaaua

SEQ ID NO: 283971 - RNA, 64 nt, Human
uuacuauuugggcucugaaauaaaaauuaugaaauauggugaggucacauguuggugcugccuu

SEQ ID NO: 283972 - RNA, 64 nt, Human
ucuugucuauucugcauaucuuucccccuaggauuauggugauuaucuguguuaaaaaauaagu

SEQ ID NO: 283973 - RNA, 64 nt, Human
uuaaaauacaaagacgauuuuuucaggcugugauuauggugaacauaacaaaacccaguaguca

SEQ ID NO: 283974 - RNA, 64 nt, Human
augaguauuuguugcauuuguucaauuuguuguauauggugaauauuuaauuaugguuuucuug

SEQ ID NO: 283975 - RNA, 64 nt, Human
gauaguaauuauauuuaauguauaacuauagcauuauggugaguggaauuugacauuguccaaa

SEQ ID NO: 283976 - RNA, 64 nt, Human
ucuuuucuuuucuugccuuuuuuuuuuuuugaaauuugccgagcaguggagcccucugacaauu

SEQ ID NO: 283977 - RNA, 64 nt, Human
gaccugaugcccugagagcccacugcaguuggacuuugccgaugcugcaagaaggggugcagag

SEQ ID NO: 283978 - RNA, 64 nt, Human
guuuuuuccgacuguaagagauauuugauguccuuuugccgagguggauguguuagucucaggc

SEQ ID NO: 283979 - RNA, 64 nt, Human
aaagcuuacacagcuucuuagcaauuuuuuuuuuuuugccgaaacaauaaauugccuuuagcag

SEQ ID NO: 283980 - RNA, 64 nt, Human
ucuauugucuuuuuucagauacaacauuuuugucuauggugaacugcuguaaaugacgcagaga

SEQ ID NO: 283981 - RNA, 64 nt, Human
auacagaggagaagggaaaggcagagggugugauuauggugacaauagcugccuuccccuaucg

SEQ ID NO: 283982 - RNA, 64 nt, Human
ccugaggucagaaguucgagaccagccuuaccaauauggugaagccccaucucuacuaaaaaua

SEQ ID NO: 283983 - RNA, 64 nt, Human
gcuauuuuuggagccagaauuuucaugucugauuuauggugauuuucuuaagaaccagaacugc

SEQ ID NO: 283984 - RNA, 64 nt, Human
caggacgaaggcagcguuaggagaauaguugugguauggugacuucuguguuuaucugcagggg

SEQ ID NO: 283985 - RNA, 64 nt, Human
ggaugaagucaaucuucuugcaggaacauguuacuauggugauuucuacgcaacacuaauuaaa

SEQ ID NO: 283986 - RNA, 64 nt, Human
cacaagcagugacaccucggguccuuuccguugcuauggugaaaauuccuggauggaauggauc

SEQ ID NO: 283987 - RNA, 64 nt, Human
acuguuccuucuauggggcucuugcucuagugucuauggugagaacacaggccccgccccuucc

SEQ ID NO: 283988 - RNA, 64 nt, Human
uaaggcaaaucccuggccacuuuagucuccccacuauggugaggacgaggguggggcauugaga

SEQ ID NO: 283989 - RNA, 64 nt, Human
ccuggggucaggaguucgagaccagccugaccaauauggugaaaccccaucucuacuaaaaaua

SEQ ID NO: 283990 - RNA, 64 nt, Human
augaagucaagaguucgagaccagcaauggccaguauggugaaacccugucucuccuaaaaaua

SEQ ID NO: 283991 - RNA, 64 nt, Human
acuacgaagaccuugauuuaccguuaaccuauuguauggugauguuuuuauucucucaggcagu

SEQ ID NO: 283992 - RNA, 64 nt, Human
ggacuaagccaaugacaccuuccaucuuuccagcuauggugacuggguuagguaugaucuugug

SEQ ID NO: 283993 - RNA, 64 nt, Human
gaccagaauuaccuuccucauggcaaagggggauuauggugaauuguuguucuuauagucuguu

SEQ ID NO: 283994 - RNA, 64 nt, Human; identical to SEQ ID NO: 242596

SEQ ID NO: 283995 - RNA, 64 nt, Human; identical to SEQ ID NO: 242597

SEQ ID NO: 283996 - RNA, 64 nt, Human
gacacugaaauaauuuuacucaacuauguuuucaacaagcaaaaauauaguauucuaagauuaa

SEQ ID NO: 283997 - RNA, 64 nt, Human
uuugugaugucugaaaaaacagaacccgaaaagcuauggugauauguacaggcauuauuucaga

SEQ ID NO: 283998 - RNA, 64 nt, Human
gucggcaagcaucugacuugcccaauccccuggauauggugagccccgccaugcuuuuauucug

SEQ ID NO: 283999 - RNA, 64 nt, Human
aguuuuuuuuccccugaaaagcuguguauaaaauuauggugaauaaacuuuuauguuuccauuu

SEQ ID NO: 284000 - RNA, 64 nt, Human
cucacaauaaguuaacuugcgcaaacuuuuuacauauggugaggugcguaaggaagcccuggcc

SEQ ID NO: 284001 - RNA, 64 nt, Human
cuuacauauagcagugacacuuguugccuaacuuuauggugaccuccuauuuuguaagggcugu

SEQ ID NO: 284002 - RNA, 64 nt, Human
caugagagaaucagagggaaugcaggacguggucuauggugagccaacgacacagugagaagga

SEQ ID NO: 284003 - RNA, 64 nt, Human
acccauauaacaccccaccccuguucgcuuccuguauggugauaucauauguaacauuuacucc

SEQ ID NO: 284004 - RNA, 64 nt, Human
gcauguuggggaccaggagguaaaacuggccauuuauggugaaccugugucuuggagcugacuu

SEQ ID NO: 284005 - RNA, 64 nt, Human
aaggacauuggagagauagagucacuauuacugauauggugacugagucaacaacauacugcca

SEQ ID NO: 284006 - RNA, 64 nt, Human
guugugagacccgaggggcggcggcgcgguuuuuuauggugacacaaauguauauuuugcuaac

SEQ ID NO: 284007 - RNA, 64 nt, Human
gaucacgaggucaggagaucaagaccauccuggcuauggugaaaccccgucucuacuaaaaaaa

SEQ ID NO: 284008 - RNA, 64 nt, Human
caugaggucaggaguuugagaccagccuggccaauauggugaaaccacgucucuauuaaaaaua

SEQ ID NO: 284009 - RNA, 64 nt, Human
ggcgaaaccaugucucuacuaaaaauacaaaaauuauggugacgccugccuguagucccagcua

SEQ ID NO: 284010 - RNA, 64 nt, Human
ccuaaggucaggaguucgagaccagccuggccaauauggugaaaccccaucucuacuaaaaaua

SEQ ID NO: 284011 - RNA, 64 nt, Human; identical to SEQ ID NO: 242578

SEQ ID NO: 284012 - RNA, 64 nt, Human; identical to SEQ ID NO: 242579

SEQ ID NO: 284013 - RNA, 64 nt, Human; identical to SEQ ID NO: 242585

SEQ ID NO: 284014 - RNA, 64 nt, Human
cacaaggucaagaguucgugaccagccuggccaauauggugaaaccccaugucuacuaaaaaua

SEQ ID NO: 284015 - RNA, 64 nt, Human
cacgaggucaggagauugagaccauccuggcuaauauggugaaacccugucucuacuaaaaaua

SEQ ID NO: 284016 - RNA, 64 nt, Human
cacaaggucaggagaucgagaccauccuggccaauauggugaaacccgucucuacuaaaaauac

SEQ ID NO: 284017 - RNA, 64 nt, Human
cacgaggucaguaguucgagaccagccuggucaauauggugaaaccccaucucuacuaaaaaau

SEQ ID NO: 284018 - RNA, 64 nt, Human
auggagguugugggccgaggcgcuuauuuucccuuauggugaccugaguccuggagacucccau

SEQ ID NO: 284019 - RNA, 64 nt, Human
gagaaauguaccuugcagcugaauggcuaggucauauggugaucuaguauguaacuggaauuau

SEQ ID NO: 284020 - RNA, 64 nt, Human
uacaaggucaggaguucaagaccacccuggacaauauggugaaacccugucucuacuaaaaaua

SEQ ID NO: 284021 - RNA, 64 nt, Human
accagauuucaguggggcaugacgugaauguguauauggugauucaaaugcaaaauuuguuuau

SEQ ID NO: 284022 - RNA, 64 nt, Human
ucugagaauugaaaacugcagauaaccggccggguauggugacucaugccuguaauccuagcac

SEQ ID NO: 284023 - RNA, 64 nt, Human
auucccugaccagugagaggguuccugggggaaguauggugaauaaacugacaugcaugcuuca

SEQ ID NO: 284024 - RNA, 64 nt, Human
uggugggaacauucgaggugucacccugcagagcuauggugagguguggauaaggcuuaggugc

SEQ ID NO: 284025 - RNA, 64 nt, Human
cuugaggucaggaguucaagaccagccuggccaauauggugaaacccagucucuacuaaaaaua

SEQ ID NO: 284026 - RNA, 64 nt, Human
agccaguucauuuaagaggaaauggacuggcauuuauggugaaagcuggcuguuaaaauuauuu

SEQ ID NO: 284027 - RNA, 64 nt, Human
uuugcugaggagcugggcccggggcccgccugccuauggugaaacccacggggugucaugcccc

SEQ ID NO: 284028 - RNA, 64 nt, Human; identical to SEQ ID NO: 242574

SEQ ID NO: 284029 - RNA, 64 nt, Human; identical to SEQ ID NO: 242575

SEQ ID NO: 284030 - RNA, 64 nt, Human
gcuggaaaagaagauccaguugcuagaagcuaaauuugccgaguuagaagguggagaugaugau

SEQ ID NO: 284031 - RNA, 64 nt, Human
cauguaguuuauagaaaguauacucuaaagggaauuugccgaagaccuuuuacugauugaacag

SEQ ID NO: 284032 - RNA, 64 nt, Human
ugugcuccuggcuucuuacgccguccaggccaaguauggugacuacgaccccaguguucacaag

SEQ ID NO: 284033 - RNA, 64 nt, Human
gauggguguguuuauuugcucagggcgggcagccuauggugaagaggagacagaggcgaugggc

SEQ ID NO: 284034 - RNA, 64 nt, Human
ccacuagaaauagcuuguccugucaacuaugaaauauggugacuagauuuuaauucauaaccgu

SEQ ID NO: 284035 - RNA, 64 nt, Human
caguauggggcccccucccucuccucuccucuccuauggugagcccagcgugggcaccgggccg

SEQ ID NO: 284036 - RNA, 63 nt, Human
ucacaucaggauccgauugagagcucugacuccuauggugaccucucagaugccagcgaccug

SEQ ID NO: 284037 - RNA, 64 nt, Human
accuucuccccaagccagcguggacccuggugucuauggugaagcugggcccucccacccugag

SEQ ID NO: 284038 - RNA, 64 nt, Human
aguuaauacuuuaaaaauuuucagguuuuuuuaguauggugaauauugauagauauaaaccuca

SEQ ID NO: 284039 - RNA, 64 nt, Human
aggcucaacuagggagugagugcaaaaagcugaguauggugagagaagccugugcccugaucca

SEQ ID NO: 284040 - RNA, 64 nt, Human
cugccauggcgggaggaggggcaguaguuauugauauggugagccccaucucucaguuuucaug

SEQ ID NO: 284041 - RNA, 64 nt, Human
auucaaaaugaauacaaaauuaaaauuugaacauuauggugauuauggugaggagaaugggaua

SEQ ID NO: 284042 - RNA, 64 nt, Human
gaauacaaaauuaaaauuugaacauuauggugauuauggugaggagaaugggauauuaacauaa

SEQ ID NO: 284043 - RNA, 64 nt, Human
uugauacaagaacuugguuguaccucagggguauuauggugaacaaaaaaaaaaccagucucaa

SEQ ID NO: 284044 - RNA, 64 nt, Human
acaugcuuucuucacaguaacucaguucaaguacuauggugauuugccuacagugauguuugga

SEQ ID NO: 284045 - RNA, 64 nt, Human
aagacaguaauaaugcagacacaaacugguuucauauggugagagcagccacagcagcagcuug

SEQ ID NO: 284046 - RNA, 64 nt, Human; identical to SEQ ID NO: 242563

SEQ ID NO: 284047 - RNA, 64 nt, Human; identical to SEQ ID NO: 242564

SEQ ID NO: 284048 - RNA, 64 nt, Human
gcuucacggaggauguuggggagagaggauuugauuugccgagugguuuggagaucuuuagggg

SEQ ID NO: 284049 - RNA, 64 nt, Human
aguauuuuuuauguagccauaauuuuuuuuuuuuuuugccgaaaucugaauaaacuacauauau

SEQ ID NO: 284050 - RNA, 64 nt, Human
ucaaagugaacucuuguucuuaaauuuugaauuuuauggugagauuguaaagauagaggcaauu

SEQ ID NO: 284051 - RNA, 64 nt, Human
acagcgugaccucagggguuguccacuuuaccuuuauggugaggccugucggauggcuaagucc

SEQ ID NO: 284052 - RNA, 64 nt, Human
uaggaaagaugguguuuauuccaguuugcauuuuuauggugaaauaaaauccuuuuccaaugaa

SEQ ID NO: 284053 - RNA, 64 nt, Human
ggaagccggugccuggguggccauccuacccagcguggcccaggccgggaagagccaccuggca

SEQ ID NO: 284054 - RNA, 64 nt, Human
aagaacaacaggauagagcuguugggguggcacaguggcccaaagagcagcuucagagauaauu

SEQ ID NO: 284055 - RNA, 64 nt, Human
cagggucuugcuccguugcccagguuggagugcaguggcccaucagggcucacuguaaccuccg

SEQ ID NO: 284056 - RNA, 64 nt, Human
accuucccccuugaagagaggggaaaggccuacaguggcccacauaauugccugacucacacuu

SEQ ID NO: 284057 - RNA, 64 nt, Human
uagaagaacacacaugcgggcaccuucaucguguguggcccacugucagaacuuaauaaaaguc

SEQ ID NO: 284058 - RNA, 64 nt, Human
acacacgcaggacucuggagccagaguagaggcuguggcccaggcacuaccugcuggcucccac

SEQ ID NO: 284059 - RNA, 64 nt, Human
augccagcagccugccuauggcuccagcugugcuguggcccagcagcauggccugcaucuggaa

SEQ ID NO: 284060 - RNA, 64 nt, Human
cccucuuuguguuguaguccaugcuauuaaaaguguggcccacagaccaagagccucaacauuu

SEQ ID NO: 284061 - RNA, 64 nt, Human
gaggaagagaaaaaauauuuuccugccaggcaugguggcccacgcacuucgggaggucgaggca

SEQ ID NO: 284062 - RNA, 64 nt, Human
aauuguagaguuggguagucgcaacagaaucucuguggcccacaaggcuaaaauauuuacauuc

SEQ ID NO: 284063 - RNA, 64 nt, Human
cauggguggaaagugcucagugaaguacaccuguguggcccaguucugaaagcuuuauacaguu

SEQ ID NO: 284064 - RNA, 64 nt, Human
aggucuuccugcacugcccaccccuggcuggucuguggcccaaggaaggccacuccacauuaag

SEQ ID NO: 284065 - RNA, 64 nt, Human
accgccugccuagcccugcgccggcaaccaccuaguggcccagggaaggccgauaauuuaaaca

SEQ ID NO: 284066 - RNA, 61 nt, Human
cgauucccagacuggcuugaccacuggaugcuuugccgaaagcagcuuggcuugguagcuc

SEQ ID NO: 284067 - RNA, 64 nt, Human
auucaaaugcaugauauuguauguaccugggaaauuugccgauuuccuaagcuguuggaagggg

SEQ ID NO: 284068 - RNA, 64 nt, Human
auugaggcccaguaagacacucauguggcuaguguuugccgaaugaaacucaacucaauaaaaa

SEQ ID NO: 284069 - RNA, 64 nt, Human
cugucaacugacaaagagaagagaagacaagucuguggcccagacaggaugccaagucuggggg

SEQ ID NO: 284070 - RNA, 64 nt, Human
uucaauuauacgaauauguucuuuggguucugcuguggcccagacaguguuaacuuuuuuuuua

SEQ ID NO: 284071 - RNA, 64 nt, Human
gggaccaccaucuugcugauggaaggaacaacagguggcccaggacaugcuccugcauacuccu

SEQ ID NO: 284072 - RNA, 64 nt, Human
uucccuuugcugagcaagcaugugguugcauuggguggcccaggaugacaaugcacagcacaga

SEQ ID NO: 284073 - RNA, 64 nt, Human
aaagaaaacgacuuuccuucauuucccuaagccuguggcccaaaugguggaccagaaugauggu

SEQ ID NO: 284074 - RNA, 64 nt, Human
ggguaggggcagcuggcauggucagguaacacuaguggcccagccccgcagacccacaagcccu

SEQ ID NO: 284075 - RNA, 64 nt, Human
gacgggcgccgucgcucggguggcggaggcugcgguggcccagcgagacggccgccucgagaga

SEQ ID NO: 284076 - RNA, 60 nt, Human
uggcugcuaacgaugggugacgcuggugaaguggcccagggaagugcacaugucucuccc

SEQ ID NO: 284077 - RNA, 64 nt, Human
cuucccuccgcaucccgucagcuggaaaaggccuguggcccagaggcuucuccaaagggagggu

SEQ ID NO: 284078 - RNA, 63 nt, Human
uacuggccucagaccacuagccccuuacccagaguggcccacaggaaacagccugcaccauuu

SEQ ID NO: 284079 - RNA, 64 nt, Human
ucccacugcccaagcauuggcauggucaugaaugguggcccagccaacaggaagcccagccuuu

SEQ ID NO: 284080 - RNA, 64 nt, Human
gcuggggaagugaacuacccagggcagccccuuuguggcccaggauaaucaacacuguucucuc

SEQ ID NO: 284081 - RNA, 64 nt, Human
ugcagacgugagaugaacacuggagugggcagagguggcccaggaccauggcacccuuagagug

SEQ ID NO: 284082 - RNA, 64 nt, Human
uucaagggaugagcuaugaaggcucccugggaguguggcccacaucaguucaacauccucuggu

SEQ ID NO: 284083 - RNA, 64 nt, Human
gaggaacccagccccugaccccugccacccuccgguggcccaggugccuaccucccucaagccu

SEQ ID NO: 284084 - RNA, 64 nt, Human
agagccaaucauguuaacucuuccuuaucagccuguggcccagagacacaaugggguccuucug

SEQ ID NO: 284085 - RNA, 64 nt, Human; identical to SEQ ID NO: 242568

SEQ ID NO: 284086 - RNA, 64 nt, Human; identical to SEQ ID NO: 242569

SEQ ID NO: 284087 - RNA, 64 nt, Human
uaccagccgcccgcccugggcuguggacccugcguuugccgagcgcuaugccccggacaaaacg

SEQ ID NO: 284088 - RNA, 64 nt, Human
cagcacacaugggaggccuguggcccuguguccaguggcccacaggacacgccuccaccauaug

SEQ ID NO: 284089 - RNA, 64 nt, Human
acuugccuacccucaaugccacacuguuuuugaaguggcccauaacuugaaggaaaaguuuaaa

SEQ ID NO: 284090 - RNA, 64 nt, Human
cugagcuaagaauagacugugggucuccucacuuguggcccagugcucuuucugcuauacaaaa

SEQ ID NO: 284091 - RNA, 64 nt, Human
aggcuggcaagggaggagggccggccagcauuugguggcccaucagucuggccaucugucacgu

SEQ ID NO: 284092 - RNA, 64 nt, Human
ucggggagaaaccugguaacauaaaagcaguucaguggcccagagguuauuuuuuuccuauugc

SEQ ID NO: 284093 - RNA, 64 nt, Human
gugcaaaaauguacuagccaauacgcuuaaguguguggcccaugaauugaacaauuuaaccuug

SEQ ID NO: 284094 - RNA, 64 nt, Human
ugcuagaccuugaagaguagaaaauuaagagaugguggcccaauugagaggggaaaaugcaguu

SEQ ID NO: 284095 - RNA, 64 nt, Human
ugucucauaaauuggcacugauggagcaucagcuguggcccacagagagccuugcugagaaggg

SEQ ID NO: 284096 - RNA, 64 nt, Human
aguguaggugguaucauucucuuucucacucaguguggcccagaguugcucagaauuggagcag

SEQ ID NO: 284097 - RNA, 64 nt, Human
gauguauuugagaaaauacauuugauuugauuuuguggcccauuccuaaaggucauuguaucca

SEQ ID NO: 284098 - RNA, 64 nt, Human
uguggggugggguauggggaggagaaccuucaugguggcccaccuggccugguuguccaagcug

SEQ ID NO: 284099 - RNA, 64 nt, Human
gcuuuguguuuucaggaaagggccuagcuucuguguggcccacagaguucacugccugugagac

SEQ ID NO: 284100 - RNA, 64 nt, Human
gaggagggggccucucauggcccuucccuggccuguggcccagccuggcuggccugcagguguc

SEQ ID NO: 284101 - RNA, 64 nt, Human
gcuggacuguggaccccgaugggccagaguccuuguggcccacagcauagcacuggggacagag

SEQ ID NO: 284102 - RNA, 64 nt, Human
agcaaggugcuugcagucaccugaggccguccguguggcccagggccccagcugccuuuagggc

SEQ ID NO: 284103 - RNA, 64 nt, Human
ucacuguuuuucacuuuucacuucuggcuuuuuuguggcccaaggccaauauaggauuaauauc

SEQ ID NO: 284104 - RNA, 64 nt, Human; identical to SEQ ID NO: 242603

SEQ ID NO: 284105 - RNA, 64 nt, Human
aucggaggcggcgccccguucuagggccguggccuuugccgagacuguagcagagaaaacguau

SEQ ID NO: 284106 - RNA, 64 nt, Human
ccuuucugaagcugcuuccucuuauaaaauagcuuuugccgaaacauaguuuuuuuuuagcaga

SEQ ID NO: 284107 - RNA, 64 nt, Human
auggucuuuauuuaggacaacaauuaacaaugcaguggcccauucuugucacucuacacauaug

SEQ ID NO: 284108 - RNA, 64 nt, Human
ggugccucugccuuaucccugguggagauggaauguggcccauugccuccucccucuccuguca

SEQ ID NO: 284109 - RNA, 64 nt, Human
aggaugaacuagccaugacuaggguccucaggcaguggcccagggaaucagggagcacuggagg

SEQ ID NO: 284110 - RNA, 64 nt, Human
ucauggggaagcgccugggcacuggggauugcuuguggcccacucaacucuuggggcaguggcc

SEQ ID NO: 284111 - RNA, 64 nt, Human
cugugguucaggaaaacuacugauacuuucagggguggcccaaugagggaauccauugaacugg

SEQ ID NO: 284112 - RNA, 64 nt, Human
cccacagguauagacaaggcugagcaggguuccuguggcccaggauggaggccaccgcugcccu

SEQ ID NO: 284113 - RNA, 64 nt, Human
agaaccuguggccucaaccagccaccaagcugauguggcccaaguccaucucuuggucuucucc

SEQ ID NO: 284114 - RNA, 64 nt, Human
cuucauauguccccugucuuccuccaucugagaaguggcccaugugcuucaaggcccaggaggg

SEQ ID NO: 284115 - RNA, 64 nt, Human
uuggcuagacggaccagcuggaaagaucaugaugguggcccagccuugggaugucaugugggac

SEQ ID NO: 284116 - RNA, 64 nt, Human
cauggacauccccacuuccagcccauguacacuaguggcccacgaccaaggggucuucauuucc

SEQ ID NO: 284117 - RNA, 64 nt, Human
augcauuuucuagaauagagcugggacuucccauguggcccacaucugaccuggcagcccaugu

SEQ ID NO: 284118 - RNA, 64 nt, Human
gacucuuggacuuuuggaugccuggccuuaggcuguggcccagaagcuggaaguuugggaaagg

SEQ ID NO: 284119 - RNA, 63 nt, Human
gugugcuuccauccugcauuaaaauucacucaguguggcccagaggcugucuauugaucugca

SEQ ID NO: 284120 - RNA, 64 nt, Human
uuaucucagggcuuucugggcacugcacuucagcguggcccaccugcccaugcccugaggccag

SEQ ID NO: 284121 - RNA, 64 nt, Human
ucaucaccaucuccaucauucagcuggucaucugguggcccaaaggucacccaaagagucagca

SEQ ID NO: 284122 - RNA, 64 nt, Human
ggcagcuccuguggaaguuuccaguucccaguauguggcccagagugaugguguaguacaccaa

SEQ ID NO: 284123 - RNA, 53 nt, Human; identical to SEQ ID NO: 214071

SEQ ID NO: 284124 - RNA, 64 nt, Human; identical to SEQ ID NO: 214141

SEQ ID NO: 284125 - RNA, 64 nt, Human; identical to SEQ ID NO: 214142

SEQ ID NO: 284126 - RNA, 64 nt, Human
gugaaaggaaagugcuugcugugauguuccuacuguggcccagcugcccagcauggaccuggug

SEQ ID NO: 284127 - RNA, 64 nt, Human
gagaucguuagcagcaucaguccacaaacacuuaguggcccacaauauauagagagauagaaaa

SEQ ID NO: 284128 - RNA, 64 nt, Human
uacaggccucagccuugcccucaaugcacgaaagguggcccaggagagaggaucaaugccauag

SEQ ID NO: 284129 - RNA, 64 nt, Human
gcugcucagcugggucuccuguccuagagggaagguggcccagagucuuugguggagcggaauc

SEQ ID NO: 284130 - RNA, 64 nt, Human
auuuuuuguuuuuguuuuuggacagucuagcucuguggcccaggcuggcgugcagugggccguc

SEQ ID NO: 284131 - RNA, 64 nt, Human
ucgagugccugcaguggcugaagagccagccucgguggcccagcuggggcuggaaccaggucuc

SEQ ID NO: 284132 - RNA, 64 nt, Human
ugugcaagucagugagacgaaguauagagaacagguggcccagauccaggggacccaacuucug

SEQ ID NO: 284133 - RNA, 64 nt, Human
cgcgggagccucagguucucucaggggcagcaaaguggcccaagcugccccugacagcacaggg

SEQ ID NO: 284134 - RNA, 64 nt, Human
ucucugaggacacuuagaauaugaggaagaggguguggcccaacccucacuucaccuggggagg

SEQ ID NO: 284135 - RNA, 64 nt, Human
uagaaaauauuuuguuuauaauuggccuggugugguggcccacgccuguaaucccagcacuuug

SEQ ID NO: 284136 - RNA, 64 nt, Human
gaagccauaggucaggcagacaucagcucagccuguggcccauugggugauuuccuguauuuua

SEQ ID NO: 284137 - RNA, 64 nt, Human
cugccgauggauugguuucugugugguauaaauuguggcccauuuaugaaguccccaaaagagu

SEQ ID NO: 284138 - RNA, 64 nt, Human
gaaaugagccagaagccaaggcccugaguuggcaguggcccauaaguguaaaauaaaaguuuac

SEQ ID NO: 284139 - RNA, 64 nt, Human
acuuaaaaguuuaggguuuucucuugguuguagaguggcccagaauugcauucugaaugaauaa

SEQ ID NO: 284140 - RNA, 64 nt, Human
gaaguuaaaaggauuugcuccuuguaugauguaaguggcccaccccaauuuuguaacaugaugc

SEQ ID NO: 284141 - RNA, 64 nt, Human
gucaguuugugucugucucggggaaugugugucuguggcccaagcaggugacaggaagagaugg

SEQ ID NO: 284142 - RNA, 64 nt, Human; identical to SEQ ID NO: 214145

SEQ ID NO: 284143 - RNA, 64 nt, Human; identical to SEQ ID NO: 214146

SEQ ID NO: 284144 - RNA, 64 nt, Human; identical to SEQ ID NO: 214147

SEQ ID NO: 284145 - RNA, 64 nt, Human
cacccggcuucuccgcaggcuuuccucuuccccaguggcccacuaaugguaucacuccgagucu

SEQ ID NO: 284146 - RNA, 64 nt, Human
cuuaagagagugguguuugauuaacaaaaaaacuguggcccaaguggaacccuugaccuuuucu

SEQ ID NO: 284147 - RNA, 64 nt, Human
uugucauaacaugcaaauugcuucaauuuucucuguggcccaaacuugugggucacaaacccug

SEQ ID NO: 284148 - RNA, 64 nt, Human
gggccaggucaaucccaggcagucugaccccagaguggcccagcucauccccuacucuguuauu

SEQ ID NO: 284149 - RNA, 64 nt, Human
uuuuuguuuguuuuuugagauggagucucacucuguggcccaggcuggagugcaguggcgcaau

SEQ ID NO: 284150 - RNA, 64 nt, Human
auuguuggugacagggcaaccaugggacuaggagguggcccauacacauggcuggcugguccug

SEQ ID NO: 284151 - RNA, 64 nt, Human
aaaguagggugugacuugaaaguaucgugaccauguggcccaccagcagccuuuccaaagggga

SEQ ID NO: 284152 - RNA, 64 nt, Human
ugaugcagaccuggcuguggagagcagcuaauguguggcccagagagccugucuguguggagca

SEQ ID NO: 284153 - RNA, 64 nt, Human
uaggcagggcccagcccugcuuccuggaguggauguggcccagagaaggaggcugggggaucac

SEQ ID NO: 284154 - RNA, 64 nt, Human
cuaaugauucaaucucccuuacccugaccaaucaguggcccaaauuuuccagccccuugccucc

SEQ ID NO: 284155 - RNA, 64 nt, Human
auaccuuuucaaaacagauuuuguuuuccuaccuguggcccauccacuccucucugguacccca

SEQ ID NO: 284156 - RNA, 64 nt, Human
agcaaaggaucuggaccaguuucccugcugugcuguggcccaggccagagccugugggcaggca

SEQ ID NO: 284157 - RNA, 64 nt, Human
uccuugcuguggagauccauuccccaccuuuccuguggcccaaccuuuuauuuaaaugugcuac

SEQ ID NO: 284158 - RNA, 64 nt, Human
cuuguggguggggcccagggaggauggggagggaguggcccaggccugccccuucgcuccugcc

SEQ ID NO: 284159 - RNA, 64 nt, Human
ggagcccgcagaagccguccacagcccugccucaguggcccagugggcagaggccagggagugc

SEQ ID NO: 284160 - RNA, 64 nt, Human
aaucucagccuccuucaacauuuucuucucguguguggcccacaucccuccacuucuccaacuu

SEQ ID NO: 284161 - RNA, 64 nt, Human; identical to SEQ ID NO: 214138

SEQ ID NO: 284162 - RNA, 64 nt, Human; identical to SEQ ID NO: 214139

SEQ ID NO: 284163 - RNA, 64 nt, Human; identical to SEQ ID NO: 214143

SEQ ID NO: 284164 - RNA, 64 nt, Human
uggagcgagucaguccuggggcuugcugacauggguggcccauuggaaaggagaaccaggucag

SEQ ID NO: 284165 - RNA, 64 nt, Human
acugggaagaacacugcccccucccucggguuggguggcccagccagcuggccagccuccacuc

SEQ ID NO: 284166 - RNA, 64 nt, Human
gguuuggaucugucuagaacagcgguuuguggcuguggcccagcuccgagagugauauuugcuc

SEQ ID NO: 284167 - RNA, 64 nt, Human
uagaugcguuaaaaugacaugagcaggcgacucaguggcccaaaacaggacccagaacauucau

SEQ ID NO: 284168 - RNA, 64 nt, Human
gacucagcuuggcugggaagugcuccucaccuguguggcccagauggcuccaacaagcaaaagg

SEQ ID NO: 284169 - RNA, 64 nt, Human
uguuggcuucucucccgagcuugugccugauucuguggcccaaaacaaucauuguuaacaucuu

SEQ ID NO: 284170 - RNA, 64 nt, Human
cucaccagcaggugugcaguaggcaagcuugaagguggcccaugcuucucuguugucacacaac

SEQ ID NO: 284171 - RNA, 64 nt, Human
augaagaagcugaagcccagaguggggaaggggaguggcccaaggucacacagcuaguuugagu

SEQ ID NO: 284172 - RNA, 64 nt, Human
gcgccauggugugucagugucuguguguugauggguggcccaugagugacccccgccaggggag

SEQ ID NO: 284173 - RNA, 64 nt, Human
gcagaaccagcucaagaaaggagaugcccuagugguggcccagcuggcuggaguccaggcagcc

SEQ ID NO: 284174 - RNA, 64 nt, Human
acaggucuuuccuaaggcugcaagguuuaggcugguggcccaggaccaucauccuacuguaaua

SEQ ID NO: 284175 - RNA, 64 nt, Human
accucuaggccccaaccacggauuuuuuuucucaguggcccaugucacaaacccuaucucagga

SEQ ID NO: 284176 - RNA, 64 nt, Human
auuuaaauuuuaaaggaauggaguuuuucagccuguggcccagcacuggucaagaaaacaagau

SEQ ID NO: 284177 - RNA, 64 nt, Human
agaauguacauauuccacuugacugggaagcuguguggcccaaaucacuguuugaguggaggaa

SEQ ID NO: 284178 - RNA, 64 nt, Human
ucacaagaauucgacagccagaugcuccaagaggguggcccaaggcuauagccccuccuucaau

SEQ ID NO: 284179 - RNA, 64 nt, Human
cugauucacaaagugcugagccccucuuccccguguggcccaccccaggcacggcucauuccuc

SEQ ID NO: 284180 - RNA, 60 nt, Human; identical to SEQ ID NO: 214070

SEQ ID NO: 284181 - RNA, 64 nt, Human; identical to SEQ ID NO: 214133

SEQ ID NO: 284182 - RNA, 64 nt, Human; identical to SEQ ID NO: 214152

SEQ ID NO: 284183 - RNA, 64 nt, Human
cacuggcccuuuugcuuuucacgcccagggcucaguggcccaggaagugugcugggcagccugu

SEQ ID NO: 284184 - RNA, 64 nt, Human
ccccguggaccgcuuccccugccuucucucugccguggcccagagccggcccagcugcacacac

SEQ ID NO: 284185 - RNA, 64 nt, Human
agaagccgagagacccuguccucccuaaugcacuguggcccaguccccuugccuuuuuccuguu

SEQ ID NO: 284186 - RNA, 64 nt, Human
gugaccagacaguccugagacccagaaggcccagguggcccaagugcucuugguggcccagcuu

SEQ ID NO: 284187 - RNA, 64 nt, Human
gacccagaaggcccagguggcccaagugcucuugguggcccagcuuggccagcacacacuuucc

SEQ ID NO: 284188 - RNA, 64 nt, Human
ugcugcagguggcagagugaaugucccccaucauguggcccaacucuccuggccuggccaucuc

SEQ ID NO: 284189 - RNA, 64 nt, Human
uggggccuagcuguauaggaggaauugccuaaggguggcccacucuugugauugccccauuucc

SEQ ID NO: 284190 - RNA, 64 nt, Human
aguagaguuuguauagguaacuagguaacuuauuguggcccagauaaggcuuuaggaugccuca

SEQ ID NO: 284191 - RNA, 64 nt, Human
gggcagagagaugcagugggugcggggggauccuguggcccacagagcugccccagcagacgcu

SEQ ID NO: 284192 - RNA, 64 nt, Human
cccugcagugcaagcugcugcuccagagcguaccguggcccagacugauccucgaggccuccug

SEQ ID NO: 284193 - RNA, 64 nt, Human
cccugcggugcaagcugcugcuccagagcauaccguggcccaggugguauccccaaggccucgu

SEQ ID NO: 284194 - RNA, 64 nt, Human
cggccccaagcugccuuccucgauguggcccaaaguggcccaaagcgucccaaaguaggccucg

SEQ ID NO: 284195 - RNA, 64 nt, Human
cggcgccucccggccccaagcugccuuccucgauguggcccaaaguggcccaaagcgucccaaa

SEQ ID NO: 284196 - RNA, 64 nt, Human
agugccacccacggaggcaggacacaggcagcguguggcccauucagcaggcccaggucuucag

SEQ ID NO: 284197 - RNA, 64 nt, Human
ccuuccaggccucugggaggcagcucaccccaggguggcccacaccuguuccuagcagggcgcc

SEQ ID NO: 284198 - RNA, 64 nt, Human
ccuugugaaaacuaaccuucucugcugagcaauuguggcccauagccauauuuugagaagaaau

SEQ ID NO: 284199 - RNA, 64 nt, Human
caguggcccgcgugauuguggcauuuaaggagcaguggcccaugugacuguggcauuuucggca

SEQ ID NO: 284200 - RNA, 64 nt, Human
gucugcggaaggugggaggaggcagacgcccugcguggcccauggucggggcguccacgccgag

SEQ ID NO: 284201 - RNA, 64 nt, Human
gggagccaaggaggaaauguggaaacgcaguuguguggcccagcacgagccugggcgaccaccg

SEQ ID NO: 284202 - RNA, 64 nt, Human
acugcuacuggauuuuugcugcagaaauauaucaguggcccacauuaaacauaccaguuggauc

SEQ ID NO: 284203 - RNA, 64 nt, Human
ggagauuaacugaagugacagauuagaguuagaaguggcccaaaggagcaucugguacaacccc

SEQ ID NO: 284204 - RNA, 64 nt, Human
ggcauugcaggaccuugggcacaucugcugguggguggcccagagccucugcuggaaggggcag

SEQ ID NO: 284205 - RNA, 64 nt, Human
gagcugagaaaucuuccucuccggcccacugucuguggcccauugucauuguuuccucaugaaa

SEQ ID NO: 284206 - RNA, 64 nt, Human
gcuucuguucaguugucuaaguaucaucccuucuguggcccaucacgcagcagaguugcccuac

SEQ ID NO: 284207 - RNA, 64 nt, Human
uuuucuguccaucguguacgcuauucuagugcuuguggcccaguacugucuaugaguugucgug

SEQ ID NO: 284208 - RNA, 64 nt, Human
cuaagccagagacccuuauccacugcuccucuagguggcccauuuaugguuuguuguaagagaa

SEQ ID NO: 284209 - RNA, 64 nt, Human
gaagcaggacuggguagcagagccgggaagguggguggcccauuacagggggguccccagggug

SEQ ID NO: 284210 - RNA, 64 nt, Human
caccauccccucaggcagcacccucgcauuccggguggcccagcugguuauugacucugacuug

SEQ ID NO: 284211 - RNA, 64 nt, Human
cacagucucccaucucuccuccccucccccugggguggcccaccgcauggguacaggggguucc

SEQ ID NO: 284212 - RNA, 64 nt, Human
cugaaagcaggagccccucuggugcuccuagaggguggcccagaggagcugugccagggcgugg

SEQ ID NO: 284213 - RNA, 64 nt, Human
gguugugcccagcugggccacggccaugcgugggguggcccaauaaacaccguggacucccagc

SEQ ID NO: 284214 - RNA, 64 nt, Human
uggucauaguguuguugcaaaauugaccauacagguggcccauguauaaaaucugaauuuuagg

SEQ ID NO: 284215 - RNA, 64 nt, Human
ucaugauuaacugucaagacacugguagaacagaacaagcaaaagauuaagaguucaaaaguaa

SEQ ID NO: 284216 - RNA, 64 nt, Human
acuuguagcucuuccucuaugccuuggugccgcaguggcccaucuuuuaugggaagacagagug

SEQ ID NO: 284217 - RNA, 64 nt, Human
ucuucccugggcugccaccagcccccgccccagaguggcccaccguggcacuagaaugcaagua

SEQ ID NO: 284218 - RNA, 64 nt, Human
uccuucccccugugcugacagcauugcuguggggguggcccacugcccuccccuggcccucaug

SEQ ID NO: 284219 - RNA, 64 nt, Human
uuggaggcaacagacggugguccucuugguaaguguggcccacacccagccugguggacaugga

SEQ ID NO: 284220 - RNA, 64 nt, Human
uuuaaaaugguaugccaacuuaaguauuuacaggguggcccaaauagaacaagaugcacucgcu

SEQ ID NO: 284221 - RNA, 64 nt, Human
aacccugaugagaccuuaguguucuccaggcucuguggcccaggcugagagcagcaggguagaa

SEQ ID NO: 284222 - RNA, 64 nt, Human
augggugaagacaagcaagucccccuggaggcggguggcccagaaagccaucuacaggguuccc

SEQ ID NO: 284223 - RNA, 64 nt, Human
ucuaccuaucuaacccccaaccacagcccccuugguggcccaugaguugcuuccaugaaaucuu

SEQ ID NO: 284224 - RNA, 64 nt, Human
uuuggcuaagagccuggccuccagccccagcaguguggcccagagcaggggccgacugccaaag

SEQ ID NO: 284225 - RNA, 64 nt, Human
uaacauuagaaaauaagguccagggccggacacaguggcccaugccuguaaucccagcacuuug

SEQ ID NO: 284226 - RNA, 64 nt, Human
gaggccccaccugaaggguggaugugcuggagggguggcccagagccauacugcguccacccug

SEQ ID NO: 284227 - RNA, 64 nt, Human
ccaucucuuuggaaaaacaguuagucuggagccuguggcccaggcccuucuguccccaggcauc

SEQ ID NO: 284228 - RNA, 64 nt, Human
ggaaucagucacugugcuauccuuguggagucuuguggcccaacuaccagagaacgcugucccc

SEQ ID NO: 284229 - RNA, 64 nt, Human
ucuguguaaagagccguuugugucuugggaguuuguggcccacaugccgauagcacggucaucg

SEQ ID NO: 284230 - RNA, 64 nt, Human
uugucacccuccuuauuucuguuacuacuugucuguggcccagggcaguggcuuuccugaggca

SEQ ID NO: 284231 - RNA, 64 nt, Human
uuccaagggcccacguagcaccggcaaccgccaaguggcccaggcucugaacuggcucugggcu

SEQ ID NO: 284232 - RNA, 64 nt, Human; identical to SEQ ID NO: 214125

SEQ ID NO: 284233 - RNA, 64 nt, Human; identical to SEQ ID NO: 214126

SEQ ID NO: 284234 - RNA, 64 nt, Human
agugauucugcagagccugagcugcugcugugguguggcccacuggagcaaacugcuggcaccu

SEQ ID NO: 284235 - RNA, 64 nt, Human
ccaccucccucagaggcucugcuagccacacuccguggcccacccuuuguuaccaguucuuccu

SEQ ID NO: 284236 - RNA, 64 nt, Human
cucucugaugcuccagcauuggggcaggggcaugguggcccauguagucuccugggccucacca

SEQ ID NO: 284237 - RNA, 64 nt, Human
ccugucacacugcagccccuuccccuucccucucguggcccacaaggaggaaggaagggcaacc

SEQ ID NO: 284238 - RNA, 64 nt, Human
gcuggcagacccacuggaggucaggcacggaccaguggcccagcccugggugucccaucaccau

SEQ ID NO: 284239 - RNA, 64 nt, Human
acucugaccuucagcccucccuacagccggggguguggcccagagaagcuuccagcacagcccu

SEQ ID NO: 284240 - RNA, 64 nt, Human
cguuuuguuuuuaagagauggagucucucacucuguggcccaggcuggagugcaguggcaugau

SEQ ID NO: 284241 - RNA, 64 nt, Human
cugggcaauacugcccgccugucauggccuggugguggcccacaccuaucuucucaccuuggag

SEQ ID NO: 284242 - RNA, 60 nt, Human
uuuauuucuggaccaaguaaagauggguccguggcccacacucggucaugugcucagaca

SEQ ID NO: 284243 - RNA, 64 nt, Human
uggcuggcugguagccaagcacuuauggaccagaguggcccaggccagcugggcgccuuccucc

SEQ ID NO: 284244 - RNA, 64 nt, Human
ggcaccuucggcugguccuguggggcccuggacgguggcccagugguggcaggggcugcuccug

SEQ ID NO: 284245 - RNA, 64 nt, Human
uaggcacugagaucuacaaaugggaagcuugugaguggcccaucuuuguuggccuacgaacuuu

SEQ ID NO: 284246 - RNA, 64 nt, Human
gcauuaccgucccugcucuucccagguggggacaguggcccaagcaaggccucacucgcagcca

SEQ ID NO: 284247 - RNA, 64 nt, Human
ccuguggcuucuucccccaguguaccguuccacuguggcccacauucuugugcacgcgggcauu

SEQ ID NO: 284248 - RNA, 64 nt, Human
gggguggggggaggcugaacaaacucaggaccugguggcccaccggagguguuaccggguuucc

SEQ ID NO: 284249 - RNA, 64 nt, Human
agucgggugacucauuuuucuguguagagacucgguggcccaggcaggaggugaaagcagccau

SEQ ID NO: 284250 - RNA, 64 nt, Human; identical to SEQ ID NO: 242560

SEQ ID NO: 284251 - RNA, 64 nt, Human; identical to SEQ ID NO: 242561

SEQ ID NO: 284252 - RNA, 64 nt, Human; identical to SEQ ID NO: 242562

SEQ ID NO: 284253 - RNA, 64 nt, Human
ugacugggucuucaaugacaggcuuggacuagcuguggcccagacaucggcccugcccagaauu

SEQ ID NO: 284254 - RNA, 59 nt, Human
agaccuaccgcagcuccuagcccguugcgguggcccaucccgcauacccaucuucucgg

SEQ ID NO: 284255 - RNA, 64 nt, Human
agcuggguuaucaugguuggcuuagguaccucagguggcccaggagguccccccuccauaagga

SEQ ID NO: 284256 - RNA, 64 nt, Human
cuuaaugaaaaacaggacaaaacaauuccuuuuuguggcccagguaaauuauuucugguuucac

SEQ ID NO: 284257 - RNA, 64 nt, Human
cuucucacacaaacgcuuucaaaguugggcaaaaguggcccagugcgugaggucagucaacagc

SEQ ID NO: 284258 - RNA, 64 nt, Human
gcauugggugccaggggcugcccaggcuuccugaguggcccaccugggugggaggcugccaccg

SEQ ID NO: 284259 - RNA, 64 nt, Human
cugagcuccacaaaugcaaaagauguauuuuccuguggcccaugacauuugcaguuauucccag

SEQ ID NO: 284260 - RNA, 64 nt, Human
gcuggugaaagcccugcucuuuaaucaaacucugguggcccacugacuaagaagaaaguuuauu

SEQ ID NO: 284261 - RNA, 64 nt, Human
cugaaggaaucugggaauuagcccuggccugaaaguggcccaucauucauacccacuguucuga

SEQ ID NO: 284262 - RNA, 64 nt, Human
gucccucuagcaucacuccugagcugcgggagagguggcccagagaacagcagagucaguuaca

SEQ ID NO: 284263 - RNA, 64 nt, Human
uuuacauguggcccaacacaauucuucuuccaacguggcccagagaagccaaaagauuggauac

SEQ ID NO: 284264 - RNA, 64 nt, Human
caucggcuaucguuagugcuaguggauuuuacauguggcccaacacaauucuucuuccaacgug

SEQ ID NO: 284265 - RNA, 64 nt, Human
gacuucugccugaccagagcucccacuacaugcaguggcccagggcagaggggcugauacaugg

SEQ ID NO: 284266 - RNA, 64 nt, Human
uuggaugcugggguguggggguuggaagcugucuguggcccacuugggcacccacgcuucuguc

SEQ ID NO: 284267 - RNA, 64 nt, Human
ggugccucgccaagcugucugaggucugucccagguggcccagguggugcagguagaacagggu

SEQ ID NO: 284268 - RNA, 64 nt, Human
ucucuacagagaauacaaaaauuagccaggcaugguggcccaugccuguaguaccugcuauugg

SEQ ID NO: 284269 - RNA, 64 nt, Human; identical to SEQ ID NO: 242566

SEQ ID NO: 284270 - RNA, 64 nt, Human; identical to SEQ ID NO: 240403

SEQ ID NO: 284271 - RNA, 64 nt, Human; identical to SEQ ID NO: 240404

SEQ ID NO: 284272 - RNA, 64 nt, Human
uuuauguguggcccaagauaauucuucuuccaauguggcccagggaagccaaaagaugggacac

SEQ ID NO: 284273 - RNA, 64 nt, Human
uuuucucgucagcuaucguuaguguauuuuauguguggcccaagauaauucuucuuccaaugug

SEQ ID NO: 284274 - RNA, 64 nt, Human
gcauaagggaugaaaacuuggccgagacuaauguguggcccacagcuuuggcuggaaucauuuu

SEQ ID NO: 284275 - RNA, 64 nt, Human
augcaagagguggaaauguucuccauaucaagauguggcccaagggguuaagugggaacaauca

SEQ ID NO: 284276 - RNA, 64 nt, Human
uacucucggagcugccuccaugggcacaguaaagguggcccaaggaaggugugagugcauucug

SEQ ID NO: 284277 - RNA, 64 nt, Human
cccauaggugaagccuucuggaggagaaggugacguggcccagcguccaagggacagacucagc

SEQ ID NO: 284278 - RNA, 64 nt, Human
uggugaaccugaaugguccagccaccuucugcagguggcccaaggugaugugcugcagggaagc

SEQ ID NO: 284279 - RNA, 64 nt, Human
cauagagggagaggaagcacacugcagggcugcuguggcccagucguccgcucagccaaggagu

SEQ ID NO: 284280 - RNA, 64 nt, Human
aaaauggaauagauaaugaugccuuuuauuuaaaguggcccacauaauauacauugaguacucc

SEQ ID NO: 284281 - RNA, 64 nt, Human
ccagcuaaucuggaccucagagauagaucagccaguggcccaaagccauuucaaguacagaaau

SEQ ID NO: 284282 - RNA, 64 nt, Human
cauuucuuacauaguugauggcucgauaucugugguggcccagauuguuuuguuuuguuucgcu

SEQ ID NO: 284283 - RNA, 64 nt, Human
agaaaggagcaacacacugccccuaggcgugcguguggcccaguuucucucugcucuccauuaa

SEQ ID NO: 284284 - RNA, 64 nt, Human
ucugagggaugcguccuacccgcgccaucgccccguggcccaggacggggaccuccccuuaguc

SEQ ID NO: 284285 - RNA, 64 nt, Human
gugggcugcacucugugcccaugggcacugcuggguggcccauccccccucaccaggggcaggc

SEQ ID NO: 284286 - RNA, 64 nt, Human
uuucugaaacggaaucccagccagcggauuggggguggcccaggggaugcugcugaugugcagg

SEQ ID NO: 284287 - RNA, 64 nt, Human
acuaagcuggggacaggaaccaaguccuuugcguguggcccaacaaccaucuacagaacagcug

SEQ ID NO: 284288 - RNA, 64 nt, Human
uguuaguugggaaagauugaguuaucagauuuaauuugccgaugggagccuuuaucugucauua

SEQ ID NO: 284289 - RNA, 64 nt, Human
cugcccaaucuucaccagcuucagaaaucugaccuuugccgaugcugcaauaaaguguuguaau

SEQ ID NO: 284290 - RNA, 64 nt, Human
gaucuuuuauuuuuccuucauguuugauuuuuguuuugccgaggauuuugguuagaucuuuuag

SEQ ID NO: 284291 - RNA, 61 nt, Human
uccuccuguggagggugugacccugucugccguggcccaggacucgcccgcccaccugccu

SEQ ID NO: 284292 - RNA, 64 nt, Human
agggcaagcuuccaacccggcccaagggccgcauguggcccaggauauggcuuugaauggggcc

SEQ ID NO: 284293 - RNA, 58 nt, Human
ggggccccaccaucuugugacaaaugguguggcccagggccacauaacagacugcugu

SEQ ID NO: 284294 - RNA, 64 nt, Human
auugccaugguuacauacuaauugcugcagcucuguggcccagcccacugcuucagcugugggc

SEQ ID NO: 284295 - RNA, 64 nt, Human
cuuugcccuuuaaggaguggggauaauguccacgguggcccagccucuugcugauggcaccuuc

SEQ ID NO: 284296 - RNA, 64 nt, Human
cccuggauccuccugggccgcugccuguucuccuguggcccaagugugaccaggaaggucucuu

SEQ ID NO: 284297 - RNA, 64 nt, Human
cagcagugagugggcagguuuggaggagccccgaguggcccaggaguccccccacacacagaug

SEQ ID NO: 284298 - RNA, 52 nt, Human
acacggagcugcacaucuagcuguggcccaggcugggccccgaccugggaug

SEQ ID NO: 284299 - RNA, 64 nt, Human
caguucagggggacuuuccccucuccugucucagguggcccagcccugucagccugucuggcca

SEQ ID NO: 284300 - RNA, 64 nt, Human
uuauguguacuccaaggcaacuccuucuuucaacguggcccagggaggccaaaagauuggacac

SEQ ID NO: 284301 - RNA, 64 nt, Human
gcagguugugagcuggaaaagaaaguucuagacuguggcccagaauagggcuggggcagcuccc

SEQ ID NO: 284302 - RNA, 64 nt, Human
augaccccagccagaugagcgaguggggcucagcguggcccauggugccugucacucagcauuc

SEQ ID NO: 284303 - RNA, 64 nt, Human
ggacacaccucauggacugaggccagagcccccuguggcccauuccccauucauuuuucccuuc

SEQ ID NO: 284304 - RNA, 64 nt, Human
agucggugggagaagggcgggagggugggcccgaguggcccagugggugggugggguggggugg

SEQ ID NO: 284305 - RNA, 64 nt, Human
uuccagaugggccacagacuggggaggagaaucaguggcccagccagaaguuaaagggcugagg

SEQ ID NO: 284306 - RNA, 64 nt, Human
ccuggccaccuggggacuggcacuguggugcacaguggcccaauguggccaacggaaguuuuau

SEQ ID NO: 284307 - RNA, 64 nt, Human; identical to SEQ ID NO: 214119

SEQ ID NO: 284308 - RNA, 64 nt, Human; identical to SEQ ID NO: 214120

SEQ ID NO: 284309 - RNA, 64 nt, Human; identical to SEQ ID NO: 240459

SEQ ID NO: 284310 - RNA, 64 nt, Human
uagcaagaugcuuacuaccacaccguuuuccucgguggcccaauagcucguguaucuaaguuga

SEQ ID NO: 284311 - RNA, 64 nt, Human
gcacgggcacuggccagcugcucucuccaagcagguggcccagaucccacccacguggacuuuc

SEQ ID NO: 284312 - RNA, 64 nt, Human
acuuggaacuagauggccaucuuuccaggcuuugguggcccaagagcagucuggguggauggaa

SEQ ID NO: 284313 - RNA, 64 nt, Human
cuccucuaacucacaguggguuuugugaggcucuguggcccagagcagaccugcauaucugagc

SEQ ID NO: 284314 - RNA, 64 nt, Human
caugccuggcaucuggaagccagcaggccagaggguggcccaaaggcugaugaacgguagggaa

SEQ ID NO: 284315 - RNA, 64 nt, Human
uauguguuuguuuuuugagacagagucucacacuguggcccaggcuggacuccagcacaguggc

SEQ ID NO: 284316 - RNA, 64 nt, Human
ccgugccauuguaaauguuguagagaugugggccguggcccaaccguccuauaugagauguagc

SEQ ID NO: 284317 - RNA, 64 nt, Human
uauacaagcccauaugaagagcugggggcggaugguggcccaggagacagcacaccaccaggcu

SEQ ID NO: 284318 - RNA, 64 nt, Human
cuuguaaccugaacuucugugugguggcaguacuguggcccaccaguguaaucucccuggauua

SEQ ID NO: 284319 - RNA, 64 nt, Human
uuuggagaacagggaaagccuggaggcuucccagguggcccagcgugguguccugucagcuucc

SEQ ID NO: 284320 - RNA, 64 nt, Human
ucuuguccucacuaacccggagcgauuccagacgguggcccagauggugagagucuggaggaau

SEQ ID NO: 284321 - RNA, 64 nt, Human
cuucacaacaguucuuguuagaaucaugggauguguggcccagagguaagaauagaauuucuuu

SEQ ID NO: 284322 - RNA, 64 nt, Human
cuuuugaugccagaaaaggcuucuguucacaacaguggcccauggagaaagaggcucuuauuaa

SEQ ID NO: 284323 - RNA, 64 nt, Human
agacuaaggaagaagucugaggcagacggugaggguggcccaggagccauggccucacacagac

SEQ ID NO: 284324 - RNA, 50 nt, Human
gcggccaggggaggcauuaaguggcccaaaagagagccaggggagccccu

SEQ ID NO: 284325 - RNA, 64 nt, Human
aagaaaaggaggacugaaggacaaacaaccaagaguggcccaguccccacccccacaucuagcu

SEQ ID NO: 284326 - RNA, 64 nt, Human; identical to SEQ ID NO: 242558

SEQ ID NO: 284327 - RNA, 64 nt, Human; identical to SEQ ID NO: 240405

SEQ ID NO: 284328 - RNA, 64 nt, Human
gggauaccuggaggggccagcaaguagaguguugguggcccaagcaaaccaguguugccaauac

SEQ ID NO: 284329 - RNA, 64 nt, Human
auuuuguaaauguauaaacucaccucugguaacaguggcccagacgcugcuuugugcuaaaagc

SEQ ID NO: 284330 - RNA, 64 nt, Human
uuuccagaccagcauccaguggccaucaggucuuguggcccaaaggcuaugcuugccuccggcu

SEQ ID NO: 284331 - RNA, 64 nt, Human
ggagaugugagagaaaauauguaaccacaucuuaguggcccaagaaaauacaggccugaaggga

SEQ ID NO: 284332 - RNA, 64 nt, Human
caauuaauaguggcugccaguugugcuggcguaaguggcccacaucauggggaaggagugcugu

SEQ ID NO: 284333 - RNA, 64 nt, Human
accgugaccuuguguaaauuuauuuauauuuauuguggcccauccaccccacuucugcaaaccc

SEQ ID NO: 284334 - RNA, 64 nt, Human
uaacuuucuaagucauuuugcuuagaaauucaguguggcccauacccuuuguccucccagccug

SEQ ID NO: 284335 - RNA, 64 nt, Human
gucaacaagcacuguucuggaaccuucucuccacguggcccacaggccugaccacaggggcugu

SEQ ID NO: 284336 - RNA, 64 nt, Human
ucacugggagagaagagccguccagggacccaugguggcccacauguggaugccacaugcugcu

SEQ ID NO: 284337 - RNA, 64 nt, Human
aucucuacaaaaauaaaaaauaugucugggcaugguggcccaagucugagucccaguuacuugg

SEQ ID NO: 284338 - RNA, 64 nt, Human
aaguguuucucucccaucauccggauuucugguuguggcccagcaauuaacaaaaacagcuuca

SEQ ID NO: 284339 - RNA, 64 nt, Human
gaauucauguauugguuucaguaccaagugacugguggcccaauucuuuaaugggacaaauauu

SEQ ID NO: 284340 - RNA, 64 nt, Human
ggccccccaggcccaggcgaaagggcagcagcauguggcccauggcaccacccccacggcccag

SEQ ID NO: 284341 - RNA, 64 nt, Human
agcuaaguuugcaauaacagaguacacaaguauaguggcccaggauguagugaaagaacaaauc

SEQ ID NO: 284342 - RNA, 64 nt, Human
acaaaugugcucucuuucuuguaaauagacaugaguggcccaaagcaacaaauuaauacacuuu

SEQ ID NO: 284343 - RNA, 64 nt, Human
aguauuaagguuucuggauuuuuuucucccaacuguggcccaaaagaauuaaaaucuguuaaua

SEQ ID NO: 284344 - RNA, 64 nt, Human; identical to SEQ ID NO: 240475

SEQ ID NO: 284345 - RNA, 64 nt, Human; identical to SEQ ID NO: 240476

SEQ ID NO: 284346 - RNA, 64 nt, Human; identical to SEQ ID NO: 242567

SEQ ID NO: 284347 - RNA, 64 nt, Human
ggauuguuccugucaaucaaugguuuauuggaagguggcccaguaugagcccuagaagagugug

SEQ ID NO: 284348 - RNA, 64 nt, Human
uggauccaggucuaggcccuucaucugcugcucuguggcccagggcagguuugcuugaccucug

SEQ ID NO: 284349 - RNA, 61 nt, Human
uauuccagguauaugaguagaccagugaugaguggcccaggacucuaugacccuacaacca

SEQ ID NO: 284350 - RNA, 64 nt, Human
gcccuuucaugcuagcaggaagacugaaagcaagguggcccaguguggggucauagggcuugau

SEQ ID NO: 284351 - RNA, 64 nt, Human
cugacccgggacucacucuucauucagaagacugguggcccacgugccaggaccaccccaccuc

SEQ ID NO: 284352 - RNA, 64 nt, Human
auguuggcucagagcuauagcuucucugugggggguggcccaagggaaggcuccucuggggccc

SEQ ID NO: 284353 - RNA, 64 nt, Human
ugcaggggucugugcuuggcucuuagcaaagcagguggcccacagugaccuccaggagguggcu

SEQ ID NO: 284354 - RNA, 64 nt, Human
cuggucuuuuccuccccauuccuacaauuucuauguggcccaagucauuccuaaucuuggucuc

SEQ ID NO: 284355 - RNA, 64 nt, Human
ucagagcuuucucuccaaagacuaagaugaagacguggcccaagguaggggguagggggagccu

SEQ ID NO: 284356 - RNA, 64 nt, Human
guucaggacgugcacuuccccaagucggcacugaguggcccagcaccgccuagcccugccaccc

SEQ ID NO: 284357 - RNA, 64 nt, Human
ccugugguuguuaguggggccugaggucaucggcguggcccaaggcuggcaggucaaccucgcg

SEQ ID NO: 284358 - RNA, 64 nt, Human
ccaaagugccggugagacccauggcuguguugguguggcccauggcuguuggugggacccgugg

SEQ ID NO: 284359 - RNA, 64 nt, Human
ccucugcagauggcuggaguguugacccaggcuuguggcccagguaucaccuucccuuccuccu

SEQ ID NO: 284360 - RNA, 64 nt, Human
gggacaaguugacccaccucucacagucauggguguggcccacuugugggagucuccuguccac

SEQ ID NO: 284361 - RNA, 64 nt, Human
gcuuaagugcaugcauugagcugccuccagccugguggcccagcuauuaccacacuugggguuu

SEQ ID NO: 284362 - RNA, 64 nt, Human
gcuccuuguacaacccagacccaucuuguauuuuguggcccagaaaacugaacgauuauuuugu

SEQ ID NO: 284363 - RNA, 64 nt, Human; identical to SEQ ID NO: 214084

SEQ ID NO: 284364 - RNA, 64 nt, Human; identical to SEQ ID NO: 214085

SEQ ID NO: 284365 - RNA, 64 nt, Human; identical to SEQ ID NO: 214086

SEQ ID NO: 284366 - RNA, 64 nt, Human
acucuaaaucaaggaucaugugugcacaauacuuguggcccacaaaauuucacaaugacugcug

SEQ ID NO: 284367 - RNA, 64 nt, Human
gucagcagguggccuugccuggggagccccauguguggcccaccccaccaggccauccccauac

SEQ ID NO: 284368 - RNA, 64 nt, Human
cuacucccuucugcagaugaggaaaccgagagaaguggcccaaggucacgcaacucugagaugc

SEQ ID NO: 284369 - RNA, 64 nt, Human
cuggcucuacccuugggaagccugaucccgguguguggcccagcuuguucaggcccugggaugc

SEQ ID NO: 284370 - RNA, 64 nt, Human
uauucaaaaaaauaaucacuaaaggccaggugcaguggcccaugccuguaaucccagcacuuug

SEQ ID NO: 284371 - RNA, 64 nt, Human
cuugucuguguccuuccaaccccaagcugcuuauguggcccaaccccacugcugucaacuaggc

SEQ ID NO: 284372 - RNA, 64 nt, Human
auuugcauuggaguugagguuuacucuaaugaugguggcccagcugugcccagaggacagccag

SEQ ID NO: 284373 - RNA, 64 nt, Human
uugccaauagugucauccucacagugaacacucaguggcccauggcauuuuauaggcauaccuc

SEQ ID NO: 284374 - RNA, 64 nt, Human
guugagaagucaaguaagcgacauaguaguucagguggcccaugccugggaucuucucuaugau

SEQ ID NO: 284375 - RNA, 64 nt, Human
cauguaugcguacugguuguugagcugggaaaccguggcccaggcaguggucacuacagccuga

SEQ ID NO: 284376 - RNA, 64 nt, Human
aacaggcagagagguuccgggauggucugcucaaguggcccacacuggucauugccuuaagcca

SEQ ID NO: 284377 - RNA, 64 nt, Human
aaggugcugggcccagaggcuuugccuugacagaguggcccaggguuucaagggaggaggaacc

SEQ ID NO: 284378 - RNA, 64 nt, Human
ccauagguuauaggcuggcuggugaaagguucacguggcccaggcugaacuucauugccuagcu

SEQ ID NO: 284379 - RNA, 64 nt, Human
agcugguuugguccuugugugagggaccaagcauguggcccaggcucuaagcucugcggggauu

SEQ ID NO: 284380 - RNA, 64 nt, Human
aggggcacuaacccaggcugacgccaagaaugaaguggcccacugcagcccuggcgagcaggcu

SEQ ID NO: 284381 - RNA, 64 nt, Human
uuggcugaaaacacugaggugcucccaucugugcguggcccaugagcugggaugguccuccagc

SEQ ID NO: 284382 - RNA, 64 nt, Human; identical to SEQ ID NO: 242571

SEQ ID NO: 284383 - RNA, 64 nt, Human; identical to SEQ ID NO: 242572

SEQ ID NO: 284384 - RNA, 64 nt, Human; identical to SEQ ID NO: 242573

SEQ ID NO: 284385 - RNA, 64 nt, Human
uucuuugacuuacaguauaaccauguagccaauuguggcccacuaaaaucuacagaaguuaaug

SEQ ID NO: 284386 - RNA, 64 nt, Human
ccuccucaucucaugagcuucuuggggcuggccaguggcccagggccagcuuggcgauaggugc

SEQ ID NO: 284387 - RNA, 64 nt, Human
uugggcucaggcugggugcucugccaugggcugaguggcccagauauucuucuguccaucuuug

SEQ ID NO: 284388 - RNA, 64 nt, Human
acuuuaguuacuugaugagcuggcuguggccaggguggcccaccugcccuucccuguuccuuuc

SEQ ID NO: 284389 - RNA, 64 nt, Human
cuggguccgaugcccucucuggagauaggccuauguggcccacaguaggugaagaaugucuggc

SEQ ID NO: 284390 - RNA, 64 nt, Human
cccugaguguccagaucuggccaaggugucuaggguggcccacgggggugcuggaauuggcacu

SEQ ID NO: 284391 - RNA, 64 nt, Human
gggggaucuggcauccuccuaaggaccggggcgcguggcccagauaagaauagguguuccuuug

SEQ ID NO: 284392 - RNA, 64 nt, Human
gggugacaaguaugggcaggaggcauggggcaggguggcccaccccagugggcaguagccuggc

SEQ ID NO: 284393 - RNA, 64 nt, Human
cugaggccuggcauuggguggaugcgggcuggccguggcccagugaagccugcagagccccgcu

SEQ ID NO: 284394 - RNA, 64 nt, Human
uggguucccacuggcucugcccagguggggugggguggcccaggcagcagaagguucccugagg

SEQ ID NO: 284395 - RNA, 64 nt, Human
uuuuuuuuuuuuuuuugagaccaaaucuugcucuguggcccaggcuggagugcaguggcacgau

SEQ ID NO: 284396 - RNA, 64 nt, Human
ccagguacuaggaggcaccaggaaaucccgcgggguggcccaugcagaccaggcgcacguggcu

SEQ ID NO: 284397 - RNA, 64 nt, Human
ccacccucuacuucccgcccaguggggcuggaauguggcccagccggcuggaaccucaagggcc

SEQ ID NO: 284398 - RNA, 64 nt, Human
ggcaccagcgggcagugcgggcggccagauugcuguggcccauccugauuccacaaaccucuuu

SEQ ID NO: 284399 - RNA, 64 nt, Human
uaaggagcuuugcucuuggaauuacugaaagucuguggcccaagagagagacacaaguggccuu

SEQ ID NO: 284400 - RNA, 64 nt, Human
aaaggaaagacugagaugguugccaggacuugggguggcccaccuguggagaggacuggcugcc

SEQ ID NO: 284401 - RNA, 64 nt, Human; identical to SEQ ID NO: 214093

SEQ ID NO: 284402 - RNA, 64 nt, Human; identical to SEQ ID NO: 214094

SEQ ID NO: 284403 - RNA, 64 nt, Human; identical to SEQ ID NO: 214095

SEQ ID NO: 284404 - RNA, 64 nt, Human
uggcaccuggagagcccuuaagucuguccuggcuguggcccaugccgacagauaucguggggcu

SEQ ID NO: 284405 - RNA, 64 nt, Human
ugcguccugacgcacaggagagagcugaagguggguggcccaggccagggugugaacuuucucc

SEQ ID NO: 284406 - RNA, 64 nt, Human
accgccuggcccucuguggucacagaggggcucgguggcccagguggugguuccgccuccaggg

SEQ ID NO: 284407 - RNA, 64 nt, Human
auuuucaaauucccuauuccaaaaauagugccggguggcccaaagauaacaucugaagggaaag

SEQ ID NO: 284408 - RNA, 64 nt, Human
gccuucaugggaagggcucccagccacacccagaguggcccaaagcuguugaagucagcauccu

SEQ ID NO: 284409 - RNA, 64 nt, Human
ugggcagaaccagagagaugggacaugguagacuguggcccagaccccagagcagagaaacuug

SEQ ID NO: 284410 - RNA, 64 nt, Human
aaaagaaaaagcaacuaagguuaaaagcuauauuguggcccaagacacugucugaaagaugaca

SEQ ID NO: 284411 - RNA, 64 nt, Human
cauacaggaaaaagucagcgggucaagcuagccuguggcccagccacaacuagcugacaaagcu

SEQ ID NO: 284412 - RNA, 64 nt, Human
uggggugcugccucucacacauuucugccacgugguggcccagcuccucacccagggcccccaa

SEQ ID NO: 284413 - RNA, 64 nt, Human
cugucagcaccaccggcacagggcagagaugcggguggcccaaggaccacgaucaagggguccg

SEQ ID NO: 284414 - RNA, 64 nt, Human
cauccaggucccaugccaagaaccagugauucuaguggcccaccaccucccucuccugccaccc

SEQ ID NO: 284415 - RNA, 64 nt, Human
ccugaaccugugggggccuugcccauuugaccauguggcccaggccaaagcccaguguuggccu

SEQ ID NO: 284416 - RNA, 64 nt, Human
gagauagggauauccaggggaagaggguguugcuguggcccacucucugucuaaucucuuuaca

SEQ ID NO: 284417 - RNA, 64 nt, Human
uagcaggaagcccacauggaggcuccgccaggcuguggcccagcuggugauggcccuuuugcuc

SEQ ID NO: 284418 - RNA, 64 nt, Human
auuugggccugguggaugccaaccuggauaaccuguggcccagcauugacuguccacccagccu

SEQ ID NO: 284419 - RNA, 64 nt, Human
gcaacgcagaccacaagcgagugccugggagggaguggcccagggugguucuggagccauugug

SEQ ID NO: 284420 - RNA, 64 nt, Human; identical to SEQ ID NO: 214096

SEQ ID NO: 284421 - RNA, 64 nt, Human; identical to SEQ ID NO: 214097

SEQ ID NO: 284422 - RNA, 64 nt, Human; identical to SEQ ID NO: 214099

SEQ ID NO: 284423 - RNA, 64 nt, Human
cuacugugugccaccccaagaagggauggucccuguggcccaggcagggucgucagaggccagc

SEQ ID NO: 284424 - RNA, 64 nt, Human
ucgugugcugcugcugcuauugcugucuggugagguggcccaggcccccggcuuuccuccggag

SEQ ID NO: 284425 - RNA, 64 nt, Human
uucaucgugaggcugccacagugccugacuacuuguggcccaggcaggcuucccccaacacagg

SEQ ID NO: 284426 - RNA, 64 nt, Human
cuucccaguugcuuccuagcacauuccauucuuuguggcccagggccuggaccagaccauugug

SEQ ID NO: 284427 - RNA, 64 nt, Human
cugcccauguuuccucccaggaagagcgggcagaguggcccagccccaggcagugcuuccugag

SEQ ID NO: 284428 - RNA, 64 nt, Human
gaugcuggaugugcugcaggagcuccgaggcacuguggcccagcaggugagccugcuguucugc

SEQ ID NO: 284429 - RNA, 64 nt, Human
ccacccccagguaugucucuguauggcagcaaauguggcccauggccugcagcaaaacguccua

SEQ ID NO: 284430 - RNA, 64 nt, Human
aaaaaaaaaaaaauacaaaaauuagccgggcgugguggcccacgccuguaaucccagcuacucg

SEQ ID NO: 284431 - RNA, 64 nt, Human
ugccaguggccuggggguguccaggcucccauccguggcccagccccucuccccucugucuuga

SEQ ID NO: 284432 - RNA, 64 nt, Human
guagcaaaaguucugagaggagcugagcccuguuguggcccauuaaagaacaggguccucaggc

SEQ ID NO: 284433 - RNA, 64 nt, Human
uuuuuuuuuuuuuuuggagacagggucucucucuguggcccaggcugaagugcaguggugugau

SEQ ID NO: 284434 - RNA, 64 nt, Human
cauggcuccagguaacagucccugggacugagcaguggcccauguuggcuguuggagcuuucuu

SEQ ID NO: 284435 - RNA, 64 nt, Human
aggaggcugggcucugggaagaaggagugaagcuguggcccauccugcaggcagaagaggcccu

SEQ ID NO: 284436 - RNA, 64 nt, Human
uugaggagagaguaggaugcugauuuuccuacccguggcccaggucugugccuuccccaugcca

SEQ ID NO: 284437 - RNA, 64 nt, Human
gggacuggccccugggaagcucugagaugaggcuguggcccagcuguaguccugaccuuccucu

SEQ ID NO: 284438 - RNA, 64 nt, Human
ucaaggagucucuugucuagcaggcagcaucgggguggcccacugagucucggcauagucccca

SEQ ID NO: 284439 - RNA, 64 nt, Human; identical to SEQ ID NO: 214102

SEQ ID NO: 284440 - RNA, 64 nt, Human; identical to SEQ ID NO: 214103

SEQ ID NO: 284441 - RNA, 64 nt, Human; identical to SEQ ID NO: 214104

SEQ ID NO: 284442 - RNA, 64 nt, Human
gccaccugggguacugcccucaagagaacgugcuguggcccaugcugacguugagggaacaccu

SEQ ID NO: 284443 - RNA, 64 nt, Human
ccgccaaccagcuccugcugccauccccagggagguggcccaggaaggugccuggcccagaaua

SEQ ID NO: 284444 - RNA, 55 nt, Human
acuccucagguguggacuagacggcguggcccaaggguggugagaaccggagaac

SEQ ID NO: 284445 - RNA, 64 nt, Human
guaaagcacacagauguggguaagaugaaaaacuguggcccaacagggcuuaacccuauggaug

SEQ ID NO: 284446 - RNA, 64 nt, Human
cucuugucacuagggggacuaggggguccccaaaguggcccacuuucuguggcucugaucagcg

SEQ ID NO: 284447 - RNA, 64 nt, Human
ugggcugcugugggcuccuggggagguggcccucguggcccacgcuccaugccaguggcucacg

SEQ ID NO: 284448 - RNA, 64 nt, Human
cuuaggggcggcgcccaucguccugccugccgcaguggcccagccccuucucucccugcaggug

SEQ ID NO: 284449 - RNA, 64 nt, Human
gugugcugugccaaagagcucagcagaggcucacguggcccaggcuggugcgcccgcugucucg

SEQ ID NO: 284450 - RNA, 64 nt, Human
uuccgcccuccgguuaucaagcaaaaugucucuuguggcccaucuuacuggaagagaguuccgg

SEQ ID NO: 284451 - RNA, 64 nt, Human
accagaccaggggcuauuuuugugacccacauagguggcccauucagccucaaggggaaaucca

SEQ ID NO: 284452 - RNA, 64 nt, Human
gggcggcggggacuccgagagccccggagagaacguggcccagcccuggagggcaggcggccac

SEQ ID NO: 284453 - RNA, 64 nt, Human
cuugccucuugucauugucuguccccacccggucguggcccacccggcuagagacggcguccuc

SEQ ID NO: 284454 - RNA, 64 nt, Human
guccuggccuggcacccgcagccgucucccuuccguggcccagggagguguuugcuguccgaag

SEQ ID NO: 284455 - RNA, 64 nt, Human
ggaugcugucaagcauacuguacugcccagaacaguggcccauagcagggaccugcccuaucaa

SEQ ID NO: 284456 - RNA, 64 nt, Human
gaagcuggagccccaacuuugauccuccauuggaguggcccaaaucuuuccaucuagggcaagu

SEQ ID NO: 284457 - RNA, 53 nt, Human
aggccaagaaggcggauuaggggguggcccaaggggcaccggggagaggaccc

SEQ ID NO: 284458 - RNA, 64 nt, Human; identical to SEQ ID NO: 214105

SEQ ID NO: 284459 - RNA, 64 nt, Human; identical to SEQ ID NO: 214106

SEQ ID NO: 284460 - RNA, 64 nt, Human; identical to SEQ ID NO: 214112

SEQ ID NO: 284461 - RNA, 64 nt, Human
agggguagcagccagaaagccaaagcagccaucgguggcccaggcuccacgugcuuacugagga

SEQ ID NO: 284462 - RNA, 64 nt, Human
gagaucagaaguggagauguuggggccaggcacaguggcccaggccuguaaucccaucacuuug

SEQ ID NO: 284463 - RNA, 64 nt, Human
aaagcgggggcuugcagggaaagugaaugggccuguggcccaccuggggucacuuggaaaggau

SEQ ID NO: 284464 - RNA, 64 nt, Human
cccaacccugccuggaucucccugcuucaccccuguggcccaccaggugggccaugaaaggaga

SEQ ID NO: 284465 - RNA, 64 nt, Human
acacggcugaccucauacaucaagccaauaccguguggcccaagacccccaccauaaaucacau

SEQ ID NO: 284466 - RNA, 64 nt, Human
ccauaaaucacaucauuagcaugaaccacccagaguggcccaagacucccagaucagcuaccag

SEQ ID NO: 284467 - RNA, 64 nt, Human
gggguacugugauaaccaccauggauacauuuugguggcccacuggguacugugaggacugcua

SEQ ID NO: 284468 - RNA, 64 nt, Human
agggggcguugaggaauuguggcguugacuggauguggcccaggagggggucgagggggccaac

SEQ ID NO: 284469 - RNA, 64 nt, Human
uccgccacuagagggcgcgccggucccgcuccugguggcccacuguggcugcccgggcgacagu

SEQ ID NO: 284470 - RNA, 64 nt, Human
ccucggaggacaucgucuguguccaggucagaaaguggcccaggaagggggcaguuucugucgc

SEQ ID NO: 284471 - RNA, 64 nt, Human
agaccauaaucaugcauaucacauaagaccagaaguggcccagguccagggucaguuaauuuag

SEQ ID NO: 284472 - RNA, 64 nt, Human
auucccugacucuuagccccagacucuucauucaguggcccacauuuuccuuaggaaaaacaug

SEQ ID NO: 284473 - RNA, 64 nt, Human
uuuuuuuuuuuuuuuuaagacggauucucacucuguggcccaggcuggagugcaguggugcgau

SEQ ID NO: 284474 - RNA, 64 nt, Human
gcuaaggugagagggaugcaggcauggguuggggguggcccagagaaacuuaugacagcuguac

SEQ ID NO: 284475 - RNA, 64 nt, Human
acccacguucucccguccuggggugaggcuuccuguggcccagcccgccccauucaccugugga

SEQ ID NO: 284476 - RNA, 64 nt, Human
gucggggauuugggagugauguaucugggugguuguggcccagagucucucaugagguugcagu

SEQ ID NO: 284477 - RNA, 64 nt, Human; identical to SEQ ID NO: 214081

SEQ ID NO: 284478 - RNA, 64 nt, Human; identical to SEQ ID NO: 214082

SEQ ID NO: 284479 - RNA, 64 nt, Human; identical to SEQ ID NO: 214087

SEQ ID NO: 284480 - RNA, 64 nt, Human
uucuccuuccccgcagccuguaguauucaucgugguggcccacccucucucuccccuuggagcu

SEQ ID NO: 284481 - RNA, 64 nt, Human
accuuuucuuucuuuuuggcuagggaaggugcagguggcccagcauucagggaggagucguaag

SEQ ID NO: 284482 - RNA, 64 nt, Human
cagucucugagggcaccucauggaccaggggcugguggcccaggccagggagggaacccugggc

SEQ ID NO: 284483 - RNA, 64 nt, Human
uguaaggcaaucuuggcacacguggggcuuaccaguggcccagguaauuuuuuguuucauggac

SEQ ID NO: 284484 - RNA, 64 nt, Human
gcucaucaaacucucagcauauggacggccagcuguggcccauaucuuggucacucugaagcac

SEQ ID NO: 284485 - RNA, 64 nt, Human
aaaggaaagagacggggcucugaggccgagcacaguggcccaugccuauaaucccagcacuuug

SEQ ID NO: 284486 - RNA, 64 nt, Human
uugggcagggucucugcuccagcaagcaaacaggguggcccagguggcuauuuugagaacucca

SEQ ID NO: 284487 - RNA, 64 nt, Human
gaagcgggggcuugcaaggaaagugaaugggccuguggcccacccggggucaccaggaaaggau

SEQ ID NO: 284488 - RNA, 64 nt, Human
ugcugagacuuacgcccuguucccuuccugcccuguggcccacgggccggccagcugggugccc

SEQ ID NO: 284489 - RNA, 64 nt, Human
agagaccaagagcaggggauagaagccgggcgaaguggcccaugccuguaaucucagcacucug

SEQ ID NO: 284490 - RNA, 64 nt, Human
auuuaacuggagacauaaucucaauuuguaaaguguggcccauuuucuaacauuuuuauuuugc

SEQ ID NO: 284491 - RNA, 64 nt, Human
ccugugcuguccucaggccuccgcuccuguuuugguggcccaggcucuccccugacccauccuc

SEQ ID NO: 284492 - RNA, 64 nt, Human
ccaggauuuagggucacaugcugcaggcagggcuguggcccagcugggucugacaaggacccag

SEQ ID NO: 284493 - RNA, 64 nt, Human
gggagugcggucagcuccacacaguaguccccacguggcccacucccggcccaggcugcuuucc

SEQ ID NO: 284494 - RNA, 64 nt, Human
ccagcagggcacuguggguggcucacccuagauuguggcccagaucucaggagucucugccuuc

SEQ ID NO: 284495 - RNA, 64 nt, Human
ggagaaggaccagguggaggaagucaccuacgacguggcccaguauauaaaguucgagaugccg

SEQ ID NO: 284496 - RNA, 64 nt, Human; identical to SEQ ID NO: 214077

SEQ ID NO: 284497 - RNA, 64 nt, Human; identical to SEQ ID NO: 214078

SEQ ID NO: 284498 - RNA, 64 nt, Human
uuccaggaauccaacugagcauugaaaucucucauuugccgacuuauuuuuauaggaagccaau

SEQ ID NO: 284499 - RNA, 64 nt, Human
aggcaagaccaaccacaucuggucucugccuucgguggcccacacaccuaagcgucaucgucau

SEQ ID NO: 284500 - RNA, 64 nt, Human
uaauccaauaugcagcaagcaagggugaccuccaguggcccacucaaguccaugagccauuauc

SEQ ID NO: 284501 - RNA, 64 nt, Human
aaaccuauggauucauucacuugauauuggcaagguggcccacaaugagugaguagugauuuuu

SEQ ID NO: 284502 - RNA, 64 nt, Human
cugaccuaauuuucugcugcaagguccccuggcaguggcccauccugucuucuacuugaaacgu

SEQ ID NO: 284503 - RNA, 50 nt, Human
uggagcacugcuggaagugaguggcccaccagagccucccucagccacgc

SEQ ID NO: 284504 - RNA, 64 nt, Human
gugccugccucccccgcccccagccggugcucagguggcccaggggccgcacagacgaggcgug

SEQ ID NO: 284505 - RNA, 64 nt, Human
gccuguggcugcagccguggcccguggugcagccguggcccauggcagccuguagaauccaggu

SEQ ID NO: 284506 - RNA, 64 nt, Human
caaaaaagcugacuguggugauuugcugagugcuguggcccacaggcagggcaagucucggugg

SEQ ID NO: 284507 - RNA, 64 nt, Human
guuccagcagaucucagugggcugguugauuuguguggcccauggauuugaaagaagcugcugc

SEQ ID NO: 284508 - RNA, 64 nt, Human
cauggagcagagguuggccucccuggaggagcagguggcccagacagcccaagcccugcacugg

SEQ ID NO: 284509 - RNA, 64 nt, Human
gggcagugugagguaguccuggauccccgccaggguggcccagacgccagcccuucccugugug

SEQ ID NO: 284510 - RNA, 64 nt, Human
auggauuugaugaaagugcaaagugcccucauuuguggcccaagccuggucuccucccaaaaua

SEQ ID NO: 284511 - RNA, 64 nt, Human
uaucaaaaacaagagaaaagacacgagagagacuguggcccaucaacagacguugauaugcaac

SEQ ID NO: 284512 - RNA, 64 nt, Human
auggcugaguccuguggcuggcccgugaugccagguggcccaugugcccagggcgccugcaggg

SEQ ID NO: 284513 - RNA, 64 nt, Human
aggaagucgugugcaggagccagcagggcgccaaguggcccagugccugcagcucaccuguggg

SEQ ID NO: 284514 - RNA, 64 nt, Human
aggaggccgggcgagcccgguguucugaagaccuguggcccagcagagccucugacaguaaagu

SEQ ID NO: 284515 - RNA, 64 nt, Human
acuaccuuguauaaaauauuauuuauuuucucuaucccggcauucuaauuucucuuauccuaau

SEQ ID NO: 284516 - RNA, 64 nt, Human
agagagcaacgaggaaaggagagggacucuggcgucccggcaggcgagaggcgaggcugagcga

SEQ ID NO: 284517 - RNA, 64 nt, Human; identical to SEQ ID NO: 214100

SEQ ID NO: 284518 - RNA, 64 nt, Human
ggugguucugugcaugccugggugugguuaaggcguggcccagaaggcuucccuggugcucuca

SEQ ID NO: 284519 - RNA, 64 nt, Human
agaaggggcucuguccacagucccccgccgccagguggcccacaugggaccagcaugggggcag

SEQ ID NO: 284520 - RNA, 64 nt, Human
cgggcugagcggagucuggguuagccaggccugcguggcccaugguggcccuuccagugcauau

SEQ ID NO: 284521 - RNA, 64 nt, Human
uccuccccagcccaaccucgggccugcgucugagguggcccaggaccccaagcugcagagccca

SEQ ID NO: 284522 - RNA, 64 nt, Human
cggcaucgccaggcacuggcugggguggggaaagguggcccaguggagccgguggccaggaagg

SEQ ID NO: 284523 - RNA, 64 nt, Human
gcaggcgggcgagugcgugagugcacgccagcgcguggcccauguaugaggagugaaggggccc

SEQ ID NO: 284524 - RNA, 64 nt, Human
ucugaagccccacuggguguuacugcagcagggcguggcccaggccgagggauggugccagcag

SEQ ID NO: 284525 - RNA, 64 nt, Human
augcacaaucugugcuuccagucccucacccuauguggcccaauagcuggcuggauuucacacu

SEQ ID NO: 284526 - RNA, 64 nt, Human
ugcccugccgccacaugcaguggaggagaggccuguggcccaaagaaccugguagcgccuccug

SEQ ID NO: 284527 - RNA, 64 nt, Human
uagacuggucucaucuccauugccuuaaugccagguggcccaggaguacccaugcacagcagcu

SEQ ID NO: 284528 - RNA, 64 nt, Human
ugugcccccuggagcagugggcaagacaguccuuguggcccacccuguccuuguuucugugucc

SEQ ID NO: 284529 - RNA, 64 nt, Human
ucccaggccaccucugcuuccaccuucacuauaaguggcccaguucugguuuucuagauuguac

SEQ ID NO: 284530 - RNA, 64 nt, Human
aucagcugccucuaccaaccacccucuaucagcaguggcccaggaaggaggucaagcaucuucg

SEQ ID NO: 284531 - RNA, 64 nt, Human
ccgagucuguauaacucagggugcucugggugggguggcccagugacuugggaacacagcuucu

SEQ ID NO: 284532 - RNA, 64 nt, Human
ggcuguggccgugcaggccuccuuccagcccagaguggcccaguagagcaaggcagacagugac

SEQ ID NO: 284533 - RNA, 64 nt, Human
cccagggcccagaguguuccccaugcuccaccugguggcccaggccacagcugcugcuuguauu

SEQ ID NO: 284534 - RNA, 64 nt, Human; identical to SEQ ID NO: 214072

SEQ ID NO: 284535 - RNA, 64 nt, Human; identical to SEQ ID NO: 214114

SEQ ID NO: 284536 - RNA, 64 nt, Human
ggcaccugggaaaaggcaccuggaagguuuccauguggcccagcccagcauggaagcagggugg

SEQ ID NO: 284537 - RNA, 64 nt, Human
gccgaccuggggauggccucugaucccuggagcaguggcccacuugcccggugcucucagaaac

SEQ ID NO: 284538 - RNA, 64 nt, Human
auauauuaaaauauauuuaauauguuuugccuuuguggcccaugaaagucuuacugggcccugg

SEQ ID NO: 284539 - RNA, 64 nt, Human
cuuccagcccaggguucccauuuggcuucuggcaguggcccaacuagccaagucugguguuccc

SEQ ID NO: 284540 - RNA, 64 nt, Human
aguuugaguuuuauuauuuauuauuuuaauuccaguggcccaucuuauaauacaacuuguuucu

SEQ ID NO: 284541 - RNA, 64 nt, Human
uuuacagccuuguugccgcuggccagaccaccagguggcccauuacucgagaugaucaucacaa

SEQ ID NO: 284542 - RNA, 64 nt, Human
agcguuuucugaagaagugaggagagccauuggcguggcccacaaaccuuggauucaccaucca

SEQ ID NO: 284543 - RNA, 64 nt, Human
uauuguuuaaaaaccaaacuugaagccaggcaugguggcccacaccuguggucccagcuacuca

SEQ ID NO: 284544 - RNA, 64 nt, Human
ccugggcgucaucugguccugguaagaggagugcguggcccaccaggccccccugucacccaug

SEQ ID NO: 284545 - RNA, 64 nt, Human
gcacagaggccuccuguggccugccagucaucgaguggcccaacaggggcuccaugccagccga

SEQ ID NO: 284546 - RNA, 64 nt, Human
aauugcugacaugggccaggccaggcacuguuuuguggcccaugcuaggcaguggcugcuccau

SEQ ID NO: 284547 - RNA, 64 nt, Human
cccugcguccaggaggccacugcacugcucacuuguggcccagcgcguccuuggaaaucugugg

SEQ ID NO: 284548 - RNA, 64 nt, Human; identical to SEQ ID NO: 214115

SEQ ID NO: 284549 - RNA, 64 nt, Human; identical to SEQ ID NO: 214116

SEQ ID NO: 284550 - RNA, 64 nt, Human; identical to SEQ ID NO: 214118

SEQ ID NO: 284551 - RNA, 62 nt, Human
uguguacuucagucuuggaguuuggaacucuacccugguaggaaagcaccgcagcauguggg

SEQ ID NO: 284552 - RNA, 62 nt, Human
ccaucuguaaaacaggguuuggacuagguguucccugguauucugugaucugccucuugcug

SEQ ID NO: 284553 - RNA, 62 nt, Human
uauuucuccuuuggauuuuggggagaaccaagcccugguagggaagagguaagggggaugau

SEQ ID NO: 284554 - RNA, 62 nt, Human
gccaaaaagggcagugcucaggacucccuggccccugguaccuuucccugacuccuggugcc

SEQ ID NO: 284555 - RNA, 62 nt, Human
gcagacaugugcacuugaagaugcugccccuucccugguaccuagcaaagcuccugccucuu

SEQ ID NO: 284556 - RNA, 62 nt, Human
caugugaaacgugcuugaagggguauaccuuacccugguaaccuuacucaaaagaaggguca

SEQ ID NO: 284557 - RNA, 62 nt, Human
auuccucuggucucuuuuccucucuuccaaugcccugguaaggaauacuacccggguuuacu

SEQ ID NO: 284558 - RNA, 62 nt, Human
caccucaaaagguaccucuucuguaaagcuuucccugguaucaggaaucaaaauuaaucagg

SEQ ID NO: 284559 - RNA, 62 nt, Human
cccgcuuccauagcgacggcugauggaaccgccccugguaccugcuggccucccuuccccag

SEQ ID NO: 284560 - RNA, 62 nt, Human
ggauuuaacaaguaacaaauucuguuguguuucccugguauacaucuuucuaggaaaaaaaa

SEQ ID NO: 284561 - RNA, 62 nt, Human
uuuggggaggaaggaaggacauuaaauucuuucccugguaaugaaaagagcccuuuaucaau

SEQ ID NO: 284562 - RNA, 62 nt, Human
caguaaacuuugaaaaccuuucacugaugauucccugguaagugcuccugugaggggccacu

SEQ ID NO: 284563 - RNA, 64 nt, Human; identical to SEQ ID NO: 214122

SEQ ID NO: 284564 - RNA, 64 nt, Human; identical to SEQ ID NO: 214123

SEQ ID NO: 284565 - RNA, 64 nt, Human; identical to SEQ ID NO: 214124

SEQ ID NO: 284566 - RNA, 62 nt, Human
ugauuauuuaauauauagugcuaucaagcaaucccugguacuuuggacuuccauggcuuguu

SEQ ID NO: 284567 - RNA, 62 nt, Human
gggcauuagugguuugggcugggccuuuugugcccugguacucugccaccuguguugcugau

SEQ ID NO: 284568 - RNA, 62 nt, Human
ccccuugugaggagggggcacuccucuccagccccugguaccacaguccucacgauggugca

SEQ ID NO: 284569 - RNA, 62 nt, Human
ugucacuggaggucguaggcaguggcucaucacccugguagggcugauaggggcuuucaggg

SEQ ID NO: 284570 - RNA, 62 nt, Human
acuuuuuugagugguuccucagagaccuacuacccugguauaggaaagaauccauuugaaga

SEQ ID NO: 284571 - RNA, 62 nt, Human
aaggagcgaggagggcaagcggccucccagcucccugguaccucgaggcaccauuccagcca

SEQ ID NO: 284572 - RNA, 62 nt, Human
aaugaaacuucaauuccaugcuuuggcuuugucccugguaacuaaaaucaggucacaauuuu

SEQ ID NO: 284573 - RNA, 62 nt, Human
ccauuuagccaccaucuuugcagguugcuuugcccugguagggcaguaacauuggguccugg

SEQ ID NO: 284574 - RNA, 62 nt, Human
ucccuccucugauggauggcuugcagggcagccccugguaaccagcccagucaggccccagc

SEQ ID NO: 284575 - RNA, 62 nt, Human
auaacuaggaaguggcagaacugauucuccagcccugguagcauuugcucagagccuacgcu

SEQ ID NO: 284576 - RNA, 62 nt, Human
caugcugccuccuaagugacuccgauuuucagcccugguagaauaaggaagacagcugaugc

SEQ ID NO: 284577 - RNA, 62 nt, Human
aggguggggcgggugagugaaaagguggaaaucccugguaccuugccuggugguuacacagu

SEQ ID NO: 284578 - RNA, 62 nt, Human
cgccagugacccugaggaagcccgucccuuaucccugguauccacgguuccccagagcuuug

SEQ ID NO: 284579 - RNA, 62 nt, Human
ccaggcagaucauguaggacgcggcauccugccccugguagagaggacgaauguuccacacc

SEQ ID NO: 284580 - RNA, 62 nt, Human
guuuucaguuccgcuauugcuaagcauuguuucccugguaauucuucucguccuaaucucaa

SEQ ID NO: 284581 - RNA, 62 nt, Human
cugguugaggaccacugccagggaugcuaacucccugguaauucuuggcuuacccuuuguac

SEQ ID NO: 284582 - RNA, 64 nt, Human
uguggccuuuuuugugcucuuaugugucuguauuucccggcagaguauacgcccuugaaugcca

SEQ ID NO: 284583 - RNA, 64 nt, Human
cuuaagacaaaaaugcaaaaaggcagucaucccaucccggcagacccuuaucguugguguuuuc

SEQ ID NO: 284584 - RNA, 64 nt, Human; identical to SEQ ID NO: 214132

SEQ ID NO: 284585 - RNA, 62 nt, Human
agcaccugggagcucuggccuggggcuggaggcccugguaggagcugcaguuggaggccguu

SEQ ID NO: 284586 - RNA, 62 nt, Human
agauaagaggaaggcuucugucuccugcuugucccugguaauggaaugucucgguguaaaaa

SEQ ID NO: 284587 - RNA, 62 nt, Human
ucuggggcuucagucuuuuccaugaacuucuccccugguagaaagaagaugaaugagcaaaa

SEQ ID NO: 284588 - RNA, 62 nt, Human
agggggaauaugcaagcuaaagccccucuauacccugguaggcuuccucuucagcaugcccc

SEQ ID NO: 284589 - RNA, 62 nt, Human
ccagacuugccuuacccugggcugaucuuugccccugguaugcauuaauggacuccacugaa

SEQ ID NO: 284590 - RNA, 62 nt, Human
gcaguagcccuucauuaguguagauagucauucccugguaggguggaggguaagacauaggg

SEQ ID NO: 284591 - RNA, 62 nt, Human
ggggcgagccaaccccaccucuaugcccugagcccugguaguccagagaccccaacucugcc

SEQ ID NO: 284592 - RNA, 62 nt, Human
acucuguuuuggcaccacacauguauauuucccccugguacacuuggaagacucuuauccau

SEQ ID NO: 284593 - RNA, 62 nt, Human
caagauuuccuacuuucuccugaaacccaaagcccugguaaaagggauacacaggacugaaa

SEQ ID NO: 284594 - RNA, 62 nt, Human
ccuucuugggaaacugggcugcaugaggugggcccugguaguuuguaccccaggccccuaua

SEQ ID NO: 284595 - RNA, 62 nt, Human
gcaaaaguccccagauggcaauacaaaguauccccugguaccacauauauucauuugugagu

SEQ ID NO: 284596 - RNA, 62 nt, Human
cagggcaggcuucccugcagauggguggcagccccugguagaaugcuggauuucucuggaau

SEQ ID NO: 284597 - RNA, 62 nt, Human
uuauuuggaaaugacuuuguuuaugugucuaucccugguaaugauguuguagugcagcuuaa

SEQ ID NO: 284598 - RNA, 62 nt, Human
auuauacaaauacuaucucuguauuguucugacccugguaaauauauuucaaaacuucagau

SEQ ID NO: 284599 - RNA, 62 nt, Human
aagaaguuggaaacuucauuuuaccuucgugacccugguagaccacuuggucucacugguug

SEQ ID NO: 284600 - RNA, 62 nt, Human
gccccagcacuaaagcaguggacaccaggagucccugguaauaaguacuguguacagaauuc

SEQ ID NO: 284601 - RNA, 60 nt, Human
cagagccugcaaccgacuagaggaccugggucccggcagcucuuugcucacccaucuccc

SEQ ID NO: 284602 - RNA, 64 nt, Human
acucagaguugggaagagaugcacauaaucgcucucccggcacaccucaugccucuucccugcc

SEQ ID NO: 284603 - RNA, 64 nt, Human
gccagaagcaggugcuaagauggacugcacagggucccggcacucccucgggacccauucagga

SEQ ID NO: 284604 - RNA, 62 nt, Human
gaaaaugggauugucaaacagcccauuaaguucccugguauuucaccuuccuguccaucugu

SEQ ID NO: 284605 - RNA, 62 nt, Human
uaguuuguaagcuuaaagggacauuuuauuuucccugguaaagaggauucuaauauuucaag

SEQ ID NO: 284606 - RNA, 62 nt, Human
accuuuuuugaaaagugcugguuaguucccgccccugguaaaccugggguagguggggguuc

SEQ ID NO: 284607 - RNA, 62 nt, Human
aaaagaaaguaaugccacacauugugcuuggccccugguaagcagaggcuuugggguccuag

SEQ ID NO: 284608 - RNA, 62 nt, Human
ccuggguucaagagacucuccugccucagccucccugguagcugggauuacaggugugagcc

SEQ ID NO: 284609 - RNA, 62 nt, Human
cucaccaucuuuucccacaaucaaauaucacucccugguacuuccagcuuccaacucuaggg

SEQ ID NO: 284610 - RNA, 62 nt, Human
guggaagaugacggagaugcauuuugaagcaccccugguacucagcacacacaugcuuaccu

SEQ ID NO: 284611 - RNA, 62 nt, Human
gggggcugggaaguccccugcaucccaugguacccugguauugggacagcaaaagccaguaa

SEQ ID NO: 284612 - RNA, 62 nt, Human
aguggagucuguuugauagcgucggcucagagcccugguaccuuggacccaagaggaggccc

SEQ ID NO: 284613 - RNA, 62 nt, Human
agacaaaagaguucuuuaugagccucgauguucccugguaaacuuuuaaaaaggccuucucu

SEQ ID NO: 284614 - RNA, 62 nt, Human
agguccaacccagcuucuuggcaugagguuuacccugguaacaacucaugugcaacugguag

SEQ ID NO: 284615 - RNA, 62 nt, Human
uccuuauugauauuauugguacaggcagacaacccugguaggagagauggauucugggguca

SEQ ID NO: 284616 - RNA, 62 nt, Human
guggccauggcugagacccaaucccugggcgccccugguauccaaagggcccagggacccug

SEQ ID NO: 284617 - RNA, 62 nt, Human
acagucacaucacccaucagcacauggaaggccccugguauggacacugaaaggaagggcug

SEQ ID NO: 284618 - RNA, 62 nt, Human
uuuggucuuccacagucauguugaggugggcucccugguaugguaaaaagccagguauaaug

SEQ ID NO: 284619 - RNA, 62 nt, Human
auuuacucaggagagcaggagcuaccuguaagcccugguaucuccccaucccuacucccagc

SEQ ID NO: 284620 - RNA, 64 nt, Human
gaacaaagcagugacaaccauuggcccuuagcauucccggcauaccuauuagugucuuaaaaag

SEQ ID NO: 284621 - RNA, 64 nt, Human
accagucccagggaaugaaugguggucuccccacucccggcagcacuuuaggcagcccauaagc

SEQ ID NO: 284622 - RNA, 64 nt, Human; identical to SEQ ID NO: 242577

SEQ ID NO: 284623 - RNA, 62 nt, Human
caaggacucugagagcuggcaggucugaguaacccugguaacaauucucuucaccuuaucaa

SEQ ID NO: 284624 - RNA, 50 nt, Human
accuggaaacugcuguuugacccugguauucgggcaaagaggacaugagc

SEQ ID NO: 284625 - RNA, 62 nt, Human
uuuguaaaaugcuguauccuaggaauaagcugcccugguaaccagucucuagcuagugccuc

SEQ ID NO: 284626 - RNA, 62 nt, Human
uggagaagacuauuugccaugacguuuuguugcccugguauuuggacacuccucagcuuuaa

SEQ ID NO: 284627 - RNA, 62 nt, Human
uggugccuuucugagugucuaaaacuugacaccccugguaaaucuuucaacacacuuccacu

SEQ ID NO: 284628 - RNA, 62 nt, Human
guuccauaaacaaaacauacauagugggaacucccugguaugccauagagcacacaagaacc

SEQ ID NO: 284629 - RNA, 62 nt, Human
caaaaaaaaaaaaaaaaaucacagguugcaaacccugguaacacugcaugcuuaauguugug

SEQ ID NO: 284630 - RNA, 62 nt, Human
cuccccaggcauuugccaagggaggcggauuucccugguaguguagcuguguggcuuuccuu

SEQ ID NO: 284631 - RNA, 62 nt, Human
caucgcuugaauacaguacuccuagggcuugacccugguacccagcccagccuuagcaccca

SEQ ID NO: 284632 - RNA, 62 nt, Human
aguagagauggagggccgggaagcaaaccgugcccugguauugucagacacacccaggcuug

SEQ ID NO: 284633 - RNA, 62 nt, Human
uuaugaggcucuuuccuuccuaagggaccuuucccugguaguaguggucucauucacaaaaa

SEQ ID NO: 284634 - RNA, 62 nt, Human
aggagcgcgcuccacgcgcgugcacacagcuucccugguaauaaagagcuggcaucuuucuu

SEQ ID NO: 284635 - RNA, 62 nt, Human
gugggccgaccagaggggggcuucgagguggucccugguacuggggugaccgaguggacagc

SEQ ID NO: 284636 - RNA, 62 nt, Human
ccucagucuauuccugucauagaugugggugucccugguagggaagugccuguguggucugu

SEQ ID NO: 284637 - RNA, 62 nt, Human
auauugccucugcuccuaucaggguugcuaaacccugguacaucguauauaaaauguauuaa

SEQ ID NO: 284638 - RNA, 62 nt, Human
uccaggcacacgaccaagucagcgagagcuagcccugguaagcaaacauagcccauuacagg

SEQ ID NO: 284639 - RNA, 64 nt, Human
gaucucagcugggugcgauggcucacgccuguaaucccggcacuuugggaggccaaggugggug

SEQ ID NO: 284640 - RNA, 64 nt, Human
aaaaucuccccuuuuuuacuuuuuuaaagaguacucccggcauggucaauuuccuuuauaguua

SEQ ID NO: 284641 - RNA, 64 nt, Human
ggagaguugugcugggauagcgcaggaaggugggucccggcaacacgcaggggaugaguggacc

SEQ ID NO: 284642 - RNA, 62 nt, Human
ucgaugaccugaugcagcacacgcacauccagcccugguaccugcggguggagagggccauc

SEQ ID NO: 284643 - RNA, 62 nt, Human
ccgaacuagucccaacgcguuugcaaauauuccccugguagccuacuuccuuacccccgaau

SEQ ID NO: 284644 - RNA, 62 nt, Human
auagagcauucugucugggcagagacuguggacccugguaugcccacgugggacagaggaca

SEQ ID NO: 284645 - RNA, 62 nt, Human
gggggugggacaaugaaugccucauacuuacacccugguacugguugauuggaccucagggg

SEQ ID NO: 284646 - RNA, 62 nt, Human
accuccaaagggaacguccauuugcaugugugcccugguauuuaggguuugucucaugguca

SEQ ID NO: 284647 - RNA, 62 nt, Human
ccuuucuccagcacagcagacuauuguccgugcccugguauuuaggccaucacauauggugg

SEQ ID NO: 284648 - RNA, 62 nt, Human
uuugauugcuggcaucuugccaccccagguaucccugguauuguccuaagcuguauuuguga

SEQ ID NO: 284649 - RNA, 62 nt, Human
aucuugcugaaguaugucagcaccuuuucucacccugguaaguacaguauuucaagagcacg

SEQ ID NO: 284650 - RNA, 62 nt, Human
gggguguggggugugggcuggaagcacuggcucccugguagggacaauaaagguuuuggguc

SEQ ID NO: 284651 - RNA, 62 nt, Human
gucagaugcagaucucuacuguaaaaugggcucccugguaucuccugucuucccuacugcuc

SEQ ID NO: 284652 - RNA, 62 nt, Human
ggccaugccaagacccaggacauaggacggaccccugguacccagaagaggaguucuugcuc

SEQ ID NO: 284653 - RNA, 62 nt, Human
ucagugaaaucggcuuucuccucagacucugucccugguaaggagugacaaggaagcucaca

SEQ ID NO: 284654 - RNA, 62 nt, Human
ggugggggccaagucacagguuggccagaaaacccugguaaguaaugagggcugaguuugca

SEQ ID NO: 284655 - RNA, 62 nt, Human
uuaaaccuuuguguucagccagagccccugugcccugguaggcguugggguuaguaucucuc

SEQ ID NO: 284656 - RNA, 62 nt, Human
ugaagauacccgcuuaaggaugcuaacauuuacccugguacugccacauuuucucuagagca

SEQ ID NO: 284657 - RNA, 62 nt, Human
acuuucauuuucguguugccagcggagcagugcccugguacuugcugucauagcucuauaua

SEQ ID NO: 284658 - RNA, 64 nt, Human
uuucccaaguuuuaugggaacuggcuauuccuugucccggcacaccuucucauuccuuccuuuc

SEQ ID NO: 284659 - RNA, 64 nt, Human
gcccagcuuucugcgugcccuccuggccccucacucccggcagcgggccggccucgcccccacu

SEQ ID NO: 284660 - RNA, 64 nt, Human
aggaaccaaauggggauguaaaccuaaaagggguucccggcaccucgguuuguguugguuggag

SEQ ID NO: 284661 - RNA, 62 nt, Human
cuggacagaaggccuccagcuccuccgcucugcccugguagcccuucacgaaggcuuugugu

SEQ ID NO: 284662 - RNA, 62 nt, Human
uggucauggaggccaucgggcucccaguuagacccugguauccucaucaugauggaaaaaau

SEQ ID NO: 284663 - RNA, 60 nt, Human
cucuccuaagacaccugcaauaaaguguagcacccugguacaucugugauguuugccuuc

SEQ ID NO: 284664 - RNA, 62 nt, Human
gaggugggggaagagcugaaucucuuuauuuucccugguagagacaucuucaaggcaugaaa

SEQ ID NO: 284665 - RNA, 62 nt, Human
aaauccacauccauggucuccuagaccugcuacccugguacuuccacccuaccccaccccga

SEQ ID NO: 284666 - RNA, 62 nt, Human
aggacaaggacuuugauuuauuucugcccccacccugguacugccuggugccugccacaaaa

SEQ ID NO: 284667 - RNA, 62 nt, Human
ucugaaggcagggugagggggcaagggacauacccugguaacuaccuuccuucucgcacuua

SEQ ID NO: 284668 - RNA, 62 nt, Human
cuccccacucccggugcugaggcugcaucagacccugguagggaggggugccgcagccacua

SEQ ID NO: 284669 - RNA, 62 nt, Human
gggggcucugcuuuuucccccuggcaauuuuccccugguauaagaugugcuagauuaauuuc

SEQ ID NO: 284670 - RNA, 62 nt, Human
ccacagaccaagacuggaguaagaccuuuuaacccugguagaaugaauguggcaggagacuu

SEQ ID NO: 284671 - RNA, 62 nt, Human
gaaacaguacacucaaaacauccuugacuguccccugguacacauaugcaagagacuuuaug

SEQ ID NO: 284672 - RNA, 62 nt, Human
aaguauuguuuauaaccaccaaaaaaaaaaagcccugguaguuuuuuggcaccuuauguuua

SEQ ID NO: 284673 - RNA, 62 nt, Human
agaggugaggcagaauccacuguagccuuccgcccugguauuuggggggaugaccagcccag

SEQ ID NO: 284674 - RNA, 62 nt, Human
gguucccuguugcuuuugugucuguuuccugucccugguaggggaagugaugucguggaugg

SEQ ID NO: 284675 - RNA, 62 nt, Human
gaauuuaaauuuaaaugaaaggaaaaauauaucccugguaguuuuguguuaaccacugauaa

SEQ ID NO: 284676 - RNA, 62 nt, Human
ccauuuucucucuugggagcaauggucacagucccugguaccugaaaagguaccuaggucua

SEQ ID NO: 284677 - RNA, 64 nt, Human
cccagagacccuccaugaacugugcucccagccuucccggcaggucugggaguagggaagggcu

SEQ ID NO: 284678 - RNA, 63 nt, Human
gggcucuguccucagccugaguggacagcagugucccggcacaggcccaucgagccgggucca

SEQ ID NO: 284679 - RNA, 64 nt, Human
uggcucuggaaggagggaugaugagugggcguuuucccggcaggcccccgggguccucagccuc

SEQ ID NO: 284680 - RNA, 53 nt, Human
uccuggugaagagccagugaggccccugguacccaagcccccuccccugaccu

SEQ ID NO: 284681 - RNA, 62 nt, Human
cuauaugccagcgcccagggaggagucaguaccccugguaaaccaagccucccacacugaaa

SEQ ID NO: 284682 - RNA, 62 nt, Human
gcugcagggucuuuuucuagggucccugaacgcccugguaaggcuggugagguccuggugcc

SEQ ID NO: 284683 - RNA, 62 nt, Human
ccugauccuuaagauuaugcuccagugggagacccugguaggcacaaagcuugugccuugac

SEQ ID NO: 284684 - RNA, 62 nt, Human
ucucuucucucgguugcucccucugccuaggccccugguacucagucacggcagccaggaga

SEQ ID NO: 284685 - RNA, 62 nt, Human
aguuguuuuaaaaugcggucucuuucuucuuccccugguacuuuuuucuuucuguguacuga

SEQ ID NO: 284686 - RNA, 62 nt, Human
aguuguuuuaaaaugcggucucuuucuucuuccccugguacuuuuuucuuucugucuacuga

SEQ ID NO: 284687 - RNA, 62 nt, Human
ucccuucuuuagugguuugcuuaaauuuaaaucccugguaaucuguagaaccuucuccuagg

SEQ ID NO: 284688 - RNA, 62 nt, Human
agggggcccugaggcaggaccgcccuccugaccccugguaggagggucacauccacuuggug

SEQ ID NO: 284689 - RNA, 62 nt, Human
uuucuucuuuucaugauaaauuuguguugugucccugguagcagaaauccuuaccuauaugu

SEQ ID NO: 284690 - RNA, 62 nt, Human
cgaauccugaggggauaucccuaugucccagccccugguacucccccagcccucaguuuuca

SEQ ID NO: 284691 - RNA, 62 nt, Human
gagccggggcuguccaacuccccuaacucaaucccugguacauuccuaauaaagcaguuuug

SEQ ID NO: 284692 - RNA, 62 nt, Human
caggacucucugcuuggauucacuaaaaagggcccugguaaaauaguggaucucaguuuuua

SEQ ID NO: 284693 - RNA, 62 nt, Human
caggugaugauacgucggaauagaggcaccagcccugguaacugcaucuucuccccuugcca

SEQ ID NO: 284694 - RNA, 62 nt, Human
cugggagccgcaugcccugggcccaggccugacccugguaccgaagcuguggacguucucgc

SEQ ID NO: 284695 - RNA, 62 nt, Human
ugccacgcagagguccaacuugccacccgcgucccugguaccugagaccaccgacauccuca

SEQ ID NO: 284696 - RNA, 64 nt, Human
gcagaugccagcagugccugcccguguccccaugucccggcaugaaggacacugcuagagaguu

SEQ ID NO: 284697 - RNA, 64 nt, Human
gcgccuggcuccaggaaaacacgcuugccuuccuucccggcagcuucgccacucuccuuaugga

SEQ ID NO: 284698 - RNA, 64 nt, Human
gcaaguacuggcccaaccacaucaugcuggugcuucccggcauguucaauaaugcaggcguggg

SEQ ID NO: 284699 - RNA, 62 nt, Human
gaugggaggagucgugggagcccagcuccaggcccugguaccccucuucaugcacugauuug

SEQ ID NO: 284700 - RNA, 62 nt, Human
gcuuucuuugcugcccuuccagggagcugccccccugguagggcaugugccuguuucccucu

SEQ ID NO: 284701 - RNA, 62 nt, Human
ccagggcaggcaggggccacacuaugccugcgcccugguaaaggugaccccugccauuuacc

SEQ ID NO: 284702 - RNA, 62 nt, Human
aggggaaaagaaugccugacccugggaaggcucccugguagaauacaccacacuuuucaggu

SEQ ID NO: 284703 - RNA, 62 nt, Human
uuuacuuugagcccccaaccccccucucccagcccugguaggguuccccaaccaaagacggc

SEQ ID NO: 284704 - RNA, 62 nt, Human
uugagcaggacagcccugcuccuggacagggacccugguaagagcucucuccucagggagga

SEQ ID NO: 284705 - RNA, 62 nt, Human
acuccaccuagagcaccaggaaacagcuuguacccugguagggaaaugguguugcugaaagg

SEQ ID NO: 284706 - RNA, 62 nt, Human
ccuguuggucaacuuugaaauacaaauguuugcccugguaauuagcaaugaacugcuggcag

SEQ ID NO: 284707 - RNA, 62 nt, Human
uuuuuuuuuugcuggaaaugcccccuccacaccccugguagcucuguguccugagaaaucca

SEQ ID NO: 284708 - RNA, 62 nt, Human
accgacagucugccugggccacagcccucucacccugguacugcaugcacgcaaugcuagcu

SEQ ID NO: 284709 - RNA, 62 nt, Human
aggccugagcccaggaaagccccccucacugucccugguaccgcugccaacacccauugacc

SEQ ID NO: 284710 - RNA, 62 nt, Human
cucgcacugcaaaugccgcucucacguaugcgcccugguaugugccugcguucugauagaug

SEQ ID NO: 284711 - RNA, 62 nt, Human
aaaugccaguucaagacaccuucucccugccccccugguaguaacagucagggccuggucug

SEQ ID NO: 284712 - RNA, 62 nt, Human
ugcccucccuccuuccuucuugcuucuaauagcccugguacaugguacacacccccccaccu

SEQ ID NO: 284713 - RNA, 62 nt, Human
cugcccucccuccuuccuuuugcuucucauagcccugguacaugguacacacacccccaccu

SEQ ID NO: 284714 - RNA, 62 nt, Human
aucuuucagguggaaaaguacagugcugccugcccugguauguuuuucuuauagauguuagc

SEQ ID NO: 284715 - RNA, 64 nt, Human
cagccccuccagcuccacguggagacagaagggaucccggcacaucagugguaacagcggacgu

SEQ ID NO: 284716 - RNA, 64 nt, Human
ucccuuucccccauuagugcucucucugccuggaucccggcagaagcuaugaaagggaauaaag

SEQ ID NO: 284717 - RNA, 64 nt, Human; identical to SEQ ID NO: 214069

SEQ ID NO: 284718 - RNA, 62 nt, Human
gcucuaucugcaagccugacucugccagccuccccugguagagaggagguuuacccacuccc

SEQ ID NO: 284719 - RNA, 62 nt, Human
cucacuaagagggcaccaaguggggcaaauaccccugguaacccauuuauggaggcugccac

SEQ ID NO: 284720 - RNA, 62 nt, Human; identical to SEQ ID NO: 220908

SEQ ID NO: 284721 - RNA, 62 nt, Human
gaaaggaaacaauccuuacgcaaaaucuuacacccugguauaacagacagcaugacuggaca

SEQ ID NO: 284722 - RNA, 62 nt, Human
cuccgucugccugugugcuggcuguccuagcucccugguaacagcauccucugcuggcucuc

SEQ ID NO: 284723 - RNA, 62 nt, Human
ccugugcaauucagucugcucucccuuguggacccugguaaagaaaagccucagcucauagu

SEQ ID NO: 284724 - RNA, 54 nt, Human
aacuacccaggucccucugagcagcccugguaacaagggugggaagaagggaca

SEQ ID NO: 284725 - RNA, 62 nt, Human
gccagagagcaaacauagguggccugagagagcccugguacgugguggagaaggacagcguc

SEQ ID NO: 284726 - RNA, 62 nt, Human
cagaagcuacugcgaugccccgggaguuagcccccugguaauagcuguaaacuuccaauuuc

SEQ ID NO: 284727 - RNA, 62 nt, Human
uuccccaaaagguucuucuaagccuuuauugucccugguaaauguuucccggcugggcgcgg

SEQ ID NO: 284728 - RNA, 62 nt, Human
ccagagcuccugucuguaggaaguuucuaauucccugguaucuauaaacccuuuucagggga

SEQ ID NO: 284729 - RNA, 62 nt, Human
uucaaugaauuucugccuaugaggcaucuggccccugguagccagcucuccagaauuacuug

SEQ ID NO: 284730 - RNA, 62 nt, Human
uucucugaugagaauauugcuggcccugcuuucccugguagguauuugccaggcccaaugcu

SEQ ID NO: 284731 - RNA, 62 nt, Human
ucauuccucauauuagauuucccaagaaaucacccugguauccaauaucugagcauggcaaa

SEQ ID NO: 284732 - RNA, 62 nt, Human
gcuccugggggccggccccuggagucuucccucccugguagccucuaaccagcauucccaga

SEQ ID NO: 284733 - RNA, 62 nt, Human
uaggauaagaaugugccucucaagccuugacucccugguauucuuuuuuugauugcauucaa

SEQ ID NO: 284734 - RNA, 64 nt, Human
uuucccaggcuaaaggaaagucaccugcaagagaucccggcacugaucuggagcagcugacagg

SEQ ID NO: 284735 - RNA, 64 nt, Human
gacacccgggggccugugucuguggccgcucccaucccggcagcccuggcugcugcucgcccca

SEQ ID NO: 284736 - RNA, 64 nt, Human
cgggcgaggccaauggaaaggagacugaggggagucccggcagugagcccgaggcccugggacc

SEQ ID NO: 284737 - RNA, 62 nt, Human
uucucugaugagauuauugucaacccugcuuucccugguagauauuugccaggcccaaugcu

SEQ ID NO: 284738 - RNA, 62 nt, Human
caaggucuugcucuccuagguagcccccucuucccugguaagaaaaagcaaaaggcauuucc

SEQ ID NO: 284739 - RNA, 62 nt, Human
caaaucacguguccaucgagcacgucugaaaccccugguagccccgacuucuuuuuaauuaa

SEQ ID NO: 284740 - RNA, 64 nt, Human
gccaagcuuugucuuuggggcuugcugcagaaaccuggccuacggaagauacgacaccacuggg

SEQ ID NO: 284741 - RNA, 64 nt, Human
ccucgucgcuuucaagucacaucauauaugcgaucuggccuaaccauggagauauugguuauca

SEQ ID NO: 284742 - RNA, 64 nt, Human
gucaacuaugcuggcuggacuggcugccuuguuccuggccuaggacuuagcuucauaacuauca

SEQ ID NO: 284743 - RNA, 64 nt, Human
ggcucaguaaaauaaagcacucuuauuuuuugaucuggccuauuuugccccucauuguguagcc

SEQ ID NO: 284744 - RNA, 64 nt, Human
gaaagugagaggugggggacagggguuucucuuucuggccuaaggacuuucagguaaucagagu

SEQ ID NO: 284745 - RNA, 64 nt, Human
agaagaaaaucagagagggaagaucugguauuuccuggccuaaauuccccuuggggaggacagg

SEQ ID NO: 284746 - RNA, 64 nt, Human
cccauucccuccccucccaccccuugcuccuugucuggccuagaagugugggaaauucaggaaa

SEQ ID NO: 284747 - RNA, 64 nt, Human
uucccacuuuucuaaaagcuguggagggaucuagcuggccuaugucuacacucagugcccugag

SEQ ID NO: 284748 - RNA, 64 nt, Human
ggugaggacgagcccucacccuucuugucuuccuucccggcagcgcccgcagcgggccauuuac

SEQ ID NO: 284749 - RNA, 64 nt, Human
agccguuuguguggucuccauguaggugcuguguucccggcaccgccuugcucugaacacuggu

SEQ ID NO: 284750 - RNA, 64 nt, Human
cuguaauugcugccuuuucucauucuguuaauagucccggcaaccagauuucaguggggcauga

SEQ ID NO: 284751 - RNA, 64 nt, Human
aaccaugccaagccugccugccaggccucugcgccuggccuagggugcagccaccugccugaca

SEQ ID NO: 284752 - RNA, 64 nt, Human
agagugcugggauuauaggcgugagccaccgugccuggccuaaaggaagucauucuuaucucua

SEQ ID NO: 284753 - RNA, 64 nt, Human
aaagugcugggauuacaggcaugaaccaccacgccuggccuaaaauguuuuuaaauaacuguac

SEQ ID NO: 284754 - RNA, 64 nt, Human
uaucaucuuaucaucaauuauuagacaaaucccacuggccuacagucuugcuucugcagcaccc

SEQ ID NO: 284755 - RNA, 64 nt, Human
ccagcgccaggcccaaaaccaggccugggccugccuggccuaaacccaguaguuaaaaaucaac

SEQ ID NO: 284756 - RNA, 64 nt, Human
aaagugcugggguuacaagcaugagccaccacaccuggccuauuaugaccuuuuucauuuuucu

SEQ ID NO: 284757 - RNA, 64 nt, Human
ggaauucccacagcccuccaguguacugaggguacuggccuagccauguggaauucccuacccu

SEQ ID NO: 284758 - RNA, 64 nt, Human
acaaagggagagugggccuucaggagaugccgggcuggccuaacagcucaggugcuccuaaacu

SEQ ID NO: 284759 - RNA, 64 nt, Human
aaauuuaggggccucagucccucaccgccaugcccuggccuauucugucucuccuucuuccccc

SEQ ID NO: 284760 - RNA, 64 nt, Human
uaaugucauucaaaaaggccuggucagugccugucuggccuagggccacucccaccugcaggac

SEQ ID NO: 284761 - RNA, 64 nt, Human
gcaccccaggcagcuccuguuuggaaauggggagcuggccuaggugggagccaccacuccugcc

SEQ ID NO: 284762 - RNA, 64 nt, Human
aucuugccgggggcagggcauucccucggaaguccuggccuaaggauuuuauuacacugucugc

SEQ ID NO: 284763 - RNA, 64 nt, Human
ggcgugcugguccccuccucagugacaucaaagccuggccuaauuguuccuauuggggaugagg

SEQ ID NO: 284764 - RNA, 64 nt, Human
aaagugcugggauuacaggugugagccaccgcaccuggccuaaaccagauuucuuuagggcaca

SEQ ID NO: 284765 - RNA, 64 nt, Human
uuaguucauagauuuuguuagauguucuuuccaccuggccuaugauguuuagauguucauacuu

SEQ ID NO: 284766 - RNA, 64 nt, Human
cccugcugcccccaggccugggagcuugaagcccucccggcaucuggcauccgagccucccgcc

SEQ ID NO: 284767 - RNA, 64 nt, Human
ggcacuguucaucucagcuuuucugucccuuugcucccggcaagcgcuucugcugaaaguucau

SEQ ID NO: 284768 - RNA, 64 nt, Human
cgcuggaaggauagccucgcuucccaggugcagcucccggcaggucuggacaguuccacagagc

SEQ ID NO: 284769 - RNA, 64 nt, Human
ccagagggccagggaggaggagaaaggaauugagcuggccuaucuagagcagcugcauggccaa

SEQ ID NO: 284770 - RNA, 64 nt, Human
ccuguagaugcugugcaugccccaugaugaguuucuggccuaauugagggaaggaggaaauuca

SEQ ID NO: 284771 - RNA, 64 nt, Human
cccucccuggaggcugcucuucugauucugagagcuggccuaguggugcugagggccccuuucu

SEQ ID NO: 284772 - RNA, 64 nt, Human
gguuguuauuaaccaagcuacagauucacacuuucuggccuaaacccuaaugggaugaggcuuu

SEQ ID NO: 284773 - RNA, 64 nt, Human
accaguagacgcuccucuacucuuugagacaucacuggccuauaauaaauggguuaauuuaugu

SEQ ID NO: 284774 - RNA, 64 nt, Human
cucugugcuuucucucguccuuccaaagucgguucuggccuaacgcaugucccaacaccuuggg

SEQ ID NO: 284775 - RNA, 64 nt, Human
gccucucuccccagagcagggucccugccgaggacuggccuagagcaagcacuggaaaagaggc

SEQ ID NO: 284776 - RNA, 64 nt, Human
caggcuggacauggggcagucguucuggggaggccuggccuagcagccacccaccugagcccuc

SEQ ID NO: 284777 - RNA, 64 nt, Human
aaucuggggguucagauggguagcacuaagccagcuggccuaaagaugcaauaaguuccuaggu

SEQ ID NO: 284778 - RNA, 64 nt, Human
gucaggacuuuaucagcagggguaaaacuaccaccuggccuagccuaaguaggaagugaaaaga

SEQ ID NO: 284779 - RNA, 64 nt, Human
caggcaaacauggucaguauucuguaaaguuccccuggccuaaaugauuacuugcucugggcaa

SEQ ID NO: 284780 - RNA, 64 nt, Human
cuaaaaugcauugcauaguugaucaagucacucucuggccuaaaaccuuccuuggcucccugcu

SEQ ID NO: 284781 - RNA, 64 nt, Human
acaguaauugcaagaggagaccucacauucaggacuggccuagugaacguaauccaugcuuuaa

SEQ ID NO: 284782 - RNA, 64 nt, Human
uaaauaguuauauaauucacucaagcacugauaucuggccuaaaaucuuggaaguacaugucca

SEQ ID NO: 284783 - RNA, 64 nt, Human
uagggguaccuggaauguaggaucucccccaugccuggccuaccacccuaaugugucuggaauu

SEQ ID NO: 284784 - RNA, 64 nt, Human
uuccuaacaaagcgguugugagccuggauccgacucccggcagugcugacccugcagggcaagu

SEQ ID NO: 284785 - RNA, 64 nt, Human
aucguuuuuuaacuuucacauuccuaagcuggcuucccggcacagaagccauggauuuccccuc

SEQ ID NO: 284786 - RNA, 64 nt, Human
ccgggcuugugugcacacgccacacacugggcguucccggcacgggagaggcccagaguuuccu

SEQ ID NO: 284787 - RNA, 64 nt, Human
cuggcuggaccaaccugcuggcucaggcaugugacuggccuaacugcaugcccagggcacugcc

SEQ ID NO: 284788 - RNA, 64 nt, Human
cauucucaauguguucacuuggacagagcccugccuggccuaacgauuagaggguuagucucca

SEQ ID NO: 284789 - RNA, 64 nt, Human
cugaggcuccugcucucccauccaccugucuguccuggccuaaugccaggcucugaguucugug

SEQ ID NO: 284790 - RNA, 64 nt, Human
guuucgucauguuggccaggcuggucucgaacuccuggccuaggugauccacccgccucgaccu

SEQ ID NO: 284791 - RNA, 64 nt, Human
aaagugccgggauuacaggcgugagccacugcgccuggccuaguuugguuuuuuaauuauggua

SEQ ID NO: 284792 - RNA, 64 nt, Human
ggagaugagcucgccugcaggcagcugcugugagcuggccuaccugccugccccaggccaugcc

SEQ ID NO: 284793 - RNA, 64 nt, Human
ugucacucacgcacuccccaucccuuagggcuuccuggccuacugcauccuugugggagucagg

SEQ ID NO: 284794 - RNA, 64 nt, Human
ugcacugaggaaauuuuucccccuacauugacuccuggccuacaucagccaaacuuaaccuugg

SEQ ID NO: 284795 - RNA, 64 nt, Human
aaugaccaauugaguaagaacaucccugucuuaacuggccuaaauuucuucugguagugucagu

SEQ ID NO: 284796 - RNA, 64 nt, Human
uccuuauucuccaccugcucaguuccugucuacccuggccuagagguaaccacuauucucaucc

SEQ ID NO: 284797 - RNA, 64 nt, Human
acacauccaaggcaccguggacuguguuuccauccuggccuagaggagcaguaaaagauagcau

SEQ ID NO: 284798 - RNA, 64 nt, Human
cuguuuuauuaaaaaaguaaacaccugagcacagcuggccuacacaggagcgacagauucuccu

SEQ ID NO: 284799 - RNA, 64 nt, Human
aauaccuaccuucuauuuguuauucagaucagaucuggccuauuuucauauuuauccuaagcca

SEQ ID NO: 284800 - RNA, 64 nt, Human
cauacauguauauauguaucaguucugaguuccacuggccuaucccaaauacacuggauuacca

SEQ ID NO: 284801 - RNA, 64 nt, Human
aacacagaggaguuaugaccaguguuguaaggaucuggccuagaaauggcaugcaucucuucca

SEQ ID NO: 284802 - RNA, 64 nt, Human; identical to SEQ ID NO: 214135

SEQ ID NO: 284803 - RNA, 64 nt, Human; identical to SEQ ID NO: 214136

SEQ ID NO: 284804 - RNA, 64 nt, Human; identical to SEQ ID NO: 214137

SEQ ID NO: 284805 - RNA, 64 nt, Human
aagagacaaguuuaucacagaauuuuuuuuccugcuggccuauugcuauaccaaugauguugag

SEQ ID NO: 284806 - RNA, 64 nt, Human
ugcagcuuccuguuucaguaggggagugaccuaacuggccuaauuaaugggauaccccgacauu

SEQ ID NO: 284807 - RNA, 64 nt, Human
ucucaccugucaccugacucgagcccccugcuuccuggccuaggcgaggguuccagguuucaga

SEQ ID NO: 284808 - RNA, 64 nt, Human
uguccugguauccuuuuccugugugguugccccucuggccuaggguuaagugugcaagauaacu

SEQ ID NO: 284809 - RNA, 64 nt, Human
aguaaaaauaugaaguaccgagaggcuaaacccacuggccuaagaucucaccaaaguucaugaa

SEQ ID NO: 284810 - RNA, 64 nt, Human
uggcuuauuuuacccaugagcuggccaauacuuccuggccuagaaaaauaucuccacucucccc

SEQ ID NO: 284811 - RNA, 64 nt, Human
acguguguugggaaagaagaaagggugagaaacccuggccuaaacaauccaucccacagauccu

SEQ ID NO: 284812 - RNA, 64 nt, Human
uagguaaaccagcaaauuuggcucgauaauaucgcuggccuaagcgucaggcuuguuuucaugc

SEQ ID NO: 284813 - RNA, 64 nt, Human
cuuucgccauguuguccaggcuggucucgaacuccuggccuaaugaucugcccaccucugccuc

SEQ ID NO: 284814 - RNA, 64 nt, Human
guuuugaauucuacacuguugucuuuccucugugcuggccuaggacauuaggauuccuuccacg

SEQ ID NO: 284815 - RNA, 64 nt, Human
aaaguguugggauuacaggugugagccacugcgccuggccuaaacaaacuuuuugaaaagcugu

SEQ ID NO: 284816 - RNA, 64 nt, Human
aaaaugcugggauuacaggcgugagccaccgcgccuggccuaaaauguguucuuuauuauugac

SEQ ID NO: 284817 - RNA, 64 nt, Human
ucucucgcagagcauggaaggcaggagaggugggcuggccuagggcaggagcuccacuucucuc

SEQ ID NO: 284818 - RNA, 64 nt, Human
ugcuguagaagucagccguaggaauucaaaauggcuggccuaccuuggcuaccagacauauugg

SEQ ID NO: 284819 - RNA, 64 nt, Human
cccaccugucuuugcuaccugaacgcaccacccucuggccuaggcuggcuccagugugccaugc

SEQ ID NO: 284820 - RNA, 64 nt, Human
gguggggguggagugggggcuuccagguggcccuucccggcacacauuccauuuguugagcccc

SEQ ID NO: 284821 - RNA, 64 nt, Human
ugugagcuggcggucaggagugagggcccagccuucccggcaccucccagccagguggcccugc

SEQ ID NO: 284822 - RNA, 64 nt, Human
aaagugcugggauuacaggcaugagccacugcaccuggccuacguauuaggcuuuauguaagau

SEQ ID NO: 284823 - RNA, 64 nt, Human
auuuuucuuuucucuucagaauuaaaaaacacaucuggccuaauguuccagauccuucaaagag

SEQ ID NO: 284824 - RNA, 64 nt, Human
aaaaugcugagauuacaggugugagccaccaugccuggccuaaacuaauuuuuagauaguuccu

SEQ ID NO: 284825 - RNA, 64 nt, Human
uuuaaaucuaucaguucauugccuggucaggucucuggccuauaaacaugcaaaaaaacuaauu

SEQ ID NO: 284826 - RNA, 64 nt, Human
acaccauuacccacccccguuccccugaggugcucuggccuaugcccugagcaaggggggucuu

SEQ ID NO: 284827 - RNA, 64 nt, Human
ccagggacauccugaguuugguggcuacuucccucuggccuaagguaggggaggccuucucaga

SEQ ID NO: 284828 - RNA, 64 nt, Human
aaccauaaaauaguucagcaaguagcccacaguucuggccuaacagcagacuugcuguuuucac

SEQ ID NO: 284829 - RNA, 64 nt, Human
ccaggacaaaagugacgcuaaaauaccuuaguugcuggccuauccugugguccauuucauacca

SEQ ID NO: 284830 - RNA, 64 nt, Human
gcuugccauuguuuacucucuuauuuaccaacuucuggccuaggcaugacagugggcaccuucc

SEQ ID NO: 284831 - RNA, 64 nt, Human
aaagugcugggauuacaagaaugagccaccgugccuggccuauuuuauuauauuguaauauauu

SEQ ID NO: 284832 - RNA, 64 nt, Human
cuugagggaagugggacuccuggcuccccagggccuggccuacucaaucucucccaccucaucc

SEQ ID NO: 284833 - RNA, 64 nt, Human
acuugcagaggaccuguccccucucaaaaguccccuggccuaggguggggacccccaaaccuac

SEQ ID NO: 284834 - RNA, 64 nt, Human
aaucccaguucuuccccugcccagcuauugggagcuggccuaaguauugcuccccaccuccuug

SEQ ID NO: 284835 - RNA, 64 nt, Human
gccuaucuggacaggccccugcagccucuguccccuggccuagccucucuguccuucccugagu

SEQ ID NO: 284836 - RNA, 64 nt, Human
acacaucccuuccuguguugguguuuccuuuagacuggccuagccugggcaucacuguaaagua

SEQ ID NO: 284837 - RNA, 64 nt, Human; identical to SEQ ID NO: 214074

SEQ ID NO: 284838 - RNA, 64 nt, Human; identical to SEQ ID NO: 214075

SEQ ID NO: 284839 - RNA, 64 nt, Human; identical to SEQ ID NO: 214076

SEQ ID NO: 284840 - RNA, 64 nt, Human
gaauuccaggacucucaauggggggacgggaugccuggccuaagcaccuggagcaggggacccc

SEQ ID NO: 284841 - RNA, 64 nt, Human
ccuaaccaaacuucuuccuaaggagauuuauauucuggccuacacagcaguccuugauggcuga

SEQ ID NO: 284842 - RNA, 64 nt, Human
aaagugcugggauuacaggcaugagccaccacaucuggccuaggaccuuaaauauuggaaagca

SEQ ID NO: 284843 - RNA, 64 nt, Human
gccccaaugcucguuaacagcugcuguaacuagucuggccuacaauagugugauucauguagga

SEQ ID NO: 284844 - RNA, 64 nt, Human
cucggcauaugccaccuccaugccacugccagagcuggccuagcaagaugugcucucagaaugg

SEQ ID NO: 284845 - RNA, 64 nt, Human
caggguacagcccauucccccagcccuggcugaccuggccuagcaguuuggcccugcuggccuu

SEQ ID NO: 284846 - RNA, 64 nt, Human
guggaucgccugaggucaggaguucaagacaagccuggccuacaugguugaaaccccaucucua

SEQ ID NO: 284847 - RNA, 64 nt, Human
uaggccccgggacccccggccuccaggcuggggccuggccuauuuaagcccccucuugagaggg

SEQ ID NO: 284848 - RNA, 64 nt, Human
accaggagugaaaaaggaaaguagaaggcagcugcuggccuagauguugguuugggaauauuag

SEQ ID NO: 284849 - RNA, 64 nt, Human
ugccgcguguggagccgcagccuuucccccuggacuggccuaugcccccgcgcccgcugccccc

SEQ ID NO: 284850 - RNA, 58 nt, Human
acccuuguauagguuggugagcacacgucuggccuacagaaugcggccucugagacau

SEQ ID NO: 284851 - RNA, 64 nt, Human
aaggauacuuuuacagguuaagacaaaggguugacuggccuauuuaucugaucaagaacauguc

SEQ ID NO: 284852 - RNA, 64 nt, Human
ucccucagucucaaagucaccuugaaagcuucaccuggccuacaacuuuuauuuuaaaaagaug

SEQ ID NO: 284853 - RNA, 64 nt, Human
gucuuucugggguguuuauguccucagcugaagccuggccuaguugcugagaggggcuggggag

SEQ ID NO: 284854 - RNA, 64 nt, Human
augaccugguccuaggacacccuuggacagaagacuggccuaccuagcagaccuggauuuuucu

SEQ ID NO: 284855 - RNA, 64 nt, Human
acccggugaccagugguggccccucagcccacccucccggcagcucagccuguggcucuugagg

SEQ ID NO: 284856 - RNA, 64 nt, Human
uagugcuguccucccaucuccugugggcagccccucccggcagccagggcuuccuggaggcgau

SEQ ID NO: 284857 - RNA, 64 nt, Human
ccccugcagcgguucccuggacgggcgggagcucucccggcaggugcggagcuccguggaacug

SEQ ID NO: 284858 - RNA, 64 nt, Human
ccuuuuguuuuuggcuuuccugguucugucuagacuggccuaggggccagggcuuugggauggg

SEQ ID NO: 284859 - RNA, 64 nt, Human
cagggcuuggccugagcuccugagccagcggggccuggccuaccucccccauccccugcuuccc

SEQ ID NO: 284860 - RNA, 64 nt, Human
aggcugggccucccugacccggccagacuggugucuggccuaaugagggagccggggcucccca

SEQ ID NO: 284861 - RNA, 64 nt, Human
ggggccuccacagaccccccuccugcggggcacgcuggccuaagagacguggcacugagccucg

SEQ ID NO: 284862 - RNA, 64 nt, Human
caauaacauuccaaagaacguaguuuggaaaacacuggccuaucggcuguaauaggaagggucu

SEQ ID NO: 284863 - RNA, 56 nt, Human
gcuaccugcugcagcccugaaggccccuggccuagccuggagcccaggaccuaagu

SEQ ID NO: 284864 - RNA, 64 nt, Human
uuccugcugacagcuggaugucacacaugaaggucuggccuagcgagugaugggucuaggcccu

SEQ ID NO: 284865 - RNA, 64 nt, Human
ucagcuaggcaggugcccccaucccccccgcauucuggccuaggcaggagaggaugggcgcagc

SEQ ID NO: 284866 - RNA, 64 nt, Human
cgcacacaaucauagagaaccucucugcucucugcuggccuacagcuugucuguuucucaagca

SEQ ID NO: 284867 - RNA, 64 nt, Human
cuagcagaugugcacaauauaaacaaaaagauaucuggccuaccuuacuacuaaaagcauuuaa

SEQ ID NO: 284868 - RNA, 64 nt, Human
ccuucuaacaugugucagcuacccuaccacacaccuggccuaggagacacaucauucauugcuc

SEQ ID NO: 284869 - RNA, 60 nt, Human
uggggagcccuggcagcugagcccucaguccuggccuagacuguucugacaaucuaaccu

SEQ ID NO: 284870 - RNA, 64 nt, Human
aaguagggggcuuucuggggccuagcgaucucuccuggccuauccgcugccagccuugagcccu

SEQ ID NO: 284871 - RNA, 64 nt, Human
cugccgucccagcaggggcggcaggagagagaggcuggccuacacaggugcccgucauggaaga

SEQ ID NO: 284872 - RNA, 64 nt, Human
cucugagcacaugcauaguggcaucagcagcuuccuggccuacucccaaucacacugugcccug

SEQ ID NO: 284873 - RNA, 50 nt, Human
uccgcaagcugcagugcuagucccggcauccugauggcuccgacaggccu

SEQ ID NO: 284874 - RNA, 64 nt, Human
cuuaaacuuuaccuuuuauuuuaaaguucuaguuucccggcauugauaguucccuauuugaaau

SEQ ID NO: 284875 - RNA, 64 nt, Human
gugcagacucacagauaauaaagcucagagcagcucccggcaggggcacucacggcacacgccc

SEQ ID NO: 284876 - RNA, 64 nt, Human
ggguuccuggggugggcuuggggugaguguaguucuggccuagcagcacccucuuguggcuugu

SEQ ID NO: 284877 - RNA, 64 nt, Human
aaagugcuggaauuacaggugugagccacucugccuggccuaccacuaacuugaauacauucag

SEQ ID NO: 284878 - RNA, 64 nt, Human
ucuccacgcagcaggaagaucccaccgacccuuccuggccuaauccuuuagauuaggucacauu

SEQ ID NO: 284879 - RNA, 64 nt, Human
acccaguagcuaaccccacugugcuuccacaugccuggccuaaaaugggugauauacaggucuu

SEQ ID NO: 284880 - RNA, 64 nt, Human
uggggcugcuucccugucccuucccuccccuuugcuggccuacucuggcauaauucaagugucu

SEQ ID NO: 284881 - RNA, 64 nt, Human
ccaccccuccccuuggggagguggggaggcacugcuggccuagaccagcugcugaaagcuggug

SEQ ID NO: 284882 - RNA, 64 nt, Human
acuaagggccguggaagcuugaccagcgugcugacuggccuagggccccugccccucaccuucu

SEQ ID NO: 284883 - RNA, 64 nt, Human
ucgucaacccuucagccgccgacccgggaggggucuggccuacacuggucuuccccuucccauc

SEQ ID NO: 284884 - RNA, 64 nt, Human
caaacguuucuuucuaacauuguauuuuauaacucuggccuaugauuguguugugucuugcauu

SEQ ID NO: 284885 - RNA, 64 nt, Human
uuacugcagccauucugugugugugguucagacccuggccuagggccggugauguggaugagug

SEQ ID NO: 284886 - RNA, 64 nt, Human
uucccugccaagcaucgugcaauaagugaauuuccuggccuacuucauaaucucuaaguuuggg

SEQ ID NO: 284887 - RNA, 64 nt, Human
agaauugaguuucacaguggaauuggcuuuggaucuggccuauagauuagugacauaaaauauu

SEQ ID NO: 284888 - RNA, 64 nt, Human
ccuacaccaguggaaaagagucuccaguucugcucuggccuacuaacuguuaccacugagagaa

SEQ ID NO: 284889 - RNA, 64 nt, Human
gcauuucuaaggagucucagggaugccuaugcugcuggccuaaaaccacacucagaaacgagga

SEQ ID NO: 284890 - RNA, 64 nt, Human
ucccaugggugugagggugauggguacuccaggacuggccuaugcuguguugugggcuuugguu

SEQ ID NO: 284891 - RNA, 62 nt, Human
accccgcacggcgagacgcggguggcggcagggcgucccagggugcggcaccgcggcuccag

SEQ ID NO: 284892 - RNA, 62 nt, Human
gcgugccuugcuccacccggacucccugggcugcgucccacauccacccuccugccccgugg

SEQ ID NO: 284893 - RNA, 62 nt, Human
cggucugcacguaaccgugaagacguguggccgcgucccaccugcggcuggguacccugcac

SEQ ID NO: 284894 - RNA, 64 nt, Human
accugcccuggggcuuacagcacuauaugaguuccuggccuauccugcaaauaugcccaugcug

SEQ ID NO: 284895 - RNA, 64 nt, Human
uucauccucuuuuaaaaccaaauuuuuuuuucuucuggccuacaaguauuuuuuuuuuaaaaaa

SEQ ID NO: 284896 - RNA, 57 nt, Human
uuugucucacuuuagagugaucauccucuggccuaccuugacacaugcucuccuuca

SEQ ID NO: 284897 - RNA, 64 nt, Human
agucuagaccaacacacaaagauccuggcuaacccuggccuauuuagauuccuuccucucaccu

SEQ ID NO: 284898 - RNA, 64 nt, Human
ugcaaagaagggcccgagcuuaguuuccccaggacuggccuaggaaggagcaccggccacagcu

SEQ ID NO: 284899 - RNA, 64 nt, Human
caaagugcuggauuacaggugugagccaccgugccuggccuaaauaaauaauuucguaagcaua

SEQ ID NO: 284900 - RNA, 64 nt, Human
aagcucacuucuuuggaggcaccuguccagaagccuggccuaggcagcuucaaccuuugaacuu

SEQ ID NO: 284901 - RNA, 64 nt, Human
aaagugcugggauuauaggcguaagccacugugucuggccuaguguaugauuaugcaugaguca

SEQ ID NO: 284902 - RNA, 64 nt, Human
gacugugucacagauuacucccauucagacgucucuggccuaugugaaaaccagugaaucccuu

SEQ ID NO: 284903 - RNA, 64 nt, Human
uagguccuguaggggcuggaaaauaaaccgcaugcuggccuagccuucaaguugcuuuucagcc

SEQ ID NO: 284904 - RNA, 64 nt, Human
guaccucagccagcagaacaucgcugggacgugccuggccuaaggcauccuaccaacagcacca

SEQ ID NO: 284905 - RNA, 64 nt, Human
aagauugagcucucugcccuugaucagccccacccuggccuagaccagcagacagagccaggag

SEQ ID NO: 284906 - RNA, 64 nt, Human
agccuguguuggaacaucccucguuuacggggcgcuggccuaccuccugaggaccucagccaca

SEQ ID NO: 284907 - RNA, 64 nt, Human
aaagugcugggauuacaggcgucagccaccgcgccuggccuauaccaguauuuucuaguuuaaa

SEQ ID NO: 284908 - RNA, 64 nt, Human
aaagcaauaauggucccauccaggcagucgggggcuggccuaggagauaucugagggaggaggc

SEQ ID NO: 284909 - RNA, 62 nt, Human
ccgcugcugcugcugcgcccuuaccuuccccagcgucccagucucuggcaguucuggaaugg

SEQ ID NO: 284910 - RNA, 62 nt, Human
gggcccacagagaugcaugcgcaggcucauaugcgucccaagcagccgcagcgcagccgccg

SEQ ID NO: 284911 - RNA, 62 nt, Human
cucagcccccgggaaaugagcucccagggcuggcgucccaccuuccaggugggggcuggcac

SEQ ID NO: 284912 - RNA, 64 nt, Human
uccaaaguacacuguuucaaacuuuacuauggcccuggccuagcauacguacacauuuuauuuu

SEQ ID NO: 284913 - RNA, 64 nt, Human
auuugcugguuaaaaggauuggggcccaaauccucuggccuagcauuucucaguguuugcuauu

SEQ ID NO: 284914 - RNA, 64 nt, Human
uguauaaaaaagcaauuacccuuaaaacuguacucuggccuacuuuucuauuuugcaauuaaau

SEQ ID NO: 284915 - RNA, 64 nt, Human
cuaccuggucugguugggcagccagaccagcaggcuggccuauguggucuaagguucagccuga

SEQ ID NO: 284916 - RNA, 64 nt, Human
uugggguuuaagaagcccaagccuuguuccugcccuggccuagggagcacucaggaggguuccu

SEQ ID NO: 284917 - RNA, 64 nt, Human
auuuguugcagaaaaacaauggauacauuuucuucuggccuaaaugaauauuuaugugcaaaca

SEQ ID NO: 284918 - RNA, 64 nt, Human
cccuggacugcucucccugcccagcugggccucucuggccuauuccuaccuuccaggcccacug

SEQ ID NO: 284919 - RNA, 64 nt, Human
caugccacaccgguacccuccucccgacugaccacuggccuaccccuuucuccagcccugacua

SEQ ID NO: 284920 - RNA, 64 nt, Human
agagugcugggauuacaggcaugagccacugcaccuggccuaggacugguguccuaagaagagg

SEQ ID NO: 284921 - RNA, 64 nt, Human
cauugaagacaccgcauuugugaacucuugcuuccuggccuagaaccauucagccuacccugua

SEQ ID NO: 284922 - RNA, 64 nt, Human
gaagcagaacagcccagagccccaggugccuggccuggccuagaccucuggaauugagauuaaa

SEQ ID NO: 284923 - RNA, 64 nt, Human
ggcgggugggaccuacccaggcucugagacuuuacuggccuaugccugaggccucuuuuccuuu

SEQ ID NO: 284924 - RNA, 64 nt, Human
cuccaaggacugagacugaccuccucuggugacacuggccuagggccugacacucuccuaagag

SEQ ID NO: 284925 - RNA, 64 nt, Human
ccccagcauuacgaucccccaaguguccuggacccuggccuaaagaaucccacccccacuucau

SEQ ID NO: 284926 - RNA, 64 nt, Human
ucaggcugggcucuccacccaaguuaggccugcucuggccuaauggaucuuacuguaugagcag

SEQ ID NO: 284927 - RNA, 62 nt, Human
uuuugcaaguggcuugaagaggaguuucauucgcgucccaucuuucagaagccuuguccagg

SEQ ID NO: 284928 - RNA, 62 nt, Human
ggcaaaugaaggcgcaugucucucagaacucagcgucccaagacgcucugggcgggccaacu

SEQ ID NO: 284929 - RNA, 62 nt, Human
gcacguugcuucaggcaugggggguggggggagcgucccaaaucaauaagaagguagaauga

SEQ ID NO: 284930 - RNA, 64 nt, Human
gaaucuggugcaccaugcacuuuccugcuagacucuggccuaguucaagcugaccaauggcaga

SEQ ID NO: 284931 - RNA, 64 nt, Human
uuuaaauuaaauuuuuuguuuuuacuaucacaggcuggccuaacuaauacaaaauaggugauga

SEQ ID NO: 284932 - RNA, 64 nt, Human
cccacagagacuggaaugcgucagccugagaccacuggccuauuuucucagcugcccucuugag

SEQ ID NO: 284933 - RNA, 64 nt, Human
uaaugucacuguuuuuauuccuuccaucuagcagcuggccuaaucacucugagucacaggugug

SEQ ID NO: 284934 - RNA, 64 nt, Human
ugcgaaugagcugggcccugggugaggugggggucuggccuaguggggaggggccuggccuggg

SEQ ID NO: 284935 - RNA, 64 nt, Human
uaggugugauaguacuuucaaacagcgccuccaccuggccuacucuguuauuuccaccuguuug

SEQ ID NO: 284936 - RNA, 64 nt, Human
ccagcaaaugccccgagccauugaggacccuauccuggccuacacagcugaaggagagaucaac

SEQ ID NO: 284937 - RNA, 64 nt, Human
aaaucuugcauuaucuuguuuguacagaaauauacuggccuagcagaggcaaaaaaaaaaaaaa

SEQ ID NO: 284938 - RNA, 64 nt, Human
ggaaaccagagucacacugcgcgucugugcaucucuggccuaccgcaguggccccggcugucug

SEQ ID NO: 284939 - RNA, 64 nt, Human
gagaggcuuugagggaugguggaguccggcucugcuggccuagaagcagagugcacccucgugc

SEQ ID NO: 284940 - RNA, 64 nt, Human
uggacugcgagccucgucugggacucggcuggagcuggccuagggaggccugggguaaccuggg

SEQ ID NO: 284941 - RNA, 64 nt, Human
acauauucccaugguagacugugacacagcugagcuggccuauuuuggacgugugaggaugugg

SEQ ID NO: 284942 - RNA, 64 nt, Human
ccucuggacacugccagagauggggguugagccucuggccuaauuuccccccucgcuuccccca

SEQ ID NO: 284943 - RNA, 64 nt, Human
uuuucagaaaaaauauaauugcaaguagguaggacuggccuaaauugucuaauguaauaaaguc

SEQ ID NO: 284944 - RNA, 64 nt, Human
cuggggcuuccccgccacaucgcggcccuccagccuggccuaacacuuggggagccccagcaug

SEQ ID NO: 284945 - RNA, 62 nt, Human
aaccucaagaaccagacugugcagagggcauugcgucccaaucuuuaguccuugcugaauca

SEQ ID NO: 284946 - RNA, 58 nt, Human
ucaccuucuccaagcucugagagcccucgcgucccaggccccagccagggggccggcc

SEQ ID NO: 284947 - RNA, 64 nt, Human; identical to SEQ ID NO: 214080

SEQ ID NO: 284948 - RNA, 64 nt, Human
accugggagcacggcgccuggcucuuaccagcgucuggccuagaggaagccuuugagcgaccuu

SEQ ID NO: 284949 - RNA, 64 nt, Human
uccuugauaauauguauuuucuucuugaauuucacuggccuaaugagauaauacucuuaucuuu

SEQ ID NO: 284950 - RNA, 64 nt, Human
agaaucguucuaguguuuuugccgaagauuaccgcuggccuacugugaagggagaugaccugug

SEQ ID NO: 284951 - RNA, 64 nt, Human
gaaucugcccuuuaauaaagcauuauugagauugcuggccuauuggggaagccugcgggcacag

SEQ ID NO: 284952 - RNA, 64 nt, Human
aaggugacacuggguccaggagcucccuggggcccuggccuaccacucacuggccucgcucccc

SEQ ID NO: 284953 - RNA, 64 nt, Human
aggaggccuggccgccccgacccccuccacggggcuggccuagaagcaaguaguagaauaaaac

SEQ ID NO: 284954 - RNA, 64 nt, Human
uagcgcugaguucaucaaaagggagggggugggccuggccuaaucaggugagccacucacccuc

SEQ ID NO: 284955 - RNA, 64 nt, Human
aaauugcugggauuacaggugugagccaccgcgccuggccuauuauuuuuuguaagaauaaaac

SEQ ID NO: 284956 - RNA, 64 nt, Human
aagcucugggagcuugacuauggaccaaacagcucuggccuagggauugggccacccuacccag

SEQ ID NO: 284957 - RNA, 64 nt, Human
caggcauggcugucuccugccccugccugcccaucuggccuauaccccagccguggggcccggg

SEQ ID NO: 284958 - RNA, 64 nt, Human
uuugccuugguccccauuaugggaugcauuaggacuggccuaugcaucgaaaaucuuuuuguuu

SEQ ID NO: 284959 - RNA, 64 nt, Human
gugcaaucugcuguaugcgcugggcccccaccugcuggccuaccguugccuucaguggcccgca

SEQ ID NO: 284960 - RNA, 64 nt, Human
cgacgaguaugaggcguuccgcaagaggaugaugcuggccuaccgcuuccggcccaacccccug

SEQ ID NO: 284961 - RNA, 55 nt, Human
agaaagagaacuccgagugaggggucuggccuaggcccgggaucggaccaggcuc

SEQ ID NO: 284962 - RNA, 64 nt, Human
gggguuggagggacccugugucuuacucgccccucuggccuaagggccacucugguuaucugcc

SEQ ID NO: 284963 - RNA, 62 nt, Human
uccagccagggguggggaugggguugggcucugcgucccacugagucucauuccucuguccc

SEQ ID NO: 284964 - RNA, 62 nt, Human
ccauagcggggcccacaggcagggguaugagugcgucccacccaacgcagcaccagccccgg

SEQ ID NO: 284965 - RNA, 62 nt, Human
cucgugugaucauucucguggggcugccgugagcgucccagaggccgggagcgugggcccug

SEQ ID NO: 284966 - RNA, 64 nt, Human
ugggauugggguuguugggcagccugccauucaccuggccuauccuggcccuucucaugcccaa

SEQ ID NO: 284967 - RNA, 64 nt, Human
ccagccagugccauguccucugcagguggaguuacuggccuacuccuuccccaugagcccuccc

SEQ ID NO: 284968 - RNA, 64 nt, Human
auuuuauauuucaaauuaaauaauuuuaaaguugcuggccuaaugagcaauguucucaauuuuc

SEQ ID NO: 284969 - RNA, 64 nt, Human
ucuaagcaaguuagcuguagugccauuucagaaacuggccuaaauggcuauguagaacauuuca

SEQ ID NO: 284970 - RNA, 64 nt, Human
aacgugcugggauuacagccgugagccgccgcgccuggccuagacuuguguguucuaaacaggu

SEQ ID NO: 284971 - RNA, 64 nt, Human
ucgccuggaggagggccagcucgcugcccgagcucuggccuagggaccuugccgcugaccaaga

SEQ ID NO: 284972 - RNA, 64 nt, Human
gggaagcacuauggccucagcugggggaaagacccuggccuaggggucuuagccacuccccacc

SEQ ID NO: 284973 - RNA, 64 nt, Human
ugcccugucccugccaugcaacuucacaacucagcuggccuagaccccugggaggccuccaagu

SEQ ID NO: 284974 - RNA, 64 nt, Human
aaagcacugggauuacaggcgugagccacccggccuggccuagaaugacuuuuaaaagaucaaa

SEQ ID NO: 284975 - RNA, 64 nt, Human
aaagugcuggaauuacaggcauuagccaccaugccuggccuauucuggucucuuuaacucucuc

SEQ ID NO: 284976 - RNA, 64 nt, Human
gguugcaugggcuuccugggucuccacucuccgucuggccuaaaggugauguauuugguguuug

SEQ ID NO: 284977 - RNA, 64 nt, Human
ggcccggucccaguccggugccuuccacccugcccuggccuaccacagcugccuccgggccucg

SEQ ID NO: 284978 - RNA, 64 nt, Human
ccagugucuggcccagccauggcuggaugugcaucuggccuaugacccugugccuguguuucau

SEQ ID NO: 284979 - RNA, 64 nt, Human
uacccaagguggagucccccaaagucccuucugucuggccuauccugugcccaccaccuguggc

SEQ ID NO: 284980 - RNA, 64 nt, Human
cacuggagaugggaguuagugaaggggugacucccuggccuaguauagugugacccugggacua

SEQ ID NO: 284981 - RNA, 64 nt, Human
gaggcaccucccacacuccuauggucacagacuucuggccuaggaccccucgccuucaggagaa

SEQ ID NO: 284982 - RNA, 64 nt, Human
cuuggagcuguaaaccagagagcugcuggggauucuggccuagucccuuccacacccccacccc

SEQ ID NO: 284983 - RNA, 64 nt, Human
gcuccugggcauuagcaaggcagagccuuuuuaccuggccuagaaagggcaaggggugaggaua

SEQ ID NO: 284984 - RNA, 64 nt, Human
uuaucuuuugguugucucugcuuaauggaggagccuggccuaggauggaggccuggcuuagauc

SEQ ID NO: 284985 - RNA, 64 nt, Human
ugcuguggguucccaucauuuccugugucagcgccuggccuacccagauuguaucaugugcuag

SEQ ID NO: 284986 - RNA, 64 nt, Human
cauucaaaagaaagcuuuggaaaaaaagagcuggcuggccuaaaaaccuaaauauaugaugaag

SEQ ID NO: 284987 - RNA, 64 nt, Human
aggccugaugggccugguaguuuuccaucuuguucuggccuagaggucaguccuuugcacuucc

SEQ ID NO: 284988 - RNA, 64 nt, Human
ccagugucuucaggcuuuacuggggaccugcgagcuggccuaaugugguggccugcaagccagg

SEQ ID NO: 284989 - RNA, 64 nt, Human; identical to SEQ ID NO: 284740

SEQ ID NO: 284990 - RNA, 64 nt, Human; identical to SEQ ID NO: 284741

SEQ ID NO: 284991 - RNA, 64 nt, Human; identical to SEQ ID NO: 284742

SEQ ID NO: 284992 - RNA, 64 nt, Human
gugucucuuuucaaggucugcccaggaugcugcuucccggcaugcaccuuguuuccauguuguc

SEQ ID NO: 284993 - RNA, 64 nt, Human
cagccgaugccccagcccugcacgccacccacuaucccggcacgcucccucugcagauggucgc

SEQ ID NO: 284994 - RNA, 64 nt, Human
guuuggcugggcaucgaugccuccuuucugggacucccggcacaacuccccucauccagggagg

SEQ ID NO: 284995 - RNA, 64 nt, Human; identical to SEQ ID NO: 284743

SEQ ID NO: 284996 - RNA, 64 nt, Human; identical to SEQ ID NO: 284744

SEQ ID NO: 284997 - RNA, 64 nt, Human; identical to SEQ ID NO: 284745

SEQ ID NO: 284998 - RNA, 64 nt, Human; identical to SEQ ID NO: 284746

SEQ ID NO: 284999 - RNA, 64 nt, Human; identical to SEQ ID NO: 284747

SEQ ID NO: 285000 - RNA, 64 nt, Human; identical to SEQ ID NO: 284751

SEQ ID NO: 285001 - RNA, 64 nt, Human; identical to SEQ ID NO: 284752

SEQ ID NO: 285002 - RNA, 64 nt, Human; identical to SEQ ID NO: 284753

SEQ ID NO: 285003 - RNA, 64 nt, Human; identical to SEQ ID NO: 284754

SEQ ID NO: 285004 - RNA, 64 nt, Human; identical to SEQ ID NO: 284755

SEQ ID NO: 285005 - RNA, 64 nt, Human; identical to SEQ ID NO: 284756

SEQ ID NO: 285006 - RNA, 64 nt, Human; identical to SEQ ID NO: 284757

SEQ ID NO: 285007 - RNA, 64 nt, Human; identical to SEQ ID NO: 284758

SEQ ID NO: 285008 - RNA, 64 nt, Human; identical to SEQ ID NO: 284759

SEQ ID NO: 285009 - RNA, 64 nt, Human; identical to SEQ ID NO: 284760

SEQ ID NO: 285010 - RNA, 62 nt, Human
cagacccaccccagggcacauguccugcgggggcgucccagcuguguuuuuugaugucuccu

SEQ ID NO: 285011 - RNA, 62 nt, Human
aaugugauuauaguuaacacaugacccuucuagcgucccagccaguguuuuuccugaccucu

SEQ ID NO: 285012 - RNA, 64 nt, Human
cugccuuguuggcaaaguauccaucuugucuaucucccggcacuucugaaauauauugcuacca

SEQ ID NO: 285013 - RNA, 64 nt, Human; identical to SEQ ID NO: 284761

SEQ ID NO: 285014 - RNA, 64 nt, Human; identical to SEQ ID NO: 284762

SEQ ID NO: 285015 - RNA, 64 nt, Human; identical to SEQ ID NO: 284763

SEQ ID NO: 285016 - RNA, 64 nt, Human; identical to SEQ ID NO: 284764

SEQ ID NO: 285017 - RNA, 64 nt, Human; identical to SEQ ID NO: 284765

SEQ ID NO: 285018 - RNA, 64 nt, Human; identical to SEQ ID NO: 284769

SEQ ID NO: 285019 - RNA, 64 nt, Human; identical to SEQ ID NO: 284770

SEQ ID NO: 285020 - RNA, 64 nt, Human; identical to SEQ ID NO: 284771

SEQ ID NO: 285021 - RNA, 64 nt, Human; identical to SEQ ID NO: 284772

SEQ ID NO: 285022 - RNA, 64 nt, Human; identical to SEQ ID NO: 284773

SEQ ID NO: 285023 - RNA, 64 nt, Human; identical to SEQ ID NO: 284774

SEQ ID NO: 285024 - RNA, 64 nt, Human; identical to SEQ ID NO: 284775

SEQ ID NO: 285025 - RNA, 64 nt, Human; identical to SEQ ID NO: 284776

SEQ ID NO: 285026 - RNA, 64 nt, Human; identical to SEQ ID NO: 284777

SEQ ID NO: 285027 - RNA, 64 nt, Human; identical to SEQ ID NO: 284778

SEQ ID NO: 285028 - RNA, 64 nt, Human
cagggacgccccugccuagcagccuucgcggaacucccggcaguguuagacgcguugugggucg

SEQ ID NO: 285029 - RNA, 64 nt, Human
ccgcccccagccaggccgaacuccgcacucgcucucccggcagaggggccagaaucgcccggcc

SEQ ID NO: 285030 - RNA, 64 nt, Human
ugcacugcagaugauccugcggaccacgucaaggucccggcacacgcugcuguccacgucgucc

SEQ ID NO: 285031 - RNA, 64 nt, Human; identical to SEQ ID NO: 284779

SEQ ID NO: 285032 - RNA, 64 nt, Human; identical to SEQ ID NO: 284780

SEQ ID NO: 285033 - RNA, 64 nt, Human; identical to SEQ ID NO: 284781

SEQ ID NO: 285034 - RNA, 64 nt, Human; identical to SEQ ID NO: 284782

SEQ ID NO: 285035 - RNA, 64 nt, Human; identical to SEQ ID NO: 284783

SEQ ID NO: 285036 - RNA, 64 nt, Human; identical to SEQ ID NO: 284787

SEQ ID NO: 285037 - RNA, 64 nt, Human; identical to SEQ ID NO: 284788

SEQ ID NO: 285038 - RNA, 64 nt, Human; identical to SEQ ID NO: 284789

SEQ ID NO: 285039 - RNA, 64 nt, Human; identical to SEQ ID NO: 284790

SEQ ID NO: 285040 - RNA, 64 nt, Human; identical to SEQ ID NO: 284791

SEQ ID NO: 285041 - RNA, 64 nt, Human; identical to SEQ ID NO: 284792

SEQ ID NO: 285042 - RNA, 64 nt, Human; identical to SEQ ID NO: 284793

SEQ ID NO: 285043 - RNA, 64 nt, Human; identical to SEQ ID NO: 284794

SEQ ID NO: 285044 - RNA, 64 nt, Human; identical to SEQ ID NO: 284795

SEQ ID NO: 285045 - RNA, 64 nt, Human; identical to SEQ ID NO: 284796

SEQ ID NO: 285046 - RNA, 64 nt, Human
ggacacugugcuguuuuguuucguuucugugaucucccggcacguuuggagcugggaagaccac

SEQ ID NO: 285047 - RNA, 64 nt, Human
ccuggagcugcaggucccccggcaucucucucugucccggcagcccaggauggccuggugcccc

SEQ ID NO: 285048 - RNA, 64 nt, Human
ggguguggcccugccaucuucccagcagggccacucccggcacuccaugcuuagucacugccug

SEQ ID NO: 285049 - RNA, 64 nt, Human; identical to SEQ ID NO: 284797

SEQ ID NO: 285050 - RNA, 64 nt, Human; identical to SEQ ID NO: 284798

SEQ ID NO: 285051 - RNA, 64 nt, Human; identical to SEQ ID NO: 284799

SEQ ID NO: 285052 - RNA, 64 nt, Human; identical to SEQ ID NO: 284800

SEQ ID NO: 285053 - RNA, 64 nt, Human; identical to SEQ ID NO: 284801

SEQ ID NO: 285054 - RNA, 64 nt, Human; identical to SEQ ID NO: 284805

SEQ ID NO: 285055 - RNA, 64 nt, Human; identical to SEQ ID NO: 284806

SEQ ID NO: 285056 - RNA, 64 nt, Human; identical to SEQ ID NO: 284807

SEQ ID NO: 285057 - RNA, 64 nt, Human; identical to SEQ ID NO: 284808

SEQ ID NO: 285058 - RNA, 64 nt, Human; identical to SEQ ID NO: 284809

SEQ ID NO: 285059 - RNA, 64 nt, Human; identical to SEQ ID NO: 284810

SEQ ID NO: 285060 - RNA, 64 nt, Human; identical to SEQ ID NO: 284811

SEQ ID NO: 285061 - RNA, 64 nt, Human; identical to SEQ ID NO: 284812

SEQ ID NO: 285062 - RNA, 64 nt, Human; identical to SEQ ID NO: 284813

SEQ ID NO: 285063 - RNA, 64 nt, Human; identical to SEQ ID NO: 284814

SEQ ID NO: 285064 - RNA, 64 nt, Human
aggcucugccaggcgcaguggcucaugccuauaaucccggcacuuugggagucuguggcaggag

SEQ ID NO: 285065 - RNA, 64 nt, Human
ccccacagggacugguggcugguuccagggcucgucccggcauuucaugucuucccacgggguu

SEQ ID NO: 285066 - RNA, 64 nt, Human
ggggacaagagagggccagggucugugcuucugcucccggcacuggucagggagucugggaaga

SEQ ID NO: 285067 - RNA, 64 nt, Human; identical to SEQ ID NO: 284815

SEQ ID NO: 285068 - RNA, 64 nt, Human; identical to SEQ ID NO: 284816

SEQ ID NO: 285069 - RNA, 64 nt, Human; identical to SEQ ID NO: 284817

SEQ ID NO: 285070 - RNA, 64 nt, Human; identical to SEQ ID NO: 284818

SEQ ID NO: 285071 - RNA, 64 nt, Human; identical to SEQ ID NO: 284819

SEQ ID NO: 285072 - RNA, 64 nt, Human; identical to SEQ ID NO: 284822

SEQ ID NO: 285073 - RNA, 64 nt, Human; identical to SEQ ID NO: 284823

SEQ ID NO: 285074 - RNA, 64 nt, Human; identical to SEQ ID NO: 284824

SEQ ID NO: 285075 - RNA, 64 nt, Human; identical to SEQ ID NO: 284825

SEQ ID NO: 285076 - RNA, 64 nt, Human; identical to SEQ ID NO: 284826

SEQ ID NO: 285077 - RNA, 64 nt, Human; identical to SEQ ID NO: 284827

SEQ ID NO: 285078 - RNA, 64 nt, Human; identical to SEQ ID NO: 284828

SEQ ID NO: 285079 - RNA, 64 nt, Human; identical to SEQ ID NO: 284829

SEQ ID NO: 285080 - RNA, 64 nt, Human; identical to SEQ ID NO: 284830

SEQ ID NO: 285081 - RNA, 64 nt, Human; identical to SEQ ID NO: 284831

SEQ ID NO: 285082 - RNA, 64 nt, Human
accuaggggggacauggagggcgguuguugccucucccggcauuucuccucagucuccugucca

SEQ ID NO: 285083 - RNA, 64 nt, Human
gacuuguaccuggagcaggaggaacuccaguccgucccggcauccauggcagcccgcgguuagg

SEQ ID NO: 285084 - RNA, 64 nt, Human
gcuguuuuuaaugaaacugaaaaaauagacuugaucccggcaggacugugauacagagcccuag

SEQ ID NO: 285085 - RNA, 64 nt, Human; identical to SEQ ID NO: 284832

SEQ ID NO: 285086 - RNA, 64 nt, Human; identical to SEQ ID NO: 284833

SEQ ID NO: 285087 - RNA, 64 nt, Human; identical to SEQ ID NO: 284834

SEQ ID NO: 285088 - RNA, 64 nt, Human; identical to SEQ ID NO: 284835

SEQ ID NO: 285089 - RNA, 64 nt, Human; identical to SEQ ID NO: 284836

SEQ ID NO: 285090 - RNA, 64 nt, Human; identical to SEQ ID NO: 284840

SEQ ID NO: 285091 - RNA, 64 nt, Human; identical to SEQ ID NO: 284841

SEQ ID NO: 285092 - RNA, 64 nt, Human; identical to SEQ ID NO: 284842

SEQ ID NO: 285093 - RNA, 64 nt, Human; identical to SEQ ID NO: 284843

SEQ ID NO: 285094 - RNA, 64 nt, Human; identical to SEQ ID NO: 284844

SEQ ID NO: 285095 - RNA, 64 nt, Human; identical to SEQ ID NO: 284845

SEQ ID NO: 285096 - RNA, 64 nt, Human; identical to SEQ ID NO: 284846

SEQ ID NO: 285097 - RNA, 64 nt, Human; identical to SEQ ID NO: 284847

SEQ ID NO: 285098 - RNA, 64 nt, Human; identical to SEQ ID NO: 284848

SEQ ID NO: 285099 - RNA, 64 nt, Human; identical to SEQ ID NO: 284849

SEQ ID NO: 285100 - RNA, 64 nt, Human
cagcuaccccugcagcuggggaagacuuaugccaucccggcagcgaggcugggcuggccagcca

SEQ ID NO: 285101 - RNA, 58 nt, Human; identical to SEQ ID NO: 284850

SEQ ID NO: 285102 - RNA, 64 nt, Human; identical to SEQ ID NO: 284851

SEQ ID NO: 285103 - RNA, 64 nt, Human; identical to SEQ ID NO: 284852

SEQ ID NO: 285104 - RNA, 64 nt, Human; identical to SEQ ID NO: 284853

SEQ ID NO: 285105 - RNA, 64 nt, Human; identical to SEQ ID NO: 284854

SEQ ID NO: 285106 - RNA, 64 nt, Human; identical to SEQ ID NO: 284858

SEQ ID NO: 285107 - RNA, 64 nt, Human; identical to SEQ ID NO: 284859

SEQ ID NO: 285108 - RNA, 64 nt, Human; identical to SEQ ID NO: 284860

SEQ ID NO: 285109 - RNA, 64 nt, Human; identical to SEQ ID NO: 284861

SEQ ID NO: 285110 - RNA, 64 nt, Human; identical to SEQ ID NO: 284862

SEQ ID NO: 285111 - RNA, 56 nt, Human; identical to SEQ ID NO: 284863

SEQ ID NO: 285112 - RNA, 64 nt, Human; identical to SEQ ID NO: 284864

SEQ ID NO: 285113 - RNA, 64 nt, Human; identical to SEQ ID NO: 284865

SEQ ID NO: 285114 - RNA, 64 nt, Human; identical to SEQ ID NO: 284866

SEQ ID NO: 285115 - RNA, 64 nt, Human; identical to SEQ ID NO: 284867

SEQ ID NO: 285116 - RNA, 64 nt, Human
ggacucucccuacugccugagcaaaccugaggccucccggcagacccacccacccccuggggcu

SEQ ID NO: 285117 - RNA, 64 nt, Human
cuuuggcaaggauguucggcuggucucccuuggcucccggcagaaccuuuguguaaaugaagac

SEQ ID NO: 285118 - RNA, 64 nt, Human
gaaucaggagagggauacaagagaggagauggggucccggcacccaucuguaucaucagugccu

SEQ ID NO: 285119 - RNA, 64 nt, Human; identical to SEQ ID NO: 284868

SEQ ID NO: 285120 - RNA, 60 nt, Human; identical to SEQ ID NO: 284869

SEQ ID NO: 285121 - RNA, 64 nt, Human; identical to SEQ ID NO: 284870

SEQ ID NO: 285122 - RNA, 64 nt, Human; identical to SEQ ID NO: 284871

SEQ ID NO: 285123 - RNA, 64 nt, Human; identical to SEQ ID NO: 284872

SEQ ID NO: 285124 - RNA, 64 nt, Human; identical to SEQ ID NO: 284876

SEQ ID NO: 285125 - RNA, 64 nt, Human; identical to SEQ ID NO: 284877

SEQ ID NO: 285126 - RNA, 64 nt, Human; identical to SEQ ID NO: 284878

SEQ ID NO: 285127 - RNA, 64 nt, Human; identical to SEQ ID NO: 284879

SEQ ID NO: 285128 - RNA, 64 nt, Human; identical to SEQ ID NO: 284880

SEQ ID NO: 285129 - RNA, 64 nt, Human; identical to SEQ ID NO: 284881

SEQ ID NO: 285130 - RNA, 64 nt, Human; identical to SEQ ID NO: 284882

SEQ ID NO: 285131 - RNA, 64 nt, Human; identical to SEQ ID NO: 284883

SEQ ID NO: 285132 - RNA, 64 nt, Human; identical to SEQ ID NO: 284884

SEQ ID NO: 285133 - RNA, 64 nt, Human; identical to SEQ ID NO: 284885

SEQ ID NO: 285134 - RNA, 62 nt, Human
acaacauuccagccccacccucaggcuggagggcgucccagccuaaucccgagcuggggcac

SEQ ID NO: 285135 - RNA, 62 nt, Human
ucuagguucaaaagaaguuguaguguuaucaggcgucccauaccuuguuuuuaaucuccugu

SEQ ID NO: 285136 - RNA, 62 nt, Human
guauuuuuuuuaaugaaauauuauugcuggaggcgucccaggcaagccuggcuguaguagcg

SEQ ID NO: 285137 - RNA, 64 nt, Human; identical to SEQ ID NO: 284886

SEQ ID NO: 285138 - RNA, 64 nt, Human; identical to SEQ ID NO: 284887

SEQ ID NO: 285139 - RNA, 64 nt, Human; identical to SEQ ID NO: 284888

SEQ ID NO: 285140 - RNA, 64 nt, Human; identical to SEQ ID NO: 284889

SEQ ID NO: 285141 - RNA, 64 nt, Human; identical to SEQ ID NO: 284890

SEQ ID NO: 285142 - RNA, 64 nt, Human; identical to SEQ ID NO: 284894

SEQ ID NO: 285143 - RNA, 64 nt, Human; identical to SEQ ID NO: 284895

SEQ ID NO: 285144 - RNA, 57 nt, Human; identical to SEQ ID NO: 284896

SEQ ID NO: 285145 - RNA, 64 nt, Human; identical to SEQ ID NO: 284897

SEQ ID NO: 285146 - RNA, 64 nt, Human; identical to SEQ ID NO: 284898

SEQ ID NO: 285147 - RNA, 64 nt, Human; identical to SEQ ID NO: 284899

SEQ ID NO: 285148 - RNA, 64 nt, Human; identical to SEQ ID NO: 284900

SEQ ID NO: 285149 - RNA, 64 nt, Human; identical to SEQ ID NO: 284901

SEQ ID NO: 285150 - RNA, 64 nt, Human; identical to SEQ ID NO: 284902

SEQ ID NO: 285151 - RNA, 64 nt, Human; identical to SEQ ID NO: 284903

SEQ ID NO: 285152 - RNA, 62 nt, Human
uucgcacuuccauccucucccacuuccaucuggcgucccacaccuuguccccugcacuucug

SEQ ID NO: 285153 - RNA, 62 nt, Human
acucagccacaaagccccccagcucccacaccgcgucccagcuccccucuuuuguaaguaug

SEQ ID NO: 285154 - RNA, 62 nt, Human
gccgcugcaccaccacccgagccugggagccagcgucccagccuaaucacggaucugcugcc

SEQ ID NO: 285155 - RNA, 64 nt, Human; identical to SEQ ID NO: 284904

SEQ ID NO: 285156 - RNA, 64 nt, Human; identical to SEQ ID NO: 284905

SEQ ID NO: 285157 - RNA, 64 nt, Human; identical to SEQ ID NO: 284906

SEQ ID NO: 285158 - RNA, 64 nt, Human; identical to SEQ ID NO: 284907

SEQ ID NO: 285159 - RNA, 64 nt, Human; identical to SEQ ID NO: 284908

SEQ ID NO: 285160 - RNA, 64 nt, Human; identical to SEQ ID NO: 284912

SEQ ID NO: 285161 - RNA, 64 nt, Human; identical to SEQ ID NO: 284913

SEQ ID NO: 285162 - RNA, 64 nt, Human; identical to SEQ ID NO: 284914

SEQ ID NO: 285163 - RNA, 64 nt, Human; identical to SEQ ID NO: 284915

SEQ ID NO: 285164 - RNA, 64 nt, Human; identical to SEQ ID NO: 284916

SEQ ID NO: 285165 - RNA, 64 nt, Human; identical to SEQ ID NO: 284917

SEQ ID NO: 285166 - RNA, 64 nt, Human; identical to SEQ ID NO: 284918

SEQ ID NO: 285167 - RNA, 64 nt, Human; identical to SEQ ID NO: 284919

SEQ ID NO: 285168 - RNA, 64 nt, Human; identical to SEQ ID NO: 284920

SEQ ID NO: 285169 - RNA, 64 nt, Human; identical to SEQ ID NO: 284921

SEQ ID NO: 285170 - RNA, 62 nt, Human
cgcgccccccgccguuggcugcgggagagcccgcgucccacucccgugcucgccucgacccc

SEQ ID NO: 285171 - RNA, 62 nt, Human
gggucuuucuuucauaaaggaccucauuccuugcgucccagcccaggaacagugcugucuuu

SEQ ID NO: 285172 - RNA, 64 nt, Human
cuaauuacagaccccaccaguacagcuugacagcucccggcaccaucccuuccuucaucugacu

SEQ ID NO: 285173 - RNA, 64 nt, Human; identical to SEQ ID NO: 284922

SEQ ID NO: 285174 - RNA, 64 nt, Human; identical to SEQ ID NO: 284923

SEQ ID NO: 285175 - RNA, 64 nt, Human; identical to SEQ ID NO: 284924

SEQ ID NO: 285176 - RNA, 64 nt, Human; identical to SEQ ID NO: 284925

SEQ ID NO: 285177 - RNA, 64 nt, Human; identical to SEQ ID NO: 284926

SEQ ID NO: 285178 - RNA, 64 nt, Human; identical to SEQ ID NO: 284930

SEQ ID NO: 285179 - RNA, 64 nt, Human; identical to SEQ ID NO: 284931

SEQ ID NO: 285180 - RNA, 64 nt, Human; identical to SEQ ID NO: 284932

SEQ ID NO: 285181 - RNA, 64 nt, Human; identical to SEQ ID NO: 284933

SEQ ID NO: 285182 - RNA, 64 nt, Human; identical to SEQ ID NO: 284934

SEQ ID NO: 285183 - RNA, 64 nt, Human; identical to SEQ ID NO: 284935

SEQ ID NO: 285184 - RNA, 64 nt, Human; identical to SEQ ID NO: 284936

SEQ ID NO: 285185 - RNA, 64 nt, Human; identical to SEQ ID NO: 284937

SEQ ID NO: 285186 - RNA, 64 nt, Human; identical to SEQ ID NO: 284938

SEQ ID NO: 285187 - RNA, 64 nt, Human; identical to SEQ ID NO: 284939

SEQ ID NO: 285188 - RNA, 62 nt, Human
cguggcccgcugggacuggccgccccuccccagcgucccagggcucugguucuggagggcca

SEQ ID NO: 285189 - RNA, 62 nt, Human
gcucagccaagaaacuuucccgugucacgccugcgucccaccguggggcucucuuggagcac

SEQ ID NO: 285190 - RNA, 62 nt, Human
gccuuccucgauguggcccaaaguggcccaaagcgucccaaaguaggccucgccaggcccac

SEQ ID NO: 285191 - RNA, 64 nt, Human; identical to SEQ ID NO: 284940

SEQ ID NO: 285192 - RNA, 64 nt, Human; identical to SEQ ID NO: 284941

SEQ ID NO: 285193 - RNA, 64 nt, Human; identical to SEQ ID NO: 284942

SEQ ID NO: 285194 - RNA, 64 nt, Human; identical to SEQ ID NO: 284943

SEQ ID NO: 285195 - RNA, 64 nt, Human; identical to SEQ ID NO: 284944

SEQ ID NO: 285196 - RNA, 64 nt, Human; identical to SEQ ID NO: 284948

SEQ ID NO: 285197 - RNA, 64 nt, Human; identical to SEQ ID NO: 284949

SEQ ID NO: 285198 - RNA, 64 nt, Human; identical to SEQ ID NO: 284950

SEQ ID NO: 285199 - RNA, 64 nt, Human; identical to SEQ ID NO: 284951

SEQ ID NO: 285200 - RNA, 64 nt, Human; identical to SEQ ID NO: 284952

SEQ ID NO: 285201 - RNA, 64 nt, Human; identical to SEQ ID NO: 284953

SEQ ID NO: 285202 - RNA, 64 nt, Human; identical to SEQ ID NO: 284954

SEQ ID NO: 285203 - RNA, 64 nt, Human; identical to SEQ ID NO: 284955

SEQ ID NO: 285204 - RNA, 64 nt, Human; identical to SEQ ID NO: 284956

SEQ ID NO: 285205 - RNA, 64 nt, Human; identical to SEQ ID NO: 284957

SEQ ID NO: 285206 - RNA, 62 nt, Human
cguggugccauccccagggggcaugaccagaugcgucccaagauguugauuuuuacuguguu

SEQ ID NO: 285207 - RNA, 64 nt, Human; identical to SEQ ID NO: 284958

SEQ ID NO: 285208 - RNA, 64 nt, Human; identical to SEQ ID NO: 284959

SEQ ID NO: 285209 - RNA, 64 nt, Human; identical to SEQ ID NO: 284960

SEQ ID NO: 285210 - RNA, 55 nt, Human; identical to SEQ ID NO: 284961

SEQ ID NO: 285211 - RNA, 64 nt, Human; identical to SEQ ID NO: 284962

SEQ ID NO: 285212 - RNA, 64 nt, Human; identical to SEQ ID NO: 284966

SEQ ID NO: 285213 - RNA, 64 nt, Human; identical to SEQ ID NO: 284967

SEQ ID NO: 285214 - RNA, 64 nt, Human; identical to SEQ ID NO: 284968

SEQ ID NO: 285215 - RNA, 64 nt, Human; identical to SEQ ID NO: 284969

SEQ ID NO: 285216 - RNA, 64 nt, Human; identical to SEQ ID NO: 284970

SEQ ID NO: 285217 - RNA, 64 nt, Human; identical to SEQ ID NO: 284971

SEQ ID NO: 285218 - RNA, 64 nt, Human; identical to SEQ ID NO: 284972

SEQ ID NO: 285219 - RNA, 64 nt, Human; identical to SEQ ID NO: 284973

SEQ ID NO: 285220 - RNA, 64 nt, Human; identical to SEQ ID NO: 284974

SEQ ID NO: 285221 - RNA, 64 nt, Human; identical to SEQ ID NO: 284975

SEQ ID NO: 285222 - RNA, 60 nt, Human
gcuuuugcguggugaccugagcggcucggggcgucccagcgacgcgggaaggggcagggc

SEQ ID NO: 285223 - RNA, 62 nt, Human
gcccagcaaccugccagcuacaggagcccccugcgucccagagacucccucacccaggcagg

SEQ ID NO: 285224 - RNA, 62 nt, Human
ggcacugcagggacacuggugucuuccauguagcgucccagcuuugggcuccuguaacagac

SEQ ID NO: 285225 - RNA, 64 nt, Human; identical to SEQ ID NO: 284976

SEQ ID NO: 285226 - RNA, 64 nt, Human; identical to SEQ ID NO: 284977

SEQ ID NO: 285227 - RNA, 64 nt, Human; identical to SEQ ID NO: 284978

SEQ ID NO: 285228 - RNA, 64 nt, Human; identical to SEQ ID NO: 284979

SEQ ID NO: 285229 - RNA, 64 nt, Human; identical to SEQ ID NO: 284980

SEQ ID NO: 285230 - RNA, 64 nt, Human; identical to SEQ ID NO: 284981

SEQ ID NO: 285231 - RNA, 64 nt, Human; identical to SEQ ID NO: 284982

SEQ ID NO: 285232 - RNA, 64 nt, Human; identical to SEQ ID NO: 284983

SEQ ID NO: 285233 - RNA, 64 nt, Human; identical to SEQ ID NO: 284984

SEQ ID NO: 285234 - RNA, 64 nt, Human; identical to SEQ ID NO: 284985

SEQ ID NO: 285235 - RNA, 64 nt, Human; identical to SEQ ID NO: 284986

SEQ ID NO: 285236 - RNA, 64 nt, Human; identical to SEQ ID NO: 284987

SEQ ID NO: 285237 - RNA, 64 nt, Human; identical to SEQ ID NO: 284988

SEQ ID NO: 285238 - RNA, 62 nt, Human
cugucuuuuccagcuggagcagcugggcauaagcgucccaccugcaacaaggugggcguuua

SEQ ID NO: 285239 - RNA, 64 nt, Human; identical to SEQ ID NO: 284740

SEQ ID NO: 285240 - RNA, 64 nt, Human; identical to SEQ ID NO: 284741

SEQ ID NO: 285241 - RNA, 64 nt, Human; identical to SEQ ID NO: 284742

SEQ ID NO: 285242 - RNA, 64 nt, Human; identical to SEQ ID NO: 284743

SEQ ID NO: 285243 - RNA, 64 nt, Human; identical to SEQ ID NO: 284744

SEQ ID NO: 285244 - RNA, 64 nt, Human; identical to SEQ ID NO: 284745

SEQ ID NO: 285245 - RNA, 64 nt, Human; identical to SEQ ID NO: 284746

SEQ ID NO: 285246 - RNA, 64 nt, Human; identical to SEQ ID NO: 284747

SEQ ID NO: 285247 - RNA, 64 nt, Human; identical to SEQ ID NO: 284751

SEQ ID NO: 285248 - RNA, 64 nt, Human; identical to SEQ ID NO: 284752

SEQ ID NO: 285249 - RNA, 64 nt, Human; identical to SEQ ID NO: 284753

SEQ ID NO: 285250 - RNA, 64 nt, Human; identical to SEQ ID NO: 284754

SEQ ID NO: 285251 - RNA, 64 nt, Human; identical to SEQ ID NO: 284755

SEQ ID NO: 285252 - RNA, 59 nt, Human
uuuaaauagucccuaaucccuaauuugcacuaguuaacccuggucagggucccuguauu

SEQ ID NO: 285253 - RNA, 59 nt, Human
cuucagaagaagcuucauucccucuuaaucuaguuaagccaggacauccagaauucauu

SEQ ID NO: 285254 - RNA, 59 nt, Human
agugagaucauuuacuuccccggcacgcccuaguuaagcagcugacauaagacagcccg

SEQ ID NO: 285255 - RNA, 64 nt, Human; identical to SEQ ID NO: 284756

SEQ ID NO: 285256 - RNA, 64 nt, Human; identical to SEQ ID NO: 284757

SEQ ID NO: 285257 - RNA, 64 nt, Human; identical to SEQ ID NO: 284758

SEQ ID NO: 285258 - RNA, 64 nt, Human; identical to SEQ ID NO: 284759

SEQ ID NO: 285259 - RNA, 64 nt, Human; identical to SEQ ID NO: 284760

SEQ ID NO: 285260 - RNA, 64 nt, Human; identical to SEQ ID NO: 284761

SEQ ID NO: 285261 - RNA, 64 nt, Human; identical to SEQ ID NO: 284762

SEQ ID NO: 285262 - RNA, 64 nt, Human; identical to SEQ ID NO: 284763

SEQ ID NO: 285263 - RNA, 64 nt, Human; identical to SEQ ID NO: 284764

SEQ ID NO: 285264 - RNA, 64 nt, Human; identical to SEQ ID NO: 284765

SEQ ID NO: 285265 - RNA, 64 nt, Human; identical to SEQ ID NO: 284769

SEQ ID NO: 285266 - RNA, 64 nt, Human; identical to SEQ ID NO: 284770

SEQ ID NO: 285267 - RNA, 64 nt, Human; identical to SEQ ID NO: 284771

SEQ ID NO: 285268 - RNA, 64 nt, Human; identical to SEQ ID NO: 284772

SEQ ID NO: 285269 - RNA, 64 nt, Human; identical to SEQ ID NO: 284773

SEQ ID NO: 285270 - RNA, 59 nt, Human
uuauucagcaaccagaaaauaagcugguacuaguuaaacaauuggauaauaucuuggcu

SEQ ID NO: 285271 - RNA, 59 nt, Human
uauccauagaucuaaggggcaaacagauacuaguuaacugcccccaccucugucucccu

SEQ ID NO: 285272 - RNA, 59 nt, Human
aaagggaagaaaguauaauagaaacuuugcuaguuaaaaaaaaaagaaaaaaaaagaaa

SEQ ID NO: 285273 - RNA, 64 nt, Human; identical to SEQ ID NO: 284774

SEQ ID NO: 285274 - RNA, 64 nt, Human; identical to SEQ ID NO: 284775

SEQ ID NO: 285275 - RNA, 64 nt, Human; identical to SEQ ID NO: 284776

SEQ ID NO: 285276 - RNA, 64 nt, Human; identical to SEQ ID NO: 284777

SEQ ID NO: 285277 - RNA, 64 nt, Human; identical to SEQ ID NO: 284778

SEQ ID NO: 285278 - RNA, 64 nt, Human; identical to SEQ ID NO: 284779

SEQ ID NO: 285279 - RNA, 64 nt, Human; identical to SEQ ID NO: 284780

SEQ ID NO: 285280 - RNA, 64 nt, Human; identical to SEQ ID NO: 284781

SEQ ID NO: 285281 - RNA, 64 nt, Human; identical to SEQ ID NO: 284782

SEQ ID NO: 285282 - RNA, 64 nt, Human; identical to SEQ ID NO: 284783

SEQ ID NO: 285283 - RNA, 64 nt, Human; identical to SEQ ID NO: 284787

SEQ ID NO: 285284 - RNA, 64 nt, Human; identical to SEQ ID NO: 284788

SEQ ID NO: 285285 - RNA, 64 nt, Human; identical to SEQ ID NO: 284789

SEQ ID NO: 285286 - RNA, 64 nt, Human; identical to SEQ ID NO: 284790

SEQ ID NO: 285287 - RNA, 64 nt, Human; identical to SEQ ID NO: 284791

SEQ ID NO: 285288 - RNA, 59 nt, Human
aauagggcugguggcucucuugguaagaucuaguuaauauaaaugaucaccuuucauug

SEQ ID NO: 285289 - RNA, 59 nt, Human
aaaaugcaaauuaaguuacucuuaaaacucuaguuaaaauacuugauguacauaaagug

SEQ ID NO: 285290 - RNA, 59 nt, Human
uucccagagcuccaccccaaccaggagcucuaguuaauggagagcucccagcacacucg

SEQ ID NO: 285291 - RNA, 64 nt, Human; identical to SEQ ID NO: 284792

SEQ ID NO: 285292 - RNA, 64 nt, Human; identical to SEQ ID NO: 284793

SEQ ID NO: 285293 - RNA, 64 nt, Human; identical to SEQ ID NO: 284794

SEQ ID NO: 285294 - RNA, 64 nt, Human; identical to SEQ ID NO: 284795

SEQ ID NO: 285295 - RNA, 64 nt, Human; identical to SEQ ID NO: 284796

SEQ ID NO: 285296 - RNA, 64 nt, Human; identical to SEQ ID NO: 284797

SEQ ID NO: 285297 - RNA, 64 nt, Human; identical to SEQ ID NO: 284798

SEQ ID NO: 285298 - RNA, 64 nt, Human; identical to SEQ ID NO: 284799

SEQ ID NO: 285299 - RNA, 64 nt, Human; identical to SEQ ID NO: 284800

SEQ ID NO: 285300 - RNA, 64 nt, Human; identical to SEQ ID NO: 284801

SEQ ID NO: 285301 - RNA, 64 nt, Human; identical to SEQ ID NO: 284805

SEQ ID NO: 285302 - RNA, 64 nt, Human; identical to SEQ ID NO: 284806

SEQ ID NO: 285303 - RNA, 64 nt, Human; identical to SEQ ID NO: 284807

SEQ ID NO: 285304 - RNA, 64 nt, Human; identical to SEQ ID NO: 284808

SEQ ID NO: 285305 - RNA, 64 nt, Human; identical to SEQ ID NO: 284809

SEQ ID NO: 285306 - RNA, 59 nt, Human
gaggccaguuaauuuaaaaaaaacagucgcuaguuaacagcgacagagcccagcacccu

SEQ ID NO: 285307 - RNA, 59 nt, Human
aggaggcaaagguucuaucugcuuagcaacuaguuaauaagugguaucugacacacucu

SEQ ID NO: 285308 - RNA, 50 nt, Human
aagggggcccggcucccuaggcgucccaucucggugagucccuggcaacu

SEQ ID NO: 285309 - RNA, 64 nt, Human; identical to SEQ ID NO: 284810

SEQ ID NO: 285310 - RNA, 64 nt, Human; identical to SEQ ID NO: 284811

SEQ ID NO: 285311 - RNA, 64 nt, Human; identical to SEQ ID NO: 284812

SEQ ID NO: 285312 - RNA, 64 nt, Human; identical to SEQ ID NO: 284813

SEQ ID NO: 285313 - RNA, 64 nt, Human; identical to SEQ ID NO: 284814

SEQ ID NO: 285314 - RNA, 64 nt, Human; identical to SEQ ID NO: 284815

SEQ ID NO: 285315 - RNA, 64 nt, Human; identical to SEQ ID NO: 284816

SEQ ID NO: 285316 - RNA, 64 nt, Human; identical to SEQ ID NO: 284817

SEQ ID NO: 285317 - RNA, 64 nt, Human; identical to SEQ ID NO: 284818

SEQ ID NO: 285318 - RNA, 64 nt, Human; identical to SEQ ID NO: 284819

SEQ ID NO: 285319 - RNA, 64 nt, Human; identical to SEQ ID NO: 284822

SEQ ID NO: 285320 - RNA, 64 nt, Human; identical to SEQ ID NO: 284823

SEQ ID NO: 285321 - RNA, 64 nt, Human; identical to SEQ ID NO: 284824

SEQ ID NO: 285322 - RNA, 64 nt, Human; identical to SEQ ID NO: 284825

SEQ ID NO: 285323 - RNA, 64 nt, Human; identical to SEQ ID NO: 284826

SEQ ID NO: 285324 - RNA, 59 nt, Human
auuuucauuugagaauuucucaauuguaucuaguuaaauagcacaguuuggaaacuugu

SEQ ID NO: 285325 - RNA, 59 nt, Human
ucacccaaugccaagggcagaaagcaaaccuaguuaaauaggugagaaaaaaaauaaua

SEQ ID NO: 285326 - RNA, 59 nt, Human
uucuuuuaauuauuuuagacacuugaguucuaguuaaaucuuaaccauguucuuaaguc

SEQ ID NO: 285327 - RNA, 64 nt, Human; identical to SEQ ID NO: 284827

SEQ ID NO: 285328 - RNA, 64 nt, Human; identical to SEQ ID NO: 284828

SEQ ID NO: 285329 - RNA, 64 nt, Human; identical to SEQ ID NO: 284829

SEQ ID NO: 285330 - RNA, 64 nt, Human; identical to SEQ ID NO: 284830

SEQ ID NO: 285331 - RNA, 64 nt, Human; identical to SEQ ID NO: 284831

SEQ ID NO: 285332 - RNA, 64 nt, Human; identical to SEQ ID NO: 284832

SEQ ID NO: 285333 - RNA, 64 nt, Human; identical to SEQ ID NO: 284833

SEQ ID NO: 285334 - RNA, 64 nt, Human; identical to SEQ ID NO: 284834

SEQ ID NO: 285335 - RNA, 64 nt, Human; identical to SEQ ID NO: 284835

SEQ ID NO: 285336 - RNA, 64 nt, Human; identical to SEQ ID NO: 284836

SEQ ID NO: 285337 - RNA, 64 nt, Human; identical to SEQ ID NO: 284840

SEQ ID NO: 285338 - RNA, 64 nt, Human; identical to SEQ ID NO: 284841

SEQ ID NO: 285339 - RNA, 64 nt, Human; identical to SEQ ID NO: 284842

SEQ ID NO: 285340 - RNA, 64 nt, Human; identical to SEQ ID NO: 284843

SEQ ID NO: 285341 - RNA, 64 nt, Human; identical to SEQ ID NO: 284844

SEQ ID NO: 285342 - RNA, 59 nt, Human
auuccauauauuuugaauauuuaacucaucuaguuaauaauguuuuuauuccaugcgaa

SEQ ID NO: 285343 - RNA, 59 nt, Human
aacuuuccuuucaauguagcaaagcauuccuaguuaaccagagccuuggaaucuacugc

SEQ ID NO: 285344 - RNA, 59 nt, Human
gggcuggguuuuggauuaacccauccuuccuaguuaacaccuuuuuguuuuuauuuuau

SEQ ID NO: 285345 - RNA, 64 nt, Human; identical to SEQ ID NO: 284845

SEQ ID NO: 285346 - RNA, 64 nt, Human; identical to SEQ ID NO: 284846

SEQ ID NO: 285347 - RNA, 64 nt, Human; identical to SEQ ID NO: 284847

SEQ ID NO: 285348 - RNA, 64 nt, Human; identical to SEQ ID NO: 284848

SEQ ID NO: 285349 - RNA, 64 nt, Human; identical to SEQ ID NO: 284849

SEQ ID NO: 285350 - RNA, 58 nt, Human; identical to SEQ ID NO: 284850

SEQ ID NO: 285351 - RNA, 64 nt, Human; identical to SEQ ID NO: 284851

SEQ ID NO: 285352 - RNA, 64 nt, Human; identical to SEQ ID NO: 284852

SEQ ID NO: 285353 - RNA, 64 nt, Human; identical to SEQ ID NO: 284853

SEQ ID NO: 285354 - RNA, 64 nt, Human; identical to SEQ ID NO: 284854

SEQ ID NO: 285355 - RNA, 64 nt, Human; identical to SEQ ID NO: 284858

SEQ ID NO: 285356 - RNA, 64 nt, Human; identical to SEQ ID NO: 284859

SEQ ID NO: 285357 - RNA, 64 nt, Human; identical to SEQ ID NO: 284860

SEQ ID NO: 285358 - RNA, 64 nt, Human; identical to SEQ ID NO: 284861

SEQ ID NO: 285359 - RNA, 64 nt, Human; identical to SEQ ID NO: 284862

SEQ ID NO: 285360 - RNA, 62 nt, Human
ccaaaccuggucacacagcauccugcaccuuagcgucccauguaagggacucugcaagcuug

SEQ ID NO: 285361 - RNA, 62 nt, Human
caauagugaccucacuuccaggucaaggucuggcgucccaaaugaaagaagcaggcaaaggg

SEQ ID NO: 285362 - RNA, 50 nt, Human
cggaggagcuacugggcugagcgucccaggcauagaaaccucgaagcgcc

SEQ ID NO: 285363 - RNA, 56 nt, Human; identical to SEQ ID NO: 284863

SEQ ID NO: 285364 - RNA, 64 nt, Human; identical to SEQ ID NO: 284864

SEQ ID NO: 285365 - RNA, 64 nt, Human; identical to SEQ ID NO: 284865

SEQ ID NO: 285366 - RNA, 64 nt, Human; identical to SEQ ID NO: 284866

SEQ ID NO: 285367 - RNA, 64 nt, Human; identical to SEQ ID NO: 284867

SEQ ID NO: 285368 - RNA, 64 nt, Human; identical to SEQ ID NO: 284868

SEQ ID NO: 285369 - RNA, 60 nt, Human; identical to SEQ ID NO: 284869

SEQ ID NO: 285370 - RNA, 64 nt, Human; identical to SEQ ID NO: 284870

SEQ ID NO: 285371 - RNA, 64 nt, Human; identical to SEQ ID NO: 284871

SEQ ID NO: 285372 - RNA, 64 nt, Human; identical to SEQ ID NO: 284872

SEQ ID NO: 285373 - RNA, 64 nt, Human; identical to SEQ ID NO: 284876

SEQ ID NO: 285374 - RNA, 64 nt, Human; identical to SEQ ID NO: 284877

SEQ ID NO: 285375 - RNA, 64 nt, Human; identical to SEQ ID NO: 284878

SEQ ID NO: 285376 - RNA, 64 nt, Human; identical to SEQ ID NO: 284879

SEQ ID NO: 285377 - RNA, 64 nt, Human; identical to SEQ ID NO: 284880

SEQ ID NO: 285378 - RNA, 59 nt, Human
caucaggucugcaugccagggugccuccucuaguuaaagucagucaccuccccagaagg

SEQ ID NO: 285379 - RNA, 59 nt, Human
aagaauuaaccaacugaugacuuaccugccuaguuaauaucuuccuuucaccuuugucu

SEQ ID NO: 285380 - RNA, 62 nt, Human
uaacucuagccucuugccugagcuucagacucgcgucccacugcccacaggacacauccacc

SEQ ID NO: 285381 - RNA, 64 nt, Human; identical to SEQ ID NO: 284881

SEQ ID NO: 285382 - RNA, 64 nt, Human; identical to SEQ ID NO: 284882

SEQ ID NO: 285383 - RNA, 64 nt, Human; identical to SEQ ID NO: 284883

SEQ ID NO: 285384 - RNA, 64 nt, Human; identical to SEQ ID NO: 284884

SEQ ID NO: 285385 - RNA, 64 nt, Human; identical to SEQ ID NO: 284885

SEQ ID NO: 285386 - RNA, 64 nt, Human; identical to SEQ ID NO: 284886

SEQ ID NO: 285387 - RNA, 64 nt, Human; identical to SEQ ID NO: 284887

SEQ ID NO: 285388 - RNA, 64 nt, Human; identical to SEQ ID NO: 284888

SEQ ID NO: 285389 - RNA, 64 nt, Human; identical to SEQ ID NO: 284889

SEQ ID NO: 285390 - RNA, 64 nt, Human; identical to SEQ ID NO: 284890

SEQ ID NO: 285391 - RNA, 64 nt, Human; identical to SEQ ID NO: 284894

SEQ ID NO: 285392 - RNA, 64 nt, Human; identical to SEQ ID NO: 284895

SEQ ID NO: 285393 - RNA, 57 nt, Human; identical to SEQ ID NO: 284896

SEQ ID NO: 285394 - RNA, 64 nt, Human; identical to SEQ ID NO: 284897

SEQ ID NO: 285395 - RNA, 64 nt, Human; identical to SEQ ID NO: 284898

SEQ ID NO: 285396 - RNA, 64 nt, Human; identical to SEQ ID NO: 6182

SEQ ID NO: 285397 - RNA, 64 nt, Human; identical to SEQ ID NO: 6183

SEQ ID NO: 285398 - RNA, 58 nt, Human
agcucgggcugguuaacugacuugcucagcgucccauggugaguccgagcgggcgggg

SEQ ID NO: 285399 - RNA, 64 nt, Human; identical to SEQ ID NO: 284899

SEQ ID NO: 285400 - RNA, 64 nt, Human; identical to SEQ ID NO: 284900

SEQ ID NO: 285401 - RNA, 64 nt, Human; identical to SEQ ID NO: 284901

SEQ ID NO: 285402 - RNA, 64 nt, Human; identical to SEQ ID NO: 284902

SEQ ID NO: 285403 - RNA, 64 nt, Human; identical to SEQ ID NO: 284903

SEQ ID NO: 285404 - RNA, 64 nt, Human; identical to SEQ ID NO: 284904

SEQ ID NO: 285405 - RNA, 64 nt, Human; identical to SEQ ID NO: 284905

SEQ ID NO: 285406 - RNA, 64 nt, Human; identical to SEQ ID NO: 284906

SEQ ID NO: 285407 - RNA, 64 nt, Human; identical to SEQ ID NO: 284907

SEQ ID NO: 285408 - RNA, 64 nt, Human; identical to SEQ ID NO: 284908

SEQ ID NO: 285409 - RNA, 64 nt, Human; identical to SEQ ID NO: 284912

SEQ ID NO: 285410 - RNA, 64 nt, Human; identical to SEQ ID NO: 284913

SEQ ID NO: 285411 - RNA, 64 nt, Human; identical to SEQ ID NO: 284914

SEQ ID NO: 285412 - RNA, 64 nt, Human; identical to SEQ ID NO: 284915

SEQ ID NO: 285413 - RNA, 64 nt, Human; identical to SEQ ID NO: 284916

SEQ ID NO: 285414 - RNA, 59 nt, Human
caauaaaauuuuuaaaaaggauaaacuggcuaguuaaaaguaaauggcauuuaauuaaa

SEQ ID NO: 285415 - RNA, 59 nt, Human
aucuaucaggaaaacccucaagacagcuucuaguuaaaaccuuuguugcuguccucuca

SEQ ID NO: 285416 - RNA, 64 nt, Human
agagugacuuucuaaauaugaaacagauaauuuacgguacaaggcugacauagugcccuuguca

SEQ ID NO: 285417 - RNA, 64 nt, Human; identical to SEQ ID NO: 284917

SEQ ID NO: 285418 - RNA, 64 nt, Human; identical to SEQ ID NO: 284918

SEQ ID NO: 285419 - RNA, 64 nt, Human; identical to SEQ ID NO: 284919

SEQ ID NO: 285420 - RNA, 64 nt, Human; identical to SEQ ID NO: 284920

SEQ ID NO: 285421 - RNA, 64 nt, Human; identical to SEQ ID NO: 284921

SEQ ID NO: 285422 - RNA, 64 nt, Human; identical to SEQ ID NO: 284922

SEQ ID NO: 285423 - RNA, 64 nt, Human; identical to SEQ ID NO: 284923

SEQ ID NO: 285424 - RNA, 64 nt, Human; identical to SEQ ID NO: 284924

SEQ ID NO: 285425 - RNA, 64 nt, Human; identical to SEQ ID NO: 284925

SEQ ID NO: 285426 - RNA, 64 nt, Human; identical to SEQ ID NO: 284926

SEQ ID NO: 285427 - RNA, 64 nt, Human; identical to SEQ ID NO: 284930

SEQ ID NO: 285428 - RNA, 64 nt, Human; identical to SEQ ID NO: 284931

SEQ ID NO: 285429 - RNA, 64 nt, Human; identical to SEQ ID NO: 284932

SEQ ID NO: 285430 - RNA, 64 nt, Human; identical to SEQ ID NO: 284933

SEQ ID NO: 285431 - RNA, 64 nt, Human; identical to SEQ ID NO: 284934

SEQ ID NO: 285432 - RNA, 64 nt, Human
ggagccaggcuggcccagagcugagaugggagugcgguacaaucuggagcccacagcugucggu

SEQ ID NO: 285433 - RNA, 64 nt, Human
cccuaacuccuuaacaacuguagcaagaacugcacgguacaaacccaaaaaagaacaagcucau

SEQ ID NO: 285434 - RNA, 64 nt, Human
agguccacagaccuacugcacugaguuaaaauagcgguacaaguucuggcaagagcagauacug

SEQ ID NO: 285435 - RNA, 64 nt, Human; identical to SEQ ID NO: 284935

SEQ ID NO: 285436 - RNA, 64 nt, Human; identical to SEQ ID NO: 284936

SEQ ID NO: 285437 - RNA, 64 nt, Human; identical to SEQ ID NO: 284937

SEQ ID NO: 285438 - RNA, 64 nt, Human; identical to SEQ ID NO: 284938

SEQ ID NO: 285439 - RNA, 64 nt, Human; identical to SEQ ID NO: 284939

SEQ ID NO: 285440 - RNA, 64 nt, Human; identical to SEQ ID NO: 284940

SEQ ID NO: 285441 - RNA, 64 nt, Human; identical to SEQ ID NO: 284941

SEQ ID NO: 285442 - RNA, 64 nt, Human; identical to SEQ ID NO: 284942

SEQ ID NO: 285443 - RNA, 64 nt, Human; identical to SEQ ID NO: 284943

SEQ ID NO: 285444 - RNA, 64 nt, Human; identical to SEQ ID NO: 284944

SEQ ID NO: 285445 - RNA, 64 nt, Human; identical to SEQ ID NO: 284948

SEQ ID NO: 285446 - RNA, 64 nt, Human; identical to SEQ ID NO: 284949

SEQ ID NO: 285447 - RNA, 64 nt, Human; identical to SEQ ID NO: 284950

SEQ ID NO: 285448 - RNA, 64 nt, Human; identical to SEQ ID NO: 284951

SEQ ID NO: 285449 - RNA, 64 nt, Human; identical to SEQ ID NO: 284952

SEQ ID NO: 285450 - RNA, 55 nt, Human
aagacgcaaccaggaugugaggagccgguacaaggcgcagccagcuccucccgaa

SEQ ID NO: 285451 - RNA, 64 nt, Human
gcuggguccaggugaagugaccugcuguugagaccgguacaaauuggauuucaggaaggagacu

SEQ ID NO: 285452 - RNA, 64 nt, Human
ccgucggcacuggcugcaugaucgugaugucacacgguacaauguccuacccacaacuccucug

SEQ ID NO: 285453 - RNA, 64 nt, Human; identical to SEQ ID NO: 284953

SEQ ID NO: 285454 - RNA, 64 nt, Human; identical to SEQ ID NO: 284954

SEQ ID NO: 285455 - RNA, 64 nt, Human; identical to SEQ ID NO: 284955

SEQ ID NO: 285456 - RNA, 64 nt, Human; identical to SEQ ID NO: 284956

SEQ ID NO: 285457 - RNA, 64 nt, Human; identical to SEQ ID NO: 284957

SEQ ID NO: 285458 - RNA, 64 nt, Human; identical to SEQ ID NO: 284958

SEQ ID NO: 285459 - RNA, 64 nt, Human; identical to SEQ ID NO: 284959

SEQ ID NO: 285460 - RNA, 64 nt, Human; identical to SEQ ID NO: 284960

SEQ ID NO: 285461 - RNA, 55 nt, Human; identical to SEQ ID NO: 284961

SEQ ID NO: 285462 - RNA, 64 nt, Human; identical to SEQ ID NO: 284962

SEQ ID NO: 285463 - RNA, 64 nt, Human; identical to SEQ ID NO: 284966

SEQ ID NO: 285464 - RNA, 64 nt, Human; identical to SEQ ID NO: 284967

SEQ ID NO: 285465 - RNA, 64 nt, Human; identical to SEQ ID NO: 284968

SEQ ID NO: 285466 - RNA, 64 nt, Human; identical to SEQ ID NO: 284969

SEQ ID NO: 285467 - RNA, 64 nt, Human; identical to SEQ ID NO: 284970

SEQ ID NO: 285468 - RNA, 59 nt, Human
augauagaaagggaaguaaggcgugugugcuaguuaauagguuuaguagcuuuuaugga

SEQ ID NO: 285469 - RNA, 62 nt, Human
aaaaauacaauccuuguauuuuuucuuugaccagacccaaauuuuccccuuccccccuccau

SEQ ID NO: 285470 - RNA, 64 nt, Human
ggggaaggucgcagcuuugggcagcuuugagaagcgguacaagaguucugugccugugugucca

SEQ ID NO: 285471 - RNA, 64 nt, Human; identical to SEQ ID NO: 284971

SEQ ID NO: 285472 - RNA, 64 nt, Human; identical to SEQ ID NO: 284972

SEQ ID NO: 285473 - RNA, 64 nt, Human; identical to SEQ ID NO: 284973

SEQ ID NO: 285474 - RNA, 64 nt, Human; identical to SEQ ID NO: 284974

SEQ ID NO: 285475 - RNA, 64 nt, Human; identical to SEQ ID NO: 284975

SEQ ID NO: 285476 - RNA, 64 nt, Human; identical to SEQ ID NO: 284976

SEQ ID NO: 285477 - RNA, 64 nt, Human; identical to SEQ ID NO: 284977

SEQ ID NO: 285478 - RNA, 64 nt, Human; identical to SEQ ID NO: 284978

SEQ ID NO: 285479 - RNA, 64 nt, Human; identical to SEQ ID NO: 284979

SEQ ID NO: 285480 - RNA, 64 nt, Human; identical to SEQ ID NO: 284980

SEQ ID NO: 285481 - RNA, 64 nt, Human; identical to SEQ ID NO: 284981

SEQ ID NO: 285482 - RNA, 64 nt, Human; identical to SEQ ID NO: 284982

SEQ ID NO: 285483 - RNA, 64 nt, Human; identical to SEQ ID NO: 284983

SEQ ID NO: 285484 - RNA, 64 nt, Human; identical to SEQ ID NO: 284984

SEQ ID NO: 285485 - RNA, 64 nt, Human; identical to SEQ ID NO: 284985

SEQ ID NO: 285486 - RNA, 59 nt, Human
uuauuacuaaaguauuuaguaucuugcagcuaguuaauauuucaucuuuugcuuauuuc

SEQ ID NO: 285487 - RNA, 59 nt, Human
auguaaaagcauaauuaacacauuggcugcuaguuaacaauuggaauaacuuuauucug

SEQ ID NO: 285488 - RNA, 59 nt, Human
cuuuucagccugggugccacagcgagacccuaguuaagagaaaaaaaaaguaaaaacaa

SEQ ID NO: 285489 - RNA, 64 nt, Human; identical to SEQ ID NO: 284986

SEQ ID NO: 285490 - RNA, 64 nt, Human; identical to SEQ ID NO: 284987

SEQ ID NO: 285491 - RNA, 64 nt, Human; identical to SEQ ID NO: 284988

SEQ ID NO: 285492 - RNA, 64 nt, Human; identical to SEQ ID NO: 284740

SEQ ID NO: 285493 - RNA, 64 nt, Human; identical to SEQ ID NO: 284741

SEQ ID NO: 285494 - RNA, 64 nt, Human; identical to SEQ ID NO: 284742

SEQ ID NO: 285495 - RNA, 64 nt, Human; identical to SEQ ID NO: 284743

SEQ ID NO: 285496 - RNA, 64 nt, Human; identical to SEQ ID NO: 284744

SEQ ID NO: 285497 - RNA, 64 nt, Human; identical to SEQ ID NO: 284745

SEQ ID NO: 285498 - RNA, 64 nt, Human; identical to SEQ ID NO: 284746

SEQ ID NO: 285499 - RNA, 64 nt, Human; identical to SEQ ID NO: 284747

SEQ ID NO: 285500 - RNA, 59 nt, Human
cacccaaagaaguucccuuuugccuuuuccuaguuaagcccacuccagccccagauaac

SEQ ID NO: 285501 - RNA, 59 nt, Human
ucugucucaaacccuggcuguaauuucagcuaguuaauaauucuuuguguucaguucca

SEQ ID NO: 285502 - RNA, 59 nt, Human
acuaauauguaaaccaaaaguuaaauauucuaguuaaggauuguuucuuuaaacaacuu

SEQ ID NO: 285503 - RNA, 64 nt, Human; identical to SEQ ID NO: 284751

SEQ ID NO: 285504 - RNA, 64 nt, Human; identical to SEQ ID NO: 284752

SEQ ID NO: 285505 - RNA, 64 nt, Human; identical to SEQ ID NO: 284753

SEQ ID NO: 285506 - RNA, 64 nt, Human; identical to SEQ ID NO: 284754

SEQ ID NO: 285507 - RNA, 64 nt, Human; identical to SEQ ID NO: 284755

SEQ ID NO: 285508 - RNA, 64 nt, Human; identical to SEQ ID NO: 284756

SEQ ID NO: 285509 - RNA, 64 nt, Human; identical to SEQ ID NO: 284757

SEQ ID NO: 285510 - RNA, 64 nt, Human; identical to SEQ ID NO: 284758

SEQ ID NO: 285511 - RNA, 64 nt, Human; identical to SEQ ID NO: 284759

SEQ ID NO: 285512 - RNA, 64 nt, Human; identical to SEQ ID NO: 284760

SEQ ID NO: 285513 - RNA, 64 nt, Human; identical to SEQ ID NO: 284761

SEQ ID NO: 285514 - RNA, 64 nt, Human; identical to SEQ ID NO: 284762

SEQ ID NO: 285515 - RNA, 64 nt, Human; identical to SEQ ID NO: 284763

SEQ ID NO: 285516 - RNA, 64 nt, Human; identical to SEQ ID NO: 284764

SEQ ID NO: 285517 - RNA, 64 nt, Human; identical to SEQ ID NO: 284765

SEQ ID NO: 285518 - RNA, 59 nt, Human
uuaacuccaugagaaugguuacucaggaacuaguuaaagagcaaacccauuucucccgc

SEQ ID NO: 285519 - RNA, 59 nt, Human
accaaauuguggacacuguuuauauacugcuaguuaacaauuaccacuuuuaaaaaauu

SEQ ID NO: 285520 - RNA, 59 nt, Human
ccaaggaacaagaagagaaaucugauagccuaguuaaauauuucaguguuguuuggugu

SEQ ID NO: 285521 - RNA, 64 nt, Human; identical to SEQ ID NO: 284769

SEQ ID NO: 285522 - RNA, 64 nt, Human; identical to SEQ ID NO: 284770

SEQ ID NO: 285523 - RNA, 64 nt, Human; identical to SEQ ID NO: 284771

SEQ ID NO: 285524 - RNA, 64 nt, Human; identical to SEQ ID NO: 284772

SEQ ID NO: 285525 - RNA, 64 nt, Human; identical to SEQ ID NO: 284773

SEQ ID NO: 285526 - RNA, 64 nt, Human; identical to SEQ ID NO: 284774

SEQ ID NO: 285527 - RNA, 64 nt, Human; identical to SEQ ID NO: 284775

SEQ ID NO: 285528 - RNA, 64 nt, Human; identical to SEQ ID NO: 284776

SEQ ID NO: 285529 - RNA, 64 nt, Human; identical to SEQ ID NO: 284777

SEQ ID NO: 285530 - RNA, 64 nt, Human; identical to SEQ ID NO: 284778

SEQ ID NO: 285531 - RNA, 64 nt, Human; identical to SEQ ID NO: 284779

SEQ ID NO: 285532 - RNA, 64 nt, Human; identical to SEQ ID NO: 284780

SEQ ID NO: 285533 - RNA, 64 nt, Human; identical to SEQ ID NO: 284781

SEQ ID NO: 285534 - RNA, 64 nt, Human; identical to SEQ ID NO: 284782

SEQ ID NO: 285535 - RNA, 64 nt, Human; identical to SEQ ID NO: 284783

SEQ ID NO: 285536 - RNA, 64 nt, Human
agugugugagaaagaacagcacagucuuuuccuacgguacaagcuacauauguaggaaaauuuu

SEQ ID NO: 285537 - RNA, 62 nt, Human
cuggugugucugcccccucuggcauccucugggcgucccaugaucccuucugugucugcgug

SEQ ID NO: 285538 - RNA, 64 nt, Human; identical to SEQ ID NO: 284787

SEQ ID NO: 285539 - RNA, 64 nt, Human; identical to SEQ ID NO: 284788

SEQ ID NO: 285540 - RNA, 64 nt, Human; identical to SEQ ID NO: 284789

SEQ ID NO: 285541 - RNA, 64 nt, Human; identical to SEQ ID NO: 284790

SEQ ID NO: 285542 - RNA, 64 nt, Human; identical to SEQ ID NO: 284791

SEQ ID NO: 285543 - RNA, 64 nt, Human; identical to SEQ ID NO: 284792

SEQ ID NO: 285544 - RNA, 64 nt, Human; identical to SEQ ID NO: 284793

SEQ ID NO: 285545 - RNA, 64 nt, Human; identical to SEQ ID NO: 284794

SEQ ID NO: 285546 - RNA, 64 nt, Human; identical to SEQ ID NO: 284795

SEQ ID NO: 285547 - RNA, 64 nt, Human; identical to SEQ ID NO: 284796

SEQ ID NO: 285548 - RNA, 64 nt, Human; identical to SEQ ID NO: 284797

SEQ ID NO: 285549 - RNA, 64 nt, Human; identical to SEQ ID NO: 284798

SEQ ID NO: 285550 - RNA, 64 nt, Human; identical to SEQ ID NO: 284799

SEQ ID NO: 285551 - RNA, 64 nt, Human; identical to SEQ ID NO: 284800

SEQ ID NO: 285552 - RNA, 64 nt, Human; identical to SEQ ID NO: 284801

SEQ ID NO: 285553 - RNA, 59 nt, Human
aacucucaugacaugaaaaauaaauacaacuaguuaaguauaaaaugccaaauaaaagu

SEQ ID NO: 285554 - RNA, 59 nt, Human
uauacaguuuuaacuuacuuagauuuauucuaguuaagccauaaguucaacguguaaac

SEQ ID NO: 285555 - RNA, 59 nt, Human
ucuuucuuugaagcuguucuaguccuccucuaguuaacuuagcuuuauguagaauuucu

SEQ ID NO: 285556 - RNA, 64 nt, Human; identical to SEQ ID NO: 284805

SEQ ID NO: 285557 - RNA, 64 nt, Human; identical to SEQ ID NO: 284806

SEQ ID NO: 285558 - RNA, 64 nt, Human; identical to SEQ ID NO: 284807

SEQ ID NO: 285559 - RNA, 64 nt, Human; identical to SEQ ID NO: 284808

SEQ ID NO: 285560 - RNA, 64 nt, Human; identical to SEQ ID NO: 284809

SEQ ID NO: 285561 - RNA, 64 nt, Human; identical to SEQ ID NO: 284810

SEQ ID NO: 285562 - RNA, 64 nt, Human; identical to SEQ ID NO: 284811

SEQ ID NO: 285563 - RNA, 64 nt, Human; identical to SEQ ID NO: 284812

SEQ ID NO: 285564 - RNA, 64 nt, Human; identical to SEQ ID NO: 284813

SEQ ID NO: 285565 - RNA, 64 nt, Human; identical to SEQ ID NO: 284814

SEQ ID NO: 285566 - RNA, 64 nt, Human; identical to SEQ ID NO: 284815

SEQ ID NO: 285567 - RNA, 64 nt, Human; identical to SEQ ID NO: 284816

SEQ ID NO: 285568 - RNA, 64 nt, Human; identical to SEQ ID NO: 284817

SEQ ID NO: 285569 - RNA, 64 nt, Human; identical to SEQ ID NO: 284818

SEQ ID NO: 285570 - RNA, 64 nt, Human; identical to SEQ ID NO: 284819

SEQ ID NO: 285571 - RNA, 59 nt, Human
auuagguagaaaagacaaaacccaaacaccuaguuaauugagggauggacaccucuaaa

SEQ ID NO: 285572 - RNA, 59 nt, Human
aaaaggaagaacucuugacuauuuagauucuaguuaaauaucuggaauccuagcaguca

SEQ ID NO: 285573 - RNA, 59 nt, Human
ugcaaauccauagcacaagauaaauugagcuaguuaaggcaaaucagguaaaauaguca

SEQ ID NO: 285574 - RNA, 64 nt, Human; identical to SEQ ID NO: 284822

SEQ ID NO: 285575 - RNA, 64 nt, Human; identical to SEQ ID NO: 284823

SEQ ID NO: 285576 - RNA, 64 nt, Human; identical to SEQ ID NO: 284824

SEQ ID NO: 285577 - RNA, 64 nt, Human; identical to SEQ ID NO: 284825

SEQ ID NO: 285578 - RNA, 64 nt, Human; identical to SEQ ID NO: 284826

SEQ ID NO: 285579 - RNA, 64 nt, Human; identical to SEQ ID NO: 284827

SEQ ID NO: 285580 - RNA, 64 nt, Human; identical to SEQ ID NO: 284828

SEQ ID NO: 285581 - RNA, 64 nt, Human; identical to SEQ ID NO: 284829

SEQ ID NO: 285582 - RNA, 64 nt, Human; identical to SEQ ID NO: 284830

SEQ ID NO: 285583 - RNA, 64 nt, Human; identical to SEQ ID NO: 284831

SEQ ID NO: 285584 - RNA, 64 nt, Human; identical to SEQ ID NO: 284832

SEQ ID NO: 285585 - RNA, 64 nt, Human; identical to SEQ ID NO: 284833

SEQ ID NO: 285586 - RNA, 64 nt, Human; identical to SEQ ID NO: 284834

SEQ ID NO: 285587 - RNA, 64 nt, Human; identical to SEQ ID NO: 284835

SEQ ID NO: 285588 - RNA, 64 nt, Human; identical to SEQ ID NO: 284836

SEQ ID NO: 285589 - RNA, 59 nt, Human
acauguuguauaggaauccuguagugccacuaguuaaaugccgaauucucaucuggaug

SEQ ID NO: 285590 - RNA, 59 nt, Human
uuauggggauuuuaaaaaucauugaauaacuaguuaaaugaaauuuuagcuacacacug

SEQ ID NO: 285591 - RNA, 59 nt, Human
auuucauguuuauuaaacucgaacuuuggcuaguuaaacucauauugaaacuucaucua

SEQ ID NO: 285592 - RNA, 64 nt, Human; identical to SEQ ID NO: 284840

SEQ ID NO: 285593 - RNA, 64 nt, Human; identical to SEQ ID NO: 284841

SEQ ID NO: 285594 - RNA, 64 nt, Human; identical to SEQ ID NO: 284842

SEQ ID NO: 285595 - RNA, 64 nt, Human; identical to SEQ ID NO: 284843

SEQ ID NO: 285596 - RNA, 64 nt, Human; identical to SEQ ID NO: 284844

SEQ ID NO: 285597 - RNA, 64 nt, Human; identical to SEQ ID NO: 284845

SEQ ID NO: 285598 - RNA, 64 nt, Human; identical to SEQ ID NO: 284846

SEQ ID NO: 285599 - RNA, 64 nt, Human; identical to SEQ ID NO: 284847

SEQ ID NO: 285600 - RNA, 64 nt, Human; identical to SEQ ID NO: 284848

SEQ ID NO: 285601 - RNA, 64 nt, Human; identical to SEQ ID NO: 284849

SEQ ID NO: 285602 - RNA, 58 nt, Human; identical to SEQ ID NO: 284850

SEQ ID NO: 285603 - RNA, 64 nt, Human; identical to SEQ ID NO: 284851

SEQ ID NO: 285604 - RNA, 64 nt, Human; identical to SEQ ID NO: 284852

SEQ ID NO: 285605 - RNA, 64 nt, Human; identical to SEQ ID NO: 284853

SEQ ID NO: 285606 - RNA, 64 nt, Human; identical to SEQ ID NO: 284854

SEQ ID NO: 285607 - RNA, 59 nt, Human
agaacauuagccuagaaguuuuugcuuugcuaguuaaagcuuacuuugcagagcuuccc

SEQ ID NO: 285608 - RNA, 59 nt, Human
ccuuguuuuauagguuuacuuuuguuaagcuaguuaaagguucguuguauuaagacccc

SEQ ID NO: 285609 - RNA, 59 nt, Human
uacaggugcauucuaguuacaugaacaugcuaguuaaauaaaagucacaauuaagucau

SEQ ID NO: 285610 - RNA, 64 nt, Human; identical to SEQ ID NO: 284858

SEQ ID NO: 285611 - RNA, 64 nt, Human; identical to SEQ ID NO: 284859

SEQ ID NO: 285612 - RNA, 64 nt, Human; identical to SEQ ID NO: 284860

SEQ ID NO: 285613 - RNA, 64 nt, Human; identical to SEQ ID NO: 284861

SEQ ID NO: 285614 - RNA, 64 nt, Human; identical to SEQ ID NO: 284862

SEQ ID NO: 285615 - RNA, 56 nt, Human; identical to SEQ ID NO: 284863

SEQ ID NO: 285616 - RNA, 64 nt, Human; identical to SEQ ID NO: 284864

SEQ ID NO: 285617 - RNA, 64 nt, Human; identical to SEQ ID NO: 284865

SEQ ID NO: 285618 - RNA, 64 nt, Human; identical to SEQ ID NO: 284866

SEQ ID NO: 285619 - RNA, 64 nt, Human; identical to SEQ ID NO: 284867

SEQ ID NO: 285620 - RNA, 64 nt, Human; identical to SEQ ID NO: 284868

SEQ ID NO: 285621 - RNA, 60 nt, Human; identical to SEQ ID NO: 284869

SEQ ID NO: 285622 - RNA, 64 nt, Human; identical to SEQ ID NO: 284870

SEQ ID NO: 285623 - RNA, 64 nt, Human; identical to SEQ ID NO: 284871

SEQ ID NO: 285624 - RNA, 64 nt, Human; identical to SEQ ID NO: 284872

SEQ ID NO: 285625 - RNA, 59 nt, Human
uaccaacagugaagcuguggaaugcccagcuaguuaaagaaugcaaaggaaaauauuuu

SEQ ID NO: 285626 - RNA, 59 nt, Human
ugcagaauccaaaguaaauguccugcuagcuaguuaaggauuguuuuaaaucuguuauu

SEQ ID NO: 285627 - RNA, 59 nt, Human
uagguaccaagugagugggaauacauauucuaguuaaagcauuugugucuagcuacaca

SEQ ID NO: 285628 - RNA, 64 nt, Human; identical to SEQ ID NO: 284876

SEQ ID NO: 285629 - RNA, 64 nt, Human; identical to SEQ ID NO: 284877

SEQ ID NO: 285630 - RNA, 64 nt, Human; identical to SEQ ID NO: 284878

SEQ ID NO: 285631 - RNA, 64 nt, Human; identical to SEQ ID NO: 284879

SEQ ID NO: 285632 - RNA, 64 nt, Human; identical to SEQ ID NO: 284880

SEQ ID NO: 285633 - RNA, 64 nt, Human; identical to SEQ ID NO: 284881

SEQ ID NO: 285634 - RNA, 64 nt, Human; identical to SEQ ID NO: 284882

SEQ ID NO: 285635 - RNA, 64 nt, Human; identical to SEQ ID NO: 284883

SEQ ID NO: 285636 - RNA, 64 nt, Human; identical to SEQ ID NO: 284884

SEQ ID NO: 285637 - RNA, 64 nt, Human; identical to SEQ ID NO: 284885

SEQ ID NO: 285638 - RNA, 64 nt, Human; identical to SEQ ID NO: 284886

SEQ ID NO: 285639 - RNA, 64 nt, Human; identical to SEQ ID NO: 284887

SEQ ID NO: 285640 - RNA, 64 nt, Human; identical to SEQ ID NO: 284888

SEQ ID NO: 285641 - RNA, 64 nt, Human; identical to SEQ ID NO: 284889

SEQ ID NO: 285642 - RNA, 64 nt, Human; identical to SEQ ID NO: 284890

SEQ ID NO: 285643 - RNA, 59 nt, Human
caggaaacaacuuuuccaaaaucccacagcuaguuaaugacagaucuccccacuacauu

SEQ ID NO: 285644 - RNA, 59 nt, Human
uggcauuucuaugcaggcagcacagcagacuaguuaaucuauugcuuggacuuaacuag

SEQ ID NO: 285645 - RNA, 64 nt, Human
ucugucucuucugucccaggaaccuauccgcuuacgguacaagcugacauucaaccaaggugga

SEQ ID NO: 285646 - RNA, 64 nt, Human; identical to SEQ ID NO: 284894

SEQ ID NO: 285647 - RNA, 64 nt, Human; identical to SEQ ID NO: 284895

SEQ ID NO: 285648 - RNA, 57 nt, Human; identical to SEQ ID NO: 284896

SEQ ID NO: 285649 - RNA, 64 nt, Human; identical to SEQ ID NO: 284897

SEQ ID NO: 285650 - RNA, 64 nt, Human; identical to SEQ ID NO: 284898

SEQ ID NO: 285651 - RNA, 64 nt, Human; identical to SEQ ID NO: 284899

SEQ ID NO: 285652 - RNA, 64 nt, Human; identical to SEQ ID NO: 284900

SEQ ID NO: 285653 - RNA, 64 nt, Human; identical to SEQ ID NO: 284901

SEQ ID NO: 285654 - RNA, 64 nt, Human; identical to SEQ ID NO: 284902

SEQ ID NO: 285655 - RNA, 64 nt, Human; identical to SEQ ID NO: 284903

SEQ ID NO: 285656 - RNA, 64 nt, Human; identical to SEQ ID NO: 284904

SEQ ID NO: 285657 - RNA, 64 nt, Human; identical to SEQ ID NO: 284905

SEQ ID NO: 285658 - RNA, 64 nt, Human; identical to SEQ ID NO: 284906

SEQ ID NO: 285659 - RNA, 64 nt, Human; identical to SEQ ID NO: 284907

SEQ ID NO: 285660 - RNA, 64 nt, Human; identical to SEQ ID NO: 284908

SEQ ID NO: 285661 - RNA, 59 nt, Human
gcguugaaguuuguuguuuuuuuucucaacuaguuaagucaacugcuucugaaauaacu

SEQ ID NO: 285662 - RNA, 59 nt, Human
ggaagcuuauaauucauuuuuauugcagacuaguuaaaucccacaaagugaauaucuuc

SEQ ID NO: 285663 - RNA, 59 nt, Human
cuuugccccuagacucuagacuauguuaacuaguuaaggauguuacauuuugaaaggau

SEQ ID NO: 285664 - RNA, 64 nt, Human; identical to SEQ ID NO: 284912

SEQ ID NO: 285665 - RNA, 64 nt, Human; identical to SEQ ID NO: 284913

SEQ ID NO: 285666 - RNA, 64 nt, Human; identical to SEQ ID NO: 284914

SEQ ID NO: 285667 - RNA, 64 nt, Human; identical to SEQ ID NO: 284915

SEQ ID NO: 285668 - RNA, 64 nt, Human; identical to SEQ ID NO: 284916

SEQ ID NO: 285669 - RNA, 64 nt, Human; identical to SEQ ID NO: 284917

SEQ ID NO: 285670 - RNA, 64 nt, Human; identical to SEQ ID NO: 284918

SEQ ID NO: 285671 - RNA, 64 nt, Human; identical to SEQ ID NO: 284919

SEQ ID NO: 285672 - RNA, 64 nt, Human; identical to SEQ ID NO: 284920

SEQ ID NO: 285673 - RNA, 64 nt, Human; identical to SEQ ID NO: 284921

SEQ ID NO: 285674 - RNA, 64 nt, Human; identical to SEQ ID NO: 284922

SEQ ID NO: 285675 - RNA, 64 nt, Human; identical to SEQ ID NO: 284923

SEQ ID NO: 285676 - RNA, 64 nt, Human; identical to SEQ ID NO: 284924

SEQ ID NO: 285677 - RNA, 64 nt, Human; identical to SEQ ID NO: 284925

SEQ ID NO: 285678 - RNA, 64 nt, Human; identical to SEQ ID NO: 284926

SEQ ID NO: 285679 - RNA, 59 nt, Human
acuguauuugagacauuuuuugugugugacuaguuaauuuugcaggaugugccauauca

SEQ ID NO: 285680 - RNA, 59 nt, Human
aaaucaccuuuucuaaaaagucaauucaucuaguuaagucgcugaacaauuaccugcca

SEQ ID NO: 285681 - RNA, 59 nt, Human
auucaaagggaagcagcauuucuuguuaacuaguuaagcacuaugcugcuaguuacagu

SEQ ID NO: 285682 - RNA, 64 nt, Human; identical to SEQ ID NO: 284930

SEQ ID NO: 285683 - RNA, 64 nt, Human; identical to SEQ ID NO: 284931

SEQ ID NO: 285684 - RNA, 64 nt, Human; identical to SEQ ID NO: 284932

SEQ ID NO: 285685 - RNA, 64 nt, Human; identical to SEQ ID NO: 284933

SEQ ID NO: 285686 - RNA, 64 nt, Human; identical to SEQ ID NO: 284934

SEQ ID NO: 285687 - RNA, 64 nt, Human; identical to SEQ ID NO: 284935

SEQ ID NO: 285688 - RNA, 64 nt, Human; identical to SEQ ID NO: 284936

SEQ ID NO: 285689 - RNA, 64 nt, Human; identical to SEQ ID NO: 284937

SEQ ID NO: 285690 - RNA, 64 nt, Human; identical to SEQ ID NO: 284938

SEQ ID NO: 285691 - RNA, 64 nt, Human; identical to SEQ ID NO: 284939

SEQ ID NO: 285692 - RNA, 64 nt, Human; identical to SEQ ID NO: 284940

SEQ ID NO: 285693 - RNA, 64 nt, Human; identical to SEQ ID NO: 284941

SEQ ID NO: 285694 - RNA, 64 nt, Human; identical to SEQ ID NO: 284942

SEQ ID NO: 285695 - RNA, 64 nt, Human; identical to SEQ ID NO: 284943

SEQ ID NO: 285696 - RNA, 64 nt, Human; identical to SEQ ID NO: 284944

SEQ ID NO: 285697 - RNA, 59 nt, Human
aaaaaucagccauuucaugcaaccagaaacuaguuaaaagcuucuauuuuccucuuuga

SEQ ID NO: 285698 - RNA, 59 nt, Human
ggaggaagguuccauaagcuacauguuuccuaguuaagcucuuuccuauuguguuuaua

SEQ ID NO: 285699 - RNA, 59 nt, Human
aagaguuguguauguggguguuucucccccuaguuaauuccuguuguguaaggguaggc

SEQ ID NO: 285700 - RNA, 64 nt, Human; identical to SEQ ID NO: 284948

SEQ ID NO: 285701 - RNA, 64 nt, Human; identical to SEQ ID NO: 284949

SEQ ID NO: 285702 - RNA, 64 nt, Human; identical to SEQ ID NO: 284950

SEQ ID NO: 285703 - RNA, 64 nt, Human; identical to SEQ ID NO: 284951

SEQ ID NO: 285704 - RNA, 64 nt, Human; identical to SEQ ID NO: 284952

SEQ ID NO: 285705 - RNA, 64 nt, Human; identical to SEQ ID NO: 284953

SEQ ID NO: 285706 - RNA, 64 nt, Human; identical to SEQ ID NO: 284954

SEQ ID NO: 285707 - RNA, 64 nt, Human; identical to SEQ ID NO: 284955

SEQ ID NO: 285708 - RNA, 64 nt, Human; identical to SEQ ID NO: 284956

SEQ ID NO: 285709 - RNA, 64 nt, Human; identical to SEQ ID NO: 284957

SEQ ID NO: 285710 - RNA, 64 nt, Human; identical to SEQ ID NO: 284958

SEQ ID NO: 285711 - RNA, 64 nt, Human; identical to SEQ ID NO: 284959

SEQ ID NO: 285712 - RNA, 64 nt, Human; identical to SEQ ID NO: 284960

SEQ ID NO: 285713 - RNA, 55 nt, Human; identical to SEQ ID NO: 284961

SEQ ID NO: 285714 - RNA, 64 nt, Human; identical to SEQ ID NO: 284962

SEQ ID NO: 285715 - RNA, 59 nt, Human
uaaaguaaagcccugugguguaucaacuacuaguuaagagucucaguugauuucuguaa

SEQ ID NO: 285716 - RNA, 59 nt, Human
aucagcccucaaagaauggggucugugggcuaguuaaaauagaaauaaacuuuuaaaau

SEQ ID NO: 285717 - RNA, 59 nt, Human
uuuguaaauagcaagaagcuguacagauucuaguuaauguugugaauaacaucaauuaa

SEQ ID NO: 285718 - RNA, 64 nt, Human; identical to SEQ ID NO: 284966

SEQ ID NO: 285719 - RNA, 64 nt, Human; identical to SEQ ID NO: 284967

SEQ ID NO: 285720 - RNA, 64 nt, Human; identical to SEQ ID NO: 284968

SEQ ID NO: 285721 - RNA, 64 nt, Human; identical to SEQ ID NO: 284969

SEQ ID NO: 285722 - RNA, 64 nt, Human; identical to SEQ ID NO: 284970

SEQ ID NO: 285723 - RNA, 64 nt, Human; identical to SEQ ID NO: 284971

SEQ ID NO: 285724 - RNA, 64 nt, Human; identical to SEQ ID NO: 284972

SEQ ID NO: 285725 - RNA, 64 nt, Human; identical to SEQ ID NO: 284973

SEQ ID NO: 285726 - RNA, 64 nt, Human; identical to SEQ ID NO: 284974

SEQ ID NO: 285727 - RNA, 64 nt, Human; identical to SEQ ID NO: 284975

SEQ ID NO: 285728 - RNA, 64 nt, Human; identical to SEQ ID NO: 284976

SEQ ID NO: 285729 - RNA, 64 nt, Human; identical to SEQ ID NO: 284977

SEQ ID NO: 285730 - RNA, 64 nt, Human; identical to SEQ ID NO: 284978

SEQ ID NO: 285731 - RNA, 64 nt, Human; identical to SEQ ID NO: 284979

SEQ ID NO: 285732 - RNA, 64 nt, Human; identical to SEQ ID NO: 284980

SEQ ID NO: 285733 - RNA, 59 nt, Human
ccugcuuaguguccuuaaccaaacugcaucuaguuaaaauuuguaacaaauagcccucu

SEQ ID NO: 285734 - RNA, 59 nt, Human
aagaaaaaauguuagaccaaauaaugcggcuaguuaacagugguacgauuucucgcccg

SEQ ID NO: 285735 - RNA, 59 nt, Human
acaaaccccacaguuuauccaaggaaaaucuaguuaaaauaauccaauggacagaagcc

SEQ ID NO: 285736 - RNA, 64 nt, Human; identical to SEQ ID NO: 284981

SEQ ID NO: 285737 - RNA, 64 nt, Human; identical to SEQ ID NO: 284982

SEQ ID NO: 285738 - RNA, 64 nt, Human; identical to SEQ ID NO: 284983

SEQ ID NO: 285739 - RNA, 64 nt, Human; identical to SEQ ID NO: 284984

SEQ ID NO: 285740 - RNA, 64 nt, Human; identical to SEQ ID NO: 284985

SEQ ID NO: 285741 - RNA, 64 nt, Human; identical to SEQ ID NO: 284986

SEQ ID NO: 285742 - RNA, 64 nt, Human; identical to SEQ ID NO: 284987

SEQ ID NO: 285743 - RNA, 64 nt, Human; identical to SEQ ID NO: 284988

SEQ ID NO: 285744 - RNA, 64 nt, Human; identical to SEQ ID NO: 284740

SEQ ID NO: 285745 - RNA, 64 nt, Human; identical to SEQ ID NO: 284741

SEQ ID NO: 285746 - RNA, 64 nt, Human; identical to SEQ ID NO: 284742

SEQ ID NO: 285747 - RNA, 59 nt, Human
acguugaacuccauggugccugagagagacuaguuaaggguuggucuucuguauccucu

SEQ ID NO: 285748 - RNA, 59 nt, Human
uugguuuggcacaggcacagagcuggucccuaguuaaguggcauuuauguuaaaaaaaa

SEQ ID NO: 285749 - RNA, 59 nt, Human
cauuagaaauuggucuuucuuagaauggucuaguuaaguuccacauguagcauaauucu

SEQ ID NO: 285750 - RNA, 64 nt, Human; identical to SEQ ID NO: 284743

SEQ ID NO: 285751 - RNA, 64 nt, Human; identical to SEQ ID NO: 284744

SEQ ID NO: 285752 - RNA, 64 nt, Human; identical to SEQ ID NO: 284745

SEQ ID NO: 285753 - RNA, 64 nt, Human; identical to SEQ ID NO: 284746

SEQ ID NO: 285754 - RNA, 64 nt, Human; identical to SEQ ID NO: 284747

SEQ ID NO: 285755 - RNA, 64 nt, Human; identical to SEQ ID NO: 284751

SEQ ID NO: 285756 - RNA, 64 nt, Human; identical to SEQ ID NO: 284752

SEQ ID NO: 285757 - RNA, 64 nt, Human; identical to SEQ ID NO: 284753

SEQ ID NO: 285758 - RNA, 64 nt, Human; identical to SEQ ID NO: 284754

SEQ ID NO: 285759 - RNA, 64 nt, Human; identical to SEQ ID NO: 284755

SEQ ID NO: 285760 - RNA, 64 nt, Human; identical to SEQ ID NO: 284756

SEQ ID NO: 285761 - RNA, 64 nt, Human; identical to SEQ ID NO: 284757

SEQ ID NO: 285762 - RNA, 64 nt, Human; identical to SEQ ID NO: 284758

SEQ ID NO: 285763 - RNA, 64 nt, Human; identical to SEQ ID NO: 284759

SEQ ID NO: 285764 - RNA, 64 nt, Human; identical to SEQ ID NO: 284760

SEQ ID NO: 285765 - RNA, 59 nt, Human
uagaaguauguauaauaaaacaauacuaccuaguuaaacauuuacuuucucuuuugccu

SEQ ID NO: 285766 - RNA, 59 nt, Human
agggcuuccacacacuuauuuauuuugcccuaguuaauccuguuguuugcugccauugg

SEQ ID NO: 285767 - RNA, 59 nt, Human
aaaagguaaauacacccaaagggagggaccuaguuaagucacuggcaccuagauaaguu

SEQ ID NO: 285768 - RNA, 64 nt, Human; identical to SEQ ID NO: 284761

SEQ ID NO: 285769 - RNA, 64 nt, Human; identical to SEQ ID NO: 284762

SEQ ID NO: 285770 - RNA, 64 nt, Human; identical to SEQ ID NO: 284763

SEQ ID NO: 285771 - RNA, 64 nt, Human; identical to SEQ ID NO: 284764

SEQ ID NO: 285772 - RNA, 64 nt, Human; identical to SEQ ID NO: 284765

SEQ ID NO: 285773 - RNA, 64 nt, Human; identical to SEQ ID NO: 284769

SEQ ID NO: 285774 - RNA, 64 nt, Human; identical to SEQ ID NO: 284770

SEQ ID NO: 285775 - RNA, 64 nt, Human; identical to SEQ ID NO: 284771

SEQ ID NO: 285776 - RNA, 64 nt, Human; identical to SEQ ID NO: 284772

SEQ ID NO: 285777 - RNA, 64 nt, Human; identical to SEQ ID NO: 284773

SEQ ID NO: 285778 - RNA, 64 nt, Human; identical to SEQ ID NO: 284774

SEQ ID NO: 285779 - RNA, 64 nt, Human; identical to SEQ ID NO: 284775

SEQ ID NO: 285780 - RNA, 64 nt, Human; identical to SEQ ID NO: 284776

SEQ ID NO: 285781 - RNA, 64 nt, Human; identical to SEQ ID NO: 284777

SEQ ID NO: 285782 - RNA, 64 nt, Human; identical to SEQ ID NO: 284778

SEQ ID NO: 285783 - RNA, 59 nt, Human
guuugggagaggagcaaagcaguugaaaacuaguuaaugagcuacaagagucaaauagu

SEQ ID NO: 285784 - RNA, 59 nt, Human
uuuaauaucaguuuuuuuuaaacaugauucuaguuaaauguagaagagagaagaaagag

SEQ ID NO: 285785 - RNA, 58 nt, Human
uggcaccaacaguuccauaguuuaacaucuaguuaagcuacaaauauaguauaagcau

SEQ ID NO: 285786 - RNA, 64 nt, Human; identical to SEQ ID NO: 284779

SEQ ID NO: 285787 - RNA, 64 nt, Human; identical to SEQ ID NO: 284780

SEQ ID NO: 285788 - RNA, 64 nt, Human; identical to SEQ ID NO: 284781

SEQ ID NO: 285789 - RNA, 64 nt, Human; identical to SEQ ID NO: 284782

SEQ ID NO: 285790 - RNA, 64 nt, Human; identical to SEQ ID NO: 284783

SEQ ID NO: 285791 - RNA, 64 nt, Human; identical to SEQ ID NO: 284787

SEQ ID NO: 285792 - RNA, 64 nt, Human; identical to SEQ ID NO: 284788

SEQ ID NO: 285793 - RNA, 64 nt, Human; identical to SEQ ID NO: 284789

SEQ ID NO: 285794 - RNA, 64 nt, Human; identical to SEQ ID NO: 284790

SEQ ID NO: 285795 - RNA, 64 nt, Human; identical to SEQ ID NO: 284791

SEQ ID NO: 285796 - RNA, 64 nt, Human; identical to SEQ ID NO: 284792

SEQ ID NO: 285797 - RNA, 64 nt, Human; identical to SEQ ID NO: 284793

SEQ ID NO: 285798 - RNA, 64 nt, Human; identical to SEQ ID NO: 284794

SEQ ID NO: 285799 - RNA, 64 nt, Human; identical to SEQ ID NO: 284795

SEQ ID NO: 285800 - RNA, 64 nt, Human; identical to SEQ ID NO: 284796

SEQ ID NO: 285801 - RNA, 64 nt, Human
cccauccuuuucugcuccaaccugccccacugggucccggcaggggccaugccuaccaagcucg

SEQ ID NO: 285802 - RNA, 64 nt, Human
ugugugugugugaaacguagucugcaacucugccucccggcaauuauacaugugucaggauguc

SEQ ID NO: 285803 - RNA, 64 nt, Human
agggcugugagcugggcuucuguccuccucugugucccggcauggaagccaguauaagcauuuc

SEQ ID NO: 285804 - RNA, 64 nt, Human; identical to SEQ ID NO: 284797

SEQ ID NO: 285805 - RNA, 64 nt, Human; identical to SEQ ID NO: 284798

SEQ ID NO: 285806 - RNA, 64 nt, Human; identical to SEQ ID NO: 284799

SEQ ID NO: 285807 - RNA, 64 nt, Human; identical to SEQ ID NO: 284800

SEQ ID NO: 285808 - RNA, 64 nt, Human; identical to SEQ ID NO: 284801

SEQ ID NO: 285809 - RNA, 64 nt, Human; identical to SEQ ID NO: 284805

SEQ ID NO: 285810 - RNA, 64 nt, Human; identical to SEQ ID NO: 284806

SEQ ID NO: 285811 - RNA, 64 nt, Human; identical to SEQ ID NO: 284807

SEQ ID NO: 285812 - RNA, 64 nt, Human; identical to SEQ ID NO: 284808

SEQ ID NO: 285813 - RNA, 64 nt, Human; identical to SEQ ID NO: 284809

SEQ ID NO: 285814 - RNA, 64 nt, Human; identical to SEQ ID NO: 284810

SEQ ID NO: 285815 - RNA, 64 nt, Human; identical to SEQ ID NO: 284811

SEQ ID NO: 285816 - RNA, 64 nt, Human; identical to SEQ ID NO: 284812

SEQ ID NO: 285817 - RNA, 64 nt, Human; identical to SEQ ID NO: 284813

SEQ ID NO: 285818 - RNA, 64 nt, Human; identical to SEQ ID NO: 284814

SEQ ID NO: 285819 - RNA, 59 nt, Human
auuuauuuguaucugggaaaauauucucucuaguuaaaaaugauuuaaagagucgacua

SEQ ID NO: 285820 - RNA, 59 nt, Human
cuuucaaaauggaaucugaguauuagacacuaguuaacauauuuguguauauuaaauau

SEQ ID NO: 285821 - RNA, 59 nt, Human
guuucucuuccuuuacuuagccuauaaaacuaguuaaaaauggaauuucuuuuagcaau

SEQ ID NO: 285822 - RNA, 64 nt, Human; identical to SEQ ID NO: 284815

SEQ ID NO: 285823 - RNA, 64 nt, Human; identical to SEQ ID NO: 284816

SEQ ID NO: 285824 - RNA, 64 nt, Human; identical to SEQ ID NO: 284817

SEQ ID NO: 285825 - RNA, 64 nt, Human; identical to SEQ ID NO: 284818

SEQ ID NO: 285826 - RNA, 64 nt, Human; identical to SEQ ID NO: 284819

SEQ ID NO: 285827 - RNA, 64 nt, Human; identical to SEQ ID NO: 284822

SEQ ID NO: 285828 - RNA, 64 nt, Human; identical to SEQ ID NO: 284823

SEQ ID NO: 285829 - RNA, 64 nt, Human; identical to SEQ ID NO: 284824

SEQ ID NO: 285830 - RNA, 64 nt, Human; identical to SEQ ID NO: 284825

SEQ ID NO: 285831 - RNA, 64 nt, Human; identical to SEQ ID NO: 284826

SEQ ID NO: 285832 - RNA, 64 nt, Human; identical to SEQ ID NO: 284827

SEQ ID NO: 285833 - RNA, 64 nt, Human; identical to SEQ ID NO: 284828

SEQ ID NO: 285834 - RNA, 64 nt, Human; identical to SEQ ID NO: 284829

SEQ ID NO: 285835 - RNA, 64 nt, Human; identical to SEQ ID NO: 284830

SEQ ID NO: 285836 - RNA, 64 nt, Human; identical to SEQ ID NO: 284831

SEQ ID NO: 285837 - RNA, 59 nt, Human
uuaagaaaauggaagagaaaaagagagugcuaguuaaaaaaucgggauguuuuaguuug

SEQ ID NO: 285838 - RNA, 59 nt, Human
auugauuauggaacuuuuguucccugaagcuaguuaacugugucuaaaguuaaauaaau

SEQ ID NO: 285839 - RNA, 59 nt, Human
uggccauuguguaugauuuugaugcacaacuaguuaaaagccuuucauaccagucagua

SEQ ID NO: 285840 - RNA, 64 nt, Human; identical to SEQ ID NO: 284832

SEQ ID NO: 285841 - RNA, 64 nt, Human; identical to SEQ ID NO: 284833

SEQ ID NO: 285842 - RNA, 64 nt, Human; identical to SEQ ID NO: 284834

SEQ ID NO: 285843 - RNA, 64 nt, Human; identical to SEQ ID NO: 284835

SEQ ID NO: 285844 - RNA, 64 nt, Human; identical to SEQ ID NO: 284836

SEQ ID NO: 285845 - RNA, 64 nt, Human; identical to SEQ ID NO: 284840

SEQ ID NO: 285846 - RNA, 64 nt, Human; identical to SEQ ID NO: 284841

SEQ ID NO: 285847 - RNA, 64 nt, Human; identical to SEQ ID NO: 284842

SEQ ID NO: 285848 - RNA, 64 nt, Human; identical to SEQ ID NO: 284843

SEQ ID NO: 285849 - RNA, 64 nt, Human; identical to SEQ ID NO: 284844

SEQ ID NO: 285850 - RNA, 64 nt, Human; identical to SEQ ID NO: 284845

SEQ ID NO: 285851 - RNA, 64 nt, Human; identical to SEQ ID NO: 284846

SEQ ID NO: 285852 - RNA, 64 nt, Human; identical to SEQ ID NO: 284847

SEQ ID NO: 285853 - RNA, 64 nt, Human; identical to SEQ ID NO: 284848

SEQ ID NO: 285854 - RNA, 64 nt, Human; identical to SEQ ID NO: 284849

SEQ ID NO: 285855 - RNA, 59 nt, Human
cacaccuuucuuuucuuuuccucuugugccuaguuaaguggaaauguguuuggagauag

SEQ ID NO: 285856 - RNA, 59 nt, Human
uguucaaggugagaauaagaaauagccaacuaguuaaaauguaugaaaagaaaacuuuc

SEQ ID NO: 285857 - RNA, 59 nt, Human
cgcacuugucacaguacagcuaauuuuuccuaguuaacauauuuuguacaauauuaaaa

SEQ ID NO: 285858 - RNA, 58 nt, Human; identical to SEQ ID NO: 284850

SEQ ID NO: 285859 - RNA, 64 nt, Human; identical to SEQ ID NO: 284851

SEQ ID NO: 285860 - RNA, 64 nt, Human; identical to SEQ ID NO: 284852

SEQ ID NO: 285861 - RNA, 64 nt, Human; identical to SEQ ID NO: 284853

SEQ ID NO: 285862 - RNA, 64 nt, Human; identical to SEQ ID NO: 284854

SEQ ID NO: 285863 - RNA, 64 nt, Human; identical to SEQ ID NO: 284858

SEQ ID NO: 285864 - RNA, 64 nt, Human; identical to SEQ ID NO: 284859

SEQ ID NO: 285865 - RNA, 64 nt, Human; identical to SEQ ID NO: 284860

SEQ ID NO: 285866 - RNA, 64 nt, Human; identical to SEQ ID NO: 284861

SEQ ID NO: 285867 - RNA, 64 nt, Human; identical to SEQ ID NO: 284862

SEQ ID NO: 285868 - RNA, 56 nt, Human; identical to SEQ ID NO: 284863

SEQ ID NO: 285869 - RNA, 64 nt, Human; identical to SEQ ID NO: 284864

SEQ ID NO: 285870 - RNA, 64 nt, Human; identical to SEQ ID NO: 284865

SEQ ID NO: 285871 - RNA, 64 nt, Human; identical to SEQ ID NO: 284866

SEQ ID NO: 285872 - RNA, 64 nt, Human; identical to SEQ ID NO: 284867

SEQ ID NO: 285873 - RNA, 59 nt, Human
ucuuuuacauaaagcagaagaggaaucaacuaguuaauugcaagguuucuacucuguuu

SEQ ID NO: 285874 - RNA, 59 nt, Human
guauugcuugugagaacuugaacuguuuacuaguuaauugaagaaaaaguguaacacua

SEQ ID NO: 285875 - RNA, 59 nt, Human
uuauucagcaaccagaaaauaagcugguacuaguuaaacaauuggauaucuuggcugcu

SEQ ID NO: 285876 - RNA, 64 nt, Human; identical to SEQ ID NO: 284868

SEQ ID NO: 285877 - RNA, 60 nt, Human; identical to SEQ ID NO: 284869

SEQ ID NO: 285878 - RNA, 64 nt, Human; identical to SEQ ID NO: 284870

SEQ ID NO: 285879 - RNA, 64 nt, Human; identical to SEQ ID NO: 284871

SEQ ID NO: 285880 - RNA, 64 nt, Human; identical to SEQ ID NO: 284872

SEQ ID NO: 285881 - RNA, 64 nt, Human; identical to SEQ ID NO: 284876

SEQ ID NO: 285882 - RNA, 64 nt, Human; identical to SEQ ID NO: 284877

SEQ ID NO: 285883 - RNA, 64 nt, Human; identical to SEQ ID NO: 284878

SEQ ID NO: 285884 - RNA, 64 nt, Human; identical to SEQ ID NO: 284879

SEQ ID NO: 285885 - RNA, 64 nt, Human; identical to SEQ ID NO: 284880

SEQ ID NO: 285886 - RNA, 64 nt, Human; identical to SEQ ID NO: 284881

SEQ ID NO: 285887 - RNA, 64 nt, Human; identical to SEQ ID NO: 284882

SEQ ID NO: 285888 - RNA, 64 nt, Human; identical to SEQ ID NO: 284883

SEQ ID NO: 285889 - RNA, 64 nt, Human; identical to SEQ ID NO: 284884

SEQ ID NO: 285890 - RNA, 64 nt, Human; identical to SEQ ID NO: 284885

SEQ ID NO: 285891 - RNA, 59 nt, Human
aaagugaauugacuacaaaguagacaugacuaguuaacaacacagcugggaucuaaaca

SEQ ID NO: 285892 - RNA, 59 nt, Human
cuugcaauauuucaauaggaguccaauuacuaguuaaaacacuggcggggugcgguggc

SEQ ID NO: 285893 - RNA, 59 nt, Human
gcuuaagaaaacuuucccaaaauguugaccuaguuaaaugaggcuauauaaauuucuaa

SEQ ID NO: 285894 - RNA, 64 nt, Human; identical to SEQ ID NO: 284886

SEQ ID NO: 285895 - RNA, 64 nt, Human; identical to SEQ ID NO: 284887

SEQ ID NO: 285896 - RNA, 64 nt, Human; identical to SEQ ID NO: 284888

SEQ ID NO: 285897 - RNA, 64 nt, Human; identical to SEQ ID NO: 284889

SEQ ID NO: 285898 - RNA, 64 nt, Human; identical to SEQ ID NO: 284890

SEQ ID NO: 285899 - RNA, 64 nt, Human; identical to SEQ ID NO: 284894

SEQ ID NO: 285900 - RNA, 64 nt, Human; identical to SEQ ID NO: 284895

SEQ ID NO: 285901 - RNA, 57 nt, Human; identical to SEQ ID NO: 284896

SEQ ID NO: 285902 - RNA, 64 nt, Human; identical to SEQ ID NO: 284897

SEQ ID NO: 285903 - RNA, 64 nt, Human; identical to SEQ ID NO: 284898

SEQ ID NO: 285904 - RNA, 64 nt, Human; identical to SEQ ID NO: 284899

SEQ ID NO: 285905 - RNA, 64 nt, Human; identical to SEQ ID NO: 284900

SEQ ID NO: 285906 - RNA, 64 nt, Human; identical to SEQ ID NO: 284901

SEQ ID NO: 285907 - RNA, 64 nt, Human; identical to SEQ ID NO: 284902

SEQ ID NO: 285908 - RNA, 64 nt, Human; identical to SEQ ID NO: 284903

SEQ ID NO: 285909 - RNA, 64 nt, Human; identical to SEQ ID NO: 93825

SEQ ID NO: 285910 - RNA, 64 nt, Human; identical to SEQ ID NO: 93826

SEQ ID NO: 285911 - RNA, 60 nt, Human; identical to SEQ ID NO: 93827

SEQ ID NO: 285912 - RNA, 64 nt, Human; identical to SEQ ID NO: 284904

SEQ ID NO: 285913 - RNA, 64 nt, Human; identical to SEQ ID NO: 284905

SEQ ID NO: 285914 - RNA, 64 nt, Human; identical to SEQ ID NO: 284906

SEQ ID NO: 285915 - RNA, 64 nt, Human; identical to SEQ ID NO: 284907

SEQ ID NO: 285916 - RNA, 64 nt, Human; identical to SEQ ID NO: 284908

SEQ ID NO: 285917 - RNA, 64 nt, Human; identical to SEQ ID NO: 284912

SEQ ID NO: 285918 - RNA, 64 nt, Human; identical to SEQ ID NO: 284913

SEQ ID NO: 285919 - RNA, 64 nt, Human; identical to SEQ ID NO: 284914

SEQ ID NO: 285920 - RNA, 64 nt, Human; identical to SEQ ID NO: 284915

SEQ ID NO: 285921 - RNA, 64 nt, Human; identical to SEQ ID NO: 284916

SEQ ID NO: 285922 - RNA, 64 nt, Human; identical to SEQ ID NO: 284917

SEQ ID NO: 285923 - RNA, 64 nt, Human; identical to SEQ ID NO: 284918

SEQ ID NO: 285924 - RNA, 64 nt, Human; identical to SEQ ID NO: 284919

SEQ ID NO: 285925 - RNA, 64 nt, Human; identical to SEQ ID NO: 284920

SEQ ID NO: 285926 - RNA, 64 nt, Human; identical to SEQ ID NO: 284921

SEQ ID NO: 285927 - RNA, 64 nt, Human; identical to SEQ ID NO: 93830

SEQ ID NO: 285928 - RNA, 64 nt, Human; identical to SEQ ID NO: 93831

SEQ ID NO: 285929 - RNA, 64 nt, Human; identical to SEQ ID NO: 93832

SEQ ID NO: 285930 - RNA, 64 nt, Human; identical to SEQ ID NO: 284922

SEQ ID NO: 285931 - RNA, 64 nt, Human; identical to SEQ ID NO: 284923

SEQ ID NO: 285932 - RNA, 64 nt, Human; identical to SEQ ID NO: 284924

SEQ ID NO: 285933 - RNA, 64 nt, Human; identical to SEQ ID NO: 284925

SEQ ID NO: 285934 - RNA, 64 nt, Human; identical to SEQ ID NO: 284926

SEQ ID NO: 285935 - RNA, 64 nt, Human; identical to SEQ ID NO: 284930

SEQ ID NO: 285936 - RNA, 64 nt, Human; identical to SEQ ID NO: 284931

SEQ ID NO: 285937 - RNA, 64 nt, Human; identical to SEQ ID NO: 284932

SEQ ID NO: 285938 - RNA, 64 nt, Human; identical to SEQ ID NO: 284933

SEQ ID NO: 285939 - RNA, 64 nt, Human; identical to SEQ ID NO: 284934

SEQ ID NO: 285940 - RNA, 64 nt, Human; identical to SEQ ID NO: 284935

SEQ ID NO: 285941 - RNA, 64 nt, Human; identical to SEQ ID NO: 284936

SEQ ID NO: 285942 - RNA, 64 nt, Human; identical to SEQ ID NO: 284937

SEQ ID NO: 285943 - RNA, 64 nt, Human; identical to SEQ ID NO: 284938

SEQ ID NO: 285944 - RNA, 64 nt, Human; identical to SEQ ID NO: 284939

SEQ ID NO: 285945 - RNA, 64 nt, Human; identical to SEQ ID NO: 93833

SEQ ID NO: 285946 - RNA, 64 nt, Human; identical to SEQ ID NO: 93834

SEQ ID NO: 285947 - RNA, 59 nt, Human
aauguuucuuaggauuguaggaaaauuaucuaguuaaucauaauauuugauggaaagaa

SEQ ID NO: 285948 - RNA, 64 nt, Human; identical to SEQ ID NO: 284940

SEQ ID NO: 285949 - RNA, 64 nt, Human; identical to SEQ ID NO: 284941

SEQ ID NO: 285950 - RNA, 64 nt, Human; identical to SEQ ID NO: 284942

SEQ ID NO: 285951 - RNA, 64 nt, Human; identical to SEQ ID NO: 284943

SEQ ID NO: 285952 - RNA, 64 nt, Human; identical to SEQ ID NO: 284944

SEQ ID NO: 285953 - RNA, 64 nt, Human; identical to SEQ ID NO: 284948

SEQ ID NO: 285954 - RNA, 64 nt, Human; identical to SEQ ID NO: 284949

SEQ ID NO: 285955 - RNA, 64 nt, Human; identical to SEQ ID NO: 284950

SEQ ID NO: 285956 - RNA, 64 nt, Human; identical to SEQ ID NO: 284951

SEQ ID NO: 285957 - RNA, 64 nt, Human; identical to SEQ ID NO: 284952

SEQ ID NO: 285958 - RNA, 64 nt, Human; identical to SEQ ID NO: 284953

SEQ ID NO: 285959 - RNA, 64 nt, Human; identical to SEQ ID NO: 284954

SEQ ID NO: 285960 - RNA, 64 nt, Human; identical to SEQ ID NO: 284955

SEQ ID NO: 285961 - RNA, 64 nt, Human; identical to SEQ ID NO: 284956

SEQ ID NO: 285962 - RNA, 64 nt, Human; identical to SEQ ID NO: 284957

SEQ ID NO: 285963 - RNA, 64 nt, Human; identical to SEQ ID NO: 93836

SEQ ID NO: 285964 - RNA, 64 nt, Human; identical to SEQ ID NO: 93837

SEQ ID NO: 285965 - RNA, 64 nt, Human; identical to SEQ ID NO: 93838

SEQ ID NO: 285966 - RNA, 64 nt, Human; identical to SEQ ID NO: 284958

SEQ ID NO: 285967 - RNA, 64 nt, Human; identical to SEQ ID NO: 284959

SEQ ID NO: 285968 - RNA, 64 nt, Human; identical to SEQ ID NO: 284960

SEQ ID NO: 285969 - RNA, 55 nt, Human; identical to SEQ ID NO: 284961

SEQ ID NO: 285970 - RNA, 64 nt, Human; identical to SEQ ID NO: 284962

SEQ ID NO: 285971 - RNA, 64 nt, Human; identical to SEQ ID NO: 284966

SEQ ID NO: 285972 - RNA, 64 nt, Human; identical to SEQ ID NO: 284967

SEQ ID NO: 285973 - RNA, 64 nt, Human; identical to SEQ ID NO: 284968

SEQ ID NO: 285974 - RNA, 64 nt, Human; identical to SEQ ID NO: 284969

SEQ ID NO: 285975 - RNA, 64 nt, Human; identical to SEQ ID NO: 284970

SEQ ID NO: 285976 - RNA, 64 nt, Human; identical to SEQ ID NO: 284971

SEQ ID NO: 285977 - RNA, 64 nt, Human; identical to SEQ ID NO: 284972

SEQ ID NO: 285978 - RNA, 64 nt, Human; identical to SEQ ID NO: 284973

SEQ ID NO: 285979 - RNA, 64 nt, Human; identical to SEQ ID NO: 284974

SEQ ID NO: 285980 - RNA, 64 nt, Human; identical to SEQ ID NO: 284975

SEQ ID NO: 285981 - RNA, 64 nt, Human; identical to SEQ ID NO: 93842

SEQ ID NO: 285982 - RNA, 64 nt, Human; identical to SEQ ID NO: 93843

SEQ ID NO: 285983 - RNA, 64 nt, Human; identical to SEQ ID NO: 93844

SEQ ID NO: 285984 - RNA, 64 nt, Human; identical to SEQ ID NO: 284976

SEQ ID NO: 285985 - RNA, 64 nt, Human; identical to SEQ ID NO: 284977

SEQ ID NO: 285986 - RNA, 64 nt, Human; identical to SEQ ID NO: 284978

SEQ ID NO: 285987 - RNA, 64 nt, Human; identical to SEQ ID NO: 284979

SEQ ID NO: 285988 - RNA, 64 nt, Human; identical to SEQ ID NO: 284980

SEQ ID NO: 285989 - RNA, 64 nt, Human; identical to SEQ ID NO: 284981

SEQ ID NO: 285990 - RNA, 64 nt, Human; identical to SEQ ID NO: 284982

SEQ ID NO: 285991 - RNA, 64 nt, Human; identical to SEQ ID NO: 284983

SEQ ID NO: 285992 - RNA, 64 nt, Human; identical to SEQ ID NO: 284984

SEQ ID NO: 285993 - RNA, 64 nt, Human; identical to SEQ ID NO: 284985

SEQ ID NO: 285994 - RNA, 64 nt, Human; identical to SEQ ID NO: 284986

SEQ ID NO: 285995 - RNA, 64 nt, Human; identical to SEQ ID NO: 284987

SEQ ID NO: 285996 - RNA, 64 nt, Human; identical to SEQ ID NO: 284988

SEQ ID NO: 285997 - RNA, 62 nt, Human; identical to SEQ ID NO: 93806

SEQ ID NO: 285998 - RNA, 64 nt, Human; identical to SEQ ID NO: 93807

SEQ ID NO: 285999 - RNA, 59 nt, Human
ugugcauaccaaugaauguuuuguaccaucuaguuaaauuuuuuaaauaaaguuuuaug

SEQ ID NO: 286000 - RNA, 64 nt, Human; identical to SEQ ID NO: 284740

SEQ ID NO: 286001 - RNA, 64 nt, Human; identical to SEQ ID NO: 284741

SEQ ID NO: 286002 - RNA, 64 nt, Human; identical to SEQ ID NO: 284742

SEQ ID NO: 286003 - RNA, 64 nt, Human; identical to SEQ ID NO: 284743

SEQ ID NO: 286004 - RNA, 64 nt, Human; identical to SEQ ID NO: 284744

SEQ ID NO: 286005 - RNA, 64 nt, Human; identical to SEQ ID NO: 284745

SEQ ID NO: 286006 - RNA, 64 nt, Human; identical to SEQ ID NO: 284746

SEQ ID NO: 286007 - RNA, 64 nt, Human; identical to SEQ ID NO: 284747

SEQ ID NO: 286008 - RNA, 64 nt, Human; identical to SEQ ID NO: 284751

SEQ ID NO: 286009 - RNA, 64 nt, Human; identical to SEQ ID NO: 284752

SEQ ID NO: 286010 - RNA, 64 nt, Human; identical to SEQ ID NO: 284753

SEQ ID NO: 286011 - RNA, 64 nt, Human; identical to SEQ ID NO: 284754

SEQ ID NO: 286012 - RNA, 64 nt, Human; identical to SEQ ID NO: 284755

SEQ ID NO: 286013 - RNA, 64 nt, Human; identical to SEQ ID NO: 93839

SEQ ID NO: 286014 - RNA, 64 nt, Human; identical to SEQ ID NO: 93840

SEQ ID NO: 286015 - RNA, 64 nt, Human; identical to SEQ ID NO: 93847

SEQ ID NO: 286016 - RNA, 64 nt, Human; identical to SEQ ID NO: 284756

SEQ ID NO: 286017 - RNA, 64 nt, Human; identical to SEQ ID NO: 284757

SEQ ID NO: 286018 - RNA, 64 nt, Human; identical to SEQ ID NO: 284758

SEQ ID NO: 286019 - RNA, 64 nt, Human; identical to SEQ ID NO: 284759

SEQ ID NO: 286020 - RNA, 64 nt, Human; identical to SEQ ID NO: 284760

SEQ ID NO: 286021 - RNA, 64 nt, Human; identical to SEQ ID NO: 284761

SEQ ID NO: 286022 - RNA, 64 nt, Human; identical to SEQ ID NO: 284762

SEQ ID NO: 286023 - RNA, 64 nt, Human; identical to SEQ ID NO: 284763

SEQ ID NO: 286024 - RNA, 64 nt, Human; identical to SEQ ID NO: 284764

SEQ ID NO: 286025 - RNA, 64 nt, Human; identical to SEQ ID NO: 284765

SEQ ID NO: 286026 - RNA, 64 nt, Human; identical to SEQ ID NO: 284769

SEQ ID NO: 286027 - RNA, 64 nt, Human; identical to SEQ ID NO: 284770

SEQ ID NO: 286028 - RNA, 64 nt, Human; identical to SEQ ID NO: 284771

SEQ ID NO: 286029 - RNA, 64 nt, Human; identical to SEQ ID NO: 284772

SEQ ID NO: 286030 - RNA, 64 nt, Human; identical to SEQ ID NO: 284773

SEQ ID NO: 286031 - RNA, 64 nt, Human; identical to SEQ ID NO: 93848

SEQ ID NO: 286032 - RNA, 59 nt, Human
caccugcaaauaaaacuacuagaauacugcuaguuaaaauaagugcucuauaugcauaa

SEQ ID NO: 286033 - RNA, 59 nt, Human
ugaacuauuuauuuccuccuccccuaccccuaguuaagugccacaaagacuguguuaug

SEQ ID NO: 286034 - RNA, 64 nt, Human; identical to SEQ ID NO: 284774

SEQ ID NO: 286035 - RNA, 64 nt, Human; identical to SEQ ID NO: 284775

SEQ ID NO: 286036 - RNA, 64 nt, Human; identical to SEQ ID NO: 284776

SEQ ID NO: 286037 - RNA, 64 nt, Human; identical to SEQ ID NO: 284777

SEQ ID NO: 286038 - RNA, 64 nt, Human; identical to SEQ ID NO: 284778

SEQ ID NO: 286039 - RNA, 64 nt, Human; identical to SEQ ID NO: 284779

SEQ ID NO: 286040 - RNA, 64 nt, Human; identical to SEQ ID NO: 284780

SEQ ID NO: 286041 - RNA, 64 nt, Human; identical to SEQ ID NO: 284781

SEQ ID NO: 286042 - RNA, 64 nt, Human; identical to SEQ ID NO: 284782

SEQ ID NO: 286043 - RNA, 64 nt, Human; identical to SEQ ID NO: 284783

SEQ ID NO: 286044 - RNA, 64 nt, Human; identical to SEQ ID NO: 284787

SEQ ID NO: 286045 - RNA, 64 nt, Human; identical to SEQ ID NO: 284788

SEQ ID NO: 286046 - RNA, 64 nt, Human; identical to SEQ ID NO: 284789

SEQ ID NO: 286047 - RNA, 64 nt, Human; identical to SEQ ID NO: 284790

SEQ ID NO: 286048 - RNA, 64 nt, Human; identical to SEQ ID NO: 284791

SEQ ID NO: 286049 - RNA, 59 nt, Human
uaaagcuuauuuauaaacugcagucagagcuaguuaauuuccuuaaaucuuuuuguauu

SEQ ID NO: 286050 - RNA, 59 nt, Human
aguuuucaaauacuauugaccacauugcucuaguuaauguaaggucagcucugacuuuu

SEQ ID NO: 286051 - RNA, 59 nt, Human
caugugcuaaacaaaauaauaugaaagaccuaguuaaaaauucuaaccaauguaaaaug

SEQ ID NO: 286052 - RNA, 64 nt, Human; identical to SEQ ID NO: 284792

SEQ ID NO: 286053 - RNA, 64 nt, Human; identical to SEQ ID NO: 284793

SEQ ID NO: 286054 - RNA, 64 nt, Human; identical to SEQ ID NO: 284794

SEQ ID NO: 286055 - RNA, 64 nt, Human; identical to SEQ ID NO: 284795

SEQ ID NO: 286056 - RNA, 64 nt, Human; identical to SEQ ID NO: 284796

SEQ ID NO: 286057 - RNA, 64 nt, Human; identical to SEQ ID NO: 284797

SEQ ID NO: 286058 - RNA, 64 nt, Human; identical to SEQ ID NO: 284798

SEQ ID NO: 286059 - RNA, 64 nt, Human; identical to SEQ ID NO: 284799

SEQ ID NO: 286060 - RNA, 64 nt, Human; identical to SEQ ID NO: 284800

SEQ ID NO: 286061 - RNA, 64 nt, Human; identical to SEQ ID NO: 284801

SEQ ID NO: 286062 - RNA, 64 nt, Human; identical to SEQ ID NO: 284805

SEQ ID NO: 286063 - RNA, 64 nt, Human; identical to SEQ ID NO: 284806

SEQ ID NO: 286064 - RNA, 64 nt, Human; identical to SEQ ID NO: 284807

SEQ ID NO: 286065 - RNA, 64 nt, Human; identical to SEQ ID NO: 284808

SEQ ID NO: 286066 - RNA, 64 nt, Human; identical to SEQ ID NO: 284809

SEQ ID NO: 286067 - RNA, 59 nt, Human
ucuugaagaccuagaacauagaagaaugccuaguuaaaaaaaaaaaucaaugaaacuac

SEQ ID NO: 286068 - RNA, 59 nt, Human
aguugauuuuccuauuuuaacaguaccaacuaguuaauugggaaauguaaguucugaau

SEQ ID NO: 286069 - RNA, 59 nt, Human
aaaaauuauuucuacacugacaggauuuacuaguuaagcaauguuuaauauaaauuuua

SEQ ID NO: 286070 - RNA, 64 nt, Human; identical to SEQ ID NO: 284810

SEQ ID NO: 286071 - RNA, 64 nt, Human; identical to SEQ ID NO: 284811

SEQ ID NO: 286072 - RNA, 64 nt, Human; identical to SEQ ID NO: 284812

SEQ ID NO: 286073 - RNA, 64 nt, Human; identical to SEQ ID NO: 284813

SEQ ID NO: 286074 - RNA, 64 nt, Human; identical to SEQ ID NO: 284814

SEQ ID NO: 286075 - RNA, 64 nt, Human; identical to SEQ ID NO: 284815

SEQ ID NO: 286076 - RNA, 64 nt, Human; identical to SEQ ID NO: 284816

SEQ ID NO: 286077 - RNA, 64 nt, Human; identical to SEQ ID NO: 284817

SEQ ID NO: 286078 - RNA, 64 nt, Human; identical to SEQ ID NO: 284818

SEQ ID NO: 286079 - RNA, 64 nt, Human; identical to SEQ ID NO: 284819

SEQ ID NO: 286080 - RNA, 64 nt, Human; identical to SEQ ID NO: 284822

SEQ ID NO: 286081 - RNA, 64 nt, Human; identical to SEQ ID NO: 284823

SEQ ID NO: 286082 - RNA, 64 nt, Human; identical to SEQ ID NO: 284824

SEQ ID NO: 286083 - RNA, 64 nt, Human; identical to SEQ ID NO: 284825

SEQ ID NO: 286084 - RNA, 64 nt, Human; identical to SEQ ID NO: 284826

SEQ ID NO: 286085 - RNA, 64 nt, Human; identical to SEQ ID NO: 93822

SEQ ID NO: 286086 - RNA, 64 nt, Human; identical to SEQ ID NO: 93823

SEQ ID NO: 286087 - RNA, 64 nt, Human; identical to SEQ ID NO: 93828

SEQ ID NO: 286088 - RNA, 64 nt, Human; identical to SEQ ID NO: 284827

SEQ ID NO: 286089 - RNA, 64 nt, Human; identical to SEQ ID NO: 284828

SEQ ID NO: 286090 - RNA, 64 nt, Human; identical to SEQ ID NO: 284829

SEQ ID NO: 286091 - RNA, 64 nt, Human; identical to SEQ ID NO: 284830

SEQ ID NO: 286092 - RNA, 64 nt, Human; identical to SEQ ID NO: 284831

SEQ ID NO: 286093 - RNA, 64 nt, Human; identical to SEQ ID NO: 284832

SEQ ID NO: 286094 - RNA, 64 nt, Human; identical to SEQ ID NO: 284833

SEQ ID NO: 286095 - RNA, 64 nt, Human; identical to SEQ ID NO: 284834

SEQ ID NO: 286096 - RNA, 64 nt, Human; identical to SEQ ID NO: 284835

SEQ ID NO: 286097 - RNA, 64 nt, Human; identical to SEQ ID NO: 284836

SEQ ID NO: 286098 - RNA, 64 nt, Human; identical to SEQ ID NO: 284840

SEQ ID NO: 286099 - RNA, 64 nt, Human; identical to SEQ ID NO: 284841

SEQ ID NO: 286100 - RNA, 64 nt, Human; identical to SEQ ID NO: 284842

SEQ ID NO: 286101 - RNA, 64 nt, Human; identical to SEQ ID NO: 284843

SEQ ID NO: 286102 - RNA, 64 nt, Human; identical to SEQ ID NO: 284844

SEQ ID NO: 286103 - RNA, 59 nt, Human
gcagucaguuauuauguauaggaggugagcuaguuaacaaacuuguaccacaaaacaau

SEQ ID NO: 286104 - RNA, 59 nt, Human
ggcaugguucugcuuugcuguuugucuuccuaguuaaggcucuuuauaaagagcuuguu

SEQ ID NO: 286105 - RNA, 59 nt, Human
aguaauuaaagauguugcccuuucuaaugcuaguuaacaguuggaaaauauaauugcuc

SEQ ID NO: 286106 - RNA, 64 nt, Human; identical to SEQ ID NO: 284845

SEQ ID NO: 286107 - RNA, 64 nt, Human; identical to SEQ ID NO: 284846

SEQ ID NO: 286108 - RNA, 64 nt, Human; identical to SEQ ID NO: 284847

SEQ ID NO: 286109 - RNA, 64 nt, Human; identical to SEQ ID NO: 284848

SEQ ID NO: 286110 - RNA, 64 nt, Human; identical to SEQ ID NO: 284849

SEQ ID NO: 286111 - RNA, 58 nt, Human; identical to SEQ ID NO: 284850

SEQ ID NO: 286112 - RNA, 64 nt, Human; identical to SEQ ID NO: 284851

SEQ ID NO: 286113 - RNA, 64 nt, Human; identical to SEQ ID NO: 284852

SEQ ID NO: 286114 - RNA, 64 nt, Human; identical to SEQ ID NO: 284853

SEQ ID NO: 286115 - RNA, 64 nt, Human; identical to SEQ ID NO: 284854

SEQ ID NO: 286116 - RNA, 64 nt, Human; identical to SEQ ID NO: 284858

SEQ ID NO: 286117 - RNA, 64 nt, Human; identical to SEQ ID NO: 284859

SEQ ID NO: 286118 - RNA, 64 nt, Human; identical to SEQ ID NO: 284860

SEQ ID NO: 286119 - RNA, 64 nt, Human; identical to SEQ ID NO: 284861

SEQ ID NO: 286120 - RNA, 64 nt, Human; identical to SEQ ID NO: 284862

SEQ ID NO: 286121 - RNA, 64 nt, Human; identical to SEQ ID NO: 93816

SEQ ID NO: 286122 - RNA, 64 nt, Human; identical to SEQ ID NO: 93817

SEQ ID NO: 286123 - RNA, 64 nt, Human; identical to SEQ ID NO: 93845

SEQ ID NO: 286124 - RNA, 56 nt, Human; identical to SEQ ID NO: 284863

SEQ ID NO: 286125 - RNA, 64 nt, Human; identical to SEQ ID NO: 284864

SEQ ID NO: 286126 - RNA, 64 nt, Human; identical to SEQ ID NO: 284865

SEQ ID NO: 286127 - RNA, 64 nt, Human; identical to SEQ ID NO: 284866

SEQ ID NO: 286128 - RNA, 64 nt, Human; identical to SEQ ID NO: 284867

SEQ ID NO: 286129 - RNA, 64 nt, Human; identical to SEQ ID NO: 284868

SEQ ID NO: 286130 - RNA, 60 nt, Human; identical to SEQ ID NO: 284869

SEQ ID NO: 286131 - RNA, 64 nt, Human; identical to SEQ ID NO: 284870

SEQ ID NO: 286132 - RNA, 64 nt, Human; identical to SEQ ID NO: 284871

SEQ ID NO: 286133 - RNA, 64 nt, Human; identical to SEQ ID NO: 284872

SEQ ID NO: 286134 - RNA, 64 nt, Human; identical to SEQ ID NO: 284876

SEQ ID NO: 286135 - RNA, 64 nt, Human; identical to SEQ ID NO: 284877

SEQ ID NO: 286136 - RNA, 64 nt, Human; identical to SEQ ID NO: 284878

SEQ ID NO: 286137 - RNA, 64 nt, Human; identical to SEQ ID NO: 284879

SEQ ID NO: 286138 - RNA, 64 nt, Human; identical to SEQ ID NO: 284880

SEQ ID NO: 286139 - RNA, 59 nt, Human
uugcguaguuaaacagacguguauccagucuaguuaaggaagaaacauuaagauuguuu

SEQ ID NO: 286140 - RNA, 59 nt, Human
agcuuugauaauggagcgagaugccaucucuaguuaaaaauauauauuaacaauaaagu

SEQ ID NO: 286141 - RNA, 59 nt, Human
aaauagaaacuguaaagucaucaggauagcuaguuaagucgguaaccuuaaacucaugu

SEQ ID NO: 286142 - RNA, 64 nt, Human; identical to SEQ ID NO: 284881

SEQ ID NO: 286143 - RNA, 64 nt, Human; identical to SEQ ID NO: 284882

SEQ ID NO: 286144 - RNA, 64 nt, Human; identical to SEQ ID NO: 284883

SEQ ID NO: 286145 - RNA, 64 nt, Human; identical to SEQ ID NO: 284884

SEQ ID NO: 286146 - RNA, 64 nt, Human; identical to SEQ ID NO: 284885

SEQ ID NO: 286147 - RNA, 64 nt, Human; identical to SEQ ID NO: 284886

SEQ ID NO: 286148 - RNA, 64 nt, Human; identical to SEQ ID NO: 284887

SEQ ID NO: 286149 - RNA, 64 nt, Human; identical to SEQ ID NO: 284888

SEQ ID NO: 286150 - RNA, 64 nt, Human; identical to SEQ ID NO: 284889

SEQ ID NO: 286151 - RNA, 64 nt, Human; identical to SEQ ID NO: 284890

SEQ ID NO: 286152 - RNA, 64 nt, Human; identical to SEQ ID NO: 284894

SEQ ID NO: 286153 - RNA, 64 nt, Human; identical to SEQ ID NO: 284895

SEQ ID NO: 286154 - RNA, 57 nt, Human; identical to SEQ ID NO: 284896

SEQ ID NO: 286155 - RNA, 64 nt, Human; identical to SEQ ID NO: 284897

SEQ ID NO: 286156 - RNA, 64 nt, Human; identical to SEQ ID NO: 284898

SEQ ID NO: 286157 - RNA, 64 nt, Human
gugcguucugcauagaauucaaacgagauucacccagcgcgaggaggaagaaacagcaguuccu

SEQ ID NO: 286158 - RNA, 64 nt, Human
ccuccuccccaccagcauguuugacguggguggccagcgcgaugaacgccgcaaguggauccag

SEQ ID NO: 286159 - RNA, 64 nt, Human
ccucgaagccacgauggaucgcugguuuccucugcagcgcgagggcuccggcgaccagaggauu

SEQ ID NO: 286160 - RNA, 64 nt, Human; identical to SEQ ID NO: 284899

SEQ ID NO: 286161 - RNA, 64 nt, Human; identical to SEQ ID NO: 284900

SEQ ID NO: 286162 - RNA, 64 nt, Human; identical to SEQ ID NO: 284901

SEQ ID NO: 286163 - RNA, 64 nt, Human; identical to SEQ ID NO: 284902

SEQ ID NO: 286164 - RNA, 64 nt, Human; identical to SEQ ID NO: 284903

SEQ ID NO: 286165 - RNA, 64 nt, Human; identical to SEQ ID NO: 284904

SEQ ID NO: 286166 - RNA, 64 nt, Human; identical to SEQ ID NO: 284905

SEQ ID NO: 286167 - RNA, 64 nt, Human; identical to SEQ ID NO: 284906

SEQ ID NO: 286168 - RNA, 64 nt, Human; identical to SEQ ID NO: 284907

SEQ ID NO: 286169 - RNA, 64 nt, Human; identical to SEQ ID NO: 284908

SEQ ID NO: 286170 - RNA, 64 nt, Human; identical to SEQ ID NO: 284912

SEQ ID NO: 286171 - RNA, 64 nt, Human; identical to SEQ ID NO: 284913

SEQ ID NO: 286172 - RNA, 64 nt, Human; identical to SEQ ID NO: 284914

SEQ ID NO: 286173 - RNA, 64 nt, Human; identical to SEQ ID NO: 284915

SEQ ID NO: 286174 - RNA, 64 nt, Human; identical to SEQ ID NO: 284916

SEQ ID NO: 286175 - RNA, 64 nt, Human; identical to SEQ ID NO: 93809

SEQ ID NO: 286176 - RNA, 64 nt, Human; identical to SEQ ID NO: 93810

SEQ ID NO: 286177 - RNA, 64 nt, Human; identical to SEQ ID NO: 93811

SEQ ID NO: 286178 - RNA, 64 nt, Human; identical to SEQ ID NO: 284917

SEQ ID NO: 286179 - RNA, 64 nt, Human; identical to SEQ ID NO: 284918

SEQ ID NO: 286180 - RNA, 64 nt, Human; identical to SEQ ID NO: 284919

SEQ ID NO: 286181 - RNA, 64 nt, Human; identical to SEQ ID NO: 284920

SEQ ID NO: 286182 - RNA, 64 nt, Human; identical to SEQ ID NO: 284921

SEQ ID NO: 286183 - RNA, 64 nt, Human; identical to SEQ ID NO: 284922

SEQ ID NO: 286184 - RNA, 64 nt, Human; identical to SEQ ID NO: 284923

SEQ ID NO: 286185 - RNA, 64 nt, Human; identical to SEQ ID NO: 284924

SEQ ID NO: 286186 - RNA, 64 nt, Human; identical to SEQ ID NO: 284925

SEQ ID NO: 286187 - RNA, 64 nt, Human; identical to SEQ ID NO: 284926

SEQ ID NO: 286188 - RNA, 64 nt, Human; identical to SEQ ID NO: 284930

SEQ ID NO: 286189 - RNA, 64 nt, Human; identical to SEQ ID NO: 284931

SEQ ID NO: 286190 - RNA, 64 nt, Human; identical to SEQ ID NO: 284932

SEQ ID NO: 286191 - RNA, 64 nt, Human; identical to SEQ ID NO: 284933

SEQ ID NO: 286192 - RNA, 64 nt, Human; identical to SEQ ID NO: 284934

SEQ ID NO: 286193 - RNA, 59 nt, Human
uuaccuggcuuauuuaauaugcuuauaaccuaguuaaagaaaggaaaagaaaacaaaaa

SEQ ID NO: 286194 - RNA, 59 nt, Human
aacacuuugcugcuuagaaauuucuuccgcuaguuaaccuaaaucaucucucucaaguu

SEQ ID NO: 286195 - RNA, 59 nt, Human
cagaacccacuguucauucuuaucuucugcuaguuaauauagccugaagacagaggaua

SEQ ID NO: 286196 - RNA, 64 nt, Human; identical to SEQ ID NO: 284935

SEQ ID NO: 286197 - RNA, 64 nt, Human; identical to SEQ ID NO: 284936

SEQ ID NO: 286198 - RNA, 64 nt, Human; identical to SEQ ID NO: 284937

SEQ ID NO: 286199 - RNA, 64 nt, Human; identical to SEQ ID NO: 284938

SEQ ID NO: 286200 - RNA, 64 nt, Human; identical to SEQ ID NO: 284939

SEQ ID NO: 286201 - RNA, 64 nt, Human; identical to SEQ ID NO: 284940

SEQ ID NO: 286202 - RNA, 64 nt, Human; identical to SEQ ID NO: 284941

SEQ ID NO: 286203 - RNA, 64 nt, Human; identical to SEQ ID NO: 284942

SEQ ID NO: 286204 - RNA, 64 nt, Human; identical to SEQ ID NO: 284943

SEQ ID NO: 286205 - RNA, 64 nt, Human; identical to SEQ ID NO: 284944

SEQ ID NO: 286206 - RNA, 64 nt, Human; identical to SEQ ID NO: 284948

SEQ ID NO: 286207 - RNA, 64 nt, Human; identical to SEQ ID NO: 284949

SEQ ID NO: 286208 - RNA, 64 nt, Human; identical to SEQ ID NO: 284950

SEQ ID NO: 286209 - RNA, 64 nt, Human; identical to SEQ ID NO: 284951

SEQ ID NO: 286210 - RNA, 64 nt, Human; identical to SEQ ID NO: 284952

SEQ ID NO: 286211 - RNA, 64 nt, Human; identical to SEQ ID NO: 93812

SEQ ID NO: 286212 - RNA, 64 nt, Human; identical to SEQ ID NO: 93813

SEQ ID NO: 286213 - RNA, 64 nt, Human; identical to SEQ ID NO: 93815

SEQ ID NO: 286214 - RNA, 64 nt, Human; identical to SEQ ID NO: 284953

SEQ ID NO: 286215 - RNA, 64 nt, Human; identical to SEQ ID NO: 284954

SEQ ID NO: 286216 - RNA, 64 nt, Human; identical to SEQ ID NO: 284955

SEQ ID NO: 286217 - RNA, 64 nt, Human; identical to SEQ ID NO: 284956

SEQ ID NO: 286218 - RNA, 64 nt, Human; identical to SEQ ID NO: 284957

SEQ ID NO: 286219 - RNA, 64 nt, Human; identical to SEQ ID NO: 284958

SEQ ID NO: 286220 - RNA, 64 nt, Human; identical to SEQ ID NO: 284959

SEQ ID NO: 286221 - RNA, 64 nt, Human; identical to SEQ ID NO: 284960

SEQ ID NO: 286222 - RNA, 55 nt, Human; identical to SEQ ID NO: 284961

SEQ ID NO: 286223 - RNA, 64 nt, Human; identical to SEQ ID NO: 284962

SEQ ID NO: 286224 - RNA, 64 nt, Human; identical to SEQ ID NO: 284966

SEQ ID NO: 286225 - RNA, 64 nt, Human; identical to SEQ ID NO: 284967

SEQ ID NO: 286226 - RNA, 64 nt, Human; identical to SEQ ID NO: 284968

SEQ ID NO: 286227 - RNA, 64 nt, Human; identical to SEQ ID NO: 284969

SEQ ID NO: 286228 - RNA, 64 nt, Human; identical to SEQ ID NO: 284970

SEQ ID NO: 286229 - RNA, 64 nt, Human; identical to SEQ ID NO: 93819

SEQ ID NO: 286230 - RNA, 64 nt, Human; identical to SEQ ID NO: 93820

SEQ ID NO: 286231 - RNA, 64 nt, Human; identical to SEQ ID NO: 93821

SEQ ID NO: 286232 - RNA, 64 nt, Human; identical to SEQ ID NO: 284971

SEQ ID NO: 286233 - RNA, 64 nt, Human; identical to SEQ ID NO: 284972

SEQ ID NO: 286234 - RNA, 64 nt, Human; identical to SEQ ID NO: 284973

SEQ ID NO: 286235 - RNA, 64 nt, Human; identical to SEQ ID NO: 284974

SEQ ID NO: 286236 - RNA, 64 nt, Human; identical to SEQ ID NO: 284975

SEQ ID NO: 286237 - RNA, 64 nt, Human; identical to SEQ ID NO: 284976

SEQ ID NO: 286238 - RNA, 64 nt, Human; identical to SEQ ID NO: 284977

SEQ ID NO: 286239 - RNA, 64 nt, Human; identical to SEQ ID NO: 284978

SEQ ID NO: 286240 - RNA, 64 nt, Human; identical to SEQ ID NO: 284979

SEQ ID NO: 286241 - RNA, 64 nt, Human; identical to SEQ ID NO: 284980

SEQ ID NO: 286242 - RNA, 64 nt, Human; identical to SEQ ID NO: 284981

SEQ ID NO: 286243 - RNA, 64 nt, Human; identical to SEQ ID NO: 284982

SEQ ID NO: 286244 - RNA, 64 nt, Human; identical to SEQ ID NO: 284983

SEQ ID NO: 286245 - RNA, 64 nt, Human; identical to SEQ ID NO: 284984

SEQ ID NO: 286246 - RNA, 64 nt, Human; identical to SEQ ID NO: 284985

SEQ ID NO: 286247 - RNA, 59 nt, Human
ucucuggggguggaaaggaggaagagauacuaguuaaagauuuuaaaaauguaaauaaa

SEQ ID NO: 286248 - RNA, 59 nt, Human
ucugaaauguucguuuuguggaaaagaaacuaguuaaauuuacuauuccuaacccgaau

SEQ ID NO: 286249 - RNA, 59 nt, Human
acaguccuguggucuccuuggaaauccgucuaguuaacauuucaagggcaauaccgugu

SEQ ID NO: 286250 - RNA, 64 nt, Human; identical to SEQ ID NO: 284986

SEQ ID NO: 286251 - RNA, 64 nt, Human; identical to SEQ ID NO: 284987

SEQ ID NO: 286252 - RNA, 64 nt, Human; identical to SEQ ID NO: 284988

SEQ ID NO: 286253 - RNA, 64 nt, Human
ccuccucuaccagugacguucgccaucauaccgccagcgcgacagccaccuggugccaacucac

SEQ ID NO: 286254 - RNA, 64 nt, Human
aaagaagggggccuguuggaggcugggaaccccgcagcgcgaggcugccucaucaacggcaaga

SEQ ID NO: 286255 - RNA, 64 nt, Human
ggauguaccagaagcacuagaccaggacgaccuccagcgcgaucuccagcagcuccuucggcau

SEQ ID NO: 286256 - RNA, 64 nt, Human
uaugauucaggcuggacagccuggacauuuugagcagcgcgagaguagaagugaauacccccag

SEQ ID NO: 286257 - RNA, 64 nt, Human
cagagggcaggagccccagcuuagcccugagcgccagcgcgaggaccagggccugccacuaagc

SEQ ID NO: 286258 - RNA, 64 nt, Human
cgcgcgcuccuggguccccggcaccccggccccgcagcgcgacucgcccuccagccccaacccc

SEQ ID NO: 286259 - RNA, 64 nt, Human
ggacugaccccggggcagcacugggcucaggcuucagcgcgacuguccgcauggcucccucccg

SEQ ID NO: 286260 - RNA, 64 nt, Human
caucucgcguggagggcugucguuugaacucucccagcgcgagagacccugccccgcccccuuc

SEQ ID NO: 286261 - RNA, 64 nt, Human
acgccgagcucccggccagccgccggcccgcaggcagcgcgagggaggagcugcgccgccggcu

SEQ ID NO: 286262 - RNA, 54 nt, Human
cccaggcccugacgcuaugacacacagcgcgagcccaugagaggacagaggcgg

SEQ ID NO: 286263 - RNA, 64 nt, Human
accccguuccguaggcaauaacgugcguccgccucagcgcgagauuaggaguucaaacaauggu

SEQ ID NO: 286264 - RNA, 64 nt, Human
ccagccuguaucaggcuguggccacacgagaggacagcgcgagcucaggagagauuucgugaca

SEQ ID NO: 286265 - RNA, 64 nt, Human; identical to SEQ ID NO: 93794

SEQ ID NO: 286266 - RNA, 64 nt, Human; identical to SEQ ID NO: 93795

SEQ ID NO: 286267 - RNA, 64 nt, Human; identical to SEQ ID NO: 93796

SEQ ID NO: 286268 - RNA, 64 nt, Human; identical to SEQ ID NO: 93797

SEQ ID NO: 286269 - RNA, 64 nt, Human; identical to SEQ ID NO: 93798

SEQ ID NO: 286270 - RNA, 64 nt, Human; identical to SEQ ID NO: 93799

SEQ ID NO: 286271 - RNA, 64 nt, Human; identical to SEQ ID NO: 93800

SEQ ID NO: 286272 - RNA, 64 nt, Human; identical to SEQ ID NO: 93801

SEQ ID NO: 286273 - RNA, 64 nt, Human; identical to SEQ ID NO: 93802

SEQ ID NO: 286274 - RNA, 64 nt, Human; identical to SEQ ID NO: 93803

SEQ ID NO: 286275 - RNA, 64 nt, Human; identical to SEQ ID NO: 93804

SEQ ID NO: 286276 - RNA, 64 nt, Human; identical to SEQ ID NO: 93805

SEQ ID NO: 286277 - RNA, 64 nt, Human
ggcggggacacggcgguaccguccugcgcucgggaacgcggaauguugcccuggucgccgccgc

SEQ ID NO: 286278 - RNA, 64 nt, Human
ucagacugcugagagcaacagauggagcuuugggaacgcggagaacagugggguuacagggagu

SEQ ID NO: 286279 - RNA, 64 nt, Human
guucaguaaaaguaugcacuguuagauuacugauaacgcggauagauuuuuguuuaccauaaau

SEQ ID NO: 286280 - RNA, 59 nt, Human
auucuuaggcaaauucagagaaauaagugcuaguuaauacuaaucaccuccuccucugu

SEQ ID NO: 286281 - RNA, 59 nt, Human
guauggccccccccuucccccucccaguacuaguuaauuuugaguaauuguauugucag

SEQ ID NO: 286282 - RNA, 59 nt, Human
aaagcuuaggauuaauuagaagaagcaaucuaguuaaauuucccauuuguauuuuauuu

SEQ ID NO: 286283 - RNA, 59 nt, Human
aagaauggacugcuucgacacugaaagugcuaguuaaauggauucauaugaagugcuuu

SEQ ID NO: 286284 - RNA, 59 nt, Human
ggcagggacacauguguggcauacaguuccuaguuaagaucccaaauccugagauauug

SEQ ID NO: 286285 - RNA, 59 nt, Human
ugcauacgugaggcuuaccuucuucaggacuaguuaaccagaggggcuuccuuuguaug

SEQ ID NO: 286286 - RNA, 59 nt, Human
aaaguaaaauggaaaaugauacucaauaccuaguuaaacucauuucacuucuccuggga

SEQ ID NO: 286287 - RNA, 59 nt, Human
uuugaguagguagguagguuuuaaaaauacuaguuaaaaugccacaagcaugaguguga

SEQ ID NO: 286288 - RNA, 59 nt, Human
aaacuguuaucgaacuuucuuuguugcugcuaguuaaaacuuguugcaacuuuucacuu

SEQ ID NO: 286289 - RNA, 59 nt, Human
uuugaaggaauaaauguucuuuauacagccuaguuaauguuuaaaaagaaaaaaauagc

SEQ ID NO: 286290 - RNA, 59 nt, Human
acuugcuguagaugaaugguuaacacgagcuaguuaaacagugccauuguuuugccagu

SEQ ID NO: 286291 - RNA, 59 nt, Human
cuucaaacucuucagaagcagcaacagggcuaguuaauucaacucccaauuguucugaa

SEQ ID NO: 286292 - RNA, 59 nt, Human
uucuuucagcccacuuuuaucgccuuaaccuaguuaauguauauuuugaauugugugua

SEQ ID NO: 286293 - RNA, 59 nt, Human
guuguauuccuuuuauauugcugagaaaacuaguuaaaugaucagauucuugcuguuaa

SEQ ID NO: 286294 - RNA, 59 nt, Human
acccguuuccuuuuuccucuuccuuaauucuaguuaaaacauucacuuacggagaaugu

SEQ ID NO: 286295 - RNA, 59 nt, Human
uccccauggucagaagucaacuugcacaucuaguuaaaguccaagguaacugcaaacag

SEQ ID NO: 286296 - RNA, 59 nt, Human
gcauccuaaaugcuaguuugcuucagccccuaguuaaccucaggacuugguuugcauau

SEQ ID NO: 286297 - RNA, 59 nt, Human
gagauucauccauauuguugaauguuucacuaguuaauguuuauuguucaauauuuuug

SEQ ID NO: 286298 - RNA, 59 nt, Human
acgagcuauagaaaagcuauugagaguaucuaguuaaucagugcaguaguuggaaaccu

SEQ ID NO: 286299 - RNA, 59 nt, Human
aagauucaucuuuucaguuugauaguagacuaguuaaggaagaacucuuucauuacuug

SEQ ID NO: 286300 - RNA, 59 nt, Human
uuuuuuaaucaccguuuguuuugugcuuucuaguuaaccugaugccaguacagugcaau

SEQ ID NO: 286301 - RNA, 59 nt, Human
cauaccggacuugucacacggaccucgggcuaguuaaggugugcaaagaucucuagagu

SEQ ID NO: 286302 - RNA, 59 nt, Human
cagagccuuagccacaccuaaaauaccuccuaguuaauagugguauaaaugccucuuca

SEQ ID NO: 286303 - RNA, 59 nt, Human
acccacucacuuagaugcuaaaggugauucuaguuaaucugggauuagggucaggaaaa

SEQ ID NO: 286304 - RNA, 59 nt, Human
agaagguuuucauuuucauuuuuaaagaucuaguuaauuaagguggaaaacauauaugc

SEQ ID NO: 286305 - RNA, 59 nt, Human
uauguaacugugaauaauuguauauaucucuaguuaagaaugagggaauggggagguuu

SEQ ID NO: 286306 - RNA, 59 nt, Human
agauuauuucuaucaguuacaaucuuuuucuaguuaaguguaccuaauuuauggaaugg

SEQ ID NO: 286307 - RNA, 59 nt, Human
uaaggauuaacuagcccuuuaaggauuaacuaguuaaggauuaauagcaaaagauauua

SEQ ID NO: 286308 - RNA, 59 nt, Human
acuggaagauaaugcacaaaaugaagggacuaguuaaggauuaacuagcccuuuaagga

SEQ ID NO: 286309 - RNA, 59 nt, Human
ccauuugaauaaaaugacaauaacuaaagcuaguuaaugucagugacauuaaacuaacu

SEQ ID NO: 286310 - RNA, 59 nt, Human
aagaaaaaauguuagaccaaauaaugcggcuaguuaacagugguacgauuucuagcccg

SEQ ID NO: 286311 - RNA, 59 nt, Human
accucacuaccccauugaagacgcaucaccuaguuaaccugcugcaguuuuuacaugau

SEQ ID NO: 286312 - RNA, 59 nt, Human
agcagcuuccuuucuuuccauggcacugccuaguuaacagaagucuuauaaaaauuuaa

SEQ ID NO: 286313 - RNA, 59 nt, Human
gcuuugaaugcagaagggagcagcuccuccuaguuaaguuuccacuaaaucaucgccaa

SEQ ID NO: 286314 - RNA, 59 nt, Human
accuggugaacuugcuaucugcucuguuucuaguuaaaauauaauaaauauuaucuucc

SEQ ID NO: 286315 - RNA, 59 nt, Human
gguaaauuaaaucugguaaacugaauuuccuaguuaaauaaaauuaguugcaguauaug

SEQ ID NO: 286316 - RNA, 59 nt, Human
auacaaaguuucagagaacuaccaacucucuaguuaauuuugaugaagauguuuucauu

SEQ ID NO: 286317 - RNA, 59 nt, Human
gcccucauuugcauuuguguacagauuaacuaguuaaggcuugagaagcucugaauaau

SEQ ID NO: 286318 - RNA, 59 nt, Human
aagaaugcagagaaaagcaaggagagacucuaguuaagaggugcuggcugcggggaucc

SEQ ID NO: 286319 - RNA, 59 nt, Human
ccuaggguaguucaaaaauaugaugugagcuaguuaagccuuugcuugacugauuucag

SEQ ID NO: 286320 - RNA, 59 nt, Human
uacccauaauauuggaagcagccugagggcuaguuaauccaaacaugcaucaacaauuu

SEQ ID NO: 286321 - RNA, 59 nt, Human
ugcagauuuagguuacuuuaguguauguucuaguuaauaaguuaaaauucuggacacau

SEQ ID NO: 286322 - RNA, 63 nt, Human
uuuguugauaaaaugacaauuaaaaaauggcauuuagccaaaggccuuuucagccaggaguaa

SEQ ID NO: 286323 - RNA, 63 nt, Human
gaaucugccuuggagcacugcugguuuuauauauuagccaaagguuuuguucuggccuucugu

SEQ ID NO: 286324 - RNA, 63 nt, Human
ugacugcauacucgauauguuguuuuuguaacuuuagccaaaagaaaguaaccuuuaguggca

SEQ ID NO: 286325 - RNA, 63 nt, Human
auuuugcuguaaggcuuaaugcucuucuuuuguuuagccaagaaaacauucuuaguuggaaac

SEQ ID NO: 286326 - RNA, 63 nt, Human
aaaguauguaacauucccaguuucagccacaauuuagccaagaauaagauaaaaacuugaaua

SEQ ID NO: 286327 - RNA, 63 nt, Human
gugggccaguuguggcucaaauccucuauauuuuuagccaauggcaaucaaauucuuucagcu

SEQ ID NO: 286328 - RNA, 63 nt, Human
ggggcauggcugcugacgugggcauggguggauuuagccaaggaccuggcaacccaggaaaca

SEQ ID NO: 286329 - RNA, 62 nt, Human
guggggaugaggucaccaggggaggagccugugcgucccagcugaaggcaguggcaggggag

SEQ ID NO: 286330 - RNA, 62 nt, Human
ugagccccagcgggcuggcgggccuuuuuccugcgucccagccugcaccccuccggccccgu

SEQ ID NO: 286331 - RNA, 63 nt, Human
cauagaaaccugugucuacaaaaaauuuaaaaauuagccaaguauggugacaggcaccuaugg

SEQ ID NO: 286332 - RNA, 63 nt, Human
ccauuccuaccuugcauuuuuccugucagugccuuagccaaggcaaggagauaaggaugcucu

SEQ ID NO: 286333 - RNA, 63 nt, Human
gauaaaaccccaucucuacaaaaagcauaaaaauuagccaagugugguagagugugccugaag

SEQ ID NO: 286334 - RNA, 63 nt, Human
gcaucccuccucugcucuccaucauaacugcuauuagccaaauucaggcccagucaucuccua

SEQ ID NO: 286335 - RNA, 63 nt, Human
ugugaucuccauuacuuuauuuuccuggagguauuagccaacacaguuagaucagagaaagca

SEQ ID NO: 286336 - RNA, 63 nt, Human
gagaauaaacaucauaguuucuuggccacugaauuagccaaaacacuuaggaagaaaucacuu

SEQ ID NO: 286337 - RNA, 63 nt, Human
uuuccgcacaggauuuccuaagacgagagggauuuagccaagagcacagacuuggauuccuuc

SEQ ID NO: 286338 - RNA, 63 nt, Human
acucaggcagaucucagcccucuacugagucccuuagccaagcaguuucuuucaaagaagcca

SEQ ID NO: 286339 - RNA, 63 nt, Human
uuguuuuaaauuguauacaagcuguacauaaaauuagccaaaugaaucauuucuuauaucuua

SEQ ID NO: 286340 - RNA, 63 nt, Human
acauugguagacuccuaaaauacaguugacaacuuagccaauugcaacuccaguguugauaau

SEQ ID NO: 286341 - RNA, 63 nt, Human
uuucuucaaauagcuugcuuacaugauaaucaauuagccaaccaugagucauuuagaauagug

SEQ ID NO: 286342 - RNA, 63 nt, Human
agucugauuaggaaugauggcacugguuguauuuuagccaagacaguuuagcauggagcuauu

SEQ ID NO: 286343 - RNA, 63 nt, Human
uuucaaugcauuuuuuucauguaagcccuuuuuuuagccaaaauguaaaaauggcuguaauau

SEQ ID NO: 286344 - RNA, 63 nt, Human
ugcaauugcuuauguuaucuucaucaugaaauuuuagccaagucuuauguccagaaugguauu

SEQ ID NO: 286345 - RNA, 63 nt, Human
cuagcuaaaccagaaaggugauuccaggaggaguuagccaaacaacaacaaaaacaaaaaaug

SEQ ID NO: 286346 - RNA, 63 nt, Human
cccgaagugccaaauuccaggaggacaagagccuuagccaaugacaacucacucuccccuacu

SEQ ID NO: 286347 - RNA, 63 nt, Human
gaaaccccgucuccacuaaaaaauacaaaaaaauuagccaagcaugguggcaggcgccuguag

SEQ ID NO: 286348 - RNA, 64 nt, Human; identical to SEQ ID NO: 6145

SEQ ID NO: 286349 - RNA, 64 nt, Human; identical to SEQ ID NO: 6146

SEQ ID NO: 286350 - RNA, 64 nt, Human; identical to SEQ ID NO: 6147

SEQ ID NO: 286351 - RNA, 63 nt, Human
uuagucuacgccccacuguuuccacccauccccuuagccaaccucugucuuuuugaauuuucu

SEQ ID NO: 286352 - RNA, 63 nt, Human
uuucaguguuuugucugauuuuaauguccguucuuagccaagcugcuagcagguguuaauugg

SEQ ID NO: 286353 - RNA, 63 nt, Human
ucucuacaaaaaaagcaacaacgacaaaaaaaauuagccaagcauaguggcacaccccuguag

SEQ ID NO: 286354 - RNA, 63 nt, Human
ugccaucagucccuguuauugagggauuaucccuuagccaacauuccuaucugugggugggcg

SEQ ID NO: 286355 - RNA, 63 nt, Human
aggguacggagucuucaggcccaguuucucacuuuagccaauucgagggcuccuugugguggg

SEQ ID NO: 286356 - RNA, 63 nt, Human
aacacaaaaaagaagcuaccuaugauccuggauuuagccaaagugcuagcgcuuuccugagaa

SEQ ID NO: 286357 - RNA, 63 nt, Human
uuauccauguuugcuuaaugcuucugcuaaguguuagccaaaaucuagccauuuauauuuagu

SEQ ID NO: 286358 - RNA, 63 nt, Human
ggaaaagaguauuuuucuaauacguugcaaggauuagccaaaucuucuuauugaagaaagaag

SEQ ID NO: 286359 - RNA, 63 nt, Human
gugaaaccccauuucuacuaaaaauacaaaaaauuagccaagugugguggcauaugccuguaa

SEQ ID NO: 286360 - RNA, 63 nt, Human
uagaaauuaauauacuuauaaaauuaagauuuauuagccaaacuugaauucuaguuuuaaaac

SEQ ID NO: 286361 - RNA, 63 nt, Human
uacuucccauguuaccaaaauacccccaacucuuuagccaaaagagaacccugaccuccugag

SEQ ID NO: 286362 - RNA, 63 nt, Human
accuacccgguauuuuaaauguucuguaaauuauuagccaaauagaacuguaaugggguugua

SEQ ID NO: 286363 - RNA, 63 nt, Human
cauucucagauaggggcacccaagcuaaggguauuagccaaagaugccaggauggguagcuag

SEQ ID NO: 286364 - RNA, 63 nt, Human
auggaccaggaugaagagggaucaaagagauaauuagccaaaaacccaguagccuagaagaua

SEQ ID NO: 286365 - RNA, 63 nt, Human
agauacaaaacuccacuggccucuaaaauuauauuagccaagagugguuucauuugagugccu

SEQ ID NO: 286366 - RNA, 63 nt, Human
guuuuucagauucuucauugggauauuaaaauauuagccaaauuucucucuguuuuauauaug

SEQ ID NO: 286367 - RNA, 63 nt, Human
aauuguaauuuuuaaaaaggcuacaauuaaauuuuagccaaugccacucaccaaaucuuugca

SEQ ID NO: 286368 - RNA, 62 nt, Human
cagacggugugguugggggugggaggugagcuagacccaacccuuagcuuuuagccuggcug

SEQ ID NO: 286369 - RNA, 62 nt, Human
cuugucaccccaguucccuugguggcaaccccagacccaacccaugccccugacagaucuag

SEQ ID NO: 286370 - RNA, 64 nt, Human; identical to SEQ ID NO: 6148

SEQ ID NO: 286371 - RNA, 63 nt, Human
caguucucuucccugcaguguuuucauuuuauuuuagccaaacauuuugccuguuuucuguuu

SEQ ID NO: 286372 - RNA, 63 nt, Human
guuguuaacccauccuuucauuuacucauauaauuagccaaaaaaaaaaggauggcuacauac

SEQ ID NO: 286373 - RNA, 63 nt, Human
acucggcuguuaggccauucucuaaauucuaguuuagccaaaaguuuaugugugguuuggggc

SEQ ID NO: 286374 - RNA, 63 nt, Human
agcuaaguuuuuguuucauuuugauuuuuuuuuuuagccaaccaccuugucaggaaaggauga

SEQ ID NO: 286375 - RNA, 63 nt, Human
agggcuagggcuggaggggccaggugaucuuccuuagccaaucccaguccgucugugucagcc

SEQ ID NO: 286376 - RNA, 63 nt, Human
uuuagauaauuuauaguaaaacugaaauuauuauuagccaaugcauuggugcauagaauuuac

SEQ ID NO: 286377 - RNA, 63 nt, Human
cgcauggagcauuuugcuucuggggugucuuccuuagccaaagggaacgugucauuugcucga

SEQ ID NO: 286378 - RNA, 63 nt, Human
gugaaacccuaucuccgugaaaaaauaugaaaauuagccaagagugguggcacaugccuguag

SEQ ID NO: 286379 - RNA, 63 nt, Human
cagggagaagggacaagacuuuuaaaagacuuguuagccaacuucaagaauuaauauuuaugu

SEQ ID NO: 286380 - RNA, 63 nt, Human
cugggcuuaaguuuuacuugaggaucauaugaauuagccaaaagaauggcugacuguugccuu

SEQ ID NO: 286381 - RNA, 63 nt, Human
uaacuucuuccauauuuucucacuaaucucccguuagccaaaauaugccagaaaugggaaaga

SEQ ID NO: 286382 - RNA, 63 nt, Human
uuuuacaucuuuuugaagcacugccacagguuauuagccaagguggccuuccuucacagucau

SEQ ID NO: 286383 - RNA, 63 nt, Human
uuauuuagaaucacuuuaaucaaccaauaauccuuagccaauuuauaagggacuuuuauuugu

SEQ ID NO: 286384 - RNA, 63 nt, Human
uuguauuuuuuguagagacgggguuucaccauguuagccaagauggucucgaucuccugaccu

SEQ ID NO: 286385 - RNA, 63 nt, Human
cuuuggcagucuucauuuacuaccacuuguucuuuagccaaaagcugauuacauaugauauaa

SEQ ID NO: 286386 - RNA, 63 nt, Human
acuuuaaauguucuguauuuguaucuguuuuuauuagccaauuagugggauuuuaugccaguu

SEQ ID NO: 286387 - RNA, 63 nt, Human
agcaauuucucuguacuucuauauaugaaugucuuagccaauuuucugcuacuauaacagaau

SEQ ID NO: 286388 - RNA, 64 nt, Human; identical to SEQ ID NO: 6150

SEQ ID NO: 286389 - RNA, 64 nt, Human; identical to SEQ ID NO: 6151

SEQ ID NO: 286390 - RNA, 64 nt, Human; identical to SEQ ID NO: 6152

SEQ ID NO: 286391 - RNA, 63 nt, Human
gaugucucugguucuauagugcaaaugcuuuuauuagccaauaggaauuuuaaaauaacaugg

SEQ ID NO: 286392 - RNA, 63 nt, Human
cauauaguuuggacugaaucacaucuguaguacuuagccaaagacaauuuggaggagaauauc

SEQ ID NO: 286393 - RNA, 63 nt, Human
agauacuuagcaaaugccauucauauaguauuguuagccaaacuauuauuccuuccuuagaag

SEQ ID NO: 286394 - RNA, 63 nt, Human
auuucuuucauuugucuagugaaucagaaaggcuuagccaaggccacaucugggaagagugga

SEQ ID NO: 286395 - RNA, 63 nt, Human
cugccaggaucaacugcccagagugccagaguuuuagccaaagguguacuuacuuccuuauuu

SEQ ID NO: 286396 - RNA, 63 nt, Human
uaacuggcuauucauucauccuucaggaggaucuuagccaagaauauuugcaaugacacauga

SEQ ID NO: 286397 - RNA, 63 nt, Human
aauagacacuuaaugcaaucuuuuuuccugauauuagccaaugggagaauuaacaaugucuag

SEQ ID NO: 286398 - RNA, 63 nt, Human
gaaagcucuauguuuucguuaauaaagggcaacuuagccaaguuuaaggucgcgugcgaugca

SEQ ID NO: 286399 - RNA, 63 nt, Human
uccggcccccgucuuguaaaaaggggaggagaauuagccaaacacuguaagcuuuuaagaaaa

SEQ ID NO: 286400 - RNA, 63 nt, Human
aaauuguucuuccuuggagugucuuggcuauucuuagccaacuguuccuccauauuacuucua

SEQ ID NO: 286401 - RNA, 63 nt, Human
aauuaucaaagcugauacagcacauauacagaauuagccaaaugguauaagacaauagaaaaa

SEQ ID NO: 286402 - RNA, 63 nt, Human
ggagggaugauggcugguguuauuggccaguuuuuagccaauccaacugaccuagugaagguu

SEQ ID NO: 286403 - RNA, 63 nt, Human
caagacugaacaccgacuaagguuuucauacuauuagccaaugcuguagacagaagcauuuug

SEQ ID NO: 286404 - RNA, 63 nt, Human
acaccgucucuacaaaaaaaaaaaaaaaaaaaauuagccaaguacaguggggcacaccuauag

SEQ ID NO: 286405 - RNA, 63 nt, Human
gaacuugagauagggccuaauuuguuauacauauuagccaacauguuggcuuaguaagucuaa

SEQ ID NO: 286406 - RNA, 63 nt, Human
ggaaggugcuguacaguucauuccuuugcaccauuagccaaucugucuuuuauggauucugug

SEQ ID NO: 286407 - RNA, 63 nt, Human
cccugcugcauuuuacccucaucaugcaccacuuuagccaaauucugucuccugcauacacuc

SEQ ID NO: 286408 - RNA, 63 nt, Human
uaauugaaacccuauugagaggugaugucuguguuagccaaugacccaggugagcugcucggg

SEQ ID NO: 286409 - RNA, 62 nt, Human
ggcugcagcucacccagccccaggggcagaagagacccaaccacuucuauuuuuugaggcua

SEQ ID NO: 286410 - RNA, 62 nt, Human
ggguccaagccuggggcugccucugcucuccaagacccaaagacccugggaaccuccucugg

SEQ ID NO: 286411 - RNA, 63 nt, Human
gacacaaaacaucuaaugccaauauauacaugauuagccaacaucuuugcuaucaagaccacu

SEQ ID NO: 286412 - RNA, 63 nt, Human
uaaauaaaaugguaguaaugaaugcaaucaguauuagccaaaauaaagaauuuaugagucauu

SEQ ID NO: 286413 - RNA, 63 nt, Human
uucuaggucauuaacguuuuuuauuuaguuucuuuagccaauaguggcugaguuucgcacuug

SEQ ID NO: 286414 - RNA, 63 nt, Human
ucuccaaugcauuuuuuuacauaguugugagcguuagccaaguuauuuucauguuguuaugua

SEQ ID NO: 286415 - RNA, 63 nt, Human
gaaacuuaaggcaaaaaagaucccugggauuacuuagccaaggcuuaaauuuauuuuucaaag

SEQ ID NO: 286416 - RNA, 63 nt, Human
aacuucuuuaacgagaucaugaauucuuuucccuuagccaaaacaugaaauauuuaaccuagu

SEQ ID NO: 286417 - RNA, 63 nt, Human
aaccuuacaaaugugaggaauguggcaaagguuuuagccaacucucaaaccuuacuaaacaca

SEQ ID NO: 286418 - RNA, 63 nt, Human
agcaaaagacugauuucaugauggggaaaacaauuagccaaaguuuaauuucuuacacugugg

SEQ ID NO: 286419 - RNA, 63 nt, Human
cugaagugugacuaccuccacucaugucccauuuuagccaagcuuauuuaagaucacagugaa

SEQ ID NO: 286420 - RNA, 63 nt, Human
caaaugacauauugaaagcaaaggcuguuuuauuuagccaagaugauuaccauuaggaguuac

SEQ ID NO: 286421 - RNA, 63 nt, Human
gcagccugcccuaucuccgcauuuccaguuguauuagccaauagauuuccuacuuauuuaagc

SEQ ID NO: 286422 - RNA, 63 nt, Human
gccaacauggugaaacccugucucuacuaaaaauuagccaagugugguaauguucaccugcag

SEQ ID NO: 286423 - RNA, 63 nt, Human
uucaggagguugggggaaaagauguuuaugaguuuagccaacagaacagguaauuuacuccug

SEQ ID NO: 286424 - RNA, 63 nt, Human
uaaaaucuaaauucagucuuuaaugaaauaauauuagccaaaugguggaacuaauuuauuucu

SEQ ID NO: 286425 - RNA, 63 nt, Human
cccuagauaccacagccugcccccuccccuccuuuagccaagucaggaucuuaggccucagca

SEQ ID NO: 286426 - RNA, 63 nt, Human
aggguuggagucucuaagauugagaggucugaguuagccaaugaagacaucugagauccuauc

SEQ ID NO: 286427 - RNA, 63 nt, Human
uuuuuugccgcagccaauaagauaauagcagaauuagccaauccuaaaaccuucuaaagacga

SEQ ID NO: 286428 - RNA, 64 nt, Human; identical to SEQ ID NO: 6153

SEQ ID NO: 286429 - RNA, 64 nt, Human; identical to SEQ ID NO: 6154

SEQ ID NO: 286430 - RNA, 64 nt, Human; identical to SEQ ID NO: 6156

SEQ ID NO: 286431 - RNA, 63 nt, Human
uuuacagaugacuaaaaauguuaauuuuaugacuuagccaaauauguucuagguugcauauau

SEQ ID NO: 286432 - RNA, 63 nt, Human
gucucuccccuggcaaaacaagagcuggguaguuuagccaaacggcacccccucgaguucacu

SEQ ID NO: 286433 - RNA, 63 nt, Human
guugccauagugcuguauuugaaaaucgaugcuuuagccaaaagcugaaugaccaccguuucc

SEQ ID NO: 286434 - RNA, 63 nt, Human
uuuuaauauggcaaagcaaccuuaagcucuauuuuagccaaaugaaacauaaucugaaauuau

SEQ ID NO: 286435 - RNA, 63 nt, Human
gaaauaucucaggauagcacuuuuggcaaacucuuagccaaggcuucuucauuggugcuguua

SEQ ID NO: 286436 - RNA, 63 nt, Human
ucugcucacgcuuccaaguuguucucaaugacauuagccaaaguuggguuugccauucauccc

SEQ ID NO: 286437 - RNA, 63 nt, Human
ggcuggaggcgccuuccccucgcggucccccacuuagccaaggcgugggggcggaaagguggc

SEQ ID NO: 286438 - RNA, 63 nt, Human
acuguauuauggcugauuuucuuuuuaauauauuuagccaagugaugcacuuuaugauaauua

SEQ ID NO: 286439 - RNA, 63 nt, Human
agcacuuugcugagaggguuuuaacaaaucauauuagccaaaaagccuacaacauagaugcau

SEQ ID NO: 286440 - RNA, 63 nt, Human
aaguauuuuuuaaaaaccugcaaagauauaaauuuagccaaguuaccugacgggugagaagaa

SEQ ID NO: 286441 - RNA, 63 nt, Human
gaaagaaauggugggaaacucuccccguaaugcuuagccaacuuuaaaguguacccuucaaua

SEQ ID NO: 286442 - RNA, 63 nt, Human
augcauuuaauaucucuuaccugaaaucauaacuuagccaagccuaccuuaaauguucucaga

SEQ ID NO: 286443 - RNA, 63 nt, Human
ucaucaguuuuccugauuuacaagugcaauauuuuagccaaugccuugggagaagcugccaug

SEQ ID NO: 286444 - RNA, 63 nt, Human
cugagcuguugguggcccugggcuuugggccccuuagccaauguccuugucucuugucuuugg

SEQ ID NO: 286445 - RNA, 63 nt, Human
uucagagacugcggaggggcuuggcagacggucuuagccaagggcugugguggcauuggccga

SEQ ID NO: 286446 - RNA, 63 nt, Human
uugugguuaauguaacaaauauguucuucauauuuagccaauauauuaauuuccuuuuucauu

SEQ ID NO: 286447 - RNA, 63 nt, Human
ugugguuaauguaacaauauauguucuucauauuuagccaauauauuaauuuccuuuuucauu

SEQ ID NO: 286448 - RNA, 62 nt, Human
uuauugcugaaugguucuuuaguuauuaaccuagacccaaaucaaagaccaguuggauuuau

SEQ ID NO: 286449 - RNA, 62 nt, Human
ucagcaucaagccccacaguucuuaauacaggagacccaacaaugaguggacaagucaugga

SEQ ID NO: 286450 - RNA, 62 nt, Human
uaccauucagcaugagauuugggcaggaacacagacccaaaccauaccacacacauuaucau

SEQ ID NO: 286451 - RNA, 63 nt, Human
uguggugaauguaacaauauauguucuucauauuuagccaauauauuaauuuccuuuuucauu

SEQ ID NO: 286452 - RNA, 63 nt, Human
cagaacaaugaaacauacucucccuacacuugcuuagccaagagauaccacucagguaacuuu

SEQ ID NO: 286453 - RNA, 63 nt, Human
ggaaguguaacagcugaggucucuugagggagcuuagccaaugugggagcagcgguuugggga

SEQ ID NO: 286454 - RNA, 63 nt, Human
uauaccguucaguauaaaaguguccuaagcauauuagccaaucuuuucacaguagagcauacu

SEQ ID NO: 286455 - RNA, 63 nt, Human
cccaguagcaacuagaucucuuuuaccucuucuuuagccaagaagcaagaucugucacccaca

SEQ ID NO: 286456 - RNA, 63 nt, Human
gugagaagaaaauuaauguauuagcaaccaguguuagccaacucugcuguaauuaccuuuaga

SEQ ID NO: 286457 - RNA, 63 nt, Human
aaaauuacuuguuaaacucuaguucuuaaguuguuagccaaguaaauaucauuguugaacuga

SEQ ID NO: 286458 - RNA, 63 nt, Human
cccguucacauuuuuguauuuuguuuaaauuaguuagccaauauuuuucuuacugauuuuuaa

SEQ ID NO: 286459 - RNA, 63 nt, Human
ucacggccugguguugugauacugggaagagcauuagccaagaacuugucucuuugaucuguu

SEQ ID NO: 286460 - RNA, 63 nt, Human
uucucagguuauuaaucaaaauuauuguauaaguuagccaauagaauuuuuagguuaaaacaa

SEQ ID NO: 286461 - RNA, 63 nt, Human
cugcuguucucugcugugugggcccuuaaagucuuagccaagagccaagacauagcccuguga

SEQ ID NO: 286462 - RNA, 63 nt, Human
uacauagaagguuuguuugacagaggagaaaaauuagccaaggaagauuguuguuuaaauuca

SEQ ID NO: 286463 - RNA, 63 nt, Human
caccuuuaggggacccuccauguuugcuggguauuagccaagcugguccugggagaaugcaga

SEQ ID NO: 286464 - RNA, 63 nt, Human
uaacaaauaaccuauaaaguguuuaugacaaauuuagccaauaaagaaauuaacacccaaaag

SEQ ID NO: 286465 - RNA, 63 nt, Human
aaagcacggggcuguaaauuaccauuuacuagauuagccaaauagucugaauuuccagaaaac

SEQ ID NO: 286466 - RNA, 63 nt, Human
uugagaagcacuguuccagccugcccucuucauuuagccaaugcuuacugcgcuagacgcuuc

SEQ ID NO: 286467 - RNA, 63 nt, Human
ccccauuuuucccgagccccgcccacagagcucuuagccaauccuaugcagagagcaucuccu

SEQ ID NO: 286468 - RNA, 64 nt, Human; identical to SEQ ID NO: 6160

SEQ ID NO: 286469 - RNA, 64 nt, Human; identical to SEQ ID NO: 6161

SEQ ID NO: 286470 - RNA, 64 nt, Human; identical to SEQ ID NO: 6162

SEQ ID NO: 286471 - RNA, 63 nt, Human
ugccaccuuuuggguguggugucaccagccuguuuagccaaguagcuuugggcauaggcugcc

SEQ ID NO: 286472 - RNA, 63 nt, Human
gcuaaagcagaaauggaacuuccggaucugaaauuagccaauauaauguucuuuuguauuugg

SEQ ID NO: 286473 - RNA, 63 nt, Human
guguaaaaaaaaaaaaucucaguuauguuuuuauuagccaaauucuaaugauuggcuccugga

SEQ ID NO: 286474 - RNA, 63 nt, Human
auugaauacacccaaccuacugaacaucguagcuuagccaagccuaccuuaaaugcucugaga

SEQ ID NO: 286475 - RNA, 63 nt, Human
aaaaacuaugucaguauuuuaauaugguuacauuuagccaaaguugagggaaagagcuuauaa

SEQ ID NO: 286476 - RNA, 63 nt, Human
cugcagggugcccguggcuguggccagugucccuuagccaaccugcugggcucaccaguuccc

SEQ ID NO: 286477 - RNA, 63 nt, Human
ggaggguggcuucuccugacuggcaggaugaccuuagccaagauauuccucuguucccucugc

SEQ ID NO: 286478 - RNA, 63 nt, Human
caaggucagcuuggcuggucugaggccaccuucuuagccaaaaaccuaggguucauuuucagg

SEQ ID NO: 286479 - RNA, 63 nt, Human
guugucaguuuuaucgcaaagauguuuuguauuuuagccaaaucuuuuuauaguacaaacuua

SEQ ID NO: 286480 - RNA, 63 nt, Human
aggauuaccugaggcaaggaguuugagaccagcuuagccaacauaguaagacccccaucucuu

SEQ ID NO: 286481 - RNA, 63 nt, Human
cagggaaagaagaguucugagcagggccuagucuuagccaauauuaaaacauacuaugaagcc

SEQ ID NO: 286482 - RNA, 63 nt, Human
auccagacccuuucacaaacaaguucugaguuuuuagccaauugauccucuacuuuccuucuu

SEQ ID NO: 286483 - RNA, 63 nt, Human
guuccucagacagaccucaauaugguaacccaguuagccaagauguuggaugcguugcuagaa

SEQ ID NO: 286484 - RNA, 63 nt, Human
uucccuucuuggugcuuacacaucucagacccuuuagccaaacccuugucagugacaguauuu

SEQ ID NO: 286485 - RNA, 63 nt, Human
gaacuuacagugugguuugagcacuggguucuuuuagccaaauuccauacaaaaagaauuugg

SEQ ID NO: 286486 - RNA, 63 nt, Human
gcuuucaucagaaguuacacagaccacagugauuuagccaaauaagucuuaaccaaaaaaagg

SEQ ID NO: 286487 - RNA, 63 nt, Human
gccccuggaauagcuuucaugccaaguuuagaauuagccaaugaaauguaaauaaacuuugga

SEQ ID NO: 286488 - RNA, 63 nt, Human
uuugguaucugugugacugcucugugcccauccuuagccaacuugcuggcgugacaagugccc

SEQ ID NO: 286489 - RNA, 63 nt, Human
agugagaggcagcuucucagcagcaggugcuccuuagccaaauaugggaucuucucccacacu

SEQ ID NO: 286490 - RNA, 62 nt, Human
uuugagucugaauccccggccucugucaccugagacccaaccccuagcugggccaacuccag

SEQ ID NO: 286491 - RNA, 63 nt, Human
gaaagacuuaugaagucuuuuacuaccucuggguuagccaaacaaccuucaaaaagcauuguu

SEQ ID NO: 286492 - RNA, 63 nt, Human
aacuccagacugguguucuggggcaaagagcuauuagccaaacugauucuaugcaggugaagg

SEQ ID NO: 286493 - RNA, 63 nt, Human
agccaaaacaccaggaaacacauuucuguggccuuagccaagcaguuuguuaguuacauauuc

SEQ ID NO: 286494 - RNA, 63 nt, Human
acacaaacagguaguucguugggggcaaaugaauuagccaacuguuaacuggaagcuuuugau

SEQ ID NO: 286495 - RNA, 63 nt, Human
cagggacugauuucuauuuaucuugacuuuauauuagccaauuugaaagggucugcuucacaa

SEQ ID NO: 286496 - RNA, 63 nt, Human
gacaggguuucacugucccuuaagaccauccuguuagccaagauggucuugaucuccugaccu

SEQ ID NO: 286497 - RNA, 63 nt, Human
uucuuguuucauuacguauuuagggcauacauguuagccaaaucuacacucagccuaacucuu

SEQ ID NO: 286498 - RNA, 63 nt, Human
uuguguuagcacuggguaagcuuuaauugucccuuagccaaucaaacauuaaggacuauggag

SEQ ID NO: 286499 - RNA, 63 nt, Human
uuaccauuccuguuauaaacuaguauuuguuguuuagccaaaacagaaaaugauuuccacugg

SEQ ID NO: 286500 - RNA, 63 nt, Human
gucaccuuuacuugccuuugcagaaaacagaacuuagccaaaccuaaguaagagucaugccug

SEQ ID NO: 286501 - RNA, 63 nt, Human
uauuauuguacagaugaagcgaauugacucccuuuagccaacugcuaauggaucgaaugugcu

SEQ ID NO: 286502 - RNA, 63 nt, Human
guuauuuuccagguacccuucucgcuuuugccauuagccaaggauagaagcugcagugguauu

SEQ ID NO: 286503 - RNA, 63 nt, Human
gacacauaucccuguuagcauuccccgggaccuuuagccaagaggagcugcagggaccauggc

SEQ ID NO: 286504 - RNA, 63 nt, Human
agccauucucuuuucagagcauauaauacuaucuuagccaaacuugccuuugcuucacucauc

SEQ ID NO: 286505 - RNA, 63 nt, Human
uauagaacccaaggaaugccuuccugucauauuuuagccaaaacaacugguuauaugccuccc

SEQ ID NO: 286506 - RNA, 63 nt, Human
cauagccuucuuaagcagagguguuccauuguuuuagccaauccuugguugaaucuuaggaau

SEQ ID NO: 286507 - RNA, 63 nt, Human
gcaacaacaguaagucucuaagucaaucauuuguuagccaagcaaagccauuuauugauggug

SEQ ID NO: 286508 - RNA, 62 nt, Human
auuuuauaauauuuuuuuuuaaucuaggaaaaagacccaaacaaaucuaacuucuugcuuuc

SEQ ID NO: 286509 - RNA, 62 nt, Human
cuacuucaaguacacuuccacaccaggaaaacagacccaaauuccauaaacagaacugacgu

SEQ ID NO: 286510 - RNA, 62 nt, Human
gaagggcaagagagguggaucugugagggaaaagacccaauaggauaacucaaguuacuggu

SEQ ID NO: 286511 - RNA, 63 nt, Human
ccuuaacccaaaugaaaguaaaucccuuuccccuuagccaaaauaagguuggguuuucuaaaa

SEQ ID NO: 286512 - RNA, 63 nt, Human
cagugacuccugcugguaccugcccucuauuuauuagccaacuguuucccugcugaaugccuc

SEQ ID NO: 286513 - RNA, 63 nt, Human
cgguuguaggacuaaauaaugaucuuccaaauauuagccaaagaggcauucagcaauuaaaga

SEQ ID NO: 286514 - RNA, 63 nt, Human
ugucuuucuacuguggcagggaggcuucccccuuuagccaaaagaaagaugguccggagccca

SEQ ID NO: 286515 - RNA, 63 nt, Human
gguugauugcugccaauguugauugcugaggccuuagccaagauuucaggcaucauuugcucc

SEQ ID NO: 286516 - RNA, 63 nt, Human
uucccccaccagcagccauggcuggcuggggcuuuagccaagccaccuacugccaggaauugg

SEQ ID NO: 286517 - RNA, 63 nt, Human
ucucuuccuuucuuuuuuuaaaaaauagcagcuuuagccaagugcagggccuguaaucccagc

SEQ ID NO: 286518 - RNA, 63 nt, Human
ggugaaaccucaucucuacuaaaaauacaaaaauuagccaagugugauggcacauaccuguaa

SEQ ID NO: 286519 - RNA, 63 nt, Human
uccuccucaucccaucucacucuccgugguaacuuagccaacuugaccccucucaucccacuc

SEQ ID NO: 286520 - RNA, 63 nt, Human
uccuguuugccucuuuuauuuaaugccaaaguuuuagccaaagacaucuuccuacuuuuguug

SEQ ID NO: 286521 - RNA, 63 nt, Human
cauguuaccuuuaugauuaaaguaucauguuauuuagccaaugcaaaucuguuuuaaaacaaa

SEQ ID NO: 286522 - RNA, 63 nt, Human
uugccuuuuuuucuggguaauguuuuuuggauuuuagccaaaauucuuugcuuguauaacacu

SEQ ID NO: 286523 - RNA, 63 nt, Human
guguucuggugaaagaaccaaauuacuggcuuguuagccaacagcuucugauagcaauucaua

SEQ ID NO: 286524 - RNA, 63 nt, Human
ccagcaagucucugguagaaaaacacccaguuuuuagccaaagcaaauucuccuauuaacacu

SEQ ID NO: 286525 - RNA, 63 nt, Human
uuuguauuuuuauagaggcgcaguuucaccguguuagccaagauggucucgaucuccugaccu

SEQ ID NO: 286526 - RNA, 63 nt, Human
guauuaggugucauuuccauuauuuauauuaguuuagccaaaggauaaguguccccuaugggg

SEQ ID NO: 286527 - RNA, 63 nt, Human
guauuagguguuauuuccauuauuuauauuaguuuagccaaaggauaaguguccccuaugggg

SEQ ID NO: 286528 - RNA, 63 nt, Human
ugcauuuucuggguucugggugguugcccuucauuagccaaauugaaaaaagaaauucccugg

SEQ ID NO: 286529 - RNA, 62 nt, Human
gagguggccauaaaggggcagagucuucuuucagacccaacucuuagagggcacaucaccag

SEQ ID NO: 286530 - RNA, 62 nt, Human
auguuucuuggggcagagaagguggagaguaaagacccaacauuacuaacaaugauacaguu

SEQ ID NO: 286531 - RNA, 63 nt, Human
uagcaccuuaguaccuccgcugcuucacuugcuuuagccaaagccauaaaaaaccugcaacgu

SEQ ID NO: 286532 - RNA, 63 nt, Human
guugagacaucaggaagguaaaaacccagcggcuuagccaagcccuaagccuguccccagacc

SEQ ID NO: 286533 - RNA, 63 nt, Human
gaggagguuuggcuauugucacaugacagacuguuagccaaggacaaagaaguucugcaaacc

SEQ ID NO: 286534 - RNA, 63 nt, Human
uguaucacaaaucaguguuaaaacaccagaacuuuagccaaaauaaaugucuuacauuacaaa

SEQ ID NO: 286535 - RNA, 63 nt, Human
auaaaauugaaauaaaauacaucuacuaggcuguuagccaaagcaucaccauuacaaguccau

SEQ ID NO: 286536 - RNA, 63 nt, Human
aucuguaagaaaguaccgcaguuaauauuuucuuuagccaacuuauauucaauguauuuuuua

SEQ ID NO: 286537 - RNA, 63 nt, Human
agguaauuuuacauuuccccuuuaaaguaaauuuuagccaacucaucauucugaaaugucccu

SEQ ID NO: 286538 - RNA, 63 nt, Human
gcugagccagugcgagacugaacuugugcagccuuagccaagacaaagcaguguuuuucagca

SEQ ID NO: 286539 - RNA, 63 nt, Human
aucuuuuuuuaaagaaauuaaguucuugaaaauuuagccaaaucccguuuuaugggaaugcuc

SEQ ID NO: 286540 - RNA, 63 nt, Human
auuaucagggugcccucggugcagcuggcgauguuagccaaggagcggcuacaggaggugcgc

SEQ ID NO: 286541 - RNA, 63 nt, Human
acugaaaauguuuaauuggcauuuuuuaaugacuuagccaaagaagugcagcuauuauuccau

SEQ ID NO: 286542 - RNA, 63 nt, Human
ggugaaaccucgucuccgcuagaaauacaaaaauuagccaagcaugguagcaagugccuauaa

SEQ ID NO: 286543 - RNA, 63 nt, Human
uguauuaaacauguaaauuaauuguuugucugauuagccaaucucaccacccaaauggggagg

SEQ ID NO: 286544 - RNA, 63 nt, Human
ggugaaauccccucucuacuaaaaauauaaaaauuagccaaguuugguggcaugcaccuguaa

SEQ ID NO: 286545 - RNA, 63 nt, Human
auuuauauucccuuugguuaaaaugcaggcuuuuuagccaacaacaaaaguguuuucccccca

SEQ ID NO: 286546 - RNA, 63 nt, Human
uccuccaccaccugacggggugucgguagcgucuuagccaagaguccaauuaaagaacgaaaa

SEQ ID NO: 286547 - RNA, 63 nt, Human
ucuuccucuuaucuaccuguacuuuugcauccauuagccaaccuuuggccaucccaccuaucc

SEQ ID NO: 286548 - RNA, 62 nt, Human
cuggagcaccaggcacgaacccaccugcugagagacccaaggaggaaaaacagacaaaaaca

SEQ ID NO: 286549 - RNA, 62 nt, Human
accuaugcucuaaaacaugaaugcuuuguuacagacccaagcuguccauuucugugaugggu

SEQ ID NO: 286550 - RNA, 62 nt, Human
aggaccgucuaggugcgcagccaccuauggaugcgucccagccagccccgucgcucucgucc

SEQ ID NO: 286551 - RNA, 63 nt, Human
ggucuuuugagugcacugagugugggagaguuuuuagccaaaauucccaccucauucggcacc

SEQ ID NO: 286552 - RNA, 63 nt, Human
uaugacagguauagguauggauaugacccauuuuuagccaagagggucugagcuguaucugcu

SEQ ID NO: 286553 - RNA, 63 nt, Human
aacccuaugaaugugaccauugcgagaaagccuuuagccaacggugucaacuuacuaggcagc

SEQ ID NO: 286554 - RNA, 63 nt, Human
agaaccaucucuacccaaaaaaaaaauuaaaaauuagccaagcauggugaugauauaggaguu

SEQ ID NO: 286555 - RNA, 63 nt, Human
ccaucccccaagacccuguccaaggcccagauguuagccaaggacuugucccaccugaggaca

SEQ ID NO: 286556 - RNA, 63 nt, Human
uaaagugggcaggacauacuaggguuuagcauuuuagccaaugucuuccuagguggggcuagg

SEQ ID NO: 286557 - RNA, 63 nt, Human
ugagagccaguuaauuuuaagaauuucacacauuuagccaaucuuucuagaugucucugaagg

SEQ ID NO: 286558 - RNA, 63 nt, Human
ccagggguguugaggccagcggugagagccguguuagccaagacauggaacuguguucucaag

SEQ ID NO: 286559 - RNA, 63 nt, Human
auuaucaacacugucauuacguagaaacuuugguuagccaagcagugcauugucaguuacguc

SEQ ID NO: 286560 - RNA, 63 nt, Human
cuuauaaucccaaugacuaugaagaaaaauaauuuagccaaauaguuccuagaacaggaaaaa

SEQ ID NO: 286561 - RNA, 63 nt, Human
uaaaaugcuuuuggggagacauauauuaaaauuuuagccaagaugauagacaugucucaauua

SEQ ID NO: 286562 - RNA, 63 nt, Human
cuaggcgaaaguaauggggaagauuagaaagaauuagccaaccaggcuacaguugauauuuaa

SEQ ID NO: 286563 - RNA, 63 nt, Human
uugcuuuuaauaauuuuaugaaauggcaaagguuuagccaagaggaaauuuuggcaugaauac

SEQ ID NO: 286564 - RNA, 63 nt, Human
aggcccaaauuguuuccaagugaaaauucauuuuuagccaaguacuucauagcaaucuuugcc

SEQ ID NO: 286565 - RNA, 63 nt, Human
ggagaaaccccaucucuacuaaaaauacaaaaauuagccaagugcaguggcaugugcuuguaa

SEQ ID NO: 286566 - RNA, 63 nt, Human
agugagaucuuuucucuacaaaaaauuuaaaaauuagccaagugugguggugugcaccuguag

SEQ ID NO: 286567 - RNA, 63 nt, Human
ugcuuugguccguauuucccaagcccuccucuuuuagccaaggcuacagggcacuugucuucc

SEQ ID NO: 286568 - RNA, 63 nt, Human
uucauggacaaagauucuccacuuggccaaacuuuagccaagcuccucaaccuucucccaggc

SEQ ID NO: 286569 - RNA, 62 nt, Human
uauauguuuuaaacuuugauguaaaccuuuuuagacccaaacuuguggaaguaucauguguu

SEQ ID NO: 286570 - RNA, 64 nt, Human; identical to SEQ ID NO: 6130

SEQ ID NO: 286571 - RNA, 63 nt, Human
cuuuuuaaaagauuuuuuuaacuuaaaaaguaguuagccaauaugcaaucacugaaaacuaug

SEQ ID NO: 286572 - RNA, 63 nt, Human
uuuuggcaaugucuguguuacauuucauguaauuuagccaacucccauuccaacuaggcuuug

SEQ ID NO: 286573 - RNA, 63 nt, Human
agcugcucucccaaccuggaaggccgucuccccuuagccaaguccuccucaggcuuggagaac

SEQ ID NO: 286574 - RNA, 63 nt, Human
cuuccaagucagguagguaguucaaucuaguuguuagccaaggacucaaggacugaauuguuu

SEQ ID NO: 286575 - RNA, 63 nt, Human
ccaagaccguagaaggagucacaucuagccggcuuagccaaaguacagguguauauaguucag

SEQ ID NO: 286576 - RNA, 63 nt, Human
auacuugaaggccuuggaaauggagucugcugauuagccaaaaagcccacuuuagguagcaag

SEQ ID NO: 286577 - RNA, 63 nt, Human
acaagaaaauacuaaaauaaaaauccuuucgauuuagccaacucuuuuugcuguaggcuagga

SEQ ID NO: 286578 - RNA, 63 nt, Human
gaaucugcagagggugcuacugaagauccagccuuagccaaucaccaccucauugggugaaag

SEQ ID NO: 286579 - RNA, 63 nt, Human
uguuuucugauguuacugguuuucuuuucccuauuagccaaagugacuaucucuuaagagaag

SEQ ID NO: 286580 - RNA, 63 nt, Human
cuaguguguaaguuuucuauuuccccaguacuuuuagccaaccuuaccaagugguguguaaac

SEQ ID NO: 286581 - RNA, 63 nt, Human
uacauuugaaaauguugucuuguuaguuugcaguuagccaaggagugaaugggagaaacauag

SEQ ID NO: 286582 - RNA, 63 nt, Human
ccucuugcuucugagaaauggggaagagaccuuuuagccaaaaugcccuucuuaaaaagagag

SEQ ID NO: 286583 - RNA, 62 nt, Human
cucgccuggcugcagccugcgccaccgcccagagacccaagcugccuccccucuccuuccug

SEQ ID NO: 286584 - RNA, 62 nt, Human
ccauuagccuuaccugcccugcccugauugugagacccaaauguguaggcucuaaauuccag

SEQ ID NO: 286585 - RNA, 62 nt, Human
caucaaaugaggacugugggacccagauuugaagacccaauaaaaauacucaacuuuuuaaa

SEQ ID NO: 286586 - RNA, 62 nt, Human
gggagaggagguagauggggaagaaauaccccagacccaacaaaccuccagccagaaagcca

SEQ ID NO: 286587 - RNA, 62 nt, Human
gaagaaagacuucucaaggaggugccuccaucagacccaaaggacucaugggggcuagcugc

SEQ ID NO: 286588 - RNA, 62 nt, Human
auaaaauauuuuaauuuucuuguauuucauuuagacccaagaacaugcugaccaauguguuc

SEQ ID NO: 286589 - RNA, 62 nt, Human
cccgcacugccaucuucuaguggccauggcugagacccaaucccugggcgccccugguaucc

SEQ ID NO: 286590 - RNA, 62 nt, Human
aauacugauauuucacauacggagauauuugaagacccaagucugccuuucacagagcccuc

SEQ ID NO: 286591 - RNA, 62 nt, Human
ggccucuucucauugaaagcucugcuuuauacagacccaagcauacacaccaggccgucacu

SEQ ID NO: 286592 - RNA, 62 nt, Human
aggacaugguaaaauguguuuuaauaacccccagacccaaaugaaaauuucaaagucaauac

SEQ ID NO: 286593 - RNA, 62 nt, Human
acuaguuugggacuuggcuggcaugugcugccagacccaaagggauuguaucuggauuauua

SEQ ID NO: 286594 - RNA, 62 nt, Human
aguuuucuauauaaacuguaguaucuucaugaagacccaaggcucaaauuuacuguccuuaa

SEQ ID NO: 286595 - RNA, 62 nt, Human
cuuuauugcuuuaaaguucacuuugggcccacagacccaagagcuaauuuucugguuugugg

SEQ ID NO: 286596 - RNA, 62 nt, Human
gucuuaauuucgcuuugugcaucuuccccuccagacccaaugucucuguuuucuuuuccuuu

SEQ ID NO: 286597 - RNA, 62 nt, Human
uuggacaauucagacuuuacuaaagcacaguuagacccaaggccuaugcugaggucuaaacc

SEQ ID NO: 286598 - RNA, 54 nt, Human
ugcaagaaggggccgacuagccgaagacccaagucagcauuccggugguguaac

SEQ ID NO: 286599 - RNA, 54 nt, Human
augaagaccagcuaaauuaaacucagacccaaucaccucuaaaaaccaaaaccc

SEQ ID NO: 286600 - RNA, 62 nt, Human
uuuuucuggcuguuggaaaccugaaugcuuuuagacccaaauggaaaauuucugaaaugcug

SEQ ID NO: 286601 - RNA, 62 nt, Human
gagcaucgcgcaggagugaggcccaggcgccgagacccaaggcgccacugagggcaccgcgc

SEQ ID NO: 286602 - RNA, 62 nt, Human
gcagcacugaugucucuuuaccgauggguuccagacccaagguaguccuggcacugcccugu

SEQ ID NO: 286603 - RNA, 62 nt, Human
cuaagagggcagacugugaacuugacugggugagacccaaagcggucccugucccucuagug

SEQ ID NO: 286604 - RNA, 62 nt, Human
gggaaauccaaucagagaccaggcccuggcuaagacccaaacauaugcacauucacuuagca

SEQ ID NO: 286605 - RNA, 62 nt, Human
uggggugggguaccggauuucgguaucgucccagacccaagugagucacgcuuccugauucc

SEQ ID NO: 286606 - RNA, 62 nt, Human
cuauuucuguuccccugaacuaauuugagauuagacccaaacaugcuuuuaaaugucucaug

SEQ ID NO: 286607 - RNA, 62 nt, Human
caccccagcuccagcugucuucuaccacuagaagacccaagagaagcagaagucgcucgcac

SEQ ID NO: 286608 - RNA, 62 nt, Human
ugaaaugacagaggccaaagauggccaagugaagacccaagucucagaaaacccagacuugg

SEQ ID NO: 286609 - RNA, 62 nt, Human
gacaaaaucaucuuugugaaggccucgcaggaagacccaacacaugggaccuauaacugccc

SEQ ID NO: 286610 - RNA, 62 nt, Human
ucagucauuucagaggcagcagaugcccagggagacccaagaaagagucagguuagggagca

SEQ ID NO: 286611 - RNA, 62 nt, Human
uuuauagcuuagcauuagugacuuauuucaaaagacccaaaucaaaaaguuaguuugaaagc

SEQ ID NO: 286612 - RNA, 62 nt, Human
uguacaccaauauucauagcagcuuauucacaagacccaaaaggcagaagcaacccaaaugu

SEQ ID NO: 286613 - RNA, 62 nt, Human
gcuuauaaaauaaaaauguuuaguucaagaagagacccaagcuggguaugguggugugagag

SEQ ID NO: 286614 - RNA, 62 nt, Human
ccgucuuagcuucaauccuggcagcaccugguagacccaaggacuuggguggaucaggacac

SEQ ID NO: 286615 - RNA, 62 nt, Human
uucaugcccacggguucugccagccccagcacagacccaaacuggggcugggccucuauccc

SEQ ID NO: 286616 - RNA, 62 nt, Human
gaaaagagggagauguuuuguccagaccuacuagacccaacagaaaagguuuuuguauuaga

SEQ ID NO: 286617 - RNA, 62 nt, Human
ucuaggcuucaucauuuuccagugagaagcagagacccaaagggccuguuacuugugcuugg

SEQ ID NO: 286618 - RNA, 62 nt, Human
uuccuuacuugcacuguuacucuuaauuuuaaagacccaacuugccaaaauguuggcugcgu

SEQ ID NO: 286619 - RNA, 62 nt, Human
aguggaagaacuuguuugcuugaaaguaucucagacccaaggcaccucaggucucuuugcug

SEQ ID NO: 286620 - RNA, 62 nt, Human
acccaaauauguaauaaauaccauaguagcucagacccaaggagauauuuuucuaaaaucag

SEQ ID NO: 286621 - RNA, 62 nt, Human
uauuuaauuuuaaagguuugauaaauauacaaagacccaagcauacaauuugagcaugcugu

SEQ ID NO: 286622 - RNA, 62 nt, Human
ucaauggggcccaaauuagaaugcuuauaaugagacccaaucuccaggaaaacaacacucac

SEQ ID NO: 286623 - RNA, 62 nt, Human
aauuugaaguaacauauauccuguaguaacauagacccaaaguuacuauagucaaccaaguc

SEQ ID NO: 286624 - RNA, 62 nt, Human
cauacaggaaacuuaaaacaagaggugucaaaagacccaaauuaggugcauuuuacuuguuu

SEQ ID NO: 286625 - RNA, 62 nt, Human
gggggauuggggggacuggggaggcgcagccuagacccaauugcuugcccccaugaggcuag

SEQ ID NO: 286626 - RNA, 62 nt, Human
ggaaacugggauguagcuggggacgaaaggacagacccaagcguucucccugccugagaugg

SEQ ID NO: 286627 - RNA, 62 nt, Human
guuuuauuuaguccagaugcugaaggaugggaagacccaagcagcugguguggaggucuuuc

SEQ ID NO: 286628 - RNA, 62 nt, Human
cuaccugauaauaaauucuuacuuguccuucaagacccaacucagauagauagagcuuccug

SEQ ID NO: 286629 - RNA, 62 nt, Human
uauccccaagaaaacuuuugaaaggaaagaguagacccaaagauguuauuuucugcuguuug

SEQ ID NO: 286630 - RNA, 62 nt, Human
uggcuuuuuguggcugaaaaaacauaacuguuagacccaaagcauuuuaugcuccguuccau

SEQ ID NO: 286631 - RNA, 62 nt, Human
ccaaguagcuuagcccagcuaaguucuaucagagacccaaauuauauuuuuuaaaaauuuaa

SEQ ID NO: 286632 - RNA, 62 nt, Human
uaaggaaacugcaucacgauugaaagaggaacagacccaaaucugaaccucuuuugaguuua

SEQ ID NO: 286633 - RNA, 62 nt, Human
cguuucaaacugaggaagcuacaacacagugaagacccaaggaaggccuaugaaaagguccu

SEQ ID NO: 286634 - RNA, 62 nt, Human
uauccuugaaauccaaaagagguccaugacauagacccaaagguauucaugaguuauucauu

SEQ ID NO: 286635 - RNA, 62 nt, Human
cauuucuguggcuugauuucuugaauaugcugagacccaauuuggacuacauuuggcagaaa

SEQ ID NO: 286636 - RNA, 62 nt, Human
ggagguguccccaccccuuccaccugucccccagacccaaagcucucuccccacccuaccug

SEQ ID NO: 286637 - RNA, 62 nt, Human
ucauaaaacauauuauguuccuaguuuuaaaaagacccaaaguaugauuaauauaauuuauu

SEQ ID NO: 286638 - RNA, 62 nt, Human
acaaucauagcucacugcagcuuugaccucccagacccaagugauccucccaccucagccuc

SEQ ID NO: 286639 - RNA, 62 nt, Human
ggaauccacaguccaauuccacuucaauugauagacccaaaaaauauaauuuaaucaaaguu

SEQ ID NO: 286640 - RNA, 62 nt, Human
cggggcaacacaguggaaaguggggaggccauagacccaaacaaguucuuugggccaggcau

SEQ ID NO: 286641 - RNA, 62 nt, Human
ggcaaaagcuaaaauaguucacuccucaacugagacccaaagaauuauagauauuuuucaug

SEQ ID NO: 286642 - RNA, 62 nt, Human
uggaugcuuaaaauagaguauacaaguuuuuuagacccaaagaaaaaaacagcagagucuca

SEQ ID NO: 286643 - RNA, 62 nt, Human
auuugacacuuuaaaauaaucagaagucacugagacccaaagcuagugaauaauucaaguga

SEQ ID NO: 286644 - RNA, 62 nt, Human
cugcuggccagcuauguccucuaggaaaugacagacccaaccaccagcaauaaacauuucca

SEQ ID NO: 286645 - RNA, 62 nt, Human
uucauuugauggaaauacuuguguauauuuaaagacccaauugcuccucuggagcuuguacu

SEQ ID NO: 286646 - RNA, 62 nt, Human
uuauuuaaguuggaucagcugaaguguguuuuagacccaaaccaucuggccccuucguuuug

SEQ ID NO: 286647 - RNA, 62 nt, Human
agggguuuaauauaaauacaaccagcauagaaagacccaaaacuauacagaaaccaaaacca

SEQ ID NO: 286648 - RNA, 62 nt, Human
ucgaguuucugguaagacugcugguugacaucagacccaacccaugaaggcuggaaggcagc

SEQ ID NO: 286649 - RNA, 62 nt, Human
uucuucaagccugccaucaaggacauuucuuaagacccaacuggcaugaguugggguaauuu

SEQ ID NO: 286650 - RNA, 62 nt, Human
ccacucuggcuuguuuucagaaccuaaaaagcagacccaaguuuccuuucuccuccgccgca

SEQ ID NO: 286651 - RNA, 62 nt, Human
auacacaaccuucucuaaccaacuauauaucaagacccaaaaauugaagaaaaauauuguuu

SEQ ID NO: 286652 - RNA, 62 nt, Human
cccuggcuccuugcagcagggcugggccugcgagacccaaggcucacugcagcgcgcuccug

SEQ ID NO: 286653 - RNA, 62 nt, Human
uuacagaguaugagagucguaggacccuuacaagacccaacaagccacucgaugcauuuuuc

SEQ ID NO: 286654 - RNA, 62 nt, Human
ucuggaggauaaauaagaggucacccuccuccagacccaaagauagauuugugccuguguug

SEQ ID NO: 286655 - RNA, 62 nt, Human
uuuuguuucuuugaacguuuauuaaaaugccaagacccaaccauuucuuccaccugcuugau

SEQ ID NO: 286656 - RNA, 62 nt, Human
gguuuugagacuccccuuagagauagagaaacagacccaagaaaugugcucaauugcaaugg

SEQ ID NO: 286657 - RNA, 62 nt, Human
auuaagcaaaauguuuaaagacacaacggaauagacccaaaaagauaauuucuaucugauuu

SEQ ID NO: 286658 - RNA, 62 nt, Human
ugaggcccuacaaauaguaacccuaggcucagagacccaauuuuuuaagcccccagacuccu

SEQ ID NO: 286659 - RNA, 62 nt, Human
uguugauccuugagaacuuggcccugugcuuuagacccaaggacccgauucuugggcuagga

SEQ ID NO: 286660 - RNA, 62 nt, Human
gaauugaauaucuaauaaggagauuuaagauaagacccaauaaaugaauguauucuguaaug

SEQ ID NO: 286661 - RNA, 62 nt, Human
cuuagcacacaguuaaauuauauuuacauccuagacccaaauaaauaggauuguguguauau

SEQ ID NO: 286662 - RNA, 62 nt, Human
uacuguauuuuccuuauauggaaaaccguuauagacccaauaacaacuaaaccuuucaaaag

SEQ ID NO: 286663 - RNA, 62 nt, Human
acuaaguggcggguagugaauuaucugugccuagacccaaacugaaagugucucaggcagga

SEQ ID NO: 286664 - RNA, 62 nt, Human
aauuaaaaacacaugaaaugaauaacaaaacaagacccaaauagaguuuauuuuauucucag

SEQ ID NO: 286665 - RNA, 62 nt, Human
agaaauaugacaauccuagguaauuaaaccauagacccaaagcccuuacguuugaugcaauu

SEQ ID NO: 286666 - RNA, 62 nt, Human
guuaaagucugagcucuguugcagauaaccagagacccaacaaccaaaggcaaagcguaagc

SEQ ID NO: 286667 - RNA, 62 nt, Human
uugggguacaaaggaaaggacagaggugugggagacccaagguggucuugagauugacagac

SEQ ID NO: 286668 - RNA, 62 nt, Human
agagaaagagagagagagcgcgagagagaucaagacccaaguuuugaaucucaaccgagguc

SEQ ID NO: 286669 - RNA, 62 nt, Human
uagguuuuugagcagaacucuuucagcuuguuagacccaacuuugcuuuuguuuagcuucac

SEQ ID NO: 286670 - RNA, 62 nt, Human
ggucuugacccucauccagcaagggacucgacagacccaagggucccuggaacguagggagg

SEQ ID NO: 286671 - RNA, 62 nt, Human
auucuuaggauuuuuuuaccagcuuuguuuacagacccaaauguaaauauuaaaaauaaaua

SEQ ID NO: 286672 - RNA, 62 nt, Human
cauugcacagaaguccuucuggcugcaggugcagacccaaacuuagauccccucaacugucu

SEQ ID NO: 286673 - RNA, 62 nt, Human
aauagcuuuccuggcuaaaagacccagguaaaagacccaaccccagcagaaagacaccgcgg

SEQ ID NO: 286674 - RNA, 62 nt, Human
gguggagaucgcugcaucccugcagcucaacgagacccaagugaagaucugguuccagaacc

SEQ ID NO: 286675 - RNA, 62 nt, Human
uguuuuuucuuuuuugcuguuagaauaauuucagacccaauaaggaauuucgauuauuaaag

SEQ ID NO: 286676 - RNA, 59 nt, Human
augauggugaugaauuauaagaaauaaacagacccaauucaucaacuggaaagcaauuc

SEQ ID NO: 286677 - RNA, 62 nt, Human
aucugcuugugggagugggaaauggguauuuuagacccaacacagguucuaaauuuaaaaca

SEQ ID NO: 286678 - RNA, 62 nt, Human
gagcagaacgggaaccaccugcagagguccccagacccaaagcaggacgggagacaacugcu

SEQ ID NO: 286679 - RNA, 62 nt, Human
ucaauggagauggccucugcugacucagaugaagacccaaggcauaagguugggaaaacacc

SEQ ID NO: 286680 - RNA, 62 nt, Human
ugcugugaauauuggaaaugcuuaggaucuucagacccaauagcucuaauuuuaacauuucu

SEQ ID NO: 286681 - RNA, 62 nt, Human
cccuccgcaggcccagggcugggcacucccugagacccaaagacccaccucaacgacgagug

SEQ ID NO: 286682 - RNA, 62 nt, Human
aaguagaagaaagacagaaaaaauaacugauuagacccaagauuucaugggaagaaguuaaa

SEQ ID NO: 286683 - RNA, 62 nt, Human
cugagggcaguacccuccauugggcacaguccagacccaagucaaagaugccccauuccuug

SEQ ID NO: 286684 - RNA, 62 nt, Human
agaggggaccugcugggaauggggugggugguagacccaacucaucaggcagcggguagggc

SEQ ID NO: 286685 - RNA, 62 nt, Human
uuaugaaaaugcugcguuguguugaaugaaaaagacccaaauuacugcuuaugaagaaauaa

SEQ ID NO: 286686 - RNA, 62 nt, Human
aacuaagauccgagcagaacugaaggagauagagacccaaaaaacccuucaaaaaaucaaug

SEQ ID NO: 286687 - RNA, 62 nt, Human
aaacccacaauugaacuuccaggaaagugugaagacccaaaacagcuuugucuccaaagaag

SEQ ID NO: 286688 - RNA, 62 nt, Human
cucuuguuuugacuuuguuuuaaugcuuccuaagacccaagugccuccugcuguuuccuccu

SEQ ID NO: 286689 - RNA, 62 nt, Human
uggauuguuuaagaacuauuuuaaaguguuccagacccaaaaaggaaaaauaaaaaaaaagg

SEQ ID NO: 286690 - RNA, 62 nt, Human
ccagcaacaaaaccuaaucaguaaggccagcuagacccaauggcucaugccuguaaucccaa

SEQ ID NO: 286691 - RNA, 62 nt, Human
uccugaacaaguuugaagaccuauuguuucauagacccaagaccaaacgcaucuaaaggauc

SEQ ID NO: 286692 - RNA, 62 nt, Human
auuauacccauagguaauacaaaaagcucugaagacccaaagaugacauuacuaaugaugug

SEQ ID NO: 286693 - RNA, 62 nt, Human
ucuguccuccccuauugcgcucucaagaccagagacccaacagcagugaucucagggcagac

SEQ ID NO: 286694 - RNA, 62 nt, Human
augacagacagggacgaagcagagaccucuacagacccaagucaccaaguggagccuuuuuu

SEQ ID NO: 286695 - RNA, 62 nt, Human
ucugacaaaggagccugcacauuugggugagcagacccaagcuguuuacagcucuuucuugu

SEQ ID NO: 286696 - RNA, 62 nt, Human
uacucuuggggccccagcggugggagugcaaaagacccaacgccaacaccuggugccuucug

SEQ ID NO: 286697 - RNA, 62 nt, Human
gauaauaguuacuaguaguaguauucuuacuaagacccaauacaaauggauuauuuaaacca

SEQ ID NO: 286698 - RNA, 62 nt, Human
ucugauucucuaaugcgaaaagccuuauucuaagacccaagguuuggaucugcuaccaccag

SEQ ID NO: 286699 - RNA, 62 nt, Human
augcauguucuccugccaaggaaccuuuacacagacccaaacaaaaaaauaauaaucaaaug

SEQ ID NO: 286700 - RNA, 62 nt, Human
gcggacaauuggggccaaacgaggaaggacacagacccaaaagccagacccaggucccagcg

SEQ ID NO: 286701 - RNA, 62 nt, Human
agcucuauaaggacagguacuauauuuccguaagacccaauaguuacuguacaucccauaaa

SEQ ID NO: 286702 - RNA, 62 nt, Human
agugcccgguccccuugagggccaucacacccagacccaacggguugcagccuccugagcag

SEQ ID NO: 286703 - RNA, 62 nt, Human
uacacaaugaaaacacaucuguuggggugaucagacccaacacccggccaugggggcuacaa

SEQ ID NO: 286704 - RNA, 62 nt, Human
cugcucuggaagagaaggaacagggagcagagagacccaacugggagccagagauggaacuu

SEQ ID NO: 286705 - RNA, 62 nt, Human
ggcgaagugucagcccucaauguuggguacuuagacccaaaccaauaaauggugaguuuuga

SEQ ID NO: 286706 - RNA, 62 nt, Human
aauggcuaauguuacaaaaaguuauacuccagagacccaaagcuugacauuuaccuaaugua

SEQ ID NO: 286707 - RNA, 62 nt, Human
ggaaagaaauaauacaaauuggcuuucaagugagacccaaaggaagaacuggauaaaaucuu

SEQ ID NO: 286708 - RNA, 62 nt, Human
ggugcuccagccggcccugcagcaguacagccagacccaagaccuagguggccuccgugagc

SEQ ID NO: 286709 - RNA, 62 nt, Human
ugcagagcgcucucugugugccagagagccagagacccaagacagggcccgggcucuggacc

SEQ ID NO: 286710 - RNA, 62 nt, Human
agacucugucucaaaacaaacaaacaaacaaaagacccaaucugagucuuaucguuguacug

SEQ ID NO: 286711 - RNA, 62 nt, Human
uaaggcaugaauaagaggggaggucaaaauaaagacccaaucugaggccgggcacgguggcu

SEQ ID NO: 286712 - RNA, 50 nt, Human
cuaaugugaaaauugacuagagacccaagaaaaccuggaacuuuggauca

SEQ ID NO: 286713 - RNA, 62 nt, Human
ccuccuggaggaggaaguggaggccgcugcguagacccaacagcguccaguuccuacuaacu

SEQ ID NO: 286714 - RNA, 62 nt, Human
gaagaaucucuccucucucucucucucuggaaagacccaacuuucucacugcugucagccaa

SEQ ID NO: 286715 - RNA, 62 nt, Human
gcgugcugugguguggacugggugcuacuuauagacccaaucagaauacggugguugagaag

SEQ ID NO: 286716 - RNA, 62 nt, Human
cuuacaacuggcucuuccuccccucacuaagaagacccaaaccucugcauaaugggauuugg

SEQ ID NO: 286717 - RNA, 62 nt, Human
acccgaaccagccccgugccagcccgguccccagacccaagccugaccccauccgaguggaa

SEQ ID NO: 286718 - RNA, 62 nt, Human
ccucucccucaagccuaagacacuaagaccccagacccaaagccaaguccaccagaguggcu

SEQ ID NO: 286719 - RNA, 62 nt, Human
aagagcuuacuggguaguuagaguucaucaggagacccaacccuuagauuucauaaguaccc

SEQ ID NO: 286720 - RNA, 62 nt, Human
uuguauugcuuuuuaaucuguuaauuuuuuaaagacccaagcagucauuuugaguuauaucu

SEQ ID NO: 286721 - RNA, 62 nt, Human
ugcacugauggguccugaauucaccuugagaaagacccaaaggccagucagggggugggggg

SEQ ID NO: 286722 - RNA, 62 nt, Human
cacuuuauucugggcggggggugagugggggaagacccaacccuccuuucucgcugccccua

SEQ ID NO: 286723 - RNA, 62 nt, Human
ugggccgcucuauuccaaaggaaucauggauuagacccaagggcugagcuccucuagggcag

SEQ ID NO: 286724 - RNA, 62 nt, Human
uuuacuuugauaacuugugauuguuuagcuuaagacccaagaaaugcuguuugcucauggua

SEQ ID NO: 286725 - RNA, 62 nt, Human
gguacugugcccaccacacaugauuaggccucagacccaacucugguccuggcuccacaaca

SEQ ID NO: 286726 - RNA, 62 nt, Human
cuccucccuuuuaucuucuagccacaguucuaagacccaaagugggggguggacacagaagu

SEQ ID NO: 286727 - RNA, 62 nt, Human
uaguguguuuggaauuugacuuuccauuucugagacccaagggggcguagauguaguggcaa

SEQ ID NO: 286728 - RNA, 62 nt, Human
ugcacaacacagaaggaaacuugauuucaauaagacccaauucuuaacagucuuuucuaccc

SEQ ID NO: 286729 - RNA, 62 nt, Human
aaacuagugugaaguuuacaguuagaagaaacagacccaaaguugccagaagguaauaaaua

SEQ ID NO: 286730 - RNA, 62 nt, Human
uguuggacccauaguagaauuuuccaggucacagacccaagcuuccauggguuguuacugug

SEQ ID NO: 286731 - RNA, 62 nt, Human
uucaagaucagccugggcaacagagugagauaagacccaaucuuuauuuaaaaaauaaauaa

SEQ ID NO: 286732 - RNA, 62 nt, Human
ggcuggcuggacaggcgggugugaggaguugcagacccaaacccacgugcauuuugggacaa

SEQ ID NO: 286733 - RNA, 62 nt, Human
cauuuuauaaaucaaucaguaaauauuuuguaagacccaaaauccuggcauauugccagguc

SEQ ID NO: 286734 - RNA, 62 nt, Human
guagaaagaagccuccuacccagcaaaccaguagacccaaaaguugaaaaaaacugaugaca

SEQ ID NO: 286735 - RNA, 62 nt, Human
cugccuuggagucgucuggcaucucccacacaagacccaaguagcugcuaccuucuuuggcc

SEQ ID NO: 286736 - RNA, 62 nt, Human
uauguuuuauuucuauuuggacucagagaucuagacccaauaauuaguaggcuccugcugcc

SEQ ID NO: 286737 - RNA, 62 nt, Human
aagaguccucuggggaggaccccaagggccggagacccaaagaucaugauauuccaaaugga

SEQ ID NO: 286738 - RNA, 62 nt, Human
caauucuguccccaucaaggggucagcuggagagacccaagacccuaucuguucaccaggga

SEQ ID NO: 286739 - RNA, 62 nt, Human
acaggucauuucagaguaagccuuuguucccaagacccaacaacugucacccucuucuguac

SEQ ID NO: 286740 - RNA, 62 nt, Human
cuacagauguaacucauuuguauauugcagacagacccaaaguggcacugaauuuucuugcu

SEQ ID NO: 286741 - RNA, 62 nt, Human
gaggaggaggaaccccucgucccccuaggagcagacccaagcuuguggcaccaggcaucuga

SEQ ID NO: 286742 - RNA, 62 nt, Human
cugguugaagauagaggauaugaaaugccauaagacccaaucaaaugaagaaauaaacccag

SEQ ID NO: 286743 - RNA, 62 nt, Human
gcgggaaggaggggcaaggucuuucaggaaccagacccaacaggcccuucuguagccucccc

SEQ ID NO: 286744 - RNA, 62 nt, Human
ggauucagagggacccccgggacaagggucugagacccaaaggcacaguuuagaggauuggg

SEQ ID NO: 286745 - RNA, 62 nt, Human
auuaaaauauaaauauuagaaaauuacuuuggagacccaaguaaauauuucucauacauaug

SEQ ID NO: 286746 - RNA, 62 nt, Human
gugcaacugucucaacgaugcuguguggcuucagacccaaacaaggcccugaggaaggagac

SEQ ID NO: 286747 - RNA, 62 nt, Human
uuggagguguucuggacaguggggagggcuccagacccaaccuggucacagaagagccucuc

SEQ ID NO: 286748 - RNA, 55 nt, Human
caucggaaaugccuaccugagagagagacccaaacuuuacucugggagguaggcu

SEQ ID NO: 286749 - RNA, 62 nt, Human
acaauuuauuuuccgcagcaugucagcuaaguagacccaauggggagagaaaaugccugcuu

SEQ ID NO: 286750 - RNA, 62 nt, Human
gagacaccccaccucccuccuccauggggcacagacccaacacaaggcggggaugcucccac

SEQ ID NO: 286751 - RNA, 62 nt, Human
uuaaaggcaccauggggaccuggguugcccugagacccaagccauuguuagcagcuagccag

SEQ ID NO: 286752 - RNA, 62 nt, Human
cggaaccuccucagccuguuugaggacacccuagacccaaccugagccccagacucugccuc

SEQ ID NO: 286753 - RNA, 62 nt, Human
cuccuuagggggugggcgaggagccucugggcagacccaagaaccauggggacugggguggg

SEQ ID NO: 286754 - RNA, 62 nt, Human
agaaccaguuaagagacaacuaucaauucuugagacccaaauuauaagggcccugcccugua

SEQ ID NO: 286755 - RNA, 62 nt, Human
ugagagucacagucaccuggaagaaaguauccagacccaaccuguuagcuacccucaccagc

SEQ ID NO: 286756 - RNA, 62 nt, Human
auacacuggauguucucucuuugcuucaauggagacccaaggagcugggaggucucuuaaga

SEQ ID NO: 286757 - RNA, 58 nt, Human
ugaaaggggcauuguuauaggguuuuaaagacccaagguuucuaacagccucugcugu

SEQ ID NO: 286758 - RNA, 62 nt, Human
cuacgggggcacuuggaggaccuggcgugcucagacccaacagcaaaggaacuagaaagaag

SEQ ID NO: 286759 - RNA, 62 nt, Human
guugaccagagaaaggggagagaauucgggaaagacccaaaguguuuguaauucuucuuugu

SEQ ID NO: 286760 - RNA, 62 nt, Human
gccacgugaccucuugccgugccccuugucauagacccaaggagcaacucuguccccugagc

SEQ ID NO: 286761 - RNA, 62 nt, Human
aguugcaaaacuguucugaagcuuaauauuagagacccaaguaagauuguuuuuagucuugc

SEQ ID NO: 286762 - RNA, 62 nt, Human
uuucccuuagcaaaccauaacagaaaaaaauaagacccaauauuggcaaagagacuacugaa

SEQ ID NO: 286763 - RNA, 62 nt, Human
cccaaggcaggugguguguugggggccccuucagacccaaagcuuuaggcaugauuccaacu

SEQ ID NO: 286764 - RNA, 62 nt, Human
uuugaagcaagagaaaauuccauuuuauaguuagacccaaauucacuaaauaguguguaugu

SEQ ID NO: 286765 - RNA, 62 nt, Human
guguaagggagggagggguagggacagaagcuagacccaaucuccuuugggaugugggcagg

SEQ ID NO: 286766 - RNA, 62 nt, Human
uaagcccccagggccuccagggcccagguucgagacccaaacccccaaaauccaaaacuucu

SEQ ID NO: 286767 - RNA, 62 nt, Human
cugucaccagccgcacgcgugguaaaugacccagacccaacucgccuguggacggggaggcu

SEQ ID NO: 286768 - RNA, 62 nt, Human
accaacgccuuggacuccucucuuugcugaagagacccaagucucuugacaccucagaguga

SEQ ID NO: 286769 - RNA, 62 nt, Human
cauuuggaggaaguucacauuuccuggcaugcagacccaaaacuggguucuggcucugccug

SEQ ID NO: 286770 - RNA, 62 nt, Human
gagauuuugaugaauuuauauugguuuuaaugagacccaaaugacucucucuuaacaauuca

SEQ ID NO: 286771 - RNA, 62 nt, Human
cgcugacuuuugucccuuguucccgguguaggagacccaaggcaucuugaaucccaucuaua

SEQ ID NO: 286772 - RNA, 62 nt, Human
gcuccaggucagcuccuucccauacacucugcagacccaacagucccgcauuagcucuagca

SEQ ID NO: 286773 - RNA, 62 nt, Human
ugcuaaucucuuuuauuuuguaacugaagaugagacccaaagaaagggaaagcugagauuuu

SEQ ID NO: 286774 - RNA, 62 nt, Human
caccagcgccaacagccguggggaagccaaggagacccaagggguccaggaggugggcgccc

SEQ ID NO: 286775 - RNA, 62 nt, Human
ccgagcuguucuuucagcugcuccaaggauugagacccaagucaucaugaaaaaggcccaag

SEQ ID NO: 286776 - RNA, 62 nt, Human
gcaacuucuucaauuccagaguuucugagaacagacccaaauucaauggcaugaccaagaac

SEQ ID NO: 286777 - RNA, 62 nt, Human
gagugagggccuauuuuccaacagcucuucgcagacccaagagcuuggcacauuuccggguu

SEQ ID NO: 286778 - RNA, 62 nt, Human
guguuccucggcggacucugcugaccuccugcagacccaaaccacagccacaucccagcuuc

SEQ ID NO: 286779 - RNA, 62 nt, Human
acugccuccucuccaguggucucccaggugccagacccaaaagcuuuuccuacagugauacc

SEQ ID NO: 286780 - RNA, 62 nt, Human
gaugaagucgucuucuucggugaccacuuccgagacccaacccugcacgcccagcuccagug

SEQ ID NO: 286781 - RNA, 62 nt, Human
gacugauccuggcucugacggcugaagagggaagacccaaggcuggguggcguggcucguga

SEQ ID NO: 286782 - RNA, 62 nt, Human
ccaugccgaccucauccuaacuccacucacgcagacccaaccuaaccuccacuagcuccaaa

SEQ ID NO: 286783 - RNA, 62 nt, Human
uucugcgccucaggcugcuggggccucagacgagacccaagggcagagcauuuaagagugaa

SEQ ID NO: 286784 - RNA, 62 nt, Human
cccaccucccacccuccuccucuucuccuucaagacccaacugagcacccgcucugauuccc

SEQ ID NO: 286785 - RNA, 62 nt, Human
aaaaaggaagagguggaaacccagagagacagagacccaaagggagagaaacagagacucag

SEQ ID NO: 286786 - RNA, 62 nt, Human
gagggcugccucuugacagugcagucuuaucgagacccaaugccucagucugcucauccgua

SEQ ID NO: 286787 - RNA, 62 nt, Human
aagcuuuaaaaaauaaagcugugucuuuagggagacccaauaaagaaugcaauccaugccau

SEQ ID NO: 286788 - RNA, 64 nt, Human
cgagaccagccugggcaacauggugaaacccugucgguacaaaaaaauacaaaaauuugccugu

SEQ ID NO: 286789 - RNA, 64 nt, Human
uuucacagcugcuccaagccuguugcccaauucacgguacaagggagcaccccuucccuuuccu

SEQ ID NO: 286790 - RNA, 62 nt, Human
gucugaggagugugaacuguuggggucaguuaagacccaacauaacucuaucagaagaaaac

SEQ ID NO: 286791 - RNA, 62 nt, Human
guacuuuucucaggguuucccuacccugcccuagacccaaaagugguggaggcugagaagaa

SEQ ID NO: 286792 - RNA, 62 nt, Human
gcauccuuagucccaccuguagcugaauccacagacccaaagccugcacaacccaaccucgc

SEQ ID NO: 286793 - RNA, 62 nt, Human
acuuugguuccuucuccgggcggcucucucugagacccaaggcugcagucccucagugcugg

SEQ ID NO: 286794 - RNA, 62 nt, Human
cucacccaaaagaauuaucaucccaacagccaagacccaacaggugcugaacugugcaucaa

SEQ ID NO: 286795 - RNA, 62 nt, Human
ucccuaugaaggcuccuuuugaaugugucuugagacccaaauugagcauguugcuguuauuc

SEQ ID NO: 286796 - RNA, 62 nt, Human
auggcugccugugggaccccagcuacucccccagacccaaguucugcagaacuaacccccag

SEQ ID NO: 286797 - RNA, 62 nt, Human
ugcuuuaauuuauuuuucuucugcguguggucagacccaauuacacuguggcuaagacucuc

SEQ ID NO: 286798 - RNA, 62 nt, Human
cuaucuguucaaacgucaccuguucccaccccagacccaaagagguugauucaguugccuuc

SEQ ID NO: 286799 - RNA, 62 nt, Human
acaguagugaaggccugagcuccagguuugaaagacccaacuggagcguggggcgggcaggc

SEQ ID NO: 286800 - RNA, 62 nt, Human
gcuuuucuaggauguggccuuagagcaagaacagacccaacagccagcccuucauccuccag

SEQ ID NO: 286801 - RNA, 62 nt, Human
acucaggugcuaggaaaaaaaacauagacucaagacccaagauucaauggaccaggagaaag

SEQ ID NO: 286802 - RNA, 62 nt, Human
ggagauuguguauucagugaaaggcugaucaaagacccaaaggaaugcaacaguuuaucucu

SEQ ID NO: 286803 - RNA, 62 nt, Human
cacacucaaaccagugacaccacaggaaagaaagacccaagacguuggaauggcuguuucca

SEQ ID NO: 286804 - RNA, 62 nt, Human
cauucaagucacugcucuucagaauacacucuagacccaaaggugugcuaaucacuucacag

SEQ ID NO: 286805 - RNA, 62 nt, Human
uuuaaauuucuaagaauuuauaucauaacuagagacccaaauaucuuucacagaauuuuguu

SEQ ID NO: 286806 - RNA, 62 nt, Human
auuuacccaacuggcaagucgugcuaacccgaagacccaaaguaccccuuuaugcaaaauag

SEQ ID NO: 286807 - RNA, 64 nt, Human
ccaccccuccccauccucagccuggauggaaccccgguacaaggaggcagcuaaccacugugcc

SEQ ID NO: 286808 - RNA, 64 nt, Human
aaaaaaaugcauguugguaaguaaaaguaucucacgguacaaauuaagaaugacuuucuucaaa

SEQ ID NO: 286809 - RNA, 64 nt, Human
cccucucaaguccaucaaguaccucaucugcacccgguacaaguggcucaucaucaagaucgug

SEQ ID NO: 286810 - RNA, 64 nt, Human; identical to SEQ ID NO: 31718

SEQ ID NO: 286811 - RNA, 64 nt, Human; identical to SEQ ID NO: 31719

SEQ ID NO: 286812 - RNA, 64 nt, Human; identical to SEQ ID NO: 31720

SEQ ID NO: 286813 - RNA, 64 nt, Human; identical to SEQ ID NO: 31721

SEQ ID NO: 286814 - RNA, 64 nt, Human; identical to SEQ ID NO: 31722

SEQ ID NO: 286815 - RNA, 64 nt, Human; identical to SEQ ID NO: 31723

SEQ ID NO: 286816 - RNA, 64 nt, Human; identical to SEQ ID NO: 31724

SEQ ID NO: 286817 - RNA, 64 nt, Human; identical to SEQ ID NO: 31725

SEQ ID NO: 286818 - RNA, 64 nt, Human; identical to SEQ ID NO: 31726

SEQ ID NO: 286819 - RNA, 61 nt, Human; identical to SEQ ID NO: 31727

SEQ ID NO: 286820 - RNA, 64 nt, Human; identical to SEQ ID NO: 31728

SEQ ID NO: 286821 - RNA, 64 nt, Human; identical to SEQ ID NO: 31729

SEQ ID NO: 286822 - RNA, 64 nt, Human; identical to SEQ ID NO: 31730

SEQ ID NO: 286823 - RNA, 64 nt, Human; identical to SEQ ID NO: 31731

SEQ ID NO: 286824 - RNA, 64 nt, Human; identical to SEQ ID NO: 31732

SEQ ID NO: 286825 - RNA, 64 nt, Human; identical to SEQ ID NO: 31733

SEQ ID NO: 286826 - RNA, 64 nt, Human; identical to SEQ ID NO: 6166

SEQ ID NO: 286827 - RNA, 64 nt, Human; identical to SEQ ID NO: 6167

SEQ ID NO: 286828 - RNA, 64 nt, Human; identical to SEQ ID NO: 6168

SEQ ID NO: 286829 - RNA, 64 nt, Human; identical to SEQ ID NO: 6169

SEQ ID NO: 286830 - RNA, 64 nt, Human; identical to SEQ ID NO: 31734

SEQ ID NO: 286831 - RNA, 64 nt, Human; identical to SEQ ID NO: 31735

SEQ ID NO: 286832 - RNA, 64 nt, Human; identical to SEQ ID NO: 31736

SEQ ID NO: 286833 - RNA, 64 nt, Human; identical to SEQ ID NO: 31737

SEQ ID NO: 286834 - RNA, 64 nt, Human; identical to SEQ ID NO: 31738

SEQ ID NO: 286835 - RNA, 64 nt, Human; identical to SEQ ID NO: 31739

SEQ ID NO: 286836 - RNA, 64 nt, Human; identical to SEQ ID NO: 31740

SEQ ID NO: 286837 - RNA, 64 nt, Human; identical to SEQ ID NO: 31741

SEQ ID NO: 286838 - RNA, 64 nt, Human; identical to SEQ ID NO: 31742

SEQ ID NO: 286839 - RNA, 64 nt, Human; identical to SEQ ID NO: 31743

SEQ ID NO: 286840 - RNA, 64 nt, Human; identical to SEQ ID NO: 31744

SEQ ID NO: 286841 - RNA, 64 nt, Human; identical to SEQ ID NO: 31745

SEQ ID NO: 286842 - RNA, 64 nt, Human; identical to SEQ ID NO: 31746

SEQ ID NO: 286843 - RNA, 64 nt, Human; identical to SEQ ID NO: 31747

SEQ ID NO: 286844 - RNA, 64 nt, Human; identical to SEQ ID NO: 31748

SEQ ID NO: 286845 - RNA, 64 nt, Human; identical to SEQ ID NO: 31749

SEQ ID NO: 286846 - RNA, 64 nt, Human; identical to SEQ ID NO: 6157

SEQ ID NO: 286847 - RNA, 64 nt, Human; identical to SEQ ID NO: 6158

SEQ ID NO: 286848 - RNA, 64 nt, Human; identical to SEQ ID NO: 6170

SEQ ID NO: 286849 - RNA, 64 nt, Human; identical to SEQ ID NO: 6171

SEQ ID NO: 286850 - RNA, 64 nt, Human; identical to SEQ ID NO: 31750

SEQ ID NO: 286851 - RNA, 64 nt, Human; identical to SEQ ID NO: 31751

SEQ ID NO: 286852 - RNA, 64 nt, Human; identical to SEQ ID NO: 31752

SEQ ID NO: 286853 - RNA, 64 nt, Human; identical to SEQ ID NO: 31753

SEQ ID NO: 286854 - RNA, 62 nt, Human; identical to SEQ ID NO: 31754

SEQ ID NO: 286855 - RNA, 64 nt, Human; identical to SEQ ID NO: 31755

SEQ ID NO: 286856 - RNA, 64 nt, Human; identical to SEQ ID NO: 31756

SEQ ID NO: 286857 - RNA, 64 nt, Human; identical to SEQ ID NO: 31757

SEQ ID NO: 286858 - RNA, 54 nt, Human; identical to SEQ ID NO: 31758

SEQ ID NO: 286859 - RNA, 64 nt, Human; identical to SEQ ID NO: 31759

SEQ ID NO: 286860 - RNA, 64 nt, Human; identical to SEQ ID NO: 31760

SEQ ID NO: 286861 - RNA, 64 nt, Human; identical to SEQ ID NO: 31761

SEQ ID NO: 286862 - RNA, 64 nt, Human; identical to SEQ ID NO: 31762

SEQ ID NO: 286863 - RNA, 64 nt, Human; identical to SEQ ID NO: 31763

SEQ ID NO: 286864 - RNA, 64 nt, Human; identical to SEQ ID NO: 31764

SEQ ID NO: 286865 - RNA, 64 nt, Human; identical to SEQ ID NO: 31765

SEQ ID NO: 286866 - RNA, 64 nt, Human; identical to SEQ ID NO: 6173

SEQ ID NO: 286867 - RNA, 64 nt, Human; identical to SEQ ID NO: 6174

SEQ ID NO: 286868 - RNA, 64 nt, Human; identical to SEQ ID NO: 6175

SEQ ID NO: 286869 - RNA, 64 nt, Human; identical to SEQ ID NO: 6176

SEQ ID NO: 286870 - RNA, 64 nt, Human; identical to SEQ ID NO: 31766

SEQ ID NO: 286871 - RNA, 64 nt, Human; identical to SEQ ID NO: 31767

SEQ ID NO: 286872 - RNA, 64 nt, Human; identical to SEQ ID NO: 31768

SEQ ID NO: 286873 - RNA, 64 nt, Human; identical to SEQ ID NO: 31769

SEQ ID NO: 286874 - RNA, 64 nt, Human; identical to SEQ ID NO: 31770

SEQ ID NO: 286875 - RNA, 64 nt, Human; identical to SEQ ID NO: 31771

SEQ ID NO: 286876 - RNA, 64 nt, Human; identical to SEQ ID NO: 31772

SEQ ID NO: 286877 - RNA, 64 nt, Human; identical to SEQ ID NO: 31773

SEQ ID NO: 286878 - RNA, 64 nt, Human; identical to SEQ ID NO: 31774

SEQ ID NO: 286879 - RNA, 64 nt, Human; identical to SEQ ID NO: 31775

SEQ ID NO: 286880 - RNA, 64 nt, Human; identical to SEQ ID NO: 31776

SEQ ID NO: 286881 - RNA, 64 nt, Human; identical to SEQ ID NO: 31777

SEQ ID NO: 286882 - RNA, 64 nt, Human; identical to SEQ ID NO: 31778

SEQ ID NO: 286883 - RNA, 64 nt, Human; identical to SEQ ID NO: 31779

SEQ ID NO: 286884 - RNA, 64 nt, Human; identical to SEQ ID NO: 31780

SEQ ID NO: 286885 - RNA, 64 nt, Human; identical to SEQ ID NO: 31781

SEQ ID NO: 286886 - RNA, 64 nt, Human; identical to SEQ ID NO: 6177

SEQ ID NO: 286887 - RNA, 64 nt, Human; identical to SEQ ID NO: 6178

SEQ ID NO: 286888 - RNA, 64 nt, Human; identical to SEQ ID NO: 6180

SEQ ID NO: 286889 - RNA, 64 nt, Human; identical to SEQ ID NO: 6181

SEQ ID NO: 286890 - RNA, 64 nt, Human; identical to SEQ ID NO: 31782

SEQ ID NO: 286891 - RNA, 64 nt, Human; identical to SEQ ID NO: 31783

SEQ ID NO: 286892 - RNA, 64 nt, Human; identical to SEQ ID NO: 31784

SEQ ID NO: 286893 - RNA, 64 nt, Human; identical to SEQ ID NO: 31785

SEQ ID NO: 286894 - RNA, 64 nt, Human; identical to SEQ ID NO: 31786

SEQ ID NO: 286895 - RNA, 64 nt, Human; identical to SEQ ID NO: 31787

SEQ ID NO: 286896 - RNA, 64 nt, Human; identical to SEQ ID NO: 31788

SEQ ID NO: 286897 - RNA, 51 nt, Human; identical to SEQ ID NO: 31789

SEQ ID NO: 286898 - RNA, 64 nt, Human; identical to SEQ ID NO: 31790

SEQ ID NO: 286899 - RNA, 64 nt, Human; identical to SEQ ID NO: 31791

SEQ ID NO: 286900 - RNA, 64 nt, Human; identical to SEQ ID NO: 31792

SEQ ID NO: 286901 - RNA, 64 nt, Human; identical to SEQ ID NO: 31793

SEQ ID NO: 286902 - RNA, 64 nt, Human; identical to SEQ ID NO: 31794

SEQ ID NO: 286903 - RNA, 64 nt, Human; identical to SEQ ID NO: 31795

SEQ ID NO: 286904 - RNA, 64 nt, Human; identical to SEQ ID NO: 31796

SEQ ID NO: 286905 - RNA, 64 nt, Human; identical to SEQ ID NO: 31797

SEQ ID NO: 286906 - RNA, 64 nt, Human; identical to SEQ ID NO: 6185

SEQ ID NO: 286907 - RNA, 64 nt, Human; identical to SEQ ID NO: 31798

SEQ ID NO: 286908 - RNA, 64 nt, Human; identical to SEQ ID NO: 31799

SEQ ID NO: 286909 - RNA, 64 nt, Human; identical to SEQ ID NO: 31800

SEQ ID NO: 286910 - RNA, 64 nt, Human; identical to SEQ ID NO: 31801

SEQ ID NO: 286911 - RNA, 64 nt, Human; identical to SEQ ID NO: 31802

SEQ ID NO: 286912 - RNA, 64 nt, Human; identical to SEQ ID NO: 31803

SEQ ID NO: 286913 - RNA, 64 nt, Human; identical to SEQ ID NO: 31804

SEQ ID NO: 286914 - RNA, 64 nt, Human; identical to SEQ ID NO: 31805

SEQ ID NO: 286915 - RNA, 64 nt, Human; identical to SEQ ID NO: 31806

SEQ ID NO: 286916 - RNA, 64 nt, Human; identical to SEQ ID NO: 31807

SEQ ID NO: 286917 - RNA, 64 nt, Human; identical to SEQ ID NO: 31808

SEQ ID NO: 286918 - RNA, 64 nt, Human; identical to SEQ ID NO: 31809

SEQ ID NO: 286919 - RNA, 64 nt, Human; identical to SEQ ID NO: 31810

SEQ ID NO: 286920 - RNA, 64 nt, Human; identical to SEQ ID NO: 31811

SEQ ID NO: 286921 - RNA, 64 nt, Human; identical to SEQ ID NO: 31812

SEQ ID NO: 286922 - RNA, 64 nt, Human; identical to SEQ ID NO: 31813

SEQ ID NO: 286923 - RNA, 64 nt, Human; identical to SEQ ID NO: 6125

SEQ ID NO: 286924 - RNA, 64 nt, Human; identical to SEQ ID NO: 6126

SEQ ID NO: 286925 - RNA, 62 nt, Human
ugagcaggaagggcgaggagacaccuugaucagcgucccaguuucacagccaggcaaaccga

SEQ ID NO: 286926 - RNA, 62 nt, Human
cucggcggccguguccuccuccuggcguggcugcgucccagggcgcggguggguuuggugaa

SEQ ID NO: 286927 - RNA, 64 nt, Human; identical to SEQ ID NO: 31814

SEQ ID NO: 286928 - RNA, 64 nt, Human; identical to SEQ ID NO: 31815

SEQ ID NO: 286929 - RNA, 64 nt, Human; identical to SEQ ID NO: 31816

SEQ ID NO: 286930 - RNA, 64 nt, Human; identical to SEQ ID NO: 31817

SEQ ID NO: 286931 - RNA, 64 nt, Human; identical to SEQ ID NO: 31818

SEQ ID NO: 286932 - RNA, 64 nt, Human; identical to SEQ ID NO: 31819

SEQ ID NO: 286933 - RNA, 64 nt, Human; identical to SEQ ID NO: 31820

SEQ ID NO: 286934 - RNA, 64 nt, Human; identical to SEQ ID NO: 31821

SEQ ID NO: 286935 - RNA, 64 nt, Human; identical to SEQ ID NO: 31822

SEQ ID NO: 286936 - RNA, 64 nt, Human; identical to SEQ ID NO: 31823

SEQ ID NO: 286937 - RNA, 64 nt, Human; identical to SEQ ID NO: 31824

SEQ ID NO: 286938 - RNA, 64 nt, Human; identical to SEQ ID NO: 31825

SEQ ID NO: 286939 - RNA, 64 nt, Human; identical to SEQ ID NO: 31826

SEQ ID NO: 286940 - RNA, 64 nt, Human; identical to SEQ ID NO: 31827

SEQ ID NO: 286941 - RNA, 64 nt, Human; identical to SEQ ID NO: 31828

SEQ ID NO: 286942 - RNA, 64 nt, Human; identical to SEQ ID NO: 31829

SEQ ID NO: 286943 - RNA, 64 nt, Human; identical to SEQ ID NO: 6111

SEQ ID NO: 286944 - RNA, 64 nt, Human; identical to SEQ ID NO: 6112

SEQ ID NO: 286945 - RNA, 64 nt, Human; identical to SEQ ID NO: 6163

SEQ ID NO: 286946 - RNA, 64 nt, Human; identical to SEQ ID NO: 6164

SEQ ID NO: 286947 - RNA, 64 nt, Human; identical to SEQ ID NO: 31830

SEQ ID NO: 286948 - RNA, 64 nt, Human; identical to SEQ ID NO: 31831

SEQ ID NO: 286949 - RNA, 64 nt, Human; identical to SEQ ID NO: 31832

SEQ ID NO: 286950 - RNA, 64 nt, Human; identical to SEQ ID NO: 31833

SEQ ID NO: 286951 - RNA, 64 nt, Human; identical to SEQ ID NO: 31834

SEQ ID NO: 286952 - RNA, 64 nt, Human; identical to SEQ ID NO: 31835

SEQ ID NO: 286953 - RNA, 64 nt, Human; identical to SEQ ID NO: 31836

SEQ ID NO: 286954 - RNA, 64 nt, Human; identical to SEQ ID NO: 31837

SEQ ID NO: 286955 - RNA, 64 nt, Human; identical to SEQ ID NO: 31838

SEQ ID NO: 286956 - RNA, 64 nt, Human; identical to SEQ ID NO: 31839

SEQ ID NO: 286957 - RNA, 64 nt, Human; identical to SEQ ID NO: 31840

SEQ ID NO: 286958 - RNA, 64 nt, Human; identical to SEQ ID NO: 31841

SEQ ID NO: 286959 - RNA, 64 nt, Human; identical to SEQ ID NO: 31842

SEQ ID NO: 286960 - RNA, 64 nt, Human; identical to SEQ ID NO: 31843

SEQ ID NO: 286961 - RNA, 56 nt, Human; identical to SEQ ID NO: 31844

SEQ ID NO: 286962 - RNA, 64 nt, Human; identical to SEQ ID NO: 31845

SEQ ID NO: 286963 - RNA, 64 nt, Human; identical to SEQ ID NO: 6095

SEQ ID NO: 286964 - RNA, 64 nt, Human; identical to SEQ ID NO: 6096

SEQ ID NO: 286965 - RNA, 64 nt, Human; identical to SEQ ID NO: 6097

SEQ ID NO: 286966 - RNA, 64 nt, Human; identical to SEQ ID NO: 6098

SEQ ID NO: 286967 - RNA, 64 nt, Human; identical to SEQ ID NO: 31846

SEQ ID NO: 286968 - RNA, 64 nt, Human; identical to SEQ ID NO: 31847

SEQ ID NO: 286969 - RNA, 64 nt, Human; identical to SEQ ID NO: 31848

SEQ ID NO: 286970 - RNA, 64 nt, Human; identical to SEQ ID NO: 6102

SEQ ID NO: 286971 - RNA, 64 nt, Human; identical to SEQ ID NO: 6103

SEQ ID NO: 286972 - RNA, 64 nt, Human; identical to SEQ ID NO: 6104

SEQ ID NO: 286973 - RNA, 64 nt, Human; identical to SEQ ID NO: 31718

SEQ ID NO: 286974 - RNA, 64 nt, Human; identical to SEQ ID NO: 31719

SEQ ID NO: 286975 - RNA, 64 nt, Human; identical to SEQ ID NO: 6108

SEQ ID NO: 286976 - RNA, 64 nt, Human; identical to SEQ ID NO: 6109

SEQ ID NO: 286977 - RNA, 64 nt, Human; identical to SEQ ID NO: 6110

SEQ ID NO: 286978 - RNA, 64 nt, Human; identical to SEQ ID NO: 31720

SEQ ID NO: 286979 - RNA, 64 nt, Human; identical to SEQ ID NO: 31721

SEQ ID NO: 286980 - RNA, 64 nt, Human; identical to SEQ ID NO: 31722

SEQ ID NO: 286981 - RNA, 64 nt, Human; identical to SEQ ID NO: 31723

SEQ ID NO: 286982 - RNA, 64 nt, Human; identical to SEQ ID NO: 31724

SEQ ID NO: 286983 - RNA, 64 nt, Human; identical to SEQ ID NO: 31725

SEQ ID NO: 286984 - RNA, 64 nt, Human; identical to SEQ ID NO: 31726

SEQ ID NO: 286985 - RNA, 61 nt, Human; identical to SEQ ID NO: 31727

SEQ ID NO: 286986 - RNA, 64 nt, Human; identical to SEQ ID NO: 31728

SEQ ID NO: 286987 - RNA, 64 nt, Human; identical to SEQ ID NO: 31729

SEQ ID NO: 286988 - RNA, 64 nt, Human; identical to SEQ ID NO: 31730

SEQ ID NO: 286989 - RNA, 64 nt, Human; identical to SEQ ID NO: 31731

SEQ ID NO: 286990 - RNA, 64 nt, Human; identical to SEQ ID NO: 31732

SEQ ID NO: 286991 - RNA, 64 nt, Human; identical to SEQ ID NO: 31733

SEQ ID NO: 286992 - RNA, 64 nt, Human; identical to SEQ ID NO: 31734

SEQ ID NO: 286993 - RNA, 64 nt, Human; identical to SEQ ID NO: 31735

SEQ ID NO: 286994 - RNA, 64 nt, Human; identical to SEQ ID NO: 6114

SEQ ID NO: 286995 - RNA, 64 nt, Human; identical to SEQ ID NO: 6115

SEQ ID NO: 286996 - RNA, 64 nt, Human; identical to SEQ ID NO: 6116

SEQ ID NO: 286997 - RNA, 64 nt, Human; identical to SEQ ID NO: 6117

SEQ ID NO: 286998 - RNA, 64 nt, Human; identical to SEQ ID NO: 31736

SEQ ID NO: 286999 - RNA, 64 nt, Human; identical to SEQ ID NO: 31737

SEQ ID NO: 287000 - RNA, 64 nt, Human; identical to SEQ ID NO: 31738

SEQ ID NO: 287001 - RNA, 64 nt, Human; identical to SEQ ID NO: 31739

SEQ ID NO: 287002 - RNA, 64 nt, Human; identical to SEQ ID NO: 31740

SEQ ID NO: 287003 - RNA, 64 nt, Human; identical to SEQ ID NO: 31741

SEQ ID NO: 287004 - RNA, 64 nt, Human; identical to SEQ ID NO: 31742

SEQ ID NO: 287005 - RNA, 64 nt, Human; identical to SEQ ID NO: 31743

SEQ ID NO: 287006 - RNA, 64 nt, Human; identical to SEQ ID NO: 31744

SEQ ID NO: 287007 - RNA, 64 nt, Human; identical to SEQ ID NO: 31745

SEQ ID NO: 287008 - RNA, 64 nt, Human; identical to SEQ ID NO: 31746

SEQ ID NO: 287009 - RNA, 64 nt, Human; identical to SEQ ID NO: 31747

SEQ ID NO: 287010 - RNA, 64 nt, Human; identical to SEQ ID NO: 31748

SEQ ID NO: 287011 - RNA, 64 nt, Human; identical to SEQ ID NO: 31749

SEQ ID NO: 287012 - RNA, 64 nt, Human; identical to SEQ ID NO: 31750

SEQ ID NO: 287013 - RNA, 64 nt, Human; identical to SEQ ID NO: 31751

SEQ ID NO: 287014 - RNA, 64 nt, Human; identical to SEQ ID NO: 31752

SEQ ID NO: 287015 - RNA, 64 nt, Human; identical to SEQ ID NO: 31753

SEQ ID NO: 287016 - RNA, 62 nt, Human; identical to SEQ ID NO: 31754

SEQ ID NO: 287017 - RNA, 64 nt, Human; identical to SEQ ID NO: 31755

SEQ ID NO: 287018 - RNA, 64 nt, Human; identical to SEQ ID NO: 31756

SEQ ID NO: 287019 - RNA, 64 nt, Human; identical to SEQ ID NO: 31757

SEQ ID NO: 287020 - RNA, 54 nt, Human; identical to SEQ ID NO: 31758

SEQ ID NO: 287021 - RNA, 64 nt, Human; identical to SEQ ID NO: 31759

SEQ ID NO: 287022 - RNA, 64 nt, Human; identical to SEQ ID NO: 31760

SEQ ID NO: 287023 - RNA, 64 nt, Human; identical to SEQ ID NO: 31761

SEQ ID NO: 287024 - RNA, 64 nt, Human; identical to SEQ ID NO: 31762

SEQ ID NO: 287025 - RNA, 64 nt, Human; identical to SEQ ID NO: 31763

SEQ ID NO: 287026 - RNA, 64 nt, Human; identical to SEQ ID NO: 31764

SEQ ID NO: 287027 - RNA, 64 nt, Human; identical to SEQ ID NO: 31765

SEQ ID NO: 287028 - RNA, 64 nt, Human; identical to SEQ ID NO: 31766

SEQ ID NO: 287029 - RNA, 64 nt, Human; identical to SEQ ID NO: 31767

SEQ ID NO: 287030 - RNA, 64 nt, Human; identical to SEQ ID NO: 6121

SEQ ID NO: 287031 - RNA, 64 nt, Human; identical to SEQ ID NO: 6122

SEQ ID NO: 287032 - RNA, 64 nt, Human; identical to SEQ ID NO: 6123

SEQ ID NO: 287033 - RNA, 64 nt, Human; identical to SEQ ID NO: 6124

SEQ ID NO: 287034 - RNA, 64 nt, Human; identical to SEQ ID NO: 31768

SEQ ID NO: 287035 - RNA, 64 nt, Human; identical to SEQ ID NO: 31769

SEQ ID NO: 287036 - RNA, 64 nt, Human; identical to SEQ ID NO: 31770

SEQ ID NO: 287037 - RNA, 64 nt, Human; identical to SEQ ID NO: 31771

SEQ ID NO: 287038 - RNA, 64 nt, Human; identical to SEQ ID NO: 31772

SEQ ID NO: 287039 - RNA, 64 nt, Human; identical to SEQ ID NO: 31773

SEQ ID NO: 287040 - RNA, 64 nt, Human; identical to SEQ ID NO: 31774

SEQ ID NO: 287041 - RNA, 64 nt, Human; identical to SEQ ID NO: 31775

SEQ ID NO: 287042 - RNA, 64 nt, Human; identical to SEQ ID NO: 31776

SEQ ID NO: 287043 - RNA, 64 nt, Human; identical to SEQ ID NO: 31777

SEQ ID NO: 287044 - RNA, 64 nt, Human; identical to SEQ ID NO: 31778

SEQ ID NO: 287045 - RNA, 64 nt, Human; identical to SEQ ID NO: 31779

SEQ ID NO: 287046 - RNA, 64 nt, Human; identical to SEQ ID NO: 31780

SEQ ID NO: 287047 - RNA, 64 nt, Human; identical to SEQ ID NO: 31781

SEQ ID NO: 287048 - RNA, 64 nt, Human; identical to SEQ ID NO: 31782

SEQ ID NO: 287049 - RNA, 64 nt, Human; identical to SEQ ID NO: 31783

SEQ ID NO: 287050 - RNA, 64 nt, Human; identical to SEQ ID NO: 6099

SEQ ID NO: 287051 - RNA, 64 nt, Human; identical to SEQ ID NO: 6100

SEQ ID NO: 287052 - RNA, 64 nt, Human; identical to SEQ ID NO: 6128

SEQ ID NO: 287053 - RNA, 64 nt, Human; identical to SEQ ID NO: 6129

SEQ ID NO: 287054 - RNA, 64 nt, Human; identical to SEQ ID NO: 31784

SEQ ID NO: 287055 - RNA, 64 nt, Human; identical to SEQ ID NO: 31785

SEQ ID NO: 287056 - RNA, 64 nt, Human; identical to SEQ ID NO: 31786

SEQ ID NO: 287057 - RNA, 64 nt, Human; identical to SEQ ID NO: 31787

SEQ ID NO: 287058 - RNA, 64 nt, Human; identical to SEQ ID NO: 31788

SEQ ID NO: 287059 - RNA, 51 nt, Human; identical to SEQ ID NO: 31789

SEQ ID NO: 287060 - RNA, 64 nt, Human; identical to SEQ ID NO: 31790

SEQ ID NO: 287061 - RNA, 64 nt, Human; identical to SEQ ID NO: 31791

SEQ ID NO: 287062 - RNA, 64 nt, Human; identical to SEQ ID NO: 31792

SEQ ID NO: 287063 - RNA, 64 nt, Human; identical to SEQ ID NO: 31793

SEQ ID NO: 287064 - RNA, 64 nt, Human; identical to SEQ ID NO: 31794

SEQ ID NO: 287065 - RNA, 64 nt, Human; identical to SEQ ID NO: 31795

SEQ ID NO: 287066 - RNA, 64 nt, Human; identical to SEQ ID NO: 31796

SEQ ID NO: 287067 - RNA, 64 nt, Human; identical to SEQ ID NO: 31797

SEQ ID NO: 287068 - RNA, 64 nt, Human; identical to SEQ ID NO: 31798

SEQ ID NO: 287069 - RNA, 64 nt, Human; identical to SEQ ID NO: 31799

SEQ ID NO: 287070 - RNA, 62 nt, Human
cacacuuaaaaggcuuaauguuucucuggaaagcgucccagaauauuagccaguuuucuguc

SEQ ID NO: 287071 - RNA, 62 nt, Human
gccuccuggguucaggagauucuccucugucagcgucccaaguagcuggaauuacagccaug

SEQ ID NO: 287072 - RNA, 62 nt, Human
cggccccgggaggaucucaauaaagaacucgagcgucccagacccguaucuccuuucgcugc

SEQ ID NO: 287073 - RNA, 62 nt, Human
cagaccgggcuggagggugaccuuggcugugugcgucccagcaaaagagcucuggcccgcau

SEQ ID NO: 287074 - RNA, 64 nt, Human; identical to SEQ ID NO: 31800

SEQ ID NO: 287075 - RNA, 64 nt, Human; identical to SEQ ID NO: 31801

SEQ ID NO: 287076 - RNA, 64 nt, Human; identical to SEQ ID NO: 31802

SEQ ID NO: 287077 - RNA, 64 nt, Human; identical to SEQ ID NO: 31803

SEQ ID NO: 287078 - RNA, 64 nt, Human; identical to SEQ ID NO: 31804

SEQ ID NO: 287079 - RNA, 64 nt, Human; identical to SEQ ID NO: 31805

SEQ ID NO: 287080 - RNA, 64 nt, Human; identical to SEQ ID NO: 31806

SEQ ID NO: 287081 - RNA, 64 nt, Human; identical to SEQ ID NO: 31807

SEQ ID NO: 287082 - RNA, 64 nt, Human; identical to SEQ ID NO: 31808

SEQ ID NO: 287083 - RNA, 64 nt, Human; identical to SEQ ID NO: 31809

SEQ ID NO: 287084 - RNA, 64 nt, Human; identical to SEQ ID NO: 31810

SEQ ID NO: 287085 - RNA, 64 nt, Human; identical to SEQ ID NO: 31811

SEQ ID NO: 287086 - RNA, 64 nt, Human; identical to SEQ ID NO: 31812

SEQ ID NO: 287087 - RNA, 64 nt, Human; identical to SEQ ID NO: 31813

SEQ ID NO: 287088 - RNA, 64 nt, Human; identical to SEQ ID NO: 31814

SEQ ID NO: 287089 - RNA, 64 nt, Human; identical to SEQ ID NO: 31815

SEQ ID NO: 287090 - RNA, 64 nt, Human; identical to SEQ ID NO: 6132

SEQ ID NO: 287091 - RNA, 64 nt, Human; identical to SEQ ID NO: 6133

SEQ ID NO: 287092 - RNA, 64 nt, Human; identical to SEQ ID NO: 6134

SEQ ID NO: 287093 - RNA, 64 nt, Human; identical to SEQ ID NO: 6135

SEQ ID NO: 287094 - RNA, 64 nt, Human; identical to SEQ ID NO: 31816

SEQ ID NO: 287095 - RNA, 64 nt, Human; identical to SEQ ID NO: 31817

SEQ ID NO: 287096 - RNA, 64 nt, Human; identical to SEQ ID NO: 31818

SEQ ID NO: 287097 - RNA, 64 nt, Human; identical to SEQ ID NO: 31819

SEQ ID NO: 287098 - RNA, 64 nt, Human; identical to SEQ ID NO: 31820

SEQ ID NO: 287099 - RNA, 64 nt, Human; identical to SEQ ID NO: 31821

SEQ ID NO: 287100 - RNA, 64 nt, Human; identical to SEQ ID NO: 31822

SEQ ID NO: 287101 - RNA, 64 nt, Human; identical to SEQ ID NO: 31823

SEQ ID NO: 287102 - RNA, 64 nt, Human; identical to SEQ ID NO: 31824

SEQ ID NO: 287103 - RNA, 64 nt, Human; identical to SEQ ID NO: 31825

SEQ ID NO: 287104 - RNA, 64 nt, Human; identical to SEQ ID NO: 31826

SEQ ID NO: 287105 - RNA, 64 nt, Human; identical to SEQ ID NO: 31827

SEQ ID NO: 287106 - RNA, 64 nt, Human; identical to SEQ ID NO: 31828

SEQ ID NO: 287107 - RNA, 64 nt, Human; identical to SEQ ID NO: 31829

SEQ ID NO: 287108 - RNA, 64 nt, Human; identical to SEQ ID NO: 31830

SEQ ID NO: 287109 - RNA, 64 nt, Human; identical to SEQ ID NO: 31831

SEQ ID NO: 287110 - RNA, 64 nt, Human; identical to SEQ ID NO: 6118

SEQ ID NO: 287111 - RNA, 64 nt, Human; identical to SEQ ID NO: 6119

SEQ ID NO: 287112 - RNA, 64 nt, Human; identical to SEQ ID NO: 6136

SEQ ID NO: 287113 - RNA, 64 nt, Human; identical to SEQ ID NO: 6137

SEQ ID NO: 287114 - RNA, 64 nt, Human; identical to SEQ ID NO: 31832

SEQ ID NO: 287115 - RNA, 64 nt, Human; identical to SEQ ID NO: 31833

SEQ ID NO: 287116 - RNA, 64 nt, Human; identical to SEQ ID NO: 31834

SEQ ID NO: 287117 - RNA, 64 nt, Human; identical to SEQ ID NO: 31835

SEQ ID NO: 287118 - RNA, 64 nt, Human; identical to SEQ ID NO: 31836

SEQ ID NO: 287119 - RNA, 64 nt, Human; identical to SEQ ID NO: 31837

SEQ ID NO: 287120 - RNA, 64 nt, Human; identical to SEQ ID NO: 31838

SEQ ID NO: 287121 - RNA, 64 nt, Human; identical to SEQ ID NO: 31839

SEQ ID NO: 287122 - RNA, 64 nt, Human; identical to SEQ ID NO: 31840

SEQ ID NO: 287123 - RNA, 64 nt, Human; identical to SEQ ID NO: 31841

SEQ ID NO: 287124 - RNA, 64 nt, Human; identical to SEQ ID NO: 31842

SEQ ID NO: 287125 - RNA, 64 nt, Human; identical to SEQ ID NO: 31843

SEQ ID NO: 287126 - RNA, 56 nt, Human; identical to SEQ ID NO: 31844

SEQ ID NO: 287127 - RNA, 64 nt, Human; identical to SEQ ID NO: 31845

SEQ ID NO: 287128 - RNA, 64 nt, Human; identical to SEQ ID NO: 31846

SEQ ID NO: 287129 - RNA, 64 nt, Human; identical to SEQ ID NO: 31847

SEQ ID NO: 287130 - RNA, 64 nt, Human; identical to SEQ ID NO: 6139

SEQ ID NO: 287131 - RNA, 64 nt, Human; identical to SEQ ID NO: 6140

SEQ ID NO: 287132 - RNA, 64 nt, Human; identical to SEQ ID NO: 6141

SEQ ID NO: 287133 - RNA, 64 nt, Human; identical to SEQ ID NO: 6142

SEQ ID NO: 287134 - RNA, 64 nt, Human; identical to SEQ ID NO: 31848

SEQ ID NO: 287135 - RNA, 64 nt, Human; identical to SEQ ID NO: 6105

SEQ ID NO: 287136 - RNA, 64 nt, Human; identical to SEQ ID NO: 6106

SEQ ID NO: 287137 - RNA, 64 nt, Human; identical to SEQ ID NO: 6143

SEQ ID NO: 287138 - RNA, 64 nt, Human; identical to SEQ ID NO: 6086

SEQ ID NO: 287139 - RNA, 64 nt, Human; identical to SEQ ID NO: 6087

SEQ ID NO: 287140 - RNA, 64 nt, Human; identical to SEQ ID NO: 6088

SEQ ID NO: 287141 - RNA, 57 nt, Human; identical to SEQ ID NO: 6089

SEQ ID NO: 287142 - RNA, 64 nt, Human; identical to SEQ ID NO: 6090

SEQ ID NO: 287143 - RNA, 64 nt, Human; identical to SEQ ID NO: 6091

SEQ ID NO: 287144 - RNA, 63 nt, Human; identical to SEQ ID NO: 6092

SEQ ID NO: 287145 - RNA, 64 nt, Human; identical to SEQ ID NO: 6093

SEQ ID NO: 287146 - RNA, 63 nt, Human
cagcggccgcagcgaagcugccguucauguguuggaggccaaauguggcaaaccaaccccagg

SEQ ID NO: 287147 - RNA, 63 nt, Human
gugguggcucacgccuguaaucccagcacauugggaggccaaggcagguggaucaccugaggu

SEQ ID NO: 287148 - RNA, 63 nt, Human
gucagaaaagggcugggcuugggaaggggagguggaggccagguguccccagaccucuaaccc

SEQ ID NO: 287149 - RNA, 63 nt, Human
auguuccccugggccccucagaaagucgagcuuggaggccagccuggaucugucucucccuuc

SEQ ID NO: 287150 - RNA, 63 nt, Human
augauacccuggguggagugggggagcugagcaggaggccagguggcaaccaguagcugcugg

SEQ ID NO: 287151 - RNA, 63 nt, Human
gccuggucacauggugccuagggaugcagggcuggaggccagaggugucagcaacacuguguc

SEQ ID NO: 287152 - RNA, 63 nt, Human
gcuggggcuaggagggcagcaggguggccucugggaggccaggauggcacuguuggcaccgag

SEQ ID NO: 287153 - RNA, 63 nt, Human
uuaaaaagcacagggggaagaagaagagauuucggaggccauccugccaggggcggacggggc

SEQ ID NO: 287154 - RNA, 63 nt, Human
augguggcucacgcuuguaaucccagcacuuugggaggccaagguggguggaucaccugaggu

SEQ ID NO: 287155 - RNA, 63 nt, Human
gggaggaaguuggcugagccauugagugcugggggaggccauccaagauggcaugaaucgggc

SEQ ID NO: 287156 - RNA, 63 nt, Human
uguaucucaggucuggguccucccucuagccgaggaggccaccugcagccuccacccggcucu

SEQ ID NO: 287157 - RNA, 63 nt, Human
ugcucuauccacugcagggccagccacucgccaggaggccacgggccacgggaagaaccaagc

SEQ ID NO: 287158 - RNA, 63 nt, Human
uuuucccucugggagccuaaaccaggcugcaucggaggccaggacccggaucauucacuguga

SEQ ID NO: 287159 - RNA, 63 nt, Human
aauugggggccuuccauguagaaaguggggucaggaggccaagaaagggaauaugaauguaua

SEQ ID NO: 287160 - RNA, 63 nt, Human
ucaucugggguuggcaacaggacagaguucacaggaggccagugggcgggccaugagggacag

SEQ ID NO: 287161 - RNA, 63 nt, Human
uccggcccccagagcgccccucccuagugacccggaggccacaugagucccagugggaggcgc

SEQ ID NO: 287162 - RNA, 64 nt, Human
auuauuggcugggcauggugacucaugccuguaaucccggcacuuugggaggccaagggaggug

SEQ ID NO: 287163 - RNA, 64 nt, Human
uccaguggagaaccuucuuaaaccacugcuuccuucccggcaugcauuuugcauugguccagcc

SEQ ID NO: 287164 - RNA, 64 nt, Human
uuggaggguccucuuuuuauguugaguugcugcuucccggcaugccuucauuuugcuauggggg

SEQ ID NO: 287165 - RNA, 63 nt, Human
acuggagcugcuggaucccaguguggugguguaggaggccacagugagcagguggccccagcu

SEQ ID NO: 287166 - RNA, 63 nt, Human
ccaccccaucacgguggcccugagggcugacccggaggccaguggagcugccugguguccacg

SEQ ID NO: 287167 - RNA, 63 nt, Human
gcaguggcucacaccuguaaucccagcacuuugggaggccaaggugaguggaucaccugaggu

SEQ ID NO: 287168 - RNA, 63 nt, Human
ucccaagcagacacaacagcagcacagaggucuggaggccacacaaaaagugaugcucgcccu

SEQ ID NO: 287169 - RNA, 63 nt, Human
aagccaugauuacuuuagaccuagcccaggcuuggaggccagcuggaggaagaagggucuaaa

SEQ ID NO: 287170 - RNA, 63 nt, Human
acaguggcucacgccuguaaucucaacacuuugggaggccaaggugggaagaucacuugaucc

SEQ ID NO: 287171 - RNA, 63 nt, Human
augguggcucacaccuguaaucccagcacuuugggaggccaaggcaggcaaucaccugagguc

SEQ ID NO: 287172 - RNA, 63 nt, Human
uaagugcccugugcugguugccaggcgcagaggggaggccagcccugcccucaggaccugccu

SEQ ID NO: 287173 - RNA, 63 nt, Human
cuccuccuuccagcaccugccagagcuucuccaggaggccaagcagaggcuccccucaugaag

SEQ ID NO: 287174 - RNA, 63 nt, Human
aggcugccaaaggcaagggcuggucuucaggauggaggccagccugugcagaaggcugcagcu

SEQ ID NO: 287175 - RNA, 63 nt, Human
acagucaccccaaggcagguguagggagcccagggaggccaaucagcccccugaagacucugg

SEQ ID NO: 287176 - RNA, 63 nt, Human
gugguggcucaugccuguaaucccgacacuuugggaggccaaggcaggaggauggcuugaagc

SEQ ID NO: 287177 - RNA, 63 nt, Human
agucaugguggccacggccacagccacuaaucaggaggccaggccacccugccucuacccaac

SEQ ID NO: 287178 - RNA, 63 nt, Human
gcgguggcucacgccuguaauccuagcacuuugggaggccaaggugggaggauugcuugagcu

SEQ ID NO: 287179 - RNA, 63 nt, Human
aaaacgggucaguauuaagguuuucaaccggaaggaggccaaccagcccgacagugccauccc

SEQ ID NO: 287180 - RNA, 63 nt, Human
gcgguggcucacgccuguaaucccagcacuuugggaggccaaggugggcggaucgccugaggu

SEQ ID NO: 287181 - RNA, 64 nt, Human
cucagcccaucuggcagagucccaggaacucggagacuggcacagcugcuuugucugccagugc

SEQ ID NO: 287182 - RNA, 64 nt, Human
aagcucccagagccccugucucgggcuccccaccgacuggcagcugcacuauccccaacucccc

SEQ ID NO: 287183 - RNA, 64 nt, Human
ggcaguucaugguguuagggcacucacccccacagacuggcaaacccugcaggacuuccguggc

SEQ ID NO: 287184 - RNA, 63 nt, Human
augguggcucacaccuguaaucccagcacuuugggaggccaaggugggugggucaucugaggu

SEQ ID NO: 287185 - RNA, 63 nt, Human
ucaguggcucaugccuauaauuccagcacuuugggaggccaaggcagaaggaucacuugagac

SEQ ID NO: 287186 - RNA, 63 nt, Human
gugguaguuuaagccuauaaucucagcccuuuuggaggccaagguaagaggaucgcuugaggu

SEQ ID NO: 287187 - RNA, 63 nt, Human
augguggcucaugccucuaaucucagcacuuugggaggccaaggugggcggaucacuugaggu

SEQ ID NO: 287188 - RNA, 63 nt, Human
gcaguggcucacaccuguaaucccaacaccuugggaggccaaggugggcggaucacuugaggu

SEQ ID NO: 287189 - RNA, 63 nt, Human
ggucagcccccaaaccaaaguugucccaacagaggaggccagugaggcagagacagagcucuc

SEQ ID NO: 287190 - RNA, 63 nt, Human
ucugccugcaucugccacuuucugcuacccuagggaggccaggaggagcuucggaggaccauc

SEQ ID NO: 287191 - RNA, 63 nt, Human
gugguggaucacgccuguaaucccagcacucugggaggccaaagcgggcagaucaccugaggu

SEQ ID NO: 287192 - RNA, 63 nt, Human
cacugggcugauccugaauggcacaggccaaggggaggccagccucgccuuucuacccaggcc

SEQ ID NO: 287193 - RNA, 63 nt, Human
acgguggcucaugccuauaaucccagcacuuugggaggccaagguggguggaucaccugaggu

SEQ ID NO: 287194 - RNA, 63 nt, Human
accugcuuuuuucuguuuuuacaguggaaucuaggaggccacuuagucgucuuuuuuuccucu

SEQ ID NO: 287195 - RNA, 63 nt, Human
cuccucucugcuguuccucucuacaagaaccugggaggccaacgccuaaagaucauaauauca

SEQ ID NO: 287196 - RNA, 63 nt, Human
ucagaaagcaugcugugugggggcugcuucucaggaggccaggcccuucugagcggaaccguc

SEQ ID NO: 287197 - RNA, 63 nt, Human
gcgguggcucacgccuguaaucccagcacuuugggaggccaaggugggcggaucacaagguca

SEQ ID NO: 287198 - RNA, 63 nt, Human
gcucauggcguaaugggccugcccaaugcuuugggaggccaaggcagguagaucgcuugagcc

SEQ ID NO: 287199 - RNA, 63 nt, Human
gucugcaccacauggcgggguuggggggccgcuggaggccaccugccaaggcgugggauggga

SEQ ID NO: 287200 - RNA, 64 nt, Human
cccuccacuggaggggucuccucugcagcucagggacuggcacacuggccuccagaagggcagc

SEQ ID NO: 287201 - RNA, 64 nt, Human
augaugagugugaagaaaucauuucucuaugcaagacuggcauccugggacugcacgaugaacu

SEQ ID NO: 287202 - RNA, 64 nt, Human
agucaccccggccucuugcaagagaaaguccagggacuggcaagaagacccuuugacuaaagau

SEQ ID NO: 287203 - RNA, 63 nt, Human
gauggagcagcucuugggauccuuuggggaaaaggaggccauucugggccccuuggcaaaccu

SEQ ID NO: 287204 - RNA, 63 nt, Human
ucuccccaggcaagcucugaagucccugcagguggaggccaugccugucuuaaacucaguugc

SEQ ID NO: 287205 - RNA, 63 nt, Human
gucuaggugcagcagcuccaagcaugggaccaaggaggccagaaccugucgcuggaaaccagg

SEQ ID NO: 287206 - RNA, 63 nt, Human
gagguggcucacgccuguaaucccaguaguuugggaggccaaggcgggcagaucaccugaggu

SEQ ID NO: 287207 - RNA, 63 nt, Human
gugguggcucaugccuguaaucccaacacuuugggaggccaaggcaggcagaucacuuaaggc

SEQ ID NO: 287208 - RNA, 63 nt, Human
ugucgggguccuccagggagcugacccagagguggaggccacggaggcagggucucuggggac

SEQ ID NO: 287209 - RNA, 63 nt, Human
aggauacuuguacauagguaaccaauguacaugggaggccacauauuuuguucacuguuguau

SEQ ID NO: 287210 - RNA, 63 nt, Human
augguggcucacaccuauaaccccagcacuuugggaggccaaggcaggcagaucaccugaagu

SEQ ID NO: 287211 - RNA, 63 nt, Human
agaaagggaccauugggugcauagagauggggaggaggccacugggcugaauuuucucuuuag

SEQ ID NO: 287212 - RNA, 63 nt, Human
ggcacaccucaugccuguaaucccagcacucugggaggccaaggcagaugaucaccugagguc

SEQ ID NO: 287213 - RNA, 63 nt, Human
gaagcccuguucugagaacgagcagacugcaggggaggccaugggauuccccaggccaguguc

SEQ ID NO: 287214 - RNA, 63 nt, Human
uuaauuuacacuuaccaccucauuugcuuuucuggaggccaugcaauauaggcgggacuacag

SEQ ID NO: 287215 - RNA, 63 nt, Human
cacgguggcucacgccuguaaucccaguacuugggaggccaaggcaggcauaucaacuugagg

SEQ ID NO: 287216 - RNA, 63 nt, Human
gcuguggcucacgccuauaaucccagcacuuugggaggccaaggcaggcggaucccugaguuc

SEQ ID NO: 287217 - RNA, 53 nt, Human
ugcuccagggaagggugugaggaggaggccaccagauucagaauucagaauuu

SEQ ID NO: 287218 - RNA, 63 nt, Human
ccuucuguucuugaucucuuagggauccuauagggaggccauuuccuguccuggaauuaguuu

SEQ ID NO: 287219 - RNA, 64 nt, Human
aauuauugagccaguugucaguguucuguuacaugacuggcagacuaaauucuucaucguuguu

SEQ ID NO: 287220 - RNA, 64 nt, Human
ggacaguccgcgccugggggacgcuggcuggcucgacuggcagagagagcgcuggcagaucugg

SEQ ID NO: 287221 - RNA, 64 nt, Human
acaacuguagaggcaguucgaccagccagggaaagacuggcaagaaaagaguuaaggcaaaaaa

SEQ ID NO: 287222 - RNA, 63 nt, Human
augguggcucacaccuguaaucccuguacuuugggaggccaaggggggagaucacuugagguc

SEQ ID NO: 287223 - RNA, 63 nt, Human
gugguggcucacgccuguaaucccaacacuuugggaggccaaggcaggcggaucaccugaggu

SEQ ID NO: 287224 - RNA, 63 nt, Human
auauucuuugaggggucacuggcuuuaggacagggaggccagggaagagguggguuggggagg

SEQ ID NO: 287225 - RNA, 63 nt, Human
ucccuaccagccagggguuuccaagggaccuuuggaggccaugcuuagacacauuccuguacc

SEQ ID NO: 287226 - RNA, 63 nt, Human
uuccccacagggugcccgguccccacggcgcaaggaggccaagcucagcugugugucugagcc

SEQ ID NO: 287227 - RNA, 63 nt, Human
ccauggggugccgagccaacgccucaggaaucaggaggccagccugguaccaaaaggaguacc

SEQ ID NO: 287228 - RNA, 63 nt, Human
gcuugcucuugugccuccugggcaagggcugaaggaggccacuccaucucaccucggggggcu

SEQ ID NO: 287229 - RNA, 63 nt, Human
guggugggucacgccuguaaucccagcacuuugggaggccaaggcggguugaucacccgaggu

SEQ ID NO: 287230 - RNA, 63 nt, Human
auuugggugagaacugagaggugggagaugauuggaggccauggccuauguacaaacauacug

SEQ ID NO: 287231 - RNA, 63 nt, Human
cuuccaaggggguuucagucuggacuuauacagggaggccagaagggcuccaugcacuggaau

SEQ ID NO: 287232 - RNA, 63 nt, Human
augguggcucaugccuguaaucccagcacuuggggaggccaaggcaggcggaucacaugaggc

SEQ ID NO: 287233 - RNA, 63 nt, Human
uagggcgaagacccuuauuacacggaaaacgguggaggccagggcuauagcucaggaccuggg

SEQ ID NO: 287234 - RNA, 63 nt, Human
caaacucacagagcccuugugcagauccagcauggaggccacccucaggagugacuucucauc

SEQ ID NO: 287235 - RNA, 63 nt, Human
uagcuuaucaaaugaaguauuauuuuguggacuggaggccaaaaagucaaugugagcuucuca

SEQ ID NO: 287236 - RNA, 63 nt, Human
gcaccugggggcgcgggcgggggaccccugcugggaggccaggagacugccccugcugccuuc

SEQ ID NO: 287237 - RNA, 63 nt, Human
gcaggggcucacaccuguaauccuagcacuuugggaggccaaggcggguggaucacuugagac

SEQ ID NO: 287238 - RNA, 62 nt, Human
cgggugugcgucgagugagcgucccgaggccacgugcggaggccccucacugugcugucaaa

SEQ ID NO: 287239 - RNA, 62 nt, Human
cuggcuggaccgcgugugaaaggcagaacuaacgugcggaaacauuugaaaacaacucugaa

SEQ ID NO: 287240 - RNA, 62 nt, Human
gcggccugcagcgugagcugugggagaggggucgugcggaggauccuguauugugcccgggc

SEQ ID NO: 287241 - RNA, 63 nt, Human
uggaaaguugugucuucugggaaagagaccuggggaggccaggaguagcugaggguccuuucu

SEQ ID NO: 287242 - RNA, 63 nt, Human
gcaguggcucacgccuguaaucccagcacuuugggaggccaaggcaaacggaucacgagguca

SEQ ID NO: 287243 - RNA, 63 nt, Human
cacucccuuccugcuguguuauagaacuguaggggaggccauggaaaugacucuaaagauaca

SEQ ID NO: 287244 - RNA, 63 nt, Human
accagcuggggggcaggggggagaggggguaauggaggccaagccugcagcuuucuggaaauu

SEQ ID NO: 287245 - RNA, 63 nt, Human
cagcccuagugggagcccagcacacugcuucucggaggccaggcccuccugcuggcugaggcu

SEQ ID NO: 287246 - RNA, 63 nt, Human
ugagcagggcccucagaggaaaggcaguauggcggaggccaugggggccccucggcauucaca

SEQ ID NO: 287247 - RNA, 63 nt, Human
gcgguggcucacgccuguaaucccaacacuuugggaggccaagguggguggaucacaagguca

SEQ ID NO: 287248 - RNA, 63 nt, Human
cuuuucagugucuucucggaaaaaaccauccuuggaggccacaagugaugagaaggauucuuu

SEQ ID NO: 287249 - RNA, 63 nt, Human
gcacgguggcucaccuguaaucccagcacuuugggaggccaaggcgggcagaucaccugaggu

SEQ ID NO: 287250 - RNA, 63 nt, Human
uacuggauuaacuaauacuuuauaggcuuuucaggaggccacaucacuagcaguagggagaac

SEQ ID NO: 287251 - RNA, 63 nt, Human
ggcuugcaccuccacaaaguaagguuggcccuuggaggccauguuugggucuccggccagggc

SEQ ID NO: 287252 - RNA, 63 nt, Human
ugaacugcugaggaugggggguguccccucagcggaggccaagggaggggagcagccuaguug

SEQ ID NO: 287253 - RNA, 63 nt, Human
ugcacaggccaccccccucuucaggcugcugcaggaggccaggcccaggccagagaccccagg

SEQ ID NO: 287254 - RNA, 63 nt, Human
gcgguggcucaggccuguaaucccagcacuuugggaggccaagaugggcggaucaugaaguca

SEQ ID NO: 287255 - RNA, 63 nt, Human
augguagcacacaccuguagucccagauacuugggaggccaaggcaggaggauugcuugagac

SEQ ID NO: 287256 - RNA, 63 nt, Human
acgguggcucacgccuguaaucccagcacuuugggaggccaaggugggcggaucaccugaugu

SEQ ID NO: 287257 - RNA, 64 nt, Human
cuagauguguuuacagaaagcaaguauccaguaugacuggcauguguucaugcuauucagaauc

SEQ ID NO: 287258 - RNA, 62 nt, Human
gugaaugucccuggaaagcacgccggccugcgcgugcggagcggagccccccguguucacac

SEQ ID NO: 287259 - RNA, 63 nt, Human
guaguggcucacaccuguaaucccagcacuuugggaggccaaggagggcagaucacuucaggu

SEQ ID NO: 287260 - RNA, 63 nt, Human
gcaguggcucacgccuguaaucccagcacuuugggaggccaagguggguggaucaccuguggu

SEQ ID NO: 287261 - RNA, 63 nt, Human
aaugcagcccccauuguggucacaggaaguagaggaggccacguucuuacuaguuucccuugc

SEQ ID NO: 287262 - RNA, 63 nt, Human
gugguggcucaugccuguaaucucaguacauugggaggccaaggcagguggaucaccugaggu

SEQ ID NO: 287263 - RNA, 63 nt, Human
ggcucugguauuaaccuggaagccccccuggcuggaggccaccgccacccuaggaagggggca

SEQ ID NO: 287264 - RNA, 63 nt, Human
augguggcuuacgccuguaauccuagcacuuugggaggccaagacgggcggaucaccugaggu

SEQ ID NO: 287265 - RNA, 63 nt, Human
agaaaguauuggacugagauauuugguuaccauggaggccaaugcuuuuuucaucuuauuaaa

SEQ ID NO: 287266 - RNA, 63 nt, Human
gcccugcagggucagaaccuccccacccccaggggaggccaggcagaagccugggucacagca

SEQ ID NO: 287267 - RNA, 63 nt, Human
auuguuccuuuuccuacaaaggaagcagucucuggaggccagaaagaaaagccuucuuuuuca

SEQ ID NO: 287268 - RNA, 63 nt, Human
auggugucuguguacccgcuggucuuguuuggaggaggccaagugaaugugcagcuucaaaga

SEQ ID NO: 287269 - RNA, 63 nt, Human
ugcagcugcacccacccugcuugaucccaccugggaggccaggacacugaggagcucugaacc

SEQ ID NO: 287270 - RNA, 63 nt, Human
cuggcccaugguccugcuucaugcuuugggucaggaggccaaagcugauguucaggccccacc

SEQ ID NO: 287271 - RNA, 63 nt, Human
augguggcucacgccuguaaucccagcacuuugggaggccauggcggguggaacauuugaggg

SEQ ID NO: 287272 - RNA, 63 nt, Human
acgguggcugacaccuguaaucccagcacuuugggaggccaagguggggggauuacccgaggu

SEQ ID NO: 287273 - RNA, 63 nt, Human
ggcaggcaaagccugugugacuguggcagugccggaggccaagggggccaagaggaaaagcau

SEQ ID NO: 287274 - RNA, 63 nt, Human
acaaggcugagcaggguuccuguggcccaggauggaggccaccgcugcccugccaucccgucu

SEQ ID NO: 287275 - RNA, 62 nt, Human
ugagaggagcagguggaggcgcucaggcauaccgugcggaacgaccguaccaccaucaggcg

SEQ ID NO: 287276 - RNA, 62 nt, Human
gcacuggagaggccggagccuuuggaacaaaccgugcggaacgcguccaggggccuucccgc

SEQ ID NO: 287277 - RNA, 62 nt, Human
auggacaccaguuaaacagaccagcaaauccgcgugcggaacaggacccaggcgucuccucu

SEQ ID NO: 287278 - RNA, 63 nt, Human
cugagcaguucaucuuuuccagagguaaggguaggaggccaacuucagggucugggucugagc

SEQ ID NO: 287279 - RNA, 63 nt, Human
agcguggugugugccuguagucucagcuacuugggaggccauggugggaggauggguugagca

SEQ ID NO: 287280 - RNA, 63 nt, Human
gcaguggcucacuccuguaauccgagcaauuugggaggccaaggugggaguuuugcuugaggc

SEQ ID NO: 287281 - RNA, 63 nt, Human
gugagcuuuggaaauguuuucuaauagacacagggaggccaguucuguuucagagcaauuauc

SEQ ID NO: 287282 - RNA, 63 nt, Human
gacugugcuggccuggagagugcuggggcagguggaggccagggaauggucccauacaguuau

SEQ ID NO: 287283 - RNA, 63 nt, Human
caacucagccucgcaagagguggcagaggcacaggaggccacaguccuuccuggggcauucca

SEQ ID NO: 287284 - RNA, 63 nt, Human
cuguauguauuuccaccugaggagaaggccuggggaggccacagugcaccauugcacagggcu

SEQ ID NO: 287285 - RNA, 63 nt, Human
aacaugagagaagcagaaggaggaaacauaagaggaggccaaaaguuaaacguucuaaaaaga

SEQ ID NO: 287286 - RNA, 63 nt, Human
ugccccucaccccccacccacacugcagguagaggaggccaucugaucccaugggaagccauc

SEQ ID NO: 287287 - RNA, 63 nt, Human
uuguuggagaauaagucagucugaggggaaaugggaggccagagaugagaacccuuugaaaag

SEQ ID NO: 287288 - RNA, 63 nt, Human
ccucccugaaccagggagacagccucugggauuggaggccagaggccagggucagacccagcc

SEQ ID NO: 287289 - RNA, 63 nt, Human
agcaggccccgcccucucacagaggaugggugaggaggccagaccugcccugccccauugucc

SEQ ID NO: 287290 - RNA, 63 nt, Human
gcaguggcucacaccuguaaucccagcacguugggaggccaaggcgggcagaucacgagguca

SEQ ID NO: 287291 - RNA, 63 nt, Human
ggccaugagugacgggcagugaccagagggacuggaggccagcgguguccacccuugcccuca

SEQ ID NO: 287292 - RNA, 63 nt, Human
auggugacucaugccuguaaucccggcacuuugggaggccaagggaggugaucacuugagccc

SEQ ID NO: 287293 - RNA, 63 nt, Human
gguacccaaggugcgguagggggucgagggggaggaggccaccugaccaaaugccgccaaccc

SEQ ID NO: 287294 - RNA, 53 nt, Human
ucaucuucaacagccgguagccgcgugcggaggggacagagcgugagcugagc

SEQ ID NO: 287295 - RNA, 62 nt, Human
cgccuccagcggggagcacgggugcugccuuccgugcggaucgagcuuuccuggacucgguc

SEQ ID NO: 287296 - RNA, 62 nt, Human
uugaggaaagccgguggaagauucuggaaugccgugcggaugaacuucagcacccgagucag

SEQ ID NO: 287297 - RNA, 63 nt, Human
ccgugucacccugccuggaagaggucuggguggggaggccaguucccauaggaaggagucugc

SEQ ID NO: 287298 - RNA, 63 nt, Human
cccguccaccccagagacccugcccuuccacccggaggccaaaggccaacuguacucccaaag

SEQ ID NO: 287299 - RNA, 63 nt, Human
uauuugauauucacuuuacucacaaguagugcgggaggccagcuccuggcaggcccucgcgau

SEQ ID NO: 287300 - RNA, 63 nt, Human
cugccgcaagggaagccucaggaaccagcaccuggaggccaggauagccaagcccugggugag

SEQ ID NO: 287301 - RNA, 63 nt, Human
gugagcacaucggcacagcaugcauccagcucuggaggccacggugcaggcauagcugccugc

SEQ ID NO: 287302 - RNA, 63 nt, Human
ucacacaagcacacacacacaguccucacacacggaggccagacacaggccgugggacccagg

SEQ ID NO: 287303 - RNA, 63 nt, Human
gggagccagcuggaagggaaggagaggggccagggaggccacaggcccggccauaugagcauc

SEQ ID NO: 287304 - RNA, 61 nt, Human
aacucucugcuggguucugacucagaccauaggaggccaacccaaaauaagcaggcgugac

SEQ ID NO: 287305 - RNA, 63 nt, Human
gcuuggaaaagguuuucuggggaggaggaggcuggaggccaggacacuguuuguuguggaacu

SEQ ID NO: 287306 - RNA, 63 nt, Human
uucccaccccuacacacacacucccugcuugcaggaggccaaacugucccucccuugcugaac

SEQ ID NO: 287307 - RNA, 63 nt, Human
gccugcugggcuccccccagugggaugggacagggaggccacacgcacuggugccaaaaccag

SEQ ID NO: 287308 - RNA, 63 nt, Human
cagagcugcagccagcucugcccucuacccuagggaggccagaaagacacaaacagcccuccg

SEQ ID NO: 287309 - RNA, 63 nt, Human
gcgguggcucaugccuguaaucccagcacuaugggaggccagggagggaggaucuccagaggu

SEQ ID NO: 287310 - RNA, 63 nt, Human
gcauccauggcuaaugaaagauaccaagaacauggaggccaagaaacucuccaaggaccggau

SEQ ID NO: 287311 - RNA, 63 nt, Human
agcugccagggccuguggaggacaggccagagaggaggccagcaggcccagaguccccagggg

SEQ ID NO: 287312 - RNA, 63 nt, Human
aggcagauugggugguagugggagguugugcauggaggccagugaaagcugacaucuguaaaa

SEQ ID NO: 287313 - RNA, 64 nt, Human; identical to SEQ ID NO: 278555

SEQ ID NO: 287314 - RNA, 64 nt, Human
ccagauguuggacaccaggaaggggccccacagccgagacgacguguccagugaccaucucaga

SEQ ID NO: 287315 - RNA, 63 nt, Human
ccucccaccuguccccagaucagucucugggauggaggccagagagcuggucaggcuccccca

SEQ ID NO: 287316 - RNA, 63 nt, Human
guggugacucacaccuguaauuccagcacuucaggaggccaaggugggaagaucauuugaguu

SEQ ID NO: 287317 - RNA, 63 nt, Human
agaguggcuuacaccuauaaucccagcaauuugggaggccaaggugggcagaucacuugaggu

SEQ ID NO: 287318 - RNA, 63 nt, Human
aggucuauucacugcaucccagugauacaaaguggaggccacugccuucugacaucuggcuca

SEQ ID NO: 287319 - RNA, 63 nt, Human
cuauaccuuauccauaggcgcaggugcacagggggaggccauaaagaucaaacaugcauggau

SEQ ID NO: 287320 - RNA, 63 nt, Human
guguccccgugcaguaggggcuacugugaccauggaggccagugccagcaccugcccaguggg

SEQ ID NO: 287321 - RNA, 63 nt, Human
acugugacauuucagccugaccaugaagacggcggaggccaggagacguucaacgccaccgga

SEQ ID NO: 287322 - RNA, 63 nt, Human
cacgucuguagaucuguacauaucugggccuuuggaggccacguguggcaugggaggggcuac

SEQ ID NO: 287323 - RNA, 63 nt, Human
guggcugggcccucucccaccugccuguucaguggaggccagggcagcagcccagaacagcac

SEQ ID NO: 287324 - RNA, 63 nt, Human
auaguggcucacgccuguaaucccagcacuuuaggaggccaaggcggguggaucaccugaggu

SEQ ID NO: 287325 - RNA, 63 nt, Human
caauggcucacaccuguuaaucccagcacuucgggaggccaaggugggcaguucgcuugggcc

SEQ ID NO: 287326 - RNA, 63 nt, Human
aacagauaacauuuuuuuuuguuuuuuggguguggaggccauuuuuagagauacagaauugga

SEQ ID NO: 287327 - RNA, 63 nt, Human
gcaaugggauaugccugcaggcccagcuacacgggaggccaaggcaggaggaucacuugaaau

SEQ ID NO: 287328 - RNA, 63 nt, Human
gcgguggcucacgccuguaaucccagcacuuugggaggccaagguggguggaccacaugaggu

SEQ ID NO: 287329 - RNA, 63 nt, Human
gugguggcucacgccugugaucccagcacuuugggaggccaagacgggcggaucaugagguca

SEQ ID NO: 287330 - RNA, 63 nt, Human
gcaguggcucaugccuauauucccugcacuuugggaggccaaagcaggaggaucgcuugagcc

SEQ ID NO: 287331 - RNA, 64 nt, Human
accaaugucuaagucgugccuccuuccaccucccucccggcaugggaaagccaccucucccuca

SEQ ID NO: 287332 - RNA, 64 nt, Human
gacccaggcguccgggcucccagcccgccccuccucccggcacucccuaaaugaucucuccuuc

SEQ ID NO: 287333 - RNA, 64 nt, Human
acagccugaggcuuauaaagcuuguacagcugccucccggcaguccaggaaaacugcaaaaaau

SEQ ID NO: 287334 - RNA, 63 nt, Human
gcgguggcucaagccuguaaccccagcacuuugggaggccaaggagggaggaucacaagguca

SEQ ID NO: 287335 - RNA, 63 nt, Human
gugacugaugccuguaaucccaacacuuuguugggaggccaaagcaggaggauagcuugaggc

SEQ ID NO: 287336 - RNA, 63 nt, Human
aaagucuguuucaaaaaguguggccucagcucuggaggccacccccaggaaggaguuugaggu

SEQ ID NO: 287337 - RNA, 63 nt, Human
ccucagcacucggggcaacacaguggaaaguggggaggccauagacccaaacaaguucuuugg

SEQ ID NO: 287338 - RNA, 63 nt, Human
acgguggcucacgccuguaaucccagcacuuuaggaggccaagguagguggaucacuugaggu

SEQ ID NO: 287339 - RNA, 63 nt, Human
gcgguggcucacgccuguaaucccagcccuuugggaggccaaggcggguggaucacuugaggu

SEQ ID NO: 287340 - RNA, 63 nt, Human
augguggcucacaccuauaaucccaacacuuucggaggccaaggagggacaaacgaacccuug

SEQ ID NO: 287341 - RNA, 63 nt, Human
augagcacauaggacucuagacggcauccagccggaggccagagcugagcccucagcccggga

SEQ ID NO: 287342 - RNA, 63 nt, Human
auagggcuggaaucugucuaggagcccucucucggaggccacagaggcuggggguagccauug

SEQ ID NO: 287343 - RNA, 63 nt, Human
gagcaaagugcagguuaugcaagucgccaggcaggaggccauuccaggagugggauuauucau

SEQ ID NO: 287344 - RNA, 63 nt, Human
aaaaaccaucuguaaaagacugaggugggggugggaggccagcacgguggugaggcaguugag

SEQ ID NO: 287345 - RNA, 63 nt, Human
aaaaaccaucuguaaaagacuggggugggggugggaggccagcacgguggugaggcaguugag

SEQ ID NO: 287346 - RNA, 63 nt, Human
augguggcucaugccuguaaucccagcacuuugggaggccaagguaggcagaucaccugaggu

SEQ ID NO: 287347 - RNA, 63 nt, Human
augguggcucacaccuguaauccaagcacuuugggaggccaaggugggagcaucacuugaucc

SEQ ID NO: 287348 - RNA, 63 nt, Human
gauccauggaagugcacuuaggcuugcugugguggaggccauaguggagaugaaggcucugcu

SEQ ID NO: 287349 - RNA, 63 nt, Human
gaguguagcugccagcguagaaacccaugaaaaggaggccacaggagauuccugggagcacug

SEQ ID NO: 287350 - RNA, 64 nt, Human
uguuaauuuuguuaagaauuucaauaucaagacugacuggcaccaacacuuugguauucaauuu

SEQ ID NO: 287351 - RNA, 64 nt, Human
uuauauauuugcaagcaaaggacaguaagaaguugacuggcaaaagagcagugcugaaggagga

SEQ ID NO: 287352 - RNA, 63 nt, Human
cuaguggcgcacaccugcaaucccaacacuuugggaggccaagagaggaagauugcuugagcc

SEQ ID NO: 287353 - RNA, 63 nt, Human
ugguggccugacaccugcaaucccaacauuuugggaggccaaggugggagggucccuuccuug

SEQ ID NO: 287354 - RNA, 63 nt, Human
ucaguggcucauuccuguaaucccagcacuuugggaggccaaggcgggcagaucaccuuaggu

SEQ ID NO: 287355 - RNA, 53 nt, Human
gcaagaaggagaagaaguaacauggaggccaggccaagagccacagggcggcc

SEQ ID NO: 287356 - RNA, 63 nt, Human
gcaguggcucacaccuguaaucccagcacuuugggaggccaaaguggguggaucacuugagga

SEQ ID NO: 287357 - RNA, 63 nt, Human
caggcauucgccugccucucacaaauguuucagggaggccaguucugcagggugucagcucca

SEQ ID NO: 287358 - RNA, 63 nt, Human
aaggagugcagggaggggcaggaaaggagacaaggaggccaguauggacacuguguccaguau

SEQ ID NO: 287359 - RNA, 63 nt, Human
uguuucugcucuuugucagcuuucaggggagaaggaggccacuggaaaauuauuucccuaagu

SEQ ID NO: 287360 - RNA, 63 nt, Human
aguaagccuagguguugucagcaggcaggcuggggaggccaguguugugggcuuccugcuggg

SEQ ID NO: 287361 - RNA, 63 nt, Human
gcaguggcucaugccuauaaucccagcacuuugggaggccaaggugggcggaucaccugagcu

SEQ ID NO: 287362 - RNA, 63 nt, Human
augguggcucaugccuguaaucccaacacuuugggaggccaaggaggguggaucacuuaaggu

SEQ ID NO: 287363 - RNA, 63 nt, Human
cgguagcucacguccuauagucgcagcacuuugggaggccaaggugggcaguucacgugaggu

SEQ ID NO: 287364 - RNA, 63 nt, Human
acuauaagaugcagucucagaggaucagcaaguggaggccaucaguauugacuuucucuuacu

SEQ ID NO: 287365 - RNA, 63 nt, Human
ggcagggacugccggccccggagucucccacagggaggccauuccccuucuacucaccgacau

SEQ ID NO: 287366 - RNA, 63 nt, Human
uccgaaucccagggcuggguguagguagccguuggaggccaucgcuacagggcaccuaucugu

SEQ ID NO: 287367 - RNA, 63 nt, Human
caucguccccggggcaguugcgugacccugcugggaggccagaccgggccagacugaggguca

SEQ ID NO: 287368 - RNA, 64 nt, Human
uuccccagccacugccuucaugcugcccccgccggacuggcagagccaggggucagccaccugc

SEQ ID NO: 287369 - RNA, 64 nt, Human
ucuuuccuuagguucuuuccucugagcaaacacugacuggcauccugcuuuccagugccugcca

SEQ ID NO: 287370 - RNA, 63 nt, Human
cucucucaacaucacauacagcuucagcugccuggaggccagaaggaaagggcagugcagggg

SEQ ID NO: 287371 - RNA, 63 nt, Human
uagcuaucugggacauuauuggcagugggcccuggaggccagucccuagccccccuugccccu

SEQ ID NO: 287372 - RNA, 63 nt, Human
cugcaggggccgugaccagcccucugccuccagggaggccaacugacucugagccaggguucc

SEQ ID NO: 287373 - RNA, 63 nt, Human
uucuagcuucccauucccagagcaaggcaggcgggaggccaaggacuggacuuggcuuauuuc

SEQ ID NO: 287374 - RNA, 63 nt, Human
gcucaagaauguacaguggcuccccaaugccuuggaggccauaaggccagccaguucuagcuc

SEQ ID NO: 287375 - RNA, 63 nt, Human
agggucuagcucuaccacauucaggaggccucaggaggccagccugccaugagagcacauguc

SEQ ID NO: 287376 - RNA, 63 nt, Human
gcucagugccauagccuuaccgcagccugcgcgggaggccacagcccgugccgauuccagugc

SEQ ID NO: 287377 - RNA, 63 nt, Human
gugguggcucacaccuguaaucccaacacuuugggaggccaaggcagguagaucacuugaugc

SEQ ID NO: 287378 - RNA, 63 nt, Human
ccucugcagccggaggaggagauguugaggggaggaggccagccagugugaccggcgcuagga

SEQ ID NO: 287379 - RNA, 63 nt, Human
uugccuacugucaguggcuuugccaagaugggaggaggccagugcccacuugcccaccgaccu

SEQ ID NO: 287380 - RNA, 63 nt, Human
acaguggcucacgccuguaaucccaacaccuugggaggccaaggcaggcagaucacgacauca

SEQ ID NO: 287381 - RNA, 63 nt, Human
gagagcaacacaggauggucucugccaugaacuggaggccaggaaucuccucacugaaaauua

SEQ ID NO: 287382 - RNA, 63 nt, Human
cuguccugcccucccagcaauaaccaccucccuggaggccagcugagaugccuggcuacuugg

SEQ ID NO: 287383 - RNA, 63 nt, Human
gcgguggcucacgccuguaaucccagcacuuugggaggccaaggcgggcagaccaugagguca

SEQ ID NO: 287384 - RNA, 63 nt, Human
acaguggcucauaccuguaaugccagcacuuugggaggccaaggcgggcagaucacgagguca

SEQ ID NO: 287385 - RNA, 63 nt, Human
ugagauucaccaguaaggggagggaggggcccuggaggccacauccugccccaccccaccccc

SEQ ID NO: 287386 - RNA, 53 nt, Human
agcccauccugaugaccuagccgcgugcggagccugcgcagagccccggccgg

SEQ ID NO: 287387 - RNA, 62 nt, Human
gggaaccaagagaaccacguagaauccucaaccgugcggaccaucaaccuucgagaaauucc

SEQ ID NO: 287388 - RNA, 64 nt, Human
cgcuuuccuuccuccccuuuugcccccguggggcucccggcauccugaaagccagcaaagccuc

SEQ ID NO: 287389 - RNA, 63 nt, Human
uaguugaugcuuccccagggucccccuggcuggggaggccaagaauagggaagggacuuguag

SEQ ID NO: 287390 - RNA, 63 nt, Human
guggugacucacaccuauaaucccaauacuuugggaggccaaggcaggaggauugcuugaggu

SEQ ID NO: 287391 - RNA, 63 nt, Human
guugccagguaaagaaaccauggcauaaagcugggaggccaaacacccaagcacaaacugucg

SEQ ID NO: 287392 - RNA, 63 nt, Human
gcaguggcucacaccuguaaucccagcacuuugggaggccaaggcgagcggaucaugagguca

SEQ ID NO: 287393 - RNA, 63 nt, Human
gcgguggcucacgccuguaauccuagcacuuugggaggccaaguugggcagaucacaaguuca

SEQ ID NO: 287394 - RNA, 63 nt, Human
uucagcccaagguuccuccucuccuaccaagcaggaggccaggaacuucuuuggacuuggaag

SEQ ID NO: 287395 - RNA, 63 nt, Human
uggcucacgccuguaaucccagcacuuacuuugggaggccaaggugggcagauaaccugcggu

SEQ ID NO: 287396 - RNA, 63 nt, Human
augguggcucacgccuguaauuccagugcuuugggaggccaagaugggaggaucauuugagcc

SEQ ID NO: 287397 - RNA, 63 nt, Human
gggaggcugggcggguacagcgcggaggaggagggaggccaggcgggcauggcguggaggagg

SEQ ID NO: 287398 - RNA, 63 nt, Human
gaucaugcccuuugcagggacauggauggagcuggaggccauuauccuucauaaacuauugca

SEQ ID NO: 287399 - RNA, 61 nt, Human
aggccacaucuaagaaguaaagagcuuuccgggaggccaauuuggaaagaacccaaaggcu

SEQ ID NO: 287400 - RNA, 63 nt, Human
gcucagaaacugcuagguaaaagaauuccagaaggaggccagggcauaaguuggaugaccuau

SEQ ID NO: 287401 - RNA, 63 nt, Human
uggagaugggaagacagggaaaggaaggcagcaggaggccacaagcccaccaggucuucaugu

SEQ ID NO: 287402 - RNA, 63 nt, Human
gugcaagaaucuggagcugggaaaaggguucuuggaggccaggggaauacggggucccagaga

SEQ ID NO: 287403 - RNA, 62 nt, Human
uuaacguccucauccgcuagccgcgcaggcguggaggccaggaggcuggggccccugggcug

SEQ ID NO: 287404 - RNA, 63 nt, Human
gcaguggcucauuccuguaaucccagcacuuugggaggccaaggggacaggacugcuugaggc

SEQ ID NO: 287405 - RNA, 64 nt, Human
ccgccccugcccccccgggcuguucggggccggaucccggcagcggccuccccaaagcgacagg

SEQ ID NO: 287406 - RNA, 64 nt, Human
ucuuuucuuuaggaaccguggagcaugcaacacaucccggcacuguuuucggccuucuguggcc

SEQ ID NO: 287407 - RNA, 64 nt, Human
ccccaacccuccccuggacagacucugaaggcccucccggcaccucugccaaggcuggguaaga

SEQ ID NO: 287408 - RNA, 63 nt, Human
gguggcuggggccugggagaggccaggugaaugggaggccagggccccagacuccccgaaguu

SEQ ID NO: 287409 - RNA, 63 nt, Human
gaggggacuguguuucuuuaaggaugcugaccuggaggccaccgagaggcuggggcuggggcu

SEQ ID NO: 287410 - RNA, 58 nt, Human
aagaagaaagcaagucauaaagccucagggaggccauuuuugccuaaauuugaaauga

SEQ ID NO: 287411 - RNA, 63 nt, Human
agggcuccuccucaggcugcugccaacccaccuggaggccaccucccuccaggagaucccagg

SEQ ID NO: 287412 - RNA, 63 nt, Human
ccuucccacaugcugaagcgaggacuagaggcuggaggccaagcagcugagccaaagaagauc

SEQ ID NO: 287413 - RNA, 62 nt, Human
ggaagauuuucagguuuuaauaacgcagucauggaggccaagaacuugcaauaccaauguuc

SEQ ID NO: 287414 - RNA, 62 nt, Human
ggaagauuuucagguuuuaauaaagcagcuauggaggccaagaacaugccagaccaauauuc

SEQ ID NO: 287415 - RNA, 63 nt, Human
guggaggcucaugccuguaaucccagcacuuugggaggccaaggugggcggaucacgagguca

SEQ ID NO: 287416 - RNA, 63 nt, Human
gacaucaaccuccgccuuaagcuauguauguauggaggccagucgcagcuuuauuaugcagac

SEQ ID NO: 287417 - RNA, 63 nt, Human
acagugccucaugccuauaaucccagcacuuugggaggccaagguggguggaucacuugaguu

SEQ ID NO: 287418 - RNA, 53 nt, Human
ccaaagaaucguauauuuaggagggaggccauacgccaugccauagcuugugc

SEQ ID NO: 287419 - RNA, 63 nt, Human
gcagggccugcuuggaggaaggauuugugugucggaggccacuccgagggcaauucuguuagg

SEQ ID NO: 287420 - RNA, 63 nt, Human
guuccuucuuggucagagguagcugcagaggggggaggccaaggguuuggucuaagcugugcc

SEQ ID NO: 287421 - RNA, 63 nt, Human
gugggggcagcaggggccugggccauagcugggggaggccagacccugagggcuuugcagggc

SEQ ID NO: 287422 - RNA, 63 nt, Human
gugcuggcucacaucuguaaugccagcacuuugggaggccaagguggguggaucaccugaggg

SEQ ID NO: 287423 - RNA, 63 nt, Human
gcaguggcucaugccuauaaucuuagcacuuugggaggccaagguaggaggauugcuugaagc

SEQ ID NO: 287424 - RNA, 64 nt, Human
ucugcaggcccucaccccuuaacuuccucauacagacuggcacugggcagggccucucaugugg

SEQ ID NO: 287425 - RNA, 64 nt, Human
ggaacuagggccauuuuuauuacaaugaacucaggacuggcaacaaccauaugguuguuccauu

SEQ ID NO: 287426 - RNA, 64 nt, Human
cacaggauggggcaggcucuggcacagugccugggacuggcaggguggcugagcggcugucuug

SEQ ID NO: 287427 - RNA, 63 nt, Human
cggccuauccugauccuuggaggaggaggaagaggaggccacuguggcccguggcccugcccu

SEQ ID NO: 287428 - RNA, 63 nt, Human
gguagggcacaaagauggauguaaugcacuuugggaggccaaggcgggaggauugcuugagcc

SEQ ID NO: 287429 - RNA, 63 nt, Human
acgguggcuuacaccuguaacccuggcauuuugggaggccaaggugggcagauugccugagcu

SEQ ID NO: 287430 - RNA, 63 nt, Human
augguggcucaccccuguaaucccagcacuuugggaggccaaggcggguggaucaugagguca

SEQ ID NO: 287431 - RNA, 63 nt, Human
gaucagugggccuccaaggaggggcuguaaaauggaggccauugugugagccuaucagaguug

SEQ ID NO: 287432 - RNA, 63 nt, Human
gcgguggcucacgccuguaaucccagcacuuugggaggccaagguggggggaucacaagguca

SEQ ID NO: 287433 - RNA, 63 nt, Human
gcgguggcucaugccuauaaucccagcacuuugggaggccaaggugggcagaucaggagguca

SEQ ID NO: 287434 - RNA, 63 nt, Human
acaaacaugggugguaacaagaguuccaucccaggaggccaaacggugcaacagaaggguagg

SEQ ID NO: 287435 - RNA, 63 nt, Human
ggcaguggccucugugggcccuugucaagagcuggaggccacucccaagagccucuccuaugg

SEQ ID NO: 287436 - RNA, 63 nt, Human
ugcucucacccacggauaaaaccagaagcgacaggaggccagcuccugggguuccugggagcc

SEQ ID NO: 287437 - RNA, 63 nt, Human
ucacaauaaagccggggccgagcagcuggcaggggaggccaaucccucccuccccuccccagu

SEQ ID NO: 287438 - RNA, 62 nt, Human
gcaagucggacagcgaguagggcggggggcauggaggccaggucucaguccgcgcuaaacaa

SEQ ID NO: 287439 - RNA, 63 nt, Human
gugcuauuuaagccuguaaaucccagcacuuugggaggccagggcggguggaucacgauauaa

SEQ ID NO: 287440 - RNA, 63 nt, Human
auggucgcucaugccuguaaucccagcacuuugggaggccaaggcaggcagaucacuugaggu

SEQ ID NO: 287441 - RNA, 63 nt, Human
gugguaauguucaccugcagucccagcuacuugggaggccaaggcacgagaauugcuugaaca

SEQ ID NO: 287442 - RNA, 63 nt, Human
gaagcuagaggaauaaagcugugagcaaacagaggaggccagccucaccucauuccaacaccu

SEQ ID NO: 287443 - RNA, 64 nt, Human
cgggccuaccggguucguaguagucguacacggagacuggcagcgccgacguccugcccaccac

SEQ ID NO: 287444 - RNA, 64 nt, Human
uuuucauuuugugugacucccauggggaggaacagacuggcaggaagcacaccgggguuaacac

SEQ ID NO: 287445 - RNA, 64 nt, Human
cugcugcccaggggcuuccaguccugucuguguggacuggcaccugggcugcuggagaagucuc

SEQ ID NO: 287446 - RNA, 63 nt, Human
aauggagagaaaucauaacagacgguggcacaaggaggccaucuuuuccucaucgguuauugu

SEQ ID NO: 287447 - RNA, 63 nt, Human
gacaaugaccacuacccugggugugauaucacaggaggccagagagaggcaaaggcucaggcc

SEQ ID NO: 287448 - RNA, 63 nt, Human
gccccuugacacacgcccuccucaaauccuaggggaggccauucccaugagacugccugucac

SEQ ID NO: 287449 - RNA, 63 nt, Human
ggagcucacgcccagagacugggcugcucucccggaggccaaacccaagaaggucuggcaaag

SEQ ID NO: 287450 - RNA, 63 nt, Human
cgcaccaggccauccagcgugcagccuugccucggaggccagcccacccccagaagccaggaa

SEQ ID NO: 287451 - RNA, 63 nt, Human
acaguggcgcaugccuguaaucccagaacuuugggaggccaagacgggaugauugcuugagcu

SEQ ID NO: 287452 - RNA, 63 nt, Human
gugguggcgggcgccuauaauccuagcuacuagggaggccaaggugggagaucgcuuaaaccc

SEQ ID NO: 287453 - RNA, 63 nt, Human
gugguggcucacgccuauaaucccagcacuuugggaggccaaggcaggcagaucauuugagau

SEQ ID NO: 287454 - RNA, 63 nt, Human
cacccucccucaccuguuauaaaaaauucgcugggaggccaauaggcugaaauggcuccugca

SEQ ID NO: 287455 - RNA, 63 nt, Human
gcagugccucaugccuguaaucccagcacuuugggaggccaaggugggaggaucguuugagcc

SEQ ID NO: 287456 - RNA, 63 nt, Human
gugguggcucacacuuguaaucccagcacuuugggaggccaaggugggcggaucaugagguca

SEQ ID NO: 287457 - RNA, 63 nt, Human
gugacggugcacaccucuagucccagcuacucgggaggccaagacagaaggaucaccuugagg

SEQ ID NO: 287458 - RNA, 63 nt, Human
acgucuacaauucccaaaagaccucuuacuuugggaggccaaggugggugggucacuugaacc

SEQ ID NO: 287459 - RNA, 63 nt, Human
gacugcaugaaucuaccugaguugcuggcauugggaggccaguuacuggaaaggaauggaaaa

SEQ ID NO: 287460 - RNA, 63 nt, Human
aagggaggguaaagcagagagaauguauucacaggaggccauaaauuagcauugugccauguc

SEQ ID NO: 287461 - RNA, 63 nt, Human
ucccugucccugucuccaguuccucuccccucaggaggccaccucaggaaggauuuugacagg

SEQ ID NO: 287462 - RNA, 64 nt, Human
uagcagcccugguguauuuucgauauuucaggaagacuggcagauuggaccagacccugaauuc

SEQ ID NO: 287463 - RNA, 64 nt, Human
cacuuucugccagcaucugcagccagcaagcugggacuggcaggaaauaacccacaaaagaagc

SEQ ID NO: 287464 - RNA, 64 nt, Human
gucacacugcauugccgaaguccagcuuucugcagacuggcagucgcacacacauuuggaaugc

SEQ ID NO: 287465 - RNA, 63 nt, Human
cagugguaaacugugguuuccccaagcugcacaggaggccagaaaccacaaguaugaugacua

SEQ ID NO: 287466 - RNA, 63 nt, Human
caccuguaauccgacuguaagcucaucaccuugggaggccacuguaggaggaucaauugagcc

SEQ ID NO: 287467 - RNA, 63 nt, Human
gucguggcacacaccuguaaucccagcuauuugggaggccaaggcaggagaauugccugaacc

SEQ ID NO: 287468 - RNA, 50 nt, Human
aaugcugcaaaaagccaugaggaggccaagaagcugcuguggcugaugcg

SEQ ID NO: 287469 - RNA, 63 nt, Human
augguggcuuacgccuguaaucccagcacuuugggaggccaaggcgggcggaucaugagguca

SEQ ID NO: 287470 - RNA, 63 nt, Human
acucuggggagucggauucaggaaacacccccaggaggccaagccugaaaacagaggggaggg

SEQ ID NO: 287471 - RNA, 63 nt, Human
ccugccucacugguaagggaaaaccuuggcuugggaggccagcccuggcccuugaagggguug

SEQ ID NO: 287472 - RNA, 63 nt, Human
gcgguggcucacaccuguaaucccagcacuuugggaggccaaggcaggcggaucaccugaggu

SEQ ID NO: 287473 - RNA, 63 nt, Human
gcgguggcucacaccuguaaucccagcacuuugggaggccaauguggguggaucaugagguca

SEQ ID NO: 287474 - RNA, 63 nt, Human
gguggcucaugccuauaaaauuccagcacuuugggaggccaaggcaggaggaucacuugagcc

SEQ ID NO: 287475 - RNA, 63 nt, Human
aaaggagucaugugcauacauagaaucagugauggaggccaggcacgguaucucaugccuaua

SEQ ID NO: 287476 - RNA, 63 nt, Human
ugccuccagguaccaccccauccuccggcugcaggaggccaagccgcagagguccgcgagguc

SEQ ID NO: 287477 - RNA, 63 nt, Human
ucugaagguugcugucugucaugagugcaugaaggaggccaagaguuuaugcuaugggaggaa

SEQ ID NO: 287478 - RNA, 63 nt, Human
gagguggcucccgccuguaaucucagcacuuugggaggccaaggcaggcaaucaccugagggc

SEQ ID NO: 287479 - RNA, 63 nt, Human
gagccuuaaguuccacuagagccuccggcccagggaggccagaaucagcacaaucccggcccc

SEQ ID NO: 287480 - RNA, 63 nt, Human
guuuagagaaugagaaauggaacagugaggaauggaggccauauuuccaugacuucccuugua

SEQ ID NO: 287481 - RNA, 51 nt, Human
ugccgcggaagggggacugaggacuggcagagcugccggcgccggacccug

SEQ ID NO: 287482 - RNA, 64 nt, Human
ucucaccagaauucuggaucacccaagaggaaaagacuggcaguucuagauuccucuauauggg

SEQ ID NO: 287483 - RNA, 64 nt, Human
guggagaaaacagaggaaaacuugcaguuacgaagacuggcaacuuggcuuuacuaaguuuuca

SEQ ID NO: 287484 - RNA, 63 nt, Human
ggggcugccaggcucugcaggcacccaggguggggaggccacccuuccugcccuacccgcaga

SEQ ID NO: 287485 - RNA, 63 nt, Human
ccacguggagagaaguugcccuccaggccgacaggaggccaugcccaccgccccuggacaggc

SEQ ID NO: 287486 - RNA, 63 nt, Human
cccaaauuucaaggaauaauugagauuaaguauggaggccauucaaggcaaaaauguccuaaa

SEQ ID NO: 287487 - RNA, 63 nt, Human
agugugacccuugcauuggcaccccuccagccuggaggccaggcuuccagcaacuuccuucug

SEQ ID NO: 287488 - RNA, 63 nt, Human
gcgguggcucacaccuguaaucccagcacuuuuggaggccaagguggguggaucaccugaggu

SEQ ID NO: 287489 - RNA, 63 nt, Human
acaguggcucacgccuguaaucccaacacuuugggaggccaaggaggguggaucaccugaggu

SEQ ID NO: 287490 - RNA, 63 nt, Human
acgcagugaggcuggugcccaugcuccacacugggaggccaggcugaccccaccagccaguca

SEQ ID NO: 287491 - RNA, 63 nt, Human
gugguggcucaugccuauaaucccagcacuuugggaggccaaggcagguggaucaccugaggu

SEQ ID NO: 287492 - RNA, 63 nt, Human
ccaauggcucaugccuguaaucccaacacuuugggaggccaaggugggaggauggcuuguguc

SEQ ID NO: 287493 - RNA, 63 nt, Human
cucugggcugggcacaguggcucacacacuuugggaggccaagcgggggugcagaucaccuga

SEQ ID NO: 287494 - RNA, 63 nt, Human
ucaugaacuugguucgcagccugccuugccccuggaggccacgccaggcgcucaccccugagc

SEQ ID NO: 287495 - RNA, 63 nt, Human
gcgcaguauuuggauaaucagggucuccucccuggaggccagcucugccccaggggcugagcu

SEQ ID NO: 287496 - RNA, 63 nt, Human
acgguggcucacgccuauaaucccagcacuuagggaggccaaggcgggcagaucaccugaggu

SEQ ID NO: 287497 - RNA, 63 nt, Human
uccuggccagccugcccugcgguccugucaccuggaggccagccucacaugcccaaaucucca

SEQ ID NO: 287498 - RNA, 63 nt, Human
gggcugggcagaggcggucagccugggagucccggaggccaggcugcacaccuggugggagaa

SEQ ID NO: 287499 - RNA, 63 nt, Human
gaggcagcaaaggcugaccuaucaaagccucccggaggccaccgugcuggguaccaggacuca

SEQ ID NO: 287500 - RNA, 64 nt, Human
ugcuccuggcucaacccaaccaacaggacugacugacuggcaggacaaggucuggcauggcaca

SEQ ID NO: 287501 - RNA, 55 nt, Human
gcccgacagaggccuccugauccaggacuggcaggauugaucccaccuccaaguc

SEQ ID NO: 287502 - RNA, 64 nt, Human
uaguagcucugguguaguuucugcauuucaagaagacuggcagacaguuguuuuuauucuuccu

SEQ ID NO: 287503 - RNA, 63 nt, Human
guucuccuugcuuuaagccuugauaggagacggggaggccaacccuucucugcagaccgugau

SEQ ID NO: 287504 - RNA, 63 nt, Human
gcccuugcucugacugcggccaagcaccacgcaggaggccacucuugucucucagcagcuguu

SEQ ID NO: 287505 - RNA, 63 nt, Human
gcaguggcucacaccugugaucccagcacuuugggaggccaaggcagggggauuacuucagcc

SEQ ID NO: 287506 - RNA, 63 nt, Human
aucuggggcuucuccacuccugccccagaguguggaggccacaguggggccucuccguauuug

SEQ ID NO: 287507 - RNA, 63 nt, Human
auucuguuaaagcaucuucauaggugcuuggugggaggccaaggucgccgaauccucgugguu

SEQ ID NO: 287508 - RNA, 63 nt, Human
agugacagagguagaaaacaguaggcccucacaggaggccaccuucgcuagcagggaguggga

SEQ ID NO: 287509 - RNA, 63 nt, Human
cugccucucuucuucagcgccacaaaauuacauggaggccagcugguuuugugaggagauugu

SEQ ID NO: 287510 - RNA, 63 nt, Human
acugguagucauguggccccaccuggaugcagaggaggccaggaugugcagucuccacauagu

SEQ ID NO: 287511 - RNA, 63 nt, Human
gugaaagcaugaaaaagaggacacauggaaucuggaggccauuuagaugauuaguuaauuugu

SEQ ID NO: 287512 - RNA, 63 nt, Human
gcaguggcucacaccuguaaucccaacacuuugggaggccaagguggguggaucaucuaaggc

SEQ ID NO: 287513 - RNA, 63 nt, Human
cgguggcuaacaccuauaauucccagcacuuugggaggccaagaugggcaaaucacuugaguc

SEQ ID NO: 287514 - RNA, 63 nt, Human
ccuggugguggcccacaccuaucuucucaccuuggaggccacacccaacuuuccaaagacccu

SEQ ID NO: 287515 - RNA, 63 nt, Human
gcugcuccccucugcacggaccaugcgacacugggaggccagugagccacuccggccccgaau

SEQ ID NO: 287516 - RNA, 63 nt, Human
cauaaaauccaauauuguaauccuagcacuuugggaggccaaggcggguggaucacaagguca

SEQ ID NO: 287517 - RNA, 63 nt, Human
uagaguccacccgguguccugaaguccucggggggaggccagccccuggcucacuggcacagg

SEQ ID NO: 287518 - RNA, 63 nt, Human
gaggaggcugugaggcuggagggaccagauggaggaggccagcagcuagccauugcacacugg

SEQ ID NO: 287519 - RNA, 64 nt, Human
uagcagccgugaagucauuucuguauuucaggaagacuggcagacaguugcuuugauucuuccu

SEQ ID NO: 287520 - RNA, 64 nt, Human
gcacauaaaagaaaaauaauguuucggaguccaggacuggcaggacaggucaucagauacucag

SEQ ID NO: 287521 - RNA, 64 nt, Human
ugcagcucugcagaauguucagcaugccauuucugacuggcacaucucgugaaguuucauagaa

SEQ ID NO: 287522 - RNA, 63 nt, Human
cgagaaggaggcccagcaaguguauggugggaaggaggccaggacgugaguggggcuggggcu

SEQ ID NO: 287523 - RNA, 63 nt, Human
uagcuuccagaacccacccugccccucuaccugggaggccaaaugggugagugggcuggggcu

SEQ ID NO: 287524 - RNA, 63 nt, Human
augaccccuucccugagguggcugucuccaugaggaggccaacccuugccauugaccguggcc

SEQ ID NO: 287525 - RNA, 63 nt, Human
ggacccacgcuccaaggcugagaccaguucccuggaggccacccacccugugccccggcaggc

SEQ ID NO: 287526 - RNA, 63 nt, Human
gcugggagcccaugcaguagggcagaaggcagcggaggccaggucugucccggcuggagaaca

SEQ ID NO: 287527 - RNA, 63 nt, Human
uuggcugauugguggaaaguaggguggaccaaaggaggccacgugagcagucagcaccaguuc

SEQ ID NO: 287528 - RNA, 63 nt, Human
acaguggcucacgccuguaaucccagcacuuugggaggccaaagcagguggauuacccaaggc

SEQ ID NO: 287529 - RNA, 63 nt, Human
ggccaggaccccuccacaugcaccugcuaguggggaggccacacccacaagcgcugcgucgug

SEQ ID NO: 287530 - RNA, 63 nt, Human
uuggggccguuuguuaagcggcacucauuuugcggaggccaugcgggugcucaccacccccau

SEQ ID NO: 287531 - RNA, 63 nt, Human
gggguggcacaugccuguaaucccagcacuuugggaggccaaggcugguggaucaccugaggu

SEQ ID NO: 287532 - RNA, 63 nt, Human
gcaaugacucaugccuguaaucccagcacguugggaggccaagucgggcggaucacaagguca

SEQ ID NO: 287533 - RNA, 63 nt, Human
aagccaguaaagaauacuucuggcagcacuuugggaggccaaggcgggcggaucacgagguca

SEQ ID NO: 287534 - RNA, 63 nt, Human
ccagccaucaucucuuaacuacggaggcccgccggaggccacaccaucccuuaguuucuccuu

SEQ ID NO: 287535 - RNA, 63 nt, Human
aacagaccagaucuuuacucacaacucaugcuaggaggccaguccuagcaucaccuuauguug

SEQ ID NO: 287536 - RNA, 63 nt, Human; identical to SEQ ID NO: 287185

SEQ ID NO: 287537 - RNA, 63 nt, Human
ucugacgaugcugcagcgccuggagcagcugguggaggccaaguaacuggccaacaccugccu

SEQ ID NO: 287538 - RNA, 64 nt, Human
cgaagacuggcaacuuggcuuuacuaaguuuucagacuggcaggaagucaaaccuauuaggcug

SEQ ID NO: 287539 - RNA, 64 nt, Human
gggaaugucauggucuugcuuuacuaaguuuugagacuggcagguagugaaacucauuaggcug

SEQ ID NO: 287540 - RNA, 56 nt, Human
gaagccgcuuugaguccuagccaaaggacuggcaucgggggugcacuggcaagggc

SEQ ID NO: 287541 - RNA, 63 nt, Human
gcgguggcucauaccuguaaucccagcaguuggggaggccaaggugggaggauugcuugagcc

SEQ ID NO: 287542 - RNA, 63 nt, Human
gcagaguugagggagccgagcugagccacgcugggaggccagagccuuucucugccaucagcc

SEQ ID NO: 287543 - RNA, 63 nt, Human
guuuccuuucccugccucuuguccaauggagugggaggccaggugaguggagcagagguccug

SEQ ID NO: 287544 - RNA, 63 nt, Human
gcaguggcucacaccuauaaucccaacacuuugggaggccaggaguuuugagaccagccuggg

SEQ ID NO: 287545 - RNA, 63 nt, Human
agaugcugcuacgagugaccagugcuguguggaggaggccaagggcggccccugggaaaccgg

SEQ ID NO: 287546 - RNA, 50 nt, Human
uuuuccccauuuccagaugaggaggccacuguccagggccaugcaguggu

SEQ ID NO: 287547 - RNA, 63 nt, Human
acgguggcucaugccuguaaucccagcuacgcaggaggccaaggcaggagaaucacuugaacc

SEQ ID NO: 287548 - RNA, 63 nt, Human
gugguggcucacgccuguaaucccagcacuuugggaggccaaggugggcagaucaugagguca

SEQ ID NO: 287549 - RNA, 63 nt, Human
acaguggcucaugccuguaauccuaacacuuugggaggccaaggugggaagauugccugagcu

SEQ ID NO: 287550 - RNA, 63 nt, Human
acugcagagacugauggaaguuagagagguggaggaggccagcucgcuccaaaacccuugggg

SEQ ID NO: 287551 - RNA, 63 nt, Human
agcggcucaugugugcuggcugcauggugcuggggaggccacagccagcccuuccucugcacc

SEQ ID NO: 287552 - RNA, 63 nt, Human
auuuagauacuucauaaaauuaugaacagauauggaggccagagcucauuuggguaaacuuac

SEQ ID NO: 287553 - RNA, 63 nt, Human
ggccuggaacccuggaagggagggaggcccaugggaggccaagccugggggcugggggcgggu

SEQ ID NO: 287554 - RNA, 63 nt, Human
gggacugcucagcacucccuaaaaacacaccauggaggccacuggugacugcuggugggcagg

SEQ ID NO: 287555 - RNA, 63 nt, Human
agcucugcuggcaugagccacaguuucuugacuggaggccaucaacccucuugguugaggccu

SEQ ID NO: 287556 - RNA, 63 nt, Human
ccucccggccuggauccauggcugacucugccuggaggccauuugugccugccucugugcugc

SEQ ID NO: 287557 - RNA, 64 nt, Human
ggaguacaauggugcgaucucagcucagugcaaccuccgccacccggguucaggcaauucucuu

SEQ ID NO: 287558 - RNA, 64 nt, Human; identical to SEQ ID NO: 278539

SEQ ID NO: 287559 - RNA, 64 nt, Human
uccucggagccccgcgagguccggcccagcaacuucccggcauccgcgcucuagccugaacccu

SEQ ID NO: 287560 - RNA, 63 nt, Human
cugagugaugaagucaggaagcccuguggcucuggaggccacuugugguucauucuuuuccca

SEQ ID NO: 287561 - RNA, 63 nt, Human
uugccgcuucagcuugcugaggacugucuccaaggaggccaaauggaaaaggagaggcuacuu

SEQ ID NO: 287562 - RNA, 63 nt, Human
cugcuggucuaaaccaggcagccucucuugcuaggaggccacuucugcuguuacauaacuccu

SEQ ID NO: 287563 - RNA, 63 nt, Human
cuccagguggccgcuggucucccgcuguguucaggaggccacauauacagccccucccagcca

SEQ ID NO: 287564 - RNA, 63 nt, Human
ggauggggcugggggaugggccugagugagaggggaggccaagaguggccccaccuggcccuc

SEQ ID NO: 287565 - RNA, 63 nt, Human
ggccaagaguggccccaccuggcccucucugaaggaggccaccuccuaaaaggcccagagaga

SEQ ID NO: 287566 - RNA, 63 nt, Human
ucacggccaucuuguguugucacugcagaguuuggaggccaguuuuccacagccuaaacaggg

SEQ ID NO: 287567 - RNA, 63 nt, Human
augguggcucacgccuguaaucccagcacugugggaggccaagccaggcaaaucgcuugaggc

SEQ ID NO: 287568 - RNA, 63 nt, Human
caauuuguucugcauuaaugccacaguggggauggaggccaggccguggccagagcagauacg

SEQ ID NO: 287569 - RNA, 63 nt, Human
augguggcucaugccuguaaucccagcacuuugggaggccaggaguucgagaccagccuggcc

SEQ ID NO: 287570 - RNA, 63 nt, Human
aggcagaaaccuaucucagggagggaaggggauggaggccagagucucccagugggugaugcu

SEQ ID NO: 287571 - RNA, 63 nt, Human
ggcuaaggaaggagauagguggcuccuaaaagaggaggccaucuucucacccaccccuuccuc

SEQ ID NO: 287572 - RNA, 63 nt, Human
cacugccaccagccucaccgccugcgggcagggggaggccagcaggcccgggcccagcacccc

SEQ ID NO: 287573 - RNA, 63 nt, Human
ccagggcccugggcuggaccucaggacaggcauggaggccacaggggcccagcagcccacccu

SEQ ID NO: 287574 - RNA, 63 nt, Human
ggucgccggcgccuuuuucuuuuuagaugggaaggaggccaggaaagggucagcuuaaccauu

SEQ ID NO: 287575 - RNA, 63 nt, Human
cugcagcccuucccacagcuugcaaggaccaagggaggccagcagguggacagggggccucag

SEQ ID NO: 287576 - RNA, 64 nt, Human
caguugaccaagcugcuuaaaguagaaggaucaggacuggcaggggauaugagggccaguguag

SEQ ID NO: 287577 - RNA, 64 nt, Human
aacucuucccuggagcggcaguggucuucguguggacuggcaggaaaaugauuuuucaaaacgu

SEQ ID NO: 287578 - RNA, 64 nt, Human
gagccagauggccagucuccaggccugguccacggacuggcagggaccccaggcacaagagcug

SEQ ID NO: 287579 - RNA, 63 nt, Human
aagagcugccaggcagugucuuagaugugagacggaggccauggcgagaauccagcuuugacc

SEQ ID NO: 287580 - RNA, 63 nt, Human
ggggcccugcccuggcagggucauccugugcucggaggccaucucgggcacaggcccaccccg

SEQ ID NO: 287581 - RNA, 63 nt, Human
guuggcagaaaggauguuuugucccauuuccuuggaggccaccgggacagaccuggacacuag

SEQ ID NO: 287582 - RNA, 63 nt, Human
gcaguggcucaugccuguaaucucagcaauuugggaggccaaggaaggaggaaugcuugagcc

SEQ ID NO: 287583 - RNA, 63 nt, Human
gaguccgaaguggagaaaggcuggugggaacauggaggccaguguuggggagccuguggaggc

SEQ ID NO: 287584 - RNA, 63 nt, Human
ggugaagccgcgcuccccuggaagcgacccaggggaggccaaguugucagcuuuuugauccuc

SEQ ID NO: 287585 - RNA, 63 nt, Human
cacaguggcucaugcauguaauucuagcacuuuggaggccaaggcaggaggacugcuugagcc

SEQ ID NO: 287586 - RNA, 63 nt, Human
acgguagcuuaugccuguaaucucagcacuuugggaggccaaggcaggcagaucaugagguca

SEQ ID NO: 287587 - RNA, 63 nt, Human
guggugguucuugccuauagucccagugcuuugggaggccauagcaggaggauugcuugagcc

SEQ ID NO: 287588 - RNA, 63 nt, Human
ccugcagggcuggucagggugucuggggcaggaggaggccaacucacugaacuagugcagggu

SEQ ID NO: 287589 - RNA, 63 nt, Human
ggucugcaggcagggcugacucuaggugcccuuggaggccagccagugaccugaggaagcgug

SEQ ID NO: 287590 - RNA, 63 nt, Human
cuggccaugguugcugagcaugggcagaccaguggaggccacccuacuguguuaucugcgccu

SEQ ID NO: 287591 - RNA, 63 nt, Human
aaaggggcucaccccuauaaucccaggacuuugggaggccaaggcaggaggaucacuugaguc

SEQ ID NO: 287592 - RNA, 63 nt, Human
gcagccuucuccccaaccaggauguuggccuggggaggccacagcagggcugagggaacucug

SEQ ID NO: 287593 - RNA, 63 nt, Human
cccugggcagccucggacuaugacuggcuacggggaggccaccaccaggccccagcucuccac

SEQ ID NO: 287594 - RNA, 63 nt, Human
ucuuacuccuccucaaggagucuguaguggaaaggaggccacagaauaagcugcuuauucuga

SEQ ID NO: 287595 - RNA, 64 nt, Human
uucucuuugguguuacacagcccaagaggacugagacuggcacuuagcccaagaggucugagcc

SEQ ID NO: 287596 - RNA, 64 nt, Human
cuuccccaaccucagagccugacuguaaugaagagacuggcagcaccuccuggaacacaagccu

SEQ ID NO: 287597 - RNA, 64 nt, Human
acagauguggaauuuuauuuguuuaguuuuaaaagacuggcaaccaggucuaaggauuagaaaa

SEQ ID NO: 287598 - RNA, 63 nt, Human
uucgcuaaacuauaaaugcaguuguguccaguuggaggccaggguaccacaugucacaggcgg

SEQ ID NO: 287599 - RNA, 63 nt, Human
uccaaggcaacuccuucuuucaacguggcccagggaggccaaaagauuggacaccccugcaaa

SEQ ID NO: 287600 - RNA, 63 nt, Human
gagcaucucugcugagacaguccuuuugcucucggaggccagggaagaugguacuuagaggcu

SEQ ID NO: 287601 - RNA, 63 nt, Human
gugcuacugcacguaacacuccuccuuaggccuggaggccaagguguggguccccacgccuga

SEQ ID NO: 287602 - RNA, 63 nt, Human
cugucucaccucuaggcccucugcuggugcuguggaggccaagaccccauuaagccuaaaggu

SEQ ID NO: 287603 - RNA, 63 nt, Human
uggguggaggguggaagguccugugcaggacagggaggccaccaaaggggcugcugucuccug

SEQ ID NO: 287604 - RNA, 63 nt, Human
ucugcaagugcucagggaaauggccuucccgccggaggccagcuaucugccugacaggcugug

SEQ ID NO: 287605 - RNA, 63 nt, Human
ggguacacuggggaauguuagcaagacugggaaggaggccacauuccugucugcagcagccgc

SEQ ID NO: 287606 - RNA, 63 nt, Human
acaguggcucacgccuguaaucccagcacuuugggaggccaaggcggguggauuaccuccauc

SEQ ID NO: 287607 - RNA, 63 nt, Human
gccugggcaggggcagccaaggcugggaaaugaggaggccaugcacaggguggggcagcuuuc

SEQ ID NO: 287608 - RNA, 63 nt, Human
cugcaggcaaagcuggacaugugcccuggcccaggaggccauguugggcccucguuuccauug

SEQ ID NO: 287609 - RNA, 63 nt, Human
uguugccaauaccucagacuccagggaaagagaggaggccaucauucucacuguaccacuagg

SEQ ID NO: 287610 - RNA, 63 nt, Human
aucuguuugaaaacuauccaguaaaaagcugauggaggccaauuacauggcggguguauugac

SEQ ID NO: 287611 - RNA, 63 nt, Human
aaggugggaccuccugcagccuggaaagaggagggaggccaaggccauucccuaacucccucc

SEQ ID NO: 287612 - RNA, 63 nt, Human
ugacacacuccuagcagcugguaaaggggugcuggaggccauggaggagcucuagaaacauua

SEQ ID NO: 287613 - RNA, 63 nt, Human
ggcggucucacucccagggaccuuuuuggucauggaggccaucgggcucccaguuagacccug

SEQ ID NO: 287614 - RNA, 64 nt, Human
gcagaaccugcuguaacccucaguucaaaaaauggacuggcaaugugauuagcguuggaugcuu

SEQ ID NO: 287615 - RNA, 64 nt, Human
guuccugggggaugaagaaaccauaauuacuugagacuggcagcaguggguauaugguaaaagc

SEQ ID NO: 287616 - RNA, 64 nt, Human
uuaauuugaccgucuacuccaauccccgccaagagacuggcauagcuggacauccaacauacca

SEQ ID NO: 287617 - RNA, 63 nt, Human
acccgcaucccagcauugggccacccaucugagggaggccaaaaucaucacagaugcugcugu

SEQ ID NO: 287618 - RNA, 63 nt, Human
cuugggugcuuacaacaauuuuccucacagucuggaggccagaagucuaaaaucaaaguguca

SEQ ID NO: 287619 - RNA, 63 nt, Human
gugccaguccuccucaggagaaggggaagggaaggaggccacuuugagagggcugaagggagg

SEQ ID NO: 287620 - RNA, 63 nt, Human
agccagcagaagcaggguacccuuuggggagcaggaggccaauaaaaaguucagaguucauug

SEQ ID NO: 287621 - RNA, 63 nt, Human
agguccaaguaaaccgcuagcuuguugcaccguggaggccacaggagcagaaacauggaaugc

SEQ ID NO: 287622 - RNA, 63 nt, Human
ggccccgcaggcgaaagcacguuccagccaccaggaggccaccuauuguuucaaaauaaagac

SEQ ID NO: 287623 - RNA, 63 nt, Human
ggcgggaaaggauggaguguuuuaguucuugggggaggccaccccaaaccccagccccaacuc

SEQ ID NO: 287624 - RNA, 63 nt, Human
auccagggcaacguccaggccaaugugccagcuggaggccaggcccaggugcgugccuugucc

SEQ ID NO: 287625 - RNA, 63 nt, Human
gcaauggcucacgccugugaucccagcacuuugggaggccaaggcggguggaucacgagguca

SEQ ID NO: 287626 - RNA, 63 nt, Human
acgguggcucacgccuguaaucccagcacuuugggaggccaaggccagcggaucacuugaggu

SEQ ID NO: 287627 - RNA, 63 nt, Human
cugcaacuggaaagcgggggcgcccgccgacgaggaggccaccgugccaagccggcagagguc

SEQ ID NO: 287628 - RNA, 63 nt, Human
ggaaccucuggagagccacaggcacccccagcuggaggccagacuccucucuugugcuagcug

SEQ ID NO: 287629 - RNA, 63 nt, Human
aagcauagauuccccaaagugaggcucauggugggaggccacucaccuuccuagcugcugcuc

SEQ ID NO: 287630 - RNA, 63 nt, Human
guaccccguguucguguaccagccggccauccgggaggccaacgggaucguggagugcgggcc

SEQ ID NO: 287631 - RNA, 63 nt, Human
uacucucaaguucccccaaagccccaaagaguuggaggccaagggaaggggcagggaggggag

SEQ ID NO: 287632 - RNA, 63 nt, Human
ucugucuaggaaucaugugccaagcagagguugggaggccauuuguguuuauauauaagccaa

SEQ ID NO: 287633 - RNA, 64 nt, Human
agccaaauggugcucgcaauugugcuugcugcuggacuggcaagcuucauguuauguuuauuug

SEQ ID NO: 287634 - RNA, 64 nt, Human
uggccuugaagccuggaggacuguugggcauguagacuggcaccuugaagauucaccauuguuu

SEQ ID NO: 287635 - RNA, 64 nt, Human
aaucaucacuuauuucucugccaccugguuuuaggacuggcacucuauaaaugacgcugacuuu

SEQ ID NO: 287636 - RNA, 63 nt, Human
auauuuuuauucaccuguuccgugcuauauggaggaggccaaguccauuuagugacauuucuu

SEQ ID NO: 287637 - RNA, 63 nt, Human
cuuagcuggccaggagugcccuaaggguaagagggaggccacugaggucucuguugaacuggu

SEQ ID NO: 287638 - RNA, 63 nt, Human
acccccagaggggcgccuguggggagggaaccaggaggccacacugggggagcgugcagccag

SEQ ID NO: 287639 - RNA, 63 nt, Human
gggaccagcggcuuguucuagggauuuggaccuggaggccaagggcaauaggagagggucuga

SEQ ID NO: 287640 - RNA, 63 nt, Human
ucccucuuuucucccacacaucucacaucauggggaggccagagggggccacacgagagcucc

SEQ ID NO: 287641 - RNA, 63 nt, Human
acaguggcucacaccuguaauccuagcacuuugggaggccaaggcagguggaucaccugaggu

SEQ ID NO: 287642 - RNA, 63 nt, Human
caacuacugcugaguuugggugcacccuaagauggaggccagguagcaauggggccggccuca

SEQ ID NO: 287643 - RNA, 63 nt, Human
ugcugguaaauauuuacauucagccagggaagaggaggccagaggucgggccagcugccccau

SEQ ID NO: 287644 - RNA, 63 nt, Human
augguggcucaugccuguaaucccagcauuuugggaggccaaggcgggcggaucacuugaggu

SEQ ID NO: 287645 - RNA, 63 nt, Human
caguggcucacaccuuguaaucccagcacuuugggaggccaaggugggcggaucacccugagg

SEQ ID NO: 287646 - RNA, 63 nt, Human
gcgguggcucacgcauguaaucccagcacuuugggaggccaaggcagguggaucacgagguca

SEQ ID NO: 287647 - RNA, 63 nt, Human
uacacugaucuuucaagucugggagacagauaaggaggccaggugcaaggcagggaggcagag

SEQ ID NO: 287648 - RNA, 63 nt, Human
ggggugucucaugccuauaauuccagcacuuugggaggccaaggcaggcagaucacuuugagg

SEQ ID NO: 287649 - RNA, 63 nt, Human
auacagccuuggacuagcaauuuaugcuucuugggaggccagccuugacugacucaaagcaaa

SEQ ID NO: 287650 - RNA, 63 nt, Human
agcccagccacauuucagccgagguccaaggcaggaggccauuuacuugagacagauucucuc

SEQ ID NO: 287651 - RNA, 63 nt, Human
caguuugacaauucugagaguuguccugcaguuggaggccaccagagguaucugagcucccug

SEQ ID NO: 287652 - RNA, 64 nt, Human
uagcagccgugaugucauuucuguauuucaggaagacuggcagacaguugcuuucauucuuccu

SEQ ID NO: 287653 - RNA, 64 nt, Human
uagcagccgugaugucauuuuuguauuucaggaagacuggcagaaaguugcuuugauucuuccu

SEQ ID NO: 287654 - RNA, 64 nt, Human
agccgccacaggccggggccgcgcccgcgcccccucccggcaccgccgccgucgucucccggcc

SEQ ID NO: 287655 - RNA, 63 nt, Human
cuacuucaccaaacuggccucuauccauaccaaggaggccagccuggcccugagcugcuggau

SEQ ID NO: 287656 - RNA, 63 nt, Human
cuuauucuuuagcuuucuuaaucggugcuuuauggaggccaguguaacguuacaugacucguu

SEQ ID NO: 287657 - RNA, 63 nt, Human
ccuccagcccuggagaggagggcagggcugcggggaggccaggccgagccccuggaaccaucc

SEQ ID NO: 287658 - RNA, 63 nt, Human
cucccccgcacgcaugcauccacugcggccggaggaggccauggagcccgaguagcugccugg

SEQ ID NO: 287659 - RNA, 63 nt, Human
cuccagcuccuuccuuccuucccccaggaacacggaggccaccgagggggcugggccuaucag

SEQ ID NO: 287660 - RNA, 63 nt, Human
uggugcccggcauguaagccccgcccaccccacggaggccacagccacacagccacgcccccu

SEQ ID NO: 287661 - RNA, 63 nt, Human
ccuccccacacccgccccugugcucugcugucuggaggccacguggauguucaugagaugcau

SEQ ID NO: 287662 - RNA, 63 nt, Human
augguggcucaugccuguaauuccagcacuuugggaggccaaggcggguggaucaccugaggu

SEQ ID NO: 287663 - RNA, 63 nt, Human
ucugcauguaccacagccccccacgccccauagggaggccaagccccggaccaugcaccaggc

SEQ ID NO: 287664 - RNA, 63 nt, Human
ucgcugaauugaagagacaggacuggcaguuggggaggccacagcagcuagaauuuccagggg

SEQ ID NO: 287665 - RNA, 63 nt, Human
gugguggcuuacgccuguaaucccagcacuuugggaggccaaggugggcggaucacaagguca

SEQ ID NO: 287666 - RNA, 63 nt, Human
gcuguggcucaugccuguaaucccagcacuuugggaggccaaggcagguggaucaccugaggu

SEQ ID NO: 287667 - RNA, 63 nt, Human
ugcguguggggcagguguggagaagggcuuuaaggaggccaauuugcugcgcgggugaccugu

SEQ ID NO: 287668 - RNA, 63 nt, Human
gcgguggcucacgccugcagucccagcacuuugggaggccaaggcguguggaucaccugaggu

SEQ ID NO: 287669 - RNA, 63 nt, Human
ucaggaaagguuuucaaaguucugcccauuucuggaggccaccacuccugucucuuccucuuu

SEQ ID NO: 287670 - RNA, 63 nt, Human
uuauucucagaacuguuacuagacucaugacuuggaggccaaaccuuaaauccagagauagca

SEQ ID NO: 287671 - RNA, 64 nt, Human
cuaccucuugaauucaugacaacgauauguuggugacuggcaguggaagcccuugacacucuug

SEQ ID NO: 287672 - RNA, 64 nt, Human
caagggcggcuacugggaggccaaggagaagcaagacuggcauaugugccccaacaucuucuga

SEQ ID NO: 287673 - RNA, 64 nt, Human
ccccgucucaggcuuucagcaguaacagugagcugacuggcaaguucgauguuagcucccggga

SEQ ID NO: 287674 - RNA, 63 nt, Human
gcgguggcucaccccuguaaucccagcacuuugggaggccaaagcaggcggaucaccugaggu

SEQ ID NO: 287675 - RNA, 63 nt, Human
ggcaggcagaucucacccagcacuaggacaccaggaggccagggaaagcaucucuggcucacc

SEQ ID NO: 287676 - RNA, 63 nt, Human
cugagaucuaaauggggacaaggcagguggaggggaggccaguguacauguaaaugcccacag

SEQ ID NO: 287677 - RNA, 63 nt, Human
ggucucuaguucaauggccagucauagcagaagggaggccaagcaccaguccaucaccccucc

SEQ ID NO: 287678 - RNA, 63 nt, Human
acagugaugugcaguuauagucccagcuacuugggaggccaaggcaggaggauuacuugagcc

SEQ ID NO: 287679 - RNA, 63 nt, Human
augaauccugcagggccaaggucugggggugcuggaggccaugcucccuccaggcuugcgggg

SEQ ID NO: 287680 - RNA, 63 nt, Human
uagaauacccugaugagaaaagagaagaggaagggaggccauaucuacaacacagccucucgg

SEQ ID NO: 287681 - RNA, 63 nt, Human
gccgggcacgguggcucaugccuggaaucuuugggaggccacggaucacuugaggacaggggu

SEQ ID NO: 287682 - RNA, 63 nt, Human
ugaagagccccaaagcaggaagaagcuccggauggaggccagcuaagccacucggggcaggcc

SEQ ID NO: 287683 - RNA, 63 nt, Human
uguggggacccauuccuggagggaccaguucauggaggccaucaccgucagugcaggugagaa

SEQ ID NO: 287684 - RNA, 63 nt, Human
gugguggcucacgccuguaaucccagcacuuugggaggccauggcggguggaucacuugaggu

SEQ ID NO: 287685 - RNA, 63 nt, Human
gcgguggcucacgccuguaauuccaucauuuugggaggccacagugggcagauugcuugagcc

SEQ ID NO: 287686 - RNA, 63 nt, Human
cccccuggaggaggaguaccuagcacaguugcaggaggccaaggaguacuagugacgggguug

SEQ ID NO: 287687 - RNA, 63 nt, Human
ggaccugcccagcugcccgugugccuacccacuggaggccauggacagcccugugagccuaca

SEQ ID NO: 287688 - RNA, 63 nt, Human
ugugcagcuaaccccucccuccccacagccagaggaggccacagaccccucaggggaguuccg

SEQ ID NO: 287689 - RNA, 63 nt, Human
cugggucagugguccacaucccgggacgcagcaggaggccaggccggcgagcccuguggauga

SEQ ID NO: 287690 - RNA, 64 nt, Human
uggaucuggaguugagagccauggguuuggacaugacuggcacaaacagcugucauauguucau

SEQ ID NO: 287691 - RNA, 64 nt, Human
uauguggacagcaagagucguuuucgcggaagccgacuggcagccaggccugucgggccccccg

SEQ ID NO: 287692 - RNA, 64 nt, Human
uugagucuguggucccuggaggguggcuucuccugacuggcaggaugaccuuagccaagauauu

SEQ ID NO: 287693 - RNA, 63 nt, Human
acagucgcucaugccucuaaucccagcacgaugggaggccaagacaggcagaucacuugagcc

SEQ ID NO: 287694 - RNA, 63 nt, Human
cuguggguucugggcuccaggggagggagcuggggaggccaggguauaagaaaagcaucagaa

SEQ ID NO: 287695 - RNA, 63 nt, Human
ucccuugcgccucagcaguuugcagugggguaaggaggccaagcccauuuguguaaucaccca

SEQ ID NO: 287696 - RNA, 63 nt, Human
gcgguggcucaugccuguaaucccagcacuuugggaggccaagauggguggaucaccugaagu

SEQ ID NO: 287697 - RNA, 63 nt, Human
gccaagugcagggccuguaaucccagcauuuuaggaggccaagguuggaggaucauuugagcc

SEQ ID NO: 287698 - RNA, 63 nt, Human
gccuggggagcccacugaggggccagggaggaaggaggccacggagcgggaggcagcgcccca

SEQ ID NO: 287699 - RNA, 63 nt, Human
augccagguggagaaaucacagagagguaaaauggaggccagugccauuucagaggggaggcu

SEQ ID NO: 287700 - RNA, 63 nt, Human
caacacucccuucccaugacccaggcugggcaaggaggccacgugauguggagggcacauucc

SEQ ID NO: 287701 - RNA, 63 nt, Human
agucgggggcuggccuaggagauaucugagggaggaggccaccucuccaagggcuucugcacc

SEQ ID NO: 287702 - RNA, 63 nt, Human
gcgauggcucacgccuguaaucccggcacuuugggaggccaagguggguggaucacuugaggu

SEQ ID NO: 287703 - RNA, 63 nt, Human
uaaggagagaaugacaucgugcggcaggguccuggaggccacuugcgcggcugggccacagag

SEQ ID NO: 287704 - RNA, 63 nt, Human
acaguggcucaugccuguaauccuagcacuuugggaggccaaggcagaaagauagcuugaguc

SEQ ID NO: 287705 - RNA, 63 nt, Human
gagcagcuauggcugcauagcaaguaguaggcaggaggccaaagacuucugagaccuggggca

SEQ ID NO: 287706 - RNA, 63 nt, Human
gcaguggcucacgccuguaaucccagcaguuugggaggccaaggcaaguggaucaugugaggu

SEQ ID NO: 287707 - RNA, 63 nt, Human
gccguggcucacucuuguaaucccaaaacuuuaggaggccaaggugggaggaucgcuugagcc

SEQ ID NO: 287708 - RNA, 63 nt, Human
uguucagguacaccaaagaggaagaagagcuguggaggccacccucuacaaagcuuuauagaa

SEQ ID NO: 287709 - RNA, 64 nt, Human
uuuccuguguacacgugacagagugccuuuucgagacuggcagggacgaggacaaauauggaug

SEQ ID NO: 287710 - RNA, 64 nt, Human
agguuguggaauuuaugcuuggcccaccuuccaagacuggcacugcccaacagacaccgcugaa

SEQ ID NO: 287711 - RNA, 64 nt, Human
gggagguaguuucaaaggccacauaccucucugagacuggcagaucgcucacuguugugaauca

SEQ ID NO: 287712 - RNA, 63 nt, Human
ugguggcucaggucuguagucuuugggucuuugggaggccagggugggaggaucacuugagcu

SEQ ID NO: 287713 - RNA, 63 nt, Human
aggggggccagaguagcugauguaggaguacugggaggccagacggcacgaggucuccaaggc

SEQ ID NO: 287714 - RNA, 63 nt, Human
aaucuggugaggauaaugguggcuccagcgacaggaggccaacccuggagaccaagaacaggg

SEQ ID NO: 287715 - RNA, 63 nt, Human
gugguggcaagcgcccuuggguccagcuacucaggaggccaaggugggaggaucacuugagcc

SEQ ID NO: 287716 - RNA, 63 nt, Human
acgggggcucacgccugucaccccagagcuuugggaggccaaggugggaggaucgcuugagac

SEQ ID NO: 287717 - RNA, 63 nt, Human
ucucuacaaaaaaaaauuaaaaagggggcuuugggaggccaaggcgggcagaucaugagggca

SEQ ID NO: 287718 - RNA, 63 nt, Human
uuuaaaacuauuugagaugcacuuuuguacucaggaggccaaggcaggaggauugcuugagcc

SEQ ID NO: 287719 - RNA, 63 nt, Human
gcggugguucacgccuguaaucccagcacuuugggaggccaaggaggguggaucaccugaggu

SEQ ID NO: 287720 - RNA, 63 nt, Human
gccuggaccuccggcuucauuucaccccugcugggaggccagguucccaccucaccacccugg

SEQ ID NO: 287721 - RNA, 63 nt, Human
acugggggaggguccuugcaauuccagcgaaucggaggccaggccaggacguccuugcucccu

SEQ ID NO: 287722 - RNA, 63 nt, Human
gcaguggcucacgccuguaaucccagcacuuugggaggccaagguggguggaucaccugaggu

SEQ ID NO: 287723 - RNA, 63 nt, Human
gcucgaagcagccacugagccauaaugcgcaggggaggccagaagcucugugccuggucugua

SEQ ID NO: 287724 - RNA, 63 nt, Human
gcucugcaggguauuugaaccuguggaauuggaggaggccauuucacucccugaacccagccu

SEQ ID NO: 287725 - RNA, 63 nt, Human
gugcacaagcuccaagcucccaggcauuccccaggaggccagccuugaccauucuccaccugc

SEQ ID NO: 287726 - RNA, 63 nt, Human
cuucuggcugccuguaaccuugaggggcauucaggaggccagcguucccucaggcacuggggg

SEQ ID NO: 287727 - RNA, 63 nt, Human
cugugccucugccuccuaggacuuauuuucccaggaggccauuuacaaggggaucuggaugac

SEQ ID NO: 287728 - RNA, 64 nt, Human
cagguuaccugggguauaccuugaucccuagagugacuggcagaguaagagaaggggagagaua

SEQ ID NO: 287729 - RNA, 64 nt, Human
uaccaagugaccauaaaggcauggcauuuguugugacuggcacccaauguuugauuuuuuuuuu

SEQ ID NO: 287730 - RNA, 64 nt, Human
ggaaacaauaaaucucgcugaauugaagagacaggacuggcaguuggggaggccacagcagcua

SEQ ID NO: 287731 - RNA, 63 nt, Human
caggaggaacaaagagauugugguggugcuaaaggaggccauaagcuacacagaggccuuggg

SEQ ID NO: 287732 - RNA, 63 nt, Human
acaguggcucgcgccuguaaucccagcacuuugggaggccaaggcggacggaucacuugaggu

SEQ ID NO: 287733 - RNA, 63 nt, Human
gugguggcucaggccuguaauccuggcacuuugggaggccaaggugggaagaucgcuugaggc

SEQ ID NO: 287734 - RNA, 63 nt, Human
uccugagaggcaguggccucuugagugaacaggggaggccaguagaugccccagauccagagc

SEQ ID NO: 287735 - RNA, 63 nt, Human
gcacaaugccagaaguugggcagagagaggcagggaggccagugagggccagggagugagugu

SEQ ID NO: 287736 - RNA, 63 nt, Human
gugguggcuuaccccuguaaucccagcacuuugggaggccaaagcaggacgaucacuugagcc

SEQ ID NO: 287737 - RNA, 63 nt, Human
gaugugcugaggccuaaauguuagcaggugggaggaggccacagaacaauaaaaacaaccaaa

SEQ ID NO: 287738 - RNA, 63 nt, Human
uuguauaacacucugcuguguggcauggcagaaggaggccagcacgcagccccuccagcucca

SEQ ID NO: 287739 - RNA, 63 nt, Human
gugguggcucacgccuguaaccccagcacuuugggaggccaaggugggcagaucacgagguca

SEQ ID NO: 287740 - RNA, 63 nt, Human
acaguggcucccaccuauaauccuagcacuuugggaggccaacgcggguggauugcuugagcc

SEQ ID NO: 287741 - RNA, 63 nt, Human
agagcaggggcuucagccacagagacacacucaggaggccagaagccgacacucaagguguuc

SEQ ID NO: 287742 - RNA, 63 nt, Human
augguggcaggcgccuguaaucccagcuacucgggaggccaaggcaggagaauugcucgaacu

SEQ ID NO: 287743 - RNA, 63 nt, Human
acgguggcucacgccuguaaucccagcacuuugggaggccaagccagauggaucaugaagcca

SEQ ID NO: 287744 - RNA, 63 nt, Human
gaccuggccuucugcacggcccaaggagaaccuggaggccaccacuaaagcugaaugaccugu

SEQ ID NO: 287745 - RNA, 63 nt, Human
gaggcaccaagugucucaggcagcgaggaaauuggaggccauuuuucagucaauuucccuuuc

SEQ ID NO: 287746 - RNA, 63 nt, Human
augguggcucacgccuguaaucucagcacuuugggaggccaaggcaggugggucaccuggggu

SEQ ID NO: 287747 - RNA, 64 nt, Human
guuucucugauaauguccccaaucauaccagggagacuggcauugacgagaacucagguggagg

SEQ ID NO: 287748 - RNA, 64 nt, Human
agcaggcaguguggaggcagccauccccugugaugacuggcagcuaaggaggaccucggagugg

SEQ ID NO: 287749 - RNA, 64 nt, Human
uaaccaacaugucacaaacaagcagcauguaacagacuggcacaugugccagcugaauuuaaaa

SEQ ID NO: 287750 - RNA, 63 nt, Human
gcaguggcucacgccuauaaucccaacacuucgggaggccaaggugagaggauaacuugaaac

SEQ ID NO: 287751 - RNA, 63 nt, Human
gcaggcccaggcuggcaggcaucucggcuugcaggaggccaacugcugagaccucuucuccau

SEQ ID NO: 287752 - RNA, 63 nt, Human
agugcuuugggaagccgaagcaggaggaucacuggaggccaagaguuggagagcagacugggc

SEQ ID NO: 287753 - RNA, 63 nt, Human
acaggcuccugcucucuggccaagcccugggugggaggccaggcccccagcgggcagggucug

SEQ ID NO: 287754 - RNA, 63 nt, Human
gagucacuccaggaauaagacaaaaggagaggaggaggccaucaccucuggccucuuccaucg

SEQ ID NO: 287755 - RNA, 51 nt, Human
ccucgcacccccgaaauuaguggaggccacaguuguagcaggcgcuaggcc

SEQ ID NO: 287756 - RNA, 63 nt, Human
uugaaacuugagaagcagagcucgccaccuucuggaggccacugugaugaugagccaagcaau

SEQ ID NO: 287757 - RNA, 63 nt, Human
cagaugagcugaucuguaagucacucugccccaggaggccagaguaaaaagugcugcuugccc

SEQ ID NO: 287758 - RNA, 63 nt, Human
ggggugauuucugugacucugggcccacagcggggaggccaagaggggcccuguggacuuuca

SEQ ID NO: 287759 - RNA, 63 nt, Human
ggccaucgggagagcucugaccugcacaccgcgggaggccagggugcugacugucaagcaucc

SEQ ID NO: 287760 - RNA, 63 nt, Human
gaggguccccacagcccgugccccacgccgccuggaggccagaggggucaguggcccugcugu

SEQ ID NO: 287761 - RNA, 63 nt, Human
caguuggggguucgaguagaucucauggguacaggaggccagcagggaccaggccagucagcc

SEQ ID NO: 287762 - RNA, 63 nt, Human
cccagccucuagcuacccuguaucgaggcaaggggaggccaguaaaguuugccaagccugauc

SEQ ID NO: 287763 - RNA, 63 nt, Human
ugcuacacaucuugggcucacaagugaggcuguggaggccaggagguucaaguauggagggua

SEQ ID NO: 287764 - RNA, 63 nt, Human
gcgguggcucacgccuguaaucccagcacuuugggaggccaaggcgggcggaucaccugaggu

SEQ ID NO: 287765 - RNA, 63 nt, Human
augguggcucacaccuguaauuccagcacuuugggaggccaaggcaggcggaucacgagguca

SEQ ID NO: 287766 - RNA, 64 nt, Human
cuugagggaaagccaguucauuuaagaggaaauggacuggcauuuauggugaaagcuggcuguu

SEQ ID NO: 287767 - RNA, 64 nt, Human
uucugggggcucgucggggggacagcuccacucugacuggcacagucuuugcauggagacuuga

SEQ ID NO: 287768 - RNA, 64 nt, Human
ggagucacuggagaaaggggcugugcuggggccagacuggcacaaggcacucgugcccacacca

SEQ ID NO: 287769 - RNA, 63 nt, Human
uccuccaguccaacugauggcccagaugcagcaggaggccagaggacagagcagaggaucuuu

SEQ ID NO: 287770 - RNA, 63 nt, Human
ugauggccuugguugagcugauggacaagugaaggaggccauggggcugugcuguccuuccug

SEQ ID NO: 287771 - RNA, 63 nt, Human
uacaugccugucugucaauuucugguugggcugggaggccacacacacacacugacaugacag

SEQ ID NO: 287772 - RNA, 63 nt, Human
caaauaugucuuuaacuguacaucucaguggcuggaggccaugccuuuuaagcauguguaaaa

SEQ ID NO: 287773 - RNA, 63 nt, Human
uccuguuguugaaugguccuggccugcaggaugggaggccagaugccuucaggagcuggugga

SEQ ID NO: 287774 - RNA, 63 nt, Human
gagccugagccagggcaauggcccugccacccuggaggccaccucuucuaagagucccaucug

SEQ ID NO: 287775 - RNA, 63 nt, Human
cuccaguggaggcugagcugacccugggcugcuggaggccagacugggcuguaguuagcuuuu

SEQ ID NO: 287776 - RNA, 63 nt, Human
ucaguggcucaccccuguaaucccagcacuuugggaggccaaggcgggucgauuacuugaggu

SEQ ID NO: 287777 - RNA, 63 nt, Human
gagguggcucacaccuguaaucccagcacuuugggaggccaaggcggguggaucacaagguca

SEQ ID NO: 287778 - RNA, 63 nt, Human
uucuaccaccagggcaaggagcuggacugcaggggaggccacgugcagcuggcggacggcucu

SEQ ID NO: 287779 - RNA, 63 nt, Human
cucuccgcucauacaggaaugaagccuuagccaggaggccaggcucagcccugugccacucac

SEQ ID NO: 287780 - RNA, 63 nt, Human
cuggaagaaugauuggcugggaggccgcgggagggaggccaggaggcccggaccaguugggag

SEQ ID NO: 287781 - RNA, 63 nt, Human
acugggcccuggggcugcccucggcaaccguggggaggccauuugcugcccuggggcaucaug

SEQ ID NO: 287782 - RNA, 63 nt, Human
uugugugagugugacggggguugggguggggcgggaggccacgggggaggccgaggcaggggc

SEQ ID NO: 287783 - RNA, 63 nt, Human
ucagaguuguacccucagaaggacggguaagcaggaggccaggggguccccagggcugaggug

SEQ ID NO: 287784 - RNA, 63 nt, Human
ggccaugauucgcccaaagccagacagcaacggggaggccaagugcaggcuggcaccgccuuc

SEQ ID NO: 287785 - RNA, 64 nt, Human
uuucuuuucugaucagguuauuggugacuuacuggacuggcaccgccaggagaaaauucuccug

SEQ ID NO: 287786 - RNA, 64 nt, Human
aacucaacccagaaccauuggucagaauuggugggacuggcaucuucccucagacuugcaguug

SEQ ID NO: 287787 - RNA, 64 nt, Human
gcaaaggccucugacuuggacccuuuccacaccagacuggcagcacuucccccaggcagccagu

SEQ ID NO: 287788 - RNA, 63 nt, Human
acgguggcucacaccuguaaucccagcacuuugggaggccaaggcgggcggaucagcugaggu

SEQ ID NO: 287789 - RNA, 63 nt, Human
gguagcaaggccaagcugauggcugcuuguuuaggaggccaucaguuccuuccuguggagaag

SEQ ID NO: 287790 - RNA, 63 nt, Human
ucugguggcucaugccuguaauccagcacuuugggaggccaaggcggacagaccaccugaggu

SEQ ID NO: 287791 - RNA, 63 nt, Human
cugugugggugcugcgugacuggagagcuguguggaggccaugugugccccgugcagggauca

SEQ ID NO: 287792 - RNA, 63 nt, Human
caggccuugcugacucucugagcuggggaggugggaggccaggcgagccugacucuguugauc

SEQ ID NO: 287793 - RNA, 63 nt, Human
aggaggcagaggcaggagaccaagauggcagguggaggccaggcuuaccacaacggaagagac

SEQ ID NO: 287794 - RNA, 63 nt, Human
acagggugagccccaaaauugggguucagcgugggaggccacguggauucuuggcuuuguaca

SEQ ID NO: 287795 - RNA, 63 nt, Human
aucuuucccaagccuugccauuaucucugugagggaggccagguagccgagggaucaggaugc

SEQ ID NO: 287796 - RNA, 63 nt, Human
ugaugggcggugacccgguaaccgaggcggcaaggaggccagguagucccggcaccucucacu

SEQ ID NO: 287797 - RNA, 63 nt, Human
uuguucacuuuaccuucugccaaaugcagagagggaggccagugucagggucggaguggccug

SEQ ID NO: 287798 - RNA, 63 nt, Human
gugguggcucacgccuguaaucccagcacuuugggaggccaagguggguggaucacuugaggu

SEQ ID NO: 287799 - RNA, 63 nt, Human
aaaacaggaccugccuacggcugaacggagccaggaggccacgugucccagcccagcguccag

SEQ ID NO: 287800 - RNA, 63 nt, Human
acuggggaagggcugggcgcuuuuccuggaaagggaggccacagauucuuucccaugggggcu

SEQ ID NO: 287801 - RNA, 63 nt, Human
ccugggcugaacauggaccacgcaguugcgacaggaggccaggggaaaaaccccugcucacuu

SEQ ID NO: 287802 - RNA, 63 nt, Human
gcgguggcucacaccuguaaucccagcauuuugggaggccaagguggguggaucacuugaggc

SEQ ID NO: 287803 - RNA, 63 nt, Human
gcggccgcgguccugccacacaagcugggcggcggaggccacgcagccgggccuucuucucuc

SEQ ID NO: 287804 - RNA, 64 nt, Human
uaagagcucugaaagaagcgcucuguuagaugcagacuggcagcauccuccuugauaaaagcag

SEQ ID NO: 287805 - RNA, 64 nt, Human
aggagacagaaagccuccgcugggcuucauuccggacuggcagaagcauugccuggacugacca

SEQ ID NO: 287806 - RNA, 64 nt, Human
ggggcucgcuuuucugggacgguauuuauuaucagacuggcaagccuaacuccauagguuuaca

SEQ ID NO: 287807 - RNA, 63 nt, Human
uagcauggccugagguaugggguaugugcauguggaggccaggguaaggugaauggggaggcu

SEQ ID NO: 287808 - RNA, 63 nt, Human
gccgcugcucucugcaaaaagaaugggcaucccggaggccacgccuaucuucucucucugcuc

SEQ ID NO: 287809 - RNA, 63 nt, Human
gcgguggcucaugccuguaaucccagcacuuugggaggccaaggcggguggaucgcgagauca

SEQ ID NO: 287810 - RNA, 63 nt, Human; identical to SEQ ID NO: 287197

SEQ ID NO: 287811 - RNA, 63 nt, Human
ccucccuaucacuccauacuggggugggcuggaggaggccacaggccagcuauuguaaaagcu

SEQ ID NO: 287812 - RNA, 63 nt, Human
ccucgcugcuugccagccucaccugcuggggcuggaggccauggaucccucauaguauccaag

SEQ ID NO: 287813 - RNA, 63 nt, Human
augguggcucacgccugaaaucccagcacuuugggaggccaaggugggcggaucaugagguca

SEQ ID NO: 287814 - RNA, 63 nt, Human
cugaaaggcuggcaagugggagggagucaguggggaggccaggauagaacuagagcugguguc

SEQ ID NO: 287815 - RNA, 63 nt, Human
caccacggcucacaccuauaaucgagcacuuugggaggccaagacaggaggaucacuugaggc

SEQ ID NO: 287816 - RNA, 60 nt, Human
gugagaaaguugccaacuagaggcccagagggaggccaucucagucuguccacugugguu

SEQ ID NO: 287817 - RNA, 63 nt, Human
gcaaggggcauuuccucuccaacuuucuuccuuggaggccaaguucucacccuguccaacuau

SEQ ID NO: 287818 - RNA, 63 nt, Human
gucccggccaccuggggaagccgcgccugccaaggaggccaccagagggcagugcaggcuucu

SEQ ID NO: 287819 - RNA, 63 nt, Human
gucccccaugccugcuggguggcuggguccuguggaggccagcagcgguguggcccccgcccc

SEQ ID NO: 287820 - RNA, 63 nt, Human
ugugaccccacaguggggcuggaccagggcccuggaggccaauaaagagcuuucuggguagac

SEQ ID NO: 287821 - RNA, 63 nt, Human
agcuggccgcucaggcgacccucagcccggcggggaggccauggcaugccccgggcguucgcu

SEQ ID NO: 287822 - RNA, 63 nt, Human
aagccaggugaccccaggugggaggcuguguguggaggccauccuggaaggaaguuuagaccu

SEQ ID NO: 287823 - RNA, 64 nt, Human
uguuuccaagucccugcaaagaagcaccacucuagacuggcaagggccuccacaguguggaggu

SEQ ID NO: 287824 - RNA, 64 nt, Human
cuuuuucucugaaguggugugggaaguaccaggggacuggcagaagcccaggcccucucuacuu

SEQ ID NO: 287825 - RNA, 64 nt, Human
acaucuuagucuuaacaaguuacagauaaucucugacuggcauguuuucugcuucuagcuugga

SEQ ID NO: 287826 - RNA, 63 nt, Human
ucccggcggguggagacuuugggauggacuggaggaggccagcguccagcuggcggugcuccc

SEQ ID NO: 287827 - RNA, 63 nt, Human
gccaccccugccaggugaggggcauggcgggcaggaggccacaccaggccccccgcccugccc

SEQ ID NO: 287828 - RNA, 63 nt, Human
augguggcucacgcuuguaaucccaguacuuugggaggccaaggcagucugggcaauauagug

SEQ ID NO: 287829 - RNA, 63 nt, Human
ugcuuuggguggacggucuccuacauguucaguggaggccaccaggagcauccaugagcgggg

SEQ ID NO: 287830 - RNA, 63 nt, Human
ggguauuuccuaguaagcauacuuucuuaagacggaggccauuugguuccugggagaauaggc

SEQ ID NO: 287831 - RNA, 63 nt, Human
gcguuggcuuucgccuguaaucccaacacuuugggaggccaggacagaucacuugaggucagg

SEQ ID NO: 287832 - RNA, 63 nt, Human
gcaguggcucacgccuauaaucucagcacucugggaggccaagauggaggauugcuugaagcc

SEQ ID NO: 287833 - RNA, 63 nt, Human
acgguggcucaugccuguaaucccagcacuuugggaggccaagacgggcggaucuuuugaggu

SEQ ID NO: 287834 - RNA, 63 nt, Human
ccaagacgggcggaucuuuugaggucgggaguuggaggccagccuggccaaaauggcaaaacc

SEQ ID NO: 287835 - RNA, 63 nt, Human
cccugcaucuggggacacagcugccgugaccagggaggccagccugggagguccagaugccca

SEQ ID NO: 287836 - RNA, 63 nt, Human
gcccuuguccuguggguugagggggucugaccaggaggccaccuacagcaggaagugaggcug

SEQ ID NO: 287837 - RNA, 63 nt, Human
uuggggggccacccggggccuggaccuaugcagggaggccacgucccaccccaccucuuguuu

SEQ ID NO: 287838 - RNA, 63 nt, Human
gcugggguugucaccuggacagggggcagccguggaggccaccguuaccaacugaagcugggg

SEQ ID NO: 287839 - RNA, 63 nt, Human
gcaggauggcaggggcaaagggcucaagggugaggaggccagugggaccccacagaguugggg

SEQ ID NO: 287840 - RNA, 63 nt, Human
gcaguggcuuaugcuuguaaucccagcacuuugggaggccaaggcaggaggaucguuugaggc

SEQ ID NO: 287841 - RNA, 63 nt, Human
gcgcagcuguccccgauaccacgagcugcugcgggaggccaccgaggccgccgaguaccagga

SEQ ID NO: 287842 - RNA, 64 nt, Human
gcagagggucauacacagggcuggaccucacgcagacuggcauggccauggguccagaggauac

SEQ ID NO: 287843 - RNA, 64 nt, Human
acaugcugcccaugccaggagauccaacccaggggacuggcaacuauaacaucgaagacuuugc

SEQ ID NO: 287844 - RNA, 64 nt, Human
auauauauauauauauauauguauaauauauaaagacuggcacccugccucucugugcccaggc

SEQ ID NO: 287845 - RNA, 63 nt, Human
gcaguggaucacgccuguaaucccagcacauugggaggccaaggcacauaggucacuugaggu

SEQ ID NO: 287846 - RNA, 63 nt, Human
ggguucaagcgauuccucugccucagcacuuugggaggccaaggcaggcagauaacaaaguca

SEQ ID NO: 287847 - RNA, 63 nt, Human
cggguggccagccugucuguguggcugggcuggggaggccacgucugguaucugaaugcuauc

SEQ ID NO: 287848 - RNA, 63 nt, Human
gcgguggcucaugccuguaaucccagcacuuugggaggccaaggcagguggaucaccugaggu

SEQ ID NO: 287849 - RNA, 63 nt, Human
ucuggccgggcaugguguaauccuaacacuuugggaggccaaggcgggcggauugccugagcu

SEQ ID NO: 287850 - RNA, 63 nt, Human
accugaugcuuugggaggacaaggugguucauuggaggccaggaguuagagaucagccugggc

SEQ ID NO: 287851 - RNA, 63 nt, Human
ugggccugaccuucccgagcccgugggggugggggaggccagccaccuccuuccucugggacu

SEQ ID NO: 287852 - RNA, 63 nt, Human
cacgauggggggugcuccuggccuggaguggguggaggccagagacacugcucagcagcaccc

SEQ ID NO: 287853 - RNA, 63 nt, Human
cccccagggaagcuuaccccuccugugcuggguggaggccacgggacaccucaggugccaccc

SEQ ID NO: 287854 - RNA, 63 nt, Human
uccugggcccgcugcgcucagagggugcugguuggaggccagagcucggcagagucacccacc

SEQ ID NO: 287855 - RNA, 63 nt, Human
gugguggcucucgccuguaaucccagcacuuugggaggccaaggcaggcggaucaccugaggu

SEQ ID NO: 287856 - RNA, 63 nt, Human
gacagcacugcaaauaacccaucuuccgggaagggaggccaggaugccucaguguuaaaauga

SEQ ID NO: 287857 - RNA, 63 nt, Human
aagcgacuuuugugccgggacuuaaaaagauaaggaggccaggugugguggcucaugccugca

SEQ ID NO: 287858 - RNA, 63 nt, Human
acacaaaacucagcccagccaggcccccucccuggaggccagccccuccccgcagggggccag

SEQ ID NO: 287859 - RNA, 63 nt, Human
cgaggccgauggcccgggcagcgggggcggcgaggaggccauggccggggccuacgacgcgcc

SEQ ID NO: 287860 - RNA, 63 nt, Human
gggaaggggaguuggaacaaaugucuguucccuggaggccaguccagugcucagaccuuuaga

SEQ ID NO: 287861 - RNA, 64 nt, Human
cgacaucaguuuaaaggcacaauacuuaaucagugacuggcaacaacgauuaguuccaucauuu

SEQ ID NO: 287862 - RNA, 64 nt, Human
ugaauccaucugaccagcugcugguaucugccaggacuggcaguucugauuuaguuaggagaga

SEQ ID NO: 287863 - RNA, 64 nt, Human
aaaagccagucaagggcauuacauuuguuccugggacuggcagcugggccuccugggugccagu

SEQ ID NO: 287864 - RNA, 63 nt, Human
uccccacaccccagccaucgccgcccgcucccaggaggccagggcaggccugcgugggcugga

SEQ ID NO: 287865 - RNA, 63 nt, Human
uccaucauuucauuucacacccccgaagggaggggaggccaggaggggagcugcuccugccag

SEQ ID NO: 287866 - RNA, 63 nt, Human
acaguggcucacaccuguaaucccagcacuuugggaggccaagaugggcggaucacgagguca

SEQ ID NO: 287867 - RNA, 63 nt, Human
ccacccccgcacgccuguaaucccagcacuuggggaggccaaggcgggaggaucgcuugagcc

SEQ ID NO: 287868 - RNA, 63 nt, Human
ucuccaugagggucacgcccccugaggaccucaggaggccagcagaacccgcaggcuccugaa

SEQ ID NO: 287869 - RNA, 63 nt, Human
uuguuggcucaugccuauagucccagcacuuugggaggccaaggugcaaggcaggcagaucau

SEQ ID NO: 287870 - RNA, 63 nt, Human
gcgguggcucaugccuguaaucccagcacuuugggaggccauggcagguggaucaccugaggu

SEQ ID NO: 287871 - RNA, 63 nt, Human
aggguggcucacaccuguaaucccugcacuuugggaggccaaggugggaggaucaguugagcc

SEQ ID NO: 287872 - RNA, 63 nt, Human
ccugccuuggucccuugccugggaagagggcgaggaggccagugguggggacgcagagggucc

SEQ ID NO: 287873 - RNA, 63 nt, Human
acaguggcuuccgccuguaaucccaacauuuugggaggccaaggcgggaggacugcuugaggc

SEQ ID NO: 287874 - RNA, 63 nt, Human
cugaggcaggagaauugcuugaacuugggagguggaggccaagauuguaccacuguauuccag

SEQ ID NO: 287875 - RNA, 63 nt, Human
agccacgcggaugccgccucaagggucuucaggggaggccagaggagagcugcugggccccga

SEQ ID NO: 287876 - RNA, 63 nt, Human
acaguggcucacaccuguaaucucagcacuuugggaggccaaggcaggaagaucacuugagcc

SEQ ID NO: 287877 - RNA, 63 nt, Human
gugguuucucacaccuguaauuccagcacgguuggaggccaaggcacauaggucacuugaggu

SEQ ID NO: 287878 - RNA, 63 nt, Human
gcucuggcucaugccuguaaucccagcacuuugggaggccaaggugggcagaucaccugagau

SEQ ID NO: 287879 - RNA, 63 nt, Human
acgguggcucacaccuguaaucccaguacuuugggaggccaaggcaagcagaucaccugaagu

SEQ ID NO: 287880 - RNA, 64 nt, Human
cccaagggcugaggagugcgggugcacagcgcgggacuggcaggcagcuccaccugcugcccca

SEQ ID NO: 287881 - RNA, 64 nt, Human
agugaccuggugccugugggaaguggguucucaggacuggcauucuuggaauaaauucacucug

SEQ ID NO: 287882 - RNA, 64 nt, Human
agcgcuccauagacgccuuugugaacugaaaagagacuggcagagucccgagaagauggggccc

SEQ ID NO: 287883 - RNA, 63 nt, Human
gcaguggaucaugucuguaauccuagcacugugggaggccaaggcaggaggaucgcuugagcc

SEQ ID NO: 287884 - RNA, 63 nt, Human
ccuagaaacaccagcucagcauggcagcagugcggaggccaggaaacccugaucgccaguuuc

SEQ ID NO: 287885 - RNA, 63 nt, Human
guggugggucacacuuguaaucccacuacuuugggaggccaaggcaggaagauugcuugagcu

SEQ ID NO: 287886 - RNA, 63 nt, Human
caguguuuugggagacuaaggcaagaacauccuggaggccaggaguucgacacuguauaacag

SEQ ID NO: 287887 - RNA, 63 nt, Human
uacagguccagggaugagcugaugguugcuggaggaggccaguguagagccagugagagaacu

SEQ ID NO: 287888 - RNA, 63 nt, Human
ccagccauggaagagcagcuggaggguggauggggaggccagagggagcaaugaggggugguc

SEQ ID NO: 287889 - RNA, 63 nt, Human
gaaaacccgacaacauuucugccagguuuguuaggaggccacaugauacuuauucaaaaaaau

SEQ ID NO: 287890 - RNA, 63 nt, Human
aaaacuaaaucagauuguaaucccaguacuuugggaggccaaggcaggcugauugcuugaggu

SEQ ID NO: 287891 - RNA, 63 nt, Human
gacagcaucuuccccaggcagcggcucuguggaggaggccauacuccccuaguuggccacugg

SEQ ID NO: 287892 - RNA, 63 nt, Human
gugguggcucaugccuguaaucccagcacuuugggaggccaaggcaggcggaucacaagguca

SEQ ID NO: 287893 - RNA, 63 nt, Human
accacuagaucauccuuauaccgacggggaaacggaggccagagagggcgugggcgcuugcac

SEQ ID NO: 287894 - RNA, 63 nt, Human
ccgagacuggaguguguuccugaagagcagccaggaggccagcauggcuggagaggcaggcau

SEQ ID NO: 287895 - RNA, 63 nt, Human
uuucucauccucucugugccaccucuccacccaggaggccauguagcauaguggaaaaagucc

SEQ ID NO: 287896 - RNA, 63 nt, Human
uucuugagccagccaggcccugccaguggggaaggaggccaagcagugccugccuaugaaauu

SEQ ID NO: 287897 - RNA, 63 nt, Human
ccaccagcccagugcgcccugccgccgcgcuugggaggccaagcuuuaaacaucucugguucc

SEQ ID NO: 287898 - RNA, 63 nt, Human
uguccuggccccuuaccccgcugccugaagcccggaggccacgccuguuggggcugauucgga

SEQ ID NO: 287899 - RNA, 64 nt, Human
agaauuuauaacacaugagcccccaaaaagccgggacuggcagcuuuaagaagcaaaggaauuu

SEQ ID NO: 287900 - RNA, 64 nt, Human
aaggacaaaguccggugaccgcugcccagacacagacuggcaauaaacuccuacuaaaucccuc

SEQ ID NO: 287901 - RNA, 64 nt, Human
uggucagcacuccucaaugaaagacagaccuaaugacuggcauuugagaugcugcuggcauuuu

SEQ ID NO: 287902 - RNA, 63 nt, Human
ugcaggauggcuuugcggaaaggagauggguuuggaggccaacaaaccugcuugucaauauug

SEQ ID NO: 287903 - RNA, 63 nt, Human
cauucccguacucaguuguucuuuugucuaaucggaggccacugugcugaggcccugcagugu

SEQ ID NO: 287904 - RNA, 63 nt, Human
ggcacccauggauuguguugagugugcagacagggaggccaccccaauaggaauucgucucca

SEQ ID NO: 287905 - RNA, 63 nt, Human
agugugggugcaacagcuacagucucauugaugggaggccauggucguggcuguggccauggg

SEQ ID NO: 287906 - RNA, 63 nt, Human
ggaauccacacguggaccauugugggucccuugggaggccagcagccagacuacggaauccac

SEQ ID NO: 287907 - RNA, 63 nt, Human
agggccacggagaugagccuggacccuggagaaggaggccaggagccagccacuggcuggaca

SEQ ID NO: 287908 - RNA, 63 nt, Human
augguggcucaugccuauuaucccagcacuuugggaggccaagguggguggaucacuugaggu

SEQ ID NO: 287909 - RNA, 63 nt, Human
ugggugguccucaccaggucucugagcugggugggaggccauccuggcgaccacugcccauuc

SEQ ID NO: 287910 - RNA, 63 nt, Human
ggcagagggaguuccuacacacacuuuuucccuggaggccaaggucuagggguagaaagggga

SEQ ID NO: 287911 - RNA, 63 nt, Human
gcuguggcucacgccuguaaucccaggacuuugggaggccaaggcgggcagaucaccggaggu

SEQ ID NO: 287912 - RNA, 63 nt, Human
ccagccuucccuggcuagcccaaauggcacuaaggaggccacugagggaauccuccacguggc

SEQ ID NO: 287913 - RNA, 63 nt, Human
aaugugaaaaggcauugggagaagcagucugggggaggccagcccagugcgggcacagcacaa

SEQ ID NO: 287914 - RNA, 63 nt, Human
ggccugggccuagauggggcagccuggcucacaggaggccagccccuccuccuccgcccccuu

SEQ ID NO: 287915 - RNA, 63 nt, Human
cuggcaugguguuugucucguacaguugggauaggaggccauucauucccaugggcacagcua

SEQ ID NO: 287916 - RNA, 63 nt, Human
cuccugcguccccagaacccaagggaacgucauggaggccacauggggccacccggcucccuc

SEQ ID NO: 287917 - RNA, 63 nt, Human
gacgcagcugugaauggccggugauguaugucaggaggccacagggagcagaggagcggggca

SEQ ID NO: 287918 - RNA, 64 nt, Human
agguuaagacucaugucuaugacuuucacucuaagacuggcaaaaggacagcagucuucuaugu

SEQ ID NO: 287919 - RNA, 64 nt, Human
acagagagacacugucacccccuuucccccacaagacuggcagaggcugggcagccuggggcug

SEQ ID NO: 287920 - RNA, 64 nt, Human
ggaccgagcuggaaaaccuccuuuaccagaugcugacuggcacuggugguuuuugcucucgaca

SEQ ID NO: 287921 - RNA, 63 nt, Human
ccaaggcuccggaccacacuggcccccugcggcggaggccaacgcagggcaccaccaccacca

SEQ ID NO: 287922 - RNA, 63 nt, Human
cccagcacugugaugggaguccacggcuagggaggaggccaagcuggccccgcagcgccucuu

SEQ ID NO: 287923 - RNA, 63 nt, Human
ggauuuauuaugggaauuggcucucgcaauuauggaggccaagaagucccacagucuugcauu

SEQ ID NO: 287924 - RNA, 63 nt, Human
caguggcucaugccuauaaucucagcacuuuugggaggccaagacaggaggaucacuucaggc

SEQ ID NO: 287925 - RNA, 63 nt, Human
gcgguggcucacaccuguaaucucagcacuuugggaggccaaggcaggcagaucacuugaggu

SEQ ID NO: 287926 - RNA, 63 nt, Human
gaaggaccccaggcccuggggaggguggcugugggaggccaaguccacugcccggaagucuug

SEQ ID NO: 287927 - RNA, 63 nt, Human
agugauguggccgggccaaggacaggcagggagggaggccaggccucgcuugcaccgcgggac

SEQ ID NO: 287928 - RNA, 63 nt, Human
cccagggcugcccccgacaggcuggcucucaguggaggccagagaucuggaaucggggucagc

SEQ ID NO: 287929 - RNA, 63 nt, Human
ucaagagcaugcaaaacgucgcauugcagagcgggaggccaggagguaauucucaaaacccuu

SEQ ID NO: 287930 - RNA, 63 nt, Human
cauaaacaugauaucaucacacuucuugguguuggaggccacuggguaacaacagaagaaaac

SEQ ID NO: 287931 - RNA, 63 nt, Human
ucucuaacagggccagcugagcagcacaggccaggaggccacaguguaagcaauaacagaucu

SEQ ID NO: 287932 - RNA, 63 nt, Human
gcggugguucgugccuguaaucccagcucuuugggaggccaaggcagguagaucacaagguca

SEQ ID NO: 287933 - RNA, 63 nt, Human
gaagagaaggagggaccuucugcagagacuccgggaggccacccucaugcacauaacccugga

SEQ ID NO: 287934 - RNA, 63 nt, Human
gcgguggcgcaugccuguaaucccagcacuuugggaggccaaggugggugaaucaccugaagu

SEQ ID NO: 287935 - RNA, 63 nt, Human
gggcugaaucaaaugggagcccuccagacauaaggaggccagaggcugcaaggagcggggucg

SEQ ID NO: 287936 - RNA, 63 nt, Human
gccauggcucacaccuguaaucuuaacacugugggaggccaaggcaaggggaucacuugagcc

SEQ ID NO: 287937 - RNA, 64 nt, Human
gggaucagagcaggagcauccucugcugguuccugacuggcaaaggaccagcguccucguucaa

SEQ ID NO: 287938 - RNA, 64 nt, Human
auauuuagguuauuuguugagacucauugguacugacuggcaaguauucugcuuuaaaguauca

SEQ ID NO: 287939 - RNA, 64 nt, Human
ggcccagagcaccuugaaggagacccuugacugugacuggcaggcaggugaggggcacagcacc

SEQ ID NO: 287940 - RNA, 63 nt, Human
auguuaagagccucacaaggaaacuggguuauuggaggccaaggcggcuuacaguucucugcg

SEQ ID NO: 287941 - RNA, 63 nt, Human
guggcagcucaugacuguaaucccagcacuuugggaggccaaggugggaggaucaauugaggc

SEQ ID NO: 287942 - RNA, 63 nt, Human
gcggcggcucacgcauguaaucccagcacuuugggaggccaaggcgggcggaucacgagguca

SEQ ID NO: 287943 - RNA, 63 nt, Human
gcauccauguuuugugccugcccucccucuuggggaggccaugcuugacucugcugaaagcug

SEQ ID NO: 287944 - RNA, 63 nt, Human
ggagauggccuguguguacaagggcggcuacugggaggccaaggagaagcaagacuggcauau

SEQ ID NO: 287945 - RNA, 63 nt, Human
aagacgcuuccauggugggcacugaggcacagaggaggccaaggagagguuguuuguucaugc

SEQ ID NO: 287946 - RNA, 63 nt, Human
guaguggcucaugccuguaauccgagcacuuugggaggccaaggcgggcggaucacgagguca

SEQ ID NO: 287947 - RNA, 63 nt, Human
cgggaggaaaggcggaggcgagcccuggaggagggaggccacaacuccgagcugcccaccugg

SEQ ID NO: 287948 - RNA, 63 nt, Human
gcaguggcuuauaccuguaauuucagcacuuggggaggccaaggcaggaggcuugcuugaggc

SEQ ID NO: 287949 - RNA, 63 nt, Human
cgcgguggcucacgccuguaaucccagcacuuuggaggccaaggcggguggaucacgagguca

SEQ ID NO: 287950 - RNA, 63 nt, Human
ccgcauccccaugcccagccuuucgcgucaccuggaggccacaucuucccaccccaccugcca

SEQ ID NO: 287951 - RNA, 63 nt, Human
acucccaggcaggggugaggguggccuggcccaggaggccaggaaggagggcccugucugccu

SEQ ID NO: 287952 - RNA, 63 nt, Human
cuccugggggcccccaaggcuccccuccuguggggaggccaccuuuuaaggcaccacuagcag

SEQ ID NO: 287953 - RNA, 63 nt, Human
gguggagagcaccagcuagccccuuccagaaggggaggccacauuugcccggcccccuggagc

SEQ ID NO: 287954 - RNA, 63 nt, Human
gcaguggcacacggcuguaaucccagcacuuugggaggccaagguuggcagaucaccugaggu

SEQ ID NO: 287955 - RNA, 63 nt, Human
ggagcccagcugaucugcaguggcugacagcagggaggccaugugcucagccuggccacguug

SEQ ID NO: 287956 - RNA, 64 nt, Human
aggugaguguggauuggugaaaaucuguuuuuaugacuggcaaagcagugcaggggggucuuuc

SEQ ID NO: 287957 - RNA, 64 nt, Human
gcugaaacacaacagaagaaaaauggagugcugggacuggcagaggaaauuaauugaugaaaga

SEQ ID NO: 287958 - RNA, 64 nt, Human
ccuuggagaugagauagggaaggagcagggaugagacuggcaauggucacagggaaagaugugg

SEQ ID NO: 287959 - RNA, 63 nt, Human
guggccauggagacuccaccuggauccccuguaggaggccagggaggggaacucagcaguuca

SEQ ID NO: 287960 - RNA, 63 nt, Human
cccguggcucacaccuguaauccuagcacauugggaggccaaggcaggcacaucaccugaguu

SEQ ID NO: 287961 - RNA, 63 nt, Human
guggcccaggccgagggauggugccagcaggguggaggccaagucccaggcuuucaggugugu

SEQ ID NO: 287962 - RNA, 63 nt, Human
caaauacuaaaaagaagugcugccgcgcaguguggaggccacuguuuggaaauaaaucuuccu

SEQ ID NO: 287963 - RNA, 63 nt, Human
ugacggcaaccucugagccaucccagagccuggggaggccaggguagaggcugacggcgcaag

SEQ ID NO: 287964 - RNA, 63 nt, Human
cagggcacacggugcgcccgccgccagcuccucggaggccagacccagguaugcagguggggc

SEQ ID NO: 287965 - RNA, 63 nt, Human
cccacacuugccccgcccucccacaccugcuugggaggccagagaggccagacaagccgagag

SEQ ID NO: 287966 - RNA, 63 nt, Human
gcgguggcucacgccuguaaucccagcacuuugggaggccaagauggguggaucaccugaggu

SEQ ID NO: 287967 - RNA, 63 nt, Human
auguccaguggcuagagguggggugggaagagaggaggccaggccaggcccucaggaauuccc

SEQ ID NO: 287968 - RNA, 63 nt, Human
ccacuacuuaaguacuugucauguacucuuagaggaggccaguaaugaucagaaccauuuuac

SEQ ID NO: 287969 - RNA, 63 nt, Human
cccugcaggacuuccguggcugaggcugugaccggaggccaggaaugccguuggguggauugu

SEQ ID NO: 287970 - RNA, 63 nt, Human
cuccagccuggagggaaggggacaaagaccccaggaggccaaagggcugcagucaccccuugu

SEQ ID NO: 287971 - RNA, 63 nt, Human
ucugccaggagagggcuuguuccuccaacucuaggaggccaggcaagcauggacaggagccaa

SEQ ID NO: 287972 - RNA, 63 nt, Human
ucagagccuugcaugucaguaaacaggaaggaaggaggccaucuguucaaaaauugugacauu

SEQ ID NO: 287973 - RNA, 63 nt, Human
gagcagcgggcucacccaggcaccugucugccaggaggccacguguguccugcccacccaggg

SEQ ID NO: 287974 - RNA, 63 nt, Human
cuucuuuagcucuggaaagaauaaggcugccuuggaggccaucgagcgugccgcuuucuucgu

SEQ ID NO: 287975 - RNA, 64 nt, Human
uagaauagcugggacuacaggcacaugccaccaggacuggcaaacuguuuuauuuuuagguaga

SEQ ID NO: 287976 - RNA, 64 nt, Human
uucauagaccuaaauuaaaagugauuuuuggcuggacuggcaacaauguucccaaugucuuuac

SEQ ID NO: 287977 - RNA, 64 nt, Human
uugguaguauuucuuccagaagaagcuaaaauaagacuggcacuuacccugaagugcauuaaua

SEQ ID NO: 287978 - RNA, 63 nt, Human
cagcuuaaaguguccaggcaucacagaagcacaggaggccaguucugaaaggcgagcagaacu

SEQ ID NO: 287979 - RNA, 63 nt, Human
ccuagugguguugucgugagugccaccuaaccaggaggccagagcgguuugaaaacauccuga

SEQ ID NO: 287980 - RNA, 63 nt, Human
gggauguggaucagguuuacuagcaccugccagggaggccaucuggggcuccuucuccacccc

SEQ ID NO: 287981 - RNA, 63 nt, Human
agacaccuucaaagucuuauugacacaguaaagggaggccaaccacuacuaacaaguucuaga

SEQ ID NO: 287982 - RNA, 63 nt, Human
ucauuuucaacucugguuaggccuccuaccuggggaggccaggucacugcacugggagguccu

SEQ ID NO: 287983 - RNA, 63 nt, Human
aagagcuggggggcagagguaaagcccugcaggggaggccacaggguccaucccgucuucagg

SEQ ID NO: 287984 - RNA, 63 nt, Human
augguagcucaugcuuguaaucucaccacuuugggaggccaagaugggaggagugcuugaggu

SEQ ID NO: 287985 - RNA, 63 nt, Human
cccccggaaggcguggagacacccacggaccagggaggccaagcagccgagcgagagcagcag

SEQ ID NO: 287986 - RNA, 63 nt, Human
gcaggccuugcuauggaugcgcuuaaucaccauggaggccagcaauacccaucucagcauggc

SEQ ID NO: 287987 - RNA, 63 nt, Human
ggaggaggaggaggaggaggaggaggaggaggaggaggccagguccugguggagccuuugccc

SEQ ID NO: 287988 - RNA, 63 nt, Human
ugugguggcucaucccuauaauccuacacuuugggaggccaaggugggcggaucacuugagcu

SEQ ID NO: 287989 - RNA, 63 nt, Human
uaucuuggagagcuggggaccagcagucugccuggaggccagggagcaguggcugaguagcuc

SEQ ID NO: 287990 - RNA, 63 nt, Human
ccuuccuagccuugcacuuucagacucucucugggaggccauaaaauaaggagcauauguccu

SEQ ID NO: 287991 - RNA, 63 nt, Human
gcagugacuuacgccuguaaucucagcacuuugggaggccaaggcaggcagaucacgagguca

SEQ ID NO: 287992 - RNA, 63 nt, Human
augggagccgggcaaacuggccgcgggggcaggggaggccaucuggagagcccagaguccccc

SEQ ID NO: 287993 - RNA, 63 nt, Human
gccacagacgagcuccgagccaggucaggcuucggaggccacaagcucagccucaggcccagg

SEQ ID NO: 287994 - RNA, 64 nt, Human
ucccaaagauuaggucguuuuccaaagagccgcgucccggcaaguccggcggaauucaccagug

SEQ ID NO: 287995 - RNA, 64 nt, Human
gcagaguccagaccccacaacuucaggagcucuuucccggcagcagagaucugcaggcugccuc

SEQ ID NO: 287996 - RNA, 64 nt, Human
uuauuguugagguuuuuuuaucuccaagggacucucccggcacuucuaccuuccagaguuacuu

SEQ ID NO: 287997 - RNA, 63 nt, Human
gcgguggcucacgccuguaaucccagcacuuugggaggccaaggcaggaggaucgcuggagcc

SEQ ID NO: 287998 - RNA, 63 nt, Human
agcuagcacggccagugccaggaccgggccgagggaggccagaccaagggaggcacgcgcgcu

SEQ ID NO: 287999 - RNA, 63 nt, Human
agagugugucaugccugcaaucccagcacuuugggaggccaaggcaggcagaucaccugaggu

SEQ ID NO: 288000 - RNA, 63 nt, Human
cugcccuuuugacaucaaagaccugcugacaauggaggccacgccugcuucucccaucgccug

SEQ ID NO: 288001 - RNA, 63 nt, Human
caccccacagggagccuuggagcccugcguccaggaggccacugcacugcucacuuguggccc

SEQ ID NO: 288002 - RNA, 63 nt, Human
gcgguggcucacgccuguaaucccagcacuuugggaggccaaggcaggcggaucaccugaggu

SEQ ID NO: 288003 - RNA, 63 nt, Human
gagagacggaagaggagacacagacacaaagcaggaggccacauaaagacagaggcagagacu

SEQ ID NO: 288004 - RNA, 63 nt, Human
gugagccaagacuacgccacugcacuccagccuggaggccagagugagacuccgucucaaaac

SEQ ID NO: 288005 - RNA, 64 nt, Human
agugcaucagugaagagaugcaagacuuucaacugacuggcaaaaagcaagcuuuagcuugucu

SEQ ID NO: 288006 - RNA, 64 nt, Human
aaaguggauguguagccuucuggaaucugcacgugacuggcauuuuaaaacaacucauuaaaua

SEQ ID NO: 288007 - RNA, 64 nt, Human
aauaauugaagaaugggaaagagaaagagacagagacuggcauuuuccucucccgaaggagauc

SEQ ID NO: 288008 - RNA, 64 nt, Human
agaagagacguacaacuucugaaagaucucagaggacuggcauugucuggagacggcuuccugg

SEQ ID NO: 288009 - RNA, 64 nt, Human
gugaugucaucgggaaaugaucucccaagucgcugccagacaccacccacugcuucgccggaca

SEQ ID NO: 288010 - RNA, 64 nt, Human
cccaaaaguaggcccucccauuggcuuuggccaggccagacacuucacaucguuuacaugguuc

SEQ ID NO: 288011 - RNA, 64 nt, Human
cacuucucagcucuccccugcccugcagcccugggccagacaaggccagaagguuucaggggca

SEQ ID NO: 288012 - RNA, 64 nt, Human
cacacgacuauguagcacaugccgggagugaucugccagacauucuaauuugaaccagauaucu

SEQ ID NO: 288013 - RNA, 64 nt, Human
aagagaauccccuccaucuuugggagggguugaugccagacaucaccagguuguagaaguugac

SEQ ID NO: 288014 - RNA, 64 nt, Human
gcuauuguccaugcucccagaaucaagcauaaaugccagacacggcgauugagaagccaaucag

SEQ ID NO: 288015 - RNA, 64 nt, Human
cauauccccaccccuucccacggcgugucccacggccagacacaugcacacacaucacacccuc

SEQ ID NO: 288016 - RNA, 64 nt, Human
ccuccacaucucccaucccagaaucaggaucugggacuggcaggguccccuccugugucucauc

SEQ ID NO: 288017 - RNA, 64 nt, Human
cuguggaacagagcugagaccccggccccccuuggacuggcacaggguccuacagagucagagg

SEQ ID NO: 288018 - RNA, 64 nt, Human
gucacauuggauuagggugggccccaaauccaaugacuggcauccuuaggagaagagagaguuu

SEQ ID NO: 288019 - RNA, 64 nt, Human
aggaccaauugacucucacacugaaucagcugcugacuggcagggcuuugggcaguuggccagg

SEQ ID NO: 288020 - RNA, 64 nt, Human
gcuacucugaucccucugggggcucuggccaagggccagacagaccuucacagaugccuacuuu

SEQ ID NO: 288021 - RNA, 64 nt, Human
ccagcuuccuccagaccccuguggcagaccgggggccagacacagauacauggggaacugcaua

SEQ ID NO: 288022 - RNA, 64 nt, Human
ccuaacaaauauauauguuuaauguuuaucauaggccagacauugugcuaugugcauaucauau

SEQ ID NO: 288023 - RNA, 64 nt, Human
gucuguagcuccucaacucaccuaauguuuaugagccagacaaauggaggaauaugacggaaga

SEQ ID NO: 288024 - RNA, 64 nt, Human
auguggacucaguaugauaacugagaugggggacgccagacaugugaggacgcuguccuccgag

SEQ ID NO: 288025 - RNA, 64 nt, Human
gagaggccaaguucagagcucucugucucccccagccagacaccugcaucccuggcuccucuau

SEQ ID NO: 288026 - RNA, 64 nt, Human
uuccucucucggagcccucagacaucuccagugugccagacaaauaggagugaguguaugugug

SEQ ID NO: 288027 - RNA, 64 nt, Human
aagacuggaugcuggaucucauagaaaauucacagccagacaaucuucuaaucuggagucuuug

SEQ ID NO: 288028 - RNA, 64 nt, Human
ccacagugagggugggagcagcggaacagggaaugccagacacaggcucgcugcugcuggaagg

SEQ ID NO: 288029 - RNA, 64 nt, Human
cucaccaccuggugaccugcagaauccuaagcgagccagacaggaucccacauagcagcagcgg

SEQ ID NO: 288030 - RNA, 64 nt, Human
ucuggacccugagagcugaaugagggcaucauaggccagacaggcccaaggauggaugaaugga

SEQ ID NO: 288031 - RNA, 64 nt, Human
ucuggcccagggcgccuccucccgacugagcagagccagacagacauuccugaggggcccagaa

SEQ ID NO: 288032 - RNA, 64 nt, Human
auauggagcgggaccacuaugugccaggcccugugccagacacugcuuauauuguggugaauca

SEQ ID NO: 288033 - RNA, 64 nt, Human
aggagcccaggacaggccuuuucugugggcccuggccagacaggguuaccuggugaggugcaga

SEQ ID NO: 288034 - RNA, 64 nt, Human
aaagucuguuucauugggguuuuuguuuuguuuagccagacacccucaacagaauauuaggcuu

SEQ ID NO: 288035 - RNA, 64 nt, Human
ucuagacacuaugcuggguucccugagucgucaggccagacauuucaacaaggcuguggggagc

SEQ ID NO: 288036 - RNA, 64 nt, Human
ggggcccuccgagggugcccgagugcggcguggagacuggcaggcggggggggcgccuggagag

SEQ ID NO: 288037 - RNA, 64 nt, Human
ugaaugcccaggagcauuucuggggggcagcuaagacuggcagcuggguugguguguuagcggg

SEQ ID NO: 288038 - RNA, 64 nt, Human
gaagcacuucucagccaaggcaccccugcccugggacuggcagggcaggggcaggggcagggac

SEQ ID NO: 288039 - RNA, 64 nt, Human
caagcuuaguguacgaguguaagauacacuuuaagccagacaccuaauucuucaguucacugcc

SEQ ID NO: 288040 - RNA, 64 nt, Human
gggcuugcaaauacaagcuuggaggugagacauggccagacaugacuccugcuuccccuuagga

SEQ ID NO: 288041 - RNA, 64 nt, Human
ggaaguugcucugaaggggugguagaugcuggaagccagacacaacccugcguacgcugcucag

SEQ ID NO: 288042 - RNA, 64 nt, Human
acaggccaucagcagcuagagguggcuggcuuuggccagacauggacccuaaaucaacagacaa

SEQ ID NO: 288043 - RNA, 64 nt, Human
gaacuccaagucugugaggggagagguuuuacaagccagacaggccugggggacugcagucccc

SEQ ID NO: 288044 - RNA, 64 nt, Human
gcaagguacucugaguccccucuguagugccucugccagacacacacugccugaguugaagaga

SEQ ID NO: 288045 - RNA, 64 nt, Human
ccucaggugggcuggcuggcugacagaccuucuggccagacagacuccuaaccaaccagaugga

SEQ ID NO: 288046 - RNA, 64 nt, Human
uggccagacagacuccuaaccaaccagauggacugccagacaggcagacaucagccacauggaa

SEQ ID NO: 288047 - RNA, 64 nt, Human
aggaccuaucuaggcagaccccagccagacccccgccagacagacucccaaccagacugacccc

SEQ ID NO: 288048 - RNA, 64 nt, Human
cauucaacacauauucauagagcuccuucucugugccagacacuguucuggaagauagcuagau

SEQ ID NO: 288049 - RNA, 64 nt, Human
uucucuccuuaaaguugugaagaaauuguuaauugccagacagguaagaaaauguuuauaaucu

SEQ ID NO: 288050 - RNA, 64 nt, Human
acgaaccuugaaaacuuuaugcuaagugaaauaagccagacaucaacagauaaauaguuuauga

SEQ ID NO: 288051 - RNA, 64 nt, Human
agcgaaagugagauaaaugucaaagguguuucaagccagacauuuucacaauugugaagaaaua

SEQ ID NO: 288052 - RNA, 64 nt, Human
uggguacuucccuugaccccgagaucacucaggagccagacaggaaacuuauucuauuccuguu

SEQ ID NO: 288053 - RNA, 64 nt, Human
uuugcacuuaaaugaaaaccuuuucagugaugcagccagacagcuauugaccacugucucuuug

SEQ ID NO: 288054 - RNA, 64 nt, Human
aaguguccauucugcugaauucagguucaucauugccagacaaauguaguaagcuaguguuuca

SEQ ID NO: 288055 - RNA, 64 nt, Human
caaauucgcaacacaacaaucagauggcaccagggacuggcagcuccacugccgucaacuccug

SEQ ID NO: 288056 - RNA, 64 nt, Human
gccuguauuuuuuuaaaaugguacaccagaaaaggacuggcagucuacuucuaccauaguuaaa

SEQ ID NO: 288057 - RNA, 64 nt, Human
cucuggggaagggaaccagcccuccagagcaggagacuggcaagagcucuuugucucaccagcu

SEQ ID NO: 288058 - RNA, 64 nt, Human
agacuacccuagacaucugcaucuuuguaaguuagccagacaauaaagaaaagcagaaugauau

SEQ ID NO: 288059 - RNA, 64 nt, Human
uguacauuuauuuuuaaagaaaaagaaaacaaaagccagacaaacccaaguuguccaggcaaau

SEQ ID NO: 288060 - RNA, 64 nt, Human
aacacugccucugaguuuugaugcuguauuugcugccagacacugagcuucugagacaucccug

SEQ ID NO: 288061 - RNA, 64 nt, Human
ucuguccugucaccugccgcccagccccucuccugccagacagcccacgaccgggucgaccccc

SEQ ID NO: 288062 - RNA, 64 nt, Human
guuguaaccuacagcugauugguaagaacuaugggccagacauuuaaucucuccaucuaugaaa

SEQ ID NO: 288063 - RNA, 64 nt, Human
ugacucaccucucugggccucagguucuacaaaugccagacaccuagcgaagagcucugcaggc

SEQ ID NO: 288064 - RNA, 64 nt, Human
cugacgauggagugaagacacuuggcagacuugagccagacacuucaccuaguaguuccugaaa

SEQ ID NO: 288065 - RNA, 64 nt, Human
gggaaccaagcaggagacgacaggcgagagaggagccagacagacccugaaaagaaggacgggu

SEQ ID NO: 288066 - RNA, 64 nt, Human
ggauguucaugggccccaguuuccaguuucccuugccagacaagcccaucuucagcaguugcua

SEQ ID NO: 288067 - RNA, 64 nt, Human
ucuagccuacaacaugcugagcuacagcccagaagccagacaugccugucuuagcugaccuguu

SEQ ID NO: 288068 - RNA, 64 nt, Human
cauggugagggguugggcagggagguauauuugagccagacaggagugcuuuggaaauugagag

SEQ ID NO: 288069 - RNA, 64 nt, Human
uguggucaggaaaucagguccagccuucccuguagccagacaguuuaugagcccagagccuccu

SEQ ID NO: 288070 - RNA, 64 nt, Human
cuacaaaaaauaaaauaaaauaaaaaccaaauuagccagacaugguggcaugcgcuuguuuaaa

SEQ ID NO: 288071 - RNA, 64 nt, Human
cacaggcgggacuuucuucagagaguggugcagcgccagacauuuugcacauaaggcaccaaac

SEQ ID NO: 288072 - RNA, 64 nt, Human
acaucagcauguaaggugaauaauaacugguuuugccagacagcagguugucugaccuucaacc

SEQ ID NO: 288073 - RNA, 64 nt, Human
cacaagcacacacacacaguccucacacacggaggccagacacaggccgugggacccaggcucc

SEQ ID NO: 288074 - RNA, 64 nt, Human
gggaggagguggggcgaggcagccagagcccuuggacuggcacagggacccucgauggagcgaa

SEQ ID NO: 288075 - RNA, 64 nt, Human
aacuauaauccagcaucuuuuauugcauuggaaagacuggcaaagucuuuuggauggguuggga

SEQ ID NO: 288076 - RNA, 64 nt, Human
aucacccuugcuccuccugggugccuggaagauggacuggcagagaccucuuuguugcguuuug

SEQ ID NO: 288077 - RNA, 64 nt, Human
gauuugguuaaugacuuaugagcaagcugguuuggccagacaguauacccaaacuuuuauauaa

SEQ ID NO: 288078 - RNA, 64 nt, Human
gguuugagccuugauuagacuuuugaugugcuaagccagacaggcagucuguacauugauggcc

SEQ ID NO: 288079 - RNA, 64 nt, Human
ccuguggucgugagaacagugagucugaccaauggccagacacaugccugcaacuuguagguca

SEQ ID NO: 288080 - RNA, 64 nt, Human
cuuuuccaggcagcuucaugaugugcaggcaguagccagacagggucaugggaagggggcccug

SEQ ID NO: 288081 - RNA, 64 nt, Human
cccuucuucuugacccauguucucaauacccacugccagacaugccacguguccccagagcuuu

SEQ ID NO: 288082 - RNA, 64 nt, Human
agauuuuccucuuaguuguuugaaauaauacuuugccagacaggaagucuuuagacugcccaca

SEQ ID NO: 288083 - RNA, 64 nt, Human
cucucccuuccaggaaugcugggcccccagccuggccagacaagaagacugucaggaagggucg

SEQ ID NO: 288084 - RNA, 64 nt, Human
auggcccccagacugacucugcaccuggcccuuugccagacagcucugucuccccauguccucu

SEQ ID NO: 288085 - RNA, 64 nt, Human
agccccgucaaccgcugcuccgucccuuuccccagccagacacucauucccauugaccaucugg

SEQ ID NO: 288086 - RNA, 64 nt, Human
gaacguaugagagggaaaggcaaagaaaaaggaagccagacacuaggagaauuauuaacuucuc

SEQ ID NO: 288087 - RNA, 64 nt, Human
auaaaccuugaaaacacuaugcuaagugaaauaagccagacacaaaaggccaaauaugaugcca

SEQ ID NO: 288088 - RNA, 64 nt, Human
auaagauggcccauuuuggaccggaacugucauugccagacagaauuguaccuuuagcacauuc

SEQ ID NO: 288089 - RNA, 64 nt, Human
gggccuugguggaauuuuuggcucugguguuuucgccagacaauaaacuuacacuggaagcuuu

SEQ ID NO: 288090 - RNA, 64 nt, Human
cggcaccguaucugcagugggcacgggggggccggccagacaggcagacugggaggauggagga

SEQ ID NO: 288091 - RNA, 64 nt, Human
cuuucagccaugcugaugaccacaccccguccaggccagacaccaccccccaccccacugucgu

SEQ ID NO: 288092 - RNA, 64 nt, Human
auugccagguugucugauauuucuuucagacuucgccagacagauugcugauaauaaauuaggu

SEQ ID NO: 288093 - RNA, 64 nt, Human
acugcugagccuccugggacagcgggcuggcagggacuggcaggaggcaggugcagggaggccu

SEQ ID NO: 288094 - RNA, 64 nt, Human
ggcaacuuugccuggauguauuaccacaugggcagacuggcagaagcccagacuuaccuggaca

SEQ ID NO: 288095 - RNA, 64 nt, Human
ucuuuuacuaauuaguuggucaguuuggagaguugacuggcaccauggaggguaggcagguggg

SEQ ID NO: 288096 - RNA, 64 nt, Human
aucuccuccaaucucuguagcccaagaugugaaagccagacaagaacacgcguguguguauaua

SEQ ID NO: 288097 - RNA, 64 nt, Human
uugacucuacugaucugaccauuucccucucaucgccagacaacugacgauuucccugguuuua

SEQ ID NO: 288098 - RNA, 64 nt, Human
gacugugccacugcaguccagccugggugacagagccagacacugucucggggaaaaaaaaaaa

SEQ ID NO: 288099 - RNA, 64 nt, Human
agcacacuguagcauuacagugggugccccccuugccagacauguggugggacagggacccacu

SEQ ID NO: 288100 - RNA, 64 nt, Human
agguuggccuuaguagucaaaaacaaagcugauagccagacacguucugauuucugcccuuguu

SEQ ID NO: 288101 - RNA, 64 nt, Human
augauaccucaauugacaaucuuccucccaccaagccagacacguuguaaaugcugcuuccuau

SEQ ID NO: 288102 - RNA, 64 nt, Human
uggagacggcaggcuuaggucucacugacagcaugccagacacaacugaaucgaagcaggccug

SEQ ID NO: 288103 - RNA, 64 nt, Human
ucaacucaucagcucuuccucaaggcaaccugaggccagacaccaagaaaccaagcguaucugc

SEQ ID NO: 288104 - RNA, 64 nt, Human
gcccagccagcuggccagccuccacucccacucugccagacacccugacacccacccaggcuuu

SEQ ID NO: 288105 - RNA, 64 nt, Human
aagcuguagggacucaucuugcauggcaccgccggccagacacugcccaaggaccaguauuugu

SEQ ID NO: 288106 - RNA, 64 nt, Human
uucacuaauguuagccuuauuuaggacaaagucagccagacaccuuguacugggcacgcgucag

SEQ ID NO: 288107 - RNA, 64 nt, Human
caagccauggugacacacagcagcacugcagauagccagacacauggcuauccuagagaggcug

SEQ ID NO: 288108 - RNA, 64 nt, Human
ccccaucuccuggacaccuggccauuguugugaagccagacagugaccucaaauguugccuugg

SEQ ID NO: 288109 - RNA, 64 nt, Human
aaaaauacaaacagaucgugugaucauucaaggagccagacaugagguccugcacgaggguguu

SEQ ID NO: 288110 - RNA, 64 nt, Human
guucaccugauggcauucggagugagcugguggagccagacagagcaggugcggggaagggaag

SEQ ID NO: 288111 - RNA, 64 nt, Human
uuucuaauuuauaacuccuagggguuauuucugugccagacacauuccaccucuccaguauugc

SEQ ID NO: 288112 - RNA, 64 nt, Human
gcugcaacccuauggccucuuggagacagaugaugacuggcaaggacuagagagcaggagugcc

SEQ ID NO: 288113 - RNA, 64 nt, Human
agcucccugccagugcagugacucugcagggaaagacuggcaaggaggcucaggugcuuccauc

SEQ ID NO: 288114 - RNA, 64 nt, Human
ccacccccaccccccacucugcuuucccaagcuugacuggcauauaccuaggccugugugugug

SEQ ID NO: 288115 - RNA, 64 nt, Human
aaggacgggcagcuaugguagaugugggcaggaagccagacacagagcggguggcuguggcuuc

SEQ ID NO: 288116 - RNA, 64 nt, Human
ugccccaaagugccaagccauuugugaaggcucugccagacaccuccaagcuugagagcucagc

SEQ ID NO: 288117 - RNA, 64 nt, Human
aggcaaccugaccagaaacacuucgcugcugcaagccagacaggaaaaagauuccaugucagau

SEQ ID NO: 288118 - RNA, 64 nt, Human
ccauagaguauaguggauaaucacugggacuagagccagacagccugggcugagaugcuggauc

SEQ ID NO: 288119 - RNA, 64 nt, Human
cucucugcaacuccuguuugcaagcgcugggccugccagacagaggccccucuuguggugcaag

SEQ ID NO: 288120 - RNA, 64 nt, Human
aauucacccaguuuagugggugguaggguacguggccagacacagucacccaguuuuuguucau

SEQ ID NO: 288121 - RNA, 64 nt, Human
auuuuguuuuauuucugcuguauaaaaaccaagagccagacaauuagacaacuauggaggaaug

SEQ ID NO: 288122 - RNA, 64 nt, Human
auuaaaauucucaccuuucacagacagacaauaagccagacaacacaaucaaagcucaauagau

SEQ ID NO: 288123 - RNA, 64 nt, Human
uuucuuugcucagauugagaacugcagcauuuaugccagacauggacagaggaaugccuguggu

SEQ ID NO: 288124 - RNA, 64 nt, Human
uuguuauuaugcucuuaaugauuuacagacugaugccagacaaaccuugggaagauguaucaau

SEQ ID NO: 288125 - RNA, 64 nt, Human
agagaaaagauguuuguuuacauaagagaaagaggccagacauggugucucacacguuuaaucc

SEQ ID NO: 288126 - RNA, 64 nt, Human
ggaaccaugaaacagaaacagcaagauggaggcagccagacaccaaacugggaacucagacacc

SEQ ID NO: 288127 - RNA, 64 nt, Human
ggcagaggggccuucaccgccaccagggugucccgccagacagggagagacuccagccuucuga

SEQ ID NO: 288128 - RNA, 64 nt, Human
cccuuguggagucagcaggagcugguguuuuucagccagacagaggcauaauaaagugacugau

SEQ ID NO: 288129 - RNA, 64 nt, Human
cccuuuggaaaauuaaccuacugggaggguucuugccagacagaacuacaguuccauugucucg

SEQ ID NO: 288130 - RNA, 64 nt, Human
cgaaacccuaucucuacaaaaaauacaaaaauuagccagacaugguggcacaugccuuuagucc

SEQ ID NO: 288131 - RNA, 64 nt, Human
ucagaaggugguuugacagcaucauaaacaggcugacuggcaggaaugaaaacaagaacauacu

SEQ ID NO: 288132 - RNA, 64 nt, Human
aucuguugaguucugugagcuacugaccuccugagacuggcacuguguaaguuuuaguugccua

SEQ ID NO: 288133 - RNA, 64 nt, Human
ccuuaguaaucauggggcaugauuauagagguuugacuggcaaauucacuuuuuacucauuuau

SEQ ID NO: 288134 - RNA, 64 nt, Human
cuucccgccccacacucaacuguugugugaaugagccagacacauugcuuaaccugaguccgag

SEQ ID NO: 288135 - RNA, 64 nt, Human
uguugaugguuaggcuaaccugcccuggcccaaagccagacauguacaagggcuuucugugagc

SEQ ID NO: 288136 - RNA, 64 nt, Human
cuguuagaauucuuuuauuuagggccuuuucugugccagacauugcucucagugcuuugcaugu

SEQ ID NO: 288137 - RNA, 64 nt, Human
acaggccacgacagacgcuggaugcccuccuaccgccagacaccuccccagaggccuuggaccu

SEQ ID NO: 288138 - RNA, 64 nt, Human
uguagacuaacucucggcugcugccccagcccgcgccagacagcccacggauccguucucagcg

SEQ ID NO: 288139 - RNA, 64 nt, Human
ugcaugucauuauuacaucaaagcauauauauuggccagacacaaacaguugaugaugucauuc

SEQ ID NO: 288140 - RNA, 64 nt, Human
ucuguccugcaccccucagggauggcgacagcaggccagacacagucugaugccagcugggagu

SEQ ID NO: 288141 - RNA, 64 nt, Human
gagaugacuuugaucauugguaacuugggccugggccagacaaaguauaaaacuuacaaaagaa

SEQ ID NO: 288142 - RNA, 64 nt, Human
aucaucaucgucuauaaacuagcuuuaggauagugccagacaaacauaugauaucaugguguaa

SEQ ID NO: 288143 - RNA, 64 nt, Human
auauauguauauauuuauuauuuucauauaauuugccagacagagaucagaauugaaccgucaa

SEQ ID NO: 288144 - RNA, 64 nt, Human
aaaacaggaaacuucuuaagugacaaauuuuaaugccagacauuuaaggagaggauuauuguug

SEQ ID NO: 288145 - RNA, 64 nt, Human
ucagaagaggcccagcguccaccucucucccagggccagacagcccuuccuggcucccccaucc

SEQ ID NO: 288146 - RNA, 64 nt, Human
ugguugagaguuagagaacuuuuaaauuucuuuagccagacaggucucuauuuuuuuaaguuau

SEQ ID NO: 288147 - RNA, 64 nt, Human
auuaaaccugccccuaucacuagugcaugcuguggccagacagaugacaccuuuuguuauguug

SEQ ID NO: 288148 - RNA, 64 nt, Human
ccacagaucaagaaagcauuugaucugacccagugccagacacaggggauuuaaggcauguuca

SEQ ID NO: 288149 - RNA, 64 nt, Human
gagaagagcagcccugagccccuguauucugcuggccagacacacauggcacagacacagcuga

SEQ ID NO: 288150 - RNA, 64 nt, Human
gaucuuaauaacagauguugaaagaaggagucaagacuggcaauuggcuggauuaagcuaaaca

SEQ ID NO: 288151 - RNA, 64 nt, Human
aauuuuuuucuuaaaauaaagacuuuuucacaaugacuggcacagauuacucagcaaaagauag

SEQ ID NO: 288152 - RNA, 64 nt, Human
cuguuuguuguccguauguccugaaaacaugagggacuggcagaugucauuuuggucuaaagag

SEQ ID NO: 288153 - RNA, 64 nt, Human
gggaguuuuccugaucuuggguccucuuuagggggccagacaagaaaggccuacgguuucugga

SEQ ID NO: 288154 - RNA, 64 nt, Human
aauagagcagauugucauauuguaacaugcgugugccagacaccgggcaguacacuuuggaaag

SEQ ID NO: 288155 - RNA, 64 nt, Human
gcgguggcugguccucaggcacgcugcacucccagccagacauggucuuuccguuucuuaagua

SEQ ID NO: 288156 - RNA, 64 nt, Human
agggcacagggacccggggccccgcggggcuggggccagacaaagacucggcaaaggggcgaga

SEQ ID NO: 288157 - RNA, 64 nt, Human
agcgcugcgucguggaagucaccccauuuccccagccagacacacucccaugacgcccacagcu

SEQ ID NO: 288158 - RNA, 64 nt, Human
cauucccaggagcaggugcgugccagccauggcugccagacacugcugcaacugaccagcugcc

SEQ ID NO: 288159 - RNA, 64 nt, Human
aauccugaauugaggucaugaggaggccccccaggccagacaguccugaaccccucugacacuu

SEQ ID NO: 288160 - RNA, 64 nt, Human
aguaguuuugucuucaaguaaaaugucugguugugccagacauuucacaagugugaaaggagau

SEQ ID NO: 288161 - RNA, 64 nt, Human
gugugagcacaaugccaaccuuaguguuucuccagccagacagaugccucagcaugaagggcuu

SEQ ID NO: 288162 - RNA, 64 nt, Human
acuucacauaagcucagaauccaagugaacacuagccagacacucugcucugcccuuguucccu

SEQ ID NO: 288163 - RNA, 64 nt, Human
acccaggccaguggaggugccacagcccuggggagccagacaggcuuugguaucguaucgccuc

SEQ ID NO: 288164 - RNA, 64 nt, Human
ugaaugaauccauuggagaagcgguggauaacuagccagacaaaauuugagaauacauaaacaa

SEQ ID NO: 288165 - RNA, 64 nt, Human
gagcugauugugaaacaucuacuagcacaccacugccagacaugacugugugugucccugaaac

SEQ ID NO: 288166 - RNA, 64 nt, Human
acuguguguccccuggcgcucuugcccauagagagccagacaccaauccucaauggcaccuugg

SEQ ID NO: 288167 - RNA, 64 nt, Human
auuuggaggcauauuuucuuuucuuacagucauugccagacagaggcauacaagucuguuugcu

SEQ ID NO: 288168 - RNA, 64 nt, Human
gcuggcacccuccauguacccaggggagauuccagccagacacccgccccccggcccuggcuaa

SEQ ID NO: 288169 - RNA, 64 nt, Human
gggguccuguuccuuccugcaaagcccaauccaagacuggcauggcucagagguugugagaaag

SEQ ID NO: 288170 - RNA, 64 nt, Human
uagucaggaaaugauauuuauaaaaaauaugagagacuggcagcuauuaacauugcaaaacugg

SEQ ID NO: 288171 - RNA, 64 nt, Human
uaaaaauacauaucuuuaugauuuucaucauaaagacuggcaauauuauaacuaaaaaucuuac

SEQ ID NO: 288172 - RNA, 64 nt, Human
aaaccccgucucuacaaaaauacaaaagaaauuagccagacaugauggcgggugccucuaaucc

SEQ ID NO: 288173 - RNA, 64 nt, Human
gacacggaagugagagacacuaaagaaggugugggccagacaaggccuuggagcccacacaugg

SEQ ID NO: 288174 - RNA, 64 nt, Human
agggcgaguggcugcgagagagaaugagccucccgccagacaggagggaggugcguguggaugu

SEQ ID NO: 288175 - RNA, 64 nt, Human
acuaaggugaggauuagagagugaguagaagugagccagacaaaaaaagcagaaaaugcagaug

SEQ ID NO: 288176 - RNA, 64 nt, Human
ccugugaacuaaugcccagcauuccucaaggucagccagacaaaaaggaacuuaggucuugggc

SEQ ID NO: 288177 - RNA, 64 nt, Human
caauauuauuggcagacauuguugaaggaaaaaagccagacaaacaacuacauaaaauauguuu

SEQ ID NO: 288178 - RNA, 64 nt, Human
gcauauucagcaggugccacuacaugccuacucugccagacacugagcuuggggcccuagggaa

SEQ ID NO: 288179 - RNA, 64 nt, Human
uuuuaugaagaaagcagaaauaauuacugaaagugccagacacuaaggaauauuauuguuuauu

SEQ ID NO: 288180 - RNA, 64 nt, Human
uugcaugcuauaaacgugaaaacuaacauuuuuggccagacacaguggcucaugcauguaauuc

SEQ ID NO: 288181 - RNA, 64 nt, Human
acuaaagaaguugggggagcucgagagccagacggccagacaggcagaccccuccagaggcccg

SEQ ID NO: 288182 - RNA, 64 nt, Human
ucucguuuaaacacgccgaaccucaccauauggagccagacauugggacgcacgcaugugauug

SEQ ID NO: 288183 - RNA, 64 nt, Human
ucagccacugugaugcagagccccaggggucuuugccagacaacuuguccugacucaacagaga

SEQ ID NO: 288184 - RNA, 64 nt, Human
cguagagaggugggauagaggaagggagguuugagccagacaggccuuucccagggaagccucc

SEQ ID NO: 288185 - RNA, 64 nt, Human
cgaaauccugucuguacuaaaaauacaaaaaucagccagacaugguggcaugcaccugcaaucc

SEQ ID NO: 288186 - RNA, 64 nt, Human
gccuuugaauuuuagaauacaaaaagagaagcaagccagacaugguggcucacaccuguaaucc

SEQ ID NO: 288187 - RNA, 52 nt, Human
agcucaaaaacaagaagugaaagccagacagcccuaacaaagcaccccaccc

SEQ ID NO: 288188 - RNA, 64 nt, Human
ucagcaaccucugagcgcccugcugccacccagugacuggcagggccgagccagcauuccaccc

SEQ ID NO: 288189 - RNA, 64 nt, Human
cuucucacucuguggaaguacuuuagugagagcugacuggcaagauaaaaacccugaaauuccc

SEQ ID NO: 288190 - RNA, 64 nt, Human
guucaugaccugaccugaagcagcagauuugauagacuggcaaagaugaauaggaaaaacuuug

SEQ ID NO: 288191 - RNA, 64 nt, Human
auagcuaccaucauuugucaagcaccuacuagaugccagacacccuacacauauugccuccugu

SEQ ID NO: 288192 - RNA, 64 nt, Human
gccaugauggcaacagaucuggaaccucagccuggccagacacaggcccucccuguuccccaga

SEQ ID NO: 288193 - RNA, 64 nt, Human
aagauaacuaggaaauccauucacaguucuuugggccagacaugccacaaggacuuccugucca

SEQ ID NO: 288194 - RNA, 57 nt, Human
cugugccaccuccacagugaggagccagccagacaucucucccccucacccccugug

SEQ ID NO: 288195 - RNA, 64 nt, Human
acccauugucaggugcucucccucaccccuguaagccagacaguuuguucaaaaccugcagcaa

SEQ ID NO: 288196 - RNA, 64 nt, Human
acauuaaggaugguggggguagauaauccauucagccagacaaacggggccagcucuuaaaaua

SEQ ID NO: 288197 - RNA, 64 nt, Human
cacuuaaaaugaucauuaggacauaacagacuaggccagacauagcaucuuguggcuuugcaac

SEQ ID NO: 288198 - RNA, 64 nt, Human
guuaagaucaccaaguagcugugcuuuaauuagagccagacaagcuuucaagguccuuuaagua

SEQ ID NO: 288199 - RNA, 64 nt, Human
uaaauuaaaaauguuuucauuugaaaguguauuugccagacaaugaaaacaguaugcaguauuu

SEQ ID NO: 288200 - RNA, 64 nt, Human
caucagaaugaacucuaugaauacauguguaagugccagacagcugaaucuuuaucagguauug

SEQ ID NO: 288201 - RNA, 64 nt, Human
agggcucacagagucuccucuguacguggccauggccagacaccccagucccuucaccaccacc

SEQ ID NO: 288202 - RNA, 64 nt, Human
acaguggcccugagcccaccccuuccugggaugggccagacaagcaggugcugggaggaggcaa

SEQ ID NO: 288203 - RNA, 64 nt, Human
uuaauagguaguaauuuguucaaaagcgguuuuagccagacaucuaguugcaguguucaagagg

SEQ ID NO: 288204 - RNA, 64 nt, Human
acacaugacaugauuugugaauaucaucaucuuugccagacaagucuccaggggaucccuguuu

SEQ ID NO: 288205 - RNA, 64 nt, Human
aaagcuacuuuugccaagaaggaugagacaaaaggccagacagaaauuggacuuugguuuucag

SEQ ID NO: 288206 - RNA, 64 nt, Human
ggaaaaucaagaugguaccucucugcauuaucccgccagacacuguauuuuaugcauucauguc

SEQ ID NO: 288207 - RNA, 64 nt, Human
gcaguagacuguauggucuuucaagagaguuccagacuggcacuuucacccagaaccaaugcgg

SEQ ID NO: 288208 - RNA, 64 nt, Human
cccuggaccucuggcugggagcgcucauucuugugacuggcaggcugcccucggucgcugcugu

SEQ ID NO: 288209 - RNA, 64 nt, Human
ccugcuggacagagacucagcgcuccuccugugugacuggcaagaggccucaugccugcugaga

SEQ ID NO: 288210 - RNA, 64 nt, Human
aguggucagcccaguuuaagggugggagucuggagccagacagccaagccccuuccacaucuac

SEQ ID NO: 288211 - RNA, 64 nt, Human
gagcuagugaggguucagagaagccccauccuaagccagacacaugaugugggcucagcucagu

SEQ ID NO: 288212 - RNA, 64 nt, Human
ggcccaagaauucaggaccagucugggcaacagagccagacacugucucuauaaaaaaaaguua

SEQ ID NO: 288213 - RNA, 64 nt, Human
aucucacagagcccacgucgacgagcaccauuuggccagacauugagaguuuggacguguccgu

SEQ ID NO: 288214 - RNA, 64 nt, Human
acacaccgacuuuguccuuuuucucagcaucagagccagacaggauucagaauaaggagagaau

SEQ ID NO: 288215 - RNA, 64 nt, Human
ugaaggugaggacucuuggaagcaggccauccuggccagacacccuagcaggaaggggcucacc

SEQ ID NO: 288216 - RNA, 64 nt, Human
agauguuuguugaauugaacugaaaauuuauguggccagacacaguggcucaugccuguaaucu

SEQ ID NO: 288217 - RNA, 64 nt, Human
uuuuuugguguucauagcuucuucucauacaggugccagacacuguuugugcuuuugauggauu

SEQ ID NO: 288218 - RNA, 64 nt, Human
auuggggcaaauccaggcacuccccaugucaacagccagacagggcuccagggcuugucccagu

SEQ ID NO: 288219 - RNA, 64 nt, Human
guugcauucuucccccuuggagccaagacgauuggccagacaucaccucagaucugagaccagc

SEQ ID NO: 288220 - RNA, 64 nt, Human
gggcuccagcggccgugugcuccagcaggccagagccagacacgaccucccugagccucacagg

SEQ ID NO: 288221 - RNA, 64 nt, Human
cuugguccccuaggccagacuucacugccacugugccagacagcucccugcagcugggcccuag

SEQ ID NO: 288222 - RNA, 64 nt, Human
gcucuggccucgguccucccccaacccugcccaagccagacagacagcaccugcagacgcaggg

SEQ ID NO: 288223 - RNA, 64 nt, Human
ccggaugcugugccuggccuccgaugccuggccugccagacacugcgccccgccugaccugggg

SEQ ID NO: 288224 - RNA, 64 nt, Human
auuuccuccaaucucuguagccccagaagugaacgccagacaggaacacgcauguguguauaua

SEQ ID NO: 288225 - RNA, 64 nt, Human
aaagaauaacaccuuuucuugcauucugagcuaagccagacagccuuuauacuagauucuauca

SEQ ID NO: 288226 - RNA, 64 nt, Human
uucccucagugacaucgaguggcauaucuaucaggacuggcauucuuuucuccugugggaguuu

SEQ ID NO: 288227 - RNA, 64 nt, Human
ucuccucuagaccagggacagguguagagauaaggacuggcaaccagagccucagcauccaaag

SEQ ID NO: 288228 - RNA, 64 nt, Human
guccucuuaggucccgggaggaacgugguucagagacuggcagccagggagcccggggcagagc

SEQ ID NO: 288229 - RNA, 64 nt, Human
acuugaguuggcuguguucgggggagcagagagagccagacagccccaagcuucugagucuaga

SEQ ID NO: 288230 - RNA, 64 nt, Human
ugggcagaguaccaggcugcugacccucagcagggccagacaaggcucaguggaucuggucuga

SEQ ID NO: 288231 - RNA, 64 nt, Human
aggcuguccugucccccaggcacccaaggauccugccagacagcacacuuuggaggaaggucug

SEQ ID NO: 288232 - RNA, 64 nt, Human
gugaggcccagggagaggccaugauucgcccaaagccagacagcaacggggaggccaagugcag

SEQ ID NO: 288233 - RNA, 64 nt, Human
uuaaaaugcgaaauuauugguuggugugaagaaagccagacaacuucuguuucuucucuuggug

SEQ ID NO: 288234 - RNA, 64 nt, Human
cuaugccaaagguaggcagaaaaugggcuugggagccagacacuccagggaucaguaguuccua

SEQ ID NO: 288235 - RNA, 64 nt, Human
uaugagaaaccauaaaauuguuuuuauuuuucaggccagacauagcuuccuaaugaaagaaaau

SEQ ID NO: 288236 - RNA, 64 nt, Human
ugacaccagaacagcccaaaucagaguucccagggccagacaggcucuuccugggccacagagg

SEQ ID NO: 288237 - RNA, 64 nt, Human
uucagagguugccugcggaguaccuugucccagggccagacacacccacaccacccacuguccu

SEQ ID NO: 288238 - RNA, 64 nt, Human
uccugaccagccgugggaauggcugggcugccaggccagacacgcuagguucuuccaaagaguc

SEQ ID NO: 288239 - RNA, 64 nt, Human
gguuccuccuuugggcccagcggccggcgaggccgccagacauacacacguuaccagacgcugg

SEQ ID NO: 288240 - RNA, 64 nt, Human
caacacuggcccccagcugaagggcccagcugcagccagacagauggugcuugagaaccgaggc

SEQ ID NO: 288241 - RNA, 64 nt, Human
gggguccuguccaggcccagggacaucuuugcaagccagacacacuuccucuugagaccucguu

SEQ ID NO: 288242 - RNA, 64 nt, Human
acaugucccaggauuugcuccacccucgagggcagccagacagcgucgccaggcaaugaggaaa

SEQ ID NO: 288243 - RNA, 64 nt, Human
ggggauggcugaggacacuggcccuuaccccagggccagacagcauccaucccugcuguuugca

SEQ ID NO: 288244 - RNA, 64 nt, Human
uaauacacaucuguguacacagaaaccggcaccugccagacagagcugguucuaagauuuaaua

SEQ ID NO: 288245 - RNA, 64 nt, Human
cuaaacguaagcacuguuuuuccauaguuuugaugacuggcauuuuauagacacccuggcagcc

SEQ ID NO: 288246 - RNA, 64 nt, Human
gaagguggauaccaugagcucuucaccuggcggggacuggcaggcuucacaaugugugaauuuc

SEQ ID NO: 288247 - RNA, 64 nt, Human
uggguuggucuucagccagcauucuggugggagugacuggcauuaacaagacuggaaaucgggg

SEQ ID NO: 288248 - RNA, 64 nt, Human
aagacucugucucuacaaaaaguuuaagaaaugagccagacauggugguguaugccuguagucc

SEQ ID NO: 288249 - RNA, 64 nt, Human
cugugagcggagcccucgaccccgugacacccuggccagacacccugcuuggacugggguggcc

SEQ ID NO: 288250 - RNA, 64 nt, Human
auaguaagaccccaucucuuaaaaaaugaauuuggccagacacaggugccucacgccuguaauc

SEQ ID NO: 288251 - RNA, 64 nt, Human
acauugugagucaguauaaccauguggauaaaaugccagacaucuuuuuauucgaaaauuuuac

SEQ ID NO: 288252 - RNA, 64 nt, Human
uccuccuaaaguggccccuguucccaucucccgggccagacagcuguccccccguccuccuccc

SEQ ID NO: 288253 - RNA, 64 nt, Human
caaacucugggccuggugggagaggccagcuugagccagacagcgcugcccagggguggccgcc

SEQ ID NO: 288254 - RNA, 64 nt, Human
auccccuaggagccuucagucugggagaaacagagccagacauagacaguuccagcaucacaga

SEQ ID NO: 288255 - RNA, 64 nt, Human
ccucauagcaucucauucaauugcaagaauagaggccagacacgguggcgcaugccuguagucc

SEQ ID NO: 288256 - RNA, 64 nt, Human
augcagcaaaguguucacuaagaguguuuaucuugccagacauaagaagaugaaugguagagca

SEQ ID NO: 288257 - RNA, 64 nt, Human
gcacgcaggauucugagcaccaggggcagaggcggccagacaaccucagggaggaguguccugg

SEQ ID NO: 288258 - RNA, 64 nt, Human
caggcgagagcuaguggggugcagagggccccaugccagacagcccuuggggcucguugcacuu

SEQ ID NO: 288259 - RNA, 64 nt, Human
gcuguaaggaccgggggucucccuccucacuaccgccagacaccccgguggaagcauuuagagg

SEQ ID NO: 288260 - RNA, 60 nt, Human
cgucguccuguuccucaugaugucaggagcgccagacaccgggggccagggugggggugg

SEQ ID NO: 288261 - RNA, 64 nt, Human
ggccccccugccccgugcugaaugaauguacagagccagacaaagcugugaauggccuaggggc

SEQ ID NO: 288262 - RNA, 64 nt, Human
aaaccccauauccauuaaaaauauuuaaaaauuagccagacaugguggcacgcgucuguggucc

SEQ ID NO: 288263 - RNA, 64 nt, Human
ccaacagaccugucuucacccuugggcuuugaaagccagacaaagcagcugccccucucccugc

SEQ ID NO: 288264 - RNA, 64 nt, Human
uuauauaauucauuugugauauccacaauaauaugacuggcaagaauugguggaaauuuguaau

SEQ ID NO: 288265 - RNA, 64 nt, Human
agcauagaaaaucagaaucaagagcaaacucugagacuggcacaauccaagaagauuuccuggc

SEQ ID NO: 288266 - RNA, 64 nt, Human
gcugaaauuugccaguaaaacaaagaaguuuaaagacuggcagguacaccauuaucacauaagu

SEQ ID NO: 288267 - RNA, 64 nt, Human
ucuguaggccccuuacccagccaugucuggacaugccagacagcuguggcaugucauaaacugu

SEQ ID NO: 288268 - RNA, 64 nt, Human
uauucaguguuugguguccacugaguugucauuugccagacaaguggagauuuuugcagcucau

SEQ ID NO: 288269 - RNA, 64 nt, Human
cuguguggcauuuuucacccugccggguucccuugccagacaugaugucgguuaucuggcaaaa

SEQ ID NO: 288270 - RNA, 64 nt, Human
ccggccugggaaacccucuccaucucccaaggcugccagacauggaccuccaggcuccagcaca

SEQ ID NO: 288271 - RNA, 64 nt, Human
uauuagcuguuacugucauuaucuguguuaaccugccagacaaccuuauauggguugcuuuugc

SEQ ID NO: 288272 - RNA, 64 nt, Human
acuaaaaagagaugcaacaugugacuggccaucagccagacaugucuagggugagaccagugcu

SEQ ID NO: 288273 - RNA, 64 nt, Human
caggcugggcucugaacgaggaccuggacucagagccagacagggcagccucagacccuucucu

SEQ ID NO: 288274 - RNA, 64 nt, Human
agccucaugucuacuguuaggugagggagucacagccagacagagaguauugcuggagggugag

SEQ ID NO: 288275 - RNA, 64 nt, Human
uuggcacccuguuggguauuggguacaauggugagccagacagacacagcgccuguccuuuugu

SEQ ID NO: 288276 - RNA, 64 nt, Human
uugaauaggcauuaaaugcaaaaauauauauguagccagacaguuuaugagaaugacccuguca

SEQ ID NO: 288277 - RNA, 64 nt, Human
gcuggugagaccacgugcugcuggcguaguguaggccagacauugacaguccugacgggagcuc

SEQ ID NO: 288278 - RNA, 64 nt, Human
uggaagagaugggugugcaagauaaaauuaaaaagccagacauacuuucuaucaagcuguaucc

SEQ ID NO: 288279 - RNA, 64 nt, Human
uggcaauguaaauugauagcuuaucuucacagaugccagacaauggacaacucaccaucagucc

SEQ ID NO: 288280 - RNA, 64 nt, Human
acacccugaaauugugacccccugggggacagcugccagacacagcuggcggcagcaccagaug

SEQ ID NO: 288281 - RNA, 64 nt, Human
accucaccugaagggggugagacccuuguuggcagccagacaaggguggggcuccacaggcagc

SEQ ID NO: 288282 - RNA, 64 nt, Human
ccgcccucccacaccugcuugggaggccagagaggccagacaagccgagagccccuucuguugu

SEQ ID NO: 288283 - RNA, 64 nt, Human
cuuacgcccugagcacaggugccaauggugacaagacuggcaagacgugagggcaugaaugguu

SEQ ID NO: 288284 - RNA, 64 nt, Human
uguccacugggcuggauucauguucaaaccacuggacuggcagggcaacgacuucuucccaccu

SEQ ID NO: 288285 - RNA, 64 nt, Human
aggcagcaagcaugcuggugggaagggaggcagggacuggcagcugccacccccuucaagaggc

SEQ ID NO: 288286 - RNA, 64 nt, Human
gaccccagagcagugcagccaccagggaaggugagccagacacaggccgggacaaaacgcagac

SEQ ID NO: 288287 - RNA, 64 nt, Human
ggagcuguagcaagaggguaguccaaaggcagaugccagacaagacacagccaggaacccggcc

SEQ ID NO: 288288 - RNA, 64 nt, Human
uugugcaguuuuuauugucugugucagacguacagccagacauguucucuauuggcauuuuucc

SEQ ID NO: 288289 - RNA, 64 nt, Human
cgcggggccucagugggggucucuggggaacacagccagacauccugauggggaggcagagcca

SEQ ID NO: 288290 - RNA, 64 nt, Human
cagcuauauccaggaucauuucucuuucuucagggccagacagcuuuuaauugaaauuguuauu

SEQ ID NO: 288291 - RNA, 64 nt, Human
agggcuugggcuguuugugugauaccggccccccgccagacaauagccuuugcugacaccccag

SEQ ID NO: 288292 - RNA, 64 nt, Human
uaaauauagaagaaauuuccccaaaauguaaaaugccagacaugucccagcccgaacuccccca

SEQ ID NO: 288293 - RNA, 56 nt, Human
ccuaccuccucuaccagugacguucgccaucauaccgccagcgcgacagccaccug

SEQ ID NO: 288294 - RNA, 64 nt, Human
gugaugugugucagaccucugagcccaagcaaagccaucauauccccugugaccugcauguaua

SEQ ID NO: 288295 - RNA, 64 nt, Human
cuuuuauugucucauuuuucguauauaauuauuuccaucauauucuuuauggaagaugcaauua

SEQ ID NO: 288296 - RNA, 64 nt, Human
ucuggucuuuuuucccccuaagucuuucucuuucccaucauacccuucccugcccaccuuguuu

SEQ ID NO: 288297 - RNA, 64 nt, Human
cuaccauuuccacccaaugagaggcuccuauuucccaucauagcucccuacccuagggaggccu

SEQ ID NO: 288298 - RNA, 64 nt, Human
cuguguccucagcucaagaauccuguagcuugucccaucauaauccauucacccguucaucaug

SEQ ID NO: 288299 - RNA, 64 nt, Human
ucagccucccaguagcugggauuagaggcaugugccaucauacccagcuaauuuuuguauuuuu

SEQ ID NO: 288300 - RNA, 64 nt, Human
uuagaaagaaagcuguucuugacagcacucugagccaucauaccucuuucccauauaaacuauu

SEQ ID NO: 288301 - RNA, 64 nt, Human
gucggaaugacuggaugggggauggguagaggaugacuggcacacuuguauaguauguaauguu

SEQ ID NO: 288302 - RNA, 64 nt, Human
gauauacaagggauggaugaaguucauguauuaggacuggcacuccuuacggugcuuauagaac

SEQ ID NO: 288303 - RNA, 64 nt, Human
uacauuaaugaacucgagauggcucuguaagccugacuggcaauaacgcacgguacuguucuug

SEQ ID NO: 288304 - RNA, 64 nt, Human
ucuccaaguaucuugugcaucccuccucugcucuccaucauaacugcuauuagccaaauucagg

SEQ ID NO: 288305 - RNA, 64 nt, Human
cugggccuuucugccuccugauguacacccaucgccaucauagcaagagugcuucuggaccuug

SEQ ID NO: 288306 - RNA, 64 nt, Human
gucugggccagagaaccuagccuuugaaaucucuccaucauaugaaacauaacgggaugggaca

SEQ ID NO: 288307 - RNA, 64 nt, Human
gggaaacauuuuaagguaauaaauagguuacuuaccaucauauguucauauagaugaaacuaau

SEQ ID NO: 288308 - RNA, 64 nt, Human
cagguuaccuaguauaguuuucccaaacuucuucccaucauagcacauguagaaaauaauauuu

SEQ ID NO: 288309 - RNA, 64 nt, Human
gaugcccugggguccgugguuguggucaucacggccaucauauucuaugugcuuccccugaaga

SEQ ID NO: 288310 - RNA, 64 nt, Human
uacucccaaacaucccacuuuuuacuguuucaggccaucauaucauucuuaagcuacuuggggu

SEQ ID NO: 288311 - RNA, 64 nt, Human
cacuuugagcaguugccuggaaggcugggcauuuccaucauauagaccucugcccuucagagua

SEQ ID NO: 288312 - RNA, 64 nt, Human
ucacucugguugcccaggcuggagugcaguggugccaucauagcucacuguagccucgaccuuc

SEQ ID NO: 288313 - RNA, 64 nt, Human
caucucauuuuuuaggaagacaugauaauacugcccaucauauucauguguaacuacuguucuu

SEQ ID NO: 288314 - RNA, 64 nt, Human
uaaacuaagugcuuaauuuuaaaguauuauguugccaucauauaguguauaaaaauguauaauu

SEQ ID NO: 288315 - RNA, 64 nt, Human
acgugccuguuuguuuguugcucuuuccuucucuccaucauagucugggugccagcgcccugaa

SEQ ID NO: 288316 - RNA, 64 nt, Human
uacuuacuuccaaagacugaauacaagccacacuccaucauaucccuuaaacuucaugaaaaac

SEQ ID NO: 288317 - RNA, 64 nt, Human
uuuugacuuacaauuggcuaaucaagauguaacaccaucauaagacaaggagaaucauauacaa

SEQ ID NO: 288318 - RNA, 64 nt, Human
uuuucuuuuuugccaauaaaguuguaaauaaagaccaucauacauuaaaauccaaauaugggcc

SEQ ID NO: 288319 - RNA, 64 nt, Human
cucuggaaauggcaucagauuuaaggauaauacuccaucauagaaauaagccuuaauaaccagu

SEQ ID NO: 288320 - RNA, 64 nt, Human
cuccccacagucuacuuuuacaaacgccuguaaagacuggcaucuucacaggaugucaguguuu

SEQ ID NO: 288321 - RNA, 64 nt, Human
caacacuuuugucuguuguguauaaaagaagaaagacuggcauguaccuucauuugcuuagcua

SEQ ID NO: 288322 - RNA, 64 nt, Human
cuucaguaaucacggggcaugauuauggagguuugacuggcaaauucgcuuuggacucguguau

SEQ ID NO: 288323 - RNA, 64 nt, Human
cuagagcuccacuaacagucucauaaggaggcagccaucauaaccauugaauagcaugcaaggg

SEQ ID NO: 288324 - RNA, 64 nt, Human
uugaaaauauuuccucuauaucaugccuggaguuccaucauagcccuucauuuccuuggcuuua

SEQ ID NO: 288325 - RNA, 64 nt, Human
uuacccacugucaggccucugagcccaagcuaagccaucauauccccugugcccugcacguaua

SEQ ID NO: 288326 - RNA, 64 nt, Human
auguguuuauuggacacacaaaaaaacuuugcaaccaucauaauacaucaauauuuaaccuaga

SEQ ID NO: 288327 - RNA, 64 nt, Human
gcugagugagaacugcuuucauugaagcuggaagccaucauaccuuacugccuugaaaccccua

SEQ ID NO: 288328 - RNA, 64 nt, Human
uugagacuguuuugaauuugggggauggcuaaaaccaucauaguacagguaaggugagggaaua

SEQ ID NO: 288329 - RNA, 64 nt, Human
uaggaugguaccaagcauuuagugcacaguggccccaucauagccugcagccucaucauuuccc

SEQ ID NO: 288330 - RNA, 64 nt, Human
gaauguuuaaaagucaguuauaagccaucucaucccaucauaauuuaugauauguuuaauauau

SEQ ID NO: 288331 - RNA, 64 nt, Human
agagguuuucaguacauauuuacaaguucuuacuccaucauacauauugggaaugagcuggcau

SEQ ID NO: 288332 - RNA, 64 nt, Human
guaacuacauuaggguuugcgggucugauggucgccaucauaacugcauacucaacucugccgu

SEQ ID NO: 288333 - RNA, 64 nt, Human
gguaaagaaauacauuuucuuuuucucaaauaugccaucauaugggauggguagguuccaguug

SEQ ID NO: 288334 - RNA, 64 nt, Human
acuggaaggaguggaagaguuggaaaauuuguaaccaucauaauacagguguaauagguuuggg

SEQ ID NO: 288335 - RNA, 64 nt, Human
acaauucuguuaacuggaaaaucacaggauauauccaucauauuuuucaggacagauaguuuuu

SEQ ID NO: 288336 - RNA, 64 nt, Human
ggucauugaucccuggcucagaggauagcgguuuccaucauaaaccaagaugaugaguucagcc

SEQ ID NO: 288337 - RNA, 64 nt, Human
uccuccuguucccugggucagaggauagcgguuuccaucauaaaccaagaugaugaguucagcc

SEQ ID NO: 288338 - RNA, 64 nt, Human
accacuccguagcuuuauauauucagcaacauuuccaucauagaauuucagcguuagaagggau

SEQ ID NO: 288339 - RNA, 64 nt, Human
auacugagaaaaccaggcucuuuggggcuagacagacuggcagagagugagaucucccucucug

SEQ ID NO: 288340 - RNA, 64 nt, Human
gccccagguagggaggggagaguaugaggagggugacuggcagcuucuccuccagacuccuagc

SEQ ID NO: 288341 - RNA, 64 nt, Human
ggcguuccugacacaaacugaggccuccuagcaagacuggcaguuuucuguaaaggaggguuau

SEQ ID NO: 288342 - RNA, 64 nt, Human
ugugaacuuagaaauuaacuuacaaucuaaccagccaucauaucauauccuaucaggcuagaua

SEQ ID NO: 288343 - RNA, 64 nt, Human
uauguuugucauuuuguaacuuaccaaaaacaaaccaucauaucauaccaacuaaaaugauaua

SEQ ID NO: 288344 - RNA, 64 nt, Human
gguuucagcauaaccuaagacagggaauugggagccaucauaugucacaguguucagaauucaa

SEQ ID NO: 288345 - RNA, 64 nt, Human
aaggggcuagugugauagggagaggggugggaugccaucauauuuaggggugguugggaacugu

SEQ ID NO: 288346 - RNA, 64 nt, Human
acaauaguuucaucauaauacauuauguuuaccuccaucauaguugcuuuuuucauaguucuug

SEQ ID NO: 288347 - RNA, 64 nt, Human
uaugaacauagacuagagaaaccguccucuuuuuccaucauaauucuaaucuaacaauggaaga

SEQ ID NO: 288348 - RNA, 64 nt, Human
agagaauaaguuaaccacaaaauaagacuuuuugccaucauauggucaauauuuuagcuuuuau

SEQ ID NO: 288349 - RNA, 64 nt, Human
cuucagaucuaugacauuauucugaucacuggcuccaucauacauauucaccacuugagauuca

SEQ ID NO: 288350 - RNA, 64 nt, Human
cauggauuuuggauaaaucauuucaguaucaucuccaucauaugccugaccccuugcucccuuc

SEQ ID NO: 288351 - RNA, 64 nt, Human
cgaccacauuugauguuugaaguuguaaucugucccaucauaaacuuaccuggagcucaugugg

SEQ ID NO: 288352 - RNA, 64 nt, Human
cugccucuuccugcagccucacuucuaccugcccccaucauaagggcacugagcccuucccagg

SEQ ID NO: 288353 - RNA, 64 nt, Human
cacaccucuuuggggaaguuacgauuuuuuuuuuccaucauaauucagucucuucuuauucuac

SEQ ID NO: 288354 - RNA, 64 nt, Human
uaguucuuuucagccuuguggagccugucagucgccaucauaccucgagugaggcccagcuaga

SEQ ID NO: 288355 - RNA, 64 nt, Human
caaucaggaagaaugcaguguucugauaccagugccaucauacacuugugauggaugggaacgc

SEQ ID NO: 288356 - RNA, 64 nt, Human
ucuccaauugucaugucaguguaggggaacuacuccaucauagcauucuggacaccuugcaugu

SEQ ID NO: 288357 - RNA, 64 nt, Human
uuaacagaugacaauuaggcuuuugucauuguugccaucauauggaagauaauguuuacauccu

SEQ ID NO: 288358 - RNA, 53 nt, Human
gucugaaaucgaagcucuagugggacuggcacacauucagccaagucuaauga

SEQ ID NO: 288359 - RNA, 64 nt, Human
ggcacaacaguucucuucuaggauuuguuuggcugacuggcaguaaccuagugaauuucugaaa

SEQ ID NO: 288360 - RNA, 64 nt, Human
cagacccauccuguuaguaugucaaaucaacuaagacuggcaggguauuaacuccauuccaggu

SEQ ID NO: 288361 - RNA, 64 nt, Human
ggucuuguguuacacauccauggaccgguucacuccaucauauacagcucucugcuccgugucc

SEQ ID NO: 288362 - RNA, 64 nt, Human
ucucugucagugugaaaauucagcggcaguguguccaucauauuaaaaauauacaagcuacagu

SEQ ID NO: 288363 - RNA, 64 nt, Human
ccucagcuugaaauggggcugcaucccuauaaacccaucauaaagucaaaaaauccuaaaacau

SEQ ID NO: 288364 - RNA, 64 nt, Human
ccucgauuuacauugugguuaauucccaauaaacccaucauaaguuaaaaaugcauauaacguu

SEQ ID NO: 288365 - RNA, 64 nt, Human
aauuagacagagacucacucaggaagugacaggcccaucauaucaaauaacuuauucacuuuuc

SEQ ID NO: 288366 - RNA, 64 nt, Human
agugauuacagauguuggcucaaguucagggccaccaucauauaccuaacaagaguucaugauu

SEQ ID NO: 288367 - RNA, 64 nt, Human
acucacacaacauauuuguauugacugaaggaaaccaucauaaugcaugcuagaauucuuugaa

SEQ ID NO: 288368 - RNA, 64 nt, Human
aaaauagagcuaaacaccacaguggucaacaaagccaucauaauguugguguuuguuucccucc

SEQ ID NO: 288369 - RNA, 64 nt, Human
cagauacaugagaagagccuccaaaacuggaagcccaucauaaggcaugagaauguuuaacuau

SEQ ID NO: 288370 - RNA, 64 nt, Human
ccaagcagcauucagcacaccccaagggacaaccccaucauaugacaugccacccucuccaugc

SEQ ID NO: 288371 - RNA, 64 nt, Human
acugguagaugugcucauucucccugaaacauacccaucauauuuccuauuauaauuacaucuc

SEQ ID NO: 288372 - RNA, 64 nt, Human
auaaaauagaaaagaaaguaaauuacagugauuuccaucauauuaucacucuugaauuuuauca

SEQ ID NO: 288373 - RNA, 64 nt, Human
guaauuaauuugggucuauuauuaacucucuguuccaucauagaauguggccaggccuuacaau

SEQ ID NO: 288374 - RNA, 64 nt, Human
gucaaaccacaaccauucuuucuugucauaguucccaucauaaaauaaugacccaaggagacgu

SEQ ID NO: 288375 - RNA, 64 nt, Human
ugauaucaguccaguuuguccuuagucacaaagcccaucauaauauaaaacaggaugguggcag

SEQ ID NO: 288376 - RNA, 64 nt, Human
augacauauuuucauuaauaguuuaaaucagugaccaucauaauaaagauaaaauuuaguugag

SEQ ID NO: 288377 - RNA, 64 nt, Human
auuggaguucacccuaggugcuuuuccccucugugacuggcagauaacacauacuuuugaaagu

SEQ ID NO: 288378 - RNA, 64 nt, Human
guacaggcaaccuuguguucucugugcccucagggacuggcagagcaagaggccaucagaagga

SEQ ID NO: 288379 - RNA, 64 nt, Human
gugauuauuugaugauuaucaguuuugcuuaguagacuggcaauauuuagucuugcugucacug

SEQ ID NO: 288380 - RNA, 64 nt, Human
ucgguuggugagugcagggaaggaggauguaauuccaucauauauacucucugugccuaccgca

SEQ ID NO: 288381 - RNA, 64 nt, Human
ccuuuuauguuuuauuauuuuugaauucauggagccaucauaaaaauauuuuuaaaaucagaau

SEQ ID NO: 288382 - RNA, 64 nt, Human
auauccggaaucacacauguuaucuuaaacccagccaucauaccuaagucuuuugccaaaaccu

SEQ ID NO: 288383 - RNA, 64 nt, Human
gagucuuuugaauggaaauuguauuauguuauagccaucauaaaaccauuuugguaguuuugac

SEQ ID NO: 288384 - RNA, 64 nt, Human
gaccuuugaggaagauaaagccuuccuucacuacccaucauauucagugucccuguuccucacu

SEQ ID NO: 288385 - RNA, 64 nt, Human
agccugccuguccuccagcugucugacuauccauccaucauaaccaccccagccugggaaggag

SEQ ID NO: 288386 - RNA, 64 nt, Human
guuaucauaucaugcuucaacuauuaaauuaagcccaucauaucauagcacuaaaaagauugag

SEQ ID NO: 288387 - RNA, 64 nt, Human
ugaugguuuggaagucuauugcugggaagaaauuccaucauacauauucaugcuuauaauaagc

SEQ ID NO: 288388 - RNA, 64 nt, Human
uccauuuaugugauggguuugcauccugauaaacccaucauaaguugaaaauaugaucauaagu

SEQ ID NO: 288389 - RNA, 64 nt, Human
uggcaaauugugcagaguaguuuauuccuucugaccaucauagaggagacauuaaauaaauuau

SEQ ID NO: 288390 - RNA, 64 nt, Human
ugaccuauccuaagcuuuuacacuuggauuuuagccaucauauguuggccaggucucacugcag

SEQ ID NO: 288391 - RNA, 64 nt, Human
caucauguuugcuuauuaaacaaagcuccuacugccaucauacuaaucaugcaaaaagauugcc

SEQ ID NO: 288392 - RNA, 64 nt, Human
gcucaguguguaggaccuacaaaccuauaggggcccaucauaacguucucuuuaauuuauauua

SEQ ID NO: 288393 - RNA, 64 nt, Human
auuuuacugguauauuauugcuucauguuuuguaccaucauaagauuuugugcagauuuuuuuu

SEQ ID NO: 288394 - RNA, 64 nt, Human
agacaaauacugcuaauaccaaaagugaaagaggccaucauagcugauccuauggucaccaaaa

SEQ ID NO: 288395 - RNA, 64 nt, Human
aagcccuuucuuuauaauucuucuguugaaauagccaucauauucacaguacuaaucacagcau

SEQ ID NO: 288396 - RNA, 64 nt, Human
agagagggcagagaagaggaggggugucuagggggacuggcagagugugagagggaccgugagg

SEQ ID NO: 288397 - RNA, 64 nt, Human
gcuggacugucaccuguuucccaguuaaagcccugacuggcagguuuuuuaauccaguggcaag

SEQ ID NO: 288398 - RNA, 64 nt, Human
ucaagcaccccaaaccugcccuuucuccccugcagacuggcaggugggauuggcucccagguca

SEQ ID NO: 288399 - RNA, 64 nt, Human
caacaggcuguuuacaaagcagaaaauaucaucaccaucauaaccuuucuccuugagaaaacuu

SEQ ID NO: 288400 - RNA, 64 nt, Human
uggcguuggagacgccuguuaggaucuucaagucccaucauagaaaauugaaacacagaguugu

SEQ ID NO: 288401 - RNA, 64 nt, Human
uuucuagcuucuacuaagauauuucuuucccuaaccaucauacacuuggcauguuucauuccca

SEQ ID NO: 288402 - RNA, 64 nt, Human
agucccaaaaaccagagaccauuuucauuuacugccaucauaaauauucuccaccauucaagau

SEQ ID NO: 288403 - RNA, 64 nt, Human
uuaaagugugaacuuaauauauaagaugccaggaccaucauauugaugacaaaaaucuauuaug

SEQ ID NO: 288404 - RNA, 64 nt, Human
gugcauacuucucaaucuuugcuuuauggccuuuccaucauaguugcccacucccucuccuuac

SEQ ID NO: 288405 - RNA, 64 nt, Human
gugagcuugacuugacucccaacccuaccaugcuccaucauacucaggucucccuacuccugcc

SEQ ID NO: 288406 - RNA, 64 nt, Human
uauggagguuuaugcaagcagaguaccagggguuccaucauaucaaccuggcaaugcacuuggu

SEQ ID NO: 288407 - RNA, 64 nt, Human
aguaacaugugaggcucuccccuccuccccucccccaucauaaagauauuuugaaaucccaagg

SEQ ID NO: 288408 - RNA, 64 nt, Human
aaccacacuuaauaaagaagagacagugaaaguaccaucauaauuaaccuaaauuuuuguuaua

SEQ ID NO: 288409 - RNA, 64 nt, Human
cauggauuuauaauggcauuuuauauuuggcaggccaucauagauuauuuacaaccuaaaagcu

SEQ ID NO: 288410 - RNA, 64 nt, Human
aguuuauguggaggauuaucuucugguguuguguccaucauaagauguaaaaagagaaaucaua

SEQ ID NO: 288411 - RNA, 64 nt, Human
ucucuuaucugccauguccauagccauaauuccaccaucauacagaucaggcaguguuuaaaau

SEQ ID NO: 288412 - RNA, 64 nt, Human
cacugcacuccagccugggugacagagugagacuccaucauaaauaaauaaauaaauaaauggg

SEQ ID NO: 288413 - RNA, 64 nt, Human
gucaguugaaaauacauuuaauaucccaauuaacccaucauaaaguugaaaaauccuaagugga

SEQ ID NO: 288414 - RNA, 64 nt, Human
aggcccggcaugaggaccugacgcugagagagaaccaucauaccccaagccaggcacuagauuu

SEQ ID NO: 288415 - RNA, 64 nt, Human
gcugugagccagacccuccuugggcagacaggcugacuggcagcaccagcuuugggggcagagu

SEQ ID NO: 288416 - RNA, 64 nt, Human
uugacucugcugaggaaaagguccaagccaagaggacuggcaggcggggccucaagccugcagc

SEQ ID NO: 288417 - RNA, 64 nt, Human
uggccaaggacaaacucuccucugggacgucugggacuggcauuugucccccacucaaauuauc

SEQ ID NO: 288418 - RNA, 64 nt, Human
ucaugucuuuuccauguguaccuguaauauuuuuccaucauaucucaaaguaaagucauuaaca

SEQ ID NO: 288419 - RNA, 64 nt, Human
aaucagcucccuuccccugccugguaugaguugcccaucauacgcaugguccuggaggaugacc

SEQ ID NO: 288420 - RNA, 64 nt, Human
gguaucaagaaaguccacugguuaguguacuaguccaucauagccuagaaaaugaucccuaucu

SEQ ID NO: 288421 - RNA, 64 nt, Human
uauuagcuguguuuuagugagaaugaauugcuauccaucauaauuuuugcuguugauuugaaca

SEQ ID NO: 288422 - RNA, 64 nt, Human
cugcauuuuuauugaacaguugacuguaucugacccaucauacuacuauacuucuggguugaac

SEQ ID NO: 288423 - RNA, 64 nt, Human
uuauauguuugcuuuagauuuucuucuguuuucaccaucauaacacuuaaguuaaaucaugaug

SEQ ID NO: 288424 - RNA, 64 nt, Human
uuccccuucuaaauaaauaaacuucgagaauaacccaucauaauccaaacaaaugaugccucaa

SEQ ID NO: 288425 - RNA, 64 nt, Human
uuacguugaugaaaaagaacauccugcccaggacccaucauacauauuuucaagaucuuauuua

SEQ ID NO: 288426 - RNA, 64 nt, Human
auagaaggagagcccaggccugcccucacgcucuccaucauaggcugacaccaagaagacucgu

SEQ ID NO: 288427 - RNA, 64 nt, Human
ugcagcgcgggaugugcucggugauggcuuugucccaucauagggggguguccccccagagaca

SEQ ID NO: 288428 - RNA, 64 nt, Human
cagccuccugcacccaaggcagugccugagaagcccaucauagacaagaaguagcaaacuguac

SEQ ID NO: 288429 - RNA, 64 nt, Human
ggaugcuucccucugcccucuuuccugccccuccccaucauaccugcacccaccccagccaggg

SEQ ID NO: 288430 - RNA, 64 nt, Human
gacccuacucuagaacuguguaccauccaauucgccaucauaaaggaaucuuccugcaucucga

SEQ ID NO: 288431 - RNA, 64 nt, Human
cuugcucuguugccugggcuggagaacaguggcaccaucauagcucacugcagccucaaacucc

SEQ ID NO: 288432 - RNA, 64 nt, Human
gucccccagcucuggugagucuuggcggcagcagccaucauaggaagggaccaaggcaaggcag

SEQ ID NO: 288433 - RNA, 64 nt, Human
ggauacacauguguauaucuguauauggaucuuaccaucauaauucauuuucuucauaucagca

SEQ ID NO: 288434 - RNA, 64 nt, Human
ugaugagggugaugggaacugaauaaaccauacggacuggcaguaacaagggcuuuuacuguuc

SEQ ID NO: 288435 - RNA, 64 nt, Human
gggcuagauguggaacuccauggaucuguguucugacuggcaccuuuggaaugaaagaaaagug

SEQ ID NO: 288436 - RNA, 64 nt, Human
cacacaguuacagagugaacacucuacuacaugugacuggcaguauuaagugugcuuauuuuaa

SEQ ID NO: 288437 - RNA, 64 nt, Human
ccagguauucuuaauugggaaaacagucaagugaccaucauagcuuuuuauucugaaaacauuc

SEQ ID NO: 288438 - RNA, 64 nt, Human
accaucaaaaugacuucucauaccaaagaauaagccaucauauuuuuucgguguugaaacaaca

SEQ ID NO: 288439 - RNA, 64 nt, Human
cuuaaagaugugaaugaguguuacaguugaaagcccaucauagguuuagugguccuaggagacu

SEQ ID NO: 288440 - RNA, 64 nt, Human
aagugcuuccguggccgacagucuggaaaugaauccaucauacauuagugccauagaguuuagu

SEQ ID NO: 288441 - RNA, 64 nt, Human
cuggucucuguccguccucugagcucaagcuaagccaucauaucccagugaccugcacauauac

SEQ ID NO: 288442 - RNA, 64 nt, Human
uaucaaacgaucuucuccacauaaccucucugugccaucauaagaauagcugcuuccgcccccg

SEQ ID NO: 288443 - RNA, 64 nt, Human
gucguucugucgcccaggcuggagugcagugccaccaucauagcucacugcagccuccaccucc

SEQ ID NO: 288444 - RNA, 64 nt, Human
gcucuguuacuguugcguagucuugaagagguacccaucauaaugacagcaucucccucugaag

SEQ ID NO: 288445 - RNA, 64 nt, Human
auauuuccccuuggucccaagccugauacuuuagccaucauaacucacuaacagggagaaguag

SEQ ID NO: 288446 - RNA, 64 nt, Human
gaaugucuguuaacuuucugagaacccuagugccccaucauauuaacugucaguauuuuggggg

SEQ ID NO: 288447 - RNA, 64 nt, Human
guucucacucuagguucuuauugccucccauuugccaucauaugagcuucgccauaaccaagua

SEQ ID NO: 288448 - RNA, 64 nt, Human
aucugagaggagucgggagucgagacucgagauuccaucauagcguaggugugugggguuggga

SEQ ID NO: 288449 - RNA, 64 nt, Human
ucaacauaucguuguuuaguuuucaagaauaaagccaucauaagaccucaugccacagaagaga

SEQ ID NO: 288450 - RNA, 64 nt, Human
aggucuugcugcugucagguguuaugcacuccauccaucauaacuguaugaaacacauuucaua

SEQ ID NO: 288451 - RNA, 64 nt, Human
cucaccucuuaaagaaaacccaccccguagauucccaucauacacuuccuucuuuuuuaaaaaa

SEQ ID NO: 288452 - RNA, 64 nt, Human
uaguguaauuaaugucagaaaacaccugucacuuccaucauagaacaucagaaaacucacaccc

SEQ ID NO: 288453 - RNA, 64 nt, Human
guguguguuaucagauaaagcacccuguaucacagacuggcaacaagaagaugguaccgugcau

SEQ ID NO: 288454 - RNA, 64 nt, Human
acuucacucccucacgcuaccccgucccccuccagacuggcaguuucaaggaugcaaauugcau

SEQ ID NO: 288455 - RNA, 64 nt, Human
ugaacugaacaaacuaucagaggaaaggaagugggacuggcacuauuugagguuaagacaaacu

SEQ ID NO: 288456 - RNA, 64 nt, Human
uuaauugacucuucauauggaaaaauaauaucucccaucauaauauaaaauauuuuucuuauga

SEQ ID NO: 288457 - RNA, 64 nt, Human
gcaagaccuucagucagaugucaaaccuuguauaccaucauagacuucauaguggagagaaacc

SEQ ID NO: 288458 - RNA, 64 nt, Human
cccucauggggcgccuaaggagacucaaguggacccaucauauaugggggcugggccucgggac

SEQ ID NO: 288459 - RNA, 58 nt, Human
gcacuuuccagggauacugagaagaaauccaucauaccauuaccucauccugugaggc

SEQ ID NO: 288460 - RNA, 64 nt, Human
acauuuuuuuaaacuugucuacuguaagauacugccaucauaaagcagagacuuacaugaguga

SEQ ID NO: 288461 - RNA, 64 nt, Human
aggcucgucaauuucagaccaaccucuuuucaacccaucauagcacguucaaggugugccuuuu

SEQ ID NO: 288462 - RNA, 64 nt, Human
gagaccacuuccaaagcaggugcugcauggcucaccaucauaugccccaaacaacugaaaguug

SEQ ID NO: 288463 - RNA, 64 nt, Human
ccagagaagaaucccagcguugcucaaagucuaaccaucauaaagacacugccugucuucuagg

SEQ ID NO: 288464 - RNA, 64 nt, Human
ucauuucuuaaaugacuaggaauuuuuuaauggaccaucauagggagggggugcuccucuuuuc

SEQ ID NO: 288465 - RNA, 64 nt, Human
uucugggaucaagaaagucuauuuaaauugauucccaucauaacugguggggcacaucuaacuc

SEQ ID NO: 288466 - RNA, 64 nt, Human
uucaagugaugcucaugauccuguuacugugugcccaucauagauuucuuuuuuuaguguugcc

SEQ ID NO: 288467 - RNA, 64 nt, Human
cagccuccugaguagcugagauuauaagcacgcaccaucauacccgacuaauuuuuguauuuau

SEQ ID NO: 288468 - RNA, 64 nt, Human
aaacagguuuuaaaaugaagugcuuuccagagaaccaucauauaaauaaagauuaauagaaaaa

SEQ ID NO: 288469 - RNA, 64 nt, Human
ccuggguccuggcccuccucccccaucugcacccccaucauagguagagaccccacccucccau

SEQ ID NO: 288470 - RNA, 64 nt, Human
ggauguucuggaugcuuuuuaauaauuaugcuucccaucauaacuggggagaaagggaagucag

SEQ ID NO: 288471 - RNA, 64 nt, Human
uucucugcuccccaggccugcucggugacugaccccaucauacccaaagugcaaucucacggcc

SEQ ID NO: 288472 - RNA, 64 nt, Human
auagcaucgaugcgagcucguggugggugcucaagacuggcauggacaucagcaucacgacagg

SEQ ID NO: 288473 - RNA, 64 nt, Human
cagagggccagaguggguaguggggaaugaaggggacuggcauguugguggguggucacugaga

SEQ ID NO: 288474 - RNA, 64 nt, Human
gggcuucggcuuggggagauggaucaagcucagagacuggcagugagagcccagaaggaccugu

SEQ ID NO: 288475 - RNA, 64 nt, Human
ugccagccucccacacugaggccaggucuaccccccaucauaccagcccccaggaccacuaccc

SEQ ID NO: 288476 - RNA, 64 nt, Human
aacaguuuugcuaacguucuaaaaugaagucguuccaucauaaucuaugaucuuguacagcacu

SEQ ID NO: 288477 - RNA, 64 nt, Human
uuccugguuuuuuccagccagcagccucuacacuccaucauaggacaucgagucccuccuccuc

SEQ ID NO: 288478 - RNA, 64 nt, Human
uaauuaguacuaacugauuuagagguuuccuuucccaucauauggaaugauguaaagaaaucag

SEQ ID NO: 288479 - RNA, 64 nt, Human
cugaugcuacuccguaauugcuuaggaguauuguccaucauaguauuuuagaacuagaaguaaa

SEQ ID NO: 288480 - RNA, 64 nt, Human
gccccuguucccccgcuggcagccacccccucccccaucauauccuuugccccaaggcugcuca

SEQ ID NO: 288481 - RNA, 64 nt, Human
acaaaagaggucgcuccagcccuaccacaggucugacuggcacugccuuuuguuugcccuugaa

SEQ ID NO: 288482 - RNA, 64 nt, Human
accugaagugaccuggaaucagugaagccaaagggacuggcagucugcccugcagggaguaccg

SEQ ID NO: 288483 - RNA, 64 nt, Human
agaaggcacagccuuacugaccagcacgcccacugacuggcaucugccggcuuugugcaggcag

SEQ ID NO: 288484 - RNA, 64 nt, Human
caguaaggaugagaccccacuguguacccuucuggacuggcaggauucucuugccaagcgcugc

SEQ ID NO: 288485 - RNA, 64 nt, Human
cgcuguucuugcuccaaagggcuccguggagagggacuggcagagcugaggccaccuggggcug

SEQ ID NO: 288486 - RNA, 64 nt, Human
gggugaucucugcugcauccaacaugggagcagagacuggcagcaggaggggggaacaugguga

SEQ ID NO: 288487 - RNA, 64 nt, Human
ucuaaagccugugcuaccaguacuaagaggggaagacuggcaauuugccaagcacuuggggauu

SEQ ID NO: 288488 - RNA, 64 nt, Human
uaucugaauuuucaaguuccccauuggaugaccagacuggcaaccauuucaaaucccagucuau

SEQ ID NO: 288489 - RNA, 64 nt, Human
gcugaccugggccaugaggagcacggaggagaaggacuggcagaucccaggugcugaagaugug

SEQ ID NO: 288490 - RNA, 64 nt, Human
ccagugaagacaccagauaggaccucugagaggggacuggcauggggggaucucagagcuuaca

SEQ ID NO: 288491 - RNA, 64 nt, Human
ccccguuugggacugugagguguuugaggguguggacuggcauccagcagccacuaacaaacac

SEQ ID NO: 288492 - RNA, 64 nt, Human
cuugugcccuggcuaccugucuccauucuaaccugacuggcacaucucagccuaaccaggagag

SEQ ID NO: 288493 - RNA, 64 nt, Human
gagucaccugcaagccccagggccugggggcagugacuggcaggugcagaugggcuguuucgug

SEQ ID NO: 288494 - RNA, 64 nt, Human
gccccuggaacacaaucacguaaguuuccuucuagacuggcauccugaugugucuugaguauaa

SEQ ID NO: 288495 - RNA, 64 nt, Human
auggccccucccccuggggagugcccugugugauggaggcgauacagccccuaccuucagagag

SEQ ID NO: 288496 - RNA, 64 nt, Human
gguacacaggguggaguagggagaagcugccccaggaggcgauguagugguggaaagaagaggc

SEQ ID NO: 288497 - RNA, 64 nt, Human
ccuggccguccaaauagaucccccaggguaccacggaggcgaaggaguuggagguguuuuccag

SEQ ID NO: 288498 - RNA, 64 nt, Human
uauuuauuuauugccuggccggugacucgggggaggaggcgacccugucaucugucccaccugc

SEQ ID NO: 288499 - RNA, 64 nt, Human
ccuucugcugggaaagcagcccugaggaggaagaggaggcgagggaaucagaaauugaggacag

SEQ ID NO: 288500 - RNA, 64 nt, Human
ugcgaggcugaggcaggagaauugcuugaaccugggaggcgaagguugcagugagccgagauug

SEQ ID NO: 288501 - RNA, 64 nt, Human
cgugguggcgggcuccuguaaucccagcuacuuuggaggcgaggcacgagaaucgcuugaaccu

SEQ ID NO: 288502 - RNA, 64 nt, Human
ugagcauggggcgcucccacucagaacucuccagggaggcgaugccagccuugggggguggggg

SEQ ID NO: 288503 - RNA, 64 nt, Human
cuuggcuguguucucugaucuaggccuucccagaggaggcgagcagaagcugugccacuuggaa

SEQ ID NO: 288504 - RNA, 64 nt, Human
ugcuuccgagagugugcagguggcccuuccccuuggaggcgagaagagagaaugugcugucuau

SEQ ID NO: 288505 - RNA, 64 nt, Human
cucgcgcuacaagaggccacucccagggacccagggaggcgauggccaccccagaggccaccuu

SEQ ID NO: 288506 - RNA, 64 nt, Human
cugcgagucuaauccgggagcggcugcugccagcggaggcgacagcagcguugggagcuccucg

SEQ ID NO: 288507 - RNA, 64 nt, Human
gaucagccccccgcccggcuagccgccccguccgggaggcgaggggcgccucugcccggcugcc

SEQ ID NO: 288508 - RNA, 64 nt, Human
cauaugcugacccugucucugugugguuggguugggaggcgaucagcagauaccauagugaacg

SEQ ID NO: 288509 - RNA, 64 nt, Human
ugguggcacaagggauggggacgcgagggggaggggaggcgaggaacaaggagaaggggcaacu

SEQ ID NO: 288510 - RNA, 64 nt, Human
guuucagcugaccagaaguggcaggaggacagguggaggcgagccagauuaggccuggaguugg

SEQ ID NO: 288511 - RNA, 64 nt, Human
gccccgccucccuaccauggugccaggggucucccuccgccaccuaggaaaggagggagaugug

SEQ ID NO: 288512 - RNA, 64 nt, Human
ugcauggucucuugggaaaagagagaugugucgccuccgccaguccgacugcccuccccacccc

SEQ ID NO: 288513 - RNA, 64 nt, Human; identical to SEQ ID NO: 278506

SEQ ID NO: 288514 - RNA, 64 nt, Human
uauaaugaugucuuagagggacugaaagguuuaaggaggcgaucaaacuaaaaugucuuaaugg

SEQ ID NO: 288515 - RNA, 64 nt, Human
guguaauccccaauguuagagguggggccggcugggaggcgacuggaucaugggugugaagccu

SEQ ID NO: 288516 - RNA, 64 nt, Human
ggcuggcccagaauggccuguugccauagcaacuggaggcgauggggcagugaacagaauaaca

SEQ ID NO: 288517 - RNA, 64 nt, Human
agcaauacaggagaggaugaagggaggagcuccaggaggcgagggaagagcccuagcagggcgg

SEQ ID NO: 288518 - RNA, 64 nt, Human
ucuucuguagggguauggugcgccgcaugacaugggaggcgauggggacgauggacagagacag

SEQ ID NO: 288519 - RNA, 64 nt, Human
cugcagcaacucccacgacuguuguacaagcucaggaggcgaauaaauguucaaacuguaugcu

SEQ ID NO: 288520 - RNA, 64 nt, Human
ggccaggaauguuugcaugaccuaccucaggaggggaggcgaggaagaguaauauuuagcauuc

SEQ ID NO: 288521 - RNA, 64 nt, Human
ugugggcagccccucccggcagccagggcuuccuggaggcgaugcagccaggccccugugggug

SEQ ID NO: 288522 - RNA, 64 nt, Human
ucacauacuguguuuuuauuuuaacaugggugagggaggcgaccugaucaggggaggugggggu

SEQ ID NO: 288523 - RNA, 64 nt, Human
aauaugcacagugauuacaaccuuuaaagcaagaggaggcgaguuaauuuggaugagugugauu

SEQ ID NO: 288524 - RNA, 64 nt, Human
ugcgguggcuccggccgguuguccuggcacacaaggaggcgaggcuaugcguucgaggccaacc

SEQ ID NO: 288525 - RNA, 64 nt, Human
uucccaagaacaaaccauuucugugcacauccuuggaggcgagaugagcuccuugcagagggcc

SEQ ID NO: 288526 - RNA, 64 nt, Human
ugggaggcugaagcaggagaauugcucaaaccugggaggcgaagauugcagugagcugaaauca

SEQ ID NO: 288527 - RNA, 64 nt, Human
gcacccugcaaaauuugaugccaggacacgcuuuggaggcgauuuaccuguuuucgcaccuacc

SEQ ID NO: 288528 - RNA, 64 nt, Human
ggaaggaaagaucaaggaaccaagcgccuccacgggaggcgagggaggcucuguaugaaacaga

SEQ ID NO: 288529 - RNA, 64 nt, Human
ugagagagaggaagacugcuggcagggaaaucgaggaggcgagacuagaacugcaccagcuucc

SEQ ID NO: 288530 - RNA, 64 nt, Human
aggcgacggaaacggaaagacucuuuucuccucucuccgccaccggcuucugaacagccuggcg

SEQ ID NO: 288531 - RNA, 64 nt, Human
ccagagagcuguccaaggcuguaucuucccagggcuccgccaagcaccgcuguccuuuccccac

SEQ ID NO: 288532 - RNA, 64 nt, Human
ugugggugcugauggcucggugcggauguuugaccuccgccaucuagaacacagcaccaucauu

SEQ ID NO: 288533 - RNA, 64 nt, Human
ccacccaccccucaccuugcaggcugccugcgugggaggcgaagucccaggacagcccagaggg

SEQ ID NO: 288534 - RNA, 64 nt, Human
ugggaggcugaggcaggagaaucacuugaacucgggaggcgaagguugcagugagccgagauuu

SEQ ID NO: 288535 - RNA, 64 nt, Human
aauuccaaaagccugagaagagagaaguggagggggaggcgagugugugaauaaaggcucccau

SEQ ID NO: 288536 - RNA, 64 nt, Human
accggacgggugguccggagggaggcuggagcggggaggcgaggagggggcugugaguccucag

SEQ ID NO: 288537 - RNA, 64 nt, Human
accuugacagaaaacuacuuugagucuacaaagaggaggcgacaaguccaucagcagaaaguca

SEQ ID NO: 288538 - RNA, 64 nt, Human
agugaccccaagucuguuucccucagcugcauaaggaggcgauauaguuugaauauuugucccc

SEQ ID NO: 288539 - RNA, 64 nt, Human
ugugguggcucaugccuguaaucccagcacuuugggaggcgaggcggggguggaucacaagguc

SEQ ID NO: 288540 - RNA, 64 nt, Human
ggugcccaggcagacggguucagccugcagaacuggaggcgaccugugaaacccacccgggcac

SEQ ID NO: 288541 - RNA, 64 nt, Human
cgucauccaggcugucaacaccagccccgagcggggaggcgaggaggcccugcaugccuuccug

SEQ ID NO: 288542 - RNA, 64 nt, Human
cgccugcccaggggccguggugacucacgggcagggaggcgacaucaggcugguucugccacug

SEQ ID NO: 288543 - RNA, 64 nt, Human
uggaaaggaguugccucuucuccaaucagagcguggaggcgaguugggcgacuucaagggccug

SEQ ID NO: 288544 - RNA, 64 nt, Human
auuuuguuagauuuugccuuucuuuuggaaggaaggaggcgauauucuggauuauaaaaaugaa

SEQ ID NO: 288545 - RNA, 64 nt, Human
cuggacaaccagaggagauacagcugcuuagaaaggaggcgacuccuagauccagggauagccc

SEQ ID NO: 288546 - RNA, 64 nt, Human
ccugugacugcagcaucuucccaccagugcugcaggaggcgacagaagucaaauauauccugca

SEQ ID NO: 288547 - RNA, 64 nt, Human
gguguguguuagggacccagggcauugggggaagggaggcgaaggccugagguuuuccaucuuc

SEQ ID NO: 288548 - RNA, 64 nt, Human
cucaagccccgcuucuaccagccuguggaguucaggaggcgagacauccuggccuccuuugaga

SEQ ID NO: 288549 - RNA, 64 nt, Human; identical to SEQ ID NO: 278507

SEQ ID NO: 288550 - RNA, 64 nt, Human
cuuaguuucuucaugucaccuuucguccugguuccuccgccacucuuccucuuggggacaacag

SEQ ID NO: 288551 - RNA, 64 nt, Human; identical to SEQ ID NO: 278508

SEQ ID NO: 288552 - RNA, 64 nt, Human
ccuaagcccuuucuaacgagagucucaaacaagcggaggcgagggccaauucaaccccauucuu

SEQ ID NO: 288553 - RNA, 64 nt, Human
aaaacaagcugauaugugccuguuucuggacaauggaggcgaaagaguggaauuucauucaaag

SEQ ID NO: 288554 - RNA, 63 nt, Human
agcccucucaccccuacuaggcucagcccagguggaggcgagaugagcuggcgcagccccgcc

SEQ ID NO: 288555 - RNA, 64 nt, Human
acauuugccgcaguggauguguacugagggggcuggaggcgaagggugggagcauagcauagga

SEQ ID NO: 288556 - RNA, 64 nt, Human
ccauagagugggcuuugccaguugcuguugcacaggaggcgagaacagcacacuucaaccccag

SEQ ID NO: 288557 - RNA, 64 nt, Human
accgcacugucugccccaaugucuaacaaaggccggaggcgacucuuccugcgaggucucagag

SEQ ID NO: 288558 - RNA, 64 nt, Human
uagagcaggccccgaacuguggucgccaggcccaggaggcgacugcaugguggagagggagcug

SEQ ID NO: 288559 - RNA, 64 nt, Human
aggguggggagagacgggcccuggugguggcucgggaggcgaagcguuguccucagccccgcgu

SEQ ID NO: 288560 - RNA, 64 nt, Human
uuccagaugagccagugccucgcaugauaccagaggaggcgagggacagagacagcaaggcaga

SEQ ID NO: 288561 - RNA, 64 nt, Human
cgucccggcgcuuuccaggagccccaggcccggaggaggcgaagcccgcagagcaaagguggaa

SEQ ID NO: 288562 - RNA, 64 nt, Human
gagagaacccaguucuagguacugucugggccugggaggcgagagcagugcccaggggacuucu

SEQ ID NO: 288563 - RNA, 64 nt, Human
uccauuuugagcaccucugccaggcugcagaccuggaggcgaagggaguguggaagaggagggu

SEQ ID NO: 288564 - RNA, 64 nt, Human
caguggauucuuggucaggugugcccacagaugcggaggcgaggugagugauuccaucauuuca

SEQ ID NO: 288565 - RNA, 64 nt, Human
cagcccagccugcucagagaagcuggcaggacugggaggcgacagaugggccccucuuggccuc

SEQ ID NO: 288566 - RNA, 64 nt, Human
cgaggggccuuggccaggacuggcccuguggccaggaggcgagaagguggcuguucccggauug

SEQ ID NO: 288567 - RNA, 64 nt, Human
cugcacacgacagcagauucgcuguccccucguuggaggcgaauggucggaccccgaguggcgg

SEQ ID NO: 288568 - RNA, 64 nt, Human
ccaaacaccacagccuucuccagagccggcacugucccggcaaccaggggugccccaggcuagc

SEQ ID NO: 288569 - RNA, 64 nt, Human
gcacggucguauccaagggagggaucauggcaugggaggcgacucaaagacuggcgugugugga

SEQ ID NO: 288570 - RNA, 64 nt, Human
ccauagucgagcucucccgcugggggcacugcggggaggcgaggccucgggaagcugaauuuuc

SEQ ID NO: 288571 - RNA, 64 nt, Human
cgugggacagaacuccugcccacccuaccccgagggaggcgaacccgcacuuccaggcuuggga

SEQ ID NO: 288572 - RNA, 64 nt, Human
aucaaagccuuaaccuuugcuuuaugcucuugugggaggcgacgggggggcaggcgggagcagg

SEQ ID NO: 288573 - RNA, 64 nt, Human
guggaugugacaacaacuuccaaauuggcucuuuggaggcgagaggaaggggagaacuuggaga

SEQ ID NO: 288574 - RNA, 64 nt, Human
cuuguuggcugccaguaggggcgggaggaaaggcggaggcgagcccuggaggagggaggccaca

SEQ ID NO: 288575 - RNA, 64 nt, Human
ggcccaccccuccccacucccugaucccguagguggaggcgaugggucacgagccauguuaagc

SEQ ID NO: 288576 - RNA, 59 nt, Human
cacuagagaagagucugugagucacuugaggaggcgagucuagcagauucuuucagagg

SEQ ID NO: 288577 - RNA, 64 nt, Human
ccuggagggcuccagaccuuucugagcccugcuuggaggcgagcauuuucacugcuaggacaag

SEQ ID NO: 288578 - RNA, 64 nt, Human
aauuuuucauggagggaaaauugcuuccucugugggaggcgaaucuggcugcaaaagccucagu

SEQ ID NO: 288579 - RNA, 64 nt, Human
acauaaccuauauaccuccagcagcuggacauggggaggcgacaguccuaucuagacaucauac

SEQ ID NO: 288580 - RNA, 64 nt, Human
ccuggcccuccuggugcccacucccgccagccccugccucgaggacugauacugcagugacugc

SEQ ID NO: 288581 - RNA, 64 nt, Human
caugguccucauaucucccaugggaauccuguccugccucgaaggagcagccugggcagccauc

SEQ ID NO: 288582 - RNA, 64 nt, Human
caggucuccaaguggaacccgguccagacagggcugccucgacuucaccuuucccccuaacuuc

SEQ ID NO: 288583 - RNA, 64 nt, Human
gccucagcccuagacucccuccuccugccacuggugccucgaguagccauggcaacgggcccag

SEQ ID NO: 288584 - RNA, 64 nt, Human; identical to SEQ ID NO: 278522

SEQ ID NO: 288585 - RNA, 64 nt, Human
guucucucagggacucucagggcagcuccugccacuccgccagggccagcaugccaguccaggc

SEQ ID NO: 288586 - RNA, 64 nt, Human
gcccagccaccagcuuggggcuggaugaaggggucuccgccagcucagcuggagccggagccgg

SEQ ID NO: 288587 - RNA, 64 nt, Human
uggccugcugggaaccccgcagcccgugaagcagugccucgaggcaccggcgcugcagguacuu

SEQ ID NO: 288588 - RNA, 64 nt, Human
uggagggaaggacauuacugaaccugucuugcugugccucgaaacucuggagguuggagcauca

SEQ ID NO: 288589 - RNA, 64 nt, Human
gcaaaccaaggggguuuauagucaucugucgcauugccucgaguugcaguaauugaaaaaaugc

SEQ ID NO: 288590 - RNA, 64 nt, Human
caugguggcccaccuggccugguuguccaagcugugccucgacacauccucauccccagcaugg

SEQ ID NO: 288591 - RNA, 64 nt, Human
ugccucgcuggggcggucuuggaggccuggucucugccucgacgggagauccccgaucacuggc

SEQ ID NO: 288592 - RNA, 64 nt, Human
uucuccuaauacaacccguaauagcauuuuugccugccucgaggcagaguuucccgugagcaau

SEQ ID NO: 288593 - RNA, 64 nt, Human
ccggaaugagccuucgacccugaaauccuuggggugccucgaggacgacuggccgaaaagccgc

SEQ ID NO: 288594 - RNA, 64 nt, Human
aaaccgaaacgugaccacgcacaaaggcagucacugccucgaggggugcagaccgcagaauuuu

SEQ ID NO: 288595 - RNA, 64 nt, Human
uccuccuaggcgcucagaggccgcucugggggguugccucgaguccccccaccccuccccaccc

SEQ ID NO: 288596 - RNA, 64 nt, Human
gaccuuaaaaaagcaagaaggccaugaccaucccugccucgaaacuugcaagucacuugucuga

SEQ ID NO: 288597 - RNA, 64 nt, Human
ccauccuguucuauggaauaaagcgucgccucucugccucgaaccagucaaauggaguauugcg

SEQ ID NO: 288598 - RNA, 64 nt, Human
ucuuugggccaggcauggccuaguaaguacaccaugccucgaaaauaaguccagaagcacugga

SEQ ID NO: 288599 - RNA, 64 nt, Human
cgaggugcccgcucagcucagcaagguucucaacugccucgaguacccaccagaccaagaaggc

SEQ ID NO: 288600 - RNA, 64 nt, Human
cuggucuugaacuccugaacucaagugauccaccugccucgaccucccaaaguacugggauuac

SEQ ID NO: 288601 - RNA, 64 nt, Human
acgggacugcuugcugccucuccuuucuuccucuugccucgagguggaagcuguauagagcccg

SEQ ID NO: 288602 - RNA, 64 nt, Human
agacgcuggccucagacacagacagcagucuugaugccucgacgggaccccuugaaggcugucg

SEQ ID NO: 288603 - RNA, 64 nt, Human
gccagccucuggguccagccagagccccuggcuucuccgccacccacacccuucccacccugcu

SEQ ID NO: 288604 - RNA, 64 nt, Human
ccugcauccccacaugcggggcagaggcccuucucuccgccaaaugucuacacaguauacacag

SEQ ID NO: 288605 - RNA, 64 nt, Human
uuucccccacccuccuuaccccgcugggcuaggucuccgccagggcuggccucaguuucuccuc

SEQ ID NO: 288606 - RNA, 64 nt, Human
guuuuggaaggauuccuuuuucuguagaauacuuugccucgauauauaagcauacagaugcacu

SEQ ID NO: 288607 - RNA, 64 nt, Human
aaagcaauaacucaccaaagcucaacgcugccccugccucgaccuccaugggucucuucguguu

SEQ ID NO: 288608 - RNA, 64 nt, Human
ugauggcaacacugaaggaacaguuacccugcuuugccucgaaagugucaucaauuuguaauuu

SEQ ID NO: 288609 - RNA, 56 nt, Human
gcuuugccacugccgccuagacuugcugccucgacacgugggcuccccucuuccuc

SEQ ID NO: 288610 - RNA, 64 nt, Human
cuggucuccaacuccugaccucaggugauccaccugccucgaccucacaaagugcugggauuac

SEQ ID NO: 288611 - RNA, 64 nt, Human
ucagaacuaacccaggacucaguccugcuucuuuugccucgagugauuuuccucuguuuuucac

SEQ ID NO: 288612 - RNA, 64 nt, Human
caucggggugcccgcgauggcccucaugaagccaugccucgacggcauucaggaagcccugcaa

SEQ ID NO: 288613 - RNA, 64 nt, Human; identical to SEQ ID NO: 288610

SEQ ID NO: 288614 - RNA, 64 nt, Human
gauugcucccuccuguguggacguugccuggcccugccucgaugccucucuggcgcaucaccug

SEQ ID NO: 288615 - RNA, 64 nt, Human
ucagggcuacagcaguagggaggucagugcuucgugccucgauugaaggugaccucugccccag

SEQ ID NO: 288616 - RNA, 64 nt, Human
ccugcugagccugcccccuggauuggcuguaauuugccucgaaguucagcaguucaucuucaug

SEQ ID NO: 288617 - RNA, 64 nt, Human
guuccaguccaugugcauccugagcugugugaucugccucgaggcuaugaucugagcaagcagg

SEQ ID NO: 288618 - RNA, 64 nt, Human
uaaugaguggacggcagacagcuauauuuaguggugccucgacacucacgaaccgccagcgugg

SEQ ID NO: 288619 - RNA, 64 nt, Human
ugcugauaaugcugcagcccugcugguuugggcuugccucgaagauuuuauuaaggcacgaaga

SEQ ID NO: 288620 - RNA, 64 nt, Human
agccuggcauccccagucuuugccuucuuccagcugccucgacacagcacuguggccugucccu

SEQ ID NO: 288621 - RNA, 56 nt, Human
agaugggggaggagccauagagccucugccucgaugccguuuugcccccgcucuuu

SEQ ID NO: 288622 - RNA, 64 nt, Human
aggcugagcccuguacccaccccagcacagccaccuccgccagaccccguggcucugggagagc

SEQ ID NO: 288623 - RNA, 64 nt, Human
cugcaucuugccccaauucuuaggauuucuuuuccuccgccacugcagugauuguuagagguag

SEQ ID NO: 288624 - RNA, 64 nt, Human; identical to SEQ ID NO: 278524

SEQ ID NO: 288625 - RNA, 64 nt, Human
uagaucccuguguuccagcguggagggacaaucgugccucgauggaugcgagugcggcggucuu

SEQ ID NO: 288626 - RNA, 64 nt, Human
uggcaaacaaaacccgagcugagcaucaggaccuugccucgaauugucuuccaguauuacggug

SEQ ID NO: 288627 - RNA, 64 nt, Human
ggcuggucucaaacuccuaaccucgugauccgccugccucgaccucccaaagugcugggauuac

SEQ ID NO: 288628 - RNA, 64 nt, Human
acugcaaccuccaccuuccugguucaagcgauucugccucgaccucucaaguagcugggauuac

SEQ ID NO: 288629 - RNA, 64 nt, Human
gcugguccagcugugcccagaucugucacugaugugccucgaaagauccgguguuuguggcucc

SEQ ID NO: 288630 - RNA, 64 nt, Human
gguaguccucugcgucagggagcacuuuuuuguuugccucgagacuacucauuagcgcacuggc

SEQ ID NO: 288631 - RNA, 64 nt, Human
gggcugcacugacauugaugccugggggaccuuuugccucgaggcugagcuggaaaaucuugaa

SEQ ID NO: 288632 - RNA, 64 nt, Human
ggauggggugggggcgggcuccccuagggacaggugccucgagugcccgugccuggggucccgc

SEQ ID NO: 288633 - RNA, 64 nt, Human
ggucccaaggucccugggaggacugggccccucaugccucgagcuuggcaaccgaaaacccgag

SEQ ID NO: 288634 - RNA, 64 nt, Human
ggucugcauaaugaucccauuucagccugugcucugccucgauuguuguguuggacauuccggu

SEQ ID NO: 288635 - RNA, 64 nt, Human
gguugaugaucuuugcagacaggcaagcaccuccugccucgaacuggcugcaaaggguaucagg

SEQ ID NO: 288636 - RNA, 64 nt, Human
cuggucaccagauuguuuuguaaugcccgccccuugccucgauauugccaguuucuugugcaau

SEQ ID NO: 288637 - RNA, 64 nt, Human
uggaagaggacccaagagagugccgugcugaggcugccucgaggucacugccuuccggagcugc

SEQ ID NO: 288638 - RNA, 64 nt, Human
cauccaggcaccugccuauaccccacaucccuucugccucgaggccaagaugccuaaaaaagcu

SEQ ID NO: 288639 - RNA, 64 nt, Human
aagucuuuuugaaguguuauuucauccagggaaaugccucgagccauagagccugaaaucaucu

SEQ ID NO: 288640 - RNA, 63 nt, Human
aggagccaccucuccuuuaauuuauuucuucaaugccucgaccugccgcagggguccgggauu

SEQ ID NO: 288641 - RNA, 64 nt, Human
cccucugucuggggcacuggcacccacagcaggacuccgccagucugaugccaggacugaauaa

SEQ ID NO: 288642 - RNA, 64 nt, Human
ggcucuugggcaaacguccuuccucacggggcgccuccgccaagccggcccagcugcaccccuc

SEQ ID NO: 288643 - RNA, 64 nt, Human
gggacaccccccgccccccaccuuugggaucagccuccgccauuccaagucaacacucuucuug

SEQ ID NO: 288644 - RNA, 64 nt, Human
gacagugaaagagaucugaccuaacuaucuaucuugccucgaaacugcccuuggucguuccuga

SEQ ID NO: 288645 - RNA, 64 nt, Human
ugcccggucagcgcagccccagcccgcccaccccugccucgaguuaguuuuacaauuaaaacau

SEQ ID NO: 288646 - RNA, 64 nt, Human
ccccagagcaauaaagucagcuggcuuucucaccugccucgacugggccucccuuuuugaaacg

SEQ ID NO: 288647 - RNA, 64 nt, Human
cgcuggauccuagauccccaaccccagauccccaugccucgagcccuggaucuccaagcucagc

SEQ ID NO: 288648 - RNA, 64 nt, Human
ugaggcaacuccuuuccccgcuucagcccucaacugccucgaguccugugaugguccagggaau

SEQ ID NO: 288649 - RNA, 64 nt, Human
gguggcgggaccguucccaggagguaccagcaccugccucgaucuccucugagccucuucugcc

SEQ ID NO: 288650 - RNA, 64 nt, Human
ggcuggucucgaacuccugaccucgugauccgccugccucgacuucccagagugcugggauuac

SEQ ID NO: 288651 - RNA, 64 nt, Human
acacaugcagccccuggagggcagccucuuccugugccucgauggggugggugggagggcaucu

SEQ ID NO: 288652 - RNA, 64 nt, Human
gaaggccggguggagcccauccaugcugugguguugccucgagggaagucgcuggaccagugug

SEQ ID NO: 288653 - RNA, 64 nt, Human
uugcaggcggcccucagugcauccccacgaccccugccucgagggccgccugccuuagcaaugg

SEQ ID NO: 288654 - RNA, 64 nt, Human
cgccuggguuucuuggccccagcugcccagcaggugccucgauucccugcccuugugaccuccc

SEQ ID NO: 288655 - RNA, 64 nt, Human
ccugugucucccuaauauguaucaaagcaagcugugccucgaccaccuugggcacauauccuca

SEQ ID NO: 288656 - RNA, 64 nt, Human
aguaguguaaacugcgucucggaugucugucuuuugccucgaagccacgauggaucgcugguuu

SEQ ID NO: 288657 - RNA, 64 nt, Human
gguguggcucugcccuggaaagggggugaccucuugccucgaggggcccagggaagccugggug

SEQ ID NO: 288658 - RNA, 64 nt, Human
uucuacaucagaucaaaacacuaaguugguguacugccucgaccuuuuuucagcucauccugga

SEQ ID NO: 288659 - RNA, 64 nt, Human
agugggcuugauucugcaguaaaucuuuuacaacugccucgaaacacagaaaccuuuuuaaaaa

SEQ ID NO: 288660 - RNA, 64 nt, Human
cccauaacgggguggcccugccgcugacucaggucuccgccaugcacgcguggacucucggaug

SEQ ID NO: 288661 - RNA, 64 nt, Human; identical to SEQ ID NO: 278538

SEQ ID NO: 288662 - RNA, 64 nt, Human
ugauuauuucuugcagaaucaccacacgagaccaucccggcagucaugguuuugcuuuaguuuu

SEQ ID NO: 288663 - RNA, 64 nt, Human
uaagccaagaucgugccauugcacuccagccugggugacagagcgagacuccaucucaaaaaaa

SEQ ID NO: 288664 - RNA, 64 nt, Human
ugagccaagaucgcgcuauugcacuccagccugggugacagagcaagacucugccucagaaaaa

SEQ ID NO: 288665 - RNA, 64 nt, Human
uaaaauuaagucauugaugcugcuguuacagagugugacagaggauccaugucugugacacagg

SEQ ID NO: 288666 - RNA, 64 nt, Human
ugagccgagaucacgccacugcacuccagccugggugacagagcgagacucuggcucauaaaau

SEQ ID NO: 288667 - RNA, 64 nt, Human
ugcccacuucaaacaugguguguccuuuggagcugugacagaggugccuguucugacuuagaac

SEQ ID NO: 288668 - RNA, 64 nt, Human
ucugagggcccagggcccgggcacccacaagcccgugacagaugccaacuucccacacggcagc

SEQ ID NO: 288669 - RNA, 64 nt, Human
auguaaacucaucugcagaaaauguaaacgucaugugacagaucuaacagggcaagugguacag

SEQ ID NO: 288670 - RNA, 64 nt, Human
gcaagggcuggagccccgccugggucagacgccagugacagaagcugugaguggaagacgaggg

SEQ ID NO: 288671 - RNA, 64 nt, Human
gcccugagcaucacccaagugccugaugccucaggugacagaaggcaggacguuccaugccgag

SEQ ID NO: 288672 - RNA, 64 nt, Human
agacuccguuuugugccacugcacuccagccagggugacagagugagacucugucucaaaaaaa

SEQ ID NO: 288673 - RNA, 64 nt, Human
agggguggggagccaaggguggacuuuaagcauggugacagaugguauuuugggcagaaagcuc

SEQ ID NO: 288674 - RNA, 64 nt, Human
gccaauuuucuucaucuuugccauauggaggacugugacagacuuuggacaguggccucuugag

SEQ ID NO: 288675 - RNA, 64 nt, Human
cgauggagauggacuaggcuggcccgggaggggagugacagagggacguucuaggagcaauugg

SEQ ID NO: 288676 - RNA, 64 nt, Human
agccugucccagucucagcagggauguccuccaggugacagaggguggcaaggugacugacaca

SEQ ID NO: 288677 - RNA, 64 nt, Human
gagccaugguugcaccacugcucuccaggcuugagugacagagcaagacuguaucucaaaggaa

SEQ ID NO: 288678 - RNA, 64 nt, Human
uggcgggggcggaggggugguucuuuuccuucuccuccgccagaggccacgggcgcccuuguuc

SEQ ID NO: 288679 - RNA, 64 nt, Human
agacuuggggcgagugagcggguggcaggccgggcuccgccacugcaugcucccgccggaccga

SEQ ID NO: 288680 - RNA, 64 nt, Human
gguuuccguggccuguuugcagcuagacauugaccuccgccauugagcuccacgguuuacagac

SEQ ID NO: 288681 - RNA, 64 nt, Human
ugagccgagauugcaccacugcacuccagccugggugacagagcaagugagacccugucucaaa

SEQ ID NO: 288682 - RNA, 64 nt, Human
cauuuucucugcagcuuauucuugccaugcuuaggugacagaaguuuguuaaguaccauccuug

SEQ ID NO: 288683 - RNA, 64 nt, Human
ugagccuugaucacgccacugcacuccagccugggugacagagcaagacuccaucucaaaaaaa

SEQ ID NO: 288684 - RNA, 64 nt, Human
gcaagccgagauugugccacuguacuccagccuggugacagagcgagacucccucucaaaaaaa

SEQ ID NO: 288685 - RNA, 64 nt, Human
ggugcuguuaaguauuuguaccuaacagucuugugugacagaugaaaauaggauguaacauaau

SEQ ID NO: 288686 - RNA, 64 nt, Human
ugagccgagauuaugccacuguacuccagccugggugacagagugacacucugucucaaaaaaa

SEQ ID NO: 288687 - RNA, 64 nt, Human
ggagccgagauagugucacugcacuccagccugggugacagagcgagacuccgucucaaaaaac

SEQ ID NO: 288688 - RNA, 64 nt, Human
ugcagccggcacagggucugcucuuucucugccagugacagacaggcucuuagcagcuuccaga

SEQ ID NO: 288689 - RNA, 64 nt, Human
gagacuuagcauguucuugggugaugugagucaugugacagaaguacagacauaacuccaaugu

SEQ ID NO: 288690 - RNA, 64 nt, Human
uguucacuccuuuuuucccagguauacugaaggggugacagagagaggucuucauggcagacca

SEQ ID NO: 288691 - RNA, 64 nt, Human
cuccagggcuuccagcacggggccucugccuggugugacagauaccggcuggccucacuugaug

SEQ ID NO: 288692 - RNA, 64 nt, Human
agcaaauugcacuguacuuuucacuccagccugggugacagagcaagacucccgucucgggggc

SEQ ID NO: 288693 - RNA, 64 nt, Human
ugagucaagaucgcgccacugcacuccagccugggugacagagcaagacucugucuuaaaaaaa

SEQ ID NO: 288694 - RNA, 64 nt, Human
ugagccgagauugcgccacugcacuccagccugggugacagagcgacacucggucucaaaaaac

SEQ ID NO: 288695 - RNA, 64 nt, Human
gaggcugcuuacucaacuugugucuuaauuaaaagugacagaggaaaccacggaggcugugugu

SEQ ID NO: 288696 - RNA, 64 nt, Human
guguguguauguguguguuuauauguguaugugugugacagaaaaaucuguagagaagaggcac

SEQ ID NO: 288697 - RNA, 64 nt, Human
cauccucaucugagcggggcuccucgcccucccacuccgccaccuccguccacaccucggucug

SEQ ID NO: 288698 - RNA, 64 nt, Human
ugagccaugaucgugccacuacacuccagccugggugacagagugagauccugucucaaaaaaa

SEQ ID NO: 288699 - RNA, 64 nt, Human
ugagcugucauugugccacuauccuccaguaugggugacagagugagaccuggucucuaaaaaa

SEQ ID NO: 288700 - RNA, 64 nt, Human
uguaugccaaaauuaguuguuuaagugaaguuuugugacagaaaaaagguuguuuuaauaucua

SEQ ID NO: 288701 - RNA, 64 nt, Human
cccagaggagauagugcagaaauuccgcaaggcugugacagacuucaccucggaggucaccuau

SEQ ID NO: 288702 - RNA, 64 nt, Human
gagcuuguaauugcaccacugcacuccagccugggugacagagcaagacccugucuuaaaaaaa

SEQ ID NO: 288703 - RNA, 64 nt, Human
ggagccuaagcugccugcuacugggcuuuacauggugacagacauuuccgugggauagggaaga

SEQ ID NO: 288704 - RNA, 59 nt, Human
uuuaucucugcccaguauaguaugcuccagugacagauggauuagggugugucauacua

SEQ ID NO: 288705 - RNA, 64 nt, Human
uauuuucaacauaaagaaaagacgaauauuuaaggugacagauaucccaacuacgcugauuuga

SEQ ID NO: 288706 - RNA, 64 nt, Human
guggugccaccacugcagacuauugugguacuuugugacagaagacauguacacacacaccaca

SEQ ID NO: 288707 - RNA, 64 nt, Human
ucaacugagaucauaccacuucauuccagccugggugacagagcaagacucugucucaaaaaaa

SEQ ID NO: 288708 - RNA, 64 nt, Human
ugagccaaaaucaugccaauguauuccagucugggugacagagugagacucugucucaaaaaau

SEQ ID NO: 288709 - RNA, 64 nt, Human
ugagcuauauugguuuuuuuucuaaauaguaguagugacagauaacauuuauugagugcuugcu

SEQ ID NO: 288710 - RNA, 64 nt, Human
ugauuauugaggacagaaggcucagaaacaguuugugacagaaaaugcaguguuucauuuuuca

SEQ ID NO: 288711 - RNA, 64 nt, Human
uuuggcuuuugcuggaagguccaggauggaccaugugacagaaguccacgggcacccucuguag

SEQ ID NO: 288712 - RNA, 64 nt, Human
ugaguggagaucgcaccacugcccuccagccuaggugacagaaugagacucuaucucaaaaaaa

SEQ ID NO: 288713 - RNA, 64 nt, Human
ugaaccgagaucaugccaccgcacuucagccugggugacagagaaggacuccgucucaaaaaaa

SEQ ID NO: 288714 - RNA, 64 nt, Human
caccccaaguccaagaacaaaugccagccacguccuccgccacuuggagagaugagaacccagu

SEQ ID NO: 288715 - RNA, 64 nt, Human
gagggccccucagcagaggaaggggaguccccuccuccgccaccgagaguccugugcuucggaa

SEQ ID NO: 288716 - RNA, 64 nt, Human
auucacaguaccaugcgaguagcccacaguuaauucccggcagauucuuuggcuguguuuuauc

SEQ ID NO: 288717 - RNA, 64 nt, Human
ugagcugauaucaugccccuguacuccagccugggugacagagcaagacucugucucaaaaaau

SEQ ID NO: 288718 - RNA, 64 nt, Human
uagcacaguguauugggagaaagggaaauuucgggugacagauugaucacccuggcugacaugu

SEQ ID NO: 288719 - RNA, 64 nt, Human
uguuucgacagccaaguuuucuucaaaauauuaugugacagaauacgacucaauucaccggcua

SEQ ID NO: 288720 - RNA, 64 nt, Human
ugagccgagcuugcacuacugcacuccagccugggugacagaguaagacuccaugucaaaaaaa

SEQ ID NO: 288721 - RNA, 64 nt, Human
ugagcugagaucacaccaccgcacuccagccugggugacagagugagacucugucucaaaaaaa

SEQ ID NO: 288722 - RNA, 64 nt, Human
ugagucgagaucgugccacuggacuccagccugggugacagagcgagacuccauuucaaaaaaa

SEQ ID NO: 288723 - RNA, 64 nt, Human
ugagccaagauugugccacugcacuccagccugggugacagagcaggacccugucucuauuuua

SEQ ID NO: 288724 - RNA, 64 nt, Human
ugagccaagauagugccacugcacuucagccugggugacagagugagacucugucucaaaaaaa

SEQ ID NO: 288725 - RNA, 64 nt, Human
agaacauugucaggcacuucuagguauuggacaagugacagaaacugaucauccauauucaaaa

SEQ ID NO: 288726 - RNA, 64 nt, Human
auuucuuuguuucuccagaguguuauggaaagcagugacagaugugcuuuaucaucuccaucuu

SEQ ID NO: 288727 - RNA, 64 nt, Human
guagaaaauagaagucauucuuauuuuagaaaaagugacagaagcaguccaguaagauuauaug

SEQ ID NO: 288728 - RNA, 64 nt, Human
ugagccauguucacaccgcugcacucaagcuugggugacagaacaagaccccgucucaaaaaaa

SEQ ID NO: 288729 - RNA, 64 nt, Human
guuaucccuucccauuauauugaaguugagaaaugugacagaggcauuuagaguauggacuuuu

SEQ ID NO: 288730 - RNA, 64 nt, Human
aaauuguauuacaguagaccgcugacguucccaagugacagauccagggccuuucaaacauccc

SEQ ID NO: 288731 - RNA, 64 nt, Human
ugaaccaagauugcaccacugcacuccagccggggugacagagugagacuccgacugaaaauaa

SEQ ID NO: 288732 - RNA, 64 nt, Human
augaugaggccgagguaaaagagacaucugcagugugacagaagggagcaugagaagcauggcu

SEQ ID NO: 288733 - RNA, 64 nt, Human
ccagacucagcuggaagucuaccugcuggacagccuccgccaagaucuacaggacaaagggagg

SEQ ID NO: 288734 - RNA, 64 nt, Human
ccuacguauccugcagcgggaggaggaggagcaccuccgccagauccugcagaaguacuccuau

SEQ ID NO: 288735 - RNA, 64 nt, Human; identical to SEQ ID NO: 278457

SEQ ID NO: 288736 - RNA, 64 nt, Human
ugagcuaaaauugugccacugcacuccagccugggugacagaggaagacuccgucucacaaaaa

SEQ ID NO: 288737 - RNA, 64 nt, Human
gaggcugagguugcgccacuacacuccagccugggugacagagugagacucugccucaaaaaaa

SEQ ID NO: 288738 - RNA, 64 nt, Human
cccuuguacagccaaaauaauguauauauggaaagugacagacaaauucucuaaucucuuuggu

SEQ ID NO: 288739 - RNA, 64 nt, Human
aagaaguuaguguauauauaaacacaaauaauuagugacagauucauaaaaaauugaauguugu

SEQ ID NO: 288740 - RNA, 64 nt, Human
aaaaauaaaauguuucaaggauuccugaccauaagugacagagaaagagaguuguggguuuaga

SEQ ID NO: 288741 - RNA, 64 nt, Human
caguggcaaaggauccagauagccuagggugagggugacagagggacagugggcuaugccacua

SEQ ID NO: 288742 - RNA, 64 nt, Human
ugagccgagauugcaccacugcacuccagccugggugacagagcaagacuccaucucaguaaau

SEQ ID NO: 288743 - RNA, 64 nt, Human
aacacuaaagaauaauauauaagcacacaaauuggugacagaauuucaauuacgugaacgcauc

SEQ ID NO: 288744 - RNA, 64 nt, Human
ugaaccaagaucacaucacugcacuucaaccugggugacagagcaagacccugucucaaaaaca

SEQ ID NO: 288745 - RNA, 64 nt, Human
auuaacaaaaugguuuggagaucucuucuuuugugugacagaagucagcaaccaaauuucaucu

SEQ ID NO: 288746 - RNA, 64 nt, Human
ugcagcaggggagggacaaacaaccaagcuaugggugacagaggcucucuccuggugccugcac

SEQ ID NO: 288747 - RNA, 64 nt, Human
guuccgugcuugucccuguggaaguaucuugguugugacagagucaagggugugugcagcauug

SEQ ID NO: 288748 - RNA, 64 nt, Human
ugagcugagaucgcaucauugcacugcagucugagugacagagugagacuccaucucauuaaaa

SEQ ID NO: 288749 - RNA, 64 nt, Human
ugaucccagauugugccacugcccuccagccugggugacagagugagauucugucuacaaaaaa

SEQ ID NO: 288750 - RNA, 64 nt, Human
gugagccaaggucauaccagugcacuccaggcgggugacagagcaagacugcgucucaagaaaa

SEQ ID NO: 288751 - RNA, 64 nt, Human
auaugugcggcuuuucagaagaaauuuaaucagugugacagaaaaaaaaauguuuuaugguagc

SEQ ID NO: 288752 - RNA, 64 nt, Human; identical to SEQ ID NO: 278492

SEQ ID NO: 288753 - RNA, 64 nt, Human
acggcaucaacacuacccgcgcugcuguuagacacuccgccauuccugguucucuccgaaccgu

SEQ ID NO: 288754 - RNA, 64 nt, Human
aaaaccuaugggcuugaggaggucacgaugccgacuccgccagagcuuuuccacugauuguacu

SEQ ID NO: 288755 - RNA, 64 nt, Human
gcuccacacacauaauggcagcucacacagggacgugacagagcuaucauuaugcacuugggag

SEQ ID NO: 288756 - RNA, 64 nt, Human
aaaucuuaucuaugugcagcaugacucucuccaggugacagaaagggcucuagacagcugagag

SEQ ID NO: 288757 - RNA, 64 nt, Human
ugagcugagaucaugccauugcacuccaaccugggugacagagugagacuccaucucaaaaaaa

SEQ ID NO: 288758 - RNA, 64 nt, Human
gccauccuuccugcuguucuagguacuggccugggugacagagcaggacaugagacauagauac

SEQ ID NO: 288759 - RNA, 64 nt, Human
uccuucagauauuuuuaauauuaaauauauuuuagugacagagugccaacuucuuucaucagga

SEQ ID NO: 288760 - RNA, 64 nt, Human
ggaccuguugcuagcaggcaaucuccauuucucagugacagaagcauguuugagaugccguggg

SEQ ID NO: 288761 - RNA, 64 nt, Human
cucugacacagacaguagucaagaagaaaaugaagugacagaacauaccccuuuacugagaccu

SEQ ID NO: 288762 - RNA, 64 nt, Human
ugugccaagaucauaccacugcacuccagcccuggugacagaggagaccccgucucaaaaauug

SEQ ID NO: 288763 - RNA, 64 nt, Human
gguugcagugaguugagaucgcacuccagccugggugacagagugagauucugucucaaaagca

SEQ ID NO: 288764 - RNA, 64 nt, Human
uggaaaagaguuaucggcccauagcuaauaaguagugacagacaaccaagcuucaauauuuuuc

SEQ ID NO: 288765 - RNA, 64 nt, Human
ugcugggaucuaguuuuccaaguaacauuuuguggugacagaagccuaaaaaaagcuaaaauca

SEQ ID NO: 288766 - RNA, 64 nt, Human
agagacugauguauaauggacagguguuccuugagugacagacuuacaaagggaguguuuaauu

SEQ ID NO: 288767 - RNA, 64 nt, Human
aaaaauaaucaaagauagcauucauugagagacagugacagauauaauuuacuacauauauuga

SEQ ID NO: 288768 - RNA, 64 nt, Human
uaaaucuuaaaaccuucauaucuagguauccauugugacagacaaguaaaauugcaggugauuu

SEQ ID NO: 288769 - RNA, 64 nt, Human
gugagccaagaucgugccacugcacuccagccuggugacagagugagacucuguuucaaaaaag

SEQ ID NO: 288770 - RNA, 64 nt, Human
auaaagggcccagcccuuucuguuuuggaagcuagugacagaaucccaaggauuugaaagcucg

SEQ ID NO: 288771 - RNA, 64 nt, Human
ugaagcacuacaggaggaaugcaccacggcagcucuccgccaauuucucucagauuuccacaga

SEQ ID NO: 288772 - RNA, 64 nt, Human
cagagcauauuagcacaucacuccaagcaacaaccuccgccagaagaaagcaaaugcuguuuua

SEQ ID NO: 288773 - RNA, 64 nt, Human
acagaacucagcaguaauuuuguccaaccacuggcuccgccacugauuuccuacuggcccucag

SEQ ID NO: 288774 - RNA, 64 nt, Human
ugugcugugauugugacacugcccuccagccugggugacagagugagacccugucucaaaagca

SEQ ID NO: 288775 - RNA, 64 nt, Human
ugagccgagaucaugcgacugcacuccagccugggugacagagccagacucugucucaaaaaaa

SEQ ID NO: 288776 - RNA, 64 nt, Human
ugaggcaagauugcgccacugcacuccagucugggugacagaugaagacugucuuggaaaaaaa

SEQ ID NO: 288777 - RNA, 64 nt, Human
augauggaaaggaagaaugcagaggaggagaaaagugacagauccuccauuuuuguugggaugc

SEQ ID NO: 288778 - RNA, 64 nt, Human
gaaaguguuuuuauagggcuucaauacccagguggugacagagcagaagaaccgguuuuuuuuu

SEQ ID NO: 288779 - RNA, 64 nt, Human
cccugccucuggcuuccuaaacccaucaucuaaggugacagagcagugcuggaauagcaucucc

SEQ ID NO: 288780 - RNA, 64 nt, Human
aaaccaaacaggcuaggggagaauaggucuaauugugacagacuuaaaaacaacacauuauuug

SEQ ID NO: 288781 - RNA, 64 nt, Human
ugagacaagaucacgucacuguacuccagccugggugacagagugauacuccaucucaaaaaaa

SEQ ID NO: 288782 - RNA, 64 nt, Human
cugaggugugccauuggggccucagccuucucuggugacagaggcucagcuguggccaccaaca

SEQ ID NO: 288783 - RNA, 64 nt, Human
uucugaagguaauuaaauuuagacuauguaguaugugacagaauuuuuuuaaaauuauaaaaag

SEQ ID NO: 288784 - RNA, 64 nt, Human
uuaaucaaaugauuaaggucaaucccuuuuugcagugacagaagaggagcauguaaauuaccca

SEQ ID NO: 288785 - RNA, 64 nt, Human
uuuacagccagugccagcacaagguaguaaucuagugacagagaacaggguguuauggggagca

SEQ ID NO: 288786 - RNA, 64 nt, Human
auucuauuuucauuuucugcaagccugcguucuugugacagauuauacagaauugugucugcag

SEQ ID NO: 288787 - RNA, 64 nt, Human
ugagcugagauugugccacugcacuccagccugggugacagagugagacuccaucucaaaaaua

SEQ ID NO: 288788 - RNA, 64 nt, Human
auaaaaugguuggaagaaaauguuuugaguauaugugacagaaaacuuuggauauuauauguuu

SEQ ID NO: 288789 - RNA, 64 nt, Human
ugagccgagaucgcgccacugcacuccagccugggugacagagcgagacuccgucucaaaaaaa

SEQ ID NO: 288790 - RNA, 64 nt, Human; identical to SEQ ID NO: 278458

SEQ ID NO: 288791 - RNA, 64 nt, Human
acuuguucacacagaaacgugcacgcccccuuuucuccgccacuucaccaguuucugaaaucca

SEQ ID NO: 288792 - RNA, 64 nt, Human
ucggcuucuugcugcaccugugcauucuccaccccuccgccaauggcuuccagcuccuaaaaca

SEQ ID NO: 288793 - RNA, 64 nt, Human
uuucauuuaaaauugguauagagaaaaaaaggaugugacagaagcagagaugaccagaaagcac

SEQ ID NO: 288794 - RNA, 64 nt, Human
guggguggaguaguacccccaggcccugcccugggugacagacugggaggaaaccaggcuggac

SEQ ID NO: 288795 - RNA, 64 nt, Human
uuuuggcacugagauauuuauuguuuauuuaucagugacagaguucacuauaaaugguguuuuu

SEQ ID NO: 288796 - RNA, 64 nt, Human
gucaacagcaaagcuuggugucuuggcacuguuagugacagagcccagcaucccuucugccccc

SEQ ID NO: 288797 - RNA, 64 nt, Human
aaagaagaggaaauguuuacuuccaaauuaggaugugacagagaagggauagggaaauccucuc

SEQ ID NO: 288798 - RNA, 64 nt, Human
cgagaucgagaucacaccacugcacucagccugggugacagagcaagacuccgucuccaaaaaa

SEQ ID NO: 288799 - RNA, 64 nt, Human
ugagccaagaucaugccauugcacuccagccugggugacagaguaacacucugucucagaaaaa

SEQ ID NO: 288800 - RNA, 64 nt, Human
cuguaagugccaucaauuaaaauaguuuugugcagugacagagauuuucuuuuuucuuuucaau

SEQ ID NO: 288801 - RNA, 64 nt, Human
gauugagaaacccugauuuaucacaaugcccacugugacagaacaagacacucacagauuagug

SEQ ID NO: 288802 - RNA, 64 nt, Human
ugagccaagaucguaccacugcacuccagccugggugacagagugagacucugucuccaaaaaa

SEQ ID NO: 288803 - RNA, 64 nt, Human
gugagcugagaucacaccacugcacuccagccuggugacagagcaagacuccggcucuuaaaaa

SEQ ID NO: 288804 - RNA, 64 nt, Human
ugaaccaagaucgcggcgcugcacucuagccugggugacagagucagacuccgucccaaaaaaa

SEQ ID NO: 288805 - RNA, 64 nt, Human
agacaguuucugcccaaagucauguuaccaguuggugacagagcuggaaauacguagagaucua

SEQ ID NO: 288806 - RNA, 64 nt, Human
uacuauaaugugaugauucuaaauuuguaccuaugugacagacauuuucaauaaugugaacugc

SEQ ID NO: 288807 - RNA, 64 nt, Human
agagccaugauuaaaccaaggcacuccagccugggugacagagugagacugucucaaaauaaaa

SEQ ID NO: 288808 - RNA, 64 nt, Human
guuuuguuuuauuauuuauuuauuuauuuauuuugugacagagagagauuccaucucaaaaaaa

SEQ ID NO: 288809 - RNA, 64 nt, Human
gaaucguucuagauuaguuaccaauuaaauauaacuccgccaguguaagggugugaggugcagu

SEQ ID NO: 288810 - RNA, 64 nt, Human
caacgggaugguguccacggcaagugugcacacccuccgccagaccucacuggccuggcuggac

SEQ ID NO: 288811 - RNA, 64 nt, Human; identical to SEQ ID NO: 278460

SEQ ID NO: 288812 - RNA, 64 nt, Human
aaaaacugaucuuuaaaggagaugccgacagcuagugacagaugaagauggaagaacauaccuu

SEQ ID NO: 288813 - RNA, 64 nt, Human
uaaccuuauacucuauguugaaguaagguauuaagugacagauacuaaagugaauaugcaggag

SEQ ID NO: 288814 - RNA, 64 nt, Human
ugagccuugauuauaccacugcacuccagccugggugacagagcgagacucugucucagaaaaa

SEQ ID NO: 288815 - RNA, 64 nt, Human
ccuaaacuguuacaguacauuucucagcauccuugugacagaaagcugcaagaauggcacuuuu

SEQ ID NO: 288816 - RNA, 64 nt, Human
ugagccgagaucaugccacugcacuccagccugggugacagagccagacuccgucucaaaaaaa

SEQ ID NO: 288817 - RNA, 64 nt, Human
ugagccgagaucaggccauugcacuucagccugggugacagagugagacuccaucucaaaaaaa

SEQ ID NO: 288818 - RNA, 64 nt, Human
ugagcugagacugugccacugcaguccagccugggugacagagccagacacugucucggggaaa

SEQ ID NO: 288819 - RNA, 63 nt, Human
auugacuaucaaacugaagccagaaauaaaguuggugacagauaggccugauuguauuugucu

SEQ ID NO: 288820 - RNA, 64 nt, Human
caccuggccgccuccaggagccuacccccugaaagugacagagacccagaucucauggaaacug

SEQ ID NO: 288821 - RNA, 64 nt, Human
ugagcugugauuaugccauugcacuccagccugggugacagagcaauacccugucuuuaaaaau

SEQ ID NO: 288822 - RNA, 64 nt, Human
aagaaaugguauguagagcuuagauuucccuauugugacagagccaugguguguuuguaauaau

SEQ ID NO: 288823 - RNA, 64 nt, Human
uaagcagagauugugccacuggacuccagccugggugacagagcgagacuccgucucaaacaaa

SEQ ID NO: 288824 - RNA, 64 nt, Human
gacaacugccagauacuggcaauacuccagccuggugacagagugagacucugucucaaaaaaa

SEQ ID NO: 288825 - RNA, 64 nt, Human
cacugucauuuuccaucccauccccaccaccugagugacagaaaucuaaacacacauccguccc

SEQ ID NO: 288826 - RNA, 64 nt, Human
ugagcugagaucgcaccaccacacuccagccugggugacagagugaaacccuuaaucaaucagu

SEQ ID NO: 288827 - RNA, 64 nt, Human
acacgaagugccgagacacuccucgccucaccgcgugacagagccucugcccggcccucccguu

SEQ ID NO: 288828 - RNA, 64 nt, Human
ggagugcaguggcgugaucucugcucacugcaagcuccgccaucuggguucaagcgauucuccu

SEQ ID NO: 288829 - RNA, 64 nt, Human
uuagcauuggaguguuagaaacuagaauagaccucuccgccaccgagcugcugugucacgcccu

SEQ ID NO: 288830 - RNA, 64 nt, Human
gugcaugccccucgugcccgcacugcacgccgcccuccgccacgccacagccacagccgccgcc

SEQ ID NO: 288831 - RNA, 64 nt, Human
ugagccaagauugcgccacugcacuccagccugggugacagagcaagacuccauuucaaaaaaa

SEQ ID NO: 288832 - RNA, 64 nt, Human; identical to SEQ ID NO: 288816

SEQ ID NO: 288833 - RNA, 64 nt, Human
ugagucgugauugugccacugcacuccagccggggugacagaagagaccuugucucgaaaagga

SEQ ID NO: 288834 - RNA, 64 nt, Human
ccuuccccuuccugguccuucagcccaugucaacgugacagacaccuuuguauguuccuuugua

SEQ ID NO: 288835 - RNA, 64 nt, Human
uuugacccaaacuggccuuuuaaaauaaucaggagugacagagucaacuucugcagcaccugcu

SEQ ID NO: 288836 - RNA, 64 nt, Human
cccauuuaucaggaugaccauugccauuugucaggugacagacagcuuggucacaacacaacug

SEQ ID NO: 288837 - RNA, 64 nt, Human
uaagcugagauugugccacugcaccccagccugggugacagagcaagacuccaucacaaaaaaa

SEQ ID NO: 288838 - RNA, 64 nt, Human
ugagccaagaucgcgccacugcacuccagcccgggugacagagcaagacuccgucucaaaaaaa

SEQ ID NO: 288839 - RNA, 64 nt, Human
ugguuuguggcugugugugugacugugagugugagugacagauacauaguuucauuggucauuu

SEQ ID NO: 288840 - RNA, 64 nt, Human
ugagccgugauugugccacugcauaccagccuaggugacagaaugagacccugucucaaaaaaa

SEQ ID NO: 288841 - RNA, 64 nt, Human
uggggauggguuuaggagcuccagguugggagcagugacagagagucauggccguggugagggu

SEQ ID NO: 288842 - RNA, 64 nt, Human
ugagcugugauugugccacuguacuccagccugggugacagagcgagacucugucucaaaaaaa

SEQ ID NO: 288843 - RNA, 64 nt, Human
aaugaaaucuuauuauuuuaauaaguagcugacagugacagaaagauuggauuuggaucagauu

SEQ ID NO: 288844 - RNA, 64 nt, Human
ugagcugagagugccccacugcacuccagccugggugacagagcgagacuuugucccaaaacaa

SEQ ID NO: 288845 - RNA, 64 nt, Human
ggucuugggaaauaugaaugcccccagcuggcccgugacagacuccugaggacagcuguccucu

SEQ ID NO: 288846 - RNA, 64 nt, Human
agaggcugcuauuuuuguuuuagauaauuggccagugacagaguuuacccuugccuccuuucuu

SEQ ID NO: 288847 - RNA, 64 nt, Human
gaggagcugcagggcgagcccggacggcugccgucuccgccagaggccaccccggcccggccuc

SEQ ID NO: 288848 - RNA, 64 nt, Human
cucacuccucccccgacgugaagccucccugucucuccgccagcucugagucccaggcagcugg

SEQ ID NO: 288849 - RNA, 64 nt, Human; identical to SEQ ID NO: 278474

SEQ ID NO: 288850 - RNA, 64 nt, Human
ugagcugagaucgugccacugcacucuagccggagugacagaguaagacucugucucaaaaaua

SEQ ID NO: 288851 - RNA, 64 nt, Human
aagaaaguauaaagucacuuccaguguuggcugugugacagaaucuuguauuugggccaaggug

SEQ ID NO: 288852 - RNA, 64 nt, Human
ugagcuuuaauggcugaagacccagaucagggcagugacagaucacagggacaucuguggcucc

SEQ ID NO: 288853 - RNA, 64 nt, Human
cuaguaaucaaaauuaauaugaagaaacuagguugugacagacuagauuauauuuaguagggga

SEQ ID NO: 288854 - RNA, 64 nt, Human
cuagcugcugccauuucuguaacugcccagaagggugacagauuucugaaggggaaaggauuca

SEQ ID NO: 288855 - RNA, 64 nt, Human
auccaaugcaggcaaggaaaauaaaagauuuccagugacagaaaaauauauuaucucaaguauu

SEQ ID NO: 288856 - RNA, 64 nt, Human
cguuugagcguuugcuaucugacugcugaucugcgugacagaaacaccagcauauuugcaacgc

SEQ ID NO: 288857 - RNA, 64 nt, Human
ugaguugaccauuugggaauuaaacaggucacacgugacagaugaagaaaccaagggggcugcu

SEQ ID NO: 288858 - RNA, 64 nt, Human
ugagcugugaucacaccacugcacuccagccugggugacagagugagacucugucucaauuaau

SEQ ID NO: 288859 - RNA, 64 nt, Human
cagggguggaaucggagugugucugcccgcccuugugacagacacacggaaggcuucugacgcu

SEQ ID NO: 288860 - RNA, 64 nt, Human
gcuccguguccccugggcucaagucaagcagucggugacagauuucauucccaauaacagaauc

SEQ ID NO: 288861 - RNA, 64 nt, Human
ugagcugagauggcaccacugcacuccagcuugggugacagagugagacuccaucucaacaaaa

SEQ ID NO: 288862 - RNA, 64 nt, Human
agugagcuguuugagccacugcacgccagccugggugacagagccagacccugucuucaaaaaa

SEQ ID NO: 288863 - RNA, 64 nt, Human
uguguauauaugucaaauugucagcaugacaaaagugacagauguuauuuuuguauuuuuaaaa

SEQ ID NO: 288864 - RNA, 64 nt, Human
ugagccgagaucgcgccacugcacuccaaccugggugacagacucugucuccaaaacaaaacaa

SEQ ID NO: 288865 - RNA, 64 nt, Human
ugagccaagauugcgccacugcacuccagccuaggugacagagugagacccugucucuaaauaa

SEQ ID NO: 288866 - RNA, 62 nt, Human
agggccuccggauaaugugaagcugagugagccuccgccauccagcaugacaaacuguggcc

SEQ ID NO: 288867 - RNA, 64 nt, Human
ccaccaaaacugcuccuccuccuguauuccugaccuccgccauccaccccguugcucaagccgg

SEQ ID NO: 288868 - RNA, 64 nt, Human
uccaaaauauugggguacagcucaccaccccccacuccgccaacccauuccuaccuccucuagu

SEQ ID NO: 288869 - RNA, 64 nt, Human
ugagccaagauuaugccacugcacuucagccugggugacagagcaagacucuuaucucaaaaaa

SEQ ID NO: 288870 - RNA, 64 nt, Human
ugggccaagaucgcaccacugcacuccagccugggugacagagcgagacucugucucaaauaau

SEQ ID NO: 288871 - RNA, 64 nt, Human
uucagcagacuuugcuccuaauggcucucugaaagugacagacuuaaauauugcucugcagugc

SEQ ID NO: 288872 - RNA, 64 nt, Human
caacacccccuaccaccaggaugggcaguaauaugugacagagcccaaagcaaggcuggaacgc

SEQ ID NO: 288873 - RNA, 56 nt, Human
augaaaaacaucaaaaauaacaagaugugacagaagccacuuaggcagcaaacaua

SEQ ID NO: 288874 - RNA, 64 nt, Human
ugagccaugaucacaucacugcaguccagccugggugacagagcaagaccugucacccugccac

SEQ ID NO: 288875 - RNA, 64 nt, Human
auauuaauauuaaucaagaauuuaacagauauaugugacagaaaucuaacuucaagugacugaa

SEQ ID NO: 288876 - RNA, 64 nt, Human
ucuuaaguaaauuagcauuugguagucugaaauggugacagauuacuuguuaaaauugugaaaa

SEQ ID NO: 288877 - RNA, 64 nt, Human
augaaauuaucucaaggaucuuccaugggaagaugugacagaaccaggacacuacugcuuaaua

SEQ ID NO: 288878 - RNA, 64 nt, Human
ggugcagcccagcuggcggaggggcgaagcuuuggugacagacggagagugggggacuagcugu

SEQ ID NO: 288879 - RNA, 64 nt, Human
uuuauauuucagaucauaucuacugaaugauuuggugacagaaauuugcauugcuuuuaccuau

SEQ ID NO: 288880 - RNA, 64 nt, Human
uuaacugaaaguaacagaaggaccuuucuuaaaugugacagaugguccugcagugugaaacuga

SEQ ID NO: 288881 - RNA, 64 nt, Human
ugagccaagauugugccacuguauuccagacugggugacagagugagacuccaucucaaaaaaa

SEQ ID NO: 288882 - RNA, 64 nt, Human
gaacccgaggucgcgccacugcacuucagccugggugacagagcuagacuccaucucaaaaaaa

SEQ ID NO: 288883 - RNA, 64 nt, Human
ggguuuucuuuguuguuguuguuguucuagccaugugacagaggcucuuucuaaaaguauguag

SEQ ID NO: 288884 - RNA, 64 nt, Human
ugagccaagauugugccacugcacuccagccugggugacagagcaagacuccaucucaaaaaaa

SEQ ID NO: 288885 - RNA, 64 nt, Human
caacacagauuuagagauacaaccccccacccuucuccgccauucuucccuacucccaacccac

SEQ ID NO: 288886 - RNA, 64 nt, Human
gacgucuccagccccgcagcccggcccgggcguccuccgccagcuccugugaccagcgcgucuc

SEQ ID NO: 288887 - RNA, 64 nt, Human
ucuuagcauugggcagacaccagggcaaccugcccuccgccaucccugcuauuuaaauuauuua

SEQ ID NO: 288888 - RNA, 64 nt, Human
uguucaccccgcugcuccugccccuuggagcccagugacagaaagaacagccucugucaccccg

SEQ ID NO: 288889 - RNA, 64 nt, Human
augagccaugauuucccacugcacuccagccugagugacagagcgagacuccaucucuuuaaaa

SEQ ID NO: 288890 - RNA, 64 nt, Human
ucagcccugauugugccagugcacuccggccugggugacagagugagacccugucucaaaaaaa

SEQ ID NO: 288891 - RNA, 64 nt, Human
uuuauauaauucaaaagaaugcauguuucacauugugacagauaaagauguaugauuucuaagg

SEQ ID NO: 288892 - RNA, 64 nt, Human
uacacugaagcagcucauagcaaguuaaaauauugugacagauuugaaaucauguuugaauuuc

SEQ ID NO: 288893 - RNA, 64 nt, Human
gauuuuuacuacauagguagcacauuuaucauuugugacagaauaaugugaaguuaaguaauua

SEQ ID NO: 288894 - RNA, 64 nt, Human
gugagccgagaucgcaccacugcacuccagccuggugacagagcaaaaaaaaaaaaauugaagu

SEQ ID NO: 288895 - RNA, 64 nt, Human
ggguaagugacuugcccaaggucagagccacuuggugacagagccaggaugagaacaaagauuc

SEQ ID NO: 288896 - RNA, 64 nt, Human
ugagcugaggucgugcuacugcacucccgccugggugacagagugagacucuaucucaaaaaaa

SEQ ID NO: 288897 - RNA, 64 nt, Human
ugagccaugcucacaccacugcacuccagccugggugacagagcaagaucuugucucaaaaaag

SEQ ID NO: 288898 - RNA, 64 nt, Human
ugcacgcguauguucguugcagcacugcccaucagugacagacuggauuaaaaaaaugugguac

SEQ ID NO: 288899 - RNA, 64 nt, Human
gaucgcaccacugcacuccagcacuccagccugggugacagagcaagacucucucucaaaaaaa

SEQ ID NO: 288900 - RNA, 64 nt, Human
cucuucccuuccugcacugaggagauuaacugaagugacagauuagaguuagaaguggcccaaa

SEQ ID NO: 288901 - RNA, 64 nt, Human
uccccuccgcuuucugaagccuggggagaaaucagugacagagguguuuugguuuuauuguuau

SEQ ID NO: 288902 - RNA, 64 nt, Human
ccagucuucacaucacucuggccucaucaccaaggugacagaggacacaggggagggggaaaac

SEQ ID NO: 288903 - RNA, 64 nt, Human
uuugaauuccuuuuggauaaaguuauuucuugaugugacagaguaguguguuuucauuuuuauu

SEQ ID NO: 288904 - RNA, 64 nt, Human
uacagaaucgaacucugcacuucucucuccuuuacgagacgaaaaggaaaagcaaaccagaauc

SEQ ID NO: 288905 - RNA, 64 nt, Human
agaauacauugaucagcaguuugagcaguauuuccgagacgagaguggccugaaccgaaagaac

SEQ ID NO: 288906 - RNA, 64 nt, Human; identical to SEQ ID NO: 278476

SEQ ID NO: 288907 - RNA, 64 nt, Human
uauuagcccagacaucuguaauguuuuugcacuggugacagacaaaaucuguuuuaaaaucaua

SEQ ID NO: 288908 - RNA, 64 nt, Human
ugaaauccaggccccugucucaacuuggagagaggugacagacggcagaucuuccaaaucaaau

SEQ ID NO: 288909 - RNA, 64 nt, Human
aauacauuguaaauaaccucagcugggaugaggagugacagaauaucaaaauaauuuguggcug

SEQ ID NO: 288910 - RNA, 64 nt, Human
ucgucugggcucguggauaugucccucaggugcggugacagaaugguggcaccacgauaugugu

SEQ ID NO: 288911 - RNA, 64 nt, Human
ggccuuaauuuaauauacuuguuagcaagcgugugugacagagaguggggaaagcuacaucauu

SEQ ID NO: 288912 - RNA, 64 nt, Human
aggagagugcagccucacagugacuuucucagaggugacagagaugauggaugagcagcuggau

SEQ ID NO: 288913 - RNA, 64 nt, Human
caugauguugggaaggguguagugcccuagguuggugacagaagggacagacacuugugcacag

SEQ ID NO: 288914 - RNA, 64 nt, Human
uaaauauucaguuacauuuuuaaaaaaucuguacgugacagaauauuaaaacauggaauauuuu

SEQ ID NO: 288915 - RNA, 64 nt, Human
uugcuuuaaucaccauauaaaaggaaaaaaauuggugacagagcacaaauagaaaaccuauuuu

SEQ ID NO: 288916 - RNA, 64 nt, Human
uuuaucccacaguggauugacucagccucugugggugacagacuucuaagcaggaagauagacg

SEQ ID NO: 288917 - RNA, 64 nt, Human
gcagauguaagcguauacuuaguugccguuagaugugacagaaugagauaauuuauguaaagca

SEQ ID NO: 288918 - RNA, 64 nt, Human
ugagccaauaucgugccacugcauuccagccugggugacagaaugaaacuccaucacuccaucu

SEQ ID NO: 288919 - RNA, 64 nt, Human
ugagcugagaucgccccacugcuuuucaaccugggugacagaaccagacccugucucaaaacaa

SEQ ID NO: 288920 - RNA, 64 nt, Human
uucguuaucuguggaaaacguuuuaaguugucaugugacagaaacuuuuccuuuguccaucgag

SEQ ID NO: 288921 - RNA, 64 nt, Human
ugccacuauuaagcugcuaauuguuccuguuggggugacagauacugaauguauacguauugug

SEQ ID NO: 288922 - RNA, 64 nt, Human
ugagccgagauuucaccagugcacuccagccugggugacagagcaagacuccaucucaaaaaaa

SEQ ID NO: 288923 - RNA, 62 nt, Human
guggacaugagaccacuguuggccagggacgccgugcggaggccuacguggcugccugagca

SEQ ID NO: 288924 - RNA, 64 nt, Human
ugagcugaguucgugccauuacacuccagccugggugacagagugagacucugucucaaaaaaa

SEQ ID NO: 288925 - RNA, 64 nt, Human
agugagcugagaugccaccaccacaccagccugggugacagagugaaacucguaucuccaaaca

SEQ ID NO: 288926 - RNA, 64 nt, Human
ugagccaagaucgcaccgcugcacuccagccugggugacagagcgacccucugucucaaaaaau

SEQ ID NO: 288927 - RNA, 64 nt, Human
ccccaagucuggcuccauuccuggccuucuguuggugacagacccccccccuaaggugcucguu

SEQ ID NO: 288928 - RNA, 64 nt, Human
aguaaugugacuaugaccaugauauauuauauaugugacagauacaaauucucugugaucaguu

SEQ ID NO: 288929 - RNA, 64 nt, Human
uucccuagcugcaaaaccugaaauugaccacuaggugacagaauguuugccaguauccccacaa

SEQ ID NO: 288930 - RNA, 64 nt, Human
gaugugaaaugaagacuauauauauggaauggaggugacagaaagaaagaaauucuuuguuuga

SEQ ID NO: 288931 - RNA, 64 nt, Human
ugagccacgaucacaccacugcacuccagccuaggugacagagugagauccugucucaaaaaac

SEQ ID NO: 288932 - RNA, 64 nt, Human
ugagccgagauugcgccauugcacucuagccugugugacagagcaagacccugucucaaaaaaa

SEQ ID NO: 288933 - RNA, 64 nt, Human
ggaucugugccaucuuggauugagaauugcagaugugacagaauggauugacccuaguugguug

SEQ ID NO: 288934 - RNA, 64 nt, Human
gugagcugaaaucgcguaccacacuccagccugggugacagagcgagacuguguuucaaagaaa

SEQ ID NO: 288935 - RNA, 64 nt, Human
ucagggucugggcgccucgcauuugcagucuguugugacagacacggggagcuccgcgugccag

SEQ ID NO: 288936 - RNA, 64 nt, Human
aacgaaggcuaggaggcggcgucagaggugcugggugacagagccaugagccagccauuuuaua

SEQ ID NO: 288937 - RNA, 64 nt, Human
uuuugugcaagcuaauuuggccacauuuggccuggugacagaacuguucauaaggaaguaauau

SEQ ID NO: 288938 - RNA, 64 nt, Human
gaggucaguugauuuccccagguacauucauggugugacagacacauggguacaaauaaaagac

SEQ ID NO: 288939 - RNA, 64 nt, Human
ggacccugugagcggaccagaccugcccugcucugugacagagccugagacuuggaggugccag

SEQ ID NO: 288940 - RNA, 64 nt, Human
uuguugccuucuagcuugcugguaacuuuggcgccuccgccaagcccugccagacuccccuggc

SEQ ID NO: 288941 - RNA, 64 nt, Human
gcaagguguacugggaggugggcggacccccaggcuccgccagccccuccaccccagccugccu

SEQ ID NO: 288942 - RNA, 64 nt, Human; identical to SEQ ID NO: 278490

SEQ ID NO: 288943 - RNA, 64 nt, Human
cugagaucaggaugcuuguauaguggccugugaggugacagauuggcagggcccaaggccccag

SEQ ID NO: 288944 - RNA, 64 nt, Human
aggaaacccagagugcccagcugucuggaaugaagugacagagguagaaaacaguaggcccuca

SEQ ID NO: 288945 - RNA, 64 nt, Human
uaagggugggaggccugggcccggggccucccccgugacagaaccacacugggcagaggggucu

SEQ ID NO: 288946 - RNA, 64 nt, Human
ugagcugagauugugccacugcacuccagucugugugacagaaugagaccuugucuugaaaaaa

SEQ ID NO: 288947 - RNA, 64 nt, Human
ugagccaagauugcgccacugcacuccagccugggugacagagcaagacuccgucucaaaaaaa

SEQ ID NO: 288948 - RNA, 64 nt, Human
ugagccaggaucacaccauugcuguccagccugggugacagagcaagacugcguuucaaaaaaa

SEQ ID NO: 288949 - RNA, 64 nt, Human
ugagcugagauccugccacugcacuccagucugggugacagagcaagacuccaucucaaaaaau

SEQ ID NO: 288950 - RNA, 64 nt, Human
ugagcugagaucgugccacugcacuccagccugggugacagagcaagacucugucucaaaaaaa

SEQ ID NO: 288951 - RNA, 64 nt, Human
ugagccgagacgacaccacugcacuccagccugggugacagagggagacucugucucgaaagaa

SEQ ID NO: 288952 - RNA, 64 nt, Human
ugaaccgagaucgcuccacugcacuccagccugggugacagauccagacucugucucaaaaaaa

SEQ ID NO: 288953 - RNA, 64 nt, Human
agauugugccacugcacucugcacuccagccugggugacagagggagacucugucucaaaaaaa

SEQ ID NO: 288954 - RNA, 64 nt, Human
ugagcugagauugugccacuguacugcagccugggugacagaaugagacugcaucucaaaaaau

SEQ ID NO: 288955 - RNA, 64 nt, Human
ugagcugagaucaugccacugcacuccagccugagugacagagagagauucaaaaaacaaaaaa

SEQ ID NO: 288956 - RNA, 64 nt, Human
ugagcugagaucacaccauugcacucuagucugggugacagagcgagacucugucucaaaaaaa

SEQ ID NO: 288957 - RNA, 64 nt, Human
ucccaucaucugcuucccccaaggccucccacaggugacagaauguucugccuucccuuccauc

SEQ ID NO: 288958 - RNA, 64 nt, Human
cccccacuuacaaccagguggguggaacaggcaugugacagaguggggagccugggcucagcuc

SEQ ID NO: 288959 - RNA, 64 nt, Human
gggcccuggguggccucugggcccuuucuccugucuccgccacucccucuggcggcgcuggccg

SEQ ID NO: 288960 - RNA, 64 nt, Human
gggaccuguguagccccaagagaucccccacauccuccgccaucccuuugcagucaccaaggaa

SEQ ID NO: 288961 - RNA, 64 nt, Human
accggugccagcccugacuccgccgccccucugccuccgccagggcuggaccacgagcuggccu

SEQ ID NO: 288962 - RNA, 64 nt, Human
ugagcuaugauagugccacugcacuccagccugggugacagauuuugucuuaaaaaaaaaaaaa

SEQ ID NO: 288963 - RNA, 64 nt, Human
gucuaaagaucccacauucacacugacuugggcagugacagagcccagagcaaacagggccagg

SEQ ID NO: 288964 - RNA, 64 nt, Human
uuccucacuucagggugacaagauauguauaacagugacagaaaucuccaaagcugcuguauau

SEQ ID NO: 288965 - RNA, 54 nt, Human
aacaaaugcugaaaaucugacugugugacagaacguaucacugaugacugauag

SEQ ID NO: 288966 - RNA, 64 nt, Human
cagguauaucaguggaaacacagaguuauuuuaagugacagacaaauuacgguugaguucugug

SEQ ID NO: 288967 - RNA, 64 nt, Human
cuucccuucuuccugcagguucccgccaagccaugugacagagugcucacacucaggcacuugc

SEQ ID NO: 288968 - RNA, 64 nt, Human
acagcugcuguacaucguccuggcgagugacaaugugacagaagccugggcgaggcccucggag

SEQ ID NO: 288969 - RNA, 64 nt, Human
ugagccaagaucacgccacugcacuccagcuggagugacagagccaaacuccgucaaaaaaaaa

SEQ ID NO: 288970 - RNA, 64 nt, Human
gagccaugacugugccacugcaccucuagucugggugacagagcaagacccuguuuaaaaaaga

SEQ ID NO: 288971 - RNA, 64 nt, Human
ugagccgagaucgagccacugcacuccagccugggugacagagcgugagacuccgucucaaaaa

SEQ ID NO: 288972 - RNA, 64 nt, Human
ccaagaucacaggagccacugcacuccagccugggugacagagugagacucugucucaaaaaaa

SEQ ID NO: 288973 - RNA, 64 nt, Human
ugagccaagauugugccacuguacuccagccugggugacagagugagacuccaucucaauaaaa

SEQ ID NO: 288974 - RNA, 64 nt, Human
uuuguguuuuucuuguggugaugaauucagcaaggugacagagguacuauuauaauucuuacuu

SEQ ID NO: 288975 - RNA, 64 nt, Human
ugaacugugauuguuccacuacaguccagccugggugacagagaaaagaaaaagaaaacauuac

SEQ ID NO: 288976 - RNA, 64 nt, Human
caugguggaaaaguacuaucggaauaacucugcagugacagaauuugaaguuuggcuagcaucc

SEQ ID NO: 288977 - RNA, 64 nt, Human
gagaguccucagcccaagggaaaugaccucaacagugacagacaacaggccuucugcagccagg

SEQ ID NO: 288978 - RNA, 64 nt, Human; identical to SEQ ID NO: 288623

SEQ ID NO: 288979 - RNA, 64 nt, Human; identical to SEQ ID NO: 278649

SEQ ID NO: 288980 - RNA, 64 nt, Human; identical to SEQ ID NO: 288585

SEQ ID NO: 288981 - RNA, 64 nt, Human
augaauggaaaccuaaguaaaacuaagcucauuagugacagacuuguuuucuucuuguuauucc

SEQ ID NO: 288982 - RNA, 64 nt, Human
ggaggugacauguuuagagucacccagcugguuagugacagaaaaagcgugagaguugucuagg

SEQ ID NO: 288983 - RNA, 64 nt, Human
augagccaagauugggccacugcauuccagccuggugacagagcgagacugucucaaaaaaaaa

SEQ ID NO: 288984 - RNA, 64 nt, Human
cccagaaagcaagcccaggagaggaaggcagagugugacagagcagagccagggccaggcgcac

SEQ ID NO: 288985 - RNA, 64 nt, Human
ugagcugagauugcgucacugaacuccggccugggugacagaaggaggcucugccuuaaaaaaa

SEQ ID NO: 288986 - RNA, 64 nt, Human
uggaaguacagacuggcacagcaacaucaggguugugacagagggaagcauggcuggggggagg

SEQ ID NO: 288987 - RNA, 64 nt, Human
aggaauugcaaagaaucaaguccacccuucucaugugacagauggggaaacugaggccuugaga

SEQ ID NO: 288988 - RNA, 64 nt, Human
gagaaacugagccaaggccacauagcuaccuacagugacagaaucaaaauucaaacucagguuu

SEQ ID NO: 288989 - RNA, 64 nt, Human
ugaucaggaauugugccacugcacuccaaccugagugacagagcaacacucugucuuaaaagaa

SEQ ID NO: 288990 - RNA, 64 nt, Human
ugagccaugauugcaccacugcaccccagccugggugacagagcaagacccugucucaaaaaaa

SEQ ID NO: 288991 - RNA, 64 nt, Human
cacauccuggcuccaguguggaugcagagagagugugacagaggaucugccugugaaccaccug

SEQ ID NO: 288992 - RNA, 64 nt, Human
ugagcccagaucaugccacuguacuccagccuaggugacagagcaagacucugucucaaaaaca

SEQ ID NO: 288993 - RNA, 64 nt, Human
cucccugccccgcccuggccaugugaucguguuggugacagacccugaugugcuggugcugugu

SEQ ID NO: 288994 - RNA, 64 nt, Human
gccuggcucaccuggccacuguccagccagccuugugacagacuccggccugaaggcagaauga

SEQ ID NO: 288995 - RNA, 64 nt, Human
ugagauguguuugugccauugcacaccagucugggugacagagaaagacccugucucaaaaaca

SEQ ID NO: 288996 - RNA, 64 nt, Human
ucagccaagauagcaccacugcacuccaggcugggugacagagcgagacuccaugucaaaaaaa

SEQ ID NO: 288997 - RNA, 64 nt, Human; identical to SEQ ID NO: 288586

SEQ ID NO: 288998 - RNA, 64 nt, Human; identical to SEQ ID NO: 288754

SEQ ID NO: 288999 - RNA, 64 nt, Human; identical to SEQ ID NO: 288603

SEQ ID NO: 289000 - RNA, 64 nt, Human
ccaaguggcauaauucaggggcugacacuucaaggugacagaaggaccagcccuugagggagaa

SEQ ID NO: 289001 - RNA, 64 nt, Human
gugccccuuuccucauucugacacccagaagacagugacagauguguuugcaaggcugggaugg

SEQ ID NO: 289002 - RNA, 64 nt, Human
ggcagccccaggccauggcguugccagccucccugugacagagccuggugaacagugagccugg

SEQ ID NO: 289003 - RNA, 64 nt, Human
gagucuaggcugagggcaagaugggaggucagaggugacagaagcguucaggggugccugggcc

SEQ ID NO: 289004 - RNA, 64 nt, Human
ccuggagcagauguccuagaagguuuuaggaauagugacagagucaggccaccccaagggccau

SEQ ID NO: 289005 - RNA, 64 nt, Human
ugagcggagauugcaccacugcacuccagccugggugacagagcaagacucccucucaaaagaa

SEQ ID NO: 289006 - RNA, 64 nt, Human
uaagccaagaucacgccacugcacuccagccugggugacagagcaaggcucugucucaaaaaaa

SEQ ID NO: 289007 - RNA, 64 nt, Human
ugagcugagauuacaccacugcacuccagccugggugacagagugagacuccaucucaaaaacu

SEQ ID NO: 289008 - RNA, 64 nt, Human
gcauuguaauugugaacagcucuuacuugugccagugacagaugcaguggucuccuuuccccag

SEQ ID NO: 289009 - RNA, 64 nt, Human
caucagagugaagcacgccugucuagguucuccagugacagaaagauccugaagcauggacuaa

SEQ ID NO: 289010 - RNA, 64 nt, Human
ugagccgagaucgugucacugcacuccagccugggugacagagacuccauuuaaaaaaaaaaaa

SEQ ID NO: 289011 - RNA, 64 nt, Human
uuaccucugguacacugucuugguaagccuggaugugacagacaccucggcucuccuugaauaa

SEQ ID NO: 289012 - RNA, 64 nt, Human
ccauccucuugucagggcccuuuccuguguacacgugacagagugccuuuucgagacuggcagg

SEQ ID NO: 289013 - RNA, 64 nt, Human
aaagacccacaugcuacaagacgggcaaaauaaagugacagaugaccacccugcagcucuccag

SEQ ID NO: 289014 - RNA, 64 nt, Human
auuugagacuuagaaaaauccuacaaggcuggcagugacagaacuaagaugaucaucuccaguu

SEQ ID NO: 289015 - RNA, 64 nt, Human
gcccaaugggagagguaggguuuuucuagcuugugugacagaaguagcaaaaucugguccuccc

SEQ ID NO: 289016 - RNA, 64 nt, Human; identical to SEQ ID NO: 278651

SEQ ID NO: 289017 - RNA, 64 nt, Human; identical to SEQ ID NO: 288641

SEQ ID NO: 289018 - RNA, 64 nt, Human; identical to SEQ ID NO: 288642

SEQ ID NO: 289019 - RNA, 64 nt, Human
ccuguuauuuuuuuauuauuauuguuuuuuuuuagugacagagucucauucuguugcccaugcu

SEQ ID NO: 289020 - RNA, 64 nt, Human
ugagcugagaucgugccacugcacuccagccugggugacagagugagacuccaucauaaauaaa

SEQ ID NO: 289021 - RNA, 64 nt, Human
aaaucaaggauaaauaucuuacgcacgauaucuagugacagaggagaaaguggaaaaugaccuc

SEQ ID NO: 289022 - RNA, 64 nt, Human
aagagcgaaacuccauuucaaaaaaaaaaaauuggugacagacucaaugauggaaugauuuguc

SEQ ID NO: 289023 - RNA, 64 nt, Human
gugagccaaguucccccacuguacuccagccugggugacagaguaagacuccaucucaaaacaa

SEQ ID NO: 289024 - RNA, 64 nt, Human
ugcugcuccuugguuuugccugguuagacuuucagugacagauguugggguguuuuugcuuaga

SEQ ID NO: 289025 - RNA, 64 nt, Human
guaaugggugaaugagguuguuuggaaagucggugugacagacacauggaugccaucuacuucu

SEQ ID NO: 289026 - RNA, 64 nt, Human
ugagcugagaucgugccacugcacuccaggcugggugacagagcgagacuccaucucaaaaaaa

SEQ ID NO: 289027 - RNA, 64 nt, Human
cgaugaggccugggcucagugagccaggacgaaugugacagacaccccuugcugccacagucag

SEQ ID NO: 289028 - RNA, 64 nt, Human
ggcuuuaucuuuggagaaggcaaggaaggaggcggugacagacgggcugaagcgagcccucagg

SEQ ID NO: 289029 - RNA, 64 nt, Human
gcagcagauucccaacaguaaccuccuccuccuggugacagaccccaccugugacugcagcauc

SEQ ID NO: 289030 - RNA, 64 nt, Human
agauaauaagaaauuguucugguagauauauccugugacagaagauacuuuagguggaacuaug

SEQ ID NO: 289031 - RNA, 64 nt, Human
ugagccuugauugugucacugcacuccagcuugggugacagagacccugucucgagaaauuaaa

SEQ ID NO: 289032 - RNA, 64 nt, Human
ggagggaaaaagugaaggagaggcuuuggaccuggugacagagugaucagaugacagagggguu

SEQ ID NO: 289033 - RNA, 64 nt, Human
ggaggcugcagcuggaucagaggaaaaauccagugugacagagugcaagucagaagaccuggcu

SEQ ID NO: 289034 - RNA, 64 nt, Human
guuccuagcuggcuagggauugaaguccuggacagugacagaggauaccacaguaguucaagac

SEQ ID NO: 289035 - RNA, 64 nt, Human; identical to SEQ ID NO: 288604

SEQ ID NO: 289036 - RNA, 64 nt, Human; identical to SEQ ID NO: 288605

SEQ ID NO: 289037 - RNA, 64 nt, Human; identical to SEQ ID NO: 278442

SEQ ID NO: 289038 - RNA, 64 nt, Human
cgagccgagaucgcgccgcugcauuccagccugggugacagagcgagaccaugucucaaaaaau

SEQ ID NO: 289039 - RNA, 64 nt, Human
ggggacuuucccacacugugccuuuacgaucagcgugacagaguagaagcuggagugccucacc

SEQ ID NO: 289040 - RNA, 64 nt, Human
caagaucacaucacugcacugcacuccagccggggugacagagcgaaccucugucucaaaaaaa

SEQ ID NO: 289041 - RNA, 64 nt, Human
aagcagcuuuaaacaaauucauauucugucuggagugacagaccacaucuuuaucuguucuugc

SEQ ID NO: 289042 - RNA, 64 nt, Human
uucucagaccugugauccguguaucuucuccccagugacagaaguagagaagagaauggaaagc

SEQ ID NO: 289043 - RNA, 64 nt, Human
cucuucuuagggaaaucuccugaaggaaaaaaaugugacagaauguuccauagucugagagaau

SEQ ID NO: 289044 - RNA, 64 nt, Human
ucaaauuacccaguccaccacagaaucagcuaaugugacagaaguaaauauagugcgucauaau

SEQ ID NO: 289045 - RNA, 64 nt, Human
gauuaccuggcugaaccauuggcucuguucaccagugacagaugguuuccccauccacugagug

SEQ ID NO: 289046 - RNA, 64 nt, Human
agagcuaugcuccuccucaaagcacaaucauccugugacagaaguugcugcaacacgcguuugu

SEQ ID NO: 289047 - RNA, 64 nt, Human
ucuucucauguauuauccaugguuuucucuguuugugacagauuaguaaaauuuaaugagcccu

SEQ ID NO: 289048 - RNA, 64 nt, Human
aauuaaggauauaaacuuuccacaccuuccugucgugacagauaaaagcacagaaaggacaacc

SEQ ID NO: 289049 - RNA, 64 nt, Human
uucauggaccaaaggguuuacuugacaaauuugugugacagacuccgaacaauuccuuuacuac

SEQ ID NO: 289050 - RNA, 64 nt, Human
ugagccgagauugcgccacugcacacuagcuugggugacagaggaagacugucucaaaaaaaaa

SEQ ID NO: 289051 - RNA, 64 nt, Human
uacuuacauugagugauguguuuaacaacaaauugugacagagcugagugcuccuaucuuacag

SEQ ID NO: 289052 - RNA, 64 nt, Human
ugaaaaauguacaauuuaacauuuuaaauaaauagugacagaaguuguuuauacucugugucag

SEQ ID NO: 289053 - RNA, 64 nt, Human
aacaugcuaauuccucuucaguguuuauuuucuagugacagaaugcuaacauuucuuacacccu

SEQ ID NO: 289054 - RNA, 64 nt, Human; identical to SEQ ID NO: 278665

SEQ ID NO: 289055 - RNA, 64 nt, Human; identical to SEQ ID NO: 288678

SEQ ID NO: 289056 - RNA, 64 nt, Human; identical to SEQ ID NO: 288679

SEQ ID NO: 289057 - RNA, 64 nt, Human
ugagccaugauugagccaccacacuccaaccuaggugacagagcaagacccugucucaaaaaaa

SEQ ID NO: 289058 - RNA, 64 nt, Human
cacagagccauaccauaucagcccagaucaaguagugacagaguagggauuugaauacagguua

SEQ ID NO: 289059 - RNA, 64 nt, Human
ugagccaagaucgcgccacugcacuccagccugggugacagaacaagacugucucaaaaaaaaa

SEQ ID NO: 289060 - RNA, 64 nt, Human
ucuguugaugcaugccagugcugguuacuagucagugacagagaacacagagagggacaaacac

SEQ ID NO: 289061 - RNA, 64 nt, Human
cccgcuggcuucuggcugguccagugaugggcaagugacagaccuuccccaggcucugcuucca

SEQ ID NO: 289062 - RNA, 64 nt, Human
ugagccgugauugugccaauguacuccagccuaggugacagagugagacccugucucaaaaaua

SEQ ID NO: 289063 - RNA, 64 nt, Human
guccuagcaaguacucaggagagcaggggugggugugacagaggcuggcucuggauugggggac

SEQ ID NO: 289064 - RNA, 64 nt, Human
ggaauaaauaauucaccuauauguguuugagguugugacagacuuauaaaaucuuuuuaaaaaa

SEQ ID NO: 289065 - RNA, 64 nt, Human
uaccacagguuccugaauaauuccugcagggcuggugacagacauaacagcucugguuuuauaa

SEQ ID NO: 289066 - RNA, 64 nt, Human
aauuugucaagaaggccuuauccauuucgauugugugacagauugaaauuuauuguuuacauug

SEQ ID NO: 289067 - RNA, 64 nt, Human
ccacccaauuuccccacuguccucugauccccucgugacagaaccuuucagcauaacgccucac

SEQ ID NO: 289068 - RNA, 64 nt, Human
ucuaguuaugugcccuauaaugauguuucagucagugacagaccucauauauggcagugguucc

SEQ ID NO: 289069 - RNA, 64 nt, Human
ugagacgagauugugccacugcacucuagccugggugacagagcaaaacugugucucaaaaaaa

SEQ ID NO: 289070 - RNA, 64 nt, Human
aggacgucgguguucccaacuccaaggggaccuggugacagacgaggcugcaggcugccucccu

SEQ ID NO: 289071 - RNA, 64 nt, Human
ugagccaugauugcacuacugcagugcaaccugggugacagagugagacccugacucagaaaga

SEQ ID NO: 289072 - RNA, 64 nt, Human
augaaaaggacuguucaagugggucuggccaaaugugacagaugcagaucuuagaggacuuaca

SEQ ID NO: 289073 - RNA, 64 nt, Human; identical to SEQ ID NO: 278666

SEQ ID NO: 289074 - RNA, 64 nt, Human; identical to SEQ ID NO: 288697

SEQ ID NO: 289075 - RNA, 64 nt, Human
ugagucgagauugcacugcugcauuccagccagggugacagagugagaccauguuucaaacaag

SEQ ID NO: 289076 - RNA, 64 nt, Human
cgagccaagaucgcgccacugcacuccagccugggugacagagcgagacucugucucaaaaaaa

SEQ ID NO: 289077 - RNA, 64 nt, Human
uaagccaagaucgugccacugcacuccagccuuggugacagagcaagacuccgucuccaaaaaa

SEQ ID NO: 289078 - RNA, 64 nt, Human
gucucuacaaaaaaaaaauuugccaagagccugagugacagagcaagaccccaucucaaaaaaa

SEQ ID NO: 289079 - RNA, 64 nt, Human
gccccugcaaaggguauugauggacuuccugccagugacagagcaugucuauugcaaacaauuc

SEQ ID NO: 289080 - RNA, 64 nt, Human
guuuucuccauugcauuguuaggcauggugacaagugacagaguucuugcccucuguccaguuu

SEQ ID NO: 289081 - RNA, 64 nt, Human
ugagcugagaucgcgccacugcacuccagccugggugacagagcgagacuaucucagaaacaaa

SEQ ID NO: 289082 - RNA, 64 nt, Human
ccgugguccuuuguaaacuauggcuccaugcugugugacagaucaacgugcugaugguaaguag

SEQ ID NO: 289083 - RNA, 64 nt, Human
guaagcugagaucgugccacugcacuccagccuggugacagagugagacuccgucucaaaaaaa

SEQ ID NO: 289084 - RNA, 64 nt, Human
agacuccauagcugugccuaggagucuaggaaaagugacagaggcuuggcuuuuuuaccuuuag

SEQ ID NO: 289085 - RNA, 64 nt, Human
uaagccaaggucaugccacugcacucuagccugggugacagagcgagacuccaucucaaaaaaa

SEQ ID NO: 289086 - RNA, 64 nt, Human
ugagcugagaucacgccacugcacuccagucugggugacagagagagaccauauccaaaaaaaa

SEQ ID NO: 289087 - RNA, 64 nt, Human
uggcuuaaccaaacaaugacuccucauuccagcggugacagaagagaaagggucauuuacauca

SEQ ID NO: 289088 - RNA, 64 nt, Human
ugagccaagaucgugccacugcacuucagccugggugacagaaagagaccuucucucaaaaaaa

SEQ ID NO: 289089 - RNA, 64 nt, Human
ccaaaaaaucccaggaacuccuaaaccuuccccugugacagaagaugagguuggcagcugauca

SEQ ID NO: 289090 - RNA, 64 nt, Human
ucaacauaaugcuuaagaauggaauuuccucucugugacagaacccaggaauuaauuccuaaau

SEQ ID NO: 289091 - RNA, 64 nt, Human; identical to SEQ ID NO: 288643

SEQ ID NO: 289092 - RNA, 64 nt, Human; identical to SEQ ID NO: 288660

SEQ ID NO: 289093 - RNA, 64 nt, Human
ugcuugaacccaggaaguggcaguugcagugagccgagacgacaccacugcacuccagccuggg

SEQ ID NO: 289094 - RNA, 64 nt, Human
cugggacucucagcccccaguugcuuauccagaugugacagagcucgacccaagccaggcugca

SEQ ID NO: 289095 - RNA, 64 nt, Human
ugagccgugaucaugccacugcacuccagccugggugacagagugagacccugucuuuaaaaaa

SEQ ID NO: 289096 - RNA, 64 nt, Human
gacauugcggacagccacggccaggccagagggagugacagaggcagccccauucugccugccc

SEQ ID NO: 289097 - RNA, 64 nt, Human
ugagccgagaucacgccacugcacuauagccuaggugacagagugagacucugucucaaaaaaa

SEQ ID NO: 289098 - RNA, 64 nt, Human
gggagggagacugcaccacugcacuucagccugggugacagagggagacucugucuuaaaaaaa

SEQ ID NO: 289099 - RNA, 64 nt, Human
auuagacggucccauaugggagugaugggagacagugacagaucaucaggcauuagauucucau

SEQ ID NO: 289100 - RNA, 64 nt, Human
ugaacagagacagugccacugcacaucagccugagugacagagagacuuugucucaaaaaaaaa

SEQ ID NO: 289101 - RNA, 64 nt, Human
ugagccgagauugcaccaccgcacuccagccugggugacagagcgagacuuaucucauaaauaa

SEQ ID NO: 289102 - RNA, 64 nt, Human
ucucauaaauaaauagauagauacuccagccugggugacagagcgagacuuauagauagauaga

SEQ ID NO: 289103 - RNA, 64 nt, Human
ugagcugaaauccugccacugcacaccagccugggugacagagcgagacuccaucucaaaaaaa

SEQ ID NO: 289104 - RNA, 64 nt, Human
ugaauucauucuggaggggcaguggagaucaggagugacagaucacagggugagggccaccucc

SEQ ID NO: 289105 - RNA, 64 nt, Human
cagccccuguccucaccaugggccugggccaggugugacagaguagagguagcacagggggcug

SEQ ID NO: 289106 - RNA, 64 nt, Human
agccaagauggugccauugcacuccagccugggcgugacagagugagacuccaucugauuguaa

SEQ ID NO: 289107 - RNA, 64 nt, Human
ugagccgagaucccgccacugcacuccagcccaggugacagagcgagacuccaucucaaaaaaa

SEQ ID NO: 289108 - RNA, 64 nt, Human
gcuugcuguuugcugcccagccauaacccacucagugacagacgaacacagcuaaggccucgcu

SEQ ID NO: 289109 - RNA, 64 nt, Human
cgaagaucgcaccacugcacgcacuccagccugggugacagagcgagacuccgucucaaaaaaa

SEQ ID NO: 289110 - RNA, 64 nt, Human
ugcuuggccaggaggugagagaaggauggguccccuccgccauggggucggcuccugauggugu

SEQ ID NO: 289111 - RNA, 62 nt, Human
ggcagcuguaagaggugcuaggaggcugccgccuccgccagcgccugucgccgucacucucc

SEQ ID NO: 289112 - RNA, 64 nt, Human; identical to SEQ ID NO: 278491

SEQ ID NO: 289113 - RNA, 64 nt, Human
cauagcuaugugacaaugagaagcaaacuuuuuugugacagauuguauuggcauaggcaugaua

SEQ ID NO: 289114 - RNA, 64 nt, Human
cuugagcccaggcaucguugagcauuaacacucugugacagagcugcagaccccugccuugagu

SEQ ID NO: 289115 - RNA, 64 nt, Human
cucugcaccugucuucuguuaccaucccuggacagugacagauuuuaagccagccaccagaauu

SEQ ID NO: 289116 - RNA, 64 nt, Human
cgcagugagauugcgccauugcauuccagccugggugacagagcgagacuccguaucagaaaga

SEQ ID NO: 289117 - RNA, 64 nt, Human
gugaccccucauugcaccacuuuacuuagccugggugacagagugagacccuaucucaaaaaaa

SEQ ID NO: 289118 - RNA, 64 nt, Human
cuggggaaccucaaccuccccccugccucgguuggugacagagggggugggacaggggcggggg

SEQ ID NO: 289119 - RNA, 64 nt, Human
ucagccaagaucaugcuacugcacuccagccugggugacagagcgagacuccgucucaaaaaaa

SEQ ID NO: 289120 - RNA, 64 nt, Human
guuguaacugcuugagguauguuuuaugaauuaagugacagauuuguuauccuuuauuaacgua

SEQ ID NO: 289121 - RNA, 64 nt, Human
ucuagggguagcagccggugugacucccuuucuggugacagacagggccccagcagcccugucu

SEQ ID NO: 289122 - RNA, 64 nt, Human
ccggaggcaccuggguccaucagagaaggugcaggugacagaggcgaaggcagauggggcacug

SEQ ID NO: 289123 - RNA, 64 nt, Human
caugaccuacuucaaaccccuacugaccuggcuggugacagaacaugcagcaaggggacaucuu

SEQ ID NO: 289124 - RNA, 64 nt, Human
ggagccgaggccgcaccacugcacuccagccugggugacagagugagacuccaacucaaaaaaa

SEQ ID NO: 289125 - RNA, 64 nt, Human
ugagcuaugauugcaccacugcacuccaaccugggugacagagugagacccugucucaaaaaaa

SEQ ID NO: 289126 - RNA, 64 nt, Human
ugagccaagaucgcacuacugcacuccagccugggugacagaguaagacccugucucaacaaaa

SEQ ID NO: 289127 - RNA, 64 nt, Human
ugagccgagaucgcgccacugcacuccagccugggugacagagccagacuccaucucaaagaaa

SEQ ID NO: 289128 - RNA, 64 nt, Human
auuggggugauaaggggccuugcucugagcacaggugacagaucauaggaaguggcuggucugg

SEQ ID NO: 289129 - RNA, 62 nt, Human; identical to SEQ ID NO: 289111

SEQ ID NO: 289130 - RNA, 64 nt, Human; identical to SEQ ID NO: 278618

SEQ ID NO: 289131 - RNA, 64 nt, Human
gcagcauaagagaaugugaagcccuucagugagacgagacgagcaaugggaaaccuuuucuguu

SEQ ID NO: 289132 - RNA, 64 nt, Human
ugagcugagaucgcgccauugcacuccagccugggugacagagcaagacucugucucauaaaua

SEQ ID NO: 289133 - RNA, 64 nt, Human
aaucaguguuugugaagaggcaggacuggccagagugacagacauacggugauccaggaggcuc

SEQ ID NO: 289134 - RNA, 64 nt, Human
ugaaccaagaucgggccacugcacuccagcuugggugacagagcaagacuccaucucaaaaaaa

SEQ ID NO: 289135 - RNA, 64 nt, Human
ggggucauaaucaugccacuguacuccagccugggugacagagugagacccugucuccgaaaaa

SEQ ID NO: 289136 - RNA, 64 nt, Human
ugagcucagauagugccacugcacuccagccugggugacagagcgagacuccgucucaaaaaaa

SEQ ID NO: 289137 - RNA, 64 nt, Human
uuggcccugacuccugcggggguauggggaagcugugacagaaacgaugggugcugugguccuc

SEQ ID NO: 289138 - RNA, 64 nt, Human
ugagccaaggucgcgacacugcacuccagccugggugacagagugagacuccaucucaacagaa

SEQ ID NO: 289139 - RNA, 64 nt, Human
aauccacaaaagccacuuuauuuuaaaauaucaugugacagauacuuuccagagcuacaacaug

SEQ ID NO: 289140 - RNA, 64 nt, Human
uggggagaggaauucugugagccuuuucauuucggugacagaagagaugggcagagcaacuuau

SEQ ID NO: 289141 - RNA, 64 nt, Human
gcuucugccaugaaauccuggccaugggaccccagugacagaugaugucuuccauggucaucag

SEQ ID NO: 289142 - RNA, 64 nt, Human
ugagccaagauugcaccauugcauuccagccugggugacagagcgagacuccaucucaaaaaaa

SEQ ID NO: 289143 - RNA, 64 nt, Human
ugagccgggaccgugccauuguacuccagccugggugacagagcgagauuccgucucaaaaaaa

SEQ ID NO: 289144 - RNA, 64 nt, Human
ugagcugagauugcaccacuggacuacagccugggugacagagcgagacucugucucaaaaaaa

SEQ ID NO: 289145 - RNA, 64 nt, Human
ggcuuuaggcacuuuugugccagagcuugugagggugacagaagaggguccaggcuggaaaccu

SEQ ID NO: 289146 - RNA, 64 nt, Human
cuuuucauauuaaugacaaaauuagagucuggaagugacagaagucagaucuacagccacccag

SEQ ID NO: 289147 - RNA, 64 nt, Human
ugagcugagaucacaccacugcacuccagccugggugacagagagacucugucucaaaaaaaaa

SEQ ID NO: 289148 - RNA, 64 nt, Human
acacuccguaaacagcccagcuguaacgccagaccgagacgaacacucugccuaacuaucaaag

SEQ ID NO: 289149 - RNA, 64 nt, Human
cagaggccaaagcacuaaggggagggcgcauacccgagacgauuguaugaagaaaauauggagg

SEQ ID NO: 289150 - RNA, 64 nt, Human; identical to SEQ ID NO: 287314

SEQ ID NO: 289151 - RNA, 64 nt, Human
aaacuccaauguagaaauucaacauuugcugucugugacagaugaacuuuugcauguguauaua

SEQ ID NO: 289152 - RNA, 64 nt, Human
ugagcugagaucaugccacugcacuccggccuaggugacagagggaaacuccaucuccaggaaa

SEQ ID NO: 289153 - RNA, 64 nt, Human
gauggaagguaauguuuaauguugaugucauggagugacagaauggcuuugcuggcacucagag

SEQ ID NO: 289154 - RNA, 64 nt, Human
cuauaaacagugaacuuaauauguuucugugagagugacagagcugugcccguuuaucuucauu

SEQ ID NO: 289155 - RNA, 64 nt, Human
ugucuauaacucagaucgcaccaaacuuccuguggugacagacucuuccauuucagacugguuu

SEQ ID NO: 289156 - RNA, 64 nt, Human
gaaauggaagaaaaagauucagccaaguggggaggugacagaugcacaauuaugaaaccugguu

SEQ ID NO: 289157 - RNA, 64 nt, Human
gguaauauguuugcagccugcuguccagccaagagugacagauacuucuagugacuuccccggu

SEQ ID NO: 289158 - RNA, 64 nt, Human
ugagccgagauugcgccacuggacuccagccugcgugacagagagccugucucuaaauuaauua

SEQ ID NO: 289159 - RNA, 64 nt, Human
ugcaggaggcugcuuuuggcacuacccaccccgugugacagaauaggagccagcgacucaggac

SEQ ID NO: 289160 - RNA, 64 nt, Human
ugagccgugauggcaccauugcacuccaaccggggugacagaugagguccucuguuuaccuccc

SEQ ID NO: 289161 - RNA, 64 nt, Human
ugagcugagauugugccacugcacuccagccugggugacagagugagauuccgucucaacaaga

SEQ ID NO: 289162 - RNA, 64 nt, Human
gugagccaugauugugccacugcacuccagcuuggugacagagugagauccugucucuaaauaa

SEQ ID NO: 289163 - RNA, 64 nt, Human
ugagcucagauugcgucacugcacuccaaccugggugacagagcgagacuccaccucaaaaaaa

SEQ ID NO: 289164 - RNA, 64 nt, Human
uuccuccccucaacagugaguuagacucaagggggugacagaaccgagaagggggugacagucc

SEQ ID NO: 289165 - RNA, 64 nt, Human
aacauuguuagucuguggguuuagaaagacugaagugacagauuaagaguucuugauauuagau

SEQ ID NO: 289166 - RNA, 64 nt, Human
ugaggcaguuuugguggaugggggaccuccacuggugacagagaagacaccaggguuuggggga

SEQ ID NO: 289167 - RNA, 64 nt, Human
uuuccacggaaacagaacucgaugcacugaccugcuccgccaggaaagugagcguguagcgucc

SEQ ID NO: 289168 - RNA, 64 nt, Human
ugucuccaacugcugcaccccaucccgacccugucuccgccaccucgcagccccauuaaagcgc

SEQ ID NO: 289169 - RNA, 64 nt, Human
caaugacaugugugcuagagcuuacucugagaaggugacagaguucauguugugugcugggcuc

SEQ ID NO: 289170 - RNA, 64 nt, Human
guuuagcuauugacuauggcugcuuuagacaacugugacagacuauauggcucgcaaaacugca

SEQ ID NO: 289171 - RNA, 64 nt, Human
gggcaguugaccugcacagacaggaaccucagcagugacagaagagagauccagggaugggucu

SEQ ID NO: 289172 - RNA, 64 nt, Human
ugaacuaugauggugccacugcauuccagccugggugacagaaugaaauccuggcacaaaaaaa

SEQ ID NO: 289173 - RNA, 64 nt, Human
ugagcugagcuaacaccacggcacuucagccugggugacagaaugagacucugugucaaaaaaa

SEQ ID NO: 289174 - RNA, 64 nt, Human
cgagcugagaucacaccacugcacuccagccuuggugacagagugagacucugucucaaaaaaa

SEQ ID NO: 289175 - RNA, 64 nt, Human
gugagccgagauugcaccacugcacuccagccgggugacagagugagacuccaucucaaaaaca

SEQ ID NO: 289176 - RNA, 64 nt, Human
acuuggugucaggagaggacauggagggggcugagugacagagaugguucagcugguaccagag

SEQ ID NO: 289177 - RNA, 64 nt, Human
ugagcugagaucgugccacugcacuccagccugggugacagagugagacccugucucaaaaaaa

SEQ ID NO: 289178 - RNA, 64 nt, Human
ugagccaugaucauaccacugcacuccagccugggugacagagcgagacccugucucaaaaaaa

SEQ ID NO: 289179 - RNA, 64 nt, Human
gaggccaagauuguaccacuguauuccagcccgggugacagagcaagacugugucucaaaaaaa

SEQ ID NO: 289180 - RNA, 64 nt, Human
uugguaauuauacugcauugauuuuguuguuguugugacagaguuucacucugucccccaggcu

SEQ ID NO: 289181 - RNA, 64 nt, Human
ggacgcgggagggugcaugucuugggaaaagggggugacagacaacuuuugagagggcagcaga

SEQ ID NO: 289182 - RNA, 64 nt, Human
aaauguuuguuaauaaaaauaagaaauagcuacagugacagauuuuagagcaaaaauuaguaau

SEQ ID NO: 289183 - RNA, 64 nt, Human
ugagccaagaucgcgccacugcacuccagccugggugacagagcgagaccgucucaaaaagaaa

SEQ ID NO: 289184 - RNA, 64 nt, Human
auccauaaugagagaucuuacaaguguaauaaaugugacagauuuuucagauaucguucauaua

SEQ ID NO: 289185 - RNA, 64 nt, Human; identical to SEQ ID NO: 288680

SEQ ID NO: 289186 - RNA, 64 nt, Human; identical to SEQ ID NO: 287557

SEQ ID NO: 289187 - RNA, 64 nt, Human
ugccauugcaggugcccccuccaggccugacuggcuccgccaggcacuaaccugccauaacccu

SEQ ID NO: 289188 - RNA, 64 nt, Human
ugagcagagaucaugcuacugcacuccagccugggugacagagcgagacuccaucucaaaaaaa

SEQ ID NO: 289189 - RNA, 64 nt, Human
ggagccaugaucaugccauuguacuccagcaugggugacagagacagauaguguaucgaaaaau

SEQ ID NO: 289190 - RNA, 64 nt, Human
cauaauaaugagaaaucacauaaauguacugugugugacagaggcuuuauucaggccucacagc

SEQ ID NO: 289191 - RNA, 64 nt, Human
gugagccgagauugcaccacugcacuccagccuggugacagagcgagacuccgucucaaaaaaa

SEQ ID NO: 289192 - RNA, 64 nt, Human
ugagcuaagaucgcaccacugcacuccagccugggugacagagcgagacuccauuucaaaaaaa

SEQ ID NO: 289193 - RNA, 64 nt, Human
ugagucgagauaacacuacugcauuccagccugggugacagagugagacucccccucaaaaaaa

SEQ ID NO: 289194 - RNA, 50 nt, Human
uuuuggugcugagcgcaugagugacagaggcagagaugcugcugcaacug

SEQ ID NO: 289195 - RNA, 64 nt, Human
gagaaauuuccugacaagguauauuuguuuucuagugacagaaaggcaaaggaacaaguccuag

SEQ ID NO: 289196 - RNA, 64 nt, Human
ugagccgagaucacaccacugcacuccagccugggugacagagcgaggcuccgucucaaaaaaa

SEQ ID NO: 289197 - RNA, 64 nt, Human
ugagccgugauugcaccacugcacuccagccugagugacagagcgagacccugucucaaaaaac

SEQ ID NO: 289198 - RNA, 64 nt, Human
ugagcuaugguggcaccacugcacuccagccugggugacagagcaagacccugucucuaaaaua

SEQ ID NO: 289199 - RNA, 64 nt, Human
uuucagagggcagggagcaauuuuucuauggcaugugacagauuccuccaguuagaaaaagcug

SEQ ID NO: 289200 - RNA, 64 nt, Human
auccacauauccacaagaagugccucuuaggucugugacagagagugugucuccauuccucagu

SEQ ID NO: 289201 - RNA, 64 nt, Human
ucauaggugucuauuuggacucuaagcucuacgggugacagaucuuguuucugaagaugguuua

SEQ ID NO: 289202 - RNA, 64 nt, Human
ugagcucugaugguaccacugcacuccagccugggugacagagcgagacccugucuuaaaaaaa

SEQ ID NO: 289203 - RNA, 64 nt, Human
ugagcugaaauugugccacugcacuccagccugagugacagagugagacuuugcaaccaaaaaa

SEQ ID NO: 289204 - RNA, 64 nt, Human; identical to SEQ ID NO: 288959

SEQ ID NO: 289205 - RNA, 64 nt, Human; identical to SEQ ID NO: 288960

SEQ ID NO: 289206 - RNA, 64 nt, Human; identical to SEQ ID NO: 278601

SEQ ID NO: 289207 - RNA, 64 nt, Human
gugagccgagaucacgacacugcacuccagcugugugacagaaugagaccaucuccaaaaaaaa

SEQ ID NO: 289208 - RNA, 64 nt, Human
uuguggcgaagaucaaauugaagauaaaauggaagugacagaaaacauugaagucguuacacac

SEQ ID NO: 289209 - RNA, 64 nt, Human
uugacuaaauaaaaaguacaaagggcacauauacgugacagaauuguacacaaucacuccauug

SEQ ID NO: 289210 - RNA, 64 nt, Human
uucagacacagaugcauagggaggacaccaugccgugacagaggcagagggugcagugacacag

SEQ ID NO: 289211 - RNA, 64 nt, Human
gcacacuguuucaucuugacccuuucuugggaaggugacagagagguaggagggcaaacaucuu

SEQ ID NO: 289212 - RNA, 64 nt, Human
cucaguugaacccucugaauucuggauugagaaugugacagaaugaucuggagcccuugcugac

SEQ ID NO: 289213 - RNA, 64 nt, Human
cacaucugcuagaggaacagugacauggacaccugugacagagagaggacaguuaggagggaca

SEQ ID NO: 289214 - RNA, 64 nt, Human
aaucuagguauuucugugaagguauuuuguagaugugacagaaguccauucccaauugacuaag

SEQ ID NO: 289215 - RNA, 64 nt, Human
gagaggaaggggccgccuacuccugcaaaugcuugugacagaugccaggagguagaugugugcu

SEQ ID NO: 289216 - RNA, 64 nt, Human
acccaguguagggaaacacagccagaccacuguggugacagacuuucuuuauaaacauuuggaa

SEQ ID NO: 289217 - RNA, 64 nt, Human
cuuuggaaugggagcguggaaccaccuguacagagugacagauuugggaugcaccacuggauug

SEQ ID NO: 289218 - RNA, 64 nt, Human
ugagccgagauaucgccacugcacuccagccugggugacagagcgagacuccaucucaaaaaaa

SEQ ID NO: 289219 - RNA, 64 nt, Human
ugagcugagaucgugccacugcacuccagccugggugacagagugagacccuauuucaaaaaaa

SEQ ID NO: 289220 - RNA, 64 nt, Human
ugccgaucccaggcacuugaccuuguuccugugggugacagagaugagaaccagggaagcugug

SEQ ID NO: 289221 - RNA, 64 nt, Human
ugagccaagaucgcgccacugcacuccagccugggugacagagcgagacuccgucucaaaaaaa

SEQ ID NO: 289222 - RNA, 64 nt, Human
gugugugugugugugugugugugugugugugugugugacagagagagagcgagagagccugugu

SEQ ID NO: 289223 - RNA, 64 nt, Human; identical to SEQ ID NO: 288847

SEQ ID NO: 289224 - RNA, 64 nt, Human; identical to SEQ ID NO: 288848

SEQ ID NO: 289225 - RNA, 63 nt, Human; identical to SEQ ID NO: 278635

SEQ ID NO: 289226 - RNA, 64 nt, Human
gugagcuaagacugcaccacugcacuccagccuggugacagaacgagacucugucuuaaaaaca

SEQ ID NO: 289227 - RNA, 64 nt, Human
ugagcugugaucucaccacugcauuccagccugggugacagaguuagauuccacccucucccac

SEQ ID NO: 289228 - RNA, 64 nt, Human
agcuguuuacugacauggugcugugugugagcgagugacagaaggcccgaggaggccgacuggg

SEQ ID NO: 289229 - RNA, 64 nt, Human
gggcauggcacugagaugcauccacucagcaggagugacagaggcagaaguuccuuuaaagcac

SEQ ID NO: 289230 - RNA, 64 nt, Human
acaggguuuggcuugcaguuucccuuucaaauaugugacagagaucucacagcugaacgugacu

SEQ ID NO: 289231 - RNA, 64 nt, Human
cacucccccgcuuuuuuggcgaauccuaguaagagugacagaagcagguggcccugugggcuga

SEQ ID NO: 289232 - RNA, 64 nt, Human
ugagccaagauggcaccacugcacuccagccuaggugacagagugagacuccgucucaaaaaaa

SEQ ID NO: 289233 - RNA, 64 nt, Human
cccuuuguuucccucauccucggcucccacacaggugacagacccagcagauagcuucucucug

SEQ ID NO: 289234 - RNA, 64 nt, Human
uccuucaaaagaccaaaagugacuggugucucgugugacagauugcuucauuuauguuucuaca

SEQ ID NO: 289235 - RNA, 64 nt, Human
ugagccaagauugugccacuguauuccaacuugggugacagagcacgacucugucucaaaaaaa

SEQ ID NO: 289236 - RNA, 64 nt, Human
ucaacaugauuucauaaggugcaaauaaaaguuggugacagauuuaauauaauuuugaucacaa

SEQ ID NO: 289237 - RNA, 64 nt, Human
cgagccaagaucgcaccacugcacuccagccugggugacagagcgagaaucagucucaaaaaaa

SEQ ID NO: 289238 - RNA, 64 nt, Human
ugagccgagauugugccacugcacuccaaccugggugacagagugagauuccaucugaaaaaca

SEQ ID NO: 289239 - RNA, 64 nt, Human
ugagcagagaucacaccacugcacucuagccugggugacagagcaagacucugucuaaaaaaca

SEQ ID NO: 289240 - RNA, 64 nt, Human
aggcugcagugagcugcacugcauuccagccugggugacagagugagauccugucucugaagaa

SEQ ID NO: 289241 - RNA, 64 nt, Human
ugauccgagaucacaccacugcauuccagccugggugacagagugagacccuguccaaaaaaaa

SEQ ID NO: 289242 - RNA, 64 nt, Human; identical to SEQ ID NO: 288714

SEQ ID NO: 289243 - RNA, 64 nt, Human; identical to SEQ ID NO: 288715

SEQ ID NO: 289244 - RNA, 64 nt, Human; identical to SEQ ID NO: 278602

SEQ ID NO: 289245 - RNA, 64 nt, Human
ugagccaagaucacaccauugcacuccagccugggugacagagugagacucugucucaagaagg

SEQ ID NO: 289246 - RNA, 64 nt, Human
aguuuucauucucugucaauaugacaagcucaaagugacagaauauguuauagguugaagcaca

SEQ ID NO: 289247 - RNA, 64 nt, Human
aagucuuacuucguguccuuccuuuguagagaaagugacagagcaggcggguggugaaguaggg

SEQ ID NO: 289248 - RNA, 64 nt, Human
aguauuccuagcacucaauguaaucacccuauuugugacagagaaagggaaaaaaauauaauaa

SEQ ID NO: 289249 - RNA, 64 nt, Human
ugagucaugauuguaugacugcacuccagccugggugacagagcaagacccuguuucaaaaaga

SEQ ID NO: 289250 - RNA, 64 nt, Human
ugaucugagaucacaccauugcccuccagccugggugacagagugagacccuguuccaaaaaaa

SEQ ID NO: 289251 - RNA, 64 nt, Human
agucaugggacuuuuuccuagggcucuauuaacagugacagaaagccauucccauucaauuacu

SEQ ID NO: 289252 - RNA, 64 nt, Human
ugagccaagaucgcaccauugcacaccaaccugcgugacagagcaagauugcaucucaaaacaa

SEQ ID NO: 289253 - RNA, 64 nt, Human
gagagaccuuuuuuuuuaauguucgguuaaaaaugugacagaugaguacaaaaaugcagacacu

SEQ ID NO: 289254 - RNA, 62 nt, Human
uccugugaugucccaguuucccacucugaagaucccaacaugguccuagcacugcacacuca

SEQ ID NO: 289255 - RNA, 62 nt, Human
agauggcugagugcaauggcucacacuuguaaucccaacacuuuggaaggcugaggcgggag

SEQ ID NO: 289256 - RNA, 62 nt, Human
cagugagcaagagaaaugucuaaagcugcuucucccaacaccguccaaagucuccacugccu

SEQ ID NO: 289257 - RNA, 62 nt, Human
auaugaaauauuacagucacucacuccuguaaucccaacacuuugggaggcugaggcgggag

SEQ ID NO: 289258 - RNA, 62 nt, Human
uaauaagugcauguaugcucacugucaaaaauucccaacacuagaaaaucauguagaauaaa

SEQ ID NO: 289259 - RNA, 64 nt, Human; identical to SEQ ID NO: 288868

SEQ ID NO: 289260 - RNA, 64 nt, Human; identical to SEQ ID NO: 288961

SEQ ID NO: 289261 - RNA, 64 nt, Human; identical to SEQ ID NO: 288885

SEQ ID NO: 289262 - RNA, 62 nt, Human
ugaucacuacagaugaacccaaugugccaacuucccaacagucuauagaguauuagaagauu

SEQ ID NO: 289263 - RNA, 62 nt, Human
cagcuacccacuuuccuucaugaacaucccccucccaacacuacccuucccugcacuaaagc

SEQ ID NO: 289264 - RNA, 62 nt, Human
aauaagcugcgugugguggcucacaccuguaaucccaacacuuugggacguugaaaugggag

SEQ ID NO: 289265 - RNA, 62 nt, Human
acuaggccaggcgugguggcucacgccuguaaucccaacacuuugggaggccgaggcgggcg

SEQ ID NO: 289266 - RNA, 62 nt, Human
cagaguguccuagagaaccucccagguguggaucccaacaaugaagccauucgaaaugcuau

SEQ ID NO: 289267 - RNA, 62 nt, Human
gggacccugucauccugcuuuauuuauuugggucccaacaccccgcagccgcaugccccuua

SEQ ID NO: 289268 - RNA, 62 nt, Human
uggauuuucaaagauuguuggcaguuuccuccucccaacaguuuuaccucgggaugguuggu

SEQ ID NO: 289269 - RNA, 62 nt, Human
uguggauuaucaaguuuugaaggaacuguacaucccaacagacugaaacauucuaagugaaa

SEQ ID NO: 289270 - RNA, 62 nt, Human
auuugggcaggugcaguggcucacaccuguaaucccaacaccuugggaggccaaggugggcg

SEQ ID NO: 289271 - RNA, 62 nt, Human
augacccacggucagcccccaaaccaaaguugucccaacagaggaggccagugaggcagaga

SEQ ID NO: 289272 - RNA, 62 nt, Human
gugauuuuccucgguggaggaggcccguggggucccaacacggaagagccaugggccgugug

SEQ ID NO: 289273 - RNA, 62 nt, Human
gugaaucacauaauugucuuuggaacuuggucucccaacacuuauugugauugcaaaguguu

SEQ ID NO: 289274 - RNA, 62 nt, Human
gccaccggugugggggauggaggcgcguuugcucccaacauccuggagaauaaagaaggccu

SEQ ID NO: 289275 - RNA, 62 nt, Human
ucuaggccaggcaugguggcucaugccuguaaucccaacacuuaggguggcugaggcaggca

SEQ ID NO: 289276 - RNA, 62 nt, Human
gccagugguccaaggagggagacagagggucgucccaacagggggagguagggcuuugaaaa

SEQ ID NO: 289277 - RNA, 62 nt, Human
agaaggcugggcgugguggcucaugccuguaaucccaacacuuugggaggccaaggcaggca

SEQ ID NO: 289278 - RNA, 64 nt, Human; identical to SEQ ID NO: 288772

SEQ ID NO: 289279 - RNA, 64 nt, Human; identical to SEQ ID NO: 288773

SEQ ID NO: 289280 - RNA, 64 nt, Human; identical to SEQ ID NO: 278617

SEQ ID NO: 289281 - RNA, 62 nt, Human
agguggcugcgugugguggcucaugccuguaaucccaacauucugggaggcccaggcgggag

SEQ ID NO: 289282 - RNA, 62 nt, Human
ccuuaccacugaucuggccaagaaugaggcccucccaacacuuucacucccucuccaagccu

SEQ ID NO: 289283 - RNA, 62 nt, Human
auaguggaauagagaaacagcuccucgccucuucccaacaacgcaaauuaugagcagcuccu

SEQ ID NO: 289284 - RNA, 62 nt, Human
uaaaucaugagaucagagaugcuguucaucagucccaacaagauggccuagaaaucgcauuc

SEQ ID NO: 289285 - RNA, 62 nt, Human
aaaacgccacguguaguggcucaugccuguaaucccaacacuuugggaggcugaaguaggag

SEQ ID NO: 289286 - RNA, 62 nt, Human
uggccugagaccggggcacaggguaggggggaucccaacacuccucccuguggaggaggcag

SEQ ID NO: 289287 - RNA, 62 nt, Human
aagccggcuggggugguggcucacgccuguaaucccaacacuuugggaggccaaggcaggcg

SEQ ID NO: 289288 - RNA, 62 nt, Human
cccuuaaaaggaaacagaucaacuacaccgcaucccaacaacccagguucuuuuccuuccuu

SEQ ID NO: 289289 - RNA, 62 nt, Human
aggcaaauccgaaaucagcaggacgacuguuuucccaacacggguaaaucuaguaccauguc

SEQ ID NO: 289290 - RNA, 62 nt, Human
auugcuaugcauuuauuaggaaaaacugaauuucccaacaggugaacugaaaaguuauuuua

SEQ ID NO: 289291 - RNA, 62 nt, Human
ugggggcugggugcaguggcucacaccuguauucccaacacuuuuggaggcugagguuggag

SEQ ID NO: 289292 - RNA, 62 nt, Human
ucuucaguagccaucagaucagaaagaaucucucccaacauuuuagagucuugcuucccaaa

SEQ ID NO: 289293 - RNA, 62 nt, Human
aguaagccgggcgcgguggcucacgccuguaaucccaacacuuugggaggccaaggugggug

SEQ ID NO: 289294 - RNA, 62 nt, Human
aacuggaguaaaugcaauacuguguuguaauaucccaacaaaaaucagacaaaaaauggaac

SEQ ID NO: 289295 - RNA, 62 nt, Human
uuacguuguaccauucuguugggcaacaauugucccaacaaccacacuuaaauccagugggg

SEQ ID NO: 289296 - RNA, 62 nt, Human
agcaggaugggcgcaguggcucacgccacuaaucccaacauuuuaggaggccuaggcaggag

SEQ ID NO: 289297 - RNA, 64 nt, Human
cacccuucacugugcgugcagacacacugacacacuccgccacgagugcuccagagcccacgag

SEQ ID NO: 289298 - RNA, 64 nt, Human
gaugcacuuccccccaacguccuucgacagugcccuccgccacagacuuugcccggccucaucu

SEQ ID NO: 289299 - RNA, 64 nt, Human
gaauuuaaaaggucacacaaaagaagcaaucgggcuccgccaccacaaaaugaaacccaaggua

SEQ ID NO: 289300 - RNA, 62 nt, Human
aaaaggcugggugugguggcucacacccauaaucccaacacuuuggcucagcagauugcuug

SEQ ID NO: 289301 - RNA, 62 nt, Human
uagaguaagaaauuucagguuguuggugacuaucccaacagucauguuuuaaauguacaguu

SEQ ID NO: 289302 - RNA, 62 nt, Human
aacuuguucacaaacucauucagaaaugauucucccaacaaugcguaucagcuauucauuga

SEQ ID NO: 289303 - RNA, 62 nt, Human
uuugcuuuuuauaaaccaaacucuaucugaaaucccaacaaaaaaaauuuaacuccauaugu

SEQ ID NO: 289304 - RNA, 62 nt, Human
cuuguguugagcaagcaguagcauuugcuuccucccaacaagcagcuggguuaggaaaacca

SEQ ID NO: 289305 - RNA, 62 nt, Human
uccuuccaaagucgguucuggccuaacgcaugucccaacaccuuggguucauuugcccggug

SEQ ID NO: 289306 - RNA, 62 nt, Human
gauguacauuuacaagcggccuuauguacauuucccaacaaucuuuuuaaggcaaaauugug

SEQ ID NO: 289307 - RNA, 62 nt, Human
ccagcccugcaugaaacagaguccaagcugucucccaacagccuggguucgguccuuggcug

SEQ ID NO: 289308 - RNA, 62 nt, Human
uaaaacauaacaagagucaccuuuacuccaguucccaacaaguuccucaucuucaucugagg

SEQ ID NO: 289309 - RNA, 62 nt, Human
aauauuugguuucaaaaggcagauuuaucuucucccaacauucuguuauuucugauacuuuu

SEQ ID NO: 289310 - RNA, 62 nt, Human
uugcuuuugcauccuauucuuacaaagugaugucccaacagggaacaguaggagcuggagug

SEQ ID NO: 289311 - RNA, 62 nt, Human
uccaggccaggcgcgguggcucacgccuguaaucccaacacuuugggaggccgaggugggug

SEQ ID NO: 289312 - RNA, 62 nt, Human
gaauccucuccauuuucccaaauaaaaaccuaucccaacagugacuauaucacucagcauug

SEQ ID NO: 289313 - RNA, 62 nt, Human
acaucuuuguacagagacaucuuggcaccucaucccaacaaaucacauuuguagaaauguaa

SEQ ID NO: 289314 - RNA, 62 nt, Human
uugaggccaggcguggaggcucacaccuauaaucccaacacuuugggaggccgaggugggag

SEQ ID NO: 289315 - RNA, 62 nt, Human
uucauucugcauauucuuucccuaggguuucuucccaacaccaaaggacuuaccaucugucu

SEQ ID NO: 289316 - RNA, 64 nt, Human; identical to SEQ ID NO: 288886

SEQ ID NO: 289317 - RNA, 64 nt, Human; identical to SEQ ID NO: 288887

SEQ ID NO: 289318 - RNA, 64 nt, Human; identical to SEQ ID NO: 289110

SEQ ID NO: 289319 - RNA, 62 nt, Human
acccuacuuucauuccucccaccccaagcaaaucccaacauuucucuucaguguguugacuu

SEQ ID NO: 289320 - RNA, 62 nt, Human
ugggucagcacuuuaccuuuuuucuuuaaggcucccaacaaugcuauacagcgcaguuguuu

SEQ ID NO: 289321 - RNA, 62 nt, Human
ggcguucaggaaacacagauucuuuguccuuuucccaacagcccaggcuguugauaccucag

SEQ ID NO: 289322 - RNA, 62 nt, Human
uguuuuuucauauguacuuuucauuggaagauucccaacaagaauuuggauggaaaaccuga

SEQ ID NO: 289323 - RNA, 62 nt, Human
caaaguaaugaagccagcugccaauuacauccucccaacagcacuuuggucuguggacugcu

SEQ ID NO: 289324 - RNA, 62 nt, Human
ccccaaaacagccugagcaaaaagaccagccuucccaacaugccuccugcccugcuaaagac

SEQ ID NO: 289325 - RNA, 62 nt, Human
aguuggccaggcaugguggcucacgccuguaaucccaacacuuugggaggcugaggcaggca

SEQ ID NO: 289326 - RNA, 62 nt, Human
uugaggccaggugcggugccucacaucuguaaucccaacacuuugggaggcugagaugggug

SEQ ID NO: 289327 - RNA, 62 nt, Human
cuacaagagcagaauuacuugaauuucuugaaucccaacaagaaaacaugauuaaaaaagua

SEQ ID NO: 289328 - RNA, 62 nt, Human
aucguugaacugugcauuuucccugcauuuuuucccaacaaaauuuuguuggggguuauguu

SEQ ID NO: 289329 - RNA, 62 nt, Human
uuuuggccaggcgcgguggcucacggcuguaaucccaacacuuugggagucugaggcgggcg

SEQ ID NO: 289330 - RNA, 62 nt, Human
cauugucaaagcaguggcaagggacggagaggucccaacaggagucaggaagagguuugauu

SEQ ID NO: 289331 - RNA, 62 nt, Human
cauaugcuauuucuggauagagaugacuauuuucccaacaaguagaaacacuuaaaaucauc

SEQ ID NO: 289332 - RNA, 62 nt, Human
guaucuuauugcuaacccucaaaacaagcccuucccaacauaagcgcuuuugugccaaaccc

SEQ ID NO: 289333 - RNA, 62 nt, Human
uguuauuuucauaaguucagauguuuaucaguucccaacauuguuucuuuaucuguaguggg

SEQ ID NO: 289334 - RNA, 62 nt, Human
uuguaaaaggcugccauuauggacauuagguaucccaacauaaccaucuggaguguguccag

SEQ ID NO: 289335 - RNA, 64 nt, Human; identical to SEQ ID NO: 288828

SEQ ID NO: 289336 - RNA, 64 nt, Human; identical to SEQ ID NO: 288829

SEQ ID NO: 289337 - RNA, 64 nt, Human; identical to SEQ ID NO: 278619

SEQ ID NO: 289338 - RNA, 62 nt, Human
aguuugccuggugcaguggcucacaccuguaaucccaacauuuugggaacccaaggugggua

SEQ ID NO: 289339 - RNA, 62 nt, Human
guggggccaggcaugguggcucacacguguaaucccaacacuuugggaggcugaggaggaag

SEQ ID NO: 289340 - RNA, 62 nt, Human
ugccaggccuguaugaggcuuuucccaccagcucccaacagaggccucccccagccaggacc

SEQ ID NO: 289341 - RNA, 62 nt, Human
agucccucugugggagcccgggugccaggcccucccaacaccacaccacccuccaggccccc

SEQ ID NO: 289342 - RNA, 62 nt, Human
gugcagaacuaccaccuuucuuuuagcaccaaucccaacaugaaauuauauuacucagauuu

SEQ ID NO: 289343 - RNA, 62 nt, Human
gaagauaaucuccaaagguccacgaugggcuuucccaacagcuccaccuuacuucuucucau

SEQ ID NO: 289344 - RNA, 62 nt, Human
agcaccugucucccacucaaaccucucccaucucccaacaacugcacuuuagaauaccagca

SEQ ID NO: 289345 - RNA, 62 nt, Human
cuucagccaggcauagugacugaugccuguaaucccaacacuuuguugggaggccaaagcag

SEQ ID NO: 289346 - RNA, 62 nt, Human
ucaaauuuaccuacuucugaguuaccucaguuucccaacaauggaccuuggcacacuggagu

SEQ ID NO: 289347 - RNA, 62 nt, Human
ccucaugaccuaaucgugaccuuaaaggccccucccaacacuguuacaauggcaauuaaauu

SEQ ID NO: 289348 - RNA, 62 nt, Human
gaauagaauuucauuggaaauguaaaacacuuucccaacaauggucaugacuuucuucuguu

SEQ ID NO: 289349 - RNA, 62 nt, Human
uuugggcugggcaugguggcucacaccuauaaucccaacacuuucggaggccaaggagggac

SEQ ID NO: 289350 - RNA, 62 nt, Human
aggauguggcuuuauuuuauaaaucacaaccaucccaacaguggauuuaaacaagauuucuu

SEQ ID NO: 289351 - RNA, 62 nt, Human
acgcaggagccuauccugaauuuuguaaaauaucccaacaguucuuaaaugaaaacuggccu

SEQ ID NO: 289352 - RNA, 62 nt, Human
uagcuagaccuuugcuuccuucuugccagcucucccaacauacccaauccuggugaucaggg

SEQ ID NO: 289353 - RNA, 62 nt, Human
uuuuaggagacugguugguuuuuuucccucuuucccaacauguuuaagaaauguaacauucu

SEQ ID NO: 289354 - RNA, 64 nt, Human; identical to SEQ ID NO: 288733

SEQ ID NO: 289355 - RNA, 64 nt, Human; identical to SEQ ID NO: 288734

SEQ ID NO: 289356 - RNA, 64 nt, Human; identical to SEQ ID NO: 289187

SEQ ID NO: 289357 - RNA, 62 nt, Human
ugugccuacaauggccuuguaacagccauuguucccaacagcaucacuuaggggugugaaaa

SEQ ID NO: 289358 - RNA, 62 nt, Human
cauuggccaggcacgguggcucacgccuguaaucccaacacuuuaggagaccaaggcgggca

SEQ ID NO: 289359 - RNA, 62 nt, Human
uucaagcugggccuaguggcgcacaccugcaaucccaacacuuugggaggccaagagaggaa

SEQ ID NO: 289360 - RNA, 62 nt, Human
uggggccugccccugccuagcagucucccagcucccaacagccuggggaagcucugcacaga

SEQ ID NO: 289361 - RNA, 62 nt, Human
uuuaaaaagaugugguggccugacaccugcaaucccaacauuuugggaggccaaggugggag

SEQ ID NO: 289362 - RNA, 62 nt, Human
accugagugacagaaaucuaaacacacauccgucccaacauuccccagaccauucagaauca

SEQ ID NO: 289363 - RNA, 62 nt, Human
gcauuauaaguuucucaauguacaucuuuuuaucccaacacccucaaacuagaauauuuguc

SEQ ID NO: 289364 - RNA, 62 nt, Human
gaacacuuucccacuguuauucuuuccucauaucccaacacucagaacucuugugacauuag

SEQ ID NO: 289365 - RNA, 62 nt, Human
caggucuucggcaccaccacaauuaauucccuucccaacacuugccugauggaaaaaaaaca

SEQ ID NO: 289366 - RNA, 62 nt, Human
agcaggccgggcaugguggcucaugccuguaaucccaacacuuugggaggccaaggagggug

SEQ ID NO: 289367 - RNA, 62 nt, Human
auuaggcugggcgcuguggcucacaccuguaaucccaacacuuugggaggcugaggugggca

SEQ ID NO: 289368 - RNA, 62 nt, Human
uacagggcaccuaucuguuaucgcugcuguccucccaacagcugucuccaguucuaguuccu

SEQ ID NO: 289369 - RNA, 62 nt, Human
agacuuagagccaaacuguuuaagcuguaucaucccaacaaaguauccuuucaugaacgggg

SEQ ID NO: 289370 - RNA, 62 nt, Human
uguuacuucuuuccaggaugcaaggucuauuaucccaacagaagagaaaauauuuuuauauu

SEQ ID NO: 289371 - RNA, 62 nt, Human
ucaauauuuaaugcuucagaagcaugugagguucccaacacugucagcaaaaaccuuaggag

SEQ ID NO: 289372 - RNA, 62 nt, Human
ucucaucuggacuauggguuguacugugaccaucccaacaccucacccucugucuacaagga

SEQ ID NO: 289373 - RNA, 64 nt, Human; identical to SEQ ID NO: 288753

SEQ ID NO: 289374 - RNA, 64 nt, Human; identical to SEQ ID NO: 278633

SEQ ID NO: 289375 - RNA, 64 nt, Human; identical to SEQ ID NO: 288511

SEQ ID NO: 289376 - RNA, 62 nt, Human
ggacauaauggccuccuuguucacuuuuuauuucccaacacucccucuucccagauucucug

SEQ ID NO: 289377 - RNA, 62 nt, Human
cuuccauguggauguuauauaccuucaucaaaucccaacaucucuauauuaauuaguggcgu

SEQ ID NO: 289378 - RNA, 62 nt, Human
cgauuagauaacauuuucucccaacucaaagaucccaacaaugaauaggaggcauggaagua

SEQ ID NO: 289379 - RNA, 62 nt, Human
cuucuuauccccuuaaaagaaugccuuccacuucccaacagcccccaucaagggaccccaag

SEQ ID NO: 289380 - RNA, 62 nt, Human
acagcucccugacucucggggggagaaggggcucccaacaugacccugaguccccuggauuu

SEQ ID NO: 289381 - RNA, 62 nt, Human
ccaucaccaccuuucaucugauuccagaccugucccaacagcagggaugcuacaugggaaga

SEQ ID NO: 289382 - RNA, 62 nt, Human
cuugggccgggcgugguggcucacaccuguaaucccaacacuuugggaggccaaggcaggua

SEQ ID NO: 289383 - RNA, 62 nt, Human
gcugggcugggcacaguggcucacgccuguaaucccaacaccuugggaggccaaggcaggca

SEQ ID NO: 289384 - RNA, 62 nt, Human
gaggcgcuuggugcccucuggacuuucccacuucccaacaugggagaauugugaacuuucca

SEQ ID NO: 289385 - RNA, 62 nt, Human
uccccucaguccuccuuugcuccugcugcuucucccaacagcccacuguuaggagguaguag

SEQ ID NO: 289386 - RNA, 62 nt, Human
ucauuccagaucccaggccccuggaggcugccucccaacaguggggaagagugacucuccag

SEQ ID NO: 289387 - RNA, 62 nt, Human
aaagggcucacucuaccucuaggcauguuucaucccaacaaucagacugugccaaagcaggg

SEQ ID NO: 289388 - RNA, 62 nt, Human
aaaugacuuugaaccacuuugcaauuguagauucccaacaauaaaauugaagauaagcucuu

SEQ ID NO: 289389 - RNA, 62 nt, Human
cgugggccacaaugccucuagcuauggugcacucccaacaugguauccuguccuuucccuaa

SEQ ID NO: 289390 - RNA, 62 nt, Human
ugugucuuuugcacccaauaugaaacaucuucucccaacacugcuuuaauggaaguucuagg

SEQ ID NO: 289391 - RNA, 62 nt, Human
ccuuugugcucuguuccuguccagcaggggucucccaacaagugcucuuuccaccccaaagg

SEQ ID NO: 289392 - RNA, 64 nt, Human; identical to SEQ ID NO: 288940

SEQ ID NO: 289393 - RNA, 64 nt, Human; identical to SEQ ID NO: 288941

SEQ ID NO: 289394 - RNA, 64 nt, Human; identical to SEQ ID NO: 288512

SEQ ID NO: 289395 - RNA, 62 nt, Human
uaaccuuugaaccuugaauuuuggagauguauucccaacagcagaaugcaacugugggcauu

SEQ ID NO: 289396 - RNA, 62 nt, Human
uaucccuaucuggucucacucaguccucugcaucccaacauucccaggacaugcaugaucac

SEQ ID NO: 289397 - RNA, 62 nt, Human
aaacuugucuguucaugucccaaggcauaacuucccaacauuuaagaaaccccaauagacac

SEQ ID NO: 289398 - RNA, 62 nt, Human
auacagaauugaaagccuucguaucuugaaccucccaacauuuuucuuauggcuguugaaaa

SEQ ID NO: 289399 - RNA, 62 nt, Human
uuauuuacgugugaaagcaacauggaugugauucccaacacagaauuuucaugacccuuuua

SEQ ID NO: 289400 - RNA, 62 nt, Human
cagccuaaauuucaucaucccuucuaugguauucccaacaaauuaucauccaaccuauacuu

SEQ ID NO: 289401 - RNA, 62 nt, Human
uuuguuuuuaaaaauauuucuuaaacaugcugucccaacauuugugaguugugucacaagug

SEQ ID NO: 289402 - RNA, 62 nt, Human
guuauucuccccaugaggcuaaccggccucuuucccaacacuuaaucauggcagccaggaug

SEQ ID NO: 289403 - RNA, 62 nt, Human
ugaagcccgaggaagguguguggagauucuaaucccaacaagcaagggucuccuucaagauu

SEQ ID NO: 289404 - RNA, 62 nt, Human
auacccaggaccaagccacagcagguccuccaucccaacagccaugcccgcauuagcucuua

SEQ ID NO: 289405 - RNA, 62 nt, Human
cuuucucagugcacuuugaaccuggaaaacaaucccaacaggcccgugggaccaugacuuag

SEQ ID NO: 289406 - RNA, 62 nt, Human
cggugugguuuggaggauuuguuuuuuuuuuuucccaacagaaaagaacagccauuagaaga

SEQ ID NO: 289407 - RNA, 62 nt, Human
gugggaccaaaagggaacaggugccucagccaucccaacagugucgucagaggguccccagg

SEQ ID NO: 289408 - RNA, 62 nt, Human
ucacuuuaugugagaucucccgagaguuuccaucccaacaugauggacuuugguuugaacac

SEQ ID NO: 289409 - RNA, 62 nt, Human
ggcuggccaggcacgguagcucacgccuguaaucccaacacuuugggaggccgaggcaggug

SEQ ID NO: 289410 - RNA, 62 nt, Human
gucccaccauuuucucaguuucucccucucucucccaacacacacacacacacaccccucac

SEQ ID NO: 289411 - RNA, 64 nt, Human; identical to SEQ ID NO: 278441

SEQ ID NO: 289412 - RNA, 64 nt, Human
gguagacgcaggcggcagaggugcuggaccacaucuccgccaagucacugcccagcagccuucu

SEQ ID NO: 289413 - RNA, 62 nt, Human
gaaaauuaguugauuuuuaguugauuuuuuugucccaacauuuuuuuuaaccuuuuugccac

SEQ ID NO: 289414 - RNA, 62 nt, Human
ggaaaaagaaagccuaugggaaauggcugugcucccaacauagcuuugcagaugaugugggu

SEQ ID NO: 289415 - RNA, 62 nt, Human
gcccgcaagguuagggcauagaguugucuccuucccaacacggacccagagagcagcccuuc

SEQ ID NO: 289416 - RNA, 62 nt, Human
aaagggccgggcacaguggcuuauuccuguaaucccaacacuguggaaggccgaggcaggag

SEQ ID NO: 289417 - RNA, 62 nt, Human
uuuaaucuguugccugauuuucucuggcauagucccaacagaucggaagaguguuacccucu

SEQ ID NO: 289418 - RNA, 62 nt, Human
aauugcaugaaacuaggcuucuguaaucaauaucccaacauucugcaauggcagcauuccca

SEQ ID NO: 289419 - RNA, 62 nt, Human
cuacuaaccauuucaaaugcagacucaaaccuucccaacaucuuuaugacucuagaauaauc

SEQ ID NO: 289420 - RNA, 62 nt, Human
ucuguauaccccuucaagcaguuguuucccauucccaacaaacuguacuuuauacaauucug

SEQ ID NO: 289421 - RNA, 62 nt, Human
agugguacauaaauuuaucucgcccugcauauucccaacauacuuaacacagauguuuuuua

SEQ ID NO: 289422 - RNA, 62 nt, Human
ugcuggccgggcgcgguggcucacgccuguaaucccaacacuuugggaggcccaggcgggcg

SEQ ID NO: 289423 - RNA, 62 nt, Human
agucugccgggcacaguggcucacgccuguaaucccaacacuuugggaggccaaggagggug

SEQ ID NO: 289424 - RNA, 62 nt, Human
uccauucacuguuaacauggaauaaacacaauucccaacaucuuagauaguguauuaugcuu

SEQ ID NO: 289425 - RNA, 62 nt, Human
auucugcaggaaaccccagcagugugaacgcaucccaacauagguuaagagcaaguugaaaa

SEQ ID NO: 289426 - RNA, 62 nt, Human
ggccagcuagacccaauggcucaugccuguaaucccaacacuuugggaggccaaggugggag

SEQ ID NO: 289427 - RNA, 62 nt, Human
uguggcccaggcccuucuguccccaggcaucaucccaacagcucauuuucccuaguccgccu

SEQ ID NO: 289428 - RNA, 62 nt, Human
uugcagcugggcgugguggcuuaugcuuguaaucccaacacuuagggagucaggagaaucac

SEQ ID NO: 289429 - RNA, 64 nt, Human; identical to SEQ ID NO: 288830

SEQ ID NO: 289430 - RNA, 64 nt, Human; identical to SEQ ID NO: 278634

SEQ ID NO: 289431 - RNA, 64 nt, Human; identical to SEQ ID NO: 288530

SEQ ID NO: 289432 - RNA, 62 nt, Human
gucaagccucagaagccaacuccuuugaaacuucccaacagcagggcuuuggccaagcccuu

SEQ ID NO: 289433 - RNA, 62 nt, Human
uucauauguuugauuuuuauugcacaugguuuucccaacauguggaacaauaaauauccaug

SEQ ID NO: 289434 - RNA, 62 nt, Human
ucuuggccaggcgcaguggcucacaccuguaaucccaacacuuugggaggccaaggugggug

SEQ ID NO: 289435 - RNA, 62 nt, Human
aagguuaauucucuagggcuaguagaacuggaucccaacaccaaacucuuaauuagaccuag

SEQ ID NO: 289436 - RNA, 62 nt, Human
aggcaccaccuggacacuuucuuguugaauccucccaacacccagcacgcugucauccccac

SEQ ID NO: 289437 - RNA, 62 nt, Human
aagaaaagaacacuucuuuauuugagggacuuucccaacaccaggugcuuggggauuucuua

SEQ ID NO: 289438 - RNA, 62 nt, Human
accuggcggugccccggggcucacgccuguaaucccaacacuuugggaggcccaggcaggag

SEQ ID NO: 289439 - RNA, 62 nt, Human
uccuuccuucccacccaucgcuguguguuaguucccaacaucgaauguguacaacuuaaguu

SEQ ID NO: 289440 - RNA, 62 nt, Human
cggacauguuccaagcccugccucaacuuuucucccaacacuaagcuuuccucccaacacac

SEQ ID NO: 289441 - RNA, 62 nt, Human
gccucaacuuuucucccaacacuaagcuuuccucccaacacacauccaucucguguguucau

SEQ ID NO: 289442 - RNA, 62 nt, Human
gcaaagccgggcgcgguggcucacaccuguaaucccaacaguuuggaagaccgaggcgggug

SEQ ID NO: 289443 - RNA, 62 nt, Human
gacuucucguagauaacuucacagucauccagucccaacaccugcucuugccugguaggaac

SEQ ID NO: 289444 - RNA, 62 nt, Human
cacuggcuggcaagcaucaacaggagucuucuucccaacacgagcgcauccauguccugaga

SEQ ID NO: 289445 - RNA, 62 nt, Human
ucugggccuagugcaguggcucacaccuauaaucccaacacuuugggaggccaggaguuuug

SEQ ID NO: 289446 - RNA, 62 nt, Human
gucuucuuucagaaugggaauauaugugugccucccaacauuuacuguuaaaguguguuauc

SEQ ID NO: 289447 - RNA, 62 nt, Human
cauguccucacauuucaaaaccaaucaugccuucccaacagucccccaaagucuuaacucau

SEQ ID NO: 289448 - RNA, 64 nt, Human; identical to SEQ ID NO: 288531

SEQ ID NO: 289449 - RNA, 64 nt, Human; identical to SEQ ID NO: 288532

SEQ ID NO: 289450 - RNA, 64 nt, Human; identical to SEQ ID NO: 288550

SEQ ID NO: 289451 - RNA, 62 nt, Human
auggggccaggugcaguggcucacaccuguaaucccaacauuuugggaggccgagaagggug

SEQ ID NO: 289452 - RNA, 62 nt, Human
guguaauugccaaauacacuuuuccaaauuugucccaacagcccuguaagccagcuuucuuc

SEQ ID NO: 289453 - RNA, 62 nt, Human
uuggaaaaaaauuuuagccuuaucuuaaucugucccaacagcaaugugacggauuuuugcag

SEQ ID NO: 289454 - RNA, 62 nt, Human
uccuaccuacucuucuuguaaacucugcugcuucccaacacaacuagagugcaauuuuggca

SEQ ID NO: 289455 - RNA, 62 nt, Human
uaucuggcugugcagccuugcucuguggcuuuucccaacacaaucagugcuagugcugggga

SEQ ID NO: 289456 - RNA, 62 nt, Human
acaaaagaaaacacaaaauccuagcuugggauucccaacaaauucagccuccucucccaggg

SEQ ID NO: 289457 - RNA, 62 nt, Human
ggcacgguggcaggaacaacuauccucgucugucccaacacugagcaggcacucgguaaaca

SEQ ID NO: 289458 - RNA, 62 nt, Human
gcucagagcuuugucacuugccacauggugucucccaacaugggagggaucagccccgccug

SEQ ID NO: 289459 - RNA, 62 nt, Human
cgcgcccaaaagauugaacuuaaaugccccccucccaacagcgcuuuaaaagcgaccucucu

SEQ ID NO: 289460 - RNA, 62 nt, Human
gagaaaauguauucuccuuuccuauaccgcucucccaacaaaaaaacaacuaguuaguucua

SEQ ID NO: 289461 - RNA, 62 nt, Human
cuccagguucacuuuggauaugaucuuucuuuucccaacauaugcccucagaaaagugacag

SEQ ID NO: 289462 - RNA, 62 nt, Human
cacgccgacccggcgcuccccaaggaaugcugucccaacaagauucccgugaaagagcaccc

SEQ ID NO: 289463 - RNA, 62 nt, Human
agcaagcuggaugcaguggcucaugccuguaaucccaacacuuuugggagguccaggcagga

SEQ ID NO: 289464 - RNA, 62 nt, Human
caagcgggaaaggcaauaaauccaagaaauugucccaacaaccaccaauucuuacggaggaa

SEQ ID NO: 289465 - RNA, 62 nt, Human
uggggcccugccggaagggagcccccugcuccucccaacaaacuccagaacagcagaaagcg

SEQ ID NO: 289466 - RNA, 62 nt, Human
ugucccaucugcagccacacuacucgcuccucucccaacaacucccuucguggggacaaaag

SEQ ID NO: 289467 - RNA, 64 nt, Human
ugacauggugccugagaggcaggcauagaggcuucuccgccagccuccucuggacggcaggcuc

SEQ ID NO: 289468 - RNA, 56 nt, Human; identical to SEQ ID NO: 278570

SEQ ID NO: 289469 - RNA, 64 nt, Human; identical to SEQ ID NO: 288810

SEQ ID NO: 289470 - RNA, 62 nt, Human
acagucaauaguguugcuuuaaauugugccccucccaacaugcuugauguuuggccugaucu

SEQ ID NO: 289471 - RNA, 62 nt, Human
ucccuuuccucugcuucucuccucaucaucauucccaacaacauccucugccacacacaaca

SEQ ID NO: 289472 - RNA, 62 nt, Human
uucacguuuacagagcauaaggcugucuuggaucccaacaggcacccagcccugcauggggg

SEQ ID NO: 289473 - RNA, 62 nt, Human
ugucccaaaucuagcuuugcccacgaauggcaucccaacagaguuaaagaaacugcuugcag

SEQ ID NO: 289474 - RNA, 62 nt, Human
guuuuccucccuuugccucuaccuggcccucaucccaacagcccagcaaggggagagagaaa

SEQ ID NO: 289475 - RNA, 62 nt, Human
ugcuucugagaaagcauuugccuuucuuccucucccaacauaacaaucgugguaacagaaug

SEQ ID NO: 289476 - RNA, 62 nt, Human
gcaggauuguaaguagaccgaauucuaauuuuucccaacacauagugguaauuggagguuac

SEQ ID NO: 289477 - RNA, 62 nt, Human
cuuuugucgugguggcuggcucggauaaauuuucccaacaauuaaaucuugccuuuacacac

SEQ ID NO: 289478 - RNA, 62 nt, Human
cugcuuccucucgacuuuaggaggaauauccuucccaacaucaccacuacuuaccucaaguc

SEQ ID NO: 289479 - RNA, 62 nt, Human
cuuugcugcaggguauuuguggugcagcagauucccaacaguaaccuccuccuccuggugac

SEQ ID NO: 289480 - RNA, 62 nt, Human
uccccuucaugaagguagagagaaggggucucucccaacauauuucucuuccuugugccucu

SEQ ID NO: 289481 - RNA, 62 nt, Human
gaugggccgggcgcaguggcucacgccuguaaucccaacaccuuaggaguccgaggugggug

SEQ ID NO: 289482 - RNA, 62 nt, Human
guaaagaccccaucugccuuguccaugccguuucccaacagggaugucacuugauaugagaa

SEQ ID NO: 289483 - RNA, 62 nt, Human
caugaucuagagauagaaaaaucccuacuaagucccaacaggagaaagacaggcucuuuuuc

SEQ ID NO: 289484 - RNA, 62 nt, Human
cccugccacaccaacacacuuucuauuugggcucccaacacuauuucuccaucucacuccuu

SEQ ID NO: 289485 - RNA, 62 nt, Human
auuuucccuaaaagguuugucccaagaucugcucccaacaguugacugucacugacaauguu

SEQ ID NO: 289486 - RNA, 62 nt, Human
ccuacaaaacguaacuccaguccuccacccucucccaacaaaaauaacaaugcuguugacag

SEQ ID NO: 289487 - RNA, 62 nt, Human
aagaggccgggugcgguggcucacgccuguaaucccaacacuuuaggaguccaaggcgggcg

SEQ ID NO: 289488 - RNA, 62 nt, Human
cuuuggcugagcucgguggcucaugccuguaaucccaacacuuugagaagcugaggugggag

SEQ ID NO: 289489 - RNA, 62 nt, Human
auagucuccaaaugacuuuguauuuacaucacucccaacaaauguugauucuuaauauuuag

SEQ ID NO: 289490 - RNA, 62 nt, Human
uagcugcuuucagauuguuccauuaucuguacucccaacaacccugccggauauauuuguug

SEQ ID NO: 289491 - RNA, 62 nt, Human
cugacggggguggcacacaggacacggguggaucccaacaggcagcaccgcaccucugcccg

SEQ ID NO: 289492 - RNA, 62 nt, Human
ugcucagcugucaaggcucagucgcuagcauuucccaacacaaagauucugaccuuaaaugc

SEQ ID NO: 289493 - RNA, 62 nt, Human
uaguauuuccaaacuguuauauacccaucuacucccaacauggauauaaguuuuuuaaaaaa

SEQ ID NO: 289494 - RNA, 62 nt, Human
gaggcaagaauaaagugaaaaaguauauguaaucccaacaucuaauuuuagucuuagaaacu

SEQ ID NO: 289495 - RNA, 62 nt, Human
cacggaggcuugccccaucacccucugagcccucccaacacagcacacuagucagcccacug

SEQ ID NO: 289496 - RNA, 62 nt, Human
uuucaaaaacacaguguuuuuguaaaguguggucccaacaggaggacaauucaugaacuucg

SEQ ID NO: 289497 - RNA, 62 nt, Human
gauccagcuguuuuagucacagacugagcugaucccaacaggcccuggcagcgucuggacuu

SEQ ID NO: 289498 - RNA, 62 nt, Human
acacaaaccaaaccgucaacagcauaauaaaaucccaacaacuauuuuuauuucauuuuuca

SEQ ID NO: 289499 - RNA, 62 nt, Human
aacugaugggaaaggaccaauuauuuauaguuucccaacaaaaguucuaagauuuuuuaccu

SEQ ID NO: 289500 - RNA, 62 nt, Human
auuuuugcgauauugaauagaacaucuucuguucccaacacuguuuggcuucacuaauuuag

SEQ ID NO: 289501 - RNA, 62 nt, Human
uccgccacacuccauuuucccuccucugaagcucccaacaacucugacagggucagaucucu

SEQ ID NO: 289502 - RNA, 64 nt, Human; identical to SEQ ID NO: 278569

SEQ ID NO: 289503 - RNA, 64 nt, Human; identical to SEQ ID NO: 289412

SEQ ID NO: 289504 - RNA, 64 nt, Human
auucaggaccccacucaucuagcccuccaagagccuccgccaaauuguagccauguaauuggaa

SEQ ID NO: 289505 - RNA, 62 nt, Human
ggggacuggagccgccuccacgcugugcucccucccaacaacggccgagccugcaccgacaa

SEQ ID NO: 289506 - RNA, 62 nt, Human
cuuuguauuugauauacaaagucucuagacuuucccaacaaggggcuuuugacaaaagaguu

SEQ ID NO: 289507 - RNA, 62 nt, Human
uuaauggguuaaaaauaagccacugccugacaucccaacauuugacaccccagcaaugugug

SEQ ID NO: 289508 - RNA, 62 nt, Human
auuuggccgggcacaguggcucacgccuguaaucccaacacuuugggaggccgaggcgggcc

SEQ ID NO: 289509 - RNA, 62 nt, Human
auacucccacaggcuagaccagagaugccaagucccaacagcacugagcugugugcacugug

SEQ ID NO: 289510 - RNA, 62 nt, Human
caagccuugucccuuccuccucccagcaacagucccaacaagcaggcuucugagagcccgug

SEQ ID NO: 289511 - RNA, 62 nt, Human
gagggcagcugugacuacaggccugugcggugucccaacaaccccagcugccccccgcugcu

SEQ ID NO: 289512 - RNA, 62 nt, Human
gccgugccugcccuccaccuugagugccauacucccaacagcuccagguacccaccggggga

SEQ ID NO: 289513 - RNA, 62 nt, Human
aagccauuuccacuacagugagaaagcccggaucccaacaguugucaaauugauuaguuugc

SEQ ID NO: 289514 - RNA, 62 nt, Human
auguggcugggcgcagcggcucacgccuguuaucccaacacuuugggaggccgaggcaggcg

SEQ ID NO: 289515 - RNA, 62 nt, Human
uaccauuaucuguggaacacagaaucaucuguucccaacacuccagccccuugguccugugg

SEQ ID NO: 289516 - RNA, 62 nt, Human
agaccuuuuguacauuuuuacaggggugccccucccaacaguucccuuccugguuaauuaaa

SEQ ID NO: 289517 - RNA, 62 nt, Human
gcugaggaggagguuaaaggccaaaugcuguuucccaacaccccaaagucugcacacgucuc

SEQ ID NO: 289518 - RNA, 62 nt, Human
cccacccauagggcuggcucacauccagucacucccaacagcguccagcacacaaauaaaag

SEQ ID NO: 289519 - RNA, 62 nt, Human
uauaugauaauguacaggucacagauccccuuucccaacacuuugaagaugaaucuggaguc

SEQ ID NO: 289520 - RNA, 62 nt, Human
gucagggaggcggggccaagggugucccacauucccaacaccgcccucugaucaccauggga

SEQ ID NO: 289521 - RNA, 64 nt, Human; identical to SEQ ID NO: 289297

SEQ ID NO: 289522 - RNA, 64 nt, Human; identical to SEQ ID NO: 289298

SEQ ID NO: 289523 - RNA, 64 nt, Human; identical to SEQ ID NO: 278571

SEQ ID NO: 289524 - RNA, 62 nt, Human
aaaaggccgggcaugguggcucaugccuguaaucccaacacuuugggaggcuaaggcagcug

SEQ ID NO: 289525 - RNA, 62 nt, Human
uccuggccaguugcaguggcucacgccuauaaucccaacacuucgggaggccaaggugagag

SEQ ID NO: 289526 - RNA, 62 nt, Human
ccaguuccaccugcugguagggguagguuggcucccaacacauccccagcaggccucucuug

SEQ ID NO: 289527 - RNA, 62 nt, Human
gggccgggggcagucugagagaggccauucuuucccaacaccucuuggggaguuuagggugg

SEQ ID NO: 289528 - RNA, 62 nt, Human
ugucacgccagacuucccacggcuccucgagaucccaacacugccagcauuucccuuccuuc

SEQ ID NO: 289529 - RNA, 62 nt, Human
gcccgguugcucaccaguuguagcuugccagcucccaacacccuuccuggugccaauaaacu

SEQ ID NO: 289530 - RNA, 62 nt, Human
caucauuaauaaaaguugccauuucaacuacgucccaacauucccuaauaggguauucaggg

SEQ ID NO: 289531 - RNA, 62 nt, Human
agaagcgcccuguauuuauucccccaucuucaucccaacagcccagcaagaaggaggagaca

SEQ ID NO: 289532 - RNA, 62 nt, Human
gauggaggcccucaggaucugacacccucuugucccaacaccagucagcccuauacccuaac

SEQ ID NO: 289533 - RNA, 62 nt, Human
cuguccgcccucuuccccucuaaugcucacgcucccaacacaaggugggcagggaggcacca

SEQ ID NO: 289534 - RNA, 62 nt, Human
aagcuuuccuggagagucucacuccccuccuuucccaacacuucagacugcaagugagcaaa

SEQ ID NO: 289535 - RNA, 62 nt, Human
gcuuucugaucaacaaaacugagcaaggaagaucccaacacugaagggguagaaggccaggg

SEQ ID NO: 289536 - RNA, 62 nt, Human
uucuccagcaaguaaacauuccucugcucaccucccaacaagacuaacagucuuuuuagaag

SEQ ID NO: 289537 - RNA, 62 nt, Human
agugagccccuaccccccaccccgauccccgcucccaacacugccggagucgcgucaugcca

SEQ ID NO: 289538 - RNA, 62 nt, Human
uugcuauuucaauaacagauggugcugcuaauucccaacauuucuuaaauuauuuuauauca

SEQ ID NO: 289539 - RNA, 62 nt, Human
auuuggccgggugcggcagcucaugccuguaaucccaacacuuugggaggcugaggcaggcg

SEQ ID NO: 289540 - RNA, 64 nt, Human; identical to SEQ ID NO: 289504

SEQ ID NO: 289541 - RNA, 64 nt, Human; identical to SEQ ID NO: 289467

SEQ ID NO: 289542 - RNA, 64 nt, Human; identical to SEQ ID NO: 278443

SEQ ID NO: 289543 - RNA, 62 nt, Human
gcugcugagcuuucgucaggaagauaagacuuucccaacaguccgaagccuaggauaugagg

SEQ ID NO: 289544 - RNA, 62 nt, Human
uaugggccuggugugguggcucacaccuguaaucccaacacuuugggagcccgaggcgggug

SEQ ID NO: 289545 - RNA, 62 nt, Human
gggcuccaugagaaugaguugccuccaaccugucccaacagcugacagccaggagccacucu

SEQ ID NO: 289546 - RNA, 62 nt, Human
ugugccucacccagggccugaccccagaguggucccaacaacccggucucaugcccacuccc

SEQ ID NO: 289547 - RNA, 62 nt, Human
cagcuuccaccggcagggaguugugagcgccuucccaacaaugugccccucaccccuugaug

SEQ ID NO: 289548 - RNA, 62 nt, Human
gguggucucuucugcugcuagcaacucaaaaaucccaacagcacucccuauccuuucccuga

SEQ ID NO: 289549 - RNA, 62 nt, Human
aggcuguggccucaggaaucaacuuaggcaguucccaacaagcgcuagccuguaauuguagc

SEQ ID NO: 289550 - RNA, 62 nt, Human
gacugaagcccuggcugccucagcgcucugucucccaacaccagcugguguugcagagggag

SEQ ID NO: 289551 - RNA, 62 nt, Human
ccagcaucacaaggcacuugucuacaagugugucccaacacaguccugggccacuuucccca

SEQ ID NO: 289552 - RNA, 62 nt, Human
uguuccauuggguccucuuggugucguuucccucccaacagagcugggcuacccccccuccu

SEQ ID NO: 289553 - RNA, 62 nt, Human
uaaugaccaagguaccgauuucugcuaaguucucccaacaacaugaaacugccuauucacgc

SEQ ID NO: 289554 - RNA, 62 nt, Human
auccggauacguaugguggcucacgccuguaaucccaacacuuugggaggcagauguggaag

SEQ ID NO: 289555 - RNA, 62 nt, Human
aauuugcaguuuccacuaaugacauuuugauuucccaacagagauacuucuggucuuacugc

SEQ ID NO: 289556 - RNA, 62 nt, Human
uuuucuacuaauuauuuuuugaagcauuauuuucccaacacaaaagagcuuuuuucucggua

SEQ ID NO: 289557 - RNA, 54 nt, Human
ccagagacuucuacccauagcacaucccaacaccgucacgccaaaggaagagaa

SEQ ID NO: 289558 - RNA, 62 nt, Human
uaaucaagauuaaauguaaauaaucagggcaaucccaacacaugucuagcuuucaccuccag

SEQ ID NO: 289559 - RNA, 64 nt, Human; identical to SEQ ID NO: 289299

SEQ ID NO: 289560 - RNA, 64 nt, Human; identical to SEQ ID NO: 278585

SEQ ID NO: 289561 - RNA, 64 nt, Human; identical to SEQ ID NO: 288771

SEQ ID NO: 289562 - RNA, 62 nt, Human
ugcuugggaacccccacuccccacuccccacaucccaacauccuggugucuguccccagugg

SEQ ID NO: 289563 - RNA, 62 nt, Human
gcccagccucccgcggggccacacacuuccccucccaacacacacacacaccugccaucuug

SEQ ID NO: 289564 - RNA, 62 nt, Human
cccuggccgggagcguuggcuuucgccuguaaucccaacacuuugggaggccaggacagauc

SEQ ID NO: 289565 - RNA, 62 nt, Human
aucgggccgggggcgguggcucacgccuguaaucccaacacuuugggagcccgaggcgggcg

SEQ ID NO: 289566 - RNA, 62 nt, Human
gcaccacacuuaccacuguauguguacuaugaucccaacaggcuugugacauagauuucaua

SEQ ID NO: 289567 - RNA, 62 nt, Human
cagggagggaaacugaggaaaucuuccauuccucccaacagcucaaaauuaggccuugggca

SEQ ID NO: 289568 - RNA, 62 nt, Human
gauaggcugggugcgguggcucacgccuguaaucccaacacuuugggaggccgaggcgagca

SEQ ID NO: 289569 - RNA, 62 nt, Human
guaaagacacuuguggggugagucaucccuacucccaacaucuggaggggaaaggugaguga

SEQ ID NO: 289570 - RNA, 62 nt, Human
agugccauccgaaagaagcuaaaccuugcacaucccaacacccaccccagggagaguucccg

SEQ ID NO: 289571 - RNA, 62 nt, Human
gaacaggcugggagugguggcucagccuacaaucccaacacuuugggaggcugaggaagggg

SEQ ID NO: 289572 - RNA, 62 nt, Human
gccaaacaagggguuuggaccagaccugggauucccaacagguggacuugucgguugucacc

SEQ ID NO: 289573 - RNA, 62 nt, Human
gcagagaacagaggguccagggcccuccuggcucccaacagcuucucaguucccacuuccug

SEQ ID NO: 289574 - RNA, 62 nt, Human
accacuggaucccacacaaaucagugaauggaucccaacaccccaaccacaggagcacggau

SEQ ID NO: 289575 - RNA, 62 nt, Human
auuuuaccuucuuuuguuucuauugugcagauucccaacagugggauuaaagaguaucuggc

SEQ ID NO: 289576 - RNA, 62 nt, Human
caaacgccaggcacgguggcucaugccuguaaucccaacacuuugggaggcugaggccggag

SEQ ID NO: 289577 - RNA, 50 nt, Human
acaguggcuuccgccuguaaucccaacauuuugggaggccaaggcgggag

SEQ ID NO: 289578 - RNA, 64 nt, Human; identical to SEQ ID NO: 288791

SEQ ID NO: 289579 - RNA, 64 nt, Human; identical to SEQ ID NO: 278586

SEQ ID NO: 289580 - RNA, 64 nt, Human; identical to SEQ ID NO: 288792

SEQ ID NO: 289581 - RNA, 62 nt, Human
gacuggcugggugcaguggcucaugccuguaaucccaacacuuugggaguccgaggcaggug

SEQ ID NO: 289582 - RNA, 62 nt, Human
aucaggcacugcgccaccugcuucacaguacuucccaacaacucuuagagguagguguauuc

SEQ ID NO: 289583 - RNA, 62 nt, Human
uugugaauguuguccugugucaucugucagcuucccaacaauacuuugugucuuuuguucuc

SEQ ID NO: 289584 - RNA, 62 nt, Human
aucuuuuuuacucuaugccccaaauauagcguucccaacaacauccauguccuaugugugac

SEQ ID NO: 289585 - RNA, 62 nt, Human
gcugcuaacccuugcaccagcccuugugggacucccaacacaagacaaagcucaggaugcug

SEQ ID NO: 289586 - RNA, 62 nt, Human
aagaaacaaagccaugccugcuccugccucucucccaacauguuuccagcaaguagaugccc

SEQ ID NO: 289587 - RNA, 62 nt, Human
uccucucgcgagcggcccgggcagggacccugucccaacaccaacaccuccucuccagccca

SEQ ID NO: 289588 - RNA, 62 nt, Human
gauagguaauuuuaaauauucaaaccaaaucuucccaacaguuggcaaguuguuuauuuuau

SEQ ID NO: 289589 - RNA, 62 nt, Human
ggcuccuuaccuuggucuuuucccuguucaucucccaacaugcugugcuccauagcugguag

SEQ ID NO: 289590 - RNA, 62 nt, Human
uggucccugaaagaaagcauuugugugggcaaucccaacaugaaauguagacagcgugaaua

SEQ ID NO: 289591 - RNA, 62 nt, Human
uuuuuaauuaaaaaaacccacccuuuuucauuucccaacauuuuuuggcuauuaugaucgcu

SEQ ID NO: 289592 - RNA, 62 nt, Human
guggggguguaagaaugacugcaacaggcacuucccaacaauggccugcuguucacauggac

SEQ ID NO: 289593 - RNA, 62 nt, Human
cccaugagccugcccgcugcaaugccuagacuucccaacagccuuagcugccagugcugguc

SEQ ID NO: 289594 - RNA, 62 nt, Human
cucucuuccacaaugguugaaccaauuuacauucccaacaguguaaaagcauucauguuucu

SEQ ID NO: 289595 - RNA, 62 nt, Human
ccacaggagcugacagguuuuucaauuaauauucccaacaugaaugagaugccucauuccuc

SEQ ID NO: 289596 - RNA, 62 nt, Human
ugaaccuuuucuggccaugaaccauuauaaaaucccaacauauauacugaaaauacugaaac

SEQ ID NO: 289597 - RNA, 62 nt, Human; identical to SEQ ID NO: 288866

SEQ ID NO: 289598 - RNA, 64 nt, Human; identical to SEQ ID NO: 288867

SEQ ID NO: 289599 - RNA, 64 nt, Human; identical to SEQ ID NO: 288809

SEQ ID NO: 289600 - RNA, 62 nt, Human
cauggcuaccugcugugguuugaauguuugagucccaacaaaauucauaucaaaacauaauc

SEQ ID NO: 289601 - RNA, 62 nt, Human
cuaguuuugaugacaauguuuucuuguaagaaucccaacacuuuagaauagaaaaggaccua

SEQ ID NO: 289602 - RNA, 62 nt, Human
acggcuguuccccucacccaaaagaauuaucaucccaacagccaagacccaacaggugcuga

SEQ ID NO: 289603 - RNA, 62 nt, Human
agagaaauguuucacgcaagcagucccccaacucccaacacacacucccuuucauuccgagc

SEQ ID NO: 289604 - RNA, 62 nt, Human
acaaaauuuauuuuuauuuuuugugguuauauucccaacaacauuaaaaaauacucgaggca

SEQ ID NO: 289605 - RNA, 62 nt, Human
guuuucccacuguuaagcuggaaugaggacugucccaacaacaguagguacaguggacaaaa

SEQ ID NO: 289606 - RNA, 62 nt, Human
caaagucuuugagcccuuucccagucaaaugcucccaacaaggcaucccuuauucugaccuc

SEQ ID NO: 289607 - RNA, 62 nt, Human
gagggugcggcccggaguuguccaucuguccaucccaacagcaagacgaggauguggcuguu

SEQ ID NO: 289608 - RNA, 62 nt, Human
gcuggaaaggccagcagccuuccaguggcuucucccaacacucuuggggaccaaauauauuu

SEQ ID NO: 289609 - RNA, 62 nt, Human
cauucuggaauccuccccacauucuagaauucucccaacauuuuuuuuucuugagacagagu

SEQ ID NO: 289610 - RNA, 62 nt, Human
aguuuguaccgaugaaacgcgcaacuuuguaaucccaacacuuucuauuuucuagaaucuuc

SEQ ID NO: 289611 - RNA, 62 nt, Human
aauaagaauaacacucaagacuauguucuccaucccaacacaucacuuaccacuugcacuau

SEQ ID NO: 289612 - RNA, 62 nt, Human
guccaaauucaccuuccccuaaaccccaagcuucccaacagaucauaugguaggacccucga

SEQ ID NO: 289613 - RNA, 62 nt, Human
uuuagauggccaugaagaggaugcugugaaauucccaacaaacauugaugcugacagucaug

SEQ ID NO: 289614 - RNA, 62 nt, Human
gucccugugaacaccugcacuaugagaagguuucccaacaagaguguaucaugauggcauuc

SEQ ID NO: 289615 - RNA, 62 nt, Human
aauucuuguucuuuagaacuguguucucaccuucccaacacugcacugccgaaguguagcgg

SEQ ID NO: 289616 - RNA, 64 nt, Human; identical to SEQ ID NO: 289167

SEQ ID NO: 289617 - RNA, 64 nt, Human; identical to SEQ ID NO: 289168

SEQ ID NO: 289618 - RNA, 64 nt, Human; identical to SEQ ID NO: 288622

SEQ ID NO: 289619 - RNA, 62 nt, Human
guacuuaaaauaucuguagcugauuaaauuuuucccaacaaccucacuggggagaaagugug

SEQ ID NO: 289620 - RNA, 62 nt, Human
cccaggccuugccugaggggucaggcugccucucccaacacacacucagauagcacaaauuc

SEQ ID NO: 289621 - RNA, 62 nt, Human
guguguucaaacaucauaaaauggggaucgccucccaacagcagauuucgacauuaccugag

SEQ ID NO: 289622 - RNA, 62 nt, Human
uaccacagccugcccagagagaaacuaucuucucccaacauuuacuaacauccacuggucaa

SEQ ID NO: 289623 - RNA, 62 nt, Human
aaaggaggcuccgugagaugggguccagcccaucccaacacaagggugcagcuugauucggg

SEQ ID NO: 289624 - RNA, 64 nt, Human; identical to SEQ ID NO: 278540

SEQ ID NO: 289625 - RNA, 64 nt, Human; identical to SEQ ID NO: 289093

SEQ ID NO: 289626 - RNA, 64 nt, Human; identical to SEQ ID NO: 289148

SEQ ID NO: 289627 - RNA, 64 nt, Human; identical to SEQ ID NO: 289149

SEQ ID NO: 289628 - RNA, 64 nt, Human; identical to SEQ ID NO: 278554

SEQ ID NO: 289629 - RNA, 64 nt, Human; identical to SEQ ID NO: 289131

SEQ ID NO: 289630 - RNA, 64 nt, Human; identical to SEQ ID NO: 288904

SEQ ID NO: 289631 - RNA, 64 nt, Human; identical to SEQ ID NO: 288905

SEQ ID NO: 289632 - RNA, 64 nt, Human
ugggaguuuguggccacuggguauguguggcuaccgcggguaugcgagugccagauauuggcug

SEQ ID NO: 289633 - RNA, 64 nt, Human
agaaauaaggcuaaccaucgaaaagaacaugggccgcggguaaacuagcuuugcucuuuagaug

SEQ ID NO: 289634 - RNA, 64 nt, Human
cuaaugacgaggaaccgaaaaaucgcgaguguuucgcggguaacugggguugagggccaaaaua

SEQ ID NO: 289635 - RNA, 64 nt, Human
ccgcucucucaggcgcaugugccaguuggggccccgcggguagaugccggcaggccuuccggaa

SEQ ID NO: 289636 - RNA, 64 nt, Human
caguggcuuuugccccagaaaggggaaaggaacacgcggguagaugauuucuagcaggcaggaa

SEQ ID NO: 289637 - RNA, 62 nt, Human
agaauuaggcgcccaccguguccccuccagcgcgcgcgaagaagcuugggagucguggcggg

SEQ ID NO: 289638 - RNA, 62 nt, Human
cgggcugccccgcuuugcggacgggcuguccccgcgcgaacggaacguuggacuuuucguua

SEQ ID NO: 289639 - RNA, 62 nt, Human
gccccgcccugcacuccagcucgccccuuucccgcgcgaagugaaggaugcgucacuuuucu

SEQ ID NO: 289640 - RNA, 57 nt, Human
gccuuacgcugaaaggcugaaguggggcgcgcgaagggcggcgaagcggagacggcg

SEQ ID NO: 289641 - RNA, 62 nt, Human
guaaaagcuucccgacuguucuacuuuggguccgcgcgaagcccacucacgugugaucugug

SEQ ID NO: 289642 - RNA, 62 nt, Human
ccggccaggaccccggcccccaaugcacuuuacgcgcgaagaaguugccggaugguuguccc

SEQ ID NO: 289643 - RNA, 62 nt, Human
ccgcgccaacgcacgcaacccuugcugcugcccgcgcgaagugggcauugcaaagugcgcuc

SEQ ID NO: 289644 - RNA, 62 nt, Human
guagugugacuguggcucaacuuuccaugguacgcgcgaauuguucuggaagucacagaugg

SEQ ID NO: 289645 - RNA, 62 nt, Human
ccacgucuccuugagaaccaauaccaaacgagcgcgcgaaccuugaaaugucacgggcuucu

SEQ ID NO: 289646 - RNA, 64 nt, Human
auuggccaggccugacccucuuggaccuuucuucuuugccgacaaccacugcccagcagccucu

SEQ ID NO: 289647 - RNA, 64 nt, Human
gagcagcauuucauguucuuuugcuguuuugugcuuugccgauuuuggauuuuauuuuucacaa

SEQ ID NO: 289648 - RNA, 64 nt, Human
ugguuuuauuuauaauaauuuguuucugaagaaauuugccgagaguuacaggucaaaaagccuu

SEQ ID NO: 289649 - RNA, 64 nt, Human
aucaucuccccaccucuccuccccucuccucaguuuugccgacugcuuuucaucugagucacca

SEQ ID NO: 289650 - RNA, 64 nt, Human
cccuuuuagugggaaaggauauguucuaggagaaacaagcaauuuaccuucaccugggaaacug

SEQ ID NO: 289651 - RNA, 64 nt, Human
acaauggaaauuuauguuggcgauagccaagaccacaagcaaaagcacauacuggaaaugauga

SEQ ID NO: 289652 - RNA, 64 nt, Human
cacauggggcguacuauuuuuauugagcccaaaaacaagcaaaaccaaagaauauguagucuaa

SEQ ID NO: 289653 - RNA, 64 nt, Human
gcuaggcacuuugauccgguuuuccaguucuugcacaagcaaguuugugucagccacgcccugg

SEQ ID NO: 289654 - RNA, 64 nt, Human
aauacuuauaaaaagacuucauuuuuagugauugacaagcaaacggguucauuuaaaacagguu

SEQ ID NO: 289655 - RNA, 64 nt, Human
agcaagagggaaagcagaccccuuuagucacuccacaagcaauagcuccaugagaggcauggac

SEQ ID NO: 289656 - RNA, 64 nt, Human
ggaaucaaagaaaauggaacuucuuuuugaaaagacaagcaaccauguuaacuguauugacaca

SEQ ID NO: 289657 - RNA, 64 nt, Human
ucagcucuuccuuuuuauuaccuuuuucaauucaacaagcaacuuucugcuacauacuuacucc

SEQ ID NO: 289658 - RNA, 64 nt, Human
aacaaaagcaagacuguugcucaaaucuauucagacaagcaacagguuuuauaauuuuuuuauu

SEQ ID NO: 289659 - RNA, 64 nt, Human
augaaucuuaugaauguuaaccuuuccguuuauuacaagcaaguacuauuauuucugauuuuau

SEQ ID NO: 289660 - RNA, 64 nt, Human
uuaauuuuauuugacuuuaugacauugcuuuucaacaagcaaauguuaaauguguuaagccuug

SEQ ID NO: 289661 - RNA, 64 nt, Human
gggcugugaaaaccucaucacuggagguaaaagcacaagcaaugccuguggacaagaugucauu

SEQ ID NO: 289662 - RNA, 64 nt, Human
agagaguaacuguaccuauuauuuguuucuucagacaagcaaaucauuuggucagaguucauau

SEQ ID NO: 289663 - RNA, 64 nt, Human
uuuuauuuaacacugcaaaggaaagagagagaaaacaagcaaagauagguaggacagaaaggaa

SEQ ID NO: 289664 - RNA, 64 nt, Human
aauaggaaagucaucuaugaauucaucaugaaagacaagcaauccaucaugaaauucguucuaa

SEQ ID NO: 289665 - RNA, 64 nt, Human
uagaaaauaauauuuuuauggcacacugggauaaacaagcaagauugcucacuucuggaagcug

SEQ ID NO: 289666 - RNA, 64 nt, Human
ucuuuuuucuuuuuuuuaagccaugcugugaccuacaagcaaacuaaauagccaacauuucuga

SEQ ID NO: 289667 - RNA, 64 nt, Human
acuagacuaagaagauuuaguuuauaaauucagaacaagcaauuguggaagggugguggcgugc

SEQ ID NO: 289668 - RNA, 64 nt, Human
caucucacuuugccccaguuacaaaaauaguagaacaagcaacauaaaacaaugaaggaaaacc

SEQ ID NO: 289669 - RNA, 64 nt, Human
cccagcauugauacccaaugacaaacuauggagaacaagcaaaguaugcaggcccccugcagcc

SEQ ID NO: 289670 - RNA, 64 nt, Human
cucccggauggaguggagaaacuaggagacugggacaagcaaaaggcugcaaacaacccagaag

SEQ ID NO: 289671 - RNA, 64 nt, Human
gaccuaagggaaugucugguuaccuccuaguuauacaagcaaaaucugcauaguauguagucuu

SEQ ID NO: 289672 - RNA, 64 nt, Human
agcccgaggaagguguguggagauucuaaucccaacaagcaagggucuccuucaagauuaaugc

SEQ ID NO: 289673 - RNA, 64 nt, Human
cuuccuaggagagucuuacauguguugagauuucacaagcaaugcgaguuguaaaauaccagcu

SEQ ID NO: 289674 - RNA, 64 nt, Human
aauguguuucuauuuuagaugaguguuuccuaauacaagcaacauuaacaucuucagaaaagga

SEQ ID NO: 289675 - RNA, 64 nt, Human
aaggacgugucucaggagcuugauccagaccucuacaagcaaauggagaaguucaggaagguag

SEQ ID NO: 289676 - RNA, 64 nt, Human
ucauuugaaccaguuuuccaagaacaaaucuugcacaagcaaaguauaagaauuauccuaaaaa

SEQ ID NO: 289677 - RNA, 63 nt, Human
uauguuuacuagcugaaucucaauaacaauguaaacaagcaacaaaccaucuucugauucuua

SEQ ID NO: 289678 - RNA, 64 nt, Human
auaauuuuuuugaucuucgaugaaccugacaaaaacaagcaaugggcaauggauucucuauuca

SEQ ID NO: 289679 - RNA, 64 nt, Human
gggaagcagaacaacagaaggaacuuuaaaagcaacaagcaauuauguaccauauauacacugu

SEQ ID NO: 289680 - RNA, 64 nt, Human
aaacgaaaacaguuuaaaucucuaccacagccucacaagcaaaugcuaaggggaacauacaugu

SEQ ID NO: 289681 - RNA, 64 nt, Human
gguuggggacccagauggaacacaaagggagaagacaagcaaauucucuuuucuggagggagac

SEQ ID NO: 289682 - RNA, 64 nt, Human
auuuuuguagccucucacugaauccaacauauccacaagcaaguuaucugucuuucuaccugau

SEQ ID NO: 289683 - RNA, 64 nt, Human
auuucaacccagauuuuaccuugcagacggaaugacaagcaaaaaguguuguggggaaucaaau

SEQ ID NO: 289684 - RNA, 64 nt, Human
uuuguaagguacauaaaauccaauuuauauguaaacaagcaauaauuuaaguugagaacuuaug

SEQ ID NO: 289685 - RNA, 64 nt, Human
cuaauaagcagauguuuggccuuucagaaagucaacaagcaaaaugccuugagugucccaaaac

SEQ ID NO: 289686 - RNA, 64 nt, Human
ucugucacagugcuauuuggaaaacggaaaauuuacaagcaaccuagagguccagcaaugugaa

SEQ ID NO: 289687 - RNA, 64 nt, Human
ggcaucuagcacuuacaucucucuaugcuguucuacaagcaaacaaacaaaaauaggaguauag

SEQ ID NO: 289688 - RNA, 64 nt, Human
aagcaagcaagcaaacaaauccauaacaaccacaacaagcaacaagaacaagaacaacaacaag

SEQ ID NO: 289689 - RNA, 64 nt, Human
ucccuuauuacauuugcaacucugcccaacaaaaacaagcaagcaaaccacaaugguaaagugg

SEQ ID NO: 289690 - RNA, 64 nt, Human
aaucuacaauggauccaaaaggacaaaacauguuacaagcaaaucaacauaguugcugcaggcg

SEQ ID NO: 289691 - RNA, 64 nt, Human; identical to SEQ ID NO: 283399

SEQ ID NO: 289692 - RNA, 64 nt, Human
gaacauaauuggagaaccuuuccuucaagcagaaacaagcaacugagggaaaaagaaacacaac

SEQ ID NO: 289693 - RNA, 64 nt, Human
ugaaucauaccugcuuuauucuuagcugagcaaaacaagcaaugcuuugggagguguuaacuca

SEQ ID NO: 289694 - RNA, 64 nt, Human
gaguauaacuucuuucagcccucagauuuuaaauacaagcaaauaaacucacuauuuuuagacg

SEQ ID NO: 289695 - RNA, 64 nt, Human
cuugaacucuauuaauaaugguaguauuauauauacaagcaaauaucuauucucaagugguaag

SEQ ID NO: 289696 - RNA, 64 nt, Human
cgucaccucuuccacagagcacuuuggcauguaaacaagcaagagcacugccucuauaggguaa

SEQ ID NO: 289697 - RNA, 64 nt, Human
cuuaccuuagcauugccaagaacuucagcagacaacaagcaauucuauuuauuuuauguugugu

SEQ ID NO: 289698 - RNA, 64 nt, Human
aaugcagucuguccaggcucgucauuggaggugaacaagcaaacccagacggcuccacuaggac

SEQ ID NO: 289699 - RNA, 64 nt, Human
gccccagguagaaacuuuuaucuauucugagaaaacaagcaaguucugagagccaggguuuucc

SEQ ID NO: 289700 - RNA, 64 nt, Human
ccugugcaauuauaaacuauaagcaaguuaagugacaagcaaauguaauaaagacuaguuuuaa

SEQ ID NO: 289701 - RNA, 64 nt, Human
cuggauauuuucacaccuuaccucauuuaauacaacaagcaaggagguagacaauauugucuac

SEQ ID NO: 289702 - RNA, 64 nt, Human
gauuagcugugucacuuuuaaauaagaaguccacacaagcaagccaaauuuuuagaugacgaag

SEQ ID NO: 289703 - RNA, 64 nt, Human
aaagucccugccugcaugcauucuggcggaagagacaagcaagcaaugaacaaauuagcagaaa

SEQ ID NO: 289704 - RNA, 64 nt, Human
gaaacagguacuggacuuuucccuccugcaugaaacaagcaaacaauggacaaaauaugugaaa

SEQ ID NO: 289705 - RNA, 64 nt, Human
aacgugaauugagucuccaaggucuccaugugaaacaagcaaaaagagaauuaucuguaauguu

SEQ ID NO: 289706 - RNA, 64 nt, Human
uuugaguuacuucaaucauuuucacaggcagccaacaagcaauuaagagcaguuauaauagagg

SEQ ID NO: 289707 - RNA, 64 nt, Human
gaugcugaucccuucaaguggggacagcaaaaagacaagcaaaacugaugugcacuuuauggcu

SEQ ID NO: 289708 - RNA, 64 nt, Human
ucccagagggucuuaguccuggaaagucaggccaacaagcaacguuugcaucauguuaucucuu

SEQ ID NO: 289709 - RNA, 64 nt, Human
ugauuuguacaaauuuuuucugaaauuuaaauugacaagcaauguuauaaaaauauugcuaauc

SEQ ID NO: 289710 - RNA, 64 nt, Human
aaucauuuaaccaaagaagauguguagugccuuaacaagcaauccucugucaaaaucugaggua

SEQ ID NO: 289711 - RNA, 64 nt, Human
cuuuccggacauacgcagcaccauacaauauuucacaagcaauggaaaagcaguuaccucauuc

SEQ ID NO: 289712 - RNA, 64 nt, Human
gauauugcugugucccucagauuuuaguaguuugacaagcaagaacacauauccaaauggaauu

SEQ ID NO: 289713 - RNA, 64 nt, Human
uuuuuuuuccaacugugaucucgccuuguuucuuacaagcaaaccagggucccuucuuggcacg

SEQ ID NO: 289714 - RNA, 64 nt, Human
guuuaauuuuauuugacuuucgcauugcuuuucaacaagcaaauguuaaauguguuaagacuug

SEQ ID NO: 289715 - RNA, 64 nt, Human
auucaguuucuuuaauagaugaggaaaaauagcaacaagcaaguugcuuauaauaaaauaauuu

SEQ ID NO: 289716 - RNA, 64 nt, Human
ggaagggucuccaggcuucacucaggguagagaaacaagcaaagcccagcagcgcacagggugc

SEQ ID NO: 289717 - RNA, 64 nt, Human
agauauuuugauucucauugccauucuuauggccacaagcaaaguaaugguucucauaguggua

SEQ ID NO: 289718 - RNA, 64 nt, Human
uguagcuuaacaccauccacucacuccaacaaagaacacuuagaaugauaaaaaaaaaaaaaaa

SEQ ID NO: 289719 - RNA, 64 nt, Human
cacuugcacuauuacucagcagcaguaacaugguaacacuuaaaaugguacucggggaccucca

SEQ ID NO: 289720 - RNA, 64 nt, Human
uuccuauuaccuugaucucuucccccaacuuccuaacacuuauuaauuuaugaaacuguuuuuc

SEQ ID NO: 289721 - RNA, 64 nt, Human
auuaagaagcuggggguaggguggggguggggagaacacuuaacaacauggggaccagucaggg

SEQ ID NO: 289722 - RNA, 64 nt, Human
aauguaaauuucaguuguuuuucccucuaggacaaacacuuaccaaaauaugcaacuuuuuuuu

SEQ ID NO: 289723 - RNA, 64 nt, Human
aauccaaaguaagcucauaaaaauaauugaugauaacacuuaccaaaagaucacugcaaaccug

SEQ ID NO: 289724 - RNA, 64 nt, Human
aucuguaaaguagcacuuaaauauaucugauagcaacacuuaagauauugcauggggauuacuu

SEQ ID NO: 289725 - RNA, 64 nt, Human
gaaagagauguggcuuuugugauauucuaucacaaacacuuauuguaucucuguaaaauacaau

SEQ ID NO: 289726 - RNA, 64 nt, Human; identical to SEQ ID NO: 281736

SEQ ID NO: 289727 - RNA, 64 nt, Human
gaccacgaucuacaugcuggcagggaagccccgcggauccgaaggcccuguccgcucugucuuc

SEQ ID NO: 289728 - RNA, 64 nt, Human
ucucugcugccuugggguuggcagaacacgugaaggauccgaggagcgagaggaauguccauuu

SEQ ID NO: 289729 - RNA, 64 nt, Human
cuauuuagugaucuguaaauaauugaaguaauguaacacuuaauguuuuaauaugucaguuauu

SEQ ID NO: 289730 - RNA, 64 nt, Human
uccgcuguuuguuuuccucuugccacaauuugcuaacacuuaaaaaauuuuccugcacccagua

SEQ ID NO: 289731 - RNA, 64 nt, Human
agaaaagcucuggaguauugaucacuacuggaaaaacacuuaaggagcuaaacuuaccuucggg

SEQ ID NO: 289732 - RNA, 64 nt, Human
uuacugggaauggaaaguguggugaagaucauucaacacuuauguugucauuucucccauuuuc

SEQ ID NO: 289733 - RNA, 64 nt, Human
acuggaucuuuguuuagcaaacucacuggaaaugaacacuuaauggaauuuuuaagucuguucu

SEQ ID NO: 289734 - RNA, 64 nt, Human
aacaucauaguuucuuggccacugaauuagccaaaacacuuaggaagaaaucacuuaaauaccu

SEQ ID NO: 289735 - RNA, 64 nt, Human
uggguaugaacagauugccugcuuucccuuaaauaacacuuagauuuauuggaccagucagcac

SEQ ID NO: 289736 - RNA, 64 nt, Human
cacugaaacuaugcagcauuucaguuuucauuuaaacacuuaguucagaaaccuuaaaggauuu

SEQ ID NO: 289737 - RNA, 64 nt, Human
uuaacagaucauuuauaaagcaggaguccauuuuaacacuuaccgacuuuuuuugguuuggaaa

SEQ ID NO: 289738 - RNA, 64 nt, Human
gaaucacauaauugucuuuggaacuuggucucccaacacuuauugugauugcaaaguguuuacc

SEQ ID NO: 289739 - RNA, 64 nt, Human
gugucuagcacugaauggggaaacugggggcagcaacacuuauagccaguuaaagccacucugc

SEQ ID NO: 289740 - RNA, 64 nt, Human
uaggccaggcaugguggcucaugccuguaaucccaacacuuaggguggcugaggcaggcagauc

SEQ ID NO: 289741 - RNA, 64 nt, Human
uaaaauaugcucauaaaaggccuuuaugaagaaaaacacuuaagcugagaccuggauaaguggg

SEQ ID NO: 289742 - RNA, 64 nt, Human
gugagcuaccaaaacuuccacagaugugagauuuaacacuuaauugcagucacguguaugcaac

SEQ ID NO: 289743 - RNA, 55 nt, Human
uaauacagacagaagcaugaaagaaaacacuuaacuugcaugugcacagcuuuug

SEQ ID NO: 289744 - RNA, 64 nt, Human
guggggggacagccgaugggagccagcaccagcaggauccgagggcgccccggacagaggucug

SEQ ID NO: 289745 - RNA, 64 nt, Human
ggguggcugggcagucagggaaggagggucgcccggauccgacauuuuggagagauuccuucac

SEQ ID NO: 289746 - RNA, 64 nt, Human
caagcagucucuggugcuuuucuucucucaaaauggauccgauaaauauuugaauagagcagau

SEQ ID NO: 289747 - RNA, 64 nt, Human
ugacauuuugugauauuugaauguuauuaaguuaaacacuuagaguugaguauauucaggggag

SEQ ID NO: 289748 - RNA, 64 nt, Human
ccugaauauauauacagauagauagaugaguaucaacacuuacaagcucuacacagucugugag

SEQ ID NO: 289749 - RNA, 64 nt, Human
ugcaaucaaaauuagaguacuuugguuugaaaacaacacuuagagccuccagauaacuuuuaag

SEQ ID NO: 289750 - RNA, 64 nt, Human
cuuucuaggugaagcagacuguggugaauuuagcaacacuuaugaaguuucuuaaaguggcuca

SEQ ID NO: 289751 - RNA, 64 nt, Human
guggaaaaucguugcuucagaaaagacuucaaauaacacuuacuugugccuggcugugcuggau

SEQ ID NO: 289752 - RNA, 64 nt, Human
aaguuuauuuccugacagcagguguacacaugccaacacuuaaucauuuuauggcaccuauuuc

SEQ ID NO: 289753 - RNA, 64 nt, Human
uaauacagauguuuuacuguuuauuucuaauucaaacacuuaaguagcuuuauuguuaaacuuu

SEQ ID NO: 289754 - RNA, 64 nt, Human
caagguccacuauuucugaguuuaauguguuuccaacacuuaaggagacucuaaugaaagcuga

SEQ ID NO: 289755 - RNA, 64 nt, Human
gccaucaguauguguugcagagcucacagccaggaacacuuauuuugaacaaugcagacaguac

SEQ ID NO: 289756 - RNA, 64 nt, Human
aaugucaugauuuuuuuccgguccugccacauguaacacuuacucuguuaccuaaauuuuauag

SEQ ID NO: 289757 - RNA, 64 nt, Human
acauuaauaacuacacaaaauuuuauuuaaagagaacacuuagcagccuaugauaguuuucaau

SEQ ID NO: 289758 - RNA, 64 nt, Human
gcuguugaguuuuuguuuugucuucugugguaagaacacuuaacucaagaccuacccucuuaac

SEQ ID NO: 289759 - RNA, 64 nt, Human
uauucucuucauagcaguuccuauaaagggauuaaacacuuauuucuguguuaugguucuuauu

SEQ ID NO: 289760 - RNA, 64 nt, Human
agaugcuaaacuucuuagaaugaaaauaugcuucaacacuuaaguagcauacacugcccuacaa

SEQ ID NO: 289761 - RNA, 64 nt, Human
ucauguaguuacuauuugugugugguggcagaagaacacuuaagagcuacucucuuucuacaua

SEQ ID NO: 289762 - RNA, 64 nt, Human
gagccucccaucugggcaguggagccauaaacggggauccgagaagagaguauccacuuuuuuu

SEQ ID NO: 289763 - RNA, 64 nt, Human
ccaccucuguuccuaacaaagcgguugugagccuggauccgacucccggcagugcugacccugc

SEQ ID NO: 289764 - RNA, 64 nt, Human; identical to SEQ ID NO: 281739

SEQ ID NO: 289765 - RNA, 64 nt, Human
uuaugaaacuacuuauucauaguuaauucucauuaacacuuacauuuccauaaagaaaacucaa

SEQ ID NO: 289766 - RNA, 64 nt, Human
uuuugagaaauaagguucaaaaaauaagaaugcuaacacuuaagcacagacuagagcuugcuug

SEQ ID NO: 289767 - RNA, 64 nt, Human
caagccucaaagagagaaaguuucguuauauuaaaacacuuagguaacuuuucggucuuuccca

SEQ ID NO: 289768 - RNA, 64 nt, Human
gucugccgacuauggagucuccaccuuuggacacaacacuuacucaccauuuacucuuuaucac

SEQ ID NO: 289769 - RNA, 64 nt, Human
cccacauagaaccguccuccaguggugaagcggaaacacuuagcuuuauccacccuccccacug

SEQ ID NO: 289770 - RNA, 64 nt, Human
gacauagucucuaccuauagaaauguauuuugaaaacacuuauuuuacacagcaauuuuguauc

SEQ ID NO: 289771 - RNA, 64 nt, Human
uagcuucauuucauauaaacauaaguaacucccaaacacuuauguagaggacuaaaaauguauc

SEQ ID NO: 289772 - RNA, 64 nt, Human
ggaguuaaaaugcacauauagacacauacacccaaacacuuacaccaaacuacugaaugaagca

SEQ ID NO: 289773 - RNA, 64 nt, Human
aguugugauacgaauagaacaaaaaaaaaaaaaaaacacuuaaacuuuguuaggacuccgauga

SEQ ID NO: 289774 - RNA, 64 nt, Human
aaugaggugucaugguucccuguggcaaauuuagaacacuuaucguuuggcaggacacagagag

SEQ ID NO: 289775 - RNA, 64 nt, Human
ugacuguuuuagggacuagaccaugugcuuuuuuaacacuuauauauauaauggucuauuugaa

SEQ ID NO: 289776 - RNA, 64 nt, Human
gacaugaaaacugugcaagcaaaaaccgaagaaaaacacuuaaguacaacuguagugacaguga

SEQ ID NO: 289777 - RNA, 64 nt, Human
ccaggauggcauagagaaagcuggcaauuagguuaacacuuacauauuauagugccccuuuaag

SEQ ID NO: 289778 - RNA, 64 nt, Human
aaacaugaaacugaauaaggagaagaguauuuuuaacacuuaaauuucuuggcaaauuuuaaaa

SEQ ID NO: 289779 - RNA, 64 nt, Human
aucuuaagguauuuacauguauguggaaaaacaaaacacuuaacuagaauucucuaauaagguu

SEQ ID NO: 289780 - RNA, 64 nt, Human
gaagucucuucccuuucuacccaguacucgagcccagggcuagaaguugaaacucacuaguaau

SEQ ID NO: 289781 - RNA, 64 nt, Human
aaggaaccacugguuuuugggauagaacuugggccagggcuaggaacacaggcuccacggugac

SEQ ID NO: 289782 - RNA, 64 nt, Human
uccccaagagugaugcccggcagcauucccagcucagggcuaaugguucacggaagccaggaau

SEQ ID NO: 289783 - RNA, 64 nt, Human
cccaguauuuuuauacggaaaaaauuguauugaaaacacuuaguaugcaguugauaagaggaau

SEQ ID NO: 289784 - RNA, 64 nt, Human
uuucaaauccccuuucgcagugaaagaaacagcaaacacuuaagauucagcaucuguucuccag

SEQ ID NO: 289785 - RNA, 64 nt, Human
uuucugaaauaagauuuaaaaacaaaacaaaaaaaacacuuaauauuucagacuguuacaggaa

SEQ ID NO: 289786 - RNA, 64 nt, Human
auugaauuuaugcucuauuuuuguuuauuuaagcaacacuuaauguaaaagugcaacaggcaau

SEQ ID NO: 289787 - RNA, 64 nt, Human
gcaauacuucauaauguaauggaauuguuuggggaacacuuacuguacccucucauccuuuuuc

SEQ ID NO: 289788 - RNA, 64 nt, Human
ccugggcuauuggcugcucccaauccuugccccaaacacuuagcuggcuccccaugacuuaagu

SEQ ID NO: 289789 - RNA, 64 nt, Human
caaaaaauccaaaugaaaaacauaauugcuucaaaacacuuacacaguuggaaaguuauaugua

SEQ ID NO: 289790 - RNA, 64 nt, Human
uuuugucuccccacccccaacuuggcuaguaauaaacacuuacugaagaagaagcaauaagaga

SEQ ID NO: 289791 - RNA, 64 nt, Human
uggcacucaaaaagguucaacauugaguccacuuaacacuuagguguuagaagaccuaacuuuc

SEQ ID NO: 289792 - RNA, 64 nt, Human
ggaaaaagaucuucaaccuuucgggaggagagaaaacacuuaguucauuggcuuuaguauuugc

SEQ ID NO: 289793 - RNA, 64 nt, Human
auuuuaauuguuacuuauuauuuagauauuucucaacacuuaaauucauaaaauuaagaccaug

SEQ ID NO: 289794 - RNA, 64 nt, Human
aguuggagcagaugguuuguuacuugaaucuccaaacacuuaguugaauuuuuacagauauuuc

SEQ ID NO: 289795 - RNA, 64 nt, Human
agacauacggagcagaauaaagaguacagauaugaacacuuauacuuacggucaauugauuuuu

SEQ ID NO: 289796 - RNA, 64 nt, Human
cuccacucucccagcuugcuuuaguuuuuucagcaacacuuaucccacauccuauggaauucag

SEQ ID NO: 289797 - RNA, 64 nt, Human
cgcacagggauguuuuguuuagcuugcggacucuaacacuuaaaaaaaaacccagaucagaaga

SEQ ID NO: 289798 - RNA, 64 nt, Human
auuugccuuuuuaaguaaaaaagaaaaaucagaacagggcuauuugaagaauuauuuuauacac

SEQ ID NO: 289799 - RNA, 64 nt, Human
ucugcuuggucaagguuugugccccacuacagaacagggcuaaauuagccaccaccacugaaaa

SEQ ID NO: 289800 - RNA, 64 nt, Human
ucuucuucaucuucaaacucuucagaagcagcaacagggcuaguuaauucaacucccaauuguu

SEQ ID NO: 289801 - RNA, 64 nt, Human
caaagaccaucgagacggccauucuuguuuacaaaacacuuaccaagaaagcacuuuguagggg

SEQ ID NO: 289802 - RNA, 64 nt, Human
gcucuuugcuucaugccucgcuuuaaugguaguaaacacuuaaccaguggaauagucugacugc

SEQ ID NO: 289803 - RNA, 64 nt, Human
aacuccaagagaucguuagcagcaucaguccacaaacacuuaguggcccacaauauauagagag

SEQ ID NO: 289804 - RNA, 64 nt, Human
cuggauagagaugacuauuuucccaacaaguagaaacacuuaaaaucaucuuucuuuuuuguuu

SEQ ID NO: 289805 - RNA, 64 nt, Human
aagacauacauuauucacuuccauuuuuacaauaaacacuuacuuaacaucuacucugugccaa

SEQ ID NO: 289806 - RNA, 64 nt, Human
cccaacagauacuggaaguuuugcauuuauggucaacacuuaaggguuuuagaaaacagccguc

SEQ ID NO: 289807 - RNA, 64 nt, Human
ugcaagaucuucuaaaccccaagagacuucacacaacacuuauguaugcaccccaaagacuaau

SEQ ID NO: 289808 - RNA, 64 nt, Human
gcugaguugugccuaaggguggcugaaauacuaaaacacuuaucuuacagcaagugaacagggg

SEQ ID NO: 289809 - RNA, 64 nt, Human
ccagcuuuguccccacaguguaccuuuuugcuaaaacacuuauuacccuucugcagcaaaggca

SEQ ID NO: 289810 - RNA, 64 nt, Human
ucugcuaucccacuguauagauccacagggagcaaacacuuagaaaugauagagaacugaagga

SEQ ID NO: 289811 - RNA, 64 nt, Human
uguuucucucugaaauuacugugaauauuuaacaaacacuuacuugaucuauguuaugaaauaa

SEQ ID NO: 289812 - RNA, 64 nt, Human
aacauauuaucagucacaguuuucuuuccaauuaaacacuuaacuuuuguuauucccuguauau

SEQ ID NO: 289813 - RNA, 64 nt, Human
aaacugaugacuuuuuccuuccugcuacauggguaacacuuaguuguuugucuaauuucuauuu

SEQ ID NO: 289814 - RNA, 64 nt, Human
auguaaggugugcacagugaucuucaacuuaacaaacacuuacguucuccuuuauaaaaugcau

SEQ ID NO: 289815 - RNA, 64 nt, Human
guuagcauugcauugauaacucagaaucuugauaaacacuuaauauuugggccugaagcauuaa

SEQ ID NO: 289816 - RNA, 64 nt, Human
aggcugggcaccacaguguuuccaagagcaagcuggauccgaguagauucccuagggcuuguug

SEQ ID NO: 289817 - RNA, 64 nt, Human
acccccuuauuuaaaugugugcuaugacccacuaugaccacagcaucugcauuuucuaaaaaau

SEQ ID NO: 289818 - RNA, 64 nt, Human
gccucaaugugguugcaaggccgcuguucacccacagggcuaagagcuagcgcugccgcacccc

SEQ ID NO: 289819 - RNA, 64 nt, Human
ucuuuagugugcuugaaugcccuucuuuccauauaacacuuaucuucuucuuaauucggcaaug

SEQ ID NO: 289820 - RNA, 64 nt, Human
acuauaccuacuucauuuaaaauaacaugaguuaaacacuuagcugagugcacuucauguugga

SEQ ID NO: 289821 - RNA, 64 nt, Human
gagcucuaaaugcaaaacucuuuuauacugaaaaaacacuuaaaguaguuuuguguggcaucac

SEQ ID NO: 289822 - RNA, 64 nt, Human
caugaauucuaaguuuuggguaauguuaacucagaacacuuaaucaaauugagcuaugugccau

SEQ ID NO: 289823 - RNA, 64 nt, Human
ccgaugaguuaaaucuugcaaguuaacacaacguaacacuuaaaagcauacauuuucagcaacc

SEQ ID NO: 289824 - RNA, 64 nt, Human
ccaagcuccucugugaagcaggucuuucacucacaacacuuaacagggaacggcagggcucuuu

SEQ ID NO: 289825 - RNA, 64 nt, Human
cucuggcucuauuuauguuacuuuuugcgauaagaacacuuaacauaaguauucucuccucuug

SEQ ID NO: 289826 - RNA, 64 nt, Human
uggaugaugccaccugcuucaacuguauauaauaaacacuuaugaugacauuucuugccuggcu

SEQ ID NO: 289827 - RNA, 64 nt, Human
guucaaagauacaagaaaaaguagaaaaaaaaauaacacuuaacuaaaaccccuaggucauuug

SEQ ID NO: 289828 - RNA, 64 nt, Human
aagcugcuggcaugcacgggaacagugaaugccaaacacuuaaagcaauucgauguuuaaguau

SEQ ID NO: 289829 - RNA, 64 nt, Human
guaagauuguuaauuuccuucaaucucuagugacaacacuuaauuucuuuucuaauaaaaaaaa

SEQ ID NO: 289830 - RNA, 64 nt, Human
uuacacuucauauagcauugauaaucuucaggugaacacuuagugaucauuuaaaaagcucacu

SEQ ID NO: 289831 - RNA, 64 nt, Human
aauuagauccuccccuucaaaugcuguaauuaacaacacuuaaaaaacuugaauaaaauauuga

SEQ ID NO: 289832 - RNA, 64 nt, Human
aacauacucuuacuguucugucuuuaugaaucugaacacuuagaugauacugcauuuuaagcau

SEQ ID NO: 289833 - RNA, 64 nt, Human
caccaaaccccacuuccccucauaaguuuguuuaaacacuuaucuucuggauuagaaugccggu

SEQ ID NO: 289834 - RNA, 64 nt, Human; identical to SEQ ID NO: 289763

SEQ ID NO: 289835 - RNA, 64 nt, Human; identical to SEQ ID NO: 281771

SEQ ID NO: 289836 - RNA, 64 nt, Human; identical to SEQ ID NO: 289746

SEQ ID NO: 289837 - RNA, 64 nt, Human
caacacgagaucaaucagccuuggucaauggacaaacacuuaggacugaacugaaccccucccc

SEQ ID NO: 289838 - RNA, 64 nt, Human
uggauuuuauuuuuuauuugcuuuuuuuuuauauaacacuuaaagguuucuuugaaaacccucc

SEQ ID NO: 289839 - RNA, 64 nt, Human
uuaucuuggcccugcacucucaacaugaguagcgaacacuuaaauuggguuuucaacaguccca

SEQ ID NO: 289840 - RNA, 64 nt, Human
ugacuauauuaugcugucuuugacuuagucagucaacacuuauugagcaccuacuaagugccaa

SEQ ID NO: 289841 - RNA, 64 nt, Human
caaagaauuuaguuccaccucuucauaccaguuuaacacuuaauauauuucauuggauuuuaga

SEQ ID NO: 289842 - RNA, 64 nt, Human
uacaguuaucaaauauuacuuuuaauuuguucucaacacuuauuucagguaauagcuuggggau

SEQ ID NO: 289843 - RNA, 64 nt, Human
ccuguauacauuaagucaucucuagauuauuuauaacacuuaauacaauguaaaugcuauguag

SEQ ID NO: 289844 - RNA, 61 nt, Human
uugaaccaauggauccuuaagauuuucagaaaacacuuauuuuguuucuuaaguuaugacu

SEQ ID NO: 289845 - RNA, 64 nt, Human
auugcucucaaggaucuaguggauuaguaaguuaaacacuuaacauuuuuuaggucugcuuuuu

SEQ ID NO: 289846 - RNA, 64 nt, Human
cugcucauuuccccuacuuauuaaaaucacaccaaacacuuacuauuuucuuaucucuuucacu

SEQ ID NO: 289847 - RNA, 64 nt, Human
cgcauucagggacagaucuaggcaguuucuaaacaacacuuagacuggggucuaacguugacaa

SEQ ID NO: 289848 - RNA, 64 nt, Human
gaaggcaugccucauugguaauuuggaagacaccaacacuuacccagaaucuguugcuauuuaa

SEQ ID NO: 289849 - RNA, 64 nt, Human
uaugagaauuccaauuucuguccacuuccucaccaacacuuauuauuuuccuuuuccuuuuuuu

SEQ ID NO: 289850 - RNA, 64 nt, Human
caauuuggucuucaauucaagagaugcuucauaaaacacuuauagccuuaaaccauucaagggc

SEQ ID NO: 289851 - RNA, 64 nt, Human
ccaagaguuuaucaaucacuuccuaauauuaauaaacacuuauuagugcuugcuguguucuagg

SEQ ID NO: 289852 - RNA, 64 nt, Human
ucuuuguauaaugggcucaaauucucuaccucuucagggcuaauacuuuuaacugagcugcugc

SEQ ID NO: 289853 - RNA, 64 nt, Human
ccccaucauucaugcuacugccaaccuggggagccagggcuaugggagcagcuuuuuuuucccc

SEQ ID NO: 289854 - RNA, 64 nt, Human
cuugggggacagaaaggaggaaguucugacuuuucagggcuaccuuauuucuacuaaggaccca

SEQ ID NO: 289855 - RNA, 64 nt, Human
aacaccugacaacuucugaauauuggacauuuuaaacacuuacaaauaaauccaagacugucau

SEQ ID NO: 289856 - RNA, 64 nt, Human
ggccucaacaccuucugaacguggauagugccagaacacuuaggagggugucuuuggaccaaug

SEQ ID NO: 289857 - RNA, 64 nt, Human
gcacugugaguuaccuuuguuucauagcaucuccaacacuuaaguucagacuuaaaaauuugcc

SEQ ID NO: 289858 - RNA, 64 nt, Human
auuucuggaaaaaaugaaauguacauaaaaauaaaacacuuaaaguugaguuucaauauguacu

SEQ ID NO: 289859 - RNA, 63 nt, Human
cuuucaggugcaacuucuaaaaaaagauuuuuaaacacuuaaugggaaacuggaauuguuaau

SEQ ID NO: 289860 - RNA, 64 nt, Human
uauucuccccaugaggcuaaccggccucuuucccaacacuuaaucauggcagccaggaugggug

SEQ ID NO: 289861 - RNA, 64 nt, Human
gugaagaauguggcaaagcuuuuaaccaagucucaacacuuacuauacauaagauaauuuauac

SEQ ID NO: 289862 - RNA, 64 nt, Human
cugcuucugagauaagaaccauuuguguaacaccaacacuuaacuucagaaagacaugcauuau

SEQ ID NO: 289863 - RNA, 64 nt, Human
ccaguugacuuuuaaauguaagaauggaauuccaaacacuuaacacauucagcuauaugacaga

SEQ ID NO: 289864 - RNA, 64 nt, Human
aacaauuagaugaaaccauguuaaagcugagaugaacacuuagaaauucagggauauugggucu

SEQ ID NO: 289865 - RNA, 64 nt, Human
agcuucaaccagaauucagccucugguaaacaugaacacuuaaaucuaacagaggauuuucaga

SEQ ID NO: 289866 - RNA, 64 nt, Human
aaauauaugcuccacaauuuauauuuagagagagaacacuuagucuugccugucaaaaagucca

SEQ ID NO: 289867 - RNA, 64 nt, Human
acaaagugagacccccaucucuacaaaaaauaaaaacacuuaaaaauuauccggguaccgugca

SEQ ID NO: 289868 - RNA, 64 nt, Human
gugaagaauguggcaaagcuuuuaaccaaucuucaacacuuacuacacauaagauaauucauac

SEQ ID NO: 289869 - RNA, 64 nt, Human
guuuagauaugacauuuauucaaaguuaaaagcaaacacuuacagaauuaugaagagguaucug

SEQ ID NO: 289870 - RNA, 64 nt, Human; identical to SEQ ID NO: 72751

SEQ ID NO: 289871 - RNA, 64 nt, Human; identical to SEQ ID NO: 72752

SEQ ID NO: 289872 - RNA, 64 nt, Human
ugcugcuuuucuuguucacuuuacacacuaaguaaacacuuauugucaggugccuagucuugag

SEQ ID NO: 289873 - RNA, 64 nt, Human
uccauccucaacacccaacugucucgaugcaaugaacacuuaauaaaaaacagucgauugguca

SEQ ID NO: 289874 - RNA, 64 nt, Human
acacauugugaauguaauuaacaccacugaguuaaacacuuaaaaugguuaaaauggcaaauug

SEQ ID NO: 289875 - RNA, 64 nt, Human
cauaugcauuuaugggaagacaaaacaagaaugaaacacuuauacugacuuucaucugguagua

SEQ ID NO: 289876 - RNA, 64 nt, Human
uuuugucacaauucauuuuuauuaauagaaaauaaacacuuauuccaguuucaaaguuguuaua

SEQ ID NO: 289877 - RNA, 64 nt, Human
auguauuucugaaccacuuggcagacaaauucacaacacuuaauguucauauuuugaguaaagg

SEQ ID NO: 289878 - RNA, 64 nt, Human
acagcuuagccucguccacccuaaauguacucagaacacuuagaauugcccacaguugggcaga

SEQ ID NO: 289879 - RNA, 64 nt, Human
acuacccaccaagcucauacagggaaccacacccaacacuuagacaugcgaacaagcagccccc

SEQ ID NO: 289880 - RNA, 64 nt, Human
auuacauaaaauaacuuuucaaauauaguuuaauaacacuuagaaguguuuacuuaccuggaaa

SEQ ID NO: 289881 - RNA, 64 nt, Human
ucuauaauacccaugaaaugauaauuuguaaaauaacacuuagugauaucuggaaauaauaauu

SEQ ID NO: 289882 - RNA, 64 nt, Human
uuuaugaauauuaaaauuaucauuaauaauauaaaacacuuauuugagauuaaauuaaauuuuu

SEQ ID NO: 289883 - RNA, 64 nt, Human
accucuuaaaaacauuguuuccacuuuaaaaguaaacacuuaauaaauuuuuggaagaucucug

SEQ ID NO: 289884 - RNA, 64 nt, Human
agauagcaacucuuugcucuguaugacaacagugaacacuuaaugaaagaauguggcuuucuuc

SEQ ID NO: 289885 - RNA, 64 nt, Human
ugugcaaguuuaucaguaaauaacuggaaaacagaacacuuauguuauacaauacagaucaucu

SEQ ID NO: 289886 - RNA, 64 nt, Human
uuguuuaagucgagauauaaaaacugaacacgauaacacuuacucuuaaaucaagcaucaacac

SEQ ID NO: 289887 - RNA, 64 nt, Human
ggcaggcccucuaggggcacuggggaacgucuugggauccgaccccgggccgaccgcaccguac

SEQ ID NO: 289888 - RNA, 64 nt, Human; identical to SEQ ID NO: 281737

SEQ ID NO: 289889 - RNA, 64 nt, Human
aaaaagguaugucuuugguuuggcagaauucaugcagggcuaucaagugguguucuaggguaac

SEQ ID NO: 289890 - RNA, 64 nt, Human
uuuuuuuaagguuaaagaauuuaauccauugugaaacacuuaacuggacaaacuguaguuuuag

SEQ ID NO: 289891 - RNA, 64 nt, Human
acucuggauggaggaauaacuuaccuaucacuacaacacuuacaaaugagaauuucucagaauu

SEQ ID NO: 289892 - RNA, 64 nt, Human
aaacacggaguuugggcucuguuggcuaagguguaacacuuaaagcaauuuucucccauugugc

SEQ ID NO: 289893 - RNA, 64 nt, Human
ucugcauuuucuacucugagcccauuuguuaauaaacacuuauuuuuauauaauuagcuguccu

SEQ ID NO: 289894 - RNA, 64 nt, Human
auuugagguaguuuguuuguauacuguuucuccaaacacuuaauauuucuuacaucaaagcaac

SEQ ID NO: 289895 - RNA, 64 nt, Human
gaagaugcaugguugcauccuuuuccuucugaccaacacuuagucuuuaacuuuguaagguucg

SEQ ID NO: 289896 - RNA, 64 nt, Human
uuauguuccuuuauuuaggaaacaccauuauaaaaacacuuauaguaaauggggacauucacua

SEQ ID NO: 289897 - RNA, 64 nt, Human
caguuagauuauugaaauauuauagagaguuaugaacacuuaaauuaugauagugguaugacau

SEQ ID NO: 289898 - RNA, 64 nt, Human
ugggucagcuugaauguccccauucuauaaauucaacacuuauuuucugaauucauaaaaauaa

SEQ ID NO: 289899 - RNA, 64 nt, Human
uuagacauaauccauuccacucauuauuccagcaaacacuuacugacaaaucggguccugaguu

SEQ ID NO: 289900 - RNA, 64 nt, Human
cuuagcaauuucuauuacaacuuuucuuagacuuaacacuuaugauaaaugacuaacauaguaa

SEQ ID NO: 289901 - RNA, 64 nt, Human
guacuguucuauaguuuuucaggaucuuaaaacuaacacuuauaaaacucuuaucuugagucua

SEQ ID NO: 289902 - RNA, 64 nt, Human
augagcauuagccccagcuuuguaaccaaugaggaacacuuacuuauuuuuaaguaucuugaca

SEQ ID NO: 289903 - RNA, 64 nt, Human
uucagccgggucuucaaaacuguaggggggaaauaacacuuaaguuucuuuuucucaucuagaa

SEQ ID NO: 289904 - RNA, 64 nt, Human
guaaaaauuaauauaauauuuuccccacaaaagaaacacuuaacagaggcaagugcaauuuaua

SEQ ID NO: 289905 - RNA, 64 nt, Human; identical to SEQ ID NO: 282752

SEQ ID NO: 289906 - RNA, 64 nt, Human; identical to SEQ ID NO: 282753

SEQ ID NO: 289907 - RNA, 64 nt, Human; identical to SEQ ID NO: 282754

SEQ ID NO: 289908 - RNA, 64 nt, Human
gcagcugggcgugguggcuuaugcuuguaaucccaacacuuagggagucaggagaaucacuuga

SEQ ID NO: 289909 - RNA, 64 nt, Human
aagaacacuuucuaccucuguuucagauuuuugaaacacuuauuuuaaaccaaauuuuaauuuc

SEQ ID NO: 289910 - RNA, 64 nt, Human
guaaaggagacaugaggcuuacugguugcuuuugaacacuuacuuaguucuuagcuacacccac

SEQ ID NO: 289911 - RNA, 64 nt, Human
auagcuuagccuagccugccuuaaacaugcucagaacacuuacauuagccuacagugggcaaaa

SEQ ID NO: 289912 - RNA, 64 nt, Human
gugccugcagccaccguggacugucuguuuuuguaacacuuaaguuauuuuaucagcacuuuau

SEQ ID NO: 289913 - RNA, 64 nt, Human
auuuuguacuuucugcagcaaucagcuuaauaacaacacuuauugcaccugucucucucugaga

SEQ ID NO: 289914 - RNA, 64 nt, Human
uguaaauaaaauguuuuuaaaaccuguuaguuaaaacacuuaggugaugggcacugcugcuuau

SEQ ID NO: 289915 - RNA, 64 nt, Human
accaccaacauucuguguucacauguguggguccaacacuuacuaccugguguaugaaauugga

SEQ ID NO: 289916 - RNA, 64 nt, Human
cccuuggaaaugccauaggaagcccacaaccgcuaacacuuacaauuuuggugcaaaagcaaac

SEQ ID NO: 289917 - RNA, 64 nt, Human
uuuaaugcuggaauuuuuauuaugucaccucuaaaacacuuaaauugccaaauuuggcuaguag

SEQ ID NO: 289918 - RNA, 64 nt, Human
auacauuuaacucagggaauuuguacuacuuggaaacacuuaacuguaaugcaacaugccuugg

SEQ ID NO: 289919 - RNA, 64 nt, Human
gcagacccagagccaguuccuauccccuaaccuaaacacuuauaggugaggacuccauccuccu

SEQ ID NO: 289920 - RNA, 64 nt, Human
aaagacaucuuucucuuuucuaaaagacuucccuaacacuuaccccauggcugcacaguuggug

SEQ ID NO: 289921 - RNA, 64 nt, Human
auaguaccuuuacauuuugcaaaacaguguugucaacacuuauuaaagcauuuucaaaaugaaa

SEQ ID NO: 289922 - RNA, 64 nt, Human
uuugccaugccugaguucuuuccuaucccacccuaacacuuaacauauuacuuagucugcuuug

SEQ ID NO: 289923 - RNA, 64 nt, Human; identical to SEQ ID NO: 282816

SEQ ID NO: 289924 - RNA, 64 nt, Human; identical to SEQ ID NO: 282817

SEQ ID NO: 289925 - RNA, 64 nt, Human; identical to SEQ ID NO: 282818

SEQ ID NO: 289926 - RNA, 64 nt, Human
auacuguugacauuaacuuucauaaaugaagcauaacacuuacuaguuuagagaaaugguagau

SEQ ID NO: 289927 - RNA, 64 nt, Human
uggauuuaguggugagaagaacuaaauaaaaggaaacacuuauuuacuuuucuauugagaauau

SEQ ID NO: 289928 - RNA, 64 nt, Human
aaagauagaagcauuauuuauaacugaagaguauaacacuuaucuucuuaaguaaaugcucuca

SEQ ID NO: 289929 - RNA, 64 nt, Human
gccauuaaacuuagcauuaucuucaucaugggaaaacacuuauuuuacuuucgauuuuuuuuuu

SEQ ID NO: 289930 - RNA, 64 nt, Human
ucuugcaguguuuucuaugaaaugcuugggcacaaacacuuauuucugugaaagagaacaugua

SEQ ID NO: 289931 - RNA, 64 nt, Human
guuuauucgggaaaacugaggccagaugcucugcaacacuuacgcuuuuucaacaaugugcacu

SEQ ID NO: 289932 - RNA, 64 nt, Human
uguacuuaaugugaaauauuuagauaccuuuuugaacacuuaacaguuucuuugagacaaugac

SEQ ID NO: 289933 - RNA, 64 nt, Human
aaggcccacuguaauacguagcucucuuaaauauaacacuuaggacuagaagauuagaaacuac

SEQ ID NO: 289934 - RNA, 64 nt, Human
caaaaaaaaaacaaaaaacaaaaacaaacaaaaaaacacuuaaaagcccaaggaguaagccugu

SEQ ID NO: 289935 - RNA, 64 nt, Human
caaagaauuccacagaguuaaauaucuuaaguuaaacacuuaaaauaaguguuugcgugauauu

SEQ ID NO: 289936 - RNA, 64 nt, Human
cugccaaacauuauauuacuaauaaaacuuaaccaacacuuacaauucagucaucaaaguaagu

SEQ ID NO: 289937 - RNA, 64 nt, Human
auuuuuauuuuaaauguuuaauuguauuugauuaaacacuuaacuggauuuuggaauaauaaaa

SEQ ID NO: 289938 - RNA, 64 nt, Human
uugaugcaaugagauagaagauguuugcuaccugaacacuuauugcuuugaaacuagacuugag

SEQ ID NO: 289939 - RNA, 64 nt, Human
ucacuggguguugaucuuacaagauauugaugauaacacuuaaaauuguaaccugcauuuuuca

SEQ ID NO: 289940 - RNA, 64 nt, Human
cagcaaaacuuccacagacauccuucuggacuuaaacacuuaacauuaaccacauuauuaauug

SEQ ID NO: 289941 - RNA, 64 nt, Human; identical to SEQ ID NO: 281755

SEQ ID NO: 289942 - RNA, 64 nt, Human; identical to SEQ ID NO: 282871

SEQ ID NO: 289943 - RNA, 64 nt, Human; identical to SEQ ID NO: 282872

SEQ ID NO: 289944 - RNA, 64 nt, Human
gccaggcucagccucaagcaguguuuucauugccaacacuuacuguacccacuccgcagagccc

SEQ ID NO: 289945 - RNA, 64 nt, Human
guagcuuagccaagccuaccuuaaaugcucugagaacacuuauauuagccuacagcugggaaaa

SEQ ID NO: 289946 - RNA, 64 nt, Human
acugaggcgcucgcucccaugcacaacucuccaaaacacuuauccuccugcaagagugggcuuu

SEQ ID NO: 289947 - RNA, 64 nt, Human
ucagagugucucauugagucuagaucauugaaccaacacuuaaccaaaugucccacucccauca

SEQ ID NO: 289948 - RNA, 64 nt, Human
aucguagaucucaaaggaucuugcuuuaacuuucaacacuuagaaaaucuacaaacauucagac

SEQ ID NO: 289949 - RNA, 64 nt, Human
ugcugguagaucuacugacuguagccaucaccagaacacuuaguuucuucccagacaugaauuu

SEQ ID NO: 289950 - RNA, 64 nt, Human
aaaaaacugucagagcgaauucaugcauucaacaaacacuuaugagugccuggaguaugccguc

SEQ ID NO: 289951 - RNA, 64 nt, Human
aacuuccaaaauauaaaaauagagccaccauaucaacacuuagcccuacccauuaguaucaccc

SEQ ID NO: 289952 - RNA, 64 nt, Human
gcaggggaugcccagaagaguggugagauaguaaaacacuuauucccucauccuuucagguuuu

SEQ ID NO: 289953 - RNA, 64 nt, Human
ugguccaguaggaggugcccuucacucuaagcuuaacacuuaguagggaagagauucucaaaug

SEQ ID NO: 289954 - RNA, 64 nt, Human
gaauggagaccauccgucggcccugcuaaggacuaacacuuagccaucguuuuucacaggccug

SEQ ID NO: 289955 - RNA, 64 nt, Human
auaacuggacauaugucauuuuaaggacaauagaaacacuuagacuuacuugaaaauccaaugc

SEQ ID NO: 289956 - RNA, 64 nt, Human
guaaugcagguuaauuacaacacagauguaccgaaacacuuaauugugaaccgcuaacauugaa

SEQ ID NO: 289957 - RNA, 64 nt, Human
uuacaacuuuacuuuguucuccagaggccuggagaacacuuagggauugugaaaauagcaggac

SEQ ID NO: 289958 - RNA, 64 nt, Human
acaccucauccagccuucuuacuuuguggaugggaacacuuaaggaauagagagauuaaaucuu

SEQ ID NO: 289959 - RNA, 64 nt, Human; identical to SEQ ID NO: 282940

SEQ ID NO: 289960 - RNA, 64 nt, Human; identical to SEQ ID NO: 282941

SEQ ID NO: 289961 - RNA, 64 nt, Human; identical to SEQ ID NO: 289762

SEQ ID NO: 289962 - RNA, 64 nt, Human
auauuucuuugauacuugaaauagagggagcuagaacacuuaauguuuaaucuguuaaaccugc

SEQ ID NO: 289963 - RNA, 64 nt, Human
cguuucguugggucauugccugaaaugcaaagacaacacuuacccaggauguuuccccaaggcc

SEQ ID NO: 289964 - RNA, 64 nt, Human
ggguuguguguuuauuucacuugaugauacaaugaacacuuauaagugaagugauacuauccag

SEQ ID NO: 289965 - RNA, 64 nt, Human
ucacuuccugauucuuaagcuucaucagcaccagaacacuuaauucucuucaauuuccuuuuuu

SEQ ID NO: 289966 - RNA, 64 nt, Human
uccccugcucacucuuccacagauauaaagaacaaacacuuagcaucccacacucaccccuucu

SEQ ID NO: 289967 - RNA, 64 nt, Human
uuucuacuuuuuuauuguaaaaggugcauuuuucaacacuuacuuuugguuucaauggugguag

SEQ ID NO: 289968 - RNA, 64 nt, Human
uuucuuuuuggacauuuaccuuuuugaaaaagaaaacacuuaaaaugaucauuaggacauaaca

SEQ ID NO: 289969 - RNA, 64 nt, Human
uucaaggucugucauaugaguccuccccuuuuacaacacuuauuaugguauuuuucaaguuauu

SEQ ID NO: 289970 - RNA, 64 nt, Human
uggaguuuauuuagaaguaaagugugaugacgauaacacuuaagugugaauuuuuaaauauagu

SEQ ID NO: 289971 - RNA, 64 nt, Human
aaaaucacuugcuuuugacuuaugcaguuguuuuaacacuuagugaugacuguguauucuccaa

SEQ ID NO: 289972 - RNA, 64 nt, Human
uuaguaaaagauaggcccacuuuauuccaagaauaacacuuagcacauaaacucuucuuccagc

SEQ ID NO: 289973 - RNA, 64 nt, Human
uaccacugguaacauuucuacuaaaucuuucuguaacacuuaaagaauucccucauucauuacc

SEQ ID NO: 289974 - RNA, 64 nt, Human
aaugaauguguuuguugagauauuacaguaauaaaacacuuaagaacaggaagauuacauuugu

SEQ ID NO: 289975 - RNA, 64 nt, Human
agcauuuuagaaacuacaaauauagguuugauucaacacuuaagucucagacugauuucuugcg

SEQ ID NO: 289976 - RNA, 64 nt, Human
aauuauauauuacuuguaagguaugaugaauaacaacacuuaaaaacucaucacaccuaaagac

SEQ ID NO: 289977 - RNA, 64 nt, Human; identical to SEQ ID NO: 72748

SEQ ID NO: 289978 - RNA, 64 nt, Human; identical to SEQ ID NO: 72749

SEQ ID NO: 289979 - RNA, 64 nt, Human
ugguaauuaggagcaaaugaguuauuacaggcaaaacacuuagaacaguuccuggcauauagua

SEQ ID NO: 289980 - RNA, 64 nt, Human
uuuguuucccuauaugcagucuuuaaaggauuacaacacuuaaaauugaauggacuugugucaa

SEQ ID NO: 289981 - RNA, 64 nt, Human
cuguuuaaagaaaaagguauauauaaguaaucagaacacuuagaagacugauagaugucacaca

SEQ ID NO: 289982 - RNA, 64 nt, Human
acauagcucuuaacaacuuccaggauauucacacaacacuuaggcuuaaaaaugagcucacuca

SEQ ID NO: 289983 - RNA, 64 nt, Human
uuugcuuuagauuuucuucuguuuucaccaucauaacacuuaaguuaaaucaugauguaaaauu

SEQ ID NO: 289984 - RNA, 64 nt, Human
uuauuuuuucaacuucaagguauuaacagcuguuaacacuuaaaaaguacugccacauauguag

SEQ ID NO: 289985 - RNA, 64 nt, Human
uauugaugugauuauucuuaaguguuaaaucauuaacacuuaaaugacuucauugggaauauug

SEQ ID NO: 289986 - RNA, 64 nt, Human
uccaguucuuuauaacaaaacagggaucuguuugaacacuuacuguuguuuuuuuuuuuuuaca

SEQ ID NO: 289987 - RNA, 64 nt, Human
ucuucccucccaauuauccacucuaauggagcagaacacuuacauggaaaauccuaaacaugga

SEQ ID NO: 289988 - RNA, 64 nt, Human
aaaaauguucugcuuaaguguuaaauaaaacggaaacacuuauucgugcuugguaauaugugug

SEQ ID NO: 289989 - RNA, 64 nt, Human
caagggaaacagcacagccuguuuauaauuaggaaacacuuaaaacagccuggcauuugggaac

SEQ ID NO: 289990 - RNA, 64 nt, Human
aggcaaucauuuacaacugauuuugaucacagggaacacuuacuuagaacccugauuagaggca

SEQ ID NO: 289991 - RNA, 64 nt, Human
uuuuagauauuaucauaacaucugggucuacucaaacacuuauuguuugaaagacuuaugucuu

SEQ ID NO: 289992 - RNA, 64 nt, Human
uguucuguguauaucauuaacauuuucccaaauaaacacuuaauucucuuuucccuaggugcca

SEQ ID NO: 289993 - RNA, 64 nt, Human
cagauguaauugucuaauguucugaugggaacguaacacuuauuuuuauauaaaaagagacuga

SEQ ID NO: 289994 - RNA, 64 nt, Human; identical to SEQ ID NO: 72744

SEQ ID NO: 289995 - RNA, 64 nt, Human; identical to SEQ ID NO: 72745

SEQ ID NO: 289996 - RNA, 64 nt, Human
guuuaaaucccuaagaaugucagaauuaaaauaacagggcuaucccguaauuggaaauauuucu

SEQ ID NO: 289997 - RNA, 64 nt, Human
guaucagaauuguuauugcuucauuuagacauaaaacacuuaaguguuuucuucacuccgugac

SEQ ID NO: 289998 - RNA, 64 nt, Human
gcacucuaauuagagaacuggaggaaccacauauaacacuuaacuuccccuacccugccccucc

SEQ ID NO: 289999 - RNA, 64 nt, Human
uuaacugacaugggccuuuaagaaccuuaaugacaacacuuaauagcaacagagcacuugagaa

SEQ ID NO: 290000 - RNA, 64 nt, Human
auaaauuaccacauuugccuucccuucaucagcuaacacuuaucacuuauacuaccaauaacuu

SEQ ID NO: 290001 - RNA, 64 nt, Human
acuuauuuaaaaaccuauuaguagaauuaguggaaacacuuagguuaaagugaaucuuguccau

SEQ ID NO: 290002 - RNA, 64 nt, Human
aaauagaaaaauaauuugguuuuuuaucaagaacaacacuuaucguuauguauuguguuaguua

SEQ ID NO: 290003 - RNA, 64 nt, Human
aauuuguucaauguauaacauucucaggauuuguaacacuuaaaugaucagacagaauaauauu

SEQ ID NO: 290004 - RNA, 64 nt, Human
gcuagcugagaagcagcaaugaacagaaagcuguaacacuuaugacaacaauucuugcagugcc

SEQ ID NO: 290005 - RNA, 64 nt, Human
ccuuuuuuucugugaaauaugugaauaauaauuaaacacuuagacuugauucccguucugguuc

SEQ ID NO: 290006 - RNA, 64 nt, Human
uccuguguguggaauagaggccccucgugcuaccaacacuuacccuguguuuaaaaagaucuug

SEQ ID NO: 290007 - RNA, 64 nt, Human
gggugguccuucuugaauucauguacaugguauuaacacuuaguguucgggguuuuuuguuaug

SEQ ID NO: 290008 - RNA, 63 nt, Human
ccuuuuuuucugugaaauaugugaauaauaauuaaacacuuagacuugauucccguucugguu

SEQ ID NO: 290009 - RNA, 64 nt, Human
cacccaguuuuuagccaaagcaaauucuccuauuaacacuuagcaggaugaauuuaauauucau

SEQ ID NO: 290010 - RNA, 64 nt, Human
auguguaauagaauuaaaaauaauagcuguguauaacacuuagcucaagccacgcaugugugag

SEQ ID NO: 290011 - RNA, 64 nt, Human
aaacgacaacaagcuucuucccagggugaggggaaacacuuaaggaauaaauauggagcugggg

SEQ ID NO: 290012 - RNA, 64 nt, Human; identical to SEQ ID NO: 282819

SEQ ID NO: 290013 - RNA, 64 nt, Human; identical to SEQ ID NO: 282869

SEQ ID NO: 290014 - RNA, 64 nt, Human; identical to SEQ ID NO: 289727

SEQ ID NO: 290015 - RNA, 64 nt, Human
ccaguagguugaggacaggagagggaagggucuuaacacuuacacccuuuuguacauuuugaau

SEQ ID NO: 290016 - RNA, 64 nt, Human
uaaguagaaaacagccaccaugacaauaaacaaaaacacuuaaaaauauuuuuagcuuguuuua

SEQ ID NO: 290017 - RNA, 64 nt, Human
uccugcggucuccccgcauccacagggaggguaaaacacuuagcuuuuauuuuaauaguacaua

SEQ ID NO: 290018 - RNA, 64 nt, Human
ccugcuggacaaauucuaaaagagcuagagcuguaacacuuauucuugcaucuuauuaauuuuc

SEQ ID NO: 290019 - RNA, 64 nt, Human
uccuucucccuucccuuuggacaguguuacagugaacacuuagcauccuguuuuugguugguag

SEQ ID NO: 290020 - RNA, 64 nt, Human
ggacuuugggacaaaucucuuugugcuguuugguaacacuuaacucuauuuguugcaaucuuuc

SEQ ID NO: 290021 - RNA, 64 nt, Human
ugaauuauucugguuauuacuaaaguuucuaugaaacacuuaaguagauuuuaagaauaaaugu

SEQ ID NO: 290022 - RNA, 64 nt, Human
uuucuagcauuaauaugccccacgcaauauuuggaacacuuaugugaaaaaugauuuguuuuuc

SEQ ID NO: 290023 - RNA, 64 nt, Human
aaggaagagcuguuucaguaaagaaugaagugaaaacacuuauuuaggaaaauguuucucaaca

SEQ ID NO: 290024 - RNA, 64 nt, Human
guucauugacaguguuaggaugugaaggcugggaaacacuuauuuugcuucaagaguuccacuu

SEQ ID NO: 290025 - RNA, 64 nt, Human
cugaucuaauuucuguuuuauaccuuauacccaaaacacuuacuaccaacacagcuguuaaaca

SEQ ID NO: 290026 - RNA, 64 nt, Human
cucaaaguguguuccccggacaagcagcaucugcaacacuuaggaaggucuucgaaauacuaau

SEQ ID NO: 290027 - RNA, 64 nt, Human
caccauuccagaaccucucuuuucuaagaugcacaacacuuaucaaagauauguuuaguuuaga

SEQ ID NO: 290028 - RNA, 64 nt, Human
ucuguucauuuuuuaauugagcaaaugucuauugaacacuuaaaauuaauuagaaugugguaau

SEQ ID NO: 290029 - RNA, 64 nt, Human
auguguuuugugugacccauacaguguuguaaaaaacacuuagaaccauuauucuaaaaaaugg

SEQ ID NO: 290030 - RNA, 64 nt, Human; identical to SEQ ID NO: 281772

SEQ ID NO: 290031 - RNA, 64 nt, Human; identical to SEQ ID NO: 289744

SEQ ID NO: 290032 - RNA, 64 nt, Human; identical to SEQ ID NO: 289745

SEQ ID NO: 290033 - RNA, 64 nt, Human
uuuuuuucacacaucagaaaaaacugacuguauaaacacuuaucacugaccuuuuucuaugugu

SEQ ID NO: 290034 - RNA, 64 nt, Human
agagggauuaucacuaucugauacuucugaaagaaacacuuacaaaauuucuuaucuguaaaau

SEQ ID NO: 290035 - RNA, 64 nt, Human
acccuugucccuggccauugccugguggucuagaaacacuuaaaacuugaaguagugacaccua

SEQ ID NO: 290036 - RNA, 64 nt, Human
uagacagagcucauaguauuuguuuucugcuccgaacacuuaaaaaauacuaagacgugauagu

SEQ ID NO: 290037 - RNA, 64 nt, Human
aaaagcaggaaacugaaggaagcaggggcugaggaacacuuagagggugggcagaagcgggggu

SEQ ID NO: 290038 - RNA, 64 nt, Human
guaaugaguguggcaaagccuuuagugaccagucaacacuuaccaucaggccauucauggugua

SEQ ID NO: 290039 - RNA, 64 nt, Human
ggaacaaguaucucaggaugaaaucucaaugaaaaacacuuauuuugggggaauaucuauuuua

SEQ ID NO: 290040 - RNA, 64 nt, Human
guaaugaguguggcaaagccuuuggcaagcagucaacacuuauucaccaucaggcaauucaugg

SEQ ID NO: 290041 - RNA, 64 nt, Human
ccaaaaaauggagaaaaaguaggcugacucaggaaacacuuagaaaguacagccauaccucaaa

SEQ ID NO: 290042 - RNA, 64 nt, Human
guugagauuuuuaaaaaguuuuacaaauacauauaacacuuaugugcugggcuuucuuuuaaau

SEQ ID NO: 290043 - RNA, 64 nt, Human
agguuggcuuacagguauguauaugugcagaagaaacacuuaagauacaaguucuuuugaauuc

SEQ ID NO: 290044 - RNA, 64 nt, Human
aagauaaauucccagaagugaauuuguuagaucaaacacuuaaaacuuuuuguuauggaagaau

SEQ ID NO: 290045 - RNA, 64 nt, Human
acuaaaggcaaaaaucaaagcacaguuguccauuaacacuuauaaguuaauuauggguuuauga

SEQ ID NO: 290046 - RNA, 64 nt, Human
uggucuccaguuuucaguuggaacucugguguuuaacacuuaagggagacaaaggcugugucca

SEQ ID NO: 290047 - RNA, 64 nt, Human
gguacccaggagaagggauuuugggcccaggagaaacacuuacauucuggugccuugucuuuug

SEQ ID NO: 290048 - RNA, 64 nt, Human; identical to SEQ ID NO: 72740

SEQ ID NO: 290049 - RNA, 64 nt, Human; identical to SEQ ID NO: 72741

SEQ ID NO: 290050 - RNA, 64 nt, Human
auguggcucagagguaucacagugacaaaagagccagggcuagggcuggaggggccaggugauc

SEQ ID NO: 290051 - RNA, 64 nt, Human
gaauuugccacuuuuucuaaacgaagauuuauggaacacuuaccacacggcugacgcugcgcga

SEQ ID NO: 290052 - RNA, 64 nt, Human
augaaaauugugagaaauuuaaaucagcaauaguaacacuuagauuuuuauaaacuaacaaaaa

SEQ ID NO: 290053 - RNA, 64 nt, Human
ugccaucaagguuagcaaacuuuauacguagccuaacacuuaaaaaaugcacucauuaucuuaa

SEQ ID NO: 290054 - RNA, 64 nt, Human
uuuguacucugugccuuuauuucucaaaccggccaacacuuagggaaaauagaaaagaaccuac

SEQ ID NO: 290055 - RNA, 64 nt, Human
guguguguuuugguuaaucacaaauuuuguagauaacacuuaauacuauacuaagagcuuuuca

SEQ ID NO: 290056 - RNA, 64 nt, Human
ugagaugaguauuuuauucguguucuguuuccgaaacacuuagcaaagaaggucacagugaugu

SEQ ID NO: 290057 - RNA, 64 nt, Human
agucugagguauauucuuuacuuuugauuaagaaaacacuuaaccuucuaauuaauggagagcc

SEQ ID NO: 290058 - RNA, 64 nt, Human
aucauuaggacauaauacauguugagagugucucaacacuuauuagugacaguauugacaucug

SEQ ID NO: 290059 - RNA, 64 nt, Human
ggagaaugcuggaaagaggacaaguuugagaggcaacacuuaaacacuagggcuacuguggcau

SEQ ID NO: 290060 - RNA, 64 nt, Human
agccuuugaaaaucccauaaauugguuuuagcuaaacacuuacuaguagugucuuuaaauuauu

SEQ ID NO: 290061 - RNA, 64 nt, Human
aauaaauaccacuuuuaaaaaugacacauauuuaaacacuuagaaaauaaaguuaacacuuacu

SEQ ID NO: 290062 - RNA, 64 nt, Human
augacacauauuuaaacacuuagaaaauaaaguuaacacuuacugaagugcuaguacuaaacug

SEQ ID NO: 290063 - RNA, 64 nt, Human
uuuuaaagagguggggcucacugcaacuggggagaacacuuagcauauggauaugauugguguu

SEQ ID NO: 290064 - RNA, 64 nt, Human
ugugguugagcuuuauguuuacagucucagcaacaacacuuaugcauccaaacacucacaaaug

SEQ ID NO: 290065 - RNA, 64 nt, Human
cagcacuaccacauccaaacauaagucacugaaaaacacuuaauauuuaugaguugguaaugac

SEQ ID NO: 290066 - RNA, 64 nt, Human; identical to SEQ ID NO: 72729

SEQ ID NO: 290067 - RNA, 64 nt, Human; identical to SEQ ID NO: 72730

SEQ ID NO: 290068 - RNA, 64 nt, Human; identical to SEQ ID NO: 282573

SEQ ID NO: 290069 - RNA, 64 nt, Human
uauacauguaagcuacaauuuugagugcuuuauaaacacuuaagauauauauauaaauuuuaau

SEQ ID NO: 290070 - RNA, 64 nt, Human
cuuuuucgauaaacuaacuacuguagaagaagugaacacuuaccuggaggcucaccuugcagaa

SEQ ID NO: 290071 - RNA, 64 nt, Human
ugaucuguuauagguccuuuagaaacacauaauuaacacuuaagguugggugcugcuaauucuu

SEQ ID NO: 290072 - RNA, 64 nt, Human
uaauugcuuuucugaugcauuuaaaaauaaauggaacacuuaaauguauauuaccgaugcaaac

SEQ ID NO: 290073 - RNA, 64 nt, Human
guacauuccaaguucuagauuaccuacguuuggaaacacuuaauuuacaaauugugaucuuagu

SEQ ID NO: 290074 - RNA, 64 nt, Human
ggauccuggaccugggaggccccugugagggccagcucuggaaaaaccugggaguugaugccgg

SEQ ID NO: 290075 - RNA, 64 nt, Human
ccagcgcgggucucugcucagcaccccagccggggcucuggacccaggguaacagccccaguuc

SEQ ID NO: 290076 - RNA, 64 nt, Human
gcacccccagccagaacacccugagggucucggggcucuggagagaguggggcgggaggaagaa

SEQ ID NO: 290077 - RNA, 64 nt, Human
ccccuugucaguugucagcucuucccaaaacaaagcucuggaguuucugcuggaaguguuuaau

SEQ ID NO: 290078 - RNA, 64 nt, Human
uccccaccccaccccacucuuacccaauuucugggcucuggauccucacagucauggaggcacc

SEQ ID NO: 290079 - RNA, 64 nt, Human
cucugacugucacucggcucucccuacccauuuggcucuggaagcugcuuggcccccccagauc

SEQ ID NO: 290080 - RNA, 64 nt, Human
guccucagggugaagcaggacugaggaguggccagcucuggauagcuggcuguggagaggaagc

SEQ ID NO: 290081 - RNA, 64 nt, Human
uggauucuggaccaccaccugggaccaaccuucagcucuggaaccuucauaaagcaggucagcg

SEQ ID NO: 290082 - RNA, 64 nt, Human
agggcuugcuuggucagcucaggcccuccuagcugcucuggaggcuccuuugauucucuagacc

SEQ ID NO: 290083 - RNA, 64 nt, Human
aaugacagaagaucgucugaaugaagugaaagcugcucuggauaacuugagacaugacccagaa

SEQ ID NO: 290084 - RNA, 64 nt, Human; identical to SEQ ID NO: 289728

SEQ ID NO: 290085 - RNA, 64 nt, Human; identical to SEQ ID NO: 289887

SEQ ID NO: 290086 - RNA, 64 nt, Human; identical to SEQ ID NO: 281773

SEQ ID NO: 290087 - RNA, 64 nt, Human
gauauaagaaacugagcaagcucccugauuucccgcucuggagauuugaagggagaguagaaga

SEQ ID NO: 290088 - RNA, 64 nt, Human
cuuguaccuaugggauuggacaggacugcaguuggcucuggaccugcauuaaaauggguuucac

SEQ ID NO: 290089 - RNA, 51 nt, Human
aagccaaauauggauucuagggcucuggaacugauugcucccaggaucucc

SEQ ID NO: 290090 - RNA, 64 nt, Human
uacauucugccccugaaugauucugucuagaaaagcucuggaguauugaucacuacuggaaaaa

SEQ ID NO: 290091 - RNA, 64 nt, Human
guucaucuccagggccccaccucagaucaaagcagcucuggaugagaugggaccugcagcucuc

SEQ ID NO: 290092 - RNA, 64 nt, Human
auuggaagaagaaccaggcauggaaagauggggagcucuggagguguuguggggauggugaugg

SEQ ID NO: 290093 - RNA, 64 nt, Human
agaaaccccagccuaaugaaacccuagguguugggcucuggaaugggacuuugucccuucuaau

SEQ ID NO: 290094 - RNA, 64 nt, Human
cuccaggcccuugcugagauuguagagauugagugcucuggaccgcaaaagccaggcuaguccu

SEQ ID NO: 290095 - RNA, 64 nt, Human
cugaaggcagagggaugaaaugccaagacucuaugcucuggaaaaccugaggccaaauauugau

SEQ ID NO: 290096 - RNA, 64 nt, Human
cguguggaggagguuguugcuuuauuuuuuuaaggcucuggaguguuguguaugguuucuuuuc

SEQ ID NO: 290097 - RNA, 64 nt, Human
uggggcccagcaaugggggccccugaugccaagagcucuggagguucuugaaagaggggacacg

SEQ ID NO: 290098 - RNA, 64 nt, Human
accugucugcugccagcacaguaggucccggccagcucuggaguucucucaucggaggcccaug

SEQ ID NO: 290099 - RNA, 64 nt, Human
uuuuauauuuauuguuagaaaaugacuuauuucugcucuggaauaaaguugcagaugauucaaa

SEQ ID NO: 290100 - RNA, 64 nt, Human
cuugggaauaggcagggucagauuccagggcauggcucuggacucagcugguuuauaccuauau

SEQ ID NO: 290101 - RNA, 64 nt, Human
cugaagucagagguguuugacucccauuccuugggcucuggagcuuuccccaagaauuacauca

SEQ ID NO: 290102 - RNA, 64 nt, Human; identical to SEQ ID NO: 72705

SEQ ID NO: 290103 - RNA, 64 nt, Human; identical to SEQ ID NO: 72706

SEQ ID NO: 290104 - RNA, 64 nt, Human; identical to SEQ ID NO: 72707

SEQ ID NO: 290105 - RNA, 64 nt, Human
gucuucucucugccuaauugucaaggccuccuuggcucuggagcuaugaaaggccccacuuuca

SEQ ID NO: 290106 - RNA, 64 nt, Human
gagaaaaacugagguacacagagguaccucagaagcucuggaugucuuuggggguuuugcuaag

SEQ ID NO: 290107 - RNA, 64 nt, Human
cuagugugacccugcucuuccagcuccugggccagcucuggaagggcuguauuugggccuaauc

SEQ ID NO: 290108 - RNA, 64 nt, Human
ugcagacagaaauuccagugauuucuacugcacagcucuggacaucucuuuuccuaguauuauu

SEQ ID NO: 290109 - RNA, 64 nt, Human
aaagggugccaacaggucccuugggaaugaguuggcucuggacguuucugcccuguuccccgau

SEQ ID NO: 290110 - RNA, 64 nt, Human
auaacuccuuguggcauucugaagugugugccaggcucuggacuaggugcuagguuuccaggga

SEQ ID NO: 290111 - RNA, 64 nt, Human
ccccucguggcuuggauagaauccagggcucguggcucuggaaugugucugaacuugcugccuc

SEQ ID NO: 290112 - RNA, 64 nt, Human
caacaggguacucuucucuguuugcccagaaucagcucuggauuuuaagcccagacuucagugg

SEQ ID NO: 290113 - RNA, 64 nt, Human
cuacuugggaagcugaagugggaggaucaccugagcucuggagguggaggcugccaugagccau

SEQ ID NO: 290114 - RNA, 64 nt, Human
uauugaguauuuaccauauguugggauacugugggcucuggagagaggagggggcaauagagcu

SEQ ID NO: 290115 - RNA, 64 nt, Human
ugcugcugccuggguaucugggaccccagaucaggcucuggagacgcugcuaccugaggggaag

SEQ ID NO: 290116 - RNA, 64 nt, Human
cuaccucuggggucucuugcugcuugccucugcugcucuggacugggagagcuucuguccugug

SEQ ID NO: 290117 - RNA, 64 nt, Human
ggaauauauauccgggagagcuaggucccuuggggcucuggaugcuggguaacccagagguaau

SEQ ID NO: 290118 - RNA, 64 nt, Human
uccuccuuucagcccccuuuauggggaccaggcagcucuggagccagccacaggggcuguuaga

SEQ ID NO: 290119 - RNA, 64 nt, Human
ccuuagauuagcucuggaccagccuguuggacccgcucuggaccaacccuguuuccugaguuug

SEQ ID NO: 290120 - RNA, 64 nt, Human; identical to SEQ ID NO: 72710

SEQ ID NO: 290121 - RNA, 64 nt, Human; identical to SEQ ID NO: 72711

SEQ ID NO: 290122 - RNA, 64 nt, Human; identical to SEQ ID NO: 72712

SEQ ID NO: 290123 - RNA, 64 nt, Human
ccaugaaucaaagacauggaauuaccuuagauuagcucuggaccagccuguuggacccgcucug

SEQ ID NO: 290124 - RNA, 64 nt, Human
uauucccuauuuguuuucuucuguauguuagggugcucuggaagagaggaaugccugugugagc

SEQ ID NO: 290125 - RNA, 64 nt, Human
uuccccacaagcccccuccaacccccacccccaugcucuggaccucauggcuccuaugagcuug

SEQ ID NO: 290126 - RNA, 64 nt, Human
agacauacuuuuguagaaguggaccaacuucaaagcucuggacaggagacaccugcuccaggcc

SEQ ID NO: 290127 - RNA, 64 nt, Human
gucuuggcccuaaugagaaacccuuuguaagugggcucuggauuuuugguuuuguuuucuuuuu

SEQ ID NO: 290128 - RNA, 64 nt, Human
agaaaaaggauaccuuugauuuuguguguuucaugcucuggauuuuuuuuuuuuuuccuucucu

SEQ ID NO: 290129 - RNA, 64 nt, Human
ugggugagagcccgucacaguccuggguguggcugcucuggaagaauuaggaggcagccauaau

SEQ ID NO: 290130 - RNA, 64 nt, Human
augguguuaaaucucugaaacuugaacguaugaugcucuggacauuuuaggaagcuuaaguaaa

SEQ ID NO: 290131 - RNA, 64 nt, Human
uccagauagcucacaugugcugaccacacuucaggcucuggacuggagcucucuggcauggggg

SEQ ID NO: 290132 - RNA, 64 nt, Human
cagagaugcagggauuggccagcuggguugguuugcucuggaauggcuaacucuugccugcuuu

SEQ ID NO: 290133 - RNA, 64 nt, Human
uuuuaccaggcuguaaaagcaaaaccucguaucagcucuggaacaauaccugcaguuauucuuc

SEQ ID NO: 290134 - RNA, 64 nt, Human
guuuguacuuaagauacauuuguugucuaaaauggcucuggauaacauuuuuggguuaaaaaau

SEQ ID NO: 290135 - RNA, 64 nt, Human
agaagacgagccacguaugaggugccugcccugggcucuggaccccgggcacacgagggacggu

SEQ ID NO: 290136 - RNA, 64 nt, Human
ugugccucuggguacaaaagugccucaacgacaugcucuggaaaucccaaaugccacagucuga

SEQ ID NO: 290137 - RNA, 64 nt, Human
cgucagcacucacggccugcagggacucagcacagcucuggauucuggaucucuccugcuguaa

SEQ ID NO: 290138 - RNA, 64 nt, Human; identical to SEQ ID NO: 72713

SEQ ID NO: 290139 - RNA, 64 nt, Human; identical to SEQ ID NO: 72714

SEQ ID NO: 290140 - RNA, 64 nt, Human; identical to SEQ ID NO: 72716

SEQ ID NO: 290141 - RNA, 64 nt, Human
ccaagucagcaacaauuuaugcaauuuggaggaagcucuggaucacaguugccucaaauccaga

SEQ ID NO: 290142 - RNA, 64 nt, Human
gccggcuggcagcccccaucugcucaauaucacugcucuggauaggaaaugaccgccaucucca

SEQ ID NO: 290143 - RNA, 64 nt, Human
cccagccucucccugccaaagcccaacucccagggcucuggaaauggugaggcgaggggcuuga

SEQ ID NO: 290144 - RNA, 64 nt, Human
cucccaccucugugaccucaggcacuagccuuuggcucuggagacagccccagagcaggguguu

SEQ ID NO: 290145 - RNA, 64 nt, Human
accuccccacgcccuccccuccccugcugcaggggcucuggagagaaacaauaaagagauucac

SEQ ID NO: 290146 - RNA, 64 nt, Human
uucgugauuugaauggguccccuccccuccugcugcucuggagugcaagcccucuucugcccug

SEQ ID NO: 290147 - RNA, 64 nt, Human
uucuccaaacugaagcagccucuccccagguccagcucuggaggggagggggauccgacugcuu

SEQ ID NO: 290148 - RNA, 64 nt, Human
acaguucaucuuccuuucuuccugcuaaccuucugcucuggacuggacucacuuuucugcucca

SEQ ID NO: 290149 - RNA, 64 nt, Human
ugcccagaagagaaaaugacccaugcgcaguugggcucuggauacggcgcugucuauagcaagu

SEQ ID NO: 290150 - RNA, 64 nt, Human
uuagcucacaucauuucaugccccugugccucuagcucuggagauugguggggggagguggggg

SEQ ID NO: 290151 - RNA, 64 nt, Human
uguccucccaggacaagccaaggagccaacgagggcucuggagcugugaguggugccaaaagac

SEQ ID NO: 290152 - RNA, 64 nt, Human
ucuuaggugccauggaucgaugucaggguggucagcucuggacuaagccacccaccuccaauuu

SEQ ID NO: 290153 - RNA, 64 nt, Human
agcuuagaguucuucuuucuuucuuaagcccuuugcucuggaggaaguucuccagcuucagcuc

SEQ ID NO: 290154 - RNA, 64 nt, Human
caacacccugagguuguguguggaaggugaucuggcucuggacaggcacuaucuggguuuuggg

SEQ ID NO: 290155 - RNA, 64 nt, Human
cacugguccccucucuggcucugugggucccugggcucuggacaagcacugggggacgugcccc

SEQ ID NO: 290156 - RNA, 64 nt, Human; identical to SEQ ID NO: 72720

SEQ ID NO: 290157 - RNA, 59 nt, Human; identical to SEQ ID NO: 72721

SEQ ID NO: 290158 - RNA, 64 nt, Human; identical to SEQ ID NO: 72722

SEQ ID NO: 290159 - RNA, 64 nt, Human
ccccguuucuuaagaaacuuuuagggacccugcagcucuggaguggguggagggagggagcuac

SEQ ID NO: 290160 - RNA, 64 nt, Human
gguuuuguuuguagugaacaaaguugaaacauuugcucuggacuaaagaagccuagugguuugu

SEQ ID NO: 290161 - RNA, 64 nt, Human
uguuauggaucagugacuguaguaggaguuugaggcucuggaacucucacauauucaagucuuu

SEQ ID NO: 290162 - RNA, 64 nt, Human
auuuacacaaagcgagcugagaccacagguucuugcucuggaugagcagcaugacaccaucaaa

SEQ ID NO: 290163 - RNA, 64 nt, Human
ccaguuauaggccuugccaggguuucgagaagcugcucuggaauuugcaagucauggcugugcc

SEQ ID NO: 290164 - RNA, 64 nt, Human
ccgagaagggggcaccgacucacagcccgagugggcucuggaccgggccuaccgcgaugcgcgc

SEQ ID NO: 290165 - RNA, 64 nt, Human
uggaaaaaucucuggagucagaggccugggcgcagcucuggacucugcguauaacagugagugu

SEQ ID NO: 290166 - RNA, 64 nt, Human
caacggucuggcagggcagcaggaggcuuucugggcucuggacuccacggaugcgugggcagag

SEQ ID NO: 290167 - RNA, 64 nt, Human
caggaccaaggcccuugggccacuacccugcuaggcucuggagcuguagaggcuuccugaacug

SEQ ID NO: 290168 - RNA, 64 nt, Human
auuguggcuugauguggcaagccgaaaccacuuggcucuggaaaucuaaguucauacugguuua

SEQ ID NO: 290169 - RNA, 64 nt, Human
ugaggcuugaggggaaauggugugagacgaaugggcucuggacauaugccuguugauuugagaa

SEQ ID NO: 290170 - RNA, 64 nt, Human
cagggaacgcagggugaagggaacaaagcuggaggcucuggagcugggucuguuuugacgguca

SEQ ID NO: 290171 - RNA, 64 nt, Human
uccagcagugguauuaauacugccggucacccaggcucuggagccagagagacagaccgggguu

SEQ ID NO: 290172 - RNA, 64 nt, Human
gggaaguguguggagauuuaggugcugcucugcugcucuggauggcugaaggcuccugggccau

SEQ ID NO: 290173 - RNA, 64 nt, Human
uggguucccuuuccuucccaccccuguggccacagcucuggagugggaggguugguugccccuc

SEQ ID NO: 290174 - RNA, 64 nt, Human; identical to SEQ ID NO: 283126

SEQ ID NO: 290175 - RNA, 64 nt, Human; identical to SEQ ID NO: 283127

SEQ ID NO: 290176 - RNA, 64 nt, Human; identical to SEQ ID NO: 289816

SEQ ID NO: 290177 - RNA, 64 nt, Human
ggcucugcuggcucccucaggcccugcuuaccaagcucuggaggagggagugcugcauuacuga

SEQ ID NO: 290178 - RNA, 64 nt, Human
augagagugagcacaucggcacagcaugcauccagcucuggaggccacggugcaggcauagcug

SEQ ID NO: 290179 - RNA, 64 nt, Human
ccugugaccuggucuggucaggcaaugcccugcggcucuggaaagcaacuucaucccagcugcu

SEQ ID NO: 290180 - RNA, 64 nt, Human
gucuuuuucaguagaguauggaauaaucuuaccugcucuggauugccaugagcaggugaaaaug

SEQ ID NO: 290181 - RNA, 64 nt, Human
cugacuucagccugugaggggaggguugagggaggcucuggaaagcccagccacaccugagucc

SEQ ID NO: 290182 - RNA, 64 nt, Human
agcguagggagaggguggauuugugcagggugcagcucuggagaagaagcuggaucacucuugg

SEQ ID NO: 290183 - RNA, 52 nt, Human
uuuguuuagcccaaaaguaaucgcucuggaguagaaaccaaaugugaauagc

SEQ ID NO: 290184 - RNA, 64 nt, Human
ucaugaguaaaauggaauaauaccuaacaggcaggcucuggaaguuggaaaucacauacacaca

SEQ ID NO: 290185 - RNA, 64 nt, Human
gccuguccaguaaagagauugauuuguuuguauggcucuggaauaacucauucguuuaugaaca

SEQ ID NO: 290186 - RNA, 64 nt, Human
aucucugaaaguaaucaaucaaguggcuccaguagcucuggauuuucugccagggcugggccau

SEQ ID NO: 290187 - RNA, 64 nt, Human
ucucgauacugacggcuccgugcugacauucugagcucuggagucacaccagcgcaggggcgug

SEQ ID NO: 290188 - RNA, 64 nt, Human
uccuggguaccggcaacuacagcagccgggugaagcucuggagcucugcauccuguggccuggc

SEQ ID NO: 290189 - RNA, 64 nt, Human
ggucucuugccuggcucccagggcuaggguuagggcucuggaggugcuuucacucaaccaaggg

SEQ ID NO: 290190 - RNA, 64 nt, Human
ugugacacaugagacucacaguuggaguucuccagcucuggaggugcugaaggagcugcauuaa

SEQ ID NO: 290191 - RNA, 64 nt, Human
ucccaccugauggcuguucucccaccgggucugggcucuggaaggagccagaugcccccagaaa

SEQ ID NO: 290192 - RNA, 64 nt, Human; identical to SEQ ID NO: 72726

SEQ ID NO: 290193 - RNA, 64 nt, Human; identical to SEQ ID NO: 72727

SEQ ID NO: 290194 - RNA, 64 nt, Human; identical to SEQ ID NO: 72728

SEQ ID NO: 290195 - RNA, 64 nt, Human
gcaaggcccacugcugcuccugggugagaagggagcucuggagcaggaccagcugggggccggc

SEQ ID NO: 290196 - RNA, 64 nt, Human
cauucccgaaguaauaagugaggacgaaugcacugcucuggaacauaacccagugcuaacuggg

SEQ ID NO: 290197 - RNA, 64 nt, Human
aguuguguccuagccacaucagacagcuaucuaagcucuggacuaccccuuugugcagcugaau

SEQ ID NO: 290198 - RNA, 64 nt, Human
ccacuaagaacaccugcauucuucccuuaucccugcucuggauuuuaguuuugugcuuaguuaa

SEQ ID NO: 290199 - RNA, 64 nt, Human
ggcaguguuaccccgugucccgggugggcgcagggcucuggauggugagcccucugcccugugg

SEQ ID NO: 290200 - RNA, 64 nt, Human
uuuugaaaagucuguuucaaaaaguguggccucagcucuggaggccacccccaggaaggaguuu

SEQ ID NO: 290201 - RNA, 64 nt, Human
gccucuagauuuucuucugugcuucucucuaucugcucuggaauggaugagugaauguguucug

SEQ ID NO: 290202 - RNA, 64 nt, Human
ggaguugcgucuccucugcaggccacgauggucugcucuggagcauugggugaacacacaggcu

SEQ ID NO: 290203 - RNA, 64 nt, Human
agucagcuucagaaauguuuuaaaagggacuuuagcucuggaacucaaaaucaauuuauuaaga

SEQ ID NO: 290204 - RNA, 64 nt, Human
gaguuaaccaggagacuacuccugugacuguggagcucuggaaggcuuggugggagugaauuug

SEQ ID NO: 290205 - RNA, 64 nt, Human
gcuccuaaaggcagcaaccauucaucuuuccuuugcucuggauacaccgaaugaccagguaaca

SEQ ID NO: 290206 - RNA, 64 nt, Human
ccaaucacuuagcuccucauaacaagucuaacuggcucuggaaagcugaaagggcugcacugga

SEQ ID NO: 290207 - RNA, 64 nt, Human
acauaaagcaaauagacacagucauacugucacugcucuggacuguguggagcucgcuaaaguc

SEQ ID NO: 290208 - RNA, 64 nt, Human
gaggagggcaccaaguuuuccuuuuuucuaaauagcucuggaaccaggcuuguaauccauagca

SEQ ID NO: 290209 - RNA, 64 nt, Human
agaaucacagcccucaugaucauucucagugagggcucuggauugagagggaggcccugggagg

SEQ ID NO: 290210 - RNA, 64 nt, Human; identical to SEQ ID NO: 72717

SEQ ID NO: 290211 - RNA, 64 nt, Human; identical to SEQ ID NO: 72718

SEQ ID NO: 290212 - RNA, 64 nt, Human; identical to SEQ ID NO: 72732

SEQ ID NO: 290213 - RNA, 64 nt, Human
cguaauaucugggccuuggaaggaaggacacagggcucuggaaggaggaggcugcaugccugaa

SEQ ID NO: 290214 - RNA, 64 nt, Human
agggugugugggauagcgauugcauuuuccuuuugcucuggaguuucacuccccuucugggucc

SEQ ID NO: 290215 - RNA, 64 nt, Human
gaggacuccaguugccucagguugguucugcugugcucuggaaaguaacugcagccaccaggua

SEQ ID NO: 290216 - RNA, 64 nt, Human
aagauguuuuuagaggggcaaaaauauuuugcaagcucuggaauuguugaauguauucuuuuau

SEQ ID NO: 290217 - RNA, 64 nt, Human
agaggaagaaaagagcugggacaauaaaacacuggcucuggaaucuggaauguuaaguccaggc

SEQ ID NO: 290218 - RNA, 64 nt, Human
gaaacuccuuccaaggcugagggggucaguaggugcucuggagggacucggcaccacuugauau

SEQ ID NO: 290219 - RNA, 64 nt, Human
acagaagacauugcuaaaagaguuaaaagucauugcucuggagaauuaggagggauggggcagg

SEQ ID NO: 290220 - RNA, 64 nt, Human
ugaaucaaaucucuuccacaugggugcauuuguagcucuggaccugucucuaccuaaggacaag

SEQ ID NO: 290221 - RNA, 64 nt, Human
guaaucuccugugaucugugcuagcugugaggcagcucuggaacgugaagagcuguuugguuug

SEQ ID NO: 290222 - RNA, 64 nt, Human
cgggucuuauccuuugcucuguuuuucucuucaggcucuggaaaaucagaucugugacuuaauc

SEQ ID NO: 290223 - RNA, 64 nt, Human
gcauuccacuacauugugagcuuucccuuggaaggcucuggacucuauccaagcuuaugauaau

SEQ ID NO: 290224 - RNA, 64 nt, Human
ggaaauaagaaggcccuguugacgggcugucuuggcucuggaauucaugcauccuggccuugcc

SEQ ID NO: 290225 - RNA, 64 nt, Human
acgcagccgccugcccgggagaacccugccugaagcucuggaaacuuguggguggggcccaggg

SEQ ID NO: 290226 - RNA, 64 nt, Human
uggccaggcgcgguggcucaggccuguaaucccagcucuggaagcugaaggauagcuugagccc

SEQ ID NO: 290227 - RNA, 64 nt, Human
cugugauugccuuucccagcuacgcaggaugcaggcucuggagagagaacaggaugcccugugg

SEQ ID NO: 290228 - RNA, 64 nt, Human; identical to SEQ ID NO: 72702

SEQ ID NO: 290229 - RNA, 64 nt, Human; identical to SEQ ID NO: 72703

SEQ ID NO: 290230 - RNA, 62 nt, Human; identical to SEQ ID NO: 72735

SEQ ID NO: 290231 - RNA, 64 nt, Human
ugccagcaccaguccucuggggcacaugguuugagcucuggacuucccacauggccagcuuucu

SEQ ID NO: 290232 - RNA, 64 nt, Human
cacaugugaccacauacguguuaggaggcugcaugcucuggaagccuggacucuaagcuggagc

SEQ ID NO: 290233 - RNA, 64 nt, Human
ccaccgccgcaggguucuuuuaccugugccaccagcucuggagacauccacacccauucccagg

SEQ ID NO: 290234 - RNA, 64 nt, Human
ccucgccugaagccuuccucuggcuucacagaaugcucuggaacucuggggucuggucagggag

SEQ ID NO: 290235 - RNA, 64 nt, Human
gcauacucucucauuuauucuguuuaucucccuggcucuggaggugcagccacuggucuucacu

SEQ ID NO: 290236 - RNA, 64 nt, Human
uguccauuguugcucuaguucugacccagagguagcucuggagugauuuuagaccuacucacuc

SEQ ID NO: 290237 - RNA, 64 nt, Human
cucccccacuuucccuuccccaccccacuuguaugcucuggaaucuguggagacgccagcccug

SEQ ID NO: 290238 - RNA, 64 nt, Human
ccagagcagacaucuuccacguggagaagcugcagcucuggaaagaggguuuaagaugcuagga

SEQ ID NO: 290239 - RNA, 64 nt, Human
uggcagacuauauuaacagcugcugaacaaaucagcucuggaggugauuccacauccccuggca

SEQ ID NO: 290240 - RNA, 64 nt, Human
caauagagggaagacugaggcugaagaauugacggcucuggacccaggacagacagacagacag

SEQ ID NO: 290241 - RNA, 64 nt, Human
gaagaauacuuuaaacagccugacuguguccuuggcucuggauccagaaggccuuaugcuccaa

SEQ ID NO: 290242 - RNA, 64 nt, Human
ugcucugagguggagccuucucagggucaguccagcucuggagccccucuccagcucggucacc

SEQ ID NO: 290243 - RNA, 64 nt, Human
gggcuccacggguagugcgaccucgguucugugggcucuggaaggccaccaggguagggucucc

SEQ ID NO: 290244 - RNA, 64 nt, Human
ccgcgugacucccgccuccucccugugcucucuggcucuggacugugacugcgccuggauucug

SEQ ID NO: 290245 - RNA, 64 nt, Human
acuugaauuugggcagcuaccacgggucugccaugcucuggaggagcaagggggccacaucccc

SEQ ID NO: 290246 - RNA, 64 nt, Human; identical to SEQ ID NO: 72696

SEQ ID NO: 290247 - RNA, 64 nt, Human; identical to SEQ ID NO: 72697

SEQ ID NO: 290248 - RNA, 64 nt, Human; identical to SEQ ID NO: 72708

SEQ ID NO: 290249 - RNA, 64 nt, Human
cgaccuucaaguggcuuuuggggccccagguugagcucuggauguuucaagccaaggcucggcu

SEQ ID NO: 290250 - RNA, 64 nt, Human
aacccuucccaccaggguagcuuugggcacugcagcucuggacuuuucuggccccuccugagau

SEQ ID NO: 290251 - RNA, 64 nt, Human
agaagaggcuggugcuguggccagggugagagcugcucuggaaaaugugacccagauccucaca

SEQ ID NO: 290252 - RNA, 64 nt, Human
gugcacuucacuggagagaaagaacuggaauuucgcucuggaggggauguggaccacaguacuc

SEQ ID NO: 290253 - RNA, 64 nt, Human
ggccgaggggauguccugcuccaauacccgcacugcucuggaguuugcccucuuucccaaggag

SEQ ID NO: 290254 - RNA, 64 nt, Human
gaagaggcuucauggccagggcuauggauucuuugcucuggaugaagcugagacacaguuuuca

SEQ ID NO: 290255 - RNA, 64 nt, Human
ccccaggagagggagugucuccuuccaggugcuagcucuggacagcagcugauuuuaggcagga

SEQ ID NO: 290256 - RNA, 64 nt, Human
uauagggacacaccucagaaacccuuccuugacagcucuggacagggaaaauuuggcucccuca

SEQ ID NO: 290257 - RNA, 64 nt, Human
cuaaaucacugaguuuacagaguaauaauguguugcucuggacauugacagcuuucuagagcca

SEQ ID NO: 290258 - RNA, 64 nt, Human
cccuacaaacuccuacuacgucgucuaaauugcugcucuggaauaaggugauuucugcccccag

SEQ ID NO: 290259 - RNA, 64 nt, Human
ccuauuguuacuuccaauuuauaaucaagaaggggcucuggauccccuuuuaaauuacacacac

SEQ ID NO: 290260 - RNA, 64 nt, Human
agugaccuacccaaaccuuuuguucuguaaaacugcucuggaaauaccgggaagcccaguuuuc

SEQ ID NO: 290261 - RNA, 64 nt, Human
uguguccuuuccagacuccagggcuccccgggcugcucuggaucccaggacuccggcuuucgcc

SEQ ID NO: 290262 - RNA, 64 nt, Human
ugugcuugcagcccgggcaccuucccacuuucuagcucuggagagguuggauuuugcuuuugua

SEQ ID NO: 290263 - RNA, 64 nt, Human
ucgcccuggacugugugcucaggagcccugggaggcucuggagcccacuguacuugcucuugau

SEQ ID NO: 290264 - RNA, 64 nt, Human; identical to SEQ ID NO: 72736

SEQ ID NO: 290265 - RNA, 64 nt, Human; identical to SEQ ID NO: 72737

SEQ ID NO: 290266 - RNA, 64 nt, Human
ucacggcuugguucagcagagcaugggggcgggggcucuggagugguggggaagugaugcugcc

SEQ ID NO: 290267 - RNA, 64 nt, Human
uggaccaugccagauucugccucucuggaaagaggcucuggacagcagaagccuccaagcacag

SEQ ID NO: 290268 - RNA, 64 nt, Human
ccuccaggcccccaacuccgcccagccucuccccgcucuggauccugcacucuaacacucgacu

SEQ ID NO: 290269 - RNA, 64 nt, Human
cugcagaugcugacaggcccugggaggcugcugugcucuggagaagcuggagcagcucauuucu

SEQ ID NO: 290270 - RNA, 64 nt, Human
aguaaauuccugugcucugaaaugccacuugguagcucuggacaaugaaggacaauugacucaa

SEQ ID NO: 290271 - RNA, 64 nt, Human
ccagccagaaugcccucucuccagaggacacacagcucuggauuucuacccccuugcuauccuc

SEQ ID NO: 290272 - RNA, 64 nt, Human
agaggcaccacagggaggugggugaagcacuucggcucuggaguuacagaucuggguucaaggc

SEQ ID NO: 290273 - RNA, 64 nt, Human
ucagaaauuaaaaacauaacuauugccagauuuagcucuggaauguuuagaaucaggcuagaau

SEQ ID NO: 290274 - RNA, 64 nt, Human
ccuucagcagccuauuggcucucccugccucugagcucuggacucuguuugaauauuccaagua

SEQ ID NO: 290275 - RNA, 64 nt, Human
aagccacccuuauccugguuccugccuccugggggcucuggagacggaugccuauggcgccuca

SEQ ID NO: 290276 - RNA, 64 nt, Human
uacugauacuaacaggccugcuagcucagccgacgcucuggacacucuagaaaucacuccucag

SEQ ID NO: 290277 - RNA, 64 nt, Human
cgcccauggucucacguggcaagaagugccuuuagcucuggaucccaaccguuuggcacagcuu

SEQ ID NO: 290278 - RNA, 64 nt, Human
aagcugggaucccggccagccaggugacccccacgcucuggaugucucugcucuguuccuuccc

SEQ ID NO: 290279 - RNA, 64 nt, Human
ugagcagaccgccccacccuccccggcugggagggcucuggagggcccuggagggggggucccc

SEQ ID NO: 290280 - RNA, 64 nt, Human
ggcugggaggagggggccacagcuuagguuuggagcucuggauguacauacauaaguaggagca

SEQ ID NO: 290281 - RNA, 64 nt, Human; identical to SEQ ID NO: 72692

SEQ ID NO: 290282 - RNA, 64 nt, Human; identical to SEQ ID NO: 72693

SEQ ID NO: 290283 - RNA, 64 nt, Human; identical to SEQ ID NO: 72739

SEQ ID NO: 290284 - RNA, 55 nt, Human
gugagagguggacugugugaucccagcucuggagcaagcuguagacggacagcag

SEQ ID NO: 290285 - RNA, 64 nt, Human
agcagaugucacaggauuaaaugugcaguuuggggcucuggaauuugggucagaaccuucucuc

SEQ ID NO: 290286 - RNA, 64 nt, Human
uucauaaaccauguuacauuuuuguuaagccuuggcucuggauguggccuagauauuugauauu

SEQ ID NO: 290287 - RNA, 64 nt, Human
ugagaggcagcaugguagagugggcagaccuugugcucuggacucagguucaaaguucagauga

SEQ ID NO: 290288 - RNA, 64 nt, Human
acccuggagacagggagccccuucuuucuccacagcucuggaccuuucccccucucccugcggc

SEQ ID NO: 290289 - RNA, 64 nt, Human
aggccaaccacagcgucuugggugggcaggacaggcucuggagggaaaagccagagagaccaag

SEQ ID NO: 290290 - RNA, 64 nt, Human
cuagauagaggccuccguccccauggccgccaccgcucuggaccacaggcggggaggaagcaug

SEQ ID NO: 290291 - RNA, 64 nt, Human
uccaccccucccccagcccugcuucugaccuguggcucuggagccccugccccugccugcaucc

SEQ ID NO: 290292 - RNA, 64 nt, Human
uugcagagacaccugagaaucgauggcucagucugcucuggagccacagucuggcgucugaccc

SEQ ID NO: 290293 - RNA, 53 nt, Human
cuccaaggacguguccuuaggcggcucuggaaggcccagcgccagcccccguc

SEQ ID NO: 290294 - RNA, 64 nt, Human
ugagagggugcugcccgcucaaugcccagcagcagcucuggaaggcagugcucagccccaucac

SEQ ID NO: 290295 - RNA, 64 nt, Human
ccugggccuccccuaagaggcuuuccccgaggcagcucuggaaucugugcccaccuggggccug

SEQ ID NO: 290296 - RNA, 64 nt, Human
ccaggcuugccugcuccccaccugggaugccccugcucuggaccucucauuucucuucauuggu

SEQ ID NO: 290297 - RNA, 64 nt, Human
gccaaugcuaguauggaggcugugaaguccccaagcucuggaagcccacacuauuuguugguga

SEQ ID NO: 290298 - RNA, 64 nt, Human
cccaaucagcagucuucaaucgaucaauaauucugcucuggaagagaaggaacagggagcagag

SEQ ID NO: 290299 - RNA, 64 nt, Human; identical to SEQ ID NO: 72673

SEQ ID NO: 290300 - RNA, 64 nt, Human; identical to SEQ ID NO: 72674

SEQ ID NO: 290301 - RNA, 64 nt, Human; identical to SEQ ID NO: 72683

SEQ ID NO: 290302 - RNA, 64 nt, Human
uuccuagaggcagagguugaagauggaagagggagcucuggagugcuaacuugaacaccaaggg

SEQ ID NO: 290303 - RNA, 64 nt, Human
accuguuagcugugguugugcacugucuuuuguagcucuggacuggagggguagauggggaguc

SEQ ID NO: 290304 - RNA, 64 nt, Human
guggcaggcugcuguccacgggggagaagucucugcucuggacuggacagaagagagacuuuua

SEQ ID NO: 290305 - RNA, 64 nt, Human
guuagaagcgucuguaucucuggagcagccaggcgcucuggagccagcuggagagagagagauc

SEQ ID NO: 290306 - RNA, 64 nt, Human
uuguuaacucauuauuuaauugaacauuuccaaagcucuggaaaggcaugcauuuguaggugca

SEQ ID NO: 290307 - RNA, 64 nt, Human
gcuggucuggauagauagcuuacagcaguagugggcucuggaaugcccaagggaagaggcaagg

SEQ ID NO: 290308 - RNA, 64 nt, Human
auuccagccggagguccaaccuucgcagccaguggcucuggagggccugagugacagcggcagu

SEQ ID NO: 290309 - RNA, 64 nt, Human
ucccagccuuacucaggaguggugaacauuuucugcucuggacauagaauagguagguucauuc

SEQ ID NO: 290310 - RNA, 64 nt, Human
agccaaaacuuguuuccacauuaagagucagccagcucuggaauggucuggaaaugucuuccug

SEQ ID NO: 290311 - RNA, 64 nt, Human
uguuuucugagugaugaagucaggaagcccuguggcucuggaggccacuugugguucauucuuu

SEQ ID NO: 290312 - RNA, 64 nt, Human
agcugcuucuuaaucaauccaaauuucauuuacagcucuggaacacuuuggggcugauuugucu

SEQ ID NO: 290313 - RNA, 64 nt, Human
gagaaguuugcuaaaauauuuguaugugggggaagcucuggagugugccuaggagggggcuggc

SEQ ID NO: 290314 - RNA, 64 nt, Human
ugcccuuuguacagccuccacccccauuaaaacugcucuggacuugcuggcugggccuccuccu

SEQ ID NO: 290315 - RNA, 64 nt, Human
aauaaauaccuccccgguuuuguuuuuguaaaaugcucuggaggaaggaagaaacguggcagau

SEQ ID NO: 290316 - RNA, 64 nt, Human
guggguucuguucaguugcuaaugaggcuccuccgcucuggacacaacccuuuuauagauuaau

SEQ ID NO: 290317 - RNA, 64 nt, Human; identical to SEQ ID NO: 72648

SEQ ID NO: 290318 - RNA, 64 nt, Human; identical to SEQ ID NO: 72649

SEQ ID NO: 290319 - RNA, 64 nt, Human; identical to SEQ ID NO: 72650

SEQ ID NO: 290320 - RNA, 64 nt, Human
cgcuggccccaugcagccucccugggcugggcuggcucuggauggagccaggcaucggcaaggg

SEQ ID NO: 290321 - RNA, 64 nt, Human
gggcacugugggacugggacacuuuuauguuaaugcucuggacuugccuccagagacugcucca

SEQ ID NO: 290322 - RNA, 64 nt, Human
gcagaucccccuuuccaaccuguaacucugaugugcucuggaucagcuuuuaacuuuuaaucau

SEQ ID NO: 290323 - RNA, 64 nt, Human
aaauugggcaagggacaaggugcuagaauccuaagcucuggaaauauuucaugacacuggugua

SEQ ID NO: 290324 - RNA, 64 nt, Human
gccacugccccugauggaacucauggagaaugaagcucuggaaauccucaccaaagcccuccgg

SEQ ID NO: 290325 - RNA, 64 nt, Human
cugacugaggacugcagaccgccaccacucaggggcucuggaggggucagcuggagcccaccaa

SEQ ID NO: 290326 - RNA, 51 nt, Human
gcugccaguguaagaucugaggcucuggacucaggucucaugugaguccug

SEQ ID NO: 290327 - RNA, 64 nt, Human
aggucaacacgugauuguuguacguacacauugugcucuggagugccuauuuauugaaaucauu

SEQ ID NO: 290328 - RNA, 64 nt, Human
caagcaugaggaaauagaagauucaggggccugagcucuggaagcugcaagcaaaagggauggg

SEQ ID NO: 290329 - RNA, 64 nt, Human
ugggaccaguguggagccugagggugccugcccugcucuggagggagggccaggagcugccaca

SEQ ID NO: 290330 - RNA, 51 nt, Human
gcugccaguguaagaucugaggcucuggacccagaccuucagguuucuccu

SEQ ID NO: 290331 - RNA, 51 nt, Human
gcugccaguguaagaucugaggcucuggacucaggccucaugugaguccug

SEQ ID NO: 290332 - RNA, 64 nt, Human
ucguccagcacccucugcagccuuggugccuguagcucuggacuucccugggccuuucccugug

SEQ ID NO: 290333 - RNA, 64 nt, Human
aaaacgaaggccucugaaggacccuucagagguggcucuggaaugacaugugucaagcugcuug

SEQ ID NO: 290334 - RNA, 62 nt, Human
ccauagguaaacccaguuaaguuccguauggagcucuggacuccuaaauuccccugaagaag

SEQ ID NO: 290335 - RNA, 64 nt, Human; identical to SEQ ID NO: 72651

SEQ ID NO: 290336 - RNA, 64 nt, Human; identical to SEQ ID NO: 72652

SEQ ID NO: 290337 - RNA, 64 nt, Human; identical to SEQ ID NO: 72743

SEQ ID NO: 290338 - RNA, 59 nt, Human
uccuucgacaggggacguagccuuuucuugcucuggaagcccagggagguugagcagug

SEQ ID NO: 290339 - RNA, 64 nt, Human
cggggagggguuaaagacaggaucucacucuggcgcucuggagugcaguggugugauuagggau

SEQ ID NO: 290340 - RNA, 64 nt, Human
uaaguuauaauaaacagaaauguauuggcucagagcucuggaggcugggaaguccauaguggag

SEQ ID NO: 290341 - RNA, 64 nt, Human
cuuggucccauggcugaagcuggagcagcggauugcucuggagcagccaaggccgccagcgugu

SEQ ID NO: 290342 - RNA, 64 nt, Human
ucacucuggucgacucuuccucucagagaauguugcucuggaggcugcucugcaugaaaacccu

SEQ ID NO: 290343 - RNA, 64 nt, Human
ugacuuugauggggggauuucugguuaugucaaggcucuggagacaggaagggccuuuggccgc

SEQ ID NO: 290344 - RNA, 64 nt, Human
cagcacaggccuagcugguucuggguuggaguuggcucuggauagggucagucaccaggccugg

SEQ ID NO: 290345 - RNA, 51 nt, Human; identical to SEQ ID NO: 290330

SEQ ID NO: 290346 - RNA, 64 nt, Human
accgacaagauuaaaaauaacuuggcagccugaggcucuggagugcccacaggcugguguaagg

SEQ ID NO: 290347 - RNA, 64 nt, Human
ggguccagcccagcacuggaccauuccgucuccugcucuggacuugcccucucccuuccuggca

SEQ ID NO: 290348 - RNA, 64 nt, Human
gcuugguggucaggaacaggggcagcucacgguggcucuggaguacguuuccucugucagaugc

SEQ ID NO: 290349 - RNA, 64 nt, Human
uggagaauuuggagccuggcagagagacuggacagcucuggaggaacaggccugcugaggggag

SEQ ID NO: 290350 - RNA, 64 nt, Human
caucucccgucucaacagccccaggccuaugggggcucuggaaggaugggccagcuugcagggg

SEQ ID NO: 290351 - RNA, 64 nt, Human
cugucuuuacuggggucaaaucuuaaagcacacagcucuggacucaagacaggagguuugcguc

SEQ ID NO: 290352 - RNA, 64 nt, Human
gggaugggacaguuuuccauauccuugcuguggagcucuggaacacucucuaaauuucccucua

SEQ ID NO: 290353 - RNA, 64 nt, Human; identical to SEQ ID NO: 72654

SEQ ID NO: 290354 - RNA, 64 nt, Human; identical to SEQ ID NO: 72655

SEQ ID NO: 290355 - RNA, 64 nt, Human; identical to SEQ ID NO: 72656

SEQ ID NO: 290356 - RNA, 64 nt, Human
ucccaauaggucuuuauuccucaauccuccaaaugcucuggagaggcccccacccuugagaaga

SEQ ID NO: 290357 - RNA, 64 nt, Human
aaaauuagggagucaaacguggaccugaaagucagcucuggacccccucccucaccgcacaacu

SEQ ID NO: 290358 - RNA, 64 nt, Human
uuagguacaaaauccuacuuuucagagccuuccagcucuggaaccucaaacauccucaugcucu

SEQ ID NO: 290359 - RNA, 64 nt, Human
gagacuuuuggcccaggaggaauauuuacuuuuagcucuggacaucauuacaaaaaggaauauu

SEQ ID NO: 290360 - RNA, 64 nt, Human
augcagcuauguaaaagagaaccaaaacuugagugcucuggauaacuauauggaaugcuuucua

SEQ ID NO: 290361 - RNA, 64 nt, Human
accccagcccuagcccuuuagccuuucacccugugcucuggaaaggcuaccaaauacuggccaa

SEQ ID NO: 290362 - RNA, 64 nt, Human
caacaccaaaaugaacuugguucucuucgacgaugcucuggagcauuuaacccgggugcaccgu

SEQ ID NO: 290363 - RNA, 64 nt, Human
uugaaaagcuuguccaucacucuaguagggagaggcucuggacagaugaauaccuuuucuucgg

SEQ ID NO: 290364 - RNA, 64 nt, Human
gcucucggggucuuuccucagccucgaaaagugggcucuggaaucccuuuguaaauaggugugu

SEQ ID NO: 290365 - RNA, 58 nt, Human
caaaccuaagagcacagugaauuugaaggcucuggaagaaaagaaaaaagucuuugag

SEQ ID NO: 290366 - RNA, 64 nt, Human
cuuuaagagaaaugagcugcacuccaugagugcagcucuggagguacgaaaagaggggaagaga

SEQ ID NO: 290367 - RNA, 64 nt, Human
ugacuucauugaaaaucugcacaauucaguuucagcucuggauuacuucaguugaccuuuguga

SEQ ID NO: 290368 - RNA, 51 nt, Human
aagaaccuaugaaucucuaaggcucuggaaccaucugcccgcccaccaugc

SEQ ID NO: 290369 - RNA, 64 nt, Human
cucagagggaaaaaucuugagaccagaugguggagcucuggagucagaggaaaugggugucuuc

SEQ ID NO: 290370 - RNA, 64 nt, Human
gacugccccgggccccgccucauuccaugacccggcucuggaucccacacuguacuucccacag

SEQ ID NO: 290371 - RNA, 64 nt, Human; identical to SEQ ID NO: 72660

SEQ ID NO: 290372 - RNA, 64 nt, Human; identical to SEQ ID NO: 72661

SEQ ID NO: 290373 - RNA, 64 nt, Human; identical to SEQ ID NO: 72662

SEQ ID NO: 290374 - RNA, 64 nt, Human
aagaaccuggaacuuggggaguuaagaccuggcagcucuggacagccccacccuggugggccaa

SEQ ID NO: 290375 - RNA, 64 nt, Human
aaagagacagcucuucuacuacccccacagaccugcucuggacacuugcucaugcccugccaag

SEQ ID NO: 290376 - RNA, 64 nt, Human
aauagcaggaguggcagucaaaacugaaauuauagcucuggaguaggaagguuauauuuauaau

SEQ ID NO: 290377 - RNA, 64 nt, Human
cuccuucugccaacuggaagcagauggugaccaggcucuggagaaggcaaggccugaagauggg

SEQ ID NO: 290378 - RNA, 64 nt, Human
agccuugccguggggaccuuggaaaccuggcuuugcucuggacaaaggguuccagagagaagcu

SEQ ID NO: 290379 - RNA, 64 nt, Human
aacugagcccagaguaacugcacgccuuugugcagcucuggagcuccaccaacucucggccugc

SEQ ID NO: 290380 - RNA, 64 nt, Human
auuccggugccuaccagaagucgcaagcugcuuggcucuggagggcgccuaggagucggugucg

SEQ ID NO: 290381 - RNA, 64 nt, Human
ccgcgcccucccuccgccucccaucccgcuuagcgcucuggacagauggacgcaggcccugucc

SEQ ID NO: 290382 - RNA, 64 nt, Human
cugcugaauacuaaacacucacauggcaagaguugcucuggagagguagggccagaggaaugcu

SEQ ID NO: 290383 - RNA, 64 nt, Human
aguucuuugugcuuuucugcugcauaugucaguggcucuggagauuguuaccaucugcuacaua

SEQ ID NO: 290384 - RNA, 64 nt, Human
uuugacauuggcuggcuggcugagcccauuuucggcucuggagauuauccaugggugaugaggg

SEQ ID NO: 290385 - RNA, 64 nt, Human
acuuagccauuuuucaaagcaauugaaaugcauugcucuggaucuguuccuuggcaguggacuc

SEQ ID NO: 290386 - RNA, 64 nt, Human
ugugaccugcuugcuagagaacugugaacauguggcucuggauagagugacugcugcuccauau

SEQ ID NO: 290387 - RNA, 64 nt, Human
ggucuuugcugcugcucucaggcgcuucuccaaugcucuggagugugcauuucagcuugaaccu

SEQ ID NO: 290388 - RNA, 64 nt, Human
cgugggugguaggagguuuuuuuuuuuacccagggcucuggaaggacaccaaacuguucugcuu

SEQ ID NO: 290389 - RNA, 64 nt, Human; identical to SEQ ID NO: 72657

SEQ ID NO: 290390 - RNA, 64 nt, Human; identical to SEQ ID NO: 72658

SEQ ID NO: 290391 - RNA, 64 nt, Human; identical to SEQ ID NO: 72666

SEQ ID NO: 290392 - RNA, 64 nt, Human
cucaggagagcaggggugggugugacagaggcuggcucuggauugggggacaacagaaccagag

SEQ ID NO: 290393 - RNA, 64 nt, Human
acaggaaguuaagcuguuccucucccuggcugcugcucuggauggccagagaacaagaugcucc

SEQ ID NO: 290394 - RNA, 64 nt, Human
ugugcccugcuguaucauaaagcacacacuuagcgcucuggagccggacgguggcuccaccacu

SEQ ID NO: 290395 - RNA, 64 nt, Human
uuugacuggguuccuauuuuaagcacaaaugagagcucuggagccagaaugccaggguucuaac

SEQ ID NO: 290396 - RNA, 64 nt, Human
caugcucaacagggaguggaggagaggagacaaggcucuggacagccgguccagccacauccag

SEQ ID NO: 290397 - RNA, 64 nt, Human
gggcacagauuggagagggcucugugcugacauggcucuggacucuaaagaccaaacuucacuc

SEQ ID NO: 290398 - RNA, 64 nt, Human
ccaaggccugugcacagguagccccucaugcugggcucuggaccaugagcugaguaggaaggau

SEQ ID NO: 290399 - RNA, 64 nt, Human
aaauucccaaggcccuaaggucccucaccugguugcucuggaagcucuugcugauaggaaugau

SEQ ID NO: 290400 - RNA, 64 nt, Human
cuucccccucuucuucugaagaucagaacauucagcucuggagaacagugguugccugggggcu

SEQ ID NO: 290401 - RNA, 64 nt, Human
accccagcacugagaagcuacauuuccuuccugugcucuggacugcugcccuuguccccgagga

SEQ ID NO: 290402 - RNA, 64 nt, Human
gggcugagugugcuggcccugugacucaggaccagcucuggagucuccagcccacccuccgcac

SEQ ID NO: 290403 - RNA, 64 nt, Human
ugccguagcaugauugcgcucauggauacagauggcucuggaaagcucaaccugcaggaguucc

SEQ ID NO: 290404 - RNA, 64 nt, Human
guucugcucauucuaaugauggcccauucuacuugcucuggaccugcccccgcauccccugccu

SEQ ID NO: 290405 - RNA, 64 nt, Human
ugcuacauuuuuaggguuugucuacauuuuuugggcucuggauaaggaauuaaaggagugcagc

SEQ ID NO: 290406 - RNA, 64 nt, Human
cucagaggcauacacuuuuuacagauggacaaaagcucuggaacccuguggcuucaaauccuuu

SEQ ID NO: 290407 - RNA, 64 nt, Human; identical to SEQ ID NO: 72670

SEQ ID NO: 290408 - RNA, 64 nt, Human; identical to SEQ ID NO: 72671

SEQ ID NO: 290409 - RNA, 64 nt, Human; identical to SEQ ID NO: 72672

SEQ ID NO: 290410 - RNA, 61 nt, Human
aacucagugucaucauguaguggcaugcucagcucuggauuugcagucaguuugggauucu

SEQ ID NO: 290411 - RNA, 64 nt, Human
caccuccucgggcccagcucaagcccccuuccuugcucuggaccccuuagguauacccuggaag

SEQ ID NO: 290412 - RNA, 64 nt, Human
ggaagccacccaggaaggaagcacagagcugggggcucuggaaacgcccugugucucuggcuac

SEQ ID NO: 290413 - RNA, 64 nt, Human
gguggacuuccgagauguggcccuugcacuagcagcucuggaugggggcaggagccuggaagag

SEQ ID NO: 290414 - RNA, 64 nt, Human
cuuccuccagcuuccagcuaggccagaagggcaugcucuggaacccagcaggaucacagcugcc

SEQ ID NO: 290415 - RNA, 64 nt, Human
ggauucagcagcugccuuaucacucuacugcaaggcucuggacuucuuuguaccugcccugcac

SEQ ID NO: 290416 - RNA, 62 nt, Human
guuccauggagccuggauaaacagugcuuuggaggcucuggacagcugugugguguuugugu

SEQ ID NO: 290417 - RNA, 64 nt, Human
auggagacggccaguucuggcggccagauguggugcucuggaauccagucccauuuccuuccug

SEQ ID NO: 290418 - RNA, 64 nt, Human
aaauagaugauguagcuguacauuuuaaauguaugcucuggaaugagucacuuuuuuucccuga

SEQ ID NO: 290419 - RNA, 64 nt, Human
cuggcugugagagacuuaaaaucucuugaggagcgcucuggagaauggcugaaggagaggaaac

SEQ ID NO: 290420 - RNA, 64 nt, Human
gcaagggucucccccagcaggauggguggggccugcucuggagcugagcccguggccgcucaca

SEQ ID NO: 290421 - RNA, 64 nt, Human
uaaauugucuuugggggauuccaccacacccaaugcucuggagccacaaggagugucccuucuu

SEQ ID NO: 290422 - RNA, 64 nt, Human
gagauuccccccaccugugugagaaaaauaaacagcucuggagucuuguuccugacuccagagg

SEQ ID NO: 290423 - RNA, 64 nt, Human
gcccugggccaggcaggugucugcugcucaccuggcucuggagggcugcccugcagcugggccu

SEQ ID NO: 290424 - RNA, 60 nt, Human
cacggaucagccugagaugaucccagcugugcucuggacaggguaaccagggugggcuug

SEQ ID NO: 290425 - RNA, 64 nt, Human; identical to SEQ ID NO: 72723

SEQ ID NO: 290426 - RNA, 64 nt, Human; identical to SEQ ID NO: 72724

SEQ ID NO: 290427 - RNA, 64 nt, Human; identical to SEQ ID NO: 72733

SEQ ID NO: 290428 - RNA, 64 nt, Human
aaauaacuccuucaccaggcagugaguggcguaggcucuggagccaggcugccugggcuccaau

SEQ ID NO: 290429 - RNA, 64 nt, Human
cacuccuaccucccuuaccaccaggagcauucaagcucuggauugggcagcagaugugccccca

SEQ ID NO: 290430 - RNA, 64 nt, Human
ccuuucuggucuccacaguaggccagaguugggggcucuggagcuguuuccccaagugcaucca

SEQ ID NO: 290431 - RNA, 64 nt, Human
acagccccuugugcugugagcagagcaggcaguggcucuggaggcugccuguggucuccuuccg

SEQ ID NO: 290432 - RNA, 64 nt, Human
uguucagcuacuucacacugaguaccucaaaucugcucuggagucgauuaugccaccugugugu

SEQ ID NO: 290433 - RNA, 64 nt, Human
gggacaggucagcgucaggggcagccugcugucugcucuggagggcggcgcucaccucuggguc

SEQ ID NO: 290434 - RNA, 64 nt, Human
gggagcgccacuggcuucccgccacccgaagggagcucuggacccucagagccccugcagagga

SEQ ID NO: 290435 - RNA, 64 nt, Human
uuauucaauuuuacugaaguacuggcucuuuccugcucuggacaagaauugagcaacuugucug

SEQ ID NO: 290436 - RNA, 64 nt, Human
gcccacagucaggggccuccacaugccuggccuggcucuggaagucacgucuuagcuucugaac

SEQ ID NO: 290437 - RNA, 64 nt, Human
ggauagucuggaaaguugggauuugcaaauaaaggcucuggaagcauugcugguccugaagcuu

SEQ ID NO: 290438 - RNA, 64 nt, Human
guacuucaugagggagacugucaauaaggcuguggcucuggacaccuaugagaagggccagcug

SEQ ID NO: 290439 - RNA, 64 nt, Human
cgaggucgauggaacuggccacgcacaggcucuggcucuggaaggagggaugaugagugggcgu

SEQ ID NO: 290440 - RNA, 64 nt, Human
cauccugauaaaauucggcgcuauugcccccguagcucuggagcucuaaaccgucuaucugcuu

SEQ ID NO: 290441 - RNA, 64 nt, Human
gaucaaauuucaguggcuuuggacagaaaagaaggcucuggauuuaagcggguggucaccugug

SEQ ID NO: 290442 - RNA, 64 nt, Human
agcugagagcuggaggacaauauccagggacauggcucuggaaaauaacuuuuuuuuuuuuaag

SEQ ID NO: 290443 - RNA, 64 nt, Human; identical to SEQ ID NO: 72676

SEQ ID NO: 290444 - RNA, 56 nt, Human; identical to SEQ ID NO: 72677

SEQ ID NO: 290445 - RNA, 64 nt, Human; identical to SEQ ID NO: 72678

SEQ ID NO: 290446 - RNA, 64 nt, Human
uggguauaucaguaagaagagggcacaagaacuggcucuggagaccaaagcaguuguuaaaaau

SEQ ID NO: 290447 - RNA, 64 nt, Human
cagauagggaggugaguccucucuaucuccucuggcucuggaagcaccuugaaaaugugcauuu

SEQ ID NO: 290448 - RNA, 64 nt, Human
gacaauuacaagacggggagugagacuccugauugcucuggaagccugcugauuucuacaacug

SEQ ID NO: 290449 - RNA, 64 nt, Human
ggaaggccuuggguggcccccucuccuucuccuagcucuggaggugcugcucuagggcagggaa

SEQ ID NO: 290450 - RNA, 64 nt, Human
ccugcuaugaggguguauauauuuuuuacccaaagcucuggaauuguacauuuauuuuuuaaaa

SEQ ID NO: 290451 - RNA, 64 nt, Human
aggccagggacucagcguccccugcuacuccugugcucuggaggcugcagagcugacccagagu

SEQ ID NO: 290452 - RNA, 64 nt, Human
aggggcuuuugcuaaaaauaguggccagaccagagcucuggagccaccugucccaccucaaaug

SEQ ID NO: 290453 - RNA, 64 nt, Human
ccccacuccauggaaguccuugggaugggcgucugcucuggacaccccaaagagcuccugcccu

SEQ ID NO: 290454 - RNA, 64 nt, Human
gcagaagcagcaggaggcacuugaggagcaggcggcucuggagccuaagcuggaccugcuacug

SEQ ID NO: 290455 - RNA, 64 nt, Human
aacuguuugccacugcugcccucaccccugcccggcucuggaguaccgucugccccagacaagu

SEQ ID NO: 290456 - RNA, 64 nt, Human
acgccgagccaguggcggcugguaucccgcggcggcucuggaagcuggacgcggaccacggccc

SEQ ID NO: 290457 - RNA, 64 nt, Human
ccuaggcagaggcuccgcggcaggaggagccggugcucuggaagaccugaaagaagcccaggug

SEQ ID NO: 290458 - RNA, 64 nt, Human
gagccuguaaggaaagaggcaggcugagcugggggcucuggaccaggaagaugcucugacagau

SEQ ID NO: 290459 - RNA, 64 nt, Human
cucagaauuuugauagaaaaccauggggccaagagcucuggaagccuggccggaaagaccaagg

SEQ ID NO: 290460 - RNA, 64 nt, Human
cuccuucaugugaaucccagggggcagagaggaggcucuggaggcacacaggaugcagccuucc

SEQ ID NO: 290461 - RNA, 64 nt, Human; identical to SEQ ID NO: 72663

SEQ ID NO: 290462 - RNA, 64 nt, Human; identical to SEQ ID NO: 72664

SEQ ID NO: 290463 - RNA, 64 nt, Human; identical to SEQ ID NO: 72682

SEQ ID NO: 290464 - RNA, 64 nt, Human
uguccuuuguugugguuggagguuggugaucauugcucuggauuuggggcucccggcugccacc

SEQ ID NO: 290465 - RNA, 64 nt, Human
ucucacccugggaagauguggugcccccuccagggcucuggaggauggaugccucccccagggg

SEQ ID NO: 290466 - RNA, 64 nt, Human
uguggcccugccucugcccagcgagaggccgugggcucuggacaagccgcccuucaggcugggg

SEQ ID NO: 290467 - RNA, 64 nt, Human
aguucuacauaaaugggaucauuuuauacauggugcucuggaacccacauuuuucaugcaguca

SEQ ID NO: 290468 - RNA, 64 nt, Human
cuuccugugcccucaccccaaucccugccacugggcucuggaccucaggagggcaggcugaggu

SEQ ID NO: 290469 - RNA, 64 nt, Human
guaagcuggauauccugggggaggaggggaaugcgcucuggaaacacccuuccggaacccuucg

SEQ ID NO: 290470 - RNA, 64 nt, Human
cccccgcaaguccauuuuauuuccuucuugugcugcucuggaagagaggcaguagcaaagagau

SEQ ID NO: 290471 - RNA, 64 nt, Human
cccaagcaggacccggggguuccagccccuagcugcucuggagugggggagguugguggaccau

SEQ ID NO: 290472 - RNA, 64 nt, Human
gccaccaaggcccccaccagggccucugaccaccgcucuggagaggacaguguggcaugcucca

SEQ ID NO: 290473 - RNA, 64 nt, Human
aaaaagaaaaugagcagauuucuuuccauugugggcucuggaaaccacauggcuucaccugucc

SEQ ID NO: 290474 - RNA, 64 nt, Human
cuucuaucacagcaaccaaguagugaggauggcagcucuggagguguauguucgaagggcuuau

SEQ ID NO: 290475 - RNA, 64 nt, Human
gauggagaucuuggaacugaaacgcacagccagugcucuggaaauugagcuccaagcacagcaa

SEQ ID NO: 290476 - RNA, 64 nt, Human
ccuuggggucagcagccaccagcuggccugguuggcucuggauuucuggacuuuuuaaugaagc

SEQ ID NO: 290477 - RNA, 64 nt, Human
ugaaucuuuggaagccuugaguucagaaucugcugcucuggaauauuucccuucgaucuuaucu

SEQ ID NO: 290478 - RNA, 64 nt, Human
ggccuucuugagcuaggguggaauggggcagggugcucuggacucuuacccccuccccucccau

SEQ ID NO: 290479 - RNA, 64 nt, Human
uucuaguugagcuguaauuugaaugcauuguucucagggcuauuugugcuaaaagcugaaauuu

SEQ ID NO: 290480 - RNA, 64 nt, Human
ugauggucguugugggggucucuugccuggcucccagggcuaggguuagggcucuggaggugcu

SEQ ID NO: 290481 - RNA, 64 nt, Human
guauauugaacagacugaauauauuuuaccauuacagggcuaaaaggagucuucauguguuaau

SEQ ID NO: 290482 - RNA, 64 nt, Human
auuuucuauguguuguguuuguagucuugucuuagcucuggacgugaaauacuucgaugaugau

SEQ ID NO: 290483 - RNA, 64 nt, Human
cuguuugcugaaaaaagcucuggggcugucugaggcucuggaaugcucucuggaggguuaacuc

SEQ ID NO: 290484 - RNA, 64 nt, Human
auaaugacccgcuuuucuagaaaguucauaaucagcucuggaacaagcacacuugauuccucac

SEQ ID NO: 290485 - RNA, 64 nt, Human
ugccagagagccagagacccaagacagggcccgggcucuggaccugggugccccccugccaggc

SEQ ID NO: 290486 - RNA, 64 nt, Human
ggacucugcagggcugcccucucuaacuggccuggcucuggaagggcuggugaggacucugccu

SEQ ID NO: 290487 - RNA, 64 nt, Human
ccaagcccccuccuugucugugcauccgggggcagcucuggaggggguuugcuggggaacuggc

SEQ ID NO: 290488 - RNA, 64 nt, Human
ccuugggacucgggaggugccagaggcggcggcugcucuggaccucgguguucacugaccuuug

SEQ ID NO: 290489 - RNA, 64 nt, Human
ggcaagucccagucccaguccucggccacccccagcucuggaucccagggccagcugcccucug

SEQ ID NO: 290490 - RNA, 64 nt, Human
ccaagcgucacccucacacuggaggaggaugucugcucuggacuuaucaccccaggagaacuga

SEQ ID NO: 290491 - RNA, 64 nt, Human
uuugcauauggaggacagguggacaugguccugagcucuggacggagcaggcacccugaucuca

SEQ ID NO: 290492 - RNA, 64 nt, Human
gcuggagcaggcgggcagugcccugggagaccccgcucuggauaagacacccaaccccaacucc

SEQ ID NO: 290493 - RNA, 64 nt, Human
gcagcccuacccggggcucaacacacaggcuguggcucuggacauccggauauuaaaaggagcg

SEQ ID NO: 290494 - RNA, 64 nt, Human
agccaacucccaucuugguucugacccaaauccugcucuggacucuggagaggagauugaaaua

SEQ ID NO: 290495 - RNA, 64 nt, Human
auugggcucugggaaggggucagggugagaggcugcucuggagaacaaugagguccucauagca

SEQ ID NO: 290496 - RNA, 64 nt, Human
cauucuugcugaaccguuugugauugccauuugagcucuggaagccucuauugccaugagaguu

SEQ ID NO: 290497 - RNA, 64 nt, Human; identical to SEQ ID NO: 72685

SEQ ID NO: 290498 - RNA, 57 nt, Human; identical to SEQ ID NO: 72686

SEQ ID NO: 290499 - RNA, 64 nt, Human; identical to SEQ ID NO: 72687

SEQ ID NO: 290500 - RNA, 64 nt, Human
cucugcaagagaaaauaagcaggacagaggauuugcucuggacagagauggaagagccgggaac

SEQ ID NO: 290501 - RNA, 64 nt, Human
cuagggcaggggcagaguuuuggaaacagugcaggcucuggagccagacuggcgagauucaaau

SEQ ID NO: 290502 - RNA, 64 nt, Human
ggggcagaucgggggcuugaacccagguggucaggcucuggagcccacaauugucuuacccacu

SEQ ID NO: 290503 - RNA, 64 nt, Human
gaagggggaggcccagggcuggugagucuagaaugcucuggaacccuacaccuagugaugugug

SEQ ID NO: 290504 - RNA, 64 nt, Human
ggagaagcuguacaacgucaggauucagagguaggcucuggagccagucuaccuugaguuaaau

SEQ ID NO: 290505 - RNA, 64 nt, Human
cugagaaggugacagaguucauguugugugcugggcucuggacaggugguaaagacacuugugg

SEQ ID NO: 290506 - RNA, 64 nt, Human
ggagccucagggacagaucugaugaucccaggaggcucuggaggacaaucuaggaccuacauua

SEQ ID NO: 290507 - RNA, 64 nt, Human
auaaauagaacauguuuuaagaaguggcuauauagcucuggauaaaacgaacaaaagaauuaga

SEQ ID NO: 290508 - RNA, 64 nt, Human
auuugucaugcccuagcauggacugucucauacugcucuggacuaugugguaauaaaggcuuua

SEQ ID NO: 290509 - RNA, 64 nt, Human
agguggucccuccagcccugguuaggcacugagggcucuggacgggcuccaggaacccugggcu

SEQ ID NO: 290510 - RNA, 64 nt, Human
gcacgcgcucaagccaccagggugcgagaugccagcucuggaguucucgguuguuguaggaggu

SEQ ID NO: 290511 - RNA, 64 nt, Human
ccgccgcuggggccucggagacuuggaggaggacgcucuggaaccaucaucccgcuucucuccg

SEQ ID NO: 290512 - RNA, 64 nt, Human
cugcaguggucucagccacauccuauguauuuuggcucuggaggagcaaagcuguauccuggag

SEQ ID NO: 290513 - RNA, 64 nt, Human
gacucagcgggccccgucucuauaaugcagcugugcucuggaguccucaacccggggcucauuu

SEQ ID NO: 290514 - RNA, 64 nt, Human
gcggccuucacucagggucagcgggcaccagguugcucuggaagagcuugaggaugugguucuc

SEQ ID NO: 290515 - RNA, 64 nt, Human; identical to SEQ ID NO: 72688

SEQ ID NO: 290516 - RNA, 64 nt, Human; identical to SEQ ID NO: 72689

SEQ ID NO: 290517 - RNA, 64 nt, Human; identical to SEQ ID NO: 72691

SEQ ID NO: 290518 - RNA, 64 nt, Human
uuugccuuugguuccccgcgaaguccgaggccuggcucuggagcccgccugcgccccccagugg

SEQ ID NO: 290519 - RNA, 64 nt, Human
gagggggcugggucggcagcccaggcauccucaagcucuggacacccacuugagcccagauucc

SEQ ID NO: 290520 - RNA, 64 nt, Human
uuagaagcacaaguacguuaaacaagugcuaaacgcucuggaaagcauggcuuuauuuucuuaa

SEQ ID NO: 290521 - RNA, 64 nt, Human
cccugggacugugguggccgguggcccuggcccagcucuggagugcaugugugugugcucagau

SEQ ID NO: 290522 - RNA, 64 nt, Human
cacuagugaagccuguuucguugaacuaauucuggcucuggaaauguuuuuguuuuauaguuau

SEQ ID NO: 290523 - RNA, 64 nt, Human
gaucaagagcuucucuugcaucuucuuccacugggcucuggauuaaucaauuacccaaaggcug

SEQ ID NO: 290524 - RNA, 64 nt, Human
agccagccggcuaugaaagggagcgagccccucggcucuggaggcaaucaagcagacauagaag

SEQ ID NO: 290525 - RNA, 64 nt, Human
agauguuauuacuguuuugggccuccaugccccagcucuggaugaaggcaaaaacuguacugug

SEQ ID NO: 290526 - RNA, 64 nt, Human
uaucaaaauuguuuauacacucuuuccuccaugagcucuggaagguauaugcaucuucuguaau

SEQ ID NO: 290527 - RNA, 64 nt, Human
aagggccacaucccacugccacccuugacgcccugcucuggauaacaagacuuugacuugggga

SEQ ID NO: 290528 - RNA, 64 nt, Human
acauugauagucccuugaacacacaugcugccgagcucuggaaaaaccccacaggugaguccuc

SEQ ID NO: 290529 - RNA, 64 nt, Human
aagaccauuuucugguucuguguccucugccugggcucuggaagaggccuucccauggccauuu

SEQ ID NO: 290530 - RNA, 64 nt, Human
uccaaggguaugggaagccauauucacaccucacgcucuggacaugauuuagggaagcagggac

SEQ ID NO: 290531 - RNA, 64 nt, Human
cugcuggcagagaugcauuccagagaugcacuccgcucuggaacucacucucagccacagggag

SEQ ID NO: 290532 - RNA, 64 nt, Human
cccauucgccagcccuccacguccucccaggcuggcucuggagcugugaggggagguguaggug

SEQ ID NO: 290533 - RNA, 64 nt, Human; identical to SEQ ID NO: 72679

SEQ ID NO: 290534 - RNA, 64 nt, Human; identical to SEQ ID NO: 72680

SEQ ID NO: 290535 - RNA, 64 nt, Human; identical to SEQ ID NO: 72747

SEQ ID NO: 290536 - RNA, 64 nt, Human
ugagucaccuuccaaguuguuccaugggcuccuggcucuggacuguggccaaccuucuccacau

SEQ ID NO: 290537 - RNA, 64 nt, Human
cuuccucugcuguuggaugagagugagugaguaugcucuggaccuuauccuugaaagaugauca

SEQ ID NO: 290538 - RNA, 64 nt, Human
ugcccuccacucugguacuaucagaguagggcaggcucuggauuaaagcuuuuagccggucuaa

SEQ ID NO: 290539 - RNA, 64 nt, Human
aaggagccgacaaaaguugcuuccauuggcaugggcucuggagcuguccagaaguccagggaca

SEQ ID NO: 290540 - RNA, 64 nt, Human
guggaaucccaaggcuggggguggaaggagcagggcucuggagggauucgcauucaaggcacag

SEQ ID NO: 290541 - RNA, 64 nt, Human
gggaaggguccagacaggagauuuggauauaggagcucuggaucucagcugugguuccuuucua

SEQ ID NO: 290542 - RNA, 64 nt, Human
ucucucacagcuugauuccugccauauggaggaggcucuggaguccugcucugugugguccagg

SEQ ID NO: 290543 - RNA, 64 nt, Human
gccuguuaccagaggauccccgagagccacaccagcucuggacaucaccgccccuggaacuggg

SEQ ID NO: 290544 - RNA, 64 nt, Human
cuucccccccccacgagucuugcccuugacuucugcucuggauucacucuucccugucggccgc

SEQ ID NO: 290545 - RNA, 64 nt, Human
ugugccuugggucucagcugcugacacgcagccugcucuggagccugcagaugagauccgggag

SEQ ID NO: 290546 - RNA, 64 nt, Human
augauuuguguacaaaugaaaguucgaaagcugugcucuggacaguguucucaaagcaacuuuc

SEQ ID NO: 290547 - RNA, 64 nt, Human
caguggaugcagcucacaugcugaggaacacccagcucuggacagaguucuuauaaauguauaa

SEQ ID NO: 290548 - RNA, 64 nt, Human
cauaucccucccauauuuucuuuuugcugcuuuugcucuggaacuuugcuuuuagcagggaaag

SEQ ID NO: 290549 - RNA, 64 nt, Human
uggcucuguguacagcgcugugcauguuacauuugcucuggaaacaucucugggguuugcuugu

SEQ ID NO: 290550 - RNA, 64 nt, Human
cagguuccugcuaagaucccacgggcgagggcuugcucuggacucagucugucaaguccccgaa

SEQ ID NO: 290551 - RNA, 64 nt, Human; identical to SEQ ID NO: 72667

SEQ ID NO: 290552 - RNA, 60 nt, Human; identical to SEQ ID NO: 72668

SEQ ID NO: 290553 - RNA, 64 nt, Human; identical to SEQ ID NO: 72695

SEQ ID NO: 290554 - RNA, 64 nt, Human
gugucugugaugcucccaagcaaaggaaaugcaagcucuggaaauucguuaauguauuugaugu

SEQ ID NO: 290555 - RNA, 64 nt, Human
gaggagcgcaugcgugcuuaucugcaauggaggcgcucuggaggcugugguguguucucuccuu

SEQ ID NO: 290556 - RNA, 64 nt, Human
aaucgaggccuugaaacugaaagagagggagacagcucuggauauucugcacaaugagaacucc

SEQ ID NO: 290557 - RNA, 64 nt, Human
agaagagcccagaaaacagagucucaagacccccgcucuggacugucauaagcuagcacccgug

SEQ ID NO: 290558 - RNA, 64 nt, Human
ccagcauugcugugcauggcucccucaggaagaagcucuggaguggggccgaggccccagaugc

SEQ ID NO: 290559 - RNA, 64 nt, Human
ggugacccugccccuggcugggagcuccccuggggcucuggaaccugaagcccugagaaggaga

SEQ ID NO: 290560 - RNA, 64 nt, Human
agguggaauacccaaggucauguagccagugagugcucuggaaagccaaagcagcucaucccuu

SEQ ID NO: 290561 - RNA, 64 nt, Human
gcaggccuucacugcagcacugagccucaaauccgcucuggagcaugaggcuggaugcaguggu

SEQ ID NO: 290562 - RNA, 64 nt, Human
gcuccccaccugguugcccaguuccuauugaugagcucuggacagaaagaugcccguuuggcca

SEQ ID NO: 290563 - RNA, 64 nt, Human
ccaggguagcagcuggugggacacugaucugugagcucuggaaugucugcuuagaauucugaga

SEQ ID NO: 290564 - RNA, 64 nt, Human
accuuggcgucuguucugggagcacggaugauaagcucuggaagcuggcaguguguaaagcacu

SEQ ID NO: 290565 - RNA, 64 nt, Human
guggagugggcgcaggcacgccaggccuucuuuagcucuggaaagaauaaggcugccuuggagg

SEQ ID NO: 290566 - RNA, 64 nt, Human
ugagucuccuaacccaagauggaagagccagagggcucuggagugagcagaaccucaccccauu

SEQ ID NO: 290567 - RNA, 64 nt, Human
ugauugucuacccaaucaacaguuuucccucuuugcucuggaaauauuuguacucauauagcau

SEQ ID NO: 290568 - RNA, 64 nt, Human
gccugccuuagguugcugacuucuuuauuucagagcucuggagacaccuaguuugaaaaauguu

SEQ ID NO: 290569 - RNA, 64 nt, Human; identical to SEQ ID NO: 72699

SEQ ID NO: 290570 - RNA, 64 nt, Human; identical to SEQ ID NO: 72700

SEQ ID NO: 290571 - RNA, 64 nt, Human; identical to SEQ ID NO: 72701

SEQ ID NO: 290572 - RNA, 64 nt, Human
ccaucaggggugguuacauagaccagcagcuacagcucuggaaauugaaaucauaaucugucaa

SEQ ID NO: 290573 - RNA, 64 nt, Human
gacagucaagagcagucaguugcuuacuuauuuugcucuggaugagucugggacacgcuguaac

SEQ ID NO: 290574 - RNA, 64 nt, Human
agucugcagcacagugaccaaaucugacaaucgagcucuggaucaccacuugauuauguaguag

SEQ ID NO: 290575 - RNA, 64 nt, Human
augguuaaacaaaccauccauaacuuggaauacugcucuggaaugaaaaggaacuaacuguuga

SEQ ID NO: 290576 - RNA, 64 nt, Human
ccucugcccuuugauguccuugagcuacucuucagcucuggaaguuguggacaaaccguaggaa

SEQ ID NO: 290577 - RNA, 64 nt, Human
auggguguuuccgugacuuagcugugucccuguagcucuggaacugaaggaacuagguaggaga

SEQ ID NO: 290578 - RNA, 64 nt, Human
uuuuaaucuuuuuguuuuucuuuuagacacauuagcucuggagugagucugucauaauauuuga

SEQ ID NO: 290579 - RNA, 64 nt, Human
ccucgcuugcuggccgcaaccaaggagcuaucuagcucuggaggaaacuuucuuucuuaauucc

SEQ ID NO: 290580 - RNA, 64 nt, Human
gauaccugguaaggugcuucuuccucuuuuccaggcucuggagagaagcccucacccugagggu

SEQ ID NO: 290581 - RNA, 64 nt, Human
uuacauuuaaaaaagcaaaaagugaaaaaaaaaagcucuggacaccuuuaauaagcucgccacu

SEQ ID NO: 290582 - RNA, 64 nt, Human
aaaaaccccccacgaaaucagccacaacuaaaucgcucuggacggugccgccaggugacccuac

SEQ ID NO: 290583 - RNA, 64 nt, Human
guucccuccuggagguucauacauucauauauaugcucuggaguaauuuaugcauuuggauaau

SEQ ID NO: 290584 - RNA, 64 nt, Human
ucacagaaaagaaaagcagagucagcuacugagagcucuggaaagaaggaugucaagaagguga

SEQ ID NO: 290585 - RNA, 64 nt, Human; identical to SEQ ID NO: 72642

SEQ ID NO: 290586 - RNA, 64 nt, Human; identical to SEQ ID NO: 72643

SEQ ID NO: 290587 - RNA, 64 nt, Human; identical to SEQ ID NO: 72644

SEQ ID NO: 290588 - RNA, 64 nt, Human; identical to SEQ ID NO: 72645

SEQ ID NO: 290589 - RNA, 64 nt, Human; identical to SEQ ID NO: 72646

SEQ ID NO: 290590 - RNA, 64 nt, Human
acagagaauaaacuccuacgaaagcccuacauugagcuccaaucugcucggggugggacgggug

SEQ ID NO: 290591 - RNA, 64 nt, Human
aggaugucugagaccacuugggcgcuguuuucucagcuccaauuucaagagugagcuaucaaac

SEQ ID NO: 290592 - RNA, 64 nt, Human
gacggggagcacagacuuuguguccugcacacugagcuccaagugugccccagccacugagccu

SEQ ID NO: 290593 - RNA, 64 nt, Human
uuuccccccucaauugagagcucuuguuauucagagcuccaagacuagaccuggcuaacaaaca

SEQ ID NO: 290594 - RNA, 64 nt, Human
uuggggcucugccagguccccugggaccaacuacagcuccaaucagaaacccugcgcuuccuug

SEQ ID NO: 290595 - RNA, 64 nt, Human
ucccuccucccccacgccuccauccacacacagcagcuccaaccuggaggcuggaccaacugcu

SEQ ID NO: 290596 - RNA, 64 nt, Human
cucucaccccugccccuuagagucuaggugcagcagcuccaagcaugggaccaaggaggccaga

SEQ ID NO: 290597 - RNA, 64 nt, Human
ccagcauuucaugggggcugaggcagaacccaggagcuccaagaaaggccacccauagagcuca

SEQ ID NO: 290598 - RNA, 64 nt, Human
ucaggucuugcaggugucgacugucuuccggcccagcuccaagcccuccucugguugccuggac

SEQ ID NO: 290599 - RNA, 64 nt, Human
aguaaccaccuuccuucaagccuucagccccuccagcuccaagucucagaucucgaccauugaa

SEQ ID NO: 290600 - RNA, 64 nt, Human
uccccuuuauguacaggaugcuuugguuauauuuagcuccaaaccuucacacacagacuguugu

SEQ ID NO: 290601 - RNA, 64 nt, Human
gucucccccugcaugccccaugugggaggugcugagcuccaaaccagcaucacaccaacucuga

SEQ ID NO: 290602 - RNA, 64 nt, Human
cccaugaguucagaaggcacacucugccaugcugagcuccaagggugcuaccaggggaagaugg

SEQ ID NO: 290603 - RNA, 64 nt, Human
aggagucugagaagcagggaugccuggggugaucagcuccaaccaguggcagcagagugguggc

SEQ ID NO: 290604 - RNA, 64 nt, Human
agugaugagaauuguaugucauguuagcaaacgcagcuccaacuuauauaaaauagacuuacug

SEQ ID NO: 290605 - RNA, 64 nt, Human
auuacaugucaaauuacuuuugcuaucauaaauaagcuccaaagucccccauuuaauuuuuuuu

SEQ ID NO: 290606 - RNA, 64 nt, Human
cucagggguucccucucccgcugcucaccugugucagggcuaggaggcaggggcugcaggcuca

SEQ ID NO: 290607 - RNA, 52 nt, Human
cuggcugugaaggcagcugacacagggcuaggggcagcagcugggccuucga

SEQ ID NO: 290608 - RNA, 64 nt, Human
cugaagcguuccuucccuggaggaacucugguugcagggcuaaacuuagaggcugcuagagugu

SEQ ID NO: 290609 - RNA, 64 nt, Human
augcaugugugugugugcguguguguauaguuuuagcuccaagccaagcaaguuuguguuugga

SEQ ID NO: 290610 - RNA, 64 nt, Human
uuauuggaugauaggcccuagaacccaauaaaggagcuccaaaugucguuggguggggaagcaa

SEQ ID NO: 290611 - RNA, 64 nt, Human
aacugugugaaaccugccaaucuguguagaucagagcuccaaauuuuggauuaucgggccugug

SEQ ID NO: 290612 - RNA, 64 nt, Human
ccuuuacagggacuuuaugugguuuagggcucagagcuccaaaacucugggcucagcugcuccu

SEQ ID NO: 290613 - RNA, 64 nt, Human
gcccgaggagccagguugcauuuauuggauggggagcuccaaggggcauuagugguuugggcug

SEQ ID NO: 290614 - RNA, 64 nt, Human
uugucccuuuugaucauuauuaacucaggguuucagcuccaaccucgcugaguuggugcagcuc

SEQ ID NO: 290615 - RNA, 64 nt, Human
ugcagccugccccugugaucccuucggcgccagcagcuccaaaacuggaccaccagagaaugga

SEQ ID NO: 290616 - RNA, 64 nt, Human
uuuuauaaggcugaugucaauuucuguguugccaagcuccaagccccaucuucuaaauggcaaa

SEQ ID NO: 290617 - RNA, 64 nt, Human
uuugcugucucuaggauucauauagcacccacagagcuccaaguaaccaaauucccccaaagac

SEQ ID NO: 290618 - RNA, 64 nt, Human
agaaucaauauacaggguaauagcuuuggcucagagcuccaauaaugugcuucagaucugucca

SEQ ID NO: 290619 - RNA, 64 nt, Human
ugaggucaaucaaggaaaauuucuuaaugaaauaagcuccaaagagccaaaguaucaacuuaca

SEQ ID NO: 290620 - RNA, 64 nt, Human
ccgugacaggacaggcucccaagcucacucuuugagcuccaacgcuuguuaaacaugaggaaau

SEQ ID NO: 290621 - RNA, 64 nt, Human
ucugagauagcagcuaccccggcaccaucugcccagcuccaaggacccuuggugagggcguggc

SEQ ID NO: 290622 - RNA, 64 nt, Human
uccaccaccauguugaagcccuuggcagccugagagcuccaaggaacaagcugugacaaccagg

SEQ ID NO: 290623 - RNA, 64 nt, Human
caggcgccaggccaagggggaaaugcucuuugaaagcuccaauuauugguccccaaaagcagcu

SEQ ID NO: 290624 - RNA, 64 nt, Human
aauacaaagcaaaaggacuauuauuuuggguugaagcuccaaaacugacagcaucugauaaucu

SEQ ID NO: 290625 - RNA, 64 nt, Human
gcuucuccuuaccugcacccaggccucagaguuucagggcuaacccccagaauacugguagggg

SEQ ID NO: 290626 - RNA, 64 nt, Human
gcacaaccagaaucuugaguugggcagggaaggucagggcuacagaggcucuugaggcuccgag

SEQ ID NO: 290627 - RNA, 64 nt, Human
guuaauacuuuuagacaguaaguccggcugguugcagggcuauuugccccgacagcaucagccu

SEQ ID NO: 290628 - RNA, 64 nt, Human
gggucugagcccgugggcaagcccuggccgagugagcuccaaugcuaacucaugugccgaucuc

SEQ ID NO: 290629 - RNA, 64 nt, Human
guucgugccuguaagauugguuuguguccugaccagcuccaaaaauauacuucacugcccugaa

SEQ ID NO: 290630 - RNA, 64 nt, Human
cagaaggaaaagagaauuuuggccaucaaaauccagcuccaagugaacuuaaagagcuuauaua

SEQ ID NO: 290631 - RNA, 64 nt, Human
uuugcccaggcggugcaaacaauccacuucuucaagcuccaacacaaaugcugccuccuuuagg

SEQ ID NO: 290632 - RNA, 64 nt, Human
gcacacagcuuagaagugcuauaaaaaaggaaagagcuccaaauugaaucaccuuuauaauuua

SEQ ID NO: 290633 - RNA, 64 nt, Human
uugcugcugauaugcuggugauucccaaauacauagcuccaacccccaacuucccccagacuuu

SEQ ID NO: 290634 - RNA, 64 nt, Human
caacacagaacacgcccuccuccucgcugccugcagcuccaaucugauucugcuugggaauggg

SEQ ID NO: 290635 - RNA, 64 nt, Human
ugagcuuugaagauugcuaaauuaaauaauuuauagcuccaaaaacaaaaauauacuuguauau

SEQ ID NO: 290636 - RNA, 64 nt, Human
uguccuuccagaaaaaccagcuuaucaucuaucaagcuccaaccccuuauacagcuccucuggu

SEQ ID NO: 290637 - RNA, 64 nt, Human
cuguuuuuacuggaaacauagcaaaccuugauuuagcuccaagaaauugaguagggaaauauuu

SEQ ID NO: 290638 - RNA, 64 nt, Human
cuucugcugcuggauucucaggcuaacauccuggagcuccaaccuucuaacuucugugguuuga

SEQ ID NO: 290639 - RNA, 64 nt, Human
uuucuuggguuucuuucaggauuuuucuucucacagcuccaagcacgugucccgugccucccca

SEQ ID NO: 290640 - RNA, 64 nt, Human
cagggcucacaggagacagggcucaggcugccggagcuccaaccaaacucugucccacuucacg

SEQ ID NO: 290641 - RNA, 64 nt, Human
gagaauggaggacugggaggagaagcauuaacugagcuccaagggugugugggcagagagcuug

SEQ ID NO: 290642 - RNA, 64 nt, Human
cagauauugcgccugugugcguguguauaagucaagcuccaagaggcuccugaaugugacuggc

SEQ ID NO: 290643 - RNA, 64 nt, Human
uaaaggaguaguuaagcucuguaaaugugccacgagcuccaacacgaccaucguagggugaagc

SEQ ID NO: 290644 - RNA, 64 nt, Human
cucaagcuacagcagcagcacuucccaagccugcugaccacagucacaucacccaucagcacau

SEQ ID NO: 290645 - RNA, 64 nt, Human
gaaccucuuuuguuggggaaggguggcauucugcugaccacagcacuccaaccaaaagccaaaa

SEQ ID NO: 290646 - RNA, 64 nt, Human
acuuuguugggggacuuuggaggcgggcaggggacagggcuauugauaagguccccuugguguu

SEQ ID NO: 290647 - RNA, 64 nt, Human
gguuccuauggcuggccacugcacagagcucuccagcuccaagaccuguugguuccaagcccug

SEQ ID NO: 290648 - RNA, 64 nt, Human
gagcuccaagauauaagcccuccaagggaucagaagcuccaaguuccugucuucuguuuuauag

SEQ ID NO: 290649 - RNA, 64 nt, Human
cucaggaagcuucuagagacuuuaugcccuccagagcuccaagauauaagcccuccaagggauc

SEQ ID NO: 290650 - RNA, 64 nt, Human
auucucaugguaggauuucugagaucuuaaucuaagcuccaaaguugucuacuuuuuugauccu

SEQ ID NO: 290651 - RNA, 64 nt, Human
aaaccugcugcaacuauuguuauuaacucuguauagcuccaaaccuggaaccuccugaucaguu

SEQ ID NO: 290652 - RNA, 64 nt, Human
ccccuuguuccaaaugaagacggcaucacgaagcagcuccaaaaggaaaagcuugggcggugcc

SEQ ID NO: 290653 - RNA, 64 nt, Human
caguuuuaggccugcguuacauauugccucuuccagcuccaaaguuuuggacccugucaguuuu

SEQ ID NO: 290654 - RNA, 64 nt, Human
gauaaaucuauguuguuuugcauggcuauuguuaagcuccaaagguucacuguguuucugccgc

SEQ ID NO: 290655 - RNA, 64 nt, Human
acuuucaaccuagguuauaagacuguuauucuauagcuccaacuuaaggugccuuuuuaauucc

SEQ ID NO: 290656 - RNA, 64 nt, Human
ugcaauaaguauguauugaacuguacuguaaaguagcuccaaaacuuaauuacucuccuguuuu

SEQ ID NO: 290657 - RNA, 64 nt, Human
aaauaauauuugagucuuucugcucaaagaaugaagcuccaaccauuguucuaagcuguguaga

SEQ ID NO: 290658 - RNA, 64 nt, Human
caugcgggagccaggagagcacccuucuccacucagcuccaaagcgaaucuuugaaaacaccca

SEQ ID NO: 290659 - RNA, 64 nt, Human
aacucuaguagggcuauuuguugguaagcucuuuagcuccaauuucccuuaagcaaaguuuuuu

SEQ ID NO: 290660 - RNA, 64 nt, Human
ugcauuuacugauuaaaaauaagaacugaccaauagcuccaagugucacacaccagaacauuaa

SEQ ID NO: 290661 - RNA, 64 nt, Human
gaggagucccugcaauaagccccugcauuugccaagcuccaaagacucccucccuagucugccu

SEQ ID NO: 290662 - RNA, 64 nt, Human
uuuuaagaauuucauucuuuuuguauggucauggagcuccaaccauuuuuaauaggaaagucuu

SEQ ID NO: 290663 - RNA, 64 nt, Human
ugcuuaaaagguuaaauuucaagcaaaaugcuuacagggcuaggcaguaccaaaguaacugaau

SEQ ID NO: 290664 - RNA, 64 nt, Human
ggcuagaacgggacgucuucuaaaaagccuugggcagggcuagcaacaucguagguguuuauua

SEQ ID NO: 290665 - RNA, 64 nt, Human
gucccagguuggaggcccuaggcgcgguucaggucagggcuauggauggggcccaggggcuuug

SEQ ID NO: 290666 - RNA, 64 nt, Human
aguccaggauggaaccugguucacccuucauaccagcuccaagccccagaccaugggagcuguc

SEQ ID NO: 290667 - RNA, 64 nt, Human
ccugcuucuccucacagggccuggccauauagccagcuccaacccaaagcccugcacagugccu

SEQ ID NO: 290668 - RNA, 64 nt, Human
uuucccucuuccuguguccccagauccccacuacagcuccaagaggaugggccuagaaagccaa

SEQ ID NO: 290669 - RNA, 64 nt, Human
ugauuguagagaaccuuguuucugcaggaagccuagcuccaagcacgcagucuguagacauuuu

SEQ ID NO: 290670 - RNA, 64 nt, Human
uuaugaaaugugccuuuucugaagagauuguguuagcuccaaagcuuuuccuaucgcaguguuu

SEQ ID NO: 290671 - RNA, 64 nt, Human
auccugaggcacagcucccaggggacagagguguagcuccaaucucccugacugcaccucaggg

SEQ ID NO: 290672 - RNA, 64 nt, Human
cuuguauuuauuugaaacacugggcuguuugcacagcuccaacugugcaugcucaaaaugugca

SEQ ID NO: 290673 - RNA, 64 nt, Human
ccaggcuggcccaaggggagugccuccuucgucaagcuccaagucaaggucagagcggggucag

SEQ ID NO: 290674 - RNA, 64 nt, Human
guagaagucacauuccugaacaggauauucucacagcuccaagaauuucuaggacugaauuaug

SEQ ID NO: 290675 - RNA, 64 nt, Human
ggcgccaucuaugguguggaugggaaacugcuccagcuccaagagguuuuucagcucuuugaca

SEQ ID NO: 290676 - RNA, 64 nt, Human
cuggagggcaguggcacgaucucagcucacugcaagcuccaacucccggguucacgccauucuc

SEQ ID NO: 290677 - RNA, 64 nt, Human
cugugcaugugcguggaaguguuccugucucaauagcuccaagcuguuaaagauauuuuuauuc

SEQ ID NO: 290678 - RNA, 64 nt, Human
cacuucccugggaacucauccuguguggggaggcagcuccaacagcuugaccagaccuagaccu

SEQ ID NO: 290679 - RNA, 64 nt, Human
ccccuccuggaaaaugguguuggguuuggucuccagcuccaauacuuauuaaggcuguugcugc

SEQ ID NO: 290680 - RNA, 64 nt, Human
gggagaacuggaagaauaacauccauugucguacagcuccaaacaacuucagaugaauuuuuac

SEQ ID NO: 290681 - RNA, 64 nt, Human
aaaugaagauuuugcagcacugaaaaucuauuaaagcuccaaauuuuaaguuucuaaauaaucu

SEQ ID NO: 290682 - RNA, 64 nt, Human
uuuaaaauaggggagccugugguggccuggugcacagggcuagaacgagagugccuccccuucu

SEQ ID NO: 290683 - RNA, 64 nt, Human
guagacguguguuucuagagccugcuggaucucccagggcuacucacucaaguucaaggaccaa

SEQ ID NO: 290684 - RNA, 64 nt, Human
uuagcugcuuuuguuuuuuuuuuuuuuuuuuugccagggcuauggaguggggguuguuugucaa

SEQ ID NO: 290685 - RNA, 64 nt, Human
uuuuucuguuauuuucaauuuauuacaacuugacagcuccaagcucuuauuacuaaaguauuua

SEQ ID NO: 290686 - RNA, 64 nt, Human
auaaacauauaugauaguggcucuaguuuuauagagcuccaaguguauuaaacaugacagccau

SEQ ID NO: 290687 - RNA, 64 nt, Human
cucccuuuuuggguaaaccagcucugaacuuccaagcuccaaauccaaggaaacaugcagcucu

SEQ ID NO: 290688 - RNA, 64 nt, Human
caccaagaaaacagccgauacuggcagccauugcagcuccaaacugcagaggcaaggccaauuu

SEQ ID NO: 290689 - RNA, 64 nt, Human
augcaccugguuggaagaugcucagccucacaaaagcuccaagcccuuugggagccaaaguguc

SEQ ID NO: 290690 - RNA, 64 nt, Human
ccucuugccucauggaugucuggucccucugcacagcuccaaccaacaggacuguagggugaug

SEQ ID NO: 290691 - RNA, 64 nt, Human
uacgacauaacagaauugcccuccaagucacacaagcuccaagacuaaacaaacagacaggucc

SEQ ID NO: 290692 - RNA, 64 nt, Human
cuuuccauaguagagaaaacaucuuaagagagcaagcuccaauaugcaagagcuuaucgauccu

SEQ ID NO: 290693 - RNA, 64 nt, Human
gugcacauaaucuauuaugauccaaugcaaauacagcuccaaaaauauuaaauguauauauauu

SEQ ID NO: 290694 - RNA, 64 nt, Human
aauuaacccuguguccucagucgccagcacuuacagcuccaacuuuuuugaaugaccaucuggu

SEQ ID NO: 290695 - RNA, 64 nt, Human
ggggugucuaagccacguccaaaugguggacaguagcuccaacagugacaugacagagggaggg

SEQ ID NO: 290696 - RNA, 64 nt, Human
cccaccaugccagaaugggaaguugugacguugcagcuccaaccgacgugcucauagugaucag

SEQ ID NO: 290697 - RNA, 64 nt, Human
gccccuuccccacugcccaggagcccccauccuaagcuccaagcaugucugggccaggcagagg

SEQ ID NO: 290698 - RNA, 64 nt, Human
ccucugacaagcaggagaagguaagggcccggucagcuccaaggagcgcgcuccacgcgcgugc

SEQ ID NO: 290699 - RNA, 64 nt, Human
uugggucagaaccuucucucucugaauuuggaucagcuccaagcagugaaaauaguaaucagau

SEQ ID NO: 290700 - RNA, 64 nt, Human
gguaccucucccugcaucauacccaggaacugccagcuccaaaauauugggguacagcucacca

SEQ ID NO: 290701 - RNA, 64 nt, Human
cauuauucuccugauccuccuaccugguccaccccagggcuaccggaagguaaaaucuucaccu

SEQ ID NO: 290702 - RNA, 64 nt, Human
acuuugcguuuugcuaucugauuuuuauuuuucacagggcuaagcaugagcuuucauucucacu

SEQ ID NO: 290703 - RNA, 64 nt, Human
agcauggacucagaaaagcugagucuggcuagaccagggcuauggagaucaauuuuuccaacag

SEQ ID NO: 290704 - RNA, 64 nt, Human
uucucugcagaccgugauccucacuagacagaggagcuccaaaccugcccaucucaucccaugc

SEQ ID NO: 290705 - RNA, 64 nt, Human
gaccagcacuuagggugggcggggcuccugagggagcuccaacucagaagggagcuagccagag

SEQ ID NO: 290706 - RNA, 64 nt, Human
agcccaggcagggaauggccuugaaagccauuggagcuccaauucgugacccacucagccuuau

SEQ ID NO: 290707 - RNA, 64 nt, Human
gugcuaccccaauuagggcccagccugccauggcagcuccaacaaggaccgucugggauagcac

SEQ ID NO: 290708 - RNA, 64 nt, Human
caagcaauucuguagcaaauaaauccuuugaaagagcuccaaauugguggcauuauccuuucaa

SEQ ID NO: 290709 - RNA, 64 nt, Human
accguccuggccagcuaccgucagagagaaccagagcuccaagucuuuaauuugccaagaugaa

SEQ ID NO: 290710 - RNA, 64 nt, Human
aaaggcccugcuuccuggaaaggacacucagagcagcuccaagacagaggcucuguggcggggg

SEQ ID NO: 290711 - RNA, 64 nt, Human
uaacaguucauucuacuuaauaaugcaauaauggagcuccaaguugucuuggacuucuacacca

SEQ ID NO: 290712 - RNA, 64 nt, Human
acucuacaucugcuucuccuguggcucugccaucagcuccaauaucaauaugaacucguauugg

SEQ ID NO: 290713 - RNA, 64 nt, Human
uaagauagcugaaagaagcugcugugaggagcucagcuccaaacacaggaucagcaccuuguau

SEQ ID NO: 290714 - RNA, 64 nt, Human
acugcaucgguggacacugguauuuauuuauguuagcuccaagcggaccggugguucaaaagug

SEQ ID NO: 290715 - RNA, 64 nt, Human
uaugucugucauccagcuccuaugucuguuauccagcuccaaguacagcuuguguauaucaaca

SEQ ID NO: 290716 - RNA, 64 nt, Human
gacagauuaugauugcucaggcauaccagguuauagcuccaaguuccacaggucugcuaccaca

SEQ ID NO: 290717 - RNA, 64 nt, Human
cucugggccccuccucccugcugccacuuaucccagcuccaaguuuuuuuaaaaauaauauuau

SEQ ID NO: 290718 - RNA, 64 nt, Human
cucuggcucuuuugauagaagaaagcaacacaaaagcuccaaagggcccccuaacccucuugug

SEQ ID NO: 290719 - RNA, 64 nt, Human
ugccacccccuucccuguccuuccccaacuccccagcuccaagaguggaagaaauccccaagau

SEQ ID NO: 290720 - RNA, 64 nt, Human
caccacuugagacugggggcagcauggaguagggcagggcuacggggauacacggugcacccug

SEQ ID NO: 290721 - RNA, 64 nt, Human
gcucgccagaccuccucucaaugcucaucacacacagggcuauuccuuuccuccaaugaaccaa

SEQ ID NO: 290722 - RNA, 64 nt, Human
guuguucuccugggagacuucuuuuuuuaaaugccagggcuacuucugcuuuaccucaguggua

SEQ ID NO: 290723 - RNA, 64 nt, Human
cuguucaugaggguuccgcccccaugacccaaucagcuccaaaggccccaccuccuaauacugu

SEQ ID NO: 290724 - RNA, 64 nt, Human
auccagacugccaugucagcuaucccaguagcugagcuccaaggacucaggcagagggacucag

SEQ ID NO: 290725 - RNA, 64 nt, Human
cugucagggaccagauguguccugccucaucccuagcuccaaucccuuccccacgugaccgggg

SEQ ID NO: 290726 - RNA, 64 nt, Human
cagguuggguaacccucccuguucaucccauguuagcuccaaagcauuucccacccuccaucua

SEQ ID NO: 290727 - RNA, 64 nt, Human
caauagggcccaaaccuuuuuauuuuacaauaugagcuccaagacacuuacugaucuacuguga

SEQ ID NO: 290728 - RNA, 64 nt, Human
ucucaacaaaauuagaagaauuaaauuuaaaacuagcuccaaaagagcagucgucuuucauuuu

SEQ ID NO: 290729 - RNA, 64 nt, Human
cguguucugccagguccaugggggcuggcaucccagcuccaacucgaggagccucaguuuccuc

SEQ ID NO: 290730 - RNA, 64 nt, Human
ucuuaaagaugaaaugguugcagaaaaucuguuuagcuccaacuuuggcuuaauuuaaaucaaa

SEQ ID NO: 290731 - RNA, 64 nt, Human
uuccgucuguagcaggagcuagggcugcugccucagcuccaagacaagaaugaaccuggcugug

SEQ ID NO: 290732 - RNA, 64 nt, Human
caguuccccaacccacucccuuccaacaacaaccagcuccaacugacucuggucuugggaggug

SEQ ID NO: 290733 - RNA, 64 nt, Human
uuuaguugaccuucaaauauucaagcuauucugcagcuccaagaugcaauuauagaaacagcuc

SEQ ID NO: 290734 - RNA, 64 nt, Human
cugcaccuucuuagggaagggcaugccagccaucagcuccaaacaggcuguaaccaaguccacc

SEQ ID NO: 290735 - RNA, 64 nt, Human
gaggcauucccagcccuucacuuaacuccuacuuagcuccaaaauaccuguauccaauuuguau

SEQ ID NO: 290736 - RNA, 64 nt, Human
gcccagcccuguccacugcaggguugugucugcaagcuccaaggaggccuggggguuggguggg

SEQ ID NO: 290737 - RNA, 64 nt, Human
acaaggauagaugcuggcccagggcccagagcccagcuccaaggggaaucagaacucaaauggg

SEQ ID NO: 290738 - RNA, 64 nt, Human
uuugggccagacaugccacaaggacuuccuguccagcuccaaccugcaaagaucuguccucagc

SEQ ID NO: 290739 - RNA, 64 nt, Human
ucaugaaaacagccccuuuaccugccaagacaagcagggcuauauuucagugacagcugauauu

SEQ ID NO: 290740 - RNA, 64 nt, Human
acuaugaaucacucacacucacucgaaaacuaugcagggcuagggagcguuuaugagcuaccgg

SEQ ID NO: 290741 - RNA, 64 nt, Human
uguccagggugggcacccacagugacucagaggacagggcuaggcaggagaccugcugcuccuc

SEQ ID NO: 290742 - RNA, 64 nt, Human
uuugaggaucucacauuagacaccaacaaauuaaagcuccaaaauuauuuauuuuuuauguguu

SEQ ID NO: 290743 - RNA, 64 nt, Human
ccagggaagccucccagcggcucaugaagcaucgagcuccaagcccagaugccaagcucccugg

SEQ ID NO: 290744 - RNA, 64 nt, Human
acagauuucuuguccugccuucuagaugccucugagcuccaaacccagggcagccauggcuucu

SEQ ID NO: 290745 - RNA, 64 nt, Human
acccucacucccagguccccucccauuugguagcagcuccaacagggguccagccugcaucuug

SEQ ID NO: 290746 - RNA, 64 nt, Human
ucaguaaguuuuuagaacaucaaaauguuuucugagcuccaaguggcuagguuguaaaaguuuu

SEQ ID NO: 290747 - RNA, 64 nt, Human
gggugcucuucguaagggguaguuguuguuuuauagcuccaaaugguuuuuuuauucucagugu

SEQ ID NO: 290748 - RNA, 64 nt, Human
augcccuccuaaaugucagcuguugucacacaguagcuccaacacuuugagcauuuuuaaggga

SEQ ID NO: 290749 - RNA, 64 nt, Human
gguuaggaauguggugcucuuguugggggaagugagcuccaagaguagcuuuuuuucaucucuu

SEQ ID NO: 290750 - RNA, 64 nt, Human
cagagaugcauugugauuguaauuacugaguugaagcuccaaccaauuugaauuuguuucuuaa

SEQ ID NO: 290751 - RNA, 51 nt, Human
auguucaaugucggaagugagagcuccaagcagcaggauaaguaguagaca

SEQ ID NO: 290752 - RNA, 64 nt, Human
aaaagggaggaagauccugaagauucucuuaugaagcuccaaaauugauaauccugucucagcu

SEQ ID NO: 290753 - RNA, 64 nt, Human
cugccucaacucugucuccaggucuauucccuccagcuccaaaaggagcagcccuacuucuacc

SEQ ID NO: 290754 - RNA, 64 nt, Human
gggauuggagagggauggggagggaagggaaggcagcuccaagaagaggucccuguggcgaagu

SEQ ID NO: 290755 - RNA, 64 nt, Human
auccucuugcguuuuggcccccauuugcucccugagcuccaagauaagaauggccccgagagaa

SEQ ID NO: 290756 - RNA, 64 nt, Human
uuguggcuguguccccucacuuguccaagaccaaagcuccaaccaaacaauaccccaucguuug

SEQ ID NO: 290757 - RNA, 64 nt, Human
ugugugaccagggcgggaggggccccaguggcugagcuccaagugccugcugaagucugcaggg

SEQ ID NO: 290758 - RNA, 64 nt, Human
ucuaaugcccaaaugccagccaguguggauguugugaccacagagcaggauugugcauuggcuu

SEQ ID NO: 290759 - RNA, 64 nt, Human
uacucugcucuggccaguggugccaggugccacccagggcuacugccuggcuaucuggccuggc

SEQ ID NO: 290760 - RNA, 64 nt, Human
uggccgcccuacggaaaaucccauccacagaggccagggcuacccaagccccuccaggugagcu

SEQ ID NO: 290761 - RNA, 64 nt, Human
ggcacuaccacccugcuccaucaucacuacguccagcuccaacggcacuggugccccauuccau

SEQ ID NO: 290762 - RNA, 64 nt, Human
cucaguaaaacaaggugcugcuuuguauaucaaaagcuccaaccauguccucucccccucagcc

SEQ ID NO: 290763 - RNA, 64 nt, Human
caguuaagccuuuggaaacagcucgacuuuaaaaagcuccaaaugcagcuuuaaaaaauuaauc

SEQ ID NO: 290764 - RNA, 64 nt, Human
uuggaggggggaggugggauccuccaggugcacaagcuccaagcucccaggcauuccccaggag

SEQ ID NO: 290765 - RNA, 64 nt, Human
cgggacuggacgagcaguagauccagcagccugcagcuccaaggaacauugccucucuggaucu

SEQ ID NO: 290766 - RNA, 64 nt, Human
ggaaguuguguuuguguuucaagcagaaaaacugagcuccaagugagcacauucagcuuuggaa

SEQ ID NO: 290767 - RNA, 64 nt, Human
gagcgagcgagggcccccggacuggaggcuugagagcuccaacgggaagauggcuucacggagg

SEQ ID NO: 290768 - RNA, 64 nt, Human
ccucucccaauuuuauucccuuauucauuucaagagcuccaauggggucuccagcugaaagccc

SEQ ID NO: 290769 - RNA, 64 nt, Human
auagucaaugagagugaagcugcagccggcauccagcuccaagcuuccugcauucaguccuuug

SEQ ID NO: 290770 - RNA, 64 nt, Human
uucccacuccucugagcccggaggggacaccccaagcuccaagcuccaagcuccaggccaaagg

SEQ ID NO: 290771 - RNA, 64 nt, Human
uccucugagcccggaggggacaccccaagcuccaagcuccaagcuccaggccaaaggcugaaag

SEQ ID NO: 290772 - RNA, 59 nt, Human
uucgccgaauccaacaguagcugauuaaaagcuccaaguacgauaauuccucaagcaug

SEQ ID NO: 290773 - RNA, 64 nt, Human
uggggacccuggacgugccgacauauggccauugagcuccaacccacacauucccauucaccaa

SEQ ID NO: 290774 - RNA, 64 nt, Human
auaguuccucuuucucauuuugcaaacuacccagagcuccaaggacagccugaagaucucagug

SEQ ID NO: 290775 - RNA, 64 nt, Human
gaacugaaacgcacagccagugcucuggaaauugagcuccaagcacagcaaagccuggugcgug

SEQ ID NO: 290776 - RNA, 64 nt, Human
ugaagaacagaaagguguucaugugacuucagugagcuccaacccuggggcccugagauggccc

SEQ ID NO: 290777 - RNA, 56 nt, Human
ugcuaaggaaagcauuguaauccuugugaccacaccgauggagauacagaaaaagu

SEQ ID NO: 290778 - RNA, 64 nt, Human
ucaggguaggaaccauguggagccacacauucccugaccacagggaagcaccuggcucaaucau

SEQ ID NO: 290779 - RNA, 64 nt, Human
cggcagcucugcgccaucuaccggcugaacuuucugaccacagcccccagcaggggaggcccac

SEQ ID NO: 290780 - RNA, 64 nt, Human
gccucugaugagggcgaauugcuaugacauuccaagcuccaauaaagacugucccagacuuugg

SEQ ID NO: 290781 - RNA, 64 nt, Human
gaaguggaaacuccuccugcaggaagagccuuaaagcuccaaauacccuauaucuuucuuuaau

SEQ ID NO: 290782 - RNA, 64 nt, Human
ccucacuucugggagacagagcuacagcugggacagcuccaagcuacccuaaccccuccuuucc

SEQ ID NO: 290783 - RNA, 64 nt, Human
gagacucuuuggccauuucccauggcucagacuaagcuccaagcccuucaggaguuccaaggga

SEQ ID NO: 290784 - RNA, 64 nt, Human
ggagaggcuggcaugagguucagucauuccagugagcuccaaagaggggccaccuguucucaaa

SEQ ID NO: 290785 - RNA, 64 nt, Human
gcugcagcagaguuugaagggcccagccgugcccagcuccaagcagacacacaggcaguggcca

SEQ ID NO: 290786 - RNA, 64 nt, Human
ugaagaaaacaaaccgacucacaaaccuccaaguagcuccaaaugcaauuuuuaaaauggaaaa

SEQ ID NO: 290787 - RNA, 64 nt, Human
ccuacuaaaggguaacuucaggugugcagcccugagcuccaaggcucugcaccaugccacacac

SEQ ID NO: 290788 - RNA, 64 nt, Human
uaucuuagaguaucuccagaaacuggcuuagaggagcuccaaauauguggaauuaccacacucu

SEQ ID NO: 290789 - RNA, 64 nt, Human
augaauuaaguaauuauaaacauaaauuuccuguagcuccaacaugacuuugaucugaguaaua

SEQ ID NO: 290790 - RNA, 64 nt, Human
ugcgccaggucgguccucccugccaaccuuccccagcuccaauauguagcagucucucuggaug

SEQ ID NO: 290791 - RNA, 64 nt, Human
cuugucucaaaaaaaaaaaaaaaaaaaaaaaaaaagcuccaaagucaccucugucaaagccaca

SEQ ID NO: 290792 - RNA, 64 nt, Human
cagggaggguuccuuggggacaagggugguuggcagcuccaagccuuuaaaccuggcuucugaa

SEQ ID NO: 290793 - RNA, 64 nt, Human
uggucuugaacuccugaugucaggugauucuccuagcuccaaauguuuucauuaucucuccccc

SEQ ID NO: 290794 - RNA, 64 nt, Human
aguagagaagccugaggaauuuacaaaaugaugcagcuccaagccauuguauggcccauguggg

SEQ ID NO: 290795 - RNA, 64 nt, Human
aggcccaggccccaugaggcaccaguggaagcacagcuccaaguucagacaggugcccuuagag

SEQ ID NO: 290796 - RNA, 64 nt, Human
gaagcagagccuguaucaugggacacacaccccuugaccacacagcauccacucuccugcgguu

SEQ ID NO: 290797 - RNA, 64 nt, Human
cuucagcucagugcuacucugaauacaauacugcugaccacauuuggcuacuucagcuuaaaug

SEQ ID NO: 290798 - RNA, 64 nt, Human
cccagagacccucugccuggaggcgggccuuccccagggcuacaucugcacgccccgugguguc

SEQ ID NO: 290799 - RNA, 64 nt, Human
caagcucagcucuaagaaccgccccaaccccuccagcuccaaaucugagccuccaccacauaga

SEQ ID NO: 290800 - RNA, 64 nt, Human
ggagacaacagcccugucucaaaacuggguugccagcuccaauguaccagcagcuggaaucuga

SEQ ID NO: 290801 - RNA, 64 nt, Human
ugauguaugugcucugccagugugaagggugaacagcuccaacuuuauguccccccagggacau

SEQ ID NO: 290802 - RNA, 64 nt, Human
cccugaggccaugagggugggagccggccugggcagcuccaacuccagagaaggguacagcuga

SEQ ID NO: 290803 - RNA, 64 nt, Human
gggccgagccgcugagcagguguugguccucaggagcuccaaccccggacggcagaugccuucc

SEQ ID NO: 290804 - RNA, 64 nt, Human
acuccacucacgcagacccaaccuaaccuccacuagcuccaaaaucccugcuccugcguccccg

SEQ ID NO: 290805 - RNA, 64 nt, Human
uucccugggggagccccgacggccacaggacuccagcuccaaguggguuuucuuggcuccccug

SEQ ID NO: 290806 - RNA, 64 nt, Human
uugcgggggggguugcuuuuuucuggggucuuugagcuccaaaaaauaaacacuuccuuugagg

SEQ ID NO: 290807 - RNA, 64 nt, Human
gagccacccucagcaggagcugggguggccccugagcuccaacggccauaacagcucugacucc

SEQ ID NO: 290808 - RNA, 64 nt, Human
aacuuuauguuauccaaguucugggauagccaugagcuccaauuaccucagagcuccgaguccu

SEQ ID NO: 290809 - RNA, 64 nt, Human
gcucagcugccaacaguggauugaguuuggggguagcuccaagccuucuccugccucugaacug

SEQ ID NO: 290810 - RNA, 64 nt, Human
cuaugcuugaaaacucacuuccugaagcagcuugagcuccaaagugcacaucugguuccaacuu

SEQ ID NO: 290811 - RNA, 64 nt, Human
ccucagccucucugguagcugagacugcaugcccagcuccaaaucaccuugauucauaucagca

SEQ ID NO: 290812 - RNA, 64 nt, Human
gacuaguccuuacuagccugaggguaaaagauuaagcuccaaccucaagucauuuaccuggucu

SEQ ID NO: 290813 - RNA, 64 nt, Human
cugccaugcagacccaugccccccucccccaggcagcuccaagaaagcucccugacucgccccu

SEQ ID NO: 290814 - RNA, 64 nt, Human
caggcucacaggcugugccacccgucccuccgacagcuccaauacugugacccuccuuccucag

SEQ ID NO: 290815 - RNA, 64 nt, Human
acccgcuggcucccaggcccugagaggacagagaugaccacaucccugcuggaugcaggacccg

SEQ ID NO: 290816 - RNA, 64 nt, Human
cccuaccccucacauggccacgcaugacccacacugaccacacccugcccucuucggugacauu

SEQ ID NO: 290817 - RNA, 64 nt, Human
ggauugcacguggccucuugagcaguggcugguccagggcuagugacuugugucccaugauccc

SEQ ID NO: 290818 - RNA, 64 nt, Human
agagaaggagcuggcgagaaccuuccccacacucagcuccaaacgccuccucucccaggucauc

SEQ ID NO: 290819 - RNA, 64 nt, Human
acacaaagaacuugggguguaaggauaaggcaaaagcuccaaucccauuuuucaguucuccuag

SEQ ID NO: 290820 - RNA, 64 nt, Human
cccugcugagcugcagcaccugcucuaggggacgagcuccaagcaaagccuggcucugggaaaa

SEQ ID NO: 290821 - RNA, 64 nt, Human
gccaucuguggggcaggcacacacaccucccgccagcuccaauuuugcacuuuuucccugcuug

SEQ ID NO: 290822 - RNA, 64 nt, Human
caagcauaauccacuucaauguaauauuuucuguagcuccaaaggcuaucucuucauauugacu

SEQ ID NO: 290823 - RNA, 64 nt, Human
ucucguguacagauagaccggccucgccccuuccagcuccaagggcuacaucaaccgaccuuuc

SEQ ID NO: 290824 - RNA, 64 nt, Human
ugagagaagugcucugccugccagugcagugcccagcuccaaggcucuagaggguguucaggug

SEQ ID NO: 290825 - RNA, 64 nt, Human
cuuggccccugccugcgucugugcucaaagcagcagcuccaacccugccucuguccccuucccc

SEQ ID NO: 290826 - RNA, 64 nt, Human
uguuuccuuaggccugggguaggggauggagagcagcuccaaggcugagcuggggcucuggccc

SEQ ID NO: 290827 - RNA, 64 nt, Human
gugacaucucaucagcucccuauugucaagaaguagcuccaaagucuuugagcccuuucccagu

SEQ ID NO: 290828 - RNA, 52 nt, Human
cuguucccgccguccucugaggagcuccaagccaacaaggcuacacuggugu

SEQ ID NO: 290829 - RNA, 64 nt, Human
gcccauggcagccaacuauaaugucuuccucaacagcuccaagcuagcugaguggcguaugcag

SEQ ID NO: 290830 - RNA, 64 nt, Human
gacagggaagucuccgcccugauuggaugaggaaagcuccaacccagucuccuaagcgacuggc

SEQ ID NO: 290831 - RNA, 64 nt, Human
gcagaacuuagggucagggucucagggaacccugagcuccaagcgugcugugcgucugaccugg

SEQ ID NO: 290832 - RNA, 64 nt, Human
gcugcccuccccagaccaccccggcagccugagcagcuccaaagcacuggcuugggguccgaga

SEQ ID NO: 290833 - RNA, 64 nt, Human
ucugguccagcugccccacccagcugcccuuaucagcuccaagucccucucugagccuuuauug

SEQ ID NO: 290834 - RNA, 64 nt, Human
cccuugugcaagaucacauagucaggaggugacacagggcuaagacuugaaccaaggcucuaag

SEQ ID NO: 290835 - RNA, 64 nt, Human
agacagagguccaggguggguuacauagcacauccagggcuaagcaagaaauaauucagagguc

SEQ ID NO: 290836 - RNA, 64 nt, Human
guauaaagaucacccguuguauucaccccacacccagggcuaguauaaacaugacccugggcuu

SEQ ID NO: 290837 - RNA, 64 nt, Human
cacaucccccccaaccuacccccaccccaaaagcagcuccaacagaauggccagagggccucag

SEQ ID NO: 290838 - RNA, 64 nt, Human
uauagccauuaaagaaagcacuaaggaugaugggagcuccaaaucugauaucagauaauuuaga

SEQ ID NO: 290839 - RNA, 64 nt, Human
guagggccaccacuacgccuucacuugucacccaagcuccaaccacagagaguuugacaaguuu

SEQ ID NO: 290840 - RNA, 64 nt, Human
cccauguaccuuauaucccucucugaaacagaacagcuccaauagcaacaagcuaguuguucug

SEQ ID NO: 290841 - RNA, 64 nt, Human
ugggguugcagcucuguucaaacacaauucuaucagcuccaaaaugugugaacuugacuugugu

SEQ ID NO: 290842 - RNA, 64 nt, Human; identical to SEQ ID NO: 235155

SEQ ID NO: 290843 - RNA, 64 nt, Human; identical to SEQ ID NO: 235156

SEQ ID NO: 290844 - RNA, 64 nt, Human; identical to SEQ ID NO: 235157

SEQ ID NO: 290845 - RNA, 64 nt, Human; identical to SEQ ID NO: 235158

SEQ ID NO: 290846 - RNA, 64 nt, Human; identical to SEQ ID NO: 235159

SEQ ID NO: 290847 - RNA, 64 nt, Human
agggcugguauuaauaaaaguuagcuuuuaucugcagggcuagguuaaggcuggcauucuuacu

SEQ ID NO: 290848 - RNA, 64 nt, Human
uuuuucuucauucagcuuagccuuucuguuuggccagggcuacuuacaggggcuguugggguug

SEQ ID NO: 290849 - RNA, 64 nt, Human
acaguucuguauaccaaaguggcuauaucaacaucagggcuagcacaucuuucucuauuauccu

SEQ ID NO: 290850 - RNA, 64 nt, Human; identical to SEQ ID NO: 235160

SEQ ID NO: 290851 - RNA, 64 nt, Human; identical to SEQ ID NO: 235164

SEQ ID NO: 290852 - RNA, 64 nt, Human; identical to SEQ ID NO: 235165

SEQ ID NO: 290853 - RNA, 64 nt, Human; identical to SEQ ID NO: 235166

SEQ ID NO: 290854 - RNA, 64 nt, Human; identical to SEQ ID NO: 235167

SEQ ID NO: 290855 - RNA, 64 nt, Human; identical to SEQ ID NO: 235168

SEQ ID NO: 290856 - RNA, 64 nt, Human; identical to SEQ ID NO: 235169

SEQ ID NO: 290857 - RNA, 64 nt, Human; identical to SEQ ID NO: 235170

SEQ ID NO: 290858 - RNA, 64 nt, Human; identical to SEQ ID NO: 235171

SEQ ID NO: 290859 - RNA, 64 nt, Human; identical to SEQ ID NO: 235172

SEQ ID NO: 290860 - RNA, 64 nt, Human; identical to SEQ ID NO: 235173

SEQ ID NO: 290861 - RNA, 64 nt, Human; identical to SEQ ID NO: 235174

SEQ ID NO: 290862 - RNA, 64 nt, Human; identical to SEQ ID NO: 235175

SEQ ID NO: 290863 - RNA, 64 nt, Human; identical to SEQ ID NO: 235176

SEQ ID NO: 290864 - RNA, 64 nt, Human
ucccacuuuccaagggcuccaggaaucuggggccugaccacagauuccucucccauccuuuucu

SEQ ID NO: 290865 - RNA, 64 nt, Human
caggcccacacaacuggccaccucuucccguuaaugaccacagcagacagaauuugagcccagc

SEQ ID NO: 290866 - RNA, 64 nt, Human
cugugacaagcaugccagaaguggcaggggccaucagggcuaaccacuucacaccuaccaucgu

SEQ ID NO: 290867 - RNA, 64 nt, Human
ggcucucggugccgaagauugccugccagaggacugaccacagccuggcuggcagcugcucugu

SEQ ID NO: 290868 - RNA, 64 nt, Human
agacagaggcccggugacacaguucagccaggacugaccacagggcucuagagcucucuuuggu

SEQ ID NO: 290869 - RNA, 64 nt, Human
accuaaaacauucuccucggaaauuacauggugcugaccacaaaguuucuggauguuuuauuaa

SEQ ID NO: 290870 - RNA, 64 nt, Human
ggaagcaguuuaaauagcccuguucucauuacucugaccacauacaucauagggugcuaaaguu

SEQ ID NO: 290871 - RNA, 64 nt, Human
uuauuguuuauagauuaaagcguuuauuuuauaaugaccacauuguuuuaaaugcgacaguagc

SEQ ID NO: 290872 - RNA, 64 nt, Human
auguuauaugaacuaauuguauuguuuuauacugugaccacaaauauuaugcaaugcaccauuu

SEQ ID NO: 290873 - RNA, 64 nt, Human
acagaaccuguccucccaggcuguuccugaggccugaccacaguauuuauuuuggcaugucucu

SEQ ID NO: 290874 - RNA, 64 nt, Human
auagcaauuuucuguggcacugagaaaccauguaugaccacaauaaaaauccauuuugugaaag

SEQ ID NO: 290875 - RNA, 64 nt, Human
gugucagucccuguggccuuccuuggggcuucucugaccacaugugcccaacuucaauaagaga

SEQ ID NO: 290876 - RNA, 64 nt, Human
cuuacaaaacaaauuccacaaagaacacccuauaugaccacagcugcagaucaguucuuagcaa

SEQ ID NO: 290877 - RNA, 64 nt, Human
aaugaacuacuuucaugagcaguuguagcaggccugaccacagauucccagagggccaggugug

SEQ ID NO: 290878 - RNA, 64 nt, Human
guguuuacuaugugcaacgguauugaaguucuuaugaccacagaucaucaguacuguugucuca

SEQ ID NO: 290879 - RNA, 64 nt, Human
cccugccccuggcaagcccugaagucgggagaggugaccacaggucugaaaaucagccagugcc

SEQ ID NO: 290880 - RNA, 64 nt, Human
caacugagcccacauagcgcauucauaguuucccugaccacagccuugggaagacgguggaaac

SEQ ID NO: 290881 - RNA, 64 nt, Human
uuguuagagcuuauuaguacagguucucaagagaugaccacauaaaagugcucuguuuauaaau

SEQ ID NO: 290882 - RNA, 64 nt, Human
ggcggcugggcagagcacaucccccaggacuugaugaccacacggggcagagagaaaccaacca

SEQ ID NO: 290883 - RNA, 64 nt, Human
uguaccuuacagcucacguaaugccugcuggcgcugaccacacagcuccuuccuccucucccag

SEQ ID NO: 290884 - RNA, 64 nt, Human
cgaagacccuuauuacacggaaaacgguggaggccagggcuauagcucaggaccugggaccucc

SEQ ID NO: 290885 - RNA, 64 nt, Human
augagagucagagccuuuggaaaggcugcauccccagggcuagagcucagaugaccuuauuucu

SEQ ID NO: 290886 - RNA, 64 nt, Human
guggcuuaaggaagugugaagauaugauccaguccagggcuaggcucagccaccugucuccugu

SEQ ID NO: 290887 - RNA, 64 nt, Human
gaaacuuuccuaccagaaagcuuugucucaagccugaccacaagagacaugauggaguuucaug

SEQ ID NO: 290888 - RNA, 64 nt, Human
uaggaagucuuguccuagaacgcccuggcugguaugaccacaguucauggcggcucuucucgcu

SEQ ID NO: 290889 - RNA, 64 nt, Human
gagcucaguaaccuggacggcucuaaggcuggaaugaccacauagguagguauggugaguucaa

SEQ ID NO: 290890 - RNA, 64 nt, Human
cuugagcacaggaguuugaggcugcagugaccuaugaccacaucacuguacgccagcccgggug

SEQ ID NO: 290891 - RNA, 64 nt, Human
cuuucucuuugagguggagagacccauaaagccuugaccacaucacuccauauggggaggagaa

SEQ ID NO: 290892 - RNA, 64 nt, Human
agcuccauucuggccuccuccaccaccugccuugugaccacaucucccaccacguccccagauc

SEQ ID NO: 290893 - RNA, 64 nt, Human
auguaguagccucauuuaccaucguuuguauuacugaccacauaugcuugucacugggaaagaa

SEQ ID NO: 290894 - RNA, 64 nt, Human
uacacugugcuaggcgcauucuaggacaugaauaugaccacacccucuuucaccggguguuucu

SEQ ID NO: 290895 - RNA, 64 nt, Human
agagguucuuauuugucgauuuuauuuuauaauuugaccacagcaucugaacucccucucuccc

SEQ ID NO: 290896 - RNA, 64 nt, Human
ggacuacuuuuuuuuuuuuuccucaagcuucaggugaccacaauagcaacaccucccuauucug

SEQ ID NO: 290897 - RNA, 64 nt, Human
uagauggacaggcugagguguuuggcagugaugaugaccacauucaguuugugcagguacacau

SEQ ID NO: 290898 - RNA, 64 nt, Human
caagucucaacauccuaucagugacucugcucccugaccacacaucggaagggcuggaugaccc

SEQ ID NO: 290899 - RNA, 64 nt, Human
uuucuccuuuccagaccccuacucugugcagugcugaccacagcuagagccaccgccccauugc

SEQ ID NO: 290900 - RNA, 64 nt, Human
cugugggauuugcagaguguuucuuccaugucuuugaccacaggguuguugcugcccaggcucu

SEQ ID NO: 290901 - RNA, 64 nt, Human
aacagcucuuguuggucugagaaggcaggauaagugaccacauauuuaugccacuaccuccacc

SEQ ID NO: 290902 - RNA, 64 nt, Human
uggaccuguggcuucucugaggcccuugaguaacugaccacauuuggagguuuugcuggaaaug

SEQ ID NO: 290903 - RNA, 64 nt, Human
augcacucgucauuugcauacgacaguagcauucugaccacacuuguacgcuguaaccucaucu

SEQ ID NO: 290904 - RNA, 64 nt, Human
gauauuccuggacauccagauagcucacaugugcugaccacacuucaggcucuggacuggagcu

SEQ ID NO: 290905 - RNA, 64 nt, Human
uaaaaacucuauuuauaccuuaacaugaaauccaugaccacaccaaacuugguuauucauaauu

SEQ ID NO: 290906 - RNA, 64 nt, Human
uucuuccgccccagcggagugcgcuggggcgcgccagggcuaggcccgccggaggagcgcgucc

SEQ ID NO: 290907 - RNA, 64 nt, Human
gcagcuugaaacuggcuuuaccaaucuugaaauuugaccacaagugucuuauauaugcagaucu

SEQ ID NO: 290908 - RNA, 64 nt, Human
auucgauuuuuaauuauugaaaguaugucaccauugaccacauguaacuaacaauaaauaauau

SEQ ID NO: 290909 - RNA, 64 nt, Human
ccugcugaguuggaaauuccagugcagcacugauugaccacaguugccaaucuaaaagcacaaa

SEQ ID NO: 290910 - RNA, 64 nt, Human
aucuucauugucuuaccucugaaggaauagaaccugaccacauuauuaugaaacauuauggcug

SEQ ID NO: 290911 - RNA, 64 nt, Human
uguuuagucucgcuaaaguuauauuugucuguuaugaccacagaguuauauguguguguaucaa

SEQ ID NO: 290912 - RNA, 64 nt, Human
uugacuuucuuccugacuagguuugcauauauggugaccacaguacuucuuaguguauugguga

SEQ ID NO: 290913 - RNA, 64 nt, Human
guggccuuuccauucaugugcauuuuucugccacugaccacaagacgauuuccugaguuuugua

SEQ ID NO: 290914 - RNA, 64 nt, Human
aaaaaagcuagagacccuuuuugcaaacauuuggugaccacacauuugagggaagacguggcgu

SEQ ID NO: 290915 - RNA, 64 nt, Human
uauuuuuaaacuauagcuuacaaaauacauucucugaccacagucuccuccuugauauacaagg

SEQ ID NO: 290916 - RNA, 64 nt, Human
gccccccuccgguuuagaaagaggaacaccagauugaccacauucccaacuagaaaaaucuucu

SEQ ID NO: 290917 - RNA, 64 nt, Human
caacaaaguuccagcuuguguagucucuuuuuauugaccacaugaaucgaaaacacucaucaca

SEQ ID NO: 290918 - RNA, 64 nt, Human
gcaaugauauuaugagggauaugagauaggugacugaccacaaagaagaaaauucugucucaaa

SEQ ID NO: 290919 - RNA, 64 nt, Human
uuaaaauuaccauuacuuguuuuuuaaaaacacaugaccacauauguauauguauaucuaccua

SEQ ID NO: 290920 - RNA, 64 nt, Human
gucagcauuaaugaaacucauguuuaaacuucucugaccacaucgucaggauagaauucuaacu

SEQ ID NO: 290921 - RNA, 64 nt, Human
augaaauaugaacuaucucauuagaagucauaguugaccacagacauguuauucuucugaaaga

SEQ ID NO: 290922 - RNA, 64 nt, Human
cccucugaggguucuggaaucugugcaccuuauuugaccacacuccaaaauucuguuuuuauuu

SEQ ID NO: 290923 - RNA, 64 nt, Human
aucugcaggucuugccagugaaccccuggacaacugaccacacccacaaggcauccaaagucug

SEQ ID NO: 290924 - RNA, 64 nt, Human
auuacagccagaugggggcugaagaccauccucuugaccacagaggugugacugugggaauucc

SEQ ID NO: 290925 - RNA, 64 nt, Human
ugugauugaaaauaagucuaaacagcuguaaaagugaccacaaugacaugaaauaaauuuaaua

SEQ ID NO: 290926 - RNA, 64 nt, Human
gaugaucaucugucccaggucacacuccuucauuugaccacauggccuauuugcaacuucuuuu

SEQ ID NO: 290927 - RNA, 64 nt, Human
cccagccgacuuccacugggcugacagacuuugcugaccacaggggaacgauguucuuuucuuu

SEQ ID NO: 290928 - RNA, 64 nt, Human
cuaguuacguagccgcugcucacgcgcucacuccugaccacaugcacguucccuagaugcagac

SEQ ID NO: 290929 - RNA, 64 nt, Human
ggacccugucuucugggcacaguggacucagcagugaccacaccaacacugacccuugaaccaa

SEQ ID NO: 290930 - RNA, 64 nt, Human
uacccaacugacuugcuuagguaccuggcagcugugaccacagcucaaguaaaaaaacaaaaac

SEQ ID NO: 290931 - RNA, 64 nt, Human
guacaugauugccaaucugcauuucuuaccagugugaccacacuguuacgaugcaauucuagcc

SEQ ID NO: 290932 - RNA, 64 nt, Human
uugcucucacuaguugucagcuucucuggauaagugaccacagaagcaggaguccuccugcuug

SEQ ID NO: 290933 - RNA, 64 nt, Human
gaucauuauuauauauagguauugauugcuacccugaccacagugcuuuggacuaugagaaacu

SEQ ID NO: 290934 - RNA, 64 nt, Human
uuuauacaccaauugauuuuaaaccauaaaaagcugaccacaggcaguuacuucugagggcauc

SEQ ID NO: 290935 - RNA, 64 nt, Human
gcagagaaugacagcaaacagaucacuaggccucugaccacaggugcugaguacucagcagccc

SEQ ID NO: 290936 - RNA, 64 nt, Human
gacuacugaaaugucauuuuaguuauuuuucuuaugaccacauuguacaaaugaaucuguguua

SEQ ID NO: 290937 - RNA, 64 nt, Human
gcccgggacccgccuggucuuucagccaugcugaugaccacaccccguccaggccagacaccac

SEQ ID NO: 290938 - RNA, 64 nt, Human
cacauauaaggguaggguugggauuaccauuuacugaccacaucugugaggugccgagcugggu

SEQ ID NO: 290939 - RNA, 64 nt, Human
cacaagcaauauuagcagggcuucuguuucuaagugaccacagacuaacccuuucuaggcuuua

SEQ ID NO: 290940 - RNA, 64 nt, Human
uaaagguaucacggucgccaccuggcauuccuucugaccacagcaucauuuugcauucaaauua

SEQ ID NO: 290941 - RNA, 64 nt, Human
aagguaaacguuauggcugaaauaguaaagcaccugaccacaaaaccucuuguaaaaacagccc

SEQ ID NO: 290942 - RNA, 64 nt, Human
uggccggcccuguggucggaccuggcuacagcccugaccacagcaucuucccagugacggagcg

SEQ ID NO: 290943 - RNA, 64 nt, Human
ugaaaacuaaagagacuauuacuuccuuuucacaugaccacaaguccucugauggaaauguaca

SEQ ID NO: 290944 - RNA, 64 nt, Human
caaggacuuuccaaauggaguuuucaaauacuauugaccacauugcucuaguuaauguaagguc

SEQ ID NO: 290945 - RNA, 64 nt, Human
gcucuguuuguuuagaugccaagguuuccauuuucagggcuauaaaaaguauuacuuggaaaug

SEQ ID NO: 290946 - RNA, 64 nt, Human
uacaagaagggcgagugagggcacagcggggccccagggcuacccucccccaggaggucgaccc

SEQ ID NO: 290947 - RNA, 64 nt, Human
aaauuugacauuucacagaugcacuuacauauuuugaccacaagggggaaauuuugugcauuau

SEQ ID NO: 290948 - RNA, 64 nt, Human
cccugcugucgggccccaggccguuguccugcucugaccacagaguuuuaauguuuugguuuuc

SEQ ID NO: 290949 - RNA, 64 nt, Human
aguaggggaagacaugcagccuaaggcuguaugaugaccacacguuccuaagcuggagugcuua

SEQ ID NO: 290950 - RNA, 64 nt, Human
cagacauaacauucaauuuuucauuuaugcuaagugaccacaguauacaaaguaauaagcagga

SEQ ID NO: 290951 - RNA, 64 nt, Human
caucagucccugagucaccauggaagcagcauccugaccacagcuggcagucaagccacagcug

SEQ ID NO: 290952 - RNA, 64 nt, Human
gaaagccgucaggggcagugggcggcuucccggcugaccacaguggcuuggacugugaggguag

SEQ ID NO: 290953 - RNA, 64 nt, Human
ggaguccccguucacacugaggaacggagaccugugaccacagcaggcugacagauggacagaa

SEQ ID NO: 290954 - RNA, 64 nt, Human
uugcagauuugaaacuaacccagaacuucuaacuugaccacacaaggcaguugcccaaaccauu

SEQ ID NO: 290955 - RNA, 64 nt, Human
uaacacacaccauauauaaaacagccuuucuggcugaccacaugguuaaaugcauaccuuccca

SEQ ID NO: 290956 - RNA, 64 nt, Human
cauugaagguggucauuccuucaaaacuguguuuugaccacacaaggugggcauuaacaaacca

SEQ ID NO: 290957 - RNA, 64 nt, Human
gugucuucauugccucucuccccuuggcgucugaugaccacagcaaagcacugggaauuucuac

SEQ ID NO: 290958 - RNA, 64 nt, Human
ucaucaucuguaacuguugagauguaugugcaugugaccacaaaugcuugcuuggacuugccca

SEQ ID NO: 290959 - RNA, 64 nt, Human
cuuaucaauuuggcaagcuacuuaucaaccagacugaccacaagaacugucaucucaucaauga

SEQ ID NO: 290960 - RNA, 64 nt, Human
cauuuucugugggcaggccucgaaaaccaucacaugaccacauagcaugaggccacugcugcuu

SEQ ID NO: 290961 - RNA, 64 nt, Human
ugaugggcagcaaaccugcuguuuaacaucagggugaccacauuaagcccaguauuccaguugg

SEQ ID NO: 290962 - RNA, 64 nt, Human
ucugaauauuuuguaauaaaggucuuugcacaugugaccacauacguguuaggaggcugcaugc

SEQ ID NO: 290963 - RNA, 64 nt, Human
uugccuccaccucuccuuggaaauacuuuaucugugaccacacgcugucucuugagaauuugga

SEQ ID NO: 290964 - RNA, 64 nt, Human
guggcuugagaauuuaucaaucaucuuuccgaaaugaccacauugugcuuuuaguuuguauguu

SEQ ID NO: 290965 - RNA, 64 nt, Human
ugguggcugccacuagcccaggaacaugacaacgugaccacaccacacaugccuccaacacaca

SEQ ID NO: 290966 - RNA, 64 nt, Human
gccacuccaggaggaagucgggaggcguggagggugaccacaccuuggccuucugggaacucuc

SEQ ID NO: 290967 - RNA, 64 nt, Human
auccuugcuuugagucaggcugugggcaaguuccugaccacagggaguaaauuggccucuuuga

SEQ ID NO: 290968 - RNA, 64 nt, Human
auauaaaggucaaucauuuauaauagaaacaccuugaccacaagcccuugauugaacauuuuau

SEQ ID NO: 290969 - RNA, 64 nt, Human
aggcauuugacuccuacagcagaaguucugagccugaccacagaugguguguaaucuaucaaac

SEQ ID NO: 290970 - RNA, 58 nt, Human
cugcaggacucgugagcugaagugcagaugaccacauucaagggggaaccuucugccc

SEQ ID NO: 290971 - RNA, 58 nt, Human
uugcaggauuccugagcugaaaugcagaugaccacauucaaggaagaacuuucugccc

SEQ ID NO: 290972 - RNA, 64 nt, Human
acuugcugugugcgaagaucgccuugcuuuacugugaccacagccccgacgcggggcuguuuaa

SEQ ID NO: 290973 - RNA, 64 nt, Human
gaccuggaggccaccgagaggcuggggcuggggcugaccacaacauccuuccugugguugcugg

SEQ ID NO: 290974 - RNA, 64 nt, Human
augucuuguauaguucauauucauggcugaaacuugaccacacuauugcugauuguaugguuuu

SEQ ID NO: 290975 - RNA, 64 nt, Human
cgagauaacuugacaaucaguuccauggacauggugaccacagccagcuggaaccugaagucua

SEQ ID NO: 290976 - RNA, 64 nt, Human
gggggccuggccagucauugacagacggacuuguugaccacacgccccucaccaaacaaugcag

SEQ ID NO: 290977 - RNA, 64 nt, Human
acccugguaacaacucaugugcaacugguagucuugaccacauuccauccauuuccucagguuu

SEQ ID NO: 290978 - RNA, 64 nt, Human
uucuaauuuuggcccuaccuguaacuuaauuuugugaccacaguuguaccauucaccgugccug

SEQ ID NO: 290979 - RNA, 64 nt, Human
acuacaaucugugcagacagcauggacacaaagaugaccacaaggggcccaaaacagaaaagag

SEQ ID NO: 290980 - RNA, 64 nt, Human
uucaccauguuggccagggcuggucucgaacuccugaccacagguaaucagcccgccucggccu

SEQ ID NO: 290981 - RNA, 64 nt, Human
cuuaaguacuccugauucuuaacauugucuuuaaugaccacaagacaaccaacagcuggccacg

SEQ ID NO: 290982 - RNA, 64 nt, Human
gaccccggccucggagcccgucuggcacccagagugaccacaaguccagcagggaggcggcgcc

SEQ ID NO: 290983 - RNA, 64 nt, Human
gggaugcgaugcguaggugccuuucucuuccugcugaccacaagcucugugcuggggguaccug

SEQ ID NO: 290984 - RNA, 64 nt, Human
ugucccucauuuugcugugacacccugaaaaagcugaccacaaaugcaguauuaucuugacaua

SEQ ID NO: 290985 - RNA, 64 nt, Human
cugggguaaaaaaacccugcugaagagaggacagugaccacagaacucaguguaccaaacaugc

SEQ ID NO: 290986 - RNA, 64 nt, Human
aaccuggguauagugcagaaaacguggcacacacugaccacacauuaggcugugucaccauugu

SEQ ID NO: 290987 - RNA, 64 nt, Human
auaauaauuauggguaugaaaaugacucuucauaugaccacauaugugaaaguauauauaugug

SEQ ID NO: 290988 - RNA, 64 nt, Human
aauuguacuuuaggcuauauuucuaagagcgaaaugaccacagccaaagguaugaacauuguuc

SEQ ID NO: 290989 - RNA, 64 nt, Human
uugaaaaugguuuugaugucaacacucuacuugcugaccacauuucccagagcuaugacgauga

SEQ ID NO: 290990 - RNA, 64 nt, Human
cucguggaaagggaaaggggaggagaugggacuuugaccacacacagugaugccucacacccug

SEQ ID NO: 290991 - RNA, 64 nt, Human
cugggccugaucucuaaccccgucaugcugcugcugaccacacccagccaaccugccccucccu

SEQ ID NO: 290992 - RNA, 64 nt, Human
aacucacuccaggccaagugugccuuagcacgagugaccacaguuuaauagaccacacacaucg

SEQ ID NO: 290993 - RNA, 64 nt, Human
gagggccugaucccaggagacaccagggccagagugaccacagcagggcaggcaucaugugugu

SEQ ID NO: 290994 - RNA, 64 nt, Human
gauacaggugacagugaagauagaagaaccacgaugaccacagacucaaugugcucuguaacau

SEQ ID NO: 290995 - RNA, 64 nt, Human
uaguuauucagacaaaauuuggaaacuuauuuuaugaccacaucuaauauucuggcugcuuugg

SEQ ID NO: 290996 - RNA, 64 nt, Human
gcugacuaagaaucccuaagccuagcugggaaggugaccacauccaccuuuaaacacggggcuu

SEQ ID NO: 290997 - RNA, 64 nt, Human
ucuccacagagaccccauuuaaauaacacaaaauugaccacagugauuagaugaaaaaauuauu

SEQ ID NO: 290998 - RNA, 64 nt, Human
agggaauagauuagauuagaacacucgcacaagaugaccacauauagaagcagaaagccccaaa

SEQ ID NO: 290999 - RNA, 64 nt, Human
guccccaguuauuaugaaaccaccaauaacccacugaccacagugagaaccacugauuuuuucc

SEQ ID NO: 291000 - RNA, 64 nt, Human
gcucccgggcucacucaaggagacugcggcauguugaccacaccagacuggguuucagggaaug

SEQ ID NO: 291001 - RNA, 64 nt, Human
gaaacugccuucaaggccacggcuggucaucugcugaccacaccccagauccgcccucuccugc

SEQ ID NO: 291002 - RNA, 64 nt, Human
agcucaacagaucugcauuuggcugcuucucuugugaccacaauuaucuugccuuauccaggaa

SEQ ID NO: 291003 - RNA, 64 nt, Human
gcugugacagcagcugggccaggaggccguguaaugaccacacacuccucucaagcaaaaaaug

SEQ ID NO: 291004 - RNA, 64 nt, Human
aggcuuucugcacuuucugcacccccuuccaaagugaccacaaaauuucaaagggacucauaca

SEQ ID NO: 291005 - RNA, 64 nt, Human
cucuucagaccccuguuaaucucucaguuuucugugaccacaacuauacuguggaggauacaau

SEQ ID NO: 291006 - RNA, 64 nt, Human
ucuucucagcaccacaucacacuuauuuccacauugaccacauaguuggaaguaaagcacuccu

SEQ ID NO: 291007 - RNA, 64 nt, Human
gaaaguuagaggaacugaaaguuugggaauaggcugaccacauauuaugccagugaccaguaug

SEQ ID NO: 291008 - RNA, 64 nt, Human
acauucuuuucuucugcuucccuugccuauuugcugaccacacuccggcuccuaugucaccuug

SEQ ID NO: 291009 - RNA, 64 nt, Human
ucuuaauguugcacauaaguuuauacagaguggaugaccacacuagcacagaagagaacaacau

SEQ ID NO: 291010 - RNA, 64 nt, Human
aaugguuauaaagucauauccacuucuuccacaaugaccacagcaaaugaccaagcaugaacua

SEQ ID NO: 291011 - RNA, 64 nt, Human
gcggaauggcuuuagaggcagaugaaguggucuuugaccacaguugauugaaccagagcacuua

SEQ ID NO: 291012 - RNA, 64 nt, Human
uuagauuauggugcuuuacaaagagagugguccaugaccacacuuagugagaaggagccacaag

SEQ ID NO: 291013 - RNA, 64 nt, Human
uauauauuuaucuguguuuuaagauugugcauauugaccacaauuguuuuuauuuuguaaugug

SEQ ID NO: 291014 - RNA, 64 nt, Human
uaucuuuuaaagauauaauaauaggauguaaacuugaccacaacuacuguuuuuuugaaauaca

SEQ ID NO: 291015 - RNA, 64 nt, Human
ggaacugggccucgguggccggggccgcgagcugugaccacagcacccucaagcauacggcgcu

SEQ ID NO: 291016 - RNA, 51 nt, Human
gucggacuugugaguccuaggugaccacacugcuucccuuucucaguuccu

SEQ ID NO: 291017 - RNA, 64 nt, Human
uugaaguuucugaagguugacgucacuggaagucugaccacaaacaaguuggcuguuacuguau

SEQ ID NO: 291018 - RNA, 64 nt, Human
augacacgggcuuggucuuugccaccagcaugccugaccacaguauucaccugguguuguggaa

SEQ ID NO: 291019 - RNA, 64 nt, Human
uugugcaguucccgcaggccaugcagcgcugccgugaccacaugauacguagccuacagucagu

SEQ ID NO: 291020 - RNA, 64 nt, Human
aaccaggaaauugcuccucucagccaaccaagguugaccacacaccacccuuccggagcagcuc

SEQ ID NO: 291021 - RNA, 64 nt, Human
uuauuugguguuugcuugaaugcugguacuauugugaccacaggcugguguguaggugguaaaa

SEQ ID NO: 291022 - RNA, 64 nt, Human
ccucgcugcuguuccacugucugcucccguguucugaccacagcucuggugccguuucucaagc

SEQ ID NO: 291023 - RNA, 64 nt, Human
gucccucugccccucccaccugcacaugucacacugaccacaucuguagacaucuugaguugua

SEQ ID NO: 291024 - RNA, 64 nt, Human
caggaaaggggaaaaggaacuuugccaaugauagugaccacagcaaaagcaaauaauaauaaua

SEQ ID NO: 291025 - RNA, 64 nt, Human
acauuagaacacagaaucauuuacauccuaauacugaccacaguucacuaaagcucaguagcau

SEQ ID NO: 291026 - RNA, 64 nt, Human
acacaauugugcugaaucugucugacuauaacucugaccacacagaaccagggcugccccugua

SEQ ID NO: 291027 - RNA, 64 nt, Human
caaaggaaugcggucuaaccacaggcugcccugcugaccacacuaccuggaccugggaggacuu

SEQ ID NO: 291028 - RNA, 64 nt, Human
caagaucuguugcccaagauguuacaggucacaaugaccacauuugaaauuguuuucccuuuca

SEQ ID NO: 291029 - RNA, 64 nt, Human
uaugauagacuccuauuuuucuuguuuuauauuaugaccacacacaucucugcuggaaagucaa

SEQ ID NO: 291030 - RNA, 64 nt, Human
gucacuguuccauugcagaccagacuugcuggccugaccacaagggaguggcugggaacucaca

SEQ ID NO: 291031 - RNA, 64 nt, Human
uaagcaagcucagaccugcccccaguucaguacuugaccacaucccaggauuuauggugucugu

SEQ ID NO: 291032 - RNA, 64 nt, Human
ccugucaauccagaacugccucugagcuccaggcugaccacagaucagccacagccugaugccu

SEQ ID NO: 291033 - RNA, 64 nt, Human
agccccaaggcuuugacaaccaggcguuccucccugaccacaaggccaacugggcgcccguccc

SEQ ID NO: 291034 - RNA, 64 nt, Human
gccccauccuucccgccuccgggcauaaggccccugaccacacuucagaagccccauccccccu

SEQ ID NO: 291035 - RNA, 64 nt, Human
uuaggaccauacgcaccugugacaagggcuguguugaccacagucacacuguggcaugacugga

SEQ ID NO: 291036 - RNA, 64 nt, Human
uauacacacuccuguuauucugggauaagauaaaugaccacaguaccuuaauuucuaggugggu

SEQ ID NO: 291037 - RNA, 64 nt, Human
ugaccaaugagcagugggcccuacucugcaccucugaccacaccuuggcaagucuuucccaagc

SEQ ID NO: 291038 - RNA, 64 nt, Human
uacugaucaugugcacucguacaguauauuacugugaccacaaggauguggcaaagauucucau

SEQ ID NO: 291039 - RNA, 64 nt, Human
guucgaucagugggucuuuuggcacuuugaaccuugaccacagggaccaagaaguggcaaugag

SEQ ID NO: 291040 - RNA, 64 nt, Human
accaggucggugcaguauuugauuucuggugaggugaccacagcugcaguuagggaagggagcc

SEQ ID NO: 291041 - RNA, 64 nt, Human
cauuuuauauuuaguuccuuccccagucaacaacugaccacaucugccucugccugagcauuag

SEQ ID NO: 291042 - RNA, 64 nt, Human
caaaaagauuaaacaaaaaauacuauaaaaccccugaccacauuuaaaaaaugauaauaaaagu

SEQ ID NO: 291043 - RNA, 64 nt, Human
uaaaaugagaaguccaaggucaucucuggcccagugaccacagagagaucugcaccucccggac

SEQ ID NO: 291044 - RNA, 64 nt, Human
ggaggaaugucugagcagagucaagcaacuggcuugaccacagucugaagcaaggugccacuua

SEQ ID NO: 291045 - RNA, 64 nt, Human
aucccagcucagaagacacccuucaacccugggaugaccacaauuccuuccaauuucugcggcu

SEQ ID NO: 291046 - RNA, 64 nt, Human
aucagggcaggagagaauauaauugugaaggagucagggcuaacaccuggaucuccagaaaccu

SEQ ID NO: 291047 - RNA, 64 nt, Human
agaccugggucaguucuuugcuggugguccccucugaccacaagcuucugccugaagauuccuc

SEQ ID NO: 291048 - RNA, 64 nt, Human
ccacauggcaggucugcuguguccacaccacagaugaccacaucuaauccugcuucuacucuca

SEQ ID NO: 291049 - RNA, 64 nt, Human
caaguaaaauguuagagggugcgggggugaggacugaccacagauucccuggauaguguagugg

SEQ ID NO: 291050 - RNA, 64 nt, Human
auauguuaaauguauagcuggcaccuuaguugcaugaccacauagaacaugugucuaucugcuu

SEQ ID NO: 291051 - RNA, 64 nt, Human
ggcaagacaacuauaugguuaagaauuuccaguaugaccacacccaauaacuguuauuagagug

SEQ ID NO: 291052 - RNA, 64 nt, Human
uaaugaaaaugaaggucagagagaauaauugcccugaccacauuugccuuucaguaggaggagg

SEQ ID NO: 291053 - RNA, 64 nt, Human
guucugcauauacagugcaucagucuguucucuuugaccacaauuggaauacauuucaagaugg

SEQ ID NO: 291054 - RNA, 64 nt, Human
aaaggauuuuuggaagguaaagaaggcugaauagugaccacaugggccuguuuucaggguccca

SEQ ID NO: 291055 - RNA, 64 nt, Human
cauaugcacccgcaauagaagggcaccacuuggaugaccacaggcacuuaguuuuuggcuaguu

SEQ ID NO: 291056 - RNA, 64 nt, Human
auucuggaacucucuccuuuccuggcuggggcucugaccacaaacuccccuccaggcugccccu

SEQ ID NO: 291057 - RNA, 64 nt, Human
uucuggaaccuucucuccacguggcccacaggccugaccacaggggcuguggguccugcguccc

SEQ ID NO: 291058 - RNA, 64 nt, Human
cauugccuuuuggacauguaaaauauuuaggauuugaccacacaauggcuaugaaaaugcaagu

SEQ ID NO: 291059 - RNA, 64 nt, Human
gaucucuagcuaaucaacacaacccaccaacaaaugaccacagguuggcacuguguggucuuuc

SEQ ID NO: 291060 - RNA, 64 nt, Human
aaggucuaaccaggggguuuucaggggcauugucugaccacauucuuuuuguauccaaauagug

SEQ ID NO: 291061 - RNA, 64 nt, Human
cuaaaacauggucuucuuaauuuucuauauggauugaccacagucuuaucuuccaccauuaagc

SEQ ID NO: 291062 - RNA, 64 nt, Human
cuucauuccggacuggcagaagcauugccuggacugaccacaccaaccaggccuucauccuccu

SEQ ID NO: 291063 - RNA, 64 nt, Human
aaugaagauaauaaugccuaccucagagggaugcugaccacagaccuuuauagcagcccguaug

SEQ ID NO: 291064 - RNA, 64 nt, Human
ggagagaccaauauuugugacauggauaguuucaugaccacaacucauucaaucauuuuauagu

SEQ ID NO: 291065 - RNA, 64 nt, Human
uuucuuaagccaugaugugaaaccaaugacccugugaccacauggcacagaacacuaaauuuug

SEQ ID NO: 291066 - RNA, 64 nt, Human
cgggaggggaugcugaggcugauggagcugccuccagggcuagggccacucaccggaggagggc

SEQ ID NO: 291067 - RNA, 64 nt, Human
cccucggucaccugugcuaccucuaacaccacacugaccacacuguaucgugaguguccguuga

SEQ ID NO: 291068 - RNA, 64 nt, Human
uuggcauaggguggaaagggcuacccuggggcucugaccacacuguaguauguguggagggugc

SEQ ID NO: 291069 - RNA, 64 nt, Human
uuaaaucaugcuguauaaagcaauaacaauugauugaccacaugaaaguguggccugcacuaua

SEQ ID NO: 291070 - RNA, 64 nt, Human
uacauauauauauuuucacuugcuuucaagaugaugaccacacauggauuuugauauguaaaua

SEQ ID NO: 291071 - RNA, 64 nt, Human
uuuuccagacucuaggguuuuccaaugugacuaaugaccacaccugccucucccgucgucucuu

SEQ ID NO: 291072 - RNA, 64 nt, Human
ccugaaaagucaacaacuccucucgaaagaacaaugaccacagucaacauccucugaggaugag

SEQ ID NO: 291073 - RNA, 64 nt, Human
uugaguuaggcuaaauacaucagaaguguucuacugaccacauaagaaguuaguauugccaauc

SEQ ID NO: 291074 - RNA, 64 nt, Human
uaucucagccacuuucagccuuaugcacguagaaugaccacagccacucgcauccguauagcac

SEQ ID NO: 291075 - RNA, 64 nt, Human
ccauagaaaaguaagcuugaacucccaauugaugugaccacacucuucuuaauuuuguucacag

SEQ ID NO: 291076 - RNA, 64 nt, Human
gagcagcaaggccggcuauggagcugccgucgugugaccacagugugaugucucagaagggcuc

SEQ ID NO: 291077 - RNA, 64 nt, Human
ugaaauuuucuauuuaacauuuucagaccacaguugaccacagguaacggaaaccucaaucaca

SEQ ID NO: 291078 - RNA, 64 nt, Human
gaccgucagauugugucaagucaggugugcaaauugaccacacucccaaagaaucauuuaaaag

SEQ ID NO: 291079 - RNA, 64 nt, Human
ggccaggauccgggccccugcccuccucugcaccugaccacacucccuacucagggcuagucug

SEQ ID NO: 291080 - RNA, 64 nt, Human
gggcaggaggagagaggaaaagggagggcgagaaugaccacacaacacagccuuggaccaugag

SEQ ID NO: 291081 - RNA, 64 nt, Human
gccaugugaccauggccucucccugggaacgggcugaccacaacacacccugcugccauccacu

SEQ ID NO: 291082 - RNA, 64 nt, Human
agcacugccagggacugcccugucugcugugcccugaccacaggcugcuucauggcguuacugc

SEQ ID NO: 291083 - RNA, 64 nt, Human
uuccccaagacauucuagguuugcaagaaaaauaugaccacacuccagcugggaucacaugugg

SEQ ID NO: 291084 - RNA, 64 nt, Human
cauggcccuagcagccaguacagugcccugucugugaccacacuccaccuaugugccagggccu

SEQ ID NO: 291085 - RNA, 64 nt, Human
ggcucagaaaugucugugguauugggucagacucugaccacagguuuuaugcuguuuagcacaa

SEQ ID NO: 291086 - RNA, 54 nt, Human
gguggggcccaggguccugaggccugaccacauggcucccucgccugcccuggg

SEQ ID NO: 291087 - RNA, 64 nt, Human
aggagccggucagagauggaccuggccagaugucugaccacaccccaaucucagagcuaacauc

SEQ ID NO: 291088 - RNA, 64 nt, Human
ccgccuguuuuuccagcaaaccacgcuaacuagcugaccacagacuccacaguggggggacggg

SEQ ID NO: 291089 - RNA, 64 nt, Human
uagaacagggaucuuucccaguaucuugagugggugaccacacuugucagugggaggcucuggg

SEQ ID NO: 291090 - RNA, 64 nt, Human
cauauaggaauucagcuccacaaagcuucaggccugaccacagcuggcccucuagguuguuugg

SEQ ID NO: 291091 - RNA, 64 nt, Human
ucccaggggaacacaggcccagaugacaucccuuugaccacaucgcucuaggauaacuggcacc

SEQ ID NO: 291092 - RNA, 64 nt, Human
uccaggagcuaaucugaccguucuauuguguggaugaccacauaagaaggcaauuuuaguguau

SEQ ID NO: 291093 - RNA, 64 nt, Human
agcgggucuaguggaaagauugugucuggucguuugaccacacaccgcccugauuugcuguuuu

SEQ ID NO: 291094 - RNA, 64 nt, Human
ccucugccugagugugcaccaggcccauguuuauugaccacagucugagggggggggaagggga

SEQ ID NO: 291095 - RNA, 64 nt, Human
gagguauggccaugcccuagacccuccccaaggaugaccacacccgaaguccugucacugagca

SEQ ID NO: 291096 - RNA, 64 nt, Human
ccugucagugcagcccguguggccccuucacuucugaccacacuuccuguccagagagagaagu

SEQ ID NO: 291097 - RNA, 64 nt, Human
gcaacaaugucaaugucaacacugagucuaauuuugaccacauuuauagugguauagugucaau

SEQ ID NO: 291098 - RNA, 64 nt, Human
cccuuugcuuguagaauaaagaagugcgcggaagugaccacagaagacccgcucuccaucuucc

SEQ ID NO: 291099 - RNA, 64 nt, Human
caccguccgaauccccgcaggacccauggagcuaugaccacaccaggccauucaaauggcucug

SEQ ID NO: 291100 - RNA, 64 nt, Human
agguugaauuaauuccugggcauggacuaccagaugaccacaaguugcguugaggccgcaucuu

SEQ ID NO: 291101 - RNA, 64 nt, Human
guaaauuaaaugaagauacaguggagaaugggggugaccacaaaagaggcucccccuaaacaca

SEQ ID NO: 291102 - RNA, 64 nt, Human
aagggccuggagcugaguaguagccagucugcugugaccacaggcucagguccgacccugcugc

SEQ ID NO: 291103 - RNA, 64 nt, Human
aguaugugucugguuccuugggugggacgauuccugaccacacuguccagcucuugcucucauu

SEQ ID NO: 291104 - RNA, 64 nt, Human
cccagccuggucauuugcuguccgcuuuucucugugaccacagcagcccugaacaaccaguaug

SEQ ID NO: 291105 - RNA, 64 nt, Human
cugagugcuguacauguauuaguuccuuuacugcugaccacauuguacccauuucacagagaag

SEQ ID NO: 291106 - RNA, 53 nt, Human
cucuccccaggucucggugacucugaccacacccagcucaggacuggauucug

SEQ ID NO: 291107 - RNA, 64 nt, Human
agugucauuuuuauggcaauauugauaacacaaaugaccacaaacuaaaucauaaaauaauuga

SEQ ID NO: 291108 - RNA, 64 nt, Human
ccuucaccuuuuaaguucagggaacaguuuguccugaccacacauauguuaucaguguaaugcu

SEQ ID NO: 291109 - RNA, 64 nt, Human
uggcacuauagccugaugucccacauugacccacugaccacacaggaaaagcagcgaaaccugc

SEQ ID NO: 291110 - RNA, 64 nt, Human
gcagacugcauccgcucauuuuuuguuguuuuugugaccacaaaaacaacgcugcucuuuguuu

SEQ ID NO: 291111 - RNA, 64 nt, Human
gcugauggacagugaccgccacuggcccccaacaugaccacacgugggugcugaacucggggcg

SEQ ID NO: 291112 - RNA, 64 nt, Human
aagaaacuuuuccuucaucauuuccugcacucgcugaccacaacuuuggacaccccaggcugcc

SEQ ID NO: 291113 - RNA, 64 nt, Human
agagagaacugugcuuccaaacagaaaucaggagugaccacaaagccugaaaacacuuugccac

SEQ ID NO: 291114 - RNA, 64 nt, Human
ucaaagaggguguaauaaacuguaauaauaaucaugaccacaaaccauaaaggacugugugaug

SEQ ID NO: 291115 - RNA, 64 nt, Human
ucaaagaggauguaauaaauuguaguaauaaauaugaccacaagccauaaaugacugcaggaca

SEQ ID NO: 291116 - RNA, 64 nt, Human
accacauccacucucaaccccguccccuucgcacugaccacacccaccccguucggccccgccc

SEQ ID NO: 291117 - RNA, 64 nt, Human
acccucaacccauugcgcccaguccccaccacagugaccacacccucacuggcucggcccugcc

SEQ ID NO: 291118 - RNA, 64 nt, Human
uuuuuucagcaccacaccacaccuauuccaaaauugaccacauaguuggaaguaaagcacuccu

SEQ ID NO: 291119 - RNA, 64 nt, Human
aaacccucuccucccuccuccacaccuugagugaugaccacaccaaucacuguauuuuauagcu

SEQ ID NO: 291120 - RNA, 64 nt, Human
aauaauucccuaugcuacccuuaauaacauacaaugaccacauagugugagaacuuccaacaag

SEQ ID NO: 291121 - RNA, 64 nt, Human
guguugcgugaucugugaaaaauacaucucccucugaccacagacuccucaucuguggagaagg

SEQ ID NO: 291122 - RNA, 64 nt, Human
cuucguccaggagcugaggaagcgggguucucccugaccacagggacccagaagacccgcuucu

SEQ ID NO: 291123 - RNA, 64 nt, Human
aaagcucauuaguugagauucugugagucuagguugaccacagaggcaagcacuggugagucua

SEQ ID NO: 291124 - RNA, 64 nt, Human
agauucaugucucuauaaaauagacaguauaucaugaccacacugguuuuuuguuauccuuuga

SEQ ID NO: 291125 - RNA, 64 nt, Human
uucuccacuuuuuuuuuucuugaguagacuucagugaccacacuguggaaaauaccuuugcaga

SEQ ID NO: 291126 - RNA, 64 nt, Human
aaucuguaucagucagcuacugcuguguaacaaaugaccacaaauguagcaaccagaaacaaca

SEQ ID NO: 291127 - RNA, 64 nt, Human
uccagaaagcaaaaggcuuacaaucccuguugucugaccacaguuuaaaauuaauuagaaacua

SEQ ID NO: 291128 - RNA, 64 nt, Human
agcagaaaaauauguauauuauuguaaauagaaaugaccacagcagaaugucacacauggcugu

SEQ ID NO: 291129 - RNA, 64 nt, Human
agcagaaaaauauguauauuauuguaaauagaaaugaccacaucagaaugucacacauggcugu

SEQ ID NO: 291130 - RNA, 64 nt, Human
uggccuaagggcuucucucucaggaccucuaauuugaccacaaccaaccugggcuucagccaca

SEQ ID NO: 291131 - RNA, 64 nt, Human
ugaccuguuugggcuguugccacuuaaaaguucaugaccacaaauguccacagugucuuccucu

SEQ ID NO: 291132 - RNA, 64 nt, Human
ccccuuuuucgggacucuguauucccucuugggcugaccacagcuucucccuuucccaaccaau

SEQ ID NO: 291133 - RNA, 50 nt, Human
ugaacaagcagccauacugaugaccacagcaaccagcuccacggccugau

SEQ ID NO: 291134 - RNA, 64 nt, Human
gagaagaguaggaucacacacacaggugcaaucuugaccacacuuaccugcaagaggaguaacc

SEQ ID NO: 291135 - RNA, 64 nt, Human
uguggggcaggugucucaggacgaaggcgccgcgugaccacaugggcagcucuguucacaaagu

SEQ ID NO: 291136 - RNA, 64 nt, Human
uguauuacuugacaaagagacacugugcagagggugaccacagucuguaauuccccacuucaau

SEQ ID NO: 291137 - RNA, 64 nt, Human
cugcaagacaaauaaaauccaagccauccauuugugaccacagucauaagcauucacuuagcca

SEQ ID NO: 291138 - RNA, 64 nt, Human
cauaccauuagagaaaccauuuguaaaacucaaaugaccacauaaagcuuaucaaggagucuag

SEQ ID NO: 291139 - RNA, 64 nt, Human
augacauccuuguagcauagauggucuauaaugcugaccacagauuucuuagaaaugcugcucu

SEQ ID NO: 291140 - RNA, 64 nt, Human
aaaccccgguuuccuucaacguccacauuccaggugaccacacgugucuccuccuccucaucuu

SEQ ID NO: 291141 - RNA, 64 nt, Human
acugauaugcaaaugauguuuacuacguugguugugaccacaaccucaggcaagugcuacaauc

SEQ ID NO: 291142 - RNA, 64 nt, Human
guccauggcugaguuuauuaguacaugggcuuagugaccacaaaauauuuuauuaagaaacugu

SEQ ID NO: 291143 - RNA, 64 nt, Human
ugaaaacacacuugacccucaggcaggagggcacugaccacaccccacacaaccucaaaggguc

SEQ ID NO: 291144 - RNA, 64 nt, Human
acaugcacacagaccacauagcacacaugugcacugaccacaccuguauagaccaugcacagua

SEQ ID NO: 291145 - RNA, 64 nt, Human
cugacacgaagccagcagaggucagaggggacucugaccacagcccgcucucuggcugucuguc

SEQ ID NO: 291146 - RNA, 64 nt, Human
cucucaccguacauacuccagucuaauuuaaaucugaccacaguugcauggucgcuuuaccaug

SEQ ID NO: 291147 - RNA, 64 nt, Human
uggagggacaaguggacucagggcagcgccaggcugaccacagcacagccaacacgcaccugcc

SEQ ID NO: 291148 - RNA, 64 nt, Human
uucgagcuuuggaucaugcuaugucuguugcaagugaccacaaugugaaagaauuuaagucuuu

SEQ ID NO: 291149 - RNA, 64 nt, Human
ccuuuucuccugcagcauggagcaaucagucaugugaccacacccuccucccucugcccccucc

SEQ ID NO: 291150 - RNA, 64 nt, Human
uccauuccugcaagaguuuuaagcuugagagagcugaccacagggccccccggggaacagggau

SEQ ID NO: 291151 - RNA, 64 nt, Human
acuggcccccggagggagcgacccagccggcggcugaccacaggcaccccggccucuccgagac

SEQ ID NO: 291152 - RNA, 64 nt, Human
cuuucuuaguaauuuggcuucaaagacaaauuuuugaccacaccuccguuuucuccgucagacu

SEQ ID NO: 291153 - RNA, 64 nt, Human
ccccuuccccauuaaugugaguaaugaauuagccugaccacagguggucacuguaggcuaaugg

SEQ ID NO: 291154 - RNA, 64 nt, Human
uuuuauagugaaucucaagggaucaucccauccuugaccacagggacaagaggggcccccucgc

SEQ ID NO: 291155 - RNA, 64 nt, Human
uaucacacacauugcugugaacaggaaacuccugugaccacaacaugaggccacuggagacgca

SEQ ID NO: 291156 - RNA, 57 nt, Human
ggaagccauuaaugaacuaauucguuuugaccacauauauaccaagccccuagucuu

SEQ ID NO: 291157 - RNA, 64 nt, Human
gugaacaaacuacacaagucaucuacaagagcccugaccacagggugagacagcagggcccagg

SEQ ID NO: 291158 - RNA, 64 nt, Human
acuuacaggccuugcucacagcugauugggcaccugaccacacgcccccacaggcucugaccag

SEQ ID NO: 291159 - RNA, 64 nt, Human
caguggaauggagauuucauuuugucagcagcagugaccacagccuuaccaaagcagacgcgug

SEQ ID NO: 291160 - RNA, 64 nt, Human
ccugccauaaaugaaauugaaaugguagaauggcugaccacagcaaugaccagcccucauuagg

SEQ ID NO: 291161 - RNA, 64 nt, Human
ugguuugguccccccacccgcugcucaguggcucugaccacacuccccucgcagcgucaguggu

SEQ ID NO: 291162 - RNA, 64 nt, Human
caugaaacagcagcugaagccagcucccugaaucugaccacagacacuccuggggggccugaaa

SEQ ID NO: 291163 - RNA, 64 nt, Human
ccagcagugaguagaucuucuuaauauagcugucugaccacauguggaaggcagcuagacuuau

SEQ ID NO: 291164 - RNA, 64 nt, Human
cccuucccuucucccaucucugucccugcaagcacagggcuaaggagggauagaguaggacccu

SEQ ID NO: 291165 - RNA, 64 nt, Human
augcuucuguuauuauuccaagacuggagauaggcagggcuaaaaagguauuauuauuuuuccu

SEQ ID NO: 291166 - RNA, 64 nt, Human
aggaugagaaguucugacucacucaugccaugcccagggcuaucugaaacaaugucucauuaag

SEQ ID NO: 291167 - RNA, 64 nt, Human
gaggugugaagggaaagaaauucuuuucaaaagcugaccacaaagaguaguuaaaaguuuuugu

SEQ ID NO: 291168 - RNA, 64 nt, Human
uuucauaccaacuaucuaaaaccuaauugcaaauugaccacagaccucuaaccuccuacuuuua

SEQ ID NO: 291169 - RNA, 64 nt, Human
ggcugcacaucucaguauauguagggaccccaaaugaccacaacacaguacaauugcccuuuac

SEQ ID NO: 291170 - RNA, 64 nt, Human
ugguuuuuaguguauucacaaaguuguguaaccgugaccacagucaauuuuagaacauuucguu

SEQ ID NO: 291171 - RNA, 64 nt, Human
aguuagcuucaacaucuaaguguauggaugauacugaccacacauguuguuuugcuuauccauu

SEQ ID NO: 291172 - RNA, 64 nt, Human
cccccugcagccuccuguagcccgccucaugcacugaccacagcccccaggggaggaugguacu

SEQ ID NO: 291173 - RNA, 64 nt, Human
uuucuagauuagguaguguccucauuuuauauugugaccacacagcuagagcaccagagcccuu

SEQ ID NO: 291174 - RNA, 64 nt, Human; identical to SEQ ID NO: 291173

SEQ ID NO: 291175 - RNA, 64 nt, Human
guuuucccaccgggauacgggaagccaccugugucagggcuaggcccugggaucgggaguuaca

SEQ ID NO: 291176 - RNA, 64 nt, Human
cugcccccuccacuucccucagaugaugaggagccagggcuaagggggcagccuucucucuucc

SEQ ID NO: 291177 - RNA, 64 nt, Human
acgguuugucacacgauaaagggauuuuuuuuuucagggcuacuacgguugaucuugcaacucu

SEQ ID NO: 291178 - RNA, 64 nt, Human
uggagccaucccuucggagccaacaagaccgccccagggcuauagcagaaagaacuuuaaagcu

SEQ ID NO: 291179 - RNA, 64 nt, Human
ugagacuuaagagcugcaucccaggaucagaagccagggcuaauugggguaggacaauauuccc

SEQ ID NO: 291180 - RNA, 64 nt, Human
gaauggcccuucgugauaagucagcugugacugucagggcuaugcuaugggccuucuagacugu

SEQ ID NO: 291181 - RNA, 64 nt, Human
gagaucuggaucugcccaucacuuuggcuagugacagggcuaauuaauuugcuuuauacauuuu

SEQ ID NO: 291182 - RNA, 64 nt, Human
guaaaggccacccucucgcuucccuggcuggccccagggcuaccacugguauuccugagccucu

SEQ ID NO: 291183 - RNA, 64 nt, Human
uccacucugugaaacccacaggggaugugauaaacagggcuauuagggguaucagccacgucga

SEQ ID NO: 291184 - RNA, 64 nt, Human
cucuugcuuguccccaaaucaccuaacccucauccagggcuauuuuggugggcagggacugccu

SEQ ID NO: 291185 - RNA, 64 nt, Human
ucgaguuucccaaaccgaaucaccuuaagaaggacagggcuagggcauuuggccaggauggcca

SEQ ID NO: 291186 - RNA, 64 nt, Human
acacguagcagcggugcacuaacgugugcagaaacagggcuacucuguguuuccagugugggaa

SEQ ID NO: 291187 - RNA, 64 nt, Human; identical to SEQ ID NO: 203644

SEQ ID NO: 291188 - RNA, 64 nt, Human; identical to SEQ ID NO: 203645

SEQ ID NO: 291189 - RNA, 64 nt, Human; identical to SEQ ID NO: 203646

SEQ ID NO: 291190 - RNA, 64 nt, Human; identical to SEQ ID NO: 203647

SEQ ID NO: 291191 - RNA, 64 nt, Human; identical to SEQ ID NO: 203648

SEQ ID NO: 291192 - RNA, 64 nt, Human; identical to SEQ ID NO: 203649

SEQ ID NO: 291193 - RNA, 64 nt, Human; identical to SEQ ID NO: 203650

SEQ ID NO: 291194 - RNA, 64 nt, Human; identical to SEQ ID NO: 203651

SEQ ID NO: 291195 - RNA, 64 nt, Human; identical to SEQ ID NO: 203652

SEQ ID NO: 291196 - RNA, 64 nt, Human; identical to SEQ ID NO: 203653

SEQ ID NO: 291197 - RNA, 64 nt, Human; identical to SEQ ID NO: 203654

SEQ ID NO: 291198 - RNA, 64 nt, Human; identical to SEQ ID NO: 203655

SEQ ID NO: 291199 - RNA, 64 nt, Human; identical to SEQ ID NO: 203656

SEQ ID NO: 291200 - RNA, 64 nt, Human; identical to SEQ ID NO: 203657

SEQ ID NO: 291201 - RNA, 64 nt, Human
gaaaggcuaguaugagcgagaaaaggagagagcgcgugcagagacuugguggugcauaauggau

SEQ ID NO: 291202 - RNA, 64 nt, Human
agagccaucugucacggacccacgcccagaggaacgugcagaaaaaagcagagcuacauggcug

SEQ ID NO: 291203 - RNA, 64 nt, Human
ugacuucugcugaaggacagaacauugccuuccucgugcagagcuggggcugccagccugagcg

SEQ ID NO: 291204 - RNA, 64 nt, Human
auccucagcaagaaacaaaaccaaacuggacucucgugcagaaaauguagcccauuaccacaug

SEQ ID NO: 291205 - RNA, 64 nt, Human
aggugcuagaauccaguucacacccuucacugugcgugcagacacacugacacacuccgccacg

SEQ ID NO: 291206 - RNA, 64 nt, Human
ccaucaugcggucagagugcagaaacccggucagcgugcagaaaccagcugucugcugaugaac

SEQ ID NO: 291207 - RNA, 64 nt, Human
cuagaaaggccagcuggcaccucugucucauguucgugcagauuauuacagacaccucuuuccu

SEQ ID NO: 291208 - RNA, 64 nt, Human
gggcugugaagacaacagcagaaaugcuaacaagcgugcagaaacaccagagagugcguauccu

SEQ ID NO: 291209 - RNA, 64 nt, Human
uugaucaggaugacaugugccauuuuucagaggacgugcagacaggcuggcauucuagauuacu

SEQ ID NO: 291210 - RNA, 64 nt, Human
cuagcgaccuugugccgcccagcuguccauggcccgugcagagcagaggacagugagugucugc

SEQ ID NO: 291211 - RNA, 64 nt, Human
gucuugaccguuccacuugagauagguuggucaucgugcagaaggccccaggaccucagcacac

SEQ ID NO: 291212 - RNA, 64 nt, Human
aagggaccucaagcaccacgcccuccagggcagccgugcagacgaccuugguucacuuuucagg

SEQ ID NO: 291213 - RNA, 64 nt, Human
agcagcagaagucccuauuuuucuaggaguucaucgugcagacagucuucacuacaggacucgg

SEQ ID NO: 291214 - RNA, 56 nt, Human
gaacggaggaggaacugugauuggcacgugcagauacaaugcuccugagaagacag

SEQ ID NO: 291215 - RNA, 58 nt, Human
ugaagcgccgcagcaguuaaccuaugaccgugcagagggagcccggaguccgagucaa

SEQ ID NO: 291216 - RNA, 54 nt, Human
ccuccaagcguucaaagugaaggccgugcagagcuggucacugaaaugagccug

SEQ ID NO: 291217 - RNA, 64 nt, Human; identical to SEQ ID NO: 197403

SEQ ID NO: 291218 - RNA, 64 nt, Human
acacacacacggauaugcugucuggacgcacacacgugcagauaugguauccggacacacacgu

SEQ ID NO: 291219 - RNA, 64 nt, Human
cacacacagauaaugcugccucaacacucacacacgugcagauauugccuggacacacacaugu

SEQ ID NO: 291220 - RNA, 64 nt, Human
augugcacagauaugcugucuggacaugcacacacgugcagauaugcuguccggauacacacgc

SEQ ID NO: 291221 - RNA, 64 nt, Human
ggaggggcuucuuccggacaguagacacccugcccgugcagagagaugucaugggggcaccugc

SEQ ID NO: 291222 - RNA, 64 nt, Human
ugcugcaauugcacgcggagugaguuuuuuagugcgugcagauggugagagauaagaucuauag

SEQ ID NO: 291223 - RNA, 64 nt, Human
gcgccguguagaagccgcucuguauccauccacgcgugcagagcugccagcagggagcucacag

SEQ ID NO: 291224 - RNA, 64 nt, Human
acccccacuuuuguuccuuccugcugggcugccucgugcagagacacaguguaggggccaugca

SEQ ID NO: 291225 - RNA, 64 nt, Human
cccucucuccaccccugggcuaugcaggccagcccgugcagaccacccccgacgcguccacuug

SEQ ID NO: 291226 - RNA, 64 nt, Human
augaugcugaugcaauuccuccaucaucucuggacgugcagaccagauccagaagaaaggccug

SEQ ID NO: 291227 - RNA, 64 nt, Human
gcagcacccaggagccccccaggcugccugccugcgugcagaggcaggagaggaccguggagcg

SEQ ID NO: 291228 - RNA, 64 nt, Human
guuuccccaaagaccgggagggucacggauggggcgugcagaauccuuguguuuuuucucgcug

SEQ ID NO: 291229 - RNA, 64 nt, Human
agagugaggauggaccucaaaaguuugauccccucgugcagaugaagaagcugaagcccagagu

SEQ ID NO: 291230 - RNA, 64 nt, Human
ggggucuggcuccuuucagagacacuacacuucccgugcagacucagaugccaacucaaagugc

SEQ ID NO: 291231 - RNA, 64 nt, Human
gggcuuccugcuggggcggccagcacccucuccacgugcagaccccaugcgucccggagccugg

SEQ ID NO: 291232 - RNA, 64 nt, Human
gguuaagcgcgacccaggcacugcagcaccccuacgugcagagaugauccuggaguguggaggc

SEQ ID NO: 291233 - RNA, 64 nt, Human
acauuacagguguuguagacagaggcacuugucucgugcagagggauuaaauuagaccugugag

SEQ ID NO: 291234 - RNA, 64 nt, Human; identical to SEQ ID NO: 198285

SEQ ID NO: 291235 - RNA, 64 nt, Human; identical to SEQ ID NO: 198286

SEQ ID NO: 291236 - RNA, 64 nt, Human; identical to SEQ ID NO: 196438

SEQ ID NO: 291237 - RNA, 64 nt, Human
aaaugcuauuuaucucugagccguccccguccuccgugcagagcaaguugaggucauuccuucu

SEQ ID NO: 291238 - RNA, 64 nt, Human
agucucgugcagugcugcguagguuagcccgcaucgugcagacaaccucaguccucuugucuau

SEQ ID NO: 291239 - RNA, 64 nt, Human
acccaaagaccugcagccaccagugcuucacuagcgugcagaccagcccugucccgccucccug

SEQ ID NO: 291240 - RNA, 64 nt, Human
auggcucacaacagcagggccuucuucuuuuugacgugcagaaucucaguggcaucuggguuca

SEQ ID NO: 291241 - RNA, 64 nt, Human
uguucggggacccugugagccuucuggccggcugcgugcagagcccacugggcacgguggucgg

SEQ ID NO: 291242 - RNA, 64 nt, Human
agacugguccucgcuccggggagcaaguggggggcgugcagaugugccugugucugucucugag

SEQ ID NO: 291243 - RNA, 64 nt, Human
ggagccacgggaagaaagcagccggagucacgcacgugcagagcugggcaugggagagaaacgg

SEQ ID NO: 291244 - RNA, 64 nt, Human
ccaggucaucccuccccgggccuggggcgcucugcgugcagauuuuguacaaaaaaaaaaaaga

SEQ ID NO: 291245 - RNA, 64 nt, Human
cccccacuccuucgacgcccccacccccgccccccgugcagagagccggcuccugggccugcug

SEQ ID NO: 291246 - RNA, 64 nt, Human
aagaagcccagaucucuucagcaaucguuucuuccgugcagagcaaaaucacucaggucagugg

SEQ ID NO: 291247 - RNA, 64 nt, Human
acauggagaugugcagcaugaagcgcggccuggacgugcagauggagaccugccgccggcucau

SEQ ID NO: 291248 - RNA, 64 nt, Human
cuccagcggugggaagugaugcagagagcccacccgugcagagggcagaagaggacgaaaugcc

SEQ ID NO: 291249 - RNA, 64 nt, Human
gguuucaguuccaacagaaaggucgggguagguucgugcagagauggggcuggcaggggggcua

SEQ ID NO: 291250 - RNA, 64 nt, Human
gugagcccaguuccaacggcuguguucugguaaucgugcagaacagcaugugggcucugggccu

SEQ ID NO: 291251 - RNA, 64 nt, Human
ucuuuuugaaaguuacaguauguguuuucacuuucgugcagauaacuggaaguaaagcggcaaa

SEQ ID NO: 291252 - RNA, 64 nt, Human
caaacacauuuaaaauugguuuaccucaggaugacgugcagaaaaaugggugaaggauaaaccg

SEQ ID NO: 291253 - RNA, 64 nt, Human; identical to SEQ ID NO: 197093

SEQ ID NO: 291254 - RNA, 64 nt, Human; identical to SEQ ID NO: 197111

SEQ ID NO: 291255 - RNA, 64 nt, Human; identical to SEQ ID NO: 197128

SEQ ID NO: 291256 - RNA, 64 nt, Human
gugccuucgucugaguuuuccugcuuuccugccucgugcagauucugagguauaucugcugccu

SEQ ID NO: 291257 - RNA, 64 nt, Human
cucagcugaugccagcauacauuaaagcgguucacgugcagagaacaaagcagugacaaccauu

SEQ ID NO: 291258 - RNA, 64 nt, Human
auuuuaguugagugcagagggcuuuuauaacaaacgugcagaaauuuuggagggcugugauuuu

SEQ ID NO: 291259 - RNA, 64 nt, Human
augagauaauguuagagguuuuaaagugauuaaacgugcagacuaugcaaaccaggcccagucu

SEQ ID NO: 291260 - RNA, 64 nt, Human
acuucgagcgccugcugcggcucagugacuacaacgugcagaccagccagggugccauccugca

SEQ ID NO: 291261 - RNA, 64 nt, Human
aagaaguacuuuugaagacucccauuuuaagaaccgugcagauuuugcuaccaaaagucuucac

SEQ ID NO: 291262 - RNA, 64 nt, Human
guuccucgcucugggaugcaggcaugcuucucaccgugcagagcugcacuuggccucagcuggc

SEQ ID NO: 291263 - RNA, 64 nt, Human
caagggacuccaccaccaagucacuuccccugcucgugcagaggcacgggaugagucuggguga

SEQ ID NO: 291264 - RNA, 64 nt, Human
agcuggccgaggaccugaaggugcagcuggagcacgugcagacucggcugcgggagauccagcc

SEQ ID NO: 291265 - RNA, 64 nt, Human
agcagccucuaugcugugauuuccacaccggguccgugcagaggaaacagaaacucccaacugu

SEQ ID NO: 291266 - RNA, 64 nt, Human
uccaaauguccuuucucagaggggccagcuaacccgugcagaaccagcacuaagguggacagca

SEQ ID NO: 291267 - RNA, 64 nt, Human
ccaaggagcugcaaaguggagucugguucagccccgugcagacucacccagagcuuaacguugu

SEQ ID NO: 291268 - RNA, 64 nt, Human
gagaacaagugagcuggggccaggaggcagcagccgugcagagccugggcuccggcagggagag

SEQ ID NO: 291269 - RNA, 64 nt, Human
ucucacaagugggaaagacugaagaaacacaucucgugcagaucugcuggcagaggacaaucaa

SEQ ID NO: 291270 - RNA, 64 nt, Human
gccccacagagcagguguugccaaugcugcgguucgugcagaagcggggaaacucaacggugua

SEQ ID NO: 291271 - RNA, 64 nt, Human
cagucagccugcucagagcgggggugcuggagcgcgugcagacacagcucuuccggagcagccu

SEQ ID NO: 291272 - RNA, 64 nt, Human; identical to SEQ ID NO: 197703

SEQ ID NO: 291273 - RNA, 64 nt, Human; identical to SEQ ID NO: 197364

SEQ ID NO: 291274 - RNA, 64 nt, Human; identical to SEQ ID NO: 197235

SEQ ID NO: 291275 - RNA, 64 nt, Human
ggguacagagaggucaagcccaggaggacugccccgugcagacuggaggggacgcugguagaga

SEQ ID NO: 291276 - RNA, 64 nt, Human
uucucccgauugcuccuguguaaagaugccuugucgugcagaaacaaauggcuguccaguuuau

SEQ ID NO: 291277 - RNA, 64 nt, Human
caggcugggccucugugucacccacuccugggugcgugcagacccuuccccuccaccccccagg

SEQ ID NO: 291278 - RNA, 64 nt, Human
auggugcgugcauccccgagcacccuggcgaccucgugcagaccgaggccuucuccaaagaaag

SEQ ID NO: 291279 - RNA, 64 nt, Human
cugcguccaucugugcugugcgccccacaguagacgugcagacgucccugagagguucuugaag

SEQ ID NO: 291280 - RNA, 64 nt, Human
uaaucaccucaugaugauggaguuaaaaguaaaccgugcagacccuggggucccuguuguacgc

SEQ ID NO: 291281 - RNA, 64 nt, Human
ccaucagggugcuguauucaggaaacccaucucacgugcagagacacacauaggcucaaaauaa

SEQ ID NO: 291282 - RNA, 64 nt, Human
uuugccguugcaugcaaccagcccugugauuccacgugcagaucccagcagccuguuggggcag

SEQ ID NO: 291283 - RNA, 64 nt, Human
guuuaucaaaagcaagccccccaggcccagcccacgugcagagggaggagaaugagguucugug

SEQ ID NO: 291284 - RNA, 64 nt, Human
aaccggccccaccacccccuccuacccgggccuccgugcagagaugggcuuucucugccagucc

SEQ ID NO: 291285 - RNA, 64 nt, Human
auguagacgucacgaagagauauagcgauggcgucgugcagaugcagcacgucgcacacagaca

SEQ ID NO: 291286 - RNA, 64 nt, Human
gcuggugcacugcauggagucgagguggaggucacgugcagagcuccaugaggucccggagccc

SEQ ID NO: 291287 - RNA, 64 nt, Human
cucugucaccaauaacgacugcggagaacuguagcgugcagauguguugccccucccuuuuaaa

SEQ ID NO: 291288 - RNA, 64 nt, Human
ucuaggcagggaaagggcacacacccuaggucagcgugcagagcagugaugcuggaggacacac

SEQ ID NO: 291289 - RNA, 64 nt, Human
cccagucccgcaggcuccguggcuuugggccucacgugcagacccugccaugcagacccaugcc

SEQ ID NO: 291290 - RNA, 64 nt, Human
uugcccgaggaggggccggccugcuggccuggggcgugcagacacugcugaguggagacagagc

SEQ ID NO: 291291 - RNA, 64 nt, Human
ucagugggauuguaagcauuuguaauagcuucauguacagcaugcugcuuggugaacaaucauu

SEQ ID NO: 291292 - RNA, 64 nt, Human
gcccugaaaaucgucucccuccccuucucuugcuguacagcaugcguucucuuuuugugguugc

SEQ ID NO: 291293 - RNA, 64 nt, Human
uuagaaugcucauuucuuuuaaaugguuuaauuuguacagcagaggaauguuauuguaguagua

SEQ ID NO: 291294 - RNA, 64 nt, Human
ucucaggggcuccauuauggcuugauuuacuccacgugcagaagucuugaguggaccuaggagg

SEQ ID NO: 291295 - RNA, 64 nt, Human
gacacuuggaauuucuccuuuuaguguuuauauacgugcagauuaauuuauauauauauauaua

SEQ ID NO: 291296 - RNA, 64 nt, Human
cauuguaaaguuccuuaagucauauuugacugggcgugcagaauaacuucuuaacuuuuaacua

SEQ ID NO: 291297 - RNA, 64 nt, Human
cauuguaaaguuccuuaagucauauuugacugggcgugcagaauaacuucuuaacuauuaacua

SEQ ID NO: 291298 - RNA, 64 nt, Human
uggucaagccagggcagucacagcugcuuggggcccacagcacugcugccuggucuccacagua

SEQ ID NO: 291299 - RNA, 64 nt, Human
ggaguggggcaggcggggucuuuguucucggcucccacagcagagccaggugagggggggccug

SEQ ID NO: 291300 - RNA, 64 nt, Human
ggagccaggcaggugaugucuuuguucucggcucccacagcagagccaggugagggggcgccug

SEQ ID NO: 291301 - RNA, 64 nt, Human
gguuuucugugcccaugacuugggggcugcacccccacagcacccccacaauguaggaaaagac

SEQ ID NO: 291302 - RNA, 64 nt, Human
gucacucaucucagaauguccccaccaauccccgccacagcaggcgccucgggucccagauguc

SEQ ID NO: 291303 - RNA, 64 nt, Human
gcccacacaacuggccaccucuucccguuaaugaccacagcagacagaauuugagcccagcacc

SEQ ID NO: 291304 - RNA, 64 nt, Human
cugaagacuuauggcagugaacacaucugauuucccacagcacaacagcccugcauggguuugu

SEQ ID NO: 291305 - RNA, 64 nt, Human
guuuaaaguuuacuucauuaucugcuagugucauccacagcaguucauccucauccacacuaag

SEQ ID NO: 291306 - RNA, 64 nt, Human
gguuucuuagauugcuagcuuuuccuccaggggaccacagcaggugaagcucaagagcgcaugg

SEQ ID NO: 291307 - RNA, 64 nt, Human
auucucagccauccaggcaagagcacucuggguuccacagcacagcagacauggaacgcugaag

SEQ ID NO: 291308 - RNA, 64 nt, Human
agcccagccuagucagggcacagcugcccugcugccacagcaaggaaauguccugcauggggca

SEQ ID NO: 291309 - RNA, 64 nt, Human
ucuaagcaaacaacucccagcugaggaaugcaggccacagcacccaaucaagacaaauuguuau

SEQ ID NO: 291310 - RNA, 64 nt, Human
aguggccuguuucaucacguaugugcugcuaccuguacagcagacaugccgcuccagugacauu

SEQ ID NO: 291311 - RNA, 60 nt, Human
gucacagggaaggauucuaaaagguaugcaguacagcaguauagaauccaugccaauaca

SEQ ID NO: 291312 - RNA, 64 nt, Human
guucucuauugcugcucucucacucccccaugagguacagcagaaaggagaacuauccaaaacu

SEQ ID NO: 291313 - RNA, 64 nt, Human
acuccaucgcuaaagggaccaucugcugcaguuaccacagcaacugaccugagcggcacccugg

SEQ ID NO: 291314 - RNA, 64 nt, Human
ucugguucuccccauccccacaaaggcuguugaaccacagcaccaggaagccugagaaugaauc

SEQ ID NO: 291315 - RNA, 64 nt, Human
cuuuguuguaagucucccaacguccuauuaggagccacagcaggugaggcauuuggugcagcag

SEQ ID NO: 291316 - RNA, 64 nt, Human
cagaagcaacagaggugccaggccucagccucacccacagcagccccaucgccaaaggauggaa

SEQ ID NO: 291317 - RNA, 64 nt, Human
cgagggugaggccuagccuucuugucuuuguaacccacagcagcugguacugugccuugccuau

SEQ ID NO: 291318 - RNA, 64 nt, Human
ugugugccaaagccuaccccaccuggcaggugucccacagcaacagaaggaauaguagucccca

SEQ ID NO: 291319 - RNA, 64 nt, Human
aaacuuucuaugcucaguggaaaguaucugccagccacagcaugaggccugugaaggcugacug

SEQ ID NO: 291320 - RNA, 64 nt, Human
auauguacuguauguccuguagcccagugcggcuccacagcauggaaucugauguaugauauga

SEQ ID NO: 291321 - RNA, 64 nt, Human
uagguccugagacuguugauagccccagacauacccacagcauuauauguaacaucucuccuga

SEQ ID NO: 291322 - RNA, 64 nt, Human
cugaugccugaauccagccagcuguugcucugacccacagcaauagagcaaguuacccaucacc

SEQ ID NO: 291323 - RNA, 64 nt, Human
gcccucguugggagcagugcccaccuuccuuggcccacagcagauaggucccgagcagcaggac

SEQ ID NO: 291324 - RNA, 64 nt, Human
gcugggagagauggacucuguccucagcaacacuccacagcagaaagggguagcagguaccccu

SEQ ID NO: 291325 - RNA, 64 nt, Human
gaagacaugcuugaggagccacggaguuugggggccacagcaccugggcacacacccgagcacc

SEQ ID NO: 291326 - RNA, 64 nt, Human
gcacugcccugccccaugggguggcacaggggucccacagcaggucuuccugcacugcccaccc

SEQ ID NO: 291327 - RNA, 64 nt, Human
ugcagugagagaccaaccccuaacaagggcugggccacagcagggaguccagcccuaccuucuu

SEQ ID NO: 291328 - RNA, 64 nt, Human
gguggguggagcaagccccaccugcguuuuucugccacagcauccaaucgugaagaacucggga

SEQ ID NO: 291329 - RNA, 64 nt, Human
agauuaauaaauuggcuauguuguuccaaugaauguacagcacuuccauuaacuuuugaaagca

SEQ ID NO: 291330 - RNA, 64 nt, Human
auguuuuguagcuagaauaaaaucauuuuuacaaguacagcauucuuggaaagaauuuaacacc

SEQ ID NO: 291331 - RNA, 64 nt, Human
cuaauuuauuaaugaugauaauuauaauguaucuguacagcacuuuuuacauuugcgaagugcu

SEQ ID NO: 291332 - RNA, 64 nt, Human
uaccuaucacuuacauuuuugugguuuugagaaaguacagcaguagacuggggcgucaccucca

SEQ ID NO: 291333 - RNA, 64 nt, Human
gggcaccacucuccucagccacauuauuggggccccacagcaagacugcuugggucucaaggaa

SEQ ID NO: 291334 - RNA, 64 nt, Human
aaagcuuguucauccauuauaaauauaucuuuagccacagcaaaccacacuuaaccuaucuaua

SEQ ID NO: 291335 - RNA, 64 nt, Human
uccccaccccuagaaacagggcuggaaaucucccccacagcagugugacuggugaaaaugcuga

SEQ ID NO: 291336 - RNA, 64 nt, Human
guuacucccuguuauuuuucugcccuggguucuuccacagcacaaacacaccucugccacccca

SEQ ID NO: 291337 - RNA, 64 nt, Human
agaagagaggugcacuacgugggaagugcugauuccacagcaugcagccugguaggggaaggaa

SEQ ID NO: 291338 - RNA, 64 nt, Human
aaacaaacaagcuacauucuguauuugccaguuuccacagcaugaaguacauagcuuccuuagc

SEQ ID NO: 291339 - RNA, 64 nt, Human
uuucagggagacuucauguguucauuuauuuccaccacagcagauuuuaagaaauuauaauaug

SEQ ID NO: 291340 - RNA, 64 nt, Human
gguucuuauuugucgauuuuauuuuauaauuugaccacagcaucugaacucccucucucccugg

SEQ ID NO: 291341 - RNA, 64 nt, Human
aggcccggcccagccuaggcccgggguggccacaccacagcaagccggcccccccucuuuuggc

SEQ ID NO: 291342 - RNA, 64 nt, Human
cccugcaacauccgucuuggaggagaggcugcagccacagcacccuacugcccuuuaaauaaag

SEQ ID NO: 291343 - RNA, 64 nt, Human
caagcucucccuuaucaagugaauaucaucaaaaccacagcauccuugaucagagaagggggag

SEQ ID NO: 291344 - RNA, 64 nt, Human
acacggaucgugcugcucccuggccagccuuuggccacagcaccaccagcugcuguugcugaga

SEQ ID NO: 291345 - RNA, 64 nt, Human
uaguaaaucccuucaguauuuaucccuccuuuccccacagcagcuuucuuuccugucaacuaga

SEQ ID NO: 291346 - RNA, 64 nt, Human
uaacccugcauuucccauuaaucuacauaucuucccacagcagcuuugcucagugauacccaca

SEQ ID NO: 291347 - RNA, 64 nt, Human
auuuuuaauauuuuuuaauggaacaugaaaaccuccacagcaacaucgaaaccagggagaaagu

SEQ ID NO: 291348 - RNA, 64 nt, Human
gaggggcaacacacaagaaccagguccccucagcccacagcacugucuuuuugcugauccaccc

SEQ ID NO: 291349 - RNA, 64 nt, Human
cuaaaguuagagaauuuuuuuccaacugcauucuguacagcacuaguuacauuaugacaggaag

SEQ ID NO: 291350 - RNA, 64 nt, Human
auguauaaaacugauggaaauaauagucaccaaaguacagcacauaccauuuugugucuaauaa

SEQ ID NO: 291351 - RNA, 64 nt, Human
cuaaaccuugaaaauccaaagcuauuguugcauuguacagcacugaagggcuuuauguuacaau

SEQ ID NO: 291352 - RNA, 64 nt, Human
uuugcaggccgccagcaggaaggcgaaggugguaguacagcaagaggcacuggcggggcagcag

SEQ ID NO: 291353 - RNA, 64 nt, Human
gcucuucuuggucuuggcuagacugccuagauucccacagcagacaagguugagaauccauugc

SEQ ID NO: 291354 - RNA, 64 nt, Human
auaacacugagauuuuuuuaaaagcuggaagauuguacagcauaaagcuaaagugaaggcaaaa

SEQ ID NO: 291355 - RNA, 64 nt, Human
gcucuugaaccuucuuacacacucagccccuucuguacagcaccucuuguccaggugcaucuca

SEQ ID NO: 291356 - RNA, 64 nt, Human
cccuuucaagaauuuuuuuuuuuuuugguguguuguacagcaguauaauuuuucacuuauuuau

SEQ ID NO: 291357 - RNA, 64 nt, Human
aguagguuaagaaucaaucuucuuuuucuuaauaguacagcagacuuuagcuucaaguuucaua

SEQ ID NO: 291358 - RNA, 64 nt, Human
uuguacacuuuuccacuuucaaaaccuauuuuaaguacagcaaaauuuauuuaaaacugucaua

SEQ ID NO: 291359 - RNA, 64 nt, Human
uuucugcaguugguugauuggauuuuuuucugagguacagcauuaauacuaguccaaaaaaugu

SEQ ID NO: 291360 - RNA, 64 nt, Human
augguacagccuguugcuccugggccacacaccuguacagcaugugaccgcacugaauaccgca

SEQ ID NO: 291361 - RNA, 64 nt, Human
gcacugcugccaucuagugauacacuuuuguaaaguacagcaaaaccuacagauauauacagua

SEQ ID NO: 291362 - RNA, 64 nt, Human
guguuguuuaggcaauguaacauuuaccggcuguguacagcaaacaagcuauuuuuuagaaacc

SEQ ID NO: 291363 - RNA, 64 nt, Human
aggcugaauguuacugcuugccauaugaugugaaguacagcaauaucccaaguucuugugacug

SEQ ID NO: 291364 - RNA, 64 nt, Human
uuuauaugaaguucuucccaguuugugaauucuaguacagcagccaugcagccaccuuauuuca

SEQ ID NO: 291365 - RNA, 64 nt, Human
ucagagaauuucauucuugagagaauccuuacgaguacagcaaacccuucaucacaaguucaag

SEQ ID NO: 291366 - RNA, 64 nt, Human
gcuggugagggaagggcucagcuucccaccccacguacagcaagggacuccccaggugcggccc

SEQ ID NO: 291367 - RNA, 64 nt, Human
aaaaugaagucguuccaucauaaucuaugaucuuguacagcacuuauagaaauaagcuguucuu

SEQ ID NO: 291368 - RNA, 64 nt, Human
uugagacccuguguuugaagcauuuacaggcaauguacagcaacagagguaccucuugguguau

SEQ ID NO: 291369 - RNA, 64 nt, Human
auauuuuugaaagagcucuuuuagguuaauuuaaguacagcaauuucucauguaauguuuaggg

SEQ ID NO: 291370 - RNA, 64 nt, Human; identical to SEQ ID NO: 227169

SEQ ID NO: 291371 - RNA, 64 nt, Human; identical to SEQ ID NO: 229444

SEQ ID NO: 291372 - RNA, 64 nt, Human; identical to SEQ ID NO: 229449

SEQ ID NO: 291373 - RNA, 64 nt, Human
augugggaaagguaaagcaacaccaaauaaaagcccacagcagcuucaucuuuacgauaacuca

SEQ ID NO: 291374 - RNA, 64 nt, Human
guuuuugcuguuccauucuguguagcaccauucaccacagcaggauagggagccucgacucuuu

SEQ ID NO: 291375 - RNA, 64 nt, Human
gaauucuaggaagaauaauaaaaucucguguauuccacagcaaacuuacauaccauaaagacag

SEQ ID NO: 291376 - RNA, 64 nt, Human
cugaccuggcugaaagccgcugucucggagccccccacagcauuuuguuccccucccgcuggcc

SEQ ID NO: 291377 - RNA, 64 nt, Human
agcugcuuccaccuuucagauauagauguuggaaccacagcagaaguuauagagcgacaacuua

SEQ ID NO: 291378 - RNA, 64 nt, Human
cagagauggaggccgagccaauagacugaagagaccacagcaauuggcuccuccaucuagagau

SEQ ID NO: 291379 - RNA, 64 nt, Human
aaucacaagcaguuguuuguggcccuccuaaggcccacagcacauauagugugucugugauauu

SEQ ID NO: 291380 - RNA, 64 nt, Human
aauggugaaaugacuggauugcucuuuauccagcccacagcaggggaaagaaaggcaacucgca

SEQ ID NO: 291381 - RNA, 64 nt, Human
uugccaugucuuuucuggaacauacuugcauccaccacagcaucaauucccuugauccagccca

SEQ ID NO: 291382 - RNA, 64 nt, Human
acuguggaccccgaugggccagaguccuuguggcccacagcauagcacuggggacagagcgcuc

SEQ ID NO: 291383 - RNA, 64 nt, Human
gacgcguuggugacggugcccagccugcgguuccccacagcaucgcaggcgcucggaaauccuc

SEQ ID NO: 291384 - RNA, 64 nt, Human
ucuauagaagggugucaggggcaaguacacuucaccacagcaauagcuugccuauuagucugcu

SEQ ID NO: 291385 - RNA, 64 nt, Human
caauaacgguaacuugacucuuccaucuuuucacccacagcaggcaccuaagucugccuuuccu

SEQ ID NO: 291386 - RNA, 64 nt, Human
ugggcaaguggauauuuauuaggcuauuucaaagccacagcauaagaaugucagccuagccaca

SEQ ID NO: 291387 - RNA, 64 nt, Human
ucacacacacacacacacacacacacacacgaauccacagcaauccaucagauaugcuggaaga

SEQ ID NO: 291388 - RNA, 64 nt, Human
ucccuagacucaucccaugucagcucccuaggagccacagcaccaggaagggaugcugccuuca

SEQ ID NO: 291389 - RNA, 64 nt, Human; identical to SEQ ID NO: 229453

SEQ ID NO: 291390 - RNA, 64 nt, Human; identical to SEQ ID NO: 229457

SEQ ID NO: 291391 - RNA, 64 nt, Human; identical to SEQ ID NO: 229466

SEQ ID NO: 291392 - RNA, 64 nt, Human; identical to SEQ ID NO: 229472

SEQ ID NO: 291393 - RNA, 64 nt, Human
aucuaaggucuggggaggguggcuggcccggccuccacagcaccccaccccauaucuucuuucc

SEQ ID NO: 291394 - RNA, 64 nt, Human
ucaucugagguggcuacucaacagguuugaggccccacagcaacagaaguccaggacccacuag

SEQ ID NO: 291395 - RNA, 64 nt, Human
acguuuuuggacacugugcuacugaaacucccagccacagcauuuaucagacugcggugaacau

SEQ ID NO: 291396 - RNA, 64 nt, Human
aucaaauaugcaaagcacugacuucuaaguaaaaccacagcaguugaaaagacuccaaagaaau

SEQ ID NO: 291397 - RNA, 64 nt, Human
ugcaccugaaaaaccugggcaccuaagcaaugagccacagcaaaaaguaaagaacaacaacaaa

SEQ ID NO: 291398 - RNA, 64 nt, Human
aggcauuuuugaguggccugauuacauauuccucccacagcaaguccguauccuggaaguguua

SEQ ID NO: 291399 - RNA, 64 nt, Human
cuuugugcacaaugcaucccaucccaaagacaguccacagcaggacuugcuccaucucugaacu

SEQ ID NO: 291400 - RNA, 64 nt, Human
uagccuuuucuuugaagacacacucggcucuucuccacagcaagcguccagggcagauggcaga

SEQ ID NO: 291401 - RNA, 51 nt, Human
aacuggaggagaccagcuagcccacagcaaccaaagagacuuccucuuggc

SEQ ID NO: 291402 - RNA, 64 nt, Human
gaagcuacugcaagguuccaggcuugggccugggccacagcaacagcaguggucaaauaucuag

SEQ ID NO: 291403 - RNA, 64 nt, Human
ggagucaguguuauuacugguggaugcaccguguccacagcagcccccaaucccagcgaugcgu

SEQ ID NO: 291404 - RNA, 64 nt, Human
aaacuaggaaaggaggcccccacagcugauccugccacagcacaccugacucacucggcucugu

SEQ ID NO: 291405 - RNA, 64 nt, Human
gcauuggccacugaaggguacaaaggcaaaaggaccacagcaccacuuagguguagcauggauu

SEQ ID NO: 291406 - RNA, 64 nt, Human
acuauggcaaaaaacauuaccauccccacccauaccacagcauccccuagagagagugaggugc

SEQ ID NO: 291407 - RNA, 64 nt, Human
ccuaggucacgugccucucaaauacugauuucugccacagcaccucuugaggcaucccuuggcu

SEQ ID NO: 291408 - RNA, 64 nt, Human
gacccaagcguucucccugccugagaugguguggccacagcaguggaaggcugcacacaggcac

SEQ ID NO: 291409 - RNA, 64 nt, Human; identical to SEQ ID NO: 229475

SEQ ID NO: 291410 - RNA, 64 nt, Human; identical to SEQ ID NO: 229483

SEQ ID NO: 291411 - RNA, 64 nt, Human; identical to SEQ ID NO: 229487

SEQ ID NO: 291412 - RNA, 64 nt, Human; identical to SEQ ID NO: 229490

SEQ ID NO: 291413 - RNA, 64 nt, Human
agguuuaccuggaucuggcuacugaggcuagagcccacagcagaaugggguugggccuguggcc

SEQ ID NO: 291414 - RNA, 64 nt, Human
cugccgugaacucauguguugccauguacagaggccacagcagcaugaaggguuguggcuuccc

SEQ ID NO: 291415 - RNA, 64 nt, Human
ugauccgccaagcagggcaguaucuggguuacagccacagcaggaagaaccacuggagagacac

SEQ ID NO: 291416 - RNA, 64 nt, Human
cagcacccaccagucagguauguucugagugaacccacagcagucgcagaaugagcaccuggca

SEQ ID NO: 291417 - RNA, 64 nt, Human
cacuggcuuaagagguuucucagaauaucuauggccacagcagcauaccaguuuccauccuaau

SEQ ID NO: 291418 - RNA, 64 nt, Human
ugcauaccuuuaauauuuuuccuucuuaaauuggccacagcaggggucauucacacucucacug

SEQ ID NO: 291419 - RNA, 64 nt, Human
cauucauuuggaugcagugaaaagggcagaaauaccacagcagagaauaaaauugauaauguug

SEQ ID NO: 291420 - RNA, 64 nt, Human
uaaaaugacagaaguuagcuguagaugaccuaucccacagcaaucggaguucuugaagaagaaa

SEQ ID NO: 291421 - RNA, 64 nt, Human
ggaaacugagguaagagcagucucuaaaaacuacccacagcagcauuggugcaggggaacuugg

SEQ ID NO: 291422 - RNA, 64 nt, Human
cucugcucuugcccacaaagcugacccgaauggaccacagcagugggcuccuaugccuccuggc

SEQ ID NO: 291423 - RNA, 64 nt, Human
cccuuauuuaaaugugugcuaugacccacuaugaccacagcaucugcauuuucuaaaaaauucc

SEQ ID NO: 291424 - RNA, 64 nt, Human
caaaaagaaaaaggaaaaaaaaaaaucccaucacccacagcaaaugacagcugcaaaagagaac

SEQ ID NO: 291425 - RNA, 64 nt, Human
auuaacccacuccuccccaacaaggucuuauaaaccacagcacuuuguuccaaguucagaguuu

SEQ ID NO: 291426 - RNA, 64 nt, Human
gaccuucagugccauccugacucuagaaggccccccacagcagggcguagggggcaucacccug

SEQ ID NO: 291427 - RNA, 64 nt, Human
gagguuccaaauugggcuucugugcccagagcguccacagcaccauucccaguguagacuccca

SEQ ID NO: 291428 - RNA, 64 nt, Human
aacuuuuuuccucauucggcuguauaauacauaaccacagcaagacugacauccacuuaggaug

SEQ ID NO: 291429 - RNA, 64 nt, Human; identical to SEQ ID NO: 229494

SEQ ID NO: 291430 - RNA, 64 nt, Human; identical to SEQ ID NO: 229502

SEQ ID NO: 291431 - RNA, 64 nt, Human; identical to SEQ ID NO: 229506

SEQ ID NO: 291432 - RNA, 64 nt, Human
ccucaucuggcacuaugcaugucucacucacccuccacagcacucagucccaucgacguucacu

SEQ ID NO: 291433 - RNA, 64 nt, Human
gaccagaggagugcuggagcuccagcagccccaaccacagcauucccuaacauggaggcaaaau

SEQ ID NO: 291434 - RNA, 64 nt, Human
uucuggaaagacaucuccaaggugagguccacccccacagcagaccucaaguagaaauugccca

SEQ ID NO: 291435 - RNA, 64 nt, Human
guuuucucuuucuugcaagaugaaauuuuauuuuccacagcaaaauuacucuacuguuaaaauu

SEQ ID NO: 291436 - RNA, 64 nt, Human
uugcagucagcagcaucuauggaugcaaauccagccacagcagacaaucauggauauacggcac

SEQ ID NO: 291437 - RNA, 64 nt, Human
ccgaccggcauggccacucagacacaaguccacaccacagcacuaccgucccauccguucucau

SEQ ID NO: 291438 - RNA, 64 nt, Human
cauuccaucugagguccuuccugaacaugucacuccacagcagaggaccgguugcagcuuaccc

SEQ ID NO: 291439 - RNA, 64 nt, Human
cugggcaccaccaccugccugagggccuagcucaccacagcacauccuccaggaucuagccuuc

SEQ ID NO: 291440 - RNA, 64 nt, Human
ucccauccuuacccaccaggaacuagagccccaaccacagcagaugcuuccugggcagccacug

SEQ ID NO: 291441 - RNA, 64 nt, Human
ucuuaggggggugguggcaucuggacaaaugccaccacagcaggugggguggcaaagcuaccug

SEQ ID NO: 291442 - RNA, 64 nt, Human
uuacagacuggaauaguggcauaaggaguuagaaccacagcagacaccauucauuccaugucca

SEQ ID NO: 291443 - RNA, 64 nt, Human
cuuccuaccuugauugagggugugaugccuggagccacagcagccacuuugcuaccaugacaaa

SEQ ID NO: 291444 - RNA, 64 nt, Human
ugucgcgccucuccuccucggaaacagaacccucccacagcacauccuacccggaagaccagcc

SEQ ID NO: 291445 - RNA, 64 nt, Human
uuauucucuaaauaauacaguaugacaacuauuuccacagcauuuacauuguauuggguaauau

SEQ ID NO: 291446 - RNA, 64 nt, Human
acaauguauuuauggagagaaguaaaaauaaguuccacagcaacacauuuacaugaauuaugaa

SEQ ID NO: 291447 - RNA, 64 nt, Human
cagggacuggaggcacccccagcccugccccaggccacagcaggacaggccgggacaggccuca

SEQ ID NO: 291448 - RNA, 64 nt, Human; identical to SEQ ID NO: 229512

SEQ ID NO: 291449 - RNA, 64 nt, Human; identical to SEQ ID NO: 229522

SEQ ID NO: 291450 - RNA, 64 nt, Human; identical to SEQ ID NO: 229528

SEQ ID NO: 291451 - RNA, 64 nt, Human; identical to SEQ ID NO: 229531

SEQ ID NO: 291452 - RNA, 64 nt, Human
cugcuaccuuagagugugaaggugaugguaacugccacagcaaaggcaauaccguaguuuuuga

SEQ ID NO: 291453 - RNA, 64 nt, Human
uauuugugaauuacuucugaggaaaugcuaacuuccacagcauuguauuuaauuauaacaauaa

SEQ ID NO: 291454 - RNA, 64 nt, Human
ggccuuccucucgccccugugcacccggagaugcccacagcaccagcaccugagcucaccuccg

SEQ ID NO: 291455 - RNA, 64 nt, Human
gggcucuggaggugcuuucacucaaccaagggggccacagcacuggggagugaaacugccccgc

SEQ ID NO: 291456 - RNA, 64 nt, Human
acugggauguagagaggcguuagugggcagguggccacagcaggacugaggacaggcccccauu

SEQ ID NO: 291457 - RNA, 64 nt, Human
uacuuaagaagaaacuugguaaucauuguggcacccacagcaagcaguugccuuaccagugaaa

SEQ ID NO: 291458 - RNA, 64 nt, Human
gaaagucagcccacgucggagcggugaggaggagccacagcacauggggugccaccucgagguc

SEQ ID NO: 291459 - RNA, 64 nt, Human
agguaucacggucgccaccuggcauuccuucugaccacagcaucauuuugcauucaaauuaagg

SEQ ID NO: 291460 - RNA, 64 nt, Human
uagccagucauauacucucagacccuuguacacaccacagcaugagguuguguugguuaaaaau

SEQ ID NO: 291461 - RNA, 64 nt, Human
acauguauuuuguauuuauuuuacauuuaaauucccacagcaaauagaaaauaauuuaucauac

SEQ ID NO: 291462 - RNA, 64 nt, Human
ccggcccuguggucggaccuggcuacagcccugaccacagcaucuucccagugacggagcggga

SEQ ID NO: 291463 - RNA, 64 nt, Human
gccugcccagcagccucugcucccuccuggggacccacagcagacgucugcaagccacugcuga

SEQ ID NO: 291464 - RNA, 64 nt, Human
guagcuucuaaugugagguuugaguccagugcgcccacagcagcaugcccuucucaccccuugc

SEQ ID NO: 291465 - RNA, 64 nt, Human
auacuucacaauacuauuugcauaagacaaaauaccacagcaaaaaaaaaaaucugauuaacaa

SEQ ID NO: 291466 - RNA, 64 nt, Human
aaaaacacaguccugagagggauggaccagacugccacagcagcucauagcacaaaaaaagguu

SEQ ID NO: 291467 - RNA, 64 nt, Human
aaaaaacacaaucuuaaggggauagacuagacugccacagcagcccauggcacaacuaacaccu

SEQ ID NO: 291468 - RNA, 64 nt, Human; identical to SEQ ID NO: 229541

SEQ ID NO: 291469 - RNA, 64 nt, Human; identical to SEQ ID NO: 229545

SEQ ID NO: 291470 - RNA, 64 nt, Human; identical to SEQ ID NO: 229549

SEQ ID NO: 291471 - RNA, 64 nt, Human
uggacucaauccagagccagauaguagggggaagccacagcauuuccuuuuaacucaguucaau

SEQ ID NO: 291472 - RNA, 64 nt, Human
cggccucacaaagugcuaggauuacaggcaugagccacagcacccggcccagaauaagaauacu

SEQ ID NO: 291473 - RNA, 64 nt, Human
caugagaacauguaaaaaauggaggggaaaaaggccacagcaaucuguacuacaaucaacuuua

SEQ ID NO: 291474 - RNA, 61 nt, Human
ccucucuaaagggcauauaacauggcaucugccacagcagaauggagcggugugaggaagg

SEQ ID NO: 291475 - RNA, 64 nt, Human
agcagcaacaguuuguguagccagucuaccaccaccacagcaccccagacagcuaggcuuagcc

SEQ ID NO: 291476 - RNA, 64 nt, Human
gcaagcuuauggguuucuugguaaagagccuuuaccacagcaaggaaugggaacauuuccccau

SEQ ID NO: 291477 - RNA, 64 nt, Human
guccccguucacacugaggaacggagaccugugaccacagcaggcugacagauggacagaaucu

SEQ ID NO: 291478 - RNA, 64 nt, Human
aaaaaauucccuaaagacuaacuugaaaagaaaaccacagcaggaugcuaauggaauuacugcc

SEQ ID NO: 291479 - RNA, 64 nt, Human
agauuuuaaaacuucuaagauuauucuccucuauccacagcauucacaaaaauuaauauaauuu

SEQ ID NO: 291480 - RNA, 64 nt, Human
ugacgcccuguagcauaccccuagguaccaacuuccacagcagucucguaaauucuccuguuca

SEQ ID NO: 291481 - RNA, 58 nt, Human
cuagaaguuuucgaauguaauaauacuuccacagcaacaggugcuagagaccacuguu

SEQ ID NO: 291482 - RNA, 64 nt, Human
uauuuucaguaaauacauuuaaacaauguuaaggccacagcacacauaucucagccauucauug

SEQ ID NO: 291483 - RNA, 64 nt, Human
aacaaagcaaauauguucaucacugucaggcugcccacagcaacaccaagcauauuagaagagg

SEQ ID NO: 291484 - RNA, 64 nt, Human
aucuguuucuccuccuuuacgcccauuuuccuacccacagcagcaaaugacaacgugucugucc

SEQ ID NO: 291485 - RNA, 64 nt, Human
uuuauuuauuuuuuuuuugagaaucacuucuuggccacagcacaucacagacacaguuucugga

SEQ ID NO: 291486 - RNA, 64 nt, Human
acagggucagagaucugucagaggaaaauggucuccacagcaacucuggagggaagcugaagac

SEQ ID NO: 291487 - RNA, 64 nt, Human; identical to SEQ ID NO: 229553

SEQ ID NO: 291488 - RNA, 64 nt, Human; identical to SEQ ID NO: 229563

SEQ ID NO: 291489 - RNA, 64 nt, Human; identical to SEQ ID NO: 229568

SEQ ID NO: 291490 - RNA, 64 nt, Human; identical to SEQ ID NO: 229572

SEQ ID NO: 291491 - RNA, 64 nt, Human
ucuucauugccucucuccccuuggcgucugaugaccacagcaaagcacugggaauuucuacucu

SEQ ID NO: 291492 - RNA, 64 nt, Human
ccugccaggcuggggcuuccucaggcauggguguccacagcacuggcccccucuccccagccuc

SEQ ID NO: 291493 - RNA, 64 nt, Human
cccaccuuauccucccaccccacucccuccaccaccacagcacaccggugcuggccacaccagc

SEQ ID NO: 291494 - RNA, 64 nt, Human
gcuuucucacauucggucuacuugcaggguaucuccacagcaugcaccauucuggguacagggg

SEQ ID NO: 291495 - RNA, 64 nt, Human
agucugucaccacguggcuugggaacuucuggagccacagcaggcaucacggugcgacgugaga

SEQ ID NO: 291496 - RNA, 64 nt, Human
uauauucacguuuuccuaggugugugugugcaggccacagcagcaugcccuugguguagucagu

SEQ ID NO: 291497 - RNA, 64 nt, Human
ugaaauaacuggacacacacucacacaaguaacaccacagcagaccucggaguacugcuaagug

SEQ ID NO: 291498 - RNA, 64 nt, Human
gaugauggcucauuuccacccaaccccaggauuuccacagcacacacccacaggccuggaccug

SEQ ID NO: 291499 - RNA, 64 nt, Human
ucccugcccagcucagagcugagggccucccccuccacagcaaccaaucacaaccauaaagcua

SEQ ID NO: 291500 - RNA, 64 nt, Human
ugguuggugcagauggugauaggaccagugggucccacagcauggccacacugcaccuccuucg

SEQ ID NO: 291501 - RNA, 64 nt, Human
gccuuggaggaggcgccuaaguuucccccagugcccacagcacccuccggcgcugaaaauacac

SEQ ID NO: 291502 - RNA, 64 nt, Human
cagacugcaaaucugccugauaggacccauauucccacagcacuaauucaacauauaccuuacu

SEQ ID NO: 291503 - RNA, 64 nt, Human
ucaucuccuuuauugcaguucaaauccucaccauccacagcaagaugaauuuuaucagccaugu

SEQ ID NO: 291504 - RNA, 64 nt, Human
caccccuucucuaacacuagcuucaaggcagaagccacagcagccucuguccagccugcaggug

SEQ ID NO: 291505 - RNA, 64 nt, Human
caaggaagugaccugccugcuggcauuggccagaccacagcagcaccuccuccaugcaggccuu

SEQ ID NO: 291506 - RNA, 64 nt, Human
acagaugugagaacaugcugcaagagccugccagccacagcaaucaggacucacagcucuucaa

SEQ ID NO: 291507 - RNA, 64 nt, Human; identical to SEQ ID NO: 229576

SEQ ID NO: 291508 - RNA, 64 nt, Human; identical to SEQ ID NO: 229584

SEQ ID NO: 291509 - RNA, 64 nt, Human; identical to SEQ ID NO: 229588

SEQ ID NO: 291510 - RNA, 64 nt, Human
augcauaagacuguguuuuuuagcacacagauacccacagcauacacugacgaucuccacgcag

SEQ ID NO: 291511 - RNA, 64 nt, Human
auggacuguccccaucugcagagaggcuugacugccacagcaucuguggcuaugcucagagggu

SEQ ID NO: 291512 - RNA, 64 nt, Human
uauauagucuuauucaccaauauauccaauacacccacagcaaugguaccuuuuuaagaucagg

SEQ ID NO: 291513 - RNA, 64 nt, Human
ugauaagcacuuuuuaaauggcucuaagaauaagccacagcaaagaauuuaaaguggcuccuuu

SEQ ID NO: 291514 - RNA, 64 nt, Human
augcuccuuuucccagaacuccucucugcugcacccacagcaucuguucccgaggaguuaugac

SEQ ID NO: 291515 - RNA, 64 nt, Human
uguuuagcuuuuugaggaacagacaaacuguuuuccacagcaguugaaccauuccacauuccca

SEQ ID NO: 291516 - RNA, 64 nt, Human
acccacaguagaggggucucaugucuccccaguuccacagcagugucacagacgugaaagccag

SEQ ID NO: 291517 - RNA, 64 nt, Human
acccuuggcuuaacuccuaagccccugcccagcaccacagcagagaucacacacugacccuccg

SEQ ID NO: 291518 - RNA, 64 nt, Human
gguaccgcugugcguggggucagguguuuccguaccacagcaggagcagggcccgcccgcaucc

SEQ ID NO: 291519 - RNA, 64 nt, Human
uggccaucacagccccauggacaacacuaauuguccacagcaaagggcaaggaauccucuggga

SEQ ID NO: 291520 - RNA, 64 nt, Human
guaccuacagguaagucuacauccucucugacagccacagcacuacaucaaucccugacguuag

SEQ ID NO: 291521 - RNA, 64 nt, Human
uguaaaauuuugaacacaacacuggaaaggguauccacagcaggaaguccccaguucaccucca

SEQ ID NO: 291522 - RNA, 64 nt, Human
cugaaugugggcguaagaaagcgggaagggucccccacagcaagagagagacccucccagucac

SEQ ID NO: 291523 - RNA, 64 nt, Human
ccuuaggaaggugugagaccggcuucccccauccccacagcaaaacacggccugucccaagcca

SEQ ID NO: 291524 - RNA, 64 nt, Human
gacccgccugcggucugcaucagccucugggaaaccacagcagugaugccagcugggcacguca

SEQ ID NO: 291525 - RNA, 64 nt, Human
aaaaauccagacucuuucgauacccaggaccaagccacagcagguccuccaucccaacagccau

SEQ ID NO: 291526 - RNA, 55 nt, Human; identical to SEQ ID NO: 229593

SEQ ID NO: 291527 - RNA, 64 nt, Human; identical to SEQ ID NO: 229600

SEQ ID NO: 291528 - RNA, 64 nt, Human; identical to SEQ ID NO: 229604

SEQ ID NO: 291529 - RNA, 64 nt, Human; identical to SEQ ID NO: 229608

SEQ ID NO: 291530 - RNA, 64 nt, Human
uaaaauaagcaaucuucuauucucauuccuuuucccacagcagcauauuuuagaggcacauaca

SEQ ID NO: 291531 - RNA, 64 nt, Human
ugucccaucaugcuuuccacugacccaaaauucaccacagcauuucuaucuuuauauuucuguc

SEQ ID NO: 291532 - RNA, 64 nt, Human
gaaaauguuuuaaggauuuucuucaaagaauaagccacagcaaugguuuuguagaaaacuccug

SEQ ID NO: 291533 - RNA, 64 nt, Human
cucaacaucaggggaugccugaggagugcgagcuccacagcaacauggcaggcaggagguccuc

SEQ ID NO: 291534 - RNA, 64 nt, Human
ccgcacucacccaugugccaaggugggguauuuaccacagcagcugaacagccaaaugcauggu

SEQ ID NO: 291535 - RNA, 64 nt, Human
gugugcccagugggaguuccuuccagccccaggaccacagcagcagccaggugccgaguggauu

SEQ ID NO: 291536 - RNA, 64 nt, Human
gggggagaagccaggacagcagcuuccgcugucuccacagcagacacgggacggauuccacaga

SEQ ID NO: 291537 - RNA, 64 nt, Human
aucuguccuucagggugcucggacagaauucuuaccacagcaaaggcauaagaugcuugauacg

SEQ ID NO: 291538 - RNA, 64 nt, Human
caguggccgcaagcgcagggaggaugccacagccccacagcacccaggcuccauggggaagugc

SEQ ID NO: 291539 - RNA, 64 nt, Human
gcaggaguggagagcuggugcccucaggaggagaccacagcauguccaucagcucagcagagcu

SEQ ID NO: 291540 - RNA, 64 nt, Human
uaucccagcaaauugggaucacaugcuuuugucuccacagcaaccagccacugcaggcagcaug

SEQ ID NO: 291541 - RNA, 64 nt, Human
ugcgugucccuuccuccccgagucagggcgacuuccacagcagcagaacaagugccuccuggac

SEQ ID NO: 291542 - RNA, 64 nt, Human
ggccugaucccaggagacaccagggccagagugaccacagcagggcaggcaucaugugugugug

SEQ ID NO: 291543 - RNA, 64 nt, Human
cccagcugggccuggugcccugcgucgucguuggccacagcaugggaggaaagacagccaugcu

SEQ ID NO: 291544 - RNA, 64 nt, Human
ugucaguacuauaaaugcuugagauauaaugaauccacagcauucaaggucaggucuacucaaa

SEQ ID NO: 291545 - RNA, 64 nt, Human
aauaacuauauaauguaugcuuauuggaauucugccacagcaggaagcuugagucaaaaugugu

SEQ ID NO: 291546 - RNA, 64 nt, Human; identical to SEQ ID NO: 229612

SEQ ID NO: 291547 - RNA, 64 nt, Human; identical to SEQ ID NO: 229621

SEQ ID NO: 291548 - RNA, 64 nt, Human; identical to SEQ ID NO: 229626

SEQ ID NO: 291549 - RNA, 64 nt, Human
ccugggaaucuagaacaguuuagaggggaaagagccacagcaaagaaaagccgaggcaggguga

SEQ ID NO: 291550 - RNA, 64 nt, Human
gcugccagcucugguaacuugguuaccaaagaugccacagcacagaaauaucgaccaacaccuc

SEQ ID NO: 291551 - RNA, 64 nt, Human
gccuucuccucccugcagugccaacaugcacugcccacagcaggagcuggauccagcgucagug

SEQ ID NO: 291552 - RNA, 64 nt, Human
ucagcguagaaaacgcaccuccaucccgcccuucccacagcauuccuccaucuuagauagaugg

SEQ ID NO: 291553 - RNA, 64 nt, Human
cacuuccuggggagcuacaggggcacuuaacccaccacagcacagccucaucaaaaugcagcug

SEQ ID NO: 291554 - RNA, 64 nt, Human
cucucuggcgccuucugaacccgucucagcagguccacagcaccugggcagaggucagagacca

SEQ ID NO: 291555 - RNA, 64 nt, Human
gcaaccauuguuccaggucccccagggcuuccucccacagcagcugugaauggcacagugaccu

SEQ ID NO: 291556 - RNA, 64 nt, Human
caguaacucucauugacuggauuagaggugauggccacagcaaaugggagagcaaaauguuggc

SEQ ID NO: 291557 - RNA, 64 nt, Human
auuuauaaugaaaaguggcauuuggguauagucaccacagcaauguucuacaucccuaagauua

SEQ ID NO: 291558 - RNA, 64 nt, Human
aguuguaaauacuaguguagaucucuuuuguuuaccacagcaaauacugauuuuaugauuguua

SEQ ID NO: 291559 - RNA, 64 nt, Human
ucacugggcauauccuccuucuccuuaaccagcuccacagcagccccugagucaccugcacaag

SEQ ID NO: 291560 - RNA, 64 nt, Human
cuuauagucacugacauuuaggaauagucuguuaccacagcauaagcugguaaaaaaaaaaaaa

SEQ ID NO: 291561 - RNA, 64 nt, Human
ugcuaucgagcccuggugcuauguggccccggagccacagcacaaucaucucaguggcgaagca

SEQ ID NO: 291562 - RNA, 64 nt, Human
acacugcagauacuuccauuuggacccgcuguggccacagcauggccccuuuaguccucccgcc

SEQ ID NO: 291563 - RNA, 64 nt, Human
gugggaggagcgacugcccugcccaaaugaacugccacagcagggacagcuggaccgcagaguu

SEQ ID NO: 291564 - RNA, 64 nt, Human
uagauauccucucccccuccuccagggaagguggccacagcaaguacagcggcuccccucugcu

SEQ ID NO: 291565 - RNA, 64 nt, Human; identical to SEQ ID NO: 229633

SEQ ID NO: 291566 - RNA, 64 nt, Human; identical to SEQ ID NO: 229643

SEQ ID NO: 291567 - RNA, 64 nt, Human; identical to SEQ ID NO: 229648

SEQ ID NO: 291568 - RNA, 64 nt, Human; identical to SEQ ID NO: 229653

SEQ ID NO: 291569 - RNA, 64 nt, Human
ugggacagucaugggacugcaucuuccgacuuguccacagcagaugaggacagugagaauuaag

SEQ ID NO: 291570 - RNA, 64 nt, Human
ggcugagcuggcccggggcugccccggucuugugccacagcacuguuuucuuucugcccucuuc

SEQ ID NO: 291571 - RNA, 64 nt, Human
cgaauccagugcacucaaguuuggccaagggacuccacagcacccagaagacugcaugccucaa

SEQ ID NO: 291572 - RNA, 64 nt, Human
caagcacuaucacuuuaaauacuauuauuugcuaccacagcaacuauauauuuccauagcuuuu

SEQ ID NO: 291573 - RNA, 64 nt, Human
auccaugacaagguccgggagcagcagaccaaaaccacagcagccuccuauuaaguguaacaaa

SEQ ID NO: 291574 - RNA, 64 nt, Human
cauccuucuaaagugcugggauuacaggugugagccacagcacucggccuaaauagguuuuucu

SEQ ID NO: 291575 - RNA, 64 nt, Human
ccucuuuuguuggggaaggguggcauucugcugaccacagcacuccaaccaaaagccaaaaacc

SEQ ID NO: 291576 - RNA, 64 nt, Human
ugacagggagccaaggcgaggcggcugucugcgaccacagcagccucgaaacaccaggcagcag

SEQ ID NO: 291577 - RNA, 64 nt, Human
acagccaugccucaaaaucaaaucauuugcauucccacagcauccugaauaccgacuaccucuu

SEQ ID NO: 291578 - RNA, 64 nt, Human
uuccuaggcucugccccagccaguccagagccuaccacagcaauacccccaacacucacuccac

SEQ ID NO: 291579 - RNA, 64 nt, Human
ugccucaguuccagaaauuauugccaaacaggagccacagcaauuuuuggcuacuuuucugcuc

SEQ ID NO: 291580 - RNA, 64 nt, Human
uuauggcagagaaguuucuccgcaccagaauuauccacagcaacuuggcugagccccacuacac

SEQ ID NO: 291581 - RNA, 64 nt, Human
cagcagcaguuuccaagacgggccagaaacgcauccacagcaguggcacccgcggcucaggggc

SEQ ID NO: 291582 - RNA, 64 nt, Human
gcacugagcuguuggggcacacugcccagcccggccacagcagcucagccagucacagcuccac

SEQ ID NO: 291583 - RNA, 60 nt, Human
uggccgaaauguuauuuuaacgaggaaagaccacagcaagauucuuucauucgucuccuc

SEQ ID NO: 291584 - RNA, 64 nt, Human
gguuauaaagucauauccacuucuuccacaaugaccacagcaaaugaccaagcaugaacuaaag

SEQ ID NO: 291585 - RNA, 64 nt, Human; identical to SEQ ID NO: 229662

SEQ ID NO: 291586 - RNA, 64 nt, Human; identical to SEQ ID NO: 229668

SEQ ID NO: 291587 - RNA, 64 nt, Human; identical to SEQ ID NO: 229672

SEQ ID NO: 291588 - RNA, 64 nt, Human
aaaaaaaucuuguggauugauugcuuugccauccccacagcagcuuuugcaaauugcuuuccaa

SEQ ID NO: 291589 - RNA, 64 nt, Human
gagccuccuaaaauucuagccauuugucacacaaccacagcaagaaacguguucuauaucuaga

SEQ ID NO: 291590 - RNA, 64 nt, Human
ugugaagggucuuggccucaucccucagguccccccacagcacuucccacuacugcuucugucc

SEQ ID NO: 291591 - RNA, 64 nt, Human
gcugugcauggcaggcccggcaauagcuucugacccacagcacccgcgccucagaagcuacggu

SEQ ID NO: 291592 - RNA, 64 nt, Human
gccaaccccugaaagcagaaccuggccucccuggccacagcagccuuacccaccgcucuacgug

SEQ ID NO: 291593 - RNA, 64 nt, Human
cugucugguuguauaaacggugcaaacaaugucgccacagcacccacgcgguuugcauucuuuu

SEQ ID NO: 291594 - RNA, 64 nt, Human
ugcauccccugcacccgcuaccacaccagcucagccacagcagagccaaucacagacccaccac

SEQ ID NO: 291595 - RNA, 64 nt, Human
gcauucccagcucuacccugcauggcugagcugcccacagcaggccagguccagagagaccgag

SEQ ID NO: 291596 - RNA, 64 nt, Human
acugggccucgguggccggggccgcgagcugugaccacagcacccucaagcauacggcgcuguu

SEQ ID NO: 291597 - RNA, 64 nt, Human
ucuuaacagaaagguaaugggcccccagaaauacccacagcauagugaccucagacccugauac

SEQ ID NO: 291598 - RNA, 64 nt, Human
uugcucacagaugcagagacugacaauugugucuccacagcagagguggaugcuagcuacacca

SEQ ID NO: 291599 - RNA, 64 nt, Human
ggccauugccaggagcccacccuggucacgcuggccacagcacaaagaacaacuccucaccagu

SEQ ID NO: 291600 - RNA, 64 nt, Human
cugccccggccuccucggagagcagcagcaccaaccacagcaucgggagcacccagagcacccc

SEQ ID NO: 291601 - RNA, 64 nt, Human
cggaggaaacagacauggggagggugaacaguccccacagcagacagcuacuugggcaugaaga

SEQ ID NO: 291602 - RNA, 64 nt, Human
gagaccacaaaauacaaggccagaccuagaguguccacagcaggccugugcugcccgccucagg

SEQ ID NO: 291603 - RNA, 64 nt, Human
cugccaagcaggacuuggcacaugagcacccaccccacagcaccaucaggcagcacccaugggc

SEQ ID NO: 291604 - RNA, 64 nt, Human; identical to SEQ ID NO: 229680

SEQ ID NO: 291605 - RNA, 64 nt, Human; identical to SEQ ID NO: 229681

SEQ ID NO: 291606 - RNA, 64 nt, Human; identical to SEQ ID NO: 229682

SEQ ID NO: 291607 - RNA, 64 nt, Human; identical to SEQ ID NO: 229683

SEQ ID NO: 291608 - RNA, 64 nt, Human
caccccgccccuccauaguucaggauagaggcucccacagcagccgguaaggaaguggguggca

SEQ ID NO: 291609 - RNA, 64 nt, Human
uuuuauaggaaagcccagugacaugggccagcagccacagcauauuguaaacugaagaugacca

SEQ ID NO: 291610 - RNA, 64 nt, Human
cacguagguggcguuguuccacucggcuaucaggccacagcagcccccuggugcggcccgagac

SEQ ID NO: 291611 - RNA, 64 nt, Human
ggggggcuucugcucccugagacucuggguucacccacagcacuuucugaggaagaggacacca

SEQ ID NO: 291612 - RNA, 64 nt, Human
aaaaaaaaugaaaggucaaccccuaugcaaauuaccacagcaaagguuucauucaggagauucu

SEQ ID NO: 291613 - RNA, 64 nt, Human
uaccuuuuaaaauauuuuagauaaaugcacagcaccacagcaccacaucuaagcauuagugaug

SEQ ID NO: 291614 - RNA, 64 nt, Human
auggacaaaacaucacuggaaacaaaggcuguaaccacagcaacagacuuugugauacaguuaa

SEQ ID NO: 291615 - RNA, 64 nt, Human
aggcagugggaggucugcagccuggucauggccuccacagcaggucccuguggacagacauauc

SEQ ID NO: 291616 - RNA, 64 nt, Human
guggugucagagggcaacuggaugacucgcaguaccacagcacugggacagacagaagccacac

SEQ ID NO: 291617 - RNA, 64 nt, Human
ugccucugauagaacaugcuagaaauggucuuuuccacagcauagucugggacuggaaaagaga

SEQ ID NO: 291618 - RNA, 64 nt, Human
acuuaccagagggagcccuacuggccuucccccaccacagcagcccugccugugaagcucuugu

SEQ ID NO: 291619 - RNA, 64 nt, Human
gaaaggggaaaaggaacuuugccaaugauagugaccacagcaaaagcaaauaauaauaauauua

SEQ ID NO: 291620 - RNA, 64 nt, Human
gaaguuggguuggcucuuugugaaccucucauccccacagcagaaucaccaacacucuccgcuu

SEQ ID NO: 291621 - RNA, 64 nt, Human
guugugcacgcagauuagcaggccaaggucugagccacagcagcauuuuuauuucagauuuuga

SEQ ID NO: 291622 - RNA, 64 nt, Human
uuagacugcuuucgcauuaaacagcuaacuucauccacagcaaauugacucaaucaggaaccuu

SEQ ID NO: 291623 - RNA, 64 nt, Human
guugggaguaagugccuugcgugggaauaaacuuccacagcauucgaauauuuuaaugaagccc

SEQ ID NO: 291624 - RNA, 64 nt, Human
acacacacacacaugcacaagucaugugcgaacagcccuccaaagccuaugccacagacagcuc

SEQ ID NO: 291625 - RNA, 64 nt, Human
gagucaacaguccccugauccccuaccucugccugcccuccagccccaucaccagcuucuugcu

SEQ ID NO: 291626 - RNA, 64 nt, Human
ugcaauggugagaucucaacucacugcaaccucugcccuccagguucaagugauucuccucccu

SEQ ID NO: 291627 - RNA, 64 nt, Human
ccucuccccccgccugccaccuccccccacaagugcccuccaggcuuuucuuggggaagauacc

SEQ ID NO: 291628 - RNA, 64 nt, Human
uguggcccgagcaggcucaggcggccccacucacccacagcauccgccgccaccccuucgggug

SEQ ID NO: 291629 - RNA, 64 nt, Human
acacauggccucgccaucguggguaaaaucggccccacagcacgucugcaccagcgggccguua

SEQ ID NO: 291630 - RNA, 64 nt, Human
ccggcugccucuuugcggugguggccugaccgucccacagcagccuccaccagggcccuggugc

SEQ ID NO: 291631 - RNA, 64 nt, Human
ggaagagucugaggaugauagugaaacugaccagccacagcagacaggcccagauugagguggu

SEQ ID NO: 291632 - RNA, 64 nt, Human
aaauucucuuuguaguaauuacuuguuacugacaccacagcaguauagcauaugucacagcucc

SEQ ID NO: 291633 - RNA, 64 nt, Human
aacuaggaggaggaauauuccaucuuggcagaaaccacagcauugguuuuuuucuacuugugug

SEQ ID NO: 291634 - RNA, 64 nt, Human
accagccucagaugagacgggccaggacgcccagccacagcaagcccugucccuuugccggauc

SEQ ID NO: 291635 - RNA, 64 nt, Human
aauuuucuguuuagugggcagguguuauuccugcccacagcaaagcuuggacuugcagcuugcu

SEQ ID NO: 291636 - RNA, 64 nt, Human
ccuuccaggcccuaagcacgugcagcaaagcacaccacagcaccuuugauaaccucucuccauc

SEQ ID NO: 291637 - RNA, 64 nt, Human
cguccuaugaccaaaggccccugccaggugugggccacagcagcagguaugugugaaagcaacg

SEQ ID NO: 291638 - RNA, 64 nt, Human
gaaaaugggcugagcugcaccagacccucacacaccacagcacugcaagcugauggaauguucc

SEQ ID NO: 291639 - RNA, 64 nt, Human
guggccauccugcagaugagcaccguguccagugccacagcacaaggcgccuccccgccccgcc

SEQ ID NO: 291640 - RNA, 64 nt, Human
guucugggagcgcuggggucgccugggccacaggccacagcagcucaccucaggacugggcucu

SEQ ID NO: 291641 - RNA, 64 nt, Human
cagacgauuucagugaccaaaugcucagcuguaaccacagcacuaacuggccuucuuuccagau

SEQ ID NO: 291642 - RNA, 64 nt, Human
aacaaacguacuuccaccagauguguccccagauccacagcaggcacauaucucuccaagggau

SEQ ID NO: 291643 - RNA, 64 nt, Human
gcaccccagagauaugaggcacccuuugcuccacccacagcagggccccgucagacucugccag

SEQ ID NO: 291644 - RNA, 64 nt, Human
agagcaaaugagggagggggcgcucaggacccaggcccuccaugggcuagugugaguggcagcc

SEQ ID NO: 291645 - RNA, 64 nt, Human
auuuguggugcuuggaagagccggccuugggugggcccuccaccgccucuacccucacugggug

SEQ ID NO: 291646 - RNA, 64 nt, Human
gagaccuccuaagggaagggacaguuccuggaaggcccuccagcuggaugcuggggaucagcga

SEQ ID NO: 291647 - RNA, 64 nt, Human
uucuggcuccccaucccaccuggcuccagagccugcccuccacagcuugcugccaagcuacucc

SEQ ID NO: 291648 - RNA, 64 nt, Human
gggugggugaauuccaguguggucagccaguccuccacagcaccucguggcccguacucuugug

SEQ ID NO: 291649 - RNA, 64 nt, Human
agcgccauccaggcccccugggggcgcccgucucccacagcaaaggugagggacaagggucacu

SEQ ID NO: 291650 - RNA, 64 nt, Human
uccuggagauuccauuccauuuucaaguguacagccacagcaaggagcccgacacugauuugau

SEQ ID NO: 291651 - RNA, 64 nt, Human
agguuagugaguaccuagggcggcucaacuccucccacagcaccaacccagcauggucccacug

SEQ ID NO: 291652 - RNA, 64 nt, Human
gcccagccccaaggccaggcugucuacccuauggccacagcaggaggucagcccagggccagga

SEQ ID NO: 291653 - RNA, 64 nt, Human
ucuugccccaacccccagcacccgggcucagggaccacagcaaggcaccugcagguugggccau

SEQ ID NO: 291654 - RNA, 64 nt, Human
ccuugccccccacccaagaagcccugcccuccagccacagcaguccacagcagcaggguuaaga

SEQ ID NO: 291655 - RNA, 64 nt, Human
cacccaagaagcccugcccuccagccacagcaguccacagcagcaggguuaagacucagcacag

SEQ ID NO: 291656 - RNA, 64 nt, Human
cugucuuggggccccaccuggccaagaguagcagccacagcaguaccuccucugaguccuuugc

SEQ ID NO: 291657 - RNA, 64 nt, Human
uucauuuguugaaaaauaaggauccuuuuuaauaccacagcauuuguacuguuccuuuuuaaua

SEQ ID NO: 291658 - RNA, 64 nt, Human
uggcauggccugcuguauaccccaccccaguacuccacagcaccuuguacaguaggcauggggg

SEQ ID NO: 291659 - RNA, 64 nt, Human
guauauuuuaugagcuuuuuggcuuucuuuuuucccacagcaacugccaaugaaggaugaaucc

SEQ ID NO: 291660 - RNA, 64 nt, Human
accuccagggcagaaagagcccaggcuccgggguccacagcacaggauguggggcgagggcaca

SEQ ID NO: 291661 - RNA, 64 nt, Human
ccuucuccccaaccaggauguuggccuggggaggccacagcagggcugagggaacucugcuaug

SEQ ID NO: 291662 - RNA, 64 nt, Human
acagagcugacaaaauuuugcuccccagugaaggccacagcaaccuucugcccauccugucugu

SEQ ID NO: 291663 - RNA, 64 nt, Human
ugccaccaaaggccagggucacugaaggccuggcccacagcaggugcugagcaaagggaacagu

SEQ ID NO: 291664 - RNA, 64 nt, Human
cucauucauaauuucgcaacuguccuuuuggguugcccuccaacacauuacuuccauuucagaa

SEQ ID NO: 291665 - RNA, 64 nt, Human
acccagagggaagaaggaacaguggaggcgggacgcccuccaucuccucggagccccgcgaggu

SEQ ID NO: 291666 - RNA, 64 nt, Human
ccaaacuuucccacauuuuccuguuuucuucugagcccuccaaacuguuccagccucugccugu

SEQ ID NO: 291667 - RNA, 64 nt, Human
uaaaaauuaggcuucuaagaaaggaugggacucugcccuccaggcaaggaguaaauggccccag

SEQ ID NO: 291668 - RNA, 64 nt, Human
caaauagcucccugccuccccacugccccuaaagccacagcagaagagccauucaucucauaaa

SEQ ID NO: 291669 - RNA, 64 nt, Human
caccccucugguucacaccgcacccugcacucacccacagcagcuccauccacugggaaaacug

SEQ ID NO: 291670 - RNA, 64 nt, Human
aucaggcccagagcaacccugagaccccagguacccacagcauuggcuguucuucauaggagac

SEQ ID NO: 291671 - RNA, 64 nt, Human
cuguaaguagagguggaaaaccagagagauguuuccacagcagccauuucccuacccuguuucc

SEQ ID NO: 291672 - RNA, 64 nt, Human
ugacauuucuaguuugcccccucugcccugaaccccacagcaugccugucucagcucccugucc

SEQ ID NO: 291673 - RNA, 64 nt, Human
cucacucuuaaucaaaguguggaggagguggcccccacagcaggguuuggaaccuacagacccu

SEQ ID NO: 291674 - RNA, 64 nt, Human
uaagcugcccugaggguuuccuucggggaccagcccacagcacaccaagguggcccggaagaac

SEQ ID NO: 291675 - RNA, 64 nt, Human
cuuucuaauggggagggcugagggcucccuguccccacagcagguauguugggcucugccccag

SEQ ID NO: 291676 - RNA, 64 nt, Human
aagagaaucuggaccacuacccgggcaccagggaccacagcacugguuuggaccguuacucugc

SEQ ID NO: 291677 - RNA, 64 nt, Human
cagaugccagcuguacugccggcucugccggcacccacagcaacgguacgagcuuguggccucc

SEQ ID NO: 291678 - RNA, 64 nt, Human
ugcaguugguaguucguguacauauuggaacaauccacagcagaucauagcaugauguuuucau

SEQ ID NO: 291679 - RNA, 64 nt, Human
ccaccuccugggaccacaccacuaccgcccccaaccacagcagagacuagcagcggggccaccu

SEQ ID NO: 291680 - RNA, 64 nt, Human
guuuauuauaaaccuucugcuugcugauuuuuucccacagcaugugauucugaaaauguaacua

SEQ ID NO: 291681 - RNA, 64 nt, Human
gcuguuuccaacacuggugauuucuaacuacggcccacagcagaugcuguugaauaacaccaug

SEQ ID NO: 291682 - RNA, 64 nt, Human
cugaaaggacaguauagcugcccuugcucccuacccacagcaccugaguuaaaaagugauuuuu

SEQ ID NO: 291683 - RNA, 64 nt, Human
aaaaaaaaaaggaaaaaaccaaaagcauaaaaaaccacagcaaauuucuugaugaaaauugaaa

SEQ ID NO: 291684 - RNA, 54 nt, Human; identical to SEQ ID NO: 150516

SEQ ID NO: 291685 - RNA, 64 nt, Human
caagggugaauccuucccacacuccuccaugguugcccuccagggucuagcccagccuauuugu

SEQ ID NO: 291686 - RNA, 64 nt, Human
ggucgaggcugcagugugcugugauugugacacugcccuccagccugggugacagagugagacc

SEQ ID NO: 291687 - RNA, 64 nt, Human
cauccauacuggagcccuggauuuuugcaguucugcccuccaccuugcuaucugcaccaggagg

SEQ ID NO: 291688 - RNA, 64 nt, Human
ccuuuuuuucccucucuccaccccuguccucuagccacagcauuuuucuuuuugucuuuuuuuu

SEQ ID NO: 291689 - RNA, 64 nt, Human
ccacccuccacaggaaauugccucaugggcagggccacagcagagagacacagcaugggcagug

SEQ ID NO: 291690 - RNA, 64 nt, Human
cccauaaccugcuaaggucagggcccagggccccccacagcauggcugagggaccccuucccag

SEQ ID NO: 291691 - RNA, 64 nt, Human
ucuauauucugcuucaaaucagccuucagguuucccacagcauggccccugcugacacgagaac

SEQ ID NO: 291692 - RNA, 64 nt, Human
cauuuccaaggccccccucccucuccagguccccccacagcaauaaaagcuucccccugauauc

SEQ ID NO: 291693 - RNA, 64 nt, Human
augaacaaauaaaaauucccagaccacagaauuuccacagcaagaauacacuuauuuuaauuaa

SEQ ID NO: 291694 - RNA, 64 nt, Human
caggggaccauaggucccgucauguacucaguguccacagcagucagucguguaugacccugua

SEQ ID NO: 291695 - RNA, 64 nt, Human
aaaggcucacugacaagagacagcuguuaauuucccacagcaaucauugcagacuaacuuuauu

SEQ ID NO: 291696 - RNA, 64 nt, Human
auggagugcuugcuaugugccccucauggcaggcccacagcacucugaacaggcacagcccucc

SEQ ID NO: 291697 - RNA, 64 nt, Human
cuuggggcacccuuuuagagaagacuguugaaacccacagcacucguugggguaugaggaaacc

SEQ ID NO: 291698 - RNA, 64 nt, Human
acaggacguacacaauauccugcugcugggaaaaccacagcauuuuaucuauuuuuuauuuuaa

SEQ ID NO: 291699 - RNA, 64 nt, Human
ugaauugaagagacaggacuggcaguuggggaggccacagcagcuagaauuuccaggggaaagu

SEQ ID NO: 291700 - RNA, 64 nt, Human
cauuuuugagugguccaagccugcuguuuugaacccacagcaguggagauuuguauucuuauuu

SEQ ID NO: 291701 - RNA, 64 nt, Human
ggcaacaagcaugcagccagcaagcuucggaaaaccacagcaucaaagacaucccaaauaacau

SEQ ID NO: 291702 - RNA, 64 nt, Human
ugcacgcugcccaggggcuucagaaaaggaguggccacagcaccccgaagggagcaucuguuua

SEQ ID NO: 291703 - RNA, 64 nt, Human
ccaugauucuagugcuucugccuuaccguguuucccacagcaacacagagacugauucaaagaa

SEQ ID NO: 291704 - RNA, 64 nt, Human; identical to SEQ ID NO: 229684

SEQ ID NO: 291705 - RNA, 64 nt, Human; identical to SEQ ID NO: 229685

SEQ ID NO: 291706 - RNA, 64 nt, Human; identical to SEQ ID NO: 229686

SEQ ID NO: 291707 - RNA, 64 nt, Human
aaaugcuuucaucuauguuuaucacauuuuaauaccacagcacuuauaaugaugucacuacaua

SEQ ID NO: 291708 - RNA, 64 nt, Human
uuuccgucuguacucucagaaagcaccgaaugacccacagcaagcugauauuuuaggugcucua

SEQ ID NO: 291709 - RNA, 64 nt, Human
gccuggcuauacagugcauccuugaacugucagcccacagcagcaauaugcuuauucuauccac

SEQ ID NO: 291710 - RNA, 64 nt, Human
ccugagccgaugccuuccccucugccuagaugaaccacagcauuuugguaaaugccucagcaug

SEQ ID NO: 291711 - RNA, 64 nt, Human
aucggugcugucagcccugcugucagaccuucuuccacagcaaaugagauguaugcccaaagac

SEQ ID NO: 291712 - RNA, 64 nt, Human
auuucuagucaucuguggauguuaccuugcuuguccacagcagccagucacccuggccaguccc

SEQ ID NO: 291713 - RNA, 64 nt, Human
accacgacugagggcucccggcucggcuucuuccccacagcaggcugcucagagggggugcugc

SEQ ID NO: 291714 - RNA, 64 nt, Human
gcacaccacaacacacaacacaccucaccucacaccacagcacaccucaccacaccacaccgca

SEQ ID NO: 291715 - RNA, 64 nt, Human
cgcacugcaccauaccucaccacaucucaccacaccacagcacaccucaccacacaacacacca

SEQ ID NO: 291716 - RNA, 64 nt, Human
ggcuccuacccagagauucuacccagugaaacucccacagcaacgcagguagauggggcugacc

SEQ ID NO: 291717 - RNA, 64 nt, Human
ccauucucaguaaugggagaucuugaguugcaguccacagcauucacauucucaggauaaacau

SEQ ID NO: 291718 - RNA, 64 nt, Human
gccagcugccuguucuuaccuccgccugcgagagccacagcaaggagcucagccagccguggug

SEQ ID NO: 291719 - RNA, 64 nt, Human
auuggagagagccgggagagagccgcagcuccguccacagcaccacggagaggacagcgccucu

SEQ ID NO: 291720 - RNA, 64 nt, Human
uuuuugcguacacagagaaggcuauguaaacaaaccacagcaggaucgaaggguuuuuagagaa

SEQ ID NO: 291721 - RNA, 64 nt, Human
gccccgaaccuugcaucaaggcuccuugguguggccacagcagaccagaugggaaauuauuugu

SEQ ID NO: 291722 - RNA, 64 nt, Human
cagaacaacaguuggcaggacaggugugacacagccacagcagaggcaaggggugccaggaguc

SEQ ID NO: 291723 - RNA, 64 nt, Human; identical to SEQ ID NO: 229687

SEQ ID NO: 291724 - RNA, 64 nt, Human; identical to SEQ ID NO: 229688

SEQ ID NO: 291725 - RNA, 64 nt, Human; identical to SEQ ID NO: 229689

SEQ ID NO: 291726 - RNA, 64 nt, Human
uuggcuggcuccagaguggacagguacgcucuguccacagcagcugcucaggcacaguaugccg

SEQ ID NO: 291727 - RNA, 64 nt, Human
accugcuugcgaccugcugagggcuugucugcucccacagcaccaucuaagaccccuccucuag

SEQ ID NO: 291728 - RNA, 64 nt, Human
gggaaguagagauguggcggcuuucccacccugcccacagcaggcccuccugcccagcugcucu

SEQ ID NO: 291729 - RNA, 64 nt, Human
caaccuaagguggcauuacagaucuuugagcgagccacagcaacuuuucugccaagucagcuua

SEQ ID NO: 291730 - RNA, 64 nt, Human
cguuucuggaaggauagggcuguguggucaugucccacagcaagcuuuugggaucgggggaaua

SEQ ID NO: 291731 - RNA, 64 nt, Human
gacaguagcaaaaccacuuucuacuuuccaaacaccacagcaucagcaugguuuaggggaagca

SEQ ID NO: 291732 - RNA, 64 nt, Human
ucacuccagugaguuacccagggcuccagggagcccacagcagcaucagacccauccaggggcu

SEQ ID NO: 291733 - RNA, 64 nt, Human
cccaucucuucaauggggcugauaccuucacagcccacagcaugggcacuuaugaggacaaagu

SEQ ID NO: 291734 - RNA, 64 nt, Human
uucaacauaugaauugggggaggacacauuuggaccacagcaugaaccuuuagaacaggguuuc

SEQ ID NO: 291735 - RNA, 64 nt, Human
caggcaaaaguauuugauuugacuuuauaguuuuccacagcacaaugagcaaaagacaaaccuc

SEQ ID NO: 291736 - RNA, 64 nt, Human
ggggcccagaacagucccaccugugcugcugugcccacagcacaaagccaggcuucacucccaa

SEQ ID NO: 291737 - RNA, 64 nt, Human
cacccuguguacccagguccagaggguccguccaccacagcagccccagguggagggcuggucu

SEQ ID NO: 291738 - RNA, 64 nt, Human
gccccucugcacggucaccaucgccugggccugcccacagcacuggugcucaccucuaccuccu

SEQ ID NO: 291739 - RNA, 64 nt, Human
aaggaaagaguaauuuacaacgaaggaaaaaaacccacagcacacccuucgcggcugucagcgc

SEQ ID NO: 291740 - RNA, 64 nt, Human
gccccucuuagguuuggagcagaaguggaggugcccacagcagguacccacuggcccccuccuc

SEQ ID NO: 291741 - RNA, 64 nt, Human
cuguccccgggacugagcugccaugccagccugcccacagcagccuccuagaguuagcaacacc

SEQ ID NO: 291742 - RNA, 64 nt, Human; identical to SEQ ID NO: 229651

SEQ ID NO: 291743 - RNA, 64 nt, Human; identical to SEQ ID NO: 229652

SEQ ID NO: 291744 - RNA, 64 nt, Human; identical to SEQ ID NO: 229678

SEQ ID NO: 291745 - RNA, 64 nt, Human; identical to SEQ ID NO: 229679

SEQ ID NO: 291746 - RNA, 64 nt, Human
ucacuucccuuugcaucugagauccugcuggaaaccacagcaaccuguauccacuauuaggagg

SEQ ID NO: 291747 - RNA, 64 nt, Human
aguuggcuuuauucuugggcuucacaguguggccccacagcaccaguuauugauaaaaagagcu

SEQ ID NO: 291748 - RNA, 64 nt, Human
uccucccuccuagggucuuguguugcaaguugguccacagcaucuccggggcuuugugggauca

SEQ ID NO: 291749 - RNA, 64 nt, Human
cugguaacuuguuagaaauguacauucucaggcuccacagcaggccgccugaaucaaauccugg

SEQ ID NO: 291750 - RNA, 64 nt, Human
uaugacaagagcagugaaggugagguacuugcugccacagcagaaucuaaagaaagcauugagu

SEQ ID NO: 291751 - RNA, 64 nt, Human
ccucuaaucuuggaaccucugaauaugggaccucccacagcaaagggugacuuuugucauuaag

SEQ ID NO: 291752 - RNA, 64 nt, Human
gccacgaagagcuggaccagcuucaaguacauguccacagcaacaugcaggaaggccucuuccc

SEQ ID NO: 291753 - RNA, 64 nt, Human
gucucuggguggaagugugugccaagagcuacucccacagcagccccaggagaaggggcuuugu

SEQ ID NO: 291754 - RNA, 64 nt, Human
ccagcaccuuguggaagaccacacauggguggucccacagcaugggaccaggcuggccugaggg

SEQ ID NO: 291755 - RNA, 64 nt, Human
gggcaugguagucaccgcgaagccgggcaccgucccacagcaucuccuagaagcagccggcaca

SEQ ID NO: 291756 - RNA, 64 nt, Human
cacacaaucugaaaaccacugaaggacaagccaaccacagcagccaagcccacuccuugcagca

SEQ ID NO: 291757 - RNA, 64 nt, Human
gccggcucagguagcacugggcacgaggagugggccacagcaggaucucaacgggaaagcagcc

SEQ ID NO: 291758 - RNA, 64 nt, Human
uguuugaaaguuacgcuuuucuguuguucuagagccacagcagucuaauauugaaauauaauau

SEQ ID NO: 291759 - RNA, 64 nt, Human
ggccccacuucguucucaguuccacugguuuaaaccacagcacauccucuuagaaucaaacaca

SEQ ID NO: 291760 - RNA, 64 nt, Human
ucaguccuauucaacauaguacuggaaguccucgccacagcaaucaggcaagagaaagaaauaa

SEQ ID NO: 291761 - RNA, 64 nt, Human
ggacagagcagccaaugaaaacggccgccugaacccacagcaauaagaaugaaugaggaugccu

SEQ ID NO: 291762 - RNA, 64 nt, Human; identical to SEQ ID NO: 229690

SEQ ID NO: 291763 - RNA, 64 nt, Human; identical to SEQ ID NO: 229691

SEQ ID NO: 291764 - RNA, 64 nt, Human; identical to SEQ ID NO: 229692

SEQ ID NO: 291765 - RNA, 64 nt, Human
cugaaaggagacauugcucuaugucugccuucgaccacagcaagccaucauccuccauugcucc

SEQ ID NO: 291766 - RNA, 64 nt, Human
cuuccagguggggacaagccccucuuggucucagccacagcaccccuuauuccagcugcccugc

SEQ ID NO: 291767 - RNA, 64 nt, Human
guggguaggccauagccaaggaucgauuccccaaccacagcaaaggcaacacucuuccuccaga

SEQ ID NO: 291768 - RNA, 64 nt, Human
caucugaaauggaggcauugcaaugaaaaggcacccacagcaucaugcaaguggcaucuuguaa

SEQ ID NO: 291769 - RNA, 64 nt, Human
guauguuucagagaacauuggauaucaguuuuucccacagcagggacugugagagacaaccagc

SEQ ID NO: 291770 - RNA, 64 nt, Human
caucucugguguucccaccacccuagaugaaaauccacagcacagaccucuaccguguuucucu

SEQ ID NO: 291771 - RNA, 64 nt, Human
agacagaagucaggugucaucaucagacuugcggccacagcacuagagucacccccccaggccu

SEQ ID NO: 291772 - RNA, 64 nt, Human
ugaggcuugaaaacacaccacauugaaaauccugccacagcagcagccgcagccgccaacagca

SEQ ID NO: 291773 - RNA, 64 nt, Human
ucucccacacugcuaggugggccagccccucccaccacagcaggugucauauauggggggccaa

SEQ ID NO: 291774 - RNA, 64 nt, Human
ucugccagggguacugggucccccucagcacccuccacagcacaggccuuccaaguggaugucc

SEQ ID NO: 291775 - RNA, 64 nt, Human
ccaucuagaacacagcaccaucauuuacgaagacccacagcaucacccacugcuucgccucugc

SEQ ID NO: 291776 - RNA, 64 nt, Human
uuccagagagcgagcgcccuuuagcggccugccaccacagcacgcggccuccugauccggaagc

SEQ ID NO: 291777 - RNA, 64 nt, Human
ccaccccacccuuccucuguguguuaucucugccccacagcagccccugggcagcaccaguggc

SEQ ID NO: 291778 - RNA, 64 nt, Human
agguucuuccaggcgagaaaccuguggucuagaaccacagcaagaagaggaggcaugcuggccu

SEQ ID NO: 291779 - RNA, 64 nt, Human
gccaggagcuaccccaggagugggccaggccgggccacagcaauaggaaagccagggccagagc

SEQ ID NO: 291780 - RNA, 64 nt, Human
gcguggggccaggagcuuguccaaggccacaggcccacagcacccccugccggcgggcuccgug

SEQ ID NO: 291781 - RNA, 64 nt, Human; identical to SEQ ID NO: 229670

SEQ ID NO: 291782 - RNA, 64 nt, Human; identical to SEQ ID NO: 229671

SEQ ID NO: 291783 - RNA, 64 nt, Human; identical to SEQ ID NO: 229696

SEQ ID NO: 291784 - RNA, 64 nt, Human; identical to SEQ ID NO: 229697

SEQ ID NO: 291785 - RNA, 64 nt, Human
ugaccacaggcucagguccgacccugcugcuuggccacagcaguggcugggcaagugggaacca

SEQ ID NO: 291786 - RNA, 64 nt, Human
accccugcagaccucauagagccucaucugguggccacagcagccaagccuagagcccuccgga

SEQ ID NO: 291787 - RNA, 64 nt, Human
accccagggccaagagaaaggccugcacacaagcccacagcacagcucccugccaaacugaagc

SEQ ID NO: 291788 - RNA, 64 nt, Human
uuuggcccagcucauuacuuucucccuuucucuaccacagcaaacacauucuccaccaugucag

SEQ ID NO: 291789 - RNA, 64 nt, Human
cccaccaggccagcucuccucccacaacagcuucccacagcaugaagaucuccguggcugccau

SEQ ID NO: 291790 - RNA, 64 nt, Human
agcucaggccugcugguucccacuccauacuuucccacagcacuacgauguguugaaugcuuac

SEQ ID NO: 291791 - RNA, 64 nt, Human
gagugagaugaguggugcuguccauggaaucaggccacagcaggaacugccccacuggccauuu

SEQ ID NO: 291792 - RNA, 64 nt, Human
gcccccuccccgcucccaccucccugcugggaaaccacagcauuaucacagcauuauugugaca

SEQ ID NO: 291793 - RNA, 64 nt, Human
agccuggucauuugcuguccgcuuuucucugugaccacagcagcccugaacaaccaguaugugu

SEQ ID NO: 291794 - RNA, 64 nt, Human
gggguguccgucaguuauuaguggauggagauucccacagcaaggcugcauuugaaugauuucc

SEQ ID NO: 291795 - RNA, 64 nt, Human
guuaccaacugaagagccccaagcucuccauggcccacagcaggcacaggucugagcucuaugu

SEQ ID NO: 291796 - RNA, 64 nt, Human
gccugagaggacacaaugggggaggggcuucggaccacagcaggagccccgacugcccaccuga

SEQ ID NO: 291797 - RNA, 64 nt, Human
gcagagaacagaguguucuggcaaagaggaaaucccacagcagcgcagaggaccugggccugga

SEQ ID NO: 291798 - RNA, 64 nt, Human
agaagggacguuuccaucauucacagugcccuccccacagcacuaccucaccccgacccccacc

SEQ ID NO: 291799 - RNA, 64 nt, Human
gaccgaugacaagcugugacuccagcugggggcgccacagcacccaccaccugccgccuucaga

SEQ ID NO: 291800 - RNA, 64 nt, Human
ugauggcucucaccaccauggcgucacuccgcgaccacagcacaccagaaacacucagcauuau

SEQ ID NO: 291801 - RNA, 64 nt, Human; identical to SEQ ID NO: 229698

SEQ ID NO: 291802 - RNA, 64 nt, Human; identical to SEQ ID NO: 229699

SEQ ID NO: 291803 - RNA, 64 nt, Human; identical to SEQ ID NO: 229700

SEQ ID NO: 291804 - RNA, 64 nt, Human
cagagcauaggcagaauaaaaugguuuaaauaccccacagcaaauagaguaacugacaaaccac

SEQ ID NO: 291805 - RNA, 64 nt, Human
ugccuucuuucuugaguuugcuccuguugacuucccacagcacagauaauugacaugucccuuu

SEQ ID NO: 291806 - RNA, 64 nt, Human
cuacuucuauucagcauuguacuugaaguucuagccacagcaguuagguuaggaauucaagguu

SEQ ID NO: 291807 - RNA, 64 nt, Human
accgcgccuucucaucggcggcggugcucaugcaccacagcaaggaggugcauggccgggagcg

SEQ ID NO: 291808 - RNA, 64 nt, Human
accucagugggugggcagggcuuggucccccuccccacagcaagggaaggcagcuggcucuucu

SEQ ID NO: 291809 - RNA, 64 nt, Human
uauuggaugauuugggcauuacgaucaccucuuaccacagcacagaacauacauucuucaacag

SEQ ID NO: 291810 - RNA, 64 nt, Human
gugacaagaggcugguuuuuaauaacgaaugcagccacagcaccagaccaggggcuauuuuugu

SEQ ID NO: 291811 - RNA, 64 nt, Human
cccgaggccccccaucauccccuguuauuuauugccacagcagagucuaauuuauaugccacgg

SEQ ID NO: 291812 - RNA, 64 nt, Human
ugauggaccgaaggcucuggugucugguuuggccccacagcagugugggccgauccuguuuacc

SEQ ID NO: 291813 - RNA, 64 nt, Human
gcuuccgggguguggcugccgggucggcucugguccacagcacggugccggggcugcagguugu

SEQ ID NO: 291814 - RNA, 55 nt, Human
ccgggacggcaacuuucugaacaucccacagcagucucagguaggagacccugcc

SEQ ID NO: 291815 - RNA, 64 nt, Human
gccccucccuccaucuccccacacccaccccaccccacagcagggcuccuggcccccacccccc

SEQ ID NO: 291816 - RNA, 64 nt, Human
cgcaugguucuggacggcccagcagcuccuguggccacagcagcuuuguacacgaagaccaucc

SEQ ID NO: 291817 - RNA, 64 nt, Human
ggcagcagcccuucccgggggccuacccagugccccacagcagaacccgugggcgcucguguug

SEQ ID NO: 291818 - RNA, 64 nt, Human
gugcuuuuuuaaccaaggaggggccaguggauucccacagcacaaccggucccuuccaugcccu

SEQ ID NO: 291819 - RNA, 64 nt, Human
ccgggagugacuggcuggcuccucuguccugaccccacagcaccucccugaccuuuaggagccc

SEQ ID NO: 291820 - RNA, 64 nt, Human; identical to SEQ ID NO: 229701

SEQ ID NO: 291821 - RNA, 64 nt, Human; identical to SEQ ID NO: 229702

SEQ ID NO: 291822 - RNA, 59 nt, Human; identical to SEQ ID NO: 229703

SEQ ID NO: 291823 - RNA, 64 nt, Human; identical to SEQ ID NO: 229704

SEQ ID NO: 291824 - RNA, 64 nt, Human
cagcaugucccucugacaugcccaggguucucauccacagcagcugggucaccugauagggccg

SEQ ID NO: 291825 - RNA, 64 nt, Human
ggcugggccucaacucaucugacccaucaauucuccacagcagagaaaaaccauucaaauauga

SEQ ID NO: 291826 - RNA, 64 nt, Human
ccuccugaggcccugauggcagcucugcgccaggccacagcagccgcccgcugccgcugccgcc

SEQ ID NO: 291827 - RNA, 64 nt, Human
agcacauguguuacaugucaggcagugaaaccccccacagcagccuucccucucagaggauaca

SEQ ID NO: 291828 - RNA, 64 nt, Human
ucaggaccaccuuugggagugucauccuuacaaaccacagcaugcccggcuccucccagaacca

SEQ ID NO: 291829 - RNA, 64 nt, Human
aggccucuccccuggcaccugcuucaguuguccuccacagcacugauuugcagcccacaagcug

SEQ ID NO: 291830 - RNA, 64 nt, Human
aaaguugugcagagcgcuggggacuccagacuccccacagcagcagagacucgggacugaggca

SEQ ID NO: 291831 - RNA, 64 nt, Human
uguuugaaaacauuuugugaaagccugcuuuguuccacagcauugucuccacucuugaggagca

SEQ ID NO: 291832 - RNA, 64 nt, Human
ggcuucccagggucucagcugagaagcagcaguuccacagcacagccuggucaguccugcgcac

SEQ ID NO: 291833 - RNA, 64 nt, Human
uuccacagcuaaagggcauauguccucugcagauccacagcagagaaaaagucccgugcuugcu

SEQ ID NO: 291834 - RNA, 64 nt, Human
uuccugggcucaagcgauccucccaccucagccuccacagcagcuggaacuccaggugugaauc

SEQ ID NO: 291835 - RNA, 64 nt, Human
cagccccgaaucccacccccgggaccagccacauccacagcacaacugccccgcuggagaggca

SEQ ID NO: 291836 - RNA, 64 nt, Human
gaggguccaggcgggcaagucauccuccuggugcccacagcaggggcuggcccacguagggggc

SEQ ID NO: 291837 - RNA, 64 nt, Human
cugcagcgccugccgccccggggacucgcagcacccacagcaccacguccucgaauucucagac

SEQ ID NO: 291838 - RNA, 64 nt, Human
agugccaagaggccccagggcccagggacuccccccacagcagggugggacccgggacccgcgg

SEQ ID NO: 291839 - RNA, 64 nt, Human
cggccucccaaagugcugggauuacaggugugagccacagcacccaaccuuuuuuuccccgccg

SEQ ID NO: 291840 - RNA, 64 nt, Human; identical to SEQ ID NO: 229666

SEQ ID NO: 291841 - RNA, 64 nt, Human; identical to SEQ ID NO: 229667

SEQ ID NO: 291842 - RNA, 64 nt, Human
guccacugcguuccugggaagggcugcgaggccugcccuccaaaccugacuggggaugggcggc

SEQ ID NO: 291843 - RNA, 64 nt, Human
ccuuggccugccugcccgccagccacgcgugucagcccuccaguucuccuucaguugacgccag

SEQ ID NO: 291844 - RNA, 64 nt, Human
agccucuggccggagaucggccgcccacggggggccacagcagcggccgcucgcccaggaugga

SEQ ID NO: 291845 - RNA, 64 nt, Human
aggaccagacuguuggugacuccuuccccggcccccacagcaguaucagaaacuucugacaauc

SEQ ID NO: 291846 - RNA, 64 nt, Human
cagggccccgggagggaacccugcccccaaccccccacagcaaggcuguacagucucgcccuug

SEQ ID NO: 291847 - RNA, 64 nt, Human
gagggacgacugccuucaagcaucccugcaacugccacagcaggugggggcagggcucguggga

SEQ ID NO: 291848 - RNA, 64 nt, Human
caaucuacguucuagucacuggccucaaaggaccccacagcaccugggccagaccaacagcucg

SEQ ID NO: 291849 - RNA, 64 nt, Human
auuuguggauacagucuucaucuucuucacuuacccacagcagcaacaccaggccugucacaca

SEQ ID NO: 291850 - RNA, 64 nt, Human
agaaaaauauguauauuauuguaaauagaaaugaccacagcagaaugucacacauggcuguucu

SEQ ID NO: 291851 - RNA, 58 nt, Human
gccagccugcuguaagcuaagaacccacccacagcagcccucgggggugucacugcuu

SEQ ID NO: 291852 - RNA, 64 nt, Human
augguaccucucaguguauugguuacuagggcugccacagcaauguaccacaaaccgagugaca

SEQ ID NO: 291853 - RNA, 64 nt, Human
uccagggugguagugcugggcuguucccagccucccacagcagagcuggacgcuguggaaaugg

SEQ ID NO: 291854 - RNA, 64 nt, Human
cagccucccaaaguguugggauuacaggugugagccacagcaccuggccaaccaacacuucuca

SEQ ID NO: 291855 - RNA, 64 nt, Human
agggguggggucccucugucuggggcacuggcacccacagcaggacuccgccagucugaugcca

SEQ ID NO: 291856 - RNA, 64 nt, Human
ccuccuguccuggacgugacuucauccugaggagccacagcacaggccgugcuggcacuuucug

SEQ ID NO: 291857 - RNA, 64 nt, Human
aguuuacguguugcaccuuuucacagacgguuccccacagcauccucagacagcucugugaugu

SEQ ID NO: 291858 - RNA, 64 nt, Human
aggaaaaacacaguccuagggacaaaagccagguccacagcagucauuuuuaaaauaaaguuau

SEQ ID NO: 291859 - RNA, 64 nt, Human
ggcuugucugccgcaggcacagaaggguagaaagccacagcagggggcaguccagcagacucug

SEQ ID NO: 291860 - RNA, 64 nt, Human; identical to SEQ ID NO: 229613

SEQ ID NO: 291861 - RNA, 64 nt, Human; identical to SEQ ID NO: 229614

SEQ ID NO: 291862 - RNA, 64 nt, Human; identical to SEQ ID NO: 229615

SEQ ID NO: 291863 - RNA, 64 nt, Human
ugcggccuguucauuaguccuuucuucccgcugcccacagcauuugcauccuugcugggauccu

SEQ ID NO: 291864 - RNA, 64 nt, Human
guuuguuagccagcacuucugcucugucgucucuccacagcaccuuugugaacucaggaaugug

SEQ ID NO: 291865 - RNA, 53 nt, Human
ugaacaagcagccauacugaugaccacagcaaccagcuccacggccugaugca

SEQ ID NO: 291866 - RNA, 64 nt, Human
ccccaaacacuguggaaggggagaaggaagugauccacagcauucaggccacuuggggucuaga

SEQ ID NO: 291867 - RNA, 64 nt, Human
cuccugcaucccuugaguguugaucaggaggcguccacagcauuguucucgccucugaaugaug

SEQ ID NO: 291868 - RNA, 64 nt, Human
gggacugccaugcacucugccuggugucacaugcccacagcagccucggugacgagagcacgga

SEQ ID NO: 291869 - RNA, 64 nt, Human
gcgggggaagcuguguggaaggagaagcugguggccacagcagaguccugcucuggggacgccu

SEQ ID NO: 291870 - RNA, 64 nt, Human
cugugacccuccuuccucaggaagcgcguugaacccacagcacuccgugguguguuugcagggu

SEQ ID NO: 291871 - RNA, 64 nt, Human
ugcugggaggagcugagggggaacaggagcagggccacagcaccccugaggucuggccaggccc

SEQ ID NO: 291872 - RNA, 64 nt, Human
ccggugcuaccacaccgugcccucaguggacuaaccacagcagcagccagggaugggcccugga

SEQ ID NO: 291873 - RNA, 64 nt, Human
guucuguauuugaaagugccuuugcagcucagaaccacagcaacgaucacaaaugacuuuauua

SEQ ID NO: 291874 - RNA, 64 nt, Human
ggacgggguagagccaggggugauggaggaaccaccacagcagugccuucucgucgaagcgggc

SEQ ID NO: 291875 - RNA, 52 nt, Human
cgagggacaaagggaagugagcccacagcaggcuguaccaggcugcccugcu

SEQ ID NO: 291876 - RNA, 64 nt, Human
aagaagcccaccuucuggucccaaccugcagaccccacagcagucaguuggucaggcccugcug

SEQ ID NO: 291877 - RNA, 64 nt, Human
cggucucugcugaggcucccagccucaguuucccccacagcagcacgggccccacugugcugcu

SEQ ID NO: 291878 - RNA, 64 nt, Human
gaccguccagcauucacuggccggccagcuguguccacagcaguuuuugauaaagguguucuuu

SEQ ID NO: 291879 - RNA, 64 nt, Human; identical to SEQ ID NO: 229619

SEQ ID NO: 291880 - RNA, 64 nt, Human; identical to SEQ ID NO: 229620

SEQ ID NO: 291881 - RNA, 64 nt, Human; identical to SEQ ID NO: 229622

SEQ ID NO: 291882 - RNA, 64 nt, Human; identical to SEQ ID NO: 229623

SEQ ID NO: 291883 - RNA, 64 nt, Human
aggugccgaggugucuucauucucucgcacauuuccacagcaccugcuaaguuuguauuuaaug

SEQ ID NO: 291884 - RNA, 64 nt, Human
gaacuuugcuccaacacacugaugugugggcuucccacagcaggacugacuucccccuuucugu

SEQ ID NO: 291885 - RNA, 64 nt, Human
agcuuugccagcccuaauaagaagcaugcuaaagccacagcagcuacugugguucuucaagcaa

SEQ ID NO: 291886 - RNA, 64 nt, Human
ucuuaauagcaugcugcuccuuuuugcucaguguccacagcaagaugacgugauucuuauuuuc

SEQ ID NO: 291887 - RNA, 64 nt, Human
guuugccacgugcugcccgugacagcacauugagccacagcauuuguagacaggacagaggggu

SEQ ID NO: 291888 - RNA, 64 nt, Human
caggcccuugggcaggcuggggugacggcagaggccacagcaccagcucugacaaguccuauca

SEQ ID NO: 291889 - RNA, 64 nt, Human
gacgaguaccaagccacaagaacacuucuuuuggccacagcauaagcugaugguauguaaggaa

SEQ ID NO: 291890 - RNA, 64 nt, Human
ggggagccccuucugcucagcucugggccauucuccacagcaaccccaggcugaagcagguucc

SEQ ID NO: 291891 - RNA, 64 nt, Human
agggacaaguggacucagggcagcgccaggcugaccacagcacagccaacacgcaccugccuca

SEQ ID NO: 291892 - RNA, 57 nt, Human
uugagcagaugcagaacuagacccccgccacagcagccucugaaguuggacagcaaa

SEQ ID NO: 291893 - RNA, 64 nt, Human
gagccucgcugugucuugcuguucccaggcaccaccacagcaggugcugccauacucuuguggu

SEQ ID NO: 291894 - RNA, 64 nt, Human
ugaguauucugucacagacaagccuccauuaaagccacagcagugcuacccaccacacacaccu

SEQ ID NO: 291895 - RNA, 64 nt, Human
gucugcaggaaggaggacagcagacuuuaggaccccacagcauggcagugcugaccauuucacc

SEQ ID NO: 291896 - RNA, 64 nt, Human
guuucaugcugugaggccuugcaccaggugggggccacagcaccagcagcaucuuugcugggca

SEQ ID NO: 291897 - RNA, 64 nt, Human
accugugggggacugauucaauacauaugcacguccacagcagagaaugccaugcggccugugu

SEQ ID NO: 291898 - RNA, 64 nt, Human
augaggcaccuuuuauauuauauuuguaaaagaaccacagcagcuauuuuggaaagaagcuguu

SEQ ID NO: 291899 - RNA, 64 nt, Human; identical to SEQ ID NO: 229627

SEQ ID NO: 291900 - RNA, 64 nt, Human; identical to SEQ ID NO: 229628

SEQ ID NO: 291901 - RNA, 64 nt, Human; identical to SEQ ID NO: 229629

SEQ ID NO: 291902 - RNA, 64 nt, Human; identical to SEQ ID NO: 229630

SEQ ID NO: 291903 - RNA, 64 nt, Human
ccuccauccuuccucuguuccuucuggccgggcaccacagcacuggggcucaccucuugguuga

SEQ ID NO: 291904 - RNA, 64 nt, Human
ugccacaacggccagcaggugccccauccucugcccacagcagacucugucccauggcucuccg

SEQ ID NO: 291905 - RNA, 64 nt, Human
agggccugguguggaaccagggagcugugggaagccacagcagaaauggaagaaaaacaggucu

SEQ ID NO: 291906 - RNA, 64 nt, Human
cacagcuggcuuguaaggcaggagcuggcccaggccacagcaccugcuggggugggaaagggcc

SEQ ID NO: 291907 - RNA, 64 nt, Human
ccugaauaaacagaaugagcugcagucucuuggcccacagcacuggcuuccccaucucaccugg

SEQ ID NO: 291908 - RNA, 64 nt, Human
ggagccagagagccuggacaucagggacuuuugcccacagcacaugacaccgacagcugcccag

SEQ ID NO: 291909 - RNA, 64 nt, Human
aggccagcagccccugagcccccaguccggaucuccacagcagcaaaggucaccaggcucuccg

SEQ ID NO: 291910 - RNA, 64 nt, Human
ccuccccuccuuuaccgaggacagccugccucugccacagcaaggcugucggggucaagcugga

SEQ ID NO: 291911 - RNA, 64 nt, Human
caggcuaacucugcagaagcacagacacuacagaccacagcauucagcccccauggaguuuggu

SEQ ID NO: 291912 - RNA, 64 nt, Human
cagaaaacacuagacccaggauugaaaaagcaaaccacagcagaaccauccuuuugucauuaau

SEQ ID NO: 291913 - RNA, 64 nt, Human
ucacggagaaggcggcgcccgucaugaacgucauccacagcaucuucagccucgugcucaaguu

SEQ ID NO: 291914 - RNA, 64 nt, Human
gcaugggcaggggcuuucuccuuggaugugggacccacagcagcuuccugaggcuggggguggg

SEQ ID NO: 291915 - RNA, 64 nt, Human
gggggguggccuguggcuuguauccuucaguccaccacagcaaauguguguagauuucaugcuc

SEQ ID NO: 291916 - RNA, 64 nt, Human
gccauaaaugaaauugaaaugguagaauggcugaccacagcaaugaccagcccucauuagggcc

SEQ ID NO: 291917 - RNA, 64 nt, Human
uggugccucuauugaagacuuugcccugccacuuccacagcaguaagccgaaaggaugaagagu

SEQ ID NO: 291918 - RNA, 64 nt, Human
cccaagcggaaugaggccaagacuggcgcugacaccacagcagcugggccccucuuccagcagc

SEQ ID NO: 291919 - RNA, 64 nt, Human; identical to SEQ ID NO: 229624

SEQ ID NO: 291920 - RNA, 64 nt, Human; identical to SEQ ID NO: 229625

SEQ ID NO: 291921 - RNA, 64 nt, Human
aggccagccugucccugaaagagaagauggccaugcccuccauguguaagaacaaugccagggc

SEQ ID NO: 291922 - RNA, 64 nt, Human
cuguggaugacauggccuuacuccagaaucccaggcccuccacugugacucuccuacuggugcu

SEQ ID NO: 291923 - RNA, 64 nt, Human
uaacccagucuuucuucacucuggcuucaaaaagccacagcagagcauugucaccgcaggugcu

SEQ ID NO: 291924 - RNA, 64 nt, Human
cagccaggucugacuccaaagcuguuccauuacaccacagcauuguguggaauuugaggucuag

SEQ ID NO: 291925 - RNA, 64 nt, Human
caugaugagaaauaugguaacggguuuguaacugccacagcaaaacaauuugccuccaugccug

SEQ ID NO: 291926 - RNA, 64 nt, Human
gaauuagagagguuaaauaccuuuuccuagauucccacagcaggaagguggcauagcuguuuug

SEQ ID NO: 291927 - RNA, 64 nt, Human
cucaggcaggcccaucuagagcuauugcuccuucccacagcaaagguauuguggaugacccuua

SEQ ID NO: 291928 - RNA, 64 nt, Human
uuguuuaacuuguaaaugaaaaaauucucuuaaaccacagcacuauugagugaaacauugaacu

SEQ ID NO: 291929 - RNA, 64 nt, Human
ugaccagccgaaccaggaacucaaucaaaaugcgccacagcaggaccacaagggcaaggagacc

SEQ ID NO: 291930 - RNA, 64 nt, Human
guggauugaaguauagauuccaguagccuaguuuccacagcacgauaacaccaugacgccuacu

SEQ ID NO: 291931 - RNA, 64 nt, Human
cauuuuuggcuacauguccgagugaguugcucuuccacagcaguuacauaaguuuuguauuauu

SEQ ID NO: 291932 - RNA, 64 nt, Human
ucuuccuucuggggccugaguuccccaaacuaccccacagcagucccucaaagacagcccucaa

SEQ ID NO: 291933 - RNA, 64 nt, Human
uucaaaugggcucgugacccaaaaaagucaagaaccacagcacuugaguaaaauacucuuuuua

SEQ ID NO: 291934 - RNA, 64 nt, Human
uccugcgaggcuaugagugggaugagugaugcccccacagcaccuccauguggacuuaggaagg

SEQ ID NO: 291935 - RNA, 64 nt, Human
gcagacacaaacugguuucauauggugagagcagccacagcagcagcuugaccugguauucuac

SEQ ID NO: 291936 - RNA, 64 nt, Human
cccaucgucuuguguacacugcuccuguggccuuccacagcagaaaccagggcaaaagggucca

SEQ ID NO: 291937 - RNA, 64 nt, Human
ugccaagucugucuugacaacuggaaacaggguuccacagcagcccauucgugcugaaaacugg

SEQ ID NO: 291938 - RNA, 64 nt, Human
auguuguuuucagguuaauggacacgcaaagaaaccacagcacauacuucuuuucuuucauuua

SEQ ID NO: 291939 - RNA, 64 nt, Human; identical to SEQ ID NO: 229634

SEQ ID NO: 291940 - RNA, 64 nt, Human; identical to SEQ ID NO: 229638

SEQ ID NO: 291941 - RNA, 64 nt, Human; identical to SEQ ID NO: 229639

SEQ ID NO: 291942 - RNA, 64 nt, Human; identical to SEQ ID NO: 229640

SEQ ID NO: 291943 - RNA, 64 nt, Human
gaagccucggccucccugagcucugaccccagccucacccgaaaggccagccuggggcucuccg

SEQ ID NO: 291944 - RNA, 64 nt, Human
gcuuuuggggcacaacaucccaccgcagucccccucacccgacaacaccuccuaccuggccccu

SEQ ID NO: 291945 - RNA, 64 nt, Human
gggguccucugggauuaguuaugcagauauuaaaucacccgaagacacuaacuuacagaagaca

SEQ ID NO: 291946 - RNA, 64 nt, Human
aagcuagugguuuucaaacugguacacauuagacucacccgaggaauuuuaaaacagccuauau

SEQ ID NO: 291947 - RNA, 64 nt, Human
ggggcugacaaaagggugauuccaagaucauccuucacccgagguccugcccaagcacaggcca

SEQ ID NO: 291948 - RNA, 64 nt, Human
aaucccagcacuuugggaggccaaggcggguugaucacccgaggucaggaguucaagaccagcc

SEQ ID NO: 291949 - RNA, 64 nt, Human
uagccgagucacacccgguggcucugguaugaauucacccgaagcgcuucugcaccaacucacc

SEQ ID NO: 291950 - RNA, 64 nt, Human
acccuggaccacauucggaaggggaacuuagagaucacccgaccaacccuucguuuuacaguug

SEQ ID NO: 291951 - RNA, 64 nt, Human
ugggggaucgcaauuaaggagcaagcccccauuuucacccgauccugggcucucccuuccaagc

SEQ ID NO: 291952 - RNA, 64 nt, Human
uuuguauacccacgcuucagcuacuaucuaaucaucacccgaagauuuaagauacaccaaauuu

SEQ ID NO: 291953 - RNA, 64 nt, Human
gaaucacccgaucacagacgaguggccaccggaaucacccgauaacagcccaucacaacuccaa

SEQ ID NO: 291954 - RNA, 64 nt, Human
gaaucgcccgaucacagacgagcagucaucggaaucacccgaucacagacgaguggccaccgga

SEQ ID NO: 291955 - RNA, 64 nt, Human
gaaucacccgaucacagacgagcagucaucggacucacccgaucacagacgagcggucaccaga

SEQ ID NO: 291956 - RNA, 64 nt, Human
gacucgcccgaucacagacgagcagucaucggaaucacccgaucacagacgagcagucaucgga

SEQ ID NO: 291957 - RNA, 64 nt, Human; identical to SEQ ID NO: 291955

SEQ ID NO: 291958 - RNA, 64 nt, Human; identical to SEQ ID NO: 229641

SEQ ID NO: 291959 - RNA, 64 nt, Human; identical to SEQ ID NO: 229642

SEQ ID NO: 291960 - RNA, 64 nt, Human
gaaucgcccaaucacagacaagcagucaucggaaucacccgaucacagacgagcagucaucgga

SEQ ID NO: 291961 - RNA, 64 nt, Human
gaaucgcccggucacagacgagcagucaucggacucacccgaucacagacgagcggucaccgga

SEQ ID NO: 291962 - RNA, 64 nt, Human
cauuugaaaacaacucugaaugugcgguucggaaucacccgaucacagacgagcggucaccgga

SEQ ID NO: 291963 - RNA, 62 nt, Human
cuauuguuggaucaugauuuagucuuauguacauucacccgaagacaaaaaugguacuuaaa

SEQ ID NO: 291964 - RNA, 64 nt, Human
gggcucgagagggcugguccuuauuuauuuaacuucacccgaguuccucuggguuucuaagcag

SEQ ID NO: 291965 - RNA, 64 nt, Human
guugugcucuuugugcccaagaugcgcaggcugaucacccgaggggaauggcagucggaggcgc

SEQ ID NO: 291966 - RNA, 64 nt, Human
ugaugaucacagagccauccuaacaaacggaauaucacccgaccuccuuuaugugagagagaaa

SEQ ID NO: 291967 - RNA, 64 nt, Human
agcaagugaccagcccuugagcuccccaaaaaccucacccgaggcugcccacuauggucaucuu

SEQ ID NO: 291968 - RNA, 64 nt, Human
cagugguggcugccaucccucggggcccaggcccucacccgaagggcugccucacucuguggug

SEQ ID NO: 291969 - RNA, 64 nt, Human
ggcgcggagcccaacugcgccgaccccgccacucucacccgacccgugcacgacgcugcccggg

SEQ ID NO: 291970 - RNA, 64 nt, Human
ggcgcggagcccaacugcgcagacccugccacucucacccgaccggugcaugaugcugcccggg

SEQ ID NO: 291971 - RNA, 64 nt, Human
uggccucugcugccgggccacguuaguccgcagcucacccgaacagaggacaacccugaggugu

SEQ ID NO: 291972 - RNA, 64 nt, Human
acuuaguuauuugagugugggagaggagaccaggucacccgauucccgccaagccggaaguccc

SEQ ID NO: 291973 - RNA, 64 nt, Human
gggacucucacaucucgggccccaaauggacagaucacccgaggagcuggaggggucggccaag

SEQ ID NO: 291974 - RNA, 64 nt, Human
aaucccagcacuuugguaggccgagguggacggaucacccgaggucaggaguuugagaccagcc

SEQ ID NO: 291975 - RNA, 64 nt, Human; identical to SEQ ID NO: 229610

SEQ ID NO: 291976 - RNA, 64 nt, Human; identical to SEQ ID NO: 229611

SEQ ID NO: 291977 - RNA, 64 nt, Human
cagcugccuggccagcccacccuccugcaaccucucacccgaacaccagugaucaggacuggag

SEQ ID NO: 291978 - RNA, 64 nt, Human
auaguccccuggacugagucccccaggccuuccuucacccgacuuccaaacucuuccuuguggu

SEQ ID NO: 291979 - RNA, 64 nt, Human
acuguaaaugccuugcuuguaugaucgucccuggucacccgacuuuggaauuugcaccaucaug

SEQ ID NO: 291980 - RNA, 64 nt, Human
cccccucuucccucagcagccccggaagccugccucacccgacgaggacagcgagcggcccggc

SEQ ID NO: 291981 - RNA, 64 nt, Human
cucgcucccauguuuccacccggcacccugauccucacccgaaucuccuuuuuuuuuuucuuuu

SEQ ID NO: 291982 - RNA, 64 nt, Human
gcuuccggaucugaccccacagccuuuggccugcucacccgaccagccugggccgcauucccug

SEQ ID NO: 291983 - RNA, 64 nt, Human
ggcaucuaaggccuagcaggggugggcacacgggucacccgaggcccauaccaagacucuguuc

SEQ ID NO: 291984 - RNA, 64 nt, Human
cgggucucagccccugccuuccccagucucugggucacccgaauuuucccaccccugcuucucc

SEQ ID NO: 291985 - RNA, 64 nt, Human
aaucccagcacuuugggaggccgagguggguggaucacccgaggucaggaguucgagaccagcc

SEQ ID NO: 291986 - RNA, 64 nt, Human
cuguuuccucccucucuggcccugucuuaccccaucacccgacucuggccacugaccucagggc

SEQ ID NO: 291987 - RNA, 64 nt, Human
uuuuuuuuuuuuugagagacagggucuaccucugucacccgagcuagagugcaguggugcaguc

SEQ ID NO: 291988 - RNA, 64 nt, Human
uuuggggaacgaaugcaacagggaguaaggacucucacccgagagcuggcuucugccacuugcc

SEQ ID NO: 291989 - RNA, 64 nt, Human
ucugcaggucgguuugcugccugcccuccuccucucacccgauguccaggugggauuuuaaagu

SEQ ID NO: 291990 - RNA, 64 nt, Human
uuaguuaguaccuugccacucuacccccaacacgucacccgaguagaagcugggcaaggcccua

SEQ ID NO: 291991 - RNA, 64 nt, Human
caaccacuugaaaagcuggaccaauagcaaggugucacccgaccucagugaagucuuugauguu

SEQ ID NO: 291992 - RNA, 64 nt, Human; identical to SEQ ID NO: 229631

SEQ ID NO: 291993 - RNA, 64 nt, Human; identical to SEQ ID NO: 229632

SEQ ID NO: 291994 - RNA, 64 nt, Human
ucagaguggacagaaagcauuagcguccacgagcucacccgacgccgagccugugaggugggcu

SEQ ID NO: 291995 - RNA, 64 nt, Human
agugcagccaugcagaugguuauuccagcucuggucacccgacuccuuucaccaaauugcuccu

SEQ ID NO: 291996 - RNA, 64 nt, Human
uacggcgaauuaugcucaauggucugauuuuaacucacccgauguuaaucaaugcacauugcuu

SEQ ID NO: 291997 - RNA, 64 nt, Human
uacaaagggacacauccuuauuuugaggguauacucacccgaucauugauuugcauccccaugg

SEQ ID NO: 291998 - RNA, 64 nt, Human
auucuuuauauagauaguauuuuauauuuuauucucacccgaaguauucacacaaucuuuuuaa

SEQ ID NO: 291999 - RNA, 64 nt, Human
guccagagcaacuuaccccggccagccagcccucucacccgaggaucccuacccccuggcccca

SEQ ID NO: 292000 - RNA, 64 nt, Human
cauguguuggugaagcuggugcugugggggccacucacucgaaugacaccuggaggccuguucc

SEQ ID NO: 292001 - RNA, 60 nt, Human
aaguugucaguggaaaauaguauuaacagcucacucgagcaagaacccuccugacaguac

SEQ ID NO: 292002 - RNA, 64 nt, Human
acuccaguguucucuuaaugaggcacuuugccugucacucgagcaagccuggguguuccuuccu

SEQ ID NO: 292003 - RNA, 64 nt, Human
ucccuggaaagggggagaguugcccuuuacagaaucacucgagcccuuuccagcacuguugguc

SEQ ID NO: 292004 - RNA, 64 nt, Human
ggcuaauuuuuguguuuuuuguagagauggagauucacucgacuaauucuuuuuguauucuuag

SEQ ID NO: 292005 - RNA, 64 nt, Human
acauucuaaagagagugagcaugagcucacuccaucacucgaugagauaauaugagauuucuac

SEQ ID NO: 292006 - RNA, 64 nt, Human
cacaagggagugugacuucuuggccauaauaaacucacucgauaguguuuauguuauuaaucug

SEQ ID NO: 292007 - RNA, 64 nt, Human; identical to SEQ ID NO: 229606

SEQ ID NO: 292008 - RNA, 64 nt, Human; identical to SEQ ID NO: 229607

SEQ ID NO: 292009 - RNA, 64 nt, Human; identical to SEQ ID NO: 229644

SEQ ID NO: 292010 - RNA, 64 nt, Human; identical to SEQ ID NO: 229645

SEQ ID NO: 292011 - RNA, 64 nt, Human
aaaacggcagacacaacauguuccuccacgcggcucacucgaugccugcaggccccagugugug

SEQ ID NO: 292012 - RNA, 64 nt, Human
cauauaugaaauugagucuuagauuuaaugaauuucacucgaaaauaaaugaucagaagaauuu

SEQ ID NO: 292013 - RNA, 64 nt, Human
agaaaaauaaaacuguuuaugauacuuguguuagucacucgagcuagcuuauuucagccacuuc

SEQ ID NO: 292014 - RNA, 64 nt, Human
aaggucuuuacuuacuugucuguaucuuucugucucacucgaaaggcacagucucaaugcgcua

SEQ ID NO: 292015 - RNA, 64 nt, Human
auccuauaaugaagaauacuggcacaggcaaugcucacucgaaaacuucaaguaauuucuaguu

SEQ ID NO: 292016 - RNA, 64 nt, Human
aaggaaguauggaaaaguacacucugucacuuugucacucgaugucauuccaaaguuauugccu

SEQ ID NO: 292017 - RNA, 64 nt, Human
uccccagaugccugagccuuuguccaaagugaggucacucgagaauucauggacacggccccca

SEQ ID NO: 292018 - RNA, 64 nt, Human
gugguagugcaagcugaaggcugaggcaggagaaucacucgaacccgggaggcagagguugcag

SEQ ID NO: 292019 - RNA, 64 nt, Human
cggugucuggugcgucagccugcugcuucgugucucacucgagaguugcuucugguuucacacu

SEQ ID NO: 292020 - RNA, 64 nt, Human
guacgucuagcuccucagggcuucggaucgcagcucacucgaggccuggggaaggggacucagg

SEQ ID NO: 292021 - RNA, 64 nt, Human
aaugucagcuacccaggagucugaggcacaagaaucacucgaaccugggagguggagguugcga

SEQ ID NO: 292022 - RNA, 64 nt, Human
gaggagcuucaucuguauuuauggcuacuucccaucacucgaauuaccaccugaacuccaccuc

SEQ ID NO: 292023 - RNA, 64 nt, Human
agucccagcuacuugggaggcugaggcaggagaaucacucgaacccaggaggcagagguugcag

SEQ ID NO: 292024 - RNA, 64 nt, Human
aauccuagcauuuugggaggacgaggcggguggaucacucgaugucaggaguuugagaccagcc

SEQ ID NO: 292025 - RNA, 64 nt, Human
cggagcaaauuauccacaaaggauuugcauuacgucacucgaaacguuuucauccaugcuuagc

SEQ ID NO: 292026 - RNA, 64 nt, Human; identical to SEQ ID NO: 229586

SEQ ID NO: 292027 - RNA, 64 nt, Human; identical to SEQ ID NO: 229587

SEQ ID NO: 292028 - RNA, 64 nt, Human
uuuauacaagcaauauauauauggauuucuauaaucacucgaugugauacaguauaaauaugcu

SEQ ID NO: 292029 - RNA, 64 nt, Human
uguauauauauaaaaaacuaugaaucacucacacucacucgaaaacuaugcagggcuagggagc

SEQ ID NO: 292030 - RNA, 64 nt, Human
uuucauuuauagugccaguagguguaccuuguguucacucgaacuaagaacaaugguuaaggca

SEQ ID NO: 292031 - RNA, 64 nt, Human
agauauuaaugcccagacaaaaagcuaauaccagucacucgauaauaaaguauucgcauuauag

SEQ ID NO: 292032 - RNA, 64 nt, Human
cuggagaucaugaugaacuuuuggcugaaccucaucacucgaacuccagcuucaagaauguguu

SEQ ID NO: 292033 - RNA, 64 nt, Human
gaaaaaaaagcuggauuugauuuuuuuuuucuggucacucgagcacaucuaagaucacccauua

SEQ ID NO: 292034 - RNA, 64 nt, Human
cagccuucccucucuuucugggauguuugggacuucacucgaccugcacgggcucugcccgaca

SEQ ID NO: 292035 - RNA, 64 nt, Human
gaucccagcuacuuggaaggcugaggugagaggaucacucgaggagauuggggcugccaugagc

SEQ ID NO: 292036 - RNA, 64 nt, Human
aaucccagcuacuagggaggcugaggcaggagaaucacucgaacccgggaggcagagguugcag

SEQ ID NO: 292037 - RNA, 64 nt, Human
auuuuuuguagagacagggucucacuguguugccucacucgagcugcugaccucaagugauccu

SEQ ID NO: 292038 - RNA, 64 nt, Human
caggugaacacaagcggcugccgcauguagccacucacucgacuuuuuuucagcugugaccauu

SEQ ID NO: 292039 - RNA, 64 nt, Human
uauucagaaugagaaaaauccuaacccaauagaaucacucgaaaaagaaucugcuuucaaaacg

SEQ ID NO: 292040 - RNA, 64 nt, Human
aauccgagugcuuugggaggcugaggcaggaggaucacucgagcucaagaauucaagaccuggg

SEQ ID NO: 292041 - RNA, 64 nt, Human
aagaaguacugccaauacugccaaccagagcagcucacucgagaucuuuguguccagaguuuuu

SEQ ID NO: 292042 - RNA, 64 nt, Human; identical to SEQ ID NO: 229646

SEQ ID NO: 292043 - RNA, 64 nt, Human; identical to SEQ ID NO: 229647

SEQ ID NO: 292044 - RNA, 64 nt, Human; identical to SEQ ID NO: 229649

SEQ ID NO: 292045 - RNA, 64 nt, Human; identical to SEQ ID NO: 229650

SEQ ID NO: 292046 - RNA, 64 nt, Human
auuccaagacuggccugaaacugcaugagcaacaucacucgaaauaauuuuuuuuuucaaaagc

SEQ ID NO: 292047 - RNA, 64 nt, Human
uuacauaaaauuauuuuguuuggcauuauuuuucucacucgaagaaacuauauaggguuguuuu

SEQ ID NO: 292048 - RNA, 64 nt, Human
cagaauggagacacccgugaccucaggcugaaagucacucgacauuggucucuuguguugauag

SEQ ID NO: 292049 - RNA, 64 nt, Human
uaagacuuacaaaaaaagauuuaaaguggcagcuucacucgacauuuggugagagaaguacaaa

SEQ ID NO: 292050 - RNA, 64 nt, Human
aaucccagcaauuugggaguccgaggcgggcggaucacucgaggucaggaguuccagaccagcc

SEQ ID NO: 292051 - RNA, 64 nt, Human
cuccuuuccaccaaagccagguuuccugguaaggucacucgaagauaagggauggggauggggg

SEQ ID NO: 292052 - RNA, 64 nt, Human
cuaaccuuugaguccagcccuuuccaguuuucauucacucgaaguaacugcacucaagcugugc

SEQ ID NO: 292053 - RNA, 64 nt, Human
ggcucggccgcagagccggggcccagcgaaucacgcagagaaaucuuacagaaaacaggggugg

SEQ ID NO: 292054 - RNA, 64 nt, Human
ccaaccagagaccuuugcuuugauaucaucaacugcagagaaugcuguugaugggaaugcugga

SEQ ID NO: 292055 - RNA, 64 nt, Human
gaaauucucaucaguccauugcucuugagucuuugcagagaaccucagaucaggugcaccuggg

SEQ ID NO: 292056 - RNA, 64 nt, Human
auacugugaguuuccaaccucagcccaucugugggcagagaaggucuaguuuguccaucagcau

SEQ ID NO: 292057 - RNA, 64 nt, Human
agguggcaaaauggcacugaauauccccuuggcagcagagaaaacccacugaaagaucguagag

SEQ ID NO: 292058 - RNA, 64 nt, Human
agaccgagaaauuuaaagaaucggacagauggacgcagagaaccagagggcaaugugggaccuu

SEQ ID NO: 292059 - RNA, 64 nt, Human
ccaggagcacaucagggagcugggaaacacaguugcagagaacucagcuguauguugcccucug

SEQ ID NO: 292060 - RNA, 64 nt, Human; identical to SEQ ID NO: 229657

SEQ ID NO: 292061 - RNA, 64 nt, Human; identical to SEQ ID NO: 229658

SEQ ID NO: 292062 - RNA, 64 nt, Human; identical to SEQ ID NO: 229659

SEQ ID NO: 292063 - RNA, 64 nt, Human
ucuaauuggggacaggcagaccuagauaagaaaagcagagaacuacuuuggaaaacaguuuauc

SEQ ID NO: 292064 - RNA, 64 nt, Human
gaaaauacagcaggaagagacagcuuuuagaggggcagagaauuagaggauggugguaguaaug

SEQ ID NO: 292065 - RNA, 64 nt, Human
aaugaaaaagcagggacaacaggaggaaaugaaggcagagaaauauaguuuccuuuccuaggau

SEQ ID NO: 292066 - RNA, 64 nt, Human
ccagaagaccuuucagaugguuuauuugcuuucagcagagaauuuauuucauacaguuacuuaa

SEQ ID NO: 292067 - RNA, 64 nt, Human
aguuuguuuuauugagguggaaaaauagccccaagcagagaaaaggaggguaggucugcauuau

SEQ ID NO: 292068 - RNA, 64 nt, Human
cuucauaaauuagugcuguuuacuuucagaggaagcagagaaguugcuguuauguuuuugcauc

SEQ ID NO: 292069 - RNA, 64 nt, Human
uaggaggaaaugaggaaaucgcuguguuguuaaugcagagaacaaacucuguuuaguugcaggg

SEQ ID NO: 292070 - RNA, 64 nt, Human
ucuccugccgcucccugcagaggaugcucguuuugcagagaaggcaguguuccucuauucccuu

SEQ ID NO: 292071 - RNA, 64 nt, Human
gugagcaaaaugcugcuuucugccuugguggcaggcagagaacugucucguacuagaauucaag

SEQ ID NO: 292072 - RNA, 64 nt, Human
acaccucaaacucugucagugcccuggcauucuggcagagaauccucaccaguucucaccaacc

SEQ ID NO: 292073 - RNA, 64 nt, Human
acaaacaaagcagaacuaaaauauugggaccauggcagagaaaagcaggagaggagcaaaauga

SEQ ID NO: 292074 - RNA, 64 nt, Human
auuaguuagucuuggaacuaguguuaaguaucuggcagagaacaguuaaucccuaaggucuuga

SEQ ID NO: 292075 - RNA, 64 nt, Human
acugcucucauaauugaagacguguuuguuauuggcagagaaccuuaaaaaaggccuuuaccuc

SEQ ID NO: 292076 - RNA, 64 nt, Human
cuuuaccucagcgaugcuuccuagccccaggcuugcagagaacacagagugguguuguggucua

SEQ ID NO: 292077 - RNA, 64 nt, Human; identical to SEQ ID NO: 229602

SEQ ID NO: 292078 - RNA, 64 nt, Human; identical to SEQ ID NO: 229603

SEQ ID NO: 292079 - RNA, 64 nt, Human
gccacagcccacacagcccugggacacugcccuggcccuccauacucugcucccuacuggcugu

SEQ ID NO: 292080 - RNA, 64 nt, Human
aggcuggagagugagggaggaggcucugcuggccgcagagaacacagggaugggagggucccua

SEQ ID NO: 292081 - RNA, 64 nt, Human
gaaaucagacaguaagagaaagccaaaaagcaaugcagagaaagguguccaagcugucuucagc

SEQ ID NO: 292082 - RNA, 64 nt, Human
gugaucuacauuugggugcuuguuucugagauuugcagagaaguauaacaugguaguuccucua

SEQ ID NO: 292083 - RNA, 64 nt, Human
agcugucuuccuguguaccucuagaaucccagcagcagagaaccaucaaggcgggagggccugc

SEQ ID NO: 292084 - RNA, 64 nt, Human
agcuaaaaaauuguuaaacuugcagcuugguauugcagagaagauuuuauaagaauuuugcuuu

SEQ ID NO: 292085 - RNA, 64 nt, Human
gcacagaagcugcaaaagggaucuucgaaacugggcagagaaaaaauaaaguggaauauuaagu

SEQ ID NO: 292086 - RNA, 64 nt, Human
guguuuguuuuguuaaaguuguuggcaccaggaugcagagaaucagacuggccugaggugaagg

SEQ ID NO: 292087 - RNA, 64 nt, Human
ccguucuagggccguggccuuugccgagacuguagcagagaaaacguauuuauuauuccagagu

SEQ ID NO: 292088 - RNA, 64 nt, Human
auacucauacuugcuguccagagggaguaaaacagcagagaacaguuugugugccauuaaaaca

SEQ ID NO: 292089 - RNA, 64 nt, Human
caaaugguucucaauuuuccaguuugauugaagugcagagaaaaaucccuuagauugcaaaaua

SEQ ID NO: 292090 - RNA, 64 nt, Human
ucaggugccacucccugagcuuuggggacaguuggcagagaaggccucuugugcucacgcuccc

SEQ ID NO: 292091 - RNA, 64 nt, Human
ugcaguuucuguaaacaacuuguauaauagaaaagcagagaaauaaauuucccuccccuucaag

SEQ ID NO: 292092 - RNA, 64 nt, Human
ggaaaacaaaaaucagaaggcugcauucuagagggcagagaaauucccccgaagacugagcugg

SEQ ID NO: 292093 - RNA, 64 nt, Human
gaccagguguuuuucuuuuggggcgaaccccugagcagagaaucuuacuaggcuuugguuauca

SEQ ID NO: 292094 - RNA, 64 nt, Human; identical to SEQ ID NO: 229564

SEQ ID NO: 292095 - RNA, 64 nt, Human; identical to SEQ ID NO: 229565

SEQ ID NO: 292096 - RNA, 64 nt, Human; identical to SEQ ID NO: 229566

SEQ ID NO: 292097 - RNA, 64 nt, Human
augcuagagucaacuuacucuguugcuggcuuuagcagagaauaggaggaaccauaugaaaaag

SEQ ID NO: 292098 - RNA, 64 nt, Human
gcccugagaaagcccugucgggcuuugugugaaggcagagaaagggacaaugauaguagaguga

SEQ ID NO: 292099 - RNA, 64 nt, Human
gagugggacuucaaaauuuuuauuauugacaauggcagagaacaauuaaaggguugacucaaga

SEQ ID NO: 292100 - RNA, 64 nt, Human
aaaaaugaauauguugaucauuaggggugugggagcagagaaaauugugaaagugacucucacu

SEQ ID NO: 292101 - RNA, 64 nt, Human
aauauuuuuaacuuggggcaggaagaagggagcagcagagaauugacuagauauagcaccuauu

SEQ ID NO: 292102 - RNA, 64 nt, Human
guggugacucauuuccauaccauuguggaauugagcagagaaccugcucucggaggaugccuag

SEQ ID NO: 292103 - RNA, 64 nt, Human
caguuucucagacuguagccauugaaaauuagaugcagagaauucagagauuucuucuuaaugg

SEQ ID NO: 292104 - RNA, 64 nt, Human
ggagggggguuuccagggccugguguuggagagugcagagaaauaucuaccucccuggaggugu

SEQ ID NO: 292105 - RNA, 64 nt, Human
augcugugaguuuccaaccucagcccaucugcgggcagagaaggucuaguuuguccaacaccau

SEQ ID NO: 292106 - RNA, 64 nt, Human
gaaaggggaaacagaauuaaagacaccagaaguagcagagaagcagggggccagagcuacaaca

SEQ ID NO: 292107 - RNA, 64 nt, Human
aauguaaaaauaaaaucuaacucucauuugacaagcagagaaagaaaaguuaaauaccagauaa

SEQ ID NO: 292108 - RNA, 64 nt, Human
aagcugccagagugcacuggggggaauguucucagcagagaagaaugaggagaaguuuaauauu

SEQ ID NO: 292109 - RNA, 64 nt, Human
acaggggcugaggagagagggcacaggagagagggcagagaagaggaggggugucuagggggac

SEQ ID NO: 292110 - RNA, 64 nt, Human
cagaauauauacaugcaucuauguacagagccuugcagagaaacacaaaauuuugaggcuagac

SEQ ID NO: 292111 - RNA, 64 nt, Human; identical to SEQ ID NO: 229561

SEQ ID NO: 292112 - RNA, 64 nt, Human; identical to SEQ ID NO: 229562

SEQ ID NO: 292113 - RNA, 64 nt, Human; identical to SEQ ID NO: 229567

SEQ ID NO: 292114 - RNA, 64 nt, Human
ugggugggggccagggccugggcuuuacucaauugcagagaaaaaacuuucucccugcaucuca

SEQ ID NO: 292115 - RNA, 64 nt, Human
uuccuguccauaucuggcuugcaugugccagaaagcagagaauagaaaauguaaucuccaacau

SEQ ID NO: 292116 - RNA, 64 nt, Human
ggcagugugggacccucaguucuaggacugguccgcagagaaagcacccaggagcagagcgcuu

SEQ ID NO: 292117 - RNA, 64 nt, Human
aggaucacucucaaaugagauuaaaaacaaggaagcagagaauggucagagaaugggauucaga

SEQ ID NO: 292118 - RNA, 64 nt, Human
gugagacucaauaauaacugaacuacagcaaaaggcagagaauuacagggagaaaaaacuugua

SEQ ID NO: 292119 - RNA, 64 nt, Human
uugcugacuuaaccccccauagugugggggaccugcagagaaccauggcauucccuauuccaca

SEQ ID NO: 292120 - RNA, 64 nt, Human
acaaaaugggcgaagauauugucuuuaggauaaggcagagaaacagauguugcagacuuccacg

SEQ ID NO: 292121 - RNA, 64 nt, Human
cugccccaguucuccuaagaaaaauccgcugugggcagagaacgaugaugauuuaaugguguuu

SEQ ID NO: 292122 - RNA, 64 nt, Human
uuuaaaaauaguauacacuuauuuuaagugaaaagcagagaauuuuauuuauagcuaauuuuag

SEQ ID NO: 292123 - RNA, 64 nt, Human
ccucacagcagucacaggcccaggaaggcggcaggcagagaaguggagugacuauuuggagaau

SEQ ID NO: 292124 - RNA, 64 nt, Human
cagguuacaaaggccaugugccccuuugaaucuggcagagaaaguuuccucguuguaaguauuu

SEQ ID NO: 292125 - RNA, 64 nt, Human
gaaacaauuauugguggugaacuguacuuaaauugcagagaaaccuguaaguaauggaagguaa

SEQ ID NO: 292126 - RNA, 64 nt, Human
gcagccggcuuagaggagcuagcccaucaagccggcagagaaucccccacacgcucugaaggac

SEQ ID NO: 292127 - RNA, 64 nt, Human
cagucaguucugagcgagcggccccuggacaguugcagagaaacacaggcuugucgugccguuu

SEQ ID NO: 292128 - RNA, 64 nt, Human; identical to SEQ ID NO: 229551

SEQ ID NO: 292129 - RNA, 64 nt, Human; identical to SEQ ID NO: 229552

SEQ ID NO: 292130 - RNA, 64 nt, Human; identical to SEQ ID NO: 229569

SEQ ID NO: 292131 - RNA, 64 nt, Human
agcacugauuuuugauagacuaaguggaaaauuugcagagaaaugaugguuguaaguggacaug

SEQ ID NO: 292132 - RNA, 64 nt, Human
cugacauucugcaccagcuaccucugccuccauggcagagaaaaggccauaagaacaguggaag

SEQ ID NO: 292133 - RNA, 64 nt, Human
aaagaaaaaauacauguuuuuaagaaaacauugagcagagaacugcagccaggaugcgcucagc

SEQ ID NO: 292134 - RNA, 64 nt, Human
gcaguuggacuuugccgaugcugcaagaaggggugcagagaagacuccuguguuggagacacuc

SEQ ID NO: 292135 - RNA, 64 nt, Human
uggagggcgguggucuguuacagggugugcaggggcagagaaggaagggaccaggggacugggc

SEQ ID NO: 292136 - RNA, 64 nt, Human
gaaaugcucaaugucugaugcuaagugggagaaggcagagaacaaaggauguggcauaaugguc

SEQ ID NO: 292137 - RNA, 64 nt, Human
ucuaacuuguuaugcagcaauagauaaauaauaugcagagaaagagaaacaaaugcauuuguuu

SEQ ID NO: 292138 - RNA, 64 nt, Human
aacccuaggaacaaggagccuuuguuccaacagagcagagaaggagguucucuauguucagacc

SEQ ID NO: 292139 - RNA, 64 nt, Human
acucggauucuuuugcaugaugggguaaagcuuagcagagaaucaugggagcuaaccuuuaucc

SEQ ID NO: 292140 - RNA, 64 nt, Human
ucaccugucugccuggcuggcaccucauaucucagcagagaagccagugguggccacgcagccu

SEQ ID NO: 292141 - RNA, 64 nt, Human
gucucucuaggaggaguggacugaauggaucguugcagagaagacucacccagaccuggccagg

SEQ ID NO: 292142 - RNA, 64 nt, Human
ucauucagccguauugcacagaugagcaauuacagcagagaaaauucauuagugcucccacuca

SEQ ID NO: 292143 - RNA, 64 nt, Human
aguuaguggaaaucugaacauucuccuguggaaggcagagaaaucuaagcugugucugcccaau

SEQ ID NO: 292144 - RNA, 64 nt, Human
guaugccuguuaauuuuaagagcuucccuuucuugcagagaacaagucugcccagauuccaugc

SEQ ID NO: 292145 - RNA, 64 nt, Human; identical to SEQ ID NO: 229570

SEQ ID NO: 292146 - RNA, 64 nt, Human; identical to SEQ ID NO: 229571

SEQ ID NO: 292147 - RNA, 64 nt, Human; identical to SEQ ID NO: 229573

SEQ ID NO: 292148 - RNA, 64 nt, Human
aagccuuggaacgaguauaaauaauggcuguucagcagagaaacccauguccucucuccauagg

SEQ ID NO: 292149 - RNA, 64 nt, Human
gggccuucccuggggguggccagccugguagggggcagagaaggaaaagcugaggggggucccu

SEQ ID NO: 292150 - RNA, 64 nt, Human
cagcgggcccaggccuaccucacucucucccuuggcagagaagcagacguccauagcuccucuc

SEQ ID NO: 292151 - RNA, 50 nt, Human
uuuucagauuuuacaaaugagcagagaauacgguuuugguguccugcuac

SEQ ID NO: 292152 - RNA, 64 nt, Human
uuuuaauuaucuauugcuaaaaacauaguaagaugcagagaauucuuuauuugucauaagccag

SEQ ID NO: 292153 - RNA, 64 nt, Human
agcucccucaaagucagggcccaccccaucugaggcagagaagacucgaguccagcccccagga

SEQ ID NO: 292154 - RNA, 64 nt, Human
ucagggaguaagugacacuuugaacuccucaagggcagagaacugucuuucauuuuugaacccu

SEQ ID NO: 292155 - RNA, 64 nt, Human
cuucuuuugcuaacauaaaaaugaguaaacuacagcagagaaauaagaauaaaacuaaugaagg

SEQ ID NO: 292156 - RNA, 64 nt, Human
agcugagcuuagcucugcccuggaaccuaccagagcagagaagggcaggagaggaagauuuguc

SEQ ID NO: 292157 - RNA, 64 nt, Human
guggaauuccaaauaaguaaaacugaaauucagugcagagaaaacuuuguccacuagugcaagu

SEQ ID NO: 292158 - RNA, 64 nt, Human
gaaaaaugcauccuaaccauuccauccuguuggugcagagaaauuuuggugauuuauuagaaga

SEQ ID NO: 292159 - RNA, 64 nt, Human
gucaagugcaaaacuacccuggcccaaaggaagggcagagaacauaauuacaucuuaggccaca

SEQ ID NO: 292160 - RNA, 64 nt, Human
acaggaggccacaguccuuccuggggcauuccaggcagagaaggagcagaggcucucccggcag

SEQ ID NO: 292161 - RNA, 64 nt, Human
acauucaaaugguuguagccuggugggguagaaggcagagaagacuacccagccagugaagugc

SEQ ID NO: 292162 - RNA, 64 nt, Human; identical to SEQ ID NO: 229663

SEQ ID NO: 292163 - RNA, 64 nt, Human; identical to SEQ ID NO: 229664

SEQ ID NO: 292164 - RNA, 59 nt, Human; identical to SEQ ID NO: 229665

SEQ ID NO: 292165 - RNA, 64 nt, Human
aggaaagggagcuacagaaaggagguuuaggauugcagagaagaugcaagagcacuuuggccca

SEQ ID NO: 292166 - RNA, 64 nt, Human
uaaugccccaguugucccccacuccuaaugccaggcagagaaggacagccuuuauagacuuaau

SEQ ID NO: 292167 - RNA, 64 nt, Human
cuggaccuaagucuaguguauccauacaauuggugcagagaaauaagguguaaauggugcuuug

SEQ ID NO: 292168 - RNA, 64 nt, Human
cacaucuaaacaaaguuuagguaaaugaauuaucgcagagaaaaaccacaugagaaaauuuuug

SEQ ID NO: 292169 - RNA, 64 nt, Human
auccucccuuugguaccuuaauuugacuguccucgcagagaaugugaacauguguguguguugu

SEQ ID NO: 292170 - RNA, 64 nt, Human
ucagcauuuaugaaacaaggcuaggggaagaugggcagagaaaaaggggacaccuaguuugguu

SEQ ID NO: 292171 - RNA, 64 nt, Human
auuuggaugcagugaaaagggcagaaauaccacagcagagaauaaaauugauaauguuggcaac

SEQ ID NO: 292172 - RNA, 64 nt, Human
guacgucugacugagagaaagauggucgucuccagcagagaaagugaacagcauuuguuggaag

SEQ ID NO: 292173 - RNA, 64 nt, Human
agaguuaggcuucucacccacugcguauuaacuggcagagaauuuaggggagguucagaagaca

SEQ ID NO: 292174 - RNA, 64 nt, Human
cugcccucacugccucuuugcaguaggggagagagcagagaaguacaggucaucugcugggauc

SEQ ID NO: 292175 - RNA, 64 nt, Human
guaguucacaauucuaauaaccuucccucaaaaugcagagaaaauauaaguugucucuuuauau

SEQ ID NO: 292176 - RNA, 64 nt, Human
uuuuuuuaugucucaaguaaaauggcugagcauugcagagaaaaaaaaaaguccccacauuuua

SEQ ID NO: 292177 - RNA, 64 nt, Human
aagcuucccuccaucccccuuuacccucuuugcugcagagaaacuuaagcaaaggggacagcug

SEQ ID NO: 292178 - RNA, 64 nt, Human
gaaagcaguuuuuauaaaaagaaagcccgggucugcagagaaugaaaacugguuggaaacuaaa

SEQ ID NO: 292179 - RNA, 64 nt, Human; identical to SEQ ID NO: 229547

SEQ ID NO: 292180 - RNA, 64 nt, Human; identical to SEQ ID NO: 229548

SEQ ID NO: 292181 - RNA, 64 nt, Human; identical to SEQ ID NO: 229581

SEQ ID NO: 292182 - RNA, 64 nt, Human
auggcugaguaguuuuuugaugaauucaaucaaugcagagaacgcuuuuagauaaaucagaacu

SEQ ID NO: 292183 - RNA, 64 nt, Human
uucuccuugguauuucugggucuuucugacaucagcagagaacuggaaagacauagccaacugc

SEQ ID NO: 292184 - RNA, 64 nt, Human
aaaugaugcaguaaaugagcaaugacaguguacugcagagaaaauuuacucuugccuagaacug

SEQ ID NO: 292185 - RNA, 64 nt, Human
cagaguuagcauaauuuggagcuauucaggaauugcagagaaaugcauuuucacagaaaucaag

SEQ ID NO: 292186 - RNA, 64 nt, Human
aaccugcuguccuccagaaagcaccaaggaaaaagcagagaaugacagcaaacagaucacuagg

SEQ ID NO: 292187 - RNA, 64 nt, Human
gcuuuucccuguccugacaccaggcaagaaaagcgcagagaaaucggugucugacgauuuugga

SEQ ID NO: 292188 - RNA, 64 nt, Human
acgcccaccugugccucagggcaccgccugccgagcagagaaggcacagcagccgucagagucc

SEQ ID NO: 292189 - RNA, 64 nt, Human
caaaaacuugcauucuggcauaauuuuuacaguugcagagaauuguuucugggcucauuaaaaa

SEQ ID NO: 292190 - RNA, 64 nt, Human
aauucaguuaagacuucugugauagauguuuauagcagagaagaaaugucucaucaauagaaaa

SEQ ID NO: 292191 - RNA, 64 nt, Human
ucucggaauggcaggggaagccuugcacuagguugcagagaagcauccuccacauccuguguca

SEQ ID NO: 292192 - RNA, 64 nt, Human
ugacccuccaccgcagaaggaaggcagggaggaggcagagaagaaagaacggaagaagagauca

SEQ ID NO: 292193 - RNA, 64 nt, Human
ggauuggggucaauugcaguccacguaacuggcugcagagaaaucuaccgagcaaggaaaaggc

SEQ ID NO: 292194 - RNA, 64 nt, Human
caguauugaguguucuaguuccuggaauuaguuggcagagaaaaugcugccuagugcuacagau

SEQ ID NO: 292195 - RNA, 64 nt, Human
cucuugcagcaaaaauaauaugaggucaucaagggcagagaacuguguggcaucuccuuauagu

SEQ ID NO: 292196 - RNA, 64 nt, Human; identical to SEQ ID NO: 229574

SEQ ID NO: 292197 - RNA, 64 nt, Human; identical to SEQ ID NO: 229575

SEQ ID NO: 292198 - RNA, 64 nt, Human; identical to SEQ ID NO: 229585

SEQ ID NO: 292199 - RNA, 64 nt, Human
aaugagcacgcauggaaaaguuucccagucuucagcagagaaguuuucuggaggucucugaacc

SEQ ID NO: 292200 - RNA, 64 nt, Human
uucuuaaauuucuuuacucaugacauuucgcagugcagagaaggcagaacccaagaaaaacguc

SEQ ID NO: 292201 - RNA, 64 nt, Human
ugguaucaugguguuuauuuucuuucuuauaacugcagagaaaauauccugacuaaaaaaaauu

SEQ ID NO: 292202 - RNA, 64 nt, Human
gcaauuuacuuuuaaagacaaacauaacuauuuagcagagaauauuuuaauaaaugcaaaacaa

SEQ ID NO: 292203 - RNA, 64 nt, Human
cuaaugauucaaauguuuuaaaguuuaaugccuagcagagaacugccuuaaaaaaaaaaaaaaa

SEQ ID NO: 292204 - RNA, 64 nt, Human
acaugcuaaaauggcuucugaaugaaauacgacagcagagaaagaugccacugaaaugcugaaa

SEQ ID NO: 292205 - RNA, 64 nt, Human
aagccaaaacauccuucaagucugugguuuugaugcagagaagaaaauaguuuugauuuuugag

SEQ ID NO: 292206 - RNA, 64 nt, Human
uuuugcgauuucacaguuggcacuucugccaugagcagagaacugaugcgacuuguuuugcugc

SEQ ID NO: 292207 - RNA, 64 nt, Human
gaauguuuauacaaaaaaugaaauucuuccaacagcagagaaacucuaaaaaguuugauaguac

SEQ ID NO: 292208 - RNA, 64 nt, Human
aaauacuguacuucuguaccaacauugccuccuagcagagaagugugugugugacaagccaguu

SEQ ID NO: 292209 - RNA, 64 nt, Human
aguguggucuguucuuuaccucccuuuauuuggugcagagaaguuagauccugcuaaauuucaa

SEQ ID NO: 292210 - RNA, 64 nt, Human
acacccacccucucccccuucagccaugcugauggcagagaagauaagaacuuggagcccauuu

SEQ ID NO: 292211 - RNA, 64 nt, Human
aaugucgugcacuggcaaugcuauuuuagagucugcagagaagagaaagcauguugcuuaaaca

SEQ ID NO: 292212 - RNA, 64 nt, Human
gccucuggggaagagagggaagagaaagcacagagcagagaagcagagauguuccuugaacugc

SEQ ID NO: 292213 - RNA, 51 nt, Human; identical to SEQ ID NO: 229660

SEQ ID NO: 292214 - RNA, 64 nt, Human; identical to SEQ ID NO: 229661

SEQ ID NO: 292215 - RNA, 64 nt, Human; identical to SEQ ID NO: 229669

SEQ ID NO: 292216 - RNA, 64 nt, Human
ugaggcaugagcugggggggcccccuuuuucagggcagagaaugaggcgugugcacugucugcu

SEQ ID NO: 292217 - RNA, 64 nt, Human
cuaaauuuguucucaccaagcacugccugugcaugcagagaaaaucugugcauccucuuuuaua

SEQ ID NO: 292218 - RNA, 64 nt, Human
uuguugagugcaacuuucauagucccaaagauaggcagagaacaucuccagaaaugugugugug

SEQ ID NO: 292219 - RNA, 64 nt, Human
gccagaaaugaagaagaaguuugcagauguauuugcagagaagacgaaggcagaguggugucaa

SEQ ID NO: 292220 - RNA, 64 nt, Human
uaugucucccuauuuaccacacaauaauguaaaugcagagaaugaggaggcaucuuuuaaaagc

SEQ ID NO: 292221 - RNA, 64 nt, Human
ggcaagcaggaccuggcaucaugguggauauggugcagagaagcuggacuucugugggccccuc

SEQ ID NO: 292222 - RNA, 64 nt, Human
aauucauguggaucuggggacugagugugggagugcagagaaagaaagggaaacuggcugaggg

SEQ ID NO: 292223 - RNA, 64 nt, Human
gaaccauuacaacaccuauauauccaagaagcaugcagagaagaauugguuuguuggccucaag

SEQ ID NO: 292224 - RNA, 64 nt, Human
gucauugacuucgggcuggaccguugcccucugagcagagaacagacccauuucugggagcugc

SEQ ID NO: 292225 - RNA, 64 nt, Human
cgggcucccugggcacccagcaagaucuggggcugcagagaacagaagagcuggugcacuuaau

SEQ ID NO: 292226 - RNA, 64 nt, Human
acaucuauuguuuaaaauagaugauuauaacggggcagagaacuuucuuuucucugcaagaaug

SEQ ID NO: 292227 - RNA, 64 nt, Human
auuauucuuauuucagagccugcgaggucaagcugcagagaacaugagcuucuaccuccagaug

SEQ ID NO: 292228 - RNA, 64 nt, Human
acucacaauuucuauuuccgggacuacaggaagggcagagaauacugacgguuaccaguauuaa

SEQ ID NO: 292229 - RNA, 64 nt, Human
uaauggagggcuccuacuugggacagagcccucagcagagaauuagcagucuguugguggguuc

SEQ ID NO: 292230 - RNA, 64 nt, Human; identical to SEQ ID NO: 229589

SEQ ID NO: 292231 - RNA, 64 nt, Human; identical to SEQ ID NO: 229590

SEQ ID NO: 292232 - RNA, 64 nt, Human; identical to SEQ ID NO: 229591

SEQ ID NO: 292233 - RNA, 64 nt, Human
uccccccuguaaacacagugcugcgagaucgcuggcagagaaggcuuccuccagcggcugggug

SEQ ID NO: 292234 - RNA, 64 nt, Human
ggccaccuccucagccguggguggugggcccauggcagagaagccugaacucuuuacuggguua

SEQ ID NO: 292235 - RNA, 64 nt, Human
ugcaucugaagugcuuacacggcgucuggcauaugcagagaaauuagcuuacaaauguuauuuu

SEQ ID NO: 292236 - RNA, 64 nt, Human
cucaugggccuucuuucugccucagaggacgggggcagagaagugaugaagggaaauguucuua

SEQ ID NO: 292237 - RNA, 64 nt, Human
uauucauguuaagauacuacuacauuugaagugggcagagaacaucagaugauugaaauguucg

SEQ ID NO: 292238 - RNA, 64 nt, Human
acuugccaaugggaaauucauccgaguggcacuggcagagaaggauaggaguggaaugcccaca

SEQ ID NO: 292239 - RNA, 64 nt, Human
ugcccuaauauuuuucggccugaugggaauuagugcagagaagccaugucaccauagaaggcaa

SEQ ID NO: 292240 - RNA, 64 nt, Human
agaaaagagcacaggcugcaccaaagcaggggcagcagagaauaaaauaucccuuugaacuugu

SEQ ID NO: 292241 - RNA, 64 nt, Human
gucugagaaucaguucaaggcauaugcagaguuggcagagaaacugagagaaaagggauggaga

SEQ ID NO: 292242 - RNA, 64 nt, Human
auaaauaucuucaugguggggcagguuauuggaugcagagaagaucugcucggaauuguagcca

SEQ ID NO: 292243 - RNA, 64 nt, Human
aagaggggaagaagcaucuuaagaagaggaaacagcagagaacuggcuggaugaccugugacuc

SEQ ID NO: 292244 - RNA, 64 nt, Human
agggcuccuucuggagcauuugguggggacagcugcagagaagaggccuggaacucgggcagca

SEQ ID NO: 292245 - RNA, 64 nt, Human
ccagggagggggccugcauuggcugcaaggaugagcagagaacaaggacagaggccaggcacug

SEQ ID NO: 292246 - RNA, 64 nt, Human
ucaucaaugaaccuuuucaaacuuuucuaugauugcagagaagcuuuuuauauacccagcauaa

SEQ ID NO: 292247 - RNA, 64 nt, Human; identical to SEQ ID NO: 229543

SEQ ID NO: 292248 - RNA, 64 nt, Human; identical to SEQ ID NO: 229544

SEQ ID NO: 292249 - RNA, 64 nt, Human; identical to SEQ ID NO: 229592

SEQ ID NO: 292250 - RNA, 64 nt, Human
caacuucaagcuuccaagaaacaguuaagaggaggcagagaagagcagaaacacuucuuugcug

SEQ ID NO: 292251 - RNA, 64 nt, Human
ccucuggaguccaggggcuggccgguuguucuaugcagagaaagcagucaauaaauguuugcca

SEQ ID NO: 292252 - RNA, 64 nt, Human
cauuccccccgaaaaauugaaauguaaagaugaggcagagaauaaaguguucuaugaaauucag

SEQ ID NO: 292253 - RNA, 64 nt, Human
uggucaugcagugagauaggaaaucaagauggaagcagagaaucuggcaugccaaaaacuaaca

SEQ ID NO: 292254 - RNA, 64 nt, Human
gaugugacuuauuuuccuuuuacuauacagcuuggcagagaaaauaaauaucaucaaauaagau

SEQ ID NO: 292255 - RNA, 64 nt, Human
uccgauuccccaucagcuccuuuacuaaagcugugcagagaauccgaggcuaugagugggggug

SEQ ID NO: 292256 - RNA, 64 nt, Human
gacugaacuugaccugugaccucugacccggggagcagagaacacuggcuucacagaggacuuu

SEQ ID NO: 292257 - RNA, 64 nt, Human
uuggucaauuuuauuauuaauucuuaaauucccugcagagaaugcccccuuuauugcugcacca

SEQ ID NO: 292258 - RNA, 64 nt, Human
caucuuacggcgaagggagagggaccuuaggggagcagagaagacaggcaaaguuguggacugu

SEQ ID NO: 292259 - RNA, 64 nt, Human
cagccucaaacuggcauccaggcacugggcccaugcagagaaggcaccugcagagagcagggca

SEQ ID NO: 292260 - RNA, 64 nt, Human
uaagagaaauaaacucaaaaugcuguuggaauaugcagagaauugcuaccagaauauucaguaa

SEQ ID NO: 292261 - RNA, 64 nt, Human
uucauucuauuucucuuuaauuuuauucacugaggcagagaaacaauuuuugaaaaagagcaaa

SEQ ID NO: 292262 - RNA, 64 nt, Human
agguaaaagugugagcagugaguuacagcgagaggcagagaaagaagagacaggagggcaaggg

SEQ ID NO: 292263 - RNA, 64 nt, Human
uggggcuuuaaucggagcacugcuggaaaugauugcagagaauguagugcuucauauauccaug

SEQ ID NO: 292264 - RNA, 64 nt, Human; identical to SEQ ID NO: 229526

SEQ ID NO: 292265 - RNA, 64 nt, Human; identical to SEQ ID NO: 229527

SEQ ID NO: 292266 - RNA, 64 nt, Human; identical to SEQ ID NO: 229677

SEQ ID NO: 292267 - RNA, 64 nt, Human
ucaacaaagacuaccuuuggcuaaaugucuagaagcagagaaguaaagugagcaaaauccagug

SEQ ID NO: 292268 - RNA, 64 nt, Human
cacgucuagaugugaaauuucugaaaauguugaagcagagaaacauucacacacaaaaagcaac

SEQ ID NO: 292269 - RNA, 64 nt, Human
gugcuugcuaccuugugaauucuuccuuagacaugcagagaaaauguaugcaagagaccaaaaa

SEQ ID NO: 292270 - RNA, 64 nt, Human
ugcauugggauggguggagaaagacgacaagagagcagagaaucugcugauguggcugcgcuua

SEQ ID NO: 292271 - RNA, 64 nt, Human
cagccucucuggccagggccuuacugggcccagagcagagaaggaccuguccaacacacacagc

SEQ ID NO: 292272 - RNA, 64 nt, Human
gaacaauccccuuuuuuccaucaagcuguagccugcagagaauggaaacgugggaaaggaaugg

SEQ ID NO: 292273 - RNA, 64 nt, Human
uucucaugcuuuucuuuauaauucacacauauaugcagagaagauauguucuuguuaacauugu

SEQ ID NO: 292274 - RNA, 64 nt, Human
ccagugguuucagaaaugucuggguguuuuauuugcagagaacaagaugugucuuaugagucuu

SEQ ID NO: 292275 - RNA, 64 nt, Human
ggucagugucgguggggggugggaggagagagcggcagagaagcucugagagccccuuccccca

SEQ ID NO: 292276 - RNA, 64 nt, Human
ccccgacagguggggcacagaccucuguuccugagcagagaagcagaaaaggagguucccucuc

SEQ ID NO: 292277 - RNA, 64 nt, Human
ccaccccauugaugcggugacggggcggaaaggcgcagagaagcugagggcggucucugaucug

SEQ ID NO: 292278 - RNA, 64 nt, Human
uaaccuaaacuugaccugcuuaauacauucuagggcagagaacccaggaugggacacuaaaaaa

SEQ ID NO: 292279 - RNA, 64 nt, Human
gucacccaacccgagaugucaggaaaggccuucugcagagaaaauguccccccacccgccaucu

SEQ ID NO: 292280 - RNA, 64 nt, Human
uccaccucugacucuucagcagcugaagauuaaugcagagaaagagcaaagcccaaaagggaga

SEQ ID NO: 292281 - RNA, 64 nt, Human; identical to SEQ ID NO: 229582

SEQ ID NO: 292282 - RNA, 64 nt, Human; identical to SEQ ID NO: 229583

SEQ ID NO: 292283 - RNA, 64 nt, Human; identical to SEQ ID NO: 229594

SEQ ID NO: 292284 - RNA, 64 nt, Human
aaggguuuuagucaacaugccauaucucauuauugcagagaacacuacauuacuuuaugaacac

SEQ ID NO: 292285 - RNA, 64 nt, Human
augugccuugccugacagaauugcuuagaaaggagcagagaaggacgggagcuggcguagcucu

SEQ ID NO: 292286 - RNA, 64 nt, Human
gugaaacuugaaccgggaagugggaggacguagagcagagaagagaacauuuuuaaaaggaagg

SEQ ID NO: 292287 - RNA, 64 nt, Human
uccgcaggcagguguggaugcugcaauucccaaugcagagaagcggaccgacagcggcagccgg

SEQ ID NO: 292288 - RNA, 64 nt, Human
agaaaagugugugcuuuaguauuagaggagauaggcagagaagucuugcuuaguuccuucgugc

SEQ ID NO: 292289 - RNA, 64 nt, Human
aaggggcuuucucucccuuuucagcccucucugugcagagaaaagaugugaguccgcuugauga

SEQ ID NO: 292290 - RNA, 64 nt, Human
ccagaccccucacuccaaaauccuacuggcuguagcagagaauaccuuugaaccaagauucugu

SEQ ID NO: 292291 - RNA, 64 nt, Human
ugcccagccucugggaacacuuggaagguuuuaagcagagaagugacagguuggaaaagauggu

SEQ ID NO: 292292 - RNA, 64 nt, Human
uggguacccugguggggaugcagggaaggccggggcagagaaagugaaggucgacccagggcug

SEQ ID NO: 292293 - RNA, 64 nt, Human
aauuaucaacuuggaaaacuggaaaaucuggauggcagagaaauauacuaucuaucucaccagu

SEQ ID NO: 292294 - RNA, 64 nt, Human
gugaguuugccaguagagcugugaagaaacagcugcagagaacauuugaccuuccuggcauucu

SEQ ID NO: 292295 - RNA, 64 nt, Human
uuaucuugccuuauccaggaauaauugccccuuugcagagaaaaaaaaaaacuuaaaaaaagca

SEQ ID NO: 292296 - RNA, 64 nt, Human
auuuuaaugccuguacacagaauucuaucgugaugcagagaagaaagaacggagugaagccauu

SEQ ID NO: 292297 - RNA, 64 nt, Human
caccuuggagggucugaccaucuucaccuguuccgcagagaaauguugcucuccauuauucccu

SEQ ID NO: 292298 - RNA, 64 nt, Human; identical to SEQ ID NO: 229595

SEQ ID NO: 292299 - RNA, 64 nt, Human; identical to SEQ ID NO: 229596

SEQ ID NO: 292300 - RNA, 64 nt, Human; identical to SEQ ID NO: 229601

SEQ ID NO: 292301 - RNA, 64 nt, Human
gcuggaguugggggugucucgggcccaggcccuggcagagaaacagggaggccuggggagagcu

SEQ ID NO: 292302 - RNA, 64 nt, Human
guaugaaaagcuucgggacacuuacauugaagaagcagagaaguacaaaaugcaauugcaagag

SEQ ID NO: 292303 - RNA, 64 nt, Human
ccguaugaugauugucagaagacaggacuaaguagcagagaauagcuaagagauaaauugggcu

SEQ ID NO: 292304 - RNA, 64 nt, Human
auacugaguacccuaggccaacuuuuuuuucuuugcagagaaccuuuuuuguuuuauucuucag

SEQ ID NO: 292305 - RNA, 64 nt, Human
aaagauaucuuuucuuuagagaacugaaaagagagcagagaauauaacaugaaaugauagauuu

SEQ ID NO: 292306 - RNA, 64 nt, Human
uuuuggcaacagcacagaaaacuaauauuuuuaagcagagaaucuuggcaaugagugagagaug

SEQ ID NO: 292307 - RNA, 64 nt, Human
uuuuuguuuacaacguaacauggcaugagagagggcagagaaacuaaguugcuggggaaaguua

SEQ ID NO: 292308 - RNA, 64 nt, Human
cuaagcacauggaugagacgugagcacaguuauggcagagaaguuucuccgcaccagaauuauc

SEQ ID NO: 292309 - RNA, 64 nt, Human
ccuugaaguuuggaaacagguggucuucuaugcugcagagaaacuaugcauuaggucucuuuuc

SEQ ID NO: 292310 - RNA, 64 nt, Human
cagcuguucacaugcagaaaugcucucuucacaggcagagaagccuguggcuaaaguuuccaca

SEQ ID NO: 292311 - RNA, 64 nt, Human
aauggacucagcucugucugcucaaugccauugugcagagaagcacccuaaugcauaagcuuuu

SEQ ID NO: 292312 - RNA, 64 nt, Human
acuguagcacaaucuauaauuuuuaccuucauaugcagagaaauuaagaauuuacaucuuuuac

SEQ ID NO: 292313 - RNA, 64 nt, Human
aaucaaaucugguauugaacugcaggugacuuuggcagagaaauguuuucacuuuuggucuccu

SEQ ID NO: 292314 - RNA, 64 nt, Human
uuuacagggggaacacucaugcugagcugagaaagcagagaaguggcgugggagccagcugggg

SEQ ID NO: 292315 - RNA, 64 nt, Human; identical to SEQ ID NO: 229492

SEQ ID NO: 292316 - RNA, 64 nt, Human; identical to SEQ ID NO: 229493

SEQ ID NO: 292317 - RNA, 51 nt, Human; identical to SEQ ID NO: 229495

SEQ ID NO: 292318 - RNA, 64 nt, Human
auuaugagacuucaauuuccaaagagaagaacuagcagagaaauuguauuucaguaauuuuaag

SEQ ID NO: 292319 - RNA, 64 nt, Human
aaaauggaaccaggcuuggaaccguaggacccaagcagagaagcucucgggcuaggaagaucuc

SEQ ID NO: 292320 - RNA, 64 nt, Human
agggauguuuuccccccuugcuugugccuuaaaggcagagaagcgaggcggaugcccuggaagc

SEQ ID NO: 292321 - RNA, 64 nt, Human
ccgagagaugacacuagucagaaaauuggcaguggcagagaauccaaacucaacaagugcuccu

SEQ ID NO: 292322 - RNA, 64 nt, Human
uugcuuaugaauucacaccuugaguauaaaacuugcagagaacauucagcgauuuccaguccac

SEQ ID NO: 292323 - RNA, 64 nt, Human
accugaucaagagcagugcuucuccauuuguuuugcagagaaauguuuuucauuucccgugugu

SEQ ID NO: 292324 - RNA, 64 nt, Human
uuccacacagcgggaaggcugcugggaacagguggcagagaagugccauguuugcguugagccu

SEQ ID NO: 292325 - RNA, 64 nt, Human
auaagccaagauaccccauaaacacacucagaaagcagagaaaaaggacaagagucuguguuug

SEQ ID NO: 292326 - RNA, 64 nt, Human
uaaagaucucaaaaaagccaaucuuuguacucuugcagagaaaauucagacuaucauccucaag

SEQ ID NO: 292327 - RNA, 64 nt, Human
auuaauugagguggcaacauaguuugagacgagggcagagaacaggaagauacauagcuagaag

SEQ ID NO: 292328 - RNA, 64 nt, Human
caagguguuaaggggauaguaccucccaauucaagcagagaaacugaccugacuaaaguuaauc

SEQ ID NO: 292329 - RNA, 64 nt, Human
gguuuuuacuucuaggcagucccaauuuuuaaaggcagagaaguaucugcaucuuuauuugaaa

SEQ ID NO: 292330 - RNA, 64 nt, Human
aaugucaggaacagaaggaugaaugaggucccaggcagagaaucauacuuagcaaaguuuuacc

SEQ ID NO: 292331 - RNA, 64 nt, Human
agcggacggauaccgggagcgcuugggcgaaacagcagagaaagaaagacuguggucggggaag

SEQ ID NO: 292332 - RNA, 64 nt, Human; identical to SEQ ID NO: 229496

SEQ ID NO: 292333 - RNA, 64 nt, Human; identical to SEQ ID NO: 229501

SEQ ID NO: 292334 - RNA, 64 nt, Human; identical to SEQ ID NO: 229503

SEQ ID NO: 292335 - RNA, 64 nt, Human
aaguacucuguaggguacuguaauuugucaaaaugcagagaauggaaaacagugaacggaaaac

SEQ ID NO: 292336 - RNA, 64 nt, Human
ggucugacuccaagguggugucagugcugaguuggcagagaaacacagggccuaggaggagaaa

SEQ ID NO: 292337 - RNA, 64 nt, Human
cuuuuucagccaggguuucucugccuucugccuggcagagaaaacacacugcuauggggaaaau

SEQ ID NO: 292338 - RNA, 64 nt, Human
ggguaagcuguuguucccugaggcugaggcugaggcagagaaucuuccagaugauaaaccccag

SEQ ID NO: 292339 - RNA, 64 nt, Human
ugggggagguggaugucagaucugguagguugcagcagagaaaauaaaugugccuugagagacc

SEQ ID NO: 292340 - RNA, 64 nt, Human
uacuaaaaggauguuauagagucuguugucuuaagcagagaaagacaucuaaauggugucagga

SEQ ID NO: 292341 - RNA, 64 nt, Human
caaagcaacacaacuuguaucaaaaucacaacuggcagagaagcugguggauccaauccuuucu

SEQ ID NO: 292342 - RNA, 64 nt, Human
gaauaggugaaggaacuagggauauuuaacuggagcagagaacaucuggagagagagcaagauu

SEQ ID NO: 292343 - RNA, 64 nt, Human
ggcuaggcaagccccagguugcagacauggugaagcagagaaacuguucuucugguuccugcac

SEQ ID NO: 292344 - RNA, 64 nt, Human
uguucccauuuauccaaauaacuuggacagagcagcagagaaaagcugaugggagugagagaac

SEQ ID NO: 292345 - RNA, 64 nt, Human
accugcgccuguguggaaauuuggagaaguugcggcagagaagccaugcguuccagcauuccac

SEQ ID NO: 292346 - RNA, 64 nt, Human
ggccaaggccaagcccugccccagauccucauaggcagagaagcccuucugacauuucccccag

SEQ ID NO: 292347 - RNA, 64 nt, Human
gggacugccaccuccccuugccagcugcugagccgcagagaagugacgguuccuacacaggaca

SEQ ID NO: 292348 - RNA, 64 nt, Human
aacugcaccucacccccgcacgugugcaugacucgcagagaauauuccagcaauuguguacccc

SEQ ID NO: 292349 - RNA, 64 nt, Human; identical to SEQ ID NO: 229507

SEQ ID NO: 292350 - RNA, 64 nt, Human; identical to SEQ ID NO: 229508

SEQ ID NO: 292351 - RNA, 64 nt, Human; identical to SEQ ID NO: 229509

SEQ ID NO: 292352 - RNA, 64 nt, Human
gacuuggcaacauuaacauguccuaagacuuagugcagagaagcuuggcaguacguucuuugac

SEQ ID NO: 292353 - RNA, 64 nt, Human
agaccauauuuuuaaaggggugccucauuauggggcagagaacuuuucaauaagucucauuaag

SEQ ID NO: 292354 - RNA, 64 nt, Human
cccaagcagccaccgcagcagcagaguacaaccugcagagaagcugaucaccgggcagagauag

SEQ ID NO: 292355 - RNA, 64 nt, Human
uugggagggacagggcuuggggagcaggucucuggcagagaaggauguccguuccaggagcaca

SEQ ID NO: 292356 - RNA, 64 nt, Human
ugauaagcaacuccaccuaaggcaugaauaugcggcagagaaaacagcaauagugaaugaaugc

SEQ ID NO: 292357 - RNA, 64 nt, Human
cccacucccagacagagcagaaguauuuuuauaagcagagaauuuuuuaugucuuaccagauag

SEQ ID NO: 292358 - RNA, 64 nt, Human
uuucaguacagaacacugacaaacaaggaaagcggcagagaaagaagaaagaccuagaagguug

SEQ ID NO: 292359 - RNA, 64 nt, Human
uaucugcccguguacccucaacugccuccuuuuugcagagaacgauccccacaggaacuggucu

SEQ ID NO: 292360 - RNA, 64 nt, Human
cuuuugaaggacuccuuaggcuuuguugaaugaagcagagaagauuguauaguuggggcugguc

SEQ ID NO: 292361 - RNA, 64 nt, Human
uuccuuucccucugcccaccaaguccucauaucugcagagaacccauugaucaccuugugcccu

SEQ ID NO: 292362 - RNA, 64 nt, Human
cuaccugcagucggcccugagcagcucuacuucugcagagaaguucccuucaccgcauccgucg

SEQ ID NO: 292363 - RNA, 64 nt, Human
uucucugagugccuuuuucuccuuaaggaggccugcagagaaaggggcuuugggcucugccccc

SEQ ID NO: 292364 - RNA, 64 nt, Human
aauacccuuugucucuccucuaugcgugcccauugcagagaaggggacugggaccaaaggggug

SEQ ID NO: 292365 - RNA, 64 nt, Human
gccaacucaagagggaaguuggaguaugucuguugcagagaaccaauauagcagugcccagggg

SEQ ID NO: 292366 - RNA, 64 nt, Human; identical to SEQ ID NO: 229504

SEQ ID NO: 292367 - RNA, 64 nt, Human; identical to SEQ ID NO: 229505

SEQ ID NO: 292368 - RNA, 64 nt, Human; identical to SEQ ID NO: 229605

SEQ ID NO: 292369 - RNA, 64 nt, Human
cuaugccuguuuuauaggugggguuaggccagaugcagagaaagcuaaaugugggaaucaugga

SEQ ID NO: 292370 - RNA, 64 nt, Human
ugcccagccuucucaguggacuugccccuccuaagcagagaaggccuaugagguugcuugcugc

SEQ ID NO: 292371 - RNA, 64 nt, Human
ggauggggcgggggcggucuagggcaauaggagagcagagaaugggggaacuugaggguggggg

SEQ ID NO: 292372 - RNA, 64 nt, Human
ccuaccuccaucagugaaggcaacacccaggcgggcagagaagggcucagggcaccagcaacca

SEQ ID NO: 292373 - RNA, 64 nt, Human
cgugggcuggugugagaagguuugcaugcucagagcagagaagggcucuccccacugcuucgug

SEQ ID NO: 292374 - RNA, 64 nt, Human
gcauuuguccagugccccaucaugggccugaaaggcagagaaacuuuuuccuacacagauucuu

SEQ ID NO: 292375 - RNA, 64 nt, Human
agguuaccuuggcgugugucccugugguacccuggcagagaagagaccaagcuuguuucccugc

SEQ ID NO: 292376 - RNA, 64 nt, Human
guugaggcaucuggagacugagaaagaaucaaaggcagagaagaccagccgugcuccugcauuc

SEQ ID NO: 292377 - RNA, 64 nt, Human
uacccauaacuuuuccaaauuugguucaaauugugcagagaaacaauaaaauuuuuaaaaagga

SEQ ID NO: 292378 - RNA, 64 nt, Human
auuuucagauuuuuuuccccuagauuuugagggagcagagaaacuggaaaaaacuuuagucaau

SEQ ID NO: 292379 - RNA, 64 nt, Human
cuauuuaugcugaaagaacuauuccaugagaaaagcagagaaccccaaagugggcaggcaaccc

SEQ ID NO: 292380 - RNA, 64 nt, Human
gauuguccacauuucaugauaaaaugagagcuccgcagagaauguuagccuuucuguuguaaau

SEQ ID NO: 292381 - RNA, 64 nt, Human
uauaaaggcccaucugaucacuggauugggcugagcagagaacaaggccaaccauggaaaugga

SEQ ID NO: 292382 - RNA, 62 nt, Human
guaagcaacagcucauuuaaauguuucuuggggcagagaagguggagaguaaagacccaaca

SEQ ID NO: 292383 - RNA, 64 nt, Human; identical to SEQ ID NO: 229513

SEQ ID NO: 292384 - RNA, 64 nt, Human; identical to SEQ ID NO: 229514

SEQ ID NO: 292385 - RNA, 64 nt, Human; identical to SEQ ID NO: 229515

SEQ ID NO: 292386 - RNA, 64 nt, Human
gugcaguuaguauacaacugacuaaaacaagcaagcagagaaaagcaucagccuuccagaguua

SEQ ID NO: 292387 - RNA, 64 nt, Human
uucagguuucuauuguauuuuuuuuaacauucuugcagagaaagcaagauccaaauugauuuug

SEQ ID NO: 292388 - RNA, 64 nt, Human
cugugcagcuuaucaacgaccgcuguguggacaugcagagaagcaggcacgguagccacuggga

SEQ ID NO: 292389 - RNA, 64 nt, Human
cuuaucaacgaccgcuguguggacaugcagagaagcagagaagaagaaaggagcugaggaggag

SEQ ID NO: 292390 - RNA, 64 nt, Human
aaauaugacuguagccuuuuaagcuucagucucagcagagaauuuccuaaaugcguuugaccua

SEQ ID NO: 292391 - RNA, 64 nt, Human
cuggauggggguuuggggaaggagggcauguguagcagagaacuuaggggggccuccuugccuu

SEQ ID NO: 292392 - RNA, 64 nt, Human
caggaaaucccagugucuagcaaugguuugguuugcagagaacacagccugauacuuaauuuuc

SEQ ID NO: 292393 - RNA, 64 nt, Human
uuucuaaauaaccaauaguugccaaucuaaaauggcagagaagaugaaauuugauaaacugaau

SEQ ID NO: 292394 - RNA, 64 nt, Human
aagaugucagggacuagggagggagggagggaaggcagagaaaaauuacuuagccucucccaag

SEQ ID NO: 292395 - RNA, 64 nt, Human
cacagaggugggaccuaagaggacucaugauuaugcagagaauuggauugggucucugucauag

SEQ ID NO: 292396 - RNA, 64 nt, Human
auaaggauaaaugagggacagguuggaugccguugcagagaaaaucagcaaugacauaaagaga

SEQ ID NO: 292397 - RNA, 64 nt, Human
uugccagauccaaaggggcauacugaguguuguggcagagaaguaaacauuaccacacuguuag

SEQ ID NO: 292398 - RNA, 64 nt, Human
aaagugaugauauuuaaaauaguucucaguugaagcagagaaaugccacugugcuaguugccca

SEQ ID NO: 292399 - RNA, 64 nt, Human
cucugaaauuuccuuaaauuauauacuuaacauagcagagaaacuggauuguuuuuguauauaa

SEQ ID NO: 292400 - RNA, 64 nt, Human; identical to SEQ ID NO: 196443

SEQ ID NO: 292401 - RNA, 64 nt, Human; identical to SEQ ID NO: 197158

SEQ ID NO: 292402 - RNA, 64 nt, Human; identical to SEQ ID NO: 197159

SEQ ID NO: 292403 - RNA, 64 nt, Human
gguaaaagaggguugcauuucuugcagccagaaggcagagaaagugaagaccaaguccagaacu

SEQ ID NO: 292404 - RNA, 64 nt, Human
cucuaggauaagcuugugugguucugccagugaagcagagaaccaccugugcuguuguggaagg

SEQ ID NO: 292405 - RNA, 64 nt, Human
ugagacccugucuccaaaaacaaacaaaaaaggagcagagaaagacagugguacagcuaaccug

SEQ ID NO: 292406 - RNA, 64 nt, Human
ugguucuuccuggggcccggccgauccucaggaugcagagaagucauguagacccaccagcccc

SEQ ID NO: 292407 - RNA, 64 nt, Human
cgucucccuuuucacagcacuccuuugccccagagcagagaauggaaaagccagggagguggaa

SEQ ID NO: 292408 - RNA, 64 nt, Human
auuuuggcaauguugacuaagaaacagaguccaagcagagaagguaggaacccuccauagcucu

SEQ ID NO: 292409 - RNA, 64 nt, Human
cuggacaccgccaugagcacagggcagggcuggggcagagaaaggaagggaacuggagcuggcc

SEQ ID NO: 292410 - RNA, 64 nt, Human
uggcccaggagccauggccucacacagacccgaggcagagaacagcucauugggucacugguga

SEQ ID NO: 292411 - RNA, 64 nt, Human
acccucagcuaggcccagaugguggggacagacggcagagaaagagcaugcauugcucuuaacc

SEQ ID NO: 292412 - RNA, 64 nt, Human
cagggccuuuuucuccacucaccugcacccagaagcagagaaaagcaggcacuguucacuuuuc

SEQ ID NO: 292413 - RNA, 64 nt, Human
uuaaggaggaaauuagugccacccacggugagaagcagagaaggcacuugcauccuaugcagcc

SEQ ID NO: 292414 - RNA, 64 nt, Human
auuugucaagaugguuagcucuuuguuuuggggugcagagaaagaaaagagcagcaacagcaga

SEQ ID NO: 292415 - RNA, 64 nt, Human
aucuggcuccuguuuccaugggucaaagccgguugcagagaaucuguagucacuuuggagcuuu

SEQ ID NO: 292416 - RNA, 64 nt, Human
gguauucuuaauauccugggugacuaauauccaggcagagaagcuccuggaaccauaacuguaa

SEQ ID NO: 292417 - RNA, 64 nt, Human; identical to SEQ ID NO: 196946

SEQ ID NO: 292418 - RNA, 64 nt, Human; identical to SEQ ID NO: 196444

SEQ ID NO: 292419 - RNA, 64 nt, Human; identical to SEQ ID NO: 197365

SEQ ID NO: 292420 - RNA, 64 nt, Human
ucucucucuuucucugcagauggacuguaacaaagcagagaaguuugauuuuguaaguucccuu

SEQ ID NO: 292421 - RNA, 64 nt, Human
cuguucauagaugggaagcuuccuuauaacugaugcagagaaaaauuaguccuucaaauacugc

SEQ ID NO: 292422 - RNA, 64 nt, Human
gggaccugcuucauucaagcuucauauaugcuuugcagagaacucauaaaggagcauauaaggc

SEQ ID NO: 292423 - RNA, 64 nt, Human
cucuuuugucaggaaacucagccaguggacuguggcagagaaaguccuccacucagaggcagag

SEQ ID NO: 292424 - RNA, 64 nt, Human
cucaccugcccuggaaccccggcacccggcuugggcagagaacugacuagaacaggguguuccc

SEQ ID NO: 292425 - RNA, 64 nt, Human
auuaaaaaaaaaguuguguggugggaaugugaaagcagagaaauaacuuguaaauggauaauuu

SEQ ID NO: 292426 - RNA, 64 nt, Human
cagacaaugccagcauaaauccauccauccaaaggcagagaaccaaaggggccauggaagguuc

SEQ ID NO: 292427 - RNA, 64 nt, Human
ucaucuaacuuacacguggugcauauuaaaauaagcagagaaaaaaaaaugugaauaaacuacu

SEQ ID NO: 292428 - RNA, 64 nt, Human
gguuauuuccuaauguaagaauagcuaaaauguugcagagaaauaagugacccaacaaaauuua

SEQ ID NO: 292429 - RNA, 64 nt, Human
uuuuaaaaggauugauucagcuaagcaaaguugggcagagaaauacagccauuuuguuuuuaau

SEQ ID NO: 292430 - RNA, 64 nt, Human
ugaaguuaaguggaauccuuucaaaugacgagcugcagagaacucagcaccaagggcugccuau

SEQ ID NO: 292431 - RNA, 64 nt, Human
cucuguggucugccuuagugggccaaguccaaaugcagagaaggccuuucccuuccgcgccugc

SEQ ID NO: 292432 - RNA, 64 nt, Human
guggaggggaaggguagggcagccagagaaaggagcagagaaggcacacaaacgaggaaugagg

SEQ ID NO: 292433 - RNA, 64 nt, Human
gaguugguggaugggugggcauggaacaggaugggcagagaaaggguagugugugagggagcug

SEQ ID NO: 292434 - RNA, 64 nt, Human; identical to SEQ ID NO: 196861

SEQ ID NO: 292435 - RNA, 64 nt, Human; identical to SEQ ID NO: 196445

SEQ ID NO: 292436 - RNA, 64 nt, Human; identical to SEQ ID NO: 196815

SEQ ID NO: 292437 - RNA, 64 nt, Human
cugaggaaaucguuuggugaaaugaauccagaaagcagagaaaaugcuucauuacuuuaaauag

SEQ ID NO: 292438 - RNA, 64 nt, Human
ugcgagguucuacuagcucccugccccucgcccugcagagaagagaaccaugccaggggagaag

SEQ ID NO: 292439 - RNA, 64 nt, Human
caguuugguagugccccaccucccgcccucaccugcagagaaacgcgcuccuuggcggacacug

SEQ ID NO: 292440 - RNA, 64 nt, Human
gaggugagggucaaagaacggggucccugggcuggcagagaagguuugugucccuguugaggag

SEQ ID NO: 292441 - RNA, 64 nt, Human
aacaaagaaaccacauuuuuaaaauuaccuuguggcagagaacuaaaaagcuuuguguucuuca

SEQ ID NO: 292442 - RNA, 64 nt, Human
uuaaaaauacuagugaagccucuuguguuugugugcagagaaguauaugauccaccaugcuaau

SEQ ID NO: 292443 - RNA, 64 nt, Human
caaccaagcgcauccaaucucaaggaaucuuuaagcagagaagggcauaaaacagcuuuggggu

SEQ ID NO: 292444 - RNA, 64 nt, Human
ugggauuugggcuacccuaaagggagaaggaagggcagagaauggcugggucagggccagacug

SEQ ID NO: 292445 - RNA, 64 nt, Human
caaaaauucucagaccucugagagggccuugagggcagagaauacugaccucaccuugggaugu

SEQ ID NO: 292446 - RNA, 64 nt, Human
caaguugcccacccugcggagcuaggaggcgcgagcagagaacguguguguuaggagaacucgg

SEQ ID NO: 292447 - RNA, 64 nt, Human
uuuucugcccccauucuuacuuugucccaggcaugcagagaaagauggugauauuuuaggccag

SEQ ID NO: 292448 - RNA, 64 nt, Human
ugccgucugaccccugauccaggcagcccccucugcagagaaaaggguuggggagaagccucug

SEQ ID NO: 292449 - RNA, 64 nt, Human
ucacugggucucagggcccagagcuuuggccagagcagagaacagaaugugucaaggagaagaa

SEQ ID NO: 292450 - RNA, 64 nt, Human
cagccaggaucccccaaagugugcagagggcucagcagagaacaguaugggacccccucaccag

SEQ ID NO: 292451 - RNA, 64 nt, Human; identical to SEQ ID NO: 229523

SEQ ID NO: 292452 - RNA, 64 nt, Human; identical to SEQ ID NO: 229524

SEQ ID NO: 292453 - RNA, 64 nt, Human; identical to SEQ ID NO: 229525

SEQ ID NO: 292454 - RNA, 64 nt, Human
agugaggucccucccaaaguuguuuucgugugaggcagagaaagccacacucugaauacauuuu

SEQ ID NO: 292455 - RNA, 64 nt, Human
aaaaagucaguguuguacauagcauaaaaacucugcagagaaguauucccaauaaggaaauagc

SEQ ID NO: 292456 - RNA, 64 nt, Human
agcucuaggagggcuggcaacuuagagguggggagcagagaauucucuuauccaacaucaacau

SEQ ID NO: 292457 - RNA, 64 nt, Human
agcugaugccagcauacauuaaagcgguucacgugcagagaacaaagcagugacaaccauuggc

SEQ ID NO: 292458 - RNA, 64 nt, Human
uuaagaauaaauuugaaauagaguauaacugaaugcagagaauuauguaccucuaauugcuuaa

SEQ ID NO: 292459 - RNA, 64 nt, Human
aaacaaaucaagaauauauuaaaucuagaggaaugcagagaagaaaacuauaaaacagaaccaa

SEQ ID NO: 292460 - RNA, 64 nt, Human
agacugcuccuccaaggggaagcaguguggaacagcagagaaagucccgucccuaucucugacu

SEQ ID NO: 292461 - RNA, 64 nt, Human
ugcuccucugcaaaggccagccagcuugggagcagcagagaaauaaacagcauuucugaugccc

SEQ ID NO: 292462 - RNA, 64 nt, Human
cugaccuccucuggccucagccugcagggugugggcagagaagggcaucugggacguggugcca

SEQ ID NO: 292463 - RNA, 64 nt, Human
agaagccauccauggaaauuugaacugagugggggcagagaaagagugcagaucccuuugcuug

SEQ ID NO: 292464 - RNA, 64 nt, Human
cccagcccugccugauguggcucugggaauuccugcagagaagagcagggguggccaggagaua

SEQ ID NO: 292465 - RNA, 64 nt, Human
agcuacuugcugaccauuuccugcuucucaagcugcagagaagcuuuucauucccacccccacc

SEQ ID NO: 292466 - RNA, 64 nt, Human
uggacuacuuguuucguaaagauaaccaguuuuugcagagaaacguguacccauauauaauucu

SEQ ID NO: 292467 - RNA, 64 nt, Human
cacuuucugaggaugccucacuucccugggcucugcagagaacacacagagagaagacuuucag

SEQ ID NO: 292468 - RNA, 64 nt, Human; identical to SEQ ID NO: 196441

SEQ ID NO: 292469 - RNA, 64 nt, Human; identical to SEQ ID NO: 197127

SEQ ID NO: 292470 - RNA, 64 nt, Human
aucugccauuuaauuagcugcauaucaccuuaggguacagcacuuaacgcaaucugccucaauu

SEQ ID NO: 292471 - RNA, 64 nt, Human
ugauuugucugcuaagaagacggguuccugcuuugcagagaaggagccggggaccagcuugaag

SEQ ID NO: 292472 - RNA, 64 nt, Human
gggugacucugagcacagguagacgcagacgugugcagagaaugugcucuucggaggaagaaca

SEQ ID NO: 292473 - RNA, 64 nt, Human
acauuuuugucuauggugaacugcuguaaaugacgcagagaaaugccuaaaaaggacagguggu

SEQ ID NO: 292474 - RNA, 64 nt, Human
cuccccugaguguauaugagugcugaguaguauugcagagaaugugaugaguuauucacuguca

SEQ ID NO: 292475 - RNA, 64 nt, Human
uuuuaauuugaauugccuguucaggguuccuuaugcagagaaauaaagcagauucaggaauugg

SEQ ID NO: 292476 - RNA, 64 nt, Human
ucuaggaugaucaguaguucagcacuuaaaaacugcagagaaaacugaaaguuauguuccagau

SEQ ID NO: 292477 - RNA, 64 nt, Human
ccgagagcaaggcacaaccucgaguucuuggggcgcagagaacuuaggagagaagcacggagga

SEQ ID NO: 292478 - RNA, 64 nt, Human
caagguucaaauacuuuuuauuagacacggccaggcagagaagaccaugggaguucccgagggg

SEQ ID NO: 292479 - RNA, 64 nt, Human
caggauguguccugcugucugccccgugggaagagcagagaaaucaucaccaccuugggcccca

SEQ ID NO: 292480 - RNA, 64 nt, Human
gaaugcuccuaaaagagaacuugauagccugacagcagagaaguauuauuugguggggagucug

SEQ ID NO: 292481 - RNA, 64 nt, Human
gauuuugauccaagcuggucccacucaguccauagcagagaaugaaagggcccagagagggugg

SEQ ID NO: 292482 - RNA, 64 nt, Human
acuccaccgcgaucugccugcgggggaucucagcgcagagaaguugagaggacccaugaaggaa

SEQ ID NO: 292483 - RNA, 64 nt, Human
auaaaagaugauaguaauuuaccaagugacauuugcagagaaacagguguacaguuaucguugu

SEQ ID NO: 292484 - RNA, 64 nt, Human
guuguucuuguguugguucccauguaaagaagcagcagagaaaugcgaugguucaacagcucgc

SEQ ID NO: 292485 - RNA, 64 nt, Human; identical to SEQ ID NO: 229510

SEQ ID NO: 292486 - RNA, 64 nt, Human; identical to SEQ ID NO: 229511

SEQ ID NO: 292487 - RNA, 64 nt, Human; identical to SEQ ID NO: 229529

SEQ ID NO: 292488 - RNA, 64 nt, Human
cacuggagaaagguguccuccaugcccucaggcagcagagaacuggcccagagcccuuggagug

SEQ ID NO: 292489 - RNA, 64 nt, Human
acccauccacucaccucccauucccagccacauggcagagaaaaaaaucauaauaaaauggcuu

SEQ ID NO: 292490 - RNA, 64 nt, Human
cccaggagaccaaagggaggggcucugccgcuuagcagagaagaaagggccugggagguggugg

SEQ ID NO: 292491 - RNA, 64 nt, Human
auaaccuuuaacuauuuucaagccuuacacaauagcagagaauauaaacugaaaaaauccauac

SEQ ID NO: 292492 - RNA, 64 nt, Human
uauauacuuaagaauacacaggauauuuuggggggcagagaauaaaacguuaguuaaucccuuu

SEQ ID NO: 292493 - RNA, 64 nt, Human
cacaaccagccaggcagguccacagagagggagagcagagaaagaaguccuuucucuuuauuga

SEQ ID NO: 292494 - RNA, 64 nt, Human
aaugcgcccgccuggcggacagcucccuucugaagcagagaagccuccauggucacgaagcagc

SEQ ID NO: 292495 - RNA, 64 nt, Human
uuggugcacaugguuggcacacggugggcagagggcagagaaugccacugcuugguuauugguc

SEQ ID NO: 292496 - RNA, 64 nt, Human
ccaaucccuucauuucaaccuaaagagacccuaagcagagaaccuagcugagccacuccugacc

SEQ ID NO: 292497 - RNA, 64 nt, Human
ucaggugauugaguuugacaagccugaaguccuugcagagaagccagauucugcauuugcgaug

SEQ ID NO: 292498 - RNA, 64 nt, Human
gcugaagauacuuaguauccucggcugcuuguuagcagagaaaggacucaccuuaguggugacu

SEQ ID NO: 292499 - RNA, 64 nt, Human
guuuuccuagcuguguuauuccugguuuaauucagcagagaagguaaggugugaaccuaccugc

SEQ ID NO: 292500 - RNA, 64 nt, Human
gaguccaaggugcaacuccuaaaugaauuguguugcagagaacucccaguauaauucacugacc

SEQ ID NO: 292501 - RNA, 64 nt, Human
uucccacuccuuaagcaagcacaaagaagaugaggcagagaauugucagagcugaaaguuccuu

SEQ ID NO: 292502 - RNA, 64 nt, Human; identical to SEQ ID NO: 229532

SEQ ID NO: 292503 - RNA, 64 nt, Human; identical to SEQ ID NO: 229533

SEQ ID NO: 292504 - RNA, 64 nt, Human; identical to SEQ ID NO: 229534

SEQ ID NO: 292505 - RNA, 64 nt, Human
cuguagaucccuaggccccugagagcuggacagagcagagaacuacagggccaaggguccagag

SEQ ID NO: 292506 - RNA, 64 nt, Human
cuuuccgcgucagcaaguaggaaucguuuuugcugcagagaauaaaaggaccacgugcaauacu

SEQ ID NO: 292507 - RNA, 64 nt, Human
agaucugacagcccagaccuuucuacggcuggcagcagagaaacaaagucuggacccacuccau

SEQ ID NO: 292508 - RNA, 50 nt, Human
uuguuuuuuccuucuuuugagcagagaaaguaaaaguacgacauagaaau

SEQ ID NO: 292509 - RNA, 64 nt, Human
gagaaucgucagcuguaaguaggagcuacacagcgcagagaaaauggaaccacccauccgugag

SEQ ID NO: 292510 - RNA, 64 nt, Human
caggcuguggcugcucccagcagaggcggggccggcagagaaggggccuccuccacccagaguc

SEQ ID NO: 292511 - RNA, 64 nt, Human
agacaccacuccaggcucauagccccgucuugaugcagagaagccacccacguggggugugcca

SEQ ID NO: 292512 - RNA, 64 nt, Human
ugggauuccucccugcgaugcgugucuuucccacgcagagaagcccagucucuucucuggaucu

SEQ ID NO: 292513 - RNA, 64 nt, Human
augggacaugguagacuguggcccagaccccagagcagagaaacuuguucccaugacccuuccc

SEQ ID NO: 292514 - RNA, 64 nt, Human
agaacuccuaguacucugaccagccagggccagggcagagaagcagcacucuuaggcuugcuua

SEQ ID NO: 292515 - RNA, 64 nt, Human
ucagaacccacagugagaggggagggcuccuggggcagagaaguuccuuagguuuucuuuggaa

SEQ ID NO: 292516 - RNA, 64 nt, Human
uaucuuauauugggcgauuugggggcucggggaggcagagaaucucuugggagucuuggguggc

SEQ ID NO: 292517 - RNA, 64 nt, Human
cgugagcagugugucuccugcaugcagaaagggagcagagaaggccaggggcuuuugcuaaaaa

SEQ ID NO: 292518 - RNA, 64 nt, Human
accucagcauuaucuauauaguaccuuugcucuugcagagaagccuugguacuaggcaguuaga

SEQ ID NO: 292519 - RNA, 64 nt, Human; identical to SEQ ID NO: 229535

SEQ ID NO: 292520 - RNA, 64 nt, Human; identical to SEQ ID NO: 229536

SEQ ID NO: 292521 - RNA, 64 nt, Human; identical to SEQ ID NO: 229609

SEQ ID NO: 292522 - RNA, 64 nt, Human
gaugccaaguggggccagggccaagucucaaguggcagagaaagggucccaagugcugguccca

SEQ ID NO: 292523 - RNA, 64 nt, Human
uuaccuacuuaccauacugggagguagaagagaugcagagaaauguggaauuuguggaccuaug

SEQ ID NO: 292524 - RNA, 64 nt, Human
uggagggccccgugguuccuggagaaagcaggacgcagagaagaacaaaugaggcucacccacg

SEQ ID NO: 292525 - RNA, 64 nt, Human
uuaaaagaaauguuuuacacaguucauccaaagagcagagaacugaacuucucacuauugccuu

SEQ ID NO: 292526 - RNA, 64 nt, Human
auauccacagucuguuccuguucugauauucugagcagagaaaaggcacuaacgguuccucuua

SEQ ID NO: 292527 - RNA, 64 nt, Human
gggucaucacugccuuggggaggaguggggcagggcagagaauccccccaauuccugccugaaa

SEQ ID NO: 292528 - RNA, 64 nt, Human
gcaaaggacacagcuagcaacgggcuggaaaaaggcagagaacguggagugaucaucuccaacu

SEQ ID NO: 292529 - RNA, 64 nt, Human
agagagggaaagaggcagagaaggaaagagacaggcagagaaggagagaggcagagagggagag

SEQ ID NO: 292530 - RNA, 64 nt, Human
agacagaggggaagagaggcagagagggaaagaggcagagaaggaaagagacaggcagagaagg

SEQ ID NO: 292531 - RNA, 64 nt, Human
aaaauaaugugaaauucuggaaauuuucuuuggggcagagaagagcauuagcccugucuuauca

SEQ ID NO: 292532 - RNA, 64 nt, Human
auccaaucugccugugacaugcauuuuacucuuugcagagaaugagcugcaguccaguuuaaug

SEQ ID NO: 292533 - RNA, 64 nt, Human
gcacugggauccaagcagggggaugaaaaacucagcagagaaauucgagaccauuuugcaagac

SEQ ID NO: 292534 - RNA, 64 nt, Human
gccacacaggaagaaagucuugguuacuuaagaggcagagaagccccuaggcaaagacuggccu

SEQ ID NO: 292535 - RNA, 64 nt, Human
ggcaagacguggccuguaggcacugucucagccugcagagaagaaagugaggccgggagccuga

SEQ ID NO: 292536 - RNA, 64 nt, Human; identical to SEQ ID NO: 197109

SEQ ID NO: 292537 - RNA, 64 nt, Human; identical to SEQ ID NO: 197110

SEQ ID NO: 292538 - RNA, 64 nt, Human; identical to SEQ ID NO: 229530

SEQ ID NO: 292539 - RNA, 64 nt, Human
cgcugucagugugaaacggugcuugccaacaaucgcagagaagcugaagaaugguuggcuguuc

SEQ ID NO: 292540 - RNA, 64 nt, Human
gcugaccacauuguacccauuucacagagaaggagcagagaaauuaaguggcuugcucaagguc

SEQ ID NO: 292541 - RNA, 64 nt, Human
cguuccuccgaaucccgucggcuucucgacccacgcagagaagccccgggcuuggcggcucuag

SEQ ID NO: 292542 - RNA, 64 nt, Human
agccccuuuccccaccacaacccaccacggccaggcagagaagggcaacucccaagagccacug

SEQ ID NO: 292543 - RNA, 64 nt, Human
acauugugggaaaggcuuuggccauggucugggggcagagaacaaggggggagacacaaguaga

SEQ ID NO: 292544 - RNA, 64 nt, Human
accugugaguggggcagggagggguuccgguugugcagagaacagaguguucuggcaaagagga

SEQ ID NO: 292545 - RNA, 64 nt, Human
uaacggggcugggaagaaaagcagagagagaauugcagagaaucagacuccuuuuccagggccu

SEQ ID NO: 292546 - RNA, 64 nt, Human
cauguacaacuuuggucauaugagaagcaggugcgcagagaauuccuugaaagaucugagguuu

SEQ ID NO: 292547 - RNA, 64 nt, Human
uguaauuagucaucuggaacaaagacuaaaaacagcagagaauugcggguucuacccagucaga

SEQ ID NO: 292548 - RNA, 64 nt, Human
ucaguaauuggagaauucagagauugcauuucuagcagagaauuccuucagccuucuuccaaag

SEQ ID NO: 292549 - RNA, 64 nt, Human
cccagucaugggcuagcugauagagucauuaauugcagagaaguucuggaagcuuucaaccucc

SEQ ID NO: 292550 - RNA, 59 nt, Human
uaacugaaauagaaaaggaaaaggaagaagcagagaagaaaaaaucaaagaaaucuguc

SEQ ID NO: 292551 - RNA, 64 nt, Human
uugaacucccuaaguaaggcccacaguucuugaugcagagaaccaaagugaaucauagaaaagc

SEQ ID NO: 292552 - RNA, 64 nt, Human
ucuacagaauaauccaguauugcugauuuuaaaggcagagaaguucucaaaguuaauucaccua

SEQ ID NO: 292553 - RNA, 64 nt, Human; identical to SEQ ID NO: 229470

SEQ ID NO: 292554 - RNA, 64 nt, Human; identical to SEQ ID NO: 229471

SEQ ID NO: 292555 - RNA, 64 nt, Human; identical to SEQ ID NO: 229542

SEQ ID NO: 292556 - RNA, 64 nt, Human
gccccucuccuuccccggcucgcaggagagcagagcagagaacuguggggaacgcugugcuguu

SEQ ID NO: 292557 - RNA, 64 nt, Human
cuguauaaacaaaagaaucuuccauauuuauacagcagagaagcuguaggacuguuugugacug

SEQ ID NO: 292558 - RNA, 60 nt, Human
acgaccaugacgagcucuagcuggaugggcgcagagaaccucaagaaggcaugaagccag

SEQ ID NO: 292559 - RNA, 64 nt, Human
uaauucauuucaguuacaugaaagauuucaaacugcagagaaccacuaugaauguaaacaaugu

SEQ ID NO: 292560 - RNA, 64 nt, Human
cacgucauuucaaagacaugaaaaaacucacacugcagagaaacccuaugaaugcaagcaaugu

SEQ ID NO: 292561 - RNA, 64 nt, Human
aagagaccugcaacugugagaguccagacaggaagcagagaaggcguccuugcggaaagggcau

SEQ ID NO: 292562 - RNA, 64 nt, Human
cucaguucuuaacacacauacgauaauucuuacugcagagaaacucuacaaaccaguaagaugu

SEQ ID NO: 292563 - RNA, 64 nt, Human
uauacacacggugcaccaaucuacaguauauauagcagagaaucagaggcuaaaaauauuaccc

SEQ ID NO: 292564 - RNA, 64 nt, Human
ggaaaugcaaaguuuagcagaagcaagcaauuaggcagagaacaaaaauguuaagcaugguguu

SEQ ID NO: 292565 - RNA, 64 nt, Human
agagaauacgauggccuuuagaaaaugcccuuuagcagagaauuuguaauuuaagaaauuuucu

SEQ ID NO: 292566 - RNA, 64 nt, Human
cugacagcuucaugaaacuguccaccaagaucaagcagagaaaauaauuaauuucaugggacua

SEQ ID NO: 292567 - RNA, 64 nt, Human
ggccucaacucaucugacccaucaauucuccacagcagagaaaaaccauucaaauaugagaacu

SEQ ID NO: 292568 - RNA, 64 nt, Human
cucagcauaccccaguggucgugggacugucagagcagagaaugcugcaggguuucuaacagaa

SEQ ID NO: 292569 - RNA, 64 nt, Human
ggccgcaagcagcugccugggggguguccaaggagcagagaaaacuacuagaugugaacuugaa

SEQ ID NO: 292570 - RNA, 64 nt, Human; identical to SEQ ID NO: 229516

SEQ ID NO: 292571 - RNA, 64 nt, Human; identical to SEQ ID NO: 229521

SEQ ID NO: 292572 - RNA, 64 nt, Human; identical to SEQ ID NO: 229546

SEQ ID NO: 292573 - RNA, 64 nt, Human
ggauauuggagcccacgugggcccaccccgggcagcagagaaggcccagcugacagggggugag

SEQ ID NO: 292574 - RNA, 64 nt, Human
auuaaaaaaucaaaacauagaugcuagugaggcugcagagaaaagcaaauacuuauacacugcu

SEQ ID NO: 292575 - RNA, 64 nt, Human
ugcuuaccaaugucuaagguccccacugccugcugcagagaaaacacacuccuuugcuuagccc

SEQ ID NO: 292576 - RNA, 64 nt, Human
ugcuuacaaaugccuaaggucgccacugccugcugcagagaaaacacacuccuuugcuuagccc

SEQ ID NO: 292577 - RNA, 64 nt, Human
aagccuuuagccaacggugucaacuuacuaggcagcagagaauucauacuggagagaagcccug

SEQ ID NO: 292578 - RNA, 64 nt, Human
cagcuaaagggcauauguccucugcagauccacagcagagaaaaagucccgugcuugcuaguca

SEQ ID NO: 292579 - RNA, 64 nt, Human
ccggaggggcuugcaggguggcugaagcccuggggcagagaacagaggguccagggcccuccug

SEQ ID NO: 292580 - RNA, 64 nt, Human
agcugcgugcuggaguucuguccccaaaccaacugcagagaagaaagacgagccucggcccagg

SEQ ID NO: 292581 - RNA, 64 nt, Human
ggaugaauagauagaugguguuugcauguaaauugcagagaaaacaaaaccaaagcugauugga

SEQ ID NO: 292582 - RNA, 64 nt, Human
cacuucccuucaaagacgugaaaccacucacagugcagagaaaccccaugaauguaagcaaugu

SEQ ID NO: 292583 - RNA, 64 nt, Human
cuuguuguucuuggcacauguucuuauuuuaacugcagagaaucacucugggcuggacuguuuu

SEQ ID NO: 292584 - RNA, 64 nt, Human
gucuccagauuaucuuggaggggacaggaggauggcagagaaacaacugucaauccagauuuga

SEQ ID NO: 292585 - RNA, 64 nt, Human
aacaauccuuaucuaacaucaccaaauucacauugcagagaaacuucagaaauauaagaaaugu

SEQ ID NO: 292586 - RNA, 64 nt, Human
cgcagacccggaggagcaucagcaaggggcccgggcagagaaucggcuaugucuucauuaugag

SEQ ID NO: 292587 - RNA, 64 nt, Human; identical to SEQ ID NO: 198119

SEQ ID NO: 292588 - RNA, 64 nt, Human; identical to SEQ ID NO: 197476

SEQ ID NO: 292589 - RNA, 64 nt, Human; identical to SEQ ID NO: 196435

SEQ ID NO: 292590 - RNA, 64 nt, Human
uagaaaugaacacagagauauugccuguguguuugcagagaagaugguuucuauaaagaguagg

SEQ ID NO: 292591 - RNA, 64 nt, Human; identical to SEQ ID NO: 292590

SEQ ID NO: 292592 - RNA, 64 nt, Human
caugccuguaaucccagcuacucgggaggcugaggcagagaauugcuugaauccgggaggcgga

SEQ ID NO: 292593 - RNA, 64 nt, Human
caguaguucagccaagugauugggagaccacacagcagagaagccucacaagaguggagacaua

SEQ ID NO: 292594 - RNA, 64 nt, Human
gggcgccuaaaaucccagcuacucgggagacuaggcagagaauugguugaacccgggaggugga

SEQ ID NO: 292595 - RNA, 64 nt, Human
gucacaccuugcaagucaucauagucuucauacugcagagaaaucuuacaaaugugaagacugu

SEQ ID NO: 292596 - RNA, 64 nt, Human
aacaacccuugcacgucaucauagaauucauacugcagagaaacuuuacaaauaggaagaaugu

SEQ ID NO: 292597 - RNA, 64 nt, Human
uauuaauuacaaaaggaaaaucaguaauuuugcagcagagaaauauggccaacuccaccuuaac

SEQ ID NO: 292598 - RNA, 64 nt, Human
gugcugcgauuacaggcgugagccaccgugcccggcagagaaaaacugcuuaagguugaaaaga

SEQ ID NO: 292599 - RNA, 64 nt, Human
agauuggugugaauugcuaagggaaaaaccuuaugcagagaaaaguuuuugacuggaaauacac

SEQ ID NO: 292600 - RNA, 64 nt, Human
agcugucaugaaggagggagggagcacauuccuggcagagaaaacagcacgugcaaaggccccg

SEQ ID NO: 292601 - RNA, 64 nt, Human
acagauggaagcaaaggaauccugccugccuucagcagagaauucaccgaauccuagaacugug

SEQ ID NO: 292602 - RNA, 64 nt, Human
uugccuaaaguaaggugugaccagugaaacaacagcagagaaucauguuccuuugcuguggaac

SEQ ID NO: 292603 - RNA, 64 nt, Human
ccuuucauucauugugacuuuuguucuuagggaagcagagaagacuccccaaguucuuauaacc

SEQ ID NO: 292604 - RNA, 64 nt, Human; identical to SEQ ID NO: 197402

SEQ ID NO: 292605 - RNA, 64 nt, Human; identical to SEQ ID NO: 196436

SEQ ID NO: 292606 - RNA, 64 nt, Human; identical to SEQ ID NO: 196962

SEQ ID NO: 292607 - RNA, 64 nt, Human
ccagcagacucugacucaacuuucuaggcaccuagcagagaaagauaagaucaaaagguguuug

SEQ ID NO: 292608 - RNA, 64 nt, Human
aggaguuuaugaauuugaagcuuaugggauuuuggcagagaaauuuucagcugugcuugauacc

SEQ ID NO: 292609 - RNA, 64 nt, Human
cggcgccgcacguagacccucagcccugguggcggcagagaagcgggcgaggcacuguggucgc

SEQ ID NO: 292610 - RNA, 64 nt, Human
cuuuaacaaagaaugguuucagugaaacaaucuagcagagaauuaaugucagaaccuuuuuaaa

SEQ ID NO: 292611 - RNA, 64 nt, Human
gcaccuguguguaaauacaugcuuggucuucucugcagagaacugaggcuaaacucugucccua

SEQ ID NO: 292612 - RNA, 64 nt, Human
ugccaugaucccaccugcgaccucuagugcgagugcagagaaggugggaccagggccaggguuc

SEQ ID NO: 292613 - RNA, 64 nt, Human
cucucuugccugaggggaaagagagaugggccaggcagagaacagaacuggaggcaguccaucu

SEQ ID NO: 292614 - RNA, 64 nt, Human
gaaggcuggucuagccccagacagggcaugaggggcagagaauucaagaagguacagcuuuggc

SEQ ID NO: 292615 - RNA, 64 nt, Human
ucaagccaguaaacccauccccccugagccagcugcagagaauggagcccaaacagauguucug

SEQ ID NO: 292616 - RNA, 64 nt, Human
uucucucuugaagaggauucuuugaaaagguccugcagagaaaucaguacagguuaucccgaaa

SEQ ID NO: 292617 - RNA, 64 nt, Human
cuucauugcccacauggauagacggagcuguggugcagagaacuuuucccgcaacaggugcagg

SEQ ID NO: 292618 - RNA, 64 nt, Human
cgaguuugcugggagcugggagcaggcuugccuggcagagaaccuguucagauacaggccaguu

SEQ ID NO: 292619 - RNA, 64 nt, Human
caggacaccagagcccaccagacagugccggccagcagagaagcagagagccagcgccacacaa

SEQ ID NO: 292620 - RNA, 64 nt, Human
uuaguggagaugccagauaucccauacagaauuagcagagaaaauacacacaggcuucuauuca

SEQ ID NO: 292621 - RNA, 64 nt, Human; identical to SEQ ID NO: 196963

SEQ ID NO: 292622 - RNA, 64 nt, Human; identical to SEQ ID NO: 196964

SEQ ID NO: 292623 - RNA, 64 nt, Human; identical to SEQ ID NO: 229489

SEQ ID NO: 292624 - RNA, 64 nt, Human
aaggggauuucuaaagcaggcaaucccuguagccgcagagaauaaacgccuucccaaaauggca

SEQ ID NO: 292625 - RNA, 64 nt, Human
uguagacagaggggugaagaaggaggaggaagaggcagagaaggaggagaccagggcugggaaa

SEQ ID NO: 292626 - RNA, 64 nt, Human
aaggcuguccggagggcagaccaggugccuugccgcagagaaaacaccaaagucuccuguucgc

SEQ ID NO: 292627 - RNA, 64 nt, Human
aacccuucugaguuggcccuggaguggcucacgggcagagaaggguagcccuggggcuggggga

SEQ ID NO: 292628 - RNA, 64 nt, Human
ggguccuucccucugcucccuacuccccaccacggcagagaauaggcuuucuaagaugcugcga

SEQ ID NO: 292629 - RNA, 64 nt, Human
ucucuggccacauucaagucccccauuggugggggcagagaaguaggaccaggccauccuuggc

SEQ ID NO: 292630 - RNA, 64 nt, Human
cuaacggcuaaagagacugaugcaucaacaccaggcagagaauaaagcagauuuuuuuguuguu

SEQ ID NO: 292631 - RNA, 64 nt, Human
ugggggacugauucaauacauaugcacguccacagcagagaaugccaugcggccuguguaagaa

SEQ ID NO: 292632 - RNA, 64 nt, Human
ggccagaguuaagggaaagaggaggaaguccuaagcagagaaguagcaccauuauccccauuua

SEQ ID NO: 292633 - RNA, 64 nt, Human
gaguguggagaagguggaagagcugagcucagaggcagagaagcuccuugcagggagcacuggg

SEQ ID NO: 292634 - RNA, 64 nt, Human
uggggcuuccugggaaaaggaaggccaugagaaggcagagaaguaggccagagcuggguucuug

SEQ ID NO: 292635 - RNA, 64 nt, Human
auucccugcucuguacugggugugugaagccccagcagagaaggccggagggagggcuugggug

SEQ ID NO: 292636 - RNA, 64 nt, Human
ccuuuuccuugacuauuacacugccuggaggauagcagagaagccugucuguacuucauucaaa

SEQ ID NO: 292637 - RNA, 64 nt, Human
aaggaggucacuuggcauucaggcucuuggggaggcagagaagccaccuucaggccugggaagg

SEQ ID NO: 292638 - RNA, 64 nt, Human; identical to SEQ ID NO: 196437

SEQ ID NO: 292639 - RNA, 64 nt, Human; identical to SEQ ID NO: 196980

SEQ ID NO: 292640 - RNA, 64 nt, Human; identical to SEQ ID NO: 196981

SEQ ID NO: 292641 - RNA, 64 nt, Human
gguccuguggacaucacagcuucaggccugaagagcagagaagcccuguucucugcauguagga

SEQ ID NO: 292642 - RNA, 64 nt, Human
uccauaccacugugcugaccgcucagccugaagagcagagaaugccaugggugggacugugggg

SEQ ID NO: 292643 - RNA, 64 nt, Human
aggcaaagaaaggugagacccucucccaagaggagcagagaaaacuggaagaagauuugcuggu

SEQ ID NO: 292644 - RNA, 64 nt, Human
ugggacaccuguaauguaacccacacagcgguuugcagagaauguuagccaugacuugggcuuu

SEQ ID NO: 292645 - RNA, 64 nt, Human
caacuuucuuagcucaagagagaggcugagaaaugcagagaagaauaagacauaaaauagcucc

SEQ ID NO: 292646 - RNA, 64 nt, Human
ucauagaaacuguaugaacaaccagauuuacauagcagagaaaucauacauugaaugcuuacuu

SEQ ID NO: 292647 - RNA, 64 nt, Human
uccuuuccaacaccccugaaauucauagucaguagcagagaaaagcagaucccaauucauccca

SEQ ID NO: 292648 - RNA, 64 nt, Human
ggugccuguaaucacagcuacucgggaggcugaggcagagaauugcuugaacccaggaggugga

SEQ ID NO: 292649 - RNA, 64 nt, Human
cccuagaaauaauuccuaaucuuuagaaaauagggcagagaaacauuauuuuacaccauggaga

SEQ ID NO: 292650 - RNA, 64 nt, Human
cugcuguggagugagguguauugguguugcagccgcagagaaaugccccaguguuauuuauucc

SEQ ID NO: 292651 - RNA, 64 nt, Human
gcgcgcgcacgcgcacacacucacgcacacacaagcagagaaggcgcugaucuugaacuaaucc

SEQ ID NO: 292652 - RNA, 64 nt, Human
gaguguugcaguguauauuguaacaaccuaaaacgcagagaaguuuaauuuaauacuguuuuuu

SEQ ID NO: 292653 - RNA, 64 nt, Human
uuaaauacuggggaccgauaucacuguugauagugcagagaaacccuccacauuuuucagugca

SEQ ID NO: 292654 - RNA, 59 nt, Human
ccauucguaugcagccuugaagggagaaggcagagaaaacacacgcuccucugcccuuc

SEQ ID NO: 292655 - RNA, 64 nt, Human; identical to SEQ ID NO: 229445

SEQ ID NO: 292656 - RNA, 64 nt, Human; identical to SEQ ID NO: 229446

SEQ ID NO: 292657 - RNA, 64 nt, Human; identical to SEQ ID NO: 229447

SEQ ID NO: 292658 - RNA, 64 nt, Human
uuaaaaucuuccaaaugccuuuuuuuccucagaggcagagaaugacuaaguacggggagcagac

SEQ ID NO: 292659 - RNA, 64 nt, Human
ccccaagagacaggagagacuccgaacuccaucagcagagaagaccuccaguauaucgcaggcc

SEQ ID NO: 292660 - RNA, 64 nt, Human
cugguuucuagggauaaaaugauggccacccaaagcagagaauuuauccuuugguuagcauuuu

SEQ ID NO: 292661 - RNA, 64 nt, Human
aguuggaccccucaccuggccuccagggaagaaugcagagaaaagcaaggagagacucuaguua

SEQ ID NO: 292662 - RNA, 64 nt, Human
auuuuuuaaagagagaaauaauuaccugcacaaagcagagaacuucauaaaacauuaaccccua

SEQ ID NO: 292663 - RNA, 64 nt, Human
guugaaaguggccaaucucuaucagcuuaauuuggcagagaaaauuuguaacaacucugagcac

SEQ ID NO: 292664 - RNA, 64 nt, Human
ggugguuccgcuccguggacuggaaagcuguuccgcagagaaaacugaagguacaacauguauc

SEQ ID NO: 292665 - RNA, 64 nt, Human
uagacacacacacacagacacacacaaagaaucagcagagaaaacaaaauacaaguccuguucu

SEQ ID NO: 292666 - RNA, 64 nt, Human
gcuucgccuugauucuccgagaagccuccgagaagugcuuuaaguguguuugcaugcgccaggc

SEQ ID NO: 292667 - RNA, 64 nt, Human
cuuucuuaggccuuccccccaccccuuugccccagugcuuuaagcccuucuuugucuucuugcu

SEQ ID NO: 292668 - RNA, 64 nt, Human; identical to SEQ ID NO: 197496

SEQ ID NO: 292669 - RNA, 64 nt, Human; identical to SEQ ID NO: 197837

SEQ ID NO: 292670 - RNA, 64 nt, Human; identical to SEQ ID NO: 197032

SEQ ID NO: 292671 - RNA, 64 nt, Human
ugugccuccugugugucugcagacaagucuugcugugcuuuauuugugaaacuuuaaugaggaa

SEQ ID NO: 292672 - RNA, 64 nt, Human
uaggugaggguugucuaauccuauggcacaggacgugcuuuacaucuccagaucuguucuucac

SEQ ID NO: 292673 - RNA, 64 nt, Human
agaacaaaagccaaguguaaauuggugauuuagagugcuuuaaaauuucaggacucagauauga

SEQ ID NO: 292674 - RNA, 64 nt, Human
cuuguguuuguacauugcacagaaacuugugugggugcuuuaguaaaaaacgugaauggagcag

SEQ ID NO: 292675 - RNA, 64 nt, Human
ugccaaugauaggugcaaagaauauuggcaaaaggugcuuuaccuugagccauuauuuguguca

SEQ ID NO: 292676 - RNA, 64 nt, Human
ucuguacuuuuaccuguagacuauuuuuacuaaggugcuuuauaauguguuuuaaagcauugca

SEQ ID NO: 292677 - RNA, 64 nt, Human
ucuuuauguuuuauuagaaaaaaacuguuuuaaugugcuuuaucauaaauaaauauccugacaa

SEQ ID NO: 292678 - RNA, 64 nt, Human
uugcuaaugggagcacuucuuccuuuguuaggcugugcuuuacugauaaaaccaaguauugaau

SEQ ID NO: 292679 - RNA, 64 nt, Human
cacugaaagugcuaguuaaauggauucauaugaagugcuuuacucccaaccauugaguuauuua

SEQ ID NO: 292680 - RNA, 64 nt, Human
uggccugcuuccgucccugaaucccuuccaaccugugcuuuagugaacguugcucuguaacccu

SEQ ID NO: 292681 - RNA, 64 nt, Human
uuccccagccgcacucaugcccugcuccugucuugugcuuuauccugccccgcuccccaucgcc

SEQ ID NO: 292682 - RNA, 64 nt, Human
uacugucuucuguuuccuuuugccuuugcagaaugugcuuuagccuuugucugagaauggguuu

SEQ ID NO: 292683 - RNA, 64 nt, Human
aaaaugcagauguugaaggaauaauagguaucuugugcuuuaauacuuuauggcaggauuguac

SEQ ID NO: 292684 - RNA, 64 nt, Human
agacacuggaaaauauguaugugugguuaauaaagugcuuuaaacugaauugacauuaacagug

SEQ ID NO: 292685 - RNA, 64 nt, Human; identical to SEQ ID NO: 197126

SEQ ID NO: 292686 - RNA, 64 nt, Human; identical to SEQ ID NO: 196439

SEQ ID NO: 292687 - RNA, 64 nt, Human; identical to SEQ ID NO: 227170

SEQ ID NO: 292688 - RNA, 64 nt, Human
ccugaggccaaauauugaucuguauuaagcuccagugcuuuauccacauuguagccuaauauuc

SEQ ID NO: 292689 - RNA, 64 nt, Human
ucuuguaccugcuuuaugauacguaguagugaccgugcuuuaucagagcuguuuuuaaugaugu

SEQ ID NO: 292690 - RNA, 64 nt, Human
gcuguuucuuuuuuuaugacuguaaacauagauagugcuuuauuuuguuaauaauaagauaaug

SEQ ID NO: 292691 - RNA, 64 nt, Human
guaucuggcuucccuggaagcucuccgagcucuggugcuuuaguuaggucauuuuuuuagaaau

SEQ ID NO: 292692 - RNA, 64 nt, Human
gcucuugguuuccagagggucuggacugguuugggugcuuuaaaauagauauuuaguucagugg

SEQ ID NO: 292693 - RNA, 64 nt, Human
uuucuuuugagaguacccccaguuuauuucuacugugcuuuauugcuacuguucuuuauuguga

SEQ ID NO: 292694 - RNA, 64 nt, Human
ccuuuuuucauuauggaaaauaauuuaaacacuagugcuuuagugugcacucuccuguaagguc

SEQ ID NO: 292695 - RNA, 64 nt, Human
gaccuuggacuugucucuuacugcugaccagucugugcuuuaugggcagagaugagacccaggc

SEQ ID NO: 292696 - RNA, 64 nt, Human
caauguauacuuucacuuuuaaaaugccuguuuugugcuuuacaauaaaugauaugaaaccucc

SEQ ID NO: 292697 - RNA, 64 nt, Human
agcaaaccacacuuaaccuaucuauaauaaaaaugugcuuuaaauaauuuugggugguauuugu

SEQ ID NO: 292698 - RNA, 64 nt, Human
auuuaaaacuuauaacaucuuauuguugguaauagugcuuuauauuugucugauuuuauuuuuc

SEQ ID NO: 292699 - RNA, 64 nt, Human
ucauuuuguugauaauuucugcauuuaauggucugugcuuuaaaugguaacgcuacggccccag

SEQ ID NO: 292700 - RNA, 64 nt, Human
acauuuuaauauauaauguacaauuuaagaauuggugcuuuaccuuuacuaugcuuuuuuuuac

SEQ ID NO: 292701 - RNA, 64 nt, Human
ggcaaggggauuucucaggucauuuggagaacaagugcuuuaguaguaguuuaaaguaguaacu

SEQ ID NO: 292702 - RNA, 54 nt, Human; identical to SEQ ID NO: 197948

SEQ ID NO: 292703 - RNA, 64 nt, Human; identical to SEQ ID NO: 198118

SEQ ID NO: 292704 - RNA, 64 nt, Human; identical to SEQ ID NO: 197031

SEQ ID NO: 292705 - RNA, 64 nt, Human
uacaugaauaauaauacugucuuacguuuuucuggugcuuuauaauguauacauuacaucugag

SEQ ID NO: 292706 - RNA, 64 nt, Human
uugccuuuuuauaacuuuuuauauucucagcagagugcuuuaccaauugaaguaaaauguggca

SEQ ID NO: 292707 - RNA, 64 nt, Human
agaauaggaguagcaaaaauaugguuuuaaauuggugcuuuauuaggugacuuccuuuuaggcg

SEQ ID NO: 292708 - RNA, 64 nt, Human
aacaaaacaaaacaaacuuccaaacaguguguuggugcuuuagcgauugauugauguacagaac

SEQ ID NO: 292709 - RNA, 64 nt, Human
uuaaacauuuuauacauuuaaagucuuguuaauggugcuuuaagugucaauguagcauguaaaa

SEQ ID NO: 292710 - RNA, 64 nt, Human
ugcagauucguuuccaaaacuauugcuacuuugugugcuuuaaacaaaauaccuuggguugaug

SEQ ID NO: 292711 - RNA, 64 nt, Human
ccaaguacguuuucuuauuuaaaugacaacuuuggugcuuuaaaaugagguaccacuuuuuaaa

SEQ ID NO: 292712 - RNA, 64 nt, Human
gguugaacaaaaacaaauucuuuuaauucaacgggugcuuuacauaaugaaaaaaccacuugug

SEQ ID NO: 292713 - RNA, 64 nt, Human
uugucaaucauuuuuggaauuuuucuuucuuucugugcuuuauuacuaauaaguccaaugagug

SEQ ID NO: 292714 - RNA, 64 nt, Human
auuuauucuuuagauuuuagccuuguaaguuaaagugcuuuacaugaugaugugaaaagcuguu

SEQ ID NO: 292715 - RNA, 64 nt, Human
uauugaaaggccuagguauuaauuuuuuaaaugagugcuuuaacuuaaaacaggcguuuggaau

SEQ ID NO: 292716 - RNA, 64 nt, Human
cccuuuguccuucucggcgggggcuuccuggucugugcuuuacuuggcuuuuuuccuucccguc

SEQ ID NO: 292717 - RNA, 64 nt, Human
guauuucugacuaacacaaaugguccuuucacaugugcuuuauuagacucugggagagaaaagu

SEQ ID NO: 292718 - RNA, 64 nt, Human
gaaaugcauuugaugagugcuggaaacuucuuaagugcuuuacaguuuguuuucauuguuugca

SEQ ID NO: 292719 - RNA, 64 nt, Human; identical to SEQ ID NO: 196432

SEQ ID NO: 292720 - RNA, 64 nt, Human; identical to SEQ ID NO: 197762

SEQ ID NO: 292721 - RNA, 64 nt, Human; identical to SEQ ID NO: 198232

SEQ ID NO: 292722 - RNA, 64 nt, Human
ucuuaacaacacacugucauuuaaggcugugcuugugcuuuauacaaagagaaagagguggucu

SEQ ID NO: 292723 - RNA, 64 nt, Human
agucaugaaaaauaucucaagugguaaguuguuugugcuuuaggcaaacauuaaccagcucuaa

SEQ ID NO: 292724 - RNA, 64 nt, Human
ugaaaccucaaauuauauaauguaucuuauguaugugcuuuauauuguuauuuguguauacauu

SEQ ID NO: 292725 - RNA, 64 nt, Human
uuucuccagaguguuauggaaagcagugacagaugugcuuuaucaucuccaucuuuagccuuua

SEQ ID NO: 292726 - RNA, 64 nt, Human
auaaguccuucuguuaauuuguaaaagcacauuagugcuuuaccugugaaauuccccgcccccc

SEQ ID NO: 292727 - RNA, 64 nt, Human
ucgaacacucaugaugugccaagugcugugcuaagugcuuuacgaacauucgucauaucaggau

SEQ ID NO: 292728 - RNA, 64 nt, Human
ggccccucugccaagccugugugcgaugcccuuggugcuuuagugcaagaagccuaggcucaga

SEQ ID NO: 292729 - RNA, 64 nt, Human
aggaaauacuuugcauaaauuaaucagccccagagugcuuuaaaaaauucucuuaaauaaaaau

SEQ ID NO: 292730 - RNA, 64 nt, Human
cccagccucccaccuguuuauuuaacuuauuucagugcuuuauaauaaaggaaacacuaacaaa

SEQ ID NO: 292731 - RNA, 64 nt, Human
uuucagcaaauggcauucccaagauaaagcuguugugcuuuaacucauuucuuuucuuugguau

SEQ ID NO: 292732 - RNA, 64 nt, Human
uuuugcaguuuuuuucauugccaaaaacuaaauggugcuuuauauuuagauuggaaagaauuuc

SEQ ID NO: 292733 - RNA, 64 nt, Human
acuuauacuaauuuacauuguuuaccaagcuguagugcuuuaagaacacuacuuaaaaagcaaa

SEQ ID NO: 292734 - RNA, 64 nt, Human
cacacacaugcacacacccauaaacacacacacagugcuuuaagaaagggccaggugauaucac

SEQ ID NO: 292735 - RNA, 64 nt, Human
gaaaaaaagcaggacuccaccucuguauucccccgugcuuuaccuucuggcaucaugaaaagcu

SEQ ID NO: 292736 - RNA, 64 nt, Human; identical to SEQ ID NO: 197094

SEQ ID NO: 292737 - RNA, 64 nt, Human; identical to SEQ ID NO: 197234

SEQ ID NO: 292738 - RNA, 64 nt, Human; identical to SEQ ID NO: 196440

SEQ ID NO: 292739 - RNA, 64 nt, Human
uggcugggugcggugguucaugccuauaaucccagugcuuuacaaggcugaggcaggaggcucu

SEQ ID NO: 292740 - RNA, 64 nt, Human
uacaugguuugucggggacauuuaacucauggaggugcuuuagauuucaacaucagaugguuga

SEQ ID NO: 292741 - RNA, 64 nt, Human
aaggcugaacaaucauggauuuuucugaucaauugugcuuuaggaaauuauugacaguuuugca

SEQ ID NO: 292742 - RNA, 61 nt, Human
ugggagguggcauguucuaacuccuagacuagugcuuuaccuuuauuaaugaacugugaca

SEQ ID NO: 292743 - RNA, 64 nt, Human
ugucuuugggucaccaguuaccuucuuaaaauaugugcuuuagguagguguuauuacauaucug

SEQ ID NO: 292744 - RNA, 64 nt, Human
uuaauaauggcaagugacguggcccuggggaaaggugcuuuauguaccgugugugcguguaugu

SEQ ID NO: 292745 - RNA, 64 nt, Human
auauuauaaaggguuaauuguauauuuauaucaugugcuuuaucguuuuccccucauguaucca

SEQ ID NO: 292746 - RNA, 64 nt, Human
ucagcuuugcugaaacgcacauuaccuggaauaagugcuuuaauuguagaauuagaaugggauu

SEQ ID NO: 292747 - RNA, 64 nt, Human
ugaccagugaagcgcccuuucauuguaaaacauugugcuuuaccuacuacccuagccuugucuu

SEQ ID NO: 292748 - RNA, 64 nt, Human
acucugcuggaauccuauugagaagguagacauugugcuuuauuaauauagucgcucuucagcc

SEQ ID NO: 292749 - RNA, 64 nt, Human
uugggauucugguuugggguggucagugcccucugugcuuuauggacacaaaaccagagcacuu

SEQ ID NO: 292750 - RNA, 64 nt, Human
auuuuguuagcaugcugcuugguuuucuuacuuagugcuuuaaaauguuuuuuuuuauguuuaa

SEQ ID NO: 292751 - RNA, 64 nt, Human
cuggucuauguuauagcucuagcaguauggaaaugugcuuuaaaauaugcuuaccuuuugaaug

SEQ ID NO: 292752 - RNA, 64 nt, Human
caucaccaaaugaaaguuuguauuuaacgaggaggugcuuuacacuguacuuuuugguguuuuu

SEQ ID NO: 292753 - RNA, 64 nt, Human; identical to SEQ ID NO: 196431

SEQ ID NO: 292754 - RNA, 64 nt, Human; identical to SEQ ID NO: 197628

SEQ ID NO: 292755 - RNA, 64 nt, Human; identical to SEQ ID NO: 196876

SEQ ID NO: 292756 - RNA, 64 nt, Human
gaacacauaggaaugucuguggggugacucuacugugcuuuaucuuuuaacauuaagugccuuu

SEQ ID NO: 292757 - RNA, 64 nt, Human
ugugagaccaaauugcugaccugggucagugcaugugcuuuaugguguggugcaucuuuggaga

SEQ ID NO: 292758 - RNA, 64 nt, Human
uguuagacuagagcugagguuggaggauuccauagugcuuuaaacgugaugcauguuuuaaugg

SEQ ID NO: 292759 - RNA, 64 nt, Human
acaaagugucuuaaaaguuuuaaauagagaaaaugugcuuuacacaguugccuauaaaaagugc

SEQ ID NO: 292760 - RNA, 64 nt, Human
ccugaaauuuucacauauuauuucacuuuuguuagugcuuuaugggaagaauagggagucuaua

SEQ ID NO: 292761 - RNA, 64 nt, Human
agauacuuuuuagguggcauuuuauucauuuccugugcuuuaaauaaacaaauguaccaaaaaa

SEQ ID NO: 292762 - RNA, 64 nt, Human
agaaguuggucuuacuuugugcaaaagcaggcuugugcuuuauaccccauuugauuucgaugua

SEQ ID NO: 292763 - RNA, 64 nt, Human
ccagagcauaguauuuccugaaauaacaaguuuagugcuuuaacuauggcuacaugugcuuaag

SEQ ID NO: 292764 - RNA, 64 nt, Human
aggaagggaagggccacagccuucauuucuaggagugcuuuaagagaaacuguaaauggugcuc

SEQ ID NO: 292765 - RNA, 64 nt, Human
gaaugauuuuagauuuuccagagaauauuauaaagugcuuuagguaugaaaauaaaucaucuuu

SEQ ID NO: 292766 - RNA, 64 nt, Human
uugaacugcugaacuaguuggaggucuagaugaggugcuuuacgcaucagcugccuuagacagc

SEQ ID NO: 292767 - RNA, 64 nt, Human
gguuaaauugugggaaaggguccagauuuuaaaggugcuuuaagguugcccucugccgauacug

SEQ ID NO: 292768 - RNA, 64 nt, Human
augucucuuuaguuucuuuugcacaugcuacauugugcuuuagaccggagauaauacagugacu

SEQ ID NO: 292769 - RNA, 64 nt, Human
uuaagggacuacgauaauguguacuaugacaaacgugcuuuauucuucuaacgcaguaagaauu

SEQ ID NO: 292770 - RNA, 64 nt, Human; identical to SEQ ID NO: 198138

SEQ ID NO: 292771 - RNA, 64 nt, Human; identical to SEQ ID NO: 197475

SEQ ID NO: 292772 - RNA, 64 nt, Human; identical to SEQ ID NO: 196407

SEQ ID NO: 292773 - RNA, 64 nt, Human
gcaugcguuuaaauucuauuauauaaagccccaagugcuuuaccuucuaaaacaugcuucucua

SEQ ID NO: 292774 - RNA, 64 nt, Human
auauuuggcuucaaaggaguaccuuuacuuacaugugcuuuaugguaaguacauugaauuuuac

SEQ ID NO: 292775 - RNA, 64 nt, Human
uuguaaugcauauccaucuuggauucaauccaaggugcuuuagcuaucaguaguaccaaaggau

SEQ ID NO: 292776 - RNA, 64 nt, Human
uucaagaugaauugaaauuuuuaaucaagauagugugcuuuauucuguuguauuuuuuauuauu

SEQ ID NO: 292777 - RNA, 64 nt, Human
aagucagauuuuaaggcaaauaaagugacauaaggugcuuuauauuuuauuuugguauauuuaa

SEQ ID NO: 292778 - RNA, 64 nt, Human
ggaagaucuaauaagcuguguuuccugggaaguggugcuuuacuuagcccuguggacaacuucu

SEQ ID NO: 292779 - RNA, 64 nt, Human
aaauuauuuuccacccuacaucaguauauugguugugcuuuauauuugccaaaguccuaacuga

SEQ ID NO: 292780 - RNA, 64 nt, Human
gagucaaugucuucaugguaaauuucucccaauugugcuuuagguucacagcugaggacuguag

SEQ ID NO: 292781 - RNA, 64 nt, Human
gcaccaaggcaacggcaccauuggucucuggguagugcuuuaagaaugaacacaaucacguuau

SEQ ID NO: 292782 - RNA, 64 nt, Human
aaguaccacaucuacaauuuugguaaccgaacuggugcuuuaguaauguggauuuuuuucuuuu

SEQ ID NO: 292783 - RNA, 64 nt, Human
gaagcuaagaaauauaccuacacaaacuugucaggugcuuuacaacuacauaguacuuuuuaac

SEQ ID NO: 292784 - RNA, 64 nt, Human
ugauauacucaccuuagaacugcucagaacccuggugcuuuauuuuuguuuuaaucuuuuguug

SEQ ID NO: 292785 - RNA, 64 nt, Human
acaaaaacaauucacuaaaaauaaauaugucauugugcuuuaaaaaaauaaccucuuguaguua

SEQ ID NO: 292786 - RNA, 64 nt, Human
uucaauuccugugauuuuuguucucuucccugaagugcuuuacagugcauggaaucuccaucau

SEQ ID NO: 292787 - RNA, 64 nt, Human; identical to SEQ ID NO: 198174

SEQ ID NO: 292788 - RNA, 64 nt, Human; identical to SEQ ID NO: 196408

SEQ ID NO: 292789 - RNA, 64 nt, Human; identical to SEQ ID NO: 198175

SEQ ID NO: 292790 - RNA, 64 nt, Human
aguuuauaaguuugauuucagauguuggaaaugugugcuuuauaguguuuacuaaagugacaag

SEQ ID NO: 292791 - RNA, 64 nt, Human
cuguacauuucacaggcuaaugggauaaaggacugugcuuuaaagauaaaaauaucaucauagu

SEQ ID NO: 292792 - RNA, 64 nt, Human
uccaugcagacuccucagaucugaacacaguuuagugcuuuacaugcugugcucuuugaagaga

SEQ ID NO: 292793 - RNA, 64 nt, Human
gccuguagucuuauuggaaaucuauuuuaucagugugcuuuauugaguguggauuuugcauaca

SEQ ID NO: 292794 - RNA, 64 nt, Human
guucaguguagacauuuugaaaagauuguuuccugugcuuuacgauagcuuagugcaaugugca

SEQ ID NO: 292795 - RNA, 64 nt, Human
uacagccauuuaaaugaucauugcugcuacagaagugcuuuaagagaauugccugaaacaucug

SEQ ID NO: 292796 - RNA, 64 nt, Human
uugcccagcccucagauggcucuccuacaugauggugcuuuagaaacaaagguaaaauuugccu

SEQ ID NO: 292797 - RNA, 64 nt, Human
auugagggggacuuaugugcuuuuauugaauggagugcuuuacaauuuuuauuuuuaaaugggg

SEQ ID NO: 292798 - RNA, 64 nt, Human
caccuuucuagcgugagcuguagaguaacgagaagugcuuuauacugaacgugguugaugggag

SEQ ID NO: 292799 - RNA, 64 nt, Human
auucauuuuuaaauggucauuucuuauucagugagugcuuuaguguuuuaaacuauauggauaa

SEQ ID NO: 292800 - RNA, 64 nt, Human
cuuaaggacucguuaccauuugcaguuaccauaagugcuuuaucuucucuaugcacaggcuuaa

SEQ ID NO: 292801 - RNA, 64 nt, Human
agccaggaagccccguuuguaagcguguguuguggugcuuuauuguacauccuccaguggcguu

SEQ ID NO: 292802 - RNA, 64 nt, Human
caucagaaacagauauccgaguggguggggaggugugcuuuagauuucucauuagaagaccacc

SEQ ID NO: 292803 - RNA, 64 nt, Human
gcaacaucuuuucuucccaggcguucuucucugggugcuuuauucucuucuuuuucuuuauuuc

SEQ ID NO: 292804 - RNA, 64 nt, Human; identical to SEQ ID NO: 198176

SEQ ID NO: 292805 - RNA, 64 nt, Human; identical to SEQ ID NO: 198061

SEQ ID NO: 292806 - RNA, 64 nt, Human; identical to SEQ ID NO: 197420

SEQ ID NO: 292807 - RNA, 64 nt, Human
augugucugcaaacauccuuauucccaacuuaaagugcuuuauugcagagaguuauggaaauau

SEQ ID NO: 292808 - RNA, 64 nt, Human
ugucugggauguugauccuugagaacuuggcccugugcuuuagacccaaggacccgauucuugg

SEQ ID NO: 292809 - RNA, 64 nt, Human
cgcaggcagugcggcuuuuggcuguguacauagggugcuuuauucuccacagagugauacaugc

SEQ ID NO: 292810 - RNA, 64 nt, Human
uauaugagucucaaguuuuauuauugcaauaaaagugcuuuaugcuggcuuuucucaaaaaaua

SEQ ID NO: 292811 - RNA, 64 nt, Human
aguugguaaaaggcaacuuucagaagaaaauaaugugcuuuagaaaaaaaauucaaauuuauag

SEQ ID NO: 292812 - RNA, 64 nt, Human
uguggaagaaaucauagagcuggagacuacuuuugugcuuuacaaaacugugaaggauuguggu

SEQ ID NO: 292813 - RNA, 64 nt, Human
caccuauucaauaacugaaaaagacauuaccauagugcuuuacauuuuuaaaguaauguuacaa

SEQ ID NO: 292814 - RNA, 64 nt, Human
uuuaggugaucaggaugccguugguggcauuuacgugcuuuauaugauuuuuaccucuguaaca

SEQ ID NO: 292815 - RNA, 64 nt, Human
ugggguugguauugcaaaaugaauugaacggauggugcuuuaaugagagaaguaaaggaauaua

SEQ ID NO: 292816 - RNA, 64 nt, Human
gaaagagacuguagcaauacaaaaaucaagcuuagugcuuuauuaccugaguuuuuaauagagc

SEQ ID NO: 292817 - RNA, 64 nt, Human
aauaucauuuguggguuuugaaugcaucuuuaaagugcuuuaaaaaaaaguuuuauaaguaggg

SEQ ID NO: 292818 - RNA, 64 nt, Human
cuuuacaggaaguaaaugcaaauuacuuuuaagugugcuuuaaagaaaaauauuuuccccacaa

SEQ ID NO: 292819 - RNA, 62 nt, Human
aguauacaagcuccaaguaaaugugugcuuaggugcuuuaaaacucaaaggcucuuuucaga

SEQ ID NO: 292820 - RNA, 64 nt, Human
ugguuccagacuuccuauaagacugucugcauuggugcuuuaguaucucaggccuccaaggauu

SEQ ID NO: 292821 - RNA, 64 nt, Human; identical to SEQ ID NO: 197139

SEQ ID NO: 292822 - RNA, 64 nt, Human; identical to SEQ ID NO: 196442

SEQ ID NO: 292823 - RNA, 64 nt, Human; identical to SEQ ID NO: 197140

SEQ ID NO: 292824 - RNA, 64 nt, Human
auguuuccuuuuugggugaaauggauuuaugugagugcuuuaaacaaauagcaauacuuauaga

SEQ ID NO: 292825 - RNA, 64 nt, Human
caccuaacuguucagucauucugguuuucaagcagugcuuuaucucauguccuugaauauaguu

SEQ ID NO: 292826 - RNA, 64 nt, Human
gaugaugacaacugugaacucugacauaaauuuagugcuuuauaacgaacugaaucagguugag

SEQ ID NO: 292827 - RNA, 64 nt, Human
caagaccaguauucuaaaguuuugcaacaauuaagugcuuuaccuaaguguugauugugccugu

SEQ ID NO: 292828 - RNA, 64 nt, Human
gccagaccaauauucuacaguuugcaacaaugaagugcuuuaccuaaguguggauugugccucu

SEQ ID NO: 292829 - RNA, 64 nt, Human
caagaccaauauucuaaaguuuugcaacaaugaagugcuuuacuuaaguguugauugugccugu

SEQ ID NO: 292830 - RNA, 64 nt, Human
cuuugugccaaaaauaucauaccuaauuuuuauagugcuuuacuaucagaauuuauauuguuua

SEQ ID NO: 292831 - RNA, 64 nt, Human
gauugauuuuguuuucauagugggaaucaggauugugcuuuauugagccugcaguuacauugaa

SEQ ID NO: 292832 - RNA, 64 nt, Human
ucucuggauuuauaaugcaguaugaauauacuuugugcuuuaugguuuuuauaaugucuuuuug

SEQ ID NO: 292833 - RNA, 64 nt, Human
uacaaccaaaaacugccuagaucuuugcaguuaugugcuuuaugccacgaagaacugaaguaug

SEQ ID NO: 292834 - RNA, 64 nt, Human
aaggacaguaaacacacauguaugacccuuacaagugcuuuaagauuuuaaaaaugugauguuu

SEQ ID NO: 292835 - RNA, 64 nt, Human
gauuuugaaauauaguaaacacuuggaaaugguggugcuuuaaaaagauauuaauagauaauau

SEQ ID NO: 292836 - RNA, 64 nt, Human
agauugcacccugaugcccugguuuaggaaagcagugcuuuaaccuuuugccccuggaaauuac

SEQ ID NO: 292837 - RNA, 64 nt, Human
cuguaacccuugguugccagagauaaagugaaaagugcuuuaggugagaugacuaaauuaugcc

SEQ ID NO: 292838 - RNA, 64 nt, Human; identical to SEQ ID NO: 196425

SEQ ID NO: 292839 - RNA, 64 nt, Human; identical to SEQ ID NO: 197439

SEQ ID NO: 292840 - RNA, 64 nt, Human; identical to SEQ ID NO: 197440

SEQ ID NO: 292841 - RNA, 64 nt, Human
ggaggaagauguuuuguaaucuuuuuuuccccaugugcuuuagugggcuuugguuuucuuuuug

SEQ ID NO: 292842 - RNA, 64 nt, Human
ucauuuaaguaaaagguuagcagagcaaagugcggugcuuuagcugcugcuugugccgcugugg

SEQ ID NO: 292843 - RNA, 64 nt, Human
uacugaggaauguaggaaaaaaaaucugaggauagugcuuuacucuuucuguuuuuaaagggca

SEQ ID NO: 292844 - RNA, 64 nt, Human
ugaauguguuuaaacugcagugaauaaaugagaugugcuuuaauuuaacccgauuuuuggaaug

SEQ ID NO: 292845 - RNA, 64 nt, Human
augauuccauaaauuguauuauugggauuagaaugugcuuuaugacagguuaguguuuccucug

SEQ ID NO: 292846 - RNA, 64 nt, Human
acuaauguggauugaaauguagagauacacuggagugcuuuauuuagcaauauuugaugaaagc

SEQ ID NO: 292847 - RNA, 64 nt, Human
uuucuucuuaacuugggagauauauugaaacaaggugcuuuauaagauuauuguacuuaagacu

SEQ ID NO: 292848 - RNA, 64 nt, Human
guugaaaaguaaaaaauauaugugguuuggaugugugcuuuaauucagcuuuagaaauuaauac

SEQ ID NO: 292849 - RNA, 64 nt, Human
ucaugauuuccuuucuuagacuucauaggagauagugcuuuaaaaaaaaaaaaaacuucuauua

SEQ ID NO: 292850 - RNA, 64 nt, Human
gacacgagcuuaaucaacagaaguaucaagccaugugcuuuagcauaaaagaauauuuagaaaa

SEQ ID NO: 292851 - RNA, 64 nt, Human
auucauugguauacaacaauuuuuauucuuaugugugcuuuaagggcuguguuuugcucuuagg

SEQ ID NO: 292852 - RNA, 64 nt, Human
auagugaauguauuguacugugucugugaaaacugugcuuuaaauuauauuuucauauguuuug

SEQ ID NO: 292853 - RNA, 64 nt, Human
gucccagcuccccucuuaugguuucugucauaaugugcuuuaucugauugacuccaaacauccc

SEQ ID NO: 292854 - RNA, 64 nt, Human
cuuuauguauauuuguagcuauauuucauacaaagugcuuuaaguguggagagucaauuaaaca

SEQ ID NO: 292855 - RNA, 64 nt, Human; identical to SEQ ID NO: 197421

SEQ ID NO: 292856 - RNA, 64 nt, Human; identical to SEQ ID NO: 197422

SEQ ID NO: 292857 - RNA, 64 nt, Human; identical to SEQ ID NO: 196426

SEQ ID NO: 292858 - RNA, 64 nt, Human
ucuccuuggcagggacacuaaagggcugucuucagugcuuuaaugguuuuguuuucuaaugcaa

SEQ ID NO: 292859 - RNA, 64 nt, Human
gucuucaaugaucaaauuuugagcaaagaaacuugugcuuuaccaaggggaauuacugaaaaag

SEQ ID NO: 292860 - RNA, 64 nt, Human
agcuaagcaagccccgaauuugauaguguauaaggugcuuuauucccucgaauguccauuaagc

SEQ ID NO: 292861 - RNA, 64 nt, Human
uagcauucucgauggguauugaggaugguuggaugugcuuuauuguguguggaaacaugccucu

SEQ ID NO: 292862 - RNA, 64 nt, Human
ugcucagcuguguccguaggagucggaugugucugugcuuuauuauggccuuguuuauauauca

SEQ ID NO: 292863 - RNA, 64 nt, Human
ucacccggcccggagcgguguauuuugauugcuggugcuuuaacuauauugaccaagguguaua

SEQ ID NO: 292864 - RNA, 64 nt, Human
auaaauagagugacuauccacaggagaaaagugugugcuuuaguauuagaggagauaggcagag

SEQ ID NO: 292865 - RNA, 64 nt, Human
ucugaguccucccccugagguucucuuuuucuuggugcuuuauuagcaacucuggauauuuuua

SEQ ID NO: 292866 - RNA, 64 nt, Human
aguucaagaagcaauacaguguaacaugucacuugugcuuuaaaauuagucuguaucaccauuu

SEQ ID NO: 292867 - RNA, 57 nt, Human
augaugaagcugacuccuaaaccaaaagugcuuuaaaaaccagccuggcgaggacag

SEQ ID NO: 292868 - RNA, 64 nt, Human
auuuuucuugggcaagauugguguuuacuuaggggugcuuuaaaaauauauuuuuacaaguaua

SEQ ID NO: 292869 - RNA, 64 nt, Human
caccagccagguccucaggcaaaguccucagccagugcuuuagagcaacuucccgcaaaucaga

SEQ ID NO: 292870 - RNA, 64 nt, Human
uuguugaacuaaagccuuuuuuugauuaccuguagugcuuuaaaguauauuuuuaaaagggagg

SEQ ID NO: 292871 - RNA, 64 nt, Human
uuucaagcuguguauuuuugccuauuuguugcuugugcuuuauuuuucuuagucauuuguggaa

SEQ ID NO: 292872 - RNA, 64 nt, Human; identical to SEQ ID NO: 197457

SEQ ID NO: 292873 - RNA, 64 nt, Human; identical to SEQ ID NO: 197458

SEQ ID NO: 292874 - RNA, 64 nt, Human; identical to SEQ ID NO: 196428

SEQ ID NO: 292875 - RNA, 64 nt, Human
auucagguggauaaauagucuuacaaaagacaaugugcuuuauguuauaccuauagcuuugguc

SEQ ID NO: 292876 - RNA, 64 nt, Human
aaaaaaagauuuguaaaaucaccggaacaauugugugcuuuauuuuauagguagugguuauuag

SEQ ID NO: 292877 - RNA, 64 nt, Human
aguaaaguaccuuuauguuaugaggauauaaugugugcuuuauugaauuagaaaauuagugacc

SEQ ID NO: 292878 - RNA, 64 nt, Human
auauauuggaggagcauccacuaucaguauuucugugcuuuauaaacuauauuagagggacugg

SEQ ID NO: 292879 - RNA, 64 nt, Human
uauggugguguguuuuuauuucugaauuuuccaugugcuuuaauauuuguuuaagaauauuuuu

SEQ ID NO: 292880 - RNA, 64 nt, Human
aaaagaaagaaaucguuucuaacaguaaauuauugugcuuuaguugcuaguuuguacugagagu

SEQ ID NO: 292881 - RNA, 64 nt, Human
uuuaggguccgugacuaccaucugcaugguuuaagugcuuuacucacggaguuuaaauaauagu

SEQ ID NO: 292882 - RNA, 64 nt, Human
uuauucuuugacccagaaagacuggagaagguaugugcuuuaagugcugcucuaccugaaaaga

SEQ ID NO: 292883 - RNA, 64 nt, Human
cugauguuacaagggaccacacuuuugagaaucugugcuuuaagcuaaggaaauauugccuggu

SEQ ID NO: 292884 - RNA, 64 nt, Human
ggcugccacagccccugcucugucuuagauuauggugcuuuacaaagagagugguccaugacca

SEQ ID NO: 292885 - RNA, 64 nt, Human
aaauggauaucauuucuaggacaagcuuggugccgugcuuuaauguggcaugguacaagauaaa

SEQ ID NO: 292886 - RNA, 64 nt, Human
aguugcuucugguuucacacuuuuuaaccccucugugcuuuagcagccgugaccuugccuucau

SEQ ID NO: 292887 - RNA, 64 nt, Human
uuaggcauuaaccuugauagaaucacucaguuuggugcuuuaaauuaagucuguuuacuaugaa

SEQ ID NO: 292888 - RNA, 64 nt, Human
caugcacaggaagauauugguggccggugguuuugugcuuuaaaaaugcaauaucugaccaaga

SEQ ID NO: 292889 - RNA, 64 nt, Human; identical to SEQ ID NO: 196372

SEQ ID NO: 292890 - RNA, 64 nt, Human; identical to SEQ ID NO: 198003

SEQ ID NO: 292891 - RNA, 57 nt, Human; identical to SEQ ID NO: 229450

SEQ ID NO: 292892 - RNA, 64 nt, Human
uuaaaagggaaguuauuuauauuuuguguauaaugugcuuuauuugcaaaucacccacuccuuu

SEQ ID NO: 292893 - RNA, 64 nt, Human
ucugcccuguaaaaaucagacucggaaccgaugugugcuuuagggaauuuuaaguugcaugcau

SEQ ID NO: 292894 - RNA, 64 nt, Human
ccggagcacuugcagaggacuugcuauuugccaggugcuuuauguaucauuaaauuuuucucau

SEQ ID NO: 292895 - RNA, 64 nt, Human
uagacauuguucagcccacuuguagaagguccgugugcuuuaccaaaggguagguuuuaaagau

SEQ ID NO: 292896 - RNA, 64 nt, Human
aagccacaaggaaugggugaaagauuauuguaaugugcuuuaacuaaauagguaaauauacuaa

SEQ ID NO: 292897 - RNA, 64 nt, Human
augguccaggagaaggccaauuccuauacgcagcgugcuuuaaaaaauaaauaagaaacaacuc

SEQ ID NO: 292898 - RNA, 64 nt, Human
gcccaggcccacacacucugcccgugucacacgugugcuuuaacacaaaacagauaacacuaaa

SEQ ID NO: 292899 - RNA, 64 nt, Human
gaacuguauauuuauuuugaaagaaauguuauucgugcuuuaaaaaggaaaaaaaaccaugaau

SEQ ID NO: 292900 - RNA, 64 nt, Human
ucugauggcaguuccucaaauaacuuuaacuuuugugcuuuagggauaguuguuaaaguuacaa

SEQ ID NO: 292901 - RNA, 64 nt, Human
uccccaacaugguuaauuccaacucucagaucuugugcuuuaguuaguacaugugacucaccag

SEQ ID NO: 292902 - RNA, 64 nt, Human
agcagagguagaagauaucacugcagccugcuuugugcuuuaauuggguaccaagcuuugggga

SEQ ID NO: 292903 - RNA, 64 nt, Human
uuuucuuucucuugcuccaagaagagcccuguuggugcuuuaccaccgcuuggagucucccgag

SEQ ID NO: 292904 - RNA, 64 nt, Human
uauugaguacuuacugugcuaggcacugagucaggugcuuuacauacguccccuucauuuaggu

SEQ ID NO: 292905 - RNA, 64 nt, Human
cuacauuuuuaaugggagcaccuuuuaucccaaagugcuuuauaaauugaguggacugauauau

SEQ ID NO: 292906 - RNA, 64 nt, Human; identical to SEQ ID NO: 197514

SEQ ID NO: 292907 - RNA, 64 nt, Human; identical to SEQ ID NO: 197515

SEQ ID NO: 292908 - RNA, 64 nt, Human; identical to SEQ ID NO: 197363

SEQ ID NO: 292909 - RNA, 64 nt, Human
cuaucuucuuacccugaaacagaaaauaaauauugugcuuuaugugguaguguuguacccauuc

SEQ ID NO: 292910 - RNA, 64 nt, Human
aaaugaguauuuuuuugcuagcaccuccccuugcgugcuuuaaaugacaucugccugggaugua

SEQ ID NO: 292911 - RNA, 64 nt, Human
uauuggaggagcugccgugcugcugauacggggugugcuuuaugcugcucuuugcgguuuguug

SEQ ID NO: 292912 - RNA, 64 nt, Human
gaaaaaaggacucauggcauuauuaauauaauuagugcuuuacauguguuaguuauacauauua

SEQ ID NO: 292913 - RNA, 64 nt, Human
ucucccccuaguuugugagaaacaucucaauaaagugcuuuaaaaagauuguguuaccagaaua

SEQ ID NO: 292914 - RNA, 64 nt, Human
gcaauagaaauagcuaauuuauuuccccaggugugugcuuuaggcgugggcugaccaggcuucu

SEQ ID NO: 292915 - RNA, 64 nt, Human
ucuggaaugacaugugucaagcugcuuggaccucgugcuuuaagugccuacauuaucuaacugu

SEQ ID NO: 292916 - RNA, 64 nt, Human
guaagaacuaaugaaucugagcagucauuuaucagugcuuuaacagcauaucguaugucuuugg

SEQ ID NO: 292917 - RNA, 64 nt, Human
guauuucugacuaaaacaaauggcucuuucacaugugcuuuauuagacucugggagagaaaauu

SEQ ID NO: 292918 - RNA, 64 nt, Human
gucauucuauuaugaagaaaacaguuuuauuugagugcuuuaauauaaugcaacauuuaaguca

SEQ ID NO: 292919 - RNA, 64 nt, Human
ccaaaacagaauuuaggggugggugaaagcacuugugcuuuagcuuuuucauauuaaauauaua

SEQ ID NO: 292920 - RNA, 64 nt, Human
accaauuguaaaaacugaaauuagguugaggaaagugcuuuagaaauaauaaagauguacaaau

SEQ ID NO: 292921 - RNA, 64 nt, Human
gaagcauaauuuaagaaaaacaucaacauuuuuugugcuuuaaacuguaguaguuggucuagaa

SEQ ID NO: 292922 - RNA, 64 nt, Human
aaccugucuccaaaaccaugccauaauaauauaagugcuuuagaaauuaaaucauuguguuuuu

SEQ ID NO: 292923 - RNA, 64 nt, Human; identical to SEQ ID NO: 196406

SEQ ID NO: 292924 - RNA, 64 nt, Human; identical to SEQ ID NO: 198136

SEQ ID NO: 292925 - RNA, 64 nt, Human; identical to SEQ ID NO: 198156

SEQ ID NO: 292926 - RNA, 64 nt, Human
accaggcagauucaguguguggaacaggaaggaugugcuuuaaaaaaagguggaaucccucaaa

SEQ ID NO: 292927 - RNA, 64 nt, Human
gcacuagcauuauaccaagaguaugagaaauacagugcuuuauggcucuaacauuacugccuuc

SEQ ID NO: 292928 - RNA, 64 nt, Human
uuuccccacaagcccuucuuccuguaucaagaaugugcuuuagaguaugugagcaaccugucuu

SEQ ID NO: 292929 - RNA, 64 nt, Human
acaucugcaaaugauauuuaaaccaucuuggcuugugcuuuauucaaacuaaugugaaacaaua

SEQ ID NO: 292930 - RNA, 64 nt, Human
uguaauuuuuuuaaaaaccaccagauacagaaaugugcuuuaacaucaguugaaaccuaaauuu

SEQ ID NO: 292931 - RNA, 64 nt, Human
augguuucuggugguauuucugaaguuagguaaagugcuuuacuugccuugguuguuaauugaa

SEQ ID NO: 292932 - RNA, 64 nt, Human
cuucauauucccaauaaaccccacguuguggcaggugcuuuauaaacacucuuauuuaaucucc

SEQ ID NO: 292933 - RNA, 64 nt, Human
augcuggagauauuugauacucucauuuaaacuggugcuuuauguacaugagauguacuaaaau

SEQ ID NO: 292934 - RNA, 64 nt, Human
cucuggaaaauagauguuacaguucuuaaaggcagugcuuuaaagugaaguucauucuguuucc

SEQ ID NO: 292935 - RNA, 64 nt, Human
gaauggcucaccuugccuaaaguauaugaagagugugcuuuaugucgagcuccugcuugcuugc

SEQ ID NO: 292936 - RNA, 64 nt, Human
guauguggcuguggcccucccucguggaggugccgugcuuuaaagaggccuuagugcccgggau

SEQ ID NO: 292937 - RNA, 64 nt, Human
cucaaaaaaaaaaaaaugcacauagcuaucaagugugcuuuagcuugaaaaggugaccuugcaa

SEQ ID NO: 292938 - RNA, 64 nt, Human
ggagagaaggauggggaagcauugcaaggaaauugugcuuuauccaacaaaauguaaggagcca

SEQ ID NO: 292939 - RNA, 64 nt, Human
gacuguaggaucaugucugcaacuuuuagaaauagugcuuuauauugcagcagucuuuuauauu

SEQ ID NO: 292940 - RNA, 64 nt, Human; identical to SEQ ID NO: 197914

SEQ ID NO: 292941 - RNA, 64 nt, Human; identical to SEQ ID NO: 198023

SEQ ID NO: 292942 - RNA, 64 nt, Human; identical to SEQ ID NO: 197761

SEQ ID NO: 292943 - RNA, 64 nt, Human
ugccgguuugaaaauaugccugcaaucugagccagugcuuuaauggcaugucagacagaacuug

SEQ ID NO: 292944 - RNA, 64 nt, Human
acccagcaaucuuuuaggaagagauuuuacaguggugcuuuauuuauaucaauaauccaguaua

SEQ ID NO: 292945 - RNA, 64 nt, Human
agcccacaccauuccagugcucagccuagcaaaugugcuuuaaugcacacuucucagaccugug

SEQ ID NO: 292946 - RNA, 64 nt, Human
uugaaaauguaauugugauuuaccugugccaaaggugcuuuaaaugucacauuuguaaagggga

SEQ ID NO: 292947 - RNA, 64 nt, Human
aauacaacaucuuauucuuuagcuuucuuaaucggugcuuuauggaggccaguguaacguuaca

SEQ ID NO: 292948 - RNA, 64 nt, Human
uucaggcuuaauuuuccuaacuuguucagcacuagugcuuuaccucucauuuuuaauugaacug

SEQ ID NO: 292949 - RNA, 64 nt, Human
auauuuaauuuuuuuaauauauaggucuuaaguggugcuuuaaaaagaacccucacaaguuaaa

SEQ ID NO: 292950 - RNA, 64 nt, Human
ucuccauacuuaaauggucaguagcuacugaguggugcuuuaucugaauaggccuggaucgaag

SEQ ID NO: 292951 - RNA, 64 nt, Human
ucuuuuuagaaacccacuguuaaaauuuaaaaaggugcuuuaaaauaaaacgccuauaaagauu

SEQ ID NO: 292952 - RNA, 64 nt, Human
agcagauuguuuccucuuccaaaguaaaauugcugugcuuuauggauaguaagaauggcccuag

SEQ ID NO: 292953 - RNA, 64 nt, Human
uggcaaaaacacugagcuuucgaauaugaaucaugugcuuuaggugggaauugugaauucugaa

SEQ ID NO: 292954 - RNA, 64 nt, Human
aucuuuuugaaagauuauacuucuuuaccucuuugugcuuuagaaauuauuuuccuucaagugu

SEQ ID NO: 292955 - RNA, 64 nt, Human
cuuucugauauggcaguuacacuuuuucacuuaagugcuuuaguuuagacuaacuuuacaacuu

SEQ ID NO: 292956 - RNA, 64 nt, Human
gaggacagguuucuguuaagaucaccaaguagcugugcuuuaauuagagccagacaagcuuuca

SEQ ID NO: 292957 - RNA, 64 nt, Human; identical to SEQ ID NO: 196335

SEQ ID NO: 292958 - RNA, 64 nt, Human; identical to SEQ ID NO: 198193

SEQ ID NO: 292959 - RNA, 64 nt, Human; identical to SEQ ID NO: 198194

SEQ ID NO: 292960 - RNA, 64 nt, Human
gugccauacuaguaugugcuucaaaagggcaaaugugcuuuagugcccuaaggcuaaauuuugg

SEQ ID NO: 292961 - RNA, 64 nt, Human
ucaauaacuauugcugcuuucucuucuacuucuugugcuuuacucugaauuuccaguguggucu

SEQ ID NO: 292962 - RNA, 64 nt, Human
uggguaguggugaugaaugcaaaacuuugugaaugugcuuuauaaaagugauaauuagacacuu

SEQ ID NO: 292963 - RNA, 64 nt, Human
uuugaaggauuucagcuccuccucucuguaauuugugcuuuaagcauuuuuuuuccuaaaauaa

SEQ ID NO: 292964 - RNA, 64 nt, Human
cuuuguaucuaacuuuucucaauccucucuugaggugcuuuacuaaugggaaugauuucuguau

SEQ ID NO: 292965 - RNA, 64 nt, Human
ggauacuuuuguuuuaaaaggcuaaaauguuugugugcuuuaaaauucuuaaugaauucacugg

SEQ ID NO: 292966 - RNA, 64 nt, Human
ugauuuuuaacaugguucccaccauguaagacuggugcuuuagcaucuaugccacaugcguuga

SEQ ID NO: 292967 - RNA, 64 nt, Human
cuuugugcuuuguguacauuguguucucccuagggugcuuuagacccuguuuguuuucuucugc

SEQ ID NO: 292968 - RNA, 64 nt, Human
auagugaaguguaaugaaaaacaucucuaggaaugugcuuuaaccacugcugcaaaagagacaa

SEQ ID NO: 292969 - RNA, 64 nt, Human
agcucucuuacccagauucacuaauuguucauacgugcuuuaucuuucaugcuuucucuguaca

SEQ ID NO: 292970 - RNA, 64 nt, Human
uguggcagccugcccugcuacaugcuagacaagugugcuuuaguacauagccacaaguucuuca

SEQ ID NO: 292971 - RNA, 64 nt, Human
guuguccuguuuguauaguccccccucuguggacgugcuuuaguagcuccucuuaccuagaggg

SEQ ID NO: 292972 - RNA, 64 nt, Human
acugcuuauuuguuugaagaauccagccaucguagugcuuuagucacuaucguaaacauucaug

SEQ ID NO: 292973 - RNA, 64 nt, Human
cuuuccucacuucugcuuuguuuaaaucacaagagugcuuuaaugaugacauuuagcaagugcu

SEQ ID NO: 292974 - RNA, 64 nt, Human; identical to SEQ ID NO: 196390

SEQ ID NO: 292975 - RNA, 64 nt, Human; identical to SEQ ID NO: 198099

SEQ ID NO: 292976 - RNA, 64 nt, Human; identical to SEQ ID NO: 197441

SEQ ID NO: 292977 - RNA, 64 nt, Human
gucuaauacaugccagagauuuuuuuuucaaaaagugcuuuaucccuacaauguacugacaguu

SEQ ID NO: 292978 - RNA, 64 nt, Human
guccaugcaggcaucuccaggaugcccugacacugugcuuuaggacuggcugcgcucaugggca

SEQ ID NO: 292979 - RNA, 64 nt, Human
aguguauacauuuuuggcuuuacaguuucuuucagugcuuuaaagauguaccucugcuauuuac

SEQ ID NO: 292980 - RNA, 64 nt, Human
uuuuguugagggcuguacuuuuuacccccuuuaagugcuuuaacaggauauacguuugauuuuc

SEQ ID NO: 292981 - RNA, 64 nt, Human
ucauucuccugcuuuaaaaagugcaugaacuguagugcuuuaaacaaucaucuccuuaacaggg

SEQ ID NO: 292982 - RNA, 64 nt, Human
uguaguaucagcuacuuguaaggcuguggcagaagugcuuuagcccaggagguugaggcugcag

SEQ ID NO: 292983 - RNA, 64 nt, Human
ugaguuucuuguaagguuaccguuucuaagaguugugcuuuauggccacugagagaauucagaa

SEQ ID NO: 292984 - RNA, 64 nt, Human
ggacagagccgcuaaggacaaaacaaucccucccgugcuuuaugauggcagcaggggcugggga

SEQ ID NO: 292985 - RNA, 64 nt, Human
aaaguaucaaauugucuucuuaauaugauaaacugugcuuuaucauucugaaaacucaggauac

SEQ ID NO: 292986 - RNA, 64 nt, Human
auuuuugccagucucauggguagauaguggugcagugcuuuaacauacauucaucugaucagca

SEQ ID NO: 292987 - RNA, 64 nt, Human
gaaagacuuauguauaauugcuuuuuaaaaugcagugcuuuacuuuaaacuaaggggaacuuug

SEQ ID NO: 292988 - RNA, 64 nt, Human
uucaugggucuugcuaauggaaaguagcauauaugugcuuuaaaaauauuaauccuuuugaaaa

SEQ ID NO: 292989 - RNA, 64 nt, Human
aucuuugggcaucagaaaacaggguccaggaauggugcuuuaugugagauaccccacuccacau

SEQ ID NO: 292990 - RNA, 64 nt, Human
aucugcagugaguauaaauucacuugucaccucagugcuuuacaguuugaaguggucacuuacc

SEQ ID NO: 292991 - RNA, 64 nt, Human; identical to SEQ ID NO: 198212

SEQ ID NO: 292992 - RNA, 64 nt, Human; identical to SEQ ID NO: 198213

SEQ ID NO: 292993 - RNA, 64 nt, Human; identical to SEQ ID NO: 198214

SEQ ID NO: 292994 - RNA, 64 nt, Human
auaacucuucaaccuuaacuauggcaauacauuugugcuuuaacuguuacauagcaguaucacc

SEQ ID NO: 292995 - RNA, 64 nt, Human
cuccugaccuacaaaguugugacuuaauaaaugugugcuuuaagcugcuccauuugugcugacu

SEQ ID NO: 292996 - RNA, 64 nt, Human
auaguggauugugcugcuguuagccuuaguuucagugcuuuacaagucucgcuuauuaucucac

SEQ ID NO: 292997 - RNA, 64 nt, Human
caucuuuuauuaaguucaguuauuagucugugaagugcuuuacuuuuugcacaauuuuaauagc

SEQ ID NO: 292998 - RNA, 64 nt, Human
agcccugaguucaccaguguucagcauggcagucgugcuuuagccaccaaagacaugaggaaau

SEQ ID NO: 292999 - RNA, 64 nt, Human
uguuaaugauugaaacuguaauugccuucggguugugcuuuagucuguaaaauucuaaaggaga

SEQ ID NO: 293000 - RNA, 64 nt, Human
uaguagaaauugauuugcauaguccaauggaugugugcuuuaacaccacuauguugcacaaaaa

SEQ ID NO: 293001 - RNA, 64 nt, Human
auaggaaaaaaguucagacaucgcuacaauaaaugugcuuuauuugauccaccaaauucucucu

SEQ ID NO: 293002 - RNA, 64 nt, Human
aguugcuguugagcuuaaucuuuuuaauccaaaggugcuuuacuuuuccuagacuggauagaaa

SEQ ID NO: 293003 - RNA, 64 nt, Human
agcuggcauuuagagagcuacagucuucauuuuagugcuuuacacauucgggccugaaaacaaa

SEQ ID NO: 293004 - RNA, 64 nt, Human
cucuacuucagaugaugaacacuguguacugugugugcuuuaaagaaguuuuauuuaauugcuc

SEQ ID NO: 293005 - RNA, 64 nt, Human
agcauaaucagcugauuaagaauggaaaaguuaggugcuuuagaccaaauaaggcacuggggca

SEQ ID NO: 293006 - RNA, 64 nt, Human
uuuccagucuccaccaggaaccucuucagaaagugugcuuuaugcugaaacagaauacuguuaa

SEQ ID NO: 293007 - RNA, 64 nt, Human
uucggauuuaaauuucuggucucuccggcuuucugugcuuuaacuaucuuugcuaaagucucuu

SEQ ID NO: 293008 - RNA, 64 nt, Human; identical to SEQ ID NO: 198251

SEQ ID NO: 293009 - RNA, 64 nt, Human; identical to SEQ ID NO: 198252

SEQ ID NO: 293010 - RNA, 64 nt, Human; identical to SEQ ID NO: 198041

SEQ ID NO: 293011 - RNA, 64 nt, Human
aaaaaaaaagaaacuucaguuaacagccuccuuggugcuuuaagcauucagcuuccuucaggcu

SEQ ID NO: 293012 - RNA, 64 nt, Human
cugagcggccagcuuggccuuugccuuaauaaaugugcuuuauuuucucuucagugaacuuuau

SEQ ID NO: 293013 - RNA, 64 nt, Human
gccaguauaguuucugugcccugcagcagcccaagugcuuuaaagccguuucaagcuguauagu

SEQ ID NO: 293014 - RNA, 64 nt, Human
aacugguuuuacccuguugauaaucagaaggagugugcuuuaggauuuauugcauaauacuauu

SEQ ID NO: 293015 - RNA, 58 nt, Human
ugauacauaaucuacaauaagggucuuagugcuuuagaaaaaaguuaaaauuggaagu

SEQ ID NO: 293016 - RNA, 50 nt, Human
uacauuacacccaacaguaagugcuuuauggucaguauucuauguggaga

SEQ ID NO: 293017 - RNA, 64 nt, Human
guauguacaaagauuaaaaaucaaccucuuuuuugugcuuuaaaaugacuuugggauuaaaaaa

SEQ ID NO: 293018 - RNA, 64 nt, Human
gagggggauggggacauugggaaccugucaagaagugcuuuauccagagaagcaaauuuugcac

SEQ ID NO: 293019 - RNA, 64 nt, Human
uuaauuuuuucugguguacaaugcuaauaaaauggugcuuuaaaagauguguucuucaguuguu

SEQ ID NO: 293020 - RNA, 64 nt, Human
gggcugggugucccuggcccacucccgguccccugugcuuuaccuccuugcccuugugucucag

SEQ ID NO: 293021 - RNA, 64 nt, Human
gagugcgauaggacauauggaaaaccaacacaaagugcuuuagcauuaaaacucaccaucaaau

SEQ ID NO: 293022 - RNA, 64 nt, Human
guacacuccuccuuuucuguugugugaucaguuugugcuuuauucuguauuugucucccauguc

SEQ ID NO: 293023 - RNA, 64 nt, Human
acaggcaucuggaagugcucucucgccacucugggugcuuuacugucucuggcuuguuuccauc

SEQ ID NO: 293024 - RNA, 64 nt, Human
acacagcugagagccaagcccaguucucuggguugugcuuuacuccacgcaucaauaaauaauu

SEQ ID NO: 293025 - RNA, 64 nt, Human; identical to SEQ ID NO: 198271

SEQ ID NO: 293026 - RNA, 64 nt, Human; identical to SEQ ID NO: 198022

SEQ ID NO: 293027 - RNA, 64 nt, Human; identical to SEQ ID NO: 196354

SEQ ID NO: 293028 - RNA, 64 nt, Human
uuaccaccuuccucccgauuuguucaccuauuuugugcuuuaaaucucaauaaaauacuuacug

SEQ ID NO: 293029 - RNA, 64 nt, Human
auuuuccuugacguccaagaguuugagagcgaaagugcuuuaggcccaggcgggggucguggcc

SEQ ID NO: 293030 - RNA, 61 nt, Human
aaagaauaagccagauguaaucagggccugagugcuuuaccuuuaaaaucauucccuuucc

SEQ ID NO: 293031 - RNA, 64 nt, Human
gcgauuauacaaggauuuacacaugcuuccucuggugcuuuacuucccaaaccuaaaaaagcaa

SEQ ID NO: 293032 - RNA, 64 nt, Human
aauaaguuaaaauuaauucuuuauccagagucgggugcuuuagaauuuauaagucacuuaugug

SEQ ID NO: 293033 - RNA, 64 nt, Human
uuuaugagucucaaguuuuauuauugcaauaaaagugcuuuaugccggcuuuucucagcucugu

SEQ ID NO: 293034 - RNA, 64 nt, Human
gaccaggaaugguuaaaucaucuuuacaaaaugugugcuuuaacuguuuacaaguaaaaccuaa

SEQ ID NO: 293035 - RNA, 64 nt, Human
caggucucggguccgauuaauuuaugguuucugcgugcuuuauuuauggcuuauaaauguguau

SEQ ID NO: 293036 - RNA, 64 nt, Human
ugugcaucugauggaaaccacugggcucaaacacgugcuuuauucuccuguuuauuuuugcugu

SEQ ID NO: 293037 - RNA, 64 nt, Human
guucuagccacucgagcucaugcaugugaaacgugugcuuuacgaagguggcagcugacagacg

SEQ ID NO: 293038 - RNA, 64 nt, Human
gguguuggggcaugauguguggaggaacuggaaggugcuuuaggucugguucagggucgggcau

SEQ ID NO: 293039 - RNA, 64 nt, Human
uuuauucuaaauuuuaagugguucuuugguuccagugcuuuauguuguuguuguuuuuggaugg

SEQ ID NO: 293040 - RNA, 64 nt, Human
cugcauacuguguuauguuacaguccaguuuugugugcuuuacuacacaguuugguuacaggac

SEQ ID NO: 293041 - RNA, 64 nt, Human
cacugggcaaauccauauaauuagagaauuuuaagugcuuuagagcggugugauucuacugugc

SEQ ID NO: 293042 - RNA, 64 nt, Human; identical to SEQ ID NO: 196430

SEQ ID NO: 293043 - RNA, 64 nt, Human; identical to SEQ ID NO: 197533

SEQ ID NO: 293044 - RNA, 64 nt, Human; identical to SEQ ID NO: 197141

SEQ ID NO: 293045 - RNA, 64 nt, Human
cagggauagacggggagcucccccaggcuccucugugcuuuacuaagauggccucagucuccac

SEQ ID NO: 293046 - RNA, 64 nt, Human
gggcugaauuguuuugcagaggaagauggcaucugugcuuuaaauuucucauuacuggguuaga

SEQ ID NO: 293047 - RNA, 64 nt, Human
ucuuaggucucaagggcacuuuggcgcguaguaagugcuuuauguaagaaggcagggcaggggg

SEQ ID NO: 293048 - RNA, 64 nt, Human
ggucaauauuugguuuccuaaaugcuuuuacucugugcuuuaagaaaaugaaagauaaauaacc

SEQ ID NO: 293049 - RNA, 64 nt, Human
ucgauaaaggauauagcaacaucuuuugauaauugugcuuuacaacuugaaugcugauucaagg

SEQ ID NO: 293050 - RNA, 64 nt, Human
aaauuggcuguuuuguuaaaauauaucuuuuagugugcuuuaaaguagauaguauacuuuacau

SEQ ID NO: 293051 - RNA, 64 nt, Human
acauggaaauucaaaugccauucaaaggccacuggugcuuuauuuuucuaucugcugaguaaac

SEQ ID NO: 293052 - RNA, 64 nt, Human
aauuugaugccuugugaacaaguaauuuuauauugugcuuuaauuuuuuaaaaaguauucuuua

SEQ ID NO: 293053 - RNA, 62 nt, Human
aagcaaagcagcaagcaugaaccuuaagcacugugcuuuaagcauccugaaaaaugagucuc

SEQ ID NO: 293054 - RNA, 64 nt, Human
guguagugucccuggcaggcauuuaccaggccaugugcuuuaacguuacgguaauacuuuacuu

SEQ ID NO: 293055 - RNA, 64 nt, Human
uugauaugcauuucucagauuccaccaucuuuuugugcuuuauggaaugacagucccuacaaua

SEQ ID NO: 293056 - RNA, 64 nt, Human
ucagaagucauauacauguaagcuacaauuuugagugcuuuauaaacacuuaagauauauauau

SEQ ID NO: 293057 - RNA, 64 nt, Human
auaacaguuauaaagaaagauuguaaacuaaagugugcuuuauaaaaaaaaguuguuuauaaaa

SEQ ID NO: 293058 - RNA, 64 nt, Human
gcucuuuuguuucccaccccccugacauguaugugugcuuuaauaaagcuuucucacuugucaa

SEQ ID NO: 293059 - RNA, 64 nt, Human; identical to SEQ ID NO: 197965

SEQ ID NO: 293060 - RNA, 64 nt, Human; identical to SEQ ID NO: 197966

SEQ ID NO: 293061 - RNA, 64 nt, Human; identical to SEQ ID NO: 197967

SEQ ID NO: 293062 - RNA, 64 nt, Human
uccugcuuuuccuggcaggcauuugccggccuaugugcuuuaaccuuaagcugauacuuuccuu

SEQ ID NO: 293063 - RNA, 64 nt, Human
cuauuccaacugggcauuucaauccauuuuuuaggugcuuuagagauaauugcuugccagugcc

SEQ ID NO: 293064 - RNA, 64 nt, Human
agggaauaacuguaugcagguuugaaaaggaaaugugcuuuaggcaugagucauaagaugccau

SEQ ID NO: 293065 - RNA, 64 nt, Human
uaaaauggacauuuucaauacauaaaaauaaacagugcuuuauaaaaauaagucuuuugcuucu

SEQ ID NO: 293066 - RNA, 64 nt, Human
cugaaauguuagauuaauuugaucuaguucuaaagugcuuuagucauauaugaauuuaaaccua

SEQ ID NO: 293067 - RNA, 64 nt, Human
cuuuguaugucugacccaagugccaaaggcagacgugcuuuauagcuaaaugaacaaagcaaag

SEQ ID NO: 293068 - RNA, 64 nt, Human; identical to SEQ ID NO: 224482

SEQ ID NO: 293069 - RNA, 64 nt, Human; identical to SEQ ID NO: 224483

SEQ ID NO: 293070 - RNA, 64 nt, Human; identical to SEQ ID NO: 224484

SEQ ID NO: 293071 - RNA, 64 nt, Human; identical to SEQ ID NO: 224485

SEQ ID NO: 293072 - RNA, 64 nt, Human; identical to SEQ ID NO: 224486

SEQ ID NO: 293073 - RNA, 64 nt, Human; identical to SEQ ID NO: 224487

SEQ ID NO: 293074 - RNA, 64 nt, Human; identical to SEQ ID NO: 224488

SEQ ID NO: 293075 - RNA, 64 nt, Human; identical to SEQ ID NO: 224489

SEQ ID NO: 293076 - RNA, 64 nt, Human; identical to SEQ ID NO: 197985

SEQ ID NO: 293077 - RNA, 64 nt, Human; identical to SEQ ID NO: 197986

SEQ ID NO: 293078 - RNA, 64 nt, Human; identical to SEQ ID NO: 198117

SEQ ID NO: 293079 - RNA, 64 nt, Human; identical to SEQ ID NO: 224490

SEQ ID NO: 293080 - RNA, 64 nt, Human; identical to SEQ ID NO: 224491

SEQ ID NO: 293081 - RNA, 64 nt, Human; identical to SEQ ID NO: 224494

SEQ ID NO: 293082 - RNA, 64 nt, Human; identical to SEQ ID NO: 224495

SEQ ID NO: 293083 - RNA, 64 nt, Human; identical to SEQ ID NO: 224496

SEQ ID NO: 293084 - RNA, 64 nt, Human; identical to SEQ ID NO: 224497

SEQ ID NO: 293085 - RNA, 64 nt, Human; identical to SEQ ID NO: 224498

SEQ ID NO: 293086 - RNA, 64 nt, Human; identical to SEQ ID NO: 224499

SEQ ID NO: 293087 - RNA, 64 nt, Human; identical to SEQ ID NO: 224500

SEQ ID NO: 293088 - RNA, 64 nt, Human; identical to SEQ ID NO: 224501

SEQ ID NO: 293089 - RNA, 64 nt, Human; identical to SEQ ID NO: 224502

SEQ ID NO: 293090 - RNA, 64 nt, Human; identical to SEQ ID NO: 224503

SEQ ID NO: 293091 - RNA, 63 nt, Human; identical to SEQ ID NO: 224504

SEQ ID NO: 293092 - RNA, 64 nt, Human; identical to SEQ ID NO: 224505

SEQ ID NO: 293093 - RNA, 64 nt, Human; identical to SEQ ID NO: 198195

SEQ ID NO: 293094 - RNA, 64 nt, Human; identical to SEQ ID NO: 198155

SEQ ID NO: 293095 - RNA, 64 nt, Human; identical to SEQ ID NO: 198005

SEQ ID NO: 293096 - RNA, 64 nt, Human; identical to SEQ ID NO: 224506

SEQ ID NO: 293097 - RNA, 64 nt, Human; identical to SEQ ID NO: 224507

SEQ ID NO: 293098 - RNA, 64 nt, Human; identical to SEQ ID NO: 224511

SEQ ID NO: 293099 - RNA, 64 nt, Human; identical to SEQ ID NO: 224512

SEQ ID NO: 293100 - RNA, 64 nt, Human; identical to SEQ ID NO: 224513

SEQ ID NO: 293101 - RNA, 64 nt, Human; identical to SEQ ID NO: 224514

SEQ ID NO: 293102 - RNA, 64 nt, Human; identical to SEQ ID NO: 224515

SEQ ID NO: 293103 - RNA, 64 nt, Human; identical to SEQ ID NO: 224516

SEQ ID NO: 293104 - RNA, 64 nt, Human; identical to SEQ ID NO: 224517

SEQ ID NO: 293105 - RNA, 64 nt, Human; identical to SEQ ID NO: 224518

SEQ ID NO: 293106 - RNA, 64 nt, Human; identical to SEQ ID NO: 224519

SEQ ID NO: 293107 - RNA, 64 nt, Human; identical to SEQ ID NO: 224520

SEQ ID NO: 293108 - RNA, 64 nt, Human; identical to SEQ ID NO: 224521

SEQ ID NO: 293109 - RNA, 64 nt, Human; identical to SEQ ID NO: 224522

SEQ ID NO: 293110 - RNA, 64 nt, Human; identical to SEQ ID NO: 198060

SEQ ID NO: 293111 - RNA, 64 nt, Human; identical to SEQ ID NO: 196371

SEQ ID NO: 293112 - RNA, 64 nt, Human; identical to SEQ ID NO: 197311

SEQ ID NO: 293113 - RNA, 64 nt, Human; identical to SEQ ID NO: 224523

SEQ ID NO: 293114 - RNA, 64 nt, Human; identical to SEQ ID NO: 224524

SEQ ID NO: 293115 - RNA, 64 nt, Human; identical to SEQ ID NO: 224528

SEQ ID NO: 293116 - RNA, 64 nt, Human; identical to SEQ ID NO: 224529

SEQ ID NO: 293117 - RNA, 64 nt, Human; identical to SEQ ID NO: 224530

SEQ ID NO: 293118 - RNA, 64 nt, Human; identical to SEQ ID NO: 224531

SEQ ID NO: 293119 - RNA, 64 nt, Human; identical to SEQ ID NO: 224532

SEQ ID NO: 293120 - RNA, 64 nt, Human; identical to SEQ ID NO: 224533

SEQ ID NO: 293121 - RNA, 64 nt, Human; identical to SEQ ID NO: 224534

SEQ ID NO: 293122 - RNA, 64 nt, Human; identical to SEQ ID NO: 224535

SEQ ID NO: 293123 - RNA, 64 nt, Human; identical to SEQ ID NO: 224536

SEQ ID NO: 293124 - RNA, 64 nt, Human; identical to SEQ ID NO: 224537

SEQ ID NO: 293125 - RNA, 64 nt, Human; identical to SEQ ID NO: 224538

SEQ ID NO: 293126 - RNA, 64 nt, Human; identical to SEQ ID NO: 224539

SEQ ID NO: 293127 - RNA, 64 nt, Human; identical to SEQ ID NO: 198079

SEQ ID NO: 293128 - RNA, 64 nt, Human; identical to SEQ ID NO: 196352

SEQ ID NO: 293129 - RNA, 64 nt, Human; identical to SEQ ID NO: 198231

SEQ ID NO: 293130 - RNA, 64 nt, Human; identical to SEQ ID NO: 224540

SEQ ID NO: 293131 - RNA, 64 nt, Human; identical to SEQ ID NO: 224541

SEQ ID NO: 293132 - RNA, 64 nt, Human; identical to SEQ ID NO: 224545

SEQ ID NO: 293133 - RNA, 64 nt, Human; identical to SEQ ID NO: 224546

SEQ ID NO: 293134 - RNA, 64 nt, Human; identical to SEQ ID NO: 224547

SEQ ID NO: 293135 - RNA, 64 nt, Human; identical to SEQ ID NO: 224548

SEQ ID NO: 293136 - RNA, 64 nt, Human; identical to SEQ ID NO: 224549

SEQ ID NO: 293137 - RNA, 64 nt, Human; identical to SEQ ID NO: 224550

SEQ ID NO: 293138 - RNA, 64 nt, Human; identical to SEQ ID NO: 224551

SEQ ID NO: 293139 - RNA, 64 nt, Human; identical to SEQ ID NO: 224552

SEQ ID NO: 293140 - RNA, 64 nt, Human; identical to SEQ ID NO: 224553

SEQ ID NO: 293141 - RNA, 64 nt, Human; identical to SEQ ID NO: 224554

SEQ ID NO: 293142 - RNA, 64 nt, Human; identical to SEQ ID NO: 224555

SEQ ID NO: 293143 - RNA, 64 nt, Human; identical to SEQ ID NO: 224556

SEQ ID NO: 293144 - RNA, 64 nt, Human; identical to SEQ ID NO: 198042

SEQ ID NO: 293145 - RNA, 64 nt, Human; identical to SEQ ID NO: 198043

SEQ ID NO: 293146 - RNA, 64 nt, Human; identical to SEQ ID NO: 198024

SEQ ID NO: 293147 - RNA, 64 nt, Human; identical to SEQ ID NO: 224557

SEQ ID NO: 293148 - RNA, 64 nt, Human; identical to SEQ ID NO: 224558

SEQ ID NO: 293149 - RNA, 64 nt, Human; identical to SEQ ID NO: 224562

SEQ ID NO: 293150 - RNA, 64 nt, Human; identical to SEQ ID NO: 224563

SEQ ID NO: 293151 - RNA, 64 nt, Human; identical to SEQ ID NO: 224564

SEQ ID NO: 293152 - RNA, 64 nt, Human; identical to SEQ ID NO: 224565

SEQ ID NO: 293153 - RNA, 64 nt, Human; identical to SEQ ID NO: 224566

SEQ ID NO: 293154 - RNA, 64 nt, Human; identical to SEQ ID NO: 224567

SEQ ID NO: 293155 - RNA, 64 nt, Human; identical to SEQ ID NO: 224568

SEQ ID NO: 293156 - RNA, 64 nt, Human; identical to SEQ ID NO: 224569

SEQ ID NO: 293157 - RNA, 64 nt, Human; identical to SEQ ID NO: 224570

SEQ ID NO: 293158 - RNA, 64 nt, Human; identical to SEQ ID NO: 224571

SEQ ID NO: 293159 - RNA, 64 nt, Human; identical to SEQ ID NO: 224572

SEQ ID NO: 293160 - RNA, 64 nt, Human; identical to SEQ ID NO: 224573

SEQ ID NO: 293161 - RNA, 64 nt, Human; identical to SEQ ID NO: 196389

SEQ ID NO: 293162 - RNA, 64 nt, Human; identical to SEQ ID NO: 198080

SEQ ID NO: 293163 - RNA, 64 nt, Human; identical to SEQ ID NO: 198098

SEQ ID NO: 293164 - RNA, 64 nt, Human; identical to SEQ ID NO: 224574

SEQ ID NO: 293165 - RNA, 64 nt, Human; identical to SEQ ID NO: 224575

SEQ ID NO: 293166 - RNA, 64 nt, Human; identical to SEQ ID NO: 224580

SEQ ID NO: 293167 - RNA, 64 nt, Human; identical to SEQ ID NO: 224581

SEQ ID NO: 293168 - RNA, 64 nt, Human; identical to SEQ ID NO: 224582

SEQ ID NO: 293169 - RNA, 64 nt, Human; identical to SEQ ID NO: 224583

SEQ ID NO: 293170 - RNA, 64 nt, Human; identical to SEQ ID NO: 224584

SEQ ID NO: 293171 - RNA, 64 nt, Human; identical to SEQ ID NO: 224585

SEQ ID NO: 293172 - RNA, 64 nt, Human; identical to SEQ ID NO: 224586

SEQ ID NO: 293173 - RNA, 64 nt, Human; identical to SEQ ID NO: 224587

SEQ ID NO: 293174 - RNA, 64 nt, Human; identical to SEQ ID NO: 224588

SEQ ID NO: 293175 - RNA, 64 nt, Human; identical to SEQ ID NO: 224589

SEQ ID NO: 293176 - RNA, 64 nt, Human; identical to SEQ ID NO: 224590

SEQ ID NO: 293177 - RNA, 64 nt, Human; identical to SEQ ID NO: 224591

SEQ ID NO: 293178 - RNA, 64 nt, Human; identical to SEQ ID NO: 196353

SEQ ID NO: 293179 - RNA, 64 nt, Human; identical to SEQ ID NO: 198269

SEQ ID NO: 293180 - RNA, 64 nt, Human; identical to SEQ ID NO: 197627

SEQ ID NO: 293181 - RNA, 64 nt, Human; identical to SEQ ID NO: 224592

SEQ ID NO: 293182 - RNA, 64 nt, Human; identical to SEQ ID NO: 224593

SEQ ID NO: 293183 - RNA, 64 nt, Human; identical to SEQ ID NO: 224598

SEQ ID NO: 293184 - RNA, 64 nt, Human; identical to SEQ ID NO: 224599

SEQ ID NO: 293185 - RNA, 64 nt, Human; identical to SEQ ID NO: 224600

SEQ ID NO: 293186 - RNA, 64 nt, Human; identical to SEQ ID NO: 224601

SEQ ID NO: 293187 - RNA, 64 nt, Human; identical to SEQ ID NO: 224602

SEQ ID NO: 293188 - RNA, 64 nt, Human; identical to SEQ ID NO: 224603

SEQ ID NO: 293189 - RNA, 64 nt, Human; identical to SEQ ID NO: 224604

SEQ ID NO: 293190 - RNA, 64 nt, Human; identical to SEQ ID NO: 224605

SEQ ID NO: 293191 - RNA, 64 nt, Human; identical to SEQ ID NO: 224606

SEQ ID NO: 293192 - RNA, 64 nt, Human; identical to SEQ ID NO: 224607

SEQ ID NO: 293193 - RNA, 64 nt, Human; identical to SEQ ID NO: 224608

SEQ ID NO: 293194 - RNA, 64 nt, Human; identical to SEQ ID NO: 224609

SEQ ID NO: 293195 - RNA, 64 nt, Human; identical to SEQ ID NO: 196433

SEQ ID NO: 293196 - RNA, 64 nt, Human; identical to SEQ ID NO: 197946

SEQ ID NO: 293197 - RNA, 64 nt, Human; identical to SEQ ID NO: 197947

SEQ ID NO: 293198 - RNA, 64 nt, Human; identical to SEQ ID NO: 224610

SEQ ID NO: 293199 - RNA, 64 nt, Human; identical to SEQ ID NO: 224611

SEQ ID NO: 293200 - RNA, 64 nt, Human; identical to SEQ ID NO: 222795

SEQ ID NO: 293201 - RNA, 59 nt, Human; identical to SEQ ID NO: 222796

SEQ ID NO: 293202 - RNA, 64 nt, Human; identical to SEQ ID NO: 222797

SEQ ID NO: 293203 - RNA, 64 nt, Human; identical to SEQ ID NO: 222798

SEQ ID NO: 293204 - RNA, 64 nt, Human; identical to SEQ ID NO: 222799

SEQ ID NO: 293205 - RNA, 64 nt, Human; identical to SEQ ID NO: 222800

SEQ ID NO: 293206 - RNA, 64 nt, Human; identical to SEQ ID NO: 222801

SEQ ID NO: 293207 - RNA, 64 nt, Human; identical to SEQ ID NO: 222802

SEQ ID NO: 293208 - RNA, 64 nt, Human; identical to SEQ ID NO: 222803

SEQ ID NO: 293209 - RNA, 64 nt, Human; identical to SEQ ID NO: 222804

SEQ ID NO: 293210 - RNA, 64 nt, Human; identical to SEQ ID NO: 222805

SEQ ID NO: 293211 - RNA, 64 nt, Human; identical to SEQ ID NO: 198282

SEQ ID NO: 293212 - RNA, 64 nt, Human; identical to SEQ ID NO: 198283

SEQ ID NO: 293213 - RNA, 64 nt, Human; identical to SEQ ID NO: 198284

SEQ ID NO: 293214 - RNA, 64 nt, Human
ccugcucuugcacacuuuccuucugagccuccauggagaccagccugcaagccggcccagccug

SEQ ID NO: 293215 - RNA, 64 nt, Human
gcucagcuaagugcucccccuagcucccaucucaggagaccaaaucucacagaaaaauaggcac

SEQ ID NO: 293216 - RNA, 64 nt, Human
gggcugggugcagccagcuguccugcagcucuggggagaccagcacagaacugaggaacaucug

SEQ ID NO: 293217 - RNA, 64 nt, Human
ugaagaaaguagagccugacacugcucccacuuuggagaccacauucccugcacacggucuuug

SEQ ID NO: 293218 - RNA, 64 nt, Human
aagucauuguugucuacacaaaauaaauguauauggagaccaaagaccaauggaggcuugucua

SEQ ID NO: 293219 - RNA, 64 nt, Human
gaggaucugagauuuccguguuuggcugaaccugggagaccagcugggccuccaaguaggauaa

SEQ ID NO: 293220 - RNA, 64 nt, Human
gaaggucuuauuuauauaauuuuuuccaagccaaggagaccauuggccauccaggaaauuucgu

SEQ ID NO: 293221 - RNA, 64 nt, Human
uggaagacuuucuggcucuuaacuggggaguaguggagaccauaggagaggacucuccucccuc

SEQ ID NO: 293222 - RNA, 64 nt, Human
agguaggagcaucaccuggggcugggagggaguuggagaccagccuggaugacauaaugagauu

SEQ ID NO: 293223 - RNA, 64 nt, Human
aaaagccaaaaggagcuggccauccagggccuagggagaccagccuuccucagcuaugcuugcc

SEQ ID NO: 293224 - RNA, 58 nt, Human
accggcagcacgccuccuaggaacugugggagaccagcggagugggagggagacgcag

SEQ ID NO: 293225 - RNA, 64 nt, Human
aucucccccaacuagacuggagcccccgaaggauggagaccaugucugugccaucucuguuucc

SEQ ID NO: 293226 - RNA, 61 nt, Human
ucaacaccguccgcaucuaguccaggcagaaggagaccacaaccuccugggaccacugcca

SEQ ID NO: 293227 - RNA, 64 nt, Human
cccugacuugauuugacaacugggcccuguugguggagaccagugccugaacuggacccuguga

SEQ ID NO: 293228 - RNA, 64 nt, Human
uugugcuacaguagcagaguugagucauugcaagggagaccauauggcccagguagccuaaaau

SEQ ID NO: 293229 - RNA, 64 nt, Human; identical to SEQ ID NO: 229451

SEQ ID NO: 293230 - RNA, 64 nt, Human; identical to SEQ ID NO: 229452

SEQ ID NO: 293231 - RNA, 64 nt, Human; identical to SEQ ID NO: 229550

SEQ ID NO: 293232 - RNA, 64 nt, Human
accugcuacacucuugccugucccagagcccuugggagaccagcuguugcucccaccuuucccc

SEQ ID NO: 293233 - RNA, 64 nt, Human
aaagugaugacauuauuagcagacacugcuuaaaggagaccauuuguagcaguuggcuuaaccu

SEQ ID NO: 293234 - RNA, 64 nt, Human
aguuucagagacaacuuugaauccuugucagccuggagaccagcaccagaggaaucuacaaggc

SEQ ID NO: 293235 - RNA, 64 nt, Human
cccggcucacggggagcucagagguccaugccgaggagaccaggcaggaccucccgaggcugcg

SEQ ID NO: 293236 - RNA, 64 nt, Human
gcccgcuggagcuugucuucccuaacauagccugggagaccaccccuugccacuugggccacuu

SEQ ID NO: 293237 - RNA, 64 nt, Human
ggagggcgcccuugaggcaugcccucugagggagggagaccagagaugcagggauuggccagcu

SEQ ID NO: 293238 - RNA, 64 nt, Human
guguaccauugagaugagaauggguagauggaacggagaccaucaagccacacccccuucuuaa

SEQ ID NO: 293239 - RNA, 64 nt, Human
acugcaagaugcucucaacaggauuaugucucauggagaccaguaagaaaaucauuuaucugaa

SEQ ID NO: 293240 - RNA, 64 nt, Human
caggaggcugagguuuggaggcaaaaucaaccugggagaccaccccggccgcggcgccucagug

SEQ ID NO: 293241 - RNA, 64 nt, Human
ccccuuauccccaggcuggugccccgggagggcuggagaccaggccaugggcccucacggagag

SEQ ID NO: 293242 - RNA, 64 nt, Human
aggccgaggugggcggaucacgaggucaggagauggagaccauccuggcuaacacggugaaacc

SEQ ID NO: 293243 - RNA, 64 nt, Human
cucuuaccacgacguuucuguucuacacuuggguggagaccaguugaccauagagcauuugcag

SEQ ID NO: 293244 - RNA, 64 nt, Human
gccgaggugggcggaucacuugaggucaggaguuggagaccagccuggccaacguggugaaucc

SEQ ID NO: 293245 - RNA, 64 nt, Human
uggcauggaccucuguccggcagagguguggacuggagaccaggauucaugcuggucuggaaca

SEQ ID NO: 293246 - RNA, 64 nt, Human
accuauaccuagcauaguacaaucagaaccucguggagaccaccggggacaggcuugcggacgc

SEQ ID NO: 293247 - RNA, 64 nt, Human
cccagugauacaaaccuguccuggaauucuaccuggagaccagagcuggccugaaaauuacugg

SEQ ID NO: 293248 - RNA, 64 nt, Human; identical to SEQ ID NO: 229423

SEQ ID NO: 293249 - RNA, 64 nt, Human; identical to SEQ ID NO: 229443

SEQ ID NO: 293250 - RNA, 64 nt, Human; identical to SEQ ID NO: 229448

SEQ ID NO: 293251 - RNA, 64 nt, Human
gaaguagguguauuccccuggcagucugggcaacggagaccaagaaacauuuuuagguuguuuu

SEQ ID NO: 293252 - RNA, 64 nt, Human
aggcugaggcaggcggaucacgaggucaggagauggagaccauccuggcuaacauggugaaacc

SEQ ID NO: 293253 - RNA, 64 nt, Human
uucaagaugaagaacuacaugauacaguggaccuggagaccauccccuuggaaagacaacccag

SEQ ID NO: 293254 - RNA, 64 nt, Human
caacuuggauuuaugguaaccccuuauaguucauggagaccaaaauuugggguauuuauaauag

SEQ ID NO: 293255 - RNA, 64 nt, Human
ccgcuucccaucaccggaggagcuuccccggccgggagaccaguguuagaggauccaagcgacc

SEQ ID NO: 293256 - RNA, 64 nt, Human
uaggaagccgaagugugcagaucaccugagguccggagaccagccuggccaacauggugaaacc

SEQ ID NO: 293257 - RNA, 64 nt, Human
uucugcucuuggccucuccugaggccucauaaugggagaccaaaucaaaaaugucccaugucac

SEQ ID NO: 293258 - RNA, 64 nt, Human
ugagaacuugcucuacguggucaggaaagagcagggagaccaagcagagucgugggcaggggua

SEQ ID NO: 293259 - RNA, 64 nt, Human
ggaaauggugaagcauagcucugggucuccugggggagaccaggcuuggcugcgggagagcugg

SEQ ID NO: 293260 - RNA, 64 nt, Human
ggugagggcugagugcccuggcuuccucacuuggggagaccaugggucucuguagaaauuccaa

SEQ ID NO: 293261 - RNA, 64 nt, Human
agcuuugaggugacucagagcuaagaaugaaauaggagaccaaguuagaauucaugauacuggu

SEQ ID NO: 293262 - RNA, 64 nt, Human
aaggagggucaggaaggaugagcauuuagggcaaggagaccaccaacagcccucaggucagggu

SEQ ID NO: 293263 - RNA, 64 nt, Human
cacccaggaccaggucuguguggggaugugccuuggagaccaaggcaauaguccuuuccacuac

SEQ ID NO: 293264 - RNA, 64 nt, Human
caugugccuacaccuugugcccugaugccgagguggagaccauugggaaauaauuaauagauau

SEQ ID NO: 293265 - RNA, 64 nt, Human
aggcuggggcugaaagcagaagcaugcacagggaggagaccacuuuuauugcuugucugggugg

SEQ ID NO: 293266 - RNA, 64 nt, Human
guaggucacucuccagcaguuaggcaccuuaacuggagaccagaaaccuuccagagaacacagg

SEQ ID NO: 293267 - RNA, 64 nt, Human; identical to SEQ ID NO: 227167

SEQ ID NO: 293268 - RNA, 64 nt, Human; identical to SEQ ID NO: 227168

SEQ ID NO: 293269 - RNA, 64 nt, Human; identical to SEQ ID NO: 229454

SEQ ID NO: 293270 - RNA, 64 nt, Human
cuuccugcgccccgggacucaauuaaacccgcccggagaccacgccgggcccagcgcgucugcc

SEQ ID NO: 293271 - RNA, 64 nt, Human
ucucuaaaugugauuuauuucuugcuuugagauuggagaccacuuugcauuggccagggugucu

SEQ ID NO: 293272 - RNA, 64 nt, Human
gugagcccccagcgaggggaggcccagccuccgaggagaccaggaacccugcuucagcagcccc

SEQ ID NO: 293273 - RNA, 64 nt, Human
uagggacaagcagugaggugguggccaugacacuggagaccaagccucagcggagggaucagcg

SEQ ID NO: 293274 - RNA, 64 nt, Human
cacaagggcagagcagcauucugagagacgcacaggagaccaagccagaccaauaaacagaaca

SEQ ID NO: 293275 - RNA, 64 nt, Human
caaagggaugcucugccaaagguuuaaacacccaggagaccaucagccucuccugggagcacag

SEQ ID NO: 293276 - RNA, 64 nt, Human
caugaucagauguggucagacucuuucugggccuggagaccacggucacuuguugacugucucu

SEQ ID NO: 293277 - RNA, 64 nt, Human
uguauaauuuucacuucugcauuauguacauaaaggagaccacuaccacugggguagaaauucc

SEQ ID NO: 293278 - RNA, 64 nt, Human
gaguagugcucucguugaugaagcacauguaugaggagaccagcagcaaaacauaaccauaugu

SEQ ID NO: 293279 - RNA, 64 nt, Human
ggugaugcaggaggaucacuugaggccaggaguuggagaccagccuggccaacauggugaaacc

SEQ ID NO: 293280 - RNA, 64 nt, Human
uagaacauauauuaaucuacuggcgaaugggaaaggagaccauuuucuuagaaagcaaauaaac

SEQ ID NO: 293281 - RNA, 64 nt, Human
agauauucauuggcagcucaaagacuuccacccuggagaccacacugcacacagugacuuccug

SEQ ID NO: 293282 - RNA, 64 nt, Human
cgcuccagggguggcuggagacgggugggcggcuggagaccaugcagagcgccgugaguucuca

SEQ ID NO: 293283 - RNA, 64 nt, Human
gcggggaccagggcccaaggccccagggcuggaaggagaccaaggggcagccgcccuggaggga

SEQ ID NO: 293284 - RNA, 64 nt, Human
cagcugaaucuccagggaggcugcagagcaucguggagaccacuuucugccucggccuuuaaau

SEQ ID NO: 293285 - RNA, 64 nt, Human
uauugcucuccuucugagucaggacauguguacaggagaccaagaacaaugaguauuagaaaaa

SEQ ID NO: 293286 - RNA, 64 nt, Human; identical to SEQ ID NO: 229458

SEQ ID NO: 293287 - RNA, 64 nt, Human; identical to SEQ ID NO: 229462

SEQ ID NO: 293288 - RNA, 64 nt, Human; identical to SEQ ID NO: 229463

SEQ ID NO: 293289 - RNA, 64 nt, Human
aaagaugauacaaccaugauuugcaacuguaacaggagaccauuuauuauaagcguaccuguuu

SEQ ID NO: 293290 - RNA, 64 nt, Human
agacucacugugagucuccccggccauuucacgaggagaccacagugcugccaccagugccuaa

SEQ ID NO: 293291 - RNA, 64 nt, Human
aggccgagaugggcagaucuugaggucgguagauggagaccauccuggccaacauggugaaacc

SEQ ID NO: 293292 - RNA, 64 nt, Human
agucaccccugaacgccuccgcaggcagauucauggagaccagucccaguagcaaccgccccuu

SEQ ID NO: 293293 - RNA, 64 nt, Human
cugggggugggguuuucccugagcggcaacuccuggagaccacauagccugaauccucagaauu

SEQ ID NO: 293294 - RNA, 64 nt, Human
gguuuuaaaugugucauuaaacuaauauuuagugggagaccauaaugugucagccaccuugaua

SEQ ID NO: 293295 - RNA, 64 nt, Human
auauacacauuuagacugaguugcacacuggcagggagaccaaaaacauuacuuccauacuugu

SEQ ID NO: 293296 - RNA, 64 nt, Human
gccucgaaauuguugaagauucaacaagcugaguggagaccauggucuguagaccccuucccga

SEQ ID NO: 293297 - RNA, 64 nt, Human
uauguuuguauccguguccaaacucuuuuucuagggagaccagcacuggauuagaguucaccau

SEQ ID NO: 293298 - RNA, 64 nt, Human
gaaggcagcuacuuuauaagccccaaugggccauggagaccacugucagaaaugggauauuagu

SEQ ID NO: 293299 - RNA, 64 nt, Human
ggagguuacuggggaaacagcucagcagauuuuuggagaccaaaccaaaggucucacuaggaaa

SEQ ID NO: 293300 - RNA, 64 nt, Human
cgugguggcucaugccuguaaucugagcacuuugggagaccaaggcggguagaucccuugugcc

SEQ ID NO: 293301 - RNA, 64 nt, Human
cacaguuugaaaaauauugcuacaagacacuuaaggagaccauccuguuuaaguuuauucuuau

SEQ ID NO: 293302 - RNA, 64 nt, Human
aggcugagaagggcggaucacgaggucaggagauggagaccauccuggcuaacacggugagacc

SEQ ID NO: 293303 - RNA, 64 nt, Human
cacgguggcucacgccuguaaucccaacacuuuaggagaccaaggcgggcagaucacuugaggu

SEQ ID NO: 293304 - RNA, 64 nt, Human
uugacaagguagagaucugauauuuugagauuuuggagaccauuuccugugccagaaucacugc

SEQ ID NO: 293305 - RNA, 64 nt, Human; identical to SEQ ID NO: 229467

SEQ ID NO: 293306 - RNA, 64 nt, Human; identical to SEQ ID NO: 229468

SEQ ID NO: 293307 - RNA, 64 nt, Human; identical to SEQ ID NO: 229469

SEQ ID NO: 293308 - RNA, 64 nt, Human
cugcagccaccagguaugaaaaggagccugguggggagaccacugcacccaaaacaaauccuuu

SEQ ID NO: 293309 - RNA, 64 nt, Human
cugguuugcauuuaccucauauaaagaaugggaaggagaccauuggguaacccucaagugucag

SEQ ID NO: 293310 - RNA, 64 nt, Human
cugcccugauagggcuuaccugugggugggggagggagaccacacaugucagagguagugaagg

SEQ ID NO: 293311 - RNA, 64 nt, Human
ccauauaguucugauuggauuucguuccuccugaggagaccaugccguugagcuuggcuaccca

SEQ ID NO: 293312 - RNA, 64 nt, Human
uuuuuggagaaaugaauguuugucuggagcagagggagaccauacuagggcgacuccuguguga

SEQ ID NO: 293313 - RNA, 64 nt, Human
cgccccuccgccccgcccgccccacuaucuuuaaggagaccagagaccgccuacuggagagaaa

SEQ ID NO: 293314 - RNA, 64 nt, Human
ccccagggcuuuugcugacucugggaaagagucuggagaccacauuugguucucgaaccaucua

SEQ ID NO: 293315 - RNA, 64 nt, Human
aaaaauguuaaacccuuaccaacagcuuuucccaggagaccauuuguauuaccauuacuuguau

SEQ ID NO: 293316 - RNA, 64 nt, Human
ugaggaauuaccagugaaaaauuccaucugugauggagaccaacaaaaauaauaaaacacaaag

SEQ ID NO: 293317 - RNA, 64 nt, Human
cccucucuccccaguauuaucuuacuugcaaaauggagaccaaauucuauccugugaggcuuuu

SEQ ID NO: 293318 - RNA, 64 nt, Human
gacaggggaaagggcucucuuacaccgcacucagggagaccacuucucaggauggggucagaug

SEQ ID NO: 293319 - RNA, 64 nt, Human
ucuguguucguguaggcauaaugugaggagguggggagaccaccccacccccauguccaccaug

SEQ ID NO: 293320 - RNA, 64 nt, Human
ggccuacagcuuugaucccugacaucuggaaucuggagaccagggagccuuugguucuggccag

SEQ ID NO: 293321 - RNA, 64 nt, Human
aaaaaaaaaaggccugaaccccaaggaagacuguggagaccaucuugucuuccuccccuuccuc

SEQ ID NO: 293322 - RNA, 64 nt, Human
gucagaacugggcaccaggacuggagcccccuccggagaccaaacucaccaucccucaguccuc

SEQ ID NO: 293323 - RNA, 64 nt, Human
gcccuuuagggcuguugcuagggagagggaagagggagaccaaaugucgggguuggggugggag

SEQ ID NO: 293324 - RNA, 64 nt, Human; identical to SEQ ID NO: 229455

SEQ ID NO: 293325 - RNA, 64 nt, Human; identical to SEQ ID NO: 229456

SEQ ID NO: 293326 - RNA, 64 nt, Human; identical to SEQ ID NO: 229473

SEQ ID NO: 293327 - RNA, 64 nt, Human
cugagauaacgaauucuugaguuuguuuucuaaaggagaccagaaauccacuauuacaaaugua

SEQ ID NO: 293328 - RNA, 64 nt, Human
uuuuuuuuuuuuuuuugaucagcaaagaaauacaggagaccagucucgaguggugcuguacuug

SEQ ID NO: 293329 - RNA, 64 nt, Human
uucugaguaaugcuugcuugcuaaugaauguauaggagaccacauuguaauuguucuuagauga

SEQ ID NO: 293330 - RNA, 64 nt, Human
ugcaccaggguucaguagaguccacuucugcccuggagaccacaaaucaacuagcuccauuuac

SEQ ID NO: 293331 - RNA, 64 nt, Human
cugccagcgcccuccucugcuguugcagcugcaaggagaccaugccugugggagccaggccucg

SEQ ID NO: 293332 - RNA, 64 nt, Human
gcauuugcccucauccugagaaggccagaauacuggagaccagcgugaacccucacccagaguc

SEQ ID NO: 293333 - RNA, 64 nt, Human
agucugauaucuugggcagcuugcugcuuacuggggagaccagcaugcuuagacacuuauugcc

SEQ ID NO: 293334 - RNA, 64 nt, Human
uccucucuaccuuugaaaacucuccugggguggaggagaccagggcaggauagacagaccucug

SEQ ID NO: 293335 - RNA, 64 nt, Human
uccccaaauaccugcgcugcuaccgaugccucuuggagaccaaggaguuagggugccuucuggg

SEQ ID NO: 293336 - RNA, 64 nt, Human
agcuggguggugggugagggugugagacaggcagggagaccagguaaugaguggcugcaaggag

SEQ ID NO: 293337 - RNA, 64 nt, Human
auggggaagggccagccacugacuacuugaucuuggagaccacauuuagauggaaaugagagga

SEQ ID NO: 293338 - RNA, 64 nt, Human
uugggggagcaugaugggcaggugagggcaggauggagaccaagggagucagugagcagaggcc

SEQ ID NO: 293339 - RNA, 64 nt, Human
guugauggguggcccaugagugacccccgccaggggagaccaggcuggcuggauccagcacauc

SEQ ID NO: 293340 - RNA, 64 nt, Human
cacacgauucuguccagagugagcacuggaugguggagaccauaggucaccccagauuccuuga

SEQ ID NO: 293341 - RNA, 64 nt, Human
guauggaggcugcucaccccacagacacugguggggagaccauggcucagaggaaggguggagc

SEQ ID NO: 293342 - RNA, 64 nt, Human
agaggagcaacaaucagacaugaguccacccuuuggagaccaggccucagcucuuggugggccc

SEQ ID NO: 293343 - RNA, 64 nt, Human
guuuuuuccaccccacaguuccuccugggaucuggcccuccagggaaguggagccuccagcccc

SEQ ID NO: 293344 - RNA, 64 nt, Human
cuuucccgucacccuugcuauccccuggagcacugcccuccagagcugcccuucccaggaagga

SEQ ID NO: 293345 - RNA, 64 nt, Human
cacuuuaaaaagauuaagcaagugaaauucugcugcccuccaccauuuauuuuuacagugcuuu

SEQ ID NO: 293346 - RNA, 64 nt, Human
aagaagaggcgaguagggcacaacaggcacaaagggagaccauaaggagacacagaggaaggac

SEQ ID NO: 293347 - RNA, 64 nt, Human
accugccuucauguggacccuuagaacagcacugggagaccagcaggacuccugagaacugugc

SEQ ID NO: 293348 - RNA, 64 nt, Human
cccaggaaggaauuugguuggauucugucacuguggagaccaagauuuuuuaaaauucccaauu

SEQ ID NO: 293349 - RNA, 64 nt, Human
aaaaaaaaaaaccacaccuaaaauagaccacugaggagaccauagagcggaugcuuucaugcac

SEQ ID NO: 293350 - RNA, 64 nt, Human
ugugggcaggaguggagagcuggugcccucaggaggagaccacagcauguccaucagcucagca

SEQ ID NO: 293351 - RNA, 64 nt, Human
gcuaaggcgggaggaugacuugaggccaggaguuggagaccagccuggccaacauggugaaacc

SEQ ID NO: 293352 - RNA, 64 nt, Human
aaaaccacacucacaccccaccccgaagagcuguggagaccaaaccaagacuacgcuacacaca

SEQ ID NO: 293353 - RNA, 64 nt, Human
cauucagaauaggaucugaagagaucaaagcaauggagaccaccaaacugucuugaaggcaugu

SEQ ID NO: 293354 - RNA, 64 nt, Human
gauguauguuuauauuuuaagucagcugucaaggggagaccacagccuuaguaugacauccugc

SEQ ID NO: 293355 - RNA, 64 nt, Human
uggagacaugggcaagcauuaguggcuucagauuggagaccagccugggacuucccugcaguga

SEQ ID NO: 293356 - RNA, 64 nt, Human
ucgccucagcguuucugguucaauagguuuugggggagaccaagaacguuaacauuucuagcaa

SEQ ID NO: 293357 - RNA, 64 nt, Human
cccacuccccaaauacagaggucugcuuugaagcggagaccauuuccaggccuuauugagacca

SEQ ID NO: 293358 - RNA, 64 nt, Human
uaaauagggaaaaaacauguaaaaaauguaaaauggagaccaauugcacuaggcaaguguauau

SEQ ID NO: 293359 - RNA, 64 nt, Human
gcugaggcgggcagaucaccugaggucaggaguuggagaccagccugaccaacauggacaaacc

SEQ ID NO: 293360 - RNA, 64 nt, Human
gaguguaauccuaggaagcaucaggugaaaagcaggagaccaaagaaguggucaggaacaauca

SEQ ID NO: 293361 - RNA, 64 nt, Human
ucacugaagacuuccagggccuacgggcagagguggagaccaucuccaaggaacuggagcuuuu

SEQ ID NO: 293362 - RNA, 64 nt, Human; identical to SEQ ID NO: 229476

SEQ ID NO: 293363 - RNA, 64 nt, Human; identical to SEQ ID NO: 229477

SEQ ID NO: 293364 - RNA, 64 nt, Human; identical to SEQ ID NO: 229481

SEQ ID NO: 293365 - RNA, 64 nt, Human
ccucucuucaucuggaagaagaggcaagggggcaggagaccaggcucuagcucugggcccuccu

SEQ ID NO: 293366 - RNA, 64 nt, Human
acuggauuggccaaacaucagaccugucuuccaaggagaccaaguccuggcuacaucccagccu

SEQ ID NO: 293367 - RNA, 64 nt, Human
gaaaaaaagaagccccuucacucuacaggggacaggagaccauggauuggaccccaaagggauu

SEQ ID NO: 293368 - RNA, 64 nt, Human
uugggaggccaaggcaggcaaucaccugagggcaggagaccagccugacuaacauggagaaacc

SEQ ID NO: 293369 - RNA, 64 nt, Human
uccuuaaaugccuucuguaguuucagaucaguagggagaccauauaauaauuuuaugguaccug

SEQ ID NO: 293370 - RNA, 64 nt, Human
gaaaaguauuuuugucugacaguggaauauaucuggagaccacaaguaccacuccuauucuguu

SEQ ID NO: 293371 - RNA, 64 nt, Human
ugagucuaauuuccucucuguuuuuaacuauucuggagaccaagaaaccacuaggaauugaagg

SEQ ID NO: 293372 - RNA, 64 nt, Human
uuuagauuuugauauugauuuagaagacacaggaggagaccaucaaaugaauuaauaucacugu

SEQ ID NO: 293373 - RNA, 64 nt, Human
acuguuaauggaaagcagucacagcugaguuuucggagaccaagaaauuaaaauacaauugcac

SEQ ID NO: 293374 - RNA, 64 nt, Human
cuuccuucaacccaggaagcgucuuuggugcuugggagaccaagaaaccaagaaauuaacaacu

SEQ ID NO: 293375 - RNA, 64 nt, Human
cccgcaguccugaggagccagcggccaccugcggggagaccaccgccgcccagacuacugacgg

SEQ ID NO: 293376 - RNA, 64 nt, Human
auggcugucaaucccgaggcagaaguuuucagguggagaccaagcggccuuugcucuucuuccu

SEQ ID NO: 293377 - RNA, 64 nt, Human
guggacgcuguccauugccacggccaugagggcuggagaccagaacagcauggcccgaagcgug

SEQ ID NO: 293378 - RNA, 64 nt, Human
ccucuugucuccccagggcccaccggaacgacauggagaccaucuaccccuuccuuuuccuggg

SEQ ID NO: 293379 - RNA, 64 nt, Human
gaagccuguuucagaaaucuggagcuggcacuguggagaccacacacccuuugggaaagcucuu

SEQ ID NO: 293380 - RNA, 64 nt, Human
ucuggaggggcugaggacagaugugccugcuuguggagaccaggcugggccuaagcgaaggguc

SEQ ID NO: 293381 - RNA, 64 nt, Human
uuugcugcuugugugcgugugcauuugugaacacguacagcauaucuauacaaaauucugcuau

SEQ ID NO: 293382 - RNA, 64 nt, Human
ugagacacaguggauuuuuauugaaaggaaccacguacagcaaugcggagugggauagggauaa

SEQ ID NO: 293383 - RNA, 64 nt, Human; identical to SEQ ID NO: 229474

SEQ ID NO: 293384 - RNA, 64 nt, Human
ugaggucccuguguguaggcuggggcggggcccaggagaccacggggagcaaaccagcuuguuc

SEQ ID NO: 293385 - RNA, 64 nt, Human
gccaaggugggaggauugcuugagcccaagaguuggagaccagccugggcaacauggugagacc

SEQ ID NO: 293386 - RNA, 64 nt, Human
ugcucccugcuuucauuuauguuugcugaccuguggagaccagucuuucugacacacagugaag

SEQ ID NO: 293387 - RNA, 64 nt, Human
aaaagcccacuuaagaguauacauugcuauuaugggagaccacccagacaucugacuaauggcu

SEQ ID NO: 293388 - RNA, 64 nt, Human
ccgccgcggccccgaucggggcgggggaauccccggagaccagccuccuuaaucccuucccccg

SEQ ID NO: 293389 - RNA, 64 nt, Human
ggggaggacgauggccccgacccuggcagcgagaggagaccaggaggcuaggacccuggccgcg

SEQ ID NO: 293390 - RNA, 64 nt, Human
ugucuucuagcugcuuccucaaccccuguccccuggagaccagaagcugaggcccucucaggga

SEQ ID NO: 293391 - RNA, 64 nt, Human
uugggaggcgaggcggggguggaucacaaggucaggagaccagccuggccaacauggcgaagcc

SEQ ID NO: 293392 - RNA, 64 nt, Human
gcuuuccuucacuuaguuauuugagugugggagaggagaccaggucacccgauucccgccaagc

SEQ ID NO: 293393 - RNA, 64 nt, Human
caccuaugaccacauugggcccaacgucugcaugggagaccacaaggugacauagacugagguc

SEQ ID NO: 293394 - RNA, 64 nt, Human
ccacaggaacggugcuggaccaccuggucggggaggagaccauggcugacuaccugcuguacac

SEQ ID NO: 293395 - RNA, 64 nt, Human
gcuaccacccuauaaccucccuaccagguaauaaggagaccaagucuuugaucaaauucugauu

SEQ ID NO: 293396 - RNA, 64 nt, Human
cacgguggcucaggccuauaaccccagcucccuaggagaccaaggcgggagcaucucuugaggc

SEQ ID NO: 293397 - RNA, 64 nt, Human
aggccgagaaggguggaucaugaggucaggagauggagaccauccuggccaacauggugaaacc

SEQ ID NO: 293398 - RNA, 64 nt, Human
aacaaauaccaagguauuccuucugcugcagccuggagaccaccgagagucgagcuggggcaca

SEQ ID NO: 293399 - RNA, 64 nt, Human
aaucagagaaguugaagaugaauguugacucccaggagaccagaacuauuuuuuuaaagccuga

SEQ ID NO: 293400 - RNA, 64 nt, Human
uguggugugagugauauauuucuauguuuuuaauguacagcaucuguacuuuguuugccuugau

SEQ ID NO: 293401 - RNA, 64 nt, Human
uguuucuuaaaggcauuuugguuuuuuaaaaucuguacagcaagagcaacuuuuucugucaaau

SEQ ID NO: 293402 - RNA, 64 nt, Human
cuacaugaacuacuauugauaccagcauacaaguguacagcacuuuacacacaagagguuuauu

SEQ ID NO: 293403 - RNA, 64 nt, Human
aguuucgaguauaagaaucauugucaugaaguuaggagaccacaaagccauuucucagagucau

SEQ ID NO: 293404 - RNA, 64 nt, Human
cauauggcuugagaagcggagauauuggagauugggagaccagggcccgggguuugggagggcu

SEQ ID NO: 293405 - RNA, 64 nt, Human
uggauuuuuuuccccaaggcacaaaauguauaauggagaccaaauagugaucugauccauagua

SEQ ID NO: 293406 - RNA, 64 nt, Human
aggacagcacugggaaccuagcuacacugagcagggagaccaugccucccagagcuuguugucu

SEQ ID NO: 293407 - RNA, 64 nt, Human
gagacaucuuggccugucccugccugggggucauggagaccaugucuucuuagagcaaaugugg

SEQ ID NO: 293408 - RNA, 64 nt, Human
ccacgccgccucagccugccaccucccaccuagaggagaccaugggcccugccccacccacucc

SEQ ID NO: 293409 - RNA, 64 nt, Human
ggggcaagggucaaacugacucacucuaccaggaggagaccagguugcaguggcguaaggcccc

SEQ ID NO: 293410 - RNA, 64 nt, Human
guccuaccuccacucucugccccuaaagaugggaggagaccagcgguccaugggucuggccugu

SEQ ID NO: 293411 - RNA, 64 nt, Human
ucuauguacaugcugggggagagugccuaaugugggagaccaaauagggaucaccaggcuaaug

SEQ ID NO: 293412 - RNA, 64 nt, Human
cagaugagcagucacacuguuacuccacagcggaggagaccagcucagaggcccaggaaucgga

SEQ ID NO: 293413 - RNA, 64 nt, Human
aguguggaagcuuuaggggaacauggagaaagaaggagaccacauaccccaaagugaccuaaga

SEQ ID NO: 293414 - RNA, 64 nt, Human
gacuccaggacccuugaguguaaugcaaaaauuuggagaccagcuaugccugcccucugugggu

SEQ ID NO: 293415 - RNA, 64 nt, Human
gcugagguaggcagaucacuugaggucaggaguuggagaccagccuggccaacauagugaaacc

SEQ ID NO: 293416 - RNA, 64 nt, Human
acaagcugggcaaaucacugucccuuggacuccaggagaccaguguccuagucuugccuuuuuu

SEQ ID NO: 293417 - RNA, 64 nt, Human
aaagcagcuauugguaaauuucugagauauagcaggagaccaaaacauguuuggaaagagaaua

SEQ ID NO: 293418 - RNA, 64 nt, Human
cacguggauuuugucaaggagaaucauaaaagcaggagaccaguagcagaaauguagacaggau

SEQ ID NO: 293419 - RNA, 64 nt, Human
gggaagccaccaugcaauccagugaggcuucaguguacagcaaccaaaaugguagggaggucuu

SEQ ID NO: 293420 - RNA, 64 nt, Human
agacuagugcauaaaaaugcaauaggugucauauguacagcauucuucuuagaguugccuuuuc

SEQ ID NO: 293421 - RNA, 64 nt, Human
ucccccagggcuccuccccagccggugacuuacuguacagcaggcaggagggugggcaggcaac

SEQ ID NO: 293422 - RNA, 64 nt, Human
agccccacggacaaagggacacacagcccccaauggagaccauuguaagugguggggcugggag

SEQ ID NO: 293423 - RNA, 64 nt, Human
acuccaaacaaagcugggcacagagaaucagcuaggagaccaguuauucaggguccauuucucu

SEQ ID NO: 293424 - RNA, 64 nt, Human
uuuuuaucuuaaaaucaguuucuauuauccuuggggagaccaucccuaacaaaguacagguggg

SEQ ID NO: 293425 - RNA, 64 nt, Human
agagggguugagccuucuuccuccuuggguuggaggagaccagggugccucuuaucuccuucua

SEQ ID NO: 293426 - RNA, 64 nt, Human
uuggguuggagugaaauucuggucucagacaccaggagaccagagucucugaggaugaaguuuc

SEQ ID NO: 293427 - RNA, 64 nt, Human
ccucuguuguucuccaucaucuuuaauagcaacuggagaccacuuuggucauugguaagggggu

SEQ ID NO: 293428 - RNA, 64 nt, Human
gacucuggauaggguccccacauccagggcguggggagaccauuggcauuugggaaccauuuuc

SEQ ID NO: 293429 - RNA, 56 nt, Human
ggcuggcggcugcugucugagccccgggagaccaggugggggcaggacuguggccc

SEQ ID NO: 293430 - RNA, 64 nt, Human
cugucucaccccucgguguguccuccccaacuuuggagaccaagucagggccacucucguccuc

SEQ ID NO: 293431 - RNA, 64 nt, Human
uuaaccuucugggggagggggauuagcuagacuaggagaccagaagugaaugggaaagggugag

SEQ ID NO: 293432 - RNA, 64 nt, Human
ccauaaccaaaacucacaugaaacggaggcagauggagaccaagggugggauccagaauggagu

SEQ ID NO: 293433 - RNA, 64 nt, Human
ugcaggagggugacaauaaaauccuaguggaauuggagaccauuggaagggauggaauauaagu

SEQ ID NO: 293434 - RNA, 64 nt, Human
ggacauacauaaggagagaagguacagugaugaaggagaccauaauucuguaguguugaugauc

SEQ ID NO: 293435 - RNA, 64 nt, Human
aaguuuuuuuuaaaauguggugucccauuccaagggagaccaauuccuaaaggguaaagaaggg

SEQ ID NO: 293436 - RNA, 64 nt, Human
gggcggcagugaggugucaccccccuccagcugaggagaccaggcccaguggcagggguuucuc

SEQ ID NO: 293437 - RNA, 64 nt, Human
cagggcccaggccaggccgcuuuuuuaccccaguggagaccagcagaagccugggguaccuagu

SEQ ID NO: 293438 - RNA, 64 nt, Human
ugucuaaaaaacaauucagaauaccagcagcauuguacagcaagggguaaauaagcuuaauuua

SEQ ID NO: 293439 - RNA, 64 nt, Human
cacccgggcugccugccccugcugcuugggacguguacagcacagaaugaguauuuauuuaaau

SEQ ID NO: 293440 - RNA, 64 nt, Human
ugggagcugggcacuacucugccaguccagaguuguacagcagaagccucucuccuagacugaa

SEQ ID NO: 293441 - RNA, 64 nt, Human
agaccccugcuauagccagagaacaauaaagaagggagaccaggccugacuguguguguucacu

SEQ ID NO: 293442 - RNA, 64 nt, Human
caugcucccagauuccagaggguuaaccaggaauggagaccauccgucggcccugcuaaggacu

SEQ ID NO: 293443 - RNA, 64 nt, Human
aggccaaggcggguggaucacgaggucaggagauggagaccauccuggcuaacauggugaaacc

SEQ ID NO: 293444 - RNA, 64 nt, Human
uggauggacccccaugucugagaggggugaaagaggagaccaauggcaguucagguucaagaua

SEQ ID NO: 293445 - RNA, 64 nt, Human
ugugguggcucacaccuguaaucccagcacuuugggagaccaaggcgggcggaucacuuaaagu

SEQ ID NO: 293446 - RNA, 64 nt, Human
aacgcaaaccccugacuucauggaugaggaaccuggagaccaaagagacaaagggacuuuuuca

SEQ ID NO: 293447 - RNA, 64 nt, Human
gggcuaugcugugugucacuggcuuggguuggagggagaccauggggauggggcacuuaacaau

SEQ ID NO: 293448 - RNA, 64 nt, Human
agucccuguucaaaacccgggagaaggaguaucaggagaccauugaccagauagagguaagggc

SEQ ID NO: 293449 - RNA, 64 nt, Human
gaggccuuccuaucuccaagucuauguauuuucuggagaccaaaccagauaccagauaaucaca

SEQ ID NO: 293450 - RNA, 64 nt, Human
guuugaguauuuuuuaaaagggaaacaguaccaaggagaccagcccuaccuugaucuggggaua

SEQ ID NO: 293451 - RNA, 64 nt, Human
uccgccacacauucaguuucuuuaucuguaaaauggagaccaccccccgccacgcugaacggug

SEQ ID NO: 293452 - RNA, 64 nt, Human
ccaaggguauuuauugaacuaccagcaguaucuaggagaccacgaaggaauaccacgaaggaau

SEQ ID NO: 293453 - RNA, 64 nt, Human
uuuggucugguccuugagccacaagaaguggaggggagaccaugccugggaacagacccccuuu

SEQ ID NO: 293454 - RNA, 64 nt, Human
augggaucuucucccacacucacaucuaucugcuggagaccauccccuccgagauccaggucuu

SEQ ID NO: 293455 - RNA, 64 nt, Human
agaaugcccuggccagagcgagcaacacggcggaggagaccaucagugccaugaagacuguccg

SEQ ID NO: 293456 - RNA, 64 nt, Human
cccgguggcucaugccuguaaucccagcacugugggagaccacggugggggaaucccuugagcc

SEQ ID NO: 293457 - RNA, 64 nt, Human
cggagcugggguuuggugcaguuuccagggugcaguacagcagggccugaauacuggcccugga

SEQ ID NO: 293458 - RNA, 64 nt, Human
guuuucauagacacuuauuuaaucuuuuuaaauuguacagcaaggugcucuaaguaauauucga

SEQ ID NO: 293459 - RNA, 64 nt, Human
cuucagaauauccacacuagugaaagucuucugaguacagcaaaugugugacauuauuuugcua

SEQ ID NO: 293460 - RNA, 64 nt, Human
ggcagcucugcaguugggaggggcaccguccggaggagaccaggccucuacacaccccccacuc

SEQ ID NO: 293461 - RNA, 64 nt, Human
agggcgaugguggggagacucggugggugaauggggagaccagaaagaaagaguccacagagcc

SEQ ID NO: 293462 - RNA, 64 nt, Human
ggguuucggagcuuguguaacaguuuuugggauaggagaccagcgguuuuggguugggauuagu

SEQ ID NO: 293463 - RNA, 64 nt, Human
uguaauguugguuauaugaaguucaucucaaaauggagaccaugaccagaguuuccagaugaua

SEQ ID NO: 293464 - RNA, 64 nt, Human
agguuaagcccugaggggucccugauaacaaccuggagaccaggauuuuauggcuccccucacu

SEQ ID NO: 293465 - RNA, 64 nt, Human
cagggugcugugggugauauggacagcagaagggggagaccaagguuccagcucaaccaauaac

SEQ ID NO: 293466 - RNA, 64 nt, Human
uugguagccugaagugggagauugcuugaguccaggagaccagccugggcaacauagcaaaacc

SEQ ID NO: 293467 - RNA, 64 nt, Human
acgguguccuguggagaccagacucugcaaguggggagaccacccccgcaagccagugacaagg

SEQ ID NO: 293468 - RNA, 64 nt, Human
ccccuuggaagggaagggaaggacgguguccuguggagaccagacucugcaaguggggagacca

SEQ ID NO: 293469 - RNA, 51 nt, Human
gcauccgauuucuucacuaaaggagaccaaacuguuccuugcggucuagua

SEQ ID NO: 293470 - RNA, 64 nt, Human
uauuuaaauauauauguugcuguugcugaauacaggagaccagguuaggaauauaguuucauaa

SEQ ID NO: 293471 - RNA, 64 nt, Human
aacaugcucagaacuugcugggacagugugggugggagaccagggcuuugcaauucguggcauc

SEQ ID NO: 293472 - RNA, 64 nt, Human
cagggcucaggccucacccauugcccacuccuggggagaccaucaccuggcucaucguuuccac

SEQ ID NO: 293473 - RNA, 64 nt, Human
uccuugggagggggugacggaaccagcacuguguggagaccagcuucaaggagcggaaggcugg

SEQ ID NO: 293474 - RNA, 64 nt, Human
ccagacgaagaacauuguguccuaaugguaggcaggagaccaaggagcagaaggcuugccuucc

SEQ ID NO: 293475 - RNA, 64 nt, Human
ccaugcugagcauccuggaggaccuggagagcugggagaccaugaugagccugacuccccaugc

SEQ ID NO: 293476 - RNA, 64 nt, Human
gaauagaaguuaugugauuucagugaguugauguguacagcauggcugugcuccaucugauuua

SEQ ID NO: 293477 - RNA, 64 nt, Human
gcugcgaggagaagcuguacuuuggcuugagugaguacagcaagucucugcagugggggaucac

SEQ ID NO: 293478 - RNA, 64 nt, Human
uaucaggugccaagcccuguucucggugcugggaguacagcagugagcaaaggagacaauauuc

SEQ ID NO: 293479 - RNA, 64 nt, Human
uccgaggcaggggaauugcuugaacucaggaguuggagaccagccugggcaacauggcaaaacg

SEQ ID NO: 293480 - RNA, 64 nt, Human
cacaccugccaacagcacugggggcuucuccccaggagaccacgcugcccuccaagaccaggag

SEQ ID NO: 293481 - RNA, 64 nt, Human
gugcccaacacuguggaucagcaaacacgauagaggagaccagucaguacuucuuggagggggc

SEQ ID NO: 293482 - RNA, 64 nt, Human
uguguaggggcagcucggccucuggucgccuuggggagaccaaaagucggacaggaaacaucug

SEQ ID NO: 293483 - RNA, 64 nt, Human
auaaugguggcuccagcgacaggaggccaacccuggagaccaagaacagggcgccuggcugcca

SEQ ID NO: 293484 - RNA, 64 nt, Human
uucauuucuucaagaugcucuggguggugggaugggagaccauccucagcccuccucagaccuu

SEQ ID NO: 293485 - RNA, 64 nt, Human
uggaaugacgcgguccagggagggcggaggcccaggagaccaaagggaggggcucugccgcuua

SEQ ID NO: 293486 - RNA, 64 nt, Human
ccagugccggguccucccucccuuccuggcuuggggagaccaguuucuggggagcuuccaagag

SEQ ID NO: 293487 - RNA, 64 nt, Human
gccgaggcgggcggaucaccugaggccaggaguuggagaccagccaggccaccauggugaaacc

SEQ ID NO: 293488 - RNA, 56 nt, Human
ucugucugucucuccugugaaaccugggagaccagaguccccuuuaggguucccgg

SEQ ID NO: 293489 - RNA, 64 nt, Human
augugcagggugggucuuggggcugggucugccuggagaccagugggcccagggggaaggggga

SEQ ID NO: 293490 - RNA, 64 nt, Human
augcuaagacaugucuugugaaggaagguuucuuggagaccacuuuuauuuacucaugagaagu

SEQ ID NO: 293491 - RNA, 64 nt, Human
ccucgggaaggugacagucugugugccuugguguggagaccaaccugaggauguccugggaaau

SEQ ID NO: 293492 - RNA, 64 nt, Human
agcccccagagccucacuggccccggcgggaugaggagaccaugccgggcgcgcacacacggca

SEQ ID NO: 293493 - RNA, 64 nt, Human
cuggcacacagggcuggcucagugugcggacagaggagaccacucugcuccuggggccagaggc

SEQ ID NO: 293494 - RNA, 64 nt, Human
ggaggaucccuugaucccuuguggccaggaguugggagaccagccuggggaccauagcgagacc

SEQ ID NO: 293495 - RNA, 64 nt, Human
augggagagccuauugcucccaggcuacgcaccuguacagcaugugacuacugaauacuauagg

SEQ ID NO: 293496 - RNA, 64 nt, Human
cuuauuuuaccucgagaauuguuaccuuaaauuaguacagcacuuucuucuucccauggugcuu

SEQ ID NO: 293497 - RNA, 64 nt, Human
auagucacuucuaguuuggcauuucacaaacucuguacagcaagguauugguagguuacucaau

SEQ ID NO: 293498 - RNA, 64 nt, Human
auaucaguaagaagagggcacaagaacuggcucuggagaccaaagcaguuguuaaaaauucucu

SEQ ID NO: 293499 - RNA, 64 nt, Human
uguagagggugcucagagcguggcaugagagcaaggagaccauggcuacucuuugaaauggaug

SEQ ID NO: 293500 - RNA, 64 nt, Human
gcggaggcaggaggaucgcucaagccccggaguuggagaccagccagagcaacacagugagacc

SEQ ID NO: 293501 - RNA, 64 nt, Human
gcccuuggaccuccuuguaacaucagggaccuuuggagaccauuaucaguguaagcccugcuua

SEQ ID NO: 293502 - RNA, 64 nt, Human
agggcagagugagaaagacauggagggaaauaagggagaccaagagcacagcaggacugaaauu

SEQ ID NO: 293503 - RNA, 64 nt, Human
aggccagggcuggaaggacaggccugcccaugcaggagaccaucuggacaccgggcagggaagg

SEQ ID NO: 293504 - RNA, 64 nt, Human
ccugguggcgagcccaagugguugccuccuacgaggagaccaacgaaguggagauucgauacgu

SEQ ID NO: 293505 - RNA, 64 nt, Human
gccaaggcgggcggaucagcugaggucaggaguuggagaccagcguggccaacauggugaaacc

SEQ ID NO: 293506 - RNA, 64 nt, Human
ucaaaguguuauuuuguuuuuccuuccaaugucuggagaccaccagggcaucucugggcuggau

SEQ ID NO: 293507 - RNA, 64 nt, Human
ucucucuuaacguuccugggagacuccaacaaauggagaccagaaacaaggcaaccacgaccuu

SEQ ID NO: 293508 - RNA, 64 nt, Human
auggagacugcgagaccguggcaccccuacugcuggagaccacaguccugauguggacgcaggg

SEQ ID NO: 293509 - RNA, 64 nt, Human
gccagaggggaggugggcugcacuccuccugccuggagaccaggcccccuucuugccuggugcu

SEQ ID NO: 293510 - RNA, 64 nt, Human
ccagcccacacuagccugggugcaucugcuaaugggagaccaaaucuuuguccgggaagcaaga

SEQ ID NO: 293511 - RNA, 64 nt, Human
cuggaaacacccuuccggaacccuucggggaaaaggagaccauccuuggagugaacguccccug

SEQ ID NO: 293512 - RNA, 64 nt, Human
ugguuggcauggccuggggcaggaggcagaggcaggagaccaagauggcagguggaggccaggc

SEQ ID NO: 293513 - RNA, 64 nt, Human
cugccgucaccaguuagaggccaccauggugugaggagaccaucaccucgaccagaacuccaga

SEQ ID NO: 293514 - RNA, 64 nt, Human
aaaaugcugacagccucaugcugguggacuucgaguacagcaguuauaacuauaggugaggcug

SEQ ID NO: 293515 - RNA, 64 nt, Human
accugaggccuaguggggaucuguccuaagcugaguacagcagccaggggaccagaacugugug

SEQ ID NO: 293516 - RNA, 64 nt, Human
cagugaaaaguucuaacuuguuuuugagaagucaguacagcaggggaaaacauaugugaugcaa

SEQ ID NO: 293517 - RNA, 64 nt, Human
agauuacaacccaaagucucccaggaagcuguggggagaccagaggaucaagcugaagugaagc

SEQ ID NO: 293518 - RNA, 64 nt, Human
gggcgggacuggggagggaacuccgccccucgcgggagaccagaacucuuggagcuuaggggag

SEQ ID NO: 293519 - RNA, 64 nt, Human
gccuggcuggguccugaagcccucugucuaccugggagaccagggaccacaggccuuagggaua

SEQ ID NO: 293520 - RNA, 64 nt, Human
cugggugggaggagcgaaaguggggguguccuggggagaccaggaaccugccaagcccaggcug

SEQ ID NO: 293521 - RNA, 64 nt, Human
agaagacgccacagauuuccuucccucuccuccaggagaccauaagauagaucccccauccucu

SEQ ID NO: 293522 - RNA, 64 nt, Human
cagggaucuuucuucccagcccuggagccuggagggagaccacccucuggguccuugcuggggc

SEQ ID NO: 293523 - RNA, 64 nt, Human
uggauugccugcugcaaagcuuugauuuggcaaaggagaccauggaagaaucaugguggaucca

SEQ ID NO: 293524 - RNA, 64 nt, Human
cagaccuguuucuucuaagggaggaggacaugguggagaccagggacaggagagccagcagggu

SEQ ID NO: 293525 - RNA, 64 nt, Human
ggcagaagauggacugggggagggggcagagagaggagaccaaaaugaggugguggcacagggu

SEQ ID NO: 293526 - RNA, 64 nt, Human
ccccaacccccaggcagcccggcagaggacgggaggagaccagucccccacccagccguaccag

SEQ ID NO: 293527 - RNA, 64 nt, Human
cacgauggcucaaaccuguaaucccagcacuuugggagaccaaggcggguggaucacuugaggu

SEQ ID NO: 293528 - RNA, 64 nt, Human
gccucagcaucucacauccaccaccuccaggaggggagaccacugguaaguccuccuccugcuc

SEQ ID NO: 293529 - RNA, 64 nt, Human
cuggcuuagggguugaucacuuuccuagcaaaggggagaccacauguggugcacagggaagaaa

SEQ ID NO: 293530 - RNA, 64 nt, Human
uggcucuccaacaagaaggaaagcagggaggaagggagaccacugugucaccuggaggagaagu

SEQ ID NO: 293531 - RNA, 64 nt, Human
aucagauuuuuagauaaguguaauuuucucuauaggagaccacguugcuacaucuguuaaugcc

SEQ ID NO: 293532 - RNA, 64 nt, Human
cuucuuauuaaugaagugcauagugcugcucccaggagaccacugcugacagauacacagagaa

SEQ ID NO: 293533 - RNA, 64 nt, Human
gcgguggacugaaggcaugagaugcccuuugaguguacagcaaaucaauguuuuccugcuuggg

SEQ ID NO: 293534 - RNA, 64 nt, Human
ggauuguggggacaggagugagacaaccccccagguacagcacuggcuuuucuuuucagccccu

SEQ ID NO: 293535 - RNA, 64 nt, Human
uuaacauguugugaauugugaauuaucugcugucguacagcacauuagcaaauugucaucggac

SEQ ID NO: 293536 - RNA, 64 nt, Human
uuugcaguguaguaagagaauccaucuuuuacuaggagaccagauuccuuuuauaccucauuca

SEQ ID NO: 293537 - RNA, 64 nt, Human
gacaguauuauuaauacuaugcaaauauggaauaggagaccauuugauuuucuaggcuuugugg

SEQ ID NO: 293538 - RNA, 64 nt, Human
ccggcggccccgccgcagaccagcuggcggguguggagaccaggcuccugaccccgccaugcau

SEQ ID NO: 293539 - RNA, 64 nt, Human
cgcuggccucuccccagcggagccugcacguuacggagaccaucacaugugggcguggucagug

SEQ ID NO: 293540 - RNA, 64 nt, Human
gcccgcccgcgccccggaggcccuggcucuguccggagaccaggugagcacagccuggagccug

SEQ ID NO: 293541 - RNA, 64 nt, Human
guaucuguggggaccugacaagggcaggggaagcggagaccagggugcaggcuccgcccccacc

SEQ ID NO: 293542 - RNA, 64 nt, Human
ggaggcugagcuggaucacuugaguucaggaguuggagaccaggccugagcaacaaagcgagau

SEQ ID NO: 293543 - RNA, 64 nt, Human
aggccgaggcgggcggaucacuaggucaggaaauggagaccauccuggccaacacagugaaacc

SEQ ID NO: 293544 - RNA, 64 nt, Human
ggccagccccuacuggacccuuguaaucugauuuggagaccauccccccgaugggaccagcagc

SEQ ID NO: 293545 - RNA, 64 nt, Human
acgagaccaacguggaaaagucugaagggccuugggagaccagguagcaccuggccccaucaug

SEQ ID NO: 293546 - RNA, 64 nt, Human
cagcacugcaagagggugagcucuugguguauuuggagaccauccaguuauucaucugacugcc

SEQ ID NO: 293547 - RNA, 64 nt, Human
ccuccaccugggggccccuggacacugucuacuuggagaccacuggcccccuucccccaggguu

SEQ ID NO: 293548 - RNA, 64 nt, Human
gcaaacaccagcuccucagcuucgugucccugcuggagaccaacaagccguaccuggugaacug

SEQ ID NO: 293549 - RNA, 64 nt, Human
gaggggaggacccauggcucuccccccuagcccgggagaccagggccuuccucuuccucugcuu

SEQ ID NO: 293550 - RNA, 64 nt, Human
guggcacucagcuuggggcugggccugcuggccuggagaccagggugccugcgggccuuggggg

SEQ ID NO: 293551 - RNA, 64 nt, Human
caggcuguagcagcagaguugagcaguugugacaggagaccauguggccugcagagcccaaaua

SEQ ID NO: 293552 - RNA, 64 nt, Human; identical to SEQ ID NO: 227165

SEQ ID NO: 293553 - RNA, 64 nt, Human; identical to SEQ ID NO: 227166

SEQ ID NO: 293554 - RNA, 64 nt, Human
cagcccucuggcgucucuagaaacugcugcugauggagaccaggacagagcccgcccccacccg

SEQ ID NO: 293555 - RNA, 64 nt, Human
ucucuguccccuccacccucacuccauccaccucggagaccacccucccccagccagauacgga

SEQ ID NO: 293556 - RNA, 64 nt, Human
aucaucccgcuucucuccggccugagcaucucagggagaccaggggccgagccgcugagcaggu

SEQ ID NO: 293557 - RNA, 64 nt, Human
augugaggcaagcuaaggccuggagggucagaugggagaccaggucccaagggagcaagaccuc

SEQ ID NO: 293558 - RNA, 64 nt, Human
caggacagagcgggaggccgggccuugggccacaggagaccagcucagggcggaaggucaggcu

SEQ ID NO: 293559 - RNA, 64 nt, Human
aggacgaggcaggcggaucaugaggucaggagauggagaccauccuggcuaacacggugaaacc

SEQ ID NO: 293560 - RNA, 64 nt, Human
uguaagugcccacuuccucauguuuucacacgauggagaccaacaaauaggucggucggucucc

SEQ ID NO: 293561 - RNA, 64 nt, Human
gccgaggugaaaggaucacuugagcccaggaauuggagaccagcgugggcaacuuagcgagacu

SEQ ID NO: 293562 - RNA, 64 nt, Human
gcagaggccggcagaucacuugagcccaggaguuggagaccagacuggggaacauggcaagacc

SEQ ID NO: 293563 - RNA, 64 nt, Human
uguaauggaaccuuuucugugccccuaucuucccggagaccacgcuucuccuccgugccgugcg

SEQ ID NO: 293564 - RNA, 64 nt, Human
ucuguaguagcccugcacaaaggguggggagucaggagaccaucccaaaggcaucucccugucu

SEQ ID NO: 293565 - RNA, 64 nt, Human
ucauguggcgccuguuucgacgccgggacccccaggagaccaggucuggcucgcggcggacguc

SEQ ID NO: 293566 - RNA, 64 nt, Human
uuggcuaugguaguuucaguccagugggugggauggagaccaacgaccaaguguuccugcaagg

SEQ ID NO: 293567 - RNA, 64 nt, Human
guuuuauagagucaguaguucagccaagugauugggagaccacacagcagagaagccucacaag

SEQ ID NO: 293568 - RNA, 64 nt, Human
uguugcugcccaacuucaacauucauaauggccaggagaccacacaacagagacauuuaaugag

SEQ ID NO: 293569 - RNA, 64 nt, Human
gccaaggcgggaggacugcuugaggccagaaguuggagaccagccugggcaaguggacaccuca

SEQ ID NO: 293570 - RNA, 64 nt, Human
uauucaucuuuaauccuguuuucagucucuauguguacagcaguauuuuuaauaaagaauuaca

SEQ ID NO: 293571 - RNA, 64 nt, Human
uuaagcaaauuucauuucacauuuuuguaaugcuguacagcaguucacaaaaaaauguucauug

SEQ ID NO: 293572 - RNA, 64 nt, Human; identical to SEQ ID NO: 229482

SEQ ID NO: 293573 - RNA, 59 nt, Human
ggccggugaugcaggccugagugugugcgggagaccaaauaaaccggcuugggugcgca

SEQ ID NO: 293574 - RNA, 64 nt, Human
ccugcagggugauucuggggguccgcugguauguggagaccaccuccgaggccuugugucaugg

SEQ ID NO: 293575 - RNA, 64 nt, Human
uggggcagaggcaugcuccuggcaucgaguggguggagaccagagaagccgcucaacauccugc

SEQ ID NO: 293576 - RNA, 64 nt, Human
ugguggagggggaggggagaagccaagggacacaggagaccacccccgagcuugccucagggcc

SEQ ID NO: 293577 - RNA, 64 nt, Human
cccuguaggucuccuggguguugagagacaaguuggagaccaaccuccaaugaaugagccgcgg

SEQ ID NO: 293578 - RNA, 64 nt, Human
cccagguccuauggcagcuccucauuagauuaaaggagaccacuuccaaagcaggugcugcaug

SEQ ID NO: 293579 - RNA, 64 nt, Human
gcuugacucugggcccaacccccauuucccuucaggagaccagcgagaggcccuggcccauucc

SEQ ID NO: 293580 - RNA, 64 nt, Human
gacaucaucaaggucagaggguaaauuccuaacaggagaccacaaagguuucacuucuuuuaga

SEQ ID NO: 293581 - RNA, 64 nt, Human
aaggugcuaagcccucucuccacaaugccaagacggagaccacagccuacaccaaauccagccc

SEQ ID NO: 293582 - RNA, 64 nt, Human
gacagagaguauugcuggagggugagagaauuguggagaccaacuaccacauagcaagagccca

SEQ ID NO: 293583 - RNA, 64 nt, Human
accggggguggagaggagccucaaguacauuccaggagaccacugucuccucgcuggccugggc

SEQ ID NO: 293584 - RNA, 64 nt, Human
ugcuggaauggggaggggcuccccaagauggccuggagaccacccagcccugaccugggacccc

SEQ ID NO: 293585 - RNA, 64 nt, Human
gcgggggacaggaacacccagccccagcgagucuggagaccaggacucugccuuccaggcguag

SEQ ID NO: 293586 - RNA, 64 nt, Human
acccaucagcacagguuggauagggguuaguguaggagaccaguuacagaauggccuggagucu

SEQ ID NO: 293587 - RNA, 64 nt, Human
gggugaagaaggaggaggaagaggcagagaaggaggagaccagggcugggaaagaaacuucuca

SEQ ID NO: 293588 - RNA, 64 nt, Human
gggcucagcuuuugauugaagagagagacacgauggagaccauugguaagcugcccuauuugcc

SEQ ID NO: 293589 - RNA, 64 nt, Human
gcuuuuuaaauuuuucuaauaauaucuuacauuuguacagcaugaugaccuuuacaaagugcuc

SEQ ID NO: 293590 - RNA, 64 nt, Human
uccauccgcuaaguuuagauggaguccaaacgcaguacagcagaagaguuaacauuuacacagu

SEQ ID NO: 293591 - RNA, 64 nt, Human
cccaggauccaucugcccucauaaaaguguucagguacagcagcugaggcugcccugaggaauc

SEQ ID NO: 293592 - RNA, 64 nt, Human
ugugaggugcacgcuccgcagcccagcccagccgggagaccacguggccauugcggucuccuga

SEQ ID NO: 293593 - RNA, 64 nt, Human
guuggaccccaagacgacguacaacagguucugcggagaccaagagaaggcgugugagcaaccc

SEQ ID NO: 293594 - RNA, 64 nt, Human
gccagggcgcgggggccgccagccgcacuucugaggagaccagcagucaugcaucgugcaccac

SEQ ID NO: 293595 - RNA, 64 nt, Human
aauguauuugaugucuuaguguuuuagugacuagggagaccauuaacuaguuuaucauuaacca

SEQ ID NO: 293596 - RNA, 64 nt, Human
ucguccuggacaccacaggggcaccugcaggcugggagaccagguccucugugcaugggcccgg

SEQ ID NO: 293597 - RNA, 64 nt, Human
aguuugggugcuggugguguggcuguaggggaggggagaccacacccaaggugggggcuguggc

SEQ ID NO: 293598 - RNA, 64 nt, Human
acccggcuggucccaccccaaauaccucagccauggagaccaugucaugcagaauuaacaaggu

SEQ ID NO: 293599 - RNA, 64 nt, Human
ugucccugugcccagcacagggugccuggcagggggagaccacagguaugcagguggggggaca

SEQ ID NO: 293600 - RNA, 64 nt, Human
uucuucugcacccuggggugaggacggcuuggagggagaccagcaguuaacggugagggaggua

SEQ ID NO: 293601 - RNA, 64 nt, Human
uccggaucguuccugcagggaagcggcagcacacggagaccacuugguugaauucuguuggaac

SEQ ID NO: 293602 - RNA, 64 nt, Human
uaggccaggcccugggagggcaggcaggcaaaggggagaccagagggucuguguucuccaggag

SEQ ID NO: 293603 - RNA, 64 nt, Human
auucccaggugauucacagccacauuaaaguucaggagaccauaggaccccugacccaugagaa

SEQ ID NO: 293604 - RNA, 64 nt, Human
aggucggcuuguuucucacauguagggagagaggggagaccaaccccuuugugucuuuugaaau

SEQ ID NO: 293605 - RNA, 64 nt, Human
ucuuggggcaccuaagacagcacccccucucaggggagaccaugguggccccggccgcaccccc

SEQ ID NO: 293606 - RNA, 64 nt, Human
ugagucaggguuggauggucaucggcuuucagaaggagaccacgggaauguucagggaaacaau

SEQ ID NO: 293607 - RNA, 64 nt, Human
ugucccccaggaggacucccugcuuagcucugugggagaccaacuacgacuggcaucuucucuu

SEQ ID NO: 293608 - RNA, 64 nt, Human; identical to SEQ ID NO: 229464

SEQ ID NO: 293609 - RNA, 64 nt, Human; identical to SEQ ID NO: 229465

SEQ ID NO: 293610 - RNA, 64 nt, Human; identical to SEQ ID NO: 229484

SEQ ID NO: 293611 - RNA, 64 nt, Human
uuccaggagagggaaagaucguaaggaugagagaggagaccauccaagccagaaauuauuuaau

SEQ ID NO: 293612 - RNA, 64 nt, Human
auaauacuuaucuuacaagguugcaagagcucaaggagaccauguauguaaaguuccugcugua

SEQ ID NO: 293613 - RNA, 64 nt, Human
aucaaaaugcgccacagcaggaccacaagggcaaggagaccaccgccuucuccagugcuuccuu

SEQ ID NO: 293614 - RNA, 64 nt, Human
aucaaaaugagccauagcgggaccacaagggcaaggagaccaccaccuucuccagucucucuuc

SEQ ID NO: 293615 - RNA, 64 nt, Human
ggagcccagugccagccagagguugugcaggcaaggagaccaaagauugaugagaagaccccca

SEQ ID NO: 293616 - RNA, 64 nt, Human
gcugagguggguggauugcuugagcccaggaguuggagaccagucugggaaacguggugagacc

SEQ ID NO: 293617 - RNA, 64 nt, Human
ucagguugcacaggugcaugcaagagcauucuuaggagaccacuguuuugaaaaacuuuugacu

SEQ ID NO: 293618 - RNA, 64 nt, Human
ugaaaauaguugaagagaaaugcucacugcacaaggagaccaagaaaaaccccccacgaaauca

SEQ ID NO: 293619 - RNA, 64 nt, Human
gagaaugauaaauuauccuagcaaaggggccucuggagaccaucuuguuccagccucugaagac

SEQ ID NO: 293620 - RNA, 64 nt, Human
gucagguugcacagaugcauguagagcauucuuaggagaccauuguuuuagaaaacuuugauuu

SEQ ID NO: 293621 - RNA, 64 nt, Human
aagcaggcaacuggccugacccaugagaccguuuggagaccaagcagcagaugcagguguggac

SEQ ID NO: 293622 - RNA, 64 nt, Human
ggccagggaggguucuccccaugacaaccccacuguacagcagaucgugcagcugucuccuguc

SEQ ID NO: 293623 - RNA, 64 nt, Human
aaauagucucuguggcaggucacugggggacaauguacagcauucuggccauccacuucuuuuu

SEQ ID NO: 293624 - RNA, 64 nt, Human
cuagugacuuccuggugaggcccagccuguccugguacagcagggucuugcuguaacucagaca

SEQ ID NO: 293625 - RNA, 64 nt, Human
uuaccuggucuugguaauaaguuucuuuuagcuuguacagcauccucagaccaacugaggagcu

SEQ ID NO: 293626 - RNA, 63 nt, Human
uuuugcuaucauugcuaagagauucccgcugauugggcucagugccagcuguuauucugcuuc

SEQ ID NO: 293627 - RNA, 63 nt, Human
gagugcccucuuaguuggugugugaggucuuggugggcucaggccagcuguuugcgagugugg

SEQ ID NO: 293628 - RNA, 63 nt, Human
cuugcuauguugcccaggcuggucucaaacuccugggcucaagcgauccucccaucucagccu

SEQ ID NO: 293629 - RNA, 63 nt, Human
uuccccugugucuccagguaaccagcuaacucuugggcucaggcacccuugcacaggguugca

SEQ ID NO: 293630 - RNA, 63 nt, Human
caucauccacaaccuuguuucucacuuccugguugggcucaucucugaagaacaggucuccca

SEQ ID NO: 293631 - RNA, 63 nt, Human
cauguaacucugaccaaucugggaaguggagggugggcucaugggccgugcucugccccuguc

SEQ ID NO: 293632 - RNA, 63 nt, Human
cucacuguguugcccaggcuggucucgaacuccugggcucaagcgguccaccugccuccgccu

SEQ ID NO: 293633 - RNA, 63 nt, Human
gaggacuggaugcuagacugcugagcuguggucugggcucaguugagaagauaggaucucccu

SEQ ID NO: 293634 - RNA, 63 nt, Human
aaagcaaagccugggaaucugcucauuguuguuugggcucagguauugagccugauggcccag

SEQ ID NO: 293635 - RNA, 63 nt, Human
gaagaagcggagaaggguucaguguagccacucugggcucauagggacacuuggucacuccag

SEQ ID NO: 293636 - RNA, 63 nt, Human
agcugaucauagcucacugcagcuucaaacucuugggcucaagccauccuucugccucacugu

SEQ ID NO: 293637 - RNA, 63 nt, Human
uuuaagaagaaaacuauagcaggguacaaugcuugggcucaggaaguuucucugugcaacuag

SEQ ID NO: 293638 - RNA, 63 nt, Human
uccuuaagucuguguguuucugugucucaagacugggcucacauucuggcuuuguccauaaca

SEQ ID NO: 293639 - RNA, 63 nt, Human
ggcaugaacauagcucacuguuaccuugaauucugggcucaggugauccuuccgccucacccu

SEQ ID NO: 293640 - RNA, 64 nt, Human; identical to SEQ ID NO: 229485

SEQ ID NO: 293641 - RNA, 64 nt, Human; identical to SEQ ID NO: 229486

SEQ ID NO: 293642 - RNA, 64 nt, Human; identical to SEQ ID NO: 229488

SEQ ID NO: 293643 - RNA, 63 nt, Human
uguccuggccuccugcucuccagaucuguaaacugggcucaaggacuguacaagcagaguaca

SEQ ID NO: 293644 - RNA, 63 nt, Human
ccuagaguaacggcucugcugccaggguuucucugggcucauucuuccacugacuuaauuaug

SEQ ID NO: 293645 - RNA, 63 nt, Human
cucacuauguugcccagacuagccuugaacucuugggcucaagugauucucccuccucagccu

SEQ ID NO: 293646 - RNA, 63 nt, Human
gcaugaaaacaaagaaaugccccuacugaagacugggcucaaaggaccaaugcagggcugguu

SEQ ID NO: 293647 - RNA, 63 nt, Human
ucucacauguugcccaggcuggccuugaacuccugggcucaagcauuccuccugccucagccu

SEQ ID NO: 293648 - RNA, 63 nt, Human
ucuagggucuagcgggcacaaacguccccaggcugggcucauucccaucgugagugagcccag

SEQ ID NO: 293649 - RNA, 63 nt, Human
uucucugggucuauguaggccccuggucugcccugggcucaucagccuuccugaccuccuccu

SEQ ID NO: 293650 - RNA, 63 nt, Human
acugugaaaucugguaaggcaguccugaggacaugggcucaagucucaguccccucagaccac

SEQ ID NO: 293651 - RNA, 63 nt, Human
acuguucuuuuuuaaaauauuuguaauauggaaugggcucaguaagaagagcuuggaaaaugc

SEQ ID NO: 293652 - RNA, 63 nt, Human
ccaccucucaagccuccaaccucuuggccagauugggcucauuaaugucguugccugcccauc

SEQ ID NO: 293653 - RNA, 63 nt, Human
gugagaucuggguucacugcaaccucugccuccugggcucaagcaauccucccacuucagccu

SEQ ID NO: 293654 - RNA, 63 nt, Human
guuugagccaaggucuuggaaggcauugccccaugggcucaggugacucgggguggagugagc

SEQ ID NO: 293655 - RNA, 63 nt, Human
cagugccccacuccuuugugcacaaggacacguugggcucacaggaggagcacaggcucuugg

SEQ ID NO: 293656 - RNA, 63 nt, Human
guuuaugggccuugcuuugggcuuugcaggcucugggcucagggcuggagugcgcucuugguc

SEQ ID NO: 293657 - RNA, 63 nt, Human
ucacuauauccacuucacuccucauuugcccaaugggcucaaguaccccauaagauuuaccag

SEQ ID NO: 293658 - RNA, 63 nt, Human
acuuugcaagcucugccuuggguucagcccaucugggcucaaauuccagccucaccacucaca

SEQ ID NO: 293659 - RNA, 64 nt, Human
ggaaccagcuggaaacacaaaacaaacagugauuguacagcaggcugggcccaggaggucaggu

SEQ ID NO: 293660 - RNA, 64 nt, Human
agacacccggggugggggaaguggggagcaguaaguacagcauaguaguuucccgauugugcug

SEQ ID NO: 293661 - RNA, 64 nt, Human
caaauccacuuaaauucuguuuuccugaaaagagguacagcauaagaaauagcucuuuauugau

SEQ ID NO: 293662 - RNA, 63 nt, Human
gugcgaucaaggcccacugcagucuugaccuccugggcucaggugauccuuccaccucagcuu

SEQ ID NO: 293663 - RNA, 63 nt, Human
gaccccuuguccugcugcaugccuguuggcuacugggcucaucccagcuggcaguggagacug

SEQ ID NO: 293664 - RNA, 63 nt, Human
ggugccaucauugcugucugcagccuugaacucugggcucaagcaauccucucaccucagccu

SEQ ID NO: 293665 - RNA, 63 nt, Human
guggucuccgcucugaauuggauccaggggaccugggcucauucuucuuggcucaccaacccu

SEQ ID NO: 293666 - RNA, 63 nt, Human
uauauuuucucuccucgaguugcuccucauggcugggcucauuucggucccuuucuccuuggu

SEQ ID NO: 293667 - RNA, 63 nt, Human
cuaauuuaacuggugaaauuuaaagugaauucaugggcucaucuuuaaagcuuuuacuaaaag

SEQ ID NO: 293668 - RNA, 63 nt, Human
cucgcuuuguugcccaggcuggucuugaauuccugggcucaagcaauucuuccaccucagccu

SEQ ID NO: 293669 - RNA, 63 nt, Human
cccauagaagacgggaagaaagagguaugaagaugggcucaauuaugagccagggaggauuga

SEQ ID NO: 293670 - RNA, 63 nt, Human
cgccagugauggagcagauacucaaggaggcacugggcucagccugggcauuaaagggacaga

SEQ ID NO: 293671 - RNA, 63 nt, Human
uucaccguuuugcccaggcuggucucaaacuccugggcucaagcaauguauugaauuuuaaaa

SEQ ID NO: 293672 - RNA, 63 nt, Human
cucacuauguugcucaggcuggccuugaacuccugggcucaagcaauccuccugccucagccu

SEQ ID NO: 293673 - RNA, 63 nt, Human
cagggaugcucauuccaugacucugccuaaccaugggcucagggccagguccucacagcaguc

SEQ ID NO: 293674 - RNA, 63 nt, Human
cgguggggggcucucaagugccugauccugcccugggcucagagccagcccagagggaagcaa

SEQ ID NO: 293675 - RNA, 63 nt, Human
gaaugggccugguaggccccaggccagacuaacugggcucaaggggugcuggaaggcgcagag

SEQ ID NO: 293676 - RNA, 63 nt, Human
ccuugcacugugcugcucucacagaucggugucugggcucagccagguggaaggaaccugccu

SEQ ID NO: 293677 - RNA, 63 nt, Human
cuccaggaccagccagcuguguucccugcagacugggcucagcccgacauccaacaggcgcca

SEQ ID NO: 293678 - RNA, 64 nt, Human
gguggugucccugccaauuccuuccuucucuucuguacagcagaaguaauuacaagcacuucuc

SEQ ID NO: 293679 - RNA, 64 nt, Human
ccacauaaaacagcuccuaauugacaugggcaaaguacagcagauagcaacucuuugcucugua

SEQ ID NO: 293680 - RNA, 64 nt, Human
uucucacuugccuuuguuacuuaaugugcuuucaguacagcagauaugcaauauucaccaaaua

SEQ ID NO: 293681 - RNA, 63 nt, Human
ugggcucagaccuagcagcguggggugagucccugggcucaguccuagcugcauggggugcag

SEQ ID NO: 293682 - RNA, 63 nt, Human
ugaaugggucuacaccugcaugggcugagucccugggcucagaccuagcagcguggggugagu

SEQ ID NO: 293683 - RNA, 63 nt, Human
gagcaaggggcagauagcucagcaaggaaagaaugggcucagaaaaaggagggcuggcuggag

SEQ ID NO: 293684 - RNA, 63 nt, Human
cagacagcacagggcaggggugguggagggggcugggcucacaggccucucuuuuccccgccu

SEQ ID NO: 293685 - RNA, 63 nt, Human
ucucucuaauuucaauuuguuuauauuuaccucugggcucaauaagggcaucugugcagaaau

SEQ ID NO: 293686 - RNA, 63 nt, Human
gugcaaucauagcucauugaagccucgcacuccugggcucaagugguccuccugccucagcuu

SEQ ID NO: 293687 - RNA, 63 nt, Human
gugcagucuuggcucacugcaaccuccaccuccugggcucaagcgauucucaugccucagccu

SEQ ID NO: 293688 - RNA, 63 nt, Human
ucaucuguccuggccauucaggcaacuccagccugggcucaauccuggaguucugucugguca

SEQ ID NO: 293689 - RNA, 63 nt, Human
uugaaaugaggagacaauccuggguuauccuugugggcucaguuuaaucacaagaaggaggca

SEQ ID NO: 293690 - RNA, 63 nt, Human
cuuauuuaaggcacuguauuuaauuggauuuccugggcucaucauuguuuaaacugaagacca

SEQ ID NO: 293691 - RNA, 63 nt, Human
acaaaagaggguuuccucacuccuuuuacucacugggcucaugacagugaaggagaugcucca

SEQ ID NO: 293692 - RNA, 63 nt, Human
caugccugccuucugcucccuccccagcugguuugggcucaaauugucccuggagacuagggu

SEQ ID NO: 293693 - RNA, 63 nt, Human
gcauggucaaggcucacugcagcuucaaucuucugggcucaaguaauccuuccaccucagccu

SEQ ID NO: 293694 - RNA, 63 nt, Human
aagggaucagagucugacugucacucagaauccugggcucaguugcuugacaaccuugggaaa

SEQ ID NO: 293695 - RNA, 63 nt, Human
gcaugaacacaacgcacugcagccucuaccuccugggcucaagcaguccucccaccucagucu

SEQ ID NO: 293696 - RNA, 63 nt, Human
uucacuauguugccuaagcuggucucaaacuccugggcucaagcgauccucccaccucagcuu

SEQ ID NO: 293697 - RNA, 64 nt, Human
ggcgguaccuguguuucccuucgaaagccucucaguacagcacuccuguuccucuguuaaaacu

SEQ ID NO: 293698 - RNA, 64 nt, Human
cgugcuuuuguugaggcaucuuccagaauguaagguacagcagcuccgguuucuauuauuguga

SEQ ID NO: 293699 - RNA, 64 nt, Human
cuacaguuuuucacauggaauuccguuuucugagguacagcacauuuuagguaacaguauuuaa

SEQ ID NO: 293700 - RNA, 63 nt, Human
uuaugugguuuagggcucagagcuccaaaacucugggcucagcugcuccuguaccuuggaggu

SEQ ID NO: 293701 - RNA, 56 nt, Human
cugagucucugaggaggugaucaggcugggcucagcucagcucuccuccucuagcu

SEQ ID NO: 293702 - RNA, 63 nt, Human
agggugugagucgugugcugugucucaugcaugugggcucauucucuccaagcugcuuuucau

SEQ ID NO: 293703 - RNA, 63 nt, Human
ucccaccucgaggcucuucuuccugccacccuuugggcucagaggaggguggcuuuuuucgag

SEQ ID NO: 293704 - RNA, 63 nt, Human
cacacacugaaggccugaggaagacugaggacaugggcucagugguggcuucccagucauggu

SEQ ID NO: 293705 - RNA, 63 nt, Human
gauuuagagccuagaugagcuuaggauagagagugggcucauuggccuaaauaaaaagagaag

SEQ ID NO: 293706 - RNA, 63 nt, Human
ggagggacugggaugagagaaagugggaccuggugggcucaaccacacacaccugucugugca

SEQ ID NO: 293707 - RNA, 63 nt, Human
uuuacugaggauuaaaauaaaaaaccguaggaaugggcucaacagugaacaaagcacaccaga

SEQ ID NO: 293708 - RNA, 63 nt, Human
gacccccacccuggcauacuacacagaucacucugggcucacuugccugccuaauggucaucu

SEQ ID NO: 293709 - RNA, 63 nt, Human
gagcgaucaccgcucacugcagucgcgaccuccugggcucaagcgauccuccugccucaaccu

SEQ ID NO: 293710 - RNA, 63 nt, Human
gcacaaucucggcucacugcaaccucugccuucugggcucaagcaauccucccacuucaaccu

SEQ ID NO: 293711 - RNA, 63 nt, Human
ucuucggccagcgcagaccugguguuuguuuguugggcucacgcuugcacaaugaaggcuugu

SEQ ID NO: 293712 - RNA, 63 nt, Human
uuuacuaugcuguccagacuggucuuaaacuccugggcucaagugaucccccugccuuggccu

SEQ ID NO: 293713 - RNA, 63 nt, Human
auugggcugguuaggcccagcaccacacugaagugggcucagugguuuuuggagugaagaagc

SEQ ID NO: 293714 - RNA, 63 nt, Human
gugucaucaaagcucagugcagccuccaacuccugggcucaauacucuugccucagccuccuc

SEQ ID NO: 293715 - RNA, 63 nt, Human
gcucugaggcuucuuucuccucgcccgcuccccugggcucagcucggacgcugcaguuauuga

SEQ ID NO: 293716 - RNA, 64 nt, Human
gucauauaggaauuuuuuucugucuuuucccuguguacagcaaacugaggaagaaagaucauua

SEQ ID NO: 293717 - RNA, 64 nt, Human
caggaaacagcaaaggcuagcuuuaggagagaaaguacagcaccugguguuuuuauuuaugaga

SEQ ID NO: 293718 - RNA, 64 nt, Human
uuuaaacucaauguaaaauguuauauaugcaucaguacagcauuuucaacauauuggcaacaua

SEQ ID NO: 293719 - RNA, 63 nt, Human
auuggaaacaaauggaaagccugucgggacuucugggcucagaaccagcuggcucacgcacuc

SEQ ID NO: 293720 - RNA, 63 nt, Human
gagcuggcagggacacacugccuuuggggcuccugggcucauuuggaugggcaagauucgcug

SEQ ID NO: 293721 - RNA, 63 nt, Human
aucuucuagccuuaugaccaggaaccuuuguuuugggcucaaguacacauccugauuugguuu

SEQ ID NO: 293722 - RNA, 63 nt, Human
ggauucugaaacuuaagucuuacauauuuuuugugggcucacuaaguguucugcuguguuuca

SEQ ID NO: 293723 - RNA, 63 nt, Human
ggagcugggacugugggcucgccuuuucguaccugggcucaggugcgguguggccaccgccac

SEQ ID NO: 293724 - RNA, 63 nt, Human
ggaaaagcaugucuuauuuaaaacuguaauuuaugggcucaggaucugaccgcagucccggga

SEQ ID NO: 293725 - RNA, 63 nt, Human
agggucuugauauuuuuuugggacaggguuaccugggcucaagugauccuucugccucagccu

SEQ ID NO: 293726 - RNA, 63 nt, Human
ggauugcuugagcccagaacuucaagaugagccugggcucauagugagaacccaucuauacaa

SEQ ID NO: 293727 - RNA, 63 nt, Human
cuguaaaugcgggcucaguggaccacuggugacugggcucaugccuccaagucagaguuuccc

SEQ ID NO: 293728 - RNA, 63 nt, Human
gccccugggggcccacgacucaccuggugggccugggcucagcaaacagcccucccucccagu

SEQ ID NO: 293729 - RNA, 63 nt, Human
guggcaugaucuuggcucacuucagccuugacuugggcucaagugauccuccuaccugagccu

SEQ ID NO: 293730 - RNA, 63 nt, Human
guacagucacggcucacaaaagccuugaccuccugggcucaggugauccucccaccucagccu

SEQ ID NO: 293731 - RNA, 63 nt, Human
gcaccaucuuggcucacugcagccucugccuccugggcucaaacaguccucccaccucagccu

SEQ ID NO: 293732 - RNA, 63 nt, Human
caagggaagacaucaagacuggacuugaacuccugggcucaagccaucccccaaccuuggccu

SEQ ID NO: 293733 - RNA, 63 nt, Human
cauguuccaagcaaaaucuccccgccugggccaugggcucacccucggggcucccuucuucuc

SEQ ID NO: 293734 - RNA, 63 nt, Human
ucuugccauguuacccaggcuggucucaacuccugggcucaagcgauccuccugccucagucu

SEQ ID NO: 293735 - RNA, 64 nt, Human; identical to SEQ ID NO: 229554

SEQ ID NO: 293736 - RNA, 64 nt, Human; identical to SEQ ID NO: 229555

SEQ ID NO: 293737 - RNA, 64 nt, Human; identical to SEQ ID NO: 229556

SEQ ID NO: 293738 - RNA, 63 nt, Human
gggaggagguggcacuguguuaguugacaguugugggcucauguagucuuuuuugccaugagu

SEQ ID NO: 293739 - RNA, 63 nt, Human
uauuuuagugauuauuauuuuauuaaaggggucugggcucacugccuggugaaguuucaagug

SEQ ID NO: 293740 - RNA, 63 nt, Human
accuggauaaagcccauaagcugggucucaggcugggcucagcaaaggacucgccuugcaacc

SEQ ID NO: 293741 - RNA, 63 nt, Human
agagaagauggugccaaggcugucuuuguauaaugggcucaaauucucuaccucuucagggcu

SEQ ID NO: 293742 - RNA, 63 nt, Human
gcgcgaucuccgcucacugcaagcucugccuccugggcucacaccauucuccugccucagccu

SEQ ID NO: 293743 - RNA, 63 nt, Human
uuucccauguugcucaugcuggucucaaacuccugggcucaagcaauccacccaccucugccu

SEQ ID NO: 293744 - RNA, 63 nt, Human
ggucucagcggcagguggaggagagcaggaugcugggcucaagcgcuuggcguguggaucucu

SEQ ID NO: 293745 - RNA, 63 nt, Human
guuucccaguuguugacugugacaggcucagcaugggcucagcagaugcugucuuaauuugug

SEQ ID NO: 293746 - RNA, 63 nt, Human
uucaccauguugcccaggcuggucucaaccuccugggcucaagcaauccuccugccucggccu

SEQ ID NO: 293747 - RNA, 63 nt, Human
gcgcaaucucggcucacugcaaccucugccuccugggcucaagcaauucucccaccucagccu

SEQ ID NO: 293748 - RNA, 63 nt, Human
agguccgugggacccauguuagagcagaaaauuugggcucagcacauuuuacuguuaguagag

SEQ ID NO: 293749 - RNA, 63 nt, Human
ggcauagcucuggggugggcaguuuuuugaaaaugggcucaaccagaaaagcccaaguucaug

SEQ ID NO: 293750 - RNA, 63 nt, Human
gcuaaaacucuccaggggcagguaaagcccugcugggcucagaagcacuauagaauuugcugu

SEQ ID NO: 293751 - RNA, 63 nt, Human
gcagcaaaagagccauguucaaaauagucauuaugggcucaaauagaaagaagacuuuuaagu

SEQ ID NO: 293752 - RNA, 63 nt, Human
cauuuugaacuuugaggacuguuggucagaaaaugggcucaaaagugaguuugcuuaaugaag

SEQ ID NO: 293753 - RNA, 63 nt, Human
ccauugaaugaucagcauguugacaucauugucugggcucaacaggaugucaaauaauauuuc

SEQ ID NO: 293754 - RNA, 64 nt, Human
ugcuuuucacguuauaaaauguuuauauuuaccaguacagcacugggcuuuauaaagacugcac

SEQ ID NO: 293755 - RNA, 64 nt, Human
auacaucauccgcagccugggaaccuucucccucguacagcacaggaaccugacacauaguagg

SEQ ID NO: 293756 - RNA, 64 nt, Human
cauucguccacuaagggaacagccucagaaacugguacagcaaugggugagaugagaucaugga

SEQ ID NO: 293757 - RNA, 63 nt, Human
gcgacccagcuucccuccacuuccagguggugcugggcucaccgagggagcacuggugggugc

SEQ ID NO: 293758 - RNA, 63 nt, Human
gcaggaacccuuuccaaaagcccagagaugcccugggcucagaucuguaauucucccaggagc

SEQ ID NO: 293759 - RNA, 63 nt, Human
gcaaaccaguuaaaccuaacacccugccuugucugggcucaucaccucucccuaucccagacu

SEQ ID NO: 293760 - RNA, 63 nt, Human
guggcagcauugucccacuucagaugccaggagugggcucauccuagaggagcggaguuuucc

SEQ ID NO: 293761 - RNA, 63 nt, Human
cacugacauaccuaccuucaagaugaguucaggugggcucaguucuggggcuugggaaaaggg

SEQ ID NO: 293762 - RNA, 63 nt, Human
ccaacaggcccuugguagagcuggugccagaugugggcucagauccugggcaugaugggccga

SEQ ID NO: 293763 - RNA, 63 nt, Human
aaaacagagccauucccuuggaaugcauaucgcugggcucaacauagaguuugucuuccucuu

SEQ ID NO: 293764 - RNA, 63 nt, Human
cuugguauguugcccagacuguucggaaacuccugggcucaagugauccuuccaccucagccu

SEQ ID NO: 293765 - RNA, 63 nt, Human
ggcgugaucucaguucacugcugcuuucccuccugggcucaagcaguucucccaccucagccu

SEQ ID NO: 293766 - RNA, 63 nt, Human
ggcauaauuuuuacaguugcagagaauuguuucugggcucauuaaaaaaaguaguauugcaga

SEQ ID NO: 293767 - RNA, 63 nt, Human
gacagugaauccagcaacucaguggauccaagcugggcucagaggucggaaggaggguagagc

SEQ ID NO: 293768 - RNA, 63 nt, Human
cuugcuauguuguccaggcuggccuugagcuccugggcucaagcaauccucccaccucagccu

SEQ ID NO: 293769 - RNA, 63 nt, Human
agugauuuuuuuguccuucagccaaacacaauaugggcucaagucacuuuuauuugaaauguc

SEQ ID NO: 293770 - RNA, 63 nt, Human
cucacuauguugcucaggcugaucucgagcuccugggcucaagugauccucccaccucagccu

SEQ ID NO: 293771 - RNA, 63 nt, Human
uggaaauaaguguuuugcuuuugucugauggucugggcucauuuuuauguuuauuuuagaaaa

SEQ ID NO: 293772 - RNA, 63 nt, Human
cuuauuauauuguccaggcuggucuugaauuccugggcucaagcuucccaaguagcugcaaca

SEQ ID NO: 293773 - RNA, 64 nt, Human
ucccuucacuuaucagcauacuauuguagaaaguguacagcauacugacucaauucuuaagucu

SEQ ID NO: 293774 - RNA, 64 nt, Human
cggaauaauaaaaagcauuuggugccuauuugaaguacagcauaagggaaucccuuguauaugc

SEQ ID NO: 293775 - RNA, 64 nt, Human
caggaaggucaagacgcucuccaaagggcaggaaguacagcacuuccgaagaguuuaguuggcc

SEQ ID NO: 293776 - RNA, 63 nt, Human
guagaaacaaaguccaggcuggucuugaacuccugggcucaagcauuucuccuaccucggccu

SEQ ID NO: 293777 - RNA, 63 nt, Human
ccuggcaagaucucugauuucauaauacuuuuuugggcucauguaguggaauuaaauauaccu

SEQ ID NO: 293778 - RNA, 63 nt, Human
auuauaacacuguaguggaacauucuucugcauugggcucacugcguguuaccuaagacguau

SEQ ID NO: 293779 - RNA, 63 nt, Human
uauauuuuauuaugcaaugccuuagucauaaacugggcucaaacaauucucagccuaaaacac

SEQ ID NO: 293780 - RNA, 63 nt, Human
uugcaaucacagcucacugcagccucaaacuccugggcucaagugauccucccaccucugccu

SEQ ID NO: 293781 - RNA, 63 nt, Human
aauaaaccacuuacuguaaaauuucagaaauugugggcucauucccucccucuaguuuauuua

SEQ ID NO: 293782 - RNA, 63 nt, Human
ucuuucucccagcuucaaaugcaaauucaucauugggcucacuucuaauaacugcaguguuuc

SEQ ID NO: 293783 - RNA, 63 nt, Human
gguugaucauggcucacugcauccuugacuuccugggcucaagugauccaccucagccugccu

SEQ ID NO: 293784 - RNA, 63 nt, Human
ucacuauguugaccaagcuggucuuggaacuccugggcucaagugauccuccugccuuggccu

SEQ ID NO: 293785 - RNA, 63 nt, Human
ugucuauuuuccuuucaaaauugguauuuuuguugggcucaauuuucauuauaauacuuuucu

SEQ ID NO: 293786 - RNA, 63 nt, Human
gcacaaucuuggcucacugcaaccucugccuccugggcucaacggauccuuccaccucagccu

SEQ ID NO: 293787 - RNA, 63 nt, Human
uuugccaaguugcccaggcugaucuugaacuccugggcucaagccauccucccuccucagccu

SEQ ID NO: 293788 - RNA, 63 nt, Human
gcaggaucucagcucacugcaaccucugccuccugggcucaagagaccagcccaccuccgccu

SEQ ID NO: 293789 - RNA, 63 nt, Human
guuugaugauagcuuacugaagcuucccacuccugggcucaaguuauccuuccauuuuggccu

SEQ ID NO: 293790 - RNA, 63 nt, Human
acaacuucugaaacacacaccagcccugaguucugggcucauuugaagccuggaauagcaaua

SEQ ID NO: 293791 - RNA, 63 nt, Human
cuucugaagucucaggcuuagaaguuaccaaagugggcucagaaacugucaucuccugguucc

SEQ ID NO: 293792 - RNA, 64 nt, Human
aggaaguggucaugggcuaccaugugucuccaugguacagcaaaguaguuucaguauuuucccc

SEQ ID NO: 293793 - RNA, 64 nt, Human
gugauagaauaaaaauauguuaccugcaguguaaguacagcacacugucaaauucuuuuccuua

SEQ ID NO: 293794 - RNA, 64 nt, Human
cacuguaccuacuagguuccuccugaggguucagguacagcaaggagagcuccaucccccacag

SEQ ID NO: 293795 - RNA, 63 nt, Human
ucccuucucuuaccuguacagugagaugcucagugggcucaauccuccacuacaggucccggu

SEQ ID NO: 293796 - RNA, 63 nt, Human
ucugaguaagacucgugccucccccugcugcccugggcucaggcugcuacccucuggggccca

SEQ ID NO: 293797 - RNA, 63 nt, Human
gcgcaauccuggcucacugcagccucuaauuccugggcucaagucaagugguucuccugccuc

SEQ ID NO: 293798 - RNA, 63 nt, Human
gccugaucauagcucacuucagccuccaacuccugggcucaagcaauccugcugucucagccu

SEQ ID NO: 293799 - RNA, 63 nt, Human
guacaaucacaacucaccguagccucaaacuccugggcucaagugauucucccaccucaggca

SEQ ID NO: 293800 - RNA, 63 nt, Human
uucaucauguugcccaggcuggucuugaacuccugggcucaagccaucugccugccuccaccu

SEQ ID NO: 293801 - RNA, 63 nt, Human
gauuuuccauuguauccucuuuuugguagaugcugggcucaucuucuagaaucucguuucucc

SEQ ID NO: 293802 - RNA, 63 nt, Human
uaauacagaguguguucgcacuuagccaugggcugggcucaagaaccugauaccuggguugau

SEQ ID NO: 293803 - RNA, 63 nt, Human
cugugggacaaagcacugcugaugaaguccccgugggcucauccgggcuggaauucuugguuu

SEQ ID NO: 293804 - RNA, 63 nt, Human
cagagggucucaggaaggucuggaggucacagcugggcucacagaagcucuugggcccuggca

SEQ ID NO: 293805 - RNA, 63 nt, Human
guggcacgaucauagcucacugaaguuucgaccugggcucaagcaauccucccgcuucagccu

SEQ ID NO: 293806 - RNA, 63 nt, Human
cuugcucuguugccuaggcuggucuugaacuccugggcucagaugauccuccuguccucagcc

SEQ ID NO: 293807 - RNA, 63 nt, Human
uccugggugugaguguuccuguguaacaagaacugggcucaacgguccagcuguuucuaugga

SEQ ID NO: 293808 - RNA, 63 nt, Human
gcaugaucaugguucacuucaaccccuaccuccugggcucaaguguuccucucaccuuauccu

SEQ ID NO: 293809 - RNA, 63 nt, Human
uucucuguguugcccagucuugucucaaacuccugggcucaagcgauccacccaccuugggcu

SEQ ID NO: 293810 - RNA, 63 nt, Human
gugaaaucauagcgcacugcagccuugaacuccugggcucaagcgauccucccaccucagccu

SEQ ID NO: 293811 - RNA, 64 nt, Human
aaguacugggcuuauauuucauuggaauacauguguacagcaauaagcagguuuccaaauccgg

SEQ ID NO: 293812 - RNA, 64 nt, Human
ggcauuuuugaaaaggcugauuauguguaucaagguacagcaucguaggguuccccuaaacuug

SEQ ID NO: 293813 - RNA, 64 nt, Human
guuuuuaaauuuaaauucagagguuauaaaauguguacagcauuuuuaagugaaaauuaguacu

SEQ ID NO: 293814 - RNA, 63 nt, Human
gugcaaucauagcucauugcagccuucaauuccugggcucaggcaauccuccugccucagccu

SEQ ID NO: 293815 - RNA, 63 nt, Human
gugaaggagcccauucgggugggagacuucagaugggcucaguaccugucccagccacaggcu

SEQ ID NO: 293816 - RNA, 63 nt, Human
gcaugggaugcuccaggaggucugggguaccagugggcucagaugaagcucuugugcucaugu

SEQ ID NO: 293817 - RNA, 63 nt, Human
uggcaguagaggcuauggacagggcaugccacgugggcucauauggggcugggaguaguuguc

SEQ ID NO: 293818 - RNA, 63 nt, Human
uggcacacuguguggugaccauggucaucauagugggcucacggcggaaacgggaucauucaa

SEQ ID NO: 293819 - RNA, 63 nt, Human
gacagacuagauuauauuuaguaggggaaaaauugggcucaagaaccauucaucaguacguga

SEQ ID NO: 293820 - RNA, 63 nt, Human
cucccuauguugcccaggcagaucucagacugcugggcucaagcgauccucacaccucagccu

SEQ ID NO: 293821 - RNA, 63 nt, Human
gcauagucuucacucacuguaaucuccagcuccugggcucaagugauccucuagacucagccu

SEQ ID NO: 293822 - RNA, 63 nt, Human
uccaucauauacagcucucugcuccguguccccugggcucaagucaagcagucggugacagau

SEQ ID NO: 293823 - RNA, 63 nt, Human
cugucacccaggcuggaguguaguggcaugaucugggcucacugcaaccuccuccuccuggau

SEQ ID NO: 293824 - RNA, 63 nt, Human
auuacccucucagcaugcuugcagagagcugggugggcucauucuugcagucauacugcuuau

SEQ ID NO: 293825 - RNA, 63 nt, Human
gugggagcaaaugggucacaaauagcucagcugugggcucagaaacugcuagguaaaagaauu

SEQ ID NO: 293826 - RNA, 63 nt, Human
ggaacacacaucauccccaccccucccccagcgugggcucaccauucuuaguccuuucucaag

SEQ ID NO: 293827 - RNA, 63 nt, Human
cccuagucucugcaccuccuuaggcccugccucugggcucagaccccaaccuagucaagggga

SEQ ID NO: 293828 - RNA, 63 nt, Human
acacaguccaccuuucggccggccagccugaucugggcucagcauguuuggggucagucagug

SEQ ID NO: 293829 - RNA, 63 nt, Human
gcacaaucauugcucacuguaaccucgaauuccugggcucaagcaacccucccaccuuagccu

SEQ ID NO: 293830 - RNA, 64 nt, Human
ccuuguugcaaauauuuuucuccuauagcaguaaguacagcauuagaaggugauuagagagucu

SEQ ID NO: 293831 - RNA, 64 nt, Human
aauaacuccuuagagaccaaugucuguagcagguguacagcaucuugugaaaguuauggagcau

SEQ ID NO: 293832 - RNA, 64 nt, Human
cacagauugguauaauggagaagaugguuuagguguacagcaaauuuaaaauagucaguggauu

SEQ ID NO: 293833 - RNA, 63 nt, Human
gcaugaucauagcucauuguaaccucaaacuccugggcucaagagauccuuuugcuucagccu

SEQ ID NO: 293834 - RNA, 63 nt, Human
cccuggccccagcguccccugccagcauccucgugggcucacagaccccggccucggagcccg

SEQ ID NO: 293835 - RNA, 63 nt, Human
caaugcaaugcaucccaaugguuguggggauugugggcucaacucaagagaaguuuaggaggg

SEQ ID NO: 293836 - RNA, 63 nt, Human
cuaaggaugggaggggaacuugguuuaucugggugggcucagugaccccuuggaauggcugag

SEQ ID NO: 293837 - RNA, 63 nt, Human
aggaagccgucgcggggaccaugcugccuucucugggcucacgacuguucuggaaaggacccc

SEQ ID NO: 293838 - RNA, 63 nt, Human
guagcuccaaucucccugacugcaccucaggguugggcucagggcuugcggccugcaggcacu

SEQ ID NO: 293839 - RNA, 63 nt, Human
ccauagacugccccacuuaaacucuugucagucugggcucaggguucccagagcucauucccc

SEQ ID NO: 293840 - RNA, 63 nt, Human
aauuuugccuagugcuuuuucucuaccugcccuugggcucacuaauaucaccaguauuauuac

SEQ ID NO: 293841 - RNA, 63 nt, Human
uucacuauguugcccaggcuggucucaaacuccugggcucaagcaauccuccugccucagcuu

SEQ ID NO: 293842 - RNA, 63 nt, Human
cgccacccaguggaaggacacucuuggcucguuugggcucaaggcaccgcagccugucagcca

SEQ ID NO: 293843 - RNA, 63 nt, Human
cacguucuaguuguucggagaaagccuagguucugggcucagguccagaugcagcggggauuc

SEQ ID NO: 293844 - RNA, 63 nt, Human
agaacaagcugugugucaucacagauuguacugugggcucagaaaccgugagagagcccccac

SEQ ID NO: 293845 - RNA, 63 nt, Human
agcuugugacuguuaguagugcaaggauuuguaugggcucagugauuacaaacaaagacaugc

SEQ ID NO: 293846 - RNA, 63 nt, Human
uucuuaaacugagacguggcucugcaggucuccugggcucauuccauggugugguauguuuau

SEQ ID NO: 293847 - RNA, 63 nt, Human
gggcaaaggggcaugauccagggucccccagggugggcucagcuccagggagaggccacccac

SEQ ID NO: 293848 - RNA, 63 nt, Human
gaggaggggcagagccaggaggcaguggggcugugggcucagagcucaggagucgccuuaccu

SEQ ID NO: 293849 - RNA, 64 nt, Human
aauuaauaaaaaauggaaagaaucuaauagagugguacagcacuguuauuuuucaaagaugugu

SEQ ID NO: 293850 - RNA, 64 nt, Human
gcugggcauuuucccagauguuuacagacugugaguacagcagaaaaucuuuuacuagugugug

SEQ ID NO: 293851 - RNA, 64 nt, Human
gugcucuuggagaguuucaggccugugcauguguguacagcaggagguaauaugcuauaauguc

SEQ ID NO: 293852 - RNA, 63 nt, Human
cccaccauguugcccaggcuggugucaaacuccugggcucagucaguccccccaucucacccu

SEQ ID NO: 293853 - RNA, 63 nt, Human
agucauggcucacugcagcuuaagcucacugccugggcucaagugaucuuacuccagccuccc

SEQ ID NO: 293854 - RNA, 63 nt, Human
ucagggcuuacugcagccucacccucgauuuccugggcucaagcaauccucccaccucagccc

SEQ ID NO: 293855 - RNA, 63 nt, Human
gcaugaucauagcucacugcagccucauacuccugggcucaagcaauccuccugccucagccu

SEQ ID NO: 293856 - RNA, 63 nt, Human
gccccagcuccguuucuaccaccgcauccucacugggcucacugcaggcaugcugaacaaggg

SEQ ID NO: 293857 - RNA, 63 nt, Human
uaugucauaucccaagugaacuugagcccuguuugggcucaggagauagaagacaaaaucugu

SEQ ID NO: 293858 - RNA, 63 nt, Human
acaguugaacguuagugaaucuugagccucauuugggcucagggcagagcagguguuuaucug

SEQ ID NO: 293859 - RNA, 63 nt, Human
aaauuaccaaacucaaagcuuauuugaguagaaugggcucaugggcaaugugauguucccugu

SEQ ID NO: 293860 - RNA, 63 nt, Human
ugcuaaccacagggccugagaagucuugcuuuaugggcucaagaaugccaugcgcuggcagua

SEQ ID NO: 293861 - RNA, 63 nt, Human
gcugggaccgauucggugacggcccaaggaagcugggcucagggcucgccucucccgccucga

SEQ ID NO: 293862 - RNA, 63 nt, Human
gaagauuuucuucuuauuuaaugugguuuauuuugggcucagaaauaauugcucuguugaaaa

SEQ ID NO: 293863 - RNA, 59 nt, Human
ccagaucauuuuauuggugacuucacuuuugggcucaaggacugugugaaccaacaagg

SEQ ID NO: 293864 - RNA, 63 nt, Human
uuguuuuuaauacaugauucucuaugaaauugaugggcucaaacuagcugugaaucuucugag

SEQ ID NO: 293865 - RNA, 63 nt, Human
gucagaaugugaaaaaggaauaaaaaauacuguugggcucaaacuaaauucaaagaaguacuu

SEQ ID NO: 293866 - RNA, 63 nt, Human
acuaacuuguucacuggauugucugggaugacuugggcucauauccacaauacuugguauaag

SEQ ID NO: 293867 - RNA, 63 nt, Human
acauccugucuucccagagaagguggacacucuugggcucauuguaaagugccugcugcauca

SEQ ID NO: 293868 - RNA, 64 nt, Human
uuuucacucacuauuucacuuuauuaagaugacuguacagcaauuuguauauaaagcuuaugau

SEQ ID NO: 293869 - RNA, 64 nt, Human
uaaucucugcacuggucauuugagaauuuuuuuuguacagcauucaugugugauauuuuccaga

SEQ ID NO: 293870 - RNA, 64 nt, Human
caugacauugggcauuggucaaaacccauagcauguacagcacaaagcguuugcucuaauguga

SEQ ID NO: 293871 - RNA, 63 nt, Human
uucacacugagaagucauuucuggcuacuuccuugggcucaguucccugggucaucagccauc

SEQ ID NO: 293872 - RNA, 63 nt, Human
aaggagaaccaugcaugaacaguaucagucgucugggcucaugcugggaugucgcagugcucc

SEQ ID NO: 293873 - RNA, 63 nt, Human
aauucuagcuuuuuuccuccuuucucuguauauugggcucagagaguacacugugucucuaug

SEQ ID NO: 293874 - RNA, 63 nt, Human
cuuggggucccccucaaaccugugucuggggugugggcucacagaucccuaucagccugguuc

SEQ ID NO: 293875 - RNA, 63 nt, Human
accuacuccucccccuccuccaugcugucccugugggcucacaccggcacugugcacucuacu

SEQ ID NO: 293876 - RNA, 63 nt, Human
gucacugcccccgcacucccacagggcucaggcugggcucagaggccacugagaugccagcuc

SEQ ID NO: 293877 - RNA, 63 nt, Human
cugcuccccccauuugcugacguagugcucucaugggcucaccugggcccaaggcacagccag

SEQ ID NO: 293878 - RNA, 63 nt, Human
uccuaccacugagcgccuuugccagguccagccugggcucagguuccaagacucagcugccua

SEQ ID NO: 293879 - RNA, 63 nt, Human
acacccgcuucuggacgucggggacccagcgguugggcucaggccacaacggccugagauugc

SEQ ID NO: 293880 - RNA, 63 nt, Human
gcaugaucauagcucauugcauccuugaaauccugggcucaggugauccucccgccugagccu

SEQ ID NO: 293881 - RNA, 63 nt, Human
guugauuucccuuuggacauucucagcaaauucugggcucagucuuuuugaucgccacuucuu

SEQ ID NO: 293882 - RNA, 63 nt, Human
gggcgcccggccccacucuccggaucuggacgaugggcucacgccaggaacgccgguuccccc

SEQ ID NO: 293883 - RNA, 63 nt, Human
ucagcaccuaggccaggguggggccgccgcagaugggcucaggaagccccaggugcacucagc

SEQ ID NO: 293884 - RNA, 63 nt, Human
gccagcaugaccuggggcuugguuucccugcccugggcucaguggcacugcugagcugcagca

SEQ ID NO: 293885 - RNA, 63 nt, Human
caauccucccagaaagcaaaccuguaagugucuugggcucagggaccauggcuuguagcccuu

SEQ ID NO: 293886 - RNA, 63 nt, Human
ccguugggacggcgggugccuggagggcagcucugggcucagcgggcagugcuuagagcacag

SEQ ID NO: 293887 - RNA, 64 nt, Human
uucuaaauucuuguaucagauccaaagcucuauuguacagcaaauuauucuucaaaaugauuau

SEQ ID NO: 293888 - RNA, 64 nt, Human
agaaauaacuaguagaaaguucugggugugagguguacagcagucuagguggcauagugaugaa

SEQ ID NO: 293889 - RNA, 64 nt, Human
agcuuuuuuuuuuuccauauaccugauagucuguguacagcauuguuuugucugggaagcaggg

SEQ ID NO: 293890 - RNA, 63 nt, Human
ccaggagaccacggggagcaaaccagcuuguucugggcucagggagggagggcgguggacaau

SEQ ID NO: 293891 - RNA, 63 nt, Human
uaauucuccgcaccucgguugugugcuuccgaaugggcucacucccguggugguguuugagag

SEQ ID NO: 293892 - RNA, 63 nt, Human
ugcgaucgcggcacacugcagccuuggcuucccugggcucaagcaguccucccaccucagucu

SEQ ID NO: 293893 - RNA, 63 nt, Human
gcuggaggggaagaggggccccgaggaugggccugggcucagcauucgagaucuugagaauga

SEQ ID NO: 293894 - RNA, 63 nt, Human
gggagggggagauauaaggagacaccuucuuucugggcucaaguauccugccacucugucaug

SEQ ID NO: 293895 - RNA, 63 nt, Human
gcccaggccccgggcaccuccugcaaccaucucugggcucagcaccugaggcggguuuccugg

SEQ ID NO: 293896 - RNA, 63 nt, Human
uggcauaaucacagcucacugcaaccucaauccugggcucaagugauccucccgcuucagccu

SEQ ID NO: 293897 - RNA, 63 nt, Human
ucuuucucccaggcagggcucugcagguccauaugggcucaaugucaccacccucugcauggc

SEQ ID NO: 293898 - RNA, 63 nt, Human
ggguggaacaggcaugugacagaguggggagccugggcucagcuccucccccugccguugguu

SEQ ID NO: 293899 - RNA, 63 nt, Human
ccaaaaaaauggaucuguugcaguggugcaaucugggcucacugaaaccaccacccagguuca

SEQ ID NO: 293900 - RNA, 63 nt, Human
gaggccuuggcaucuugcaguugcugucagagaugggcucauaucugcuuggggaagccaaug

SEQ ID NO: 293901 - RNA, 63 nt, Human
uuccagcggucaggacugaccccggggcagcacugggcucaggcuucagcgcgacuguccgca

SEQ ID NO: 293902 - RNA, 63 nt, Human
uuggccucggcccugguucccucccuccugcucugggcucagauacugugacaucccagaagc

SEQ ID NO: 293903 - RNA, 63 nt, Human
uuaguuggauccuccacaucuugcauauauacaugggcucaauuauuauguuugucaggauaa

SEQ ID NO: 293904 - RNA, 63 nt, Human
aagccuguaaagaauuguuugggcucuaaaaguugggcucaugguggcaauauccuuuuaaug

SEQ ID NO: 293905 - RNA, 63 nt, Human
ugugggcuagaaugccugcacauuuaguuaaacugggcucagcaugcuuguccucaaaauguc

SEQ ID NO: 293906 - RNA, 64 nt, Human
gaaaaaggcaauaaugauagaaauuauuucuuagguacagcaauaguugauaggaugugagggu

SEQ ID NO: 293907 - RNA, 64 nt, Human
gguaaauacugucccacucagcucugcuggcgcaguacagcagcagcagccccagcacagcugu

SEQ ID NO: 293908 - RNA, 64 nt, Human
gggaauaauuuauaccaucuuuucagacaagaauguacagcaaaaauaaggggaacaguaguau

SEQ ID NO: 293909 - RNA, 63 nt, Human
cuucccagucccgccagccuggggcauccuccaugggcucagcacugagaggucuugggucug

SEQ ID NO: 293910 - RNA, 63 nt, Human
ugaucucgcagcucuccagggcagaagucgcggugggcucagugggugcccugagcggggucu

SEQ ID NO: 293911 - RNA, 63 nt, Human
cuggaggcugugcuggggaucugagguuuggucugggcucagugggagacggcagugcaaucc

SEQ ID NO: 293912 - RNA, 63 nt, Human
gccucuguuucuuauuuuaaaauucucugcuacugggcucagucccaggcccuuccuugggcu

SEQ ID NO: 293913 - RNA, 63 nt, Human
aacgucuccgugcagcccccagagagaggcccaugggcucagaccaggcuuuguuguccugcu

SEQ ID NO: 293914 - RNA, 63 nt, Human
caccauguuucaggcuuggggcuggggcaggcuugggcucaauccugggcacccaggggcagc

SEQ ID NO: 293915 - RNA, 63 nt, Human
gguccaccuuggccuguuuuguuuuucuuuccuugggcucagcaauucaaauucuaguuguua

SEQ ID NO: 293916 - RNA, 63 nt, Human
ccuccccuccccagccuuuuccagaaaccauacugggcucagaucagagcuccgaagcgguca

SEQ ID NO: 293917 - RNA, 63 nt, Human
cagacuaccugcccucagcuuggauaaccaggcugggcucagcucagcucccacaaaugacag

SEQ ID NO: 293918 - RNA, 63 nt, Human
uucaccauauugcccaggguggucucaaacuccugggcucaagcgaacugucagccucagccu

SEQ ID NO: 293919 - RNA, 63 nt, Human
cucacuauaaugcuuagacuggucuugaacuccugggcucaagcgauccuccugccccugucu

SEQ ID NO: 293920 - RNA, 63 nt, Human
uucacucucuccuggaaaccaacuguaagcuggugggcucaaccugugggagguuaagaggag

SEQ ID NO: 293921 - RNA, 63 nt, Human
ugaccuugaagugaaagucuucuguugcuauugugggcucaaauauuuggucaugggggaaga

SEQ ID NO: 293922 - RNA, 63 nt, Human
cccuuggcauguaccccaaggccugauggccacugggcucagccugucccccacuccugccug

SEQ ID NO: 293923 - RNA, 63 nt, Human
cucugccaggcaccccacuuucuccuaguaacaugggcucaggggacucagcccuggacagag

SEQ ID NO: 293924 - RNA, 63 nt, Human
cauccugcagcugggacagaggccagcuccuguugggcucaguugagacuaaguaaauuagga

SEQ ID NO: 293925 - RNA, 64 nt, Human
gcuugccuccaccagauguccacaacaauaugaaguacagcagaagccccaagcaacuuuccuu

SEQ ID NO: 293926 - RNA, 64 nt, Human
ccaucagccggguucaggcccuuguaaguuagcuguacagcagaaguuugcugucucuaggauu

SEQ ID NO: 293927 - RNA, 64 nt, Human
ggggcagcgccaaggcggucucgcgcgggacuuuguacagcagugucuuauccagcagccauug

SEQ ID NO: 293928 - RNA, 63 nt, Human
accuggucuucggagcuggguuggccccuucuuugggcucaggaagcagccuuagcacacggg

SEQ ID NO: 293929 - RNA, 63 nt, Human
accugugcuuggcccacagucuggcucaugaugugggcucaguaaugugcgagaaagugaaaa

SEQ ID NO: 293930 - RNA, 63 nt, Human
caaaagcacaaccauucugaaguuacuggagcaugggcucagcucauccucccucuggccccu

SEQ ID NO: 293931 - RNA, 63 nt, Human
auaauaaaaccagguuuguugaucuuuuaguuaugggcucaaagaauuuauucaucucuaaca

SEQ ID NO: 293932 - RNA, 63 nt, Human
gugcaaucucagcucacugcaaacucugucuccugggcucaagugauucucgugccucagccu

SEQ ID NO: 293933 - RNA, 63 nt, Human
guggcuguggccagugucccuuagccaaccugcugggcucaccaguuccccgucugaucugcc

SEQ ID NO: 293934 - RNA, 63 nt, Human
cuugccaugucgcccaggcugaucuugaacuccugggcucaagcaaucugccagccucagccu

SEQ ID NO: 293935 - RNA, 63 nt, Human
aguggagcauggcccucccuggcucccugucccugggcucagcacgaccacacaggacaccca

SEQ ID NO: 293936 - RNA, 63 nt, Human
ugccaagaauggaauuaggcucaggauccagccugggcucacccuguguggcucauucccacc

SEQ ID NO: 293937 - RNA, 63 nt, Human
cuggccccaggccccagccacggcugcagagccugggcucagccccagggagggcagggagag

SEQ ID NO: 293938 - RNA, 63 nt, Human
ugugcacccuuugcucccugcucuuucugccucugggcucauguaucugcgcagcucugguac

SEQ ID NO: 293939 - RNA, 63 nt, Human
uucgccauguugcccaggguggucucaaacuccugggcucaagugauccacccgccuugccuc

SEQ ID NO: 293940 - RNA, 63 nt, Human
uucgccauguuggccaggcuggucucgaacaccugggcucaacugauccgccugccucggccu

SEQ ID NO: 293941 - RNA, 63 nt, Human
aaaaccugcccccaacuguuagucaaucugagcugggcucagcugggcuguucuucugccagc

SEQ ID NO: 293942 - RNA, 63 nt, Human
aacugcuccuuaugugacaaaauagguagcucuugggcucauguccuggguuuuggcucuuua

SEQ ID NO: 293943 - RNA, 63 nt, Human
gcggcccggcgggggcucccuggggaccccagaugggcucagugcugccacccagaucagauc

SEQ ID NO: 293944 - RNA, 64 nt, Human
augguaagcacugaaguauaauaaguaaccuuugguacagcagguuugcugcaguguuuuuuuc

SEQ ID NO: 293945 - RNA, 64 nt, Human
agauauuucguauuucccccacugcuuuuuauuuguacagcaucauuaaacacuaagcucaguu

SEQ ID NO: 293946 - RNA, 64 nt, Human
ucuauugagagcccucucucccauucugugaugaguacagcagagaccuuccugcuuuuuacug

SEQ ID NO: 293947 - RNA, 63 nt, Human
cucccuguguugaccagguuggucucgaacuccugggcucaagcaguccuccugccuuggccu

SEQ ID NO: 293948 - RNA, 63 nt, Human
uacagaugucacagcugaggguacgaugaggccugggcucagugagccaggacgaaugugaca

SEQ ID NO: 293949 - RNA, 63 nt, Human
gucagcgcugugcgcgcggagagaggugcgccgugggcucaagagccugagugggugguuugc

SEQ ID NO: 293950 - RNA, 63 nt, Human
caguuugcuuugaucuucuucaauaugugaauuugggcucacagaaucaaagccuaugcuugg

SEQ ID NO: 293951 - RNA, 63 nt, Human
ggucuugcuauauugcccaggcuggucuugaacugggcucaagugauccucacgccuuggccu

SEQ ID NO: 293952 - RNA, 63 nt, Human
cuugcuauguugcccaagcuaguuucaaacuccugggcucaagcgaugcuccugcuucagccu

SEQ ID NO: 293953 - RNA, 63 nt, Human
gcacaaucauggcucacugcagccccgaacuacugggcucaagccuuccucccgccucagccu

SEQ ID NO: 293954 - RNA, 63 nt, Human
caaaggggauaaucugggaaagacaccaaaucaugggcucacuuuaaaaaaagaaagaauaaa

SEQ ID NO: 293955 - RNA, 63 nt, Human
uuacuuugcuaaauauguauauuuuuauaaaaaugggcucauauugugcauaccauuuuguaa

SEQ ID NO: 293956 - RNA, 63 nt, Human
gcggggguacgagggaggaaggggagcaagacuugggcucacaggcugguuaccucuuugcug

SEQ ID NO: 293957 - RNA, 63 nt, Human
ucccggacccuuccaccccacugggcccaaccaugggcucaggacccuggaauuccguuuucu

SEQ ID NO: 293958 - RNA, 63 nt, Human
cugccgagugauagagcagaaggagguucccaaugggcucagggacgaagcuuguggcaagga

SEQ ID NO: 293959 - RNA, 63 nt, Human
uuuacagauguagaagaaauuuauucaaaagugugggcucaugaaguucacuucagugcagug

SEQ ID NO: 293960 - RNA, 63 nt, Human
aucgcuauguugcucaggcuggucuugaacuccugggcucaagcuauccuccugccucagccu

SEQ ID NO: 293961 - RNA, 63 nt, Human
ggggaagaaccugggcauccuuccccucaagccugggcucauggagccccugcccagggcccu

SEQ ID NO: 293962 - RNA, 63 nt, Human
caggcuucucuuuuuguuuuuuuaccuagaaauugggcucaguggucuucaacuugaggacga

SEQ ID NO: 293963 - RNA, 64 nt, Human
ucaugguccuauaauggauauuauucagaccuuaguacagcaagacacucuggccaccauaaaa

SEQ ID NO: 293964 - RNA, 64 nt, Human
caagaagcuacucuagaagucggagcagaggaugguacagcagaggccgaaccagaagccggag

SEQ ID NO: 293965 - RNA, 64 nt, Human
ucacagcugccagguaccuaagcaagucaguuggguacagcaggacacgccaccauuccagggu

SEQ ID NO: 293966 - RNA, 63 nt, Human
cucauucuguugccuaggcuugucuggaacuccugggcucaagggaucuuguagccuuagccu

SEQ ID NO: 293967 - RNA, 63 nt, Human
guccagcccuaggcuacagcggcucucaugaugugggcucaccugcgccccagacccugcagg

SEQ ID NO: 293968 - RNA, 63 nt, Human
agcuggggcagcugccucccaggggugggacucugggcucagagagaggcccuugagcugcag

SEQ ID NO: 293969 - RNA, 63 nt, Human
uuugccauguuucucaggcuggucuugaacuccugggcucaagcaauucaucccccucagccu

SEQ ID NO: 293970 - RNA, 63 nt, Human
gcacaaucaccacacacugccgcuucaaucuccugggcucaaaugauccuuccaccucagccu

SEQ ID NO: 293971 - RNA, 63 nt, Human
gcaccaucauagcucacugcagccucaaacuccugggcucaagcgauccuccccgcucagccu

SEQ ID NO: 293972 - RNA, 63 nt, Human
cuauuguaguuccuuuaggauuuguaugugcucugggcucaugaagauauugcaucaugagcu

SEQ ID NO: 293973 - RNA, 63 nt, Human
cucuuguccaggcuggagugcaauagcgcgaucugggcucacugcaaccuccgccucccuggu

SEQ ID NO: 293974 - RNA, 63 nt, Human
uuguuccagguggccauagucagucaccaugugugggcucagggacccccaggaccaggaugu

SEQ ID NO: 293975 - RNA, 63 nt, Human
uuguaaacauuacuugauuuuuuaaagaaguuuugggcucacugcuaaaauagaguauacaac

SEQ ID NO: 293976 - RNA, 63 nt, Human
cuaugguaguucccuuaggauuuguaugugcucugggcucaugaagauauugcaucaugagcu

SEQ ID NO: 293977 - RNA, 63 nt, Human
augcuaucauagcacacuacagccuacaacucuugggcucaagcaucacgccuagcaguuucu

SEQ ID NO: 293978 - RNA, 63 nt, Human
gcuggggcuugagcuugagcuugggcuuaggcuugggcucagcuuuugacccucaggcaucuc

SEQ ID NO: 293979 - RNA, 63 nt, Human
augacaaacugccuccuggcuuggagggaucuuugggcucauggaugaauggcgagccaccug

SEQ ID NO: 293980 - RNA, 63 nt, Human
augacaggacagacugguggugaggagucuaagugggcucaguuugaugucagugucugggcu

SEQ ID NO: 293981 - RNA, 63 nt, Human
gagucuaagugggcucaguuugaugucagugucugggcucaugacuuguaaauggaagcugau

SEQ ID NO: 293982 - RNA, 64 nt, Human
acauggccuuguucaaccucagcucagaauauguguacagcaaguuuuuugcuguaccacaaaa

SEQ ID NO: 293983 - RNA, 64 nt, Human
uaguguuugggauucaaaccaacagucugucaguguacagcagcaguacucuccugcacagucu

SEQ ID NO: 293984 - RNA, 64 nt, Human
cacacacccugaggucagggagugcuggcucacaguacagcaugugccuuaaugcuucauauga

SEQ ID NO: 293985 - RNA, 63 nt, Human; identical to SEQ ID NO: 293972

SEQ ID NO: 293986 - RNA, 63 nt, Human
cuguggcaguucccuuuggauuuguaugugcucugggcucaugaagauauugcaucgugagcu

SEQ ID NO: 293987 - RNA, 63 nt, Human
ugugaguuuucuauuaugaagguuaauaauaaaugggcucauuuaguugccugggcaccuauu

SEQ ID NO: 293988 - RNA, 63 nt, Human
ggggugccuuuccuaauuugcaaaggugccauaugggcucacagcacccuggaggagaagggc

SEQ ID NO: 293989 - RNA, 63 nt, Human
uggguucuuacuucucagccaguaccugccccaugggcucaaggauuccuggccagcuccugc

SEQ ID NO: 293990 - RNA, 63 nt, Human
cccacucugccuuuccuauugagcaaccagcucugggcucaguuuccucaccuggaggguugg

SEQ ID NO: 293991 - RNA, 63 nt, Human
ggugcaaucuggcucacugcauccucaacuuccugggcucaagugauccuuccacuucagccu

SEQ ID NO: 293992 - RNA, 63 nt, Human
uccagggccugcgggcauaaccugaucuguagcugggcucagccacaggccuuccugguugga

SEQ ID NO: 293993 - RNA, 63 nt, Human
gccuagaccgauggcagccaucgaauauuccucugggcucacgggguguuuuccaccccccug

SEQ ID NO: 293994 - RNA, 63 nt, Human
ucagugauugggggaggaaaagucccaacccaaugggcucaaacuucuaagggguacuccucu

SEQ ID NO: 293995 - RNA, 59 nt, Human
agggaagucauaucugcuaaagcgaauccugggcucacugccccccacaggcacugugg

SEQ ID NO: 293996 - RNA, 63 nt, Human
cgacgggggccgaggccaggcugccccucccugugggcucagggucuccugcgggcuaggcag

SEQ ID NO: 293997 - RNA, 63 nt, Human
ggacuguaacgggcaggacaguuggguguggccugggcucaugccugguggugucacauccca

SEQ ID NO: 293998 - RNA, 63 nt, Human
cuccuuauguuguccaggccagucuugaacucuugggcucaagcgauccucccaccugggacu

SEQ ID NO: 293999 - RNA, 63 nt, Human
gggcggcggcggcggggaccggucgccuggcgcugggcucagucuccucagggucugagaccc

SEQ ID NO: 294000 - RNA, 63 nt, Human
gacucccaugugcugccgucugaugugcucagaugggcucaucguugguucguuuuuacugua

SEQ ID NO: 294001 - RNA, 64 nt, Human
aggggcaccccccuaggccagcacagccugagggguacagcaaaggggacccuuugcuggcccc

SEQ ID NO: 294002 - RNA, 64 nt, Human
uaaacaaaccuacuacacugccaguuguauaaaaguacagcacauucaguuauguacaguaugu

SEQ ID NO: 294003 - RNA, 64 nt, Human
ucaugucuuucuuuuugaaagauggaauacauuaguacagcaggagaccucggcugcuucuuuc

SEQ ID NO: 294004 - RNA, 63 nt, Human
gccucuccagccucaggaugcucuuguuuauucugggcucagacccuccucuuguacgucuca

SEQ ID NO: 294005 - RNA, 63 nt, Human
caauuaugauaggauuuuuacagacaccuauuuugggcucaguuuucaucauuaccauuaaau

SEQ ID NO: 294006 - RNA, 63 nt, Human
ucucacuaugucgccaggcuggucucuaacuccugggcucagugauccucccguuucgacuuc

SEQ ID NO: 294007 - RNA, 63 nt, Human
guaugaucauaguucacuguauucucaaccuccugggcucaaaugaucuccucccaccucagc

SEQ ID NO: 294008 - RNA, 63 nt, Human
ugcagagggagugugcgaaucuacccugaccaaugggcucaagaauaaaguaugauuuuugag

SEQ ID NO: 294009 - RNA, 63 nt, Human
uggcgcgaucccagcacugcagccucaaccuccugggcucaagccauccuuccgccucagcuu

SEQ ID NO: 294010 - RNA, 63 nt, Human
cucacuauauugcucaggcuggucuugaacuccugggcucaagugaucuucccacgugggccu

SEQ ID NO: 294011 - RNA, 63 nt, Human
uuugccauguuacccaggcuggucucaaacuccugggcucaagcgauccuccuggcucagccu

SEQ ID NO: 294012 - RNA, 63 nt, Human
caaaugcuggcaaauccaggcugguguucugucugggcucagacauccacauaacccugucac

SEQ ID NO: 294013 - RNA, 63 nt, Human
cagugcugaagggcuguugugauguucugagguugggcucaggcugggugcucugccaugggc

SEQ ID NO: 294014 - RNA, 63 nt, Human
uuaaaaaucaaaguacccaaaacugagucccuuugggcucagaaaugucugugguauuggguc

SEQ ID NO: 294015 - RNA, 63 nt, Human
cucccuguguuacccaggcuggucucaaacuccugggcucaagugauccucccaucuuggccu

SEQ ID NO: 294016 - RNA, 63 nt, Human
uuccucaaaucaaaaacaggcagguacagguagugggcucacaacguuugaccucgacugguu

SEQ ID NO: 294017 - RNA, 63 nt, Human
cuuacugugacaagcacaggaacggucagaaacugggcucaucacaccaaggcaaagcaacgg

SEQ ID NO: 294018 - RNA, 63 nt, Human
ccccagggaagccggggcccacuccgauccgccugggcucagcuaagcacggaagccaagggg

SEQ ID NO: 294019 - RNA, 63 nt, Human
ucugcugagggccgugucugguggggauggggcugggcucacccucaggaguagggcugggga

SEQ ID NO: 294020 - RNA, 64 nt, Human
gaaauaccugugugacacagacccacuucaguguguacagcaaauucuauagugcuucugagcc

SEQ ID NO: 294021 - RNA, 64 nt, Human
uuccuaagaugcccaugagaacagaccaagauguguacagcacuaugagcauuaaaaaaccuuc

SEQ ID NO: 294022 - RNA, 64 nt, Human
aauauauaaccaguguuguggauuuaacagaaauguacagcaaggagauuuacaacugggggag

SEQ ID NO: 294023 - RNA, 63 nt, Human
ccuacccucuagaggggcugggaagggccguucugggcucaccuggccugggagacccaucug

SEQ ID NO: 294024 - RNA, 63 nt, Human
ccaugaucauagcucacugcagccucgaaucccugggcucaaguguuccuccugccucauccu

SEQ ID NO: 294025 - RNA, 63 nt, Human
cuuacuauguugcccaggcuggugucgaacuccugggcucaagcgauccuucugccuuggccu

SEQ ID NO: 294026 - RNA, 63 nt, Human
uuggcucccaacacauccccagcaggccucucuugggcucaaaagccaagcugugcccagcca

SEQ ID NO: 294027 - RNA, 63 nt, Human
uaguuguggagcuacagucugaagaacauagcuugggcucaaguucaaaugagccaucuuuuu

SEQ ID NO: 294028 - RNA, 63 nt, Human
gauuacuaucauggcauauaaccaaaauccgacugggcucaagaggccacuuagggaaagaug

SEQ ID NO: 294029 - RNA, 63 nt, Human
cccgccgcgcuagcugugagcugagcaaagcccugggcucacagcaccccaaaagccuguggc

SEQ ID NO: 294030 - RNA, 63 nt, Human
gguguuacgugcaggaacguggagacccugacgugggcucacugcguuugguuuucuuuucag

SEQ ID NO: 294031 - RNA, 63 nt, Human
gcacaaucuuggcucacugcaaccucuguguccugggcucaagugauccuccugccucagccu

SEQ ID NO: 294032 - RNA, 63 nt, Human
ccugggaugggggucaauguaugcuacacaucuugggcucacaagugaggcuguggaggccag

SEQ ID NO: 294033 - RNA, 63 nt, Human
gugugugcgugacguacugcagccucaaccuccugggcucaagugauccucccaccucagccu

SEQ ID NO: 294034 - RNA, 63 nt, Human
acauaaucauagcucacuguacccuugaacuccugggcucaagugauccuccugccucagccu

SEQ ID NO: 294035 - RNA, 63 nt, Human
uaaagaugguguauguuuguaaaaauauucuucugggcucaaaagcuagcuugagggggcaga

SEQ ID NO: 294036 - RNA, 63 nt, Human
aagcucaagaaccugcacgagggccuaaaacagugggcucagcuuuggcugugcauuggaauc

SEQ ID NO: 294037 - RNA, 63 nt, Human
gugcgaucauggcucacugcagccucgaacuccugggcucaagcaauccuccugagugauccc

SEQ ID NO: 294038 - RNA, 63 nt, Human
guaguuuucuguuuuaaaucccccaccccuggcugggcucaguggcucaccccuguaauccca

SEQ ID NO: 294039 - RNA, 64 nt, Human
aaaaaucuuaaagccuguaauuucugagaaaagaguacagcauuuacucuuaucaucuagaaau

SEQ ID NO: 294040 - RNA, 64 nt, Human
uauguguacaaauucuuuuuaagauugucaucuuguacagcaaaauauuauguugguauauuac

SEQ ID NO: 294041 - RNA, 64 nt, Human
cuuuucacaugaccacaaguccucugauggaaauguacagcagaaacucuugagagagaggcua

SEQ ID NO: 294042 - RNA, 63 nt, Human
cucacuauguugcccaggcugcucuugaauuccugggcucaagcaguccucccacccuaccac

SEQ ID NO: 294043 - RNA, 63 nt, Human
aaggaacaaagacaggcaaacggcaacguagccugggcucacugugcuggggcacggcgggau

SEQ ID NO: 294044 - RNA, 63 nt, Human
gaagucgugagugaagcugcggguuggcuugacugggcucagccacugagcugccucaaccgg

SEQ ID NO: 294045 - RNA, 63 nt, Human
acuucuggagagucugugagacugccugagaggugggcucagcuaagccacaauguguacuuu

SEQ ID NO: 294046 - RNA, 63 nt, Human
gcugcacccacuccccuagggaugcucuaaagcugggcucaagcaagcccuggccagaggucc

SEQ ID NO: 294047 - RNA, 63 nt, Human
gucgcccuuugcugcauggcagggggcugcugcugggcucagugaaguugcugcuucucccag

SEQ ID NO: 294048 - RNA, 63 nt, Human
gaagccacucugaaaucacucugaagccaaagcugggcucaguggggaaggucaggaauggag

SEQ ID NO: 294049 - RNA, 63 nt, Human
gauggccugcauguuguaacuaccccgucccgcugggcucaaggaacagcucagcuaaagccc

SEQ ID NO: 294050 - RNA, 63 nt, Human
gcugcguggggcccucuccagcccguccuacccugggcucacauggggccugugcccaccccu

SEQ ID NO: 294051 - RNA, 63 nt, Human
ccaucaccacggcucacugcagccucagcguccugggcucaaaugauccucccaccucagccu

SEQ ID NO: 294052 - RNA, 63 nt, Human
uccuggccgucaugugcuugcucuuacagugccugggcucagccuaccagcugcugccauaca

SEQ ID NO: 294053 - RNA, 63 nt, Human
cucacaguguugcccaggcuggucucaaacuccugggcucaggcgauccaccugucucagccu

SEQ ID NO: 294054 - RNA, 63 nt, Human
ucagugccuuacagggaaauagccuggggugucugggcucaggguuggccagcuugcagagga

SEQ ID NO: 294055 - RNA, 63 nt, Human
aggucuccagcucuccucuaccacccaacacccugggcucacuuuuggauaggaaauaaacuc

SEQ ID NO: 294056 - RNA, 63 nt, Human
ugcuccccacagggccaggcuggcaggggccagugggcucagcccagguaggggcaggaugga

SEQ ID NO: 294057 - RNA, 63 nt, Human
ucuuaccauuugccccagcuggucucaaaccccugggcucaagcaagccuccugccuuggccu

SEQ ID NO: 294058 - RNA, 64 nt, Human
gaaauagggcguuuccuuuucaugaauugauuucguacagcacaguggcuuauaaggaaccagc

SEQ ID NO: 294059 - RNA, 64 nt, Human
gacagacagaauuguguaugccuugccuaucacgguacagcacgaagccaggcuccuuucucca

SEQ ID NO: 294060 - RNA, 64 nt, Human
gguauggauguuugcuuguuuauuaacuaaagauguacagcaaacugcccguuuagaguccugu

SEQ ID NO: 294061 - RNA, 63 nt, Human
ccgggcuccauucccaaggaaaagagaggagcuugggcucacagaaagagaaggggaugaaac

SEQ ID NO: 294062 - RNA, 63 nt, Human
aucccuaugcugccuaggcugaccuugaacuccugggcucaagcagucuacccaccucagccu

SEQ ID NO: 294063 - RNA, 63 nt, Human
gaccaagcccuacuuuuguucuucuauaggcccugggcucaaucuaagcgggugcuggggucc

SEQ ID NO: 294064 - RNA, 63 nt, Human
cuguugcccaggcuggaaugcaguggugugcucugggcucacugcaaccuucaccuccagguu

SEQ ID NO: 294065 - RNA, 63 nt, Human
ggcaccuggcagugagggacagagcuaguggggugggcucagcagaagugggugcauuucugc

SEQ ID NO: 294066 - RNA, 63 nt, Human
ugucacccaggcuggugugcaggggugcggucaugggcucaugggauucuccuaccucagccu

SEQ ID NO: 294067 - RNA, 63 nt, Human
gauggccuggauucacgcccucuuguuuccuuuugggcucaaagcccuuccuaccucugguga

SEQ ID NO: 294068 - RNA, 63 nt, Human
ggggcuggccugccugagugggaagacagcccuugggcucacacucucacugagccuugcugg

SEQ ID NO: 294069 - RNA, 63 nt, Human
ccuucccucaagccagggcuccuccuccugucgugggcucauugugaccacuggccucucuac

SEQ ID NO: 294070 - RNA, 63 nt, Human
aguuccucgccagaggcugcugcccuuccuggcugggcucaggaggcuccuuguaggcauaug

SEQ ID NO: 294071 - RNA, 63 nt, Human
aguagagacaagguuucaccauguuggucaggcugggcucaaacuccugaauccgccugccuc

SEQ ID NO: 294072 - RNA, 63 nt, Human
gugcgauuauagcccggugcagccucuaacuccugggcucaagcaauccaagugauccuccca

SEQ ID NO: 294073 - RNA, 63 nt, Human
gcuggaggcuuuggcauaggcugcaaaccaauuugggcucagagggaauaucagugauccaua

SEQ ID NO: 294074 - RNA, 63 nt, Human
aauccaggguaggaagcagcagcucugcuggacugggcucagcagucccauuugggauguaag

SEQ ID NO: 294075 - RNA, 63 nt, Human
gcgugaucauaccucacugcagcuucaacuuccugggcucaaguaauccucccaccccagccu

SEQ ID NO: 294076 - RNA, 63 nt, Human
gcuccccugggcagaggcgcccacugggugcugugggcucaggagggggcggggcaggagcug

SEQ ID NO: 294077 - RNA, 64 nt, Human
acaggccccccgcagcacccugcagagcacacagguacagcaacaggaaucucagagacaggug

SEQ ID NO: 294078 - RNA, 64 nt, Human
gcaucaccgacucugcaaaggauuucauuuugggguacagcaggguguuuuaagugcugugacu

SEQ ID NO: 294079 - RNA, 64 nt, Human
gacucuaggcuucagguugcauugggguuccucuguacagcaagauguuucuugccuuuuguua

SEQ ID NO: 294080 - RNA, 63 nt, Human
caagcggccaggcagggucuggccccgggcugcugggcucacaaagucacacuagaccacagu

SEQ ID NO: 294081 - RNA, 63 nt, Human
gugcaaucaugguucacugcagucuugaccuuuugggcucaagugauccucccaccucagccu

SEQ ID NO: 294082 - RNA, 63 nt, Human
ugcucaguagcugggucuguucccccagccccuugggcucaccugaaguccuaucacugccgc

SEQ ID NO: 294083 - RNA, 63 nt, Human
cuguuugagggaccagggucgacccugcccccuugggcucaggccccgcccccaggauccuac

SEQ ID NO: 294084 - RNA, 63 nt, Human
aggacgcgaccucaguuguccugcccuguggaaugggcucaagguuccugagacacccgauuc

SEQ ID NO: 294085 - RNA, 63 nt, Human
aaccacucgucaacugcugauucuacugggcugugggcucagaccucauuucaggcaccagau

SEQ ID NO: 294086 - RNA, 63 nt, Human
guguguucuuggcucacugcacccuccgccuccugggcucaagcaguccuucugccuuagccu

SEQ ID NO: 294087 - RNA, 63 nt, Human
gcacaaucucagcucauugcaaccucugcuuccugggcucaagcacucugcccaccucagccu

SEQ ID NO: 294088 - RNA, 63 nt, Human
gugcaaucauggcucacugcagccucaaauuccugggcucaagcgauccucccaccucagccu

SEQ ID NO: 294089 - RNA, 63 nt, Human
ccccugggagccgcauuuucacuaucuggaaaaugggcucaaugcaaagguggcagacauuua

SEQ ID NO: 294090 - RNA, 63 nt, Human
guuggucugugauuugccgacagccuugcaggcugggcucagggacaaagucccccccaaaac

SEQ ID NO: 294091 - RNA, 63 nt, Human
gucaggaaguucgagauuccuucacugucagaaugggcucaaggagccaucuuuugugauagg

SEQ ID NO: 294092 - RNA, 63 nt, Human
uuucagaggcauaggaucuggagccagacugcuugggcucaaguccuggcucugcugcgugac

SEQ ID NO: 294093 - RNA, 63 nt, Human
cucucuacguugcccaggcuggucucgaacuccugggcucaagugauccacccaucuccaccu

SEQ ID NO: 294094 - RNA, 63 nt, Human
ugaugaagaugggcuggaaggagggcgaggggcugggcucagagggccagggcaucaagaacc

SEQ ID NO: 294095 - RNA, 63 nt, Human
uuguugcccaagcuggagugcaguggugcaaugugggcucacugcaaccucugccuuccaggu

SEQ ID NO: 294096 - RNA, 63 nt, Human
agggagugguuaaggcauaggcugguggccuaaguacagcauuaaucauuaaggaacccauua

SEQ ID NO: 294097 - RNA, 64 nt, Human
aagaaggagaaaguugaaggacucagcuaaaggaguacagcaauuguaguaacugacacauccu

SEQ ID NO: 294098 - RNA, 64 nt, Human; identical to SEQ ID NO: 229491

SEQ ID NO: 294099 - RNA, 63 nt, Human
cucacuauguugcccaggcuggucuugaacuucugggcucaagugauccucccuccuuggccu

SEQ ID NO: 294100 - RNA, 63 nt, Human
guacaagcacaguucacuguacccuguuccuccugggcucaagugauucuuccaccuaaauuu

SEQ ID NO: 294101 - RNA, 63 nt, Human
gagcaacaaccuuauggagugagcagccaccuuugggcucauucuggacgacgugucuuugac

SEQ ID NO: 294102 - RNA, 63 nt, Human
cucacuauguuucccaggcugaucuugaacuccugggcucaagagauccuccugccuuggccu

SEQ ID NO: 294103 - RNA, 63 nt, Human
cuugugauauugcccaggcuguucuucaacuccugggcucaagcaguccucccaccuuggccu

SEQ ID NO: 294104 - RNA, 63 nt, Human
uuugccauguuucccuggcuggucucagacuccugggcucaagcaaucugcccgccucugccu

SEQ ID NO: 294105 - RNA, 63 nt, Human
uuuaagugcuccaagcagauggaauuagagaggugggcucaaaucuaggcccuggcacuguca

SEQ ID NO: 294106 - RNA, 63 nt, Human
ucugucaccaggcuggaaugcaguggcgcaaucugggcucacugcaaccuccgccucucgggu

SEQ ID NO: 294107 - RNA, 63 nt, Human
cucacuauguugcccaggcuggucuugaacucuugggcucaagugauccucccgccucagccu

SEQ ID NO: 294108 - RNA, 63 nt, Human
ucaccauguugccuaggcgggucucaaaacuccugggcucaagugauccuccugccucagccu

SEQ ID NO: 294109 - RNA, 63 nt, Human
ggugguuccagcccccaucaauugaacuguuucugggcucagucagacacagacauucaucug

SEQ ID NO: 294110 - RNA, 63 nt, Human
ccagccuccccuucuuguggugagacugaauuuugggcucagacaccagcaacagccucuugg

SEQ ID NO: 294111 - RNA, 63 nt, Human
gggacaccuuuguuccagccugguuuccugggcugggcucaggaaagcugccaaauucagucc

SEQ ID NO: 294112 - RNA, 63 nt, Human
cccaagucuucucccguccauuccagucaaaucugggcucacucaccccagcgagcucucaaa

SEQ ID NO: 294113 - RNA, 63 nt, Human
aagcucgaucaguguguguaggaaugacauaccugggcucaggggaagcaagggggcuuagaa

SEQ ID NO: 294114 - RNA, 63 nt, Human
gcauucagcacacacaaaccuacugcccacauuugggcucaggguuggccauuugcuaguucu

SEQ ID NO: 294115 - RNA, 64 nt, Human
acaaaagaaguaucuguuuuauuguauagaacaaguacagcauuuuacuacauaguauacaagu

SEQ ID NO: 294116 - RNA, 64 nt, Human
augaaaauucuugaccccucacacuuuacccccuguacagcacaggcauaccauggagauauua

SEQ ID NO: 294117 - RNA, 64 nt, Human
uuaacuuguaagcccuaguaauggccaauuauuuguacagcaacagaaguaaauugaagauacu

SEQ ID NO: 294118 - RNA, 63 nt, Human
cucacuauguuguccagacugaucucaaacuccugggcucaagugauccacccaccuuggccu

SEQ ID NO: 294119 - RNA, 63 nt, Human
gaggucagugcagccccuaccccugcucaggagugggcucagagucuagcaaaugcuaaggcc

SEQ ID NO: 294120 - RNA, 63 nt, Human
cuugcuauguuguccagacuggucucaaacuccugggcucaagcgauccucccaaagugcuug

SEQ ID NO: 294121 - RNA, 63 nt, Human
uucucagaauccucuuuccuccccauuuggcccugggcucaggggaccagguggggcgggugg

SEQ ID NO: 294122 - RNA, 63 nt, Human
gacagcucagguugugcaucugauggaaaccacugggcucaaacacgugcuuuauucuccugu

SEQ ID NO: 294123 - RNA, 63 nt, Human
aggugucuagaaacccaggucagacacacucucugggcucaagauucuuguguacacacacac

SEQ ID NO: 294124 - RNA, 63 nt, Human
ugcucuguugcccagcuuggacucgaacuuuccugggcucaagcgacccuccugccucagccc

SEQ ID NO: 294125 - RNA, 63 nt, Human
aacagauagauguugcucuuucaccugggugucugggcucaagcuuucccgcccagccucacu

SEQ ID NO: 294126 - RNA, 63 nt, Human
gaccaagcccccuuuugugugaauggcaguaacugggcucaggagcucugagguggcacccug

SEQ ID NO: 294127 - RNA, 63 nt, Human
ggagcaaaugcuggaugagcaacuccuguucuuugggcucaaggggacuggugaugggacaau

SEQ ID NO: 294128 - RNA, 63 nt, Human
cuucucuugaaaacuugguauaucuggccacacugggcucacauucccaaggguaacucuugg

SEQ ID NO: 294129 - RNA, 63 nt, Human
agcugugccagcugcuucugcccaccccgccucugggcucacaccagcccugguggccaagcc

SEQ ID NO: 294130 - RNA, 63 nt, Human
auguuaaauagagcucaggaaaggauugaugccugggcucagcugaacucuauuccuggccag

SEQ ID NO: 294131 - RNA, 52 nt, Human
agagaguugaacaguggugagcugggcucacagcuccauccaugggccccau

SEQ ID NO: 294132 - RNA, 63 nt, Human
ggcgccccaugggcccucagcgucuccccaugcugggcucacuacaugggccagcccuugcuc

SEQ ID NO: 294133 - RNA, 63 nt, Human
uuucaccauguugccaaggccagucugaaauccugggcucaagugauccuccugcuuuggccu

SEQ ID NO: 294134 - RNA, 64 nt, Human
ugugguuggcuuaagagguuugucuuuuguuuuuguacagcaguugggccaaccuuugcuggcu

SEQ ID NO: 294135 - RNA, 64 nt, Human
aaggaugaggagggggaaagggucuuaauucuauguacagcagagacauuaaacuugcuguguc

SEQ ID NO: 294136 - RNA, 64 nt, Human
ggaaauuguaaagcuuaaucaaaaagaauagccaguacagcauacaaucucagaaacuuagaag

SEQ ID NO: 294137 - RNA, 63 nt, Human
ccagcugcugaugggcacccgcccugggccagcugggcucaguuccugaccuggguuaggugg

SEQ ID NO: 294138 - RNA, 63 nt, Human
guguaguguggaugcgaggccacggcucagugaugggcucaccacccagaaguggggagagac

SEQ ID NO: 294139 - RNA, 63 nt, Human
caaagcacauuuugaaugaguauggaaccuccaugggcucagaaaaaagaugcuaauauauuu

SEQ ID NO: 294140 - RNA, 63 nt, Human
agcccucugcucucagcggcgccacagagagccugggcucagccuucugcaucaggacauggc

SEQ ID NO: 294141 - RNA, 63 nt, Human
gacccuggcugugcugcaagcugacuccagccuugggcucagcagcacccggugaacagcagc

SEQ ID NO: 294142 - RNA, 63 nt, Human
ggcagagcucaggagggugggugggagcugcagugggcucagaguccagcaaugaggcccccu

SEQ ID NO: 294143 - RNA, 63 nt, Human
aucugcacguuuguaaagcuaagggguggugcuugggcucaggccugagguuuugcaucuguu

SEQ ID NO: 294144 - RNA, 63 nt, Human
cucggcuggcuccagcugcccugcaggugccccugggcucagguaguuaguuguucagccacu

SEQ ID NO: 294145 - RNA, 63 nt, Human
uccccacggugacugagcugcgagagccugcgcugggcucacucccuggccuccgccccugag

SEQ ID NO: 294146 - RNA, 63 nt, Human
gccagcacgugcaugguucacagaaaaggauccugggcucagaaucucgagaaccgccugcuc

SEQ ID NO: 294147 - RNA, 63 nt, Human
cgagucccauuggcugggcucuggccugaucacugggcucaggucagggcuugguucccuugc

SEQ ID NO: 294148 - RNA, 63 nt, Human
agcuucggacuucuuuuagagccaggccugggcugggcucauagacgcuucacagagccugca

SEQ ID NO: 294149 - RNA, 63 nt, Human
acucccugcuccccgcacccggagccucagggaugggcucaggcugauggucagcugggcgcu

SEQ ID NO: 294150 - RNA, 63 nt, Human
acugcauuucauuuugauuuuggauaauaaaccugggcucagccugagccucugcuucuaacu

SEQ ID NO: 294151 - RNA, 63 nt, Human
cugggcuuucuaaagcaagugaccugaaggcucugggcucaccauacaacacccacguuguuu

SEQ ID NO: 294152 - RNA, 63 nt, Human
gugggggaggaggagaggucuccaugugacacaugggcucagggcugccagaaucagcggaug

SEQ ID NO: 294153 - RNA, 64 nt, Human
ccucccuucuugguuccauuuccauccaugacagguacagcaucccaggagcccggccugaggg

SEQ ID NO: 294154 - RNA, 64 nt, Human
augucuguaaaucuuaaccuccugccuaggauuuguacagcaucuggugugugcuuauaagcca

SEQ ID NO: 294155 - RNA, 64 nt, Human
uuuaguuauuugugucaaauuauaauuauaaaagguacagcagaaaauauaccauguuuuuaua

SEQ ID NO: 294156 - RNA, 63 nt, Human
uugacaugaccuggaccauagggcuuccuauccugggcucagcugccccugucugaagggucu

SEQ ID NO: 294157 - RNA, 63 nt, Human
acguggucauagcucacugcagccucaaccuccugggcucaagugacccuccugccucagccu

SEQ ID NO: 294158 - RNA, 63 nt, Human
guaggacccucgagagccuuacuucaaagugccugggcucagccugguuucugggugcuagau

SEQ ID NO: 294159 - RNA, 63 nt, Human
acacaaucauagcucacugcagccuuuaacuacugggcucaagacauccuccugcuucagccu

SEQ ID NO: 294160 - RNA, 63 nt, Human
cuugcuauguugcccaggcuggucuugaacuccugggcucaugcaauccuccugccuuggccu

SEQ ID NO: 294161 - RNA, 63 nt, Human
cauugcuguuagagaaaugaaauaaaauggggcugggcucaguggcucacgccuguaauccca

SEQ ID NO: 294162 - RNA, 63 nt, Human
ggugucacguuuugcagggagguguuugggccuugggcucagccacugggagacaguugggac

SEQ ID NO: 294163 - RNA, 63 nt, Human
caagacugggcaauuuacaaaagaaagguuuaaugggcucacaguuccacaugacugaggagg

SEQ ID NO: 294164 - RNA, 63 nt, Human
aaaagaugcccccacugggcagacacagcccuaugggcucaugguuugacaaacagaguggag

SEQ ID NO: 294165 - RNA, 63 nt, Human
ucuaggcaagagagaguggguucaaaagacuccugggcucaccuguuagcgcuggcccagccc

SEQ ID NO: 294166 - RNA, 63 nt, Human
guuucugccucacaaagcuguaacagaauggguugggcucaggccuaauuuucucugucauuc

SEQ ID NO: 294167 - RNA, 63 nt, Human
uucgccaaguuguccaggcuggucuugaacuccugggcucaagugauccgcccgccucagucu

SEQ ID NO: 294168 - RNA, 63 nt, Human
ugucugagagcuagccagaacugggguacagccugggcucagggaauagcugucaacacucgg

SEQ ID NO: 294169 - RNA, 63 nt, Human
ggauuuguauauauaccugcgcuuguuuuaaagugggcucagcacauaggguucccacgaagc

SEQ ID NO: 294170 - RNA, 63 nt, Human
caugucgcacuaaguguguucuccuguugcaguugggcucaucaucgucauagcuggcaugua

SEQ ID NO: 294171 - RNA, 64 nt, Human
ccaaauuuuuuguauauuaaagcaccaaauucauguacagcaugcaucacggaucaauagacug

SEQ ID NO: 294172 - RNA, 64 nt, Human
aauugaauucuacucauuagaguacuuuuuaaaaguacagcagaaagaaaagaaguggaacaua

SEQ ID NO: 294173 - RNA, 64 nt, Human
gugcaauuguguuuccuuuaccuuguaaaauuuuguacagcauaaauaaguaaaaaaaucacug

SEQ ID NO: 294174 - RNA, 64 nt, Human
acuucgggggucguucugugccuuccagcaucuuguacagcaaauccugacucgugucuuuuua

SEQ ID NO: 294175 - RNA, 64 nt, Human
uucuugaguguuaagucuuuuaccaaaagugucuguacagcagccauccaaguugccccuacuu

SEQ ID NO: 294176 - RNA, 64 nt, Human
gacucugagcacugccccugcucgccuuggucauguacagcacugaaaggaaugaagcaccagc

SEQ ID NO: 294177 - RNA, 64 nt, Human
uguauugcccacucauuuguauaagugcgcuucgguacagcacggguccugcucccgcgaugug

SEQ ID NO: 294178 - RNA, 64 nt, Human
ccuugccagaguucaucaaggauggcuccaguacguacagcaagauuccugcccacaggaaggg

SEQ ID NO: 294179 - RNA, 64 nt, Human
cacacagaauuaccuaauaauccagaucacugagguacagcaugcaauugaccagcuuaagaga

SEQ ID NO: 294180 - RNA, 64 nt, Human
aguaaccaaaaugcuaugccuuuuuugcaccuuuguacagcagccaaaucaugaacucaaaaug

SEQ ID NO: 294181 - RNA, 64 nt, Human
cauuaauccguuaaguaaaauggacuuuguaauuguacagcauaccuaagaaacucagaaggug

SEQ ID NO: 294182 - RNA, 64 nt, Human
cguucacuucaaccuacagacccuuuuguauaauguacagcaaaugucauuaaauauugaaugc

SEQ ID NO: 294183 - RNA, 64 nt, Human
ucugacacugcuuacacugcacucugacccuguaguacagcaauaaccgucuaauaaagagccu

SEQ ID NO: 294184 - RNA, 64 nt, Human
ggugaggcggccgggggcauuaacugaccucugaguacagcaauaaaauaaccuggggaucuuu

SEQ ID NO: 294185 - RNA, 64 nt, Human
gaaucuagaauucuuauaacaugaauaacaaaauguacagcaagccuauguaguucaauuaaua

SEQ ID NO: 294186 - RNA, 64 nt, Human
guaacuccuauucauaucccauagaucuaguauuguacagcacugcauucucugaggaaguccc

SEQ ID NO: 294187 - RNA, 64 nt, Human
uggaagaaugaccuaguugcuccucucaacauggguacagcaaacucagcacagccaagaagcc

SEQ ID NO: 294188 - RNA, 64 nt, Human
cacagagcuguguugcuuuaaagccaccacaaggguacagcauuaaauggcagaacuggaaaag

SEQ ID NO: 294189 - RNA, 64 nt, Human
ugucagcuuuguccaagaucagaugauuguagguguacagcauuauuucuggacucucuguuau

SEQ ID NO: 294190 - RNA, 64 nt, Human
aauuuggaaggcauugaagcuugcaccuuuucauguacagcauuaaaauuuuaccucucucugg

SEQ ID NO: 294191 - RNA, 64 nt, Human; identical to SEQ ID NO: 229705

SEQ ID NO: 294192 - RNA, 64 nt, Human; identical to SEQ ID NO: 229706

SEQ ID NO: 294193 - RNA, 64 nt, Human; identical to SEQ ID NO: 229707

SEQ ID NO: 294194 - RNA, 64 nt, Human; identical to SEQ ID NO: 229708

SEQ ID NO: 294195 - RNA, 64 nt, Human; identical to SEQ ID NO: 229709

SEQ ID NO: 294196 - RNA, 64 nt, Human; identical to SEQ ID NO: 229710

SEQ ID NO: 294197 - RNA, 64 nt, Human; identical to SEQ ID NO: 229711

SEQ ID NO: 294198 - RNA, 64 nt, Human; identical to SEQ ID NO: 229715

SEQ ID NO: 294199 - RNA, 64 nt, Human; identical to SEQ ID NO: 229716

SEQ ID NO: 294200 - RNA, 64 nt, Human; identical to SEQ ID NO: 229717

SEQ ID NO: 294201 - RNA, 64 nt, Human; identical to SEQ ID NO: 229718

SEQ ID NO: 294202 - RNA, 64 nt, Human; identical to SEQ ID NO: 229719

SEQ ID NO: 294203 - RNA, 64 nt, Human; identical to SEQ ID NO: 229720

SEQ ID NO: 294204 - RNA, 64 nt, Human; identical to SEQ ID NO: 229721

SEQ ID NO: 294205 - RNA, 64 nt, Human; identical to SEQ ID NO: 229722

SEQ ID NO: 294206 - RNA, 64 nt, Human; identical to SEQ ID NO: 229723

SEQ ID NO: 294207 - RNA, 64 nt, Human; identical to SEQ ID NO: 229724

SEQ ID NO: 294208 - RNA, 64 nt, Human; identical to SEQ ID NO: 229725

SEQ ID NO: 294209 - RNA, 64 nt, Human; identical to SEQ ID NO: 229726

SEQ ID NO: 294210 - RNA, 64 nt, Human; identical to SEQ ID NO: 229727

SEQ ID NO: 294211 - RNA, 64 nt, Human; identical to SEQ ID NO: 229728

SEQ ID NO: 294212 - RNA, 64 nt, Human; identical to SEQ ID NO: 229729

SEQ ID NO: 294213 - RNA, 64 nt, Human; identical to SEQ ID NO: 229730

SEQ ID NO: 294214 - RNA, 64 nt, Human; identical to SEQ ID NO: 229734

SEQ ID NO: 294215 - RNA, 64 nt, Human; identical to SEQ ID NO: 229735

SEQ ID NO: 294216 - RNA, 64 nt, Human; identical to SEQ ID NO: 229736

SEQ ID NO: 294217 - RNA, 64 nt, Human; identical to SEQ ID NO: 229737

SEQ ID NO: 294218 - RNA, 64 nt, Human; identical to SEQ ID NO: 229738

SEQ ID NO: 294219 - RNA, 64 nt, Human; identical to SEQ ID NO: 229739

SEQ ID NO: 294220 - RNA, 64 nt, Human; identical to SEQ ID NO: 229740

SEQ ID NO: 294221 - RNA, 64 nt, Human; identical to SEQ ID NO: 229741

SEQ ID NO: 294222 - RNA, 64 nt, Human; identical to SEQ ID NO: 229742

SEQ ID NO: 294223 - RNA, 64 nt, Human; identical to SEQ ID NO: 229743

SEQ ID NO: 294224 - RNA, 64 nt, Human; identical to SEQ ID NO: 229744

SEQ ID NO: 294225 - RNA, 64 nt, Human; identical to SEQ ID NO: 229745

SEQ ID NO: 294226 - RNA, 64 nt, Human; identical to SEQ ID NO: 229746

SEQ ID NO: 294227 - RNA, 64 nt, Human; identical to SEQ ID NO: 229747

SEQ ID NO: 294228 - RNA, 64 nt, Human; identical to SEQ ID NO: 229748

SEQ ID NO: 294229 - RNA, 64 nt, Human; identical to SEQ ID NO: 229749

SEQ ID NO: 294230 - RNA, 64 nt, Human; identical to SEQ ID NO: 229753

SEQ ID NO: 294231 - RNA, 64 nt, Human; identical to SEQ ID NO: 229754

SEQ ID NO: 294232 - RNA, 64 nt, Human; identical to SEQ ID NO: 229755

SEQ ID NO: 294233 - RNA, 64 nt, Human; identical to SEQ ID NO: 229756

SEQ ID NO: 294234 - RNA, 64 nt, Human; identical to SEQ ID NO: 229757

SEQ ID NO: 294235 - RNA, 64 nt, Human; identical to SEQ ID NO: 229758

SEQ ID NO: 294236 - RNA, 64 nt, Human; identical to SEQ ID NO: 229759

SEQ ID NO: 294237 - RNA, 64 nt, Human; identical to SEQ ID NO: 229760

SEQ ID NO: 294238 - RNA, 64 nt, Human; identical to SEQ ID NO: 229761

SEQ ID NO: 294239 - RNA, 64 nt, Human; identical to SEQ ID NO: 229762

SEQ ID NO: 294240 - RNA, 64 nt, Human; identical to SEQ ID NO: 229763

SEQ ID NO: 294241 - RNA, 64 nt, Human; identical to SEQ ID NO: 229764

SEQ ID NO: 294242 - RNA, 64 nt, Human; identical to SEQ ID NO: 229765

SEQ ID NO: 294243 - RNA, 64 nt, Human; identical to SEQ ID NO: 229766

SEQ ID NO: 294244 - RNA, 64 nt, Human; identical to SEQ ID NO: 229767

SEQ ID NO: 294245 - RNA, 64 nt, Human; identical to SEQ ID NO: 229768

SEQ ID NO: 294246 - RNA, 64 nt, Human; identical to SEQ ID NO: 229772

SEQ ID NO: 294247 - RNA, 51 nt, Human; identical to SEQ ID NO: 229773

SEQ ID NO: 294248 - RNA, 64 nt, Human; identical to SEQ ID NO: 229774

SEQ ID NO: 294249 - RNA, 64 nt, Human; identical to SEQ ID NO: 229775

SEQ ID NO: 294250 - RNA, 64 nt, Human; identical to SEQ ID NO: 229776

SEQ ID NO: 294251 - RNA, 64 nt, Human; identical to SEQ ID NO: 229777

SEQ ID NO: 294252 - RNA, 64 nt, Human; identical to SEQ ID NO: 229778

SEQ ID NO: 294253 - RNA, 64 nt, Human; identical to SEQ ID NO: 229779

SEQ ID NO: 294254 - RNA, 64 nt, Human; identical to SEQ ID NO: 229780

SEQ ID NO: 294255 - RNA, 64 nt, Human; identical to SEQ ID NO: 229781

SEQ ID NO: 294256 - RNA, 64 nt, Human; identical to SEQ ID NO: 229782

SEQ ID NO: 294257 - RNA, 64 nt, Human; identical to SEQ ID NO: 229783

SEQ ID NO: 294258 - RNA, 64 nt, Human; identical to SEQ ID NO: 229784

SEQ ID NO: 294259 - RNA, 64 nt, Human; identical to SEQ ID NO: 229785

SEQ ID NO: 294260 - RNA, 64 nt, Human; identical to SEQ ID NO: 229786

SEQ ID NO: 294261 - RNA, 64 nt, Human; identical to SEQ ID NO: 229787

SEQ ID NO: 294262 - RNA, 64 nt, Human; identical to SEQ ID NO: 229791

SEQ ID NO: 294263 - RNA, 64 nt, Human; identical to SEQ ID NO: 229792

SEQ ID NO: 294264 - RNA, 64 nt, Human; identical to SEQ ID NO: 229793

SEQ ID NO: 294265 - RNA, 64 nt, Human; identical to SEQ ID NO: 229794

SEQ ID NO: 294266 - RNA, 64 nt, Human; identical to SEQ ID NO: 229795

SEQ ID NO: 294267 - RNA, 64 nt, Human; identical to SEQ ID NO: 229796

SEQ ID NO: 294268 - RNA, 64 nt, Human; identical to SEQ ID NO: 229797

SEQ ID NO: 294269 - RNA, 64 nt, Human; identical to SEQ ID NO: 229798

SEQ ID NO: 294270 - RNA, 64 nt, Human; identical to SEQ ID NO: 229799

SEQ ID NO: 294271 - RNA, 64 nt, Human; identical to SEQ ID NO: 229800

SEQ ID NO: 294272 - RNA, 64 nt, Human; identical to SEQ ID NO: 229801

SEQ ID NO: 294273 - RNA, 64 nt, Human; identical to SEQ ID NO: 229802

SEQ ID NO: 294274 - RNA, 64 nt, Human; identical to SEQ ID NO: 229803

SEQ ID NO: 294275 - RNA, 64 nt, Human; identical to SEQ ID NO: 229804

SEQ ID NO: 294276 - RNA, 64 nt, Human; identical to SEQ ID NO: 229805

SEQ ID NO: 294277 - RNA, 64 nt, Human; identical to SEQ ID NO: 229806

SEQ ID NO: 294278 - RNA, 64 nt, Human; identical to SEQ ID NO: 229811

SEQ ID NO: 294279 - RNA, 64 nt, Human; identical to SEQ ID NO: 229812

SEQ ID NO: 294280 - RNA, 64 nt, Human; identical to SEQ ID NO: 218908

SEQ ID NO: 294281 - RNA, 64 nt, Human; identical to SEQ ID NO: 218909

SEQ ID NO: 294282 - RNA, 64 nt, Human; identical to SEQ ID NO: 218910

SEQ ID NO: 294283 - RNA, 64 nt, Human
uucucacgucugcgucucagaucuaacgugguuucacaucaauccgcuuucaugggauuuuggu

SEQ ID NO: 294284 - RNA, 64 nt, Human
uuuucagaacugcuauacucaaacuugcagaucucacaucaaggagagggaaaagcacaaugca

SEQ ID NO: 294285 - RNA, 64 nt, Human; identical to SEQ ID NO: 218911

SEQ ID NO: 294286 - RNA, 64 nt, Human; identical to SEQ ID NO: 218912

SEQ ID NO: 294287 - RNA, 64 nt, Human; identical to SEQ ID NO: 218913

SEQ ID NO: 294288 - RNA, 64 nt, Human; identical to SEQ ID NO: 218914

SEQ ID NO: 294289 - RNA, 64 nt, Human; identical to SEQ ID NO: 218915

SEQ ID NO: 294290 - RNA, 64 nt, Human; identical to SEQ ID NO: 218916

SEQ ID NO: 294291 - RNA, 64 nt, Human; identical to SEQ ID NO: 218917

SEQ ID NO: 294292 - RNA, 64 nt, Human; identical to SEQ ID NO: 218918

SEQ ID NO: 294293 - RNA, 64 nt, Human; identical to SEQ ID NO: 218919

SEQ ID NO: 294294 - RNA, 64 nt, Human; identical to SEQ ID NO: 218920

SEQ ID NO: 294295 - RNA, 64 nt, Human; identical to SEQ ID NO: 218921

SEQ ID NO: 294296 - RNA, 64 nt, Human; identical to SEQ ID NO: 218922

SEQ ID NO: 294297 - RNA, 64 nt, Human; identical to SEQ ID NO: 218923

SEQ ID NO: 294298 - RNA, 64 nt, Human; identical to SEQ ID NO: 218924

SEQ ID NO: 294299 - RNA, 64 nt, Human
uuaauaaucauaugucagcauucugacuacuuaccacaucaaaucugggcccaaacagccucag

SEQ ID NO: 294300 - RNA, 64 nt, Human
gccauuccacccccuccccugcuggggagaaugacacaucaagcugcuaacaauugggggaagg

SEQ ID NO: 294301 - RNA, 64 nt, Human
augauacugucaauuugagauagcagaaguuucacacaucaaaguaaaagauuugcauaucauu

SEQ ID NO: 294302 - RNA, 64 nt, Human; identical to SEQ ID NO: 218925

SEQ ID NO: 294303 - RNA, 64 nt, Human; identical to SEQ ID NO: 218926

SEQ ID NO: 294304 - RNA, 64 nt, Human; identical to SEQ ID NO: 218927

SEQ ID NO: 294305 - RNA, 64 nt, Human; identical to SEQ ID NO: 218928

SEQ ID NO: 294306 - RNA, 64 nt, Human; identical to SEQ ID NO: 218929

SEQ ID NO: 294307 - RNA, 64 nt, Human; identical to SEQ ID NO: 218930

SEQ ID NO: 294308 - RNA, 64 nt, Human; identical to SEQ ID NO: 218931

SEQ ID NO: 294309 - RNA, 64 nt, Human; identical to SEQ ID NO: 218932

SEQ ID NO: 294310 - RNA, 64 nt, Human; identical to SEQ ID NO: 218933

SEQ ID NO: 294311 - RNA, 64 nt, Human; identical to SEQ ID NO: 218934

SEQ ID NO: 294312 - RNA, 64 nt, Human; identical to SEQ ID NO: 218935

SEQ ID NO: 294313 - RNA, 64 nt, Human; identical to SEQ ID NO: 218936

SEQ ID NO: 294314 - RNA, 64 nt, Human; identical to SEQ ID NO: 218937

SEQ ID NO: 294315 - RNA, 64 nt, Human; identical to SEQ ID NO: 218938

SEQ ID NO: 294316 - RNA, 64 nt, Human
aaugagguuguaucaauagcagugacaaaacgcacacaucaacccacagaccuuaggaggagga

SEQ ID NO: 294317 - RNA, 57 nt, Human
gugcagaggaacauguuugaguucaagcacaucaaggccuucgaccgggcuuuugcu

SEQ ID NO: 294318 - RNA, 64 nt, Human
agaugaugcauggccacauuauugcuuugacccucacaucaagaaaucugaaugaucuggacca

SEQ ID NO: 294319 - RNA, 64 nt, Human; identical to SEQ ID NO: 218939

SEQ ID NO: 294320 - RNA, 64 nt, Human; identical to SEQ ID NO: 218940

SEQ ID NO: 294321 - RNA, 64 nt, Human; identical to SEQ ID NO: 218941

SEQ ID NO: 294322 - RNA, 64 nt, Human; identical to SEQ ID NO: 218942

SEQ ID NO: 294323 - RNA, 64 nt, Human; identical to SEQ ID NO: 218943

SEQ ID NO: 294324 - RNA, 64 nt, Human; identical to SEQ ID NO: 218944

SEQ ID NO: 294325 - RNA, 64 nt, Human; identical to SEQ ID NO: 218945

SEQ ID NO: 294326 - RNA, 64 nt, Human; identical to SEQ ID NO: 218946

SEQ ID NO: 294327 - RNA, 64 nt, Human; identical to SEQ ID NO: 218947

SEQ ID NO: 294328 - RNA, 64 nt, Human; identical to SEQ ID NO: 218948

SEQ ID NO: 294329 - RNA, 64 nt, Human; identical to SEQ ID NO: 218949

SEQ ID NO: 294330 - RNA, 64 nt, Human; identical to SEQ ID NO: 218950

SEQ ID NO: 294331 - RNA, 64 nt, Human; identical to SEQ ID NO: 218951

SEQ ID NO: 294332 - RNA, 64 nt, Human; identical to SEQ ID NO: 218952

SEQ ID NO: 294333 - RNA, 64 nt, Human
ucagaauuuuaaaggcaguuguuucuuuccuaagcacaucaauucguaguaaaugaugcuucgg

SEQ ID NO: 294334 - RNA, 64 nt, Human
cuggaauucuaacaaggaggagaggagacuaaaucacaucaauuugcaacucuauguuucuuug

SEQ ID NO: 294335 - RNA, 64 nt, Human
gaaacuccaaacaaguauucauuaugaacagauacacaucaaaaucauaauaauauuuucaaaa

SEQ ID NO: 294336 - RNA, 64 nt, Human; identical to SEQ ID NO: 218953

SEQ ID NO: 294337 - RNA, 64 nt, Human; identical to SEQ ID NO: 218954

SEQ ID NO: 294338 - RNA, 64 nt, Human; identical to SEQ ID NO: 218955

SEQ ID NO: 294339 - RNA, 64 nt, Human; identical to SEQ ID NO: 218958

SEQ ID NO: 294340 - RNA, 64 nt, Human; identical to SEQ ID NO: 218959

SEQ ID NO: 294341 - RNA, 64 nt, Human; identical to SEQ ID NO: 218960

SEQ ID NO: 294342 - RNA, 64 nt, Human; identical to SEQ ID NO: 218961

SEQ ID NO: 294343 - RNA, 64 nt, Human; identical to SEQ ID NO: 218962

SEQ ID NO: 294344 - RNA, 64 nt, Human
ggaacuuguaaguggaaagauuauugccacccugcacaucaaguauccuaaggacaggggauau

SEQ ID NO: 294345 - RNA, 64 nt, Human
uugcuuccucccucuguugucugccugugugacacacaucaauggcaauaacuucuuccaacuc

SEQ ID NO: 294346 - RNA, 64 nt, Human
aaccaaaaggccguguguuuagaagccuaauugucacaucaagcaucauuguccccaugcaaca

SEQ ID NO: 294347 - RNA, 64 nt, Human
caucauaaggaaguuauuaacgggcauguauuaucacaucaagcaugcaauaaugugcaaauuu

SEQ ID NO: 294348 - RNA, 64 nt, Human
cauuuggaguuucauaugcagcauuaauuaagcucacaucaaaauagaccagccauuugcacau

SEQ ID NO: 294349 - RNA, 64 nt, Human
aauuaacauuauguacuguauauaucauuuuagacacaucaaucauguauccauauuauagcuu

SEQ ID NO: 294350 - RNA, 64 nt, Human
ccuccucaccaacggcagugccaaaaucagcccccacaucaaggugguguucucugugcuuucu

SEQ ID NO: 294351 - RNA, 64 nt, Human
guuuuccacucuuucagagaaaccucagcuucaucacaucaaaguuacuccagagcaaccaagc

SEQ ID NO: 294352 - RNA, 64 nt, Human
acccuuggagcaaacauaccucccuugugacucccacaucaaccauuaaaguuauuuaacagca

SEQ ID NO: 294353 - RNA, 64 nt, Human
caguuaauucuauuuuucaagguuuuuggcaaagcacaucaauguuagacuaguugaaguggaa

SEQ ID NO: 294354 - RNA, 64 nt, Human
uuaucugaccaugaacuugcucuucuagacaacucacaucaaagcccucacuccacuaauggag

SEQ ID NO: 294355 - RNA, 64 nt, Human
uaauguguccagguuccccauauuauuacaguuccacaucaaggccgagugcaccgcccaccac

SEQ ID NO: 294356 - RNA, 64 nt, Human
accacgaguccuuugaggcuccuggacagagacccacaucaagaucggaagcccuuuggguggc

SEQ ID NO: 294357 - RNA, 64 nt, Human
uaacaguacauuuuguuuucuucauagauuuagacacaucaauuuguaauuuaggguacuuaca

SEQ ID NO: 294358 - RNA, 64 nt, Human
guguaagcugauaaaaacguagcuaccguacacacacaucaaucacucaauuuccuguccuuuu

SEQ ID NO: 294359 - RNA, 64 nt, Human
cacccgcuagcaguggcgauucagguucucuugccacaucaauaucccagaugguaaagacuga

SEQ ID NO: 294360 - RNA, 64 nt, Human
cccauccugaauaagauacuuauguugagcuauucacaucaaggggacucaauauaucaacaau

SEQ ID NO: 294361 - RNA, 64 nt, Human
cacauccgauucugaaucagagguuagugaaauucacaucaaagucaaacccacaaccaagucg

SEQ ID NO: 294362 - RNA, 64 nt, Human
augauaauggugcuuggaaaucaagcaaacagcgcacaucaacuucugacucugagggguccug

SEQ ID NO: 294363 - RNA, 54 nt, Human
aaguuggauuccugggaugauuugcacaucaacugcucaacuguggauuguuuu

SEQ ID NO: 294364 - RNA, 64 nt, Human
cacaugguggcaccagcaccacuccuuuccuuaccacaucaacugauuaaagcagugaccagca

SEQ ID NO: 294365 - RNA, 64 nt, Human
uugugggggcaccugggaggucaaaggucuccaccacaucaaccuauuuuguuuuacccuuuuu

SEQ ID NO: 294366 - RNA, 64 nt, Human
gccagugcugacccugcagcacuuucagcauaugcacaucaaaguuggagaccgcgcugaacuu

SEQ ID NO: 294367 - RNA, 64 nt, Human
cuccucccacagccuucugucuuggccuugucaucacaucaauccuguuguguggugcugugug

SEQ ID NO: 294368 - RNA, 64 nt, Human
cagaaaacuauacuuuggucugcuucuacaguggcacaucaacccaccuuugagcuuuagaucu

SEQ ID NO: 294369 - RNA, 64 nt, Human
gacuccuuuccucugaggaagaagggauaauagacacaucaaaugccccgaauuuagucacacc

SEQ ID NO: 294370 - RNA, 64 nt, Human
uggccauuagguuauuauuugagaggaaaguccucacaucaauaguacauaugaaagugaccuc

SEQ ID NO: 294371 - RNA, 64 nt, Human
aguuuuucuuccuuuuuucccucuguuuauauugcacaucaagucaaaaacauguuugggaaag

SEQ ID NO: 294372 - RNA, 64 nt, Human
gcaguagcugcuuuugucauaaauaucuuccuaccacaucaaaaaugcugcuuuuaaaauuuuu

SEQ ID NO: 294373 - RNA, 64 nt, Human
gcaccuauaaauuauggagcauuguagauuuuaccacaucaauucauagcaguaacuuuaagag

SEQ ID NO: 294374 - RNA, 64 nt, Human
gauucuuucaguucuuuggauucuaaauacaugccacaucaaaccuuugaguagauccauuucc

SEQ ID NO: 294375 - RNA, 64 nt, Human
guauuuucaugaaaauaccauuuaguaagaauaccacaucaaauaagaaauaaugcuacaauuu

SEQ ID NO: 294376 - RNA, 64 nt, Human
uaauaaugcuaaagaaaaagucauccaaucuaaccacaucaauauugucauuccuguauucacc

SEQ ID NO: 294377 - RNA, 64 nt, Human
auucauucuuaucugccaaagaauuaucuagaagcacaucaaauaccagcaccccaccugcuca

SEQ ID NO: 294378 - RNA, 64 nt, Human
uuaaaauccugucauucucuggcucuucuuuuuucacaucaaaaugaugcuguuggacuuagag

SEQ ID NO: 294379 - RNA, 64 nt, Human
ugcuguaacauuucccaccaacucucuugcuguccacaucaacagcuaaaucauuuauucauau

SEQ ID NO: 294380 - RNA, 64 nt, Human
cauguuaaauagcacuuuuaauagcaaaaaaaggcacaucaacugcgaaguuauccuuaguuug

SEQ ID NO: 294381 - RNA, 64 nt, Human
aaucagguauugcaguguucaaacaagguauggacacaucaacauauucaccuuuuggaaggac

SEQ ID NO: 294382 - RNA, 64 nt, Human
uauugugguggauagccaagcacauugggaucuccacaucaaauacugacauuucuucuacagg

SEQ ID NO: 294383 - RNA, 64 nt, Human
agggauagggguuagcagaagagagaaauagugucacaucaagggcaggaucucauagcuaggg

SEQ ID NO: 294384 - RNA, 64 nt, Human
ugaagugagucaugugugauuuaaguucaggcagcacaucaauuucuaaauacuuuuuguuuau

SEQ ID NO: 294385 - RNA, 64 nt, Human
ccuuggaaaucugacuucuugcagaaggaguaggcacaucaagauauucaggggugccccaaga

SEQ ID NO: 294386 - RNA, 64 nt, Human
cuugcuaauuggggaugcuucuuagagcaucuuccacaucaacuccccuggcugcuggcuaccg

SEQ ID NO: 294387 - RNA, 64 nt, Human
gagggugacaaaaacaacaaaacaccguuauaaacacaucaaagguucauucugacugagguaa

SEQ ID NO: 294388 - RNA, 64 nt, Human
ugucuaccauguuuucuuuucuagcugaauaaaccacaucaaaggaaagggaccacaguauuug

SEQ ID NO: 294389 - RNA, 64 nt, Human
gacaggcgccgccucgcccccgggcccuuucguccacaucaaaaaugcaucaagucuccacgug

SEQ ID NO: 294390 - RNA, 64 nt, Human
cacgucccuuccugucucggucugcggucuuuaccacaucaauaggacuuuuuaugcguccggg

SEQ ID NO: 294391 - RNA, 54 nt, Human
cagagcaagcaaagaaauagauuacacaucaagugaaaaauauuccuccuguug

SEQ ID NO: 294392 - RNA, 64 nt, Human
ugguuuuacacagagaaauacaaaauaaagaucacacaucaagacuaucuacaaaaauuuauua

SEQ ID NO: 294393 - RNA, 64 nt, Human
caaauacacacuucuuuccccaaacaucauguagcacaucaauauguagggagacauucuuaug

SEQ ID NO: 294394 - RNA, 64 nt, Human
uuggaucaaguuuaaaugacugugcugccccuuucacaucaaagaacuacugacaacgaaggcc

SEQ ID NO: 294395 - RNA, 64 nt, Human
gccuucugaccuuucaguuuuuuaauuuuauagucacaucaacaucuuuaugaucuauugccua

SEQ ID NO: 294396 - RNA, 64 nt, Human
caucugagggggagggagauggaugcucaguugucacaucaaaggauacagcauuauucuagca

SEQ ID NO: 294397 - RNA, 64 nt, Human
gagggaggcgaccugaucaggggagguggggguacacaucaauuugaguuguucaggcuacuga

SEQ ID NO: 294398 - RNA, 64 nt, Human
uguccauugaauauguagcggcugccagagaucacacaucaaugcaaauuccagagccugucug

SEQ ID NO: 294399 - RNA, 64 nt, Human
aggagugaauacaccuaccuggugccuugaaaaucacaucaaguaguuaauuaucuaccccuua

SEQ ID NO: 294400 - RNA, 64 nt, Human
uaaauuauacauucaagguaguggccaaauguaacacaucaaucauggaaugauuucucugcua

SEQ ID NO: 294401 - RNA, 64 nt, Human
ggauguggauggugggggcauggacaaagcuugacacaucaaguuaucaaggccuuggaggagg

SEQ ID NO: 294402 - RNA, 64 nt, Human
ccccacuggaauuuuauuucucucaggugcgugccacaucaauaacaacaguuuuuauguuugc

SEQ ID NO: 294403 - RNA, 64 nt, Human
ugggagaaugguuguaucuuauggaaggaauuaucacaucaaggagucaggggaaagugacugg

SEQ ID NO: 294404 - RNA, 64 nt, Human
cucuuugccuaacaaucucggaaggaaaauauaucacaucaauaaucaauaaaaauaaguaaaa

SEQ ID NO: 294405 - RNA, 64 nt, Human
uuagaucaagagaauauuucagaguuuugguuuacacaucaagaaacagacacacauaccuagg

SEQ ID NO: 294406 - RNA, 64 nt, Human
gaguaauaaaaccuuugaaaguagaguagaugaucacaucaaaguauuuuuguaaaagaauucu

SEQ ID NO: 294407 - RNA, 64 nt, Human
auagagauggagucauguacucuaucuggcucuacacaucaaucacaucuugauucaaaccuca

SEQ ID NO: 294408 - RNA, 64 nt, Human
cucaaggaauuaacuugugcaagcugacucccagcacaucaaagaaugcaauuaacugauaaca

SEQ ID NO: 294409 - RNA, 64 nt, Human
aaauuuauauucagauuuguuucguuucauaagacacaucaaacaggccuauacaaaagguuua

SEQ ID NO: 294410 - RNA, 64 nt, Human
accaguuguacagccugauguaggacuuggaaaacacaucaauccaggacaaaagugacgcuaa

SEQ ID NO: 294411 - RNA, 64 nt, Human
augugaugugcaaggaaaauaauaggauauaaaacacaucaaguagaaaauuucuuauacuuca

SEQ ID NO: 294412 - RNA, 64 nt, Human
accgcccaggcggucugcucuugguguucagaaucacaucaaugcgaacgucacagcgccuucg

SEQ ID NO: 294413 - RNA, 64 nt, Human
gguaaaagcggguaaugaacauuccuauccccaacacaucaauuguauuuuuucuguaaaacuc

SEQ ID NO: 294414 - RNA, 64 nt, Human
caaucuauuuuauaauuauauuugacauuuuguucacaucaacuaauguucaccuguagaagag

SEQ ID NO: 294415 - RNA, 64 nt, Human
ucguuagcaacugcgagcagaagcuuuccagucacacaucaaggcgcuugaucacaauggaaaa

SEQ ID NO: 294416 - RNA, 64 nt, Human
caguauuucagaacuuugagaauuggagagcaggcacaucaacugaucucauuucuagagagcc

SEQ ID NO: 294417 - RNA, 64 nt, Human
agggguuugcucacucagcaauaaauaacugugucacaucaaauccuaaauauaccacuacaaa

SEQ ID NO: 294418 - RNA, 64 nt, Human
uaauguccauuuccaucuuccccgucucccuuuccacaucaaggcacaucagacuucucagaga

SEQ ID NO: 294419 - RNA, 64 nt, Human
uguucaauuuuuuucauugaagacagcuucuauacacaucaaaguuuuauagcuagacuguaca

SEQ ID NO: 294420 - RNA, 64 nt, Human
gaacuauccaguguuaucuaaaaauuaaucugagcacaucaagauuuuuucauucucgugacau

SEQ ID NO: 294421 - RNA, 64 nt, Human
uuuuucuaaguaagaacacugagauauugggacacacaucaaaaaccuggagugcucaauugga

SEQ ID NO: 294422 - RNA, 64 nt, Human
acuaauucuuuauuuuugauguugugggaauuaacacaucaauggugguuaugggaacuaccaa

SEQ ID NO: 294423 - RNA, 64 nt, Human
gcagagauucccuggagggcuuguugaaagcacucacaucaacggagccucagaaagggagcug

SEQ ID NO: 294424 - RNA, 64 nt, Human
cccguuacacuacuacucagcccucuccugcggccacaucaacggaugcaagucacagucuuaa

SEQ ID NO: 294425 - RNA, 64 nt, Human
gucuugcugucaugaaaucagcaagagaggaugacacaucaaauaauaacucggauuccagccc

SEQ ID NO: 294426 - RNA, 64 nt, Human
uccaaauaacauuguucccauccuccccacccaccacaucaaaacauaacacaucacagcacuc

SEQ ID NO: 294427 - RNA, 64 nt, Human
caaguauuagaauaccacaggaaccacaagacugcacaucaaaauaugccccauucaacaucua

SEQ ID NO: 294428 - RNA, 64 nt, Human
gccccauccaacacccacaguaauuauuaucuggcacaucaaugaauuugggguccuauacacu

SEQ ID NO: 294429 - RNA, 64 nt, Human
aaauuugugccuacaccauguucugagagucguucacaucaaauucuuaucuuuuccaagccag

SEQ ID NO: 294430 - RNA, 64 nt, Human
uuuuucaagauuguaaugugauugaaguuuucaacacaucaacucacauauguucaaaaccaaa

SEQ ID NO: 294431 - RNA, 64 nt, Human
guuucacuaagacugauauuuuaggccucuuguucacaucaaaagauauuggugucagaauacc

SEQ ID NO: 294432 - RNA, 64 nt, Human
uuuuuuaaagaagauuugagcauuuuucuguaaucacaucaaaaugauguuuucuguguaaagc

SEQ ID NO: 294433 - RNA, 64 nt, Human
uuuaaaauuuacuuaguaaugcacauucaaaacacacaucaagucuucaggauaaaguucaaaa

SEQ ID NO: 294434 - RNA, 64 nt, Human
agguuugccaguuugcagaaacuaacucuuuucucacaucaacauuuguaaaauugauguguua

SEQ ID NO: 294435 - RNA, 64 nt, Human
augguauuuauuuguuauucuucaaugacccuuccacaucaacaguauuuaucauguguuaaag

SEQ ID NO: 294436 - RNA, 64 nt, Human
gauuguguacugcacaaccccagagaauaccagucacaucaaucaggguacgauugcacucacu

SEQ ID NO: 294437 - RNA, 64 nt, Human
uguguguucucauuaccugguuaugauagauaugcacaucaaagccuuuaccaguaucuuccug

SEQ ID NO: 294438 - RNA, 64 nt, Human
caggcugaccccaccagccagucagcuacaacuccacaucaacuccacaugcgcccagcucgag

SEQ ID NO: 294439 - RNA, 64 nt, Human
uucuccaguccuacauuucugaauugacuucuagcacaucaaaaauauuucagucauuaucagu

SEQ ID NO: 294440 - RNA, 64 nt, Human
uaucucugugucuguccaccagccacagcccaaacacaucaaacuugcuaagcggcggauaccc

SEQ ID NO: 294441 - RNA, 64 nt, Human
aggucccuuucucccucggugaaacacaguccuccacaucaauuuccaaacaaugaauuaggua

SEQ ID NO: 294442 - RNA, 64 nt, Human
uaguuguguuugaaaacguuuugauuuuuggaaacacaucaaaauaaauaauggcguuuguugu

SEQ ID NO: 294443 - RNA, 64 nt, Human
acaggcaaccaaagcaaaaguggacaaaugggaucacaucaaguuaaaaaucuucugcauugca

SEQ ID NO: 294444 - RNA, 64 nt, Human
gcugccuaugaccgccacuaguuaccgcggggaccacaucaagcuucaggccgacagcuucggc

SEQ ID NO: 294445 - RNA, 64 nt, Human
gagaaaaguguuccuuguguuuucaacucauagccacaucaaacauuuuccuuuuguauguaca

SEQ ID NO: 294446 - RNA, 64 nt, Human
aaauaucaucuugaauuguaaucccuauaauccccacaucaagggagagaucagguggagguaa

SEQ ID NO: 294447 - RNA, 64 nt, Human
uuauaaauugugcccuaagucagguacaaauguacacaucaaaaugcccauauuguaucuaucu

SEQ ID NO: 294448 - RNA, 64 nt, Human
uggugcauugagcaaauuguggucaaauauacaucacaucaaauuuaccaucuuaaccauuguu

SEQ ID NO: 294449 - RNA, 64 nt, Human
uaggggcacagugaauguguguauguaugaaggccacaucaacuuuauguagcaaagggcuugg

SEQ ID NO: 294450 - RNA, 64 nt, Human
ugccucccugcccccacaccugcacccaaacagacacaucaacgcaccccacucacagacaccc

SEQ ID NO: 294451 - RNA, 64 nt, Human
uuuuguucuuccccacaauuccauuacuaagaaacacaucaaauaaacugacuuuuucccccca

SEQ ID NO: 294452 - RNA, 64 nt, Human
agccugaaagcauuuccugcuucuacaagugugccacaucaauccgguaaugccccaguguuau

SEQ ID NO: 294453 - RNA, 64 nt, Human
uaauaugaucuguggagaauguacacaguuuaaacacaucaauaaauacuuuaacuuccaccga

SEQ ID NO: 294454 - RNA, 64 nt, Human
gaggccaaaagauuggacaccccugcaaacuaaucacaucaaucucucuugauuacacugugug

SEQ ID NO: 294455 - RNA, 64 nt, Human
uaauucucagcagaaauuuaaauaagauuuaauucacaucaaauaaaauuuagaaaauaaaauu

SEQ ID NO: 294456 - RNA, 64 nt, Human
aaaaucuccuuuaacaaccaagcaguuccucauucacaucaacagagcgaggcugugauaacuu

SEQ ID NO: 294457 - RNA, 64 nt, Human
agagaaaaugaaggaaggccacaagcucagagcccacaucaacacugccccccucccagcaccc

SEQ ID NO: 294458 - RNA, 64 nt, Human
ugccuuauuucccuauggcugagccuuguugugacacaucaagcuuuucuguagauguugucuu

SEQ ID NO: 294459 - RNA, 64 nt, Human
auuuuuauauaguagcuuauuugaccauaagucacacaucaaaaaaagauuacccuuaguguau

SEQ ID NO: 294460 - RNA, 64 nt, Human
augauuaaugaacaaaaacaaagagaaaaaaacacacaucaauuaaaggagacaaaaagaggca

SEQ ID NO: 294461 - RNA, 64 nt, Human
cugguuccuaacucucucccuccuccugcccacacacaucaaaagaaucuucccuacacccuuc

SEQ ID NO: 294462 - RNA, 64 nt, Human
gacugggucuagccccugaucccaaaucuguuuacacaucaaucugccucacugcuguucuggg

SEQ ID NO: 294463 - RNA, 64 nt, Human
ugugccccagaaagggcaguuacccggccagggucacaucaaccgccagaaguggaguugggca

SEQ ID NO: 294464 - RNA, 64 nt, Human
uuuucugguuugauugauuuccuuuuuucuuagacacaucaaagucaagaaagaugguuuuacc

SEQ ID NO: 294465 - RNA, 64 nt, Human
uaaacaaauaguguuauccuuuuacaauuaacugcacaucaauuuuauagacuuguucuacauu

SEQ ID NO: 294466 - RNA, 64 nt, Human
auuugaauggaaauucaagcacaaguacuggggacacaucaaagugugguguuugguuugccug

SEQ ID NO: 294467 - RNA, 64 nt, Human
uuucugucucucucuuucuuuucucucucucucucacaucaacccagugcugcagguuuugugu

SEQ ID NO: 294468 - RNA, 64 nt, Human
accauuuuccucuucugaaaauucuguaucugagcacaucaagagacucuuguagcagugguua

SEQ ID NO: 294469 - RNA, 64 nt, Human
cccauucuuagccuaacguucgucauugccucgucacaucaaugcaaaagguccugauuuuguu

SEQ ID NO: 294470 - RNA, 64 nt, Human
aggcaaaaagaacgagugauuuuuccuuaggauacacaucaaccacuuugcuguugaagcuguc

SEQ ID NO: 294471 - RNA, 64 nt, Human
guacuaauuuucacugcuaauaauucuguaaggacacaucaaagcuggccaaaauaaugaauuu

SEQ ID NO: 294472 - RNA, 64 nt, Human
aauaccaacaagguugcaacguuuacauuauagccacaucaacagaaguaacugguauauucuu

SEQ ID NO: 294473 - RNA, 64 nt, Human
agaaauuggagagcaaaaauuuugcuugucacugcacaucaauauaaaaaagcuuauuuaacuu

SEQ ID NO: 294474 - RNA, 64 nt, Human
aauauuuaaagaugcuuuggaaaccaaccgugaacacaucaacaccacgacgucuacgauuacu

SEQ ID NO: 294475 - RNA, 64 nt, Human
aggaauguauguguacauauuuauugcauacuugcacaucaaaucgauguacauaguuuaacac

SEQ ID NO: 294476 - RNA, 64 nt, Human
uaaaugggcacaagagaauuuuccugggaaaguucacaucaaaaagagugaaugugguauauuu

SEQ ID NO: 294477 - RNA, 64 nt, Human
aucccaguuacuuaggaggcugaggcaggagaaucacaucaaccugggaggcggagguugcagu

SEQ ID NO: 294478 - RNA, 64 nt, Human
uuagggucuuuacucccuaaugaugucugauuggcacaucaagaguuaacucugccuucugggc

SEQ ID NO: 294479 - RNA, 64 nt, Human
gaugaaccuggaggcccaccucaaggagugcgagcacaucaaaugcccccacuccaaguacggg

SEQ ID NO: 294480 - RNA, 64 nt, Human
gcgggacgcauccauguuaaaugacgagcugucccacaucaacgcgcggcugaacaugggcauc

SEQ ID NO: 294481 - RNA, 64 nt, Human
ccaggaauggugcuuuaugugagauaccccacuccacaucaacauuccagggaugagccaaacc

SEQ ID NO: 294482 - RNA, 64 nt, Human
uggucucuuuuaaaagacgaaucucaugaauauucacaucaaagacuugagcuuuuuaaacuag

SEQ ID NO: 294483 - RNA, 64 nt, Human
cuguaaguggauaagucuguauguguguaucauacacaucaaccuccauguccuuaguccuggg

SEQ ID NO: 294484 - RNA, 64 nt, Human
uauuuuagaagaaaguggaugaucagcucacuaccacaucaaaggugccaacucucuaaaacgu

SEQ ID NO: 294485 - RNA, 64 nt, Human
acuuaaagcaaaauaguauugcugaacucuuaggcacaucaauuaauugauuccucgcgacauc

SEQ ID NO: 294486 - RNA, 64 nt, Human
agcauagaacccgguauacagggguuucugcugacacaucaacgucuacacaccuaugcgccac

SEQ ID NO: 294487 - RNA, 64 nt, Human
gaagggacugaaauuguggggggaagguaggaggcacaucaauaaagaggaaaccaccaagcug

SEQ ID NO: 294488 - RNA, 64 nt, Human
aguucuguguucacguggcccccgacuccucagccacaucaagucuccuagaccacuguggacu

SEQ ID NO: 294489 - RNA, 64 nt, Human
uuaaaacaucauuacugccaucuuuaucaugaagcacaucaauuacaagcuguagaccaccuaa

SEQ ID NO: 294490 - RNA, 64 nt, Human
ucccaacaagcgcuagccuguaauuguagcuuuccacaucaagaguccuuauguuauugggaug

SEQ ID NO: 294491 - RNA, 64 nt, Human
ugauauaacucaggcugcaauuccauccaguucccacaucaacggagccacacauuuggcacug

SEQ ID NO: 294492 - RNA, 64 nt, Human
gaagacaucccacuaggaagagagagacuaccuccacaucaagaauauuuaaguuauuaucuca

SEQ ID NO: 294493 - RNA, 64 nt, Human
cuggcuucgaacauagcacaaguaacuugaauagcacaucaauagguuacuggacaaaagcaga

SEQ ID NO: 294494 - RNA, 64 nt, Human
guuucaugaaaggcauggcggcugcauuucauaccacaucaaaauacaguaacauuucuauacu

SEQ ID NO: 294495 - RNA, 63 nt, Human
uggcuggauuugaagcuuaaacuccuguggauucacaucaaauaccaguucaguuuugucauu

SEQ ID NO: 294496 - RNA, 64 nt, Human
ccucaauaaaauacuggcaaaccgaauccagcagcacaucaaaaagcuuauccaccaugaucaa

SEQ ID NO: 294497 - RNA, 64 nt, Human
aauaggaugauuugcauuuuguaaaauuauccugcacaucaagcugcaugccuuaaagcggaaa

SEQ ID NO: 294498 - RNA, 64 nt, Human
ccucagcaaaauacuaguaaaccaaauccaucugcacaucaaaaagcuaauccaacauuaucaa

SEQ ID NO: 294499 - RNA, 64 nt, Human
aagugcauuaaacugaaucacaauguaaauauuacacaucaagcgaugaaacuggaaaacuaca

SEQ ID NO: 294500 - RNA, 64 nt, Human
caauguuuuaaauugaaugaucauguaaauauuacacaucaaaccaaugacaugggaaaauggg

SEQ ID NO: 294501 - RNA, 64 nt, Human
ccaauaugugggguuggugaccaaucaguugagccacaucaaagcuaaguaagagcauggggcg

SEQ ID NO: 294502 - RNA, 64 nt, Human
uugaggcuccagacauacucaccucuaccucgaccacaucaaccccaucaccaagaggagguuc

SEQ ID NO: 294503 - RNA, 64 nt, Human
ugugugugcccuggugguggucuuaaggaccuaccacaucaacaucuggacaacccucacugau

SEQ ID NO: 294504 - RNA, 64 nt, Human
aacucaccacuuacccgggauaguaaacaugauacacaucaauaaaggcagacuuuauugugaa

SEQ ID NO: 294505 - RNA, 64 nt, Human
caggugugccuuaaccucccuauucagaaagcuccacaucaauaaacaugacacucugaaguga

SEQ ID NO: 294506 - RNA, 64 nt, Human
uuuguguuuaauauaucugggugauggaucacaacacaucaauaaacugacuuacccuaaaauc

SEQ ID NO: 294507 - RNA, 64 nt, Human
acuuguccagcugagcgccaggauggaacacggccacaucaaagaggcugaggcuggcacagga

SEQ ID NO: 294508 - RNA, 64 nt, Human
aacuugaguucuguuuugcaccuggauuuaccagcacaucaaagcugcuucgcaagcccccuca

SEQ ID NO: 294509 - RNA, 64 nt, Human
gaggggugacaguggaguagagaagcuguggaaacacaucaagcacaaguaugagaacaaguag

SEQ ID NO: 294510 - RNA, 64 nt, Human
uuaccugcucacuggcucuagccagcccagggaccacaucaaugugagaggaagccuccaccuc

SEQ ID NO: 294511 - RNA, 64 nt, Human; identical to SEQ ID NO: 294394

SEQ ID NO: 294512 - RNA, 64 nt, Human
gaccaugucuuaucuacuugcacuguucacccuucacaucaacccuguuacagcacucuguucu

SEQ ID NO: 294513 - RNA, 64 nt, Human
ccguguguuagaaaaguaagaagcagucaauuuucacaucaaagacagcaucuaagaaguuuug

SEQ ID NO: 294514 - RNA, 64 nt, Human
gucagacaaaauggcaguauccuaagaguuaaggcacaucaaacacaggagucgagagagugca

SEQ ID NO: 294515 - RNA, 64 nt, Human
uaaaggaguuuaaugcagugaucuuuguuuuuggcacaucaaaaauucucagucauuauucaug

SEQ ID NO: 294516 - RNA, 64 nt, Human
cccugagacaaccugggagacagccuggaucagccacaucaacucaguuguccaccacagggga

SEQ ID NO: 294517 - RNA, 64 nt, Human
ggacugagcucgugugccauccauauccaucuuucacaucaaugucuguccuguggccaugucc

SEQ ID NO: 294518 - RNA, 64 nt, Human
uugauagaauucaaaaaggccaucuuuuugcuuucacaucaauaaaauuuaccaaguaauagau

SEQ ID NO: 294519 - RNA, 64 nt, Human
uaugucaaauauaauuuuuuuaaaaauugaguggcacaucaaagaaaugugaaauuaaaaagaa

SEQ ID NO: 294520 - RNA, 64 nt, Human
aggagaaagcaaaauacaucagcuugguaguuaacacaucaaauauuucuugcugcuucuagga

SEQ ID NO: 294521 - RNA, 64 nt, Human
ucacagcugcuuggggcccacagcacugcugccuggucuccacaguagccucccugcccggguc

SEQ ID NO: 294522 - RNA, 64 nt, Human
aacccuugccccuccucauagaccaagucccgggggucuccacucaguccugcugccugcuuca

SEQ ID NO: 294523 - RNA, 64 nt, Human
gaggacccccagaacuaagaagggagggcgagugggucuccauuccccgagaagccgggggcag

SEQ ID NO: 294524 - RNA, 64 nt, Human
ucccucucaggguccuggggaucugccucucuguggucuccauccugacucuugaacuuaccca

SEQ ID NO: 294525 - RNA, 64 nt, Human
acugggaaagaggccagaagagccguuuggccagggucuccaauuuaggcuuucaacauuaucu

SEQ ID NO: 294526 - RNA, 64 nt, Human
gccuccggauuguguuaguaguagccaucaggagggucuccaacuaaaacacuuguuccugcuu

SEQ ID NO: 294527 - RNA, 64 nt, Human
ccuccaggagaaggggcccaagguccccguggauggucuccaccugugcuuggaaccaguguaa

SEQ ID NO: 294528 - RNA, 64 nt, Human
acaguuucaggcccccaaaccguuuccaccggcgggucuccaaaacaacccacggcucaacucc

SEQ ID NO: 294529 - RNA, 64 nt, Human
gagcucuuguuccgugccaggcauucaauccucaggucuccaccaaggaggcaggauucuuccc

SEQ ID NO: 294530 - RNA, 64 nt, Human
gcagcuccccaggcugaaagcagcccuggcccagggucuccaugguucuaggcagacccucuuu

SEQ ID NO: 294531 - RNA, 64 nt, Human
guaaucaagacuugagauaucgaagucaguuauuggucuccagagugcagcucugggagccuuu

SEQ ID NO: 294532 - RNA, 64 nt, Human
ccaguaucugucauggaacugaacauucaucgauggucuccauguauucauuuauucacuuguu

SEQ ID NO: 294533 - RNA, 64 nt, Human
uuugccuucauucucuuacccaccucuaccuaugggucuccaaucucggauauccaccuugugg

SEQ ID NO: 294534 - RNA, 64 nt, Human
ccucugagccuggucuuuuguccuuuuuuauuuuggucuccaagaugaaugcucaucuuuggag

SEQ ID NO: 294535 - RNA, 64 nt, Human
gaaccaacaucacugcucuuuuagauaaaccucugcccuccacuccuugcuugaguggguuaaa

SEQ ID NO: 294536 - RNA, 64 nt, Human
gcuggccacgcggcucguucccccgcuccucggggcccuccaaggugucuccguagucagcagg

SEQ ID NO: 294537 - RNA, 64 nt, Human
aggcgagcagaggaaaccccuuccugggccugcugcccuccacggagcagcagcacccuccagc

SEQ ID NO: 294538 - RNA, 64 nt, Human
gcccucagaggaguccugcaggcuuccuaccaguggucuccaggggugcaggaguaacuggggc

SEQ ID NO: 294539 - RNA, 64 nt, Human
ccucuacucucagcugacugcugcauuuaggccaggucuccaauugcuuuccuccagaaagugu

SEQ ID NO: 294540 - RNA, 64 nt, Human
ccuccauugccuggcccaggugagcagcuuggcaggucuccaaguggaacccgguccagacagg

SEQ ID NO: 294541 - RNA, 64 nt, Human
ccucccuccuguggccgccggcagcauggacaaaggucuccaugcagggggaggaggccugcuu

SEQ ID NO: 294542 - RNA, 64 nt, Human
uaugggaguuugccuuguagauuccucuggugcuggucuccaggcugacaaggauucaaaguug

SEQ ID NO: 294543 - RNA, 64 nt, Human
cccaggcagcuguuugcagcugaagaaacaaacuggucuccaggcugucuugccuuuauuccug

SEQ ID NO: 294544 - RNA, 64 nt, Human
gcccucuccugugucuguccuccggaccuacccaggucuccaccaucaggacccugucuuuggg

SEQ ID NO: 294545 - RNA, 64 nt, Human
gaccugaauugaaagagaauuuggagccaggaugggucuccauucuguguggcaccuugauugg

SEQ ID NO: 294546 - RNA, 64 nt, Human
uaggaucucguuuguggugagugggcugcucugaggucuccacugggcugccauuuagccaugu

SEQ ID NO: 294547 - RNA, 64 nt, Human
ggaugggggaaagaaaagaaagagaagaagcuggggucuccaggcaggguaguaagcugacacu

SEQ ID NO: 294548 - RNA, 64 nt, Human
gcaaagccaaaaccuucguccuuuuaaaaaccuaggucuccaguuggcuuuacuuuaaaaugcc

SEQ ID NO: 294549 - RNA, 64 nt, Human
cuccacuuuauuucucugggaaaaauaggcugcaggucuccagagcauaucgaugcaguacugu

SEQ ID NO: 294550 - RNA, 64 nt, Human
uguagcaagaugcaaaugcauggcaaauccugucggucuccaguugguuaucugaauaguguca

SEQ ID NO: 294551 - RNA, 64 nt, Human
aguagaggcgggguuucaccauguuagccaggauggucuccaucuccugaccucgugauccgcc

SEQ ID NO: 294552 - RNA, 64 nt, Human
gccagaucccuuauccaacucucgacuuuuccuuggucuccaguggaagggaaaagcccaugau

SEQ ID NO: 294553 - RNA, 64 nt, Human
cucacacugaguuucagugugauuucaggcuguuggucuccagggcacaggaucuuagcuacuc

SEQ ID NO: 294554 - RNA, 64 nt, Human
cccaggcagcaccaggccccagcucccuccgggggcccuccaggaaccaccaagcucucucacg

SEQ ID NO: 294555 - RNA, 50 nt, Human; identical to SEQ ID NO: 150450

SEQ ID NO: 294556 - RNA, 64 nt, Human
aucaucucaugccucaggcuuuggcagguauccugcccuccaucuuauuccaguguguucaccu

SEQ ID NO: 294557 - RNA, 64 nt, Human
accaacuccucugccccuaaggcugugucccuguggucuccagccaccccuaccccagucacuc

SEQ ID NO: 294558 - RNA, 64 nt, Human
uggcgacucuauagacucuaggacauaaauuagaggucuccaaaaucggaucuggggcucuggg

SEQ ID NO: 294559 - RNA, 64 nt, Human
ugccauuggguuuugcccuugcaaaggcuuccuaggucuccaguggccccucaggacccagggu

SEQ ID NO: 294560 - RNA, 64 nt, Human
gagagcaugccgucuugauguuuaaaaaacccagggucuccacccuuccuuugauuugugcaau

SEQ ID NO: 294561 - RNA, 64 nt, Human
cucggccaaccaaggcacgcagcauguccccucaggucuccagucaguccagguugacccucag

SEQ ID NO: 294562 - RNA, 64 nt, Human
uccuccaggucccacuccuguucauugccccuuaggucuccaaaauguaaauucuaauguuuac

SEQ ID NO: 294563 - RNA, 64 nt, Human
auaaaauaaauauacauuuaguggcuugggcuauggucuccaaagauccuucaaaaauacauca

SEQ ID NO: 294564 - RNA, 64 nt, Human
gaggggcucuccuggccucaaucuccaucuuuagggucuccacagacuaacauugaagucuucc

SEQ ID NO: 294565 - RNA, 64 nt, Human
uguuguuacugauucuccugucagagaucugggaggucuccacugaggaugugagccugauuau

SEQ ID NO: 294566 - RNA, 64 nt, Human
aaggagaagccaaauggcugcacuggccgauucuggucuccagaggaccuugguguuugcucuc

SEQ ID NO: 294567 - RNA, 64 nt, Human
uuauguuggauacucaauucuuaaccaaaaucuuggucuccacaaacucuaccaucccuuuucu

SEQ ID NO: 294568 - RNA, 64 nt, Human
gguggagacgggguuucgcuguguuggccgggcuggucuccagcuccuaaccgcgagugauccg

SEQ ID NO: 294569 - RNA, 64 nt, Human
aaccuccagccuccugcccagcacaggaaucgguggucuccaccugucauucuagaaacaggaa

SEQ ID NO: 294570 - RNA, 64 nt, Human
uuucucaacaaggaagacuccccugccuccucaaggucuccauucuccuaggagacaaagcaau

SEQ ID NO: 294571 - RNA, 64 nt, Human
acagccaggagaugcugggccaguuccuccaagaggucuccaucauggcagugaugaaaaccua

SEQ ID NO: 294572 - RNA, 64 nt, Human
gguggggcaggacauggcucccauuuugaagggaggucuccaugugguccgagugaggugagac

SEQ ID NO: 294573 - RNA, 64 nt, Human
ccgcaugcggcccaggauggcuuugaaugcggcccaacgcaaauucgcaaacuuucuuaaaaca

SEQ ID NO: 294574 - RNA, 64 nt, Human
agcgcguggcccauguaugaggagugaaggggcccaacgcaauaaccacgucccccacccgggc

SEQ ID NO: 294575 - RNA, 64 nt, Human
agcuaucauuaugcacuugggagaaaauuaagggccgauuuaauuaaacuuagguaagaagauu

SEQ ID NO: 294576 - RNA, 64 nt, Human
ccuccaccugcagccccaggccucccucccccggggucuccaccucaggggagacuuaggccag

SEQ ID NO: 294577 - RNA, 64 nt, Human
cccuaggggagccucccacuggagugcccggccaggucuccaagccccaaaugaguccuuguga

SEQ ID NO: 294578 - RNA, 64 nt, Human
auagggaccucacccuggggccagagugggcucuggucuccacagauggcucaacguuuuugga

SEQ ID NO: 294579 - RNA, 64 nt, Human
aauaguguugaaaauucacaguuuuaaguuugauggucuccauucaggcaaguguguuucagca

SEQ ID NO: 294580 - RNA, 64 nt, Human
gcgaugugcgcccucuuucacuuuuuuucuucuaggucuccaggucccggaggggauuugugga

SEQ ID NO: 294581 - RNA, 64 nt, Human
acugguguggauggcccaggaggugcuggagcuaggucuccaggugggccugguucccaggcag

SEQ ID NO: 294582 - RNA, 64 nt, Human
acacuacagagaucccacacuacuuccggcuuauggucuccaggcccuucuccguuucucaaga

SEQ ID NO: 294583 - RNA, 64 nt, Human
ucacguagucuagcuaguucacauucaaggucuaggucuccaucaucuagaucucauucacgaa

SEQ ID NO: 294584 - RNA, 64 nt, Human
agauuuccuucccaucccagcugaaauacugaggggucuccaggaggagacuagauuuaugaau

SEQ ID NO: 294585 - RNA, 64 nt, Human
caaaacccacagagaauaagggaaggcagcagagggucuccaagggcaucacugggucugcugg

SEQ ID NO: 294586 - RNA, 64 nt, Human
gccagcugcuugugggggcaccugggaggucaaaggucuccaccacaucaaccuauuuuguuuu

SEQ ID NO: 294587 - RNA, 64 nt, Human
gccaggauggguagcuagcccauguuuagauccaggucuccaauucaugguuaucagggcaugu

SEQ ID NO: 294588 - RNA, 64 nt, Human
uguagagacgagguuuugccauguugcccaggcuggucuccaacuccuggacuuaacgccaucc

SEQ ID NO: 294589 - RNA, 64 nt, Human
aguagagacagagucucaccacauugcccaggcuggucuccaacuccugagcucaggcagucug

SEQ ID NO: 294590 - RNA, 64 nt, Human
caccuaguuccuuuuggcuuucaucugcaguguaggucuccauagcuagugacacacaaagccu

SEQ ID NO: 294591 - RNA, 64 nt, Human
cucucuggaccauacgcggaggaguuuucuguguggucuccagcuccucuccagacacagagac

SEQ ID NO: 294592 - RNA, 64 nt, Human
ggagguaucuauuuuaagucaggggcuuuacuagccgauuuaguucucacaauaaccaugugga

SEQ ID NO: 294593 - RNA, 64 nt, Human
auaaauuugaauuucuguaggaagaaucaaaucaccgauuuaaagauugcaauauauaauaauc

SEQ ID NO: 294594 - RNA, 64 nt, Human
aaaacgaaaaccaaccgccuugcauccaguguucccgauuuacuaaaauagguaaccaggcguc

SEQ ID NO: 294595 - RNA, 64 nt, Human
acacagcguuggucucuguuuggaaucacugugaggucuccagaaggaccuggccgccagcccc

SEQ ID NO: 294596 - RNA, 64 nt, Human
guccguauuuuuaacagaagacagugcaacaacuggucuccaccaguauuugucacuuuauuuu

SEQ ID NO: 294597 - RNA, 64 nt, Human
caagccucagacucuuaccaucccggugcaugcaggucuccaugaagaagcugggacucauuca

SEQ ID NO: 294598 - RNA, 64 nt, Human
gcgcuguggucaccugaggaugugguucagguggggucuccagaaggcugcuugcccccagaga

SEQ ID NO: 294599 - RNA, 64 nt, Human
aguaaugacaggguuucaccguguuggccaggcuggucuccaacuccugaccucaggcgaucca

SEQ ID NO: 294600 - RNA, 64 nt, Human
ggacacacauugcaacuucccacuucugacgaaaggucuccaugcuuuugcuguuuucuuuacu

SEQ ID NO: 294601 - RNA, 64 nt, Human
uucuuccugauauugauuuuauuuguuaacugaaggucuccauauguuuguuuauauugcuaau

SEQ ID NO: 294602 - RNA, 64 nt, Human
ggcccgucagagucaagagaugucauccccccagggucuccaaggcauuuccacacuauuggug

SEQ ID NO: 294603 - RNA, 64 nt, Human
acuggcccaguuuacagugaaauggagaauuucaggucuccacgucugcccaggaaagaacuuc

SEQ ID NO: 294604 - RNA, 64 nt, Human
uuggucuacuugucuagucccauaccagacucacggucuccauuauuggagcuuuaauaauuuu

SEQ ID NO: 294605 - RNA, 64 nt, Human
gaggagggggccgccgcggacccuggcagcgaugggucuccaggcaaguccccguccaaaaaga

SEQ ID NO: 294606 - RNA, 64 nt, Human
auucauugcccacuaggaucccacuggcgaagauggucuccauaucagcucucugcagaaggga

SEQ ID NO: 294607 - RNA, 64 nt, Human
gccgaacccagcccucugcgcgccagugcugugcggucuccacacccuuacgguuuccuagaau

SEQ ID NO: 294608 - RNA, 64 nt, Human
cauaucacagauguggggccauggccucgaugauggucuccacaggucuuuccaccucugugag

SEQ ID NO: 294609 - RNA, 64 nt, Human
aggaggggagccuccaaguguggugcaagccgggggucuccacaucuuccuucucugaagucca

SEQ ID NO: 294610 - RNA, 64 nt, Human
aagaacaaauuuguucuuccugauaugauaacuaggucuccaagagaaaauagaaaggcugcuu

SEQ ID NO: 294611 - RNA, 64 nt, Human
agaacuuuauuucuucauacgacauaacagaauugcccuccaagucacacaagcuccaagacua

SEQ ID NO: 294612 - RNA, 64 nt, Human
uggagaugucagucuguccacguggagagaaguugcccuccaggccgacaggaggccaugccca

SEQ ID NO: 294613 - RNA, 64 nt, Human
acucugaucccucuguacaggcuggauggaaggggcccuccacacuuccugggaggucagagac

SEQ ID NO: 294614 - RNA, 64 nt, Human
aaaaaugaagcaaaucucacuggauauuuuuaaaggucuccacagaguuuaugccauauuggaa

SEQ ID NO: 294615 - RNA, 64 nt, Human
aguagagaugggguuucaccauguuggccaggcuggucuccaucuccugaccucgugauucacc

SEQ ID NO: 294616 - RNA, 64 nt, Human
uuuaauauuuaaaggcagauguacgcuuuaaauuggucuccauuucuucuuagaauguugauau

SEQ ID NO: 294617 - RNA, 64 nt, Human
agcugcccucuccgugcaaugucacugcucguguggucuccagcaagggauucgggcgaagaca

SEQ ID NO: 294618 - RNA, 64 nt, Human
acaugugcccauugauacaaggcugcugaggccuggucuccaguuggaaauauaauuaagggug

SEQ ID NO: 294619 - RNA, 64 nt, Human
gagcacagccucacggacagugccaaacccugugggucuccaggggcuugggaaauguguucuu

SEQ ID NO: 294620 - RNA, 64 nt, Human
cucuucuugcuauaugauuuagcaaguucuagaaggucuccaagacaauaauuacauuggcaca

SEQ ID NO: 294621 - RNA, 64 nt, Human
cucuucccuucccacccagcugcgcccucggcucggucuccagcgccucagcccacccuucccg

SEQ ID NO: 294622 - RNA, 64 nt, Human
ggaaaccucacuguuuccuccuuccagggacugaggucuccaagcuagcuguggcuuaugcaga

SEQ ID NO: 294623 - RNA, 64 nt, Human
uaagccuucucaggcaagcuguauacuaguuacuggucuccacugccaugccuuuucaagguuc

SEQ ID NO: 294624 - RNA, 64 nt, Human
auuauauacaaucguguguaaaccuuuacacuaaggucuccauauacuauuuuuuucuacugaa

SEQ ID NO: 294625 - RNA, 64 nt, Human
aagacacagggucagagaucugucagaggaaaauggucuccacagcaacucuggagggaagcug

SEQ ID NO: 294626 - RNA, 64 nt, Human
aaggaaauagagcaacacaaaggccucgaaaagaggucuccagcaaaaggcucugcaagugcaa

SEQ ID NO: 294627 - RNA, 64 nt, Human
agacuuaaacugagccaugcuaccagcaucccagggucuccagccuacagaugagcuguugugc

SEQ ID NO: 294628 - RNA, 64 nt, Human
uuaauacuuccucuuaaaaaucuccaagaagcugggucuccagaucccauuuagaaccaaccag

SEQ ID NO: 294629 - RNA, 64 nt, Human
uuuuauuccgucuccaugaggaauugaaggaguuggucuccaccuagagauacauuugauuuac

SEQ ID NO: 294630 - RNA, 64 nt, Human
cagagacccaacagcagugaucucagggcagacagcccuccacuccagcucugagacccuuuuc

SEQ ID NO: 294631 - RNA, 64 nt, Human
ucugagcugucgucacugacuucaugacagucuggcccuccagacaagagcagcgcuggcaucg

SEQ ID NO: 294632 - RNA, 64 nt, Human
aguggccugcccguacuccuccacccagaugagggcccuccagagccugcaggcaucugugggg

SEQ ID NO: 294633 - RNA, 64 nt, Human
agcacucugucguucucugagccccaccucagcaggucuccaggaucccucacauuuccccugu

SEQ ID NO: 294634 - RNA, 64 nt, Human
acaaaacugugaaggauuguggucaccuggaacaggucuccaaucuauguuagcacuauguggc

SEQ ID NO: 294635 - RNA, 64 nt, Human
agagaacaucagaugauugaaauguucgcccaggggucuccagcaacuuuggaaaucucuuugu

SEQ ID NO: 294636 - RNA, 64 nt, Human
uuucuaauucaagcggguuuuuggaaaaauuuauggucuccauuaaaauacauauuacaacugg

SEQ ID NO: 294637 - RNA, 64 nt, Human
cacauuuucgccccaaaauaaugagaccucaccuggucuccacguuuccacgucccugcucaaa

SEQ ID NO: 294638 - RNA, 64 nt, Human
accguccagccauccaaccucacuucgccuuacaggucuccauuuugugguaaaaaaagguuuu

SEQ ID NO: 294639 - RNA, 64 nt, Human
ccucuuggcuaaggugcuguuccuguuccugcaaggucuccagaaccccuuuggaaauggugaa

SEQ ID NO: 294640 - RNA, 64 nt, Human
ugugaccucaccucaaagacaauucauagccuguggucuccacauaaacagcaacaagacaagu

SEQ ID NO: 294641 - RNA, 64 nt, Human
ccaaccacgggcuguuuaggaggaugccugcuugggucuccaaauggcugggguaggaaugguu

SEQ ID NO: 294642 - RNA, 64 nt, Human
uuguacuauuuuguuucugcccugaugucccuugggucuccauccuacugccuggcuuucuugg

SEQ ID NO: 294643 - RNA, 64 nt, Human
auaacggcgcagccagguauucggagccacuacaggucuccauaucuugaugguucccugggcc

SEQ ID NO: 294644 - RNA, 64 nt, Human
gcucuggcuucugugauggugcaagaggcaggauggucuccagacaccuucuugcagagugauu

SEQ ID NO: 294645 - RNA, 64 nt, Human
uguucuggaaaggaccccauggcagacuuggcaaggucuccacuucaggggcaaacaucuccau

SEQ ID NO: 294646 - RNA, 64 nt, Human
cuguccaggccucucauaucaugaccagacggcgggucuccaucuucuuucacuccuguggccc

SEQ ID NO: 294647 - RNA, 64 nt, Human
aguagagaugagguuucaccauguuggccaggcuggucuccaacuccugaccucaggugaucca

SEQ ID NO: 294648 - RNA, 64 nt, Human
ccugggagagaaguuugaagcacaacucccuuaaggucuccaaaccagacggugacgccugcgg

SEQ ID NO: 294649 - RNA, 64 nt, Human
aggaacaccuucgagcuuugcagaccugcggucagcccuccaugcgcaagacuaaagcagcgga

SEQ ID NO: 294650 - RNA, 64 nt, Human
ggguccccggcaccccggccccgcagcgcgacucgcccuccagccccaacccccggcccggcgc

SEQ ID NO: 294651 - RNA, 64 nt, Human
cugucagagauuccagaagccucuccuccccgccgcccuccaccccugccuuucagcguugugg

SEQ ID NO: 294652 - RNA, 64 nt, Human
gcauuugugucgguuaaaaauucgaaggcuuaugggucuccagaaacucugccagccagccuca

SEQ ID NO: 294653 - RNA, 64 nt, Human
aagcccaguacguacaauuguguuggguguggguggucuccaaggccacgcugcucucugaauu

SEQ ID NO: 294654 - RNA, 64 nt, Human
gcgaaacaguuugaaagggacugaggcucacccaggucuccagcaaacggaggacugaacuggg

SEQ ID NO: 294655 - RNA, 64 nt, Human
acucuuggagccugcagagcugcgggcuggguguggucuccacuggggauugggccccugccag

SEQ ID NO: 294656 - RNA, 64 nt, Human
uguacuaggccuaugaagagugguaagccaaauaggucuccaugggagauacauuauguaaaua

SEQ ID NO: 294657 - RNA, 64 nt, Human
ggauuagccccuccuggaaaaugguguuggguuuggucuccagcuccaauacuuauuaaggcug

SEQ ID NO: 294658 - RNA, 64 nt, Human
cucccuacugccuuuucagacuuggagcacccaaggucuccaaugaaaguuuucucauucaccu

SEQ ID NO: 294659 - RNA, 64 nt, Human; identical to SEQ ID NO: 294647

SEQ ID NO: 294660 - RNA, 64 nt, Human
gggaauccuguguggaauguugaacuuucgccauggucuccaucguucugggcguaaauucccu

SEQ ID NO: 294661 - RNA, 64 nt, Human
cacuuuaaaaacaggccagccugcuugggcgcucggucuccaccccagggucauaaguggggag

SEQ ID NO: 294662 - RNA, 64 nt, Human
aacagcaggauugcuuuugaccuuuuagaagauuggucuccaguaaagguggacauuuuugaga

SEQ ID NO: 294663 - RNA, 52 nt, Human
auuacguugccccggugugaguggucuccauggcaacuuggagccagccagg

SEQ ID NO: 294664 - RNA, 64 nt, Human
aguagagacgggguuucaccauguuggucaggauggucuccaucucuugacauugugauccacc

SEQ ID NO: 294665 - RNA, 64 nt, Human
uuaccuggacugagccucacuuacagcuucucuaggucuccagcuugcagacagccuaugggag

SEQ ID NO: 294666 - RNA, 64 nt, Human
uguagagacagguucuugccagguggcucaggcuggucuccaacuccugagcucaagcgaucug

SEQ ID NO: 294667 - RNA, 64 nt, Human
aaucuccgcuuguccaagacaggggccuaaggagggucuccacacugcugcuaggggcuguugc

SEQ ID NO: 294668 - RNA, 52 nt, Human; identical to SEQ ID NO: 150601

SEQ ID NO: 294669 - RNA, 64 nt, Human
ggagccggggcugugagaggaucaucuggggcaggcccuccacuuccaagcaagcagauggggg

SEQ ID NO: 294670 - RNA, 64 nt, Human
gccccagccccaauccagagaagcgcuguugcccgcccuccacccacuaggugaacagcaggau

SEQ ID NO: 294671 - RNA, 64 nt, Human
gaccccgggccagcacuuggcaggcaggaggugcggucuccagaguggugggccagggcgggcu

SEQ ID NO: 294672 - RNA, 64 nt, Human
ugcugacgggacccuucugaaguucgggacgcggcggcugcaguuucacccccgaauuuccaag

SEQ ID NO: 294673 - RNA, 64 nt, Human
gcaccaggugucuuuuuccaguccccagaagcagagagcacagccccugcugugugggucugca

SEQ ID NO: 294674 - RNA, 64 nt, Human
ccuccuggcacuccagaccugggugaugugcaggagagcacacugauagaaauccuugugucca

SEQ ID NO: 294675 - RNA, 64 nt, Human
caaacagcaagcacugacaagcagcacauucucaagagcacacagguaagaggaccugcuuuac

SEQ ID NO: 294676 - RNA, 64 nt, Human
ugauugugauguaugggaaaagaacuccagucagagagcacaucuaguucaacaucagagcauu

SEQ ID NO: 294677 - RNA, 64 nt, Human
ccauuuaaaaucacuguaauuaauuaguuugauuagagcacaaagcuuagcuaaucaaccauua

SEQ ID NO: 294678 - RNA, 64 nt, Human
accuagaguugccaguggcacauuacaccaguacagagcacauuccaaaggagacauuggacca

SEQ ID NO: 294679 - RNA, 64 nt, Human
gugccauguggcuacuuuaguaauauugccaagaagagcacaguuuuuacacuaguggcaucuc

SEQ ID NO: 294680 - RNA, 64 nt, Human
uaggaguggagcacguuucugugaacguuaacccagagcacagcgccaaggccugucuucccuu

SEQ ID NO: 294681 - RNA, 64 nt, Human
acuguuuuuuauuuggacacuuacauaacagugcagagcacaaugcuguguaacauaggaauuc

SEQ ID NO: 294682 - RNA, 64 nt, Human
gccuugauuuguucuuacaguuaagaagcccugcagagcacaaacuucagaaacccggcuuccu

SEQ ID NO: 294683 - RNA, 64 nt, Human
uuuaaauuauauuuucauauguuuuguuggggacagagcacauuaagucugaaagcaacagagg

SEQ ID NO: 294684 - RNA, 64 nt, Human
ggagguaaagaaauagccaaucaucuauugccugagagcacagcaggagggacaaugaucggga

SEQ ID NO: 294685 - RNA, 64 nt, Human
ggaccgagggucccagccugcaggcuccccgcagagagcacaggaagaggcaggggcggggucc

SEQ ID NO: 294686 - RNA, 64 nt, Human
auaaaaagacaaaacagguuugccuuggcaucagagagcacaaagauuaaaaguuacuuuaaau

SEQ ID NO: 294687 - RNA, 64 nt, Human
aggggagaggugaaaucuugcaaguuguagcaagagcacacaggaaaccccuaacuuuccuaua

SEQ ID NO: 294688 - RNA, 64 nt, Human
cuuuuuuuuuuucugaaaaaaggaaaaagcacacagcacacaauuucaagccauuuucagauca

SEQ ID NO: 294689 - RNA, 64 nt, Human
agggaugugcuguaauuugauuuacaugcauuagagcacacaguagaaaaacuuuagcuucauu

SEQ ID NO: 294690 - RNA, 64 nt, Human
gcugcuaguaggagccguuaggggaggaguuuggggucuccacacgaugccuagagaaugcugc

SEQ ID NO: 294691 - RNA, 64 nt, Human
aucauaauuaccaagugaagcugguggaacauauggucuccauuuuacaguuaaggaauauaau

SEQ ID NO: 294692 - RNA, 64 nt, Human
ccucauauccacuggcaguccccguucgcaucauggucuccauguguaccgccaaagucaauua

SEQ ID NO: 294693 - RNA, 64 nt, Human
gaguauaggaacugcuggcuuugcaaauagaaguggucuccagcaaccguugaaaggcauagaa

SEQ ID NO: 294694 - RNA, 64 nt, Human
cgggcuggugggagccaagaccagacagagugggggucuccaucuguuuucucuucucccucaa

SEQ ID NO: 294695 - RNA, 64 nt, Human
cuguaaaugucugcgcagggugcacaugcugcgaggucuccauccuccgggccugucccuccca

SEQ ID NO: 294696 - RNA, 64 nt, Human
aaggauuaaauauguauuuuguagacucuuucccggucuccaagaacaaaguaaaugauucuau

SEQ ID NO: 294697 - RNA, 62 nt, Human
cacccuccuuugcugcuuaauaaauucugaacuuggucuccaugcuguuuuccugcccucca

SEQ ID NO: 294698 - RNA, 64 nt, Human
uguuuaucauaaaaaagaaacaguauuagauuuuggucuccauaaucuauuuugguauuguuac

SEQ ID NO: 294699 - RNA, 64 nt, Human
gugcagcagcagcuccucucaagcucacucucuaggucuccaggguaggaguguuuuucuagca

SEQ ID NO: 294700 - RNA, 64 nt, Human
agcacagcauacaagugugugcucuguucgcccaggucuccaugguuaguugaagccaauuucu

SEQ ID NO: 294701 - RNA, 64 nt, Human
agaacaaaugugugcauucacccccagucacaauggucuccauugcauuucaaaggagaggauc

SEQ ID NO: 294702 - RNA, 64 nt, Human
ugguugugaauuacuguagcagcaaaagcaaauuggucuccacaccuaaaaucgucugccugug

SEQ ID NO: 294703 - RNA, 64 nt, Human
aaguugagcagguaucaacuaggggaggagagagggucuccaguguuccccccauagagaccag

SEQ ID NO: 294704 - RNA, 64 nt, Human
ucuggguuccaucccaccugcuacaugcucaccaggucuccauugaggaagaacaggaacgccg

SEQ ID NO: 294705 - RNA, 64 nt, Human
ugcugcaggcuguuguaacacuuuaagggccccaggucuccacugccaagcaggacuuggcaca

SEQ ID NO: 294706 - RNA, 64 nt, Human
caaaugaauucuaaaccaaucaaaugucugggaagcccuccaagaaaaaaaauagaaaagcacu

SEQ ID NO: 294707 - RNA, 64 nt, Human
aggccuggcgcgggguggcugcugcccccuccuugcccuccacgcccugcccccugcauccccu

SEQ ID NO: 294708 - RNA, 64 nt, Human
ccuccaccggugccuccucuggggaagggaaccagcccuccagagcaggagacuggcaagagcu

SEQ ID NO: 294709 - RNA, 64 nt, Human
ccaggcuuccuuugccugaagcuguuuugggaagggucuccacacaggcacugaucucccaagc

SEQ ID NO: 294710 - RNA, 64 nt, Human
ggccccgugcuccuccuccuccuccucagggcugggucuccagagaguggggccuugguccuga

SEQ ID NO: 294711 - RNA, 64 nt, Human
cagaccccagccccauucccaucuacugaaacagggucuccacaagaggggccagggaauaugg

SEQ ID NO: 294712 - RNA, 64 nt, Human
gucucugucacuguggacuccagucauucaaggaggucuccacucuuggguuuuuuuuauuuuc

SEQ ID NO: 294713 - RNA, 64 nt, Human
ggacagucucaguuaugggauaaggcccccugggggucuccauuucuuuccaacaguuucaugu

SEQ ID NO: 294714 - RNA, 64 nt, Human
aucacacaccauccccacugucauucagggccugggucuccagcucuguaaccaguccuguccc

SEQ ID NO: 294715 - RNA, 64 nt, Human
aguggguguguggggaagucacugucccacuaugggucuccacuacccagucacugacccuggg

SEQ ID NO: 294716 - RNA, 64 nt, Human
cacacuuccaugagaagaagcagauccccuguguggucuccaugcucaccaaggaacucuacuu

SEQ ID NO: 294717 - RNA, 64 nt, Human
acugaguuucuuaggaaauuugucuucaguauuaggucuccaacucuuguaaaaaguuuauaug

SEQ ID NO: 294718 - RNA, 64 nt, Human
uacuuaggugucuuaacgugaauugagucuccaaggucuccaugugaaacaagcaaaaagagaa

SEQ ID NO: 294719 - RNA, 64 nt, Human
gaauggcagagcucacuucuguaccacgucugcuggucuccagccuuguauggaguuagaagcg

SEQ ID NO: 294720 - RNA, 64 nt, Human
cccccuuucacaggcagccagugcccugagccagggucuccagaaagccccacccaggccaggc

SEQ ID NO: 294721 - RNA, 64 nt, Human
caggucucauaaugcauguggcacuuagguccaaggucuccagagggugaaagcuggagucugu

SEQ ID NO: 294722 - RNA, 64 nt, Human
aaaaaaaaaaagauccauuuuuuagguucuuuucggucuccagcugacaacccaacuggacaau

SEQ ID NO: 294723 - RNA, 64 nt, Human
gagauggaaggaaacguuauaccuuguaccccucggucuccauccaucaagccaaaccugcugc

SEQ ID NO: 294724 - RNA, 64 nt, Human
ggucaagcauuugucuugacuugcuuuccucccgggucuccagccuccgaccccucgccccaug

SEQ ID NO: 294725 - RNA, 64 nt, Human
ccacccugugggcagccuggcggaaaagauccaggcccuccacuucuccuugaggcagcuggag

SEQ ID NO: 294726 - RNA, 64 nt, Human
accgagcaccagggcagguugcgcugacucugcggcccuccaggacggacaccgggugaccccu

SEQ ID NO: 294727 - RNA, 64 nt, Human
ugucagauauuguucuuuugauaugcaguuuccagcccuccaaugaguccccagcacagaucuc

SEQ ID NO: 294728 - RNA, 64 nt, Human
agcagcucacuucucuguguucugccuccccucuggucuccagaguuuuccuguccucuagagg

SEQ ID NO: 294729 - RNA, 64 nt, Human
auucccauugcucuccuggcucacucuuacggucggucuccagugacugaagcauuccccaccc

SEQ ID NO: 294730 - RNA, 64 nt, Human
aaggccccgugcuggauauuuaaauuuaggggccggucuccagggcgcguagauaaauaaauac

SEQ ID NO: 294731 - RNA, 64 nt, Human
agucugcucccaugacccucugcccacuuccauuggucuccaggccccaauaaucugggguuga

SEQ ID NO: 294732 - RNA, 64 nt, Human
aaucuaacaggaaucuagccugaggaagaagggaggucuccauuucuaugucugguauuugggg

SEQ ID NO: 294733 - RNA, 64 nt, Human
aguagacacaggguuucauaauguuccccaggcuggucuccaacuccucgccucaagcaauucg

SEQ ID NO: 294734 - RNA, 64 nt, Human
guuucucguggacacugcuggcuugcgggcagucggucuccaggguaccuguugucucuuuucc

SEQ ID NO: 294735 - RNA, 64 nt, Human
gaaucaggaaacugcucucccucagcugggcuggggucuccagggaccugagcuacaugcaggu

SEQ ID NO: 294736 - RNA, 64 nt, Human
cccagugcagaguuaucucuaugaggaggccccgggucuccagcccccuccaucuccccugggg

SEQ ID NO: 294737 - RNA, 64 nt, Human
guggcagacaggaagaaaacauguccaggccccuggucuccauagagaauggugcuuuguccaa

SEQ ID NO: 294738 - RNA, 64 nt, Human
gcugcagcucagggcaacggcaggccaggucgugggucuccagccgugcuuggccucagggcug

SEQ ID NO: 294739 - RNA, 64 nt, Human
gggagccagccagcgugcaacugcccaagcuccaggucuccaggacaagagcaguugucugcca

SEQ ID NO: 294740 - RNA, 64 nt, Human
ugcuccuuucccuuugaggacucccacccuuuggggucuccaggauccucauggaaggggaagg

SEQ ID NO: 294741 - RNA, 64 nt, Human
aaggucacacagugauccgggaucccagaacucuggucuccaaauuacagcccaggacaccuuu

SEQ ID NO: 294742 - RNA, 64 nt, Human
uuugaaauccaaacuacuuucuuaauaucacuuuggucuccauuuuucccaggacaggaaauau

SEQ ID NO: 294743 - RNA, 64 nt, Human
cucagugucuugacaucacccuacccaggcggugggucuccaccacagccacuuugagucugug

SEQ ID NO: 294744 - RNA, 64 nt, Human
aucccaucugugcuuaaccagaauccagcaagucagcacacaagugauuuuauuguuauuuugu

SEQ ID NO: 294745 - RNA, 64 nt, Human
uauauuugcaaacuucuuuauaaaaggugaaaaaagcacacaaaagagagggugucuucauauu

SEQ ID NO: 294746 - RNA, 64 nt, Human
augagaugcugcuccaagccugugaggggcgaacagcacacaaggcugcccgucuugggaucac

SEQ ID NO: 294747 - RNA, 64 nt, Human
gcuccuggacaugcgguacugaggugcagacaagggucuccacuguggugacugggucccuugg

SEQ ID NO: 294748 - RNA, 64 nt, Human
gauuuaaagcacagggagauucuugucacauuggggucuccaaagcuagaaugggauuucaugu

SEQ ID NO: 294749 - RNA, 64 nt, Human
uuuuuucaauuccuaaccuuuuuuaaaguuuccuggucuccacuggacacagagcuuuggagac

SEQ ID NO: 294750 - RNA, 64 nt, Human
gggugaugccaguagauaaaagugugagagaaggggucuccagggaagagucacaggcuguugg

SEQ ID NO: 294751 - RNA, 64 nt, Human
caccaugcaguugccagugugauuagugccuaggggucuccauuuagcagaaaugguaaugaca

SEQ ID NO: 294752 - RNA, 64 nt, Human
aagcacccugucaagggcccugacccagaguuguggucuccaaggaggcagcagaacuaagucu

SEQ ID NO: 294753 - RNA, 64 nt, Human
uuucuuuuucuauuuuaguguuucauuuaugugcggucuccaauuuaggacuuuuccauagugc

SEQ ID NO: 294754 - RNA, 64 nt, Human
gagaaaggagauaguggaagagucaggacagguuggucuccagccccacuucccaaauaugccu

SEQ ID NO: 294755 - RNA, 62 nt, Human
acacugcacuccagccugggcaacaguaaaaccuggucuccaaaaaaaaaaaaaaaaaguac

SEQ ID NO: 294756 - RNA, 64 nt, Human
agcagucaguacccucccaacggccccccucgaaggucuccacucuccucugggcuccuccuug

SEQ ID NO: 294757 - RNA, 64 nt, Human
acagaggugcuggaggguaggccucagaccagggggucuccaaaacuuuguaaaucaugcaucu

SEQ ID NO: 294758 - RNA, 64 nt, Human
uugguuuucuguucccauguuugcuaaggauaauggucuccaguucuaccgauguucccacaaa

SEQ ID NO: 294759 - RNA, 64 nt, Human
guggagugcgcugggacguugugugcaauagagaggucuccacaccagaugucuuccagauucu

SEQ ID NO: 294760 - RNA, 64 nt, Human
ucugcccccaggguucgugggcucugggcuugacggucuccagcuccccuuucugccaggaagc

SEQ ID NO: 294761 - RNA, 64 nt, Human
ugucaaaagcuuauuagcaucaaucaagauucuaggucuccaaaaguacaggcuuuuucuucau

SEQ ID NO: 294762 - RNA, 64 nt, Human
gggccccaaguagggcaccgugagugcagcgcggggucuccauggugcuaggccaggguggcca

SEQ ID NO: 294763 - RNA, 64 nt, Human
ugcagcuguccagccacugcccuuuaacaugcccagcacacaugggaggccuguggcccugugu

SEQ ID NO: 294764 - RNA, 64 nt, Human
cccucugauuuguuuuuaguuaguuuuuauugugagcacacauaguaccuaguuacaucuuaag

SEQ ID NO: 294765 - RNA, 64 nt, Human
cucuacuaauaauuaaaaaacuagcuggcaugguagcacacaccuguagucccagauacuuggg

SEQ ID NO: 294766 - RNA, 64 nt, Human
cacggccugcgggagcuccggcuucucguccuccggucuccacccugagggagcaccgacccgg

SEQ ID NO: 294767 - RNA, 64 nt, Human
uguguagaugaaggcuugaucuaaaauaguauaaggucuccagcuucaguaaaaguuuuuagug

SEQ ID NO: 294768 - RNA, 64 nt, Human
ccucaggaccucugcugaagagggggaugaagugggucuccagggaggcagugggggccuuguu

SEQ ID NO: 294769 - RNA, 64 nt, Human
uuaccacguuguuggccuccauugccuucguauuggucuccaauugcauggucucuguggaucu

SEQ ID NO: 294770 - RNA, 64 nt, Human
uguugcuagaauuuuuuauagcuuagauauaaaaggucuccaacaaagaccuuugcaauauauu

SEQ ID NO: 294771 - RNA, 64 nt, Human
aggacgcugccgccuaagagugcaaggcugcucaggucuccaagcgccguaggaggucaccugg

SEQ ID NO: 294772 - RNA, 64 nt, Human
aaucuguuaacaggcuucuggcauguagaucaguggucuccaagcuuuugugauuguauauucc

SEQ ID NO: 294773 - RNA, 64 nt, Human
gaaaccuagcaaucuuauuggagagacaagaauuggucuccagcugccuuugaucaagauucgg

SEQ ID NO: 294774 - RNA, 64 nt, Human
gacucucagucauaaaggaaugaccaagagagugggucuccagugagagaaaugccuaugaaag

SEQ ID NO: 294775 - RNA, 64 nt, Human
cugaccuagugccuguguugcagaccauuucugaggucuccaccauccaaggaggcacagccgu

SEQ ID NO: 294776 - RNA, 64 nt, Human
cgugaggggcaagcuaggccccagaggcccuggaggucuccaggggccugcagaaggaaagaag

SEQ ID NO: 294777 - RNA, 64 nt, Human
gaaaggggaauuuaguuucucuacaugucauuucggucuccaaacucccuguuggcuuuuuaau

SEQ ID NO: 294778 - RNA, 64 nt, Human
uuagaauuuuuacccaauuggauuggaaugcagaggucuccaaacugauuaaauauuugaagag

SEQ ID NO: 294779 - RNA, 64 nt, Human
ccugaccugccccuuccuuguuuuuccuccuacuggucuccaccaaggcuuuguuagcccccac

SEQ ID NO: 294780 - RNA, 64 nt, Human
gccaugccagugucugugcacaucccugucuguuggucuccauggccacuguggaccgggaccc

SEQ ID NO: 294781 - RNA, 64 nt, Human
uaguguccuaggccacugcagagggcagacugcuggucuccacagauaccugcuguucucagcu

SEQ ID NO: 294782 - RNA, 64 nt, Human
ggcugguugcuguagaaacacauaacaaagggcagcccuccacuucugguauaauuguguagcc

SEQ ID NO: 294783 - RNA, 64 nt, Human
uaugucugggaugcaaguauugcuaaauauguuagcccuccagguuaaaguugauucagcuuua

SEQ ID NO: 294784 - RNA, 64 nt, Human
uugguuuuguguuugcuuuuccggaccccacucugcccuccaaaaagacaaaaaaaaaaaaaaa

SEQ ID NO: 294785 - RNA, 64 nt, Human
uuuacuguuuuacaguauuauuuaauauccaacuggucuccaaucuccauuacauagggacugu

SEQ ID NO: 294786 - RNA, 64 nt, Human
uaagguguccuccugaagccaaguaggugguucuggucuccaaguaucguuaagcacaggugcu

SEQ ID NO: 294787 - RNA, 64 nt, Human
ucaaaaucuagucaucuguguaggagcuaaagcaggucuccagggagagaggguggucgucugu

SEQ ID NO: 294788 - RNA, 64 nt, Human
uggauccuggucuagcugaaucuucagagugggaggucuccaaaaagauauuaccuuauugggc

SEQ ID NO: 294789 - RNA, 64 nt, Human
gaucuguuucauucuuagccucaggccucaugagggucuccacagggccggagcucagguuaca

SEQ ID NO: 294790 - RNA, 64 nt, Human
aguagagacgagguuucacuguguuggccaggauggucuccaucucuugaccucgugauccacc

SEQ ID NO: 294791 - RNA, 64 nt, Human
aguuucuagagcuuuuugucuguaauggugauugggucuccacuguagaugcaugcaguguuca

SEQ ID NO: 294792 - RNA, 64 nt, Human
aaauucauaaucagggguguccucuagcucccacggucuccagagcagcaaggccggcuaugga

SEQ ID NO: 294793 - RNA, 64 nt, Human
acacugaccauugugaaauucagccuucccugugggucuccauaccauuuuaugauguguaugg

SEQ ID NO: 294794 - RNA, 64 nt, Human
caggaagugagcuaaggcucacccagagcagcugggucuccaggcugccugggcuuuuuguccu

SEQ ID NO: 294795 - RNA, 64 nt, Human
gggcuccccggcccugggugggcggugggcagcuggucuccagggacucagugaguggcugugc

SEQ ID NO: 294796 - RNA, 64 nt, Human
ggaugcaaagggcaggugagucaagaaccgcauaggucuccaguccccacggggcucccaggcc

SEQ ID NO: 294797 - RNA, 64 nt, Human
ugauguaggaguacugggaggccagacggcacgaggucuccaaggccccagcaaagccauggcu

SEQ ID NO: 294798 - RNA, 64 nt, Human
ggaagccguccagucccuagaaggcuggacagagggucuccaggcccuucugacuuuguugccc

SEQ ID NO: 294799 - RNA, 64 nt, Human
cugugaccucugcagaacuccucauccugcguuuggucuccagguguccccuuucugccguguu

SEQ ID NO: 294800 - RNA, 64 nt, Human
cgccuaugggguucugacuucacuuuccucagcgggucuccaguccccugacccagcucuaaag

SEQ ID NO: 294801 - RNA, 64 nt, Human
augcauccccauggagagacagcauugcuccccagcccuccagaaaccuugagcagauccaggg

SEQ ID NO: 294802 - RNA, 64 nt, Human
ugggaucggggcuuucagccccacccugaugccugcccuccaggauggcugguuuagucugggu

SEQ ID NO: 294803 - RNA, 64 nt, Human
gcucugcgugugcagcucucugcgucccuccugggcccuccagcgucagacacuaaugggaguu

SEQ ID NO: 294804 - RNA, 64 nt, Human
uggagaugucucuguguguuuguguguaucugugggucuccauccuccaugggggcucagccag

SEQ ID NO: 294805 - RNA, 64 nt, Human
cuuggguuuuggguugagggugcuaggagaggauggucuccacccaucuuucuauuuccaguac

SEQ ID NO: 294806 - RNA, 64 nt, Human
ucaucuugggguguguccuaugaagauccuuucuggucuccacaguaggccagaguugggggcu

SEQ ID NO: 294807 - RNA, 64 nt, Human
gacucccuggugccugauccugcuggggccugggggucuccaucuggacguccucucuccuuua

SEQ ID NO: 294808 - RNA, 64 nt, Human
ccuggggacuuggaaucagucggcagucaugcugggucuccacgugguguguuucgugggaaca

SEQ ID NO: 294809 - RNA, 64 nt, Human
ggagcccugcuguaccccagccuucccaggacguggucuccagcuucuucauccugccagaguu

SEQ ID NO: 294810 - RNA, 64 nt, Human
uuuauucccuuauucauuucaagagcuccaauggggucuccagcugaaagccccuccgggaggc

SEQ ID NO: 294811 - RNA, 64 nt, Human
ucaucacacugggaguuggugcuucuugucucugggucuccagaguuugccccgccugugcaca

SEQ ID NO: 294812 - RNA, 64 nt, Human
acacccagugccucugacucuguccccaugggcuggucuccaaagcucuuuccauugcccaggg

SEQ ID NO: 294813 - RNA, 64 nt, Human
aggaggaugaagggaggagagagcuuuugcucugggucuccaguggauaggagaggaccugccu

SEQ ID NO: 294814 - RNA, 64 nt, Human
ggguggcccccagagaagcacagaccugagauggggucuccaugcccgguuugcuguuggaaug

SEQ ID NO: 294815 - RNA, 64 nt, Human
ccacccaacuccuggcacugcucccaggggaucgggucuccacuccagcuuucucaauuaaaga

SEQ ID NO: 294816 - RNA, 64 nt, Human
ucaguguugcccuugccccuaaccucagcccgagggucuccaggauguugccuggcccaggacu

SEQ ID NO: 294817 - RNA, 64 nt, Human
aaaucuuugccauuucccaaacacuccgcuccauggucuccagucaucagagcaacucuaccug

SEQ ID NO: 294818 - RNA, 64 nt, Human
cagcgagacgggguuucauuauguuggccaggcuggucuccaacuccugaccuaaagugaucug

SEQ ID NO: 294819 - RNA, 64 nt, Human
uccaccccugugccaccccagagcccugggggguggucuccaugccugccacccuggcaucggc

SEQ ID NO: 294820 - RNA, 64 nt, Human
gggggagguugcagugagccaagaucgcuccauugcccuccagccugggugacaagagcaaaac

SEQ ID NO: 294821 - RNA, 64 nt, Human
gauagccuggguugggaguuagugcauaucaucagcccuccaucuaaugugauugcuaagaugu

SEQ ID NO: 294822 - RNA, 64 nt, Human
caagugccuagacuguuacuuuggcaauuuccuggcccuccacuccucauccccacaaucuggc

SEQ ID NO: 294823 - RNA, 64 nt, Human
caggacauagggcagggggccucacugccuuguuggucuccaccuuguuccuaccucugcaggc

SEQ ID NO: 294824 - RNA, 64 nt, Human
uccccacaggcgcggggacagcagcccgaccuguggucuccaugccugugcccucacacaggug

SEQ ID NO: 294825 - RNA, 64 nt, Human
cucucggcagccacagccaaggguggaggcuucaggucuccagcuucucugcuucucagcugcc

SEQ ID NO: 294826 - RNA, 64 nt, Human
uuuauuuagcagcuaguaacuucacuuauuucagggucuccaauugagaaacauggcacuguuu

SEQ ID NO: 294827 - RNA, 64 nt, Human
uaauuaugugaacuuuugagagagaugaaaggauggucuccaaaaaauuaaugaugguuauuuc

SEQ ID NO: 294828 - RNA, 64 nt, Human
ccccucaggcaccuuuccuccccuggacacccauggucuccaugagugcucccucugcugcccc

SEQ ID NO: 294829 - RNA, 64 nt, Human
ccaggaccauaggaagguccugaguccaccuccuggucuccaccucugucauuccgucaauucu

SEQ ID NO: 294830 - RNA, 64 nt, Human
cacucagggccuggacugcuccaaaacucgcccaggucuccagcucuccucuaccacccaacac

SEQ ID NO: 294831 - RNA, 64 nt, Human
guauccccaggucccucccagaacugacuccuaaggucuccagccagggcuucugagaugcaaa

SEQ ID NO: 294832 - RNA, 64 nt, Human
cuggccgcaagaacuccccacagaggcagaagagggucuccaccuauggccccaggccuuugcg

SEQ ID NO: 294833 - RNA, 64 nt, Human
aaaaggugcuucagagacuagauguaucugagagggucuccagaccagguuacugcaaaaauga

SEQ ID NO: 294834 - RNA, 64 nt, Human
ugugggaggugcaggggccaagagagacgugguaggucuccaagagucccacccgggggggaag

SEQ ID NO: 294835 - RNA, 64 nt, Human
ggagauaguuugacugaacccccaccuugaccuuggucuccagggguguggaauggugggggaa

SEQ ID NO: 294836 - RNA, 64 nt, Human
ccagccccguuucuaucagcccggccagcaugcaggucuccacaucaccaucuagaguaucacg

SEQ ID NO: 294837 - RNA, 64 nt, Human
caccccucaguccugcccacagagaggcuuggucggucuccacucccagggagaacgggaagug

SEQ ID NO: 294838 - RNA, 64 nt, Human
uuccuugucccugccucacucugagagccuugggggucuccaccagugcagacaagggcuacag

SEQ ID NO: 294839 - RNA, 64 nt, Human
agagggagcugagguccuggugccaggggcccaggcccuccaaccauaaacaguccaggaugga

SEQ ID NO: 294840 - RNA, 64 nt, Human
cacagcugggcaugccaugucugagcggcgcagagcccuccaggccugcaggggcaaggggcug

SEQ ID NO: 294841 - RNA, 64 nt, Human
gaggaguuagagugcugagcuccugggccucccagcccuccaguggccugugggugagggaagc

SEQ ID NO: 294842 - RNA, 64 nt, Human
cacucuuuccuuuuaucuuauuaauaaaaauguuggucuccaccacugacuacaaugauuuccc

SEQ ID NO: 294843 - RNA, 64 nt, Human
aacugucaggagcccagaaccaaccccaggucuuggucuccauuggcgagaacacaggacgugg

SEQ ID NO: 294844 - RNA, 64 nt, Human
ugauuucagaauguuguaggccucauuagagcuuggucuccaaaaaucuguuugaaaaaagcaa

SEQ ID NO: 294845 - RNA, 64 nt, Human
guggugccacagggaaggggcucccacugcuucuggucuccagggacagugcugcuggaaaggc

SEQ ID NO: 294846 - RNA, 64 nt, Human
ugcagguguggcagagauggggcaugggcauuggggucuccaucagccucuguggggugucuca

SEQ ID NO: 294847 - RNA, 64 nt, Human
cagaacccaccccaccccccagugcagacuucggggucuccaccccaggccagcagcgcccacu

SEQ ID NO: 294848 - RNA, 64 nt, Human
uuuaauuuucucggaggugauaggcuuccacacaggucuccagaagcccugcauugaauaucca

SEQ ID NO: 294849 - RNA, 64 nt, Human
auugagguccucaggccacgccccugcagauccaggucuccaggccuugcccacugagccuuca

SEQ ID NO: 294850 - RNA, 64 nt, Human
gaucaagacggaguuucaccauguuggccaggcuggucuccaacuccugcccucaagugauccg

SEQ ID NO: 294851 - RNA, 64 nt, Human
cgucuugcuagggcuucccccuucuccccaucccggucuccagagacccagcuucugagagaca

SEQ ID NO: 294852 - RNA, 64 nt, Human
aggguuuguccuaagaggaccaccgccaucucugggucuccagggggagagccuggcccugucc

SEQ ID NO: 294853 - RNA, 64 nt, Human
agcuccagauggccuccugagcuggacgaccccaggucuccagacaucuagggaccagagcagg

SEQ ID NO: 294854 - RNA, 64 nt, Human
caugggcugugagacugugugaagccguuuguguggucuccauguaggugcuguguucccggca

SEQ ID NO: 294855 - RNA, 64 nt, Human
accucaaaacgacgggggcaggugcaaguucauaggucuccaagaccacccuccuuucauuugc

SEQ ID NO: 294856 - RNA, 64 nt, Human
uaguagagacaguguuuaccauguuggccaggcaggucuccaacuccugaccucaagugauaug

SEQ ID NO: 294857 - RNA, 64 nt, Human
cuguguuguccagaggugaggcugggcccucccuggucuccagcuuaaacaggagugaacuccc

SEQ ID NO: 294858 - RNA, 64 nt, Human
gagacuuuaugcccuccagagcuccaagauauaagcccuccaagggaucagaagcuccaaguuc

SEQ ID NO: 294859 - RNA, 64 nt, Human
ccauccucucucaggaagcuucuagagacuuuaugcccuccagagcuccaagauauaagcccuc

SEQ ID NO: 294860 - RNA, 64 nt, Human
accagacacagcuguuguucggggcuguggaacugcccuccaagcugcuggucuacuugucggu

SEQ ID NO: 294861 - RNA, 64 nt, Human
aguagagacgggguuucaccauguuagacaggauggucuccaucuccugaguuugugaucugcc

SEQ ID NO: 294862 - RNA, 64 nt, Human
cccaaaucacuugucucuguuccucagaguuguaggucuccagauauguccccagugcuccaca

SEQ ID NO: 294863 - RNA, 64 nt, Human
acugaaagggacccggagcugggaaacccacgguggucuccaggcccuggcuggggcucugaga

SEQ ID NO: 294864 - RNA, 64 nt, Human
ucaagagcagaguuaagaucuaccaaacugaaggggucuccagauuaucuuggaggggacagga

SEQ ID NO: 294865 - RNA, 64 nt, Human
uugaugcuggagaacuaaucacccagagggagcuggucuccagccaggugagcaacaaccuuau

SEQ ID NO: 294866 - RNA, 64 nt, Human
gcuggggguuguauccccggccaccuccuguccaggucuccaucccccuuuggaugggaggccu

SEQ ID NO: 294867 - RNA, 53 nt, Human
cagggaugguuccaaagugaagaggucuccauggcaacaggacaccagcaagu

SEQ ID NO: 294868 - RNA, 64 nt, Human
uucagucuggacuauauugggacugggacuucugggucuccagggaggguauuuauuggucagg

SEQ ID NO: 294869 - RNA, 64 nt, Human
caccagccuucgaguuccuuguuucccuugcucuggucuccacguguaugaugggguucucagg

SEQ ID NO: 294870 - RNA, 64 nt, Human
ccgaggaggaggggacuggggucccggauucuugggucuccaagaagucuguccacagacuucu

SEQ ID NO: 294871 - RNA, 64 nt, Human
uccccaagacauggggacuuugcagugagcaaugggucuccacaaguaccucucaucuugagag

SEQ ID NO: 294872 - RNA, 64 nt, Human
gagaugggguuucaccuuguuggguggccaggcuggucuccaacuccugagcucaagugaucca

SEQ ID NO: 294873 - RNA, 64 nt, Human
cuguagguguccaauaaacaguagauggaaacugggucuccacccacucagugccucccuaccu

SEQ ID NO: 294874 - RNA, 64 nt, Human
uguucacuuugggguugguucucagccauccaagggucuccagugagguggcugcuugcugucu

SEQ ID NO: 294875 - RNA, 64 nt, Human
gccaggagaacaggaacagaacugagcaggggcaggucuccaaggcaagcccagcuggugugac

SEQ ID NO: 294876 - RNA, 64 nt, Human
cccugaaagacuggccccuggcuccccgccccucggucuccacgugguguauggaucugugguc

SEQ ID NO: 294877 - RNA, 64 nt, Human
uuacacuacacugaacacuaaagaauaauauauaagcacacaaauuggugacagaauuucaauu

SEQ ID NO: 294878 - RNA, 64 nt, Human
agaccauugcccaccgggagccgacaccugaccuagcacacacugacacaggggccuggacaag

SEQ ID NO: 294879 - RNA, 64 nt, Human
ucaugguaguacuuacuagaucacauugauguuaagcacacaaugggcaaaugcagaauuauag

SEQ ID NO: 294880 - RNA, 64 nt, Human
uauaccuuguguguaagcagcccuuuuuuuuuuuggucuccaccccccuccccccgccccgcac

SEQ ID NO: 294881 - RNA, 64 nt, Human
agcucuuugcaggcguccaauccuagaaaccaauggucuccagaacucucacacaaguguuuuu

SEQ ID NO: 294882 - RNA, 64 nt, Human
gggcucggcagaagggacgccggaucaggggccuggucuccagcaccugcccgaguggccgugg

SEQ ID NO: 294883 - RNA, 64 nt, Human
aaugggaacuaacacaucuugccauuugaaucagggucuccaguuucuagaaaaggcagacacu

SEQ ID NO: 294884 - RNA, 64 nt, Human
gggcauuuggaacuucuuuuuaaagucaucucauggucuccaguuuucaguuggaacucuggug

SEQ ID NO: 294885 - RNA, 64 nt, Human
gagaggcuggcacuaggggccacuggggggcuggggucuccaggggaugacuguuuucaaucuc

SEQ ID NO: 294886 - RNA, 64 nt, Human
ccuaaggguuguaggaccuuggcagagggggccuggucuccauuagaggguguuguuuucuccu

SEQ ID NO: 294887 - RNA, 64 nt, Human
acauagugggcccccuacauacgcauggauucugggucuccagauuggaacagaggauggagcu

SEQ ID NO: 294888 - RNA, 64 nt, Human
gccucgcuccguccacccguguguguguccggugggucuccacugcggggccagggccacgcuc

SEQ ID NO: 294889 - RNA, 64 nt, Human
gagagggccuccguucugccaccugccuugaaagggucuccagcugccauauguagcauuggag

SEQ ID NO: 294890 - RNA, 64 nt, Human
ucuuuccugguguagaucgagcaagaagcagcauggucuccacagaaagugccuccuccacuua

SEQ ID NO: 294891 - RNA, 64 nt, Human
ugaaaaggaacuugcccugagcacuccuggugcaggucuccaccugcacauuggguggggcucc

SEQ ID NO: 294892 - RNA, 64 nt, Human
gugcccgcagcccugcagcaccccggcuuucccgggucuccagccccaguccagaguugggcac

SEQ ID NO: 294893 - RNA, 64 nt, Human
gagaagguauuuuauaugucugcugccagcugcuggucuccacacccucaaccguucucaaccc

SEQ ID NO: 294894 - RNA, 64 nt, Human
uuucuaaagagugucuugcuauguugcccaggcuggucuccaacucaagugauccuccugccgc

SEQ ID NO: 294895 - RNA, 64 nt, Human
ggagggggcagauggugguugcaugggcuuccugggucuccacucuccgucuggccuaaaggug

SEQ ID NO: 294896 - RNA, 64 nt, Human
uuaaauauauuuuuaggaaacucucgcaguccccgcccuccaucucaccucacccgucucccaa

SEQ ID NO: 294897 - RNA, 64 nt, Human
aaaauguauuuguccuucucaaagcaaaccagaggcccuccacugucacccuaaauagagguag

SEQ ID NO: 294898 - RNA, 64 nt, Human
aagauggcagaggcaaauccacagaaggggggcugcccuccacacacacacgcccgucacccac

SEQ ID NO: 294899 - RNA, 64 nt, Human
cugugccagauggagccuuuauuccacgucgcguggucuccaagaccccaccuaccucccugau

SEQ ID NO: 294900 - RNA, 64 nt, Human
cuuguaacccuggcagcuaaggccuccagggcggggucuccauauaacuacacgguucaugaac

SEQ ID NO: 294901 - RNA, 64 nt, Human
ucccuucccauauccuucaaaagaaccacacuagggucuccaccuacuuauacaaugcggaugc

SEQ ID NO: 294902 - RNA, 64 nt, Human
ugaacacccgaugcuacgugucccaaaggaaacuggucuccacccacccccggcccguccucgu

SEQ ID NO: 294903 - RNA, 64 nt, Human
acuggagacgggguuucacuguguuagccacgauggucuccaucuccugaccucgugaucugcc

SEQ ID NO: 294904 - RNA, 64 nt, Human
uacuugcugcucugggccuccccaccuuuccuggggucuccacauucccacuagugggucuuau

SEQ ID NO: 294905 - RNA, 64 nt, Human
cuugggaucagugcucucuauugauguucuugcuggucuccagacacauuccuguugcauuaag

SEQ ID NO: 294906 - RNA, 64 nt, Human
ggggccccgcuggccagcccugggccacuucccgggucuccauugugcguggguggcguguucc

SEQ ID NO: 294907 - RNA, 64 nt, Human
gcccuuccaggugggugugggacaccugggagaaggucuccaagggagggugcagcccucuugc

SEQ ID NO: 294908 - RNA, 64 nt, Human
ugaaccaggaggcuucaugugggggaggaggagaggucuccaugugacacaugggcucagggcu

SEQ ID NO: 294909 - RNA, 64 nt, Human
cugcagcccugcagccacccacgcaccaucugugggucuccaaaggcaccuuguagcauguacu

SEQ ID NO: 294910 - RNA, 64 nt, Human
cagggaucgacaggcaccucuucugccuuuacuuggucuccaaguaccuaggagucagcucucc

SEQ ID NO: 294911 - RNA, 64 nt, Human
aguagagaugggguuucacguuguuagccaggauggucuccaucuccugaccucaugauccgcc

SEQ ID NO: 294912 - RNA, 64 nt, Human
gccccauaugccccaacucauagcaccuaaaaugggucuccaggguccuugcccuguuuauagu

SEQ ID NO: 294913 - RNA, 64 nt, Human
guuucugaaaauuaaauauguauuauuaaaaguuggucuccaacacuuguuuaaacaugacuuu

SEQ ID NO: 294914 - RNA, 64 nt, Human
gcgucagcuguuuccuaggcaagggcaggaaaguggucuccagcccuugcuccacucaugccug

SEQ ID NO: 294915 - RNA, 64 nt, Human
gugagagcugugauggcuaacugauguuuauaaugcccuccauccagguagcaagaugugugua

SEQ ID NO: 294916 - RNA, 64 nt, Human
guaggugccuacagagacuauagagcuagacaaagcccuccaaacuggccccuccugcucacug

SEQ ID NO: 294917 - RNA, 64 nt, Human
uuuacaggcagacauuauugguaaacaagaucuugcccuccaaugaaaugacuuacauguuuua

SEQ ID NO: 294918 - RNA, 64 nt, Human
uguguggcccuggacaagccacagccccugccugggucuccacauccccagcuguaugaggaga

SEQ ID NO: 294919 - RNA, 64 nt, Human
uaguuucauugauuuaaucauaaauaauggaaauggucuccaagaaguuuuauuuuucauuuuu

SEQ ID NO: 294920 - RNA, 64 nt, Human
ggaagaggaaggaauaacaacucagugaaaagauggucuccaguuucugaaugaaaaagcuaca

SEQ ID NO: 294921 - RNA, 64 nt, Human
gaaggccugccccccuucccaccccuauacccuaggucuccaccccucaagccaggagacccug

SEQ ID NO: 294922 - RNA, 64 nt, Human
guuuauuucuucuacagcacagauucacuggcugggucuccagucucaaauugccaaucauuug

SEQ ID NO: 294923 - RNA, 64 nt, Human
gugucuguaauuuguugggggguggauaggguggggucuccaucuacuuuuugucaccaucauc

SEQ ID NO: 294924 - RNA, 64 nt, Human
ccucccaggcacugcagaggcaccggugaggaagggucuccaggcuucacucaggguagagaaa

SEQ ID NO: 294925 - RNA, 64 nt, Human
ugcucccaggcacugcagaggcccgguggggaagggucuccaggcuuuauuccucccaggcacu

SEQ ID NO: 294926 - RNA, 64 nt, Human
cugccucugggccaugccaggccagagggcaguggcccuccaccuuguuccugcccuuuaacuu

SEQ ID NO: 294927 - RNA, 64 nt, Human
agguucagcugaagcuggugcgcccugucucugugcccuccagcaagaagccacccuccuugca

SEQ ID NO: 294928 - RNA, 64 nt, Human
aagcagguccagaacuaagugggaguggaggcaggcccuccacagaagcucugcagcaggggcu

SEQ ID NO: 294929 - RNA, 64 nt, Human
uugcuuccccccccaguccuccgcaugagcuguugcccuccaggggccuggcacagcuggccuu

SEQ ID NO: 294930 - RNA, 64 nt, Human; identical to SEQ ID NO: 294521

SEQ ID NO: 294931 - RNA, 64 nt, Human; identical to SEQ ID NO: 294522

SEQ ID NO: 294932 - RNA, 64 nt, Human; identical to SEQ ID NO: 294523

SEQ ID NO: 294933 - RNA, 64 nt, Human; identical to SEQ ID NO: 294524

SEQ ID NO: 294934 - RNA, 64 nt, Human; identical to SEQ ID NO: 294525

SEQ ID NO: 294935 - RNA, 64 nt, Human; identical to SEQ ID NO: 294526

SEQ ID NO: 294936 - RNA, 64 nt, Human; identical to SEQ ID NO: 294527

SEQ ID NO: 294937 - RNA, 64 nt, Human; identical to SEQ ID NO: 294528

SEQ ID NO: 294938 - RNA, 64 nt, Human; identical to SEQ ID NO: 294529

SEQ ID NO: 294939 - RNA, 64 nt, Human
uucagugauugaaacucauaccccauugcccuuugcccuccagucuccccuucagaaacaucuc

SEQ ID NO: 294940 - RNA, 64 nt, Human
ugaggcgugucuuccaggcccucccacagcuugugcccuccacaguguggacucaggucccaua

SEQ ID NO: 294941 - RNA, 64 nt, Human
gaggcagaagcacugaggugggcuggacaugggugcccuccacgucccucauauccccaggcac

SEQ ID NO: 294942 - RNA, 64 nt, Human
cuccaggaaagccaagcuggcggccaccgcaggggcccuccacauucuggccgguaacuggggg

SEQ ID NO: 294943 - RNA, 64 nt, Human; identical to SEQ ID NO: 294530

SEQ ID NO: 294944 - RNA, 64 nt, Human; identical to SEQ ID NO: 294531

SEQ ID NO: 294945 - RNA, 64 nt, Human; identical to SEQ ID NO: 294532

SEQ ID NO: 294946 - RNA, 64 nt, Human; identical to SEQ ID NO: 294533

SEQ ID NO: 294947 - RNA, 64 nt, Human; identical to SEQ ID NO: 294534

SEQ ID NO: 294948 - RNA, 64 nt, Human; identical to SEQ ID NO: 294538

SEQ ID NO: 294949 - RNA, 64 nt, Human; identical to SEQ ID NO: 294539

SEQ ID NO: 294950 - RNA, 64 nt, Human; identical to SEQ ID NO: 294540

SEQ ID NO: 294951 - RNA, 64 nt, Human; identical to SEQ ID NO: 294541

SEQ ID NO: 294952 - RNA, 64 nt, Human; identical to SEQ ID NO: 294542

SEQ ID NO: 294953 - RNA, 64 nt, Human; identical to SEQ ID NO: 294543

SEQ ID NO: 294954 - RNA, 64 nt, Human; identical to SEQ ID NO: 294544

SEQ ID NO: 294955 - RNA, 64 nt, Human; identical to SEQ ID NO: 294545

SEQ ID NO: 294956 - RNA, 64 nt, Human; identical to SEQ ID NO: 294546

SEQ ID NO: 294957 - RNA, 64 nt, Human; identical to SEQ ID NO: 294547

SEQ ID NO: 294958 - RNA, 64 nt, Human; identical to SEQ ID NO: 294548

SEQ ID NO: 294959 - RNA, 64 nt, Human
ucaaaggcauccaggcgcgugucaucuaccagaugcccuccaccgccauuucuuggucugucua

SEQ ID NO: 294960 - RNA, 64 nt, Human
cagcuaucuggaguuaacuugcaagcauauuggugcccuccaugaccaccucuggcuuaggacu

SEQ ID NO: 294961 - RNA, 64 nt, Human
ucuugcucuauucaguuuacagucaacccucccaagcacacaccccgcuucccuuggaaucccu

SEQ ID NO: 294962 - RNA, 64 nt, Human; identical to SEQ ID NO: 294549

SEQ ID NO: 294963 - RNA, 64 nt, Human; identical to SEQ ID NO: 294550

SEQ ID NO: 294964 - RNA, 64 nt, Human; identical to SEQ ID NO: 294551

SEQ ID NO: 294965 - RNA, 64 nt, Human; identical to SEQ ID NO: 294552

SEQ ID NO: 294966 - RNA, 64 nt, Human; identical to SEQ ID NO: 294553

SEQ ID NO: 294967 - RNA, 64 nt, Human; identical to SEQ ID NO: 294557

SEQ ID NO: 294968 - RNA, 64 nt, Human; identical to SEQ ID NO: 294558

SEQ ID NO: 294969 - RNA, 64 nt, Human; identical to SEQ ID NO: 294559

SEQ ID NO: 294970 - RNA, 64 nt, Human; identical to SEQ ID NO: 294560

SEQ ID NO: 294971 - RNA, 64 nt, Human; identical to SEQ ID NO: 294561

SEQ ID NO: 294972 - RNA, 64 nt, Human; identical to SEQ ID NO: 294562

SEQ ID NO: 294973 - RNA, 64 nt, Human; identical to SEQ ID NO: 294563

SEQ ID NO: 294974 - RNA, 64 nt, Human; identical to SEQ ID NO: 294564

SEQ ID NO: 294975 - RNA, 64 nt, Human; identical to SEQ ID NO: 294565

SEQ ID NO: 294976 - RNA, 64 nt, Human; identical to SEQ ID NO: 294566

SEQ ID NO: 294977 - RNA, 64 nt, Human; identical to SEQ ID NO: 294567

SEQ ID NO: 294978 - RNA, 64 nt, Human
gcagggcguucgaugugcgguuggcccccagcgcgcccuccagagcugcggugucucccugccu

SEQ ID NO: 294979 - RNA, 64 nt, Human
uuguuuuuguuuuguaacuuugguugauguuaaggcccuccauuuuggaaagcaggaaaacagg

SEQ ID NO: 294980 - RNA, 64 nt, Human
cuuaggguggagaugccgccuacacacgauccuggcccuccaccugccuccaggccacgaaaug

SEQ ID NO: 294981 - RNA, 64 nt, Human; identical to SEQ ID NO: 294568

SEQ ID NO: 294982 - RNA, 64 nt, Human; identical to SEQ ID NO: 294569

SEQ ID NO: 294983 - RNA, 64 nt, Human; identical to SEQ ID NO: 294570

SEQ ID NO: 294984 - RNA, 64 nt, Human; identical to SEQ ID NO: 294571

SEQ ID NO: 294985 - RNA, 64 nt, Human; identical to SEQ ID NO: 294572

SEQ ID NO: 294986 - RNA, 64 nt, Human; identical to SEQ ID NO: 294576

SEQ ID NO: 294987 - RNA, 64 nt, Human; identical to SEQ ID NO: 294577

SEQ ID NO: 294988 - RNA, 64 nt, Human; identical to SEQ ID NO: 294578

SEQ ID NO: 294989 - RNA, 64 nt, Human; identical to SEQ ID NO: 294579

SEQ ID NO: 294990 - RNA, 64 nt, Human; identical to SEQ ID NO: 294580

SEQ ID NO: 294991 - RNA, 64 nt, Human; identical to SEQ ID NO: 294581

SEQ ID NO: 294992 - RNA, 64 nt, Human; identical to SEQ ID NO: 294582

SEQ ID NO: 294993 - RNA, 64 nt, Human; identical to SEQ ID NO: 294583

SEQ ID NO: 294994 - RNA, 64 nt, Human; identical to SEQ ID NO: 294584

SEQ ID NO: 294995 - RNA, 64 nt, Human; identical to SEQ ID NO: 294585

SEQ ID NO: 294996 - RNA, 64 nt, Human; identical to SEQ ID NO: 294586

SEQ ID NO: 294997 - RNA, 64 nt, Human
gagccgauccucgcacccuccgcucccuccacuggcccuccaggucgauucccugggcuccagg

SEQ ID NO: 294998 - RNA, 64 nt, Human
ucucucucucuucuuucucucugagggagagggagcccuccaaacuucagauccuguggguuua

SEQ ID NO: 294999 - RNA, 64 nt, Human
cccuccuuuaggagacaggagucaccagggcacagcccuccaggcccgccucaggaaggaauga

SEQ ID NO: 295000 - RNA, 64 nt, Human; identical to SEQ ID NO: 294587

SEQ ID NO: 295001 - RNA, 64 nt, Human; identical to SEQ ID NO: 294588

SEQ ID NO: 295002 - RNA, 64 nt, Human; identical to SEQ ID NO: 294589

SEQ ID NO: 295003 - RNA, 64 nt, Human; identical to SEQ ID NO: 294590

SEQ ID NO: 295004 - RNA, 64 nt, Human; identical to SEQ ID NO: 294591

SEQ ID NO: 295005 - RNA, 64 nt, Human; identical to SEQ ID NO: 294595

SEQ ID NO: 295006 - RNA, 64 nt, Human; identical to SEQ ID NO: 294596

SEQ ID NO: 295007 - RNA, 64 nt, Human; identical to SEQ ID NO: 294597

SEQ ID NO: 295008 - RNA, 64 nt, Human; identical to SEQ ID NO: 294598

SEQ ID NO: 295009 - RNA, 64 nt, Human; identical to SEQ ID NO: 294599

SEQ ID NO: 295010 - RNA, 64 nt, Human; identical to SEQ ID NO: 294600

SEQ ID NO: 295011 - RNA, 64 nt, Human; identical to SEQ ID NO: 294601

SEQ ID NO: 295012 - RNA, 64 nt, Human; identical to SEQ ID NO: 294602

SEQ ID NO: 295013 - RNA, 64 nt, Human; identical to SEQ ID NO: 294603

SEQ ID NO: 295014 - RNA, 64 nt, Human; identical to SEQ ID NO: 294604

SEQ ID NO: 295015 - RNA, 64 nt, Human; identical to SEQ ID NO: 294605

SEQ ID NO: 295016 - RNA, 64 nt, Human
gcugccugugccugagcucccgcugcccaggggagcccuccacgccggcucuuccccacccuca

SEQ ID NO: 295017 - RNA, 64 nt, Human
agauucaucauaccuugaccuguaccucuucucugcccuccacuucccugcccuggaguccguu

SEQ ID NO: 295018 - RNA, 64 nt, Human
gacaggucaaaaugguccccaucagccuggagcagcccuccagaccuggguggaauuccagggu

SEQ ID NO: 295019 - RNA, 64 nt, Human; identical to SEQ ID NO: 294606

SEQ ID NO: 295020 - RNA, 64 nt, Human; identical to SEQ ID NO: 294607

SEQ ID NO: 295021 - RNA, 64 nt, Human; identical to SEQ ID NO: 294608

SEQ ID NO: 295022 - RNA, 64 nt, Human; identical to SEQ ID NO: 294609

SEQ ID NO: 295023 - RNA, 64 nt, Human; identical to SEQ ID NO: 294610

SEQ ID NO: 295024 - RNA, 64 nt, Human; identical to SEQ ID NO: 294614

SEQ ID NO: 295025 - RNA, 64 nt, Human; identical to SEQ ID NO: 294615

SEQ ID NO: 295026 - RNA, 64 nt, Human; identical to SEQ ID NO: 294616

SEQ ID NO: 295027 - RNA, 64 nt, Human; identical to SEQ ID NO: 294617

SEQ ID NO: 295028 - RNA, 64 nt, Human; identical to SEQ ID NO: 294618

SEQ ID NO: 295029 - RNA, 64 nt, Human; identical to SEQ ID NO: 294619

SEQ ID NO: 295030 - RNA, 64 nt, Human; identical to SEQ ID NO: 294620

SEQ ID NO: 295031 - RNA, 64 nt, Human; identical to SEQ ID NO: 294621

SEQ ID NO: 295032 - RNA, 64 nt, Human; identical to SEQ ID NO: 294622

SEQ ID NO: 295033 - RNA, 64 nt, Human; identical to SEQ ID NO: 294623

SEQ ID NO: 295034 - RNA, 64 nt, Human; identical to SEQ ID NO: 294624

SEQ ID NO: 295035 - RNA, 64 nt, Human
gacacccccuuuuucaccacuccccuuccccaucgcccuccagccccacucccuguaggauuuu

SEQ ID NO: 295036 - RNA, 64 nt, Human
cauagcuccucucccucacaagcgcucccagccugcccuccagcugcugcucuccccucccagu

SEQ ID NO: 295037 - RNA, 64 nt, Human
cuugcaaguguauacaaaaacuaaauagacuucugcccuccaacaucuuuuuauugcauuacuu

SEQ ID NO: 295038 - RNA, 64 nt, Human; identical to SEQ ID NO: 294625

SEQ ID NO: 295039 - RNA, 64 nt, Human; identical to SEQ ID NO: 294626

SEQ ID NO: 295040 - RNA, 64 nt, Human; identical to SEQ ID NO: 294627

SEQ ID NO: 295041 - RNA, 64 nt, Human; identical to SEQ ID NO: 294628

SEQ ID NO: 295042 - RNA, 64 nt, Human; identical to SEQ ID NO: 294629

SEQ ID NO: 295043 - RNA, 64 nt, Human; identical to SEQ ID NO: 294633

SEQ ID NO: 295044 - RNA, 64 nt, Human; identical to SEQ ID NO: 294634

SEQ ID NO: 295045 - RNA, 64 nt, Human; identical to SEQ ID NO: 294635

SEQ ID NO: 295046 - RNA, 64 nt, Human; identical to SEQ ID NO: 294636

SEQ ID NO: 295047 - RNA, 64 nt, Human; identical to SEQ ID NO: 294637

SEQ ID NO: 295048 - RNA, 64 nt, Human; identical to SEQ ID NO: 294638

SEQ ID NO: 295049 - RNA, 64 nt, Human; identical to SEQ ID NO: 294639

SEQ ID NO: 295050 - RNA, 64 nt, Human; identical to SEQ ID NO: 294640

SEQ ID NO: 295051 - RNA, 64 nt, Human; identical to SEQ ID NO: 294641

SEQ ID NO: 295052 - RNA, 64 nt, Human; identical to SEQ ID NO: 294642

SEQ ID NO: 295053 - RNA, 64 nt, Human; identical to SEQ ID NO: 294643

SEQ ID NO: 295054 - RNA, 64 nt, Human
ugaggacuguccucccacagaccugcagugaggggcccuccaugcgcagaugaggggccacuga

SEQ ID NO: 295055 - RNA, 64 nt, Human
ucugccuccugccugcgggcaccuacaagguugugcccuccaccuaccugccggacacagaggg

SEQ ID NO: 295056 - RNA, 64 nt, Human
ugacuccugcuucaguucucagcuguuuaccacagcccuccaggguccaaagauugaggagcuu

SEQ ID NO: 295057 - RNA, 64 nt, Human; identical to SEQ ID NO: 294644

SEQ ID NO: 295058 - RNA, 64 nt, Human; identical to SEQ ID NO: 294645

SEQ ID NO: 295059 - RNA, 64 nt, Human; identical to SEQ ID NO: 294646

SEQ ID NO: 295060 - RNA, 64 nt, Human; identical to SEQ ID NO: 294647

SEQ ID NO: 295061 - RNA, 64 nt, Human; identical to SEQ ID NO: 294648

SEQ ID NO: 295062 - RNA, 64 nt, Human; identical to SEQ ID NO: 294652

SEQ ID NO: 295063 - RNA, 64 nt, Human; identical to SEQ ID NO: 294653

SEQ ID NO: 295064 - RNA, 64 nt, Human; identical to SEQ ID NO: 294654

SEQ ID NO: 295065 - RNA, 64 nt, Human; identical to SEQ ID NO: 294655

SEQ ID NO: 295066 - RNA, 64 nt, Human; identical to SEQ ID NO: 294656

SEQ ID NO: 295067 - RNA, 64 nt, Human; identical to SEQ ID NO: 294657

SEQ ID NO: 295068 - RNA, 64 nt, Human; identical to SEQ ID NO: 294658

SEQ ID NO: 295069 - RNA, 64 nt, Human; identical to SEQ ID NO: 294647

SEQ ID NO: 295070 - RNA, 64 nt, Human; identical to SEQ ID NO: 294660

SEQ ID NO: 295071 - RNA, 64 nt, Human; identical to SEQ ID NO: 294661

SEQ ID NO: 295072 - RNA, 64 nt, Human; identical to SEQ ID NO: 294662

SEQ ID NO: 295073 - RNA, 64 nt, Human
ucucugcacaaagccuuuggugguucugcccucugcccuccagcuuuacccaccagaguaagca

SEQ ID NO: 295074 - RNA, 64 nt, Human
cuucuguuaacugaagccugcuccuucuuguucugcccuccagagauuugcucaaaugaucaau

SEQ ID NO: 295075 - RNA, 64 nt, Human
uauugaucuguuuuaaguaugagaggcuuauagugcccuccauuguaaauccauagucaucuuu

SEQ ID NO: 295076 - RNA, 52 nt, Human; identical to SEQ ID NO: 294663

SEQ ID NO: 295077 - RNA, 64 nt, Human; identical to SEQ ID NO: 294664

SEQ ID NO: 295078 - RNA, 64 nt, Human; identical to SEQ ID NO: 294665

SEQ ID NO: 295079 - RNA, 64 nt, Human; identical to SEQ ID NO: 294666

SEQ ID NO: 295080 - RNA, 64 nt, Human; identical to SEQ ID NO: 294667

SEQ ID NO: 295081 - RNA, 64 nt, Human; identical to SEQ ID NO: 294671

SEQ ID NO: 295082 - RNA, 64 nt, Human; identical to SEQ ID NO: 294690

SEQ ID NO: 295083 - RNA, 64 nt, Human; identical to SEQ ID NO: 294691

SEQ ID NO: 295084 - RNA, 64 nt, Human; identical to SEQ ID NO: 294692

SEQ ID NO: 295085 - RNA, 64 nt, Human; identical to SEQ ID NO: 294693

SEQ ID NO: 295086 - RNA, 64 nt, Human; identical to SEQ ID NO: 294694

SEQ ID NO: 295087 - RNA, 64 nt, Human; identical to SEQ ID NO: 294695

SEQ ID NO: 295088 - RNA, 64 nt, Human; identical to SEQ ID NO: 294696

SEQ ID NO: 295089 - RNA, 62 nt, Human; identical to SEQ ID NO: 294697

SEQ ID NO: 295090 - RNA, 64 nt, Human; identical to SEQ ID NO: 294698

SEQ ID NO: 295091 - RNA, 64 nt, Human; identical to SEQ ID NO: 294699

SEQ ID NO: 295092 - RNA, 64 nt, Human
cuggccgcccccgugcgagcggcaccccugcccugcccuccacagaauuggguuccaagggcug

SEQ ID NO: 295093 - RNA, 64 nt, Human
agauugagguuccuggacagaucaggcuagcccugcccuccacccacaccugcccgcuccccac

SEQ ID NO: 295094 - RNA, 64 nt, Human
uuuuguugcuuguuuguaauucauuuuauacaaagcccuccagccuguuuguggggcugaaacc

SEQ ID NO: 295095 - RNA, 64 nt, Human; identical to SEQ ID NO: 294700

SEQ ID NO: 295096 - RNA, 64 nt, Human; identical to SEQ ID NO: 294701

SEQ ID NO: 295097 - RNA, 64 nt, Human; identical to SEQ ID NO: 294702

SEQ ID NO: 295098 - RNA, 64 nt, Human; identical to SEQ ID NO: 294703

SEQ ID NO: 295099 - RNA, 64 nt, Human; identical to SEQ ID NO: 294704

SEQ ID NO: 295100 - RNA, 64 nt, Human; identical to SEQ ID NO: 294705

SEQ ID NO: 295101 - RNA, 64 nt, Human; identical to SEQ ID NO: 294709

SEQ ID NO: 295102 - RNA, 64 nt, Human; identical to SEQ ID NO: 294710

SEQ ID NO: 295103 - RNA, 64 nt, Human; identical to SEQ ID NO: 294711

SEQ ID NO: 295104 - RNA, 64 nt, Human; identical to SEQ ID NO: 294712

SEQ ID NO: 295105 - RNA, 64 nt, Human; identical to SEQ ID NO: 294713

SEQ ID NO: 295106 - RNA, 64 nt, Human; identical to SEQ ID NO: 294714

SEQ ID NO: 295107 - RNA, 64 nt, Human; identical to SEQ ID NO: 294715

SEQ ID NO: 295108 - RNA, 64 nt, Human; identical to SEQ ID NO: 294716

SEQ ID NO: 295109 - RNA, 64 nt, Human; identical to SEQ ID NO: 294717

SEQ ID NO: 295110 - RNA, 64 nt, Human; identical to SEQ ID NO: 294718

SEQ ID NO: 295111 - RNA, 64 nt, Human
gccaggggcuuacaucaaaacaccucagagggcugcccuccagaggcugcacccagaacagugg

SEQ ID NO: 295112 - RNA, 64 nt, Human
ggccagcucuggaguucucucaucggaggcccaugcccuccacuccacugccuuuggaaggguc

SEQ ID NO: 295113 - RNA, 64 nt, Human
gguggacguugcagugaucccagauugugccacugcccuccagccugggugacagagugagauu

SEQ ID NO: 295114 - RNA, 64 nt, Human; identical to SEQ ID NO: 294719

SEQ ID NO: 295115 - RNA, 64 nt, Human; identical to SEQ ID NO: 294720

SEQ ID NO: 295116 - RNA, 64 nt, Human; identical to SEQ ID NO: 294721

SEQ ID NO: 295117 - RNA, 64 nt, Human; identical to SEQ ID NO: 294722

SEQ ID NO: 295118 - RNA, 64 nt, Human; identical to SEQ ID NO: 294723

SEQ ID NO: 295119 - RNA, 64 nt, Human; identical to SEQ ID NO: 294724

SEQ ID NO: 295120 - RNA, 64 nt, Human; identical to SEQ ID NO: 294728

SEQ ID NO: 295121 - RNA, 64 nt, Human; identical to SEQ ID NO: 294729

SEQ ID NO: 295122 - RNA, 64 nt, Human; identical to SEQ ID NO: 294730

SEQ ID NO: 295123 - RNA, 64 nt, Human; identical to SEQ ID NO: 294731

SEQ ID NO: 295124 - RNA, 64 nt, Human; identical to SEQ ID NO: 294732

SEQ ID NO: 295125 - RNA, 64 nt, Human; identical to SEQ ID NO: 294733

SEQ ID NO: 295126 - RNA, 64 nt, Human; identical to SEQ ID NO: 294734

SEQ ID NO: 295127 - RNA, 64 nt, Human; identical to SEQ ID NO: 294735

SEQ ID NO: 295128 - RNA, 64 nt, Human; identical to SEQ ID NO: 294736

SEQ ID NO: 295129 - RNA, 64 nt, Human; identical to SEQ ID NO: 294737

SEQ ID NO: 295130 - RNA, 64 nt, Human
uguaguuucagaccagaccugaauagucuccuaugcccuccaaaagucggguccuugcuccugc

SEQ ID NO: 295131 - RNA, 64 nt, Human
ugauuaucauuaguaagguaagucuuagaucagagcccuccagcccuucuuuuugaaaccuccc

SEQ ID NO: 295132 - RNA, 64 nt, Human
uagacaaaugugauaaugacaugauuucccaccugcccuccaagaaaauggugacucacucuca

SEQ ID NO: 295133 - RNA, 64 nt, Human; identical to SEQ ID NO: 294738

SEQ ID NO: 295134 - RNA, 64 nt, Human; identical to SEQ ID NO: 294739

SEQ ID NO: 295135 - RNA, 64 nt, Human; identical to SEQ ID NO: 294740

SEQ ID NO: 295136 - RNA, 64 nt, Human; identical to SEQ ID NO: 294741

SEQ ID NO: 295137 - RNA, 64 nt, Human; identical to SEQ ID NO: 294742

SEQ ID NO: 295138 - RNA, 64 nt, Human; identical to SEQ ID NO: 294743

SEQ ID NO: 295139 - RNA, 64 nt, Human; identical to SEQ ID NO: 294747

SEQ ID NO: 295140 - RNA, 64 nt, Human; identical to SEQ ID NO: 294748

SEQ ID NO: 295141 - RNA, 64 nt, Human; identical to SEQ ID NO: 294749

SEQ ID NO: 295142 - RNA, 64 nt, Human; identical to SEQ ID NO: 294750

SEQ ID NO: 295143 - RNA, 64 nt, Human; identical to SEQ ID NO: 294751

SEQ ID NO: 295144 - RNA, 64 nt, Human; identical to SEQ ID NO: 294752

SEQ ID NO: 295145 - RNA, 64 nt, Human; identical to SEQ ID NO: 294753

SEQ ID NO: 295146 - RNA, 64 nt, Human; identical to SEQ ID NO: 294754

SEQ ID NO: 295147 - RNA, 62 nt, Human; identical to SEQ ID NO: 294755

SEQ ID NO: 295148 - RNA, 64 nt, Human; identical to SEQ ID NO: 294756

SEQ ID NO: 295149 - RNA, 64 nt, Human
gugaugguggauagaggugaaggagguagggagugcccuccaagugcaaaaauaacaaauauga

SEQ ID NO: 295150 - RNA, 64 nt, Human
gagcccuuauuugaauucacuguguggagcccuagcccuccauucucgacauuccccaaccucc

SEQ ID NO: 295151 - RNA, 64 nt, Human
caggcacugcucucugcagagggggucauuccaggcccuccagugugugugauagucaccaugc

SEQ ID NO: 295152 - RNA, 64 nt, Human; identical to SEQ ID NO: 294757

SEQ ID NO: 295153 - RNA, 64 nt, Human; identical to SEQ ID NO: 294758

SEQ ID NO: 295154 - RNA, 64 nt, Human; identical to SEQ ID NO: 294759

SEQ ID NO: 295155 - RNA, 64 nt, Human; identical to SEQ ID NO: 294760

SEQ ID NO: 295156 - RNA, 64 nt, Human; identical to SEQ ID NO: 294761

SEQ ID NO: 295157 - RNA, 64 nt, Human; identical to SEQ ID NO: 294762

SEQ ID NO: 295158 - RNA, 64 nt, Human; identical to SEQ ID NO: 294766

SEQ ID NO: 295159 - RNA, 64 nt, Human; identical to SEQ ID NO: 294767

SEQ ID NO: 295160 - RNA, 64 nt, Human; identical to SEQ ID NO: 294768

SEQ ID NO: 295161 - RNA, 64 nt, Human; identical to SEQ ID NO: 294769

SEQ ID NO: 295162 - RNA, 64 nt, Human; identical to SEQ ID NO: 294770

SEQ ID NO: 295163 - RNA, 64 nt, Human; identical to SEQ ID NO: 294771

SEQ ID NO: 295164 - RNA, 64 nt, Human; identical to SEQ ID NO: 294772

SEQ ID NO: 295165 - RNA, 64 nt, Human; identical to SEQ ID NO: 294773

SEQ ID NO: 295166 - RNA, 64 nt, Human; identical to SEQ ID NO: 294774

SEQ ID NO: 295167 - RNA, 64 nt, Human; identical to SEQ ID NO: 294775

SEQ ID NO: 295168 - RNA, 64 nt, Human
ccaccauccaguguagggcacaacccuggggacugcccuccauagccugucccgacugccgacu

SEQ ID NO: 295169 - RNA, 64 nt, Human
ucugcucuucuuccaaauauauaaaaaaggaauugcccuccagguaaucccuuuccuuuuuccc

SEQ ID NO: 295170 - RNA, 64 nt, Human
aauugcugccuuugcuugauguuguagaugaguugcccuccaccuggcuggagagauggcacau

SEQ ID NO: 295171 - RNA, 64 nt, Human; identical to SEQ ID NO: 294776

SEQ ID NO: 295172 - RNA, 64 nt, Human; identical to SEQ ID NO: 294777

SEQ ID NO: 295173 - RNA, 64 nt, Human; identical to SEQ ID NO: 294778

SEQ ID NO: 295174 - RNA, 64 nt, Human; identical to SEQ ID NO: 294779

SEQ ID NO: 295175 - RNA, 64 nt, Human; identical to SEQ ID NO: 294780

SEQ ID NO: 295176 - RNA, 64 nt, Human; identical to SEQ ID NO: 294781

SEQ ID NO: 295177 - RNA, 64 nt, Human; identical to SEQ ID NO: 294785

SEQ ID NO: 295178 - RNA, 64 nt, Human; identical to SEQ ID NO: 294786

SEQ ID NO: 295179 - RNA, 64 nt, Human; identical to SEQ ID NO: 294787

SEQ ID NO: 295180 - RNA, 64 nt, Human; identical to SEQ ID NO: 294788

SEQ ID NO: 295181 - RNA, 64 nt, Human; identical to SEQ ID NO: 294789

SEQ ID NO: 295182 - RNA, 64 nt, Human; identical to SEQ ID NO: 294790

SEQ ID NO: 295183 - RNA, 64 nt, Human; identical to SEQ ID NO: 294791

SEQ ID NO: 295184 - RNA, 64 nt, Human; identical to SEQ ID NO: 294792

SEQ ID NO: 295185 - RNA, 64 nt, Human; identical to SEQ ID NO: 294793

SEQ ID NO: 295186 - RNA, 64 nt, Human; identical to SEQ ID NO: 294794

SEQ ID NO: 295187 - RNA, 64 nt, Human
aagccccagagguagaagggaccucaagcaccacgcccuccagggcagccgugcagacgaccuu

SEQ ID NO: 295188 - RNA, 64 nt, Human
uacccuggcgggccacccugccagccagcagcuggcccuccaccaucuucacauuccaagacug

SEQ ID NO: 295189 - RNA, 64 nt, Human
ccaccuccuugcucuccccagccugccaagcccagcccuccagagccagcccuccuggguaccg

SEQ ID NO: 295190 - RNA, 64 nt, Human; identical to SEQ ID NO: 294795

SEQ ID NO: 295191 - RNA, 64 nt, Human; identical to SEQ ID NO: 294796

SEQ ID NO: 295192 - RNA, 64 nt, Human; identical to SEQ ID NO: 294797

SEQ ID NO: 295193 - RNA, 64 nt, Human; identical to SEQ ID NO: 294798

SEQ ID NO: 295194 - RNA, 64 nt, Human; identical to SEQ ID NO: 294799

SEQ ID NO: 295195 - RNA, 64 nt, Human; identical to SEQ ID NO: 294800

SEQ ID NO: 295196 - RNA, 64 nt, Human; identical to SEQ ID NO: 294804

SEQ ID NO: 295197 - RNA, 64 nt, Human; identical to SEQ ID NO: 294805

SEQ ID NO: 295198 - RNA, 64 nt, Human; identical to SEQ ID NO: 294806

SEQ ID NO: 295199 - RNA, 64 nt, Human; identical to SEQ ID NO: 294807

SEQ ID NO: 295200 - RNA, 64 nt, Human; identical to SEQ ID NO: 294808

SEQ ID NO: 295201 - RNA, 64 nt, Human; identical to SEQ ID NO: 294809

SEQ ID NO: 295202 - RNA, 64 nt, Human; identical to SEQ ID NO: 294810

SEQ ID NO: 295203 - RNA, 64 nt, Human; identical to SEQ ID NO: 294811

SEQ ID NO: 295204 - RNA, 64 nt, Human; identical to SEQ ID NO: 294812

SEQ ID NO: 295205 - RNA, 64 nt, Human; identical to SEQ ID NO: 294813

SEQ ID NO: 295206 - RNA, 64 nt, Human
gcucauagacacggggcgucuccagguggucccagcccuccagauguuucuagcucuccaggug

SEQ ID NO: 295207 - RNA, 64 nt, Human
gcugagaguuuuguuauaguuguuuucuaacccagcccuccacugccaaaggccaaaagcucag

SEQ ID NO: 295208 - RNA, 64 nt, Human
agcagcauagcaaacagauggauuugaagcuaaaagcacacagggucugcuauuccugaggcug

SEQ ID NO: 295209 - RNA, 64 nt, Human; identical to SEQ ID NO: 294814

SEQ ID NO: 295210 - RNA, 64 nt, Human; identical to SEQ ID NO: 294815

SEQ ID NO: 295211 - RNA, 64 nt, Human; identical to SEQ ID NO: 294816

SEQ ID NO: 295212 - RNA, 64 nt, Human; identical to SEQ ID NO: 294817

SEQ ID NO: 295213 - RNA, 64 nt, Human; identical to SEQ ID NO: 294818

SEQ ID NO: 295214 - RNA, 64 nt, Human; identical to SEQ ID NO: 294819

SEQ ID NO: 295215 - RNA, 64 nt, Human; identical to SEQ ID NO: 294823

SEQ ID NO: 295216 - RNA, 64 nt, Human; identical to SEQ ID NO: 294824

SEQ ID NO: 295217 - RNA, 64 nt, Human; identical to SEQ ID NO: 294825

SEQ ID NO: 295218 - RNA, 64 nt, Human; identical to SEQ ID NO: 294826

SEQ ID NO: 295219 - RNA, 64 nt, Human; identical to SEQ ID NO: 294827

SEQ ID NO: 295220 - RNA, 64 nt, Human; identical to SEQ ID NO: 294828

SEQ ID NO: 295221 - RNA, 64 nt, Human; identical to SEQ ID NO: 294829

SEQ ID NO: 295222 - RNA, 64 nt, Human; identical to SEQ ID NO: 294830

SEQ ID NO: 295223 - RNA, 64 nt, Human; identical to SEQ ID NO: 294831

SEQ ID NO: 295224 - RNA, 64 nt, Human; identical to SEQ ID NO: 294832

SEQ ID NO: 295225 - RNA, 64 nt, Human
cugccccacagaccgccaaggugaaggcccuccugcccuccauggugaagggccugaagaacau

SEQ ID NO: 295226 - RNA, 64 nt, Human
agcuuuaaaaugguuccgacuugucccucucucagcccuccauggccuggcacgaggggauggg

SEQ ID NO: 295227 - RNA, 64 nt, Human
agauauuugaagacccaagucugccuuucacagagcccuccauuccaaguuuaguuuuugucaa

SEQ ID NO: 295228 - RNA, 64 nt, Human; identical to SEQ ID NO: 294833

SEQ ID NO: 295229 - RNA, 64 nt, Human; identical to SEQ ID NO: 294834

SEQ ID NO: 295230 - RNA, 64 nt, Human; identical to SEQ ID NO: 294835

SEQ ID NO: 295231 - RNA, 64 nt, Human; identical to SEQ ID NO: 294836

SEQ ID NO: 295232 - RNA, 64 nt, Human; identical to SEQ ID NO: 294837

SEQ ID NO: 295233 - RNA, 64 nt, Human; identical to SEQ ID NO: 294838

SEQ ID NO: 295234 - RNA, 64 nt, Human; identical to SEQ ID NO: 294842

SEQ ID NO: 295235 - RNA, 64 nt, Human; identical to SEQ ID NO: 294843

SEQ ID NO: 295236 - RNA, 64 nt, Human; identical to SEQ ID NO: 294844

SEQ ID NO: 295237 - RNA, 64 nt, Human; identical to SEQ ID NO: 294845

SEQ ID NO: 295238 - RNA, 64 nt, Human; identical to SEQ ID NO: 294846

SEQ ID NO: 295239 - RNA, 64 nt, Human; identical to SEQ ID NO: 294847

SEQ ID NO: 295240 - RNA, 64 nt, Human; identical to SEQ ID NO: 294848

SEQ ID NO: 295241 - RNA, 64 nt, Human; identical to SEQ ID NO: 294849

SEQ ID NO: 295242 - RNA, 64 nt, Human; identical to SEQ ID NO: 294850

SEQ ID NO: 295243 - RNA, 64 nt, Human; identical to SEQ ID NO: 294851

SEQ ID NO: 295244 - RNA, 64 nt, Human
acgagcaggcgaacgccacccucaaucaguacccgcccuccaucaaugguggucgugugauuga

SEQ ID NO: 295245 - RNA, 64 nt, Human
ccagucuuuccccugugaugagcagaugaccaccgcccuccagggucagcguuuggcuguuugu

SEQ ID NO: 295246 - RNA, 64 nt, Human
uuuucugauaaaauccaucccguguuugccacacgcccuccaguccucaguucccacugccuaa

SEQ ID NO: 295247 - RNA, 64 nt, Human; identical to SEQ ID NO: 294852

SEQ ID NO: 295248 - RNA, 64 nt, Human; identical to SEQ ID NO: 294853

SEQ ID NO: 295249 - RNA, 64 nt, Human; identical to SEQ ID NO: 294854

SEQ ID NO: 295250 - RNA, 64 nt, Human; identical to SEQ ID NO: 294855

SEQ ID NO: 295251 - RNA, 64 nt, Human; identical to SEQ ID NO: 294856

SEQ ID NO: 295252 - RNA, 64 nt, Human; identical to SEQ ID NO: 294857

SEQ ID NO: 295253 - RNA, 64 nt, Human; identical to SEQ ID NO: 294861

SEQ ID NO: 295254 - RNA, 64 nt, Human; identical to SEQ ID NO: 294862

SEQ ID NO: 295255 - RNA, 64 nt, Human; identical to SEQ ID NO: 294863

SEQ ID NO: 295256 - RNA, 64 nt, Human; identical to SEQ ID NO: 294864

SEQ ID NO: 295257 - RNA, 64 nt, Human; identical to SEQ ID NO: 294865

SEQ ID NO: 295258 - RNA, 64 nt, Human; identical to SEQ ID NO: 294866

SEQ ID NO: 295259 - RNA, 53 nt, Human; identical to SEQ ID NO: 294867

SEQ ID NO: 295260 - RNA, 24 nt, Human
gacugggacuucugggucuccagg

SEQ ID NO: 295261 - RNA, 24 nt, Human
guuucccuugcucuggucuccacg

SEQ ID NO: 295262 - RNA, 24 nt, Human
gucccggauucuugggucuccaag

SEQ ID NO: 295263 - RNA, 64 nt, Human
ggcacaucaguuaaugccagugaggucagcuucugcccuccagcaauacaugugcagggguugc

SEQ ID NO: 295264 - RNA, 64 nt, Human
ccacauuucuaauaccaccaccccugugcuucaggcccuccaaaccccuguguuccccaaaugu

SEQ ID NO: 295265 - RNA, 64 nt, Human
cucccagcccccugcugccuucucuaugcagccugcccuccaucauccaccccagaauugcucu

SEQ ID NO: 295266 - RNA, 24 nt, Human
ugcagugagcaaugggucuccaca

SEQ ID NO: 295267 - RNA, 24 nt, Human
uggguggccaggcuggucuccaac

SEQ ID NO: 295268 - RNA, 24 nt, Human
guagauggaaacugggucuccacc

SEQ ID NO: 295269 - RNA, 24 nt, Human
cucagccauccaagggucuccagu

SEQ ID NO: 295270 - RNA, 24 nt, Human
acugagcaggggcaggucuccaag

SEQ ID NO: 295271 - RNA, 24 nt, Human
gcuccccgccccucggucuccacg

SEQ ID NO: 295272 - RNA, 24 nt, Human
cccuuuuuuuuuuuggucuccacc

SEQ ID NO: 295273 - RNA, 24 nt, Human
uccuagaaaccaauggucuccaga

SEQ ID NO: 295274 - RNA, 24 nt, Human
cggaucaggggccuggucuccagc

SEQ ID NO: 295275 - RNA, 24 nt, Human
gccauuugaaucagggucuccagu

SEQ ID NO: 295276 - RNA, 24 nt, Human
uaaagucaucucauggucuccagu

SEQ ID NO: 295277 - RNA, 24 nt, Human
cacuggggggcuggggucuccagg

SEQ ID NO: 295278 - RNA, 24 nt, Human
ggcagagggggccuggucuccauu

SEQ ID NO: 295279 - RNA, 24 nt, Human
acgcauggauucugggucuccaga

SEQ ID NO: 295280 - RNA, 24 nt, Human
guguguguccggugggucuccacu

SEQ ID NO: 295281 - RNA, 24 nt, Human
accugccuugaaagggucuccagc

SEQ ID NO: 295282 - RNA, 64 nt, Human
ccacugaccaucugugacccuucccugccauugggcccuccaccuguggcucacaucucgccag

SEQ ID NO: 295283 - RNA, 64 nt, Human
gcggagguugcaguaagccgagaccaugcuuauugcccuccagucugggcaacaaaaaugaaac

SEQ ID NO: 295284 - RNA, 64 nt, Human
cacuccucucccacagagugcuggacuguuccaggcccuccagugggcugaugcugggacccuu

SEQ ID NO: 295285 - RNA, 24 nt, Human
gcaagaagcagcauggucuccaca

SEQ ID NO: 295286 - RNA, 24 nt, Human
gcacuccuggugcaggucuccacc

SEQ ID NO: 295287 - RNA, 24 nt, Human
ccccggcuuucccgggucuccagc

SEQ ID NO: 295288 - RNA, 24 nt, Human
ugcugccagcugcuggucuccaca

SEQ ID NO: 295289 - RNA, 24 nt, Human
auguugcccaggcuggucuccaac

SEQ ID NO: 295290 - RNA, 24 nt, Human
gcaugggcuuccugggucuccacu

SEQ ID NO: 295291 - RNA, 24 nt, Human
auuccacgucgcguggucuccaag

SEQ ID NO: 295292 - RNA, 24 nt, Human
ggccuccagggcggggucuccaua

SEQ ID NO: 295293 - RNA, 24 nt, Human
aagaaccacacuagggucuccacc

SEQ ID NO: 295294 - RNA, 24 nt, Human
ucccaaaggaaacuggucuccacc

SEQ ID NO: 295295 - RNA, 24 nt, Human
guguuagccacgauggucuccauc

SEQ ID NO: 295296 - RNA, 24 nt, Human
cccaccuuuccuggggucuccaca

SEQ ID NO: 295297 - RNA, 24 nt, Human
uugauguucuugcuggucuccaga

SEQ ID NO: 295298 - RNA, 24 nt, Human
ugggccacuucccgggucuccauu

SEQ ID NO: 295299 - RNA, 24 nt, Human
gacaccugggagaaggucuccaag

SEQ ID NO: 295300 - RNA, 24 nt, Human
gggggaggaggagaggucuccaug

SEQ ID NO: 295301 - RNA, 64 nt, Human
gucaagccccuauccaggcccgaauccuuccgcugcccuccaagcgcccucuggggacagacca

SEQ ID NO: 295302 - RNA, 64 nt, Human
ugaagagccugcccuccuauauggauucuucagggcccuccacaucugagguggcucauuccca

SEQ ID NO: 295303 - RNA, 64 nt, Human
gaguaaggggcaaaucacagcaauauuccacagcgcccuccagaguuaccuggggaggaccgag

SEQ ID NO: 295304 - RNA, 24 nt, Human
acgcaccaucugugggucuccaaa

SEQ ID NO: 295305 - RNA, 24 nt, Human
uucugccuuuacuuggucuccaag

SEQ ID NO: 295306 - RNA, 24 nt, Human
uuguuagccaggauggucuccauc

SEQ ID NO: 295307 - RNA, 24 nt, Human
uagcaccuaaaaugggucuccagg

SEQ ID NO: 295308 - RNA, 24 nt, Human
uauuauuaaaaguuggucuccaac

SEQ ID NO: 295309 - RNA, 24 nt, Human
aagggcaggaaaguggucuccagc

SEQ ID NO: 295310 - RNA, 24 nt, Human
acagccccugccugggucuccaca

SEQ ID NO: 295311 - RNA, 24 nt, Human
uaaauaauggaaauggucuccaag

SEQ ID NO: 295312 - RNA, 24 nt, Human
cucagugaaaagauggucuccagu

SEQ ID NO: 295313 - RNA, 24 nt, Human
accccuauacccuaggucuccacc

SEQ ID NO: 295314 - RNA, 24 nt, Human
agauucacuggcugggucuccagu

SEQ ID NO: 295315 - RNA, 24 nt, Human
gguggauaggguggggucuccauc

SEQ ID NO: 295316 - RNA, 24 nt, Human
caccggugaggaagggucuccagg

SEQ ID NO: 295317 - RNA, 24 nt, Human
gcccgguggggaagggucuccagg

SEQ ID NO: 295318 - RNA, 64 nt, Human
auauuuuuuuuuuggcgagucaccagugacccgagcccuccacaccagccuccuguaucucauc

SEQ ID NO: 295319 - RNA, 64 nt, Human
cagcacaccauucuuguccuuccccaguuuccucgcccuccaccccuccagcuucaugcucagu

SEQ ID NO: 295320 - RNA, 64 nt, Human
ggcagagguugcagugaguggagaucgcaccacugcccuccagccuaggugacagaaugagacu

SEQ ID NO: 295321 - RNA, 64 nt, Human; identical to SEQ ID NO: 291943

SEQ ID NO: 295322 - RNA, 64 nt, Human; identical to SEQ ID NO: 291944

SEQ ID NO: 295323 - RNA, 64 nt, Human; identical to SEQ ID NO: 291945

SEQ ID NO: 295324 - RNA, 64 nt, Human; identical to SEQ ID NO: 291946

SEQ ID NO: 295325 - RNA, 64 nt, Human
ccagaccccagguggaccauccucccaaacuagggcccuccacucuauccagggcaggccaggg

SEQ ID NO: 295326 - RNA, 64 nt, Human
gguaugacccuggugccuggcagguucucccucugcccuccacugggcccaguggcucagggac

SEQ ID NO: 295327 - RNA, 64 nt, Human
cuguccauguggcucuaucuuuuaaaaccucaaggcccuccacuguccuaagauaaagccucuc

SEQ ID NO: 295328 - RNA, 64 nt, Human; identical to SEQ ID NO: 291947

SEQ ID NO: 295329 - RNA, 64 nt, Human; identical to SEQ ID NO: 291948

SEQ ID NO: 295330 - RNA, 64 nt, Human; identical to SEQ ID NO: 291949

SEQ ID NO: 295331 - RNA, 64 nt, Human; identical to SEQ ID NO: 291950

SEQ ID NO: 295332 - RNA, 64 nt, Human; identical to SEQ ID NO: 291951

SEQ ID NO: 295333 - RNA, 64 nt, Human; identical to SEQ ID NO: 291952

SEQ ID NO: 295334 - RNA, 64 nt, Human; identical to SEQ ID NO: 291953

SEQ ID NO: 295335 - RNA, 64 nt, Human; identical to SEQ ID NO: 291954

SEQ ID NO: 295336 - RNA, 64 nt, Human; identical to SEQ ID NO: 291955

SEQ ID NO: 295337 - RNA, 64 nt, Human; identical to SEQ ID NO: 291956

SEQ ID NO: 295338 - RNA, 64 nt, Human; identical to SEQ ID NO: 291955

SEQ ID NO: 295339 - RNA, 64 nt, Human; identical to SEQ ID NO: 291960

SEQ ID NO: 295340 - RNA, 64 nt, Human; identical to SEQ ID NO: 291961

SEQ ID NO: 295341 - RNA, 64 nt, Human; identical to SEQ ID NO: 291962

SEQ ID NO: 295342 - RNA, 62 nt, Human; identical to SEQ ID NO: 291963

SEQ ID NO: 295343 - RNA, 64 nt, Human; identical to SEQ ID NO: 291964

SEQ ID NO: 295344 - RNA, 64 nt, Human
agcacccagcuuaaccccugccaucccaugcugggcccuccaggccaagagucucagcuggccg

SEQ ID NO: 295345 - RNA, 64 nt, Human
cccgucagucugggggcuucacaagggcaggagagcccuccaucacugacuuccagaucaggga

SEQ ID NO: 295346 - RNA, 64 nt, Human
acuguuggaaucagcaggccucugugcucccucugcccuccagaacucagugacucuugaacau

SEQ ID NO: 295347 - RNA, 64 nt, Human
gaguccucuccccaaaucagggcucuagacccgagcccuccaaaccuggacucugggacuuagg

SEQ ID NO: 295348 - RNA, 64 nt, Human; identical to SEQ ID NO: 291965

SEQ ID NO: 295349 - RNA, 64 nt, Human; identical to SEQ ID NO: 291966

SEQ ID NO: 295350 - RNA, 64 nt, Human; identical to SEQ ID NO: 291967

SEQ ID NO: 295351 - RNA, 64 nt, Human; identical to SEQ ID NO: 291968

SEQ ID NO: 295352 - RNA, 64 nt, Human; identical to SEQ ID NO: 291969

SEQ ID NO: 295353 - RNA, 64 nt, Human; identical to SEQ ID NO: 291970

SEQ ID NO: 295354 - RNA, 64 nt, Human; identical to SEQ ID NO: 291971

SEQ ID NO: 295355 - RNA, 64 nt, Human; identical to SEQ ID NO: 291972

SEQ ID NO: 295356 - RNA, 64 nt, Human; identical to SEQ ID NO: 291973

SEQ ID NO: 295357 - RNA, 64 nt, Human; identical to SEQ ID NO: 291974

SEQ ID NO: 295358 - RNA, 64 nt, Human; identical to SEQ ID NO: 291977

SEQ ID NO: 295359 - RNA, 64 nt, Human; identical to SEQ ID NO: 291978

SEQ ID NO: 295360 - RNA, 64 nt, Human; identical to SEQ ID NO: 291979

SEQ ID NO: 295361 - RNA, 64 nt, Human; identical to SEQ ID NO: 291980

SEQ ID NO: 295362 - RNA, 64 nt, Human; identical to SEQ ID NO: 291981

SEQ ID NO: 295363 - RNA, 64 nt, Human; identical to SEQ ID NO: 291982

SEQ ID NO: 295364 - RNA, 64 nt, Human
accccucccuggccauccuccuggaauguggucugcccuccaccagagcuccugccugccagga

SEQ ID NO: 295365 - RNA, 64 nt, Human
gcucuguuuccuaauucaggaccccacucaucuagcccuccaagagccuccgccaaauuguagc

SEQ ID NO: 295366 - RNA, 64 nt, Human
gcugaccucugaggggcugaggggugaggccagggcccuccagggggagggguagccagcuugg

SEQ ID NO: 295367 - RNA, 55 nt, Human; identical to SEQ ID NO: 150521

SEQ ID NO: 295368 - RNA, 64 nt, Human; identical to SEQ ID NO: 291983

SEQ ID NO: 295369 - RNA, 64 nt, Human; identical to SEQ ID NO: 291984

SEQ ID NO: 295370 - RNA, 64 nt, Human; identical to SEQ ID NO: 291985

SEQ ID NO: 295371 - RNA, 64 nt, Human; identical to SEQ ID NO: 291986

SEQ ID NO: 295372 - RNA, 64 nt, Human; identical to SEQ ID NO: 291987

SEQ ID NO: 295373 - RNA, 64 nt, Human; identical to SEQ ID NO: 291988

SEQ ID NO: 295374 - RNA, 64 nt, Human; identical to SEQ ID NO: 291989

SEQ ID NO: 295375 - RNA, 64 nt, Human; identical to SEQ ID NO: 291990

SEQ ID NO: 295376 - RNA, 64 nt, Human; identical to SEQ ID NO: 291991

SEQ ID NO: 295377 - RNA, 64 nt, Human; identical to SEQ ID NO: 291994

SEQ ID NO: 295378 - RNA, 64 nt, Human; identical to SEQ ID NO: 291995

SEQ ID NO: 295379 - RNA, 64 nt, Human; identical to SEQ ID NO: 291996

SEQ ID NO: 295380 - RNA, 64 nt, Human; identical to SEQ ID NO: 291997

SEQ ID NO: 295381 - RNA, 64 nt, Human; identical to SEQ ID NO: 291998

SEQ ID NO: 295382 - RNA, 64 nt, Human; identical to SEQ ID NO: 291999

SEQ ID NO: 295383 - RNA, 64 nt, Human
ccugaaucuccacccaccucccaaacuccugccugcccuccagacugucugcccauacaccugu

SEQ ID NO: 295384 - RNA, 64 nt, Human
uauggaaaugcgaugucagauggaugguaauggugcccuccaguggcugugagaccucauugcg

SEQ ID NO: 295385 - RNA, 64 nt, Human
uuccccaucaugggcaaggaagggaauucccacagcccuccaguguacugaggguacuggccua

SEQ ID NO: 295386 - RNA, 64 nt, Human
caguauuaccaccagacugacuccaggacucacugcccuccagaaaacagaggugacaaaugug

SEQ ID NO: 295387 - RNA, 63 nt, Human
auguguuggugaagcuggugcugugggggccacucacucgaaugacaccuggaggccuguucc

SEQ ID NO: 295388 - RNA, 60 nt, Human; identical to SEQ ID NO: 292001

SEQ ID NO: 295389 - RNA, 63 nt, Human
cuccaguguucucuuaaugaggcacuuugccugucacucgagcaagccuggguguuccuuccu

SEQ ID NO: 295390 - RNA, 63 nt, Human
cccuggaaagggggagaguugcccuuuacagaaucacucgagcccuuuccagcacuguugguc

SEQ ID NO: 295391 - RNA, 63 nt, Human
gcuaauuuuuguguuuuuuguagagauggagauucacucgacuaauucuuuuuguauucuuag

SEQ ID NO: 295392 - RNA, 63 nt, Human
cauucuaaagagagugagcaugagcucacuccaucacucgaugagauaauaugagauuucuac

SEQ ID NO: 295393 - RNA, 63 nt, Human
acaagggagugugacuucuuggccauaauaaacucacucgauaguguuuauguuauuaaucug

SEQ ID NO: 295394 - RNA, 63 nt, Human
aaacggcagacacaacauguuccuccacgcggcucacucgaugccugcaggccccagugugug

SEQ ID NO: 295395 - RNA, 63 nt, Human
auauaugaaauugagucuuagauuuaaugaauuucacucgaaaauaaaugaucagaagaauuu

SEQ ID NO: 295396 - RNA, 63 nt, Human
gaaaaauaaaacuguuuaugauacuuguguuagucacucgagcuagcuuauuucagccacuuc

SEQ ID NO: 295397 - RNA, 63 nt, Human
aggucuuuacuuacuugucuguaucuuucugucucacucgaaaggcacagucucaaugcgcua

SEQ ID NO: 295398 - RNA, 63 nt, Human
uccuauaaugaagaauacuggcacaggcaaugcucacucgaaaacuucaaguaauuucuaguu

SEQ ID NO: 295399 - RNA, 63 nt, Human
aggaaguauggaaaaguacacucugucacuuugucacucgaugucauuccaaaguuauugccu

SEQ ID NO: 295400 - RNA, 63 nt, Human
ccccagaugccugagccuuuguccaaagugaggucacucgagaauucauggacacggccccca

SEQ ID NO: 295401 - RNA, 63 nt, Human
ugguagugcaagcugaaggcugaggcaggagaaucacucgaacccgggaggcagagguugcag

SEQ ID NO: 295402 - RNA, 63 nt, Human
ggugucuggugcgucagccugcugcuucgugucucacucgagaguugcuucugguuucacacu

SEQ ID NO: 295403 - RNA, 58 nt, Human; identical to SEQ ID NO: 150491

SEQ ID NO: 295404 - RNA, 64 nt, Human
cugugaucugcccuagcgcucucuuccagaagaugcccuccaauccuuuccacccuauucccua

SEQ ID NO: 295405 - RNA, 64 nt, Human
ugauggguuaguggauggaaggggcugacagacagcccuccaucuaaacugcccccucugcccu

SEQ ID NO: 295406 - RNA, 64 nt, Human
gucccacagggaccacauccaccccagccccacugcccuccagggccaggauucaggccucuga

SEQ ID NO: 295407 - RNA, 63 nt, Human
uacgucuagcuccucagggcuucggaucgcagcucacucgaggccuggggaaggggacucagg

SEQ ID NO: 295408 - RNA, 63 nt, Human
augucagcuacccaggagucugaggcacaagaaucacucgaaccugggagguggagguugcga

SEQ ID NO: 295409 - RNA, 63 nt, Human
aggagcuucaucuguauuuauggcuacuucccaucacucgaauuaccaccugaacuccaccuc

SEQ ID NO: 295410 - RNA, 63 nt, Human
gucccagcuacuugggaggcugaggcaggagaaucacucgaacccaggaggcagagguugcag

SEQ ID NO: 295411 - RNA, 63 nt, Human
auccuagcauuuugggaggacgaggcggguggaucacucgaugucaggaguuugagaccagcc

SEQ ID NO: 295412 - RNA, 63 nt, Human
ggagcaaauuauccacaaaggauuugcauuacgucacucgaaacguuuucauccaugcuuagc

SEQ ID NO: 295413 - RNA, 63 nt, Human
uuauacaagcaauauauauauggauuucuauaaucacucgaugugauacaguauaaauaugcu

SEQ ID NO: 295414 - RNA, 63 nt, Human
guauauauauaaaaaacuaugaaucacucacacucacucgaaaacuaugcagggcuagggagc

SEQ ID NO: 295415 - RNA, 63 nt, Human
uucauuuauagugccaguagguguaccuuguguucacucgaacuaagaacaaugguuaaggca

SEQ ID NO: 295416 - RNA, 63 nt, Human
gauauuaaugcccagacaaaaagcuaauaccagucacucgauaauaaaguauucgcauuauag

SEQ ID NO: 295417 - RNA, 63 nt, Human
uggagaucaugaugaacuuuuggcugaaccucaucacucgaacuccagcuucaagaauguguu

SEQ ID NO: 295418 - RNA, 63 nt, Human
aaaaaaaagcuggauuugauuuuuuuuuucuggucacucgagcacaucuaagaucacccauua

SEQ ID NO: 295419 - RNA, 63 nt, Human
agccuucccucucuuucugggauguuugggacuucacucgaccugcacgggcucugcccgaca

SEQ ID NO: 295420 - RNA, 63 nt, Human
aucccagcuacuuggaaggcugaggugagaggaucacucgaggagauuggggcugccaugagc

SEQ ID NO: 295421 - RNA, 63 nt, Human
aucccagcuacuagggaggcugaggcaggagaaucacucgaacccgggaggcagagguugcag

SEQ ID NO: 295422 - RNA, 63 nt, Human
uuuuuuguagagacagggucucacuguguugccucacucgagcugcugaccucaagugauccu

SEQ ID NO: 295423 - RNA, 64 nt, Human
gccaucauggugacugucaugguucuacagaaaugcccuccaugugucccucuaauguugcaug

SEQ ID NO: 295424 - RNA, 64 nt, Human
accuucuauucauaaauguucuauacaguggacagcccuccagaaugguacuucagugccuagu

SEQ ID NO: 295425 - RNA, 64 nt, Human
uagaaagaaaagaacacuugcccagggcagcuuugcccuccaagaggcucccuccugucucuaa

SEQ ID NO: 295426 - RNA, 64 nt, Human
ugcucuggcacagaccacugugguugauggcauggcccuccaacuuggaauaggauuuuccuuu

SEQ ID NO: 295427 - RNA, 63 nt, Human
aggugaacacaagcggcugccgcauguagccacucacucgacuuuuuuucagcugugaccauu

SEQ ID NO: 295428 - RNA, 63 nt, Human
auucagaaugagaaaaauccuaacccaauagaaucacucgaaaaagaaucugcuuucaaaacg

SEQ ID NO: 295429 - RNA, 63 nt, Human
auccgagugcuuugggaggcugaggcaggaggaucacucgagcucaagaauucaagaccuggg

SEQ ID NO: 295430 - RNA, 63 nt, Human
agaaguacugccaauacugccaaccagagcagcucacucgagaucuuuguguccagaguuuuu

SEQ ID NO: 295431 - RNA, 63 nt, Human
uuccaagacuggccugaaacugcaugagcaacaucacucgaaauaauuuuuuuuuucaaaagc

SEQ ID NO: 295432 - RNA, 63 nt, Human
uacauaaaauuauuuuguuuggcauuauuuuucucacucgaagaaacuauauaggguuguuuu

SEQ ID NO: 295433 - RNA, 63 nt, Human
agaauggagacacccgugaccucaggcugaaagucacucgacauuggucucuuguguugauag

SEQ ID NO: 295434 - RNA, 63 nt, Human
aagacuuacaaaaaaagauuuaaaguggcagcuucacucgacauuuggugagagaaguacaaa

SEQ ID NO: 295435 - RNA, 63 nt, Human
aucccagcaauuugggaguccgaggcgggcggaucacucgaggucaggaguuccagaccagcc

SEQ ID NO: 295436 - RNA, 63 nt, Human
uccuuuccaccaaagccagguuuccugguaaggucacucgaagauaagggauggggauggggg

SEQ ID NO: 295437 - RNA, 63 nt, Human
uaaccuuugaguccagcccuuuccaguuuucauucacucgaaguaacugcacucaagcugugc

SEQ ID NO: 295438 - RNA, 64 nt, Human
cccugcggccgcagggcuuccccgccuggcgccugcccuccagggcuggggccucgccuggcgg

SEQ ID NO: 295439 - RNA, 64 nt, Human
gagaagcaaaaacaaaaguaaacuccuuucccuggcccuccaaacauauauucugugagauaac

SEQ ID NO: 295440 - RNA, 64 nt, Human
agagaaugaagcacccagucucguaccauuuugagcccuccagcacuacuuauuuucccccacc

SEQ ID NO: 295441 - RNA, 64 nt, Human
cucugaggcucuuucugggccaaguuccucuagugcccuccacagccgcagccucccucugacc

SEQ ID NO: 295442 - RNA, 64 nt, Human
cuaggucccucccagccccaugugccugccgccugcccuccacacaucccuguccccccaaccc

SEQ ID NO: 295443 - RNA, 64 nt, Human
uacccacacuggcuguagccacuucaguccaucugcccuccagaggagggguuucuuccugauu

SEQ ID NO: 295444 - RNA, 64 nt, Human
ugcagcagagaggaggccccacagcuugcccuuugcccuccaucccuggcuguccugaguggug

SEQ ID NO: 295445 - RNA, 64 nt, Human
aggccaggacccggaucauucacugugauacccugcccuccagagggugcgcucagagacacgg

SEQ ID NO: 295446 - RNA, 64 nt, Human
ucccugcuuccccuucagugcuuacuuggcuccagcccuccagcugcagccccuggggaaaagc

SEQ ID NO: 295447 - RNA, 64 nt, Human
gaguguugaacuucaaccugagggggccgacagugcccuccaagacagagacgacugaacuuuu

SEQ ID NO: 295448 - RNA, 64 nt, Human
uccccguuacucaaauccuuggcacuacuacaaugcccuccauucuucagggcugagaauugac

SEQ ID NO: 295449 - RNA, 64 nt, Human
guguuucaggagaggacugugcuggaucaugcuugcccuccacagggaauacagcauccuuaca

SEQ ID NO: 295450 - RNA, 64 nt, Human
ccgcggagccugcauuuccucgcagccucucagugcccuccagccccgcgaccauguggccaca

SEQ ID NO: 295451 - RNA, 64 nt, Human
gccccgcgcgggugcgcccuggcacccucucccugcccuccagcguuuccacugucgcccgcgc

SEQ ID NO: 295452 - RNA, 64 nt, Human
cgcagcccaguggggugccaugcacaggccacaggcccuccaccucaccuccagcucaggggcc

SEQ ID NO: 295453 - RNA, 64 nt, Human
uaaaaauaaauaaauaagggaaauuccuaacuuugcccuccaaagucuaacuuugguuuucuug

SEQ ID NO: 295454 - RNA, 64 nt, Human
gcagucaccaggagaugaggguuaggugugcccagcccuccagacccggccuuucugguuaacc

SEQ ID NO: 295455 - RNA, 64 nt, Human
agcgcuggugggcucuuuguccuggugcccaggagcccuccagcccccugcccacagaagggaa

SEQ ID NO: 295456 - RNA, 64 nt, Human
ugagagacccuggacguuuuucugcucucuucuggcccuccauggagucaugggccucggccuc

SEQ ID NO: 295457 - RNA, 64 nt, Human
gggucucccugggacccuuaauuucuuguccccugcccuccaugggcaguuauauucugcauca

SEQ ID NO: 295458 - RNA, 64 nt, Human
cuucauuuuuuuuuucuccuuuacuccaaacucagcccuccaguuucuucagauguaaacccug

SEQ ID NO: 295459 - RNA, 64 nt, Human
augugagagacagaaucccuggggugcuggacuggcccuccagaggguaagccauguccggagu

SEQ ID NO: 295460 - RNA, 64 nt, Human
gaggcccugcucucuguacaggaggccucucgcugcccuccaggcuucuucccuucuucaggcu

SEQ ID NO: 295461 - RNA, 64 nt, Human
gcagccugcugggugggccacacucagccugacugcccuccaugggggcauucuggcacccccu

SEQ ID NO: 295462 - RNA, 64 nt, Human
cacgucccggcugggccccagaccccagcuuccugcccuccaccgggagucugcaugguuggga

SEQ ID NO: 295463 - RNA, 64 nt, Human
ucgugcugucucuugccugucccaccugugcccugcccuccagcuuguauuuaagucccugggc

SEQ ID NO: 295464 - RNA, 64 nt, Human
ugcccccaauuccaucagaccaaggcugcaaguggcccuccauucguguguguauuuaggggcu

SEQ ID NO: 295465 - RNA, 64 nt, Human
ugagggcaaccuugccccccacccaagaagcccugcccuccagccacagcaguccacagcagca

SEQ ID NO: 295466 - RNA, 64 nt, Human
uaggauagcaaagugagccauagugggccaggcugcccuccaugcugggccccagcccaggucu

SEQ ID NO: 295467 - RNA, 64 nt, Human
agagaaucguuccucagccucauggugaacucgcgcccuccagccugaucccccgcucccuccu

SEQ ID NO: 295468 - RNA, 64 nt, Human
cacugccacuuuugcuugcccuccuggcuggggugcccuccaugucaugcacgugaugcauuuc

SEQ ID NO: 295469 - RNA, 64 nt, Human
ccccuuuucuacaaucaaauccauucauuauugcgcccuccagguccccuccuuuuugcagaag

SEQ ID NO: 295470 - RNA, 64 nt, Human
uuuacccuagauguucccaccuucagugcuccacgcccuccauagaccuucagagaaggugaaa

SEQ ID NO: 295471 - RNA, 64 nt, Human
cccaggagggcaggggcauugggaaugggugggugcccuccagagaggggcugcuaccucccag

SEQ ID NO: 295472 - RNA, 64 nt, Human
ccugaugugcuggugcuguguccccaaaaccggggcccuccacagaggccccuucccagcgaca

SEQ ID NO: 295473 - RNA, 64 nt, Human
uaaagcauuccaagcaauauugcagauugagcaggcccuccagcugcuggccacagaggcuccu

SEQ ID NO: 295474 - RNA, 64 nt, Human
cuacuggcucucugcucgagagccaauacccugugcccuccacucaucuggauuuacaggaacu

SEQ ID NO: 295475 - RNA, 64 nt, Human
ggucagcagcugauccugauccaccuccgcccaggcccuccaagcucuacucaccccuagggcc

SEQ ID NO: 295476 - RNA, 64 nt, Human
cugccuccagggucuggcugagugggaucagguggcccuccaacucagcacaggaaauaaguag

SEQ ID NO: 295477 - RNA, 64 nt, Human
gcuccagcugaggacaacggaacccccuuucccugcccuccagagacugauccuagccaggcac

SEQ ID NO: 295478 - RNA, 64 nt, Human
ccuucugucccuccugccuuccuucucuucccaagcccuccaauccccaucccaggcuugcugu

SEQ ID NO: 295479 - RNA, 64 nt, Human
cccuugguggguccccuccaggaaccaaggaguggcccuccagguggcagcacuaaggacaccc

SEQ ID NO: 295480 - RNA, 64 nt, Human
aggggcaucagcccugaacgguugagagcguggagcccuccaggccuuugcucuccccucuagg

SEQ ID NO: 295481 - RNA, 64 nt, Human
cagggacacuucccugcccaggccaccucccacagcccuccacuggucuggccagaugcacugg

SEQ ID NO: 295482 - RNA, 64 nt, Human
cauugcccacccugaagguggauaagccaaccaugcccuccauagagguccccuauccuuaaau

SEQ ID NO: 295483 - RNA, 64 nt, Human
gccacauggccaucugcuccucccugcccccguggcccuccaucaccuucugcuccuaggaggc

SEQ ID NO: 295484 - RNA, 64 nt, Human
accucccauuggcucgcucccccccccccaccgugcccuccaucacgcccugcccccagggugg

SEQ ID NO: 295485 - RNA, 64 nt, Human
ccgcccugccucagccugggcccugugcccuugagcccuccaccccuggcccaagaccccccca

SEQ ID NO: 295486 - RNA, 64 nt, Human
cucugagagcaggugggcacuggcuggguacggugcccuccacaggacucucccuacugccuga

SEQ ID NO: 295487 - RNA, 64 nt, Human
ccagccuucucauuuccgccucuccagacacugcgcccuccacccucacucugccauuguucca

SEQ ID NO: 295488 - RNA, 64 nt, Human
uagcagcaucauccuugacagugauguuuuucaggcccuccauugagaaccugaggaaaucugu

SEQ ID NO: 295489 - RNA, 64 nt, Human
gagaucaggcagccccaccugcaggagaacgucagcccuccaggggaucagccccugccaguuc

SEQ ID NO: 295490 - RNA, 64 nt, Human
ggggcucggacccugaacucagacucuacagauugcccuccaagugaggacuuggcucccccac

SEQ ID NO: 295491 - RNA, 64 nt, Human
uguagagagccccuaaguccuucaucauaccacugcccuccaaaucuacucuucuuuuaagcaa

SEQ ID NO: 295492 - RNA, 64 nt, Human
ccacugccccuccaacucccagggacucauuacagcccuccauuaagcagaggcuggcacggcu

SEQ ID NO: 295493 - RNA, 64 nt, Human
cuaguaaauccuucagcaacaaggcuggcuuggugcccuccaagcaucuaauggcuuauuaaau

SEQ ID NO: 295494 - RNA, 64 nt, Human
ucaaaaguugccugggguucuguauuucuucucugcccuccaauccccgacugcuaugauguuu

SEQ ID NO: 295495 - RNA, 64 nt, Human
gauggacuucacagauuuguccaggcugccccuggcccuccaugacacacccccgauuccugga

SEQ ID NO: 295496 - RNA, 64 nt, Human
ugucuguggccuucuggggcaccgauucuaccaggcccuccagcugcguggucuccgcagacca

SEQ ID NO: 295497 - RNA, 64 nt, Human
uuuccagcccuccggagagugggcuuggcccuaggcccuccagcucagccagaaaaagcccaga

SEQ ID NO: 295498 - RNA, 64 nt, Human
gcaguggguguccacccgugucccucaugggugagcccuccagcugugagcccaggcagugugg

SEQ ID NO: 295499 - RNA, 64 nt, Human
ggcggagcuugcaguaagcugagaucgcgccacugcccuccagccugggcaacagagcaagacu

SEQ ID NO: 295500 - RNA, 64 nt, Human
cugagacgaagcucccugacagccgagacuggcagcccuccaucugguccguacccucgccaga

SEQ ID NO: 295501 - RNA, 64 nt, Human
gaucagcagauacaugucagugcagagguucucugcccuccagaagcccucgucugggaauucg

SEQ ID NO: 295502 - RNA, 64 nt, Human
gggcggggugggauuuuugcauaagcacuuugcugcccuccaguggcugcuugaggaaacgcag

SEQ ID NO: 295503 - RNA, 64 nt, Human
caggcggcugggaucucaggcagggugugcgucagcccuccaacccccagaggggcgccugugg

SEQ ID NO: 295504 - RNA, 64 nt, Human
uggccagaggucugggcccaucccaggccucaaggcccuccaggccuguggggagcacuggagg

SEQ ID NO: 295505 - RNA, 64 nt, Human
cccccagcccugucaugugccuugggcuccuccugcccuccaucucagccauuggggcagggac

SEQ ID NO: 295506 - RNA, 64 nt, Human
gaggguaugguggugugccgauaccuccucgccugcccuccaagccccagcugccuuccuuuug

SEQ ID NO: 295507 - RNA, 64 nt, Human
ccuagguucccaugucccagccuggccuguggcugcccuccaucccuuccccagagauggcucc

SEQ ID NO: 295508 - RNA, 64 nt, Human
agggugagagucuggguccaggccuggccauguggcccuccaguguaugagagggcccugccug

SEQ ID NO: 295509 - RNA, 64 nt, Human
cucaagugccuucugugaguuuaaaugugcuggugcccuccagaaaagccucggccucagcucc

SEQ ID NO: 295510 - RNA, 64 nt, Human
ccaagcagccucccccagcacuugcggccgcucagcccuccaaccaagaccuaagucacacauc

SEQ ID NO: 295511 - RNA, 64 nt, Human
aucaguccagugaccauauuuaugaaaagcuguagcccuccaaggucugggaauuuaucgagaa

SEQ ID NO: 295512 - RNA, 64 nt, Human
cauggcgaccugugucaaauccguccauugaucugcccuccagcacacauuuacugagcuucug

SEQ ID NO: 295513 - RNA, 64 nt, Human
gcugcuguuuccugcuugcccggccaccacccaugcccuccauagggugagguggagccauggu

SEQ ID NO: 295514 - RNA, 64 nt, Human
uaauaguggagguauuguggguucauuugaguaagcccuccaaagauaccauucaaauaaccug

SEQ ID NO: 295515 - RNA, 64 nt, Human
caguggccaguguucgcugugggaucaccuucuggcccuccagcagcaugauggcacgcugucg

SEQ ID NO: 295516 - RNA, 64 nt, Human
ccccaauucccaggucucacaucccaccccuccugcccuccaacccuucugccuugaaagcugg

SEQ ID NO: 295517 - RNA, 64 nt, Human
auuuccaagcucuuggaagggguaacagugaaccgcccuccaugggcuccacaucuuuuccuuu

SEQ ID NO: 295518 - RNA, 64 nt, Human
gugacccucuaguucaacugugccagaggaaacagcccuccagugcccaccugccucacuccuc

SEQ ID NO: 295519 - RNA, 64 nt, Human
uccccagaccaaaugucccaggcacacagcccaugcccuccaccauggaguacauuuucucccu

SEQ ID NO: 295520 - RNA, 64 nt, Human
caggaaguuacccuauaugucuaaaaggggaggagcccuccauuccaauuguccaccccuuucc

SEQ ID NO: 295521 - RNA, 64 nt, Human
ucacccucuucaagcaccuuccccaacccacguugcccuccaggccucuguccagcccuuccuc

SEQ ID NO: 295522 - RNA, 64 nt, Human
uccagcccccccugagccccaccuccuccagggagcccuccaggaagccccuucccugacuccu

SEQ ID NO: 295523 - RNA, 64 nt, Human
gguggagguugcagugagcugagauuggaccacugcccuccagccugggugauagagugagacu

SEQ ID NO: 295524 - RNA, 64 nt, Human
cccagguggaggcgagaugagcuggcgcagccccgcccuccauccuccccacaucccugcagcc

SEQ ID NO: 295525 - RNA, 64 nt, Human
ggccugagagcugggcaacagcagugauggcgaugcccuccaccucuuuccuccaguggagugg

SEQ ID NO: 295526 - RNA, 64 nt, Human
uccuuuuccagauacguuugccagcaaagcugcugcccuccaggauguauaugcagacgccucc

SEQ ID NO: 295527 - RNA, 64 nt, Human
ccggcgcagcaccugggcaguguccccaccccaggcccuccacauccuccucccugucuggugu

SEQ ID NO: 295528 - RNA, 64 nt, Human
ugacaccgucuuacucuaccucagacaugaggaggcccuccauuccugguuucuguagcuugca

SEQ ID NO: 295529 - RNA, 64 nt, Human
gauggccuccagcgucagugccaagacugagcgggcccuccaguguuguccaaggaaauguaga

SEQ ID NO: 295530 - RNA, 64 nt, Human
caauaccuggagcucagaaaggcagagccaucuggcccuccaggguguccccagccaucaggag

SEQ ID NO: 295531 - RNA, 64 nt, Human
gcuuccgccugccucccagcgaguacgucaucgugcccuccaccuacgagccccaccaggaggg

SEQ ID NO: 295532 - RNA, 64 nt, Human
cugccgguggcacucagcaccuccuugugcuagagcccuccaucaccuucacgcugucccacca

SEQ ID NO: 295533 - RNA, 64 nt, Human
gaggggaaggcugauaacggcguaagaugaaguggcccuccacaaaggcugguuaggggacagu

SEQ ID NO: 295534 - RNA, 64 nt, Human
uaucgacaaucugucagccgacgcagggcuggaggcccuccauuucccuccccuuuuaauuuau

SEQ ID NO: 295535 - RNA, 64 nt, Human
aagcugcagcucugcucaacugcgucuucucucagcccuccacacacacucacccccacuccca

SEQ ID NO: 295536 - RNA, 64 nt, Human
ccggcccucccagcccggccagccugagcuugcugcccuccaguagagacagaggggcaguguu

SEQ ID NO: 295537 - RNA, 64 nt, Human
ucccaagcuccauucuuccuucccucaacucucugcccuccacagagcuauggagaaggcugga

SEQ ID NO: 295538 - RNA, 55 nt, Human; identical to SEQ ID NO: 150699

SEQ ID NO: 295539 - RNA, 64 nt, Human
aguccaccuguuuaucaacggcaccauuccugcagcccuccagacuuccugcccuuagcaagug

SEQ ID NO: 295540 - RNA, 64 nt, Human
cugugacaggaaugggaaaaggacagcacaggaugcccuccaaggaugagcugguccagagaua

SEQ ID NO: 295541 - RNA, 64 nt, Human
cagcacugggggcuucuccccaggagaccacgcugcccuccaagaccaggagcagcugugagcu

SEQ ID NO: 295542 - RNA, 64 nt, Human
cccuucccuguccuaagccugacgccugcaccgggcccuccagcccuccccugcccagauagcu

SEQ ID NO: 295543 - RNA, 64 nt, Human
cggccucagauccugggaccccugggccgugccugcccuccaccuugagugccauacucccaac

SEQ ID NO: 295544 - RNA, 64 nt, Human
ccgcugauggggggagccauccagaccgaacagcgcccuccacggccgagucccccgccgcugg

SEQ ID NO: 295545 - RNA, 64 nt, Human
aucagggcauugccugugacugaggcggagcccagcccuccagcgucugccuccaggagcugca

SEQ ID NO: 295546 - RNA, 64 nt, Human
gcucuggggccagaauggcuguccuugucguagagcccuccacauuuucuuuuucuuuuuugag

SEQ ID NO: 295547 - RNA, 64 nt, Human
gaacuacaagugugagccaccgcgccuggcccaagcccuccacauuuucaauccaggagccuug

SEQ ID NO: 295548 - RNA, 64 nt, Human
ucaccuuuauucuggcagaggagggagcaucagugcccuccaggauagacuuuucccaagccua

SEQ ID NO: 295549 - RNA, 64 nt, Human
aagucccaccaccugcacauguguagccccaccagcccuccaaggcauugcucgcccaagcagc

SEQ ID NO: 295550 - RNA, 64 nt, Human
ccaccucucucacuccuugaaaacacuguucucugcccuccaagaccuucuccuucaccuuugu

SEQ ID NO: 295551 - RNA, 64 nt, Human
cugccuccccgcggggcagggcucgggaccugcagcccuccaugccugacccuccccccacccc

SEQ ID NO: 295552 - RNA, 64 nt, Human
gacuggacccguagccccuggcuaggucgaaacagcccuccaccucccagccaagaucugucuu

SEQ ID NO: 295553 - RNA, 64 nt, Human
cugacuaagccuuugacuuaaggguugcuugcuugcccuccaaauguccuuucucagaggggcc

SEQ ID NO: 295554 - RNA, 64 nt, Human
cuggggggacaucucaccucccccauggcacagagcccuccacaccccuggaccagggcauccg

SEQ ID NO: 295555 - RNA, 64 nt, Human
aaugaugaccuggacccuggccagaagagcccuggcccuccagcaaggcagcaccugcucugau

SEQ ID NO: 295556 - RNA, 64 nt, Human
gccaguacagacuccagacagaggggcccuuggggcccuccaaccucaggugaugagcugagaa

SEQ ID NO: 295557 - RNA, 64 nt, Human
gaggagcacuggggaaagccucagcccaauucgggcccuccaauuacugaggcauacguaacag

SEQ ID NO: 295558 - RNA, 64 nt, Human
gagagcacugcccugugaagaaagcccuuucccagcccuccaccacuuccacccuggcgagugg

SEQ ID NO: 295559 - RNA, 64 nt, Human
gguugaggggacugacgggggccaccaccgccccgcccuccagcgccuccucccaggguggcug

SEQ ID NO: 295560 - RNA, 64 nt, Human
uugaucacugcguucuucaagggaugaauccagagcccuccaugaggccaagcuuguccuucaa

SEQ ID NO: 295561 - RNA, 64 nt, Human
ggcagauaaaccccaugaggggucaggcugaugugcccuccagcaguaucugagaagcugcuac

SEQ ID NO: 295562 - RNA, 64 nt, Human
ggcccuccacuggccccagggcuggagcugcccugcccuccauaggcaacuggugcagggacug

SEQ ID NO: 295563 - RNA, 64 nt, Human
ugcacuagcugacugugcuggcuggcucuggcuggcccuccacuggccccagggcuggagcugc

SEQ ID NO: 295564 - RNA, 64 nt, Human
cuaugucucagugccccuuaaauuucugcccugagcccuccacgucagugccaucggucuagaa

SEQ ID NO: 295565 - RNA, 64 nt, Human
cugugacaaagucugagggucuuccuuuaugcuugcccuccacacuaagagaaguuggcgucuc

SEQ ID NO: 295566 - RNA, 64 nt, Human
agaaauagcaaugguuguuccuaagguauugcuugcccuccaugucuuccuaaagagcagaacu

SEQ ID NO: 295567 - RNA, 64 nt, Human
gagagauuggaguccuggucucccuaagggaauagcccuccaccuguggcccccauugcauuca

SEQ ID NO: 295568 - RNA, 64 nt, Human
cccugccuggucuagcuccucuccaaacagccaugcccuccaaaugcuagagaccugggcccug

SEQ ID NO: 295569 - RNA, 64 nt, Human
cgacccccagcucaagcgcuggggccugcugccagcccuccaccuuccccaccccuugggccau

SEQ ID NO: 295570 - RNA, 61 nt, Human
gcgagaucacccugcucugacccagcccccagcccuccaguaccuucugccagaagacuca

SEQ ID NO: 295571 - RNA, 64 nt, Human
gacucauaggggcugggccucggaccccacuccggcccuccagagccccacagccccaucugcg

SEQ ID NO: 295572 - RNA, 64 nt, Human
aaaucuaguaaugaggaaacugagcauuucuuuugcccuccagggugccaagacccuacauaug

SEQ ID NO: 295573 - RNA, 64 nt, Human
cuaacacuagucugugugcugugguuccuggggugcccuccacugcccucuguucaguaacagg

SEQ ID NO: 295574 - RNA, 64 nt, Human
ggucugaccuggggggauuggagggaaaugaccugcccuccaccaccacccaaagugugggauu

SEQ ID NO: 295575 - RNA, 64 nt, Human
acacaagcccagcagguccugagugaagccgugggcccuccaaaugcucguuuuauagcaaccu

SEQ ID NO: 295576 - RNA, 64 nt, Human
cugugugacaucaguggcauggcuccagucugcugcccuccaucccgacauggacccggagcua

SEQ ID NO: 295577 - RNA, 64 nt, Human
cuuggccugcugaaguguuaggaagagggugggugcccuccagaccuggggacugaguggggaa

SEQ ID NO: 295578 - RNA, 64 nt, Human
acucuaccugaaccugcacaccuacgugcgcagggcccuccaccgccacuaugggcccgagcuc

SEQ ID NO: 295579 - RNA, 64 nt, Human
uugaaaggaagucacuggagugcugccaggggccgcccuccaagguuaaugagaggcccacauc

SEQ ID NO: 295580 - RNA, 64 nt, Human
ccagccccagccucaccaccgcaucccaccuccugcccuccauaccucuaguugugucugaugc

SEQ ID NO: 295581 - RNA, 64 nt, Human
ugccucagccucccgaguagcugggacuacaggugcccuccaccacgcuuggcuaauuuuuuug

SEQ ID NO: 295582 - RNA, 64 nt, Human
caccccacaggcuuuacccuuugagaaaaaggcagcccuccagauuuuguagacauuuuucuua

SEQ ID NO: 295583 - RNA, 54 nt, Human; identical to SEQ ID NO: 150744

SEQ ID NO: 295584 - RNA, 64 nt, Human
gcgaccugacaccauguuggggguuguguguggugcccuccacguggcagaugugagccugcgg

SEQ ID NO: 295585 - RNA, 64 nt, Human
uggggucuugggagcaggccuuuuuguguccucggcccuccacccuugguggggaggggaccca

SEQ ID NO: 295586 - RNA, 64 nt, Human
uccugcaaaccucacaggguccccacacaacagugcccuccagaagcagccccucggaggcaga

SEQ ID NO: 295587 - RNA, 64 nt, Human
gcacaaauccaggaggcucucauauccuggaauugcccuccagguauccucagucuuucugcuu

SEQ ID NO: 295588 - RNA, 64 nt, Human
ggggaccuugggagccugggcuugaaggacaguugcccuccaggagguuccucacacacaacuc

SEQ ID NO: 295589 - RNA, 64 nt, Human
aguggggguggggggucccaaagaguuugaugaggcccuccacaccugcggcccaauccaaggu

SEQ ID NO: 295590 - RNA, 64 nt, Human
gaaggggaggagggcggggggcaccuacuacaucgcccuccacaucccugauuccuguuguuau

SEQ ID NO: 295591 - RNA, 54 nt, Human; identical to SEQ ID NO: 150752

SEQ ID NO: 295592 - RNA, 64 nt, Human
ccagacagccucccccuguccccucuaugaccucgcccuccacaaaugggaaaaccagacuacu

SEQ ID NO: 295593 - RNA, 50 nt, Human; identical to SEQ ID NO: 150754

SEQ ID NO: 295594 - RNA, 64 nt, Human
ccuguagggucuggggcuuccccgccacaucgcggcccuccagccuggccuaacacuuggggag

SEQ ID NO: 295595 - RNA, 64 nt, Human
ggugggaucccacgcccccucccggccccucccugcccuccauucagggagaaaccucuccuuc

SEQ ID NO: 295596 - RNA, 64 nt, Human
ugagguuaaacaaagggcccugaaguuugagugcgcccuccauuugcccugugcugaacuugcu

SEQ ID NO: 295597 - RNA, 64 nt, Human
cuuaggcuccuccacaaacgcuggcgggugugccgcccuccagccucuccgcccccguccccuc

SEQ ID NO: 295598 - RNA, 64 nt, Human
caggauuuucacacccccuccucaagcugggccugcccuccaagugcuuguuauauaccuccac

SEQ ID NO: 295599 - RNA, 64 nt, Human
acaaaacugacaggaaugcacauucgauuuucaagcccuccagagcuugaacaacaacuuuagg

SEQ ID NO: 295600 - RNA, 64 nt, Human
aguagagggguguggcugggccugucacccuggggcccuccagguaggcccguuuucacgugga

SEQ ID NO: 295601 - RNA, 64 nt, Human
agagcaggcggcucuucuggaacgcagggcccgggcccuccagccccgcccggcccagguaucc

SEQ ID NO: 295602 - RNA, 64 nt, Human
aggcucuuggugacuguggcagcgggaguucccggcccuccacacccggggccagacccucggg

SEQ ID NO: 295603 - RNA, 64 nt, Human
ggggggccugugaccucccauggagcccagccccgcccuccacaccuccggcgcuccgcaccca

SEQ ID NO: 295604 - RNA, 64 nt, Human
ggcugaggcugcagugaguugugauugcaccacugcccuccagccugggcaacagagugaaacc

SEQ ID NO: 295605 - RNA, 64 nt, Human
ccucguacugccucauggaaaauccuccggagccgcccuccauuguggguuccugagaguagga

SEQ ID NO: 295606 - RNA, 64 nt, Human
agaaacagcacagcuggggcggggacccagccuugcccuccacccgaggcucugggacaaggcg

SEQ ID NO: 295607 - RNA, 64 nt, Human
cacuuuggccaccaguucuucggccagcaccucugcccuccagaaccugcagccuggaggggug

SEQ ID NO: 295608 - RNA, 64 nt, Human
agccaaggagacccaagggguccaggaggugggcgcccuccauccuucgagaagcuucccaggc

SEQ ID NO: 295609 - RNA, 64 nt, Human
ccacggggcagggcccacugagggaacaucaguggcccuccagucagguucuguggguuuggaa

SEQ ID NO: 295610 - RNA, 64 nt, Human
uaugcugaggccccacagacuuacagaagaaguggcccuccauagacauguguagcaucaaaac

SEQ ID NO: 295611 - RNA, 64 nt, Human
cgaguuuuaugcaucacaguuaacaugucagcuggcccuccaggcccccgcccccaucccgucc

SEQ ID NO: 295612 - RNA, 64 nt, Human
ccuccuccuucagccuggucucccccucuucucugcccuccacccccgucucugcacugagaua

SEQ ID NO: 295613 - RNA, 64 nt, Human
augaggaccagcuuagcugacacacccccagcuggcccuccacccccaccucaagugccuuauu

SEQ ID NO: 295614 - RNA, 64 nt, Human
uccucuuuggcaccuccauucccuguugcugaaggcccuccagcauccccuuaagcaucuguac

SEQ ID NO: 295615 - RNA, 64 nt, Human
uuauauuuuuuaauaucgggggguggaccacgccgcccuccauccgugcugcaugaaaaacauu

SEQ ID NO: 295616 - RNA, 64 nt, Human
caagccguaccuggugaacugcguccgcaucccugcccuccagucccuccugcuuuuuagccgg

SEQ ID NO: 295617 - RNA, 64 nt, Human
ccaggagcccugcccaccuccgugcagcugaccugcccuccagcccaggacuaggggcaggacu

SEQ ID NO: 295618 - RNA, 64 nt, Human
ugcaaacaaggaauccuugccuuuaaggugacaggcccuccacaggcuuccagacuugaaggaa

SEQ ID NO: 295619 - RNA, 64 nt, Human
ucggguccaccugcagcaugacagcacccugcuggcccuccagggggcccugggccucuaugau

SEQ ID NO: 295620 - RNA, 64 nt, Human
aaacaaagccauggggaaguuccagcugagcagagcccuccacagcucagcaaagccucuguag

SEQ ID NO: 295621 - RNA, 64 nt, Human
ccgcgggagcugaggaagcgccgcuccaccgucugcccuccaaggacccgcauggaggcagugg

SEQ ID NO: 295622 - RNA, 64 nt, Human
cagacuccucggaggagaagucagcauuuuugaagcccuccacaccguuccggaagagcuggca

SEQ ID NO: 295623 - RNA, 64 nt, Human
uccuagagugaggcucuguccaauacauggcucugcccuccagaacuucaggcucucagugacc

SEQ ID NO: 295624 - RNA, 64 nt, Human
uggggccgggggccacgggcugcaugcugggcgggcccuccagagaaggacacaaacguguuuc

SEQ ID NO: 295625 - RNA, 64 nt, Human
cuggugcggggcagggccuaacaaggaaaccugggcccuccaagccagguugaggucugguaac

SEQ ID NO: 295626 - RNA, 64 nt, Human
ggaaggagguggaugguuaggucugcugggaugggcccuccaagcccaagccuccugcuccggg

SEQ ID NO: 295627 - RNA, 64 nt, Human
auucuuccaccagccaccacccuccgacccccuagcccuccacaagaagcagcauugagagagc

SEQ ID NO: 295628 - RNA, 64 nt, Human
cauagcggacgggggucccgagguggaaaccauugcccuccagaacaaccgugagaaccaggca

SEQ ID NO: 295629 - RNA, 64 nt, Human
accucagccucccaaauagcugggacuacaaggugcccuccagcaugccuggcugauuuuugua

SEQ ID NO: 295630 - RNA, 64 nt, Human
gaacaaccucuaccugcggcugcaggagcugguggcccuccaagggcagcauccacccugcagc

SEQ ID NO: 295631 - RNA, 64 nt, Human
ggcugcccccucagcagaggcagcugguggcuuugcccuccaccugccaacccuugggcucgga

SEQ ID NO: 295632 - RNA, 64 nt, Human
uaggacccccacccccgacccucgcgaauaaaaggcccuccaucugcccaaagcucuggacucc

SEQ ID NO: 295633 - RNA, 64 nt, Human
guucucugagguccugugcccucguccagcugcugcccuccacagcgguucuucacaggauccc

SEQ ID NO: 295634 - RNA, 64 nt, Human
accugcaacuucagacauuccagcucccccacucgcccuccacuaccucugagagcccagccac

SEQ ID NO: 295635 - RNA, 64 nt, Human
cucuccccuugucugcacuguucaaaccucugccgcccuccacaccucuaaacaucuccccucu

SEQ ID NO: 295636 - RNA, 64 nt, Human
aagaagcccgagacugauuccuuuagaauuaacagcccuccaugcugugcaacaggacaucaga

SEQ ID NO: 295637 - RNA, 64 nt, Human
accaggggaccucgggacugcgcgugaggccccggcccuccaaauccaaauccagacgcaggcc

SEQ ID NO: 295638 - RNA, 64 nt, Human
gggcauggacugacugccaggcugcgugcgcccugcccuccacccagccuccuggacucggccu

SEQ ID NO: 295639 - RNA, 64 nt, Human
ugccuaacucaugggcucugcccuucugcucggugcccuccacgugaggcggggcaccugcaug

SEQ ID NO: 295640 - RNA, 64 nt, Human
ggaaacgauaguucugcagucugcgccuuuccacgcccuccagccccgggggagauaaggucau

SEQ ID NO: 295641 - RNA, 64 nt, Human
ugaaaugagcagugagcagcccuuuagcaaaaucgcccuccaguccuuccuggagaugccuuca

SEQ ID NO: 295642 - RNA, 55 nt, Human; identical to SEQ ID NO: 150803

SEQ ID NO: 295643 - RNA, 64 nt, Human
cugguccccaucccugucucucccuuucacccuugcccuccaguccucuaccucuggccugccc

SEQ ID NO: 295644 - RNA, 64 nt, Human
agguagagccugugcagccugggcugcugucauugcccuccaguaagggcucaggguuuugcuu

SEQ ID NO: 295645 - RNA, 55 nt, Human; identical to SEQ ID NO: 150806

SEQ ID NO: 295646 - RNA, 64 nt, Human
aggcaucuccacagccccggguccucugucuaacgcccuccauuucacgcccuccaucucacag

SEQ ID NO: 295647 - RNA, 64 nt, Human
ccccggguccucugucuaacgcccuccauuucacgcccuccaucucacagucaagauaaaggcc

SEQ ID NO: 295648 - RNA, 64 nt, Human
ggcggaaggaacgcguguucauccucagugaucugcccuccagcaucucggcagcaucucaucc

SEQ ID NO: 295649 - RNA, 64 nt, Human
ugacuggcagacccugcccacgccccauucgccagcccuccacguccucccaggcuggcucugg

SEQ ID NO: 295650 - RNA, 64 nt, Human
gaaaggagcgccaaugagguucccugcaacccccgcccuccagcccaccgcccaaccuuuuaca

SEQ ID NO: 295651 - RNA, 64 nt, Human
ccucagggggcuguggggccagaagcugggccaagcccuccagccagaguugccagcaggcgag

SEQ ID NO: 295652 - RNA, 64 nt, Human
gcccugccuuugguuccuggacauuugguauucugcccuccacucugguacuaucagaguaggg

SEQ ID NO: 295653 - RNA, 64 nt, Human
gaagcccucccggcaucuggcauccgagccucccgcccuccagggugcgcuucccucucuugcc

SEQ ID NO: 295654 - RNA, 64 nt, Human
cugacuuccuaguaacuguugcaguuuacaaccugcccuccagggacacgucuccaugguuuuu

SEQ ID NO: 295655 - RNA, 64 nt, Human
ggggagagcauggcuaccagggagcugcagcggagcccuccagcccucaccccaggccagcccc

SEQ ID NO: 295656 - RNA, 64 nt, Human
gguagccgcacugcagaagcaacagcccgaccgcgcccuccagggucgucccuggcccaaggcc

SEQ ID NO: 295657 - RNA, 64 nt, Human
cccucgggcuggugucuugagaccagccugccaggcccuccagcaggaggacagagugcccugg

SEQ ID NO: 295658 - RNA, 64 nt, Human
ccaccuccugucccucugcucccgcccggcaccagcccuccaguagauccuuucacgaccuugg

SEQ ID NO: 295659 - RNA, 64 nt, Human
ucggagcugguuccucucucccacccuaagggcagcccuccaugguccugucuguccuucugaa

SEQ ID NO: 295660 - RNA, 64 nt, Human
ccuagcgggcaggguugggcugaaucaaaugggagcccuccagacauaaggaggccagaggcug

SEQ ID NO: 295661 - RNA, 64 nt, Human
ugcuuggggggcguuggccgacuucuuagagaaggcccuccaugugacuuccucccaggagcca

SEQ ID NO: 295662 - RNA, 64 nt, Human
ggucgggccccugggcucuagagugacuuuugacgcccuccaucccucccgccaggcacugucc

SEQ ID NO: 295663 - RNA, 64 nt, Human
cagcaccagcagcaucuuugcugggcagggcccagcccuccacugcagaagcaucuggaagcac

SEQ ID NO: 295664 - RNA, 64 nt, Human
ggaugcuggggccccacugccccuccgcugccuugcccuccauccuuccucuguuccuucuggc

SEQ ID NO: 295665 - RNA, 64 nt, Human
cucaucuuggaaacugcucuuauugugccaauaugcccuccaaacccucccaggauucaaagcu

SEQ ID NO: 295666 - RNA, 64 nt, Human
cauugucucauggaaagacucaacuugcaacugugcccuccacacuauccuuacuucugucucc

SEQ ID NO: 295667 - RNA, 64 nt, Human
cucccaccaucaccucccucaccucgggacaguagcccuccacuucuccagccucucagcccug

SEQ ID NO: 295668 - RNA, 64 nt, Human
guagcccccgggguugggcaagggaaggaugguggcccuccagaggucaugaagggaccucugu

SEQ ID NO: 295669 - RNA, 64 nt, Human
auuuuauuauaaauuacaauccacucauccaccugcccuccaccaggagugggcaccccauaag

SEQ ID NO: 295670 - RNA, 64 nt, Human
guacccccaucacccagggcguggagaugaccacgcccuccaaacagagcaacaacaaguacgc

SEQ ID NO: 295671 - RNA, 64 nt, Human
cagccgugacucagccuggacaccggacaugacugcccuccaggaauaaccccucccugagaca

SEQ ID NO: 295672 - RNA, 64 nt, Human
gcccuggccgcuggagacucuuaaagcccccacagcccuccagguccuccagcucugucagaug

SEQ ID NO: 295673 - RNA, 64 nt, Human
cuggcuccuuggucucuccgguugguguuaaagggcccuccacugccaccucucaugggaugga

SEQ ID NO: 295674 - RNA, 64 nt, Human
uuccuuugugcuggggccaggcgaguggagaaacgcccuccagucugagagcaggggagggaag

SEQ ID NO: 295675 - RNA, 64 nt, Human
auggagagcugcccagcucuccuacaagguuagugcccuccaccuagggaagcaugaaccacag

SEQ ID NO: 295676 - RNA, 64 nt, Human
ggaacacggagcagaugagagagggucggggcuugcccuccaccuuggacuuggaagaagccca

SEQ ID NO: 295677 - RNA, 64 nt, Human
cuagagccaggaccaggugggggugcggcccugugcccuccaaauucacaggggguaccuagga

SEQ ID NO: 295678 - RNA, 64 nt, Human
caaggcuucccgggggcggcgacugccgagcuccgcccuccaggcggccccacccgccugccgu

SEQ ID NO: 295679 - RNA, 64 nt, Human
agacaggaacccuugcauccauuguugugucugugcccuccaaagagccuucagaaugcuccug

SEQ ID NO: 295680 - RNA, 64 nt, Human
uuuccauugaauuaucaacugugauuuuuauauugcccuccaagugguagaagaagauugcaaa

SEQ ID NO: 295681 - RNA, 64 nt, Human
aggccccgcccaagccaccagggagccaaucucagcccuccacgccaaggagccuugcccacca

SEQ ID NO: 295682 - RNA, 64 nt, Human
aggccacagccgcaucuugaucaggcuuucucaagcccuccaucggccccaccagaucuccauu

SEQ ID NO: 295683 - RNA, 64 nt, Human
acccuaaucuuccaccaccucuccggcugccccugcccuccaucacagacagcagagccgggca

SEQ ID NO: 295684 - RNA, 64 nt, Human
cugccuugucccaccagggaggcagcagacucaggcccuccaugguccucuuugucauuuuguu

SEQ ID NO: 295685 - RNA, 64 nt, Human
cacccagccgagcccccccugccccgagccccccgcccuccagcccaggggggaccgugggugg

SEQ ID NO: 295686 - RNA, 55 nt, Human; identical to SEQ ID NO: 150847

SEQ ID NO: 295687 - RNA, 64 nt, Human
gugcuuugcugaaggauuuagacggggaugaagugcccuccagccucagagcuagccacaaagc

SEQ ID NO: 295688 - RNA, 64 nt, Human
ugccauaucaccacacaauaggaucccccuucuugcccuccacccccauaagauugugaagggu

SEQ ID NO: 295689 - RNA, 64 nt, Human
gguccaggccacagugaucugagaucacaccauugcccuccagccugggugacagagugagacc

SEQ ID NO: 295690 - RNA, 62 nt, Human
uugcuuuacucuuucuuuaugauugcaucugaccgcaccaaggugggccaugcguuguuugg

SEQ ID NO: 295691 - RNA, 62 nt, Human
guguggagaggggugcacccacucaccaggguccgcaccagcugcucugccccuugggcauc

SEQ ID NO: 295692 - RNA, 62 nt, Human
cagcgggagccucccugccucaggccucugugccgcaccauugaacuguaccaugugcuaca

SEQ ID NO: 295693 - RNA, 62 nt, Human
ccugcauaugcaccuggggaguccccacacacccgcaccaaaggggaaacauucaaaggaga

SEQ ID NO: 295694 - RNA, 62 nt, Human
agaaaauguaaaggagggagaucuuucccaggccgcaccauuucugucacucacauggaccc

SEQ ID NO: 295695 - RNA, 62 nt, Human
cacaccugcccaccucaccucacugcaccgcaccgcaccagagccagagcagcugcuugucu

SEQ ID NO: 295696 - RNA, 62 nt, Human
cgcguuccaggguuuugauguggugggaugauccgcaccaucuucacugaugugcuucccuu

SEQ ID NO: 295697 - RNA, 62 nt, Human
cgagguggaccccgaaacggacggcccggagcccgcaccagccccgcgccuacccgggccgc

SEQ ID NO: 295698 - RNA, 62 nt, Human
gcccugugcuccggccauggccgcuguguccgccgcaccagccaccccaaagcccuccuccu

SEQ ID NO: 295699 - RNA, 62 nt, Human
uucuagaguuguuuucuuccucccccccccccccgcaccauugguuguguaucacuuucacu

SEQ ID NO: 295700 - RNA, 62 nt, Human
aaaaccaaguaucacacuuuaauguacaugggccgcaccauaaugagaugugagccuugugc

SEQ ID NO: 295701 - RNA, 58 nt, Human
cgugccaguacaacagcugaccgccccgccgcaccacgcgggccggcggccggagcgg

SEQ ID NO: 295702 - RNA, 62 nt, Human
gccuaaccugcauugcagccguucaccggacaccgcaccagacccucaaaacccauccaaga

SEQ ID NO: 295703 - RNA, 62 nt, Human
acccagccugagauggucccaucugcagggccccgcaccaguuggagcagaugccuccccac

SEQ ID NO: 295704 - RNA, 62 nt, Human
ucacugacugugcacugugcuuagagacccugccgcaccacagugccaaugcuugucagaca

SEQ ID NO: 295705 - RNA, 62 nt, Human
gggcgggugaacgcagacccugacuaccugccccgcaccauggacuuuggccucaacgugcg

SEQ ID NO: 295706 - RNA, 62 nt, Human
cggcacuuggcuuucuguuccuagagcccaucccgcaccagcauuuuggaaccugcagagag

SEQ ID NO: 295707 - RNA, 62 nt, Human
acgugcacuuggugcugcgcccagggaggaagccgcaccaccagccagcgcaggcccuggug

SEQ ID NO: 295708 - RNA, 62 nt, Human
gacgugagcacaguuauggcagagaaguuucuccgcaccagaauuauccacagcaacuuggc

SEQ ID NO: 295709 - RNA, 62 nt, Human
uuggacacuccgagagugcagcuguucuccccccgcaccauccguguccugcauucugcgag

SEQ ID NO: 295710 - RNA, 62 nt, Human
ucugcuccucugcugcaggacggccggcugccccgcaccaucccucuccccagcugcaaacu

SEQ ID NO: 295711 - RNA, 62 nt, Human
auauccaccucuguccagggugccgccagcugccgcaccagcccgaacaccauugagggagc

SEQ ID NO: 295712 - RNA, 62 nt, Human
ggcgggcccgggccugccgccccccagcccugccgcaccaagcuggcccuccuuccucccuc

SEQ ID NO: 295713 - RNA, 62 nt, Human
uuccaccugggagccugugcccucagaccgccccgcaccagagccacgggcuguggggcggg

SEQ ID NO: 295714 - RNA, 62 nt, Human
uucccaggcuuggugcacuucaucuauguggaccgcaccacugggcagaugguggcgccuuc

SEQ ID NO: 295715 - RNA, 62 nt, Human
ugggaaacagugcagugacucacccccugcccccgcaccaaccacccauauucaggagaaga

SEQ ID NO: 295716 - RNA, 62 nt, Human
cugaacucaagcugcguuuauuaaugccucucccgcaccaggccgggcuugggcccugcaca

SEQ ID NO: 295717 - RNA, 62 nt, Human
cggaugcaggcgaggccgcggccccagaguccccgcaccaggcagagccguaccugucaccc

SEQ ID NO: 295718 - RNA, 62 nt, Human
agaacgguggcuacugugaguggggagcagaaccgcaccacuguuauacugggauaacaauu

SEQ ID NO: 295719 - RNA, 62 nt, Human
uguguacauucggaguuccuguuuugcucaucccgcaccaccccacccuccacacacuaaca

SEQ ID NO: 295720 - RNA, 62 nt, Human
gaaguugagagucuuuagaccugugcacagccccgcaccaaggggugcuguaugcucuaggc

SEQ ID NO: 295721 - RNA, 62 nt, Human
guuuuaccgccugcaaccucacugugcccgccccgcaccaugcccuagccccaggucuagcc

SEQ ID NO: 295722 - RNA, 62 nt, Human
acuuggaucaaaagcaaaacagucucuccgccccgcaccagaucaaguaguuuggacaucac

SEQ ID NO: 295723 - RNA, 62 nt, Human
ggaaucaggccgccgagggcugagcuccagagccgcaccaucugccacaaacagaauucgag

SEQ ID NO: 295724 - RNA, 62 nt, Human
agauugucccagggccuuguggaggacacgggccgcaccacacagugcucccugcccugccu

SEQ ID NO: 295725 - RNA, 62 nt, Human
agggccaauucaaccccauucuuuccagcgccccgcaccauagcaccugcccaccugagaac

SEQ ID NO: 295726 - RNA, 62 nt, Human
uuuggcugaccuucaauucccucuccaggacuccgcaccacuccccuacacccagagcauuc

SEQ ID NO: 295727 - RNA, 54 nt, Human
agcugcgcaagaagagcugagucgccgcaccagccgccgcgccccgggccggcg

SEQ ID NO: 295728 - RNA, 62 nt, Human
ccagacugagggucugggauggggugaaccuuccgcaccagagggacacuccacagaagcca

SEQ ID NO: 295729 - RNA, 62 nt, Human
agaagagccccacgggcuuccugcaucuuccaccgcaccauaccuggagcccuccgaggggu

SEQ ID NO: 295730 - RNA, 62 nt, Human
ccgcuucuagagccucgacacccccccaacccccgcaccaagcagacaaagucaauaaaaga

SEQ ID NO: 295731 - RNA, 62 nt, Human
gcccuguugccaaacaacucccugaggccucuccgcaccaccucagcgggcaggagguccca

SEQ ID NO: 295732 - RNA, 62 nt, Human
cuuuucucugccuuucuaccgaccaugugaccccgcaccagcccugcccccaccugcccucc

SEQ ID NO: 295733 - RNA, 62 nt, Human
cuaaguaggcccuccccucccuaaaucugcuuccgcaccaccuggucuuagccccaaagaug

SEQ ID NO: 295734 - RNA, 62 nt, Human
acccgggagguggagguugcagggagccgaggccgcaccacugcacuccagccugggugaca

SEQ ID NO: 295735 - RNA, 62 nt, Human
gcuggccaaguguugagagcugccugcgagccccgcaccaccccgcggagcacguacccagg

SEQ ID NO: 295736 - RNA, 62 nt, Human
aguuggcgggggcuuggcugugcccucagauuccgcaccaauaaagccuucaaacucccuaa

SEQ ID NO: 295737 - RNA, 62 nt, Human
gccccaggccccucuguaccauccccuccccuccgcaccacugaccucuugucuccuguugu

SEQ ID NO: 295738 - RNA, 62 nt, Human
acauggccuauguaccuaacguggccuucuucccgcaccacccuugccugcgcuggcccagu

SEQ ID NO: 295739 - RNA, 62 nt, Human
ugccagcaggccccaccauggaaaucaaaacaccgcaccagccagcagaauggacauucuga

SEQ ID NO: 295740 - RNA, 62 nt, Human
agugcagaagggugcgccucuucccucuacccccgcaccaccugcugugugccagccugaga

SEQ ID NO: 295741 - RNA, 62 nt, Human
cuuuucuacaugaugcccugcugaccaugcagccgcaccagagagagauucuuccccaauug

SEQ ID NO: 295742 - RNA, 62 nt, Human
gaugaaaaguagaggcugcugggaggcaagagccgcaccaugcaggauggggaggagggcga

SEQ ID NO: 295743 - RNA, 62 nt, Human
cucuuuccuucuccaggacggccgagaguuauccgcaccagugauuguugacauugacagcu

SEQ ID NO: 295744 - RNA, 64 nt, Human
guggggcgauuuuuuaugugccaaauacccccgucccccccaugaauccugcugucccugcugc

SEQ ID NO: 295745 - RNA, 64 nt, Human
gccugggacaggggaggacccuucuuuuggacagcccccccacccagagcccggucccuugggg

SEQ ID NO: 295746 - RNA, 52 nt, Human; identical to SEQ ID NO: 223655

SEQ ID NO: 295747 - RNA, 64 nt, Human
ccccuccugugaccucaggguuuggcccauggggcccccccaggccccugccccaacugauucu

SEQ ID NO: 295748 - RNA, 64 nt, Human
ucucccuacccauuuggcucuggaagcugcuuggcccccccagaucagggccugggugaacucc

SEQ ID NO: 295749 - RNA, 64 nt, Human
ggagggagggcgucugaugcucucucucugccuccccccccauccugucaggcacaggugacgg

SEQ ID NO: 295750 - RNA, 64 nt, Human
aaaaagagcaggaggggacaccccuccauaugcccccccccaucuccugcuuucaugucccugg

SEQ ID NO: 295751 - RNA, 64 nt, Human
cgucuucggaaguuaccagccugugagauccaagcccccccacccaggcccccuaaaaaucagg

SEQ ID NO: 295752 - RNA, 64 nt, Human
uaaccugcgagaucagcagauaagaucaacaggucccccccacaugaggccacccaggaaaaaa

SEQ ID NO: 295753 - RNA, 64 nt, Human
acucaccccaccuaaggccaucuagugccaacuccccccccaccauuccccucacugcacuuug

SEQ ID NO: 295754 - RNA, 64 nt, Human
uuuguccuugggguucuuucugcuuauguuuuuucccccccaucugguaauaguccucuucuga

SEQ ID NO: 295755 - RNA, 64 nt, Human
caauggaguacugggucacagggauuccuccuuucccccccaaauauuaacuccagaaacuagg

SEQ ID NO: 295756 - RNA, 64 nt, Human
ugucaacacugcauugucuuuugagcucuuuuuucccccccaacaaaguuuuuuuguuuuuugu

SEQ ID NO: 295757 - RNA, 64 nt, Human
uccccuuccuccuuacccucccucccuuacucuccccccccaccaccacccuccacccccaacu

SEQ ID NO: 295758 - RNA, 64 nt, Human
gccuuggugucccgaguagcugggauuacagguucccccccaccuucccccacacccagcuaau

SEQ ID NO: 295759 - RNA, 64 nt, Human
cuucaggguaucccagaccccucucaacacccgccccccccauguuuaaacuuugugccuuuga

SEQ ID NO: 295760 - RNA, 64 nt, Human
uucuugcuaaccaggccgagaggccacacacuugcccccccauccccacaaaccagguaaugcc

SEQ ID NO: 295761 - RNA, 64 nt, Human
cacagcuuucagggacagugggcaagaggacacccccccccaccaccucaguggaacacaccau

SEQ ID NO: 295762 - RNA, 64 nt, Human
ccuuuguuuuuuaaaaguuuaugacaguuggcuccccccccacccccagcaaccccaucccaga

SEQ ID NO: 295763 - RNA, 64 nt, Human
caugaugggccugaacucggacaagugaucgccacccccccaccccaggcccugccagagcagg

SEQ ID NO: 295764 - RNA, 64 nt, Human
uaugggacagccaaguuauacccaaccccagaugcccccccauccugcucagcugcgucauggg

SEQ ID NO: 295765 - RNA, 64 nt, Human
aacuagauuuuucuaucuucuguggucgcccgcccccccccaaaaaaauaccauuuaugguucu

SEQ ID NO: 295766 - RNA, 64 nt, Human
auccucacuucaggagcuuuuaaaaauacugagacccccccauaaccagagauucagauucaaa

SEQ ID NO: 295767 - RNA, 64 nt, Human
cgaugccaccggccugugggucucugaagggacccccccccaaucggacugccaaauucuccgg

SEQ ID NO: 295768 - RNA, 64 nt, Human
aaugcccuugaugguggaaaaaagaaaacaaccacccccccacugcccaaaaaaaaaagcccug

SEQ ID NO: 295769 - RNA, 64 nt, Human
acaauuccuugggcuucuccugagguaaugauuacccccccacccacagcugagucugugaggc

SEQ ID NO: 295770 - RNA, 64 nt, Human
ugcaaccacuauuguuuuaauggaaagcaaaaaacccccccaaacuuaucagaauccucguucu

SEQ ID NO: 295771 - RNA, 64 nt, Human
cugccccccacuaagcuaauuccacaccccuguacccccccagggggcccucugccucauggca

SEQ ID NO: 295772 - RNA, 64 nt, Human
gcacggggcacagccgcgacucugcaggcagcuucccccccaugccagggcucugcgccgucau

SEQ ID NO: 295773 - RNA, 64 nt, Human
cucacagucuuauagcacaauauacccaaaucagcccccccaguccgagggcugggcccgaggu

SEQ ID NO: 295774 - RNA, 64 nt, Human
auuuguagccaauuuuagacucuuuucaauaccucccccccauuuuaauuaguauugaucauau

SEQ ID NO: 295775 - RNA, 64 nt, Human
uucuaugcauguuuucccuccuccccccaauucccccccccaucaccuuaucucccaggacaca

SEQ ID NO: 295776 - RNA, 64 nt, Human
gcaguuucuaucuuuagcccaucaucauuuucugcccccccaaaaucuguugaaaugauucacu

SEQ ID NO: 295777 - RNA, 64 nt, Human
acuugcuugugguguuuucguuucuuuuucaucucccccccacccacaaagagcacggagccag

SEQ ID NO: 295778 - RNA, 64 nt, Human
auuuguuuuaaaauuaaaauacuguguacccccccccccccaugaaaugcagguucacuaaaug

SEQ ID NO: 295779 - RNA, 56 nt, Human; identical to SEQ ID NO: 223688

SEQ ID NO: 295780 - RNA, 64 nt, Human
cauguucugugugaauaugcauaaccagagugaccccccccagcacccagcaugcccggcugug

SEQ ID NO: 295781 - RNA, 64 nt, Human
cuauuuaaaacugucagauccugaccagcaagcccccccccagccccccuuccaagugacuccg

SEQ ID NO: 295782 - RNA, 64 nt, Human
uaggcaagggggcagaucccagagccccucucaccccccccaccacaggccugcuccuuccuua

SEQ ID NO: 295783 - RNA, 64 nt, Human
ccuguaagcagaagcagcauccaagugccccuggcccccccauguguugauucaacccgguucc

SEQ ID NO: 295784 - RNA, 64 nt, Human
agucuccccagcucccugaugaugcucacccccgcccccccaccucaggugcugcuggugugag

SEQ ID NO: 295785 - RNA, 64 nt, Human
gaagcaaaugcaagcugggcugggucuagucccucccccccacaggugacaugaguacagaccc

SEQ ID NO: 295786 - RNA, 64 nt, Human
cugcccaagaaagccuggguauuguccaagguuucccccccacugagacagccugagauauggc

SEQ ID NO: 295787 - RNA, 64 nt, Human
guaagcaagagggcagggccgggguuuguggucccccccccaccacaaacacagcacuucggcu

SEQ ID NO: 295788 - RNA, 64 nt, Human
auauauuucauauaacauauauauuuauuuauuucccccccauagaaggcaaaauggcuuucag

SEQ ID NO: 295789 - RNA, 64 nt, Human
guugguggggaaaggugucuuucuuucugcccuccccccccaaaauaauucuguucacuuuugu

SEQ ID NO: 295790 - RNA, 64 nt, Human
cccuccaucucaaucccguaucuacgcacccccccccccccaggcaaagcagugcucugaguau

SEQ ID NO: 295791 - RNA, 64 nt, Human
ugcaccuuagaagccugcucugcauccauuuacccccccccaagggcuuuguuucacuguuuau

SEQ ID NO: 295792 - RNA, 64 nt, Human
uaaacaaaaauuacauuacaagauccagguucuucccccccacacucaaucaagccagcccucu

SEQ ID NO: 295793 - RNA, 64 nt, Human
aacagacugggacagugucugauucccccuucaccccccccacccccgccuugccacacacagc

SEQ ID NO: 295794 - RNA, 64 nt, Human
auuuccccucuucccuucaacaugaaaauauauacccccccaugcagucuaaaaugcuucagua

SEQ ID NO: 295795 - RNA, 64 nt, Human
cugcacaaagacacauacauucaccgcccccccgcccccccaacgcgcacacacacguccucuc

SEQ ID NO: 295796 - RNA, 64 nt, Human
aaccucauucaaauauuuacccgggacacacacccccccccacacacacacacagacacacuca

SEQ ID NO: 295797 - RNA, 64 nt, Human
uuucccccuauccuuuuucucuccaccccauccccccccccauuucguuuugcuuuugguugcc

SEQ ID NO: 295798 - RNA, 64 nt, Human
ucccucacccggcaaggggcgcgcgcccccaggacccccccaguccgccccgugcuccucugcc

SEQ ID NO: 295799 - RNA, 64 nt, Human
agccugggcaacagagcaagaccccauccuccaccccccccaaaaaauagaaagaaaaaaaaag

SEQ ID NO: 295800 - RNA, 64 nt, Human
cgcacacaggccccacccccacaguuccacgccccccccccaaggccacacccucccucccuag

SEQ ID NO: 295801 - RNA, 64 nt, Human
uuuuuguccucuuuguuaugcuuggaagcucccccccccccaacagugugucgagucuuugcaa

SEQ ID NO: 295802 - RNA, 64 nt, Human
ugaguauaugugaauauagagcuaggaaaaaaagcccccccaaauaccuuuuuaaccccucuga

SEQ ID NO: 295803 - RNA, 64 nt, Human
uuuaagcuuuugaaauuaaauuaucuauucuucccccccccaaaaaaaaguauuguaaauccuu

SEQ ID NO: 295804 - RNA, 64 nt, Human
acagaaacaagugcccagucagcaccuaccccuucccccccaggggguugaauaugcaaaagca

SEQ ID NO: 295805 - RNA, 64 nt, Human
gcuguaaagcaguuuuucuacuuuuaaagacccccccccccaacagaacacuaaacagacuauu

SEQ ID NO: 295806 - RNA, 64 nt, Human
gccaacuaugcagcccacaagaaggcccugcgggcccccccauugcccagcacugucucauaga

SEQ ID NO: 295807 - RNA, 64 nt, Human
uaacgaacccaacaaugaagauacaguucugucacccccccagcauucuccuguggcccucuag

SEQ ID NO: 295808 - RNA, 64 nt, Human
ucucuuacaaacuuuaagugcucugauaugacuucccccccaaauuuuauuaugaacauuuuua

SEQ ID NO: 295809 - RNA, 64 nt, Human
gcucccgacugcuucuugcagaggcugagagucccccccccaccuuuuuuuucauuuagaugua

SEQ ID NO: 295810 - RNA, 64 nt, Human
ccuguggcauggagaagccucagggaaaggccugcccccccagcacauacucccauaguguccu

SEQ ID NO: 295811 - RNA, 64 nt, Human
gguugggggcagaguuucugcaguuccaucaggucccccccaggugcaggugcugacaauacug

SEQ ID NO: 295812 - RNA, 64 nt, Human
cguguguugugauuguggcauggagaguccccaucccccccaugugagcgugucccgggcgggu

SEQ ID NO: 295813 - RNA, 64 nt, Human
aaugccgacccuguggccugcugcccgccccccccccccccacaguggccauacgggcacagga

SEQ ID NO: 295814 - RNA, 64 nt, Human
gaguaucccuccucugugugcucaugcugugaaucccccccauucuaccacuucuccccucauc

SEQ ID NO: 295815 - RNA, 64 nt, Human
auuuaagacaccucccccaccgcccgccccccgccccccccaaucaaaguguggucccaaaaca

SEQ ID NO: 295816 - RNA, 64 nt, Human
auguaacugccucaaggacccuggacucugcucacccccccaccacucugccuggccuccugcu

SEQ ID NO: 295817 - RNA, 64 nt, Human
uuaaccucauuuccguuuccuaccuguuugcuuccccccccaguccuccgcaugagcuguugcc

SEQ ID NO: 295818 - RNA, 64 nt, Human
auuuaaucuguacuauccagugagguaauuucuucccccccaagauagagucaagcucugucac

SEQ ID NO: 295819 - RNA, 64 nt, Human
uggccaguggacucauccauucuuuggaacaaaucccccccacuccaaaguccauggauucaau

SEQ ID NO: 295820 - RNA, 64 nt, Human
gccaaauccauucuucuugcccuggcucacuugucccccccaccgccccgcgcuggagccacug

SEQ ID NO: 295821 - RNA, 64 nt, Human
caccaucgcccgcccauucuacuacucaaccccucccccccaagguauuuccagaacuaaaccc

SEQ ID NO: 295822 - RNA, 64 nt, Human
uggcguugcagagaugaugagagcuguguggccacccccccaaccuugcccccggcacaccaaa

SEQ ID NO: 295823 - RNA, 64 nt, Human
uuggauacauacaccagcauuccuuuugaacgcccccccccaccccugggggcucucauguuuu

SEQ ID NO: 295824 - RNA, 64 nt, Human
aggaagcuuguugcggcauugaucuaaccuuuuucccccccauuucaguugcaguuuuuguaga

SEQ ID NO: 295825 - RNA, 64 nt, Human
auugcacuccagccugggcaacaggaguaaaacucccccccacccaaaaaaaaaaacaacaaca

SEQ ID NO: 295826 - RNA, 64 nt, Human
uguucacuuucaaguuggcugucccccccgccgccccccccacccccauauguacagaugauaa

SEQ ID NO: 295827 - RNA, 64 nt, Human
uguuugucagaaggaaaaauaaugcauuuaucuucccccccaccccccgccccauggaauauuu

SEQ ID NO: 295828 - RNA, 64 nt, Human
caagccuucuuaaagccuuauuuuucaaaagcgccccccccauucuuguucagauuaagaguug

SEQ ID NO: 295829 - RNA, 64 nt, Human
gcacccacaggcccccucagggcuccuugccuuucccccccaccagcacaccccguacccugcc

SEQ ID NO: 295830 - RNA, 64 nt, Human
cccacccuggcuuccuuccuccacccaguggagacccccccaaggcaugaggggaaagccauua

SEQ ID NO: 295831 - RNA, 64 nt, Human
cugaaucuccccuucuuugugacagcuccucccacccccccaaaaaauaaaaaaaccacaaaaa

SEQ ID NO: 295832 - RNA, 64 nt, Human
uccgcaaauaccacugaagaggacacacucugcacccccccaccccacgaccuuggcccgagcc

SEQ ID NO: 295833 - RNA, 64 nt, Human
aaccuggugauauugccagcagacccccugccaucccccccaguuguccuggggcugaaugggc

SEQ ID NO: 295834 - RNA, 64 nt, Human
ggagucucccccuuccuccugugcccuccccuuccccccccaacagcugcuaugggggggcuaa

SEQ ID NO: 295835 - RNA, 64 nt, Human
uccccuugcugaguccccugccaagcgcucggagcccccccaggacacucugcacccccucacc

SEQ ID NO: 295836 - RNA, 64 nt, Human
gggggcugagggguugaugugggguucaggauggcccccccaugggggguggaugauuugcacu

SEQ ID NO: 295837 - RNA, 64 nt, Human
guccuggcuaccagcucucaccuacacccacgcacccccccacacacuaugcucucucaagaau

SEQ ID NO: 295838 - RNA, 64 nt, Human
cacuaugcucucucaagaauguaauuuauuggggcccccccagcugcuuuccucaccugccccu

SEQ ID NO: 295839 - RNA, 64 nt, Human
gcuccaucaccagcccgggcuggcccaaggaguacccccccaacaagaacugcaucuggcagcu

SEQ ID NO: 295840 - RNA, 64 nt, Human
gaccagccuggcccacccugcuccacccacugggcccccccaguuauugauaccccucugugcu

SEQ ID NO: 295841 - RNA, 64 nt, Human
agcuccccagccuggcguagagcaccccuccccucccccccaccccccuggagugcugcccucu

SEQ ID NO: 295842 - RNA, 64 nt, Human
ggcauuaaaacguugcaaauuccuuuacuguuaucccccccaccaccaggaccauguagggugc

SEQ ID NO: 295843 - RNA, 64 nt, Human
uccauggcccugucccaggccggcccagaugugucccccccaggccuuguccuacguccaaggu

SEQ ID NO: 295844 - RNA, 64 nt, Human
aaagggcuggcucccccuccccaggcuggagacccccccccaacuccaggaaagagcagucaga

SEQ ID NO: 295845 - RNA, 64 nt, Human
uccagugacacguggacaaaugcgggcucaucagcccccccagagagggucaggccgaacccca

SEQ ID NO: 295846 - RNA, 64 nt, Human
uccuggugccccagacgggggccgagggccugagcccccccaucccuccucugccaggguuucu

SEQ ID NO: 295847 - RNA, 64 nt, Human
uaaccagugccuuuccuccccacuggagggcaagcccccccacccacccaggauguccuggcuc

SEQ ID NO: 295848 - RNA, 64 nt, Human
uugcaauuuaugcuuuucgccuggcaguuauuuucccccccaagcuauccuguuucagauaaua

SEQ ID NO: 295849 - RNA, 64 nt, Human
acuauuuuaaaaugucaacaauauggagaauaaccccccccaacacaccuauaaaaacccaaau

SEQ ID NO: 295850 - RNA, 64 nt, Human
aucucuguggcccugagacaccagggaaaaucuccccccccacaggacauacuaguucccuggc

SEQ ID NO: 295851 - RNA, 64 nt, Human
uuggaggaacagaaacaccagcugcucccucacccccccccaugccuuccuggucccucugugc

SEQ ID NO: 295852 - RNA, 64 nt, Human
gagcguucagggggucccugagauaguuuagaugcccccccaucuuagaccucagcucccacag

SEQ ID NO: 295853 - RNA, 64 nt, Human
agacagcaucagaugcagcagugcccaccgcccccccccccaccccccgcccugcccacagagc

SEQ ID NO: 295854 - RNA, 64 nt, Human
agacugcccccuucccuccagcggcacuccaagucccccccauguuggaaagaggaacagggcu

SEQ ID NO: 295855 - RNA, 64 nt, Human
uugguguuccucaguagcuuuacuuucuuccuuucccccccaaaugguugcguccuuugaaccu

SEQ ID NO: 295856 - RNA, 64 nt, Human
ggagcccgaugcaugugggucagggaucugggggcccccccagcuggcgggaaccccaaaugga

SEQ ID NO: 295857 - RNA, 64 nt, Human
agaaccucgcccaucccccccgcggcuccuggcucccccccacuccccucgcucccccuccccc

SEQ ID NO: 295858 - RNA, 64 nt, Human
aagcugacccugcuggccaggcaaggggccagaccccccccaacccccagcugccaucgcucuc

SEQ ID NO: 295859 - RNA, 64 nt, Human
cauguccuccaaggcaaaguuuggcaaacuguggcccccccacugucauauuuuguuaauaaaa

SEQ ID NO: 295860 - RNA, 64 nt, Human; identical to SEQ ID NO: 295859

SEQ ID NO: 295861 - RNA, 64 nt, Human
guugggggcgggcaggcaggaggcccucccuccacccccccacccucagcccggcaacuucugg

SEQ ID NO: 295862 - RNA, 64 nt, Human
cacuggcucucccuuucuucugagacacauccagcccccccacgucucccucauauacacagac

SEQ ID NO: 295863 - RNA, 64 nt, Human
aggacuuuuuuguuuuuugcacuucgcuguguuucccccccaucuuuaaaaauaauuaguaaua

SEQ ID NO: 295864 - RNA, 64 nt, Human
ccuggccucucaucaggaucugccccccagagaccccccccagacacugcagggccuggugaug

SEQ ID NO: 295865 - RNA, 64 nt, Human
cuauagcaaagggcuccuugauucauaagcaccucccccccaaaaaaaccaaauugguaaaaau

SEQ ID NO: 295866 - RNA, 64 nt, Human
aauuacuugugaucauucugaagugccaaaggagcccccccauuccugggccuuucugagggca

SEQ ID NO: 295867 - RNA, 64 nt, Human
cugcagguagcaccaucuggcuggaggggggcaccccccccauggaugcccuucaggugaguuu

SEQ ID NO: 295868 - RNA, 64 nt, Human
aacuggacucucugggggcaggugccaagauuugcccccccaguggcccugggcugggccuggc

SEQ ID NO: 295869 - RNA, 64 nt, Human
ccaccaccugcacugccccccacauucucccagccccccccaaggacccccucuccuugacccc

SEQ ID NO: 295870 - RNA, 64 nt, Human
guugaggcacagccugugcagagagggugggucacccccccagauccaaggagaaacugcaggu

SEQ ID NO: 295871 - RNA, 64 nt, Human
acauuugucucaccccugauauugguuccugaugcccccccaacaaaaauaaauaaauaaauua

SEQ ID NO: 295872 - RNA, 64 nt, Human
ugcuauacaaacauuuugcuaagucugcccaaagcccccccaaugcauuccuucaacaaaauac

SEQ ID NO: 295873 - RNA, 64 nt, Human
uccuauuucacccccuucuuccugucacaugacccccccccauguuuuauuaaagggggugcug

SEQ ID NO: 295874 - RNA, 64 nt, Human
cccggcccuucccucacuuccauccaucucuagacccccccaaggcuuucugugucgcugcccc

SEQ ID NO: 295875 - RNA, 64 nt, Human
ccucuccaacccccaaacugcugcugcggggaaccccccccaccccgccuucagagcccucccc

SEQ ID NO: 295876 - RNA, 64 nt, Human
agugccacggggaaggggaguagggaugucuuuucccccccagcagugaugaguggggcuagcu

SEQ ID NO: 295877 - RNA, 64 nt, Human
gaacggcaagaaaggaauggacccuguguguggccccccccaccccuggcggcugggugauccu

SEQ ID NO: 295878 - RNA, 64 nt, Human
uucccagcgacacuaccuggggcucaggccuggacccccccaguucacgguugcuccugggagc

SEQ ID NO: 295879 - RNA, 64 nt, Human
gcagagggcgccugaaguagggucccgccccccccccccccauucagacacauggauguugggu

SEQ ID NO: 295880 - RNA, 64 nt, Human
aguccauguguaccccgcucaccacgggaacggccccccccaaccacaggcaucaggcaaccau

SEQ ID NO: 295881 - RNA, 64 nt, Human
ggcuggggacccagacuuuuggccccagcgcuggcccccccagccccacacccuauaucuccgu

SEQ ID NO: 295882 - RNA, 64 nt, Human
aggaguggcccuccagguggcagcacuaaggacacccccccacaacaagaguuagcagcgaggu

SEQ ID NO: 295883 - RNA, 64 nt, Human
ugugauggcacguguucacacacccuccuguguacccccccagggucaccgaaguccccacacg

SEQ ID NO: 295884 - RNA, 64 nt, Human
caggagccccacccccaugcagccucuuccccaccccccccaccacgugcucaaucaugaguac

SEQ ID NO: 295885 - RNA, 64 nt, Human
agguugcuacugugcaaugcauaccuccucaacacccccccacacucaguaaagaauuuuccaa

SEQ ID NO: 295886 - RNA, 64 nt, Human
uguaugcaaaugacacugcagagcauuguuuucucccccccacguaggagauuuuauucaacua

SEQ ID NO: 295887 - RNA, 64 nt, Human
cugcacccuccaaccucccauuggcucgcucccccccccccaccgugcccuccaucacgcccug

SEQ ID NO: 295888 - RNA, 64 nt, Human
ugagcagugacggauaguuuagcuuacuauguuucccccccaauucaaugaucuauaacaacag

SEQ ID NO: 295889 - RNA, 64 nt, Human
cugugcccuugagcccuccaccccuggcccaagacccccccaaacugucugacucuguguuucc

SEQ ID NO: 295890 - RNA, 64 nt, Human
cuugaugucagacagcugugacccuggacagggccccccccaccaucuguaaaacggggacagu

SEQ ID NO: 295891 - RNA, 64 nt, Human
gugccccauucuuuuguaauuuaaauggcugcaucccccccaccucucccugacccuguauaua

SEQ ID NO: 295892 - RNA, 64 nt, Human
ucacugccauacauuagaaaugagacaaucaaagcccccccaggguggcacacccaucuguuug

SEQ ID NO: 295893 - RNA, 64 nt, Human
cuaccccaguuccaucuguaguccuaaccaggagcccccccauggaacugcagcccccugucuc

SEQ ID NO: 295894 - RNA, 64 nt, Human
aauagaacauagcaaagcaaagacagaaugcccccccccccaaauauuguccugucccugucug

SEQ ID NO: 295895 - RNA, 64 nt, Human
uccugagccauugcagggggcagggaaguucacccccccccaccacccccccgcccccccgaag

SEQ ID NO: 295896 - RNA, 64 nt, Human
auugacucaauaagugagucuuggauuuagcaggcccccccaccuuuuuuuuuuguuuuuggag

SEQ ID NO: 295897 - RNA, 64 nt, Human
cuagugcccagguccccaucuccaugucccgggucccccccagccugcucuagcugcccaccgc

SEQ ID NO: 295898 - RNA, 64 nt, Human
aggcuggaagagaagagacagaaagaccccaugacccccccauguggauccccaucugugucuc

SEQ ID NO: 295899 - RNA, 64 nt, Human
agacagguaugagaggcuguccucgucuuugauucccccccaaccccaccucgggccucacgac

SEQ ID NO: 295900 - RNA, 64 nt, Human
uuuacuaugauuguguaugugccgcuaccaccaccccccccauggggggguggagaggggugca

SEQ ID NO: 295901 - RNA, 64 nt, Human
ugcacuccagccugcggacagaccaagacuucaucccccccaaaaaaaaaagauuggaggugau

SEQ ID NO: 295902 - RNA, 64 nt, Human
ccucccggcacucccuaaaugaucucuccuuccccccccccaccccgagauacgggguuccagg

SEQ ID NO: 295903 - RNA, 64 nt, Human
ccagagccaggggggugaggagcuggggaucccucccccccaugcacugugaaggacccuuguu

SEQ ID NO: 295904 - RNA, 64 nt, Human
aaccccugaggcuccaccacccacccuuucauuucccccccagaagccuaaggccuaauagcug

SEQ ID NO: 295905 - RNA, 64 nt, Human
gaccccacagaguuaaaacuugggauuccccuggcccccccagaacacuuguauauuguuuguu

SEQ ID NO: 295906 - RNA, 64 nt, Human
gggaggggagagaggugggggcaagggggaaaugcccccccaucuccuuggaggcaguggugug

SEQ ID NO: 295907 - RNA, 64 nt, Human
cucccaucagaacccugccugcccaccugcaacucccccccaacaaugccauucccacuugccc

SEQ ID NO: 295908 - RNA, 64 nt, Human
agcgcgcuguugauuguguuuuccuuguuuucagcccccccacuccagcccgcagcacauuucc

SEQ ID NO: 295909 - RNA, 64 nt, Human
agaccugacaauuugugauaucuaauaauaaccccccccccaauauugauuaagccuccuccuu

SEQ ID NO: 295910 - RNA, 64 nt, Human
auaauuuauuuuucuacacuucaauaugaacugccccccccacauuaauauaaaaacuacuaau

SEQ ID NO: 295911 - RNA, 64 nt, Human
cugguaguccauuaaauucuccugucuagaaugacccccccaccaguacuugaccaauuucaug

SEQ ID NO: 295912 - RNA, 64 nt, Human
aagguaguugcuaugguccgaauaucugggccugcccccccaaauuaugcugaaaccuaaucac

SEQ ID NO: 295913 - RNA, 64 nt, Human
uuggugucacuucuuuucugcuaucccccagccccccccccaaaauccucauguuucugcuuca

SEQ ID NO: 295914 - RNA, 64 nt, Human
cucaucucccaaaucccaaaugccacuccaaguacccccccagauaccaugucaggauauuuuu

SEQ ID NO: 295915 - RNA, 64 nt, Human
gguggcaccucuccaccuguacccgcccccccaccccccccaccccugccccuuggaagaguug

SEQ ID NO: 295916 - RNA, 64 nt, Human
ccucuucccgguggcaccucuccaccuguacccgcccccccaccccccccaccccugccccuug

SEQ ID NO: 295917 - RNA, 64 nt, Human
gggauaccccaccccgccccgcccugcccgcccccccccccaccaguccugcccccgcauggag

SEQ ID NO: 295918 - RNA, 64 nt, Human
uaauaagguuuuauuuugauuguguucguuuccccccccccaauaguaaaauuucuccuccuuu

SEQ ID NO: 295919 - RNA, 64 nt, Human
ucccugucugggucacuuuuuaagcuuguaaccgcccccccagacuuauaaucuuaaauguauu

SEQ ID NO: 295920 - RNA, 64 nt, Human
caagugccagaggugggcaggugguggcacugagcccccccaacacugugcccugguggagaaa

SEQ ID NO: 295921 - RNA, 64 nt, Human
cgacugggaauccuagggggcuccaugacaccuucccccccagacccagacuugggccguugcu

SEQ ID NO: 295922 - RNA, 64 nt, Human
ugugacuuugggcaaaucauuucacuccucaaagcccccccacacaagcuggauucccacuucu

SEQ ID NO: 295923 - RNA, 64 nt, Human
ccccaguccuuuccuacuccagaaaugcuccccacccccccaaagagggaaaagcagauaaccc

SEQ ID NO: 295924 - RNA, 64 nt, Human
ugccugcauccacgcuacugcccccugccccccgcccccccaguuuguacgguugcaacagugu

SEQ ID NO: 295925 - RNA, 64 nt, Human
uccucccucuccagcgaccaaagcuuccccggggcccccccagccugcaagacaggugaguggc

SEQ ID NO: 295926 - RNA, 64 nt, Human
gccuguaucugcugucccuccccugccccccugccccccccaccgccuucccuuuuucccuguc

SEQ ID NO: 295927 - RNA, 64 nt, Human
uggcccacuaggagggcuggcccuaagauacagacccccccaacuccccaaagcggggaggaga

SEQ ID NO: 295928 - RNA, 64 nt, Human
auuacaaccuuuuccuuaaggucuuuuaccaccucccccccaaaaaaaucccccaaaacugauu

SEQ ID NO: 295929 - RNA, 64 nt, Human
gccacagugccuggccucuucccucuccccaccccccccccaacuuuuuuuuuuuuuuauggca

SEQ ID NO: 295930 - RNA, 64 nt, Human
ugucguuuuauacuuugcuagguagacuuuauuacccccccacuaugcccucauuuuuuuaaaa

SEQ ID NO: 295931 - RNA, 64 nt, Human
ccaggcuggucucgaacuccugaccucaggugaucccccccaccucagccucccaaagugcugg

SEQ ID NO: 295932 - RNA, 64 nt, Human
cagccgaggucccugcugccagcuucaggugacccccccccaucccccggcaccucccuugggc

SEQ ID NO: 295933 - RNA, 64 nt, Human
acaccccgaggagggagggcuccuuucuagccugcccccccacccccacuucaccccuccccag

SEQ ID NO: 295934 - RNA, 64 nt, Human
cuuccccgccacacccgcucugucuucccacugucccccccaucccgggcagggcccaguggga

SEQ ID NO: 295935 - RNA, 64 nt, Human
acgcaagggccugaugggguggaaggcauggcggcccccccagcugucaucaauuaaaggcaaa

SEQ ID NO: 295936 - RNA, 64 nt, Human
uucugugggcauggccgcuucuagagccucgacacccccccaacccccgcaccaagcagacaaa

SEQ ID NO: 295937 - RNA, 53 nt, Human; identical to SEQ ID NO: 223846

SEQ ID NO: 295938 - RNA, 52 nt, Human; identical to SEQ ID NO: 223847

SEQ ID NO: 295939 - RNA, 64 nt, Human
ucuuugcuucuuuuuuuucuuucuuguuuuucuucccccccaccccccacccccuucgguuaac

SEQ ID NO: 295940 - RNA, 64 nt, Human
cugcuucagagccaagacuaggccaggguggggacccccccaguacccucccuacaucaaugug

SEQ ID NO: 295941 - RNA, 64 nt, Human
accagaccaggccuaaagcccaccccuacccucacccccccaauccucuccugaaacuuaaaaa

SEQ ID NO: 295942 - RNA, 64 nt, Human
gacuguucuuaggccugaaaaggggcugggcacccccccccaccaaggauggacgaagaccccc

SEQ ID NO: 295943 - RNA, 64 nt, Human
cccccgcacaccucccucagcaccaagaccgggacccccccacccacgugucucauuguggcug

SEQ ID NO: 295944 - RNA, 64 nt, Human
aacucugggaaggagguugugauugcuggcaagucccccccaacuguaccacgggcaugaggag

SEQ ID NO: 295945 - RNA, 64 nt, Human
uaacuagguuuuugcuucuccaguggugaccacccccccccauccccgcucacaacuuggguuc

SEQ ID NO: 295946 - RNA, 64 nt, Human
aucugggccuuugaacaacuggggggcguuuucucccccccauugggacaccagucuucggugu

SEQ ID NO: 295947 - RNA, 64 nt, Human
gaauuuuauuaaaugugacgaacugccccccccccccccccagcaggagagcagcaaaauuuau

SEQ ID NO: 295948 - RNA, 64 nt, Human
uugagggacaccucuaacaucucggcccccugugcccccccagccccuucacuccucccggcug

SEQ ID NO: 295949 - RNA, 64 nt, Human
gagacagagagcuccucccuggguugucuguggacccccccaggagcugcuaauuggcagcacc

SEQ ID NO: 295950 - RNA, 64 nt, Human
ggaaaaaggcuaaauccacccuuaccccuccugacccccccaaguggagggaacagauccuggc

SEQ ID NO: 295951 - RNA, 64 nt, Human
ggagagaaggggcagagcugggggcugagggagacccccccacaccccuucucuccuuccucuc

SEQ ID NO: 295952 - RNA, 64 nt, Human
uuuggggguauuuuguuuuuguucucaccugcugcccccccaccccaccaccccagggauaaau

SEQ ID NO: 295953 - RNA, 64 nt, Human
uggcucugcucauccagaggauauucccccaucccccccccaucaaguuuggugggcagagcua

SEQ ID NO: 295954 - RNA, 64 nt, Human
caucaucagacuugcggccacagcacuagagucacccccccaggccuccagaaccuuacuggca

SEQ ID NO: 295955 - RNA, 64 nt, Human
acuuccuggaaggaggaugcagacuuccagagagcccccccaacggacgugcugagaagggaga

SEQ ID NO: 295956 - RNA, 64 nt, Human
gguucugagcccuggcugcuuguccuccucgcaacccccccaggccggagcuuccuuccuuagc

SEQ ID NO: 295957 - RNA, 64 nt, Human
guggcacgccugccccaggaugcccccuuucccucccccccaugcccagagccccgccugccuc

SEQ ID NO: 295958 - RNA, 64 nt, Human
acccccgggauccugcccccaagucauuuccguccccccccaggcccucccaccaccccauuuu

SEQ ID NO: 295959 - RNA, 64 nt, Human
ccagcuccacacauuccagccaggcccaggccagcccccccacccacccccaggccuccuaggg

SEQ ID NO: 295960 - RNA, 64 nt, Human
agccggagcuggcagcauacccagagauccggggcccccccacccccaaaucacgagugcagcu

SEQ ID NO: 295961 - RNA, 64 nt, Human
cacuucuaauguuaagugggguacagaucagcugcccccccacguagccuggacaucgucuuau

SEQ ID NO: 295962 - RNA, 64 nt, Human
uucggcgccaaaggugacccgcgccaaccucccucccccccagugccuaugacggcggcacagc

SEQ ID NO: 295963 - RNA, 64 nt, Human
agccacacugcccuguuugcugccaugaggcccccccccccagcaauaucccaggggcgggccc

SEQ ID NO: 295964 - RNA, 64 nt, Human
acacuugugcaccugucuuacauucucuguugcucccccccacacucuugcucagucugucacc

SEQ ID NO: 295965 - RNA, 64 nt, Human
gugaggggcuuucucuuccccuuccuguuucagacccccccauuucccgcacaugguguggggg

SEQ ID NO: 295966 - RNA, 64 nt, Human
uuuauagaaaugacaauagagggccacggggaggcccccccagaagcaagauucaaaucucuug

SEQ ID NO: 295967 - RNA, 64 nt, Human
aaagucacccucgcgggcugggccuuccacgcaucccccccaccccccauggaacagaaagcca

SEQ ID NO: 295968 - RNA, 64 nt, Human
ggagggaaucacuggugcuauagaaauugagaugcccccccaggccagcaaauguuccuuuuug

SEQ ID NO: 295969 - RNA, 64 nt, Human
ccagcuccucuuggagaagcuguugcugagaccccccccccaagucaaucagaaccacaacagg

SEQ ID NO: 295970 - RNA, 64 nt, Human
gggcuaagacaaaguauauuaauaagcuuuucagcccccccacucccguuccguaguguagaag

SEQ ID NO: 295971 - RNA, 64 nt, Human
ccagccucagcugagucuuuuuggucugcacccacccccccacccccccccccccgcccacaug

SEQ ID NO: 295972 - RNA, 64 nt, Human
uuucugucucagcgggcagugcccagagcccacgcccccccaagagcccucgauggacagccuc

SEQ ID NO: 295973 - RNA, 64 nt, Human
gacugacggacggacgacggacaggcggaugugucccccccagccccuccccuccccauaccaa

SEQ ID NO: 295974 - RNA, 64 nt, Human
caaaccuuuucauuggaaaaacagaaacaacccucccccccauuuuuuccccucuauucaucaa

SEQ ID NO: 295975 - RNA, 64 nt, Human
uuuauuuacccaaguguucagcuuauucaccccacccccccaccccccaucacacgugcuccug

SEQ ID NO: 295976 - RNA, 64 nt, Human
cccugccagcacucccccuucaccccacacccggcccccccaccuaaccacagcgccucuccag

SEQ ID NO: 295977 - RNA, 64 nt, Human
cugcaggccacgcccagcuuccuccccccgacuccccccccagagacacggucccaccauguua

SEQ ID NO: 295978 - RNA, 64 nt, Human
cacccuuuccugucgggaagggagaggggaacuacccccccagccugcccuccgccccgcccca

SEQ ID NO: 295979 - RNA, 64 nt, Human
gaugcagacaaaaucucaccuggcaggcccaacccccccccaccccucccccgccguguguggc

SEQ ID NO: 295980 - RNA, 64 nt, Human
caaacaaaaaauacaauaaauauuugaacccccucccccccagcacaacccccccaaaacaacc

SEQ ID NO: 295981 - RNA, 64 nt, Human
aauaaauauuugaacccccucccccccagcacaacccccccaaaacaacccaacccacgaggac

SEQ ID NO: 295982 - RNA, 64 nt, Human
cacuccggcuccucuuuucauccccccccuuccccccccccaacaagggggacaugguggaggg

SEQ ID NO: 295983 - RNA, 64 nt, Human
gggaguggggccugagcugagcacugcccccucacccccccaccaccccuucccauuucaucgg

SEQ ID NO: 295984 - RNA, 64 nt, Human
auuuauucuuuccauucauuccaucugggaggaacccccccaacuccugccagcuuccccuagc

SEQ ID NO: 295985 - RNA, 64 nt, Human
guccuguccccgagccccugcagguccccccccgcccccccacucaagaguuagagcagguggc

SEQ ID NO: 295986 - RNA, 64 nt, Human
auuggcaauuguccccagggacaaaacacugugucccccccagugcagggaaccgugauaagcc

SEQ ID NO: 295987 - RNA, 64 nt, Human
uccccacccccucggggcagaguuugcacaaagucccccccauaauacagggggagccacuugg

SEQ ID NO: 295988 - RNA, 64 nt, Human
ugccucuccauccuccgaaaaaccccugaggacccccccccauccucuucuaggaugaggggaa

SEQ ID NO: 295989 - RNA, 64 nt, Human
aacaauuugguaacacaccacaggaaguagcucucccccccagcccccuccucccucaagggag

SEQ ID NO: 295990 - RNA, 64 nt, Human
ccaccacucccccacccugaccgugcugaacagacccccccacacgagagaaaauaaaggagca

SEQ ID NO: 295991 - RNA, 64 nt, Human
agagcccgaggggcaccccagccccgccucugcucccccccaccccacccacccucggggcgcc

SEQ ID NO: 295992 - RNA, 64 nt, Human
cccaccuaugacucagggcccaccacaccccacccccccccaacuggcugaaccccuggcaggc

SEQ ID NO: 295993 - RNA, 64 nt, Human
accggggugacagaugagguccucuguuuaccuccccccccaaaaaaaaaauucaguaggaauu

SEQ ID NO: 295994 - RNA, 64 nt, Human
auuucaucuacuucugaaguugauagucuucccccccccccacuuuuuucuuuuuugagacagg

SEQ ID NO: 295995 - RNA, 64 nt, Human
ccuggacuaggcccugcuucagugcccaccugggcccccccagggaccuggaaacagugcuggg

SEQ ID NO: 295996 - RNA, 64 nt, Human
uuuuuuauuuaagagguggggucccaggugggaacccccccacaauaaagucugucaauguuug

SEQ ID NO: 295997 - RNA, 64 nt, Human
gggugcucugggguccuugacacacauaaaggugcccccccaccuuccaccucuuagcacuggu

SEQ ID NO: 295998 - RNA, 64 nt, Human
cuucuggaaacugugaagaucucacucugccccccccccccaucuucgggaccaggauuugcac

SEQ ID NO: 295999 - RNA, 64 nt, Human
auggugauagcauuucagugacaucuucuuuggccccccccauuaggugcugugcccacuucuu

SEQ ID NO: 296000 - RNA, 64 nt, Human
acuuccuucuagggagcacccucccaccccccaccccccccacacacaccaucuuuccauccca

SEQ ID NO: 296001 - RNA, 64 nt, Human
ugggggguuagggggagucccccucccucccuuucccccccaagcacagaggggagaggggcca

SEQ ID NO: 296002 - RNA, 64 nt, Human
cacacuccauggagucuggaaugcaugggagcugcccccccaguggacaccauuggaccccacc

SEQ ID NO: 296003 - RNA, 64 nt, Human
gguccaccucaguuuucuaaaggucaaauuaaggcccccccaaaaauacaguauguagcugaau

SEQ ID NO: 296004 - RNA, 64 nt, Human
cagguaaucaugaauauuuucaaggacuuccccccccccccacuucacccccuaccauugaggg

SEQ ID NO: 296005 - RNA, 64 nt, Human
agccgcagccccaggccaucaucugcugcuggggcccccccaccacgcggugccaggcccagug

SEQ ID NO: 296006 - RNA, 64 nt, Human
gggugguaccaaaaugcauccccaugacccacagcccccccacacccguccuuggguaggguac

SEQ ID NO: 296007 - RNA, 64 nt, Human
cgacagccuugcaggcugggcucagggacaaagucccccccaaaacccgcagguccucaugucc

SEQ ID NO: 296008 - RNA, 64 nt, Human
cccaaccggcgggggggugucucccugcccccgacccccccauacccccuucucugugacacac

SEQ ID NO: 296009 - RNA, 64 nt, Human
ccggcgggacccccagggaccaccccucagggcgcccccccacccccgcccgguccaccuagac

SEQ ID NO: 296010 - RNA, 64 nt, Human
agagacagagagagagaaaaaaaaucacccaccacccccccaaaaacacaaaaaaagaaaaucu

SEQ ID NO: 296011 - RNA, 64 nt, Human
gggggucuccgaggugccgguuaggaguuugaaccccccccacucugcagagggaagcggggac

SEQ ID NO: 296012 - RNA, 64 nt, Human
ugcaccauuuccgaggacgacgcagccccucgagcccccccaccggccccggccgccccagcga

SEQ ID NO: 296013 - RNA, 64 nt, Human
aaugagcuucuaacucagagcugaugaacaaaagcccccccacccccaaugccugccuccucac

SEQ ID NO: 296014 - RNA, 64 nt, Human
aggcuccagagagggggcaccuccccacacaccccccccccaccgaggccuaggccccugccac

SEQ ID NO: 296015 - RNA, 64 nt, Human
caccuuggcgucacggugggcuggaggcagcccccccccccacaacacuugaggccaaaggaca

SEQ ID NO: 296016 - RNA, 64 nt, Human
cagcaggggcccauucagucccagggagcagagacccccccaaccccuucacaaaccccaacac

SEQ ID NO: 296017 - RNA, 64 nt, Human
caccccaggccuaggccugggccugggcuggggucccccccacugccagcugcaaggaaccagc

SEQ ID NO: 296018 - RNA, 64 nt, Human
ucuuuauaaacgaggcaaaagcauuuaauucccacccccccaccccccgcucccuucugcuccu

SEQ ID NO: 296019 - RNA, 64 nt, Human
ugccugauucucuggggggggccucaguaaugggcccccccaaccccuuucucugguacagugc

SEQ ID NO: 296020 - RNA, 64 nt, Human
ucuccucccaucuccuccucuucccucuccuccucccccccaacuccugaccucagcuuggugu

SEQ ID NO: 296021 - RNA, 64 nt, Human
uuugcccccaaagucucccuuccccuagugaccccccccccacuucaccccaugucccagagcc

SEQ ID NO: 296022 - RNA, 64 nt, Human
gguugaccucagaggccuaagcaacuggggccaucccccccauuagaggggcccccaaaacuug

SEQ ID NO: 296023 - RNA, 64 nt, Human
gaaucuucuggaggagccucccuccccccccacccccccccacugcuccuggaguucucaucgg

SEQ ID NO: 296024 - RNA, 64 nt, Human
cccguccuuagaaucuucuggaggagccucccuccccccccacccccccccacugcuccuggag

SEQ ID NO: 296025 - RNA, 64 nt, Human
aucuggacagaggaagaugggagggugcucaucacccccccagcauaaugaucagccuccuucc

SEQ ID NO: 296026 - RNA, 64 nt, Human
gccugcaguggacuggccccuuaauucccacaggcccccccagcaaggccaaagggaggccccu

SEQ ID NO: 296027 - RNA, 64 nt, Human
cuggacagugaugaggucuugccgccuuaacugucccccccagucacuucucccacaggcccag

SEQ ID NO: 296028 - RNA, 64 nt, Human
caccuuguuucauuuguaaaaggaaauacagaaacccccccaagaaugugugagggucuugagg

SEQ ID NO: 296029 - RNA, 64 nt, Human
caggugccagucaucugugaagcuagggcgccuacccccccacccggaggaccccugcggcccc

SEQ ID NO: 296030 - RNA, 64 nt, Human
ccccacucaggggaccccacuccccucacacacacccccccacaaggaacccucaggccacccu

SEQ ID NO: 296031 - RNA, 64 nt, Human
cacccacccaaagaguccccacuuaacaauaccccccccccacggcaagaaugcccaaauccga

SEQ ID NO: 296032 - RNA, 64 nt, Human
cacauuuuauccuaauaucgguagcauauaaugccccccccaaaauaucuguuuuccaugcaaa

SEQ ID NO: 296033 - RNA, 64 nt, Human
ucuugcuucuaauagcccugguacaugguacacacccccccaccuccugcaauuaaacaguagc

SEQ ID NO: 296034 - RNA, 64 nt, Human
uauugcugggagcuggcuucugucccuuucuucccccccccacgagucuugcccuugacuucug

SEQ ID NO: 296035 - RNA, 64 nt, Human
uugggagacaaagggguagagggucugucuugggcccccccagacucuagccugagcagugcag

SEQ ID NO: 296036 - RNA, 64 nt, Human
cccccaccaguauggccccaccugcucuuuccuccccccccaagguguggccccaccuguucuu

SEQ ID NO: 296037 - RNA, 64 nt, Human
gcaaggugccaggacugggagggaaaguccagggcccccccacccuccccaccacccuccgcca

SEQ ID NO: 296038 - RNA, 64 nt, Human
gccccaugaggguguuuuuuuuuuuucuuuuugucccccccaucccccuuuuuuuuuguuuugu

SEQ ID NO: 296039 - RNA, 64 nt, Human
gcuggggagggaggacccucggggcuaccgcgcgcccccccaucccacagaucaggagccaagg

SEQ ID NO: 296040 - RNA, 64 nt, Human
auuuauucauccuauauacaucaggcuguaagaccccccccagucaucauuaauacaauguguu

SEQ ID NO: 296041 - RNA, 64 nt, Human
ccuaaagauaucuuuuuagaugauaaaauguacacccccccaucaccaaccucacaacuuagaa

SEQ ID NO: 296042 - RNA, 64 nt, Human
gccauacucuuguggucucugugcgccccccccccccccccacccgucugccaagcauggguau

SEQ ID NO: 296043 - RNA, 64 nt, Human
auugucccccugccccaggccccgggaucagcugcccccccauccccgcucccgccgcuacucc

SEQ ID NO: 296044 - RNA, 64 nt, Human
ccgcccaccgcugcccugucuguugcgacacccucccccccacauacacacgcagcguuuugau

SEQ ID NO: 296045 - RNA, 64 nt, Human
cugaccuuuuccucguccacccugggcuuggggacccccccaccggacucuccacucuccggca

SEQ ID NO: 296046 - RNA, 64 nt, Human
uaauaaaauagaaaaaucgcgcacuugcgcgucccccccccacccccuuuuuuaaacaaguguu

SEQ ID NO: 296047 - RNA, 64 nt, Human
aagggcgguccccauccugggcccccacucuagacccccccaccaccugguuaagucucgagug

SEQ ID NO: 296048 - RNA, 64 nt, Human
ccccugcaccucucagccucugccgccgggcacccccccccaggcuccuggugccagaugauga

SEQ ID NO: 296049 - RNA, 64 nt, Human
cccagccaagccugacuuuggggacacccuccugcccccccaccccacuccccccauccuaccu

SEQ ID NO: 296050 - RNA, 64 nt, Human
aggccugagugggaguggggggccuugcuccacccccccccauccccuacugugacuugcuuua

SEQ ID NO: 296051 - RNA, 51 nt, Human; identical to SEQ ID NO: 223960

SEQ ID NO: 296052 - RNA, 64 nt, Human
uacaggagaagaaacagcagcuccacuaccgacccccccccagguuugauguccuuccaagaau

SEQ ID NO: 296053 - RNA, 64 nt, Human
cacuuucuucuuaacuuuacuucucuuuuugucccccccccaucuuacagaaguugaggccaag

SEQ ID NO: 296054 - RNA, 64 nt, Human
cugaacagaccacugcaucucacugggccagcagcccccccagcccccagccuugguggggacc

SEQ ID NO: 296055 - RNA, 64 nt, Human
ucaagggcagugggaucucgauggagccuccccccccccccacccaugccucccucuuccuccu

SEQ ID NO: 296056 - RNA, 64 nt, Human
uucaaggcccuuccugucuuggccggccccacugcccccccauucuaugccccaaccaccaagg

SEQ ID NO: 296057 - RNA, 64 nt, Human
auaaaacaucacauuuuggugucucucaggcuuucccccccaacuaugguuucuuugcuuuuug

SEQ ID NO: 296058 - RNA, 64 nt, Human
uccagccugggcaaacagagggagacuccaucgccccccccaacaaaaaaaaaaguuucccaua

SEQ ID NO: 296059 - RNA, 64 nt, Human
ccucucaggggagaccaugguggccccggccgcacccccccacccuggugccaccacugcaacu

SEQ ID NO: 296060 - RNA, 64 nt, Human
caauuccuugggcuucuccugagguaaugauuuacccccccacccacagcugagucugugaggc

SEQ ID NO: 296061 - RNA, 64 nt, Human
aagucuauuaggucaguuuagcaagaacaccuaacccccccauaucuguucaaccucaguaucu

SEQ ID NO: 296062 - RNA, 50 nt, Human; identical to SEQ ID NO: 223971

SEQ ID NO: 296063 - RNA, 64 nt, Human
agacagcacagcgaagacugcuaaaugcacugaccccccccauuagaaugugauuuuuguuccu

SEQ ID NO: 296064 - RNA, 64 nt, Human
ccccaggcuuugccucagggccuuuagccuaugucccccccacauaaagagagcuucucagagc

SEQ ID NO: 296065 - RNA, 64 nt, Human
uuucagugauguggcaugcguuuuuuuuuaacugcccccccagcccugacauguucuuuuuuug

SEQ ID NO: 296066 - RNA, 64 nt, Human
aggugggggcgggggaaaugggggaaugacacaucccccccaaccuacccccaccccaaaagca

SEQ ID NO: 296067 - RNA, 64 nt, Human
aggaaugucccagugagguuaccacuuaaaucuucccccccaccccccacccuuuugcugauug

SEQ ID NO: 296068 - RNA, 64 nt, Human
ggcguaauggaaaaucagcucaaaugagaucaggcccccccaggguccacccacagagcacuac

SEQ ID NO: 296069 - RNA, 64 nt, Human
uuccucugggcauccuggaucccugaauuauccccccccccaugaaguacuucaagggccaagc

SEQ ID NO: 296070 - RNA, 64 nt, Human
cccacuguaguggccuuuggagaugcccccaccucccccccaccaacucucgcguguuggagag

SEQ ID NO: 296071 - RNA, 64 nt, Human
aagaccagccugggcaacauagugagacgccccccccccccaucucuacaaaaaauuuaaaaaa

SEQ ID NO: 296072 - RNA, 64 nt, Human
ggcagagaggggcaggcuugggcaccccuucugccccccccacugagaacuaugcaauggaguu

SEQ ID NO: 296073 - RNA, 64 nt, Human
cgcugcacgccucugggcccccuggcacagccaacccccccagugcaaaccccaaggccaagcc

SEQ ID NO: 296074 - RNA, 64 nt, Human
ucaaacuccuaaccuugugauccgcccuccuuagcccccccaaaaaauuacaauaauuuuguca

SEQ ID NO: 296075 - RNA, 64 nt, Human
gaucccugaucccuuccaccugcucugcugaugacccccccagcuucacuucugacucuucccc

SEQ ID NO: 296076 - RNA, 61 nt, Human
agcugugcccugcugccugagcgucccccuacccccccagggccugcugccuuuugggacu

SEQ ID NO: 296077 - RNA, 64 nt, Human
uugugagguuccauaugauaauucuuuacaccuccccccccaagagaaaguacacagggcuauu

SEQ ID NO: 296078 - RNA, 64 nt, Human
acgcagucuuguaggcagcugccaccuuaugcagugcaucgaaaccuuuugcuuggggaugugc

SEQ ID NO: 296079 - RNA, 64 nt, Human
acaggcugguaaugugcuggccaccuccagcuccugcaucgagucuguaaaccagagcugguuc

SEQ ID NO: 296080 - RNA, 64 nt, Human
auuuagccguuuccuccagauuuucuucuuuaugugcaucgacuugaguguaaacauaacuuau

SEQ ID NO: 296081 - RNA, 64 nt, Human
agaggucaugccugggaggaagggaucgucaugcugcaucgaauccucucuccgccguguggcc

SEQ ID NO: 296082 - RNA, 64 nt, Human
ugccuucuccgcgucauuguuggaagaggagagaugcaucgagcagucccagcugcuuuucauu

SEQ ID NO: 296083 - RNA, 64 nt, Human
agcaggacuaacaacugggaaauaagcaaaaaacugcaucgauccccagccugguguuguucuu

SEQ ID NO: 296084 - RNA, 64 nt, Human
guccccaaaccugcaagggcuccccacugccuacugcaucgagucaaaacucaaaugcuuggcu

SEQ ID NO: 296085 - RNA, 64 nt, Human
uuauagaucagcguuuagucaccuccagguuauaugcaucgagaaccugaauaaaucaugccac

SEQ ID NO: 296086 - RNA, 64 nt, Human
guacccgcaaaacgggacauaguaugugacaaucugcaucgaucauggacuacuaaaugccuuu

SEQ ID NO: 296087 - RNA, 64 nt, Human
uauggcuuucucacuuuuauuuuguagcauggguugcaucgacuuuuuuacuagagaauuuuac

SEQ ID NO: 296088 - RNA, 64 nt, Human
uguauacaaauucuuccuuaagugaaaguuaugcugcaucgaauuguaacugaaaguauagauc

SEQ ID NO: 296089 - RNA, 64 nt, Human
cccccgguguggaaaaggcuaaauaaggugacagugcaucgaugcucccccgcguggccuuugg

SEQ ID NO: 296090 - RNA, 64 nt, Human
aaaugcauguuuagggauggcuaaaauuccaaggugcaucgacauuaacccacucauuuaguaa

SEQ ID NO: 296091 - RNA, 64 nt, Human
uauaugaaaauguacugauuuuuuuuuaauaaacugcaucgagauccaaccgacugaauuguua

SEQ ID NO: 296092 - RNA, 64 nt, Human
ccuauuggaauucgagacuuaauuaaugaagcuuugcaucgagaaacgaugggucugaagucca

SEQ ID NO: 296093 - RNA, 64 nt, Human
acacacaguuacugacuuagccuaaacaaccuggugcaucgaaauguauucaccuuucuuuugu

SEQ ID NO: 296094 - RNA, 64 nt, Human
uguauggaaugguaguacuacauuuuauuuaucaugcaucgauugguggacauuuggaucguuu

SEQ ID NO: 296095 - RNA, 64 nt, Human
aacucuugacaguugccucaagauggagugaaauugcaucgaggguaagacuguguccacaggu

SEQ ID NO: 296096 - RNA, 64 nt, Human
agaacuugcagaguguguauucuuggauggcugaugcaucgacuugcauucccacuuaacacuu

SEQ ID NO: 296097 - RNA, 64 nt, Human
ucagacaacgacugaugaaaacgcccaugcgguuugcaucgacugauaguguguucuuuccggg

SEQ ID NO: 296098 - RNA, 64 nt, Human
ucugcccaacccaagggcccgugcgcuccaacccugcaucgaacugccaacauaguacaccuuu

SEQ ID NO: 296099 - RNA, 64 nt, Human
aaaacugcauggcagauacgugacugccacaauaugcaucgaagacaaacuuacuauaaagaug

SEQ ID NO: 296100 - RNA, 64 nt, Human
uguagccguggaccgaauacgcacucuugaaagcugcaucgagaacccgcccaagcgccaccug

SEQ ID NO: 296101 - RNA, 64 nt, Human
ccugggauaaacugggagaacuauggcagcuacuugcaucgacuuguaccucacuuagcccuug

SEQ ID NO: 296102 - RNA, 64 nt, Human
aucacuguguaaaacuaagugucucuaaauguaaugcaucgauuuagugucuggaacauaauaa

SEQ ID NO: 296103 - RNA, 64 nt, Human
agaaccaggaucucuggagaaacaguugggcuguugcaucgaguaaugucacuggacucggccu

SEQ ID NO: 296104 - RNA, 64 nt, Human
gguccccucagcaucaagcagcccaaccaaggcgugcaucgagccuugcaccucaacaaaaggc

SEQ ID NO: 296105 - RNA, 64 nt, Human
uaaguucuuaaugucaaccaucuuuaagguauugugcaucgacacuaaaaacugaucaguguaa

SEQ ID NO: 296106 - RNA, 64 nt, Human
acagucccugugucucacagcgguaaucguguguugcaucgaugcguuuguggucaccacgaag

SEQ ID NO: 296107 - RNA, 64 nt, Human
ggcugaguggaaaauggugugagccccaccgcugugcaucgaaugagggaaguggcagcagaga

SEQ ID NO: 296108 - RNA, 64 nt, Human
gacacacugguuaaaaauuaaacauaaaagaaauugcaucgauguaaucagaaugaagaccgca

SEQ ID NO: 296109 - RNA, 64 nt, Human
gguccccauuaugggaugcauuaggacuggccuaugcaucgaaaaucuuuuuguuuguaaacgu

SEQ ID NO: 296110 - RNA, 64 nt, Human
gagagugguuuccguuugcagcuacacagcugugugcaucgacguucuccuggggugugugcca

SEQ ID NO: 296111 - RNA, 64 nt, Human
gagaguaacugugcuuggaauagaaaagcccugcugcaucgagacacaaugcuggcagcugcgg

SEQ ID NO: 296112 - RNA, 64 nt, Human
uuguuugauuuuuucuuuuauauuauaaagcaauugcaucgauaaaagcuuggacuccauuuua

SEQ ID NO: 296113 - RNA, 58 nt, Human
ggcaguccuuacaguucugagcagugggcggcugcaagccaaccaauauuuucuguca

SEQ ID NO: 296114 - RNA, 64 nt, Human
uuuauaacuuguguuauuuaaugagucagucaaucggcugcaguaugggaucugauaaggaucu

SEQ ID NO: 296115 - RNA, 64 nt, Human
ucuuaaccuaccuggaagaagccauugagcucuccggcugcaucuaguucugcuguuuagccuc

SEQ ID NO: 296116 - RNA, 64 nt, Human
guguccgugggugugcagugcccagcacgggacccggcugcaggggaccuucaauaaacacuug

SEQ ID NO: 296117 - RNA, 64 nt, Human
agcggagcuaggacccccuccacggccuggaccucggcugcaguaaaguuacgugaggccuguc

SEQ ID NO: 296118 - RNA, 64 nt, Human
cuucaugagucuacaaccuccauuggcccaaagucggcugcaacauugguuauggaguauaagg

SEQ ID NO: 296119 - RNA, 64 nt, Human
gccggcuccucacacaccauggagacuaccauugcggcugcaucgccuucuccccuccauccag

SEQ ID NO: 296120 - RNA, 64 nt, Human
guguguguagcggaaaaggacaagacggugcagucggcugcauacucccagucgggaguguggu

SEQ ID NO: 296121 - RNA, 64 nt, Human
ucgcauucucuucugugaccagccucuaggcuagcggcugcauucguggucugugcaaacacuu

SEQ ID NO: 296122 - RNA, 64 nt, Human
ggcccgggcgcuccuacagcagugccugcacgcccggcugcaaauucgcccagccaauggggac

SEQ ID NO: 296123 - RNA, 64 nt, Human
uauugagagauuugauuuuuauaaaguaaaaauacggcugcauuaggguuacaaacagaaaagu

SEQ ID NO: 296124 - RNA, 64 nt, Human
accccgcagacaccuuggacauccuccucccacccggcugcagaggccagaggcccccagccca

SEQ ID NO: 296125 - RNA, 64 nt, Human
cuccggcagcagagcgcauggugcuagccauggccggcugcagaggacccagugaggaaagcuc

SEQ ID NO: 296126 - RNA, 64 nt, Human
agccggggagcugaggggcagggccguagacucacggcugcaccugcagggagcagcacgccaa

SEQ ID NO: 296127 - RNA, 54 nt, Human
ucuacaaucauuacuccugacacacggcugcaugaccagucccacccccccgug

SEQ ID NO: 296128 - RNA, 64 nt, Human
gucaucgcugagaagaugccaauguuucauccaccggcugcacaggcacaaacucccccaccca

SEQ ID NO: 296129 - RNA, 64 nt, Human
gcuuaauaagucacugacaucagcacugccaacucggcugcaauuguggaccuucccuaccaaa

SEQ ID NO: 296130 - RNA, 64 nt, Human
aucauugaaucaauggaucuguugaagaacucagcugcuggaaaccaugcaaaauguuuugaau

SEQ ID NO: 296131 - RNA, 64 nt, Human
cccagccaaccacccuuggaacuugccucuuguccugcuggaaagauagcaguguucuccugac

SEQ ID NO: 296132 - RNA, 64 nt, Human
aaauccuaaagccacaaccccuucuaccacugagcugcuggagguggguccuuauuucaagcca

SEQ ID NO: 296133 - RNA, 64 nt, Human
gaauauggauaucucagccuggaugccgaggaagcugcuggaugcuuaauggugcuagaggcuc

SEQ ID NO: 296134 - RNA, 64 nt, Human
augcccccaaccccaagcccugcccuucaccgcccggcugcacuggccucuaggacucacagca

SEQ ID NO: 296135 - RNA, 64 nt, Human
uguuuuaaccuuugcaccuucucagugcuguaugcggcugcagccgucucaccuguuuccccac

SEQ ID NO: 296136 - RNA, 64 nt, Human
agcaggccaugcauccugcugccaaggguggacacggcugcagacuucugggggaauugucgcc

SEQ ID NO: 296137 - RNA, 64 nt, Human
gccuuuaguagggaccugcucugugcucacaccucggcugcaugcacccugcugugacggaggc

SEQ ID NO: 296138 - RNA, 64 nt, Human
uugggaaugaagagguagcaggaggguggagugucggcugcaaaggcagcaguagcugagcugg

SEQ ID NO: 296139 - RNA, 64 nt, Human
ucacucaguuugacaagggcagugguccguacuucggcugcaugagauaaucacuugggagcuu

SEQ ID NO: 296140 - RNA, 64 nt, Human
ugcccacgcuagccucccugcagggaccccgggccggcugcaggggccaacaagaggucagcuu

SEQ ID NO: 296141 - RNA, 64 nt, Human
ccucucugccucgaaccagucaaauggaguauugcggcugcacgucacacuaggguggccaccc

SEQ ID NO: 296142 - RNA, 64 nt, Human
uguggccugcaugcugccugaucuugccuagaaccggcugcaccugcuguucucuuguuuaugc

SEQ ID NO: 296143 - RNA, 64 nt, Human
cucgugguguguuugccuugggccuuucaugccccggcugcacacaucgucugugaauuguggc

SEQ ID NO: 296144 - RNA, 64 nt, Human
acagcagcagggggagagggagggaaggaaggugcggcugcaagaaggaaggcacgggacaggc

SEQ ID NO: 296145 - RNA, 64 nt, Human
cucccuugcccucaggccaggucccugcuggaagcggcugcaucuuccugucagcccugguuuc

SEQ ID NO: 296146 - RNA, 64 nt, Human
uugguaucgcaacuacgggcaccuggaguugauucggcugcagcuggccgcccaguuugagaau

SEQ ID NO: 296147 - RNA, 64 nt, Human
gcgucccugacggacaaguggaggccucuugcugcggcugcaauggaggcaaggggcugcagag

SEQ ID NO: 296148 - RNA, 64 nt, Human
cccgcggagcuucugcugagcgccggcaggucgucggcugcaaccacacacuuggaucgcacgu

SEQ ID NO: 296149 - RNA, 64 nt, Human
accuguccccacucaacugacucauaccuguuuccggcugcaucacuaugugccccacagagaa

SEQ ID NO: 296150 - RNA, 58 nt, Human
cugggacccagucccacugacacgguggcggcugcacaacagcccugccugagaagcc

SEQ ID NO: 296151 - RNA, 64 nt, Human
ugggaggccuggcagucuucaugcugcccugcugcugcuggaaggauggggaucuuucaccuuu

SEQ ID NO: 296152 - RNA, 58 nt, Human
uucuugugaccggggcaggaugugucuucugcuggaccggcaccuuuuguuuguccca

SEQ ID NO: 296153 - RNA, 64 nt, Human
ugaaaaguagaaaaaugucacguuuccauaucuccugcuggaaaucagaaaauauaauaaaauu

SEQ ID NO: 296154 - RNA, 64 nt, Human
ggggcaggcggaaacaggcucacagauugugugucggcugcagcagugauuccaacaagcagcu

SEQ ID NO: 296155 - RNA, 64 nt, Human
cccccuuccuuaucacugucuggucuccgagcuucggcugcagccugagguguguccugggcuc

SEQ ID NO: 296156 - RNA, 64 nt, Human
ccucaacugccuacaucuggggcaagcagcacaccggcugcagaugggacagccagcccugccu

SEQ ID NO: 296157 - RNA, 64 nt, Human
cuuccacauguuaacaguagagcucuaugcacuccggcugcaaucguauggcuuucucuaaccc

SEQ ID NO: 296158 - RNA, 64 nt, Human
aaguauugggauuacccgcgugagccaccgcgcccggcugcaaauaaucuuucuuuuuuucuga

SEQ ID NO: 296159 - RNA, 64 nt, Human
auuuuuuaagaagaguuuguauuauuuuuucauacggcugcagcagcagcugccaggggcuugg

SEQ ID NO: 296160 - RNA, 64 nt, Human
uuugucuguuucuccuuccacccugcuggcugggcggcugcacucagcaucaccccuuccuggg

SEQ ID NO: 296161 - RNA, 64 nt, Human
uguggugucauuaaaguuguuugaaccaaaguggcggcugcaucuuugucccgaugcuagccgu

SEQ ID NO: 296162 - RNA, 64 nt, Human
guuguuuguuaaaaauuaaaaucuccguucuuuccggcugcauugcuuuugcauguucacauau

SEQ ID NO: 296163 - RNA, 64 nt, Human
uauaauaaugcccucauauugaguggucuguaaacggcugcacacuucaggcacuguaguugcu

SEQ ID NO: 296164 - RNA, 64 nt, Human
agacagugggaugugcuacauugucuauuuuuggcggcugcacaugacaucaaauuguuuccug

SEQ ID NO: 296165 - RNA, 64 nt, Human
ucuuucuccaucccaggucccaggugugugauggcggcugcaaucugucuuguggguauuaaug

SEQ ID NO: 296166 - RNA, 64 nt, Human
ccuccucuuugccuccagguaccaccccauccuccggcugcaggaggccaagccgcagaggucc

SEQ ID NO: 296167 - RNA, 64 nt, Human
uucagggugaaggacagaguccuggguggggcagcggcugcagggcgcaccagagaacccagcc

SEQ ID NO: 296168 - RNA, 64 nt, Human
agaggagacggaggugcuggcacaugagaucgagcggcugcagauggagaugaaggaggacgac

SEQ ID NO: 296169 - RNA, 64 nt, Human
cagagccugacagcgcagcuccugaggacuucugcggcugcaggagaaggagcuguggccuguc

SEQ ID NO: 296170 - RNA, 64 nt, Human
caguucagcuucacccucaggaguggcccgaacccugcuggacccaggcucccuucucaccauc

SEQ ID NO: 296171 - RNA, 64 nt, Human
ugucagcucuucccaaaacaaagcucuggaguuucugcuggaaguguuuaaugugaggcaucag

SEQ ID NO: 296172 - RNA, 64 nt, Human
aagcuggcuugagucaagccuguccagaguuccccugcuggacuccaucaccacacucccccca

SEQ ID NO: 296173 - RNA, 64 nt, Human
ggcucccuuguccucaggcuccacgggagcggggcugcuggagagagcggggaacucccaccac

SEQ ID NO: 296174 - RNA, 64 nt, Human
caggacagcccagaggggggcuacagagaggagucggcugcagcagagggcaggagccccagcu

SEQ ID NO: 296175 - RNA, 64 nt, Human
ccugucugcaaggacgcagaauaagcagugagggcggcugcaggagaggaaggggcucccacag

SEQ ID NO: 296176 - RNA, 64 nt, Human
gcuggccuucucucgucugaucguggagcugcggcggcugcacccaggccacgugcugcccgac

SEQ ID NO: 296177 - RNA, 64 nt, Human
ucuucccugaagacgagcagcucuucuccuccaacggcugcaagaccguggccucccgaaucgc

SEQ ID NO: 296178 - RNA, 64 nt, Human
agguguaggcucuccacuuaggcgcacaagcugacggcugcagccagcaggccccggugacgag

SEQ ID NO: 296179 - RNA, 64 nt, Human
ccccucccucugucccugugcuccaagcugcccccggcugcagcccaggccauggacaugugca

SEQ ID NO: 296180 - RNA, 64 nt, Human
agauucauauucuugugcaaccaucaucaccauccggcugcaaaacucuuucaucuugcaaaac

SEQ ID NO: 296181 - RNA, 64 nt, Human
agugaggacuauggcugcauguccucugcuugcccggcugcagagcagagaugugcagcccucu

SEQ ID NO: 296182 - RNA, 64 nt, Human
guguucgccugccagcccagagcccuggaggagccggcugcacagagaggcuuuucuucccagc

SEQ ID NO: 296183 - RNA, 64 nt, Human
cccuggaagucuuguucuuugaccauuacgucugcggcugcaucaccagauaaugagcuucacc

SEQ ID NO: 296184 - RNA, 64 nt, Human
aggugauuuuuuuccauaggaggauaccaucuggcggcugcacauuguaacaguaaaggcagaa

SEQ ID NO: 296185 - RNA, 64 nt, Human
auugggccuucaaccuguaugaccuuaacaaggacggcugcaucaccaaggaggugcagggcaa

SEQ ID NO: 296186 - RNA, 64 nt, Human
cuggcccggcacuguccuccugaggggcaggcgccggcugcaacagucucaugggucaccacgu

SEQ ID NO: 296187 - RNA, 64 nt, Human
ugauaaagauuuuaucaccucauauggaaaacaccggcugcacuggauucaucaguguuaacuu

SEQ ID NO: 296188 - RNA, 64 nt, Human
ugcggaagcugaacccuccugaugagaguggccccggcugcaugagcugcaagugugugcucuc

SEQ ID NO: 296189 - RNA, 64 nt, Human
ugagcgcaugugcgcauuuaugagcaucuacuugcggcugcacucagggccauuugaacccagu

SEQ ID NO: 296190 - RNA, 64 nt, Human
cagcuaccucuuaaugccuguggagggacuggagcugcuggaucccaguguggugguguaggag

SEQ ID NO: 296191 - RNA, 64 nt, Human
ugggaaccuagcacaccugaaucagcuggacauacugcuggaguccagugcuuucuuuccguca

SEQ ID NO: 296192 - RNA, 64 nt, Human
cagucccuagaccuccauucacucuguuucucuucugcuggauuauauaauuuaaaaauaaugu

SEQ ID NO: 296193 - RNA, 64 nt, Human
gggccuccagucuucuggaaugucuucacugcagcugcuggaaaucacugcuuucauucccaca

SEQ ID NO: 296194 - RNA, 64 nt, Human
guccuaguggauuguguugugcugccuaagcugccggcugcaggagccagagaagugacccccg

SEQ ID NO: 296195 - RNA, 64 nt, Human
accccaaccucuguaaauagauuuaccgcauuuacggcugcauucuguaagugggcauggucuc

SEQ ID NO: 296196 - RNA, 64 nt, Human
gcugcaugcggccacucggcaggccgcgggcauccggcugcaggaccagguggugaucaucgac

SEQ ID NO: 296197 - RNA, 64 nt, Human
augguuccagccuaucaggacugcacucucuucucggcugcacuaaagcuggcacucccccagc

SEQ ID NO: 296198 - RNA, 64 nt, Human
ggcgggugaggagacuggccccaggccccagccacggcugcagagccugggcucagccccaggg

SEQ ID NO: 296199 - RNA, 63 nt, Human
aagagacagcagccagcuaaucucccacacccacggcugcauaccugcacuuucagguagcgu

SEQ ID NO: 296200 - RNA, 64 nt, Human
cccuuaaagacugaggaaaaugacaaaguauucucggcugcaaaaauccccaaaggaaaacacc

SEQ ID NO: 296201 - RNA, 64 nt, Human
guguucuagcacuuuguccauuucccguggcauccggcugcagccacugccaugacagcaccug

SEQ ID NO: 296202 - RNA, 64 nt, Human
gguuuauaaaacauuccauggugaacaauucugucggcugcauuauagccaugagugaauagac

SEQ ID NO: 296203 - RNA, 64 nt, Human
guuuucagcuccuaacuggacccucuugcccagccggcugcaaguuuuguaagcgcggacagac

SEQ ID NO: 296204 - RNA, 64 nt, Human
aagugcuggaauuauaggcgugaaccaccgcccccggcugcaguuggauuuuuaaauugcuuuu

SEQ ID NO: 296205 - RNA, 64 nt, Human
gugacagggucugcggcaccgcgccuggccaggccggcugcaguuucucacuucccuguuccau

SEQ ID NO: 296206 - RNA, 64 nt, Human
agugagcaugguacuuggccuuuggaggaacaaucggcugcauugaagauccagcugccuauug

SEQ ID NO: 296207 - RNA, 64 nt, Human
uggcgccuccuagcucaggacaguggcgacugcccggcugcaugcacuccgauuacccacgugc

SEQ ID NO: 296208 - RNA, 64 nt, Human
gugggggcugggugggguggcuccgcccaggaggcggcugcacgguucucugcaucguuaccag

SEQ ID NO: 296209 - RNA, 64 nt, Human
ucaccgccaucauuggggaccuggccucgcacuucggcugcaccauuggucucaaagauucagu

SEQ ID NO: 296210 - RNA, 64 nt, Human
cggcgauuugggugccagcauccugcaacacccacugcuggaaaucucuucauuguggccuuau

SEQ ID NO: 296211 - RNA, 64 nt, Human
ugggaguaaaacuuuaaugggaggggagggcuggcugcuggaagaaggaagaagccagacuggu

SEQ ID NO: 296212 - RNA, 64 nt, Human
cuucaggagagggucucucuccaggacugccaggcugcuggaggaccugccccuaccugcugca

SEQ ID NO: 296213 - RNA, 64 nt, Human
aaauggccacauuuccuauauuuugacagagauacugcuggaaaaauuaaaauuaaaaugccau

SEQ ID NO: 296214 - RNA, 64 nt, Human
gggugggcuaggccgguucugagcaacccccacccggcugcaggguguuuuacaaggugaagag

SEQ ID NO: 296215 - RNA, 64 nt, Human
cucucccgucgucucuucugggcacccucccacccggcugcauacccgggcagggcucccacag

SEQ ID NO: 296216 - RNA, 64 nt, Human
uuugugcaggucgcggcgcuuccugccucauccucggcugcauggggcgggggcgcuguuuuua

SEQ ID NO: 296217 - RNA, 64 nt, Human
ucuccaucagcaaccucacaccugccuucagacccggcugcaacuuccuaagcugccccugccc

SEQ ID NO: 296218 - RNA, 64 nt, Human
uccuugugccaccugguggacgggaaaggcagggcggcugcaguuucagaggccagagccuggc

SEQ ID NO: 296219 - RNA, 64 nt, Human
agccccugcacucaaggccacauucccucgacaacggcugcacgggcuguccgggauccggggu

SEQ ID NO: 296220 - RNA, 64 nt, Human
ggagcgcccucuagggagggacauggccccggugcggcugcagcucacccagccccaggggcag

SEQ ID NO: 296221 - RNA, 64 nt, Human
ucugcugccccaugggcugagccaagugugcccacggcugcaucugcaaagggacgucggagaa

SEQ ID NO: 296222 - RNA, 64 nt, Human
cucuggccuaauggaucuuacuguaugagcaggacggcugcauuggauuguacaacuguuuugu

SEQ ID NO: 296223 - RNA, 64 nt, Human
acgcgcccugcucucacggccucggcacaggcagcggcugcacguguucugcugaagugcgucu

SEQ ID NO: 296224 - RNA, 64 nt, Human
ccgcugucucccaggugcuugcugggacucggggcggcugcaccuggcugucaccugggugugc

SEQ ID NO: 296225 - RNA, 64 nt, Human
gcuucagaggaguguugagugacaccugaggaugcggcugcacacacucagccaagggccgagu

SEQ ID NO: 296226 - RNA, 64 nt, Human
ggcagcaggcagcaccccucugccagccgggccccggcugcagaagugcuguugguuuggaugc

SEQ ID NO: 296227 - RNA, 64 nt, Human
uuacagguucuguacagaguaaugagaugugugacggcugcaaaccagguguuuuuuucugagg

SEQ ID NO: 296228 - RNA, 64 nt, Human; identical to SEQ ID NO: 296227

SEQ ID NO: 296229 - RNA, 64 nt, Human
gaauuuccaaaggauaauauuuuucuaauaaaugcggcugcaaccuccugugcauuuaauuaaa

SEQ ID NO: 296230 - RNA, 64 nt, Human
uuacagagcugugucaugccauccuuugggcccucugcuggaaaaguagaaucaagucucaaau

SEQ ID NO: 296231 - RNA, 64 nt, Human
gaaauccuuucucugacuuaggaaccagcgcccccugcuggagaaguuuuuucauuuuguuagc

SEQ ID NO: 296232 - RNA, 64 nt, Human
ccucagaaacugcagcagccacgcacacagaagccugcuggaagacaggucucucuccguccac

SEQ ID NO: 296233 - RNA, 64 nt, Human
auaauuuuacauaagaucugccuuccacacuucccugcuggaaggcauucucagagcuuuaugu

SEQ ID NO: 296234 - RNA, 64 nt, Human
cgaccuuuaccauaggaugaaguaaccuugcauucggcugcaagguguacuguacguacacagg

SEQ ID NO: 296235 - RNA, 64 nt, Human
gugcccuugcuggguccaggguaggcaaggcugccggcugcacccuguauggagcuagagaggg

SEQ ID NO: 296236 - RNA, 64 nt, Human
gggggcugccauccccugccugccaccugccccucggcugcaugcccacagccguaccugccug

SEQ ID NO: 296237 - RNA, 64 nt, Human
ggauggcagcuucuacuuucuggaauugaauccucggcugcagguagagcacccuuguacagag

SEQ ID NO: 296238 - RNA, 64 nt, Human
cagauggcagugccauaagcaagucuauaaauaucggcugcagccaucccccucauuuuaaaug

SEQ ID NO: 296239 - RNA, 64 nt, Human
ccucuguggcaagaccacgcccagcaaaaguggucggcugcagugccaggaccacccuugccug

SEQ ID NO: 296240 - RNA, 64 nt, Human
gacuggugaucagggcccggcccacggcccugagcggcugcagccugcuuugggacgaugguca

SEQ ID NO: 296241 - RNA, 64 nt, Human
acccugccacaccccucacccugcuguccucccacggcugcagcagaguuugaagggcccagcc

SEQ ID NO: 296242 - RNA, 64 nt, Human
gcaccacgauagcaccguuucaugaaaggcauggcggcugcauuucauaccacaucaaaauaca

SEQ ID NO: 296243 - RNA, 64 nt, Human
cugcggucugugcccgcgcccagcccagcugccccggcugcacgccugcugcucccagcucgcc

SEQ ID NO: 296244 - RNA, 64 nt, Human
ucccauggcccugcuguggcuccccagcuccagucggcugcacgcacaccccugcuccggcuca

SEQ ID NO: 296245 - RNA, 62 nt, Human
agacgaccgggagcacauagcggccgggagcccggcugcacaccaggcugcugcuuuguccg

SEQ ID NO: 296246 - RNA, 64 nt, Human
gcuccggcugugacggcuccggccguucucacugcggcugcaccggcccccgcugcggucacua

SEQ ID NO: 296247 - RNA, 64 nt, Human
aagacugcgggcucugcccccagcucugccaggacggcugcaagaccagcuggcccgggagggg

SEQ ID NO: 296248 - RNA, 64 nt, Human
guuagcugcuccucuccgcagccagaaaugcugccggcugcacccagagggagcagugaggcag

SEQ ID NO: 296249 - RNA, 64 nt, Human
ccugcaccuacccaagcugaacaaccucuaccugcggcugcaggagcugguggcccuccaaggg

SEQ ID NO: 296250 - RNA, 64 nt, Human
agcggaacagggaaugccagacacaggcucgcugcugcuggaaggcggggugggacuuccuucc

SEQ ID NO: 296251 - RNA, 64 nt, Human
ugaggcccaagagcauaugggcaauucggauuuccugcuggaccacaagguucuguugauauua

SEQ ID NO: 296252 - RNA, 64 nt, Human
gcucucugaguuuugcacacgaaguugcccucaucugcuggagaucgauaaggaaggcacaaga

SEQ ID NO: 296253 - RNA, 64 nt, Human
caguagugcugccccugugacaggcaucagcucccugcuggaacugagguagacacaggugugg

SEQ ID NO: 296254 - RNA, 64 nt, Human
acucguccccaccgcccgcccggggcuagggacucggcugcaccugcucuuggacccuggucuc

SEQ ID NO: 296255 - RNA, 64 nt, Human
ggauucgccucccagcggacgugagcuuccacugcggcugcagagacgcgagcaaccucuucuc

SEQ ID NO: 296256 - RNA, 64 nt, Human
aaaggaaaggacccugaagccaauaucugauucucggcugcaccuucucuuggccacccuggcc

SEQ ID NO: 296257 - RNA, 64 nt, Human
gagauaugaucccagaaaacaucugucucuacuucggcugcaaaacccaugguuuaaaucuaua

SEQ ID NO: 296258 - RNA, 64 nt, Human
caggaccuuuuguucacagcgugcagcagcgagccggcugcagugugucuccccuggccucgcc

SEQ ID NO: 296259 - RNA, 64 nt, Human
aguugcagcuuuguguuaagcugaucacagacaccggcugcaccaucagcgggaagcagagccc

SEQ ID NO: 296260 - RNA, 64 nt, Human
cuucccaugcugguggccaccgugucccuugcugcggcugcaucuuccagucucuccuccgucu

SEQ ID NO: 296261 - RNA, 64 nt, Human
ggcaggcaggggcuagggaaugccugcugcugaucggcugcagacggaccauggggugucaacg

SEQ ID NO: 296262 - RNA, 64 nt, Human
agcguggccuccgugacccaugcgauucaagucgcggcugcaggauccuugccuccaacgugcc

SEQ ID NO: 296263 - RNA, 61 nt, Human
uggagaaaaaggaugccugaacacgcaaagucggcugcagaauuauugccaaguugcugcu

SEQ ID NO: 296264 - RNA, 64 nt, Human
caccccaugcuccaggcauacagaugugguuucucggcugcaccgggccaggcugcgggugugc

SEQ ID NO: 296265 - RNA, 64 nt, Human
guccggccccgucagcgugugcugguccagccagcggcugcaggcgaguuucuagaaccagagu

SEQ ID NO: 296266 - RNA, 64 nt, Human
gggcaaaccgaacccugcgcucgcaccuccuacacggcugcagugggacauuccaaaacaggug

SEQ ID NO: 296267 - RNA, 64 nt, Human
cacuggauagugcuguaucacuuaggugugcauucggcugcaaauaacagaaaacccagcaaac

SEQ ID NO: 296268 - RNA, 64 nt, Human
aaaaagcaacccugcagcaaagugaauuucuguccggcugcaauuuaaaaaugaaaacuuaggu

SEQ ID NO: 296269 - RNA, 64 nt, Human
uuauuuaguuuauuaaugaauuaagucaaaauuacggcugcaaaauggcuaaggucaaguaaag

SEQ ID NO: 296270 - RNA, 64 nt, Human
ucaccugugcuuucugggaccaaagaaugggcaccugcuggaguccgggcagagcuuucucagu

SEQ ID NO: 296271 - RNA, 64 nt, Human
agggcucugaauacgggcuuaaagucaucuuguccugcuggaauuugcugugcagagccauaag

SEQ ID NO: 296272 - RNA, 64 nt, Human
gggggcuaccaaaacaccccuucuggaguagaagcugcuggaaggcaggccugagccauucacc

SEQ ID NO: 296273 - RNA, 64 nt, Human
caagacuuggugggaaguaagcuggagauccaggcugcuggagauccaaugccugcugccucca

SEQ ID NO: 296274 - RNA, 64 nt, Human
gagacagcccuucccacuggcucccugauggcaccugcuggaggaaaggggcacggccucccuc

SEQ ID NO: 296275 - RNA, 64 nt, Human
uucugaccaggcguccucugcccccagggagaggcugcuggauggugaccccuggggaaugccc

SEQ ID NO: 296276 - RNA, 64 nt, Human
ccaaugaguuggauggcaagaaugcaggcagaagcugcuggauaaaauaggcuacagccaccuc

SEQ ID NO: 296277 - RNA, 64 nt, Human
cugccugguuugcauccggcucacagagcccagacugcuggaacagccaaggacugucaggcug

SEQ ID NO: 296278 - RNA, 64 nt, Human
auuugauuucugacuugcuaagccuguaauuuaccugcuggaauagacagaguccagcugccca

SEQ ID NO: 296279 - RNA, 64 nt, Human
agcagccuccagugcuggcugcuggcccacagcucugcuggaagaacugcauggggaguacauu

SEQ ID NO: 296280 - RNA, 64 nt, Human
acagugagcaaggguucacaugcauucuuuuauacugcuggauuuuguugugcaucauuuaaaa

SEQ ID NO: 296281 - RNA, 64 nt, Human
gaccuaguauggaauuguuacuuagugcugccaccugcuggauguuaaaagguauuucaguaca

SEQ ID NO: 296282 - RNA, 64 nt, Human
uuacugugccuucacucauagugugccuucuuagcugcuggagaauuuggggagaggauguaca

SEQ ID NO: 296283 - RNA, 64 nt, Human
ucagggcuugacucaugauagacaaaguauaugccugcuggauggaagaaucucuugggcgagc

SEQ ID NO: 296284 - RNA, 64 nt, Human
acagaccucaacauucaacaacauccauacagcacugcuggaggaagaggaagauuugugcaga

SEQ ID NO: 296285 - RNA, 64 nt, Human
ccaaggcccaccgugccccaggcucagcagggagcugcuggagguaguagagccugaagucuug

SEQ ID NO: 296286 - RNA, 64 nt, Human
ucuagcccuuuuagauuuuggcacugugaaaccccugcuggaaaccugagugacccucccuccc

SEQ ID NO: 296287 - RNA, 64 nt, Human
gaagcucccuaccucccugcccuucuccuccuuccugcuggaaugaacuaaagcagaugucaag

SEQ ID NO: 296288 - RNA, 64 nt, Human
ggaagagagcgaggcaucccugaauuccacgcaucugcuggaaacgagccgugucagaucgcac

SEQ ID NO: 296289 - RNA, 64 nt, Human
guccucauucucagucugaccagaaugcagggcccugcuggacugucaccuguuucccaguuaa

SEQ ID NO: 296290 - RNA, 64 nt, Human
ggacuugauagugguguauuaacuuauuuaugugcugcuggauacaguuugcuaauauuuuguu

SEQ ID NO: 296291 - RNA, 64 nt, Human
gaguuauggacuuugggagugagacaucuucuugcugcuggauuuccaagcugagaggacguga

SEQ ID NO: 296292 - RNA, 64 nt, Human
ggugccgugcuaggggguaggggccucucccucacugcuggacuggagcugggcuccuguagac

SEQ ID NO: 296293 - RNA, 64 nt, Human
uggagaugcauacagaucagcaccuucucuguaccugcuggacccccaugugcacccuucuccc

SEQ ID NO: 296294 - RNA, 64 nt, Human
ccccugggaaacacaucauucccagccucaggcccugcuggaauuggggcugccuuauaugugu

SEQ ID NO: 296295 - RNA, 64 nt, Human
augcccucagauggagacauuggauguggagcuccugcuggaugcgugcccugaccccugcacc

SEQ ID NO: 296296 - RNA, 64 nt, Human
cagaugggcugcuagacuaccccucuucaucagccugcuggaaagagcagacagcguaacagca

SEQ ID NO: 296297 - RNA, 64 nt, Human
augaggcagagggaagacauugaagaaaacaucucugcuggaauauuuggaaaagaacacucuu

SEQ ID NO: 296298 - RNA, 64 nt, Human
ccuuuauauaggcuuccaacaccaaauaaccuaacugcuggaaaacaagggaaauuuaaaucuc

SEQ ID NO: 296299 - RNA, 64 nt, Human
acuucaacucuuaguucacuuuuguauaguugcucugcuggaaagaaaugagagugaaucugcu

SEQ ID NO: 296300 - RNA, 64 nt, Human
guagagucaucugaguguagagaaugucccuucacugcuggaaaaauccacuggcucccaagaa

SEQ ID NO: 296301 - RNA, 64 nt, Human
ugagaugcaaagagucuaccuuuccaaguucucacugcuggaaagagcuagaagcacaguucaa

SEQ ID NO: 296302 - RNA, 64 nt, Human
cacacacacacgcacggcuuccuauaacuucuuccugcuggacagagacucagcgcuccuccug

SEQ ID NO: 296303 - RNA, 64 nt, Human
cgggccuuuccugcccucuguggucaucugccaccugcuggaucaagugcuuucucuuuuacac

SEQ ID NO: 296304 - RNA, 64 nt, Human
gcgccauuccugguugucuguugaaucuuucuggcugcuggaauuggagauaggauguuuugcu

SEQ ID NO: 296305 - RNA, 64 nt, Human
acauccaacagcaccagcaggagagugggcuagccugcuggaugcuguucgugccugucccugc

SEQ ID NO: 296306 - RNA, 64 nt, Human
ucugacugacuguggccagucccuggacugguagcugcuggaggccuucuuguuucuccagucc

SEQ ID NO: 296307 - RNA, 64 nt, Human
ggagauucaggagcagcaaugggucucaccauagcugcuggaaucacaccugagaacugagaua

SEQ ID NO: 296308 - RNA, 64 nt, Human
cacgaugcuguccucgugcgauugcccucuccugcugcuggacuucugccuuuguuggccugau

SEQ ID NO: 296309 - RNA, 64 nt, Human
gaguggcugacagagcaggucugcaggccaccagcugcuggaugucaccaagaaggggcucgag

SEQ ID NO: 296310 - RNA, 64 nt, Human
acacuuuuuucucauguucuaaagucuuagaauacugcuggauuguugagcaugagacagagca

SEQ ID NO: 296311 - RNA, 64 nt, Human
gguuacaagcagugguaggauugcagccgugggccugcuggacacacacauacaccaaagaugu

SEQ ID NO: 296312 - RNA, 64 nt, Human
ugcgcggcccauacugggcgugugcaucugaauccugcuggagagcaaacacgaacuucuguuc

SEQ ID NO: 296313 - RNA, 64 nt, Human
uauaagguggguggcaggagggaacaggugccaccugcuggacaaucacacgaaaggcaggcgg

SEQ ID NO: 296314 - RNA, 64 nt, Human
ccccauccgcccucuggaccuguguagggccucacugcuggagcggggaaaccgcagcucagcc

SEQ ID NO: 296315 - RNA, 64 nt, Human
cccuucgccucccagccccucaagacaccgcuggcugcuggacacccucuucacuugugugugu

SEQ ID NO: 296316 - RNA, 64 nt, Human
uauauucauucuccaguguugcugaauuaaaauucugcuggacuuuuuaacauagcaaauccga

SEQ ID NO: 296317 - RNA, 64 nt, Human
auuuaaauaagaaaaaaaucaaaucgaagucagccugcuggaaaagugaucacauggcaguugc

SEQ ID NO: 296318 - RNA, 64 nt, Human
ccuggcugggaguggcauguaugacgugacuggccugcuggauguggagggggcgcgugcaggc

SEQ ID NO: 296319 - RNA, 64 nt, Human
cgggguuugccaugcuggccaggcuggucucgaacugcuggauucaagugauccgcccaucucc

SEQ ID NO: 296320 - RNA, 64 nt, Human
gcgcagaugaggggccacugacccaccugcgcuucugcuggaggaggggaagcugggcccaaag

SEQ ID NO: 296321 - RNA, 64 nt, Human
cugggcagaagggcggcuggcuguccuggagcugcugcuggagccugcccucagagugucccuu

SEQ ID NO: 296322 - RNA, 64 nt, Human
auuugugagucuucuaguuacuggaccgaguuuucugcuggaucuggugggaaggcagcucggu

SEQ ID NO: 296323 - RNA, 64 nt, Human
guucauaguuuuuuuuugaacaguuuagacaaaacugcuggaaauuaaaccaauuuccugcauu

SEQ ID NO: 296324 - RNA, 64 nt, Human
ucaucucaaauuauuuugaauucuucccaaauggcugcuggauuuaggugguaauaggggcugu

SEQ ID NO: 296325 - RNA, 64 nt, Human
cuccuugcuccucucccuccugccucaacuggggcugcuggaagggggcccucuggauucccuu

SEQ ID NO: 296326 - RNA, 64 nt, Human
uauagcaaguuggccagucuggccuccuguuccucugcuggaccugggguaggcugcaggggug

SEQ ID NO: 296327 - RNA, 64 nt, Human
uggugcaauuucuugaggaugggaacauguagagcugcuggaaggaguaauucugugcuugaca

SEQ ID NO: 296328 - RNA, 64 nt, Human
agggugcgaggggaacuccgaguucuuucugagccugcuggacaugaagagcagaugaccacca

SEQ ID NO: 296329 - RNA, 64 nt, Human
auguggcuccugggcuacccacagccagggcagccugcuggagccacagggccagggccaugca

SEQ ID NO: 296330 - RNA, 64 nt, Human
gggugguuuucccaucucagguguguugcagugucugcuggagacauugaggcaggcacugcca

SEQ ID NO: 296331 - RNA, 64 nt, Human
cuucugcccugguuaauuuagcccuaacucucaucugcuggagagucagcucccaaacuguucu

SEQ ID NO: 296332 - RNA, 64 nt, Human
gccucuccuccauucccuauggguucugugaccacugcuggaccaaggacguggaugacccucc

SEQ ID NO: 296333 - RNA, 64 nt, Human
cuccuuccaggccuacccuacugcccgcugcguccugcuggaggugcaagugccugcugcccuu

SEQ ID NO: 296334 - RNA, 64 nt, Human
cgcccgacugcaacugcugacccugcagagcuggcugcuggacgcaccgugcucgcugcccgca

SEQ ID NO: 296335 - RNA, 64 nt, Human
cacccacgcugcccccagagcuugggcugcccuccugcuggacacucaggacagcuugguuuau

SEQ ID NO: 296336 - RNA, 64 nt, Human
uggggccuggagcuggcccuuccucuacuuuucccugcuggaagccagaagggcuugaggccuc

SEQ ID NO: 296337 - RNA, 64 nt, Human
aauguguguugaaggacugggacguacguggaggcugcuggaccuggucagagacugaugugcc

SEQ ID NO: 296338 - RNA, 64 nt, Human
cuaaaucgccuccugagggugacuguugcuuauucugcuggacagguuuuuacauaaagcaaag

SEQ ID NO: 296339 - RNA, 64 nt, Human
guggagaugcuggugucuggguagucauggauuucugcuggacauuugaaugugauaaacaauc

SEQ ID NO: 296340 - RNA, 64 nt, Human
auuccugccaugccccagccuucuccaggacaaccugcuggaacgcagugguguuuucagggca

SEQ ID NO: 296341 - RNA, 64 nt, Human
aguauuccaugucaacaauuuguccaaaggaaaacugcuggagggagguggagggaggaaggug

SEQ ID NO: 296342 - RNA, 64 nt, Human
caaagucuguuggcuuccaauccauuucuguguccugcuggagguuuuaaccuagacaaggauu

SEQ ID NO: 296343 - RNA, 64 nt, Human
ccaauuugccauggggaggcugcaguguccaagccugcuggaaacugggauguagcuggggacg

SEQ ID NO: 296344 - RNA, 64 nt, Human
auguuuucucacagcagcugccugggugaagcaucugcuggacaagucggaccacuggccaggg

SEQ ID NO: 296345 - RNA, 64 nt, Human
accacacaguccccagacucagcuggaagucuaccugcuggacagccuccgccaagaucuacag

SEQ ID NO: 296346 - RNA, 64 nt, Human
ugagcagugagcagaaagcugugaacaggcugggcugcuggagguggggcgaggcaggccgacu

SEQ ID NO: 296347 - RNA, 64 nt, Human
cccucucauucucacuccuccuugggcccugaggcugcuggauccggucugccugccucccugu

SEQ ID NO: 296348 - RNA, 64 nt, Human
uuccaguucuaccaaaucuguacuugggagcagccugcuggauccagaacaugacaacagagag

SEQ ID NO: 296349 - RNA, 64 nt, Human
ucauccaaccccugcacaggucacagcaggugcccugcuggauaucugggucuggaacaggagg

SEQ ID NO: 296350 - RNA, 64 nt, Human
cuagucucgugagacuuugccccauggcagaacucugcuggaauccuauugagaagguagacau

SEQ ID NO: 296351 - RNA, 55 nt, Human
aagccaaaggaauugaguaagacaacugcuggaagaugucuuaaaucaagcuuuc

SEQ ID NO: 296352 - RNA, 64 nt, Human
guugcuugaggagcuuucuccugagcuccagucccugcuggauucccugguuaauucagcuuga

SEQ ID NO: 296353 - RNA, 64 nt, Human
uaaccaccaccaacagccauucaucaucugaucucugcuggaucuacagacaccgaugcagacc

SEQ ID NO: 296354 - RNA, 64 nt, Human
ggacuccuugcauuuuuugcugcucuuccgagggcugcuggaacccaggaguggggguaagugg

SEQ ID NO: 296355 - RNA, 64 nt, Human
cauuccagagucugccauacuccgucuccuccagcugcuggauaauacagaggaacuucaacuu

SEQ ID NO: 296356 - RNA, 64 nt, Human
guuuuacuaaguccccucucccugauagggaauccugcuggaccagcgcagcccugguguggag

SEQ ID NO: 296357 - RNA, 64 nt, Human
agcugugcugggcagcagggccucgcguaaggaacugcuggaacccacugagcccuucccgggg

SEQ ID NO: 296358 - RNA, 64 nt, Human
cuguccgcgcccaagaaagauaagcaaguauuuccugcuggauggggguuggcaggaagcuguu

SEQ ID NO: 296359 - RNA, 64 nt, Human
guguccuggaucgucugggagcccagugucaagucugcuggaaugcaggaaguagaacagaauc

SEQ ID NO: 296360 - RNA, 64 nt, Human
uuggacagaauaucuguggcaucaugggcuauggcugcuggaaaggggccagugggauccuaga

SEQ ID NO: 296361 - RNA, 64 nt, Human
caguggcucacuuugggaggcugaggcaggaaggcugcuggaaacugagaguucaagaccagcc

SEQ ID NO: 296362 - RNA, 64 nt, Human
caaauagaagccuuagaugcuauaguuccuucugcugcuggauucucaggcuaacauccuggag

SEQ ID NO: 296363 - RNA, 64 nt, Human
gacucccagucuccugguggcucuggccucggcccugcuggauccaccuccuagacccggggcc

SEQ ID NO: 296364 - RNA, 64 nt, Human
uuggagcugcugcccccuuucuuccuggccucggcugcuggaauuggaaucaggcuguacucuu

SEQ ID NO: 296365 - RNA, 64 nt, Human
guuucaguccaugaucccacugaccuacucuugccugcuggaggguaaugagaagcuuugguuc

SEQ ID NO: 296366 - RNA, 64 nt, Human
gagucuucuuccucaaguuucggcagcugugcugcugcuggaugggcugcuccucccagggcuc

SEQ ID NO: 296367 - RNA, 64 nt, Human
agugguguggccugaaaacaaagaauaaccuaggcugcuggaaagcacccuuuugguuguuuuc

SEQ ID NO: 296368 - RNA, 58 nt, Human
cgcuggccacccagcgcuaagacaguugcugcuggaggaugaccagggaagcccccug

SEQ ID NO: 296369 - RNA, 64 nt, Human
ggagagguacucaaacaaguuacuuucaguuguccugcuggauuuuaaaaaaauagaaaaagaa

SEQ ID NO: 296370 - RNA, 64 nt, Human
ugcauggcagguggggaaaggggggcuugcaccccugcuggaaagaaaagguuuguguauauuu

SEQ ID NO: 296371 - RNA, 64 nt, Human
ccaaacuccugucauggcacggaagcuaggagugcugcuggacccuuccuaaaccugucacuca

SEQ ID NO: 296372 - RNA, 64 nt, Human
aagauuaagauuaugaaaguaacaguuauugauacugcuggacuucaaaggcaaaguucauuuc

SEQ ID NO: 296373 - RNA, 64 nt, Human
agacuugcuuccccaccaaagauguccugggauucugcuggaucucaaagaugugccaagccaa

SEQ ID NO: 296374 - RNA, 64 nt, Human
aacugguauauacauauauaugucaggcaaagugcugcuggaaguagaauuuguccaauaacag

SEQ ID NO: 296375 - RNA, 64 nt, Human
acuuagcaauuagaguucuuuuauuaagauguaucugcuggauuaaggguacagguugaaauag

SEQ ID NO: 296376 - RNA, 64 nt, Human
uuaaucucuguucuccuuacaaauuccuuuugugcugcuggaaaggaucuuuggcuagguggau

SEQ ID NO: 296377 - RNA, 64 nt, Human
ugcagcuuugacagugcuuauuuaaagaaaaauacugcuggaaaauuuccaauuucuacuacgu

SEQ ID NO: 296378 - RNA, 64 nt, Human
gcaggucauuaggauuaggcagaaucucucagagcugcuggacaaggaggucuacuuauuuugu

SEQ ID NO: 296379 - RNA, 64 nt, Human
ggcugggguggggauggagguaucaggagucuagcugcuggaggaugggacagcugugcugggu

SEQ ID NO: 296380 - RNA, 64 nt, Human
gagcccuggugggcaggguuggggggucugucuucugcuggaugcugcuuguaauccauuuggu

SEQ ID NO: 296381 - RNA, 64 nt, Human
uggcuuccaccccccagucacccacuuggguuaucugcuggaaguuaucgauaggacugugugg

SEQ ID NO: 296382 - RNA, 64 nt, Human
auggcuccuugagccucacgacgcaauccguguccugcuggauaaccagacugugacauuucag

SEQ ID NO: 296383 - RNA, 64 nt, Human
uuucuugccaaugaggucugaaauggagguccuucugcuggauaaaaugagguucaacuguuga

SEQ ID NO: 296384 - RNA, 56 nt, Human
guccaaaaauuggcaacugaagccagcugcuggagauauguaaagaaaaaagcacc

SEQ ID NO: 296385 - RNA, 64 nt, Human
gcccuuccugauugaucuucugagagcucgaaugcugcuggacacguaccccuuucuauuauua

SEQ ID NO: 296386 - RNA, 64 nt, Human
uugaaauggcauuuaauuucaaccuaaauacugacugcuggacauaaaucacagaaaauuuaac

SEQ ID NO: 296387 - RNA, 64 nt, Human
aauuacucugucccucuggaccgaaucucuuuaacugcuggauaguuuuagaggaauucuccug

SEQ ID NO: 296388 - RNA, 64 nt, Human
ccaguauuccuugcacuugugaauguguugcacucugcuggaugaaauggcaguggauuuuuaa

SEQ ID NO: 296389 - RNA, 64 nt, Human
ggggaugagguugcuuacuaagcuuugccagcugcugcuggaucacagcugcuuucuguuguca

SEQ ID NO: 296390 - RNA, 64 nt, Human
uuaugauagaguuuauaaaacaguccuguguaaacugcuggaaguucuuccacagucaggucaa

SEQ ID NO: 296391 - RNA, 64 nt, Human
auuuuugcuaguccaugugcuagagguaaacguucugcuggaauucugcauccagcucuauccc

SEQ ID NO: 296392 - RNA, 64 nt, Human
aaucuuuaaacaauucugugagcaaaguuuguagcugcuggauuauugucugucuuuauagcaa

SEQ ID NO: 296393 - RNA, 64 nt, Human
aguccugcagaaucaaucccgacuuccauaccugcugcuggacuguaccagacgucugucccag

SEQ ID NO: 296394 - RNA, 64 nt, Human
gacucacugagugcaccuccaucuccaagcacugcugcuggaagaccccauucccucuuuaucu

SEQ ID NO: 296395 - RNA, 64 nt, Human
cuccagcccauugguagacguguguuucuagagccugcuggaucucccagggcuacucacucaa

SEQ ID NO: 296396 - RNA, 64 nt, Human
ugaacggaacuaaagucugugacaguggauauagcugcuggaccauuccaucuuauauguaaag

SEQ ID NO: 296397 - RNA, 64 nt, Human
uauccaucuuugaacuucugacuacuuguuguaucugcuggauauuuaguucaacuguauaguu

SEQ ID NO: 296398 - RNA, 64 nt, Human
gcugugguuacaugcagucaguaaaccugugagacugcuggaggaaauguagcagacagcaugg

SEQ ID NO: 296399 - RNA, 64 nt, Human
auauuaauuccaggaacacauguuuuuauuuccucugcuggaauaggagaaagcuuaauauauu

SEQ ID NO: 296400 - RNA, 64 nt, Human
cggagcaaaggcuuucgggagugugaggcugcaucugcuggagcaaagggaaaccgugggcuuu

SEQ ID NO: 296401 - RNA, 64 nt, Human
cagagagaaagcacuuccaucgcugaggaaaguucugcuggaccgcacacccuuagaaggaugg

SEQ ID NO: 296402 - RNA, 64 nt, Human
aaagucagucacagaccacugcaacaugccuucccugcuggaucauuauauacauucagauugu

SEQ ID NO: 296403 - RNA, 64 nt, Human
caaauugcgcccauuuagaggauguggcuguaaccugcuggaugggacuccauagcuccuuccc

SEQ ID NO: 296404 - RNA, 64 nt, Human
ugggccuuggcugggccucugguucugacacuuucugcuggaagcugucaggcugggacaggcu

SEQ ID NO: 296405 - RNA, 64 nt, Human
cgugccgcuccucccuugcccucaggccaggucccugcuggaagcggcugcaucuuccugucag

SEQ ID NO: 296406 - RNA, 64 nt, Human
acauguggugguacgaaaacaauuccccuguggccugcuggacugguuggaaccagaacaggcu

SEQ ID NO: 296407 - RNA, 64 nt, Human
cugaggacagagcuugaagccuccacaccagcugcugcuggagauucaaagcccaacugugggu

SEQ ID NO: 296408 - RNA, 64 nt, Human
uugaucugaagcuuccaauagcuugaggccuuugcugcuggaugaugcccuuuuugggagcauc

SEQ ID NO: 296409 - RNA, 64 nt, Human
caucucuccugaagaccugccacggcaaguggagcugcuggaugcgguaagccaagcugcucag

SEQ ID NO: 296410 - RNA, 64 nt, Human
gaggauuaagagcaacagccccagagccugggcucugcuggacuuaguauaaugugaaaaaaau

SEQ ID NO: 296411 - RNA, 64 nt, Human
gucaguaauuguguuaaccacguguauaacagcucugcuggacacccaagaaagccaugggaac

SEQ ID NO: 296412 - RNA, 64 nt, Human
gcccaggaucgcguuggucacuguuauuugccuacugcuggaagaaggacaaccgcuggcaagg

SEQ ID NO: 296413 - RNA, 64 nt, Human
uaaaaauaguggucaacuuuaguaauauaaaaggcugcuggaugcugagauuccacauaacaca

SEQ ID NO: 296414 - RNA, 64 nt, Human
uggguggacucacacuugcucaguucaggcagcucugcuggagggcggugccaugccuaagccu

SEQ ID NO: 296415 - RNA, 64 nt, Human
ugaacaauucagauccccacuuucugagggugcccugcuggaagauaacccuguuuguaauugu

SEQ ID NO: 296416 - RNA, 64 nt, Human
cagggucaagugcuacgggccuccuucccguguccugcuggaacgucuucguguccaccugggu

SEQ ID NO: 296417 - RNA, 58 nt, Human
aggauuuggguuuucuauaagggguuuccugcuggacaggggcgugggauugaauuaa

SEQ ID NO: 296418 - RNA, 64 nt, Human
ugaccggaucgaaucucucagcgaccaggugcugcugcuggaggagaggcuaggugccugugag

SEQ ID NO: 296419 - RNA, 64 nt, Human
acugaccucacagacugaccauuccaucccacagcugcuggacauagagugauuugcagccccu

SEQ ID NO: 296420 - RNA, 64 nt, Human
ccucugugagugaccauccaggcagucaccauaacugcuggagugucugggauugguagcucuc

SEQ ID NO: 296421 - RNA, 64 nt, Human
uggcuaguggauuuaaaacaacacauaccugucacugcuggagucaaacuuauaaaaagccuua

SEQ ID NO: 296422 - RNA, 64 nt, Human
cuggagucaaucacccuucccacaaaucaccaaacugcuggaacucuccagccaaaugcuggga

SEQ ID NO: 296423 - RNA, 64 nt, Human
uccacuccccuaaaccuacaguccuggaaggucucugcuggaagagacugggagaguggggagg

SEQ ID NO: 296424 - RNA, 64 nt, Human
uguaaaucauucuuaagcccagauaugagaacuucugcuggaaagugggacccucugagugggu

SEQ ID NO: 296425 - RNA, 64 nt, Human
caaagggaauuaauauuguugacuuuuaaaacaucugcuggauauauuauaugcaauuaauagu

SEQ ID NO: 296426 - RNA, 64 nt, Human
gccaaaccucggcauuuuuuguguuauuuucugacugcuggauucuguaguaaggugacauagc

SEQ ID NO: 296427 - RNA, 64 nt, Human
gacaccagaggugggggcaacucugcaagcucaccugcuggacgugagaauguuggaacguucc

SEQ ID NO: 296428 - RNA, 64 nt, Human
aaacccacaccucuggaagauaccuucacggccgcugcuggagcuucuguugcugugaauacuu

SEQ ID NO: 296429 - RNA, 64 nt, Human
aguccacuccgaccuuuuucuuugaacaugcaugcugcuggaauauguauaaaucagaacuagc

SEQ ID NO: 296430 - RNA, 64 nt, Human
acucugccuucaggaacacgggucuguagagggucugcuggagacgccugaaagacaguuccau

SEQ ID NO: 296431 - RNA, 64 nt, Human
accuaaggcccacuggagggcgcucaucaaguagcugcuggauguugacgaaggaagcggcggc

SEQ ID NO: 296432 - RNA, 64 nt, Human
aacaccgcaacaggcuucaguaucagggcugaaacugcuggaugaauaaacuauuuauuaaaaa

SEQ ID NO: 296433 - RNA, 64 nt, Human
gaagggcacaagguggaggggggauggggggaugcugcuggaggucucagugggugcagacagc

SEQ ID NO: 296434 - RNA, 64 nt, Human
cgggcaccuacuacaaaccguagugggguggaggcugcuggaggugggagugaggagaugaggg

SEQ ID NO: 296435 - RNA, 64 nt, Human
ggugugggacuaugaggagggagagguggaggcccugcuggaucgauacuucgaggcugauccu

SEQ ID NO: 296436 - RNA, 64 nt, Human
cccuucccaaguauuugugcaaugauuguguuuacugcuggauuuuugaagguuuuuuuuuuua

SEQ ID NO: 296437 - RNA, 64 nt, Human
ugugcugggguuuguucugcugucacuguuuaugcugcuggaacuuagcacugucuugauuuga

SEQ ID NO: 296438 - RNA, 64 nt, Human
uaaagaauuuuagaagaucuuggugcugcuauuccugcuggaggaaugaauagauggcuguuuc

SEQ ID NO: 296439 - RNA, 64 nt, Human
uuuuuuuuuuuuuuuuuugaggcagagucuugcucugcuggagugcgguggugcaaucucggcu

SEQ ID NO: 296440 - RNA, 64 nt, Human
guuugcagucucucucugccauggccuuggcaggcugcuggaaggcagcuuguggaggccguug

SEQ ID NO: 296441 - RNA, 64 nt, Human
ggacgcuccccacauccuuccagaaggagacgagcugcuggaagagaagcaggagggguguuuu

SEQ ID NO: 296442 - RNA, 64 nt, Human
ugccccagcuucacucucucccucagcaccugcccugcuggaggccccagcccuccguggacag

SEQ ID NO: 296443 - RNA, 64 nt, Human
cuguuauuuugaguuuauguguugagaucagugacugcuggauagucucccagucugaucaaug

SEQ ID NO: 296444 - RNA, 64 nt, Human
gaagcguaagguaacacuggcauuccucuagccucugcuggagugcagugaggauuuucuagca

SEQ ID NO: 296445 - RNA, 64 nt, Human
acacauuaggcugugucaccauugugugguguaccugcuggaagaauucuagcaugcuacuugg

SEQ ID NO: 296446 - RNA, 64 nt, Human
agaauguuuuaaaucuggugcaaaagaacuauaucugcuggaugagccuugaaagcagucuugg

SEQ ID NO: 296447 - RNA, 64 nt, Human
agcaggagguggcaaucccgacugcauuucccuccugcuggaauauggaggaagcggaaaugua

SEQ ID NO: 296448 - RNA, 64 nt, Human
aaagcugccucccaguggccacacagaacucucccugcuggacucaccugaggaaagaggcucc

SEQ ID NO: 296449 - RNA, 64 nt, Human
ucagacucuguacuguggggcuuuaaucggagcacugcuggaaaugauugcagagaauguagug

SEQ ID NO: 296450 - RNA, 64 nt, Human
cuggugcuucugcaccgggcgucccugcaucugacugcuggaagaagaaccagacugaggaaaa

SEQ ID NO: 296451 - RNA, 64 nt, Human
uucauucuuuucggcuacucaaccacuccgcaugcugcuggaauauuucuggcuuuagaaguac

SEQ ID NO: 296452 - RNA, 64 nt, Human
aagguauaauaggcuguaaagcugauuuacccuacugcuggacuuuggaaauccuaguuaguuu

SEQ ID NO: 296453 - RNA, 64 nt, Human
ggcuuuucaaagguggcuuuguuagguaguaaaacugcuggauucuucuuccucaaauauuugg

SEQ ID NO: 296454 - RNA, 64 nt, Human
uugaagguggcuuuucugcgaguucuucugccuccugcuggagaacagagacccuucaagaggu

SEQ ID NO: 296455 - RNA, 64 nt, Human
caccacgcgcucuacggaggcuucuccauugucccugcuggagauugggucccucggucucccu

SEQ ID NO: 296456 - RNA, 64 nt, Human
gggccuccccuacaucgcugcugucguccacgcccugcuggaccggccuuaggggugaaggugg

SEQ ID NO: 296457 - RNA, 64 nt, Human
uuguaaaauaacccacuagugccugagcucagugcugcuggaugaugagggagaucaagaaaaa

SEQ ID NO: 296458 - RNA, 64 nt, Human
uucuuuuugaaacagucuuacucugucucccaggcugcuggagugcaguggcacaaucucggcc

SEQ ID NO: 296459 - RNA, 64 nt, Human
uggggucggggggauuaugucacgagcguucaaacugcuggaaaucucaaaacuguacugucuu

SEQ ID NO: 296460 - RNA, 64 nt, Human
aaacauaccugguuguacaacuuuagcaucggggcugcuggaaggguaaaagcuaaauggaguu

SEQ ID NO: 296461 - RNA, 64 nt, Human
gcagugcuuggauucagccuccugcuggguccuucugcuggauacaggcaccaagaggcggucg

SEQ ID NO: 296462 - RNA, 64 nt, Human
auuuuugccucacuuaauuccagccuuuuguuuucugcuggaaaauaaguguggacauugaagc

SEQ ID NO: 296463 - RNA, 64 nt, Human
uugggcacaucugcugguggguggcccagagccucugcuggaaggggcagcaggaggaguggaa

SEQ ID NO: 296464 - RNA, 64 nt, Human
aagacagggacaaacaacucaagugucuuaacagcugcuggagugggauccuuguuaucucuua

SEQ ID NO: 296465 - RNA, 64 nt, Human
gauucuuguuuuaguaaucauucuauaaaugauacugcuggauugauugccguggguugauagc

SEQ ID NO: 296466 - RNA, 64 nt, Human
acuagcacagggaauuuagagguuguagcaucuucugcuggaguaauacucaggcuauucuaau

SEQ ID NO: 296467 - RNA, 52 nt, Human
ugagagcuuccuucaaaugaggcugcuggaucuugcccucuucaggaaagga

SEQ ID NO: 296468 - RNA, 64 nt, Human
uauucauucacaguugccaagagcagcuccgcgccugcuggaucguggaugcagcguaaacauc

SEQ ID NO: 296469 - RNA, 64 nt, Human
uuuguuucccuuaaggaacccucaccaacuaucucugcuggauuugggaguuccgcaucuuuug

SEQ ID NO: 296470 - RNA, 64 nt, Human
gugcuuguguuggcaacacagcgugugcauggggcugcuggaggagagcauuccagagcaguac

SEQ ID NO: 296471 - RNA, 64 nt, Human
gcagaaggguccgaugugccaagugaucaugauucugcuggaaagaggauuuuaaauauugugg

SEQ ID NO: 296472 - RNA, 64 nt, Human
agccugauccagccuuuccaagucacuagaaguccugcuggaucuugccuaaaucccaagaaau

SEQ ID NO: 296473 - RNA, 64 nt, Human
cccaacugugcuugguccucuggcuucucuccuccugcuggagugccagucccugagcucagac

SEQ ID NO: 296474 - RNA, 64 nt, Human
acuggagcuuuuggacagagagcugugccagcugcugcuggagggccuggagggggugcugcgg

SEQ ID NO: 296475 - RNA, 64 nt, Human
gacugucugccacucggcacugggccaccugccccugcuggaggggcaccaugugugagccgcc

SEQ ID NO: 296476 - RNA, 64 nt, Human
cacgaucgagggccuggccucgcuguugguggcccugcuggagaagaccacgugggucgaccgu

SEQ ID NO: 296477 - RNA, 64 nt, Human
gccgcuggaggagaccgacuggucgcacucgcagcugcuggacuugggccccaucgacgcgcuc

SEQ ID NO: 296478 - RNA, 64 nt, Human
ugugcagcuuagcacuuguuguugagaucggacccugcuggaagcagggaaaagaagcgugaag

SEQ ID NO: 296479 - RNA, 64 nt, Human
cauuaucuuucagaaacaggagcccauuucucuucugcuggaguuauugacauucuccugaccu

SEQ ID NO: 296480 - RNA, 64 nt, Human
gaaggccuugcgggggugggguuuguccacagagcugcuggagcagcaccaagagccagucuug

SEQ ID NO: 296481 - RNA, 64 nt, Human
aagguucaacaagagaacggagcugggaaugugacugcuggagccugagagguggaggaguucu

SEQ ID NO: 296482 - RNA, 64 nt, Human
gugaguuugcagaaagcagguggugagcuccugccugcuggagguugccauggagggccauucc

SEQ ID NO: 296483 - RNA, 64 nt, Human
uggccuuuccccaaugcuugaaagaagaucaccacugcuggaggcauaauguacaaggcaggaa

SEQ ID NO: 296484 - RNA, 64 nt, Human
gccccggggcccccuggucaccgagacucagccucugcuggagaaagccacgcccucccugcua

SEQ ID NO: 296485 - RNA, 64 nt, Human
ccacuggggccagcaauacuccagagcccaguuucugcuggaucccauggguggcacauuggga

SEQ ID NO: 296486 - RNA, 64 nt, Human
uccaggauccacacacauccucaccccacagaaacugcuggacacacugaagaaacugaauaaa

SEQ ID NO: 296487 - RNA, 64 nt, Human
cugugggaaaaaagaaaaaccugcucccuucgcucugcuggaagcuggagggugcuaggccccu

SEQ ID NO: 296488 - RNA, 64 nt, Human
agggguugggugcuaagcgcgagccucgccgucccugcuggagcccucgccugccugccccucu

SEQ ID NO: 296489 - RNA, 64 nt, Human
ggugggcccucagcugagggaagguacgagcucccugcuggagccugggacccauggcacaggc

SEQ ID NO: 296490 - RNA, 64 nt, Human
ccgcccgcccaccccgcugccuggcgggcagccccugcuggaccaaggugcggaccggagcggc

SEQ ID NO: 296491 - RNA, 64 nt, Human
ggucaggaggaccuggaguggacuagaaucggggcugcuggaacugggacagcugccuguggcu

SEQ ID NO: 296492 - RNA, 64 nt, Human
cugucuccacgaugguggaaacaguggggaacuacugcuggaaaaagcccuaauagcagaaaua

SEQ ID NO: 296493 - RNA, 64 nt, Human
ccaauccuggaaauucgacacaauuagauuugaacugcuggaaauacaacacauguuaaaucuu

SEQ ID NO: 296494 - RNA, 64 nt, Human
agccaccgcacccaguccugagggguggccucugcugcuggauuucaugucuuccuccagcaug

SEQ ID NO: 296495 - RNA, 64 nt, Human
cuugugggcaagaaggagcuggcaaggaccggcgcugcuggagacugacccagcccucuggcug

SEQ ID NO: 296496 - RNA, 64 nt, Human
ucacuguccauuccaaauagcccacacgugcucucugcuggauucuaaauuaugugaauuuugc

SEQ ID NO: 296497 - RNA, 64 nt, Human
uccagaaacagacccuguuaguccuucuacuuaccugcuggauuuuucaagcacuaaauuuaua

SEQ ID NO: 296498 - RNA, 64 nt, Human
ccgugaggauuccccguguuagagguggggacgccugcuggaggccgccuggcugauguagggc

SEQ ID NO: 296499 - RNA, 64 nt, Human
cgcggaaugacauuaguggaaccgggcuagggaacugcuggaaguucaggaugccaccaccuug

SEQ ID NO: 296500 - RNA, 64 nt, Human
ggccgacugcagccgcuucgacagcccugaccugcugcuggaagccggugacccggccacgucc

SEQ ID NO: 296501 - RNA, 64 nt, Human
ccuccccgcccguugcacccacuuuggcuggcgucugcuggagaggaugucucuguccgcauuc

SEQ ID NO: 296502 - RNA, 64 nt, Human
cauuugcacccuguuaagaauggacuuaaaaguacugcuggacaggcaugugugcucaaaguac

SEQ ID NO: 296503 - RNA, 64 nt, Human
acacuuacugaacagcuugaaggccuuuugaguucugcuggacaggagcacuuuaucugaagac

SEQ ID NO: 296504 - RNA, 64 nt, Human
uuuccaagcaaccgaaguugaguaaguucccacacugcuggaccuguggcaaagagugcuuuga

SEQ ID NO: 296505 - RNA, 64 nt, Human
uccaagucucgcuacauuuccgccacaucccucucugcuggacguccagguggagguggcaucc

SEQ ID NO: 296506 - RNA, 64 nt, Human
aaugcagcacacugaguuuguacaauuguguuaacugcuggaagggacagaugcacugauauau

SEQ ID NO: 296507 - RNA, 64 nt, Human
ggaggaauuaguugggaugccaauuuccucuccacugcuggacaugagauggagaggcugaggg

SEQ ID NO: 296508 - RNA, 64 nt, Human
cuagacacugaugccauugugugcugccucaagacugcuggagucaggacauuuuauagagccu

SEQ ID NO: 296509 - RNA, 64 nt, Human
ucugacaguaugaaguccagaugugucccugaugcugcuggaggcugcuguggcacaaagaaaa

SEQ ID NO: 296510 - RNA, 64 nt, Human
gacucucccguggaugacggaugaggacucugggcugcuggaauaggacacucaagacuuuuga

SEQ ID NO: 296511 - RNA, 64 nt, Human
gcguccaaggcacacaggguacuuucuggacccacugcuggacagacuugaaggugucaugccc

SEQ ID NO: 296512 - RNA, 64 nt, Human
ccaaugauuauccauauguguucuuaauuuuuaacugcuggaaguguuaaaacacacacacaca

SEQ ID NO: 296513 - RNA, 64 nt, Human
uccccagcccagacccccaggugcccaaggccugcugcuggagcaggcaccuugggcugggccu

SEQ ID NO: 296514 - RNA, 64 nt, Human
guuucuacugacucucuaggcugcgggcuccuggcugcuggagcugagcgggacgcuggaggga

SEQ ID NO: 296515 - RNA, 64 nt, Human
uggagcuuugugacacuugggaggcaaacacaagcugcuggaacucauccucaacaagccaggg

SEQ ID NO: 296516 - RNA, 64 nt, Human
ggugucucucuuuggagaaaccaaccagauacaucugcuggagagcccaggugggcacagagaa

SEQ ID NO: 296517 - RNA, 64 nt, Human
uuggaauuggaaacagaaaauucgccaggccauacugcuggagcccauucagauaaaacugccc

SEQ ID NO: 296518 - RNA, 64 nt, Human
auacuguauuucuccaaggcuguuggucuacaaccugcuggagauguaaauuugccaugacuuc

SEQ ID NO: 296519 - RNA, 64 nt, Human
acgucccucccugcugcugcuggggaggggcaggcugcuggagccgcccucugaguugcccggg

SEQ ID NO: 296520 - RNA, 64 nt, Human
acuggaggucuuuuagccugcccuugcauggcgccugcuggaggaggagagagcucugcuggca

SEQ ID NO: 296521 - RNA, 64 nt, Human
ggccucuuuacugaccaacugaaguauagacuuacugcuggacaaucugcaugggcaucacccc

SEQ ID NO: 296522 - RNA, 64 nt, Human
ccacuuugccacccuggcacugauccugcuggugcugcuggaggcucuggcccaggcggacaca

SEQ ID NO: 296523 - RNA, 64 nt, Human
ugacuucugacucuaaaagcaaucaaacauguuucugcuggacagugaccaagaauuauaguac

SEQ ID NO: 296524 - RNA, 64 nt, Human
ugggacggaagccaagccauuauggcagaugaaccugcuggauuuguaaauaauuuaaaauccu

SEQ ID NO: 296525 - RNA, 64 nt, Human
cagccucccaaaaggacagagaacuaaaaaauugcugcuggagaaggugaaagucgcuuuggga

SEQ ID NO: 296526 - RNA, 64 nt, Human
cucagcuccccuggagccagcugauccuguaacgcugcuggaggucagucugagcuaccaagac

SEQ ID NO: 296527 - RNA, 64 nt, Human
agacauccuagcaaccagccccugcugccccauccugcuggaaucaacacagacuugcucucca

SEQ ID NO: 296528 - RNA, 64 nt, Human
gaguuuguuuaaaauugaaauuaguuauuuucuucugcuggacaguauuaaauagagcaggaug

SEQ ID NO: 296529 - RNA, 64 nt, Human
gcagcagggucccaaagguagcuggauggcugaacugcuggauaugggagauacaugacgcgaa

SEQ ID NO: 296530 - RNA, 64 nt, Human
uguuuugugaacuaugucuuacaugucuagaguucugcuggaucuagggaaaggaggagcuauc

SEQ ID NO: 296531 - RNA, 64 nt, Human
cauuugucaugagguuuuuggauuugccaaugaucugcuggacaucaugccccaugucauagag

SEQ ID NO: 296532 - RNA, 64 nt, Human
aacaaucuggaaggaaacuucacggacaggaagacugcuggagaagagaagcguguuagcccau

SEQ ID NO: 296533 - RNA, 64 nt, Human
gcaagaugcuccuacccugauagaucagggguggcugcuggaggcugugcuggggaucugaggu

SEQ ID NO: 296534 - RNA, 64 nt, Human
gaggguuaaggcucagggauuuuauuucagugaacugcuggaacucacacaugcccugauaugu

SEQ ID NO: 296535 - RNA, 64 nt, Human
uuuuucuuguuuuauauuaugaccacacacaucucugcuggaaagucaacauguaguaagcaag

SEQ ID NO: 296536 - RNA, 64 nt, Human
cuagcaaccagggcgggccaguugggcaauggagcugcuggagcccgguacccacucagcucug

SEQ ID NO: 296537 - RNA, 64 nt, Human
accaguccuagcccugguccauacgggcucccaacugcuggaaguacagacuggcacagcaaca

SEQ ID NO: 296538 - RNA, 64 nt, Human
aagaauucauguggguguuucuuauccuuacauucugcuggauacguuuaccccucuugucuuc

SEQ ID NO: 296539 - RNA, 64 nt, Human
gaaggaaggacggaagcaaggaaggaaggaagggcugcuggagcccagucaccccgggaccgug

SEQ ID NO: 296540 - RNA, 64 nt, Human
acacaggcaccccacacaaaccuauuuauugaaucugcuggacccaagcggcucuccagcccuu

SEQ ID NO: 296541 - RNA, 64 nt, Human
cacagagaauccauuuucuacacauuaacuugagcugcuggagggacacugcuggcaaacggag

SEQ ID NO: 296542 - RNA, 64 nt, Human
ucaacgugcauguuacuacuuaaaacuagucuuucugcuggaaucuaaggaguauauauauaua

SEQ ID NO: 296543 - RNA, 64 nt, Human
ugcagcccugggcucugucucuacucccagggaccugcuggaaggcuggagugcccagggagag

SEQ ID NO: 296544 - RNA, 64 nt, Human
aauuuucucacuuguauuauuauuugaauggaugcugcuggaggaaucaguuggaauugaagac

SEQ ID NO: 296545 - RNA, 64 nt, Human
gugugccgccgggcgacgugcauugauggggaagcugcuggaggagcaggggugggggguggga

SEQ ID NO: 296546 - RNA, 64 nt, Human
gcccaccugggugcacugggacggguccccagaucugcuggaaugauuguccgggcccugcaga

SEQ ID NO: 296547 - RNA, 64 nt, Human
auuuacugauaguuuggcugcacuguggaaaagccugcuggaagucucccugccgugggcucuc

SEQ ID NO: 296548 - RNA, 64 nt, Human
augagcccugcgagcaauagaguugaagcagccucugcuggacaguggacuguucuauuuuuuu

SEQ ID NO: 296549 - RNA, 64 nt, Human
uggaggaaaaggaaccaaguuaacugagauacugcugcuggaaugggcgagacauugcugcaaa

SEQ ID NO: 296550 - RNA, 64 nt, Human
gagggagagauguaguggauucugugagacauaccugcuggaguugaagcaguaaauagcaugu

SEQ ID NO: 296551 - RNA, 64 nt, Human
ugaugucacauccuuugacccuggucugagcugacugcuggaagaugaucuuucugcacugaga

SEQ ID NO: 296552 - RNA, 64 nt, Human
gugggucucagucugcuugaauggugaugagauucugcuggaucucagcacgcugcaggugucu

SEQ ID NO: 296553 - RNA, 64 nt, Human
uuucagauucaguuagcaaaccuugaugaagcaccugcuggacacugagggacccaaagcucaa

SEQ ID NO: 296554 - RNA, 64 nt, Human
uccugauaccuauaaguucacccccaccccacagcugcuggagagaaaucccaagaggcagccc

SEQ ID NO: 296555 - RNA, 64 nt, Human
agucaaugcaucagucagagaagaacucucauggcugcuggagguaccagcuggacaagguguu

SEQ ID NO: 296556 - RNA, 64 nt, Human
ucuauuuuuaaaaaauguaucucuuuagccuuuucugcuggagauuauauuaggaaguuucauc

SEQ ID NO: 296557 - RNA, 64 nt, Human
ucugugcuggccagcgagcgcccagcuccugacacugcuggagaggccccagccgcuuggcgau

SEQ ID NO: 296558 - RNA, 64 nt, Human
uguggcucuuucuccugaccaucaugggaagugucugcuggauuccauuuucuaagaguuucug

SEQ ID NO: 296559 - RNA, 64 nt, Human
uuaaugauggguaaucaaaacauucacauuuauucugcuggauuuaaaaauauguacuuuuuuu

SEQ ID NO: 296560 - RNA, 64 nt, Human
ugcguugcuagaaggagaaauagaagaccuugaccugcuggagugcuacuuccuggaggcuuug

SEQ ID NO: 296561 - RNA, 64 nt, Human
gcagguacugccagccauaccuuccugguagcaucugcuggaccuaaguaaggcaugucugucu

SEQ ID NO: 296562 - RNA, 64 nt, Human
gaaaacuacuuuuuggucaugaaauuguucaucgcugcuggagaaugaacgucauugcgauuua

SEQ ID NO: 296563 - RNA, 64 nt, Human
gaccagguggcugcugcaggagcuggugcuguuccugcuggaguggagugucuggggcuccugg

SEQ ID NO: 296564 - RNA, 64 nt, Human
ccuucuccugggcucccguagcacacuauaacaucugcuggaguguugcuguugcaccauacuu

SEQ ID NO: 296565 - RNA, 64 nt, Human
aaaguguggaagccagggcccagggaaggcagugcugcuggaaauggcuucuuuaaacugugag

SEQ ID NO: 296566 - RNA, 64 nt, Human
cuauucagauuaugagagcaucagaguauuaucacugcuggaggaauuuugucaacuacccacc

SEQ ID NO: 296567 - RNA, 64 nt, Human
gcucaccugacagccgagggacacgagcaucacucugcuggacggaccauuaggggccuugcca

SEQ ID NO: 296568 - RNA, 64 nt, Human
uuguaauuucacuuucaucuugcuuaauaaauaucugcuggauucuuucauucacuuuuuuaca

SEQ ID NO: 296569 - RNA, 64 nt, Human
caugcagcaccaggggauaugcccaacucacugccugcuggaagcucugugggaaucagaugaa

SEQ ID NO: 296570 - RNA, 64 nt, Human
ccguguccagcugugacugugcggugggcuccaucugcuggacaaaaggggaacugcaccaugg

SEQ ID NO: 296571 - RNA, 64 nt, Human
aaagagcaggaguccugggucuucccaguugagacugcuggagcugagacacaguacucucuua

SEQ ID NO: 296572 - RNA, 64 nt, Human
auccaguugcacuaaauuccucucugaaucuuggcugcuggagccauucauucagcaaccuugu

SEQ ID NO: 296573 - RNA, 64 nt, Human
gggggccuggagauacagagagcccaaauaaugccugcuggauugucuccugaugaguacaugu

SEQ ID NO: 296574 - RNA, 64 nt, Human
gggacgugugcuuguggggcacagguggcggccccugcuggagcccggcugggcgcagcgccua

SEQ ID NO: 296575 - RNA, 59 nt, Human
agcuuaacuacaagguguaggcaugcccacugcuggacacguccccgacucguggccac

SEQ ID NO: 296576 - RNA, 64 nt, Human
cuauccauaccaaggaggccagccuggcccugagcugcuggauacagcuggaccugaauuccug

SEQ ID NO: 296577 - RNA, 64 nt, Human
caaggcccuugugggcacgagagugcggcccuugcugcuggagaucugaggucacugcugugag

SEQ ID NO: 296578 - RNA, 64 nt, Human
agggcgugggaagagcagggcuugcccagcgacacugcuggacaggaauuaacucuccaaaggu

SEQ ID NO: 296579 - RNA, 64 nt, Human
caaauaugggaucuucucccacacucacaucuaucugcuggagaccauccccuccgagauccag

SEQ ID NO: 296580 - RNA, 64 nt, Human
aggaaaacagaaagggcuugaaauuuaauaagugcugcuggaaggggauuuuccaagccuggaa

SEQ ID NO: 296581 - RNA, 64 nt, Human
ggagaacuucuacccccuggaggggggccgggugcugcuggacggcaagcccaucagcgccuac

SEQ ID NO: 296582 - RNA, 64 nt, Human
ugccuuuucaauaucaaauaaaaccaucagcauccugcuggauugauagcaaaggauuuccaaa

SEQ ID NO: 296583 - RNA, 64 nt, Human
uuuuuuuaaaaacuggaacagugugauaggaagccugcuggaugauuucuuaaauauucuaaaa

SEQ ID NO: 296584 - RNA, 64 nt, Human
auucuccaacgauauacaaauuggacuuguucaacugcuggauauaugcuaccaauaaccccag

SEQ ID NO: 296585 - RNA, 64 nt, Human
augcuucauuuaaucaggaauaauccuuuuuuuucugcuggacauguauaaauuucacuggauu

SEQ ID NO: 296586 - RNA, 64 nt, Human
uaucaaaguucuuacaguuaauuacugcaacuugcugcuggacaauuguauacagaguuaaagg

SEQ ID NO: 296587 - RNA, 64 nt, Human
gagagccccuuuugacagaaagcccagcacgacccugcuggaagaacugacagugcccucgccc

SEQ ID NO: 296588 - RNA, 64 nt, Human
acuguacacgcuguauauaggggucaaugugaugcugcuggagacgagaauaaacuggacuaga

SEQ ID NO: 296589 - RNA, 64 nt, Human
caaaagaucaauuccaagggacaccuggaaccuccugcuggacuuuggaaacaugauugcggau

SEQ ID NO: 296590 - RNA, 56 nt, Human
ggccccgugugaugggcuagccggaccugcuggaggcuggucccuuuuugggaaac

SEQ ID NO: 296591 - RNA, 64 nt, Human
guuagggucaaggguguccuccacucuuuaacagcugcuggacagacacauuagagcagcuguu

SEQ ID NO: 296592 - RNA, 64 nt, Human
aguaggccuggggcuaugcauacgcauuaagggccugcuggagaaaccuucacuccagacagac

SEQ ID NO: 296593 - RNA, 64 nt, Human
caggaggcggcagccgggcgcacccucgccagcccugcuggaguuugcugugggcacugaggcg

SEQ ID NO: 296594 - RNA, 64 nt, Human
gcuuauuuuagggccagcggcaggggacuccagccugcuggacacuucaguccagcucucuccu

SEQ ID NO: 296595 - RNA, 64 nt, Human
aucuuuggacggugagaucucacagaugucagaacugcuggaacuaugaaaugggguauauaac

SEQ ID NO: 296596 - RNA, 64 nt, Human
uaacucagugaguggcuuccaggggccccaggcccugcuggaugugggccaagcccuacagcuu

SEQ ID NO: 296597 - RNA, 64 nt, Human
cgguccccacgcccagcggcccacccaccagcagcugcuggaggucguaguggcuggaggaggc

SEQ ID NO: 296598 - RNA, 64 nt, Human
cagccagcaaacgaaaccauaucgcaaaccagagcugcuggaaaccagcacacgcaaaagauga

SEQ ID NO: 296599 - RNA, 64 nt, Human
gcacugggggacaugggaggggucuagcuggccacugcuggaggcagcgcuggucgucaccugg

SEQ ID NO: 296600 - RNA, 64 nt, Human
ccaggccccacuccagugcugcccacacucccagcugcuggaggagaggggagaugccaaggug

SEQ ID NO: 296601 - RNA, 64 nt, Human
uagaccaaggaacaaaaaaaccacaaaggccaaacugcuggacgucuuucuuuuuuuccccccc

SEQ ID NO: 296602 - RNA, 64 nt, Human
ggagccuuaggaugcagcaugccuucaggagacacugcuggaccucagcauucccuugauauca

SEQ ID NO: 296603 - RNA, 64 nt, Human
cugccccaggcuuccuuucagaggaaggccuguccugcuggaacuggagccaaggggaggcugc

SEQ ID NO: 296604 - RNA, 64 nt, Human
uggggacccugcacccuccgggaagccauggagucugcuggaggcaccauaucagccugcggga

SEQ ID NO: 296605 - RNA, 64 nt, Human
gccacugcuagggguaccccagcugcugccacuccugcuggagggugaacuggggacccugcac

SEQ ID NO: 296606 - RNA, 64 nt, Human
cuagcccugccaccccacugcccuccugggccuucugcuggaugggcaccugggggguucuggu

SEQ ID NO: 296607 - RNA, 64 nt, Human
ccaugcaccugcccugggugaggaaguagcauugcugcuggaugagaaacgccugcgcugcucu

SEQ ID NO: 296608 - RNA, 64 nt, Human
cagacuggcauugcucggguaccacuugcuggagcugcuggaggcccugggguugguagggcag

SEQ ID NO: 296609 - RNA, 64 nt, Human
ggaguaccagcuggugugccaauuccccaggccccugcuggauuggcaggcccuguccgaggag

SEQ ID NO: 296610 - RNA, 64 nt, Human
uucuucccuguccuccacccuggaccccagccggcugcuggagcccagaggccaccuucucccu

SEQ ID NO: 296611 - RNA, 64 nt, Human
caaguccaaccaccgcaaugaguucuggagugcucugcuggagaaggcuuaugcuaaguaagca

SEQ ID NO: 296612 - RNA, 64 nt, Human
ugugaaaaaguaauuauguuuauaaauagacuaacugcuggauguuaccaccaaguaagaaagc

SEQ ID NO: 296613 - RNA, 64 nt, Human
caauggcgagccaagccgggcugugcuggaugcccugcuggagggcaaggcccaguggggggag

SEQ ID NO: 296614 - RNA, 64 nt, Human
aaugcucgucuccuuagcguccaggguggggauucugcuggaauaaagagcuuccucagugacu

SEQ ID NO: 296615 - RNA, 64 nt, Human
gcuggcccagaaggaggaggagaugaaggugaagcugcuggagcugcaagaguugguguugccc

SEQ ID NO: 296616 - RNA, 54 nt, Human
aaaagauccaaaagauuugaacuccugcuggaauacaaaauucuugagcaucug

SEQ ID NO: 296617 - RNA, 64 nt, Human
aggagaaaaagccuccaguccaaggaaaccacagcugcuggagacuccuaggcaggacaugcug

SEQ ID NO: 296618 - RNA, 64 nt, Human
aaccuaggcccuccuugaaguuuacacuuugccacugcuggaggcuccccugaguccucugcau

SEQ ID NO: 296619 - RNA, 64 nt, Human
agaaauaacccuguggauggaauuggggcagcggcugcuggagaucugugugccuugccuuccu

SEQ ID NO: 296620 - RNA, 64 nt, Human
uuuuuugagacacagucucgcucuguugcccaggcugcuggagugccguggcgcaaucucggcu

SEQ ID NO: 296621 - RNA, 64 nt, Human
gcuggcucaggacaaggaggagaugaaggugaagcugcuggagcugguguugcagcuugugggc

SEQ ID NO: 296622 - RNA, 64 nt, Human
gcaagaggagaggaugcuggagcaagaggagaggcugcuggagcuugaguggaaagccgagccu

SEQ ID NO: 296623 - RNA, 64 nt, Human
gcaaccccggggcgcugcuuggcaccuuagcagacugcuggaaccuuuuggccaguaggucgug

SEQ ID NO: 296624 - RNA, 64 nt, Human
aacuguagcugcccccgugucacccccgccaucacugcuggacaggagccacccccuuggguac

SEQ ID NO: 296625 - RNA, 64 nt, Human
acggcagcgccuugcccagaccuccccugcccaccugcuggagcccagccugugccgcccucug

SEQ ID NO: 296626 - RNA, 64 nt, Human
gggcguggaggacuggccuuggccccccagggggcugcuggacuuugggagagacagcccacac

SEQ ID NO: 296627 - RNA, 64 nt, Human
gcuuaaaggggcuguggcugaggcuguagcaucucugcuggaggugagacacucugggaacuga

SEQ ID NO: 296628 - RNA, 64 nt, Human
gcacucugcguuuucccguguuuggggcugaggccugcuggacagauggcuggccaagugggag

SEQ ID NO: 296629 - RNA, 64 nt, Human
ucuguuuucuucacuucccuuugcaucugagauccugcuggaaaccacagcaaccuguauccac

SEQ ID NO: 296630 - RNA, 64 nt, Human
gugacugcucagaggccgggcuucuuuucaaguacugcuggaucauacucaccccuugggauua

SEQ ID NO: 296631 - RNA, 64 nt, Human
uauugauaaaaagagcuccccuuugcugacagaacugcuggauuugguucucauugguccagac

SEQ ID NO: 296632 - RNA, 64 nt, Human
caggacucugcccagaccacacguagcccccaggcugcuggacacgucggacagcgaaguaucc

SEQ ID NO: 296633 - RNA, 64 nt, Human
aagugggacuucccgucgccugcgagccugcggccugcuggagccugcgcagcuuggauggaga

SEQ ID NO: 296634 - RNA, 64 nt, Human
cccagccccugucccagcucccgaccugcacuuccugcuggacucaggccuccagcucccugcc

SEQ ID NO: 296635 - RNA, 64 nt, Human
agguaucuccugacagagguacuuaacaauggcucugcuggaaauuucuauaaauaaaaugucc

SEQ ID NO: 296636 - RNA, 56 nt, Human
aggggcuggggcugaacugagggcuccugcuggauuccgaaaaggccgggaagcca

SEQ ID NO: 296637 - RNA, 64 nt, Human
cuucucccuccuguccuguccuugccccucaggacugcuggaaaauaaauccuuuaaaauagug

SEQ ID NO: 296638 - RNA, 64 nt, Human
uuggcagcagugcuccccagaucccagaaggucccugcuggaguguuuccagugcaccuguagg

SEQ ID NO: 296639 - RNA, 64 nt, Human
gcuacggcuccugcuagagaggguggcaggccugcugcuggaccccagaggccacugugaccgc

SEQ ID NO: 296640 - RNA, 64 nt, Human
ggugccccgcccaugcuggauaggaccugggaugcugcuggagcugaaucggaugccaccaagg

SEQ ID NO: 296641 - RNA, 64 nt, Human
agaagcacggaaugugaacuggugccccggcagccugcuggacucccagaccccauccagccag

SEQ ID NO: 296642 - RNA, 64 nt, Human
caucugugcauaucacggccccccagggcaguuccugcuggaccagacucucuggcagaggagg

SEQ ID NO: 296643 - RNA, 64 nt, Human
aaaaaagggugaccugugauuuuuuuucuuauaccugcuggaagucaguacaaugcgucaaaag

SEQ ID NO: 296644 - RNA, 64 nt, Human
cccaggcccugagaggacagagaugaccacaucccugcuggaugcaggacccguccaaagaugc

SEQ ID NO: 296645 - RNA, 64 nt, Human
acaucugggaaacuucugggugcugggugcucugcugcuggacuuuuguggcugugucuguguc

SEQ ID NO: 296646 - RNA, 64 nt, Human
uagagguaaagacauagugacaaauggcuacagacugcuggaaagguagcaggugaugccaagg

SEQ ID NO: 296647 - RNA, 64 nt, Human
ucuguuuucuucacuucccuuugcaucugagauccugcuggaaaccacggcaaccuguauccac

SEQ ID NO: 296648 - RNA, 64 nt, Human
uaauaaagucuguauauacauguacacuuugauccugcuggaaaauuuuaucagcaaacacauu

SEQ ID NO: 296649 - RNA, 64 nt, Human
ucucccuaauaagauuauuaauuugacuugaaaacugcuggaacaauagugauuaauaaagaua

SEQ ID NO: 296650 - RNA, 64 nt, Human
cauccacgggacccugaaacuccacuuggccuaucugcuggaccugcuggggcagaguugauug

SEQ ID NO: 296651 - RNA, 64 nt, Human
ggggcacguggagcaagagauccugguccccucccugcuggaccugccacccagagcuuccugc

SEQ ID NO: 296652 - RNA, 64 nt, Human
ccugccuucguccugagagcuucugugugucaggcugcuggaaagaagacuccauucccaggac

SEQ ID NO: 296653 - RNA, 64 nt, Human
cuccgccucugcccgggagaaagcccaggccagccugcuggacaagcagagaccaugagaagga

SEQ ID NO: 296654 - RNA, 64 nt, Human
augagaagccaaauggugcucgcaauugugcuugcugcuggacuggcaagcuucauguuauguu

SEQ ID NO: 296655 - RNA, 64 nt, Human
cggccgagaggcacacacugccuucacgacgugacugcuggaccuggccgagcuugaggccaca

SEQ ID NO: 296656 - RNA, 64 nt, Human
ggcugaagaagaggccuguggaaugcagcauuaccugcuggacagagcagggcaggcaguucua

SEQ ID NO: 296657 - RNA, 64 nt, Human
ccuuccucagccgcagcagcaccuggggcuccagcugcuggaauccuaccaucccaggaggcag

SEQ ID NO: 296658 - RNA, 64 nt, Human
uucugguccaggcagaucaggggcucuggggaaacugcuggaacucgaggugaggaucagccuu

SEQ ID NO: 296659 - RNA, 64 nt, Human
aaaugacuucuagggugaagccugggugaugaggcugcuggaagcuuugaagucucccauuccc

SEQ ID NO: 296660 - RNA, 64 nt, Human
ccucgccuccaguggaggcugagcugacccugggcugcuggaggccagacugggcuguaguuag

SEQ ID NO: 296661 - RNA, 64 nt, Human
ggagggguacauggcugugaugggggagguggugcugcuggacugagccaguggagggggaaga

SEQ ID NO: 296662 - RNA, 64 nt, Human
ucugaggggacugacucuggcaucucugccgaggcugcuggaaucgacuggggcaucuucccgg

SEQ ID NO: 296663 - RNA, 64 nt, Human
gaucucugacuucuagagccccagcugcuggcggcugcuggaauauccuaccugauaggauuaa

SEQ ID NO: 296664 - RNA, 64 nt, Human
agaugcuacaaaaccucaugccuacugucugccacugcuggagaaggaaucaugguuucuagaa

SEQ ID NO: 296665 - RNA, 64 nt, Human
uugguggauccauguauguguccagcacagcggccugcuggacucugagaacugggaaagauca

SEQ ID NO: 296666 - RNA, 64 nt, Human
uugcagcuugugauuucuuccagcuugggaggggcugcuggaaguggcauuucguucagagcug

SEQ ID NO: 296667 - RNA, 64 nt, Human
cagcaaccugcuucugacuggccagcccccuccccugcuggaggaggggagaagccccgcucug

SEQ ID NO: 296668 - RNA, 64 nt, Human
ugggacacuucccugggccucaacaaggaucaggcugcuggaaacacagucacuugggagcugc

SEQ ID NO: 296669 - RNA, 64 nt, Human
acgaagacccacagcaucacccacugcuucgccucugcuggaacaagcaggacccuaacuaccu

SEQ ID NO: 296670 - RNA, 64 nt, Human
gauccauggagacugcgagaccguggcaccccuacugcuggagaccacaguccugauguggacg

SEQ ID NO: 296671 - RNA, 64 nt, Human
gagccuggggcaugcucuucaggcaugcucuugccugcuggauugccggcggcggcccugggac

SEQ ID NO: 296672 - RNA, 64 nt, Human
caaacgaggucacuucccauucacacauguccgucugcuggaucaacagaaucccgaugaggac

SEQ ID NO: 296673 - RNA, 64 nt, Human
ccuccucgcccucuggggacuuguagucugucaccugcuggauuuggccccaaguucaaggccc

SEQ ID NO: 296674 - RNA, 64 nt, Human
ugauuccccaagggcacccgcucucccucccucccugcuggaggaacacgucauaucagaugag

SEQ ID NO: 296675 - RNA, 64 nt, Human
uagccaggaaacccucuucuucccuggucuggcucugcuggagcgggugggaaccaaacaccuu

SEQ ID NO: 296676 - RNA, 64 nt, Human
gggguggggggcaguucagugaagucuagaagaccugcuggacaaauucuaaaagagcuagagc

SEQ ID NO: 296677 - RNA, 64 nt, Human
agggacggaaugccuggucuugagcaaccucccacugcuggagugcgagugggaaucagagccu

SEQ ID NO: 296678 - RNA, 64 nt, Human
guaggcucagaaaugaagggaaccccucagugggcugcuggacccaucuuucccaagccuugcc

SEQ ID NO: 296679 - RNA, 64 nt, Human
gcauaggcuucgguuuuccccucggaaacugcuucugcuggaggauauguguuggaauaauuac

SEQ ID NO: 296680 - RNA, 64 nt, Human
ccccgugagagggacugucccuugaguuucucaacugcuggaaggagcugugucccagcaagga

SEQ ID NO: 296681 - RNA, 64 nt, Human
cacaagguccagaucacucuggagcaggccagcucugcuggacagugacccucuucccaggccu

SEQ ID NO: 296682 - RNA, 64 nt, Human
gguggccuaagaguugagcucucggaacugcaugcugcuggacaguaucacugucuuuccuaga

SEQ ID NO: 296683 - RNA, 64 nt, Human
gugccccuaccccacgccgccccaccacuauaggcugcuggaguccuggaaccaccugggucgg

SEQ ID NO: 296684 - RNA, 64 nt, Human
agaauggagacggcauucuuggacuucacuggggcugcuggauuggaugggaaaccuucuggaa

SEQ ID NO: 296685 - RNA, 64 nt, Human
aaacugaaagugaaaguccagaaacuguucccaccugcuggagugaaggggccaaggaggguga

SEQ ID NO: 296686 - RNA, 64 nt, Human
ccggcuggagggugagaucaacacguacuggggccugcuggacagcgaggacagcaggcaaguu

SEQ ID NO: 296687 - RNA, 64 nt, Human
ccaucccuugguuuuuggaucauaaugaucuugccugcuggauauuucaguuauaucugugaua

SEQ ID NO: 296688 - RNA, 64 nt, Human
agagccggcaguucccugcaggagagaggaggggcugcuggacccaaggcucagucccucugcu

SEQ ID NO: 296689 - RNA, 64 nt, Human
guaucugggaacugugccuuugaguuuccucaggcugcuggaggaaaacugagacucagacagg

SEQ ID NO: 296690 - RNA, 64 nt, Human
cccggcucggccgccuccgccucugcuacugccgcugcuggaagacagccuggauuuccuuucu

SEQ ID NO: 296691 - RNA, 64 nt, Human
gccccuagagacaacacccuucccaggccacuggcugcuggacuguuccucaggagcggccugg

SEQ ID NO: 296692 - RNA, 64 nt, Human
cuaugcaaaccagcuuuaggucccaauucggggccugcuggaguuccggccugggcaccagcau

SEQ ID NO: 296693 - RNA, 64 nt, Human
uucuguauuaugacaguauuguugugauggccaucugcuggaaacuccugaagagcauuaugua

SEQ ID NO: 296694 - RNA, 64 nt, Human
cgcugcugcuggcuguggcuagagcccccuggggcugcuggagcugcugccucuguucuggagg

SEQ ID NO: 296695 - RNA, 64 nt, Human
uccucugccccccugcaggcaggcccaaguaggacugcuggaggcugugcuuugacauuguaag

SEQ ID NO: 296696 - RNA, 64 nt, Human
ccaacaccugaaaagcaaauuuggcaaagacuaccugcuggagaugaagcugaagaaccuggca

SEQ ID NO: 296697 - RNA, 64 nt, Human
ucuauuagaaugauaucugggaucacaaagccaacugcuggagagguagugaggaaaugguuuc

SEQ ID NO: 296698 - RNA, 64 nt, Human
ugugggccgaucuaaccccuuacccaucucucuacugcuggacuguggagggucaccagguugg

SEQ ID NO: 296699 - RNA, 64 nt, Human
cuuggcccccgccagcuugucccagccacucuagcugcuggaugugauccugggacauguacuc

SEQ ID NO: 296700 - RNA, 64 nt, Human
acugaccgcugggccacacggcugccccucagcccugcuggaacagggucugccugcgagggcu

SEQ ID NO: 296701 - RNA, 64 nt, Human
gacagugugugugugagcagagguggccgcacaccugcuggacaucuuugccaggcugugccuu

SEQ ID NO: 296702 - RNA, 64 nt, Human
agggagaacgggaaguggaccccagcccgggagccugcuggaccccagaucguccccuccuccc

SEQ ID NO: 296703 - RNA, 64 nt, Human
gaucugugucuuccagggaucagcugcuuggcuucugcuggaggugccucccugugggggcgca

SEQ ID NO: 296704 - RNA, 64 nt, Human
gccugaaggcccacaacccccacccccaggacugcugcuggagccuggacacguccuacuuaag

SEQ ID NO: 296705 - RNA, 64 nt, Human
auucagucuuguuccagugacaguuggaaggccucugcuggagagacaccagcucucagggcag

SEQ ID NO: 296706 - RNA, 64 nt, Human
gggcucccacugcuucuggucuccagggacagugcugcuggaaaggcuagugaugagcuucacc

SEQ ID NO: 296707 - RNA, 64 nt, Human
aaggaccugaucauuggggaagcuggcuuucuggcugcuggaggcuggggagaagguguucauu

SEQ ID NO: 296708 - RNA, 64 nt, Human
cagggcuugaaguaggagcccagcaaagaaccaccugcuggacaguccuugacauguguucugu

SEQ ID NO: 296709 - RNA, 64 nt, Human
cucaaggggaaauccaggguaggaagcagcagcucugcuggacugggcucagcagucccauuug

SEQ ID NO: 296710 - RNA, 64 nt, Human
gugggaauccgagcggcucccucgggagcggggacugcuggaacagcggcuauucuucuguuau

SEQ ID NO: 296711 - RNA, 64 nt, Human
gccgagggacccugguggggguggcuccuucucacugcuggauccggacuuuuuaaauaaaaac

SEQ ID NO: 296712 - RNA, 64 nt, Human
ggguguuuuugggggagucgccgccaagcccaggcugcuggagccaggcacccuccucugucac

SEQ ID NO: 296713 - RNA, 64 nt, Human
ccccaugcuggcugugcacugcgcgggccugagacugcuggauacaauguugggcaacaacuca

SEQ ID NO: 296714 - RNA, 64 nt, Human
uccugcccgcucuacccugaccugggcuugucaucugcuggaacaggcgccauggggccugcca

SEQ ID NO: 296715 - RNA, 64 nt, Human
cccccccuuccacuuuuuuuuguauguuuuuuuucugcuggaaacagacucgauucauauugaa

SEQ ID NO: 296716 - RNA, 64 nt, Human
uugauguccccauuuagccaucuccauggagcuccugcuggagggcccugaacccugcacugcg

SEQ ID NO: 296717 - RNA, 64 nt, Human
ccgggcucuccuuucaaaaagccacgucgugcugcugcuggaagccaacagccuccggccagca

SEQ ID NO: 296718 - RNA, 64 nt, Human
cucccucaaagucauaaauccugagugacaacugcugcuggaugacagaucccuucaccugugg

SEQ ID NO: 296719 - RNA, 64 nt, Human
cuuccaguccugucuguguggacuggcaccugggcugcuggagaagucuccucccguucggacc

SEQ ID NO: 296720 - RNA, 64 nt, Human
gagggucagcaucauuggugaacagaugcaggcgcugcuggaccaucuggggagagugacaguc

SEQ ID NO: 296721 - RNA, 64 nt, Human
uacuggaauugcuacacucugacacaaacauuuacugcuggaucgaccacaaagcagauguggc

SEQ ID NO: 296722 - RNA, 64 nt, Human
ccugauccugccccuuccuucuugccuguagcuccugcuggaggaagaggauuccagccuguug

SEQ ID NO: 296723 - RNA, 64 nt, Human
gccccacacaccagucccagcaaggugaccacggcugcuggaccccuucccuguucaggcaggc

SEQ ID NO: 296724 - RNA, 64 nt, Human
gauuucaggcagcaggggcugcugugaugccguccugcuggagugauuuauacugugaaaugag

SEQ ID NO: 296725 - RNA, 64 nt, Human
ugcucuccugccuccaccgccuugguuuugcuuccugcuggaggcagggcaccugcugcgaccc

SEQ ID NO: 296726 - RNA, 64 nt, Human
gagcagcaaacaccagcuccucagcuucgugucccugcuggagaccaacaagccguaccuggug

SEQ ID NO: 296727 - RNA, 64 nt, Human
gcgucccgucuugcacacccaggggccucccuuucugcuggaguccccuguguccucagccauc

SEQ ID NO: 296728 - RNA, 64 nt, Human
uccucuucccuuagccucucccacccggccacagcugcuggagaauaaauuugggaugcugaug

SEQ ID NO: 296729 - RNA, 64 nt, Human
aggaggaggauuaaguccaccugucccuccugggcugcuggauugucucguuuuccugccaaau

SEQ ID NO: 296730 - RNA, 64 nt, Human
ucucuugcuuacaaaugucuaagguccccacugccugcuggagagaaaacacacuugcuuagcc

SEQ ID NO: 296731 - RNA, 64 nt, Human
ucccuugcuuacaaaugucuaagguccccacugccugcuggagagaaaacacacuccuuugcuu

SEQ ID NO: 296732 - RNA, 64 nt, Human
ucucuugcuuacaaaugucuaagguccccacugccugcuggagaaaaaacacacuccuuugcuu

SEQ ID NO: 296733 - RNA, 64 nt, Human
cucucuugcuuacaaaugucuagguccccacugccugcuggaaagaaaacacacuccuuugcuu

SEQ ID NO: 296734 - RNA, 64 nt, Human
ucucuugcuuacaaaugucuaagguccccacugccugcuggagagaaaacacacuccuuugcuu

SEQ ID NO: 296735 - RNA, 64 nt, Human
uuucaauucuuauuggguaccccaaaaaguggaacugcuggaucacaugguacuucuaacuuua

SEQ ID NO: 296736 - RNA, 64 nt, Human
acccaguuugggucaggagggcccagccuugguucugcuggacacuuaugugcaaggauucccu

SEQ ID NO: 296737 - RNA, 64 nt, Human
ccuuuccagaggcccugccgagagcccgugcugccugcuggagccgccugcagacgcgguccuc

SEQ ID NO: 296738 - RNA, 64 nt, Human
ggacgggguugcccuguguucaccacgaguguggcugcuggaucagggcagccggggagguggc

SEQ ID NO: 296739 - RNA, 64 nt, Human
cagacgccacccagcccuggggggaggcccacgccugcuggaccaacgcggguucuggggugca

SEQ ID NO: 296740 - RNA, 64 nt, Human
aacucggucucccucagaucccccgcgagggaggcugcuggacccaccccgcugucccccauga

SEQ ID NO: 296741 - RNA, 64 nt, Human
agagaggagccccacuucacuccggcaggcagaccugcuggagcugcuuugcagaaugacuugg

SEQ ID NO: 296742 - RNA, 64 nt, Human
accuaccuggguccucacuuuccuggggccucaccugcuggagucuucgguggccagguauguc

SEQ ID NO: 296743 - RNA, 64 nt, Human
accugcuggggaccucaccugcuggggaccuuggcugcuggaggcugcaccuacugaggauguc

SEQ ID NO: 296744 - RNA, 64 nt, Human
ggcugccgggaaccucaucugccuggggccucaccugcuggaguccuuuguggccaacccucuc

SEQ ID NO: 296745 - RNA, 64 nt, Human
ggcugccuggggucucaccugccuggggccucaccugcuggagucuuugguggccaggcaugug

SEQ ID NO: 296746 - RNA, 64 nt, Human
gaccauggguuccuuauucuggacaaacccuccucugcuggaacccuggacuuuggccccaguc

SEQ ID NO: 296747 - RNA, 64 nt, Human
caguggcacagcaaguggauccuggcaacugcagcugcuggauuccagauucuggguccccaau

SEQ ID NO: 296748 - RNA, 64 nt, Human
ccccaugccucgagcccuggaucuccaagcucagcugcuggauucuggaugucaacaaaccuca

SEQ ID NO: 296749 - RNA, 64 nt, Human
gaccggcccuuuggagccggcagcccaggggucccugcuggaucagagaaauagaagcacccga

SEQ ID NO: 296750 - RNA, 64 nt, Human
gcacuaucucuaccuggccgccuucaccuggaugcugcuggagggugugcaccucuuccucacu

SEQ ID NO: 296751 - RNA, 64 nt, Human
ccugggcuucuaucccugugaggagaggugcugucugcuggagccucuaguccacccucuccag

SEQ ID NO: 296752 - RNA, 64 nt, Human
gccucggccuccgccccggcccaccaccucgcuacugcuggaaccgcgcagccugcuggugcuc

SEQ ID NO: 296753 - RNA, 64 nt, Human
uauuuugccauaauacaugccaaaauacaagucccugcuggacauucucccuaagcacaucuuu

SEQ ID NO: 296754 - RNA, 64 nt, Human
ggcccuggcuuggaguggguuggcuugcugauggcugcuggaggggacgcuggcuaaagugggu

SEQ ID NO: 296755 - RNA, 64 nt, Human
gcccagaaguaggcgccugcccaccugccaccgacugcuggaacccagccagugggagggccug

SEQ ID NO: 296756 - RNA, 64 nt, Human
gcacccuccaggacaggagaucugggaugccuggcugcuggaguacauguguucacaaggguua

SEQ ID NO: 296757 - RNA, 64 nt, Human
agaaucccauguuuguuacuaggauuuacauuaacugcuggaaucacauuuugcuacuauuuaa

SEQ ID NO: 296758 - RNA, 64 nt, Human
gaccaguuuuggccagaagggcccagccuggguucugcuggaagcugauguggaaggcuucccu

SEQ ID NO: 296759 - RNA, 64 nt, Human
ugugucuugcaggagcuccuuugcauguucuaaacugcuggaggccuuugccagaguuaaauca

SEQ ID NO: 296760 - RNA, 64 nt, Human
aacauuuacuucugguauggaacaacuagaaauacugcuggaaauaauauccaaagagcugauu

SEQ ID NO: 296761 - RNA, 64 nt, Human
cauuuuuuauagaaucauggaaucuagaauauuccugcuggaaagaaccugagaguugguuugg

SEQ ID NO: 296762 - RNA, 64 nt, Human
cuucauugacaacaccuacucgugcucgggcaagcugcuggagagggagaucaaggcgguaagg

SEQ ID NO: 296763 - RNA, 64 nt, Human
gccagcugcccuaugggccugccgggcugagggccugcuggaggccucaggugcuguccauggg

SEQ ID NO: 296764 - RNA, 64 nt, Human
ucccagggcaaggguuaaggccugaaucaugagccugcuggaagcccagccccuacugcuguga

SEQ ID NO: 296765 - RNA, 64 nt, Human
uaacuggauguuuuggcaacuuuguggggagagacugcuggauuucuuaaagcaacguauuccu

SEQ ID NO: 296766 - RNA, 64 nt, Human
uucccacacgauuagcuuuauuauggcuugugaacugcuggagucuggcuuuaccuuuuuguau

SEQ ID NO: 296767 - RNA, 64 nt, Human
aggggcccaaacauguccaguccucuucuucccucugcuggaaccuuuggggacacucaagggu

SEQ ID NO: 296768 - RNA, 64 nt, Human
ggcuccauuuggcaccugcugagccacaguuguccugcuggaugugcugugcagguugguagga

SEQ ID NO: 296769 - RNA, 64 nt, Human
agagggcccaugggagugacugcacccuugguggcugcuggaaggggagagguucucagcauca

SEQ ID NO: 296770 - RNA, 64 nt, Human
ggugugggagagggaugaugaagagagagagggccugcuggagagcauagggucuggaacacca

SEQ ID NO: 296771 - RNA, 64 nt, Human
uucuugagcagaccgugauuuggaagagaggcaccugcuggaaaccacacuucuugaaacagcc

SEQ ID NO: 296772 - RNA, 64 nt, Human
gugcugcugaacucuguugggugaacugguauugcugcuggagggcugugggcuccucugucuc

SEQ ID NO: 296773 - RNA, 64 nt, Human
cauuuuacaaaguaguuuauucuuauuauacuuucugcuggagagugccuugaaauaaaaugug

SEQ ID NO: 296774 - RNA, 64 nt, Human
ccggaggaaggaucaucugagacgcaggaggcaucugcuggagcagcaauuucccaauuuauug

SEQ ID NO: 296775 - RNA, 64 nt, Human
uaacaauugguuuucagggcccaguccaagccugcugcuggaaaccucagaguuaaaucccuau

SEQ ID NO: 296776 - RNA, 64 nt, Human
cauucaggccuuugccagcggguggcccccaguccugcuggaccagcugaacccccagggagac

SEQ ID NO: 296777 - RNA, 64 nt, Human
ggagcccuugaaaggugaaaaguaguggggcccccugcuggacucaggugcccagaacucuuuu

SEQ ID NO: 296778 - RNA, 64 nt, Human
agggguagggauugcaaguaaaggacuuuuuuaacugcuggauuuguuuuuccaacugagucca

SEQ ID NO: 296779 - RNA, 64 nt, Human
ugugauggcaggagggaaccuucagccugucuggcugcuggaccuggacaccagggcucggugg

SEQ ID NO: 296780 - RNA, 64 nt, Human
acucagaccuggggacagaggugaaaugcacaagcugcuggagaaggggucagagccauaucaa

SEQ ID NO: 296781 - RNA, 64 nt, Human
gauuucccugcugccuccauaaacagaaagaggucugcuggauccgcuaagggaucagggagag

SEQ ID NO: 296782 - RNA, 64 nt, Human
auacucuucuauaaauaaaagggaggaauauauucugcuggaagcccaugaaccaucgcugagg

SEQ ID NO: 296783 - RNA, 64 nt, Human
guguuggcaaacgagacuuucuccuggccccugccugcuggagaucagcaugccuguccuuuca

SEQ ID NO: 296784 - RNA, 64 nt, Human
gagaccagcaggccccccaacccagagacugggucugcuggagucuccacacagugguggggag

SEQ ID NO: 296785 - RNA, 64 nt, Human
uucucccaccaucaccgccuguguccuucaggggcugcuggagggcagcccaaagccaggggcc

SEQ ID NO: 296786 - RNA, 64 nt, Human
cuuuggugcuuaacacacaacacagcugcagacccugcuggaggccgagggcuccaggugcuau

SEQ ID NO: 296787 - RNA, 64 nt, Human
caauucuuacuccacggguucaugacagccuauucugcuggagacugugucuuaaaacuuccuc

SEQ ID NO: 296788 - RNA, 64 nt, Human
accucugauucaaaacuuauuagaacaguagcuucugcuggaauuugcaaucacugaagucaua

SEQ ID NO: 296789 - RNA, 64 nt, Human
uuuauuuuguuugcugucugucuccccugccccacugcuggaacagaggcuccaagaaaacagg

SEQ ID NO: 296790 - RNA, 64 nt, Human
auuuuauuucacuuguguuuugucuuaaacccuacugcuggaaacaauuuuauguaauaagcaa

SEQ ID NO: 296791 - RNA, 64 nt, Human
gggcugugcaccuuguacuauuucacaauggguucugcuggacagauaaugggccaguguuauu

SEQ ID NO: 296792 - RNA, 64 nt, Human
cucagcguccucccugccccucuccccuucacaccugcuggagccugugagggagguggcgggu

SEQ ID NO: 296793 - RNA, 64 nt, Human
uuuacugguugaucucuuggugguuuucaacuuccugcuggaaacuagagguggggcacccccc

SEQ ID NO: 296794 - RNA, 64 nt, Human
ugcuuccucuuucaggguugacgccaugguggaccugcuggaccuggacccacugaagaggucg

SEQ ID NO: 296795 - RNA, 64 nt, Human
augcugcguaauuacccuucagcucuuaguuccucugcuggaaacaucaugccaacaacuuaca

SEQ ID NO: 296796 - RNA, 64 nt, Human
aauuuuggaugagcauggagcugucaccucucagcugcuggaugacuugagaugaaaaaggaga

SEQ ID NO: 296797 - RNA, 64 nt, Human
aggggagcacuuggggcagcccccagaaggaccacugcuggaucccagggagaaccugcuggcg

SEQ ID NO: 296798 - RNA, 64 nt, Human
cugagugggcuucucugggagcucuccaguggcacugcuggaccugcccacguuucuguaaaau

SEQ ID NO: 296799 - RNA, 64 nt, Human
cagcuguaaggccaguccagggaacccuccccugcugcuggaaacccuucugaguuggcccugg

SEQ ID NO: 296800 - RNA, 55 nt, Human
cagcagcacuccccuauugaaagaccugcuggagcucacaaggugaggggcuggg

SEQ ID NO: 296801 - RNA, 64 nt, Human
gacgcgaccccucagacagggguccaagaagccccugcuggaggacgacccucagggugccagg

SEQ ID NO: 296802 - RNA, 64 nt, Human
ucuuucccaaagugcuuacuuggaaagaguguggcugcuggacucuuuucgaaaugccccucug

SEQ ID NO: 296803 - RNA, 64 nt, Human
caggaagagccucagcuccaggcuggggcucuggcugcuggagcaucugcuggcugguggggug

SEQ ID NO: 296804 - RNA, 64 nt, Human
ucugccugagugggccucucaggucacucgugcccugcuggaggacagaggggcaccucagccg

SEQ ID NO: 296805 - RNA, 64 nt, Human
uccugagcuggugacccuccugccacccaagcugcugcuggaccuaggccuggcccuccgccug

SEQ ID NO: 296806 - RNA, 64 nt, Human
cagauucaccuuuuuucaccccacacuugcagagcugcuggaggugaggucaggugccucccag

SEQ ID NO: 296807 - RNA, 64 nt, Human
uuuuguuacugaauugccugucccugagcuuggccugcuggagcaugaugcuggaggcugugug

SEQ ID NO: 296808 - RNA, 64 nt, Human
uuagccgacaacagagacuggacugugggcccuccugcuggagccaggccuuccuccugggcgc

SEQ ID NO: 296809 - RNA, 54 nt, Human
ugagcagcagcauggccugaggggcugcuggacugaccgaggggcugcccagca

SEQ ID NO: 296810 - RNA, 64 nt, Human
uguugucaugucacucaccccaagcaccugcuggcugcuggaagcauaccccaagaccccaagc

SEQ ID NO: 296811 - RNA, 64 nt, Human
cuucaguucccuuccacuugaguucucucuucuccugcuggaagccgccccucucugcgaugga

SEQ ID NO: 296812 - RNA, 64 nt, Human
acccacuugcuggacagucugagccaagucccuccugcuggagaaaagccuggaacugccaaaa

SEQ ID NO: 296813 - RNA, 64 nt, Human
gcucagugggccuggggccucucugacguggugccugcuggagggaggcucgucgucaccagcu

SEQ ID NO: 296814 - RNA, 64 nt, Human
aguuccgguaguggccaucuuacauucucauguccugcuggaagugccuaguugccugcaaagc

SEQ ID NO: 296815 - RNA, 64 nt, Human
cagcauuuggccaagcucggaggcuuggccagcacugcuggauggcucagagcaagcugggcuc

SEQ ID NO: 296816 - RNA, 64 nt, Human
ccgccgugggguguauugacuggucccccaugggcugcuggaaaggcccggagaugcaucugug

SEQ ID NO: 296817 - RNA, 64 nt, Human
cgcccagcgcuuuggaaaccacauccgcaaagcccugcuggacauugcugaucuuuuccaaguu

SEQ ID NO: 296818 - RNA, 64 nt, Human
ggaccugcccccaacuggccucccugagaugaaccugcuggagauguacagccugaaggaugag

SEQ ID NO: 296819 - RNA, 64 nt, Human
ucucuuaaaaugacaaaaaguguccauaaagaggcugcuggagagugcguggccauagggagcc

SEQ ID NO: 296820 - RNA, 64 nt, Human
uuccuuuacacauaacuacaccugacaccaggcucugcuggaugugaguuuccacugcaugggc

SEQ ID NO: 296821 - RNA, 64 nt, Human
uuaaaaaaaaaaaaagguuaaaccgguuucucuacugcuggacuuuucagagucuuucauaugc

SEQ ID NO: 296822 - RNA, 64 nt, Human
aggaagagcuuuaguucccaggcugaaccugccacugcuggagccauuucaacaaggcauccuc

SEQ ID NO: 296823 - RNA, 64 nt, Human
caguugagauacccuacaccaaccagauuuucaacugcuggacauaugaaugaagcuauccuag

SEQ ID NO: 296824 - RNA, 64 nt, Human
cgcugaugaccucuucuucuguuaccgcuggcugcugcuggaacucaagcgugaguucgccuuc

SEQ ID NO: 296825 - RNA, 64 nt, Human
gaacccauucaugcuguuccucugccuggccauccugcuggagcaccgcgaccacaucaugcgc

SEQ ID NO: 296826 - RNA, 64 nt, Human
agagauauauuuauuaacagccaaccugugcaaccugcuggagcuuuauuuuuaauuuaauuua

SEQ ID NO: 296827 - RNA, 64 nt, Human
acccuucacaucaacccuguuacagcacucuguucugcuggaccacuuauuguaguuguagcua

SEQ ID NO: 296828 - RNA, 64 nt, Human
cuucguaaugaauuuucuuuacauccuguccacacugcuggagauacuaagucccaaccuaaau

SEQ ID NO: 296829 - RNA, 64 nt, Human
uuuauuuacugguuguacuaaauaaugaugaccucugcuggauuucuguuuacauccagaaaac

SEQ ID NO: 296830 - RNA, 64 nt, Human
ccuccuucccccucuccccauuguauuuauuugccugcuggaaaaucacauccggaaauaaaau

SEQ ID NO: 296831 - RNA, 64 nt, Human
ugagccugccccccaccuccggcgcgugggcauccugcuggacuaugauaacggcucuaucgcc

SEQ ID NO: 296832 - RNA, 64 nt, Human
cagauagcacaaauucuaccauccccuucccuggcugcuggaaauggaccccgcaacccugucc

SEQ ID NO: 296833 - RNA, 64 nt, Human
gggccuggccacacacuuccaugugucuuuuugccugcuggaggacacggaccauugaugcacu

SEQ ID NO: 296834 - RNA, 64 nt, Human
cuggaauuugccagaugcaucucaaguaagccagcugcuggauuuggcucugggcccuucuagu

SEQ ID NO: 296835 - RNA, 64 nt, Human
aaaaagaucguguuuaaauuaacuuguagaaaaucugcuggaaugguuguuguuuuccacugag

SEQ ID NO: 296836 - RNA, 64 nt, Human
ccccucccccaaccccucccccuggggcuggccucugcuggauuuugagauuugaggguguggc

SEQ ID NO: 296837 - RNA, 57 nt, Human
cgacccccaagccacacugaggugccgcugcuggagaugcgugcccccggcggcuac

SEQ ID NO: 296838 - RNA, 64 nt, Human
cucccuggccgggccaggcgccugcacagacuggcugcuggaccugcgcacgcagcccaggaau

SEQ ID NO: 296839 - RNA, 64 nt, Human
agguuugacuagaugauggaugccaauauuaaaucugcuggaguuucauguacaagaugaagga

SEQ ID NO: 296840 - RNA, 64 nt, Human
cugugucccaccacaaccuccagccucccuuuucagagcacagcauuaaaguuuggggaauucu

SEQ ID NO: 296841 - RNA, 64 nt, Human
guccggcuggccgccuucauggaggcaucauggcagagcacaugagauguccucagcugggcuu

SEQ ID NO: 296842 - RNA, 64 nt, Human
uuugacaaaggagcuugccuccuuugaaugaccuagagcacagggaggaacuuguccauuaguu

SEQ ID NO: 296843 - RNA, 64 nt, Human
cuaggggagaggugaaaucuugcaaguuguagcaagagcacacaggaaaccccuaacuuuccua

SEQ ID NO: 296844 - RNA, 64 nt, Human
guaaugaugucccucaagucuggucuccuggcagagagcacaugggcauuagauaccaucaaca

SEQ ID NO: 296845 - RNA, 64 nt, Human
auugaaauuaaacccugagccaccguguccuuguagagcacagaguagagaacaacuggcagcu

SEQ ID NO: 296846 - RNA, 64 nt, Human
ucccaguggggacggggcagggccuggccugggaagagcacagcugcagaucccaggccucugg

SEQ ID NO: 296847 - RNA, 64 nt, Human
cguccagcccuccuacgcagaugcugucacuggcagagcacagcccacggggaucacagcguuu

SEQ ID NO: 296848 - RNA, 64 nt, Human
aaaagcaggcugaaacuauggacaugauuucugaagagcacaucuccacugacuuucauaaagc

SEQ ID NO: 296849 - RNA, 64 nt, Human
gauugcugcagaaauguccuaugcacucuuugcaagagcacacaacaaaugucagauaccaauu

SEQ ID NO: 296850 - RNA, 64 nt, Human
uggagagagaaggacagugcacggagagguuuccagagcacaaauuguugguuccuagcacaaa

SEQ ID NO: 296851 - RNA, 64 nt, Human
auccccauggcagacagcgggcuggugaacaggaagagcacagaaucucuguggggcgaugcug

SEQ ID NO: 296852 - RNA, 51 nt, Human
cucaggagugugguuguuaggagagcacacagguggguuuggacaccuccc

SEQ ID NO: 296853 - RNA, 51 nt, Human
acgaagaggacccagcauagaagagcacagcuggccccggcguuucaugaa

SEQ ID NO: 296854 - RNA, 64 nt, Human
aagucaaggaacccagggccagcuggaaguguggagcacacaugcuguggagcacacaugcugu

SEQ ID NO: 296855 - RNA, 64 nt, Human
cacaggauuuccuaagacgagagggauuuagccaagagcacagacuuggauuccuucugucccu

SEQ ID NO: 296856 - RNA, 64 nt, Human
gaagaggaacccaguucccuugacuucccuuuugagagcacacguucugcuggguagcucaauu

SEQ ID NO: 296857 - RNA, 64 nt, Human
gugaagugaaccucuaccugaccaugaagaggcaagagcacagacuuacaaggauuucaacuua

SEQ ID NO: 296858 - RNA, 64 nt, Human
ugagggaugugcuguaauuugauuuacaugcauuagagcacacaguagaaaaacuuuagcuuca

SEQ ID NO: 296859 - RNA, 64 nt, Human
auaagaggacuucuuggggccagaacuguggaggagagcacauuugauuaucauauugaccugg

SEQ ID NO: 296860 - RNA, 64 nt, Human
aagaucuuuuuuccuucacuuauugcugaaaccaagagcacaauucccauugagagaaagaucu

SEQ ID NO: 296861 - RNA, 64 nt, Human
gaggcggcgcugcucuccccgagggcggcugggcagagcacaucccccaggacuugaugaccac

SEQ ID NO: 296862 - RNA, 64 nt, Human
gggcguugcugugcuaugaaauauaaagcauaacagagcacaaggaacauuuugaaaaugcagg

SEQ ID NO: 296863 - RNA, 64 nt, Human
ugagacucuuaggaaacuaacuagaucucaauugagagcacauaacaauagaugauaccaaaua

SEQ ID NO: 296864 - RNA, 64 nt, Human
uuagguggugaucuuaaaugggugagauggaacgagagcacacauuaaagagagaguaaauucc

SEQ ID NO: 296865 - RNA, 64 nt, Human
aguauccacaggauauuaaacguguaaauugcacagagcacacuuauuuaugaauugucuaaag

SEQ ID NO: 296866 - RNA, 64 nt, Human
uucuuuucaaagugggauagcuauugcagcuuaaagagcacagguuccaguacugguuuuccaa

SEQ ID NO: 296867 - RNA, 64 nt, Human
cucugcuccuagaagcgagaugagcgcagugugaagagcacagcugugcgggugguagacuuug

SEQ ID NO: 296868 - RNA, 64 nt, Human
augccuuugaucuggaauuggacauuucucugucagagcacagaggaggcucauaucaccucuu

SEQ ID NO: 296869 - RNA, 64 nt, Human
ugagaaggauggcggggcuagggaagcagagagcagagcacacacuggcucaagcagcagaggu

SEQ ID NO: 296870 - RNA, 64 nt, Human
auugggaucuuggguuggagggacagugaagcuuagagcacaugaacucaagguuagugacucu

SEQ ID NO: 296871 - RNA, 59 nt, Human
aagacaccaaaucuaggugaucacugaagcaacgcaaccgcuuccaccaccaugguguu

SEQ ID NO: 296872 - RNA, 64 nt, Human
uccaauguagaaauuguacguaauguauuuaaaucaacgcaaauguaugaauaacaaauacagu

SEQ ID NO: 296873 - RNA, 64 nt, Human
cacauuuguggaaaaugcuauuauuaagagaacaagcacacaguggaaauuacugaugaguagc

SEQ ID NO: 296874 - RNA, 64 nt, Human
aaagcaagcccaucucuaaguagaaaaaucacccagagcacaugcugaccugauaacuggggug

SEQ ID NO: 296875 - RNA, 64 nt, Human
caggugugaguucugugagucacugcuaagagacagagcacauuuucaggccagcaacuauccu

SEQ ID NO: 296876 - RNA, 64 nt, Human
guauugcauuuucccccuagagaaauagaucaaaagagcacaagaguaugcguacauaguuuac

SEQ ID NO: 296877 - RNA, 64 nt, Human
acauaacacuaaaugcugauuauuuagagccauuagagcacagcuucuucugccccucuacugu

SEQ ID NO: 296878 - RNA, 64 nt, Human
cgcccccacccaggacauaccuuccccaggauagagagcacaccucccuccuguccuugcucuc

SEQ ID NO: 296879 - RNA, 64 nt, Human
ggaaaugucuguauugguuggaugaaacuccaccagagcacagcuuagcuggggcgagaugcau

SEQ ID NO: 296880 - RNA, 64 nt, Human
ugauggucacaguuaucccaauggacacuaaguuagagcacaacaaaaccugauucuggucuuc

SEQ ID NO: 296881 - RNA, 64 nt, Human
ccuguccugacccgauggagcagccgguaagugaagagcacagcuggaagcagagacaccuuau

SEQ ID NO: 296882 - RNA, 64 nt, Human
cugccuccagaauggucuuucuaaugugugaaucagagcacagcagccccugcacaaagcccuu

SEQ ID NO: 296883 - RNA, 64 nt, Human
ccuaccucaccaggcuacuggcagcagcaucccgagagcacaucaucuccacagccugguaaau

SEQ ID NO: 296884 - RNA, 64 nt, Human
uugccagcguuaaaguagaaaauaacauuucagaagagcacaauaugcauaaaacauuuuucaa

SEQ ID NO: 296885 - RNA, 64 nt, Human
gaaauaccuaagugcugagaauuuuuaguacuaaagagcacagcugcucaaaguaaagccugag

SEQ ID NO: 296886 - RNA, 64 nt, Human
uucacauugcuuuaccaguuuggcacuggaaccaagagcacaugucguggcuggcuacaagguu

SEQ ID NO: 296887 - RNA, 64 nt, Human
ggucuaccugcauucauaauuccaggaucugugaagagcacauaugugucagggcacaauuccc

SEQ ID NO: 296888 - RNA, 64 nt, Human
aggaugggacgaugugcccagggagggacccaccagagcacaagagaagguggcuaccuggggg

SEQ ID NO: 296889 - RNA, 64 nt, Human
uaagaauaccagcuuuccccuuucccugagaggaagagcacauguuggucuccucuuaguguga

SEQ ID NO: 296890 - RNA, 62 nt, Human
cacacagauacccacagcauacacugacgaucuccacgcaguagacagguuuugucuucacu

SEQ ID NO: 296891 - RNA, 62 nt, Human
auuuggagggagggagcaguaccuucccggaguccacgcaugugaguugggucaagugcauu

SEQ ID NO: 296892 - RNA, 62 nt, Human
gagcgaacccacucccaagauaacggccugaguccacgcaggagggcagagcccucguggcc

SEQ ID NO: 296893 - RNA, 62 nt, Human
gacagaggcccccaagcugaucugguggugcauccacgcacccccacccugggacuuuggau

SEQ ID NO: 296894 - RNA, 64 nt, Human
gacuggaauccagggcaguuccaagugacaguacagagcacagcagcgaccuugggccugaaag

SEQ ID NO: 296895 - RNA, 62 nt, Human
ccagcuccaauuuuuuguaaaacagaaguuccagagcacagaaggucaucaucacaagcaaa

SEQ ID NO: 296896 - RNA, 64 nt, Human
gguaaaauacuaauaaauugcauauuccuugaccagagcacagauuacuuaugcuucuuaauuu

SEQ ID NO: 296897 - RNA, 64 nt, Human
auucucccucagucucgagauaaauagccagccuagagcacaacagggcauuggguacuugcau

SEQ ID NO: 296898 - RNA, 64 nt, Human
uuauagucauuaaguuuuuauuuuacuugaaccaagagcacaugaaugaacaggaaaagaugua

SEQ ID NO: 296899 - RNA, 64 nt, Human
guuuaacuguugcuauccuguuacuagauuauauagagcacaugugcuuauuuuguacugcaga

SEQ ID NO: 296900 - RNA, 64 nt, Human
uuaguauacacauacccacuaauucaaguaugucagagcacaaaguuggcagcugguuauauuu

SEQ ID NO: 296901 - RNA, 64 nt, Human
gauauuuuagaugcacccguguuuguaaaaauguagagcacaauggaauuaugcuggaagucuc

SEQ ID NO: 296902 - RNA, 64 nt, Human
uccccuaacugauuuccauccaaaccuaccuuauagagcacaauauuaaguguuguacaauuac

SEQ ID NO: 296903 - RNA, 64 nt, Human
uuuuaaaguggguuauucuggaguuuuuguuuggagagcacaccuaucuuagugguuccccacc

SEQ ID NO: 296904 - RNA, 64 nt, Human
ugacuuagaagcaauagggggcagcaggccaccaagagcacaaccccagggcgaggucugggga

SEQ ID NO: 296905 - RNA, 64 nt, Human
ugcgaggaccacuuuggagacugggguggccucaagagcacacagagaagggaagaaggggcca

SEQ ID NO: 296906 - RNA, 64 nt, Human
guacugcggacagugugggccagggaggaaaaccagagcacacaguuuugucaccauggaacac

SEQ ID NO: 296907 - RNA, 64 nt, Human
augaggaacaggugcuggggcuaaaguuugggguagagcacaagggacaagaggaacucuugga

SEQ ID NO: 296908 - RNA, 64 nt, Human
uacuagcugauuccccuauuuuaacaaacugacaagagcacauccauaaaaugaaaaccuguua

SEQ ID NO: 296909 - RNA, 64 nt, Human
agacuuuaauucucuuacugcuucuuuucacuucagagcacacuuaugggccaagcccagcuua

SEQ ID NO: 296910 - RNA, 62 nt, Human
cccaucauuuucaggucugcagaaccauagcuuccacgcaccugaacgagcacagaaugaac

SEQ ID NO: 296911 - RNA, 62 nt, Human
ugccggguaaggggcuaccgcgacgccacuuguccacgcagccaccaccggcccgggccagu

SEQ ID NO: 296912 - RNA, 62 nt, Human
cuucaccaaagucacccucgcgggcugggccuuccacgcaucccccccaccccccauggaac

SEQ ID NO: 296913 - RNA, 62 nt, Human
aggcagcaagccgggccguccguguuccauccuccacgcacccccaccuaucguugguucgc

SEQ ID NO: 296914 - RNA, 64 nt, Human
ccacaugggcguguggcuggggcguggccaccacagagcacauggcugugucuaggcgcaagca

SEQ ID NO: 296915 - RNA, 64 nt, Human
uuacaugcugaauuagccucgaucuuuuugauuaagagcacaaacuuuuuuuuguaaaacaugu

SEQ ID NO: 296916 - RNA, 64 nt, Human
cauuuauauugaaaaacaaaugagauggacuuaaagagcacauccugauaaauacuuucucucu

SEQ ID NO: 296917 - RNA, 64 nt, Human
agacucuuuuagggcauuuuucugacucaugaaaagagcacagaaaaggauguuuggcaauuug

SEQ ID NO: 296918 - RNA, 64 nt, Human
aaaacccacacacaaagcaaaaacucaaguauuaagagcacauauuuuugacccaguggaggcu

SEQ ID NO: 296919 - RNA, 58 nt, Human
auuuugcaauguuuaauuaagugcccaaagagcacaaacauuuuucaacaaauaucuu

SEQ ID NO: 296920 - RNA, 64 nt, Human
guguugagaugggccuugugguuucucuguacucagagcacauuucuuguaauuacuauuguua

SEQ ID NO: 296921 - RNA, 64 nt, Human
aggcauguccccaauuaccauggcaaccuuugccagagcacagaccccagagucuugugguucu

SEQ ID NO: 296922 - RNA, 64 nt, Human
uucuguugaagggaaaucuagucaguugcuugaaagagcacagcccaaauaaaacaaggacuga

SEQ ID NO: 296923 - RNA, 64 nt, Human
caaguuaguucugucacgcuucuucccauuauuuagagcacaguuuuuuaaagcaacuguacaa

SEQ ID NO: 296924 - RNA, 64 nt, Human
ggauauuugauuacguaacaaccagcuaaaacugagagcacacagccuucggaaacccccaagg

SEQ ID NO: 296925 - RNA, 64 nt, Human
ccaacaaaaaauccaagugugccuugaauuguacagagcacaauuauuauguuugaaaugugua

SEQ ID NO: 296926 - RNA, 64 nt, Human
acaaaacacaaacccaggacuuucugccuaaggcagagcacaagacucacagcagcaccgaagc

SEQ ID NO: 296927 - RNA, 64 nt, Human
aacccgaguuaaggaggggccuggcaggcguaucagagcacauuagugaugcccuucaccccag

SEQ ID NO: 296928 - RNA, 64 nt, Human
acacaauguggcaugacuaaguacuugcucucugagagcacagcguuuacauauuuaccuguau

SEQ ID NO: 296929 - RNA, 64 nt, Human
gauccaagcugggcucagaggucggaaggaggguagagcacacugggagguuucaucuuggagg

SEQ ID NO: 296930 - RNA, 62 nt, Human
ccaccuccuccaugccucggcgcucgaucuccuccacgcacuggcgcacgauguagggcacc

SEQ ID NO: 296931 - RNA, 62 nt, Human
gccaggccucugccuccucuucaucugcuucuuccacgcaccaccaccaccaccaccaccau

SEQ ID NO: 296932 - RNA, 64 nt, Human
uuaagauaaacuuaaggaucguuucugguguagaagucuucaaguguagacuuaaggaaaaaau

SEQ ID NO: 296933 - RNA, 64 nt, Human
uacaaaaaugaauacugaauuuugagucuauccuagucuucacaacuuugacguaauuaaaucc

SEQ ID NO: 296934 - RNA, 64 nt, Human
gguaccacauauauucauuugugaguuuggauauagagcacauuaucuaaaccauuuuguaguu

SEQ ID NO: 296935 - RNA, 64 nt, Human
gaguuuggggaaagccaaagaagaccuaggccauagagcacaguggaacgcaggcugagaacgc

SEQ ID NO: 296936 - RNA, 64 nt, Human
cuugccugugcagcugggcgcugaccuuccagguagagcacagauggcacaaccccgaggcagc

SEQ ID NO: 296937 - RNA, 64 nt, Human
auccauaccaacaaagucauaaagagcauauuuuagagcacaguaagacuuugcauggaguaaa

SEQ ID NO: 296938 - RNA, 64 nt, Human
auuagcaauuagaguuguaugcuauauaauacauagagcacagagcccuuugcccauaauauca

SEQ ID NO: 296939 - RNA, 64 nt, Human
uauuuuuauauuauuuuacuuauuuggaauuuacagagcacaccuaagcaauuaggauauaaca

SEQ ID NO: 296940 - RNA, 64 nt, Human
acacaacaaaguagcacaaagcaguuuaacagaaagagcacauuuguggacuuccagaugguca

SEQ ID NO: 296941 - RNA, 64 nt, Human
ccguggggaguguuuuaacggaucgugucgcaggagagcacagcccagcguuggggccgggacc

SEQ ID NO: 296942 - RNA, 64 nt, Human
augcucgcagguuagaguuggguguaaguaaagcagagcacauaugggguccauuuuugcacuu

SEQ ID NO: 296943 - RNA, 64 nt, Human
agagagagagcgcgggagagagugagagagagugagagcacaaagauaacgcaggagagagaga

SEQ ID NO: 296944 - RNA, 64 nt, Human
gaaaagaaauagaauuaucaagcuuuuaaaaacuagagcacagaaggaauaaggucaugaaauu

SEQ ID NO: 296945 - RNA, 64 nt, Human
gggaugacaugucccuacaccccuccccugcccuagagcacacuguagcauuacagugggugcc

SEQ ID NO: 296946 - RNA, 64 nt, Human
ccagggcccccacaggccccccgcagcacccugcagagcacacagguacagcaacaggaaucuc

SEQ ID NO: 296947 - RNA, 64 nt, Human
auaaaagagcaacauugaccaaaccugggaaacaagagcacagucuuguuuggagagucuacau

SEQ ID NO: 296948 - RNA, 64 nt, Human
ucagaaagaggaagucagauagaaauagucccugagagcacacuguguagcuaagccugcuggg

SEQ ID NO: 296949 - RNA, 64 nt, Human
aacuuucauacguaaaggugcaguugcucauuguagagcacauuuaguccaaugaagauaaaug

SEQ ID NO: 296950 - RNA, 64 nt, Human
auguggcaggcuggaguuauugaagcagaguggcagucuucaguuugcagaguaggggucuguc

SEQ ID NO: 296951 - RNA, 64 nt, Human
uccuccgaauugcugccgucuggccucuggccucagucuucagauagacaguaagaagaaagca

SEQ ID NO: 296952 - RNA, 64 nt, Human
uccauuuaaaauggaauuuguuuguauuuggggcagucuucaguaaagccuuucuccuuucuuu

SEQ ID NO: 296953 - RNA, 64 nt, Human
acuggcuccaucagaagacguugaagggcagugaagagcacagacucugugggcuucuuagaua

SEQ ID NO: 296954 - RNA, 64 nt, Human
guugggccuggugaggguuaggacuucagaaaccagagcacaagccccacagagggggaacagc

SEQ ID NO: 296955 - RNA, 64 nt, Human
uuugacaacucuaaaaaauaaaaaaaaaaaacuuagagcacaauaauccuugccuauguacuuc

SEQ ID NO: 296956 - RNA, 64 nt, Human
gcccggccaaaaagaacauuuugucaaucugaacagagcacagaacauuuuuucagacugaaca

SEQ ID NO: 296957 - RNA, 64 nt, Human
gucugggcagagacagaagcugauuuaacagcauagagcacagcgcccuacuuccccacagaca

SEQ ID NO: 296958 - RNA, 64 nt, Human
cauucaggaggccucaggaggccagccugccaugagagcacauguccucuggccaggaguagug

SEQ ID NO: 296959 - RNA, 64 nt, Human
auuuuaaagaugcagccagcucuaaacaacacacagagcacaaauaugcuccugacggacucag

SEQ ID NO: 296960 - RNA, 64 nt, Human
gauguaugcaauugcacauuguaauuauauuaacagagcacacuaauaauuuguauagauuaua

SEQ ID NO: 296961 - RNA, 64 nt, Human
guguggagggggagguaggacugggcuggaugagagagcacagcugugacuuccuccuaacugu

SEQ ID NO: 296962 - RNA, 64 nt, Human
aggccugcaggggcaaggggcuggcuggagucucagagcacagagguaggagaacugggguuca

SEQ ID NO: 296963 - RNA, 64 nt, Human
ggacagcaccccucagcaccacccacccucauucagagcacaccgugagcccccgucggccauu

SEQ ID NO: 296964 - RNA, 64 nt, Human
auuugcaacgccaaggauauuggucuuaagugcaagagcacaaaugagagugugagagaaagua

SEQ ID NO: 296965 - RNA, 64 nt, Human
ccuuuuugcaugauaucuucaagccugggcguacagagcacauuugucaguauuuuugccggcu

SEQ ID NO: 296966 - RNA, 64 nt, Human
ggacugaagucuaaggggcugagaccaagaagggagagcacaagacuaacuuuggucucuugac

SEQ ID NO: 296967 - RNA, 64 nt, Human
uaaaauuaauguccucauuaaugcaaguaauuuuagagcacaguguagccauguacaguuucca

SEQ ID NO: 296968 - RNA, 64 nt, Human
cuacccuccaugugagaauauuuuucccaggacuagagcacaacauaauuuuuauuuuuggcaa

SEQ ID NO: 296969 - RNA, 64 nt, Human
gaaugcgaaacauuccagaggcaguagccuccaaagcacacagagccccuggccccgccgcggc

SEQ ID NO: 296970 - RNA, 64 nt, Human
gacccugcagucauuggagcacccgggucagcaaagcacacaagcucacucaagaccagaugga

SEQ ID NO: 296971 - RNA, 64 nt, Human
caaguccuuuuacaaucagugugucuccugaacuagcacacaggcuguagaaacagucuuagaa

SEQ ID NO: 296972 - RNA, 64 nt, Human
agcaaaaagcaggacucccaggagccacaagaaaagagcacaggcugcaccaaagcaggggcag

SEQ ID NO: 296973 - RNA, 64 nt, Human
ucuuguagaacauuucaaacauacauaaaagagaagagcacagugaacccccauguacuccaug

SEQ ID NO: 296974 - RNA, 64 nt, Human
ggugcucucaagcccugcugcagagauccuuuucagagcacacacuguuccagcccaucugucu

SEQ ID NO: 296975 - RNA, 64 nt, Human
gugcccaacccugcgacuagcaaggcucgcagcaagagcacagcccucaacuacuugugccaga

SEQ ID NO: 296976 - RNA, 64 nt, Human
uagauuugagcauuugaagauucaaaguugcgaaagagcacaaaccauauuagguaaaauauug

SEQ ID NO: 296977 - RNA, 64 nt, Human
aaacaauguuuucuuucugguagcgcauaauaacagagcacaagcaucuuuuagauuugagcau

SEQ ID NO: 296978 - RNA, 64 nt, Human
guugcaaagguuaugauuauuucaacacaauggaagagcacaguuaaggccaacuaacguaaaa

SEQ ID NO: 296979 - RNA, 64 nt, Human
gugcgcucucgcucucacuuucgcccuguaccugagagcacagguguaacugugaugucauagu

SEQ ID NO: 296980 - RNA, 64 nt, Human
gaccagcucccguugggccaggccagcccagcccagagcacaggcuccagcaauaugucugcau

SEQ ID NO: 296981 - RNA, 64 nt, Human
aacaauugaaggaguggcaaacuuacuuguauugagagcacacgcaauuccuacuggugaaauu

SEQ ID NO: 296982 - RNA, 56 nt, Human
acuccuguccagcagccugacaugacagagcacagcugcccaaauacaaaguucuu

SEQ ID NO: 296983 - RNA, 64 nt, Human
ucuuauugcacacuguucgcuggaagcuuuuugaagagcacauucuccucagugagcucaugag

SEQ ID NO: 296984 - RNA, 64 nt, Human
cuucauuacaucaaaucaacacugcuccauggugagagcacagcaacucauuuauauauauaua

SEQ ID NO: 296985 - RNA, 64 nt, Human
auucccuccucccgucacuccacgcagcuggcagagagcacagugaucaccagcgugaguggug

SEQ ID NO: 296986 - RNA, 64 nt, Human
caggcguucucagccuccggaugacacaaauaccagagcacagauucaagugcaauccauguau

SEQ ID NO: 296987 - RNA, 64 nt, Human
uggugcugggacugcagggagagggcugugaggaagagcacaggcuucaugcacauugcacaga

SEQ ID NO: 296988 - RNA, 64 nt, Human
gauuaucaaacauuaccaguguugaacuauuaaaagcacacaauguguaguaaacuaucauagg

SEQ ID NO: 296989 - RNA, 64 nt, Human
aaugaagucucugaagugaaacugcuuguuuccuagcacacacuuuugguuaagucuguuuuau

SEQ ID NO: 296990 - RNA, 64 nt, Human
ggugacuuuucuuucacgauuucauuaauuugaaagcacacaggaaaguugcuccauugauaac

SEQ ID NO: 296991 - RNA, 64 nt, Human
agggcccccacaggccccccgcagcacccugcagagcacacagguacagcaacaggaaucucag

SEQ ID NO: 296992 - RNA, 64 nt, Human
ucuugcuaacagauucagaaaagugucucaaagcagagcacagaguuauuugguguuugcugaa

SEQ ID NO: 296993 - RNA, 64 nt, Human
uuucagagcucagacugaucaggcaucaagcuacccucaagaguuucugggcuggauguuucag

SEQ ID NO: 296994 - RNA, 64 nt, Human
uaaagcagcaaaugcaggaaggcugucucgccauccucaagacucagcagcucucauucuccag

SEQ ID NO: 296995 - RNA, 64 nt, Human
acuugaauccccauccuagcuucucucuccuuccccucaagaccugaucugguuuuaaggggcc

SEQ ID NO: 296996 - RNA, 64 nt, Human
ccugggugacccuggcaggugcgcucagagcuguccucaagauggaggaugcugcccuugggcc

SEQ ID NO: 296997 - RNA, 64 nt, Human
guuuuucaguuaucuccccauuugucaaaguugaccucaagauaacauuuuucauuaaagcauc

SEQ ID NO: 296998 - RNA, 64 nt, Human
agucacugugagcucccaggugcagccagaggcaccucaagaagaagaggggcauaaacuuucc

SEQ ID NO: 296999 - RNA, 64 nt, Human
aacaacuaaaugacuccucugucaucaucagcgcccucaagaccuaccuggugucgggguaagg

SEQ ID NO: 297000 - RNA, 64 nt, Human
caaucgcggaggagauugaccugcugguguucgaccucaagaccaugcgggaggugaggcgggc

SEQ ID NO: 297001 - RNA, 64 nt, Human
uaugugccacacuuugcacuacucauaaugauaaccucaagacuaucagaagaaauauuuaaau

SEQ ID NO: 297002 - RNA, 64 nt, Human
ugcuauguugcccagguuggucuugaacuccuggccucaagagauccccccaaccuuggccucc

SEQ ID NO: 297003 - RNA, 64 nt, Human
uuucucugacuugucaauccacaucuucccauucccucaagauccaaugaacauccaaccucca

SEQ ID NO: 297004 - RNA, 64 nt, Human
aagaaggcugcuaauuggauuuugguaguucuuaccucaagaaaacuugaauuauuugggggaa

SEQ ID NO: 297005 - RNA, 64 nt, Human
ccugccaccuagacacugaugccauugugugcugccucaagacugcuggagucaggacauuuua

SEQ ID NO: 297006 - RNA, 64 nt, Human
auuagucuguuuucacacugcugauaaagacauuccucaagauugugaagaaaaagagguuuaa

SEQ ID NO: 297007 - RNA, 64 nt, Human
ccuuguggggucccagguccugcugccaagagccccucaagagaagggcugaaccuggggagau

SEQ ID NO: 297008 - RNA, 64 nt, Human
ucccaagaucuuaaauggacacuuguauagaaauagucuucauuuuaucugagacauaauauaa

SEQ ID NO: 297009 - RNA, 64 nt, Human
uuauuucuaaugaacacuccucuucaucuuauuaagucuucacaguuuuuccaguggcuauaau

SEQ ID NO: 297010 - RNA, 64 nt, Human
agugagggucagagaggagucagagagaaucccuagucuucaagcagauuggagaaacccuuga

SEQ ID NO: 297011 - RNA, 64 nt, Human
uaacaaggcugccaaguaauggagaaguaugguuagucuucauauugaaauucuguugcuuauu

SEQ ID NO: 297012 - RNA, 64 nt, Human
aguggccagguuuauuauuagaagacacaguggcagagcacacaugugcacagguucugauuau

SEQ ID NO: 297013 - RNA, 62 nt, Human
cccuuuugaaggaagguuaauguaacccaacaagagcacauuuuaucauagcagagacaucu

SEQ ID NO: 297014 - RNA, 64 nt, Human
acauuucacagaacuucucuuuuauauaaaggcaagagcacaaaaugaguucagaugaucacaa

SEQ ID NO: 297015 - RNA, 64 nt, Human
aaauaaacagucucuuuuuuacaaagccuguguuagagcacagauuuaccuaggcuugaagauu

SEQ ID NO: 297016 - RNA, 64 nt, Human
aaacauacauagugggaacucccugguaugccauagagcacacaagaaccccaauauuaaugcu

SEQ ID NO: 297017 - RNA, 64 nt, Human
gcuuauuuaauuaccacuuugcaagccuuacaagagagcacaaguuggccuacauuuuuauauu

SEQ ID NO: 297018 - RNA, 64 nt, Human
uuaaucaccauauaaaaggaaaaaaauuggugacagagcacaaauagaaaaccuauuuuuaaau

SEQ ID NO: 297019 - RNA, 64 nt, Human
gggguggaauucgucuucugggaggaagcuggagagagcacagugaaauugaaauacccauucc

SEQ ID NO: 297020 - RNA, 64 nt, Human
gcaauaggaacacaggguggaaccgccuuugucaagagcacauuccaaaucaaacuugcaaaug

SEQ ID NO: 297021 - RNA, 64 nt, Human
uccaacuuuggccuucaggacacccuguaagaacagagcacacuugcuggacagugccaguucc

SEQ ID NO: 297022 - RNA, 64 nt, Human
gaucuucuugucagagaagcugcaugguuucugcagagcacaguuagcuagaaaggugauagca

SEQ ID NO: 297023 - RNA, 64 nt, Human
cgcuaauucggguacccauuccccaaguaaccagagagcacagagaaaugcuggugaaacuggc

SEQ ID NO: 297024 - RNA, 64 nt, Human
acagagcauacaacagagggggcacccggggaggagagcacauacuguguuccaauuucacgcu

SEQ ID NO: 297025 - RNA, 64 nt, Human
gcuggcagccucugucccuccagaacggcuaaccagagcacacuguccccaccgccuccccuuu

SEQ ID NO: 297026 - RNA, 64 nt, Human
gccuggauuuccgcaccugccugucuccucucccagagcacaguauuugggagacuuugacuau

SEQ ID NO: 297027 - RNA, 64 nt, Human
aagugcccucuccuugaccuugagaugaaggucaagagcacagggaccaggccuugguuaggcu

SEQ ID NO: 297028 - RNA, 64 nt, Human
caaaauuguauauucagugacuuacacuaugccuagcacacaacacacacugaguaaauauuug

SEQ ID NO: 297029 - RNA, 64 nt, Human
aaaaaagggaaaacuauagcuuugaguggcagacagcacacaucacaugcaucaacucacaacu

SEQ ID NO: 297030 - RNA, 64 nt, Human
uuaaccucuuauacauuauagauaauucuaagacagcacacaaacuuaucaauaaagccaucuc

SEQ ID NO: 297031 - RNA, 64 nt, Human
uguuuccaggugugcucaagugccuuccucuagcagagcacagaaagcuagaauacccccaggg

SEQ ID NO: 297032 - RNA, 64 nt, Human
aggacaccgccucggccccacguccuuagaggccagagcacaucugaaaacugcaaucacagcc

SEQ ID NO: 297033 - RNA, 64 nt, Human
caacguugccaugugcguuugcucuguggggaacagagcacagagggugagcgacaugugcaga

SEQ ID NO: 297034 - RNA, 64 nt, Human
aaagcucugugaccacugcuguaccacauuaugcagagcacacaggacaggcuggugcaccucc

SEQ ID NO: 297035 - RNA, 64 nt, Human
uugaaagguggucuguggaucugucugaauagaaagagcacaguaaguaugcauugccggagaa

SEQ ID NO: 297036 - RNA, 64 nt, Human
ugaccucccauuuggacccauaguuuauuuauagagagcacacacucccuaauugucagauggu

SEQ ID NO: 297037 - RNA, 64 nt, Human
gcagcaaacuuggguccuguguguucaaaaccauagagcacaaggucaaggaagcuagagucug

SEQ ID NO: 297038 - RNA, 64 nt, Human
aaaacgccauagcacagcugucuuuaugcaagcaagagcacaucuacuccagcaugaucuguca

SEQ ID NO: 297039 - RNA, 64 nt, Human
gaccaagaggcagcagucaucccugccaccagccagagcacaggaagagcagugugauggggcc

SEQ ID NO: 297040 - RNA, 64 nt, Human
uggagggcagcucugggcucagcgggcagugcuuagagcacaggccccucuguugggggauggg

SEQ ID NO: 297041 - RNA, 64 nt, Human
ucccuuuuaccuugagguauucgucccucgggacagagcacagcuugugcaacucugguagcgu

SEQ ID NO: 297042 - RNA, 64 nt, Human
ccgugcacaacuuugacaucuggucuugcuccauagagcacaacucaagauagaccaugagaca

SEQ ID NO: 297043 - RNA, 64 nt, Human
gccauggugccgccuuccugaauuggcaguggucagagcacaccugaacccuauccugggcugg

SEQ ID NO: 297044 - RNA, 64 nt, Human
gaaaggccuaaaguuucacuuggggacagagagcagagcacacucgggccucaucccucccaag

SEQ ID NO: 297045 - RNA, 64 nt, Human
ucaaaaaaaagaagaaaauaaauaaauaaaaaucagagcacaagaaguaccaguccaccaacuc

SEQ ID NO: 297046 - RNA, 64 nt, Human
ucccuucauacaaucuagucagaauagcaguucuagagcacagguucucagucuaagcuaugga

SEQ ID NO: 297047 - RNA, 64 nt, Human
ccuccccaucuggaauucacagcuguucccuggcagcacacaggaggguauuaaggaccuuugu

SEQ ID NO: 297048 - RNA, 64 nt, Human
ucaaccuccuggguccaagugauccucccaccucagcacacaacaccaugcccaauuuuaagug

SEQ ID NO: 297049 - RNA, 64 nt, Human
acugggaaaugggcauacaguacugagaaaugggagcacacaguacugggaaaugggagcacag

SEQ ID NO: 297050 - RNA, 64 nt, Human
aaggcuuuuccucccuucucugguuucaaagaucagagcacauaaccccuccugugcuugagug

SEQ ID NO: 297051 - RNA, 64 nt, Human
ucucaaggcgcagguauuuauucuguaucugucuagagcacacaccaaaauccaaccuucuaau

SEQ ID NO: 297052 - RNA, 64 nt, Human
cagauaucacugugaauugaauaaauuuguugaaagagcacacaggcacacauacacacaaacu

SEQ ID NO: 297053 - RNA, 64 nt, Human
uuugcuuuccagcaggcguaguauauuuagucggagagcacaucuguaugcgacaacuugauua

SEQ ID NO: 297054 - RNA, 64 nt, Human
uugaccuauuugugggagggaugaaaggcuacaaagagcacauucuuguaauuuucaaauuuuu

SEQ ID NO: 297055 - RNA, 64 nt, Human
cugcaaccaggacuuguggugcagcugcagacacagagcacagcucaugggcaacaucacuggg

SEQ ID NO: 297056 - RNA, 64 nt, Human
cucauccuccugguucaggaccucuaccccagcgagagcacagcagaggacgacauucaggucu

SEQ ID NO: 297057 - RNA, 64 nt, Human
uaauuggagaagauuuaugucagcacacacuuacagagcacaaaugcaguauauaggugcugga

SEQ ID NO: 297058 - RNA, 64 nt, Human
ggaggcggccagggcaguuguugggugaauguggagagcacauggccaugucuugcccccggag

SEQ ID NO: 297059 - RNA, 64 nt, Human
gaagagauggggagauucaggaucccccugugccagagcacagccucaccggaugcugcuuccc

SEQ ID NO: 297060 - RNA, 64 nt, Human
uuauuguuacaaugcacaguggaggacugcuuauagagcacagaccuuuguauuauaauuuuua

SEQ ID NO: 297061 - RNA, 64 nt, Human
uucugcagagacacccguuucagccacaucuaaaagagcacaguuuauguggugcggaauuaaa

SEQ ID NO: 297062 - RNA, 64 nt, Human
acaaugaccacuguuauuguuacuuugacuuuucagagcacacccuuccucugguuuuuguaua

SEQ ID NO: 297063 - RNA, 64 nt, Human
ggcaaaaaggagccuuuugcucucugugacccuaagagcacacugcacagggaaaauugcccca

SEQ ID NO: 297064 - RNA, 64 nt, Human
ugccuuuuauaguaugcccaccucaggcagacacagagcacaaugcugggguucucuucacacu

SEQ ID NO: 297065 - RNA, 64 nt, Human
gggcugcccgcucccagugucuuccugugggggaagagcacagcccucccgccccuuccccgag

SEQ ID NO: 297066 - RNA, 64 nt, Human
aaagucaaagacaacauuauaacuaaaagucgaaagcacacaaaauauaaauaauaguguaugc

SEQ ID NO: 297067 - RNA, 64 nt, Human
uucaguaaauacauuuaaacaauguuaaggccacagcacacauaucucagccauucauuguucu

SEQ ID NO: 297068 - RNA, 64 nt, Human
cguaaagccucaaaacacagcacacacacacacgagcacacacacacacacacacacgaacaca

SEQ ID NO: 297069 - RNA, 64 nt, Human
gccugauggaaguuaacccggagcuaagucacccagagcacaggagcugccaugucagauggga

SEQ ID NO: 297070 - RNA, 64 nt, Human
caggaccaguuucucugccaaggggaggaguuggagagcacaguugccccguugugugagggca

SEQ ID NO: 297071 - RNA, 64 nt, Human
caguucaugaacuaacugccgugggccuccuggcagagcacaacuggggcuuuuguauaagaag

SEQ ID NO: 297072 - RNA, 64 nt, Human
gaccagcagagggagggaucaggcagcaguguuuagagcacaccacacuggccacuguaaacug

SEQ ID NO: 297073 - RNA, 64 nt, Human
ggaggcucagcaaagcugaauuaacucaggcagaagagcacagaugugugggauugggggagga

SEQ ID NO: 297074 - RNA, 64 nt, Human
cucuccaucuguuugguggggguagagcugauccagagcacagaucuguuucgugcauuggaag

SEQ ID NO: 297075 - RNA, 64 nt, Human
cuauugaaagaccuuucaugaaauauaagucuccagagcacacaagaguauuucuucugaaaaa

SEQ ID NO: 297076 - RNA, 64 nt, Human
auauauaaccacuguagauauugacaaaaguaagagagcacagucaacauaaaguuuaaccaga

SEQ ID NO: 297077 - RNA, 64 nt, Human
ccaaccucacggagacuuuguaauuuguuuucugagagcacaggggugaccaaugagcaguggg

SEQ ID NO: 297078 - RNA, 64 nt, Human
cucauggaaucaagcugaagucagucuucuucugagagcacauucuuacucaguuuuuuuccuc

SEQ ID NO: 297079 - RNA, 64 nt, Human
cacaggcagcccagcccuccucugucaacaucaaagagcacauuuaccaguauagcuugcauag

SEQ ID NO: 297080 - RNA, 64 nt, Human
uauguccacauaagaaagcaucuaaacugaacugagagcacagcgggcuacccuggacaaagua

SEQ ID NO: 297081 - RNA, 64 nt, Human
ggccuuauuuugaacugccucaggaccccacuggagagcacagcaugccuuacuacugggucau

SEQ ID NO: 297082 - RNA, 64 nt, Human
aaggaguaagaccccuggaccaccagccccagcaagagcacaagaggaagagagagacccucac

SEQ ID NO: 297083 - RNA, 64 nt, Human
ccaaauuaugucgugagcuauauagcaaagaacaagagcacaaauguaagccuuguccaaggag

SEQ ID NO: 297084 - RNA, 64 nt, Human
ucucuucagccuugcucugucccugccucuuaucagagcacagguagacacacgggcauagcca

SEQ ID NO: 297085 - RNA, 64 nt, Human
uuuacucuguuuccucagcccugcagccccugggagcacacacugggugcagcccugggccagg

SEQ ID NO: 297086 - RNA, 64 nt, Human
cuuggaguuagagccaagcugucagacggugcccagcacacauuaauguuagcuucuuucugag

SEQ ID NO: 297087 - RNA, 64 nt, Human
cagcuggcccggccacucugaauugcgccuuccgagcacacauaaaagcacaaagacagagacg

SEQ ID NO: 297088 - RNA, 64 nt, Human
gacuccaucucuauauaaaaacaaaaaccacgaaagcacacacaaaauaaaucagugggauuug

SEQ ID NO: 297089 - RNA, 64 nt, Human
uauuauucugacaccagcuugcugcuaugauuucagagcacauaaguaaaggugcuuuuuaaug

SEQ ID NO: 297090 - RNA, 64 nt, Human
acaccugaaaagauacaucugauauuuucuauauagagcacaguaaauaaguuuuuucauugug

SEQ ID NO: 297091 - RNA, 64 nt, Human
aaaaaaauuaaccagagagggucuguaaucucgcagagcacaggcagaaucguuccuuccuugc

SEQ ID NO: 297092 - RNA, 64 nt, Human
uguggacagugggugggggcacuacuccccacucagagcacaaaugcaacuccuuccccuacaa

SEQ ID NO: 297093 - RNA, 64 nt, Human
auaagcaucuucuuuaugccuaguauuugugauaagagcacaaaacaauuuucuaaucucaaag

SEQ ID NO: 297094 - RNA, 64 nt, Human
agcugaggccggaggagaaguagcagucgcuggcagagcacacaggcugcucugggggaugagc

SEQ ID NO: 297095 - RNA, 64 nt, Human
caauauuuagagcaaguguccucaugugauaaacagagcacaguccaaagauacccucuuucuc

SEQ ID NO: 297096 - RNA, 64 nt, Human
gaggggccccgccagcccgauggggaugaggaggagagcacagcccucagcaucaacgaggaga

SEQ ID NO: 297097 - RNA, 64 nt, Human
gaaaugaaaauaauuacuuugaaacuuggcuuuaagagcacauuuaucguacgucacaguguau

SEQ ID NO: 297098 - RNA, 64 nt, Human
gggugauggggcugagcaggaggggggcuggguaagagcacagguuagggcauggaaggcuucu

SEQ ID NO: 297099 - RNA, 64 nt, Human
uguguauuuauagucccuccuaucaaacaauuacagagcacaaugauugucauuggguauauau

SEQ ID NO: 297100 - RNA, 64 nt, Human
ugucuucuaaauuauguacuguuguugguuaaauagagcacaauguaguuauucuaaugcccag

SEQ ID NO: 297101 - RNA, 64 nt, Human
ccuuguccauuuagcgaugaggaaagugaagcucagagcacaaaccaggugccagaggcgggag

SEQ ID NO: 297102 - RNA, 64 nt, Human
aacauuuuucaagucucuaacuagagugaacucuagagcacaguaguucagaaacuauuuagag

SEQ ID NO: 297103 - RNA, 64 nt, Human
uucaucuuuaccaacggcaagccuuucugcacagagagcacagcagaauggcuccugucacugc

SEQ ID NO: 297104 - RNA, 64 nt, Human
gauaaaggaagaaccaaaagccaaguuaaagcugagagcacaagugcugcauggaaaggcaaua

SEQ ID NO: 297105 - RNA, 64 nt, Human
uaaaguggcauguuagugaggaguucugauauuaagcacacacacacaugcacacaaauggacu

SEQ ID NO: 297106 - RNA, 64 nt, Human
gcaucucuguauuucugcgccuagcacggugccuagcacacaguaggcgcucaauaaauguuga

SEQ ID NO: 297107 - RNA, 64 nt, Human
gggggugggccguggcuaguguccugcugcagucagcacacacgugggauuggcuagcucaucc

SEQ ID NO: 297108 - RNA, 64 nt, Human
aaaagacuuuuuguacauuuggaaaagacaagcgagagcacacuauucucauugccaacguuaa

SEQ ID NO: 297109 - RNA, 64 nt, Human
agugcaguauuuaccuguugaauucagcaucuugagagcacaagggaaaaaauaagaaccuacg

SEQ ID NO: 297110 - RNA, 64 nt, Human
auuuucauauuacucagguaaagauggaaaugacagagcacagacauuuauuuuuuaaauugau

SEQ ID NO: 297111 - RNA, 64 nt, Human
aauuucagaagcuucccugcaaguagauaucgagagagcacacuuuccauuagagccugguaau

SEQ ID NO: 297112 - RNA, 64 nt, Human
ccuucuggcaaauucaagaggcaugaguggaccgagagcacauccagcauuugcaucaccuccc

SEQ ID NO: 297113 - RNA, 64 nt, Human
ggggacauucagcugaugcauuauauaccccgucagagcacacuuguaucuuuuaccuucccuu

SEQ ID NO: 297114 - RNA, 64 nt, Human
aggaaaggcuugaaacacgagaagcagcaaagacagagcacacaagugcauaaggcuguugucu

SEQ ID NO: 297115 - RNA, 64 nt, Human
gguuuucaauucucugaagccuuguguagcuuucagagcacacguauccuaauuacccuccucu

SEQ ID NO: 297116 - RNA, 64 nt, Human
acuuuuaaaucaaugggaacaauuagcaacagaaagagcacagucccugcuuuugacuggguuc

SEQ ID NO: 297117 - RNA, 64 nt, Human
ucauagggggguguccccccagagacaaagcugcagagcacauuccaugccagacgcucuggcc

SEQ ID NO: 297118 - RNA, 64 nt, Human
ugcccacacacggcgcaggcugcccgccuccuggagagcacacuucagcugaaacaguaaagcc

SEQ ID NO: 297119 - RNA, 64 nt, Human
uaaugaauuaaauuauuccauaaauaauauuuaaagagcacaagaaaaauuuuuuaaagugcac

SEQ ID NO: 297120 - RNA, 64 nt, Human
guuuggauaaggcuggggaggcccgaaguccgcuagagcacagucccauccaggcugaugccaa

SEQ ID NO: 297121 - RNA, 64 nt, Human
agcagauucuguauauguugguaacuacccaccaagagcacauggguagcagggaagaaguaaa

SEQ ID NO: 297122 - RNA, 64 nt, Human
uugucucuaaguugaaggcuuuguuggaggggacagagcacaggaacagccuugacagucugua

SEQ ID NO: 297123 - RNA, 64 nt, Human
ccugagagcaccuggaauuuguuggaagcagaucagagcacacguacgaaaaggugcaauugcu

SEQ ID NO: 297124 - RNA, 64 nt, Human
aacgauaugucuguccaucuuucuccuuucuuccagcacacacagcuaagagauaagaaggcug

SEQ ID NO: 297125 - RNA, 64 nt, Human
ccagaacacuggugguggacacagcuuuccugucagcacacaaaagaccuguuccucuuccaaa

SEQ ID NO: 297126 - RNA, 64 nt, Human
gugccuucaaagcccacguaaagccucaaaacacagcacacacacacacgagcacacacacaca

SEQ ID NO: 297127 - RNA, 64 nt, Human
ucaaaagcacuggacagagaauguuacugugaauagagcacauauuacucuuuuuagcaaccua

SEQ ID NO: 297128 - RNA, 64 nt, Human
cggagccgggacccagaggggcagcgcagggcgcagagcacacccgcugggccagcagcuccca

SEQ ID NO: 297129 - RNA, 64 nt, Human
cugccccgacaccucgggcacaucgcaugcacucagagcacagagccgggcagacgcagcaccu

SEQ ID NO: 297130 - RNA, 64 nt, Human
gcagcacugaaaguuguuuuccuguuagauggcaagagcacaaugcccaaaauagaagaugcag

SEQ ID NO: 297131 - RNA, 64 nt, Human
acaaaaucuuagggaagauaaguugaguuguccaagagcacacugaaaguugaauguuaucuaa

SEQ ID NO: 297132 - RNA, 64 nt, Human
gaggagucaggagcagggacuuugacucuuaggaagagcacacaugagggcaaggcugcuggca

SEQ ID NO: 297133 - RNA, 64 nt, Human
auuguuuuuguuuuuguuuuuguuuugacacugcagagcacaaggcuaaagguuacagcugaga

SEQ ID NO: 297134 - RNA, 64 nt, Human
acaaaucaaagcagauauauuaagugacuguucaagagcacacuuggcccaaguggcagagcuu

SEQ ID NO: 297135 - RNA, 64 nt, Human
cgcagcggcuucgaggagcugaacaacgagaacaagagcacacugcaguuggagcagcaaguaa

SEQ ID NO: 297136 - RNA, 64 nt, Human
caugggggaacaaugagcagagauggcagagggcagagcacauggcccccagaggcuuccaguc

SEQ ID NO: 297137 - RNA, 64 nt, Human
caaagauaauuuaaacuuuguuuguagauaaaauagagcacaaacugugaagugcaucuuucca

SEQ ID NO: 297138 - RNA, 64 nt, Human
cuguagguggccgcugacaagugccuuuaguugaagagcacauuucuuucaucucucuugucca

SEQ ID NO: 297139 - RNA, 64 nt, Human
gugcccgccacacgcacgcacacacucuuacacgagagcacacucgaucccccuaggccagcgg

SEQ ID NO: 297140 - RNA, 64 nt, Human
cagcuucauuugcgagagcgccgaggcaggacacagagcacagcugugcuggaaguguggggag

SEQ ID NO: 297141 - RNA, 64 nt, Human
uggccccagccagggcggugggcaguccugguguagagcacaagccucuccacccuagagaaau

SEQ ID NO: 297142 - RNA, 64 nt, Human
caggcuccgaggggccguggugacucuugaucaaagagcacagugaacugucccuucugagucu

SEQ ID NO: 297143 - RNA, 64 nt, Human
gaauauaaaaaaauguuuuauauagaacauaaaaagcacacauagucuugacaaauguauauaa

SEQ ID NO: 297144 - RNA, 64 nt, Human
auaaagaaucagcuagaguugucaugauaaagucagcacacacaaaaaggcuucuuacacauac

SEQ ID NO: 297145 - RNA, 64 nt, Human
uugugcagaccuggcuguggcuugcuggugugcaagcacacaucacuuuagaggggcugcgccc

SEQ ID NO: 297146 - RNA, 64 nt, Human
aggagugugugauuuuuugcauuccugacaaaggagagcacacccagguuuggagguccuaggu

SEQ ID NO: 297147 - RNA, 64 nt, Human
uguuccacuguccagcccagcaugaguagcagguagagcacagcuuuacuggcuguuuguaugc

SEQ ID NO: 297148 - RNA, 64 nt, Human
uugucuuuuuaaaaguguuuauuuuuggcaauaaagagcacaacauaaucuccuucaugcguca

SEQ ID NO: 297149 - RNA, 64 nt, Human
cucugggcugugcggccccgagucugcguccauuagagcacaguccacccgaggcuagcaccgu

SEQ ID NO: 297150 - RNA, 64 nt, Human
ccugguucacugcagacaguggcaccccagcaccagagcacaaugagaaacggcagcgccgaca

SEQ ID NO: 297151 - RNA, 64 nt, Human
ugaguaaacugauagauuuuacucugacugcaaaagagcacaccuaugcugcuuguugcaguaa

SEQ ID NO: 297152 - RNA, 64 nt, Human
ccaacuuccagcucugcccuguguuucggaaaccagagcacagugucugccccggccaaggagu

SEQ ID NO: 297153 - RNA, 64 nt, Human
acgcaguccuagaggcgugcccuuuggggcuugaagagcacacugugggacgcacgugcuucug

SEQ ID NO: 297154 - RNA, 64 nt, Human
gcccccgagguguguguaggaggcggaggcccgcagagcacagagcaggagaagggcuugggcc

SEQ ID NO: 297155 - RNA, 64 nt, Human
ccucauguccacucaguaacaaguauugggacguagagcacagccucacucagcucugaaaggu

SEQ ID NO: 297156 - RNA, 64 nt, Human
caucugcugcgcccggccccacugacagaucugaagagcacaguaggaagggaggcggcuccuc

SEQ ID NO: 297157 - RNA, 64 nt, Human
cgucuguucuuuaccaaaaccauccaucccuagaagagcacagagcccugaggggcugggcugg

SEQ ID NO: 297158 - RNA, 64 nt, Human
gccauagguuguuucuuugucuuccggguccuaaagagcacagagaaaauggagguccccaguc

SEQ ID NO: 297159 - RNA, 64 nt, Human
uuggcccaagcccugccugacugaccacccccucagagcacagaucagggaccucacgcaucuc

SEQ ID NO: 297160 - RNA, 64 nt, Human
aaauaugacuccuuucucuaucccaagccaaccaagagcacauucuuaaaggaaaagucaacau

SEQ ID NO: 297161 - RNA, 64 nt, Human
gaagcaucuguuccuuccuggucacgagguggccagagcacaauguauaggcagaccagugguc

SEQ ID NO: 297162 - RNA, 64 nt, Human
cgaggaccacuuuggagacugggguggccucaagagcacacagagaagggaagaaggggccauc

SEQ ID NO: 297163 - RNA, 64 nt, Human
acugcggacagugugggccagggaggaaaaccagagcacacaguuuugucaccauggaacaccc

SEQ ID NO: 297164 - RNA, 64 nt, Human
cagguucucaaagcuggcccagaugcugauacacagcacacagggaaaggaagacagucucaca

SEQ ID NO: 297165 - RNA, 64 nt, Human
cagcacgcaugucccuccaaggcugucuucucccagagcacaagaaggccagcccacugggccc

SEQ ID NO: 297166 - RNA, 64 nt, Human
gugagaaagacauggagggaaauaagggagaccaagagcacagcaggacugaaauuuuggacgg

SEQ ID NO: 297167 - RNA, 64 nt, Human
cccccauccaagcauccuucgauuagggaaguggagagcacaucccuguaaggcccauaagaga

SEQ ID NO: 297168 - RNA, 64 nt, Human
gugguucucagccaagacauaaaaacuaggacucagagcacauacaaaaccaguuauguuucgg

SEQ ID NO: 297169 - RNA, 64 nt, Human
uuuacaaauguccaugugggagagagagagcaugagagcacaguagcccagccugcuggucagc

SEQ ID NO: 297170 - RNA, 59 nt, Human
acaagcuccugaaggagugaggccugggcagagcacacucagcaggauagaggcagugc

SEQ ID NO: 297171 - RNA, 64 nt, Human
ccucgcugcccaucagaaagccugaggcgugcccagagcacaagacugggggcaacuguagaug

SEQ ID NO: 297172 - RNA, 64 nt, Human
gccccacuaucaguguccagcgugcugguuccccagagcacagcucagcaucacacugacacuc

SEQ ID NO: 297173 - RNA, 64 nt, Human
uuggguaggacuucggguguucgguccuggucgcagagcacagaucuuuaaagaagcgagagag

SEQ ID NO: 297174 - RNA, 64 nt, Human
cuuccaccaaguuggaacauccuuggaaauuggaagagcacaagaggagauccagggcaaggcc

SEQ ID NO: 297175 - RNA, 64 nt, Human
ggugggauauuuugggaugucaagggguggaggcagagcacaagucacaccagaaacugcuuuu

SEQ ID NO: 297176 - RNA, 64 nt, Human
ggcucucugggccgguucccugcagacccgcaggagagcacaugugccuugcaugaaguguggg

SEQ ID NO: 297177 - RNA, 64 nt, Human
ucuuauaaaguggaaucaccaaaucuuaucacacagagcacaguccuguaguuacccagcccgc

SEQ ID NO: 297178 - RNA, 64 nt, Human
caugagccauccucugcccugacuagcgaggggcagagcacaccccagugcuuacgccuccacc

SEQ ID NO: 297179 - RNA, 64 nt, Human
cuuccuagagcagcguagacagcugguaaacugaagagcacaacuauauucuuaugaaggaauu

SEQ ID NO: 297180 - RNA, 64 nt, Human
agcuucugcccagcuuuauugcugcuauuggcaaagagcacaggacucagcccucguggcuaaa

SEQ ID NO: 297181 - RNA, 64 nt, Human
gauaauguauauaaaguacuuuagccugguaccuagcacacaauaagcauucaauaaauauuag

SEQ ID NO: 297182 - RNA, 64 nt, Human
aaaaaaagaagaaaaaccuguuuccgugugcaaaagcacacauauguaugucuguguuauaaaa

SEQ ID NO: 297183 - RNA, 64 nt, Human
auauucuuuaaugauauuaaauaugccgaagccaagcacacagucuuucuaaaguguguguaug

SEQ ID NO: 297184 - RNA, 64 nt, Human
uuguuuucucggcagaucugcaaggcuggcuuuaagagcacaaggagggaaaguaacgaaaggg

SEQ ID NO: 297185 - RNA, 64 nt, Human
aggggcggguugguguguuuuccccuuguguaccagagcacauuccuuaggggacggcuuuggg

SEQ ID NO: 297186 - RNA, 64 nt, Human
ugagcuauaugauuuaucagagaucugauuccaaagagcacagaauacuguucucagaccauga

SEQ ID NO: 297187 - RNA, 64 nt, Human
aagcacauuuccacccaauuuugucauccgagagagagcacaaacugcaggcccuuguugcagc

SEQ ID NO: 297188 - RNA, 64 nt, Human
gugggaaauggugucccugucccucccaaagcacagagcacagaaaugaggccguuuacauggc

SEQ ID NO: 297189 - RNA, 64 nt, Human
acccgcccucaugggcaccgggcaggcgccucacagagcacagacgugcccucggccuuggucg

SEQ ID NO: 297190 - RNA, 60 nt, Human
ccgaggccacuacccccugacacugccggaagagcacagggacacagccagagcccacgg

SEQ ID NO: 297191 - RNA, 64 nt, Human
cccaguaccaaaaaggucuucugugucuacuggaagagcacagggcagggcagccaguggucca

SEQ ID NO: 297192 - RNA, 64 nt, Human
cacacccgcacccgcgccucacgaucccucacccagagcacacggccgcggagaugacgucacg

SEQ ID NO: 297193 - RNA, 64 nt, Human
guuauuagaacaauguaaauguauuugcugaaagagagcacaaaaaugggagaaaaugcaaaca

SEQ ID NO: 297194 - RNA, 64 nt, Human
cuccugagguagaggaguggagaacuggcucuuaagagcacaguuuucuuuucuuuuuucuuuu

SEQ ID NO: 297195 - RNA, 64 nt, Human
acucugugguuuuuggaccccauggggcccagacagagcacaggagcaugggcugccucugagu

SEQ ID NO: 297196 - RNA, 64 nt, Human
gcccucccugucugcacugcccaggccagaggguagagcacagggguuuccccauacuaccucc

SEQ ID NO: 297197 - RNA, 64 nt, Human
accaguucccaccuagagcacuguguccugcccuagagcacaaagaccugcuccucccgagacu

SEQ ID NO: 297198 - RNA, 64 nt, Human
cagaccaucuccagcauccugcuuccuaggccccagagcacaaguuccagcuggucuuuuggga

SEQ ID NO: 297199 - RNA, 64 nt, Human
ggcgccuccuuggucucuaggauccaggcuccacagagcacaugacuagccaggccccuggcuu

SEQ ID NO: 297200 - RNA, 64 nt, Human
agaugcacuuagagugaagaaacacuguaauuacagcacacagauugcaaguauugcguaccaa

SEQ ID NO: 297201 - RNA, 64 nt, Human
acugauuuuuuuuuuccuuacagugagacauuuaagcacacauuuuauucacauagauacuaug

SEQ ID NO: 297202 - RNA, 64 nt, Human
gaagccauaagagagagaccgaauucuguggcucagcacacaggacugacccacagcccaggca

SEQ ID NO: 297203 - RNA, 64 nt, Human
accuuucuaagccugugguugcuucacccgcugcagagcacacgcaacccagccucagcaucac

SEQ ID NO: 297204 - RNA, 64 nt, Human
cuuuucuucugacucguggggcucccugcugcagagagcacagcccuugccuggagcccaggaa

SEQ ID NO: 297205 - RNA, 64 nt, Human
uucugcaaguaugagugaagacccacagugcaccagagcacagcugcauccuggagccccagac

SEQ ID NO: 297206 - RNA, 64 nt, Human
uucucagagcagggcgauugggacaucaccagccagagcacaggaagccacccugccugcuggg

SEQ ID NO: 297207 - RNA, 64 nt, Human
auugacaacuguuccugcuucuacuaaaaaaaaaagagcacaaaagaaaaacuaaauuauugaa

SEQ ID NO: 297208 - RNA, 64 nt, Human
gacucaagcugacgggacuccaguagggacuuugagagcacauuuuguaaaaauauuuaucuag

SEQ ID NO: 297209 - RNA, 64 nt, Human
aggugcacagaccacacagcacacacaagugcacagagcacacugcacacaugcacacacacac

SEQ ID NO: 297210 - RNA, 64 nt, Human
auuuuuuuuuaaaggucuuguugcaguaggagaaagagcacaaaagaggucugggaacuucucu

SEQ ID NO: 297211 - RNA, 64 nt, Human
uugggguccccugagcgucuuccaggguggcuggagagcacagacgcgccagggagcccccucu

SEQ ID NO: 297212 - RNA, 64 nt, Human
caaggaaauaaugugaaugcgaggaaaugucuuuagagcacagggacagagggggaaauaagag

SEQ ID NO: 297213 - RNA, 64 nt, Human
uaagugugcugugagggaagggcugccuuauuuuagagcacagauuuucugaauaucuauuuug

SEQ ID NO: 297214 - RNA, 64 nt, Human
gguuuuuuuuccugccugucauacuugcuaaacaagagcacagcgggccugucagaugaaguca

SEQ ID NO: 297215 - RNA, 64 nt, Human
aaaauucagaagggacucuaccauaucuuagcucagagcacagaggagugccuuauccccacac

SEQ ID NO: 297216 - RNA, 64 nt, Human
auuccaucugguuuugagaaacuuagcagcucacagagcacagagauccugccuucuuccuacu

SEQ ID NO: 297217 - RNA, 64 nt, Human
agcccaaaacagaagggggcugccccagcccagcagagcacagaguuucuggagcucccaucca

SEQ ID NO: 297218 - RNA, 64 nt, Human
ccagcaccuggggagaucggugcuaccaaggaagagagcacacagauaagacagaggggaggag

SEQ ID NO: 297219 - RNA, 64 nt, Human
uagggugcuacuugggggauaucuauuacuaaucagcacacaauagcugggugggcacccccuc

SEQ ID NO: 297220 - RNA, 64 nt, Human
cacgaaaauuagucuagcauugccggggguaaaaagcacacacugguccugcagcuuauugaau

SEQ ID NO: 297221 - RNA, 64 nt, Human
gcauuuuaaagccccauacacagaaguauacgaaagcacacaaaacacuccaaguuucagcagu

SEQ ID NO: 297222 - RNA, 64 nt, Human
gucucguuauugugaagucuuucguagacaccccagagcacacacauccccuuaguccaccggu

SEQ ID NO: 297223 - RNA, 64 nt, Human
gggugcacccccugccuaccacccucccuucuagagagcacaucgccugaccggggagaagugg

SEQ ID NO: 297224 - RNA, 64 nt, Human
aggacagaggggcaccucagccgcccccaagcccagagcacagcaauaaggucggccugcagga

SEQ ID NO: 297225 - RNA, 64 nt, Human
gucaugugcccugugaccacugaagggugucagcagagcacacggcaugaggacagagggaggg

SEQ ID NO: 297226 - RNA, 64 nt, Human
cauucaguggaaagaugcacguugauacuauuuuagagcacaaauaaacucacuauacaauggu

SEQ ID NO: 297227 - RNA, 64 nt, Human
gaugcccggauugcaagaauaaaugcccuaaaggagagcacauaugcaaugccugauggguucc

SEQ ID NO: 297228 - RNA, 64 nt, Human
uuuuauacacugaggguagcccauuuauaaauuaagagcacauuauauucagaagguucuaaca

SEQ ID NO: 297229 - RNA, 64 nt, Human
gaucucugcucugcuuaaugggacccaaggucucagagcacaggcauauuauuuucuggguuug

SEQ ID NO: 297230 - RNA, 64 nt, Human
ugcagcaaucuuugaaagacuuccaaagaauguuagagcacaguacauaauacacuugcccugc

SEQ ID NO: 297231 - RNA, 64 nt, Human
uuuaagugcagucauuucuuuuugguuugcaaaaagagcacagcccuggacuacaaguuuggag

SEQ ID NO: 297232 - RNA, 64 nt, Human
ucagugagaauugcauuaggagcccucuggggaaagagcacaggaacugaguugcugggccuca

SEQ ID NO: 297233 - RNA, 59 nt, Human
acuccacuacccggguauagcuccaacucagagcacagccaaucuccaggcucccuccc

SEQ ID NO: 297234 - RNA, 64 nt, Human
uaugucaaaauuuuuacagguuugcucaucugccagagcacacauauaaauuugguauuucuua

SEQ ID NO: 297235 - RNA, 64 nt, Human
aagguugucaagacacacccuugggcuuaucuacagagcacacuuuucuaacagugaaucuccu

SEQ ID NO: 297236 - RNA, 64 nt, Human
ugaagcauguacucauugucagauguucccucugagagcacagaggaggcaaaagcuucugugg

SEQ ID NO: 297237 - RNA, 64 nt, Human
ugccaugcauuuuuuuuuuuacaguucucaaggaagagcacagaacaauuucucauuucauauu

SEQ ID NO: 297238 - RNA, 64 nt, Human
auauuugauuacguaacaaccagcuaaaacugagagcacacagccuucggaaacccccaaggug

SEQ ID NO: 297239 - RNA, 64 nt, Human
auaguuuagaauauuugcguauuaauuaugggcaagcacacaccuucugaauagaaauauuguu

SEQ ID NO: 297240 - RNA, 64 nt, Human
guguguuuuucuccucuugguuuucauuugcucaagcacacaaaagggacuuuuguuuacucua

SEQ ID NO: 297241 - RNA, 64 nt, Human
agacaccugggaggagucuccaagccaugugcacagcacacacgugcagugcacacaaagaaau

SEQ ID NO: 297242 - RNA, 64 nt, Human
cuuuucucuguaccuguguguauagaaauagauuagagcacaguugaaauucauggaacuggca

SEQ ID NO: 297243 - RNA, 64 nt, Human
uuauugcugaacaucauuguucaguaucaugucaagagcacauuguuauuuauccauucaucca

SEQ ID NO: 297244 - RNA, 64 nt, Human
uggcccuacagccugcuugcuccgccuauaccacagagcacagccuggacauuauggagggugu

SEQ ID NO: 297245 - RNA, 64 nt, Human
uuuaagugcagucauuucuuuuugguuugcaaaaagagcacagcccuggacuaugaguuuggag

SEQ ID NO: 297246 - RNA, 58 nt, Human
aacggaagcaggaugaauaaagaaagggagagcacaugaagcuuugcuaauuauaacc

SEQ ID NO: 297247 - RNA, 64 nt, Human
ugacaauuuuuuguauuugcuuuuucucccuuuaagagcacauucuucuguaaggagaaaggca

SEQ ID NO: 297248 - RNA, 64 nt, Human
cauguggucuucugaaaauggaacaccauucuucagagcacacgucuagcccucagcaagacag

SEQ ID NO: 297249 - RNA, 64 nt, Human
uaaauuuuccauauucuagaucauuuuuuauugaagagcacaguauguguggaagacaguguau

SEQ ID NO: 297250 - RNA, 64 nt, Human
uggccuuagguguccugacugucuaggcagccaaagagcacacguuaagcaauccagaggugcc

SEQ ID NO: 297251 - RNA, 64 nt, Human
auuuggccagagaugaccucaaggcccaccaaauagagcacaacuucccauugggagcuuuggc

SEQ ID NO: 297252 - RNA, 64 nt, Human
ccugcgaauuacccuaauucucaaaagcaaaacaagagcacacaagcgugaagaaaaggaucuu

SEQ ID NO: 297253 - RNA, 64 nt, Human
ggugcaggcaggcuggccuggggucaggccgggcagagcacagcggggugagagggauuccuaa

SEQ ID NO: 297254 - RNA, 64 nt, Human
agauggacagaggcccaaugggugaaggcuuugaagagcacacagaagccccuggccccccacg

SEQ ID NO: 297255 - RNA, 64 nt, Human
guuuucucuguaccuguguguauagaaauagaucagagcacaguugaaauucauggaacuggca

SEQ ID NO: 297256 - RNA, 64 nt, Human; identical to SEQ ID NO: 296840

SEQ ID NO: 297257 - RNA, 64 nt, Human; identical to SEQ ID NO: 296841

SEQ ID NO: 297258 - RNA, 64 nt, Human
agguuggucaucgugcagaaggccccaggaccucagcacacacagccuccucuuggucugagua

SEQ ID NO: 297259 - RNA, 64 nt, Human
uugcaauaauuuuggccuagagacuucaaauaguagcacacauuaagaaccuguuacagcucau

SEQ ID NO: 297260 - RNA, 64 nt, Human
guugcauugaauugaacuuuggcaaugagaacacagcacacagcucccuuuucaaaaagggucu

SEQ ID NO: 297261 - RNA, 64 nt, Human; identical to SEQ ID NO: 296842

SEQ ID NO: 297262 - RNA, 64 nt, Human; identical to SEQ ID NO: 296843

SEQ ID NO: 297263 - RNA, 64 nt, Human; identical to SEQ ID NO: 296844

SEQ ID NO: 297264 - RNA, 64 nt, Human; identical to SEQ ID NO: 296845

SEQ ID NO: 297265 - RNA, 64 nt, Human; identical to SEQ ID NO: 296846

SEQ ID NO: 297266 - RNA, 64 nt, Human; identical to SEQ ID NO: 296847

SEQ ID NO: 297267 - RNA, 64 nt, Human; identical to SEQ ID NO: 296848

SEQ ID NO: 297268 - RNA, 64 nt, Human; identical to SEQ ID NO: 296849

SEQ ID NO: 297269 - RNA, 64 nt, Human; identical to SEQ ID NO: 296850

SEQ ID NO: 297270 - RNA, 64 nt, Human; identical to SEQ ID NO: 296851

SEQ ID NO: 297271 - RNA, 64 nt, Human; identical to SEQ ID NO: 296855

SEQ ID NO: 297272 - RNA, 64 nt, Human; identical to SEQ ID NO: 296856

SEQ ID NO: 297273 - RNA, 64 nt, Human; identical to SEQ ID NO: 296857

SEQ ID NO: 297274 - RNA, 64 nt, Human; identical to SEQ ID NO: 296858

SEQ ID NO: 297275 - RNA, 64 nt, Human; identical to SEQ ID NO: 296859

SEQ ID NO: 297276 - RNA, 51 nt, Human; identical to SEQ ID NO: 296852

SEQ ID NO: 297277 - RNA, 64 nt, Human
uuuugcugcuaaagcaagagaaacuuggagcugaagcacacaccuggucugccccuagauuucu

SEQ ID NO: 297278 - RNA, 64 nt, Human
agaaggauggcggggcuagggaagcagagagcagagcacacacuggcucaagcagcagagguaa

SEQ ID NO: 297279 - RNA, 64 nt, Human
gacuuccccuucuggaaauguggugacuuggcuuagucuucaaacuggauucauggauuugaag

SEQ ID NO: 297280 - RNA, 64 nt, Human
aguugaggaagugugggccuggcuguucaugggaagucuucaguggccuucauggauggccauc

SEQ ID NO: 297281 - RNA, 64 nt, Human; identical to SEQ ID NO: 296860

SEQ ID NO: 297282 - RNA, 64 nt, Human; identical to SEQ ID NO: 296861

SEQ ID NO: 297283 - RNA, 64 nt, Human; identical to SEQ ID NO: 296862

SEQ ID NO: 297284 - RNA, 64 nt, Human; identical to SEQ ID NO: 296863

SEQ ID NO: 297285 - RNA, 64 nt, Human; identical to SEQ ID NO: 296864

SEQ ID NO: 297286 - RNA, 64 nt, Human; identical to SEQ ID NO: 296865

SEQ ID NO: 297287 - RNA, 64 nt, Human; identical to SEQ ID NO: 296866

SEQ ID NO: 297288 - RNA, 64 nt, Human; identical to SEQ ID NO: 296867

SEQ ID NO: 297289 - RNA, 64 nt, Human; identical to SEQ ID NO: 296868

SEQ ID NO: 297290 - RNA, 64 nt, Human; identical to SEQ ID NO: 296869

SEQ ID NO: 297291 - RNA, 64 nt, Human; identical to SEQ ID NO: 296870

SEQ ID NO: 297292 - RNA, 64 nt, Human; identical to SEQ ID NO: 296874

SEQ ID NO: 297293 - RNA, 64 nt, Human; identical to SEQ ID NO: 296875

SEQ ID NO: 297294 - RNA, 64 nt, Human; identical to SEQ ID NO: 296876

SEQ ID NO: 297295 - RNA, 64 nt, Human; identical to SEQ ID NO: 296877

SEQ ID NO: 297296 - RNA, 64 nt, Human; identical to SEQ ID NO: 296878

SEQ ID NO: 297297 - RNA, 64 nt, Human
gagugacacuauuuguaaauauaacuaguugugaagcacacauaccuuuauuuugggaauuuau

SEQ ID NO: 297298 - RNA, 64 nt, Human
cacagugagagcuuuuucccuuugcuaaccaacgagcacacagaagaucuccagucaccccaua

SEQ ID NO: 297299 - RNA, 64 nt, Human
cuguuaauaaaagaaaaacaaauguaauugaaauagcacacagcauucucuagucaauaucuuu

SEQ ID NO: 297300 - RNA, 64 nt, Human; identical to SEQ ID NO: 296879

SEQ ID NO: 297301 - RNA, 64 nt, Human; identical to SEQ ID NO: 296880

SEQ ID NO: 297302 - RNA, 64 nt, Human; identical to SEQ ID NO: 296881

SEQ ID NO: 297303 - RNA, 64 nt, Human; identical to SEQ ID NO: 296882

SEQ ID NO: 297304 - RNA, 64 nt, Human; identical to SEQ ID NO: 296883

SEQ ID NO: 297305 - RNA, 64 nt, Human; identical to SEQ ID NO: 296884

SEQ ID NO: 297306 - RNA, 64 nt, Human; identical to SEQ ID NO: 296885

SEQ ID NO: 297307 - RNA, 64 nt, Human; identical to SEQ ID NO: 296886

SEQ ID NO: 297308 - RNA, 64 nt, Human; identical to SEQ ID NO: 296887

SEQ ID NO: 297309 - RNA, 64 nt, Human; identical to SEQ ID NO: 296888

SEQ ID NO: 297310 - RNA, 64 nt, Human; identical to SEQ ID NO: 296889

SEQ ID NO: 297311 - RNA, 64 nt, Human; identical to SEQ ID NO: 296894

SEQ ID NO: 297312 - RNA, 62 nt, Human; identical to SEQ ID NO: 296895

SEQ ID NO: 297313 - RNA, 64 nt, Human; identical to SEQ ID NO: 296896

SEQ ID NO: 297314 - RNA, 64 nt, Human; identical to SEQ ID NO: 296897

SEQ ID NO: 297315 - RNA, 64 nt, Human; identical to SEQ ID NO: 296898

SEQ ID NO: 297316 - RNA, 64 nt, Human
ccugcuuucccaccucgaggccgcggccucccccccgauuuauagacaacucugacauugucac

SEQ ID NO: 297317 - RNA, 64 nt, Human
cucgucaccggagcugaucacugucaguuuuguaccgauuuagaaauaacaauaauaaugaaga

SEQ ID NO: 297318 - RNA, 64 nt, Human
ccaaaauacaaauuugacccaagaaaugaaaaagccgauuuaccuugaaacugagccuuugcaa

SEQ ID NO: 297319 - RNA, 64 nt, Human; identical to SEQ ID NO: 296899

SEQ ID NO: 297320 - RNA, 64 nt, Human; identical to SEQ ID NO: 296900

SEQ ID NO: 297321 - RNA, 64 nt, Human; identical to SEQ ID NO: 296901

SEQ ID NO: 297322 - RNA, 64 nt, Human; identical to SEQ ID NO: 296902

SEQ ID NO: 297323 - RNA, 64 nt, Human; identical to SEQ ID NO: 296903

SEQ ID NO: 297324 - RNA, 64 nt, Human; identical to SEQ ID NO: 296904

SEQ ID NO: 297325 - RNA, 64 nt, Human; identical to SEQ ID NO: 296905

SEQ ID NO: 297326 - RNA, 64 nt, Human; identical to SEQ ID NO: 296906

SEQ ID NO: 297327 - RNA, 64 nt, Human; identical to SEQ ID NO: 296907

SEQ ID NO: 297328 - RNA, 64 nt, Human; identical to SEQ ID NO: 296908

SEQ ID NO: 297329 - RNA, 64 nt, Human; identical to SEQ ID NO: 296909

SEQ ID NO: 297330 - RNA, 64 nt, Human; identical to SEQ ID NO: 296914

SEQ ID NO: 297331 - RNA, 64 nt, Human; identical to SEQ ID NO: 296915

SEQ ID NO: 297332 - RNA, 64 nt, Human; identical to SEQ ID NO: 296916

SEQ ID NO: 297333 - RNA, 64 nt, Human; identical to SEQ ID NO: 296917

SEQ ID NO: 297334 - RNA, 64 nt, Human; identical to SEQ ID NO: 296918

SEQ ID NO: 297335 - RNA, 64 nt, Human
gguacaccccaugucuccacagggcauacagcauccgauuuaaucuggauccauuccggcgccu

SEQ ID NO: 297336 - RNA, 64 nt, Human
cccagugauggucaguauucuuuuggaauguaaaccgauuuaaugccaaaccaccuuaaccuuu

SEQ ID NO: 297337 - RNA, 58 nt, Human; identical to SEQ ID NO: 296919

SEQ ID NO: 297338 - RNA, 64 nt, Human; identical to SEQ ID NO: 296920

SEQ ID NO: 297339 - RNA, 64 nt, Human; identical to SEQ ID NO: 296921

SEQ ID NO: 297340 - RNA, 64 nt, Human; identical to SEQ ID NO: 296922

SEQ ID NO: 297341 - RNA, 64 nt, Human; identical to SEQ ID NO: 296923

SEQ ID NO: 297342 - RNA, 64 nt, Human; identical to SEQ ID NO: 296924

SEQ ID NO: 297343 - RNA, 64 nt, Human; identical to SEQ ID NO: 296925

SEQ ID NO: 297344 - RNA, 64 nt, Human; identical to SEQ ID NO: 296926

SEQ ID NO: 297345 - RNA, 64 nt, Human; identical to SEQ ID NO: 296927

SEQ ID NO: 297346 - RNA, 64 nt, Human; identical to SEQ ID NO: 296928

SEQ ID NO: 297347 - RNA, 64 nt, Human; identical to SEQ ID NO: 296929

SEQ ID NO: 297348 - RNA, 64 nt, Human; identical to SEQ ID NO: 296934

SEQ ID NO: 297349 - RNA, 64 nt, Human; identical to SEQ ID NO: 296935

SEQ ID NO: 297350 - RNA, 64 nt, Human; identical to SEQ ID NO: 296936

SEQ ID NO: 297351 - RNA, 64 nt, Human; identical to SEQ ID NO: 296937

SEQ ID NO: 297352 - RNA, 64 nt, Human; identical to SEQ ID NO: 296938

SEQ ID NO: 297353 - RNA, 64 nt, Human
uuaugaugaaguaaguguuaagugucagauaaauagcacacagaauaguucuuucugcuggucu

SEQ ID NO: 297354 - RNA, 64 nt, Human
acauccuucagacuuuuaaggcauuccaaaucccagucuucauguugaacuggguuaagcauuu

SEQ ID NO: 297355 - RNA, 64 nt, Human; identical to SEQ ID NO: 296939

SEQ ID NO: 297356 - RNA, 64 nt, Human; identical to SEQ ID NO: 296940

SEQ ID NO: 297357 - RNA, 64 nt, Human; identical to SEQ ID NO: 296941

SEQ ID NO: 297358 - RNA, 64 nt, Human; identical to SEQ ID NO: 296942

SEQ ID NO: 297359 - RNA, 64 nt, Human; identical to SEQ ID NO: 296943

SEQ ID NO: 297360 - RNA, 64 nt, Human; identical to SEQ ID NO: 296944

SEQ ID NO: 297361 - RNA, 64 nt, Human; identical to SEQ ID NO: 296945

SEQ ID NO: 297362 - RNA, 64 nt, Human; identical to SEQ ID NO: 296946

SEQ ID NO: 297363 - RNA, 64 nt, Human; identical to SEQ ID NO: 296947

SEQ ID NO: 297364 - RNA, 64 nt, Human; identical to SEQ ID NO: 296948

SEQ ID NO: 297365 - RNA, 64 nt, Human; identical to SEQ ID NO: 296949

SEQ ID NO: 297366 - RNA, 64 nt, Human; identical to SEQ ID NO: 296953

SEQ ID NO: 297367 - RNA, 64 nt, Human; identical to SEQ ID NO: 296954

SEQ ID NO: 297368 - RNA, 64 nt, Human; identical to SEQ ID NO: 296955

SEQ ID NO: 297369 - RNA, 64 nt, Human; identical to SEQ ID NO: 296956

SEQ ID NO: 297370 - RNA, 64 nt, Human; identical to SEQ ID NO: 296957

SEQ ID NO: 297371 - RNA, 64 nt, Human
uuacuuuuuuuuuuuuuuuaaaagcuauguuguuagcacacagaacacuucauuguuguuuuug

SEQ ID NO: 297372 - RNA, 64 nt, Human
ucaaaauggauuucauauaauuucggagcacggaagcacacacaagcucuuuaugaauucugcu

SEQ ID NO: 297373 - RNA, 64 nt, Human
uugcugcagaaauguccuaugcacucuuugcaagagcacacaacaaaugucagauaccaauuuu

SEQ ID NO: 297374 - RNA, 64 nt, Human; identical to SEQ ID NO: 296958

SEQ ID NO: 297375 - RNA, 64 nt, Human; identical to SEQ ID NO: 296959

SEQ ID NO: 297376 - RNA, 64 nt, Human; identical to SEQ ID NO: 296960

SEQ ID NO: 297377 - RNA, 64 nt, Human; identical to SEQ ID NO: 296961

SEQ ID NO: 297378 - RNA, 64 nt, Human; identical to SEQ ID NO: 296962

SEQ ID NO: 297379 - RNA, 64 nt, Human; identical to SEQ ID NO: 296963

SEQ ID NO: 297380 - RNA, 64 nt, Human; identical to SEQ ID NO: 296964

SEQ ID NO: 297381 - RNA, 64 nt, Human; identical to SEQ ID NO: 296965

SEQ ID NO: 297382 - RNA, 64 nt, Human; identical to SEQ ID NO: 296966

SEQ ID NO: 297383 - RNA, 64 nt, Human; identical to SEQ ID NO: 296967

SEQ ID NO: 297384 - RNA, 64 nt, Human; identical to SEQ ID NO: 296968

SEQ ID NO: 297385 - RNA, 64 nt, Human; identical to SEQ ID NO: 296972

SEQ ID NO: 297386 - RNA, 64 nt, Human; identical to SEQ ID NO: 296973

SEQ ID NO: 297387 - RNA, 64 nt, Human; identical to SEQ ID NO: 296974

SEQ ID NO: 297388 - RNA, 64 nt, Human; identical to SEQ ID NO: 296975

SEQ ID NO: 297389 - RNA, 64 nt, Human; identical to SEQ ID NO: 296976

SEQ ID NO: 297390 - RNA, 64 nt, Human
uucugcagauccauggcugcccugggaacuccaaagcacacaccuacuuccuccccagcucacg

SEQ ID NO: 297391 - RNA, 64 nt, Human
caggcaaggauuuuuggguuuaagaugcacuuuuagcacacauuuguauuucccuuggcauauc

SEQ ID NO: 297392 - RNA, 64 nt, Human
acguccuugaguggaguucccugcugaagccccuagcacacacugcaugccuuaacaagugugu

SEQ ID NO: 297393 - RNA, 64 nt, Human; identical to SEQ ID NO: 296977

SEQ ID NO: 297394 - RNA, 64 nt, Human; identical to SEQ ID NO: 296978

SEQ ID NO: 297395 - RNA, 64 nt, Human; identical to SEQ ID NO: 296979

SEQ ID NO: 297396 - RNA, 64 nt, Human; identical to SEQ ID NO: 296980

SEQ ID NO: 297397 - RNA, 64 nt, Human; identical to SEQ ID NO: 296981

SEQ ID NO: 297398 - RNA, 56 nt, Human; identical to SEQ ID NO: 296982

SEQ ID NO: 297399 - RNA, 64 nt, Human; identical to SEQ ID NO: 296983

SEQ ID NO: 297400 - RNA, 64 nt, Human; identical to SEQ ID NO: 296984

SEQ ID NO: 297401 - RNA, 64 nt, Human; identical to SEQ ID NO: 296985

SEQ ID NO: 297402 - RNA, 64 nt, Human; identical to SEQ ID NO: 296986

SEQ ID NO: 297403 - RNA, 64 nt, Human; identical to SEQ ID NO: 296987

SEQ ID NO: 297404 - RNA, 64 nt, Human; identical to SEQ ID NO: 294673

SEQ ID NO: 297405 - RNA, 51 nt, Human; identical to SEQ ID NO: 296853

SEQ ID NO: 297406 - RNA, 64 nt, Human; identical to SEQ ID NO: 294674

SEQ ID NO: 297407 - RNA, 64 nt, Human; identical to SEQ ID NO: 294675

SEQ ID NO: 297408 - RNA, 64 nt, Human; identical to SEQ ID NO: 294676

SEQ ID NO: 297409 - RNA, 64 nt, Human
cuuggugccacagagggcugugucuuacuagaaacaacgcaaaccucuccuuccucagaauagu

SEQ ID NO: 297410 - RNA, 64 nt, Human
ccagacccaaagagguugauucaguugccuucugcaacgcaaaguaauguuuugaguucuguaa

SEQ ID NO: 297411 - RNA, 64 nt, Human
cuuccuggagggcagccccacaggacgguuuaugagcacacaauuauagcuuguuucuacuuua

SEQ ID NO: 297412 - RNA, 64 nt, Human; identical to SEQ ID NO: 294677

SEQ ID NO: 297413 - RNA, 64 nt, Human; identical to SEQ ID NO: 294678

SEQ ID NO: 297414 - RNA, 64 nt, Human; identical to SEQ ID NO: 294679

SEQ ID NO: 297415 - RNA, 64 nt, Human; identical to SEQ ID NO: 294680

SEQ ID NO: 297416 - RNA, 64 nt, Human; identical to SEQ ID NO: 294681

SEQ ID NO: 297417 - RNA, 64 nt, Human; identical to SEQ ID NO: 294682

SEQ ID NO: 297418 - RNA, 64 nt, Human; identical to SEQ ID NO: 294683

SEQ ID NO: 297419 - RNA, 64 nt, Human; identical to SEQ ID NO: 294684

SEQ ID NO: 297420 - RNA, 64 nt, Human; identical to SEQ ID NO: 294685

SEQ ID NO: 297421 - RNA, 64 nt, Human; identical to SEQ ID NO: 294686

SEQ ID NO: 297422 - RNA, 64 nt, Human; identical to SEQ ID NO: 296992

SEQ ID NO: 297423 - RNA, 64 nt, Human; identical to SEQ ID NO: 297012

SEQ ID NO: 297424 - RNA, 62 nt, Human; identical to SEQ ID NO: 297013

SEQ ID NO: 297425 - RNA, 64 nt, Human; identical to SEQ ID NO: 297014

SEQ ID NO: 297426 - RNA, 64 nt, Human; identical to SEQ ID NO: 297015

SEQ ID NO: 297427 - RNA, 64 nt, Human; identical to SEQ ID NO: 297016

SEQ ID NO: 297428 - RNA, 64 nt, Human
cccuguauaucuuagcagcacugaguccagugcgagcacacacccacuauacaagaguggcuau

SEQ ID NO: 297429 - RNA, 64 nt, Human
ucuucuucuuuuuuuuuuucugaaaaaaggaaaaagcacacagcacacaauuucaagccauuuu

SEQ ID NO: 297430 - RNA, 53 nt, Human
cucaggagugugguuguuaggagagcacacagguguucauacaguggcauuug

SEQ ID NO: 297431 - RNA, 64 nt, Human
ggaugcagagaaucagacuggccugaggugaaggagcacacagcccugagggcuuggaacccug

SEQ ID NO: 297432 - RNA, 64 nt, Human; identical to SEQ ID NO: 297017

SEQ ID NO: 297433 - RNA, 64 nt, Human; identical to SEQ ID NO: 297018

SEQ ID NO: 297434 - RNA, 64 nt, Human; identical to SEQ ID NO: 297019

SEQ ID NO: 297435 - RNA, 64 nt, Human; identical to SEQ ID NO: 297020

SEQ ID NO: 297436 - RNA, 64 nt, Human; identical to SEQ ID NO: 297021

SEQ ID NO: 297437 - RNA, 64 nt, Human; identical to SEQ ID NO: 297022

SEQ ID NO: 297438 - RNA, 64 nt, Human; identical to SEQ ID NO: 297023

SEQ ID NO: 297439 - RNA, 64 nt, Human; identical to SEQ ID NO: 297024

SEQ ID NO: 297440 - RNA, 64 nt, Human; identical to SEQ ID NO: 297025

SEQ ID NO: 297441 - RNA, 64 nt, Human; identical to SEQ ID NO: 297026

SEQ ID NO: 297442 - RNA, 64 nt, Human; identical to SEQ ID NO: 297027

SEQ ID NO: 297443 - RNA, 64 nt, Human; identical to SEQ ID NO: 297031

SEQ ID NO: 297444 - RNA, 64 nt, Human; identical to SEQ ID NO: 297032

SEQ ID NO: 297445 - RNA, 64 nt, Human; identical to SEQ ID NO: 297033

SEQ ID NO: 297446 - RNA, 64 nt, Human; identical to SEQ ID NO: 297034

SEQ ID NO: 297447 - RNA, 64 nt, Human; identical to SEQ ID NO: 297035

SEQ ID NO: 297448 - RNA, 64 nt, Human
ggccagcuggaaguguggagcacacaugcuguggagcacacaugcuguggagauugcagugugu

SEQ ID NO: 297449 - RNA, 64 nt, Human
gaagcccaccgugccccaugcaggggcucccuccagcacacagcccucaccccagcacagccag

SEQ ID NO: 297450 - RNA, 64 nt, Human
aggcuguagaguggcugugucgggcaucagauggagcacacagguggcugcagcccagcccacc

SEQ ID NO: 297451 - RNA, 64 nt, Human; identical to SEQ ID NO: 297036

SEQ ID NO: 297452 - RNA, 64 nt, Human; identical to SEQ ID NO: 297037

SEQ ID NO: 297453 - RNA, 64 nt, Human; identical to SEQ ID NO: 297038

SEQ ID NO: 297454 - RNA, 64 nt, Human; identical to SEQ ID NO: 297039

SEQ ID NO: 297455 - RNA, 64 nt, Human; identical to SEQ ID NO: 297040

SEQ ID NO: 297456 - RNA, 64 nt, Human; identical to SEQ ID NO: 297041

SEQ ID NO: 297457 - RNA, 64 nt, Human; identical to SEQ ID NO: 297042

SEQ ID NO: 297458 - RNA, 64 nt, Human; identical to SEQ ID NO: 297043

SEQ ID NO: 297459 - RNA, 64 nt, Human; identical to SEQ ID NO: 297044

SEQ ID NO: 297460 - RNA, 64 nt, Human; identical to SEQ ID NO: 297045

SEQ ID NO: 297461 - RNA, 64 nt, Human; identical to SEQ ID NO: 297046

SEQ ID NO: 297462 - RNA, 64 nt, Human; identical to SEQ ID NO: 297050

SEQ ID NO: 297463 - RNA, 64 nt, Human; identical to SEQ ID NO: 297051

SEQ ID NO: 297464 - RNA, 64 nt, Human; identical to SEQ ID NO: 297052

SEQ ID NO: 297465 - RNA, 64 nt, Human; identical to SEQ ID NO: 297053

SEQ ID NO: 297466 - RNA, 64 nt, Human; identical to SEQ ID NO: 297054

SEQ ID NO: 297467 - RNA, 64 nt, Human
aucaucuaagaaaaugauuccauacaaauaacucagcacacaagugacccaggacauaugccug

SEQ ID NO: 297468 - RNA, 64 nt, Human
uucuggcccccaaacaagggaagauaaaguccccagcacacagcaggagucaaaaauucuucuc

SEQ ID NO: 297469 - RNA, 64 nt, Human
aucuuugaagcauuuugggcuuaagauugccagcagcacacaucagaugcagucauuguugcua

SEQ ID NO: 297470 - RNA, 64 nt, Human; identical to SEQ ID NO: 297055

SEQ ID NO: 297471 - RNA, 64 nt, Human; identical to SEQ ID NO: 297056

SEQ ID NO: 297472 - RNA, 64 nt, Human; identical to SEQ ID NO: 297057

SEQ ID NO: 297473 - RNA, 64 nt, Human; identical to SEQ ID NO: 297058

SEQ ID NO: 297474 - RNA, 64 nt, Human; identical to SEQ ID NO: 297059

SEQ ID NO: 297475 - RNA, 64 nt, Human; identical to SEQ ID NO: 297060

SEQ ID NO: 297476 - RNA, 64 nt, Human; identical to SEQ ID NO: 297061

SEQ ID NO: 297477 - RNA, 64 nt, Human; identical to SEQ ID NO: 297062

SEQ ID NO: 297478 - RNA, 64 nt, Human; identical to SEQ ID NO: 297063

SEQ ID NO: 297479 - RNA, 64 nt, Human; identical to SEQ ID NO: 297064

SEQ ID NO: 297480 - RNA, 64 nt, Human; identical to SEQ ID NO: 297065

SEQ ID NO: 297481 - RNA, 64 nt, Human; identical to SEQ ID NO: 297069

SEQ ID NO: 297482 - RNA, 64 nt, Human; identical to SEQ ID NO: 297070

SEQ ID NO: 297483 - RNA, 64 nt, Human; identical to SEQ ID NO: 297071

SEQ ID NO: 297484 - RNA, 64 nt, Human; identical to SEQ ID NO: 297072

SEQ ID NO: 297485 - RNA, 64 nt, Human; identical to SEQ ID NO: 297073

SEQ ID NO: 297486 - RNA, 64 nt, Human
uucgaaggcccagauaagacagggaacacuugugagcacacagagcagcaucugaugcccugug

SEQ ID NO: 297487 - RNA, 64 nt, Human
agguggugaucuuaaaugggugagauggaacgagagcacacauuaaagagagaguaaauuccaa

SEQ ID NO: 297488 - RNA, 64 nt, Human
ucaaauuaaggcaacaaacauauaccuuccaugaagcacacacagacuuuugaaagcaaggaca

SEQ ID NO: 297489 - RNA, 64 nt, Human; identical to SEQ ID NO: 297074

SEQ ID NO: 297490 - RNA, 64 nt, Human; identical to SEQ ID NO: 297075

SEQ ID NO: 297491 - RNA, 64 nt, Human; identical to SEQ ID NO: 297076

SEQ ID NO: 297492 - RNA, 64 nt, Human; identical to SEQ ID NO: 297077

SEQ ID NO: 297493 - RNA, 64 nt, Human; identical to SEQ ID NO: 297078

SEQ ID NO: 297494 - RNA, 64 nt, Human; identical to SEQ ID NO: 297079

SEQ ID NO: 297495 - RNA, 64 nt, Human; identical to SEQ ID NO: 297080

SEQ ID NO: 297496 - RNA, 64 nt, Human; identical to SEQ ID NO: 297081

SEQ ID NO: 297497 - RNA, 64 nt, Human; identical to SEQ ID NO: 297082

SEQ ID NO: 297498 - RNA, 64 nt, Human; identical to SEQ ID NO: 297083

SEQ ID NO: 297499 - RNA, 64 nt, Human; identical to SEQ ID NO: 297084

SEQ ID NO: 297500 - RNA, 64 nt, Human; identical to SEQ ID NO: 297089

SEQ ID NO: 297501 - RNA, 64 nt, Human; identical to SEQ ID NO: 297090

SEQ ID NO: 297502 - RNA, 64 nt, Human; identical to SEQ ID NO: 297091

SEQ ID NO: 297503 - RNA, 64 nt, Human; identical to SEQ ID NO: 297092

SEQ ID NO: 297504 - RNA, 64 nt, Human; identical to SEQ ID NO: 297093

SEQ ID NO: 297505 - RNA, 64 nt, Human
gguggggcuacugcagugugcugccaaaugggacagcacacagccugugcacaugggacaugug

SEQ ID NO: 297506 - RNA, 64 nt, Human
aaugagaaagccugagaagaaagaaccaaccacaagcacacaggaaggaaagcgcaggagguga

SEQ ID NO: 297507 - RNA, 64 nt, Human
augauauaagguuuuuuuuucucacagaagaugaagcacacaggaaccuaaugggccaacuggg

SEQ ID NO: 297508 - RNA, 64 nt, Human; identical to SEQ ID NO: 297094

SEQ ID NO: 297509 - RNA, 64 nt, Human; identical to SEQ ID NO: 297095

SEQ ID NO: 297510 - RNA, 64 nt, Human; identical to SEQ ID NO: 297096

SEQ ID NO: 297511 - RNA, 64 nt, Human; identical to SEQ ID NO: 297097

SEQ ID NO: 297512 - RNA, 64 nt, Human; identical to SEQ ID NO: 297098

SEQ ID NO: 297513 - RNA, 64 nt, Human; identical to SEQ ID NO: 297099

SEQ ID NO: 297514 - RNA, 64 nt, Human; identical to SEQ ID NO: 297100

SEQ ID NO: 297515 - RNA, 64 nt, Human; identical to SEQ ID NO: 297101

SEQ ID NO: 297516 - RNA, 64 nt, Human; identical to SEQ ID NO: 297102

SEQ ID NO: 297517 - RNA, 64 nt, Human; identical to SEQ ID NO: 297103

SEQ ID NO: 297518 - RNA, 64 nt, Human; identical to SEQ ID NO: 297104

SEQ ID NO: 297519 - RNA, 64 nt, Human; identical to SEQ ID NO: 297108

SEQ ID NO: 297520 - RNA, 64 nt, Human; identical to SEQ ID NO: 297109

SEQ ID NO: 297521 - RNA, 64 nt, Human; identical to SEQ ID NO: 297110

SEQ ID NO: 297522 - RNA, 64 nt, Human; identical to SEQ ID NO: 297111

SEQ ID NO: 297523 - RNA, 64 nt, Human; identical to SEQ ID NO: 297112

SEQ ID NO: 297524 - RNA, 64 nt, Human
cacuaaaaugguugcaguuuuauggcauaugucuccgauuuagaugguuauucucuagaaaaua

SEQ ID NO: 297525 - RNA, 64 nt, Human
auaaauuugaauuucuguaggaagaaucaaaucaccgauuuaaagagugcaauauauaauaauc

SEQ ID NO: 297526 - RNA, 64 nt, Human
uucucauuuuucuaaaagaaagaaaaaaggaaacccgauuuauuucuccugaaucuuuuuaagu

SEQ ID NO: 297527 - RNA, 64 nt, Human; identical to SEQ ID NO: 297113

SEQ ID NO: 297528 - RNA, 64 nt, Human; identical to SEQ ID NO: 297114

SEQ ID NO: 297529 - RNA, 64 nt, Human; identical to SEQ ID NO: 297115

SEQ ID NO: 297530 - RNA, 64 nt, Human; identical to SEQ ID NO: 297116

SEQ ID NO: 297531 - RNA, 64 nt, Human; identical to SEQ ID NO: 297117

SEQ ID NO: 297532 - RNA, 64 nt, Human; identical to SEQ ID NO: 297118

SEQ ID NO: 297533 - RNA, 64 nt, Human; identical to SEQ ID NO: 297119

SEQ ID NO: 297534 - RNA, 64 nt, Human; identical to SEQ ID NO: 297120

SEQ ID NO: 297535 - RNA, 64 nt, Human; identical to SEQ ID NO: 297121

SEQ ID NO: 297536 - RNA, 64 nt, Human; identical to SEQ ID NO: 297122

SEQ ID NO: 297537 - RNA, 64 nt, Human; identical to SEQ ID NO: 297123

SEQ ID NO: 297538 - RNA, 64 nt, Human; identical to SEQ ID NO: 297127

SEQ ID NO: 297539 - RNA, 64 nt, Human; identical to SEQ ID NO: 297128

SEQ ID NO: 297540 - RNA, 64 nt, Human; identical to SEQ ID NO: 297129

SEQ ID NO: 297541 - RNA, 64 nt, Human; identical to SEQ ID NO: 297130

SEQ ID NO: 297542 - RNA, 64 nt, Human; identical to SEQ ID NO: 297131

SEQ ID NO: 297543 - RNA, 64 nt, Human
ggacuugcuaaaugaccuagcacuauucucuggcccgauuuaucauaucccuuuucuccuccaa

SEQ ID NO: 297544 - RNA, 64 nt, Human
uguaaaaaacaaugccuguacugaaguaccaccaccgauuuaaaugggcugaguugggggaggc

SEQ ID NO: 297545 - RNA, 64 nt, Human
ccuccaagggaaugaauuauucaguuaauguaauagcacacauuaaagaguguaaaaucaauug

SEQ ID NO: 297546 - RNA, 64 nt, Human; identical to SEQ ID NO: 297132

SEQ ID NO: 297547 - RNA, 64 nt, Human; identical to SEQ ID NO: 297133

SEQ ID NO: 297548 - RNA, 64 nt, Human; identical to SEQ ID NO: 297134

SEQ ID NO: 297549 - RNA, 64 nt, Human; identical to SEQ ID NO: 297135

SEQ ID NO: 297550 - RNA, 64 nt, Human; identical to SEQ ID NO: 297136

SEQ ID NO: 297551 - RNA, 64 nt, Human; identical to SEQ ID NO: 297137

SEQ ID NO: 297552 - RNA, 64 nt, Human; identical to SEQ ID NO: 297138

SEQ ID NO: 297553 - RNA, 64 nt, Human; identical to SEQ ID NO: 297139

SEQ ID NO: 297554 - RNA, 64 nt, Human; identical to SEQ ID NO: 297140

SEQ ID NO: 297555 - RNA, 64 nt, Human; identical to SEQ ID NO: 297141

SEQ ID NO: 297556 - RNA, 64 nt, Human; identical to SEQ ID NO: 297142

SEQ ID NO: 297557 - RNA, 64 nt, Human; identical to SEQ ID NO: 297146

SEQ ID NO: 297558 - RNA, 64 nt, Human; identical to SEQ ID NO: 297147

SEQ ID NO: 297559 - RNA, 64 nt, Human; identical to SEQ ID NO: 297148

SEQ ID NO: 297560 - RNA, 64 nt, Human; identical to SEQ ID NO: 297149

SEQ ID NO: 297561 - RNA, 64 nt, Human; identical to SEQ ID NO: 297150

SEQ ID NO: 297562 - RNA, 64 nt, Human
uguuucauuuuggugugcaacccugucauuacgucaacgcaacgucuaacuggacuucccaaga

SEQ ID NO: 297563 - RNA, 64 nt, Human
auacauccaaagggccugggaguuggggggugcccaacgcaauccuugggggugcaggguggag

SEQ ID NO: 297564 - RNA, 64 nt, Human
uuauuuuccauuuggaacgugggacaacagaccacaacgcaauuccauuuugcaagucuuucca

SEQ ID NO: 297565 - RNA, 64 nt, Human; identical to SEQ ID NO: 297151

SEQ ID NO: 297566 - RNA, 64 nt, Human; identical to SEQ ID NO: 297152

SEQ ID NO: 297567 - RNA, 64 nt, Human; identical to SEQ ID NO: 297153

SEQ ID NO: 297568 - RNA, 64 nt, Human; identical to SEQ ID NO: 297154

SEQ ID NO: 297569 - RNA, 64 nt, Human; identical to SEQ ID NO: 297155

SEQ ID NO: 297570 - RNA, 64 nt, Human; identical to SEQ ID NO: 297156

SEQ ID NO: 297571 - RNA, 64 nt, Human; identical to SEQ ID NO: 297157

SEQ ID NO: 297572 - RNA, 64 nt, Human; identical to SEQ ID NO: 297158

SEQ ID NO: 297573 - RNA, 64 nt, Human; identical to SEQ ID NO: 297159

SEQ ID NO: 297574 - RNA, 64 nt, Human; identical to SEQ ID NO: 297160

SEQ ID NO: 297575 - RNA, 64 nt, Human; identical to SEQ ID NO: 297161

SEQ ID NO: 297576 - RNA, 64 nt, Human; identical to SEQ ID NO: 297165

SEQ ID NO: 297577 - RNA, 64 nt, Human; identical to SEQ ID NO: 297166

SEQ ID NO: 297578 - RNA, 64 nt, Human; identical to SEQ ID NO: 297167

SEQ ID NO: 297579 - RNA, 64 nt, Human; identical to SEQ ID NO: 297168

SEQ ID NO: 297580 - RNA, 64 nt, Human; identical to SEQ ID NO: 297169

SEQ ID NO: 297581 - RNA, 64 nt, Human
uuuggaacugucguacacauucuauauguaagauagcacacaaguagaaauauuuaaaagcagu

SEQ ID NO: 297582 - RNA, 64 nt, Human
gagaugcugggagggcugaacccccacucacacaagcacacacacacaguccucacacacggag

SEQ ID NO: 297583 - RNA, 64 nt, Human
gucaugauuaccugcaugcuuugagcucagcagcagucuucauaaacacauuuaaaacaagauc

SEQ ID NO: 297584 - RNA, 59 nt, Human; identical to SEQ ID NO: 297170

SEQ ID NO: 297585 - RNA, 64 nt, Human; identical to SEQ ID NO: 297171

SEQ ID NO: 297586 - RNA, 64 nt, Human; identical to SEQ ID NO: 297172

SEQ ID NO: 297587 - RNA, 64 nt, Human; identical to SEQ ID NO: 297173

SEQ ID NO: 297588 - RNA, 64 nt, Human; identical to SEQ ID NO: 297174

SEQ ID NO: 297589 - RNA, 64 nt, Human; identical to SEQ ID NO: 297175

SEQ ID NO: 297590 - RNA, 64 nt, Human; identical to SEQ ID NO: 297176

SEQ ID NO: 297591 - RNA, 64 nt, Human; identical to SEQ ID NO: 297177

SEQ ID NO: 297592 - RNA, 64 nt, Human; identical to SEQ ID NO: 297178

SEQ ID NO: 297593 - RNA, 64 nt, Human; identical to SEQ ID NO: 297179

SEQ ID NO: 297594 - RNA, 64 nt, Human; identical to SEQ ID NO: 297180

SEQ ID NO: 297595 - RNA, 64 nt, Human; identical to SEQ ID NO: 297184

SEQ ID NO: 297596 - RNA, 64 nt, Human; identical to SEQ ID NO: 297185

SEQ ID NO: 297597 - RNA, 64 nt, Human; identical to SEQ ID NO: 297186

SEQ ID NO: 297598 - RNA, 64 nt, Human; identical to SEQ ID NO: 297187

SEQ ID NO: 297599 - RNA, 64 nt, Human; identical to SEQ ID NO: 297188

SEQ ID NO: 297600 - RNA, 64 nt, Human
agcaaccacaaguuuaaaugaagacaagcugaaacaacgcaagcugguuuuauauuagauauuu

SEQ ID NO: 297601 - RNA, 64 nt, Human
ucucuuucuauuccccagugaacugagguuuuuaccgauuuauagagcagucaaauccgaagug

SEQ ID NO: 297602 - RNA, 64 nt, Human
gauaguuauguucagcuuuugaaaauggacguuuccgauuuacaaauguaaaauugcagcuuau

SEQ ID NO: 297603 - RNA, 64 nt, Human; identical to SEQ ID NO: 297189

SEQ ID NO: 297604 - RNA, 60 nt, Human; identical to SEQ ID NO: 297190

SEQ ID NO: 297605 - RNA, 64 nt, Human; identical to SEQ ID NO: 297191

SEQ ID NO: 297606 - RNA, 64 nt, Human; identical to SEQ ID NO: 297192

SEQ ID NO: 297607 - RNA, 64 nt, Human; identical to SEQ ID NO: 297193

SEQ ID NO: 297608 - RNA, 64 nt, Human; identical to SEQ ID NO: 297194

SEQ ID NO: 297609 - RNA, 64 nt, Human; identical to SEQ ID NO: 297195

SEQ ID NO: 297610 - RNA, 64 nt, Human; identical to SEQ ID NO: 297196

SEQ ID NO: 297611 - RNA, 64 nt, Human; identical to SEQ ID NO: 297197

SEQ ID NO: 297612 - RNA, 64 nt, Human; identical to SEQ ID NO: 297198

SEQ ID NO: 297613 - RNA, 64 nt, Human; identical to SEQ ID NO: 297199

SEQ ID NO: 297614 - RNA, 64 nt, Human; identical to SEQ ID NO: 297203

SEQ ID NO: 297615 - RNA, 64 nt, Human; identical to SEQ ID NO: 297204

SEQ ID NO: 297616 - RNA, 64 nt, Human; identical to SEQ ID NO: 297205

SEQ ID NO: 297617 - RNA, 64 nt, Human; identical to SEQ ID NO: 297206

SEQ ID NO: 297618 - RNA, 64 nt, Human; identical to SEQ ID NO: 297207

SEQ ID NO: 297619 - RNA, 64 nt, Human
auugaccaguguucuuuauugcaaaaacauauacccgauuuagcagugucagcguauuuuuucu

SEQ ID NO: 297620 - RNA, 64 nt, Human
caaauaagaaaauuguguacucuagaaauggagaccgauuuacaauuuauguauucccuaaucc

SEQ ID NO: 297621 - RNA, 64 nt, Human
aucaagaugaaagcccuaauauguaaagucaaauccgauuuaaauuuugugcuuuuauagaaag

SEQ ID NO: 297622 - RNA, 64 nt, Human; identical to SEQ ID NO: 297208

SEQ ID NO: 297623 - RNA, 64 nt, Human; identical to SEQ ID NO: 297209

SEQ ID NO: 297624 - RNA, 64 nt, Human; identical to SEQ ID NO: 297210

SEQ ID NO: 297625 - RNA, 64 nt, Human; identical to SEQ ID NO: 297211

SEQ ID NO: 297626 - RNA, 64 nt, Human; identical to SEQ ID NO: 297212

SEQ ID NO: 297627 - RNA, 64 nt, Human; identical to SEQ ID NO: 297213

SEQ ID NO: 297628 - RNA, 64 nt, Human; identical to SEQ ID NO: 297214

SEQ ID NO: 297629 - RNA, 64 nt, Human; identical to SEQ ID NO: 297215

SEQ ID NO: 297630 - RNA, 64 nt, Human; identical to SEQ ID NO: 297216

SEQ ID NO: 297631 - RNA, 64 nt, Human; identical to SEQ ID NO: 297217

SEQ ID NO: 297632 - RNA, 64 nt, Human; identical to SEQ ID NO: 297218

SEQ ID NO: 297633 - RNA, 64 nt, Human; identical to SEQ ID NO: 297222

SEQ ID NO: 297634 - RNA, 64 nt, Human; identical to SEQ ID NO: 297223

SEQ ID NO: 297635 - RNA, 64 nt, Human; identical to SEQ ID NO: 297224

SEQ ID NO: 297636 - RNA, 64 nt, Human; identical to SEQ ID NO: 297225

SEQ ID NO: 297637 - RNA, 64 nt, Human; identical to SEQ ID NO: 297226

SEQ ID NO: 297638 - RNA, 64 nt, Human
cugcccagcuucaagauauugaaggaaaaauugaccgauuuauuauuccuagagagguagaaaa

SEQ ID NO: 297639 - RNA, 64 nt, Human
uguagggccagagaguaguacaacguuaaauuguccgauuuauguguauuacuuaaagcuauaa

SEQ ID NO: 297640 - RNA, 64 nt, Human
acaguaugaacccugcuugauguaaaauggaaauagcacacaggcagauggcccuggguuugga

SEQ ID NO: 297641 - RNA, 64 nt, Human; identical to SEQ ID NO: 297227

SEQ ID NO: 297642 - RNA, 64 nt, Human; identical to SEQ ID NO: 297228

SEQ ID NO: 297643 - RNA, 64 nt, Human; identical to SEQ ID NO: 297229

SEQ ID NO: 297644 - RNA, 64 nt, Human; identical to SEQ ID NO: 297230

SEQ ID NO: 297645 - RNA, 64 nt, Human; identical to SEQ ID NO: 297231

SEQ ID NO: 297646 - RNA, 64 nt, Human; identical to SEQ ID NO: 297232

SEQ ID NO: 297647 - RNA, 59 nt, Human; identical to SEQ ID NO: 297233

SEQ ID NO: 297648 - RNA, 64 nt, Human; identical to SEQ ID NO: 297234

SEQ ID NO: 297649 - RNA, 64 nt, Human; identical to SEQ ID NO: 297235

SEQ ID NO: 297650 - RNA, 64 nt, Human; identical to SEQ ID NO: 297236

SEQ ID NO: 297651 - RNA, 64 nt, Human; identical to SEQ ID NO: 297237

SEQ ID NO: 297652 - RNA, 64 nt, Human; identical to SEQ ID NO: 297242

SEQ ID NO: 297653 - RNA, 64 nt, Human; identical to SEQ ID NO: 297243

SEQ ID NO: 297654 - RNA, 64 nt, Human; identical to SEQ ID NO: 297244

SEQ ID NO: 297655 - RNA, 64 nt, Human; identical to SEQ ID NO: 297245

SEQ ID NO: 297656 - RNA, 58 nt, Human; identical to SEQ ID NO: 297246

SEQ ID NO: 297657 - RNA, 64 nt, Human
ccagagaaagugauagaaucuuccccaaauuaccccgauuuaggacaaagugaauuuauaagga

SEQ ID NO: 297658 - RNA, 64 nt, Human
uaucagauauguaugaacugcuacugcuguacuuccgauuuacggacaucauuuuauugcuauu

SEQ ID NO: 297659 - RNA, 64 nt, Human
gugcugguaaauguuaagccauuuaacuggagcuccgauuuaacugggaaccccuucuuuguag

SEQ ID NO: 297660 - RNA, 64 nt, Human
ggugaggauuuggcauauccaccaaaaaaugcauccgauuuaaccaacaucuccaccagcgcua

SEQ ID NO: 297661 - RNA, 64 nt, Human; identical to SEQ ID NO: 297247

SEQ ID NO: 297662 - RNA, 64 nt, Human; identical to SEQ ID NO: 297248

SEQ ID NO: 297663 - RNA, 64 nt, Human; identical to SEQ ID NO: 297249

SEQ ID NO: 297664 - RNA, 64 nt, Human; identical to SEQ ID NO: 297250

SEQ ID NO: 297665 - RNA, 64 nt, Human; identical to SEQ ID NO: 297251

SEQ ID NO: 297666 - RNA, 64 nt, Human; identical to SEQ ID NO: 297252

SEQ ID NO: 297667 - RNA, 64 nt, Human; identical to SEQ ID NO: 297253

SEQ ID NO: 297668 - RNA, 64 nt, Human; identical to SEQ ID NO: 297254

SEQ ID NO: 297669 - RNA, 64 nt, Human; identical to SEQ ID NO: 297255

SEQ ID NO: 297670 - RNA, 64 nt, Human
uucaguucugcaaaagugaaacauuaaacauugccaacgcaaauguauguacuuugucuuuagu

SEQ ID NO: 297671 - RNA, 64 nt, Human
gaaaaugugcagcacccucacugguuccuccccccaacgcaaggaggaugcccaauuguugccc

SEQ ID NO: 297672 - RNA, 64 nt, Human
uuugguuuuccuacucuacaauccuuuccucgaccaacgcaaccucuaguaccuuuccagccga

SEQ ID NO: 297673 - RNA, 64 nt, Human
accuugauccugcaaacccagacucguugagcagcaacgcaaucaccaucaucccacugcccaa

SEQ ID NO: 297674 - RNA, 64 nt, Human
uggaauagagaaacagcuccucgccucuucccaacaacgcaaauuaugagcagcuccuugaaga

SEQ ID NO: 297675 - RNA, 63 nt, Human
cgauggaagggcuggggaagugauuaaauaaaagcaacgcaagaaaaaugccucuccuguuuu

SEQ ID NO: 297676 - RNA, 64 nt, Human
agagcuccaccgcagucccgggugucugcggccgcaacgcaacggacacuggcuggaaccccgg

SEQ ID NO: 297677 - RNA, 64 nt, Human
uuuuacauaaggaaauaaguccuaggaaauuagucaacgcaaauugcauuugcguuuguaccuu

SEQ ID NO: 297678 - RNA, 64 nt, Human
aguaaauccacccaaggagaggaaaauaaaaugacaacgcaagaccuaguggcuaagauucugc

SEQ ID NO: 297679 - RNA, 64 nt, Human
auagcucaugcaucuaugacacccuggcccugcgcaacgcaagcaucggacuucacacgaggga

SEQ ID NO: 297680 - RNA, 64 nt, Human
uagccuguguuuuuaaauccagggcugcaggcagcaacgcaagucaggcugaacauucagucuc

SEQ ID NO: 297681 - RNA, 64 nt, Human
acagacagcuuggucacaacacaacuguguccugagcacacaagauuccaucagcccugaagga

SEQ ID NO: 297682 - RNA, 64 nt, Human
uuuaacaauccugacaugcucccuccaauuuaaaagcacacacacacacacacacacacacaca

SEQ ID NO: 297683 - RNA, 64 nt, Human
auggcucauuuccacccaaccccaggauuuccacagcacacacccacaggccuggaccugggau

SEQ ID NO: 297684 - RNA, 64 nt, Human
guguagaauuuuggcuuuuuuaaguuauguuguuagcacacaggacacuuccuuguugucuuuu

SEQ ID NO: 297685 - RNA, 64 nt, Human
uuaaaacccaugaagaaaucugagguaaaguguuagcacacagacuguuaaaaugucugccuca

SEQ ID NO: 297686 - RNA, 64 nt, Human
gguuugccaggccaauguugcugauggccccuccagcacacacacauaagcacugaaaucacuu

SEQ ID NO: 297687 - RNA, 64 nt, Human
gagauggacuguggccaggcuuccacauuccugaagcacacagaucucaggaaagguuauuuuu

SEQ ID NO: 297688 - RNA, 64 nt, Human
gcauuuaguuuacuagaaauucuuuaccuuaagcagcacacacauuuacuacacacacaguguu

SEQ ID NO: 297689 - RNA, 64 nt, Human
gacggagaugcauuuugaagcaccccugguacucagcacacacaugcuuaccuaaugcaucacu

SEQ ID NO: 297690 - RNA, 64 nt, Human
caauagauaaaugcuugugcuaccuaaagcacuuagcacacaguuaaauuauauuuacauccua

SEQ ID NO: 297691 - RNA, 64 nt, Human
auaaaguggggauauauagaaaacacacaguguuagcacacaguaagaucucaaugcacauuug

SEQ ID NO: 297692 - RNA, 64 nt, Human
guuuuugcacacauuuugaucgaacuauauucuaagcacacaaaaagcacaguagaacagaaau

SEQ ID NO: 297693 - RNA, 64 nt, Human
aacuuaauaguguaugcauaagacuguguuuuuuagcacacagauacccacagcauacacugac

SEQ ID NO: 297694 - RNA, 64 nt, Human
uagugcauuagucuaucucagccuaguguucugcagcacacaugggcaggcaguuuacucacac

SEQ ID NO: 297695 - RNA, 64 nt, Human
uuguuccgcuuauauuccaugcauaccacauaaaagcacacagugcgaaaacucuugcugauac

SEQ ID NO: 297696 - RNA, 64 nt, Human
uucuguuucuuaagggcacacacacgugcgugcgagcacacacacacauacgugcacagggucc

SEQ ID NO: 297697 - RNA, 64 nt, Human
ccuccacacacacacgcccgucacccacaccuugagcacacaccaugaagaucaccagcuugga

SEQ ID NO: 297698 - RNA, 64 nt, Human
augcuccuugccucugcucugugcacucacgcucagcacacaugcauccuccccucuccugcgu

SEQ ID NO: 297699 - RNA, 64 nt, Human
ugcucucaagcccugcugcagagauccuuuucagagcacacacuguuccagcccaucugucuca

SEQ ID NO: 297700 - RNA, 64 nt, Human
ucagacccagacguggugcuucucacacuggaggagcacacauccaagagggacuccaagcccu

SEQ ID NO: 297701 - RNA, 64 nt, Human
uaccuguguauagcuucccaccuuccaugagugcagcacacagguagugcuggaaaaacgcauc

SEQ ID NO: 297702 - RNA, 64 nt, Human
ggcccaggacccaggaggccuccccaccuaccccagcacacacacucccugccacuguucugcg

SEQ ID NO: 297703 - RNA, 64 nt, Human
uggaauauaggagguagggucuggagcccugacaagcacacaguucuuuugcaggagucaagau

SEQ ID NO: 297704 - RNA, 64 nt, Human
ucaaaauccagacauacagucaacacugagaaucagcacacaccauauuucaaauauagaagag

SEQ ID NO: 297705 - RNA, 64 nt, Human
cgaccccauacagagaacucagcuugaagcuggaagcacacaguggguagcaggagaaggaccg

SEQ ID NO: 297706 - RNA, 64 nt, Human
uacuugggcacacgccuguaguccaggccacucgagcacacaccuguaguaccagcuacucugg

SEQ ID NO: 297707 - RNA, 64 nt, Human
uaguuguauaaauuuuuaaaugccgucaguagaaagcacacaagguuaugauuuuuuuaauuac

SEQ ID NO: 297708 - RNA, 64 nt, Human
aacagcaagcacugacaagcagcacauucucaagagcacacaggauuaaguugucaucauucug

SEQ ID NO: 297709 - RNA, 64 nt, Human
guggcccaagugcucuugguggcccagcuuggccagcacacacuuuccuccugcagcacccccu

SEQ ID NO: 297710 - RNA, 64 nt, Human
aauauacaaugauccuggaaauugcaguaacaaaagcacacaacgauuauaguaacuauaagau

SEQ ID NO: 297711 - RNA, 64 nt, Human
uaccugugugagucagagcccucuggguuuguggagcacacaggccugccccucuccagccagc

SEQ ID NO: 297712 - RNA, 64 nt, Human
cacaggcgaagccauuggaagcacuucaggaacaagcacacagcugugggacuugaacaugcaa

SEQ ID NO: 297713 - RNA, 64 nt, Human
cugggauugccuauuccagagaggguacagaaaaagcacacagauggcuugucucaggaguguu

SEQ ID NO: 297714 - RNA, 64 nt, Human
agucccuuauuuggaagagagaaaggauguguguagcacacacucaucauggauugcucagagu

SEQ ID NO: 297715 - RNA, 64 nt, Human
cccuuuguggccgccguccccauccccugcccucagcacacacaucugcacacacgcagcuuug

SEQ ID NO: 297716 - RNA, 64 nt, Human
aguugagaaauuucacaaaacugccuggcacacaagcacacacauacauagacacauuuuaagu

SEQ ID NO: 297717 - RNA, 64 nt, Human
cagcccccuguauucucaugauuuucucucaggaagcacacacugugaauggcagacuuuucau

SEQ ID NO: 297718 - RNA, 64 nt, Human
aauaaugaguaggaucuuguuuuguuuuaucaccagcacacagauugcuauaaacuguuacuuu

SEQ ID NO: 297719 - RNA, 64 nt, Human
auuaucaauaauaaugugucucccucuuggacugagcacacaucugagcugaacggccuuuaaa

SEQ ID NO: 297720 - RNA, 64 nt, Human
accacaggcaaagaaaaccacuaggaccaccaggagcacacaaccccagacccacgccggaggg

SEQ ID NO: 297721 - RNA, 64 nt, Human
uggccagguuuauuauuagaagacacaguggcagagcacacaugugcacagguucugauuauuu

SEQ ID NO: 297722 - RNA, 64 nt, Human
uugguggugguauauuaaaaaaagaaagaaugaaagcacacaaaaugagucaguuuggggucag

SEQ ID NO: 297723 - RNA, 64 nt, Human
acauacauagugggaacucccugguaugccauagagcacacaagaaccccaauauuaaugcuaa

SEQ ID NO: 297724 - RNA, 64 nt, Human
agaauaacauaggugccuuugcuacgcgaagugaagcacacaguuuuagauuuuugcaggaccu

SEQ ID NO: 297725 - RNA, 64 nt, Human
aauauaggauuaugauuucaucaugaauauuuugagcacacacucuaaguuuggagcuauuucu

SEQ ID NO: 297726 - RNA, 64 nt, Human
guuaugugaucgcacccggacuguucauauguuaagcacacauacuuuagaugugugcucccug

SEQ ID NO: 297727 - RNA, 64 nt, Human
gagacaccaaacugccaaaaacaagacgcguagcagcacacacuucacaaagccaagccuaggc

SEQ ID NO: 297728 - RNA, 64 nt, Human
ggugucccaugaucuugaugugcugcuaggcuggagcacacacuggccauuacugaacacagcc

SEQ ID NO: 297729 - RNA, 64 nt, Human
aaagaaaagugaacacguuuguagaacuuucauaagcacacaguugcuguguugaguucucuuu

SEQ ID NO: 297730 - RNA, 64 nt, Human
ugagcuccgugcacuucaccaaagcccccaucccagcacacaggacccguguguaugagacggu

SEQ ID NO: 297731 - RNA, 64 nt, Human
gaggcccccuagaccagcucuuccagcuggauggagcacacacaggccuccagcugggccaugu

SEQ ID NO: 297732 - RNA, 64 nt, Human
acuuugccucugaugcucagccccacccccaaauagcacacaagcuuguuaaccccaccucuua

SEQ ID NO: 297733 - RNA, 64 nt, Human
uuuauugagcuccaccuguguguauguguacccaagcacacaugugugaagggcuauagccaaa

SEQ ID NO: 297734 - RNA, 64 nt, Human
caugacauggcacauagagaaaauauuuuuuucuagcacacaagagcaaccugaaaggcugcuc

SEQ ID NO: 297735 - RNA, 64 nt, Human
ugguugguuuuauuugucaguuugguugggcuauagcacacaguuauuuaaucaaacaguaauc

SEQ ID NO: 297736 - RNA, 64 nt, Human
gagguaaagcaggacccuugcagacauguugcccagcacacaguaggcccucaauaaaagccau

SEQ ID NO: 297737 - RNA, 64 nt, Human
agcucugugaccacugcuguaccacauuaugcagagcacacaggacaggcuggugcaccuccag

SEQ ID NO: 297738 - RNA, 64 nt, Human
accucccauuuggacccauaguuuauuuauagagagcacacacucccuaauugucagaugguuu

SEQ ID NO: 297739 - RNA, 64 nt, Human
gagggucagcauggaaauucacauucaacaagguagcacacaggaccaagagcagcacaugcaa

SEQ ID NO: 297740 - RNA, 64 nt, Human
uuuguuuuguuuuguuuugcuuuuuaauaauuuuagcacacaucugcugacucuccuucaacau

SEQ ID NO: 297741 - RNA, 64 nt, Human
agacugugauguaucuuuacuggaaaugagcccaagcacacaugcauggcauuuguuccacagg

SEQ ID NO: 297742 - RNA, 64 nt, Human
aacuccagacucuugggccguccccauuugcaacagcacacauaguuucugguauauuuguugg

SEQ ID NO: 297743 - RNA, 64 nt, Human
gccacugugaacugcagagggcugugcacacaguagcacacaggaucucacaguaacgcggcau

SEQ ID NO: 297744 - RNA, 64 nt, Human
gcuuuuaccagccucaguguggaggcuccaucccagcacacaggccuggggcuuggcaggggcc

SEQ ID NO: 297745 - RNA, 64 nt, Human
ugccgccaaacaaggcaaaaaaauuuaaacaugaagcacacacacaaaaaaggcaguaggaaaa

SEQ ID NO: 297746 - RNA, 50 nt, Human
augccuuuggaggccaguagagcacacaggguauccacauguuacccugc

SEQ ID NO: 297747 - RNA, 50 nt, Human; identical to SEQ ID NO: 297746

SEQ ID NO: 297748 - RNA, 64 nt, Human
cuggagaauaaaugcaguaauccucucccaaauaagcacacacauuuucaauucucauguuuga

SEQ ID NO: 297749 - RNA, 64 nt, Human
acccaguggcagauuguacacugcuagcacugcuagcacacaguagcaaagcaaacagcuacau

SEQ ID NO: 297750 - RNA, 64 nt, Human
uuuucugauaauuagcugauauucaugguuguuuagcacacaguucaggaccuuugagaucaug

SEQ ID NO: 297751 - RNA, 64 nt, Human
aaugccuccuuuguuacacacucaagaauuugucagcacacaauuaauugcagccauaguaccu

SEQ ID NO: 297752 - RNA, 64 nt, Human
aggugcaaggguaccugugccacaccaaccugggagcacacagaauacuauuaaugugcaccca

SEQ ID NO: 297753 - RNA, 64 nt, Human
ucaaggcgcagguauuuauucuguaucugucuagagcacacaccaaaauccaaccuucuaauaa

SEQ ID NO: 297754 - RNA, 64 nt, Human
gauaucacugugaauugaauaaauuuguugaaagagcacacaggcacacauacacacaaacugu

SEQ ID NO: 297755 - RNA, 64 nt, Human
uguucacaggugacccgugucagccugcaucgcaagcacacacccugcgggccuucaagucuca

SEQ ID NO: 297756 - RNA, 64 nt, Human
cacagcagaaucaccaacacucuccgcuucccccagcacacacacauacaacacagaucauuuc

SEQ ID NO: 297757 - RNA, 64 nt, Human
ccaucccccgcuguaaauauacacuauuuuugauagcacacauggggcccccauaucucuuggc

SEQ ID NO: 297758 - RNA, 64 nt, Human
augaacugagcgucuuacacacgcaguacagaggagcacacauuaggauagaaacaguagaaua

SEQ ID NO: 297759 - RNA, 64 nt, Human
guuaaauaugugaaugguggaaauggugacuagcagcacacauucugggaagcaucaaauagac

SEQ ID NO: 297760 - RNA, 64 nt, Human
ucagucauugcuucucuguaaauuaaaauguuacagcacacacauacacacacagagagcauuu

SEQ ID NO: 297761 - RNA, 64 nt, Human
cuucuaaaacacuuuccugcuccucucugucucuagcacacaacugugaauguccuguggaauu

SEQ ID NO: 297762 - RNA, 64 nt, Human
gcaugcuuguccucaaaauguccauccuggucacagcacacaagauggcuauuggucugcuuuu

SEQ ID NO: 297763 - RNA, 64 nt, Human
ugcugggccaugaugguauguagaagggucugucagcacacauggaaagcccccauuugcacag

SEQ ID NO: 297764 - RNA, 64 nt, Human
guuaauuuuguaauaauuggagaagauuuaugucagcacacacuuacagagcacaaaugcagua

SEQ ID NO: 297765 - RNA, 64 nt, Human
ugacgggaggcuggggagagaccccagcaccuugagcacacaggagccaggaggagcccaacag

SEQ ID NO: 297766 - RNA, 64 nt, Human
gcacuuauauauuuguuacacuguauugcaagauagcacacagaaguuggcugcgucaaguaga

SEQ ID NO: 297767 - RNA, 64 nt, Human
uuauaugaauacaaauuauuucucaaagauuuauagcacacacuauucucaggaauucuguauu

SEQ ID NO: 297768 - RNA, 64 nt, Human
uuacaaugagaaccauucuagguagugaucuuggagcacacaugaauaacuuucugaaggugca

SEQ ID NO: 297769 - RNA, 64 nt, Human
aacuccagagcugcccaccucccacugcccccucagcacacacacaguccccaggcggccuagg

SEQ ID NO: 297770 - RNA, 64 nt, Human
aacugaagggccugcucuuuccauuguggaucacagcacacacauacauacacccuccaccucc

SEQ ID NO: 297771 - RNA, 64 nt, Human
uuuagggccccuuagcagggugagcuguuaaaacagcacacaucucucauccccucuuccuuua

SEQ ID NO: 297772 - RNA, 64 nt, Human
gaggcugauaccccugaccuaucugcagucccccagcacacaaggaagaccagauguagcuaca

SEQ ID NO: 297773 - RNA, 64 nt, Human
ugucugggacgcugcuguauucugaaagucacauagcacacaguaauguuaucuggaagcucug

SEQ ID NO: 297774 - RNA, 64 nt, Human
gggugauggguucguuagaaguccaaaccucagcagcacacaauauacucauguaacaagccug

SEQ ID NO: 297775 - RNA, 64 nt, Human
aauguuuuucauguuacugccuagggcggugcugagcacacagcaaguuuaauaaacuugacug

SEQ ID NO: 297776 - RNA, 64 nt, Human
auugaaagaccuuucaugaaauauaagucuccagagcacacaagaguauuucuucugaaaaaaa

SEQ ID NO: 297777 - RNA, 64 nt, Human
agagacgucauuguucaguagcaggcaaagagggagcacacagcauuauucugauggaaaaaga

SEQ ID NO: 297778 - RNA, 64 nt, Human
accuguauucuaguacguuauaauuuucuagaucagcacacacaugaucagcccacugaguuau

SEQ ID NO: 297779 - RNA, 64 nt, Human
gaaauuauuauugccacuuagaaaaauucagaaaagcacacacucacauacacacacacaaaau

SEQ ID NO: 297780 - RNA, 64 nt, Human
gaaggauucugucuuuacuggggucaaaucuuaaagcacacagcucuggacucaagacaggagg

SEQ ID NO: 297781 - RNA, 64 nt, Human
ggcaaacuccagcuuaaagcccuagacagguaaaagcacacauuggauggcagcauggguuucu

SEQ ID NO: 297782 - RNA, 64 nt, Human
gagggaaagacauucagacccacagaaaggaggcagcacacagagaaagaugcacagaucaacc

SEQ ID NO: 297783 - RNA, 64 nt, Human
agacacucaguuucacaagugagcccucuugcccagcacacaccuauggcuggcugggcaaggc

SEQ ID NO: 297784 - RNA, 64 nt, Human
aagagcuaagaaauaaccuccaucccuaccccucagcacacaaccccuacgguaacagcacacu

SEQ ID NO: 297785 - RNA, 64 nt, Human
uuauuguaaaauaaaaauguauauaaagcauaugagcacacaaauggacaauaaaugccacagc

SEQ ID NO: 297786 - RNA, 64 nt, Human
gacaaugcugagauugaucuggaagauuuaaagaagcacacagucuacuacggugguuuccaug

SEQ ID NO: 297787 - RNA, 64 nt, Human
acuugacuugacuuuggggguaaagucuuucaccagcacacaagaguuugauuguacaaauaua

SEQ ID NO: 297788 - RNA, 64 nt, Human
gccagccucagaaaggcacccaggugugcaggggagcacacagggcccggcagcccccaggaau

SEQ ID NO: 297789 - RNA, 64 nt, Human
cugaggccggaggagaaguagcagucgcuggcagagcacacaggcugcucugggggaugagcug

SEQ ID NO: 297790 - RNA, 64 nt, Human
uuaggagagugguuuaacaugagaaggcgccaacagcacacagggucagggucacuucuagaaa

SEQ ID NO: 297791 - RNA, 64 nt, Human
uagccuguagauuuauuuccauuuuccaaauuccagcacacagagaucccagccccuaugagua

SEQ ID NO: 297792 - RNA, 64 nt, Human
ggcugaagaguaaggugguugcuauagggacuucagcacacauggacuuguagggccacuggca

SEQ ID NO: 297793 - RNA, 64 nt, Human
ugggugggaugcucacuacagcucugauguauauagcacacagcccccuccgccccuccggucu

SEQ ID NO: 297794 - RNA, 64 nt, Human
aguugcccugcuaccuaguuuguuagugcauuugagcacacauuuuaauuuuccucuaauuaaa

SEQ ID NO: 297795 - RNA, 64 nt, Human
cuuuuguuucaugauuuugauuuuuaaaauuauuagcacacaacuauuuucagcccuuuaauaa

SEQ ID NO: 297796 - RNA, 64 nt, Human
uaggacucacuucucugauuaauaagcaauuugcagcacacagcguuccacugcgggguuucac

SEQ ID NO: 297797 - RNA, 64 nt, Human
accugugucaaauccguccauugaucugcccuccagcacacauuuacugagcuucuguuacgug

SEQ ID NO: 297798 - RNA, 64 nt, Human
gucucccuucuguuucuucagcacauugacccauagcacacacauacacaccaccaccaacaac

SEQ ID NO: 297799 - RNA, 64 nt, Human
cagucaccauuuuaauauggggacaaugaagacaagcacacaggagguagaauaucagaguggg

SEQ ID NO: 297800 - RNA, 64 nt, Human
aacucccuucucggggugggacagacgagacaacagcacacaggcagccagccguggccagagg

SEQ ID NO: 297801 - RNA, 64 nt, Human
acggacgugugauacacacaugcauguacagguaagcacacauguacaagcuccuacaggcuug

SEQ ID NO: 297802 - RNA, 64 nt, Human
ugugcgcacacacagauaugcacacacauggaugagcacacacacaccaaugcgcacacacacc

SEQ ID NO: 297803 - RNA, 64 nt, Human
aaagauguucccuguaggucacggcacucccaaaagcacacaagcacauacagacauaugcauc

SEQ ID NO: 297804 - RNA, 64 nt, Human
agcaacagauguuuuauugagugaagccuuaaaaagcacacaccacacacagcuaacugccaaa

SEQ ID NO: 297805 - RNA, 64 nt, Human
ugcugagaucgaagaggccaguaggagacacgacagcacacacaguggauuccagugcaugggg

SEQ ID NO: 297806 - RNA, 64 nt, Human
cccccaccccacuugcccuugguucuuuagaaggagcacacacaucccuugauuccucccugau

SEQ ID NO: 297807 - RNA, 64 nt, Human
gagacagaagguuuugugcccugcuguaucauaaagcacacacuuagcgcucuggagccggacg

SEQ ID NO: 297808 - RNA, 64 nt, Human
gaaaggcuugaaacacgagaagcagcaaagacagagcacacaagugcauaaggcuguugucuuc

SEQ ID NO: 297809 - RNA, 64 nt, Human
cuuucagaggaagcagcucauagaaacauacaaaagcacacaaguauuuugggaaaaaauccua

SEQ ID NO: 297810 - RNA, 64 nt, Human
ugucaugcucccuggggcaggaccuugagccugcagcacacacuaggccaccugcagucucaca

SEQ ID NO: 297811 - RNA, 64 nt, Human
gggucccuggcgcgcccucaucagccgucgcgcaagcacacacgagggacgugugccagagccc

SEQ ID NO: 297812 - RNA, 64 nt, Human
gaauuuuguuuuacuuuuuuuaagcuauguuguuagcacacagaacacuucauuguuguuuuug

SEQ ID NO: 297813 - RNA, 64 nt, Human
agugugugcgugcgugugggugugugcgcgcgugagcacacacgcguguguugggggggguggg

SEQ ID NO: 297814 - RNA, 64 nt, Human
ucuccaacaauaaagcacagaguggauuuaauuaagcacacaaaugcuaaggcagaauuuugag

SEQ ID NO: 297815 - RNA, 64 nt, Human
aguuucccucccuuuucugacugacacuaagucuagcacacagcacuugggccagcaaauccug

SEQ ID NO: 297816 - RNA, 64 nt, Human
uuuugcuuagaucaguguugaacuaaguuggcauagcacacacuaacaguuguaggagauccau

SEQ ID NO: 297817 - RNA, 64 nt, Human
uaauuccuuauagccaauaucaacaguggcaaucagcacacagaggaaaggacccaaaucacua

SEQ ID NO: 297818 - RNA, 64 nt, Human
cuggccuggccucugggcuggggcuggggcugggagcacacacgcugggaccuauguguuugug

SEQ ID NO: 297819 - RNA, 64 nt, Human
ggagucaggagcagggacuuugacucuuaggaagagcacacaugagggcaaggcugcuggcaga

SEQ ID NO: 297820 - RNA, 64 nt, Human
acuagaaugagagggaagagauagcauggcaugcagcacacacggcugcuccaguucauggccu

SEQ ID NO: 297821 - RNA, 64 nt, Human
ccucucucguccaucucuguugccucugcacaucagcacacacugacuccaccugggcuggcuc

SEQ ID NO: 297822 - RNA, 64 nt, Human
uaccauuucauuuuuuggcacuaggucauuaaguagcacacagucugaaugcccuuuucuggag

SEQ ID NO: 297823 - RNA, 64 nt, Human
gaccggcaagcuggcuguguacaggaaaauuggaagcacacaguggacugugccucuuaaagau

SEQ ID NO: 297824 - RNA, 64 nt, Human
cggaaguggaagacuccccuuuccuagggccucaagcacacaccgccaccucuggggccgucag

SEQ ID NO: 297825 - RNA, 64 nt, Human
uuaauuucugagcagaugauugugcugugggaacagcacacagugagggugccuagcacaaugu

SEQ ID NO: 297826 - RNA, 64 nt, Human
ggcuuagugugacacacaggcaucucccaggccaagcacacacaggcugcgcccaguuccgcag

SEQ ID NO: 297827 - RNA, 64 nt, Human
acgggcuguaccccuggcuucuagaagacugccuagcacacaguaggcauucaauacuuguuga

SEQ ID NO: 297828 - RNA, 64 nt, Human
gggaucagaaacuuuuucauauaaccugucugaaagcacacaaagucuuguuuacuacuguuua

SEQ ID NO: 297829 - RNA, 64 nt, Human
cugcaaaauuuucuucaaagcaacaaguccuaggagcacacaaagcaacccaaaggcuuuuccc

SEQ ID NO: 297830 - RNA, 64 nt, Human
gcuggcucacauccagucacucccaacagcguccagcacacaaauaaaagacccuugggcccug

SEQ ID NO: 297831 - RNA, 64 nt, Human
auauauauauauauauauauauauaugguaaacaagcacacacaauuuuauccaaugcaaacaa

SEQ ID NO: 297832 - RNA, 64 nt, Human
acaguguuccucuacgacccgaccucucuauguaagcacacaugcgcacacacacuugcauuca

SEQ ID NO: 297833 - RNA, 64 nt, Human
cuuuuauacagacuuugagacuugccaucagcacagcacacagcagcacccuuccccugaggcc

SEQ ID NO: 297834 - RNA, 64 nt, Human
uuggcuuugagauucuguaacugcagacuucauuagcacacagauucacuuuaauuucuuaauu

SEQ ID NO: 297835 - RNA, 55 nt, Human
gucaaagugacaugcucugagaggcagcacacacagaauaacccugcauccaaau

SEQ ID NO: 297836 - RNA, 64 nt, Human
ccaggagcugugcccggugccugcagccuucauaagcacacacguccauucccuacuaaggccc

SEQ ID NO: 297837 - RNA, 64 nt, Human
cgaugcaggaggaagcaagcgugucuuccccugcagcacacagcgacuugcguugacaaaggag

SEQ ID NO: 297838 - RNA, 64 nt, Human
aauuaacugugaaaccauuuaauccaaacauguaagcacacacucacuuauuaagucacauacu

SEQ ID NO: 297839 - RNA, 64 nt, Human
ucuaagaucuugccucuuuccuccucaugaaagcagcacacauuguguuaacuuaugucucuug

SEQ ID NO: 297840 - RNA, 64 nt, Human
uuuuauaacccugaaugcccccacccuuccccuaagcacacagggguuaaagcugugugucccu

SEQ ID NO: 297841 - RNA, 64 nt, Human
aaccaggucaaugccgggcaccuguucgugcagcagcacacacacccuaccuuccacgcgcugc

SEQ ID NO: 297842 - RNA, 64 nt, Human
caugucaagugucacauuagugucacagacagaaagcacacaccuaugcaauauggcuuaucua

SEQ ID NO: 297843 - RNA, 64 nt, Human
ccggggacccagggggacuccaccccccuaagcaagcacacacauacucacaguugaugaguug

SEQ ID NO: 297844 - RNA, 64 nt, Human
cggguuccuuccuagaaauguggcagcccauuccagcacacaggcuucugcagcaaucucugag

SEQ ID NO: 297845 - RNA, 64 nt, Human
cuaacaccccccuggaggcaugccccuuuucuccagcacacaagcacauuggggcaccuggaaa

SEQ ID NO: 297846 - RNA, 64 nt, Human
caaacacaaccaucuacacacaucuacacccccaagcacacacacaugguccgugccaugucac

SEQ ID NO: 297847 - RNA, 64 nt, Human
uccaucgcacuggguaaggccuccaguauuggacagcacacagaaagguuuucaucaucaagag

SEQ ID NO: 297848 - RNA, 64 nt, Human
uuccugcccccugccuugccaaagacauuuaaucagcacacagcugccagacuauucccacagu

SEQ ID NO: 297849 - RNA, 64 nt, Human
ugguuucuuuucuguggggcccagacuucuguaaagcacacagauguggguaagaugaaaaacu

SEQ ID NO: 297850 - RNA, 64 nt, Human
gccauuccguccugcuccccagcucacucucugaagcacacaucauuggcuuuccuauuuuucu

SEQ ID NO: 297851 - RNA, 64 nt, Human
guccuuguucccccaggaagggccugguggccccagcacacacuugggauuauguguauacaua

SEQ ID NO: 297852 - RNA, 64 nt, Human
aggaggcagauaaauaaaggccuuaucuuaugaaagcacacaagagccuccauacuauuaauau

SEQ ID NO: 297853 - RNA, 64 nt, Human
auucacagacugauuggaauucuuucuguugaaaagcacacacaauaaagaaccccucguuagc

SEQ ID NO: 297854 - RNA, 64 nt, Human
acgucccuggguaaccuaauggccacuggcuagcagcacacaaucucgccagggaaaaucugag

SEQ ID NO: 297855 - RNA, 64 nt, Human
uggugcccagaacguugaucuaacaccaucuugaagcacacaugcugaucuccaggugcaccac

SEQ ID NO: 297856 - RNA, 64 nt, Human
aguccugggagccggccgcccucggucugguguaagcacacaugcacgauuaaagaggagacgc

SEQ ID NO: 297857 - RNA, 64 nt, Human
aagaagacaucagagaugcugcuaagucggcuccagcacacaggagccccccacaacgaagagu

SEQ ID NO: 297858 - RNA, 64 nt, Human
uuuguuuuuagcuuccacuuugggaacaugucaaagcacacauugagaagucccaugagugaaa

SEQ ID NO: 297859 - RNA, 64 nt, Human
ccuggucacacacuccaucagcaaaauguauuugagcacacaccagcaauguauguauauuuuu

SEQ ID NO: 297860 - RNA, 64 nt, Human
gugcccguccuggaguugcaccacugauagucacagcacacaaugauugacaacucacuuuuuu

SEQ ID NO: 297861 - RNA, 64 nt, Human
ccagaagauucuuauuuagagcuucagucuuuggagcacacagggccuucgugagacagugaaa

SEQ ID NO: 297862 - RNA, 64 nt, Human
uaugauaacacuaugaauuaugugcagagugaaaagcacacaggcuuuagagucaaaguaucuc

SEQ ID NO: 297863 - RNA, 64 nt, Human
cacuggacaucaccacaucacuguggaggaugaaagcacacagaugaauuguguguacuugggc

SEQ ID NO: 297864 - RNA, 64 nt, Human
ugggccaaaggcucacuaccccugugcguuguccagcacacagacacuaugugcauuauuugua

SEQ ID NO: 297865 - RNA, 64 nt, Human
aucccucaguggcaucccaugguuuuuaaguuaaagcacacauucuucaaaauagccuaaaaac

SEQ ID NO: 297866 - RNA, 64 nt, Human
aaaggaggaggggacauagaaaaaaugaaaugcaagcacacaucuuuucaggcuucucugccaa

SEQ ID NO: 297867 - RNA, 64 nt, Human
cccucgucagaaguacaugaggggcgcagagaugagcacacagcuuugggcacgguccagggca

SEQ ID NO: 297868 - RNA, 64 nt, Human
aagacauuugggaaagccuucacacagccuuuugagcacacaugagaauguauacuggagagaa

SEQ ID NO: 297869 - RNA, 64 nt, Human
uuuuuaaaaucuucuaaauuuuuuguuuaauaaaagcacacauuauaaaaauucaaaaauuacc

SEQ ID NO: 297870 - RNA, 64 nt, Human
aucuucccugggccucugcccuggccugcuucccagcacacacuucuuuggccuaagggcuucu

SEQ ID NO: 297871 - RNA, 64 nt, Human
ugagugcgaucacuguugagaaaccuuuagucacagcacacacuuuucucaacauuauuggcuu

SEQ ID NO: 297872 - RNA, 64 nt, Human
uucagaugucagugucugcaugugggaaagccauagcacacaucuuaccuuuccaaguaaucag

SEQ ID NO: 297873 - RNA, 64 nt, Human
ccugaaggaggugagagaagaccucugugaggaaagcacacagucaccuucucggcaacuaagc

SEQ ID NO: 297874 - RNA, 64 nt, Human
cccaagccgccuccagguagcagccacagccaggagcacacagacagaagacugugucaugggu

SEQ ID NO: 297875 - RNA, 64 nt, Human
gaugaaggcaaaaacuguacuguguuucgcauuaagcacacacaucuggcccugacuucuggag

SEQ ID NO: 297876 - RNA, 64 nt, Human
ggcgcaaaggugccucauagcauagccagcauucagcacacacaaaccuacugcccacauuugg

SEQ ID NO: 297877 - RNA, 64 nt, Human
ccgcugcgcuuuugcaugcccgggcgaggaccgaagcacacaccuccacgcgcacgggcccugg

SEQ ID NO: 297878 - RNA, 64 nt, Human
gacaggagaucaccauaagcgucccugauauagcagcacacauuuucacguuuccacuuaaauc

SEQ ID NO: 297879 - RNA, 64 nt, Human
gaaaaagaauguauucaucugcuucuuggguuuaagcacacaccugaaggggagauauuggggg

SEQ ID NO: 297880 - RNA, 64 nt, Human
uccuccuuacucuuggauaaauaaacagccugugagcacacaggcagcccggcccaguguaugu

SEQ ID NO: 297881 - RNA, 64 nt, Human
cucccuuaggggaagccccgagugagagucccccagcacacacuccccaacccccuccagcaac

SEQ ID NO: 297882 - RNA, 64 nt, Human
gaacuuggagaaagaccgcaugaagauacuuguaagcacacaugaucccucugaauuguuuuac

SEQ ID NO: 297883 - RNA, 64 nt, Human
acacagcacaugcacacaggugcacagaccacacagcacacacaagugcacagagcacacugca

SEQ ID NO: 297884 - RNA, 64 nt, Human
caugcacgcuugcacacaugcacacagaccacauagcacacaugugcacugaccacaccuguau

SEQ ID NO: 297885 - RNA, 64 nt, Human
ggugaauagucacuaucaguguggagacaagcacagcacacagacauuuuaggaaggaaaggaa

SEQ ID NO: 297886 - RNA, 64 nt, Human
agcgagugcuugggauccgcauccagccgugcugagcacacaacaggcuguguguggaaauggc

SEQ ID NO: 297887 - RNA, 64 nt, Human
acgaagggauggcucuccaguccuugggucccguagcacacaguuacaguguccuaagauacug

SEQ ID NO: 297888 - RNA, 64 nt, Human
agaggcugaggcuggcacaggacaugcgguagccagcacacagggcagugagggagggcuguca

SEQ ID NO: 297889 - RNA, 64 nt, Human
aguuugaauaguuagacauggaaauuauuuuauaagcacacaccuaaagauaucuuuuuagaug

SEQ ID NO: 297890 - RNA, 64 nt, Human
uggaagauuuuguuuuuaaccucacauuaaggaaagcacacaucaccuugaaagguugcacacu

SEQ ID NO: 297891 - RNA, 64 nt, Human
aaccuaaaggcaugacauuuccauacuugucacaagcacacacugauucugcccuugucacuuc

SEQ ID NO: 297892 - RNA, 64 nt, Human
aguggacccucaaccgaccccaccccaccaucucagcacacacccucaccacagacuggaggcu

SEQ ID NO: 297893 - RNA, 60 nt, Human
ucacucagaaagccucuuagucauuccuggagcacacagggccuuugcguggagccaccg

SEQ ID NO: 297894 - RNA, 64 nt, Human
aggcuuuaguguacagggacagccauggccacacagcacacauguggagcagcggcucucccug

SEQ ID NO: 297895 - RNA, 64 nt, Human
uucuuuuggaucauaaacuggaaauacugauggaagcacacaaguggagagaaguugacaugga

SEQ ID NO: 297896 - RNA, 64 nt, Human
gggggugaguuccccuuuguccucucguggaaacagcacacagcaagcaaccacaaaaccagag

SEQ ID NO: 297897 - RNA, 64 nt, Human
ggcuuuucccaggucucaggagguggccugagucagcacacaucuucccacucgguagacaggc

SEQ ID NO: 297898 - RNA, 64 nt, Human
aaggaaggaacuacaagagagucggagaugaugcagcacacacacaauuccccagcccagugau

SEQ ID NO: 297899 - RNA, 64 nt, Human
ugguucagcugccucugcacccccucccacccccagcacacacacaaguuggcccccagcugcg

SEQ ID NO: 297900 - RNA, 64 nt, Human
gguugggcuuggcccucucugccugagagagcucagcacacacacagcucagacccacggacag

SEQ ID NO: 297901 - RNA, 64 nt, Human
agcaccuggggagaucggugcuaccaaggaagagagcacacagauaagacagaggggaggaggu

SEQ ID NO: 297902 - RNA, 64 nt, Human
cucguuauugugaagucuuucguagacaccccagagcacacacauccccuuaguccaccgguua

SEQ ID NO: 297903 - RNA, 64 nt, Human
ugaguuaugcaguucccaguguccaguuaaaggaagcacacaugcuagucaugugagacaaccu

SEQ ID NO: 297904 - RNA, 64 nt, Human
agcacagcaggagcuuccgccuccucuccacuggagcacacaacuugaaccuggcuuauuuucu

SEQ ID NO: 297905 - RNA, 64 nt, Human
caggugagccggcguguccuggggagaugcugccagcacacaggggcccuccugcugccagcag

SEQ ID NO: 297906 - RNA, 64 nt, Human
ggccucccaacuugguucugggcccccgccugcaagcacacauggcaaggagggcuuuagcagg

SEQ ID NO: 297907 - RNA, 64 nt, Human
gccuguccgaccccaucuuacagacgagaaaaccagcacacaggcaccaaggaacuguccggaa

SEQ ID NO: 297908 - RNA, 64 nt, Human
uuggucggguucacagugaccgagagucagguccagcacacaccugggaaagggaugcugcccc

SEQ ID NO: 297909 - RNA, 64 nt, Human
gaaaugaaacuuugccacaaccagccuuugcuguagcacacacauauaucacugaaccuguuug

SEQ ID NO: 297910 - RNA, 64 nt, Human
ugucaaaauuuuuacagguuugcucaucugccagagcacacauauaaauuugguauuucuuaac

SEQ ID NO: 297911 - RNA, 64 nt, Human
cucugacugaauagacagugguauagguugacacagcacacaaguggcuauugugauguaugau

SEQ ID NO: 297912 - RNA, 64 nt, Human
aauuccccuccauuugaauauggugguuguuauaagcacacacaagauacaugguggaagaucu

SEQ ID NO: 297913 - RNA, 64 nt, Human
gcgacagguagcacguaucugagagacaccugcaagcacacacugucccagcugguacccauaa

SEQ ID NO: 297914 - RNA, 64 nt, Human
caagcucaaagugacagaauauguuauagguugaagcacacauauuugcaguuuacugaaaagu

SEQ ID NO: 297915 - RNA, 64 nt, Human
cuccucaccuaaacccaucuccuacuuugggcgcagcacacauauuuucuugucaacuuuuccc

SEQ ID NO: 297916 - RNA, 64 nt, Human
gggacuacugauguucugugauacaucagguuucagcacacaacuuacauuucuuugccuccaa

SEQ ID NO: 297917 - RNA, 64 nt, Human
uucuucucuauagaccugcagaggaagcugcuaaagcacacaaaauguccacgaaacguggacu

SEQ ID NO: 297918 - RNA, 64 nt, Human
ucgcuaaucagucauuucuucauguacagaggucagcacacauuauuuggcuuaaaccagaacc

SEQ ID NO: 297919 - RNA, 64 nt, Human
uuuagaguuucuuuuuuugaucacuuacuuucaaagcacacagucaaacaagguuaugccaaau

SEQ ID NO: 297920 - RNA, 64 nt, Human
gugagaaaccagguuuagaagacagucacagaacagcacacauccaaauucagcgccauugaaa

SEQ ID NO: 297921 - RNA, 64 nt, Human
ugcgaauuacccuaauucucaaaagcaaaacaagagcacacaagcgugaagaaaaggaucuuaa

SEQ ID NO: 297922 - RNA, 64 nt, Human
auggacagaggcccaaugggugaaggcuuugaagagcacacagaagccccuggccccccacgag

SEQ ID NO: 297923 - RNA, 64 nt, Human
agcuuuccuuggggagggaagagccuugauguccagcacacagccuggcuauaaagacacgaag

SEQ ID NO: 297924 - RNA, 64 nt, Human
cugagaaauauuuaaagcucaagaagaacacagaagcacacaucccucagcuaugagagagaug

SEQ ID NO: 297925 - RNA, 64 nt, Human
auaacuguuucuugugaccuggaacuaacgucaaagcacacaagacauaauaauaaagacaugu

SEQ ID NO: 297926 - RNA, 64 nt, Human
cuuugacugaauagacagugguauagguugacacagcacacaaguggcuauugugauguaugau

SEQ ID NO: 297927 - RNA, 64 nt, Human
ucaaggaacuguguguuuccaacaucaugguagcagcacacacuuccaaagcucagccagggac

SEQ ID NO: 297928 - RNA, 64 nt, Human
uauauaaauaugugaaauauuaugaucugaacuuagcacacaugaagcaacauuucuuugcuac

SEQ ID NO: 297929 - RNA, 64 nt, Human
aguuagauggggaacauuuugcuagcccauuagaagcacacagaauuauccuuguccuccuaau

SEQ ID NO: 297930 - RNA, 64 nt, Human
aguaaacacuuuaguugcuuucagggaugacacaagcacacaaugauuuuugcuuacaaucacu

SEQ ID NO: 297931 - RNA, 64 nt, Human
gcccucagccccuccgggcacacgugccgccugaccgggcgacccuuuucaguucggcaaacgu

SEQ ID NO: 297932 - RNA, 64 nt, Human
ugagcugagauggcaccacuuauugcacuccagcccgggcgacagagcgagacuccaucuacca

SEQ ID NO: 297933 - RNA, 64 nt, Human
uuaaaggaguaugaggugggugacccaggacagagaacgcuacuggauccugggagguucagca

SEQ ID NO: 297934 - RNA, 64 nt, Human
cuuguggugaggggugugggaagaccaaaggaaggaacgcuaacaauuucucauacuuagaaac

SEQ ID NO: 297935 - RNA, 64 nt, Human
uuccuaaaugguauuuucaaguguaauauugugagaacgcuacugcaguaguugauguugugug

SEQ ID NO: 297936 - RNA, 64 nt, Human
ggacuggggacugagcccaggagguuugcacaagccgggcgauuuguuuguaacuagcaguggg

SEQ ID NO: 297937 - RNA, 64 nt, Human
cuacccaggggaccacaccaaguccuugccugugccgggcgagcccugugugagugaggcugug

SEQ ID NO: 297938 - RNA, 64 nt, Human
aucaaccccccgagucucucccugaaggggagcaccgggcgagugcaugugcuacugcugcuac

SEQ ID NO: 297939 - RNA, 64 nt, Human
gcgccaggggaguuccugcuccgagucuucucuaccgggcgagucucccuuaggugagaggaac

SEQ ID NO: 297940 - RNA, 64 nt, Human
guuagggacugucacccucagcacugugaacauaccgggcgagaucauucuucaggggaaggag

SEQ ID NO: 297941 - RNA, 64 nt, Human
gguccccggacggacuccuucaccgacugcacccccgggcgaguuacgcggccucucugugccg

SEQ ID NO: 297942 - RNA, 64 nt, Human
ccccugccagucggcucccugcucagcugcuggcccgggcgaccugggacucagcaccaacggc

SEQ ID NO: 297943 - RNA, 64 nt, Human
gagaccgaaguggacagugguuaagauuguggggccgggcgagguggcucacgccuguaauccc

SEQ ID NO: 297944 - RNA, 64 nt, Human
ugaccacacuucagaagccccauccccccugccaccgggcgaucccugcugugagccgaagcuc

SEQ ID NO: 297945 - RNA, 64 nt, Human
caggccugacggaaggccuguucugugugugccgccgggcgacgugcauugauggggaagcugc

SEQ ID NO: 297946 - RNA, 64 nt, Human
ugagcgccgcaccgcuucagggacggagacaggaccgggcgagcccuggggcggcggccgcucc

SEQ ID NO: 297947 - RNA, 64 nt, Human
ccccuccuuucucccccuaaacuuuggccggccgccgggcgacaccacgaguuauuucccagcu

SEQ ID NO: 297948 - RNA, 64 nt, Human
agcucggaggacuuguguucagggguccugggccccgggcgaggucccgcccucccguggucac

SEQ ID NO: 297949 - RNA, 64 nt, Human
cggcccuuccccugucggaagccguugcuugaccccgggcgagggaggcgguagccuccggguc

SEQ ID NO: 297950 - RNA, 64 nt, Human
ggacugugggagcuagggucugcggggcgccugcccgggcgaggucggaagcugcaggccagcu

SEQ ID NO: 297951 - RNA, 64 nt, Human
uuagaagcaaagauuucaguagaauuuuaguccugaacgcuacggggaaaaugcauuuucuuca

SEQ ID NO: 297952 - RNA, 64 nt, Human
uaaugcugcaaacuuaauguucuuaugcaaaauggaacgcuaaugaaacacagcuuacaaucgc

SEQ ID NO: 297953 - RNA, 64 nt, Human
acuuuauauaaaaggaugacucaaaggauaaaaugaacgcuauuugaggacucugguugaagga

SEQ ID NO: 297954 - RNA, 64 nt, Human
ccacuucguugcacgcggguccggcgcacaguucccgggcgagugggcugugggugcugacguu

SEQ ID NO: 297955 - RNA, 64 nt, Human
gccggucccgcuccugguggcccacuguggcugcccgggcgacaguacgcccagggccuguguu

SEQ ID NO: 297956 - RNA, 64 nt, Human
ggcccugagaacgggugcccuugaggcccugcccccgggcgauggugcaggcugguuugcuugu

SEQ ID NO: 297957 - RNA, 64 nt, Human
ccuacagcgagagugacgaugauuggugcuaagcccgggcgagguggcgcccgcccggcccccc

SEQ ID NO: 297958 - RNA, 64 nt, Human
uggggagacagagaccaagagcaggggauagaagccgggcgaaguggcccaugccuguaaucuc

SEQ ID NO: 297959 - RNA, 64 nt, Human
gguagggcccacugcgcccccguccccagcgcccccgggcgacuucguguuugcacucugcccu

SEQ ID NO: 297960 - RNA, 64 nt, Human
ccgccacuaccuccuccgcugcgcuuuugcaugcccgggcgaggaccgaagcacacaccuccac

SEQ ID NO: 297961 - RNA, 64 nt, Human
ugcugagccgggaggcaggaagaagacggaggagccgggcgacagcuaccacgugaaugcccgg

SEQ ID NO: 297962 - RNA, 64 nt, Human
uaauuacuaauauuauugaaugccuuagaggaggccgggcgagcccgguguucugaagaccugu

SEQ ID NO: 297963 - RNA, 64 nt, Human
gggugggggccggggcuggcccugggacccccaggaacgcuaagacacaggcuccaguaggggc

SEQ ID NO: 297964 - RNA, 64 nt, Human
acaguuagcuccucagaaaggugaaugugagcaagaacgcuacaguucgagguaugacauucua

SEQ ID NO: 297965 - RNA, 64 nt, Human
uagauuuaacccuaagguaagaugcugggguauagaacgcuaagaauuuucccccaaggacucu

SEQ ID NO: 297966 - RNA, 64 nt, Human
uugaauauuauuccucaaaaaauugcacauaguagaacgcuaucugggaagcuauuuuuuucag

SEQ ID NO: 297967 - RNA, 64 nt, Human
uguacucacagagaacuaauugacuaaacaacuugaacgcuagugguuuguccuuagacaaucu

SEQ ID NO: 297968 - RNA, 64 nt, Human
acaauaaaacuguugucagcuuuuguuuuacagagaacgcuagauauuaagaauuuugaaaugg

SEQ ID NO: 297969 - RNA, 64 nt, Human
aaacccccaaaugccccaaaauccaaaccuuccugaacgcuaugacaccaugaguggaaaauuc

SEQ ID NO: 297970 - RNA, 64 nt, Human
gggauuacaggcuugagcuaccgcgcccggccgugaacgcuauuuucuaagcagccagcaguga

SEQ ID NO: 297971 - RNA, 64 nt, Human
ugugguguucgcuaucucuugugucaaaucuggugaacgcuacgcuuacauauauugucuuugu

SEQ ID NO: 297972 - RNA, 64 nt, Human
ugaugccacacauucucucucaauuucagcuucggaacgcuaugaaaauaauacaugauuaaag

SEQ ID NO: 297973 - RNA, 64 nt, Human
cgacagggugucuuaugcaaaggcugacuugccugaacgcuaagaacaugacuucugucugagc

SEQ ID NO: 297974 - RNA, 64 nt, Human
uuacggucagccuuauuccccuucaccucccagugaacgcuaagaaguuucagacaagcagaga

SEQ ID NO: 297975 - RNA, 64 nt, Human
uuuacuugauuucuuuccacaauaaacugacagagaacgcuacuaaugauuuuuuuuuuuuuuu

SEQ ID NO: 297976 - RNA, 64 nt, Human
guuuauuuuaccauugacugcugcccucaaucuagaacgcuacacaagaaauauuuguuuuacu

SEQ ID NO: 297977 - RNA, 64 nt, Human
aacaugaacugaacgguuaaaagcacagucuauggaacgcuaauggagucagccccuaaagcug

SEQ ID NO: 297978 - RNA, 64 nt, Human
gaaccaccuuuuccagccagaguucccaaagcuggaacgcuagcugccugcucuuccuuaagau

SEQ ID NO: 297979 - RNA, 64 nt, Human
uuggggcugguuugguuuuugacaccugaaaugcgaacgcuaugugcuaaauuugucaccguau

SEQ ID NO: 297980 - RNA, 64 nt, Human
uuggaacucagagagguggcuauugcauugcgcagaacgcuacagagcccaugcucuucccaga

SEQ ID NO: 297981 - RNA, 64 nt, Human
uaacagccccaguucaucccaaccccucucagagccucaagagggguagcucggcugccggaag

SEQ ID NO: 297982 - RNA, 64 nt, Human
aggugugauuugugcaagccagguucaacccuugccucaagaaaucagaugggaccaauuuagu

SEQ ID NO: 297983 - RNA, 64 nt, Human
uucugcuuccugcccccacccccacaugugcaauccucaagauuuguccugauucuauuuccug

SEQ ID NO: 297984 - RNA, 64 nt, Human
cccagggacuuggguggaugcgcugauagaacauccucaagacaguuuccuugaaaucaauaaa

SEQ ID NO: 297985 - RNA, 64 nt, Human
uuccucauucauugagcuuuuuaaaagaucacaaccucaagaugguuaaaauccauugacauuu

SEQ ID NO: 297986 - RNA, 64 nt, Human
gggaagauggcuggugaggagcuuaacagaggaaccucaagaagauucugaaaauccuaccccc

SEQ ID NO: 297987 - RNA, 64 nt, Human
ccagcgucuggcugccuguggccuggagggacccccucaagaggagacaaagccuaaguuuggg

SEQ ID NO: 297988 - RNA, 64 nt, Human
aaaaaagagucagcccuuggcuucugcuucaaacccucaagaggggaagcaacuccgugugccu

SEQ ID NO: 297989 - RNA, 64 nt, Human
gggcaauacugaagggguuaaacagguuuuugcuccucaagaauuuguuugccugggcccagga

SEQ ID NO: 297990 - RNA, 64 nt, Human
ugauaacacuuaccaaaagaucacugcaaaccugccucaagaagcugaugguggcacuucaauu

SEQ ID NO: 297991 - RNA, 64 nt, Human
cacuagcuuugguuuuuuaaacauagauuauauuccucaagaugaagggcuuaacauauccaca

SEQ ID NO: 297992 - RNA, 64 nt, Human
uggaacucugauuuaaacagcuggggaugaaauuccucaagaugauuauuccugaaagugugga

SEQ ID NO: 297993 - RNA, 58 nt, Human
gagcagcaaaaaggaaauaguguuggucccucaagagggagacuuucuuccucagugg

SEQ ID NO: 297994 - RNA, 64 nt, Human
ucuguuacaguuuuucuuuugaucgugcacuuauagucuucauuuaauuccucauagaauccca

SEQ ID NO: 297995 - RNA, 64 nt, Human
aaaaaacuuauaaagucacuuuuuauuuuuccucagucuucaaugacgagagcaauauuaagaa

SEQ ID NO: 297996 - RNA, 64 nt, Human
agacucaauaaaaucauguacauuucugaaaugaccucaagauguccuccuuguucuacucaua

SEQ ID NO: 297997 - RNA, 64 nt, Human
ugacucaagguucauucuugcugcaauugaacauccucaagaguugggauggaaauggugauuu

SEQ ID NO: 297998 - RNA, 64 nt, Human
aacugcucuaauaucagcaagucucuuuauauggccucaagaucaaugaaaugaugucauaagc

SEQ ID NO: 297999 - RNA, 64 nt, Human
auuuguauuucaccaccuaaauguaauguugauuccucaagaaugaaaugaaggcacuacauug

SEQ ID NO: 298000 - RNA, 64 nt, Human
ggccugucuguccuccucccuaauucagacccagccucaagaggaaagggaguaaaauaaaacu

SEQ ID NO: 298001 - RNA, 64 nt, Human
aggagcaggagacggcauugcgcgucuacagccaccucaagagcguccugaaggaccacugugu

SEQ ID NO: 298002 - RNA, 64 nt, Human
cccugacagggcugccuggccucucccucgugcuccucaagagcccaguccauacacuguggau

SEQ ID NO: 298003 - RNA, 64 nt, Human
ugaagauacaauuuuauuugauaucaaugaacgcccucaagacugagcugcuuuuaucauacuc

SEQ ID NO: 298004 - RNA, 64 nt, Human
uuuugaauuauuaauucaagaucaacaaagcauuccucaagaucacuuuuaaaaaagguuagaa

SEQ ID NO: 298005 - RNA, 64 nt, Human
aagucgauguaauuaacugauggcccaaaaacuaccucaagagaccuggcccuguuaagacggc

SEQ ID NO: 298006 - RNA, 64 nt, Human
cagcagugggcuacauacaaugagagcccugagcccucaagaacucaugccagcucagcccuac

SEQ ID NO: 298007 - RNA, 64 nt, Human
caauggagacauugugaauuuaagugaacauuugccucaagauguuaacuauaaacacacugca

SEQ ID NO: 298008 - RNA, 64 nt, Human
auguugaccugcaaagcaguguaggauuuucucuccucaagagcguguauuauuaucuaguaga

SEQ ID NO: 298009 - RNA, 64 nt, Human
cugagggcauccgacaaggcccaucuccuucccuccucaagaagcagaggccuccucuggagug

SEQ ID NO: 298010 - RNA, 64 nt, Human
uuuguauggcaguauguauauauuguguuaaguuccucaagaaucuccuuaaaaacuuugaagu

SEQ ID NO: 298011 - RNA, 64 nt, Human
caaggauagaugagcucugaguuucucaguacucccucaagacuggacaucuuggucuuuuucu

SEQ ID NO: 298012 - RNA, 62 nt, Human
gauguuuugggggaacgccgggacugagagacuccacgcaggcgaauucccguuuggggcuu

SEQ ID NO: 298013 - RNA, 62 nt, Human
cuucccugccuaguuuccuuuuguuccuugaguccacgcagaauuccauucucuggucagca

SEQ ID NO: 298014 - RNA, 64 nt, Human
guuuugagacaauacagauguuuucccuuguggcagucuucagccuccucuacccuacaugauc

SEQ ID NO: 298015 - RNA, 64 nt, Human
aaugguuaaacuucugcacuuucuuaguuaccacagucuucauaccaaguauuggguacagguu

SEQ ID NO: 298016 - RNA, 64 nt, Human
gucugagcugccuucucuaucauucagcuugaguccucaagacuacuggucacaaugagucuga

SEQ ID NO: 298017 - RNA, 64 nt, Human
cugggauuuaaggacuucugggggaccaagacauccucaagaaaacaggggcauccagggcucc

SEQ ID NO: 298018 - RNA, 64 nt, Human
ucaagucccccagcagaaccagccucaaaaacgcccucaagaacaugaugggccugaacucgga

SEQ ID NO: 298019 - RNA, 64 nt, Human
cuggaaggaccauaaauuuaaauggagaaaggacccucaagacaaaugacccccaucccauggg

SEQ ID NO: 298020 - RNA, 64 nt, Human
ucaaucucccagccccucucuaccauauugggacccucaagagguuugugcuagcccgaugccu

SEQ ID NO: 298021 - RNA, 64 nt, Human
gaagugguucuuagauggugaucugggauuaggcccucaagacccuuuuggguuucugcccugc

SEQ ID NO: 298022 - RNA, 64 nt, Human
uuccugcucacauccacagucagggcacggcgccccucaagaacuccagagucaccugucucau

SEQ ID NO: 298023 - RNA, 64 nt, Human
cauauuuuguaucagugcuguuaauuugcuguugccucaagaaaaagugcuuuuucuccaugga

SEQ ID NO: 298024 - RNA, 64 nt, Human
gacucugcuaaaacagugcucuggcuugggcuuaccucaagagggaagauaguugaguuuuauu

SEQ ID NO: 298025 - RNA, 64 nt, Human
uacagcaaugugcagaacaagcauucccacuuuuccucaagauaacugaccaaguguuuucuua

SEQ ID NO: 298026 - RNA, 64 nt, Human
uuugcaaacugcccauucacccaugaagaggaagccucaagaucccuuggaauugcaucccaag

SEQ ID NO: 298027 - RNA, 64 nt, Human
guugcgcccggagcccgcccuucgccucccagccccucaagacaccgcuggcugcuggacaccc

SEQ ID NO: 298028 - RNA, 64 nt, Human
ugccucgacacauccucauccccagcaugggacaccucaagaugaauaauaauucacaaaauuu

SEQ ID NO: 298029 - RNA, 64 nt, Human
cugugaauguuccaacaccugccuccacuucuccccucaagaaauuuucaacgccaggaaucau

SEQ ID NO: 298030 - RNA, 64 nt, Human
caugaagagacuucugcuuuucaacccccacccuccucaagaaguaauaauuuguuuacuugua

SEQ ID NO: 298031 - RNA, 64 nt, Human
ccugucucagugcauuuuguuuuccugcuuccuaccucaagaucuuggcaaugguacacuacaa

SEQ ID NO: 298032 - RNA, 64 nt, Human
aaaaugauuuuaucugugaauucagauuuuaaaaagucuucacucucugaagaugaucauuugc

SEQ ID NO: 298033 - RNA, 64 nt, Human
cugucagccacuguaggcucuaagaaccacgugcagucuucagcccauuaaauuaucgauuauu

SEQ ID NO: 298034 - RNA, 64 nt, Human
ucccacuacacacagaaaacccugugagauggccagucuucauaauagcaacguaccuucaccc

SEQ ID NO: 298035 - RNA, 64 nt, Human
gggucacaguugccagguugggaaugcuagauguagucuucacccaucaccuucugucguccuc

SEQ ID NO: 298036 - RNA, 64 nt, Human
auugcauucaucuuguguuuuauaugagaaggugccucaagaauuuccuguuggauuuguuuaa

SEQ ID NO: 298037 - RNA, 64 nt, Human
acaagucaccuccacuaugugggucuuccuuuccccucaagagaaggagcaauuguuccccuga

SEQ ID NO: 298038 - RNA, 64 nt, Human
aggucauuuugguaaaauacuucuugaagccgagccucaagaugaaggcaaagcacgaaauguu

SEQ ID NO: 298039 - RNA, 64 nt, Human
cuccugugaguuaagcuauguuuacuacugggacccucaagaggaauaccacuuauguuacacu

SEQ ID NO: 298040 - RNA, 64 nt, Human
uuuuuugaaccuuauuucucaaaacuuauaguagccucaagaagucuauugauauuggucaugu

SEQ ID NO: 298041 - RNA, 64 nt, Human
auaugcuggugauucuuaugcaaaggugaagccaccucaagaugaauaucuuaauuuauuacuu

SEQ ID NO: 298042 - RNA, 64 nt, Human
auuuugugcucugaguuuugcuguugaaagucucccucaagaauagcuucagauccucuugugu

SEQ ID NO: 298043 - RNA, 64 nt, Human
uugaguggacauugugggguguauuucuggauacccucaagaucuucauuuaaauuuugauacu

SEQ ID NO: 298044 - RNA, 64 nt, Human
auggaugcgaggaccacuuuggagacugggguggccucaagagcacacagagaagggaagaagg

SEQ ID NO: 298045 - RNA, 64 nt, Human
caauuaauuagacuuuuguauaagagaugucaugccucaagaaagccauaaaccugguaggaac

SEQ ID NO: 298046 - RNA, 64 nt, Human
auaauugcaacuucaguugaucuuuugaccaagaccucaagagagccagaacuacccagcuaag

SEQ ID NO: 298047 - RNA, 64 nt, Human
uuuauaagcaauguaauuaugcuauucacaggggccucaagaauugguauguaugaugugaucu

SEQ ID NO: 298048 - RNA, 64 nt, Human
auuguuuuacaucaaugcaugcuucguugugaucccucaagauguaacacuugguaugcucggu

SEQ ID NO: 298049 - RNA, 64 nt, Human
uguccagccaggacacaagacuucugauuucuacccucaagauacucccagauccuaaauccag

SEQ ID NO: 298050 - RNA, 64 nt, Human
gguggguaaugccagggguggggugggcacaggcccucaagagccccuuuugccuuguaguccu

SEQ ID NO: 298051 - RNA, 64 nt, Human
gaucccugcugggcacaccccacaaaccccacucccucaagaagggccagggccagggcuguau

SEQ ID NO: 298052 - RNA, 64 nt, Human
ccaaagcuuucugucuuccaacugcagucuccacagucuucagaagacaaaugcucagguaguc

SEQ ID NO: 298053 - RNA, 64 nt, Human
gcucuaaacauaggaaugguugaagaggucuugcagucuucagaugaaacuaaaucucuagaag

SEQ ID NO: 298054 - RNA, 64 nt, Human
uuuuacacuaauuuuauuguuauacauaaaugguagucuucauuuuugaagucuuacauuuuca

SEQ ID NO: 298055 - RNA, 64 nt, Human
uaaauuagaaggggcccucgcuauuuucugugucagucuucauuuuaaauauggauacaaaaag

SEQ ID NO: 298056 - RNA, 64 nt, Human
ugccaagggaauccacccagaaugcaccccugaaccucaagaucacgguccagccucugccgga

SEQ ID NO: 298057 - RNA, 64 nt, Human
gcaguguuaauauuuacaggauuuuggcucgauaccucaagauuuaucuaacagugcaguuuca

SEQ ID NO: 298058 - RNA, 64 nt, Human
uugugcaggacaguaaauaaugaaaaccaaauuuccucaagaaauaacugaagaaggagcaagu

SEQ ID NO: 298059 - RNA, 64 nt, Human
auaccaccuucaauaucgaguuccggaaagccuuccucaagauccugucuugcugagggagcag

SEQ ID NO: 298060 - RNA, 64 nt, Human
uacaauuuaauugcucaaccaugcauuuaaaacuccucaagaaaggauugguacugcaacugua

SEQ ID NO: 298061 - RNA, 64 nt, Human
cuaagggaacacacaaagaauuacacaacguuuuccucaagaaaaugguacaaaacacaaccga

SEQ ID NO: 298062 - RNA, 64 nt, Human
gucuucaucaaguggaagccaacuguccugccugccucaagaauauguguuuucuuuagcuucc

SEQ ID NO: 298063 - RNA, 64 nt, Human
ccuugccuugaaggggcagcuguggccuaggcuaccucaagacucaccucauccuuaccgcaca

SEQ ID NO: 298064 - RNA, 64 nt, Human
uuuugcucuccauuuugacuugcaagaaauaauaccucaagauaaucugauuuauuagcuauuu

SEQ ID NO: 298065 - RNA, 64 nt, Human
auguaaauuugcucuguuuuaagacuuugaacuaccucaagaagaggaaucuaauacaauauuu

SEQ ID NO: 298066 - RNA, 64 nt, Human
uagauaagaaaggacuacagcauuugauguguguccucaagaacuugucuugggucugaaaaag

SEQ ID NO: 298067 - RNA, 64 nt, Human
cuuuugucuccagaguaugcgggagacccuuccaccucaagauggauauuucuuccccaaggau

SEQ ID NO: 298068 - RNA, 64 nt, Human
cuuguagauaaaaguguuccaguaaucagaaaauccucaagaaaauugacuucauuauuuggaa

SEQ ID NO: 298069 - RNA, 64 nt, Human
cuugaggcugccuuggcagcaggggcacagcaggccucaagagccccuaauugucucaggguuc

SEQ ID NO: 298070 - RNA, 64 nt, Human
cagauauguauuugcuacucaaguguacagaucuccucaagaaacaucaagggacuccuguguc

SEQ ID NO: 298071 - RNA, 64 nt, Human
agaaggauaaauuguaccaucauuuuauuauaauccucaagagaaaauguguaauucaaaagau

SEQ ID NO: 298072 - RNA, 64 nt, Human
auuaauaagauaaagaaauguuucccugccccacagucuucauucuauuucucuuuaauuuuau

SEQ ID NO: 298073 - RNA, 64 nt, Human
auccuacuuauagaaaaggagaaaauaauuaaacagucuucauuuuuaaguaacugauuuaaaa

SEQ ID NO: 298074 - RNA, 64 nt, Human
cuuugacuauaaugugggagccaauuuuugccucagucuucauuuuuauauuuaccuuguuauu

SEQ ID NO: 298075 - RNA, 64 nt, Human
guucuucauaucccaaauuagaguuuacagggacagucuucauuuacuuguaaauaaaauauga

SEQ ID NO: 298076 - RNA, 64 nt, Human
ugaguguacagaguggaauaagacagagaccugcccucaagagcaaaguagaucaugcauagag

SEQ ID NO: 298077 - RNA, 64 nt, Human
aaaagucaucauugcuguuuagcuugacuguuuuccucaagaacaucgaucugaaggauucaua

SEQ ID NO: 298078 - RNA, 64 nt, Human
caacuuccuuaaauuucagaccugacuguaauggccucaagauagagagauacccuuauaagag

SEQ ID NO: 298079 - RNA, 64 nt, Human
ggagucaguccuaggcuggaugggaggguggcccccucaagaggacucccagccuccacaucug

SEQ ID NO: 298080 - RNA, 64 nt, Human
uaauuuuuaauuauaauuauugugaaguggagagccucaagauaaaacucugucauucagaaga

SEQ ID NO: 298081 - RNA, 64 nt, Human
ugccacccaucuacuugcauucgucuuuggcagaccucaagauaaauauggguuaaugccugca

SEQ ID NO: 298082 - RNA, 64 nt, Human
uuccuggcagaacaggccccaugcugacgucccuccucaagagcuggauggcauugcaaaugau

SEQ ID NO: 298083 - RNA, 64 nt, Human
aaauaucaccuagaaaaguagccucacucuuauuccucaagaauuaauauccaauguuuaugag

SEQ ID NO: 298084 - RNA, 64 nt, Human
aguguuguugugggugugucaaauccccuuucauccucaagagcucccugcuucccuuagauua

SEQ ID NO: 298085 - RNA, 64 nt, Human
ccaagaagcaugcagagaagaauugguuuguuggccucaagaagaaugggagcugcaaacgcgg

SEQ ID NO: 298086 - RNA, 64 nt, Human
cuugcagaauaauagagccacugguuuaauguuuccucaagauagguuuuaguguaagcuagua

SEQ ID NO: 298087 - RNA, 64 nt, Human
ccagcccuucuccuccugcuaacccuucucacacccucaagaggaguuagaaaagagguccuug

SEQ ID NO: 298088 - RNA, 64 nt, Human
gucauucagccaacccagaggauguagacccuguccucaagaagugcagggcgaguucugccgu

SEQ ID NO: 298089 - RNA, 64 nt, Human
agcuguggaacgagacuucugcagagguggcugaccucaagaagcagguacaggcccuucagcc

SEQ ID NO: 298090 - RNA, 64 nt, Human
uaucuuguuuugaucauuuccacugcacauuucuccucaagaaaagcgaaaggacagacuguug

SEQ ID NO: 298091 - RNA, 64 nt, Human
uguuuuacuccgugccuuacuggauuuggccuguccucaagaaugguaauuaugaagaguggag

SEQ ID NO: 298092 - RNA, 64 nt, Human
cacugggggaccagcccugcagaccacucugacaagucuucagcccacacccugccagccccac

SEQ ID NO: 298093 - RNA, 64 nt, Human
gugcgcagcagccccaggaccucacccugagcugagucuucaggagccgcccugguggcacaac

SEQ ID NO: 298094 - RNA, 64 nt, Human
uuccuuuggggggcccgggcggguugugggaaucagucuucacagacagacgugagccaggcgg

SEQ ID NO: 298095 - RNA, 64 nt, Human
agaacugaccuggaugcggcccucugcagggcccagucuucaguccuguggucccuggacuggu

SEQ ID NO: 298096 - RNA, 64 nt, Human
aaacagcguccauuuuuucauauuagagguggaaccucaagaaugacuuuauucuuguaucuca

SEQ ID NO: 298097 - RNA, 64 nt, Human
uguguguaucagugucucaaugugaagauuguaaccucaagauuaggaaucuuaaaagagccac

SEQ ID NO: 298098 - RNA, 64 nt, Human
gcuuaccugguaagaauauucagcuggucuggguccucaagacuccaauagacacucuuagaga

SEQ ID NO: 298099 - RNA, 64 nt, Human
uggacgagaagacucagccugagggccugcggagccucaagaagccagaccgcaagaagcgcua

SEQ ID NO: 298100 - RNA, 64 nt, Human
ggacugucuucaucaaguauuucccuacagaacuccucaagaaaacagagaucauuuggcuaga

SEQ ID NO: 298101 - RNA, 64 nt, Human
cccugcggaaacagaaacauagacugagaacaaaccucaagacuaucagugugaccuccccaua

SEQ ID NO: 298102 - RNA, 64 nt, Human
aggacucugggccccuccccagcuccacucccuaccucaagaaugugaccauuuggaaaaggca

SEQ ID NO: 298103 - RNA, 64 nt, Human
ccaccucacccagagcaccucccagccaccguccccucaagagcccccagaacgagacccugua

SEQ ID NO: 298104 - RNA, 64 nt, Human
guggggagaaggcaaguuacaaagauagaccuucccucaagauaaucagauuuucaugguauua

SEQ ID NO: 298105 - RNA, 64 nt, Human
ccaagaucaguugcuuauagauaauguucaaugaccucaagacauauauuuuugagaaauuauc

SEQ ID NO: 298106 - RNA, 64 nt, Human
acaccucugcauauuacauguaccuccuccugcuccucaagaguguggucuauuuugccaucau

SEQ ID NO: 298107 - RNA, 64 nt, Human
cucccaugcccguucugaccucagccuuggaacuccucaagaaccugaagauuccaguggucag

SEQ ID NO: 298108 - RNA, 64 nt, Human
auaugucagagauugccuguggcucuaauaugcaccucaagauuuuaaggagauaauguuuuua

SEQ ID NO: 298109 - RNA, 64 nt, Human
ugcaacguguauaucauccuaaaaguggggguugccucaagacagcccccaggaacugauaaga

SEQ ID NO: 298110 - RNA, 64 nt, Human
cuugcagccucuggacagaugugagaaggcaccaccucaagaggggaggagcggggcugauccu

SEQ ID NO: 298111 - RNA, 64 nt, Human
agagguucagagaacuuuccagguuuauacuauaccucaagaccacauagauuagcuacugcuu

SEQ ID NO: 298112 - RNA, 64 nt, Human
cuucaguucucuccaauauuaccaggcccaacucagucuucagugauuuuaaacagcauugaca

SEQ ID NO: 298113 - RNA, 64 nt, Human
uauuccuuggccauugucaacggagagcuggccaagucuucacaaacccuugcaacauugccug

SEQ ID NO: 298114 - RNA, 64 nt, Human
cuaggacccagggcuggcuucuaaguuuccguccagucuucaggcaaguucuguguuagucaug

SEQ ID NO: 298115 - RNA, 64 nt, Human
ugugaagacugccaggccuaggcucucuguagagagucuucaagaucccggagugguagcgcug

SEQ ID NO: 298116 - RNA, 64 nt, Human
uuauuugggucucuuagaccuuaccucucaacucccucaagaguaccagucucugaaguuauaa

SEQ ID NO: 298117 - RNA, 64 nt, Human
uaauaaugcagagauaauuagacaugguucccgcccucaagaagcucacaaaaguauucaggaa

SEQ ID NO: 298118 - RNA, 64 nt, Human
gugaauagccuggccaccagccauccucccuccaccucaagacccccauuugucccagacuaaa

SEQ ID NO: 298119 - RNA, 64 nt, Human
ucauuuugaugauucugagaagaaacuuguccuuccucaagaacacagcccugcuucugacaua

SEQ ID NO: 298120 - RNA, 64 nt, Human
aaaaauaaccaaaaaaugugagcuauaauguuucccucaagaacaaacagaaacgagauuugcc

SEQ ID NO: 298121 - RNA, 64 nt, Human
cuucucuuuuguuagggaggccucauucuaaguuccucaagagaguccuuggcuuaaagcugua

SEQ ID NO: 298122 - RNA, 64 nt, Human
ugucagccccaguuggcuuccuggucaacaaggaccucaagaacugccuguggaccgaggcccc

SEQ ID NO: 298123 - RNA, 64 nt, Human
aaaaagguguauuuuuucuuuuagaauguaagcuccucaagagcagggacaauguuuucuguau

SEQ ID NO: 298124 - RNA, 64 nt, Human
agcguggccacaacuuauagacaguaucccuuguccucaagauuuuuaguuuggcccaagugug

SEQ ID NO: 298125 - RNA, 64 nt, Human
agaguaaauggaacuggucaacucuugacaguugccucaagauggagugaaauugcaucgaggg

SEQ ID NO: 298126 - RNA, 64 nt, Human
aaugcagagguaacucucaggcagcuaagcagcaccucaagaaaacauguuaaauuaaugcuuc

SEQ ID NO: 298127 - RNA, 64 nt, Human
cuuauuuauugcaugcgucgcuuccacaggggccccucaagagcugugacucgggagagcuacc

SEQ ID NO: 298128 - RNA, 64 nt, Human
ucugagaguagcugcugcuuucccugacuuccuuccucaagaauacagucuauucugggggguu

SEQ ID NO: 298129 - RNA, 64 nt, Human
ccacacacucuggaaugcuuuaguuuccuuuuccccucaagaugucugagucagcuaggaugcu

SEQ ID NO: 298130 - RNA, 64 nt, Human
aauuugggugagcugcaccugauuaguugaaaggccucaagaacaaacacugcaguuuccugga

SEQ ID NO: 298131 - RNA, 64 nt, Human
aacacugcaguuuccuggaaaagaagaaacuuugccucaagacuauagccaucgacuccugccu

SEQ ID NO: 298132 - RNA, 64 nt, Human
gucagaauacuccuuucauccaucacucagccagagucuucaggacagacuccgcaugggacuu

SEQ ID NO: 298133 - RNA, 64 nt, Human
ugccacuagcccuccucucccagugacaaccaaaagucuucaucaaacguuccccuggguucac

SEQ ID NO: 298134 - RNA, 64 nt, Human
uguggaugcacacagcuuuaccuacuguacugguagucuucacuucuaucuuuuaaguuacaaa

SEQ ID NO: 298135 - RNA, 64 nt, Human
aauuuuuauuaugaaacuuuccuuugucauuauuagucuucaaaagcaugauuuuuaauaguug

SEQ ID NO: 298136 - RNA, 64 nt, Human
uuauaaacuugccauagauaucucagauuugaaaccucaagacagauuuauuauucuuaaaugc

SEQ ID NO: 298137 - RNA, 64 nt, Human
uguuuuaaucauuaggaaacacugauuaacugcaagucuucaugauucugucauauuaagaaac

SEQ ID NO: 298138 - RNA, 64 nt, Human
uaggcuggcugcacuguucacauuugucucuaaaagucuucaucgcuaaaagauaccauaauuu

SEQ ID NO: 298139 - RNA, 64 nt, Human
agguggggaguccagggcucccggagagggagucagucuucacuugcacugggggaacagaugc

SEQ ID NO: 298140 - RNA, 64 nt, Human
aauuaaaaguuccaaacuaaagccaauagcaccaagucuucauaagaauacaaaguauacauac

SEQ ID NO: 298141 - RNA, 64 nt, Human
gagaggggcagguuuccugagaguucagcaguacagucuucaucuuuugaaagguagauauguu

SEQ ID NO: 298142 - RNA, 64 nt, Human
cuccucacuagggcugagcaccuucucugaguagagucuucauccuuagcaccacagacuucug

SEQ ID NO: 298143 - RNA, 64 nt, Human
cgcccccccccucaccccagaccuacagaaucagagucuucaagggauggggccagggaaucug

SEQ ID NO: 298144 - RNA, 64 nt, Human
ucugcucaaauaauacucuuaucgaaaaugcuaaagucuucaauguuaaaauacugauugguaa

SEQ ID NO: 298145 - RNA, 64 nt, Human
gaggcggaggcuccagucccugcugggcugccucagucuucagugcugauugugucacggguca

SEQ ID NO: 298146 - RNA, 64 nt, Human
acaucaaucaaccguagcaauguggucaucacgaagucuucauugacucacuggcuuggauuuu

SEQ ID NO: 298147 - RNA, 64 nt, Human
cuuugacauauuuuauaguguguuaauuacaaauagucuucauaugccagaauauaagagcaag

SEQ ID NO: 298148 - RNA, 64 nt, Human
gagggggccgcgccaggcucccaggccuccacagagucuucagcgcaucccccaacagcagccc

SEQ ID NO: 298149 - RNA, 64 nt, Human
uagggaaacuugacuaauguaaugauugucacaaagucuucaguaacgcuacaacgauugcaaa

SEQ ID NO: 298150 - RNA, 64 nt, Human
cccaucccccuaagucccuuugucuugacccccaagucuucaaccagauauccucggcaaccca

SEQ ID NO: 298151 - RNA, 64 nt, Human
uugcauccuaucagauuguugaggugggugugauagucuucaggugcagugcguucauucacua

SEQ ID NO: 298152 - RNA, 64 nt, Human
cucccagauagcugccccugccacgcaggccaggagucuucacacucaggcaccaggccugguc

SEQ ID NO: 298153 - RNA, 64 nt, Human
aaguuggccuugcccuugagaguauauggggaccagucuucaugucuuggaguaauuugucaaa

SEQ ID NO: 298154 - RNA, 64 nt, Human
acucacaggauccugagcugcacuuaccugugagagucuucaaacuuuuaaaccuugccaguca

SEQ ID NO: 298155 - RNA, 64 nt, Human
auugcuucccagcuuguguuauauggcuacagcaagucuucagcugcugcaaugaggaaauggg

SEQ ID NO: 298156 - RNA, 64 nt, Human
ucaccuugcaggcugugguggagcugacgcugggagucuucauaauacagcacagcgguuaagc

SEQ ID NO: 298157 - RNA, 64 nt, Human
uuaaagaaaacugaacugaggaaaaugguguuuuccucaagaagacuacuggaacuggaugacc

SEQ ID NO: 298158 - RNA, 64 nt, Human
cauuuuccaucuccaaauagccaggcccucucucccucaagaaaugcccagauguagaaauuca

SEQ ID NO: 298159 - RNA, 64 nt, Human
gccuuugccuuugagcccugggguaaggccuggaccucaagauuccuggaaagaagccccagcc

SEQ ID NO: 298160 - RNA, 64 nt, Human
gagaaggaaaaauagcuuuuaucaauuuuuuucuccucaagauucuguaauaaaccucaaaguc

SEQ ID NO: 298161 - RNA, 64 nt, Human
cagguugaguccagaugcuucucaccuucuuucuccucaagaaagaugcuuuuugggaaacguu

SEQ ID NO: 298162 - RNA, 64 nt, Human
aggacugcuggcuguaaccagggcacaucacccaccucaagacaagcccacgcccuugucagcu

SEQ ID NO: 298163 - RNA, 64 nt, Human
auccuguaguuuauguagaaugccacaucugcguccucaagaccuguuucauccauuugggaaa

SEQ ID NO: 298164 - RNA, 64 nt, Human
agccccagagggcuuuguggaggacaggccuugcccucaagaacgucguaccugacgcugagcc

SEQ ID NO: 298165 - RNA, 64 nt, Human
gccacccucaccuagaaacaugccuuugugcccaccucaagaugggcagugucccuguucugaa

SEQ ID NO: 298166 - RNA, 64 nt, Human
uagcagacaaggggugucugacuggcuucuuuugccucaagaugguguaugucguaagugaugc

SEQ ID NO: 298167 - RNA, 64 nt, Human
uguuaaagaggcuguuaucaggcuuaaccauaacccucaagaucugcuugacagugauuaaauc

SEQ ID NO: 298168 - RNA, 64 nt, Human
ccacuuuucagagucaucuacaaaauuuuucuuuccucaagaaaagaguuccuuuugccuuauu

SEQ ID NO: 298169 - RNA, 64 nt, Human
uuacucuaacaagccacaugaauagaagaauuuuccucaagauggacccgguaaauauaaccac

SEQ ID NO: 298170 - RNA, 64 nt, Human
accacuggacuggcagggcaacgacuucuucccaccucaagaugagguccucgcccccuugucu

SEQ ID NO: 298171 - RNA, 64 nt, Human
cuucuggaacccagaagaggagacaguuuaccauccucaagaucauucaguguuuuuccuuuaa

SEQ ID NO: 298172 - RNA, 64 nt, Human
aagccccuggaucuuugggguaaaaggaggguggccucaagaaacaaugucuggggacaggccu

SEQ ID NO: 298173 - RNA, 53 nt, Human
gcuauaaagccagugacugagaaagucuucaccuggaaaucacaacuggguau

SEQ ID NO: 298174 - RNA, 64 nt, Human
uuaagaaauuguuuuguaguuucugguuuauagcagucuucaaguuuuccaucuucacuguaug

SEQ ID NO: 298175 - RNA, 64 nt, Human
gcuucauagaaacuuaauuagauuauaccacuagagucuucagauuuuuauacuuuuuuuuuuu

SEQ ID NO: 298176 - RNA, 64 nt, Human
aacugggucaucauuuguccuguucuagcaagauagucuucaguuucauuuuccugugcccugu

SEQ ID NO: 298177 - RNA, 64 nt, Human
guugucauggccucagcuaugcuuccuggcucucccucaagagugcagccuuggcuagagaacu

SEQ ID NO: 298178 - RNA, 64 nt, Human
uguagaccagacacagggcguauggaaagcacguccucaagacuguaguauuccagaugagcug

SEQ ID NO: 298179 - RNA, 64 nt, Human
aagaggaggagggauucuggucuucacugccaugccucaagaacaccuuuguuuugcacugaca

SEQ ID NO: 298180 - RNA, 64 nt, Human
acugggaaugcugggaaaugagauacauucccgcccucaagaaucucccagucugguaggagag

SEQ ID NO: 298181 - RNA, 64 nt, Human
uugccuugcuucucccauuuccugaucuagcacuccucaagacuuugauccuuggaaaccgugu

SEQ ID NO: 298182 - RNA, 64 nt, Human
agggccuggcucacaugccccuccuuagaggcagccucaagaugaaccagggaaucaaacucaa

SEQ ID NO: 298183 - RNA, 64 nt, Human
agcggucagcagacaaggagaagagcaaggguucccucaagaggaagugagcggugcuguccuc

SEQ ID NO: 298184 - RNA, 64 nt, Human
acuaguuuggauaucuuuaggguuuagaaucuaaccucaagaauaagaaauacaaguacaaauu

SEQ ID NO: 298185 - RNA, 64 nt, Human
uaacauacauauuaacaauaucuaucaggaaaacccucaagacagcuucuaguuaaaaccuuug

SEQ ID NO: 298186 - RNA, 64 nt, Human
gcguguggggagaacaucucccuuccggggcugcccucaagagcuucugaaaaacuaaugacuc

SEQ ID NO: 298187 - RNA, 64 nt, Human
cccguggugaggcugcccgccgugcccugcaguaccucaagaucauggcaggcagcaagugaag

SEQ ID NO: 298188 - RNA, 64 nt, Human
ugaauaaagaaaaagguagcagugcuucucugguccucaagagacuuggauuuaaagguaggau

SEQ ID NO: 298189 - RNA, 64 nt, Human
uagacccucucuauagccaugagacuccuuguggccucaagaaauuuagacgcccacgacagca

SEQ ID NO: 298190 - RNA, 64 nt, Human
uauuuccuucauaaagaaugccacccaucugauuccucaagaaucuagaccuagaaauaccauu

SEQ ID NO: 298191 - RNA, 64 nt, Human
uucaugcacacuugcacccauguguagucaggugccucaagagaaggcaaccuugacucuuucu

SEQ ID NO: 298192 - RNA, 64 nt, Human
agaacauuauguuuguaucauuucuuucauaaaaccucaagagcauuuuuaagcccuuuucauc

SEQ ID NO: 298193 - RNA, 64 nt, Human
aauucuguuuauagaauaagggagaaaauaauccagucuucacuggguucccauucugaggguc

SEQ ID NO: 298194 - RNA, 64 nt, Human
uguuaauguugccuuuuacucuguuugcauucuaagucuucaaagucuuguguuuguuuuauag

SEQ ID NO: 298195 - RNA, 64 nt, Human; identical to SEQ ID NO: 296933

SEQ ID NO: 298196 - RNA, 64 nt, Human
auccucagauguggagggagguaggcacugccucagucuucauccaaacaccuuucccuuugcc

SEQ ID NO: 298197 - RNA, 64 nt, Human
ccuucucucuaccugccaccaaaaagaaagaaacccucaagaguucuaauucuuuuucaucuau

SEQ ID NO: 298198 - RNA, 64 nt, Human
auuaaaaauaguaagccucccuccucguccccugccucaagaaauugccuccuuauuuaucaac

SEQ ID NO: 298199 - RNA, 64 nt, Human
auuuuugaaaaauagucaccaacuguauauacuuccucaagaacugauaauucauuauaucauc

SEQ ID NO: 298200 - RNA, 64 nt, Human
uacuuuuuacuguuugccaaaacacuugaaugugccucaagaaaagguaccuacuacaugcugu

SEQ ID NO: 298201 - RNA, 64 nt, Human
aguucuauacuggauccuuucuuucucuaauaauccucaagaaauccuuacagguaaguauugc

SEQ ID NO: 298202 - RNA, 64 nt, Human
cauguuuaacuggaaguugagagucugcuuuguaccucaagaguuacaugagcauguuguggau

SEQ ID NO: 298203 - RNA, 64 nt, Human
cuauaauuguauauaugccuuugauguauuuuccccucaagauuaucaacuguguguucgacag

SEQ ID NO: 298204 - RNA, 64 nt, Human
caucaggguccucagugcagagcaacuuacgcauccucaagaauccacugcuuuucaggcaagg

SEQ ID NO: 298205 - RNA, 64 nt, Human
guuucuuagcuuggggagaugauggacuuagcuuccucaagauaaauuucuaguuuauuaagau

SEQ ID NO: 298206 - RNA, 64 nt, Human
agagcagugguugucaaaguguggucugggggggccucaagagccuuucaaggguauucuaggu

SEQ ID NO: 298207 - RNA, 64 nt, Human
uccacuaagaaggccugucuacacugcaggggaaccucaagaacuuuucauugcacuucuaaaa

SEQ ID NO: 298208 - RNA, 64 nt, Human
ucaaaaggaagagccuuuuaaaaacauuugccaaccucaagaauaaauacugaaagucuugaaa

SEQ ID NO: 298209 - RNA, 64 nt, Human
ugggagccaggaguaagacaagugggauuuggggccucaagaaauauacucucccagauuuuua

SEQ ID NO: 298210 - RNA, 64 nt, Human
aaaaggcacuucuaaagguaagugguuuaaguugccucaagagagggacaauguagcuuuauuu

SEQ ID NO: 298211 - RNA, 64 nt, Human
aaaagaagacugacuggguggaggcucugccuugccucaagaaccauccccugcagagcaucca

SEQ ID NO: 298212 - RNA, 64 nt, Human
agaacagaaaaucgucuuauaguugagaauuuauccucaagagucagcuggcagguuuguugaa

SEQ ID NO: 298213 - RNA, 64 nt, Human
augacgugcuuacuacugcagugcauuugucauuagucuucauguuaauacaguacauuuauuc

SEQ ID NO: 298214 - RNA, 64 nt, Human
ggagacucccucggcaagauggcagaggguacggagucuucaggcccaguuucucacuuuagcc

SEQ ID NO: 298215 - RNA, 64 nt, Human
guauugaauguaaaggaagcaaggccuguauugcagucuucauacaaaacaaaaggaauaagaa

SEQ ID NO: 298216 - RNA, 64 nt, Human
aaauaagaaaccccagccaugaaaucuaccaugaagucuucaaguucaugucacugagaagcuu

SEQ ID NO: 298217 - RNA, 64 nt, Human
cguaggccuugcaucucgccaccuccacuucuguccucaagaacaaguccuaggucaagggaaa

SEQ ID NO: 298218 - RNA, 64 nt, Human
ggaauuagugcuggauuugaagcuacgcacucagccucaagaacucccuggaauaucccugaga

SEQ ID NO: 298219 - RNA, 64 nt, Human
agauggcccugggaaucaauuccucaggaauugcccucaagaacucugcuucuugcuuugcaga

SEQ ID NO: 298220 - RNA, 64 nt, Human
caaaucuuagaguucauaaauuuacuugagguugccucaagaacucagggaacaauacuguaaa

SEQ ID NO: 298221 - RNA, 64 nt, Human
uggggugggggguggaaaugcaguuuagccauguccucaagauaaagucuugguaaaaauaaau

SEQ ID NO: 298222 - RNA, 64 nt, Human
uugggaguagagucucaaggucauuccccucuucccucaagacucucugaaugcugcuccacug

SEQ ID NO: 298223 - RNA, 64 nt, Human
ccuugcaagagaagucaaaggaacuuuuguuucuccucaagagccuggacaucucugucuguca

SEQ ID NO: 298224 - RNA, 64 nt, Human
guguuuacugaauuuccacacuuauuuugaagacccucaagaguaaauguggcagagugaaagg

SEQ ID NO: 298225 - RNA, 64 nt, Human
aaugccuaagagugaaaguaguucuauugacauuccucaagauauuuaauaucaacugcauuau

SEQ ID NO: 298226 - RNA, 64 nt, Human
ugcaucaguguggacuccuagaacgugcgaccugccucaagaaaaugcaguuuucaaaaacaga

SEQ ID NO: 298227 - RNA, 64 nt, Human
gggcuccacuucauccagaugaaggaaaggaagaccucaagaaaaauucacaguugagugcauc

SEQ ID NO: 298228 - RNA, 64 nt, Human
cuuuaaauuaaaaaaaauuuuuaaaagaccaggaccucaagauagcagguuuauacuuagaaau

SEQ ID NO: 298229 - RNA, 64 nt, Human
cuacaacacuacagagcacuguuugcauccccauccucaagacaguauauuuaccuugacuaau

SEQ ID NO: 298230 - RNA, 64 nt, Human
ucgguccuccggagcccacaaccuggacacagcuccucaagacagguagcauggaccuuaaggc

SEQ ID NO: 298231 - RNA, 64 nt, Human
agccccucucucacacaucacauucccaugguggccucaagaaaggcccggaagcgccaggcug

SEQ ID NO: 298232 - RNA, 64 nt, Human
agagccgggcugcucgugagaaagagagcuucaaccucaagagggcucaggugugugcaggggu

SEQ ID NO: 298233 - RNA, 64 nt, Human
uucacacucucacugucuugcaggaaucacaagaagucuucauaugugaacgugccauucaguu

SEQ ID NO: 298234 - RNA, 64 nt, Human
gugagugugggggaaauguaguaaccuaguuaguagucuucaauauaaccaauuguacaagggg

SEQ ID NO: 298235 - RNA, 64 nt, Human
gccauuuucauguucucugccaauuacuauaggcagucuucauuuugcagaggugagguaagac

SEQ ID NO: 298236 - RNA, 64 nt, Human
cauaacuacuuugauauuuuaacucagguacuccagucuucaccccaaccucagcugauuguag

SEQ ID NO: 298237 - RNA, 64 nt, Human
uccuccacauugugcacacugguuuugccuuuguccucaagaguugauacuuggcauuagcaug

SEQ ID NO: 298238 - RNA, 64 nt, Human
ugaugaaugcccgcagugagcuauacuuacgcuuccucaagaagaggauuagcucugauuuuga

SEQ ID NO: 298239 - RNA, 64 nt, Human
uccucaccaagcucauuacaucugccagggccugccucaagaagcccagcccagccuuuuccug

SEQ ID NO: 298240 - RNA, 64 nt, Human
guguaaccauuuguuaacuguacugaagguguguccucaagaagaaaguguucaaauuaaaaaa

SEQ ID NO: 298241 - RNA, 64 nt, Human
ccccccaccccgcccaagccaaugcagacacugaccucaagaccagccacaccaagucugugca

SEQ ID NO: 298242 - RNA, 64 nt, Human
ugcugucucucaguaguauagcgguuacuucaugccucaagauuuggguaccuggauugcuaaa

SEQ ID NO: 298243 - RNA, 64 nt, Human
ucucuuggaauaaugacguaccacucaguuggacccucaagagucacugcuuugucugugcugg

SEQ ID NO: 298244 - RNA, 64 nt, Human
uauaucaauucuagacuguuacaggugacggacgccucaagagagagaagagaaaaugaaagca

SEQ ID NO: 298245 - RNA, 64 nt, Human
ugguuggugcagauggaaguuucugucugcuggcccucaagagaguguuuugccagggacacag

SEQ ID NO: 298246 - RNA, 64 nt, Human
acggcucuuuuugucacacaggauggcaugugauccucaagacgacgaacaaugaacuaaagcc

SEQ ID NO: 298247 - RNA, 64 nt, Human
ggcagcgccuauguuucucuggagauuccugcaaccucaagagacuucccaggcgcucaggccu

SEQ ID NO: 298248 - RNA, 64 nt, Human
ugucgcuuggcuaagugacucccagcccaagcccccucaagagucugggucgggggaggaggag

SEQ ID NO: 298249 - RNA, 64 nt, Human
uguauauaccaccuaggaggagaugccaccaagcccucaagaaguugugcccuuccccgccugc

SEQ ID NO: 298250 - RNA, 64 nt, Human
cguacaucauuauuaauauaaaaauaacaggcagccucaagaaugugcugagauuucucuggaa

SEQ ID NO: 298251 - RNA, 64 nt, Human
ucuccuuuggaggaagggaaugaaacauuuauggccucaagauacuauacauuuaaagcacccc

SEQ ID NO: 298252 - RNA, 64 nt, Human
aggcuacccgcaucccacucagccccucccuaccccucaagauuugaugaaaauuccaaccaug

SEQ ID NO: 298253 - RNA, 64 nt, Human
guaacaaaaaagaccaugcaucauaaaauugcccagucuucagcggagcaguuuucuggagauc

SEQ ID NO: 298254 - RNA, 64 nt, Human
uagguggcugggucagugcuuaagacaggauucuagucuucacuugccugugcagcugggcgcu

SEQ ID NO: 298255 - RNA, 64 nt, Human
ccacacuuuaauaucacauuauaaagggaaggacagucuucauuccuccugguuauugguuugu

SEQ ID NO: 298256 - RNA, 64 nt, Human
cccaaaugugaagaagugaaaaagacuucgcagcagucuucauuguggugcucuucaugaucau

SEQ ID NO: 298257 - RNA, 64 nt, Human
cucccugccauuguggacucuuguauuugagggaccucaagagagugaggacccuaccauccac

SEQ ID NO: 298258 - RNA, 64 nt, Human
gcaggccugcaggguguggggaaggaggacacaaccucaagaaaggaagcgugaaccccaggga

SEQ ID NO: 298259 - RNA, 64 nt, Human
cugcaguucaguuuugggccaccugggguacugcccucaagagaacgugcuguggcccaugcug

SEQ ID NO: 298260 - RNA, 64 nt, Human
cuccagacgaugcauuucuuggccaaaguggcuuccucaagaaagcagcacuuaccuuugaaaa

SEQ ID NO: 298261 - RNA, 64 nt, Human
ucaaauggcuucacaguccuuacuucucuaccugccucaagaaggggcucagagcagagacuug

SEQ ID NO: 298262 - RNA, 64 nt, Human
gaucaugcaucuuugagugcaguuuggucugaccccucaagagaaaagcauggugccguagggc

SEQ ID NO: 298263 - RNA, 64 nt, Human
uagaaucaaugaaauaccauauuuugauuccauuccucaagauaauuuuagaguuauaaaacca

SEQ ID NO: 298264 - RNA, 64 nt, Human
ccaugacgagcucuagcuggaugggcgcagagaaccucaagaaggcaugaagccagccccugca

SEQ ID NO: 298265 - RNA, 64 nt, Human
caauguaagcaaugugggaaagccgucagaucagccucaagacuucaaaugcauggaagcacuc

SEQ ID NO: 298266 - RNA, 64 nt, Human
aaaaaggaagaaaccacagaaagaaaacuacagaccucaagauuccacucugugcccgccucug

SEQ ID NO: 298267 - RNA, 64 nt, Human
ccauucuuugagaccuuuucuccuucucugccucccucaagaugagugcccgggcaugagaagc

SEQ ID NO: 298268 - RNA, 64 nt, Human
gcuucugguugauuaaugagggcaugggguggucccucaagaccuuccccuaccuuuuguggaa

SEQ ID NO: 298269 - RNA, 64 nt, Human
caaacuucucccggguccagcgccuggggcugccccucaagauggucauguacucagcugugag

SEQ ID NO: 298270 - RNA, 64 nt, Human
acaauuaugggggguggggggugugaucugagugccucaagaugguuuucaaaaaaauuuuuuu

SEQ ID NO: 298271 - RNA, 64 nt, Human
ccgaccuacgccacuggaaacacacccaccgcaaccucaagaaccagacugugcagagggcauu

SEQ ID NO: 298272 - RNA, 64 nt, Human
uacaggaccccccaagucuuccuacccucugcacccucaagaaacccccagugccuuguaugaa

SEQ ID NO: 298273 - RNA, 64 nt, Human
aaaaaucuaucauuucaagauaggcuuagcaggaugggcgcaguggcucacgccacuaauccca

SEQ ID NO: 298274 - RNA, 64 nt, Human
ucgccugaggcuguuugccaauucaggguucugcugggcgcaaggaacgcacuguucaaacgca

SEQ ID NO: 298275 - RNA, 64 nt, Human
ucccuccaguggcaccuccuggaaacaguccacuugggcgcaaaacccagugccuuccaaauga

SEQ ID NO: 298276 - RNA, 64 nt, Human
cugggguugggggacgggaagagccgugcccccuugggcgcacucuucagcgucuccuccuccu

SEQ ID NO: 298277 - RNA, 64 nt, Human
acuuccuucauuaacaaagacccuuguucuuaucccucaagaagaaacccaccauaaccagccc

SEQ ID NO: 298278 - RNA, 64 nt, Human
acaucuugccaaaaauauugaaccugaauuuaagccucaagagccaacucccaguuuagagaaa

SEQ ID NO: 298279 - RNA, 64 nt, Human
gcauguaccuauugacuguauccucaugcauuuuccucaagaaugucugaagaagguaguaaua

SEQ ID NO: 298280 - RNA, 64 nt, Human
uaaaaagcuacauaugccccucccaaaccgggaaccucaagaucuccacccuaaaauaguucug

SEQ ID NO: 298281 - RNA, 64 nt, Human
cccgccgggcuacgaugacauguaccugugaaggccucaagaauguaacaucccaggcuucccu

SEQ ID NO: 298282 - RNA, 63 nt, Human
ugcacuccagcccgggcaacagaguaagacccugccucaagaaaaaaaaaaaaaaaaaaaauc

SEQ ID NO: 298283 - RNA, 64 nt, Human
guggccaggugccggcacagugccucucccagagccucaagaagggccauuuaggagcuugcuu

SEQ ID NO: 298284 - RNA, 64 nt, Human
uuuggcugcuuuucaaggugucccccaauguggcccucaagagccauccccacugccuggccag

SEQ ID NO: 298285 - RNA, 64 nt, Human
uauguuggucauuaggugaauauuacucauuuucccucaagagaagcucauaaguguguguggg

SEQ ID NO: 298286 - RNA, 64 nt, Human
augcaaguuggggccaggauaggggaggggugcuccucaagaggaagaaaccgagaggcccgcg

SEQ ID NO: 298287 - RNA, 64 nt, Human
ugaaucguccucaaaaugacgaagcuugaauuguccucaagauggaugugaaucuuacauuccu

SEQ ID NO: 298288 - RNA, 64 nt, Human
caggacaccacaugggagggggcucaggccucagccucaagaucuucagcuguggccucucggg

SEQ ID NO: 298289 - RNA, 64 nt, Human
guccugcucuggggacgccugcuucauuuacaagccucaagauggcucuguguagggccugagc

SEQ ID NO: 298290 - RNA, 64 nt, Human
cgagagaagaggaguggaugagccugcggguuugccucaagaaacuucaugagggucucuuacu

SEQ ID NO: 298291 - RNA, 64 nt, Human
aauguagauucacagauacauuuacuuucagaauccucaagaggauuucaaaugcuaacuuuua

SEQ ID NO: 298292 - RNA, 64 nt, Human
aggggcagagaauucaagaagguacagcuuuggcccucaagagcccacuguaugcuggggaaau

SEQ ID NO: 298293 - RNA, 64 nt, Human
cauugcuguggaaaaaucucuggagucagaggccugggcgcagcucuggacucugcguauaaca

SEQ ID NO: 298294 - RNA, 64 nt, Human
caucaucaugccuuccaaauuguggguggcucugugggcgcaucaauaaaagccguccuugauu

SEQ ID NO: 298295 - RNA, 64 nt, Human
guuaaaguacuggauuaagaaaacaacaacaggcugggcgcaguggcucacaccuguaauccca

SEQ ID NO: 298296 - RNA, 64 nt, Human
aagcagccagacguugaacuguguuuccuuucccugggcgcagggugcagggugucuuccggau

SEQ ID NO: 298297 - RNA, 64 nt, Human
cugacuguggcuaucucugucccaucacccugagccucaagauggaagacauugucugcuugaa

SEQ ID NO: 298298 - RNA, 64 nt, Human
acauugaacuugcugucaugaggcgagaucaaucccucaagauuuuaaauccugaagaaauuga

SEQ ID NO: 298299 - RNA, 64 nt, Human
ggaaaaucuugcuuuuauggucuuccccccucgcccucaagaacaagggccuugugcgugggcc

SEQ ID NO: 298300 - RNA, 64 nt, Human
cauacuuuccuguauaguucacguuucauguaauccucaagaaauaaaaggaagccaaagagug

SEQ ID NO: 298301 - RNA, 64 nt, Human
cacaaacucuaucggagaacaugaaucaaaagugccucaagaggaaugaaaaaagcuuuacugg

SEQ ID NO: 298302 - RNA, 64 nt, Human
cuagcaccauucuugauguccagggaagaagccaccucaagacauaugaggggugcccugggcu

SEQ ID NO: 298303 - RNA, 64 nt, Human
uccauuugcagggucaucagacagucaccuuuggccucaagaggccucagaacugcaaacuccu

SEQ ID NO: 298304 - RNA, 64 nt, Human
cuccccgguggccagagccagccagcauggccacccucaagaggcgagaugagcccacagaggc

SEQ ID NO: 298305 - RNA, 64 nt, Human
gucuuaaucagauaaaagauagaggcuaugggggccucaagauuuuuggagagcagaggugguc

SEQ ID NO: 298306 - RNA, 64 nt, Human
uucaucuccucugugggaggacacaucucugcagccucaagaguuaggcagagacucaaguuac

SEQ ID NO: 298307 - RNA, 64 nt, Human
ggauguccauuucggggagaggagcaggugggacccucaagaaaaugacggagaacaucccaga

SEQ ID NO: 298308 - RNA, 64 nt, Human
gaaaccaugccuggaggggccgugaacacagaacccucaagacaaggaugacagagcuggagga

SEQ ID NO: 298309 - RNA, 64 nt, Human
cggcuuuugaaacuuagguauuuuauauuuuuccccucaagaacuuuuuuuuaagagacagauu

SEQ ID NO: 298310 - RNA, 64 nt, Human
aggaauaccgugggcuuccugcccucaccccacaccucaagaccaucccacugcuugccugcuu

SEQ ID NO: 298311 - RNA, 64 nt, Human
aggaggcucccuguacuggagucgucccacuauuccucaagaaaucuuagaaccagcuugugag

SEQ ID NO: 298312 - RNA, 64 nt, Human
ugucuuaauauuuuuauauaggcugaugucuuugccucaagauuguuaggagguaauuuuccau

SEQ ID NO: 298313 - RNA, 64 nt, Human
ucucccuuccuuugagggaagcucagcuuucuuacgcgcucaucguuggacgggcugccaugca

SEQ ID NO: 298314 - RNA, 64 nt, Human
ugauuauuuuuaaagaaauauauaugguauguauccucaagaccuaaaaugucagacugguuua

SEQ ID NO: 298315 - RNA, 64 nt, Human
caccauguuggccaggcugguaucaaacuccugaccucaagagauccacucgccuugcccuccc

SEQ ID NO: 298316 - RNA, 64 nt, Human
caaagucccuucuguugugauuccuaggacuuuuccucaagaggaaaucuggauuuccaccuac

SEQ ID NO: 298317 - RNA, 64 nt, Human
ugacgaguagcaagagaccaaagcauuauuuuccccucaagacaacagaaaccauucagagcag

SEQ ID NO: 298318 - RNA, 64 nt, Human
gcucaccccucucugaagggcuguuguucugcuuccucaagaaauuaaacauuuguuucugugu

SEQ ID NO: 298319 - RNA, 50 nt, Human
acccuacaccuggccccugaccucaagaucaaggaaaggaggauggacga

SEQ ID NO: 298320 - RNA, 64 nt, Human
ccuguggucagauguggaggcccagggaauagacccucaagagcccccaagagacaggagagac

SEQ ID NO: 298321 - RNA, 64 nt, Human
aagggaugcuuuauacacauaauacugaauuuaaccucaagaggcaaaucuguuuuguacccca

SEQ ID NO: 298322 - RNA, 64 nt, Human
gaaagaauuagcaguaaaauacaugagauaaagaccucaagaaguuaaaagauacuuaauucuu

SEQ ID NO: 298323 - RNA, 64 nt, Human
ugucuaacgagagacaucaguuucucaggaugauccucaagaacguuauggaguccauguugca

SEQ ID NO: 298324 - RNA, 64 nt, Human; identical to SEQ ID NO: 297981

SEQ ID NO: 298325 - RNA, 64 nt, Human; identical to SEQ ID NO: 297982

SEQ ID NO: 298326 - RNA, 64 nt, Human; identical to SEQ ID NO: 297983

SEQ ID NO: 298327 - RNA, 64 nt, Human; identical to SEQ ID NO: 297984

SEQ ID NO: 298328 - RNA, 64 nt, Human; identical to SEQ ID NO: 297985

SEQ ID NO: 298329 - RNA, 64 nt, Human
aucccccccgcauucuggccuaggcaggagaggaugggcgcagcccugccacuuaacuuguuug

SEQ ID NO: 298330 - RNA, 64 nt, Human
gaggccugugcccaucgcaggccugggaggaaagugggcgcagagcccuccugcucacacagcu

SEQ ID NO: 298331 - RNA, 64 nt, Human
ccauucugcacucagaaaauggcacuugggggacugggcgcaguuggucuuuaaccacuuuuca

SEQ ID NO: 298332 - RNA, 64 nt, Human
gaugucuaaccauuaagauuauccaaagucaggcugggcgcaguggcucacgccuguaauccca

SEQ ID NO: 298333 - RNA, 64 nt, Human; identical to SEQ ID NO: 297986

SEQ ID NO: 298334 - RNA, 64 nt, Human; identical to SEQ ID NO: 297987

SEQ ID NO: 298335 - RNA, 64 nt, Human; identical to SEQ ID NO: 297988

SEQ ID NO: 298336 - RNA, 64 nt, Human; identical to SEQ ID NO: 297989

SEQ ID NO: 298337 - RNA, 64 nt, Human; identical to SEQ ID NO: 297990

SEQ ID NO: 298338 - RNA, 64 nt, Human; identical to SEQ ID NO: 297991

SEQ ID NO: 298339 - RNA, 64 nt, Human; identical to SEQ ID NO: 297992

SEQ ID NO: 298340 - RNA, 64 nt, Human; identical to SEQ ID NO: 297996

SEQ ID NO: 298341 - RNA, 64 nt, Human; identical to SEQ ID NO: 297997

SEQ ID NO: 298342 - RNA, 64 nt, Human; identical to SEQ ID NO: 297998

SEQ ID NO: 298343 - RNA, 64 nt, Human; identical to SEQ ID NO: 297999

SEQ ID NO: 298344 - RNA, 64 nt, Human; identical to SEQ ID NO: 298000

SEQ ID NO: 298345 - RNA, 64 nt, Human; identical to SEQ ID NO: 298001

SEQ ID NO: 298346 - RNA, 64 nt, Human; identical to SEQ ID NO: 298002

SEQ ID NO: 298347 - RNA, 64 nt, Human; identical to SEQ ID NO: 298003

SEQ ID NO: 298348 - RNA, 64 nt, Human; identical to SEQ ID NO: 298004

SEQ ID NO: 298349 - RNA, 64 nt, Human
ugaagaaaacuguaaacuuuaaagaauaaucagcugggcgcaguggcucaugcuuguaaucaca

SEQ ID NO: 298350 - RNA, 64 nt, Human
cccagcgccggggggagggaggagggcgugggcaugggcgcagaggcuuuuccaguguguauaa

SEQ ID NO: 298351 - RNA, 64 nt, Human
gaaaauaauuuuuuacaaaaagucacuuuugggcugggcgcaguggcucacgccuguaauccca

SEQ ID NO: 298352 - RNA, 64 nt, Human
uaaaaugagaagguuaaauuuaucuuaguacugcugggcgcaguggcucaugccuguaaucuga

SEQ ID NO: 298353 - RNA, 64 nt, Human; identical to SEQ ID NO: 298005

SEQ ID NO: 298354 - RNA, 64 nt, Human; identical to SEQ ID NO: 298006

SEQ ID NO: 298355 - RNA, 64 nt, Human; identical to SEQ ID NO: 298007

SEQ ID NO: 298356 - RNA, 64 nt, Human; identical to SEQ ID NO: 298008

SEQ ID NO: 298357 - RNA, 64 nt, Human; identical to SEQ ID NO: 298009

SEQ ID NO: 298358 - RNA, 64 nt, Human; identical to SEQ ID NO: 298010

SEQ ID NO: 298359 - RNA, 64 nt, Human; identical to SEQ ID NO: 298011

SEQ ID NO: 298360 - RNA, 64 nt, Human; identical to SEQ ID NO: 298016

SEQ ID NO: 298361 - RNA, 64 nt, Human; identical to SEQ ID NO: 298017

SEQ ID NO: 298362 - RNA, 64 nt, Human; identical to SEQ ID NO: 298018

SEQ ID NO: 298363 - RNA, 64 nt, Human; identical to SEQ ID NO: 298019

SEQ ID NO: 298364 - RNA, 64 nt, Human; identical to SEQ ID NO: 298020

SEQ ID NO: 298365 - RNA, 64 nt, Human; identical to SEQ ID NO: 298021

SEQ ID NO: 298366 - RNA, 64 nt, Human; identical to SEQ ID NO: 298022

SEQ ID NO: 298367 - RNA, 64 nt, Human; identical to SEQ ID NO: 298023

SEQ ID NO: 298368 - RNA, 64 nt, Human; identical to SEQ ID NO: 298024

SEQ ID NO: 298369 - RNA, 64 nt, Human
ggggcacagguggcggccccugcuggagcccggcugggcgcagcgccuauguaggacggguguu

SEQ ID NO: 298370 - RNA, 64 nt, Human
cagugagcugagauccugccacugcacuccagccugggcgcaagaccaagacuuaaacgcaaaa

SEQ ID NO: 298371 - RNA, 64 nt, Human
ugcauuccaucccagcuccucagcauggccucagugggcgcacccaugccucccgcaguccagg

SEQ ID NO: 298372 - RNA, 64 nt, Human
ggaccucuauccuccaggagucucagccuuucccugggcgcaggcccaccuuggcauggccgcc

SEQ ID NO: 298373 - RNA, 64 nt, Human; identical to SEQ ID NO: 298025

SEQ ID NO: 298374 - RNA, 64 nt, Human; identical to SEQ ID NO: 298026

SEQ ID NO: 298375 - RNA, 64 nt, Human; identical to SEQ ID NO: 298027

SEQ ID NO: 298376 - RNA, 64 nt, Human; identical to SEQ ID NO: 298028

SEQ ID NO: 298377 - RNA, 64 nt, Human; identical to SEQ ID NO: 298029

SEQ ID NO: 298378 - RNA, 64 nt, Human; identical to SEQ ID NO: 298030

SEQ ID NO: 298379 - RNA, 64 nt, Human; identical to SEQ ID NO: 298031

SEQ ID NO: 298380 - RNA, 64 nt, Human; identical to SEQ ID NO: 298036

SEQ ID NO: 298381 - RNA, 64 nt, Human; identical to SEQ ID NO: 298037

SEQ ID NO: 298382 - RNA, 64 nt, Human; identical to SEQ ID NO: 298038

SEQ ID NO: 298383 - RNA, 64 nt, Human; identical to SEQ ID NO: 298039

SEQ ID NO: 298384 - RNA, 64 nt, Human; identical to SEQ ID NO: 298040

SEQ ID NO: 298385 - RNA, 64 nt, Human; identical to SEQ ID NO: 298041

SEQ ID NO: 298386 - RNA, 64 nt, Human; identical to SEQ ID NO: 298042

SEQ ID NO: 298387 - RNA, 64 nt, Human; identical to SEQ ID NO: 298043

SEQ ID NO: 298388 - RNA, 64 nt, Human; identical to SEQ ID NO: 298044

SEQ ID NO: 298389 - RNA, 64 nt, Human
uucaaguaaagugauuuuuuuuaauuuaacauaaagucuucagaaagccuuucuaugaaagaau

SEQ ID NO: 298390 - RNA, 64 nt, Human; identical to SEQ ID NO: 297994

SEQ ID NO: 298391 - RNA, 64 nt, Human
aacucagucuucagagccucaauuauuaaggaaaagucuucaggaaaaauacuaaaauauuuuc

SEQ ID NO: 298392 - RNA, 64 nt, Human
auuuacacuuaaguuaucauucuuuuagaaacucagucuucagagccucaauuauuaaggaaaa

SEQ ID NO: 298393 - RNA, 64 nt, Human; identical to SEQ ID NO: 298045

SEQ ID NO: 298394 - RNA, 64 nt, Human; identical to SEQ ID NO: 298046

SEQ ID NO: 298395 - RNA, 64 nt, Human; identical to SEQ ID NO: 298047

SEQ ID NO: 298396 - RNA, 64 nt, Human; identical to SEQ ID NO: 298048

SEQ ID NO: 298397 - RNA, 64 nt, Human; identical to SEQ ID NO: 298049

SEQ ID NO: 298398 - RNA, 64 nt, Human; identical to SEQ ID NO: 298050

SEQ ID NO: 298399 - RNA, 64 nt, Human; identical to SEQ ID NO: 298051

SEQ ID NO: 298400 - RNA, 64 nt, Human; identical to SEQ ID NO: 298056

SEQ ID NO: 298401 - RNA, 64 nt, Human; identical to SEQ ID NO: 298057

SEQ ID NO: 298402 - RNA, 64 nt, Human; identical to SEQ ID NO: 298058

SEQ ID NO: 298403 - RNA, 64 nt, Human; identical to SEQ ID NO: 298059

SEQ ID NO: 298404 - RNA, 64 nt, Human; identical to SEQ ID NO: 298060

SEQ ID NO: 298405 - RNA, 64 nt, Human; identical to SEQ ID NO: 298061

SEQ ID NO: 298406 - RNA, 64 nt, Human; identical to SEQ ID NO: 298062

SEQ ID NO: 298407 - RNA, 64 nt, Human; identical to SEQ ID NO: 298063

SEQ ID NO: 298408 - RNA, 64 nt, Human; identical to SEQ ID NO: 298064

SEQ ID NO: 298409 - RNA, 64 nt, Human
aauuccaaaguuguauuugaaaguaugaccucacagucuucauuuguccauagcaaacauaugu

SEQ ID NO: 298410 - RNA, 64 nt, Human; identical to SEQ ID NO: 297583

SEQ ID NO: 298411 - RNA, 64 nt, Human; identical to SEQ ID NO: 297995

SEQ ID NO: 298412 - RNA, 64 nt, Human
ugucauguaccugccaugaacaugacaaaagguuagucuucaauagacugaaauguauaagaga

SEQ ID NO: 298413 - RNA, 64 nt, Human; identical to SEQ ID NO: 298065

SEQ ID NO: 298414 - RNA, 64 nt, Human; identical to SEQ ID NO: 298066

SEQ ID NO: 298415 - RNA, 64 nt, Human; identical to SEQ ID NO: 298067

SEQ ID NO: 298416 - RNA, 64 nt, Human; identical to SEQ ID NO: 298068

SEQ ID NO: 298417 - RNA, 64 nt, Human; identical to SEQ ID NO: 298069

SEQ ID NO: 298418 - RNA, 64 nt, Human; identical to SEQ ID NO: 298070

SEQ ID NO: 298419 - RNA, 64 nt, Human; identical to SEQ ID NO: 298071

SEQ ID NO: 298420 - RNA, 64 nt, Human; identical to SEQ ID NO: 298076

SEQ ID NO: 298421 - RNA, 64 nt, Human; identical to SEQ ID NO: 298077

SEQ ID NO: 298422 - RNA, 64 nt, Human; identical to SEQ ID NO: 298078

SEQ ID NO: 298423 - RNA, 64 nt, Human; identical to SEQ ID NO: 298079

SEQ ID NO: 298424 - RNA, 64 nt, Human; identical to SEQ ID NO: 298080

SEQ ID NO: 298425 - RNA, 64 nt, Human; identical to SEQ ID NO: 298081

SEQ ID NO: 298426 - RNA, 64 nt, Human; identical to SEQ ID NO: 298082

SEQ ID NO: 298427 - RNA, 64 nt, Human; identical to SEQ ID NO: 298083

SEQ ID NO: 298428 - RNA, 64 nt, Human; identical to SEQ ID NO: 298084

SEQ ID NO: 298429 - RNA, 64 nt, Human
uuaagagaaaugagcacgcauggaaaaguuucccagucuucagcagagaaguuuucuggagguc

SEQ ID NO: 298430 - RNA, 64 nt, Human
cccauuucuucaauaucauuuuugaggcuuuggcagucuucauuuacuaccacuuguucuuuag

SEQ ID NO: 298431 - RNA, 64 nt, Human; identical to SEQ ID NO: 298014

SEQ ID NO: 298432 - RNA, 64 nt, Human
guuuugaggcaauagagaugccuuccccuguagcagucuucagccuccucuacccuacaagauc

SEQ ID NO: 298433 - RNA, 64 nt, Human; identical to SEQ ID NO: 298085

SEQ ID NO: 298434 - RNA, 64 nt, Human; identical to SEQ ID NO: 298086

SEQ ID NO: 298435 - RNA, 64 nt, Human; identical to SEQ ID NO: 298087

SEQ ID NO: 298436 - RNA, 64 nt, Human; identical to SEQ ID NO: 298088

SEQ ID NO: 298437 - RNA, 64 nt, Human; identical to SEQ ID NO: 298089

SEQ ID NO: 298438 - RNA, 64 nt, Human; identical to SEQ ID NO: 298090

SEQ ID NO: 298439 - RNA, 64 nt, Human; identical to SEQ ID NO: 298091

SEQ ID NO: 298440 - RNA, 64 nt, Human; identical to SEQ ID NO: 298096

SEQ ID NO: 298441 - RNA, 64 nt, Human; identical to SEQ ID NO: 298097

SEQ ID NO: 298442 - RNA, 64 nt, Human; identical to SEQ ID NO: 298098

SEQ ID NO: 298443 - RNA, 64 nt, Human; identical to SEQ ID NO: 298099

SEQ ID NO: 298444 - RNA, 64 nt, Human; identical to SEQ ID NO: 298100

SEQ ID NO: 298445 - RNA, 64 nt, Human; identical to SEQ ID NO: 298101

SEQ ID NO: 298446 - RNA, 64 nt, Human; identical to SEQ ID NO: 298102

SEQ ID NO: 298447 - RNA, 64 nt, Human; identical to SEQ ID NO: 298103

SEQ ID NO: 298448 - RNA, 64 nt, Human; identical to SEQ ID NO: 298104

SEQ ID NO: 298449 - RNA, 64 nt, Human
aaugcaugugccuuuauuucacaaaacauguggcugggcgcagcggcucacgccuguuauccca

SEQ ID NO: 298450 - RNA, 64 nt, Human
uaucaugcacaaaugagcagggccgcggugggagugggcgcagugcgcugcugccacugaggug

SEQ ID NO: 298451 - RNA, 64 nt, Human
gcuuguauuuacuuuucuuggcccuggccagggcugggcgcaaggcacgcagugaugggcaaac

SEQ ID NO: 298452 - RNA, 64 nt, Human
gggaagagcuuucaccuucuuuaaaacucucggcugggcgcaguggcucaugccuguaauccca

SEQ ID NO: 298453 - RNA, 64 nt, Human; identical to SEQ ID NO: 298105

SEQ ID NO: 298454 - RNA, 64 nt, Human; identical to SEQ ID NO: 298106

SEQ ID NO: 298455 - RNA, 64 nt, Human; identical to SEQ ID NO: 298107

SEQ ID NO: 298456 - RNA, 64 nt, Human; identical to SEQ ID NO: 298108

SEQ ID NO: 298457 - RNA, 64 nt, Human; identical to SEQ ID NO: 298109

SEQ ID NO: 298458 - RNA, 58 nt, Human; identical to SEQ ID NO: 297993

SEQ ID NO: 298459 - RNA, 64 nt, Human; identical to SEQ ID NO: 298110

SEQ ID NO: 298460 - RNA, 64 nt, Human; identical to SEQ ID NO: 298111

SEQ ID NO: 298461 - RNA, 64 nt, Human; identical to SEQ ID NO: 298116

SEQ ID NO: 298462 - RNA, 64 nt, Human; identical to SEQ ID NO: 298117

SEQ ID NO: 298463 - RNA, 64 nt, Human; identical to SEQ ID NO: 298118

SEQ ID NO: 298464 - RNA, 64 nt, Human; identical to SEQ ID NO: 298119

SEQ ID NO: 298465 - RNA, 64 nt, Human; identical to SEQ ID NO: 298120

SEQ ID NO: 298466 - RNA, 64 nt, Human; identical to SEQ ID NO: 298121

SEQ ID NO: 298467 - RNA, 64 nt, Human; identical to SEQ ID NO: 298122

SEQ ID NO: 298468 - RNA, 64 nt, Human; identical to SEQ ID NO: 298123

SEQ ID NO: 298469 - RNA, 64 nt, Human
ucccuccuguucuccauuaaugaacguccuacccagucuucaacucccgggucagauccugugu

SEQ ID NO: 298470 - RNA, 64 nt, Human; identical to SEQ ID NO: 297354

SEQ ID NO: 298471 - RNA, 64 nt, Human
aaccaacugaacugccaacaaaauaaaaauaaaaagucuucacuauguagcauaccuucccuug

SEQ ID NO: 298472 - RNA, 64 nt, Human
uguccucaucuauaaaaugagggacuucccuagaagucuucauggucucuuccagcccagacau

SEQ ID NO: 298473 - RNA, 64 nt, Human; identical to SEQ ID NO: 298124

SEQ ID NO: 298474 - RNA, 64 nt, Human; identical to SEQ ID NO: 298125

SEQ ID NO: 298475 - RNA, 64 nt, Human; identical to SEQ ID NO: 298126

SEQ ID NO: 298476 - RNA, 64 nt, Human; identical to SEQ ID NO: 298127

SEQ ID NO: 298477 - RNA, 64 nt, Human; identical to SEQ ID NO: 298128

SEQ ID NO: 298478 - RNA, 64 nt, Human; identical to SEQ ID NO: 298129

SEQ ID NO: 298479 - RNA, 64 nt, Human; identical to SEQ ID NO: 298130

SEQ ID NO: 298480 - RNA, 64 nt, Human; identical to SEQ ID NO: 298131

SEQ ID NO: 298481 - RNA, 64 nt, Human; identical to SEQ ID NO: 296993

SEQ ID NO: 298482 - RNA, 64 nt, Human; identical to SEQ ID NO: 296994

SEQ ID NO: 298483 - RNA, 64 nt, Human; identical to SEQ ID NO: 296995

SEQ ID NO: 298484 - RNA, 64 nt, Human; identical to SEQ ID NO: 296996

SEQ ID NO: 298485 - RNA, 64 nt, Human; identical to SEQ ID NO: 296997

SEQ ID NO: 298486 - RNA, 64 nt, Human; identical to SEQ ID NO: 296998

SEQ ID NO: 298487 - RNA, 64 nt, Human; identical to SEQ ID NO: 296999

SEQ ID NO: 298488 - RNA, 64 nt, Human; identical to SEQ ID NO: 297000

SEQ ID NO: 298489 - RNA, 64 nt, Human; identical to SEQ ID NO: 298015

SEQ ID NO: 298490 - RNA, 64 nt, Human
auuucaaaagaacauucuuauauuuuaucaaggaagucuucaaauuugauucuaaauagcgauu

SEQ ID NO: 298491 - RNA, 64 nt, Human
aagagaagccacagaugagugggccagcgaggccagucuucaauguccacuaauucacucuaag

SEQ ID NO: 298492 - RNA, 64 nt, Human
uuaauauuaagcacaucagaacgugaauugccaaagucuucauuagaaggcagcauuuuuccuc

SEQ ID NO: 298493 - RNA, 64 nt, Human; identical to SEQ ID NO: 297001

SEQ ID NO: 298494 - RNA, 64 nt, Human; identical to SEQ ID NO: 297002

SEQ ID NO: 298495 - RNA, 64 nt, Human; identical to SEQ ID NO: 297003

SEQ ID NO: 298496 - RNA, 64 nt, Human; identical to SEQ ID NO: 297004

SEQ ID NO: 298497 - RNA, 64 nt, Human; identical to SEQ ID NO: 297005

SEQ ID NO: 298498 - RNA, 64 nt, Human; identical to SEQ ID NO: 297006

SEQ ID NO: 298499 - RNA, 64 nt, Human; identical to SEQ ID NO: 297007

SEQ ID NO: 298500 - RNA, 64 nt, Human; identical to SEQ ID NO: 298136

SEQ ID NO: 298501 - RNA, 64 nt, Human; identical to SEQ ID NO: 298157

SEQ ID NO: 298502 - RNA, 64 nt, Human; identical to SEQ ID NO: 298158

SEQ ID NO: 298503 - RNA, 64 nt, Human; identical to SEQ ID NO: 298159

SEQ ID NO: 298504 - RNA, 64 nt, Human; identical to SEQ ID NO: 298160

SEQ ID NO: 298505 - RNA, 64 nt, Human; identical to SEQ ID NO: 298161

SEQ ID NO: 298506 - RNA, 64 nt, Human; identical to SEQ ID NO: 298162

SEQ ID NO: 298507 - RNA, 64 nt, Human; identical to SEQ ID NO: 298163

SEQ ID NO: 298508 - RNA, 64 nt, Human; identical to SEQ ID NO: 298164

SEQ ID NO: 298509 - RNA, 64 nt, Human
ccuggcgauaucacuuuaacuuucugaaccucagagucuucaccuauaagacggggaaaauaau

SEQ ID NO: 298510 - RNA, 64 nt, Human
gacaaagcuucagcuuugguuuuuguauuuuuuuagucuucauaacagcuacauuucuguugcu

SEQ ID NO: 298511 - RNA, 64 nt, Human
uacaacuccacuugauuuaguugaucaccaucucagucuucaaaagauaacaucaugaggugug

SEQ ID NO: 298512 - RNA, 64 nt, Human
ugcucuggaagaauuaggaggcagccauaauaagagucuucagagagaugaugggaggggccag

SEQ ID NO: 298513 - RNA, 64 nt, Human; identical to SEQ ID NO: 298165

SEQ ID NO: 298514 - RNA, 64 nt, Human; identical to SEQ ID NO: 298166

SEQ ID NO: 298515 - RNA, 64 nt, Human; identical to SEQ ID NO: 298167

SEQ ID NO: 298516 - RNA, 64 nt, Human; identical to SEQ ID NO: 298168

SEQ ID NO: 298517 - RNA, 64 nt, Human; identical to SEQ ID NO: 298169

SEQ ID NO: 298518 - RNA, 64 nt, Human; identical to SEQ ID NO: 298170

SEQ ID NO: 298519 - RNA, 64 nt, Human; identical to SEQ ID NO: 298171

SEQ ID NO: 298520 - RNA, 64 nt, Human; identical to SEQ ID NO: 298172

SEQ ID NO: 298521 - RNA, 64 nt, Human; identical to SEQ ID NO: 298177

SEQ ID NO: 298522 - RNA, 64 nt, Human; identical to SEQ ID NO: 298178

SEQ ID NO: 298523 - RNA, 64 nt, Human; identical to SEQ ID NO: 298179

SEQ ID NO: 298524 - RNA, 64 nt, Human; identical to SEQ ID NO: 298180

SEQ ID NO: 298525 - RNA, 64 nt, Human; identical to SEQ ID NO: 298181

SEQ ID NO: 298526 - RNA, 64 nt, Human; identical to SEQ ID NO: 298182

SEQ ID NO: 298527 - RNA, 64 nt, Human; identical to SEQ ID NO: 298183

SEQ ID NO: 298528 - RNA, 64 nt, Human; identical to SEQ ID NO: 298184

SEQ ID NO: 298529 - RNA, 64 nt, Human; identical to SEQ ID NO: 296951

SEQ ID NO: 298530 - RNA, 64 nt, Human
cauucacucuggcugcugggacaucagaaaacaaagucuucaucucucucuccaguuucaccca

SEQ ID NO: 298531 - RNA, 64 nt, Human
cugcagaaauccagaagcauccuuaaugcuucucagucuucagccagagggagggcuguuauuu

SEQ ID NO: 298532 - RNA, 64 nt, Human
augcaugcaucacagacuguauuugauugauucgagucuucaaauauuguuuaauggaaugaug

SEQ ID NO: 298533 - RNA, 64 nt, Human; identical to SEQ ID NO: 298185

SEQ ID NO: 298534 - RNA, 64 nt, Human; identical to SEQ ID NO: 298186

SEQ ID NO: 298535 - RNA, 64 nt, Human; identical to SEQ ID NO: 298187

SEQ ID NO: 298536 - RNA, 64 nt, Human; identical to SEQ ID NO: 298188

SEQ ID NO: 298537 - RNA, 64 nt, Human; identical to SEQ ID NO: 298189

SEQ ID NO: 298538 - RNA, 64 nt, Human; identical to SEQ ID NO: 298190

SEQ ID NO: 298539 - RNA, 64 nt, Human; identical to SEQ ID NO: 298191

SEQ ID NO: 298540 - RNA, 64 nt, Human; identical to SEQ ID NO: 298192

SEQ ID NO: 298541 - RNA, 64 nt, Human; identical to SEQ ID NO: 298197

SEQ ID NO: 298542 - RNA, 64 nt, Human; identical to SEQ ID NO: 298198

SEQ ID NO: 298543 - RNA, 64 nt, Human; identical to SEQ ID NO: 298199

SEQ ID NO: 298544 - RNA, 64 nt, Human; identical to SEQ ID NO: 298200

SEQ ID NO: 298545 - RNA, 64 nt, Human; identical to SEQ ID NO: 298201

SEQ ID NO: 298546 - RNA, 64 nt, Human; identical to SEQ ID NO: 298202

SEQ ID NO: 298547 - RNA, 64 nt, Human; identical to SEQ ID NO: 298203

SEQ ID NO: 298548 - RNA, 64 nt, Human; identical to SEQ ID NO: 298204

SEQ ID NO: 298549 - RNA, 64 nt, Human
gguuugaguuacucugucauauaacauguagaucagucuucaugugaccugcaguauuuuuuuu

SEQ ID NO: 298550 - RNA, 64 nt, Human; identical to SEQ ID NO: 296952

SEQ ID NO: 298551 - RNA, 64 nt, Human
auaaucagauuacacaaaaucuaggcagugaacaagucuucauccuggcccaggaaauagccua

SEQ ID NO: 298552 - RNA, 64 nt, Human
cucucccgagcgccccaucuugugccauguuuuaagucuucauggauguucugcaugucauggg

SEQ ID NO: 298553 - RNA, 64 nt, Human; identical to SEQ ID NO: 298205

SEQ ID NO: 298554 - RNA, 64 nt, Human; identical to SEQ ID NO: 298206

SEQ ID NO: 298555 - RNA, 64 nt, Human; identical to SEQ ID NO: 298207

SEQ ID NO: 298556 - RNA, 64 nt, Human; identical to SEQ ID NO: 298208

SEQ ID NO: 298557 - RNA, 64 nt, Human; identical to SEQ ID NO: 298209

SEQ ID NO: 298558 - RNA, 64 nt, Human; identical to SEQ ID NO: 298210

SEQ ID NO: 298559 - RNA, 64 nt, Human; identical to SEQ ID NO: 298211

SEQ ID NO: 298560 - RNA, 64 nt, Human; identical to SEQ ID NO: 298212

SEQ ID NO: 298561 - RNA, 64 nt, Human; identical to SEQ ID NO: 298217

SEQ ID NO: 298562 - RNA, 64 nt, Human; identical to SEQ ID NO: 298218

SEQ ID NO: 298563 - RNA, 64 nt, Human; identical to SEQ ID NO: 298219

SEQ ID NO: 298564 - RNA, 64 nt, Human; identical to SEQ ID NO: 298220

SEQ ID NO: 298565 - RNA, 64 nt, Human; identical to SEQ ID NO: 298221

SEQ ID NO: 298566 - RNA, 64 nt, Human; identical to SEQ ID NO: 298222

SEQ ID NO: 298567 - RNA, 64 nt, Human; identical to SEQ ID NO: 298223

SEQ ID NO: 298568 - RNA, 64 nt, Human; identical to SEQ ID NO: 298224

SEQ ID NO: 298569 - RNA, 64 nt, Human
gaagcagugugauccagggauuacuggccuccagagucuucaagauccugagaacuuggaauuc

SEQ ID NO: 298570 - RNA, 64 nt, Human
aaauuaaauaacugaaauuguggugagacgucauagucuucaugagaacgugggggugaauuuc

SEQ ID NO: 298571 - RNA, 64 nt, Human; identical to SEQ ID NO: 297008

SEQ ID NO: 298572 - RNA, 64 nt, Human
uuccccacuccuucuuuauugcacacaggacaccagucuucaaggaaagggacuuuuuuccagu

SEQ ID NO: 298573 - RNA, 64 nt, Human; identical to SEQ ID NO: 298225

SEQ ID NO: 298574 - RNA, 64 nt, Human; identical to SEQ ID NO: 298226

SEQ ID NO: 298575 - RNA, 64 nt, Human; identical to SEQ ID NO: 298227

SEQ ID NO: 298576 - RNA, 64 nt, Human; identical to SEQ ID NO: 298228

SEQ ID NO: 298577 - RNA, 64 nt, Human; identical to SEQ ID NO: 298229

SEQ ID NO: 298578 - RNA, 64 nt, Human; identical to SEQ ID NO: 298230

SEQ ID NO: 298579 - RNA, 64 nt, Human; identical to SEQ ID NO: 298231

SEQ ID NO: 298580 - RNA, 64 nt, Human; identical to SEQ ID NO: 298232

SEQ ID NO: 298581 - RNA, 64 nt, Human; identical to SEQ ID NO: 298237

SEQ ID NO: 298582 - RNA, 64 nt, Human; identical to SEQ ID NO: 298238

SEQ ID NO: 298583 - RNA, 64 nt, Human; identical to SEQ ID NO: 298239

SEQ ID NO: 298584 - RNA, 64 nt, Human; identical to SEQ ID NO: 298240

SEQ ID NO: 298585 - RNA, 64 nt, Human; identical to SEQ ID NO: 298241

SEQ ID NO: 298586 - RNA, 64 nt, Human; identical to SEQ ID NO: 298242

SEQ ID NO: 298587 - RNA, 64 nt, Human; identical to SEQ ID NO: 298243

SEQ ID NO: 298588 - RNA, 64 nt, Human; identical to SEQ ID NO: 298244

SEQ ID NO: 298589 - RNA, 64 nt, Human; identical to SEQ ID NO: 297009

SEQ ID NO: 298590 - RNA, 64 nt, Human
aaaaagacaauuccuuauugucugaauguaauacagucuucauuguacuauucaacccuuuguu

SEQ ID NO: 298591 - RNA, 64 nt, Human
ugccccuaaugcagcauauuuuucuuaccaaaggagucuucagcccuauaaaaggauuccucua

SEQ ID NO: 298592 - RNA, 64 nt, Human
uccaauauaaaggcagggaaauuugacugcauggagucuucagguagaaauguuucucuugccu

SEQ ID NO: 298593 - RNA, 64 nt, Human; identical to SEQ ID NO: 298245

SEQ ID NO: 298594 - RNA, 64 nt, Human; identical to SEQ ID NO: 298246

SEQ ID NO: 298595 - RNA, 64 nt, Human; identical to SEQ ID NO: 298247

SEQ ID NO: 298596 - RNA, 64 nt, Human; identical to SEQ ID NO: 298248

SEQ ID NO: 298597 - RNA, 64 nt, Human; identical to SEQ ID NO: 298249

SEQ ID NO: 298598 - RNA, 64 nt, Human; identical to SEQ ID NO: 298250

SEQ ID NO: 298599 - RNA, 64 nt, Human; identical to SEQ ID NO: 298251

SEQ ID NO: 298600 - RNA, 64 nt, Human; identical to SEQ ID NO: 298252

SEQ ID NO: 298601 - RNA, 64 nt, Human; identical to SEQ ID NO: 298257

SEQ ID NO: 298602 - RNA, 64 nt, Human; identical to SEQ ID NO: 298258

SEQ ID NO: 298603 - RNA, 64 nt, Human; identical to SEQ ID NO: 298259

SEQ ID NO: 298604 - RNA, 64 nt, Human; identical to SEQ ID NO: 298260

SEQ ID NO: 298605 - RNA, 64 nt, Human; identical to SEQ ID NO: 298261

SEQ ID NO: 298606 - RNA, 64 nt, Human; identical to SEQ ID NO: 298262

SEQ ID NO: 298607 - RNA, 64 nt, Human; identical to SEQ ID NO: 298263

SEQ ID NO: 298608 - RNA, 64 nt, Human; identical to SEQ ID NO: 298264

SEQ ID NO: 298609 - RNA, 64 nt, Human
aaguaaauuugucacucuagcauuuugaaugaauagucuucacuuuuuaaauuauucaucuucu

SEQ ID NO: 298610 - RNA, 64 nt, Human; identical to SEQ ID NO: 296932

SEQ ID NO: 298611 - RNA, 64 nt, Human
ugcagagaguauugaauguaaaucagagcucucuagucuucauuaaggcagcaaguccuggguu

SEQ ID NO: 298612 - RNA, 64 nt, Human
cacuucaccuuaaugggucuugucuaucuucauuagucuucaaagaaaaaccauuugcuaccaa

SEQ ID NO: 298613 - RNA, 64 nt, Human; identical to SEQ ID NO: 298265

SEQ ID NO: 298614 - RNA, 64 nt, Human; identical to SEQ ID NO: 298266

SEQ ID NO: 298615 - RNA, 64 nt, Human; identical to SEQ ID NO: 298267

SEQ ID NO: 298616 - RNA, 64 nt, Human; identical to SEQ ID NO: 298268

SEQ ID NO: 298617 - RNA, 64 nt, Human; identical to SEQ ID NO: 298269

SEQ ID NO: 298618 - RNA, 64 nt, Human; identical to SEQ ID NO: 298270

SEQ ID NO: 298619 - RNA, 64 nt, Human; identical to SEQ ID NO: 298271

SEQ ID NO: 298620 - RNA, 64 nt, Human; identical to SEQ ID NO: 298272

SEQ ID NO: 298621 - RNA, 64 nt, Human; identical to SEQ ID NO: 298277

SEQ ID NO: 298622 - RNA, 64 nt, Human; identical to SEQ ID NO: 298278

SEQ ID NO: 298623 - RNA, 64 nt, Human; identical to SEQ ID NO: 298279

SEQ ID NO: 298624 - RNA, 64 nt, Human; identical to SEQ ID NO: 298280

SEQ ID NO: 298625 - RNA, 64 nt, Human; identical to SEQ ID NO: 298281

SEQ ID NO: 298626 - RNA, 63 nt, Human; identical to SEQ ID NO: 298282

SEQ ID NO: 298627 - RNA, 64 nt, Human; identical to SEQ ID NO: 298283

SEQ ID NO: 298628 - RNA, 64 nt, Human; identical to SEQ ID NO: 298284

SEQ ID NO: 298629 - RNA, 64 nt, Human
gaguuguaggguuaccccuuugacaagcuuccauagucuucagacacgcacauugauggcaucc

SEQ ID NO: 298630 - RNA, 64 nt, Human
cucacaaagggcuagccuugaaugucacucgcccagucuucagucuccugacuuagagauacaa

SEQ ID NO: 298631 - RNA, 64 nt, Human; identical to SEQ ID NO: 297011

SEQ ID NO: 298632 - RNA, 64 nt, Human
ccaucuuggaagcagauccuccagccuccagucaagucuucagauaauugcaacuucaguugau

SEQ ID NO: 298633 - RNA, 64 nt, Human; identical to SEQ ID NO: 298285

SEQ ID NO: 298634 - RNA, 64 nt, Human; identical to SEQ ID NO: 298286

SEQ ID NO: 298635 - RNA, 64 nt, Human; identical to SEQ ID NO: 298287

SEQ ID NO: 298636 - RNA, 64 nt, Human; identical to SEQ ID NO: 298288

SEQ ID NO: 298637 - RNA, 64 nt, Human; identical to SEQ ID NO: 298289

SEQ ID NO: 298638 - RNA, 64 nt, Human; identical to SEQ ID NO: 298290

SEQ ID NO: 298639 - RNA, 64 nt, Human; identical to SEQ ID NO: 298291

SEQ ID NO: 298640 - RNA, 64 nt, Human; identical to SEQ ID NO: 298292

SEQ ID NO: 298641 - RNA, 64 nt, Human; identical to SEQ ID NO: 298297

SEQ ID NO: 298642 - RNA, 64 nt, Human; identical to SEQ ID NO: 298298

SEQ ID NO: 298643 - RNA, 64 nt, Human; identical to SEQ ID NO: 298299

SEQ ID NO: 298644 - RNA, 64 nt, Human; identical to SEQ ID NO: 298300

SEQ ID NO: 298645 - RNA, 64 nt, Human; identical to SEQ ID NO: 298301

SEQ ID NO: 298646 - RNA, 64 nt, Human; identical to SEQ ID NO: 298302

SEQ ID NO: 298647 - RNA, 64 nt, Human; identical to SEQ ID NO: 298303

SEQ ID NO: 298648 - RNA, 64 nt, Human; identical to SEQ ID NO: 298304

SEQ ID NO: 298649 - RNA, 64 nt, Human; identical to SEQ ID NO: 298032

SEQ ID NO: 298650 - RNA, 64 nt, Human
uucuugaaaguuuuaacuaagugagaaauaagguagucuucaaaaucuuggucaucuguuugga

SEQ ID NO: 298651 - RNA, 64 nt, Human
aaagcaguuucuaggaaauguuuaaauaaaagagagucuucaccuuaaagaaaccuauggagca

SEQ ID NO: 298652 - RNA, 64 nt, Human
gaguucuccuacaggaagcagaugagaacugcccagucuucagguuuaggccauuggucuuuga

SEQ ID NO: 298653 - RNA, 64 nt, Human; identical to SEQ ID NO: 298305

SEQ ID NO: 298654 - RNA, 64 nt, Human; identical to SEQ ID NO: 298306

SEQ ID NO: 298655 - RNA, 64 nt, Human; identical to SEQ ID NO: 298307

SEQ ID NO: 298656 - RNA, 64 nt, Human; identical to SEQ ID NO: 298308

SEQ ID NO: 298657 - RNA, 64 nt, Human; identical to SEQ ID NO: 298309

SEQ ID NO: 298658 - RNA, 64 nt, Human; identical to SEQ ID NO: 298310

SEQ ID NO: 298659 - RNA, 64 nt, Human; identical to SEQ ID NO: 298311

SEQ ID NO: 298660 - RNA, 64 nt, Human; identical to SEQ ID NO: 298312

SEQ ID NO: 298661 - RNA, 64 nt, Human; identical to SEQ ID NO: 298314

SEQ ID NO: 298662 - RNA, 64 nt, Human; identical to SEQ ID NO: 298315

SEQ ID NO: 298663 - RNA, 64 nt, Human; identical to SEQ ID NO: 298316

SEQ ID NO: 298664 - RNA, 64 nt, Human; identical to SEQ ID NO: 298317

SEQ ID NO: 298665 - RNA, 64 nt, Human; identical to SEQ ID NO: 298318

SEQ ID NO: 298666 - RNA, 50 nt, Human; identical to SEQ ID NO: 298319

SEQ ID NO: 298667 - RNA, 64 nt, Human; identical to SEQ ID NO: 298320

SEQ ID NO: 298668 - RNA, 64 nt, Human; identical to SEQ ID NO: 298321

SEQ ID NO: 298669 - RNA, 64 nt, Human
cucgcaagcaaaaaaucucaugaccucauauuugagucuucauuuucaucaucuacuuguucua

SEQ ID NO: 298670 - RNA, 64 nt, Human
gggauaagcuucuccuugacaauggaaaggcagcagucuucaacauuugguugcaaaucuccau

SEQ ID NO: 298671 - RNA, 64 nt, Human
uuccagaagguuuauucuguauaaacuacauguuagucuucaguagaguaucuuuuuuuuuucc

SEQ ID NO: 298672 - RNA, 64 nt, Human; identical to SEQ ID NO: 297279

SEQ ID NO: 298673 - RNA, 64 nt, Human; identical to SEQ ID NO: 298322

SEQ ID NO: 298674 - RNA, 64 nt, Human; identical to SEQ ID NO: 298323

SEQ ID NO: 298675 - RNA, 64 nt, Human
caaaacagauaaucauaagaugaaucaguauguagcuuaacaccauccacucacuccaacaaag

SEQ ID NO: 298676 - RNA, 64 nt, Human
gauaagccuggggcuacuguugcugggaacuuaggcuuaacauaaagccgaagaagguaccuag

SEQ ID NO: 298677 - RNA, 64 nt, Human
gggagagaggcgcugggaagauggcuggugaggagcuuaacagaggaaccucaagaagauucug

SEQ ID NO: 298678 - RNA, 64 nt, Human
uuuuaaacauagauuauauuccucaagaugaagggcuuaacauauccacagcuuccucaguuug

SEQ ID NO: 298679 - RNA, 64 nt, Human
uguaauuccaaaacuuaagaaccauauuuacauugcuuaacacagaauuuuacaucuaagcaag

SEQ ID NO: 298680 - RNA, 64 nt, Human
uguucaaacugagguggaaugcagugguucccaugcuuaacaaaucauuaaaacacccuagaac

SEQ ID NO: 298681 - RNA, 64 nt, Human
ugugcaucugcuugucaggaagagucacauugcugcuuaacaugcuggauugcccuagucuuca

SEQ ID NO: 298682 - RNA, 64 nt, Human
uugcccaccugaggaggaacucagucaagcuguugcuuaacagcuugauccagggcgugaaagg

SEQ ID NO: 298683 - RNA, 64 nt, Human
ugaugaagcuaacacuugaauuuucugaagucuagcuuaacaucuuugguuuuccuacucuaca

SEQ ID NO: 298684 - RNA, 64 nt, Human
cacuuuuuagagcggcgucuuaguuuauuuaaacgcuuaacaucuuccaccgcaacagcuugcc

SEQ ID NO: 298685 - RNA, 64 nt, Human
uguaauauagaaaacugucccuuuccaggugggagcuuaacaccuguauaaaaccuaagguuuu

SEQ ID NO: 298686 - RNA, 64 nt, Human
gcaguauaguccaugauaucuaaggaguuggcaagcuuaacaaaacccauuuuuuauaaauguc

SEQ ID NO: 298687 - RNA, 64 nt, Human
cacucucgaugcuacuuacagaggacaucuguaaagucuucauaaaagaccuugaaugaugccu

SEQ ID NO: 298688 - RNA, 64 nt, Human
ucuacagaacagcccuggcacugcauucaaauccagucuucauucagcugggaucaaaaugcca

SEQ ID NO: 298689 - RNA, 64 nt, Human
aacaaggggugcuccaggaagaaagaguccccccagucuucauucgcaguuuaugguuucauag

SEQ ID NO: 298690 - RNA, 64 nt, Human
uccuaauuccacagcugcucaauaaaguacaagagcuuaacaguguguuggcgcuuugcuuugg

SEQ ID NO: 298691 - RNA, 64 nt, Human
ggccucucaucacugcuuuucucaagcuucuucagcuuaacaaccccuucccuaacagguuggg

SEQ ID NO: 298692 - RNA, 64 nt, Human
cucgggagaccccuaaugaggaaguugagguaaugcuuaacauuguugcugugagaauuuacug

SEQ ID NO: 298693 - RNA, 64 nt, Human
aaugaaaauauuuauauaaaaauacauuuauucugcuuaacacaaauuaaaacugacauaaaau

SEQ ID NO: 298694 - RNA, 64 nt, Human
uuguuaaauuaaaauuuuuuuuuuuacuuggauggcuuaacauuuuugcaagaaaaauaggaag

SEQ ID NO: 298695 - RNA, 64 nt, Human
caaaucucaauucuugacuucugugcaccugcaggcuuaacagcacauagaagcugccaaggcu

SEQ ID NO: 298696 - RNA, 64 nt, Human
uaaauaagaguguuauuaaugauuaugaacuuuugcuuaacaaaauaacauacgacgagagcuu

SEQ ID NO: 298697 - RNA, 64 nt, Human
uuguuuauaaaacaaugacuuuuaaagauuuagugcuuaacauuuucccaagugugggaacauu

SEQ ID NO: 298698 - RNA, 54 nt, Human
gagugguggauuuguauuaaaauagcuuaacacuaccaauuucccauuuuggaa

SEQ ID NO: 298699 - RNA, 64 nt, Human
uagugauaaaccaucugcucaucguaaguguaaggcuuaacaaauaaguaauacaugcuauauu

SEQ ID NO: 298700 - RNA, 64 nt, Human
uuuuuuguuguuguauuaaaccauguacguugcagcuuaacaauaaaaaaaaaucuaugaaucu

SEQ ID NO: 298701 - RNA, 64 nt, Human
gggugguugaacuucacacacguaaggucuuagugcuuaacaguuuaaaggaaaguccuuguug

SEQ ID NO: 298702 - RNA, 64 nt, Human
cuccaaacaccucucuguuguaauaugguaggaugcuuaacagaaucaaguacuuuuccccucu

SEQ ID NO: 298703 - RNA, 64 nt, Human
augagaaguuaaaaugaaugugucaugagaaugggcuuaacacaucguugguuugaaaacuucc

SEQ ID NO: 298704 - RNA, 64 nt, Human
aaucuauucucagcagggcauagggcacgcacuggcuuaacaguuuaguauauaaggcucaaau

SEQ ID NO: 298705 - RNA, 64 nt, Human
uguaucuugugauauauggguuuuaacaaauucuagucuucacgcugagagagcacuacuugag

SEQ ID NO: 298706 - RNA, 64 nt, Human
aauguaacaaaucacuuucaaaggaguucccagaagucuucagaaagacuaaaauucugucucu

SEQ ID NO: 298707 - RNA, 64 nt, Human; identical to SEQ ID NO: 297010

SEQ ID NO: 298708 - RNA, 64 nt, Human
gaugauuuuuuuuuaaaucacaaaaugugauuaugcuuaacagcuguuuccuguuucucuuaaa

SEQ ID NO: 298709 - RNA, 64 nt, Human
guaaaaaaacaaaaacaggcaaauaaauaaacaugcuuaacaugucuuuguguugcuguuuugu

SEQ ID NO: 298710 - RNA, 64 nt, Human
cuugucagagcucuucuauaaccucgcucuaauggcuuaacaguuguucuggguggaaacgucc

SEQ ID NO: 298711 - RNA, 64 nt, Human
aucaggagugaaagauuuuaaagcagccuccgaagcuuaacaaaugagcauuccaagcucaguu

SEQ ID NO: 298712 - RNA, 64 nt, Human
uaaaacagaguuguauuuuuugauauuuaacaaugcuuaacacuuuaaaugccacuucugagga

SEQ ID NO: 298713 - RNA, 64 nt, Human
cuuuucuuacgaaaagucaauaauuaagcaaauugcuuaacacuugguuccaguuccugccuau

SEQ ID NO: 298714 - RNA, 64 nt, Human
guuuucaucuacugacuucuuucucauuagguaggcuuaacaacuuacuugagaauuuugcaac

SEQ ID NO: 298715 - RNA, 64 nt, Human
uguucucuaaaauccugugaacaugacuuaaccagcuuaacaucaucaguaguacugccuagau

SEQ ID NO: 298716 - RNA, 64 nt, Human
auaauguccauccugucgugaugugauaggagcagcuuaacaggcagggagaagcgccuccaac

SEQ ID NO: 298717 - RNA, 64 nt, Human
ugacaaauucuuuuucacacugauguagauaacagcuuaacauuuacauaguucuuacuacuug

SEQ ID NO: 298718 - RNA, 64 nt, Human
ccuucagcaccuuuagcugcauuuguaugccagugcuuaacacauugccuuauucauacuagca

SEQ ID NO: 298719 - RNA, 64 nt, Human
guauaauuaugacuuacuaguauuuuugaacaaugcuuaacauacuaaccuuacauacacucua

SEQ ID NO: 298720 - RNA, 64 nt, Human
guauaauuuugacuuacuaguauuuuugaacaaugcuuaacauacuaaccuuacauacacucua

SEQ ID NO: 298721 - RNA, 64 nt, Human
caaaagugauuagaacuaagaugcaggggaaauugcuuaacauuuucagauaucagauaacugc

SEQ ID NO: 298722 - RNA, 64 nt, Human
gauuggcaaaaagcaagauauaagagauucauuugcuuaacauuucuacauaauauuuaugguc

SEQ ID NO: 298723 - RNA, 64 nt, Human
aacugccaucuggcaucuuccuuccuugauuuuaagucuucagcuucuuggccaacuuaguuug

SEQ ID NO: 298724 - RNA, 64 nt, Human
auccgugaaugcgcugaucguuucuuccaguuagagucuucaucuguccgacaaguucacucgc

SEQ ID NO: 298725 - RNA, 64 nt, Human; identical to SEQ ID NO: 297280

SEQ ID NO: 298726 - RNA, 64 nt, Human
ugaaauuuuuaucugagauugggauguggauuaugcuuaacagugagagcugaaaugagaccau

SEQ ID NO: 298727 - RNA, 64 nt, Human
uguuuauacaaagaauccuuauuucagucuagcagcuuaacaacaaaggauaaaucagacuaua

SEQ ID NO: 298728 - RNA, 64 nt, Human
aagagccaaguuaaaaauaauuggcuagcaacaggcuuaacacugauucuuauuguauuacaaa

SEQ ID NO: 298729 - RNA, 64 nt, Human
ccuggagcaauugagaggacuguuuaaacacagagcuuaacaauggcagaauuguauaucucgu

SEQ ID NO: 298730 - RNA, 64 nt, Human
cagagcuuaacaauggcagaauuguauaucucgugcuuaacagauuuugguugaacuuuacccu

SEQ ID NO: 298731 - RNA, 64 nt, Human
uuuuccacuccuauggaaaagggucuucuuggcagcuuaacauugacuucuugguuuggggaga

SEQ ID NO: 298732 - RNA, 64 nt, Human
gacugaagguccuaauugcucacccaagggggcugcuuaacacaaacagccucagacccgaggu

SEQ ID NO: 298733 - RNA, 64 nt, Human
auaaaaggaauacuccuuuuccuuuuggaucauagcuuaacaaggcacaggaagggaagggauc

SEQ ID NO: 298734 - RNA, 64 nt, Human
caucauucacuucacugugcuguuguuaugaugugcuuaacagggaacgugauuagugaaagga

SEQ ID NO: 298735 - RNA, 64 nt, Human
ugcucucagcaaguggacagugauaccguuuacagcuuaacaccuuugugaaucccacgccauu

SEQ ID NO: 298736 - RNA, 64 nt, Human
aaaaaaaggacacagaucaaaaaaacacccaaaggcuuaacagaacauggaaaguucccacuaa

SEQ ID NO: 298737 - RNA, 64 nt, Human
auuuuaauuuaaaagaaagaucaauuauauccaugcuuaacaggaucagcaggagcuuuauaaa

SEQ ID NO: 298738 - RNA, 64 nt, Human
cacuuaaaauaucagauaaauacagucaugcaucgcuuaacaacggggauacagucuaagaauu

SEQ ID NO: 298739 - RNA, 64 nt, Human
caagucugugucccaucagacuugcagccuuucagcuuaacaguugcccgguccugcuggcccc

SEQ ID NO: 298740 - RNA, 64 nt, Human
guaucaaauacuguguuaauacuuaaucaagcaggcuuaacacuguguacauauugucaguagu

SEQ ID NO: 298741 - RNA, 64 nt, Human
ucuucauuuuaucuuuuagaguuaugcccagccaagucuucaguauauccaggggcaacagauu

SEQ ID NO: 298742 - RNA, 64 nt, Human
gaaauucaaaucugaaagucauagugcugaauuaagucuucacaaacaacacauaaagauccag

SEQ ID NO: 298743 - RNA, 64 nt, Human
agcauaccuccaaaauccgagaagagcaaaucagagucuucaaaauggaucaccacuaagggca

SEQ ID NO: 298744 - RNA, 64 nt, Human
uuuuuuuauuagcagcgugauuuguauaucgauggcuuaacauauacaacagcauuucuucucc

SEQ ID NO: 298745 - RNA, 64 nt, Human
gggcugacuaggcaugauuuuuuuggucuuaaaagcuuaacauguaaaauuggcaaaaaaaauu

SEQ ID NO: 298746 - RNA, 64 nt, Human
cacuuggauuuuuuuuuuuguuuuuuuuuuuuuugcuuaacaguuuuagaauacauuguacuua

SEQ ID NO: 298747 - RNA, 64 nt, Human
cagguuuugcuaugugcucacauuucaacuuuaugcuuaacaugaauggaaaaauaugaaagua

SEQ ID NO: 298748 - RNA, 64 nt, Human
gcuuuaaaagcuagagaucucagagaaauagcuggcuuaacaaugacagaacagcuuaaaauuu

SEQ ID NO: 298749 - RNA, 64 nt, Human
uugugucagugcccaaaggagguagguugauggugcuuaacaaacaugaaguaugguguaauag

SEQ ID NO: 298750 - RNA, 64 nt, Human
aaaacuggccugguuugccuuuuuuaucaagagagcuuaacagauaaaaaaugaaauuagucua

SEQ ID NO: 298751 - RNA, 64 nt, Human
aaaacagaagucaugaauguaaauugaaugagaggcuuaacaugcaugaaaauacagauggacc

SEQ ID NO: 298752 - RNA, 64 nt, Human
uccuguuuucaugucuuugcuucaucuggaauuggcuuaacacccuuuuauaaaguuuguguuu

SEQ ID NO: 298753 - RNA, 64 nt, Human
cggcagcuucucugaugggaaaguuccuuuuuuggcuuaacacucacccuuucuucacacucac

SEQ ID NO: 298754 - RNA, 64 nt, Human
cauugugagauaaggacagugucaaagugauaaagcuuaacacuugaccuaaacuucuauuuuc

SEQ ID NO: 298755 - RNA, 64 nt, Human
cugcuguaucuaacccaguuggauuuucuuucaugcuuaacacaguagugaaaauagaagguag

SEQ ID NO: 298756 - RNA, 64 nt, Human
uagucuguacuucaguucucaucuuguaaauaaugcuuaacauaaacuuguacuuacacugaaa

SEQ ID NO: 298757 - RNA, 64 nt, Human
caagauggcaggggccggagugagggggcugcuggcuuaacagcaggcaucugggcaggccagu

SEQ ID NO: 298758 - RNA, 64 nt, Human
aaagugacacguacaaugugguuuauaaaaauaagcuuaacaucugagaaaauguaccaagugg

SEQ ID NO: 298759 - RNA, 64 nt, Human
guccucauacugaagacaaacuuguuucaaugauagucuucauuuuuaaaaacaaaaaggcagg

SEQ ID NO: 298760 - RNA, 64 nt, Human
cccccacaccccaucucucuucccuaauccuccaagucuucagcgagacccuugcauuagaaac

SEQ ID NO: 298761 - RNA, 64 nt, Human
agucccuauuuuucuaggaguucaucgugcagacagucuucacuacaggacucggcccuggggc

SEQ ID NO: 298762 - RNA, 64 nt, Human
aucacaacacaguaucuuuaacagugcuugagaugcuuaacagagaaggcauccagugcuucau

SEQ ID NO: 298763 - RNA, 64 nt, Human
cuggcuccgucccucccagccuucugcugcccuugcuuaacaaugccggccaacuggcgaccuc

SEQ ID NO: 298764 - RNA, 64 nt, Human
guuuuucuguaugacacaccucagaggagccugugcuuaacauuuguaggauuauuucgagggc

SEQ ID NO: 298765 - RNA, 64 nt, Human
auauguagguaaaugauuacagaaaaauuuaucugcuuaacaaacuuagaaugacuuuuuccuu

SEQ ID NO: 298766 - RNA, 64 nt, Human
uuuaauguagagaaagaaaugucugccauuugcugcuuaacaggcuuugugucagguuuuucag

SEQ ID NO: 298767 - RNA, 64 nt, Human
ccuacuaaaagucauuuguuaccuaaacuuaugugcuuaacaggcaaugcuucucagaccacaa

SEQ ID NO: 298768 - RNA, 64 nt, Human
ucaaacauugcaaaaguggguggcaauauucagugcuuaacacuuuucuagcguugguacaucu

SEQ ID NO: 298769 - RNA, 64 nt, Human
uauuuggaaugcauauagauugucuugucauugugcuuaacauuaccauaagugugucuuuucc

SEQ ID NO: 298770 - RNA, 64 nt, Human
uaccuggauaucuagcuuccuuuaccccuguucugcuuaacagaacugccaagcccagaaguac

SEQ ID NO: 298771 - RNA, 64 nt, Human
aucauggcuaagcuuaaaaaaaacucauggugaggcuuaacaaugucuuguaagcaaaagguag

SEQ ID NO: 298772 - RNA, 64 nt, Human
ucaggagccagcagggcgggccaggagaaagaaggcuuaacauuaaguauuccuuggcccagca

SEQ ID NO: 298773 - RNA, 64 nt, Human
gcaugucuuuuucaaccugucaguauccccuucugcuuaacacacccacugagaaaacccuguu

SEQ ID NO: 298774 - RNA, 64 nt, Human
uacuucaaaugguaauuguuuuguuuuuguaauagcuuaacaaauaaaccuagguuuucuauau

SEQ ID NO: 298775 - RNA, 64 nt, Human
guaaugugcaaugauguguuuuauuuuccuugaugcuuaacauuacuaacaauugcaaaaauaa

SEQ ID NO: 298776 - RNA, 64 nt, Human
ggagaagggccuucucagaagcuugaaggcucuggcuuaacagagaaagagacuaaugugucca

SEQ ID NO: 298777 - RNA, 64 nt, Human
cucaguuucccucacucaggaacucuguuucugaagucuucaguuaaguuugaguuuaugacug

SEQ ID NO: 298778 - RNA, 64 nt, Human
aaacuuaucuuaaacugacccuucccuuugagugagucuucauuccucucccaugugggaaccc

SEQ ID NO: 298779 - RNA, 64 nt, Human
aagggauaugugaaacaauguuaacauuuuugguagucuucaaccagggauuguuucuguuuaa

SEQ ID NO: 298780 - RNA, 64 nt, Human
caaauggucaggugauauucuugauugaaaaguugcuuaacauuucaguaauauaauuuuaauu

SEQ ID NO: 298781 - RNA, 64 nt, Human
ccuuugguccaguaggaggugcccuucacucuaagcuuaacacuuaguagggaagagauucuca

SEQ ID NO: 298782 - RNA, 64 nt, Human
uuagugaaaaacugcuguaaacacaggggacacagcuuaacaaugcaacuuuuaauuacuguuu

SEQ ID NO: 298783 - RNA, 64 nt, Human
caaugcauauacuauauacagccaguaaauacaugcuuaacaaaaggaaugagccugaaguuca

SEQ ID NO: 298784 - RNA, 64 nt, Human
gggcagucuuguaguuuaaaauauauuucuaaaagcuuaacaguucguuuucaacuaaauugug

SEQ ID NO: 298785 - RNA, 64 nt, Human
acgugaaaagugccauuuuuagaauaacuuuaaagcuuaacagguuuccuuuuaauauccuuuu

SEQ ID NO: 298786 - RNA, 64 nt, Human
uuggacacauagacugaaugagaccaaaggaaaagcuuaacauacuaccucaagugaacuuuua

SEQ ID NO: 298787 - RNA, 64 nt, Human
uuuuaugacugccgggggggucagcuggagugcugcuuaacaaguaucucuccuacucucagug

SEQ ID NO: 298788 - RNA, 64 nt, Human
gagucuccaucuuaggggauuaucuuacguuuaagcuuaacauuucauguaguaagauuuggag

SEQ ID NO: 298789 - RNA, 64 nt, Human
ugaaaauaugcacuguaaaggguggggugauguggcuuaacaaucagacuucuucuauuuuugc

SEQ ID NO: 298790 - RNA, 64 nt, Human
uaucaucauaucaaauaugccaauucuaaaaagagcuuaacauuagaauaguauaugguagaau

SEQ ID NO: 298791 - RNA, 64 nt, Human
agcagcuuccaaacauauucauauugcuuaagaggcuuaacauuaccuaaacuagagacuagac

SEQ ID NO: 298792 - RNA, 64 nt, Human
ugugauuguuuguguguccccuuuccucuucuuugcuuaacacaauuaucuuguguuaaggauc

SEQ ID NO: 298793 - RNA, 64 nt, Human
ggggagagacucacuuuuguaacuaaagaacauagcuuaacauuuucccuuugaauggucacac

SEQ ID NO: 298794 - RNA, 64 nt, Human
uauugaugccauuuaaagggauggaugcaaccuagcuuaacaguauaaugcugcaaauuuuccu

SEQ ID NO: 298795 - RNA, 64 nt, Human
uuccucccuuggcccaaccagcaaagcgccccucagucuucaagggcuuuccuggaugccaccc

SEQ ID NO: 298796 - RNA, 62 nt, Human
acccccagggccacaacugaccccgagggaccagucuucauacccacggaaaguuauuggga

SEQ ID NO: 298797 - RNA, 64 nt, Human
cauucuuggacccaauccucagaugcacggauucagucuucaggggaaacucuguuuuaagggg

SEQ ID NO: 298798 - RNA, 64 nt, Human
agaagugcaacauguaugugcaaaagcuaaaauggcuuaacaucaugcuacacuuuacacuaaa

SEQ ID NO: 298799 - RNA, 64 nt, Human
aguguuuggggguucaacacacacaugcaauuuugcuuaacaaaaguauuuuauaauacaguuu

SEQ ID NO: 298800 - RNA, 64 nt, Human
gucuucacuucaagagggccacacugcaaccucagcuuaacaugaauaacaaagacuggcucag

SEQ ID NO: 298801 - RNA, 64 nt, Human
ugguaccaugcuuuaccucauuucaagaaaauaugcuuaacagagaggaaaaaaaugugguuug

SEQ ID NO: 298802 - RNA, 64 nt, Human
acaaaagaaagacauaugaaaggaauuguaauuggcuuaacagaaacagucuguaaaaaccuaa

SEQ ID NO: 298803 - RNA, 64 nt, Human
augugaaauaccuaggaagacauguauggagaaugcuuaacaaaugcucuucuccuuuuucugu

SEQ ID NO: 298804 - RNA, 64 nt, Human
gugggaggucuccaaaaagauauuaccuuauugggcuuaacaauucacaaggcacuuucacacc

SEQ ID NO: 298805 - RNA, 64 nt, Human
cacauccguggaucggacauggcugcaugugccugcuuaacagggccaacuuaguuccuacugu

SEQ ID NO: 298806 - RNA, 64 nt, Human
agaggcaauauuauuacuguuuaagugauuauuugcuuaacacagguuuuauuuugucuuuuug

SEQ ID NO: 298807 - RNA, 64 nt, Human
gcuaaagcagggggcaagguagauaaaugugagggcuuaacauagaauaugaaacaaauuggcc

SEQ ID NO: 298808 - RNA, 64 nt, Human
uugcccauucugguguaacuuaugugacucuagugcuuaacagcugccguugaagcuaauauuc

SEQ ID NO: 298809 - RNA, 64 nt, Human
ugaccaggaaacagcucaucccagagaaggagaugcuuaacaaaaaaaaauugaaauuguuucc

SEQ ID NO: 298810 - RNA, 64 nt, Human
cagugccacgcacaggugcugaccuauaguaagugcuuaacauuuguugaauaggggaaagaaa

SEQ ID NO: 298811 - RNA, 64 nt, Human
uugauaccugcacuguccugaccaucgcacaccggcuuaacacuaucauggacuacaccaggug

SEQ ID NO: 298812 - RNA, 64 nt, Human
aauagucuaaagaaccagagucacuacuauaguggcuuaacauuuaaucugucuccaauauuuu

SEQ ID NO: 298813 - RNA, 64 nt, Human
acaucaguauuaugaaaacuuguacuuuuugccaagucuucaacucuucauugagcuaucuuca

SEQ ID NO: 298814 - RNA, 64 nt, Human
caaacuuuuaugucaaauuuuuuuucuuagaaguagucuucauuauuauaaauuuguacaccaa

SEQ ID NO: 298815 - RNA, 64 nt, Human
ucauauuagacuucuguuuucaaucucguauagaagucuucaugaaaugcuaugucauuucaug

SEQ ID NO: 298816 - RNA, 64 nt, Human
ugggccagggcucauggcuggauaauuucccuaggcuuaacaacccaagcaagcuucgcguccu

SEQ ID NO: 298817 - RNA, 64 nt, Human
ugggccagggcucauggcuggauaauuucccuaggcuuaacaacccaagcaagcuucgcauccu

SEQ ID NO: 298818 - RNA, 64 nt, Human; identical to SEQ ID NO: 298817

SEQ ID NO: 298819 - RNA, 64 nt, Human
uuuggcguaaauacuugguaguuuugacaucucugcuuaacacucaagagaggcucccuaaugu

SEQ ID NO: 298820 - RNA, 64 nt, Human
agcauagcuuggucuuauuucuuacuguaugaaagcuuaacagcaaugugauuuaagguuuugu

SEQ ID NO: 298821 - RNA, 64 nt, Human
uuccugcaggagccuacccugaaaucucuucucagcuuaacauggaaaugaggaucccaccagc

SEQ ID NO: 298822 - RNA, 64 nt, Human
aucacagugccugugcccaagcaguccucacuuugcuuaacaguggccccagagagcaggagua

SEQ ID NO: 298823 - RNA, 64 nt, Human
ucuuaagguagauggugauuagcacauguaguaugcuuaacauuuaauauuauaauaagacauc

SEQ ID NO: 298824 - RNA, 64 nt, Human
ugaggguggggggucugguagaacacugcaacccgcuuaacaaauaauccugccuuuggccggg

SEQ ID NO: 298825 - RNA, 64 nt, Human
ggagucuuagcuugcaagcuuguggaaggauuuagcuuaacaacugucacuccugaaaagcaau

SEQ ID NO: 298826 - RNA, 64 nt, Human
uguauguaaaucuucauggugauugucauguaaggcuuaacacaguggguggugaguucugacu

SEQ ID NO: 298827 - RNA, 64 nt, Human
cuuacaaguuaaaaaaacagccagauuaucauuugcuuaacaaagaaaucaugcaauuaccaua

SEQ ID NO: 298828 - RNA, 64 nt, Human
gaaaucaggucugcaaaugacuagucagaaccuugcuuaacaugagauuuuaacacaacaauga

SEQ ID NO: 298829 - RNA, 64 nt, Human
gagcccugccaccgucuuaccucugggcuuuggugcuuaacacacaacacagcugcagacccug

SEQ ID NO: 298830 - RNA, 64 nt, Human
uacuggugauguugaaauaugcauacuaauuuuugcuuaacauuagaugucaugaggaaacuac

SEQ ID NO: 298831 - RNA, 64 nt, Human
agcaaguuuuuaaaaaaugcaagaggcaguuguuagucuucagggcuuggcaacugaaauagcu

SEQ ID NO: 298832 - RNA, 64 nt, Human
ccacccucuguagagcugagcauuucuuuuaaauagucuucauugccaauuuguucuuguagca

SEQ ID NO: 298833 - RNA, 64 nt, Human
ggagaagugaaagacuucccagaccuggcugucuugggcgcagccuaacuuuucacaagaugga

SEQ ID NO: 298834 - RNA, 64 nt, Human
gaauuaugggaggcucugacugucucgggugucagcuuaacauuccacagaugggggguuaguu

SEQ ID NO: 298835 - RNA, 64 nt, Human
caccucugccccaguggauuagcaaguguggcaggcuuaacauguccagguucuccccaauaac

SEQ ID NO: 298836 - RNA, 64 nt, Human
uuaaaacaucugguuuucauguuaacuguaucuggcuuaacacauaaaagguguuugugugugu

SEQ ID NO: 298837 - RNA, 64 nt, Human
ugucaaauaccaaugcuuuauaucgacgcgaagugcuuaacacagccgggcuugggggcaguca

SEQ ID NO: 298838 - RNA, 64 nt, Human
aaaggguuaagaugucuaaaauagggaccuagaagcuuaacacuauuuaaguaaauacaguaga

SEQ ID NO: 298839 - RNA, 64 nt, Human
gcugcuguaacaaauuaccaccaauaauaugauggcuuaacacaacagaaacuuauuugcuuac

SEQ ID NO: 298840 - RNA, 64 nt, Human
uuuuggaaaccugccgugaaaggaaauucuaaaggcuuaacaugaaacugucugcauuucuacc

SEQ ID NO: 298841 - RNA, 64 nt, Human
agucagccuuugggaagaauccacugugaacaaagcuuaacacauggggcuucaucgcucauag

SEQ ID NO: 298842 - RNA, 64 nt, Human
uuaaucaucuggauuuuuuauucuuuucagauaggcuuaacaaauggagcuuucuguauauaaa

SEQ ID NO: 298843 - RNA, 64 nt, Human
cagaggaacaucgucacaacgaauacuucuggaagcuuaacaaaacuaacccugcuguccuuuu

SEQ ID NO: 298844 - RNA, 64 nt, Human
gauauauguuuguggaauggauuuuccugaagcugcuuaacaguugcuuuggauucucuaagau

SEQ ID NO: 298845 - RNA, 64 nt, Human
cuccugcaggaggcucaacccgacggaucacagugaaagggauuccucccacgccagaucugca

SEQ ID NO: 298846 - RNA, 64 nt, Human
aggaaccagaggcagagagacgaggauacccagcgaaagggacgggaggaagcauccgaaaccu

SEQ ID NO: 298847 - RNA, 64 nt, Human
uuguuaaaagggacaauguggccacuucucuguggaaagggaguugguugggggguugagaugg

SEQ ID NO: 298848 - RNA, 64 nt, Human
uagguuuucauaagcauuguuucuuuaaggcauggaaagggaagaaugcucaagcaagucaugu

SEQ ID NO: 298849 - RNA, 64 nt, Human
uuacggaguuugccaugggaugugugauaucagcagucuucagcuccuuacaaauuaccaaaag

SEQ ID NO: 298850 - RNA, 64 nt, Human
cuuguacuuuugccuuagguucucaagggacaauagucuucauguuggauucuccaacaggcug

SEQ ID NO: 298851 - RNA, 64 nt, Human
uuaauuuggaguaacuaauucuguggcuguugugagucuucagcacccucccauguaccuuaua

SEQ ID NO: 298852 - RNA, 64 nt, Human
auagaagguagaaaugaaaagugagaaaauauuugaaagggauuauauuaauugcuaaauauuu

SEQ ID NO: 298853 - RNA, 64 nt, Human
caguaaaguggguugaggugagggcugugguccugaaagggacgccuuugacaucguggcuguc

SEQ ID NO: 298854 - RNA, 64 nt, Human
uaccgaccuaucccaguugugugaggcugcgagagaaagggagugcaugugcgcgcgugcaugu

SEQ ID NO: 298855 - RNA, 64 nt, Human
uuggcacaucgacaagggcugucccaagucaauggaaagggaaaggguggggguuaggggaagg

SEQ ID NO: 298856 - RNA, 64 nt, Human
uugccuggugggggaaggggaggaggggaagaaggaaagggaagagucuuccaaggccagaagg

SEQ ID NO: 298857 - RNA, 64 nt, Human
agguggaggagcuucccacuccaggacuguugaugaaagggacagauugaggaggaagugggcu

SEQ ID NO: 298858 - RNA, 64 nt, Human
gccuuccauguagaaaguggggucaggaggccaagaaagggaauaugaauguauauccaaguca

SEQ ID NO: 298859 - RNA, 64 nt, Human
cucuagagggauauaccccagauggcugagggaagaaagggauugaggugguaggaguucaagg

SEQ ID NO: 298860 - RNA, 64 nt, Human
uaacuuugaaccauaaagggugccaggucugggugaaagggauacuuuuaugcaaccauaagac

SEQ ID NO: 298861 - RNA, 64 nt, Human
acaaauacuaaggucccagggugggagggcuagggaaagggauauggaguucuuacuugacuug

SEQ ID NO: 298862 - RNA, 64 nt, Human
aaguuaaauuuacagcuaaugauccaagcagauagaaagggaucaauguauggugggaggauug

SEQ ID NO: 298863 - RNA, 64 nt, Human
ugaauuccuaguaacuuucuugguaugcuggccagaaagggaaaugaggaggagaguagaaacc

SEQ ID NO: 298864 - RNA, 64 nt, Human
aacuucugcuuucaucccaugccucaucaaugaggaaagggaacaaaguguauaaaacugccac

SEQ ID NO: 298865 - RNA, 64 nt, Human
aaaaacaagaaaauuuggggagggggagaaagaagaaagggauugcugucucccuugaauuccu

SEQ ID NO: 298866 - RNA, 64 nt, Human
acauauaguuucauaccauucauuuuuuaacaaagaaagggaaaagucugcuuguaagcugguu

SEQ ID NO: 298867 - RNA, 64 nt, Human
uuuuauauuguuuuaucuaucugucuuugcaagcagucuucagguuaaagauacuucuaacagg

SEQ ID NO: 298868 - RNA, 64 nt, Human
gcaggguggcuccuuugugugcagcagguguaguagucuucauuuucaugguacguuuuaauau

SEQ ID NO: 298869 - RNA, 64 nt, Human
cuuuagggacagcuuagaauuauuugcacuauugagucuucauguucccacuucaaaacaaaca

SEQ ID NO: 298870 - RNA, 64 nt, Human
ugaaaacaaaucacacaccguuucccaaaccaacagucuucacauuucuaucccucuguuauug

SEQ ID NO: 298871 - RNA, 64 nt, Human
uucauuuccaaaucauuuuuuuuuuucuuuuggggaaagggaaggaaaaauuauaaucacuaau

SEQ ID NO: 298872 - RNA, 64 nt, Human
ucaacaucaaaaauuguguagaaauauuuucagugaaagggaauaacuaguacuuuucugcaua

SEQ ID NO: 298873 - RNA, 64 nt, Human
aaaaaguaauucagaugacauuugagaaguaggggaaagggaaucauguugacaguuuuaguuc

SEQ ID NO: 298874 - RNA, 64 nt, Human
accugcgugggagaggcguagcgaggucggaggggaaagggagaucccacgugcaaguaggggg

SEQ ID NO: 298875 - RNA, 64 nt, Human
gagccuugaagcugccuuuggugacacacugagugaaagggacugggccagcucaguggaccgu

SEQ ID NO: 298876 - RNA, 64 nt, Human
cagagaaaugugaagggugggguuuuaugugugggaaagggacccgaagcccaggcugaagagu

SEQ ID NO: 298877 - RNA, 64 nt, Human
guaauacuaaguccucagagcuccaugcuguucugaaagggauggccacaaguucuuucccagc

SEQ ID NO: 298878 - RNA, 53 nt, Human
gcauggcugagagcaacugaagggaaagggaaagguaaccacucaggaguaga

SEQ ID NO: 298879 - RNA, 64 nt, Human
ucucuguauguccagcacuuuguagccaugggaggaaagggacuauaaaaguguacaauguuaa

SEQ ID NO: 298880 - RNA, 64 nt, Human
caguaaugaaugaaaguggaacauguuucuuuuugaaagggagagaauugaccauuuauuguug

SEQ ID NO: 298881 - RNA, 64 nt, Human
ucugagccagugagucuauugcaugguguuuugagaaagggaauuuuagugacaccuuaugcca

SEQ ID NO: 298882 - RNA, 64 nt, Human
uccaaguaggcuaggcuccagauuuaugaggaaagaaagggacagcauuugcugcccccacccc

SEQ ID NO: 298883 - RNA, 64 nt, Human
guccuccucccuaauucagacccagccucaagaggaaagggaguaaaauaaaacuaacuuguuu

SEQ ID NO: 298884 - RNA, 64 nt, Human
caugagcuggcaaccagccagcgucccuuggugagaaagggauugcugaggcaccguccaggcc

SEQ ID NO: 298885 - RNA, 64 nt, Human
cucuucuagaacccuagcccagggacuggagcaggaaagggaccuucaaagugaagacugccuu

SEQ ID NO: 298886 - RNA, 53 nt, Human
gcucccccagugaugucuagcugagucuucaugacccuucaacccugauuacu

SEQ ID NO: 298887 - RNA, 64 nt, Human
caccaggagcagcagccagcaccaccuacacaggagucuucagacccagagaaggacggugcca

SEQ ID NO: 298888 - RNA, 64 nt, Human
agcacuggacguggcaacuguucagaggagaggcagucuucaaguucuacauucauucagaaaa

SEQ ID NO: 298889 - RNA, 64 nt, Human
caggccuaggaugguucuuguccuauauccaccuagucuucaccuggggcuauaauucuguccu

SEQ ID NO: 298890 - RNA, 64 nt, Human
agaaggacaucccaggagcagggucuggugggaggaaagggaaggaggaggcuaaggcugccca

SEQ ID NO: 298891 - RNA, 64 nt, Human
ggccugacccagucggagccugacaugguggagggaaagggagacaaguggggcugcacucggu

SEQ ID NO: 298892 - RNA, 64 nt, Human
cucugaagguguccccacgaaggccagaaagggggaaagggaccugggcgaggagaggauuugu

SEQ ID NO: 298893 - RNA, 64 nt, Human
uucuccccaacaggaaacugugggauuugaaaaggaaagggaagggaaaacagagaaccuagug

SEQ ID NO: 298894 - RNA, 64 nt, Human
cuggaaucaaggggagggggaagggaaugaaauggaaagggaggcugauucccuuccccugacu

SEQ ID NO: 298895 - RNA, 64 nt, Human
accuuaggauuuaaggaaggggcuucuuaauguagaaagggaagaagaagagagaaaagaaggg

SEQ ID NO: 298896 - RNA, 64 nt, Human
aaauauuaauuuucaaggggaaaaaaccugagaagaaagggagaaaagaccaugaaauuuacca

SEQ ID NO: 298897 - RNA, 64 nt, Human
ucucugccugagccucuauucuuauauuaucagagaaagggaccauugggugcauagagauggg

SEQ ID NO: 298898 - RNA, 64 nt, Human
uuggaaaaaccuccaguuacuagugacgaggauagaaagggaagugcuucucuuuggcuuuuuc

SEQ ID NO: 298899 - RNA, 64 nt, Human
gagaaagcccugucgggcuuugugugaaggcagagaaagggacaaugauaguagagugauaugg

SEQ ID NO: 298900 - RNA, 64 nt, Human
cuuuggccagaaggaugaauacuuggauauuacugaaagggagggguggagauggguguggcag

SEQ ID NO: 298901 - RNA, 64 nt, Human
uuaaccccucugagcccgggucucuucauuaguugaaagggauaguaauaccuacuugcagguu

SEQ ID NO: 298902 - RNA, 64 nt, Human
uggacuacuuuaauuuggauccuuuggguuuggagaaagggaaugugaaagcugucauuacaga

SEQ ID NO: 298903 - RNA, 64 nt, Human
cuggcuacguaguucgggcaaauccuccaaaagggaaagggaggauuugcuuagaaggauggcg

SEQ ID NO: 298904 - RNA, 64 nt, Human
ugaauagcagagagcaaaccaaucagucccucaggaaagggaagaaaaagaagagguggcacca

SEQ ID NO: 298905 - RNA, 64 nt, Human
cuagguuuuucuuagcuuccagcucuuuccauacagucuucacugaaguguuugguacaaggau

SEQ ID NO: 298906 - RNA, 64 nt, Human
cagggcaagcagaugucgcaagcccuauuuauucagucuucacuauaacucuuagaguugagac

SEQ ID NO: 298907 - RNA, 64 nt, Human
gggaugugggggcugggggacugggaggccuggcagucuucaugcugcccugcugcugcuggaa

SEQ ID NO: 298908 - RNA, 64 nt, Human
acgggguuggacugagcccugucaccucugugauagucuucacucugacaggcaauggugacug

SEQ ID NO: 298909 - RNA, 64 nt, Human
gaaaaaaaugaaauaaaaagaagagagggaggaagaaagggagagagaagaaaagaaaaaugaa

SEQ ID NO: 298910 - RNA, 64 nt, Human
gauagcugaugaaggauuucaagucuggaaaugggaaagggagggguagaaguuccuuuucaga

SEQ ID NO: 298911 - RNA, 64 nt, Human
guuuagcaaguuuaggagagaauagucaugaaaagaaagggaagaaaggggagaagggaagagg

SEQ ID NO: 298912 - RNA, 64 nt, Human
uaagggaaaggaaaagaacacuagcuaaggaagggaaagggaagugauaucauaaaaguagcaa

SEQ ID NO: 298913 - RNA, 64 nt, Human
cuucuacacugaccagcaagcuaggccgcuggaggaaagggaacucacccaacucuaaauugug

SEQ ID NO: 298914 - RNA, 64 nt, Human
aauucagcaacaacaaaaaauacauauaaaacuagaaagggacuuuuuuuccuuucuuuucaua

SEQ ID NO: 298915 - RNA, 64 nt, Human
ucauuucugcagcucugacugugagcccugagaagaaagggaagacuuggggcuugggaagaga

SEQ ID NO: 298916 - RNA, 64 nt, Human
aaagagaagcagucugggccagaugcccugccaggaaagggacauggacccacgugcuugaggc

SEQ ID NO: 298917 - RNA, 64 nt, Human
gaaaagaaagugcuugaaagauuucaaauuuucagaaagggaacaacgaaggcccucucuuccu

SEQ ID NO: 298918 - RNA, 64 nt, Human
gccucacaguggguaaauauaucauacaucucuugaaagggaaaauauccaugucaguuucuuu

SEQ ID NO: 298919 - RNA, 64 nt, Human
ucuuccauugugggguagguggucggggaugggagaaagggaaaagucagggaaggggagaaga

SEQ ID NO: 298920 - RNA, 64 nt, Human
aauucagagaauuugguagcacaguguauugggagaaagggaaauuucgggugacagauugauc

SEQ ID NO: 298921 - RNA, 64 nt, Human
uauagaggggcaguuagagggagaacaggggugggaaagggagcaaggggcagauagcucagca

SEQ ID NO: 298922 - RNA, 64 nt, Human
ccucgggguuugagguggccaugggcagacagccgaaagggagggagggugugggugugcgugu

SEQ ID NO: 298923 - RNA, 64 nt, Human
cccuccccaaccaccucaugguauauuuaagagugaaagggacaaacuaguagguuugucaagu

SEQ ID NO: 298924 - RNA, 64 nt, Human
aacuugaaauaaauguguggacuuaauucaccccagucuucaucaucugggcaucagaauauuu

SEQ ID NO: 298925 - RNA, 64 nt, Human
gccacuaugcugacuucuuauuccuuuucauaacagucuucaaagcacagcucaucuaaagaau

SEQ ID NO: 298926 - RNA, 64 nt, Human
agucacauugcugcuuaacaugcuggauugcccuagucuucagaaugguccugagaaaacauca

SEQ ID NO: 298927 - RNA, 64 nt, Human
ugaagaauccuguaagccccugaauuaagcagaaagucuucauggcuuuucuggucuucggcug

SEQ ID NO: 298928 - RNA, 64 nt, Human
ugaggagguagugcuguaggcccagggggucagggaaagggaggggggcaugugagggauggaa

SEQ ID NO: 298929 - RNA, 64 nt, Human
guguguuucuuagguaaagucucuuuuugcuacugaaagggaaauggucucuaaacacugguca

SEQ ID NO: 298930 - RNA, 64 nt, Human
uauaaauaugcuucuugaauaauacacauuuugggaaagggaaaaaugucuguucaaaaaguaa

SEQ ID NO: 298931 - RNA, 64 nt, Human
uuuuuuccccuuuuuaauauucuggcaaucuuuagaaagggagauuccaaacucccauuuggua

SEQ ID NO: 298932 - RNA, 64 nt, Human
ccagccacaggauggcaguagaauaaagacagucgaaagggauuucugcucacuggcaggagac

SEQ ID NO: 298933 - RNA, 64 nt, Human
gaagugggauggcugacaggcacauaacuuacgggaaagggaauuucauacauacgauuuuugu

SEQ ID NO: 298934 - RNA, 64 nt, Human
aauggagugggcuggggagugcagaaguugggcagaaagggaggaggagggcaacagggaauga

SEQ ID NO: 298935 - RNA, 64 nt, Human
aaggcaaaauaguauuuucuauuacugugcaggggaaagggauggaucgauacaugcaaauuua

SEQ ID NO: 298936 - RNA, 64 nt, Human
uggcaugccauugaugcuguacagaauugcaggugaaagggagaauuuuagacuuaauuuuuaa

SEQ ID NO: 298937 - RNA, 64 nt, Human
agguguacagcagucuagguggcauagugaugaagaaagggaucagagucugacugucacucag

SEQ ID NO: 298938 - RNA, 64 nt, Human
uauuuuuauaagaaaaucaaguauauaaaucuaggaaagggaucuucuaguuucuguguuguuu

SEQ ID NO: 298939 - RNA, 64 nt, Human
guuuuucaauagauuauucugccauuuuuuaaaggaaagggaaaaugaaaacagcaugucuuuu

SEQ ID NO: 298940 - RNA, 64 nt, Human
cuaucugccagcagcaccucgggggcucuacaaggaaagggagcuucccuauuauccaggggcu

SEQ ID NO: 298941 - RNA, 64 nt, Human
aagcuuggaacuguuuugaaagauaacacagagggaaagggagagccaccugguacuuguccac

SEQ ID NO: 298942 - RNA, 64 nt, Human
uuuggauucuuauuguuaucaccuauguacaauggaaagggauuuuaagcacaaaccugcugcu

SEQ ID NO: 298943 - RNA, 64 nt, Human
accaugaccuggaaucuuuugcucuuguuuuugcagucuucaaggcugggggcccugucucauu

SEQ ID NO: 298944 - RNA, 64 nt, Human
agcacacacaagauacaugguggaagaucuaaggagucuucauguacuucauuaaaaaauaaca

SEQ ID NO: 298945 - RNA, 64 nt, Human
uucccacauccucugaguuggaagucccaucucaagucuucaauaaagacucuugaauauugaa

SEQ ID NO: 298946 - RNA, 64 nt, Human; identical to SEQ ID NO: 296950

SEQ ID NO: 298947 - RNA, 64 nt, Human
ugccuucugcgcaaaggguuucaccaaggauggagaaagggagacagcuugcagauggcgcguu

SEQ ID NO: 298948 - RNA, 64 nt, Human
cuucuuuauugcacacaggacaccagucuucaaggaaagggacuuuuuuccagucugccaauca

SEQ ID NO: 298949 - RNA, 64 nt, Human
cagcaacaugaaaagagcauaucaaugugguggagaaagggaagggguuggcuuuuuaauuuau

SEQ ID NO: 298950 - RNA, 64 nt, Human
agguagaggaaaaggguuugggcguugcuaggcugaaagggaagccacaccacuggccuucccu

SEQ ID NO: 298951 - RNA, 64 nt, Human
cuucugucauugggaaugaaauaaauuauuacgagaaagggacuuguccuaacugguuugaggc

SEQ ID NO: 298952 - RNA, 64 nt, Human
gugcugaauguggacucaaucccuagggcuggcagaaagggaacagaaagguuuuugaguacgg

SEQ ID NO: 298953 - RNA, 64 nt, Human
uugcucuucugggaagagaaguucaggggucccagaaagggacagggaaauaaauggugccugg

SEQ ID NO: 298954 - RNA, 64 nt, Human
cuucguucaagaccggcgcuuggcacccuuguuggaaagggauuuucagcauaacauuuuccuu

SEQ ID NO: 298955 - RNA, 64 nt, Human
ggaaaggguggaugcucucaggcugagggaggcagaaagggaaaguauuagcaugagcuuucca

SEQ ID NO: 298956 - RNA, 64 nt, Human
cccuacccauaaaauuauuugaaaacuuucaccagaaagggauguaagucucgcuuauauuuug

SEQ ID NO: 298957 - RNA, 64 nt, Human
agaaaaaaggacuguauaguuuaaagggaggauugaaagggagguaaaaaaucagauuagacca

SEQ ID NO: 298958 - RNA, 64 nt, Human
caguauucuacuucuguuuaaaaaggggagaugagaaagggaauacuaucuaaccaauaacuug

SEQ ID NO: 298959 - RNA, 64 nt, Human
ggccacuacuuuaaguauacaaucuuuaaaauaagaaagggaggcuaauauuuuucaugcuauc

SEQ ID NO: 298960 - RNA, 64 nt, Human
cuggucuugggguauggugcuagcuaugguaagggaaagggaccuuuccgaaaaacaucuuuug

SEQ ID NO: 298961 - RNA, 64 nt, Human
cugguggauuccuaugacacagggggccuggaaagaaagggaaaguggauuuaaaauauauaua

SEQ ID NO: 298962 - RNA, 64 nt, Human
ugaagaaagaaaaauuaaauugguaguaaaauauagucuucaaguauacguuugagagugcuuu

SEQ ID NO: 298963 - RNA, 64 nt, Human
cagaaaaauaaauaagaguuauugcacuaacaaaagucuucaucacuuguaguucuggaugcug

SEQ ID NO: 298964 - RNA, 64 nt, Human
uugggaacugauuauagagaaucauauauaguccagucuucauuuuacauacacacacauauuu

SEQ ID NO: 298965 - RNA, 64 nt, Human
gcugcugcuaagaauauucgaggucaagagcuccagucuucaauaccugcagaggaggcaugac

SEQ ID NO: 298966 - RNA, 64 nt, Human
gauggcuugugaauuugcucucaaggugcuuauggaaagggauccugauugauugaaauucaug

SEQ ID NO: 298967 - RNA, 64 nt, Human
guccugccagcucaaccugucauuuacagacuaagaaagggaaguacacaccuggcuuguggcc

SEQ ID NO: 298968 - RNA, 64 nt, Human
uguguucauuuguugagccauaucucagaagaaggaaagggagcuacagaaaggagguuuagga

SEQ ID NO: 298969 - RNA, 64 nt, Human
gauaccucagagccuucucuuuacucuccaaagugaaagggaagcccccgucucucuaacugca

SEQ ID NO: 298970 - RNA, 64 nt, Human
cgcccuggguuucaugagcuuggacagcaagguggaaagggagauuccagggaagaggcaucgc

SEQ ID NO: 298971 - RNA, 64 nt, Human
aacgcagaaaagaaaaaaagguuaagcauaaaaagaaagggaaaaagcagaaacacugcagaag

SEQ ID NO: 298972 - RNA, 64 nt, Human
aaagagaacacaccaaaaaagugaaagagaaauugaaagggaaaaaagacaaaaagcauaaggc

SEQ ID NO: 298973 - RNA, 64 nt, Human
caguuauggugccucaggggcugcgucagccaaggaaagggaagugcugcuuaguccuggacuu

SEQ ID NO: 298974 - RNA, 64 nt, Human
cuaagaaaauaauuagaaguagacaaagauuaaugaaagggauguucaugacagcaucauauac

SEQ ID NO: 298975 - RNA, 64 nt, Human
ggaccagagagagugaaagagaaaagaaaacucagaaagggaugaaucugaacuauaugauuac

SEQ ID NO: 298976 - RNA, 64 nt, Human
cuagagcuugaagccacucaagccaguuggggaggaaagggaugcggagguacccucuagcugg

SEQ ID NO: 298977 - RNA, 64 nt, Human
ggcaacuagucagaaaaccagcuauggccuuacagaaagggaaaaauuaacccauuauuaaaaa

SEQ ID NO: 298978 - RNA, 64 nt, Human
agcuuguccuaaaucuugcuguccacccuuccaggaaagggacauuguaaaugaauaaaacauu

SEQ ID NO: 298979 - RNA, 64 nt, Human
uucucagugggcugcaguugcccaaccacaggaagaaagggaaggagguagagggaagaaacag

SEQ ID NO: 298980 - RNA, 64 nt, Human
cauccguccgucuuuuuuacuuugucugguaccugaaagggaaauaaaaggaacuaaauccagg

SEQ ID NO: 298981 - RNA, 64 nt, Human
cuucuuuauuuuuuuuuucuuuuuauugaaacccagucuucauuuaguugcuaaggcuuuuaau

SEQ ID NO: 298982 - RNA, 64 nt, Human
acacagacagacacacacacacacaacaauuaacagucuucaggcaaaacgucgaaucagcuau

SEQ ID NO: 298983 - RNA, 64 nt, Human
gucaccuacuccccgaaguuaccagcucagcucgagucuucagggcugggcuccuaggcugccc

SEQ ID NO: 298984 - RNA, 64 nt, Human
guaggaaacagguauaauuuuaaugugaaaauuaagucuucacuuucugugcaaguaauccugc

SEQ ID NO: 298985 - RNA, 64 nt, Human
uuauuucuuuuaggucuagggacaggagugaauagaaagggaggagagcucuauuauguucuau

SEQ ID NO: 298986 - RNA, 64 nt, Human
guauuccuuagaggaaacaguucuuuaaaguuaggaaagggaguaggcaggcauguguuggcaa

SEQ ID NO: 298987 - RNA, 64 nt, Human
ggggagcggagcuuggcccugcgcccugugcagggaaagggauggucaggcccaguucucgugc

SEQ ID NO: 298988 - RNA, 64 nt, Human
ccugagcucuggugagaaaagcugaauuuacaaggaaagggaugaaguuaauauuugcaucaca

SEQ ID NO: 298989 - RNA, 64 nt, Human
aucaucucucacuauauauuauaguaaaacccucgaaagggaucacccccacacuccuuucccu

SEQ ID NO: 298990 - RNA, 64 nt, Human
uugauuccuggaagcaaacgugggacugucggaggaaagggauuguucuggucuuacucauaac

SEQ ID NO: 298991 - RNA, 64 nt, Human
gaucauccgacucagaaauauaaacacuuuuaaugaaagggaggaacggaaggacaauuuccag

SEQ ID NO: 298992 - RNA, 64 nt, Human
aauacugaguaaccacugggaaaauauuucagaugaaagggaugacaaaagcauguugcgcuuu

SEQ ID NO: 298993 - RNA, 64 nt, Human
gggauuuauaagagggaauuauaagagggauuaugaaagggaauuacuuuugagcaaggggagc

SEQ ID NO: 298994 - RNA, 64 nt, Human
aauuugaauucaguucuucauuuugcagauggcugaaagggacgagagaaugauggugaagcug

SEQ ID NO: 298995 - RNA, 64 nt, Human
uuuagcccucagcuggccaguacuuauugcuaaagaaagggagaucaauggaguugccuaccag

SEQ ID NO: 298996 - RNA, 64 nt, Human
augauuuagguacgucaaagcaguagucaaggaggaaagggauaguccaaagacuuaacugguu

SEQ ID NO: 298997 - RNA, 64 nt, Human
caaccagaaguucuuaauauuuaugauggcacuagaaagggauuuggcauuuuauguccuucug

SEQ ID NO: 298998 - RNA, 64 nt, Human
cggacaggacugauggcgggaccgcgcugcccgagaaagggacggaccaauacguguguuugcu

SEQ ID NO: 298999 - RNA, 64 nt, Human
augugggaggcuuuggcgcaggggacacuuucaggaaagggaggagcacaaggacucugugcau

SEQ ID NO: 299000 - RNA, 64 nt, Human
ucuacaaguaucuacauaucuaaagaauauggaaagucuucaguuugcuuucuggguuucagac

SEQ ID NO: 299001 - RNA, 64 nt, Human
gaacuaaaugugcuuccaugagacuggcuugagaagucuucagcaccaaguuccugaaagcuuu

SEQ ID NO: 299002 - RNA, 64 nt, Human
cagcucuguuuuuuaguagaguagucuuuagaguagucuucacuguuaucuauauaccuagaaa

SEQ ID NO: 299003 - RNA, 64 nt, Human
aaacaguuuuaggguggaagccauucccaguuugagucuucauccuguaagcccccaggggcag

SEQ ID NO: 299004 - RNA, 64 nt, Human
ugaaguccauugcugaaaacugcagccagggguugaaagggaugcagacuugaagagucugagg

SEQ ID NO: 299005 - RNA, 64 nt, Human
uguuuuuugacagauuguugaaauuaaaugaauugaaagggaaacucagaguacuaggacguuu

SEQ ID NO: 299006 - RNA, 64 nt, Human
ggcaaaucgucucuguacauguguguacauauuagaaagggaagauguuaagauauguggccug

SEQ ID NO: 299007 - RNA, 64 nt, Human
uuaaaugguaauguagcauuuauuuugcuaaauugaaagggaacauagauggaauuccaaaaua

SEQ ID NO: 299008 - RNA, 64 nt, Human
uguuccucuggggugguccaguucuagagugggagaaagggagucaggcgcauugggaaucgug

SEQ ID NO: 299009 - RNA, 64 nt, Human
acuuguaugcugcccacauacgugagggggagcugaaagggagccccuccucugagcagccucu

SEQ ID NO: 299010 - RNA, 64 nt, Human
gaugcuuuggcugauauuuacauguuuucgauaagaaagggaucgcugauugaguuauugagau

SEQ ID NO: 299011 - RNA, 64 nt, Human
ggcugggggugaaucccaaugagggucccucucagaaagggagaacgccagagcccuggcuggu

SEQ ID NO: 299012 - RNA, 64 nt, Human
gaaaaaggcuaugagaugagcugaguuauagagagaaagggagaggcauguacgguguggggaa

SEQ ID NO: 299013 - RNA, 64 nt, Human
aucauggaagucaguugcgggggcagcccauaaggaaagggaaagugagugggguugggcauag

SEQ ID NO: 299014 - RNA, 64 nt, Human
uccuaccccugccauuucccaccccugcuucagcgaaagggacucucuaacagggcagucacug

SEQ ID NO: 299015 - RNA, 64 nt, Human
ugaccugugauauuuuacuugaauuugucuccccgaaagggacacaauguggcaugacuaagua

SEQ ID NO: 299016 - RNA, 64 nt, Human
guuuucuuuucuagcugaauaaaccacaucaaaggaaagggaccacaguauuugaauguuugaa

SEQ ID NO: 299017 - RNA, 64 nt, Human
cguuuacugcugcuuggggccagggcaguccuuugaaagggaagcaaguuccggaauuuguucg

SEQ ID NO: 299018 - RNA, 64 nt, Human
uguuguuucucuugcaaauuauacuuuugguuuagaaagggauuaggucuuuucaaaaggguga

SEQ ID NO: 299019 - RNA, 64 nt, Human
cuaauaggccaguuugugauaagcuuacucuaugagucuucauuuuucuaaaauaaagugaaug

SEQ ID NO: 299020 - RNA, 64 nt, Human
gcaccacucuccuuucacagagcagagucugaauagucuucagagauaggccugugggccagau

SEQ ID NO: 299021 - RNA, 64 nt, Human
auagaaacuacacacuagacacagcaguagucauagucuucacagguuuaggagcuacuggacc

SEQ ID NO: 299022 - RNA, 64 nt, Human
acugaauauauuuuaccauuacagggcuaaaaggagucuucauguguuaauacuaccuccuugu

SEQ ID NO: 299023 - RNA, 64 nt, Human
uucuuauugauuuggaauuguaaccuauguaugagaaagggauuuucugguauuuuggugacgu

SEQ ID NO: 299024 - RNA, 64 nt, Human
uuuuagguuuacagaaguucuaccuuagggaaaagaaagggaaguaaauugaaaaaggggggag

SEQ ID NO: 299025 - RNA, 64 nt, Human
acauuauuagaauauaaaaaauguuauuacugaggaaagggaggagaggacaaguguaauaaau

SEQ ID NO: 299026 - RNA, 64 nt, Human
uucaggcuugugucuaccucuuccaugaaaaauggaaagggaugaaaauaaugggaguauaaua

SEQ ID NO: 299027 - RNA, 64 nt, Human
gcaaacaccuacaauaaagccaucuacuuuuagggaaagggaguugaaaaugcaaccaacucuu

SEQ ID NO: 299028 - RNA, 64 nt, Human
ugugauuaucaauuaccacaccaucucccaugaagaaagggaacggugaaguacuaagcgcuag

SEQ ID NO: 299029 - RNA, 64 nt, Human
cgguuugucugcccauuaucuucauucugcaagggaaagggaaaggaagcagggcagugguggg

SEQ ID NO: 299030 - RNA, 64 nt, Human
uuuguaugggaacauuggcaagaaagaauagugugaaagggaacuguuuuaguuuccuaucagu

SEQ ID NO: 299031 - RNA, 64 nt, Human
cugggaauuaugcuagaaggucgugggcacuaaagaaagggagagaaagagaagcuauauagag

SEQ ID NO: 299032 - RNA, 64 nt, Human
gaaacaacugaacccaucaauaagaaaaaggaucgaaagggaccaagcagcucacuacgauauc

SEQ ID NO: 299033 - RNA, 64 nt, Human
ugcaugcauaaugaaccguuuacaguguauuuaagaaagggaaagcugugccuuuuuuagcuuc

SEQ ID NO: 299034 - RNA, 64 nt, Human
aagagaaauguaagauucuagaaagucgcagcaggaaagggaguucccuggucuccugggaagu

SEQ ID NO: 299035 - RNA, 64 nt, Human
uaagggcuaauagauuuccauuuuucaauuaauggaaagggaaugcuacuauaccuacuucauu

SEQ ID NO: 299036 - RNA, 64 nt, Human
uccaggaaacccuggcuugcuugccgagccuaaugaaagggaaagucagcuuucagagccagug

SEQ ID NO: 299037 - RNA, 64 nt, Human
uagaagugacugaaauauuuuugugcauauuugagaaagggaacuuuccuuuuauuaauuguca

SEQ ID NO: 299038 - RNA, 64 nt, Human
cccuggcggucaucucgacgccagaccagaccaaagucuucagugcauccuacgaccggucccu

SEQ ID NO: 299039 - RNA, 64 nt, Human
uggacaaccugugagugcaucucuucuuuccuuuagucuucacagcuaacucuggagagcuuca

SEQ ID NO: 299040 - RNA, 64 nt, Human
uucuguagaaugcuguagaauccgguuuuaguugagucuucacauuuagaauuugaaaggaaaa

SEQ ID NO: 299041 - RNA, 64 nt, Human
aacacauuuuuccccaugaacggugcuguucugaagucuucaaauuuuucccucuaauaggaaa

SEQ ID NO: 299042 - RNA, 64 nt, Human
ugagagggggguauaugauucuuuaugaaauggggaaagggagcuaacauuaauuaugcaugua

SEQ ID NO: 299043 - RNA, 64 nt, Human
gauggaccaaggacgggccugaaggcacaugggggaaagggagcacacggggaggacguugggg

SEQ ID NO: 299044 - RNA, 64 nt, Human
ggacaauugaaauuugcuaaagggaaaggggaaagaaagggaaaagggagaaaaagaaacacaa

SEQ ID NO: 299045 - RNA, 64 nt, Human
gaacucaagaaagccacuggggaaaacucgagaagaaagggaguauacuaguagguuagaucug

SEQ ID NO: 299046 - RNA, 64 nt, Human
aauggaggcauuugcugucuaauauucaaacauagaaagggagcugcuuuuaaagaauucccug

SEQ ID NO: 299047 - RNA, 64 nt, Human
uuucaugagcugaggcgugggccagggccaucuggaaagggaacucggcuuuuccagaacgugg

SEQ ID NO: 299048 - RNA, 64 nt, Human
acagaagggcccauguacuuguugggaggaggaggaaagggaaggcuggcagguaggucggcac

SEQ ID NO: 299049 - RNA, 64 nt, Human
guacuguaggcagcugaagaaccgccguucccuugaaagggaacaccuggcauucugugguguu

SEQ ID NO: 299050 - RNA, 64 nt, Human
ggacugauggacugaaaacauugaugugauucuugaaagggaauuuagaauauguuaaggccaa

SEQ ID NO: 299051 - RNA, 64 nt, Human
ggaucuggggacugagugugggagugcagagaaagaaagggaaacuggcugaggggauaccaua

SEQ ID NO: 299052 - RNA, 64 nt, Human
uagaaggauggcaucuccauguagaauaaaugaagaaagggaggcccagccgcaggaaggcaga

SEQ ID NO: 299053 - RNA, 64 nt, Human
agagaccuuauuccaaagcacgauugcagaaggggaaagggaauauugcaaaagggagaggaag

SEQ ID NO: 299054 - RNA, 64 nt, Human
gugggaaacagccaccgagaagguucuagcucuagaaagggacuaaacuuauucucucauccga

SEQ ID NO: 299055 - RNA, 64 nt, Human
gcaccaauaaaaaaaugacuccuaguuguguuuggaaagggagagaagagaugucugaggaagg

SEQ ID NO: 299056 - RNA, 64 nt, Human
ucccaucccaggagguggugaguuggcuacaagagaaagggacaagugaggcaggccuagcagu

SEQ ID NO: 299057 - RNA, 64 nt, Human
gccucuuuuuguauuuuuauaacuaaacagaggaagucuucagaagaccucgcuuuaaaacaaa

SEQ ID NO: 299058 - RNA, 64 nt, Human
gaggaggaagaggcucugugagaugaauaggaggagucuucaggaggaggggcuguccucuccg

SEQ ID NO: 299059 - RNA, 64 nt, Human
ucagcacuuuuaaguggaagaucauuugaaucucagucuucagccugcacugauuuguagccug

SEQ ID NO: 299060 - RNA, 64 nt, Human
uagcauccguugcuuucggggugcagcucugcucagucuucaauuuguuucuguagcuacugug

SEQ ID NO: 299061 - RNA, 64 nt, Human
uagaaggugacuucuugcugugcccacacauggugaaagggacuaccaacucucuggagucucu

SEQ ID NO: 299062 - RNA, 64 nt, Human
accucccucacucagcuccuuuccccugaucagagaaagggaucaaggggguugggagggggga

SEQ ID NO: 299063 - RNA, 64 nt, Human
ugccccagacugacuugugagugggguuuauggggaaagggagggacugagggcagagucucug

SEQ ID NO: 299064 - RNA, 64 nt, Human
aucuuuaauauuuuaucuuuacagauuucccugagaaagggaauuaugaaauuuuuaauacaaa

SEQ ID NO: 299065 - RNA, 64 nt, Human
ugguagagaauaauuaaggcuucugauaagacaggaaagggauauuucaucaugacuguuaaga

SEQ ID NO: 299066 - RNA, 64 nt, Human
uggcuuuggaagaaaauaugcugcuguaaauuaggaaagggagaccagccugaccaauauggag

SEQ ID NO: 299067 - RNA, 64 nt, Human
gauuacccaagaauaacuuaaguagaagaaacaagaaagggaaucuuguauauuuuuguugaua

SEQ ID NO: 299068 - RNA, 64 nt, Human
agggaagacgaguguggaggauagguuaagaaaggaaagggacagaagucuugcaauaggcugc

SEQ ID NO: 299069 - RNA, 64 nt, Human
cccaaguuucauucgcccucagccacgcacaagggaaagggaacuuuggguuaugccuccugga

SEQ ID NO: 299070 - RNA, 64 nt, Human
cugcgcaucaggacugcuucaucgucuuggcugagaaagggaaaagacacacaagucgcguggg

SEQ ID NO: 299071 - RNA, 64 nt, Human
agacgcaacucauuuuauaucaacacgcuuggaggaaagggacucagggaagggagcagggagu

SEQ ID NO: 299072 - RNA, 64 nt, Human
ggauucuugaauuacucgaagccuucucugggaagaaagggaauucugacaaagcacaauucca

SEQ ID NO: 299073 - RNA, 64 nt, Human
uguccuuaaaagaagcucuagcaugaaauuaaaggaaagggaaagaaauagaucuggugcaccc

SEQ ID NO: 299074 - RNA, 64 nt, Human
guagggugagggaggacaggccaguagggggagggaaagggagaggggaagggcaggggacuca

SEQ ID NO: 299075 - RNA, 64 nt, Human
caugaaauuugccuccugaguucagguuuacccugaaagggaugcagauuauccuguuccucac

SEQ ID NO: 299076 - RNA, 64 nt, Human
aaacaguuauggaggacuuguauggagaaauuuaagucuucacugagggccacuuuacaaagga

SEQ ID NO: 299077 - RNA, 64 nt, Human
uugaaaaaccuccaagagggcaugaauauggcagagucuucauauggaaacaguuuuuauucua

SEQ ID NO: 299078 - RNA, 64 nt, Human
cacucagauccacauucaagugugcccacccugcagucuucauccucacucagcugcugccucu

SEQ ID NO: 299079 - RNA, 64 nt, Human
aagcaaagaagcuauuuaggaauuuacaggccaaagucuucauuuauugcccaguccauuuaaa

SEQ ID NO: 299080 - RNA, 64 nt, Human
gguggcaauuauaucacauugagacagaaauucagaaagggagccagccacccuggggcaguga

SEQ ID NO: 299081 - RNA, 64 nt, Human
aaggggcaggcuacuggggugggguagcuuucgggaaagggaauaaggagcacgaugcaagggc

SEQ ID NO: 299082 - RNA, 64 nt, Human
gcaggugccaguccccucacucucugggagcugugaaagggaucccuguccuuggguccugggu

SEQ ID NO: 299083 - RNA, 64 nt, Human
cuggcuggagaccgaggccagaaggcaaaaaccagaaagggaacaguccauaacuuaccucugc

SEQ ID NO: 299084 - RNA, 64 nt, Human
ugcaggaccagaaguaauuauacuaaaguaucaagaaagggaguuagggcuuaaacuauucugu

SEQ ID NO: 299085 - RNA, 64 nt, Human
cuguucccuucccucuguugcagggaaccaggaggaaagggaaagauguugccauauuuccuac

SEQ ID NO: 299086 - RNA, 64 nt, Human
aagaaaggaaggaaagaagggagggaaacagggagaaagggaaaaagaagaaaaagagaaagau

SEQ ID NO: 299087 - RNA, 64 nt, Human
aaaucagugacucacuuccaaagaguggaguauggaaagggaaacauaguaacuuuacagggga

SEQ ID NO: 299088 - RNA, 64 nt, Human
aagccuuagggaauauugaagggccugacauggggaaagggaaggcuaaaaauacuuggucaaa

SEQ ID NO: 299089 - RNA, 64 nt, Human
uuucugggcucucugaccccugcgcuagacuguggaaagggaguauuauuauaguauacaacac

SEQ ID NO: 299090 - RNA, 64 nt, Human
uucuccauuuugcauugagcaguagaguacaguggaaagggaauaagaauacugauuauucuga

SEQ ID NO: 299091 - RNA, 64 nt, Human
ucuacagccuucaugccccaugcauuagggaauagaaagggaaagaagguguggagaagacaca

SEQ ID NO: 299092 - RNA, 64 nt, Human
ggagggguaaaaccagcuuaagguucagcgagcagaaagggaccugagaggaugcucacuguaa

SEQ ID NO: 299093 - RNA, 64 nt, Human
uugcucuuacgaacauaauggacucuuaagaauggaaagggaugacauuuaccuaugugugcug

SEQ ID NO: 299094 - RNA, 64 nt, Human
acaaugaaacaggaaagaagagagggagagagaggaaagggaaggaagaaaggaaggagggaga

SEQ ID NO: 299095 - RNA, 64 nt, Human
acgacaaagucaguuuaauaucuuucuucugcugagucuucaggauguuagcuagucuuucaaa

SEQ ID NO: 299096 - RNA, 64 nt, Human
accuggaacugaacugagcugcucagagacaggaagucuucagggaaggucaccugagcccgga

SEQ ID NO: 299097 - RNA, 64 nt, Human
accuggaacugaacugagcugcucagagacaggaagucuucagggaaggucaccugagccugga

SEQ ID NO: 299098 - RNA, 64 nt, Human
cccgaaaguauucagcuggcauuuagagagcuacagucuucauuuuagugcuuuacacauucgg

SEQ ID NO: 299099 - RNA, 64 nt, Human
uaguuaaagcuuacuuugcagagcuucccaaagugaaagggaaacugaacuucacaauuuugca

SEQ ID NO: 299100 - RNA, 64 nt, Human
gguucuggugcagggagugagaagugggggaagugaaagggaaagcauccgugagaaagcggcc

SEQ ID NO: 299101 - RNA, 64 nt, Human
acggguccauccagggggacccucuccuuucugugaaagggaaucgugugugugccccaggcac

SEQ ID NO: 299102 - RNA, 64 nt, Human
gcuuguugaaagcacucacaucaacggagccucagaaagggagcugaggccaugcacggcccug

SEQ ID NO: 299103 - RNA, 64 nt, Human
aauguucguuuaugaucuuagcaaaugauggauugaaagggacuuacuuaacugcauaaagaga

SEQ ID NO: 299104 - RNA, 64 nt, Human
cacccacucccuugaaguuguggaggaggugaaagaaagggacccaccugcuagucgccccuca

SEQ ID NO: 299105 - RNA, 64 nt, Human
ucucuguacauuuuucucauuucuaauugaagaagaaagggagggcagagaggacagaaaauua

SEQ ID NO: 299106 - RNA, 64 nt, Human
uugucuuauguagaauguggcaaugccaacuggagaaagggaagaaggacauauuaccuugguu

SEQ ID NO: 299107 - RNA, 64 nt, Human
gguugcgguuauuuuccugguaguuugcguguaagaaagggagaauauaguuuuagaggaagcu

SEQ ID NO: 299108 - RNA, 64 nt, Human
auaguuauugagaccuauaguguguggcuuagaugaaagggagaguaaauuuucauaccaugcu

SEQ ID NO: 299109 - RNA, 64 nt, Human
gaauggccgggcccaagagaugaaggaaaggagugaaagggaaguaggaccagagaaguggaag

SEQ ID NO: 299110 - RNA, 64 nt, Human
augcacugacugggccacaucuugaaaacucguggaaagggaaaggggaggagaugggacuuug

SEQ ID NO: 299111 - RNA, 64 nt, Human
ugggauagggaggagggaauuacuagggaggagagaaagggacaaaagcacccugcuucauacu

SEQ ID NO: 299112 - RNA, 64 nt, Human
uuaauuccuaugaaguuggcacauuucaugaggggaaagggagaagggugguaaauauuuucaa

SEQ ID NO: 299113 - RNA, 64 nt, Human
gcuccaaaaaucugcacgcggagcgaaacaguuugaaagggacugaggcucacccaggucucca

SEQ ID NO: 299114 - RNA, 64 nt, Human
ucuaaggaagaucacuuugcucugauuauggaaaagucuucaagggcugcuucaaacucaaaca

SEQ ID NO: 299115 - RNA, 64 nt, Human
gucagugcuggaggaucugauuggcaagcuuaccagucuucagcugcaacaccuguuuaugauc

SEQ ID NO: 299116 - RNA, 64 nt, Human
gggaaaccuuugcuugcuuacuauuaggaggggaagucuucaguagggaacacgaucauuccau

SEQ ID NO: 299117 - RNA, 64 nt, Human
gaacgggugugggggccgggggcuggcuugcugaagucuucaacuugcacucggagcuccuuug

SEQ ID NO: 299118 - RNA, 64 nt, Human
aaauaaugaucuuggaauauuugcugugaagggagaaagggagagaaaacucuucugaggauca

SEQ ID NO: 299119 - RNA, 64 nt, Human
gugucuucuggggggcagaaccaauuggaaggaagaaagggaccccucuccaguccuggcuccu

SEQ ID NO: 299120 - RNA, 64 nt, Human
agaugaagcagugaaagagacaggaauugggagggaaagggagaaugguguacccuuuauuucu

SEQ ID NO: 299121 - RNA, 64 nt, Human
gugugggugcucauagaguugcccagcccagggggaaagggagcaagaguuguccagagaagac

SEQ ID NO: 299122 - RNA, 64 nt, Human
caugggugcaccccacccccuaggguccccaugggaaagggacaugcaaggaaacagcacagaa

SEQ ID NO: 299123 - RNA, 64 nt, Human
auagaggagcugcuuguuguuuguugacagcuuggaaagggaagaucuuaugccuuuucuuuuc

SEQ ID NO: 299124 - RNA, 64 nt, Human
uuuuucccaugaguugggggucgggugggggagggaaagggagggaugaccuucccagggagaa

SEQ ID NO: 299125 - RNA, 64 nt, Human
aucaguaauuuuguguuugggguguggggguggugaaagggaaguagaaccgaaacaagauuag

SEQ ID NO: 299126 - RNA, 64 nt, Human
gccucaguuuuccaucuguuuuugauaagaauaagaaagggagugagugugaagauggugguua

SEQ ID NO: 299127 - RNA, 64 nt, Human
auucuuaaaagccccagucucuggagaaaagagagaaagggauaaucaccuggaaggauuccaa

SEQ ID NO: 299128 - RNA, 64 nt, Human
ccuguuaucucuauuuuuuuaagcuaccaggaaggaaagggaagaagagaucacgaaacuggga

SEQ ID NO: 299129 - RNA, 64 nt, Human
gguguguuguaucuuuguaagagcaaaagccucagaaagggauugcuuugcauuacuguccccu

SEQ ID NO: 299130 - RNA, 64 nt, Human
uaccccaauucucuggggacauaaaaccaggcuggaaagggaccaggaaguuugaaauagugac

SEQ ID NO: 299131 - RNA, 64 nt, Human
cauuuacugacaaaaagggaaaauacgaaacacagaaagggaaaauaaacugacuuuuauaaug

SEQ ID NO: 299132 - RNA, 64 nt, Human
auggguuugcagugauaagucauacuuuuccaccgaaagggagggcuugggaaucccugagauu

SEQ ID NO: 299133 - RNA, 64 nt, Human
caggacugaugccgaaaugucaccagguccuuucagucuucacaguggagaacucuuggccaaa

SEQ ID NO: 299134 - RNA, 64 nt, Human
guuguuguguauuuucaguaucacuggaucccucagucuucaccguuuuauaaacguauaagau

SEQ ID NO: 299135 - RNA, 64 nt, Human
gcauuuugguuuuuuuucuuaagugaauaauaccagucuucaaagaaaacaaggugaagaccua

SEQ ID NO: 299136 - RNA, 64 nt, Human
gccuagaacuuuggugcacgugcccucuagccgaagucuucagcaagaggauucgcugcuggug

SEQ ID NO: 299137 - RNA, 64 nt, Human
ggacuuuuguuuguuuguuuguuucaggaaaaaagaaagggagagagaggaaaauagaggguug

SEQ ID NO: 299138 - RNA, 64 nt, Human
gggggcacaccugggccucccggaagcuguggacgaaagggagagcggguccuccagggcaagg

SEQ ID NO: 299139 - RNA, 64 nt, Human
cauccuccccagcgccaucugugugcagcaaccagaaagggaugaacuuggcccucuugcgggc

SEQ ID NO: 299140 - RNA, 64 nt, Human
aguuuguccuggagugacauacacauccaccauggaaagggaagcaucucugccuguggauucu

SEQ ID NO: 299141 - RNA, 64 nt, Human
gaagcccaagugaaauuaauauuaugcagaugaugaaagggaccucugaacaggauuucugcaa

SEQ ID NO: 299142 - RNA, 64 nt, Human
uaauccaacuuuuuucuaauauaucuaaacaauugaaagggaagcuuauucauggaauauuggc

SEQ ID NO: 299143 - RNA, 64 nt, Human
uuauugauauuguugguggcggucaccauuccuggaaagggacugucccaagccacuuaccuuc

SEQ ID NO: 299144 - RNA, 64 nt, Human
aguagaugucuuuuuacugugacugcacgugguggaaagggacuagcaagcuuaccccauucau

SEQ ID NO: 299145 - RNA, 64 nt, Human
cgucagcaggaaaacuggaucaugacuuuugcucgaaagggagaauaacauaggugccuuugcu

SEQ ID NO: 299146 - RNA, 64 nt, Human
uccagaccccuacagcugugucuaagcucaggaggaaagggacccucccaucauucaugggggg

SEQ ID NO: 299147 - RNA, 64 nt, Human
gacggggugggagaggggagaggagagaguuugggaaagggagauggagaagaacucaaggaca

SEQ ID NO: 299148 - RNA, 64 nt, Human
cuugagaagcaggcggguugggugggaggaggaagaaagggaagaauuagguuugaauugcuuu

SEQ ID NO: 299149 - RNA, 64 nt, Human
acugagaagcaggcggguugggugggaggaggaagaaagggaagaauuagguuugaauugcuuu

SEQ ID NO: 299150 - RNA, 64 nt, Human
ggaaggagcauacuuaauggguaguauugaggaugaaagggaauuucucucucugccauuuuau

SEQ ID NO: 299151 - RNA, 64 nt, Human
gcauuuaagaauugaacuaggggcuggaagaagugaaagggaagcaucuaaaaaugaaagguga

SEQ ID NO: 299152 - RNA, 64 nt, Human
uuuuaaauugacuuuugaauugacaaucugaaagagucuucaaugauaugcuugcaaaaauaua

SEQ ID NO: 299153 - RNA, 64 nt, Human
uuuaagaucuuacaugcaguuauaaaaccgccacagucuucaauccagauuugaagacucaugc

SEQ ID NO: 299154 - RNA, 64 nt, Human
ccuguaauacauggauauuuuuaagauauaaagaagucuucagaaauagcaguaaaggcucaaa

SEQ ID NO: 299155 - RNA, 64 nt, Human
agagguuagagguggaccgagaaggacuuuucccagucuucaguggcacuucccaagaucuccc

SEQ ID NO: 299156 - RNA, 64 nt, Human
auaugaaaacaguacacuguuguagguuggucaggaaagggaaugauuguggcuuggaccugac

SEQ ID NO: 299157 - RNA, 64 nt, Human
ccauuuauacauagaggaagggcuuauggacugagaaagggagaacaugguagggauuauugaa

SEQ ID NO: 299158 - RNA, 64 nt, Human
uuggccacguguggggacuugucuagaccagaaugaaagggacagggucccagacacguuuggg

SEQ ID NO: 299159 - RNA, 64 nt, Human
cugcaggagugacggugaugacccagcagcaacugaaagggaggugaggggcuuccuuucugca

SEQ ID NO: 299160 - RNA, 64 nt, Human
guuggagaacauuaugcuggagagagaauauaaagaaagggagauguuggaaacuucucaagcu

SEQ ID NO: 299161 - RNA, 64 nt, Human
aauaacaguuuuaagaugggcauaggguuuggaagaaagggagaaggauucuuuuuucaaugua

SEQ ID NO: 299162 - RNA, 64 nt, Human
ucacuggucacggauuugugucugugacuuuugugaaagggagaagugacauugcaucaaagca

SEQ ID NO: 299163 - RNA, 64 nt, Human
uucuuucauguuaaauacuuggggugggaggggagaaagggaaccuuuucuuaaaaugaaaaua

SEQ ID NO: 299164 - RNA, 64 nt, Human
caguagugcuagcugaggcccagaggaacgggaggaaagggaggcagcgccggacggcgcagcu

SEQ ID NO: 299165 - RNA, 64 nt, Human
cuuccuaaagggacccccaucucuaagucacucugaaagggaguuguggagaggagacgccucc

SEQ ID NO: 299166 - RNA, 64 nt, Human
uggaaguaauauaaaagggaaaauauauuuauaagaaagggauaaagguaauagagcccuucug

SEQ ID NO: 299167 - RNA, 64 nt, Human
gauuaaaggacaccagacucuggaugcuuggauggaaagggaaaaauggacccugugaugcuaa

SEQ ID NO: 299168 - RNA, 64 nt, Human
gcugcugcauuucugagugaagugcacgucuugggaaagggaugcaaucccugaaaccaggugc

SEQ ID NO: 299169 - RNA, 64 nt, Human
acucccacucucaggugcaagaguuauguagaaggaaagggagcugaaauaggaacagaaaaau

SEQ ID NO: 299170 - RNA, 64 nt, Human
auaugaugccuggauauuucagguuucuguaaaagaaagggaaaccuaaaacaaauacccuucc

SEQ ID NO: 299171 - RNA, 64 nt, Human
auuuuugaggaugcaaagcuuuucugugaagacaagucuucacaucuuguuuucauaaacacua

SEQ ID NO: 299172 - RNA, 64 nt, Human
auaaauaauaaaagacuguuauuagcacuuaguaagucuucaucuaugcauguuuuugaguuga

SEQ ID NO: 299173 - RNA, 64 nt, Human
guuccuuaaaaucaguuuugaacuuuggucauagagucuucauauuucaguauuuggugguccc

SEQ ID NO: 299174 - RNA, 64 nt, Human
caucguuuguacccagagucggcauggccaccuaagucuucauuuaauuuauugucccccagaa

SEQ ID NO: 299175 - RNA, 64 nt, Human
agcaugugggggacagaacaguaguccuggacucgaaagggaaggugcugaccaguggggccuu

SEQ ID NO: 299176 - RNA, 64 nt, Human
aaaucagggcacuugcauccauugccuuuuccaggaaagggaagaaaacacucaguugauaaac

SEQ ID NO: 299177 - RNA, 64 nt, Human
gagccucagaguuugcuucuggcuggcggcaagggaaagggacgauggagaaggcacggcugcu

SEQ ID NO: 299178 - RNA, 64 nt, Human
ccagccuagcuccagugcuucuaguaggagggcugaaagggagcaacuuuuccuccaauccugg

SEQ ID NO: 299179 - RNA, 64 nt, Human
ucauaccuauaaagucaaucuugaguugaucagagaaagggaaacuuacuccuaauaaacagac

SEQ ID NO: 299180 - RNA, 64 nt, Human
ggaauguuugcuggggccgaaagaacaguccauugaaagggaguauuacaaaaacauggccuuu

SEQ ID NO: 299181 - RNA, 64 nt, Human
aaaaacuuguuuuauggauuccucguuuacugaggaaagggaacaugcugguucuggaaaagcc

SEQ ID NO: 299182 - RNA, 64 nt, Human
agaaccugcccugaaaaguucuuagaaacgcagugaaagggaggaacuuguccuuuacccaguu

SEQ ID NO: 299183 - RNA, 64 nt, Human
uccguuuuagaaaaggaaaacgugaacaaacuuagaaagggaaggaaaucccaucagugaaucc

SEQ ID NO: 299184 - RNA, 64 nt, Human
ugccaacucaggggacagauggagcaggaguggagaaagggaaaggcaggucuggggugugguc

SEQ ID NO: 299185 - RNA, 64 nt, Human
uucuaaauguucaaauauuucauuuugugcgugugaaagggaaaacacuuugacggaucguuuu

SEQ ID NO: 299186 - RNA, 64 nt, Human
uccuguuuauucaaaugugugauuuugcugaaaugaaagggauaaaaugaauacuuagagaaua

SEQ ID NO: 299187 - RNA, 64 nt, Human
aaguggacucgaauccuggaggaggaaauaaagggaaagggaagucguggagaggcagggaaaa

SEQ ID NO: 299188 - RNA, 64 nt, Human
aaaaucuucauagaagaacuggaaggcuauauaagaaagggaaucaauucucugguauucugga

SEQ ID NO: 299189 - RNA, 64 nt, Human
auggguaagcguuuuguaaacuucuguucaaaaggaaagggaucuaaaugacaucagaacucuu

SEQ ID NO: 299190 - RNA, 64 nt, Human
cugauguuccagcuucuagccauguagugcucucagucuucauaccccagaaauuauugguaua

SEQ ID NO: 299191 - RNA, 64 nt, Human
ugaaauaccucagauuuguaauuguugauguuugagucuucaggaaguauuugcaucucugaaa

SEQ ID NO: 299192 - RNA, 64 nt, Human
gagaaaaacucuaugaguguaagcaaugugggaaagucuucagaucugucaagaaccuuucaau

SEQ ID NO: 299193 - RNA, 64 nt, Human
ggagaaaaaccuuagugaugugauggugcaauaaagucuucacucagucuucaugaaugcaguc

SEQ ID NO: 299194 - RNA, 64 nt, Human
aguaacuaucuugaagguuugaaaaacaaccaaagaaagggagugaggacuauggcugcauguc

SEQ ID NO: 299195 - RNA, 62 nt, Human
gagaccagucuacaguuugaacaucacucaaugaaagggauaauuccaugaaucagaaaaug

SEQ ID NO: 299196 - RNA, 64 nt, Human
aaucaagcauuugcuuccucuagacuacagcagggaaagggaggagaaaucugaugucucaacu

SEQ ID NO: 299197 - RNA, 64 nt, Human
aaacaccaaagaaagacugguguguacugaauaggaaagggaaguuuuauuuggaaccuucuaa

SEQ ID NO: 299198 - RNA, 64 nt, Human
aaaagucucauaagguagccaaaugaaaaagaaugaaagggaaagugaaaaauuaaggggacaa

SEQ ID NO: 299199 - RNA, 64 nt, Human
cucugcaaaaggagagacucccaugaagccuuuugaaagggaucaucaugcagcucaacuuucu

SEQ ID NO: 299200 - RNA, 64 nt, Human
caaaacaaaaacaaaccgcauacacguucaccgagaaagggagagggaaucggagggagcagcg

SEQ ID NO: 299201 - RNA, 64 nt, Human
agugacagucuccaggggacauuucagccaugcugaaagggaggcuggcaguggucauuuggcc

SEQ ID NO: 299202 - RNA, 64 nt, Human
ugcugacagaugcuuucagacuguagagcucagagaaagggagcggcagcuagagguagccagg

SEQ ID NO: 299203 - RNA, 64 nt, Human
ccuccaugguggucacugccccuggcaggucucugaaagggaaaugcuuuucugcagaggcccc

SEQ ID NO: 299204 - RNA, 64 nt, Human
ggacugauucaaucugcaugccagccuggaggaggaaagggagccugcucucccuccccacacc

SEQ ID NO: 299205 - RNA, 64 nt, Human
uuggcccuggucaugagcagaggagggagggggagaaagggaggaagccuggugauuguggcaa

SEQ ID NO: 299206 - RNA, 64 nt, Human
auucuuccaacaguuuggacaccacaaagcaggagaaagggaacauuuuucuacagcuggaaag

SEQ ID NO: 299207 - RNA, 64 nt, Human
gggugggugaagcaccguguccucgcugaggagagaaagggaggcgugccugagaagguagccu

SEQ ID NO: 299208 - RNA, 64 nt, Human
aauacauugauauuuauuaaucauuggauuuagggaaagggacagauuuuuggugaaccugacu

SEQ ID NO: 299209 - RNA, 64 nt, Human
ucccauguaccagcagcuggaaucugaaggcgugagucuucaucuuagggcaucgcuccuccuc

SEQ ID NO: 299210 - RNA, 64 nt, Human
ucccauguaccagcagcuggaaucugaaggcaucagucuucaucuuagggcaucgcucuuccuc

SEQ ID NO: 299211 - RNA, 64 nt, Human
augcuuugagucaccuaagacaggauauagacaaagucuucaucgucuucuugcuucuucuacc

SEQ ID NO: 299212 - RNA, 64 nt, Human
uucagcugugacuuauccaccacauagcccaguaagucuucaguuuuggcugggcaugauggug

SEQ ID NO: 299213 - RNA, 64 nt, Human
agaucccaugaucuuguguauugagcuuauuguugaaagggauuuuugaaggacagaacaauua

SEQ ID NO: 299214 - RNA, 64 nt, Human
cauuauuaagggugggcuagguuggauggaaggugaaagggaugaacugccuuuugcuggaagc

SEQ ID NO: 299215 - RNA, 64 nt, Human
cugcccccugaccagaagacagaauuugaagcuggaaagggaagaccccuuuuccccuccuccu

SEQ ID NO: 299216 - RNA, 64 nt, Human
cugcaaguggacaaaggaacaagcccccagaaaagaaagggaagaacugccuucuuauacuaca

SEQ ID NO: 299217 - RNA, 64 nt, Human
gggugaguguucucagagaaacuuaccagaucaagaaagggagcucaggcuggauggaggaagc

SEQ ID NO: 299218 - RNA, 64 nt, Human
aagaccuuuuuuucuguugggagaauggaaagcagaaagggaagccaggcucuuuaauguucca

SEQ ID NO: 299219 - RNA, 64 nt, Human
uugucuuguaucaguggaagaaguaaguugcuuagaaagggaaaagucaaauuguuccagaacu

SEQ ID NO: 299220 - RNA, 64 nt, Human
uggaaccuggucacucccuggcugcuucacucaggaaagggaacuaaaaccagaauacacuaag

SEQ ID NO: 299221 - RNA, 64 nt, Human
aguuacccagcagcagguuaccaagggcugucuggaaagggagggacaaaaggacccagaagua

SEQ ID NO: 299222 - RNA, 64 nt, Human
acuuuaaggagccauacucugauaugacagaugagaaagggagagaagacuuuucucuggcaga

SEQ ID NO: 299223 - RNA, 64 nt, Human
ccugucucugcgcacagcaaccauggacaugggagaaagggaugggagccacagugcccuucac

SEQ ID NO: 299224 - RNA, 64 nt, Human
accugaugagcucauguuggcuggucccaugugugaaagggacucucucggggaaaccaaggcc

SEQ ID NO: 299225 - RNA, 64 nt, Human
gucacagggaucugcugcagccacagcuccuccagaaagggacagccacggccaagugguugcu

SEQ ID NO: 299226 - RNA, 64 nt, Human
agcucgggccacucuucugaaggccaacguggaggaaagggagcagccagccauuugggagaag

SEQ ID NO: 299227 - RNA, 64 nt, Human
agugggcagcagucagggagagacagaacugggggaaagggaugguugugggucuuucuguucc

SEQ ID NO: 299228 - RNA, 64 nt, Human
uguaaugugguaaggaaaucuuauuuguggauacagucuucaucuucuucacuuacccacagca

SEQ ID NO: 299229 - RNA, 64 nt, Human
uagggaaacuugacuaauguaaugauugucacaaagucuucaguaaugcuacaacgauuacaaa

SEQ ID NO: 299230 - RNA, 64 nt, Human
uagggaaacuugacuaauguaaugauugucacaaagucuucaguaacgcuacaaccauugcaaa

SEQ ID NO: 299231 - RNA, 64 nt, Human
uuuuaaucaacagucacaccuugcaagucaucauagucuucauacugcagagaaaucuuacaaa

SEQ ID NO: 299232 - RNA, 64 nt, Human
ugccugcaggugccuuguugcuggcuugucuucagaaagggacuguucuggguggcuggaucuc

SEQ ID NO: 299233 - RNA, 54 nt, Human
ucuuggggaacaauuccuaaagaagaaagggaagacaauuuacaaacuccaagc

SEQ ID NO: 299234 - RNA, 64 nt, Human
guuuuaaccaaauuuuaaagauuaauggaaucaugaaagggaaaaaaauugauacaacuaugca

SEQ ID NO: 299235 - RNA, 64 nt, Human
ggcaaguuuugucuaaaaacaucuuuuuggcuuggaaagggaucugggaagccagguauuaauu

SEQ ID NO: 299236 - RNA, 64 nt, Human
augugaaaccagaauugcaagacuggguggacuagaaagggagauuagaucaguuuucucuuaa

SEQ ID NO: 299237 - RNA, 64 nt, Human
uuuauuacauggucacacauaaaguugcaguuaggaaagggaugggcagggaaaaacuaguuuu

SEQ ID NO: 299238 - RNA, 64 nt, Human
uugugcaagugccuuccugagcagaagaacuggagaaagggaaccacagagccaggaggaaugu

SEQ ID NO: 299239 - RNA, 64 nt, Human
gaggacgcuccuucccuccccuccuagaggagaggaaagggagucauuaacaacuaggggguug

SEQ ID NO: 299240 - RNA, 60 nt, Human
uccucaaaaucuggaacugaggaggcuggagaaagggaaguggaaggcagugaacacacu

SEQ ID NO: 299241 - RNA, 64 nt, Human
guauugugaaagccacugauuuuaagaauggagagaaagggauuuuuuacugcaucccucugua

SEQ ID NO: 299242 - RNA, 64 nt, Human
gaaguaacuggagaauugccaauacagccagagagaaagggacuacagcuuuuuagaggaaaag

SEQ ID NO: 299243 - RNA, 64 nt, Human
cuuuuccuuguauguucuugggugguuccuaagggaaagggaagcacaugaucaugggaaugau

SEQ ID NO: 299244 - RNA, 64 nt, Human
aggaugaaagaaaggucgcagcaguagcuuuggggaaagggaggaagauauggcacuucuccaa

SEQ ID NO: 299245 - RNA, 64 nt, Human
gugccuuuguuucccaucagacugucaagaagaggaaagggaggaaaccuagcagaggaaagug

SEQ ID NO: 299246 - RNA, 64 nt, Human
ggcugggguagcccccuccaguacaccccaaagugaaagggauaagagugcagccccagaauag

SEQ ID NO: 299247 - RNA, 64 nt, Human
uuucaguuuuuccugaagaauuuucuuuaccauuagucuucaaauuggauacuguugugcagug

SEQ ID NO: 299248 - RNA, 64 nt, Human
uuuaggcaaauuaauuuaguaaucuuugaucuuuagucuucauuuucugucacucagugaguuu

SEQ ID NO: 299249 - RNA, 64 nt, Human
aguaaccacaggaauauauucucugugaauuaaaagucuucaaaguuaucauuucucugacaua

SEQ ID NO: 299250 - RNA, 64 nt, Human
ccauggggugaagccaucccaaggcugacagcucagucuucaccuugccucuggccuuguauuu

SEQ ID NO: 299251 - RNA, 64 nt, Human
cucggugauauuuuuucuacgccaaaacagacgggaaagggaacaaaauaaagugaaauccaau

SEQ ID NO: 299252 - RNA, 64 nt, Human
guuuggcgugccaagcuucucugugaaagaguuugaaagggaagaaacccaagacaaagaagag

SEQ ID NO: 299253 - RNA, 64 nt, Human
auuaacauuuaggaacccagaccgaaaaguugcugaaagggaaggagacacauucacaaagaaa

SEQ ID NO: 299254 - RNA, 64 nt, Human
guuccuuuuacaaaaguguuuagcuucaagacuggaaagggaauaugaguguaaguuuacuaua

SEQ ID NO: 299255 - RNA, 64 nt, Human
gacucacuccagaggaaggauugauuugcaaccagaaagggagcugaaaaccacggagcuccau

SEQ ID NO: 299256 - RNA, 64 nt, Human
cagaaaacagaaagcacucuaggaaucuuaggcagaaagggauuuuaucuaaaucacuggaaag

SEQ ID NO: 299257 - RNA, 64 nt, Human
ugugccucgcuccccacucugcucugaugcaucagaaagggagggcucugaggcgccccaaccc

SEQ ID NO: 299258 - RNA, 64 nt, Human
aaacucuacaguauacuugugagagaaugagagugaaagggacaaauaacaucuguguagcagu

SEQ ID NO: 299259 - RNA, 64 nt, Human
aaucaacagccccagagccacuuggagggaggaagaaagggagccggcguucaaggcuaugaca

SEQ ID NO: 299260 - RNA, 64 nt, Human
ggcaugugguuuugaccuuuuuuucaaucuucuagaaagggaacggaagcagaagugggacauc

SEQ ID NO: 299261 - RNA, 64 nt, Human
ugaaaauaauuacuggauuggauuaucauaugaugaaagggaaaguaaguggaaauggauugau

SEQ ID NO: 299262 - RNA, 64 nt, Human
uuagccuuuguuuucaaaagcacaaaggaaaagugaaagggaaagagaaacaagugacugagaa

SEQ ID NO: 299263 - RNA, 64 nt, Human
ugggcccugcauuucuggggcaggaacagagggugaaagggacagauagaugcagguccauucu

SEQ ID NO: 299264 - RNA, 64 nt, Human
ugccuuagccuaccaugugaaacucuacccugaagaaagggauggauaggaaguagaccucuuu

SEQ ID NO: 299265 - RNA, 61 nt, Human
agcgagccagcucccaauaaauggaggaggggaaagggacugucacagaaggagcaagggc

SEQ ID NO: 299266 - RNA, 64 nt, Human
ugcuggccauaggguguccuuggguacauccaggagucuucauugcuucuguuauuaccccguc

SEQ ID NO: 299267 - RNA, 64 nt, Human
cuuaaauucuugauucugccucaggagaaagaauagucuucauguuuccacucauccuuccuuu

SEQ ID NO: 299268 - RNA, 64 nt, Human
ucaccugugcacagugagccgguagcuuccuuuuagucuucaccucucaaggaaauguuuuuac

SEQ ID NO: 299269 - RNA, 64 nt, Human
gcauaguuguucgaucaggagccuguuuacuaaaagucuucauacagaguacaagugcagccgc

SEQ ID NO: 299270 - RNA, 64 nt, Human
gcucauggggguggggguucccaacccuuuccgugaaagggaccgugaguaguggaaaccagga

SEQ ID NO: 299271 - RNA, 64 nt, Human
gaagaaucuguagcuuguugaaaaagcugggggugaaagggaacaaggaaggugaugugugagu

SEQ ID NO: 299272 - RNA, 64 nt, Human
uguacagaauuuaucauggauuauugacugcugagaaagggacaguggaauuuagccauaccaa

SEQ ID NO: 299273 - RNA, 64 nt, Human
uuuuuaccagcauacgauuguuauugagcaauaugaaagggaaauguucuuuauuaaaaucaau

SEQ ID NO: 299274 - RNA, 64 nt, Human
uaagaaggauuaauaauaaugcucugaauuuuucgaaagggauucuccuaaacccacccacuuc

SEQ ID NO: 299275 - RNA, 64 nt, Human
ucugauugcacuuccuuaaguuaugaauguacuagaaagggacucauccagaauacuaugccuc

SEQ ID NO: 299276 - RNA, 64 nt, Human
gagugcugugauugacuaguaauggcuaccacgggaaagggaaggggaagcaguagcacuaaug

SEQ ID NO: 299277 - RNA, 64 nt, Human
aguauuugugugugugguuuuuuuuccuuaauuugaaagggacagcacuguguauguuuauaaa

SEQ ID NO: 299278 - RNA, 64 nt, Human
ggagcugguuauuggugugguccuagggagggcggaaagggaggcacugccauuuggagacauu

SEQ ID NO: 299279 - RNA, 64 nt, Human
gugugaugggggugcagcuuagaggacccccucugaaagggauggagaugcugaugagaacaac

SEQ ID NO: 299280 - RNA, 64 nt, Human
aguggccucccagacugcaggguccccaaggauggaaagggaauguucugcugguucuacccug

SEQ ID NO: 299281 - RNA, 64 nt, Human
caauauuuaaacaucaguacuaguuguccugggagaaagggaaaggaguuuuauguugcgugag

SEQ ID NO: 299282 - RNA, 64 nt, Human
acaaaacugcagaagguguauguuggggagaacugaaagggaaaacaaaauacuugacauaguc

SEQ ID NO: 299283 - RNA, 64 nt, Human
ggaagaagcauacaagugggaaaaacugugauuagaaagggaaaaauaggcauuuccacaguac

SEQ ID NO: 299284 - RNA, 64 nt, Human
gguuuucauggauaaguuuuuaaauguaagacaggaaagggaucuauuugaugucuaucuucag

SEQ ID NO: 299285 - RNA, 64 nt, Human
caaaagcaguugccccgacuugggauuuuccuguagucuucagugguucauaacaguagaggau

SEQ ID NO: 299286 - RNA, 50 nt, Human
aauuccauccaauacguugaagucuucaaaaugcuugcuccaguuucacu

SEQ ID NO: 299287 - RNA, 64 nt, Human
acuuucuggagucacugggccaugaugaaucauaagucuucaguggccuagcaauauccagaua

SEQ ID NO: 299288 - RNA, 64 nt, Human
gauggcuugggagcacucguucucccaaggucugagucuucauccagcccugccugucugucgc

SEQ ID NO: 299289 - RNA, 64 nt, Human
uuuuucuauugguauaacccgcccaccugaaggggaaagggaaaucaaauuaauuuuucucguu

SEQ ID NO: 299290 - RNA, 64 nt, Human
uuauuaaauaccuauauaucacagcuaaguaggagaaagggagaccuuuuuauuuuguucaggu

SEQ ID NO: 299291 - RNA, 64 nt, Human
ugccuacaggccauaguuaaccugcaauagagaagaaagggaaguagggcagugcaugacuggc

SEQ ID NO: 299292 - RNA, 64 nt, Human
ucccccaaugaaaggccagcuucgaagaaaagcugaaagggagacguuugcagugagugguuag

SEQ ID NO: 299293 - RNA, 64 nt, Human
aagagggggagaaugagaagggaaggccgggugcgaaagggacgguauccagggcgccagggug

SEQ ID NO: 299294 - RNA, 64 nt, Human
uuaaaaguuuucaagggucagcaauaugaugacugaaagggaaaaguggaggaaacgcagcugc

SEQ ID NO: 299295 - RNA, 64 nt, Human
aaaacaccaauaucuaauaccacagugggaaaaggaaagggaagaaagacuuuauucucucucu

SEQ ID NO: 299296 - RNA, 64 nt, Human
aucaggaaaaugguugggagauuucucaaucccugaaagggaugagguugggggaguugcccag

SEQ ID NO: 299297 - RNA, 64 nt, Human
ugagacaccgagacggcauguucuucauuagacggaaagggaaacugaggcucaggagagaggc

SEQ ID NO: 299298 - RNA, 64 nt, Human
caugaaagcgugguucuguaagaaaucagagggagaaagggagagaagggggagggagacaacc

SEQ ID NO: 299299 - RNA, 64 nt, Human
agaacauagggcuugcugguaccuaugugacuaagaaagggacaugauguaagggaaaaggccu

SEQ ID NO: 299300 - RNA, 64 nt, Human
aaaaguuuaccgcuguagugugaaauauugucuggaaagggaugguuuaaauauuaccaugaug

SEQ ID NO: 299301 - RNA, 64 nt, Human
cagcugacucaaaauugaggauaguuaauagguugaaagggaaaaaguauguugaaaauuuaga

SEQ ID NO: 299302 - RNA, 64 nt, Human
gaugcuuagggggcauuugugcuccucuggccaggaaagggaacagaguccauccaagcugccc

SEQ ID NO: 299303 - RNA, 64 nt, Human
uucugugacgcagacagaggggauggggauagaggaaagggaugguaaguugagauguugugug

SEQ ID NO: 299304 - RNA, 64 nt, Human
uuagugaugugauggugcaauaaagucuucacucagucuucaugaaugcagucucaucugaaag

SEQ ID NO: 299305 - RNA, 64 nt, Human
gagagacuucacaauuauaauaaauguguggaaaagucuucaaaaaaauuucacaccuugcaaa

SEQ ID NO: 299306 - RNA, 64 nt, Human
uccacaaaugcuauucagauaaggcagaacuaggagucuucacugcucugcccccaacucccgg

SEQ ID NO: 299307 - RNA, 64 nt, Human
aggcccuuccccuuccccccaauucgauuuaaucagucuucauuuuccacaguaguaaauuuuc

SEQ ID NO: 299308 - RNA, 64 nt, Human
uguuguuagaaacauauaggaauaaugccuaggggaaagggagaagugagagggacaauugggu

SEQ ID NO: 299309 - RNA, 64 nt, Human
uuaaugaaauauuuuauucuugcauuuccauaaggaaagggaaagucaugaucauccuaaagga

SEQ ID NO: 299310 - RNA, 64 nt, Human
uaggcaaaacaaaccaauuaacaaacaaccacaagaaagggagaagaggugccugugggagauu

SEQ ID NO: 299311 - RNA, 64 nt, Human
ggugugggcaaggacaagcaggauaguggagugagaaagggaggguggagggugaggccaaauc

SEQ ID NO: 299312 - RNA, 64 nt, Human
uaacccauguaaauaggcacuuaaauagaagcaggaaagggagacaaagacuggcuucuggacu

SEQ ID NO: 299313 - RNA, 64 nt, Human
gcuuuuaaaauggagcuagaaugcuugcuggauugaaagggagugccuaucuauauuuagcaag

SEQ ID NO: 299314 - RNA, 64 nt, Human
cagcguggcucgcauucaguccuguguaggagaggaaagggaaucaaaagcuugagcacaaaca

SEQ ID NO: 299315 - RNA, 64 nt, Human
gaugggacugcccauuuccucagcugcagaggaggaaagggaaaggguaggccuguagacuaac

SEQ ID NO: 299316 - RNA, 64 nt, Human
uuugcugaggaaaaggucacuuguaaacagaggagaaagggaaagaguacaaagcccuaaguuu

SEQ ID NO: 299317 - RNA, 64 nt, Human
uuucuuuuuaauuaaaauacaagaagcagcugaggaaagggagacaagguauuuuauuucugac

SEQ ID NO: 299318 - RNA, 64 nt, Human
uagaacacuguuaggguacauacgcuaccuugaugaaagggaccuucgugcaacuguagucauc

SEQ ID NO: 299319 - RNA, 64 nt, Human
uuaaagaaagucauaguuuuuuucuuuuuuaauugaaagggacaaguaucaucuaaauauuaug

SEQ ID NO: 299320 - RNA, 64 nt, Human
acuagagagagagagaauggaacgcgaacgcuuggaaagggaacgcauucguauugaacaggug

SEQ ID NO: 299321 - RNA, 64 nt, Human
agagauggccugccaagaguugcaggagacccaggaaagggaguugcugagggcagguccccga

SEQ ID NO: 299322 - RNA, 64 nt, Human
guguccacagccucuuuucuggcuguguuuuagagaaagggauuugagcuauaggcucgccucc

SEQ ID NO: 299323 - RNA, 64 nt, Human
gcugaaggaagaggaucaccuuccaagacaaaacagucuucaugggggaaaaaugacgcuuguc

SEQ ID NO: 299324 - RNA, 64 nt, Human
aggaauaauaugcauguagaaaagaccuacuuaaagucuucauuuauauucuuucaaaucaaau

SEQ ID NO: 299325 - RNA, 64 nt, Human
aaauggaggaaaacuaagcauuggccucauguucagucuucaggauaucacaccacgucuuuuc

SEQ ID NO: 299326 - RNA, 64 nt, Human
accagagcucacugccuauuugauggcuguaacaagucuucaaguauauacuuuuauaauaagu

SEQ ID NO: 299327 - RNA, 64 nt, Human
gugauuuauuaaagaguuagccauauuucaacaagaaagggaaaugauggcuauauucauuacu

SEQ ID NO: 299328 - RNA, 64 nt, Human
cgacacagaaggggguggggcgggucuauggggagaaagggagcgaggucagaggagggcaugg

SEQ ID NO: 299329 - RNA, 64 nt, Human
ccaaaggggcagagggugguggagaggagagggagaaagggaagucccagggcccgggguccac

SEQ ID NO: 299330 - RNA, 64 nt, Human
uuccugcuggccacggagacucugcuccugcauggaaagggagccugggagccagcagcccacg

SEQ ID NO: 299331 - RNA, 64 nt, Human
ggugucugguugcccugccucuggcuccagaacagaaagggagccucacgcuggcucacacaaa

SEQ ID NO: 299332 - RNA, 64 nt, Human
ggagacggagucccaccuuggcugcagggaguccgaaagggacuuggaagcuccgcuuucuacc

SEQ ID NO: 299333 - RNA, 64 nt, Human
caugauguuuuccaugaguccccuguuuguuucugaaagggacgcuacccgggaagggggcugg

SEQ ID NO: 299334 - RNA, 64 nt, Human
cagccuugggaagugagacuagaagaggggagcagaaagggaccuugaguagacaaaggccaca

SEQ ID NO: 299335 - RNA, 64 nt, Human
ggguuggagccauggccuucugggaaccuauggagaaagggaauccaaggaagcagccaaggcu

SEQ ID NO: 299336 - RNA, 64 nt, Human
ucuuaguugaguaaacaaguaagccacaguguuugaaagggaaaaaccauauugccuugugugu

SEQ ID NO: 299337 - RNA, 64 nt, Human
cuauaucgaagugagguaggugcgguauuaaagugaaagggaaggugaugcauuuauucugggu

SEQ ID NO: 299338 - RNA, 64 nt, Human
agauccugacccaagagcaccauaacauagcuccgaaagggagagcagagauggcagcugaaac

SEQ ID NO: 299339 - RNA, 64 nt, Human
ccucaaagaagucggaaugucauagucuugaaaugaaagggaaacugggaaacuggguuucuca

SEQ ID NO: 299340 - RNA, 64 nt, Human
gugcucucucugccuggaucccggcagaagcuaugaaagggaauaaagagaaaagaaguaccca

SEQ ID NO: 299341 - RNA, 64 nt, Human
cgugcccuugcuguugcugggcaguguccuuuuggaaagggagcugccccaggcuuuagugcag

SEQ ID NO: 299342 - RNA, 64 nt, Human
uaaguacuauaugguacacagucuaugagucauuagucuucauuuuaauauguaaaaaaucuug

SEQ ID NO: 299343 - RNA, 64 nt, Human
cauuauaaagaacagcugaggcugucauuccaugagucuucagaagaaaggacagcucagaaaa

SEQ ID NO: 299344 - RNA, 64 nt, Human
guacaaagguuuuccauucuauggagaggaucccagucuucagauucucugguaaguuaauaac

SEQ ID NO: 299345 - RNA, 64 nt, Human
ucgaugcuuccagcugugccucugcugccagccaagucuucauuuggggccaaaggggaaacuu

SEQ ID NO: 299346 - RNA, 64 nt, Human
agcuagccagccacaccaaccacgccagggggaggaaagggaaggacugggagagacacaaaga

SEQ ID NO: 299347 - RNA, 64 nt, Human
cugugaaugggucucuccuggccauagaaugauggaaagggaaggucagcaggucaaagcagga

SEQ ID NO: 299348 - RNA, 64 nt, Human
ggagccuggaggagcaaagacuggggucuuuugcgaaagggauugcagguucagaaggcaucuu

SEQ ID NO: 299349 - RNA, 64 nt, Human
acagccucagggggcugucggccaagagccuggagaaagggagcaagcugcccccuccuugccc

SEQ ID NO: 299350 - RNA, 64 nt, Human
ccucuccugaaacuuaaaaacagugggaauauaggaaagggaaccaaaucucauuaauuaauug

SEQ ID NO: 299351 - RNA, 64 nt, Human
ccaccuguggagaggacuggcugcccuggaggaggaaagggaggaagucuacacagaggagcac

SEQ ID NO: 299352 - RNA, 64 nt, Human
ccuggcgguguuugugaagagggcuguccuggccgaaagggaccuccagcgcugccggaaccac

SEQ ID NO: 299353 - RNA, 64 nt, Human
gccacgcagaaagcucacgugccugcagggccaggaaagggaaaugaucguuucuuuuguauua

SEQ ID NO: 299354 - RNA, 64 nt, Human
uuuggaugcagcuugaaccaagaaaacgaggagggaaagggauucagugaacuauuccucagug

SEQ ID NO: 299355 - RNA, 64 nt, Human
gucauugguggcaggggcauagaguggucagucugaaagggaggcucucuuaagagcuaugugc

SEQ ID NO: 299356 - RNA, 64 nt, Human
caaauggugcuucagcucuaacauggaggucagagaaagggacuuggaccaauaaaaugacaug

SEQ ID NO: 299357 - RNA, 64 nt, Human
ugaauagguugguccucaucauugcaaggaaugagaaagggaggauuuugcacuccucugcuuu

SEQ ID NO: 299358 - RNA, 64 nt, Human
cucuggccugugggguuauaagugauggauagcagaaagggagaacugacuccugucccaaaua

SEQ ID NO: 299359 - RNA, 64 nt, Human
acuuuuuuucuuuuuuuuuuuuggacagaguguggaaagggagccccccaaaggauagcuucuu

SEQ ID NO: 299360 - RNA, 64 nt, Human
guggggagagauggcacaccagaugcuuuugugagaaagggaugguggagugagagccuuugcc

SEQ ID NO: 299361 - RNA, 64 nt, Human; identical to SEQ ID NO: 298965

SEQ ID NO: 299362 - RNA, 64 nt, Human; identical to SEQ ID NO: 298609

SEQ ID NO: 299363 - RNA, 64 nt, Human
gugcacaagccaggcauggcuuaaaauaucaugcagucuucacucacauacuaauuugacuuug

SEQ ID NO: 299364 - RNA, 64 nt, Human
aggaagagcugagaaugguaaggagacucuucuaagucuucaucucagagacccugaguuccca

SEQ ID NO: 299365 - RNA, 64 nt, Human
gcugcauccgugagcagugugucuccugcaugcagaaagggagcagagaaggccaggggcuuuu

SEQ ID NO: 299366 - RNA, 64 nt, Human
uaucuaacacagagacacauugcaucaacuucaagaaagggacaauuugugcagcuccaggaug

SEQ ID NO: 299367 - RNA, 64 nt, Human
ccugugggcagugggcagugggcagugucuuggugaaagggaacggauacuacuuuuugccuca

SEQ ID NO: 299368 - RNA, 64 nt, Human
aucuacuauaggaaugaaguauuuauaaaccacugaaagggauagagaagugaacauuggagaa

SEQ ID NO: 299369 - RNA, 64 nt, Human
guccugaccaggugcuccuccuuugauccgaggggaaagggacugguuuauagaaagagccuag

SEQ ID NO: 299370 - RNA, 64 nt, Human
gcauuuggcaacaggagccuggacuucugugcaagaaagggagaccuaagggugaacaguggcc

SEQ ID NO: 299371 - RNA, 64 nt, Human
uuaauuucaggcaagugaggucaauguaagaagggaaagggagaagauauuugaagaaccagaa

SEQ ID NO: 299372 - RNA, 64 nt, Human
aguaccccgcauucccaugaauagagccuccaaggaaagggaggaugggguguccuuuguugug

SEQ ID NO: 299373 - RNA, 64 nt, Human
gaauaacuuucaguaguauggcagauggcacagagaaagggaaggggcucuggggacuucuccu

SEQ ID NO: 299374 - RNA, 64 nt, Human
gcugcucccccuccaccugaguuggggugggggggaaagggagggcgagcccuugggaugccgu

SEQ ID NO: 299375 - RNA, 64 nt, Human; identical to SEQ ID NO: 299355

SEQ ID NO: 299376 - RNA, 64 nt, Human
acgccauuuuccacugaccacccuauacccugaggaaagggagacuuuccuccgauguuuauuu

SEQ ID NO: 299377 - RNA, 64 nt, Human
gagcauacagaacuugagcugaaccuggucaguagaaagggaaaccccaacccuuucuugauuu

SEQ ID NO: 299378 - RNA, 64 nt, Human
caacuggcucauggagaaaacaaauuugacuugggaaagggauuauguaggaauaauguuugga

SEQ ID NO: 299379 - RNA, 64 nt, Human
ugcaguacuggggaagggcugggcgcuuuuccuggaaagggaggccacagauucuuucccaugg

SEQ ID NO: 299380 - RNA, 64 nt, Human
gagguuccugaacaaugaauucccauuaaugagcagucuucaguauuaaaaccacugucuuguc

SEQ ID NO: 299381 - RNA, 64 nt, Human
uacagacauggaggaggggaggcugcucuggcaaagucuucaaggcuuuuggggguccaggccu

SEQ ID NO: 299382 - RNA, 64 nt, Human
ucugaugaagugauuguaguaggugucuguagcuagucuucaagaccacaccuggaagaguuuc

SEQ ID NO: 299383 - RNA, 64 nt, Human
uuuuuauuaugagaaauuucagcucagugaucaaagucuucaaauaguuaaaccaaaagaagaa

SEQ ID NO: 299384 - RNA, 64 nt, Human
cugugccagaaagaaaguuaaaauacuugcuuaagaaagggaggggggugggagggguguaggg

SEQ ID NO: 299385 - RNA, 64 nt, Human
gcgcugccuuccacccauggugauggaugguuuggaaagggaauguuggugccuuuugugccac

SEQ ID NO: 299386 - RNA, 64 nt, Human
cagcugcagagcacugcagcucccagcuccuuuggaaagggacagggucgcagggcagaugcug

SEQ ID NO: 299387 - RNA, 64 nt, Human
ucaggcugcuggaggaaaacugagacucagacaggaaagggaaggccccacagacaagguagcc

SEQ ID NO: 299388 - RNA, 64 nt, Human
guauuauuugggggagggagggauggggaggggagaaagggagauggguagcaucauuuugauu

SEQ ID NO: 299389 - RNA, 64 nt, Human
aggaggaagaaaaacaggccgagugaaggugcuggaaagggagggaggacgcgaggggaaaggc

SEQ ID NO: 299390 - RNA, 64 nt, Human
ggggggaugacggggggugggaacaagauggauggaaagggagggaaagacaagaugcaacuag

SEQ ID NO: 299391 - RNA, 64 nt, Human
gagggauggagaaagggcagaggaagagacaugagaaagggagaggaagagaagcccagcucug

SEQ ID NO: 299392 - RNA, 64 nt, Human
aagaagcagaagguuuggacgugcuagccagugggaaagggaaccugagauggagcucucugau

SEQ ID NO: 299393 - RNA, 64 nt, Human
uggcacugcuuuuuuaaggcuggggcaaaggccugaaagggagagaagauuggcgcugggugcc

SEQ ID NO: 299394 - RNA, 64 nt, Human
gucauugguggcaggggcauauaguggucagucugaaagggaggcucucuuaagagcugugugc

SEQ ID NO: 299395 - RNA, 64 nt, Human
caggggccaugaaugccgcagccuucagaugccagaaagggaaaggaauggauuccccugccug

SEQ ID NO: 299396 - RNA, 64 nt, Human
uccucagaaccugugacuguuaccuucuguggcagaaagggacagugcagauguauguaaguua

SEQ ID NO: 299397 - RNA, 64 nt, Human
caguuugggguagggcuggaggaucgcuccuguggaaagggagagccauacugcacggacguag

SEQ ID NO: 299398 - RNA, 64 nt, Human
cuucuguacacaguggacugaagugcaauuuguugaaagggaacaagucauugaagagaaaaaa

SEQ ID NO: 299399 - RNA, 64 nt, Human
uccgcccaccccggccggacuuugauccccccgaagucuucacaggcacugcaucggguugucu

SEQ ID NO: 299400 - RNA, 64 nt, Human
caaccuaauuucagaucaugucuccccugcccuuagucuucauuuaugaagugaauuauuaccu

SEQ ID NO: 299401 - RNA, 64 nt, Human
ggcaaagagaauuuuagcuucuaucgauuuuguaagucuucagcugaaccacuaauagcaguca

SEQ ID NO: 299402 - RNA, 64 nt, Human
uucagagucagaaugucugguuguugggcccaggagucuucauguuaauaagcuucucccuuuc

SEQ ID NO: 299403 - RNA, 64 nt, Human
acccccgucucuuccuucugcuuuucgguuuuuggaaagggauccaucuccaggcagcccaccc

SEQ ID NO: 299404 - RNA, 64 nt, Human
cgacucccgauuucauuugcuggccaggaaaaucgaaagggaaacacccucaauuaggaaacau

SEQ ID NO: 299405 - RNA, 64 nt, Human
acaaugcuguacaguuuuauuccucuucagacaugaaagggaacauauauauuccauauauaug

SEQ ID NO: 299406 - RNA, 64 nt, Human
aggguuugccauugcuaccaagcaagcaccacaagaaagggaggguacgccaggcgagcccagg

SEQ ID NO: 299407 - RNA, 64 nt, Human
ugaaaacuacucuuuugguuuuguuugaaaguaagaaagggaggggaaacuuugcucuuuuaau

SEQ ID NO: 299408 - RNA, 64 nt, Human
gaaugaaauaugagguuuauugaauuauuccuuugaaagggaucaaaacuuauauucaaugcac

SEQ ID NO: 299409 - RNA, 56 nt, Human
ccacgagcaucguucccugagccccagaaagggagaugaaguggaaagcuguuuca

SEQ ID NO: 299410 - RNA, 64 nt, Human
cucuuuuauuuuguaacugaagaugagacccaaagaaagggaaagcugagauuuugugccauuc

SEQ ID NO: 299411 - RNA, 64 nt, Human
uuauuuuuuaguaauuuaggggagggaggagggagaaagggauaaugaugcccuuggcauaauu

SEQ ID NO: 299412 - RNA, 64 nt, Human
ccucuuccuccggauccucuuuugaucugcccaggaaagggaugcauugacacucuccugcaug

SEQ ID NO: 299413 - RNA, 64 nt, Human
guugaaaacuuacauagacagaaaguagguuuuggaaagggaaaccacagagauuagggggacu

SEQ ID NO: 299414 - RNA, 64 nt, Human
cuccugcccuugcuugacucaguuucccuccuuugaaagggaaggagcaaaacggccauuuggg

SEQ ID NO: 299415 - RNA, 64 nt, Human
ccucagcccccaccgaggacgcagccacuggggggaaagggagacacagcggaccccggccggg

SEQ ID NO: 299416 - RNA, 64 nt, Human
cccaggugggggugucuccuggcugggaaggagggaaagggagggagaguuuugcggggguugg

SEQ ID NO: 299417 - RNA, 64 nt, Human
cuuucgagguggguuuguaccuuccuuaagccaggaaagggauucauggcgucggaaaugaucu

SEQ ID NO: 299418 - RNA, 64 nt, Human
guuaguguaggagaccaguuacagaauggccuggagucuucaacuuuugaccggugcaggugug

SEQ ID NO: 299419 - RNA, 64 nt, Human
uuuucuucccgcucuuaagacauggcuggagcucagucuucauugaaugaaguuugcuguggua

SEQ ID NO: 299420 - RNA, 64 nt, Human
caagaguaaagaauucagaaggccugucaggugaagucuucagccucccacagcgcaggguccc

SEQ ID NO: 299421 - RNA, 64 nt, Human
uaaaaccacggacagcgucugugugcgcaucuugagucuucacaccuguugacucacacggcuu

SEQ ID NO: 299422 - RNA, 64 nt, Human
ggcuggaccguaggagcgcugugcucugagcuuagaaagggagguggcggauggagugggaagu

SEQ ID NO: 299423 - RNA, 64 nt, Human
gaaagaaagaaagagagagaaagaaagaaagaaagaaagggaaagauggaaggaaggaaggaaa

SEQ ID NO: 299424 - RNA, 64 nt, Human
ugaccaauaggaagagcaaccaguuacuaugagugaaagggagccagaagacugauuggagggc

SEQ ID NO: 299425 - RNA, 64 nt, Human
gcugagucaaccuuuuauuguacaggggaugagggaaagggagaggaugaggaagccccccugg

SEQ ID NO: 299426 - RNA, 64 nt, Human
ugcacaggccugcuugugaaucaggacugaaugugaaagggaaguauugagugaggacauuccc

SEQ ID NO: 299427 - RNA, 64 nt, Human
auugccguuucaauuguggaccggcgccgagggggaaagggaggugacuucgcccgguggcaau

SEQ ID NO: 299428 - RNA, 64 nt, Human
uuaaaaauuaaaaaaaccuggcagagcccgacuagaaagggacggccucuccccuccuaccugc

SEQ ID NO: 299429 - RNA, 64 nt, Human
uuauagauuagcuaaaaguauuccuuacaagaaagaaagggacaggcucuggcuuguuaucugc

SEQ ID NO: 299430 - RNA, 64 nt, Human
uuguagaucagcuauaaguauuccuuaugagaaagaaagggacaggcucuggcuuguuaucugc

SEQ ID NO: 299431 - RNA, 64 nt, Human
ugucuuucuugugccuuuuccuuggugagcaacagaaagggaaggguuccaagccucuaaaaau

SEQ ID NO: 299432 - RNA, 64 nt, Human
caaauccauuuuaaagagaagcagacugacuuuggaaagggaggcgcugggguuugaaccuccc

SEQ ID NO: 299433 - RNA, 64 nt, Human
aaauaacuauuacuuuagaucuuuccaaaucugagaaagggaggcuagcauguguucaagguua

SEQ ID NO: 299434 - RNA, 64 nt, Human
cagcauggggcuccuggggacuggugggaucuaagaaagggaggugaguggguggaggcagggu

SEQ ID NO: 299435 - RNA, 64 nt, Human
gcugcaggcggcauaguugggcccauucguccuggaaagggacuggggggucccaacuuagccc

SEQ ID NO: 299436 - RNA, 64 nt, Human
uucucuccccugggccaggugcaagaggaacaaagaaagggacuccugcagcguccggcugacc

SEQ ID NO: 299437 - RNA, 64 nt, Human
cugcccaucuggugccacagccuugcccccgccuagucuucaucagucaagucaccacagaauc

SEQ ID NO: 299438 - RNA, 64 nt, Human
cugagaccuuuuacaugggcuuauacagggagagagucuucaauaaauguagucagcacuauuu

SEQ ID NO: 299439 - RNA, 64 nt, Human
ugauauguauuuuuccaaaugcuucaugguuaggagucuucaaguuccauguuccccagauuug

SEQ ID NO: 299440 - RNA, 64 nt, Human
aaaauguuaagcuaucugaaaaauaaaaugugcaagucuucaggauggcacaaaacaaagguua

SEQ ID NO: 299441 - RNA, 64 nt, Human
acucccuguugucccuuccauccugggcaaaacugaaagggacccggagcugggaaacccacgg

SEQ ID NO: 299442 - RNA, 64 nt, Human
gccagggggccggccuugucccgccucauccacagaaagggaggaugggcgaugacaguuguuu

SEQ ID NO: 299443 - RNA, 64 nt, Human
auggggccaaaaccaguaaacagccaccuucuuggaaagggaaugcaaaggcuuugggggugau

SEQ ID NO: 299444 - RNA, 64 nt, Human
auuaugauaaaauauuuguguauggauuagaauagaaagggauuauggauguaucuauucaauu

SEQ ID NO: 299445 - RNA, 64 nt, Human
gacccccacuaaauuucuagauuggggauagggagaaagggaggcccaggaaggucuccccuga

SEQ ID NO: 299446 - RNA, 64 nt, Human
cauccccaaacugugcccugccuucagcuuuggugaaagggagggccccucaugugugcugugc

SEQ ID NO: 299447 - RNA, 64 nt, Human
uuggggaaccuauagagaagucacagaaucccaugaaagggaauggggcaggagccaggggugu

SEQ ID NO: 299448 - RNA, 64 nt, Human
caauuacuuuucauguugggguggggacggaggggaaagggaagccuggguuuuuguacaaaaa

SEQ ID NO: 299449 - RNA, 64 nt, Human
aaccagcugccuuuguaucuuguaccuuuucagagaaagggagguaucccugugccaaaggcuc

SEQ ID NO: 299450 - RNA, 64 nt, Human
uucauucucaggcugggguggacucagaugccaggaaagggacagccucccauugucaggcaga

SEQ ID NO: 299451 - RNA, 64 nt, Human
caguuacccacucggucccaguuuuguugccccagaaagggauguuauuauccuugggggcucc

SEQ ID NO: 299452 - RNA, 64 nt, Human
gacccagagagcuccaucaccccuucugccaugugaaagggagaagacaaacauccacgaacca

SEQ ID NO: 299453 - RNA, 64 nt, Human
gggugauguuugaccuucagagccagccggcuaugaaagggagcgagccccucggcucuggagg

SEQ ID NO: 299454 - RNA, 64 nt, Human
uuugccggauacaaacugguauucuguucuggaggaaagggaggaguggaggugggcugggccc

SEQ ID NO: 299455 - RNA, 64 nt, Human
caugagaugguaaauguuuaacaauggacuuucugaaagggaaaaaccaaaagcuguuuugcag

SEQ ID NO: 299456 - RNA, 62 nt, Human
gggguugauggcauuccuuucccauucuaaacuccacgcagccaaucgcuuuccuggaggag

SEQ ID NO: 299457 - RNA, 62 nt, Human
gcucccagcacacucggagcuugugcuuugucuccacgcaaagcgauaaauaaaagcauugg

SEQ ID NO: 299458 - RNA, 64 nt, Human
cgcuaaaugggagcucaauugacaggcaucaccaagucuucaaggaggacugaguucucagggg

SEQ ID NO: 299459 - RNA, 64 nt, Human
ccgauagauccagcugaagaguucuacauacauuagucuucaagguucuucucugggcguuucc

SEQ ID NO: 299460 - RNA, 64 nt, Human
cucaugguggguucaggggacucagcccugaggugaaagggagcuaucaggaacagcuauggga

SEQ ID NO: 299461 - RNA, 64 nt, Human
aaugagggcaccgcgcagcucaguuagagacggagaaagggaagaggcugggauggucucugcu

SEQ ID NO: 299462 - RNA, 64 nt, Human
uagcaucucaucuugcauucugaucaauuggcaagaaagggagauuucaaaauuauauuucuug

SEQ ID NO: 299463 - RNA, 64 nt, Human
agucagagauucuuuuuuaauccuuggagacagggaaagggacagauagcuuuccaaggacaug

SEQ ID NO: 299464 - RNA, 64 nt, Human
aguugggucagaagagucgaugaucaccaagcaggaaagggagggaauagaggaauguguucgg

SEQ ID NO: 299465 - RNA, 64 nt, Human
gggagccuguucugucuugcaucuuccaugacaugaaagggaggcuggcacuugucagucaggu

SEQ ID NO: 299466 - RNA, 64 nt, Human
caaggcuguccacaucuggcuuuugugggacucagaaagggaagcagaacugagggcugggaua

SEQ ID NO: 299467 - RNA, 64 nt, Human
cuccagcuuccacaaacaccaucuucagcuguaugaaagggacgguuguggugaaguuugucag

SEQ ID NO: 299468 - RNA, 64 nt, Human
cuggcgggauugaaggaugcugucuucguacugggaaagggauuuucagcccucagaaucgcuc

SEQ ID NO: 299469 - RNA, 64 nt, Human
uucaauuagucucaguucucuuaauuuucaggaagaaagggaaauugcagccccucagccccca

SEQ ID NO: 299470 - RNA, 64 nt, Human
auuuaguuuauuuauuuaaaagauaaugcauccugaaagggaucauuuaugaauaacaaucuga

SEQ ID NO: 299471 - RNA, 64 nt, Human
ggguaaccuucgaggaagaagaggauuuuggugugaaagggaagucaaagucagcuuguucaga

SEQ ID NO: 299472 - RNA, 64 nt, Human
gcuggaugacuugagaugaaaaaggagagacauggaaagggagacagccagguggcaccugcag

SEQ ID NO: 299473 - RNA, 64 nt, Human
acuagacaccuucugugcucauguuuggaaagcugaaagggaaggacagcugugcccuccuggg

SEQ ID NO: 299474 - RNA, 54 nt, Human
ugguuuguuauugcagaugaaguggaaagggaaggaccucuuugauuuggugug

SEQ ID NO: 299475 - RNA, 64 nt, Human
uguaagaaaccaaaauuugcuaaauauguacaugagucuucaucacagcaucguuuaugaaaac

SEQ ID NO: 299476 - RNA, 64 nt, Human
ccccagcgccaggcgcccguccagggacacacacagucuucacugugcugcagccagaugaagu

SEQ ID NO: 299477 - RNA, 64 nt, Human
caucuccucacuucaggaaaacacaguucagcaaagucuucagaugcgauccuguguaggagaa

SEQ ID NO: 299478 - RNA, 64 nt, Human
uggauggaauuuuuggauuuauauuuguuccuugagucuucagggcagugucuccaugaggguu

SEQ ID NO: 299479 - RNA, 64 nt, Human
aggauuuagugucuuuaguuaucuugcuggaugggaaagggauguugucauuucuggcacaaau

SEQ ID NO: 299480 - RNA, 64 nt, Human
gaacccaggauaggaaauggguguguuuaguggggaaagggacggggugcagacggcagggcca

SEQ ID NO: 299481 - RNA, 64 nt, Human
aggcaggucagagcagugcagggggaggagaggagaaagggaggaagcugggcugugugguccc

SEQ ID NO: 299482 - RNA, 64 nt, Human
acaguugggcuuuguucauucuagccacggggaugaaagggaucuuuugcauugcagagauuuu

SEQ ID NO: 299483 - RNA, 64 nt, Human
cagggcaguuagccagcucaaguucuuuuucagagaaagggacuuggccagugguuuaaguacc

SEQ ID NO: 299484 - RNA, 64 nt, Human
guaaaagcacugugcuuuucagugguggcugcgugaaagggagcgacacucagcuguguguucc

SEQ ID NO: 299485 - RNA, 64 nt, Human
gaggcaguuccugcguucugcuacaaaaggaauggaaagggaagggaauuuccccccaccaugg

SEQ ID NO: 299486 - RNA, 64 nt, Human
aggagguucagacauucugcccagaggggcuggggaaagggaugggagccaggaaagauuuagg

SEQ ID NO: 299487 - RNA, 64 nt, Human
uuuuaauaauuaugcuucccaucauaacuggggagaaagggaagucaggguucuagggguuauu

SEQ ID NO: 299488 - RNA, 64 nt, Human
cagcugccagaaaacaugccuacuacuaccagcagaaagggagcagagcccagagcaucaccag

SEQ ID NO: 299489 - RNA, 64 nt, Human
cccuaccuuccuaauggcuccuccucugaggagugaaagggauuuguuugcaacgugcuuugaa

SEQ ID NO: 299490 - RNA, 64 nt, Human
cagugaccgagagucagguccagcacacaccugggaaagggaugcugccccaagggggaccaaa

SEQ ID NO: 299491 - RNA, 64 nt, Human
acuccugccacgccacugugucaugaaggaaagugaaagggaacgaggaaguaggaaugcccac

SEQ ID NO: 299492 - RNA, 64 nt, Human
aacuccacaguaaaauagguagaaucugaagauagaaagggaagaaaaguaaaaguugcuuuau

SEQ ID NO: 299493 - RNA, 64 nt, Human
uccacacagcacaaacagguuuaagcaaaugauagaaagggaaguaaggcgugugugcuaguua

SEQ ID NO: 299494 - RNA, 64 nt, Human
uuugaagggaggacgggagcuggggagaggaaagagucuucaacauaacccacuugucacugac

SEQ ID NO: 299495 - RNA, 64 nt, Human
uuaacuuuggugggggaaagaguuauaggaccacagucuucacuucugauacuuguaaauuaau

SEQ ID NO: 299496 - RNA, 64 nt, Human
ucuuuguucacaauucaguuccucccaaccaaccagucuucacuucaagagggccacacugcaa

SEQ ID NO: 299497 - RNA, 64 nt, Human
ugaaagcuuccuucuaaacugccccaaguguugaagucuucacuuuauuuuguuguuuuguuuu

SEQ ID NO: 299498 - RNA, 64 nt, Human
ccugggacaucugaaugcugauacgaauggacaggaaagggagccagagcuguauaccugggac

SEQ ID NO: 299499 - RNA, 64 nt, Human
acccauagaccccaguugaagauggaauuuucaggaaagggaaaauacuagauaauucuagaau

SEQ ID NO: 299500 - RNA, 64 nt, Human
ccccagcccacucucaugguccacacugcugggggaaagggaaaggaaaucagcaacucuucaa

SEQ ID NO: 299501 - RNA, 64 nt, Human
gugguguucuguucauguucuaucaguauaucuagaaagggaauagccauauaaauuauuuucc

SEQ ID NO: 299502 - RNA, 64 nt, Human
ucuccuuucuuaacucacuacagagugagagauagaaagggauacuugaaacugggaaaggauu

SEQ ID NO: 299503 - RNA, 64 nt, Human
guccccuagggacuguccuagccaggucuccugggaaagggagaugucaggauguugcuccauc

SEQ ID NO: 299504 - RNA, 64 nt, Human
cuacuucuggugcaguccugggacaaggacaagggaaagggaugggugaaccaguagggaagcu

SEQ ID NO: 299505 - RNA, 64 nt, Human
guaggaugaagccuuguuuugggugagacagagggaaagggaaaaaacagaauuguaacaguuc

SEQ ID NO: 299506 - RNA, 51 nt, Human
aacggaagcaggaugaauaaagaaagggagagcacaugaagcuuugcuaau

SEQ ID NO: 299507 - RNA, 64 nt, Human
aauccagaggugccuucagggcaaagaauagagagaaagggagccgcugugcuggugggguaca

SEQ ID NO: 299508 - RNA, 64 nt, Human
aaauucuucucaucuugagaacucuuauugcugugaaagggagugguugguaaaaucaauagau

SEQ ID NO: 299509 - RNA, 64 nt, Human
uggccucagagucuuuuccauucaguaagaaagagaaagggaaugcaggccaguuacuuaaaag

SEQ ID NO: 299510 - RNA, 64 nt, Human
uagcacucaauguaaucacccuauuugugacagagaaagggaaaaaaauauaauaagaucaucu

SEQ ID NO: 299511 - RNA, 64 nt, Human
agaauauacccucaggugacucccucccgauccugaaagggaaagcagcugucaccugacuucu

SEQ ID NO: 299512 - RNA, 64 nt, Human
uggcugaggcugaggacgugaaccgcgggcuuuggaaagggaggggagggagacccgaaccucc

SEQ ID NO: 299513 - RNA, 62 nt, Human
agcccugcacuccacgcuggccaagaaggccuuccacgcagaaugacaagacugcaaaaauc

SEQ ID NO: 299514 - RNA, 62 nt, Human
acagguugacuuugaauguggaccucugagcauccacgcaggauggcucucaggucccaguc

SEQ ID NO: 299515 - RNA, 64 nt, Human
ggcuaguaagggagauuguauaccuguuguccacagucuucaggcagcuccccaggucucugaa

SEQ ID NO: 299516 - RNA, 64 nt, Human
agguccucuauaaaaugaagaacuaacaaaaauuagucuucagaaaugaaaaucagaaaagagg

SEQ ID NO: 299517 - RNA, 64 nt, Human
ugaaccaccuuucuugagcucugauuauguggcagaaagggaagauuuuugaaauuugguaugu

SEQ ID NO: 299518 - RNA, 64 nt, Human
cuggcuccuuaaaugccccgucucuuuguaaacugauauucagccagcaaugccuaagacuuug

SEQ ID NO: 299519 - RNA, 64 nt, Human
gguuuauguaguuuuguugcuguacccuaacuuugauauucagggagguaggaaagguaacaga

SEQ ID NO: 299520 - RNA, 64 nt, Human
gugguuucaggcagauaguugagacuggggcuuugauauucaaggucuuuggcaagaaucccag

SEQ ID NO: 299521 - RNA, 64 nt, Human
ggggcagaggagaaggcuuucacagcuguucccugauauucaggggcauugcucauugcucccu

SEQ ID NO: 299522 - RNA, 64 nt, Human
gucauuaaauccucaucauuuuaggguugccagugauauucaguguuuagagugguucauuccc

SEQ ID NO: 299523 - RNA, 64 nt, Human
aucaguuuagcaaaucuacugucaauuuggcagugauauucaucauaauaaauaucuagaaaug

SEQ ID NO: 299524 - RNA, 64 nt, Human
gggggcggggcugucaccacgugcaguaucucaagauauucagguggccagaagagcuugucag

SEQ ID NO: 299525 - RNA, 64 nt, Human
gguuauauugcacaauugguuauauuuaugaccugauauucaaagacucuggcauugauagcca

SEQ ID NO: 299526 - RNA, 64 nt, Human
caaaugcacccaagagacaagccauuuacauacagauauucacagucacacauagaaacaccca

SEQ ID NO: 299527 - RNA, 64 nt, Human
aaaacauucuuccuccaucaguagcccuuuauuugauauucagaaguggaaagcuuuuucauuc

SEQ ID NO: 299528 - RNA, 64 nt, Human
auacuuaaaaaaaauaacuaaccuuuuaaacaaagauauucaaacucacccuugugcugaaagc

SEQ ID NO: 299529 - RNA, 64 nt, Human
cugugcagagguugacagcagggcaaguuacauugauauucauccuuuauaggcuuccugcuaa

SEQ ID NO: 299530 - RNA, 64 nt, Human
ucgcaagcagucacagagaugagcccuauuacuugauauucaggaacaaagguaccugaacauu

SEQ ID NO: 299531 - RNA, 64 nt, Human
uuuaaaaaaugauguuugaagugaaaaaaaaaaggauauucagggucaaaucauguacauuaca

SEQ ID NO: 299532 - RNA, 64 nt, Human
gagaaugaaacuauagaucaaaggaauguggaggagucuucauccacagcucuguuaaauaaau

SEQ ID NO: 299533 - RNA, 64 nt, Human
ggcucacggcagccuugcccucccuggcucaagcagucuucaucucagccuccagaguagcugg

SEQ ID NO: 299534 - RNA, 64 nt, Human
ggcuccacaaugcccacccgcaucgccauucuguagucuucagggucagcuguugauaaagggg

SEQ ID NO: 299535 - RNA, 64 nt, Human
caggaaaccaaggucugaccuaggguucccucccagucuucacaucacucuggccucaucacca

SEQ ID NO: 299536 - RNA, 64 nt, Human
aauauaacacauaucuagauuuuucugcucgcaugauauucagguuucaggaaugagccuugua

SEQ ID NO: 299537 - RNA, 64 nt, Human
ucaagugauggucauucauaucacuaugaacuuggauauucaagccuuuggauggcuauggaga

SEQ ID NO: 299538 - RNA, 64 nt, Human
gccacuuccuccacgaauagcuaccuguugaagugauauucauuguugcuguacagauccagag

SEQ ID NO: 299539 - RNA, 64 nt, Human
guuuauuguagugauguuuuuauaaaagcaaaaggauauucacuuucagcgcuuauacugaagu

SEQ ID NO: 299540 - RNA, 64 nt, Human
aacccaggcaaccagccuagaagaaacacuccaagauauucauuaagugcuuuguuucccguuc

SEQ ID NO: 299541 - RNA, 64 nt, Human
aaauacuuacauuuacaagaaucauucugagacagauauucaaugauaucuggcuucacuacuc

SEQ ID NO: 299542 - RNA, 64 nt, Human
uccguucauuauuuuuuaguuaacuacacuucuugauauucaaauguucuauuaaaaaaacuga

SEQ ID NO: 299543 - RNA, 64 nt, Human
auucucaccuacuucugagcuuauuuuuccauuugauauucauugauaucaugacuuccaauug

SEQ ID NO: 299544 - RNA, 64 nt, Human
guacaggauguaauauuaccaaccuuuaaagacugauauucaaaugcuguaguguugaauacuu

SEQ ID NO: 299545 - RNA, 64 nt, Human
ucauaauucaaguauacauuucuuuuuucuaucagauauucauugucaugcaguaguaguaaaa

SEQ ID NO: 299546 - RNA, 64 nt, Human
aauaugcagcuuaggaugcuauuuugagauguaugauauucaguucauucaccugauuacuuug

SEQ ID NO: 299547 - RNA, 64 nt, Human
cuuuuuaggccagcuuuaauuuaauggcccuacugauauucacaucgaaggugacuaacaauga

SEQ ID NO: 299548 - RNA, 64 nt, Human
uaauccaucugcaucccaaguccuauuuuauaaggauauucauaaaaauuccauggugaauccu

SEQ ID NO: 299549 - RNA, 64 nt, Human
aaaauuagaaaaaaacaaacucuacuaauuuuuagauauucauuaauaggaaagauuuaauguu

SEQ ID NO: 299550 - RNA, 64 nt, Human
caagauuauaaaaagcaaaugauugauauaauuugauauucauagaguugugccuaccuuuaau

SEQ ID NO: 299551 - RNA, 64 nt, Human
uuuacuuaguaaugcacauucaaaacacacaucaagucuucaggauaaaguucaaaaccgcugu

SEQ ID NO: 299552 - RNA, 64 nt, Human
cauuaccaggccauuuuacuuaaaucuguauuaaagucuucaguuuucucucauaguggauuuu

SEQ ID NO: 299553 - RNA, 64 nt, Human
ucugccuccauuuguuaauacagaaucaacauuuagucuucauuaucuuuuuuuuuuuuuuuga

SEQ ID NO: 299554 - RNA, 64 nt, Human
aaagcacuguccugucuuaaucuuacaugcugaaagucuucauggugauaugcacuauauucag

SEQ ID NO: 299555 - RNA, 64 nt, Human
uaucaucaauauuauuucuguuacuugaauaguagauauucaucaucaugcuuuugcacuugaa

SEQ ID NO: 299556 - RNA, 64 nt, Human
agaagcuacuuuuaaaucagaauauuuaauuuuugauauucauauaauuaauagaaguugcauu

SEQ ID NO: 299557 - RNA, 64 nt, Human
cugugaugaggucagugcucugauuuugaaggaggauauucacugaagcucauaguuauaaaca

SEQ ID NO: 299558 - RNA, 64 nt, Human
accaauguuacauuuucugaaacguagcaaacaggauauucaaaagauucuuugguggccucug

SEQ ID NO: 299559 - RNA, 64 nt, Human
uuaacaguaguaagaaggcaaagaauaaacauuugauauucagcaacugaaaauaccucacugu

SEQ ID NO: 299560 - RNA, 64 nt, Human
gcaagcucuuuuguagucuauugaauauuuuauagauauucaaaauuuccuacaaacuauaauu

SEQ ID NO: 299561 - RNA, 64 nt, Human
agaagagagguagcuuuaaagugguuuuucucaugauauucacuguuuauuauuaaagaaaauc

SEQ ID NO: 299562 - RNA, 64 nt, Human
aggugauacaguucugaauugagcauuccuuuaugauauucacucuguuccucuucugcagcca

SEQ ID NO: 299563 - RNA, 64 nt, Human
ucagucuuucuuuuuuguacauuauguggauauggauauucauggcaguuuucagccuguucuu

SEQ ID NO: 299564 - RNA, 64 nt, Human
ccaaaauaauuaguaggaguucaucuuuaaaggggauauucauuugauuauacgggggaggguc

SEQ ID NO: 299565 - RNA, 64 nt, Human
auguuuucaugauuuuaggaauuacugcuuuguugauauucaaagugugaaacuaaaacuuuau

SEQ ID NO: 299566 - RNA, 64 nt, Human
aagcugggacuccauccugccauuuuuguguggagauauucauaauucugcaauacuuuaaaac

SEQ ID NO: 299567 - RNA, 64 nt, Human
aggaauuucguuuuauguggacacacucaacuuugauauucaggagauguuuuuacaaaaugac

SEQ ID NO: 299568 - RNA, 64 nt, Human
uucuagcuaguaauaacaauauaauucuuuggcagauauucagaauaacauuuuaaacuacauu

SEQ ID NO: 299569 - RNA, 64 nt, Human
aacuguuucucuaauuauaaagcaaacuguuugggauauucagggaaacuaccccaauguuaug

SEQ ID NO: 299570 - RNA, 62 nt, Human
ucgcacacacagugauucccuccucccgucacuccacgcagcuggcagagagcacagugauc

SEQ ID NO: 299571 - RNA, 62 nt, Human
ccuauucagcgcuuugcuaggggauugggugguccacgcacucgcuaauacaguucuccagg

SEQ ID NO: 299572 - RNA, 62 nt, Human
cgcaccuccccuccucgugccugcccugccucuccacgcacaguguuaaggagccaagagga

SEQ ID NO: 299573 - RNA, 62 nt, Human
ucguggagcuggggugcgugaucuggugcucguccacgcaggugugugguguaaacauguau

SEQ ID NO: 299574 - RNA, 64 nt, Human
uaaagauucaccuaagagauucugauuugccacugauauucagaauuaugauggaagacaggaa

SEQ ID NO: 299575 - RNA, 64 nt, Human
caaaccaugagaaaacuccagccauccuggaguugauauucaccauuugugaggagaaauacua

SEQ ID NO: 299576 - RNA, 64 nt, Human
aaacggcuugcagauuauaaagagacauuugguugauauucauuaauggccccauggacuuaaa

SEQ ID NO: 299577 - RNA, 64 nt, Human
cauuucaagggcaauaccguguugguuuugacuggauauucauauaaacuuuuuaaagaguuga

SEQ ID NO: 299578 - RNA, 64 nt, Human
aucuaccuuagguuaugggcucuucuuuuaguuggauauucacauuuaucuuucaguguuaacu

SEQ ID NO: 299579 - RNA, 64 nt, Human
auugaguuggaaguauuguuuuugauauguaagagauauucagaaugcucacacugaaaaugcc

SEQ ID NO: 299580 - RNA, 64 nt, Human
agaaguccacgugaaggcugggcuaaugcuccuggauauucauuuacgaccuuccucuauggcc

SEQ ID NO: 299581 - RNA, 64 nt, Human
gucagaauaaagggagaucauagugaguuaauuugauauucauauccuggaaguauacauauuu

SEQ ID NO: 299582 - RNA, 64 nt, Human
uaugagugugaagaugcuagcgaaccuaugcucagauauucaucguaagucucccuucaccugu

SEQ ID NO: 299583 - RNA, 64 nt, Human
uauguagcauguagugcacaagcugauuuuaagugauauucagauggccuuuuaaauuuaauua

SEQ ID NO: 299584 - RNA, 64 nt, Human
gaaagaugcuaaauucuaaauauuacgguuagcugauauucauucuuuucugcuuuuccagagg

SEQ ID NO: 299585 - RNA, 64 nt, Human
cugcugguacaguuguacucuaagauugguauuugauauucacuuuacucacaaguagugcggg

SEQ ID NO: 299586 - RNA, 64 nt, Human
ucagccaacuguggcucuuaauuuauugcauaaugauauucacauccccucaguugcagugaau

SEQ ID NO: 299587 - RNA, 64 nt, Human
cauuacuuguucguuauagacauggacguuaagagauauucaaaacucagaagcaucagcaaug

SEQ ID NO: 299588 - RNA, 64 nt, Human
uuuauagcaagauauugaucaaauauagaaaguugauauucaaccucacaagggcucucaaagu

SEQ ID NO: 299589 - RNA, 62 nt, Human
cucccgccccucccccaucgugcugcaugaccuccacgcacgcacguccagggacagacugg

SEQ ID NO: 299590 - RNA, 62 nt, Human
uccucgcagccgccucucccgcuccggaucccuccacgcagcggccggagccagacuagccc

SEQ ID NO: 299591 - RNA, 62 nt, Human
uauugcaauaauguuagggacauuauaugauuuccacgcaggucacaccaucugggccugag

SEQ ID NO: 299592 - RNA, 62 nt, Human
auuuucuuuuaggauauuuagaccacccuuguuccacgcaaaccagagugugucaguguuug

SEQ ID NO: 299593 - RNA, 64 nt, Human
ccccagaaccaacagaaaucagugccaagcaugcgauauucagagucuccccagaccggcaguc

SEQ ID NO: 299594 - RNA, 64 nt, Human
uaaaaauacguaauucuuccuguuuguguaauaagauauucauauuuguaguugcauuaauaau

SEQ ID NO: 299595 - RNA, 64 nt, Human
auuuugguacaauauauaaaauggagaagagcuugauauucagguacuaaccacaacuagucug

SEQ ID NO: 299596 - RNA, 52 nt, Human
ccauggagguuuggacuuaagagauauucauuggcagcucaaagacuuccac

SEQ ID NO: 299597 - RNA, 64 nt, Human
uuuguauaugccgucaucacaaugaugauauagggauauucauaugacaagagauucaugcaac

SEQ ID NO: 299598 - RNA, 64 nt, Human
uuuaauacaauccuuagaaacucagaaauuuccugauauucauuagauuaugguguuugccuaa

SEQ ID NO: 299599 - RNA, 64 nt, Human
cagaugauccugaaagucacuuccaaguucuccggauauucacaaaacugccuuccauggaggu

SEQ ID NO: 299600 - RNA, 64 nt, Human
aucugacuucuugcagaaggaguaggcacaucaagauauucaggggugccccaagagucuggga

SEQ ID NO: 299601 - RNA, 64 nt, Human
gugaguuuauuugaacuagcagaaaguaucugaagauauucaggaauaaaguuuauacuuaaaa

SEQ ID NO: 299602 - RNA, 64 nt, Human
gaaauaguguuggaauguguuugcacagucuuaugauauucagucucagucugcuauagguauu

SEQ ID NO: 299603 - RNA, 64 nt, Human
gaaagcuauaugaugcacuaguaaaaaaaacaaagauauucaaacugcuuggguucaaauggua

SEQ ID NO: 299604 - RNA, 64 nt, Human
cucucuucugauacaaggacagaagaauuggguagauauucaccuuuuaggggugcaaguauag

SEQ ID NO: 299605 - RNA, 64 nt, Human
gccacagcagcccauggcacaacuaacaccuacugauauucacauuaaauaguaugguuuccaa

SEQ ID NO: 299606 - RNA, 64 nt, Human
ugaaauacuugucaugucuuuggccaaaucagaagauauucauccugcuucaagucagcuucag

SEQ ID NO: 299607 - RNA, 64 nt, Human
ucaggacaugguuagcaaucucaauuucauuuuugauauucaaauuaauucuuacagcuugagc

SEQ ID NO: 299608 - RNA, 62 nt, Human
ucacgcugcugugggcccgaguguguugcauguccacgcaccacccguucagggcccugaau

SEQ ID NO: 299609 - RNA, 62 nt, Human
auaggaaguugacucccagcauguaaaagugauccacgcagccggaguguaugccgggagcu

SEQ ID NO: 299610 - RNA, 62 nt, Human
cuaccuuuccauccuuuacuccaaguccccacuccacgcauccuuccucaccaacucagagc

SEQ ID NO: 299611 - RNA, 62 nt, Human
gccccacagggcaaggacacagcgcgguuuuuuccacgcagcacccuucucggagacccauu

SEQ ID NO: 299612 - RNA, 64 nt, Human
guguguugaauuuaaaaaaaaaauacuuuacuuggauauucauguaauauauaaagguuuggug

SEQ ID NO: 299613 - RNA, 64 nt, Human
gguucaacauuuuucugauauaugcaguauuacagauauucagcaaaaguauuaaugggcuucu

SEQ ID NO: 299614 - RNA, 64 nt, Human
uuuaaucaacagucauuaauaaauguacauguacgauauucaaacuuuagaauuucagcuguuu

SEQ ID NO: 299615 - RNA, 64 nt, Human
aauaugguagcucgccaaccgcaucugcucaucugauauucaaacacacaguauucgugaauaa

SEQ ID NO: 299616 - RNA, 64 nt, Human
agagucagagauaacuuugaaauuucauaaguuugauauucaguggauacaaauagaacaugaa

SEQ ID NO: 299617 - RNA, 64 nt, Human
aguagcuacuuccugaacaauguaaagugucgcagauauucaauaaaauggcaaccuguuauaa

SEQ ID NO: 299618 - RNA, 64 nt, Human
cauggaacuuuagagguagauuuaauacgauuaagauauucagaaguauauuuuagaaucccug

SEQ ID NO: 299619 - RNA, 64 nt, Human
gaauucacaauuaaagcaguguguauagaauuaugauauucagaauccugcaucuuuuaaugug

SEQ ID NO: 299620 - RNA, 64 nt, Human
acuuuguucuucuuauauauuuuuucagugccgggauauucauauuccuaaagccacuauugug

SEQ ID NO: 299621 - RNA, 64 nt, Human
uggccugccagccucucuugacuacagaauaacugauauucacccaccaaacagaaaaagugaa

SEQ ID NO: 299622 - RNA, 64 nt, Human
acucuacccaugcugucuccacuucacaauauuugauauucaggagcauuuuccugccagucag

SEQ ID NO: 299623 - RNA, 64 nt, Human
agacuuuaaagcccaaauaaucauuuuucacauugauauucaagaauugagauagauagaagcc

SEQ ID NO: 299624 - RNA, 64 nt, Human
ucaguaggugcucuggagggacucggcaccacuugauauucaacagccacuugagccaaauaua

SEQ ID NO: 299625 - RNA, 64 nt, Human
uacguguguguguguguguguuaccauggaaaaggauauucacaguaguacaguucucaauauu

SEQ ID NO: 299626 - RNA, 64 nt, Human
gcuucuaaaaggcguauaacugugugaguggccagauauucacuuuuuaaaucaaaaaccucuc

SEQ ID NO: 299627 - RNA, 62 nt, Human
gaaaccaguuaagaauggaagaaaacggugcauccacgcacacauggacacagacccacaca

SEQ ID NO: 299628 - RNA, 62 nt, Human
auaagccaccauucuguggaaccaaggcccccuccacgcaaacacccucccuccuggggacc

SEQ ID NO: 299629 - RNA, 62 nt, Human
gagaaguaacugagccugcgcuugagaccuucuccacgcagcaggaagaucccaccgacccu

SEQ ID NO: 299630 - RNA, 62 nt, Human
ccuggcgcagaaccuaccugaugcgguuccucuccacgcaucucgaggcggcguuaccucca

SEQ ID NO: 299631 - RNA, 64 nt, Human
ugguuuuguuuguauuugagagcucuuguuagcugauauucauguuugaggucauaaaauuguc

SEQ ID NO: 299632 - RNA, 64 nt, Human
uuggggaaaauuaacuuuuucuuuugauaaguaugauauucaauaaaauuuucuaaauaggaau

SEQ ID NO: 299633 - RNA, 64 nt, Human
uuauuuuuuuuaauauuguugcugauuucagagggauauucacuaauaaauguaugauguauac

SEQ ID NO: 299634 - RNA, 64 nt, Human
acuuucaggccagcuuuaauuuaauggcccuacugauauucacaucuaaguugacuaacaauga

SEQ ID NO: 299635 - RNA, 64 nt, Human
agguuuuucuuugacguuuaaaacugugacaacagauauucacauuugauuauagaaacuuaau

SEQ ID NO: 299636 - RNA, 64 nt, Human
cuggggaagcagaacugcagugacccacuucaaagauauucagaggcugagcggugcagggagu

SEQ ID NO: 299637 - RNA, 64 nt, Human
ggaguguuauauuacuaugcuaucuuuagcugaugauauucauugagccuggaaaaauacaagc

SEQ ID NO: 299638 - RNA, 64 nt, Human
auacuuuuaaaaaaaagauuugcuaagaucaaaggauauucagaggugcaucuuuuucuguaag

SEQ ID NO: 299639 - RNA, 64 nt, Human
cauguaucucaucauuggaaguaagaucagggcugauauucaccugggauagacaguauuggug

SEQ ID NO: 299640 - RNA, 64 nt, Human
acaggaaguuacuucaagcacuugccaguacuaugauauucaaguaccuugcagcauuucucug

SEQ ID NO: 299641 - RNA, 64 nt, Human
gaucacacuguagugauauaguagaagcagugaugauauucagauuguuuuauuuugauucaaa

SEQ ID NO: 299642 - RNA, 64 nt, Human
agacuauauguuuugaaguuugauauuauaaugggauauucauuuuuuguucuuuucuugacuc

SEQ ID NO: 299643 - RNA, 64 nt, Human
auaaaggaaacacguuuagaaaugauuucaaaaugauauucaaucuuaacaaaagugaacauua

SEQ ID NO: 299644 - RNA, 64 nt, Human
ugacaaccuacuuugcuuggcugagugaaggaaugauauucauauauucauuuauuccauggac

SEQ ID NO: 299645 - RNA, 64 nt, Human
uacaguagccuguaaauaaaacacucuuccauaugauauucaacauuuuacaacugcaguauuc

SEQ ID NO: 299646 - RNA, 62 nt, Human
acaucucaugaagccauguucaggguaggagcuccacgcacaucaccacccauugucaggug

SEQ ID NO: 299647 - RNA, 62 nt, Human
auaagaacugaucuggcugccugaugaguguuuccacgcagcccugcauauuuagugaccaa

SEQ ID NO: 299648 - RNA, 62 nt, Human
aggcugccuucugacaugcgcuggggcuucucuccacgcauuuagacaaaaaaagcacagga

SEQ ID NO: 299649 - RNA, 62 nt, Human
aauaagauccugugauuuuucucaccugcuuuuccacgcacuguggucaucacugugcaauc

SEQ ID NO: 299650 - RNA, 64 nt, Human
accgugccuggcacuuuuuugccuucuuaauggagauauucaguuuucuuuuuuucauuuaaac

SEQ ID NO: 299651 - RNA, 64 nt, Human
uucaucauucauguaacauucucacacaguugaggauauucaucuccucaccaauuccagauug

SEQ ID NO: 299652 - RNA, 64 nt, Human
agaaaauuguuucaugaguucacuuaacuacugagauauucagagcauuuuuaccucucucuua

SEQ ID NO: 299653 - RNA, 64 nt, Human
ccuaacuccaaagccugcguucucaucccagucugauauucaccuaaguuuccggacccuuuuc

SEQ ID NO: 299654 - RNA, 64 nt, Human
uucuuuguggauaaaacuuucaaaagcaauuuaagauauucauaguguuaggaaacaccaaacc

SEQ ID NO: 299655 - RNA, 64 nt, Human
ucuuaaaauucuaucgaaauaaucuucaugcagagauauucaggguuuggauuagcaguggaau

SEQ ID NO: 299656 - RNA, 64 nt, Human
uucuccuuuuccugguugaacucccuaaaugaaugauauucauuccaacugcugccccucuguc

SEQ ID NO: 299657 - RNA, 64 nt, Human
uuacuaacuuaucugucucuuauuugcacucauggauauucacaguaagcauuguuugacauau

SEQ ID NO: 299658 - RNA, 64 nt, Human
ggcuauuuacacuguaaugaauuauaccauauaugauauucacucaguaauguuaauaaugaac

SEQ ID NO: 299659 - RNA, 64 nt, Human
uucuagcaucacuguuaaggcugugauuauguuugauauucaccuggauuuuaauacaagccaa

SEQ ID NO: 299660 - RNA, 64 nt, Human
ucccuucacaaagaguauaugcuaguuucuuguagauauucacagcucauuuuagagcucugua

SEQ ID NO: 299661 - RNA, 64 nt, Human
uuggauaucaguguuccucaugaagauauacauggauauucaauuuugauggcuuccagauuug

SEQ ID NO: 299662 - RNA, 64 nt, Human
aaaucguaauucaugguugaguuucagaacaaaagauauucauugcacauuaaccauuuagagg

SEQ ID NO: 299663 - RNA, 64 nt, Human
gauuagcauguuuauucccucacuacccccaggagauauucacuguaaugaauaugucuuuggc

SEQ ID NO: 299664 - RNA, 64 nt, Human
uuaagauuaaacuuguuuccauucucuucacauggauauucauccccauguuuaacugacacac

SEQ ID NO: 299665 - RNA, 62 nt, Human
uccugucucugaaguuuggaucauuuuauagauccacgcaauagagagcuuccuuccuauga

SEQ ID NO: 299666 - RNA, 62 nt, Human
ccgccucuggcugcgcacucccgaccgcgacguccacgcagcagagggacaugggccauucc

SEQ ID NO: 299667 - RNA, 64 nt, Human
gaauauuuggauccauguuccucuugugacccugagucuucaugcaaggagaucugaagcugaa

SEQ ID NO: 299668 - RNA, 64 nt, Human
cauuguaguagaguguaaaccuuuucccaugcccagucuucaaauuucuaauguuuugcagugu

SEQ ID NO: 299669 - RNA, 64 nt, Human
uggguucauuuuuuguuuuguuuuuuucaaucaugauauucagaaaaauccaggauccaaaaug

SEQ ID NO: 299670 - RNA, 64 nt, Human
ucucucucaucggggucauuugcuauuccccucugauauucaacccuauagaaggagccuggac

SEQ ID NO: 299671 - RNA, 64 nt, Human
guagaauguauucagcuguuuaacauguaguuuagauauucaaaaguaugcauguagaauuuaa

SEQ ID NO: 299672 - RNA, 64 nt, Human
uuuccuguggccugguccuauagccaaaaucacagauauucaugaguuucuacuugagugagaa

SEQ ID NO: 299673 - RNA, 64 nt, Human
ucaaagacagaaugguggaguguagccuccaccugauauucaggcuacucauucagucccaaau

SEQ ID NO: 299674 - RNA, 64 nt, Human
aaagaaauaucaaguaacuugccaaagguuacaagauauucauuccauggaugcacaaagaagu

SEQ ID NO: 299675 - RNA, 64 nt, Human
gugcaggggugugugugugugggggggguucccagauauucagggcaagggaccagucggaagg

SEQ ID NO: 299676 - RNA, 64 nt, Human
aauuaaugauaaaauuggcgcuuguuuuauuuucgauauucaaugcacuuuauguagcauugaa

SEQ ID NO: 299677 - RNA, 64 nt, Human
auuuugccucuuucacaaaaauaacucugaguuugauauucaaguauauuuuaaaaaucaaggg

SEQ ID NO: 299678 - RNA, 64 nt, Human
agcagcugaggauacaaaugugcugguagggagcgauauucaagauauauugugaagugugaaa

SEQ ID NO: 299679 - RNA, 64 nt, Human
gaaauaguguggaaauuaagaagaaacuaggucugauauucaaauggacaaacugccaguuuug

SEQ ID NO: 299680 - RNA, 64 nt, Human
uuucauuuguaauuggaaaaaauccaauaaaaaggauauucauuuagaaaauagcuaagaucuu

SEQ ID NO: 299681 - RNA, 64 nt, Human
uaucuguaucuuacggcuuccauaauggcuaguugauauucaaaaaccuauuucuguguuuuga

SEQ ID NO: 299682 - RNA, 64 nt, Human
agcaaaucaggaaugcaaggcuuguucaacauuugauauucaguguaauccauugcaugcauua

SEQ ID NO: 299683 - RNA, 64 nt, Human
cucuguacuucugagagaacacaucacuugugaggauauucauugugagguucuacuagugaaa

SEQ ID NO: 299684 - RNA, 62 nt, Human
ugccuaacucauacuuucccguugacacuugauccacgcagcguggcacugggacguaagug

SEQ ID NO: 299685 - RNA, 62 nt, Human
ucugcccccucuuuaaaaucgaucuacacacauccacgcacaugcgaccccgaggaaacgaa

SEQ ID NO: 299686 - RNA, 62 nt, Human
cuccuggguucuuaagggagcgaggcuuuggguccacgcacaggaucgcgcgcgggaucgca

SEQ ID NO: 299687 - RNA, 62 nt, Human
guagcaggacccuucauccugaacugccuuccuccacgcaggacaagucuuagcuuuuuugg

SEQ ID NO: 299688 - RNA, 64 nt, Human
uucuuguucauacucaaauaguaguuauuuugaagauauucaaacuuauauugaagaagugacu

SEQ ID NO: 299689 - RNA, 64 nt, Human
augcaauugcugcuaguucaguuacauuucugcugauauucagcaaauuucuaaguuuauggug

SEQ ID NO: 299690 - RNA, 64 nt, Human
ugcuaacugaauaucauugcagcaacuagacuaagauauucaagaucucuuuauuggggauggg

SEQ ID NO: 299691 - RNA, 64 nt, Human
uaccccccuucuugacuuuuucugauaauuagcugauauucaugguuguuuagcacacaguuca

SEQ ID NO: 299692 - RNA, 64 nt, Human
uugcagccauaguaccuuuuugcguaauguuugggauauucaguagcccaggauugcuacaaaa

SEQ ID NO: 299693 - RNA, 64 nt, Human
uuuuaaacauuacacuugagaucagucaugacuugauauucagguaaauuuucuuuuccaagaa

SEQ ID NO: 299694 - RNA, 64 nt, Human
gaagucuuucuucccccaacucuugaacgaugaugauauucagacgaagcauugauguuaugga

SEQ ID NO: 299695 - RNA, 64 nt, Human
aaucaaagaauauugugacacaugaaaauuauaugauauucaaauuucaguguccauaaauaaa

SEQ ID NO: 299696 - RNA, 64 nt, Human
agcaaaucaggaaugcaagccuuguucaacauuugauauucagugcaauccauugcaugcauua

SEQ ID NO: 299697 - RNA, 64 nt, Human
gguuugauucugaaaucuuucuaccuguugcaccgauauucaaauaaaaaugauagacacagaa

SEQ ID NO: 299698 - RNA, 64 nt, Human
uuuccugauaaaugccuuuuagagauagguucuugauauucagacaucugcagaaauguucugg

SEQ ID NO: 299699 - RNA, 64 nt, Human
gaauuuucuacccuuggcaugaggggaaaugauugauauucaagcaaguucucuaggaaaaaaa

SEQ ID NO: 299700 - RNA, 64 nt, Human
guauuccuguuuauuuauuuacugccacgcuacugauauucagaccuucaugaucauccaucug

SEQ ID NO: 299701 - RNA, 64 nt, Human
gaggccaguucuuccauaaggaaggcugguuauggauauucauaagguuauuucaaaguuaaua

SEQ ID NO: 299702 - RNA, 64 nt, Human
agauauuuuuaguauaugaaguuauccaggacuugauauucauaauucagugcuguggaaauga

SEQ ID NO: 299703 - RNA, 62 nt, Human
acugguugggggcaggaucauucugccccuuguccacgcacccccaccagcccucucgcuuc

SEQ ID NO: 299704 - RNA, 62 nt, Human
gaggccaggucugucccggcuggagaacagcguccacgcaguccugccuggggucaggcccu

SEQ ID NO: 299705 - RNA, 62 nt, Human
gaaaccgucugccuggcucccugucuucauucuccacgcagccuggugauggcaggccuggg

SEQ ID NO: 299706 - RNA, 62 nt, Human
gcacgggagccaggcgcuguggacagggucuguccacgcaccaccuggggucugccgccuau

SEQ ID NO: 299707 - RNA, 64 nt, Human
cuaggcuuguccugagaacaucccucaguaacuugauauucacaugaccuacaggaugucccau

SEQ ID NO: 299708 - RNA, 64 nt, Human
ugaccccaugcuccgucauuugacaggggcucaggauauucacucugugguccagagucaacug

SEQ ID NO: 299709 - RNA, 64 nt, Human
ccccagguaaaccugcauuguagcaauuuguaaggauauucagauggagcacugucacuuagac

SEQ ID NO: 299710 - RNA, 64 nt, Human
acugaaaacugaguuaacaagaugaaaucuaaaggauauucacagugacuucaauucaggaaga

SEQ ID NO: 299711 - RNA, 64 nt, Human
ccuucacaguucuuaauaccuguuuuguaaucaugauauucagucaaggcauuaugguuuuuaa

SEQ ID NO: 299712 - RNA, 64 nt, Human
uuaaaaaauguacuugcacaaggaaggaucuucagauauucaugcacugaaaaaugcuguuauc

SEQ ID NO: 299713 - RNA, 64 nt, Human
ggguuguauacagacucugugcacuauuucacuugauauucauuccccaauucacugcaaggag

SEQ ID NO: 299714 - RNA, 64 nt, Human
gaaauuggcagcugggguacuuucaguuuggacugauauucaucacaccucagauaaaaugcag

SEQ ID NO: 299715 - RNA, 64 nt, Human
uuuuuucacuuuuacuuaaacauaauauauaauggauauucauuuauacugauuuaugaaagua

SEQ ID NO: 299716 - RNA, 64 nt, Human
auuucuuucuccucucgaaccacuagucagccuggauauucaugaaagcugaaagaaggggugc

SEQ ID NO: 299717 - RNA, 64 nt, Human
uucaccccaguuuuuccuccagguuguuacuaaggauauucagggaugaguuuaaacccuaaau

SEQ ID NO: 299718 - RNA, 64 nt, Human
acuuccaaauaaauaauuuucauuuugcacugaggauauucagauguaugugcccuucuucaca

SEQ ID NO: 299719 - RNA, 64 nt, Human
auggaaacugaaaauggacucucuuugugacaaagauauucaacagaaaauauugacccugcau

SEQ ID NO: 299720 - RNA, 64 nt, Human
ucuuuuuaggaucauaaacauaaauagguuuguugauauucaggccuucagaauuuaaggguuu

SEQ ID NO: 299721 - RNA, 64 nt, Human
aguauuauuuacugcuauugggaucuauucuucagauauucaaaaacauuuuuugcuuuaaaau

SEQ ID NO: 299722 - RNA, 62 nt, Human
accuuugguugcugcauuccccuugguucgauuccacgcaaggagccacaagugagaacucc

SEQ ID NO: 299723 - RNA, 62 nt, Human
caaccaauggcacccagagagggcauggaggcuccacgcaaccccuuccacccccacaucuu

SEQ ID NO: 299724 - RNA, 62 nt, Human
uuggcccaggaaugcgugaccccugagauggguccacgcaucucucuacacuuccuucucuc

SEQ ID NO: 299725 - RNA, 62 nt, Human
ccugguucacauguggcacugaccgcgucacauccacgcacucccaaaggccagaaguaucu

SEQ ID NO: 299726 - RNA, 64 nt, Human
auaagcugcuguguguggaauugcuaaaggucaagauauucagugagaccagcuuaaaugaaua

SEQ ID NO: 299727 - RNA, 64 nt, Human
uaucaaaaguauucaugaugacucuauuuggaaugauauucagggaaaucacaauaauauagca

SEQ ID NO: 299728 - RNA, 64 nt, Human
auaauguguccuucuacauuuuauuacacuaaaugauauucauauucaagcaacagcacuuucu

SEQ ID NO: 299729 - RNA, 64 nt, Human
aggacaauuacuguacacauuaagguguaugucagauauucauauugacccaaauguguaauau

SEQ ID NO: 299730 - RNA, 64 nt, Human
augcagcagauguugacuaaaggcuugguugguagauauucaggaaauguucacugaauaaaua

SEQ ID NO: 299731 - RNA, 64 nt, Human
aguguaccauugguaguuguuuaugaaauuaccagauauucauaaaugugacaaaugaacagca

SEQ ID NO: 299732 - RNA, 64 nt, Human
gucaggaacuggucacuuugaaugugggagggaagauauucacgacaagguuuucuacgauaaa

SEQ ID NO: 299733 - RNA, 64 nt, Human
aaaugccaagagugcagcgguggggugagauucagauauucauuuauuucuaagucuguaguua

SEQ ID NO: 299734 - RNA, 64 nt, Human
uuagcacuucaacauagcucuuaacaacuuccaggauauucacacaacacuuaggcuuaaaaau

SEQ ID NO: 299735 - RNA, 64 nt, Human
aauccauuucuuuuagaaaaaauuagggugauaggauauucauuaguuaagaugguaacgucau

SEQ ID NO: 299736 - RNA, 64 nt, Human
acucuaaagccaagcacuuuauauuuuccucuuagauauucacuaaggacuuaaaauaaaauuu

SEQ ID NO: 299737 - RNA, 64 nt, Human
uuuuuuuuuuuuaacuucaguggaauuuacuuuagauauucauucaucaaauacaugggacuuc

SEQ ID NO: 299738 - RNA, 64 nt, Human
uuauuuauguuuuaagaugcaaagauguguguuugauauucacuuuaauaauuagaaauggauc

SEQ ID NO: 299739 - RNA, 64 nt, Human
aaacuuuucuaaauccuagugaugaggaugugcugauauucaacauaguccuuaaagugaaaac

SEQ ID NO: 299740 - RNA, 64 nt, Human
uauguuuucgcuuuuguauuuuaagcuuuacuuagauauucaaaaccugguauaucaagucucu

SEQ ID NO: 299741 - RNA, 62 nt, Human
agccaagcccaguucucuggguugugcuuuacuccacgcaucaauaaauaauuuugaaggcc

SEQ ID NO: 299742 - RNA, 62 nt, Human
acuccucucuuuuccuguagcguguggaccgguccacgcaauucuuuauccugugaacucau

SEQ ID NO: 299743 - RNA, 62 nt, Human
cugucacuuuggacccuaugggagugggcaucuccacgcaccuguguaugugaaagucauuu

SEQ ID NO: 299744 - RNA, 62 nt, Human
gaccuggggccccagcauccuggagcacacgcuccacgcacacacaccccagcccuguccca

SEQ ID NO: 299745 - RNA, 64 nt, Human
aaggaaaaaaauaauaccuuuaaaaaauaauuuagauauucauacuuuccaacauuauccugug

SEQ ID NO: 299746 - RNA, 64 nt, Human
uuaaauuauaucauauuuugaaaauguaauuacugauauucaaaauaaauuaaaggacuuaaaa

SEQ ID NO: 299747 - RNA, 64 nt, Human
agaauguacaacagugucacuuguuaacgagacugauauucaacaggcuucuaagaauauguau

SEQ ID NO: 299748 - RNA, 64 nt, Human
uguggcauagcauaaccacaguaagaacagaacagauauucagcagaaaacuuuuuauacucua

SEQ ID NO: 299749 - RNA, 64 nt, Human
guuggugcaauauuuuauuaucauuuaaccucaggauauucagaccaacaggauuguguugcug

SEQ ID NO: 299750 - RNA, 64 nt, Human
gcuaauaaagaaagagaauagaaaacacgcaugagauauucagaaaauacuagccuagaaauau

SEQ ID NO: 299751 - RNA, 64 nt, Human
ggcauaaaaauaguuuccuagguaaggggugugagauauucaaagaauacauguggcuaacaag

SEQ ID NO: 299752 - RNA, 64 nt, Human
ucgggaaagaaaugccugggaggaagggaagccugauauucagggucaaaacagcccuucuaau

SEQ ID NO: 299753 - RNA, 64 nt, Human
gcucuggggcugaaggauuccagccucucugccagauauucaguacucgaucucaauuccccuc

SEQ ID NO: 299754 - RNA, 64 nt, Human
uggauuucgcuaucaguucccauccuuaaguuuugauauucaauaucugauagauacacugcau

SEQ ID NO: 299755 - RNA, 64 nt, Human
auaaaguaaaugcuuguuucauuuuuaagcugcugauauucauuccuuauuguauguugucaga

SEQ ID NO: 299756 - RNA, 64 nt, Human
guacuuuagacacuaugaauuuauauauaggcaagauauucauucauucauaaacuauugccua

SEQ ID NO: 299757 - RNA, 64 nt, Human
cauucaaguguacagugaaaagucucccuuuccagauauucaagucaccuccuuaaagguaguc

SEQ ID NO: 299758 - RNA, 64 nt, Human
gauaaagaguaauuacuacaaacuaaugauuaaugauauucauauaucucuaagaucuauaucu

SEQ ID NO: 299759 - RNA, 64 nt, Human
caugcucaggacaguugcgcagggacuccugggagauauucaggagccucacacuguucagacg

SEQ ID NO: 299760 - RNA, 62 nt, Human
gccuccuucccugccugcccaccccuccaugcuccacgcaggcacucacgcuaggacagcau

SEQ ID NO: 299761 - RNA, 62 nt, Human
aucaaccuggcaaaaaugcaacaaaugaauuuuccacgcaguucuuuccaugggcauaggua

SEQ ID NO: 299762 - RNA, 51 nt, Human
aauguuacauauuugauugaaagucuucaauuuguuaacagagcaaauuug

SEQ ID NO: 299763 - RNA, 64 nt, Human
cuacucuauuuauaucuacauuuccuuccagcugagucuucaaauuuagcauuauuuugacacu

SEQ ID NO: 299764 - RNA, 64 nt, Human
uucuguuacgaacucuaagagggcugaaacuucugauauucagguggaucaccugaauucucuc

SEQ ID NO: 299765 - RNA, 64 nt, Human
ugaaccuucuauuucacuaccgcucccuguuuuagauauucagauuuaaaagguuuucaaagaa

SEQ ID NO: 299766 - RNA, 64 nt, Human
uguaacaauaaaucacagccacuugacaagaaaggauauucauuauuuucaaauggcuuuugga

SEQ ID NO: 299767 - RNA, 64 nt, Human
ugugaauguauauagucuuugcagagguccaaaugauauucaugaugguaauaaacgagauguu

SEQ ID NO: 299768 - RNA, 64 nt, Human
ggcacccgaucaauggcuuaaaucugucguuuuugauauucagguuuccucaauuuagccuuag

SEQ ID NO: 299769 - RNA, 64 nt, Human
cagaagggugaagaagugagcagaggcuuaugaagauauucagauacucuucuaugccaggaag

SEQ ID NO: 299770 - RNA, 64 nt, Human
cccuggaaaaacagucacugacucaagacacugagauauucagcccacugcccaaugccugcuu

SEQ ID NO: 299771 - RNA, 64 nt, Human
ugagaaaucagaauuggcauaauuugucuuaguugauauucaaggcuuuaaaagucauuauucc

SEQ ID NO: 299772 - RNA, 64 nt, Human
uauuggcauuaaagcuucagaaaucucugcguuugauauucaaacaucauaugccggaaauuuu

SEQ ID NO: 299773 - RNA, 64 nt, Human
gccaaauccagaagaacccauagaugaagaugaagauauucaaacagaaagaauaagaacagcc

SEQ ID NO: 299774 - RNA, 64 nt, Human
auuuguuuacuuuuuguagauuugcuuuauccaugauauucaguacaacucugucauuucuuug

SEQ ID NO: 299775 - RNA, 64 nt, Human
ucaaagcuuucuuuuuaugcuguaugugacuauagauauucauauaaaacaagugcacgugaag

SEQ ID NO: 299776 - RNA, 64 nt, Human
ugaauuguguuuucagguuuuguuuuuaguaggugauauucauucguauccagcucuuuauuac

SEQ ID NO: 299777 - RNA, 64 nt, Human
gaugaaaccccuccaggugggguuggggagacuugauauucacauccaacaguuugaaaaggga

SEQ ID NO: 299778 - RNA, 64 nt, Human
gguuuauuaagcucuucuauauuaaacacuaauagauauucaauaacggaguaaacuguuccag

SEQ ID NO: 299779 - RNA, 62 nt, Human
aucugugcacuuaccguagguagggacacguguccacgcaccacagacacacccacgacacc

SEQ ID NO: 299780 - RNA, 62 nt, Human
ggcuggaugguaggaagggaugugcccgccucuccacgcacucagcuauaccucauucacag

SEQ ID NO: 299781 - RNA, 62 nt, Human
gccucagugugcccuguugaaacuuagguuuuuccacgcaaucgauggauuguguccuagga

SEQ ID NO: 299782 - RNA, 62 nt, Human
ucccauagcuggugaaggacaccuccauccauuccacgcaguugcucaaagcagaaauuuuc

SEQ ID NO: 299783 - RNA, 64 nt, Human
cuauuuauuagaagaguuggauaaauuuucauaagauauucaauaucuccuucagauuaccagu

SEQ ID NO: 299784 - RNA, 64 nt, Human
gaagcaaaaauuugaaccuuuugacuuggcuauugauauucauucuacuugcucacaugguggu

SEQ ID NO: 299785 - RNA, 64 nt, Human
ucucacuuagccuguugacucuuguuauuaucaugauauucacaaaacgccgcauguuuaaaaa

SEQ ID NO: 299786 - RNA, 64 nt, Human
gauuccagcacccucaggaauaccuauauucagagauauucaagucccugauauuaaaaacagc

SEQ ID NO: 299787 - RNA, 64 nt, Human
aaaauauauuuuugcagauacauuaaauaugaaagauauucaauccaaaauuaagucuauguaa

SEQ ID NO: 299788 - RNA, 64 nt, Human
uucgauaaaauauauuuaauagaaauuugcguuugauauucaugaacaugaauacauguauuuu

SEQ ID NO: 299789 - RNA, 64 nt, Human
aggggcaagaaggaaaagaaacagcagcagguuugauauucagaaagaaauaugcauggauuca

SEQ ID NO: 299790 - RNA, 64 nt, Human
gggaaagugcuuaugaauggugcagguugacucugauauucauucccaaaugacaguauggcag

SEQ ID NO: 299791 - RNA, 64 nt, Human
ugaagagguuauguccugucagggaaccagccccgauauucacauagguucuuuucuauuuucc

SEQ ID NO: 299792 - RNA, 64 nt, Human
ugcuuucccuguuuucuggcacauucuacccugagauauucagcggcauaugcacugaugaugc

SEQ ID NO: 299793 - RNA, 64 nt, Human
acacucgaaccaaaagaugccucaaucccauuuugauauucauuuuagugaaaggaugcaucag

SEQ ID NO: 299794 - RNA, 64 nt, Human
aucuaaaucacaauugaguauauaaucauugagcgauauucauuuuuccaaucaguaugggauu

SEQ ID NO: 299795 - RNA, 64 nt, Human
gaauaaaaauaguugagcugauauauguuaagcagauauucaaucagaaugaacagguuccggu

SEQ ID NO: 299796 - RNA, 64 nt, Human
gaaacguuuuguauaguuauauguacaguuuauugauauucaauaaagcaguuaauuuauauau

SEQ ID NO: 299797 - RNA, 64 nt, Human
uguguuuugggagaugucaccuaaccaggacauugauauucaaucccaucccccuuccucccac

SEQ ID NO: 299798 - RNA, 62 nt, Human
agacacagauuuccugcugggggagggaggaguccacgcauccugaugcugccuggaagcuu

SEQ ID NO: 299799 - RNA, 62 nt, Human
ggcuggggggcggggcuggaggggaaggaguguccacgcaucaauaaagauuuaacgaacug

SEQ ID NO: 299800 - RNA, 64 nt, Human
gggugacuuagucugaugguuuguggaccauagaagucuucaccucugguuugaggugcagggc

SEQ ID NO: 299801 - RNA, 64 nt, Human
ccauuuuaagaaccgugcagauuuugcuaccaaaagucuucaccacuguguucuuaagugaaug

SEQ ID NO: 299802 - RNA, 64 nt, Human
auaucauuaauccugcauuacuuagaucccauaugauauucaggaauauauucauucaauauuu

SEQ ID NO: 299803 - RNA, 64 nt, Human
aauuguuuaguuguuuucuccccugauuaauggugauauucaaguaugauacaaaaagaauugu

SEQ ID NO: 299804 - RNA, 64 nt, Human
cuaccccauuggcucagagcuagggcaaacagcagauauucagacuuuauuacuuaacuagcgg

SEQ ID NO: 299805 - RNA, 64 nt, Human
acuuugaaauagaacuuucaaagcaaaaacuugagauauucaaaaauugugauuccccaacacc

SEQ ID NO: 299806 - RNA, 64 nt, Human
ggucuuaaauuguugcaacucauuagcuagugaagauauucauguaaauauauuuuaggauugu

SEQ ID NO: 299807 - RNA, 51 nt, Human
agaugggacagagaccuugaugauauucacacacauucaggaaccuguuuu

SEQ ID NO: 299808 - RNA, 64 nt, Human
aagugggacaagggugucuccuucauuacuuaaagauauucaugagggugggucacuacagaug

SEQ ID NO: 299809 - RNA, 64 nt, Human
cccaggggcggggaaggcauggcuugcuggccaggauauucagagguaggcagccaaagggcac

SEQ ID NO: 299810 - RNA, 64 nt, Human
gucaugucucagugucuaucuguauauauuauuugauauucagagaaucuaaagcacucgucua

SEQ ID NO: 299811 - RNA, 64 nt, Human
uaaagacugagcagaacugaaaaauuacuuauuggauauucauucuuuucuuuauauugucauu

SEQ ID NO: 299812 - RNA, 64 nt, Human
gaaaaugaaaaauuugaagauuugagagcaugaagauauucaugcuuuugaacucaaaauauug

SEQ ID NO: 299813 - RNA, 64 nt, Human
aaauacuguuucuacucauucaaagcacauuguagauauucagagagaagaacaaauggcuggc

SEQ ID NO: 299814 - RNA, 64 nt, Human
guucuccuaacuucuguugauuacuacuuuaagugauauucauuuaaaacauugcaaauuuauu

SEQ ID NO: 299815 - RNA, 64 nt, Human
aucaauaaguguaguuguaaugucaaaucaauaagauauucacacuccucaauaacauuauauu

SEQ ID NO: 299816 - RNA, 64 nt, Human
aauaauauuuuuaagaguauugauugaaguuugugauauucaucaauaaaaaugaguugauaau

SEQ ID NO: 299817 - RNA, 62 nt, Human
aagaggccugaggagggaggcucccgggaccguccacgcacgacccagccagacccucgcgg

SEQ ID NO: 299818 - RNA, 64 nt, Human
cagcucuuucuuguccugccauccaguagcaguuagucuucauccccacgugaacaaaauggga

SEQ ID NO: 299819 - RNA, 64 nt, Human
ugcguuacagguuuuaugauaauagaacuaugacagucuucaagucaauuaaaauccacccacc

SEQ ID NO: 299820 - RNA, 64 nt, Human
cagccuaucagugguauccacaugucaguucuuagauauucagagacucuccccuuuacaugac

SEQ ID NO: 299821 - RNA, 64 nt, Human
uuuauccaauauucuaggaauuuucagcaauacugauauucacuuuauuuuuuuucuuuuuuua

SEQ ID NO: 299822 - RNA, 64 nt, Human
gagcuaguuaagccuuugcuugacugauuucagugauauucagaaguguguaccaaucaaggcu

SEQ ID NO: 299823 - RNA, 64 nt, Human
agacacuccucacaccuguccauacccgaggguggauauucaaccagccccaccgccuacccga

SEQ ID NO: 299824 - RNA, 62 nt, Human
ucugcagaggaacaacccuaaaaccagaccacuccacgcaggacaggcaggagagauucuuc

SEQ ID NO: 299825 - RNA, 62 nt, Human
cccuccgucgggccccugccugccuucuccccuccacgcaaggcugugcucuuccucugguu

SEQ ID NO: 299826 - RNA, 62 nt, Human
ugggccggcacgcgugacacggcacuucaggcuccacgcacagaaucucgcagauaguuggg

SEQ ID NO: 299827 - RNA, 62 nt, Human
uuaaggcaaagcagagagcagagguucuucaguccacgcaacgguucuucucugaacagcaa

SEQ ID NO: 299828 - RNA, 62 nt, Human
uguuguaggaagagagcgaggcaucccugaauuccacgcaucugcuggaaacgagccguguc

SEQ ID NO: 299829 - RNA, 62 nt, Human
ccuugaacacuacugggguauauucaggcucauccacgcagcugcuggguucuugcccuaac

SEQ ID NO: 299830 - RNA, 62 nt, Human
uguggcccggagcgucuuggcugccgcccugcuccacgcagucugcuucagugcagugaagg

SEQ ID NO: 299831 - RNA, 62 nt, Human
gaggggugacaguggaggaaaauccauggauauccacgcagcagccccucuuuaaccucauc

SEQ ID NO: 299832 - RNA, 62 nt, Human
aucaaauugcacuuguucuccuacaagcaaccuccacgcagacaccucguacugcuacaggu

SEQ ID NO: 299833 - RNA, 62 nt, Human
uacuaaaccaguacuucguuaugaaaaugccuuccacgcaaauaagaaaccaagggauaaaa

SEQ ID NO: 299834 - RNA, 62 nt, Human
uuaucagggcauguguucaacaacccccaaaguccacgcagguggcuuguagaaaccuuugg

SEQ ID NO: 299835 - RNA, 62 nt, Human
caacugaugaaugggaaauaaaauguggucuguccacgcaauggaacauuauuagacucuaa

SEQ ID NO: 299836 - RNA, 62 nt, Human
uuucucaaagccagucuaccugacuaggucuauccacgcacgguucccaaccccaaggggga

SEQ ID NO: 299837 - RNA, 62 nt, Human
agagacaaacucuaggaacaaugccgauucauuccacgcagcaguauugggggugguucggg

SEQ ID NO: 299838 - RNA, 62 nt, Human
uccauugccgucagcaugacagaccuccagcauccacgcaucucuuggucccaauaacugcc

SEQ ID NO: 299839 - RNA, 62 nt, Human
cccuaucgcaucuuggacucggaaagccagacuccacgcaggaccagggaucucacgaggca

SEQ ID NO: 299840 - RNA, 62 nt, Human
gcagcacgugagguagaacgagugugagcgucuccacgcaguggcuggccccguggccgggg

SEQ ID NO: 299841 - RNA, 64 nt, Human
uguaucuccuuaguuaacaacccaguuccaggaucgagccuaaagcgggagccaggccugagug

SEQ ID NO: 299842 - RNA, 64 nt, Human
uuaaaaagacgcagggcaccugugagcgcaggagcgagccuaaggccacccagcggcagcgccc

SEQ ID NO: 299843 - RNA, 64 nt, Human
uggaggacguagaauuucacuggaucagcaaugacgagccuacacaguacuggagaacuuggca

SEQ ID NO: 299844 - RNA, 64 nt, Human
uuuaauguuguccaggaaacccuggcuugcuugccgagccuaaugaaagggaaagucagcuuuc

SEQ ID NO: 299845 - RNA, 64 nt, Human
cucuuccaaagacuccccccagguacagugccuucgagccuacaagccccgagagaaugaugaa

SEQ ID NO: 299846 - RNA, 64 nt, Human
uacagaccucccccggacagcccacucucuaucacgagccuaacccgcgggaggcggaagagac

SEQ ID NO: 299847 - RNA, 64 nt, Human
ggugccuggagcagagggacccacaagugccucccgagccuagauccuggcucggaccacugca

SEQ ID NO: 299848 - RNA, 64 nt, Human
cagucagcaugucauccacaaguauuuccugccccgagccuaugcugucgccaucccacuggcu

SEQ ID NO: 299849 - RNA, 64 nt, Human
gucaucacucaauauugcgaagcacaugccccaucgagccuacugggcagagcagcagagcagg

SEQ ID NO: 299850 - RNA, 64 nt, Human
gaaugaagaggugcgccguuucucagauuuuuugcgagccuaaaacacuugccaaguaauccug

SEQ ID NO: 299851 - RNA, 64 nt, Human
cguguccuaccuccgucuucgccaaggccccgcccgagccuaguuguucucccccugaaugugu

SEQ ID NO: 299852 - RNA, 64 nt, Human
ucaacuugcugauauuuuaguaguuaacagcuuccgagccuaucaugcaauuuggagucuguca

SEQ ID NO: 299853 - RNA, 64 nt, Human
ggcccaccugccucugucucacugaacuagaagccgagccuagaaacuaacacagccaucaagg

SEQ ID NO: 299854 - RNA, 64 nt, Human
cuuagcugguggccagccugacuggcuuccugggcgagccuaguagcuccugcaggcaggggca

SEQ ID NO: 299855 - RNA, 64 nt, Human
cuucaucauaguaugaaguguugaaaauuaauaacgagccuaguuuaggaaaaagcugcuuaaa

SEQ ID NO: 299856 - RNA, 64 nt, Human
cauauacauaaugagauauuuugggaauaggacccgagccuaaacacaaaauucauugaugugu

SEQ ID NO: 299857 - RNA, 64 nt, Human
ugugugacuuaaucaacuauaaaagcuuacaauuagucuucacaguuaugggauuguuauacua

SEQ ID NO: 299858 - RNA, 64 nt, Human
caauggcuaaaucccaaacauccuuggccugugaagucuucauuuccagaauacugaauuugug

SEQ ID NO: 299859 - RNA, 64 nt, Human
agaaaaaccauaauugcuuguggugaaacgaagcagucuucauguuaaguagcaaugguuauuu

SEQ ID NO: 299860 - RNA, 64 nt, Human
ucuuccauucauacuuuaaccuacaggucauuugagucuucacacaaauaauaaccuaucuggc

SEQ ID NO: 299861 - RNA, 64 nt, Human
agacuccuccaaaucuuaaaaugaagcaggaaaacgagccuaagaggacuuucauaccgacaac

SEQ ID NO: 299862 - RNA, 64 nt, Human
ggcauguuugucgucguccuacaaaugaggaaaccgagccuauggcgugcccuggucuguugag

SEQ ID NO: 299863 - RNA, 64 nt, Human
gccccuucucgccgagccguggggcgcgggcggccgagccuauacauaguguacaggagacauc

SEQ ID NO: 299864 - RNA, 64 nt, Human
agguugugguggggcaagaucgcaccauugcacccgagccuaggcaacaagagugaaauuccgu

SEQ ID NO: 299865 - RNA, 64 nt, Human
ucaagaagugccaguugaucaaugaauaaauaaacgagccuauuucucuuugcacauccugcuu

SEQ ID NO: 299866 - RNA, 64 nt, Human
ggccucucacccccaaggcugucucuggcccugccgagccuaugggagucccgggacagagugc

SEQ ID NO: 299867 - RNA, 64 nt, Human
gccagcuguggcagcgcauuaguuuuggcgcaagcgagccuaugcugcagggucacuuuuggcu

SEQ ID NO: 299868 - RNA, 64 nt, Human
uuccucaugggcgaucacuccgcaucuauagggucgagccuaggggagcuugagggagggcugg

SEQ ID NO: 299869 - RNA, 64 nt, Human
gggcagaggcccaucuggccugaacugaggcuccagcaucuagugguggaccggccggucacug

SEQ ID NO: 299870 - RNA, 64 nt, Human
aauugcuuuuuggccuuuuggcuaaaauaaauguagcaucuaauuuuaucaguuuaacaucuga

SEQ ID NO: 299871 - RNA, 64 nt, Human
uuuuuuuguauguauuccuuguuuucauauugauagcaucuaauucuuuugacaaucuuaauau

SEQ ID NO: 299872 - RNA, 64 nt, Human
ugccccuccugggggagauugcaucuccaggacaagcaucuaaaggaggccccugcugugcaga

SEQ ID NO: 299873 - RNA, 64 nt, Human
uacugaaggaaaaacacaagcaaaaaaaaaaaaaagcaucuaucucaucuaucucaauccuaau

SEQ ID NO: 299874 - RNA, 64 nt, Human
gacaugagccuguagguucaguagguagagaccaagcaucuaucugauagaagcacauggagug

SEQ ID NO: 299875 - RNA, 64 nt, Human
ggcugugucaccuucuccaagcaaagccauauggagcaucuacccagacucccacucugcacac

SEQ ID NO: 299876 - RNA, 64 nt, Human
cuguuugcaaguagucuauagaaauuuuguuuuaagucuucaaauaucuugagaaauaguagac

SEQ ID NO: 299877 - RNA, 64 nt, Human
gucaacagaaagcugccuucuucacuugaggcuaagucuucauauauguuuaagguugucuuuc

SEQ ID NO: 299878 - RNA, 64 nt, Human
guuuuaucgcagauuuuuauguuuugaaagacagagucuucacuaaccuuuuuuguuuuaaaau

SEQ ID NO: 299879 - RNA, 64 nt, Human
uuaacauaaaauaguuugccaaagaaguuucugaagucuucacagcucuuaaaagccaggccag

SEQ ID NO: 299880 - RNA, 64 nt, Human
gucgcccugaccgcuuguggauggagaaggggagagcaucuaggcaggcaaacagaagggaagu

SEQ ID NO: 299881 - RNA, 64 nt, Human
ugaagaacauacauguugcaaaaugacugcuuucagcaucuaacaggacuucuguaaauaauag

SEQ ID NO: 299882 - RNA, 64 nt, Human
guaaacuuugagcuuuguuaauaaacuauuaugcagcaucuacacuuugaaaaucaaguacuuc

SEQ ID NO: 299883 - RNA, 64 nt, Human
gaaaaaaauauauuuuaggaaaacaugugcaaaaagcaucuaagcaucuguuaacauuaaaacc

SEQ ID NO: 299884 - RNA, 64 nt, Human
aaaguauuuaucuccugucuacaguuuaauaaauagcaucuaguacacauucauuuuguguugg

SEQ ID NO: 299885 - RNA, 64 nt, Human
ucuguuuuuguuucccagacccaugacaacagagagcaucuagccaugauggaaaggaucuugg

SEQ ID NO: 299886 - RNA, 64 nt, Human
ugagcuucuuuuaggucccagugaugggaccagaagcaucuaaagcaaaaaaaaaaccaaaaaa

SEQ ID NO: 299887 - RNA, 64 nt, Human
ccaggaaucucauucauucauucaguauuuauugagcaucuaguauaagucugggcacuggaug

SEQ ID NO: 299888 - RNA, 64 nt, Human
ucaccauuagaggacauuuagcgugaugaaauaaagcaucuacgucagcaggccauacuguguu

SEQ ID NO: 299889 - RNA, 64 nt, Human
ucaccaccccuaguuacaaauaacuccauugaacagcaucuauucagaaacuaugccgaauaaa

SEQ ID NO: 299890 - RNA, 64 nt, Human
ccaguuuucuauauuucauagucaaagccuugaaagcaucuacaaaucucuuuuuuuagguuuu

SEQ ID NO: 299891 - RNA, 64 nt, Human
uagauauucauuaauaggaaagauuuaauguuacagcaucuacucuuuggcacuuuuucacaua

SEQ ID NO: 299892 - RNA, 64 nt, Human
gauaggaauguggguuuucuugaccaaauauaucagcaucuaauugaaaugaccaaauagcauu

SEQ ID NO: 299893 - RNA, 64 nt, Human
auuuuaaaaagcuaucccauaucgauugccaaagagcaucuaccuuaccuccuaagaagaaaag

SEQ ID NO: 299894 - RNA, 64 nt, Human
cgaucuaaaugugcaguuguguccuuaaauaugcagucuucacccagaguaaaguguugaucgc

SEQ ID NO: 299895 - RNA, 64 nt, Human
caccauucuggccuuggccugcagaagcuuucagagucuucacuggcaguagggggagaugggg

SEQ ID NO: 299896 - RNA, 64 nt, Human
accagggacacaucuguuuuggcucccaaucagcagucuucaaucgaucaauaauucugcucug

SEQ ID NO: 299897 - RNA, 64 nt, Human
ucucucauccuacauagcugccuggcaaaucccuagucuucaucagcucacaucacauuuccau

SEQ ID NO: 299898 - RNA, 64 nt, Human
uacaguuaguggguaacuuagauuuauauuagcuagcaucuaauuugcacaacuagaacacauc

SEQ ID NO: 299899 - RNA, 64 nt, Human
aagaguucagccacgcauaauucuagauuucaagagcaucuaagacuuguggauuagccucaug

SEQ ID NO: 299900 - RNA, 64 nt, Human
uagcuuucaauuucaauuaacucccuuggcuauaagcaucuaaacucaucuucuuucaauauaa

SEQ ID NO: 299901 - RNA, 64 nt, Human
ucauagaacaacaaaauagaguggacucuuuuagagcaucuauaucugcaaccuguaaauggua

SEQ ID NO: 299902 - RNA, 64 nt, Human
ucuguagcucuuuuucucugguguauucauggaaagcaucuacugccgcacgacacuaguacug

SEQ ID NO: 299903 - RNA, 64 nt, Human
auauuuauuaagguuuauagagaccuagagauacagcaucuaugacuuccuuuauuauucuaaa

SEQ ID NO: 299904 - RNA, 64 nt, Human
gaagaaauucuaaauaaugcaaacuuuuaaaauaagcaucuagguuuuugauaauucugucuac

SEQ ID NO: 299905 - RNA, 64 nt, Human
ugugaucugugggcacauuagccuaugugcaugcagcaucuaaguaaugaugucguuugaauca

SEQ ID NO: 299906 - RNA, 64 nt, Human
gccaccugcucuuuugcucuagcaccugggucccagcaucuagagcauggagccucuagaagcc

SEQ ID NO: 299907 - RNA, 64 nt, Human
auagguuuaccaggauguagucccacuguugaggagcaucuauuuagggguuaauuacuuuagu

SEQ ID NO: 299908 - RNA, 64 nt, Human
uucugacauuuucuuauguuuuuaaaaagauaagagcaucuagugcauuaaaugccaaaaaaaa

SEQ ID NO: 299909 - RNA, 64 nt, Human
acauugguguucuuggagcccuuuugcagucagcagcaucuauggaugcaaauccagccacagc

SEQ ID NO: 299910 - RNA, 64 nt, Human
uuuuauuuaaaucaugauggccuguaacaguugaagcaucuaaaaauugaaauaaauauauauu

SEQ ID NO: 299911 - RNA, 64 nt, Human
auaccaaguauaauaguuacauucacuuucaaagagcaucuaugaauuugccuuuuguaacuua

SEQ ID NO: 299912 - RNA, 64 nt, Human
uuccagccacaagucagccuccauaaugccucagagucuucacacuguggagaagggccuguug

SEQ ID NO: 299913 - RNA, 64 nt, Human
cuuauuuuagucgggcaaaccucuuguugaucauagucuucaaguugaacaucaaauuugaacg

SEQ ID NO: 299914 - RNA, 64 nt, Human
ucuaguuucaucugagaacuucugauuagcucucagucuucagcucuauuuaucuuaggaguuu

SEQ ID NO: 299915 - RNA, 64 nt, Human
uaaaaccugccuacuucaggacuuuaagacucacagucuucagccuguuaaugaugucuucaug

SEQ ID NO: 299916 - RNA, 64 nt, Human
acaggguuaauuauucauuugugguaaagauuauagcaucuauuuugaucaguggguuuuauua

SEQ ID NO: 299917 - RNA, 64 nt, Human
aacaacuacacagccuaguuuugccacaaccuuuagcaucuaaaaaguuuuaaaagcuucuaaa

SEQ ID NO: 299918 - RNA, 64 nt, Human
uugcuauaagaaacauaccagauuagccaccauuagcaucuauaucuacuuuguguuuaaaaau

SEQ ID NO: 299919 - RNA, 64 nt, Human
uggauuuucacaaacugaacauaccuguguaaucagcaucuagacccagacccagagcgucaca

SEQ ID NO: 299920 - RNA, 64 nt, Human
agaaguuuaaaaaagaaaacuaagauuauaaauuagcaucuaguuccaaaaccaaaaaaagugc

SEQ ID NO: 299921 - RNA, 64 nt, Human
uaaaugcuucucuagauccauauuaauaaacaugagcaucuaaccccuccuuucuuaggcuaga

SEQ ID NO: 299922 - RNA, 64 nt, Human
augucaugagaauaaccgauguucugauaauaguagcaucuagguacagaugcugguuguauua

SEQ ID NO: 299923 - RNA, 64 nt, Human
acuacagacucgaaaucuuuaaagauggugccuaagcaucuauguauuuuuuuuaaguuccaca

SEQ ID NO: 299924 - RNA, 64 nt, Human
gacugcaugguggcauaaaugagaaauugccuguagcaucuagucuacuugaaggaaguggaga

SEQ ID NO: 299925 - RNA, 64 nt, Human
ccagaagacagaaacuccaacuggcaaaaaagcaagcaucuaagaaaaaaaaccaccaaaguuc

SEQ ID NO: 299926 - RNA, 64 nt, Human
cauuauuacuggagucaagcccuuauaagucaaaagcaucuaugugucguaaaacauuccucaa

SEQ ID NO: 299927 - RNA, 64 nt, Human
agugaacaagacaccauauuaaguacagugauaaagcaucuauauucuguaaaaaaaaaaaaaa

SEQ ID NO: 299928 - RNA, 64 nt, Human
acuccuaagaugacaguucucuuugucuauauucagcaucuaagacaaauauuuaaacauuuua

SEQ ID NO: 299929 - RNA, 64 nt, Human
acagggaccaugucuuauucaucuuugugucuccagcaucuaguacagugccugguauauagua

SEQ ID NO: 299930 - RNA, 64 nt, Human
cagacaguauauuugaaaaaaauugauuccauguagucuucaauuuuuaauuuuuaagaauugg

SEQ ID NO: 299931 - RNA, 64 nt, Human
ucacggaguggucgaaagagcaaaaacaacaacaagucuucaagccagcagucaucaucuuccu

SEQ ID NO: 299932 - RNA, 64 nt, Human
gauuuuuuagaaguacuugcuauuuaucuucuuaagucuucauugauauucugugugaaauaag

SEQ ID NO: 299933 - RNA, 59 nt, Human
aaacucggaaaaugaauuagguuguuugcagucuucaguuguguucuuaugcuucagug

SEQ ID NO: 299934 - RNA, 64 nt, Human
uaaacaaaaucguucuuguuggauuuuauucagcagcaucuaucauguagauaaauucccaggu

SEQ ID NO: 299935 - RNA, 64 nt, Human
uccagaccgcagcugcaaaugcagcuucaacugcagcaucuagugcagcucagaaugcuuucaa

SEQ ID NO: 299936 - RNA, 64 nt, Human
auagacuagguaggaaggcccuauauugguccccagcaucuacugaggcagaccugcaacagaa

SEQ ID NO: 299937 - RNA, 64 nt, Human
uuaccaaacauuuaauuaugaaugcccacuccccagcaucuagaucuaaaauuauuaacauuuu

SEQ ID NO: 299938 - RNA, 64 nt, Human
agaaaacuuaguaauuauuugauggauaacaaaaagcaucuaucacuaacauugcuuguucaug

SEQ ID NO: 299939 - RNA, 64 nt, Human
uuuuggauauuuaauccuuacuugggaaaaaaucagcaucuagguaaauuauuauuuuaauaac

SEQ ID NO: 299940 - RNA, 64 nt, Human
ucucuaaaucuuuacucuccuaaguagacuugucagcaucuaggaagaacagcuagaaauuuuc

SEQ ID NO: 299941 - RNA, 64 nt, Human
aagacucugccugcuuaauugugcuagaaauaacagcaucuaaagugaagacuuaagaaaaacu

SEQ ID NO: 299942 - RNA, 61 nt, Human
cccugacaguguuuggcugagccgagacuggagcaucuacaccugaggacaagacgcugcc

SEQ ID NO: 299943 - RNA, 64 nt, Human
ccgucaccaaauuguaaccuggauguuauagcccagcaucuagaaauccuaugaaacguauuag

SEQ ID NO: 299944 - RNA, 64 nt, Human
acuuaagcagagggagagaaccucuacugaucagagcaucuaaaccugugugaucuaagguuua

SEQ ID NO: 299945 - RNA, 64 nt, Human
uuuagaaucuugaccaaaaaaaauuaauuuuaggagcaucuauuuaugcaguguucaaaaguac

SEQ ID NO: 299946 - RNA, 64 nt, Human
ugugauuucuuaggccuccgucuguuguaccacuagcaucuauaugacuuuuguguaauuuucu

SEQ ID NO: 299947 - RNA, 64 nt, Human
gcacuuuaaaauuagucuuuguaguucuaucauuagcaucuaauguaguucugaagacuguuuu

SEQ ID NO: 299948 - RNA, 64 nt, Human
acuucaaauuguaauucuuauuugcaguuuuaccagucuucauguacagugacgaaacugugua

SEQ ID NO: 299949 - RNA, 64 nt, Human
uuuauuccuaaugugggcacauuccacucccaugagucuucaaaaacuuuuuuuuugaauauau

SEQ ID NO: 299950 - RNA, 64 nt, Human
auaauuuggguagcuucaaacucaaauugaagagagucuucacuacaaucuucacuacaaccuu

SEQ ID NO: 299951 - RNA, 64 nt, Human
uauauccugaugcuggaugguauuaaucuuguguagucuucaacugguuagugugaaauaguuc

SEQ ID NO: 299952 - RNA, 64 nt, Human
gucuucccugaacgugucuccacucugugaagccagcaucuaggggcuaaagaugcaaaggaaa

SEQ ID NO: 299953 - RNA, 64 nt, Human
agaacuacguucugccccucucuugggcuucagaagcaucuaagaaaagcagucaucaauuaua

SEQ ID NO: 299954 - RNA, 64 nt, Human
uguuuaguuaccaguuuucccaaaguguucugguagcaucuaccauauuucaucaaaucuguga

SEQ ID NO: 299955 - RNA, 64 nt, Human
aacacugugucacgaacaacuuuuucuauuaacaagcaucuauuucuuuauucuucugggcuuc

SEQ ID NO: 299956 - RNA, 64 nt, Human
gaaacaaugugauucaagauauuuacauaccagaagcaucuaggacugauggaucacugucccg

SEQ ID NO: 299957 - RNA, 64 nt, Human
cuaaaauuauaguuagagcugagaaaaaaaaaauagcaucuaguccaacuccuugauuguaaaa

SEQ ID NO: 299958 - RNA, 64 nt, Human
caguuuguccuuuuauguuuaauauuuuacauaaagcaucuauucuauaaaaaucuuuagaaag

SEQ ID NO: 299959 - RNA, 64 nt, Human
gcaguuuuucacaaauucaucuuuacagaaaaccagcaucuagcuuagcaucuuuccccuuuua

SEQ ID NO: 299960 - RNA, 64 nt, Human
aaaaaagugugaaaaacaguaaaguugggagaggagcaucuauuuucuuaaagaaauaaaacac

SEQ ID NO: 299961 - RNA, 64 nt, Human
uuuaacaguaauguucuuauuuaaauuuucagaaagcaucuauucccaaagaaccccaggcaau

SEQ ID NO: 299962 - RNA, 64 nt, Human
aaauaauuauucauuuuuaaaaagccccuuuuaaagcaucuacuugaagauugguauaauuuuc

SEQ ID NO: 299963 - RNA, 64 nt, Human
gugggagggccauuuugucacuuugccucaguugagcaucuaggaaguauuaaaacugugaagc

SEQ ID NO: 299964 - RNA, 64 nt, Human
uuauacauuuuuuuaagaaaggacacguuauguuagcaucuagguaaggcugcaugauagcauu

SEQ ID NO: 299965 - RNA, 64 nt, Human
cugaccaagggcuuaaucaaauaaaaugacuaacagcaucuaucauaaagccacacaagccuua

SEQ ID NO: 299966 - RNA, 64 nt, Human
ugacccuacccaggaaaguaauagcuucuuuaaaagucuucaaagguuuugggaauuuuaacuu

SEQ ID NO: 299967 - RNA, 64 nt, Human
ggucuucaacaugaugaccuuggauuuaauuuaaagucuucaacacuaugcgcuuuaucauauu

SEQ ID NO: 299968 - RNA, 64 nt, Human
ccucuccacugucucuccaagccuccucaccccuagucuucaucuccuguggacgaacaucugg

SEQ ID NO: 299969 - RNA, 64 nt, Human
aguccaugacaguuacuaaaggacauuuuaggauagucuucauaugauuguuaggagacuaccu

SEQ ID NO: 299970 - RNA, 64 nt, Human
uucaggcuaccuuugugugucucuagaagagaaaagcaucuaucuggagauauaaauguguaug

SEQ ID NO: 299971 - RNA, 64 nt, Human
uggagccucgagaugcgccaccucccagaaagccagcaucuaaccuggugggcguccuacuggg

SEQ ID NO: 299972 - RNA, 64 nt, Human
ugcaguggggguggauuucagagccucucauggcagcaucuaagugaccagagcugggaugaga

SEQ ID NO: 299973 - RNA, 64 nt, Human
uuaaguuaaaaaaaaucucauaauuaagcaguagagcaucuaugauuaggaaaugugaggggca

SEQ ID NO: 299974 - RNA, 64 nt, Human
uccuacuccuuaagaaaaaaacuuugguuuauuuagcaucuacacuuuugucaguuguguugcu

SEQ ID NO: 299975 - RNA, 64 nt, Human
aacuauaugcagauuuuaaaaucuagucaguacuagcaucuauaaagggcuuuucugaaauuua

SEQ ID NO: 299976 - RNA, 64 nt, Human
agcgguucaucggcuguuugggaaauggcaugaaagcaucuacuguggcggcggcuccucuucu

SEQ ID NO: 299977 - RNA, 64 nt, Human
cuucccccauggcacaaacucgcccaugauggaaagcaucuagauuucugccuccuuuuacagu

SEQ ID NO: 299978 - RNA, 64 nt, Human
agucugcaguaguguggacuagaacaacccaaauagcaucuagaaagccaugaguuugaaaggg

SEQ ID NO: 299979 - RNA, 64 nt, Human
gguaagcuaauuaaugcagugaaugggauuggaaagcaucuacuuaaauaucuauuggguuccc

SEQ ID NO: 299980 - RNA, 64 nt, Human
agaguccauauuuguuauugcagugcaacuaaagagcaucuaugugccuucaucaagaagccca

SEQ ID NO: 299981 - RNA, 64 nt, Human
ugcaaacuaugcaucugagaaaggucugaaauccagcaucuauacguaauuuaaacaaauuuag

SEQ ID NO: 299982 - RNA, 64 nt, Human
augacaagucugaacccacgaaaauacccagcgcagcaucuacacauucaaaagauaagcugag

SEQ ID NO: 299983 - RNA, 64 nt, Human
ggcucugucaguuuagccgcgccggaccgugucaagcaucuaggagaggaguccauggugucca

SEQ ID NO: 299984 - RNA, 64 nt, Human; identical to SEQ ID NO: 298650

SEQ ID NO: 299985 - RNA, 64 nt, Human; identical to SEQ ID NO: 298651

SEQ ID NO: 299986 - RNA, 64 nt, Human; identical to SEQ ID NO: 298652

SEQ ID NO: 299987 - RNA, 64 nt, Human
ccuagagaaguaaaaagaacugauauuuaauuucagucuucagacuggucagcauuagaaaauu

SEQ ID NO: 299988 - RNA, 64 nt, Human
gugugugcugggccggggagucccugucucucacagcaucuagcaguauuauuaaauggauuca

SEQ ID NO: 299989 - RNA, 64 nt, Human
uuaauaugcuugaacugucgccuuaacuauguuaagcaucuagacuaaaagccaaaauauaauu

SEQ ID NO: 299990 - RNA, 64 nt, Human
gcccaugcuaugaguuuucuccuugauaucauucagcaucuacucuaaagaaaaaugccugucu

SEQ ID NO: 299991 - RNA, 64 nt, Human
gaauugaacuaggggcuggaagaagugaaagggaagcaucuaaaaaugaaaggugaguaaccag

SEQ ID NO: 299992 - RNA, 64 nt, Human
ggcuugauguagcagucauagcaaguuuguaaauagcaucuauguuacacucuccuagaguaua

SEQ ID NO: 299993 - RNA, 64 nt, Human
uuuuaaaaagaagccauggaaaaacuuccuaguaagcaucuacuucaggccaacaagguuauau

SEQ ID NO: 299994 - RNA, 64 nt, Human
gcgugggcagggcaccuugaacucuggcuuagcaagcaucuaggcugccucuucacuuucuuuu

SEQ ID NO: 299995 - RNA, 64 nt, Human
caccgcucacagccucuugcacccagccguuggcagcaucuacucagcaaggucacuaagcucu

SEQ ID NO: 299996 - RNA, 64 nt, Human
uaccccucuuuuaagaugcugucuuacauuaaugagcaucuaauggaaagaagguaugaguugc

SEQ ID NO: 299997 - RNA, 64 nt, Human
guugcaccucauucucccgaugacuauucaaaucagcaucuagaggcugaaugacaaugccaaa

SEQ ID NO: 299998 - RNA, 64 nt, Human
uccgccucuguaggcauggacaaccuuuaaucagagcaucuagaguggccucuuguuuauccug

SEQ ID NO: 299999 - RNA, 64 nt, Human
uuucagaggggaaaauggggccuagaaguuacagagcaucuagcuggugcgcuggcaccccugg

SEQ ID NO: 300000 - RNA, 64 nt, Human
ccaaacuauugauacauaaggguugagagaaacaagcaucuauugcaguuucuuuuugcguaca

SEQ ID NO: 300001 - RNA, 64 nt, Human
auaaauuuuugaaaaauuuugcaccacuggucauagcaucuaucuccuuugccuuaauuuacug

SEQ ID NO: 300002 - RNA, 64 nt, Human
aucgauuauuuuuuaaugaauugaauuuauauugagucuucaaauuaacugaauggauuuaaag

SEQ ID NO: 300003 - RNA, 64 nt, Human
acagcaaccaccagaauagcauauaucugaaaguagucuucagcuuuaggcagaugcaaaagaa

SEQ ID NO: 300004 - RNA, 64 nt, Human
agagcagagggcacuugcagggccugggaugagcagucuucaagcugugguaguuagcgggcag

SEQ ID NO: 300005 - RNA, 64 nt, Human
gaguccucucaaugggaaccugauugaugaucacagucuucaguggugagucaguccucaccaa

SEQ ID NO: 300006 - RNA, 64 nt, Human
uuuuuuaauucuuuuguuuaccgaacguuuacugagcaucuacccugugccagcccuacucgua

SEQ ID NO: 300007 - RNA, 64 nt, Human
agacuuuccgacugcuuuuuugauucugaaguucagcaucuaaagcagcaggucuagaagaaca

SEQ ID NO: 300008 - RNA, 64 nt, Human
cuuugcccaguagccacaucugguuuacucaggcagcaucuacuaagaaauucagcaccugcau

SEQ ID NO: 300009 - RNA, 64 nt, Human
guuauuuuuauaagaaaaccaaacaaaaauguuaagcaucuaaggacaagguaaggagggucac

SEQ ID NO: 300010 - RNA, 64 nt, Human
ucaaauacaaauuauuuauaugcauuaauuuaagagcaucuacuuagaagaaaccaaauagucu

SEQ ID NO: 300011 - RNA, 64 nt, Human
cuguucuaagacuaugugugcccaaaagcacauaagcaucuauguugagaguaaguuuguaucc

SEQ ID NO: 300012 - RNA, 64 nt, Human
aaauaagauuacaaagaauaagcagcaauauugaagcaucuacaguauguuaacuacauuuuuu

SEQ ID NO: 300013 - RNA, 64 nt, Human
uuagcauucuuacuccucuucuggggcuaaugucagcaucuauagacaauagacuauuaaaaaa

SEQ ID NO: 300014 - RNA, 64 nt, Human
aauuuuuguuauuuuaguuuuauuuuugaaaccaagcaucuauagaaaccaagaaagucagcau

SEQ ID NO: 300015 - RNA, 64 nt, Human
gccccagggagcagaagacagaaugaagagacugagcaucuaaaaugggcagccuccauccacc

SEQ ID NO: 300016 - RNA, 64 nt, Human
aaauggggguaguuuucuaucugucaugggcucuagcaucuacuccgcuacccaauucugucau

SEQ ID NO: 300017 - RNA, 64 nt, Human
uauacuggauuggugaaagaaaauaauaauaaugagcaucuaagugguuggguuuuagagauca

SEQ ID NO: 300018 - RNA, 64 nt, Human
ccucucaggucccuuuuacacuuuuugacuaacuagcaucuauauuccacacuuagcuuuuuug

SEQ ID NO: 300019 - RNA, 64 nt, Human
ccacccgugcugcucaggugcaaauggacuugagagcaucuaugugcuggugaagcaugagguc

SEQ ID NO: 300020 - RNA, 64 nt, Human
agaaaggggaugugaauggugaaaaagaacagaaagucuucaguuucuugaaggugaguaaauu

SEQ ID NO: 300021 - RNA, 64 nt, Human
aauauacugugaauuuugggauucuggaguccuuagucuucauuuccauucuucugcccaugau

SEQ ID NO: 300022 - RNA, 64 nt, Human
cauccaggacguggagagaaagagugccccaaccagucuucaggaggaagagaugcccaugaag

SEQ ID NO: 300023 - RNA, 64 nt, Human
cuuacaaccccaaucuauacauggauuuuuagaaagucuucauggcuaucuauaguucccuacc

SEQ ID NO: 300024 - RNA, 64 nt, Human
cuguccuucagggaaggcagaagaaacauuggaaagcaucuaguccagugggaagccagggguu

SEQ ID NO: 300025 - RNA, 64 nt, Human
ugucugugugagugagcgcaugugcgcauuuaugagcaucuacuugcggcugcacucagggcca

SEQ ID NO: 300026 - RNA, 64 nt, Human
ccagguggcaggauuacuacuuugccucuucagcagcaucuacucuaggcauauugaucauuuu

SEQ ID NO: 300027 - RNA, 64 nt, Human
cuucauaaugugucagugauugugugaccaaggcagcaucuagcagaaagccaggcauggagua

SEQ ID NO: 300028 - RNA, 64 nt, Human
gcuuaauuugcuucaauucagcaaccauuuauugagcaucuauuaugugccaggcacugugccg

SEQ ID NO: 300029 - RNA, 64 nt, Human
uuaagauacagaagcauuuguucaaaggauagaaagcaucuaaaaguuuaggcucaagaucaau

SEQ ID NO: 300030 - RNA, 64 nt, Human
cugaccuuuuccuugauucaacaaaaauguacugagcaucuauucauguggcaggccccugucc

SEQ ID NO: 300031 - RNA, 64 nt, Human
uaucuacagauguuaggauauguccacauaagaaagcaucuaaacugaacugagagcacagcgg

SEQ ID NO: 300032 - RNA, 64 nt, Human
ccgugcuugcuggugccucuuuucaguagugagcagcaucuaguuucccuggugcccuucccug

SEQ ID NO: 300033 - RNA, 64 nt, Human
uccuucagcaacaaggcuggcuuggugcccuccaagcaucuaauggcuuauuaaauuaucccac

SEQ ID NO: 300034 - RNA, 64 nt, Human
cagccagagccuuggcagcucugaagcuaaccuuagcaucuaagugucgaucuugaauucccug

SEQ ID NO: 300035 - RNA, 64 nt, Human
gcuugauauuacuauauuuuaacugaauagccagagcaucuaaguacagguguucuuuggcuua

SEQ ID NO: 300036 - RNA, 64 nt, Human
caaacugaucuuuucauuuaggugaggaagcaaaagcaucuaugugagaccauuuagcacacug

SEQ ID NO: 300037 - RNA, 64 nt, Human
accauaaugccuccaaaaugagaccaugauauuaagcaucuaggaucacgugcucauugaauca

SEQ ID NO: 300038 - RNA, 64 nt, Human; identical to SEQ ID NO: 298531

SEQ ID NO: 300039 - RNA, 64 nt, Human; identical to SEQ ID NO: 298532

SEQ ID NO: 300040 - RNA, 64 nt, Human
cuuugagaucucauuucagaagaacggcaugaacagucuucagccacaguugugaugguuguua

SEQ ID NO: 300041 - RNA, 64 nt, Human
gaugcagcaguaaguagcaacgccacuccuucucagucuucaucgaucaaugacauuucaucca

SEQ ID NO: 300042 - RNA, 64 nt, Human
cguggcucaggguguaaauauuccuaagaauggcagcaucuauuuccucuuuuguuugaauuaa

SEQ ID NO: 300043 - RNA, 64 nt, Human
gaagucuaauuuugguuccuaacaugccuccaacagcaucuaucaauccuguuagcuuucaguc

SEQ ID NO: 300044 - RNA, 64 nt, Human
aaagaugaauaagugccuaaguguauacagugagagcaucuauagaagccuagaagaauucugu

SEQ ID NO: 300045 - RNA, 64 nt, Human
uaaggugcaucuagugcagauagugaaguagauuagcaucuacugcccuaagugcuccuucugg

SEQ ID NO: 300046 - RNA, 64 nt, Human
cugcuuuuucugugggcauuaacuauauugcuacagcaucuaguguacugagccugcggugcau

SEQ ID NO: 300047 - RNA, 64 nt, Human
ugguuuuauuuguuuguuuacucaucacucagugagcaucuacuuugggugcauucuaguguag

SEQ ID NO: 300048 - RNA, 60 nt, Human
cagaugaugauaauauguaacauuuacuccagcaucuauuguauuuuaaauuucuacucc

SEQ ID NO: 300049 - RNA, 64 nt, Human
uaacaugguucccaccauguaagacuggugcuuuagcaucuaugccacaugcguugauggaagg

SEQ ID NO: 300050 - RNA, 64 nt, Human
cauuacgucacucgaaacguuuucauccaugcuuagcaucuacucuguauaacgcaugagaggg

SEQ ID NO: 300051 - RNA, 64 nt, Human
ggggaaggggugggagccaauacugagugccugcagcaucuacuacucugucuucacuauucag

SEQ ID NO: 300052 - RNA, 64 nt, Human
uaaaagaacaaaaacuguaaaaaggaaguaguucagcaucuaucgccagccagguuguuucuca

SEQ ID NO: 300053 - RNA, 64 nt, Human
uuuugaaauuuuuggcccugcauaaguucugcauagcaucuaaugucaaaauagaaccaacugg

SEQ ID NO: 300054 - RNA, 64 nt, Human
gugugaauuauuuugauguugaauuagacgacaaagcaucuauauagcuaagcuaaaagaauaa

SEQ ID NO: 300055 - RNA, 64 nt, Human
uaaaaccagauuagacuauauucuucaucugaggagcaucuauauguuuaauacaccuaaugua

SEQ ID NO: 300056 - RNA, 64 nt, Human
cucguguugagauauugugugccacaacccccacagucuucaccuccgugugugaugaaacuuc

SEQ ID NO: 300057 - RNA, 64 nt, Human
guugguaguagugaggagauugguauuagcaucaagucuucauugaugacuaauuuuuaauucc

SEQ ID NO: 300058 - RNA, 64 nt, Human
auauaauuuuugacuaaccugugacuggaaaauaagucuucauuuuucuccuuuacaacuuuua

SEQ ID NO: 300059 - RNA, 64 nt, Human
cauucaggcaccgaaauaguuaauauuugaaauaagucuucaaaagaaaacauaagagauuauu

SEQ ID NO: 300060 - RNA, 64 nt, Human
aaucuuucugucccucgcacagaagccaguaauuagcaucuaaugaaaaggacuguucaagugg

SEQ ID NO: 300061 - RNA, 64 nt, Human
cauauaaacaauugcuuugguuuccuuuugaaaaagcaucuacuugcuucaguugggaaggugc

SEQ ID NO: 300062 - RNA, 64 nt, Human
agagccccagagugugagaccugaaagaauguucagcaucuagcuccaugucccugcaaccacu

SEQ ID NO: 300063 - RNA, 64 nt, Human
uaugguaguuuuguuuuacuaaucuaaggguacuagcaucuacaaugauauagacaaaauaaaa

SEQ ID NO: 300064 - RNA, 64 nt, Human
uuuguguaacauuuauuaugauuuuacauaaaugagcaucuaccauuccaaagcacagcgugac

SEQ ID NO: 300065 - RNA, 64 nt, Human
ccuuuuuguuuuccuuuauaauucacuaaaauaaagcaucuauuagugucugauuuaggaaugu

SEQ ID NO: 300066 - RNA, 64 nt, Human
augggcagaggcucccucggggcucgggaucugcagcaucuauguggaucagcccacacccuuc

SEQ ID NO: 300067 - RNA, 64 nt, Human
gggcgugacagagugagacuccaucugauuguaaagcaucuaguacaguguacagugccuugga

SEQ ID NO: 300068 - RNA, 64 nt, Human
uuauguuuuagaaucaucacugccuuaauauucaagcaucuauuuaaguccuaauaaaggagaa

SEQ ID NO: 300069 - RNA, 64 nt, Human
cacagggaagaaaacauuucaagggcuauaccucagcaucuaggcuuuuuggacuaaggagcuu

SEQ ID NO: 300070 - RNA, 64 nt, Human
ggugacaucggaaaaauaaucaaaagcuauuuaaagcaucuauaaggugcucucuuucugucuu

SEQ ID NO: 300071 - RNA, 64 nt, Human
uaguauaaauaauaauaauggcuaauauuuccugagcaucuacuaaaugcaaggaauugugcuu

SEQ ID NO: 300072 - RNA, 64 nt, Human
gugucacagaaaaagccacagaaggucucagaucagcaucuauucuuuggguucaauaaggggu

SEQ ID NO: 300073 - RNA, 56 nt, Human
aggacaauggcugggacugauuggacagcaucuacccaacccaguguccacgugaa

SEQ ID NO: 300074 - RNA, 64 nt, Human; identical to SEQ ID NO: 298471

SEQ ID NO: 300075 - RNA, 64 nt, Human; identical to SEQ ID NO: 298472

SEQ ID NO: 300076 - RNA, 64 nt, Human
accccucacagcucaagccaaguccagcggccgcagucuucaccucuccacacucacuuuuuau

SEQ ID NO: 300077 - RNA, 64 nt, Human
gcucugucccuccccuagguaaagaucacacugaagucuucaaguccccagcaaccaaguuggg

SEQ ID NO: 300078 - RNA, 64 nt, Human
acucauacauuuaaaguuuuuuucauuuuacgugagcaucuauauuguacagggcugggggggc

SEQ ID NO: 300079 - RNA, 64 nt, Human
uagcuuauauuuuuuacuaaggugucaccuuauaagcaucuauaaauugacuucuuuuucuuag

SEQ ID NO: 300080 - RNA, 64 nt, Human
acauuugaaagccauuagacuuauaggugaugcaagcaucuaagagagagguuaaucacacuau

SEQ ID NO: 300081 - RNA, 64 nt, Human
uggccaguuucuaaaaaaugcacauuuaaagagaagcaucuaccacggcuuuaaaacaaaacaa

SEQ ID NO: 300082 - RNA, 64 nt, Human
guuuuaaggcuucaauuuauugcacaaaauauaaagcaucuaaacuuuaauauguauuuuaugu

SEQ ID NO: 300083 - RNA, 64 nt, Human
uuugcucugcuaccugcuguauuuauuauauggaagcaucuaaguacugucaggauggggucuu

SEQ ID NO: 300084 - RNA, 64 nt, Human
accaugaugaccugaaguucaccuaucccauuuuagcaucuacuuguuuuucccaucucuuccu

SEQ ID NO: 300085 - RNA, 64 nt, Human
ucuagauuccauugguccaagauuccggauccuaagcaucuaaguuauaagacucucacacuca

SEQ ID NO: 300086 - RNA, 64 nt, Human
uguuuccucaucuggucuuaaacuucuaggcucaagcaucuaccugccucagccuccagaagug

SEQ ID NO: 300087 - RNA, 64 nt, Human
agugaagaaucuaaugaaugugcaaccuaauuguagcaucuaaugaauguuccaccauugcugg

SEQ ID NO: 300088 - RNA, 64 nt, Human
agcuuucuuugacgguuucucccauccguguuccagcaucuaaccuuuuacuuuugcauaggaa

SEQ ID NO: 300089 - RNA, 64 nt, Human
ucucccuccaccugacaguuuguaagagugaaagagcaucuaaccugaugcucuuggagagaga

SEQ ID NO: 300090 - RNA, 64 nt, Human
ucacccuucacccucacuccugguccccauacccagcaucuaaucauccaugcccccuacuccu

SEQ ID NO: 300091 - RNA, 64 nt, Human
gcuguaugugcgugguccauagcacaguacaugcagcaucuaauaagaguuuccauuguagaau

SEQ ID NO: 300092 - RNA, 64 nt, Human
aucaaaaugccugauaaaauauauucuuaauaaaagucuucauuucauaaugaaaucaauuuau

SEQ ID NO: 300093 - RNA, 64 nt, Human
ucauucugucaaccauauugaagugaaguggcauagucuucacucacuguaaucuccagcuccu

SEQ ID NO: 300094 - RNA, 64 nt, Human
gaaucuauucucuucucuccagucccguuguuauagucuucacucauagacuuaagaugauccc

SEQ ID NO: 300095 - RNA, 64 nt, Human
cucaaggagguagaacucaguccucucccuugugagucuucacuaaaaucagugacucacuucc

SEQ ID NO: 300096 - RNA, 64 nt, Human
ugggcugguagagcaggaagcucugugaugucagagcaucuacugggacuacaggugcacugua

SEQ ID NO: 300097 - RNA, 64 nt, Human
ggugguggugguggugguggugguggugagugucagcaucuacaguacagccaggcaggcagga

SEQ ID NO: 300098 - RNA, 64 nt, Human
uggaaucacagaggggucaggaagcuguggcaggagcaucuacacagcuugggugaaaggggau

SEQ ID NO: 300099 - RNA, 64 nt, Human
uugugaucuuuauuuucccuuuguauucauuuuaagcaucuaaauaaauugcuguauugugcuu

SEQ ID NO: 300100 - RNA, 64 nt, Human
aucuaaugugaaauguaaguauccuuaaaaacaaagcaucuauuuuggcagaaauuguguucuu

SEQ ID NO: 300101 - RNA, 64 nt, Human
uagggacuuagcaagcucuuuuauaugcuaaaggagcaucuaucagauuaaguuagaacauuug

SEQ ID NO: 300102 - RNA, 64 nt, Human
ucacuuuuaugccacauuauuuuaauugcaaaaaagcaucuauauauggaggagggugggaaaa

SEQ ID NO: 300103 - RNA, 64 nt, Human
gaaaguauaguaauuuguuuucuaaggugguucaagcaucuacucuuuuuaucauuuacuucaa

SEQ ID NO: 300104 - RNA, 64 nt, Human
cugaaauguuuauaaacauaacuuuuacuacaguagcaucuaagguuuuaaauguguuuuacua

SEQ ID NO: 300105 - RNA, 64 nt, Human
cccucuucagucauugcugugcgugugaaggaagagcaucuagacguggccucgcccgacaagg

SEQ ID NO: 300106 - RNA, 64 nt, Human
guuccugccgucagugccaacugccgcauguggaagcaucuacccguucacuccagucccaccc

SEQ ID NO: 300107 - RNA, 64 nt, Human
uuauuuuuguacugacauugguaagagacuguauagcaucuauuuauuuagaugauuuaucugg

SEQ ID NO: 300108 - RNA, 64 nt, Human
ugcauuucuaaagccauuguaguccuguaauggaagcaucuagcaugucgucaaagcugaaaug

SEQ ID NO: 300109 - RNA, 64 nt, Human
aaaguaagaagcagucaauuuucacaucaaagacagcaucuaagaaguuuuguucuguccugga

SEQ ID NO: 300110 - RNA, 64 nt, Human
uuaaguagauuucaugccuggguggccaaacaacagucuucauuuuuuuuaauugaaaagaagu

SEQ ID NO: 300111 - RNA, 64 nt, Human
cagugaugacacugucugucuguggcucaauuucagucuucacagggauagacuacaacaccuc

SEQ ID NO: 300112 - RNA, 64 nt, Human
uuccgacaagcaauuugaaucuuaacuuuccaucagucuucaguguuuuuaaucuaaggaauaa

SEQ ID NO: 300113 - RNA, 64 nt, Human
uuuguuuguauuuuuuauuauuaaugacauauuuagucuucagauauauuauuuuaaaggcacc

SEQ ID NO: 300114 - RNA, 64 nt, Human
cuugagugagcccuugaaaaaugaacugcccuucagcaucuaaugggaguugugaauguaacug

SEQ ID NO: 300115 - RNA, 64 nt, Human
guuggggguguucagccacugagggacaaaacuuagcaucuaauuucaauuauagugucaugca

SEQ ID NO: 300116 - RNA, 64 nt, Human; identical to SEQ ID NO: 277268

SEQ ID NO: 300117 - RNA, 64 nt, Human; identical to SEQ ID NO: 277269

SEQ ID NO: 300118 - RNA, 64 nt, Human; identical to SEQ ID NO: 277270

SEQ ID NO: 300119 - RNA, 64 nt, Human; identical to SEQ ID NO: 277271

SEQ ID NO: 300120 - RNA, 64 nt, Human; identical to SEQ ID NO: 277272

SEQ ID NO: 300121 - RNA, 64 nt, Human; identical to SEQ ID NO: 277273

SEQ ID NO: 300122 - RNA, 64 nt, Human; identical to SEQ ID NO: 277274

SEQ ID NO: 300123 - RNA, 64 nt, Human; identical to SEQ ID NO: 277275

SEQ ID NO: 300124 - RNA, 64 nt, Human; identical to SEQ ID NO: 277276

SEQ ID NO: 300125 - RNA, 64 nt, Human; identical to SEQ ID NO: 277277

SEQ ID NO: 300126 - RNA, 64 nt, Human; identical to SEQ ID NO: 277278

SEQ ID NO: 300127 - RNA, 64 nt, Human; identical to SEQ ID NO: 277279

SEQ ID NO: 300128 - RNA, 64 nt, Human; identical to SEQ ID NO: 277280

SEQ ID NO: 300129 - RNA, 64 nt, Human; identical to SEQ ID NO: 298429

SEQ ID NO: 300130 - RNA, 64 nt, Human; identical to SEQ ID NO: 298430

SEQ ID NO: 300131 - RNA, 64 nt, Human
uuuacuacacauauuguaacaaauucaauauccuagucuucauuuguaugaaugguuuguauug

SEQ ID NO: 300132 - RNA, 64 nt, Human; identical to SEQ ID NO: 277281

SEQ ID NO: 300133 - RNA, 64 nt, Human; identical to SEQ ID NO: 277282

SEQ ID NO: 300134 - RNA, 64 nt, Human; identical to SEQ ID NO: 277283

SEQ ID NO: 300135 - RNA, 64 nt, Human; identical to SEQ ID NO: 277284

SEQ ID NO: 300136 - RNA, 64 nt, Human; identical to SEQ ID NO: 277285

SEQ ID NO: 300137 - RNA, 64 nt, Human; identical to SEQ ID NO: 277286

SEQ ID NO: 300138 - RNA, 64 nt, Human; identical to SEQ ID NO: 277287

SEQ ID NO: 300139 - RNA, 64 nt, Human; identical to SEQ ID NO: 277288

SEQ ID NO: 300140 - RNA, 64 nt, Human; identical to SEQ ID NO: 277289

SEQ ID NO: 300141 - RNA, 64 nt, Human; identical to SEQ ID NO: 277290

SEQ ID NO: 300142 - RNA, 64 nt, Human; identical to SEQ ID NO: 277291

SEQ ID NO: 300143 - RNA, 64 nt, Human; identical to SEQ ID NO: 277292

SEQ ID NO: 300144 - RNA, 64 nt, Human; identical to SEQ ID NO: 277293

SEQ ID NO: 300145 - RNA, 64 nt, Human; identical to SEQ ID NO: 277294

SEQ ID NO: 300146 - RNA, 64 nt, Human; identical to SEQ ID NO: 277295

SEQ ID NO: 300147 - RNA, 64 nt, Human; identical to SEQ ID NO: 277296

SEQ ID NO: 300148 - RNA, 64 nt, Human
gacaacucaauaaagcacugcuuuuauuuuuugcagucuucaauuugagaaaggugagaaauaa

SEQ ID NO: 300149 - RNA, 64 nt, Human
gucgaggaauucggaaagccugcaguugacauucagucuucacuugaaacucaaaacugacacu

SEQ ID NO: 300150 - RNA, 64 nt, Human
gagccaaaucuuacaaauguagcaguugugaaagagucuucagucguaguguccaccuuacuca

SEQ ID NO: 300151 - RNA, 64 nt, Human; identical to SEQ ID NO: 277297

SEQ ID NO: 300152 - RNA, 63 nt, Human; identical to SEQ ID NO: 277298

SEQ ID NO: 300153 - RNA, 64 nt, Human; identical to SEQ ID NO: 277299

SEQ ID NO: 300154 - RNA, 64 nt, Human; identical to SEQ ID NO: 277300

SEQ ID NO: 300155 - RNA, 64 nt, Human; identical to SEQ ID NO: 277301

SEQ ID NO: 300156 - RNA, 64 nt, Human; identical to SEQ ID NO: 277302

SEQ ID NO: 300157 - RNA, 64 nt, Human; identical to SEQ ID NO: 277303

SEQ ID NO: 300158 - RNA, 64 nt, Human; identical to SEQ ID NO: 277304

SEQ ID NO: 300159 - RNA, 64 nt, Human; identical to SEQ ID NO: 277305

SEQ ID NO: 300160 - RNA, 57 nt, Human; identical to SEQ ID NO: 277306

SEQ ID NO: 300161 - RNA, 64 nt, Human; identical to SEQ ID NO: 277307

SEQ ID NO: 300162 - RNA, 55 nt, Human; identical to SEQ ID NO: 277308

SEQ ID NO: 300163 - RNA, 64 nt, Human; identical to SEQ ID NO: 277309

SEQ ID NO: 300164 - RNA, 64 nt, Human; identical to SEQ ID NO: 277310

SEQ ID NO: 300165 - RNA, 64 nt, Human; identical to SEQ ID NO: 277311

SEQ ID NO: 300166 - RNA, 64 nt, Human; identical to SEQ ID NO: 277312

SEQ ID NO: 300167 - RNA, 64 nt, Human; identical to SEQ ID NO: 298689

SEQ ID NO: 300168 - RNA, 64 nt, Human; identical to SEQ ID NO: 298234

SEQ ID NO: 300169 - RNA, 64 nt, Human; identical to SEQ ID NO: 298723

SEQ ID NO: 300170 - RNA, 64 nt, Human; identical to SEQ ID NO: 277313

SEQ ID NO: 300171 - RNA, 64 nt, Human; identical to SEQ ID NO: 277314

SEQ ID NO: 300172 - RNA, 64 nt, Human; identical to SEQ ID NO: 277315

SEQ ID NO: 300173 - RNA, 64 nt, Human; identical to SEQ ID NO: 277316

SEQ ID NO: 300174 - RNA, 64 nt, Human; identical to SEQ ID NO: 277317

SEQ ID NO: 300175 - RNA, 62 nt, Human; identical to SEQ ID NO: 277318

SEQ ID NO: 300176 - RNA, 64 nt, Human; identical to SEQ ID NO: 277319

SEQ ID NO: 300177 - RNA, 64 nt, Human; identical to SEQ ID NO: 277320

SEQ ID NO: 300178 - RNA, 64 nt, Human; identical to SEQ ID NO: 277321

SEQ ID NO: 300179 - RNA, 64 nt, Human; identical to SEQ ID NO: 277322

SEQ ID NO: 300180 - RNA, 64 nt, Human; identical to SEQ ID NO: 277323

SEQ ID NO: 300181 - RNA, 64 nt, Human; identical to SEQ ID NO: 277324

SEQ ID NO: 300182 - RNA, 64 nt, Human; identical to SEQ ID NO: 277325

SEQ ID NO: 300183 - RNA, 64 nt, Human; identical to SEQ ID NO: 277326

SEQ ID NO: 300184 - RNA, 64 nt, Human; identical to SEQ ID NO: 277327

SEQ ID NO: 300185 - RNA, 64 nt, Human; identical to SEQ ID NO: 277328

SEQ ID NO: 300186 - RNA, 64 nt, Human; identical to SEQ ID NO: 298741

SEQ ID NO: 300187 - RNA, 64 nt, Human; identical to SEQ ID NO: 298742

SEQ ID NO: 300188 - RNA, 64 nt, Human; identical to SEQ ID NO: 298235

SEQ ID NO: 300189 - RNA, 64 nt, Human; identical to SEQ ID NO: 277329

SEQ ID NO: 300190 - RNA, 64 nt, Human; identical to SEQ ID NO: 277330

SEQ ID NO: 300191 - RNA, 64 nt, Human; identical to SEQ ID NO: 277331

SEQ ID NO: 300192 - RNA, 64 nt, Human; identical to SEQ ID NO: 277332

SEQ ID NO: 300193 - RNA, 64 nt, Human; identical to SEQ ID NO: 277333

SEQ ID NO: 300194 - RNA, 64 nt, Human; identical to SEQ ID NO: 277334

SEQ ID NO: 300195 - RNA, 64 nt, Human; identical to SEQ ID NO: 277335

SEQ ID NO: 300196 - RNA, 64 nt, Human; identical to SEQ ID NO: 277336

SEQ ID NO: 300197 - RNA, 64 nt, Human; identical to SEQ ID NO: 277337

SEQ ID NO: 300198 - RNA, 64 nt, Human; identical to SEQ ID NO: 277338

SEQ ID NO: 300199 - RNA, 64 nt, Human; identical to SEQ ID NO: 277339

SEQ ID NO: 300200 - RNA, 63 nt, Human; identical to SEQ ID NO: 277340

SEQ ID NO: 300201 - RNA, 64 nt, Human; identical to SEQ ID NO: 277341

SEQ ID NO: 300202 - RNA, 64 nt, Human; identical to SEQ ID NO: 277342

SEQ ID NO: 300203 - RNA, 64 nt, Human; identical to SEQ ID NO: 277343

SEQ ID NO: 300204 - RNA, 64 nt, Human; identical to SEQ ID NO: 277344

SEQ ID NO: 300205 - RNA, 64 nt, Human; identical to SEQ ID NO: 298743

SEQ ID NO: 300206 - RNA, 64 nt, Human; identical to SEQ ID NO: 298469

SEQ ID NO: 300207 - RNA, 64 nt, Human
aagggaaacccugccagugugaugaguacggaaaagucuucagagguuggaacuugggaaaaau

SEQ ID NO: 300208 - RNA, 64 nt, Human; identical to SEQ ID NO: 277345

SEQ ID NO: 300209 - RNA, 64 nt, Human; identical to SEQ ID NO: 277346

SEQ ID NO: 300210 - RNA, 64 nt, Human; identical to SEQ ID NO: 277347

SEQ ID NO: 300211 - RNA, 64 nt, Human; identical to SEQ ID NO: 277348

SEQ ID NO: 300212 - RNA, 64 nt, Human; identical to SEQ ID NO: 277349

SEQ ID NO: 300213 - RNA, 64 nt, Human; identical to SEQ ID NO: 277350

SEQ ID NO: 300214 - RNA, 64 nt, Human; identical to SEQ ID NO: 277351

SEQ ID NO: 300215 - RNA, 64 nt, Human; identical to SEQ ID NO: 277352

SEQ ID NO: 300216 - RNA, 64 nt, Human; identical to SEQ ID NO: 277353

SEQ ID NO: 300217 - RNA, 64 nt, Human; identical to SEQ ID NO: 277354

SEQ ID NO: 300218 - RNA, 64 nt, Human; identical to SEQ ID NO: 277355

SEQ ID NO: 300219 - RNA, 64 nt, Human; identical to SEQ ID NO: 277356

SEQ ID NO: 300220 - RNA, 64 nt, Human; identical to SEQ ID NO: 277357

SEQ ID NO: 300221 - RNA, 64 nt, Human; identical to SEQ ID NO: 277358

SEQ ID NO: 300222 - RNA, 64 nt, Human; identical to SEQ ID NO: 277359

SEQ ID NO: 300223 - RNA, 64 nt, Human; identical to SEQ ID NO: 277360

SEQ ID NO: 300224 - RNA, 64 nt, Human; identical to SEQ ID NO: 298236

SEQ ID NO: 300225 - RNA, 64 nt, Human; identical to SEQ ID NO: 298759

SEQ ID NO: 300226 - RNA, 64 nt, Human; identical to SEQ ID NO: 298760

SEQ ID NO: 300227 - RNA, 64 nt, Human; identical to SEQ ID NO: 277361

SEQ ID NO: 300228 - RNA, 64 nt, Human; identical to SEQ ID NO: 277362

SEQ ID NO: 300229 - RNA, 64 nt, Human; identical to SEQ ID NO: 277363

SEQ ID NO: 300230 - RNA, 64 nt, Human; identical to SEQ ID NO: 277364

SEQ ID NO: 300231 - RNA, 64 nt, Human; identical to SEQ ID NO: 277365

SEQ ID NO: 300232 - RNA, 64 nt, Human; identical to SEQ ID NO: 277366

SEQ ID NO: 300233 - RNA, 64 nt, Human; identical to SEQ ID NO: 277367

SEQ ID NO: 300234 - RNA, 64 nt, Human; identical to SEQ ID NO: 277368

SEQ ID NO: 300235 - RNA, 64 nt, Human; identical to SEQ ID NO: 277369

SEQ ID NO: 300236 - RNA, 64 nt, Human; identical to SEQ ID NO: 277370

SEQ ID NO: 300237 - RNA, 64 nt, Human; identical to SEQ ID NO: 277371

SEQ ID NO: 300238 - RNA, 64 nt, Human; identical to SEQ ID NO: 277372

SEQ ID NO: 300239 - RNA, 64 nt, Human; identical to SEQ ID NO: 277373

SEQ ID NO: 300240 - RNA, 64 nt, Human; identical to SEQ ID NO: 277374

SEQ ID NO: 300241 - RNA, 64 nt, Human; identical to SEQ ID NO: 277375

SEQ ID NO: 300242 - RNA, 64 nt, Human; identical to SEQ ID NO: 277376

SEQ ID NO: 300243 - RNA, 64 nt, Human
uacaaaugugaagaauguguuaaagccuuuaacaagucuucaacuuuuucugcacacacgaggu

SEQ ID NO: 300244 - RNA, 64 nt, Human
cacaaaugugaaaaauuugguaaauucuuuaacaagucuucaacccuuucugcacauaauauaa

SEQ ID NO: 300245 - RNA, 64 nt, Human
auccucacaccuguccaggucuucucuucccacgagucuucacaugaagagccucugcagcccu

SEQ ID NO: 300246 - RNA, 64 nt, Human; identical to SEQ ID NO: 277377

SEQ ID NO: 300247 - RNA, 64 nt, Human; identical to SEQ ID NO: 298253

SEQ ID NO: 300248 - RNA, 64 nt, Human; identical to SEQ ID NO: 299021

SEQ ID NO: 300249 - RNA, 64 nt, Human; identical to SEQ ID NO: 299022

SEQ ID NO: 300250 - RNA, 64 nt, Human
agcgcgccguguccagguggaggugcccguuccuggaccucagcgagccugagccgggcccggc

SEQ ID NO: 300251 - RNA, 64 nt, Human
cggggccccuguaacccuacucuccucucucccuggaccucagaggugacacccauugggcccu

SEQ ID NO: 300252 - RNA, 64 nt, Human
ucagacuugaaucuucucggccccccaaaaagaaggaccucauuucuuauagccucuccuguga

SEQ ID NO: 300253 - RNA, 64 nt, Human
gagaaaggggcccagccgcugacccacucacucaggaccucacucacuagccccgcuuugggcc

SEQ ID NO: 300254 - RNA, 64 nt, Human
aucauaugcagcacucaaaauggcagcauccuucggaccucaccacgcggugagugggugauua

SEQ ID NO: 300255 - RNA, 64 nt, Human
gcaaugguaugggcagggcuucaccugacauuauggaccucagaccugagaaccuggacccugg

SEQ ID NO: 300256 - RNA, 64 nt, Human
aauacagaggcaacugcauuggcuuuggguugcaggaccucaggugagaagcagaggaaggaga

SEQ ID NO: 300257 - RNA, 64 nt, Human
ugccacaucugugucucuggaacccaggaccucuggaccucagguuccuaagacuucaguccug

SEQ ID NO: 300258 - RNA, 64 nt, Human
ucucuccugggaccgugggguuggaaagucagcuggaccucauggggccuggggcucacagaca

SEQ ID NO: 300259 - RNA, 64 nt, Human
cuuuaaagggaucugugcuacacaaaauaugccaggaccucacagacaaagccauugcuagaaa

SEQ ID NO: 300260 - RNA, 64 nt, Human
uaaauuuggaugauuucuaaauuaucacaaagugggaccucagcaguagugaugugugugucuc

SEQ ID NO: 300261 - RNA, 64 nt, Human
uagaaaacaucagugaugcucagauaaacuuuuaggaccucauauuaagagcuaagcaaauggc

SEQ ID NO: 300262 - RNA, 64 nt, Human; identical to SEQ ID NO: 298761

SEQ ID NO: 300263 - RNA, 64 nt, Human; identical to SEQ ID NO: 298409

SEQ ID NO: 300264 - RNA, 64 nt, Human
cauaggguguuccugaaaagccccauagugauugagucuucaaaaccaccgauucugagagcaa

SEQ ID NO: 300265 - RNA, 64 nt, Human
gcugcuacauuagagcauaagagaugcucuccugggaccucaguacccugccuucuugacuggu

SEQ ID NO: 300266 - RNA, 64 nt, Human
ugucauccggaggaggagguggcccguaugugcaggaccucagggugccagcccucacccauac

SEQ ID NO: 300267 - RNA, 64 nt, Human
ggacuaagcuuccauagaaauacacuuuguaucuggaccucaaaauuaugggaacauuuacuua

SEQ ID NO: 300268 - RNA, 64 nt, Human
gaagaaaaugaauaauguuaagccauucuugauuggaccucauagcuuauuuuaguuaaucuuu

SEQ ID NO: 300269 - RNA, 64 nt, Human
uguggggaaucagccuccugccacccccccggaaggaccucacugucuccagcuaugcccagug

SEQ ID NO: 300270 - RNA, 64 nt, Human
agccccuguguuccccuaggcacagcugggguggggaccucaggccugggggcugggcagagga

SEQ ID NO: 300271 - RNA, 64 nt, Human
acucaagguuugaagacuuccuagcuuguccuauggaccucaacaccaaggauuacaaauugca

SEQ ID NO: 300272 - RNA, 64 nt, Human
cagauccucuccuggaucuccauucacuggccuuggaccucaccuuuguggcuacccucccacg

SEQ ID NO: 300273 - RNA, 64 nt, Human
cuacuuacugguacucucccuauuaauauuugaaggaccucaauggaauaaauuugaaaagcua

SEQ ID NO: 300274 - RNA, 64 nt, Human
cacaagcccccuccaacccccacccccaugcucuggaccucauggcuccuaugagcuuggagca

SEQ ID NO: 300275 - RNA, 64 nt, Human
ccucauccaucucagcaucaacacaauuuccaggggaccucaggucuaccucaggacugaacgc

SEQ ID NO: 300276 - RNA, 64 nt, Human
cucaaggggcccagccuccucuggacuccaccuuggaccucagugacucagaacuucugccucu

SEQ ID NO: 300277 - RNA, 64 nt, Human
ucuuccugcacaggaagacucuuuaacacccuuaggaccucaggccaucuucuccuaugaagau

SEQ ID NO: 300278 - RNA, 64 nt, Human
cagcucagaugcagccacugucucuugucaagugggaccucauacuauucucagaaggcuaacu

SEQ ID NO: 300279 - RNA, 64 nt, Human
uuuagcuuaaacuuuguuucuaccuuauguuaguggaccucaguuauccaucuguaaauuucuu

SEQ ID NO: 300280 - RNA, 64 nt, Human
cugacaucgcuggcugccccuuugggcggagaggggaccucaccaguuuuuuuaguaucgccca

SEQ ID NO: 300281 - RNA, 64 nt, Human; identical to SEQ ID NO: 298254

SEQ ID NO: 300282 - RNA, 64 nt, Human; identical to SEQ ID NO: 298255

SEQ ID NO: 300283 - RNA, 64 nt, Human; identical to SEQ ID NO: 298256

SEQ ID NO: 300284 - RNA, 64 nt, Human
gacugacuucgcgcagcgguggcucgcaccugugggaccucagggcaccggcaccgggcgccuc

SEQ ID NO: 300285 - RNA, 64 nt, Human
gggagccagugugcccaaaagccauguauuucagggaccucaggggcaccuccggcugccuagc

SEQ ID NO: 300286 - RNA, 64 nt, Human
ugaacacaggcuuguuaaugucagucugugcugaggaccucagggacuugagguugcauuuuug

SEQ ID NO: 300287 - RNA, 50 nt, Human
acagcgcccaccugucauagggaccucacccuggggccagagugggcucu

SEQ ID NO: 300288 - RNA, 64 nt, Human
gguggugcccacgggguugggcaagggcucaccaggaccucaacgggcaaaguugugcacacua

SEQ ID NO: 300289 - RNA, 64 nt, Human
ugaugaacucuuaaucaaauagcauaaguuucugggaccucaguuuuaucauuuucaaaaugga

SEQ ID NO: 300290 - RNA, 58 nt, Human
uccugaaauguggacucugagcagcaguggaccucauaccugucuccagcucccagcc

SEQ ID NO: 300291 - RNA, 64 nt, Human
agcucugauaguuguugggaauauauaauuuacuggaccucagcccaaaucaagaugcuuaaaa

SEQ ID NO: 300292 - RNA, 64 nt, Human
acccagacucuaaauauuucaugauucacaacuaggaccucauaucuuccucaucaguagaugg

SEQ ID NO: 300293 - RNA, 64 nt, Human
ucugcugcuaauuaagucaaucauuuaauuuuugggaccucaguuucuuuguaaguaaaauaac

SEQ ID NO: 300294 - RNA, 64 nt, Human
ugucugacucagccugacaagccuggauagaaauggaccucagaauacagaauggaguccuuga

SEQ ID NO: 300295 - RNA, 64 nt, Human
uuguagaccuacuugcucacaugcagauuugagaggaccucaacggcuuuucucacaaaaucgc

SEQ ID NO: 300296 - RNA, 64 nt, Human
ugagguugguggauucacacauggggguccuccaggaccucagcugcacccauuuucuggaggu

SEQ ID NO: 300297 - RNA, 64 nt, Human
uuggcaucugugggauaagaggccagccugcauaggaccucauacccuuccccaacacuaccug

SEQ ID NO: 300298 - RNA, 64 nt, Human
cuauaaaauagaugcuggacucugguugagguggggaccucaggcgacggcagcugggugagau

SEQ ID NO: 300299 - RNA, 64 nt, Human
ugggcccacauucugccccaagcagaagcugcagggaccucaguguccacccuuccugccucau

SEQ ID NO: 300300 - RNA, 64 nt, Human; identical to SEQ ID NO: 298391

SEQ ID NO: 300301 - RNA, 64 nt, Human; identical to SEQ ID NO: 298392

SEQ ID NO: 300302 - RNA, 64 nt, Human; identical to SEQ ID NO: 298412

SEQ ID NO: 300303 - RNA, 64 nt, Human
caguguucuggacuugggguaagcagugggguugggaccucagaugggaaggguggugcuaaga

SEQ ID NO: 300304 - RNA, 64 nt, Human
gccugccagugaguucugucaugcaucagacuuuggaccucagaauuuucaccuggaacaugag

SEQ ID NO: 300305 - RNA, 64 nt, Human
acuuuuucaauuucaggcacuuguggccccucaaggaccucacgcugacgagcaaucaggugag

SEQ ID NO: 300306 - RNA, 64 nt, Human
uaccucagcuucagaccccccuggccagugagcuggaccucaugcccuacacacccccacaggu

SEQ ID NO: 300307 - RNA, 64 nt, Human
uugagauagguuggucaucgugcagaaggccccaggaccucagcacacacagccuccucuuggu

SEQ ID NO: 300308 - RNA, 64 nt, Human
aacaagucauuccaugaagccccagagguagaagggaccucaagcaccacgcccuccagggcag

SEQ ID NO: 300309 - RNA, 64 nt, Human
ggagggugaguuggcccugucucuucuuuuuucuggaccucaguuuccucagugagcugguaag

SEQ ID NO: 300310 - RNA, 64 nt, Human
uguugcuggagauaaauaggcagaaggaagaagaggaccucaaauuacaauugcaacuucaaag

SEQ ID NO: 300311 - RNA, 64 nt, Human
uggaguacauccacaagcagggcaucgugcaccuggaccucaagccggagaacaucaugugugu

SEQ ID NO: 300312 - RNA, 64 nt, Human
uaguuuucgggggaggaugauguggugggacagaggaccucaguggccuauuacggagcccucu

SEQ ID NO: 300313 - RNA, 64 nt, Human
uccacuugccagggcucugggggcagauuuguggggaccucagccugcacccucuucuccucug

SEQ ID NO: 300314 - RNA, 64 nt, Human
ugggugucacccuccucccccuagugagagauaaggaccucaggcucagagagguuaugugguu

SEQ ID NO: 300315 - RNA, 64 nt, Human
gcaacacucuacuuagaagcacauguacauacauggaccucauucagaaguccauguuguagca

SEQ ID NO: 300316 - RNA, 64 nt, Human
aagucuaaugaaacgaagggaacuaaucagacguggaccucaacuucugauuccagaacacgcc

SEQ ID NO: 300317 - RNA, 64 nt, Human
uacauaguacuuugaauaauguauauuuuaaauuggaccucacaaaucuuguauuaaaguaggu

SEQ ID NO: 300318 - RNA, 64 nt, Human
acucgugcaagacaaaacugaaacccucuuuccaggaccucaguaggcaccguugagguguccu

SEQ ID NO: 300319 - RNA, 64 nt, Human; identical to SEQ ID NO: 298213

SEQ ID NO: 300320 - RNA, 64 nt, Human; identical to SEQ ID NO: 298549

SEQ ID NO: 300321 - RNA, 64 nt, Human; identical to SEQ ID NO: 298215

SEQ ID NO: 300322 - RNA, 64 nt, Human
caugcuggugagccaagcaguuugaaauugagcuggaccucaccaagcugcuguggccaucaac

SEQ ID NO: 300323 - RNA, 64 nt, Human
gaaaaguugauuacugccuguacucuacagaagaggaccucaaggaucaauaauccaacacauu

SEQ ID NO: 300324 - RNA, 64 nt, Human
gaggcugugauugggcguagaagugggagcauugggaccucacauuacacacacgagagaucau

SEQ ID NO: 300325 - RNA, 64 nt, Human
ugaucuuccggauugggggccuugcccggaagcuggaccucacggagaugaaacggaagaugca

SEQ ID NO: 300326 - RNA, 64 nt, Human
aggcaggaggcaggcgggcagaaggcccugcccgggaccucacagucccuucuuagaagccugc

SEQ ID NO: 300327 - RNA, 64 nt, Human
guucagugccuggaaauaaagagcaaggaaaaauggaccucaggcuucguggcuccuuuaggau

SEQ ID NO: 300328 - RNA, 64 nt, Human
ucagggaggcuagaaaaccuuucaauuggaaguuggaccucaggccuuuucucacgacucuugu

SEQ ID NO: 300329 - RNA, 64 nt, Human
uuuuuaaagaaauggaaaauguuuacuauuacagggaccucaacacugcccucccauacaggcu

SEQ ID NO: 300330 - RNA, 64 nt, Human
gccccggcucgcaagccccagcucaccgcgccgcggaccucacaccugcgcagcccccuccucc

SEQ ID NO: 300331 - RNA, 64 nt, Human
uaccuccauguaaagaacagcacgucuguuccaaggaccucagcucuucuuguuucuacagaug

SEQ ID NO: 300332 - RNA, 64 nt, Human
cuggccugcaggaacaaggcaggccgccuguggaggaccucagcccugcccugcccuccucaug

SEQ ID NO: 300333 - RNA, 64 nt, Human
uuuagcuuaaacuuuguuucuaccuuauguuaguggaccucaguuauccaucuguaaauuuauu

SEQ ID NO: 300334 - RNA, 64 nt, Human
augccagugccuuauuacccaggaagauuuuaaaggaccucauuaauaauuugcucacuuggua

SEQ ID NO: 300335 - RNA, 64 nt, Human
uugcuaucccuaugccucuccauggagucaguguggaccucaugauuauagaggccaauggaac

SEQ ID NO: 300336 - RNA, 64 nt, Human
ugguaggauuaguugguucuaaggaucccucuagggaccucauuauuucaagaggaacccaaag

SEQ ID NO: 300337 - RNA, 64 nt, Human
accaaucagugagcaagcaagcacagccaaaaucggaccucagcuuuaguccgucuucacacac

SEQ ID NO: 300338 - RNA, 64 nt, Human; identical to SEQ ID NO: 298670

SEQ ID NO: 300339 - RNA, 64 nt, Human; identical to SEQ ID NO: 298671

SEQ ID NO: 300340 - RNA, 64 nt, Human; identical to SEQ ID NO: 298724

SEQ ID NO: 300341 - RNA, 64 nt, Human
cuuugaucagcauugaggugaugcucaccuccgaggaccucagaacuggugcagcuucucucuc

SEQ ID NO: 300342 - RNA, 64 nt, Human
ucaguugugcugcagacaguaugaacaucucauuggaccucagaaaacccacccuggggagaag

SEQ ID NO: 300343 - RNA, 64 nt, Human
aaagugugaggcaugacccaaauuguaagcauagggaccucagggauggggaagaaacccgagu

SEQ ID NO: 300344 - RNA, 64 nt, Human
ccagucuccccuauguaaaacuuagcaacuugggggaccucauuccugggacuaugcuguaacc

SEQ ID NO: 300345 - RNA, 64 nt, Human
gaaagccccuggcucaggcugucagagugaggauggaccucaaaaguuugauccccucgugcag

SEQ ID NO: 300346 - RNA, 64 nt, Human
ccugcugucuucuccuucccugugcccugaacaaggaccucacugcccgccuuccccucccacc

SEQ ID NO: 300347 - RNA, 64 nt, Human
auuagccacuagcauggcuaauugaucauugauuggaccucauuacauaagggggcuguggacg

SEQ ID NO: 300348 - RNA, 64 nt, Human
gugggaaaggggagcuagggauugagggguuaagggaccucacacuaagaaggggcugugcuuu

SEQ ID NO: 300349 - RNA, 64 nt, Human
gcuuggucaucuaugacaccacaccagcacaguaggaccucagaaaaguacccaaaugcguacg

SEQ ID NO: 300350 - RNA, 64 nt, Human
cucaccauucaggcagaaaaagcaagucaccaagggaccucaaacuuccuuuccacaagauucu

SEQ ID NO: 300351 - RNA, 64 nt, Human
uagucugccggccacaccgcaucuuccggccgucggaccucauccacggggaggugcugggcaa

SEQ ID NO: 300352 - RNA, 64 nt, Human
cccagcaggagggcauagguggccucugcagaggggaccucagccugucacuggcccugaagac

SEQ ID NO: 300353 - RNA, 64 nt, Human
gaccucuuaauuacuagaccucaguacugaaucaggaccucacucagaaagacuaaaggaaaug

SEQ ID NO: 300354 - RNA, 64 nt, Human
guaaaggcaaaaccuugacacguguugguagcugggaccucaucuuccugagggcucugucuug

SEQ ID NO: 300355 - RNA, 64 nt, Human
cuguaaccucggcaagugccagaugucucuaaguggaccucagugccugugagugcucccccau

SEQ ID NO: 300356 - RNA, 64 nt, Human
aaaagcauuuuaaaguuuacauuuaagggaccuuggaccucaacccucucaaguuuacaagucu

SEQ ID NO: 300357 - RNA, 64 nt, Human
agaagcuaucaucacagguacaaacaucgcuugaagucuucacaucuaccacuagacaccccca

SEQ ID NO: 300358 - RNA, 64 nt, Human
gcaucucagcuuccgaacccugggcuguuuccuuagucuucauuuuauaaaaguuguugccuuu

SEQ ID NO: 300359 - RNA, 64 nt, Human
acaguucagucagugaggaugaugaaguagauacagucuucaggacaccauuagaugggcuuuc

SEQ ID NO: 300360 - RNA, 64 nt, Human
gcaaugugggcacuuaccauguuccuggcacacuggaccucaccaugucccccggucaccaguc

SEQ ID NO: 300361 - RNA, 64 nt, Human
cauucggggggaaaagugugaaaugaagcuacauggaccucacaaaaaccuguuccgacucuuu

SEQ ID NO: 300362 - RNA, 64 nt, Human
uaaccauaugccuagucucugaaacuaaaaacuuggaccucauccucaauuauuuucuccuuuc

SEQ ID NO: 300363 - RNA, 64 nt, Human
cuuguauuuaacugaauaaaugaguagacauuguggaccucacaagauuauuuaauucuuaaga

SEQ ID NO: 300364 - RNA, 54 nt, Human
cugccacuccugaggcauagaugaggaccucacccuaggaugggguuauaagcc

SEQ ID NO: 300365 - RNA, 64 nt, Human
ugugugccaagcccuggcccccacagcgcucgauggaccucagcaagcugcccagcccuggccc

SEQ ID NO: 300366 - RNA, 64 nt, Human
gcaguagugcuggucccuagagucgcuggaaguaggaccucaguagcuuuccuuccugcggccu

SEQ ID NO: 300367 - RNA, 64 nt, Human
aauauucuucaaugaaauuauauaauguaacuuuggaccucaguuuuucuuuagaaaugggugg

SEQ ID NO: 300368 - RNA, 64 nt, Human
ucacucuguccuuccgagaccugacaagcuuugaggaccucacagcuccccuguguguucaucu

SEQ ID NO: 300369 - RNA, 64 nt, Human
uauuuuacuauuuggagaauaugaugugaaaauuggaccucaaaggguuuccuuguguuuucau

SEQ ID NO: 300370 - RNA, 64 nt, Human
cuguuuccuccuuugugguagccucuggccaucuggaccucaauccccagcuuucccacuuuca

SEQ ID NO: 300371 - RNA, 64 nt, Human
ugcugucagccccaguuggcuuccuggucaacaaggaccucaagaacugccuguggaccgaggc

SEQ ID NO: 300372 - RNA, 64 nt, Human
ugguuggcuacgaaaugcuugcucaggcucagagggaccucaccccugagcaggucaggacuca

SEQ ID NO: 300373 - RNA, 64 nt, Human; identical to SEQ ID NO: 300280

SEQ ID NO: 300374 - RNA, 64 nt, Human
agggguugggccggaagguggaagagccugccaaggaccucauuuaguuuguguauuaaaacca

SEQ ID NO: 300375 - RNA, 64 nt, Human
aagacacagacugacagauggggugaaggccuggggaccucagagaacucugccuugcccucgu

SEQ ID NO: 300376 - RNA, 64 nt, Human; identical to SEQ ID NO: 298194

SEQ ID NO: 300377 - RNA, 64 nt, Human; identical to SEQ ID NO: 298983

SEQ ID NO: 300378 - RNA, 64 nt, Human; identical to SEQ ID NO: 298984

SEQ ID NO: 300379 - RNA, 64 nt, Human
cgacaugugcagaacggccccuuggcugcaguuaggaccucaguggcugguauggccaagcugc

SEQ ID NO: 300380 - RNA, 64 nt, Human
caacccugcccuaggcauaaaaugcaaggucucuggaccucagggcagggauguuagacagcgg

SEQ ID NO: 300381 - RNA, 64 nt, Human
auaguacaagucacccuacaacuacuacuucuugggaccucaagcccccaacaucccaguccuc

SEQ ID NO: 300382 - RNA, 64 nt, Human
cuuguccugguccuggccacaugucuuugcugugggaccucagacaaaacccugcaccucuuug

SEQ ID NO: 300383 - RNA, 64 nt, Human
aaaugggauuccagguuuaagauagcuccuuucuggaccucaguccuucaccuagucaccuagu

SEQ ID NO: 300384 - RNA, 64 nt, Human
guucggggauagaagccccgccgagaccccacagggaccucagucaccuuugagaagacaccau

SEQ ID NO: 300385 - RNA, 64 nt, Human
cuuaggcuaugcaggggggucuuucuuucauaaaggaccucauuccuugcgucccagcccagga

SEQ ID NO: 300386 - RNA, 64 nt, Human
cccaccuggugacaggcugugcgcagcagccccaggaccucacccugagcugagucuucaggag

SEQ ID NO: 300387 - RNA, 64 nt, Human; identical to SEQ ID NO: 300342

SEQ ID NO: 300388 - RNA, 64 nt, Human
cuuagaccucagcucccacagugccuuuuaagggggaccucaccuccugugcacagcccaccca

SEQ ID NO: 300389 - RNA, 64 nt, Human
ccaccccuccuggaccuaggccacccagccugugggaccucaggagggucagaggagaagcagc

SEQ ID NO: 300390 - RNA, 64 nt, Human
cagcccccuggugcggcccgagaccgggcagaguggaccucaccuggaaacucaccuucagcgc

SEQ ID NO: 300391 - RNA, 64 nt, Human
gcuuccugucacaguagcaggcccagcugcagaaggaccucaccugugcucacaagauccuucu

SEQ ID NO: 300392 - RNA, 64 nt, Human
gccacagcugcucaccuugucuggcaaacuggagggaccucagaaacuggacuccugcaugucc

SEQ ID NO: 300393 - RNA, 64 nt, Human
agagauacuauagaauccaaaugagaacugaauuggaccucaagucuucuauuccuacuaauag

SEQ ID NO: 300394 - RNA, 64 nt, Human
acaaaggagaagugacaaaagauaagcugcagaaggaccucagaagggcagagcaaagggugag

SEQ ID NO: 300395 - RNA, 64 nt, Human; identical to SEQ ID NO: 299019

SEQ ID NO: 300396 - RNA, 64 nt, Human; identical to SEQ ID NO: 299020

SEQ ID NO: 300397 - RNA, 64 nt, Human; identical to SEQ ID NO: 299002

SEQ ID NO: 300398 - RNA, 64 nt, Human
cgucuguggcgauuggugaacagcauaaacagcuggaccucagcaagggucaggcaaacccagu

SEQ ID NO: 300399 - RNA, 64 nt, Human
augccucauacuuacacccugguacugguugauuggaccucaggggaaaaaagugaaaaagggu

SEQ ID NO: 300400 - RNA, 64 nt, Human
ucuuccgugagggcugccaggggguggugugccaggaccucaggcugggccuuugugcuggccu

SEQ ID NO: 300401 - RNA, 64 nt, Human
gaguggucaccaggcuugcaaaugaacuucagacggaccucaggguagguucucgggacugaag

SEQ ID NO: 300402 - RNA, 63 nt, Human
aaagugaaaguggcuucuaagguacugucuucuggaccucagagcccacucuccuuggcaccc

SEQ ID NO: 300403 - RNA, 64 nt, Human
ccagccuuugccuuugagcccugggguaaggccuggaccucaagauuccuggaaagaagcccca

SEQ ID NO: 300404 - RNA, 64 nt, Human
ccuggggggaccaugcucuaacccuaguccaggcggaccucacccuucucuucccaggucuauc

SEQ ID NO: 300405 - RNA, 64 nt, Human
gagauuagugaggcaaggugcugcucagagaggaggaccucauuguucuuaggaccuuggccag

SEQ ID NO: 300406 - RNA, 64 nt, Human
caucaacacagcagccugcagauaacacuuggggggaccucagccucuauucgcaacucauaau

SEQ ID NO: 300407 - RNA, 64 nt, Human
uuucuguaggauuuucuuaugcacugcacacucuggaccucaccugcagauacaguuccccccu

SEQ ID NO: 300408 - RNA, 64 nt, Human
cuuuuuaagggauugcuuucaucuaauucuggcaggaccucaccaaaagauccagccucauacc

SEQ ID NO: 300409 - RNA, 64 nt, Human
aaaacgucucucuucccuucuuucaggaauacuuggaccucagccaaccucucgaacaguauuc

SEQ ID NO: 300410 - RNA, 52 nt, Human
gcagucaggacggugccuaaguggaccucagacauggcucagccauaggacc

SEQ ID NO: 300411 - RNA, 62 nt, Human
gcugccagugcaaaaucugaggcucugacuuuggaccucaggugaguccagcauauccacac

SEQ ID NO: 300412 - RNA, 64 nt, Human
gaucuucaaagagauggccauuaacuuagcagugggaccucacuuuuacaagcacugcucuaga

SEQ ID NO: 300413 - RNA, 64 nt, Human
uaaaauugccauuugaaaacugaccagcuaaucuggaccucagagauagaucagccaguggccc

SEQ ID NO: 300414 - RNA, 64 nt, Human; identical to SEQ ID NO: 298611

SEQ ID NO: 300415 - RNA, 64 nt, Human; identical to SEQ ID NO: 298612

SEQ ID NO: 300416 - RNA, 64 nt, Human; identical to SEQ ID NO: 298432

SEQ ID NO: 300417 - RNA, 64 nt, Human
gaccucaccggcaugcuggccuguggcaggccuaggaccucaggcggggaggaggagcugccgc

SEQ ID NO: 300418 - RNA, 64 nt, Human
gggauccaggaccugggauccagggcccugggcuggaccucaggacaggcauggaggccacagg

SEQ ID NO: 300419 - RNA, 53 nt, Human
agcccccugcccaccuuugagcaggaccucaccuuggcucuguugcuguccuc

SEQ ID NO: 300420 - RNA, 64 nt, Human
gcuccggaguuauucucugucaaaucuacuccccggaccucaaccauggcaagaaccagagguc

SEQ ID NO: 300421 - RNA, 64 nt, Human
gaauccuuuggugccaacugguguuugaaaguagggaccucagagguuuaccuagagaacaggu

SEQ ID NO: 300422 - RNA, 64 nt, Human
agagcaucaguggaaaacccaccccacacgccauggaccucagggcacucuccucccugcccac

SEQ ID NO: 300423 - RNA, 64 nt, Human
cuuuuggaccuuggaugugucaccugaacucucuggaccucagguuuccaucuguaaaaugaga

SEQ ID NO: 300424 - RNA, 64 nt, Human
acugcugcuagcucuucaagccagguucaugcuuggaccucauucugauaaaguauaagacuuu

SEQ ID NO: 300425 - RNA, 64 nt, Human
gucacagagggcaccacugagaacugcgugcauaggaccucaaaauacaaaauuagcagggccu

SEQ ID NO: 300426 - RNA, 64 nt, Human
gaagagcacugguguggggguuccaccgagaaggggaccucaucuagaaaagagguuacaaacc

SEQ ID NO: 300427 - RNA, 64 nt, Human
cucugaggauccaggcucaggacccggaguucucggaccucaacucggccaucacauaucgaau

SEQ ID NO: 300428 - RNA, 64 nt, Human
uagaauccaaauucucugagaugagggugcuuauggaccucaaauagccuuucuuaucugcucc

SEQ ID NO: 300429 - RNA, 64 nt, Human
cuggugccuccccucgaaccgccaagcagaaaccggaccucacagcugacugggaacuggacau

SEQ ID NO: 300430 - RNA, 64 nt, Human
ggaagguacugcccauugggagauggggacauugggaccucagcaaugaagaacccuugugaag

SEQ ID NO: 300431 - RNA, 64 nt, Human
uaaaucacuggggggcugggccuugcagguggagggaccucacuccagggcacggcgugggagg

SEQ ID NO: 300432 - RNA, 64 nt, Human
cccccuuucagagggccacuggguuaggaccugaggaccucacuuggcccugcaaggcccgcuu

SEQ ID NO: 300433 - RNA, 64 nt, Human; identical to SEQ ID NO: 298196

SEQ ID NO: 300434 - RNA, 64 nt, Human; identical to SEQ ID NO: 298509

SEQ ID NO: 300435 - RNA, 64 nt, Human; identical to SEQ ID NO: 298510

SEQ ID NO: 300436 - RNA, 64 nt, Human
cuguauuggacuaauucugaacuacagacaaauuggaccucaaugucauuuacuucccucauau

SEQ ID NO: 300437 - RNA, 64 nt, Human
cagcauguggggaaggacuuauggugggccagguggaccucauccugcuucuuccucccucugg

SEQ ID NO: 300438 - RNA, 64 nt, Human
caaaaaggucgcgaauccgugggacugagcacggggaccucacccgcuagccagcgucugcugc

SEQ ID NO: 300439 - RNA, 64 nt, Human
aggggguagcuagccugagagggaacccucuaagggaccucaaaggugauugugccaggcucug

SEQ ID NO: 300440 - RNA, 64 nt, Human
cuuccaguugucagcaagcaggaaaaaaaaauugggaccucaguugcaaccacaaggaacugaa

SEQ ID NO: 300441 - RNA, 64 nt, Human
agacagccacucugcuuagacaugggagcuauagggaccucagggagccccagcuucuuaccca

SEQ ID NO: 300442 - RNA, 64 nt, Human
cuaaaaaagaacuaaaaagggagaacggggcaagggaccucaggcugccccucucuccuccaug

SEQ ID NO: 300443 - RNA, 64 nt, Human
aggggguuauucaagaaauugaaaauuucaucuuggaccucagugcauaggucaaauggauuuc

SEQ ID NO: 300444 - RNA, 64 nt, Human
ggcagugaggguuggacuggugucuucagacccaggaccucagacuucuggcucacacagaccc

SEQ ID NO: 300445 - RNA, 64 nt, Human
acccaagcacuuuaugcauauagagacagaaccuggaccucaccagggacugcugggcagcgau

SEQ ID NO: 300446 - RNA, 64 nt, Human
gcccgagcaccggaccacguugcugcccaggucuggaccucagcgggagaacuggcuccggggg

SEQ ID NO: 300447 - RNA, 64 nt, Human
cugccuaggccuggagggaagcccaaggcuacuuggaccucaggaccuggaaucugagagggug

SEQ ID NO: 300448 - RNA, 64 nt, Human
uuccagucacuucucaggagcaggaacagccaggggaccucagacccaggguauuuucauacca

SEQ ID NO: 300449 - RNA, 64 nt, Human
uucuggauuuucuuaucacaaaaaagaaaaugaaggaccucaaagcaccugaacaguuuaucga

SEQ ID NO: 300450 - RNA, 64 nt, Human
aggagacaagcuucuuugaugagaaccgcacaggggaccucaucucccgccugaccucggacac

SEQ ID NO: 300451 - RNA, 64 nt, Human
aaagaauucuuaaggcauaaauacgugucuaaauggaccucauaucuuugagauaauuaaacua

SEQ ID NO: 300452 - RNA, 64 nt, Human; identical to SEQ ID NO: 299003

SEQ ID NO: 300453 - RNA, 64 nt, Human; identical to SEQ ID NO: 298945

SEQ ID NO: 300454 - RNA, 64 nt, Human; identical to SEQ ID NO: 298530

SEQ ID NO: 300455 - RNA, 64 nt, Human
aaagguuaauccgagaauuagcauggauauaccgggaccucaugcagcuuggcagauaucugag

SEQ ID NO: 300456 - RNA, 64 nt, Human
cagguccauaaagugaacugaucuuaccgagucaggaccucagccagcucucaagagguucugc

SEQ ID NO: 300457 - RNA, 64 nt, Human
cucagaacuccagcuauucacucuccagggagaaggaccucaaaucgccacucuuugggcggca

SEQ ID NO: 300458 - RNA, 64 nt, Human
ugggcacaggauacauauguccccgucccacugaggaccucaguuugggagugcccuugagccc

SEQ ID NO: 300459 - RNA, 64 nt, Human
ucccugaaguucccuguugcaugagccugcgacaggaccucacccccaccaccaggcuucuauu

SEQ ID NO: 300460 - RNA, 64 nt, Human
gcugugugacauugggacaacacuuucccucucuggaccucaguuucccucuguauacaaggau

SEQ ID NO: 300461 - RNA, 64 nt, Human
agcuccgagcugcgccugagccgugccagccggcggaccucaggcgguggacgucggcgauagc

SEQ ID NO: 300462 - RNA, 64 nt, Human
uaagaagcacgugugugcaggaagcggaggcgcaggaccucaccgcgccagcgugaaguucccg

SEQ ID NO: 300463 - RNA, 64 nt, Human
cgcaccuauaucuggaugaagagguagaaacucuggaccucauuaaugaguuauuucuuggccu

SEQ ID NO: 300464 - RNA, 64 nt, Human
cuuaggaugcagcaugccuucaggagacacugcuggaccucagcauucccuugauaucaguccc

SEQ ID NO: 300465 - RNA, 64 nt, Human
uguuuguagaucacaggcaccaguuggucuucagggaccucauagccccucgguggugccuucu

SEQ ID NO: 300466 - RNA, 64 nt, Human
ugaguaccuauuuugaugcaaaggaacggcccugggaccucagagggccacagaugggcuuccu

SEQ ID NO: 300467 - RNA, 64 nt, Human
ucccucguuuacggggcgcuggccuaccuccugaggaccucagccacagaugagaucacacgca

SEQ ID NO: 300468 - RNA, 64 nt, Human
cuugucaccaggcaaccaggaaacugcuacuuguggaccucaccagagaccaggaggguuuggu

SEQ ID NO: 300469 - RNA, 64 nt, Human
caucuuguagaacuccagcuuuguugaaaaucacggaccucagcuacaucauacacugacccag

SEQ ID NO: 300470 - RNA, 64 nt, Human
gcagguuuccgagcagagggucauacacagggcuggaccucacgcagacuggcauggccauggg

SEQ ID NO: 300471 - RNA, 64 nt, Human; identical to SEQ ID NO: 298551

SEQ ID NO: 300472 - RNA, 64 nt, Human; identical to SEQ ID NO: 298552

SEQ ID NO: 300473 - RNA, 64 nt, Human; identical to SEQ ID NO: 298569

SEQ ID NO: 300474 - RNA, 64 nt, Human
uuugcacaccacagagugcccucacccacuccauggaccucaagcagcccucagagcuggagcc

SEQ ID NO: 300475 - RNA, 64 nt, Human
acaaaauacuauagcaugcaugccacugcacuugggaccucaucaugucaguugaaucgagaaa

SEQ ID NO: 300476 - RNA, 64 nt, Human
gggguuagaauaaagcaucugaauacaguuuucaggaccucaagcagacuuccuagagacuugu

SEQ ID NO: 300477 - RNA, 64 nt, Human
aagcuuuaaauuaaaaaaaauuuuuaaaagaccaggaccucaagauagcagguuuauacuuaga

SEQ ID NO: 300478 - RNA, 64 nt, Human
agaggacagugaaccugccuuccaccugccagagggaccucaggguguggcauuauagggccag

SEQ ID NO: 300479 - RNA, 64 nt, Human
ccgccagcccucaccaccugcccuccuucuaccaggaccucagaagcccagaccuggggacccc

SEQ ID NO: 300480 - RNA, 64 nt, Human
uucaccauguuggccaggcugggcucgaacuccuggaccucaagugaucuacccgccuuggccu

SEQ ID NO: 300481 - RNA, 64 nt, Human
uagcugguggugggcgcuaauccuccugagugcuggaccucauuaaagugcauggaaaucacug

SEQ ID NO: 300482 - RNA, 64 nt, Human
acguccuggacgaaaaccagagcaagcucagcgaggaccucauggaguuccggcgggacgcauc

SEQ ID NO: 300483 - RNA, 64 nt, Human
uugaccuagggccuuuggcuuucacuaaaaguggggaccucaguaucccagauuguaauuuugc

SEQ ID NO: 300484 - RNA, 64 nt, Human
ccauguaacaguguagaugcagacucaccgaccgggaccucagacgcgagggaaaggagcacua

SEQ ID NO: 300485 - RNA, 64 nt, Human
acacccugacugucccaccuucuguccuuguccuggaccucagguucccagcgucccgagccca

SEQ ID NO: 300486 - RNA, 64 nt, Human
gcugccccccaccaguggcuucuagggaaagcaaggaccucacaugccaggugcccuaguacuu

SEQ ID NO: 300487 - RNA, 64 nt, Human
cagcugguggugggcgcuaauccuccugagugcuggaccucauuaaagugcauggaaaucacug

SEQ ID NO: 300488 - RNA, 64 nt, Human
ccccaaccuccccaccccaagaggggucugagugggaccucaaagcauggccagugcaauucug

SEQ ID NO: 300489 - RNA, 64 nt, Human
gucaguuucuagaagacauggaagcauaugcugaggaccucagccauguggccucuggggaauc

SEQ ID NO: 300490 - RNA, 64 nt, Human; identical to SEQ ID NO: 298490

SEQ ID NO: 300491 - RNA, 64 nt, Human; identical to SEQ ID NO: 298491

SEQ ID NO: 300492 - RNA, 64 nt, Human; identical to SEQ ID NO: 298492

SEQ ID NO: 300493 - RNA, 64 nt, Human; identical to SEQ ID NO: 300489

SEQ ID NO: 300494 - RNA, 64 nt, Human
ucuccuccccacccgcccuccccacggggccucgggaccucagguggccccaguucaaucuccc

SEQ ID NO: 300495 - RNA, 64 nt, Human
cagccccacccccacggcagacccuggugucccuggaccucaccgggccauggacccccccccc

SEQ ID NO: 300496 - RNA, 64 nt, Human
uccugccccguguccagaccgagcgugugccacuggaccucaguccucgccuggaggagacgcu

SEQ ID NO: 300497 - RNA, 64 nt, Human
cuuccugccacugcagagugggaagcuuccugggggaccucagccagcuccggggcucucaucu

SEQ ID NO: 300498 - RNA, 64 nt, Human
gcagagagagccagccccuacccucagaguaucuggaccucagagaccauguugugccaggggu

SEQ ID NO: 300499 - RNA, 64 nt, Human
gccugacugaccacccccucagagcacagaucagggaccucacgcaucucuuucucauauacau

SEQ ID NO: 300500 - RNA, 64 nt, Human
gggcccgccuggcagaacugagcuccucugggcaggaccucagaguccaggccccaaaaccaca

SEQ ID NO: 300501 - RNA, 64 nt, Human
gagccuguaccccuaacccuaacagcuaaaucaaggaccucagccuuauauaaucauugucccc

SEQ ID NO: 300502 - RNA, 64 nt, Human
cgcgugggcagagccuuccacagugaaugugucuggaccucauguuguugaggcugucacaguc

SEQ ID NO: 300503 - RNA, 62 nt, Human
cgaucaccccguaggaaauaaagcaggcaucucuggaccucauccacccugggccucugcug

SEQ ID NO: 300504 - RNA, 64 nt, Human
ugugcccucaccccaaucccugccacugggcucuggaccucaggagggcaggcugaggugggga

SEQ ID NO: 300505 - RNA, 64 nt, Human
ccugcaucagugauucuaaugaucagcuuugacuggaccucagcucacacgaaucuccaaggaa

SEQ ID NO: 300506 - RNA, 64 nt, Human
ugaccucucuccccacacccucaccugcacccuaggaccucacuggccauaggagcugggccac

SEQ ID NO: 300507 - RNA, 64 nt, Human
gguuuccaggagaugguagacauugggaccugggggaccucagagcagagugccacauuacagg

SEQ ID NO: 300508 - RNA, 64 nt, Human
ucagggugugcccagcccggcccuggcucagggaggaccucaggguuccuggagauuccugcag

SEQ ID NO: 300509 - RNA, 64 nt, Human; identical to SEQ ID NO: 298572

SEQ ID NO: 300510 - RNA, 64 nt, Human; identical to SEQ ID NO: 298629

SEQ ID NO: 300511 - RNA, 64 nt, Human; identical to SEQ ID NO: 298630

SEQ ID NO: 300512 - RNA, 64 nt, Human
cccaggagcagcaacccugagucaauaaggagcaggaccucagcuucauuguccuugagcagga

SEQ ID NO: 300513 - RNA, 64 nt, Human
ccucauccuguuuguuuuaggaauccuggucucaggaccucauggaagaagagggggagagagu

SEQ ID NO: 300514 - RNA, 64 nt, Human
gcuguguaaccuugaacuacacaauucuccuucgggaccucaauuuccacuuuguaaaaugagg

SEQ ID NO: 300515 - RNA, 64 nt, Human
cccuuccccaacucccgaauccucucuugaguguggaccucaacaccuugagcccuaguaaagg

SEQ ID NO: 300516 - RNA, 64 nt, Human
ucccucccugccauuguggacucuuguauuugagggaccucaagagagugaggacccuaccauc

SEQ ID NO: 300517 - RNA, 54 nt, Human
ucgagggaccgagcugcugagggaggaccucaguuaaccaauuaccuuuucccg

SEQ ID NO: 300518 - RNA, 64 nt, Human
agcgguaaugguggcugugcauucuggucagucuggaccucagcaacuucaucucaggacuaaa

SEQ ID NO: 300519 - RNA, 64 nt, Human
uugucacugcagucgaggcggagucagggcugugggaccucagcgguuagccugacucuucuuc

SEQ ID NO: 300520 - RNA, 64 nt, Human
ucuuaggaucuugaaaauauuugugcagccauuuggaccucaguaugagguaguguuaaaaggc

SEQ ID NO: 300521 - RNA, 64 nt, Human
caaaagaggucauccggggacccacuguugcccuggaccucagcgggaaggagcaggagagagc

SEQ ID NO: 300522 - RNA, 64 nt, Human
ggagaggcccucuggccgccucaacgcacuucgcggaccucagcccugcagcuggagggcaaca

SEQ ID NO: 300523 - RNA, 64 nt, Human
guguguacggagggucuagucugagugcguguggggaccucagaacacugugaccuuagcccag

SEQ ID NO: 300524 - RNA, 64 nt, Human
ccgucaauaccucccaccaaggaaugagauauguggaccucacugcucccccaacccagcguca

SEQ ID NO: 300525 - RNA, 64 nt, Human
acagggucccuucccccacuucacguccuuccugggaccucagaaugugaccuuauuuggaaau

SEQ ID NO: 300526 - RNA, 64 nt, Human
uggcuggagccaggacaugagucaggggcaccauggaccucacgugccagggagacuugaaugu

SEQ ID NO: 300527 - RNA, 64 nt, Human
acgaaagacucuuaccauuuuauuaaaaacgcaaggaccucagagacguucuuuucuguaugga

SEQ ID NO: 300528 - RNA, 64 nt, Human; identical to SEQ ID NO: 298570

SEQ ID NO: 300529 - RNA, 64 nt, Human; identical to SEQ ID NO: 298214

SEQ ID NO: 300530 - RNA, 64 nt, Human; identical to SEQ ID NO: 298389

SEQ ID NO: 300531 - RNA, 64 nt, Human
caggcgcugucucuccagagccauccuucagaguggaccucagugccaguccugccucagcauc

SEQ ID NO: 300532 - RNA, 64 nt, Human
uccucuccccaucugccuucuccucccccagaaaggaccucaaccacacuccacgccggcagcc

SEQ ID NO: 300533 - RNA, 64 nt, Human
cacacccgaggcucccaccugcggagccgcugggggaccucacgucccagccaggaucccccug

SEQ ID NO: 300534 - RNA, 64 nt, Human
augaggccacuguggguguuauuuuuucaugucuggaccucagccuauauccugagacuaagug

SEQ ID NO: 300535 - RNA, 64 nt, Human
gcaagcgcccagcuccccagagcuccccaaccucggaccucaccgcaggggcgcugggcuggag

SEQ ID NO: 300536 - RNA, 53 nt, Human
cagacaccuacauguucugauugggaccucaguggucaaaaucccuuucacca

SEQ ID NO: 300537 - RNA, 64 nt, Human
ggcuucaugguuuggggguauauagaaauucucaggaccucagaccuuugauucuccuuuagca

SEQ ID NO: 300538 - RNA, 64 nt, Human
gcaaguucaaguccuucccauacucaaguggccaggaccucacaggguauggcugucaagaggc

SEQ ID NO: 300539 - RNA, 64 nt, Human
agcgagcagcucgguccagugacccagaucccagggaccucagucggcuuaaucagaguguggc

SEQ ID NO: 300540 - RNA, 64 nt, Human
cugaaucucaccugcuaggagccucaccugcuggggaccucacccuggagggcacugggcccug

SEQ ID NO: 300541 - RNA, 64 nt, Human
cagagaccuugccacacugaaucucaccugcuggggaccucacccuggagggcccugggcccug

SEQ ID NO: 300542 - RNA, 64 nt, Human
ggggaccucgccuguuggggaccucaccugcuggggaccucaccugcuggggaccuuggcugcu

SEQ ID NO: 300543 - RNA, 64 nt, Human
agggaccucgccugcuggggaccucgccuguuggggaccucaccugcuggggaccucaccugcu

SEQ ID NO: 300544 - RNA, 64 nt, Human
ggaguccuuuguggccaacccucucucuuaccugggaccucacacgcugggcuucacggcugcc

SEQ ID NO: 300545 - RNA, 64 nt, Human
caccugagaggccggcauggggccugggcugccgggaccucacuuucccagggccucaccuacc

SEQ ID NO: 300546 - RNA, 64 nt, Human
cuuucgaagacacaugacaaugcacacuggagauggaccucacaaaaugcaagauaugugggaa

SEQ ID NO: 300547 - RNA, 64 nt, Human; identical to SEQ ID NO: 298511

SEQ ID NO: 300548 - RNA, 64 nt, Human; identical to SEQ ID NO: 298512

SEQ ID NO: 300549 - RNA, 64 nt, Human; identical to SEQ ID NO: 298590

SEQ ID NO: 300550 - RNA, 64 nt, Human
cuuccaaagacacaugauaaggcacacuagagauggaccucauaaauguaagauaugugggaaa

SEQ ID NO: 300551 - RNA, 64 nt, Human
ccccaacuuucuccaugagggucacgcccccugaggaccucaggaggccagcagaacccgcagg

SEQ ID NO: 300552 - RNA, 64 nt, Human
acguggaugccucucccucgccucugucaguucaggaccucaaggggcucggcuaugagaaggg

SEQ ID NO: 300553 - RNA, 64 nt, Human
gcugugcaggauucaggguuugcagaaauucucaggaccucagaccucuguccuaugacuaaug

SEQ ID NO: 300554 - RNA, 64 nt, Human
cacuccuuuguccccgcagggccuaccuggauguggaccucacccugacucgggagcagacgga

SEQ ID NO: 300555 - RNA, 64 nt, Human
gucaccgaagugugaggaacaguugaggucugcaggaccucacaccucccuagagggagggagg

SEQ ID NO: 300556 - RNA, 64 nt, Human
gcugggacugaggaaaggauaaaccccgauauugggaccucacagugggugucugaaaggacag

SEQ ID NO: 300557 - RNA, 64 nt, Human
ccugccuugagggaagaccacccuccugucacccggaccucaguggaagcccguuccccccauc

SEQ ID NO: 300558 - RNA, 64 nt, Human
ugucaaggccuggucucaucugaaaagcccuccuggaccucaaagaauucuucagaccucauag

SEQ ID NO: 300559 - RNA, 64 nt, Human
uuucuccuuguuggucaggcuggucucaaaccccggaccucaggugauccccccaccuuggccu

SEQ ID NO: 300560 - RNA, 64 nt, Human
gaagacagcauuccacagccuggucaggagggaaggaccucacuuguuucaucaaauggagugg

SEQ ID NO: 300561 - RNA, 64 nt, Human
ucuauccaagacugugcccacauccgaagcacaaggaccucaagucaccagcauaagaacauca

SEQ ID NO: 300562 - RNA, 64 nt, Human
cgcaccucccagagcuggcgccacugaguaauccggaccucaccaccucuuuuccuuugagccc

SEQ ID NO: 300563 - RNA, 64 nt, Human
ugcucaaguaggccuggcuggcacagggcugcauggaccucagggggcuguggggccagaagcu

SEQ ID NO: 300564 - RNA, 64 nt, Human
ugugucugcagacugcuaaccuaugacaauucagggaccucaccugucggaccuauagcuugcu

SEQ ID NO: 300565 - RNA, 64 nt, Human
ggugaagaagugaccugcgacacaggaaacgaugggaccucagucuucuucagcagaggacuug

SEQ ID NO: 300566 - RNA, 64 nt, Human; identical to SEQ ID NO: 298591

SEQ ID NO: 300567 - RNA, 64 nt, Human; identical to SEQ ID NO: 298592

SEQ ID NO: 300568 - RNA, 64 nt, Human; identical to SEQ ID NO: 298216

SEQ ID NO: 300569 - RNA, 64 nt, Human
cagaaucaaacacagaaccucagaaccagauuuaggaccucagaauccugcacucaagguggca

SEQ ID NO: 300570 - RNA, 64 nt, Human
cugugguucuucaagcaaugggccuuguaccaaaggaccucauggcuaaugccacuugcuucag

SEQ ID NO: 300571 - RNA, 64 nt, Human
aagagaaaaugugagguuguuuagauacucaucaggaccucacaggagcugagacuuaucagcc

SEQ ID NO: 300572 - RNA, 64 nt, Human
ugggugagaaauuuuaguuuagguguuugggaucggaccucaguuucuguuguuucuuuuaugu

SEQ ID NO: 300573 - RNA, 64 nt, Human
auccugccacuguuuuguuggcccacaacuaauaggaccucaaaauaagccaugcugcuuugca

SEQ ID NO: 300574 - RNA, 64 nt, Human
acuggaauugucugauauuuaagagaaacauucaggaccucaucauuaugugggggcuuuguuc

SEQ ID NO: 300575 - RNA, 64 nt, Human
cacucgggugucccgggaggugcccugggcccggggaccucacaggcaggacggcgacacuaau

SEQ ID NO: 300576 - RNA, 64 nt, Human
gggucgcacccccuccccacggccccacccacagggaccucaacuucugggcccgggauuuuuu

SEQ ID NO: 300577 - RNA, 64 nt, Human
gcccacccacucccaaaauccgucaguauucacuggaccucaggcccugugcaggagugcgauc

SEQ ID NO: 300578 - RNA, 64 nt, Human
cugugugaccuccagccggucacucacccucucuggaccucaucuguaagaggagccagcugga

SEQ ID NO: 300579 - RNA, 64 nt, Human
agacuuuucauaacagacguuaagaccaagccguggaccucaccccaggggaaugccacggccc

SEQ ID NO: 300580 - RNA, 64 nt, Human
aagacuacaugaacacgucuuguuuggagguaccggaccucauaaaaggacucucagccucuug

SEQ ID NO: 300581 - RNA, 64 nt, Human
cccaagcuccauuggagaugaccaguccuuucugggaccucaaugggucacaaucccauuggau

SEQ ID NO: 300582 - RNA, 64 nt, Human
accccaauccuauacccaaaucuaugauauucugggaccucagugauuuugguccccucccacu

SEQ ID NO: 300583 - RNA, 64 nt, Human
cccucagcaggucuggggagcuagagcaaaggagggaccucaggccuuccguuucuucuuccag

SEQ ID NO: 300584 - RNA, 64 nt, Human
ucauagcuguguccugggucacuguggcuggugaggaccucaaggaccccaucaaguguacaca

SEQ ID NO: 300585 - RNA, 64 nt, Human; identical to SEQ ID NO: 298632

SEQ ID NO: 300586 - RNA, 64 nt, Human; identical to SEQ ID NO: 298233

SEQ ID NO: 300587 - RNA, 64 nt, Human; identical to SEQ ID NO: 298669

SEQ ID NO: 300588 - RNA, 64 nt, Human
uggucacccucugcuccaggccuucuccaccacaggaccucagcugucccuccuucuacccaag

SEQ ID NO: 300589 - RNA, 64 nt, Human
aaugcagcacuggcaugcauguccuccuucugaaggaccucauccuuccucacagggggaugac

SEQ ID NO: 300590 - RNA, 64 nt, Human
ucuacggccgcagagcggcuggcaguuucuucgaggaccucagcaaggugggggaggggccggg

SEQ ID NO: 300591 - RNA, 64 nt, Human
aaaaccucuuaaaucauagcugucugaccucuacggaccucacauccaucugaggcuucaugga

SEQ ID NO: 300592 - RNA, 64 nt, Human
guauuuuuucuugcauugacauuauagacauugaggaccucauccaaacaauuuaaaaaugagu

SEQ ID NO: 300593 - RNA, 64 nt, Human
ggaauagugacaccagacaguugaugucuagauaggaccucaaugauucccuuagaaucuuaga

SEQ ID NO: 300594 - RNA, 64 nt, Human
gguugcgcaagcgauguuugcgcucgcauuacagggaccucaaccuaggugcaauccugucaug

SEQ ID NO: 300595 - RNA, 64 nt, Human
guaauuacauugugguauuaauauuuagaaaaauggaccucagcaguguauuuacuguacaucu

SEQ ID NO: 300596 - RNA, 64 nt, Human
uuccagcuccuccgugcuuccucaguuacacaaaggaccucagcugcuucucccacuuggccaa

SEQ ID NO: 300597 - RNA, 64 nt, Human
augacagcaccccugagcugggcaaagguacucaggaccucauaggagucuuaggcaguuaccu

SEQ ID NO: 300598 - RNA, 64 nt, Human
uuuucugugcucuugguauuuuacuacuugauguggaccucagagaagcugaacuguaauugaa

SEQ ID NO: 300599 - RNA, 64 nt, Human
ucuccuaccugcacagccuggggaucgugcaccgggaccucaaggugccuggcuggggccucug

SEQ ID NO: 300600 - RNA, 64 nt, Human
uguuuguuucuuaaauccuacuaucuccuggccuggaccucagaaggagcuuuuugcuuaucua

SEQ ID NO: 300601 - RNA, 64 nt, Human
uagguguuauguauuccuaugacaaaaaaaauuaagucuucaaauuuuuuaaagguuuuuuuuu

SEQ ID NO: 300602 - RNA, 64 nt, Human
gguaucuguuuaacauuuccucagucaaguucagagucuucagagacuucguaauuaaaggaac

SEQ ID NO: 300603 - RNA, 64 nt, Human
aguauauuuuaagagaugugcaugcauucuauuuagucuucagaaugcugaauuuacuuguugu

SEQ ID NO: 300604 - RNA, 64 nt, Human
gucauuuauuucuucacuguguugagcugggaggagucuucaaugugggaagggauuuucugcc

SEQ ID NO: 300605 - RNA, 64 nt, Human; identical to SEQ ID NO: 298907

SEQ ID NO: 300606 - RNA, 64 nt, Human; identical to SEQ ID NO: 298908

SEQ ID NO: 300607 - RNA, 64 nt, Human; identical to SEQ ID NO: 298175

SEQ ID NO: 300608 - RNA, 53 nt, Human; identical to SEQ ID NO: 298886

SEQ ID NO: 300609 - RNA, 64 nt, Human; identical to SEQ ID NO: 298887

SEQ ID NO: 300610 - RNA, 64 nt, Human; identical to SEQ ID NO: 298888

SEQ ID NO: 300611 - RNA, 64 nt, Human; identical to SEQ ID NO: 298889

SEQ ID NO: 300612 - RNA, 64 nt, Human; identical to SEQ ID NO: 298924

SEQ ID NO: 300613 - RNA, 64 nt, Human; identical to SEQ ID NO: 298925

SEQ ID NO: 300614 - RNA, 64 nt, Human; identical to SEQ ID NO: 298176

SEQ ID NO: 300615 - RNA, 64 nt, Human; identical to SEQ ID NO: 298926

SEQ ID NO: 300616 - RNA, 64 nt, Human; identical to SEQ ID NO: 298927

SEQ ID NO: 300617 - RNA, 64 nt, Human; identical to SEQ ID NO: 298687

SEQ ID NO: 300618 - RNA, 64 nt, Human; identical to SEQ ID NO: 298688

SEQ ID NO: 300619 - RNA, 64 nt, Human; identical to SEQ ID NO: 298193

SEQ ID NO: 300620 - RNA, 64 nt, Human; identical to SEQ ID NO: 298962

SEQ ID NO: 300621 - RNA, 64 nt, Human; identical to SEQ ID NO: 298963

SEQ ID NO: 300622 - RNA, 64 nt, Human; identical to SEQ ID NO: 298964

SEQ ID NO: 300623 - RNA, 64 nt, Human; identical to SEQ ID NO: 299987

SEQ ID NO: 300624 - RNA, 64 nt, Human; identical to SEQ ID NO: 300040

SEQ ID NO: 300625 - RNA, 64 nt, Human; identical to SEQ ID NO: 300041

SEQ ID NO: 300626 - RNA, 64 nt, Human; identical to SEQ ID NO: 298033

SEQ ID NO: 300627 - RNA, 64 nt, Human; identical to SEQ ID NO: 300002

SEQ ID NO: 300628 - RNA, 64 nt, Human; identical to SEQ ID NO: 300003

SEQ ID NO: 300629 - RNA, 64 nt, Human; identical to SEQ ID NO: 300004

SEQ ID NO: 300630 - RNA, 64 nt, Human; identical to SEQ ID NO: 300005

SEQ ID NO: 300631 - RNA, 64 nt, Human; identical to SEQ ID NO: 300020

SEQ ID NO: 300632 - RNA, 64 nt, Human; identical to SEQ ID NO: 300021

SEQ ID NO: 300633 - RNA, 64 nt, Human; identical to SEQ ID NO: 298034

SEQ ID NO: 300634 - RNA, 64 nt, Human; identical to SEQ ID NO: 300022

SEQ ID NO: 300635 - RNA, 64 nt, Human; identical to SEQ ID NO: 300023

SEQ ID NO: 300636 - RNA, 64 nt, Human; identical to SEQ ID NO: 300092

SEQ ID NO: 300637 - RNA, 64 nt, Human; identical to SEQ ID NO: 300093

SEQ ID NO: 300638 - RNA, 64 nt, Human; identical to SEQ ID NO: 298035

SEQ ID NO: 300639 - RNA, 64 nt, Human; identical to SEQ ID NO: 300056

SEQ ID NO: 300640 - RNA, 64 nt, Human; identical to SEQ ID NO: 300057

SEQ ID NO: 300641 - RNA, 64 nt, Human; identical to SEQ ID NO: 300058

SEQ ID NO: 300642 - RNA, 64 nt, Human; identical to SEQ ID NO: 300059

SEQ ID NO: 300643 - RNA, 64 nt, Human; identical to SEQ ID NO: 300207

SEQ ID NO: 300644 - RNA, 64 nt, Human; identical to SEQ ID NO: 298052

SEQ ID NO: 300645 - RNA, 64 nt, Human; identical to SEQ ID NO: 300094

SEQ ID NO: 300646 - RNA, 64 nt, Human; identical to SEQ ID NO: 300095

SEQ ID NO: 300647 - RNA, 64 nt, Human; identical to SEQ ID NO: 300110

SEQ ID NO: 300648 - RNA, 64 nt, Human; identical to SEQ ID NO: 300111

SEQ ID NO: 300649 - RNA, 64 nt, Human; identical to SEQ ID NO: 298053

SEQ ID NO: 300650 - RNA, 64 nt, Human; identical to SEQ ID NO: 300112

SEQ ID NO: 300651 - RNA, 64 nt, Human; identical to SEQ ID NO: 300113

SEQ ID NO: 300652 - RNA, 64 nt, Human; identical to SEQ ID NO: 299876

SEQ ID NO: 300653 - RNA, 64 nt, Human; identical to SEQ ID NO: 299877

SEQ ID NO: 300654 - RNA, 64 nt, Human; identical to SEQ ID NO: 298054

SEQ ID NO: 300655 - RNA, 64 nt, Human; identical to SEQ ID NO: 300131

SEQ ID NO: 300656 - RNA, 64 nt, Human; identical to SEQ ID NO: 300243

SEQ ID NO: 300657 - RNA, 64 nt, Human; identical to SEQ ID NO: 300244

SEQ ID NO: 300658 - RNA, 64 nt, Human; identical to SEQ ID NO: 298055

SEQ ID NO: 300659 - RNA, 64 nt, Human; identical to SEQ ID NO: 300148

SEQ ID NO: 300660 - RNA, 64 nt, Human; identical to SEQ ID NO: 300149

SEQ ID NO: 300661 - RNA, 64 nt, Human; identical to SEQ ID NO: 300150

SEQ ID NO: 300662 - RNA, 64 nt, Human; identical to SEQ ID NO: 299930

SEQ ID NO: 300663 - RNA, 64 nt, Human; identical to SEQ ID NO: 299931

SEQ ID NO: 300664 - RNA, 64 nt, Human; identical to SEQ ID NO: 298072

SEQ ID NO: 300665 - RNA, 64 nt, Human; identical to SEQ ID NO: 300264

SEQ ID NO: 300666 - RNA, 64 nt, Human; identical to SEQ ID NO: 299878

SEQ ID NO: 300667 - RNA, 64 nt, Human; identical to SEQ ID NO: 299879

SEQ ID NO: 300668 - RNA, 64 nt, Human; identical to SEQ ID NO: 298073

SEQ ID NO: 300669 - RNA, 64 nt, Human; identical to SEQ ID NO: 300601

SEQ ID NO: 300670 - RNA, 64 nt, Human; identical to SEQ ID NO: 300602

SEQ ID NO: 300671 - RNA, 64 nt, Human; identical to SEQ ID NO: 300603

SEQ ID NO: 300672 - RNA, 64 nt, Human; identical to SEQ ID NO: 300604

SEQ ID NO: 300673 - RNA, 64 nt, Human; identical to SEQ ID NO: 299551

SEQ ID NO: 300674 - RNA, 64 nt, Human; identical to SEQ ID NO: 299552

SEQ ID NO: 300675 - RNA, 64 nt, Human; identical to SEQ ID NO: 298074

SEQ ID NO: 300676 - RNA, 64 nt, Human; identical to SEQ ID NO: 299532

SEQ ID NO: 300677 - RNA, 64 nt, Human; identical to SEQ ID NO: 299533

SEQ ID NO: 300678 - RNA, 64 nt, Human; identical to SEQ ID NO: 299534

SEQ ID NO: 300679 - RNA, 64 nt, Human; identical to SEQ ID NO: 299535

SEQ ID NO: 300680 - RNA, 64 nt, Human; identical to SEQ ID NO: 299553

SEQ ID NO: 300681 - RNA, 64 nt, Human; identical to SEQ ID NO: 299554

SEQ ID NO: 300682 - RNA, 64 nt, Human; identical to SEQ ID NO: 298075

SEQ ID NO: 300683 - RNA, 64 nt, Human; identical to SEQ ID NO: 299667

SEQ ID NO: 300684 - RNA, 64 nt, Human; identical to SEQ ID NO: 299668

SEQ ID NO: 300685 - RNA, 51 nt, Human; identical to SEQ ID NO: 299762

SEQ ID NO: 300686 - RNA, 64 nt, Human; identical to SEQ ID NO: 299763

SEQ ID NO: 300687 - RNA, 64 nt, Human; identical to SEQ ID NO: 298092

SEQ ID NO: 300688 - RNA, 64 nt, Human; identical to SEQ ID NO: 299818

SEQ ID NO: 300689 - RNA, 64 nt, Human; identical to SEQ ID NO: 299819

SEQ ID NO: 300690 - RNA, 64 nt, Human; identical to SEQ ID NO: 299857

SEQ ID NO: 300691 - RNA, 64 nt, Human; identical to SEQ ID NO: 299858

SEQ ID NO: 300692 - RNA, 64 nt, Human; identical to SEQ ID NO: 298093

SEQ ID NO: 300693 - RNA, 64 nt, Human; identical to SEQ ID NO: 299859

SEQ ID NO: 300694 - RNA, 64 nt, Human; identical to SEQ ID NO: 299860

SEQ ID NO: 300695 - RNA, 64 nt, Human; identical to SEQ ID NO: 300076

SEQ ID NO: 300696 - RNA, 64 nt, Human; identical to SEQ ID NO: 300077

SEQ ID NO: 300697 - RNA, 64 nt, Human; identical to SEQ ID NO: 298094

SEQ ID NO: 300698 - RNA, 64 nt, Human; identical to SEQ ID NO: 299894

SEQ ID NO: 300699 - RNA, 64 nt, Human; identical to SEQ ID NO: 299895

SEQ ID NO: 300700 - RNA, 64 nt, Human; identical to SEQ ID NO: 299896

SEQ ID NO: 300701 - RNA, 64 nt, Human; identical to SEQ ID NO: 299897

SEQ ID NO: 300702 - RNA, 64 nt, Human; identical to SEQ ID NO: 299912

SEQ ID NO: 300703 - RNA, 64 nt, Human; identical to SEQ ID NO: 299913

SEQ ID NO: 300704 - RNA, 64 nt, Human; identical to SEQ ID NO: 298095

SEQ ID NO: 300705 - RNA, 64 nt, Human; identical to SEQ ID NO: 299914

SEQ ID NO: 300706 - RNA, 64 nt, Human; identical to SEQ ID NO: 299915

SEQ ID NO: 300707 - RNA, 64 nt, Human; identical to SEQ ID NO: 299437

SEQ ID NO: 300708 - RNA, 64 nt, Human; identical to SEQ ID NO: 299438

SEQ ID NO: 300709 - RNA, 64 nt, Human; identical to SEQ ID NO: 298112

SEQ ID NO: 300710 - RNA, 64 nt, Human; identical to SEQ ID NO: 299948

SEQ ID NO: 300711 - RNA, 64 nt, Human; identical to SEQ ID NO: 299949

SEQ ID NO: 300712 - RNA, 64 nt, Human; identical to SEQ ID NO: 299950

SEQ ID NO: 300713 - RNA, 64 nt, Human; identical to SEQ ID NO: 299951

SEQ ID NO: 300714 - RNA, 64 nt, Human; identical to SEQ ID NO: 299363

SEQ ID NO: 300715 - RNA, 64 nt, Human; identical to SEQ ID NO: 299364

SEQ ID NO: 300716 - RNA, 64 nt, Human; identical to SEQ ID NO: 298113

SEQ ID NO: 300717 - RNA, 64 nt, Human; identical to SEQ ID NO: 300245

SEQ ID NO: 300718 - RNA, 64 nt, Human; identical to SEQ ID NO: 300357

SEQ ID NO: 300719 - RNA, 64 nt, Human; identical to SEQ ID NO: 300358

SEQ ID NO: 300720 - RNA, 64 nt, Human; identical to SEQ ID NO: 298114

SEQ ID NO: 300721 - RNA, 64 nt, Human; identical to SEQ ID NO: 300359

SEQ ID NO: 300722 - RNA, 64 nt, Human; identical to SEQ ID NO: 299966

SEQ ID NO: 300723 - RNA, 64 nt, Human; identical to SEQ ID NO: 299967

SEQ ID NO: 300724 - RNA, 64 nt, Human; identical to SEQ ID NO: 298115

SEQ ID NO: 300725 - RNA, 64 nt, Human; identical to SEQ ID NO: 299285

SEQ ID NO: 300726 - RNA, 50 nt, Human; identical to SEQ ID NO: 299286

SEQ ID NO: 300727 - RNA, 64 nt, Human; identical to SEQ ID NO: 299287

SEQ ID NO: 300728 - RNA, 64 nt, Human; identical to SEQ ID NO: 299288

SEQ ID NO: 300729 - RNA, 64 nt, Human; identical to SEQ ID NO: 299968

SEQ ID NO: 300730 - RNA, 64 nt, Human; identical to SEQ ID NO: 299969

SEQ ID NO: 300731 - RNA, 64 nt, Human; identical to SEQ ID NO: 298132

SEQ ID NO: 300732 - RNA, 64 nt, Human; identical to SEQ ID NO: 299323

SEQ ID NO: 300733 - RNA, 64 nt, Human; identical to SEQ ID NO: 299324

SEQ ID NO: 300734 - RNA, 64 nt, Human; identical to SEQ ID NO: 299325

SEQ ID NO: 300735 - RNA, 64 nt, Human; identical to SEQ ID NO: 299326

SEQ ID NO: 300736 - RNA, 64 nt, Human; identical to SEQ ID NO: 299342

SEQ ID NO: 300737 - RNA, 64 nt, Human; identical to SEQ ID NO: 299343

SEQ ID NO: 300738 - RNA, 64 nt, Human; identical to SEQ ID NO: 298133

SEQ ID NO: 300739 - RNA, 64 nt, Human; identical to SEQ ID NO: 299344

SEQ ID NO: 300740 - RNA, 64 nt, Human; identical to SEQ ID NO: 299345

SEQ ID NO: 300741 - RNA, 64 nt, Human; identical to SEQ ID NO: 299439

SEQ ID NO: 300742 - RNA, 64 nt, Human; identical to SEQ ID NO: 299440

SEQ ID NO: 300743 - RNA, 64 nt, Human; identical to SEQ ID NO: 298134

SEQ ID NO: 300744 - RNA, 64 nt, Human; identical to SEQ ID NO: 299380

SEQ ID NO: 300745 - RNA, 64 nt, Human; identical to SEQ ID NO: 299381

SEQ ID NO: 300746 - RNA, 64 nt, Human; identical to SEQ ID NO: 299382

SEQ ID NO: 300747 - RNA, 64 nt, Human; identical to SEQ ID NO: 299383

SEQ ID NO: 300748 - RNA, 64 nt, Human; identical to SEQ ID NO: 299399

SEQ ID NO: 300749 - RNA, 64 nt, Human; identical to SEQ ID NO: 299400

SEQ ID NO: 300750 - RNA, 64 nt, Human; identical to SEQ ID NO: 298135

SEQ ID NO: 300751 - RNA, 64 nt, Human; identical to SEQ ID NO: 299401

SEQ ID NO: 300752 - RNA, 64 nt, Human; identical to SEQ ID NO: 299402

SEQ ID NO: 300753 - RNA, 64 nt, Human; identical to SEQ ID NO: 299932

SEQ ID NO: 300754 - RNA, 59 nt, Human; identical to SEQ ID NO: 299933

SEQ ID NO: 300755 - RNA, 64 nt, Human; identical to SEQ ID NO: 298137

SEQ ID NO: 300756 - RNA, 64 nt, Human; identical to SEQ ID NO: 299458

SEQ ID NO: 300757 - RNA, 64 nt, Human; identical to SEQ ID NO: 299459

SEQ ID NO: 300758 - RNA, 64 nt, Human; identical to SEQ ID NO: 299475

SEQ ID NO: 300759 - RNA, 64 nt, Human; identical to SEQ ID NO: 299476

SEQ ID NO: 300760 - RNA, 64 nt, Human; identical to SEQ ID NO: 298138

SEQ ID NO: 300761 - RNA, 64 nt, Human; identical to SEQ ID NO: 299477

SEQ ID NO: 300762 - RNA, 64 nt, Human; identical to SEQ ID NO: 299478

SEQ ID NO: 300763 - RNA, 64 nt, Human; identical to SEQ ID NO: 299247

SEQ ID NO: 300764 - RNA, 64 nt, Human; identical to SEQ ID NO: 299248

SEQ ID NO: 300765 - RNA, 64 nt, Human; identical to SEQ ID NO: 298139

SEQ ID NO: 300766 - RNA, 64 nt, Human; identical to SEQ ID NO: 299494

SEQ ID NO: 300767 - RNA, 64 nt, Human; identical to SEQ ID NO: 299495

SEQ ID NO: 300768 - RNA, 64 nt, Human; identical to SEQ ID NO: 299496

SEQ ID NO: 300769 - RNA, 64 nt, Human; identical to SEQ ID NO: 299497

SEQ ID NO: 300770 - RNA, 64 nt, Human; identical to SEQ ID NO: 299190

SEQ ID NO: 300771 - RNA, 64 nt, Human; identical to SEQ ID NO: 299191

SEQ ID NO: 300772 - RNA, 64 nt, Human; identical to SEQ ID NO: 298140

SEQ ID NO: 300773 - RNA, 64 nt, Human; identical to SEQ ID NO: 299515

SEQ ID NO: 300774 - RNA, 64 nt, Human; identical to SEQ ID NO: 299516

SEQ ID NO: 300775 - RNA, 64 nt, Human; identical to SEQ ID NO: 299152

SEQ ID NO: 300776 - RNA, 64 nt, Human; identical to SEQ ID NO: 299153

SEQ ID NO: 300777 - RNA, 64 nt, Human; identical to SEQ ID NO: 298141

SEQ ID NO: 300778 - RNA, 64 nt, Human; identical to SEQ ID NO: 299800

SEQ ID NO: 300779 - RNA, 64 nt, Human; identical to SEQ ID NO: 299801

SEQ ID NO: 300780 - RNA, 64 nt, Human; identical to SEQ ID NO: 299133

SEQ ID NO: 300781 - RNA, 64 nt, Human; identical to SEQ ID NO: 299134

SEQ ID NO: 300782 - RNA, 64 nt, Human; identical to SEQ ID NO: 298142

SEQ ID NO: 300783 - RNA, 64 nt, Human; identical to SEQ ID NO: 299038

SEQ ID NO: 300784 - RNA, 64 nt, Human; identical to SEQ ID NO: 299039

SEQ ID NO: 300785 - RNA, 64 nt, Human; identical to SEQ ID NO: 299040

SEQ ID NO: 300786 - RNA, 64 nt, Human; identical to SEQ ID NO: 299041

SEQ ID NO: 300787 - RNA, 64 nt, Human; identical to SEQ ID NO: 299135

SEQ ID NO: 300788 - RNA, 64 nt, Human; identical to SEQ ID NO: 299136

SEQ ID NO: 300789 - RNA, 64 nt, Human; identical to SEQ ID NO: 298143

SEQ ID NO: 300790 - RNA, 64 nt, Human; identical to SEQ ID NO: 299057

SEQ ID NO: 300791 - RNA, 64 nt, Human; identical to SEQ ID NO: 299058

SEQ ID NO: 300792 - RNA, 64 nt, Human; identical to SEQ ID NO: 299059

SEQ ID NO: 300793 - RNA, 64 nt, Human; identical to SEQ ID NO: 299060

SEQ ID NO: 300794 - RNA, 64 nt, Human; identical to SEQ ID NO: 299076

SEQ ID NO: 300795 - RNA, 64 nt, Human; identical to SEQ ID NO: 299077

SEQ ID NO: 300796 - RNA, 64 nt, Human; identical to SEQ ID NO: 298144

SEQ ID NO: 300797 - RNA, 64 nt, Human; identical to SEQ ID NO: 299078

SEQ ID NO: 300798 - RNA, 64 nt, Human; identical to SEQ ID NO: 299079

SEQ ID NO: 300799 - RNA, 64 nt, Human; identical to SEQ ID NO: 299154

SEQ ID NO: 300800 - RNA, 64 nt, Human; identical to SEQ ID NO: 299155

SEQ ID NO: 300801 - RNA, 64 nt, Human; identical to SEQ ID NO: 298145

SEQ ID NO: 300802 - RNA, 64 nt, Human; identical to SEQ ID NO: 299095

SEQ ID NO: 300803 - RNA, 64 nt, Human; identical to SEQ ID NO: 299096

SEQ ID NO: 300804 - RNA, 64 nt, Human; identical to SEQ ID NO: 299097

SEQ ID NO: 300805 - RNA, 64 nt, Human; identical to SEQ ID NO: 299098

SEQ ID NO: 300806 - RNA, 64 nt, Human; identical to SEQ ID NO: 299114

SEQ ID NO: 300807 - RNA, 64 nt, Human; identical to SEQ ID NO: 299115

SEQ ID NO: 300808 - RNA, 64 nt, Human; identical to SEQ ID NO: 298146

SEQ ID NO: 300809 - RNA, 64 nt, Human; identical to SEQ ID NO: 299116

SEQ ID NO: 300810 - RNA, 64 nt, Human; identical to SEQ ID NO: 299117

SEQ ID NO: 300811 - RNA, 64 nt, Human; identical to SEQ ID NO: 299266

SEQ ID NO: 300812 - RNA, 64 nt, Human; identical to SEQ ID NO: 299267

SEQ ID NO: 300813 - RNA, 64 nt, Human; identical to SEQ ID NO: 298147

SEQ ID NO: 300814 - RNA, 64 nt, Human; identical to SEQ ID NO: 299171

SEQ ID NO: 300815 - RNA, 64 nt, Human; identical to SEQ ID NO: 299172

SEQ ID NO: 300816 - RNA, 64 nt, Human; identical to SEQ ID NO: 299173

SEQ ID NO: 300817 - RNA, 64 nt, Human; identical to SEQ ID NO: 299174

SEQ ID NO: 300818 - RNA, 64 nt, Human; identical to SEQ ID NO: 298981

SEQ ID NO: 300819 - RNA, 64 nt, Human; identical to SEQ ID NO: 298982

SEQ ID NO: 300820 - RNA, 64 nt, Human; identical to SEQ ID NO: 298148

SEQ ID NO: 300821 - RNA, 64 nt, Human; identical to SEQ ID NO: 299192

SEQ ID NO: 300822 - RNA, 64 nt, Human; identical to SEQ ID NO: 299193

SEQ ID NO: 300823 - RNA, 64 nt, Human; identical to SEQ ID NO: 299304

SEQ ID NO: 300824 - RNA, 64 nt, Human; identical to SEQ ID NO: 299305

SEQ ID NO: 300825 - RNA, 64 nt, Human; identical to SEQ ID NO: 298149

SEQ ID NO: 300826 - RNA, 64 nt, Human; identical to SEQ ID NO: 299209

SEQ ID NO: 300827 - RNA, 64 nt, Human; identical to SEQ ID NO: 299210

SEQ ID NO: 300828 - RNA, 64 nt, Human; identical to SEQ ID NO: 299211

SEQ ID NO: 300829 - RNA, 64 nt, Human; identical to SEQ ID NO: 299212

SEQ ID NO: 300830 - RNA, 64 nt, Human; identical to SEQ ID NO: 299000

SEQ ID NO: 300831 - RNA, 64 nt, Human; identical to SEQ ID NO: 299001

SEQ ID NO: 300832 - RNA, 64 nt, Human; identical to SEQ ID NO: 298150

SEQ ID NO: 300833 - RNA, 64 nt, Human; identical to SEQ ID NO: 299228

SEQ ID NO: 300834 - RNA, 64 nt, Human; identical to SEQ ID NO: 299229

SEQ ID NO: 300835 - RNA, 64 nt, Human; identical to SEQ ID NO: 299230

SEQ ID NO: 300836 - RNA, 64 nt, Human; identical to SEQ ID NO: 299231

SEQ ID NO: 300837 - RNA, 64 nt, Human; identical to SEQ ID NO: 298905

SEQ ID NO: 300838 - RNA, 64 nt, Human; identical to SEQ ID NO: 298906

SEQ ID NO: 300839 - RNA, 64 nt, Human; identical to SEQ ID NO: 298151

SEQ ID NO: 300840 - RNA, 64 nt, Human; identical to SEQ ID NO: 299249

SEQ ID NO: 300841 - RNA, 64 nt, Human; identical to SEQ ID NO: 299250

SEQ ID NO: 300842 - RNA, 64 nt, Human; identical to SEQ ID NO: 298831

SEQ ID NO: 300843 - RNA, 64 nt, Human; identical to SEQ ID NO: 298832

SEQ ID NO: 300844 - RNA, 64 nt, Human; identical to SEQ ID NO: 298152

SEQ ID NO: 300845 - RNA, 64 nt, Human; identical to SEQ ID NO: 299268

SEQ ID NO: 300846 - RNA, 64 nt, Human; identical to SEQ ID NO: 299269

SEQ ID NO: 300847 - RNA, 64 nt, Human; identical to SEQ ID NO: 299306

SEQ ID NO: 300848 - RNA, 64 nt, Human; identical to SEQ ID NO: 299307

SEQ ID NO: 300849 - RNA, 64 nt, Human; identical to SEQ ID NO: 298153

SEQ ID NO: 300850 - RNA, 64 nt, Human; identical to SEQ ID NO: 299418

SEQ ID NO: 300851 - RNA, 64 nt, Human; identical to SEQ ID NO: 299419

SEQ ID NO: 300852 - RNA, 64 nt, Human; identical to SEQ ID NO: 299420

SEQ ID NO: 300853 - RNA, 64 nt, Human; identical to SEQ ID NO: 299421

SEQ ID NO: 300854 - RNA, 64 nt, Human; identical to SEQ ID NO: 298777

SEQ ID NO: 300855 - RNA, 64 nt, Human; identical to SEQ ID NO: 298778

SEQ ID NO: 300856 - RNA, 64 nt, Human; identical to SEQ ID NO: 298154

SEQ ID NO: 300857 - RNA, 64 nt, Human; identical to SEQ ID NO: 298795

SEQ ID NO: 300858 - RNA, 62 nt, Human; identical to SEQ ID NO: 298796

SEQ ID NO: 300859 - RNA, 64 nt, Human; identical to SEQ ID NO: 298797

SEQ ID NO: 300860 - RNA, 64 nt, Human; identical to SEQ ID NO: 298813

SEQ ID NO: 300861 - RNA, 64 nt, Human; identical to SEQ ID NO: 298814

SEQ ID NO: 300862 - RNA, 64 nt, Human; identical to SEQ ID NO: 298155

SEQ ID NO: 300863 - RNA, 64 nt, Human; identical to SEQ ID NO: 298779

SEQ ID NO: 300864 - RNA, 64 nt, Human; identical to SEQ ID NO: 298867

SEQ ID NO: 300865 - RNA, 64 nt, Human; identical to SEQ ID NO: 298868

SEQ ID NO: 300866 - RNA, 64 nt, Human; identical to SEQ ID NO: 298156

SEQ ID NO: 300867 - RNA, 64 nt, Human; identical to SEQ ID NO: 298815

SEQ ID NO: 300868 - RNA, 64 nt, Human; identical to SEQ ID NO: 298943

SEQ ID NO: 300869 - RNA, 64 nt, Human; identical to SEQ ID NO: 298944

SEQ ID NO: 300870 - RNA, 53 nt, Human; identical to SEQ ID NO: 298173

SEQ ID NO: 300871 - RNA, 64 nt, Human; identical to SEQ ID NO: 298849

SEQ ID NO: 300872 - RNA, 64 nt, Human; identical to SEQ ID NO: 298850

SEQ ID NO: 300873 - RNA, 64 nt, Human; identical to SEQ ID NO: 298851

SEQ ID NO: 300874 - RNA, 64 nt, Human; identical to SEQ ID NO: 298705

SEQ ID NO: 300875 - RNA, 64 nt, Human; identical to SEQ ID NO: 298706

SEQ ID NO: 300876 - RNA, 64 nt, Human; identical to SEQ ID NO: 298174

SEQ ID NO: 300877 - RNA, 64 nt, Human; identical to SEQ ID NO: 298869

SEQ ID NO: 300878 - RNA, 64 nt, Human; identical to SEQ ID NO: 298870

SEQ ID NO: 300879 - RNA, 64 nt, Human
uuuacucuguacgaaucacggcuguuggacaucucgguaucaccguugaugaacucauugguuu

SEQ ID NO: 300880 - RNA, 64 nt, Human
accuucuaaccugugaauuggcagaaaaggguagcgguaucauguauauuaaaauuggcuaaua

SEQ ID NO: 300881 - RNA, 64 nt, Human; identical to SEQ ID NO: 90358

SEQ ID NO: 300882 - RNA, 64 nt, Human; identical to SEQ ID NO: 90359

SEQ ID NO: 300883 - RNA, 64 nt, Human; identical to SEQ ID NO: 90360

SEQ ID NO: 300884 - RNA, 64 nt, Human; identical to SEQ ID NO: 90361

SEQ ID NO: 300885 - RNA, 64 nt, Human; identical to SEQ ID NO: 90362

SEQ ID NO: 300886 - RNA, 64 nt, Human; identical to SEQ ID NO: 90363

SEQ ID NO: 300887 - RNA, 64 nt, Human; identical to SEQ ID NO: 90364

SEQ ID NO: 300888 - RNA, 64 nt, Human; identical to SEQ ID NO: 90365

SEQ ID NO: 300889 - RNA, 64 nt, Human; identical to SEQ ID NO: 90366

SEQ ID NO: 300890 - RNA, 64 nt, Human; identical to SEQ ID NO: 90367

SEQ ID NO: 300891 - RNA, 64 nt, Human; identical to SEQ ID NO: 90368

SEQ ID NO: 300892 - RNA, 64 nt, Human; identical to SEQ ID NO: 90369

SEQ ID NO: 300893 - RNA, 54 nt, Human; identical to SEQ ID NO: 23168

SEQ ID NO: 300894 - RNA, 64 nt, Human; identical to SEQ ID NO: 90371

SEQ ID NO: 300895 - RNA, 64 nt, Human
agcguucuacccauuuuccuuguuuucagugcugcgguaucagucagugaucugaggaaauccu

SEQ ID NO: 300896 - RNA, 64 nt, Human
cuucaaugaaguguuaacaaccaaacccuacagacgguaucagaaacagcaaauagauauuccu

SEQ ID NO: 300897 - RNA, 64 nt, Human
uugugaaaugaaaaaaacaaauuguguuuuauugcgguaucaacaaugugaauaaggauuaaca

SEQ ID NO: 300898 - RNA, 64 nt, Human
guucaucacgagcaugagggaacagcaaggggcacgguaucacagccuggagacacccacacag

SEQ ID NO: 300899 - RNA, 64 nt, Human; identical to SEQ ID NO: 90372

SEQ ID NO: 300900 - RNA, 64 nt, Human; identical to SEQ ID NO: 90373

SEQ ID NO: 300901 - RNA, 64 nt, Human; identical to SEQ ID NO: 90374

SEQ ID NO: 300902 - RNA, 64 nt, Human; identical to SEQ ID NO: 90375

SEQ ID NO: 300903 - RNA, 64 nt, Human; identical to SEQ ID NO: 90376

SEQ ID NO: 300904 - RNA, 64 nt, Human; identical to SEQ ID NO: 90377

SEQ ID NO: 300905 - RNA, 64 nt, Human; identical to SEQ ID NO: 90378

SEQ ID NO: 300906 - RNA, 64 nt, Human; identical to SEQ ID NO: 90379

SEQ ID NO: 300907 - RNA, 64 nt, Human; identical to SEQ ID NO: 90380

SEQ ID NO: 300908 - RNA, 64 nt, Human; identical to SEQ ID NO: 90381

SEQ ID NO: 300909 - RNA, 64 nt, Human; identical to SEQ ID NO: 90382

SEQ ID NO: 300910 - RNA, 64 nt, Human; identical to SEQ ID NO: 90383

SEQ ID NO: 300911 - RNA, 64 nt, Human; identical to SEQ ID NO: 90384

SEQ ID NO: 300912 - RNA, 64 nt, Human; identical to SEQ ID NO: 90385

SEQ ID NO: 300913 - RNA, 64 nt, Human
aauuaugaaaauuauauuaaaucugggauuaugacgguaucacuguaucaucuuggucuuguuc

SEQ ID NO: 300914 - RNA, 64 nt, Human
uuggcuuugcauggcuuuucuucagguacugucucgguaucauucugcuaaucauuguuacaga

SEQ ID NO: 300915 - RNA, 64 nt, Human
uucagaucuguuuacagguuguaaaaauaaacuucgguaucagugcaucuacagaaguguuauu

SEQ ID NO: 300916 - RNA, 64 nt, Human
ccagaugcagaagaggaaaugauggaaggacuuacgguaucagauaccaauauuuaaaaguuug

SEQ ID NO: 300917 - RNA, 64 nt, Human; identical to SEQ ID NO: 90386

SEQ ID NO: 300918 - RNA, 64 nt, Human; identical to SEQ ID NO: 90387

SEQ ID NO: 300919 - RNA, 57 nt, Human; identical to SEQ ID NO: 23186

SEQ ID NO: 300920 - RNA, 64 nt, Human; identical to SEQ ID NO: 90389

SEQ ID NO: 300921 - RNA, 51 nt, Human; identical to SEQ ID NO: 23188

SEQ ID NO: 300922 - RNA, 64 nt, Human; identical to SEQ ID NO: 90391

SEQ ID NO: 300923 - RNA, 64 nt, Human; identical to SEQ ID NO: 90393

SEQ ID NO: 300924 - RNA, 64 nt, Human; identical to SEQ ID NO: 90394

SEQ ID NO: 300925 - RNA, 64 nt, Human; identical to SEQ ID NO: 90395

SEQ ID NO: 300926 - RNA, 64 nt, Human; identical to SEQ ID NO: 90396

SEQ ID NO: 300927 - RNA, 64 nt, Human; identical to SEQ ID NO: 90397

SEQ ID NO: 300928 - RNA, 64 nt, Human; identical to SEQ ID NO: 90398

SEQ ID NO: 300929 - RNA, 64 nt, Human; identical to SEQ ID NO: 90399

SEQ ID NO: 300930 - RNA, 64 nt, Human; identical to SEQ ID NO: 90400

SEQ ID NO: 300931 - RNA, 64 nt, Human
ccggagcuccuucuagcuuggccuucuuuggaugcgguaucacaugaggccugucccuaacagu

SEQ ID NO: 300932 - RNA, 64 nt, Human
ugggacucauucccgggcacaccuauggcuccuucgguaucaccuggggaagccccggaaucuu

SEQ ID NO: 300933 - RNA, 64 nt, Human
uguaauacuguaacuuccuauaaccuaauauuuucgguaucauuaaccaaaauuucacacucau

SEQ ID NO: 300934 - RNA, 64 nt, Human
gagcauagcaugaagugaugcacauauuucaccacgguaucauguacuucauggccaguguuuu

SEQ ID NO: 300935 - RNA, 64 nt, Human; identical to SEQ ID NO: 90401

SEQ ID NO: 300936 - RNA, 64 nt, Human; identical to SEQ ID NO: 90402

SEQ ID NO: 300937 - RNA, 64 nt, Human; identical to SEQ ID NO: 90403

SEQ ID NO: 300938 - RNA, 64 nt, Human; identical to SEQ ID NO: 90404

SEQ ID NO: 300939 - RNA, 64 nt, Human; identical to SEQ ID NO: 90405

SEQ ID NO: 300940 - RNA, 64 nt, Human; identical to SEQ ID NO: 90406

SEQ ID NO: 300941 - RNA, 64 nt, Human; identical to SEQ ID NO: 90407

SEQ ID NO: 300942 - RNA, 64 nt, Human; identical to SEQ ID NO: 90408

SEQ ID NO: 300943 - RNA, 64 nt, Human; identical to SEQ ID NO: 90409

SEQ ID NO: 300944 - RNA, 64 nt, Human; identical to SEQ ID NO: 90410

SEQ ID NO: 300945 - RNA, 64 nt, Human; identical to SEQ ID NO: 90411

SEQ ID NO: 300946 - RNA, 64 nt, Human; identical to SEQ ID NO: 90412

SEQ ID NO: 300947 - RNA, 64 nt, Human; identical to SEQ ID NO: 90413

SEQ ID NO: 300948 - RNA, 63 nt, Human; identical to SEQ ID NO: 90414

SEQ ID NO: 300949 - RNA, 64 nt, Human
gccaggggccacaaguuaguuggaagccggcguucgguaucagaagcgcugauggucauaucca

SEQ ID NO: 300950 - RNA, 64 nt, Human
aaaauuauaggauuuuuucuuuuuuaguaaaaaccgguaucaaaaccaaaauuauaggauuuuu

SEQ ID NO: 300951 - RNA, 64 nt, Human
uaaugcuacauguuaccacuuaggguaggaacuucgguaucaucuuggacucuucugaguccau

SEQ ID NO: 300952 - RNA, 63 nt, Human
cggugagcaggggguucagcagcuugaccgaugccccccgagggggcucuccccagcuuaaac

SEQ ID NO: 300953 - RNA, 64 nt, Human; identical to SEQ ID NO: 90415

SEQ ID NO: 300954 - RNA, 64 nt, Human; identical to SEQ ID NO: 90416

SEQ ID NO: 300955 - RNA, 64 nt, Human; identical to SEQ ID NO: 90417

SEQ ID NO: 300956 - RNA, 64 nt, Human; identical to SEQ ID NO: 90418

SEQ ID NO: 300957 - RNA, 64 nt, Human; identical to SEQ ID NO: 90419

SEQ ID NO: 300958 - RNA, 64 nt, Human; identical to SEQ ID NO: 90420

SEQ ID NO: 300959 - RNA, 64 nt, Human; identical to SEQ ID NO: 90421

SEQ ID NO: 300960 - RNA, 64 nt, Human; identical to SEQ ID NO: 90422

SEQ ID NO: 300961 - RNA, 64 nt, Human; identical to SEQ ID NO: 90423

SEQ ID NO: 300962 - RNA, 64 nt, Human; identical to SEQ ID NO: 90424

SEQ ID NO: 300963 - RNA, 64 nt, Human; identical to SEQ ID NO: 90425

SEQ ID NO: 300964 - RNA, 64 nt, Human; identical to SEQ ID NO: 90426

SEQ ID NO: 300965 - RNA, 64 nt, Human; identical to SEQ ID NO: 90427

SEQ ID NO: 300966 - RNA, 64 nt, Human; identical to SEQ ID NO: 90428

SEQ ID NO: 300967 - RNA, 63 nt, Human
cgggugacccucuagcucucucugcaucucccaccccccgacacccugggacccucgacccca

SEQ ID NO: 300968 - RNA, 63 nt, Human
gaaacgccuccuucaugcagcggcggugcugggccccccgaggcugcaccuggcucucggcug

SEQ ID NO: 300969 - RNA, 63 nt, Human
ugaacaaucagauuagacacuauguguuagaguccccccgaccagauccuuuuccaucccacu

SEQ ID NO: 300970 - RNA, 63 nt, Human
uugggggcguucgggagguuuggggggcaucaaccccccgacugugcugcucgcgaagguccc

SEQ ID NO: 300971 - RNA, 64 nt, Human; identical to SEQ ID NO: 90429

SEQ ID NO: 300972 - RNA, 64 nt, Human; identical to SEQ ID NO: 90430

SEQ ID NO: 300973 - RNA, 64 nt, Human; identical to SEQ ID NO: 90431

SEQ ID NO: 300974 - RNA, 63 nt, Human
ucccaggagcagccccuggaugcccagcaggguccccccgaaccugcacaagagucucucuca

SEQ ID NO: 300975 - RNA, 63 nt, Human
guggugccccaggugccaacaggauaaccucuaccccccgacuuugucucugggguccuguuc

SEQ ID NO: 300976 - RNA, 63 nt, Human
gccuccuggguucaagugauucuucugccuccaccccccgaguggcugguauuacaagcacau

SEQ ID NO: 300977 - RNA, 63 nt, Human
ccuuacucgaucuuaccaccaccccucccccggccccccgacugagaacucgggccucucacc

SEQ ID NO: 300978 - RNA, 63 nt, Human; identical to SEQ ID NO: 64683

SEQ ID NO: 300979 - RNA, 53 nt, Human; identical to SEQ ID NO: 64684

SEQ ID NO: 300980 - RNA, 63 nt, Human
gugcugggaaggggcggcugcgagggguaucaaccccccgagucucucccugaaggggagcac

SEQ ID NO: 300981 - RNA, 63 nt, Human
ccgccgcgaccucaguguggcuuuuacaggacuccccccgagcaucagcagggaccccggcgg

SEQ ID NO: 300982 - RNA, 63 nt, Human
ccucccggguucacgccauucuccugccucagcccccccgaguagcugggacuacaggcgccc

SEQ ID NO: 300983 - RNA, 63 nt, Human
ggacugugacuacagcgcucccggcugagcgcgccccccgagccgccgacuugccgucucccc

SEQ ID NO: 300984 - RNA, 63 nt, Human
uggccuccgcccucgguuccgccccgccccucuccccccgaccuuggggcuugugucgagccc

SEQ ID NO: 300985 - RNA, 63 nt, Human
agggugguuggagggccuuuuuaauuuaauugaccccccgagguggucuuuuguuuuaaacag

SEQ ID NO: 300986 - RNA, 63 nt, Human
gggugggggccacucaccgacccgacacucucaccccccgaccuggcugagugcgaccaccac

SEQ ID NO: 300987 - RNA, 63 nt, Human
ccucccuggaguggagcagcccugaagccugugccccccgaccugcgggccgcuguuuugguu

SEQ ID NO: 300988 - RNA, 63 nt, Human
ucugucugacggcaggauggggagcuggagagcccccccgacccucagcguacccgccucacc

SEQ ID NO: 300989 - RNA, 63 nt, Human
guguggccccaggccagugucugucaggaugguccccccgaggcgcucugggcaggcauccug

SEQ ID NO: 300990 - RNA, 63 nt, Human
gcgucagagccugcagacaacggagggcagcgcccccccgagaucaggacgaaggaccaccgu

SEQ ID NO: 300991 - RNA, 63 nt, Human
gugaaacaggagggcuguuugccucugccccauccccccgacuguguucaggagucccaccuu

SEQ ID NO: 300992 - RNA, 63 nt, Human
cugccgccgccgccgccgccgcugcccuuggguccccccgagucuccgggacugcccucucga

SEQ ID NO: 300993 - RNA, 63 nt, Human
cccucugggggccugcccaggggacccccugagccccccgaccggcuuagcugugaugggagu

SEQ ID NO: 300994 - RNA, 63 nt, Human
uacuguauauuaccuggugauaguugcuuuucaccccccgaguucaguuucuaggagccaaug

SEQ ID NO: 300995 - RNA, 63 nt, Human
uacucauggcagccauguuugauugucacagagccccccgaauacucugucuauagugacaca

SEQ ID NO: 300996 - RNA, 63 nt, Human
uauuucauuuguaaacuauauuugaacgacauuccccccgaaaaauugaaauguaaagaugag

SEQ ID NO: 300997 - RNA, 63 nt, Human
aggauuccuggaccgcuacugccccccaaacugccccccgagcuucuuccccaucaccgugcg

SEQ ID NO: 300998 - RNA, 63 nt, Human
cccgcuggugacuaagcucgcagcaagcggcuaccccccgaucugcaaaagggccucucccuu

SEQ ID NO: 300999 - RNA, 63 nt, Human
ugcuuucacugcugcacccgcgcccucggccggccccccgagcagccuuuguacucugcuugc

SEQ ID NO: 301000 - RNA, 63 nt, Human
aucaccaccgagcuggccgagcaccgcucauauccccccgacaagaaggucaaagccaaggac

SEQ ID NO: 301001 - RNA, 63 nt, Human
cugcccggcccucccuggcgccccagcccagugccccccgaagggccaaaugccaaguccacu

SEQ ID NO: 301002 - RNA, 63 nt, Human
uggggugcuccuugcaacgucuuaagcaagcgaccccccgacauagcaaaagguggcaaccca

SEQ ID NO: 301003 - RNA, 63 nt, Human
gggaagaagaaggggcucccuccucuucacauuccccccgaccccaaagccagagaaagccag

SEQ ID NO: 301004 - RNA, 63 nt, Human
aguucuuuacuggauuuuuuaaaaaccugugaaccccccgaaacuguaugugaaaguugagac

SEQ ID NO: 301005 - RNA, 63 nt, Human
gcauaaggagagucgcaucagagcuuuucacagccccccgaaaccccagccugguuuugaugg

SEQ ID NO: 301006 - RNA, 63 nt, Human
gcugcucucccaggggccagguggagagcagugccccccgacacauguauucucaucuguggu

SEQ ID NO: 301007 - RNA, 63 nt, Human
gaggaagguucucuuugcgcuugccuucucacaccccccgacuccccacccauauuuugguac

SEQ ID NO: 301008 - RNA, 63 nt, Human
cgcggaagccgacuggcagccaggccugucgggccccccgacgccgccccauuucccuuccag

SEQ ID NO: 301009 - RNA, 63 nt, Human
guuggucaaggagggaugugagggaaauagggaccccccgacuugcccuccugccucagucuu

SEQ ID NO: 301010 - RNA, 63 nt, Human
gaaaaggguugcuuggaggaccugggguggcagccccccgaccagaagcacccuauuuuauag

SEQ ID NO: 301011 - RNA, 63 nt, Human
agaguuggggagaaacugaagccguguuuuuggccccccgaggcuaacccugauccauagugc

SEQ ID NO: 301012 - RNA, 63 nt, Human
agggaaguucacccccccccaccacccccccgcccccccgaagccaugucacugaaaaggccu

SEQ ID NO: 301013 - RNA, 63 nt, Human
acuagacuuguagcaggccugggcugcaggcuuccccccgaccauucccugcagccaugcggc

SEQ ID NO: 301014 - RNA, 63 nt, Human
gcacuugcccccguggccgccaucauccccccgccccccgacguccagcccgugauugacaag

SEQ ID NO: 301015 - RNA, 63 nt, Human
cuucucuaccccaccacacaaauuucccauuucccccccgaaaaccuugaucuuacccaugaa

SEQ ID NO: 301016 - RNA, 63 nt, Human
aguuuucacuccagucaucauuuuccuaucucaccccccgaaacaccacccuaaaguuggauu

SEQ ID NO: 301017 - RNA, 63 nt, Human
agacauugcaccagaugccauuacauuuauuggccccccgaccuuguagaaaaaccccuaccc

SEQ ID NO: 301018 - RNA, 63 nt, Human
gagggucuccgcccaccccggccggacuuugauccccccgaagucuucacaggcacugcaucg

SEQ ID NO: 301019 - RNA, 63 nt, Human
uuguagggaugugcagggcugggaguuggcacuccccccgaguggggaggugacagcuuguca

SEQ ID NO: 301020 - RNA, 63 nt, Human
uccucaagucuagccucaggagaccugccccucccccccgaccuccacccccucagacuccau

SEQ ID NO: 301021 - RNA, 63 nt, Human
gcaccugcuuucccaccucgaggccgcggccucccccccgauuuauagacaacucugacauug

SEQ ID NO: 301022 - RNA, 63 nt, Human
uucaaaaauacauccuuuucugugucaugaaaaccccccgaagccauugacuucaucuuaccu

SEQ ID NO: 301023 - RNA, 63 nt, Human
gccucccuugccccuaccccggcgaagcauguuccccccgacgccccccuuggcacaagucag

SEQ ID NO: 301024 - RNA, 63 nt, Human
agggauagaaggaaggaaggaaggaacccccccccccccgaaaaaaaaaucaaagcgggaaga

SEQ ID NO: 301025 - RNA, 63 nt, Human
uuccauguaaucagagcauuagcugcagaaaaaccccccgacagagcccuggcggagaggcag

SEQ ID NO: 301026 - RNA, 63 nt, Human
ugggccuugccugcugugccugcugcugcugggccccccgaucagaccucaaggacaggugaa

SEQ ID NO: 301027 - RNA, 63 nt, Human
auaggaaaagccucuuuccacagacuuaggaagccccccgaccacgcggacgcucgcugggcu

SEQ ID NO: 301028 - RNA, 63 nt, Human
uuggggacucggccucagcgucacccugagauuccccccgagacacagugcgcuaguacggcu

SEQ ID NO: 301029 - RNA, 63 nt, Human
cgggggcccagacaguacucuccaguucuggggccccccgagugaggagggaacgggaagucg

SEQ ID NO: 301030 - RNA, 63 nt, Human
gccggugggacccuguccggcccagugccacugccccccgaggcugcuagauguagguguuag

SEQ ID NO: 301031 - RNA, 63 nt, Human
gggaucacagcugcaggccacgcccagcuuccuccccccgacuccccccccagagacacgguc

SEQ ID NO: 301032 - RNA, 63 nt, Human
agaggggucuuggagcuccuauggagcagacugccccccgagcaguguccccagccuagcccu

SEQ ID NO: 301033 - RNA, 63 nt, Human
aggggcccccacccgucaccacgccccaacacuccccccgaaccagagccgugcacuugugcc

SEQ ID NO: 301034 - RNA, 63 nt, Human
aaacgcgccccaucccuuccgccgccuccuuucccccccgacccuauucagguuuuaagucaa

SEQ ID NO: 301035 - RNA, 63 nt, Human
ggauugcacuuacucuuucaucacggaaacagaccccccgagagaagccccaacgagauuuuc

SEQ ID NO: 301036 - RNA, 63 nt, Human
guccuuuucaaaaguguuuuggagcuuucugugccccccgacuuucccccgccuccccgcccc

SEQ ID NO: 301037 - RNA, 63 nt, Human
uacuggacccuuguaaucugauuuggagaccauccccccgaugggaccagcagccccgccggc

SEQ ID NO: 301038 - RNA, 52 nt, Human; identical to SEQ ID NO: 64743

SEQ ID NO: 301039 - RNA, 63 nt, Human
ugggggccucccccacgccccccaggacaguguccccccgagugacuccgcagcuucugacac

SEQ ID NO: 301040 - RNA, 58 nt, Human; identical to SEQ ID NO: 64745

SEQ ID NO: 301041 - RNA, 63 nt, Human
caugggggcuaugcuggggaaagcagccaugcuccccccgaccuccagccgagcauccuucau

SEQ ID NO: 301042 - RNA, 63 nt, Human
ccccucgcuggcacugacuuugccuugaacagaccccccgacccucccccacaagccuuuaau

SEQ ID NO: 301043 - RNA, 63 nt, Human
acucagagagggcgcggcccccggggauuccccccccccgagggugcccaggacucgacaagc

SEQ ID NO: 301044 - RNA, 63 nt, Human
gcagugggggugucuguggagugcaugacucagccccccgacucgcagccuuaauaaagcgau

SEQ ID NO: 301045 - RNA, 63 nt, Human
cuggcuuucugaguccaggugagagcuguguggccccccgaugccacucugcccgccggaggg

SEQ ID NO: 301046 - RNA, 63 nt, Human
guucaggcuaugcugcuuugggcagguggagcaccccccgaggaagccugcaaguccagggca

SEQ ID NO: 301047 - RNA, 63 nt, Human
acgcuagcugccugcucuuccuuaagauggccuccccccgacccgccacggcccucaguugcc

SEQ ID NO: 301048 - RNA, 63 nt, Human
gggcccagaguguggcgguccccaugguggcagccccccgacugaucauccagacacaaaggu

SEQ ID NO: 301049 - RNA, 63 nt, Human
uuuuagaguggaacugggcauguccuccgccuaccccccgagccuguauuuauuuuuguauaa

SEQ ID NO: 301050 - RNA, 63 nt, Human
gccguuggccacgucuuccuucugccugagcuuccccccgaccacaggcccuuuccucaggca

SEQ ID NO: 301051 - RNA, 63 nt, Human
ugaucuuucaaaggcagcuaauugcuagcaaauccccccgauuccggccuuuucccucuauuu

SEQ ID NO: 301052 - RNA, 63 nt, Human
cugcaggaggccgagugacagccagcccuggaaccccccgacccccgcagcugcugcagccag

SEQ ID NO: 301053 - RNA, 64 nt, Human
uuucugauaauuaugcaagcaacaauucuguagccucaaguaagaccaccugugaacuugauca

SEQ ID NO: 301054 - RNA, 64 nt, Human
cagaaauacagaauaauucauagaaaucaugguucucaaguauuuguucaauuagcuuugggga

SEQ ID NO: 301055 - RNA, 64 nt, Human
cuccuggguucaagugacccucccaccucagccucucaaguagcugggacuacaggugcaccac

SEQ ID NO: 301056 - RNA, 64 nt, Human
aguuugggggauccuccucacucuccugaagugucucaaguauaccagugggagugcaggggag

SEQ ID NO: 301057 - RNA, 64 nt, Human
ucugcuucgacagaacugaguguauaccuuuacccucaaguaccacuaacacagaugauugauc

SEQ ID NO: 301058 - RNA, 64 nt, Human
cagccauaguuuggguauuuuugguuuauaugcccucaaguaaaagaaaagccgaaaggguuaa

SEQ ID NO: 301059 - RNA, 64 nt, Human
uguuaaaucuuggaacuuaaaacaauccugcuuucucaaguacuauucuaacauugcgcuuuau

SEQ ID NO: 301060 - RNA, 64 nt, Human
accaugauggccagguugguuuugaacuccugaccucaaguaaucugcccaccucggccuccca

SEQ ID NO: 301061 - RNA, 64 nt, Human
gggcacaacucugguguccuucuauggagaaaaccucaaguaaaguuuuauucugccuuugaaa

SEQ ID NO: 301062 - RNA, 64 nt, Human
ucugcuaaguauuuacaacucuauuuauuauucacucaaguauuaacauucucuauuaaauaag

SEQ ID NO: 301063 - RNA, 64 nt, Human
auaauauaucuaauuacaggagaauuuacaacaucucaaguacguaaauuaaguugucauugag

SEQ ID NO: 301064 - RNA, 64 nt, Human
aagcgaagaaagucuuugaaaaagguuucaaagucucaaguaccaccuguauuaucucacuaau

SEQ ID NO: 301065 - RNA, 64 nt, Human
gaaccagaaccaccaccuggagcccgaggaggugcucaaguacagcgaguucuucacgggcagc

SEQ ID NO: 301066 - RNA, 64 nt, Human
cuucauggaaagcaacucuugccccuaccucuucugggcgcagggaguaaguuacugcuaaauu

SEQ ID NO: 301067 - RNA, 64 nt, Human
aggacagccaccaagaaguggcugccaaagagacugggcgcaguggcucaugcccauaauccca

SEQ ID NO: 301068 - RNA, 64 nt, Human
ugcgaaguccuggaguauuguuugggucucggaaugggcgcauaaccugcgcugaccaguuuag

SEQ ID NO: 301069 - RNA, 64 nt, Human
cuauauccacuucacuccucauuugcccaaugggcucaaguaccccauaagauuuaccagccau

SEQ ID NO: 301070 - RNA, 64 nt, Human
gaaaaaaauagcuugguuuuauuugucaucuagucucaaguauagcgagauucuuucuaaaugu

SEQ ID NO: 301071 - RNA, 64 nt, Human
uuauacguguccuccuggggguuggagaugaucccucaaguacacaaagguccccuggcccuuc

SEQ ID NO: 301072 - RNA, 64 nt, Human
guaucuugaguuaaaagaaccugcucuccauuaucucaaguagcagagcagaugcuaaaccguc

SEQ ID NO: 301073 - RNA, 64 nt, Human
cucccaugcuuacgugauccucucaccucagccucucaaguaauauagcugagacuacaagugu

SEQ ID NO: 301074 - RNA, 64 nt, Human
uuuucugaucuucucccuccucccaaccuacacccucaaguagaccccagugucucuuguucuc

SEQ ID NO: 301075 - RNA, 64 nt, Human
gccaucuagcuuuuugaagucuaugggggucuuacucaaguacuaguaauuuaacuucaucaug

SEQ ID NO: 301076 - RNA, 64 nt, Human
uuuaucagugaauaauaaacauaaaugcaauuuacucaaguagcaauuuaagaaauaggaaagu

SEQ ID NO: 301077 - RNA, 64 nt, Human
gaaggccugaauguaacaaaagggcuuauucuuccucaaguaagggggaacuccugcuuugggc

SEQ ID NO: 301078 - RNA, 64 nt, Human
aaaaugcaagggccuuccucucuuaacacggaugcucaaguaaaacuagauucacagggcacag

SEQ ID NO: 301079 - RNA, 64 nt, Human
gaacaugcagaggguuaauccugcuuccuaaagccucaaguacaugccuccugcuuaguucacu

SEQ ID NO: 301080 - RNA, 64 nt, Human
cuuccagguucaagcuauucucaugccucagccucucaaguagcugggacuacagaugugggcc

SEQ ID NO: 301081 - RNA, 64 nt, Human
cauguauuauauuuaaguguaccagccuugccuucucaaguagauucuaagcuccuuuaaggca

SEQ ID NO: 301082 - RNA, 64 nt, Human
uccaagccuacaacuucaaguuuuaucauuugaacucaaguacuuuugcugcugaggaauggaa

SEQ ID NO: 301083 - RNA, 64 nt, Human
cuucaaagcugaagaaucuaaaugucgucuuugacucaaguaccaaauaauaauaaugcuauac

SEQ ID NO: 301084 - RNA, 64 nt, Human
aaaaaauucuaccaucuuucuuuaucaucuggugugggcgcacucuacagugacuucagucugc

SEQ ID NO: 301085 - RNA, 64 nt, Human
gggauauauuuuuacuuauaauaccaauuuaggcugggcgcaguggcucacgccuguaauccca

SEQ ID NO: 301086 - RNA, 64 nt, Human
ucagccagccugaggcuguggccuccaaagggucugggcgcaccccccaggucgcaggugucug

SEQ ID NO: 301087 - RNA, 64 nt, Human
uuaguaauguaacuugaagauguuaaacaaaaaucucaaguaaaaugaaaagcaaauaugggcu

SEQ ID NO: 301088 - RNA, 64 nt, Human
gguaauaggaagaacaguacauuuuugucuuuaucucaaguauauaaaguuuugccccaugaua

SEQ ID NO: 301089 - RNA, 64 nt, Human
uggucaaggcucacugcagcuucaaucuucugggcucaaguaauccuuccaccucagccuccca

SEQ ID NO: 301090 - RNA, 64 nt, Human
guaccauguagagagaugggaugguaucuaaaaacucaaguauuuucgaugauagagguaagaa

SEQ ID NO: 301091 - RNA, 64 nt, Human
auucucauuaacacuuacauuuccauaaagaaaacucaaguauuaauaaaagagacuuuacugg

SEQ ID NO: 301092 - RNA, 64 nt, Human
uggacuucucugaagcuguguuuagugaaaugagcucaaguacaugaauguuaguuguuaucac

SEQ ID NO: 301093 - RNA, 64 nt, Human
aguugaggcuaccgaaccuuacauuuugcuagagcucaaguaauagaaacuuaguuucagaauc

SEQ ID NO: 301094 - RNA, 64 nt, Human
accauguuggccaggcuggucucaaacuccugaccucaaguaauccaccugccucggccuccca

SEQ ID NO: 301095 - RNA, 64 nt, Human
uucuagccuuaugaccaggaaccuuuguuuugggcucaaguacacauccugauuugguuucucc

SEQ ID NO: 301096 - RNA, 64 nt, Human
ugggagaaaaagucauccaguuuuucauguuugccucaaguaaucuuuacaguguuacaaauua

SEQ ID NO: 301097 - RNA, 64 nt, Human
aacacuguucuaggcuuaggugaccuuaggaucacucaaguagacccuucacucccugcgagaa

SEQ ID NO: 301098 - RNA, 64 nt, Human
gggaagaagggugagauuccgucuucuucccugucucaaguaaguaaggaagguacugcggaca

SEQ ID NO: 301099 - RNA, 64 nt, Human
cagagggcagaguggcagccaggcccacaugucucucaaguaccuguccccucgcucuggugau

SEQ ID NO: 301100 - RNA, 64 nt, Human
ucuaccaagcugucacagguuuucagagaauuaucucaaguaaaacaaaugaaauuuaauuaca

SEQ ID NO: 301101 - RNA, 64 nt, Human
gucuuccaaauugaagccagaccaugcugaugaccucaaguagcacugacuauuugacaauagg

SEQ ID NO: 301102 - RNA, 62 nt, Human
cacagcguggcuuuuccuaaacugguguuuuucccccgcauuugguggauuuuuuauuauua

SEQ ID NO: 301103 - RNA, 64 nt, Human
gaaaaagaaagaaaacccacacacaaagcaaaaacucaaguauuaagagcacauauuuuugacc

SEQ ID NO: 301104 - RNA, 64 nt, Human
caucuccaaggugagguccacccccacagcagaccucaaguagaaauugcccaauuuuuaccag

SEQ ID NO: 301105 - RNA, 64 nt, Human
uugagauauuuuuagauuugaucaucuuagaaaacucaaguacauuauauacagugcaagcauc

SEQ ID NO: 301106 - RNA, 64 nt, Human
uauaaacaggacccaauuuauauucauagauccucucaaguauuauacaauuuaaaaacucuug

SEQ ID NO: 301107 - RNA, 64 nt, Human
agcaaaacaacuacucuuaaaacuuuuuuuaugucucaaguaaaauggcugagcauugcagaga

SEQ ID NO: 301108 - RNA, 64 nt, Human
ucaccccaaguagucugcucacaguaacccaaaccucaaguaaacuccccuuucccucgcuaug

SEQ ID NO: 301109 - RNA, 64 nt, Human
ggagaacgccaagaacgaagagauucugaauucccucaaguacguccggccuggugguggguuc

SEQ ID NO: 301110 - RNA, 64 nt, Human
gacuugcuuagguaccuggcagcugugaccacagcucaaguaaaaaaacaaaaacaggcaaaua

SEQ ID NO: 301111 - RNA, 64 nt, Human
aauucauccuuaguacacagagaauauacuuuuccucaaguaauauaccuguuugaagcuuuaa

SEQ ID NO: 301112 - RNA, 64 nt, Human
aggccuagucucaauggaagaagaauuuccgauccucaaguauuuucuaaagaaguucagacag

SEQ ID NO: 301113 - RNA, 64 nt, Human
cauugcaugcaaauuuuauuguuaguguucuuaacucaaguaggaguaaaccaaaaagugugau

SEQ ID NO: 301114 - RNA, 64 nt, Human
uuguauucuuuggcuuuuuuguguaguaaagggacucaaguaauguuugacagugaaggauaca

SEQ ID NO: 301115 - RNA, 64 nt, Human
uucuuuaucuguagugggaucuugaguaaugaggcucaaguaaauccucaauguguauaauuau

SEQ ID NO: 301116 - RNA, 64 nt, Human
uaaagacuguagaagaaagagcaacaauccaucucucaaguaguguaucacaguaguagccucc

SEQ ID NO: 301117 - RNA, 64 nt, Human
cucuacaaaaaaugcaaaaauaaaaaauauaguacucaaguauucuugauccuguguuucaaaa

SEQ ID NO: 301118 - RNA, 62 nt, Human
aagggccagggccuggcacccaccuggagaagcccccgcacccgagggaacccaugguggac

SEQ ID NO: 301119 - RNA, 62 nt, Human
uauuggaaggcagcucccgcauaccaggauaacccccgcaaaccacauagcagacccccgcc

SEQ ID NO: 301120 - RNA, 62 nt, Human
gugccaggggagucaggguuguagccaagacgcccccgcacggggaggguugggaagggggu

SEQ ID NO: 301121 - RNA, 64 nt, Human
guggcauuccauauacuaacaucccccagguccucucaaguacuucugcugaaacaaauuuauu

SEQ ID NO: 301122 - RNA, 64 nt, Human
auuauacacauuggaaagggccaaccuauuagggcucaaguauguauaugcaaaaaaaaaaagu

SEQ ID NO: 301123 - RNA, 64 nt, Human
uuucuuugcuaaaucuuuaaauucuguuaagauccucaaguaacuggggaguacaugcuuuagg

SEQ ID NO: 301124 - RNA, 64 nt, Human
auuacuuagguuauuuugcuuugguuaaaaauggcucaaguagaaaagcagucccauucauauu

SEQ ID NO: 301125 - RNA, 64 nt, Human
uaccucuccugcuuuucucuaauuauuacgccaacucaaguaguuaaaaaucaguaagaaaaau

SEQ ID NO: 301126 - RNA, 64 nt, Human
aaaguauguaaccagaauugguuagugugacccccucaaguagcaagugauggaaaauaagagu

SEQ ID NO: 301127 - RNA, 64 nt, Human
uccuuuuuuaaaaaaauuuuugcaaauaacugaucucaaguauaugucauuuacucaaaaucug

SEQ ID NO: 301128 - RNA, 64 nt, Human
guaacucugcucggggugaaccauucuccuuucucucaaguaaaccaguaguuuuucuucuguu

SEQ ID NO: 301129 - RNA, 64 nt, Human
caguuugagcaaugaaauccguaagauuaaacaacucaaguaaaugcuucagucaggacucuga

SEQ ID NO: 301130 - RNA, 64 nt, Human
ggcugguagcauuaaauuagcuuuuuacccucaacucaaguagcaaauaucauggagaacuuca

SEQ ID NO: 301131 - RNA, 64 nt, Human
gucuauagaaacccaaaacuaaaaucucucauaacucaaguauggaauacuuuuuuuaaagaaa

SEQ ID NO: 301132 - RNA, 64 nt, Human
uggaagaaagcaacaaagauugagaagccauguacucaaguaccaccaagggaucugccauugg

SEQ ID NO: 301133 - RNA, 64 nt, Human
agggcaaguaacuaucuguacuaguuuguggcagcucaaguaaaaucgaguccaaaccaacggc

SEQ ID NO: 301134 - RNA, 64 nt, Human
aagacagagggguccaagggagauggucucucuucucaaguaggaacaccccagccucagacag

SEQ ID NO: 301135 - RNA, 64 nt, Human
uauauuuuuauauuuaccuuuaauuaguuuguaucucaaguacccucuugagguaggaaaugcu

SEQ ID NO: 301136 - RNA, 62 nt, Human
cagaagggaaaggcggcuguuuggcucuuucucccccgcaaggacccgcugacccgcuggau

SEQ ID NO: 301137 - RNA, 62 nt, Human
agcagccugugcaaauucugaugaugaccccacccccgcacacgcacacgcacaucaugcuu

SEQ ID NO: 301138 - RNA, 62 nt, Human
cuaugacuugagccaggucugguccguggugucccccgcacccagcaggggacaggcacuca

SEQ ID NO: 301139 - RNA, 64 nt, Human
uucugcuucagcuuagagcagaacccauaaaauacucaaguacugggauaggcaagcaugugug

SEQ ID NO: 301140 - RNA, 64 nt, Human
uuugguauuuuuugaaaauuccaaauacucaugucucaaguaagcuuaaacuacaacuugucac

SEQ ID NO: 301141 - RNA, 64 nt, Human
guaaguguugucagagcagggcaauaucucuacucucaaguaugaggggaauagaaacaaagca

SEQ ID NO: 301142 - RNA, 64 nt, Human
cgguguuaaaaaaaaucaugguaaggcuacaauacucaaguaacaagguuugggacaaugucua

SEQ ID NO: 301143 - RNA, 64 nt, Human
agucaaaagcaagaaaaacguaaucccgucugaacucaaguagucauucauauaaauuugaaca

SEQ ID NO: 301144 - RNA, 64 nt, Human
agcguuguucccuuugcguuugcagugcguuuuacucaaguagccagaaacaccccacguuucu

SEQ ID NO: 301145 - RNA, 64 nt, Human
auaaaagauuuccagugacagaaaaauauauuaucucaaguauuuuuuaaaaauauaugaauuc

SEQ ID NO: 301146 - RNA, 64 nt, Human
gguaaaaaucaagccuuuggagccacagaaccagcucaaguacaugccaauguuguuuaagaaa

SEQ ID NO: 301147 - RNA, 64 nt, Human
uuuccugaucuucucccuccucccaaccuccacccucaaguaggauucaguguguuguuccccu

SEQ ID NO: 301148 - RNA, 64 nt, Human
cucauagucaugcuuuuuggaaauuuacaucauccucaaguaaaauaaauaucaguuaaauauu

SEQ ID NO: 301149 - RNA, 64 nt, Human
gggauagaagaguugaaaagggaaagcaaaacuccucaaguagcuuccuuaaaaugucauucau

SEQ ID NO: 301150 - RNA, 64 nt, Human
uauuuucuuaaaugaaguuguaacuucgguauaacucaaguauacuguauauucuuugcuuuua

SEQ ID NO: 301151 - RNA, 64 nt, Human
uagacuucugguaucuucuuacuaacauaaauaucucaaguagaaaaguuuuugaaaacuaaca

SEQ ID NO: 301152 - RNA, 64 nt, Human
cugcgugaguaacuuucuugcauaaucaagguuacucaaguagaagccugaaaauuaaucugcu

SEQ ID NO: 301153 - RNA, 64 nt, Human
caaugucuaacccaacccuaucuugaaaguugaacucaaguagaaaaauggauagaaacaaaau

SEQ ID NO: 301154 - RNA, 62 nt, Human
gcccggcccgcgcucccgcccgcacugcccuccccccgcagcaggggcgccuugggacuccg

SEQ ID NO: 301155 - RNA, 62 nt, Human
ggccaccgccccagccucaccccaucccacgacccccgcaacccuucacaucaccccccucg

SEQ ID NO: 301156 - RNA, 62 nt, Human
aguccagugaauccacgacccgcagaccuguccccccgcaacagcuuauaccauggaaugag

SEQ ID NO: 301157 - RNA, 64 nt, Human
auuugguuuuaaaauuuuuaugcuaauauaaaugcucaaguaauuuaaaauauugaaagcaucc

SEQ ID NO: 301158 - RNA, 64 nt, Human
ugccuacugauauuacuaaaguacauuauguuuacucaaguaaauaauuuucuccccaugguac

SEQ ID NO: 301159 - RNA, 64 nt, Human
aggagauugugagcuguguaaguagucaucgccacucaaguaggacaaggguccuacccaaggc

SEQ ID NO: 301160 - RNA, 64 nt, Human
auacacauaguucuguaauaaaacuguuugacuucucaaguaacaugacuuccuuauuucugaa

SEQ ID NO: 301161 - RNA, 64 nt, Human
cuuccagguucaagcgauucuccugacucagccucucaaguagcugggauuacaagcaugcgcc

SEQ ID NO: 301162 - RNA, 64 nt, Human
cauuaggaguuagguacuaauuaguuggcuaaugcucaaguauuuuauacccacaagagaggua

SEQ ID NO: 301163 - RNA, 64 nt, Human
uuuuuugauaccccacccuccuccacccucuacccucaaguagucccuggugucuguuguuccc

SEQ ID NO: 301164 - RNA, 64 nt, Human
cuuagcagaaaaugacgauuaaucuauaggaaagcucaaguaaaugcauuaucaacugcagaag

SEQ ID NO: 301165 - RNA, 64 nt, Human
auagggcccaaagaaggcaaaaagauaagauuuacucaaguagcauuugggcaaugaggaagga

SEQ ID NO: 301166 - RNA, 64 nt, Human
uacaguauucagugcacagaaaucuuaugauuggcucaaguacaguaaguuacuucucaguaaa

SEQ ID NO: 301167 - RNA, 64 nt, Human
accauggaaagggaagcaucucugccuguggauucucaaguacuuggaagcaccucuccugagg

SEQ ID NO: 301168 - RNA, 64 nt, Human
ccugcuuuacacauguuauaccauuguuuuuucccucaaguauuuuuucccugugaagaagauu

SEQ ID NO: 301169 - RNA, 64 nt, Human
aaugcaaaaucagggaaaauggguugcuuugugucucaaguauugucuuuauuuuugagacuau

SEQ ID NO: 301170 - RNA, 64 nt, Human
aacaauuuagaaccagauaugcuuugucuugauucucaaguagaauaaucuucaaaugcaaaag

SEQ ID NO: 301171 - RNA, 64 nt, Human
ggggaggacaggaaucuguauuuuucauagcaaccucaaguaaucuuuauucugagggucucgg

SEQ ID NO: 301172 - RNA, 50 nt, Human
ccgccaaagccaagaaauagcccccgcacaccacccugugccccagauga

SEQ ID NO: 301173 - RNA, 62 nt, Human
gccgcccuggcuuggcagcccugcccacgcugcccccgcaaacaauggugugugcguuuuua

SEQ ID NO: 301174 - RNA, 62 nt, Human
guggagaccagacucugcaaguggggagaccacccccgcaagccagugacaagggagcccug

SEQ ID NO: 301175 - RNA, 64 nt, Human
gauaagcaagaaagauuucaucucccaccccagccucaaguaggaguuuuauauacuguguaua

SEQ ID NO: 301176 - RNA, 64 nt, Human
aagucacagcugcuuaguacaaccaucuggguugcucaaguagaugcccauaauaagagacuau

SEQ ID NO: 301177 - RNA, 64 nt, Human
cuggaggcccagguugggagucagucgaggauuccucaaguaccauuugcuaggcugugaggug

SEQ ID NO: 301178 - RNA, 64 nt, Human
gauaaaaugugaugggaaacuucucacugaugugcucaaguacaggcauaaccauuaacccagu

SEQ ID NO: 301179 - RNA, 64 nt, Human
aucuguacuguaucaggauuacaaaggauuuagccucaaguaguucccuuuuuguauuaauaac

SEQ ID NO: 301180 - RNA, 64 nt, Human
auauagauaugagccaugguggagaacuuuaucacucaaguagacgguaaacauccuuaauaug

SEQ ID NO: 301181 - RNA, 64 nt, Human
gcugggauuacaggcaugagccaccgcgccuggccucaaguaaguuuuuauaccaugauagggg

SEQ ID NO: 301182 - RNA, 64 nt, Human
agggggagauauaaggagacaccuucuuucugggcucaaguauccugccacucugucauguccu

SEQ ID NO: 301183 - RNA, 64 nt, Human
aagggcuuuaccaaaguccacuaaauaaacacuacucaaguacagacugcaaaccaaaauguau

SEQ ID NO: 301184 - RNA, 64 nt, Human
caucccuucccuucccuggagcugcccugccuuucucaaguauuuauuuauuuauugcaugguu

SEQ ID NO: 301185 - RNA, 64 nt, Human
cuccuggauucaagcgauucuccugccucagccucucaaguagcugggauuacagggcaccugc

SEQ ID NO: 301186 - RNA, 64 nt, Human
gguuuacauuccacagacuacuucaggcuaaagacucaaguaaaacucaguuauuacgguagag

SEQ ID NO: 301187 - RNA, 64 nt, Human
cuguuucaggauuacaaaggaaucaggauuuagccucaaguaguucccuuguuguauuaauaac

SEQ ID NO: 301188 - RNA, 64 nt, Human
guauauacaagaagccaugcuguuaacaguuuaucucaaguaauuuggugucauuuacaaaagg

SEQ ID NO: 301189 - RNA, 64 nt, Human
uacuuuuuuauuugacucacaaccauucuuaggucucaaguauucccauguguuuuaaaagccu

SEQ ID NO: 301190 - RNA, 64 nt, Human
ccagcagggcuggcccggagacugggcagcuaagugggcgcauccugucuucagcuggccucac

SEQ ID NO: 301191 - RNA, 64 nt, Human
acugggcccugccggucaccaggccacugugcagugggcgcagagcauggucaggaguggccug

SEQ ID NO: 301192 - RNA, 64 nt, Human
ucuccuggagccucucccucccggcccugggaagugggcgcagcccuguguucccccagcuugg

SEQ ID NO: 301193 - RNA, 64 nt, Human
gaccaaauguaguuuuguauacagagaagaaaaccucaaguaauaggcauuuuaaguaaaaguc

SEQ ID NO: 301194 - RNA, 64 nt, Human
aggccaguggacucugaggacuccugaggggcggggcguguagccagccaggugcaugccggga

SEQ ID NO: 301195 - RNA, 64 nt, Human
ugcuggucaauaaaacgcuuccuaauagcagcuuggcguguaucugguccuagugaagaggaag

SEQ ID NO: 301196 - RNA, 64 nt, Human
gcauaaaugaaaggaauuuuauagucuccuaaauggcguguacugcaagaccucuugaacacuu

SEQ ID NO: 301197 - RNA, 64 nt, Human
cuacaaaaaaacacaaaaaauagccaggcaugguggcguguacauguggucucagauacuuggg

SEQ ID NO: 301198 - RNA, 64 nt, Human
gcggcuaagggacgguugggggcugggagcccugggcguguaguguaacuggaaucuuuugccu

SEQ ID NO: 301199 - RNA, 64 nt, Human
cacagugcaaacugcagugacuguaaauuggccuggcguguauaaacguuuucagggaaugcag

SEQ ID NO: 301200 - RNA, 64 nt, Human
agugugaaaggagauaggagaagcucaacuugagggcguguaguaaguuguagaaggcucgagg

SEQ ID NO: 301201 - RNA, 62 nt, Human
gcagcgagaacaucccaccccucccccccccccccccgcagccagugcuccuugucaagcuc

SEQ ID NO: 301202 - RNA, 50 nt, Human
ucaaccgcuuccaggacuagcccccgcaggggccugcgccaccccguccu

SEQ ID NO: 301203 - RNA, 62 nt, Human
gaggaucuuuaggccugaguugugaagcgcaacccccgcaaaacgcauuugccaucacaguu

SEQ ID NO: 301204 - RNA, 64 nt, Human
aacagcccaggugggaccuggaugaagcuuugcacucaaguauugucaagggaagcuuccugug

SEQ ID NO: 301205 - RNA, 64 nt, Human
guucuccccagagccuccuccugccccaccagcucucaaguaccuuuucuccuggacugugugg

SEQ ID NO: 301206 - RNA, 64 nt, Human
cacuuggguucaagcgauucuccugccucagccucucaaguagcgggauuacaggcgcccacca

SEQ ID NO: 301207 - RNA, 64 nt, Human
uucaguaucuuucuccgugguuuugugaaauaaacucaaguacaaagcagacagcccaugaagu

SEQ ID NO: 301208 - RNA, 64 nt, Human
gaauuagaguuucuucaaauugauucauugauuucucaaguauggauuaugugaaagagcccag

SEQ ID NO: 301209 - RNA, 64 nt, Human
uaaguuauuuugcucaaguacuuaaguagucuggcucaaguacuuuguuuacaauuaaaaugga

SEQ ID NO: 301210 - RNA, 64 nt, Human
ccuccuccucuuaagauuuuuuuaaguuauuuugcucaaguacuuaaguagucuggcucaagua

SEQ ID NO: 301211 - RNA, 64 nt, Human
cagguguucauauccuugauuuugagaauuuccccucaaguauguggcaguaaauacaacaaga

SEQ ID NO: 301212 - RNA, 64 nt, Human
gucucccuccucugucaccaccagccucuccaagcucaaguacaaauacagccgggucucauuu

SEQ ID NO: 301213 - RNA, 64 nt, Human
cuucugggcuuaagugauccucccaccucagcuucucaaguagcucuggcacuacagacaugug

SEQ ID NO: 301214 - RNA, 64 nt, Human
aaaagcugcugcuaugucucucuucugucuuauucucaaguaucuacugauguauuuagcaauu

SEQ ID NO: 301215 - RNA, 64 nt, Human
acuauguugucuaggcuggucuugaacucuuggccucaaguaauccuccugccucagccuccca

SEQ ID NO: 301216 - RNA, 64 nt, Human
uuauucuggcauaaauauuaauagcaccacuuuacucaaguacccagguugggcaauagucugc

SEQ ID NO: 301217 - RNA, 64 nt, Human
caccuuccugguucaagcgauucugccucgaccucucaaguagcugggauuacaagcaccagcc

SEQ ID NO: 301218 - RNA, 64 nt, Human
uuuucggcuccucucccuccuccuaccuuccgcccucaaguagacuccagugucuguuauuccc

SEQ ID NO: 301219 - RNA, 64 nt, Human
ccugaagucacagcagaguucaccccagagcgccugggcgcaucuuguggcaugcccaugggcu

SEQ ID NO: 301220 - RNA, 64 nt, Human
cuuccuuuuacugcauuuuuacucgugugcauucugggcgcauguugaucgcugguucagucca

SEQ ID NO: 301221 - RNA, 62 nt, Human
uggccgcuucuagagccucgacacccccccaacccccgcaccaagcagacaaagucaauaaa

SEQ ID NO: 301222 - RNA, 64 nt, Human
cucgacucacugcagcuaucucucgccucagccccucaaguagcugggacuacaggugcaugcc

SEQ ID NO: 301223 - RNA, 64 nt, Human
aaucagaaguuaauuuuuaaguguuuguaagguucucaaguacugugacauguauuuuuuugug

SEQ ID NO: 301224 - RNA, 64 nt, Human
cuguguuucacugaccauacauuuuucuuagccccucaaguaauauagcacagaguuaugaaug

SEQ ID NO: 301225 - RNA, 64 nt, Human
ccuacaucccuuucucccuucccuccucuugcuccucaaguaagaggugcagagaugagguccu

SEQ ID NO: 301226 - RNA, 64 nt, Human
ugugaaucaagagaacguccccagcuuuggcauccucaaguaucccccgagagcagaauagggu

SEQ ID NO: 301227 - RNA, 64 nt, Human
ccauaaucugggacuuuuuaaaaauaagaaccagcucaaguacaugguuucauacugggguuuc

SEQ ID NO: 301228 - RNA, 64 nt, Human
aauuuucuuuaauuccaaacuagggcuuucaugacucaaguacuuccuaaaaaaacccaaucuu

SEQ ID NO: 301229 - RNA, 64 nt, Human
aaucuaaaaguuaauuuauguugcucauauauuacucaaguauuuaaauuuagagagaaugccg

SEQ ID NO: 301230 - RNA, 64 nt, Human
aauuucuaaagcacuuacguugugccagguuccacucaaguaaauuaucucugccuucaaggag

SEQ ID NO: 301231 - RNA, 64 nt, Human
uguaccacagucuugcacauaagugcagauuuggcucaaguaaagagaauuuccucaacacuaa

SEQ ID NO: 301232 - RNA, 64 nt, Human
uuuggcuucauacacugaauuuucaguauuuuaucucaaguagauauagacacuaaccuugaua

SEQ ID NO: 301233 - RNA, 64 nt, Human
guacacaucauacugaacucuugaugagcugagccucaaguaccuguguaaaagagcucccauc

SEQ ID NO: 301234 - RNA, 64 nt, Human
guggggagugguaccuugaaaauccaaaagccaucucaaguaaaaggaauaaaugugucaugcu

SEQ ID NO: 301235 - RNA, 64 nt, Human
uggagacggcgcgguaagaggagggggagccaggcucaaguauuggcaccaaguuaggucucag

SEQ ID NO: 301236 - RNA, 64 nt, Human
cuguuuuauaaacauaaucacaacaguaauaaaccucaaguaguggcuaguguuuaguauagaa

SEQ ID NO: 301237 - RNA, 64 nt, Human
ucccgggccucuccgguucucccuugcggaaugaugggcgcauccugucugccacgugcugacg

SEQ ID NO: 301238 - RNA, 64 nt, Human
aggugacgcaacucgugaacagccgugccugccuugggcgcagccuccggcgccagagcugggc

SEQ ID NO: 301239 - RNA, 64 nt, Human
caauccccagggcacugcagagucugggcagaggugggcgcauagguacaagugcugcuuuguc

SEQ ID NO: 301240 - RNA, 64 nt, Human
ucuuguauucauuaaccauaguacuccuccccaccucaaguagacaccucucucaggagcuucu

SEQ ID NO: 301241 - RNA, 64 nt, Human
uaggagaguugugacuuaggcaggagucgaccuccucaaguaauggaacgauuucaaaggcagg

SEQ ID NO: 301242 - RNA, 64 nt, Human
gggaaucugcaguuuguagcagaaugguauuuuccucaaguagcucauaauacugccaaaucuc

SEQ ID NO: 301243 - RNA, 64 nt, Human
cgcccuuggugcuggaggcgggcuugguguccggcucaaguagccuuccucugcucugggacca

SEQ ID NO: 301244 - RNA, 64 nt, Human
acacgagacggggcuucagccgggcauggucccucucaaguaucuccuggaggaagggguaugg

SEQ ID NO: 301245 - RNA, 64 nt, Human
uuccuuugcagccuuagucacacaacugagucaucucaaguacucuuuaaggacacacagccca

SEQ ID NO: 301246 - RNA, 64 nt, Human
gcaugcuccuuaagagucaucaccacucccuaaucucaaguacccagggacacaaacacugcgg

SEQ ID NO: 301247 - RNA, 64 nt, Human
gccuuaaaauugcaugguucuuaauggcauucgccucaaguaguguguuuguauaaauucuguu

SEQ ID NO: 301248 - RNA, 64 nt, Human
cucccuggaggaaggaggguuaggggugccuauccucaaguauuggaagagcagaauugaggga

SEQ ID NO: 301249 - RNA, 64 nt, Human
gacuaaguauaugcuucaaguuuuaaauuaauaccucaaguauuaaauaaauauuccaaguuug

SEQ ID NO: 301250 - RNA, 64 nt, Human
ccgccccuguggcccuggccacuaaagcuucagacucaaguacccauucuguuuucccccagca

SEQ ID NO: 301251 - RNA, 64 nt, Human
uacauaucacuuuuaguuuagauuuuuauuuuaucucaaguauguccaguguguucgguuuguu

SEQ ID NO: 301252 - RNA, 64 nt, Human
auaccccaaaagcaauauguugucacuccuaauucucaaguacuauucaaauuguaguaaaucu

SEQ ID NO: 301253 - RNA, 64 nt, Human
uguauuagaguauuauauagcuucuuaguagggucucaaguaaguuucauuuuuuuuaucuggg

SEQ ID NO: 301254 - RNA, 64 nt, Human
uuccugcugaauuaaauuauacuucaguuguugccucaaguaaagguguuugacaagaagauac

SEQ ID NO: 301255 - RNA, 64 nt, Human
acaggaagccugugaccauggcagccuugucuuaugggcgcauaugugcguguguggcugaguc

SEQ ID NO: 301256 - RNA, 64 nt, Human
gugugcggguggcaguguuaccccgugucccgggugggcgcagggcucuggauggugagcccuc

SEQ ID NO: 301257 - RNA, 64 nt, Human
auucacaaggaaucauaaauuguguuuuugaggcugggcgcagugacucacaccuguaucccag

SEQ ID NO: 301258 - RNA, 64 nt, Human
ugaucauaccucacugcagcuucaacuuccugggcucaaguaauccucccaccccagccuccca

SEQ ID NO: 301259 - RNA, 64 nt, Human
cucucagguucaagugguucuccugccucagccucucaaguagcugggauuacaggugcacagc

SEQ ID NO: 301260 - RNA, 64 nt, Human
cuugagucauauugaggcauucaaggaugcacagcucaaguauuuauucaggaaaaaugcuuuu

SEQ ID NO: 301261 - RNA, 64 nt, Human
ccuuggucacauugagucauuccaggaugaguggcucaaguauuuccucagggaaaauacuucu

SEQ ID NO: 301262 - RNA, 64 nt, Human
cucccaggcucaagugauccucccaccucagccucucaaguagcugggacuacaggcaugugcc

SEQ ID NO: 301263 - RNA, 64 nt, Human
aggacuccagggagccucgacccuagggcugauccucaaguaccccaguuucacacauaccaaa

SEQ ID NO: 301264 - RNA, 64 nt, Human
uacaguuuuaugcuauuuguggaaagauuucuuucucaaguaguaguuuuuaauaaaacuacag

SEQ ID NO: 301265 - RNA, 64 nt, Human
agugugugugcagaguccauuucccacaucuuuccucaaguaucuucuauuuuuaucaugaauu

SEQ ID NO: 301266 - RNA, 64 nt, Human
accauguuggucaggcuggucucaaacucccgaccucaaguagucugccugccucaaccuccca

SEQ ID NO: 301267 - RNA, 64 nt, Human
cugcuagcacuugaaucugggaucucgccuuauucucaaguagcaaggcaucucgacaagcaug

SEQ ID NO: 301268 - RNA, 64 nt, Human
uuggcauuuuagaaaauccucacuguccagguuccucaaguagaauaggucauuaaacaucagc

SEQ ID NO: 301269 - RNA, 64 nt, Human
uuacagagucccaggaccggggguggagaggagccucaaguacauuccaggagaccacugucuc

SEQ ID NO: 301270 - RNA, 64 nt, Human
accggaaccuguuuugaauucagucagguuuuuacucaaguaagugguugauuuuuuuuaaguc

SEQ ID NO: 301271 - RNA, 64 nt, Human
agacugugucuuaaaacuuccuccccuaguuucucucaaguaccccucgugagcugugauuuca

SEQ ID NO: 301272 - RNA, 64 nt, Human
cauuauuguuacauauuuguuuuaacauuuuuuucucaaguauaacuaguccuaugauuucaua

SEQ ID NO: 301273 - RNA, 64 nt, Human
cuccaugacuacagggcagcuuugcacagcccucugggcgcacugugugccucugcccagaagg

SEQ ID NO: 301274 - RNA, 64 nt, Human
uagucuccuggguguguuuggcuuggccuuggcaugggcgcaggcccagugacaaagacuccuc

SEQ ID NO: 301275 - RNA, 64 nt, Human
gacagcccgggggcccugcagcuucaggucccuaugggcgcagcugcuccgugagcugagucuc

SEQ ID NO: 301276 - RNA, 64 nt, Human
uccaggagcucaugacgugaagcacuguucuguccucaaguacucaaauauuucugauacugcu

SEQ ID NO: 301277 - RNA, 64 nt, Human
agagacugguggacaucugacugugggaugugcucucaaguaggacgucaucaggacagauucu

SEQ ID NO: 301278 - RNA, 64 nt, Human
gaagagguuucuuucugcaccaggaggaggcgugcucaaguaucgguacgagaucuagccugcc

SEQ ID NO: 301279 - RNA, 64 nt, Human
ggacaccccgcacgccuccaaccucucccucgcucucaaguaccugcccgagguguuugccccc

SEQ ID NO: 301280 - RNA, 64 nt, Human
aucauuuaccacugugcuuggcagagagcggauacucaaguaaguuuuguuaaaugaaugaaug

SEQ ID NO: 301281 - RNA, 64 nt, Human
agucucuaacaauguauuuucuucaccucugcuacucaaguagcauuuacugugucuuugguuu

SEQ ID NO: 301282 - RNA, 64 nt, Human
cagcacaugguaauuuguggauuuuuuuuucauacucaaguaauggaggcuagaaaugaagaga

SEQ ID NO: 301283 - RNA, 64 nt, Human
uugugugaugccuccuuaggcacacaggcaaugucucaaguacuuugaccuuaggguagaaggc

SEQ ID NO: 301284 - RNA, 64 nt, Human
ucuugcuuccuaccuacaucugcuugagcagugccucaaguacauccuuauuaggaacauuuca

SEQ ID NO: 301285 - RNA, 64 nt, Human
ucacuggcuuugcccuggaauuugccagaugcaucucaaguaagccagcugcuggauuuggcuc

SEQ ID NO: 301286 - RNA, 64 nt, Human; identical to SEQ ID NO: 301283

SEQ ID NO: 301287 - RNA, 64 nt, Human
aaaaaaaaaaaaaaaaaguaauuggcagugacuaugggcgcacugccuaacauuuagcccugcc

SEQ ID NO: 301288 - RNA, 64 nt, Human
caaagaggccucaguccagugggagaaacagaccugggcgcaaacaacuccaggacaaggcagg

SEQ ID NO: 301289 - RNA, 64 nt, Human
cccgauggggcaucggucuaaagcuuugggggagugggcgcaguggcucacaccuguaauccca

SEQ ID NO: 301290 - RNA, 64 nt, Human
auccagaacucaaaugagccccuucauccgccugugggcgcauacuacaguaacugugacugau

SEQ ID NO: 301291 - RNA, 64 nt, Human
uccauguauuugguagauaaaugacuaacgaggcugggcgcaguggccucaugccuauaauccc

SEQ ID NO: 301292 - RNA, 64 nt, Human
agcgcugccagggagccgccauccgagcuugagcugggcgcacagaggugcccgccaggaucug

SEQ ID NO: 301293 - RNA, 64 nt, Human
aaaccgcugcucuaaagaaaagaaaacuggaggcugggcgcaguggcucacgccuauaauccca

SEQ ID NO: 301294 - RNA, 64 nt, Human
caggacaaacucuguguaccugugcccaggugaaugggcgcaggguccucuugcccuguccugc

SEQ ID NO: 301295 - RNA, 64 nt, Human
uuuuccggggccaccgggcgggaguggggaagggugggcgcacggaagaugggggccucuguac

SEQ ID NO: 301296 - RNA, 64 nt, Human
gggcuugaaggcccugauggguggaccaccagccugggcgcaguggugcugggggcgugcagcu

SEQ ID NO: 301297 - RNA, 64 nt, Human
guuggucacuggcaggcucagagacauucugcugugggcgcagggagcccggccccccaugcag

SEQ ID NO: 301298 - RNA, 64 nt, Human
uuauuguuuaauuagaaaagaauuguuguugggcugggcgcaguggaucgcaccuguaauccca

SEQ ID NO: 301299 - RNA, 55 nt, Human
acgaccaugacgagcucuagcuggaugggcgcagaggugggcggggagguggagu

SEQ ID NO: 301300 - RNA, 64 nt, Human
uguuagcagcaaagaauucucacaaaugugaauaugggcgcacauuugccucauaaagcacagc

SEQ ID NO: 301301 - RNA, 64 nt, Human
cuugucugguagcaccaugugggagggacccagcugggcgcagcgcccuguggccuuuuagauc

SEQ ID NO: 301302 - RNA, 64 nt, Human
uacacgacccagguauguaccaaguaggcacccuugggcgcacccacuggggccaggggucggg

SEQ ID NO: 301303 - RNA, 64 nt, Human
guggaaaugcuagauaaaaauguaaauuuuuggcugggcgcagcggcucacaccuguaaucccu

SEQ ID NO: 301304 - RNA, 60 nt, Human
agguggccaccuucuccuaggaucuccggaugggcgcaccugcugcucagggcaggguug

SEQ ID NO: 301305 - RNA, 64 nt, Human
augccuguaaucccaguacuuugggaggcugaggugggcgcaucaccugaggucaggaguucga

SEQ ID NO: 301306 - RNA, 64 nt, Human
cagucaaggccacaggcuggaggagagacggggcugggcgcaagguggcggagggcaguguggg

SEQ ID NO: 301307 - RNA, 54 nt, Human
ugauggcucugggggucugagcccugggcgcagcugaagccuggacgcagccac

SEQ ID NO: 301308 - RNA, 64 nt, Human
caccucugaggacagaggccgggguccaggcccgugggcgcaaaggugccucauagcauagcca

SEQ ID NO: 301309 - RNA, 64 nt, Human
cagccucacguggggcuuggacacaggcugggggugggcgcaugcuagggagacuagccugcug

SEQ ID NO: 301310 - RNA, 64 nt, Human
gcagaaguucaugggguaguggccucucaaaggcugggcgcaucccaagacagccagcagguug

SEQ ID NO: 301311 - RNA, 64 nt, Human
gcggcaggaaggggcggcccuuaccuggcaggucugggcgcaccuuuagcagguggacuccgug

SEQ ID NO: 301312 - RNA, 64 nt, Human
guccgucacaggcagugaggaugagagggggugaugggcgcaaggccccagggguccucccucu

SEQ ID NO: 301313 - RNA, 64 nt, Human
acaagccauuccuauuaccuccccaggaggcaagugggcgcagcaccagggaaauguaucucca

SEQ ID NO: 301314 - RNA, 64 nt, Human
accccucacacgcguggagacuuaugacucgucgugggcgcauggcggcgcaccugcugcagga

SEQ ID NO: 301315 - RNA, 64 nt, Human
gugugugugugcgcgcgcgcgcgcgcgcguaacgugggcgcaucccucuuuuccuucccugggu

SEQ ID NO: 301316 - RNA, 64 nt, Human
uuaaucccaaacccccuuuaagacauauuggggcugggcgcaguggcucacgccuguaauccca

SEQ ID NO: 301317 - RNA, 64 nt, Human
gcccgggagccgcaggggccccuccuccagagccugggcgcaagcgacacaggcugccgcugcu

SEQ ID NO: 301318 - RNA, 64 nt, Human
ccugcucugggccaugcagaggaaggacagagggugggcgcagggcaccaacucagggacaucc

SEQ ID NO: 301319 - RNA, 64 nt, Human
gcuggcagcccucacugcaggaggaaggguggagugggcgcaggcacgccaggccuucuuuagc

SEQ ID NO: 301320 - RNA, 64 nt, Human
aucaccgccucucccuggcucccaagggugcaggugggcgcaaggcccggcccccaucacaugu

SEQ ID NO: 301321 - RNA, 64 nt, Human
cccuuuucuccucaccuaaacccaucuccuacuuugggcgcagcacacauauuuucuugucaac

SEQ ID NO: 301322 - RNA, 64 nt, Human
ugggaucuguggucaaaggacaggcgaggagcugugggcgcagggccugccgccacugccuaca

SEQ ID NO: 301323 - RNA, 59 nt, Human; identical to SEQ ID NO: 286280

SEQ ID NO: 301324 - RNA, 59 nt, Human; identical to SEQ ID NO: 286281

SEQ ID NO: 301325 - RNA, 59 nt, Human; identical to SEQ ID NO: 286282

SEQ ID NO: 301326 - RNA, 59 nt, Human; identical to SEQ ID NO: 286283

SEQ ID NO: 301327 - RNA, 59 nt, Human; identical to SEQ ID NO: 286284

SEQ ID NO: 301328 - RNA, 59 nt, Human; identical to SEQ ID NO: 286285

SEQ ID NO: 301329 - RNA, 59 nt, Human; identical to SEQ ID NO: 286286

SEQ ID NO: 301330 - RNA, 59 nt, Human; identical to SEQ ID NO: 286287

SEQ ID NO: 301331 - RNA, 59 nt, Human; identical to SEQ ID NO: 286288

SEQ ID NO: 301332 - RNA, 59 nt, Human; identical to SEQ ID NO: 286289

SEQ ID NO: 301333 - RNA, 59 nt, Human; identical to SEQ ID NO: 286290

SEQ ID NO: 301334 - RNA, 59 nt, Human; identical to SEQ ID NO: 286032

SEQ ID NO: 301335 - RNA, 59 nt, Human; identical to SEQ ID NO: 277899

SEQ ID NO: 301336 - RNA, 99 nt, Human
ugaacuauuuauuuccuccuugaacuauuuauuuccuccuccccuaccccuaguuaagugccacaaagacuguguuauggccacaaagacuguguuaug

SEQ ID NO: 301337 - RNA, 99 nt, Human
auuuauuuguaucugggaaaauuuauuuguaucugggaaaauauucucucuaguuaaaaaugauuuaaagagucgacuaaugauuuaaagagucgacua

SEQ ID NO: 301338 - RNA, 99 nt, Human
cuuucaaaauggaaucugagcuuucaaaauggaaucugaguauuagacacuaguuaacauauuuguguauauuaaauauuauuuguguauauuaaauau

SEQ ID NO: 301339 - RNA, 97 nt, Human
ggcaguggcacuacauguaaggcaguggcacuacauguaaccuucaucuaguuaaccaaucgcaaagcaagggggaaaaucgcaaagcaagggggaa

SEQ ID NO: 301340 - RNA, 99 nt, Human
ucuugaagaccuagaacauaucuugaagaccuagaacauagaagaaugccuaguuaaaaaaaaaaaucaaugaaacuacaaaaaaaucaaugaaacuac

SEQ ID NO: 301341 - RNA, 99 nt, Human
aguugauuuuccuauuuuaaaguugauuuuccuauuuuaacaguaccaacuaguuaauugggaaauguaaguucugaaugggaaauguaaguucugaau

SEQ ID NO: 301342 - RNA, 99 nt, Human
aaaaauuauuucuacacugaaaaaauuauuucuacacugacaggauuuacuaguuaagcaauguuuaauauaaauuuuaaauguuuaauauaaauuuua

SEQ ID NO: 301343 - RNA, 99 nt, Human
uuaccuggcuuauuuaauauuuaccuggcuuauuuaauaugcuuauaaccuaguuaaagaaaggaaaagaaaacaaaaaaaaggaaaagaaaacaaaaa

SEQ ID NO: 301344 - RNA, 99 nt, Human
aacacuuugcugcuuagaaaaacacuuugcugcuuagaaauuucuuccgcuaguuaaccuaaaucaucucucucaaguuuaaaucaucucucucaaguu

SEQ ID NO: 301345 - RNA, 99 nt, Human
ggcuaccuaaaaagaugaccggcuaccuaaaaagaugacccauuauguccuaguuaaucaucauuuuuccuuuaguuuaaucauuuuuccuuuaguuua

SEQ ID NO: 301346 - RNA, 99 nt, Human
gcagucaguuauuauguauagcagucaguuauuauguauaggaggugagcuaguuaacaaacuuguaccacaaaacaauaacuuguaccacaaaacaau

SEQ ID NO: 301347 - RNA, 99 nt, Human
ggcaugguucugcuuugcugggcaugguucugcuuugcuguuugucuuccuaguuaaggcucuuuauaaagagcuuguucucuuuauaaagagcuuguu

SEQ ID NO: 301348 - RNA, 59 nt, Human; identical to SEQ ID NO: 286105

SEQ ID NO: 301349 - RNA, 59 nt, Human; identical to SEQ ID NO: 285999

SEQ ID NO: 301350 - RNA, 59 nt, Human; identical to SEQ ID NO: 277932

SEQ ID NO: 301351 - RNA, 59 nt, Human; identical to SEQ ID NO: 286247

SEQ ID NO: 301352 - RNA, 59 nt, Human; identical to SEQ ID NO: 286248

SEQ ID NO: 301353 - RNA, 59 nt, Human; identical to SEQ ID NO: 286249

SEQ ID NO: 301354 - RNA, 59 nt, Human; identical to SEQ ID NO: 285715

SEQ ID NO: 301355 - RNA, 59 nt, Human; identical to SEQ ID NO: 285716

SEQ ID NO: 301356 - RNA, 59 nt, Human; identical to SEQ ID NO: 277933

SEQ ID NO: 301357 - RNA, 59 nt, Human; identical to SEQ ID NO: 285697

SEQ ID NO: 301358 - RNA, 59 nt, Human; identical to SEQ ID NO: 285698

SEQ ID NO: 301359 - RNA, 59 nt, Human; identical to SEQ ID NO: 285699

SEQ ID NO: 301360 - RNA, 59 nt, Human; identical to SEQ ID NO: 285717

SEQ ID NO: 301361 - RNA, 59 nt, Human; identical to SEQ ID NO: 277941

SEQ ID NO: 301362 - RNA, 59 nt, Human; identical to SEQ ID NO: 285747

SEQ ID NO: 301363 - RNA, 59 nt, Human; identical to SEQ ID NO: 285748

SEQ ID NO: 301364 - RNA, 59 nt, Human; identical to SEQ ID NO: 285749

SEQ ID NO: 301365 - RNA, 59 nt, Human; identical to SEQ ID NO: 285765

SEQ ID NO: 301366 - RNA, 59 nt, Human; identical to SEQ ID NO: 285766

SEQ ID NO: 301367 - RNA, 59 nt, Human; identical to SEQ ID NO: 277942

SEQ ID NO: 301368 - RNA, 59 nt, Human; identical to SEQ ID NO: 285767

SEQ ID NO: 301369 - RNA, 59 nt, Human; identical to SEQ ID NO: 285837

SEQ ID NO: 301370 - RNA, 59 nt, Human; identical to SEQ ID NO: 285838

SEQ ID NO: 301371 - RNA, 59 nt, Human; identical to SEQ ID NO: 277943

SEQ ID NO: 301372 - RNA, 59 nt, Human; identical to SEQ ID NO: 285783

SEQ ID NO: 301373 - RNA, 59 nt, Human; identical to SEQ ID NO: 285784

SEQ ID NO: 301374 - RNA, 58 nt, Human; identical to SEQ ID NO: 285785

SEQ ID NO: 301375 - RNA, 59 nt, Human; identical to SEQ ID NO: 286049

SEQ ID NO: 301376 - RNA, 59 nt, Human; identical to SEQ ID NO: 286050

SEQ ID NO: 301377 - RNA, 59 nt, Human; identical to SEQ ID NO: 277952

SEQ ID NO: 301378 - RNA, 59 nt, Human; identical to SEQ ID NO: 285821

SEQ ID NO: 301379 - RNA, 59 nt, Human; identical to SEQ ID NO: 285679

SEQ ID NO: 301380 - RNA, 59 nt, Human; identical to SEQ ID NO: 285680

SEQ ID NO: 301381 - RNA, 59 nt, Human; identical to SEQ ID NO: 277953

SEQ ID NO: 301382 - RNA, 59 nt, Human; identical to SEQ ID NO: 285839

SEQ ID NO: 301383 - RNA, 59 nt, Human; identical to SEQ ID NO: 286051

SEQ ID NO: 301384 - RNA, 59 nt, Human; identical to SEQ ID NO: 277954

SEQ ID NO: 301385 - RNA, 59 nt, Human; identical to SEQ ID NO: 285855

SEQ ID NO: 301386 - RNA, 59 nt, Human; identical to SEQ ID NO: 285856

SEQ ID NO: 301387 - RNA, 59 nt, Human; identical to SEQ ID NO: 285857

SEQ ID NO: 301388 - RNA, 59 nt, Human; identical to SEQ ID NO: 285873

SEQ ID NO: 301389 - RNA, 59 nt, Human; identical to SEQ ID NO: 285874

SEQ ID NO: 301390 - RNA, 59 nt, Human; identical to SEQ ID NO: 277971

SEQ ID NO: 301391 - RNA, 59 nt, Human; identical to SEQ ID NO: 285891

SEQ ID NO: 301392 - RNA, 59 nt, Human; identical to SEQ ID NO: 285892

SEQ ID NO: 301393 - RNA, 59 nt, Human; identical to SEQ ID NO: 285893

SEQ ID NO: 301394 - RNA, 59 nt, Human; identical to SEQ ID NO: 285661

SEQ ID NO: 301395 - RNA, 59 nt, Human; identical to SEQ ID NO: 285662

SEQ ID NO: 301396 - RNA, 59 nt, Human; identical to SEQ ID NO: 277972

SEQ ID NO: 301397 - RNA, 59 nt, Human; identical to SEQ ID NO: 285947

SEQ ID NO: 301398 - RNA, 59 nt, Human; identical to SEQ ID NO: 285607

SEQ ID NO: 301399 - RNA, 59 nt, Human; identical to SEQ ID NO: 285608

SEQ ID NO: 301400 - RNA, 59 nt, Human; identical to SEQ ID NO: 277973

SEQ ID NO: 301401 - RNA, 59 nt, Human; identical to SEQ ID NO: 286139

SEQ ID NO: 301402 - RNA, 59 nt, Human; identical to SEQ ID NO: 286140

SEQ ID NO: 301403 - RNA, 59 nt, Human; identical to SEQ ID NO: 286141

SEQ ID NO: 301404 - RNA, 59 nt, Human; identical to SEQ ID NO: 285571

SEQ ID NO: 301405 - RNA, 59 nt, Human; identical to SEQ ID NO: 285572

SEQ ID NO: 301406 - RNA, 59 nt, Human; identical to SEQ ID NO: 277990

SEQ ID NO: 301407 - RNA, 59 nt, Human; identical to SEQ ID NO: 285486

SEQ ID NO: 301408 - RNA, 59 nt, Human; identical to SEQ ID NO: 285487

SEQ ID NO: 301409 - RNA, 59 nt, Human; identical to SEQ ID NO: 285488

SEQ ID NO: 301410 - RNA, 59 nt, Human; identical to SEQ ID NO: 285573

SEQ ID NO: 301411 - RNA, 59 nt, Human; identical to SEQ ID NO: 277991

SEQ ID NO: 301412 - RNA, 59 nt, Human; identical to SEQ ID NO: 285500

SEQ ID NO: 301413 - RNA, 59 nt, Human; identical to SEQ ID NO: 285501

SEQ ID NO: 301414 - RNA, 59 nt, Human; identical to SEQ ID NO: 285502

SEQ ID NO: 301415 - RNA, 59 nt, Human; identical to SEQ ID NO: 285518

SEQ ID NO: 301416 - RNA, 59 nt, Human; identical to SEQ ID NO: 285519

SEQ ID NO: 301417 - RNA, 59 nt, Human; identical to SEQ ID NO: 277992

SEQ ID NO: 301418 - RNA, 59 nt, Human; identical to SEQ ID NO: 285520

SEQ ID NO: 301419 - RNA, 59 nt, Human; identical to SEQ ID NO: 285589

SEQ ID NO: 301420 - RNA, 59 nt, Human; identical to SEQ ID NO: 285590

SEQ ID NO: 301421 - RNA, 59 nt, Human; identical to SEQ ID NO: 278009

SEQ ID NO: 301422 - RNA, 59 nt, Human; identical to SEQ ID NO: 285553

SEQ ID NO: 301423 - RNA, 59 nt, Human; identical to SEQ ID NO: 285554

SEQ ID NO: 301424 - RNA, 59 nt, Human; identical to SEQ ID NO: 285555

SEQ ID NO: 301425 - RNA, 59 nt, Human; identical to SEQ ID NO: 285681

SEQ ID NO: 301426 - RNA, 59 nt, Human; identical to SEQ ID NO: 278010

SEQ ID NO: 301427 - RNA, 59 nt, Human; identical to SEQ ID NO: 285591

SEQ ID NO: 301428 - RNA, 59 nt, Human; identical to SEQ ID NO: 285609

SEQ ID NO: 301429 - RNA, 59 nt, Human; identical to SEQ ID NO: 278011

SEQ ID NO: 301430 - RNA, 59 nt, Human; identical to SEQ ID NO: 285625

SEQ ID NO: 301431 - RNA, 59 nt, Human; identical to SEQ ID NO: 285626

SEQ ID NO: 301432 - RNA, 59 nt, Human; identical to SEQ ID NO: 285627

SEQ ID NO: 301433 - RNA, 59 nt, Human; identical to SEQ ID NO: 285643

SEQ ID NO: 301434 - RNA, 59 nt, Human; identical to SEQ ID NO: 285644

SEQ ID NO: 301435 - RNA, 59 nt, Human; identical to SEQ ID NO: 278025

SEQ ID NO: 301436 - RNA, 59 nt, Human; identical to SEQ ID NO: 285663

SEQ ID NO: 301437 - RNA, 59 nt, Human; identical to SEQ ID NO: 285414

SEQ ID NO: 301438 - RNA, 59 nt, Human; identical to SEQ ID NO: 285415

SEQ ID NO: 301439 - RNA, 59 nt, Human; identical to SEQ ID NO: 278026

SEQ ID NO: 301440 - RNA, 59 nt, Human; identical to SEQ ID NO: 285733

SEQ ID NO: 301441 - RNA, 59 nt, Human; identical to SEQ ID NO: 286291

SEQ ID NO: 301442 - RNA, 59 nt, Human; identical to SEQ ID NO: 286292

SEQ ID NO: 301443 - RNA, 59 nt, Human; identical to SEQ ID NO: 286293

SEQ ID NO: 301444 - RNA, 59 nt, Human; identical to SEQ ID NO: 286294

SEQ ID NO: 301445 - RNA, 59 nt, Human; identical to SEQ ID NO: 286295

SEQ ID NO: 301446 - RNA, 59 nt, Human; identical to SEQ ID NO: 286296

SEQ ID NO: 301447 - RNA, 59 nt, Human; identical to SEQ ID NO: 286297

SEQ ID NO: 301448 - RNA, 59 nt, Human; identical to SEQ ID NO: 286298

SEQ ID NO: 301449 - RNA, 59 nt, Human; identical to SEQ ID NO: 286299

SEQ ID NO: 301450 - RNA, 59 nt, Human; identical to SEQ ID NO: 286300

SEQ ID NO: 301451 - RNA, 59 nt, Human; identical to SEQ ID NO: 286301

SEQ ID NO: 301452 - RNA, 59 nt, Human; identical to SEQ ID NO: 286302

SEQ ID NO: 301453 - RNA, 59 nt, Human; identical to SEQ ID NO: 286303

SEQ ID NO: 301454 - RNA, 59 nt, Human; identical to SEQ ID NO: 286304

SEQ ID NO: 301455 - RNA, 59 nt, Human; identical to SEQ ID NO: 286305

SEQ ID NO: 301456 - RNA, 59 nt, Human; identical to SEQ ID NO: 286306

SEQ ID NO: 301457 - RNA, 59 nt, Human; identical to SEQ ID NO: 286307

SEQ ID NO: 301458 - RNA, 59 nt, Human; identical to SEQ ID NO: 286308

SEQ ID NO: 301459 - RNA, 59 nt, Human; identical to SEQ ID NO: 286309

SEQ ID NO: 301460 - RNA, 59 nt, Human; identical to SEQ ID NO: 286310

SEQ ID NO: 301461 - RNA, 59 nt, Human; identical to SEQ ID NO: 285342

SEQ ID NO: 301462 - RNA, 59 nt, Human; identical to SEQ ID NO: 285343

SEQ ID NO: 301463 - RNA, 59 nt, Human; identical to SEQ ID NO: 278027

SEQ ID NO: 301464 - RNA, 59 nt, Human; identical to SEQ ID NO: 285734

SEQ ID NO: 301465 - RNA, 59 nt, Human; identical to SEQ ID NO: 285735

SEQ ID NO: 301466 - RNA, 59 nt, Human; identical to SEQ ID NO: 286195

SEQ ID NO: 301467 - RNA, 59 nt, Human; identical to SEQ ID NO: 278041

SEQ ID NO: 301468 - RNA, 59 nt, Human; identical to SEQ ID NO: 285875

SEQ ID NO: 301469 - RNA, 59 nt, Human; identical to SEQ ID NO: 285270

SEQ ID NO: 301470 - RNA, 59 nt, Human; identical to SEQ ID NO: 285271

SEQ ID NO: 301471 - RNA, 59 nt, Human; identical to SEQ ID NO: 278042

SEQ ID NO: 301472 - RNA, 59 nt, Human; identical to SEQ ID NO: 285252

SEQ ID NO: 301473 - RNA, 59 nt, Human; identical to SEQ ID NO: 285253

SEQ ID NO: 301474 - RNA, 59 nt, Human; identical to SEQ ID NO: 285254

SEQ ID NO: 301475 - RNA, 59 nt, Human; identical to SEQ ID NO: 285272

SEQ ID NO: 301476 - RNA, 59 nt, Human; identical to SEQ ID NO: 278043

SEQ ID NO: 301477 - RNA, 59 nt, Human; identical to SEQ ID NO: 285288

SEQ ID NO: 301478 - RNA, 59 nt, Human; identical to SEQ ID NO: 285289

SEQ ID NO: 301479 - RNA, 59 nt, Human; identical to SEQ ID NO: 285290

SEQ ID NO: 301480 - RNA, 59 nt, Human; identical to SEQ ID NO: 285306

SEQ ID NO: 301481 - RNA, 59 nt, Human; identical to SEQ ID NO: 285307

SEQ ID NO: 301482 - RNA, 59 nt, Human; identical to SEQ ID NO: 278057

SEQ ID NO: 301483 - RNA, 59 nt, Human; identical to SEQ ID NO: 285324

SEQ ID NO: 301484 - RNA, 59 nt, Human; identical to SEQ ID NO: 285325

SEQ ID NO: 301485 - RNA, 59 nt, Human; identical to SEQ ID NO: 285326

SEQ ID NO: 301486 - RNA, 59 nt, Human; identical to SEQ ID NO: 285378

SEQ ID NO: 301487 - RNA, 59 nt, Human; identical to SEQ ID NO: 285379

SEQ ID NO: 301488 - RNA, 59 nt, Human; identical to SEQ ID NO: 278058

SEQ ID NO: 301489 - RNA, 59 nt, Human; identical to SEQ ID NO: 285344

SEQ ID NO: 301490 - RNA, 59 nt, Human; identical to SEQ ID NO: 285468

SEQ ID NO: 301491 - RNA, 59 nt, Human; identical to SEQ ID NO: 286311

SEQ ID NO: 301492 - RNA, 59 nt, Human; identical to SEQ ID NO: 286312

SEQ ID NO: 301493 - RNA, 59 nt, Human; identical to SEQ ID NO: 286313

SEQ ID NO: 301494 - RNA, 59 nt, Human; identical to SEQ ID NO: 286314

SEQ ID NO: 301495 - RNA, 59 nt, Human; identical to SEQ ID NO: 286315

SEQ ID NO: 301496 - RNA, 59 nt, Human; identical to SEQ ID NO: 286316

SEQ ID NO: 301497 - RNA, 59 nt, Human; identical to SEQ ID NO: 286317

SEQ ID NO: 301498 - RNA, 59 nt, Human; identical to SEQ ID NO: 286318

SEQ ID NO: 301499 - RNA, 59 nt, Human; identical to SEQ ID NO: 286319

SEQ ID NO: 301500 - RNA, 59 nt, Human; identical to SEQ ID NO: 286320

SEQ ID NO: 301501 - RNA, 59 nt, Human; identical to SEQ ID NO: 286321

SEQ ID NO: 301502 - RNA, 63 nt, Human; identical to SEQ ID NO: 286322

SEQ ID NO: 301503 - RNA, 63 nt, Human; identical to SEQ ID NO: 286323

SEQ ID NO: 301504 - RNA, 63 nt, Human; identical to SEQ ID NO: 286324

SEQ ID NO: 301505 - RNA, 63 nt, Human; identical to SEQ ID NO: 286325

SEQ ID NO: 301506 - RNA, 63 nt, Human; identical to SEQ ID NO: 286326

SEQ ID NO: 301507 - RNA, 63 nt, Human; identical to SEQ ID NO: 286327

SEQ ID NO: 301508 - RNA, 63 nt, Human; identical to SEQ ID NO: 286328

SEQ ID NO: 301509 - RNA, 63 nt, Human; identical to SEQ ID NO: 286331

SEQ ID NO: 301510 - RNA, 63 nt, Human; identical to SEQ ID NO: 286332

SEQ ID NO: 301511 - RNA, 63 nt, Human; identical to SEQ ID NO: 286333

SEQ ID NO: 301512 - RNA, 63 nt, Human; identical to SEQ ID NO: 286334

SEQ ID NO: 301513 - RNA, 63 nt, Human; identical to SEQ ID NO: 286335

SEQ ID NO: 301514 - RNA, 63 nt, Human; identical to SEQ ID NO: 286336

SEQ ID NO: 301515 - RNA, 63 nt, Human; identical to SEQ ID NO: 286337

SEQ ID NO: 301516 - RNA, 63 nt, Human; identical to SEQ ID NO: 286338

SEQ ID NO: 301517 - RNA, 63 nt, Human; identical to SEQ ID NO: 286339

SEQ ID NO: 301518 - RNA, 63 nt, Human; identical to SEQ ID NO: 286340

SEQ ID NO: 301519 - RNA, 63 nt, Human; identical to SEQ ID NO: 286341

SEQ ID NO: 301520 - RNA, 63 nt, Human; identical to SEQ ID NO: 286342

SEQ ID NO: 301521 - RNA, 63 nt, Human; identical to SEQ ID NO: 286343

SEQ ID NO: 301522 - RNA, 63 nt, Human; identical to SEQ ID NO: 286344

SEQ ID NO: 301523 - RNA, 63 nt, Human; identical to SEQ ID NO: 286345

SEQ ID NO: 301524 - RNA, 63 nt, Human; identical to SEQ ID NO: 286346

SEQ ID NO: 301525 - RNA, 63 nt, Human; identical to SEQ ID NO: 286347

SEQ ID NO: 301526 - RNA, 63 nt, Human; identical to SEQ ID NO: 286351

SEQ ID NO: 301527 - RNA, 63 nt, Human; identical to SEQ ID NO: 286352

SEQ ID NO: 301528 - RNA, 63 nt, Human; identical to SEQ ID NO: 286353

SEQ ID NO: 301529 - RNA, 63 nt, Human; identical to SEQ ID NO: 286354

SEQ ID NO: 301530 - RNA, 63 nt, Human; identical to SEQ ID NO: 286355

SEQ ID NO: 301531 - RNA, 63 nt, Human; identical to SEQ ID NO: 286356

SEQ ID NO: 301532 - RNA, 63 nt, Human; identical to SEQ ID NO: 286357

SEQ ID NO: 301533 - RNA, 63 nt, Human; identical to SEQ ID NO: 286358

SEQ ID NO: 301534 - RNA, 63 nt, Human; identical to SEQ ID NO: 286359

SEQ ID NO: 301535 - RNA, 63 nt, Human; identical to SEQ ID NO: 286360

SEQ ID NO: 301536 - RNA, 103 nt, Human
uacuucccauguuaccaaaauacuucccauguuaccaaaauacccccaacucuuuagccaaaagagaacccugaccuccugaggagaacccugaccuccugag

SEQ ID NO: 301537 - RNA, 103 nt, Human
accuacccgguauuuuaaauaccuacccgguauuuuaaauguucuguaaauuauuagccaaauagaacuguaaugggguuguaagaacuguaaugggguugua

SEQ ID NO: 301538 - RNA, 103 nt, Human
cauucucagauaggggcacccauucucagauaggggcacccaagcuaaggguauuagccaaagaugccaggauggguagcuagaugccaggauggguagcuag

SEQ ID NO: 301539 - RNA, 103 nt, Human
auggaccaggaugaagagggauggaccaggaugaagagggaucaaagagauaauuagccaaaaacccaguagccuagaagauaacccaguagccuagaagaua

SEQ ID NO: 301540 - RNA, 103 nt, Human
agauacaaaacuccacuggcagauacaaaacuccacuggccucuaaaauuauauuagccaagagugguuucauuugagugccugugguuucauuugagugccu

SEQ ID NO: 301541 - RNA, 103 nt, Human
guuuuucagauucuucauugguuuuucagauucuucauugggauauuaaaauauuagccaaauuucucucuguuuuauauauguucucucuguuuuauauaug

SEQ ID NO: 301542 - RNA, 103 nt, Human
aauuguaauuuuuaaaaaggaauuguaauuuuuaaaaaggcuacaauuaaauuuuagccaaugccacucaccaaaucuuugcaccacucaccaaaucuuugca

SEQ ID NO: 301543 - RNA, 103 nt, Human
caguucucuucccugcagugcaguucucuucccugcaguguuuucauuuuauuuuagccaaacauuuugccuguuuucuguuuauuuugccuguuuucuguuu

SEQ ID NO: 301544 - RNA, 103 nt, Human
guuguuaacccauccuuucaguuguuaacccauccuuucauuuacucauauaauuagccaaaaaaaaaaggauggcuacauacaaaaaaggauggcuacauac

SEQ ID NO: 301545 - RNA, 103 nt, Human
acucggcuguuaggccauucacucggcuguuaggccauucucuaaauucuaguuuagccaaaaguuuaugugugguuuggggcguuuaugugugguuuggggc

SEQ ID NO: 301546 - RNA, 103 nt, Human
agcuaaguuuuuguuucauuagcuaaguuuuuguuucauuuugauuuuuuuuuuuagccaaccaccuugucaggaaaggaugaaccuugucaggaaaggauga

SEQ ID NO: 301547 - RNA, 103 nt, Human
agggcuagggcuggaggggcagggcuagggcuggaggggccaggugaucuuccuuagccaaucccaguccgucugugucagccccaguccgucugugucagcc

SEQ ID NO: 301548 - RNA, 63 nt, Human; identical to SEQ ID NO: 286376

SEQ ID NO: 301549 - RNA, 63 nt, Human; identical to SEQ ID NO: 286377

SEQ ID NO: 301550 - RNA, 63 nt, Human; identical to SEQ ID NO: 286378

SEQ ID NO: 301551 - RNA, 63 nt, Human; identical to SEQ ID NO: 286379

SEQ ID NO: 301552 - RNA, 63 nt, Human; identical to SEQ ID NO: 286380

SEQ ID NO: 301553 - RNA, 63 nt, Human; identical to SEQ ID NO: 286381

SEQ ID NO: 301554 - RNA, 63 nt, Human; identical to SEQ ID NO: 286382

SEQ ID NO: 301555 - RNA, 63 nt, Human; identical to SEQ ID NO: 286383

SEQ ID NO: 301556 - RNA, 63 nt, Human; identical to SEQ ID NO: 286384

SEQ ID NO: 301557 - RNA, 63 nt, Human; identical to SEQ ID NO: 286385

SEQ ID NO: 301558 - RNA, 63 nt, Human; identical to SEQ ID NO: 286386

SEQ ID NO: 301559 - RNA, 63 nt, Human; identical to SEQ ID NO: 286387

SEQ ID NO: 301560 - RNA, 63 nt, Human; identical to SEQ ID NO: 286391

SEQ ID NO: 301561 - RNA, 103 nt, Human
cauauaguuuggacugaauccauauaguuuggacugaaucacaucuguaguacuuagccaaagacaauuuggaggagaauaucacaauuuggaggagaauauc

SEQ ID NO: 301562 - RNA, 103 nt, Human
agauacuuagcaaaugccauagauacuuagcaaaugccauucauauaguauuguuagccaaacuauuauuccuuccuuagaaguauuauuccuuccuuagaag

SEQ ID NO: 301563 - RNA, 103 nt, Human
auuucuuucauuugucuaguauuucuuucauuugucuagugaaucagaaaggcuuagccaaggccacaucugggaagaguggaccacaucugggaagagugga

SEQ ID NO: 301564 - RNA, 103 nt, Human
cugccaggaucaacugcccacugccaggaucaacugcccagagugccagaguuuuagccaaagguguacuuacuuccuuauuuguguacuuacuuccuuauuu

SEQ ID NO: 301565 - RNA, 103 nt, Human
uaacuggcuauucauucaucuaacuggcuauucauucauccuucaggaggaucuuagccaagaauauuugcaaugacacaugaauauuugcaaugacacauga

SEQ ID NO: 301566 - RNA, 103 nt, Human
aauagacacuuaaugcaaucaauagacacuuaaugcaaucuuuuuuccugauauuagccaaugggagaauuaacaaugucuagggagaauuaacaaugucuag

SEQ ID NO: 301567 - RNA, 103 nt, Human
gaaagcucuauguuuucguugaaagcucuauguuuucguuaauaaagggcaacuuagccaaguuuaaggucgcgugcgaugcauuaaggucgcgugcgaugca

SEQ ID NO: 301568 - RNA, 103 nt, Human
uccggcccccgucuuguaaauccggcccccgucuuguaaaaaggggaggagaauuagccaaacacuguaagcuuuuaagaaaaacuguaagcuuuuaagaaaa

SEQ ID NO: 301569 - RNA, 103 nt, Human
aaauuguucuuccuuggaguaaauuguucuuccuuggagugucuuggcuauucuuagccaacuguuccuccauauuacuucuaguuccuccauauuacuucua

SEQ ID NO: 301570 - RNA, 103 nt, Human
aauuaucaaagcugauacagaauuaucaaagcugauacagcacauauacagaauuagccaaaugguauaagacaauagaaaaagguauaagacaauagaaaaa

SEQ ID NO: 301571 - RNA, 103 nt, Human
ggagggaugauggcugguguggagggaugauggcugguguuauuggccaguuuuuagccaauccaacugaccuagugaagguucaacugaccuagugaagguu

SEQ ID NO: 301572 - RNA, 103 nt, Human
caagacugaacaccgacuaacaagacugaacaccgacuaagguuuucauacuauuagccaaugcuguagacagaagcauuuugcuguagacagaagcauuuug

SEQ ID NO: 301573 - RNA, 63 nt, Human; identical to SEQ ID NO: 286404

SEQ ID NO: 301574 - RNA, 63 nt, Human; identical to SEQ ID NO: 286405

SEQ ID NO: 301575 - RNA, 63 nt, Human; identical to SEQ ID NO: 286406

SEQ ID NO: 301576 - RNA, 63 nt, Human; identical to SEQ ID NO: 286407

SEQ ID NO: 301577 - RNA, 63 nt, Human; identical to SEQ ID NO: 286408

SEQ ID NO: 301578 - RNA, 63 nt, Human; identical to SEQ ID NO: 286411

SEQ ID NO: 301579 - RNA, 63 nt, Human; identical to SEQ ID NO: 286412

SEQ ID NO: 301580 - RNA, 63 nt, Human; identical to SEQ ID NO: 286413

SEQ ID NO: 301581 - RNA, 63 nt, Human; identical to SEQ ID NO: 286414

SEQ ID NO: 301582 - RNA, 63 nt, Human; identical to SEQ ID NO: 286415

SEQ ID NO: 301583 - RNA, 63 nt, Human; identical to SEQ ID NO: 286416

SEQ ID NO: 301584 - RNA, 63 nt, Human; identical to SEQ ID NO: 286417

SEQ ID NO: 301585 - RNA, 63 nt, Human; identical to SEQ ID NO: 286418

SEQ ID NO: 301586 - RNA, 103 nt, Human
cugaagugugacuaccuccacugaagugugacuaccuccacucaugucccauuuuagccaagcuuauuuaagaucacagugaauuauuuaagaucacagugaa

SEQ ID NO: 301587 - RNA, 103 nt, Human
caaaugacauauugaaagcacaaaugacauauugaaagcaaaggcuguuuuauuuagccaagaugauuaccauuaggaguuacugauuaccauuaggaguuac

SEQ ID NO: 301588 - RNA, 103 nt, Human
gcagccugcccuaucuccgcgcagccugcccuaucuccgcauuuccaguuguauuagccaauagauuuccuacuuauuuaagcgauuuccuacuuauuuaagc

SEQ ID NO: 301589 - RNA, 103 nt, Human
gccaacauggugaaacccuggccaacauggugaaacccugucucuacuaaaaauuagccaagugugguaauguucaccugcaggugguaauguucaccugcag

SEQ ID NO: 301590 - RNA, 103 nt, Human
uucaggagguugggggaaaauucaggagguugggggaaaagauguuuaugaguuuagccaacagaacagguaauuuacuccuggaacagguaauuuacuccug

SEQ ID NO: 301591 - RNA, 103 nt, Human
uaaaaucuaaauucagucuuuaaaaucuaaauucagucuuuaaugaaauaauauuagccaaaugguggaacuaauuuauuucugguggaacuaauuuauuucu

SEQ ID NO: 301592 - RNA, 103 nt, Human
cccuagauaccacagccugccccuagauaccacagccugcccccuccccuccuuuagccaagucaggaucuuaggccucagcacaggaucuuaggccucagca

SEQ ID NO: 301593 - RNA, 103 nt, Human
aggguuggagucucuaagauaggguuggagucucuaagauugagaggucugaguuagccaaugaagacaucugagauccuaucaagacaucugagauccuauc

SEQ ID NO: 301594 - RNA, 103 nt, Human
uuuuuugccgcagccaauaauuuuuugccgcagccaauaagauaauagcagaauuagccaauccuaaaaccuucuaaagacgacuaaaaccuucuaaagacga

SEQ ID NO: 301595 - RNA, 103 nt, Human
uuuacagaugacuaaaaauguuuacagaugacuaaaaauguuaauuuuaugacuuagccaaauauguucuagguugcauauauauguucuagguugcauauau

SEQ ID NO: 301596 - RNA, 103 nt, Human
gucucuccccuggcaaaacagucucuccccuggcaaaacaagagcuggguaguuuagccaaacggcacccccucgaguucacuggcacccccucgaguucacu

SEQ ID NO: 301597 - RNA, 103 nt, Human
guugccauagugcuguauuuguugccauagugcuguauuugaaaaucgaugcuuuagccaaaagcugaaugaccaccguuuccgcugaaugaccaccguuucc

SEQ ID NO: 301598 - RNA, 63 nt, Human; identical to SEQ ID NO: 286434

SEQ ID NO: 301599 - RNA, 63 nt, Human; identical to SEQ ID NO: 286435

SEQ ID NO: 301600 - RNA, 63 nt, Human; identical to SEQ ID NO: 286436

SEQ ID NO: 301601 - RNA, 63 nt, Human; identical to SEQ ID NO: 286437

SEQ ID NO: 301602 - RNA, 63 nt, Human; identical to SEQ ID NO: 286438

SEQ ID NO: 301603 - RNA, 63 nt, Human; identical to SEQ ID NO: 286439

SEQ ID NO: 301604 - RNA, 63 nt, Human; identical to SEQ ID NO: 286440

SEQ ID NO: 301605 - RNA, 63 nt, Human; identical to SEQ ID NO: 286441

SEQ ID NO: 301606 - RNA, 63 nt, Human; identical to SEQ ID NO: 286442

SEQ ID NO: 301607 - RNA, 63 nt, Human; identical to SEQ ID NO: 286443

SEQ ID NO: 301608 - RNA, 63 nt, Human; identical to SEQ ID NO: 286444

SEQ ID NO: 301609 - RNA, 63 nt, Human; identical to SEQ ID NO: 286445

SEQ ID NO: 301610 - RNA, 63 nt, Human; identical to SEQ ID NO: 286446

SEQ ID NO: 301611 - RNA, 103 nt, Human
ugugguuaauguaacaauauugugguuaauguaacaauauauguucuucauauuuagccaauauauuaauuuccuuuuucauuuauuaauuuccuuuuucauu

SEQ ID NO: 301612 - RNA, 103 nt, Human
uguggugaauguaacaauauuguggugaauguaacaauauauguucuucauauuuagccaauauauuaauuuccuuuuucauuuauuaauuuccuuuuucauu

SEQ ID NO: 301613 - RNA, 103 nt, Human
cagaacaaugaaacauacuccagaacaaugaaacauacucucccuacacuugcuuagccaagagauaccacucagguaacuuugauaccacucagguaacuuu

SEQ ID NO: 301614 - RNA, 103 nt, Human
ggaaguguaacagcugagguggaaguguaacagcugaggucucuugagggagcuuagccaaugugggagcagcgguuuggggaugggagcagcgguuugggga

SEQ ID NO: 301615 - RNA, 103 nt, Human
uauaccguucaguauaaaaguauaccguucaguauaaaaguguccuaagcauauuagccaaucuuuucacaguagagcauacuuuuucacaguagagcauacu

SEQ ID NO: 301616 - RNA, 103 nt, Human
cccaguagcaacuagaucuccccaguagcaacuagaucucuuuuaccucuucuuuagccaagaagcaagaucugucacccacaagcaagaucugucacccaca

SEQ ID NO: 301617 - RNA, 103 nt, Human
gugagaagaaaauuaauguagugagaagaaaauuaauguauuagcaaccaguguuagccaacucugcuguaauuaccuuuagacugcuguaauuaccuuuaga

SEQ ID NO: 301618 - RNA, 103 nt, Human
aaaauuacuuguuaaacucuaaaauuacuuguuaaacucuaguucuuaaguuguuagccaaguaaauaucauuguugaacugaaaauaucauuguugaacuga

SEQ ID NO: 301619 - RNA, 103 nt, Human
cccguucacauuuuuguauucccguucacauuuuuguauuuuguuuaaauuaguuagccaauauuuuucuuacugauuuuuaauuuuucuuacugauuuuuaa

SEQ ID NO: 301620 - RNA, 103 nt, Human
ucacggccugguguugugauucacggccugguguugugauacugggaagagcauuagccaagaacuugucucuuugaucuguuacuugucucuuugaucuguu

SEQ ID NO: 301621 - RNA, 103 nt, Human
uucucagguuauuaaucaaauucucagguuauuaaucaaaauuauuguauaaguuagccaauagaauuuuuagguuaaaacaagaauuuuuagguuaaaacaa

SEQ ID NO: 301622 - RNA, 103 nt, Human
cugcuguucucugcugugugcugcuguucucugcugugugggcccuuaaagucuuagccaagagccaagacauagcccugugagccaagacauagcccuguga

SEQ ID NO: 301623 - RNA, 63 nt, Human; identical to SEQ ID NO: 286462

SEQ ID NO: 301624 - RNA, 63 nt, Human; identical to SEQ ID NO: 286463

SEQ ID NO: 301625 - RNA, 63 nt, Human; identical to SEQ ID NO: 286464

SEQ ID NO: 301626 - RNA, 63 nt, Human; identical to SEQ ID NO: 286465

SEQ ID NO: 301627 - RNA, 63 nt, Human; identical to SEQ ID NO: 286466

SEQ ID NO: 301628 - RNA, 63 nt, Human; identical to SEQ ID NO: 286467

SEQ ID NO: 301629 - RNA, 63 nt, Human; identical to SEQ ID NO: 286471

SEQ ID NO: 301630 - RNA, 63 nt, Human; identical to SEQ ID NO: 286472

SEQ ID NO: 301631 - RNA, 63 nt, Human; identical to SEQ ID NO: 286473

SEQ ID NO: 301632 - RNA, 63 nt, Human; identical to SEQ ID NO: 286474

SEQ ID NO: 301633 - RNA, 63 nt, Human; identical to SEQ ID NO: 286475

SEQ ID NO: 301634 - RNA, 63 nt, Human; identical to SEQ ID NO: 286476

SEQ ID NO: 301635 - RNA, 63 nt, Human; identical to SEQ ID NO: 286477

SEQ ID NO: 301636 - RNA, 63 nt, Human; identical to SEQ ID NO: 286478

SEQ ID NO: 301637 - RNA, 63 nt, Human; identical to SEQ ID NO: 286479

SEQ ID NO: 301638 - RNA, 63 nt, Human; identical to SEQ ID NO: 286480

SEQ ID NO: 301639 - RNA, 63 nt, Human; identical to SEQ ID NO: 286481

SEQ ID NO: 301640 - RNA, 63 nt, Human; identical to SEQ ID NO: 286482

SEQ ID NO: 301641 - RNA, 63 nt, Human; identical to SEQ ID NO: 286483

SEQ ID NO: 301642 - RNA, 63 nt, Human; identical to SEQ ID NO: 286484

SEQ ID NO: 301643 - RNA, 63 nt, Human; identical to SEQ ID NO: 286485

SEQ ID NO: 301644 - RNA, 63 nt, Human; identical to SEQ ID NO: 286486

SEQ ID NO: 301645 - RNA, 63 nt, Human; identical to SEQ ID NO: 286487

SEQ ID NO: 301646 - RNA, 63 nt, Human; identical to SEQ ID NO: 286488

SEQ ID NO: 301647 - RNA, 63 nt, Human; identical to SEQ ID NO: 286489

SEQ ID NO: 301648 - RNA, 63 nt, Human; identical to SEQ ID NO: 286491

SEQ ID NO: 301649 - RNA, 63 nt, Human; identical to SEQ ID NO: 286492

SEQ ID NO: 301650 - RNA, 63 nt, Human; identical to SEQ ID NO: 286493

SEQ ID NO: 301651 - RNA, 63 nt, Human; identical to SEQ ID NO: 286494

SEQ ID NO: 301652 - RNA, 63 nt, Human; identical to SEQ ID NO: 286495

SEQ ID NO: 301653 - RNA, 63 nt, Human; identical to SEQ ID NO: 286496

SEQ ID NO: 301654 - RNA, 63 nt, Human; identical to SEQ ID NO: 286497

SEQ ID NO: 301655 - RNA, 63 nt, Human; identical to SEQ ID NO: 286498

SEQ ID NO: 301656 - RNA, 63 nt, Human; identical to SEQ ID NO: 286499

SEQ ID NO: 301657 - RNA, 63 nt, Human; identical to SEQ ID NO: 286500

SEQ ID NO: 301658 - RNA, 63 nt, Human; identical to SEQ ID NO: 286501

SEQ ID NO: 301659 - RNA, 63 nt, Human; identical to SEQ ID NO: 286502

SEQ ID NO: 301660 - RNA, 63 nt, Human; identical to SEQ ID NO: 286503

SEQ ID NO: 301661 - RNA, 63 nt, Human; identical to SEQ ID NO: 286504

SEQ ID NO: 301662 - RNA, 63 nt, Human; identical to SEQ ID NO: 286505

SEQ ID NO: 301663 - RNA, 63 nt, Human; identical to SEQ ID NO: 286506

SEQ ID NO: 301664 - RNA, 63 nt, Human; identical to SEQ ID NO: 286507

SEQ ID NO: 301665 - RNA, 63 nt, Human; identical to SEQ ID NO: 286511

SEQ ID NO: 301666 - RNA, 63 nt, Human; identical to SEQ ID NO: 286512

SEQ ID NO: 301667 - RNA, 63 nt, Human; identical to SEQ ID NO: 286513

SEQ ID NO: 301668 - RNA, 63 nt, Human; identical to SEQ ID NO: 286514

SEQ ID NO: 301669 - RNA, 63 nt, Human; identical to SEQ ID NO: 286515

SEQ ID NO: 301670 - RNA, 63 nt, Human; identical to SEQ ID NO: 286516

SEQ ID NO: 301671 - RNA, 63 nt, Human; identical to SEQ ID NO: 286517

SEQ ID NO: 301672 - RNA, 63 nt, Human; identical to SEQ ID NO: 286518

SEQ ID NO: 301673 - RNA, 63 nt, Human; identical to SEQ ID NO: 286519

SEQ ID NO: 301674 - RNA, 63 nt, Human; identical to SEQ ID NO: 286520

SEQ ID NO: 301675 - RNA, 63 nt, Human; identical to SEQ ID NO: 286521

SEQ ID NO: 301676 - RNA, 63 nt, Human; identical to SEQ ID NO: 286522

SEQ ID NO: 301677 - RNA, 63 nt, Human; identical to SEQ ID NO: 286523

SEQ ID NO: 301678 - RNA, 63 nt, Human; identical to SEQ ID NO: 286524

SEQ ID NO: 301679 - RNA, 63 nt, Human; identical to SEQ ID NO: 286525

SEQ ID NO: 301680 - RNA, 63 nt, Human; identical to SEQ ID NO: 286526

SEQ ID NO: 301681 - RNA, 63 nt, Human; identical to SEQ ID NO: 286527

SEQ ID NO: 301682 - RNA, 63 nt, Human; identical to SEQ ID NO: 286528

SEQ ID NO: 301683 - RNA, 63 nt, Human; identical to SEQ ID NO: 286531

SEQ ID NO: 301684 - RNA, 63 nt, Human; identical to SEQ ID NO: 286532

SEQ ID NO: 301685 - RNA, 63 nt, Human; identical to SEQ ID NO: 286533

SEQ ID NO: 301686 - RNA, 63 nt, Human; identical to SEQ ID NO: 286534

SEQ ID NO: 301687 - RNA, 63 nt, Human; identical to SEQ ID NO: 286535

SEQ ID NO: 301688 - RNA, 63 nt, Human; identical to SEQ ID NO: 286536

SEQ ID NO: 301689 - RNA, 63 nt, Human; identical to SEQ ID NO: 286537

SEQ ID NO: 301690 - RNA, 63 nt, Human; identical to SEQ ID NO: 286538

SEQ ID NO: 301691 - RNA, 63 nt, Human; identical to SEQ ID NO: 286539

SEQ ID NO: 301692 - RNA, 63 nt, Human; identical to SEQ ID NO: 286540

SEQ ID NO: 301693 - RNA, 63 nt, Human; identical to SEQ ID NO: 286541

SEQ ID NO: 301694 - RNA, 63 nt, Human; identical to SEQ ID NO: 286542

SEQ ID NO: 301695 - RNA, 63 nt, Human; identical to SEQ ID NO: 286543

SEQ ID NO: 301696 - RNA, 63 nt, Human; identical to SEQ ID NO: 286544

SEQ ID NO: 301697 - RNA, 63 nt, Human; identical to SEQ ID NO: 286545

SEQ ID NO: 301698 - RNA, 63 nt, Human; identical to SEQ ID NO: 286546

SEQ ID NO: 301699 - RNA, 63 nt, Human; identical to SEQ ID NO: 286547

SEQ ID NO: 301700 - RNA, 63 nt, Human; identical to SEQ ID NO: 286551

SEQ ID NO: 301701 - RNA, 63 nt, Human; identical to SEQ ID NO: 286552

SEQ ID NO: 301702 - RNA, 63 nt, Human; identical to SEQ ID NO: 286553

SEQ ID NO: 301703 - RNA, 63 nt, Human; identical to SEQ ID NO: 286554

SEQ ID NO: 301704 - RNA, 63 nt, Human; identical to SEQ ID NO: 286555

SEQ ID NO: 301705 - RNA, 63 nt, Human; identical to SEQ ID NO: 286556

SEQ ID NO: 301706 - RNA, 63 nt, Human; identical to SEQ ID NO: 286557

SEQ ID NO: 301707 - RNA, 63 nt, Human; identical to SEQ ID NO: 286558

SEQ ID NO: 301708 - RNA, 63 nt, Human; identical to SEQ ID NO: 286559

SEQ ID NO: 301709 - RNA, 63 nt, Human; identical to SEQ ID NO: 286560

SEQ ID NO: 301710 - RNA, 63 nt, Human; identical to SEQ ID NO: 286561

SEQ ID NO: 301711 - RNA, 63 nt, Human; identical to SEQ ID NO: 286562

SEQ ID NO: 301712 - RNA, 63 nt, Human; identical to SEQ ID NO: 286563

SEQ ID NO: 301713 - RNA, 63 nt, Human; identical to SEQ ID NO: 286564

SEQ ID NO: 301714 - RNA, 63 nt, Human; identical to SEQ ID NO: 286565

SEQ ID NO: 301715 - RNA, 63 nt, Human; identical to SEQ ID NO: 286566

SEQ ID NO: 301716 - RNA, 63 nt, Human; identical to SEQ ID NO: 286567

SEQ ID NO: 301717 - RNA, 63 nt, Human; identical to SEQ ID NO: 286568

SEQ ID NO: 301718 - RNA, 63 nt, Human; identical to SEQ ID NO: 286571

SEQ ID NO: 301719 - RNA, 63 nt, Human; identical to SEQ ID NO: 286572

SEQ ID NO: 301720 - RNA, 63 nt, Human; identical to SEQ ID NO: 286573

SEQ ID NO: 301721 - RNA, 63 nt, Human; identical to SEQ ID NO: 286574

SEQ ID NO: 301722 - RNA, 63 nt, Human; identical to SEQ ID NO: 286575

SEQ ID NO: 301723 - RNA, 63 nt, Human; identical to SEQ ID NO: 286576

SEQ ID NO: 301724 - RNA, 63 nt, Human; identical to SEQ ID NO: 286577

SEQ ID NO: 301725 - RNA, 63 nt, Human; identical to SEQ ID NO: 286578

SEQ ID NO: 301726 - RNA, 63 nt, Human; identical to SEQ ID NO: 286579

SEQ ID NO: 301727 - RNA, 63 nt, Human; identical to SEQ ID NO: 286580

SEQ ID NO: 301728 - RNA, 63 nt, Human; identical to SEQ ID NO: 286581

SEQ ID NO: 301729 - RNA, 63 nt, Human; identical to SEQ ID NO: 286582

SEQ ID NO: 301730 - RNA, 62 nt, Human; identical to SEQ ID NO: 286583

SEQ ID NO: 301731 - RNA, 62 nt, Human; identical to SEQ ID NO: 286584

SEQ ID NO: 301732 - RNA, 62 nt, Human; identical to SEQ ID NO: 286585

SEQ ID NO: 301733 - RNA, 62 nt, Human; identical to SEQ ID NO: 286586

SEQ ID NO: 301734 - RNA, 62 nt, Human; identical to SEQ ID NO: 286587

SEQ ID NO: 301735 - RNA, 62 nt, Human; identical to SEQ ID NO: 286588

SEQ ID NO: 301736 - RNA, 62 nt, Human; identical to SEQ ID NO: 286590

SEQ ID NO: 301737 - RNA, 62 nt, Human; identical to SEQ ID NO: 286591

SEQ ID NO: 301738 - RNA, 62 nt, Human; identical to SEQ ID NO: 286592

SEQ ID NO: 301739 - RNA, 62 nt, Human; identical to SEQ ID NO: 286593

SEQ ID NO: 301740 - RNA, 62 nt, Human; identical to SEQ ID NO: 286594

SEQ ID NO: 301741 - RNA, 62 nt, Human; identical to SEQ ID NO: 286595

SEQ ID NO: 301742 - RNA, 62 nt, Human; identical to SEQ ID NO: 286596

SEQ ID NO: 301743 - RNA, 62 nt, Human; identical to SEQ ID NO: 286597

SEQ ID NO: 301744 - RNA, 54 nt, Human; identical to SEQ ID NO: 286598

SEQ ID NO: 301745 - RNA, 54 nt, Human; identical to SEQ ID NO: 286599

SEQ ID NO: 301746 - RNA, 62 nt, Human; identical to SEQ ID NO: 286600

SEQ ID NO: 301747 - RNA, 62 nt, Human; identical to SEQ ID NO: 286601

SEQ ID NO: 301748 - RNA, 62 nt, Human; identical to SEQ ID NO: 286602

SEQ ID NO: 301749 - RNA, 62 nt, Human; identical to SEQ ID NO: 286603

SEQ ID NO: 301750 - RNA, 62 nt, Human; identical to SEQ ID NO: 286604

SEQ ID NO: 301751 - RNA, 62 nt, Human; identical to SEQ ID NO: 286605

SEQ ID NO: 301752 - RNA, 62 nt, Human; identical to SEQ ID NO: 286606

SEQ ID NO: 301753 - RNA, 62 nt, Human; identical to SEQ ID NO: 286607

SEQ ID NO: 301754 - RNA, 62 nt, Human; identical to SEQ ID NO: 286608

SEQ ID NO: 301755 - RNA, 62 nt, Human; identical to SEQ ID NO: 286609

SEQ ID NO: 301756 - RNA, 62 nt, Human; identical to SEQ ID NO: 285469

SEQ ID NO: 301757 - RNA, 62 nt, Human; identical to SEQ ID NO: 278059

SEQ ID NO: 301758 - RNA, 62 nt, Human; identical to SEQ ID NO: 286448

SEQ ID NO: 301759 - RNA, 62 nt, Human; identical to SEQ ID NO: 286449

SEQ ID NO: 301760 - RNA, 62 nt, Human; identical to SEQ ID NO: 286450

SEQ ID NO: 301761 - RNA, 62 nt, Human; identical to SEQ ID NO: 286610

SEQ ID NO: 301762 - RNA, 62 nt, Human; identical to SEQ ID NO: 286611

SEQ ID NO: 301763 - RNA, 62 nt, Human; identical to SEQ ID NO: 286612

SEQ ID NO: 301764 - RNA, 62 nt, Human; identical to SEQ ID NO: 286613

SEQ ID NO: 301765 - RNA, 62 nt, Human; identical to SEQ ID NO: 286614

SEQ ID NO: 301766 - RNA, 62 nt, Human; identical to SEQ ID NO: 286615

SEQ ID NO: 301767 - RNA, 62 nt, Human; identical to SEQ ID NO: 286616

SEQ ID NO: 301768 - RNA, 62 nt, Human; identical to SEQ ID NO: 286617

SEQ ID NO: 301769 - RNA, 62 nt, Human; identical to SEQ ID NO: 286618

SEQ ID NO: 301770 - RNA, 62 nt, Human; identical to SEQ ID NO: 286619

SEQ ID NO: 301771 - RNA, 62 nt, Human; identical to SEQ ID NO: 286620

SEQ ID NO: 301772 - RNA, 62 nt, Human; identical to SEQ ID NO: 286621

SEQ ID NO: 301773 - RNA, 62 nt, Human; identical to SEQ ID NO: 286622

SEQ ID NO: 301774 - RNA, 62 nt, Human; identical to SEQ ID NO: 286623

SEQ ID NO: 301775 - RNA, 62 nt, Human; identical to SEQ ID NO: 286624

SEQ ID NO: 301776 - RNA, 62 nt, Human; identical to SEQ ID NO: 286625

SEQ ID NO: 301777 - RNA, 62 nt, Human; identical to SEQ ID NO: 286626

SEQ ID NO: 301778 - RNA, 62 nt, Human; identical to SEQ ID NO: 286627

SEQ ID NO: 301779 - RNA, 62 nt, Human; identical to SEQ ID NO: 286628

SEQ ID NO: 301780 - RNA, 62 nt, Human; identical to SEQ ID NO: 286629

SEQ ID NO: 301781 - RNA, 62 nt, Human; identical to SEQ ID NO: 286368

SEQ ID NO: 301782 - RNA, 62 nt, Human; identical to SEQ ID NO: 286369

SEQ ID NO: 301783 - RNA, 62 nt, Human; identical to SEQ ID NO: 278073

SEQ ID NO: 301784 - RNA, 62 nt, Human; identical to SEQ ID NO: 286490

SEQ ID NO: 301785 - RNA, 62 nt, Human; identical to SEQ ID NO: 286630

SEQ ID NO: 301786 - RNA, 62 nt, Human; identical to SEQ ID NO: 286631

SEQ ID NO: 301787 - RNA, 62 nt, Human; identical to SEQ ID NO: 286632

SEQ ID NO: 301788 - RNA, 62 nt, Human; identical to SEQ ID NO: 286633

SEQ ID NO: 301789 - RNA, 62 nt, Human; identical to SEQ ID NO: 286634

SEQ ID NO: 301790 - RNA, 62 nt, Human; identical to SEQ ID NO: 286635

SEQ ID NO: 301791 - RNA, 62 nt, Human; identical to SEQ ID NO: 286636

SEQ ID NO: 301792 - RNA, 62 nt, Human; identical to SEQ ID NO: 286637

SEQ ID NO: 301793 - RNA, 62 nt, Human; identical to SEQ ID NO: 286638

SEQ ID NO: 301794 - RNA, 62 nt, Human; identical to SEQ ID NO: 286639

SEQ ID NO: 301795 - RNA, 62 nt, Human; identical to SEQ ID NO: 286640

SEQ ID NO: 301796 - RNA, 62 nt, Human; identical to SEQ ID NO: 286641

SEQ ID NO: 301797 - RNA, 62 nt, Human; identical to SEQ ID NO: 286642

SEQ ID NO: 301798 - RNA, 62 nt, Human; identical to SEQ ID NO: 286643

SEQ ID NO: 301799 - RNA, 62 nt, Human; identical to SEQ ID NO: 286644

SEQ ID NO: 301800 - RNA, 62 nt, Human; identical to SEQ ID NO: 286645

SEQ ID NO: 301801 - RNA, 62 nt, Human; identical to SEQ ID NO: 286646

SEQ ID NO: 301802 - RNA, 62 nt, Human; identical to SEQ ID NO: 286647

SEQ ID NO: 301803 - RNA, 62 nt, Human; identical to SEQ ID NO: 286650

SEQ ID NO: 301804 - RNA, 62 nt, Human; identical to SEQ ID NO: 286651

SEQ ID NO: 301805 - RNA, 62 nt, Human; identical to SEQ ID NO: 286652

SEQ ID NO: 301806 - RNA, 62 nt, Human; identical to SEQ ID NO: 286653

SEQ ID NO: 301807 - RNA, 62 nt, Human; identical to SEQ ID NO: 286654

SEQ ID NO: 301808 - RNA, 62 nt, Human; identical to SEQ ID NO: 286655

SEQ ID NO: 301809 - RNA, 62 nt, Human; identical to SEQ ID NO: 286656

SEQ ID NO: 301810 - RNA, 62 nt, Human; identical to SEQ ID NO: 286657

SEQ ID NO: 301811 - RNA, 62 nt, Human; identical to SEQ ID NO: 286658

SEQ ID NO: 301812 - RNA, 62 nt, Human; identical to SEQ ID NO: 286659

SEQ ID NO: 301813 - RNA, 62 nt, Human; identical to SEQ ID NO: 286660

SEQ ID NO: 301814 - RNA, 62 nt, Human; identical to SEQ ID NO: 286661

SEQ ID NO: 301815 - RNA, 62 nt, Human; identical to SEQ ID NO: 286662

SEQ ID NO: 301816 - RNA, 62 nt, Human; identical to SEQ ID NO: 286663

SEQ ID NO: 301817 - RNA, 62 nt, Human; identical to SEQ ID NO: 286664

SEQ ID NO: 301818 - RNA, 62 nt, Human; identical to SEQ ID NO: 286665

SEQ ID NO: 301819 - RNA, 62 nt, Human; identical to SEQ ID NO: 286666

SEQ ID NO: 301820 - RNA, 62 nt, Human; identical to SEQ ID NO: 286667

SEQ ID NO: 301821 - RNA, 62 nt, Human; identical to SEQ ID NO: 286668

SEQ ID NO: 301822 - RNA, 62 nt, Human; identical to SEQ ID NO: 286669

SEQ ID NO: 301823 - RNA, 62 nt, Human; identical to SEQ ID NO: 286589

SEQ ID NO: 301824 - RNA, 62 nt, Human; identical to SEQ ID NO: 278074

SEQ ID NO: 301825 - RNA, 62 nt, Human; identical to SEQ ID NO: 286670

SEQ ID NO: 301826 - RNA, 62 nt, Human; identical to SEQ ID NO: 286671

SEQ ID NO: 301827 - RNA, 62 nt, Human; identical to SEQ ID NO: 286672

SEQ ID NO: 301828 - RNA, 62 nt, Human; identical to SEQ ID NO: 286673

SEQ ID NO: 301829 - RNA, 62 nt, Human; identical to SEQ ID NO: 286674

SEQ ID NO: 301830 - RNA, 62 nt, Human; identical to SEQ ID NO: 286675

SEQ ID NO: 301831 - RNA, 59 nt, Human; identical to SEQ ID NO: 286676

SEQ ID NO: 301832 - RNA, 62 nt, Human; identical to SEQ ID NO: 286677

SEQ ID NO: 301833 - RNA, 62 nt, Human; identical to SEQ ID NO: 286678

SEQ ID NO: 301834 - RNA, 62 nt, Human; identical to SEQ ID NO: 286679

SEQ ID NO: 301835 - RNA, 102 nt, Human
ugcugugaauauuggaaaugugcugugaauauuggaaaugcuuaggaucuucagacccaauagcucuaauuuuaacauuucugcucuaauuuuaacauuucu

SEQ ID NO: 301836 - RNA, 102 nt, Human
cccuccgcaggcccagggcucccuccgcaggcccagggcugggcacucccugagacccaaagacccaccucaacgacgagugacccaccucaacgacgagug

SEQ ID NO: 301837 - RNA, 102 nt, Human
aaguagaagaaagacagaaaaaguagaagaaagacagaaaaaauaacugauuagacccaagauuucaugggaagaaguuaaauuucaugggaagaaguuaaa

SEQ ID NO: 301838 - RNA, 102 nt, Human
cugagggcaguacccuccaucugagggcaguacccuccauugggcacaguccagacccaagucaaagaugccccauuccuugcaaagaugccccauuccuug

SEQ ID NO: 301839 - RNA, 102 nt, Human
agaggggaccugcugggaauagaggggaccugcugggaauggggugggugguagacccaacucaucaggcagcggguagggccaucaggcagcggguagggc

SEQ ID NO: 301840 - RNA, 102 nt, Human
uuaugaaaaugcugcguuguuuaugaaaaugcugcguuguguugaaugaaaaagacccaaauuacugcuuaugaagaaauaauacugcuuaugaagaaauaa

SEQ ID NO: 301841 - RNA, 102 nt, Human
aacuaagauccgagcagaacaacuaagauccgagcagaacugaaggagauagagacccaaaaaacccuucaaaaaaucaaugaacccuucaaaaaaucaaug

SEQ ID NO: 301842 - RNA, 102 nt, Human
aaacccacaauugaacuuccaaacccacaauugaacuuccaggaaagugugaagacccaaaacagcuuugucuccaaagaagcagcuuugucuccaaagaag

SEQ ID NO: 301843 - RNA, 102 nt, Human
cucuuguuuugacuuuguuucucuuguuuugacuuuguuuuaaugcuuccuaagacccaagugccuccugcuguuuccuccugccuccugcuguuuccuccu

SEQ ID NO: 301844 - RNA, 102 nt, Human
uggauuguuuaagaacuauuuggauuguuuaagaacuauuuuaaaguguuccagacccaaaaaggaaaaauaaaaaaaaaggaggaaaaauaaaaaaaaagg

SEQ ID NO: 301845 - RNA, 102 nt, Human
gagguggccauaaaggggcagagguggccauaaaggggcagagucuucuuucagacccaacucuuagagggcacaucaccagcuuagagggcacaucaccag

SEQ ID NO: 301846 - RNA, 102 nt, Human
ccagcaacaaaaccuaaucaccagcaacaaaaccuaaucaguaaggccagcuagacccaauggcucaugccuguaaucccaagcucaugccuguaaucccaa

SEQ ID NO: 301847 - RNA, 62 nt, Human; identical to SEQ ID NO: 286691

SEQ ID NO: 301848 - RNA, 62 nt, Human; identical to SEQ ID NO: 286692

SEQ ID NO: 301849 - RNA, 62 nt, Human; identical to SEQ ID NO: 286693

SEQ ID NO: 301850 - RNA, 62 nt, Human; identical to SEQ ID NO: 286694

SEQ ID NO: 301851 - RNA, 62 nt, Human; identical to SEQ ID NO: 286695

SEQ ID NO: 301852 - RNA, 62 nt, Human; identical to SEQ ID NO: 286696

SEQ ID NO: 301853 - RNA, 62 nt, Human; identical to SEQ ID NO: 286697

SEQ ID NO: 301854 - RNA, 62 nt, Human; identical to SEQ ID NO: 286698

SEQ ID NO: 301855 - RNA, 62 nt, Human; identical to SEQ ID NO: 286699

SEQ ID NO: 301856 - RNA, 62 nt, Human; identical to SEQ ID NO: 286700

SEQ ID NO: 301857 - RNA, 62 nt, Human; identical to SEQ ID NO: 286701

SEQ ID NO: 301858 - RNA, 62 nt, Human; identical to SEQ ID NO: 286702

SEQ ID NO: 301859 - RNA, 62 nt, Human; identical to SEQ ID NO: 286703

SEQ ID NO: 301860 - RNA, 62 nt, Human; identical to SEQ ID NO: 286704

SEQ ID NO: 301861 - RNA, 62 nt, Human; identical to SEQ ID NO: 286705

SEQ ID NO: 301862 - RNA, 62 nt, Human; identical to SEQ ID NO: 286706

SEQ ID NO: 301863 - RNA, 62 nt, Human; identical to SEQ ID NO: 286707

SEQ ID NO: 301864 - RNA, 62 nt, Human; identical to SEQ ID NO: 286708

SEQ ID NO: 301865 - RNA, 62 nt, Human; identical to SEQ ID NO: 286710

SEQ ID NO: 301866 - RNA, 62 nt, Human; identical to SEQ ID NO: 286711

SEQ ID NO: 301867 - RNA, 50 nt, Human; identical to SEQ ID NO: 286712

SEQ ID NO: 301868 - RNA, 62 nt, Human; identical to SEQ ID NO: 286713

SEQ ID NO: 301869 - RNA, 62 nt, Human; identical to SEQ ID NO: 286714

SEQ ID NO: 301870 - RNA, 62 nt, Human; identical to SEQ ID NO: 286715

SEQ ID NO: 301871 - RNA, 62 nt, Human; identical to SEQ ID NO: 286716

SEQ ID NO: 301872 - RNA, 62 nt, Human; identical to SEQ ID NO: 286717

SEQ ID NO: 301873 - RNA, 62 nt, Human; identical to SEQ ID NO: 286718

SEQ ID NO: 301874 - RNA, 62 nt, Human; identical to SEQ ID NO: 286719

SEQ ID NO: 301875 - RNA, 62 nt, Human; identical to SEQ ID NO: 286720

SEQ ID NO: 301876 - RNA, 62 nt, Human; identical to SEQ ID NO: 286721

SEQ ID NO: 301877 - RNA, 62 nt, Human; identical to SEQ ID NO: 286722

SEQ ID NO: 301878 - RNA, 62 nt, Human; identical to SEQ ID NO: 286723

SEQ ID NO: 301879 - RNA, 62 nt, Human; identical to SEQ ID NO: 286724

SEQ ID NO: 301880 - RNA, 62 nt, Human; identical to SEQ ID NO: 286725

SEQ ID NO: 301881 - RNA, 62 nt, Human; identical to SEQ ID NO: 286726

SEQ ID NO: 301882 - RNA, 62 nt, Human; identical to SEQ ID NO: 286727

SEQ ID NO: 301883 - RNA, 62 nt, Human; identical to SEQ ID NO: 286728

SEQ ID NO: 301884 - RNA, 62 nt, Human; identical to SEQ ID NO: 286729

SEQ ID NO: 301885 - RNA, 62 nt, Human; identical to SEQ ID NO: 286530

SEQ ID NO: 301886 - RNA, 62 nt, Human; identical to SEQ ID NO: 278075

SEQ ID NO: 301887 - RNA, 62 nt, Human; identical to SEQ ID NO: 286508

SEQ ID NO: 301888 - RNA, 62 nt, Human; identical to SEQ ID NO: 286509

SEQ ID NO: 301889 - RNA, 62 nt, Human; identical to SEQ ID NO: 286510

SEQ ID NO: 301890 - RNA, 62 nt, Human; identical to SEQ ID NO: 286548

SEQ ID NO: 301891 - RNA, 62 nt, Human; identical to SEQ ID NO: 286549

SEQ ID NO: 301892 - RNA, 62 nt, Human; identical to SEQ ID NO: 278089

SEQ ID NO: 301893 - RNA, 62 nt, Human; identical to SEQ ID NO: 286569

SEQ ID NO: 301894 - RNA, 62 nt, Human; identical to SEQ ID NO: 286730

SEQ ID NO: 301895 - RNA, 62 nt, Human; identical to SEQ ID NO: 286731

SEQ ID NO: 301896 - RNA, 62 nt, Human; identical to SEQ ID NO: 286732

SEQ ID NO: 301897 - RNA, 62 nt, Human; identical to SEQ ID NO: 286733

SEQ ID NO: 301898 - RNA, 62 nt, Human; identical to SEQ ID NO: 286734

SEQ ID NO: 301899 - RNA, 62 nt, Human; identical to SEQ ID NO: 286735

SEQ ID NO: 301900 - RNA, 62 nt, Human; identical to SEQ ID NO: 286736

SEQ ID NO: 301901 - RNA, 62 nt, Human; identical to SEQ ID NO: 286737

SEQ ID NO: 301902 - RNA, 62 nt, Human; identical to SEQ ID NO: 286738

SEQ ID NO: 301903 - RNA, 62 nt, Human; identical to SEQ ID NO: 286739

SEQ ID NO: 301904 - RNA, 62 nt, Human; identical to SEQ ID NO: 286740

SEQ ID NO: 301905 - RNA, 62 nt, Human; identical to SEQ ID NO: 286741

SEQ ID NO: 301906 - RNA, 62 nt, Human; identical to SEQ ID NO: 286742

SEQ ID NO: 301907 - RNA, 62 nt, Human; identical to SEQ ID NO: 286743

SEQ ID NO: 301908 - RNA, 62 nt, Human; identical to SEQ ID NO: 286744

SEQ ID NO: 301909 - RNA, 62 nt, Human; identical to SEQ ID NO: 286745

SEQ ID NO: 301910 - RNA, 62 nt, Human; identical to SEQ ID NO: 286746

SEQ ID NO: 301911 - RNA, 62 nt, Human; identical to SEQ ID NO: 286747

SEQ ID NO: 301912 - RNA, 55 nt, Human; identical to SEQ ID NO: 286748

SEQ ID NO: 301913 - RNA, 62 nt, Human; identical to SEQ ID NO: 286749

SEQ ID NO: 301914 - RNA, 62 nt, Human; identical to SEQ ID NO: 286409

SEQ ID NO: 301915 - RNA, 62 nt, Human; identical to SEQ ID NO: 286410

SEQ ID NO: 301916 - RNA, 62 nt, Human; identical to SEQ ID NO: 278090

SEQ ID NO: 301917 - RNA, 62 nt, Human; identical to SEQ ID NO: 286648

SEQ ID NO: 301918 - RNA, 62 nt, Human; identical to SEQ ID NO: 286649

SEQ ID NO: 301919 - RNA, 62 nt, Human; identical to SEQ ID NO: 286750

SEQ ID NO: 301920 - RNA, 62 nt, Human; identical to SEQ ID NO: 286751

SEQ ID NO: 301921 - RNA, 62 nt, Human; identical to SEQ ID NO: 286752

SEQ ID NO: 301922 - RNA, 62 nt, Human; identical to SEQ ID NO: 286753

SEQ ID NO: 301923 - RNA, 62 nt, Human; identical to SEQ ID NO: 286754

SEQ ID NO: 301924 - RNA, 62 nt, Human; identical to SEQ ID NO: 286755

SEQ ID NO: 301925 - RNA, 62 nt, Human; identical to SEQ ID NO: 286756

SEQ ID NO: 301926 - RNA, 58 nt, Human; identical to SEQ ID NO: 286757

SEQ ID NO: 301927 - RNA, 62 nt, Human; identical to SEQ ID NO: 286758

SEQ ID NO: 301928 - RNA, 62 nt, Human; identical to SEQ ID NO: 286759

SEQ ID NO: 301929 - RNA, 62 nt, Human; identical to SEQ ID NO: 286760

SEQ ID NO: 301930 - RNA, 62 nt, Human; identical to SEQ ID NO: 286761

SEQ ID NO: 301931 - RNA, 62 nt, Human; identical to SEQ ID NO: 286762

SEQ ID NO: 301932 - RNA, 62 nt, Human; identical to SEQ ID NO: 286763

SEQ ID NO: 301933 - RNA, 62 nt, Human; identical to SEQ ID NO: 286764

SEQ ID NO: 301934 - RNA, 62 nt, Human; identical to SEQ ID NO: 286765

SEQ ID NO: 301935 - RNA, 62 nt, Human; identical to SEQ ID NO: 286766

SEQ ID NO: 301936 - RNA, 62 nt, Human; identical to SEQ ID NO: 286767

SEQ ID NO: 301937 - RNA, 62 nt, Human; identical to SEQ ID NO: 286768

SEQ ID NO: 301938 - RNA, 62 nt, Human; identical to SEQ ID NO: 286769

SEQ ID NO: 301939 - RNA, 62 nt, Human; identical to SEQ ID NO: 286709

SEQ ID NO: 301940 - RNA, 62 nt, Human; identical to SEQ ID NO: 286770

SEQ ID NO: 301941 - RNA, 62 nt, Human; identical to SEQ ID NO: 286771

SEQ ID NO: 301942 - RNA, 62 nt, Human; identical to SEQ ID NO: 286772

SEQ ID NO: 301943 - RNA, 62 nt, Human; identical to SEQ ID NO: 286773

SEQ ID NO: 301944 - RNA, 62 nt, Human; identical to SEQ ID NO: 286774

SEQ ID NO: 301945 - RNA, 62 nt, Human; identical to SEQ ID NO: 286775

SEQ ID NO: 301946 - RNA, 62 nt, Human; identical to SEQ ID NO: 286776

SEQ ID NO: 301947 - RNA, 62 nt, Human; identical to SEQ ID NO: 286777

SEQ ID NO: 301948 - RNA, 62 nt, Human; identical to SEQ ID NO: 286778

SEQ ID NO: 301949 - RNA, 62 nt, Human; identical to SEQ ID NO: 286779

SEQ ID NO: 301950 - RNA, 62 nt, Human; identical to SEQ ID NO: 286780

SEQ ID NO: 301951 - RNA, 62 nt, Human; identical to SEQ ID NO: 286781

SEQ ID NO: 301952 - RNA, 62 nt, Human; identical to SEQ ID NO: 286782

SEQ ID NO: 301953 - RNA, 62 nt, Human; identical to SEQ ID NO: 286783

SEQ ID NO: 301954 - RNA, 62 nt, Human; identical to SEQ ID NO: 286784

SEQ ID NO: 301955 - RNA, 62 nt, Human; identical to SEQ ID NO: 286785

SEQ ID NO: 301956 - RNA, 62 nt, Human; identical to SEQ ID NO: 286786

SEQ ID NO: 301957 - RNA, 62 nt, Human; identical to SEQ ID NO: 286787

SEQ ID NO: 301958 - RNA, 62 nt, Human; identical to SEQ ID NO: 286790

SEQ ID NO: 301959 - RNA, 62 nt, Human; identical to SEQ ID NO: 286791

SEQ ID NO: 301960 - RNA, 62 nt, Human; identical to SEQ ID NO: 286792

SEQ ID NO: 301961 - RNA, 62 nt, Human; identical to SEQ ID NO: 286793

SEQ ID NO: 301962 - RNA, 62 nt, Human; identical to SEQ ID NO: 286794

SEQ ID NO: 301963 - RNA, 62 nt, Human; identical to SEQ ID NO: 286795

SEQ ID NO: 301964 - RNA, 62 nt, Human; identical to SEQ ID NO: 286796

SEQ ID NO: 301965 - RNA, 62 nt, Human; identical to SEQ ID NO: 286797

SEQ ID NO: 301966 - RNA, 62 nt, Human; identical to SEQ ID NO: 286798

SEQ ID NO: 301967 - RNA, 62 nt, Human; identical to SEQ ID NO: 286799

SEQ ID NO: 301968 - RNA, 62 nt, Human; identical to SEQ ID NO: 286800

SEQ ID NO: 301969 - RNA, 62 nt, Human; identical to SEQ ID NO: 286801

SEQ ID NO: 301970 - RNA, 62 nt, Human; identical to SEQ ID NO: 286802

SEQ ID NO: 301971 - RNA, 62 nt, Human; identical to SEQ ID NO: 286803

SEQ ID NO: 301972 - RNA, 62 nt, Human; identical to SEQ ID NO: 286804

SEQ ID NO: 301973 - RNA, 62 nt, Human; identical to SEQ ID NO: 286805

SEQ ID NO: 301974 - RNA, 62 nt, Human; identical to SEQ ID NO: 286806

SEQ ID NO: 301975 - RNA, 64 nt, Human
cucggcgaaugagcugggugggugcccaggagccggcccgcagcaccugcacacacgaaguccg

SEQ ID NO: 301976 - RNA, 64 nt, Human
ugaaggugcuguccauucgaggccuggucauccuggcccgcaggucugagaaggugagugggag

SEQ ID NO: 301977 - RNA, 64 nt, Human
uugguucagcagucagcaguuaaguauauaacauggcccgcaaggacaaugaauccacucacau

SEQ ID NO: 301978 - RNA, 52 nt, Human
gaugcugcuccggcugcugagaggcccgcaacccccagcgcugcgcuagaga

SEQ ID NO: 301979 - RNA, 64 nt, Human
agcugccuuguuuagccugcuuuacauuguagguggcccgcauuuccagaaauaacguuaugca

SEQ ID NO: 301980 - RNA, 64 nt, Human
ccaccgugucccagccagggcagggagggaccauggcccgcagggucaaggggccccgaugugc

SEQ ID NO: 301981 - RNA, 64 nt, Human
cccuucuccggaaggcucuggccccaagcuggccggcccgcaggagccccauucucagagaaug

SEQ ID NO: 301982 - RNA, 64 nt, Human
cccagccggcucgccagccaugaugcugcagccgggcccgcagcucuacgacgugauggacgcg

SEQ ID NO: 301983 - RNA, 64 nt, Human
ugccucugacugccuuugaagcgcagcccucuguggcccgcagcccccugagccuggcuguugu

SEQ ID NO: 301984 - RNA, 64 nt, Human
cggggcaccuagcccugggcgagcgccgcacccgggcccgcagcggcaccgcgcccagagcggc

SEQ ID NO: 301985 - RNA, 64 nt, Human
ccacgaaugcuucugccugugcugugcauucccaggcccgcagcucccggucgaggggacuccg

SEQ ID NO: 301986 - RNA, 64 nt, Human
ucacccaaacacuucugcuuucacuuaagugucuggcccgcaauacuguaggaacaagcaugau

SEQ ID NO: 301987 - RNA, 64 nt, Human
accuuggcugugugcgucccagcaaaagagcucuggcccgcaucucgcugugcccugaaggggg

SEQ ID NO: 301988 - RNA, 64 nt, Human
gcuacaggaugggguguccgggcccggggcgcacggcccgcacgacgccuuccgcgccucgcuc

SEQ ID NO: 301989 - RNA, 64 nt, Human; identical to SEQ ID NO: 141728

SEQ ID NO: 301990 - RNA, 64 nt, Human; identical to SEQ ID NO: 141729

SEQ ID NO: 301991 - RNA, 64 nt, Human; identical to SEQ ID NO: 141730

SEQ ID NO: 301992 - RNA, 64 nt, Human
gcuugggccuugaggucuguggcagggcuccucuggcccgcaguggccuggaucuaucugggcc

SEQ ID NO: 301993 - RNA, 64 nt, Human
ucccccucuccgcucugugcucuucauucucacaggcccgcaaccccuccucucuguguccccc

SEQ ID NO: 301994 - RNA, 64 nt, Human
cugugcgcgcguucgcggcggugggcgccugucgggcccgcacucaggagcacagccauagcag

SEQ ID NO: 301995 - RNA, 64 nt, Human
gggacuauuccauuagccuguggucugcaggguaggcccgcaggaaaugaggaauggccgagcu

SEQ ID NO: 301996 - RNA, 64 nt, Human
caugagugucccuggccccuuccugccaugggcaggcccgcaggaagagccgguagggguggaa

SEQ ID NO: 301997 - RNA, 64 nt, Human
uacgucccagggagggaggggcggcccacacccaggcccgcaccgcugggagucugaggccuga

SEQ ID NO: 301998 - RNA, 64 nt, Human
gaccccgcugggaccgaagccguaaccgaagccaggcccgcagccgcuacucacucggaagcuc

SEQ ID NO: 301999 - RNA, 64 nt, Human
gcguccuccugguggccucugugugugucccuguggcccgcagccugcccgccugccccgccca

SEQ ID NO: 302000 - RNA, 64 nt, Human
cugcacgcucggcccacgggagggcaggcuccggggcccgcagccucccacgcugucugagaga

SEQ ID NO: 302001 - RNA, 64 nt, Human
ucaugcgcuuguuggcgcgacuguggcucgagcuggcccgcagacacguggguuucaucacucu

SEQ ID NO: 302002 - RNA, 64 nt, Human
ggaagucggcuccaugcucaccagcagccgcccaggcccgcagccucacccggcucccucuccu

SEQ ID NO: 302003 - RNA, 64 nt, Human
ggaagcauugcucaggguggggggcugggaccauggcccgcagaggcacugccacagcugugag

SEQ ID NO: 302004 - RNA, 64 nt, Human
cacccuggcaccaugcacggccagcaagaaucaaggcccgcagaugcuaagagggccuauuguc

SEQ ID NO: 302005 - RNA, 64 nt, Human
cucauuucgggugaaucugucuaucugugaacguggcccgcaugugcauucuuuuuuuuauaua

SEQ ID NO: 302006 - RNA, 64 nt, Human; identical to SEQ ID NO: 141731

SEQ ID NO: 302007 - RNA, 55 nt, Human; identical to SEQ ID NO: 141732

SEQ ID NO: 302008 - RNA, 64 nt, Human; identical to SEQ ID NO: 141733

SEQ ID NO: 302009 - RNA, 64 nt, Human; identical to SEQ ID NO: 141734

SEQ ID NO: 302010 - RNA, 64 nt, Human
gacgggcacagacacgcucgcgggcagcgggccaggcccgcaccccggccucagggcgcucaga

SEQ ID NO: 302011 - RNA, 64 nt, Human
ggccucagggcgcucagacggcggccaggcacagggcccgcagugcugggaccagagccagaug

SEQ ID NO: 302012 - RNA, 64 nt, Human
gcugccaccaugccugagugccugcagcccaggaggcccgcacaccgguacacucguggacacc

SEQ ID NO: 302013 - RNA, 64 nt, Human
ucucccccacccugugccccuuuucaugguaccaggcccgcacugggggcaauugacuuccucc

SEQ ID NO: 302014 - RNA, 64 nt, Human
ggaaggccccaggaguggcaccuuagugugggucggcccgcagauggcacccaaggccgggaag

SEQ ID NO: 302015 - RNA, 64 nt, Human
ccaguggguguggcuggguccagccuccagaucuggcccgcacgaugccuugcaggauggacag

SEQ ID NO: 302016 - RNA, 64 nt, Human
ugaaggaagaccugcggauagacaggagcgggcaggcccgcacauauccacuugcuggagccca

SEQ ID NO: 302017 - RNA, 64 nt, Human
gccaggagugggcuggagcugcugaggcccagaaggcccgcauaguuccucaccaggagggucu

SEQ ID NO: 302018 - RNA, 64 nt, Human
gcgccaucuaggccgcgcuggcugcacccgcccaggcccgcacccgcccagucccgagggcccg

SEQ ID NO: 302019 - RNA, 64 nt, Human
cguauucccauuagaccaagcuuguccaacccgaggcccgcaugcggcccaggauggcuuugaa

SEQ ID NO: 302020 - RNA, 64 nt, Human
ccaggccuggcugcugcuguguggagagggaggcggcccgcagcagaacagccaccgcacuucc

SEQ ID NO: 302021 - RNA, 64 nt, Human
cggucaagggcggggacagccacacugcgcgcggggcccgcaggccguaauaaagaguggcucg

SEQ ID NO: 302022 - RNA, 64 nt, Human
cuucugcauucccaagccggcagcuacugcccagggcccgcaguguuggcugcugccugccaca

SEQ ID NO: 302023 - RNA, 59 nt, Human
cugacuacuuguaucggugacgccccaccggcccgcagccccugcugcccaauaaaacc

SEQ ID NO: 302024 - RNA, 64 nt, Human; identical to SEQ ID NO: 141735

SEQ ID NO: 302025 - RNA, 64 nt, Human; identical to SEQ ID NO: 141736

SEQ ID NO: 302026 - RNA, 64 nt, Human; identical to SEQ ID NO: 141737

SEQ ID NO: 302027 - RNA, 64 nt, Human; identical to SEQ ID NO: 141738

SEQ ID NO: 302028 - RNA, 64 nt, Human
ccccgacuuguggcucggacccagggaccuucagggcccgcagacccucccggcgccuugagac

SEQ ID NO: 302029 - RNA, 50 nt, Human
aauccuacacccugguguagggcccgcaggaagagcagccacgccuggac

SEQ ID NO: 302030 - RNA, 64 nt, Human
ggcacgggccacgccgagcucccggccagccgccggcccgcaggcagcgcgagggaggagcugc

SEQ ID NO: 302031 - RNA, 64 nt, Human
cguuucugcccagcccucuguggccaggagcccuggcccgcaagagggacagagcccgggagag

SEQ ID NO: 302032 - RNA, 63 nt, Human
aaagcaaagaggcucuuuagaggcagcgggggaggcccgcagagcgcgccccuagccgguucc

SEQ ID NO: 302033 - RNA, 64 nt, Human
auuggauccaguuagcuaccucuucaagguaccaggcccgcagcacuaacagaucacaucugaa

SEQ ID NO: 302034 - RNA, 64 nt, Human
cccugaggccgguccugccccgggaggucuccccggcccgcaucccgaggcgcccaagcuggag

SEQ ID NO: 302035 - RNA, 64 nt, Human
augggaaacgacccggcacgggcauccugugugcggcccgcauggaggguuuggaaaaguucac

SEQ ID NO: 302036 - RNA, 64 nt, Human
ugugaaggucaggaggcaaguggaggauggacugggcccgcagaugcccugaccucugccccca

SEQ ID NO: 302037 - RNA, 64 nt, Human
ccuccacccagcugcuccauuuuugccacaucguggcccgcagccccagagucacuguccaugu

SEQ ID NO: 302038 - RNA, 64 nt, Human
cccauggaaugggcuguauguccugccccaacuuggcccgcagcaggccagaccccccuacccc

SEQ ID NO: 302039 - RNA, 64 nt, Human
gguuaaguccucauguguacagugcaggcccuguggcccgcacuucaguaaguuaucaacucuc

SEQ ID NO: 302040 - RNA, 64 nt, Human
agcaugcgucagcuaacuucagccugugcugcugggcccgcaccccaugucccuugucacugug

SEQ ID NO: 302041 - RNA, 64 nt, Human
gcgucgccaggacuucucugggcuguguuuaaacggcccgcaucuuaauuuuucucccuucuuu

SEQ ID NO: 302042 - RNA, 64 nt, Human; identical to SEQ ID NO: 141739

SEQ ID NO: 302043 - RNA, 64 nt, Human; identical to SEQ ID NO: 141740

SEQ ID NO: 302044 - RNA, 60 nt, Human; identical to SEQ ID NO: 141741

SEQ ID NO: 302045 - RNA, 64 nt, Human; identical to SEQ ID NO: 141742

SEQ ID NO: 302046 - RNA, 64 nt, Human
cgucugcguccugcauccaucucccuguuacaguggcccgcaucaugauuaaagaauguggauc

SEQ ID NO: 302047 - RNA, 64 nt, Human
augccuggggacaguucaggacacacacacaguaggcccgcaauaaaagcaacaccccuucaca

SEQ ID NO: 302048 - RNA, 64 nt, Human
guccaauaaggggggugugagccccgcagggacuggcccgcaccugccuuggauguuuucagca

SEQ ID NO: 302049 - RNA, 64 nt, Human; identical to SEQ ID NO: 302040

SEQ ID NO: 302050 - RNA, 64 nt, Human
gcuugcaccgaguacaaggacagacagcaggcacggcccgcagccuggcaucugugcguguggc

SEQ ID NO: 302051 - RNA, 64 nt, Human
uuccaaaccacucaggacaguacccguggcacugggcccgcagaagcaagggaugacuugguuc

SEQ ID NO: 302052 - RNA, 64 nt, Human
cucagaggcccccgagguguguguaggaggcggaggcccgcagagcacagagcaggagaagggc

SEQ ID NO: 302053 - RNA, 64 nt, Human
ucgccagcccgcucugucgcugcugcgcggcccuggcccgcaccccagggagcggcgggggcgg

SEQ ID NO: 302054 - RNA, 64 nt, Human
gccagugccccagacaguucuuuucuacccugcgggcccgcacguuuuaugagguugauaucgg

SEQ ID NO: 302055 - RNA, 64 nt, Human
uacgaccccaucuugguggcugcacacucuuccuggcccgcacccccauccccagucccuguuc

SEQ ID NO: 302056 - RNA, 64 nt, Human
aagcugccagcucgcuucccccaagcugccucauggcccgcacgccgccucacggcccccaugc

SEQ ID NO: 302057 - RNA, 64 nt, Human
acacuuccuccccagccagccucacucugucuccggcccgcagcaggagcagccagcagugcau

SEQ ID NO: 302058 - RNA, 64 nt, Human
uaugcaaaaaauacacaaauuagccuggugugguggcccgcaccuguggucccagcuacccggg

SEQ ID NO: 302059 - RNA, 64 nt, Human
ggcugggguaggccucagugagucggccggucagggcccgcagccucgccccauccacuccggu

SEQ ID NO: 302060 - RNA, 64 nt, Human; identical to SEQ ID NO: 141743

SEQ ID NO: 302061 - RNA, 64 nt, Human; identical to SEQ ID NO: 141744

SEQ ID NO: 302062 - RNA, 64 nt, Human; identical to SEQ ID NO: 141745

SEQ ID NO: 302063 - RNA, 64 nt, Human; identical to SEQ ID NO: 141746

SEQ ID NO: 302064 - RNA, 64 nt, Human
gcugugagcaccgcgcaccugccacagccucagaggcccgcacaaugaccggaggaggggccgc

SEQ ID NO: 302065 - RNA, 64 nt, Human
cugauggagaccaggacagagcccgcccccacccggcccgcagccccuccugccccuccugcca

SEQ ID NO: 302066 - RNA, 64 nt, Human
uaacaaacgcauuaagagguuuauuuggguacauggcccgcaguggcuuuugccccagaaaggg

SEQ ID NO: 302067 - RNA, 64 nt, Human
cugucgacacggcggggcccgguggccggcaucuggcccgcacguguccgaggggcccccgggu

SEQ ID NO: 302068 - RNA, 64 nt, Human
ggcccccaccugcuggccuaccguugccuucaguggcccgcauucuuccaccagccaccacccu

SEQ ID NO: 302069 - RNA, 64 nt, Human
cggaucaccuuugacugagcgacagcagcccuggggcccgcaggucccuagggaguucaugagg

SEQ ID NO: 302070 - RNA, 64 nt, Human
uccaggugcagggcgggccagaagcccccucaucggcccgcagcuggcuggcccagugcuccug

SEQ ID NO: 302071 - RNA, 64 nt, Human
cuguuccucagcgggccgggcccuugaccagcgcggcccgcaggucuuccuucucgccgucuug

SEQ ID NO: 302072 - RNA, 64 nt, Human
ugccucucagccgccuagccaagacugcagggauggcccgcagccucaucggggccaaggacac

SEQ ID NO: 302073 - RNA, 64 nt, Human
cagcaauacuucguccacaccugggaucgcgcagggcccgcagggcacaggcgcccgacagccg

SEQ ID NO: 302074 - RNA, 64 nt, Human
caggugagcuagcccuuagagaaggcugucccggggcccgcagaggugcccuuacugaggugac

SEQ ID NO: 302075 - RNA, 64 nt, Human
ggaugcuugucuggccaugaucuggagagcaucaggcccgcaggacugcacaacucugccaggg

SEQ ID NO: 302076 - RNA, 64 nt, Human
gagauaggccuugcuugcugccuucuggauucuuggcccgcacagagcuggggcugagggaugg

SEQ ID NO: 302077 - RNA, 64 nt, Human; identical to SEQ ID NO: 141747

SEQ ID NO: 302078 - RNA, 64 nt, Human; identical to SEQ ID NO: 141748

SEQ ID NO: 302079 - RNA, 64 nt, Human; identical to SEQ ID NO: 141749

SEQ ID NO: 302080 - RNA, 64 nt, Human; identical to SEQ ID NO: 141750

SEQ ID NO: 302081 - RNA, 64 nt, Human; identical to SEQ ID NO: 141751

SEQ ID NO: 302082 - RNA, 64 nt, Human; identical to SEQ ID NO: 141752

SEQ ID NO: 302083 - RNA, 64 nt, Human; identical to SEQ ID NO: 141753

SEQ ID NO: 302084 - RNA, 64 nt, Human; identical to SEQ ID NO: 141754

SEQ ID NO: 302085 - RNA, 64 nt, Human; identical to SEQ ID NO: 141755

SEQ ID NO: 302086 - RNA, 64 nt, Human; identical to SEQ ID NO: 141756

SEQ ID NO: 302087 - RNA, 64 nt, Human; identical to SEQ ID NO: 141757

SEQ ID NO: 302088 - RNA, 64 nt, Human; identical to SEQ ID NO: 141758

SEQ ID NO: 302089 - RNA, 64 nt, Human; identical to SEQ ID NO: 141759

SEQ ID NO: 302090 - RNA, 64 nt, Human; identical to SEQ ID NO: 141760

SEQ ID NO: 302091 - RNA, 64 nt, Human; identical to SEQ ID NO: 141761

SEQ ID NO: 302092 - RNA, 64 nt, Human; identical to SEQ ID NO: 141762

SEQ ID NO: 302093 - RNA, 64 nt, Human; identical to SEQ ID NO: 141763

SEQ ID NO: 302094 - RNA, 64 nt, Human; identical to SEQ ID NO: 141764

SEQ ID NO: 302095 - RNA, 64 nt, Human; identical to SEQ ID NO: 141765

SEQ ID NO: 302096 - RNA, 64 nt, Human; identical to SEQ ID NO: 141766

SEQ ID NO: 302097 - RNA, 64 nt, Human; identical to SEQ ID NO: 141767

SEQ ID NO: 302098 - RNA, 64 nt, Human; identical to SEQ ID NO: 141768

SEQ ID NO: 302099 - RNA, 64 nt, Human; identical to SEQ ID NO: 141769

SEQ ID NO: 302100 - RNA, 64 nt, Human; identical to SEQ ID NO: 141770

SEQ ID NO: 302101 - RNA, 64 nt, Human; identical to SEQ ID NO: 141771

SEQ ID NO: 302102 - RNA, 52 nt, Human; identical to SEQ ID NO: 141772

SEQ ID NO: 302103 - RNA, 64 nt, Human; identical to SEQ ID NO: 141773

SEQ ID NO: 302104 - RNA, 64 nt, Human; identical to SEQ ID NO: 141774

SEQ ID NO: 302105 - RNA, 64 nt, Human; identical to SEQ ID NO: 141775

SEQ ID NO: 302106 - RNA, 64 nt, Human; identical to SEQ ID NO: 141776

SEQ ID NO: 302107 - RNA, 64 nt, Human; identical to SEQ ID NO: 141777

SEQ ID NO: 302108 - RNA, 64 nt, Human; identical to SEQ ID NO: 141778

SEQ ID NO: 302109 - RNA, 64 nt, Human; identical to SEQ ID NO: 141779

SEQ ID NO: 302110 - RNA, 64 nt, Human; identical to SEQ ID NO: 141780

SEQ ID NO: 302111 - RNA, 64 nt, Human; identical to SEQ ID NO: 141781

SEQ ID NO: 302112 - RNA, 64 nt, Human; identical to SEQ ID NO: 141782

SEQ ID NO: 302113 - RNA, 64 nt, Human; identical to SEQ ID NO: 141783

SEQ ID NO: 302114 - RNA, 64 nt, Human; identical to SEQ ID NO: 141784

SEQ ID NO: 302115 - RNA, 64 nt, Human; identical to SEQ ID NO: 141785

SEQ ID NO: 302116 - RNA, 54 nt, Human; identical to SEQ ID NO: 141786

SEQ ID NO: 302117 - RNA, 64 nt, Human; identical to SEQ ID NO: 141787

SEQ ID NO: 302118 - RNA, 64 nt, Human; identical to SEQ ID NO: 141788

SEQ ID NO: 302119 - RNA, 64 nt, Human; identical to SEQ ID NO: 141789

SEQ ID NO: 302120 - RNA, 64 nt, Human; identical to SEQ ID NO: 141790

SEQ ID NO: 302121 - RNA, 64 nt, Human; identical to SEQ ID NO: 141791

SEQ ID NO: 302122 - RNA, 62 nt, Human; identical to SEQ ID NO: 141792

SEQ ID NO: 302123 - RNA, 64 nt, Human; identical to SEQ ID NO: 141793

SEQ ID NO: 302124 - RNA, 64 nt, Human; identical to SEQ ID NO: 141794

SEQ ID NO: 302125 - RNA, 64 nt, Human; identical to SEQ ID NO: 141795

SEQ ID NO: 302126 - RNA, 64 nt, Human; identical to SEQ ID NO: 141796

SEQ ID NO: 302127 - RNA, 64 nt, Human; identical to SEQ ID NO: 141797

SEQ ID NO: 302128 - RNA, 64 nt, Human; identical to SEQ ID NO: 141798

SEQ ID NO: 302129 - RNA, 64 nt, Human; identical to SEQ ID NO: 141799

SEQ ID NO: 302130 - RNA, 64 nt, Human; identical to SEQ ID NO: 141800

SEQ ID NO: 302131 - RNA, 52 nt, Human; identical to SEQ ID NO: 141801

SEQ ID NO: 302132 - RNA, 64 nt, Human; identical to SEQ ID NO: 141802

SEQ ID NO: 302133 - RNA, 59 nt, Human; identical to SEQ ID NO: 141803

SEQ ID NO: 302134 - RNA, 64 nt, Human; identical to SEQ ID NO: 141804

SEQ ID NO: 302135 - RNA, 64 nt, Human; identical to SEQ ID NO: 141805

SEQ ID NO: 302136 - RNA, 54 nt, Human; identical to SEQ ID NO: 141806

SEQ ID NO: 302137 - RNA, 64 nt, Human; identical to SEQ ID NO: 141807

SEQ ID NO: 302138 - RNA, 64 nt, Human; identical to SEQ ID NO: 141808

SEQ ID NO: 302139 - RNA, 55 nt, Human; identical to SEQ ID NO: 141809

SEQ ID NO: 302140 - RNA, 64 nt, Human; identical to SEQ ID NO: 141810

SEQ ID NO: 302141 - RNA, 64 nt, Human; identical to SEQ ID NO: 141811

SEQ ID NO: 302142 - RNA, 64 nt, Human; identical to SEQ ID NO: 141812

SEQ ID NO: 302143 - RNA, 64 nt, Human; identical to SEQ ID NO: 141813

SEQ ID NO: 302144 - RNA, 64 nt, Human; identical to SEQ ID NO: 141814

SEQ ID NO: 302145 - RNA, 61 nt, Human; identical to SEQ ID NO: 141815

SEQ ID NO: 302146 - RNA, 64 nt, Human; identical to SEQ ID NO: 141816

SEQ ID NO: 302147 - RNA, 64 nt, Human; identical to SEQ ID NO: 141817

SEQ ID NO: 302148 - RNA, 64 nt, Human; identical to SEQ ID NO: 141818

SEQ ID NO: 302149 - RNA, 64 nt, Human; identical to SEQ ID NO: 141819

SEQ ID NO: 302150 - RNA, 64 nt, Human; identical to SEQ ID NO: 141820

SEQ ID NO: 302151 - RNA, 64 nt, Human; identical to SEQ ID NO: 141821

SEQ ID NO: 302152 - RNA, 64 nt, Human; identical to SEQ ID NO: 141822

SEQ ID NO: 302153 - RNA, 64 nt, Human; identical to SEQ ID NO: 141823

SEQ ID NO: 302154 - RNA, 64 nt, Human; identical to SEQ ID NO: 141824

SEQ ID NO: 302155 - RNA, 64 nt, Human; identical to SEQ ID NO: 141825

SEQ ID NO: 302156 - RNA, 64 nt, Human; identical to SEQ ID NO: 141826

SEQ ID NO: 302157 - RNA, 64 nt, Human; identical to SEQ ID NO: 141827

SEQ ID NO: 302158 - RNA, 64 nt, Human; identical to SEQ ID NO: 141828

SEQ ID NO: 302159 - RNA, 64 nt, Human; identical to SEQ ID NO: 141829

SEQ ID NO: 302160 - RNA, 64 nt, Human; identical to SEQ ID NO: 141830

SEQ ID NO: 302161 - RNA, 64 nt, Human; identical to SEQ ID NO: 141831

SEQ ID NO: 302162 - RNA, 64 nt, Human; identical to SEQ ID NO: 141832

SEQ ID NO: 302163 - RNA, 56 nt, Human; identical to SEQ ID NO: 141833

SEQ ID NO: 302164 - RNA, 64 nt, Human; identical to SEQ ID NO: 141834

SEQ ID NO: 302165 - RNA, 64 nt, Human; identical to SEQ ID NO: 141835

SEQ ID NO: 302166 - RNA, 64 nt, Human; identical to SEQ ID NO: 141836

SEQ ID NO: 302167 - RNA, 64 nt, Human; identical to SEQ ID NO: 141837

SEQ ID NO: 302168 - RNA, 64 nt, Human; identical to SEQ ID NO: 141838

SEQ ID NO: 302169 - RNA, 64 nt, Human; identical to SEQ ID NO: 141839

SEQ ID NO: 302170 - RNA, 64 nt, Human; identical to SEQ ID NO: 141840

SEQ ID NO: 302171 - RNA, 64 nt, Human; identical to SEQ ID NO: 141841

SEQ ID NO: 302172 - RNA, 64 nt, Human; identical to SEQ ID NO: 141842

SEQ ID NO: 302173 - RNA, 64 nt, Human; identical to SEQ ID NO: 141843

SEQ ID NO: 302174 - RNA, 64 nt, Human; identical to SEQ ID NO: 141844

SEQ ID NO: 302175 - RNA, 64 nt, Human; identical to SEQ ID NO: 141845

SEQ ID NO: 302176 - RNA, 51 nt, Human; identical to SEQ ID NO: 141846

SEQ ID NO: 302177 - RNA, 64 nt, Human; identical to SEQ ID NO: 141847

SEQ ID NO: 302178 - RNA, 64 nt, Human; identical to SEQ ID NO: 141848

SEQ ID NO: 302179 - RNA, 64 nt, Human; identical to SEQ ID NO: 141849

SEQ ID NO: 302180 - RNA, 64 nt, Human; identical to SEQ ID NO: 141850

SEQ ID NO: 302181 - RNA, 64 nt, Human; identical to SEQ ID NO: 141851

SEQ ID NO: 302182 - RNA, 64 nt, Human; identical to SEQ ID NO: 141852

SEQ ID NO: 302183 - RNA, 64 nt, Human; identical to SEQ ID NO: 141853

SEQ ID NO: 302184 - RNA, 64 nt, Human; identical to SEQ ID NO: 141854

SEQ ID NO: 302185 - RNA, 64 nt, Human; identical to SEQ ID NO: 141855

SEQ ID NO: 302186 - RNA, 64 nt, Human; identical to SEQ ID NO: 141856

SEQ ID NO: 302187 - RNA, 64 nt, Human; identical to SEQ ID NO: 141857

SEQ ID NO: 302188 - RNA, 64 nt, Human; identical to SEQ ID NO: 141858

SEQ ID NO: 302189 - RNA, 64 nt, Human; identical to SEQ ID NO: 141859

SEQ ID NO: 302190 - RNA, 64 nt, Human; identical to SEQ ID NO: 141860

SEQ ID NO: 302191 - RNA, 64 nt, Human; identical to SEQ ID NO: 141861

SEQ ID NO: 302192 - RNA, 61 nt, Human; identical to SEQ ID NO: 141862

SEQ ID NO: 302193 - RNA, 64 nt, Human; identical to SEQ ID NO: 141863

SEQ ID NO: 302194 - RNA, 64 nt, Human; identical to SEQ ID NO: 141864

SEQ ID NO: 302195 - RNA, 64 nt, Human; identical to SEQ ID NO: 141865

SEQ ID NO: 302196 - RNA, 64 nt, Human; identical to SEQ ID NO: 141866

SEQ ID NO: 302197 - RNA, 56 nt, Human; identical to SEQ ID NO: 141867

SEQ ID NO: 302198 - RNA, 64 nt, Human; identical to SEQ ID NO: 141868

SEQ ID NO: 302199 - RNA, 64 nt, Human; identical to SEQ ID NO: 141869

SEQ ID NO: 302200 - RNA, 64 nt, Human; identical to SEQ ID NO: 141870

SEQ ID NO: 302201 - RNA, 64 nt, Human; identical to SEQ ID NO: 141871

SEQ ID NO: 302202 - RNA, 64 nt, Human; identical to SEQ ID NO: 141872

SEQ ID NO: 302203 - RNA, 64 nt, Human; identical to SEQ ID NO: 141873

SEQ ID NO: 302204 - RNA, 64 nt, Human; identical to SEQ ID NO: 141874

SEQ ID NO: 302205 - RNA, 64 nt, Human; identical to SEQ ID NO: 141875

SEQ ID NO: 302206 - RNA, 64 nt, Human; identical to SEQ ID NO: 141876

SEQ ID NO: 302207 - RNA, 64 nt, Human; identical to SEQ ID NO: 141877

SEQ ID NO: 302208 - RNA, 64 nt, Human; identical to SEQ ID NO: 141878

SEQ ID NO: 302209 - RNA, 64 nt, Human; identical to SEQ ID NO: 141879

SEQ ID NO: 302210 - RNA, 64 nt, Human; identical to SEQ ID NO: 141880

SEQ ID NO: 302211 - RNA, 64 nt, Human; identical to SEQ ID NO: 141881

SEQ ID NO: 302212 - RNA, 64 nt, Human; identical to SEQ ID NO: 141882

SEQ ID NO: 302213 - RNA, 64 nt, Human; identical to SEQ ID NO: 141883

SEQ ID NO: 302214 - RNA, 64 nt, Human; identical to SEQ ID NO: 141884

SEQ ID NO: 302215 - RNA, 64 nt, Human; identical to SEQ ID NO: 141885

SEQ ID NO: 302216 - RNA, 64 nt, Human; identical to SEQ ID NO: 141886

SEQ ID NO: 302217 - RNA, 64 nt, Human; identical to SEQ ID NO: 141887

SEQ ID NO: 302218 - RNA, 64 nt, Human; identical to SEQ ID NO: 141888

SEQ ID NO: 302219 - RNA, 64 nt, Human; identical to SEQ ID NO: 141889

SEQ ID NO: 302220 - RNA, 64 nt, Human; identical to SEQ ID NO: 141890

SEQ ID NO: 302221 - RNA, 64 nt, Human; identical to SEQ ID NO: 141891

SEQ ID NO: 302222 - RNA, 62 nt, Human
uccuugcagcuguggcagcagcaggcuccccagcggcccagggugggccagaccagcagccc

SEQ ID NO: 302223 - RNA, 62 nt, Human
acggugcuggccuguuugugaugaucagcucagcggcccagcugcuuaucugucuaacuugg

SEQ ID NO: 302224 - RNA, 62 nt, Human
gcuggcaagcguagcuauguguuggcccuggggcggcccaccccugccaagcuugccaacuu

SEQ ID NO: 302225 - RNA, 62 nt, Human
augugggggguuuccgcugccccccacccccagcggcccaccccaugccucagcuucauguc

SEQ ID NO: 302226 - RNA, 62 nt, Human
cugcggugcaggcaccuggccaugcuggcugggcggcccaagcacagcccugacuaggauga

SEQ ID NO: 302227 - RNA, 53 nt, Human
ccggcaaacucuguagcuaaugggcggcccacuucagcacugggcaaggaggg

SEQ ID NO: 302228 - RNA, 62 nt, Human
ccgcccccgccaucuguucuccaucagugugcgcggcccagccauuuccacccucgggaggc

SEQ ID NO: 302229 - RNA, 62 nt, Human
cuaucaucccacgugucuacccagacccuugugcggcccaugcccugggggcggcguccugu

SEQ ID NO: 302230 - RNA, 62 nt, Human
cgcgugugguagccaaggcccugccgcgcugugcggcccacgcccacccgcugcucggaggc

SEQ ID NO: 302231 - RNA, 55 nt, Human
gcggccguuucaacuuuuaaagggagcggcccacggccuccagcguggggagcgc

SEQ ID NO: 302232 - RNA, 62 nt, Human
ggagcgauccgcagcugcucacuccaccuugcgcggcccauacugggcgugugcaucugaau

SEQ ID NO: 302233 - RNA, 62 nt, Human
ggcugcaaauucgcccagccaauggggacguugcggcccaguggguggagguccaaagagga

SEQ ID NO: 302234 - RNA, 62 nt, Human
auguccacugucaccaagcuggauggcaagcugcggcccacaaaacagccagucagguuggc

SEQ ID NO: 302235 - RNA, 62 nt, Human
aggugcuccgggaacgccuuccgcggaaugaagcggcccaugcccuuguugacguugauguu

SEQ ID NO: 302236 - RNA, 62 nt, Human
cacgccgggcucuacgucccagggagggaggggcggcccacacccaggcccgcaccgcuggg

SEQ ID NO: 302237 - RNA, 57 nt, Human
cagagacgcgggcccagugagcuucuugcggcccagggaaugagauggagcucacgg

SEQ ID NO: 302238 - RNA, 62 nt, Human
gguucaggucaccgggacuucucucagagucagcggcccacccaacucccucauaccgucgc

SEQ ID NO: 302239 - RNA, 62 nt, Human
gguuaucugcucuuggccaucugguggugguggcggcccagagucugaagaaauggcacagg

SEQ ID NO: 302240 - RNA, 50 nt, Human
ugcagcaggugcuggcguaggcggcccagcccuccuggggagacgugacu

SEQ ID NO: 302241 - RNA, 62 nt, Human
cagggagaggcgcccggugcagauggccccgggcggcccagguccucuacugugaaggagca

SEQ ID NO: 302242 - RNA, 62 nt, Human
cuggccguguguccccagguuuguuaccugcagcggcccaucacccuguggugcggccucaa

SEQ ID NO: 302243 - RNA, 62 nt, Human
gggggucccgggcacugucgcgcuugcugcaggcggcccagccguguauuuauuuuucaccu

SEQ ID NO: 302244 - RNA, 62 nt, Human
cccaaggcgcagcgggagcgcacaggugccccgcggcccagccgggggauaacgcagggcgg

SEQ ID NO: 302245 - RNA, 62 nt, Human
gagggcgggccuuggccccgagugaaggcgcggcggcccaaccggcgugagagcgcggggcc

SEQ ID NO: 302246 - RNA, 57 nt, Human
accagcccgcgccccaguaggagccccgcggcccagcaggugcggcgcgcacggagc

SEQ ID NO: 302247 - RNA, 62 nt, Human
agguuggugugagccugggcccggcccacucagcggcccacauuggccagcauucagcugca

SEQ ID NO: 302248 - RNA, 62 nt, Human
cuccaggccccugagccuggcgggaaguggcugcggcccaggcagccaguccuggugguguu

SEQ ID NO: 302249 - RNA, 62 nt, Human
uguagaguccccgcccacccccauggcccuaugcggcccagccccgaaugccuugaagaagu

SEQ ID NO: 302250 - RNA, 62 nt, Human
cugaggcugccugcgcccaccccgcucugcaugcggcccagcccggcucccaccgaggcgcg

SEQ ID NO: 302251 - RNA, 62 nt, Human
caccccuucccaagccuucuagcgcagggccugcggcccagacguccagggagccggccccu

SEQ ID NO: 302252 - RNA, 62 nt, Human
ggagcgacccgcagcugcucacuccaccuugcgcggcccauacugggcgugugcaucugaau

SEQ ID NO: 302253 - RNA, 62 nt, Human
aucccaucaauauagucccuacaccuggggcugcggcccacaugucuucacggaggcuucca

SEQ ID NO: 302254 - RNA, 62 nt, Human
cugaacacgggugugcagacucacccuaaagggcggcccaggccccacgcuagaaggcuggc

SEQ ID NO: 302255 - RNA, 62 nt, Human
cucaagaguccgccugcuuggagcuggacccagcggcccagagucuagccagcuuggcucca

SEQ ID NO: 302256 - RNA, 62 nt, Human
auggucugaguggggcuuccugggcaguuggggcggcccacgccagcuggcccaguggguag

SEQ ID NO: 302257 - RNA, 62 nt, Human
acaggcuggcucagccugucuccagggcugcugcggcccagccccgagccugccucccucuu

SEQ ID NO: 302258 - RNA, 62 nt, Human
cgugucgggguacacccagcacuuugcgaccugcggcccagcaggcgcggaggauggcgggg

SEQ ID NO: 302259 - RNA, 62 nt, Human
ggccggcgcccaccaugcuccugggcgcccacgcggcccacagggcaagaacccggggccuc

SEQ ID NO: 302260 - RNA, 62 nt, Human
uuuacucauguucuuucuuguugaugaguucugcggcccagcauauagaaauggcucagaac

SEQ ID NO: 302261 - RNA, 62 nt, Human
uucugugacacacaaucagcgcggaccgcagcgcggcccagccccgggcacccgccucggac

SEQ ID NO: 302262 - RNA, 62 nt, Human
caggaagcuagaaaaggugucagugaccuguugcggcccagcggcuggagcagcagacguuu

SEQ ID NO: 302263 - RNA, 62 nt, Human
cggcccugccccaaguagcccagaagccuccggcggcccaggauucuaaggaugcaauccuc

SEQ ID NO: 302264 - RNA, 62 nt, Human
aggcccgcaugcggcccaggauggcuuugaaugcggcccaacgcaaauucgcaaacuuucuu

SEQ ID NO: 302265 - RNA, 62 nt, Human
uagaccaagcuuguccaacccgaggcccgcaugcggcccaggauggcuuugaaugcggccca

SEQ ID NO: 302266 - RNA, 62 nt, Human
cagaggucucuaucccaucccuuccuguuacugcggcccaaggacaggaaacaacuuuucca

SEQ ID NO: 302267 - RNA, 62 nt, Human
cagcacugggcagacaugcuggcccacgcccggcggcccauugcccagcggcacccccugcg

SEQ ID NO: 302268 - RNA, 62 nt, Human
ccugagacccagggggaccugccacugguaccgcggcccagccuggggccugggggcugccc

SEQ ID NO: 302269 - RNA, 62 nt, Human
cccgcccacuguccugggcgcccuggaagccggcggcccaagcccgacuugcuguuuuguuc

SEQ ID NO: 302270 - RNA, 62 nt, Human
acaucauggggugauugcagaaagggggaguggcggcccacgcagcuucugcugaggagcug

SEQ ID NO: 302271 - RNA, 53 nt, Human
ucuucccccaggaggcuuagggcgcggcccaggccugaaggggagcucugaga

SEQ ID NO: 302272 - RNA, 62 nt, Human
aggcuuaacauuaaguauuccuuggcccagcagcggcccagauugcggugugagauggugcc

SEQ ID NO: 302273 - RNA, 62 nt, Human
ccccagguugagcaauaagaaaccagaaccuugcggcccaguggcccgggccaguucaggcc

SEQ ID NO: 302274 - RNA, 62 nt, Human
cuuacagacuagcccagugugggcagaugccagcggcccagguggcgccauugcuguccugg

SEQ ID NO: 302275 - RNA, 62 nt, Human
cccccgcuggccaaggccuguggacgacgcuggcggcccagccugggcagguuucagggugc

SEQ ID NO: 302276 - RNA, 62 nt, Human
gcaagcaggcagcgccccggcccgcggcccccgcggcccacucggcgcacucagccagcguc

SEQ ID NO: 302277 - RNA, 62 nt, Human
guaccccccauacuggcuuacuuccaccuccugcggcccagcucuguccuccagagccuagc

SEQ ID NO: 302278 - RNA, 62 nt, Human
aggggaugaggaaggccucaggccacugcccagcggcccaggcauccuggguuucaccagug

SEQ ID NO: 302279 - RNA, 62 nt, Human
accacagcgcuggggagagggaugaaggcucggcggcccagggcagcacccaaggucugggc

SEQ ID NO: 302280 - RNA, 62 nt, Human
gggucugcucacauagccgguccccacgcccagcggcccacccaccagcagcugcuggaggu

SEQ ID NO: 302281 - RNA, 62 nt, Human
guuggguguacggguucuguuccucugagccugcggcccaccugauguuuacgugugugugu

SEQ ID NO: 302282 - RNA, 62 nt, Human
agccuugguaauggagaguuugcaaacacacagcggcccacagcuucacgugguggugugca

SEQ ID NO: 302283 - RNA, 62 nt, Human
acuggcucccacggagggugcgccugccgccagcggcccagccuugcugcccugucugcuga

SEQ ID NO: 302284 - RNA, 62 nt, Human
ugugcccuugccggcggcagguugcagccaccgcggcccaaugucaccuucacucacagucu

SEQ ID NO: 302285 - RNA, 62 nt, Human
agugggggccgcgggcagccgcucuucagcucgcggcccaggggaguggcgaggggcgcccc

SEQ ID NO: 302286 - RNA, 62 nt, Human
uagccaacuugaccccucucaucccacucccggcggcccaggcacagaagggcagggccaua

SEQ ID NO: 302287 - RNA, 62 nt, Human
uuccauccacucaccuuaccccauagcaucuugcggcccagaaaccagagccauuugucuca

SEQ ID NO: 302288 - RNA, 62 nt, Human
uuucaggucguguaugagaggugugaaaagcugcggcccacgcuguuccgguuggcgaguga

SEQ ID NO: 302289 - RNA, 62 nt, Human
ucgcuaugggaggcagccgaggccuggccaaugcggcccacuuuccugagcugucgcugccu

SEQ ID NO: 302290 - RNA, 62 nt, Human
ccaagggggccacuggcuaccccuacugcgcggcggcccaggagcucggacugcugguccug

SEQ ID NO: 302291 - RNA, 62 nt, Human
guggagucugagucugaguccugucucugccugcggcccagaaguuucccucaaaugcgcgu

SEQ ID NO: 302292 - RNA, 62 nt, Human
cuaccauaccucacacagcguugguguugugagcggcccaugaaaagccaaauuaaaaauca

SEQ ID NO: 302293 - RNA, 62 nt, Human
accucggaccuccaggcggcucagugcugccugcggcccagcuaaggggccuggccacuggg

SEQ ID NO: 302294 - RNA, 62 nt, Human
caggccccuccaggcccaccagccugguucccgcggcccauuuggucagcuuccccgccacg

SEQ ID NO: 302295 - RNA, 62 nt, Human
ucccaaagaguuugaugaggcccuccacaccugcggcccaauccaaggugggguggaagcuu

SEQ ID NO: 302296 - RNA, 62 nt, Human
cuuccagcccugagcccgcccagaggagcccagcggcccaagagcccgugccacccccagcc

SEQ ID NO: 302297 - RNA, 62 nt, Human
cucaguucccccagcuguaagacagggacggggcggcccaguggcugagaggagccggcugu

SEQ ID NO: 302298 - RNA, 62 nt, Human
ggguccuggcgggugggacccgcagccuccacgcggcccaggccagccugccacccucuggg

SEQ ID NO: 302299 - RNA, 62 nt, Human
accuugugcgaggcccucggggcccacccacagcggcccagggccagacccuggcuggaagc

SEQ ID NO: 302300 - RNA, 62 nt, Human
uguccugccccgguuugcggacgagagaaaucgcggcccacaagcauccccccaucccuugc

SEQ ID NO: 302301 - RNA, 62 nt, Human
cucccccuccugcugcuaugccugugacccccgcggcccacacacuggacugaccugcccug

SEQ ID NO: 302302 - RNA, 62 nt, Human
uccucuguucagucgcaaaggugaacacucaugcggcccagccaugggcccucugagcaacu

SEQ ID NO: 302303 - RNA, 62 nt, Human
gccagagggacgccgcagcugggaccaggcacgcggcccauggggcugggccccugcuggcc

SEQ ID NO: 302304 - RNA, 62 nt, Human
agggugcaguggagcccugagcauuguaauaugcggcccagccuauaaacagccuccgugcu

SEQ ID NO: 302305 - RNA, 62 nt, Human
augucuccuccuuccccccucuucucucuccugcggcccagccucccucucccuccuccauu

SEQ ID NO: 302306 - RNA, 62 nt, Human
ccuaucggggcauagcccagggaugcccccaggcggcccagguuagaugcgucccuuuggcu

SEQ ID NO: 302307 - RNA, 62 nt, Human
caggauagauguauucuagaguagggguggaggcggcccaggaggcugaagacaggugcaca

SEQ ID NO: 302308 - RNA, 62 nt, Human
gcuggggccuuggggacccccagguaguccaugcggcccauuccuccccuucccacucccgc

SEQ ID NO: 302309 - RNA, 62 nt, Human
uuggagggacaccagugcacuaggcagcuggggcggcccaggcugaagccaucuccgggugu

SEQ ID NO: 302310 - RNA, 62 nt, Human
ccaccccacguacagcaagggacuccccaggugcggcccaaggcuccggaccacacuggccc

SEQ ID NO: 302311 - RNA, 62 nt, Human
cgaagggaacuggcuggcuguccguccagugagcggcccagaccccaccucugcgccauugu

SEQ ID NO: 302312 - RNA, 62 nt, Human
guggagguguggaggcccccugaggagcugcggcggcccagguacgaagcugcaacucugcg

SEQ ID NO: 302313 - RNA, 58 nt, Human
uaugcagccaggcuucuugaccuucacugcggcccacaugcaccucagguucaaaaug

SEQ ID NO: 302314 - RNA, 62 nt, Human
uagccugaccaucuggacacagcagagccagggcggcccagggacggcaggagagcucgcgg

SEQ ID NO: 302315 - RNA, 62 nt, Human
uggccaaugugacuaccgugccagcagcgggggcggcccagccucugagucccguggggccc

SEQ ID NO: 302316 - RNA, 62 nt, Human
acgccccacguccagguggcagggaaagccgagcggcccacggccaggucggagcaguacuu

SEQ ID NO: 302317 - RNA, 62 nt, Human
ggacaaacgacuggacagacuuauuucucacugcggcccaguaacaggcuacaucuuugcuu

SEQ ID NO: 302318 - RNA, 64 nt, Human
gguccuugcagcuguggcagcagcaggcuccccagcggcccagggugggccagaccagcagccc

SEQ ID NO: 302319 - RNA, 64 nt, Human
ccacggugcuggccuguuugugaugaucagcucagcggcccagcugcuuaucugucuaacuugg

SEQ ID NO: 302320 - RNA, 64 nt, Human
cugcuggcaagcguagcuauguguuggcccuggggcggcccaccccugccaagcuugccaacuu

SEQ ID NO: 302321 - RNA, 62 nt, Human
ugguuagcgggagugugcugcccccacccccacccccgcacccccauucuacacaaggcaga

SEQ ID NO: 302322 - RNA, 62 nt, Human
aaccugugccaacuaagggcccccacuguaagcccccgcacccccacccccugcccagagca

SEQ ID NO: 302323 - RNA, 62 nt, Human
cuaugcgcucaauggcccggaggggcagcaaccccccgcacacgucagccaacagcagugcc

SEQ ID NO: 302324 - RNA, 64 nt, Human
gaaugugggggguuuccgcugccccccacccccagcggcccaccccaugccucagcuucauguc

SEQ ID NO: 302325 - RNA, 64 nt, Human
ggcugcggugcaggcaccuggccaugcuggcugggcggcccaagcacagcccugacuaggauga

SEQ ID NO: 302326 - RNA, 53 nt, Human; identical to SEQ ID NO: 302227

SEQ ID NO: 302327 - RNA, 64 nt, Human
ccccgcccccgccaucuguucuccaucagugugcgcggcccagccauuuccacccucgggaggc

SEQ ID NO: 302328 - RNA, 64 nt, Human
uccuaucaucccacgugucuacccagacccuugugcggcccaugcccugggggcggcguccugu

SEQ ID NO: 302329 - RNA, 64 nt, Human
gccgcgugugguagccaaggcccugccgcgcugugcggcccacgcccacccgcugcucggaggc

SEQ ID NO: 302330 - RNA, 55 nt, Human; identical to SEQ ID NO: 302231

SEQ ID NO: 302331 - RNA, 64 nt, Human
ggggagcgauccgcagcugcucacuccaccuugcgcggcccauacugggcgugugcaucugaau

SEQ ID NO: 302332 - RNA, 64 nt, Human
ccggcugcaaauucgcccagccaauggggacguugcggcccaguggguggagguccaaagagga

SEQ ID NO: 302333 - RNA, 64 nt, Human
ggauguccacugucaccaagcuggauggcaagcugcggcccacaaaacagccagucagguuggc

SEQ ID NO: 302334 - RNA, 64 nt, Human
acaggugcuccgggaacgccuuccgcggaaugaagcggcccaugcccuuguugacguugauguu

SEQ ID NO: 302335 - RNA, 64 nt, Human
gucacgccgggcucuacgucccagggagggaggggcggcccacacccaggcccgcaccgcuggg

SEQ ID NO: 302336 - RNA, 57 nt, Human; identical to SEQ ID NO: 302237

SEQ ID NO: 302337 - RNA, 64 nt, Human
uagguucaggucaccgggacuucucucagagucagcggcccacccaacucccucauaccgucgc

SEQ ID NO: 302338 - RNA, 64 nt, Human
aagguuaucugcucuuggccaucugguggugguggcggcccagagucugaagaaauggcacagg

SEQ ID NO: 302339 - RNA, 50 nt, Human; identical to SEQ ID NO: 302240

SEQ ID NO: 302340 - RNA, 64 nt, Human
uccggaggcgggcgugagacaagcccagcccgcacgcgcucaucuuucuucguuuuuugaucag

SEQ ID NO: 302341 - RNA, 64 nt, Human
cuggcaccugugcuaguuacguagccgcugcucacgcgcucacuccugaccacaugcacguucc

SEQ ID NO: 302342 - RNA, 62 nt, Human
guacgggggcgcggcagggguccccggccccucccccgcagaggucaaugccaacgaacaaa

SEQ ID NO: 302343 - RNA, 64 nt, Human
gccagggagaggcgcccggugcagauggccccgggcggcccagguccucuacugugaaggagca

SEQ ID NO: 302344 - RNA, 64 nt, Human
cccuggccguguguccccagguuuguuaccugcagcggcccaucacccuguggugcggccucaa

SEQ ID NO: 302345 - RNA, 64 nt, Human
cugggggucccgggcacugucgcgcuugcugcaggcggcccagccguguauuuauuuuucaccu

SEQ ID NO: 302346 - RNA, 64 nt, Human
ggcccaaggcgcagcgggagcgcacaggugccccgcggcccagccgggggauaacgcagggcgg

SEQ ID NO: 302347 - RNA, 64 nt, Human
gggagggcgggccuuggccccgagugaaggcgcggcggcccaaccggcgugagagcgcggggcc

SEQ ID NO: 302348 - RNA, 57 nt, Human; identical to SEQ ID NO: 302246

SEQ ID NO: 302349 - RNA, 64 nt, Human
ccagguuggugugagccugggcccggcccacucagcggcccacauuggccagcauucagcugca

SEQ ID NO: 302350 - RNA, 64 nt, Human
gacuccaggccccugagccuggcgggaaguggcugcggcccaggcagccaguccuggugguguu

SEQ ID NO: 302351 - RNA, 64 nt, Human
acuguagaguccccgcccacccccauggcccuaugcggcccagccccgaaugccuugaagaagu

SEQ ID NO: 302352 - RNA, 64 nt, Human
gccugaggcugccugcgcccaccccgcucugcaugcggcccagcccggcucccaccgaggcgcg

SEQ ID NO: 302353 - RNA, 64 nt, Human
cccaccccuucccaagccuucuagcgcagggccugcggcccagacguccagggagccggccccu

SEQ ID NO: 302354 - RNA, 64 nt, Human
ggggagcgacccgcagcugcucacuccaccuugcgcggcccauacugggcgugugcaucugaau

SEQ ID NO: 302355 - RNA, 64 nt, Human
caaucccaucaauauagucccuacaccuggggcugcggcccacaugucuucacggaggcuucca

SEQ ID NO: 302356 - RNA, 64 nt, Human
cccugaacacgggugugcagacucacccuaaagggcggcccaggccccacgcuagaaggcuggc

SEQ ID NO: 302357 - RNA, 64 nt, Human
aacucaagaguccgccugcuuggagcuggacccagcggcccagagucuagccagcuuggcucca

SEQ ID NO: 302358 - RNA, 62 nt, Human
ccgcccccuccgccgccccuuccccagcccugcccccgcagacucccccugccgccaagacu

SEQ ID NO: 302359 - RNA, 62 nt, Human
ccugggucaagccagcauccccuugguaaagacccccgcaggccaccaggcauucuggacac

SEQ ID NO: 302360 - RNA, 62 nt, Human
ugcuccuagaguaaggcucaucugggccucggcccccgcaccugguggccuuguccuugagg

SEQ ID NO: 302361 - RNA, 62 nt, Human
gggcugggccccuccaggagucacagaugaggcccccgcagagacuggugaguggugacccu

SEQ ID NO: 302362 - RNA, 64 nt, Human
ucauggucugaguggggcuuccugggcaguuggggcggcccacgccagcuggcccaguggguag

SEQ ID NO: 302363 - RNA, 64 nt, Human
ggacaggcuggcucagccugucuccagggcugcugcggcccagccccgagccugccucccucuu

SEQ ID NO: 302364 - RNA, 64 nt, Human
uccgugucgggguacacccagcacuuugcgaccugcggcccagcaggcgcggaggauggcgggg

SEQ ID NO: 302365 - RNA, 64 nt, Human
gaggccggcgcccaccaugcuccugggcgcccacgcggcccacagggcaagaacccggggccuc

SEQ ID NO: 302366 - RNA, 64 nt, Human
uguuuacucauguucuuucuuguugaugaguucugcggcccagcauauagaaauggcucagaac

SEQ ID NO: 302367 - RNA, 64 nt, Human
guuucugugacacacaaucagcgcggaccgcagcgcggcccagccccgggcacccgccucggac

SEQ ID NO: 302368 - RNA, 64 nt, Human
uucaggaagcuagaaaaggugucagugaccuguugcggcccagcggcuggagcagcagacguuu

SEQ ID NO: 302369 - RNA, 64 nt, Human
cucggcccugccccaaguagcccagaagccuccggcggcccaggauucuaaggaugcaauccuc

SEQ ID NO: 302370 - RNA, 64 nt, Human
cgaggcccgcaugcggcccaggauggcuuugaaugcggcccaacgcaaauucgcaaacuuucuu

SEQ ID NO: 302371 - RNA, 64 nt, Human
auuagaccaagcuuguccaacccgaggcccgcaugcggcccaggauggcuuugaaugcggccca

SEQ ID NO: 302372 - RNA, 64 nt, Human
cucagaggucucuaucccaucccuuccuguuacugcggcccaaggacaggaaacaacuuuucca

SEQ ID NO: 302373 - RNA, 64 nt, Human
ugcagcacugggcagacaugcuggcccacgcccggcggcccauugcccagcggcacccccugcg

SEQ ID NO: 302374 - RNA, 64 nt, Human
cuccugagacccagggggaccugccacugguaccgcggcccagccuggggccugggggcugccc

SEQ ID NO: 302375 - RNA, 64 nt, Human
cgcccgcccacuguccugggcgcccuggaagccggcggcccaagcccgacuugcuguuuuguuc

SEQ ID NO: 302376 - RNA, 64 nt, Human
agacaucauggggugauugcagaaagggggaguggcggcccacgcagcuucugcugaggagcug

SEQ ID NO: 302377 - RNA, 62 nt, Human
ugacaccggccccucccucuacccacccccuucccccgcaugcugaucccccugcccaggug

SEQ ID NO: 302378 - RNA, 62 nt, Human
cugaguugggugacuugguaccugcucaggaccccccgcacugucccaaucccacucaggcc

SEQ ID NO: 302379 - RNA, 62 nt, Human
ugcuugcugugacuccgccccugcccccucuccccccgcaugugggugcccccacuccccca

SEQ ID NO: 302380 - RNA, 62 nt, Human
cccccgacucugaaucccgggcgggaggaggacccccgcaccgcccccuccccagcguguaa

SEQ ID NO: 302381 - RNA, 53 nt, Human; identical to SEQ ID NO: 302271

SEQ ID NO: 302382 - RNA, 64 nt, Human
gaaggcuuaacauuaaguauuccuuggcccagcagcggcccagauugcggugugagauggugcc

SEQ ID NO: 302383 - RNA, 64 nt, Human
gcccccagguugagcaauaagaaaccagaaccuugcggcccaguggcccgggccaguucaggcc

SEQ ID NO: 302384 - RNA, 64 nt, Human
cacuuacagacuagcccagugugggcagaugccagcggcccagguggcgccauugcuguccugg

SEQ ID NO: 302385 - RNA, 64 nt, Human
ggcccccgcuggccaaggccuguggacgacgcuggcggcccagccugggcagguuucagggugc

SEQ ID NO: 302386 - RNA, 64 nt, Human
cagcaagcaggcagcgccccggcccgcggcccccgcggcccacucggcgcacucagccagcguc

SEQ ID NO: 302387 - RNA, 64 nt, Human
ggguaccccccauacuggcuuacuuccaccuccugcggcccagcucuguccuccagagccuagc

SEQ ID NO: 302388 - RNA, 64 nt, Human
acaggggaugaggaaggccucaggccacugcccagcggcccaggcauccuggguuucaccagug

SEQ ID NO: 302389 - RNA, 64 nt, Human
gcaccacagcgcuggggagagggaugaaggcucggcggcccagggcagcacccaaggucugggc

SEQ ID NO: 302390 - RNA, 64 nt, Human
cggggucugcucacauagccgguccccacgcccagcggcccacccaccagcagcugcuggaggu

SEQ ID NO: 302391 - RNA, 64 nt, Human
ggguuggguguacggguucuguuccucugagccugcggcccaccugauguuuacgugugugugu

SEQ ID NO: 302392 - RNA, 64 nt, Human
ccagccuugguaauggagaguuugcaaacacacagcggcccacagcuucacgugguggugugca

SEQ ID NO: 302393 - RNA, 64 nt, Human
gcacuggcucccacggagggugcgccugccgccagcggcccagccuugcugcccugucugcuga

SEQ ID NO: 302394 - RNA, 64 nt, Human
ccugugcccuugccggcggcagguugcagccaccgcggcccaaugucaccuucacucacagucu

SEQ ID NO: 302395 - RNA, 64 nt, Human
ggagugggggccgcgggcagccgcucuucagcucgcggcccaggggaguggcgaggggcgcccc

SEQ ID NO: 302396 - RNA, 61 nt, Human
agauggugguagaugugugacucuuaucagagaguaccacccaacacuuuugcuuucuucu

SEQ ID NO: 302397 - RNA, 64 nt, Human
gguaggaacaggucccaagcgguugagccuggcagaguaccaugcgcucggccccagcugcagg

SEQ ID NO: 302398 - RNA, 64 nt, Human
uugaauaaggugaagaauuucacacaacauacaagaguaccauuguuccuuauaucguuaaauc

SEQ ID NO: 302399 - RNA, 64 nt, Human
acucagggucaugcacuugcacaauguugagaaugaguaccacucucaccauugguauagccaa

SEQ ID NO: 302400 - RNA, 64 nt, Human
cuuagccaacuugaccccucucaucccacucccggcggcccaggcacagaagggcagggccaua

SEQ ID NO: 302401 - RNA, 64 nt, Human
cuuuccauccacucaccuuaccccauagcaucuugcggcccagaaaccagagccauuugucuca

SEQ ID NO: 302402 - RNA, 64 nt, Human
ucuuucaggucguguaugagaggugugaaaagcugcggcccacgcuguuccgguuggcgaguga

SEQ ID NO: 302403 - RNA, 64 nt, Human
uuucgcuaugggaggcagccgaggccuggccaaugcggcccacuuuccugagcugucgcugccu

SEQ ID NO: 302404 - RNA, 64 nt, Human
ggccaagggggccacuggcuaccccuacugcgcggcggcccaggagcucggacugcugguccug

SEQ ID NO: 302405 - RNA, 64 nt, Human
gaguggagucugagucugaguccugucucugccugcggcccagaaguuucccucaaaugcgcgu

SEQ ID NO: 302406 - RNA, 64 nt, Human
gacuaccauaccucacacagcguugguguugugagcggcccaugaaaagccaaauuaaaaauca

SEQ ID NO: 302407 - RNA, 64 nt, Human
ggaccucggaccuccaggcggcucagugcugccugcggcccagcuaaggggccuggccacuggg

SEQ ID NO: 302408 - RNA, 64 nt, Human
ggcaggccccuccaggcccaccagccugguucccgcggcccauuuggucagcuuccccgccacg

SEQ ID NO: 302409 - RNA, 64 nt, Human
ggucccaaagaguuugaugaggcccuccacaccugcggcccaauccaaggugggguggaagcuu

SEQ ID NO: 302410 - RNA, 64 nt, Human
gccuuccagcccugagcccgcccagaggagcccagcggcccaagagcccgugccacccccagcc

SEQ ID NO: 302411 - RNA, 64 nt, Human
gccucaguucccccagcuguaagacagggacggggcggcccaguggcugagaggagccggcugu

SEQ ID NO: 302412 - RNA, 64 nt, Human
cgggguccuggcgggugggacccgcagccuccacgcggcccaggccagccugccacccucuggg

SEQ ID NO: 302413 - RNA, 64 nt, Human
cgaccuugugcgaggcccucggggcccacccacagcggcccagggccagacccuggcuggaagc

SEQ ID NO: 302414 - RNA, 64 nt, Human
cguguccugccccgguuugcggacgagagaaaucgcggcccacaagcauccccccaucccuugc

SEQ ID NO: 302415 - RNA, 64 nt, Human
gguugggcaaggagacuuccaggacuuccagacagaguaccagguuuuauuuuucaccuuauuc

SEQ ID NO: 302416 - RNA, 64 nt, Human
uuaaguaauaaauguauagagagugucaagugaugaguaccaugaagaagaauaaaugagggua

SEQ ID NO: 302417 - RNA, 64 nt, Human
cuagggggaugauuauuagucacauagagcuugggaguaccacuggaaacguauggguaggagu

SEQ ID NO: 302418 - RNA, 64 nt, Human
ccgagggaggggaagcuucugucuccagcuucccgaguaccagugacacgucucgccaagcagg

SEQ ID NO: 302419 - RNA, 64 nt, Human
cacucccccuccugcugcuaugccugugacccccgcggcccacacacuggacugaccugcccug

SEQ ID NO: 302420 - RNA, 64 nt, Human
gcuccucuguucagucgcaaaggugaacacucaugcggcccagccaugggcccucugagcaacu

SEQ ID NO: 302421 - RNA, 64 nt, Human
uggccagagggacgccgcagcugggaccaggcacgcggcccauggggcugggccccugcuggcc

SEQ ID NO: 302422 - RNA, 64 nt, Human
agagggugcaguggagcccugagcauuguaauaugcggcccagccuauaaacagccuccgugcu

SEQ ID NO: 302423 - RNA, 64 nt, Human
uaaugucuccuccuuccccccucuucucucuccugcggcccagccucccucucccuccuccauu

SEQ ID NO: 302424 - RNA, 64 nt, Human
aaccuaucggggcauagcccagggaugcccccaggcggcccagguuagaugcgucccuuuggcu

SEQ ID NO: 302425 - RNA, 64 nt, Human
gccaggauagauguauucuagaguagggguggaggcggcccaggaggcugaagacaggugcaca

SEQ ID NO: 302426 - RNA, 64 nt, Human
gagcuggggccuuggggacccccagguaguccaugcggcccauuccuccccuucccacucccgc

SEQ ID NO: 302427 - RNA, 64 nt, Human
uguuggagggacaccagugcacuaggcagcuggggcggcccaggcugaagccaucuccgggugu

SEQ ID NO: 302428 - RNA, 64 nt, Human
ucccaccccacguacagcaagggacuccccaggugcggcccaaggcuccggaccacacuggccc

SEQ ID NO: 302429 - RNA, 64 nt, Human
uccgaagggaacuggcuggcuguccguccagugagcggcccagaccccaccucugcgccauugu

SEQ ID NO: 302430 - RNA, 64 nt, Human
guguggagguguggaggcccccugaggagcugcggcggcccagguacgaagcugcaacucugcg

SEQ ID NO: 302431 - RNA, 58 nt, Human; identical to SEQ ID NO: 302313

SEQ ID NO: 302432 - RNA, 64 nt, Human
aguagccugaccaucuggacacagcagagccagggcggcccagggacggcaggagagcucgcgg

SEQ ID NO: 302433 - RNA, 64 nt, Human
cguggccaaugugacuaccgugccagcagcgggggcggcccagccucugagucccguggggccc

SEQ ID NO: 302434 - RNA, 64 nt, Human
guguguggcauuuacaugguacccaggcuccacagaguaccaagauguugcccucugggaccac

SEQ ID NO: 302435 - RNA, 64 nt, Human
ucuccucugcuaggcuacccuccucuagaaggcugaguaccaugggcuacagugucuggccuug

SEQ ID NO: 302436 - RNA, 64 nt, Human
guuuuucaaaagugaacaauccugugauaaguuggaguaccauuuaguaauacagcaacauugu

SEQ ID NO: 302437 - RNA, 64 nt, Human
uaguaggcuguauucacugcuaauuuaaaaaagggaguaccaggauuuauuaaguaaagcauuu

SEQ ID NO: 302438 - RNA, 64 nt, Human
gcacgccccacguccagguggcagggaaagccgagcggcccacggccaggucggagcaguacuu

SEQ ID NO: 302439 - RNA, 64 nt, Human
auggacaaacgacuggacagacuuauuucucacugcggcccaguaacaggcuacaucuuugcuu

SEQ ID NO: 302440 - RNA, 62 nt, Human
ccuccagaggcccaccccucaugcaacagccgcccccgcaggcagggggcuggggacugcag

SEQ ID NO: 302441 - RNA, 62 nt, Human
agagacagacaugagagacaagcaucuucuuucccccgcaaguccauuuuauuuccuucuug

SEQ ID NO: 302442 - RNA, 62 nt, Human
uggacacguggccacaaaucugggacaaggggcccccgcacagcaugaaauaaaaagugccu

SEQ ID NO: 302443 - RNA, 62 nt, Human
gccuccauugcugcuuguucuggagacccccgcccccgcaccuuccagacuuagcagaagaa

SEQ ID NO: 302444 - RNA, 64 nt, Human
uguuaccuuuucagggcugacgucacauguagguggcguguaugaguggagacgggccuggguc

SEQ ID NO: 302445 - RNA, 64 nt, Human
gaccaaagaugauacucuguaaacaaggcccuucugaccggacucagugcgugugauggugagu

SEQ ID NO: 302446 - RNA, 64 nt, Human
gccgcgcuggggcucugucuuggugcacauggcuugaccggacuuucccugcuucccaccacuu

SEQ ID NO: 302447 - RNA, 64 nt, Human
guggggagacaccucagagccccgcaaaacccacugaccggaggcaaaaggcaguggggcuggg

SEQ ID NO: 302448 - RNA, 64 nt, Human
ugaugccagaccauuuggagaaguaucagaggccugaccggacacauaauaugacaaccacauu

SEQ ID NO: 302449 - RNA, 64 nt, Human
cuggaaaaguucuugucuccuggacugaaccaugugaccggaggccccuuuccuagucucaucc

SEQ ID NO: 302450 - RNA, 64 nt, Human
gggaagguggucuuggggcauggugcagagcaggugaccggagggaaucggugacggagcgggg

SEQ ID NO: 302451 - RNA, 64 nt, Human
gacccaggaacucagcuuccaaacaucugcaccuugaccggacucgccaucccgccgugggggu

SEQ ID NO: 302452 - RNA, 64 nt, Human
cgcgcaccugccacagccucagaggcccgcacaaugaccggaggaggggccgcuguggucuggc

SEQ ID NO: 302453 - RNA, 64 nt, Human
aacaguuauaucacaguugagaguuuaaucaaaaugaccggaucagcauauucuuuuuuuagau

SEQ ID NO: 302454 - RNA, 64 nt, Human
guacgguagugagcucuucaaaaugaaaacagaaugaccggauggccaucuguccuggaaacug

SEQ ID NO: 302455 - RNA, 64 nt, Human
aggugacauggugccaucaggaggcggcugcugcugaccggaguguccccuccaggugaagcug

SEQ ID NO: 302456 - RNA, 64 nt, Human
ggcaaacccugcaggacuuccguggcugaggcugugaccggaggccaggaaugccguugggugg

SEQ ID NO: 302457 - RNA, 64 nt, Human
ucaaucacuggacuccauggccuucccuucguguugaccggaccuuccuuccagggcuuuuccu

SEQ ID NO: 302458 - RNA, 64 nt, Human
aauguggagagcacauggccaugucuugcccccggaguaccacugggcgugggggguccuggca

SEQ ID NO: 302459 - RNA, 64 nt, Human
ugcugcugcacccaacuacugagcugagaccacugaguaccaggggcugggcucccugaugaca

SEQ ID NO: 302460 - RNA, 64 nt, Human
caaaaacaaaugauagauauagugacaguaccaagaguaccaggacucaauguuucauaugaag

SEQ ID NO: 302461 - RNA, 64 nt, Human
auggauuuuauuacacaugguggaagagagaagaggcguguagguuugcaaacaaaguuaagaa

SEQ ID NO: 302462 - RNA, 64 nt, Human
ccuuccccaccgcaggcaccccgggggcuggaggggcguguacccaaauccccgcgccaucagc

SEQ ID NO: 302463 - RNA, 64 nt, Human
caggcccguuucucaccugagcgcaccaccaccuggcguguagaaucuccaggaagccuggcug

SEQ ID NO: 302464 - RNA, 64 nt, Human
gaucguccugagugccaagcacguuuauaaguagggcguguauuccaguccuuucugucauucu

SEQ ID NO: 302465 - RNA, 64 nt, Human
cccgcccgaccccaccgcccucccgcccccaccuggcguguaguacuguauaaaccagucagcu

SEQ ID NO: 302466 - RNA, 64 nt, Human
acaaggaauuucccuggacgcuaauuaugagggaggcguguagcuucuuaucauuguaacuaug

SEQ ID NO: 302467 - RNA, 64 nt, Human
cugccuuuucuuuaacuuuuuuucuucuacuuuuggcguguaucugguauauguaaguguucag

SEQ ID NO: 302468 - RNA, 64 nt, Human
uuauuuguuuggaaucacucuugugugauauaaaggcguguauauuaucuuuguauuagaacca

SEQ ID NO: 302469 - RNA, 64 nt, Human
cuguguggacagucccgcccaggaggggccgcagggcguguaugagcaguuuugcaaacagaac

SEQ ID NO: 302470 - RNA, 64 nt, Human
cgcgugugcaggagccugcuccuccgagauacguggcguguagguugcuguaguuacagcgccu

SEQ ID NO: 302471 - RNA, 64 nt, Human
agcggcuugaccaaugaccuaugucacaagagguggcguguaaggaaugcagcccccugaagac

SEQ ID NO: 302472 - RNA, 64 nt, Human
ugaggaguaaaugugaucagcauguaaagugucuggcguguaguaggcucuuaauaaacacugg

SEQ ID NO: 302473 - RNA, 64 nt, Human
uuugaauaagugaauguuucuuuauugcauaacuggcguguagcacaaagaaaaagccccuucu

SEQ ID NO: 302474 - RNA, 64 nt, Human
gauuuggcugauccuccagggaccaguuucugugggcguguauuggagcagguuugucuuuaaa

SEQ ID NO: 302475 - RNA, 64 nt, Human
uccugccccugugcucggggccugggugguuacuggcguguagauggaauugcuuuuuuaauau

SEQ ID NO: 302476 - RNA, 64 nt, Human
uccugccucagccucccaaguagcugggauuacaggcguguaccaccauacccagcuaauuuuu

SEQ ID NO: 302477 - RNA, 62 nt, Human
gcuguugcgggugcgcggcagcuggagacacucccccgcagggccaaccccugcccuguugc

SEQ ID NO: 302478 - RNA, 62 nt, Human
ccccugugauccguaaggccggcggcucggggcccccgcagcagcagcagcagcagcagcag

SEQ ID NO: 302479 - RNA, 62 nt, Human
ggguuuguugaugaaccuccacccccaccccacccccgcacgccuguaaucccagcacuugg

SEQ ID NO: 302480 - RNA, 64 nt, Human
cacaagugcuuucuuuuaaguggcauuggcaauuggcguguaaugauggcaguagaaucugaau

SEQ ID NO: 302481 - RNA, 64 nt, Human
ugcuccgccugcccggcaucaucagcccuucuggggcguguaccucucacugccugccccagga

SEQ ID NO: 302482 - RNA, 64 nt, Human
cuucugggucuaggccaugguacaggagaacuguggcguguaggaggaauacuucaggaugagu

SEQ ID NO: 302483 - RNA, 64 nt, Human
ugaccaggccagguggggaggcuuuggcuggcugggcguguaggacggugagagcacuucuguc

SEQ ID NO: 302484 - RNA, 64 nt, Human
ugugggacguaggauugcacagggcugugccaguggcguguagggaacacugcccuggcucagc

SEQ ID NO: 302485 - RNA, 64 nt, Human
aauucuauaacuugagaucuuuccggggccuacaggcguguaagacagcuuggucuggucugug

SEQ ID NO: 302486 - RNA, 64 nt, Human
ccccauccuucuuccucuccagagaugccaggggggcguguaugcucugccccuucccucagac

SEQ ID NO: 302487 - RNA, 64 nt, Human
cgccuguuucugcccacagaauggcauccucaggggcguguacccuggcagccccaccagcugg

SEQ ID NO: 302488 - RNA, 64 nt, Human
gagcccaaaccacugacccacagacucugcaccccgacgccagagauaccuggagcgacggcug

SEQ ID NO: 302489 - RNA, 64 nt, Human
caccaucuaccacuacggccaccccaaaggaccccgacgccaacagacagucaaacgcugaugu

SEQ ID NO: 302490 - RNA, 64 nt, Human
ccuuccugcgggaggcccugccagcucccagcgacgacgccaccgcgcuuaugaccgaccccaa

SEQ ID NO: 302491 - RNA, 64 nt, Human
uugucauuaugggcagaugugugccauccccagccgacgccacucacugccuccuuccuccugg

SEQ ID NO: 302492 - RNA, 62 nt, Human
ggugucucugcccgcaggacgccugcccccagcccccgcagcccucuggcccccuccaucuc

SEQ ID NO: 302493 - RNA, 50 nt, Human
ccaccaaaccggcucuuugacccccgcagcccacgucccgcuuucagacc

SEQ ID NO: 302494 - RNA, 62 nt, Human
gcccauccccccucagauccagacaugccccucccccgcagacacaccccaaggcagcccaa

SEQ ID NO: 302495 - RNA, 64 nt, Human
guuggaaccgccggcguuggcuccgaagacuuagcgacgccacuggcggcaccuucuccugcgc

SEQ ID NO: 302496 - RNA, 64 nt, Human
uguggcugcccuuggcuggaaguccagggucauacgacgccauugccagaaugaagugacaaau

SEQ ID NO: 302497 - RNA, 64 nt, Human
cccaggagcaggagcugcugcucacggccagcgacgacgccaccaucaaagccuggcgcucccc

SEQ ID NO: 302498 - RNA, 64 nt, Human
ccuucugaacagagccugaggcggaugcagcccgcgacgccagaggaagcacgugcacuaacug

SEQ ID NO: 302499 - RNA, 64 nt, Human
uuaaaaauaguccuuuccuaaguuuuauauuugucgacgccaggucagucauuuuugcacuuaa

SEQ ID NO: 302500 - RNA, 64 nt, Human
gggcgggagcccauacccaggcuggcuccuggggcgacgccacgccagagggaggguuuaguac

SEQ ID NO: 302501 - RNA, 64 nt, Human
agaggagcugggagccgggccgcagacuugaccccgacgccacagcccagccacggacgcuggc

SEQ ID NO: 302502 - RNA, 64 nt, Human
cacgugggcaccguguaugcccuggcggucaucucgacgccagaccagaccaaagucuucagug

SEQ ID NO: 302503 - RNA, 64 nt, Human
cccaaccgggccuuugccggguaaggggcuaccgcgacgccacuuguccacgcagccaccaccg

SEQ ID NO: 302504 - RNA, 64 nt, Human
ggcuacagagggucucccucgaugacgacgacgacgacgccaccaccccagcccccgucuguga

SEQ ID NO: 302505 - RNA, 64 nt, Human
ggugcugucaacauuagcaagauaauggaaaucacgacgccagugggugcuuaccucccugcua

SEQ ID NO: 302506 - RNA, 64 nt, Human
cuucaccuaugugcagucgcucuacaaccaccugcgacgccacgaacugcgccugcgcggcaag

SEQ ID NO: 302507 - RNA, 62 nt, Human
cugucccuuucugugugaagaucacguuccuucccccgcaaugugcccccagacgcacgugg

SEQ ID NO: 302508 - RNA, 62 nt, Human
gaagcugccuuguggggacuuaccuggggugucccccgcaugccuguaccccagaugggugg

SEQ ID NO: 302509 - RNA, 62 nt, Human
aaacccagaugccugaggccuggcuggggcugcccccgcaggacacuguggccaugccacgg

SEQ ID NO: 302510 - RNA, 64 nt, Human
ggucaggggugaauggcucuuuucacagagaguagccaaccagagaccuuugcuuugauaucau

SEQ ID NO: 302511 - RNA, 62 nt, Human
uuuuaaccccaauuauccuucucucucuccugcccccgcaucccacucccagggugucacga

SEQ ID NO: 302512 - RNA, 62 nt, Human
gggacagcccuccugggaaucuacauuguguucccccgcauuccaggcucagggucugagga

SEQ ID NO: 302513 - RNA, 62 nt, Human
ucacaugcagaagagaaaaggccccccuccaccccccgcauucccugccgagugagagccag

SEQ ID NO: 302514 - RNA, 64 nt, Human
cuagaacugccauucccaagaccucugucucccagccaaccacccuuggaacuugccucuuguc

SEQ ID NO: 302515 - RNA, 64 nt, Human
uccuaacugcugcuucucagggaauccgacaccagccaaccauuuuaagccucuaaaagaccuc

SEQ ID NO: 302516 - RNA, 64 nt, Human
ugcuucuuucucagaauucaaaggagacgagucagccaaccacagcuacauuucaggcuuucuc

SEQ ID NO: 302517 - RNA, 64 nt, Human
accggggagcagcuggacacccagccaaggcccugccaaccaacugccucucugaggaggaggu

SEQ ID NO: 302518 - RNA, 64 nt, Human
ccuuggggaaacuugcagugggucaguggucugugccaaccaaacgauagccccauccaagcca

SEQ ID NO: 302519 - RNA, 64 nt, Human
gaaguaauuuggugcacagacaagcccuugagaagccaaccaccagaugcuggacacccucuuc

SEQ ID NO: 302520 - RNA, 64 nt, Human
acgggucaguauuaagguuuucaaccggaaggaggccaaccagcccgacagugccauccccacc

SEQ ID NO: 302521 - RNA, 64 nt, Human
agacaacuuuucaauuugauccaaauuugaacuggccaaccagucuuuaaaacacuggacuaga

SEQ ID NO: 302522 - RNA, 64 nt, Human
uguucuaagcaacuacuuuccuagaguaucauuugccaaccaaaaggcuuucagaggugugaau

SEQ ID NO: 302523 - RNA, 64 nt, Human
cagcuagcggcgacccaguguacgucccgccccggccaaccaugccaagccugccugccaggcc

SEQ ID NO: 302524 - RNA, 64 nt, Human
guacagcuuccggaucgucagccaccuugccuuugccaaccaccucugcuugccuguccacauu

SEQ ID NO: 302525 - RNA, 64 nt, Human
cuugucauucuuuguugccccuuuucugucaccagccaaccacauagccuugggaccagccucu

SEQ ID NO: 302526 - RNA, 64 nt, Human
ucuucaaauagcuugcuuacaugauaaucaauuagccaaccaugagucauuuagaauagugaua

SEQ ID NO: 302527 - RNA, 64 nt, Human
aauuugcagcugccagugcuuuccuuguggcccugccaaccagcucuuccaggacgaacucagu

SEQ ID NO: 302528 - RNA, 64 nt, Human
gcuggccuggcauuagucauuauuuaguuuccaggccaaccauccagauagagauucccucuuu

SEQ ID NO: 302529 - RNA, 62 nt, Human
uuuccuguggacgccggggaagcacagcaccacccccgcaccugcccucggccuuugugagc

SEQ ID NO: 302530 - RNA, 62 nt, Human
uugagugcagaagggugcgccucuucccucuacccccgcaccaccugcugugugccagccug

SEQ ID NO: 302531 - RNA, 62 nt, Human
ggggugcugcggcuacaccaccacccgcgcggcccccgcagccuagaccucccaggccugug

SEQ ID NO: 302532 - RNA, 64 nt, Human
auuugaccagggccuuuauuuggcaaauaacugagccaaccagaauaaaauaaccaauacucca

SEQ ID NO: 302533 - RNA, 64 nt, Human
cuucacacaugcuuauauccuuuaauaaccaauugccaaccacggcuauaagauuauuucagag

SEQ ID NO: 302534 - RNA, 64 nt, Human
cugaccccauugggaacacggaagucuauuccaggccaaccagcccaaaauuauuucaucuugu

SEQ ID NO: 302535 - RNA, 64 nt, Human
cuggagacccugaggucuaagcuacagccccucagccaaccacagacccuucucuggcucccaa

SEQ ID NO: 302536 - RNA, 64 nt, Human
aguccuuacaguucugagcagugggcggcugcaagccaaccaauauuuucugucauuuguuugu

SEQ ID NO: 302537 - RNA, 64 nt, Human
ccuaagccaguggcccucuaggaggggcagaagagccaaccagaggguuccuggaggucaucgg

SEQ ID NO: 302538 - RNA, 64 nt, Human
gcuccucagacugaccaacuccuagacaaaguuugccaaccauaagugucaaaagcacaggcca

SEQ ID NO: 302539 - RNA, 64 nt, Human
aucacauuaaaguacuugggcuucagaaguaagagccaaccaacugaaaaccugagauggagau

SEQ ID NO: 302540 - RNA, 64 nt, Human
acaguuggccaagaauuuuuuuucuuuuaaacaagccaaccaccuagcugguaauuaaugaggu

SEQ ID NO: 302541 - RNA, 64 nt, Human
agguggacucagagccuuccuugagcuaaacucggccaaccaaggcacgcagcauguccccuca

SEQ ID NO: 302542 - RNA, 64 nt, Human
aaauacgguuccaaauacgcuaaaaccaacuugugccaaccagauuuacagauuggaaauacug

SEQ ID NO: 302543 - RNA, 64 nt, Human
gauuuucauuucuucgcacuucugagacggcaaagccaaccacuuagaagccuuccacaucuuu

SEQ ID NO: 302544 - RNA, 64 nt, Human
uaccuucagcaguuaccgaggagcuaaacaugcugccaaccagcuuguccaacaacuccaggaa

SEQ ID NO: 302545 - RNA, 64 nt, Human
cuaaauauaaucaacguacagugagcucuuugaagccaaccaaggcaggcagaacccucuuaaa

SEQ ID NO: 302546 - RNA, 50 nt, Human
accugcccucaccagacugagccaaccaaccacuguggggcaugugggag

SEQ ID NO: 302547 - RNA, 64 nt, Human; identical to SEQ ID NO: 52342

SEQ ID NO: 302548 - RNA, 62 nt, Human
auuccugugccuacuuugccugaguucuucuacccccgcaguugccagccacauugggaguc

SEQ ID NO: 302549 - RNA, 64 nt, Human
auuuucagaagugucuggucaagauaacaugcuggccaaccacaauuccuagaguuaagagaac

SEQ ID NO: 302550 - RNA, 64 nt, Human
gacaugaaggggagggaggguguggggaugccuugccaaccagaagcccagccccaaggaugaa

SEQ ID NO: 302551 - RNA, 64 nt, Human
ucagcaucaccugcuuugaaauuagccuuagauugccaaccaauagaugagaauuuugaggaaa

SEQ ID NO: 302552 - RNA, 64 nt, Human
gauuugguuugggaucaauaggaaagcauaugcagccaaccaagaugcaaauguuuugaaauga

SEQ ID NO: 302553 - RNA, 64 nt, Human
gcuggccagagggucucugagggcaagagacauggccaaccaagggcaaggagugacccugugg

SEQ ID NO: 302554 - RNA, 64 nt, Human
ccuauaaggggcaggaagagcaaagcuguccuaggccaaccagagauucaucuuucaugcagug

SEQ ID NO: 302555 - RNA, 64 nt, Human
ucuucaaauggccuuaacuuggauugucuguuuggccaaccaugaaaauuaaagagugaagcag

SEQ ID NO: 302556 - RNA, 64 nt, Human
uuauuccuucuaccuuuaaaaauuuugagaacuugccaaccagggauuaaagcuauuaucuuga

SEQ ID NO: 302557 - RNA, 64 nt, Human
cuuuucauaagugguauguuuaauuggucauucagccaaccaucaguauuuuccccccacaaca

SEQ ID NO: 302558 - RNA, 64 nt, Human
uuuuuauuucuaucagcaguacuaaaauguaucagccaaccagagaacaucagugacuuuaacu

SEQ ID NO: 302559 - RNA, 64 nt, Human
ccccagaggggagcuccgagggcaggugcacauagccaaccaaugugagguuggcggacugcgc

SEQ ID NO: 302560 - RNA, 64 nt, Human
gaacaccugcacuuagaaaaaguggacagcuucugccaaccacacccuacccaugguacuguau

SEQ ID NO: 302561 - RNA, 64 nt, Human
uuuucagauccugaauuccagcaaaagagcuauugccaaccaguuugaagaccgccccccgccu

SEQ ID NO: 302562 - RNA, 64 nt, Human
cuaaguuuuuguuucauuuugauuuuuuuuuuuagccaaccaccuugucaggaaaggaugaacc

SEQ ID NO: 302563 - RNA, 64 nt, Human
cuuuaacaggacaaacuuacugcagcuugaaggagccaaccauggauuugaggcgugugaagga

SEQ ID NO: 302564 - RNA, 62 nt, Human
gccgccaucucucccuuccugccucauuucaucccccgcagcagccgggauugauugugcuu

SEQ ID NO: 302565 - RNA, 62 nt, Human
cugucugggaggcccuuaugagggcagcccagcccccgcacccacccccaaccagagaagca

SEQ ID NO: 302566 - RNA, 62 nt, Human
uucauuagucauggguggaagaaaaaccacaccccccgcaccccuccguucuuucugcauag

SEQ ID NO: 302567 - RNA, 64 nt, Human
aauaccuaauguaaaugacgaguuaaugggugcagccaaccaaccuggcacauguauucauaug

SEQ ID NO: 302568 - RNA, 64 nt, Human
guuaucugcuggaaguuaucgauaggacuguguggccaaccaagugcuugugagaucacugaca

SEQ ID NO: 302569 - RNA, 64 nt, Human
gugguccuuggccaccauucaggcuuuccaagaagccaaccaccuuggagauuuuuuuucuuga

SEQ ID NO: 302570 - RNA, 64 nt, Human
uuacuaauauuuguuguaaaagugaaacuuguuugccaaccaauaaacaacugauugagauuua

SEQ ID NO: 302571 - RNA, 64 nt, Human
ugcagccugaaauuuuaaaaaaguuguguaauacgccaaccagucaaguuguguuuuggccaga

SEQ ID NO: 302572 - RNA, 64 nt, Human
gaagagugagaagcagauggaggagaagagaagagccaaccagaagagcucugcacagggaccc

SEQ ID NO: 302573 - RNA, 64 nt, Human
aguuaucaugaaaagcuuuuuuuuuuuuuuuuuugccaaccauugccaaugucaaucaaucaca

SEQ ID NO: 302574 - RNA, 64 nt, Human
ugaccucccaaagugcugggauuauagccaugcugccaaccauguguaggguauguauauguuc

SEQ ID NO: 302575 - RNA, 64 nt, Human
uaguuauuuauuacaaaauuauauucaccuaaaugccaaccaucuacaaaaacaaugaguaauu

SEQ ID NO: 302576 - RNA, 64 nt, Human
cuuuuuucuuuaccgauguauuuuccuacucauagccaaccaauaaauucaguaucuguuucaa

SEQ ID NO: 302577 - RNA, 64 nt, Human
cugcugcaggucagcaacugugucgugagcagcugccaaccaccagccuuucuggugcuguucu

SEQ ID NO: 302578 - RNA, 64 nt, Human
uacuuauauaccuuuaauuuuuccuauuugaaaagccaaccacuuaacacauuacucauagcac

SEQ ID NO: 302579 - RNA, 64 nt, Human
uucagaaggagugguagaaaaaaacacacauucagccaaccacuuauaugaauugaauguauca

SEQ ID NO: 302580 - RNA, 64 nt, Human
guucucuguugccagggggcaggucugggccugggccaaccacguuuguuaucauggcugcugc

SEQ ID NO: 302581 - RNA, 62 nt, Human
aguacaaaccuuaaauccaaaggcucuucucagagccaaccacuuuguccgugaaaagggcu

SEQ ID NO: 302582 - RNA, 62 nt, Human
ugcuggcagcuggcaucgugucgcuuuaucugcccccgcacaguuugcuuuguacgucugcc

SEQ ID NO: 302583 - RNA, 62 nt, Human
acccgccugagacggugcugugcaggggaaagcccccgcacccacacaggaauucugcugag

SEQ ID NO: 302584 - RNA, 62 nt, Human
guuaaaggaguuccugucaccugcuccccccacccccgcaugcgucuguccacuuggcuaac

SEQ ID NO: 302585 - RNA, 64 nt, Human
cugguggucccgcuccacuacaacgaguccuacagccaaccaguguacaagcccuaccugaccu

SEQ ID NO: 302586 - RNA, 64 nt, Human
ccaccaggaggaagaccugacugaauuccucugcgccaaccacgugcugaagggaaaagacacc

SEQ ID NO: 302587 - RNA, 64 nt, Human
acucccuauucgaaaauuagugcuggaauaucuggccaaccauaugcagaagaaugaaacugaa

SEQ ID NO: 302588 - RNA, 62 nt, Human
gugugcuaaccaaaacccaaaggcucuuuucagagccaaccaccuuuucuauaaaaguugcu

SEQ ID NO: 302589 - RNA, 64 nt, Human
ucuuguuuuacccauguugggucagccugaaacugccaaccaguaggaagcauggacucuccug

SEQ ID NO: 302590 - RNA, 64 nt, Human
ucugaugugaauucagauuuccaaucuucuccuagccaaccauuuuccuggaauuaaaaauuca

SEQ ID NO: 302591 - RNA, 64 nt, Human
uugugcaguaggaccugcuccccugaaggacggggccaaccagccacuggcuuuccugcccagg

SEQ ID NO: 302592 - RNA, 64 nt, Human
accugaacugaaaggacugugugaccucccccaagccaaccacuuucaccugggaugacuuucg

SEQ ID NO: 302593 - RNA, 64 nt, Human
gaguaggaaaaaagaaugacucaaauguauuauugccaaccaagucgucaaaucuaaugucaag

SEQ ID NO: 302594 - RNA, 64 nt, Human
caugggauguguccaguauugaaaaggcugcacugccaaccaugauuugugagccuucugggaa

SEQ ID NO: 302595 - RNA, 64 nt, Human
uguggaguuagguggaagccagauuuuaaaaguugccaaccaggagauuuaacagguacaguua

SEQ ID NO: 302596 - RNA, 64 nt, Human
cagagagagagagagagagagagagugucuucaugccaaccacagccuguuucugcugaguuuc

SEQ ID NO: 302597 - RNA, 64 nt, Human
ggagcauuguccaggcauggccuguggcccgagggccaaccaccgagcaggcacagcacagcag

SEQ ID NO: 302598 - RNA, 64 nt, Human
caugggauguguccaguauugaaaaggcugcacugccaaccaugauuugugaaccuucugggaa

SEQ ID NO: 302599 - RNA, 64 nt, Human
guguaggaaagagcagaccaaaaucagcccuagagccaaccagucagucccaaagcugugaccu

SEQ ID NO: 302600 - RNA, 62 nt, Human
uuuccccagcaccccagagccagucgggacaccccccgcagcccguccugguggcuguggaa

SEQ ID NO: 302601 - RNA, 62 nt, Human
ucccugaggaacagccaggaccccaucugccacccccgcagcagugacccccacccagggcc

SEQ ID NO: 302602 - RNA, 62 nt, Human
uucuucagacugaggccuuuugguagucggagcccccgcagucgucagccucccugacgucu

SEQ ID NO: 302603 - RNA, 64 nt, Human
aauagcucuuucucauuuuuagagaagucaaauagccaaccaucaaaauuaagaauaaauugaa

SEQ ID NO: 302604 - RNA, 64 nt, Human
gcccucccugaccucccaggcugcggcucagguggccaaccaggcccugauccggggugacugg

SEQ ID NO: 302605 - RNA, 64 nt, Human
cugauuugccuagauucugagagucuggcccauagccaaccacauuuuccuuugggauaauuua

SEQ ID NO: 302606 - RNA, 64 nt, Human
gcgaucuuucuuagucccacucaccccacucagggccaaccacagaaugcccccucccugcuga

SEQ ID NO: 302607 - RNA, 64 nt, Human
gagaaggagggaggucucgggaguguagcaccaugccaaccagcccugcgcgaagacagaguga

SEQ ID NO: 302608 - RNA, 64 nt, Human
aagaugucuucauucccaagguuacuggauagaagccaaccacagucuauaccauagcaauguu

SEQ ID NO: 302609 - RNA, 64 nt, Human
agauguuaggcaucuccuguauguaagacacaaggccaaccacaacacagaacgauguugaccu

SEQ ID NO: 302610 - RNA, 64 nt, Human
auauguacagaaaaaaaggacugcaaguaaauaugccaaccauuuuaauaaaggaucucucugg

SEQ ID NO: 302611 - RNA, 64 nt, Human
agcucuugauuuggguggaaaacagggugcuaaagccaaccagccuuuggguccugggcaggug

SEQ ID NO: 302612 - RNA, 64 nt, Human
gacaguuacccccaaccugaccagugucuacauugccaaccacaggccucucuucacacacuug

SEQ ID NO: 302613 - RNA, 64 nt, Human
caucaaggccccaguggcaaccaugugguaaguggccaaccaagcccuacccagggucacccaa

SEQ ID NO: 302614 - RNA, 64 nt, Human
gcaaggaaugaccuguuccaggcgcccuccucaggccaaccacagcgucuugggugggcaggac

SEQ ID NO: 302615 - RNA, 64 nt, Human
uuuacuuguggaaaccaggaaauugcuccucucagccaaccaagguugaccacacaccacccuu

SEQ ID NO: 302616 - RNA, 64 nt, Human
ccucccaaaauuguuuugagcuuuccauguugcugccaaccauaccuuccuucccugggcugug

SEQ ID NO: 302617 - RNA, 64 nt, Human
ugccugucucccgaagcagguucgagccacaagggccaaccaggaggccccuggagcccagauc

SEQ ID NO: 302618 - RNA, 62 nt, Human
aucauuuuuggcuccgagaagagggcaaggggcccccgcaggguacuucugugcuugcccuc

SEQ ID NO: 302619 - RNA, 62 nt, Human
uaccucccacagaacgugguggacuccuucuucccccgcagcaugacccgguuuuaugccaa

SEQ ID NO: 302620 - RNA, 62 nt, Human
uccaauuccaaagccagaccagaagauucuaucccccgcagcgcucuccuuugagcaagccg

SEQ ID NO: 302621 - RNA, 64 nt, Human
ugcuguggcacaaagaaaagcugcuaaaucuauagccaaccaggggaccacaguagugggcaag

SEQ ID NO: 302622 - RNA, 64 nt, Human
gaaaguuaaaaucuagaaagaccuuagagaaccagccaaccaacucucucauuuuaaaagugaa

SEQ ID NO: 302623 - RNA, 64 nt, Human
auucagcuguguccagccugccacccauacguaggccaaccaagcacuucaugaagaggaggcc

SEQ ID NO: 302624 - RNA, 64 nt, Human
gucucuauuagucaguaaugaagacgacagccuggccaaccaagggaaaggaaauuaguaucuu

SEQ ID NO: 302625 - RNA, 64 nt, Human
cauucauuacucagcuuccuuccugaccaagucugccaaccaauggccagcuaugcgccucauc

SEQ ID NO: 302626 - RNA, 64 nt, Human
ccaggcucaugucuuuacaccuucacucagccacgccaaccagagacuggguuccaaucucacc

SEQ ID NO: 302627 - RNA, 64 nt, Human
ggacaguccugaugacacagcccucagcgagagugccaaccaggccuuccuggugagugcgggg

SEQ ID NO: 302628 - RNA, 64 nt, Human
aucccaggauuuauggugucugucuauggccacagccaaccagaaugagugggucaucuuauaa

SEQ ID NO: 302629 - RNA, 64 nt, Human
agagccugucuuggcauaaugcagugucaccugugccaaccauggggugucccgugagugugag

SEQ ID NO: 302630 - RNA, 64 nt, Human
aagugcugugcgcuugucagaccaucagaccagggccaaccaaucagaaggcaacuuacuguau

SEQ ID NO: 302631 - RNA, 64 nt, Human
aucccuagccauucuggaucuugugacccuccaugccaaccagcuucccuacuccuacccuggc

SEQ ID NO: 302632 - RNA, 64 nt, Human
uugggguaaggaucaggacuuuguccauguaguagccaaccacccucuucccugauucccgucc

SEQ ID NO: 302633 - RNA, 64 nt, Human
uucaaacuacauugcccacccugaagguggauaagccaaccaugcccuccauagagguccccua

SEQ ID NO: 302634 - RNA, 64 nt, Human
aaaaaaaaaaaaaaaaaaaaggcaauugugcggagccaaccaucacugccauuacacucacauu

SEQ ID NO: 302635 - RNA, 50 nt, Human
ccauugaagagguugauuaagccaaccaaguguagauguagcauuguucc

SEQ ID NO: 302636 - RNA, 62 nt, Human
gaccuuggggggagaacagaagggggacgacgcccccgcaccuccugcgaucuggcuggcuu

SEQ ID NO: 302637 - RNA, 62 nt, Human
cuccagaauccugaugguaucaauggauuuaucccccgcaaagacaucaaaccugaguauca

SEQ ID NO: 302638 - RNA, 62 nt, Human
gggguccagaguaaggaugugcggcccccaggcccccgcacaccucccucagcaccaagacc

SEQ ID NO: 302639 - RNA, 64 nt, Human
gguuacagggagucaucaucagcccuaccccuuggccaaccacaucucccugcuguguccccug

SEQ ID NO: 302640 - RNA, 64 nt, Human
ucugaucacuggauugggcugagcagagaacaaggccaaccauggaaauggauaaaugguacug

SEQ ID NO: 302641 - RNA, 64 nt, Human
uguacaaagugauaggaguagagcugugaaugaggccaaccagauuuccacucucucggagcuc

SEQ ID NO: 302642 - RNA, 64 nt, Human
caaauaagcauaucauaucaaauacaauauuccagccaaccaguuaauucucuuccugguuaca

SEQ ID NO: 302643 - RNA, 64 nt, Human
gcacauccaaggcuuccuggcagcucucacuacggccaaccaggacggcagggucauccugagc

SEQ ID NO: 302644 - RNA, 64 nt, Human
uccagccagguugaaugagcucauuuuuguuguagccaaccaguaagauuugcuaauguucuac

SEQ ID NO: 302645 - RNA, 64 nt, Human
ugggagugggcagugggguggcuaauugucuucggccaaccaggggccuguugcccaggcaacu

SEQ ID NO: 302646 - RNA, 64 nt, Human
uugauuguugaaugauagaugaaguauugcugaagccaaccagagaucuugaucucucucugag

SEQ ID NO: 302647 - RNA, 64 nt, Human
cuugaaggugauagccaucuacuuuccaguggcugccaaccacagggagugccaguuaacacug

SEQ ID NO: 302648 - RNA, 64 nt, Human
aaaauuguauaaaaaugaacacugccaagauaaagccaaccagacccuucaucaaagaaauugu

SEQ ID NO: 302649 - RNA, 64 nt, Human
cagcaucuuccacaguuuuccaaacuggauagcugccaaccagcagacauuacccacuugaaau

SEQ ID NO: 302650 - RNA, 64 nt, Human
uggugauuauaaaaguuccuaggaggcuagaagagccaaccaacagagaagggaaagcagucug

SEQ ID NO: 302651 - RNA, 64 nt, Human
gaggcacucaagaugaaaacuacuucaacuaaaagccaaccacuugaacaaggugagugaaguc

SEQ ID NO: 302652 - RNA, 64 nt, Human
uuagcaccgaagugugguccucagaccagugccugccaaccagauguuacuggucugugaggaa

SEQ ID NO: 302653 - RNA, 64 nt, Human
gcagccagucaaaaaguaaaaugaagagaggcacgccaaccacuccaaaauuuugagucuugca

SEQ ID NO: 302654 - RNA, 62 nt, Human
auuguaacuaaaaucuuccucaggacuauuaacccccgcaaaguuucuauagggaacugccu

SEQ ID NO: 302655 - RNA, 62 nt, Human
ggggagaaaaacucucaucccugacccuuccccccccgcaaauguuagaccagagcuguuga

SEQ ID NO: 302656 - RNA, 62 nt, Human
ccggcuucccuuacccuaucacuggccucaggcccccgcaggcugccucuucccaaccuccu

SEQ ID NO: 302657 - RNA, 64 nt, Human
acaaaacauuacucauuugauuucccccacccccgccaaccauuuaaaaaaguuugccggcuag

SEQ ID NO: 302658 - RNA, 64 nt, Human
agcuugggguuuuuuuuuuuccuuuguuaagaaagccaaccaaucacaaugauauagucauugu

SEQ ID NO: 302659 - RNA, 64 nt, Human
ucaacucgugauggaaccacaaaaggucacacaagccaaccaugucaugccagaguacaaaaca

SEQ ID NO: 302660 - RNA, 64 nt, Human
ccauuaucugagcagcuucaaagaccccugagcugccaaccacggagaugugccaagcaucuca

SEQ ID NO: 302661 - RNA, 64 nt, Human
uuuagcauauaaucaagaaauaaccaugaaaauagccaaccagcagcccucagggcugcuuugc

SEQ ID NO: 302662 - RNA, 64 nt, Human
uguccgaugggggcaggagcucccauccugggcagccaaccaggcaacaccaaggacucuuugu

SEQ ID NO: 302663 - RNA, 64 nt, Human
cuugcccucuaccuccugauaggcuugaggguuugccaaccacacuguggcuacagguggaggg

SEQ ID NO: 302664 - RNA, 64 nt, Human
gcaaggagagcccuggggucagugacacugucaggccaaccaugcacuccacaaaggggagcau

SEQ ID NO: 302665 - RNA, 64 nt, Human
ggaggaaaaaaugugaaucuuaccagcaguuccagccaaccaagugauucuucuucauucuuga

SEQ ID NO: 302666 - RNA, 64 nt, Human
auguaaagcggacaguuugaaacuuggggcauaugccaaccaaaacuucguuucugcaugucag

SEQ ID NO: 302667 - RNA, 64 nt, Human
gcucugaggggacagacaaggcuuggguguauaugccaaccagaucucauugaaguaucagcuu

SEQ ID NO: 302668 - RNA, 64 nt, Human
ugcccugcaggcuggcucccgggggucucugauggccaaccaaggggccacccagggaccucua

SEQ ID NO: 302669 - RNA, 64 nt, Human
uauuaauuucacauacuuaaaaaguagauaaugugccaaccagaagcacaagaguuccuacaca

SEQ ID NO: 302670 - RNA, 64 nt, Human
ggaacaagcugauggacugcgcaucucugagaaugccaaccagaggcggcagcccacccuuccu

SEQ ID NO: 302671 - RNA, 64 nt, Human
gaugcacauucugcugugaggaggcccagaaaaggccaaccagggcccaaccgugcaugaugac

SEQ ID NO: 302672 - RNA, 62 nt, Human
ccgaguuggggggaggggguguggcaacgugccccccgcagaggccacgcauguuugaccaa

SEQ ID NO: 302673 - RNA, 62 nt, Human
agccuggccuguaacuuauaaagugcaccucgcccccgcaagccccagccccgaggaccguc

SEQ ID NO: 302674 - RNA, 64 nt, Human
augaucuaaaugagggguagugggggauggaagagaguaccaggugguccaccguuggggagug

SEQ ID NO: 302675 - RNA, 64 nt, Human
ggucagagguggcuuucugaggccuggaaggcaggccaaccagcaaaauccugauaacaagacu

SEQ ID NO: 302676 - RNA, 64 nt, Human
ggcagagaggaggagagguguugccggcuggagggccaaccagugaacaccagcugugaaggcc

SEQ ID NO: 302677 - RNA, 64 nt, Human
ucugugggcuucagcacuuuaaagaggcuguguggccaaccaggacccaggguccccuccccag

SEQ ID NO: 302678 - RNA, 64 nt, Human
aacugcacacaaucugaaaaccacugaaggacaagccaaccacagcagccaagcccacuccuug

SEQ ID NO: 302679 - RNA, 64 nt, Human
accugugaaauguccuuaguuugggucauauaaagccaaccauuuuugaggaccauguaccuag

SEQ ID NO: 302680 - RNA, 62 nt, Human
ucuuccagaccugcuuccugaaauaaacacuggugccaaccaagacagcugugugcuucuuu

SEQ ID NO: 302681 - RNA, 64 nt, Human
gacgccuugagccgagggcauaugcgggggggcagccaaccagagcuggucacuccucaggacc

SEQ ID NO: 302682 - RNA, 64 nt, Human
aaagccaauggcuucucccucuuuaaggugcuaugccaaccagcccuggaggcugggaucugcc

SEQ ID NO: 302683 - RNA, 64 nt, Human
cuuaaaggugaaaguagcaggaacaacaacaaaagccaaccaaaaacaagguagccagugcaag

SEQ ID NO: 302684 - RNA, 64 nt, Human
uagaggguaaauaugacuccuuucucuaucccaagccaaccaagagcacauucuuaaaggaaaa

SEQ ID NO: 302685 - RNA, 64 nt, Human
agcugcuucugggggauuucaagggacugggggugccaaccaccucuggcccuguugugggggu

SEQ ID NO: 302686 - RNA, 64 nt, Human
ggauuuugagaucaucagugauacuaagguggaugccaaccagagaagcugcuaccccuacauc

SEQ ID NO: 302687 - RNA, 64 nt, Human
aacuucagcagaagaaaaauuacuuaguccuuaggccaaccaauuuaacugcagugucauguuu

SEQ ID NO: 302688 - RNA, 64 nt, Human
cagagauggaacacaccagaccccagaucacaaagccaaccaugcccagccccucccagcaccc

SEQ ID NO: 302689 - RNA, 64 nt, Human; identical to SEQ ID NO: 302688

SEQ ID NO: 302690 - RNA, 64 nt, Human
aggcggguccgggucgcaggaccaucccggccggcgcgcucaucccacccgcccaccgcagggu

SEQ ID NO: 302691 - RNA, 64 nt, Human
ugaggcgggcgggucccgagcccaggagggaacccgcgcucaggcggacggcgccgacucuuuu

SEQ ID NO: 302692 - RNA, 62 nt, Human
cuugcacaggguggggcgcgcaguaggaaccucccccgcaggagcuggcgcccucucgcucc

SEQ ID NO: 302693 - RNA, 64 nt, Human
cagagauggaacacaccagaccccagaucacaaagccaaccaugcccggccccucccagcaccc

SEQ ID NO: 302694 - RNA, 64 nt, Human
uaaauugagagauaaacaaugacaagagcugccagccaaccacacuauucaaaaagcaaagugu

SEQ ID NO: 302695 - RNA, 64 nt, Human
guggugaggaccccugaggccuccugggagaucugccaaccacgcccacgucauuugcauacgc

SEQ ID NO: 302696 - RNA, 64 nt, Human
aaaauaauaauaaaacaugcaucauuuuucauuugccaaccaagcacaaaguuauuuuauacug

SEQ ID NO: 302697 - RNA, 64 nt, Human
ggcugcagcccuguugcaauuccaugcuucccccgccaaccagcuccugcugccauccccaggg

SEQ ID NO: 302698 - RNA, 64 nt, Human
cucuccuccguggcacauggcacaagcacaagaagccaaccaggagagaguccuguagcucugg

SEQ ID NO: 302699 - RNA, 64 nt, Human
uugcauuucauacgguaaaugaggacucagcacagccaaccauaaucagcaugucugggauaga

SEQ ID NO: 302700 - RNA, 64 nt, Human
ugauaaccuuccccguugucauagcuauuucauugccaaccaacuccaucacaugguuguugau

SEQ ID NO: 302701 - RNA, 64 nt, Human
acguucuccgcgggugcuucgcggacaaggugcagccaaccacacgagcaauacugugcuggag

SEQ ID NO: 302702 - RNA, 64 nt, Human
ugcaucggcaaggccaaguugaacaccggauggugccaaccaucgguuguuuggcagcagcuuu

SEQ ID NO: 302703 - RNA, 64 nt, Human
gaaggucaggauagcaugagauagucucaauguggccaaccaaaaggacaaaacugacaggaau

SEQ ID NO: 302704 - RNA, 64 nt, Human
uuuucuccuuggguauuacaaguuuuugucuggagccaaccaagcuugccaccaacauauugag

SEQ ID NO: 302705 - RNA, 64 nt, Human
gaggaucagagcccauugcacaagaagagccgcugccaaccauccuuguccuccgauugcaaaa

SEQ ID NO: 302706 - RNA, 64 nt, Human
ugguugaccucucagcaagugcuauccaggcugggccaaccagacccacaauuaacugagccuc

SEQ ID NO: 302707 - RNA, 64 nt, Human
caugugacaacaugcaagaaguacugccaauacugccaaccagagcagcucacucgagaucuuu

SEQ ID NO: 302708 - RNA, 62 nt, Human
cguggaaaguugcugggcccccgcccccggcucccccgcacgcaugcauccacugcggccgg

SEQ ID NO: 302709 - RNA, 62 nt, Human
gagugaggugagcaccaugguuucucagccugcccccgcauggcaguuccuagguugcaguu

SEQ ID NO: 302710 - RNA, 62 nt, Human
cuuagagcuguuaggacccgauggggaggcagcccccgcaguggacaacccccgcuuggaca

SEQ ID NO: 302711 - RNA, 64 nt, Human
ugcgagugugagagugugagcagggcuugcuccugccaaccacaauucaaugaauccccgaccc

SEQ ID NO: 302712 - RNA, 64 nt, Human
uuggccucccaaucuugcccuaggauacccagaugccaaccagacaccuccuucuuccuagcca

SEQ ID NO: 302713 - RNA, 64 nt, Human
uccaccaucuauagugagccucuccauaauuagugccaaccauuagucucguucauauuuuuac

SEQ ID NO: 302714 - RNA, 64 nt, Human
uagccacaaaaaguauaaaauaccuaggaauacagccaaccagguaagugaaagauuucuacaa

SEQ ID NO: 302715 - RNA, 64 nt, Human
accugggaugaucaagcuugguggggggaggggcgccaaccauuaccaaagcuugaauaggugg

SEQ ID NO: 302716 - RNA, 64 nt, Human
aauguucaacaccauaacuagagacacucaaauugccaaccaggacaagaaguugaugacuuca

SEQ ID NO: 302717 - RNA, 64 nt, Human
agacuuugcugauaaaacagauugcaguaaagaagccaaccaaaucccaccaaaaccaaguugg

SEQ ID NO: 302718 - RNA, 64 nt, Human
uuuuuaugcuuacacuccauccaaaccuaacucugccaaccacuuuucuccuaucaguauaauu

SEQ ID NO: 302719 - RNA, 64 nt, Human
guguugggauuacaggugugagccacagcaccuggccaaccaacacuucucagggccucuuuca

SEQ ID NO: 302720 - RNA, 64 nt, Human
cagugauuuaguaaaacaccccagagucagggaagccaaccaccuugaaaccuuuagaacaucu

SEQ ID NO: 302721 - RNA, 64 nt, Human
ugggccuuuugaggccauuuuaguuugaguucgagccaaccaccucuguugguuagaugaugaa

SEQ ID NO: 302722 - RNA, 64 nt, Human
caacauugcauccuuucuggggugaagaaucugggccaaccagggguccuugggccucuagaag

SEQ ID NO: 302723 - RNA, 64 nt, Human
guuuauggguuucuuccagcagaacagagacauugccaaccauauuggaucugcuugcugucca

SEQ ID NO: 302724 - RNA, 64 nt, Human
uucccucuccucaugcccccuuccagcggcuucugccaaccauggggggcuggaccaccauggc

SEQ ID NO: 302725 - RNA, 64 nt, Human
aggcgaaaguaauggggaagauuagaaagaauuagccaaccaggcuacaguugauauuuaaaag

SEQ ID NO: 302726 - RNA, 52 nt, Human
gaggcccccgcgcgcucuagugcccccgcacgcgggagccacgaaccucggg

SEQ ID NO: 302727 - RNA, 62 nt, Human
uucugugcuguccacacucucuugccucccgacccccgcacucccuucuagcacccccaaag

SEQ ID NO: 302728 - RNA, 62 nt, Human
caggcacacagggcccggccacacccagcggccccccgcacagccacccguggggugcugcc

SEQ ID NO: 302729 - RNA, 64 nt, Human
acauaaaggacacagacaaggaacuugcugaaaggccaaccauuucaggaucagucaaaggcag

SEQ ID NO: 302730 - RNA, 64 nt, Human
gcagaauccagggucugcagcaccugcuguuguugccaaccagucucccaaagcuccuugcucc

SEQ ID NO: 302731 - RNA, 64 nt, Human
gcagcauuucgugaaggucauccagggcuacaucgccaaccagauccugcacgucaccuggugc

SEQ ID NO: 302732 - RNA, 64 nt, Human
ggccuuuauguucuuucacccauccuaggaaccagccaaccaucauguguagagccccuacugu

SEQ ID NO: 302733 - RNA, 64 nt, Human
gcccaaaguugccucacuuccacuauucucagcagccaaccaggauuuggcagcugcuccacug

SEQ ID NO: 302734 - RNA, 64 nt, Human
caccuucaaagucuuauugacacaguaaagggaggccaaccacuacuaacaaguucuagaagau

SEQ ID NO: 302735 - RNA, 64 nt, Human
ucagaugugaacuuaaccuguuucuggcuggcuagccaaccagcauggaaaacagauuagguua

SEQ ID NO: 302736 - RNA, 64 nt, Human
acaggaaauggacuauuuuugcaguccaacaucagccaaccacacacagccguguuuggaagcu

SEQ ID NO: 302737 - RNA, 55 nt, Human
uccaguuguugaugccuugaguuuugccaaccauggauggcaaaugugaugugcu

SEQ ID NO: 302738 - RNA, 64 nt, Human
cucacgcugaggucaggaguucgagaccagccuggccaaccaacauggugaaaccucgugucua

SEQ ID NO: 302739 - RNA, 55 nt, Human
ccacccuggccaagaucugaccugggcccaccaagguggacgcugggccccgcca

SEQ ID NO: 302740 - RNA, 64 nt, Human
ggcagcuauuuccugagccuaguaccccaauuaagcccaccauugguuagcacacucagcgcug

SEQ ID NO: 302741 - RNA, 64 nt, Human
cagacucuccugguuguguaacugaagauguucugcccaccagcaccagaggucacucuccaca

SEQ ID NO: 302742 - RNA, 64 nt, Human; identical to SEQ ID NO: 171233

SEQ ID NO: 302743 - RNA, 64 nt, Human; identical to SEQ ID NO: 171234

SEQ ID NO: 302744 - RNA, 64 nt, Human; identical to SEQ ID NO: 171235

SEQ ID NO: 302745 - RNA, 64 nt, Human; identical to SEQ ID NO: 171236

SEQ ID NO: 302746 - RNA, 64 nt, Human; identical to SEQ ID NO: 171237

SEQ ID NO: 302747 - RNA, 64 nt, Human; identical to SEQ ID NO: 171238

SEQ ID NO: 302748 - RNA, 64 nt, Human; identical to SEQ ID NO: 171239

SEQ ID NO: 302749 - RNA, 64 nt, Human; identical to SEQ ID NO: 171240

SEQ ID NO: 302750 - RNA, 64 nt, Human; identical to SEQ ID NO: 171241

SEQ ID NO: 302751 - RNA, 64 nt, Human; identical to SEQ ID NO: 171242

SEQ ID NO: 302752 - RNA, 64 nt, Human; identical to SEQ ID NO: 171243

SEQ ID NO: 302753 - RNA, 64 nt, Human; identical to SEQ ID NO: 171244

SEQ ID NO: 302754 - RNA, 62 nt, Human
cuccagcugagccugucucugaauuguucccucccccgcaaugugggcacuuaccauguucc

SEQ ID NO: 302755 - RNA, 62 nt, Human
gaugggagaagaaggaaggggguggcccgucacccccgcaagacuugcauccagguagccua

SEQ ID NO: 302756 - RNA, 64 nt, Human; identical to SEQ ID NO: 171245

SEQ ID NO: 302757 - RNA, 64 nt, Human; identical to SEQ ID NO: 171246

SEQ ID NO: 302758 - RNA, 64 nt, Human; identical to SEQ ID NO: 171247

SEQ ID NO: 302759 - RNA, 64 nt, Human; identical to SEQ ID NO: 171248

SEQ ID NO: 302760 - RNA, 64 nt, Human; identical to SEQ ID NO: 171249

SEQ ID NO: 302761 - RNA, 64 nt, Human; identical to SEQ ID NO: 171250

SEQ ID NO: 302762 - RNA, 64 nt, Human; identical to SEQ ID NO: 171251

SEQ ID NO: 302763 - RNA, 64 nt, Human; identical to SEQ ID NO: 171252

SEQ ID NO: 302764 - RNA, 64 nt, Human; identical to SEQ ID NO: 171253

SEQ ID NO: 302765 - RNA, 64 nt, Human; identical to SEQ ID NO: 171254

SEQ ID NO: 302766 - RNA, 64 nt, Human; identical to SEQ ID NO: 171255

SEQ ID NO: 302767 - RNA, 64 nt, Human; identical to SEQ ID NO: 171256

SEQ ID NO: 302768 - RNA, 64 nt, Human; identical to SEQ ID NO: 171257

SEQ ID NO: 302769 - RNA, 64 nt, Human; identical to SEQ ID NO: 171258

SEQ ID NO: 302770 - RNA, 64 nt, Human; identical to SEQ ID NO: 171259

SEQ ID NO: 302771 - RNA, 64 nt, Human; identical to SEQ ID NO: 171260

SEQ ID NO: 302772 - RNA, 64 nt, Human; identical to SEQ ID NO: 171261

SEQ ID NO: 302773 - RNA, 64 nt, Human; identical to SEQ ID NO: 171262

SEQ ID NO: 302774 - RNA, 64 nt, Human; identical to SEQ ID NO: 171263

SEQ ID NO: 302775 - RNA, 64 nt, Human; identical to SEQ ID NO: 171264

SEQ ID NO: 302776 - RNA, 64 nt, Human
cuacaacaaugucuuccacaacucaaacucccaccgcgcucacacaaccgguccacuccugccu

SEQ ID NO: 302777 - RNA, 64 nt, Human
gguaaagaaaaguugccgaagaugagacugcccacgcgcucagacaugauaugcggcuaugccu

SEQ ID NO: 302778 - RNA, 64 nt, Human
uagcacuuugcgaggccgagguggguggauugcccgcgcucaggaggucaagaccagccugggc

SEQ ID NO: 302779 - RNA, 64 nt, Human
cgcacucgcagcugcuggacuugggccccaucgacgcgcucaacuucuucugugagcagcugcg

SEQ ID NO: 302780 - RNA, 64 nt, Human
ggggugugcgcugccccggcaccugcuugcccuccgcgcucaucuggggccgcagcaugccuau

SEQ ID NO: 302781 - RNA, 64 nt, Human
gaaucaugggcacggagggccgcccgccacgccccgcgcucaacugcucccguggaagauuaaa

SEQ ID NO: 302782 - RNA, 64 nt, Human
cagccucagccccggaagccgagcgagcggccggcgcgcucaucgccggggagcccgccaggug

SEQ ID NO: 302783 - RNA, 64 nt, Human
acucuuaugcccccaaccugcccuaccaccaccacgcgcucagccugauguguuuacaugguac

SEQ ID NO: 302784 - RNA, 64 nt, Human
cgagaggcgaagcccacuuuuguauaccggccggcgcgcucacuuuccuccgcguugcuuccgg

SEQ ID NO: 302785 - RNA, 57 nt, Human
agcuggaggacauggcuuaggucaaggcgcgcucagaugccggagccccaagacucu

SEQ ID NO: 302786 - RNA, 64 nt, Human
gggauuugaaccggucugucuucacugagguccucgcgcucagaaaaggaccuugugagacgga

SEQ ID NO: 302787 - RNA, 64 nt, Human
gcgugccgcucugcccgcuccgccuaggcuccuccgcgcucaccacucaguacggcgccgccuu

SEQ ID NO: 302788 - RNA, 64 nt, Human
gcacgggugguccccguuccaccccaagagaacucgcgcucaguaaacgggaacaugcccccug

SEQ ID NO: 302789 - RNA, 64 nt, Human
gguggccaggggggauuuccgaaucuccaucaggcgcgcucauaguuguccccauugucuaccc

SEQ ID NO: 302790 - RNA, 64 nt, Human
aauacuuggcccgccggcuucccgcugcccccaucgcgcucacgcaauaaccggcccggccccc

SEQ ID NO: 302791 - RNA, 64 nt, Human
acgccaacuugacccucaccagcauuaucaggagcgcgcucagcaaguugguaguuuccucccc

SEQ ID NO: 302792 - RNA, 64 nt, Human
ggccucggcucuuuacuccauucacagccaugcacgcgcucaagccaccagggugcgagaugcc

SEQ ID NO: 302793 - RNA, 64 nt, Human
gggggccgccggcgcucaaccacgcugugcugcgcgcgcucaugcacgcggccgccccgggagc

SEQ ID NO: 302794 - RNA, 61 nt, Human
aguaucuuuuacaaaagugacuggcuccacucccccgcacaggacucaacagauguugacu

SEQ ID NO: 302795 - RNA, 62 nt, Human
caggcccugggacucugagcguccgugucucucccccgcaacccauccucagccggggccgu

SEQ ID NO: 302796 - RNA, 64 nt, Human
acuuccucauucauugagcuuuuuaaaagaucacaaccucaagaugguuaaaauccauugacau

SEQ ID NO: 302797 - RNA, 64 nt, Human
cugggaagauggcuggugaggagcuuaacagaggaaccucaagaagauucugaaaauccuaccc

SEQ ID NO: 302798 - RNA, 64 nt, Human
cuugagaagcaguuggagagacaugacuuguuaaaaccucaaggaaucaagacauguuacucug

SEQ ID NO: 302799 - RNA, 64 nt, Human
cauggaugggaugcuggugguggaagcgguccacaaccucaaggcugucuucaaggggcgggac

SEQ ID NO: 302800 - RNA, 59 nt, Human
accccuucucaacucuguaacauggacgcaaccucaacccagcgcaguuacaacuucac

SEQ ID NO: 302801 - RNA, 64 nt, Human
aaugugcuaaaguuggaaaguccccgucccccagaaccucaagucuagaaaccaguauggaagg

SEQ ID NO: 302802 - RNA, 64 nt, Human
uaugggcacaacucugguguccuucuauggagaaaaccucaaguaaaguuuuauucugccuuug

SEQ ID NO: 302803 - RNA, 62 nt, Human
ggccuggugcagcccacucugugccuggacaucccccgcaggccgccgcgucuguguugggg

SEQ ID NO: 302804 - RNA, 62 nt, Human
agcagccugugcaaauucugaugauggccccacccccgcacacgcacacgcacaucaugcuu

SEQ ID NO: 302805 - RNA, 62 nt, Human
aacugugcuuaucaaaauugugaacacccccacccccgcauuuuuguguguugaaauucuug

SEQ ID NO: 302806 - RNA, 64 nt, Human
guaggugguuuugaagagaauaaauucaucagauaaccucaagucacaugagaaucuuagucca

SEQ ID NO: 302807 - RNA, 64 nt, Human
ucugagaaaaaaagugagagaccucugccuacaaaaccucaaaccagucacuuuugucaauugc

SEQ ID NO: 302808 - RNA, 64 nt, Human
aacuuauaguaaggaaacucacuugauuuuaucuaaccucaaacuuuccaaguuuaauggaucg

SEQ ID NO: 302809 - RNA, 64 nt, Human
uugaucuuucuguccauguggcucuaucuuuuaaaaccucaaggcccuccacuguccuaagaua

SEQ ID NO: 302810 - RNA, 64 nt, Human
cuaaaauguuuuuccuacagucuacaugaauacaaaccucaauagcuaagcuugacguauuugu

SEQ ID NO: 302811 - RNA, 64 nt, Human
uucaccauguuggcugggcuggucucgaacuccuaaccucaagugauccacccgccucagccuc

SEQ ID NO: 302812 - RNA, 64 nt, Human
auuguuauuuaauagcugugaucagugauuuucaaaccucaaauauaguauauuaacaaauuac

SEQ ID NO: 302813 - RNA, 64 nt, Human
accauucuaggcaacaccccugaagggcauaccuaaccucaauaguguuggcuuuuaaaacgua

SEQ ID NO: 302814 - RNA, 64 nt, Human
aaacagcuuucgaaagugacccucaaagaaugagaaccucaagcaucugggauccaguggagcu

SEQ ID NO: 302815 - RNA, 64 nt, Human
uagugaucuguauaaagucaguaguucuuagcugaaccucaacugugaggaaucuaugacucca

SEQ ID NO: 302816 - RNA, 64 nt, Human
aacuaggauacccaagacugaagaaacaagaagaaaccucaaguguauugacacguaaagaagc

SEQ ID NO: 302817 - RNA, 64 nt, Human
cugcuuaaaggagaccauuuguagcaguuggcuuaaccucaacuucuaaaacuacauugaaaau

SEQ ID NO: 302818 - RNA, 64 nt, Human
aagaaaaaacggcuuucauuaccaaauaauguaaaaccucaaaagcaagggcuucaacagccuu

SEQ ID NO: 302819 - RNA, 62 nt, Human
agccuggggggcgccggguggcaaaggacucacccccgcacaggcccgccuggcuucgaguu

SEQ ID NO: 302820 - RNA, 62 nt, Human
ccaggaccugagcucccagcaucugcagacgacccccgcagccuuucccucggaccccccuc

SEQ ID NO: 302821 - RNA, 62 nt, Human
ggaucaaagaaauucagaacagccugccuguccccccgcacuuuuuacauauauuuguuuca

SEQ ID NO: 302822 - RNA, 62 nt, Human
guucuagucaauucugaaccaccaccccccgccccccgcaaaaaaguaaaagucaaaccaaa

SEQ ID NO: 302823 - RNA, 64 nt, Human
ucaaggucaggagugauuuuugcauuugguggaaaaccucaagucagacucaguggcagaacau

SEQ ID NO: 302824 - RNA, 64 nt, Human
uguauaucuuuccuuuuguuuacaacuguuaaaaaaccucaaaauaguucucuucaaaagaaga

SEQ ID NO: 302825 - RNA, 64 nt, Human
acguaaccacaguaaagcagacuccccuuucagcaaccucaaagcaaaaaaaaaaaaaaaaaaa

SEQ ID NO: 302826 - RNA, 64 nt, Human
auagugcugccucccugcgggcagacaggagaggaaccucaacucaguccauuucauagcccug

SEQ ID NO: 302827 - RNA, 64 nt, Human
uuugccauguugcccagacuggucuugaacucccaaccucaagcaauccuccugccucagccuc

SEQ ID NO: 302828 - RNA, 64 nt, Human
ggacugagguuuaggaaguuuguuacugguuaaaaaccucaaaugaaaugcgaaagaauuugaa

SEQ ID NO: 302829 - RNA, 64 nt, Human
uuugucuuguacuacuuugacccaccccugaauaaaccucaauugcuggagugggguguaguua

SEQ ID NO: 302830 - RNA, 64 nt, Human
gucagaauuuuaaaaccaaauuacugcuuuuugaaaccucaaauuauauaauguaucuuaugua

SEQ ID NO: 302831 - RNA, 64 nt, Human
acucuagggaccugccucacggaccuuagggaaaaaccucaaccugaaagaucucuuccuuucu

SEQ ID NO: 302832 - RNA, 64 nt, Human
uuucugaaucauauuggggaagcagugauuuuaaaaccucaaguuuuuaaacaugauuuauaug

SEQ ID NO: 302833 - RNA, 64 nt, Human
guuauacaguucaaggcuuucuauguuguuaaugaaccucaaaauagccguuaagacaugaaau

SEQ ID NO: 302834 - RNA, 64 nt, Human
ccacgauacugguccugguuuggggggauucugaaaccucaaacuaauagaacuuucuucucuu

SEQ ID NO: 302835 - RNA, 64 nt, Human
uucauuaaaggaauuuuagccaucaucuaguucaaaccucaacuauuacagguagaaaaucagg

SEQ ID NO: 302836 - RNA, 62 nt, Human
cucagccucccaaccccagggcccccacaggccccccgcagcacccugcagagcacacaggu

SEQ ID NO: 302837 - RNA, 59 nt, Human
gcgggggcgacucagcuugagccccuccacccccgcaggcugcagagcaaggaugaagc

SEQ ID NO: 302838 - RNA, 62 nt, Human
cccaccccacccacccucggggcgccccccuccccccgcaagccagccugggccagccccgc

SEQ ID NO: 302839 - RNA, 62 nt, Human
gcacugaccacacccaccccguucggccccgccccccgcacugaacacacccgcccucaacc

SEQ ID NO: 302840 - RNA, 64 nt, Human
uuuaugguauaacuagggggaaaugagcugcacaaaccucaauguauuuuaaaucuguugcugu

SEQ ID NO: 302841 - RNA, 64 nt, Human
ugaaguuggcaaaaacaaauacaaacaagcaaaaaaccucaaauuuuuuucagcagugagagag

SEQ ID NO: 302842 - RNA, 64 nt, Human
guggaaauaacccuagauaaaaauucagucugauaaccucaaaucaaaaagcuuuaaauaaauu

SEQ ID NO: 302843 - RNA, 64 nt, Human
gagagggcaagagugagcaagagauggaaguugcaaccucaagcucuuuuauaaugagcauuaa

SEQ ID NO: 302844 - RNA, 64 nt, Human
uauagggacauuuuucucugauagcuggaaguugaaccucaaccagguauaaaagaugcauaac

SEQ ID NO: 302845 - RNA, 64 nt, Human
aaaauuguauguguacuuucaugccaguauaggaaaccucaaucuuuuuuuuuuuucgccuuua

SEQ ID NO: 302846 - RNA, 64 nt, Human
gcuguggucuccucugcaaagcauuuuaauuaaaaaccucaauaaagauggcccugcccacacu

SEQ ID NO: 302847 - RNA, 56 nt, Human
gugaccaagacgaucuuuaacaauucaaccucaaauuucuaauuucaccaacaacu

SEQ ID NO: 302848 - RNA, 64 nt, Human
aaugaagucuuugauggguaggagagagagggaaaaccucaaacuacaucauagaaguauguua

SEQ ID NO: 302849 - RNA, 64 nt, Human
aggagaggcagauucccucagugucuuccucuuaaaccucaaucaucgagacauuaggggguau

SEQ ID NO: 302850 - RNA, 64 nt, Human
augggugauagaaacagcuuuuugaaguaaugaaaaccucaaaagaucauguugauucuuaauu

SEQ ID NO: 302851 - RNA, 64 nt, Human
cugccacagaaaagaaggggagagauguucauguaaccucaaaauacuuaggcuugguuuugau

SEQ ID NO: 302852 - RNA, 64 nt, Human
cuuccaaauccugaaauagauguuuuaaagaugcaaccucaaacaccaaugcuguuguuaaaga

SEQ ID NO: 302853 - RNA, 62 nt, Human
ugagacuccccgcccgcccuccucugcccccucccccgcagacagacagacagacggacggg

SEQ ID NO: 302854 - RNA, 62 nt, Human
gcagccugcccagcagcacauuccagucacugcccccgcacucccacagggcucaggcuggg

SEQ ID NO: 302855 - RNA, 62 nt, Human
ggaacugcucagcuaggcaggugcccccaucccccccgcauucuggccuaggcaggagagga

SEQ ID NO: 302856 - RNA, 62 nt, Human
cgagucuggagaagggaggcgccuggcuguaucccccgcaggcccucuuccgagagccuucc

SEQ ID NO: 302857 - RNA, 64 nt, Human
ucuuugaaagaaagaaaaaucucuugcugugucaaaccucaaaauguugcuauugggguuagaa

SEQ ID NO: 302858 - RNA, 64 nt, Human
aaagagguuagacuuucagacuucuuuuuucucaaaccucaaaacuuccaccccaaacuucgcu

SEQ ID NO: 302859 - RNA, 64 nt, Human
aucgggguguauuggaacacgcaauguccuucgaaaccucaacacgaggccuaagaauuuccua

SEQ ID NO: 302860 - RNA, 64 nt, Human
aacucuccuaaaauguguuucauucuaguaagaaaaccucaaaggauauuguaggauauaaauc

SEQ ID NO: 302861 - RNA, 64 nt, Human
ugcuuucuuggcaggcucguuguaccucuuggaaaaccucaaugcaagauaguguuucagugcu

SEQ ID NO: 302862 - RNA, 64 nt, Human
gcagcugcuagggagaucagggaaacacugauguaaccucaaagccucucaccauuccucuugg

SEQ ID NO: 302863 - RNA, 64 nt, Human
gagcuggaaaccugggguggguuggccaaaggagaaccucaagcuccuggccugauccagcucc

SEQ ID NO: 302864 - RNA, 61 nt, Human
cuuuuuacacaacucccuaaagaguuauuuuaaccucaaaaauuagcuaacuuuuugcaga

SEQ ID NO: 302865 - RNA, 64 nt, Human
acuucuuuggggugaucuauaguuugaaaacuaaaaccucaaagacagauguuacagaaucagc

SEQ ID NO: 302866 - RNA, 64 nt, Human
aaaguauuuuaucugcugcuuauuuguggaaugaaaccucaaacaaacccaaagggggagggua

SEQ ID NO: 302867 - RNA, 64 nt, Human
uacagccccaccaucauccccuucucauuuuauaaaccucaaaguggauucacuuucugauagu

SEQ ID NO: 302868 - RNA, 64 nt, Human
gccaccgcaggauaccucagucauaccaguuguaaaccucaagccccugacccccaagggcaca

SEQ ID NO: 302869 - RNA, 64 nt, Human
uagucaccccaaguagucugcucacaguaacccaaaccucaaguaaacuccccuuucccucgcu

SEQ ID NO: 302870 - RNA, 62 nt, Human
gaguuggacacuccgagagugcagcuguucuccccccgcaccauccguguccugcauucugc

SEQ ID NO: 302871 - RNA, 62 nt, Human
ggccccugucgagcuggggucccagccaggugcccccgcaugcccuccugcaguugcuggau

SEQ ID NO: 302872 - RNA, 62 nt, Human
uccuggggacauuuccucaaagcaguuuugcgcccccgcaagggaauggucagccuaagggu

SEQ ID NO: 302873 - RNA, 62 nt, Human
acccauuaaacaguaauucccacuccucccagcccccgcagccaccauucugcuuucugucu

SEQ ID NO: 302874 - RNA, 64 nt, Human
caugccaagggaauccacccagaaugcaccccugaaccucaagaucacgguccagccucugccg

SEQ ID NO: 302875 - RNA, 64 nt, Human
agcaaacuuucaccuauucaugaguuauuauugaaaccucaaaucauaaagacauuuaaaagaa

SEQ ID NO: 302876 - RNA, 64 nt, Human
uaguuggcuaacugaccuggaaagaaaaagcaauaaccucaaagugacuauucaguuuucagga

SEQ ID NO: 302877 - RNA, 64 nt, Human
gcuaauuuaacguggaauuccuucauuucauaagaaccucaaaauaauggugauacauucuagc

SEQ ID NO: 302878 - RNA, 64 nt, Human
auauaaaucugcuguuaggagcuccaguugcuaaaaccucaauuuaagucuuuaaaagguugua

SEQ ID NO: 302879 - RNA, 64 nt, Human
uguagcaaaguuauggggucugcuugagggcacuaaccucaacagauuauuccuccucuccuua

SEQ ID NO: 302880 - RNA, 64 nt, Human
acagucuaccuuauuuaaagcuucuacugggauaaaccucaauuccuuuauucaggaaaggaua

SEQ ID NO: 302881 - RNA, 64 nt, Human
gggcuuauaucuaauaauacagagcacuaucucuaaccucaacaguugacauuuuaaaaguuuu

SEQ ID NO: 302882 - RNA, 64 nt, Human
uuuauacacauuuuauuuguaucauuucauguuaaaccucaaauaaaugcuuccuuaugugauu

SEQ ID NO: 302883 - RNA, 64 nt, Human
uuuccugaaguauucugauaaauguguuuuuuaaaaccucaauauacuuuuuagaaaaggagca

SEQ ID NO: 302884 - RNA, 64 nt, Human
ugagaccuuaaaauaauuuauaucuugauguuaaaaccucaaagcaaaaaaagugagggagaua

SEQ ID NO: 302885 - RNA, 64 nt, Human
gcuggaauguaguggagagaucauagcucacuguaaccucaaacuccuggacucaugcaaucuu

SEQ ID NO: 302886 - RNA, 64 nt, Human
ggaugauuuuuaaacugucaaaugaaguaguguuaaccucaaauaggcuaaaugugaacaaaua

SEQ ID NO: 302887 - RNA, 62 nt, Human
acuguuggcugcuccccacccgccucccgccucccccgcagguuaugucagcagcucugaga

SEQ ID NO: 302888 - RNA, 62 nt, Human
uggggggcccuugaugccacuaaucccccgaccccccgcaucugccaaacugcacagacaca

SEQ ID NO: 302889 - RNA, 62 nt, Human
uggaggcgucuacacuggcuccacauccacuucccccgcagcucgugugggcgcucguccac

SEQ ID NO: 302890 - RNA, 62 nt, Human
cacugugugugucaccauauaacugcaccucacccccgcacgugugcaugacucgcagagaa

SEQ ID NO: 302891 - RNA, 64 nt, Human
cucacgcccgacguggcuucugaaacgugcauucaaccucaaacuuuugcauaaaauagaauga

SEQ ID NO: 302892 - RNA, 64 nt, Human
ucaagaacuuucucugccaucaacuacuauucaaaaccucaaauccacccauauguuaaaauuc

SEQ ID NO: 302893 - RNA, 64 nt, Human
uguuuacagccaaaagaaaugccucauaguucuuaaccucaacuuuuguagaaguauuuuuuuc

SEQ ID NO: 302894 - RNA, 64 nt, Human
uaaagccugcuaaaucauucacuuagaaugaaguaaccucaagguaccaaauaccccacauaag

SEQ ID NO: 302895 - RNA, 64 nt, Human
ccuuccucuagccucuugucacauguggugcacaaaccucaaccugacagcuuucagacagcau

SEQ ID NO: 302896 - RNA, 64 nt, Human
uacaaaccuuuaauauaucagugcuccaguauauaaccucaaacaaauguaaauagaacgaauu

SEQ ID NO: 302897 - RNA, 64 nt, Human
uugcaggccaaaccguacuguauuuccuucucauaaccucaaggaaccauaugugcuacccaca

SEQ ID NO: 302898 - RNA, 64 nt, Human
uaaaccucuuucuucugcuuuuuccugaucuucaaaccucaaagagccaaguuaaaaauaauug

SEQ ID NO: 302899 - RNA, 64 nt, Human
caggaagggcugauuucaaaaucugggggcgagcaaccucaaggaacacaauuucccucccuau

SEQ ID NO: 302900 - RNA, 64 nt, Human
cuauguuuuagaguugcaguaaaacuuugaugauaaccucaauaauagcaaaguuuucgucuuu

SEQ ID NO: 302901 - RNA, 64 nt, Human
uuuuuuuaagggccuuggagccaucucuaaaacaaaccucaagggauuuagugcccugucuccc

SEQ ID NO: 302902 - RNA, 64 nt, Human
uauucgcauguagauauaauguacauaacaguuuaaccucaaaguugcuggagucagggccccc

SEQ ID NO: 302903 - RNA, 64 nt, Human
augucuuguucuugagauuuuguauauuuaggaaaaccucaagcaguaauuaauaucuccugga

SEQ ID NO: 302904 - RNA, 62 nt, Human
uggcaugccccccagcuacuguaugcccccgacccccgcagaggcagaaugaacccauaggg

SEQ ID NO: 302905 - RNA, 62 nt, Human
gcaugggaaacagugcagugacucacccccugcccccgcaccaaccacccauauucaggaga

SEQ ID NO: 302906 - RNA, 62 nt, Human
cggcccugccuccccaggcggugccccugagccccccgcagcggcccgagcuggcggaagcc

SEQ ID NO: 302907 - RNA, 62 nt, Human
cgcccccagcgagccggggacccacccaccaccccccgcaccgccgacgccgccucguucgu

SEQ ID NO: 302908 - RNA, 64 nt, Human
agcugugaccucuccccuggaacugucucucaugaaccucaagcugcaucuagaggcuuccuuc

SEQ ID NO: 302909 - RNA, 64 nt, Human
guggaauggauuuguaagguaaucuuuauagauaaaccucaagcaacgauucauguuguaaccg

SEQ ID NO: 302910 - RNA, 64 nt, Human
aagccuggguucuagauaauaccagaucuaccuaaaccucaagucuauguuaaaguugcuuucc

SEQ ID NO: 302911 - RNA, 64 nt, Human
guuuuuugccaaaaaugccccagacuuuuucccaaaccucaaaaacgucuuggaaaaauuguaa

SEQ ID NO: 302912 - RNA, 64 nt, Human
ggaaaaaaaaacaagcaaacuugaacacugaagcaaccucaagcaucucuuuauuuugaugaua

SEQ ID NO: 302913 - RNA, 64 nt, Human
ugaauguuaagcagauggaaugcuguguuaaauaaaccucaaaaugucuaagauaguaacaaug

SEQ ID NO: 302914 - RNA, 64 nt, Human
uguucagagagaaugaauugcuuaaacuuugaacaaccucaauuucuuuuuaaacuaauaaagu

SEQ ID NO: 302915 - RNA, 64 nt, Human
cuucuugguuaugcagaaacaguagaaccuguguaaccucaaggagauauuguaugaaucucac

SEQ ID NO: 302916 - RNA, 64 nt, Human
ccugccucuauuaauguauuuuuauuuaucauguaaccucaaagugccuucuguauuguguaag

SEQ ID NO: 302917 - RNA, 64 nt, Human
accuuuacaauacuguauaaucagaaguucucugaaccucaauuguauaucuagacauaaaaau

SEQ ID NO: 302918 - RNA, 64 nt, Human
gcaaacagcguccauuuuuucauauuagagguggaaccucaagaaugacuuuauucuuguaucu

SEQ ID NO: 302919 - RNA, 64 nt, Human
uuacuugauguuugccuugaaagaaucaacuucuaaccucaaccauccaggaaauugacagugg

SEQ ID NO: 302920 - RNA, 64 nt, Human
uguguguguaucagugucucaaugugaagauuguaaccucaagauuaggaaucuuaaaagagcc

SEQ ID NO: 302921 - RNA, 62 nt, Human
uuucucauauagcccucagucacugagggagucccccgcaggauuggagaggcacauucccu

SEQ ID NO: 302922 - RNA, 62 nt, Human
aaagugcuguacaaauuccacccgccccaggacccccgcaccugcccucuggcaccagaugc

SEQ ID NO: 302923 - RNA, 64 nt, Human
agccucagccucccgaguagcugggauuaugggcgcccaccaccaugcccagcuaauuuuugua

SEQ ID NO: 302924 - RNA, 64 nt, Human
ccuccccagcaagcaaccugaaaucucagcagaugcccaccauuucucuagaucgccuagucuc

SEQ ID NO: 302925 - RNA, 64 nt, Human
acaguuuucgugcuuccuccugacagcgacagaaaaccucaagggcuuucccacguugacacca

SEQ ID NO: 302926 - RNA, 64 nt, Human
uauuuuacaaauuauagcuaugucuugugaaaauaaccucaaaaagaaaaauacgacucuguug

SEQ ID NO: 302927 - RNA, 64 nt, Human
aagacagccuuuaaucccccuccuccccagaaggaaccucaaaagguagaugagguacaagguc

SEQ ID NO: 302928 - RNA, 64 nt, Human
auaccagguuggugguaaguuggucgcaugugaaaaccucaacuauuuaaucaucaugauucau

SEQ ID NO: 302929 - RNA, 64 nt, Human
gcuggagugcaguggcaugaucauagcucauuguaaccucaaacuccugggcucaagagauccu

SEQ ID NO: 302930 - RNA, 64 nt, Human
agacucugucucaaaaaaaaaaaaaaaaaaaauuaaccucaaccaaacgccuauuuuuuaaugc

SEQ ID NO: 302931 - RNA, 64 nt, Human
auaccuggcugcgugugcagcugaggagggagugaaccucaagccuaaauaccuguuaggauug

SEQ ID NO: 302932 - RNA, 64 nt, Human
auggauaguauauuugcuguaaacuacaauguaaaaccucaauaaaagugcgcuguacuucuua

SEQ ID NO: 302933 - RNA, 64 nt, Human
cgcccugcggaaacagaaacauagacugagaacaaaccucaagacuaucagugugaccucccca

SEQ ID NO: 302934 - RNA, 64 nt, Human
uguguaaaugcuuaaauuucagaauuaccaucagaaccucaauugacauuccuuugaauacgcu

SEQ ID NO: 302935 - RNA, 64 nt, Human
gaggaggaaaaaaaaaaaaaagaaaagaaccaacaaccucaacugccuacuccaaaauguuggu

SEQ ID NO: 302936 - RNA, 64 nt, Human
uauauucagcuguaucuguagaaacucuuugacgaaccucaauuuaaccaauuugaugaauacc

SEQ ID NO: 302937 - RNA, 64 nt, Human
ggcccgagcuucagcuuccaggaugcuucucuggaaccucaaggcaggcagcccaggcccuggg

SEQ ID NO: 302938 - RNA, 62 nt, Human
uuucugcucagucugucccccuucccccucgacccccgcaaugagugggcaccaggggacgc

SEQ ID NO: 302939 - RNA, 64 nt, Human
agaauucaguaaaacagguugaaugguuaaaaacaaccucaaggguccaugaacaauaucugcc

SEQ ID NO: 302940 - RNA, 64 nt, Human
acccauaggaauugagaauugggagugggaagaaaaccucaaagugguucauacuugccuguaa

SEQ ID NO: 302941 - RNA, 64 nt, Human
cacccaggagugucugagcugcauuaccucuagaaaccucaaacaaguagaaacuugccuagac

SEQ ID NO: 302942 - RNA, 64 nt, Human
gagauauauagugugugauguguaaaucaggucaaaccucaacgacaauugaaaguuguuauug

SEQ ID NO: 302943 - RNA, 64 nt, Human
auugacuguauuggugaauaaauugaauagacauaaccucaaaguacuucacuuauucuuuuua

SEQ ID NO: 302944 - RNA, 64 nt, Human
ucacuaccugggugacaggaucauacguaccccaaaccucaacaucacacaguauacucagcua

SEQ ID NO: 302945 - RNA, 64 nt, Human
gagauacauuccaaggcccccagugaacuccugaaaccucaaacaguaccaaaccuuuauacac

SEQ ID NO: 302946 - RNA, 64 nt, Human
uucaccauguuggccaggcuugucucaaacuccuaaccucaacugauccaccugccucagccuc

SEQ ID NO: 302947 - RNA, 64 nt, Human
uuuccuguauaauucacuuaaauaaaagcagguuaaccucaaugauagcaguuaaaauguucua

SEQ ID NO: 302948 - RNA, 64 nt, Human
uuuuuauaccauuucaagauauguaucuuauauaaaccucaaguuggauuuuauauuuuaauaa

SEQ ID NO: 302949 - RNA, 64 nt, Human
aggcccaguaaguguaccuuguacuuuauaaauaaaccucaagcagcucaagguuguccuucua

SEQ ID NO: 302950 - RNA, 64 nt, Human
uucugggcuccuggggcucagccuagugaacugcaaccucaaaggagcaagccuugaaacaguu

SEQ ID NO: 302951 - RNA, 64 nt, Human
cagggggaggacaggaaucuguauuuuucauagcaaccucaaguaaucuuuauucugagggucu

SEQ ID NO: 302952 - RNA, 62 nt, Human
guaauauucuccccacccaccccacgcccgcacccccgcacccuuaagaagguauuuuguaa

SEQ ID NO: 302953 - RNA, 62 nt, Human
gagccuggcugcccgccugcacgcccccacugcccccgcacgaaucaccuccugcuggcuac

SEQ ID NO: 302954 - RNA, 62 nt, Human
gaaugcacugcugaggagcaugcccacccccacccccgcagugugcagauuaaagcaaguca

SEQ ID NO: 302955 - RNA, 62 nt, Human
ucauccuaggcaacagagcgagacucugucuccccccgcaaaaaaaaaaaagaaagaaagaa

SEQ ID NO: 302956 - RNA, 64 nt, Human
auggcugaauagaugacaaugggaaaaggacuugaaccucaagcucucucuaaggagcuguuuu

SEQ ID NO: 302957 - RNA, 64 nt, Human
uuggccuuaaggguaaaaaguacaauauacacuaaaccucaaccguuaaagcagaugcaaaaau

SEQ ID NO: 302958 - RNA, 64 nt, Human
aggguuugacugggggcguggagagagagggaggaaccucaauaaccuugaagguggaauccag

SEQ ID NO: 302959 - RNA, 64 nt, Human
uuguuuguuuuguuaguuuuuuuuauuuaaagcaaaccucaaacauuauuggguaucaauuacc

SEQ ID NO: 302960 - RNA, 64 nt, Human
aguuuuuaauuuuagaaaucuuauacuugaaagaaaccucaauuaucaguggcuuuaugaagua

SEQ ID NO: 302961 - RNA, 64 nt, Human
acaaaccuuauuaggaggcuagagagucaaggagaaccucaaauaugaucagagaauuguggaa

SEQ ID NO: 302962 - RNA, 64 nt, Human
ccuuuucacacuguggagcggugcagaugugggaaaccucaaagaugguugcccauuuuaaauc

SEQ ID NO: 302963 - RNA, 64 nt, Human
ggaaacuacuaaauuauuuugggugguucagccaaaccucaaaacaguuaaucucccugguuua

SEQ ID NO: 302964 - RNA, 64 nt, Human
cgucaacguggugaagcggcuguucaagauccagaaccucaaugccagcaccguccgcacggug

SEQ ID NO: 302965 - RNA, 64 nt, Human
uacugaagccgacuccccuccccaucucccucucaaccucaacccaccugcaugcaucuccccc

SEQ ID NO: 302966 - RNA, 64 nt, Human
aaggcacagguguaaauauaguagcaggaugaggaaccucaaacuggguaucauuuugcacgug

SEQ ID NO: 302967 - RNA, 64 nt, Human
aaggcugaaaggaauauagucaguaauuuaucuuaaccucaaaacuguauauaaaucuucaaag

SEQ ID NO: 302968 - RNA, 64 nt, Human
gaaaccauuucccuuaucaaagauguaauuuguaaaccucaaauaguuguguaucuguccuguu

SEQ ID NO: 302969 - RNA, 64 nt, Human
uauaugugccacacuuugcacuacucauaaugauaaccucaagacuaucagaagaaauauuuaa

SEQ ID NO: 302970 - RNA, 64 nt, Human
ucauugguagccagggguugcuaccaaacuuuguaaccucaaggacaaaaugaggaagaugugu

SEQ ID NO: 302971 - RNA, 64 nt, Human
ggaacuagguaagaguggucucuucuuauugaacaaccucaauuuaguuucaucccaccuuucu

SEQ ID NO: 302972 - RNA, 64 nt, Human
gcuggaguacaguggcauaaucacagcucacugcaaccucaauccugggcucaagugauccucc

SEQ ID NO: 302973 - RNA, 64 nt, Human
augucucagcuggaauggaaagaaugugagauggaaccucaagucacuguuuuuaccagggaca

SEQ ID NO: 302974 - RNA, 64 nt, Human
uuuuauaaacuugccauagauaucucagauuugaaaccucaagacagauuuauuauucuuaaau
